United States Patent 11,421,016 (CANCER NEOEPITOPES) - sequence listing, part 21

SEQ ID NO: 926166 - protein, 9 aa, Homo Sapiens
SAELKIPAV

SEQ ID NO: 926167 - protein, 9 aa, Homo Sapiens
GKFSLVLRF

SEQ ID NO: 926168 - protein, 9 aa, Homo Sapiens
VAVTQPEST

SEQ ID NO: 926169 - protein, 9 aa, Homo Sapiens
KELTDLDYC

SEQ ID NO: 926170 - protein, 9 aa, Homo Sapiens
RIHSEFDVF

SEQ ID NO: 926171 - protein, 9 aa, Homo Sapiens
KNYNLTKVI

SEQ ID NO: 926172 - protein, 9 aa, Homo Sapiens
LAPTTMCTS

SEQ ID NO: 926173 - protein, 9 aa, Homo Sapiens
CFTCTYKIQ

SEQ ID NO: 926174 - protein, 9 aa, Homo Sapiens
KLEQVKLMP

SEQ ID NO: 926175 - protein, 9 aa, Homo Sapiens
TLINLVAIL

SEQ ID NO: 926176 - protein, 9 aa, Homo Sapiens
VAKRSSAHA

SEQ ID NO: 926177 - protein, 9 aa, Homo Sapiens
GKSFCSWFF

SEQ ID NO: 926178 - protein, 9 aa, Homo Sapiens
EKASVIIQN

SEQ ID NO: 926179 - protein, 9 aa, Homo Sapiens
RSPLTLINL

SEQ ID NO: 926180 - protein, 9 aa, Homo Sapiens
QEERNVKKD

SEQ ID NO: 926181 - protein, 9 aa, Homo Sapiens
LVSFKEDLA

SEQ ID NO: 926182 - protein, 9 aa, Homo Sapiens
ARGPKGPPG

SEQ ID NO: 926183 - protein, 9 aa, Homo Sapiens
QGDLGSWNL

SEQ ID NO: 926184 - protein, 9 aa, Homo Sapiens
VLNVTPKSR

SEQ ID NO: 926185 - protein, 9 aa, Homo Sapiens
KDNKNNFSP

SEQ ID NO: 926186 - protein, 9 aa, Homo Sapiens
FIPCPTESV

SEQ ID NO: 926187 - protein, 9 aa, Homo Sapiens
ELLVSPEAR

SEQ ID NO: 926188 - protein, 9 aa, Homo Sapiens
SSSIVFTTS

SEQ ID NO: 926189 - protein, 9 aa, Homo Sapiens
GSWNLLICL

SEQ ID NO: 926190 - protein, 9 aa, Homo Sapiens
READSCHDE

SEQ ID NO: 926191 - protein, 9 aa, Homo Sapiens
IILPENFLI

SEQ ID NO: 926192 - protein, 9 aa, Homo Sapiens
FNLVQKEYE

SEQ ID NO: 926193 - protein, 9 aa, Homo Sapiens
DEYLNKLKH

SEQ ID NO: 926194 - protein, 9 aa, Homo Sapiens
KENTLLHFF

SEQ ID NO: 926195 - protein, 9 aa, Homo Sapiens
FGSVARMCA

SEQ ID NO: 926196 - protein, 9 aa, Homo Sapiens
HGGGKHGPA

SEQ ID NO: 926197 - protein, 9 aa, Homo Sapiens
ATLDADKFQ

SEQ ID NO: 926198 - protein, 9 aa, Homo Sapiens
IPQSPLDNK

SEQ ID NO: 926199 - protein, 9 aa, Homo Sapiens
DFRGIGGLG

SEQ ID NO: 926200 - protein, 9 aa, Homo Sapiens
EPSDTIENG

SEQ ID NO: 926201 - protein, 9 aa, Homo Sapiens
WSHLSHFSS

SEQ ID NO: 926202 - protein, 9 aa, Homo Sapiens
PKMLSSVSE

SEQ ID NO: 926203 - protein, 9 aa, Homo Sapiens
RDGYTVADL

SEQ ID NO: 926204 - protein, 9 aa, Homo Sapiens
EICINLDAA

SEQ ID NO: 926205 - protein, 9 aa, Homo Sapiens
FGEQEENLA

SEQ ID NO: 926206 - protein, 9 aa, Homo Sapiens
AVCCESASI

SEQ ID NO: 926207 - protein, 9 aa, Homo Sapiens
PDPGVLVLR

SEQ ID NO: 926208 - protein, 9 aa, Homo Sapiens
IKMEKSPLR

SEQ ID NO: 926209 - protein, 9 aa, Homo Sapiens
HSAEERQKA

SEQ ID NO: 926210 - protein, 9 aa, Homo Sapiens
DSLSISTRP

SEQ ID NO: 926211 - protein, 9 aa, Homo Sapiens
YNNKKKLSC

SEQ ID NO: 926212 - protein, 9 aa, Homo Sapiens
KVRSLRPAL

SEQ ID NO: 926213 - protein, 9 aa, Homo Sapiens
TRAEVLHMC

SEQ ID NO: 926214 - protein, 9 aa, Homo Sapiens
PKTTQSMRS

SEQ ID NO: 926215 - protein, 9 aa, Homo Sapiens
LSLEDQPLV

SEQ ID NO: 926216 - protein, 9 aa, Homo Sapiens
QQVLELSEA

SEQ ID NO: 926217 - protein, 9 aa, Homo Sapiens
AAKVAVSAP

SEQ ID NO: 926218 - protein, 9 aa, Homo Sapiens
EGAALLRIS

SEQ ID NO: 926219 - protein, 9 aa, Homo Sapiens
AENSNGSSG

SEQ ID NO: 926220 - protein, 9 aa, Homo Sapiens
NVVQPMKKL

SEQ ID NO: 926221 - protein, 9 aa, Homo Sapiens
PHLSCVRSL

SEQ ID NO: 926222 - protein, 9 aa, Homo Sapiens
RTQRARAQT

SEQ ID NO: 926223 - protein, 9 aa, Homo Sapiens
VGKFSLVLR

SEQ ID NO: 926224 - protein, 9 aa, Homo Sapiens
LGPHLSCVR

SEQ ID NO: 926225 - protein, 9 aa, Homo Sapiens
ERQKAFSTC

SEQ ID NO: 926226 - protein, 9 aa, Homo Sapiens
FKDEMNKEI

SEQ ID NO: 926227 - protein, 9 aa, Homo Sapiens
IEALHKDEE

SEQ ID NO: 926228 - protein, 9 aa, Homo Sapiens
IPTPPFFSF

SEQ ID NO: 926229 - protein, 9 aa, Homo Sapiens
TETLAVSSG

SEQ ID NO: 926230 - protein, 9 aa, Homo Sapiens
KDYIFSSYT

SEQ ID NO: 926231 - protein, 9 aa, Homo Sapiens
KEVDKFGNY

SEQ ID NO: 926232 - protein, 9 aa, Homo Sapiens
YDMAAQTSS

SEQ ID NO: 926233 - protein, 9 aa, Homo Sapiens
PSFQTYESM

SEQ ID NO: 926234 - protein, 9 aa, Homo Sapiens
SMSPIFSAK

SEQ ID NO: 926235 - protein, 9 aa, Homo Sapiens
RRPGIEIAE

SEQ ID NO: 926236 - protein, 9 aa, Homo Sapiens
QRYQEPNLS

SEQ ID NO: 926237 - protein, 9 aa, Homo Sapiens
APLIGVYHR

SEQ ID NO: 926238 - protein, 9 aa, Homo Sapiens
NYNLTKVID

SEQ ID NO: 926239 - protein, 9 aa, Homo Sapiens
QDLNVDYGL

SEQ ID NO: 926240 - protein, 9 aa, Homo Sapiens
IFKDEMNKE

SEQ ID NO: 926241 - protein, 9 aa, Homo Sapiens
SEAGTAYIQ

SEQ ID NO: 926242 - protein, 9 aa, Homo Sapiens
RFNFNDGTS

SEQ ID NO: 926243 - protein, 9 aa, Homo Sapiens
LKISYSKSH

SEQ ID NO: 926244 - protein, 9 aa, Homo Sapiens
ISCSSPCTC

SEQ ID NO: 926245 - protein, 9 aa, Homo Sapiens
SCITWKGTN

SEQ ID NO: 926246 - protein, 9 aa, Homo Sapiens
SPPPPPGKP

SEQ ID NO: 926247 - protein, 9 aa, Homo Sapiens
GLEKNGTAH

SEQ ID NO: 926248 - protein, 9 aa, Homo Sapiens
ENSQPGEQN

SEQ ID NO: 926249 - protein, 9 aa, Homo Sapiens
GAARNFHSA

SEQ ID NO: 926250 - protein, 9 aa, Homo Sapiens
EALCGQCGS

SEQ ID NO: 926251 - protein, 9 aa, Homo Sapiens
FLSKSDQSF

SEQ ID NO: 926252 - protein, 9 aa, Homo Sapiens
PSGEETLSV

SEQ ID NO: 926253 - protein, 9 aa, Homo Sapiens
RNIEQILDK

SEQ ID NO: 926254 - protein, 9 aa, Homo Sapiens
GSVLPPTEG

SEQ ID NO: 926255 - protein, 9 aa, Homo Sapiens
LNRLLLEFV

SEQ ID NO: 926256 - protein, 9 aa, Homo Sapiens
FNNRHMMIR

SEQ ID NO: 926257 - protein, 9 aa, Homo Sapiens
RFLGSSDSL

SEQ ID NO: 926258 - protein, 9 aa, Homo Sapiens
EVTLQAFDS

SEQ ID NO: 926259 - protein, 9 aa, Homo Sapiens
LDADKFQDF

SEQ ID NO: 926260 - protein, 9 aa, Homo Sapiens
SQEALVSVS

SEQ ID NO: 926261 - protein, 9 aa, Homo Sapiens
LRAARTQRA

SEQ ID NO: 926262 - protein, 9 aa, Homo Sapiens
LKNPQEVTL

SEQ ID NO: 926263 - protein, 9 aa, Homo Sapiens
QRLIASPRR

SEQ ID NO: 926264 - protein, 9 aa, Homo Sapiens
LFLKTLLQA

SEQ ID NO: 926265 - protein, 9 aa, Homo Sapiens
VGAFNSLAS

SEQ ID NO: 926266 - protein, 9 aa, Homo Sapiens
TKLVVLLDC

SEQ ID NO: 926267 - protein, 9 aa, Homo Sapiens
IQCVDGKWT

SEQ ID NO: 926268 - protein, 9 aa, Homo Sapiens
EEDIVEVQE

SEQ ID NO: 926269 - protein, 9 aa, Homo Sapiens
AGDDAPQAV

SEQ ID NO: 926270 - protein, 9 aa, Homo Sapiens
VHYCSLSLK

SEQ ID NO: 926271 - protein, 9 aa, Homo Sapiens
PKSDPGLPG

SEQ ID NO: 926272 - protein, 9 aa, Homo Sapiens
VFLSGKDVV

SEQ ID NO: 926273 - protein, 9 aa, Homo Sapiens
PPSFSTALY

SEQ ID NO: 926274 - protein, 9 aa, Homo Sapiens
KAKAILHAS

SEQ ID NO: 926275 - protein, 9 aa, Homo Sapiens
LTYNHEGIT

SEQ ID NO: 926276 - protein, 9 aa, Homo Sapiens
SEMAKEFIP

SEQ ID NO: 926277 - protein, 9 aa, Homo Sapiens
DGIVDNEDS

SEQ ID NO: 926278 - protein, 9 aa, Homo Sapiens
RPGIEIAEI

SEQ ID NO: 926279 - protein, 9 aa, Homo Sapiens
DSLEKIEAN

SEQ ID NO: 926280 - protein, 9 aa, Homo Sapiens
TAGSGRNIL

SEQ ID NO: 926281 - protein, 9 aa, Homo Sapiens
FNTVLLFSR

SEQ ID NO: 926282 - protein, 9 aa, Homo Sapiens
SWSRAASLL

SEQ ID NO: 926283 - protein, 9 aa, Homo Sapiens
LILVCQLYQ

SEQ ID NO: 926284 - protein, 9 aa, Homo Sapiens
LSFDAGVFE

SEQ ID NO: 926285 - protein, 9 aa, Homo Sapiens
THREGDVYF

SEQ ID NO: 926286 - protein, 9 aa, Homo Sapiens
NLLDVRNET

SEQ ID NO: 926287 - protein, 9 aa, Homo Sapiens
IRTDISEYY

SEQ ID NO: 926288 - protein, 9 aa, Homo Sapiens
QRETAGGTA

SEQ ID NO: 926289 - protein, 9 aa, Homo Sapiens
GHKRLIRGS

SEQ ID NO: 926290 - protein, 9 aa, Homo Sapiens
GINQPPFGI

SEQ ID NO: 926291 - protein, 9 aa, Homo Sapiens
NDMASTPKK

SEQ ID NO: 926292 - protein, 9 aa, Homo Sapiens
APGFERTMS

SEQ ID NO: 926293 - protein, 9 aa, Homo Sapiens
NTIPVTFES

SEQ ID NO: 926294 - protein, 9 aa, Homo Sapiens
ISFKTRAEV

SEQ ID NO: 926295 - protein, 9 aa, Homo Sapiens
SCSALHCPA

SEQ ID NO: 926296 - protein, 9 aa, Homo Sapiens
SSIVFTTSK

SEQ ID NO: 926297 - protein, 9 aa, Homo Sapiens
VYNPHEACF

SEQ ID NO: 926298 - protein, 9 aa, Homo Sapiens
HRGSSGTQA

SEQ ID NO: 926299 - protein, 9 aa, Homo Sapiens
EAAKVAVSA

SEQ ID NO: 926300 - protein, 9 aa, Homo Sapiens
HPMANIIWM

SEQ ID NO: 926301 - protein, 9 aa, Homo Sapiens
KSSADFLGL

SEQ ID NO: 926302 - protein, 9 aa, Homo Sapiens
KPEEEEEEL

SEQ ID NO: 926303 - protein, 9 aa, Homo Sapiens
GATSEEEVK

SEQ ID NO: 926304 - protein, 9 aa, Homo Sapiens
LEDQPLVLL

SEQ ID NO: 926305 - protein, 9 aa, Homo Sapiens
SQAQPADQK

SEQ ID NO: 926306 - protein, 9 aa, Homo Sapiens
KGPPGKGQP

SEQ ID NO: 926307 - protein, 9 aa, Homo Sapiens
VLLDCAHDS

SEQ ID NO: 926308 - protein, 9 aa, Homo Sapiens
HTEAHVGAM

SEQ ID NO: 926309 - protein, 9 aa, Homo Sapiens
PLTDRCYII

SEQ ID NO: 926310 - protein, 9 aa, Homo Sapiens
APLLGASLG

SEQ ID NO: 926311 - protein, 9 aa, Homo Sapiens
ESEFIGIGG

SEQ ID NO: 926312 - protein, 9 aa, Homo Sapiens
YCPSRWAVR

SEQ ID NO: 926313 - protein, 9 aa, Homo Sapiens
PVQPVVPRP

SEQ ID NO: 926314 - protein, 9 aa, Homo Sapiens
LQPQPQLPP

SEQ ID NO: 926315 - protein, 9 aa, Homo Sapiens
NLAIESQLK

SEQ ID NO: 926316 - protein, 9 aa, Homo Sapiens
ETSTGLKPC

SEQ ID NO: 926317 - protein, 9 aa, Homo Sapiens
LAIESQLKT

SEQ ID NO: 926318 - protein, 9 aa, Homo Sapiens
EMFQRLRTP

SEQ ID NO: 926319 - protein, 9 aa, Homo Sapiens
GNAVNSVWE

SEQ ID NO: 926320 - protein, 9 aa, Homo Sapiens
SRSVKKKLV

SEQ ID NO: 926321 - protein, 9 aa, Homo Sapiens
ELRNLKFVQ

SEQ ID NO: 926322 - protein, 9 aa, Homo Sapiens
DKALGLMCG

SEQ ID NO: 926323 - protein, 9 aa, Homo Sapiens
TYVFMGHQL

SEQ ID NO: 926324 - protein, 9 aa, Homo Sapiens
AICLLASLL

SEQ ID NO: 926325 - protein, 9 aa, Homo Sapiens
SSTFISIQS

SEQ ID NO: 926326 - protein, 9 aa, Homo Sapiens
KGIPSFQTY

SEQ ID NO: 926327 - protein, 9 aa, Homo Sapiens
YRQIEPPFR

SEQ ID NO: 926328 - protein, 9 aa, Homo Sapiens
TTDYLVGMR

SEQ ID NO: 926329 - protein, 9 aa, Homo Sapiens
EERQKAFST

SEQ ID NO: 926330 - protein, 9 aa, Homo Sapiens
GQVYNPTTT

SEQ ID NO: 926331 - protein, 9 aa, Homo Sapiens
NIPPEIGEQ

SEQ ID NO: 926332 - protein, 9 aa, Homo Sapiens
PIYDSVSPA

SEQ ID NO: 926333 - protein, 9 aa, Homo Sapiens
NTFRDVSLK

SEQ ID NO: 926334 - protein, 9 aa, Homo Sapiens
RMSFNLSWP

SEQ ID NO: 926335 - protein, 9 aa, Homo Sapiens
SLGPHLSCV

SEQ ID NO: 926336 - protein, 9 aa, Homo Sapiens
GCDSSDPDT

SEQ ID NO: 926337 - protein, 9 aa, Homo Sapiens
DSVSIIQKY

SEQ ID NO: 926338 - protein, 9 aa, Homo Sapiens
PLIMLLSSC

SEQ ID NO: 926339 - protein, 9 aa, Homo Sapiens
LGESAVGKF

SEQ ID NO: 926340 - protein, 9 aa, Homo Sapiens
FLAGSLAIT

SEQ ID NO: 926341 - protein, 9 aa, Homo Sapiens
HKPMYLFLA

SEQ ID NO: 926342 - protein, 9 aa, Homo Sapiens
YGAEKERLA

SEQ ID NO: 926343 - protein, 9 aa, Homo Sapiens
EKQLKTSCK

SEQ ID NO: 926344 - protein, 9 aa, Homo Sapiens
AHNLLYKEN

SEQ ID NO: 926345 - protein, 9 aa, Homo Sapiens
PQLQPQPQL

SEQ ID NO: 926346 - protein, 9 aa, Homo Sapiens
EPNGSVLPP

SEQ ID NO: 926347 - protein, 9 aa, Homo Sapiens
GQCPERYTC

SEQ ID NO: 926348 - protein, 9 aa, Homo Sapiens
LPLNGELVL

SEQ ID NO: 926349 - protein, 9 aa, Homo Sapiens
EERNVKKDG

SEQ ID NO: 926350 - protein, 9 aa, Homo Sapiens
VTSSKFFLS

SEQ ID NO: 926351 - protein, 9 aa, Homo Sapiens
GKLSLLKSK

SEQ ID NO: 926352 - protein, 9 aa, Homo Sapiens
KSEHMTEEE

SEQ ID NO: 926353 - protein, 9 aa, Homo Sapiens
EQGDLGSWN

SEQ ID NO: 926354 - protein, 9 aa, Homo Sapiens
GQRNIPPEI

SEQ ID NO: 926355 - protein, 9 aa, Homo Sapiens
EYSTTDAAG

SEQ ID NO: 926356 - protein, 9 aa, Homo Sapiens
SYSQASPNG

SEQ ID NO: 926357 - protein, 9 aa, Homo Sapiens
ALISCFTLS

SEQ ID NO: 926358 - protein, 9 aa, Homo Sapiens
LTFSFICKT

SEQ ID NO: 926359 - protein, 9 aa, Homo Sapiens
PKRDVGPAG

SEQ ID NO: 926360 - protein, 9 aa, Homo Sapiens
LNKMCHKPD

SEQ ID NO: 926361 - protein, 9 aa, Homo Sapiens
FDVFSQINQ

SEQ ID NO: 926362 - protein, 9 aa, Homo Sapiens
NKGMFLGFK

SEQ ID NO: 926363 - protein, 9 aa, Homo Sapiens
SPILSVSSG

SEQ ID NO: 926364 - protein, 9 aa, Homo Sapiens
NTVLLFSRL

SEQ ID NO: 926365 - protein, 9 aa, Homo Sapiens
RKKKQKEER

SEQ ID NO: 926366 - protein, 9 aa, Homo Sapiens
PLKEGELEL

SEQ ID NO: 926367 - protein, 9 aa, Homo Sapiens
VAPLLGASL

SEQ ID NO: 926368 - protein, 9 aa, Homo Sapiens
TEYKIRVLL

SEQ ID NO: 926369 - protein, 9 aa, Homo Sapiens
PGLPEKHGA

SEQ ID NO: 926370 - protein, 9 aa, Homo Sapiens
RNVKKDGAH

SEQ ID NO: 926371 - protein, 9 aa, Homo Sapiens
EVWFAAGSE

SEQ ID NO: 926372 - protein, 9 aa, Homo Sapiens
RETAGGTAK

SEQ ID NO: 926373 - protein, 9 aa, Homo Sapiens
PVGLIAVRA

SEQ ID NO: 926374 - protein, 9 aa, Homo Sapiens
MVWVLSRNS

SEQ ID NO: 926375 - protein, 9 aa, Homo Sapiens
LDPDTEYKI

SEQ ID NO: 926376 - protein, 9 aa, Homo Sapiens
SGLAQNRST

SEQ ID NO: 926377 - protein, 9 aa, Homo Sapiens
YYQGKCYCH

SEQ ID NO: 926378 - protein, 9 aa, Homo Sapiens
SVWEEEPIV

SEQ ID NO: 926379 - protein, 9 aa, Homo Sapiens
NFGSVARMC

SEQ ID NO: 926380 - protein, 9 aa, Homo Sapiens
SGEGATSRK

SEQ ID NO: 926381 - protein, 9 aa, Homo Sapiens
LEMYGERLA

SEQ ID NO: 926382 - protein, 9 aa, Homo Sapiens
LQKFYMNSV

SEQ ID NO: 926383 - protein, 9 aa, Homo Sapiens
HRFNEDCVF

SEQ ID NO: 926384 - protein, 9 aa, Homo Sapiens
VGTPGERGL

SEQ ID NO: 926385 - protein, 9 aa, Homo Sapiens
VCAFSNSCI

SEQ ID NO: 926386 - protein, 9 aa, Homo Sapiens
RGSGENGDD

SEQ ID NO: 926387 - protein, 9 aa, Homo Sapiens
VELLVSPEA

SEQ ID NO: 926388 - protein, 9 aa, Homo Sapiens
NEHDLSDRE

SEQ ID NO: 926389 - protein, 9 aa, Homo Sapiens
DGLPYPFLD

SEQ ID NO: 926390 - protein, 9 aa, Homo Sapiens
TPRKGTRTK

SEQ ID NO: 926391 - protein, 9 aa, Homo Sapiens
EVAKRSSAH

SEQ ID NO: 926392 - protein, 9 aa, Homo Sapiens
RSLGPHLSC

SEQ ID NO: 926393 - protein, 9 aa, Homo Sapiens
SSGTQASDS

SEQ ID NO: 926394 - protein, 9 aa, Homo Sapiens
GEKLYPCPQ

SEQ ID NO: 926395 - protein, 9 aa, Homo Sapiens
LNPPGKMKQ

SEQ ID NO: 926396 - protein, 9 aa, Homo Sapiens
SQGNAVNSV

SEQ ID NO: 926397 - protein, 9 aa, Homo Sapiens
PSFSTALYC

SEQ ID NO: 926398 - protein, 9 aa, Homo Sapiens
PADQKLGSN

SEQ ID NO: 926399 - protein, 9 aa, Homo Sapiens
KVEMKQKEQ

SEQ ID NO: 926400 - protein, 9 aa, Homo Sapiens
SRAASLLLP

SEQ ID NO: 926401 - protein, 9 aa, Homo Sapiens
ERTMSPYPA

SEQ ID NO: 926402 - protein, 9 aa, Homo Sapiens
KKDFSVTDT

SEQ ID NO: 926403 - protein, 9 aa, Homo Sapiens
HGEGDQALN

SEQ ID NO: 926404 - protein, 9 aa, Homo Sapiens
WRNGPKGSG

SEQ ID NO: 926405 - protein, 9 aa, Homo Sapiens
NQYCPSRWA

SEQ ID NO: 926406 - protein, 9 aa, Homo Sapiens
EFDSIYLGN

SEQ ID NO: 926407 - protein, 9 aa, Homo Sapiens
LDWAATLAS

SEQ ID NO: 926408 - protein, 9 aa, Homo Sapiens
KSPGQRARP

SEQ ID NO: 926409 - protein, 9 aa, Homo Sapiens
GPDPGVLVL

SEQ ID NO: 926410 - protein, 9 aa, Homo Sapiens
ETVSPLSSS

SEQ ID NO: 926411 - protein, 9 aa, Homo Sapiens
EKIEANAFD

SEQ ID NO: 926412 - protein, 9 aa, Homo Sapiens
SSPCTCSNN

SEQ ID NO: 926413 - protein, 9 aa, Homo Sapiens
GQLQPLLDG

SEQ ID NO: 926414 - protein, 9 aa, Homo Sapiens
SFFVFNLFT

SEQ ID NO: 926415 - protein, 9 aa, Homo Sapiens
ASGLNKSLG

SEQ ID NO: 926416 - protein, 9 aa, Homo Sapiens
DVDVQFNNR

SEQ ID NO: 926417 - protein, 9 aa, Homo Sapiens
YVAMAAGFW

SEQ ID NO: 926418 - protein, 9 aa, Homo Sapiens
SSNLQCFTC

SEQ ID NO: 926419 - protein, 9 aa, Homo Sapiens
APTTMCTSL

SEQ ID NO: 926420 - protein, 9 aa, Homo Sapiens
ADKFQDFFN

SEQ ID NO: 926421 - protein, 9 aa, Homo Sapiens
DYSLSGVST

SEQ ID NO: 926422 - protein, 9 aa, Homo Sapiens
NSVSKCDPN

SEQ ID NO: 926423 - protein, 9 aa, Homo Sapiens
QTKVFLSGK

SEQ ID NO: 926424 - protein, 9 aa, Homo Sapiens
TGERPFSCT

SEQ ID NO: 926425 - protein, 9 aa, Homo Sapiens
KVSPSASAS

SEQ ID NO: 926426 - protein, 9 aa, Homo Sapiens
EDSLIIPET

SEQ ID NO: 926427 - protein, 9 aa, Homo Sapiens
NEYFPFRPH

SEQ ID NO: 926428 - protein, 9 aa, Homo Sapiens
CRIQKLIKE

SEQ ID NO: 926429 - protein, 9 aa, Homo Sapiens
AQPPPSEPV

SEQ ID NO: 926430 - protein, 9 aa, Homo Sapiens
STDFSSCSR

SEQ ID NO: 926431 - protein, 9 aa, Homo Sapiens
KSSCVVNVT

SEQ ID NO: 926432 - protein, 9 aa, Homo Sapiens
EPPKMLSSV

SEQ ID NO: 926433 - protein, 9 aa, Homo Sapiens
GTPGERGLP

SEQ ID NO: 926434 - protein, 9 aa, Homo Sapiens
DCKNKFCCD

SEQ ID NO: 926435 - protein, 9 aa, Homo Sapiens
LFKTKLDKE

SEQ ID NO: 926436 - protein, 9 aa, Homo Sapiens
DRCYIILTQ

SEQ ID NO: 926437 - protein, 9 aa, Homo Sapiens
ERKKKQKEE

SEQ ID NO: 926438 - protein, 9 aa, Homo Sapiens
PENFLIIFT

SEQ ID NO: 926439 - protein, 9 aa, Homo Sapiens
LEYEPARGS

SEQ ID NO: 926440 - protein, 9 aa, Homo Sapiens
AVRLGLLKL

SEQ ID NO: 926441 - protein, 9 aa, Homo Sapiens
KGFYCLWDS

SEQ ID NO: 926442 - protein, 9 aa, Homo Sapiens
GASLGGIIY

SEQ ID NO: 926443 - protein, 9 aa, Homo Sapiens
LWDSGRDRC

SEQ ID NO: 926444 - protein, 9 aa, Homo Sapiens
NLLICLSSK

SEQ ID NO: 926445 - protein, 9 aa, Homo Sapiens
ISVLCIWMS

SEQ ID NO: 926446 - protein, 9 aa, Homo Sapiens
VSLNRLLLE

SEQ ID NO: 926447 - protein, 9 aa, Homo Sapiens
QVKLKAFRE

SEQ ID NO: 926448 - protein, 9 aa, Homo Sapiens
NNPIKEISS

SEQ ID NO: 926449 - protein, 9 aa, Homo Sapiens
MAPSCSALH

SEQ ID NO: 926450 - protein, 9 aa, Homo Sapiens
PKDNSPVIL

SEQ ID NO: 926451 - protein, 9 aa, Homo Sapiens
KKYNNKKKL

SEQ ID NO: 926452 - protein, 9 aa, Homo Sapiens
NGKTKKENR

SEQ ID NO: 926453 - protein, 9 aa, Homo Sapiens
VIFITYVFM

SEQ ID NO: 926454 - protein, 9 aa, Homo Sapiens
EERKKAYLT

SEQ ID NO: 926455 - protein, 9 aa, Homo Sapiens
YSLSGVSTN

SEQ ID NO: 926456 - protein, 9 aa, Homo Sapiens
PPSEPVPFM

SEQ ID NO: 926457 - protein, 9 aa, Homo Sapiens
ATGFWNPHT

SEQ ID NO: 926458 - protein, 9 aa, Homo Sapiens
IYLVMKLSC

SEQ ID NO: 926459 - protein, 9 aa, Homo Sapiens
VQPMKKLYG

SEQ ID NO: 926460 - protein, 9 aa, Homo Sapiens
LQLAQLHTL

SEQ ID NO: 926461 - protein, 9 aa, Homo Sapiens
YRRPYPDAF

SEQ ID NO: 926462 - protein, 9 aa, Homo Sapiens
SSGWSSGLA

SEQ ID NO: 926463 - protein, 9 aa, Homo Sapiens
TICEEIQNA

SEQ ID NO: 926464 - protein, 9 aa, Homo Sapiens
PILKPLIML

SEQ ID NO: 926465 - protein, 9 aa, Homo Sapiens
SPAHEQLTS

SEQ ID NO: 926466 - protein, 9 aa, Homo Sapiens
FHSAASRDP

SEQ ID NO: 926467 - protein, 9 aa, Homo Sapiens
VNFFANEVA

SEQ ID NO: 926468 - protein, 9 aa, Homo Sapiens
QELKNPQEV

SEQ ID NO: 926469 - protein, 9 aa, Homo Sapiens
DNEHDLSDR

SEQ ID NO: 926470 - protein, 9 aa, Homo Sapiens
NDIVSMMSE

SEQ ID NO: 926471 - protein, 9 aa, Homo Sapiens
VDEPMEERE

SEQ ID NO: 926472 - protein, 9 aa, Homo Sapiens
LFFNDRLLV

SEQ ID NO: 926473 - protein, 9 aa, Homo Sapiens
DLVLLKTRE

SEQ ID NO: 926474 - protein, 9 aa, Homo Sapiens
RAGKLSLLK

SEQ ID NO: 926475 - protein, 9 aa, Homo Sapiens
VSDMLLPLN

SEQ ID NO: 926476 - protein, 9 aa, Homo Sapiens
SNLVKHGQF

SEQ ID NO: 926477 - protein, 9 aa, Homo Sapiens
GASNENSEG

SEQ ID NO: 926478 - protein, 9 aa, Homo Sapiens
HFFAGGCGG

SEQ ID NO: 926479 - protein, 9 aa, Homo Sapiens
IVHTRGKSY

SEQ ID NO: 926480 - protein, 9 aa, Homo Sapiens
AESRQEVLM

SEQ ID NO: 926481 - protein, 9 aa, Homo Sapiens
DSVTPNDFD

SEQ ID NO: 926482 - protein, 9 aa, Homo Sapiens
RWAVRLGAE

SEQ ID NO: 926483 - protein, 9 aa, Homo Sapiens
LSGKDVVSL

SEQ ID NO: 926484 - protein, 9 aa, Homo Sapiens
SIKESATST

SEQ ID NO: 926485 - protein, 9 aa, Homo Sapiens
RQEVLMCTG

SEQ ID NO: 926486 - protein, 9 aa, Homo Sapiens
FRDVSLKIA

SEQ ID NO: 926487 - protein, 9 aa, Homo Sapiens
AEKQLLKSS

SEQ ID NO: 926488 - protein, 9 aa, Homo Sapiens
AGLEPNGSV

SEQ ID NO: 926489 - protein, 9 aa, Homo Sapiens
LSCVRSLEL

SEQ ID NO: 926490 - protein, 9 aa, Homo Sapiens
NGKREKMGI

SEQ ID NO: 926491 - protein, 9 aa, Homo Sapiens
LTDRCYIIL

SEQ ID NO: 926492 - protein, 9 aa, Homo Sapiens
GGALRAQKA

SEQ ID NO: 926493 - protein, 9 aa, Homo Sapiens
SHRAQTPRT

SEQ ID NO: 926494 - protein, 9 aa, Homo Sapiens
LFSHHVSKE

SEQ ID NO: 926495 - protein, 9 aa, Homo Sapiens
LPLPDNEHD

SEQ ID NO: 926496 - protein, 9 aa, Homo Sapiens
SSVLTGRTM

SEQ ID NO: 926497 - protein, 9 aa, Homo Sapiens
SGMKLYKCN

SEQ ID NO: 926498 - protein, 9 aa, Homo Sapiens
NLETSTGLK

SEQ ID NO: 926499 - protein, 9 aa, Homo Sapiens
FGFKFLQSF

SEQ ID NO: 926500 - protein, 9 aa, Homo Sapiens
LNYLKPRTE

SEQ ID NO: 926501 - protein, 9 aa, Homo Sapiens
NSIANFFCL

SEQ ID NO: 926502 - protein, 9 aa, Homo Sapiens
PSRGRDGFP

SEQ ID NO: 926503 - protein, 9 aa, Homo Sapiens
SQCRRKKIE

SEQ ID NO: 926504 - protein, 9 aa, Homo Sapiens
ANLMVWVPE

SEQ ID NO: 926505 - protein, 9 aa, Homo Sapiens
TTALGSSVL

SEQ ID NO: 926506 - protein, 9 aa, Homo Sapiens
SSGLAQNRS

SEQ ID NO: 926507 - protein, 9 aa, Homo Sapiens
NTNLETSTG

SEQ ID NO: 926508 - protein, 9 aa, Homo Sapiens
NSISCSSPC

SEQ ID NO: 926509 - protein, 9 aa, Homo Sapiens
YLNDNHLTK

SEQ ID NO: 926510 - protein, 9 aa, Homo Sapiens
LAKNLVSDI

SEQ ID NO: 926511 - protein, 9 aa, Homo Sapiens
RGGSSGWSS

SEQ ID NO: 926512 - protein, 9 aa, Homo Sapiens
YSLGQVYNP

SEQ ID NO: 926513 - protein, 9 aa, Homo Sapiens
IDWFHAWSQ

SEQ ID NO: 926514 - protein, 9 aa, Homo Sapiens
EKHNQLSEF

SEQ ID NO: 926515 - protein, 9 aa, Homo Sapiens
GRNILRLKH

SEQ ID NO: 926516 - protein, 9 aa, Homo Sapiens
VVQPMKKLY

SEQ ID NO: 926517 - protein, 9 aa, Homo Sapiens
IIWMANHTG

SEQ ID NO: 926518 - protein, 9 aa, Homo Sapiens
SVAKNPKLM

SEQ ID NO: 926519 - protein, 9 aa, Homo Sapiens
DIVSMMSED

SEQ ID NO: 926520 - protein, 9 aa, Homo Sapiens
IPLGVTHMT

SEQ ID NO: 926521 - protein, 9 aa, Homo Sapiens
YLESLRQKD

SEQ ID NO: 926522 - protein, 9 aa, Homo Sapiens
KSFCSWFFS

SEQ ID NO: 926523 - protein, 9 aa, Homo Sapiens
NVKKDGAHS

SEQ ID NO: 926524 - protein, 9 aa, Homo Sapiens
DHDPQKIHL

SEQ ID NO: 926525 - protein, 9 aa, Homo Sapiens
LFSRLFGPT

SEQ ID NO: 926526 - protein, 9 aa, Homo Sapiens
RQRETAGGT

SEQ ID NO: 926527 - protein, 9 aa, Homo Sapiens
FYFIILPEN

SEQ ID NO: 926528 - protein, 9 aa, Homo Sapiens
QTPRTGGAA

SEQ ID NO: 926529 - protein, 9 aa, Homo Sapiens
KEKASVIIQ

SEQ ID NO: 926530 - protein, 9 aa, Homo Sapiens
LKTQQNTSI

SEQ ID NO: 926531 - protein, 9 aa, Homo Sapiens
RECQKTEQE

SEQ ID NO: 926532 - protein, 9 aa, Homo Sapiens
EAEQFCQAL

SEQ ID NO: 926533 - protein, 9 aa, Homo Sapiens
LFGRGRQRE

SEQ ID NO: 926534 - protein, 9 aa, Homo Sapiens
PYQLDLANI

SEQ ID NO: 926535 - protein, 9 aa, Homo Sapiens
CQKTEQEKS

SEQ ID NO: 926536 - protein, 9 aa, Homo Sapiens
QKGESVKVQ

SEQ ID NO: 926537 - protein, 9 aa, Homo Sapiens
AVPLPLWGV

SEQ ID NO: 926538 - protein, 9 aa, Homo Sapiens
IDDEALWKV

SEQ ID NO: 926539 - protein, 9 aa, Homo Sapiens
ELWRELDRA

SEQ ID NO: 926540 - protein, 9 aa, Homo Sapiens
FSTALYCEN

SEQ ID NO: 926541 - protein, 9 aa, Homo Sapiens
TSSKFFLSI

SEQ ID NO: 926542 - protein, 9 aa, Homo Sapiens
QEENLATQS

SEQ ID NO: 926543 - protein, 9 aa, Homo Sapiens
ISDPSGEET

SEQ ID NO: 926544 - protein, 9 aa, Homo Sapiens
SFKTRAEVL

SEQ ID NO: 926545 - protein, 9 aa, Homo Sapiens
KNNILNLQG

SEQ ID NO: 926546 - protein, 9 aa, Homo Sapiens
GDNVEICIN

SEQ ID NO: 926547 - protein, 9 aa, Homo Sapiens
LRQFSQGSE

SEQ ID NO: 926548 - protein, 9 aa, Homo Sapiens
YIILTQSLH

SEQ ID NO: 926549 - protein, 9 aa, Homo Sapiens
CSFDKIDKE

SEQ ID NO: 926550 - protein, 9 aa, Homo Sapiens
GGSSGWSSG

SEQ ID NO: 926551 - protein, 9 aa, Homo Sapiens
PEIFSAEYL

SEQ ID NO: 926552 - protein, 9 aa, Homo Sapiens
LAITIAIYV

SEQ ID NO: 926553 - protein, 9 aa, Homo Sapiens
LSSSMDLLI

SEQ ID NO: 926554 - protein, 9 aa, Homo Sapiens
VLSRNSLIA

SEQ ID NO: 926555 - protein, 9 aa, Homo Sapiens
SKNGKTKKE

SEQ ID NO: 926556 - protein, 9 aa, Homo Sapiens
IVIFITYVF

SEQ ID NO: 926557 - protein, 9 aa, Homo Sapiens
FDSIYLGNI

SEQ ID NO: 926558 - protein, 9 aa, Homo Sapiens
GSPDMAENE

SEQ ID NO: 926559 - protein, 9 aa, Homo Sapiens
KLKAFREAH

SEQ ID NO: 926560 - protein, 9 aa, Homo Sapiens
FEGHSIPLK

SEQ ID NO: 926561 - protein, 9 aa, Homo Sapiens
KSYICFKCG

SEQ ID NO: 926562 - protein, 9 aa, Homo Sapiens
AENGPDPGV

SEQ ID NO: 926563 - protein, 9 aa, Homo Sapiens
LLLQLAQLH

SEQ ID NO: 926564 - protein, 9 aa, Homo Sapiens
RLVSFKEDL

SEQ ID NO: 926565 - protein, 9 aa, Homo Sapiens
GDEHSPRNW

SEQ ID NO: 926566 - protein, 9 aa, Homo Sapiens
LEELFQVKI

SEQ ID NO: 926567 - protein, 9 aa, Homo Sapiens
DSDREKDYI

SEQ ID NO: 926568 - protein, 9 aa, Homo Sapiens
STALYCENR

SEQ ID NO: 926569 - protein, 9 aa, Homo Sapiens
NKIQCVDGK

SEQ ID NO: 926570 - protein, 9 aa, Homo Sapiens
FCIDHSYYT

SEQ ID NO: 926571 - protein, 9 aa, Homo Sapiens
LSESQRFSR

SEQ ID NO: 926572 - protein, 9 aa, Homo Sapiens
AELKIPAVK

SEQ ID NO: 926573 - protein, 9 aa, Homo Sapiens
VARAWSSVF

SEQ ID NO: 926574 - protein, 9 aa, Homo Sapiens
PVILACLIT

SEQ ID NO: 926575 - protein, 9 aa, Homo Sapiens
PRGEPGLRG

SEQ ID NO: 926576 - protein, 9 aa, Homo Sapiens
LYPCPQCGR

SEQ ID NO: 926577 - protein, 9 aa, Homo Sapiens
EVQREWQEI

SEQ ID NO: 926578 - protein, 9 aa, Homo Sapiens
CDSPILSVS

SEQ ID NO: 926579 - protein, 9 aa, Homo Sapiens
GPRGPKSDP

SEQ ID NO: 926580 - protein, 9 aa, Homo Sapiens
HCPREAVLF

SEQ ID NO: 926581 - protein, 9 aa, Homo Sapiens
IHTGERPFS

SEQ ID NO: 926582 - protein, 9 aa, Homo Sapiens
GSGKEEDFI

SEQ ID NO: 926583 - protein, 9 aa, Homo Sapiens
SSVFDNLIG

SEQ ID NO: 926584 - protein, 9 aa, Homo Sapiens
APLNPKANQ

SEQ ID NO: 926585 - protein, 9 aa, Homo Sapiens
PKVRSLRPA

SEQ ID NO: 926586 - protein, 9 aa, Homo Sapiens
VLLFSRLFG

SEQ ID NO: 926587 - protein, 9 aa, Homo Sapiens
MEGAALLRI

SEQ ID NO: 926588 - protein, 9 aa, Homo Sapiens
KKKLSCYDT

SEQ ID NO: 926589 - protein, 9 aa, Homo Sapiens
PKKEHCYLL

SEQ ID NO: 926590 - protein, 9 aa, Homo Sapiens
RSLSLQKQL

SEQ ID NO: 926591 - protein, 9 aa, Homo Sapiens
LAVPLPLWG

SEQ ID NO: 926592 - protein, 9 aa, Homo Sapiens
PPCQTPKRG

SEQ ID NO: 926593 - protein, 9 aa, Homo Sapiens
SFDFASSVG

SEQ ID NO: 926594 - protein, 9 aa, Homo Sapiens
ASTPKKEHC

SEQ ID NO: 926595 - protein, 9 aa, Homo Sapiens
YATNSNNYN

SEQ ID NO: 926596 - protein, 9 aa, Homo Sapiens
QFRSLRHKI

SEQ ID NO: 926597 - protein, 9 aa, Homo Sapiens
SQKEGLDRF

SEQ ID NO: 926598 - protein, 9 aa, Homo Sapiens
TQASDSEGH

SEQ ID NO: 926599 - protein, 9 aa, Homo Sapiens
CKKTDGTCL

SEQ ID NO: 926600 - protein, 9 aa, Homo Sapiens
KHIKDNKNN

SEQ ID NO: 926601 - protein, 9 aa, Homo Sapiens
WHCRLLLQL

SEQ ID NO: 926602 - protein, 9 aa, Homo Sapiens
LQGLTEHTL

SEQ ID NO: 926603 - protein, 9 aa, Homo Sapiens
KKVFSTCGA

SEQ ID NO: 926604 - protein, 9 aa, Homo Sapiens
LISEMAKEF

SEQ ID NO: 926605 - protein, 9 aa, Homo Sapiens
FYNRYTTEF

SEQ ID NO: 926606 - protein, 9 aa, Homo Sapiens
DVSVLSFDA

SEQ ID NO: 926607 - protein, 9 aa, Homo Sapiens
PCQTPKRGT

SEQ ID NO: 926608 - protein, 9 aa, Homo Sapiens
EDGEHQVKL

SEQ ID NO: 926609 - protein, 9 aa, Homo Sapiens
LVMKILSDL

SEQ ID NO: 926610 - protein, 9 aa, Homo Sapiens
ANQEKMTQI

SEQ ID NO: 926611 - protein, 9 aa, Homo Sapiens
ETETLAVSS

SEQ ID NO: 926612 - protein, 9 aa, Homo Sapiens
LGQVYNPTT

SEQ ID NO: 926613 - protein, 9 aa, Homo Sapiens
SLSGTLTIT

SEQ ID NO: 926614 - protein, 9 aa, Homo Sapiens
ICLLASLLV

SEQ ID NO: 926615 - protein, 9 aa, Homo Sapiens
NNYNIVRIN

SEQ ID NO: 926616 - protein, 9 aa, Homo Sapiens
DRLINLDFC

SEQ ID NO: 926617 - protein, 9 aa, Homo Sapiens
LFIIGFYTL

SEQ ID NO: 926618 - protein, 9 aa, Homo Sapiens
NTLLHFFAG

SEQ ID NO: 926619 - protein, 9 aa, Homo Sapiens
TTASRLLEA

SEQ ID NO: 926620 - protein, 9 aa, Homo Sapiens
NSRGKNFFR

SEQ ID NO: 926621 - protein, 9 aa, Homo Sapiens
KKGPAARDG

SEQ ID NO: 926622 - protein, 9 aa, Homo Sapiens
LEPNGSVLP

SEQ ID NO: 926623 - protein, 9 aa, Homo Sapiens
AVLLGGVRA

SEQ ID NO: 926624 - protein, 9 aa, Homo Sapiens
RLLVTKSEH

SEQ ID NO: 926625 - protein, 9 aa, Homo Sapiens
KDDQVFSMN

SEQ ID NO: 926626 - protein, 9 aa, Homo Sapiens
SSANFDTFP

SEQ ID NO: 926627 - protein, 9 aa, Homo Sapiens
FCDIYLVMK

SEQ ID NO: 926628 - protein, 9 aa, Homo Sapiens
TRVDAICIH

SEQ ID NO: 926629 - protein, 9 aa, Homo Sapiens
ANASCITWK

SEQ ID NO: 926630 - protein, 9 aa, Homo Sapiens
ESLRQKDDF

SEQ ID NO: 926631 - protein, 9 aa, Homo Sapiens
GLTEHTLIL

SEQ ID NO: 926632 - protein, 9 aa, Homo Sapiens
QEIRQILEN

SEQ ID NO: 926633 - protein, 9 aa, Homo Sapiens
NSPSRFLGD

SEQ ID NO: 926634 - protein, 9 aa, Homo Sapiens
RCPVSGGCS

SEQ ID NO: 926635 - protein, 9 aa, Homo Sapiens
TEYTLQRVP

SEQ ID NO: 926636 - protein, 9 aa, Homo Sapiens
GNIASLCVG

SEQ ID NO: 926637 - protein, 9 aa, Homo Sapiens
EALHKDEEN

SEQ ID NO: 926638 - protein, 9 aa, Homo Sapiens
LDFCIDHSY

SEQ ID NO: 926639 - protein, 9 aa, Homo Sapiens
SERRSKSLG

SEQ ID NO: 926640 - protein, 9 aa, Homo Sapiens
ASVIIQNNA

SEQ ID NO: 926641 - protein, 9 aa, Homo Sapiens
RSSLYSQPP

SEQ ID NO: 926642 - protein, 9 aa, Homo Sapiens
QIRNYFSVP

SEQ ID NO: 926643 - protein, 9 aa, Homo Sapiens
QLRAARTQR

SEQ ID NO: 926644 - protein, 9 aa, Homo Sapiens
TVDAEGNFN

SEQ ID NO: 926645 - protein, 9 aa, Homo Sapiens
MKSAEERKK

SEQ ID NO: 926646 - protein, 9 aa, Homo Sapiens
QIKMCSQNT

SEQ ID NO: 926647 - protein, 9 aa, Homo Sapiens
LIRGSGENG

SEQ ID NO: 926648 - protein, 9 aa, Homo Sapiens
AQTSSDAHI

SEQ ID NO: 926649 - protein, 9 aa, Homo Sapiens
MKLYKCNEC

SEQ ID NO: 926650 - protein, 9 aa, Homo Sapiens
PQNDLQHYG

SEQ ID NO: 926651 - protein, 9 aa, Homo Sapiens
DMAENESEG

SEQ ID NO: 926652 - protein, 9 aa, Homo Sapiens
LSHRSCHPP

SEQ ID NO: 926653 - protein, 9 aa, Homo Sapiens
NVEICINLD

SEQ ID NO: 926654 - protein, 9 aa, Homo Sapiens
RHCESSAFP

SEQ ID NO: 926655 - protein, 9 aa, Homo Sapiens
GRIHSEFDV

SEQ ID NO: 926656 - protein, 9 aa, Homo Sapiens
DRIVSKAMI

SEQ ID NO: 926657 - protein, 9 aa, Homo Sapiens
VYIDELSSF

SEQ ID NO: 926658 - protein, 9 aa, Homo Sapiens
QELQVFSSY

SEQ ID NO: 926659 - protein, 9 aa, Homo Sapiens
RQRYQEPNL

SEQ ID NO: 926660 - protein, 9 aa, Homo Sapiens
KALGLMCGK

SEQ ID NO: 926661 - protein, 9 aa, Homo Sapiens
TRCQHKREH

SEQ ID NO: 926662 - protein, 9 aa, Homo Sapiens
ESASIVSLL

SEQ ID NO: 926663 - protein, 9 aa, Homo Sapiens
AASEKNYNL

SEQ ID NO: 926664 - protein, 9 aa, Homo Sapiens
APTSQKEGL

SEQ ID NO: 926665 - protein, 9 aa, Homo Sapiens
TCLFSHHVS

SEQ ID NO: 926666 - protein, 9 aa, Homo Sapiens
GPKGPPGKG

SEQ ID NO: 926667 - protein, 9 aa, Homo Sapiens
AVTQPESTG

SEQ ID NO: 926668 - protein, 9 aa, Homo Sapiens
SSPRLVSFK

SEQ ID NO: 926669 - protein, 9 aa, Homo Sapiens
AAASPYLKR

SEQ ID NO: 926670 - protein, 9 aa, Homo Sapiens
SSLATRHRE

SEQ ID NO: 926671 - protein, 9 aa, Homo Sapiens
KETQPWSFP

SEQ ID NO: 926672 - protein, 9 aa, Homo Sapiens
NFNPRPVET

SEQ ID NO: 926673 - protein, 9 aa, Homo Sapiens
TQNEFITGY

SEQ ID NO: 926674 - protein, 9 aa, Homo Sapiens
LILVKDLPT

SEQ ID NO: 926675 - protein, 9 aa, Homo Sapiens
ILHASRSSM

SEQ ID NO: 926676 - protein, 9 aa, Homo Sapiens
KHNQLSEFT

SEQ ID NO: 926677 - protein, 9 aa, Homo Sapiens
TLLCAVGAL

SEQ ID NO: 926678 - protein, 9 aa, Homo Sapiens
FKFLQSFND

SEQ ID NO: 926679 - protein, 9 aa, Homo Sapiens
NVMLLAYLT

SEQ ID NO: 926680 - protein, 9 aa, Homo Sapiens
TGDEHSPRN

SEQ ID NO: 926681 - protein, 9 aa, Homo Sapiens
EKENAGFPG

SEQ ID NO: 926682 - protein, 9 aa, Homo Sapiens
VEALCGQCG

SEQ ID NO: 926683 - protein, 9 aa, Homo Sapiens
LQEEELPLV

SEQ ID NO: 926684 - protein, 9 aa, Homo Sapiens
FGICLAKNL

SEQ ID NO: 926685 - protein, 9 aa, Homo Sapiens
PFHENLLDV

SEQ ID NO: 926686 - protein, 9 aa, Homo Sapiens
VLENQPLKE

SEQ ID NO: 926687 - protein, 9 aa, Homo Sapiens
MASTPKKEH

SEQ ID NO: 926688 - protein, 9 aa, Homo Sapiens
LFQVKIERE

SEQ ID NO: 926689 - protein, 9 aa, Homo Sapiens
TPGERGLPG

SEQ ID NO: 926690 - protein, 9 aa, Homo Sapiens
CQTPKRGTG

SEQ ID NO: 926691 - protein, 9 aa, Homo Sapiens
VRSLRPALP

SEQ ID NO: 926692 - protein, 9 aa, Homo Sapiens
RMIIYLTFS

SEQ ID NO: 926693 - protein, 9 aa, Homo Sapiens
PDSVNFFAN

SEQ ID NO: 926694 - protein, 9 aa, Homo Sapiens
EENPMVEAL

SEQ ID NO: 926695 - protein, 9 aa, Homo Sapiens
DNEDSVTPN

SEQ ID NO: 926696 - protein, 9 aa, Homo Sapiens
ESPWKSPGQ

SEQ ID NO: 926697 - protein, 9 aa, Homo Sapiens
PQMHLLDGR

SEQ ID NO: 926698 - protein, 9 aa, Homo Sapiens
HKPILKPLI

SEQ ID NO: 926699 - protein, 9 aa, Homo Sapiens
VEICINLDA

SEQ ID NO: 926700 - protein, 9 aa, Homo Sapiens
PRNLVSKKS

SEQ ID NO: 926701 - protein, 9 aa, Homo Sapiens
TSKYSINNT

SEQ ID NO: 926702 - protein, 9 aa, Homo Sapiens
ERYTCVKIG

SEQ ID NO: 926703 - protein, 9 aa, Homo Sapiens
IQADPELEM

SEQ ID NO: 926704 - protein, 9 aa, Homo Sapiens
IDASVAKNP

SEQ ID NO: 926705 - protein, 9 aa, Homo Sapiens
SDTIENGKA

SEQ ID NO: 926706 - protein, 9 aa, Homo Sapiens
SGPDNCTKC

SEQ ID NO: 926707 - protein, 9 aa, Homo Sapiens
ASPYLKRKQ

SEQ ID NO: 926708 - protein, 9 aa, Homo Sapiens
IFQQGLFKN

SEQ ID NO: 926709 - protein, 9 aa, Homo Sapiens
QTSSDAHIP

SEQ ID NO: 926710 - protein, 9 aa, Homo Sapiens
DGYTVADLS

SEQ ID NO: 926711 - protein, 9 aa, Homo Sapiens
VLINSLPRD

SEQ ID NO: 926712 - protein, 9 aa, Homo Sapiens
SCHPPGIYQ

SEQ ID NO: 926713 - protein, 9 aa, Homo Sapiens
PPEDSISLV

SEQ ID NO: 926714 - protein, 9 aa, Homo Sapiens
SVLFSSLQI

SEQ ID NO: 926715 - protein, 9 aa, Homo Sapiens
VCLAPTTMC

SEQ ID NO: 926716 - protein, 9 aa, Homo Sapiens
TNSTEAENS

SEQ ID NO: 926717 - protein, 9 aa, Homo Sapiens
WTSKYSINN

SEQ ID NO: 926718 - protein, 9 aa, Homo Sapiens
AEKERLAAC

SEQ ID NO: 926719 - protein, 9 aa, Homo Sapiens
VTFHCKMSE

SEQ ID NO: 926720 - protein, 9 aa, Homo Sapiens
ISGVGINQP

SEQ ID NO: 926721 - protein, 9 aa, Homo Sapiens
DGEHQVKLK

SEQ ID NO: 926722 - protein, 9 aa, Homo Sapiens
LNSVSKCDP

SEQ ID NO: 926723 - protein, 9 aa, Homo Sapiens
IAVAVHNEL

SEQ ID NO: 926724 - protein, 9 aa, Homo Sapiens
QPMKKLYGI

SEQ ID NO: 926725 - protein, 9 aa, Homo Sapiens
FLFIIGFYT

SEQ ID NO: 926726 - protein, 9 aa, Homo Sapiens
QEKSHRNSL

SEQ ID NO: 926727 - protein, 9 aa, Homo Sapiens
SCFTLSESQ

SEQ ID NO: 926728 - protein, 9 aa, Homo Sapiens
RGFPGPAGP

SEQ ID NO: 926729 - protein, 9 aa, Homo Sapiens
TLVTITNNF

SEQ ID NO: 926730 - protein, 9 aa, Homo Sapiens
HCAAASPYL

SEQ ID NO: 926731 - protein, 9 aa, Homo Sapiens
TQQNTSINM

SEQ ID NO: 926732 - protein, 9 aa, Homo Sapiens
LIRRNRKNC

SEQ ID NO: 926733 - protein, 9 aa, Homo Sapiens
TPRKVKPPE

SEQ ID NO: 926734 - protein, 9 aa, Homo Sapiens
AGKSDESGD

SEQ ID NO: 926735 - protein, 9 aa, Homo Sapiens
EYPLPKIAW

SEQ ID NO: 926736 - protein, 9 aa, Homo Sapiens
EQEHIQEDL

SEQ ID NO: 926737 - protein, 9 aa, Homo Sapiens
LFPILPSDA

SEQ ID NO: 926738 - protein, 9 aa, Homo Sapiens
SKLFWGPYL

SEQ ID NO: 926739 - protein, 9 aa, Homo Sapiens
SLRCPVSGG

SEQ ID NO: 926740 - protein, 9 aa, Homo Sapiens
GPHLSCVRS

SEQ ID NO: 926741 - protein, 9 aa, Homo Sapiens
LLGGVRASR

SEQ ID NO: 926742 - protein, 9 aa, Homo Sapiens
SEYYWLNGA

SEQ ID NO: 926743 - protein, 9 aa, Homo Sapiens
NWEEAEQFC

SEQ ID NO: 926744 - protein, 9 aa, Homo Sapiens
YHMKSAEER

SEQ ID NO: 926745 - protein, 9 aa, Homo Sapiens
NLLSEDGIQ

SEQ ID NO: 926746 - protein, 9 aa, Homo Sapiens
CELRNLKFV

SEQ ID NO: 926747 - protein, 9 aa, Homo Sapiens
GPSPRGWHA

SEQ ID NO: 926748 - protein, 9 aa, Homo Sapiens
QKFSRVPLP

SEQ ID NO: 926749 - protein, 9 aa, Homo Sapiens
MLLAYLTPG

SEQ ID NO: 926750 - protein, 9 aa, Homo Sapiens
VTSRRPYCH

SEQ ID NO: 926751 - protein, 9 aa, Homo Sapiens
CNANSISCS

SEQ ID NO: 926752 - protein, 9 aa, Homo Sapiens
HNPVVEVEV

SEQ ID NO: 926753 - protein, 9 aa, Homo Sapiens
QTPKRGTGS

SEQ ID NO: 926754 - protein, 9 aa, Homo Sapiens
TAYIQTQQL

SEQ ID NO: 926755 - protein, 9 aa, Homo Sapiens
HLDPDTEYK

SEQ ID NO: 926756 - protein, 9 aa, Homo Sapiens
GHKAENGPD

SEQ ID NO: 926757 - protein, 9 aa, Homo Sapiens
PGFERTMSP

SEQ ID NO: 926758 - protein, 9 aa, Homo Sapiens
SFYISTDFS

SEQ ID NO: 926759 - protein, 9 aa, Homo Sapiens
SGLNKSLGA

SEQ ID NO: 926760 - protein, 9 aa, Homo Sapiens
AHLNSVSKC

SEQ ID NO: 926761 - protein, 9 aa, Homo Sapiens
LYLNDNHLT

SEQ ID NO: 926762 - protein, 9 aa, Homo Sapiens
PLKENEEEP

SEQ ID NO: 926763 - protein, 9 aa, Homo Sapiens
EHIQEDLQQ

SEQ ID NO: 926764 - protein, 9 aa, Homo Sapiens
GSSGTQASD

SEQ ID NO: 926765 - protein, 9 aa, Homo Sapiens
LETSTGLKP

SEQ ID NO: 926766 - protein, 9 aa, Homo Sapiens
WLRDFHNPV

SEQ ID NO: 926767 - protein, 9 aa, Homo Sapiens
TDLDYCPIA

SEQ ID NO: 926768 - protein, 9 aa, Homo Sapiens
QALNGSKII

SEQ ID NO: 926769 - protein, 9 aa, Homo Sapiens
FVQNSHFKE

SEQ ID NO: 926770 - protein, 9 aa, Homo Sapiens
EVQEDLESE

SEQ ID NO: 926771 - protein, 9 aa, Homo Sapiens
SAEERQKAF

SEQ ID NO: 926772 - protein, 9 aa, Homo Sapiens
IGQTSQVDW

SEQ ID NO: 926773 - protein, 9 aa, Homo Sapiens
FSFICKTRV

SEQ ID NO: 926774 - protein, 9 aa, Homo Sapiens
LGLEKNGTA

SEQ ID NO: 926775 - protein, 9 aa, Homo Sapiens
DLQYQDQHS

SEQ ID NO: 926776 - protein, 9 aa, Homo Sapiens
EGDRGQHLD

SEQ ID NO: 926777 - protein, 9 aa, Homo Sapiens
ANFFCLLSQ

SEQ ID NO: 926778 - protein, 9 aa, Homo Sapiens
DSLASASPV

SEQ ID NO: 926779 - protein, 9 aa, Homo Sapiens
DQTQLLILV

SEQ ID NO: 926780 - protein, 9 aa, Homo Sapiens
ICINLDAAS

SEQ ID NO: 926781 - protein, 9 aa, Homo Sapiens
PELEAEPPK

SEQ ID NO: 926782 - protein, 9 aa, Homo Sapiens
NFSPKVELA

SEQ ID NO: 926783 - protein, 9 aa, Homo Sapiens
RGMYEELNK

SEQ ID NO: 926784 - protein, 9 aa, Homo Sapiens
EPMEEREAD

SEQ ID NO: 926785 - protein, 9 aa, Homo Sapiens
EFDVFSQIN

SEQ ID NO: 926786 - protein, 9 aa, Homo Sapiens
KSFDFASSV

SEQ ID NO: 926787 - protein, 9 aa, Homo Sapiens
QPNEQGLQQ

SEQ ID NO: 926788 - protein, 9 aa, Homo Sapiens
SITLKPAQP

SEQ ID NO: 926789 - protein, 9 aa, Homo Sapiens
TVIECETSP

SEQ ID NO: 926790 - protein, 9 aa, Homo Sapiens
QREWQEIRQ

SEQ ID NO: 926791 - protein, 9 aa, Homo Sapiens
RSSAHAGGL

SEQ ID NO: 926792 - protein, 9 aa, Homo Sapiens
QIDSLEKIE

SEQ ID NO: 926793 - protein, 9 aa, Homo Sapiens
AIIGTNVLQ

SEQ ID NO: 926794 - protein, 9 aa, Homo Sapiens
WVLLVTKQA

SEQ ID NO: 926795 - protein, 9 aa, Homo Sapiens
IQKLIKEMD

SEQ ID NO: 926796 - protein, 9 aa, Homo Sapiens
YQGNYIYGT

SEQ ID NO: 926797 - protein, 9 aa, Homo Sapiens
SDVDVQFNN

SEQ ID NO: 926798 - protein, 9 aa, Homo Sapiens
RQSMIKYLE

SEQ ID NO: 926799 - protein, 9 aa, Homo Sapiens
NYFSVPLSV

SEQ ID NO: 926800 - protein, 9 aa, Homo Sapiens
LQELWRELD

SEQ ID NO: 926801 - protein, 9 aa, Homo Sapiens
FLFAAENEQ

SEQ ID NO: 926802 - protein, 9 aa, Homo Sapiens
VVLLDCAHD

SEQ ID NO: 926803 - protein, 9 aa, Homo Sapiens
SLRPALPTW

SEQ ID NO: 926804 - protein, 9 aa, Homo Sapiens
AGLTLLCAV

SEQ ID NO: 926805 - protein, 9 aa, Homo Sapiens
FCPPSFSTA

SEQ ID NO: 926806 - protein, 9 aa, Homo Sapiens
TFSVAMFWV

SEQ ID NO: 926807 - protein, 9 aa, Homo Sapiens
CSFPEYELP

SEQ ID NO: 926808 - protein, 9 aa, Homo Sapiens
RKVKPPEDL

SEQ ID NO: 926809 - protein, 9 aa, Homo Sapiens
DIYLVMKLS

SEQ ID NO: 926810 - protein, 9 aa, Homo Sapiens
FNEDCVFDR

SEQ ID NO: 926811 - protein, 9 aa, Homo Sapiens
EYKIRVLLT

SEQ ID NO: 926812 - protein, 9 aa, Homo Sapiens
HHRQEDRLI

SEQ ID NO: 926813 - protein, 9 aa, Homo Sapiens
FDLFLKTLL

SEQ ID NO: 926814 - protein, 9 aa, Homo Sapiens
MIIYLTFSV

SEQ ID NO: 926815 - protein, 9 aa, Homo Sapiens
LQGKGLSYL

SEQ ID NO: 926816 - protein, 9 aa, Homo Sapiens
LDKVEMKQK

SEQ ID NO: 926817 - protein, 9 aa, Homo Sapiens
ERPGNFYVF

SEQ ID NO: 926818 - protein, 9 aa, Homo Sapiens
DLLVIIEVF

SEQ ID NO: 926819 - protein, 9 aa, Homo Sapiens
VLSGYGGTN

SEQ ID NO: 926820 - protein, 9 aa, Homo Sapiens
LSGEGATSR

SEQ ID NO: 926821 - protein, 9 aa, Homo Sapiens
TSFLSKSDQ

SEQ ID NO: 926822 - protein, 9 aa, Homo Sapiens
IGDAWSHLS

SEQ ID NO: 926823 - protein, 9 aa, Homo Sapiens
KHEEMFQRL

SEQ ID NO: 926824 - protein, 9 aa, Homo Sapiens
GLATMKSRW

SEQ ID NO: 926825 - protein, 9 aa, Homo Sapiens
LEETETLAV

SEQ ID NO: 926826 - protein, 9 aa, Homo Sapiens
YNRYTTEFD

SEQ ID NO: 926827 - protein, 9 aa, Homo Sapiens
QQGLFKNKV

SEQ ID NO: 926828 - protein, 9 aa, Homo Sapiens
MSQKNVDMR

SEQ ID NO: 926829 - protein, 9 aa, Homo Sapiens
KPILKPLIM

SEQ ID NO: 926830 - protein, 9 aa, Homo Sapiens
EEREADSCH

SEQ ID NO: 926831 - protein, 9 aa, Homo Sapiens
CLLSQGGGK

SEQ ID NO: 926832 - protein, 9 aa, Homo Sapiens
MSPIFSAKV

SEQ ID NO: 926833 - protein, 9 aa, Homo Sapiens
LTLINLVAI

SEQ ID NO: 926834 - protein, 9 aa, Homo Sapiens
CPSRWAVRL

SEQ ID NO: 926835 - protein, 9 aa, Homo Sapiens
VDEVFDDSI

SEQ ID NO: 926836 - protein, 9 aa, Homo Sapiens
TASRLLEAS

SEQ ID NO: 926837 - protein, 9 aa, Homo Sapiens
ENAGFPGLP

SEQ ID NO: 926838 - protein, 9 aa, Homo Sapiens
ILKPLIMLL

SEQ ID NO: 926839 - protein, 9 aa, Homo Sapiens
AEISITLKP

SEQ ID NO: 926840 - protein, 9 aa, Homo Sapiens
GDPPQPDLN

SEQ ID NO: 926841 - protein, 9 aa, Homo Sapiens
GFEQPSEVQ

SEQ ID NO: 926842 - protein, 9 aa, Homo Sapiens
RRTHSGEKL

SEQ ID NO: 926843 - protein, 9 aa, Homo Sapiens
QKFDLFLKT

SEQ ID NO: 926844 - protein, 9 aa, Homo Sapiens
FGSVFLFAA

SEQ ID NO: 926845 - protein, 9 aa, Homo Sapiens
EWPTLSIYK

SEQ ID NO: 926846 - protein, 9 aa, Homo Sapiens
SLNRLLLEF

SEQ ID NO: 926847 - protein, 9 aa, Homo Sapiens
FFVFNLFTP

SEQ ID NO: 926848 - protein, 9 aa, Homo Sapiens
YVAICHSLC

SEQ ID NO: 926849 - protein, 9 aa, Homo Sapiens
ASGAARNFH

SEQ ID NO: 926850 - protein, 9 aa, Homo Sapiens
DSRAAPGPR

SEQ ID NO: 926851 - protein, 9 aa, Homo Sapiens
RDLVLLKTR

SEQ ID NO: 926852 - protein, 9 aa, Homo Sapiens
EIFSAEYLY

SEQ ID NO: 926853 - protein, 9 aa, Homo Sapiens
IHSGMKLYK

SEQ ID NO: 926854 - protein, 9 aa, Homo Sapiens
AKSVVNLAN

SEQ ID NO: 926855 - protein, 9 aa, Homo Sapiens
PPAAHLNSV

SEQ ID NO: 926856 - protein, 9 aa, Homo Sapiens
QSKEKSPQA

SEQ ID NO: 926857 - protein, 9 aa, Homo Sapiens
TMKSRWSGS

SEQ ID NO: 926858 - protein, 9 aa, Homo Sapiens
SIPLKEGEL

SEQ ID NO: 926859 - protein, 9 aa, Homo Sapiens
TQPWSFPKG

SEQ ID NO: 926860 - protein, 9 aa, Homo Sapiens
RSSPEDSLI

SEQ ID NO: 926861 - protein, 9 aa, Homo Sapiens
MCSQNTSIP

SEQ ID NO: 926862 - protein, 9 aa, Homo Sapiens
RMHSAEERQ

SEQ ID NO: 926863 - protein, 9 aa, Homo Sapiens
DRMSFNLSW

SEQ ID NO: 926864 - protein, 9 aa, Homo Sapiens
TDSDREKDY

SEQ ID NO: 926865 - protein, 9 aa, Homo Sapiens
QTQLLILVC

SEQ ID NO: 926866 - protein, 9 aa, Homo Sapiens
SSSMDLLIQ

SEQ ID NO: 926867 - protein, 9 aa, Homo Sapiens
FAGDDAPQA

SEQ ID NO: 926868 - protein, 9 aa, Homo Sapiens
KWTTLPVCI

SEQ ID NO: 926869 - protein, 9 aa, Homo Sapiens
VIIQNNAYA

SEQ ID NO: 926870 - protein, 9 aa, Homo Sapiens
TRSLSLQKQ

SEQ ID NO: 926871 - protein, 9 aa, Homo Sapiens
SFQTYESMA

SEQ ID NO: 926872 - protein, 9 aa, Homo Sapiens
HCKMSEYPL

SEQ ID NO: 926873 - protein, 9 aa, Homo Sapiens
FHINKKARQ

SEQ ID NO: 926874 - protein, 9 aa, Homo Sapiens
AVEGPSTAE

SEQ ID NO: 926875 - protein, 9 aa, Homo Sapiens
AQTPRTGGA

SEQ ID NO: 926876 - protein, 9 aa, Homo Sapiens
RDSPSSSTF

SEQ ID NO: 926877 - protein, 9 aa, Homo Sapiens
PSDTIENGK

SEQ ID NO: 926878 - protein, 9 aa, Homo Sapiens
GPAEEANSH

SEQ ID NO: 926879 - protein, 9 aa, Homo Sapiens
TNLETSTGL

SEQ ID NO: 926880 - protein, 9 aa, Homo Sapiens
APTQGPSPR

SEQ ID NO: 926881 - protein, 9 aa, Homo Sapiens
CDFSMYFGC

SEQ ID NO: 926882 - protein, 9 aa, Homo Sapiens
ENTIPVTFE

SEQ ID NO: 926883 - protein, 9 aa, Homo Sapiens
RAQTPRTGG

SEQ ID NO: 926884 - protein, 9 aa, Homo Sapiens
FSIACNTKQ

SEQ ID NO: 926885 - protein, 9 aa, Homo Sapiens
QFGEQEENL

SEQ ID NO: 926886 - protein, 9 aa, Homo Sapiens
QSGGGSAND

SEQ ID NO: 926887 - protein, 9 aa, Homo Sapiens
KDEENEAVE

SEQ ID NO: 926888 - protein, 9 aa, Homo Sapiens
DLANITLEP

SEQ ID NO: 926889 - protein, 9 aa, Homo Sapiens
PIFSAKVII

SEQ ID NO: 926890 - protein, 9 aa, Homo Sapiens
VFDNLIGNH

SEQ ID NO: 926891 - protein, 9 aa, Homo Sapiens
SKYSINNTG

SEQ ID NO: 926892 - protein, 9 aa, Homo Sapiens
HSEFDVFSQ

SEQ ID NO: 926893 - protein, 9 aa, Homo Sapiens
NGKAKIQDK

SEQ ID NO: 926894 - protein, 9 aa, Homo Sapiens
ISTRPTCSE

SEQ ID NO: 926895 - protein, 9 aa, Homo Sapiens
HSGEKLYPC

SEQ ID NO: 926896 - protein, 9 aa, Homo Sapiens
AKVAAANVA

SEQ ID NO: 926897 - protein, 9 aa, Homo Sapiens
TKQLNCFPV

SEQ ID NO: 926898 - protein, 9 aa, Homo Sapiens
NFYVFSESI

SEQ ID NO: 926899 - protein, 9 aa, Homo Sapiens
YLKPRTEYE

SEQ ID NO: 926900 - protein, 9 aa, Homo Sapiens
CSWPCPKCR

SEQ ID NO: 926901 - protein, 9 aa, Homo Sapiens
EDSISLVFP

SEQ ID NO: 926902 - protein, 9 aa, Homo Sapiens
ILMDLKYVS

SEQ ID NO: 926903 - protein, 9 aa, Homo Sapiens
AEVLHMCVE

SEQ ID NO: 926904 - protein, 9 aa, Homo Sapiens
FPGLQGPPE

SEQ ID NO: 926905 - protein, 9 aa, Homo Sapiens
YKLIALLKW

SEQ ID NO: 926906 - protein, 9 aa, Homo Sapiens
AEPPKMLSS

SEQ ID NO: 926907 - protein, 9 aa, Homo Sapiens
LNLLSEDGI

SEQ ID NO: 926908 - protein, 9 aa, Homo Sapiens
VLEVAKRSS

SEQ ID NO: 926909 - protein, 9 aa, Homo Sapiens
PTFINMSQK

SEQ ID NO: 926910 - protein, 9 aa, Homo Sapiens
ENFLIIFTI

SEQ ID NO: 926911 - protein, 9 aa, Homo Sapiens
TKSSCVVNV

SEQ ID NO: 926912 - protein, 9 aa, Homo Sapiens
MQSAEGRKK

SEQ ID NO: 926913 - protein, 9 aa, Homo Sapiens
YFPFRPHPG

SEQ ID NO: 926914 - protein, 9 aa, Homo Sapiens
KDEKEKFLM

SEQ ID NO: 926915 - protein, 9 aa, Homo Sapiens
SLSAELKIP

SEQ ID NO: 926916 - protein, 9 aa, Homo Sapiens
LIGVYHRTQ

SEQ ID NO: 926917 - protein, 9 aa, Homo Sapiens
GSANDFREV

SEQ ID NO: 926918 - protein, 9 aa, Homo Sapiens
GEVLFSIEV

SEQ ID NO: 926919 - protein, 9 aa, Homo Sapiens
PPSLSGTLT

SEQ ID NO: 926920 - protein, 9 aa, Homo Sapiens
STEAENSNG

SEQ ID NO: 926921 - protein, 9 aa, Homo Sapiens
EYYWLNGAK

SEQ ID NO: 926922 - protein, 9 aa, Homo Sapiens
EVTKKFIRD

SEQ ID NO: 926923 - protein, 9 aa, Homo Sapiens
VFLFAAENE

SEQ ID NO: 926924 - protein, 9 aa, Homo Sapiens
AARNFHSAA

SEQ ID NO: 926925 - protein, 9 aa, Homo Sapiens
DAWSHLSHF

SEQ ID NO: 926926 - protein, 9 aa, Homo Sapiens
SWPDRSCTE

SEQ ID NO: 926927 - protein, 9 aa, Homo Sapiens
SPVQIRNYF

SEQ ID NO: 926928 - protein, 9 aa, Homo Sapiens
GLIAVRAAG

SEQ ID NO: 926929 - protein, 9 aa, Homo Sapiens
RCDKENKIF

SEQ ID NO: 926930 - protein, 9 aa, Homo Sapiens
QVYNPTTTY

SEQ ID NO: 926931 - protein, 9 aa, Homo Sapiens
GYRPQDRIV

SEQ ID NO: 926932 - protein, 9 aa, Homo Sapiens
HEQLTSPST

SEQ ID NO: 926933 - protein, 9 aa, Homo Sapiens
ECQKTEQEK

SEQ ID NO: 926934 - protein, 9 aa, Homo Sapiens
MANGHHIHD

SEQ ID NO: 926935 - protein, 9 aa, Homo Sapiens
KSVVNLANV

SEQ ID NO: 926936 - protein, 9 aa, Homo Sapiens
NSNGSSGGD

SEQ ID NO: 926937 - protein, 9 aa, Homo Sapiens
RLRTPQLTP

SEQ ID NO: 926938 - protein, 9 aa, Homo Sapiens
FDVSVLSFD

SEQ ID NO: 926939 - protein, 9 aa, Homo Sapiens
PDNTTASRL

SEQ ID NO: 926940 - protein, 9 aa, Homo Sapiens
EHTLILVKD

SEQ ID NO: 926941 - protein, 9 aa, Homo Sapiens
FFANEVAAK

SEQ ID NO: 926942 - protein, 9 aa, Homo Sapiens
LHASRSSMG

SEQ ID NO: 926943 - protein, 9 aa, Homo Sapiens
NNMSGQRNI

SEQ ID NO: 926944 - protein, 9 aa, Homo Sapiens
EGDVYFDYD

SEQ ID NO: 926945 - protein, 9 aa, Homo Sapiens
YNPTTTYLG

SEQ ID NO: 926946 - protein, 9 aa, Homo Sapiens
RLLEASMPV

SEQ ID NO: 926947 - protein, 9 aa, Homo Sapiens
AICHSLCYS

SEQ ID NO: 926948 - protein, 9 aa, Homo Sapiens
SHVAQACVR

SEQ ID NO: 926949 - protein, 9 aa, Homo Sapiens
YNDIVSMMS

SEQ ID NO: 926950 - protein, 9 aa, Homo Sapiens
LINLDFCID

SEQ ID NO: 926951 - protein, 9 aa, Homo Sapiens
HMKAREAAV

SEQ ID NO: 926952 - protein, 9 aa, Homo Sapiens
ATYRRPYPD

SEQ ID NO: 926953 - protein, 9 aa, Homo Sapiens
AKENSQPGE

SEQ ID NO: 926954 - protein, 9 aa, Homo Sapiens
EPEASHNTR

SEQ ID NO: 926955 - protein, 9 aa, Homo Sapiens
PEKHGASGP

SEQ ID NO: 926956 - protein, 9 aa, Homo Sapiens
HENLLDVRN

SEQ ID NO: 926957 - protein, 9 aa, Homo Sapiens
TTQSMRSGA

SEQ ID NO: 926958 - protein, 9 aa, Homo Sapiens
SFPEYELPE

SEQ ID NO: 926959 - protein, 9 aa, Homo Sapiens
ALVCAFSNS

SEQ ID NO: 926960 - protein, 9 aa, Homo Sapiens
QPAPRNLVS

SEQ ID NO: 926961 - protein, 9 aa, Homo Sapiens
IIPCHCCVL

SEQ ID NO: 926962 - protein, 9 aa, Homo Sapiens
QERIAKNHG

SEQ ID NO: 926963 - protein, 9 aa, Homo Sapiens
AAGFKRHVI

SEQ ID NO: 926964 - protein, 9 aa, Homo Sapiens
LVDLIDASV

SEQ ID NO: 926965 - protein, 9 aa, Homo Sapiens
SQYPNLSQL

SEQ ID NO: 926966 - protein, 9 aa, Homo Sapiens
SVKVQLCVL

SEQ ID NO: 926967 - protein, 9 aa, Homo Sapiens
HNTRGSWLP

SEQ ID NO: 926968 - protein, 9 aa, Homo Sapiens
NTTASRLLE

SEQ ID NO: 926969 - protein, 9 aa, Homo Sapiens
SSLYSQPPK

SEQ ID NO: 926970 - protein, 9 aa, Homo Sapiens
TWKGTNGEF

SEQ ID NO: 926971 - protein, 9 aa, Homo Sapiens
IMLLSSCSG

SEQ ID NO: 926972 - protein, 9 aa, Homo Sapiens
NEFITGYKI

SEQ ID NO: 926973 - protein, 9 aa, Homo Sapiens
QCPERYTCV

SEQ ID NO: 926974 - protein, 9 aa, Homo Sapiens
LGQIEEEGI

SEQ ID NO: 926975 - protein, 9 aa, Homo Sapiens
LCGPESPSP

SEQ ID NO: 926976 - protein, 9 aa, Homo Sapiens
PSEPVPFMP

SEQ ID NO: 926977 - protein, 9 aa, Homo Sapiens
FCLLSQGGG

SEQ ID NO: 926978 - protein, 9 aa, Homo Sapiens
LLTANQTLI

SEQ ID NO: 926979 - protein, 9 aa, Homo Sapiens
ENQEDKATI

SEQ ID NO: 926980 - protein, 9 aa, Homo Sapiens
VLFKTKLDK

SEQ ID NO: 926981 - protein, 9 aa, Homo Sapiens
YWHCRLLLQ

SEQ ID NO: 926982 - protein, 9 aa, Homo Sapiens
PEPPGIPGM

SEQ ID NO: 926983 - protein, 9 aa, Homo Sapiens
KKEKASVII

SEQ ID NO: 926984 - protein, 9 aa, Homo Sapiens
SSSNKGDLL

SEQ ID NO: 926985 - protein, 9 aa, Homo Sapiens
VTTALGSSV

SEQ ID NO: 926986 - protein, 9 aa, Homo Sapiens
QAQPADQKL

SEQ ID NO: 926987 - protein, 9 aa, Homo Sapiens
SPNGVTSRR

SEQ ID NO: 926988 - protein, 9 aa, Homo Sapiens
LKLTWFLLQ

SEQ ID NO: 926989 - protein, 9 aa, Homo Sapiens
FWGPYLRFW

SEQ ID NO: 926990 - protein, 9 aa, Homo Sapiens
LATMKSRWS

SEQ ID NO: 926991 - protein, 9 aa, Homo Sapiens
ILSVSSGSS

SEQ ID NO: 926992 - protein, 9 aa, Homo Sapiens
PSSSTFISI

SEQ ID NO: 926993 - protein, 9 aa, Homo Sapiens
VHYWYQGNY

SEQ ID NO: 926994 - protein, 9 aa, Homo Sapiens
TKKFIRDPI

SEQ ID NO: 926995 - protein, 9 aa, Homo Sapiens
PLIGVYHRT

SEQ ID NO: 926996 - protein, 9 aa, Homo Sapiens
EKNYATIVI

SEQ ID NO: 926997 - protein, 9 aa, Homo Sapiens
QGKGLSYLS

SEQ ID NO: 926998 - protein, 9 aa, Homo Sapiens
TGFWNPHTE

SEQ ID NO: 926999 - protein, 9 aa, Homo Sapiens
PMEEREADS

SEQ ID NO: 927000 - protein, 9 aa, Homo Sapiens
NKMCHKPDV

SEQ ID NO: 927001 - protein, 9 aa, Homo Sapiens
FCCDSGRCI

SEQ ID NO: 927002 - protein, 9 aa, Homo Sapiens
YGASNENSE

SEQ ID NO: 927003 - protein, 9 aa, Homo Sapiens
QSFNDVGCE

SEQ ID NO: 927004 - protein, 9 aa, Homo Sapiens
AVLINSLPR

SEQ ID NO: 927005 - protein, 9 aa, Homo Sapiens
EDDLSAHNL

SEQ ID NO: 927006 - protein, 9 aa, Homo Sapiens
YTVIECETS

SEQ ID NO: 927007 - protein, 9 aa, Homo Sapiens
KKDCSWPCP

SEQ ID NO: 927008 - protein, 9 aa, Homo Sapiens
RAWSSVFDN

SEQ ID NO: 927009 - protein, 9 aa, Homo Sapiens
SEYPLPKIA

SEQ ID NO: 927010 - protein, 9 aa, Homo Sapiens
PSRFLGDSP

SEQ ID NO: 927011 - protein, 9 aa, Homo Sapiens
VLPPTEGPP

SEQ ID NO: 927012 - protein, 9 aa, Homo Sapiens
SLGGIIYLV

SEQ ID NO: 927013 - protein, 9 aa, Homo Sapiens
VQESPRCKI

SEQ ID NO: 927014 - protein, 9 aa, Homo Sapiens
DFGKKDCSW

SEQ ID NO: 927015 - protein, 9 aa, Homo Sapiens
SCSFDKIDK

SEQ ID NO: 927016 - protein, 9 aa, Homo Sapiens
RGMKESEVT

SEQ ID NO: 927017 - protein, 9 aa, Homo Sapiens
VKVQLCVLG

SEQ ID NO: 927018 - protein, 9 aa, Homo Sapiens
KNGKTKKEN

SEQ ID NO: 927019 - protein, 9 aa, Homo Sapiens
FWVTGLVDS

SEQ ID NO: 927020 - protein, 9 aa, Homo Sapiens
ECLSQYPNL

SEQ ID NO: 927021 - protein, 9 aa, Homo Sapiens
TRIHSGMKL

SEQ ID NO: 927022 - protein, 9 aa, Homo Sapiens
YIRTDISEY

SEQ ID NO: 927023 - protein, 9 aa, Homo Sapiens
FMGHQLTAT

SEQ ID NO: 927024 - protein, 9 aa, Homo Sapiens
SLAITIAIY

SEQ ID NO: 927025 - protein, 9 aa, Homo Sapiens
IQADAALHK

SEQ ID NO: 927026 - protein, 9 aa, Homo Sapiens
CLGFHINKK

SEQ ID NO: 927027 - protein, 9 aa, Homo Sapiens
ENLATQSSP

SEQ ID NO: 927028 - protein, 9 aa, Homo Sapiens
LLAYLTPGA

SEQ ID NO: 927029 - protein, 9 aa, Homo Sapiens
PKSQKLWDV

SEQ ID NO: 927030 - protein, 9 aa, Homo Sapiens
LSFYISTDF

SEQ ID NO: 927031 - protein, 9 aa, Homo Sapiens
SSLSNGRSV

SEQ ID NO: 927032 - protein, 9 aa, Homo Sapiens
EVQQLSVLF

SEQ ID NO: 927033 - protein, 9 aa, Homo Sapiens
TDRCYIILT

SEQ ID NO: 927034 - protein, 9 aa, Homo Sapiens
KEEDFIRKQ

SEQ ID NO: 927035 - protein, 9 aa, Homo Sapiens
IGTNVLQDH

SEQ ID NO: 927036 - protein, 9 aa, Homo Sapiens
YQLDLANIT

SEQ ID NO: 927037 - protein, 9 aa, Homo Sapiens
CFVLEVAKR

SEQ ID NO: 927038 - protein, 9 aa, Homo Sapiens
AALHKPMYL

SEQ ID NO: 927039 - protein, 9 aa, Homo Sapiens
CFCPPSFST

SEQ ID NO: 927040 - protein, 9 aa, Homo Sapiens
AKAILHASR

SEQ ID NO: 927041 - protein, 9 aa, Homo Sapiens
VAGPASGLN

SEQ ID NO: 927042 - protein, 9 aa, Homo Sapiens
SGGGSANDF

SEQ ID NO: 927043 - protein, 9 aa, Homo Sapiens
RLGLLKLTW

SEQ ID NO: 927044 - protein, 9 aa, Homo Sapiens
QDGSPDMAE

SEQ ID NO: 927045 - protein, 9 aa, Homo Sapiens
QPLLDGFFQ

SEQ ID NO: 927046 - protein, 9 aa, Homo Sapiens
HHQKGKDKG

SEQ ID NO: 927047 - protein, 9 aa, Homo Sapiens
PSSSSFSSS

SEQ ID NO: 927048 - protein, 9 aa, Homo Sapiens
TETALAEDT

SEQ ID NO: 927049 - protein, 9 aa, Homo Sapiens
FTCTYKIQR

SEQ ID NO: 927050 - protein, 9 aa, Homo Sapiens
SGWSSGLAQ

SEQ ID NO: 927051 - protein, 9 aa, Homo Sapiens
VSKKSSFAN

SEQ ID NO: 927052 - protein, 9 aa, Homo Sapiens
PDNEHDLSD

SEQ ID NO: 927053 - protein, 9 aa, Homo Sapiens
MRVTYFCND

SEQ ID NO: 927054 - protein, 9 aa, Homo Sapiens
EKERLAACL

SEQ ID NO: 927055 - protein, 9 aa, Homo Sapiens
LKETQPWSF

SEQ ID NO: 927056 - protein, 9 aa, Homo Sapiens
SLLLLLTFV

SEQ ID NO: 927057 - protein, 9 aa, Homo Sapiens
ICFKCGKAF

SEQ ID NO: 927058 - protein, 9 aa, Homo Sapiens
VFSESIRKG

SEQ ID NO: 927059 - protein, 9 aa, Homo Sapiens
NDKALGLMC

SEQ ID NO: 927060 - protein, 9 aa, Homo Sapiens
TVADLSDFN

SEQ ID NO: 927061 - protein, 9 aa, Homo Sapiens
EAVLFKTKL

SEQ ID NO: 927062 - protein, 9 aa, Homo Sapiens
YEELNKMCH

SEQ ID NO: 927063 - protein, 9 aa, Homo Sapiens
GSPSGRSGS

SEQ ID NO: 927064 - protein, 9 aa, Homo Sapiens
PEDSLIIPE

SEQ ID NO: 927065 - protein, 9 aa, Homo Sapiens
LVNVCLGFH

SEQ ID NO: 927066 - protein, 9 aa, Homo Sapiens
LKPLIMLLS

SEQ ID NO: 927067 - protein, 9 aa, Homo Sapiens
EVDKFGNYS

SEQ ID NO: 927068 - protein, 9 aa, Homo Sapiens
HAWSQEALV

SEQ ID NO: 927069 - protein, 9 aa, Homo Sapiens
LNQTKVFLS

SEQ ID NO: 927070 - protein, 9 aa, Homo Sapiens
VDCGFEQPS

SEQ ID NO: 927071 - protein, 9 aa, Homo Sapiens
REKDYIFSS

SEQ ID NO: 927072 - protein, 9 aa, Homo Sapiens
SRGRDGFPG

SEQ ID NO: 927073 - protein, 9 aa, Homo Sapiens
SEPFHENLL

SEQ ID NO: 927074 - protein, 9 aa, Homo Sapiens
FQQGLFKNK

SEQ ID NO: 927075 - protein, 9 aa, Homo Sapiens
RLPLPDNEH

SEQ ID NO: 927076 - protein, 9 aa, Homo Sapiens
QLDAQLRQF

SEQ ID NO: 927077 - protein, 9 aa, Homo Sapiens
LGLDEYLNK

SEQ ID NO: 927078 - protein, 9 aa, Homo Sapiens
QLRQFSQGS

SEQ ID NO: 927079 - protein, 9 aa, Homo Sapiens
GGSPKVRSL

SEQ ID NO: 927080 - protein, 9 aa, Homo Sapiens
EVHYWYQGN

SEQ ID NO: 927081 - protein, 9 aa, Homo Sapiens
VGRLHCKPA

SEQ ID NO: 927082 - protein, 9 aa, Homo Sapiens
QEGPRGPKS

SEQ ID NO: 927083 - protein, 9 aa, Homo Sapiens
SNEKHLFRG

SEQ ID NO: 927084 - protein, 9 aa, Homo Sapiens
PILSVSSGS

SEQ ID NO: 927085 - protein, 9 aa, Homo Sapiens
PMANIIWMA

SEQ ID NO: 927086 - protein, 9 aa, Homo Sapiens
QQGMMRGMH

SEQ ID NO: 927087 - protein, 9 aa, Homo Sapiens
GEETLSVKV

SEQ ID NO: 927088 - protein, 9 aa, Homo Sapiens
DDFGKKDCS

SEQ ID NO: 927089 - protein, 9 aa, Homo Sapiens
RIAEQEHIQ

SEQ ID NO: 927090 - protein, 9 aa, Homo Sapiens
LVSKKSSFA

SEQ ID NO: 927091 - protein, 9 aa, Homo Sapiens
ENGRLLGQI

SEQ ID NO: 927092 - protein, 9 aa, Homo Sapiens
ELKIPAVKE

SEQ ID NO: 927093 - protein, 9 aa, Homo Sapiens
CLDWAATLA

SEQ ID NO: 927094 - protein, 9 aa, Homo Sapiens
FNEYFPFRP

SEQ ID NO: 927095 - protein, 9 aa, Homo Sapiens
GEKSYICFK

SEQ ID NO: 927096 - protein, 9 aa, Homo Sapiens
SPSRFLGDS

SEQ ID NO: 927097 - protein, 9 aa, Homo Sapiens
RESSLSNGR

SEQ ID NO: 927098 - protein, 9 aa, Homo Sapiens
KGKDKGVVY

SEQ ID NO: 927099 - protein, 9 aa, Homo Sapiens
KVAVSAPKG

SEQ ID NO: 927100 - protein, 9 aa, Homo Sapiens
FEVHYCSLS

SEQ ID NO: 927101 - protein, 9 aa, Homo Sapiens
ESSLSNGRS

SEQ ID NO: 927102 - protein, 9 aa, Homo Sapiens
NPRPVETLN

SEQ ID NO: 927103 - protein, 9 aa, Homo Sapiens
YHGRPLAQT

SEQ ID NO: 927104 - protein, 9 aa, Homo Sapiens
EGPSTAEIT

SEQ ID NO: 927105 - protein, 9 aa, Homo Sapiens
QLASFLEDL

SEQ ID NO: 927106 - protein, 9 aa, Homo Sapiens
ALLRISVLC

SEQ ID NO: 927107 - protein, 9 aa, Homo Sapiens
IVYIDELSS

SEQ ID NO: 927108 - protein, 9 aa, Homo Sapiens
QPPPSEPVP

SEQ ID NO: 927109 - protein, 9 aa, Homo Sapiens
VQDGSPDMA

SEQ ID NO: 927110 - protein, 9 aa, Homo Sapiens
SLVLYGASN

SEQ ID NO: 927111 - protein, 9 aa, Homo Sapiens
VRASRLLFQ

SEQ ID NO: 927112 - protein, 9 aa, Homo Sapiens
GHQQGSPPP

SEQ ID NO: 927113 - protein, 9 aa, Homo Sapiens
VDYGLKPRQ

SEQ ID NO: 927114 - protein, 9 aa, Homo Sapiens
NEDCVFDRR

SEQ ID NO: 927115 - protein, 9 aa, Homo Sapiens
LGSSVLTGR

SEQ ID NO: 927116 - protein, 9 aa, Homo Sapiens
RDFRGIGGL

SEQ ID NO: 927117 - protein, 9 aa, Homo Sapiens
VNVTYFPFD

SEQ ID NO: 927118 - protein, 9 aa, Homo Sapiens
EQDLNVDYG

SEQ ID NO: 927119 - protein, 9 aa, Homo Sapiens
RCLQKFYMN

SEQ ID NO: 927120 - protein, 9 aa, Homo Sapiens
LAYLTPGAQ

SEQ ID NO: 927121 - protein, 9 aa, Homo Sapiens
TDYLVGMRV

SEQ ID NO: 927122 - protein, 9 aa, Homo Sapiens
TWSFPALAF

SEQ ID NO: 927123 - protein, 9 aa, Homo Sapiens
PEASHNTRG

SEQ ID NO: 927124 - protein, 9 aa, Homo Sapiens
APIIRVRGA

SEQ ID NO: 927125 - protein, 9 aa, Homo Sapiens
RCYIILTQS

SEQ ID NO: 927126 - protein, 9 aa, Homo Sapiens
AAHGSGEAL

SEQ ID NO: 927127 - protein, 9 aa, Homo Sapiens
FYMNSVSFL

SEQ ID NO: 927128 - protein, 9 aa, Homo Sapiens
VKTPKDKKD

SEQ ID NO: 927129 - protein, 9 aa, Homo Sapiens
ANSISCSSP

SEQ ID NO: 927130 - protein, 9 aa, Homo Sapiens
IVDCGFEQP

SEQ ID NO: 927131 - protein, 9 aa, Homo Sapiens
CKLLEKFNL

SEQ ID NO: 927132 - protein, 9 aa, Homo Sapiens
KVFLSGKDV

SEQ ID NO: 927133 - protein, 9 aa, Homo Sapiens
QGPRGEPGL

SEQ ID NO: 927134 - protein, 9 aa, Homo Sapiens
SPVILACLI

SEQ ID NO: 927135 - protein, 9 aa, Homo Sapiens
VKIEREQHQ

SEQ ID NO: 927136 - protein, 9 aa, Homo Sapiens
LQKLYLNDN

SEQ ID NO: 927137 - protein, 9 aa, Homo Sapiens
YPDSVSIIQ

SEQ ID NO: 927138 - protein, 9 aa, Homo Sapiens
VLFSSLQIK

SEQ ID NO: 927139 - protein, 9 aa, Homo Sapiens
SQVQCEQVH

SEQ ID NO: 927140 - protein, 9 aa, Homo Sapiens
LVCAFSNSC

SEQ ID NO: 927141 - protein, 9 aa, Homo Sapiens
IGILRQRYQ

SEQ ID NO: 927142 - protein, 9 aa, Homo Sapiens
ELVMKILSD

SEQ ID NO: 927143 - protein, 9 aa, Homo Sapiens
RNWEEAEQF

SEQ ID NO: 927144 - protein, 9 aa, Homo Sapiens
EKEKHNQLS

SEQ ID NO: 927145 - protein, 9 aa, Homo Sapiens
LRNLKFVQN

SEQ ID NO: 927146 - protein, 9 aa, Homo Sapiens
LKFVQNSHF

SEQ ID NO: 927147 - protein, 9 aa, Homo Sapiens
YECATYRRP

SEQ ID NO: 927148 - protein, 9 aa, Homo Sapiens
ALAEVQEDL

SEQ ID NO: 927149 - protein, 9 aa, Homo Sapiens
QTPYQLDLA

SEQ ID NO: 927150 - protein, 9 aa, Homo Sapiens
KEGELELSG

SEQ ID NO: 927151 - protein, 9 aa, Homo Sapiens
ASPNGPPVS

SEQ ID NO: 927152 - protein, 9 aa, Homo Sapiens
SGRSGSTAG

SEQ ID NO: 927153 - protein, 9 aa, Homo Sapiens
SALHCPAAC

SEQ ID NO: 927154 - protein, 9 aa, Homo Sapiens
MKILSDLLK

SEQ ID NO: 927155 - protein, 9 aa, Homo Sapiens
ALSLEDQPL

SEQ ID NO: 927156 - protein, 9 aa, Homo Sapiens
VWFAAGSES

SEQ ID NO: 927157 - protein, 9 aa, Homo Sapiens
RAAILVTPC

SEQ ID NO: 927158 - protein, 9 aa, Homo Sapiens
MLLPLNGEL

SEQ ID NO: 927159 - protein, 9 aa, Homo Sapiens
RQFRSLRHK

SEQ ID NO: 927160 - protein, 9 aa, Homo Sapiens
GFKFLQSFN

SEQ ID NO: 927161 - protein, 9 aa, Homo Sapiens
YCLWDSGRD

SEQ ID NO: 927162 - protein, 9 aa, Homo Sapiens
RGLQLVANL

SEQ ID NO: 927163 - protein, 9 aa, Homo Sapiens
ATIVIGFPD

SEQ ID NO: 927164 - protein, 9 aa, Homo Sapiens
TALAEDTSD

SEQ ID NO: 927165 - protein, 9 aa, Homo Sapiens
DGTAKNPFL

SEQ ID NO: 927166 - protein, 9 aa, Homo Sapiens
RDFHNPVVE

SEQ ID NO: 927167 - protein, 9 aa, Homo Sapiens
EPPGIPGMK

SEQ ID NO: 927168 - protein, 9 aa, Homo Sapiens
SGSTAGSGR

SEQ ID NO: 927169 - protein, 9 aa, Homo Sapiens
GTQNEFITG

SEQ ID NO: 927170 - protein, 9 aa, Homo Sapiens
LDNKKDNLD

SEQ ID NO: 927171 - protein, 9 aa, Homo Sapiens
CLQKFYMNS

SEQ ID NO: 927172 - protein, 9 aa, Homo Sapiens
LDDITVSSN

SEQ ID NO: 927173 - protein, 9 aa, Homo Sapiens
NKIFKDEMN

SEQ ID NO: 927174 - protein, 9 aa, Homo Sapiens
FFNDRLLVY

SEQ ID NO: 927175 - protein, 9 aa, Homo Sapiens
CLFPILPSD

SEQ ID NO: 927176 - protein, 9 aa, Homo Sapiens
ICESCLFPI

SEQ ID NO: 927177 - protein, 9 aa, Homo Sapiens
KANVVVLVA

SEQ ID NO: 927178 - protein, 9 aa, Homo Sapiens
PRGPKSDPG

SEQ ID NO: 927179 - protein, 9 aa, Homo Sapiens
QEVTLQAFD

SEQ ID NO: 927180 - protein, 9 aa, Homo Sapiens
SSDAHIPVL

SEQ ID NO: 927181 - protein, 9 aa, Homo Sapiens
FLSIKESAT

SEQ ID NO: 927182 - protein, 9 aa, Homo Sapiens
ILDKVEMKQ

SEQ ID NO: 927183 - protein, 9 aa, Homo Sapiens
LSQYPNLSQ

SEQ ID NO: 927184 - protein, 9 aa, Homo Sapiens
EDSVTPNDF

SEQ ID NO: 927185 - protein, 9 aa, Homo Sapiens
PSSPIYDSV

SEQ ID NO: 927186 - protein, 9 aa, Homo Sapiens
PVQIRNYFS

SEQ ID NO: 927187 - protein, 9 aa, Homo Sapiens
VSMMSEDKK

SEQ ID NO: 927188 - protein, 9 aa, Homo Sapiens
DHHKIMHRV

SEQ ID NO: 927189 - protein, 9 aa, Homo Sapiens
IASPRRSKS

SEQ ID NO: 927190 - protein, 9 aa, Homo Sapiens
SIACNTKQL

SEQ ID NO: 927191 - protein, 9 aa, Homo Sapiens
LLNQTKVFL

SEQ ID NO: 927192 - protein, 9 aa, Homo Sapiens
EKDYIFSSY

SEQ ID NO: 927193 - protein, 9 aa, Homo Sapiens
VDGTAKNPF

SEQ ID NO: 927194 - protein, 9 aa, Homo Sapiens
FDHIRAVIE

SEQ ID NO: 927195 - protein, 9 aa, Homo Sapiens
EAEKQLLKS

SEQ ID NO: 927196 - protein, 9 aa, Homo Sapiens
VWVLSRNSL

SEQ ID NO: 927197 - protein, 9 aa, Homo Sapiens
FFIKRQFRS

SEQ ID NO: 927198 - protein, 9 aa, Homo Sapiens
SNKDVYFHH

SEQ ID NO: 927199 - protein, 9 aa, Homo Sapiens
RSCHPPGIY

SEQ ID NO: 927200 - protein, 9 aa, Homo Sapiens
EQILDKVEM

SEQ ID NO: 927201 - protein, 9 aa, Homo Sapiens
NKGDLLVII

SEQ ID NO: 927202 - protein, 9 aa, Homo Sapiens
QPCLDWAAT

SEQ ID NO: 927203 - protein, 9 aa, Homo Sapiens
PSKLFWGPY

SEQ ID NO: 927204 - protein, 9 aa, Homo Sapiens
TPKSRYTFK

SEQ ID NO: 927205 - protein, 9 aa, Homo Sapiens
GSSGWSSGL

SEQ ID NO: 927206 - protein, 9 aa, Homo Sapiens
VLSFDAGVF

SEQ ID NO: 927207 - protein, 9 aa, Homo Sapiens
ATMKSRWSG

SEQ ID NO: 927208 - protein, 9 aa, Homo Sapiens
KKANVVVLV

SEQ ID NO: 927209 - protein, 9 aa, Homo Sapiens
DSSLATRHR

SEQ ID NO: 927210 - protein, 9 aa, Homo Sapiens
GWSSGLAQN

SEQ ID NO: 927211 - protein, 9 aa, Homo Sapiens
SPAPSSSSF

SEQ ID NO: 927212 - protein, 9 aa, Homo Sapiens
LTIRPPPSL

SEQ ID NO: 927213 - protein, 9 aa, Homo Sapiens
GTQASDSEG

SEQ ID NO: 927214 - protein, 9 aa, Homo Sapiens
ATQSNENTI

SEQ ID NO: 927215 - protein, 9 aa, Homo Sapiens
LMCTGPESR

SEQ ID NO: 927216 - protein, 9 aa, Homo Sapiens
KQLKTSCKE

SEQ ID NO: 927217 - protein, 9 aa, Homo Sapiens
PNGSVLPPT

SEQ ID NO: 927218 - protein, 9 aa, Homo Sapiens
PSCSALHCP

SEQ ID NO: 927219 - protein, 9 aa, Homo Sapiens
TETVSPLSS

SEQ ID NO: 927220 - protein, 9 aa, Homo Sapiens
DEKEKFLMD

SEQ ID NO: 927221 - protein, 9 aa, Homo Sapiens
SVSIIQKYG

SEQ ID NO: 927222 - protein, 9 aa, Homo Sapiens
VDLGLEKNG

SEQ ID NO: 927223 - protein, 9 aa, Homo Sapiens
VSHRLCAVS

SEQ ID NO: 927224 - protein, 9 aa, Homo Sapiens
GIPQSPLDN

SEQ ID NO: 927225 - protein, 9 aa, Homo Sapiens
NICESCLFP

SEQ ID NO: 927226 - protein, 9 aa, Homo Sapiens
CFNTVLLFS

SEQ ID NO: 927227 - protein, 9 aa, Homo Sapiens
PGEGDRGQH

SEQ ID NO: 927228 - protein, 9 aa, Homo Sapiens
IWMANHTGW

SEQ ID NO: 927229 - protein, 9 aa, Homo Sapiens
QVSYSQASP

SEQ ID NO: 927230 - protein, 9 aa, Homo Sapiens
AMFCCKKDI

SEQ ID NO: 927231 - protein, 9 aa, Homo Sapiens
AEGPPGLPE

SEQ ID NO: 927232 - protein, 9 aa, Homo Sapiens
TIPTPPFFS

SEQ ID NO: 927233 - protein, 9 aa, Homo Sapiens
SAEYLYSTP

SEQ ID NO: 927234 - protein, 9 aa, Homo Sapiens
KKLVIESPL

SEQ ID NO: 927235 - protein, 9 aa, Homo Sapiens
TRTLHNWKV

SEQ ID NO: 927236 - protein, 9 aa, Homo Sapiens
KDGTPRKGT

SEQ ID NO: 927237 - protein, 9 aa, Homo Sapiens
QADPELEMD

SEQ ID NO: 927238 - protein, 9 aa, Homo Sapiens
ISLRCPVSG

SEQ ID NO: 927239 - protein, 9 aa, Homo Sapiens
LSVLFSSLQ

SEQ ID NO: 927240 - protein, 9 aa, Homo Sapiens
VLSVNYTVI

SEQ ID NO: 927241 - protein, 9 aa, Homo Sapiens
SAEERKKAY

SEQ ID NO: 927242 - protein, 9 aa, Homo Sapiens
LQPCLDWAA

SEQ ID NO: 927243 - protein, 9 aa, Homo Sapiens
MECLSQYPN

SEQ ID NO: 927244 - protein, 9 aa, Homo Sapiens
SFMAPSCSA

SEQ ID NO: 927245 - protein, 9 aa, Homo Sapiens
MKAREAAVR

SEQ ID NO: 927246 - protein, 9 aa, Homo Sapiens
PLSSSMDLL

SEQ ID NO: 927247 - protein, 9 aa, Homo Sapiens
QSTTSVYSF

SEQ ID NO: 927248 - protein, 9 aa, Homo Sapiens
EWQEIRQIL

SEQ ID NO: 927249 - protein, 9 aa, Homo Sapiens
GLDEYLNKL

SEQ ID NO: 927250 - protein, 9 aa, Homo Sapiens
GKMKQSKEK

SEQ ID NO: 927251 - protein, 9 aa, Homo Sapiens
RNSLIAAPL

SEQ ID NO: 927252 - protein, 9 aa, Homo Sapiens
NLVSKKSSF

SEQ ID NO: 927253 - protein, 9 aa, Homo Sapiens
QKLWDVFNM

SEQ ID NO: 927254 - protein, 9 aa, Homo Sapiens
RRPYPDAFQ

SEQ ID NO: 927255 - protein, 9 aa, Homo Sapiens
GSGENGDDS

SEQ ID NO: 927256 - protein, 9 aa, Homo Sapiens
KDTICEEIQ

SEQ ID NO: 927257 - protein, 9 aa, Homo Sapiens
PSLFFNDRL

SEQ ID NO: 927258 - protein, 9 aa, Homo Sapiens
SYQCGVCGK

SEQ ID NO: 927259 - protein, 9 aa, Homo Sapiens
SFLSKSDQS

SEQ ID NO: 927260 - protein, 9 aa, Homo Sapiens
ASLGGIIYL

SEQ ID NO: 927261 - protein, 9 aa, Homo Sapiens
PSFEVHYCS

SEQ ID NO: 927262 - protein, 9 aa, Homo Sapiens
KFLQSFNDV

SEQ ID NO: 927263 - protein, 9 aa, Homo Sapiens
PFIKEPHWL

SEQ ID NO: 927264 - protein, 9 aa, Homo Sapiens
ADQKLGSNS

SEQ ID NO: 927265 - protein, 9 aa, Homo Sapiens
IPLKEGELE

SEQ ID NO: 927266 - protein, 9 aa, Homo Sapiens
SSSFSSSST

SEQ ID NO: 927267 - protein, 9 aa, Homo Sapiens
IEIQELQVF

SEQ ID NO: 927268 - protein, 9 aa, Homo Sapiens
ERESSLSNG

SEQ ID NO: 927269 - protein, 9 aa, Homo Sapiens
GSTAGSGRN

SEQ ID NO: 927270 - protein, 9 aa, Homo Sapiens
NVTYFPFDN

SEQ ID NO: 927271 - protein, 9 aa, Homo Sapiens
TDSGQCPER

SEQ ID NO: 927272 - protein, 9 aa, Homo Sapiens
NPPGKMKQS

SEQ ID NO: 927273 - protein, 9 aa, Homo Sapiens
KILSDLLKR

SEQ ID NO: 927274 - protein, 9 aa, Homo Sapiens
NAVNSVWEE

SEQ ID NO: 927275 - protein, 9 aa, Homo Sapiens
WSFPALAFA

SEQ ID NO: 927276 - protein, 9 aa, Homo Sapiens
STFISIQSA

SEQ ID NO: 927277 - protein, 9 aa, Homo Sapiens
RGALKAPSQ

SEQ ID NO: 927278 - protein, 9 aa, Homo Sapiens
SYICFKCGK

SEQ ID NO: 927279 - protein, 9 aa, Homo Sapiens
RLINLDFCI

SEQ ID NO: 927280 - protein, 9 aa, Homo Sapiens
QPVVPRPEA

SEQ ID NO: 927281 - protein, 9 aa, Homo Sapiens
EALWKVATF

SEQ ID NO: 927282 - protein, 9 aa, Homo Sapiens
ILRLKHQCP

SEQ ID NO: 927283 - protein, 9 aa, Homo Sapiens
GVGINQPPF

SEQ ID NO: 927284 - protein, 9 aa, Homo Sapiens
ARMVQSGGG

SEQ ID NO: 927285 - protein, 9 aa, Homo Sapiens
IKRQFRSLR

SEQ ID NO: 927286 - protein, 9 aa, Homo Sapiens
STTDAAGFK

SEQ ID NO: 927287 - protein, 9 aa, Homo Sapiens
DSGLEKMAN

SEQ ID NO: 927288 - protein, 9 aa, Homo Sapiens
VSVLNPRQS

SEQ ID NO: 927289 - protein, 9 aa, Homo Sapiens
ALRQREHFS

SEQ ID NO: 927290 - protein, 9 aa, Homo Sapiens
PSTAEITCK

SEQ ID NO: 927291 - protein, 9 aa, Homo Sapiens
GLQGPPEPP

SEQ ID NO: 927292 - protein, 9 aa, Homo Sapiens
VLMCTGPES

SEQ ID NO: 927293 - protein, 9 aa, Homo Sapiens
VRLGLLKLT

SEQ ID NO: 927294 - protein, 9 aa, Homo Sapiens
QKTEQEKSH

SEQ ID NO: 927295 - protein, 9 aa, Homo Sapiens
SVFLFAAEN

SEQ ID NO: 927296 - protein, 9 aa, Homo Sapiens
SPIFSAKVI

SEQ ID NO: 927297 - protein, 9 aa, Homo Sapiens
PIKEISSEI

SEQ ID NO: 927298 - protein, 9 aa, Homo Sapiens
GPASGLNKS

SEQ ID NO: 927299 - protein, 9 aa, Homo Sapiens
IIPLGVTHM

SEQ ID NO: 927300 - protein, 9 aa, Homo Sapiens
PVQERIAKN

SEQ ID NO: 927301 - protein, 9 aa, Homo Sapiens
SHLSHFSSP

SEQ ID NO: 927302 - protein, 9 aa, Homo Sapiens
FLKTLLQAG

SEQ ID NO: 927303 - protein, 9 aa, Homo Sapiens
NADSSVPPR

SEQ ID NO: 927304 - protein, 9 aa, Homo Sapiens
ASKRNSERR

SEQ ID NO: 927305 - protein, 9 aa, Homo Sapiens
GPRGEPGLR

SEQ ID NO: 927306 - protein, 9 aa, Homo Sapiens
VSGSGGCSF

SEQ ID NO: 927307 - protein, 9 aa, Homo Sapiens
FSAKVIISK

SEQ ID NO: 927308 - protein, 9 aa, Homo Sapiens
GLMCGKDAD

SEQ ID NO: 927309 - protein, 9 aa, Homo Sapiens
GFAGDDAPQ

SEQ ID NO: 927310 - protein, 9 aa, Homo Sapiens
KEISSEIQQ

SEQ ID NO: 927311 - protein, 9 aa, Homo Sapiens
QCFTCTYKI

SEQ ID NO: 927312 - protein, 9 aa, Homo Sapiens
RTLHNWKVW

SEQ ID NO: 927313 - protein, 9 aa, Homo Sapiens
FSLVLRFVK

SEQ ID NO: 927314 - protein, 9 aa, Homo Sapiens
YIGSEEEEE

SEQ ID NO: 927315 - protein, 9 aa, Homo Sapiens
GLLTCHGSG

SEQ ID NO: 927316 - protein, 9 aa, Homo Sapiens
VAGKSDESG

SEQ ID NO: 927317 - protein, 9 aa, Homo Sapiens
AGERGFPGP

SEQ ID NO: 927318 - protein, 9 aa, Homo Sapiens
YIFSSYTAF

SEQ ID NO: 927319 - protein, 9 aa, Homo Sapiens
EIDWAQLNY

SEQ ID NO: 927320 - protein, 9 aa, Homo Sapiens
LEAEPPKML

SEQ ID NO: 927321 - protein, 9 aa, Homo Sapiens
AITIAIYVG

SEQ ID NO: 927322 - protein, 9 aa, Homo Sapiens
NKKDNLDPE

SEQ ID NO: 927323 - protein, 9 aa, Homo Sapiens
KKGAKGEKE

SEQ ID NO: 927324 - protein, 9 aa, Homo Sapiens
GNHGEGDQA

SEQ ID NO: 927325 - protein, 9 aa, Homo Sapiens
AEERKKAYL

SEQ ID NO: 927326 - protein, 9 aa, Homo Sapiens
NFGFKFLQS

SEQ ID NO: 927327 - protein, 9 aa, Homo Sapiens
ILACLITGY

SEQ ID NO: 927328 - protein, 9 aa, Homo Sapiens
DWAQLNYRQ

SEQ ID NO: 927329 - protein, 9 aa, Homo Sapiens
EVLHMCVEH

SEQ ID NO: 927330 - protein, 9 aa, Homo Sapiens
NYATIVIGF

SEQ ID NO: 927331 - protein, 9 aa, Homo Sapiens
QIQADPELE

SEQ ID NO: 927332 - protein, 9 aa, Homo Sapiens
YSSKSFDFA

SEQ ID NO: 927333 - protein, 9 aa, Homo Sapiens
LRAAILVTP

SEQ ID NO: 927334 - protein, 9 aa, Homo Sapiens
LDEYLNKLK

SEQ ID NO: 927335 - protein, 9 aa, Homo Sapiens
CIIRRRLSA

SEQ ID NO: 927336 - protein, 9 aa, Homo Sapiens
GLNKSLGAS

SEQ ID NO: 927337 - protein, 9 aa, Homo Sapiens
PREAVLFKT

SEQ ID NO: 927338 - protein, 9 aa, Homo Sapiens
LINLVAILP

SEQ ID NO: 927339 - protein, 9 aa, Homo Sapiens
KTTQSMRSG

SEQ ID NO: 927340 - protein, 9 aa, Homo Sapiens
MPKSQKLWD

SEQ ID NO: 927341 - protein, 9 aa, Homo Sapiens
DLIDASVAK

SEQ ID NO: 927342 - protein, 9 aa, Homo Sapiens
LKYVSATSV

SEQ ID NO: 927343 - protein, 9 aa, Homo Sapiens
TSSNKDVYF

SEQ ID NO: 927344 - protein, 9 aa, Homo Sapiens
SSCVVNVTY

SEQ ID NO: 927345 - protein, 9 aa, Homo Sapiens
NQTKVFLSG

SEQ ID NO: 927346 - protein, 9 aa, Homo Sapiens
ENICESCLF

SEQ ID NO: 927347 - protein, 9 aa, Homo Sapiens
SEEVPPCQT

SEQ ID NO: 927348 - protein, 9 aa, Homo Sapiens
ERNVKKDGA

SEQ ID NO: 927349 - protein, 9 aa, Homo Sapiens
PQEVTLQAF

SEQ ID NO: 927350 - protein, 9 aa, Homo Sapiens
TSSSSSDSS

SEQ ID NO: 927351 - protein, 9 aa, Homo Sapiens
SLSGVSTND

SEQ ID NO: 927352 - protein, 9 aa, Homo Sapiens
RKKIEQMFQ

SEQ ID NO: 927353 - protein, 9 aa, Homo Sapiens
DQKLGSNSP

SEQ ID NO: 927354 - protein, 9 aa, Homo Sapiens
AILHASRSS

SEQ ID NO: 927355 - protein, 9 aa, Homo Sapiens
LANVIYKEQ

SEQ ID NO: 927356 - protein, 9 aa, Homo Sapiens
SHRLCAVSQ

SEQ ID NO: 927357 - protein, 9 aa, Homo Sapiens
KHPMANIIW

SEQ ID NO: 927358 - protein, 9 aa, Homo Sapiens
CPERYTCVK

SEQ ID NO: 927359 - protein, 9 aa, Homo Sapiens
YNHEGITGS

SEQ ID NO: 927360 - protein, 9 aa, Homo Sapiens
EAGTAYIQT

SEQ ID NO: 927361 - protein, 9 aa, Homo Sapiens
RGKNFFRGQ

SEQ ID NO: 927362 - protein, 9 aa, Homo Sapiens
MFSRLKQIC

SEQ ID NO: 927363 - protein, 9 aa, Homo Sapiens
LTLSRKKGP

SEQ ID NO: 927364 - protein, 9 aa, Homo Sapiens
DSIYLGNIA

SEQ ID NO: 927365 - protein, 9 aa, Homo Sapiens
QLQPQPQLP

SEQ ID NO: 927366 - protein, 9 aa, Homo Sapiens
SRAAPGPRA

SEQ ID NO: 927367 - protein, 9 aa, Homo Sapiens
PSHRAQTPR

SEQ ID NO: 927368 - protein, 9 aa, Homo Sapiens
QGGHQQGSP

SEQ ID NO: 927369 - protein, 9 aa, Homo Sapiens
TLGKSFCSW

SEQ ID NO: 927370 - protein, 9 aa, Homo Sapiens
SDREKDYIF

SEQ ID NO: 927371 - protein, 9 aa, Homo Sapiens
YKLIAQRSK

SEQ ID NO: 927372 - protein, 9 aa, Homo Sapiens
GESAVGKFS

SEQ ID NO: 927373 - protein, 9 aa, Homo Sapiens
EVSVLNPRQ

SEQ ID NO: 927374 - protein, 9 aa, Homo Sapiens
DIVEVQESP

SEQ ID NO: 927375 - protein, 9 aa, Homo Sapiens
CFKCGKAFT

SEQ ID NO: 927376 - protein, 9 aa, Homo Sapiens
EGPPGLPEK

SEQ ID NO: 927377 - protein, 9 aa, Homo Sapiens
LASFLEDLQ

SEQ ID NO: 927378 - protein, 9 aa, Homo Sapiens
ESQWKDSSL

SEQ ID NO: 927379 - protein, 9 aa, Homo Sapiens
VIESEFIGI

SEQ ID NO: 927380 - protein, 9 aa, Homo Sapiens
QPWSFPKGS

SEQ ID NO: 927381 - protein, 9 aa, Homo Sapiens
QSSNLQCFT

SEQ ID NO: 927382 - protein, 9 aa, Homo Sapiens
AGFKRHVIS

SEQ ID NO: 927383 - protein, 9 aa, Homo Sapiens
KRNWEEAEQ

SEQ ID NO: 927384 - protein, 9 aa, Homo Sapiens
IPSFQTYES

SEQ ID NO: 927385 - protein, 9 aa, Homo Sapiens
MYGERLAVS

SEQ ID NO: 927386 - protein, 9 aa, Homo Sapiens
IDGIKMEKS

SEQ ID NO: 927387 - protein, 9 aa, Homo Sapiens
SVDEVFDDS

SEQ ID NO: 927388 - protein, 9 aa, Homo Sapiens
RNFHSAASR

SEQ ID NO: 927389 - protein, 9 aa, Homo Sapiens
WFAAGSESP

SEQ ID NO: 927390 - protein, 9 aa, Homo Sapiens
LFQLKEEEL

SEQ ID NO: 927391 - protein, 9 aa, Homo Sapiens
AEEAIIGTN

SEQ ID NO: 927392 - protein, 9 aa, Homo Sapiens
YSQASPNGP

SEQ ID NO: 927393 - protein, 9 aa, Homo Sapiens
PVSREENQE

SEQ ID NO: 927394 - protein, 9 aa, Homo Sapiens
TSSANFDTF

SEQ ID NO: 927395 - protein, 9 aa, Homo Sapiens
NVDYGLKPR

SEQ ID NO: 927396 - protein, 9 aa, Homo Sapiens
KPRTEYELC

SEQ ID NO: 927397 - protein, 9 aa, Homo Sapiens
EENLATQSS

SEQ ID NO: 927398 - protein, 9 aa, Homo Sapiens
EDRLIRGRT

SEQ ID NO: 927399 - protein, 9 aa, Homo Sapiens
FSQGSEEYE

SEQ ID NO: 927400 - protein, 9 aa, Homo Sapiens
KANQEKMTQ

SEQ ID NO: 927401 - protein, 9 aa, Homo Sapiens
QRARAQTPQ

SEQ ID NO: 927402 - protein, 9 aa, Homo Sapiens
SWRNGPKGS

SEQ ID NO: 927403 - protein, 9 aa, Homo Sapiens
RSVKKKLVI

SEQ ID NO: 927404 - protein, 9 aa, Homo Sapiens
GSPPPPPGK

SEQ ID NO: 927405 - protein, 9 aa, Homo Sapiens
SQNTSIPIR

SEQ ID NO: 927406 - protein, 9 aa, Homo Sapiens
DCGFEQPSE

SEQ ID NO: 927407 - protein, 9 aa, Homo Sapiens
RSLSAELKI

SEQ ID NO: 927408 - protein, 9 aa, Homo Sapiens
EDCVFDRRY

SEQ ID NO: 927409 - protein, 9 aa, Homo Sapiens
PDLNLLSED

SEQ ID NO: 927410 - protein, 9 aa, Homo Sapiens
LIASPRRSK

SEQ ID NO: 927411 - protein, 9 aa, Homo Sapiens
PELEMDLES

SEQ ID NO: 927412 - protein, 9 aa, Homo Sapiens
WGQIKRLTS

SEQ ID NO: 927413 - protein, 9 aa, Homo Sapiens
GEGDQALNG

SEQ ID NO: 927414 - protein, 9 aa, Homo Sapiens
KGEKENAGF

SEQ ID NO: 927415 - protein, 9 aa, Homo Sapiens
AQLRQFSQG

SEQ ID NO: 927416 - protein, 9 aa, Homo Sapiens
KTQQNTSIN

SEQ ID NO: 927417 - protein, 9 aa, Homo Sapiens
SGYGGTNVN

SEQ ID NO: 927418 - protein, 9 aa, Homo Sapiens
QASPNGPPV

SEQ ID NO: 927419 - protein, 9 aa, Homo Sapiens
PPLNTFRDV

SEQ ID NO: 927420 - protein, 9 aa, Homo Sapiens
AQEEDPPNP

SEQ ID NO: 927421 - protein, 9 aa, Homo Sapiens
VAAANVAVT

SEQ ID NO: 927422 - protein, 9 aa, Homo Sapiens
AYIQTQQLH

SEQ ID NO: 927423 - protein, 9 aa, Homo Sapiens
EAENSNGSS

SEQ ID NO: 927424 - protein, 9 aa, Homo Sapiens
AMAAGFWVT

SEQ ID NO: 927425 - protein, 9 aa, Homo Sapiens
TAICLLASL

SEQ ID NO: 927426 - protein, 9 aa, Homo Sapiens
RQMVWVLSR

SEQ ID NO: 927427 - protein, 9 aa, Homo Sapiens
NKSLGASCK

SEQ ID NO: 927428 - protein, 9 aa, Homo Sapiens
GLQLVANLM

SEQ ID NO: 927429 - protein, 9 aa, Homo Sapiens
LTANQTLIG

SEQ ID NO: 927430 - protein, 9 aa, Homo Sapiens
HFFCDIYLV

SEQ ID NO: 927431 - protein, 9 aa, Homo Sapiens
GKDKGVVYS

SEQ ID NO: 927432 - protein, 9 aa, Homo Sapiens
EKQLLKSSA

SEQ ID NO: 927433 - protein, 9 aa, Homo Sapiens
KGPAGERGF

SEQ ID NO: 927434 - protein, 9 aa, Homo Sapiens
IKDNKNNFS

SEQ ID NO: 927435 - protein, 9 aa, Homo Sapiens
STGLKPCDC

SEQ ID NO: 927436 - protein, 9 aa, Homo Sapiens
GGGKHGPAG

SEQ ID NO: 927437 - protein, 9 aa, Homo Sapiens
KSALQAEDK

SEQ ID NO: 927438 - protein, 9 aa, Homo Sapiens
HSGMKLYKC

SEQ ID NO: 927439 - protein, 9 aa, Homo Sapiens
TWTSKYSIN

SEQ ID NO: 927440 - protein, 9 aa, Homo Sapiens
CYIILTQSL

SEQ ID NO: 927441 - protein, 9 aa, Homo Sapiens
DSQGSGKEE

SEQ ID NO: 927442 - protein, 9 aa, Homo Sapiens
KVWVFSILI

SEQ ID NO: 927443 - protein, 9 aa, Homo Sapiens
RSGSTAGSG

SEQ ID NO: 927444 - protein, 9 aa, Homo Sapiens
PEDSISLVF

SEQ ID NO: 927445 - protein, 9 aa, Homo Sapiens
YGERLAVSK

SEQ ID NO: 927446 - protein, 9 aa, Homo Sapiens
ATSEEEVKF

SEQ ID NO: 927447 - protein, 9 aa, Homo Sapiens
RPGNFYVFS

SEQ ID NO: 927448 - protein, 9 aa, Homo Sapiens
WSQEALVSV

SEQ ID NO: 927449 - protein, 9 aa, Homo Sapiens
YLTFSVAMF

SEQ ID NO: 927450 - protein, 9 aa, Homo Sapiens
AVLFKTKLD

SEQ ID NO: 927451 - protein, 9 aa, Homo Sapiens
LVFGSVFLF

SEQ ID NO: 927452 - protein, 9 aa, Homo Sapiens
VVNLANVIY

SEQ ID NO: 927453 - protein, 9 aa, Homo Sapiens
GRQRETAGG

SEQ ID NO: 927454 - protein, 9 aa, Homo Sapiens
KFVQNSHFK

SEQ ID NO: 927455 - protein, 9 aa, Homo Sapiens
SWNLLICLS

SEQ ID NO: 927456 - protein, 9 aa, Homo Sapiens
DREKDYIFS

SEQ ID NO: 927457 - protein, 9 aa, Homo Sapiens
QPIDGIKME

SEQ ID NO: 927458 - protein, 9 aa, Homo Sapiens
NGLTFSFIC

SEQ ID NO: 927459 - protein, 9 aa, Homo Sapiens
SKSFDFASS

SEQ ID NO: 927460 - protein, 9 aa, Homo Sapiens
RGRQRETAG

SEQ ID NO: 927461 - protein, 9 aa, Homo Sapiens
SLFVSLNRL

SEQ ID NO: 927462 - protein, 9 aa, Homo Sapiens
WYQGNYIYG

SEQ ID NO: 927463 - protein, 9 aa, Homo Sapiens
GSGRNILRL

SEQ ID NO: 927464 - protein, 9 aa, Homo Sapiens
ESVDEVFDD

SEQ ID NO: 927465 - protein, 9 aa, Homo Sapiens
LASASPVAG

SEQ ID NO: 927466 - protein, 9 aa, Homo Sapiens
ACNTKQLNC

SEQ ID NO: 927467 - protein, 9 aa, Homo Sapiens
QIEVGAFNS

SEQ ID NO: 927468 - protein, 9 aa, Homo Sapiens
AEAAKVAVS

SEQ ID NO: 927469 - protein, 9 aa, Homo Sapiens
PAHEQLTSP

SEQ ID NO: 927470 - protein, 9 aa, Homo Sapiens
YSYQIKMCS

SEQ ID NO: 927471 - protein, 9 aa, Homo Sapiens
GLSLLLLLT

SEQ ID NO: 927472 - protein, 9 aa, Homo Sapiens
SNENSEGFH

SEQ ID NO: 927473 - protein, 9 aa, Homo Sapiens
HTLILVKDL

SEQ ID NO: 927474 - protein, 9 aa, Homo Sapiens
KILMDLKYV

SEQ ID NO: 927475 - protein, 9 aa, Homo Sapiens
GSHLTVVLF

SEQ ID NO: 927476 - protein, 9 aa, Homo Sapiens
LAALIRRNR

SEQ ID NO: 927477 - protein, 9 aa, Homo Sapiens
LRPALPTWV

SEQ ID NO: 927478 - protein, 9 aa, Homo Sapiens
PNGVTSRRP

SEQ ID NO: 927479 - protein, 9 aa, Homo Sapiens
IVDNEDSVT

SEQ ID NO: 927480 - protein, 9 aa, Homo Sapiens
HLPLQEEEL

SEQ ID NO: 927481 - protein, 9 aa, Homo Sapiens
RNLVSKKSS

SEQ ID NO: 927482 - protein, 9 aa, Homo Sapiens
ELAVPLPLW

SEQ ID NO: 927483 - protein, 9 aa, Homo Sapiens
GANGKREKM

SEQ ID NO: 927484 - protein, 9 aa, Homo Sapiens
HEGITGSRG

SEQ ID NO: 927485 - protein, 9 aa, Homo Sapiens
KLVIESPLQ

SEQ ID NO: 927486 - protein, 9 aa, Homo Sapiens
GKWTTLPVC

SEQ ID NO: 927487 - protein, 9 aa, Homo Sapiens
HREGDVYFD

SEQ ID NO: 927488 - protein, 9 aa, Homo Sapiens
QNEFITGYK

SEQ ID NO: 927489 - protein, 9 aa, Homo Sapiens
LHFFAGGCG

SEQ ID NO: 927490 - protein, 9 aa, Homo Sapiens
VQSGGGSAN

SEQ ID NO: 927491 - protein, 9 aa, Homo Sapiens
ISITLKPAQ

SEQ ID NO: 927492 - protein, 9 aa, Homo Sapiens
EYIGSEEEE

SEQ ID NO: 927493 - protein, 9 aa, Homo Sapiens
QYCPSRWAV

SEQ ID NO: 927494 - protein, 9 aa, Homo Sapiens
NRYTTEFDV

SEQ ID NO: 927495 - protein, 9 aa, Homo Sapiens
ALHCPAACT

SEQ ID NO: 927496 - protein, 9 aa, Homo Sapiens
CSALHCPAA

SEQ ID NO: 927497 - protein, 9 aa, Homo Sapiens
QVLELSEAL

SEQ ID NO: 927498 - protein, 9 aa, Homo Sapiens
KLLEKFNLV

SEQ ID NO: 927499 - protein, 9 aa, Homo Sapiens
DIIPLGVTH

SEQ ID NO: 927500 - protein, 9 aa, Homo Sapiens
SAHNLLYKE

SEQ ID NO: 927501 - protein, 9 aa, Homo Sapiens
IFFKTPRKV

SEQ ID NO: 927502 - protein, 9 aa, Homo Sapiens
STTSVYSFF

SEQ ID NO: 927503 - protein, 9 aa, Homo Sapiens
KLQKFDLFL

SEQ ID NO: 927504 - protein, 9 aa, Homo Sapiens
CHCCVLAAC

SEQ ID NO: 927505 - protein, 9 aa, Homo Sapiens
MYFGCPEDR

SEQ ID NO: 927506 - protein, 9 aa, Homo Sapiens
LGSWNLLIC

SEQ ID NO: 927507 - protein, 9 aa, Homo Sapiens
NVTPKSRYT

SEQ ID NO: 927508 - protein, 9 aa, Homo Sapiens
SLKASKDTI

SEQ ID NO: 927509 - protein, 9 aa, Homo Sapiens
LLEKFNLVQ

SEQ ID NO: 927510 - protein, 9 aa, Homo Sapiens
ALIRRNRKN

SEQ ID NO: 927511 - protein, 9 aa, Homo Sapiens
PLNGELVLA

SEQ ID NO: 927512 - protein, 9 aa, Homo Sapiens
VSPEARSEH

SEQ ID NO: 927513 - protein, 9 aa, Homo Sapiens
RGWHAGGDA

SEQ ID NO: 927514 - protein, 9 aa, Homo Sapiens
VSPSASASR

SEQ ID NO: 927515 - protein, 9 aa, Homo Sapiens
LAVCLAPTT

SEQ ID NO: 927516 - protein, 9 aa, Homo Sapiens
LQKQLSLLP

SEQ ID NO: 927517 - protein, 9 aa, Homo Sapiens
NKDVYFHHV

SEQ ID NO: 927518 - protein, 9 aa, Homo Sapiens
SQKLWDVFN

SEQ ID NO: 927519 - protein, 9 aa, Homo Sapiens
NLLYKENIS

SEQ ID NO: 927520 - protein, 9 aa, Homo Sapiens
RIHSGMKLY

SEQ ID NO: 927521 - protein, 9 aa, Homo Sapiens
HTETVSPLS

SEQ ID NO: 927522 - protein, 9 aa, Homo Sapiens
DFCIDHSYY

SEQ ID NO: 927523 - protein, 9 aa, Homo Sapiens
GNFLFIIGF

SEQ ID NO: 927524 - protein, 9 aa, Homo Sapiens
RNIPPEIGE

SEQ ID NO: 927525 - protein, 9 aa, Homo Sapiens
DSSDPDTSY

SEQ ID NO: 927526 - protein, 9 aa, Homo Sapiens
SNKGDLLVI

SEQ ID NO: 927527 - protein, 9 aa, Homo Sapiens
PMVEALCGQ

SEQ ID NO: 927528 - protein, 9 aa, Homo Sapiens
KKEHCYLLH

SEQ ID NO: 927529 - protein, 9 aa, Homo Sapiens
FQDFFNQNE

SEQ ID NO: 927530 - protein, 9 aa, Homo Sapiens
EELNKMCHK

SEQ ID NO: 927531 - protein, 9 aa, Homo Sapiens
ATNSNNYNI

SEQ ID NO: 927532 - protein, 9 aa, Homo Sapiens
SIYKLIALL

SEQ ID NO: 927533 - protein, 9 aa, Homo Sapiens
HQVKLKAFR

SEQ ID NO: 927534 - protein, 9 aa, Homo Sapiens
EELPLVQQQ

SEQ ID NO: 927535 - protein, 9 aa, Homo Sapiens
ENKIFKDEM

SEQ ID NO: 927536 - protein, 9 aa, Homo Sapiens
SSSGLKTQQ

SEQ ID NO: 927537 - protein, 9 aa, Homo Sapiens
PASGLNKSL

SEQ ID NO: 927538 - protein, 9 aa, Homo Sapiens
MANIIWMAN

SEQ ID NO: 927539 - protein, 9 aa, Homo Sapiens
DKFQDFFNQ

SEQ ID NO: 927540 - protein, 9 aa, Homo Sapiens
ARGSPSGRS

SEQ ID NO: 927541 - protein, 9 aa, Homo Sapiens
LHNWKVWVF

SEQ ID NO: 927542 - protein, 9 aa, Homo Sapiens
EASHNTRGS

SEQ ID NO: 927543 - protein, 9 aa, Homo Sapiens
TRGKSYQCG

SEQ ID NO: 927544 - protein, 9 aa, Homo Sapiens
PQAVFPSIV

SEQ ID NO: 927545 - protein, 9 aa, Homo Sapiens
YICFKCGKA

SEQ ID NO: 927546 - protein, 9 aa, Homo Sapiens
ATSRKEPVV

SEQ ID NO: 927547 - protein, 9 aa, Homo Sapiens
NSVWEEEPI

SEQ ID NO: 927548 - protein, 9 aa, Homo Sapiens
SRKKGPAAR

SEQ ID NO: 927549 - protein, 9 aa, Homo Sapiens
VELAVPLPL

SEQ ID NO: 927550 - protein, 9 aa, Homo Sapiens
VVPRPEALA

SEQ ID NO: 927551 - protein, 9 aa, Homo Sapiens
ATRVDAICI

SEQ ID NO: 927552 - protein, 9 aa, Homo Sapiens
DAPQAVFPS

SEQ ID NO: 927553 - protein, 9 aa, Homo Sapiens
HNQLSEFTI

SEQ ID NO: 927554 - protein, 9 aa, Homo Sapiens
IRVRGALKA

SEQ ID NO: 927555 - protein, 9 aa, Homo Sapiens
DYIVYIDEL

SEQ ID NO: 927556 - protein, 9 aa, Homo Sapiens
RLAVSKLYP

SEQ ID NO: 927557 - protein, 9 aa, Homo Sapiens
ANVIYKEQL

SEQ ID NO: 927558 - protein, 9 aa, Homo Sapiens
PTLSIYKLI

SEQ ID NO: 927559 - protein, 9 aa, Homo Sapiens
KNPQEVTLQ

SEQ ID NO: 927560 - protein, 9 aa, Homo Sapiens
PEARSEHGR

SEQ ID NO: 927561 - protein, 9 aa, Homo Sapiens
AEVQEDLES

SEQ ID NO: 927562 - protein, 9 aa, Homo Sapiens
ESDVDVQFN

SEQ ID NO: 927563 - protein, 9 aa, Homo Sapiens
CCDSGRCIA

SEQ ID NO: 927564 - protein, 9 aa, Homo Sapiens
IRRRLSAYQ

SEQ ID NO: 927565 - protein, 9 aa, Homo Sapiens
EIIPCHCCV

SEQ ID NO: 927566 - protein, 9 aa, Homo Sapiens
SGSGGCSFP

SEQ ID NO: 927567 - protein, 9 aa, Homo Sapiens
GILRQRYQE

SEQ ID NO: 927568 - protein, 9 aa, Homo Sapiens
AASRDFRGI

SEQ ID NO: 927569 - protein, 9 aa, Homo Sapiens
KKTDGTCLF

SEQ ID NO: 927570 - protein, 9 aa, Homo Sapiens
FFKGDPKDD

SEQ ID NO: 927571 - protein, 9 aa, Homo Sapiens
LHLLEVEFL

SEQ ID NO: 927572 - protein, 9 aa, Homo Sapiens
LQKFDLFLK

SEQ ID NO: 927573 - protein, 9 aa, Homo Sapiens
CSSPCTCSN

SEQ ID NO: 927574 - protein, 9 aa, Homo Sapiens
QMHLLDGRA

SEQ ID NO: 927575 - protein, 9 aa, Homo Sapiens
RAEVLHMCV

SEQ ID NO: 927576 - protein, 9 aa, Homo Sapiens
NALIMFSRL

SEQ ID NO: 927577 - protein, 9 aa, Homo Sapiens
ETALAEDTS

SEQ ID NO: 927578 - protein, 9 aa, Homo Sapiens
VYNPTTTYL

SEQ ID NO: 927579 - protein, 9 aa, Homo Sapiens
EKFNLVQKE

SEQ ID NO: 927580 - protein, 9 aa, Homo Sapiens
QHYGFHFEG

SEQ ID NO: 927581 - protein, 9 aa, Homo Sapiens
GHLPLQEEE

SEQ ID NO: 927582 - protein, 9 aa, Homo Sapiens
DEAEDSRAA

SEQ ID NO: 927583 - protein, 9 aa, Homo Sapiens
LSRNSLIAA

SEQ ID NO: 927584 - protein, 9 aa, Homo Sapiens
LAMQSLIKY

SEQ ID NO: 927585 - protein, 9 aa, Homo Sapiens
GAKAKAILH

SEQ ID NO: 927586 - protein, 9 aa, Homo Sapiens
FQSSNLQCF

SEQ ID NO: 927587 - protein, 9 aa, Homo Sapiens
SVVNLANVI

SEQ ID NO: 927588 - protein, 9 aa, Homo Sapiens
PFRPHPGSL

SEQ ID NO: 927589 - protein, 9 aa, Homo Sapiens
NEDSVTPND

SEQ ID NO: 927590 - protein, 9 aa, Homo Sapiens
NPHTEAHVG

SEQ ID NO: 927591 - protein, 9 aa, Homo Sapiens
RKKGPAARD

SEQ ID NO: 927592 - protein, 9 aa, Homo Sapiens
DELVMKILS

SEQ ID NO: 927593 - protein, 9 aa, Homo Sapiens
KNVDMRDSY

SEQ ID NO: 927594 - protein, 9 aa, Homo Sapiens
GATSRKEPV

SEQ ID NO: 927595 - protein, 9 aa, Homo Sapiens
ARNFHSAAS

SEQ ID NO: 927596 - protein, 9 aa, Homo Sapiens
DPDTEYKIR

SEQ ID NO: 927597 - protein, 9 aa, Homo Sapiens
IFITYVFMG

SEQ ID NO: 927598 - protein, 9 aa, Homo Sapiens
MWPQMHLLD

SEQ ID NO: 927599 - protein, 9 aa, Homo Sapiens
LLQGQLQPL

SEQ ID NO: 927600 - protein, 9 aa, Homo Sapiens
NIKKLLKIS

SEQ ID NO: 927601 - protein, 9 aa, Homo Sapiens
DDLSAHNLL

SEQ ID NO: 927602 - protein, 9 aa, Homo Sapiens
LKPAQPSEG

SEQ ID NO: 927603 - protein, 9 aa, Homo Sapiens
SKALQQVLE

SEQ ID NO: 927604 - protein, 9 aa, Homo Sapiens
VDRMSFNLS

SEQ ID NO: 927605 - protein, 9 aa, Homo Sapiens
NPHEACFLN

SEQ ID NO: 927606 - protein, 9 aa, Homo Sapiens
KESEVTAML

SEQ ID NO: 927607 - protein, 9 aa, Homo Sapiens
VKWPVKLFQ

SEQ ID NO: 927608 - protein, 9 aa, Homo Sapiens
SPEDSLIIP

SEQ ID NO: 927609 - protein, 9 aa, Homo Sapiens
LLDGRAQPG

SEQ ID NO: 927610 - protein, 9 aa, Homo Sapiens
VSFKEDLAG

SEQ ID NO: 927611 - protein, 9 aa, Homo Sapiens
IRRNRKNCA

SEQ ID NO: 927612 - protein, 9 aa, Homo Sapiens
EAEDSRAAP

SEQ ID NO: 927613 - protein, 9 aa, Homo Sapiens
LKTREEVLQ

SEQ ID NO: 927614 - protein, 9 aa, Homo Sapiens
SPLTLINLV

SEQ ID NO: 927615 - protein, 9 aa, Homo Sapiens
KNLVSDIEA

SEQ ID NO: 927616 - protein, 9 aa, Homo Sapiens
TVVLFFYGS

SEQ ID NO: 927617 - protein, 9 aa, Homo Sapiens
AMSYDRCKA

SEQ ID NO: 927618 - protein, 9 aa, Homo Sapiens
KDFSVTDTC

SEQ ID NO: 927619 - protein, 9 aa, Homo Sapiens
MSSSIVFTT

SEQ ID NO: 927620 - protein, 9 aa, Homo Sapiens
TQSQCRRKK

SEQ ID NO: 927621 - protein, 9 aa, Homo Sapiens
LTDLDYCPI

SEQ ID NO: 927622 - protein, 9 aa, Homo Sapiens
DEALWKVAT

SEQ ID NO: 927623 - protein, 9 aa, Homo Sapiens
FSSSSTSSA

SEQ ID NO: 927624 - protein, 9 aa, Homo Sapiens
RPQDRIVSK

SEQ ID NO: 927625 - protein, 9 aa, Homo Sapiens
RNRMSSSIV

SEQ ID NO: 927626 - protein, 9 aa, Homo Sapiens
LHKPMYLFL

SEQ ID NO: 927627 - protein, 9 aa, Homo Sapiens
YIAVAVHNE

SEQ ID NO: 927628 - protein, 9 aa, Homo Sapiens
GDFGLATMK

SEQ ID NO: 927629 - protein, 9 aa, Homo Sapiens
LNVDYGLKP

SEQ ID NO: 927630 - protein, 9 aa, Homo Sapiens
RELVYTIPT

SEQ ID NO: 927631 - protein, 9 aa, Homo Sapiens
GEGATSRKE

SEQ ID NO: 927632 - protein, 9 aa, Homo Sapiens
NKDGTPRKG

SEQ ID NO: 927633 - protein, 9 aa, Homo Sapiens
LLMIGILRQ

SEQ ID NO: 927634 - protein, 9 aa, Homo Sapiens
LWRELDRAN

SEQ ID NO: 927635 - protein, 9 aa, Homo Sapiens
WSSGLAQNR

SEQ ID NO: 927636 - protein, 9 aa, Homo Sapiens
LNTFRDVSL

SEQ ID NO: 927637 - protein, 9 aa, Homo Sapiens
GPKRDVGPA

SEQ ID NO: 927638 - protein, 9 aa, Homo Sapiens
GDIIPLGVT

SEQ ID NO: 927639 - protein, 9 aa, Homo Sapiens
CVDGKWTTL

SEQ ID NO: 927640 - protein, 9 aa, Homo Sapiens
FQTYESMAI

SEQ ID NO: 927641 - protein, 9 aa, Homo Sapiens
IVSKAMIAY

SEQ ID NO: 927642 - protein, 9 aa, Homo Sapiens
FSNSCIPAH

SEQ ID NO: 927643 - protein, 9 aa, Homo Sapiens
VLLGGVRAS

SEQ ID NO: 927644 - protein, 9 aa, Homo Sapiens
SCTQCGQAF

SEQ ID NO: 927645 - protein, 9 aa, Homo Sapiens
IVFTTSKSH

SEQ ID NO: 927646 - protein, 9 aa, Homo Sapiens
HIKDNKNNF

SEQ ID NO: 927647 - protein, 9 aa, Homo Sapiens
YCSLSLKPS

SEQ ID NO: 927648 - protein, 9 aa, Homo Sapiens
NIAHMKARE

SEQ ID NO: 927649 - protein, 9 aa, Homo Sapiens
TGLLSHRSC

SEQ ID NO: 927650 - protein, 9 aa, Homo Sapiens
FIKRQFRSL

SEQ ID NO: 927651 - protein, 9 aa, Homo Sapiens
SSNKDVYFH

SEQ ID NO: 927652 - protein, 9 aa, Homo Sapiens
QTRPVQPVV

SEQ ID NO: 927653 - protein, 9 aa, Homo Sapiens
IKEVDKFGN

SEQ ID NO: 927654 - protein, 9 aa, Homo Sapiens
PPSSSSSTS

SEQ ID NO: 927655 - protein, 9 aa, Homo Sapiens
GEGDRGQHL

SEQ ID NO: 927656 - protein, 9 aa, Homo Sapiens
PVFKSFEKP

SEQ ID NO: 927657 - protein, 9 aa, Homo Sapiens
SSGLKTQQN

SEQ ID NO: 927658 - protein, 9 aa, Homo Sapiens
IQTDYIVYI

SEQ ID NO: 927659 - protein, 9 aa, Homo Sapiens
APSCSALHC

SEQ ID NO: 927660 - protein, 9 aa, Homo Sapiens
EPGLRGPPG

SEQ ID NO: 927661 - protein, 9 aa, Homo Sapiens
RAPIIRVRG

SEQ ID NO: 927662 - protein, 9 aa, Homo Sapiens
AIESQLKTQ

SEQ ID NO: 927663 - protein, 9 aa, Homo Sapiens
NFFANEVAA

SEQ ID NO: 927664 - protein, 9 aa, Homo Sapiens
AALLRISVL

SEQ ID NO: 927665 - protein, 9 aa, Homo Sapiens
VEGPSTAEI

SEQ ID NO: 927666 - protein, 9 aa, Homo Sapiens
LMIGILRQR

SEQ ID NO: 927667 - protein, 9 aa, Homo Sapiens
DRLIRGRTS

SEQ ID NO: 927668 - protein, 9 aa, Homo Sapiens
LRQREHFSN

SEQ ID NO: 927669 - protein, 9 aa, Homo Sapiens
SKFPGALHA

SEQ ID NO: 927670 - protein, 9 aa, Homo Sapiens
LPNFEFVGR

SEQ ID NO: 927671 - protein, 9 aa, Homo Sapiens
AYVAMAAGF

SEQ ID NO: 927672 - protein, 9 aa, Homo Sapiens
LVTPCLVLI

SEQ ID NO: 927673 - protein, 9 aa, Homo Sapiens
HLLDGRAQP

SEQ ID NO: 927674 - protein, 9 aa, Homo Sapiens
KLVVLLDCA

SEQ ID NO: 927675 - protein, 9 aa, Homo Sapiens
KSDQSFFKI

SEQ ID NO: 927676 - protein, 9 aa, Homo Sapiens
QLKTQKKGK

SEQ ID NO: 927677 - protein, 9 aa, Homo Sapiens
EHFSNLAQW

SEQ ID NO: 927678 - protein, 9 aa, Homo Sapiens
QRVPTAPPQ

SEQ ID NO: 927679 - protein, 9 aa, Homo Sapiens
DVIDYSLSG

SEQ ID NO: 927680 - protein, 9 aa, Homo Sapiens
FPAQPPPSE

SEQ ID NO: 927681 - protein, 9 aa, Homo Sapiens
SVNYTVIEC

SEQ ID NO: 927682 - protein, 9 aa, Homo Sapiens
QGKCYCHMG

SEQ ID NO: 927683 - protein, 9 aa, Homo Sapiens
VDGKWTTLP

SEQ ID NO: 927684 - protein, 9 aa, Homo Sapiens
AENSRGKNF

SEQ ID NO: 927685 - protein, 9 aa, Homo Sapiens
LLPAPAPLH

SEQ ID NO: 927686 - protein, 9 aa, Homo Sapiens
GRSGSTAGS

SEQ ID NO: 927687 - protein, 9 aa, Homo Sapiens
MSYDRCKAI

SEQ ID NO: 927688 - protein, 9 aa, Homo Sapiens
GLAVCLAPT

SEQ ID NO: 927689 - protein, 9 aa, Homo Sapiens
LIQPIDGIK

SEQ ID NO: 927690 - protein, 9 aa, Homo Sapiens
NHGSQCGFC

SEQ ID NO: 927691 - protein, 9 aa, Homo Sapiens
VKFGARRLA

SEQ ID NO: 927692 - protein, 9 aa, Homo Sapiens
ALIMFSRLK

SEQ ID NO: 927693 - protein, 9 aa, Homo Sapiens
DKVEMKQKE

SEQ ID NO: 927694 - protein, 9 aa, Homo Sapiens
ICLAKNLVS

SEQ ID NO: 927695 - protein, 9 aa, Homo Sapiens
DPSGEETLS

SEQ ID NO: 927696 - protein, 9 aa, Homo Sapiens
LKSSADFLG

SEQ ID NO: 927697 - protein, 9 aa, Homo Sapiens
KKKLVIESP

SEQ ID NO: 927698 - protein, 9 aa, Homo Sapiens
MFCCKKDIA

SEQ ID NO: 927699 - protein, 9 aa, Homo Sapiens
DLSAHNLLY

SEQ ID NO: 927700 - protein, 9 aa, Homo Sapiens
NSPVILACL

SEQ ID NO: 927701 - protein, 9 aa, Homo Sapiens
WAATLASRR

SEQ ID NO: 927702 - protein, 9 aa, Homo Sapiens
STGDEHSPR

SEQ ID NO: 927703 - protein, 9 aa, Homo Sapiens
ALAEDTSDG

SEQ ID NO: 927704 - protein, 9 aa, Homo Sapiens
PHSEAGTAY

SEQ ID NO: 927705 - protein, 9 aa, Homo Sapiens
FPALAFAFF

SEQ ID NO: 927706 - protein, 9 aa, Homo Sapiens
RGCDSSDPD

SEQ ID NO: 927707 - protein, 9 aa, Homo Sapiens
LPLQEEELP

SEQ ID NO: 927708 - protein, 9 aa, Homo Sapiens
LKEGELELS

SEQ ID NO: 927709 - protein, 9 aa, Homo Sapiens
AALAEVQED

SEQ ID NO: 927710 - protein, 9 aa, Homo Sapiens
FRGIGGLGE

SEQ ID NO: 927711 - protein, 9 aa, Homo Sapiens
PLQEEELPL

SEQ ID NO: 927712 - protein, 9 aa, Homo Sapiens
KTPRKVKPP

SEQ ID NO: 927713 - protein, 9 aa, Homo Sapiens
RPFSCTQCG

SEQ ID NO: 927714 - protein, 9 aa, Homo Sapiens
DPGVLVLRA

SEQ ID NO: 927715 - protein, 9 aa, Homo Sapiens
GMKESEVTA

SEQ ID NO: 927716 - protein, 9 aa, Homo Sapiens
DCSWPCPKC

SEQ ID NO: 927717 - protein, 9 aa, Homo Sapiens
DDEALWKVA

SEQ ID NO: 927718 - protein, 9 aa, Homo Sapiens
LAGSLAITI

SEQ ID NO: 927719 - protein, 9 aa, Homo Sapiens
RYTCVKIGR

SEQ ID NO: 927720 - protein, 9 aa, Homo Sapiens
DDAPQAVFP

SEQ ID NO: 927721 - protein, 9 aa, Homo Sapiens
AKGEKENAG

SEQ ID NO: 927722 - protein, 9 aa, Homo Sapiens
DLNLLSEDG

SEQ ID NO: 927723 - protein, 9 aa, Homo Sapiens
FFCDIYLVM

SEQ ID NO: 927724 - protein, 9 aa, Homo Sapiens
LCDTSSNKD

SEQ ID NO: 927725 - protein, 9 aa, Homo Sapiens
SIFQQGLFK

SEQ ID NO: 927726 - protein, 9 aa, Homo Sapiens
HKAENGPDP

SEQ ID NO: 927727 - protein, 9 aa, Homo Sapiens
SFPALAFAF

SEQ ID NO: 927728 - protein, 9 aa, Homo Sapiens
NHGEGDQAL

SEQ ID NO: 927729 - protein, 9 aa, Homo Sapiens
VLVAVAEHS

SEQ ID NO: 927730 - protein, 9 aa, Homo Sapiens
YPEIFSAEY

SEQ ID NO: 927731 - protein, 9 aa, Homo Sapiens
EALAMQSLI

SEQ ID NO: 927732 - protein, 9 aa, Homo Sapiens
VYFDYDETW

SEQ ID NO: 927733 - protein, 9 aa, Homo Sapiens
AWSQEALVS

SEQ ID NO: 927734 - protein, 9 aa, Homo Sapiens
EEAIIGTNV

SEQ ID NO: 927735 - protein, 9 aa, Homo Sapiens
AEEANSHTT

SEQ ID NO: 927736 - protein, 9 aa, Homo Sapiens
DKKDFSVTD

SEQ ID NO: 927737 - protein, 9 aa, Homo Sapiens
IRAVIESEF

SEQ ID NO: 927738 - protein, 9 aa, Homo Sapiens
QGSGKEEDF

SEQ ID NO: 927739 - protein, 9 aa, Homo Sapiens
PNPQLMRLD

SEQ ID NO: 927740 - protein, 9 aa, Homo Sapiens
DWFHAWSQE

SEQ ID NO: 927741 - protein, 9 aa, Homo Sapiens
QILDKVEMK

SEQ ID NO: 927742 - protein, 9 aa, Homo Sapiens
FTLSESQRF

SEQ ID NO: 927743 - protein, 9 aa, Homo Sapiens
DNSPVILAC

SEQ ID NO: 927744 - protein, 9 aa, Homo Sapiens
LYGASNENS

SEQ ID NO: 927745 - protein, 9 aa, Homo Sapiens
PQDRIVSKA

SEQ ID NO: 927746 - protein, 9 aa, Homo Sapiens
SEPVPFMPF

SEQ ID NO: 927747 - protein, 9 aa, Homo Sapiens
KKLSCYDTY

SEQ ID NO: 927748 - protein, 9 aa, Homo Sapiens
ALEVQREWQ

SEQ ID NO: 927749 - protein, 9 aa, Homo Sapiens
KGDPKDDFN

SEQ ID NO: 927750 - protein, 9 aa, Homo Sapiens
KLTYNHEGI

SEQ ID NO: 927751 - protein, 9 aa, Homo Sapiens
ELSEALDSG

SEQ ID NO: 927752 - protein, 9 aa, Homo Sapiens
GSLLQGQLQ

SEQ ID NO: 927753 - protein, 9 aa, Homo Sapiens
NFHSAASRD

SEQ ID NO: 927754 - protein, 9 aa, Homo Sapiens
PYGPKRDVG

SEQ ID NO: 927755 - protein, 9 aa, Homo Sapiens
QSMRSGAGV

SEQ ID NO: 927756 - protein, 9 aa, Homo Sapiens
LGFNEYFPF

SEQ ID NO: 927757 - protein, 9 aa, Homo Sapiens
VTLNYLKPR

SEQ ID NO: 927758 - protein, 9 aa, Homo Sapiens
EKGANGKRE

SEQ ID NO: 927759 - protein, 9 aa, Homo Sapiens
RLIRGSGEN

SEQ ID NO: 927760 - protein, 9 aa, Homo Sapiens
GTPLGEVLF

SEQ ID NO: 927761 - protein, 9 aa, Homo Sapiens
HLNSVSKCD

SEQ ID NO: 927762 - protein, 9 aa, Homo Sapiens
TPLGEVLFS

SEQ ID NO: 927763 - protein, 9 aa, Homo Sapiens
AIVDCGFEQ

SEQ ID NO: 927764 - protein, 9 aa, Homo Sapiens
KIEANAFDN

SEQ ID NO: 927765 - protein, 9 aa, Homo Sapiens
VLTIIKQSK

SEQ ID NO: 927766 - protein, 9 aa, Homo Sapiens
LPYPFLDGI

SEQ ID NO: 927767 - protein, 9 aa, Homo Sapiens
DSGQCPERY

SEQ ID NO: 927768 - protein, 9 aa, Homo Sapiens
ENSNGSSGG

SEQ ID NO: 927769 - protein, 9 aa, Homo Sapiens
KIRVLLTRP

SEQ ID NO: 927770 - protein, 9 aa, Homo Sapiens
LIRGRTSTE

SEQ ID NO: 927771 - protein, 9 aa, Homo Sapiens
STDDEAEDS

SEQ ID NO: 927772 - protein, 9 aa, Homo Sapiens
LKHQCPSHR

SEQ ID NO: 927773 - protein, 9 aa, Homo Sapiens
IDELSSFIG

SEQ ID NO: 927774 - protein, 9 aa, Homo Sapiens
KSCSFDKID

SEQ ID NO: 927775 - protein, 9 aa, Homo Sapiens
ASVAKNPKL

SEQ ID NO: 927776 - protein, 9 aa, Homo Sapiens
EVPPCQTPK

SEQ ID NO: 927777 - protein, 9 aa, Homo Sapiens
SFDAGVFEV

SEQ ID NO: 927778 - protein, 9 aa, Homo Sapiens
EKNGLTFSF

SEQ ID NO: 927779 - protein, 9 aa, Homo Sapiens
KLRAGKLSL

SEQ ID NO: 927780 - protein, 9 aa, Homo Sapiens
VYSFFVFNL

SEQ ID NO: 927781 - protein, 9 aa, Homo Sapiens
QEKMTQIMF

SEQ ID NO: 927782 - protein, 9 aa, Homo Sapiens
VWVFSILIR

SEQ ID NO: 927783 - protein, 9 aa, Homo Sapiens
GARGPKGPP

SEQ ID NO: 927784 - protein, 9 aa, Homo Sapiens
KFFFVKVFN

SEQ ID NO: 927785 - protein, 9 aa, Homo Sapiens
FKNKVIWVG

SEQ ID NO: 927786 - protein, 9 aa, Homo Sapiens
ILTQSLHLT

SEQ ID NO: 927787 - protein, 9 aa, Homo Sapiens
DVYFDYDET

SEQ ID NO: 927788 - protein, 9 aa, Homo Sapiens
SFPKGSEGY

SEQ ID NO: 927789 - protein, 9 aa, Homo Sapiens
IRGSGENGD

SEQ ID NO: 927790 - protein, 9 aa, Homo Sapiens
NRLLLEFVF

SEQ ID NO: 927791 - protein, 9 aa, Homo Sapiens
RGFFIKRQF

SEQ ID NO: 927792 - protein, 9 aa, Homo Sapiens
KKFFFVKVF

SEQ ID NO: 927793 - protein, 9 aa, Homo Sapiens
EEELPLVQQ

SEQ ID NO: 927794 - protein, 9 aa, Homo Sapiens
NATGFWNPH

SEQ ID NO: 927795 - protein, 9 aa, Homo Sapiens
IEQILDKVE

SEQ ID NO: 927796 - protein, 9 aa, Homo Sapiens
DFSMYFGCP

SEQ ID NO: 927797 - protein, 9 aa, Homo Sapiens
DSLIIPETQ

SEQ ID NO: 927798 - protein, 9 aa, Homo Sapiens
PDSVSIIQK

SEQ ID NO: 927799 - protein, 9 aa, Homo Sapiens
GLPEKHGAS

SEQ ID NO: 927800 - protein, 9 aa, Homo Sapiens
DFPAQPPPS

SEQ ID NO: 927801 - protein, 9 aa, Homo Sapiens
SPYLKRKQI

SEQ ID NO: 927802 - protein, 9 aa, Homo Sapiens
NENTIPVTF

SEQ ID NO: 927803 - protein, 9 aa, Homo Sapiens
TLSESQRFS

SEQ ID NO: 927804 - protein, 9 aa, Homo Sapiens
FPKGSEGYL

SEQ ID NO: 927805 - protein, 9 aa, Homo Sapiens
YGLKVSPFK

SEQ ID NO: 927806 - protein, 9 aa, Homo Sapiens
QGPSPRGWH

SEQ ID NO: 927807 - protein, 9 aa, Homo Sapiens
SLAVEGPST

SEQ ID NO: 927808 - protein, 9 aa, Homo Sapiens
SVPPRVYIH

SEQ ID NO: 927809 - protein, 9 aa, Homo Sapiens
DYGLKPRQP

SEQ ID NO: 927810 - protein, 9 aa, Homo Sapiens
YCHMGTHCH

SEQ ID NO: 927811 - protein, 9 aa, Homo Sapiens
RVPTAPPQN

SEQ ID NO: 927812 - protein, 9 aa, Homo Sapiens
LREKEKQLK

SEQ ID NO: 927813 - protein, 9 aa, Homo Sapiens
KTSQKFSRV

SEQ ID NO: 927814 - protein, 9 aa, Homo Sapiens
CEQVHCRLP

SEQ ID NO: 927815 - protein, 9 aa, Homo Sapiens
TFINMSQKN

SEQ ID NO: 927816 - protein, 9 aa, Homo Sapiens
QKIHLECST

SEQ ID NO: 927817 - protein, 9 aa, Homo Sapiens
SGLEKMANG

SEQ ID NO: 927818 - protein, 9 aa, Homo Sapiens
RQREHFSNL

SEQ ID NO: 927819 - protein, 9 aa, Homo Sapiens
VNLANVIYK

SEQ ID NO: 927820 - protein, 9 aa, Homo Sapiens
GKCYCHMGT

SEQ ID NO: 927821 - protein, 9 aa, Homo Sapiens
DTEYKIRVL

SEQ ID NO: 927822 - protein, 9 aa, Homo Sapiens
GLKTQQNTS

SEQ ID NO: 927823 - protein, 9 aa, Homo Sapiens
KRSSAHAGG

SEQ ID NO: 927824 - protein, 9 aa, Homo Sapiens
LQGPPEPPG

SEQ ID NO: 927825 - protein, 9 aa, Homo Sapiens
EVEFLPDLR

SEQ ID NO: 927826 - protein, 9 aa, Homo Sapiens
NGALVCAFS

SEQ ID NO: 927827 - protein, 9 aa, Homo Sapiens
GKNFFRGQL

SEQ ID NO: 927828 - protein, 9 aa, Homo Sapiens
LVKHGQFHT

SEQ ID NO: 927829 - protein, 9 aa, Homo Sapiens
NTKQLNCFP

SEQ ID NO: 927830 - protein, 9 aa, Homo Sapiens
FGTPLGEVL

SEQ ID NO: 927831 - protein, 9 aa, Homo Sapiens
MDWQPNEQG

SEQ ID NO: 927832 - protein, 9 aa, Homo Sapiens
GLPYPFLDG

SEQ ID NO: 927833 - protein, 9 aa, Homo Sapiens
CATYRRPYP

SEQ ID NO: 927834 - protein, 9 aa, Homo Sapiens
SGLKTQQNT

SEQ ID NO: 927835 - protein, 9 aa, Homo Sapiens
WKGAVLVHR

SEQ ID NO: 927836 - protein, 9 aa, Homo Sapiens
ARTQRARAQ

SEQ ID NO: 927837 - protein, 9 aa, Homo Sapiens
SPKVRSLRP

SEQ ID NO: 927838 - protein, 9 aa, Homo Sapiens
LISCFTLSE

SEQ ID NO: 927839 - protein, 9 aa, Homo Sapiens
QIKRLTSWP

SEQ ID NO: 927840 - protein, 9 aa, Homo Sapiens
PAQVPSLFF

SEQ ID NO: 927841 - protein, 9 aa, Homo Sapiens
KASKDTICE

SEQ ID NO: 927842 - protein, 9 aa, Homo Sapiens
GALRAQKAS

SEQ ID NO: 927843 - protein, 9 aa, Homo Sapiens
SRYTFKIPE

SEQ ID NO: 927844 - protein, 9 aa, Homo Sapiens
GLLKLTWFL

SEQ ID NO: 927845 - protein, 9 aa, Homo Sapiens
ELTDLDYCP

SEQ ID NO: 927846 - protein, 9 aa, Homo Sapiens
DPSFEVHYC

SEQ ID NO: 927847 - protein, 9 aa, Homo Sapiens
VQEDLESER

SEQ ID NO: 927848 - protein, 9 aa, Homo Sapiens
DNVEICINL

SEQ ID NO: 927849 - protein, 9 aa, Homo Sapiens
CHGSGPDNC

SEQ ID NO: 927850 - protein, 9 aa, Homo Sapiens
TQYKLIAQR

SEQ ID NO: 927851 - protein, 9 aa, Homo Sapiens
VTPKSRYTF

SEQ ID NO: 927852 - protein, 9 aa, Homo Sapiens
MMSGSTKLE

SEQ ID NO: 927853 - protein, 9 aa, Homo Sapiens
TANQTLIGQ

SEQ ID NO: 927854 - protein, 9 aa, Homo Sapiens
QADAALHKP

SEQ ID NO: 927855 - protein, 9 aa, Homo Sapiens
YKIRVLLTR

SEQ ID NO: 927856 - protein, 9 aa, Homo Sapiens
SRQEVLMCT

SEQ ID NO: 927857 - protein, 9 aa, Homo Sapiens
TQSMRSGAG

SEQ ID NO: 927858 - protein, 9 aa, Homo Sapiens
TPYQLDLAN

SEQ ID NO: 927859 - protein, 9 aa, Homo Sapiens
PRLVSFKED

SEQ ID NO: 927860 - protein, 9 aa, Homo Sapiens
ELKSCSFDK

SEQ ID NO: 927861 - protein, 9 aa, Homo Sapiens
AQLNYRQIE

SEQ ID NO: 927862 - protein, 9 aa, Homo Sapiens
KKKQKEERQ

SEQ ID NO: 927863 - protein, 9 aa, Homo Sapiens
TLSIYKLIA

SEQ ID NO: 927864 - protein, 9 aa, Homo Sapiens
EYLNKLKHT

SEQ ID NO: 927865 - protein, 9 aa, Homo Sapiens
SVKKKLVIE

SEQ ID NO: 927866 - protein, 9 aa, Homo Sapiens
LSEFTIESL

SEQ ID NO: 927867 - protein, 9 aa, Homo Sapiens
PRRSKSYLS

SEQ ID NO: 927868 - protein, 9 aa, Homo Sapiens
KFPGALHAA

SEQ ID NO: 927869 - protein, 9 aa, Homo Sapiens
ANQTLIGQT

SEQ ID NO: 927870 - protein, 9 aa, Homo Sapiens
FVGRLHCKP

SEQ ID NO: 927871 - protein, 9 aa, Homo Sapiens
EELFQVKIE

SEQ ID NO: 927872 - protein, 9 aa, Homo Sapiens
NYPDSVSII

SEQ ID NO: 927873 - protein, 9 aa, Homo Sapiens
GRGRQRETA

SEQ ID NO: 927874 - protein, 9 aa, Homo Sapiens
QEDSQGSGK

SEQ ID NO: 927875 - protein, 9 aa, Homo Sapiens
AQYHGRPLA

SEQ ID NO: 927876 - protein, 9 aa, Homo Sapiens
KYNNKKKLS

SEQ ID NO: 927877 - protein, 9 aa, Homo Sapiens
ANGHHIHDR

SEQ ID NO: 927878 - protein, 9 aa, Homo Sapiens
IVIGFPDLM

SEQ ID NO: 927879 - protein, 9 aa, Homo Sapiens
NLKFVQNSH

SEQ ID NO: 927880 - protein, 9 aa, Homo Sapiens
TPCLVLIKC

SEQ ID NO: 927881 - protein, 9 aa, Homo Sapiens
FSRVPLPRR

SEQ ID NO: 927882 - protein, 9 aa, Homo Sapiens
PCLDWAATL

SEQ ID NO: 927883 - protein, 9 aa, Homo Sapiens
QRNIPPEIG

SEQ ID NO: 927884 - protein, 9 aa, Homo Sapiens
SGAGVQAAH

SEQ ID NO: 927885 - protein, 9 aa, Homo Sapiens
ALAMQSLIK

SEQ ID NO: 927886 - protein, 9 aa, Homo Sapiens
HRGCDSSDP

SEQ ID NO: 927887 - protein, 9 aa, Homo Sapiens
VVAPLLGAS

SEQ ID NO: 927888 - protein, 9 aa, Homo Sapiens
LVWGQIKRL

SEQ ID NO: 927889 - protein, 9 aa, Homo Sapiens
KLIAQRSKD

SEQ ID NO: 927890 - protein, 9 aa, Homo Sapiens
KASSNVFSN

SEQ ID NO: 927891 - protein, 9 aa, Homo Sapiens
KRDVGPAGL

SEQ ID NO: 927892 - protein, 9 aa, Homo Sapiens
RMVQSGGGS

SEQ ID NO: 927893 - protein, 9 aa, Homo Sapiens
LQRVPTAPP

SEQ ID NO: 927894 - protein, 9 aa, Homo Sapiens
KSFEKPVMI

SEQ ID NO: 927895 - protein, 9 aa, Homo Sapiens
CVFDRRYHR

SEQ ID NO: 927896 - protein, 9 aa, Homo Sapiens
PNFEFVGRL

SEQ ID NO: 927897 - protein, 9 aa, Homo Sapiens
VKLKAFREA

SEQ ID NO: 927898 - protein, 9 aa, Homo Sapiens
HKRLIRGSG

SEQ ID NO: 927899 - protein, 9 aa, Homo Sapiens
DTICEEIQN

SEQ ID NO: 927900 - protein, 9 aa, Homo Sapiens
SVYSFFVFN

SEQ ID NO: 927901 - protein, 9 aa, Homo Sapiens
QIVHTRGKS

SEQ ID NO: 927902 - protein, 9 aa, Homo Sapiens
LKENEEEPQ

SEQ ID NO: 927903 - protein, 9 aa, Homo Sapiens
KREHILGAA

SEQ ID NO: 927904 - protein, 9 aa, Homo Sapiens
AAGFWVTGL

SEQ ID NO: 927905 - protein, 9 aa, Homo Sapiens
PPGKMKQSK

SEQ ID NO: 927906 - protein, 9 aa, Homo Sapiens
RFLGDSPIH

SEQ ID NO: 927907 - protein, 9 aa, Homo Sapiens
VRDRDGYTV

SEQ ID NO: 927908 - protein, 9 aa, Homo Sapiens
LLYKENISQ

SEQ ID NO: 927909 - protein, 9 aa, Homo Sapiens
AGRIHSEFD

SEQ ID NO: 927910 - protein, 9 aa, Homo Sapiens
GSGGCSFPE

SEQ ID NO: 927911 - protein, 9 aa, Homo Sapiens
SQWKDSSLA

SEQ ID NO: 927912 - protein, 9 aa, Homo Sapiens
LVYPEIFSA

SEQ ID NO: 927913 - protein, 9 aa, Homo Sapiens
DKGVVYSVV

SEQ ID NO: 927914 - protein, 9 aa, Homo Sapiens
NESQWKDSS

SEQ ID NO: 927915 - protein, 9 aa, Homo Sapiens
SSRSVKKKL

SEQ ID NO: 927916 - protein, 9 aa, Homo Sapiens
NKTVSELNQ

SEQ ID NO: 927917 - protein, 9 aa, Homo Sapiens
EGPRGPKSD

SEQ ID NO: 927918 - protein, 9 aa, Homo Sapiens
LRSPLTLIN

SEQ ID NO: 927919 - protein, 9 aa, Homo Sapiens
VRNRMSSSI

SEQ ID NO: 927920 - protein, 9 aa, Homo Sapiens
IAVRAAGGG

SEQ ID NO: 927921 - protein, 9 aa, Homo Sapiens
LSGVSTNDA

SEQ ID NO: 927922 - protein, 9 aa, Homo Sapiens
LPPAAHLNS

SEQ ID NO: 927923 - protein, 9 aa, Homo Sapiens
SCELRNLKF

SEQ ID NO: 927924 - protein, 9 aa, Homo Sapiens
AAKENSQPG

SEQ ID NO: 927925 - protein, 9 aa, Homo Sapiens
QFNNRHMMI

SEQ ID NO: 927926 - protein, 9 aa, Homo Sapiens
KTRRRSSLY

SEQ ID NO: 927927 - protein, 9 aa, Homo Sapiens
FKSFEKPVM

SEQ ID NO: 927928 - protein, 9 aa, Homo Sapiens
TGATSEEEV

SEQ ID NO: 927929 - protein, 9 aa, Homo Sapiens
QDRLINLDF

SEQ ID NO: 927930 - protein, 9 aa, Homo Sapiens
SRDFRGIGG

SEQ ID NO: 927931 - protein, 9 aa, Homo Sapiens
PGLRGPPGP

SEQ ID NO: 927932 - protein, 9 aa, Homo Sapiens
FSRLKQICR

SEQ ID NO: 927933 - protein, 9 aa, Homo Sapiens
ERRSKSLGR

SEQ ID NO: 927934 - protein, 9 aa, Homo Sapiens
ENLAIESQL

SEQ ID NO: 927935 - protein, 9 aa, Homo Sapiens
MAMFCCKKD

SEQ ID NO: 927936 - protein, 9 aa, Homo Sapiens
YLYATNSNN

SEQ ID NO: 927937 - protein, 9 aa, Homo Sapiens
RMSSSIVFT

SEQ ID NO: 927938 - protein, 9 aa, Homo Sapiens
WKGTNGEFK

SEQ ID NO: 927939 - protein, 9 aa, Homo Sapiens
AQVPSLFFN

SEQ ID NO: 927940 - protein, 9 aa, Homo Sapiens
FYTLVLKAV

SEQ ID NO: 927941 - protein, 9 aa, Homo Sapiens
EDSQGSGKE

SEQ ID NO: 927942 - protein, 9 aa, Homo Sapiens
TITNNFGSV

SEQ ID NO: 927943 - protein, 9 aa, Homo Sapiens
NFLFIIGFY

SEQ ID NO: 927944 - protein, 9 aa, Homo Sapiens
NSQPGEQND

SEQ ID NO: 927945 - protein, 9 aa, Homo Sapiens
EVAPGFERT

SEQ ID NO: 927946 - protein, 9 aa, Homo Sapiens
PSPPYSRLS

SEQ ID NO: 927947 - protein, 9 aa, Homo Sapiens
GTAYIQTQQ

SEQ ID NO: 927948 - protein, 9 aa, Homo Sapiens
LALISCFTL

SEQ ID NO: 927949 - protein, 9 aa, Homo Sapiens
MVEALCGQC

SEQ ID NO: 927950 - protein, 9 aa, Homo Sapiens
EKMGIPGAA

SEQ ID NO: 927951 - protein, 9 aa, Homo Sapiens
ALRAQKASS

SEQ ID NO: 927952 - protein, 9 aa, Homo Sapiens
PQPDLNLLS

SEQ ID NO: 927953 - protein, 9 aa, Homo Sapiens
ISEMAKEFI

SEQ ID NO: 927954 - protein, 9 aa, Homo Sapiens
NLDFCIDHS

SEQ ID NO: 927955 - protein, 9 aa, Homo Sapiens
SIANFFCLL

SEQ ID NO: 927956 - protein, 9 aa, Homo Sapiens
IMHRVAPCS

SEQ ID NO: 927957 - protein, 9 aa, Homo Sapiens
EKNALIMFS

SEQ ID NO: 927958 - protein, 9 aa, Homo Sapiens
DMLLPLNGE

SEQ ID NO: 927959 - protein, 9 aa, Homo Sapiens
KPMYLFLAM

SEQ ID NO: 927960 - protein, 9 aa, Homo Sapiens
HQKGKDKGV

SEQ ID NO: 927961 - protein, 9 aa, Homo Sapiens
RNLKFVQNS

SEQ ID NO: 927962 - protein, 9 aa, Homo Sapiens
TSRRPYCHF

SEQ ID NO: 927963 - protein, 9 aa, Homo Sapiens
PKDDFNKTG

SEQ ID NO: 927964 - protein, 9 aa, Homo Sapiens
LVMKLSCID

SEQ ID NO: 927965 - protein, 9 aa, Homo Sapiens
GPAGERGFP

SEQ ID NO: 927966 - protein, 9 aa, Homo Sapiens
DNKNNFSPK

SEQ ID NO: 927967 - protein, 9 aa, Homo Sapiens
TVLLFSRLF

SEQ ID NO: 927968 - protein, 9 aa, Homo Sapiens
PNKKDEKEK

SEQ ID NO: 927969 - protein, 9 aa, Homo Sapiens
ASASRHPHK

SEQ ID NO: 927970 - protein, 9 aa, Homo Sapiens
AASPYLKRK

SEQ ID NO: 927971 - protein, 9 aa, Homo Sapiens
ASAASRDFR

SEQ ID NO: 927972 - protein, 9 aa, Homo Sapiens
IYKLIALLK

SEQ ID NO: 927973 - protein, 9 aa, Homo Sapiens
EKSYICFKC

SEQ ID NO: 927974 - protein, 9 aa, Homo Sapiens
AFNSLASLN

SEQ ID NO: 927975 - protein, 9 aa, Homo Sapiens
SPRRSKSYL

SEQ ID NO: 927976 - protein, 9 aa, Homo Sapiens
RDRDGYTVA

SEQ ID NO: 927977 - protein, 9 aa, Homo Sapiens
KEKHNQLSE

SEQ ID NO: 927978 - protein, 9 aa, Homo Sapiens
NDLQHYGFH

SEQ ID NO: 927979 - protein, 9 aa, Homo Sapiens
DLKYVSATS

SEQ ID NO: 927980 - protein, 9 aa, Homo Sapiens
VTPCLVLIK

SEQ ID NO: 927981 - protein, 9 aa, Homo Sapiens
EREADSCHD

SEQ ID NO: 927982 - protein, 9 aa, Homo Sapiens
EDESESVDE

SEQ ID NO: 927983 - protein, 9 aa, Homo Sapiens
GSESPNQKL

SEQ ID NO: 927984 - protein, 9 aa, Homo Sapiens
TNNFGSVAR

SEQ ID NO: 927985 - protein, 9 aa, Homo Sapiens
FVSLNRLLL

SEQ ID NO: 927986 - protein, 9 aa, Homo Sapiens
SNGSSGGDN

SEQ ID NO: 927987 - protein, 9 aa, Homo Sapiens
INMSQKNVD

SEQ ID NO: 927988 - protein, 9 aa, Homo Sapiens
LMCGKDADA

SEQ ID NO: 927989 - protein, 9 aa, Homo Sapiens
RRLSAYQAL

SEQ ID NO: 927990 - protein, 9 aa, Homo Sapiens
RVRGALKAP

SEQ ID NO: 927991 - protein, 9 aa, Homo Sapiens
RGPKGPPGK

SEQ ID NO: 927992 - protein, 9 aa, Homo Sapiens
QKLGSNSPP

SEQ ID NO: 927993 - protein, 9 aa, Homo Sapiens
DNKKDNLDP

SEQ ID NO: 927994 - protein, 9 aa, Homo Sapiens
KIQCVDGKW

SEQ ID NO: 927995 - protein, 9 aa, Homo Sapiens
RSPVQIRNY

SEQ ID NO: 927996 - protein, 9 aa, Homo Sapiens
LNVTPKSRY

SEQ ID NO: 927997 - protein, 9 aa, Homo Sapiens
TDDEAEDSR

SEQ ID NO: 927998 - protein, 9 aa, Homo Sapiens
IYDSVSPAN

SEQ ID NO: 927999 - protein, 9 aa, Homo Sapiens
IQEERNVKK

SEQ ID NO: 928000 - protein, 9 aa, Homo Sapiens
TLRKILMDL

SEQ ID NO: 928001 - protein, 9 aa, Homo Sapiens
EFVGRLHCK

SEQ ID NO: 928002 - protein, 9 aa, Homo Sapiens
KLYGINLSD

SEQ ID NO: 928003 - protein, 9 aa, Homo Sapiens
GDDAPQAVF

SEQ ID NO: 928004 - protein, 9 aa, Homo Sapiens
DPPQPDLNL

SEQ ID NO: 928005 - protein, 9 aa, Homo Sapiens
KGDLLVIIE

SEQ ID NO: 928006 - protein, 9 aa, Homo Sapiens
GLEKMANGH

SEQ ID NO: 928007 - protein, 9 aa, Homo Sapiens
SFEKPVMIS

SEQ ID NO: 928008 - protein, 9 aa, Homo Sapiens
AMWPQMHLL

SEQ ID NO: 928009 - protein, 9 aa, Homo Sapiens
HQCPSHRAQ

SEQ ID NO: 928010 - protein, 9 aa, Homo Sapiens
STAGSGRNI

SEQ ID NO: 928011 - protein, 9 aa, Homo Sapiens
GMEMPFIKE

SEQ ID NO: 928012 - protein, 9 aa, Homo Sapiens
HEEMFQRLR

SEQ ID NO: 928013 - protein, 9 aa, Homo Sapiens
PQSPLDNKK

SEQ ID NO: 928014 - protein, 9 aa, Homo Sapiens
KTSCKEKTE

SEQ ID NO: 928015 - protein, 9 aa, Homo Sapiens
ALGLMCGKD

SEQ ID NO: 928016 - protein, 9 aa, Homo Sapiens
SKNKGMFLG

SEQ ID NO: 928017 - protein, 9 aa, Homo Sapiens
FQRLRTPQL

SEQ ID NO: 928018 - protein, 9 aa, Homo Sapiens
MFLAGSLAI

SEQ ID NO: 928019 - protein, 9 aa, Homo Sapiens
SRDSPSSST

SEQ ID NO: 928020 - protein, 9 aa, Homo Sapiens
SGQCPERYT

SEQ ID NO: 928021 - protein, 9 aa, Homo Sapiens
RNNPIKEIS

SEQ ID NO: 928022 - protein, 9 aa, Homo Sapiens
EEAEQFCQA

SEQ ID NO: 928023 - protein, 9 aa, Homo Sapiens
RLLLQLAQL

SEQ ID NO: 928024 - protein, 9 aa, Homo Sapiens
SRKEPVVGG

SEQ ID NO: 928025 - protein, 9 aa, Homo Sapiens
APSSSSFSS

SEQ ID NO: 928026 - protein, 9 aa, Homo Sapiens
PSMSPIFSA

SEQ ID NO: 928027 - protein, 9 aa, Homo Sapiens
PRNWGHLDQ

SEQ ID NO: 928028 - protein, 9 aa, Homo Sapiens
DHIRAVIES

SEQ ID NO: 928029 - protein, 9 aa, Homo Sapiens
WYECATYRR

SEQ ID NO: 928030 - protein, 9 aa, Homo Sapiens
KTRCQHKRE

SEQ ID NO: 928031 - protein, 9 aa, Homo Sapiens
QESPWKSPG

SEQ ID NO: 928032 - protein, 9 aa, Homo Sapiens
QLVANLMVW

SEQ ID NO: 928033 - protein, 9 aa, Homo Sapiens
AASGAARNF

SEQ ID NO: 928034 - protein, 9 aa, Homo Sapiens
TPPEDSISL

SEQ ID NO: 928035 - protein, 9 aa, Homo Sapiens
IRNYFSVPL

SEQ ID NO: 928036 - protein, 9 aa, Homo Sapiens
ITYVFMGHQ

SEQ ID NO: 928037 - protein, 9 aa, Homo Sapiens
FHAWSQEAL

SEQ ID NO: 928038 - protein, 9 aa, Homo Sapiens
IKEISSEIQ

SEQ ID NO: 928039 - protein, 9 aa, Homo Sapiens
RKGTRTKRH

SEQ ID NO: 928040 - protein, 9 aa, Homo Sapiens
GEQEENLAT

SEQ ID NO: 928041 - protein, 9 aa, Homo Sapiens
GKSYQCGVC

SEQ ID NO: 928042 - protein, 9 aa, Homo Sapiens
PLNTFRDVS

SEQ ID NO: 928043 - protein, 9 aa, Homo Sapiens
SLIQPIDGI

SEQ ID NO: 928044 - protein, 9 aa, Homo Sapiens
YIESQVQCE

SEQ ID NO: 928045 - protein, 9 aa, Homo Sapiens
SSKSFDFAS

SEQ ID NO: 928046 - protein, 9 aa, Homo Sapiens
LDGRAQPGS

SEQ ID NO: 928047 - protein, 9 aa, Homo Sapiens
GPPTGPAEE

SEQ ID NO: 928048 - protein, 9 aa, Homo Sapiens
SCLFPILPS

SEQ ID NO: 928049 - protein, 9 aa, Homo Sapiens
YNPHEACFL

SEQ ID NO: 928050 - protein, 9 aa, Homo Sapiens
QDRIVSKAM

SEQ ID NO: 928051 - protein, 9 aa, Homo Sapiens
DADKFQDFF

SEQ ID NO: 928052 - protein, 9 aa, Homo Sapiens
KFSRVPLPR

SEQ ID NO: 928053 - protein, 9 aa, Homo Sapiens
GLTFSFICK

SEQ ID NO: 928054 - protein, 9 aa, Homo Sapiens
DPGVAGKSD

SEQ ID NO: 928055 - protein, 9 aa, Homo Sapiens
DWAATLASR

SEQ ID NO: 928056 - protein, 9 aa, Homo Sapiens
LYPPLNTFR

SEQ ID NO: 928057 - protein, 9 aa, Homo Sapiens
RNRKNCAQF

SEQ ID NO: 928058 - protein, 9 aa, Homo Sapiens
QEPLEETET

SEQ ID NO: 928059 - protein, 9 aa, Homo Sapiens
AALIRRNRK

SEQ ID NO: 928060 - protein, 9 aa, Homo Sapiens
KLAPTSQKE

SEQ ID NO: 928061 - protein, 9 aa, Homo Sapiens
LVGMRVTYF

SEQ ID NO: 928062 - protein, 9 aa, Homo Sapiens
CLLASLLVD

SEQ ID NO: 928063 - protein, 9 aa, Homo Sapiens
RGPKSDPGL

SEQ ID NO: 928064 - protein, 9 aa, Homo Sapiens
LAVEGPSTA

SEQ ID NO: 928065 - protein, 9 aa, Homo Sapiens
LEDQTQLLI

SEQ ID NO: 928066 - protein, 9 aa, Homo Sapiens
LEKIEANAF

SEQ ID NO: 928067 - protein, 9 aa, Homo Sapiens
LGNIASLCV

SEQ ID NO: 928068 - protein, 9 aa, Homo Sapiens
QVLTIIKQS

SEQ ID NO: 928069 - protein, 9 aa, Homo Sapiens
SDSEPFHEN

SEQ ID NO: 928070 - protein, 9 aa, Homo Sapiens
DTSSNKDVY

SEQ ID NO: 928071 - protein, 9 aa, Homo Sapiens
KVQLCVLGQ

SEQ ID NO: 928072 - protein, 9 aa, Homo Sapiens
EGITGSRGL

SEQ ID NO: 928073 - protein, 9 aa, Homo Sapiens
AEDTSDGLA

SEQ ID NO: 928074 - protein, 9 aa, Homo Sapiens
SQKNVDMRD

SEQ ID NO: 928075 - protein, 9 aa, Homo Sapiens
NSCDSPILS

SEQ ID NO: 928076 - protein, 9 aa, Homo Sapiens
LRKILMDLK

SEQ ID NO: 928077 - protein, 9 aa, Homo Sapiens
FFRGQLQVY

SEQ ID NO: 928078 - protein, 9 aa, Homo Sapiens
EDPPNPQLM

SEQ ID NO: 928079 - protein, 9 aa, Homo Sapiens
SGQRNIPPE

SEQ ID NO: 928080 - protein, 9 aa, Homo Sapiens
CRLLLQLAQ

SEQ ID NO: 928081 - protein, 9 aa, Homo Sapiens
FEFVGRLHC

SEQ ID NO: 928082 - protein, 9 aa, Homo Sapiens
FCCKKDIAI

SEQ ID NO: 928083 - protein, 9 aa, Homo Sapiens
LPGEGDRGQ

SEQ ID NO: 928084 - protein, 9 aa, Homo Sapiens
QAVFPSIVG

SEQ ID NO: 928085 - protein, 9 aa, Homo Sapiens
LLFSRLFGP

SEQ ID NO: 928086 - protein, 9 aa, Homo Sapiens
EYEPARGSP

SEQ ID NO: 928087 - protein, 9 aa, Homo Sapiens
MMRGMHQKE

SEQ ID NO: 928088 - protein, 9 aa, Homo Sapiens
QDSLSISTR

SEQ ID NO: 928089 - protein, 9 aa, Homo Sapiens
YEYIGSEEE

SEQ ID NO: 928090 - protein, 9 aa, Homo Sapiens
LEVTKKFIR

SEQ ID NO: 928091 - protein, 9 aa, Homo Sapiens
AGSESPNQK

SEQ ID NO: 928092 - protein, 9 aa, Homo Sapiens
ISLVFPELD

SEQ ID NO: 928093 - protein, 9 aa, Homo Sapiens
LLRISVLCI

SEQ ID NO: 928094 - protein, 9 aa, Homo Sapiens
RDRAERKKK

SEQ ID NO: 928095 - protein, 9 aa, Homo Sapiens
GLEPNGSVL

SEQ ID NO: 928096 - protein, 9 aa, Homo Sapiens
MRGMHQKES

SEQ ID NO: 928097 - protein, 9 aa, Homo Sapiens
VAPGFERTM

SEQ ID NO: 928098 - protein, 9 aa, Homo Sapiens
ATWSFPALA

SEQ ID NO: 928099 - protein, 9 aa, Homo Sapiens
YGPKRDVGP

SEQ ID NO: 928100 - protein, 9 aa, Homo Sapiens
TDAAGFKRH

SEQ ID NO: 928101 - protein, 9 aa, Homo Sapiens
IRLPLPDNE

SEQ ID NO: 928102 - protein, 9 aa, Homo Sapiens
PLLGASLGG

SEQ ID NO: 928103 - protein, 9 aa, Homo Sapiens
QLLKSSADF

SEQ ID NO: 928104 - protein, 9 aa, Homo Sapiens
FRSSPEDSL

SEQ ID NO: 928105 - protein, 9 aa, Homo Sapiens
RLQKLYLND

SEQ ID NO: 928106 - protein, 9 aa, Homo Sapiens
TKKENRVSP

SEQ ID NO: 928107 - protein, 9 aa, Homo Sapiens
KRLIRGSGE

SEQ ID NO: 928108 - protein, 9 aa, Homo Sapiens
HEPRYIAVA

SEQ ID NO: 928109 - protein, 9 aa, Homo Sapiens
RFNEDCVFD

SEQ ID NO: 928110 - protein, 9 aa, Homo Sapiens
VDAEGNFNP

SEQ ID NO: 928111 - protein, 9 aa, Homo Sapiens
LVVLLDCAH

SEQ ID NO: 928112 - protein, 9 aa, Homo Sapiens
YSTTDAAGF

SEQ ID NO: 928113 - protein, 9 aa, Homo Sapiens
GAQEEDPPN

SEQ ID NO: 928114 - protein, 9 aa, Homo Sapiens
RKKNYPDSV

SEQ ID NO: 928115 - protein, 9 aa, Homo Sapiens
LYATNSNNY

SEQ ID NO: 928116 - protein, 9 aa, Homo Sapiens
PRQQGMMRG

SEQ ID NO: 928117 - protein, 9 aa, Homo Sapiens
CESASIVSL

SEQ ID NO: 928118 - protein, 9 aa, Homo Sapiens
LKTLLQAGR

SEQ ID NO: 928119 - protein, 9 aa, Homo Sapiens
KDVYFHHVL

SEQ ID NO: 928120 - protein, 9 aa, Homo Sapiens
GMYEELNKM

SEQ ID NO: 928121 - protein, 9 aa, Homo Sapiens
LIAVRAAGG

SEQ ID NO: 928122 - protein, 9 aa, Homo Sapiens
QPLKENEEE

SEQ ID NO: 928123 - protein, 9 aa, Homo Sapiens
AHGSGEALA

SEQ ID NO: 928124 - protein, 9 aa, Homo Sapiens
AGFWVTGLV

SEQ ID NO: 928125 - protein, 9 aa, Homo Sapiens
SAASRDFRG

SEQ ID NO: 928126 - protein, 9 aa, Homo Sapiens
ENKTVSELN

SEQ ID NO: 928127 - protein, 9 aa, Homo Sapiens
EDEKAAKEN

SEQ ID NO: 928128 - protein, 9 aa, Homo Sapiens
QLKTSCKEK

SEQ ID NO: 928129 - protein, 9 aa, Homo Sapiens
HRVAPCSGG

SEQ ID NO: 928130 - protein, 9 aa, Homo Sapiens
SGEETLSVK

SEQ ID NO: 928131 - protein, 9 aa, Homo Sapiens
REEVLQLSS

SEQ ID NO: 928132 - protein, 9 aa, Homo Sapiens
SLLQGQLQP

SEQ ID NO: 928133 - protein, 9 aa, Homo Sapiens
VYPEIFSAE

SEQ ID NO: 928134 - protein, 9 aa, Homo Sapiens
YLNKLKHTE

SEQ ID NO: 928135 - protein, 9 aa, Homo Sapiens
VAGNADSSV

SEQ ID NO: 928136 - protein, 9 aa, Homo Sapiens
EAQAALAEV

SEQ ID NO: 928137 - protein, 9 aa, Homo Sapiens
RQFSQGSEE

SEQ ID NO: 928138 - protein, 9 aa, Homo Sapiens
KEHCYLLHS

SEQ ID NO: 928139 - protein, 9 aa, Homo Sapiens
ESCLFPILP

SEQ ID NO: 928140 - protein, 9 aa, Homo Sapiens
TQLLILVCQ

SEQ ID NO: 928141 - protein, 9 aa, Homo Sapiens
ENVVQPMKK

SEQ ID NO: 928142 - protein, 9 aa, Homo Sapiens
KIMHRVAPC

SEQ ID NO: 928143 - protein, 9 aa, Homo Sapiens
AFSNSCIPA

SEQ ID NO: 928144 - protein, 9 aa, Homo Sapiens
GHGGGKHGP

SEQ ID NO: 928145 - protein, 9 aa, Homo Sapiens
PPPSGTQNE

SEQ ID NO: 928146 - protein, 9 aa, Homo Sapiens
VYTIPTPPF

SEQ ID NO: 928147 - protein, 9 aa, Homo Sapiens
FHGMEMPFI

SEQ ID NO: 928148 - protein, 9 aa, Homo Sapiens
ITKLVVLLD

SEQ ID NO: 928149 - protein, 9 aa, Homo Sapiens
YGLKPRQPN

SEQ ID NO: 928150 - protein, 9 aa, Homo Sapiens
GYALATWSF

SEQ ID NO: 928151 - protein, 9 aa, Homo Sapiens
HRQEDRLIR

SEQ ID NO: 928152 - protein, 9 aa, Homo Sapiens
LPDNEHDLS

SEQ ID NO: 928153 - protein, 9 aa, Homo Sapiens
NPIKEISSE

SEQ ID NO: 928154 - protein, 9 aa, Homo Sapiens
TQRARAQTP

SEQ ID NO: 928155 - protein, 9 aa, Homo Sapiens
LFVSLNRLL

SEQ ID NO: 928156 - protein, 9 aa, Homo Sapiens
AVTEYTLQR

SEQ ID NO: 928157 - protein, 9 aa, Homo Sapiens
NRMSSSIVF

SEQ ID NO: 928158 - protein, 9 aa, Homo Sapiens
EESDVDVQF

SEQ ID NO: 928159 - protein, 9 aa, Homo Sapiens
EGNFNPRPV

SEQ ID NO: 928160 - protein, 9 aa, Homo Sapiens
MKESEVTAM

SEQ ID NO: 928161 - protein, 9 aa, Homo Sapiens
SRGKNFFRG

SEQ ID NO: 928162 - protein, 9 aa, Homo Sapiens
NKNNFSPKV

SEQ ID NO: 928163 - protein, 9 aa, Homo Sapiens
IIGTNVLQD

SEQ ID NO: 928164 - protein, 9 aa, Homo Sapiens
KLATQSNEN

SEQ ID NO: 928165 - protein, 9 aa, Homo Sapiens
LCALAGLTL

SEQ ID NO: 928166 - protein, 9 aa, Homo Sapiens
TYNHEGITG

SEQ ID NO: 928167 - protein, 9 aa, Homo Sapiens
LINSLPRDL

SEQ ID NO: 928168 - protein, 9 aa, Homo Sapiens
RSNSPSRFL

SEQ ID NO: 928169 - protein, 9 aa, Homo Sapiens
TLLHFFAGG

SEQ ID NO: 928170 - protein, 9 aa, Homo Sapiens
CPREAVLFK

SEQ ID NO: 928171 - protein, 9 aa, Homo Sapiens
SEFDVFSQI

SEQ ID NO: 928172 - protein, 9 aa, Homo Sapiens
QKEGLDRFQ

SEQ ID NO: 928173 - protein, 9 aa, Homo Sapiens
FSCTQCGQA

SEQ ID NO: 928174 - protein, 9 aa, Homo Sapiens
YLVMKLSCI

SEQ ID NO: 928175 - protein, 9 aa, Homo Sapiens
EEANSHTTL

SEQ ID NO: 928176 - protein, 9 aa, Homo Sapiens
VDPGVAGKS

SEQ ID NO: 928177 - protein, 9 aa, Homo Sapiens
SQLKTQKKG

SEQ ID NO: 928178 - protein, 9 aa, Homo Sapiens
RGPYGPKRD

SEQ ID NO: 928179 - protein, 9 aa, Homo Sapiens
GMLEYEPAR

SEQ ID NO: 928180 - protein, 9 aa, Homo Sapiens
RPYPDAFQC

SEQ ID NO: 928181 - protein, 9 aa, Homo Sapiens
PRQTWKGAV

SEQ ID NO: 928182 - protein, 9 aa, Homo Sapiens
AHMKAREAA

SEQ ID NO: 928183 - protein, 9 aa, Homo Sapiens
KNKFCCDSG

SEQ ID NO: 928184 - protein, 9 aa, Homo Sapiens
GAVLVHRKA

SEQ ID NO: 928185 - protein, 9 aa, Homo Sapiens
RNILRLKHQ

SEQ ID NO: 928186 - protein, 9 aa, Homo Sapiens
GEKENAGFP

SEQ ID NO: 928187 - protein, 9 aa, Homo Sapiens
MAAQTSSDA

SEQ ID NO: 928188 - protein, 9 aa, Homo Sapiens
KAKAASEKN

SEQ ID NO: 928189 - protein, 9 aa, Homo Sapiens
GAALLRISV

SEQ ID NO: 928190 - protein, 9 aa, Homo Sapiens
PIIRVRGAL

SEQ ID NO: 928191 - protein, 9 aa, Homo Sapiens
GDLGSWNLL

SEQ ID NO: 928192 - protein, 9 aa, Homo Sapiens
KKDEKEKFL

SEQ ID NO: 928193 - protein, 9 aa, Homo Sapiens
HNPVFKSFE

SEQ ID NO: 928194 - protein, 9 aa, Homo Sapiens
PKGPPGKGQ

SEQ ID NO: 928195 - protein, 9 aa, Homo Sapiens
VRRPGIEIA

SEQ ID NO: 928196 - protein, 9 aa, Homo Sapiens
IIRVRGALK

SEQ ID NO: 928197 - protein, 9 aa, Homo Sapiens
LLHLLEVEF

SEQ ID NO: 928198 - protein, 9 aa, Homo Sapiens
GKGLSYLSQ

SEQ ID NO: 928199 - protein, 9 aa, Homo Sapiens
SVIIQNNAY

SEQ ID NO: 928200 - protein, 9 aa, Homo Sapiens
EDLQYQDQH

SEQ ID NO: 928201 - protein, 9 aa, Homo Sapiens
CCVLAACSD

SEQ ID NO: 928202 - protein, 9 aa, Homo Sapiens
LTGVLSGYG

SEQ ID NO: 928203 - protein, 9 aa, Homo Sapiens
ELKNPQEVT

SEQ ID NO: 928204 - protein, 9 aa, Homo Sapiens
TTSVYSFFV

SEQ ID NO: 928205 - protein, 9 aa, Homo Sapiens
ESAVGKFSL

SEQ ID NO: 928206 - protein, 9 aa, Homo Sapiens
PLEETETLA

SEQ ID NO: 928207 - protein, 9 aa, Homo Sapiens
ISQIDSLEK

SEQ ID NO: 928208 - protein, 9 aa, Homo Sapiens
TRRRSSLYS

SEQ ID NO: 928209 - protein, 9 aa, Homo Sapiens
KQLNCFPVL

SEQ ID NO: 928210 - protein, 9 aa, Homo Sapiens
RKEKGIPSF

SEQ ID NO: 928211 - protein, 9 aa, Homo Sapiens
AKEFIPCPT

SEQ ID NO: 928212 - protein, 9 aa, Homo Sapiens
AKKANVVVL

SEQ ID NO: 928213 - protein, 9 aa, Homo Sapiens
SLCYSTVMR

SEQ ID NO: 928214 - protein, 9 aa, Homo Sapiens
YQIKMCSQN

SEQ ID NO: 928215 - protein, 9 aa, Homo Sapiens
NFNDGTSSA

SEQ ID NO: 928216 - protein, 9 aa, Homo Sapiens
RDVGPAGLP

SEQ ID NO: 928217 - protein, 9 aa, Homo Sapiens
PFLTLSRKK

SEQ ID NO: 928218 - protein, 9 aa, Homo Sapiens
FSRRSNLVK

SEQ ID NO: 928219 - protein, 9 aa, Homo Sapiens
SSKFFLSIK

SEQ ID NO: 928220 - protein, 9 aa, Homo Sapiens
TAQYHGRPL

SEQ ID NO: 928221 - protein, 9 aa, Homo Sapiens
HQQGSPPPP

SEQ ID NO: 928222 - protein, 9 aa, Homo Sapiens
QPSVRRPGI

SEQ ID NO: 928223 - protein, 9 aa, Homo Sapiens
LSHFSSPDL

SEQ ID NO: 928224 - protein, 9 aa, Homo Sapiens
SESPNQKLS

SEQ ID NO: 928225 - protein, 9 aa, Homo Sapiens
MKKLYGINL

SEQ ID NO: 928226 - protein, 9 aa, Homo Sapiens
VRHCESSAF

SEQ ID NO: 928227 - protein, 9 aa, Homo Sapiens
SDQSFFKIS

SEQ ID NO: 928228 - protein, 9 aa, Homo Sapiens
FYLESLRQK

SEQ ID NO: 928229 - protein, 9 aa, Homo Sapiens
TQSNENTIP

SEQ ID NO: 928230 - protein, 9 aa, Homo Sapiens
LQHYGFHFE

SEQ ID NO: 928231 - protein, 9 aa, Homo Sapiens
QKDDFGIYL

SEQ ID NO: 928232 - protein, 9 aa, Homo Sapiens
ATGLLSHRS

SEQ ID NO: 928233 - protein, 9 aa, Homo Sapiens
SSADFLGLS

SEQ ID NO: 928234 - protein, 9 aa, Homo Sapiens
GDLLVIIEV

SEQ ID NO: 928235 - protein, 9 aa, Homo Sapiens
SVFDNLIGN

SEQ ID NO: 928236 - protein, 9 aa, Homo Sapiens
VEVQESPRC

SEQ ID NO: 928237 - protein, 9 aa, Homo Sapiens
ACVRHCESS

SEQ ID NO: 928238 - protein, 9 aa, Homo Sapiens
YQLQELWRE

SEQ ID NO: 928239 - protein, 9 aa, Homo Sapiens
NISDPSGEE

SEQ ID NO: 928240 - protein, 9 aa, Homo Sapiens
SPSMSPIFS

SEQ ID NO: 928241 - protein, 9 aa, Homo Sapiens
FFYGSLMGV

SEQ ID NO: 928242 - protein, 9 aa, Homo Sapiens
HYGFHFEGC

SEQ ID NO: 928243 - protein, 9 aa, Homo Sapiens
WNLLICLSS

SEQ ID NO: 928244 - protein, 9 aa, Homo Sapiens
IQPIDGIKM

SEQ ID NO: 928245 - protein, 9 aa, Homo Sapiens
CGPESPSPP

SEQ ID NO: 928246 - protein, 9 aa, Homo Sapiens
GNFNPRPVE

SEQ ID NO: 928247 - protein, 9 aa, Homo Sapiens
VTAICLLAS

SEQ ID NO: 928248 - protein, 9 aa, Homo Sapiens
NQEDKATIK

SEQ ID NO: 928249 - protein, 9 aa, Homo Sapiens
KAASEKNYN

SEQ ID NO: 928250 - protein, 9 aa, Homo Sapiens
MVDEPMEER

SEQ ID NO: 928251 - protein, 9 aa, Homo Sapiens
FDAGVFEVK

SEQ ID NO: 928252 - protein, 9 aa, Homo Sapiens
ELLAALIRR

SEQ ID NO: 928253 - protein, 9 aa, Homo Sapiens
GGSANDFRE

SEQ ID NO: 928254 - protein, 9 aa, Homo Sapiens
GSGEALAMQ

SEQ ID NO: 928255 - protein, 9 aa, Homo Sapiens
FKTRAEVLH

SEQ ID NO: 928256 - protein, 9 aa, Homo Sapiens
VLVHRKAWW

SEQ ID NO: 928257 - protein, 9 aa, Homo Sapiens
TSVYSFFVF

SEQ ID NO: 928258 - protein, 9 aa, Homo Sapiens
IDAVRTQYK

SEQ ID NO: 928259 - protein, 9 aa, Homo Sapiens
KENEEEPQW

SEQ ID NO: 928260 - protein, 9 aa, Homo Sapiens
VYNDIVSMM

SEQ ID NO: 928261 - protein, 9 aa, Homo Sapiens
SSDPDTSYV

SEQ ID NO: 928262 - protein, 9 aa, Homo Sapiens
CSQNTSIPI

SEQ ID NO: 928263 - protein, 9 aa, Homo Sapiens
LSAHNLLYK

SEQ ID NO: 928264 - protein, 9 aa, Homo Sapiens
NYTVIECET

SEQ ID NO: 928265 - protein, 9 aa, Homo Sapiens
EFITGYKIR

SEQ ID NO: 928266 - protein, 9 aa, Homo Sapiens
YSQPPKTRR

SEQ ID NO: 928267 - protein, 9 aa, Homo Sapiens
VATEKKFFF

SEQ ID NO: 928268 - protein, 9 aa, Homo Sapiens
FKLVFGSVF

SEQ ID NO: 928269 - protein, 9 aa, Homo Sapiens
EAEPPKMLS

SEQ ID NO: 928270 - protein, 9 aa, Homo Sapiens
QLNYRQIEP

SEQ ID NO: 928271 - protein, 9 aa, Homo Sapiens
PSKFPGALH

SEQ ID NO: 928272 - protein, 9 aa, Homo Sapiens
QKKYNNKKK

SEQ ID NO: 928273 - protein, 9 aa, Homo Sapiens
ALPGEGDRG

SEQ ID NO: 928274 - protein, 9 aa, Homo Sapiens
SFSSSSTSS

SEQ ID NO: 928275 - protein, 9 aa, Homo Sapiens
LRDFHNPVV

SEQ ID NO: 928276 - protein, 9 aa, Homo Sapiens
IVTLNYLKP

SEQ ID NO: 928277 - protein, 9 aa, Homo Sapiens
LTIIKQSKV

SEQ ID NO: 928278 - protein, 9 aa, Homo Sapiens
SDPSGEETL

SEQ ID NO: 928279 - protein, 9 aa, Homo Sapiens
SDPGLPGAP

SEQ ID NO: 928280 - protein, 9 aa, Homo Sapiens
GKSDESGDE

SEQ ID NO: 928281 - protein, 9 aa, Homo Sapiens
IRVKWPVKL

SEQ ID NO: 928282 - protein, 9 aa, Homo Sapiens
ERQESPWKS

SEQ ID NO: 928283 - protein, 9 aa, Homo Sapiens
SCSSPCTCS

SEQ ID NO: 928284 - protein, 9 aa, Homo Sapiens
RISGVGINQ

SEQ ID NO: 928285 - protein, 9 aa, Homo Sapiens
EKLYPCPQC

SEQ ID NO: 928286 - protein, 9 aa, Homo Sapiens
SGGCSFPEY

SEQ ID NO: 928287 - protein, 9 aa, Homo Sapiens
SHLTVVLFF

SEQ ID NO: 928288 - protein, 9 aa, Homo Sapiens
NLSQLKELH

SEQ ID NO: 928289 - protein, 9 aa, Homo Sapiens
FIPNKKDEK

SEQ ID NO: 928290 - protein, 9 aa, Homo Sapiens
QPPSSSSST

SEQ ID NO: 928291 - protein, 9 aa, Homo Sapiens
ESQVQCEQV

SEQ ID NO: 928292 - protein, 9 aa, Homo Sapiens
NPMVEALCG

SEQ ID NO: 928293 - protein, 9 aa, Homo Sapiens
LLVSPEARS

SEQ ID NO: 928294 - protein, 9 aa, Homo Sapiens
LGDSPIHSS

SEQ ID NO: 928295 - protein, 9 aa, Homo Sapiens
PHTEAHVGA

SEQ ID NO: 928296 - protein, 9 aa, Homo Sapiens
SEEEVKFGA

SEQ ID NO: 928297 - protein, 9 aa, Homo Sapiens
DEPMEEREA

SEQ ID NO: 928298 - protein, 9 aa, Homo Sapiens
NVIYKEQLN

SEQ ID NO: 928299 - protein, 9 aa, Homo Sapiens
FLDGILDVI

SEQ ID NO: 928300 - protein, 9 aa, Homo Sapiens
HSEAGTAYI

SEQ ID NO: 928301 - protein, 9 aa, Homo Sapiens
TALGSSVLT

SEQ ID NO: 928302 - protein, 9 aa, Homo Sapiens
KGAVLINSL

SEQ ID NO: 928303 - protein, 9 aa, Homo Sapiens
ASNENSEGF

SEQ ID NO: 928304 - protein, 9 aa, Homo Sapiens
DCVFDRRYH

SEQ ID NO: 928305 - protein, 9 aa, Homo Sapiens
ADSSVPPRV

SEQ ID NO: 928306 - protein, 9 aa, Homo Sapiens
DVPDSVNFF

SEQ ID NO: 928307 - protein, 9 aa, Homo Sapiens
QEDRLIRGR

SEQ ID NO: 928308 - protein, 9 aa, Homo Sapiens
HFSNLAQWD

SEQ ID NO: 928309 - protein, 9 aa, Homo Sapiens
VGLIAVRAA

SEQ ID NO: 928310 - protein, 9 aa, Homo Sapiens
SRFLGDSPI

SEQ ID NO: 928311 - protein, 9 aa, Homo Sapiens
TSSDAHIPV

SEQ ID NO: 928312 - protein, 9 aa, Homo Sapiens
AVEEEESCF

SEQ ID NO: 928313 - protein, 9 aa, Homo Sapiens
YSTLGKSFC

SEQ ID NO: 928314 - protein, 9 aa, Homo Sapiens
KDCSWPCPK

SEQ ID NO: 928315 - protein, 9 aa, Homo Sapiens
SRWAVRLGA

SEQ ID NO: 928316 - protein, 9 aa, Homo Sapiens
PPQPDLNLL

SEQ ID NO: 928317 - protein, 9 aa, Homo Sapiens
GFPSKFPGA

SEQ ID NO: 928318 - protein, 9 aa, Homo Sapiens
CESCLFPIL

SEQ ID NO: 928319 - protein, 9 aa, Homo Sapiens
DQFGEQEEN

SEQ ID NO: 928320 - protein, 9 aa, Homo Sapiens
TVKDDQVFS

SEQ ID NO: 928321 - protein, 9 aa, Homo Sapiens
ADPELEMDL

SEQ ID NO: 928322 - protein, 9 aa, Homo Sapiens
AGDNVEICI

SEQ ID NO: 928323 - protein, 9 aa, Homo Sapiens
AGNADSSVP

SEQ ID NO: 928324 - protein, 9 aa, Homo Sapiens
ANIIWMANH

SEQ ID NO: 928325 - protein, 9 aa, Homo Sapiens
IYLGNIASL

SEQ ID NO: 928326 - protein, 9 aa, Homo Sapiens
QAEDKAISD

SEQ ID NO: 928327 - protein, 9 aa, Homo Sapiens
HYCSLSLKP

SEQ ID NO: 928328 - protein, 9 aa, Homo Sapiens
SPNGPPVSS

SEQ ID NO: 928329 - protein, 9 aa, Homo Sapiens
YPFLDGILD

SEQ ID NO: 928330 - protein, 9 aa, Homo Sapiens
KMQSAEGRK

SEQ ID NO: 928331 - protein, 9 aa, Homo Sapiens
ELQIKEVDK

SEQ ID NO: 928332 - protein, 9 aa, Homo Sapiens
ERLAVSKLY

SEQ ID NO: 928333 - protein, 9 aa, Homo Sapiens
NLVKHGQFH

SEQ ID NO: 928334 - protein, 9 aa, Homo Sapiens
QLSVLFSSL

SEQ ID NO: 928335 - protein, 9 aa, Homo Sapiens
ACFLNLVDH

SEQ ID NO: 928336 - protein, 9 aa, Homo Sapiens
SLQKQLSLL

SEQ ID NO: 928337 - protein, 9 aa, Homo Sapiens
NPRQSMIKY

SEQ ID NO: 928338 - protein, 9 aa, Homo Sapiens
ILPENFLII

SEQ ID NO: 928339 - protein, 9 aa, Homo Sapiens
QEEELPLVQ

SEQ ID NO: 928340 - protein, 9 aa, Homo Sapiens
GFYTLVLKA

SEQ ID NO: 928341 - protein, 9 aa, Homo Sapiens
FNDRLLVYG

SEQ ID NO: 928342 - protein, 9 aa, Homo Sapiens
CVRHCESSA

SEQ ID NO: 928343 - protein, 9 aa, Homo Sapiens
VVLVAVAEH

SEQ ID NO: 928344 - protein, 9 aa, Homo Sapiens
SSVPPRVYI

SEQ ID NO: 928345 - protein, 9 aa, Homo Sapiens
SFDKIDKEY

SEQ ID NO: 928346 - protein, 9 aa, Homo Sapiens
EQLTSPSTA

SEQ ID NO: 928347 - protein, 9 aa, Homo Sapiens
LEKMANGHH

SEQ ID NO: 928348 - protein, 9 aa, Homo Sapiens
LSVNYTVIE

SEQ ID NO: 928349 - protein, 9 aa, Homo Sapiens
VCLGFHINK

SEQ ID NO: 928350 - protein, 9 aa, Homo Sapiens
KPAQPSEGD

SEQ ID NO: 928351 - protein, 9 aa, Homo Sapiens
MIGILRQRY

SEQ ID NO: 928352 - protein, 9 aa, Homo Sapiens
AILVTPCLV

SEQ ID NO: 928353 - protein, 9 aa, Homo Sapiens
GPPEPPGIP

SEQ ID NO: 928354 - protein, 9 aa, Homo Sapiens
ILNMAMFCC

SEQ ID NO: 928355 - protein, 9 aa, Homo Sapiens
LSRKKGPAA

SEQ ID NO: 928356 - protein, 9 aa, Homo Sapiens
IKMCSQNTS

SEQ ID NO: 928357 - protein, 9 aa, Homo Sapiens
ALQAEDKAI

SEQ ID NO: 928358 - protein, 9 aa, Homo Sapiens
PSGRSGSTA

SEQ ID NO: 928359 - protein, 9 aa, Homo Sapiens
NGVTSRRPY

SEQ ID NO: 928360 - protein, 9 aa, Homo Sapiens
LIGQTSQVD

SEQ ID NO: 928361 - protein, 9 aa, Homo Sapiens
VKHGQFHTD

SEQ ID NO: 928362 - protein, 9 aa, Homo Sapiens
KDSSLATRH

SEQ ID NO: 928363 - protein, 9 aa, Homo Sapiens
ILVTPCLVL

SEQ ID NO: 928364 - protein, 9 aa, Homo Sapiens
YALATWSFP

SEQ ID NO: 928365 - protein, 9 aa, Homo Sapiens
ISEYYWLNG

SEQ ID NO: 928366 - protein, 9 aa, Homo Sapiens
WQEIRQILE

SEQ ID NO: 928367 - protein, 9 aa, Homo Sapiens
VAMAAGFWV

SEQ ID NO: 928368 - protein, 9 aa, Homo Sapiens
LQIKEVDKF

SEQ ID NO: 928369 - protein, 9 aa, Homo Sapiens
KDNSPVILA

SEQ ID NO: 928370 - protein, 9 aa, Homo Sapiens
SVNFFANEV

SEQ ID NO: 928371 - protein, 9 aa, Homo Sapiens
ASHNTRGSW

SEQ ID NO: 928372 - protein, 9 aa, Homo Sapiens
ELFQVKIER

SEQ ID NO: 928373 - protein, 9 aa, Homo Sapiens
FSMYFGCPE

SEQ ID NO: 928374 - protein, 9 aa, Homo Sapiens
EYTLQRVPT

SEQ ID NO: 928375 - protein, 9 aa, Homo Sapiens
IDHDPQKIH

SEQ ID NO: 928376 - protein, 9 aa, Homo Sapiens
LRCLQKFYM

SEQ ID NO: 928377 - protein, 9 aa, Homo Sapiens
PTSQKEGLD

SEQ ID NO: 928378 - protein, 9 aa, Homo Sapiens
NLVQKEYEG

SEQ ID NO: 928379 - protein, 9 aa, Homo Sapiens
LKPRTEYEL

SEQ ID NO: 928380 - protein, 9 aa, Homo Sapiens
GRPLAQTND

SEQ ID NO: 928381 - protein, 9 aa, Homo Sapiens
PPPSEPVPF

SEQ ID NO: 928382 - protein, 9 aa, Homo Sapiens
SHFSSPDLV

SEQ ID NO: 928383 - protein, 9 aa, Homo Sapiens
PVKLFQLKE

SEQ ID NO: 928384 - protein, 9 aa, Homo Sapiens
QEVSVLNPR

SEQ ID NO: 928385 - protein, 9 aa, Homo Sapiens
SPLSSSMDL

SEQ ID NO: 928386 - protein, 9 aa, Homo Sapiens
FPFRPHPGS

SEQ ID NO: 928387 - protein, 9 aa, Homo Sapiens
PGARGPKGP

SEQ ID NO: 928388 - protein, 9 aa, Homo Sapiens
KGTNGEFKM

SEQ ID NO: 928389 - protein, 9 aa, Homo Sapiens
SYDRCKAIC

SEQ ID NO: 928390 - protein, 9 aa, Homo Sapiens
PKANQEKMT

SEQ ID NO: 928391 - protein, 9 aa, Homo Sapiens
VVVLVAVAE

SEQ ID NO: 928392 - protein, 9 aa, Homo Sapiens
EEDPPNPQL

SEQ ID NO: 928393 - protein, 9 aa, Homo Sapiens
HQTPYQLDL

SEQ ID NO: 928394 - protein, 9 aa, Homo Sapiens
EVLFSIEVT

SEQ ID NO: 928395 - protein, 9 aa, Homo Sapiens
PLWGVPLHS

SEQ ID NO: 928396 - protein, 9 aa, Homo Sapiens
CFGTPLGEV

SEQ ID NO: 928397 - protein, 9 aa, Homo Sapiens
MSGSTKLEQ

SEQ ID NO: 928398 - protein, 9 aa, Homo Sapiens
QSPLDNKKD

SEQ ID NO: 928399 - protein, 9 aa, Homo Sapiens
LVDLGLEKN

SEQ ID NO: 928400 - protein, 9 aa, Homo Sapiens
DEHSPRNWG

SEQ ID NO: 928401 - protein, 9 aa, Homo Sapiens
PYPFLDGIL

SEQ ID NO: 928402 - protein, 9 aa, Homo Sapiens
NSLPRDLRC

SEQ ID NO: 928403 - protein, 9 aa, Homo Sapiens
KLSCYDTYP

SEQ ID NO: 928404 - protein, 9 aa, Homo Sapiens
VPLPLWGVP

SEQ ID NO: 928405 - protein, 9 aa, Homo Sapiens
HLTVVLFFY

SEQ ID NO: 928406 - protein, 9 aa, Homo Sapiens
IEEEGILRR

SEQ ID NO: 928407 - protein, 9 aa, Homo Sapiens
KRKKNYPDS

SEQ ID NO: 928408 - protein, 9 aa, Homo Sapiens
DEDESESVD

SEQ ID NO: 928409 - protein, 9 aa, Homo Sapiens
RLTSWPGKL

SEQ ID NO: 928410 - protein, 9 aa, Homo Sapiens
RSLRPALPT

SEQ ID NO: 928411 - protein, 9 aa, Homo Sapiens
HSPRNWGHL

SEQ ID NO: 928412 - protein, 9 aa, Homo Sapiens
LRGFFIKRQ

SEQ ID NO: 928413 - protein, 9 aa, Homo Sapiens
QYKLIAQRS

SEQ ID NO: 928414 - protein, 9 aa, Homo Sapiens
SVTPNDFDF

SEQ ID NO: 928415 - protein, 9 aa, Homo Sapiens
LKRKQICEL

SEQ ID NO: 928416 - protein, 9 aa, Homo Sapiens
RLHCKPAKP

SEQ ID NO: 928417 - protein, 9 aa, Homo Sapiens
IANFFCLLS

SEQ ID NO: 928418 - protein, 9 aa, Homo Sapiens
HNLLYKENI

SEQ ID NO: 928419 - protein, 9 aa, Homo Sapiens
LIDASVAKN

SEQ ID NO: 928420 - protein, 9 aa, Homo Sapiens
WLATWTSKY

SEQ ID NO: 928421 - protein, 9 aa, Homo Sapiens
ATWTSKYSI

SEQ ID NO: 928422 - protein, 9 aa, Homo Sapiens
ASRLLEASM

SEQ ID NO: 928423 - protein, 9 aa, Homo Sapiens
SFSTALYCE

SEQ ID NO: 928424 - protein, 9 aa, Homo Sapiens
VADLSDFNG

SEQ ID NO: 928425 - protein, 9 aa, Homo Sapiens
AEECRIQKL

SEQ ID NO: 928426 - protein, 9 aa, Homo Sapiens
KGESVKVQL

SEQ ID NO: 928427 - protein, 9 aa, Homo Sapiens
RYTFKIPEI

SEQ ID NO: 928428 - protein, 9 aa, Homo Sapiens
PPPSLSGTL

SEQ ID NO: 928429 - protein, 9 aa, Homo Sapiens
LSAELKIPA

SEQ ID NO: 928430 - protein, 9 aa, Homo Sapiens
QTDYIVYID

SEQ ID NO: 928431 - protein, 9 aa, Homo Sapiens
FPSKFPGAL

SEQ ID NO: 928432 - protein, 9 aa, Homo Sapiens
SLVFPELDQ

SEQ ID NO: 928433 - protein, 9 aa, Homo Sapiens
FLQSFNDVG

SEQ ID NO: 928434 - protein, 9 aa, Homo Sapiens
MAKEFIPCP

SEQ ID NO: 928435 - protein, 9 aa, Homo Sapiens
YLTPGAQKD

SEQ ID NO: 928436 - protein, 9 aa, Homo Sapiens
SFCSWFFSR

SEQ ID NO: 928437 - protein, 9 aa, Homo Sapiens
VFKSFEKPV

SEQ ID NO: 928438 - protein, 9 aa, Homo Sapiens
YIQTQQLHA

SEQ ID NO: 928439 - protein, 9 aa, Homo Sapiens
VSREENQED

SEQ ID NO: 928440 - protein, 9 aa, Homo Sapiens
SPRNWGHLD

SEQ ID NO: 928441 - protein, 9 aa, Homo Sapiens
ALQQVLELS

SEQ ID NO: 928442 - protein, 9 aa, Homo Sapiens
FNFNDGTSS

SEQ ID NO: 928443 - protein, 9 aa, Homo Sapiens
TFDVSVLSF

SEQ ID NO: 928444 - protein, 9 aa, Homo Sapiens
FVDPGVAGK

SEQ ID NO: 928445 - protein, 9 aa, Homo Sapiens
YVHNPVFKS

SEQ ID NO: 928446 - protein, 9 aa, Homo Sapiens
DKFGNYSCP

SEQ ID NO: 928447 - protein, 9 aa, Homo Sapiens
EPRYIAVAV

SEQ ID NO: 928448 - protein, 9 aa, Homo Sapiens
KFNLVQKEY

SEQ ID NO: 928449 - protein, 9 aa, Homo Sapiens
GAEISITLK

SEQ ID NO: 928450 - protein, 9 aa, Homo Sapiens
DPPNPQLMR

SEQ ID NO: 928451 - protein, 9 aa, Homo Sapiens
AERKKKQKE

SEQ ID NO: 928452 - protein, 9 aa, Homo Sapiens
GERLAVSKL

SEQ ID NO: 928453 - protein, 9 aa, Homo Sapiens
KTPKDKKDF

SEQ ID NO: 928454 - protein, 9 aa, Homo Sapiens
DQALNGSKI

SEQ ID NO: 928455 - protein, 9 aa, Homo Sapiens
AKAKAILHA

SEQ ID NO: 928456 - protein, 9 aa, Homo Sapiens
KFGNYSCPH

SEQ ID NO: 928457 - protein, 9 aa, Homo Sapiens
IGDFGLATM

SEQ ID NO: 928458 - protein, 9 aa, Homo Sapiens
CPSHRAQTP

SEQ ID NO: 928459 - protein, 9 aa, Homo Sapiens
AIDWFHAWS

SEQ ID NO: 928460 - protein, 9 aa, Homo Sapiens
CLAPTTMCT

SEQ ID NO: 928461 - protein, 9 aa, Homo Sapiens
SLLLPAPAP

SEQ ID NO: 928462 - protein, 9 aa, Homo Sapiens
LIMLLSSCS

SEQ ID NO: 928463 - protein, 9 aa, Homo Sapiens
RRPYCHFHG

SEQ ID NO: 928464 - protein, 9 aa, Homo Sapiens
FCRTRSLSL

SEQ ID NO: 928465 - protein, 9 aa, Homo Sapiens
LGKSFCSWF

SEQ ID NO: 928466 - protein, 9 aa, Homo Sapiens
LEKNGTAHQ

SEQ ID NO: 928467 - protein, 9 aa, Homo Sapiens
EGDQALNGS

SEQ ID NO: 928468 - protein, 9 aa, Homo Sapiens
GYGGTNVNM

SEQ ID NO: 928469 - protein, 9 aa, Homo Sapiens
GGGSANDFR

SEQ ID NO: 928470 - protein, 9 aa, Homo Sapiens
TYRRPYPDA

SEQ ID NO: 928471 - protein, 9 aa, Homo Sapiens
EVLMCTGPE

SEQ ID NO: 928472 - protein, 9 aa, Homo Sapiens
IKTSQKFSR

SEQ ID NO: 928473 - protein, 9 aa, Homo Sapiens
EECRIQKLI

SEQ ID NO: 928474 - protein, 9 aa, Homo Sapiens
GKEEDFIRK

SEQ ID NO: 928475 - protein, 9 aa, Homo Sapiens
EMPFIKEPH

SEQ ID NO: 928476 - protein, 9 aa, Homo Sapiens
GEHQVKLKA

SEQ ID NO: 928477 - protein, 9 aa, Homo Sapiens
LPEKHGASG

SEQ ID NO: 928478 - protein, 9 aa, Homo Sapiens
RLCGPESPS

SEQ ID NO: 928479 - protein, 9 aa, Homo Sapiens
LRMHSAEER

SEQ ID NO: 928480 - protein, 9 aa, Homo Sapiens
YISTDFSSC

SEQ ID NO: 928481 - protein, 9 aa, Homo Sapiens
FSSYLAVRS

SEQ ID NO: 928482 - protein, 9 aa, Homo Sapiens
CLAKNLVSD

SEQ ID NO: 928483 - protein, 9 aa, Homo Sapiens
EVGAFNSLA

SEQ ID NO: 928484 - protein, 9 aa, Homo Sapiens
LLCALAGLT

SEQ ID NO: 928485 - protein, 9 aa, Homo Sapiens
PYLKRKQIC

SEQ ID NO: 928486 - protein, 9 aa, Homo Sapiens
GDRGQHLDS

SEQ ID NO: 928487 - protein, 9 aa, Homo Sapiens
PNEQGLQQV

SEQ ID NO: 928488 - protein, 9 aa, Homo Sapiens
WSSVFDNLI

SEQ ID NO: 928489 - protein, 9 aa, Homo Sapiens
SPSGRSGST

SEQ ID NO: 928490 - protein, 9 aa, Homo Sapiens
EQVHCRLPY

SEQ ID NO: 928491 - protein, 9 aa, Homo Sapiens
SEHMTEEEM

SEQ ID NO: 928492 - protein, 9 aa, Homo Sapiens
KEHRGCDSS

SEQ ID NO: 928493 - protein, 9 aa, Homo Sapiens
PERYTCVKI

SEQ ID NO: 928494 - protein, 9 aa, Homo Sapiens
PAPRNLVSK

SEQ ID NO: 928495 - protein, 9 aa, Homo Sapiens
GDPKDDFNK

SEQ ID NO: 928496 - protein, 9 aa, Homo Sapiens
AVNSVWEEE

SEQ ID NO: 928497 - protein, 9 aa, Homo Sapiens
DLPSSPIYD

SEQ ID NO: 928498 - protein, 9 aa, Homo Sapiens
GEALAMQSL

SEQ ID NO: 928499 - protein, 9 aa, Homo Sapiens
QIFGICLAK

SEQ ID NO: 928500 - protein, 9 aa, Homo Sapiens
WVQDGSPDM

SEQ ID NO: 928501 - protein, 9 aa, Homo Sapiens
AFHEPRYIA

SEQ ID NO: 928502 - protein, 9 aa, Homo Sapiens
SEKDGAATR

SEQ ID NO: 928503 - protein, 9 aa, Homo Sapiens
CKAICKPLH

SEQ ID NO: 928504 - protein, 9 aa, Homo Sapiens
EQEENLATQ

SEQ ID NO: 928505 - protein, 9 aa, Homo Sapiens
LDYCPIAMQ

SEQ ID NO: 928506 - protein, 9 aa, Homo Sapiens
IESQLKTQK

SEQ ID NO: 928507 - protein, 9 aa, Homo Sapiens
PNLSQLKEL

SEQ ID NO: 928508 - protein, 9 aa, Homo Sapiens
LLEVEFLPD

SEQ ID NO: 928509 - protein, 9 aa, Homo Sapiens
TSQKEGLDR

SEQ ID NO: 928510 - protein, 9 aa, Homo Sapiens
NIDHDPQKI

SEQ ID NO: 928511 - protein, 9 aa, Homo Sapiens
RNSERRSKS

SEQ ID NO: 928512 - protein, 9 aa, Homo Sapiens
EKSHRNSLC

SEQ ID NO: 928513 - protein, 9 aa, Homo Sapiens
DISEYYWLN

SEQ ID NO: 928514 - protein, 9 aa, Homo Sapiens
EVKFGARRL

SEQ ID NO: 928515 - protein, 9 aa, Homo Sapiens
YAVVYGAEK

SEQ ID NO: 928516 - protein, 9 aa, Homo Sapiens
PSLSGTLTI

SEQ ID NO: 928517 - protein, 9 aa, Homo Sapiens
RAARTQRAR

SEQ ID NO: 928518 - protein, 9 aa, Homo Sapiens
TSTGLKPCD

SEQ ID NO: 928519 - protein, 9 aa, Homo Sapiens
NQEKMTQIM

SEQ ID NO: 928520 - protein, 9 aa, Homo Sapiens
NVVVLVAVA

SEQ ID NO: 928521 - protein, 9 aa, Homo Sapiens
DDGLPYPFL

SEQ ID NO: 928522 - protein, 9 aa, Homo Sapiens
VLVDLGLEK

SEQ ID NO: 928523 - protein, 9 aa, Homo Sapiens
LVTAICLLA

SEQ ID NO: 928524 - protein, 9 aa, Homo Sapiens
KAENGPDPG

SEQ ID NO: 928525 - protein, 9 aa, Homo Sapiens
DGTSSANFD

SEQ ID NO: 928526 - protein, 9 aa, Homo Sapiens
EFLPDLRAS

SEQ ID NO: 928527 - protein, 9 aa, Homo Sapiens
EGHSIPLKE

SEQ ID NO: 928528 - protein, 9 aa, Homo Sapiens
HDPQKIHLE

SEQ ID NO: 928529 - protein, 9 aa, Homo Sapiens
RASKRNSER

SEQ ID NO: 928530 - protein, 9 aa, Homo Sapiens
AKRSSAHAG

SEQ ID NO: 928531 - protein, 9 aa, Homo Sapiens
QSKDELVMK

SEQ ID NO: 928532 - protein, 9 aa, Homo Sapiens
IEIAEIMIE

SEQ ID NO: 928533 - protein, 9 aa, Homo Sapiens
AKNPFLDNP

SEQ ID NO: 928534 - protein, 9 aa, Homo Sapiens
LPWVLLVTK

SEQ ID NO: 928535 - protein, 9 aa, Homo Sapiens
DFGLATMKS

SEQ ID NO: 928536 - protein, 9 aa, Homo Sapiens
SVLNPRQSM

SEQ ID NO: 928537 - protein, 9 aa, Homo Sapiens
SYSKSHVSM

SEQ ID NO: 928538 - protein, 9 aa, Homo Sapiens
TNVLQDHNA

SEQ ID NO: 928539 - protein, 9 aa, Homo Sapiens
LNKDGTPRK

SEQ ID NO: 928540 - protein, 9 aa, Homo Sapiens
AAILVTPCL

SEQ ID NO: 928541 - protein, 9 aa, Homo Sapiens
VVLFFYGSL

SEQ ID NO: 928542 - protein, 9 aa, Homo Sapiens
PHEACFLNL

SEQ ID NO: 928543 - protein, 9 aa, Homo Sapiens
SLATRHREM

SEQ ID NO: 928544 - protein, 9 aa, Homo Sapiens
KEKFLMDKR

SEQ ID NO: 928545 - protein, 9 aa, Homo Sapiens
NPQEVTLQA

SEQ ID NO: 928546 - protein, 9 aa, Homo Sapiens
HATVATEKK

SEQ ID NO: 928547 - protein, 9 aa, Homo Sapiens
NGSVLPPTE

SEQ ID NO: 928548 - protein, 9 aa, Homo Sapiens
SVLSFDAGV

SEQ ID NO: 928549 - protein, 9 aa, Homo Sapiens
EEVKFGARR

SEQ ID NO: 928550 - protein, 9 aa, Homo Sapiens
QSNENTIPV

SEQ ID NO: 928551 - protein, 9 aa, Homo Sapiens
AKVAVSAPK

SEQ ID NO: 928552 - protein, 9 aa, Homo Sapiens
KDETEYEYI

SEQ ID NO: 928553 - protein, 9 aa, Homo Sapiens
NKKDEKEKF

SEQ ID NO: 928554 - protein, 9 aa, Homo Sapiens
DPKDDFNKT

SEQ ID NO: 928555 - protein, 9 aa, Homo Sapiens
ENEEEPQWE

SEQ ID NO: 928556 - protein, 9 aa, Homo Sapiens
WEEAEQFCQ

SEQ ID NO: 928557 - protein, 9 aa, Homo Sapiens
LDPSKLFWG

SEQ ID NO: 928558 - protein, 9 aa, Homo Sapiens
GKAKIQDKE

SEQ ID NO: 928559 - protein, 9 aa, Homo Sapiens
ALAGLTLLC

SEQ ID NO: 928560 - protein, 9 aa, Homo Sapiens
ELVYTIPTP

SEQ ID NO: 928561 - protein, 9 aa, Homo Sapiens
KDELVMKIL

SEQ ID NO: 928562 - protein, 9 aa, Homo Sapiens
FLEDLQYQD

SEQ ID NO: 928563 - protein, 9 aa, Homo Sapiens
SLIIPETQV

SEQ ID NO: 928564 - protein, 9 aa, Homo Sapiens
DEKAAKENS

SEQ ID NO: 928565 - protein, 9 aa, Homo Sapiens
ENRVSPTMK

SEQ ID NO: 928566 - protein, 9 aa, Homo Sapiens
QPADQKLGS

SEQ ID NO: 928567 - protein, 9 aa, Homo Sapiens
IRDPIRILV

SEQ ID NO: 928568 - protein, 9 aa, Homo Sapiens
NYIYGTDHQ

SEQ ID NO: 928569 - protein, 9 aa, Homo Sapiens
EADCKNKFC

SEQ ID NO: 928570 - protein, 9 aa, Homo Sapiens
IPNVMLLAY

SEQ ID NO: 928571 - protein, 9 aa, Homo Sapiens
LDGILDVIL

SEQ ID NO: 928572 - protein, 9 aa, Homo Sapiens
CSWFFSRSL

SEQ ID NO: 928573 - protein, 9 aa, Homo Sapiens
TWKGAVLVH

SEQ ID NO: 928574 - protein, 9 aa, Homo Sapiens
QGLTEHTLI

SEQ ID NO: 928575 - protein, 9 aa, Homo Sapiens
SSPIYDSVS

SEQ ID NO: 928576 - protein, 9 aa, Homo Sapiens
SGHRGSSGT

SEQ ID NO: 928577 - protein, 9 aa, Homo Sapiens
TCDFSMYFG

SEQ ID NO: 928578 - protein, 9 aa, Homo Sapiens
ALGSSVLTG

SEQ ID NO: 928579 - protein, 9 aa, Homo Sapiens
KPYRGMKES

SEQ ID NO: 928580 - protein, 9 aa, Homo Sapiens
FNPRPVETL

SEQ ID NO: 928581 - protein, 9 aa, Homo Sapiens
KIHLECSTS

SEQ ID NO: 928582 - protein, 9 aa, Homo Sapiens
LVYTIPTPP

SEQ ID NO: 928583 - protein, 9 aa, Homo Sapiens
RRSGFPSKF

SEQ ID NO: 928584 - protein, 9 aa, Homo Sapiens
SDIDDAVRR

SEQ ID NO: 928585 - protein, 9 aa, Homo Sapiens
HYWYQGNYI

SEQ ID NO: 928586 - protein, 9 aa, Homo Sapiens
CPPSFSTAL

SEQ ID NO: 928587 - protein, 9 aa, Homo Sapiens
DAVRTQYKL

SEQ ID NO: 928588 - protein, 9 aa, Homo Sapiens
PDTEYKIRV

SEQ ID NO: 928589 - protein, 9 aa, Homo Sapiens
SNENTIPVT

SEQ ID NO: 928590 - protein, 9 aa, Homo Sapiens
GMKLYKCNE

SEQ ID NO: 928591 - protein, 9 aa, Homo Sapiens
RAASLLLPA

SEQ ID NO: 928592 - protein, 9 aa, Homo Sapiens
GFHINKKAR

SEQ ID NO: 928593 - protein, 9 aa, Homo Sapiens
HLLEVEFLP

SEQ ID NO: 928594 - protein, 9 aa, Homo Sapiens
SQVSYSQAS

SEQ ID NO: 928595 - protein, 9 aa, Homo Sapiens
TKSEHMTEE

SEQ ID NO: 928596 - protein, 9 aa, Homo Sapiens
AVIESEFIG

SEQ ID NO: 928597 - protein, 9 aa, Homo Sapiens
ALSFYISTD

SEQ ID NO: 928598 - protein, 9 aa, Homo Sapiens
TTEFDVWAY

SEQ ID NO: 928599 - protein, 9 aa, Homo Sapiens
ATKLTYNHE

SEQ ID NO: 928600 - protein, 9 aa, Homo Sapiens
YWLATWTSK

SEQ ID NO: 928601 - protein, 9 aa, Homo Sapiens
LEKNGLTFS

SEQ ID NO: 928602 - protein, 9 aa, Homo Sapiens
RAVEEEESC

SEQ ID NO: 928603 - protein, 9 aa, Homo Sapiens
TPKKEHCYL

SEQ ID NO: 928604 - protein, 9 aa, Homo Sapiens
YLKRKQICE

SEQ ID NO: 928605 - protein, 9 aa, Homo Sapiens
PTQGPSPRG

SEQ ID NO: 928606 - protein, 9 aa, Homo Sapiens
STLGKSFCS

SEQ ID NO: 928607 - protein, 9 aa, Homo Sapiens
YDSVSPANP

SEQ ID NO: 928608 - protein, 9 aa, Homo Sapiens
WKVWVFSIL

SEQ ID NO: 928609 - protein, 9 aa, Homo Sapiens
MPFIKEPHW

SEQ ID NO: 928610 - protein, 9 aa, Homo Sapiens
VDYGLKVSP

SEQ ID NO: 928611 - protein, 9 aa, Homo Sapiens
TRPVQPVVP

SEQ ID NO: 928612 - protein, 9 aa, Homo Sapiens
IYLTFSVAM

SEQ ID NO: 928613 - protein, 9 aa, Homo Sapiens
FWNPHTEAH

SEQ ID NO: 928614 - protein, 9 aa, Homo Sapiens
FIKEPHWLF

SEQ ID NO: 928615 - protein, 9 aa, Homo Sapiens
LQPLLDGFF

SEQ ID NO: 928616 - protein, 9 aa, Homo Sapiens
KLIALLKWK

SEQ ID NO: 928617 - protein, 9 aa, Homo Sapiens
PLPDNEHDL

SEQ ID NO: 928618 - protein, 9 aa, Homo Sapiens
IQEDLQQLR

SEQ ID NO: 928619 - protein, 9 aa, Homo Sapiens
RTSSSSSDS

SEQ ID NO: 928620 - protein, 9 aa, Homo Sapiens
KSRYTFKIP

SEQ ID NO: 928621 - protein, 9 aa, Homo Sapiens
FSNLAQWDS

SEQ ID NO: 928622 - protein, 9 aa, Homo Sapiens
DLQHYGFHF

SEQ ID NO: 928623 - protein, 9 aa, Homo Sapiens
SFNLSWPDR

SEQ ID NO: 928624 - protein, 9 aa, Homo Sapiens
RVKWPVKLF

SEQ ID NO: 928625 - protein, 9 aa, Homo Sapiens
GNYIYGTDH

SEQ ID NO: 928626 - protein, 9 aa, Homo Sapiens
ISTDFSSCS

SEQ ID NO: 928627 - protein, 9 aa, Homo Sapiens
GHRGSSGTQ

SEQ ID NO: 928628 - protein, 9 aa, Homo Sapiens
GGHQQGSPP

SEQ ID NO: 928629 - protein, 9 aa, Homo Sapiens
RAQKASSNV

SEQ ID NO: 928630 - protein, 9 aa, Homo Sapiens
KALSFYIST

SEQ ID NO: 928631 - protein, 9 aa, Homo Sapiens
LLQLAQLHT

SEQ ID NO: 928632 - protein, 9 aa, Homo Sapiens
KYSINNTGK

SEQ ID NO: 928633 - protein, 9 aa, Homo Sapiens
VALPGEGDR

SEQ ID NO: 928634 - protein, 9 aa, Homo Sapiens
LMDLKYVSA

SEQ ID NO: 928635 - protein, 9 aa, Homo Sapiens
EISSEIQQL

SEQ ID NO: 928636 - protein, 9 aa, Homo Sapiens
QLQPCLDWA

SEQ ID NO: 928637 - protein, 9 aa, Homo Sapiens
TGVLSGYGG

SEQ ID NO: 928638 - protein, 9 aa, Homo Sapiens
HLSCVRSLE

SEQ ID NO: 928639 - protein, 9 aa, Homo Sapiens
DGIKMEKSP

SEQ ID NO: 928640 - protein, 9 aa, Homo Sapiens
NANSISCSS

SEQ ID NO: 928641 - protein, 9 aa, Homo Sapiens
KIEREQHQT

SEQ ID NO: 928642 - protein, 9 aa, Homo Sapiens
AKAASEKNY

SEQ ID NO: 928643 - protein, 9 aa, Homo Sapiens
KLGLDEYLN

SEQ ID NO: 928644 - protein, 9 aa, Homo Sapiens
HSSSNKGDL

SEQ ID NO: 928645 - protein, 9 aa, Homo Sapiens
EYFPFRPHP

SEQ ID NO: 928646 - protein, 9 aa, Homo Sapiens
CIKSALQAE

SEQ ID NO: 928647 - protein, 9 aa, Homo Sapiens
NILNLQGKG

SEQ ID NO: 928648 - protein, 9 aa, Homo Sapiens
GALVCAFSN

SEQ ID NO: 928649 - protein, 9 aa, Homo Sapiens
ESESVDEVF

SEQ ID NO: 928650 - protein, 9 aa, Homo Sapiens
PTGPAEEAN

SEQ ID NO: 928651 - protein, 9 aa, Homo Sapiens
MVAGNADSS

SEQ ID NO: 928652 - protein, 9 aa, Homo Sapiens
NSNNYNIVR

SEQ ID NO: 928653 - protein, 9 aa, Homo Sapiens
EDQTQLLIL

SEQ ID NO: 928654 - protein, 9 aa, Homo Sapiens
LVLLKTREE

SEQ ID NO: 928655 - protein, 9 aa, Homo Sapiens
RHEGRAPSR

SEQ ID NO: 928656 - protein, 9 aa, Homo Sapiens
AGSGRNILR

SEQ ID NO: 928657 - protein, 9 aa, Homo Sapiens
ELGNISLRC

SEQ ID NO: 928658 - protein, 9 aa, Homo Sapiens
EKKFFFVKV

SEQ ID NO: 928659 - protein, 9 aa, Homo Sapiens
RAERKKKQK

SEQ ID NO: 928660 - protein, 9 aa, Homo Sapiens
MKGAVLINS

SEQ ID NO: 928661 - protein, 9 aa, Homo Sapiens
YGGTNVNMP

SEQ ID NO: 928662 - protein, 9 aa, Homo Sapiens
TVYYQGKCY

SEQ ID NO: 928663 - protein, 9 aa, Homo Sapiens
FVLEVAKRS

SEQ ID NO: 928664 - protein, 9 aa, Homo Sapiens
TSEEVPPCQ

SEQ ID NO: 928665 - protein, 9 aa, Homo Sapiens
IRPPPSLSG

SEQ ID NO: 928666 - protein, 9 aa, Homo Sapiens
EARSEHGRY

SEQ ID NO: 928667 - protein, 9 aa, Homo Sapiens
PPKMLSSVS

SEQ ID NO: 928668 - protein, 9 aa, Homo Sapiens
NPTTTYLGA

SEQ ID NO: 928669 - protein, 9 aa, Homo Sapiens
RGIGGLGEL

SEQ ID NO: 928670 - protein, 9 aa, Homo Sapiens
ICHSLCYST

SEQ ID NO: 928671 - protein, 9 aa, Homo Sapiens
VLLKTREEV

SEQ ID NO: 928672 - protein, 9 aa, Homo Sapiens
KTREEVLQL

SEQ ID NO: 928673 - protein, 9 aa, Homo Sapiens
EKTRCQHKR

SEQ ID NO: 928674 - protein, 9 aa, Homo Sapiens
QKLYLNDNH

SEQ ID NO: 928675 - protein, 9 aa, Homo Sapiens
ALILAVCCE

SEQ ID NO: 928676 - protein, 9 aa, Homo Sapiens
HCRLLLQLA

SEQ ID NO: 928677 - protein, 9 aa, Homo Sapiens
RSKSYLSHM

SEQ ID NO: 928678 - protein, 9 aa, Homo Sapiens
RGQHLDSEE

SEQ ID NO: 928679 - protein, 9 aa, Homo Sapiens
QPVGLIAVR

SEQ ID NO: 928680 - protein, 9 aa, Homo Sapiens
PIDGIKMEK

SEQ ID NO: 928681 - protein, 9 aa, Homo Sapiens
KNFFRGQLQ

SEQ ID NO: 928682 - protein, 9 aa, Homo Sapiens
LIMFSRLKQ

SEQ ID NO: 928683 - protein, 9 aa, Homo Sapiens
RCKAICKPL

SEQ ID NO: 928684 - protein, 9 aa, Homo Sapiens
IEREQHQTE

SEQ ID NO: 928685 - protein, 9 aa, Homo Sapiens
LSGTLTITS

SEQ ID NO: 928686 - protein, 9 aa, Homo Sapiens
GSVFLFAAE

SEQ ID NO: 928687 - protein, 9 aa, Homo Sapiens
KHGQFHTDE

SEQ ID NO: 928688 - protein, 9 aa, Homo Sapiens
TNSNNYNIV

SEQ ID NO: 928689 - protein, 9 aa, Homo Sapiens
DSPSSSTFI

SEQ ID NO: 928690 - protein, 9 aa, Homo Sapiens
YWYQGNYIY

SEQ ID NO: 928691 - protein, 9 aa, Homo Sapiens
YHRTQVPQF

SEQ ID NO: 928692 - protein, 9 aa, Homo Sapiens
KENKIFKDE

SEQ ID NO: 928693 - protein, 9 aa, Homo Sapiens
TEHTLILVK

SEQ ID NO: 928694 - protein, 9 aa, Homo Sapiens
SPRGWHAGG

SEQ ID NO: 928695 - protein, 9 aa, Homo Sapiens
YDRCKAICK

SEQ ID NO: 928696 - protein, 9 aa, Homo Sapiens
INQPPFGIF

SEQ ID NO: 928697 - protein, 9 aa, Homo Sapiens
LNDNHLTKL

SEQ ID NO: 928698 - protein, 9 aa, Homo Sapiens
EMAKEFIPC

SEQ ID NO: 928699 - protein, 9 aa, Homo Sapiens
PGLQGPPEP

SEQ ID NO: 928700 - protein, 9 aa, Homo Sapiens
SPRLVSFKE

SEQ ID NO: 928701 - protein, 9 aa, Homo Sapiens
QNDLQHYGF

SEQ ID NO: 928702 - protein, 9 aa, Homo Sapiens
HASRSSMGM

SEQ ID NO: 928703 - protein, 9 aa, Homo Sapiens
FLLHLLEVE

SEQ ID NO: 928704 - protein, 9 aa, Homo Sapiens
RYTTEFDVW

SEQ ID NO: 928705 - protein, 9 aa, Homo Sapiens
LFFYGSLMG

SEQ ID NO: 928706 - protein, 9 aa, Homo Sapiens
DRDGYTVAD

SEQ ID NO: 928707 - protein, 9 aa, Homo Sapiens
RLIASPRRS

SEQ ID NO: 928708 - protein, 9 aa, Homo Sapiens
SGEALAMQS

SEQ ID NO: 928709 - protein, 9 aa, Homo Sapiens
HHKIMHRVA

SEQ ID NO: 928710 - protein, 9 aa, Homo Sapiens
IGSEEEEEE

SEQ ID NO: 928711 - protein, 9 aa, Homo Sapiens
LGNISLRCP

SEQ ID NO: 928712 - protein, 9 aa, Homo Sapiens
VHNPVFKSF

SEQ ID NO: 928713 - protein, 9 aa, Homo Sapiens
HGSGEALAM

SEQ ID NO: 928714 - protein, 9 aa, Homo Sapiens
SKRNSERRS

SEQ ID NO: 928715 - protein, 9 aa, Homo Sapiens
FAAGSESPN

SEQ ID NO: 928716 - protein, 9 aa, Homo Sapiens
AVVYGAEKE

SEQ ID NO: 928717 - protein, 9 aa, Homo Sapiens
NQLSEFTIE

SEQ ID NO: 928718 - protein, 9 aa, Homo Sapiens
QVPSLFFND

SEQ ID NO: 928719 - protein, 9 aa, Homo Sapiens
EIVTLNYLK

SEQ ID NO: 928720 - protein, 9 aa, Homo Sapiens
FHCKMSEYP

SEQ ID NO: 928721 - protein, 9 aa, Homo Sapiens
SSSTFISIQ

SEQ ID NO: 928722 - protein, 9 aa, Homo Sapiens
VAICHSLCY

SEQ ID NO: 928723 - protein, 9 aa, Homo Sapiens
TLQRVPTAP

SEQ ID NO: 928724 - protein, 9 aa, Homo Sapiens
HPKDNSPVI

SEQ ID NO: 928725 - protein, 9 aa, Homo Sapiens
LAEDTSDGL

SEQ ID NO: 928726 - protein, 9 aa, Homo Sapiens
EACFLNLVD

SEQ ID NO: 928727 - protein, 9 aa, Homo Sapiens
KKQKEERQA

SEQ ID NO: 928728 - protein, 9 aa, Homo Sapiens
LGSSDSLAS

SEQ ID NO: 928729 - protein, 9 aa, Homo Sapiens
QKENTLLHF

SEQ ID NO: 928730 - protein, 9 aa, Homo Sapiens
QPSEVQHEC

SEQ ID NO: 928731 - protein, 9 aa, Homo Sapiens
GPESPSPPY

SEQ ID NO: 928732 - protein, 9 aa, Homo Sapiens
VQIRNYFSV

SEQ ID NO: 928733 - protein, 9 aa, Homo Sapiens
GMRVTYFCN

SEQ ID NO: 928734 - protein, 9 aa, Homo Sapiens
ESVKVQLCV

SEQ ID NO: 928735 - protein, 9 aa, Homo Sapiens
NFEFVGRLH

SEQ ID NO: 928736 - protein, 9 aa, Homo Sapiens
KLRCLQKFY

SEQ ID NO: 928737 - protein, 9 aa, Homo Sapiens
YPNLSQLKE

SEQ ID NO: 928738 - protein, 9 aa, Homo Sapiens
VSVLSFDAG

SEQ ID NO: 928739 - protein, 9 aa, Homo Sapiens
GIKMEKSPL

SEQ ID NO: 928740 - protein, 9 aa, Homo Sapiens
SNNYNIVRI

SEQ ID NO: 928741 - protein, 9 aa, Homo Sapiens
KEKGIPSFQ

SEQ ID NO: 928742 - protein, 9 aa, Homo Sapiens
YIDELSSFI

SEQ ID NO: 928743 - protein, 9 aa, Homo Sapiens
LEKFNLVQK

SEQ ID NO: 928744 - protein, 9 aa, Homo Sapiens
KNHGSQCGF

SEQ ID NO: 928745 - protein, 9 aa, Homo Sapiens
SISLVFPEL

SEQ ID NO: 928746 - protein, 9 aa, Homo Sapiens
WNPHTEAHV

SEQ ID NO: 928747 - protein, 9 aa, Homo Sapiens
AQKASSNVF

SEQ ID NO: 928748 - protein, 9 aa, Homo Sapiens
VRTQYKLIA

SEQ ID NO: 928749 - protein, 9 aa, Homo Sapiens
VKDDQVFSM

SEQ ID NO: 928750 - protein, 9 aa, Homo Sapiens
EGLDRFQAA

SEQ ID NO: 928751 - protein, 9 aa, Homo Sapiens
PLGEVLFSI

SEQ ID NO: 928752 - protein, 9 aa, Homo Sapiens
SLYSQPPKT

SEQ ID NO: 928753 - protein, 9 aa, Homo Sapiens
NKKKLSCYD

SEQ ID NO: 928754 - protein, 9 aa, Homo Sapiens
EANSHTTLP

SEQ ID NO: 928755 - protein, 9 aa, Homo Sapiens
LWKVATFRH

SEQ ID NO: 928756 - protein, 9 aa, Homo Sapiens
HGSGPDNCT

SEQ ID NO: 928757 - protein, 9 aa, Homo Sapiens
WKDSSLATR

SEQ ID NO: 928758 - protein, 9 aa, Homo Sapiens
MKQSKEKSP

SEQ ID NO: 928759 - protein, 9 aa, Homo Sapiens
DYGLKVSPF

SEQ ID NO: 928760 - protein, 9 aa, Homo Sapiens
QVKIEREQH

SEQ ID NO: 928761 - protein, 9 aa, Homo Sapiens
KKFIRDPIR

SEQ ID NO: 928762 - protein, 9 aa, Homo Sapiens
LANITLEPM

SEQ ID NO: 928763 - protein, 9 aa, Homo Sapiens
VMKILSDLL

SEQ ID NO: 928764 - protein, 9 aa, Homo Sapiens
NQEPLEETE

SEQ ID NO: 928765 - protein, 9 aa, Homo Sapiens
GGKHGPAGT

SEQ ID NO: 928766 - protein, 9 aa, Homo Sapiens
LGGVRASRL

SEQ ID NO: 928767 - protein, 9 aa, Homo Sapiens
RNIDHDPQK

SEQ ID NO: 928768 - protein, 9 aa, Homo Sapiens
VDNEDSVTP

SEQ ID NO: 928769 - protein, 9 aa, Homo Sapiens
GLFKNKVIW

SEQ ID NO: 928770 - protein, 9 aa, Homo Sapiens
FKCGKAFTQ

SEQ ID NO: 928771 - protein, 9 aa, Homo Sapiens
YIFFKTPRK

SEQ ID NO: 928772 - protein, 9 aa, Homo Sapiens
RLIRGRTST

SEQ ID NO: 928773 - protein, 9 aa, Homo Sapiens
TIENGKAKI

SEQ ID NO: 928774 - protein, 9 aa, Homo Sapiens
NTRGSWLPE

SEQ ID NO: 928775 - protein, 9 aa, Homo Sapiens
DGKWTTLPV

SEQ ID NO: 928776 - protein, 9 aa, Homo Sapiens
MHLLDGRAQ

SEQ ID NO: 928777 - protein, 9 aa, Homo Sapiens
CKNKFCCDS

SEQ ID NO: 928778 - protein, 9 aa, Homo Sapiens
QDFFNQNET

SEQ ID NO: 928779 - protein, 9 aa, Homo Sapiens
TEYEYIGSE

SEQ ID NO: 928780 - protein, 9 aa, Homo Sapiens
MKSRWSGSH

SEQ ID NO: 928781 - protein, 9 aa, Homo Sapiens
EGRAPSRGR

SEQ ID NO: 928782 - protein, 9 aa, Homo Sapiens
MSFNLSWPD

SEQ ID NO: 928783 - protein, 9 aa, Homo Sapiens
ASRDFRGIG

SEQ ID NO: 928784 - protein, 9 aa, Homo Sapiens
NILRLKHQC

SEQ ID NO: 928785 - protein, 9 aa, Homo Sapiens
MCGKDADAC

SEQ ID NO: 928786 - protein, 9 aa, Homo Sapiens
KTKGFYCLW

SEQ ID NO: 928787 - protein, 9 aa, Homo Sapiens
CAAASPYLK

SEQ ID NO: 928788 - protein, 9 aa, Homo Sapiens
GITKLVVLL

SEQ ID NO: 928789 - protein, 9 aa, Homo Sapiens
SNLAQWDSP

SEQ ID NO: 928790 - protein, 9 aa, Homo Sapiens
EENQEDKAT

SEQ ID NO: 928791 - protein, 9 aa, Homo Sapiens
ERGFPGPAG

SEQ ID NO: 928792 - protein, 9 aa, Homo Sapiens
SLRQKDDFG

SEQ ID NO: 928793 - protein, 9 aa, Homo Sapiens
AEQEHIQED

SEQ ID NO: 928794 - protein, 9 aa, Homo Sapiens
DKENKIFKD

SEQ ID NO: 928795 - protein, 9 aa, Homo Sapiens
TEAENSNGS

SEQ ID NO: 928796 - protein, 9 aa, Homo Sapiens
IIYLTFSVA

SEQ ID NO: 928797 - protein, 9 aa, Homo Sapiens
KAREAAVRV

SEQ ID NO: 928798 - protein, 9 aa, Homo Sapiens
FHNPVVEVE

SEQ ID NO: 928799 - protein, 9 aa, Homo Sapiens
TDGTCLFSH

SEQ ID NO: 928800 - protein, 9 aa, Homo Sapiens
CRTRSLSLQ

SEQ ID NO: 928801 - protein, 9 aa, Homo Sapiens
MVQSGGGSA

SEQ ID NO: 928802 - protein, 9 aa, Homo Sapiens
RQTWKGAVL

SEQ ID NO: 928803 - protein, 9 aa, Homo Sapiens
IIQNNAYAV

SEQ ID NO: 928804 - protein, 9 aa, Homo Sapiens
SPPYSRLSP

SEQ ID NO: 928805 - protein, 9 aa, Homo Sapiens
PLTLINLVA

SEQ ID NO: 928806 - protein, 9 aa, Homo Sapiens
DGLLTCHGS

SEQ ID NO: 928807 - protein, 9 aa, Homo Sapiens
ELNKMCHKP

SEQ ID NO: 928808 - protein, 9 aa, Homo Sapiens
HNWKVWVFS

SEQ ID NO: 928809 - protein, 9 aa, Homo Sapiens
AEGNFNPRP

SEQ ID NO: 928810 - protein, 9 aa, Homo Sapiens
PLDNKKDNL

SEQ ID NO: 928811 - protein, 9 aa, Homo Sapiens
VSYSQASPN

SEQ ID NO: 928812 - protein, 9 aa, Homo Sapiens
LNKLKHTES

SEQ ID NO: 928813 - protein, 9 aa, Homo Sapiens
HGGITKLVV

SEQ ID NO: 928814 - protein, 9 aa, Homo Sapiens
AVRLGAEEA

SEQ ID NO: 928815 - protein, 9 aa, Homo Sapiens
FPILPSDAA

SEQ ID NO: 928816 - protein, 9 aa, Homo Sapiens
ENTLLHFFA

SEQ ID NO: 928817 - protein, 9 aa, Homo Sapiens
NIIWMANHT

SEQ ID NO: 928818 - protein, 9 aa, Homo Sapiens
KSDPGLPGA

SEQ ID NO: 928819 - protein, 9 aa, Homo Sapiens
SVRRPGIEI

SEQ ID NO: 928820 - protein, 9 aa, Homo Sapiens
PAQPPPSEP

SEQ ID NO: 928821 - protein, 9 aa, Homo Sapiens
QKNVDMRDS

SEQ ID NO: 928822 - protein, 9 aa, Homo Sapiens
QLTSPSTAF

SEQ ID NO: 928823 - protein, 9 aa, Homo Sapiens
SAFHEPRYI

SEQ ID NO: 928824 - protein, 9 aa, Homo Sapiens
KFQDFFNQN

SEQ ID NO: 928825 - protein, 9 aa, Homo Sapiens
IMFSRLKQI

SEQ ID NO: 928826 - protein, 9 aa, Homo Sapiens
QGQLQPLLD

SEQ ID NO: 928827 - protein, 9 aa, Homo Sapiens
QQNTSINMQ

SEQ ID NO: 928828 - protein, 9 aa, Homo Sapiens
KISYSKSHV

SEQ ID NO: 928829 - protein, 9 aa, Homo Sapiens
VLEVTKKFI

SEQ ID NO: 928830 - protein, 9 aa, Homo Sapiens
KGAVLVHRK

SEQ ID NO: 928831 - protein, 9 aa, Homo Sapiens
SLPPAAHLN

SEQ ID NO: 928832 - protein, 9 aa, Homo Sapiens
KAKKANVVV

SEQ ID NO: 928833 - protein, 9 aa, Homo Sapiens
LEDLQYQDQ

SEQ ID NO: 928834 - protein, 9 aa, Homo Sapiens
VGMRVTYFC

SEQ ID NO: 928835 - protein, 9 aa, Homo Sapiens
LSIKESATS

SEQ ID NO: 928836 - protein, 9 aa, Homo Sapiens
TGYRPQDRI

SEQ ID NO: 928837 - protein, 9 aa, Homo Sapiens
GAEKERLAA

SEQ ID NO: 928838 - protein, 9 aa, Homo Sapiens
FLGDSPIHS

SEQ ID NO: 928839 - protein, 9 aa, Homo Sapiens
GHSIPLKEG

SEQ ID NO: 928840 - protein, 9 aa, Homo Sapiens
RPVQPVVPR

SEQ ID NO: 928841 - protein, 9 aa, Homo Sapiens
HLSHFSSPD

SEQ ID NO: 928842 - protein, 9 aa, Homo Sapiens
LLKTREEVL

SEQ ID NO: 928843 - protein, 9 aa, Homo Sapiens
NLQGKGLSY

SEQ ID NO: 928844 - protein, 9 aa, Homo Sapiens
AAMSYDRCK

SEQ ID NO: 928845 - protein, 9 aa, Homo Sapiens
ITWKGTNGE

SEQ ID NO: 928846 - protein, 9 aa, Homo Sapiens
YVFSESIRK

SEQ ID NO: 928847 - protein, 9 aa, Homo Sapiens
GNFYVFSES

SEQ ID NO: 928848 - protein, 9 aa, Homo Sapiens
NEQGLQQVL

SEQ ID NO: 928849 - protein, 9 aa, Homo Sapiens
TPKDKKDFS

SEQ ID NO: 928850 - protein, 9 aa, Homo Sapiens
EVELLVSPE

SEQ ID NO: 928851 - protein, 9 aa, Homo Sapiens
MEEREADSC

SEQ ID NO: 928852 - protein, 9 aa, Homo Sapiens
VKKDGAHSA

SEQ ID NO: 928853 - protein, 9 aa, Homo Sapiens
DLVYPEIFS

SEQ ID NO: 928854 - protein, 9 aa, Homo Sapiens
DERESSLSN

SEQ ID NO: 928855 - protein, 9 aa, Homo Sapiens
SSPEDSLII

SEQ ID NO: 928856 - protein, 9 aa, Homo Sapiens
AKNLVSDIE

SEQ ID NO: 928857 - protein, 9 aa, Homo Sapiens
FSRLFGPTL

SEQ ID NO: 928858 - protein, 9 aa, Homo Sapiens
ILRMHSAEE

SEQ ID NO: 928859 - protein, 9 aa, Homo Sapiens
FDVWAYGVV

SEQ ID NO: 928860 - protein, 9 aa, Homo Sapiens
RTRSLSLQK

SEQ ID NO: 928861 - protein, 9 aa, Homo Sapiens
KEKQLKTSC

SEQ ID NO: 928862 - protein, 9 aa, Homo Sapiens
FLNLVDHGR

SEQ ID NO: 928863 - protein, 9 aa, Homo Sapiens
CPIAMQSLW

SEQ ID NO: 928864 - protein, 9 aa, Homo Sapiens
AVGKFSLVL

SEQ ID NO: 928865 - protein, 9 aa, Homo Sapiens
VFSSYLAVR

SEQ ID NO: 928866 - protein, 9 aa, Homo Sapiens
TSRKEPVVG

SEQ ID NO: 928867 - protein, 9 aa, Homo Sapiens
NKLKHTESD

SEQ ID NO: 928868 - protein, 9 aa, Homo Sapiens
ESEVTAMLE

SEQ ID NO: 928869 - protein, 9 aa, Homo Sapiens
IRASKRNSE

SEQ ID NO: 928870 - protein, 9 aa, Homo Sapiens
GEPGLRGPP

SEQ ID NO: 928871 - protein, 9 aa, Homo Sapiens
SDPDTSYVL

SEQ ID NO: 928872 - protein, 9 aa, Homo Sapiens
LTVVLFFYG

SEQ ID NO: 928873 - protein, 9 aa, Homo Sapiens
FNSLASLNT

SEQ ID NO: 928874 - protein, 9 aa, Homo Sapiens
LGLMCGKDA

SEQ ID NO: 928875 - protein, 9 aa, Homo Sapiens
ALATWSFPA

SEQ ID NO: 928876 - protein, 9 aa, Homo Sapiens
VYQLQELWR

SEQ ID NO: 928877 - protein, 9 aa, Homo Sapiens
HKDEENEAV

SEQ ID NO: 928878 - protein, 9 aa, Homo Sapiens
KDKKDFSVT

SEQ ID NO: 928879 - protein, 9 aa, Homo Sapiens
NLRALSLED

SEQ ID NO: 928880 - protein, 9 aa, Homo Sapiens
AAEECRIQK

SEQ ID NO: 928881 - protein, 9 aa, Homo Sapiens
STKLEQVKL

SEQ ID NO: 928882 - protein, 9 aa, Homo Sapiens
PSSVQQVLT

SEQ ID NO: 928883 - protein, 9 aa, Homo Sapiens
WQPNEQGLQ

SEQ ID NO: 928884 - protein, 9 aa, Homo Sapiens
ECFCPPSFS

SEQ ID NO: 928885 - protein, 9 aa, Homo Sapiens
TSQKFSRVP

SEQ ID NO: 928886 - protein, 9 aa, Homo Sapiens
FGDIIPLGV

SEQ ID NO: 928887 - protein, 9 aa, Homo Sapiens
GAKGEKENA

SEQ ID NO: 928888 - protein, 9 aa, Homo Sapiens
KNGTAHQRA

SEQ ID NO: 928889 - protein, 9 aa, Homo Sapiens
ETAGGTAKS

SEQ ID NO: 928890 - protein, 9 aa, Homo Sapiens
DFHNPVVEV

SEQ ID NO: 928891 - protein, 9 aa, Homo Sapiens
SNDKALGLM

SEQ ID NO: 928892 - protein, 9 aa, Homo Sapiens
PAPSSSSFS

SEQ ID NO: 928893 - protein, 9 aa, Homo Sapiens
SIYLGNIAS

SEQ ID NO: 928894 - protein, 9 aa, Homo Sapiens
YSFFVFNLF

SEQ ID NO: 928895 - protein, 9 aa, Homo Sapiens
CRRSGFPSK

SEQ ID NO: 928896 - protein, 9 aa, Homo Sapiens
SSSPRLVSF

SEQ ID NO: 928897 - protein, 9 aa, Homo Sapiens
QAALAEVQE

SEQ ID NO: 928898 - protein, 9 aa, Homo Sapiens
LRCPVSGGC

SEQ ID NO: 928899 - protein, 9 aa, Homo Sapiens
KSAVDGTAK

SEQ ID NO: 928900 - protein, 9 aa, Homo Sapiens
SPLDNKKDN

SEQ ID NO: 928901 - protein, 9 aa, Homo Sapiens
LQQVLELSE

SEQ ID NO: 928902 - protein, 9 aa, Homo Sapiens
SRLFGPTLS

SEQ ID NO: 928903 - protein, 9 aa, Homo Sapiens
ERPFSCTQC

SEQ ID NO: 928904 - protein, 9 aa, Homo Sapiens
ENSRGKNFF

SEQ ID NO: 928905 - protein, 9 aa, Homo Sapiens
ELQVFSSYL

SEQ ID NO: 928906 - protein, 9 aa, Homo Sapiens
QTWKGAVLV

SEQ ID NO: 928907 - protein, 9 aa, Homo Sapiens
LRAQKASSN

SEQ ID NO: 928908 - protein, 9 aa, Homo Sapiens
GQIEEEGIL

SEQ ID NO: 928909 - protein, 9 aa, Homo Sapiens
QQVLTIIKQ

SEQ ID NO: 928910 - protein, 9 aa, Homo Sapiens
GICLAKNLV

SEQ ID NO: 928911 - protein, 9 aa, Homo Sapiens
AQACVRHCE

SEQ ID NO: 928912 - protein, 9 aa, Homo Sapiens
DSPILSVSS

SEQ ID NO: 928913 - protein, 9 aa, Homo Sapiens
WKVATFRHG

SEQ ID NO: 928914 - protein, 9 aa, Homo Sapiens
QACVRHCES

SEQ ID NO: 928915 - protein, 9 aa, Homo Sapiens
EISITLKPA

SEQ ID NO: 928916 - protein, 9 aa, Homo Sapiens
AGSLAITIA

SEQ ID NO: 928917 - protein, 9 aa, Homo Sapiens
RTQYKLIAQ

SEQ ID NO: 928918 - protein, 9 aa, Homo Sapiens
ALTGVLSGY

SEQ ID NO: 928919 - protein, 9 aa, Homo Sapiens
SLSNGRSVS

SEQ ID NO: 928920 - protein, 9 aa, Homo Sapiens
DYSSKSFDF

SEQ ID NO: 928921 - protein, 9 aa, Homo Sapiens
NLVNVCLGF

SEQ ID NO: 928922 - protein, 9 aa, Homo Sapiens
FMAPSCSAL

SEQ ID NO: 928923 - protein, 9 aa, Homo Sapiens
KMANGHHIH

SEQ ID NO: 928924 - protein, 9 aa, Homo Sapiens
LPGARGPKG

SEQ ID NO: 928925 - protein, 9 aa, Homo Sapiens
ENEAVEAVL

SEQ ID NO: 928926 - protein, 9 aa, Homo Sapiens
IFGICLAKN

SEQ ID NO: 928927 - protein, 9 aa, Homo Sapiens
QCPSHRAQT

SEQ ID NO: 928928 - protein, 9 aa, Homo Sapiens
SLEDQPLVL

SEQ ID NO: 928929 - protein, 9 aa, Homo Sapiens
AQPADQKLG

SEQ ID NO: 928930 - protein, 9 aa, Homo Sapiens
YRGMKESEV

SEQ ID NO: 928931 - protein, 9 aa, Homo Sapiens
LAVCCESAS

SEQ ID NO: 928932 - protein, 9 aa, Homo Sapiens
WAQLNYRQI

SEQ ID NO: 928933 - protein, 9 aa, Homo Sapiens
SIDDEALWK

SEQ ID NO: 928934 - protein, 9 aa, Homo Sapiens
QTLIGQTSQ

SEQ ID NO: 928935 - protein, 9 aa, Homo Sapiens
SHNTRGSWL

SEQ ID NO: 928936 - protein, 9 aa, Homo Sapiens
PPSGTQNEF

SEQ ID NO: 928937 - protein, 9 aa, Homo Sapiens
ENGPDPGVL

SEQ ID NO: 928938 - protein, 9 aa, Homo Sapiens
KENAGFPGL

SEQ ID NO: 928939 - protein, 9 aa, Homo Sapiens
RGDVIDYSL

SEQ ID NO: 928940 - protein, 9 aa, Homo Sapiens
VTEYTLQRV

SEQ ID NO: 928941 - protein, 9 aa, Homo Sapiens
YTVADLSDF

SEQ ID NO: 928942 - protein, 9 aa, Homo Sapiens
KVLSVNYTV

SEQ ID NO: 928943 - protein, 9 aa, Homo Sapiens
FEQPSEVQH

SEQ ID NO: 928944 - protein, 9 aa, Homo Sapiens
ETQPWSFPK

SEQ ID NO: 928945 - protein, 9 aa, Homo Sapiens
VDLIDASVA

SEQ ID NO: 928946 - protein, 9 aa, Homo Sapiens
SRVTTALGS

SEQ ID NO: 928947 - protein, 9 aa, Homo Sapiens
VNSKIHNIF

SEQ ID NO: 928948 - protein, 9 aa, Homo Sapiens
EEPSTIFKL

SEQ ID NO: 928949 - protein, 9 aa, Homo Sapiens
CGGGGAHEP

SEQ ID NO: 928950 - protein, 9 aa, Homo Sapiens
SLMCRMSNK

SEQ ID NO: 928951 - protein, 9 aa, Homo Sapiens
VLQVFFKTN

SEQ ID NO: 928952 - protein, 9 aa, Homo Sapiens
EDGPVHRAG

SEQ ID NO: 928953 - protein, 9 aa, Homo Sapiens
GGAGFDINC

SEQ ID NO: 928954 - protein, 9 aa, Homo Sapiens
LLSDCDLKK

SEQ ID NO: 928955 - protein, 9 aa, Homo Sapiens
QLELSEQQV

SEQ ID NO: 928956 - protein, 9 aa, Homo Sapiens
GRVVSRLDG

SEQ ID NO: 928957 - protein, 9 aa, Homo Sapiens
AFHHKEEKH

SEQ ID NO: 928958 - protein, 9 aa, Homo Sapiens
RVLHCHVAS

SEQ ID NO: 928959 - protein, 9 aa, Homo Sapiens
CIESGPRFC

SEQ ID NO: 928960 - protein, 9 aa, Homo Sapiens
TTVTPTLTP

SEQ ID NO: 928961 - protein, 9 aa, Homo Sapiens
EGQSLLEPL

SEQ ID NO: 928962 - protein, 9 aa, Homo Sapiens
MAIFKLLDY

SEQ ID NO: 928963 - protein, 9 aa, Homo Sapiens
RPNDFAFYL

SEQ ID NO: 928964 - protein, 9 aa, Homo Sapiens
FSVAGYSLG

SEQ ID NO: 928965 - protein, 9 aa, Homo Sapiens
GEEQAVAPC

SEQ ID NO: 928966 - protein, 9 aa, Homo Sapiens
HSHLTRARR

SEQ ID NO: 928967 - protein, 9 aa, Homo Sapiens
TKHRRIYTG

SEQ ID NO: 928968 - protein, 9 aa, Homo Sapiens
EWWSLKLKY

SEQ ID NO: 928969 - protein, 9 aa, Homo Sapiens
KAEASGQPP

SEQ ID NO: 928970 - protein, 9 aa, Homo Sapiens
YAADTAGCQ

SEQ ID NO: 928971 - protein, 9 aa, Homo Sapiens
GQSLLEPLR

SEQ ID NO: 928972 - protein, 9 aa, Homo Sapiens
SQHHEKQYA

SEQ ID NO: 928973 - protein, 9 aa, Homo Sapiens
SPDVIAKMP

SEQ ID NO: 928974 - protein, 9 aa, Homo Sapiens
PVAAPTLVV

SEQ ID NO: 928975 - protein, 9 aa, Homo Sapiens
QSVNVESIF

SEQ ID NO: 928976 - protein, 9 aa, Homo Sapiens
RRPRHSHLT

SEQ ID NO: 928977 - protein, 9 aa, Homo Sapiens
QKTAHFLSM

SEQ ID NO: 928978 - protein, 9 aa, Homo Sapiens
VAECCIESG

SEQ ID NO: 928979 - protein, 9 aa, Homo Sapiens
FLEEMRERK

SEQ ID NO: 928980 - protein, 9 aa, Homo Sapiens
VVDGQFFKG

SEQ ID NO: 928981 - protein, 9 aa, Homo Sapiens
NPIFRFSSL

SEQ ID NO: 928982 - protein, 9 aa, Homo Sapiens
QEDSSDRDR

SEQ ID NO: 928983 - protein, 9 aa, Homo Sapiens
KTGVQELES

SEQ ID NO: 928984 - protein, 9 aa, Homo Sapiens
ETPPMISWM

SEQ ID NO: 928985 - protein, 9 aa, Homo Sapiens
TLANRMNTE

SEQ ID NO: 928986 - protein, 9 aa, Homo Sapiens
SFLAPMRTL

SEQ ID NO: 928987 - protein, 9 aa, Homo Sapiens
VVLTLLMVV

SEQ ID NO: 928988 - protein, 9 aa, Homo Sapiens
KGRVVSRLD

SEQ ID NO: 928989 - protein, 9 aa, Homo Sapiens
HLSPQSSNR

SEQ ID NO: 928990 - protein, 9 aa, Homo Sapiens
GKNSVSVRI

SEQ ID NO: 928991 - protein, 9 aa, Homo Sapiens
PFPRLKYLL

SEQ ID NO: 928992 - protein, 9 aa, Homo Sapiens
LKRTISTLN

SEQ ID NO: 928993 - protein, 9 aa, Homo Sapiens
ETSKRVQLL

SEQ ID NO: 928994 - protein, 9 aa, Homo Sapiens
VVFALLAHW

SEQ ID NO: 928995 - protein, 9 aa, Homo Sapiens
TSQHHEKQY

SEQ ID NO: 928996 - protein, 9 aa, Homo Sapiens
GGCGFCGCS

SEQ ID NO: 928997 - protein, 9 aa, Homo Sapiens
VSVCGRKTG

SEQ ID NO: 928998 - protein, 9 aa, Homo Sapiens
GAHEPGWQA

SEQ ID NO: 928999 - protein, 9 aa, Homo Sapiens
RRIYTGEKP

SEQ ID NO: 929000 - protein, 9 aa, Homo Sapiens
DIEVLSIIA

SEQ ID NO: 929001 - protein, 9 aa, Homo Sapiens
KEEYSAMRD

SEQ ID NO: 929002 - protein, 9 aa, Homo Sapiens
QERVLYVFT

SEQ ID NO: 929003 - protein, 9 aa, Homo Sapiens
AVIFLLFAL

SEQ ID NO: 929004 - protein, 9 aa, Homo Sapiens
SDKVVTRLS

SEQ ID NO: 929005 - protein, 9 aa, Homo Sapiens
LSDCDLKKK

SEQ ID NO: 929006 - protein, 9 aa, Homo Sapiens
LGKVTFGKV

SEQ ID NO: 929007 - protein, 9 aa, Homo Sapiens
GEGIMSRPA

SEQ ID NO: 929008 - protein, 9 aa, Homo Sapiens
IGTIFSVAG

SEQ ID NO: 929009 - protein, 9 aa, Homo Sapiens
RMQLSSLCV

SEQ ID NO: 929010 - protein, 9 aa, Homo Sapiens
GAFVSLNVP

SEQ ID NO: 929011 - protein, 9 aa, Homo Sapiens
YPCPLSPTY

SEQ ID NO: 929012 - protein, 9 aa, Homo Sapiens
PLTLMYWIS

SEQ ID NO: 929013 - protein, 9 aa, Homo Sapiens
FKLLDYIVK

SEQ ID NO: 929014 - protein, 9 aa, Homo Sapiens
PYMCHDDLL

SEQ ID NO: 929015 - protein, 9 aa, Homo Sapiens
VNLTSIDSV

SEQ ID NO: 929016 - protein, 9 aa, Homo Sapiens
SSLGRPESL

SEQ ID NO: 929017 - protein, 9 aa, Homo Sapiens
VTPTLTPTG

SEQ ID NO: 929018 - protein, 9 aa, Homo Sapiens
GECHIAGGT

SEQ ID NO: 929019 - protein, 9 aa, Homo Sapiens
SPGRFLEAL

SEQ ID NO: 929020 - protein, 9 aa, Homo Sapiens
EKLLPRSSE

SEQ ID NO: 929021 - protein, 9 aa, Homo Sapiens
EFFSSLLLK

SEQ ID NO: 929022 - protein, 9 aa, Homo Sapiens
VLSFCIARP

SEQ ID NO: 929023 - protein, 9 aa, Homo Sapiens
QFFKFDMNV

SEQ ID NO: 929024 - protein, 9 aa, Homo Sapiens
RFLEALDEL

SEQ ID NO: 929025 - protein, 9 aa, Homo Sapiens
SIENNLLFF

SEQ ID NO: 929026 - protein, 9 aa, Homo Sapiens
GRSLTLLSL

SEQ ID NO: 929027 - protein, 9 aa, Homo Sapiens
QTVKDISPS

SEQ ID NO: 929028 - protein, 9 aa, Homo Sapiens
VGGCELSPE

SEQ ID NO: 929029 - protein, 9 aa, Homo Sapiens
GAKPPTTPA

SEQ ID NO: 929030 - protein, 9 aa, Homo Sapiens
RGPGEEQAV

SEQ ID NO: 929031 - protein, 9 aa, Homo Sapiens
WLFPSLLLL

SEQ ID NO: 929032 - protein, 9 aa, Homo Sapiens
GQRGPTPPT

SEQ ID NO: 929033 - protein, 9 aa, Homo Sapiens
LTEDKIRIF

SEQ ID NO: 929034 - protein, 9 aa, Homo Sapiens
TVSVCGRKT

SEQ ID NO: 929035 - protein, 9 aa, Homo Sapiens
HFVYNFEKP

SEQ ID NO: 929036 - protein, 9 aa, Homo Sapiens
DTAGCQLHA

SEQ ID NO: 929037 - protein, 9 aa, Homo Sapiens
EDSSDRDRE

SEQ ID NO: 929038 - protein, 9 aa, Homo Sapiens
ITSSLFVSF

SEQ ID NO: 929039 - protein, 9 aa, Homo Sapiens
GQVVSSKKK

SEQ ID NO: 929040 - protein, 9 aa, Homo Sapiens
SPRPTHLSP

SEQ ID NO: 929041 - protein, 9 aa, Homo Sapiens
SDDENDISS

SEQ ID NO: 929042 - protein, 9 aa, Homo Sapiens
IWWLNSQSL

SEQ ID NO: 929043 - protein, 9 aa, Homo Sapiens
TAGCQLHAV

SEQ ID NO: 929044 - protein, 9 aa, Homo Sapiens
VTSTPQAKN

SEQ ID NO: 929045 - protein, 9 aa, Homo Sapiens
YCSPSLCCV

SEQ ID NO: 929046 - protein, 9 aa, Homo Sapiens
TAHKIIYSG

SEQ ID NO: 929047 - protein, 9 aa, Homo Sapiens
GDKNEKDTE

SEQ ID NO: 929048 - protein, 9 aa, Homo Sapiens
PLWTAIGWG

SEQ ID NO: 929049 - protein, 9 aa, Homo Sapiens
IKEAHAKVS

SEQ ID NO: 929050 - protein, 9 aa, Homo Sapiens
LTPTGTQTP

SEQ ID NO: 929051 - protein, 9 aa, Homo Sapiens
MVLELFENL

SEQ ID NO: 929052 - protein, 9 aa, Homo Sapiens
KPTMKALLE

SEQ ID NO: 929053 - protein, 9 aa, Homo Sapiens
TFFSADLVV

SEQ ID NO: 929054 - protein, 9 aa, Homo Sapiens
SFFNAVIFL

SEQ ID NO: 929055 - protein, 9 aa, Homo Sapiens
TMSLDISDK

SEQ ID NO: 929056 - protein, 9 aa, Homo Sapiens
FKGSGRNKK

SEQ ID NO: 929057 - protein, 9 aa, Homo Sapiens
VWFWVGGCE

SEQ ID NO: 929058 - protein, 9 aa, Homo Sapiens
VAAPTLVVP

SEQ ID NO: 929059 - protein, 9 aa, Homo Sapiens
RELLAEKGP

SEQ ID NO: 929060 - protein, 9 aa, Homo Sapiens
KEEKHNLEM

SEQ ID NO: 929061 - protein, 9 aa, Homo Sapiens
LIETSKRVQ

SEQ ID NO: 929062 - protein, 9 aa, Homo Sapiens
WFWVGGCEL

SEQ ID NO: 929063 - protein, 9 aa, Homo Sapiens
EGSYKFGKR

SEQ ID NO: 929064 - protein, 9 aa, Homo Sapiens
YEATRMFFE

SEQ ID NO: 929065 - protein, 9 aa, Homo Sapiens
AKVSILPDD

SEQ ID NO: 929066 - protein, 9 aa, Homo Sapiens
MASKIDMHP

SEQ ID NO: 929067 - protein, 9 aa, Homo Sapiens
HKRSRFGVT

SEQ ID NO: 929068 - protein, 9 aa, Homo Sapiens
SRFGVTSTP

SEQ ID NO: 929069 - protein, 9 aa, Homo Sapiens
KLKYQGLCP

SEQ ID NO: 929070 - protein, 9 aa, Homo Sapiens
ILRINLEDF

SEQ ID NO: 929071 - protein, 9 aa, Homo Sapiens
VCTSRCEGN

SEQ ID NO: 929072 - protein, 9 aa, Homo Sapiens
VRHCSAPEN

SEQ ID NO: 929073 - protein, 9 aa, Homo Sapiens
LTHSTKSKE

SEQ ID NO: 929074 - protein, 9 aa, Homo Sapiens
AQSKWKGAE

SEQ ID NO: 929075 - protein, 9 aa, Homo Sapiens
PTLTPTGTQ

SEQ ID NO: 929076 - protein, 9 aa, Homo Sapiens
QSKWKGAEK

SEQ ID NO: 929077 - protein, 9 aa, Homo Sapiens
SLTHSTKSK

SEQ ID NO: 929078 - protein, 9 aa, Homo Sapiens
HGLQSPKSS

SEQ ID NO: 929079 - protein, 9 aa, Homo Sapiens
EASGQPPSG

SEQ ID NO: 929080 - protein, 9 aa, Homo Sapiens
CPDSLHDAA

SEQ ID NO: 929081 - protein, 9 aa, Homo Sapiens
SGQHSEGCC

SEQ ID NO: 929082 - protein, 9 aa, Homo Sapiens
ESLMCRMSN

SEQ ID NO: 929083 - protein, 9 aa, Homo Sapiens
QRKAHFVYN

SEQ ID NO: 929084 - protein, 9 aa, Homo Sapiens
PDENKSLEK

SEQ ID NO: 929085 - protein, 9 aa, Homo Sapiens
VLQKLLFKG

SEQ ID NO: 929086 - protein, 9 aa, Homo Sapiens
DLEPNGSAL

SEQ ID NO: 929087 - protein, 9 aa, Homo Sapiens
TVYNLLSDC

SEQ ID NO: 929088 - protein, 9 aa, Homo Sapiens
LYVSELPKT

SEQ ID NO: 929089 - protein, 9 aa, Homo Sapiens
NLYVSELPK

SEQ ID NO: 929090 - protein, 9 aa, Homo Sapiens
DVLPTEIPG

SEQ ID NO: 929091 - protein, 9 aa, Homo Sapiens
WWSLKLKYQ

SEQ ID NO: 929092 - protein, 9 aa, Homo Sapiens
YRTITDFRK

SEQ ID NO: 929093 - protein, 9 aa, Homo Sapiens
SDGEGIMSR

SEQ ID NO: 929094 - protein, 9 aa, Homo Sapiens
HTPPLGEYK

SEQ ID NO: 929095 - protein, 9 aa, Homo Sapiens
PALQIPSFR

SEQ ID NO: 929096 - protein, 9 aa, Homo Sapiens
AHAKVSILP

SEQ ID NO: 929097 - protein, 9 aa, Homo Sapiens
WALRPEDRE

SEQ ID NO: 929098 - protein, 9 aa, Homo Sapiens
PLSPTYKWK

SEQ ID NO: 929099 - protein, 9 aa, Homo Sapiens
WISFLLEVV

SEQ ID NO: 929100 - protein, 9 aa, Homo Sapiens
CELSPEGIT

SEQ ID NO: 929101 - protein, 9 aa, Homo Sapiens
ESLFFLEEM

SEQ ID NO: 929102 - protein, 9 aa, Homo Sapiens
QVFFKTNKT

SEQ ID NO: 929103 - protein, 9 aa, Homo Sapiens
ILFEGYVAK

SEQ ID NO: 929104 - protein, 9 aa, Homo Sapiens
VTFGKVILV

SEQ ID NO: 929105 - protein, 9 aa, Homo Sapiens
RRRIGSEFS

SEQ ID NO: 929106 - protein, 9 aa, Homo Sapiens
GNKTKTYPA

SEQ ID NO: 929107 - protein, 9 aa, Homo Sapiens
KNEKDTEYI

SEQ ID NO: 929108 - protein, 9 aa, Homo Sapiens
PRTMIPGSP

SEQ ID NO: 929109 - protein, 9 aa, Homo Sapiens
KVVTRLSTS

SEQ ID NO: 929110 - protein, 9 aa, Homo Sapiens
ILTAHKIIY

SEQ ID NO: 929111 - protein, 9 aa, Homo Sapiens
NQELHVEKL

SEQ ID NO: 929112 - protein, 9 aa, Homo Sapiens
YVQKATFEE

SEQ ID NO: 929113 - protein, 9 aa, Homo Sapiens
KATFEEMEK

SEQ ID NO: 929114 - protein, 9 aa, Homo Sapiens
EDREDKEMK

SEQ ID NO: 929115 - protein, 9 aa, Homo Sapiens
DTAGQAQFT

SEQ ID NO: 929116 - protein, 9 aa, Homo Sapiens
EQAVAPCPR

SEQ ID NO: 929117 - protein, 9 aa, Homo Sapiens
KFLSSLSSK

SEQ ID NO: 929118 - protein, 9 aa, Homo Sapiens
APTLVVPSS

SEQ ID NO: 929119 - protein, 9 aa, Homo Sapiens
PAQLRLPLV

SEQ ID NO: 929120 - protein, 9 aa, Homo Sapiens
CGRKTGVQE

SEQ ID NO: 929121 - protein, 9 aa, Homo Sapiens
LHLEGAAFR

SEQ ID NO: 929122 - protein, 9 aa, Homo Sapiens
YTYIWWLNS

SEQ ID NO: 929123 - protein, 9 aa, Homo Sapiens
DNPFINWNL

SEQ ID NO: 929124 - protein, 9 aa, Homo Sapiens
NSSLAQSAG

SEQ ID NO: 929125 - protein, 9 aa, Homo Sapiens
RTISTLNEG

SEQ ID NO: 929126 - protein, 9 aa, Homo Sapiens
PLTEDKIRI

SEQ ID NO: 929127 - protein, 9 aa, Homo Sapiens
YFSLDSVTE

SEQ ID NO: 929128 - protein, 9 aa, Homo Sapiens
GFPGSKGIT

SEQ ID NO: 929129 - protein, 9 aa, Homo Sapiens
LNSQSLPVS

SEQ ID NO: 929130 - protein, 9 aa, Homo Sapiens
VQRKVLRLL

SEQ ID NO: 929131 - protein, 9 aa, Homo Sapiens
IFQTLGHHH

SEQ ID NO: 929132 - protein, 9 aa, Homo Sapiens
AQLELSEQQ

SEQ ID NO: 929133 - protein, 9 aa, Homo Sapiens
PTMKALLEY

SEQ ID NO: 929134 - protein, 9 aa, Homo Sapiens
TPPLGEYKV

SEQ ID NO: 929135 - protein, 9 aa, Homo Sapiens
DQKPTMKAL

SEQ ID NO: 929136 - protein, 9 aa, Homo Sapiens
LGDKNEKDT

SEQ ID NO: 929137 - protein, 9 aa, Homo Sapiens
FNRALFDLL

SEQ ID NO: 929138 - protein, 9 aa, Homo Sapiens
DKIRIFKRK

SEQ ID NO: 929139 - protein, 9 aa, Homo Sapiens
PPLGEYKVT

SEQ ID NO: 929140 - protein, 9 aa, Homo Sapiens
AKKQSLINE

SEQ ID NO: 929141 - protein, 9 aa, Homo Sapiens
HLTRARRCP

SEQ ID NO: 929142 - protein, 9 aa, Homo Sapiens
EGYVAKEKD

SEQ ID NO: 929143 - protein, 9 aa, Homo Sapiens
TTTVTPTLT

SEQ ID NO: 929144 - protein, 9 aa, Homo Sapiens
RVMFGAKGQ

SEQ ID NO: 929145 - protein, 9 aa, Homo Sapiens
RKGRVVSRL

SEQ ID NO: 929146 - protein, 9 aa, Homo Sapiens
GRDFAIFQT

SEQ ID NO: 929147 - protein, 9 aa, Homo Sapiens
LCVCNSHCV

SEQ ID NO: 929148 - protein, 9 aa, Homo Sapiens
APMRTLRAR

SEQ ID NO: 929149 - protein, 9 aa, Homo Sapiens
NPFINWNLK

SEQ ID NO: 929150 - protein, 9 aa, Homo Sapiens
ELQTEKFLS

SEQ ID NO: 929151 - protein, 9 aa, Homo Sapiens
RLHQPYEAT

SEQ ID NO: 929152 - protein, 9 aa, Homo Sapiens
MSLDISDKV

SEQ ID NO: 929153 - protein, 9 aa, Homo Sapiens
FDVLPTEIP

SEQ ID NO: 929154 - protein, 9 aa, Homo Sapiens
PRHSHLTRA

SEQ ID NO: 929155 - protein, 9 aa, Homo Sapiens
TYIWWLNSQ

SEQ ID NO: 929156 - protein, 9 aa, Homo Sapiens
SVAGYSLGF

SEQ ID NO: 929157 - protein, 9 aa, Homo Sapiens
SAPLLPPST

SEQ ID NO: 929158 - protein, 9 aa, Homo Sapiens
ANLYVSELP

SEQ ID NO: 929159 - protein, 9 aa, Homo Sapiens
LDRSDDEND

SEQ ID NO: 929160 - protein, 9 aa, Homo Sapiens
STSGRVHLT

SEQ ID NO: 929161 - protein, 9 aa, Homo Sapiens
YTSQHHEKQ

SEQ ID NO: 929162 - protein, 9 aa, Homo Sapiens
LGSSSAPPG

SEQ ID NO: 929163 - protein, 9 aa, Homo Sapiens
FGVTSTPQA

SEQ ID NO: 929164 - protein, 9 aa, Homo Sapiens
TEGVNIVMD

SEQ ID NO: 929165 - protein, 9 aa, Homo Sapiens
IPDTVYKFA

SEQ ID NO: 929166 - protein, 9 aa, Homo Sapiens
CCIESGPRF

SEQ ID NO: 929167 - protein, 9 aa, Homo Sapiens
LLKMNPNIL

SEQ ID NO: 929168 - protein, 9 aa, Homo Sapiens
VLRLLRTQT

SEQ ID NO: 929169 - protein, 9 aa, Homo Sapiens
RSRFGVTST

SEQ ID NO: 929170 - protein, 9 aa, Homo Sapiens
LEGSLDADL

SEQ ID NO: 929171 - protein, 9 aa, Homo Sapiens
DGQFFKGSG

SEQ ID NO: 929172 - protein, 9 aa, Homo Sapiens
DQLQRCQKL

SEQ ID NO: 929173 - protein, 9 aa, Homo Sapiens
ISQFFKFDM

SEQ ID NO: 929174 - protein, 9 aa, Homo Sapiens
VSMGRSLTL

SEQ ID NO: 929175 - protein, 9 aa, Homo Sapiens
DENKSLEKT

SEQ ID NO: 929176 - protein, 9 aa, Homo Sapiens
VVSSKKKAN

SEQ ID NO: 929177 - protein, 9 aa, Homo Sapiens
QRKVLRLLR

SEQ ID NO: 929178 - protein, 9 aa, Homo Sapiens
LLESDSSED

SEQ ID NO: 929179 - protein, 9 aa, Homo Sapiens
LAEKGPEVL

SEQ ID NO: 929180 - protein, 9 aa, Homo Sapiens
TAISPGRFL

SEQ ID NO: 929181 - protein, 9 aa, Homo Sapiens
VNLNEEPST

SEQ ID NO: 929182 - protein, 9 aa, Homo Sapiens
NRYCYIMTY

SEQ ID NO: 929183 - protein, 9 aa, Homo Sapiens
MGRDFAIFQ

SEQ ID NO: 929184 - protein, 9 aa, Homo Sapiens
TLMYWISFL

SEQ ID NO: 929185 - protein, 9 aa, Homo Sapiens
QGFPGSKGI

SEQ ID NO: 929186 - protein, 9 aa, Homo Sapiens
CEAHLHSPM

SEQ ID NO: 929187 - protein, 9 aa, Homo Sapiens
FVSLNVPNN

SEQ ID NO: 929188 - protein, 9 aa, Homo Sapiens
LQRCQKLLN

SEQ ID NO: 929189 - protein, 9 aa, Homo Sapiens
PEVLASAPL

SEQ ID NO: 929190 - protein, 9 aa, Homo Sapiens
NFSPSASPT

SEQ ID NO: 929191 - protein, 9 aa, Homo Sapiens
VAGSALAFR

SEQ ID NO: 929192 - protein, 9 aa, Homo Sapiens
NNLLFFLKP

SEQ ID NO: 929193 - protein, 9 aa, Homo Sapiens
QYVQKATFE

SEQ ID NO: 929194 - protein, 9 aa, Homo Sapiens
HIAGGTGEW

SEQ ID NO: 929195 - protein, 9 aa, Homo Sapiens
QLDCNSLSE

SEQ ID NO: 929196 - protein, 9 aa, Homo Sapiens
QNIALPTTK

SEQ ID NO: 929197 - protein, 9 aa, Homo Sapiens
CAVPCTAPH

SEQ ID NO: 929198 - protein, 9 aa, Homo Sapiens
VLSIIAQQL

SEQ ID NO: 929199 - protein, 9 aa, Homo Sapiens
IQERVLYVF

SEQ ID NO: 929200 - protein, 9 aa, Homo Sapiens
NWNLKECVG

SEQ ID NO: 929201 - protein, 9 aa, Homo Sapiens
NRALFDLLL

SEQ ID NO: 929202 - protein, 9 aa, Homo Sapiens
APESLFFLE

SEQ ID NO: 929203 - protein, 9 aa, Homo Sapiens
VLCAVPCTA

SEQ ID NO: 929204 - protein, 9 aa, Homo Sapiens
IESGPRFCA

SEQ ID NO: 929205 - protein, 9 aa, Homo Sapiens
SPRQVSYTS

SEQ ID NO: 929206 - protein, 9 aa, Homo Sapiens
RTKQIQERV

SEQ ID NO: 929207 - protein, 9 aa, Homo Sapiens
SLFFLEEMR

SEQ ID NO: 929208 - protein, 9 aa, Homo Sapiens
SRLDGTVAF

SEQ ID NO: 929209 - protein, 9 aa, Homo Sapiens
PENPIFRFS

SEQ ID NO: 929210 - protein, 9 aa, Homo Sapiens
CDDLGSSSA

SEQ ID NO: 929211 - protein, 9 aa, Homo Sapiens
NLKRTISTL

SEQ ID NO: 929212 - protein, 9 aa, Homo Sapiens
HVESNVSSE

SEQ ID NO: 929213 - protein, 9 aa, Homo Sapiens
YYLDQKPTM

SEQ ID NO: 929214 - protein, 9 aa, Homo Sapiens
FLLFALNTQ

SEQ ID NO: 929215 - protein, 9 aa, Homo Sapiens
TAIGWGQRG

SEQ ID NO: 929216 - protein, 9 aa, Homo Sapiens
VLELFENLK

SEQ ID NO: 929217 - protein, 9 aa, Homo Sapiens
LGDRVLQVF

SEQ ID NO: 929218 - protein, 9 aa, Homo Sapiens
PKPSPTRSV

SEQ ID NO: 929219 - protein, 9 aa, Homo Sapiens
KFRKKVEEE

SEQ ID NO: 929220 - protein, 9 aa, Homo Sapiens
LPYMCHDDL

SEQ ID NO: 929221 - protein, 9 aa, Homo Sapiens
FRKKVEEER

SEQ ID NO: 929222 - protein, 9 aa, Homo Sapiens
IDMHPTVLQ

SEQ ID NO: 929223 - protein, 9 aa, Homo Sapiens
LLAEKGPEV

SEQ ID NO: 929224 - protein, 9 aa, Homo Sapiens
HKIIYSGEK

SEQ ID NO: 929225 - protein, 9 aa, Homo Sapiens
IKAPESLFF

SEQ ID NO: 929226 - protein, 9 aa, Homo Sapiens
VYCSPSLCC

SEQ ID NO: 929227 - protein, 9 aa, Homo Sapiens
DSVTEILTV

SEQ ID NO: 929228 - protein, 9 aa, Homo Sapiens
EILTVSTQL

SEQ ID NO: 929229 - protein, 9 aa, Homo Sapiens
HYPCPLSPT

SEQ ID NO: 929230 - protein, 9 aa, Homo Sapiens
LELSEQQVG

SEQ ID NO: 929231 - protein, 9 aa, Homo Sapiens
DLFSLLGLS

SEQ ID NO: 929232 - protein, 9 aa, Homo Sapiens
KTTMASPRL

SEQ ID NO: 929233 - protein, 9 aa, Homo Sapiens
DLGSSSAPP

SEQ ID NO: 929234 - protein, 9 aa, Homo Sapiens
LTLLMVVFA

SEQ ID NO: 929235 - protein, 9 aa, Homo Sapiens
IIAQQLITI

SEQ ID NO: 929236 - protein, 9 aa, Homo Sapiens
TAHFLSMAI

SEQ ID NO: 929237 - protein, 9 aa, Homo Sapiens
DFRKKLKHP

SEQ ID NO: 929238 - protein, 9 aa, Homo Sapiens
EKFLSSLSS

SEQ ID NO: 929239 - protein, 9 aa, Homo Sapiens
RGKNSVSVR

SEQ ID NO: 929240 - protein, 9 aa, Homo Sapiens
SDCDLKKKL

SEQ ID NO: 929241 - protein, 9 aa, Homo Sapiens
MQLSSLCVC

SEQ ID NO: 929242 - protein, 9 aa, Homo Sapiens
IEAFTKKAL

SEQ ID NO: 929243 - protein, 9 aa, Homo Sapiens
KKLKHPVMS

SEQ ID NO: 929244 - protein, 9 aa, Homo Sapiens
QSPKSSLGR

SEQ ID NO: 929245 - protein, 9 aa, Homo Sapiens
SKRVQLLHS

SEQ ID NO: 929246 - protein, 9 aa, Homo Sapiens
SSETVSEAS

SEQ ID NO: 929247 - protein, 9 aa, Homo Sapiens
YMCHDDLLQ

SEQ ID NO: 929248 - protein, 9 aa, Homo Sapiens
GKVTFGKVI

SEQ ID NO: 929249 - protein, 9 aa, Homo Sapiens
SLDSVTEIL

SEQ ID NO: 929250 - protein, 9 aa, Homo Sapiens
CQLHAVPVL

SEQ ID NO: 929251 - protein, 9 aa, Homo Sapiens
MILRINLED

SEQ ID NO: 929252 - protein, 9 aa, Homo Sapiens
FFKTNKTHK

SEQ ID NO: 929253 - protein, 9 aa, Homo Sapiens
EKFILKLKE

SEQ ID NO: 929254 - protein, 9 aa, Homo Sapiens
KQVGVNLTS

SEQ ID NO: 929255 - protein, 9 aa, Homo Sapiens
PSFRITFPV

SEQ ID NO: 929256 - protein, 9 aa, Homo Sapiens
MIPGSPTEI

SEQ ID NO: 929257 - protein, 9 aa, Homo Sapiens
SWWEKSAFL

SEQ ID NO: 929258 - protein, 9 aa, Homo Sapiens
THLSPQSSN

SEQ ID NO: 929259 - protein, 9 aa, Homo Sapiens
SSLAQSAGL

SEQ ID NO: 929260 - protein, 9 aa, Homo Sapiens
QEAQLELSE

SEQ ID NO: 929261 - protein, 9 aa, Homo Sapiens
SYKFGKRHG

SEQ ID NO: 929262 - protein, 9 aa, Homo Sapiens
LCAVPCTAP

SEQ ID NO: 929263 - protein, 9 aa, Homo Sapiens
KTAHFLSMA

SEQ ID NO: 929264 - protein, 9 aa, Homo Sapiens
SLEDPKPSP

SEQ ID NO: 929265 - protein, 9 aa, Homo Sapiens
PEDREDKEM

SEQ ID NO: 929266 - protein, 9 aa, Homo Sapiens
NEEPSTIFK

SEQ ID NO: 929267 - protein, 9 aa, Homo Sapiens
YRRRIGSEF

SEQ ID NO: 929268 - protein, 9 aa, Homo Sapiens
PRLMPLVVV

SEQ ID NO: 929269 - protein, 9 aa, Homo Sapiens
AQYVQKATF

SEQ ID NO: 929270 - protein, 9 aa, Homo Sapiens
VCGRKTGVQ

SEQ ID NO: 929271 - protein, 9 aa, Homo Sapiens
GEYKVTAKC

SEQ ID NO: 929272 - protein, 9 aa, Homo Sapiens
VLLPYMCHD

SEQ ID NO: 929273 - protein, 9 aa, Homo Sapiens
MAAFHHKEE

SEQ ID NO: 929274 - protein, 9 aa, Homo Sapiens
FGNSCDPEE

SEQ ID NO: 929275 - protein, 9 aa, Homo Sapiens
LLLVVLLAL

SEQ ID NO: 929276 - protein, 9 aa, Homo Sapiens
EQKTAHFLS

SEQ ID NO: 929277 - protein, 9 aa, Homo Sapiens
CPLSPTYKW

SEQ ID NO: 929278 - protein, 9 aa, Homo Sapiens
PLGEYKVTA

SEQ ID NO: 929279 - protein, 9 aa, Homo Sapiens
INLEDFNGV

SEQ ID NO: 929280 - protein, 9 aa, Homo Sapiens
DKVVTRLST

SEQ ID NO: 929281 - protein, 9 aa, Homo Sapiens
TEILTVSTQ

SEQ ID NO: 929282 - protein, 9 aa, Homo Sapiens
FCIARPSLT

SEQ ID NO: 929283 - protein, 9 aa, Homo Sapiens
IYTGEKPYT

SEQ ID NO: 929284 - protein, 9 aa, Homo Sapiens
SGRVHLTTT

SEQ ID NO: 929285 - protein, 9 aa, Homo Sapiens
LGGLLIIPA

SEQ ID NO: 929286 - protein, 9 aa, Homo Sapiens
GSLVITVLA

SEQ ID NO: 929287 - protein, 9 aa, Homo Sapiens
QVSYTSQHH

SEQ ID NO: 929288 - protein, 9 aa, Homo Sapiens
RAHYPCPLS

SEQ ID NO: 929289 - protein, 9 aa, Homo Sapiens
PRYRRRIGS

SEQ ID NO: 929290 - protein, 9 aa, Homo Sapiens
YVSELPKTM

SEQ ID NO: 929291 - protein, 9 aa, Homo Sapiens
TDIEKGVLI

SEQ ID NO: 929292 - protein, 9 aa, Homo Sapiens
FVHNYNLKN

SEQ ID NO: 929293 - protein, 9 aa, Homo Sapiens
EEQAVAPCP

SEQ ID NO: 929294 - protein, 9 aa, Homo Sapiens
KEMASKIDM

SEQ ID NO: 929295 - protein, 9 aa, Homo Sapiens
HCEAHLHSP

SEQ ID NO: 929296 - protein, 9 aa, Homo Sapiens
TLVVPSSAP

SEQ ID NO: 929297 - protein, 9 aa, Homo Sapiens
GTIFSVAGY

SEQ ID NO: 929298 - protein, 9 aa, Homo Sapiens
QTEKFLSSL

SEQ ID NO: 929299 - protein, 9 aa, Homo Sapiens
TLLSLKRPP

SEQ ID NO: 929300 - protein, 9 aa, Homo Sapiens
VSLNVPNNK

SEQ ID NO: 929301 - protein, 9 aa, Homo Sapiens
FFSADLVVF

SEQ ID NO: 929302 - protein, 9 aa, Homo Sapiens
AVSPNFSPS

SEQ ID NO: 929303 - protein, 9 aa, Homo Sapiens
GSEGQSLLE

SEQ ID NO: 929304 - protein, 9 aa, Homo Sapiens
QFMQERQRL

SEQ ID NO: 929305 - protein, 9 aa, Homo Sapiens
LFKGDSKAD

SEQ ID NO: 929306 - protein, 9 aa, Homo Sapiens
DCNSLSEQQ

SEQ ID NO: 929307 - protein, 9 aa, Homo Sapiens
KSFFNAVIF

SEQ ID NO: 929308 - protein, 9 aa, Homo Sapiens
GSLDADLEP

SEQ ID NO: 929309 - protein, 9 aa, Homo Sapiens
KLSNVGKPY

SEQ ID NO: 929310 - protein, 9 aa, Homo Sapiens
VDGQFFKGS

SEQ ID NO: 929311 - protein, 9 aa, Homo Sapiens
EDPKPSPTR

SEQ ID NO: 929312 - protein, 9 aa, Homo Sapiens
RMEIKFRKK

SEQ ID NO: 929313 - protein, 9 aa, Homo Sapiens
CQKLLNEFL

SEQ ID NO: 929314 - protein, 9 aa, Homo Sapiens
SAVSPNFSP

SEQ ID NO: 929315 - protein, 9 aa, Homo Sapiens
AFTKKALPS

SEQ ID NO: 929316 - protein, 9 aa, Homo Sapiens
PEPRYRRRI

SEQ ID NO: 929317 - protein, 9 aa, Homo Sapiens
SLEKTLHTV

SEQ ID NO: 929318 - protein, 9 aa, Homo Sapiens
AANMGLTFF

SEQ ID NO: 929319 - protein, 9 aa, Homo Sapiens
KALPSQPPR

SEQ ID NO: 929320 - protein, 9 aa, Homo Sapiens
RKVLRLLRT

SEQ ID NO: 929321 - protein, 9 aa, Homo Sapiens
MVVFALLAH

SEQ ID NO: 929322 - protein, 9 aa, Homo Sapiens
EMASKIDMH

SEQ ID NO: 929323 - protein, 9 aa, Homo Sapiens
AGCQLHAVP

SEQ ID NO: 929324 - protein, 9 aa, Homo Sapiens
KNSVSVRIV

SEQ ID NO: 929325 - protein, 9 aa, Homo Sapiens
DSSDRDREL

SEQ ID NO: 929326 - protein, 9 aa, Homo Sapiens
YCDDLGSSS

SEQ ID NO: 929327 - protein, 9 aa, Homo Sapiens
EHGFYLKAL

SEQ ID NO: 929328 - protein, 9 aa, Homo Sapiens
VHNYNLKNH

SEQ ID NO: 929329 - protein, 9 aa, Homo Sapiens
LQAQFMQER

SEQ ID NO: 929330 - protein, 9 aa, Homo Sapiens
QELHVEKLL

SEQ ID NO: 929331 - protein, 9 aa, Homo Sapiens
PFINWNLKE

SEQ ID NO: 929332 - protein, 9 aa, Homo Sapiens
KAHFVYNFE

SEQ ID NO: 929333 - protein, 9 aa, Homo Sapiens
MRSTEGRHK

SEQ ID NO: 929334 - protein, 9 aa, Homo Sapiens
CHIAGGTGE

SEQ ID NO: 929335 - protein, 9 aa, Homo Sapiens
ALPSQPPRI

SEQ ID NO: 929336 - protein, 9 aa, Homo Sapiens
TMKALLEYT

SEQ ID NO: 929337 - protein, 9 aa, Homo Sapiens
KVEPSDTIE

SEQ ID NO: 929338 - protein, 9 aa, Homo Sapiens
QSHRHCPDS

SEQ ID NO: 929339 - protein, 9 aa, Homo Sapiens
IENNLLFFL

SEQ ID NO: 929340 - protein, 9 aa, Homo Sapiens
GIMSRPASV

SEQ ID NO: 929341 - protein, 9 aa, Homo Sapiens
LTAHKIIYS

SEQ ID NO: 929342 - protein, 9 aa, Homo Sapiens
GCELSPEGI

SEQ ID NO: 929343 - protein, 9 aa, Homo Sapiens
GNLSSPDAV

SEQ ID NO: 929344 - protein, 9 aa, Homo Sapiens
EIPGRAVLE

SEQ ID NO: 929345 - protein, 9 aa, Homo Sapiens
RASSDGEGI

SEQ ID NO: 929346 - protein, 9 aa, Homo Sapiens
SMGRSLTLL

SEQ ID NO: 929347 - protein, 9 aa, Homo Sapiens
ARPSLTGWT

SEQ ID NO: 929348 - protein, 9 aa, Homo Sapiens
QLRLPLVKG

SEQ ID NO: 929349 - protein, 9 aa, Homo Sapiens
LFEGYVAKE

SEQ ID NO: 929350 - protein, 9 aa, Homo Sapiens
PLPLGDSED

SEQ ID NO: 929351 - protein, 9 aa, Homo Sapiens
LKVEPSDTI

SEQ ID NO: 929352 - protein, 9 aa, Homo Sapiens
KSLEKTLHT

SEQ ID NO: 929353 - protein, 9 aa, Homo Sapiens
NYNLKNHMR

SEQ ID NO: 929354 - protein, 9 aa, Homo Sapiens
SRILTDIEK

SEQ ID NO: 929355 - protein, 9 aa, Homo Sapiens
GVTSTPQAK

SEQ ID NO: 929356 - protein, 9 aa, Homo Sapiens
LGSSNSLAS

SEQ ID NO: 929357 - protein, 9 aa, Homo Sapiens
FWVGGCELS

SEQ ID NO: 929358 - protein, 9 aa, Homo Sapiens
NFPNSYSNL

SEQ ID NO: 929359 - protein, 9 aa, Homo Sapiens
GDFDVLPTE

SEQ ID NO: 929360 - protein, 9 aa, Homo Sapiens
RIVREMDKQ

SEQ ID NO: 929361 - protein, 9 aa, Homo Sapiens
WKYNRYCYI

SEQ ID NO: 929362 - protein, 9 aa, Homo Sapiens
TEIPGRAVL

SEQ ID NO: 929363 - protein, 9 aa, Homo Sapiens
EKTLHTVDL

SEQ ID NO: 929364 - protein, 9 aa, Homo Sapiens
EQETPPMIS

SEQ ID NO: 929365 - protein, 9 aa, Homo Sapiens
DTVYKFAVR

SEQ ID NO: 929366 - protein, 9 aa, Homo Sapiens
LDGTVAFES

SEQ ID NO: 929367 - protein, 9 aa, Homo Sapiens
YNQEWWSLK

SEQ ID NO: 929368 - protein, 9 aa, Homo Sapiens
LESDSSEDE

SEQ ID NO: 929369 - protein, 9 aa, Homo Sapiens
YLKLLGKVT

SEQ ID NO: 929370 - protein, 9 aa, Homo Sapiens
IHLYRFWPF

SEQ ID NO: 929371 - protein, 9 aa, Homo Sapiens
PPRGPGEEQ

SEQ ID NO: 929372 - protein, 9 aa, Homo Sapiens
QVVSSKKKA

SEQ ID NO: 929373 - protein, 9 aa, Homo Sapiens
ILDTAGQAQ

SEQ ID NO: 929374 - protein, 9 aa, Homo Sapiens
DISDKVVTR

SEQ ID NO: 929375 - protein, 9 aa, Homo Sapiens
FTKKALPSQ

SEQ ID NO: 929376 - protein, 9 aa, Homo Sapiens
RKAHFVYNF

SEQ ID NO: 929377 - protein, 9 aa, Homo Sapiens
LQRLAVSSV

SEQ ID NO: 929378 - protein, 9 aa, Homo Sapiens
STKSKELNL

SEQ ID NO: 929379 - protein, 9 aa, Homo Sapiens
NSLASASLV

SEQ ID NO: 929380 - protein, 9 aa, Homo Sapiens
LDADLEPNG

SEQ ID NO: 929381 - protein, 9 aa, Homo Sapiens
SIMGNSRII

SEQ ID NO: 929382 - protein, 9 aa, Homo Sapiens
NLEDFNGVE

SEQ ID NO: 929383 - protein, 9 aa, Homo Sapiens
GWGQRGPTP

SEQ ID NO: 929384 - protein, 9 aa, Homo Sapiens
NAVIFLLFA

SEQ ID NO: 929385 - protein, 9 aa, Homo Sapiens
KFGKRHGQG

SEQ ID NO: 929386 - protein, 9 aa, Homo Sapiens
ELHLKLHLE

SEQ ID NO: 929387 - protein, 9 aa, Homo Sapiens
VPWACEQET

SEQ ID NO: 929388 - protein, 9 aa, Homo Sapiens
VVAECCIES

SEQ ID NO: 929389 - protein, 9 aa, Homo Sapiens
KQTVKDISP

SEQ ID NO: 929390 - protein, 9 aa, Homo Sapiens
TSGRVHLTT

SEQ ID NO: 929391 - protein, 9 aa, Homo Sapiens
EKGERGKNS

SEQ ID NO: 929392 - protein, 9 aa, Homo Sapiens
EGHTPPLGE

SEQ ID NO: 929393 - protein, 9 aa, Homo Sapiens
SFLLEVVSF

SEQ ID NO: 929394 - protein, 9 aa, Homo Sapiens
QSLLEPLRA

SEQ ID NO: 929395 - protein, 9 aa, Homo Sapiens
EGHKVCTSR

SEQ ID NO: 929396 - protein, 9 aa, Homo Sapiens
LVGAFVSLN

SEQ ID NO: 929397 - protein, 9 aa, Homo Sapiens
HIALGGLLI

SEQ ID NO: 929398 - protein, 9 aa, Homo Sapiens
LLNEFLEEK

SEQ ID NO: 929399 - protein, 9 aa, Homo Sapiens
VLARDLDAG

SEQ ID NO: 929400 - protein, 9 aa, Homo Sapiens
AHEPGWQAA

SEQ ID NO: 929401 - protein, 9 aa, Homo Sapiens
VESNVSSET

SEQ ID NO: 929402 - protein, 9 aa, Homo Sapiens
GGSGQHSEG

SEQ ID NO: 929403 - protein, 9 aa, Homo Sapiens
LEALDELPL

SEQ ID NO: 929404 - protein, 9 aa, Homo Sapiens
RSDDENDIS

SEQ ID NO: 929405 - protein, 9 aa, Homo Sapiens
ENNLLFFLK

SEQ ID NO: 929406 - protein, 9 aa, Homo Sapiens
KGVLIDKGK

SEQ ID NO: 929407 - protein, 9 aa, Homo Sapiens
KVSILPDDL

SEQ ID NO: 929408 - protein, 9 aa, Homo Sapiens
HVASPDVIA

SEQ ID NO: 929409 - protein, 9 aa, Homo Sapiens
LMYWISFLL

SEQ ID NO: 929410 - protein, 9 aa, Homo Sapiens
KGGCGFCGC

SEQ ID NO: 929411 - protein, 9 aa, Homo Sapiens
DCDLKKKLK

SEQ ID NO: 929412 - protein, 9 aa, Homo Sapiens
VSPGGAGFD

SEQ ID NO: 929413 - protein, 9 aa, Homo Sapiens
IASMWILFE

SEQ ID NO: 929414 - protein, 9 aa, Homo Sapiens
RPEDREDKE

SEQ ID NO: 929415 - protein, 9 aa, Homo Sapiens
GSSNSLASA

SEQ ID NO: 929416 - protein, 9 aa, Homo Sapiens
EEREQQLRR

SEQ ID NO: 929417 - protein, 9 aa, Homo Sapiens
YFCDLFSLL

SEQ ID NO: 929418 - protein, 9 aa, Homo Sapiens
LDCNSLSEQ

SEQ ID NO: 929419 - protein, 9 aa, Homo Sapiens
PKQMVLELF

SEQ ID NO: 929420 - protein, 9 aa, Homo Sapiens
IKFRKKVEE

SEQ ID NO: 929421 - protein, 9 aa, Homo Sapiens
YIRTNSSLA

SEQ ID NO: 929422 - protein, 9 aa, Homo Sapiens
QKATFEEME

SEQ ID NO: 929423 - protein, 9 aa, Homo Sapiens
YPASTQLDC

SEQ ID NO: 929424 - protein, 9 aa, Homo Sapiens
LPSQPPRII

SEQ ID NO: 929425 - protein, 9 aa, Homo Sapiens
SCLQRLAVS

SEQ ID NO: 929426 - protein, 9 aa, Homo Sapiens
PVNSKIHNI

SEQ ID NO: 929427 - protein, 9 aa, Homo Sapiens
EKGVLIDKG

SEQ ID NO: 929428 - protein, 9 aa, Homo Sapiens
HQPYEATRM

SEQ ID NO: 929429 - protein, 9 aa, Homo Sapiens
DMHPTVLQV

SEQ ID NO: 929430 - protein, 9 aa, Homo Sapiens
VVVDGQFFK

SEQ ID NO: 929431 - protein, 9 aa, Homo Sapiens
LIPDTVYKF

SEQ ID NO: 929432 - protein, 9 aa, Homo Sapiens
NEKDTEYIQ

SEQ ID NO: 929433 - protein, 9 aa, Homo Sapiens
RTLRARFQM

SEQ ID NO: 929434 - protein, 9 aa, Homo Sapiens
FFSSLLLKM

SEQ ID NO: 929435 - protein, 9 aa, Homo Sapiens
KIHNIFKGW

SEQ ID NO: 929436 - protein, 9 aa, Homo Sapiens
ILTDIEKGV

SEQ ID NO: 929437 - protein, 9 aa, Homo Sapiens
TISQFFKFD

SEQ ID NO: 929438 - protein, 9 aa, Homo Sapiens
CLRMEIKFR

SEQ ID NO: 929439 - protein, 9 aa, Homo Sapiens
NLPDCLGIG

SEQ ID NO: 929440 - protein, 9 aa, Homo Sapiens
SLFVSFKPV

SEQ ID NO: 929441 - protein, 9 aa, Homo Sapiens
SLASASLVA

SEQ ID NO: 929442 - protein, 9 aa, Homo Sapiens
RHCSAPENP

SEQ ID NO: 929443 - protein, 9 aa, Homo Sapiens
RPSLTGWTL

SEQ ID NO: 929444 - protein, 9 aa, Homo Sapiens
VQRKAHFVY

SEQ ID NO: 929445 - protein, 9 aa, Homo Sapiens
RCEGNICNL

SEQ ID NO: 929446 - protein, 9 aa, Homo Sapiens
LTGKTITLK

SEQ ID NO: 929447 - protein, 9 aa, Homo Sapiens
ESNVSSETV

SEQ ID NO: 929448 - protein, 9 aa, Homo Sapiens
ALGGLLIIP

SEQ ID NO: 929449 - protein, 9 aa, Homo Sapiens
DGEGIMSRP

SEQ ID NO: 929450 - protein, 9 aa, Homo Sapiens
LRRPRHSHL

SEQ ID NO: 929451 - protein, 9 aa, Homo Sapiens
LLEPLRAFS

SEQ ID NO: 929452 - protein, 9 aa, Homo Sapiens
TMASPRLMP

SEQ ID NO: 929453 - protein, 9 aa, Homo Sapiens
CELHLKLHL

SEQ ID NO: 929454 - protein, 9 aa, Homo Sapiens
CSIENNLLF

SEQ ID NO: 929455 - protein, 9 aa, Homo Sapiens
CNSLSEQQQ

SEQ ID NO: 929456 - protein, 9 aa, Homo Sapiens
NIINLPDCL

SEQ ID NO: 929457 - protein, 9 aa, Homo Sapiens
TGKTITLKV

SEQ ID NO: 929458 - protein, 9 aa, Homo Sapiens
LFENLKRLI

SEQ ID NO: 929459 - protein, 9 aa, Homo Sapiens
GYIRTNSSL

SEQ ID NO: 929460 - protein, 9 aa, Homo Sapiens
SVNVESIFG

SEQ ID NO: 929461 - protein, 9 aa, Homo Sapiens
PTEKAEASG

SEQ ID NO: 929462 - protein, 9 aa, Homo Sapiens
FSSLLLKMN

SEQ ID NO: 929463 - protein, 9 aa, Homo Sapiens
LTRARRCPG

SEQ ID NO: 929464 - protein, 9 aa, Homo Sapiens
RMNTELEKL

SEQ ID NO: 929465 - protein, 9 aa, Homo Sapiens
RQSHRHCPD

SEQ ID NO: 929466 - protein, 9 aa, Homo Sapiens
ELEKLKEAS

SEQ ID NO: 929467 - protein, 9 aa, Homo Sapiens
KEDGPVHRA

SEQ ID NO: 929468 - protein, 9 aa, Homo Sapiens
IVREMDKQT

SEQ ID NO: 929469 - protein, 9 aa, Homo Sapiens
AEASGQPPS

SEQ ID NO: 929470 - protein, 9 aa, Homo Sapiens
GSGQHSEGC

SEQ ID NO: 929471 - protein, 9 aa, Homo Sapiens
TEFFSSLLL

SEQ ID NO: 929472 - protein, 9 aa, Homo Sapiens
DILDTAGKE

SEQ ID NO: 929473 - protein, 9 aa, Homo Sapiens
GCQLHAVPV

SEQ ID NO: 929474 - protein, 9 aa, Homo Sapiens
STNFPNSYS

SEQ ID NO: 929475 - protein, 9 aa, Homo Sapiens
PAMAIFKLL

SEQ ID NO: 929476 - protein, 9 aa, Homo Sapiens
IMGNSRIIL

SEQ ID NO: 929477 - protein, 9 aa, Homo Sapiens
ILPVAAPTL

SEQ ID NO: 929478 - protein, 9 aa, Homo Sapiens
KVKQVGVNL

SEQ ID NO: 929479 - protein, 9 aa, Homo Sapiens
QRFFESFGN

SEQ ID NO: 929480 - protein, 9 aa, Homo Sapiens
HKVCTSRCE

SEQ ID NO: 929481 - protein, 9 aa, Homo Sapiens
QKLLNEFLE

SEQ ID NO: 929482 - protein, 9 aa, Homo Sapiens
LSNVGKPYC

SEQ ID NO: 929483 - protein, 9 aa, Homo Sapiens
LTLMYWISF

SEQ ID NO: 929484 - protein, 9 aa, Homo Sapiens
ESIFGNSCD

SEQ ID NO: 929485 - protein, 9 aa, Homo Sapiens
GFDVVTLFG

SEQ ID NO: 929486 - protein, 9 aa, Homo Sapiens
MHPTVLQVW

SEQ ID NO: 929487 - protein, 9 aa, Homo Sapiens
NLIPDTVYK

SEQ ID NO: 929488 - protein, 9 aa, Homo Sapiens
KAHLGQLPG

SEQ ID NO: 929489 - protein, 9 aa, Homo Sapiens
YKFAVRISQ

SEQ ID NO: 929490 - protein, 9 aa, Homo Sapiens
CYIMTYHEK

SEQ ID NO: 929491 - protein, 9 aa, Homo Sapiens
RSHSESLMC

SEQ ID NO: 929492 - protein, 9 aa, Homo Sapiens
LRPEDREDK

SEQ ID NO: 929493 - protein, 9 aa, Homo Sapiens
TNSSLAQSA

SEQ ID NO: 929494 - protein, 9 aa, Homo Sapiens
LKALHDHIA

SEQ ID NO: 929495 - protein, 9 aa, Homo Sapiens
KRSRFGVTS

SEQ ID NO: 929496 - protein, 9 aa, Homo Sapiens
ATDNSTPFS

SEQ ID NO: 929497 - protein, 9 aa, Homo Sapiens
FLEALDELP

SEQ ID NO: 929498 - protein, 9 aa, Homo Sapiens
TDNSTPFSW

SEQ ID NO: 929499 - protein, 9 aa, Homo Sapiens
ISTLNEGTV

SEQ ID NO: 929500 - protein, 9 aa, Homo Sapiens
NLWKYNRYC

SEQ ID NO: 929501 - protein, 9 aa, Homo Sapiens
LAWDMPRVM

SEQ ID NO: 929502 - protein, 9 aa, Homo Sapiens
PPTTPATPA

SEQ ID NO: 929503 - protein, 9 aa, Homo Sapiens
MCHDDLLQF

SEQ ID NO: 929504 - protein, 9 aa, Homo Sapiens
LEGQLPHQG

SEQ ID NO: 929505 - protein, 9 aa, Homo Sapiens
LDILDTAGK

SEQ ID NO: 929506 - protein, 9 aa, Homo Sapiens
TTPATPAPG

SEQ ID NO: 929507 - protein, 9 aa, Homo Sapiens
DRDRELMKE

SEQ ID NO: 929508 - protein, 9 aa, Homo Sapiens
WSLKLKYQG

SEQ ID NO: 929509 - protein, 9 aa, Homo Sapiens
HCSAPENPI

SEQ ID NO: 929510 - protein, 9 aa, Homo Sapiens
GQQGFPGSK

SEQ ID NO: 929511 - protein, 9 aa, Homo Sapiens
IIIPQNIIN

SEQ ID NO: 929512 - protein, 9 aa, Homo Sapiens
TEGRHKAFS

SEQ ID NO: 929513 - protein, 8 aa, Homo Sapiens
ASVAVDPQ

SEQ ID NO: 929514 - protein, 9 aa, Homo Sapiens
SNSLASASL

SEQ ID NO: 929515 - protein, 9 aa, Homo Sapiens
MYWISFLLE

SEQ ID NO: 929516 - protein, 9 aa, Homo Sapiens
LHLKLHLEG

SEQ ID NO: 929517 - protein, 9 aa, Homo Sapiens
QQNIALPTT

SEQ ID NO: 929518 - protein, 9 aa, Homo Sapiens
ECLRMEIKF

SEQ ID NO: 929519 - protein, 9 aa, Homo Sapiens
FPRLKYLLE

SEQ ID NO: 929520 - protein, 9 aa, Homo Sapiens
FSLDSVTEI

SEQ ID NO: 929521 - protein, 9 aa, Homo Sapiens
SDSPRPTHL

SEQ ID NO: 929522 - protein, 9 aa, Homo Sapiens
QRCQKLLNE

SEQ ID NO: 929523 - protein, 9 aa, Homo Sapiens
EKEEVEEDL

SEQ ID NO: 929524 - protein, 9 aa, Homo Sapiens
VHRAGLRTG

SEQ ID NO: 929525 - protein, 9 aa, Homo Sapiens
ASSDGEGIM

SEQ ID NO: 929526 - protein, 9 aa, Homo Sapiens
PCTAPHAVP

SEQ ID NO: 929527 - protein, 9 aa, Homo Sapiens
SIIAQQLIT

SEQ ID NO: 929528 - protein, 9 aa, Homo Sapiens
RPVNSKIHN

SEQ ID NO: 929529 - protein, 9 aa, Homo Sapiens
AFAQYVQKA

SEQ ID NO: 929530 - protein, 9 aa, Homo Sapiens
SLLEPLRAF

SEQ ID NO: 929531 - protein, 9 aa, Homo Sapiens
ISFLLEVVS

SEQ ID NO: 929532 - protein, 9 aa, Homo Sapiens
NKTKTYPAF

SEQ ID NO: 929533 - protein, 9 aa, Homo Sapiens
QKLLFKGDS

SEQ ID NO: 929534 - protein, 9 aa, Homo Sapiens
VKQVGVNLT

SEQ ID NO: 929535 - protein, 9 aa, Homo Sapiens
SPKSSLGRP

SEQ ID NO: 929536 - protein, 9 aa, Homo Sapiens
ACGGGGAHE

SEQ ID NO: 929537 - protein, 9 aa, Homo Sapiens
YLDQKPTMK

SEQ ID NO: 929538 - protein, 9 aa, Homo Sapiens
FYLKALHDH

SEQ ID NO: 929539 - protein, 9 aa, Homo Sapiens
IAFAQYVQK

SEQ ID NO: 929540 - protein, 9 aa, Homo Sapiens
ILDTAGKEE

SEQ ID NO: 929541 - protein, 9 aa, Homo Sapiens
FFESFGNLS

SEQ ID NO: 929542 - protein, 9 aa, Homo Sapiens
IDIEVLSII

SEQ ID NO: 929543 - protein, 9 aa, Homo Sapiens
LSQSRSLSE

SEQ ID NO: 929544 - protein, 9 aa, Homo Sapiens
NIALPTTKL

SEQ ID NO: 929545 - protein, 9 aa, Homo Sapiens
ECHIAGGTG

SEQ ID NO: 929546 - protein, 9 aa, Homo Sapiens
KTLHTVDLS

SEQ ID NO: 929547 - protein, 9 aa, Homo Sapiens
KPSPTRSVS

SEQ ID NO: 929548 - protein, 9 aa, Homo Sapiens
AMAIFKLLD

SEQ ID NO: 929549 - protein, 9 aa, Homo Sapiens
FDLLLVVLL

SEQ ID NO: 929550 - protein, 9 aa, Homo Sapiens
AIGWGQRGP

SEQ ID NO: 929551 - protein, 9 aa, Homo Sapiens
DGPVHRAGL

SEQ ID NO: 929552 - protein, 9 aa, Homo Sapiens
TGSHGECHI

SEQ ID NO: 929553 - protein, 9 aa, Homo Sapiens
QEKAHLGQL

SEQ ID NO: 929554 - protein, 9 aa, Homo Sapiens
FAQYVQKAT

SEQ ID NO: 929555 - protein, 9 aa, Homo Sapiens
KMRSTEGRH

SEQ ID NO: 929556 - protein, 9 aa, Homo Sapiens
YPHVESNVS

SEQ ID NO: 929557 - protein, 9 aa, Homo Sapiens
FHHKEEKHN

SEQ ID NO: 929558 - protein, 9 aa, Homo Sapiens
FEGYVAKEK

SEQ ID NO: 929559 - protein, 9 aa, Homo Sapiens
AGSALAFRT

SEQ ID NO: 929560 - protein, 9 aa, Homo Sapiens
DDLLQFIRS

SEQ ID NO: 929561 - protein, 9 aa, Homo Sapiens
AAAPAQLRL

SEQ ID NO: 929562 - protein, 9 aa, Homo Sapiens
KIRIFKRKK

SEQ ID NO: 929563 - protein, 9 aa, Homo Sapiens
SVTEILTVS

SEQ ID NO: 929564 - protein, 9 aa, Homo Sapiens
SKIDMHPTV

SEQ ID NO: 929565 - protein, 9 aa, Homo Sapiens
LHCHVASPD

SEQ ID NO: 929566 - protein, 9 aa, Homo Sapiens
ISDKVVTRL

SEQ ID NO: 929567 - protein, 9 aa, Homo Sapiens
GCGFCGCSQ

SEQ ID NO: 929568 - protein, 9 aa, Homo Sapiens
LGSLVITVL

SEQ ID NO: 929569 - protein, 9 aa, Homo Sapiens
VITVLARDL

SEQ ID NO: 929570 - protein, 9 aa, Homo Sapiens
ANMGLTFFS

SEQ ID NO: 929571 - protein, 9 aa, Homo Sapiens
VGAFVSLNV

SEQ ID NO: 929572 - protein, 9 aa, Homo Sapiens
EAQLELSEQ

SEQ ID NO: 929573 - protein, 9 aa, Homo Sapiens
KIIYSGEKP

SEQ ID NO: 929574 - protein, 9 aa, Homo Sapiens
ALPTTKLVK

SEQ ID NO: 929575 - protein, 9 aa, Homo Sapiens
QQGFPGSKG

SEQ ID NO: 929576 - protein, 9 aa, Homo Sapiens
EPRYRRRIG

SEQ ID NO: 929577 - protein, 9 aa, Homo Sapiens
QPYEATRMF

SEQ ID NO: 929578 - protein, 9 aa, Homo Sapiens
PLLPPSTAA

SEQ ID NO: 929579 - protein, 9 aa, Homo Sapiens
PRPTHLSPQ

SEQ ID NO: 929580 - protein, 9 aa, Homo Sapiens
NPLGDKNEK

SEQ ID NO: 929581 - protein, 9 aa, Homo Sapiens
LTDIEKGVL

SEQ ID NO: 929582 - protein, 9 aa, Homo Sapiens
TSKRVQLLH

SEQ ID NO: 929583 - protein, 9 aa, Homo Sapiens
LLPYMCHDD

SEQ ID NO: 929584 - protein, 9 aa, Homo Sapiens
LAPMRTLRA

SEQ ID NO: 929585 - protein, 9 aa, Homo Sapiens
KRRRIKLLE

SEQ ID NO: 929586 - protein, 9 aa, Homo Sapiens
SLDISDKVV

SEQ ID NO: 929587 - protein, 9 aa, Homo Sapiens
ERSTEGVNI

SEQ ID NO: 929588 - protein, 9 aa, Homo Sapiens
EVLSIIAQQ

SEQ ID NO: 929589 - protein, 9 aa, Homo Sapiens
LQIPSFRIT

SEQ ID NO: 929590 - protein, 9 aa, Homo Sapiens
LFGTRGPLS

SEQ ID NO: 929591 - protein, 9 aa, Homo Sapiens
QETPPMISW

SEQ ID NO: 929592 - protein, 9 aa, Homo Sapiens
VSGSLEDPK

SEQ ID NO: 929593 - protein, 9 aa, Homo Sapiens
RREQEEREQ

SEQ ID NO: 929594 - protein, 9 aa, Homo Sapiens
GPVHRAGLR

SEQ ID NO: 929595 - protein, 9 aa, Homo Sapiens
RFNRALFDL

SEQ ID NO: 929596 - protein, 9 aa, Homo Sapiens
SSDGEGIMS

SEQ ID NO: 929597 - protein, 9 aa, Homo Sapiens
REDKEMKTY

SEQ ID NO: 929598 - protein, 9 aa, Homo Sapiens
HEPGWQAAM

SEQ ID NO: 929599 - protein, 9 aa, Homo Sapiens
GGSCLQRLA

SEQ ID NO: 929600 - protein, 9 aa, Homo Sapiens
SVPWACEQE

SEQ ID NO: 929601 - protein, 9 aa, Homo Sapiens
PRLKYLLEE

SEQ ID NO: 929602 - protein, 9 aa, Homo Sapiens
EGIMSRPAS

SEQ ID NO: 929603 - protein, 9 aa, Homo Sapiens
FAFYLLAIG

SEQ ID NO: 929604 - protein, 9 aa, Homo Sapiens
AECCIESGP

SEQ ID NO: 929605 - protein, 9 aa, Homo Sapiens
LHQPYEATR

SEQ ID NO: 929606 - protein, 9 aa, Homo Sapiens
REQEEREQQ

SEQ ID NO: 929607 - protein, 9 aa, Homo Sapiens
LPLGDSEDP

SEQ ID NO: 929608 - protein, 9 aa, Homo Sapiens
FYGYIRTNS

SEQ ID NO: 929609 - protein, 9 aa, Homo Sapiens
IKLLESDSS

SEQ ID NO: 929610 - protein, 9 aa, Homo Sapiens
LEDPKPSPT

SEQ ID NO: 929611 - protein, 9 aa, Homo Sapiens
QIQERVLYV

SEQ ID NO: 929612 - protein, 9 aa, Homo Sapiens
IETHLPKVV

SEQ ID NO: 929613 - protein, 9 aa, Homo Sapiens
KIDMHPTVL

SEQ ID NO: 929614 - protein, 9 aa, Homo Sapiens
PMRTLRARF

SEQ ID NO: 929615 - protein, 9 aa, Homo Sapiens
HGECHIAGG

SEQ ID NO: 929616 - protein, 9 aa, Homo Sapiens
KVLRLLRTQ

SEQ ID NO: 929617 - protein, 9 aa, Homo Sapiens
NQFPGSVIE

SEQ ID NO: 929618 - protein, 9 aa, Homo Sapiens
QPLTEDKIR

SEQ ID NO: 929619 - protein, 9 aa, Homo Sapiens
ITLKVEPSD

SEQ ID NO: 929620 - protein, 9 aa, Homo Sapiens
TELQTEKFL

SEQ ID NO: 929621 - protein, 9 aa, Homo Sapiens
SDRDRELMK

SEQ ID NO: 929622 - protein, 9 aa, Homo Sapiens
AIFQTLGHH

SEQ ID NO: 929623 - protein, 9 aa, Homo Sapiens
NLKNHMRIH

SEQ ID NO: 929624 - protein, 9 aa, Homo Sapiens
SSLFVSFKP

SEQ ID NO: 929625 - protein, 9 aa, Homo Sapiens
FSWWEKSAF

SEQ ID NO: 929626 - protein, 9 aa, Homo Sapiens
PFSWWEKSA

SEQ ID NO: 929627 - protein, 9 aa, Homo Sapiens
EEIHLYRFW

SEQ ID NO: 929628 - protein, 9 aa, Homo Sapiens
DIEKGVLID

SEQ ID NO: 929629 - protein, 9 aa, Homo Sapiens
NLNEEPSTI

SEQ ID NO: 929630 - protein, 9 aa, Homo Sapiens
FGTRGPLSR

SEQ ID NO: 929631 - protein, 9 aa, Homo Sapiens
GERGKNSVS

SEQ ID NO: 929632 - protein, 9 aa, Homo Sapiens
FGNLSSPDA

SEQ ID NO: 929633 - protein, 9 aa, Homo Sapiens
QSRSLSEAK

SEQ ID NO: 929634 - protein, 9 aa, Homo Sapiens
IIGTIFSVA

SEQ ID NO: 929635 - protein, 9 aa, Homo Sapiens
DEKQQRWEQ

SEQ ID NO: 929636 - protein, 9 aa, Homo Sapiens
RCQKLLNEF

SEQ ID NO: 929637 - protein, 9 aa, Homo Sapiens
TISTLNEGT

SEQ ID NO: 929638 - protein, 9 aa, Homo Sapiens
EMDKQTVKD

SEQ ID NO: 929639 - protein, 9 aa, Homo Sapiens
PLGDKNEKD

SEQ ID NO: 929640 - protein, 9 aa, Homo Sapiens
LTELQTEKF

SEQ ID NO: 929641 - protein, 9 aa, Homo Sapiens
LTKHRRIYT

SEQ ID NO: 929642 - protein, 9 aa, Homo Sapiens
SRCEGNICN

SEQ ID NO: 929643 - protein, 9 aa, Homo Sapiens
SKELNLRIK

SEQ ID NO: 929644 - protein, 9 aa, Homo Sapiens
IINLPDCLG

SEQ ID NO: 929645 - protein, 9 aa, Homo Sapiens
KQSLINEFD

SEQ ID NO: 929646 - protein, 9 aa, Homo Sapiens
GGAHEPGWQ

SEQ ID NO: 929647 - protein, 9 aa, Homo Sapiens
SRIILLINT

SEQ ID NO: 929648 - protein, 9 aa, Homo Sapiens
FNAVIFLLF

SEQ ID NO: 929649 - protein, 9 aa, Homo Sapiens
ALQIPSFRI

SEQ ID NO: 929650 - protein, 9 aa, Homo Sapiens
RFFESFGNL

SEQ ID NO: 929651 - protein, 9 aa, Homo Sapiens
EREQQLRRE

SEQ ID NO: 929652 - protein, 9 aa, Homo Sapiens
WVGGCELSP

SEQ ID NO: 929653 - protein, 9 aa, Homo Sapiens
VVSPGGAGF

SEQ ID NO: 929654 - protein, 9 aa, Homo Sapiens
GGCELSPEG

SEQ ID NO: 929655 - protein, 9 aa, Homo Sapiens
SELPKTMSQ

SEQ ID NO: 929656 - protein, 9 aa, Homo Sapiens
DTYEGSYKF

SEQ ID NO: 929657 - protein, 9 aa, Homo Sapiens
GVRTKQIQE

SEQ ID NO: 929658 - protein, 9 aa, Homo Sapiens
TSSLFVSFK

SEQ ID NO: 929659 - protein, 9 aa, Homo Sapiens
DFAFYLLAI

SEQ ID NO: 929660 - protein, 9 aa, Homo Sapiens
QLQAQFMQE

SEQ ID NO: 929661 - protein, 9 aa, Homo Sapiens
SITSSLFVS

SEQ ID NO: 929662 - protein, 9 aa, Homo Sapiens
MNTELEKLK

SEQ ID NO: 929663 - protein, 9 aa, Homo Sapiens
FFLEEMRER

SEQ ID NO: 929664 - protein, 9 aa, Homo Sapiens
QRWEQPHGP

SEQ ID NO: 929665 - protein, 9 aa, Homo Sapiens
RFWPFGFDP

SEQ ID NO: 929666 - protein, 9 aa, Homo Sapiens
YSNLAFCVW

SEQ ID NO: 929667 - protein, 9 aa, Homo Sapiens
REMDKQTVK

SEQ ID NO: 929668 - protein, 9 aa, Homo Sapiens
GLPGQQGFP

SEQ ID NO: 929669 - protein, 9 aa, Homo Sapiens
RDANLYVSE

SEQ ID NO: 929670 - protein, 9 aa, Homo Sapiens
TGVQELESR

SEQ ID NO: 929671 - protein, 9 aa, Homo Sapiens
AVPCTAPHA

SEQ ID NO: 929672 - protein, 9 aa, Homo Sapiens
ASAPLLPPS

SEQ ID NO: 929673 - protein, 9 aa, Homo Sapiens
MDKQTVKDI

SEQ ID NO: 929674 - protein, 9 aa, Homo Sapiens
RSTEGVNIV

SEQ ID NO: 929675 - protein, 9 aa, Homo Sapiens
YRFWPFGFD

SEQ ID NO: 929676 - protein, 9 aa, Homo Sapiens
TNFPNSYSN

SEQ ID NO: 929677 - protein, 9 aa, Homo Sapiens
TLFGTRGPL

SEQ ID NO: 929678 - protein, 9 aa, Homo Sapiens
LQVFFKTNK

SEQ ID NO: 929679 - protein, 9 aa, Homo Sapiens
SVCGRKTGV

SEQ ID NO: 929680 - protein, 9 aa, Homo Sapiens
AAPQKWPLP

SEQ ID NO: 929681 - protein, 9 aa, Homo Sapiens
VPEPRYRRR

SEQ ID NO: 929682 - protein, 9 aa, Homo Sapiens
LDTAGKEEY

SEQ ID NO: 929683 - protein, 9 aa, Homo Sapiens
TITLKVEPS

SEQ ID NO: 929684 - protein, 9 aa, Homo Sapiens
MRTLRARFQ

SEQ ID NO: 929685 - protein, 9 aa, Homo Sapiens
IGFDVVTLF

SEQ ID NO: 929686 - protein, 9 aa, Homo Sapiens
ELSEQQVGQ

SEQ ID NO: 929687 - protein, 9 aa, Homo Sapiens
LPGHNEFFR

SEQ ID NO: 929688 - protein, 9 aa, Homo Sapiens
LRREQEERE

SEQ ID NO: 929689 - protein, 9 aa, Homo Sapiens
ATYCDDLGS

SEQ ID NO: 929690 - protein, 9 aa, Homo Sapiens
LNEEPSTIF

SEQ ID NO: 929691 - protein, 9 aa, Homo Sapiens
DNSTPFSWW

SEQ ID NO: 929692 - protein, 9 aa, Homo Sapiens
RWEQPHGPV

SEQ ID NO: 929693 - protein, 9 aa, Homo Sapiens
NKTTMASPR

SEQ ID NO: 929694 - protein, 9 aa, Homo Sapiens
FCELHLKLH

SEQ ID NO: 929695 - protein, 9 aa, Homo Sapiens
LLSLKRPPP

SEQ ID NO: 929696 - protein, 9 aa, Homo Sapiens
SRSLSEAKM

SEQ ID NO: 929697 - protein, 9 aa, Homo Sapiens
DDLGSSSAP

SEQ ID NO: 929698 - protein, 9 aa, Homo Sapiens
LELFENLKR

SEQ ID NO: 929699 - protein, 9 aa, Homo Sapiens
YPDAKKQSL

SEQ ID NO: 929700 - protein, 9 aa, Homo Sapiens
SYTSQHHEK

SEQ ID NO: 929701 - protein, 9 aa, Homo Sapiens
ECCIESGPR

SEQ ID NO: 929702 - protein, 9 aa, Homo Sapiens
LFFLEEMRE

SEQ ID NO: 929703 - protein, 9 aa, Homo Sapiens
KNVKEDGPV

SEQ ID NO: 929704 - protein, 9 aa, Homo Sapiens
RHSHLTRAR

SEQ ID NO: 929705 - protein, 9 aa, Homo Sapiens
QEEREQQLR

SEQ ID NO: 929706 - protein, 9 aa, Homo Sapiens
ELHVEKLLP

SEQ ID NO: 929707 - protein, 9 aa, Homo Sapiens
FDVVTLFGT

SEQ ID NO: 929708 - protein, 9 aa, Homo Sapiens
FPGSKGITL

SEQ ID NO: 929709 - protein, 9 aa, Homo Sapiens
KQMVLELFE

SEQ ID NO: 929710 - protein, 9 aa, Homo Sapiens
SSLLLKMNP

SEQ ID NO: 929711 - protein, 9 aa, Homo Sapiens
ASPRLMPLV

SEQ ID NO: 929712 - protein, 9 aa, Homo Sapiens
PSAVSPNFS

SEQ ID NO: 929713 - protein, 9 aa, Homo Sapiens
KGEKGERGK

SEQ ID NO: 929714 - protein, 9 aa, Homo Sapiens
LPGQQGFPG

SEQ ID NO: 929715 - protein, 9 aa, Homo Sapiens
WNRSHSESL

SEQ ID NO: 929716 - protein, 9 aa, Homo Sapiens
NSHLEKEPL

SEQ ID NO: 929717 - protein, 9 aa, Homo Sapiens
VNLKRTIST

SEQ ID NO: 929718 - protein, 9 aa, Homo Sapiens
EKAEASGQP

SEQ ID NO: 929719 - protein, 9 aa, Homo Sapiens
TDFRKKLKH

SEQ ID NO: 929720 - protein, 9 aa, Homo Sapiens
APENSHLEK

SEQ ID NO: 929721 - protein, 9 aa, Homo Sapiens
QAQFTAMRD

SEQ ID NO: 929722 - protein, 9 aa, Homo Sapiens
VNVESIFGN

SEQ ID NO: 929723 - protein, 9 aa, Homo Sapiens
EVAQNGSRL

SEQ ID NO: 929724 - protein, 9 aa, Homo Sapiens
SSSAPPGQA

SEQ ID NO: 929725 - protein, 9 aa, Homo Sapiens
EAFTKKALP

SEQ ID NO: 929726 - protein, 9 aa, Homo Sapiens
IPQNIINLP

SEQ ID NO: 929727 - protein, 9 aa, Homo Sapiens
MQERQRLTQ

SEQ ID NO: 929728 - protein, 9 aa, Homo Sapiens
HRHCPDSLH

SEQ ID NO: 929729 - protein, 9 aa, Homo Sapiens
LEKTLHTVD

SEQ ID NO: 929730 - protein, 9 aa, Homo Sapiens
LGEYKVTAK

SEQ ID NO: 929731 - protein, 9 aa, Homo Sapiens
STPFSWWEK

SEQ ID NO: 929732 - protein, 9 aa, Homo Sapiens
LLRTQTGGT

SEQ ID NO: 929733 - protein, 9 aa, Homo Sapiens
AISGNKTKT

SEQ ID NO: 929734 - protein, 9 aa, Homo Sapiens
IIPAGIYAP

SEQ ID NO: 929735 - protein, 9 aa, Homo Sapiens
SFGNLSSPD

SEQ ID NO: 929736 - protein, 9 aa, Homo Sapiens
FVQRKAHFV

SEQ ID NO: 929737 - protein, 9 aa, Homo Sapiens
VLFRRVAGS

SEQ ID NO: 929738 - protein, 9 aa, Homo Sapiens
LCCVQTAHN

SEQ ID NO: 929739 - protein, 9 aa, Homo Sapiens
RILTDIEKG

SEQ ID NO: 929740 - protein, 9 aa, Homo Sapiens
CFVVAECCI

SEQ ID NO: 929741 - protein, 9 aa, Homo Sapiens
GSALAFRTL

SEQ ID NO: 929742 - protein, 9 aa, Homo Sapiens
PTTPATPAP

SEQ ID NO: 929743 - protein, 9 aa, Homo Sapiens
LIIPAGIYA

SEQ ID NO: 929744 - protein, 9 aa, Homo Sapiens
LKLSNVGKP

SEQ ID NO: 929745 - protein, 9 aa, Homo Sapiens
NGGSCLQRL

SEQ ID NO: 929746 - protein, 9 aa, Homo Sapiens
LPLVKGINS

SEQ ID NO: 929747 - protein, 9 aa, Homo Sapiens
LMVVFALLA

SEQ ID NO: 929748 - protein, 9 aa, Homo Sapiens
GLLIIPAGI

SEQ ID NO: 929749 - protein, 9 aa, Homo Sapiens
ERGKNSVSV

SEQ ID NO: 929750 - protein, 9 aa, Homo Sapiens
TEKFLSSLS

SEQ ID NO: 929751 - protein, 9 aa, Homo Sapiens
IARPSLTGW

SEQ ID NO: 929752 - protein, 9 aa, Homo Sapiens
GGSKGGCGF

SEQ ID NO: 929753 - protein, 9 aa, Homo Sapiens
TELEKLKEA

SEQ ID NO: 929754 - protein, 9 aa, Homo Sapiens
NSKIHNIFK

SEQ ID NO: 929755 - protein, 9 aa, Homo Sapiens
KLLDYIVKE

SEQ ID NO: 929756 - protein, 9 aa, Homo Sapiens
LTFFSADLV

SEQ ID NO: 929757 - protein, 9 aa, Homo Sapiens
GRKTGVQEL

SEQ ID NO: 929758 - protein, 9 aa, Homo Sapiens
DKNEKDTEY

SEQ ID NO: 929759 - protein, 9 aa, Homo Sapiens
SLSEAKMLI

SEQ ID NO: 929760 - protein, 9 aa, Homo Sapiens
SLGRPESLL

SEQ ID NO: 929761 - protein, 9 aa, Homo Sapiens
ENDISSENP

SEQ ID NO: 929762 - protein, 9 aa, Homo Sapiens
SKEMILRIN

SEQ ID NO: 929763 - protein, 9 aa, Homo Sapiens
SFCIARPSL

SEQ ID NO: 929764 - protein, 9 aa, Homo Sapiens
SKGGCGFCG

SEQ ID NO: 929765 - protein, 9 aa, Homo Sapiens
WETISQFFK

SEQ ID NO: 929766 - protein, 9 aa, Homo Sapiens
AQFMQERQR

SEQ ID NO: 929767 - protein, 9 aa, Homo Sapiens
KVWFWVGGC

SEQ ID NO: 929768 - protein, 9 aa, Homo Sapiens
RQVSYTSQH

SEQ ID NO: 929769 - protein, 9 aa, Homo Sapiens
ASMWILFEG

SEQ ID NO: 929770 - protein, 9 aa, Homo Sapiens
STEGRHKAF

SEQ ID NO: 929771 - protein, 9 aa, Homo Sapiens
EGSLDADLE

SEQ ID NO: 929772 - protein, 9 aa, Homo Sapiens
MEIKFRKKV

SEQ ID NO: 929773 - protein, 9 aa, Homo Sapiens
RIKLLESDS

SEQ ID NO: 929774 - protein, 9 aa, Homo Sapiens
LWTAIGWGQ

SEQ ID NO: 929775 - protein, 9 aa, Homo Sapiens
IMSRPASVD

SEQ ID NO: 929776 - protein, 9 aa, Homo Sapiens
ENKSLEKTL

SEQ ID NO: 929777 - protein, 9 aa, Homo Sapiens
TPFSWWEKS

SEQ ID NO: 929778 - protein, 9 aa, Homo Sapiens
RVVSRLDGT

SEQ ID NO: 929779 - protein, 9 aa, Homo Sapiens
FESFGNLSS

SEQ ID NO: 929780 - protein, 9 aa, Homo Sapiens
HVEKLLPRS

SEQ ID NO: 929781 - protein, 9 aa, Homo Sapiens
CEQETPPMI

SEQ ID NO: 929782 - protein, 9 aa, Homo Sapiens
DDENDISSE

SEQ ID NO: 929783 - protein, 9 aa, Homo Sapiens
KLLPRSSEE

SEQ ID NO: 929784 - protein, 9 aa, Homo Sapiens
LRARFQMAV

SEQ ID NO: 929785 - protein, 9 aa, Homo Sapiens
LLGKVTFGK

SEQ ID NO: 929786 - protein, 9 aa, Homo Sapiens
KLLNEFLEE

SEQ ID NO: 929787 - protein, 9 aa, Homo Sapiens
LASASLVAG

SEQ ID NO: 929788 - protein, 9 aa, Homo Sapiens
KMAAFHHKE

SEQ ID NO: 929789 - protein, 9 aa, Homo Sapiens
VESIFGNSC

SEQ ID NO: 929790 - protein, 9 aa, Homo Sapiens
AHKIIYSGE

SEQ ID NO: 929791 - protein, 9 aa, Homo Sapiens
AHFVYNFEK

SEQ ID NO: 929792 - protein, 9 aa, Homo Sapiens
CHDDLLQFI

SEQ ID NO: 929793 - protein, 9 aa, Homo Sapiens
LSPTYKWKR

SEQ ID NO: 929794 - protein, 9 aa, Homo Sapiens
SLKLKYQGL

SEQ ID NO: 929795 - protein, 9 aa, Homo Sapiens
CGFCGCSQC

SEQ ID NO: 929796 - protein, 9 aa, Homo Sapiens
SSKKKANVN

SEQ ID NO: 929797 - protein, 9 aa, Homo Sapiens
RALFDLLLV

SEQ ID NO: 929798 - protein, 9 aa, Homo Sapiens
VQKATFEEM

SEQ ID NO: 929799 - protein, 9 aa, Homo Sapiens
RDFAIFQTL

SEQ ID NO: 929800 - protein, 9 aa, Homo Sapiens
SVEVAQNGS

SEQ ID NO: 929801 - protein, 9 aa, Homo Sapiens
DSPRPTHLS

SEQ ID NO: 929802 - protein, 9 aa, Homo Sapiens
LIHCEAHLH

SEQ ID NO: 929803 - protein, 9 aa, Homo Sapiens
PDAKKQSLI

SEQ ID NO: 929804 - protein, 9 aa, Homo Sapiens
SNVGKPYCL

SEQ ID NO: 929805 - protein, 9 aa, Homo Sapiens
GFYLKALHD

SEQ ID NO: 929806 - protein, 9 aa, Homo Sapiens
DSQLKLSNV

SEQ ID NO: 929807 - protein, 9 aa, Homo Sapiens
MWLFPSLLL

SEQ ID NO: 929808 - protein, 9 aa, Homo Sapiens
KHRRIYTGE

SEQ ID NO: 929809 - protein, 9 aa, Homo Sapiens
SYSNLAFCV

SEQ ID NO: 929810 - protein, 9 aa, Homo Sapiens
RPRTMIPGS

SEQ ID NO: 929811 - protein, 9 aa, Homo Sapiens
VKEDGPVHR

SEQ ID NO: 929812 - protein, 9 aa, Homo Sapiens
HCPDSLHDA

SEQ ID NO: 929813 - protein, 9 aa, Homo Sapiens
LKLLGKVTF

SEQ ID NO: 929814 - protein, 9 aa, Homo Sapiens
PWACEQETP

SEQ ID NO: 929815 - protein, 9 aa, Homo Sapiens
ENIKEAHAK

SEQ ID NO: 929816 - protein, 9 aa, Homo Sapiens
APAQLRLPL

SEQ ID NO: 929817 - protein, 9 aa, Homo Sapiens
WEQPHGPVS

SEQ ID NO: 929818 - protein, 9 aa, Homo Sapiens
LEPLRAFSA

SEQ ID NO: 929819 - protein, 9 aa, Homo Sapiens
FVVAECCIE

SEQ ID NO: 929820 - protein, 9 aa, Homo Sapiens
FSLLGLSCS

SEQ ID NO: 929821 - protein, 9 aa, Homo Sapiens
IALPTTKLV

SEQ ID NO: 929822 - protein, 9 aa, Homo Sapiens
WDMPRVMFG

SEQ ID NO: 929823 - protein, 9 aa, Homo Sapiens
AKPPTTPAT

SEQ ID NO: 929824 - protein, 9 aa, Homo Sapiens
NVESIFGNS

SEQ ID NO: 929825 - protein, 9 aa, Homo Sapiens
DAKKQSLIN

SEQ ID NO: 929826 - protein, 9 aa, Homo Sapiens
DVVTLFGTR

SEQ ID NO: 929827 - protein, 9 aa, Homo Sapiens
PQKWPLPLG

SEQ ID NO: 929828 - protein, 9 aa, Homo Sapiens
STDSQLKLS

SEQ ID NO: 929829 - protein, 9 aa, Homo Sapiens
LLMVVFALL

SEQ ID NO: 929830 - protein, 9 aa, Homo Sapiens
NLTSIDSVV

SEQ ID NO: 929831 - protein, 9 aa, Homo Sapiens
VGVNLTSID

SEQ ID NO: 929832 - protein, 9 aa, Homo Sapiens
EEEKEEVEE

SEQ ID NO: 929833 - protein, 9 aa, Homo Sapiens
EPGWQAAMA

SEQ ID NO: 929834 - protein, 9 aa, Homo Sapiens
KWKGAEKFI

SEQ ID NO: 929835 - protein, 9 aa, Homo Sapiens
AAPAQLRLP

SEQ ID NO: 929836 - protein, 9 aa, Homo Sapiens
LTSIDSVVI

SEQ ID NO: 929837 - protein, 9 aa, Homo Sapiens
ICEEIHLYR

SEQ ID NO: 929838 - protein, 9 aa, Homo Sapiens
IFSVAGYSL

SEQ ID NO: 929839 - protein, 9 aa, Homo Sapiens
KRTISTLNE

SEQ ID NO: 929840 - protein, 9 aa, Homo Sapiens
RINLEDFNG

SEQ ID NO: 929841 - protein, 9 aa, Homo Sapiens
EPLRAFSAG

SEQ ID NO: 929842 - protein, 9 aa, Homo Sapiens
LDSVTEILT

SEQ ID NO: 929843 - protein, 9 aa, Homo Sapiens
FSPSASPTS

SEQ ID NO: 929844 - protein, 9 aa, Homo Sapiens
SHLTRARRC

SEQ ID NO: 929845 - protein, 9 aa, Homo Sapiens
KQEAQLELS

SEQ ID NO: 929846 - protein, 9 aa, Homo Sapiens
NTELEKLKE

SEQ ID NO: 929847 - protein, 9 aa, Homo Sapiens
EKQQRWEQP

SEQ ID NO: 929848 - protein, 9 aa, Homo Sapiens
SQLKLSNVG

SEQ ID NO: 929849 - protein, 9 aa, Homo Sapiens
LRLLRTQTG

SEQ ID NO: 929850 - protein, 9 aa, Homo Sapiens
PNSYSNLAF

SEQ ID NO: 929851 - protein, 9 aa, Homo Sapiens
CVLQKLLFK

SEQ ID NO: 929852 - protein, 9 aa, Homo Sapiens
ADGQVVSSK

SEQ ID NO: 929853 - protein, 9 aa, Homo Sapiens
QVGVNLTSI

SEQ ID NO: 929854 - protein, 9 aa, Homo Sapiens
KVTFGKVIL

SEQ ID NO: 929855 - protein, 9 aa, Homo Sapiens
HGFYLKALH

SEQ ID NO: 929856 - protein, 9 aa, Homo Sapiens
LDTAGQAQF

SEQ ID NO: 929857 - protein, 9 aa, Homo Sapiens
ETEFFSSLL

SEQ ID NO: 929858 - protein, 9 aa, Homo Sapiens
TWALRPEDR

SEQ ID NO: 929859 - protein, 9 aa, Homo Sapiens
KGSGRNKKL

SEQ ID NO: 929860 - protein, 9 aa, Homo Sapiens
LQQLQAQFM

SEQ ID NO: 929861 - protein, 9 aa, Homo Sapiens
PQNIINLPD

SEQ ID NO: 929862 - protein, 9 aa, Homo Sapiens
KKALPSQPP

SEQ ID NO: 929863 - protein, 9 aa, Homo Sapiens
QTLGHHHPI

SEQ ID NO: 929864 - protein, 9 aa, Homo Sapiens
AVVSPGGAG

SEQ ID NO: 929865 - protein, 9 aa, Homo Sapiens
QQSPTEKAE

SEQ ID NO: 929866 - protein, 9 aa, Homo Sapiens
QQRWEQPHG

SEQ ID NO: 929867 - protein, 9 aa, Homo Sapiens
GVNLTSIDS

SEQ ID NO: 929868 - protein, 9 aa, Homo Sapiens
STLNEGTVK

SEQ ID NO: 929869 - protein, 9 aa, Homo Sapiens
PDTVYKFAV

SEQ ID NO: 929870 - protein, 9 aa, Homo Sapiens
VVTLFGTRG

SEQ ID NO: 929871 - protein, 9 aa, Homo Sapiens
LGQLPGHNE

SEQ ID NO: 929872 - protein, 9 aa, Homo Sapiens
NSQSLPVSP

SEQ ID NO: 929873 - protein, 9 aa, Homo Sapiens
QFFKGSGRN

SEQ ID NO: 929874 - protein, 9 aa, Homo Sapiens
QSPTEKAEA

SEQ ID NO: 929875 - protein, 9 aa, Homo Sapiens
INLPDCLGI

SEQ ID NO: 929876 - protein, 9 aa, Homo Sapiens
GKEEYSAMR

SEQ ID NO: 929877 - protein, 9 aa, Homo Sapiens
KLLGKVTFG

SEQ ID NO: 929878 - protein, 9 aa, Homo Sapiens
AKFVHNYNL

SEQ ID NO: 929879 - protein, 9 aa, Homo Sapiens
RFDAPENSH

SEQ ID NO: 929880 - protein, 9 aa, Homo Sapiens
GSCLQRLAV

SEQ ID NO: 929881 - protein, 9 aa, Homo Sapiens
TAGQAQFTA

SEQ ID NO: 929882 - protein, 9 aa, Homo Sapiens
SQFFKFDMN

SEQ ID NO: 929883 - protein, 9 aa, Homo Sapiens
TELRPRTMI

SEQ ID NO: 929884 - protein, 9 aa, Homo Sapiens
VNIVMDNLK

SEQ ID NO: 929885 - protein, 9 aa, Homo Sapiens
GSVIETHLP

SEQ ID NO: 929886 - protein, 9 aa, Homo Sapiens
GHKVCTSRC

SEQ ID NO: 929887 - protein, 9 aa, Homo Sapiens
LTGSHGECH

SEQ ID NO: 929888 - protein, 9 aa, Homo Sapiens
TLKVEPSDT

SEQ ID NO: 929889 - protein, 9 aa, Homo Sapiens
SPSLCCVQT

SEQ ID NO: 929890 - protein, 9 aa, Homo Sapiens
YLLEEFVKE

SEQ ID NO: 929891 - protein, 9 aa, Homo Sapiens
IALGGLLII

SEQ ID NO: 929892 - protein, 9 aa, Homo Sapiens
EKAHLGQLP

SEQ ID NO: 929893 - protein, 9 aa, Homo Sapiens
LWIIGTIFS

SEQ ID NO: 929894 - protein, 9 aa, Homo Sapiens
TYEGSYKFG

SEQ ID NO: 929895 - protein, 9 aa, Homo Sapiens
RHCPDSLHD

SEQ ID NO: 929896 - protein, 9 aa, Homo Sapiens
KRVQLLHSQ

SEQ ID NO: 929897 - protein, 9 aa, Homo Sapiens
RFGVTSTPQ

SEQ ID NO: 929898 - protein, 9 aa, Homo Sapiens
IWETISQFF

SEQ ID NO: 929899 - protein, 9 aa, Homo Sapiens
ENSHLEKEP

SEQ ID NO: 929900 - protein, 9 aa, Homo Sapiens
VEKLLPRSS

SEQ ID NO: 929901 - protein, 9 aa, Homo Sapiens
QAVAPCPRA

SEQ ID NO: 929902 - protein, 9 aa, Homo Sapiens
GSSSAPPGQ

SEQ ID NO: 929903 - protein, 9 aa, Homo Sapiens
PTHLSPQSS

SEQ ID NO: 929904 - protein, 9 aa, Homo Sapiens
LSLEGQLPH

SEQ ID NO: 929905 - protein, 9 aa, Homo Sapiens
EQELIETSK

SEQ ID NO: 929906 - protein, 9 aa, Homo Sapiens
RNPLGDKNE

SEQ ID NO: 929907 - protein, 9 aa, Homo Sapiens
NLSSPDAVM

SEQ ID NO: 929908 - protein, 9 aa, Homo Sapiens
YNRYCYIMT

SEQ ID NO: 929909 - protein, 9 aa, Homo Sapiens
QFTAMRDQY

SEQ ID NO: 929910 - protein, 9 aa, Homo Sapiens
AVVLTLLMV

SEQ ID NO: 929911 - protein, 9 aa, Homo Sapiens
EATRMFFEG

SEQ ID NO: 929912 - protein, 9 aa, Homo Sapiens
AHLGQLPGH

SEQ ID NO: 929913 - protein, 9 aa, Homo Sapiens
KPPTTPATP

SEQ ID NO: 929914 - protein, 9 aa, Homo Sapiens
LLEEFVKEN

SEQ ID NO: 929915 - protein, 9 aa, Homo Sapiens
YIWWLNSQS

SEQ ID NO: 929916 - protein, 9 aa, Homo Sapiens
TVYKFAVRI

SEQ ID NO: 929917 - protein, 9 aa, Homo Sapiens
LARDLDAGS

SEQ ID NO: 929918 - protein, 9 aa, Homo Sapiens
FVYNFEKPV

SEQ ID NO: 929919 - protein, 9 aa, Homo Sapiens
ASKIDMHPT

SEQ ID NO: 929920 - protein, 9 aa, Homo Sapiens
AFVSLNVPN

SEQ ID NO: 929921 - protein, 9 aa, Homo Sapiens
SLLGLSCSS

SEQ ID NO: 929922 - protein, 9 aa, Homo Sapiens
MGLTFFSAD

SEQ ID NO: 929923 - protein, 9 aa, Homo Sapiens
RIDIEVLSI

SEQ ID NO: 929924 - protein, 9 aa, Homo Sapiens
TKQIQERVL

SEQ ID NO: 929925 - protein, 9 aa, Homo Sapiens
LDQKPTMKA

SEQ ID NO: 929926 - protein, 9 aa, Homo Sapiens
TLTKHRRIY

SEQ ID NO: 929927 - protein, 9 aa, Homo Sapiens
KSKELNLRI

SEQ ID NO: 929928 - protein, 9 aa, Homo Sapiens
VSELPKTMS

SEQ ID NO: 929929 - protein, 9 aa, Homo Sapiens
IGWGQRGPT

SEQ ID NO: 929930 - protein, 9 aa, Homo Sapiens
RSLTLLSLK

SEQ ID NO: 929931 - protein, 9 aa, Homo Sapiens
ALRPEDRED

SEQ ID NO: 929932 - protein, 9 aa, Homo Sapiens
APQKWPLPL

SEQ ID NO: 929933 - protein, 9 aa, Homo Sapiens
TLTPTGTQT

SEQ ID NO: 929934 - protein, 9 aa, Homo Sapiens
QRAHYPCPL

SEQ ID NO: 929935 - protein, 9 aa, Homo Sapiens
RRRIKLLES

SEQ ID NO: 929936 - protein, 9 aa, Homo Sapiens
RVAGSALAF

SEQ ID NO: 929937 - protein, 9 aa, Homo Sapiens
QEWWSLKLK

SEQ ID NO: 929938 - protein, 9 aa, Homo Sapiens
EEKEEVEED

SEQ ID NO: 929939 - protein, 9 aa, Homo Sapiens
DEEEEEEKE

SEQ ID NO: 929940 - protein, 9 aa, Homo Sapiens
DRVLQVFFK

SEQ ID NO: 929941 - protein, 9 aa, Homo Sapiens
AHFLSMAIT

SEQ ID NO: 929942 - protein, 9 aa, Homo Sapiens
VLHCHVASP

SEQ ID NO: 929943 - protein, 9 aa, Homo Sapiens
GGGAHEPGW

SEQ ID NO: 929944 - protein, 9 aa, Homo Sapiens
NLLSDCDLK

SEQ ID NO: 929945 - protein, 9 aa, Homo Sapiens
VSPNFSPSA

SEQ ID NO: 929946 - protein, 9 aa, Homo Sapiens
VRTKQIQER

SEQ ID NO: 929947 - protein, 9 aa, Homo Sapiens
LLIIPAGIY

SEQ ID NO: 929948 - protein, 9 aa, Homo Sapiens
ELFENLKRL

SEQ ID NO: 929949 - protein, 9 aa, Homo Sapiens
LLGSSNSLA

SEQ ID NO: 929950 - protein, 9 aa, Homo Sapiens
PLLLLLLFP

SEQ ID NO: 929951 - protein, 9 aa, Homo Sapiens
PGEEQAVAP

SEQ ID NO: 929952 - protein, 9 aa, Homo Sapiens
TRMFFEGLR

SEQ ID NO: 929953 - protein, 9 aa, Homo Sapiens
NRSHSESLM

SEQ ID NO: 929954 - protein, 9 aa, Homo Sapiens
DGQVVSSKK

SEQ ID NO: 929955 - protein, 9 aa, Homo Sapiens
ALHDHIAYR

SEQ ID NO: 929956 - protein, 9 aa, Homo Sapiens
EVLASAPLL

SEQ ID NO: 929957 - protein, 9 aa, Homo Sapiens
FRKKLKHPV

SEQ ID NO: 929958 - protein, 9 aa, Homo Sapiens
GSLEDPKPS

SEQ ID NO: 929959 - protein, 9 aa, Homo Sapiens
LPVAAPTLV

SEQ ID NO: 929960 - protein, 9 aa, Homo Sapiens
TPATPAPGP

SEQ ID NO: 929961 - protein, 9 aa, Homo Sapiens
AIFKLLDYI

SEQ ID NO: 929962 - protein, 9 aa, Homo Sapiens
KLHLEGAAF

SEQ ID NO: 929963 - protein, 9 aa, Homo Sapiens
VASPDVIAK

SEQ ID NO: 929964 - protein, 9 aa, Homo Sapiens
WKGAEKFIL

SEQ ID NO: 929965 - protein, 9 aa, Homo Sapiens
LLLKMNPNI

SEQ ID NO: 929966 - protein, 9 aa, Homo Sapiens
LRINLEDFN

SEQ ID NO: 929967 - protein, 9 aa, Homo Sapiens
LSIIAQQLI

SEQ ID NO: 929968 - protein, 9 aa, Homo Sapiens
FAIFQTLGH

SEQ ID NO: 929969 - protein, 9 aa, Homo Sapiens
ELIETSKRV

SEQ ID NO: 929970 - protein, 9 aa, Homo Sapiens
STQLDCNSL

SEQ ID NO: 929971 - protein, 9 aa, Homo Sapiens
QAQFMQERQ

SEQ ID NO: 929972 - protein, 9 aa, Homo Sapiens
KEMILRINL

SEQ ID NO: 929973 - protein, 9 aa, Homo Sapiens
TYCDDLGSS

SEQ ID NO: 929974 - protein, 9 aa, Homo Sapiens
VSYTSQHHE

SEQ ID NO: 929975 - protein, 9 aa, Homo Sapiens
TKSKELNLR

SEQ ID NO: 929976 - protein, 9 aa, Homo Sapiens
QSLINEFDL

SEQ ID NO: 929977 - protein, 9 aa, Homo Sapiens
NVSSETVSE

SEQ ID NO: 929978 - protein, 9 aa, Homo Sapiens
KLLFKGDSK

SEQ ID NO: 929979 - protein, 9 aa, Homo Sapiens
LSFCIARPS

SEQ ID NO: 929980 - protein, 9 aa, Homo Sapiens
KEAHAKVSI

SEQ ID NO: 929981 - protein, 9 aa, Homo Sapiens
FPSLLLLIL

SEQ ID NO: 929982 - protein, 9 aa, Homo Sapiens
ITDFRKKLK

SEQ ID NO: 929983 - protein, 9 aa, Homo Sapiens
PNDFAFYLL

SEQ ID NO: 929984 - protein, 9 aa, Homo Sapiens
QNGGSCLQR

SEQ ID NO: 929985 - protein, 9 aa, Homo Sapiens
IETSKRVQL

SEQ ID NO: 929986 - protein, 9 aa, Homo Sapiens
PYEATRMFF

SEQ ID NO: 929987 - protein, 9 aa, Homo Sapiens
VTLFGTRGP

SEQ ID NO: 929988 - protein, 9 aa, Homo Sapiens
HHKEEKHNL

SEQ ID NO: 929989 - protein, 9 aa, Homo Sapiens
DFDVLPTEI

SEQ ID NO: 929990 - protein, 9 aa, Homo Sapiens
NAKFVHNYN

SEQ ID NO: 929991 - protein, 9 aa, Homo Sapiens
LKLKYQGLC

SEQ ID NO: 929992 - protein, 9 aa, Homo Sapiens
LKECVGINK

SEQ ID NO: 929993 - protein, 9 aa, Homo Sapiens
DPKPSPTRS

SEQ ID NO: 929994 - protein, 9 aa, Homo Sapiens
SLDADLEPN

SEQ ID NO: 929995 - protein, 9 aa, Homo Sapiens
APLLPPSTA

SEQ ID NO: 929996 - protein, 9 aa, Homo Sapiens
VMFGAKGQV

SEQ ID NO: 929997 - protein, 9 aa, Homo Sapiens
YKFGKRHGQ

SEQ ID NO: 929998 - protein, 9 aa, Homo Sapiens
YSQEDSSDR

SEQ ID NO: 929999 - protein, 9 aa, Homo Sapiens
ALFDLLLVV

SEQ ID NO: 930000 - protein, 9 aa, Homo Sapiens
VSSKKKANV

SEQ ID NO: 930001 - protein, 9 aa, Homo Sapiens
RLMPLVVVL

SEQ ID NO: 930002 - protein, 9 aa, Homo Sapiens
APFPRLKYL

SEQ ID NO: 930003 - protein, 9 aa, Homo Sapiens
RVNLNEEPS

SEQ ID NO: 930004 - protein, 9 aa, Homo Sapiens
HSESLMCRM

SEQ ID NO: 930005 - protein, 9 aa, Homo Sapiens
LRMQLSSLC

SEQ ID NO: 930006 - protein, 9 aa, Homo Sapiens
KKQSLINEF

SEQ ID NO: 930007 - protein, 9 aa, Homo Sapiens
NIKEAHAKV

SEQ ID NO: 930008 - protein, 9 aa, Homo Sapiens
SLPAMAIFK

SEQ ID NO: 930009 - protein, 9 aa, Homo Sapiens
KLLESDSSE

SEQ ID NO: 930010 - protein, 9 aa, Homo Sapiens
RSLSEAKML

SEQ ID NO: 930011 - protein, 9 aa, Homo Sapiens
LSEQQVGQP

SEQ ID NO: 930012 - protein, 9 aa, Homo Sapiens
VLASAPLLP

SEQ ID NO: 930013 - protein, 9 aa, Homo Sapiens
AAFHHKEEK

SEQ ID NO: 930014 - protein, 9 aa, Homo Sapiens
ACEQETPPM

SEQ ID NO: 930015 - protein, 9 aa, Homo Sapiens
ATRMFFEGL

SEQ ID NO: 930016 - protein, 9 aa, Homo Sapiens
AWDMPRVMF

SEQ ID NO: 930017 - protein, 9 aa, Homo Sapiens
EEEEEKEEV

SEQ ID NO: 930018 - protein, 9 aa, Homo Sapiens
AFYLLAIGI

SEQ ID NO: 930019 - protein, 9 aa, Homo Sapiens
VEVAQNGSR

SEQ ID NO: 930020 - protein, 9 aa, Homo Sapiens
ADLEPNGSA

SEQ ID NO: 930021 - protein, 9 aa, Homo Sapiens
DAPENSHLE

SEQ ID NO: 930022 - protein, 9 aa, Homo Sapiens
IRTNSSLAQ

SEQ ID NO: 930023 - protein, 9 aa, Homo Sapiens
CHVASPDVI

SEQ ID NO: 930024 - protein, 9 aa, Homo Sapiens
LPAMAIFKL

SEQ ID NO: 930025 - protein, 9 aa, Homo Sapiens
QELIETSKR

SEQ ID NO: 930026 - protein, 9 aa, Homo Sapiens
DTAGKEEYS

SEQ ID NO: 930027 - protein, 9 aa, Homo Sapiens
QNIINLPDC

SEQ ID NO: 930028 - protein, 9 aa, Homo Sapiens
RLPLVKGIN

SEQ ID NO: 930029 - protein, 9 aa, Homo Sapiens
VAQNGSRLN

SEQ ID NO: 930030 - protein, 9 aa, Homo Sapiens
TTMASPRLM

SEQ ID NO: 930031 - protein, 9 aa, Homo Sapiens
YGYIRTNSS

SEQ ID NO: 930032 - protein, 9 aa, Homo Sapiens
LKMRSTEGR

SEQ ID NO: 930033 - protein, 9 aa, Homo Sapiens
LQQNIALPT

SEQ ID NO: 930034 - protein, 9 aa, Homo Sapiens
LVQRKVLRL

SEQ ID NO: 930035 - protein, 9 aa, Homo Sapiens
IIPQNIINL

SEQ ID NO: 930036 - protein, 9 aa, Homo Sapiens
PKSSLGRPE

SEQ ID NO: 930037 - protein, 9 aa, Homo Sapiens
RTITDFRKK

SEQ ID NO: 930038 - protein, 9 aa, Homo Sapiens
KYNRYCYIM

SEQ ID NO: 930039 - protein, 9 aa, Homo Sapiens
ADTAGCQLH

SEQ ID NO: 930040 - protein, 9 aa, Homo Sapiens
NLLFFLKPS

SEQ ID NO: 930041 - protein, 9 aa, Homo Sapiens
DANLYVSEL

SEQ ID NO: 930042 - protein, 9 aa, Homo Sapiens
EQPHGPVSS

SEQ ID NO: 930043 - protein, 9 aa, Homo Sapiens
PTEIPGRAV

SEQ ID NO: 930044 - protein, 9 aa, Homo Sapiens
RTNSSLAQS

SEQ ID NO: 930045 - protein, 9 aa, Homo Sapiens
TEDKIRIFK

SEQ ID NO: 930046 - protein, 9 aa, Homo Sapiens
WIIGTIFSV

SEQ ID NO: 930047 - protein, 9 aa, Homo Sapiens
HCHVASPDV

SEQ ID NO: 930048 - protein, 9 aa, Homo Sapiens
DKQTVKDIS

SEQ ID NO: 930049 - protein, 9 aa, Homo Sapiens
LVVPSSAPA

SEQ ID NO: 930050 - protein, 9 aa, Homo Sapiens
ETISQFFKF

SEQ ID NO: 930051 - protein, 9 aa, Homo Sapiens
IFGNSCDPE

SEQ ID NO: 930052 - protein, 9 aa, Homo Sapiens
EPSTIFKLV

SEQ ID NO: 930053 - protein, 9 aa, Homo Sapiens
DEHGFYLKA

SEQ ID NO: 930054 - protein, 9 aa, Homo Sapiens
VERSTEGVN

SEQ ID NO: 930055 - protein, 9 aa, Homo Sapiens
LRPRTMIPG

SEQ ID NO: 930056 - protein, 9 aa, Homo Sapiens
ISGNKTKTY

SEQ ID NO: 930057 - protein, 9 aa, Homo Sapiens
SHGECHIAG

SEQ ID NO: 930058 - protein, 9 aa, Homo Sapiens
CTSRCEGNI

SEQ ID NO: 930059 - protein, 9 aa, Homo Sapiens
DMPRVMFGA

SEQ ID NO: 930060 - protein, 9 aa, Homo Sapiens
KELNLRIKY

SEQ ID NO: 930061 - protein, 9 aa, Homo Sapiens
EKDTEYIQD

SEQ ID NO: 930062 - protein, 9 aa, Homo Sapiens
LLVGAFVSL

SEQ ID NO: 930063 - protein, 9 aa, Homo Sapiens
KWPLPLGDS

SEQ ID NO: 930064 - protein, 9 aa, Homo Sapiens
KALHDHIAY

SEQ ID NO: 930065 - protein, 9 aa, Homo Sapiens
SPNFSPSAS

SEQ ID NO: 930066 - protein, 9 aa, Homo Sapiens
SSTSGRVHL

SEQ ID NO: 930067 - protein, 9 aa, Homo Sapiens
SEGQSLLEP

SEQ ID NO: 930068 - protein, 9 aa, Homo Sapiens
DRSDDENDI

SEQ ID NO: 930069 - protein, 9 aa, Homo Sapiens
LLLVGAFVS

SEQ ID NO: 930070 - protein, 9 aa, Homo Sapiens
WVLSFCIAR

SEQ ID NO: 930071 - protein, 9 aa, Homo Sapiens
FCGCSQCSC

SEQ ID NO: 930072 - protein, 9 aa, Homo Sapiens
KGERGKNSV

SEQ ID NO: 930073 - protein, 9 aa, Homo Sapiens
LTLLSLKRP

SEQ ID NO: 930074 - protein, 9 aa, Homo Sapiens
FSADLVVFA

SEQ ID NO: 930075 - protein, 9 aa, Homo Sapiens
TLRARFQMA

SEQ ID NO: 930076 - protein, 9 aa, Homo Sapiens
EGRFDAPEN

SEQ ID NO: 930077 - protein, 9 aa, Homo Sapiens
LFFLKPSVE

SEQ ID NO: 930078 - protein, 9 aa, Homo Sapiens
QLKLSNVGK

SEQ ID NO: 930079 - protein, 9 aa, Homo Sapiens
TDSQLKLSN

SEQ ID NO: 930080 - protein, 9 aa, Homo Sapiens
TVLARDLDA

SEQ ID NO: 930081 - protein, 9 aa, Homo Sapiens
WWLNSQSLP

SEQ ID NO: 930082 - protein, 9 aa, Homo Sapiens
LFDLLLVVL

SEQ ID NO: 930083 - protein, 9 aa, Homo Sapiens
DGLPGQQGF

SEQ ID NO: 930084 - protein, 9 aa, Homo Sapiens
SNVSSETVS

SEQ ID NO: 930085 - protein, 9 aa, Homo Sapiens
SKIHNIFKG

SEQ ID NO: 930086 - protein, 9 aa, Homo Sapiens
SLCCVQTAH

SEQ ID NO: 930087 - protein, 9 aa, Homo Sapiens
SPGGAGFDI

SEQ ID NO: 930088 - protein, 9 aa, Homo Sapiens
KVCTSRCEG

SEQ ID NO: 930089 - protein, 9 aa, Homo Sapiens
TTTTVTPTL

SEQ ID NO: 930090 - protein, 9 aa, Homo Sapiens
HHKRSRFGV

SEQ ID NO: 930091 - protein, 9 aa, Homo Sapiens
FFNAVIFLL

SEQ ID NO: 930092 - protein, 9 aa, Homo Sapiens
ELPKTMSQK

SEQ ID NO: 930093 - protein, 9 aa, Homo Sapiens
RTMIPGSPT

SEQ ID NO: 930094 - protein, 9 aa, Homo Sapiens
SALAFRTLV

SEQ ID NO: 930095 - protein, 9 aa, Homo Sapiens
MASPRLMPL

SEQ ID NO: 930096 - protein, 9 aa, Homo Sapiens
PTTKLVKLK

SEQ ID NO: 930097 - protein, 9 aa, Homo Sapiens
ENPIFRFSS

SEQ ID NO: 930098 - protein, 9 aa, Homo Sapiens
PESLFFLEE

SEQ ID NO: 930099 - protein, 9 aa, Homo Sapiens
AWNRSHSES

SEQ ID NO: 930100 - protein, 9 aa, Homo Sapiens
HNIFKGWSL

SEQ ID NO: 930101 - protein, 9 aa, Homo Sapiens
GDRVLQVFF

SEQ ID NO: 930102 - protein, 9 aa, Homo Sapiens
SESLMCRMS

SEQ ID NO: 930103 - protein, 9 aa, Homo Sapiens
FRRVAGSAL

SEQ ID NO: 930104 - protein, 9 aa, Homo Sapiens
PGGAGFDIN

SEQ ID NO: 930105 - protein, 9 aa, Homo Sapiens
FFKFDMNVF

SEQ ID NO: 930106 - protein, 9 aa, Homo Sapiens
AGKEEYSAM

SEQ ID NO: 930107 - protein, 9 aa, Homo Sapiens
NSYSNLAFC

SEQ ID NO: 930108 - protein, 9 aa, Homo Sapiens
KEEVEEDLE

SEQ ID NO: 930109 - protein, 9 aa, Homo Sapiens
PSTIFKLVV

SEQ ID NO: 930110 - protein, 9 aa, Homo Sapiens
GPGEEQAVA

SEQ ID NO: 930111 - protein, 9 aa, Homo Sapiens
ITVLARDLD

SEQ ID NO: 930112 - protein, 9 aa, Homo Sapiens
QNGSRLNQY

SEQ ID NO: 930113 - protein, 9 aa, Homo Sapiens
DYLKLLGKV

SEQ ID NO: 930114 - protein, 9 aa, Homo Sapiens
DFAIFQTLG

SEQ ID NO: 930115 - protein, 9 aa, Homo Sapiens
GAEKFILKL

SEQ ID NO: 930116 - protein, 9 aa, Homo Sapiens
TITDFRKKL

SEQ ID NO: 930117 - protein, 9 aa, Homo Sapiens
PASTQLDCN

SEQ ID NO: 930118 - protein, 9 aa, Homo Sapiens
FQTLGHHHP

SEQ ID NO: 930119 - protein, 9 aa, Homo Sapiens
YLKALHDHI

SEQ ID NO: 930120 - protein, 9 aa, Homo Sapiens
PAAPQKWPL

SEQ ID NO: 930121 - protein, 9 aa, Homo Sapiens
GGGSGQHSE

SEQ ID NO: 930122 - protein, 9 aa, Homo Sapiens
YNLLSDCDL

SEQ ID NO: 930123 - protein, 9 aa, Homo Sapiens
EAHLHSPMY

SEQ ID NO: 930124 - protein, 9 aa, Homo Sapiens
YVNLKRTIS

SEQ ID NO: 930125 - protein, 9 aa, Homo Sapiens
SGSLEDPKP

SEQ ID NO: 930126 - protein, 9 aa, Homo Sapiens
NSTPFSWWE

SEQ ID NO: 930127 - protein, 9 aa, Homo Sapiens
TVTPTLTPT

SEQ ID NO: 930128 - protein, 9 aa, Homo Sapiens
NSITSSLFV

SEQ ID NO: 930129 - protein, 9 aa, Homo Sapiens
DREDKEMKT

SEQ ID NO: 930130 - protein, 9 aa, Homo Sapiens
DADLEPNGS

SEQ ID NO: 930131 - protein, 9 aa, Homo Sapiens
GRVHLTTTL

SEQ ID NO: 930132 - protein, 9 aa, Homo Sapiens
VYNLLSDCD

SEQ ID NO: 930133 - protein, 9 aa, Homo Sapiens
QKPTMKALL

SEQ ID NO: 930134 - protein, 9 aa, Homo Sapiens
MKALLEYTD

SEQ ID NO: 930135 - protein, 9 aa, Homo Sapiens
NGSRLNQYD

SEQ ID NO: 930136 - protein, 9 aa, Homo Sapiens
HVYCSPSLC

SEQ ID NO: 930137 - protein, 9 aa, Homo Sapiens
YWISFLLEV

SEQ ID NO: 930138 - protein, 9 aa, Homo Sapiens
ILLIHCEAH

SEQ ID NO: 930139 - protein, 9 aa, Homo Sapiens
WSNSITSSL

SEQ ID NO: 930140 - protein, 9 aa, Homo Sapiens
AQLRLPLVK

SEQ ID NO: 930141 - protein, 9 aa, Homo Sapiens
RDRELMKEL

SEQ ID NO: 930142 - protein, 9 aa, Homo Sapiens
QIPSFRITF

SEQ ID NO: 930143 - protein, 9 aa, Homo Sapiens
CCVQTAHNI

SEQ ID NO: 930144 - protein, 9 aa, Homo Sapiens
DLLLVVLLA

SEQ ID NO: 930145 - protein, 9 aa, Homo Sapiens
FMQERQRLT

SEQ ID NO: 930146 - protein, 9 aa, Homo Sapiens
LASAPLLPP

SEQ ID NO: 930147 - protein, 9 aa, Homo Sapiens
ASTQLDCNS

SEQ ID NO: 930148 - protein, 9 aa, Homo Sapiens
AEKFILKLK

SEQ ID NO: 930149 - protein, 9 aa, Homo Sapiens
GLQSPKSSL

SEQ ID NO: 930150 - protein, 9 aa, Homo Sapiens
LFVSFKPVF

SEQ ID NO: 930151 - protein, 9 aa, Homo Sapiens
EDEKQQRWE

SEQ ID NO: 930152 - protein, 9 aa, Homo Sapiens
FKGDSKADC

SEQ ID NO: 930153 - protein, 9 aa, Homo Sapiens
PVHRAGLRT

SEQ ID NO: 930154 - protein, 9 aa, Homo Sapiens
SLNVPNNKN

SEQ ID NO: 930155 - protein, 9 aa, Homo Sapiens
ILDRSDDEN

SEQ ID NO: 930156 - protein, 9 aa, Homo Sapiens
AADTAGCQL

SEQ ID NO: 930157 - protein, 9 aa, Homo Sapiens
PENSHLEKE

SEQ ID NO: 930158 - protein, 9 aa, Homo Sapiens
VREMDKQTV

SEQ ID NO: 930159 - protein, 9 aa, Homo Sapiens
PAISGNKTK

SEQ ID NO: 930160 - protein, 9 aa, Homo Sapiens
YGVRTKQIQ

SEQ ID NO: 930161 - protein, 9 aa, Homo Sapiens
KSSLGRPES

SEQ ID NO: 930162 - protein, 9 aa, Homo Sapiens
LRLPLVKGI

SEQ ID NO: 930163 - protein, 9 aa, Homo Sapiens
YGAKPPTTP

SEQ ID NO: 930164 - protein, 9 aa, Homo Sapiens
RLLRTQTGG

SEQ ID NO: 930165 - protein, 9 aa, Homo Sapiens
LKYLLEEFV

SEQ ID NO: 930166 - protein, 9 aa, Homo Sapiens
STIFKLVVV

SEQ ID NO: 930167 - protein, 9 aa, Homo Sapiens
IYPDAKKQS

SEQ ID NO: 930168 - protein, 9 aa, Homo Sapiens
LRMEIKFRK

SEQ ID NO: 930169 - protein, 9 aa, Homo Sapiens
QLPHQGQCV

SEQ ID NO: 930170 - protein, 9 aa, Homo Sapiens
PRVMFGAKG

SEQ ID NO: 930171 - protein, 9 aa, Homo Sapiens
THSTKSKEL

SEQ ID NO: 930172 - protein, 9 aa, Homo Sapiens
SPSAVSPNF

SEQ ID NO: 930173 - protein, 9 aa, Homo Sapiens
DENDISSEN

SEQ ID NO: 930174 - protein, 9 aa, Homo Sapiens
KQIQERVLY

SEQ ID NO: 930175 - protein, 9 aa, Homo Sapiens
GQLPHQGQC

SEQ ID NO: 930176 - protein, 9 aa, Homo Sapiens
QLSSLCVCN

SEQ ID NO: 930177 - protein, 9 aa, Homo Sapiens
MWILFEGYV

SEQ ID NO: 930178 - protein, 9 aa, Homo Sapiens
PNFSPSASP

SEQ ID NO: 930179 - protein, 9 aa, Homo Sapiens
IPSFRITFP

SEQ ID NO: 930180 - protein, 9 aa, Homo Sapiens
NIFKGWSLQ

SEQ ID NO: 930181 - protein, 9 aa, Homo Sapiens
TSIMGNSRI

SEQ ID NO: 930182 - protein, 9 aa, Homo Sapiens
PGSVIETHL

SEQ ID NO: 930183 - protein, 9 aa, Homo Sapiens
HPLLLLLLF

SEQ ID NO: 930184 - protein, 9 aa, Homo Sapiens
GKTITLKVE

SEQ ID NO: 930185 - protein, 9 aa, Homo Sapiens
VSSETVSEA

SEQ ID NO: 930186 - protein, 9 aa, Homo Sapiens
SGFSSTSGR

SEQ ID NO: 930187 - protein, 9 aa, Homo Sapiens
HYFCDLFSL

SEQ ID NO: 930188 - protein, 9 aa, Homo Sapiens
SHSESLMCR

SEQ ID NO: 930189 - protein, 9 aa, Homo Sapiens
KKRRRIKLL

SEQ ID NO: 930190 - protein, 9 aa, Homo Sapiens
QMVLELFEN

SEQ ID NO: 930191 - protein, 9 aa, Homo Sapiens
FENLKRLIK

SEQ ID NO: 930192 - protein, 9 aa, Homo Sapiens
KGAEKFILK

SEQ ID NO: 930193 - protein, 9 aa, Homo Sapiens
SGNKTKTYP

SEQ ID NO: 930194 - protein, 9 aa, Homo Sapiens
LSPQSSNRK

SEQ ID NO: 930195 - protein, 9 aa, Homo Sapiens
EIHLYRFWP

SEQ ID NO: 930196 - protein, 9 aa, Homo Sapiens
LLFKGDSKA

SEQ ID NO: 930197 - protein, 9 aa, Homo Sapiens
PRQVSYTSQ

SEQ ID NO: 930198 - protein, 9 aa, Homo Sapiens
WIYPDAKKQ

SEQ ID NO: 930199 - protein, 9 aa, Homo Sapiens
FYLLAIGIC

SEQ ID NO: 930200 - protein, 9 aa, Homo Sapiens
GSYKFGKRH

SEQ ID NO: 930201 - protein, 9 aa, Homo Sapiens
QKWPLPLGD

SEQ ID NO: 930202 - protein, 9 aa, Homo Sapiens
SSDRDRELM

SEQ ID NO: 930203 - protein, 9 aa, Homo Sapiens
TEKAEASGQ

SEQ ID NO: 930204 - protein, 9 aa, Homo Sapiens
CIARPSLTG

SEQ ID NO: 930205 - protein, 9 aa, Homo Sapiens
EAHAKVSIL

SEQ ID NO: 930206 - protein, 9 aa, Homo Sapiens
VNQFPGSVI

SEQ ID NO: 930207 - protein, 9 aa, Homo Sapiens
LHVEKLLPR

SEQ ID NO: 930208 - protein, 9 aa, Homo Sapiens
YCYIMTYHE

SEQ ID NO: 930209 - protein, 9 aa, Homo Sapiens
VLILLIHCE

SEQ ID NO: 930210 - protein, 9 aa, Homo Sapiens
HKEEKHNLE

SEQ ID NO: 930211 - protein, 9 aa, Homo Sapiens
IHCEAHLHS

SEQ ID NO: 930212 - protein, 9 aa, Homo Sapiens
QQLQAQFMQ

SEQ ID NO: 930213 - protein, 9 aa, Homo Sapiens
CSAPENPIF

SEQ ID NO: 930214 - protein, 9 aa, Homo Sapiens
SLTLLSLKR

SEQ ID NO: 930215 - protein, 9 aa, Homo Sapiens
LFRRVAGSA

SEQ ID NO: 930216 - protein, 9 aa, Homo Sapiens
HAKVSILPD

SEQ ID NO: 930217 - protein, 9 aa, Homo Sapiens
FINWNLKEC

SEQ ID NO: 930218 - protein, 9 aa, Homo Sapiens
IEKGVLIDK

SEQ ID NO: 930219 - protein, 9 aa, Homo Sapiens
PTLVVPSSA

SEQ ID NO: 930220 - protein, 9 aa, Homo Sapiens
INWNLKECV

SEQ ID NO: 930221 - protein, 9 aa, Homo Sapiens
HDDLLQFIR

SEQ ID NO: 930222 - protein, 9 aa, Homo Sapiens
VIETHLPKV

SEQ ID NO: 930223 - protein, 9 aa, Homo Sapiens
CDLKKKLKE

SEQ ID NO: 930224 - protein, 9 aa, Homo Sapiens
LLIHCEAHL

SEQ ID NO: 930225 - protein, 9 aa, Homo Sapiens
TIFSVAGYS

SEQ ID NO: 930226 - protein, 9 aa, Homo Sapiens
TMIPGSPTE

SEQ ID NO: 930227 - protein, 9 aa, Homo Sapiens
NVKEDGPVH

SEQ ID NO: 930228 - protein, 9 aa, Homo Sapiens
KTITLKVEP

SEQ ID NO: 930229 - protein, 9 aa, Homo Sapiens
LDPAISGNK

SEQ ID NO: 930230 - protein, 9 aa, Homo Sapiens
SVPEPRYRR

SEQ ID NO: 930231 - protein, 9 aa, Homo Sapiens
SFRITFPVR

SEQ ID NO: 930232 - protein, 9 aa, Homo Sapiens
QLQRCQKLL

SEQ ID NO: 930233 - protein, 9 aa, Homo Sapiens
QLPGHNEFF

SEQ ID NO: 930234 - protein, 9 aa, Homo Sapiens
MYQPLTEDK

SEQ ID NO: 930235 - protein, 9 aa, Homo Sapiens
ELRPRTMIP

SEQ ID NO: 930236 - protein, 9 aa, Homo Sapiens
EDKIRIFKR

SEQ ID NO: 930237 - protein, 9 aa, Homo Sapiens
GSHGECHIA

SEQ ID NO: 930238 - protein, 9 aa, Homo Sapiens
KFVQRKAHF

SEQ ID NO: 930239 - protein, 9 aa, Homo Sapiens
RYRRRIGSE

SEQ ID NO: 930240 - protein, 9 aa, Homo Sapiens
STEGVNIVM

SEQ ID NO: 930241 - protein, 9 aa, Homo Sapiens
RSTEGRHKA

SEQ ID NO: 930242 - protein, 9 aa, Homo Sapiens
RYCYIMTYH

SEQ ID NO: 930243 - protein, 9 aa, Homo Sapiens
CQNGGSCLQ

SEQ ID NO: 930244 - protein, 9 aa, Homo Sapiens
ALEGSLDAD

SEQ ID NO: 930245 - protein, 9 aa, Homo Sapiens
SQSLPVSPR

SEQ ID NO: 930246 - protein, 9 aa, Homo Sapiens
RKKLKHPVM

SEQ ID NO: 930247 - protein, 9 aa, Homo Sapiens
GNSRIILLI

SEQ ID NO: 930248 - protein, 9 aa, Homo Sapiens
RPTHLSPQS

SEQ ID NO: 930249 - protein, 9 aa, Homo Sapiens
TLLMVVFAL

SEQ ID NO: 930250 - protein, 9 aa, Homo Sapiens
LQSPKSSLG

SEQ ID NO: 930251 - protein, 9 aa, Homo Sapiens
LYRFWPFGF

SEQ ID NO: 930252 - protein, 9 aa, Homo Sapiens
HLYRFWPFG

SEQ ID NO: 930253 - protein, 9 aa, Homo Sapiens
GQAQFTAMR

SEQ ID NO: 930254 - protein, 9 aa, Homo Sapiens
LSSLCVCNS

SEQ ID NO: 930255 - protein, 9 aa, Homo Sapiens
VLPTEIPGR

SEQ ID NO: 930256 - protein, 9 aa, Homo Sapiens
SPTEKAEAS

SEQ ID NO: 930257 - protein, 9 aa, Homo Sapiens
LLFFLKPSV

SEQ ID NO: 930258 - protein, 9 aa, Homo Sapiens
RLKYLLEEF

SEQ ID NO: 930259 - protein, 9 aa, Homo Sapiens
LPHQGQCVA

SEQ ID NO: 930260 - protein, 9 aa, Homo Sapiens
TQLDCNSLS

SEQ ID NO: 930261 - protein, 9 aa, Homo Sapiens
TLSQSRSLS

SEQ ID NO: 930262 - protein, 9 aa, Homo Sapiens
SMWILFEGY

SEQ ID NO: 930263 - protein, 9 aa, Homo Sapiens
EAVVSPGGA

SEQ ID NO: 930264 - protein, 9 aa, Homo Sapiens
FSSTSGRVH

SEQ ID NO: 930265 - protein, 9 aa, Homo Sapiens
RPRHSHLTR

SEQ ID NO: 930266 - protein, 9 aa, Homo Sapiens
SLAWDMPRV

SEQ ID NO: 930267 - protein, 9 aa, Homo Sapiens
SEQQVGQPK

SEQ ID NO: 930268 - protein, 9 aa, Homo Sapiens
TPTLTPTGT

SEQ ID NO: 930269 - protein, 9 aa, Homo Sapiens
NRMNTELEK

SEQ ID NO: 930270 - protein, 9 aa, Homo Sapiens
FFKGSGRNK

SEQ ID NO: 930271 - protein, 9 aa, Homo Sapiens
SQSRSLSEA

SEQ ID NO: 930272 - protein, 9 aa, Homo Sapiens
LKLHLEGAA

SEQ ID NO: 930273 - protein, 9 aa, Homo Sapiens
LSEAKMLII

SEQ ID NO: 930274 - protein, 9 aa, Homo Sapiens
LFSLLGLSC

SEQ ID NO: 930275 - protein, 9 aa, Homo Sapiens
CLSLEGQLP

SEQ ID NO: 930276 - protein, 9 aa, Homo Sapiens
QFPGSVIET

SEQ ID NO: 930277 - protein, 9 aa, Homo Sapiens
VYKFAVRIS

SEQ ID NO: 930278 - protein, 9 aa, Homo Sapiens
NDFAFYLLA

SEQ ID NO: 930279 - protein, 9 aa, Homo Sapiens
PRGPGEEQA

SEQ ID NO: 930280 - protein, 9 aa, Homo Sapiens
VSRLDGTVA

SEQ ID NO: 930281 - protein, 9 aa, Homo Sapiens
ANRMNTELE

SEQ ID NO: 930282 - protein, 9 aa, Homo Sapiens
NMGLTFFSA

SEQ ID NO: 930283 - protein, 9 aa, Homo Sapiens
DPALQIPSF

SEQ ID NO: 930284 - protein, 9 aa, Homo Sapiens
HLGQLPGHN

SEQ ID NO: 930285 - protein, 9 aa, Homo Sapiens
VFFKTNKTH

SEQ ID NO: 930286 - protein, 9 aa, Homo Sapiens
CDLFSLLGL

SEQ ID NO: 930287 - protein, 9 aa, Homo Sapiens
KQQRWEQPH

SEQ ID NO: 930288 - protein, 9 aa, Homo Sapiens
VLTLLMVVF

SEQ ID NO: 930289 - protein, 9 aa, Homo Sapiens
LFPSLLLLI

SEQ ID NO: 930290 - protein, 9 aa, Homo Sapiens
KTKTYPAFE

SEQ ID NO: 930291 - protein, 9 aa, Homo Sapiens
ISPGRFLEA

SEQ ID NO: 930292 - protein, 9 aa, Homo Sapiens
RRVAGSALA

SEQ ID NO: 930293 - protein, 9 aa, Homo Sapiens
PCPLSPTYK

SEQ ID NO: 930294 - protein, 9 aa, Homo Sapiens
WILFEGYVA

SEQ ID NO: 930295 - protein, 9 aa, Homo Sapiens
NHYFCDLFS

SEQ ID NO: 930296 - protein, 9 aa, Homo Sapiens
SSNSLASAS

SEQ ID NO: 930297 - protein, 9 aa, Homo Sapiens
ESFGNLSSP

SEQ ID NO: 930298 - protein, 9 aa, Homo Sapiens
NKSLEKTLH

SEQ ID NO: 930299 - protein, 9 aa, Homo Sapiens
GFSSTSGRV

SEQ ID NO: 930300 - protein, 9 aa, Homo Sapiens
RRIKLLESD

SEQ ID NO: 930301 - protein, 9 aa, Homo Sapiens
QKMAAFHHK

SEQ ID NO: 930302 - protein, 9 aa, Homo Sapiens
WLNSQSLPV

SEQ ID NO: 930303 - protein, 9 aa, Homo Sapiens
AEKGPEVLQ

SEQ ID NO: 930304 - protein, 9 aa, Homo Sapiens
FYGAKPPTT

SEQ ID NO: 930305 - protein, 9 aa, Homo Sapiens
IEVLSIIAQ

SEQ ID NO: 930306 - protein, 9 aa, Homo Sapiens
GHTPPLGEY

SEQ ID NO: 930307 - protein, 9 aa, Homo Sapiens
NIVMDNLKS

SEQ ID NO: 930308 - protein, 9 aa, Homo Sapiens
GGLLIIPAG

SEQ ID NO: 930309 - protein, 9 aa, Homo Sapiens
SRQSHRHCP

SEQ ID NO: 930310 - protein, 9 aa, Homo Sapiens
CSPSLCCVQ

SEQ ID NO: 930311 - protein, 9 aa, Homo Sapiens
PGQQGFPGS

SEQ ID NO: 930312 - protein, 9 aa, Homo Sapiens
NLKECVGIN

SEQ ID NO: 930313 - protein, 9 aa, Homo Sapiens
MGRSLTLLS

SEQ ID NO: 930314 - protein, 9 aa, Homo Sapiens
GEKGERGKN

SEQ ID NO: 930315 - protein, 9 aa, Homo Sapiens
LVITVLARD

SEQ ID NO: 930316 - protein, 9 aa, Homo Sapiens
IIYSGEKPY

SEQ ID NO: 930317 - protein, 9 aa, Homo Sapiens
EYKVTAKCF

SEQ ID NO: 930318 - protein, 9 aa, Homo Sapiens
NKSVEVAQN

SEQ ID NO: 930319 - protein, 9 aa, Homo Sapiens
NDISSENPQ

SEQ ID NO: 930320 - protein, 9 aa, Homo Sapiens
SSRQSHRHC

SEQ ID NO: 930321 - protein, 9 aa, Homo Sapiens
EIWETISQF

SEQ ID NO: 930322 - protein, 9 aa, Homo Sapiens
WTAIGWGQR

SEQ ID NO: 930323 - protein, 9 aa, Homo Sapiens
DPAISGNKT

SEQ ID NO: 930324 - protein, 9 aa, Homo Sapiens
MRPNDFAFY

SEQ ID NO: 930325 - protein, 9 aa, Homo Sapiens
KFVHNYNLK

SEQ ID NO: 930326 - protein, 9 aa, Homo Sapiens
GQLPGHNEF

SEQ ID NO: 930327 - protein, 9 aa, Homo Sapiens
FPGSVIETH

SEQ ID NO: 930328 - protein, 9 aa, Homo Sapiens
IFLLFALNT

SEQ ID NO: 930329 - protein, 9 aa, Homo Sapiens
SVIETHLPK

SEQ ID NO: 930330 - protein, 9 aa, Homo Sapiens
RKTGVQELE

SEQ ID NO: 930331 - protein, 9 aa, Homo Sapiens
ELLAEKGPE

SEQ ID NO: 930332 - protein, 9 aa, Homo Sapiens
CEEIHLYRF

SEQ ID NO: 930333 - protein, 9 aa, Homo Sapiens
FPNSYSNLA

SEQ ID NO: 930334 - protein, 9 aa, Homo Sapiens
SSLCVCNSH

SEQ ID NO: 930335 - protein, 9 aa, Homo Sapiens
EGVNIVMDN

SEQ ID NO: 930336 - protein, 9 aa, Homo Sapiens
YEGSYKFGK

SEQ ID NO: 930337 - protein, 9 aa, Homo Sapiens
RIILLINTD

SEQ ID NO: 930338 - protein, 9 aa, Homo Sapiens
FLAPMRTLR

SEQ ID NO: 930339 - protein, 9 aa, Homo Sapiens
GRFLEALDE

SEQ ID NO: 930340 - protein, 9 aa, Homo Sapiens
EDPALQIPS

SEQ ID NO: 930341 - protein, 9 aa, Homo Sapiens
GRFDAPENS

SEQ ID NO: 930342 - protein, 9 aa, Homo Sapiens
LPTEIPGRA

SEQ ID NO: 930343 - protein, 9 aa, Homo Sapiens
VVSRLDGTV

SEQ ID NO: 930344 - protein, 9 aa, Homo Sapiens
FCDLFSLLG

SEQ ID NO: 930345 - protein, 9 aa, Homo Sapiens
GDTYEGSYK

SEQ ID NO: 930346 - protein, 9 aa, Homo Sapiens
AHYPCPLSP

SEQ ID NO: 930347 - protein, 9 aa, Homo Sapiens
RVHLTTTLE

SEQ ID NO: 930348 - protein, 9 aa, Homo Sapiens
LQKLLFKGD

SEQ ID NO: 930349 - protein, 9 aa, Homo Sapiens
SAPENPIFR

SEQ ID NO: 930350 - protein, 9 aa, Homo Sapiens
GVNIVMDNL

SEQ ID NO: 930351 - protein, 9 aa, Homo Sapiens
HNYNLKNHM

SEQ ID NO: 930352 - protein, 9 aa, Homo Sapiens
LILLIHCEA

SEQ ID NO: 930353 - protein, 9 aa, Homo Sapiens
EQEEREQQL

SEQ ID NO: 930354 - protein, 9 aa, Homo Sapiens
EGQLPHQGQ

SEQ ID NO: 930355 - protein, 9 aa, Homo Sapiens
CLQRLAVSS

SEQ ID NO: 930356 - protein, 9 aa, Homo Sapiens
SYAADTAGC

SEQ ID NO: 930357 - protein, 9 aa, Homo Sapiens
PHVESNVSS

SEQ ID NO: 930358 - protein, 9 aa, Homo Sapiens
TTKLVKLKD

SEQ ID NO: 930359 - protein, 9 aa, Homo Sapiens
TSRCEGNIC

SEQ ID NO: 930360 - protein, 9 aa, Homo Sapiens
LDISDKVVT

SEQ ID NO: 930361 - protein, 9 aa, Homo Sapiens
PSLCCVQTA

SEQ ID NO: 930362 - protein, 9 aa, Homo Sapiens
APENPIFRF

SEQ ID NO: 930363 - protein, 9 aa, Homo Sapiens
EMILRINLE

SEQ ID NO: 930364 - protein, 9 aa, Homo Sapiens
ACLSLEGQL

SEQ ID NO: 930365 - protein, 9 aa, Homo Sapiens
KYLLEEFVK

SEQ ID NO: 930366 - protein, 9 aa, Homo Sapiens
ASPDVIAKM

SEQ ID NO: 930367 - protein, 9 aa, Homo Sapiens
VTSIMGNSR

SEQ ID NO: 930368 - protein, 9 aa, Homo Sapiens
KFAVRISQG

SEQ ID NO: 930369 - protein, 9 aa, Homo Sapiens
VIFLLFALN

SEQ ID NO: 930370 - protein, 9 aa, Homo Sapiens
YTGEKPYTC

SEQ ID NO: 930371 - protein, 9 aa, Homo Sapiens
KAPESLFFL

SEQ ID NO: 930372 - protein, 9 aa, Homo Sapiens
SNSITSSLF

SEQ ID NO: 930373 - protein, 9 aa, Homo Sapiens
RVLQVFFKT

SEQ ID NO: 930374 - protein, 9 aa, Homo Sapiens
WACEQETPP

SEQ ID NO: 930375 - protein, 9 aa, Homo Sapiens
LPTTKLVKL

SEQ ID NO: 930376 - protein, 9 aa, Homo Sapiens
LQTEKFLSS

SEQ ID NO: 930377 - protein, 9 aa, Homo Sapiens
SSVPEPRYR

SEQ ID NO: 930378 - protein, 9 aa, Homo Sapiens
MGNSRIILL

SEQ ID NO: 930379 - protein, 9 aa, Homo Sapiens
YNLKNHMRI

SEQ ID NO: 930380 - protein, 9 aa, Homo Sapiens
HLKLHLEGA

SEQ ID NO: 930381 - protein, 9 aa, Homo Sapiens
TTLSQSRSL

SEQ ID NO: 930382 - protein, 9 aa, Homo Sapiens
NQEWWSLKL

SEQ ID NO: 930383 - protein, 9 aa, Homo Sapiens
GSKGGCGFC

SEQ ID NO: 930384 - protein, 9 aa, Homo Sapiens
SLLLKMNPN

SEQ ID NO: 930385 - protein, 9 aa, Homo Sapiens
LLPPSTAAP

SEQ ID NO: 930386 - protein, 9 aa, Homo Sapiens
AGQAQFTAM

SEQ ID NO: 930387 - protein, 9 aa, Homo Sapiens
LANRMNTEL

SEQ ID NO: 930388 - protein, 9 aa, Homo Sapiens
WPLPLGDSE

SEQ ID NO: 930389 - protein, 9 aa, Homo Sapiens
SQEDSSDRD

SEQ ID NO: 930390 - protein, 9 aa, Homo Sapiens
IHNIFKGWS

SEQ ID NO: 930391 - protein, 9 aa, Homo Sapiens
NSRIILLIN

SEQ ID NO: 930392 - protein, 9 aa, Homo Sapiens
TAGKEEYSA

SEQ ID NO: 930393 - protein, 9 aa, Homo Sapiens
AISPGRFLE

SEQ ID NO: 930394 - protein, 9 aa, Homo Sapiens
SFCELHLKL

SEQ ID NO: 930395 - protein, 9 aa, Homo Sapiens
EIKFRKKVE

SEQ ID NO: 930396 - protein, 9 aa, Homo Sapiens
AQFTAMRDQ

SEQ ID NO: 930397 - protein, 9 aa, Homo Sapiens
FDAPENSHL

SEQ ID NO: 930398 - protein, 9 aa, Homo Sapiens
TKKALPSQP

SEQ ID NO: 930399 - protein, 9 aa, Homo Sapiens
SNLAFCVWI

SEQ ID NO: 930400 - protein, 9 aa, Homo Sapiens
KSVEVAQNG

SEQ ID NO: 930401 - protein, 9 aa, Homo Sapiens
WNLKECVGI

SEQ ID NO: 930402 - protein, 9 aa, Homo Sapiens
IMRPNDFAF

SEQ ID NO: 930403 - protein, 9 aa, Homo Sapiens
SPRLMPLVV

SEQ ID NO: 930404 - protein, 9 aa, Homo Sapiens
VPCTAPHAV

SEQ ID NO: 930405 - protein, 9 aa, Homo Sapiens
GAGFDINCG

SEQ ID NO: 930406 - protein, 9 aa, Homo Sapiens
AGFDINCGV

SEQ ID NO: 930407 - protein, 9 aa, Homo Sapiens
AQNGSRLNQ

SEQ ID NO: 930408 - protein, 9 aa, Homo Sapiens
KKKANVNLK

SEQ ID NO: 930409 - protein, 9 aa, Homo Sapiens
RLDGTVAFE

SEQ ID NO: 930410 - protein, 9 aa, Homo Sapiens
SHRHCPDSL

SEQ ID NO: 930411 - protein, 9 aa, Homo Sapiens
EEEEKEEVE

SEQ ID NO: 930412 - protein, 9 aa, Homo Sapiens
MPRVMFGAK

SEQ ID NO: 930413 - protein, 9 aa, Homo Sapiens
MCSIENNLL

SEQ ID NO: 930414 - protein, 9 aa, Homo Sapiens
LWKYNRYCY

SEQ ID NO: 930415 - protein, 9 aa, Homo Sapiens
LLPRSSEEW

SEQ ID NO: 930416 - protein, 9 aa, Homo Sapiens
SIFGNSCDP

SEQ ID NO: 930417 - protein, 9 aa, Homo Sapiens
PGRFLEALD

SEQ ID NO: 930418 - protein, 9 aa, Homo Sapiens
VTEILTVST

SEQ ID NO: 930419 - protein, 9 aa, Homo Sapiens
KGDSKADCA

SEQ ID NO: 930420 - protein, 9 aa, Homo Sapiens
ETELRPRTM

SEQ ID NO: 930421 - protein, 9 aa, Homo Sapiens
FLSSLSSKT

SEQ ID NO: 930422 - protein, 9 aa, Homo Sapiens
SLEGQLPHQ

SEQ ID NO: 930423 - protein, 9 aa, Homo Sapiens
ALRMQLSSL

SEQ ID NO: 930424 - protein, 9 aa, Homo Sapiens
IFKLLDYIV

SEQ ID NO: 930425 - protein, 9 aa, Homo Sapiens
QRLAVSSVL

SEQ ID NO: 930426 - protein, 9 aa, Homo Sapiens
SKKKANVNL

SEQ ID NO: 930427 - protein, 9 aa, Homo Sapiens
SLCVCNSHC

SEQ ID NO: 930428 - protein, 9 aa, Homo Sapiens
HSTKSKELN

SEQ ID NO: 930429 - protein, 9 aa, Homo Sapiens
GQFFKGSGR

SEQ ID NO: 930430 - protein, 9 aa, Homo Sapiens
GLTFFSADL

SEQ ID NO: 930431 - protein, 9 aa, Homo Sapiens
GGGGAHEPG

SEQ ID NO: 930432 - protein, 9 aa, Homo Sapiens
SKWKGAEKF

SEQ ID NO: 930433 - protein, 9 aa, Homo Sapiens
YQPLTEDKI

SEQ ID NO: 930434 - protein, 9 aa, Homo Sapiens
WGQRGPTPP

SEQ ID NO: 930435 - protein, 9 aa, Homo Sapiens
GFCGCSQCS

SEQ ID NO: 930436 - protein, 9 aa, Homo Sapiens
AAPTLVVPS

SEQ ID NO: 930437 - protein, 9 aa, Homo Sapiens
SRELLAEKG

SEQ ID NO: 930438 - protein, 9 aa, Homo Sapiens
IALVCTVSI

SEQ ID NO: 930439 - protein, 9 aa, Homo Sapiens
ITRITYKNN

SEQ ID NO: 930440 - protein, 9 aa, Homo Sapiens
QHQKIYTGG

SEQ ID NO: 930441 - protein, 9 aa, Homo Sapiens
WKSYVKLCH

SEQ ID NO: 930442 - protein, 9 aa, Homo Sapiens
AKELKKFSK

SEQ ID NO: 930443 - protein, 9 aa, Homo Sapiens
TAEEKPVIT

SEQ ID NO: 930444 - protein, 9 aa, Homo Sapiens
KLEDSVVYE

SEQ ID NO: 930445 - protein, 9 aa, Homo Sapiens
PFRQLRSHW

SEQ ID NO: 930446 - protein, 9 aa, Homo Sapiens
SRLIHVPQG

SEQ ID NO: 930447 - protein, 9 aa, Homo Sapiens
CWIVCTRLK

SEQ ID NO: 930448 - protein, 9 aa, Homo Sapiens
PLKLEDSVV

SEQ ID NO: 930449 - protein, 9 aa, Homo Sapiens
ILVVFMKDS

SEQ ID NO: 930450 - protein, 9 aa, Homo Sapiens
LPPWNNTKR

SEQ ID NO: 930451 - protein, 9 aa, Homo Sapiens
WKGRTAEEK

SEQ ID NO: 930452 - protein, 9 aa, Homo Sapiens
IWRSDLFGT

SEQ ID NO: 930453 - protein, 9 aa, Homo Sapiens
GRTAEEKPV

SEQ ID NO: 930454 - protein, 9 aa, Homo Sapiens
GQEGQDHEK

SEQ ID NO: 930455 - protein, 9 aa, Homo Sapiens
AEEEANLLP

SEQ ID NO: 930456 - protein, 9 aa, Homo Sapiens
LRSHWQAPR

SEQ ID NO: 930457 - protein, 9 aa, Homo Sapiens
LEWDMKINC

SEQ ID NO: 930458 - protein, 9 aa, Homo Sapiens
FIKPGDSLP

SEQ ID NO: 930459 - protein, 9 aa, Homo Sapiens
AAYPQAELA

SEQ ID NO: 930460 - protein, 9 aa, Homo Sapiens
KISNLLDNN

SEQ ID NO: 930461 - protein, 9 aa, Homo Sapiens
DYRLNALRT

SEQ ID NO: 930462 - protein, 9 aa, Homo Sapiens
HLHRMSLEP

SEQ ID NO: 930463 - protein, 9 aa, Homo Sapiens
RHVDLPSPR

SEQ ID NO: 930464 - protein, 9 aa, Homo Sapiens
WILLGCVVF

SEQ ID NO: 930465 - protein, 9 aa, Homo Sapiens
IKPHPQVVK

SEQ ID NO: 930466 - protein, 9 aa, Homo Sapiens
VFYVSSLME

SEQ ID NO: 930467 - protein, 9 aa, Homo Sapiens
YDVDARVPT

SEQ ID NO: 930468 - protein, 9 aa, Homo Sapiens
SFRLLKALK

SEQ ID NO: 930469 - protein, 9 aa, Homo Sapiens
TLCKSDLKS

SEQ ID NO: 930470 - protein, 9 aa, Homo Sapiens
CVVFSVFIS

SEQ ID NO: 930471 - protein, 9 aa, Homo Sapiens
EGKNVTVEI

SEQ ID NO: 930472 - protein, 9 aa, Homo Sapiens
KFKDEPLLF

SEQ ID NO: 930473 - protein, 9 aa, Homo Sapiens
KFSNREYET

SEQ ID NO: 930474 - protein, 9 aa, Homo Sapiens
IEHLLGDAE

SEQ ID NO: 930475 - protein, 9 aa, Homo Sapiens
GTRSVVELE

SEQ ID NO: 930476 - protein, 9 aa, Homo Sapiens
KETFKKKDT

SEQ ID NO: 930477 - protein, 9 aa, Homo Sapiens
WRSDLFGTP

SEQ ID NO: 930478 - protein, 9 aa, Homo Sapiens
LKTMGLWVD

SEQ ID NO: 930479 - protein, 9 aa, Homo Sapiens
LTIQARQVD

SEQ ID NO: 930480 - protein, 9 aa, Homo Sapiens
ENPVDFLAE

SEQ ID NO: 930481 - protein, 9 aa, Homo Sapiens
GFNIRSVQS

SEQ ID NO: 930482 - protein, 9 aa, Homo Sapiens
LYRFDQKFL

SEQ ID NO: 930483 - protein, 9 aa, Homo Sapiens
LKHISRCIG

SEQ ID NO: 930484 - protein, 9 aa, Homo Sapiens
SDLFGTLDP

SEQ ID NO: 930485 - protein, 9 aa, Homo Sapiens
LAQIQVFGH

SEQ ID NO: 930486 - protein, 9 aa, Homo Sapiens
KLVPTILRS

SEQ ID NO: 930487 - protein, 9 aa, Homo Sapiens
TQGFNIRSV

SEQ ID NO: 930488 - protein, 9 aa, Homo Sapiens
NSSRVCKCR

SEQ ID NO: 930489 - protein, 9 aa, Homo Sapiens
KPRQPNEII

SEQ ID NO: 930490 - protein, 9 aa, Homo Sapiens
TAVFRYNLF

SEQ ID NO: 930491 - protein, 9 aa, Homo Sapiens
NLWISRIQE

SEQ ID NO: 930492 - protein, 9 aa, Homo Sapiens
GNSSSVTSC

SEQ ID NO: 930493 - protein, 9 aa, Homo Sapiens
WALKHISRC

SEQ ID NO: 930494 - protein, 9 aa, Homo Sapiens
EEANLLPRQ

SEQ ID NO: 930495 - protein, 9 aa, Homo Sapiens
LRKEKERYT

SEQ ID NO: 930496 - protein, 9 aa, Homo Sapiens
DLTIQARQV

SEQ ID NO: 930497 - protein, 9 aa, Homo Sapiens
LFGTPNEAI

SEQ ID NO: 930498 - protein, 9 aa, Homo Sapiens
GLVHTQLLL

SEQ ID NO: 930499 - protein, 9 aa, Homo Sapiens
EKVNLQKCD

SEQ ID NO: 930500 - protein, 9 aa, Homo Sapiens
LDGAWLPTL

SEQ ID NO: 930501 - protein, 9 aa, Homo Sapiens
TSASCPRPP

SEQ ID NO: 930502 - protein, 9 aa, Homo Sapiens
PTVSFKAQW

SEQ ID NO: 930503 - protein, 9 aa, Homo Sapiens
PYPSAQYPP

SEQ ID NO: 930504 - protein, 9 aa, Homo Sapiens
GEEQYNSTY

SEQ ID NO: 930505 - protein, 9 aa, Homo Sapiens
FSLDCLSNI

SEQ ID NO: 930506 - protein, 9 aa, Homo Sapiens
WPSAVCGAF

SEQ ID NO: 930507 - protein, 9 aa, Homo Sapiens
FIEHLLGDA

SEQ ID NO: 930508 - protein, 9 aa, Homo Sapiens
DYDDSAFMK

SEQ ID NO: 930509 - protein, 9 aa, Homo Sapiens
ENLLIVLTV

SEQ ID NO: 930510 - protein, 9 aa, Homo Sapiens
SPPSVLFTQ

SEQ ID NO: 930511 - protein, 9 aa, Homo Sapiens
NEKRINYTI

SEQ ID NO: 930512 - protein, 9 aa, Homo Sapiens
TDTHVKELT

SEQ ID NO: 930513 - protein, 9 aa, Homo Sapiens
IEEILDLIL

SEQ ID NO: 930514 - protein, 9 aa, Homo Sapiens
HLPPPGTPM

SEQ ID NO: 930515 - protein, 9 aa, Homo Sapiens
LVVFMKDSP

SEQ ID NO: 930516 - protein, 9 aa, Homo Sapiens
CTRLKQQME

SEQ ID NO: 930517 - protein, 9 aa, Homo Sapiens
CINASGGLI

SEQ ID NO: 930518 - protein, 9 aa, Homo Sapiens
SSTSEEPDG

SEQ ID NO: 930519 - protein, 9 aa, Homo Sapiens
AEEKPVITH

SEQ ID NO: 930520 - protein, 9 aa, Homo Sapiens
ELTLFSLSI

SEQ ID NO: 930521 - protein, 9 aa, Homo Sapiens
LDVVLTING

SEQ ID NO: 930522 - protein, 9 aa, Homo Sapiens
DSVVYEDHG

SEQ ID NO: 930523 - protein, 9 aa, Homo Sapiens
SFEFVMKDL

SEQ ID NO: 930524 - protein, 9 aa, Homo Sapiens
PKICNAFFC

SEQ ID NO: 930525 - protein, 9 aa, Homo Sapiens
TLFSLSILV

SEQ ID NO: 930526 - protein, 9 aa, Homo Sapiens
VFMKDSPED

SEQ ID NO: 930527 - protein, 9 aa, Homo Sapiens
STLPAETTG

SEQ ID NO: 930528 - protein, 9 aa, Homo Sapiens
PLLIAVIVF

SEQ ID NO: 930529 - protein, 9 aa, Homo Sapiens
ISTVNRENY

SEQ ID NO: 930530 - protein, 9 aa, Homo Sapiens
TVQKSCPSC

SEQ ID NO: 930531 - protein, 9 aa, Homo Sapiens
LKSQVESLR

SEQ ID NO: 930532 - protein, 9 aa, Homo Sapiens
SASCPRPPL

SEQ ID NO: 930533 - protein, 9 aa, Homo Sapiens
NAFFCPAYW

SEQ ID NO: 930534 - protein, 9 aa, Homo Sapiens
RRDLVLGFG

SEQ ID NO: 930535 - protein, 9 aa, Homo Sapiens
GEAFPAHKV

SEQ ID NO: 930536 - protein, 9 aa, Homo Sapiens
YSQSEALCV

SEQ ID NO: 930537 - protein, 9 aa, Homo Sapiens
NAYLLQGLN

SEQ ID NO: 930538 - protein, 9 aa, Homo Sapiens
GENLTLQCD

SEQ ID NO: 930539 - protein, 9 aa, Homo Sapiens
ALFDVVSLC

SEQ ID NO: 930540 - protein, 9 aa, Homo Sapiens
KIHCADMYL

SEQ ID NO: 930541 - protein, 9 aa, Homo Sapiens
KGKGGKNGR

SEQ ID NO: 930542 - protein, 9 aa, Homo Sapiens
EYDIIVCKN

SEQ ID NO: 930543 - protein, 9 aa, Homo Sapiens
TDKFFTYDF

SEQ ID NO: 930544 - protein, 9 aa, Homo Sapiens
YNLDGDFLI

SEQ ID NO: 930545 - protein, 9 aa, Homo Sapiens
DLFPQMATL

SEQ ID NO: 930546 - protein, 9 aa, Homo Sapiens
HISRCIGDT

SEQ ID NO: 930547 - protein, 9 aa, Homo Sapiens
TKISNLLDN

SEQ ID NO: 930548 - protein, 9 aa, Homo Sapiens
LRNMALDVK

SEQ ID NO: 930549 - protein, 9 aa, Homo Sapiens
WISRIQESG

SEQ ID NO: 930550 - protein, 9 aa, Homo Sapiens
SNSTIEEID

SEQ ID NO: 930551 - protein, 9 aa, Homo Sapiens
SSGGISQIL

SEQ ID NO: 930552 - protein, 9 aa, Homo Sapiens
NMLLSHEIK

SEQ ID NO: 930553 - protein, 9 aa, Homo Sapiens
KEKETFKKK

SEQ ID NO: 930554 - protein, 9 aa, Homo Sapiens
GTDKFFTYD

SEQ ID NO: 930555 - protein, 9 aa, Homo Sapiens
LSTLSFHLS

SEQ ID NO: 930556 - protein, 9 aa, Homo Sapiens
SPCSRTCRG

SEQ ID NO: 930557 - protein, 9 aa, Homo Sapiens
GLIALVCTV

SEQ ID NO: 930558 - protein, 9 aa, Homo Sapiens
YYATLLPLL

SEQ ID NO: 930559 - protein, 9 aa, Homo Sapiens
EISMFPYPD

SEQ ID NO: 930560 - protein, 9 aa, Homo Sapiens
PQVCLDLGN

SEQ ID NO: 930561 - protein, 9 aa, Homo Sapiens
KYYKQNSLD

SEQ ID NO: 930562 - protein, 9 aa, Homo Sapiens
DGNYYDVDA

SEQ ID NO: 930563 - protein, 9 aa, Homo Sapiens
TLLPLLIAV

SEQ ID NO: 930564 - protein, 9 aa, Homo Sapiens
NRCLNGAIQ

SEQ ID NO: 930565 - protein, 9 aa, Homo Sapiens
CWEVICDDG

SEQ ID NO: 930566 - protein, 9 aa, Homo Sapiens
IKIHCADMY

SEQ ID NO: 930567 - protein, 9 aa, Homo Sapiens
GLPDLGAES

SEQ ID NO: 930568 - protein, 9 aa, Homo Sapiens
ESPLFFCFS

SEQ ID NO: 930569 - protein, 9 aa, Homo Sapiens
WEFLQFPLL

SEQ ID NO: 930570 - protein, 9 aa, Homo Sapiens
LDLILDQQE

SEQ ID NO: 930571 - protein, 9 aa, Homo Sapiens
HCFGDLQPP

SEQ ID NO: 930572 - protein, 9 aa, Homo Sapiens
TKEYCLEYN

SEQ ID NO: 930573 - protein, 9 aa, Homo Sapiens
KGLKSLKYL

SEQ ID NO: 930574 - protein, 9 aa, Homo Sapiens
GKAMHGGGC

SEQ ID NO: 930575 - protein, 9 aa, Homo Sapiens
FPLLPPWNN

SEQ ID NO: 930576 - protein, 9 aa, Homo Sapiens
FFRELPTSF

SEQ ID NO: 930577 - protein, 9 aa, Homo Sapiens
SAPQVCLDL

SEQ ID NO: 930578 - protein, 9 aa, Homo Sapiens
PSAVCGAFA

SEQ ID NO: 930579 - protein, 9 aa, Homo Sapiens
LDHEKLELL

SEQ ID NO: 930580 - protein, 9 aa, Homo Sapiens
KEKVNLQKC

SEQ ID NO: 930581 - protein, 9 aa, Homo Sapiens
NNAYLLQGL

SEQ ID NO: 930582 - protein, 9 aa, Homo Sapiens
TDGLPDLGA

SEQ ID NO: 930583 - protein, 9 aa, Homo Sapiens
LLLASLACL

SEQ ID NO: 930584 - protein, 9 aa, Homo Sapiens
YATLLPLLI

SEQ ID NO: 930585 - protein, 9 aa, Homo Sapiens
KEYCLEYNY

SEQ ID NO: 930586 - protein, 9 aa, Homo Sapiens
MAKLNQLAK

SEQ ID NO: 930587 - protein, 9 aa, Homo Sapiens
WEHGQEWTA

SEQ ID NO: 930588 - protein, 9 aa, Homo Sapiens
KSCAFSLFS

SEQ ID NO: 930589 - protein, 9 aa, Homo Sapiens
FFYHEYPWI

SEQ ID NO: 930590 - protein, 9 aa, Homo Sapiens
YTVDCQDYV

SEQ ID NO: 930591 - protein, 9 aa, Homo Sapiens
FYSVLFFDV

SEQ ID NO: 930592 - protein, 9 aa, Homo Sapiens
SVSSKGSDL

SEQ ID NO: 930593 - protein, 9 aa, Homo Sapiens
TRTLYEDGL

SEQ ID NO: 930594 - protein, 9 aa, Homo Sapiens
PSVLFTQAP

SEQ ID NO: 930595 - protein, 9 aa, Homo Sapiens
SLFSLDCLS

SEQ ID NO: 930596 - protein, 9 aa, Homo Sapiens
YVSSLMENL

SEQ ID NO: 930597 - protein, 9 aa, Homo Sapiens
IEEIDIMAI

SEQ ID NO: 930598 - protein, 9 aa, Homo Sapiens
QTLSPRSPL

SEQ ID NO: 930599 - protein, 9 aa, Homo Sapiens
HANSIEEIL

SEQ ID NO: 930600 - protein, 9 aa, Homo Sapiens
EYELEAKSY

SEQ ID NO: 930601 - protein, 9 aa, Homo Sapiens
SLADAPLGL

SEQ ID NO: 930602 - protein, 9 aa, Homo Sapiens
HPQVVKQKK

SEQ ID NO: 930603 - protein, 9 aa, Homo Sapiens
TAPGDPCRI

SEQ ID NO: 930604 - protein, 9 aa, Homo Sapiens
QQVDSLHLH

SEQ ID NO: 930605 - protein, 9 aa, Homo Sapiens
ELDKKIIDA

SEQ ID NO: 930606 - protein, 9 aa, Homo Sapiens
SVSEISMFP

SEQ ID NO: 930607 - protein, 9 aa, Homo Sapiens
PPAEEGAKP

SEQ ID NO: 930608 - protein, 9 aa, Homo Sapiens
WETCVHCFG

SEQ ID NO: 930609 - protein, 9 aa, Homo Sapiens
AYTVDCQDY

SEQ ID NO: 930610 - protein, 9 aa, Homo Sapiens
PGWGRGTSA

SEQ ID NO: 930611 - protein, 9 aa, Homo Sapiens
TTFFYHEYP

SEQ ID NO: 930612 - protein, 9 aa, Homo Sapiens
RSHWQAPRQ

SEQ ID NO: 930613 - protein, 9 aa, Homo Sapiens
GDFGLATMK

SEQ ID NO: 930614 - protein, 9 aa, Homo Sapiens
KPVITHGFT

SEQ ID NO: 930615 - protein, 9 aa, Homo Sapiens
QVDSLHLHR

SEQ ID NO: 930616 - protein, 9 aa, Homo Sapiens
SFERDSMYS

SEQ ID NO: 930617 - protein, 9 aa, Homo Sapiens
KNKELIGKY

SEQ ID NO: 930618 - protein, 9 aa, Homo Sapiens
DSLHLHRMS

SEQ ID NO: 930619 - protein, 9 aa, Homo Sapiens
SEAGLQIMI

SEQ ID NO: 930620 - protein, 9 aa, Homo Sapiens
NLHNNRTGR

SEQ ID NO: 930621 - protein, 9 aa, Homo Sapiens
ISPPPPPLP

SEQ ID NO: 930622 - protein, 9 aa, Homo Sapiens
QMAKLNQLA

SEQ ID NO: 930623 - protein, 9 aa, Homo Sapiens
SLAEEELPT

SEQ ID NO: 930624 - protein, 9 aa, Homo Sapiens
FKLEWDMKI

SEQ ID NO: 930625 - protein, 9 aa, Homo Sapiens
SPLISVSGV

SEQ ID NO: 930626 - protein, 9 aa, Homo Sapiens
CNAFFCPAY

SEQ ID NO: 930627 - protein, 9 aa, Homo Sapiens
SFCWISGWG

SEQ ID NO: 930628 - protein, 9 aa, Homo Sapiens
KKDTYKLFK

SEQ ID NO: 930629 - protein, 9 aa, Homo Sapiens
SSRFEKFIR

SEQ ID NO: 930630 - protein, 9 aa, Homo Sapiens
EIDIMAIKF

SEQ ID NO: 930631 - protein, 9 aa, Homo Sapiens
HEIKPILVF

SEQ ID NO: 930632 - protein, 9 aa, Homo Sapiens
AGAGKRVVS

SEQ ID NO: 930633 - protein, 9 aa, Homo Sapiens
STSEEPDGN

SEQ ID NO: 930634 - protein, 9 aa, Homo Sapiens
ASAFGFSLQ

SEQ ID NO: 930635 - protein, 9 aa, Homo Sapiens
LFDVVSLCP

SEQ ID NO: 930636 - protein, 9 aa, Homo Sapiens
DEFMVSYFG

SEQ ID NO: 930637 - protein, 9 aa, Homo Sapiens
SESMHKIWE

SEQ ID NO: 930638 - protein, 9 aa, Homo Sapiens
KLDAGWYTL

SEQ ID NO: 930639 - protein, 9 aa, Homo Sapiens
VVTCSCQDC

SEQ ID NO: 930640 - protein, 9 aa, Homo Sapiens
NLTLQCDSD

SEQ ID NO: 930641 - protein, 9 aa, Homo Sapiens
PLEGLQSQT

SEQ ID NO: 930642 - protein, 9 aa, Homo Sapiens
ILEYATKIS

SEQ ID NO: 930643 - protein, 9 aa, Homo Sapiens
KGRIIKIHC

SEQ ID NO: 930644 - protein, 9 aa, Homo Sapiens
DRKDVKNEI

SEQ ID NO: 930645 - protein, 9 aa, Homo Sapiens
GSQDEVSKG

SEQ ID NO: 930646 - protein, 9 aa, Homo Sapiens
CCNVRPENP

SEQ ID NO: 930647 - protein, 9 aa, Homo Sapiens
KPRYHVRRE

SEQ ID NO: 930648 - protein, 9 aa, Homo Sapiens
HEKEDDHDS

SEQ ID NO: 930649 - protein, 9 aa, Homo Sapiens
CHSGIEWVW

SEQ ID NO: 930650 - protein, 9 aa, Homo Sapiens
VSYFGRHGC

SEQ ID NO: 930651 - protein, 9 aa, Homo Sapiens
GAESLFSSP

SEQ ID NO: 930652 - protein, 9 aa, Homo Sapiens
FKKKDTYKL

SEQ ID NO: 930653 - protein, 9 aa, Homo Sapiens
ALLQAEVLH

SEQ ID NO: 930654 - protein, 9 aa, Homo Sapiens
VYEDHGITV

SEQ ID NO: 930655 - protein, 9 aa, Homo Sapiens
GDIFWKKTT

SEQ ID NO: 930656 - protein, 9 aa, Homo Sapiens
IYDEKDKTT

SEQ ID NO: 930657 - protein, 9 aa, Homo Sapiens
KEKERYTCR

SEQ ID NO: 930658 - protein, 9 aa, Homo Sapiens
HVDLPSPRA

SEQ ID NO: 930659 - protein, 9 aa, Homo Sapiens
LGAESLFSS

SEQ ID NO: 930660 - protein, 9 aa, Homo Sapiens
EEPDGNSSS

SEQ ID NO: 930661 - protein, 9 aa, Homo Sapiens
HGLADGAHS

SEQ ID NO: 930662 - protein, 9 aa, Homo Sapiens
SVLFTQAPT

SEQ ID NO: 930663 - protein, 9 aa, Homo Sapiens
SRIQESGDQ

SEQ ID NO: 930664 - protein, 9 aa, Homo Sapiens
EVLTVKKIT

SEQ ID NO: 930665 - protein, 9 aa, Homo Sapiens
DKFFTYDFV

SEQ ID NO: 930666 - protein, 9 aa, Homo Sapiens
MVEATAITT

SEQ ID NO: 930667 - protein, 9 aa, Homo Sapiens
RKEKERYTC

SEQ ID NO: 930668 - protein, 9 aa, Homo Sapiens
VDSWPSAVC

SEQ ID NO: 930669 - protein, 9 aa, Homo Sapiens
DHVVDSWPS

SEQ ID NO: 930670 - protein, 9 aa, Homo Sapiens
DVVLTINGE

SEQ ID NO: 930671 - protein, 9 aa, Homo Sapiens
VNRENYSYL

SEQ ID NO: 930672 - protein, 9 aa, Homo Sapiens
AEEGAKPEV

SEQ ID NO: 930673 - protein, 9 aa, Homo Sapiens
GKRVVSLEP

SEQ ID NO: 930674 - protein, 9 aa, Homo Sapiens
APDSFCWIS

SEQ ID NO: 930675 - protein, 9 aa, Homo Sapiens
EPKYIHPSF

SEQ ID NO: 930676 - protein, 9 aa, Homo Sapiens
PEVGDGGGA

SEQ ID NO: 930677 - protein, 9 aa, Homo Sapiens
HEKLELLQF

SEQ ID NO: 930678 - protein, 9 aa, Homo Sapiens
CKSDLKSQV

SEQ ID NO: 930679 - protein, 9 aa, Homo Sapiens
GLVLSLAEE

SEQ ID NO: 930680 - protein, 9 aa, Homo Sapiens
ENCDCTPDY

SEQ ID NO: 930681 - protein, 9 aa, Homo Sapiens
PVTFYFLAK

SEQ ID NO: 930682 - protein, 9 aa, Homo Sapiens
LNSLEQLCI

SEQ ID NO: 930683 - protein, 9 aa, Homo Sapiens
LISSFRLLK

SEQ ID NO: 930684 - protein, 9 aa, Homo Sapiens
SSFRLLKAL

SEQ ID NO: 930685 - protein, 9 aa, Homo Sapiens
ALVCTVSIL

SEQ ID NO: 930686 - protein, 9 aa, Homo Sapiens
FEFVMKDLL

SEQ ID NO: 930687 - protein, 9 aa, Homo Sapiens
KNSLFSLDC

SEQ ID NO: 930688 - protein, 9 aa, Homo Sapiens
DGLPDLGAE

SEQ ID NO: 930689 - protein, 9 aa, Homo Sapiens
EIKKSCAFS

SEQ ID NO: 930690 - protein, 9 aa, Homo Sapiens
VNLQKCDIL

SEQ ID NO: 930691 - protein, 9 aa, Homo Sapiens
TSPFSASTG

SEQ ID NO: 930692 - protein, 9 aa, Homo Sapiens
SSLMENLLI

SEQ ID NO: 930693 - protein, 9 aa, Homo Sapiens
FRYNLFASG

SEQ ID NO: 930694 - protein, 9 aa, Homo Sapiens
EEPVTFYFL

SEQ ID NO: 930695 - protein, 9 aa, Homo Sapiens
KLNQLAKMM

SEQ ID NO: 930696 - protein, 9 aa, Homo Sapiens
IYDVKQKFH

SEQ ID NO: 930697 - protein, 9 aa, Homo Sapiens
YLTQHQKIY

SEQ ID NO: 930698 - protein, 9 aa, Homo Sapiens
LMNLHNNRT

SEQ ID NO: 930699 - protein, 9 aa, Homo Sapiens
VLVFFFLLL

SEQ ID NO: 930700 - protein, 9 aa, Homo Sapiens
GPTRTLYED

SEQ ID NO: 930701 - protein, 9 aa, Homo Sapiens
LSLAEEELP

SEQ ID NO: 930702 - protein, 9 aa, Homo Sapiens
TEEEERLER

SEQ ID NO: 930703 - protein, 9 aa, Homo Sapiens
IPLEGLQSQ

SEQ ID NO: 930704 - protein, 9 aa, Homo Sapiens
SSLISSFRL

SEQ ID NO: 930705 - protein, 9 aa, Homo Sapiens
VIRHVDLPS

SEQ ID NO: 930706 - protein, 9 aa, Homo Sapiens
EKEDDHDSS

SEQ ID NO: 930707 - protein, 9 aa, Homo Sapiens
HHVLEKSKF

SEQ ID NO: 930708 - protein, 9 aa, Homo Sapiens
IVCKNSKPG

SEQ ID NO: 930709 - protein, 9 aa, Homo Sapiens
DDSAFMKPR

SEQ ID NO: 930710 - protein, 9 aa, Homo Sapiens
NCWEPKNTD

SEQ ID NO: 930711 - protein, 9 aa, Homo Sapiens
IFDLNSLEQ

SEQ ID NO: 930712 - protein, 9 aa, Homo Sapiens
QLRSHWQAP

SEQ ID NO: 930713 - protein, 9 aa, Homo Sapiens
MENLLIVLT

SEQ ID NO: 930714 - protein, 9 aa, Homo Sapiens
VVVGTDKFF

SEQ ID NO: 930715 - protein, 9 aa, Homo Sapiens
KSQVESLRE

SEQ ID NO: 930716 - protein, 9 aa, Homo Sapiens
PDSFCWISG

SEQ ID NO: 930717 - protein, 9 aa, Homo Sapiens
VKNKELIGK

SEQ ID NO: 930718 - protein, 9 aa, Homo Sapiens
GRRGKNENE

SEQ ID NO: 930719 - protein, 9 aa, Homo Sapiens
SKGSDLFGT

SEQ ID NO: 930720 - protein, 9 aa, Homo Sapiens
LESRRPSSL

SEQ ID NO: 930721 - protein, 9 aa, Homo Sapiens
RNDNSSRFE

SEQ ID NO: 930722 - protein, 9 aa, Homo Sapiens
TLSPRSPLI

SEQ ID NO: 930723 - protein, 9 aa, Homo Sapiens
YPQAELAMS

SEQ ID NO: 930724 - protein, 9 aa, Homo Sapiens
CTCRALKTM

SEQ ID NO: 930725 - protein, 9 aa, Homo Sapiens
FCPAYWMPG

SEQ ID NO: 930726 - protein, 9 aa, Homo Sapiens
KEEPVTFYF

SEQ ID NO: 930727 - protein, 9 aa, Homo Sapiens
AGKAAMGIA

SEQ ID NO: 930728 - protein, 9 aa, Homo Sapiens
EALFDVVSL

SEQ ID NO: 930729 - protein, 9 aa, Homo Sapiens
QSEALCVLL

SEQ ID NO: 930730 - protein, 9 aa, Homo Sapiens
NEKQVYKET

SEQ ID NO: 930731 - protein, 9 aa, Homo Sapiens
GRSGPAGPP

SEQ ID NO: 930732 - protein, 9 aa, Homo Sapiens
PFSASTGHA

SEQ ID NO: 930733 - protein, 9 aa, Homo Sapiens
GWGRGTSAS

SEQ ID NO: 930734 - protein, 9 aa, Homo Sapiens
AKRRYFLNE

SEQ ID NO: 930735 - protein, 9 aa, Homo Sapiens
KTTLAHACA

SEQ ID NO: 930736 - protein, 9 aa, Homo Sapiens
AFGFSLQPA

SEQ ID NO: 930737 - protein, 9 aa, Homo Sapiens
TQSSTIYDV

SEQ ID NO: 930738 - protein, 9 aa, Homo Sapiens
RTAEEKPVI

SEQ ID NO: 930739 - protein, 9 aa, Homo Sapiens
KQREIKQQQ

SEQ ID NO: 930740 - protein, 9 aa, Homo Sapiens
GTIFREHPW

SEQ ID NO: 930741 - protein, 9 aa, Homo Sapiens
MHGGGCSPH

SEQ ID NO: 930742 - protein, 9 aa, Homo Sapiens
PENPVDFLA

SEQ ID NO: 930743 - protein, 9 aa, Homo Sapiens
PGILGPQGL

SEQ ID NO: 930744 - protein, 9 aa, Homo Sapiens
HQPLGFFGV

SEQ ID NO: 930745 - protein, 9 aa, Homo Sapiens
GKGGKNGRR

SEQ ID NO: 930746 - protein, 9 aa, Homo Sapiens
EGQDHEKED

SEQ ID NO: 930747 - protein, 9 aa, Homo Sapiens
VRPENPVDF

SEQ ID NO: 930748 - protein, 9 aa, Homo Sapiens
RTCRGGVSH

SEQ ID NO: 930749 - protein, 9 aa, Homo Sapiens
AKKPAQCTE

SEQ ID NO: 930750 - protein, 9 aa, Homo Sapiens
ERWEERYGV

SEQ ID NO: 930751 - protein, 9 aa, Homo Sapiens
GSQRTVQKS

SEQ ID NO: 930752 - protein, 9 aa, Homo Sapiens
DIFWKKTTL

SEQ ID NO: 930753 - protein, 9 aa, Homo Sapiens
SYKISSGGI

SEQ ID NO: 930754 - protein, 9 aa, Homo Sapiens
VVELEIAAN

SEQ ID NO: 930755 - protein, 9 aa, Homo Sapiens
LAPDSFCWI

SEQ ID NO: 930756 - protein, 9 aa, Homo Sapiens
PTQGFNIRS

SEQ ID NO: 930757 - protein, 9 aa, Homo Sapiens
NLTKEYCLE

SEQ ID NO: 930758 - protein, 9 aa, Homo Sapiens
DLFGTPNEA

SEQ ID NO: 930759 - protein, 9 aa, Homo Sapiens
INFYAQVSD

SEQ ID NO: 930760 - protein, 9 aa, Homo Sapiens
IIKIHCADM

SEQ ID NO: 930761 - protein, 9 aa, Homo Sapiens
LGSQRTVQK

SEQ ID NO: 930762 - protein, 9 aa, Homo Sapiens
HHNKLVPTI

SEQ ID NO: 930763 - protein, 9 aa, Homo Sapiens
SNKQEAKKP

SEQ ID NO: 930764 - protein, 9 aa, Homo Sapiens
SGFPGMKGK

SEQ ID NO: 930765 - protein, 9 aa, Homo Sapiens
ITALSFEFV

SEQ ID NO: 930766 - protein, 9 aa, Homo Sapiens
QVCLDLGNC

SEQ ID NO: 930767 - protein, 9 aa, Homo Sapiens
AKDRKDVKN

SEQ ID NO: 930768 - protein, 9 aa, Homo Sapiens
PQPQRPSSQ

SEQ ID NO: 930769 - protein, 9 aa, Homo Sapiens
VSITKSILI

SEQ ID NO: 930770 - protein, 9 aa, Homo Sapiens
KIVIFIDYY

SEQ ID NO: 930771 - protein, 9 aa, Homo Sapiens
PPGDSGFPG

SEQ ID NO: 930772 - protein, 9 aa, Homo Sapiens
ERYGVQEQV

SEQ ID NO: 930773 - protein, 9 aa, Homo Sapiens
WSPCSRTCR

SEQ ID NO: 930774 - protein, 9 aa, Homo Sapiens
KGSDLFGTL

SEQ ID NO: 930775 - protein, 9 aa, Homo Sapiens
YDEKDKTTH

SEQ ID NO: 930776 - protein, 9 aa, Homo Sapiens
LLFLRIYVV

SEQ ID NO: 930777 - protein, 9 aa, Homo Sapiens
PAEEGAKPE

SEQ ID NO: 930778 - protein, 9 aa, Homo Sapiens
TIYDVKQKF

SEQ ID NO: 930779 - protein, 9 aa, Homo Sapiens
FFCFSQGTT

SEQ ID NO: 930780 - protein, 9 aa, Homo Sapiens
PENLLRKEK

SEQ ID NO: 930781 - protein, 9 aa, Homo Sapiens
TLFNYYKIN

SEQ ID NO: 930782 - protein, 9 aa, Homo Sapiens
YSSKNFLCY

SEQ ID NO: 930783 - protein, 9 aa, Homo Sapiens
DTVGCKEMP

SEQ ID NO: 930784 - protein, 9 aa, Homo Sapiens
FGLATMKSR

SEQ ID NO: 930785 - protein, 9 aa, Homo Sapiens
VTSPFSAST

SEQ ID NO: 930786 - protein, 9 aa, Homo Sapiens
EIAANGINK

SEQ ID NO: 930787 - protein, 9 aa, Homo Sapiens
IYEPKYIHP

SEQ ID NO: 930788 - protein, 9 aa, Homo Sapiens
PHPQVVKQK

SEQ ID NO: 930789 - protein, 9 aa, Homo Sapiens
RLNALRTES

SEQ ID NO: 930790 - protein, 9 aa, Homo Sapiens
GPPAEEGAK

SEQ ID NO: 930791 - protein, 9 aa, Homo Sapiens
KSAKDRKDV

SEQ ID NO: 930792 - protein, 9 aa, Homo Sapiens
INGEAFPAH

SEQ ID NO: 930793 - protein, 9 aa, Homo Sapiens
LGPQGLPGV

SEQ ID NO: 930794 - protein, 9 aa, Homo Sapiens
FLQFPLLPP

SEQ ID NO: 930795 - protein, 9 aa, Homo Sapiens
KKFSNREYE

SEQ ID NO: 930796 - protein, 9 aa, Homo Sapiens
TIPLEGLQS

SEQ ID NO: 930797 - protein, 9 aa, Homo Sapiens
NSASVHHNK

SEQ ID NO: 930798 - protein, 9 aa, Homo Sapiens
KTENCDCTP

SEQ ID NO: 930799 - protein, 9 aa, Homo Sapiens
LSGIHHFAR

SEQ ID NO: 930800 - protein, 9 aa, Homo Sapiens
SAFMKPRYH

SEQ ID NO: 930801 - protein, 9 aa, Homo Sapiens
RTVQKSCPS

SEQ ID NO: 930802 - protein, 9 aa, Homo Sapiens
MGVEGLLQN

SEQ ID NO: 930803 - protein, 9 aa, Homo Sapiens
LVLMAYDRY

SEQ ID NO: 930804 - protein, 9 aa, Homo Sapiens
EQTLSPRSP

SEQ ID NO: 930805 - protein, 9 aa, Homo Sapiens
EGAKPEVGE

SEQ ID NO: 930806 - protein, 9 aa, Homo Sapiens
ADLTIQARQ

SEQ ID NO: 930807 - protein, 9 aa, Homo Sapiens
FGLCAALYW

SEQ ID NO: 930808 - protein, 9 aa, Homo Sapiens
KDIDLFPQM

SEQ ID NO: 930809 - protein, 9 aa, Homo Sapiens
IGIYEPKYI

SEQ ID NO: 930810 - protein, 9 aa, Homo Sapiens
EVDRTITRG

SEQ ID NO: 930811 - protein, 9 aa, Homo Sapiens
SSESMHKIW

SEQ ID NO: 930812 - protein, 9 aa, Homo Sapiens
EGLQSQTQF

SEQ ID NO: 930813 - protein, 9 aa, Homo Sapiens
HCADMYLEN

SEQ ID NO: 930814 - protein, 9 aa, Homo Sapiens
LSGSEGTPA

SEQ ID NO: 930815 - protein, 9 aa, Homo Sapiens
TINGEAFPA

SEQ ID NO: 930816 - protein, 9 aa, Homo Sapiens
SQRTVQKSC

SEQ ID NO: 930817 - protein, 9 aa, Homo Sapiens
FEIFDLNSL

SEQ ID NO: 930818 - protein, 9 aa, Homo Sapiens
SSTMANNKG

SEQ ID NO: 930819 - protein, 9 aa, Homo Sapiens
RSTEEEERL

SEQ ID NO: 930820 - protein, 9 aa, Homo Sapiens
CTVSILIAI

SEQ ID NO: 930821 - protein, 9 aa, Homo Sapiens
KPEVGEKKE

SEQ ID NO: 930822 - protein, 9 aa, Homo Sapiens
SLSNINFYA

SEQ ID NO: 930823 - protein, 9 aa, Homo Sapiens
QRTVQKSCP

SEQ ID NO: 930824 - protein, 9 aa, Homo Sapiens
AQTTLLKFT

SEQ ID NO: 930825 - protein, 9 aa, Homo Sapiens
QFPLLPPWN

SEQ ID NO: 930826 - protein, 9 aa, Homo Sapiens
SQGDDVVTC

SEQ ID NO: 930827 - protein, 9 aa, Homo Sapiens
SLSGIHHFA

SEQ ID NO: 930828 - protein, 9 aa, Homo Sapiens
EWKRERAFQ

SEQ ID NO: 930829 - protein, 9 aa, Homo Sapiens
FEKFIRIHF

SEQ ID NO: 930830 - protein, 9 aa, Homo Sapiens
RLLKALKTR

SEQ ID NO: 930831 - protein, 9 aa, Homo Sapiens
EEVLTVKKI

SEQ ID NO: 930832 - protein, 9 aa, Homo Sapiens
FCFSQGTTS

SEQ ID NO: 930833 - protein, 9 aa, Homo Sapiens
QIQVFGHRT

SEQ ID NO: 930834 - protein, 9 aa, Homo Sapiens
NWLANAAVI

SEQ ID NO: 930835 - protein, 9 aa, Homo Sapiens
CQDYVHVVE

SEQ ID NO: 930836 - protein, 9 aa, Homo Sapiens
PTLPGLYRL

SEQ ID NO: 930837 - protein, 9 aa, Homo Sapiens
LLASLACLA

SEQ ID NO: 930838 - protein, 9 aa, Homo Sapiens
SPCTCRALK

SEQ ID NO: 930839 - protein, 9 aa, Homo Sapiens
LPGSAGISP

SEQ ID NO: 930840 - protein, 9 aa, Homo Sapiens
FMKPRYHVR

SEQ ID NO: 930841 - protein, 9 aa, Homo Sapiens
ELEIAANGI

SEQ ID NO: 930842 - protein, 9 aa, Homo Sapiens
DHEKEDDHD

SEQ ID NO: 930843 - protein, 9 aa, Homo Sapiens
EEILDLILD

SEQ ID NO: 930844 - protein, 9 aa, Homo Sapiens
NPLSTLSFH

SEQ ID NO: 930845 - protein, 9 aa, Homo Sapiens
EPKISLSGI

SEQ ID NO: 930846 - protein, 9 aa, Homo Sapiens
RTRDKKGSN

SEQ ID NO: 930847 - protein, 9 aa, Homo Sapiens
VKELTLFSL

SEQ ID NO: 930848 - protein, 9 aa, Homo Sapiens
GMVEATAIT

SEQ ID NO: 930849 - protein, 9 aa, Homo Sapiens
YIRTTFFYH

SEQ ID NO: 930850 - protein, 9 aa, Homo Sapiens
GRGTSASCP

SEQ ID NO: 930851 - protein, 9 aa, Homo Sapiens
GRIIKIHCA

SEQ ID NO: 930852 - protein, 9 aa, Homo Sapiens
VSKGVEPLE

SEQ ID NO: 930853 - protein, 9 aa, Homo Sapiens
INEKTTPPV

SEQ ID NO: 930854 - protein, 9 aa, Homo Sapiens
ICNAFFCPA

SEQ ID NO: 930855 - protein, 9 aa, Homo Sapiens
RIQESGDQD

SEQ ID NO: 930856 - protein, 9 aa, Homo Sapiens
ELPTSFFPV

SEQ ID NO: 930857 - protein, 9 aa, Homo Sapiens
EEGAKPEVG

SEQ ID NO: 930858 - protein, 9 aa, Homo Sapiens
CKCRPGMFC

SEQ ID NO: 930859 - protein, 9 aa, Homo Sapiens
NYYKINWTT

SEQ ID NO: 930860 - protein, 9 aa, Homo Sapiens
EAKSYLKDD

SEQ ID NO: 930861 - protein, 9 aa, Homo Sapiens
TTVISSSKQ

SEQ ID NO: 930862 - protein, 9 aa, Homo Sapiens
VVLTINGEA

SEQ ID NO: 930863 - protein, 9 aa, Homo Sapiens
TVISSSKQN

SEQ ID NO: 930864 - protein, 9 aa, Homo Sapiens
AYEIWRSDL

SEQ ID NO: 930865 - protein, 9 aa, Homo Sapiens
YQLQQKLEQ

SEQ ID NO: 930866 - protein, 9 aa, Homo Sapiens
WEPKNTDYA

SEQ ID NO: 930867 - protein, 9 aa, Homo Sapiens
CDSDVGYIR

SEQ ID NO: 930868 - protein, 9 aa, Homo Sapiens
KSKKKKKKF

SEQ ID NO: 930869 - protein, 9 aa, Homo Sapiens
NSSRFEKFI

SEQ ID NO: 930870 - protein, 9 aa, Homo Sapiens
DVLCKIVIF

SEQ ID NO: 930871 - protein, 9 aa, Homo Sapiens
PTSFFPVEY

SEQ ID NO: 930872 - protein, 9 aa, Homo Sapiens
RPCQSYNEK

SEQ ID NO: 930873 - protein, 9 aa, Homo Sapiens
EIKPILVFD

SEQ ID NO: 930874 - protein, 9 aa, Homo Sapiens
HCHSGIEWV

SEQ ID NO: 930875 - protein, 9 aa, Homo Sapiens
SYVKLCHLL

SEQ ID NO: 930876 - protein, 9 aa, Homo Sapiens
MSLPSQQTA

SEQ ID NO: 930877 - protein, 9 aa, Homo Sapiens
AMHGGGCSP

SEQ ID NO: 930878 - protein, 9 aa, Homo Sapiens
ITYKNNAYL

SEQ ID NO: 930879 - protein, 9 aa, Homo Sapiens
LILLASTVL

SEQ ID NO: 930880 - protein, 9 aa, Homo Sapiens
SLKEKVNLQ

SEQ ID NO: 930881 - protein, 9 aa, Homo Sapiens
KHISRCIGD

SEQ ID NO: 930882 - protein, 9 aa, Homo Sapiens
DSSLISSFR

SEQ ID NO: 930883 - protein, 9 aa, Homo Sapiens
STEEEERLE

SEQ ID NO: 930884 - protein, 9 aa, Homo Sapiens
LSNSTIEEI

SEQ ID NO: 930885 - protein, 9 aa, Homo Sapiens
WPSNCWEPK

SEQ ID NO: 930886 - protein, 9 aa, Homo Sapiens
VFQGAGKAA

SEQ ID NO: 930887 - protein, 9 aa, Homo Sapiens
SVATTGVDL

SEQ ID NO: 930888 - protein, 9 aa, Homo Sapiens
AACGALLFG

SEQ ID NO: 930889 - protein, 9 aa, Homo Sapiens
EVLHLDEDE

SEQ ID NO: 930890 - protein, 9 aa, Homo Sapiens
LQKCDILEL

SEQ ID NO: 930891 - protein, 9 aa, Homo Sapiens
VGDGGGAPP

SEQ ID NO: 930892 - protein, 9 aa, Homo Sapiens
AWALKHISR

SEQ ID NO: 930893 - protein, 9 aa, Homo Sapiens
RSGPAGPPG

SEQ ID NO: 930894 - protein, 9 aa, Homo Sapiens
RANLAKELK

SEQ ID NO: 930895 - protein, 9 aa, Homo Sapiens
HWQAPRQGW

SEQ ID NO: 930896 - protein, 9 aa, Homo Sapiens
SAKDRKDVK

SEQ ID NO: 930897 - protein, 9 aa, Homo Sapiens
KSYLKDDRS

SEQ ID NO: 930898 - protein, 9 aa, Homo Sapiens
PQLLINLCE

SEQ ID NO: 930899 - protein, 9 aa, Homo Sapiens
AHLPPPGTP

SEQ ID NO: 930900 - protein, 9 aa, Homo Sapiens
ALGKAMHGG

SEQ ID NO: 930901 - protein, 9 aa, Homo Sapiens
KKIIDANYF

SEQ ID NO: 930902 - protein, 9 aa, Homo Sapiens
AGKRVVSLE

SEQ ID NO: 930903 - protein, 9 aa, Homo Sapiens
YTGGKPYEC

SEQ ID NO: 930904 - protein, 9 aa, Homo Sapiens
ENLLRKEKE

SEQ ID NO: 930905 - protein, 9 aa, Homo Sapiens
SEHIPLEKF

SEQ ID NO: 930906 - protein, 9 aa, Homo Sapiens
FFFLLLLVW

SEQ ID NO: 930907 - protein, 9 aa, Homo Sapiens
FDQNEKRIN

SEQ ID NO: 930908 - protein, 9 aa, Homo Sapiens
LKEKVNLQK

SEQ ID NO: 930909 - protein, 9 aa, Homo Sapiens
FLSPIKDII

SEQ ID NO: 930910 - protein, 9 aa, Homo Sapiens
IVECKMNNI

SEQ ID NO: 930911 - protein, 9 aa, Homo Sapiens
PDKKKKFQT

SEQ ID NO: 930912 - protein, 9 aa, Homo Sapiens
KNFLCYVLL

SEQ ID NO: 930913 - protein, 9 aa, Homo Sapiens
NPSSLSNIN

SEQ ID NO: 930914 - protein, 9 aa, Homo Sapiens
LVSQKEWKR

SEQ ID NO: 930915 - protein, 9 aa, Homo Sapiens
WNSSRVCKC

SEQ ID NO: 930916 - protein, 9 aa, Homo Sapiens
MRGTIFREH

SEQ ID NO: 930917 - protein, 9 aa, Homo Sapiens
GTAVFRYNL

SEQ ID NO: 930918 - protein, 9 aa, Homo Sapiens
YYDVDARVP

SEQ ID NO: 930919 - protein, 9 aa, Homo Sapiens
EDEEEEEEK

SEQ ID NO: 930920 - protein, 9 aa, Homo Sapiens
KNNAYLLQG

SEQ ID NO: 930921 - protein, 9 aa, Homo Sapiens
VEATAITTQ

SEQ ID NO: 930922 - protein, 9 aa, Homo Sapiens
IFIDYYNMF

SEQ ID NO: 930923 - protein, 9 aa, Homo Sapiens
LTTVISSSK

SEQ ID NO: 930924 - protein, 9 aa, Homo Sapiens
QPAKKLDAG

SEQ ID NO: 930925 - protein, 9 aa, Homo Sapiens
TGLIALVCT

SEQ ID NO: 930926 - protein, 9 aa, Homo Sapiens
LSVATTGVD

SEQ ID NO: 930927 - protein, 9 aa, Homo Sapiens
MKPRYHVRR

SEQ ID NO: 930928 - protein, 9 aa, Homo Sapiens
SMFPYPDFF

SEQ ID NO: 930929 - protein, 9 aa, Homo Sapiens
PLDHEKLEL

SEQ ID NO: 930930 - protein, 9 aa, Homo Sapiens
ASCSQRADF

SEQ ID NO: 930931 - protein, 9 aa, Homo Sapiens
LPLLIAVIV

SEQ ID NO: 930932 - protein, 9 aa, Homo Sapiens
TLPAETTGS

SEQ ID NO: 930933 - protein, 9 aa, Homo Sapiens
WEERYGVQE

SEQ ID NO: 930934 - protein, 9 aa, Homo Sapiens
MKGLNSFER

SEQ ID NO: 930935 - protein, 9 aa, Homo Sapiens
RIIKIHCAD

SEQ ID NO: 930936 - protein, 9 aa, Homo Sapiens
LAKELKKFS

SEQ ID NO: 930937 - protein, 9 aa, Homo Sapiens
SIEEILDLI

SEQ ID NO: 930938 - protein, 9 aa, Homo Sapiens
AKTKPGEEQ

SEQ ID NO: 930939 - protein, 9 aa, Homo Sapiens
SKGVEPLEA

SEQ ID NO: 930940 - protein, 9 aa, Homo Sapiens
TYAIRSRLI

SEQ ID NO: 930941 - protein, 9 aa, Homo Sapiens
EKETFKKKD

SEQ ID NO: 930942 - protein, 9 aa, Homo Sapiens
VSSLMENLL

SEQ ID NO: 930943 - protein, 9 aa, Homo Sapiens
EHLLGDAEV

SEQ ID NO: 930944 - protein, 9 aa, Homo Sapiens
LIQPAKKLD

SEQ ID NO: 930945 - protein, 9 aa, Homo Sapiens
FTLFNYYKI

SEQ ID NO: 930946 - protein, 9 aa, Homo Sapiens
KFLSPIKDI

SEQ ID NO: 930947 - protein, 9 aa, Homo Sapiens
CKIVIFIDY

SEQ ID NO: 930948 - protein, 9 aa, Homo Sapiens
GAGKAAMGI

SEQ ID NO: 930949 - protein, 9 aa, Homo Sapiens
ASCPRPPLP

SEQ ID NO: 930950 - protein, 9 aa, Homo Sapiens
NLAKELKKF

SEQ ID NO: 930951 - protein, 9 aa, Homo Sapiens
SQDEVSKGV

SEQ ID NO: 930952 - protein, 9 aa, Homo Sapiens
DVLKIYDEK

SEQ ID NO: 930953 - protein, 9 aa, Homo Sapiens
MRRDLVLGF

SEQ ID NO: 930954 - protein, 9 aa, Homo Sapiens
PAKKLDAGW

SEQ ID NO: 930955 - protein, 9 aa, Homo Sapiens
DKKGSNYSQ

SEQ ID NO: 930956 - protein, 9 aa, Homo Sapiens
SQQTAIIVN

SEQ ID NO: 930957 - protein, 9 aa, Homo Sapiens
PSSLLIDIK

SEQ ID NO: 930958 - protein, 9 aa, Homo Sapiens
RRYFLNEGE

SEQ ID NO: 930959 - protein, 9 aa, Homo Sapiens
GLADGAHSL

SEQ ID NO: 930960 - protein, 9 aa, Homo Sapiens
SPEYSSESM

SEQ ID NO: 930961 - protein, 9 aa, Homo Sapiens
DIDLFPQMA

SEQ ID NO: 930962 - protein, 9 aa, Homo Sapiens
GSDLFGTLD

SEQ ID NO: 930963 - protein, 9 aa, Homo Sapiens
RTTFFYHEY

SEQ ID NO: 930964 - protein, 9 aa, Homo Sapiens
SYKRSIIKC

SEQ ID NO: 930965 - protein, 9 aa, Homo Sapiens
GVEGLLQNS

SEQ ID NO: 930966 - protein, 9 aa, Homo Sapiens
DHEKLELLQ

SEQ ID NO: 930967 - protein, 9 aa, Homo Sapiens
TDKNSLFSL

SEQ ID NO: 930968 - protein, 9 aa, Homo Sapiens
DAEVFLLVV

SEQ ID NO: 930969 - protein, 9 aa, Homo Sapiens
RPRGPPPLP

SEQ ID NO: 930970 - protein, 9 aa, Homo Sapiens
SSKNFLCYV

SEQ ID NO: 930971 - protein, 9 aa, Homo Sapiens
DVVTCSCQD

SEQ ID NO: 930972 - protein, 9 aa, Homo Sapiens
NLQVALAQI

SEQ ID NO: 930973 - protein, 9 aa, Homo Sapiens
DKKKKFQTK

SEQ ID NO: 930974 - protein, 9 aa, Homo Sapiens
PLSTLSFHL

SEQ ID NO: 930975 - protein, 9 aa, Homo Sapiens
TWEEGLVLS

SEQ ID NO: 930976 - protein, 9 aa, Homo Sapiens
LLKFTVTED

SEQ ID NO: 930977 - protein, 9 aa, Homo Sapiens
GILGPQGLP

SEQ ID NO: 930978 - protein, 9 aa, Homo Sapiens
GAACGALLF

SEQ ID NO: 930979 - protein, 9 aa, Homo Sapiens
VFRYNLFAS

SEQ ID NO: 930980 - protein, 9 aa, Homo Sapiens
AITTQARSS

SEQ ID NO: 930981 - protein, 9 aa, Homo Sapiens
KNGRRGKNE

SEQ ID NO: 930982 - protein, 9 aa, Homo Sapiens
SFDEFMVSY

SEQ ID NO: 930983 - protein, 9 aa, Homo Sapiens
DSWPSAVCG

SEQ ID NO: 930984 - protein, 9 aa, Homo Sapiens
GGQCNKKTE

SEQ ID NO: 930985 - protein, 9 aa, Homo Sapiens
RENYSYLKQ

SEQ ID NO: 930986 - protein, 9 aa, Homo Sapiens
IRSRLIHVP

SEQ ID NO: 930987 - protein, 9 aa, Homo Sapiens
TYKNNAYLL

SEQ ID NO: 930988 - protein, 9 aa, Homo Sapiens
TTLLKFTVT

SEQ ID NO: 930989 - protein, 9 aa, Homo Sapiens
LNLWISRIQ

SEQ ID NO: 930990 - protein, 9 aa, Homo Sapiens
SPLFFCFSQ

SEQ ID NO: 930991 - protein, 9 aa, Homo Sapiens
QIMITSHFP

SEQ ID NO: 930992 - protein, 9 aa, Homo Sapiens
DILVVFMKD

SEQ ID NO: 930993 - protein, 9 aa, Homo Sapiens
KTKPGEEQY

SEQ ID NO: 930994 - protein, 9 aa, Homo Sapiens
TFKKKDTYK

SEQ ID NO: 930995 - protein, 9 aa, Homo Sapiens
YTANPLSVA

SEQ ID NO: 930996 - protein, 9 aa, Homo Sapiens
REYDIIVCK

SEQ ID NO: 930997 - protein, 9 aa, Homo Sapiens
CGLVHTQLL

SEQ ID NO: 930998 - protein, 9 aa, Homo Sapiens
DLPSPRADT

SEQ ID NO: 930999 - protein, 9 aa, Homo Sapiens
GLNSFERDS

SEQ ID NO: 931000 - protein, 9 aa, Homo Sapiens
LEKQDKLAS

SEQ ID NO: 931001 - protein, 9 aa, Homo Sapiens
ALSFEFVMK

SEQ ID NO: 931002 - protein, 9 aa, Homo Sapiens
ISLSGIHHF

SEQ ID NO: 931003 - protein, 9 aa, Homo Sapiens
GRDESPGGK

SEQ ID NO: 931004 - protein, 9 aa, Homo Sapiens
LTKEYCLEY

SEQ ID NO: 931005 - protein, 9 aa, Homo Sapiens
ELKKFSKVT

SEQ ID NO: 931006 - protein, 9 aa, Homo Sapiens
GFSLQPAPP

SEQ ID NO: 931007 - protein, 9 aa, Homo Sapiens
QRADFIKPG

SEQ ID NO: 931008 - protein, 9 aa, Homo Sapiens
YLKDDRSRL

SEQ ID NO: 931009 - protein, 9 aa, Homo Sapiens
AKSYLKDDR

SEQ ID NO: 931010 - protein, 9 aa, Homo Sapiens
MAHLPPPGT

SEQ ID NO: 931011 - protein, 9 aa, Homo Sapiens
VDEKMIVEC

SEQ ID NO: 931012 - protein, 9 aa, Homo Sapiens
ETCVHCFGD

SEQ ID NO: 931013 - protein, 9 aa, Homo Sapiens
KLYSSKNFL

SEQ ID NO: 931014 - protein, 9 aa, Homo Sapiens
TLSNSTIEE

SEQ ID NO: 931015 - protein, 9 aa, Homo Sapiens
VVSLEPLKD

SEQ ID NO: 931016 - protein, 9 aa, Homo Sapiens
YVKLCHLLA

SEQ ID NO: 931017 - protein, 9 aa, Homo Sapiens
KSKFKDEPL

SEQ ID NO: 931018 - protein, 9 aa, Homo Sapiens
DEKMIVECK

SEQ ID NO: 931019 - protein, 9 aa, Homo Sapiens
VLLVLMAYD

SEQ ID NO: 931020 - protein, 9 aa, Homo Sapiens
ILGPQGLPG

SEQ ID NO: 931021 - protein, 9 aa, Homo Sapiens
HSLADAPLG

SEQ ID NO: 931022 - protein, 9 aa, Homo Sapiens
EEIDIMAIK

SEQ ID NO: 931023 - protein, 9 aa, Homo Sapiens
KIVDEKMIV

SEQ ID NO: 931024 - protein, 9 aa, Homo Sapiens
TVDCQDYVH

SEQ ID NO: 931025 - protein, 9 aa, Homo Sapiens
LMENLLIVL

SEQ ID NO: 931026 - protein, 9 aa, Homo Sapiens
DLNSLEQLC

SEQ ID NO: 931027 - protein, 9 aa, Homo Sapiens
AALGKAMHG

SEQ ID NO: 931028 - protein, 9 aa, Homo Sapiens
EYSSESMHK

SEQ ID NO: 931029 - protein, 9 aa, Homo Sapiens
YKNNAYLLQ

SEQ ID NO: 931030 - protein, 9 aa, Homo Sapiens
EHPSVSEIS

SEQ ID NO: 931031 - protein, 9 aa, Homo Sapiens
VSSKGSDLF

SEQ ID NO: 931032 - protein, 9 aa, Homo Sapiens
ELFGESHSD

SEQ ID NO: 931033 - protein, 9 aa, Homo Sapiens
DCQDYVHVV

SEQ ID NO: 931034 - protein, 9 aa, Homo Sapiens
TSPPSVLFT

SEQ ID NO: 931035 - protein, 9 aa, Homo Sapiens
SYFGRHGCK

SEQ ID NO: 931036 - protein, 9 aa, Homo Sapiens
VVLVFFFLL

SEQ ID NO: 931037 - protein, 9 aa, Homo Sapiens
SLHLHRMSL

SEQ ID NO: 931038 - protein, 9 aa, Homo Sapiens
GAHSLADAP

SEQ ID NO: 931039 - protein, 9 aa, Homo Sapiens
MTHCHSGIE

SEQ ID NO: 931040 - protein, 9 aa, Homo Sapiens
PWIAFYSVL

SEQ ID NO: 931041 - protein, 9 aa, Homo Sapiens
QLQQKLEQQ

SEQ ID NO: 931042 - protein, 9 aa, Homo Sapiens
FSVFISLPA

SEQ ID NO: 931043 - protein, 9 aa, Homo Sapiens
KLEWDMKIN

SEQ ID NO: 931044 - protein, 9 aa, Homo Sapiens
WLPTLPGLY

SEQ ID NO: 931045 - protein, 9 aa, Homo Sapiens
CKNSKPGQV

SEQ ID NO: 931046 - protein, 9 aa, Homo Sapiens
KQNSLDEQH

SEQ ID NO: 931047 - protein, 9 aa, Homo Sapiens
LPENLLRKE

SEQ ID NO: 931048 - protein, 9 aa, Homo Sapiens
PRPRGPPPL

SEQ ID NO: 931049 - protein, 9 aa, Homo Sapiens
HSGIEWVWL

SEQ ID NO: 931050 - protein, 9 aa, Homo Sapiens
VCKNSKPGQ

SEQ ID NO: 931051 - protein, 9 aa, Homo Sapiens
KGLNSFERD

SEQ ID NO: 931052 - protein, 9 aa, Homo Sapiens
LFGESHSDD

SEQ ID NO: 931053 - protein, 9 aa, Homo Sapiens
KGGKNGRRG

SEQ ID NO: 931054 - protein, 9 aa, Homo Sapiens
SITKSILIL

SEQ ID NO: 931055 - protein, 9 aa, Homo Sapiens
QQTAIIVNP

SEQ ID NO: 931056 - protein, 9 aa, Homo Sapiens
HIPLEKFYN

SEQ ID NO: 931057 - protein, 9 aa, Homo Sapiens
LLVLMAYDR

SEQ ID NO: 931058 - protein, 9 aa, Homo Sapiens
KVTQSSTIY

SEQ ID NO: 931059 - protein, 9 aa, Homo Sapiens
NEIINQYRV

SEQ ID NO: 931060 - protein, 9 aa, Homo Sapiens
KKPRQPNEI

SEQ ID NO: 931061 - protein, 9 aa, Homo Sapiens
PSAQYPPPP

SEQ ID NO: 931062 - protein, 9 aa, Homo Sapiens
RVVSLEPLK

SEQ ID NO: 931063 - protein, 9 aa, Homo Sapiens
WIDYRLNAL

SEQ ID NO: 931064 - protein, 9 aa, Homo Sapiens
ISSSKQNLW

SEQ ID NO: 931065 - protein, 9 aa, Homo Sapiens
FREHPWEVM

SEQ ID NO: 931066 - protein, 9 aa, Homo Sapiens
ERTHTGEKS

SEQ ID NO: 931067 - protein, 9 aa, Homo Sapiens
SKNFLCYVL

SEQ ID NO: 931068 - protein, 9 aa, Homo Sapiens
RFDQKFLSP

SEQ ID NO: 931069 - protein, 9 aa, Homo Sapiens
LEKFYNNRA

SEQ ID NO: 931070 - protein, 9 aa, Homo Sapiens
KFFTYDFVF

SEQ ID NO: 931071 - protein, 9 aa, Homo Sapiens
KNVTVEIMY

SEQ ID NO: 931072 - protein, 9 aa, Homo Sapiens
KGVEPLEAA

SEQ ID NO: 931073 - protein, 9 aa, Homo Sapiens
LPSPRADTL

SEQ ID NO: 931074 - protein, 9 aa, Homo Sapiens
VLRMRGTIF

SEQ ID NO: 931075 - protein, 9 aa, Homo Sapiens
KISLSGIHH

SEQ ID NO: 931076 - protein, 9 aa, Homo Sapiens
RAEPLLLVC

SEQ ID NO: 931077 - protein, 9 aa, Homo Sapiens
HILEYATKI

SEQ ID NO: 931078 - protein, 9 aa, Homo Sapiens
GGEMVLLVL

SEQ ID NO: 931079 - protein, 9 aa, Homo Sapiens
RDESPGGKG

SEQ ID NO: 931080 - protein, 9 aa, Homo Sapiens
KFDQNEKRI

SEQ ID NO: 931081 - protein, 9 aa, Homo Sapiens
QEVVLVFFF

SEQ ID NO: 931082 - protein, 9 aa, Homo Sapiens
RPSSLLIDI

SEQ ID NO: 931083 - protein, 9 aa, Homo Sapiens
IKYYKQNSL

SEQ ID NO: 931084 - protein, 9 aa, Homo Sapiens
GGKNGRRGK

SEQ ID NO: 931085 - protein, 9 aa, Homo Sapiens
TEDFFKLEW

SEQ ID NO: 931086 - protein, 9 aa, Homo Sapiens
KVGPPGDSG

SEQ ID NO: 931087 - protein, 9 aa, Homo Sapiens
SDSLDEARL

SEQ ID NO: 931088 - protein, 9 aa, Homo Sapiens
NYYDVDARV

SEQ ID NO: 931089 - protein, 9 aa, Homo Sapiens
ADGAHSLAD

SEQ ID NO: 931090 - protein, 9 aa, Homo Sapiens
LKIYDEKDK

SEQ ID NO: 931091 - protein, 9 aa, Homo Sapiens
QKSCPSCAL

SEQ ID NO: 931092 - protein, 9 aa, Homo Sapiens
EQEKQREIK

SEQ ID NO: 931093 - protein, 9 aa, Homo Sapiens
LLYRFDQKF

SEQ ID NO: 931094 - protein, 9 aa, Homo Sapiens
TANWLANAA

SEQ ID NO: 931095 - protein, 9 aa, Homo Sapiens
LGCVVFSVF

SEQ ID NO: 931096 - protein, 9 aa, Homo Sapiens
FNYYKINWT

SEQ ID NO: 931097 - protein, 9 aa, Homo Sapiens
CWEPKNTDY

SEQ ID NO: 931098 - protein, 9 aa, Homo Sapiens
QSSTIYDVK

SEQ ID NO: 931099 - protein, 9 aa, Homo Sapiens
QNSLDEQHI

SEQ ID NO: 931100 - protein, 9 aa, Homo Sapiens
FVIRHVDLP

SEQ ID NO: 931101 - protein, 9 aa, Homo Sapiens
LCKIVIFID

SEQ ID NO: 931102 - protein, 9 aa, Homo Sapiens
NYYATLLPL

SEQ ID NO: 931103 - protein, 9 aa, Homo Sapiens
MPAKRRYFL

SEQ ID NO: 931104 - protein, 9 aa, Homo Sapiens
LVSITKSIL

SEQ ID NO: 931105 - protein, 9 aa, Homo Sapiens
EGMVEATAI

SEQ ID NO: 931106 - protein, 9 aa, Homo Sapiens
EAGLQIMIT

SEQ ID NO: 931107 - protein, 9 aa, Homo Sapiens
LFGTLDPFG

SEQ ID NO: 931108 - protein, 9 aa, Homo Sapiens
SHEIKPILV

SEQ ID NO: 931109 - protein, 9 aa, Homo Sapiens
VGCKEMPTS

SEQ ID NO: 931110 - protein, 9 aa, Homo Sapiens
KKLDAGWYT

SEQ ID NO: 931111 - protein, 9 aa, Homo Sapiens
LQAEVLHLD

SEQ ID NO: 931112 - protein, 9 aa, Homo Sapiens
KINWTTGTA

SEQ ID NO: 931113 - protein, 9 aa, Homo Sapiens
RHRFDPFCW

SEQ ID NO: 931114 - protein, 9 aa, Homo Sapiens
SLDEARLSG

SEQ ID NO: 931115 - protein, 9 aa, Homo Sapiens
LRMRGTIFR

SEQ ID NO: 931116 - protein, 9 aa, Homo Sapiens
ESRRPSSLL

SEQ ID NO: 931117 - protein, 9 aa, Homo Sapiens
TGRLAVRAT

SEQ ID NO: 931118 - protein, 9 aa, Homo Sapiens
LEAKSYLKD

SEQ ID NO: 931119 - protein, 9 aa, Homo Sapiens
ANNKGLFSL

SEQ ID NO: 931120 - protein, 9 aa, Homo Sapiens
CEVDRTITR

SEQ ID NO: 931121 - protein, 9 aa, Homo Sapiens
KNTDYAVYL

SEQ ID NO: 931122 - protein, 9 aa, Homo Sapiens
KGQEGQDHE

SEQ ID NO: 931123 - protein, 9 aa, Homo Sapiens
GDGGGAPPQ

SEQ ID NO: 931124 - protein, 9 aa, Homo Sapiens
PAKRRYFLN

SEQ ID NO: 931125 - protein, 9 aa, Homo Sapiens
QPHSADLTI

SEQ ID NO: 931126 - protein, 9 aa, Homo Sapiens
EFLQFPLLP

SEQ ID NO: 931127 - protein, 9 aa, Homo Sapiens
EIKQQQRKS

SEQ ID NO: 931128 - protein, 9 aa, Homo Sapiens
NEALFDVVS

SEQ ID NO: 931129 - protein, 9 aa, Homo Sapiens
AIRSRLIHV

SEQ ID NO: 931130 - protein, 9 aa, Homo Sapiens
KRERAFQIT

SEQ ID NO: 931131 - protein, 9 aa, Homo Sapiens
GKNGRRGKN

SEQ ID NO: 931132 - protein, 9 aa, Homo Sapiens
AGLQIMITS

SEQ ID NO: 931133 - protein, 9 aa, Homo Sapiens
KVINEKTTP

SEQ ID NO: 931134 - protein, 9 aa, Homo Sapiens
GLGEMPGFF

SEQ ID NO: 931135 - protein, 9 aa, Homo Sapiens
AVINPGAIY

SEQ ID NO: 931136 - protein, 9 aa, Homo Sapiens
PLFLLFLRI

SEQ ID NO: 931137 - protein, 9 aa, Homo Sapiens
YDDSAFMKP

SEQ ID NO: 931138 - protein, 9 aa, Homo Sapiens
LEKSKFKDE

SEQ ID NO: 931139 - protein, 9 aa, Homo Sapiens
FYHEYPWIL

SEQ ID NO: 931140 - protein, 9 aa, Homo Sapiens
VCKCRPGMF

SEQ ID NO: 931141 - protein, 9 aa, Homo Sapiens
VISSSKQNL

SEQ ID NO: 931142 - protein, 9 aa, Homo Sapiens
LPLFLLFLR

SEQ ID NO: 931143 - protein, 9 aa, Homo Sapiens
KELKKFSKV

SEQ ID NO: 931144 - protein, 9 aa, Homo Sapiens
SAFGFSLQP

SEQ ID NO: 931145 - protein, 9 aa, Homo Sapiens
SPDVSYKRS

SEQ ID NO: 931146 - protein, 9 aa, Homo Sapiens
EDDTVGCKE

SEQ ID NO: 931147 - protein, 9 aa, Homo Sapiens
MALDVKNKE

SEQ ID NO: 931148 - protein, 9 aa, Homo Sapiens
RCFYNLDGD

SEQ ID NO: 931149 - protein, 9 aa, Homo Sapiens
AVAWALKHI

SEQ ID NO: 931150 - protein, 9 aa, Homo Sapiens
VKSAKDRKD

SEQ ID NO: 931151 - protein, 9 aa, Homo Sapiens
EKQREIKQQ

SEQ ID NO: 931152 - protein, 9 aa, Homo Sapiens
YKINWTTGT

SEQ ID NO: 931153 - protein, 9 aa, Homo Sapiens
EKSKFKDEP

SEQ ID NO: 931154 - protein, 9 aa, Homo Sapiens
WLVSQKEWK

SEQ ID NO: 931155 - protein, 9 aa, Homo Sapiens
GLATMKSRW

SEQ ID NO: 931156 - protein, 9 aa, Homo Sapiens
KSDLKSQVE

SEQ ID NO: 931157 - protein, 9 aa, Homo Sapiens
SSRVCKCRP

SEQ ID NO: 931158 - protein, 9 aa, Homo Sapiens
SDGLPGRDE

SEQ ID NO: 931159 - protein, 9 aa, Homo Sapiens
VIFIDYYNM

SEQ ID NO: 931160 - protein, 9 aa, Homo Sapiens
DGLPGRDES

SEQ ID NO: 931161 - protein, 9 aa, Homo Sapiens
PASAPQVCL

SEQ ID NO: 931162 - protein, 9 aa, Homo Sapiens
KKKKKKFSN

SEQ ID NO: 931163 - protein, 9 aa, Homo Sapiens
VVTGIRGRS

SEQ ID NO: 931164 - protein, 9 aa, Homo Sapiens
FSLQPAPPQ

SEQ ID NO: 931165 - protein, 9 aa, Homo Sapiens
PCTCRALKT

SEQ ID NO: 931166 - protein, 9 aa, Homo Sapiens
NLCEVDRTI

SEQ ID NO: 931167 - protein, 9 aa, Homo Sapiens
STVNRENYS

SEQ ID NO: 931168 - protein, 9 aa, Homo Sapiens
EYATKISNL

SEQ ID NO: 931169 - protein, 9 aa, Homo Sapiens
DVKNKELIG

SEQ ID NO: 931170 - protein, 9 aa, Homo Sapiens
DSLDEARLS

SEQ ID NO: 931171 - protein, 9 aa, Homo Sapiens
YNEKQVYKE

SEQ ID NO: 931172 - protein, 9 aa, Homo Sapiens
TMKSRWSGS

SEQ ID NO: 931173 - protein, 9 aa, Homo Sapiens
QLLINLCEV

SEQ ID NO: 931174 - protein, 9 aa, Homo Sapiens
GTSASCPRP

SEQ ID NO: 931175 - protein, 9 aa, Homo Sapiens
LEDDTVGCK

SEQ ID NO: 931176 - protein, 9 aa, Homo Sapiens
FNIRSVQSQ

SEQ ID NO: 931177 - protein, 9 aa, Homo Sapiens
LVFFFLLLL

SEQ ID NO: 931178 - protein, 9 aa, Homo Sapiens
DDVVTCSCQ

SEQ ID NO: 931179 - protein, 9 aa, Homo Sapiens
VEMRRDLVL

SEQ ID NO: 931180 - protein, 9 aa, Homo Sapiens
EMPGFFVPT

SEQ ID NO: 931181 - protein, 9 aa, Homo Sapiens
KGSNYSQSE

SEQ ID NO: 931182 - protein, 9 aa, Homo Sapiens
KSCPSCALQ

SEQ ID NO: 931183 - protein, 9 aa, Homo Sapiens
QVVVGTDKF

SEQ ID NO: 931184 - protein, 9 aa, Homo Sapiens
THQPLGFFG

SEQ ID NO: 931185 - protein, 9 aa, Homo Sapiens
ISRIQESGD

SEQ ID NO: 931186 - protein, 9 aa, Homo Sapiens
IQESGDQDP

SEQ ID NO: 931187 - protein, 9 aa, Homo Sapiens
TRNRCLNGA

SEQ ID NO: 931188 - protein, 9 aa, Homo Sapiens
AGISPPPPP

SEQ ID NO: 931189 - protein, 9 aa, Homo Sapiens
GLPGRDESP

SEQ ID NO: 931190 - protein, 9 aa, Homo Sapiens
FMKDSPEDK

SEQ ID NO: 931191 - protein, 9 aa, Homo Sapiens
KKFSKVTFD

SEQ ID NO: 931192 - protein, 9 aa, Homo Sapiens
SQMAKLNQL

SEQ ID NO: 931193 - protein, 9 aa, Homo Sapiens
TRSTEEEER

SEQ ID NO: 931194 - protein, 9 aa, Homo Sapiens
EVVLVFFFL

SEQ ID NO: 931195 - protein, 9 aa, Homo Sapiens
RWEERYGVQ

SEQ ID NO: 931196 - protein, 9 aa, Homo Sapiens
GSAGISPPP

SEQ ID NO: 931197 - protein, 9 aa, Homo Sapiens
NINFYAQVS

SEQ ID NO: 931198 - protein, 9 aa, Homo Sapiens
SGSQDEVSK

SEQ ID NO: 931199 - protein, 9 aa, Homo Sapiens
NVTVEIMYQ

SEQ ID NO: 931200 - protein, 9 aa, Homo Sapiens
VVDSWPSAV

SEQ ID NO: 931201 - protein, 9 aa, Homo Sapiens
GAPMAHLPP

SEQ ID NO: 931202 - protein, 9 aa, Homo Sapiens
KQQQRKSSS

SEQ ID NO: 931203 - protein, 9 aa, Homo Sapiens
TRSVVELEI

SEQ ID NO: 931204 - protein, 9 aa, Homo Sapiens
CYNISNEAL

SEQ ID NO: 931205 - protein, 9 aa, Homo Sapiens
CRGGVSHRS

SEQ ID NO: 931206 - protein, 9 aa, Homo Sapiens
WKRERAFQI

SEQ ID NO: 931207 - protein, 9 aa, Homo Sapiens
KSYVKLCHL

SEQ ID NO: 931208 - protein, 9 aa, Homo Sapiens
QQKLEQQKV

SEQ ID NO: 931209 - protein, 9 aa, Homo Sapiens
FSQGTTSQQ

SEQ ID NO: 931210 - protein, 9 aa, Homo Sapiens
AHSLADAPL

SEQ ID NO: 931211 - protein, 9 aa, Homo Sapiens
SEIKKSCAF

SEQ ID NO: 931212 - protein, 9 aa, Homo Sapiens
IQARQVDMK

SEQ ID NO: 931213 - protein, 9 aa, Homo Sapiens
SLISSFRLL

SEQ ID NO: 931214 - protein, 9 aa, Homo Sapiens
PASAFGFSL

SEQ ID NO: 931215 - protein, 9 aa, Homo Sapiens
PMAHLPPPG

SEQ ID NO: 931216 - protein, 9 aa, Homo Sapiens
NLLPRQRQY

SEQ ID NO: 931217 - protein, 9 aa, Homo Sapiens
RDLVLGFGF

SEQ ID NO: 931218 - protein, 9 aa, Homo Sapiens
SVVELEIAA

SEQ ID NO: 931219 - protein, 9 aa, Homo Sapiens
LQAQTTLLK

SEQ ID NO: 931220 - protein, 9 aa, Homo Sapiens
LDGDFLIVP

SEQ ID NO: 931221 - protein, 9 aa, Homo Sapiens
ALSTLPAET

SEQ ID NO: 931222 - protein, 9 aa, Homo Sapiens
RSVVELEIA

SEQ ID NO: 931223 - protein, 9 aa, Homo Sapiens
AFKGLKSLK

SEQ ID NO: 931224 - protein, 9 aa, Homo Sapiens
GQDHEKEDD

SEQ ID NO: 931225 - protein, 9 aa, Homo Sapiens
EFMVSYFGR

SEQ ID NO: 931226 - protein, 9 aa, Homo Sapiens
ADFIKPGDS

SEQ ID NO: 931227 - protein, 9 aa, Homo Sapiens
ALDVKNKEL

SEQ ID NO: 931228 - protein, 9 aa, Homo Sapiens
KKKKFQTKV

SEQ ID NO: 931229 - protein, 9 aa, Homo Sapiens
AVITALSFE

SEQ ID NO: 931230 - protein, 9 aa, Homo Sapiens
RALKTMGLW

SEQ ID NO: 931231 - protein, 9 aa, Homo Sapiens
FLLLLVWFL

SEQ ID NO: 931232 - protein, 9 aa, Homo Sapiens
RNSPDVSYK

SEQ ID NO: 931233 - protein, 9 aa, Homo Sapiens
SILILLAST

SEQ ID NO: 931234 - protein, 9 aa, Homo Sapiens
FYNLDGDFL

SEQ ID NO: 931235 - protein, 9 aa, Homo Sapiens
VVGTDKFFT

SEQ ID NO: 931236 - protein, 9 aa, Homo Sapiens
SPFSASTGH

SEQ ID NO: 931237 - protein, 9 aa, Homo Sapiens
RGTIFREHP

SEQ ID NO: 931238 - protein, 9 aa, Homo Sapiens
TPLPVTSPF

SEQ ID NO: 931239 - protein, 9 aa, Homo Sapiens
LLSHEIKPI

SEQ ID NO: 931240 - protein, 9 aa, Homo Sapiens
LPTLPGLYR

SEQ ID NO: 931241 - protein, 9 aa, Homo Sapiens
TVIKPHPQV

SEQ ID NO: 931242 - protein, 9 aa, Homo Sapiens
RADFIKPGD

SEQ ID NO: 931243 - protein, 9 aa, Homo Sapiens
NGEAFPAHK

SEQ ID NO: 931244 - protein, 9 aa, Homo Sapiens
WLAPDSFCW

SEQ ID NO: 931245 - protein, 9 aa, Homo Sapiens
PLLLVCINA

SEQ ID NO: 931246 - protein, 9 aa, Homo Sapiens
ENLTKEYCL

SEQ ID NO: 931247 - protein, 9 aa, Homo Sapiens
SLELDKKII

SEQ ID NO: 931248 - protein, 9 aa, Homo Sapiens
LGFFGVVST

SEQ ID NO: 931249 - protein, 9 aa, Homo Sapiens
GIRGRSGPA

SEQ ID NO: 931250 - protein, 9 aa, Homo Sapiens
GEKSYECSQ

SEQ ID NO: 931251 - protein, 9 aa, Homo Sapiens
FSASTGHAT

SEQ ID NO: 931252 - protein, 9 aa, Homo Sapiens
SQSEALCVL

SEQ ID NO: 931253 - protein, 9 aa, Homo Sapiens
ENRCFYNLD

SEQ ID NO: 931254 - protein, 9 aa, Homo Sapiens
AEPLLLVCI

SEQ ID NO: 931255 - protein, 9 aa, Homo Sapiens
SKFKDEPLL

SEQ ID NO: 931256 - protein, 9 aa, Homo Sapiens
HNKLVPTIL

SEQ ID NO: 931257 - protein, 9 aa, Homo Sapiens
KPGEEQYNS

SEQ ID NO: 931258 - protein, 9 aa, Homo Sapiens
FQGAGKAAM

SEQ ID NO: 931259 - protein, 9 aa, Homo Sapiens
EEKPVITHG

SEQ ID NO: 931260 - protein, 9 aa, Homo Sapiens
PPGILGPQG

SEQ ID NO: 931261 - protein, 9 aa, Homo Sapiens
EGAAYPQAE

SEQ ID NO: 931262 - protein, 9 aa, Homo Sapiens
KLQSYKISS

SEQ ID NO: 931263 - protein, 9 aa, Homo Sapiens
DGAHSLADA

SEQ ID NO: 931264 - protein, 9 aa, Homo Sapiens
KLEQQKVWN

SEQ ID NO: 931265 - protein, 9 aa, Homo Sapiens
CLDLGNCYE

SEQ ID NO: 931266 - protein, 9 aa, Homo Sapiens
GFFVPTVTA

SEQ ID NO: 931267 - protein, 9 aa, Homo Sapiens
DMDTVIKPH

SEQ ID NO: 931268 - protein, 9 aa, Homo Sapiens
ENLTLQCDS

SEQ ID NO: 931269 - protein, 9 aa, Homo Sapiens
PYQLQQKLE

SEQ ID NO: 931270 - protein, 9 aa, Homo Sapiens
DKLYSSKNF

SEQ ID NO: 931271 - protein, 9 aa, Homo Sapiens
LQVALAQIQ

SEQ ID NO: 931272 - protein, 9 aa, Homo Sapiens
KKPAQCTEQ

SEQ ID NO: 931273 - protein, 9 aa, Homo Sapiens
VVYEDHGIT

SEQ ID NO: 931274 - protein, 9 aa, Homo Sapiens
FTQAPTSAG

SEQ ID NO: 931275 - protein, 9 aa, Homo Sapiens
HVKELTLFS

SEQ ID NO: 931276 - protein, 9 aa, Homo Sapiens
KSILILLAS

SEQ ID NO: 931277 - protein, 9 aa, Homo Sapiens
VLCKIVIFI

SEQ ID NO: 931278 - protein, 9 aa, Homo Sapiens
LFGLCAALY

SEQ ID NO: 931279 - protein, 9 aa, Homo Sapiens
LDVKNKELI

SEQ ID NO: 931280 - protein, 9 aa, Homo Sapiens
QDEVSKGVE

SEQ ID NO: 931281 - protein, 9 aa, Homo Sapiens
DNSSRFEKF

SEQ ID NO: 931282 - protein, 9 aa, Homo Sapiens
EPLLLVCIN

SEQ ID NO: 931283 - protein, 9 aa, Homo Sapiens
LFTQAPTSA

SEQ ID NO: 931284 - protein, 9 aa, Homo Sapiens
RKDVKNEIN

SEQ ID NO: 931285 - protein, 9 aa, Homo Sapiens
IKFDQNEKR

SEQ ID NO: 931286 - protein, 9 aa, Homo Sapiens
TCVHCFGDL

SEQ ID NO: 931287 - protein, 9 aa, Homo Sapiens
KRSIIKCEK

SEQ ID NO: 931288 - protein, 9 aa, Homo Sapiens
NNKGLFSLV

SEQ ID NO: 931289 - protein, 9 aa, Homo Sapiens
VALSTLPAE

SEQ ID NO: 931290 - protein, 9 aa, Homo Sapiens
GEQGPPGIL

SEQ ID NO: 931291 - protein, 9 aa, Homo Sapiens
EHGQEWTAP

SEQ ID NO: 931292 - protein, 9 aa, Homo Sapiens
TFTLFNYYK

SEQ ID NO: 931293 - protein, 9 aa, Homo Sapiens
RLNLWISRI

SEQ ID NO: 931294 - protein, 9 aa, Homo Sapiens
TCRALKTMG

SEQ ID NO: 931295 - protein, 9 aa, Homo Sapiens
KLCHLLANS

SEQ ID NO: 931296 - protein, 9 aa, Homo Sapiens
LQLEDDTVG

SEQ ID NO: 931297 - protein, 9 aa, Homo Sapiens
LSPRSPLIS

SEQ ID NO: 931298 - protein, 9 aa, Homo Sapiens
CNVRPENPV

SEQ ID NO: 931299 - protein, 9 aa, Homo Sapiens
ESMHKIWER

SEQ ID NO: 931300 - protein, 9 aa, Homo Sapiens
PCSRTCRGG

SEQ ID NO: 931301 - protein, 9 aa, Homo Sapiens
NAKTKPGEE

SEQ ID NO: 931302 - protein, 9 aa, Homo Sapiens
NHILEYATK

SEQ ID NO: 931303 - protein, 9 aa, Homo Sapiens
LPGRDESPG

SEQ ID NO: 931304 - protein, 9 aa, Homo Sapiens
AEELFGESH

SEQ ID NO: 931305 - protein, 9 aa, Homo Sapiens
VVFSVFISL

SEQ ID NO: 931306 - protein, 9 aa, Homo Sapiens
TTSIGIYEP

SEQ ID NO: 931307 - protein, 9 aa, Homo Sapiens
PGEEQYNST

SEQ ID NO: 931308 - protein, 9 aa, Homo Sapiens
LPDLGAESL

SEQ ID NO: 931309 - protein, 9 aa, Homo Sapiens
VFSVFISLP

SEQ ID NO: 931310 - protein, 9 aa, Homo Sapiens
SASVHHNKL

SEQ ID NO: 931311 - protein, 9 aa, Homo Sapiens
TQLLLASLA

SEQ ID NO: 931312 - protein, 9 aa, Homo Sapiens
GFFGVVSTH

SEQ ID NO: 931313 - protein, 9 aa, Homo Sapiens
TFFYHEYPW

SEQ ID NO: 931314 - protein, 9 aa, Homo Sapiens
ASAPQVCLD

SEQ ID NO: 931315 - protein, 9 aa, Homo Sapiens
DSDVGYIRY

SEQ ID NO: 931316 - protein, 9 aa, Homo Sapiens
QCNKKTENC

SEQ ID NO: 931317 - protein, 9 aa, Homo Sapiens
SDLKSQVES

SEQ ID NO: 931318 - protein, 9 aa, Homo Sapiens
GDVLKIYDE

SEQ ID NO: 931319 - protein, 9 aa, Homo Sapiens
KDVKNEINI

SEQ ID NO: 931320 - protein, 9 aa, Homo Sapiens
LLQAEVLHL

SEQ ID NO: 931321 - protein, 9 aa, Homo Sapiens
ATDKNSLFS

SEQ ID NO: 931322 - protein, 9 aa, Homo Sapiens
IFREHPWEV

SEQ ID NO: 931323 - protein, 9 aa, Homo Sapiens
KYLDLSFNQ

SEQ ID NO: 931324 - protein, 9 aa, Homo Sapiens
RITYKNNAY

SEQ ID NO: 931325 - protein, 9 aa, Homo Sapiens
PLFFCFSQG

SEQ ID NO: 931326 - protein, 9 aa, Homo Sapiens
FHLSQQLAA

SEQ ID NO: 931327 - protein, 9 aa, Homo Sapiens
IKGPTRTLY

SEQ ID NO: 931328 - protein, 9 aa, Homo Sapiens
RFEKFIRIH

SEQ ID NO: 931329 - protein, 9 aa, Homo Sapiens
YKISSGGIS

SEQ ID NO: 931330 - protein, 9 aa, Homo Sapiens
AGLGEMPGF

SEQ ID NO: 931331 - protein, 9 aa, Homo Sapiens
VTGIRGRSG

SEQ ID NO: 931332 - protein, 9 aa, Homo Sapiens
TGIRGRSGP

SEQ ID NO: 931333 - protein, 9 aa, Homo Sapiens
ATMKSRWSG

SEQ ID NO: 931334 - protein, 9 aa, Homo Sapiens
CHLLANSPK

SEQ ID NO: 931335 - protein, 9 aa, Homo Sapiens
ECCNVRPEN

SEQ ID NO: 931336 - protein, 9 aa, Homo Sapiens
KKKKKFSNR

SEQ ID NO: 931337 - protein, 9 aa, Homo Sapiens
TYMTHCHSG

SEQ ID NO: 931338 - protein, 9 aa, Homo Sapiens
TWLAPDSFC

SEQ ID NO: 931339 - protein, 9 aa, Homo Sapiens
GPPGILGPQ

SEQ ID NO: 931340 - protein, 9 aa, Homo Sapiens
ATAITTQAR

SEQ ID NO: 931341 - protein, 9 aa, Homo Sapiens
LSTLPAETT

SEQ ID NO: 931342 - protein, 9 aa, Homo Sapiens
LANAAVINP

SEQ ID NO: 931343 - protein, 9 aa, Homo Sapiens
ATKISNLLD

SEQ ID NO: 931344 - protein, 9 aa, Homo Sapiens
LGDAEVFLL

SEQ ID NO: 931345 - protein, 9 aa, Homo Sapiens
TQHQKIYTG

SEQ ID NO: 931346 - protein, 9 aa, Homo Sapiens
SKEEPVTFY

SEQ ID NO: 931347 - protein, 9 aa, Homo Sapiens
DVDARVPTA

SEQ ID NO: 931348 - protein, 9 aa, Homo Sapiens
SQRADFIKP

SEQ ID NO: 931349 - protein, 9 aa, Homo Sapiens
CLNGAIQAF

SEQ ID NO: 931350 - protein, 9 aa, Homo Sapiens
AAYTVDCQD

SEQ ID NO: 931351 - protein, 9 aa, Homo Sapiens
FMVSYFGRH

SEQ ID NO: 931352 - protein, 9 aa, Homo Sapiens
LVCTVSILI

SEQ ID NO: 931353 - protein, 9 aa, Homo Sapiens
EYCLEYNYD

SEQ ID NO: 931354 - protein, 9 aa, Homo Sapiens
GLDGAWLPT

SEQ ID NO: 931355 - protein, 9 aa, Homo Sapiens
VCTRLKQQM

SEQ ID NO: 931356 - protein, 9 aa, Homo Sapiens
YRFDQKFLS

SEQ ID NO: 931357 - protein, 9 aa, Homo Sapiens
KAVITALSF

SEQ ID NO: 931358 - protein, 9 aa, Homo Sapiens
YSSTMANNK

SEQ ID NO: 931359 - protein, 9 aa, Homo Sapiens
LNALRTESS

SEQ ID NO: 931360 - protein, 9 aa, Homo Sapiens
ATLLPLLIA

SEQ ID NO: 931361 - protein, 9 aa, Homo Sapiens
AESLFSSPE

SEQ ID NO: 931362 - protein, 9 aa, Homo Sapiens
YATDKNSLF

SEQ ID NO: 931363 - protein, 9 aa, Homo Sapiens
GDAEVFLLV

SEQ ID NO: 931364 - protein, 9 aa, Homo Sapiens
DQNEKRINY

SEQ ID NO: 931365 - protein, 9 aa, Homo Sapiens
SADLTIQAR

SEQ ID NO: 931366 - protein, 9 aa, Homo Sapiens
ACGALLFGL

SEQ ID NO: 931367 - protein, 9 aa, Homo Sapiens
DSFCWISGW

SEQ ID NO: 931368 - protein, 9 aa, Homo Sapiens
IKKSCAFSL

SEQ ID NO: 931369 - protein, 9 aa, Homo Sapiens
KPHPQVVKQ

SEQ ID NO: 931370 - protein, 9 aa, Homo Sapiens
SRVCKCRPG

SEQ ID NO: 931371 - protein, 9 aa, Homo Sapiens
QALTTVISS

SEQ ID NO: 931372 - protein, 9 aa, Homo Sapiens
PITHQPLGF

SEQ ID NO: 931373 - protein, 9 aa, Homo Sapiens
SYNEKQVYK

SEQ ID NO: 931374 - protein, 9 aa, Homo Sapiens
WDMKINCSG

SEQ ID NO: 931375 - protein, 9 aa, Homo Sapiens
APMAHLPPP

SEQ ID NO: 931376 - protein, 9 aa, Homo Sapiens
YAIRSRLIH

SEQ ID NO: 931377 - protein, 9 aa, Homo Sapiens
GKNVTVEIM

SEQ ID NO: 931378 - protein, 9 aa, Homo Sapiens
PRGPPPLPG

SEQ ID NO: 931379 - protein, 9 aa, Homo Sapiens
TEERWEERY

SEQ ID NO: 931380 - protein, 9 aa, Homo Sapiens
YSVLFFDVQ

SEQ ID NO: 931381 - protein, 9 aa, Homo Sapiens
VKLCHLLAN

SEQ ID NO: 931382 - protein, 9 aa, Homo Sapiens
RNRCLNGAI

SEQ ID NO: 931383 - protein, 9 aa, Homo Sapiens
NGRRGKNEN

SEQ ID NO: 931384 - protein, 9 aa, Homo Sapiens
TSIGIYEPK

SEQ ID NO: 931385 - protein, 9 aa, Homo Sapiens
KTTSIGIYE

SEQ ID NO: 931386 - protein, 9 aa, Homo Sapiens
LAKMMDPRV

SEQ ID NO: 931387 - protein, 9 aa, Homo Sapiens
ANPLSTLSF

SEQ ID NO: 931388 - protein, 9 aa, Homo Sapiens
PDVSYKRSI

SEQ ID NO: 931389 - protein, 9 aa, Homo Sapiens
GAAYPQAEL

SEQ ID NO: 931390 - protein, 9 aa, Homo Sapiens
MNLHNNRTG

SEQ ID NO: 931391 - protein, 9 aa, Homo Sapiens
HGGGCSPHS

SEQ ID NO: 931392 - protein, 9 aa, Homo Sapiens
RYNLFASGE

SEQ ID NO: 931393 - protein, 9 aa, Homo Sapiens
EEGLVLSLA

SEQ ID NO: 931394 - protein, 9 aa, Homo Sapiens
LVCWIVCTR

SEQ ID NO: 931395 - protein, 9 aa, Homo Sapiens
RNMALDVKN

SEQ ID NO: 931396 - protein, 9 aa, Homo Sapiens
VHHNKLVPT

SEQ ID NO: 931397 - protein, 9 aa, Homo Sapiens
TKSILILLA

SEQ ID NO: 931398 - protein, 9 aa, Homo Sapiens
AELAMSKFN

SEQ ID NO: 931399 - protein, 9 aa, Homo Sapiens
QAELAMSKF

SEQ ID NO: 931400 - protein, 9 aa, Homo Sapiens
STLSFHLSQ

SEQ ID NO: 931401 - protein, 9 aa, Homo Sapiens
RTEERWEER

SEQ ID NO: 931402 - protein, 9 aa, Homo Sapiens
WKKTTLAHA

SEQ ID NO: 931403 - protein, 9 aa, Homo Sapiens
EIWRSDLFG

SEQ ID NO: 931404 - protein, 9 aa, Homo Sapiens
YPYQLQQKL

SEQ ID NO: 931405 - protein, 9 aa, Homo Sapiens
RCLNGAIQA

SEQ ID NO: 931406 - protein, 9 aa, Homo Sapiens
SRILKRKFE

SEQ ID NO: 931407 - protein, 9 aa, Homo Sapiens
KVKSAKDRK

SEQ ID NO: 931408 - protein, 9 aa, Homo Sapiens
WGRGTSASC

SEQ ID NO: 931409 - protein, 9 aa, Homo Sapiens
QPLDHEKLE

SEQ ID NO: 931410 - protein, 9 aa, Homo Sapiens
LVCINASGG

SEQ ID NO: 931411 - protein, 9 aa, Homo Sapiens
LWETCVHCF

SEQ ID NO: 931412 - protein, 9 aa, Homo Sapiens
CIKYYKQNS

SEQ ID NO: 931413 - protein, 9 aa, Homo Sapiens
SRTCRGGVS

SEQ ID NO: 931414 - protein, 9 aa, Homo Sapiens
IKQQQRKSS

SEQ ID NO: 931415 - protein, 9 aa, Homo Sapiens
PLPVTSPFS

SEQ ID NO: 931416 - protein, 9 aa, Homo Sapiens
KLELLQFQV

SEQ ID NO: 931417 - protein, 9 aa, Homo Sapiens
DFIKPGDSL

SEQ ID NO: 931418 - protein, 9 aa, Homo Sapiens
RGGVSHRSR

SEQ ID NO: 931419 - protein, 9 aa, Homo Sapiens
EMVLLVLMA

SEQ ID NO: 931420 - protein, 9 aa, Homo Sapiens
HVRMKGLNS

SEQ ID NO: 931421 - protein, 9 aa, Homo Sapiens
IPLEKFYNN

SEQ ID NO: 931422 - protein, 9 aa, Homo Sapiens
SYECSQCGK

SEQ ID NO: 931423 - protein, 9 aa, Homo Sapiens
SGPAGPPGS

SEQ ID NO: 931424 - protein, 9 aa, Homo Sapiens
DEKDKTTHL

SEQ ID NO: 931425 - protein, 9 aa, Homo Sapiens
GESHSDDRT

SEQ ID NO: 931426 - protein, 9 aa, Homo Sapiens
MDTVIKPHP

SEQ ID NO: 931427 - protein, 9 aa, Homo Sapiens
DDTVGCKEM

SEQ ID NO: 931428 - protein, 9 aa, Homo Sapiens
YYKQNSLDE

SEQ ID NO: 931429 - protein, 9 aa, Homo Sapiens
GLQIMITSH

SEQ ID NO: 931430 - protein, 9 aa, Homo Sapiens
RQLRSHWQA

SEQ ID NO: 931431 - protein, 9 aa, Homo Sapiens
MAQPYPSAQ

SEQ ID NO: 931432 - protein, 9 aa, Homo Sapiens
EERWEERYG

SEQ ID NO: 931433 - protein, 9 aa, Homo Sapiens
WKKPRQPNE

SEQ ID NO: 931434 - protein, 9 aa, Homo Sapiens
RTLYEDGLY

SEQ ID NO: 931435 - protein, 9 aa, Homo Sapiens
AFYSVLFFD

SEQ ID NO: 931436 - protein, 9 aa, Homo Sapiens
LEENLTKEY

SEQ ID NO: 931437 - protein, 9 aa, Homo Sapiens
IVDEKMIVE

SEQ ID NO: 931438 - protein, 9 aa, Homo Sapiens
APGAPMAHL

SEQ ID NO: 931439 - protein, 9 aa, Homo Sapiens
PEGAAYPQA

SEQ ID NO: 931440 - protein, 9 aa, Homo Sapiens
NLLRKEKER

SEQ ID NO: 931441 - protein, 9 aa, Homo Sapiens
DESPGGKGD

SEQ ID NO: 931442 - protein, 9 aa, Homo Sapiens
ILILLASTV

SEQ ID NO: 931443 - protein, 9 aa, Homo Sapiens
IHCADMYLE

SEQ ID NO: 931444 - protein, 9 aa, Homo Sapiens
QRPSSQGWA

SEQ ID NO: 931445 - protein, 9 aa, Homo Sapiens
EKMIVECKM

SEQ ID NO: 931446 - protein, 9 aa, Homo Sapiens
EIINQYRVK

SEQ ID NO: 931447 - protein, 9 aa, Homo Sapiens
LFNYYKINW

SEQ ID NO: 931448 - protein, 9 aa, Homo Sapiens
KGPTRTLYE

SEQ ID NO: 931449 - protein, 9 aa, Homo Sapiens
SEISMFPYP

SEQ ID NO: 931450 - protein, 9 aa, Homo Sapiens
SSLLIDIKP

SEQ ID NO: 931451 - protein, 9 aa, Homo Sapiens
NRCFYNLDG

SEQ ID NO: 931452 - protein, 9 aa, Homo Sapiens
YEPKYIHPS

SEQ ID NO: 931453 - protein, 9 aa, Homo Sapiens
KTTPPVMEQ

SEQ ID NO: 931454 - protein, 9 aa, Homo Sapiens
LSHEIKPIL

SEQ ID NO: 931455 - protein, 9 aa, Homo Sapiens
IPWIAFYSV

SEQ ID NO: 931456 - protein, 9 aa, Homo Sapiens
FRELPTSFF

SEQ ID NO: 931457 - protein, 9 aa, Homo Sapiens
AAVINPGAI

SEQ ID NO: 931458 - protein, 9 aa, Homo Sapiens
TPTQGFNIR

SEQ ID NO: 931459 - protein, 9 aa, Homo Sapiens
SPQPQRPSS

SEQ ID NO: 931460 - protein, 9 aa, Homo Sapiens
FFCPAYWMP

SEQ ID NO: 931461 - protein, 9 aa, Homo Sapiens
TCRGGVSHR

SEQ ID NO: 931462 - protein, 9 aa, Homo Sapiens
SDLFGTPNE

SEQ ID NO: 931463 - protein, 9 aa, Homo Sapiens
YNYYATLLP

SEQ ID NO: 931464 - protein, 9 aa, Homo Sapiens
QLAKMMDPR

SEQ ID NO: 931465 - protein, 9 aa, Homo Sapiens
LPTSFFPVE

SEQ ID NO: 931466 - protein, 9 aa, Homo Sapiens
NNRTGRLAV

SEQ ID NO: 931467 - protein, 9 aa, Homo Sapiens
LEPEVGDGG

SEQ ID NO: 931468 - protein, 9 aa, Homo Sapiens
PLEKFYNNR

SEQ ID NO: 931469 - protein, 9 aa, Homo Sapiens
SRRPSSLLI

SEQ ID NO: 931470 - protein, 9 aa, Homo Sapiens
ALKTMGLWV

SEQ ID NO: 931471 - protein, 9 aa, Homo Sapiens
SRFEKFIRI

SEQ ID NO: 931472 - protein, 9 aa, Homo Sapiens
EILDLILDQ

SEQ ID NO: 931473 - protein, 9 aa, Homo Sapiens
RVCKCRPGM

SEQ ID NO: 931474 - protein, 9 aa, Homo Sapiens
QLLLASLAC

SEQ ID NO: 931475 - protein, 9 aa, Homo Sapiens
RILKRKFEE

SEQ ID NO: 931476 - protein, 9 aa, Homo Sapiens
NRTGRLAVR

SEQ ID NO: 931477 - protein, 9 aa, Homo Sapiens
LQQKLEQQK

SEQ ID NO: 931478 - protein, 9 aa, Homo Sapiens
NGAIQAFAS

SEQ ID NO: 931479 - protein, 9 aa, Homo Sapiens
AKPEVGEKK

SEQ ID NO: 931480 - protein, 9 aa, Homo Sapiens
ITKSILILL

SEQ ID NO: 931481 - protein, 9 aa, Homo Sapiens
VRTRDKKGS

SEQ ID NO: 931482 - protein, 9 aa, Homo Sapiens
PEYSSESMH

SEQ ID NO: 931483 - protein, 9 aa, Homo Sapiens
SFHLSQQLA

SEQ ID NO: 931484 - protein, 9 aa, Homo Sapiens
RASPQPQRP

SEQ ID NO: 931485 - protein, 9 aa, Homo Sapiens
ATGLIALVC

SEQ ID NO: 931486 - protein, 9 aa, Homo Sapiens
ALTTVISSS

SEQ ID NO: 931487 - protein, 9 aa, Homo Sapiens
PPLPGDENR

SEQ ID NO: 931488 - protein, 9 aa, Homo Sapiens
VDLPSPRAD

SEQ ID NO: 931489 - protein, 9 aa, Homo Sapiens
LSNINFYAQ

SEQ ID NO: 931490 - protein, 9 aa, Homo Sapiens
PGFFVPTVT

SEQ ID NO: 931491 - protein, 9 aa, Homo Sapiens
NVRPENPVD

SEQ ID NO: 931492 - protein, 9 aa, Homo Sapiens
QEKQREIKQ

SEQ ID NO: 931493 - protein, 9 aa, Homo Sapiens
QGDDVVTCS

SEQ ID NO: 931494 - protein, 9 aa, Homo Sapiens
LTQHQKIYT

SEQ ID NO: 931495 - protein, 9 aa, Homo Sapiens
ILEKQDKLA

SEQ ID NO: 931496 - protein, 9 aa, Homo Sapiens
AAPTVSFKA

SEQ ID NO: 931497 - protein, 9 aa, Homo Sapiens
LSFEFVMKD

SEQ ID NO: 931498 - protein, 9 aa, Homo Sapiens
PNEIINQYR

SEQ ID NO: 931499 - protein, 9 aa, Homo Sapiens
EKFIRIHFG

SEQ ID NO: 931500 - protein, 9 aa, Homo Sapiens
MKDSPEDKS

SEQ ID NO: 931501 - protein, 9 aa, Homo Sapiens
WIAFYSVLF

SEQ ID NO: 931502 - protein, 9 aa, Homo Sapiens
VDSLHLHRM

SEQ ID NO: 931503 - protein, 9 aa, Homo Sapiens
VHCFGDLQP

SEQ ID NO: 931504 - protein, 9 aa, Homo Sapiens
QPYPSAQYP

SEQ ID NO: 931505 - protein, 9 aa, Homo Sapiens
EARLSGSEG

SEQ ID NO: 931506 - protein, 9 aa, Homo Sapiens
QEWTAPGDP

SEQ ID NO: 931507 - protein, 9 aa, Homo Sapiens
GIHHFARAA

SEQ ID NO: 931508 - protein, 9 aa, Homo Sapiens
ILDLILDQQ

SEQ ID NO: 931509 - protein, 9 aa, Homo Sapiens
HNNRTGRLA

SEQ ID NO: 931510 - protein, 9 aa, Homo Sapiens
PSQQTAIIV

SEQ ID NO: 931511 - protein, 9 aa, Homo Sapiens
LVHTQLLLA

SEQ ID NO: 931512 - protein, 9 aa, Homo Sapiens
QRPCQSYNE

SEQ ID NO: 931513 - protein, 9 aa, Homo Sapiens
LYEDGLYLF

SEQ ID NO: 931514 - protein, 9 aa, Homo Sapiens
LQQVDSLHL

SEQ ID NO: 931515 - protein, 9 aa, Homo Sapiens
VCWIVCTRL

SEQ ID NO: 931516 - protein, 9 aa, Homo Sapiens
LQIMITSHF

SEQ ID NO: 931517 - protein, 9 aa, Homo Sapiens
LFLLFLRIY

SEQ ID NO: 931518 - protein, 9 aa, Homo Sapiens
KKTENCDCT

SEQ ID NO: 931519 - protein, 9 aa, Homo Sapiens
CFYNLDGDF

SEQ ID NO: 931520 - protein, 9 aa, Homo Sapiens
LEGLQSQTQ

SEQ ID NO: 931521 - protein, 9 aa, Homo Sapiens
YKRSIIKCE

SEQ ID NO: 931522 - protein, 9 aa, Homo Sapiens
HQKIYTGGK

SEQ ID NO: 931523 - protein, 9 aa, Homo Sapiens
ITHQPLGFF

SEQ ID NO: 931524 - protein, 9 aa, Homo Sapiens
CSQRADFIK

SEQ ID NO: 931525 - protein, 9 aa, Homo Sapiens
YHEYPWILS

SEQ ID NO: 931526 - protein, 9 aa, Homo Sapiens
EAKKPAQCT

SEQ ID NO: 931527 - protein, 9 aa, Homo Sapiens
ESPGGKGDR

SEQ ID NO: 931528 - protein, 9 aa, Homo Sapiens
RMKGLNSFE

SEQ ID NO: 931529 - protein, 9 aa, Homo Sapiens
QEAKKPAQC

SEQ ID NO: 931530 - protein, 9 aa, Homo Sapiens
PRQRQYLEL

SEQ ID NO: 931531 - protein, 9 aa, Homo Sapiens
DVSYKRSII

SEQ ID NO: 931532 - protein, 9 aa, Homo Sapiens
LPAETTGSL

SEQ ID NO: 931533 - protein, 9 aa, Homo Sapiens
EKTTPPVME

SEQ ID NO: 931534 - protein, 9 aa, Homo Sapiens
NGSEIKKSC

SEQ ID NO: 931535 - protein, 9 aa, Homo Sapiens
AKLNQLAKM

SEQ ID NO: 931536 - protein, 9 aa, Homo Sapiens
VFGDIFWKK

SEQ ID NO: 931537 - protein, 9 aa, Homo Sapiens
EWDMKINCS

SEQ ID NO: 931538 - protein, 9 aa, Homo Sapiens
RDKKGSNYS

SEQ ID NO: 931539 - protein, 9 aa, Homo Sapiens
AKKLDAGWY

SEQ ID NO: 931540 - protein, 9 aa, Homo Sapiens
TAITTQARS

SEQ ID NO: 931541 - protein, 9 aa, Homo Sapiens
QKEWKRERA

SEQ ID NO: 931542 - protein, 9 aa, Homo Sapiens
LIKGPTRTL

SEQ ID NO: 931543 - protein, 9 aa, Homo Sapiens
RPENPVDFL

SEQ ID NO: 931544 - protein, 9 aa, Homo Sapiens
LTINGEAFP

SEQ ID NO: 931545 - protein, 9 aa, Homo Sapiens
FIDYYNMFT

SEQ ID NO: 931546 - protein, 9 aa, Homo Sapiens
FCWEVICDD

SEQ ID NO: 931547 - protein, 9 aa, Homo Sapiens
SGIHHFARA

SEQ ID NO: 931548 - protein, 9 aa, Homo Sapiens
VALAQIQVF

SEQ ID NO: 931549 - protein, 9 aa, Homo Sapiens
ANWLANAAV

SEQ ID NO: 931550 - protein, 9 aa, Homo Sapiens
FDLNSLEQL

SEQ ID NO: 931551 - protein, 9 aa, Homo Sapiens
TRITYKNNA

SEQ ID NO: 931552 - protein, 9 aa, Homo Sapiens
TDLWETCVH

SEQ ID NO: 931553 - protein, 9 aa, Homo Sapiens
MVLLVLMAY

SEQ ID NO: 931554 - protein, 9 aa, Homo Sapiens
DSPEDKSRL

SEQ ID NO: 931555 - protein, 9 aa, Homo Sapiens
FVFQGAGKA

SEQ ID NO: 931556 - protein, 9 aa, Homo Sapiens
ALKHISRCI

SEQ ID NO: 931557 - protein, 9 aa, Homo Sapiens
NDNSSRFEK

SEQ ID NO: 931558 - protein, 9 aa, Homo Sapiens
FSEAGLQIM

SEQ ID NO: 931559 - protein, 9 aa, Homo Sapiens
GAKPEVGEK

SEQ ID NO: 931560 - protein, 9 aa, Homo Sapiens
LKLEDSVVY

SEQ ID NO: 931561 - protein, 9 aa, Homo Sapiens
LDAGWYTLS

SEQ ID NO: 931562 - protein, 9 aa, Homo Sapiens
GSNYSQSEA

SEQ ID NO: 931563 - protein, 9 aa, Homo Sapiens
NALRTESSE

SEQ ID NO: 931564 - protein, 9 aa, Homo Sapiens
SPPPPPLPG

SEQ ID NO: 931565 - protein, 9 aa, Homo Sapiens
GDSGFPGMK

SEQ ID NO: 931566 - protein, 9 aa, Homo Sapiens
APGDPCRIC

SEQ ID NO: 931567 - protein, 9 aa, Homo Sapiens
LNQLAKMMD

SEQ ID NO: 931568 - protein, 9 aa, Homo Sapiens
PVTSPFSAS

SEQ ID NO: 931569 - protein, 9 aa, Homo Sapiens
CVHCFGDLQ

SEQ ID NO: 931570 - protein, 9 aa, Homo Sapiens
KIYTGGKPY

SEQ ID NO: 931571 - protein, 9 aa, Homo Sapiens
LINLCEVDR

SEQ ID NO: 931572 - protein, 9 aa, Homo Sapiens
IRSVQSQGF

SEQ ID NO: 931573 - protein, 9 aa, Homo Sapiens
VNMLLSHEI

SEQ ID NO: 931574 - protein, 9 aa, Homo Sapiens
DTVIKPHPQ

SEQ ID NO: 931575 - protein, 9 aa, Homo Sapiens
QDYVHVVEF

SEQ ID NO: 931576 - protein, 9 aa, Homo Sapiens
TMANNKGLF

SEQ ID NO: 931577 - protein, 9 aa, Homo Sapiens
VDARVPTAE

SEQ ID NO: 931578 - protein, 9 aa, Homo Sapiens
EWTAPGDPC

SEQ ID NO: 931579 - protein, 9 aa, Homo Sapiens
DLWETCVHC

SEQ ID NO: 931580 - protein, 9 aa, Homo Sapiens
LYSSKNFLC

SEQ ID NO: 931581 - protein, 9 aa, Homo Sapiens
TLQCDSDVG

SEQ ID NO: 931582 - protein, 9 aa, Homo Sapiens
GISPPPPPL

SEQ ID NO: 931583 - protein, 9 aa, Homo Sapiens
HRFDPFCWE

SEQ ID NO: 931584 - protein, 9 aa, Homo Sapiens
IRTTFFYHE

SEQ ID NO: 931585 - protein, 9 aa, Homo Sapiens
LQFPLLPPW

SEQ ID NO: 931586 - protein, 9 aa, Homo Sapiens
LADGAHSLA

SEQ ID NO: 931587 - protein, 9 aa, Homo Sapiens
YFLAKFYPE

SEQ ID NO: 931588 - protein, 9 aa, Homo Sapiens
LTLQCDSDV

SEQ ID NO: 931589 - protein, 9 aa, Homo Sapiens
RMNGSEIKK

SEQ ID NO: 931590 - protein, 9 aa, Homo Sapiens
AEVLHLDED

SEQ ID NO: 931591 - protein, 9 aa, Homo Sapiens
LPSQQTAII

SEQ ID NO: 931592 - protein, 9 aa, Homo Sapiens
RKVEMRRDL

SEQ ID NO: 931593 - protein, 9 aa, Homo Sapiens
TLLKFTVTE

SEQ ID NO: 931594 - protein, 9 aa, Homo Sapiens
ISRCIGDTP

SEQ ID NO: 931595 - protein, 9 aa, Homo Sapiens
DLQLEDDTV

SEQ ID NO: 931596 - protein, 9 aa, Homo Sapiens
YSEHIPLEK

SEQ ID NO: 931597 - protein, 9 aa, Homo Sapiens
EPDGNSSSV

SEQ ID NO: 931598 - protein, 9 aa, Homo Sapiens
ARLSGSEGT

SEQ ID NO: 931599 - protein, 9 aa, Homo Sapiens
WTAPGDPCR

SEQ ID NO: 931600 - protein, 9 aa, Homo Sapiens
REIKQQQRK

SEQ ID NO: 931601 - protein, 9 aa, Homo Sapiens
LLEPEVGDG

SEQ ID NO: 931602 - protein, 9 aa, Homo Sapiens
LLFGLCAAL

SEQ ID NO: 931603 - protein, 9 aa, Homo Sapiens
EKSYECSQC

SEQ ID NO: 931604 - protein, 9 aa, Homo Sapiens
TPASAPQVC

SEQ ID NO: 931605 - protein, 9 aa, Homo Sapiens
NTIPLEGLQ

SEQ ID NO: 931606 - protein, 9 aa, Homo Sapiens
PKISLSGIH

SEQ ID NO: 931607 - protein, 9 aa, Homo Sapiens
MSRILKRKF

SEQ ID NO: 931608 - protein, 9 aa, Homo Sapiens
IFWKKTTLA

SEQ ID NO: 931609 - protein, 9 aa, Homo Sapiens
GKAAMGIAH

SEQ ID NO: 931610 - protein, 9 aa, Homo Sapiens
IHHFARAAS

SEQ ID NO: 931611 - protein, 9 aa, Homo Sapiens
PFCWEVICD

SEQ ID NO: 931612 - protein, 9 aa, Homo Sapiens
PDGNSSSVT

SEQ ID NO: 931613 - protein, 9 aa, Homo Sapiens
LFLRIYVVT

SEQ ID NO: 931614 - protein, 9 aa, Homo Sapiens
IDYRLNALR

SEQ ID NO: 931615 - protein, 9 aa, Homo Sapiens
RSDLFGTPN

SEQ ID NO: 931616 - protein, 9 aa, Homo Sapiens
KSYECSQCG

SEQ ID NO: 931617 - protein, 9 aa, Homo Sapiens
YRLNALRTE

SEQ ID NO: 931618 - protein, 9 aa, Homo Sapiens
NSLDEQHIF

SEQ ID NO: 931619 - protein, 9 aa, Homo Sapiens
AFFCPAYWM

SEQ ID NO: 931620 - protein, 9 aa, Homo Sapiens
LWKSYVKLC

SEQ ID NO: 931621 - protein, 9 aa, Homo Sapiens
DYIRTTFFY

SEQ ID NO: 931622 - protein, 9 aa, Homo Sapiens
VSLEPLKDT

SEQ ID NO: 931623 - protein, 9 aa, Homo Sapiens
QVALAQIQV

SEQ ID NO: 931624 - protein, 9 aa, Homo Sapiens
QEGQDHEKE

SEQ ID NO: 931625 - protein, 9 aa, Homo Sapiens
KTMGLWVDC

SEQ ID NO: 931626 - protein, 9 aa, Homo Sapiens
PSVSEISMF

SEQ ID NO: 931627 - protein, 9 aa, Homo Sapiens
DLFGTLDPF

SEQ ID NO: 931628 - protein, 9 aa, Homo Sapiens
APTVSFKAQ

SEQ ID NO: 931629 - protein, 9 aa, Homo Sapiens
PKKGTAVFR

SEQ ID NO: 931630 - protein, 9 aa, Homo Sapiens
YYKINWTTG

SEQ ID NO: 931631 - protein, 9 aa, Homo Sapiens
NESQGDDVV

SEQ ID NO: 931632 - protein, 9 aa, Homo Sapiens
IIDANYFGP

SEQ ID NO: 931633 - protein, 9 aa, Homo Sapiens
SGGISQILD

SEQ ID NO: 931634 - protein, 9 aa, Homo Sapiens
NAAVINPGA

SEQ ID NO: 931635 - protein, 9 aa, Homo Sapiens
SNCWEPKNT

SEQ ID NO: 931636 - protein, 9 aa, Homo Sapiens
DLVLGFGFV

SEQ ID NO: 931637 - protein, 9 aa, Homo Sapiens
ANLAKELKK

SEQ ID NO: 931638 - protein, 9 aa, Homo Sapiens
VLSLAEEEL

SEQ ID NO: 931639 - protein, 9 aa, Homo Sapiens
LLGCVVFSV

SEQ ID NO: 931640 - protein, 9 aa, Homo Sapiens
GNIKFDQNE

SEQ ID NO: 931641 - protein, 9 aa, Homo Sapiens
VSQKEWKRE

SEQ ID NO: 931642 - protein, 9 aa, Homo Sapiens
GAALGKAMH

SEQ ID NO: 931643 - protein, 9 aa, Homo Sapiens
TSEEPDGNS

SEQ ID NO: 931644 - protein, 9 aa, Homo Sapiens
SSSKQNLWD

SEQ ID NO: 931645 - protein, 9 aa, Homo Sapiens
QGPPGILGP

SEQ ID NO: 931646 - protein, 9 aa, Homo Sapiens
TVSFKAQWL

SEQ ID NO: 931647 - protein, 9 aa, Homo Sapiens
EKQVYKETC

SEQ ID NO: 931648 - protein, 9 aa, Homo Sapiens
DKNSLFSLD

SEQ ID NO: 931649 - protein, 9 aa, Homo Sapiens
QSYKISSGG

SEQ ID NO: 931650 - protein, 9 aa, Homo Sapiens
HGQEWTAPG

SEQ ID NO: 931651 - protein, 9 aa, Homo Sapiens
DGNSSSVTS

SEQ ID NO: 931652 - protein, 9 aa, Homo Sapiens
PKNTDYAVY

SEQ ID NO: 931653 - protein, 9 aa, Homo Sapiens
HLDEDEDDL

SEQ ID NO: 931654 - protein, 9 aa, Homo Sapiens
IRGRSGPAG

SEQ ID NO: 931655 - protein, 9 aa, Homo Sapiens
PGAPMAHLP

SEQ ID NO: 931656 - protein, 9 aa, Homo Sapiens
VGTDKFFTY

SEQ ID NO: 931657 - protein, 9 aa, Homo Sapiens
KEAKVINEK

SEQ ID NO: 931658 - protein, 9 aa, Homo Sapiens
SNYSQSEAL

SEQ ID NO: 931659 - protein, 9 aa, Homo Sapiens
HSADLTIQA

SEQ ID NO: 931660 - protein, 9 aa, Homo Sapiens
QAEVLHLDE

SEQ ID NO: 931661 - protein, 9 aa, Homo Sapiens
NIKFDQNEK

SEQ ID NO: 931662 - protein, 9 aa, Homo Sapiens
RRPSSLLID

SEQ ID NO: 931663 - protein, 9 aa, Homo Sapiens
EDFFKLEWD

SEQ ID NO: 931664 - protein, 9 aa, Homo Sapiens
PDLGAESLF

SEQ ID NO: 931665 - protein, 9 aa, Homo Sapiens
LQSQTQFEE

SEQ ID NO: 931666 - protein, 9 aa, Homo Sapiens
HNAKTKPGE

SEQ ID NO: 931667 - protein, 9 aa, Homo Sapiens
KSNKQEAKK

SEQ ID NO: 931668 - protein, 9 aa, Homo Sapiens
RTGRLAVRA

SEQ ID NO: 931669 - protein, 9 aa, Homo Sapiens
EKERYTCRY

SEQ ID NO: 931670 - protein, 9 aa, Homo Sapiens
AQIQVFGHR

SEQ ID NO: 931671 - protein, 9 aa, Homo Sapiens
SFKAQWLSD

SEQ ID NO: 931672 - protein, 9 aa, Homo Sapiens
CSRTCRGGV

SEQ ID NO: 931673 - protein, 9 aa, Homo Sapiens
FYVSSLMEN

SEQ ID NO: 931674 - protein, 9 aa, Homo Sapiens
MHHVLEKSK

SEQ ID NO: 931675 - protein, 9 aa, Homo Sapiens
IRHVDLPSP

SEQ ID NO: 931676 - protein, 9 aa, Homo Sapiens
IYTGGKPYE

SEQ ID NO: 931677 - protein, 9 aa, Homo Sapiens
AWIDYRLNA

SEQ ID NO: 931678 - protein, 9 aa, Homo Sapiens
PQRPSSQGW

SEQ ID NO: 931679 - protein, 9 aa, Homo Sapiens
VTSPPSVLF

SEQ ID NO: 931680 - protein, 9 aa, Homo Sapiens
SLEPLKDTA

SEQ ID NO: 931681 - protein, 9 aa, Homo Sapiens
FTRNRCLNG

SEQ ID NO: 931682 - protein, 9 aa, Homo Sapiens
QSQTQFEEM

SEQ ID NO: 931683 - protein, 9 aa, Homo Sapiens
STIEEIDIM

SEQ ID NO: 931684 - protein, 9 aa, Homo Sapiens
TALSFEFVM

SEQ ID NO: 931685 - protein, 9 aa, Homo Sapiens
VDCQDYVHV

SEQ ID NO: 931686 - protein, 9 aa, Homo Sapiens
EELFGESHS

SEQ ID NO: 931687 - protein, 9 aa, Homo Sapiens
FKAQWLSDS

SEQ ID NO: 931688 - protein, 9 aa, Homo Sapiens
MIVECKMNN

SEQ ID NO: 931689 - protein, 9 aa, Homo Sapiens
TENCDCTPD

SEQ ID NO: 931690 - protein, 9 aa, Homo Sapiens
SCSQRADFI

SEQ ID NO: 931691 - protein, 9 aa, Homo Sapiens
KRVVSLEPL

SEQ ID NO: 931692 - protein, 9 aa, Homo Sapiens
SVHHNKLVP

SEQ ID NO: 931693 - protein, 9 aa, Homo Sapiens
VEGLLQNST

SEQ ID NO: 931694 - protein, 9 aa, Homo Sapiens
YDVKQKFHK

SEQ ID NO: 931695 - protein, 9 aa, Homo Sapiens
KKGSNYSQS

SEQ ID NO: 931696 - protein, 9 aa, Homo Sapiens
ETFKKKDTY

SEQ ID NO: 931697 - protein, 9 aa, Homo Sapiens
NISNEALFD

SEQ ID NO: 931698 - protein, 9 aa, Homo Sapiens
QDHVVDSWP

SEQ ID NO: 931699 - protein, 9 aa, Homo Sapiens
EKLELLQFQ

SEQ ID NO: 931700 - protein, 9 aa, Homo Sapiens
SKKKKKKFS

SEQ ID NO: 931701 - protein, 9 aa, Homo Sapiens
ALAQIQVFG

SEQ ID NO: 931702 - protein, 9 aa, Homo Sapiens
LEIAANGIN

SEQ ID NO: 931703 - protein, 9 aa, Homo Sapiens
SFSEAGLQI

SEQ ID NO: 931704 - protein, 9 aa, Homo Sapiens
DLKSQVESL

SEQ ID NO: 931705 - protein, 9 aa, Homo Sapiens
PPPLPGDEN

SEQ ID NO: 931706 - protein, 9 aa, Homo Sapiens
LHNNRTGRL

SEQ ID NO: 931707 - protein, 9 aa, Homo Sapiens
KGRTAEEKP

SEQ ID NO: 931708 - protein, 9 aa, Homo Sapiens
LCEVDRTIT

SEQ ID NO: 931709 - protein, 9 aa, Homo Sapiens
MENRCFYNL

SEQ ID NO: 931710 - protein, 9 aa, Homo Sapiens
KKTTLAHAC

SEQ ID NO: 931711 - protein, 9 aa, Homo Sapiens
CQSYNEKQV

SEQ ID NO: 931712 - protein, 9 aa, Homo Sapiens
AQPYPSAQY

SEQ ID NO: 931713 - protein, 9 aa, Homo Sapiens
HLLEPEVGD

SEQ ID NO: 931714 - protein, 9 aa, Homo Sapiens
VTCSCQDCA

SEQ ID NO: 931715 - protein, 9 aa, Homo Sapiens
LNSFERDSM

SEQ ID NO: 931716 - protein, 9 aa, Homo Sapiens
TFYFLAKFY

SEQ ID NO: 931717 - protein, 9 aa, Homo Sapiens
LPPPGTPMS

SEQ ID NO: 931718 - protein, 9 aa, Homo Sapiens
KCRPGMFCS

SEQ ID NO: 931719 - protein, 9 aa, Homo Sapiens
RLSGSEGTP

SEQ ID NO: 931720 - protein, 9 aa, Homo Sapiens
ENYSYLKQT

SEQ ID NO: 931721 - protein, 9 aa, Homo Sapiens
HTQLLLASL

SEQ ID NO: 931722 - protein, 9 aa, Homo Sapiens
NFLCYVLLI

SEQ ID NO: 931723 - protein, 9 aa, Homo Sapiens
EANLLPRQR

SEQ ID NO: 931724 - protein, 9 aa, Homo Sapiens
VLEKSKFKD

SEQ ID NO: 931725 - protein, 9 aa, Homo Sapiens
KELTLFSLS

SEQ ID NO: 931726 - protein, 9 aa, Homo Sapiens
KDSPEDKSR

SEQ ID NO: 931727 - protein, 9 aa, Homo Sapiens
FSFDEFMVS

SEQ ID NO: 931728 - protein, 9 aa, Homo Sapiens
LVLGFGFVA

SEQ ID NO: 931729 - protein, 9 aa, Homo Sapiens
LSFHLSQQL

SEQ ID NO: 931730 - protein, 9 aa, Homo Sapiens
NKGLFSLVA

SEQ ID NO: 931731 - protein, 9 aa, Homo Sapiens
IVCTRLKQQ

SEQ ID NO: 931732 - protein, 9 aa, Homo Sapiens
SPRSPLISV

SEQ ID NO: 931733 - protein, 9 aa, Homo Sapiens
RELPTSFFP

SEQ ID NO: 931734 - protein, 9 aa, Homo Sapiens
LHLHRMSLE

SEQ ID NO: 931735 - protein, 9 aa, Homo Sapiens
GAWLPTLPG

SEQ ID NO: 931736 - protein, 9 aa, Homo Sapiens
FDPFCWEVI

SEQ ID NO: 931737 - protein, 9 aa, Homo Sapiens
FDEFMVSYF

SEQ ID NO: 931738 - protein, 9 aa, Homo Sapiens
KFTVTEDGL

SEQ ID NO: 931739 - protein, 9 aa, Homo Sapiens
IHVPQGHDG

SEQ ID NO: 931740 - protein, 9 aa, Homo Sapiens
AYPQAELAM

SEQ ID NO: 931741 - protein, 9 aa, Homo Sapiens
GPPGDSGFP

SEQ ID NO: 931742 - protein, 9 aa, Homo Sapiens
YELEAKSYL

SEQ ID NO: 931743 - protein, 9 aa, Homo Sapiens
TTWLAPDSF

SEQ ID NO: 931744 - protein, 9 aa, Homo Sapiens
DPFCWEVIC

SEQ ID NO: 931745 - protein, 9 aa, Homo Sapiens
IDANYFGPI

SEQ ID NO: 931746 - protein, 9 aa, Homo Sapiens
PAETTGSLV

SEQ ID NO: 931747 - protein, 9 aa, Homo Sapiens
VEIMYQIGT

SEQ ID NO: 931748 - protein, 9 aa, Homo Sapiens
YDIIVCKNS

SEQ ID NO: 931749 - protein, 9 aa, Homo Sapiens
VVFMKDSPE

SEQ ID NO: 931750 - protein, 9 aa, Homo Sapiens
NKLVPTILR

SEQ ID NO: 931751 - protein, 9 aa, Homo Sapiens
ISSGGISQI

SEQ ID NO: 931752 - protein, 9 aa, Homo Sapiens
TGEKSYECS

SEQ ID NO: 931753 - protein, 9 aa, Homo Sapiens
EDSVVYEDH

SEQ ID NO: 931754 - protein, 9 aa, Homo Sapiens
ANAAVINPG

SEQ ID NO: 931755 - protein, 9 aa, Homo Sapiens
NKKTENCDC

SEQ ID NO: 931756 - protein, 9 aa, Homo Sapiens
FLLFLRIYV

SEQ ID NO: 931757 - protein, 9 aa, Homo Sapiens
EERYGVQEQ

SEQ ID NO: 931758 - protein, 9 aa, Homo Sapiens
NNLQVALAQ

SEQ ID NO: 931759 - protein, 9 aa, Homo Sapiens
ETTGSLVFS

SEQ ID NO: 931760 - protein, 9 aa, Homo Sapiens
DTHVKELTL

SEQ ID NO: 931761 - protein, 9 aa, Homo Sapiens
LQCDSDVGY

SEQ ID NO: 931762 - protein, 9 aa, Homo Sapiens
EHIPLEKFY

SEQ ID NO: 931763 - protein, 9 aa, Homo Sapiens
PLLPPWNNT

SEQ ID NO: 931764 - protein, 9 aa, Homo Sapiens
EATAITTQA

SEQ ID NO: 931765 - protein, 9 aa, Homo Sapiens
QLEDDTVGC

SEQ ID NO: 931766 - protein, 9 aa, Homo Sapiens
IDLFPQMAT

SEQ ID NO: 931767 - protein, 9 aa, Homo Sapiens
SLDEQHIFQ

SEQ ID NO: 931768 - protein, 9 aa, Homo Sapiens
VIKPHPQVV

SEQ ID NO: 931769 - protein, 9 aa, Homo Sapiens
LFSLDCLSN

SEQ ID NO: 931770 - protein, 9 aa, Homo Sapiens
ESQGDDVVT

SEQ ID NO: 931771 - protein, 9 aa, Homo Sapiens
EQGPPGILG

SEQ ID NO: 931772 - protein, 9 aa, Homo Sapiens
TVNRENYSY

SEQ ID NO: 931773 - protein, 9 aa, Homo Sapiens
NEKTTPPVM

SEQ ID NO: 931774 - protein, 9 aa, Homo Sapiens
FGDIFWKKT

SEQ ID NO: 931775 - protein, 9 aa, Homo Sapiens
SAGISPPPP

SEQ ID NO: 931776 - protein, 9 aa, Homo Sapiens
IIVCKNSKP

SEQ ID NO: 931777 - protein, 9 aa, Homo Sapiens
INLCEVDRT

SEQ ID NO: 931778 - protein, 9 aa, Homo Sapiens
LFTRNRCLN

SEQ ID NO: 931779 - protein, 9 aa, Homo Sapiens
AVFRYNLFA

SEQ ID NO: 931780 - protein, 9 aa, Homo Sapiens
AFMKPRYHV

SEQ ID NO: 931781 - protein, 9 aa, Homo Sapiens
CPIPWIAFY

SEQ ID NO: 931782 - protein, 9 aa, Homo Sapiens
RGPPPLPGD

SEQ ID NO: 931783 - protein, 9 aa, Homo Sapiens
TVEIMYQIG

SEQ ID NO: 931784 - protein, 9 aa, Homo Sapiens
VTVEIMYQI

SEQ ID NO: 931785 - protein, 9 aa, Homo Sapiens
RLIHVPQGH

SEQ ID NO: 931786 - protein, 9 aa, Homo Sapiens
VLMAYDRYV

SEQ ID NO: 931787 - protein, 9 aa, Homo Sapiens
PAWIDYRLN

SEQ ID NO: 931788 - protein, 9 aa, Homo Sapiens
ELEAKSYLK

SEQ ID NO: 931789 - protein, 9 aa, Homo Sapiens
EAKVINEKT

SEQ ID NO: 931790 - protein, 9 aa, Homo Sapiens
KKKKFSNRE

SEQ ID NO: 931791 - protein, 9 aa, Homo Sapiens
MHKIWERFR

SEQ ID NO: 931792 - protein, 9 aa, Homo Sapiens
TIQARQVDM

SEQ ID NO: 931793 - protein, 9 aa, Homo Sapiens
ANSIEEILD

SEQ ID NO: 931794 - protein, 9 aa, Homo Sapiens
KGLFSLVAR

SEQ ID NO: 931795 - protein, 9 aa, Homo Sapiens
IAFYSVLFF

SEQ ID NO: 931796 - protein, 9 aa, Homo Sapiens
THVKELTLF

SEQ ID NO: 931797 - protein, 9 aa, Homo Sapiens
NSPDVSYKR

SEQ ID NO: 931798 - protein, 9 aa, Homo Sapiens
EVSKGVEPL

SEQ ID NO: 931799 - protein, 9 aa, Homo Sapiens
FWKKTTLAH

SEQ ID NO: 931800 - protein, 9 aa, Homo Sapiens
LWISRIQES

SEQ ID NO: 931801 - protein, 9 aa, Homo Sapiens
AWNSSRVCK

SEQ ID NO: 931802 - protein, 9 aa, Homo Sapiens
QSYNEKQVY

SEQ ID NO: 931803 - protein, 9 aa, Homo Sapiens
VFFFLLLLV

SEQ ID NO: 931804 - protein, 9 aa, Homo Sapiens
FFPVEYIPA

SEQ ID NO: 931805 - protein, 9 aa, Homo Sapiens
VFVFQGAGK

SEQ ID NO: 931806 - protein, 9 aa, Homo Sapiens
NLQKCDILE

SEQ ID NO: 931807 - protein, 9 aa, Homo Sapiens
LLPLLIAVI

SEQ ID NO: 931808 - protein, 9 aa, Homo Sapiens
KRRYFLNEG

SEQ ID NO: 931809 - protein, 9 aa, Homo Sapiens
LTLCKSDLK

SEQ ID NO: 931810 - protein, 9 aa, Homo Sapiens
KKGTAVFRY

SEQ ID NO: 931811 - protein, 9 aa, Homo Sapiens
DHLLEPEVG

SEQ ID NO: 931812 - protein, 9 aa, Homo Sapiens
IMYQIGTFK

SEQ ID NO: 931813 - protein, 9 aa, Homo Sapiens
SSKGSDLFG

SEQ ID NO: 931814 - protein, 9 aa, Homo Sapiens
EGLVLSLAE

SEQ ID NO: 931815 - protein, 9 aa, Homo Sapiens
VSYKRSIIK

SEQ ID NO: 931816 - protein, 9 aa, Homo Sapiens
FSNREYETL

SEQ ID NO: 931817 - protein, 9 aa, Homo Sapiens
EEEANLLPR

SEQ ID NO: 931818 - protein, 9 aa, Homo Sapiens
ASPQPQRPS

SEQ ID NO: 931819 - protein, 9 aa, Homo Sapiens
FLRIYVVTV

SEQ ID NO: 931820 - protein, 9 aa, Homo Sapiens
KIYDEKDKT

SEQ ID NO: 931821 - protein, 9 aa, Homo Sapiens
RIYVVTVVG

SEQ ID NO: 931822 - protein, 9 aa, Homo Sapiens
KVEMRRDLV

SEQ ID NO: 931823 - protein, 9 aa, Homo Sapiens
YPSAQYPPP

SEQ ID NO: 931824 - protein, 9 aa, Homo Sapiens
LPDKKKKFQ

SEQ ID NO: 931825 - protein, 9 aa, Homo Sapiens
PRQPNEIIN

SEQ ID NO: 931826 - protein, 9 aa, Homo Sapiens
YKQNSLDEQ

SEQ ID NO: 931827 - protein, 9 aa, Homo Sapiens
QREIKQQQR

SEQ ID NO: 931828 - protein, 9 aa, Homo Sapiens
GQEWTAPGD

SEQ ID NO: 931829 - protein, 9 aa, Homo Sapiens
FLCYVLLIW

SEQ ID NO: 931830 - protein, 9 aa, Homo Sapiens
LELDKKIID

SEQ ID NO: 931831 - protein, 9 aa, Homo Sapiens
QKCDILELK

SEQ ID NO: 931832 - protein, 9 aa, Homo Sapiens
EKPVITHGF

SEQ ID NO: 931833 - protein, 9 aa, Homo Sapiens
FRLLKALKT

SEQ ID NO: 931834 - protein, 9 aa, Homo Sapiens
VTFYFLAKF

SEQ ID NO: 931835 - protein, 9 aa, Homo Sapiens
CFSQGTTSQ

SEQ ID NO: 931836 - protein, 9 aa, Homo Sapiens
CRALKTMGL

SEQ ID NO: 931837 - protein, 9 aa, Homo Sapiens
PSSLSNINF

SEQ ID NO: 931838 - protein, 9 aa, Homo Sapiens
SQKEWKRER

SEQ ID NO: 931839 - protein, 9 aa, Homo Sapiens
PTRTLYEDG

SEQ ID NO: 931840 - protein, 9 aa, Homo Sapiens
VLFTQAPTS

SEQ ID NO: 931841 - protein, 9 aa, Homo Sapiens
TSFFPVEYI

SEQ ID NO: 931842 - protein, 9 aa, Homo Sapiens
GYSEHIPLE

SEQ ID NO: 931843 - protein, 9 aa, Homo Sapiens
EIMYQIGTF

SEQ ID NO: 931844 - protein, 9 aa, Homo Sapiens
LKKFSKVTF

SEQ ID NO: 931845 - protein, 9 aa, Homo Sapiens
SNINFYAQV

SEQ ID NO: 931846 - protein, 9 aa, Homo Sapiens
LKSLKYLDL

SEQ ID NO: 931847 - protein, 9 aa, Homo Sapiens
FFKLEWDMK

SEQ ID NO: 931848 - protein, 9 aa, Homo Sapiens
LSFSEAGLQ

SEQ ID NO: 931849 - protein, 9 aa, Homo Sapiens
STMANNKGL

SEQ ID NO: 931850 - protein, 9 aa, Homo Sapiens
CGALLFGLC

SEQ ID NO: 931851 - protein, 9 aa, Homo Sapiens
IKGRIIKIH

SEQ ID NO: 931852 - protein, 9 aa, Homo Sapiens
PPSVLFTQA

SEQ ID NO: 931853 - protein, 9 aa, Homo Sapiens
GQCNKKTEN

SEQ ID NO: 931854 - protein, 9 aa, Homo Sapiens
EPEVGDGGG

SEQ ID NO: 931855 - protein, 9 aa, Homo Sapiens
NSLFSLDCL

SEQ ID NO: 931856 - protein, 9 aa, Homo Sapiens
LPGDENREM

SEQ ID NO: 931857 - protein, 9 aa, Homo Sapiens
TRLKQQMES

SEQ ID NO: 931858 - protein, 9 aa, Homo Sapiens
FFTYDFVFD

SEQ ID NO: 931859 - protein, 9 aa, Homo Sapiens
LGEMPGFFV

SEQ ID NO: 931860 - protein, 9 aa, Homo Sapiens
DFFKLEWDM

SEQ ID NO: 931861 - protein, 9 aa, Homo Sapiens
IQPAKKLDA

SEQ ID NO: 931862 - protein, 9 aa, Homo Sapiens
QAQTTLLKF

SEQ ID NO: 931863 - protein, 9 aa, Homo Sapiens
SWPSAVCGA

SEQ ID NO: 931864 - protein, 9 aa, Homo Sapiens
RMRGTIFRE

SEQ ID NO: 931865 - protein, 9 aa, Homo Sapiens
LHRMSLEPW

SEQ ID NO: 931866 - protein, 9 aa, Homo Sapiens
EENLTKEYC

SEQ ID NO: 931867 - protein, 9 aa, Homo Sapiens
NRENYSYLK

SEQ ID NO: 931868 - protein, 9 aa, Homo Sapiens
ALQPLDHEK

SEQ ID NO: 931869 - protein, 9 aa, Homo Sapiens
LKFTVTEDG

SEQ ID NO: 931870 - protein, 9 aa, Homo Sapiens
EKFYNNRAH

SEQ ID NO: 931871 - protein, 9 aa, Homo Sapiens
LQPLDHEKL

SEQ ID NO: 931872 - protein, 9 aa, Homo Sapiens
PGRDESPGG

SEQ ID NO: 931873 - protein, 9 aa, Homo Sapiens
KNSKPGQVI

SEQ ID NO: 931874 - protein, 9 aa, Homo Sapiens
QKFLSPIKD

SEQ ID NO: 931875 - protein, 9 aa, Homo Sapiens
RLKQQMESG

SEQ ID NO: 931876 - protein, 9 aa, Homo Sapiens
NYSQSEALC

SEQ ID NO: 931877 - protein, 9 aa, Homo Sapiens
ISSFRLLKA

SEQ ID NO: 931878 - protein, 9 aa, Homo Sapiens
LLRKEKERY

SEQ ID NO: 931879 - protein, 9 aa, Homo Sapiens
YSSESMHKI

SEQ ID NO: 931880 - protein, 9 aa, Homo Sapiens
GALLFGLCA

SEQ ID NO: 931881 - protein, 9 aa, Homo Sapiens
EPVTFYFLA

SEQ ID NO: 931882 - protein, 9 aa, Homo Sapiens
MLLSHEIKP

SEQ ID NO: 931883 - protein, 9 aa, Homo Sapiens
WLANAAVIN

SEQ ID NO: 931884 - protein, 9 aa, Homo Sapiens
FDQKFLSPI

SEQ ID NO: 931885 - protein, 9 aa, Homo Sapiens
QPLGFFGVV

SEQ ID NO: 931886 - protein, 9 aa, Homo Sapiens
KMIVECKMN

SEQ ID NO: 931887 - protein, 9 aa, Homo Sapiens
KAQWLSDSY

SEQ ID NO: 931888 - protein, 9 aa, Homo Sapiens
PLPGDENRE

SEQ ID NO: 931889 - protein, 9 aa, Homo Sapiens
LLPPWNNTK

SEQ ID NO: 931890 - protein, 9 aa, Homo Sapiens
NSTIEEIDI

SEQ ID NO: 931891 - protein, 9 aa, Homo Sapiens
VQKSCPSCA

SEQ ID NO: 931892 - protein, 9 aa, Homo Sapiens
KAMHGGGCS

SEQ ID NO: 931893 - protein, 9 aa, Homo Sapiens
TIFREHPWE

SEQ ID NO: 931894 - protein, 9 aa, Homo Sapiens
PLPGSAGIS

SEQ ID NO: 931895 - protein, 9 aa, Homo Sapiens
TLYEDGLYL

SEQ ID NO: 931896 - protein, 9 aa, Homo Sapiens
VCLDLGNCY

SEQ ID NO: 931897 - protein, 9 aa, Homo Sapiens
EVGDGGGAP

SEQ ID NO: 931898 - protein, 9 aa, Homo Sapiens
NIRSVQSQG

SEQ ID NO: 931899 - protein, 9 aa, Homo Sapiens
RFDPFCWEV

SEQ ID NO: 931900 - protein, 9 aa, Homo Sapiens
LIHVPQGHD

SEQ ID NO: 931901 - protein, 9 aa, Homo Sapiens
SQGTTSQQV

SEQ ID NO: 931902 - protein, 9 aa, Homo Sapiens
YATKISNLL

SEQ ID NO: 931903 - protein, 9 aa, Homo Sapiens
LLIDIKPIE

SEQ ID NO: 931904 - protein, 9 aa, Homo Sapiens
YMTHCHSGI

SEQ ID NO: 931905 - protein, 9 aa, Homo Sapiens
LGKAMHGGG

SEQ ID NO: 931906 - protein, 9 aa, Homo Sapiens
DLGAESLFS

SEQ ID NO: 931907 - protein, 9 aa, Homo Sapiens
SIGIYEPKY

SEQ ID NO: 931908 - protein, 9 aa, Homo Sapiens
LEYATKISN

SEQ ID NO: 931909 - protein, 9 aa, Homo Sapiens
PRSPLISVS

SEQ ID NO: 931910 - protein, 9 aa, Homo Sapiens
HLLGDAEVF

SEQ ID NO: 931911 - protein, 9 aa, Homo Sapiens
FYFLAKFYP

SEQ ID NO: 931912 - protein, 9 aa, Homo Sapiens
IVIFIDYYN

SEQ ID NO: 931913 - protein, 9 aa, Homo Sapiens
NPVDFLAEY

SEQ ID NO: 931914 - protein, 9 aa, Homo Sapiens
PLSVATTGV

SEQ ID NO: 931915 - protein, 9 aa, Homo Sapiens
AAAPTVSFK

SEQ ID NO: 931916 - protein, 9 aa, Homo Sapiens
IGDFGLATM

SEQ ID NO: 931917 - protein, 9 aa, Homo Sapiens
MYPYQLQQK

SEQ ID NO: 931918 - protein, 9 aa, Homo Sapiens
LRIYVVTVV

SEQ ID NO: 931919 - protein, 9 aa, Homo Sapiens
VRMKGLNSF

SEQ ID NO: 931920 - protein, 9 aa, Homo Sapiens
VLKIYDEKD

SEQ ID NO: 931921 - protein, 9 aa, Homo Sapiens
PLGFFGVVS

SEQ ID NO: 931922 - protein, 9 aa, Homo Sapiens
FKGLKSLKY

SEQ ID NO: 931923 - protein, 9 aa, Homo Sapiens
EIFDLNSLE

SEQ ID NO: 931924 - protein, 9 aa, Homo Sapiens
REEVLTVKK

SEQ ID NO: 931925 - protein, 9 aa, Homo Sapiens
LLINLCEVD

SEQ ID NO: 931926 - protein, 9 aa, Homo Sapiens
KSLKYLDLS

SEQ ID NO: 931927 - protein, 9 aa, Homo Sapiens
TANPLSVAT

SEQ ID NO: 931928 - protein, 9 aa, Homo Sapiens
FVNMLLSHE

SEQ ID NO: 931929 - protein, 9 aa, Homo Sapiens
QKIYTGGKP

SEQ ID NO: 931930 - protein, 9 aa, Homo Sapiens
KGTAVFRYN

SEQ ID NO: 931931 - protein, 9 aa, Homo Sapiens
GNYYDVDAR

SEQ ID NO: 931932 - protein, 9 aa, Homo Sapiens
LEDSVVYED

SEQ ID NO: 931933 - protein, 9 aa, Homo Sapiens
EMRRDLVLG

SEQ ID NO: 931934 - protein, 9 aa, Homo Sapiens
STIYDVKQK

SEQ ID NO: 931935 - protein, 9 aa, Homo Sapiens
KQEAKKPAQ

SEQ ID NO: 931936 - protein, 9 aa, Homo Sapiens
DSGFPGMKG

SEQ ID NO: 931937 - protein, 9 aa, Homo Sapiens
FFLLLLVWF

SEQ ID NO: 931938 - protein, 9 aa, Homo Sapiens
CNKKTENCD

SEQ ID NO: 931939 - protein, 9 aa, Homo Sapiens
KEWKRERAF

SEQ ID NO: 931940 - protein, 9 aa, Homo Sapiens
WEEGLVLSL

SEQ ID NO: 931941 - protein, 9 aa, Homo Sapiens
PRKDIDLFP

SEQ ID NO: 931942 - protein, 9 aa, Homo Sapiens
FRASPQPQR

SEQ ID NO: 931943 - protein, 9 aa, Homo Sapiens
LDEARLSGS

SEQ ID NO: 931944 - protein, 9 aa, Homo Sapiens
YNISNEALF

SEQ ID NO: 931945 - protein, 9 aa, Homo Sapiens
DFGLATMKS

SEQ ID NO: 931946 - protein, 9 aa, Homo Sapiens
VHNAKTKPG

SEQ ID NO: 931947 - protein, 9 aa, Homo Sapiens
RQPNEIINQ

SEQ ID NO: 931948 - protein, 9 aa, Homo Sapiens
HVVDSWPSA

SEQ ID NO: 931949 - protein, 9 aa, Homo Sapiens
AETTGSLVF

SEQ ID NO: 931950 - protein, 9 aa, Homo Sapiens
VCTVSILIA

SEQ ID NO: 931951 - protein, 9 aa, Homo Sapiens
DIIVCKNSK

SEQ ID NO: 931952 - protein, 9 aa, Homo Sapiens
LNGAIQAFA

SEQ ID NO: 931953 - protein, 9 aa, Homo Sapiens
KISSGGISQ

SEQ ID NO: 931954 - protein, 9 aa, Homo Sapiens
RKEKETFKK

SEQ ID NO: 931955 - protein, 9 aa, Homo Sapiens
QPNEIINQY

SEQ ID NO: 931956 - protein, 9 aa, Homo Sapiens
LPRQRQYLE

SEQ ID NO: 931957 - protein, 9 aa, Homo Sapiens
ESHSDDRTL

SEQ ID NO: 931958 - protein, 9 aa, Homo Sapiens
HVLEKSKFK

SEQ ID NO: 931959 - protein, 9 aa, Homo Sapiens
ISMFPYPDF

SEQ ID NO: 931960 - protein, 9 aa, Homo Sapiens
GIEWVWLHW

SEQ ID NO: 931961 - protein, 9 aa, Homo Sapiens
SHSDDRTLS

SEQ ID NO: 931962 - protein, 9 aa, Homo Sapiens
RLEENLTKE

SEQ ID NO: 931963 - protein, 9 aa, Homo Sapiens
SNEALFDVV

SEQ ID NO: 931964 - protein, 9 aa, Homo Sapiens
QPQRPSSQG

SEQ ID NO: 931965 - protein, 9 aa, Homo Sapiens
SMHKIWERF

SEQ ID NO: 931966 - protein, 9 aa, Homo Sapiens
RSPLISVSG

SEQ ID NO: 931967 - protein, 9 aa, Homo Sapiens
LFIEHLLGD

SEQ ID NO: 931968 - protein, 9 aa, Homo Sapiens
LGISTVNRE

SEQ ID NO: 931969 - protein, 9 aa, Homo Sapiens
NSIEEILDL

SEQ ID NO: 931970 - protein, 9 aa, Homo Sapiens
SEEPDGNSS

SEQ ID NO: 931971 - protein, 9 aa, Homo Sapiens
PFVIRHVDL

SEQ ID NO: 931972 - protein, 9 aa, Homo Sapiens
KKSCAFSLF

SEQ ID NO: 931973 - protein, 9 aa, Homo Sapiens
LLLVCINAS

SEQ ID NO: 931974 - protein, 9 aa, Homo Sapiens
GPPPLPGDE

SEQ ID NO: 931975 - protein, 9 aa, Homo Sapiens
ISNEALFDV

SEQ ID NO: 931976 - protein, 9 aa, Homo Sapiens
SSTIYDVKQ

SEQ ID NO: 931977 - protein, 9 aa, Homo Sapiens
MANNKGLFS

SEQ ID NO: 931978 - protein, 9 aa, Homo Sapiens
VELEIAANG

SEQ ID NO: 931979 - protein, 9 aa, Homo Sapiens
NKQEAKKPA

SEQ ID NO: 931980 - protein, 9 aa, Homo Sapiens
EPKICNAFF

SEQ ID NO: 931981 - protein, 9 aa, Homo Sapiens
LCKSDLKSQ

SEQ ID NO: 931982 - protein, 9 aa, Homo Sapiens
VAWALKHIS

SEQ ID NO: 931983 - protein, 9 aa, Homo Sapiens
RGRSGPAGP

SEQ ID NO: 931984 - protein, 9 aa, Homo Sapiens
GCVVFSVFI

SEQ ID NO: 931985 - protein, 9 aa, Homo Sapiens
LFFCFSQGT

SEQ ID NO: 931986 - protein, 9 aa, Homo Sapiens
NLDGDFLIV

SEQ ID NO: 931987 - protein, 9 aa, Homo Sapiens
LHLDEDEDD

SEQ ID NO: 931988 - protein, 9 aa, Homo Sapiens
LLIQPAKKL

SEQ ID NO: 931989 - protein, 9 aa, Homo Sapiens
GLKSLKYLD

SEQ ID NO: 931990 - protein, 9 aa, Homo Sapiens
QDHEKEDDH

SEQ ID NO: 931991 - protein, 9 aa, Homo Sapiens
GKVGPPGDS

SEQ ID NO: 931992 - protein, 9 aa, Homo Sapiens
TLPGLYRLE

SEQ ID NO: 931993 - protein, 9 aa, Homo Sapiens
LTLFSLSIL

SEQ ID NO: 931994 - protein, 9 aa, Homo Sapiens
FFVPTVTAI

SEQ ID NO: 931995 - protein, 9 aa, Homo Sapiens
SHWQAPRQG

SEQ ID NO: 931996 - protein, 9 aa, Homo Sapiens
EKRINYTIN

SEQ ID NO: 931997 - protein, 9 aa, Homo Sapiens
KKKDTYKLF

SEQ ID NO: 931998 - protein, 9 aa, Homo Sapiens
MPGFFVPTV

SEQ ID NO: 931999 - protein, 9 aa, Homo Sapiens
NPLSVATTG

SEQ ID NO: 932000 - protein, 9 aa, Homo Sapiens
PGSAGISPP

SEQ ID NO: 932001 - protein, 9 aa, Homo Sapiens
FGFSLQPAP

SEQ ID NO: 932002 - protein, 9 aa, Homo Sapiens
IRTEERWEE

SEQ ID NO: 932003 - protein, 9 aa, Homo Sapiens
KPRKDIDLF

SEQ ID NO: 932004 - protein, 9 aa, Homo Sapiens
QKLEQQKVW

SEQ ID NO: 932005 - protein, 9 aa, Homo Sapiens
EPKNTDYAV

SEQ ID NO: 932006 - protein, 9 aa, Homo Sapiens
KPAQCTEQA

SEQ ID NO: 932007 - protein, 9 aa, Homo Sapiens
LLGDAEVFL

SEQ ID NO: 932008 - protein, 9 aa, Homo Sapiens
TLSFHLSQQ

SEQ ID NO: 932009 - protein, 9 aa, Homo Sapiens
PSNCWEPKN

SEQ ID NO: 932010 - protein, 9 aa, Homo Sapiens
DQKFLSPIK

SEQ ID NO: 932011 - protein, 9 aa, Homo Sapiens
MNGSEIKKS

SEQ ID NO: 932012 - protein, 9 aa, Homo Sapiens
SVVYEDHGI

SEQ ID NO: 932013 - protein, 9 aa, Homo Sapiens
RKIVDEKMI

SEQ ID NO: 932014 - protein, 9 aa, Homo Sapiens
LIALVCTVS

SEQ ID NO: 932015 - protein, 9 aa, Homo Sapiens
DEVSKGVEP

SEQ ID NO: 932016 - protein, 9 aa, Homo Sapiens
FGESHSDDR

SEQ ID NO: 932017 - protein, 9 aa, Homo Sapiens
MVSYFGRHG

SEQ ID NO: 932018 - protein, 9 aa, Homo Sapiens
WQALTTVIS

SEQ ID NO: 932019 - protein, 9 aa, Homo Sapiens
LFPQMATLL

SEQ ID NO: 932020 - protein, 9 aa, Homo Sapiens
LQSYKISSG

SEQ ID NO: 932021 - protein, 9 aa, Homo Sapiens
LLVCINASG

SEQ ID NO: 932022 - protein, 9 aa, Homo Sapiens
GAGKRVVSL

SEQ ID NO: 932023 - protein, 9 aa, Homo Sapiens
RILEKQDKL

SEQ ID NO: 932024 - protein, 9 aa, Homo Sapiens
GDDVVTCSC

SEQ ID NO: 932025 - protein, 9 aa, Homo Sapiens
PHSADLTIQ

SEQ ID NO: 932026 - protein, 9 aa, Homo Sapiens
NAAYTVDCQ

SEQ ID NO: 932027 - protein, 9 aa, Homo Sapiens
FRQLRSHWQ

SEQ ID NO: 932028 - protein, 9 aa, Homo Sapiens
LPVTSPFSA

SEQ ID NO: 932029 - protein, 9 aa, Homo Sapiens
THCHSGIEW

SEQ ID NO: 932030 - protein, 9 aa, Homo Sapiens
SSLSNINFY

SEQ ID NO: 932031 - protein, 9 aa, Homo Sapiens
TKPGEEQYN

SEQ ID NO: 932032 - protein, 9 aa, Homo Sapiens
ILLGCVVFS

SEQ ID NO: 932033 - protein, 9 aa, Homo Sapiens
KICNAFFCP

SEQ ID NO: 932034 - protein, 9 aa, Homo Sapiens
LVLSLAEEE

SEQ ID NO: 932035 - protein, 9 aa, Homo Sapiens
VITALSFEF

SEQ ID NO: 932036 - protein, 9 aa, Homo Sapiens
GSEIKKSCA

SEQ ID NO: 932037 - protein, 9 aa, Homo Sapiens
ASVHHNKLV

SEQ ID NO: 932038 - protein, 9 aa, Homo Sapiens
ANPLSVATT

SEQ ID NO: 932039 - protein, 9 aa, Homo Sapiens
VLHLDEDED

SEQ ID NO: 932040 - protein, 9 aa, Homo Sapiens
EKDKTTHLL

SEQ ID NO: 932041 - protein, 9 aa, Homo Sapiens
MKSRWSGSH

SEQ ID NO: 932042 - protein, 9 aa, Homo Sapiens
KIIDANYFG

SEQ ID NO: 932043 - protein, 9 aa, Homo Sapiens
KDGNYYDVD

SEQ ID NO: 932044 - protein, 9 aa, Homo Sapiens
ANLLPRQRQ

SEQ ID NO: 932045 - protein, 9 aa, Homo Sapiens
RGTSASCPR

SEQ ID NO: 932046 - protein, 9 aa, Homo Sapiens
VSFKAQWLS

SEQ ID NO: 932047 - protein, 9 aa, Homo Sapiens
QGAGKAAMG

SEQ ID NO: 932048 - protein, 9 aa, Homo Sapiens
NKGKGGKNG

SEQ ID NO: 932049 - protein, 9 aa, Homo Sapiens
WEVICDDGT

SEQ ID NO: 932050 - protein, 9 aa, Homo Sapiens
DGAWLPTLP

SEQ ID NO: 932051 - protein, 9 aa, Homo Sapiens
LDKKIIDAN

SEQ ID NO: 932052 - protein, 9 aa, Homo Sapiens
KVNLQKCDI

SEQ ID NO: 932053 - protein, 9 aa, Homo Sapiens
GEMPGFFVP

SEQ ID NO: 932054 - protein, 9 aa, Homo Sapiens
RSVQSQGFK

SEQ ID NO: 932055 - protein, 9 aa, Homo Sapiens
TPPPPGKPQ

SEQ ID NO: 932056 - protein, 9 aa, Homo Sapiens
AWLPTLPGL

SEQ ID NO: 932057 - protein, 9 aa, Homo Sapiens
PCQSYNEKQ

SEQ ID NO: 932058 - protein, 9 aa, Homo Sapiens
ALLFGLCAA

SEQ ID NO: 932059 - protein, 9 aa, Homo Sapiens
GLQSQTQFE

SEQ ID NO: 932060 - protein, 9 aa, Homo Sapiens
VINEKTTPP

SEQ ID NO: 932061 - protein, 9 aa, Homo Sapiens
FFGVVSTHS

SEQ ID NO: 932062 - protein, 9 aa, Homo Sapiens
HPSVSEISM

SEQ ID NO: 932063 - protein, 9 aa, Homo Sapiens
VCINASGGL

SEQ ID NO: 932064 - protein, 9 aa, Homo Sapiens
SLLIDIKPI

SEQ ID NO: 932065 - protein, 9 aa, Homo Sapiens
SGIEWVWLH

SEQ ID NO: 932066 - protein, 9 aa, Homo Sapiens
DEARLSGSE

SEQ ID NO: 932067 - protein, 9 aa, Homo Sapiens
LYTANPLSV

SEQ ID NO: 932068 - protein, 9 aa, Homo Sapiens
PIPWIAFYS

SEQ ID NO: 932069 - protein, 9 aa, Homo Sapiens
GISTVNREN

SEQ ID NO: 932070 - protein, 9 aa, Homo Sapiens
VTQSSTIYD

SEQ ID NO: 932071 - protein, 9 aa, Homo Sapiens
LCHLLANSP

SEQ ID NO: 932072 - protein, 9 aa, Homo Sapiens
DARVPTAEN

SEQ ID NO: 932073 - protein, 9 aa, Homo Sapiens
KKKFSNREY

SEQ ID NO: 932074 - protein, 9 aa, Homo Sapiens
DSAFMKPRY

SEQ ID NO: 932075 - protein, 9 aa, Homo Sapiens
LLPRQRQYL

SEQ ID NO: 932076 - protein, 9 aa, Homo Sapiens
QNEKRINYT

SEQ ID NO: 932077 - protein, 9 aa, Homo Sapiens
DKKIIDANY

SEQ ID NO: 932078 - protein, 9 aa, Homo Sapiens
SLPSQQTAI

SEQ ID NO: 932079 - protein, 9 aa, Homo Sapiens
GIYEPKYIH

SEQ ID NO: 932080 - protein, 9 aa, Homo Sapiens
RKDIDLFPQ

SEQ ID NO: 932081 - protein, 9 aa, Homo Sapiens
VSEISMFPY

SEQ ID NO: 932082 - protein, 9 aa, Homo Sapiens
PQAELAMSK

SEQ ID NO: 932083 - protein, 9 aa, Homo Sapiens
NMALDVKNK

SEQ ID NO: 932084 - protein, 9 aa, Homo Sapiens
AKVINEKTT

SEQ ID NO: 932085 - protein, 9 aa, Homo Sapiens
FFRASPQPQ

SEQ ID NO: 932086 - protein, 9 aa, Homo Sapiens
VHTQLLLAS

SEQ ID NO: 932087 - protein, 9 aa, Homo Sapiens
VGPPGDSGF

SEQ ID NO: 932088 - protein, 9 aa, Homo Sapiens
APQVCLDLG

SEQ ID NO: 932089 - protein, 9 aa, Homo Sapiens
QCDSDVGYI

SEQ ID NO: 932090 - protein, 9 aa, Homo Sapiens
QGFNIRSVQ

SEQ ID NO: 932091 - protein, 9 aa, Homo Sapiens
QTTLLKFTV

SEQ ID NO: 932092 - protein, 9 aa, Homo Sapiens
SLMENLLIV

SEQ ID NO: 932093 - protein, 9 aa, Homo Sapiens
AKPRKDIDL

SEQ ID NO: 932094 - protein, 9 aa, Homo Sapiens
KDRKDVKNE

SEQ ID NO: 932095 - protein, 9 aa, Homo Sapiens
VEQTLSPRS

SEQ ID NO: 932096 - protein, 9 aa, Homo Sapiens
QPFRQLRSH

SEQ ID NO: 932097 - protein, 9 aa, Homo Sapiens
LATMKSRWS

SEQ ID NO: 932098 - protein, 9 aa, Homo Sapiens
TVGCKEMPT

SEQ ID NO: 932099 - protein, 9 aa, Homo Sapiens
RSRLIHVPQ

SEQ ID NO: 932100 - protein, 9 aa, Homo Sapiens
VLTINGEAF

SEQ ID NO: 932101 - protein, 9 aa, Homo Sapiens
NFYAQVSDI

SEQ ID NO: 932102 - protein, 9 aa, Homo Sapiens
NSFERDSMY

SEQ ID NO: 932103 - protein, 9 aa, Homo Sapiens
YEIWRSDLF

SEQ ID NO: 932104 - protein, 9 aa, Homo Sapiens
SAQYPPPPQ

SEQ ID NO: 932105 - protein, 9 aa, Homo Sapiens
ITTQARSSY

SEQ ID NO: 932106 - protein, 9 aa, Homo Sapiens
SFFPVEYIP

SEQ ID NO: 932107 - protein, 9 aa, Homo Sapiens
SYLKDDRSR

SEQ ID NO: 932108 - protein, 9 aa, Homo Sapiens
NQLAKMMDP

SEQ ID NO: 932109 - protein, 9 aa, Homo Sapiens
FCWISGWGM

SEQ ID NO: 932110 - protein, 9 aa, Homo Sapiens
TRDKKGSNY

SEQ ID NO: 932111 - protein, 9 aa, Homo Sapiens
GEMVLLVLM

SEQ ID NO: 932112 - protein, 9 aa, Homo Sapiens
PGDSGFPGM

SEQ ID NO: 932113 - protein, 9 aa, Homo Sapiens
SLYTANPLS

SEQ ID NO: 932114 - protein, 9 aa, Homo Sapiens
WIVCTRLKQ

SEQ ID NO: 932115 - protein, 9 aa, Homo Sapiens
TIEEIDIMA

SEQ ID NO: 932116 - protein, 9 aa, Homo Sapiens
KAAMGIAHL

SEQ ID NO: 932117 - protein, 9 aa, Homo Sapiens
PPPTLQEII

SEQ ID NO: 932118 - protein, 9 aa, Homo Sapiens
NMGLEHNHN

SEQ ID NO: 932119 - protein, 9 aa, Homo Sapiens
RIVSRGRMS

SEQ ID NO: 932120 - protein, 9 aa, Homo Sapiens
DHSSSKRQW

SEQ ID NO: 932121 - protein, 9 aa, Homo Sapiens
QGNKCEEAF

SEQ ID NO: 932122 - protein, 9 aa, Homo Sapiens
SPGPSRPAV

SEQ ID NO: 932123 - protein, 9 aa, Homo Sapiens
KSRTEAEIS

SEQ ID NO: 932124 - protein, 9 aa, Homo Sapiens
GELCKEIST

SEQ ID NO: 932125 - protein, 9 aa, Homo Sapiens
GIFGLDKLL

SEQ ID NO: 932126 - protein, 9 aa, Homo Sapiens
IYPAPCDGR

SEQ ID NO: 932127 - protein, 9 aa, Homo Sapiens
DLLSRWINS

SEQ ID NO: 932128 - protein, 9 aa, Homo Sapiens
SDSGSTATG

SEQ ID NO: 932129 - protein, 9 aa, Homo Sapiens
EEISIWEIR

SEQ ID NO: 932130 - protein, 9 aa, Homo Sapiens
PWGRLHSHC

SEQ ID NO: 932131 - protein, 9 aa, Homo Sapiens
PVKEAEDDN

SEQ ID NO: 932132 - protein, 9 aa, Homo Sapiens
IAFLTLANI

SEQ ID NO: 932133 - protein, 9 aa, Homo Sapiens
RSQFARVPG

SEQ ID NO: 932134 - protein, 9 aa, Homo Sapiens
PSDLSQTHS

SEQ ID NO: 932135 - protein, 9 aa, Homo Sapiens
LILVLFNNY

SEQ ID NO: 932136 - protein, 9 aa, Homo Sapiens
CWWSGRTWI

SEQ ID NO: 932137 - protein, 9 aa, Homo Sapiens
VCFHLQDFD

SEQ ID NO: 932138 - protein, 9 aa, Homo Sapiens
LMSSASSNS

SEQ ID NO: 932139 - protein, 9 aa, Homo Sapiens
FLTLANIKI

SEQ ID NO: 932140 - protein, 9 aa, Homo Sapiens
DSLRTWLKV

SEQ ID NO: 932141 - protein, 9 aa, Homo Sapiens
EWGPLAQIE

SEQ ID NO: 932142 - protein, 9 aa, Homo Sapiens
ILPSMFNWE

SEQ ID NO: 932143 - protein, 9 aa, Homo Sapiens
SMFNWERLG

SEQ ID NO: 932144 - protein, 9 aa, Homo Sapiens
ERGPIDTSP

SEQ ID NO: 932145 - protein, 9 aa, Homo Sapiens
LDHSSSKRQ

SEQ ID NO: 932146 - protein, 9 aa, Homo Sapiens
PQGPPVVKG

SEQ ID NO: 932147 - protein, 9 aa, Homo Sapiens
GKVGPPGER

SEQ ID NO: 932148 - protein, 9 aa, Homo Sapiens
FIIKPVHSS

SEQ ID NO: 932149 - protein, 9 aa, Homo Sapiens
AQIEASLSV

SEQ ID NO: 932150 - protein, 9 aa, Homo Sapiens
PRFFTALAG

SEQ ID NO: 932151 - protein, 9 aa, Homo Sapiens
DFGPRFFTA

SEQ ID NO: 932152 - protein, 9 aa, Homo Sapiens
REALDTYLA

SEQ ID NO: 932153 - protein, 9 aa, Homo Sapiens
MELYSYGEL

SEQ ID NO: 932154 - protein, 9 aa, Homo Sapiens
FQNMSTFLI

SEQ ID NO: 932155 - protein, 9 aa, Homo Sapiens
LSRWINSSF

SEQ ID NO: 932156 - protein, 9 aa, Homo Sapiens
LALCTPLSC

SEQ ID NO: 932157 - protein, 9 aa, Homo Sapiens
SLSGSEDKG

SEQ ID NO: 932158 - protein, 9 aa, Homo Sapiens
PVGRRCGRF

SEQ ID NO: 932159 - protein, 9 aa, Homo Sapiens
IDDASFLEA

SEQ ID NO: 932160 - protein, 9 aa, Homo Sapiens
RVIGDYGKE

SEQ ID NO: 932161 - protein, 9 aa, Homo Sapiens
EEEEAERRA

SEQ ID NO: 932162 - protein, 9 aa, Homo Sapiens
VAHERLGYA

SEQ ID NO: 932163 - protein, 9 aa, Homo Sapiens
HPIKPYGIL

SEQ ID NO: 932164 - protein, 9 aa, Homo Sapiens
YGKEARFPF

SEQ ID NO: 932165 - protein, 9 aa, Homo Sapiens
YTVVDKNAV

SEQ ID NO: 932166 - protein, 9 aa, Homo Sapiens
APRYADTLH

SEQ ID NO: 932167 - protein, 9 aa, Homo Sapiens
PLDHSSSKR

SEQ ID NO: 932168 - protein, 9 aa, Homo Sapiens
DTPLFWRLE

SEQ ID NO: 932169 - protein, 9 aa, Homo Sapiens
FLGNRACTK

SEQ ID NO: 932170 - protein, 9 aa, Homo Sapiens
AHTPVKEAE

SEQ ID NO: 932171 - protein, 9 aa, Homo Sapiens
LCISPNQRH

SEQ ID NO: 932172 - protein, 9 aa, Homo Sapiens
LFAMAVTRF

SEQ ID NO: 932173 - protein, 9 aa, Homo Sapiens
VLNIRFIKV

SEQ ID NO: 932174 - protein, 9 aa, Homo Sapiens
VGSWSLSQQ

SEQ ID NO: 932175 - protein, 9 aa, Homo Sapiens
PLVGSLRPY

SEQ ID NO: 932176 - protein, 9 aa, Homo Sapiens
LHSHCPRHC

SEQ ID NO: 932177 - protein, 9 aa, Homo Sapiens
SGTSGDRPA

SEQ ID NO: 932178 - protein, 9 aa, Homo Sapiens
LDRFYTDRI

SEQ ID NO: 932179 - protein, 9 aa, Homo Sapiens
ESCALGAQS

SEQ ID NO: 932180 - protein, 9 aa, Homo Sapiens
NSEKSKILA

SEQ ID NO: 932181 - protein, 9 aa, Homo Sapiens
LSQTHSLPS

SEQ ID NO: 932182 - protein, 9 aa, Homo Sapiens
MSKVFFKIT

SEQ ID NO: 932183 - protein, 9 aa, Homo Sapiens
ILSAYQGTL

SEQ ID NO: 932184 - protein, 9 aa, Homo Sapiens
EKVNLQKCD

SEQ ID NO: 932185 - protein, 9 aa, Homo Sapiens
QASLEIRFT

SEQ ID NO: 932186 - protein, 9 aa, Homo Sapiens
LMKKIKQEV

SEQ ID NO: 932187 - protein, 9 aa, Homo Sapiens
PWCWWSGRT

SEQ ID NO: 932188 - protein, 9 aa, Homo Sapiens
DTTFFFGYH

SEQ ID NO: 932189 - protein, 9 aa, Homo Sapiens
KLLYDKYYM

SEQ ID NO: 932190 - protein, 9 aa, Homo Sapiens
KPLSYRKLM

SEQ ID NO: 932191 - protein, 9 aa, Homo Sapiens
TVDTTMYKM

SEQ ID NO: 932192 - protein, 9 aa, Homo Sapiens
IFVRENNGT

SEQ ID NO: 932193 - protein, 9 aa, Homo Sapiens
QGVPETIAF

SEQ ID NO: 932194 - protein, 9 aa, Homo Sapiens
YLYWTYQNK

SEQ ID NO: 932195 - protein, 9 aa, Homo Sapiens
AQVVLNQKA

SEQ ID NO: 932196 - protein, 9 aa, Homo Sapiens
PAHIWLTGA

SEQ ID NO: 932197 - protein, 9 aa, Homo Sapiens
VVDKNAVAK

SEQ ID NO: 932198 - protein, 9 aa, Homo Sapiens
SMRMLIPKR

SEQ ID NO: 932199 - protein, 9 aa, Homo Sapiens
IMELYSYGE

SEQ ID NO: 932200 - protein, 9 aa, Homo Sapiens
LHIWIGFLF

SEQ ID NO: 932201 - protein, 9 aa, Homo Sapiens
IRNLVRRCI

SEQ ID NO: 932202 - protein, 9 aa, Homo Sapiens
FLIGLAVGL

SEQ ID NO: 932203 - protein, 9 aa, Homo Sapiens
TFSSRIKSH

SEQ ID NO: 932204 - protein, 9 aa, Homo Sapiens
PPREVEVKY

SEQ ID NO: 932205 - protein, 9 aa, Homo Sapiens
EWSCLCLVY

SEQ ID NO: 932206 - protein, 9 aa, Homo Sapiens
PLSVIGGDH

SEQ ID NO: 932207 - protein, 9 aa, Homo Sapiens
RGGPPRWCM

SEQ ID NO: 932208 - protein, 9 aa, Homo Sapiens
LDQEGREGP

SEQ ID NO: 932209 - protein, 9 aa, Homo Sapiens
LGCLPELPV

SEQ ID NO: 932210 - protein, 9 aa, Homo Sapiens
QKEQAVIPL

SEQ ID NO: 932211 - protein, 9 aa, Homo Sapiens
FFQSNSMNS

SEQ ID NO: 932212 - protein, 9 aa, Homo Sapiens
TFFFGYHLT

SEQ ID NO: 932213 - protein, 9 aa, Homo Sapiens
KKKKKNRKM

SEQ ID NO: 932214 - protein, 9 aa, Homo Sapiens
WEIRILPNF

SEQ ID NO: 932215 - protein, 9 aa, Homo Sapiens
ISAPTPKEK

SEQ ID NO: 932216 - protein, 9 aa, Homo Sapiens
QQVEVDLSF

SEQ ID NO: 932217 - protein, 9 aa, Homo Sapiens
LQEIIQMAA

SEQ ID NO: 932218 - protein, 9 aa, Homo Sapiens
ALALPSPYH

SEQ ID NO: 932219 - protein, 9 aa, Homo Sapiens
NQPLKENEE

SEQ ID NO: 932220 - protein, 9 aa, Homo Sapiens
TYVEYFIIS

SEQ ID NO: 932221 - protein, 9 aa, Homo Sapiens
KKHCQIVKP

SEQ ID NO: 932222 - protein, 9 aa, Homo Sapiens
PLSTLILKE

SEQ ID NO: 932223 - protein, 9 aa, Homo Sapiens
VFMEFVPGG

SEQ ID NO: 932224 - protein, 9 aa, Homo Sapiens
KILCKLSLE

SEQ ID NO: 932225 - protein, 9 aa, Homo Sapiens
KEVIKNKIR

SEQ ID NO: 932226 - protein, 9 aa, Homo Sapiens
PYSCSHCER

SEQ ID NO: 932227 - protein, 9 aa, Homo Sapiens
LAQIEASLS

SEQ ID NO: 932228 - protein, 9 aa, Homo Sapiens
MSPSDSLKP

SEQ ID NO: 932229 - protein, 9 aa, Homo Sapiens
TCIPVLCIF

SEQ ID NO: 932230 - protein, 9 aa, Homo Sapiens
YRISAPTPK

SEQ ID NO: 932231 - protein, 9 aa, Homo Sapiens
EVLVRKEQS

SEQ ID NO: 932232 - protein, 9 aa, Homo Sapiens
SCALGAQSV

SEQ ID NO: 932233 - protein, 9 aa, Homo Sapiens
QENTVSVFM

SEQ ID NO: 932234 - protein, 9 aa, Homo Sapiens
NNNCCRCFW

SEQ ID NO: 932235 - protein, 9 aa, Homo Sapiens
EIIQMAAEI

SEQ ID NO: 932236 - protein, 9 aa, Homo Sapiens
VEFGSSPTS

SEQ ID NO: 932237 - protein, 9 aa, Homo Sapiens
SCEKEGVSA

SEQ ID NO: 932238 - protein, 9 aa, Homo Sapiens
RMLIPKRNP

SEQ ID NO: 932239 - protein, 9 aa, Homo Sapiens
IGGSHALML

SEQ ID NO: 932240 - protein, 9 aa, Homo Sapiens
ENQPLKENE

SEQ ID NO: 932241 - protein, 9 aa, Homo Sapiens
IKNKIRAIG

SEQ ID NO: 932242 - protein, 9 aa, Homo Sapiens
AAIFVRENN

SEQ ID NO: 932243 - protein, 9 aa, Homo Sapiens
KVAGCKAAM

SEQ ID NO: 932244 - protein, 9 aa, Homo Sapiens
CIPVLCIFP

SEQ ID NO: 932245 - protein, 9 aa, Homo Sapiens
NCSKDKVVE

SEQ ID NO: 932246 - protein, 9 aa, Homo Sapiens
LPPIPKDFS

SEQ ID NO: 932247 - protein, 9 aa, Homo Sapiens
AFCLLMILF

SEQ ID NO: 932248 - protein, 9 aa, Homo Sapiens
AATGKAFSG

SEQ ID NO: 932249 - protein, 9 aa, Homo Sapiens
PLADAPTVR

SEQ ID NO: 932250 - protein, 9 aa, Homo Sapiens
ANVSSWLPH

SEQ ID NO: 932251 - protein, 9 aa, Homo Sapiens
SSSGCSTSR

SEQ ID NO: 932252 - protein, 9 aa, Homo Sapiens
QSNSMNSLP

SEQ ID NO: 932253 - protein, 9 aa, Homo Sapiens
KHDECGSGQ

SEQ ID NO: 932254 - protein, 9 aa, Homo Sapiens
NGIDDASFL

SEQ ID NO: 932255 - protein, 9 aa, Homo Sapiens
SHDFSTSPK

SEQ ID NO: 932256 - protein, 9 aa, Homo Sapiens
PLSSKRPAA

SEQ ID NO: 932257 - protein, 9 aa, Homo Sapiens
SLKIVLRGV

SEQ ID NO: 932258 - protein, 9 aa, Homo Sapiens
QYEGVAVIK

SEQ ID NO: 932259 - protein, 9 aa, Homo Sapiens
VHLGQPHST

SEQ ID NO: 932260 - protein, 9 aa, Homo Sapiens
DPSFYSPLS

SEQ ID NO: 932261 - protein, 9 aa, Homo Sapiens
WDNGIDDAS

SEQ ID NO: 932262 - protein, 9 aa, Homo Sapiens
NGPLIMQVG

SEQ ID NO: 932263 - protein, 9 aa, Homo Sapiens
DQEGREGPV

SEQ ID NO: 932264 - protein, 9 aa, Homo Sapiens
KYFFGPNSS

SEQ ID NO: 932265 - protein, 9 aa, Homo Sapiens
LPQDSSLSQ

SEQ ID NO: 932266 - protein, 9 aa, Homo Sapiens
MSTVHKILC

SEQ ID NO: 932267 - protein, 9 aa, Homo Sapiens
SIGTSELTD

SEQ ID NO: 932268 - protein, 9 aa, Homo Sapiens
EPDAQMLDI

SEQ ID NO: 932269 - protein, 9 aa, Homo Sapiens
QLIYQGTKM

SEQ ID NO: 932270 - protein, 9 aa, Homo Sapiens
QKTTFSSRI

SEQ ID NO: 932271 - protein, 9 aa, Homo Sapiens
WHRTLPLSV

SEQ ID NO: 932272 - protein, 9 aa, Homo Sapiens
QACKKHKLY

SEQ ID NO: 932273 - protein, 9 aa, Homo Sapiens
VSGRKMLSA

SEQ ID NO: 932274 - protein, 9 aa, Homo Sapiens
MILFAMAVT

SEQ ID NO: 932275 - protein, 9 aa, Homo Sapiens
VLIVLIYDE

SEQ ID NO: 932276 - protein, 9 aa, Homo Sapiens
DCFLKLCLN

SEQ ID NO: 932277 - protein, 9 aa, Homo Sapiens
SSKEKKKVT

SEQ ID NO: 932278 - protein, 9 aa, Homo Sapiens
MPFPGGRIT

SEQ ID NO: 932279 - protein, 9 aa, Homo Sapiens
LRDPISLYC

SEQ ID NO: 932280 - protein, 9 aa, Homo Sapiens
INSSFPVLE

SEQ ID NO: 932281 - protein, 9 aa, Homo Sapiens
WIGFLFCAV

SEQ ID NO: 932282 - protein, 9 aa, Homo Sapiens
LLPARGAAA

SEQ ID NO: 932283 - protein, 9 aa, Homo Sapiens
ALLPPEQAL

SEQ ID NO: 932284 - protein, 9 aa, Homo Sapiens
VILHIKQNI

SEQ ID NO: 932285 - protein, 9 aa, Homo Sapiens
SGDRPAWPL

SEQ ID NO: 932286 - protein, 9 aa, Homo Sapiens
ILFAMAVTR

SEQ ID NO: 932287 - protein, 9 aa, Homo Sapiens
ATQRFPNNP

SEQ ID NO: 932288 - protein, 9 aa, Homo Sapiens
IWLTGAPLA

SEQ ID NO: 932289 - protein, 9 aa, Homo Sapiens
CIFPPPHPK

SEQ ID NO: 932290 - protein, 9 aa, Homo Sapiens
RQGKSTLWR

SEQ ID NO: 932291 - protein, 9 aa, Homo Sapiens
SPLLEKPAP

SEQ ID NO: 932292 - protein, 9 aa, Homo Sapiens
KVIFYNACA

SEQ ID NO: 932293 - protein, 9 aa, Homo Sapiens
ILVLFNNYI

SEQ ID NO: 932294 - protein, 9 aa, Homo Sapiens
NPKLEGGAR

SEQ ID NO: 932295 - protein, 9 aa, Homo Sapiens
EYFIISGNS

SEQ ID NO: 932296 - protein, 9 aa, Homo Sapiens
VRKACVTPF

SEQ ID NO: 932297 - protein, 9 aa, Homo Sapiens
CKEISTNTE

SEQ ID NO: 932298 - protein, 9 aa, Homo Sapiens
PSMFNWERL

SEQ ID NO: 932299 - protein, 9 aa, Homo Sapiens
DFLDVLEFN

SEQ ID NO: 932300 - protein, 9 aa, Homo Sapiens
NPELERNRL

SEQ ID NO: 932301 - protein, 9 aa, Homo Sapiens
LAAREDRLQ

SEQ ID NO: 932302 - protein, 9 aa, Homo Sapiens
RRPREALDT

SEQ ID NO: 932303 - protein, 9 aa, Homo Sapiens
AEWGPLAQI

SEQ ID NO: 932304 - protein, 9 aa, Homo Sapiens
GNFSSFRAL

SEQ ID NO: 932305 - protein, 9 aa, Homo Sapiens
DFSCTKHDE

SEQ ID NO: 932306 - protein, 9 aa, Homo Sapiens
QDSSLSQMG

SEQ ID NO: 932307 - protein, 9 aa, Homo Sapiens
PSGPQGPPV

SEQ ID NO: 932308 - protein, 9 aa, Homo Sapiens
PGRMSRSQF

SEQ ID NO: 932309 - protein, 9 aa, Homo Sapiens
LKQQGIDIK

SEQ ID NO: 932310 - protein, 9 aa, Homo Sapiens
GDQEIAKTG

SEQ ID NO: 932311 - protein, 9 aa, Homo Sapiens
VEVDLSFPE

SEQ ID NO: 932312 - protein, 9 aa, Homo Sapiens
VGMKSCGIH

SEQ ID NO: 932313 - protein, 9 aa, Homo Sapiens
RCFWVECVD

SEQ ID NO: 932314 - protein, 9 aa, Homo Sapiens
KKPLSYRKL

SEQ ID NO: 932315 - protein, 9 aa, Homo Sapiens
KKKNRKMVN

SEQ ID NO: 932316 - protein, 9 aa, Homo Sapiens
EAAEAVLSS

SEQ ID NO: 932317 - protein, 9 aa, Homo Sapiens
FIISGNSQN

SEQ ID NO: 932318 - protein, 9 aa, Homo Sapiens
ERGPKGEKG

SEQ ID NO: 932319 - protein, 9 aa, Homo Sapiens
KEKVNLQKC

SEQ ID NO: 932320 - protein, 9 aa, Homo Sapiens
GGSHALMLP

SEQ ID NO: 932321 - protein, 9 aa, Homo Sapiens
TYPADPSFY

SEQ ID NO: 932322 - protein, 9 aa, Homo Sapiens
ERRAPEGPR

SEQ ID NO: 932323 - protein, 9 aa, Homo Sapiens
SASSNSSGS

SEQ ID NO: 932324 - protein, 9 aa, Homo Sapiens
TWLKVIQVE

SEQ ID NO: 932325 - protein, 9 aa, Homo Sapiens
GCSTSRPRP

SEQ ID NO: 932326 - protein, 9 aa, Homo Sapiens
DDRVIGDYG

SEQ ID NO: 932327 - protein, 9 aa, Homo Sapiens
CGVRKACVT

SEQ ID NO: 932328 - protein, 9 aa, Homo Sapiens
IEDTINLPG

SEQ ID NO: 932329 - protein, 9 aa, Homo Sapiens
ELGEHPPRS

SEQ ID NO: 932330 - protein, 9 aa, Homo Sapiens
LPPQKKLWE

SEQ ID NO: 932331 - protein, 9 aa, Homo Sapiens
ATGYLLRKQ

SEQ ID NO: 932332 - protein, 9 aa, Homo Sapiens
RNGKANFDC

SEQ ID NO: 932333 - protein, 9 aa, Homo Sapiens
LFNFTACHQ

SEQ ID NO: 932334 - protein, 9 aa, Homo Sapiens
PRSVASIYV

SEQ ID NO: 932335 - protein, 9 aa, Homo Sapiens
NDALVLYYK

SEQ ID NO: 932336 - protein, 9 aa, Homo Sapiens
LAPFMKHSL

SEQ ID NO: 932337 - protein, 9 aa, Homo Sapiens
SKWKKHCQI

SEQ ID NO: 932338 - protein, 9 aa, Homo Sapiens
YWTYQNKEM

SEQ ID NO: 932339 - protein, 9 aa, Homo Sapiens
ENGPLIMQV

SEQ ID NO: 932340 - protein, 9 aa, Homo Sapiens
TDGNKDMAF

SEQ ID NO: 932341 - protein, 9 aa, Homo Sapiens
PVWPNPKLE

SEQ ID NO: 932342 - protein, 9 aa, Homo Sapiens
SCSKVAGCK

SEQ ID NO: 932343 - protein, 9 aa, Homo Sapiens
VRWEIFWSE

SEQ ID NO: 932344 - protein, 9 aa, Homo Sapiens
LRGKGHLEA

SEQ ID NO: 932345 - protein, 9 aa, Homo Sapiens
YVPSPAVPK

SEQ ID NO: 932346 - protein, 9 aa, Homo Sapiens
AKLHDVQNI

SEQ ID NO: 932347 - protein, 9 aa, Homo Sapiens
QYTVVDKNA

SEQ ID NO: 932348 - protein, 9 aa, Homo Sapiens
LAVCFHLQD

SEQ ID NO: 932349 - protein, 9 aa, Homo Sapiens
TVKHNNIRN

SEQ ID NO: 932350 - protein, 9 aa, Homo Sapiens
MLPPQKKLW

SEQ ID NO: 932351 - protein, 9 aa, Homo Sapiens
NTYVEYFII

SEQ ID NO: 932352 - protein, 9 aa, Homo Sapiens
ENTTVFFFS

SEQ ID NO: 932353 - protein, 9 aa, Homo Sapiens
VTKTASISS

SEQ ID NO: 932354 - protein, 9 aa, Homo Sapiens
EVIKNKIRA

SEQ ID NO: 932355 - protein, 9 aa, Homo Sapiens
KVQPTNVLP

SEQ ID NO: 932356 - protein, 9 aa, Homo Sapiens
LAKLVQEMK

SEQ ID NO: 932357 - protein, 9 aa, Homo Sapiens
EKSKILAKR

SEQ ID NO: 932358 - protein, 9 aa, Homo Sapiens
GNLSMWSNQ

SEQ ID NO: 932359 - protein, 9 aa, Homo Sapiens
MVFSEGPLR

SEQ ID NO: 932360 - protein, 9 aa, Homo Sapiens
WRLESPRAW

SEQ ID NO: 932361 - protein, 9 aa, Homo Sapiens
PRPVWPNPK

SEQ ID NO: 932362 - protein, 9 aa, Homo Sapiens
EGVAVIKMF

SEQ ID NO: 932363 - protein, 9 aa, Homo Sapiens
ASSSAAIFV

SEQ ID NO: 932364 - protein, 9 aa, Homo Sapiens
PISLYCGHD

SEQ ID NO: 932365 - protein, 9 aa, Homo Sapiens
VALSPARSL

SEQ ID NO: 932366 - protein, 9 aa, Homo Sapiens
CNRRQRENR

SEQ ID NO: 932367 - protein, 9 aa, Homo Sapiens
KLVQEMKSI

SEQ ID NO: 932368 - protein, 9 aa, Homo Sapiens
RWCMERPPS

SEQ ID NO: 932369 - protein, 9 aa, Homo Sapiens
KDCEDGKDA

SEQ ID NO: 932370 - protein, 9 aa, Homo Sapiens
RTWLKVIQV

SEQ ID NO: 932371 - protein, 9 aa, Homo Sapiens
YRKLMDTDL

SEQ ID NO: 932372 - protein, 9 aa, Homo Sapiens
VIKMFDKVK

SEQ ID NO: 932373 - protein, 9 aa, Homo Sapiens
PSPVECRNS

SEQ ID NO: 932374 - protein, 9 aa, Homo Sapiens
KKLWESMAK

SEQ ID NO: 932375 - protein, 9 aa, Homo Sapiens
FYSPLSSPA

SEQ ID NO: 932376 - protein, 9 aa, Homo Sapiens
TMYKMQALA

SEQ ID NO: 932377 - protein, 9 aa, Homo Sapiens
ISCKSRGRE

SEQ ID NO: 932378 - protein, 9 aa, Homo Sapiens
SYYITDGNK

SEQ ID NO: 932379 - protein, 9 aa, Homo Sapiens
TQRFPNNPH

SEQ ID NO: 932380 - protein, 9 aa, Homo Sapiens
PETIAFLTL

SEQ ID NO: 932381 - protein, 9 aa, Homo Sapiens
LRALEAQKE

SEQ ID NO: 932382 - protein, 9 aa, Homo Sapiens
KLDLGFLSP

SEQ ID NO: 932383 - protein, 9 aa, Homo Sapiens
ATEKSRWSG

SEQ ID NO: 932384 - protein, 9 aa, Homo Sapiens
GGSWENINR

SEQ ID NO: 932385 - protein, 9 aa, Homo Sapiens
RSVASIYVP

SEQ ID NO: 932386 - protein, 9 aa, Homo Sapiens
GPIDTSPNI

SEQ ID NO: 932387 - protein, 9 aa, Homo Sapiens
SSALLPPEQ

SEQ ID NO: 932388 - protein, 9 aa, Homo Sapiens
FFFLHFPLF

SEQ ID NO: 932389 - protein, 9 aa, Homo Sapiens
NFTDVTEFM

SEQ ID NO: 932390 - protein, 9 aa, Homo Sapiens
PSERPAVAM

SEQ ID NO: 932391 - protein, 9 aa, Homo Sapiens
PLLEKPAPS

SEQ ID NO: 932392 - protein, 9 aa, Homo Sapiens
REESCALGA

SEQ ID NO: 932393 - protein, 9 aa, Homo Sapiens
YQLIYQGTK

SEQ ID NO: 932394 - protein, 9 aa, Homo Sapiens
STSISGMTA

SEQ ID NO: 932395 - protein, 9 aa, Homo Sapiens
SYRKLMDTD

SEQ ID NO: 932396 - protein, 9 aa, Homo Sapiens
MLAAREDRL

SEQ ID NO: 932397 - protein, 9 aa, Homo Sapiens
WCMERPPSG

SEQ ID NO: 932398 - protein, 9 aa, Homo Sapiens
KCEEAFNDS

SEQ ID NO: 932399 - protein, 9 aa, Homo Sapiens
FHWFDYHGH

SEQ ID NO: 932400 - protein, 9 aa, Homo Sapiens
DLQAQSKEN

SEQ ID NO: 932401 - protein, 9 aa, Homo Sapiens
EDFIIKPVH

SEQ ID NO: 932402 - protein, 9 aa, Homo Sapiens
YVFGPNGRS

SEQ ID NO: 932403 - protein, 9 aa, Homo Sapiens
AGPAAQRFA

SEQ ID NO: 932404 - protein, 9 aa, Homo Sapiens
VLKKVQPTN

SEQ ID NO: 932405 - protein, 9 aa, Homo Sapiens
AAQRFAAAA

SEQ ID NO: 932406 - protein, 9 aa, Homo Sapiens
AHCCSQLEK

SEQ ID NO: 932407 - protein, 9 aa, Homo Sapiens
GRVLAKLVQ

SEQ ID NO: 932408 - protein, 9 aa, Homo Sapiens
RLSPWSSTS

SEQ ID NO: 932409 - protein, 9 aa, Homo Sapiens
APSPGPSRP

SEQ ID NO: 932410 - protein, 9 aa, Homo Sapiens
PREESCALG

SEQ ID NO: 932411 - protein, 9 aa, Homo Sapiens
REISSPKIQ

SEQ ID NO: 932412 - protein, 9 aa, Homo Sapiens
EKEGVSAQP

SEQ ID NO: 932413 - protein, 9 aa, Homo Sapiens
NNGIVTKLK

SEQ ID NO: 932414 - protein, 9 aa, Homo Sapiens
EDYSELGEH

SEQ ID NO: 932415 - protein, 9 aa, Homo Sapiens
LTQDRPGSL

SEQ ID NO: 932416 - protein, 9 aa, Homo Sapiens
VCLTADSLR

SEQ ID NO: 932417 - protein, 9 aa, Homo Sapiens
ELGCNKEKE

SEQ ID NO: 932418 - protein, 9 aa, Homo Sapiens
TKLDMNLST

SEQ ID NO: 932419 - protein, 9 aa, Homo Sapiens
TDRISFRML

SEQ ID NO: 932420 - protein, 9 aa, Homo Sapiens
LSEANEGPF

SEQ ID NO: 932421 - protein, 9 aa, Homo Sapiens
CTWWSGTWR

SEQ ID NO: 932422 - protein, 9 aa, Homo Sapiens
FPGGRITLQ

SEQ ID NO: 932423 - protein, 9 aa, Homo Sapiens
EAEPAEKVQ

SEQ ID NO: 932424 - protein, 9 aa, Homo Sapiens
INYEENKLY

SEQ ID NO: 932425 - protein, 9 aa, Homo Sapiens
LVQLLRVCT

SEQ ID NO: 932426 - protein, 9 aa, Homo Sapiens
YDMAKLLYD

SEQ ID NO: 932427 - protein, 9 aa, Homo Sapiens
ALFPMAEDI

SEQ ID NO: 932428 - protein, 9 aa, Homo Sapiens
STSGTSGDR

SEQ ID NO: 932429 - protein, 9 aa, Homo Sapiens
PPSSEKLQA

SEQ ID NO: 932430 - protein, 9 aa, Homo Sapiens
RPREALDTY

SEQ ID NO: 932431 - protein, 9 aa, Homo Sapiens
AQPKDCEDG

SEQ ID NO: 932432 - protein, 9 aa, Homo Sapiens
TIFSVIFLL

SEQ ID NO: 932433 - protein, 9 aa, Homo Sapiens
KSTLWRSYR

SEQ ID NO: 932434 - protein, 9 aa, Homo Sapiens
FGNFSSFRA

SEQ ID NO: 932435 - protein, 9 aa, Homo Sapiens
LPEPPRAPE

SEQ ID NO: 932436 - protein, 9 aa, Homo Sapiens
TPLSCLKQE

SEQ ID NO: 932437 - protein, 9 aa, Homo Sapiens
TYPEPIYST

SEQ ID NO: 932438 - protein, 9 aa, Homo Sapiens
CSTSRPRPQ

SEQ ID NO: 932439 - protein, 9 aa, Homo Sapiens
PGRPRSKQE

SEQ ID NO: 932440 - protein, 9 aa, Homo Sapiens
VAVIKMFDK

SEQ ID NO: 932441 - protein, 9 aa, Homo Sapiens
NNIRNLVRR

SEQ ID NO: 932442 - protein, 9 aa, Homo Sapiens
AERRAPEGP

SEQ ID NO: 932443 - protein, 9 aa, Homo Sapiens
GSHALMLPL

SEQ ID NO: 932444 - protein, 9 aa, Homo Sapiens
PREVEVKYS

SEQ ID NO: 932445 - protein, 9 aa, Homo Sapiens
VAAVYEHPC

SEQ ID NO: 932446 - protein, 9 aa, Homo Sapiens
AQKKLYRDV

SEQ ID NO: 932447 - protein, 9 aa, Homo Sapiens
SDLSQTHSL

SEQ ID NO: 932448 - protein, 9 aa, Homo Sapiens
GPQGPPVVK

SEQ ID NO: 932449 - protein, 9 aa, Homo Sapiens
EDIMITVIL

SEQ ID NO: 932450 - protein, 9 aa, Homo Sapiens
SPLETEFPL

SEQ ID NO: 932451 - protein, 9 aa, Homo Sapiens
LYWTYQNKE

SEQ ID NO: 932452 - protein, 9 aa, Homo Sapiens
APYLSANVS

SEQ ID NO: 932453 - protein, 9 aa, Homo Sapiens
GVHLGQPHS

SEQ ID NO: 932454 - protein, 9 aa, Homo Sapiens
FFLHFPLFE

SEQ ID NO: 932455 - protein, 9 aa, Homo Sapiens
NTVSVFMEF

SEQ ID NO: 932456 - protein, 9 aa, Homo Sapiens
LQAQSKENP

SEQ ID NO: 932457 - protein, 9 aa, Homo Sapiens
QDTTFFFGY

SEQ ID NO: 932458 - protein, 9 aa, Homo Sapiens
RSPSSALLP

SEQ ID NO: 932459 - protein, 9 aa, Homo Sapiens
SLRPASTSL

SEQ ID NO: 932460 - protein, 9 aa, Homo Sapiens
NGISINYEE

SEQ ID NO: 932461 - protein, 9 aa, Homo Sapiens
TFENITQKV

SEQ ID NO: 932462 - protein, 9 aa, Homo Sapiens
RGKGHLEAG

SEQ ID NO: 932463 - protein, 9 aa, Homo Sapiens
RGPIDTSPN

SEQ ID NO: 932464 - protein, 9 aa, Homo Sapiens
PHAEQPAAE

SEQ ID NO: 932465 - protein, 9 aa, Homo Sapiens
SRSQFARVP

SEQ ID NO: 932466 - protein, 9 aa, Homo Sapiens
ETPKSCSKV

SEQ ID NO: 932467 - protein, 9 aa, Homo Sapiens
NVCLTADSL

SEQ ID NO: 932468 - protein, 9 aa, Homo Sapiens
GMKGLEGTA

SEQ ID NO: 932469 - protein, 9 aa, Homo Sapiens
EVEVKYSTV

SEQ ID NO: 932470 - protein, 9 aa, Homo Sapiens
LSRMPFPGG

SEQ ID NO: 932471 - protein, 9 aa, Homo Sapiens
RVGFLQGDI

SEQ ID NO: 932472 - protein, 9 aa, Homo Sapiens
FLIEDKVIF

SEQ ID NO: 932473 - protein, 9 aa, Homo Sapiens
GVPYYAEAD

SEQ ID NO: 932474 - protein, 9 aa, Homo Sapiens
FTEQSLLII

SEQ ID NO: 932475 - protein, 9 aa, Homo Sapiens
CASVPKIAA

SEQ ID NO: 932476 - protein, 9 aa, Homo Sapiens
ISSIGTSEL

SEQ ID NO: 932477 - protein, 9 aa, Homo Sapiens
YPAPCDGRL

SEQ ID NO: 932478 - protein, 9 aa, Homo Sapiens
LQGPKGMKG

SEQ ID NO: 932479 - protein, 9 aa, Homo Sapiens
IDVEVMNSL

SEQ ID NO: 932480 - protein, 9 aa, Homo Sapiens
FFFSSFQYL

SEQ ID NO: 932481 - protein, 9 aa, Homo Sapiens
LIQLDQEGR

SEQ ID NO: 932482 - protein, 9 aa, Homo Sapiens
VNLQKCDIL

SEQ ID NO: 932483 - protein, 9 aa, Homo Sapiens
VAVTFPITH

SEQ ID NO: 932484 - protein, 9 aa, Homo Sapiens
TVSVFMEFV

SEQ ID NO: 932485 - protein, 9 aa, Homo Sapiens
ILCISPNQR

SEQ ID NO: 932486 - protein, 9 aa, Homo Sapiens
VEYFIISGN

SEQ ID NO: 932487 - protein, 9 aa, Homo Sapiens
VDTTMYKMQ

SEQ ID NO: 932488 - protein, 9 aa, Homo Sapiens
KPYGILILG

SEQ ID NO: 932489 - protein, 9 aa, Homo Sapiens
PSRKAPSPG

SEQ ID NO: 932490 - protein, 9 aa, Homo Sapiens
SKKKKKKNR

SEQ ID NO: 932491 - protein, 9 aa, Homo Sapiens
EEKVHSMSR

SEQ ID NO: 932492 - protein, 9 aa, Homo Sapiens
GIVTKLKSR

SEQ ID NO: 932493 - protein, 9 aa, Homo Sapiens
ILEEAQKVS

SEQ ID NO: 932494 - protein, 9 aa, Homo Sapiens
MFHWFDYHG

SEQ ID NO: 932495 - protein, 9 aa, Homo Sapiens
ISSTSISGM

SEQ ID NO: 932496 - protein, 9 aa, Homo Sapiens
IKKNEEKNN

SEQ ID NO: 932497 - protein, 9 aa, Homo Sapiens
GKSTLWRSY

SEQ ID NO: 932498 - protein, 9 aa, Homo Sapiens
GPPLMKKIK

SEQ ID NO: 932499 - protein, 9 aa, Homo Sapiens
PARDFGPRF

SEQ ID NO: 932500 - protein, 9 aa, Homo Sapiens
PPRWCMERP

SEQ ID NO: 932501 - protein, 9 aa, Homo Sapiens
GDYGKEARF

SEQ ID NO: 932502 - protein, 9 aa, Homo Sapiens
VGSLRPYMV

SEQ ID NO: 932503 - protein, 9 aa, Homo Sapiens
YGHAAPGTN

SEQ ID NO: 932504 - protein, 9 aa, Homo Sapiens
PEENITSND

SEQ ID NO: 932505 - protein, 9 aa, Homo Sapiens
VIVLIVLIY

SEQ ID NO: 932506 - protein, 9 aa, Homo Sapiens
VGFLQGDIR

SEQ ID NO: 932507 - protein, 9 aa, Homo Sapiens
PKQSGLGEL

SEQ ID NO: 932508 - protein, 9 aa, Homo Sapiens
SPYHVGPIC

SEQ ID NO: 932509 - protein, 9 aa, Homo Sapiens
RAIDVTLTI

SEQ ID NO: 932510 - protein, 9 aa, Homo Sapiens
QNPATFQHP

SEQ ID NO: 932511 - protein, 9 aa, Homo Sapiens
TSGTSGDRP

SEQ ID NO: 932512 - protein, 9 aa, Homo Sapiens
GSWENINRY

SEQ ID NO: 932513 - protein, 9 aa, Homo Sapiens
RTLPLSVIG

SEQ ID NO: 932514 - protein, 9 aa, Homo Sapiens
FLHFPLFES

SEQ ID NO: 932515 - protein, 9 aa, Homo Sapiens
QGPPVVKGE

SEQ ID NO: 932516 - protein, 9 aa, Homo Sapiens
NEPDAQMLD

SEQ ID NO: 932517 - protein, 9 aa, Homo Sapiens
DRPGSLSGS

SEQ ID NO: 932518 - protein, 9 aa, Homo Sapiens
QKEMREKEE

SEQ ID NO: 932519 - protein, 9 aa, Homo Sapiens
NMSTFLIGL

SEQ ID NO: 932520 - protein, 9 aa, Homo Sapiens
TIDVEVMNS

SEQ ID NO: 932521 - protein, 9 aa, Homo Sapiens
ALPGTHILE

SEQ ID NO: 932522 - protein, 9 aa, Homo Sapiens
MKKIKQEVE

SEQ ID NO: 932523 - protein, 9 aa, Homo Sapiens
IGTSELTDM

SEQ ID NO: 932524 - protein, 9 aa, Homo Sapiens
DSLKPGLGP

SEQ ID NO: 932525 - protein, 9 aa, Homo Sapiens
FNVEIRQFF

SEQ ID NO: 932526 - protein, 9 aa, Homo Sapiens
EKSGELCKE

SEQ ID NO: 932527 - protein, 9 aa, Homo Sapiens
NLCVMANPT

SEQ ID NO: 932528 - protein, 9 aa, Homo Sapiens
RRTSLPQDS

SEQ ID NO: 932529 - protein, 9 aa, Homo Sapiens
EPSERPAVA

SEQ ID NO: 932530 - protein, 9 aa, Homo Sapiens
TEKSRWSGS

SEQ ID NO: 932531 - protein, 9 aa, Homo Sapiens
TSKKGLASK

SEQ ID NO: 932532 - protein, 9 aa, Homo Sapiens
GFLFCAVYM

SEQ ID NO: 932533 - protein, 9 aa, Homo Sapiens
RWGRLLPAR

SEQ ID NO: 932534 - protein, 9 aa, Homo Sapiens
EKNVDIACR

SEQ ID NO: 932535 - protein, 9 aa, Homo Sapiens
PRRTSLPQD

SEQ ID NO: 932536 - protein, 9 aa, Homo Sapiens
VKHNNIRNL

SEQ ID NO: 932537 - protein, 9 aa, Homo Sapiens
TSLPQDSSL

SEQ ID NO: 932538 - protein, 9 aa, Homo Sapiens
LENQPLKEN

SEQ ID NO: 932539 - protein, 9 aa, Homo Sapiens
RQRENRVKT

SEQ ID NO: 932540 - protein, 9 aa, Homo Sapiens
FCLLMILFA

SEQ ID NO: 932541 - protein, 9 aa, Homo Sapiens
EEMEAHTPV

SEQ ID NO: 932542 - protein, 9 aa, Homo Sapiens
PLSCLKQEV

SEQ ID NO: 932543 - protein, 9 aa, Homo Sapiens
KLWESMAKG

SEQ ID NO: 932544 - protein, 9 aa, Homo Sapiens
LVGSLRPYM

SEQ ID NO: 932545 - protein, 9 aa, Homo Sapiens
QTPWCWWSG

SEQ ID NO: 932546 - protein, 9 aa, Homo Sapiens
RPSRRFLSK

SEQ ID NO: 932547 - protein, 9 aa, Homo Sapiens
TLREEKVHS

SEQ ID NO: 932548 - protein, 9 aa, Homo Sapiens
GYPFRLFNF

SEQ ID NO: 932549 - protein, 9 aa, Homo Sapiens
WPTSSSGCS

SEQ ID NO: 932550 - protein, 9 aa, Homo Sapiens
AKLDSRAID

SEQ ID NO: 932551 - protein, 9 aa, Homo Sapiens
EIAKTGKFL

SEQ ID NO: 932552 - protein, 9 aa, Homo Sapiens
FPMAEDISL

SEQ ID NO: 932553 - protein, 9 aa, Homo Sapiens
HIWIGFLFC

SEQ ID NO: 932554 - protein, 9 aa, Homo Sapiens
VLIYDEQIV

SEQ ID NO: 932555 - protein, 9 aa, Homo Sapiens
CSKVAGCKA

SEQ ID NO: 932556 - protein, 9 aa, Homo Sapiens
MVMVLKKVQ

SEQ ID NO: 932557 - protein, 9 aa, Homo Sapiens
EVCASVPKI

SEQ ID NO: 932558 - protein, 9 aa, Homo Sapiens
VLAKLVQEM

SEQ ID NO: 932559 - protein, 9 aa, Homo Sapiens
VQLLRVCTR

SEQ ID NO: 932560 - protein, 9 aa, Homo Sapiens
GYAFSVWRM

SEQ ID NO: 932561 - protein, 9 aa, Homo Sapiens
RDYDALFPM

SEQ ID NO: 932562 - protein, 9 aa, Homo Sapiens
VEVLHSGPS

SEQ ID NO: 932563 - protein, 9 aa, Homo Sapiens
VTVDTTMYK

SEQ ID NO: 932564 - protein, 9 aa, Homo Sapiens
GPKGMKGLE

SEQ ID NO: 932565 - protein, 9 aa, Homo Sapiens
LEFFQSNSM

SEQ ID NO: 932566 - protein, 9 aa, Homo Sapiens
IIFALLPKP

SEQ ID NO: 932567 - protein, 9 aa, Homo Sapiens
STPLVGSLR

SEQ ID NO: 932568 - protein, 9 aa, Homo Sapiens
LVLFNNYIT

SEQ ID NO: 932569 - protein, 9 aa, Homo Sapiens
LASKAGFLP

SEQ ID NO: 932570 - protein, 9 aa, Homo Sapiens
KSRGREGGG

SEQ ID NO: 932571 - protein, 9 aa, Homo Sapiens
PEPPRAPEP

SEQ ID NO: 932572 - protein, 9 aa, Homo Sapiens
RDQQKEQAV

SEQ ID NO: 932573 - protein, 9 aa, Homo Sapiens
RKACVTPFL

SEQ ID NO: 932574 - protein, 9 aa, Homo Sapiens
RPAWPLSTS

SEQ ID NO: 932575 - protein, 9 aa, Homo Sapiens
FCNHFVSNA

SEQ ID NO: 932576 - protein, 9 aa, Homo Sapiens
HCQIVKPGF

SEQ ID NO: 932577 - protein, 9 aa, Homo Sapiens
IGFLFCAVY

SEQ ID NO: 932578 - protein, 9 aa, Homo Sapiens
SELGEHPPR

SEQ ID NO: 932579 - protein, 9 aa, Homo Sapiens
SLKRPPLAD

SEQ ID NO: 932580 - protein, 9 aa, Homo Sapiens
FWVECVDLL

SEQ ID NO: 932581 - protein, 9 aa, Homo Sapiens
GREGGGGGF

SEQ ID NO: 932582 - protein, 9 aa, Homo Sapiens
VQNILDSVS

SEQ ID NO: 932583 - protein, 9 aa, Homo Sapiens
TSSSGCSTS

SEQ ID NO: 932584 - protein, 9 aa, Homo Sapiens
PSGPEGVPY

SEQ ID NO: 932585 - protein, 9 aa, Homo Sapiens
EDVTQIVEV

SEQ ID NO: 932586 - protein, 9 aa, Homo Sapiens
TYQNKEMEF

SEQ ID NO: 932587 - protein, 9 aa, Homo Sapiens
KMQALASTL

SEQ ID NO: 932588 - protein, 9 aa, Homo Sapiens
TSFVGMKSC

SEQ ID NO: 932589 - protein, 9 aa, Homo Sapiens
ENITSNDGP

SEQ ID NO: 932590 - protein, 9 aa, Homo Sapiens
SSRTRPCTW

SEQ ID NO: 932591 - protein, 9 aa, Homo Sapiens
TKLLADSLR

SEQ ID NO: 932592 - protein, 9 aa, Homo Sapiens
QLDQEGREG

SEQ ID NO: 932593 - protein, 9 aa, Homo Sapiens
EAWSTHNTV

SEQ ID NO: 932594 - protein, 9 aa, Homo Sapiens
DEDFIIKPV

SEQ ID NO: 932595 - protein, 9 aa, Homo Sapiens
MVLKKVQPT

SEQ ID NO: 932596 - protein, 9 aa, Homo Sapiens
VEVKYSTVA

SEQ ID NO: 932597 - protein, 9 aa, Homo Sapiens
SPCDLRGKG

SEQ ID NO: 932598 - protein, 9 aa, Homo Sapiens
NLDEDFIIK

SEQ ID NO: 932599 - protein, 9 aa, Homo Sapiens
VASIYVPSP

SEQ ID NO: 932600 - protein, 9 aa, Homo Sapiens
YRGYQGRVF

SEQ ID NO: 932601 - protein, 9 aa, Homo Sapiens
SVFMEFVPG

SEQ ID NO: 932602 - protein, 9 aa, Homo Sapiens
PRPQTPWCW

SEQ ID NO: 932603 - protein, 9 aa, Homo Sapiens
DGSKWKKHC

SEQ ID NO: 932604 - protein, 9 aa, Homo Sapiens
DPISLYCGH

SEQ ID NO: 932605 - protein, 9 aa, Homo Sapiens
SPVECRNSF

SEQ ID NO: 932606 - protein, 9 aa, Homo Sapiens
SSAVGSWSL

SEQ ID NO: 932607 - protein, 9 aa, Homo Sapiens
VFSEGPLRR

SEQ ID NO: 932608 - protein, 9 aa, Homo Sapiens
RPQTPWCWW

SEQ ID NO: 932609 - protein, 9 aa, Homo Sapiens
PHVSGRKML

SEQ ID NO: 932610 - protein, 9 aa, Homo Sapiens
AYDMAKLLY

SEQ ID NO: 932611 - protein, 9 aa, Homo Sapiens
QSPVGRRCG

SEQ ID NO: 932612 - protein, 9 aa, Homo Sapiens
FFGYHLTLP

SEQ ID NO: 932613 - protein, 9 aa, Homo Sapiens
IPCTLIVIL

SEQ ID NO: 932614 - protein, 9 aa, Homo Sapiens
NPTGNLSMW

SEQ ID NO: 932615 - protein, 9 aa, Homo Sapiens
RWGRRPWPT

SEQ ID NO: 932616 - protein, 9 aa, Homo Sapiens
KNRKMVNDA

SEQ ID NO: 932617 - protein, 9 aa, Homo Sapiens
SSANMGLEH

SEQ ID NO: 932618 - protein, 9 aa, Homo Sapiens
HVEPSERPA

SEQ ID NO: 932619 - protein, 9 aa, Homo Sapiens
QGTLLPANI

SEQ ID NO: 932620 - protein, 9 aa, Homo Sapiens
TLIVILSWV

SEQ ID NO: 932621 - protein, 9 aa, Homo Sapiens
CRNSFAFTP

SEQ ID NO: 932622 - protein, 9 aa, Homo Sapiens
QGKSTLWRS

SEQ ID NO: 932623 - protein, 9 aa, Homo Sapiens
YDALFPMAE

SEQ ID NO: 932624 - protein, 9 aa, Homo Sapiens
LADAPTVRA

SEQ ID NO: 932625 - protein, 9 aa, Homo Sapiens
LDKLGNRLE

SEQ ID NO: 932626 - protein, 9 aa, Homo Sapiens
EESCALGAQ

SEQ ID NO: 932627 - protein, 9 aa, Homo Sapiens
SSASLYQQN

SEQ ID NO: 932628 - protein, 9 aa, Homo Sapiens
REVEVKYST

SEQ ID NO: 932629 - protein, 9 aa, Homo Sapiens
ETREVLVRK

SEQ ID NO: 932630 - protein, 9 aa, Homo Sapiens
EKVQAPEGL

SEQ ID NO: 932631 - protein, 9 aa, Homo Sapiens
KWKKHCQIV

SEQ ID NO: 932632 - protein, 9 aa, Homo Sapiens
FGAKARRHI

SEQ ID NO: 932633 - protein, 9 aa, Homo Sapiens
REALSSCPS

SEQ ID NO: 932634 - protein, 9 aa, Homo Sapiens
VILCISPNQ

SEQ ID NO: 932635 - protein, 9 aa, Homo Sapiens
GRKTFLILV

SEQ ID NO: 932636 - protein, 9 aa, Homo Sapiens
VSSWLPHLP

SEQ ID NO: 932637 - protein, 9 aa, Homo Sapiens
RYYAGWAYK

SEQ ID NO: 932638 - protein, 9 aa, Homo Sapiens
DVTEFMLLG

SEQ ID NO: 932639 - protein, 9 aa, Homo Sapiens
TAVVEFGSS

SEQ ID NO: 932640 - protein, 9 aa, Homo Sapiens
LEAIIFALL

SEQ ID NO: 932641 - protein, 9 aa, Homo Sapiens
PLETEFPLN

SEQ ID NO: 932642 - protein, 9 aa, Homo Sapiens
TEFMLLGLT

SEQ ID NO: 932643 - protein, 9 aa, Homo Sapiens
FLADVEGVS

SEQ ID NO: 932644 - protein, 9 aa, Homo Sapiens
NRKLFDFLD

SEQ ID NO: 932645 - protein, 9 aa, Homo Sapiens
LSFPEDCLQ

SEQ ID NO: 932646 - protein, 9 aa, Homo Sapiens
SCLKQEVAT

SEQ ID NO: 932647 - protein, 9 aa, Homo Sapiens
LCLVYQITT

SEQ ID NO: 932648 - protein, 9 aa, Homo Sapiens
IWIGFLFCA

SEQ ID NO: 932649 - protein, 9 aa, Homo Sapiens
QRDQQKEQA

SEQ ID NO: 932650 - protein, 9 aa, Homo Sapiens
QRFAAAASW

SEQ ID NO: 932651 - protein, 9 aa, Homo Sapiens
IANIQSNIG

SEQ ID NO: 932652 - protein, 9 aa, Homo Sapiens
LLPANILDW

SEQ ID NO: 932653 - protein, 9 aa, Homo Sapiens
DKLGNRLEE

SEQ ID NO: 932654 - protein, 9 aa, Homo Sapiens
QKQACKKHK

SEQ ID NO: 932655 - protein, 9 aa, Homo Sapiens
KVGPPGERG

SEQ ID NO: 932656 - protein, 9 aa, Homo Sapiens
AVGRVGSTF

SEQ ID NO: 932657 - protein, 9 aa, Homo Sapiens
ISSANMGLE

SEQ ID NO: 932658 - protein, 9 aa, Homo Sapiens
IKEKLSQDI

SEQ ID NO: 932659 - protein, 9 aa, Homo Sapiens
AWPNGISIN

SEQ ID NO: 932660 - protein, 9 aa, Homo Sapiens
LDEDFIIKP

SEQ ID NO: 932661 - protein, 9 aa, Homo Sapiens
SGPEGVPYY

SEQ ID NO: 932662 - protein, 9 aa, Homo Sapiens
PGERGPKGE

SEQ ID NO: 932663 - protein, 9 aa, Homo Sapiens
FLYACAFAS

SEQ ID NO: 932664 - protein, 9 aa, Homo Sapiens
GLPEPPRAP

SEQ ID NO: 932665 - protein, 9 aa, Homo Sapiens
IPKDFSRPK

SEQ ID NO: 932666 - protein, 9 aa, Homo Sapiens
QGHAQASLE

SEQ ID NO: 932667 - protein, 9 aa, Homo Sapiens
QDRPGSLSG

SEQ ID NO: 932668 - protein, 9 aa, Homo Sapiens
EEEAERRAP

SEQ ID NO: 932669 - protein, 9 aa, Homo Sapiens
ECRNSFAFT

SEQ ID NO: 932670 - protein, 9 aa, Homo Sapiens
PNPKLEGGA

SEQ ID NO: 932671 - protein, 9 aa, Homo Sapiens
QKKLWESMA

SEQ ID NO: 932672 - protein, 9 aa, Homo Sapiens
RAPYLSANV

SEQ ID NO: 932673 - protein, 9 aa, Homo Sapiens
FHLVCGVRK

SEQ ID NO: 932674 - protein, 9 aa, Homo Sapiens
QKELLKQQG

SEQ ID NO: 932675 - protein, 9 aa, Homo Sapiens
EQSLLIIKA

SEQ ID NO: 932676 - protein, 9 aa, Homo Sapiens
RDRMLKERA

SEQ ID NO: 932677 - protein, 9 aa, Homo Sapiens
LCKEISTNT

SEQ ID NO: 932678 - protein, 9 aa, Homo Sapiens
YACAFASHP

SEQ ID NO: 932679 - protein, 9 aa, Homo Sapiens
IMQVGMATK

SEQ ID NO: 932680 - protein, 9 aa, Homo Sapiens
DQIFIAVFP

SEQ ID NO: 932681 - protein, 9 aa, Homo Sapiens
MITVILEEI

SEQ ID NO: 932682 - protein, 9 aa, Homo Sapiens
CQARMCDAH

SEQ ID NO: 932683 - protein, 9 aa, Homo Sapiens
SHCPRHCPP

SEQ ID NO: 932684 - protein, 9 aa, Homo Sapiens
KLLADSLRG

SEQ ID NO: 932685 - protein, 9 aa, Homo Sapiens
QIEASLSVQ

SEQ ID NO: 932686 - protein, 9 aa, Homo Sapiens
EEWSCLCLV

SEQ ID NO: 932687 - protein, 9 aa, Homo Sapiens
QHNINECKV

SEQ ID NO: 932688 - protein, 9 aa, Homo Sapiens
HDVQNILDS

SEQ ID NO: 932689 - protein, 9 aa, Homo Sapiens
RPVCQARMC

SEQ ID NO: 932690 - protein, 9 aa, Homo Sapiens
FKVADEAKK

SEQ ID NO: 932691 - protein, 9 aa, Homo Sapiens
LADVEGVSV

SEQ ID NO: 932692 - protein, 9 aa, Homo Sapiens
VRLHEAAEA

SEQ ID NO: 932693 - protein, 9 aa, Homo Sapiens
TPKEKEEWI

SEQ ID NO: 932694 - protein, 9 aa, Homo Sapiens
NFSSFRALL

SEQ ID NO: 932695 - protein, 9 aa, Homo Sapiens
PADPSFYSP

SEQ ID NO: 932696 - protein, 9 aa, Homo Sapiens
TLILKEADP

SEQ ID NO: 932697 - protein, 9 aa, Homo Sapiens
MSSASSNSS

SEQ ID NO: 932698 - protein, 9 aa, Homo Sapiens
YPFRLFNFT

SEQ ID NO: 932699 - protein, 9 aa, Homo Sapiens
SEGPLRRTF

SEQ ID NO: 932700 - protein, 9 aa, Homo Sapiens
APPREVEVK

SEQ ID NO: 932701 - protein, 9 aa, Homo Sapiens
VFFKITLTS

SEQ ID NO: 932702 - protein, 9 aa, Homo Sapiens
TTLLRALEA

SEQ ID NO: 932703 - protein, 9 aa, Homo Sapiens
VDLSFPEDC

SEQ ID NO: 932704 - protein, 9 aa, Homo Sapiens
AKLLYDKYY

SEQ ID NO: 932705 - protein, 9 aa, Homo Sapiens
QIMTDFEKN

SEQ ID NO: 932706 - protein, 9 aa, Homo Sapiens
RPGSLSGSE

SEQ ID NO: 932707 - protein, 9 aa, Homo Sapiens
SCSHCERGF

SEQ ID NO: 932708 - protein, 9 aa, Homo Sapiens
PGTHILEEA

SEQ ID NO: 932709 - protein, 9 aa, Homo Sapiens
SGPLDHSSS

SEQ ID NO: 932710 - protein, 9 aa, Homo Sapiens
PWPTSSSGC

SEQ ID NO: 932711 - protein, 9 aa, Homo Sapiens
FDFLDVLEF

SEQ ID NO: 932712 - protein, 9 aa, Homo Sapiens
MAKLLYDKY

SEQ ID NO: 932713 - protein, 9 aa, Homo Sapiens
ELMSSASSN

SEQ ID NO: 932714 - protein, 9 aa, Homo Sapiens
IVSRVDGTP

SEQ ID NO: 932715 - protein, 9 aa, Homo Sapiens
LIYDEQIVW

SEQ ID NO: 932716 - protein, 9 aa, Homo Sapiens
NKFNEFFFL

SEQ ID NO: 932717 - protein, 9 aa, Homo Sapiens
VDANPILPS

SEQ ID NO: 932718 - protein, 9 aa, Homo Sapiens
FIAVFPGLP

SEQ ID NO: 932719 - protein, 9 aa, Homo Sapiens
LILIPDQTA

SEQ ID NO: 932720 - protein, 9 aa, Homo Sapiens
REGGGGGFR

SEQ ID NO: 932721 - protein, 9 aa, Homo Sapiens
WLTGAPLAT

SEQ ID NO: 932722 - protein, 9 aa, Homo Sapiens
STATGYLLR

SEQ ID NO: 932723 - protein, 9 aa, Homo Sapiens
NEEKNNGPL

SEQ ID NO: 932724 - protein, 9 aa, Homo Sapiens
EGGSAQPKD

SEQ ID NO: 932725 - protein, 9 aa, Homo Sapiens
EANGIYETI

SEQ ID NO: 932726 - protein, 9 aa, Homo Sapiens
QHAFYQLIY

SEQ ID NO: 932727 - protein, 9 aa, Homo Sapiens
PFLGNRACT

SEQ ID NO: 932728 - protein, 9 aa, Homo Sapiens
ECKVEPCKN

SEQ ID NO: 932729 - protein, 9 aa, Homo Sapiens
PNNPHVQYS

SEQ ID NO: 932730 - protein, 9 aa, Homo Sapiens
PAVAMPSLA

SEQ ID NO: 932731 - protein, 9 aa, Homo Sapiens
YVALSPARS

SEQ ID NO: 932732 - protein, 9 aa, Homo Sapiens
DGALWLGCL

SEQ ID NO: 932733 - protein, 9 aa, Homo Sapiens
DNGIDDASF

SEQ ID NO: 932734 - protein, 9 aa, Homo Sapiens
AEPGGLRSL

SEQ ID NO: 932735 - protein, 9 aa, Homo Sapiens
EKERTCAEN

SEQ ID NO: 932736 - protein, 9 aa, Homo Sapiens
DIMITVILE

SEQ ID NO: 932737 - protein, 9 aa, Homo Sapiens
LATEKSRWS

SEQ ID NO: 932738 - protein, 9 aa, Homo Sapiens
GYHKKTYRG

SEQ ID NO: 932739 - protein, 9 aa, Homo Sapiens
QKSMESNLC

SEQ ID NO: 932740 - protein, 9 aa, Homo Sapiens
KEGVSAQPA

SEQ ID NO: 932741 - protein, 9 aa, Homo Sapiens
PQDSSLSQM

SEQ ID NO: 932742 - protein, 9 aa, Homo Sapiens
SVLSYYITD

SEQ ID NO: 932743 - protein, 9 aa, Homo Sapiens
EIFWSERPT

SEQ ID NO: 932744 - protein, 9 aa, Homo Sapiens
LFPPSSEKL

SEQ ID NO: 932745 - protein, 9 aa, Homo Sapiens
GWRSPSSAL

SEQ ID NO: 932746 - protein, 9 aa, Homo Sapiens
KKKKNRKMV

SEQ ID NO: 932747 - protein, 9 aa, Homo Sapiens
LGYAFSVWR

SEQ ID NO: 932748 - protein, 9 aa, Homo Sapiens
CLPELPVGP

SEQ ID NO: 932749 - protein, 9 aa, Homo Sapiens
STFLIGLAV

SEQ ID NO: 932750 - protein, 9 aa, Homo Sapiens
LMPLPAGVP

SEQ ID NO: 932751 - protein, 9 aa, Homo Sapiens
HTYPADPSF

SEQ ID NO: 932752 - protein, 9 aa, Homo Sapiens
KILAKRLQI

SEQ ID NO: 932753 - protein, 9 aa, Homo Sapiens
CDGRLYVPT

SEQ ID NO: 932754 - protein, 9 aa, Homo Sapiens
LFSLLEAII

SEQ ID NO: 932755 - protein, 9 aa, Homo Sapiens
SRKAPSPGP

SEQ ID NO: 932756 - protein, 9 aa, Homo Sapiens
GEDSAPRYA

SEQ ID NO: 932757 - protein, 9 aa, Homo Sapiens
DYDALFPMA

SEQ ID NO: 932758 - protein, 9 aa, Homo Sapiens
SGPQGPPVV

SEQ ID NO: 932759 - protein, 9 aa, Homo Sapiens
FTDVTEFML

SEQ ID NO: 932760 - protein, 9 aa, Homo Sapiens
EDKVIFYNA

SEQ ID NO: 932761 - protein, 9 aa, Homo Sapiens
PNGISINYE

SEQ ID NO: 932762 - protein, 9 aa, Homo Sapiens
SLKEKVNLQ

SEQ ID NO: 932763 - protein, 9 aa, Homo Sapiens
QETREVLVR

SEQ ID NO: 932764 - protein, 9 aa, Homo Sapiens
TDGALWLGC

SEQ ID NO: 932765 - protein, 9 aa, Homo Sapiens
FKEGSDLSV

SEQ ID NO: 932766 - protein, 9 aa, Homo Sapiens
PKSCSKVAG

SEQ ID NO: 932767 - protein, 9 aa, Homo Sapiens
GLMPLPAGV

SEQ ID NO: 932768 - protein, 9 aa, Homo Sapiens
LLGGLTSPE

SEQ ID NO: 932769 - protein, 9 aa, Homo Sapiens
FLILVLFNN

SEQ ID NO: 932770 - protein, 9 aa, Homo Sapiens
REPRLSPWS

SEQ ID NO: 932771 - protein, 9 aa, Homo Sapiens
CFHLQDFDR

SEQ ID NO: 932772 - protein, 9 aa, Homo Sapiens
NGIVTKLKS

SEQ ID NO: 932773 - protein, 9 aa, Homo Sapiens
SINYEENKL

SEQ ID NO: 932774 - protein, 9 aa, Homo Sapiens
AYQGTLLPA

SEQ ID NO: 932775 - protein, 9 aa, Homo Sapiens
SIWEIRILP

SEQ ID NO: 932776 - protein, 9 aa, Homo Sapiens
LSPWSSTSG

SEQ ID NO: 932777 - protein, 9 aa, Homo Sapiens
LQKCDILEL

SEQ ID NO: 932778 - protein, 9 aa, Homo Sapiens
DGGDQEIAK

SEQ ID NO: 932779 - protein, 9 aa, Homo Sapiens
PGGSWENIN

SEQ ID NO: 932780 - protein, 9 aa, Homo Sapiens
PLSTSASSR

SEQ ID NO: 932781 - protein, 9 aa, Homo Sapiens
NPKQSGLGE

SEQ ID NO: 932782 - protein, 9 aa, Homo Sapiens
QQKEQAVIP

SEQ ID NO: 932783 - protein, 9 aa, Homo Sapiens
LDTYLAQGP

SEQ ID NO: 932784 - protein, 9 aa, Homo Sapiens
KARRHIIIV

SEQ ID NO: 932785 - protein, 9 aa, Homo Sapiens
QNMSTFLIG

SEQ ID NO: 932786 - protein, 9 aa, Homo Sapiens
SHVEPSERP

SEQ ID NO: 932787 - protein, 9 aa, Homo Sapiens
KTYRGYQGR

SEQ ID NO: 932788 - protein, 9 aa, Homo Sapiens
EFFFLHFPL

SEQ ID NO: 932789 - protein, 9 aa, Homo Sapiens
NDDGLTEVV

SEQ ID NO: 932790 - protein, 9 aa, Homo Sapiens
FLFCAVYMI

SEQ ID NO: 932791 - protein, 9 aa, Homo Sapiens
QPGRMSRSQ

SEQ ID NO: 932792 - protein, 9 aa, Homo Sapiens
VTEFMLLGL

SEQ ID NO: 932793 - protein, 9 aa, Homo Sapiens
SRWGRLLPA

SEQ ID NO: 932794 - protein, 9 aa, Homo Sapiens
FSPEHGSAK

SEQ ID NO: 932795 - protein, 9 aa, Homo Sapiens
AQSKENPEQ

SEQ ID NO: 932796 - protein, 9 aa, Homo Sapiens
FGIFGLDKL

SEQ ID NO: 932797 - protein, 9 aa, Homo Sapiens
YSCSHCERG

SEQ ID NO: 932798 - protein, 9 aa, Homo Sapiens
SSSAAIFVR

SEQ ID NO: 932799 - protein, 9 aa, Homo Sapiens
QIVEVLHSG

SEQ ID NO: 932800 - protein, 9 aa, Homo Sapiens
HPCILSLNP

SEQ ID NO: 932801 - protein, 9 aa, Homo Sapiens
FGVHLGQPH

SEQ ID NO: 932802 - protein, 9 aa, Homo Sapiens
EKVHSMSRV

SEQ ID NO: 932803 - protein, 9 aa, Homo Sapiens
TLLRALEAQ

SEQ ID NO: 932804 - protein, 9 aa, Homo Sapiens
VGRRCGRFV

SEQ ID NO: 932805 - protein, 9 aa, Homo Sapiens
LQENTVSVF

SEQ ID NO: 932806 - protein, 9 aa, Homo Sapiens
SGSSRGRLA

SEQ ID NO: 932807 - protein, 9 aa, Homo Sapiens
APEAEPAEK

SEQ ID NO: 932808 - protein, 9 aa, Homo Sapiens
NLSTGALPE

SEQ ID NO: 932809 - protein, 9 aa, Homo Sapiens
VKYSTVASP

SEQ ID NO: 932810 - protein, 9 aa, Homo Sapiens
SPVGRRCGR

SEQ ID NO: 932811 - protein, 9 aa, Homo Sapiens
YYITDGNKD

SEQ ID NO: 932812 - protein, 9 aa, Homo Sapiens
GVPNLPNLN

SEQ ID NO: 932813 - protein, 9 aa, Homo Sapiens
FPPSSEKLQ

SEQ ID NO: 932814 - protein, 9 aa, Homo Sapiens
RNLVRRCIT

SEQ ID NO: 932815 - protein, 9 aa, Homo Sapiens
MYKMQALAS

SEQ ID NO: 932816 - protein, 9 aa, Homo Sapiens
LKEKVNLQK

SEQ ID NO: 932817 - protein, 9 aa, Homo Sapiens
SSAAIFVRE

SEQ ID NO: 932818 - protein, 9 aa, Homo Sapiens
IVLYLSKQR

SEQ ID NO: 932819 - protein, 9 aa, Homo Sapiens
WALALPSPY

SEQ ID NO: 932820 - protein, 9 aa, Homo Sapiens
WTKLDMNLS

SEQ ID NO: 932821 - protein, 9 aa, Homo Sapiens
IQLDQEGRE

SEQ ID NO: 932822 - protein, 9 aa, Homo Sapiens
CSDTHMKKI

SEQ ID NO: 932823 - protein, 9 aa, Homo Sapiens
IYQGTKMIP

SEQ ID NO: 932824 - protein, 9 aa, Homo Sapiens
GNKCEEAFN

SEQ ID NO: 932825 - protein, 9 aa, Homo Sapiens
YSTLPQANH

SEQ ID NO: 932826 - protein, 9 aa, Homo Sapiens
IPFASLVSR

SEQ ID NO: 932827 - protein, 9 aa, Homo Sapiens
FVGMKSCGI

SEQ ID NO: 932828 - protein, 9 aa, Homo Sapiens
TQGTSHCPS

SEQ ID NO: 932829 - protein, 9 aa, Homo Sapiens
GLGPHAEQP

SEQ ID NO: 932830 - protein, 9 aa, Homo Sapiens
SRTEAEISD

SEQ ID NO: 932831 - protein, 9 aa, Homo Sapiens
GASRWGRLL

SEQ ID NO: 932832 - protein, 9 aa, Homo Sapiens
ANMGLEHNH

SEQ ID NO: 932833 - protein, 9 aa, Homo Sapiens
HCPRHCPPW

SEQ ID NO: 932834 - protein, 9 aa, Homo Sapiens
SSGCSTSRP

SEQ ID NO: 932835 - protein, 9 aa, Homo Sapiens
LCNIELMSS

SEQ ID NO: 932836 - protein, 9 aa, Homo Sapiens
DLRGKGHLE

SEQ ID NO: 932837 - protein, 9 aa, Homo Sapiens
YAGWAYKIH

SEQ ID NO: 932838 - protein, 9 aa, Homo Sapiens
GSPCDLRGK

SEQ ID NO: 932839 - protein, 9 aa, Homo Sapiens
LKVIQVEPP

SEQ ID NO: 932840 - protein, 9 aa, Homo Sapiens
PTSSSGCST

SEQ ID NO: 932841 - protein, 9 aa, Homo Sapiens
LTTPVVIVL

SEQ ID NO: 932842 - protein, 9 aa, Homo Sapiens
EVDCFLKLC

SEQ ID NO: 932843 - protein, 9 aa, Homo Sapiens
EIRILPNFN

SEQ ID NO: 932844 - protein, 9 aa, Homo Sapiens
ALSRMPFPG

SEQ ID NO: 932845 - protein, 9 aa, Homo Sapiens
LTSPEIRFS

SEQ ID NO: 932846 - protein, 9 aa, Homo Sapiens
EEELGGSVT

SEQ ID NO: 932847 - protein, 9 aa, Homo Sapiens
KEKEEWIKC

SEQ ID NO: 932848 - protein, 9 aa, Homo Sapiens
PETLDKLGN

SEQ ID NO: 932849 - protein, 9 aa, Homo Sapiens
GTSELTDMK

SEQ ID NO: 932850 - protein, 9 aa, Homo Sapiens
SPNQRHLAQ

SEQ ID NO: 932851 - protein, 9 aa, Homo Sapiens
LDSRAIDVT

SEQ ID NO: 932852 - protein, 9 aa, Homo Sapiens
HPPRSPLEP

SEQ ID NO: 932853 - protein, 9 aa, Homo Sapiens
PQKKLWESM

SEQ ID NO: 932854 - protein, 9 aa, Homo Sapiens
GHREISSPK

SEQ ID NO: 932855 - protein, 9 aa, Homo Sapiens
IFIAVFPGL

SEQ ID NO: 932856 - protein, 9 aa, Homo Sapiens
AAVYEHPCI

SEQ ID NO: 932857 - protein, 9 aa, Homo Sapiens
DMAKLLYDK

SEQ ID NO: 932858 - protein, 9 aa, Homo Sapiens
AAARKEVIK

SEQ ID NO: 932859 - protein, 9 aa, Homo Sapiens
SNIGASENS

SEQ ID NO: 932860 - protein, 9 aa, Homo Sapiens
AAWHPIKPY

SEQ ID NO: 932861 - protein, 9 aa, Homo Sapiens
RFPNNPHVQ

SEQ ID NO: 932862 - protein, 9 aa, Homo Sapiens
RISAPTPKE

SEQ ID NO: 932863 - protein, 9 aa, Homo Sapiens
KDEGSNCSK

SEQ ID NO: 932864 - protein, 9 aa, Homo Sapiens
RLESPRAWS

SEQ ID NO: 932865 - protein, 9 aa, Homo Sapiens
CWDQSQNQA

SEQ ID NO: 932866 - protein, 9 aa, Homo Sapiens
RGRMSLFAL

SEQ ID NO: 932867 - protein, 9 aa, Homo Sapiens
LDIPNLTPY

SEQ ID NO: 932868 - protein, 9 aa, Homo Sapiens
APAEASVKD

SEQ ID NO: 932869 - protein, 9 aa, Homo Sapiens
LEEAQKVSA

SEQ ID NO: 932870 - protein, 9 aa, Homo Sapiens
NPATFQHPP

SEQ ID NO: 932871 - protein, 9 aa, Homo Sapiens
PLIMQVGMA

SEQ ID NO: 932872 - protein, 9 aa, Homo Sapiens
KKYNLVLGA

SEQ ID NO: 932873 - protein, 9 aa, Homo Sapiens
VWTKLDMNL

SEQ ID NO: 932874 - protein, 9 aa, Homo Sapiens
GTHILEEAQ

SEQ ID NO: 932875 - protein, 9 aa, Homo Sapiens
AKARRHIII

SEQ ID NO: 932876 - protein, 9 aa, Homo Sapiens
DYVFGPNGR

SEQ ID NO: 932877 - protein, 9 aa, Homo Sapiens
PTPKEKEEW

SEQ ID NO: 932878 - protein, 9 aa, Homo Sapiens
ISSPKIQDA

SEQ ID NO: 932879 - protein, 9 aa, Homo Sapiens
AREPRLSPW

SEQ ID NO: 932880 - protein, 9 aa, Homo Sapiens
AHERLGYAF

SEQ ID NO: 932881 - protein, 9 aa, Homo Sapiens
LFWRLESPR

SEQ ID NO: 932882 - protein, 9 aa, Homo Sapiens
WEIFWSERP

SEQ ID NO: 932883 - protein, 9 aa, Homo Sapiens
CAFASHPNE

SEQ ID NO: 932884 - protein, 9 aa, Homo Sapiens
LIYQGTKMI

SEQ ID NO: 932885 - protein, 9 aa, Homo Sapiens
RYADTLHSK

SEQ ID NO: 932886 - protein, 9 aa, Homo Sapiens
VRDRMLKER

SEQ ID NO: 932887 - protein, 9 aa, Homo Sapiens
FASLVSRLT

SEQ ID NO: 932888 - protein, 9 aa, Homo Sapiens
LLRALNEII

SEQ ID NO: 932889 - protein, 9 aa, Homo Sapiens
ASSRTRPCT

SEQ ID NO: 932890 - protein, 9 aa, Homo Sapiens
NSSASLYQQ

SEQ ID NO: 932891 - protein, 9 aa, Homo Sapiens
AQTIYEENI

SEQ ID NO: 932892 - protein, 9 aa, Homo Sapiens
GSSRGRLAR

SEQ ID NO: 932893 - protein, 9 aa, Homo Sapiens
FNEFFFLHF

SEQ ID NO: 932894 - protein, 9 aa, Homo Sapiens
ICSHHMNDA

SEQ ID NO: 932895 - protein, 9 aa, Homo Sapiens
TNAGKAFCM

SEQ ID NO: 932896 - protein, 9 aa, Homo Sapiens
SKQEAWSTH

SEQ ID NO: 932897 - protein, 9 aa, Homo Sapiens
ERPPSGPPS

SEQ ID NO: 932898 - protein, 9 aa, Homo Sapiens
CNHFVSNAY

SEQ ID NO: 932899 - protein, 9 aa, Homo Sapiens
QEAWSTHNT

SEQ ID NO: 932900 - protein, 9 aa, Homo Sapiens
FLDRFYTDR

SEQ ID NO: 932901 - protein, 9 aa, Homo Sapiens
LPEVKVEEE

SEQ ID NO: 932902 - protein, 9 aa, Homo Sapiens
RALNEIIES

SEQ ID NO: 932903 - protein, 9 aa, Homo Sapiens
ASISSTSIS

SEQ ID NO: 932904 - protein, 9 aa, Homo Sapiens
FSRPKASSD

SEQ ID NO: 932905 - protein, 9 aa, Homo Sapiens
IFCNHFVSN

SEQ ID NO: 932906 - protein, 9 aa, Homo Sapiens
AVVEFGSSP

SEQ ID NO: 932907 - protein, 9 aa, Homo Sapiens
GQKTYQGNK

SEQ ID NO: 932908 - protein, 9 aa, Homo Sapiens
GSGNQTFIA

SEQ ID NO: 932909 - protein, 9 aa, Homo Sapiens
GTVGRVLAK

SEQ ID NO: 932910 - protein, 9 aa, Homo Sapiens
VDANNGIVT

SEQ ID NO: 932911 - protein, 9 aa, Homo Sapiens
LLRALEAQK

SEQ ID NO: 932912 - protein, 9 aa, Homo Sapiens
KLHDVQNIL

SEQ ID NO: 932913 - protein, 9 aa, Homo Sapiens
ASVKDSALL

SEQ ID NO: 932914 - protein, 9 aa, Homo Sapiens
GRPRSKQEA

SEQ ID NO: 932915 - protein, 9 aa, Homo Sapiens
SWSLSQQRR

SEQ ID NO: 932916 - protein, 9 aa, Homo Sapiens
QFFSCSHRF

SEQ ID NO: 932917 - protein, 9 aa, Homo Sapiens
RKTLHFEIF

SEQ ID NO: 932918 - protein, 9 aa, Homo Sapiens
TQIVEVLHS

SEQ ID NO: 932919 - protein, 9 aa, Homo Sapiens
IKPYGILIL

SEQ ID NO: 932920 - protein, 9 aa, Homo Sapiens
SFLEATEDA

SEQ ID NO: 932921 - protein, 9 aa, Homo Sapiens
EDETIDVEV

SEQ ID NO: 932922 - protein, 9 aa, Homo Sapiens
AKLVQEMKS

SEQ ID NO: 932923 - protein, 9 aa, Homo Sapiens
QERFLYACA

SEQ ID NO: 932924 - protein, 9 aa, Homo Sapiens
QLLQHAATG

SEQ ID NO: 932925 - protein, 9 aa, Homo Sapiens
GSAQPKDCE

SEQ ID NO: 932926 - protein, 9 aa, Homo Sapiens
DDFSCTKHD

SEQ ID NO: 932927 - protein, 9 aa, Homo Sapiens
SQEEISIWE

SEQ ID NO: 932928 - protein, 9 aa, Homo Sapiens
ATFQHPPPP

SEQ ID NO: 932929 - protein, 9 aa, Homo Sapiens
KTASISSTS

SEQ ID NO: 932930 - protein, 9 aa, Homo Sapiens
KPGLGPHAE

SEQ ID NO: 932931 - protein, 9 aa, Homo Sapiens
EEKNNGPLI

SEQ ID NO: 932932 - protein, 9 aa, Homo Sapiens
STSRPRPQT

SEQ ID NO: 932933 - protein, 9 aa, Homo Sapiens
GPRFFTALA

SEQ ID NO: 932934 - protein, 9 aa, Homo Sapiens
RGRLAREPR

SEQ ID NO: 932935 - protein, 9 aa, Homo Sapiens
KQEAWSTHN

SEQ ID NO: 932936 - protein, 9 aa, Homo Sapiens
MKGLEGTAG

SEQ ID NO: 932937 - protein, 9 aa, Homo Sapiens
SFKVADEAK

SEQ ID NO: 932938 - protein, 9 aa, Homo Sapiens
SSFPVLEYR

SEQ ID NO: 932939 - protein, 9 aa, Homo Sapiens
STQGTSHCP

SEQ ID NO: 932940 - protein, 9 aa, Homo Sapiens
PAPAEASVK

SEQ ID NO: 932941 - protein, 9 aa, Homo Sapiens
DYGKEARFP

SEQ ID NO: 932942 - protein, 9 aa, Homo Sapiens
DRPAWPLST

SEQ ID NO: 932943 - protein, 9 aa, Homo Sapiens
PRQGKSTLW

SEQ ID NO: 932944 - protein, 9 aa, Homo Sapiens
TLLPANILD

SEQ ID NO: 932945 - protein, 9 aa, Homo Sapiens
LRVCTREPP

SEQ ID NO: 932946 - protein, 9 aa, Homo Sapiens
LLSRWINSS

SEQ ID NO: 932947 - protein, 9 aa, Homo Sapiens
IVSRGRMSL

SEQ ID NO: 932948 - protein, 9 aa, Homo Sapiens
LRPASTSLW

SEQ ID NO: 932949 - protein, 9 aa, Homo Sapiens
GLATEKSRW

SEQ ID NO: 932950 - protein, 9 aa, Homo Sapiens
EDRLQEYTE

SEQ ID NO: 932951 - protein, 9 aa, Homo Sapiens
LKIPFASLV

SEQ ID NO: 932952 - protein, 9 aa, Homo Sapiens
MTDFEKNVD

SEQ ID NO: 932953 - protein, 9 aa, Homo Sapiens
EPRLSPWSS

SEQ ID NO: 932954 - protein, 9 aa, Homo Sapiens
QALPGTHIL

SEQ ID NO: 932955 - protein, 9 aa, Homo Sapiens
GTSHCPSLP

SEQ ID NO: 932956 - protein, 9 aa, Homo Sapiens
LPSMFNWER

SEQ ID NO: 932957 - protein, 9 aa, Homo Sapiens
PRIVSRVDG

SEQ ID NO: 932958 - protein, 9 aa, Homo Sapiens
IKQEPREES

SEQ ID NO: 932959 - protein, 9 aa, Homo Sapiens
LPTIGGSHA

SEQ ID NO: 932960 - protein, 9 aa, Homo Sapiens
CFLKLCLNS

SEQ ID NO: 932961 - protein, 9 aa, Homo Sapiens
VYALPPSQK

SEQ ID NO: 932962 - protein, 9 aa, Homo Sapiens
NEFFFLHFP

SEQ ID NO: 932963 - protein, 9 aa, Homo Sapiens
VPETIAFLT

SEQ ID NO: 932964 - protein, 9 aa, Homo Sapiens
EAHTPVKEA

SEQ ID NO: 932965 - protein, 9 aa, Homo Sapiens
DFGDIEDTI

SEQ ID NO: 932966 - protein, 9 aa, Homo Sapiens
VGRVLAKLV

SEQ ID NO: 932967 - protein, 9 aa, Homo Sapiens
FFGPNSSAS

SEQ ID NO: 932968 - protein, 9 aa, Homo Sapiens
AGWAYKIHG

SEQ ID NO: 932969 - protein, 9 aa, Homo Sapiens
IMITVILEE

SEQ ID NO: 932970 - protein, 9 aa, Homo Sapiens
KDEHRGFQQ

SEQ ID NO: 932971 - protein, 9 aa, Homo Sapiens
HGSAKQNGQ

SEQ ID NO: 932972 - protein, 9 aa, Homo Sapiens
GPLIMQVGM

SEQ ID NO: 932973 - protein, 9 aa, Homo Sapiens
FYNACAAQM

SEQ ID NO: 932974 - protein, 9 aa, Homo Sapiens
KTLHFEIFK

SEQ ID NO: 932975 - protein, 9 aa, Homo Sapiens
PSGSSRGRL

SEQ ID NO: 932976 - protein, 9 aa, Homo Sapiens
SLSQQRRQR

SEQ ID NO: 932977 - protein, 9 aa, Homo Sapiens
GSTFENITQ

SEQ ID NO: 932978 - protein, 9 aa, Homo Sapiens
TRAFITHGE

SEQ ID NO: 932979 - protein, 9 aa, Homo Sapiens
KVADEAKKY

SEQ ID NO: 932980 - protein, 9 aa, Homo Sapiens
LEKAPIKEK

SEQ ID NO: 932981 - protein, 9 aa, Homo Sapiens
LCTPLSCLK

SEQ ID NO: 932982 - protein, 9 aa, Homo Sapiens
EMVMVLKKV

SEQ ID NO: 932983 - protein, 9 aa, Homo Sapiens
LNIRFIKVY

SEQ ID NO: 932984 - protein, 9 aa, Homo Sapiens
RFFTALAGW

SEQ ID NO: 932985 - protein, 9 aa, Homo Sapiens
IRFIKVYWH

SEQ ID NO: 932986 - protein, 9 aa, Homo Sapiens
TWWSGTWRW

SEQ ID NO: 932987 - protein, 9 aa, Homo Sapiens
THSLPSEPV

SEQ ID NO: 932988 - protein, 9 aa, Homo Sapiens
AYIFKCEKL

SEQ ID NO: 932989 - protein, 9 aa, Homo Sapiens
RDFGPRFFT

SEQ ID NO: 932990 - protein, 9 aa, Homo Sapiens
AFSPEHGSA

SEQ ID NO: 932991 - protein, 9 aa, Homo Sapiens
THGEANGIY

SEQ ID NO: 932992 - protein, 9 aa, Homo Sapiens
FGPNGRSSW

SEQ ID NO: 932993 - protein, 9 aa, Homo Sapiens
LGGLTSPEI

SEQ ID NO: 932994 - protein, 9 aa, Homo Sapiens
VEEELGGSV

SEQ ID NO: 932995 - protein, 9 aa, Homo Sapiens
LHEAAEAVL

SEQ ID NO: 932996 - protein, 9 aa, Homo Sapiens
DANNGIVTK

SEQ ID NO: 932997 - protein, 9 aa, Homo Sapiens
PAAEPGGLR

SEQ ID NO: 932998 - protein, 9 aa, Homo Sapiens
AEQPAAEPG

SEQ ID NO: 932999 - protein, 9 aa, Homo Sapiens
HRTLPLSVI

SEQ ID NO: 933000 - protein, 9 aa, Homo Sapiens
PVVKGEAGL

SEQ ID NO: 933001 - protein, 9 aa, Homo Sapiens
LLIIKAIGN

SEQ ID NO: 933002 - protein, 9 aa, Homo Sapiens
KSCSKVAGC

SEQ ID NO: 933003 - protein, 9 aa, Homo Sapiens
TSHCPSLPA

SEQ ID NO: 933004 - protein, 9 aa, Homo Sapiens
LIPKRNPIS

SEQ ID NO: 933005 - protein, 9 aa, Homo Sapiens
VGRVGSTFE

SEQ ID NO: 933006 - protein, 9 aa, Homo Sapiens
KQQGIDIKL

SEQ ID NO: 933007 - protein, 9 aa, Homo Sapiens
EASVKDSAL

SEQ ID NO: 933008 - protein, 9 aa, Homo Sapiens
KNKIRAIGK

SEQ ID NO: 933009 - protein, 9 aa, Homo Sapiens
RPPSGPPSG

SEQ ID NO: 933010 - protein, 9 aa, Homo Sapiens
YIPCTLIVI

SEQ ID NO: 933011 - protein, 9 aa, Homo Sapiens
NLVQLLRVC

SEQ ID NO: 933012 - protein, 9 aa, Homo Sapiens
HIWLTGAPL

SEQ ID NO: 933013 - protein, 9 aa, Homo Sapiens
SEKSKILAK

SEQ ID NO: 933014 - protein, 9 aa, Homo Sapiens
GSWSLSQQR

SEQ ID NO: 933015 - protein, 9 aa, Homo Sapiens
EFGSSPTST

SEQ ID NO: 933016 - protein, 9 aa, Homo Sapiens
MLIPKRNPI

SEQ ID NO: 933017 - protein, 9 aa, Homo Sapiens
SDSLKPGLG

SEQ ID NO: 933018 - protein, 9 aa, Homo Sapiens
WGRLHSHCP

SEQ ID NO: 933019 - protein, 9 aa, Homo Sapiens
LPARGAAAP

SEQ ID NO: 933020 - protein, 9 aa, Homo Sapiens
GTWRWGRRP

SEQ ID NO: 933021 - protein, 9 aa, Homo Sapiens
STLPQANHD

SEQ ID NO: 933022 - protein, 9 aa, Homo Sapiens
DLQKSMESN

SEQ ID NO: 933023 - protein, 9 aa, Homo Sapiens
CNKEKERTC

SEQ ID NO: 933024 - protein, 9 aa, Homo Sapiens
LMDTDLVYI

SEQ ID NO: 933025 - protein, 9 aa, Homo Sapiens
RFLYACAFA

SEQ ID NO: 933026 - protein, 9 aa, Homo Sapiens
IAKTGKFLK

SEQ ID NO: 933027 - protein, 9 aa, Homo Sapiens
KVFFKITLT

SEQ ID NO: 933028 - protein, 9 aa, Homo Sapiens
SQYTVVDKN

SEQ ID NO: 933029 - protein, 9 aa, Homo Sapiens
PREALDTYL

SEQ ID NO: 933030 - protein, 9 aa, Homo Sapiens
GDRPAWPLS

SEQ ID NO: 933031 - protein, 9 aa, Homo Sapiens
YEENIARLQ

SEQ ID NO: 933032 - protein, 9 aa, Homo Sapiens
NKSRTEAEI

SEQ ID NO: 933033 - protein, 9 aa, Homo Sapiens
TLPLSVIGG

SEQ ID NO: 933034 - protein, 9 aa, Homo Sapiens
DRISFRMLI

SEQ ID NO: 933035 - protein, 9 aa, Homo Sapiens
KLMDTDLVY

SEQ ID NO: 933036 - protein, 9 aa, Homo Sapiens
SNCSKDKVV

SEQ ID NO: 933037 - protein, 9 aa, Homo Sapiens
DVQNILDSV

SEQ ID NO: 933038 - protein, 9 aa, Homo Sapiens
MEAHTPVKE

SEQ ID NO: 933039 - protein, 9 aa, Homo Sapiens
AISSIGTSE

SEQ ID NO: 933040 - protein, 9 aa, Homo Sapiens
FSSRIKSHS

SEQ ID NO: 933041 - protein, 9 aa, Homo Sapiens
ENGPPLMKK

SEQ ID NO: 933042 - protein, 9 aa, Homo Sapiens
ISIWEIRIL

SEQ ID NO: 933043 - protein, 9 aa, Homo Sapiens
NNKTLEKLD

SEQ ID NO: 933044 - protein, 9 aa, Homo Sapiens
PAAQRFAAA

SEQ ID NO: 933045 - protein, 9 aa, Homo Sapiens
EKNRKLFDF

SEQ ID NO: 933046 - protein, 9 aa, Homo Sapiens
LESPRAWSQ

SEQ ID NO: 933047 - protein, 9 aa, Homo Sapiens
EPAEKVQAP

SEQ ID NO: 933048 - protein, 9 aa, Homo Sapiens
TVGRVLAKL

SEQ ID NO: 933049 - protein, 9 aa, Homo Sapiens
DLEKAPIKE

SEQ ID NO: 933050 - protein, 9 aa, Homo Sapiens
SANMGLEHN

SEQ ID NO: 933051 - protein, 9 aa, Homo Sapiens
GRRCGRFVK

SEQ ID NO: 933052 - protein, 9 aa, Homo Sapiens
TLFPPSSEK

SEQ ID NO: 933053 - protein, 9 aa, Homo Sapiens
HVSGRKMLS

SEQ ID NO: 933054 - protein, 9 aa, Homo Sapiens
VIGDYGKEA

SEQ ID NO: 933055 - protein, 9 aa, Homo Sapiens
PSRRFLSKK

SEQ ID NO: 933056 - protein, 9 aa, Homo Sapiens
PPIPKDFSR

SEQ ID NO: 933057 - protein, 9 aa, Homo Sapiens
EGPFLGNRA

SEQ ID NO: 933058 - protein, 9 aa, Homo Sapiens
NYKITTQLC

SEQ ID NO: 933059 - protein, 9 aa, Homo Sapiens
DFSRPKASS

SEQ ID NO: 933060 - protein, 9 aa, Homo Sapiens
GTSGDRPAW

SEQ ID NO: 933061 - protein, 9 aa, Homo Sapiens
PARSLQGLR

SEQ ID NO: 933062 - protein, 9 aa, Homo Sapiens
CQIVKPGFN

SEQ ID NO: 933063 - protein, 9 aa, Homo Sapiens
LLIILPFKR

SEQ ID NO: 933064 - protein, 9 aa, Homo Sapiens
AFITHGEAN

SEQ ID NO: 933065 - protein, 9 aa, Homo Sapiens
FSSFQYLIV

SEQ ID NO: 933066 - protein, 9 aa, Homo Sapiens
NQAQVVLNQ

SEQ ID NO: 933067 - protein, 9 aa, Homo Sapiens
YFIISGNSQ

SEQ ID NO: 933068 - protein, 9 aa, Homo Sapiens
TRPCTWWSG

SEQ ID NO: 933069 - protein, 9 aa, Homo Sapiens
LRVIYPAPC

SEQ ID NO: 933070 - protein, 9 aa, Homo Sapiens
PAEKVQAPE

SEQ ID NO: 933071 - protein, 9 aa, Homo Sapiens
PQVYALPPS

SEQ ID NO: 933072 - protein, 9 aa, Homo Sapiens
PVECRNSFA

SEQ ID NO: 933073 - protein, 9 aa, Homo Sapiens
GPRRTSLPQ

SEQ ID NO: 933074 - protein, 9 aa, Homo Sapiens
EGPVRLHEA

SEQ ID NO: 933075 - protein, 9 aa, Homo Sapiens
GVSAQPATF

SEQ ID NO: 933076 - protein, 9 aa, Homo Sapiens
LLPPEQALA

SEQ ID NO: 933077 - protein, 9 aa, Homo Sapiens
IFKCEKLTI

SEQ ID NO: 933078 - protein, 9 aa, Homo Sapiens
ILHIKQNIP

SEQ ID NO: 933079 - protein, 9 aa, Homo Sapiens
GSAKQNGQK

SEQ ID NO: 933080 - protein, 9 aa, Homo Sapiens
PPQKKLWES

SEQ ID NO: 933081 - protein, 9 aa, Homo Sapiens
WINSSFPVL

SEQ ID NO: 933082 - protein, 9 aa, Homo Sapiens
AIIFALLPK

SEQ ID NO: 933083 - protein, 9 aa, Homo Sapiens
PGTNAGKAF

SEQ ID NO: 933084 - protein, 9 aa, Homo Sapiens
QAYVALSPA

SEQ ID NO: 933085 - protein, 9 aa, Homo Sapiens
SQLEKRWQR

SEQ ID NO: 933086 - protein, 9 aa, Homo Sapiens
KMWGQKEMR

SEQ ID NO: 933087 - protein, 9 aa, Homo Sapiens
MESNLCVMA

SEQ ID NO: 933088 - protein, 9 aa, Homo Sapiens
FKCEKLTIQ

SEQ ID NO: 933089 - protein, 9 aa, Homo Sapiens
QRENRVKTS

SEQ ID NO: 933090 - protein, 9 aa, Homo Sapiens
VLENQPLKE

SEQ ID NO: 933091 - protein, 9 aa, Homo Sapiens
KIPENSPLE

SEQ ID NO: 933092 - protein, 9 aa, Homo Sapiens
EMEAHTPVK

SEQ ID NO: 933093 - protein, 9 aa, Homo Sapiens
PIKPYGILI

SEQ ID NO: 933094 - protein, 9 aa, Homo Sapiens
QLCAQKCKE

SEQ ID NO: 933095 - protein, 9 aa, Homo Sapiens
LSTSASSRT

SEQ ID NO: 933096 - protein, 9 aa, Homo Sapiens
LKPGLGPHA

SEQ ID NO: 933097 - protein, 9 aa, Homo Sapiens
LNEIIESGR

SEQ ID NO: 933098 - protein, 9 aa, Homo Sapiens
WDQSQNQAQ

SEQ ID NO: 933099 - protein, 9 aa, Homo Sapiens
FFSCSHRFS

SEQ ID NO: 933100 - protein, 9 aa, Homo Sapiens
SKKGLASKA

SEQ ID NO: 933101 - protein, 9 aa, Homo Sapiens
YPADPSFYS

SEQ ID NO: 933102 - protein, 9 aa, Homo Sapiens
WPNGISINY

SEQ ID NO: 933103 - protein, 9 aa, Homo Sapiens
IYSTLPQAN

SEQ ID NO: 933104 - protein, 9 aa, Homo Sapiens
LYACAFASH

SEQ ID NO: 933105 - protein, 9 aa, Homo Sapiens
KKVSSKEKK

SEQ ID NO: 933106 - protein, 9 aa, Homo Sapiens
IGDYGKEAR

SEQ ID NO: 933107 - protein, 9 aa, Homo Sapiens
QEAQTIYEE

SEQ ID NO: 933108 - protein, 9 aa, Homo Sapiens
LHFEIFKEG

SEQ ID NO: 933109 - protein, 9 aa, Homo Sapiens
GPHAEQPAA

SEQ ID NO: 933110 - protein, 9 aa, Homo Sapiens
DFGLATEKS

SEQ ID NO: 933111 - protein, 9 aa, Homo Sapiens
FWRLESPRA

SEQ ID NO: 933112 - protein, 9 aa, Homo Sapiens
LLKQQGIDI

SEQ ID NO: 933113 - protein, 9 aa, Homo Sapiens
MGYHKKTYR

SEQ ID NO: 933114 - protein, 9 aa, Homo Sapiens
DVEGVSVLR

SEQ ID NO: 933115 - protein, 9 aa, Homo Sapiens
RGRGVTLMV

SEQ ID NO: 933116 - protein, 9 aa, Homo Sapiens
LTIQIKGKV

SEQ ID NO: 933117 - protein, 9 aa, Homo Sapiens
WWSGTWRWG

SEQ ID NO: 933118 - protein, 9 aa, Homo Sapiens
NKEKERTCA

SEQ ID NO: 933119 - protein, 9 aa, Homo Sapiens
EELGGSVTI

SEQ ID NO: 933120 - protein, 9 aa, Homo Sapiens
SCSDTHMKK

SEQ ID NO: 933121 - protein, 9 aa, Homo Sapiens
SAVGSWSLS

SEQ ID NO: 933122 - protein, 9 aa, Homo Sapiens
PRSKQEAWS

SEQ ID NO: 933123 - protein, 9 aa, Homo Sapiens
EGVSVLRSF

SEQ ID NO: 933124 - protein, 9 aa, Homo Sapiens
NEGPFLGNR

SEQ ID NO: 933125 - protein, 9 aa, Homo Sapiens
VWPNPKLEG

SEQ ID NO: 933126 - protein, 9 aa, Homo Sapiens
DKVIFYNAC

SEQ ID NO: 933127 - protein, 9 aa, Homo Sapiens
HERLGYAFS

SEQ ID NO: 933128 - protein, 9 aa, Homo Sapiens
PLPPIPKDF

SEQ ID NO: 933129 - protein, 9 aa, Homo Sapiens
PLKENEEEP

SEQ ID NO: 933130 - protein, 9 aa, Homo Sapiens
PSPAHIWLT

SEQ ID NO: 933131 - protein, 9 aa, Homo Sapiens
QSGLGELPD

SEQ ID NO: 933132 - protein, 9 aa, Homo Sapiens
SHCPSLPAS

SEQ ID NO: 933133 - protein, 9 aa, Homo Sapiens
GKGHLEAGA

SEQ ID NO: 933134 - protein, 9 aa, Homo Sapiens
HNINECKVE

SEQ ID NO: 933135 - protein, 9 aa, Homo Sapiens
EISIWEIRI

SEQ ID NO: 933136 - protein, 9 aa, Homo Sapiens
YVAHERLGY

SEQ ID NO: 933137 - protein, 9 aa, Homo Sapiens
GRMSLFALN

SEQ ID NO: 933138 - protein, 9 aa, Homo Sapiens
WGRLLPARG

SEQ ID NO: 933139 - protein, 9 aa, Homo Sapiens
RRCGRFVKK

SEQ ID NO: 933140 - protein, 9 aa, Homo Sapiens
PMAEDISLL

SEQ ID NO: 933141 - protein, 9 aa, Homo Sapiens
QSQNQAQVV

SEQ ID NO: 933142 - protein, 9 aa, Homo Sapiens
GTNAGKAFC

SEQ ID NO: 933143 - protein, 9 aa, Homo Sapiens
KAPIKEKLS

SEQ ID NO: 933144 - protein, 9 aa, Homo Sapiens
VNPTGNLSM

SEQ ID NO: 933145 - protein, 9 aa, Homo Sapiens
NIRFIKVYW

SEQ ID NO: 933146 - protein, 9 aa, Homo Sapiens
SHHMNDALV

SEQ ID NO: 933147 - protein, 9 aa, Homo Sapiens
LFCAVYMIA

SEQ ID NO: 933148 - protein, 9 aa, Homo Sapiens
PPTLQEIIQ

SEQ ID NO: 933149 - protein, 9 aa, Homo Sapiens
PYLSANVSS

SEQ ID NO: 933150 - protein, 9 aa, Homo Sapiens
YPGGSWENI

SEQ ID NO: 933151 - protein, 9 aa, Homo Sapiens
IEKSGELCK

SEQ ID NO: 933152 - protein, 9 aa, Homo Sapiens
EMSPSDSLK

SEQ ID NO: 933153 - protein, 9 aa, Homo Sapiens
QARMCDAHL

SEQ ID NO: 933154 - protein, 9 aa, Homo Sapiens
APTPKEKEE

SEQ ID NO: 933155 - protein, 9 aa, Homo Sapiens
KTLEKLDLG

SEQ ID NO: 933156 - protein, 9 aa, Homo Sapiens
TFLIGLAVG

SEQ ID NO: 933157 - protein, 9 aa, Homo Sapiens
EPIYSTLPQ

SEQ ID NO: 933158 - protein, 9 aa, Homo Sapiens
ALWLGCLPE

SEQ ID NO: 933159 - protein, 9 aa, Homo Sapiens
MGEDSAPRY

SEQ ID NO: 933160 - protein, 9 aa, Homo Sapiens
RPWPTSSSG

SEQ ID NO: 933161 - protein, 9 aa, Homo Sapiens
VIVLYLSKQ

SEQ ID NO: 933162 - protein, 9 aa, Homo Sapiens
SPARSLQGL

SEQ ID NO: 933163 - protein, 9 aa, Homo Sapiens
LEKRWQRLQ

SEQ ID NO: 933164 - protein, 9 aa, Homo Sapiens
QEEISIWEI

SEQ ID NO: 933165 - protein, 9 aa, Homo Sapiens
SRGRLAREP

SEQ ID NO: 933166 - protein, 9 aa, Homo Sapiens
NNKSRTEAE

SEQ ID NO: 933167 - protein, 9 aa, Homo Sapiens
LSYRKLMDT

SEQ ID NO: 933168 - protein, 9 aa, Homo Sapiens
SAQPKDCED

SEQ ID NO: 933169 - protein, 9 aa, Homo Sapiens
DTAQKKLYR

SEQ ID NO: 933170 - protein, 9 aa, Homo Sapiens
FCNRRQREN

SEQ ID NO: 933171 - protein, 9 aa, Homo Sapiens
RMLKERALK

SEQ ID NO: 933172 - protein, 9 aa, Homo Sapiens
LPGTHILEE

SEQ ID NO: 933173 - protein, 9 aa, Homo Sapiens
GALWLGCLP

SEQ ID NO: 933174 - protein, 9 aa, Homo Sapiens
GCNKEKERT

SEQ ID NO: 933175 - protein, 9 aa, Homo Sapiens
IQQVFGAKA

SEQ ID NO: 933176 - protein, 9 aa, Homo Sapiens
AATAVVEFG

SEQ ID NO: 933177 - protein, 9 aa, Homo Sapiens
EVKVEEELG

SEQ ID NO: 933178 - protein, 9 aa, Homo Sapiens
VVEIFCNHF

SEQ ID NO: 933179 - protein, 9 aa, Homo Sapiens
KLCLNSRKP

SEQ ID NO: 933180 - protein, 9 aa, Homo Sapiens
LAEWGPLAQ

SEQ ID NO: 933181 - protein, 9 aa, Homo Sapiens
CLQENTVSV

SEQ ID NO: 933182 - protein, 9 aa, Homo Sapiens
SSPKIQDAG

SEQ ID NO: 933183 - protein, 9 aa, Homo Sapiens
SAPYDWFGN

SEQ ID NO: 933184 - protein, 9 aa, Homo Sapiens
ASVMVFSEG

SEQ ID NO: 933185 - protein, 9 aa, Homo Sapiens
DLSFPEDCL

SEQ ID NO: 933186 - protein, 9 aa, Homo Sapiens
YVEYFIISG

SEQ ID NO: 933187 - protein, 9 aa, Homo Sapiens
RAFSPEHGS

SEQ ID NO: 933188 - protein, 9 aa, Homo Sapiens
SSASSNSSG

SEQ ID NO: 933189 - protein, 9 aa, Homo Sapiens
HAFYQLIYQ

SEQ ID NO: 933190 - protein, 9 aa, Homo Sapiens
NQRHLAQTL

SEQ ID NO: 933191 - protein, 9 aa, Homo Sapiens
IRSLKRPPL

SEQ ID NO: 933192 - protein, 9 aa, Homo Sapiens
LYDKYYMAS

SEQ ID NO: 933193 - protein, 9 aa, Homo Sapiens
QGPKGMKGL

SEQ ID NO: 933194 - protein, 9 aa, Homo Sapiens
HMKKILIFA

SEQ ID NO: 933195 - protein, 9 aa, Homo Sapiens
NKEMEFLDI

SEQ ID NO: 933196 - protein, 9 aa, Homo Sapiens
GSSPFFREK

SEQ ID NO: 933197 - protein, 9 aa, Homo Sapiens
RWINSSFPV

SEQ ID NO: 933198 - protein, 9 aa, Homo Sapiens
EKMWGQKEM

SEQ ID NO: 933199 - protein, 9 aa, Homo Sapiens
HSHCPRHCP

SEQ ID NO: 933200 - protein, 9 aa, Homo Sapiens
NFAQKELLK

SEQ ID NO: 933201 - protein, 9 aa, Homo Sapiens
ASFLEATED

SEQ ID NO: 933202 - protein, 9 aa, Homo Sapiens
VSVLRSFRL

SEQ ID NO: 933203 - protein, 9 aa, Homo Sapiens
YKIHGMTIP

SEQ ID NO: 933204 - protein, 9 aa, Homo Sapiens
PNGRSSWMR

SEQ ID NO: 933205 - protein, 9 aa, Homo Sapiens
PYYAEADIV

SEQ ID NO: 933206 - protein, 9 aa, Homo Sapiens
TIAFLTLAN

SEQ ID NO: 933207 - protein, 9 aa, Homo Sapiens
VTQIVEVLH

SEQ ID NO: 933208 - protein, 9 aa, Homo Sapiens
SPSSALLPP

SEQ ID NO: 933209 - protein, 9 aa, Homo Sapiens
RLGYAFSVW

SEQ ID NO: 933210 - protein, 9 aa, Homo Sapiens
FRYYAGWAY

SEQ ID NO: 933211 - protein, 9 aa, Homo Sapiens
RPCTWWSGT

SEQ ID NO: 933212 - protein, 9 aa, Homo Sapiens
AAEPGGLRS

SEQ ID NO: 933213 - protein, 9 aa, Homo Sapiens
RPRRPREAL

SEQ ID NO: 933214 - protein, 9 aa, Homo Sapiens
ELCKEISTN

SEQ ID NO: 933215 - protein, 9 aa, Homo Sapiens
SSTEAVLNI

SEQ ID NO: 933216 - protein, 9 aa, Homo Sapiens
MSLFALNPR

SEQ ID NO: 933217 - protein, 9 aa, Homo Sapiens
AAPEAEPAE

SEQ ID NO: 933218 - protein, 9 aa, Homo Sapiens
EHRGFQQFS

SEQ ID NO: 933219 - protein, 9 aa, Homo Sapiens
LELNLDEDF

SEQ ID NO: 933220 - protein, 9 aa, Homo Sapiens
KVIQVEPPN

SEQ ID NO: 933221 - protein, 9 aa, Homo Sapiens
GRRPWPTSS

SEQ ID NO: 933222 - protein, 9 aa, Homo Sapiens
DSLRPASTS

SEQ ID NO: 933223 - protein, 9 aa, Homo Sapiens
AFLTLANIK

SEQ ID NO: 933224 - protein, 9 aa, Homo Sapiens
ENTVSVFME

SEQ ID NO: 933225 - protein, 9 aa, Homo Sapiens
RKLMDTDLV

SEQ ID NO: 933226 - protein, 9 aa, Homo Sapiens
TRLQDTTFF

SEQ ID NO: 933227 - protein, 9 aa, Homo Sapiens
FSCTKHDEC

SEQ ID NO: 933228 - protein, 9 aa, Homo Sapiens
GEHPPRSPL

SEQ ID NO: 933229 - protein, 9 aa, Homo Sapiens
SRAIDVTLT

SEQ ID NO: 933230 - protein, 9 aa, Homo Sapiens
RRFLSKKYR

SEQ ID NO: 933231 - protein, 9 aa, Homo Sapiens
RFYTDRISF

SEQ ID NO: 933232 - protein, 9 aa, Homo Sapiens
SQNQAQVVL

SEQ ID NO: 933233 - protein, 9 aa, Homo Sapiens
PLPAGVPNL

SEQ ID NO: 933234 - protein, 9 aa, Homo Sapiens
LTEVVSKKQ

SEQ ID NO: 933235 - protein, 9 aa, Homo Sapiens
VVIVLYLSK

SEQ ID NO: 933236 - protein, 9 aa, Homo Sapiens
RAFITHGEA

SEQ ID NO: 933237 - protein, 9 aa, Homo Sapiens
PIKEKLSQD

SEQ ID NO: 933238 - protein, 9 aa, Homo Sapiens
YKMQALAST

SEQ ID NO: 933239 - protein, 9 aa, Homo Sapiens
PPGERGPKG

SEQ ID NO: 933240 - protein, 9 aa, Homo Sapiens
AEQEAQTIY

SEQ ID NO: 933241 - protein, 9 aa, Homo Sapiens
EHPPRSPLE

SEQ ID NO: 933242 - protein, 9 aa, Homo Sapiens
NPKFGVHLG

SEQ ID NO: 933243 - protein, 9 aa, Homo Sapiens
RGRKTFLIL

SEQ ID NO: 933244 - protein, 9 aa, Homo Sapiens
SGTWRWGRR

SEQ ID NO: 933245 - protein, 9 aa, Homo Sapiens
VAGPAAQRF

SEQ ID NO: 933246 - protein, 9 aa, Homo Sapiens
VSVFMEFVP

SEQ ID NO: 933247 - protein, 9 aa, Homo Sapiens
ACAFASHPN

SEQ ID NO: 933248 - protein, 9 aa, Homo Sapiens
LIIKAIGNV

SEQ ID NO: 933249 - protein, 9 aa, Homo Sapiens
PQNPATFQH

SEQ ID NO: 933250 - protein, 9 aa, Homo Sapiens
RLHSHCPRH

SEQ ID NO: 933251 - protein, 9 aa, Homo Sapiens
MSTFLIGLA

SEQ ID NO: 933252 - protein, 9 aa, Homo Sapiens
NSPLETEFP

SEQ ID NO: 933253 - protein, 9 aa, Homo Sapiens
ETIDVEVMN

SEQ ID NO: 933254 - protein, 9 aa, Homo Sapiens
STSASSRTR

SEQ ID NO: 933255 - protein, 9 aa, Homo Sapiens
QPAAEPGGL

SEQ ID NO: 933256 - protein, 9 aa, Homo Sapiens
MERPPSGPP

SEQ ID NO: 933257 - protein, 9 aa, Homo Sapiens
EKPAPSWSA

SEQ ID NO: 933258 - protein, 9 aa, Homo Sapiens
HALMLPLLS

SEQ ID NO: 933259 - protein, 9 aa, Homo Sapiens
SALLPPEQA

SEQ ID NO: 933260 - protein, 9 aa, Homo Sapiens
LEKPAPSWS

SEQ ID NO: 933261 - protein, 9 aa, Homo Sapiens
EIFKEGSDL

SEQ ID NO: 933262 - protein, 9 aa, Homo Sapiens
MKSCGIHET

SEQ ID NO: 933263 - protein, 9 aa, Homo Sapiens
EQRDQQKEQ

SEQ ID NO: 933264 - protein, 9 aa, Homo Sapiens
KPAPSWSAM

SEQ ID NO: 933265 - protein, 9 aa, Homo Sapiens
WTYQNKEME

SEQ ID NO: 933266 - protein, 9 aa, Homo Sapiens
NITSNDGPR

SEQ ID NO: 933267 - protein, 9 aa, Homo Sapiens
TYQGNKCEE

SEQ ID NO: 933268 - protein, 9 aa, Homo Sapiens
VPEDQIFIA

SEQ ID NO: 933269 - protein, 9 aa, Homo Sapiens
SLEIRFTPF

SEQ ID NO: 933270 - protein, 9 aa, Homo Sapiens
AEIWKDEHR

SEQ ID NO: 933271 - protein, 9 aa, Homo Sapiens
ISPNQRHLA

SEQ ID NO: 933272 - protein, 9 aa, Homo Sapiens
LLRVCTREP

SEQ ID NO: 933273 - protein, 9 aa, Homo Sapiens
SGSTATGYL

SEQ ID NO: 933274 - protein, 9 aa, Homo Sapiens
DVEVMNSLA

SEQ ID NO: 933275 - protein, 9 aa, Homo Sapiens
PPFPEENIT

SEQ ID NO: 933276 - protein, 9 aa, Homo Sapiens
GVRKACVTP

SEQ ID NO: 933277 - protein, 9 aa, Homo Sapiens
IPDQTAQVF

SEQ ID NO: 933278 - protein, 9 aa, Homo Sapiens
FYTDRISFR

SEQ ID NO: 933279 - protein, 9 aa, Homo Sapiens
DDASFLEAT

SEQ ID NO: 933280 - protein, 9 aa, Homo Sapiens
WAYKIHGMT

SEQ ID NO: 933281 - protein, 9 aa, Homo Sapiens
GRLHSHCPR

SEQ ID NO: 933282 - protein, 9 aa, Homo Sapiens
TVFFFSSFQ

SEQ ID NO: 933283 - protein, 9 aa, Homo Sapiens
KGHLEAGAH

SEQ ID NO: 933284 - protein, 9 aa, Homo Sapiens
SYRRGGPPR

SEQ ID NO: 933285 - protein, 9 aa, Homo Sapiens
NQTFIASSG

SEQ ID NO: 933286 - protein, 9 aa, Homo Sapiens
WSDHRPVCQ

SEQ ID NO: 933287 - protein, 9 aa, Homo Sapiens
IRQFFSCSH

SEQ ID NO: 933288 - protein, 9 aa, Homo Sapiens
PKEKEEWIK

SEQ ID NO: 933289 - protein, 9 aa, Homo Sapiens
ASRWGRLLP

SEQ ID NO: 933290 - protein, 9 aa, Homo Sapiens
KEMREKEER

SEQ ID NO: 933291 - protein, 9 aa, Homo Sapiens
PTIGGSHAL

SEQ ID NO: 933292 - protein, 9 aa, Homo Sapiens
VMVFSEGPL

SEQ ID NO: 933293 - protein, 9 aa, Homo Sapiens
YQNKEMEFL

SEQ ID NO: 933294 - protein, 9 aa, Homo Sapiens
SIYVPSPAV

SEQ ID NO: 933295 - protein, 9 aa, Homo Sapiens
RSERGPIDT

SEQ ID NO: 933296 - protein, 9 aa, Homo Sapiens
PSFYSPLSS

SEQ ID NO: 933297 - protein, 9 aa, Homo Sapiens
GIDDASFLE

SEQ ID NO: 933298 - protein, 9 aa, Homo Sapiens
TQLCAQKCK

SEQ ID NO: 933299 - protein, 9 aa, Homo Sapiens
ARKEVIKNK

SEQ ID NO: 933300 - protein, 9 aa, Homo Sapiens
CHGGRVGFL

SEQ ID NO: 933301 - protein, 9 aa, Homo Sapiens
PTSKKGLAS

SEQ ID NO: 933302 - protein, 9 aa, Homo Sapiens
WPLSTSASS

SEQ ID NO: 933303 - protein, 9 aa, Homo Sapiens
KSMESNLCV

SEQ ID NO: 933304 - protein, 9 aa, Homo Sapiens
YSYGELGHY

SEQ ID NO: 933305 - protein, 9 aa, Homo Sapiens
SPIANIQSN

SEQ ID NO: 933306 - protein, 9 aa, Homo Sapiens
WGPLAQIEA

SEQ ID NO: 933307 - protein, 9 aa, Homo Sapiens
TREVLVRKE

SEQ ID NO: 933308 - protein, 9 aa, Homo Sapiens
VFGPNGRSS

SEQ ID NO: 933309 - protein, 9 aa, Homo Sapiens
RNSFAFTPI

SEQ ID NO: 933310 - protein, 9 aa, Homo Sapiens
FLDVLEFNQ

SEQ ID NO: 933311 - protein, 9 aa, Homo Sapiens
PYGILILGQ

SEQ ID NO: 933312 - protein, 9 aa, Homo Sapiens
AQLLQHAAT

SEQ ID NO: 933313 - protein, 9 aa, Homo Sapiens
RDLEKAPIK

SEQ ID NO: 933314 - protein, 9 aa, Homo Sapiens
RIKSHSYLS

SEQ ID NO: 933315 - protein, 9 aa, Homo Sapiens
APRPVWPNP

SEQ ID NO: 933316 - protein, 9 aa, Homo Sapiens
VHKILCKLS

SEQ ID NO: 933317 - protein, 9 aa, Homo Sapiens
IPENSPLET

SEQ ID NO: 933318 - protein, 9 aa, Homo Sapiens
EGREGPVPQ

SEQ ID NO: 933319 - protein, 9 aa, Homo Sapiens
FQTSFVGMK

SEQ ID NO: 933320 - protein, 9 aa, Homo Sapiens
ASSGITCTD

SEQ ID NO: 933321 - protein, 9 aa, Homo Sapiens
DTSPNIETP

SEQ ID NO: 933322 - protein, 9 aa, Homo Sapiens
TGKAFSGQS

SEQ ID NO: 933323 - protein, 9 aa, Homo Sapiens
ADEAKKYNL

SEQ ID NO: 933324 - protein, 9 aa, Homo Sapiens
NVEIRQFFS

SEQ ID NO: 933325 - protein, 9 aa, Homo Sapiens
KHKLYVSFR

SEQ ID NO: 933326 - protein, 9 aa, Homo Sapiens
NRYPGGSWE

SEQ ID NO: 933327 - protein, 9 aa, Homo Sapiens
RKMLSALES

SEQ ID NO: 933328 - protein, 9 aa, Homo Sapiens
GSTATGYLL

SEQ ID NO: 933329 - protein, 9 aa, Homo Sapiens
EPPRAPEPE

SEQ ID NO: 933330 - protein, 9 aa, Homo Sapiens
LTTLLRALE

SEQ ID NO: 933331 - protein, 9 aa, Homo Sapiens
KRNPISVVS

SEQ ID NO: 933332 - protein, 9 aa, Homo Sapiens
PELERNRLY

SEQ ID NO: 933333 - protein, 9 aa, Homo Sapiens
KVSSKEKKK

SEQ ID NO: 933334 - protein, 9 aa, Homo Sapiens
PGSTPLVGS

SEQ ID NO: 933335 - protein, 9 aa, Homo Sapiens
GNPKQSGLG

SEQ ID NO: 933336 - protein, 9 aa, Homo Sapiens
IQDSHDFST

SEQ ID NO: 933337 - protein, 9 aa, Homo Sapiens
DRFYTDRIS

SEQ ID NO: 933338 - protein, 9 aa, Homo Sapiens
RLHEAAEAV

SEQ ID NO: 933339 - protein, 9 aa, Homo Sapiens
SRWINSSFP

SEQ ID NO: 933340 - protein, 9 aa, Homo Sapiens
KNAVAKIDA

SEQ ID NO: 933341 - protein, 9 aa, Homo Sapiens
LWRSYRRGG

SEQ ID NO: 933342 - protein, 9 aa, Homo Sapiens
GVAVIKMFD

SEQ ID NO: 933343 - protein, 9 aa, Homo Sapiens
IMTDFEKNV

SEQ ID NO: 933344 - protein, 9 aa, Homo Sapiens
RMSLFALNP

SEQ ID NO: 933345 - protein, 9 aa, Homo Sapiens
LHIKQNIPI

SEQ ID NO: 933346 - protein, 9 aa, Homo Sapiens
SFVGMKSCG

SEQ ID NO: 933347 - protein, 9 aa, Homo Sapiens
PILPSMFNW

SEQ ID NO: 933348 - protein, 9 aa, Homo Sapiens
ISINYEENK

SEQ ID NO: 933349 - protein, 9 aa, Homo Sapiens
SLRPYMVSD

SEQ ID NO: 933350 - protein, 9 aa, Homo Sapiens
APSWSAMRN

SEQ ID NO: 933351 - protein, 9 aa, Homo Sapiens
IFYNACAAQ

SEQ ID NO: 933352 - protein, 9 aa, Homo Sapiens
LGTISSANM

SEQ ID NO: 933353 - protein, 9 aa, Homo Sapiens
ALSSCPSTV

SEQ ID NO: 933354 - protein, 9 aa, Homo Sapiens
IDTSPNIET

SEQ ID NO: 933355 - protein, 9 aa, Homo Sapiens
RRQRENRVK

SEQ ID NO: 933356 - protein, 9 aa, Homo Sapiens
PLMKKIKQE

SEQ ID NO: 933357 - protein, 9 aa, Homo Sapiens
FSVIFLLKR

SEQ ID NO: 933358 - protein, 9 aa, Homo Sapiens
DRMLKERAL

SEQ ID NO: 933359 - protein, 9 aa, Homo Sapiens
FEIFKEGSD

SEQ ID NO: 933360 - protein, 9 aa, Homo Sapiens
IVLIVLIYD

SEQ ID NO: 933361 - protein, 9 aa, Homo Sapiens
VPYYAEADI

SEQ ID NO: 933362 - protein, 9 aa, Homo Sapiens
EAPRPVWPN

SEQ ID NO: 933363 - protein, 9 aa, Homo Sapiens
SVIFLLKRL

SEQ ID NO: 933364 - protein, 9 aa, Homo Sapiens
SANVSSWLP

SEQ ID NO: 933365 - protein, 9 aa, Homo Sapiens
QEVCASVPK

SEQ ID NO: 933366 - protein, 9 aa, Homo Sapiens
GGPPRWCME

SEQ ID NO: 933367 - protein, 9 aa, Homo Sapiens
CPSPAHIWL

SEQ ID NO: 933368 - protein, 9 aa, Homo Sapiens
GPLAQIEAS

SEQ ID NO: 933369 - protein, 9 aa, Homo Sapiens
GCLPELPVG

SEQ ID NO: 933370 - protein, 9 aa, Homo Sapiens
EANEGPFLG

SEQ ID NO: 933371 - protein, 9 aa, Homo Sapiens
LLQHAATGK

SEQ ID NO: 933372 - protein, 9 aa, Homo Sapiens
VIKNKIRAI

SEQ ID NO: 933373 - protein, 9 aa, Homo Sapiens
KKLYRDVMV

SEQ ID NO: 933374 - protein, 9 aa, Homo Sapiens
GGLRSLGPG

SEQ ID NO: 933375 - protein, 9 aa, Homo Sapiens
SGCSTSRPR

SEQ ID NO: 933376 - protein, 9 aa, Homo Sapiens
ASTQGTSHC

SEQ ID NO: 933377 - protein, 9 aa, Homo Sapiens
ASLVSRLTL

SEQ ID NO: 933378 - protein, 9 aa, Homo Sapiens
EQEAQTIYE

SEQ ID NO: 933379 - protein, 9 aa, Homo Sapiens
FENITQKVV

SEQ ID NO: 933380 - protein, 9 aa, Homo Sapiens
KQACKKHKL

SEQ ID NO: 933381 - protein, 9 aa, Homo Sapiens
DDGLTEVVS

SEQ ID NO: 933382 - protein, 9 aa, Homo Sapiens
LVNPTGNLS

SEQ ID NO: 933383 - protein, 9 aa, Homo Sapiens
YYLYWTYQN

SEQ ID NO: 933384 - protein, 9 aa, Homo Sapiens
PFFREKAPG

SEQ ID NO: 933385 - protein, 9 aa, Homo Sapiens
WHPIKPYGI

SEQ ID NO: 933386 - protein, 9 aa, Homo Sapiens
REPQVYALP

SEQ ID NO: 933387 - protein, 9 aa, Homo Sapiens
KKNRKMVND

SEQ ID NO: 933388 - protein, 9 aa, Homo Sapiens
PREPQVYAL

SEQ ID NO: 933389 - protein, 9 aa, Homo Sapiens
RIVSRVDGT

SEQ ID NO: 933390 - protein, 9 aa, Homo Sapiens
KDKVVESLP

SEQ ID NO: 933391 - protein, 9 aa, Homo Sapiens
FVSNAYNFF

SEQ ID NO: 933392 - protein, 9 aa, Homo Sapiens
PAEASVKDS

SEQ ID NO: 933393 - protein, 9 aa, Homo Sapiens
ERPPLSTLI

SEQ ID NO: 933394 - protein, 9 aa, Homo Sapiens
ERNRLYPAY

SEQ ID NO: 933395 - protein, 9 aa, Homo Sapiens
KNEEKNNGP

SEQ ID NO: 933396 - protein, 9 aa, Homo Sapiens
FAQKELLKQ

SEQ ID NO: 933397 - protein, 9 aa, Homo Sapiens
QPREPQVYA

SEQ ID NO: 933398 - protein, 9 aa, Homo Sapiens
LIQQVEVDL

SEQ ID NO: 933399 - protein, 9 aa, Homo Sapiens
TTVFFFSSF

SEQ ID NO: 933400 - protein, 9 aa, Homo Sapiens
CSHHMNDAL

SEQ ID NO: 933401 - protein, 9 aa, Homo Sapiens
NEIIESGRI

SEQ ID NO: 933402 - protein, 9 aa, Homo Sapiens
ADPSFYSPL

SEQ ID NO: 933403 - protein, 9 aa, Homo Sapiens
DGNKDMAFR

SEQ ID NO: 933404 - protein, 9 aa, Homo Sapiens
CPSLPASLN

SEQ ID NO: 933405 - protein, 9 aa, Homo Sapiens
KTRNGKANF

SEQ ID NO: 933406 - protein, 9 aa, Homo Sapiens
VDCFLKLCL

SEQ ID NO: 933407 - protein, 9 aa, Homo Sapiens
AAPGTNAGK

SEQ ID NO: 933408 - protein, 9 aa, Homo Sapiens
PATFQHPPP

SEQ ID NO: 933409 - protein, 9 aa, Homo Sapiens
RPRSKQEAW

SEQ ID NO: 933410 - protein, 9 aa, Homo Sapiens
NLVRRCITR

SEQ ID NO: 933411 - protein, 9 aa, Homo Sapiens
GRLLPARGA

SEQ ID NO: 933412 - protein, 9 aa, Homo Sapiens
LHFPLFESH

SEQ ID NO: 933413 - protein, 9 aa, Homo Sapiens
YFLDRFYTD

SEQ ID NO: 933414 - protein, 9 aa, Homo Sapiens
TPQNPATFQ

SEQ ID NO: 933415 - protein, 9 aa, Homo Sapiens
SGLGELPDK

SEQ ID NO: 933416 - protein, 9 aa, Homo Sapiens
EKNNGPLIT

SEQ ID NO: 933417 - protein, 9 aa, Homo Sapiens
LGEHPPRSP

SEQ ID NO: 933418 - protein, 9 aa, Homo Sapiens
LSSCPSTVS

SEQ ID NO: 933419 - protein, 9 aa, Homo Sapiens
YHKKTYRGY

SEQ ID NO: 933420 - protein, 9 aa, Homo Sapiens
PEAEPAEKV

SEQ ID NO: 933421 - protein, 9 aa, Homo Sapiens
GPFLGNRAC

SEQ ID NO: 933422 - protein, 9 aa, Homo Sapiens
MNDALVLYY

SEQ ID NO: 933423 - protein, 9 aa, Homo Sapiens
HGEANGIYE

SEQ ID NO: 933424 - protein, 9 aa, Homo Sapiens
EDTINLPGR

SEQ ID NO: 933425 - protein, 9 aa, Homo Sapiens
REDRLQEYT

SEQ ID NO: 933426 - protein, 9 aa, Homo Sapiens
MKKILIFAF

SEQ ID NO: 933427 - protein, 9 aa, Homo Sapiens
LADSLRGRG

SEQ ID NO: 933428 - protein, 9 aa, Homo Sapiens
TPPVAVTFP

SEQ ID NO: 933429 - protein, 9 aa, Homo Sapiens
RSLKRPPLA

SEQ ID NO: 933430 - protein, 9 aa, Homo Sapiens
EIRQFFSCS

SEQ ID NO: 933431 - protein, 9 aa, Homo Sapiens
CTPLSCLKQ

SEQ ID NO: 933432 - protein, 9 aa, Homo Sapiens
AREDRLQEY

SEQ ID NO: 933433 - protein, 9 aa, Homo Sapiens
DTTMYKMQA

SEQ ID NO: 933434 - protein, 9 aa, Homo Sapiens
SPAHIWLTG

SEQ ID NO: 933435 - protein, 9 aa, Homo Sapiens
ASKAGFLPR

SEQ ID NO: 933436 - protein, 9 aa, Homo Sapiens
DKLLIILPF

SEQ ID NO: 933437 - protein, 9 aa, Homo Sapiens
ANNGIVTKL

SEQ ID NO: 933438 - protein, 9 aa, Homo Sapiens
PPSGSSRGR

SEQ ID NO: 933439 - protein, 9 aa, Homo Sapiens
HTLREEKVH

SEQ ID NO: 933440 - protein, 9 aa, Homo Sapiens
PPLADAPTV

SEQ ID NO: 933441 - protein, 9 aa, Homo Sapiens
LVRKEQSST

SEQ ID NO: 933442 - protein, 9 aa, Homo Sapiens
ADSLRPAST

SEQ ID NO: 933443 - protein, 9 aa, Homo Sapiens
MEKTRNGKA

SEQ ID NO: 933444 - protein, 9 aa, Homo Sapiens
QLLDTAQKK

SEQ ID NO: 933445 - protein, 9 aa, Homo Sapiens
DFEKNVDIA

SEQ ID NO: 933446 - protein, 9 aa, Homo Sapiens
ERPAVAMPS

SEQ ID NO: 933447 - protein, 9 aa, Homo Sapiens
IKMFDKVKV

SEQ ID NO: 933448 - protein, 9 aa, Homo Sapiens
GWAYKIHGM

SEQ ID NO: 933449 - protein, 9 aa, Homo Sapiens
GPNGRSSWM

SEQ ID NO: 933450 - protein, 9 aa, Homo Sapiens
VLGTISSAN

SEQ ID NO: 933451 - protein, 9 aa, Homo Sapiens
SLRGRGVTL

SEQ ID NO: 933452 - protein, 9 aa, Homo Sapiens
SVIVLIVLI

SEQ ID NO: 933453 - protein, 9 aa, Homo Sapiens
ELTDMKKLA

SEQ ID NO: 933454 - protein, 9 aa, Homo Sapiens
YCGHDFCIR

SEQ ID NO: 933455 - protein, 9 aa, Homo Sapiens
CEKLTIQIK

SEQ ID NO: 933456 - protein, 9 aa, Homo Sapiens
VSMRMLIPK

SEQ ID NO: 933457 - protein, 9 aa, Homo Sapiens
IASSGITCT

SEQ ID NO: 933458 - protein, 9 aa, Homo Sapiens
AKKYNLVLG

SEQ ID NO: 933459 - protein, 9 aa, Homo Sapiens
GSKWKKHCQ

SEQ ID NO: 933460 - protein, 9 aa, Homo Sapiens
FAMAVTRFP

SEQ ID NO: 933461 - protein, 9 aa, Homo Sapiens
FFKITLTSD

SEQ ID NO: 933462 - protein, 9 aa, Homo Sapiens
PAPSWSAMR

SEQ ID NO: 933463 - protein, 9 aa, Homo Sapiens
GDFGDIEDT

SEQ ID NO: 933464 - protein, 9 aa, Homo Sapiens
SPWSSTSGT

SEQ ID NO: 933465 - protein, 9 aa, Homo Sapiens
KHSLKIVLR

SEQ ID NO: 933466 - protein, 9 aa, Homo Sapiens
YALPPSQKM

SEQ ID NO: 933467 - protein, 9 aa, Homo Sapiens
AAREDRLQE

SEQ ID NO: 933468 - protein, 9 aa, Homo Sapiens
NIGASENSD

SEQ ID NO: 933469 - protein, 9 aa, Homo Sapiens
TLDKLGNRL

SEQ ID NO: 933470 - protein, 9 aa, Homo Sapiens
SVMVFSEGP

SEQ ID NO: 933471 - protein, 9 aa, Homo Sapiens
VSRVDGTPG

SEQ ID NO: 933472 - protein, 9 aa, Homo Sapiens
VKDSALLMQ

SEQ ID NO: 933473 - protein, 9 aa, Homo Sapiens
IYEENIARL

SEQ ID NO: 933474 - protein, 9 aa, Homo Sapiens
VCASVPKIA

SEQ ID NO: 933475 - protein, 9 aa, Homo Sapiens
ISVIVLIVL

SEQ ID NO: 933476 - protein, 9 aa, Homo Sapiens
SKDKVVESL

SEQ ID NO: 933477 - protein, 9 aa, Homo Sapiens
ILKEADPSS

SEQ ID NO: 933478 - protein, 9 aa, Homo Sapiens
LEIRFTPFA

SEQ ID NO: 933479 - protein, 9 aa, Homo Sapiens
PLSYRKLMD

SEQ ID NO: 933480 - protein, 9 aa, Homo Sapiens
NINECKVEP

SEQ ID NO: 933481 - protein, 9 aa, Homo Sapiens
SIENSEKSK

SEQ ID NO: 933482 - protein, 9 aa, Homo Sapiens
SPEHGSAKQ

SEQ ID NO: 933483 - protein, 9 aa, Homo Sapiens
KVEPCKNGG

SEQ ID NO: 933484 - protein, 9 aa, Homo Sapiens
EPGGLRSLG

SEQ ID NO: 933485 - protein, 9 aa, Homo Sapiens
KDSALLMQT

SEQ ID NO: 933486 - protein, 9 aa, Homo Sapiens
SGNQTFIAS

SEQ ID NO: 933487 - protein, 9 aa, Homo Sapiens
QNQAQVVLN

SEQ ID NO: 933488 - protein, 9 aa, Homo Sapiens
PFPGGRITL

SEQ ID NO: 933489 - protein, 9 aa, Homo Sapiens
KHNNIRNLV

SEQ ID NO: 933490 - protein, 9 aa, Homo Sapiens
CNIELMSSA

SEQ ID NO: 933491 - protein, 9 aa, Homo Sapiens
LCIFPPPHP

SEQ ID NO: 933492 - protein, 9 aa, Homo Sapiens
NSFAFTPIS

SEQ ID NO: 933493 - protein, 9 aa, Homo Sapiens
THILEEAQK

SEQ ID NO: 933494 - protein, 9 aa, Homo Sapiens
NYEENKLYW

SEQ ID NO: 933495 - protein, 9 aa, Homo Sapiens
GTLLPANIL

SEQ ID NO: 933496 - protein, 9 aa, Homo Sapiens
EVRWEIFWS

SEQ ID NO: 933497 - protein, 9 aa, Homo Sapiens
PSSEKLQAN

SEQ ID NO: 933498 - protein, 9 aa, Homo Sapiens
YYAEADIVN

SEQ ID NO: 933499 - protein, 9 aa, Homo Sapiens
EGGGGGFRG

SEQ ID NO: 933500 - protein, 9 aa, Homo Sapiens
DASFLEATE

SEQ ID NO: 933501 - protein, 9 aa, Homo Sapiens
PRLSPWSST

SEQ ID NO: 933502 - protein, 9 aa, Homo Sapiens
KLTIQIKGK

SEQ ID NO: 933503 - protein, 9 aa, Homo Sapiens
KLDSRAIDV

SEQ ID NO: 933504 - protein, 9 aa, Homo Sapiens
GGRVGFLQG

SEQ ID NO: 933505 - protein, 9 aa, Homo Sapiens
GTIFSVIFL

SEQ ID NO: 933506 - protein, 9 aa, Homo Sapiens
MATQRFPNN

SEQ ID NO: 933507 - protein, 9 aa, Homo Sapiens
FFSSFQYLI

SEQ ID NO: 933508 - protein, 9 aa, Homo Sapiens
VDKNAVAKI

SEQ ID NO: 933509 - protein, 9 aa, Homo Sapiens
CCSQLEKRW

SEQ ID NO: 933510 - protein, 9 aa, Homo Sapiens
LVCGVRKAC

SEQ ID NO: 933511 - protein, 9 aa, Homo Sapiens
TADSLRPAS

SEQ ID NO: 933512 - protein, 9 aa, Homo Sapiens
RQFFSCSHR

SEQ ID NO: 933513 - protein, 9 aa, Homo Sapiens
EAVLNIRFI

SEQ ID NO: 933514 - protein, 9 aa, Homo Sapiens
LSQQRRQRV

SEQ ID NO: 933515 - protein, 9 aa, Homo Sapiens
IIQMAAEIA

SEQ ID NO: 933516 - protein, 9 aa, Homo Sapiens
PFRLFNFTA

SEQ ID NO: 933517 - protein, 9 aa, Homo Sapiens
ITTQLCAQK

SEQ ID NO: 933518 - protein, 9 aa, Homo Sapiens
KEKERTCAE

SEQ ID NO: 933519 - protein, 9 aa, Homo Sapiens
GLDKLLIIL

SEQ ID NO: 933520 - protein, 9 aa, Homo Sapiens
GGLTSPEIR

SEQ ID NO: 933521 - protein, 9 aa, Homo Sapiens
PKIQDAGPA

SEQ ID NO: 933522 - protein, 9 aa, Homo Sapiens
LAREPRLSP

SEQ ID NO: 933523 - protein, 9 aa, Homo Sapiens
EGSNCSKDK

SEQ ID NO: 933524 - protein, 9 aa, Homo Sapiens
RPVWPNPKL

SEQ ID NO: 933525 - protein, 9 aa, Homo Sapiens
SKVFFKITL

SEQ ID NO: 933526 - protein, 9 aa, Homo Sapiens
SSRGRLARE

SEQ ID NO: 933527 - protein, 9 aa, Homo Sapiens
TEAEISDHN

SEQ ID NO: 933528 - protein, 9 aa, Homo Sapiens
KFNEFFFLH

SEQ ID NO: 933529 - protein, 9 aa, Homo Sapiens
LYCGHDFCI

SEQ ID NO: 933530 - protein, 9 aa, Homo Sapiens
LSVIGGDHK

SEQ ID NO: 933531 - protein, 9 aa, Homo Sapiens
KKVQPTNVL

SEQ ID NO: 933532 - protein, 9 aa, Homo Sapiens
RPPLADAPT

SEQ ID NO: 933533 - protein, 9 aa, Homo Sapiens
DEHRGFQQF

SEQ ID NO: 933534 - protein, 9 aa, Homo Sapiens
FGLDKLLII

SEQ ID NO: 933535 - protein, 9 aa, Homo Sapiens
ANIQSNIGA

SEQ ID NO: 933536 - protein, 9 aa, Homo Sapiens
VCQARMCDA

SEQ ID NO: 933537 - protein, 9 aa, Homo Sapiens
KLPLSSKRP

SEQ ID NO: 933538 - protein, 9 aa, Homo Sapiens
TETPKSCSK

SEQ ID NO: 933539 - protein, 9 aa, Homo Sapiens
AEISDHNDS

SEQ ID NO: 933540 - protein, 9 aa, Homo Sapiens
KVEEELGGS

SEQ ID NO: 933541 - protein, 9 aa, Homo Sapiens
KGKVGPPGE

SEQ ID NO: 933542 - protein, 9 aa, Homo Sapiens
DRVIGDYGK

SEQ ID NO: 933543 - protein, 9 aa, Homo Sapiens
SSIGTSELT

SEQ ID NO: 933544 - protein, 9 aa, Homo Sapiens
YQGTKMIPC

SEQ ID NO: 933545 - protein, 9 aa, Homo Sapiens
TLHFEIFKE

SEQ ID NO: 933546 - protein, 9 aa, Homo Sapiens
QVFGAKARR

SEQ ID NO: 933547 - protein, 9 aa, Homo Sapiens
RPVRDRMLK

SEQ ID NO: 933548 - protein, 9 aa, Homo Sapiens
FYQLIYQGT

SEQ ID NO: 933549 - protein, 9 aa, Homo Sapiens
DALVLYYKK

SEQ ID NO: 933550 - protein, 9 aa, Homo Sapiens
STEAVLNIR

SEQ ID NO: 933551 - protein, 9 aa, Homo Sapiens
HHMNDALVL

SEQ ID NO: 933552 - protein, 9 aa, Homo Sapiens
FIEKSGELC

SEQ ID NO: 933553 - protein, 9 aa, Homo Sapiens
CQHNINECK

SEQ ID NO: 933554 - protein, 9 aa, Homo Sapiens
LWLGCLPEL

SEQ ID NO: 933555 - protein, 9 aa, Homo Sapiens
HGGRVGFLQ

SEQ ID NO: 933556 - protein, 9 aa, Homo Sapiens
ERFLYACAF

SEQ ID NO: 933557 - protein, 9 aa, Homo Sapiens
CILSLNPLA

SEQ ID NO: 933558 - protein, 9 aa, Homo Sapiens
IVEVLHSGP

SEQ ID NO: 933559 - protein, 9 aa, Homo Sapiens
RPRSVASIY

SEQ ID NO: 933560 - protein, 9 aa, Homo Sapiens
LLADSLRGR

SEQ ID NO: 933561 - protein, 9 aa, Homo Sapiens
PVVIVLYLS

SEQ ID NO: 933562 - protein, 9 aa, Homo Sapiens
PSGPPSGSS

SEQ ID NO: 933563 - protein, 9 aa, Homo Sapiens
SRTRPCTWW

SEQ ID NO: 933564 - protein, 9 aa, Homo Sapiens
RPAVAMPSL

SEQ ID NO: 933565 - protein, 9 aa, Homo Sapiens
LVSRLTLAE

SEQ ID NO: 933566 - protein, 9 aa, Homo Sapiens
EKRWQRLQS

SEQ ID NO: 933567 - protein, 9 aa, Homo Sapiens
NIELMSSAS

SEQ ID NO: 933568 - protein, 9 aa, Homo Sapiens
VVEFGSSPT

SEQ ID NO: 933569 - protein, 9 aa, Homo Sapiens
TEQSLLIIK

SEQ ID NO: 933570 - protein, 9 aa, Homo Sapiens
SLPQDSSLS

SEQ ID NO: 933571 - protein, 9 aa, Homo Sapiens
DKNAVAKID

SEQ ID NO: 933572 - protein, 9 aa, Homo Sapiens
CKVEPCKNG

SEQ ID NO: 933573 - protein, 9 aa, Homo Sapiens
PCDLRGKGH

SEQ ID NO: 933574 - protein, 9 aa, Homo Sapiens
PSPGPSRPA

SEQ ID NO: 933575 - protein, 9 aa, Homo Sapiens
SNLNDDGLT

SEQ ID NO: 933576 - protein, 9 aa, Homo Sapiens
QSIGTIFSV

SEQ ID NO: 933577 - protein, 9 aa, Homo Sapiens
PCTLIVILS

SEQ ID NO: 933578 - protein, 9 aa, Homo Sapiens
LPSPYHVGP

SEQ ID NO: 933579 - protein, 9 aa, Homo Sapiens
STLWRSYRR

SEQ ID NO: 933580 - protein, 9 aa, Homo Sapiens
LASSSAAIF

SEQ ID NO: 933581 - protein, 9 aa, Homo Sapiens
EEKMWGQKE

SEQ ID NO: 933582 - protein, 9 aa, Homo Sapiens
HILEEAQKV

SEQ ID NO: 933583 - protein, 9 aa, Homo Sapiens
LPLSVIGGD

SEQ ID NO: 933584 - protein, 9 aa, Homo Sapiens
WSGTWRWGR

SEQ ID NO: 933585 - protein, 9 aa, Homo Sapiens
DEGSNCSKD

SEQ ID NO: 933586 - protein, 9 aa, Homo Sapiens
YIFKCEKLT

SEQ ID NO: 933587 - protein, 9 aa, Homo Sapiens
QDSHDFSTS

SEQ ID NO: 933588 - protein, 9 aa, Homo Sapiens
PVCQARMCD

SEQ ID NO: 933589 - protein, 9 aa, Homo Sapiens
DETIDVEVM

SEQ ID NO: 933590 - protein, 9 aa, Homo Sapiens
KENPEQTPV

SEQ ID NO: 933591 - protein, 9 aa, Homo Sapiens
TPHVSGRKM

SEQ ID NO: 933592 - protein, 9 aa, Homo Sapiens
IESGRIGFG

SEQ ID NO: 933593 - protein, 9 aa, Homo Sapiens
AVIKMFDKV

SEQ ID NO: 933594 - protein, 9 aa, Homo Sapiens
SDELGCNKE

SEQ ID NO: 933595 - protein, 9 aa, Homo Sapiens
NPILPSMFN

SEQ ID NO: 933596 - protein, 9 aa, Homo Sapiens
ELNLDEDFI

SEQ ID NO: 933597 - protein, 9 aa, Homo Sapiens
SASSRTRPC

SEQ ID NO: 933598 - protein, 9 aa, Homo Sapiens
SVPKIAAEE

SEQ ID NO: 933599 - protein, 9 aa, Homo Sapiens
AAAATAVVE

SEQ ID NO: 933600 - protein, 9 aa, Homo Sapiens
SASLYQQNQ

SEQ ID NO: 933601 - protein, 9 aa, Homo Sapiens
VQSPVGRRC

SEQ ID NO: 933602 - protein, 9 aa, Homo Sapiens
SEANEGPFL

SEQ ID NO: 933603 - protein, 9 aa, Homo Sapiens
RENRVKTSL

SEQ ID NO: 933604 - protein, 9 aa, Homo Sapiens
LQHAATGKA

SEQ ID NO: 933605 - protein, 9 aa, Homo Sapiens
SKENPEQTP

SEQ ID NO: 933606 - protein, 9 aa, Homo Sapiens
RYPGGSWEN

SEQ ID NO: 933607 - protein, 9 aa, Homo Sapiens
VTFPITHTA

SEQ ID NO: 933608 - protein, 9 aa, Homo Sapiens
VLHSGPSKW

SEQ ID NO: 933609 - protein, 9 aa, Homo Sapiens
GLTSPEIRF

SEQ ID NO: 933610 - protein, 9 aa, Homo Sapiens
TIYEENIAR

SEQ ID NO: 933611 - protein, 9 aa, Homo Sapiens
PPVVKGEAG

SEQ ID NO: 933612 - protein, 9 aa, Homo Sapiens
ARDFGPRFF

SEQ ID NO: 933613 - protein, 9 aa, Homo Sapiens
KNVDIACRS

SEQ ID NO: 933614 - protein, 9 aa, Homo Sapiens
IENSEKSKI

SEQ ID NO: 933615 - protein, 9 aa, Homo Sapiens
HCCSQLEKR

SEQ ID NO: 933616 - protein, 9 aa, Homo Sapiens
LMILFAMAV

SEQ ID NO: 933617 - protein, 9 aa, Homo Sapiens
TQDRPGSLS

SEQ ID NO: 933618 - protein, 9 aa, Homo Sapiens
YKITTQLCA

SEQ ID NO: 933619 - protein, 9 aa, Homo Sapiens
CDLRGKGHL

SEQ ID NO: 933620 - protein, 9 aa, Homo Sapiens
DSGSTATGY

SEQ ID NO: 933621 - protein, 9 aa, Homo Sapiens
AQRFAAAAS

SEQ ID NO: 933622 - protein, 9 aa, Homo Sapiens
SEKLQANKA

SEQ ID NO: 933623 - protein, 9 aa, Homo Sapiens
SWENINRYP

SEQ ID NO: 933624 - protein, 9 aa, Homo Sapiens
KEKLSQDIK

SEQ ID NO: 933625 - protein, 9 aa, Homo Sapiens
TSPNIETPL

SEQ ID NO: 933626 - protein, 9 aa, Homo Sapiens
GRMSRSQFA

SEQ ID NO: 933627 - protein, 9 aa, Homo Sapiens
EAKLHDVQN

SEQ ID NO: 933628 - protein, 9 aa, Homo Sapiens
CSQLEKRWQ

SEQ ID NO: 933629 - protein, 9 aa, Homo Sapiens
GSNCSKDKV

SEQ ID NO: 933630 - protein, 9 aa, Homo Sapiens
GGSAQPKDC

SEQ ID NO: 933631 - protein, 9 aa, Homo Sapiens
TPLVGSLRP

SEQ ID NO: 933632 - protein, 9 aa, Homo Sapiens
LEAQKEAIS

SEQ ID NO: 933633 - protein, 9 aa, Homo Sapiens
ANEGPFLGN

SEQ ID NO: 933634 - protein, 9 aa, Homo Sapiens
ALDTYLAQG

SEQ ID NO: 933635 - protein, 9 aa, Homo Sapiens
DPSRKAPSP

SEQ ID NO: 933636 - protein, 9 aa, Homo Sapiens
TPVVIVLYL

SEQ ID NO: 933637 - protein, 9 aa, Homo Sapiens
QAQSKENPE

SEQ ID NO: 933638 - protein, 9 aa, Homo Sapiens
PKFGVHLGQ

SEQ ID NO: 933639 - protein, 9 aa, Homo Sapiens
QVEVDLSFP

SEQ ID NO: 933640 - protein, 9 aa, Homo Sapiens
LPLSSKRPA

SEQ ID NO: 933641 - protein, 9 aa, Homo Sapiens
FPEENITSN

SEQ ID NO: 933642 - protein, 9 aa, Homo Sapiens
PYHVGPICQ

SEQ ID NO: 933643 - protein, 9 aa, Homo Sapiens
TSGDRPAWP

SEQ ID NO: 933644 - protein, 9 aa, Homo Sapiens
STFENITQK

SEQ ID NO: 933645 - protein, 9 aa, Homo Sapiens
FIASSGITC

SEQ ID NO: 933646 - protein, 9 aa, Homo Sapiens
ENSEKSKIL

SEQ ID NO: 933647 - protein, 9 aa, Homo Sapiens
NNCCRCFWV

SEQ ID NO: 933648 - protein, 9 aa, Homo Sapiens
FLQGDIRLL

SEQ ID NO: 933649 - protein, 9 aa, Homo Sapiens
SAPTPKEKE

SEQ ID NO: 933650 - protein, 9 aa, Homo Sapiens
LRALNEIIE

SEQ ID NO: 933651 - protein, 9 aa, Homo Sapiens
LQGDIRLLS

SEQ ID NO: 933652 - protein, 9 aa, Homo Sapiens
VECRNSFAF

SEQ ID NO: 933653 - protein, 9 aa, Homo Sapiens
TLHIWIGFL

SEQ ID NO: 933654 - protein, 9 aa, Homo Sapiens
EKKKVTWAD

SEQ ID NO: 933655 - protein, 9 aa, Homo Sapiens
WLGCLPELP

SEQ ID NO: 933656 - protein, 9 aa, Homo Sapiens
SQTHSLPSE

SEQ ID NO: 933657 - protein, 9 aa, Homo Sapiens
GQSIGTIFS

SEQ ID NO: 933658 - protein, 9 aa, Homo Sapiens
TPVKEAEDD

SEQ ID NO: 933659 - protein, 9 aa, Homo Sapiens
VGPPGERGP

SEQ ID NO: 933660 - protein, 9 aa, Homo Sapiens
QSLLIIKAI

SEQ ID NO: 933661 - protein, 9 aa, Homo Sapiens
PDGGDQEIA

SEQ ID NO: 933662 - protein, 9 aa, Homo Sapiens
SKVAGCKAA

SEQ ID NO: 933663 - protein, 9 aa, Homo Sapiens
FGPRFFTAL

SEQ ID NO: 933664 - protein, 9 aa, Homo Sapiens
QSNLNDDGL

SEQ ID NO: 933665 - protein, 9 aa, Homo Sapiens
PQTPWCWWS

SEQ ID NO: 933666 - protein, 9 aa, Homo Sapiens
GDFGLATEK

SEQ ID NO: 933667 - protein, 9 aa, Homo Sapiens
VIFYNACAA

SEQ ID NO: 933668 - protein, 9 aa, Homo Sapiens
ALSPARSLQ

SEQ ID NO: 933669 - protein, 9 aa, Homo Sapiens
HREISSPKI

SEQ ID NO: 933670 - protein, 9 aa, Homo Sapiens
EFMLLGLTS

SEQ ID NO: 933671 - protein, 9 aa, Homo Sapiens
IKAIGNVIA

SEQ ID NO: 933672 - protein, 9 aa, Homo Sapiens
ITSNDGPRG

SEQ ID NO: 933673 - protein, 9 aa, Homo Sapiens
DMNLSTGAL

SEQ ID NO: 933674 - protein, 9 aa, Homo Sapiens
QLQPGRMSR

SEQ ID NO: 933675 - protein, 9 aa, Homo Sapiens
VSSKEKKKV

SEQ ID NO: 933676 - protein, 9 aa, Homo Sapiens
IELMSSASS

SEQ ID NO: 933677 - protein, 9 aa, Homo Sapiens
TLWRSYRRG

SEQ ID NO: 933678 - protein, 9 aa, Homo Sapiens
YLSANVSSW

SEQ ID NO: 933679 - protein, 9 aa, Homo Sapiens
ESNLCVMAN

SEQ ID NO: 933680 - protein, 9 aa, Homo Sapiens
EVLHSGPSK

SEQ ID NO: 933681 - protein, 9 aa, Homo Sapiens
DSAPRYADT

SEQ ID NO: 933682 - protein, 9 aa, Homo Sapiens
ANPILPSMF

SEQ ID NO: 933683 - protein, 9 aa, Homo Sapiens
HAAPGTNAG

SEQ ID NO: 933684 - protein, 9 aa, Homo Sapiens
YITDGNKDM

SEQ ID NO: 933685 - protein, 9 aa, Homo Sapiens
WRSYRRGGP

SEQ ID NO: 933686 - protein, 9 aa, Homo Sapiens
PENSPLETE

SEQ ID NO: 933687 - protein, 9 aa, Homo Sapiens
SELTDMKKL

SEQ ID NO: 933688 - protein, 9 aa, Homo Sapiens
PVLCIFPPP

SEQ ID NO: 933689 - protein, 9 aa, Homo Sapiens
MNLSTGALP

SEQ ID NO: 933690 - protein, 9 aa, Homo Sapiens
PLFWRLESP

SEQ ID NO: 933691 - protein, 9 aa, Homo Sapiens
ENNKSRTEA

SEQ ID NO: 933692 - protein, 9 aa, Homo Sapiens
MVDANNGIV

SEQ ID NO: 933693 - protein, 9 aa, Homo Sapiens
PTLQEIIQM

SEQ ID NO: 933694 - protein, 9 aa, Homo Sapiens
EEEEEAERR

SEQ ID NO: 933695 - protein, 9 aa, Homo Sapiens
PSSALLPPE

SEQ ID NO: 933696 - protein, 9 aa, Homo Sapiens
KKTYRGYQG

SEQ ID NO: 933697 - protein, 9 aa, Homo Sapiens
SLFSLLEAI

SEQ ID NO: 933698 - protein, 9 aa, Homo Sapiens
PKRNPISVV

SEQ ID NO: 933699 - protein, 9 aa, Homo Sapiens
AEASVKDSA

SEQ ID NO: 933700 - protein, 9 aa, Homo Sapiens
YEHPCILSL

SEQ ID NO: 933701 - protein, 9 aa, Homo Sapiens
GDIEDTINL

SEQ ID NO: 933702 - protein, 9 aa, Homo Sapiens
LVILCISPN

SEQ ID NO: 933703 - protein, 9 aa, Homo Sapiens
ADVEGVSVL

SEQ ID NO: 933704 - protein, 9 aa, Homo Sapiens
QKTYQGNKC

SEQ ID NO: 933705 - protein, 9 aa, Homo Sapiens
KNRKLFDFL

SEQ ID NO: 933706 - protein, 9 aa, Homo Sapiens
CLILIPDQT

SEQ ID NO: 933707 - protein, 9 aa, Homo Sapiens
LGNRLEEVL

SEQ ID NO: 933708 - protein, 9 aa, Homo Sapiens
PAWPLSTSA

SEQ ID NO: 933709 - protein, 9 aa, Homo Sapiens
EAKLDSRAI

SEQ ID NO: 933710 - protein, 9 aa, Homo Sapiens
PEMVMVLKK

SEQ ID NO: 933711 - protein, 9 aa, Homo Sapiens
DVTQIVEVL

SEQ ID NO: 933712 - protein, 9 aa, Homo Sapiens
SVASIYVPS

SEQ ID NO: 933713 - protein, 9 aa, Homo Sapiens
FSLLEAIIF

SEQ ID NO: 933714 - protein, 9 aa, Homo Sapiens
QLAVCFHLQ

SEQ ID NO: 933715 - protein, 9 aa, Homo Sapiens
SVIGGDHKL

SEQ ID NO: 933716 - protein, 9 aa, Homo Sapiens
HKKTYRGYQ

SEQ ID NO: 933717 - protein, 9 aa, Homo Sapiens
SRRFLSKKY

SEQ ID NO: 933718 - protein, 9 aa, Homo Sapiens
EGPLRRTFP

SEQ ID NO: 933719 - protein, 9 aa, Homo Sapiens
PPLSTLILK

SEQ ID NO: 933720 - protein, 9 aa, Homo Sapiens
KILIFAFAG

SEQ ID NO: 933721 - protein, 9 aa, Homo Sapiens
LSTLILKEA

SEQ ID NO: 933722 - protein, 9 aa, Homo Sapiens
DALFPMAED

SEQ ID NO: 933723 - protein, 9 aa, Homo Sapiens
LASVMVFSE

SEQ ID NO: 933724 - protein, 9 aa, Homo Sapiens
GTPHVSGRK

SEQ ID NO: 933725 - protein, 9 aa, Homo Sapiens
AALSRMPFP

SEQ ID NO: 933726 - protein, 9 aa, Homo Sapiens
KRPVRDRML

SEQ ID NO: 933727 - protein, 9 aa, Homo Sapiens
DSHDFSTSP

SEQ ID NO: 933728 - protein, 9 aa, Homo Sapiens
NRKMVNDAE

SEQ ID NO: 933729 - protein, 9 aa, Homo Sapiens
RSYRRGGPP

SEQ ID NO: 933730 - protein, 9 aa, Homo Sapiens
DIEDTINLP

SEQ ID NO: 933731 - protein, 9 aa, Homo Sapiens
EQWKGLPEP

SEQ ID NO: 933732 - protein, 9 aa, Homo Sapiens
EVDLSFPED

SEQ ID NO: 933733 - protein, 9 aa, Homo Sapiens
LALPSPYHV

SEQ ID NO: 933734 - protein, 9 aa, Homo Sapiens
NHFVSNAYN

SEQ ID NO: 933735 - protein, 9 aa, Homo Sapiens
VEVMNSLAV

SEQ ID NO: 933736 - protein, 9 aa, Homo Sapiens
EAEISDHND

SEQ ID NO: 933737 - protein, 9 aa, Homo Sapiens
LILKEADPS

SEQ ID NO: 933738 - protein, 9 aa, Homo Sapiens
RLLPARGAA

SEQ ID NO: 933739 - protein, 9 aa, Homo Sapiens
TWRWGRRPW

SEQ ID NO: 933740 - protein, 9 aa, Homo Sapiens
LFDFLDVLE

SEQ ID NO: 933741 - protein, 9 aa, Homo Sapiens
FGLATEKSR

SEQ ID NO: 933742 - protein, 9 aa, Homo Sapiens
ACKKHKLYV

SEQ ID NO: 933743 - protein, 9 aa, Homo Sapiens
CLVYQITTS

SEQ ID NO: 933744 - protein, 9 aa, Homo Sapiens
NPHVQYSAV

SEQ ID NO: 933745 - protein, 9 aa, Homo Sapiens
TEAVLNIRF

SEQ ID NO: 933746 - protein, 9 aa, Homo Sapiens
CLAPFMKHS

SEQ ID NO: 933747 - protein, 9 aa, Homo Sapiens
ITHGEANGI

SEQ ID NO: 933748 - protein, 9 aa, Homo Sapiens
LQKSMESNL

SEQ ID NO: 933749 - protein, 9 aa, Homo Sapiens
PEPIYSTLP

SEQ ID NO: 933750 - protein, 9 aa, Homo Sapiens
KRPPLADAP

SEQ ID NO: 933751 - protein, 9 aa, Homo Sapiens
GMKSCGIHE

SEQ ID NO: 933752 - protein, 9 aa, Homo Sapiens
KQEPREESC

SEQ ID NO: 933753 - protein, 9 aa, Homo Sapiens
ENPEQTPVL

SEQ ID NO: 933754 - protein, 9 aa, Homo Sapiens
SRIKSHSYL

SEQ ID NO: 933755 - protein, 9 aa, Homo Sapiens
TTMYKMQAL

SEQ ID NO: 933756 - protein, 9 aa, Homo Sapiens
KNNKTLEKL

SEQ ID NO: 933757 - protein, 9 aa, Homo Sapiens
FQHPPPPPG

SEQ ID NO: 933758 - protein, 9 aa, Homo Sapiens
ESKKKKKKN

SEQ ID NO: 933759 - protein, 9 aa, Homo Sapiens
MLLGLTSRR

SEQ ID NO: 933760 - protein, 9 aa, Homo Sapiens
LEKLDLGFL

SEQ ID NO: 933761 - protein, 9 aa, Homo Sapiens
VYEHPCILS

SEQ ID NO: 933762 - protein, 9 aa, Homo Sapiens
YRRGGPPRW

SEQ ID NO: 933763 - protein, 9 aa, Homo Sapiens
DSLRGRGVT

SEQ ID NO: 933764 - protein, 9 aa, Homo Sapiens
EAQKEAISP

SEQ ID NO: 933765 - protein, 9 aa, Homo Sapiens
HSLKIVLRG

SEQ ID NO: 933766 - protein, 9 aa, Homo Sapiens
CLTADSLRP

SEQ ID NO: 933767 - protein, 9 aa, Homo Sapiens
QHAATGKAF

SEQ ID NO: 933768 - protein, 9 aa, Homo Sapiens
AFYQLIYQG

SEQ ID NO: 933769 - protein, 9 aa, Homo Sapiens
KSCGIHETT

SEQ ID NO: 933770 - protein, 9 aa, Homo Sapiens
HCPSLPASL

SEQ ID NO: 933771 - protein, 9 aa, Homo Sapiens
FVRENNGTF

SEQ ID NO: 933772 - protein, 9 aa, Homo Sapiens
EKAPIKEKL

SEQ ID NO: 933773 - protein, 9 aa, Homo Sapiens
RKTFLILVL

SEQ ID NO: 933774 - protein, 9 aa, Homo Sapiens
TDFEKNVDI

SEQ ID NO: 933775 - protein, 9 aa, Homo Sapiens
LLDTAQKKL

SEQ ID NO: 933776 - protein, 9 aa, Homo Sapiens
NIQSNIGAS

SEQ ID NO: 933777 - protein, 9 aa, Homo Sapiens
RSCEKEGVS

SEQ ID NO: 933778 - protein, 9 aa, Homo Sapiens
AVYEHPCIL

SEQ ID NO: 933779 - protein, 9 aa, Homo Sapiens
AEVRWEIFW

SEQ ID NO: 933780 - protein, 9 aa, Homo Sapiens
TSASSRTRP

SEQ ID NO: 933781 - protein, 9 aa, Homo Sapiens
RPPLSTLIL

SEQ ID NO: 933782 - protein, 9 aa, Homo Sapiens
LREEKVHSM

SEQ ID NO: 933783 - protein, 9 aa, Homo Sapiens
EIIESGRIG

SEQ ID NO: 933784 - protein, 9 aa, Homo Sapiens
NAGKAFCMF

SEQ ID NO: 933785 - protein, 9 aa, Homo Sapiens
ASVPKIAAE

SEQ ID NO: 933786 - protein, 9 aa, Homo Sapiens
STLILKEAD

SEQ ID NO: 933787 - protein, 9 aa, Homo Sapiens
DELGCNKEK

SEQ ID NO: 933788 - protein, 9 aa, Homo Sapiens
NLSMWSNQT

SEQ ID NO: 933789 - protein, 9 aa, Homo Sapiens
LEAKLHDVQ

SEQ ID NO: 933790 - protein, 9 aa, Homo Sapiens
FWSERPTKV

SEQ ID NO: 933791 - protein, 9 aa, Homo Sapiens
KYSTVASPR

SEQ ID NO: 933792 - protein, 9 aa, Homo Sapiens
SWHRTLPLS

SEQ ID NO: 933793 - protein, 9 aa, Homo Sapiens
APCDGRLYV

SEQ ID NO: 933794 - protein, 9 aa, Homo Sapiens
QVYALPPSQ

SEQ ID NO: 933795 - protein, 9 aa, Homo Sapiens
AAATAVVEF

SEQ ID NO: 933796 - protein, 9 aa, Homo Sapiens
VPKIAAEEE

SEQ ID NO: 933797 - protein, 9 aa, Homo Sapiens
HDFSTSPKG

SEQ ID NO: 933798 - protein, 9 aa, Homo Sapiens
SGPPSGSSR

SEQ ID NO: 933799 - protein, 9 aa, Homo Sapiens
FPITHTAQS

SEQ ID NO: 933800 - protein, 9 aa, Homo Sapiens
FGPNSSASL

SEQ ID NO: 933801 - protein, 9 aa, Homo Sapiens
SLPSEPVGS

SEQ ID NO: 933802 - protein, 9 aa, Homo Sapiens
EKSRWSGSH

SEQ ID NO: 933803 - protein, 9 aa, Homo Sapiens
AHIWLTGAP

SEQ ID NO: 933804 - protein, 9 aa, Homo Sapiens
NVDIACRSV

SEQ ID NO: 933805 - protein, 9 aa, Homo Sapiens
KHCQIVKPG

SEQ ID NO: 933806 - protein, 9 aa, Homo Sapiens
FLSKKYRKY

SEQ ID NO: 933807 - protein, 9 aa, Homo Sapiens
DWFGNFSSF

SEQ ID NO: 933808 - protein, 9 aa, Homo Sapiens
NNPHVQYSA

SEQ ID NO: 933809 - protein, 9 aa, Homo Sapiens
HSCLILIPD

SEQ ID NO: 933810 - protein, 9 aa, Homo Sapiens
KQNIPIIRD

SEQ ID NO: 933811 - protein, 9 aa, Homo Sapiens
MLKERALKI

SEQ ID NO: 933812 - protein, 9 aa, Homo Sapiens
TKRPVRDRM

SEQ ID NO: 933813 - protein, 9 aa, Homo Sapiens
LNDDGLTEV

SEQ ID NO: 933814 - protein, 9 aa, Homo Sapiens
LIPDQTAQV

SEQ ID NO: 933815 - protein, 9 aa, Homo Sapiens
YENTTVFFF

SEQ ID NO: 933816 - protein, 9 aa, Homo Sapiens
ETKKVSSKE

SEQ ID NO: 933817 - protein, 9 aa, Homo Sapiens
REEKVHSMS

SEQ ID NO: 933818 - protein, 9 aa, Homo Sapiens
CKKHKLYVS

SEQ ID NO: 933819 - protein, 9 aa, Homo Sapiens
FSTSPKGKQ

SEQ ID NO: 933820 - protein, 9 aa, Homo Sapiens
KTFLILVLF

SEQ ID NO: 933821 - protein, 9 aa, Homo Sapiens
ENINRYPGG

SEQ ID NO: 933822 - protein, 9 aa, Homo Sapiens
QPLKENEEE

SEQ ID NO: 933823 - protein, 9 aa, Homo Sapiens
LDLGFLSPQ

SEQ ID NO: 933824 - protein, 9 aa, Homo Sapiens
GRKMLSALE

SEQ ID NO: 933825 - protein, 9 aa, Homo Sapiens
TGYLLRKQQ

SEQ ID NO: 933826 - protein, 9 aa, Homo Sapiens
QTIYEENIA

SEQ ID NO: 933827 - protein, 9 aa, Homo Sapiens
GSLSGSEDK

SEQ ID NO: 933828 - protein, 9 aa, Homo Sapiens
EGVSAQPAT

SEQ ID NO: 933829 - protein, 9 aa, Homo Sapiens
DTHMKKILI

SEQ ID NO: 933830 - protein, 9 aa, Homo Sapiens
PCDGRLYVP

SEQ ID NO: 933831 - protein, 9 aa, Homo Sapiens
DLSQTHSLP

SEQ ID NO: 933832 - protein, 9 aa, Homo Sapiens
SGELCKEIS

SEQ ID NO: 933833 - protein, 9 aa, Homo Sapiens
FQSNSMNSL

SEQ ID NO: 933834 - protein, 9 aa, Homo Sapiens
PSPYHVGPI

SEQ ID NO: 933835 - protein, 9 aa, Homo Sapiens
VLYLSKQRW

SEQ ID NO: 933836 - protein, 9 aa, Homo Sapiens
AGVPNLPNL

SEQ ID NO: 933837 - protein, 9 aa, Homo Sapiens
RMPFPGGRI

SEQ ID NO: 933838 - protein, 9 aa, Homo Sapiens
ASLEIRFTP

SEQ ID NO: 933839 - protein, 9 aa, Homo Sapiens
RALEAQKEA

SEQ ID NO: 933840 - protein, 9 aa, Homo Sapiens
MLDIPNLTP

SEQ ID NO: 933841 - protein, 9 aa, Homo Sapiens
GLTEVVSKK

SEQ ID NO: 933842 - protein, 9 aa, Homo Sapiens
NIPIIRDNL

SEQ ID NO: 933843 - protein, 9 aa, Homo Sapiens
NSSFPVLEY

SEQ ID NO: 933844 - protein, 9 aa, Homo Sapiens
APFMKHSLK

SEQ ID NO: 933845 - protein, 9 aa, Homo Sapiens
AVTFPITHT

SEQ ID NO: 933846 - protein, 9 aa, Homo Sapiens
KGMKGLEGT

SEQ ID NO: 933847 - protein, 9 aa, Homo Sapiens
VDGTPGKCC

SEQ ID NO: 933848 - protein, 9 aa, Homo Sapiens
SAYQGTLLP

SEQ ID NO: 933849 - protein, 9 aa, Homo Sapiens
LSAYQGTLL

SEQ ID NO: 933850 - protein, 9 aa, Homo Sapiens
EPREESCAL

SEQ ID NO: 933851 - protein, 9 aa, Homo Sapiens
TSELTDMKK

SEQ ID NO: 933852 - protein, 9 aa, Homo Sapiens
HRGFQQFSF

SEQ ID NO: 933853 - protein, 9 aa, Homo Sapiens
LSMWSNQTW

SEQ ID NO: 933854 - protein, 9 aa, Homo Sapiens
CLCLVYQIT

SEQ ID NO: 933855 - protein, 9 aa, Homo Sapiens
IKQNIPIIR

SEQ ID NO: 933856 - protein, 9 aa, Homo Sapiens
INECKVEPC

SEQ ID NO: 933857 - protein, 9 aa, Homo Sapiens
SMESNLCVM

SEQ ID NO: 933858 - protein, 9 aa, Homo Sapiens
NNGPLITLA

SEQ ID NO: 933859 - protein, 9 aa, Homo Sapiens
LKRPPLADA

SEQ ID NO: 933860 - protein, 9 aa, Homo Sapiens
ESPRAWSQH

SEQ ID NO: 933861 - protein, 9 aa, Homo Sapiens
RSSWMREKR

SEQ ID NO: 933862 - protein, 9 aa, Homo Sapiens
RLYPAYTGL

SEQ ID NO: 933863 - protein, 9 aa, Homo Sapiens
ALEAQKEAI

SEQ ID NO: 933864 - protein, 9 aa, Homo Sapiens
EAIIFALLP

SEQ ID NO: 933865 - protein, 9 aa, Homo Sapiens
DIPNLTPYT

SEQ ID NO: 933866 - protein, 9 aa, Homo Sapiens
HKLYVSFRD

SEQ ID NO: 933867 - protein, 9 aa, Homo Sapiens
LEDETIDVE

SEQ ID NO: 933868 - protein, 9 aa, Homo Sapiens
TFPITHTAQ

SEQ ID NO: 933869 - protein, 9 aa, Homo Sapiens
SSPFFREKA

SEQ ID NO: 933870 - protein, 9 aa, Homo Sapiens
FQENGPPLM

SEQ ID NO: 933871 - protein, 9 aa, Homo Sapiens
ALVLYYKKI

SEQ ID NO: 933872 - protein, 9 aa, Homo Sapiens
QENGPPLMK

SEQ ID NO: 933873 - protein, 9 aa, Homo Sapiens
HIKQNIPII

SEQ ID NO: 933874 - protein, 9 aa, Homo Sapiens
IFGLDKLLI

SEQ ID NO: 933875 - protein, 9 aa, Homo Sapiens
SLYCGHDFC

SEQ ID NO: 933876 - protein, 9 aa, Homo Sapiens
FPPPHPKWG

SEQ ID NO: 933877 - protein, 9 aa, Homo Sapiens
AEPRVSVWE

SEQ ID NO: 933878 - protein, 9 aa, Homo Sapiens
LSSKRPAAV

SEQ ID NO: 933879 - protein, 9 aa, Homo Sapiens
HFEIFKEGS

SEQ ID NO: 933880 - protein, 9 aa, Homo Sapiens
QGTSHCPSL

SEQ ID NO: 933881 - protein, 9 aa, Homo Sapiens
MRMLIPKRN

SEQ ID NO: 933882 - protein, 9 aa, Homo Sapiens
EPRVSVWEG

SEQ ID NO: 933883 - protein, 9 aa, Homo Sapiens
IFKEGSDLS

SEQ ID NO: 933884 - protein, 9 aa, Homo Sapiens
ELERNRLYP

SEQ ID NO: 933885 - protein, 9 aa, Homo Sapiens
RVCTREPPF

SEQ ID NO: 933886 - protein, 9 aa, Homo Sapiens
SSTSISGMT

SEQ ID NO: 933887 - protein, 9 aa, Homo Sapiens
LIGLAVGLV

SEQ ID NO: 933888 - protein, 9 aa, Homo Sapiens
LIEDKVIFY

SEQ ID NO: 933889 - protein, 9 aa, Homo Sapiens
RVGSTFENI

SEQ ID NO: 933890 - protein, 9 aa, Homo Sapiens
SSSKRQWDR

SEQ ID NO: 933891 - protein, 9 aa, Homo Sapiens
IWKDEHRGF

SEQ ID NO: 933892 - protein, 9 aa, Homo Sapiens
AQASLEIRF

SEQ ID NO: 933893 - protein, 9 aa, Homo Sapiens
PIDTSPNIE

SEQ ID NO: 933894 - protein, 9 aa, Homo Sapiens
NGRSSWMRE

SEQ ID NO: 933895 - protein, 9 aa, Homo Sapiens
EHGSAKQNG

SEQ ID NO: 933896 - protein, 9 aa, Homo Sapiens
KRPAAVGAG

SEQ ID NO: 933897 - protein, 9 aa, Homo Sapiens
LFLADVEGV

SEQ ID NO: 933898 - protein, 9 aa, Homo Sapiens
SAAIFVREN

SEQ ID NO: 933899 - protein, 9 aa, Homo Sapiens
WFGNFSSFR

SEQ ID NO: 933900 - protein, 9 aa, Homo Sapiens
GNQTFIASS

SEQ ID NO: 933901 - protein, 9 aa, Homo Sapiens
RTRPCTWWS

SEQ ID NO: 933902 - protein, 9 aa, Homo Sapiens
GRPSRRFLS

SEQ ID NO: 933903 - protein, 9 aa, Homo Sapiens
PEQWKGLPE

SEQ ID NO: 933904 - protein, 9 aa, Homo Sapiens
KTPPVAVTF

SEQ ID NO: 933905 - protein, 9 aa, Homo Sapiens
LFQNMSTFL

SEQ ID NO: 933906 - protein, 9 aa, Homo Sapiens
VIYPAPCDG

SEQ ID NO: 933907 - protein, 9 aa, Homo Sapiens
SVKDSALLM

SEQ ID NO: 933908 - protein, 9 aa, Homo Sapiens
LDPSRKAPS

SEQ ID NO: 933909 - protein, 9 aa, Homo Sapiens
KLFDFLDVL

SEQ ID NO: 933910 - protein, 9 aa, Homo Sapiens
NDSLRTWLK

SEQ ID NO: 933911 - protein, 9 aa, Homo Sapiens
ITVILEEID

SEQ ID NO: 933912 - protein, 9 aa, Homo Sapiens
SMNSLPPAA

SEQ ID NO: 933913 - protein, 9 aa, Homo Sapiens
WKDEHRGFQ

SEQ ID NO: 933914 - protein, 9 aa, Homo Sapiens
EAQTIYEEN

SEQ ID NO: 933915 - protein, 9 aa, Homo Sapiens
LKKVQPTNV

SEQ ID NO: 933916 - protein, 9 aa, Homo Sapiens
LPAGVPNLP

SEQ ID NO: 933917 - protein, 9 aa, Homo Sapiens
ADSLRGRGV

SEQ ID NO: 933918 - protein, 9 aa, Homo Sapiens
HLVCGVRKA

SEQ ID NO: 933919 - protein, 9 aa, Homo Sapiens
ETEFPLNHA

SEQ ID NO: 933920 - protein, 9 aa, Homo Sapiens
IIMELYSYG

SEQ ID NO: 933921 - protein, 9 aa, Homo Sapiens
YQGNKCEEA

SEQ ID NO: 933922 - protein, 9 aa, Homo Sapiens
PCILSLNPL

SEQ ID NO: 933923 - protein, 9 aa, Homo Sapiens
LYLSKQRWE

SEQ ID NO: 933924 - protein, 9 aa, Homo Sapiens
WRSPSSALL

SEQ ID NO: 933925 - protein, 9 aa, Homo Sapiens
KLQANKATL

SEQ ID NO: 933926 - protein, 9 aa, Homo Sapiens
DSRAIDVTL

SEQ ID NO: 933927 - protein, 9 aa, Homo Sapiens
SRPRPQTPW

SEQ ID NO: 933928 - protein, 9 aa, Homo Sapiens
GNRLEEVLA

SEQ ID NO: 933929 - protein, 9 aa, Homo Sapiens
LSPARSLQG

SEQ ID NO: 933930 - protein, 9 aa, Homo Sapiens
LYSYGELGH

SEQ ID NO: 933931 - protein, 9 aa, Homo Sapiens
QEEKMWGQK

SEQ ID NO: 933932 - protein, 9 aa, Homo Sapiens
QLLRVCTRE

SEQ ID NO: 933933 - protein, 9 aa, Homo Sapiens
LERNRLYPA

SEQ ID NO: 933934 - protein, 9 aa, Homo Sapiens
TFIASSGIT

SEQ ID NO: 933935 - protein, 9 aa, Homo Sapiens
PNQRHLAQT

SEQ ID NO: 933936 - protein, 9 aa, Homo Sapiens
LFPMAEDIS

SEQ ID NO: 933937 - protein, 9 aa, Homo Sapiens
QAQVVLNQK

SEQ ID NO: 933938 - protein, 9 aa, Homo Sapiens
RVLAKLVQE

SEQ ID NO: 933939 - protein, 9 aa, Homo Sapiens
RPPPTLQEI

SEQ ID NO: 933940 - protein, 9 aa, Homo Sapiens
TVHKILCKL

SEQ ID NO: 933941 - protein, 9 aa, Homo Sapiens
EISSPKIQD

SEQ ID NO: 933942 - protein, 9 aa, Homo Sapiens
GEKPYSCSH

SEQ ID NO: 933943 - protein, 9 aa, Homo Sapiens
KIAAEEEAY

SEQ ID NO: 933944 - protein, 9 aa, Homo Sapiens
STYPEPIYS

SEQ ID NO: 933945 - protein, 9 aa, Homo Sapiens
QEIIQMAAE

SEQ ID NO: 933946 - protein, 9 aa, Homo Sapiens
PKGMKGLEG

SEQ ID NO: 933947 - protein, 9 aa, Homo Sapiens
VDDFSCTKH

SEQ ID NO: 933948 - protein, 9 aa, Homo Sapiens
SCKSRGREG

SEQ ID NO: 933949 - protein, 9 aa, Homo Sapiens
PEVKVEEEL

SEQ ID NO: 933950 - protein, 9 aa, Homo Sapiens
GPAAQRFAA

SEQ ID NO: 933951 - protein, 9 aa, Homo Sapiens
RTSLPQDSS

SEQ ID NO: 933952 - protein, 9 aa, Homo Sapiens
HPNLVQLLR

SEQ ID NO: 933953 - protein, 9 aa, Homo Sapiens
SCLCLVYQI

SEQ ID NO: 933954 - protein, 9 aa, Homo Sapiens
TSRPRPQTP

SEQ ID NO: 933955 - protein, 9 aa, Homo Sapiens
QRFPNNPHV

SEQ ID NO: 933956 - protein, 9 aa, Homo Sapiens
RRGGPPRWC

SEQ ID NO: 933957 - protein, 9 aa, Homo Sapiens
LQPGRMSRS

SEQ ID NO: 933958 - protein, 9 aa, Homo Sapiens
EGVPYYAEA

SEQ ID NO: 933959 - protein, 9 aa, Homo Sapiens
SYVAHERLG

SEQ ID NO: 933960 - protein, 9 aa, Homo Sapiens
AIDVTLTIQ

SEQ ID NO: 933961 - protein, 9 aa, Homo Sapiens
YYAGWAYKI

SEQ ID NO: 933962 - protein, 9 aa, Homo Sapiens
VKVEEELGG

SEQ ID NO: 933963 - protein, 9 aa, Homo Sapiens
TYRGYQGRV

SEQ ID NO: 933964 - protein, 9 aa, Homo Sapiens
TLQEIIQMA

SEQ ID NO: 933965 - protein, 9 aa, Homo Sapiens
PVRDRMLKE

SEQ ID NO: 933966 - protein, 9 aa, Homo Sapiens
KSGELCKEI

SEQ ID NO: 933967 - protein, 9 aa, Homo Sapiens
LQDTTFFFG

SEQ ID NO: 933968 - protein, 9 aa, Homo Sapiens
CLKQEVATF

SEQ ID NO: 933969 - protein, 9 aa, Homo Sapiens
PPWGRLHSH

SEQ ID NO: 933970 - protein, 9 aa, Homo Sapiens
WCWWSGRTW

SEQ ID NO: 933971 - protein, 9 aa, Homo Sapiens
LCLNSRKPL

SEQ ID NO: 933972 - protein, 9 aa, Homo Sapiens
AVCFHLQDF

SEQ ID NO: 933973 - protein, 9 aa, Homo Sapiens
SDHRPVCQA

SEQ ID NO: 933974 - protein, 9 aa, Homo Sapiens
NTREALSSC

SEQ ID NO: 933975 - protein, 9 aa, Homo Sapiens
SERPAVAMP

SEQ ID NO: 933976 - protein, 9 aa, Homo Sapiens
IFPPPHPKW

SEQ ID NO: 933977 - protein, 9 aa, Homo Sapiens
AYKIHGMTI

SEQ ID NO: 933978 - protein, 9 aa, Homo Sapiens
PEDQIFIAV

SEQ ID NO: 933979 - protein, 9 aa, Homo Sapiens
CMEKTRNGK

SEQ ID NO: 933980 - protein, 9 aa, Homo Sapiens
RMSRSQFAR

SEQ ID NO: 933981 - protein, 9 aa, Homo Sapiens
VFFFSSFQY

SEQ ID NO: 933982 - protein, 9 aa, Homo Sapiens
SSEKLQANK

SEQ ID NO: 933983 - protein, 9 aa, Homo Sapiens
DLEDETIDV

SEQ ID NO: 933984 - protein, 9 aa, Homo Sapiens
ITDGNKDMA

SEQ ID NO: 933985 - protein, 9 aa, Homo Sapiens
AFASHPNEE

SEQ ID NO: 933986 - protein, 9 aa, Homo Sapiens
GFLQGDIRL

SEQ ID NO: 933987 - protein, 9 aa, Homo Sapiens
LKENEEEPQ

SEQ ID NO: 933988 - protein, 9 aa, Homo Sapiens
GAKARRHII

SEQ ID NO: 933989 - protein, 9 aa, Homo Sapiens
SLPTIGGSH

SEQ ID NO: 933990 - protein, 9 aa, Homo Sapiens
LKLCLNSRK

SEQ ID NO: 933991 - protein, 9 aa, Homo Sapiens
PNLVQLLRV

SEQ ID NO: 933992 - protein, 9 aa, Homo Sapiens
EIFCNHFVS

SEQ ID NO: 933993 - protein, 9 aa, Homo Sapiens
EENGPLIMQ

SEQ ID NO: 933994 - protein, 9 aa, Homo Sapiens
IYVPSPAVP

SEQ ID NO: 933995 - protein, 9 aa, Homo Sapiens
KCEKLTIQI

SEQ ID NO: 933996 - protein, 9 aa, Homo Sapiens
HNNIRNLVR

SEQ ID NO: 933997 - protein, 9 aa, Homo Sapiens
ARSCEKEGV

SEQ ID NO: 933998 - protein, 9 aa, Homo Sapiens
CTKHDECGS

SEQ ID NO: 933999 - protein, 9 aa, Homo Sapiens
YADTLHSKL

SEQ ID NO: 934000 - protein, 9 aa, Homo Sapiens
AVLNIRFIK

SEQ ID NO: 934001 - protein, 9 aa, Homo Sapiens
RSKQEAWST

SEQ ID NO: 934002 - protein, 9 aa, Homo Sapiens
LIVLIYDEQ

SEQ ID NO: 934003 - protein, 9 aa, Homo Sapiens
TAQKKLYRD

SEQ ID NO: 934004 - protein, 9 aa, Homo Sapiens
RENTYVEYF

SEQ ID NO: 934005 - protein, 9 aa, Homo Sapiens
AGTPHVSGR

SEQ ID NO: 934006 - protein, 9 aa, Homo Sapiens
NRLEEVLAI

SEQ ID NO: 934007 - protein, 9 aa, Homo Sapiens
REKLPLSSK

SEQ ID NO: 934008 - protein, 9 aa, Homo Sapiens
RRPWPTSSS

SEQ ID NO: 934009 - protein, 9 aa, Homo Sapiens
PCPSPAHIW

SEQ ID NO: 934010 - protein, 9 aa, Homo Sapiens
EKLQANKAT

SEQ ID NO: 934011 - protein, 9 aa, Homo Sapiens
REVLVRKEQ

SEQ ID NO: 934012 - protein, 9 aa, Homo Sapiens
VGSTFENIT

SEQ ID NO: 934013 - protein, 9 aa, Homo Sapiens
DFSTSPKGK

SEQ ID NO: 934014 - protein, 9 aa, Homo Sapiens
NLQKCDILE

SEQ ID NO: 934015 - protein, 9 aa, Homo Sapiens
PAEVRWEIF

SEQ ID NO: 934016 - protein, 9 aa, Homo Sapiens
SKAGFLPRP

SEQ ID NO: 934017 - protein, 9 aa, Homo Sapiens
QLEKRWQRL

SEQ ID NO: 934018 - protein, 9 aa, Homo Sapiens
PPVAVTFPI

SEQ ID NO: 934019 - protein, 9 aa, Homo Sapiens
KVHSMSRVQ

SEQ ID NO: 934020 - protein, 9 aa, Homo Sapiens
LAEPRVSVW

SEQ ID NO: 934021 - protein, 9 aa, Homo Sapiens
LLYDKYYMA

SEQ ID NO: 934022 - protein, 9 aa, Homo Sapiens
QMLDIPNLT

SEQ ID NO: 934023 - protein, 9 aa, Homo Sapiens
FSEGPLRRT

SEQ ID NO: 934024 - protein, 9 aa, Homo Sapiens
QEIAKTGKF

SEQ ID NO: 934025 - protein, 9 aa, Homo Sapiens
NRLYPAYTG

SEQ ID NO: 934026 - protein, 9 aa, Homo Sapiens
VEGVSVLRS

SEQ ID NO: 934027 - protein, 9 aa, Homo Sapiens
NQLAVCFHL

SEQ ID NO: 934028 - protein, 9 aa, Homo Sapiens
EIWKDEHRG

SEQ ID NO: 934029 - protein, 9 aa, Homo Sapiens
SISSTSISG

SEQ ID NO: 934030 - protein, 9 aa, Homo Sapiens
RKLFDFLDV

SEQ ID NO: 934031 - protein, 9 aa, Homo Sapiens
ISLYCGHDF

SEQ ID NO: 934032 - protein, 9 aa, Homo Sapiens
CFWVECVDL

SEQ ID NO: 934033 - protein, 9 aa, Homo Sapiens
CRCFWVECV

SEQ ID NO: 934034 - protein, 9 aa, Homo Sapiens
NEVDCFLKL

SEQ ID NO: 934035 - protein, 9 aa, Homo Sapiens
TRNGKANFD

SEQ ID NO: 934036 - protein, 9 aa, Homo Sapiens
PKDFSRPKA

SEQ ID NO: 934037 - protein, 9 aa, Homo Sapiens
LDKLLIILP

SEQ ID NO: 934038 - protein, 9 aa, Homo Sapiens
CISPNQRHL

SEQ ID NO: 934039 - protein, 9 aa, Homo Sapiens
GHAAPGTNA

SEQ ID NO: 934040 - protein, 9 aa, Homo Sapiens
KGLASKAGF

SEQ ID NO: 934041 - protein, 9 aa, Homo Sapiens
WENINRYPG

SEQ ID NO: 934042 - protein, 9 aa, Homo Sapiens
SHALMLPLL

SEQ ID NO: 934043 - protein, 9 aa, Homo Sapiens
APYDWFGNF

SEQ ID NO: 934044 - protein, 9 aa, Homo Sapiens
PLAQIEASL

SEQ ID NO: 934045 - protein, 9 aa, Homo Sapiens
LIMQVGMAT

SEQ ID NO: 934046 - protein, 9 aa, Homo Sapiens
IDVTLTIQE

SEQ ID NO: 934047 - protein, 9 aa, Homo Sapiens
AYVALSPAR

SEQ ID NO: 934048 - protein, 9 aa, Homo Sapiens
QEPREESCA

SEQ ID NO: 934049 - protein, 9 aa, Homo Sapiens
PIYSTLPQA

SEQ ID NO: 934050 - protein, 9 aa, Homo Sapiens
RFLSKKYRK

SEQ ID NO: 934051 - protein, 9 aa, Homo Sapiens
GRSSWMREK

SEQ ID NO: 934052 - protein, 9 aa, Homo Sapiens
VSRLTLAEL

SEQ ID NO: 934053 - protein, 9 aa, Homo Sapiens
SPKIQDAGP

SEQ ID NO: 934054 - protein, 9 aa, Homo Sapiens
CEKEGVSAQ

SEQ ID NO: 934055 - protein, 9 aa, Homo Sapiens
QSNIGASEN

SEQ ID NO: 934056 - protein, 9 aa, Homo Sapiens
MAEDISLLQ

SEQ ID NO: 934057 - protein, 9 aa, Homo Sapiens
EKPYSCSHC

SEQ ID NO: 934058 - protein, 9 aa, Homo Sapiens
YHVGPICQV

SEQ ID NO: 934059 - protein, 9 aa, Homo Sapiens
LEGGSAQPK

SEQ ID NO: 934060 - protein, 9 aa, Homo Sapiens
YTDRISFRM

SEQ ID NO: 934061 - protein, 9 aa, Homo Sapiens
VLEAKLHDV

SEQ ID NO: 934062 - protein, 9 aa, Homo Sapiens
QKCDILELK

SEQ ID NO: 934063 - protein, 9 aa, Homo Sapiens
PGLGPHAEQ

SEQ ID NO: 934064 - protein, 9 aa, Homo Sapiens
SLRTWLKVI

SEQ ID NO: 934065 - protein, 9 aa, Homo Sapiens
GLASKAGFL

SEQ ID NO: 934066 - protein, 9 aa, Homo Sapiens
TKHDECGSG

SEQ ID NO: 934067 - protein, 9 aa, Homo Sapiens
TWIIMELYS

SEQ ID NO: 934068 - protein, 9 aa, Homo Sapiens
EKLDLGFLS

SEQ ID NO: 934069 - protein, 9 aa, Homo Sapiens
SFAFTPISS

SEQ ID NO: 934070 - protein, 9 aa, Homo Sapiens
VGYPFRLFN

SEQ ID NO: 934071 - protein, 9 aa, Homo Sapiens
RKAPSPGPS

SEQ ID NO: 934072 - protein, 9 aa, Homo Sapiens
FSCSHRFSK

SEQ ID NO: 934073 - protein, 9 aa, Homo Sapiens
FNFTACHQS

SEQ ID NO: 934074 - protein, 9 aa, Homo Sapiens
QNKEMEFLD

SEQ ID NO: 934075 - protein, 9 aa, Homo Sapiens
IPIIRDNLA

SEQ ID NO: 934076 - protein, 9 aa, Homo Sapiens
SEENGPLIM

SEQ ID NO: 934077 - protein, 9 aa, Homo Sapiens
GEANGIYET

SEQ ID NO: 934078 - protein, 9 aa, Homo Sapiens
KENEEEPQW

SEQ ID NO: 934079 - protein, 9 aa, Homo Sapiens
WSCLCLVYQ

SEQ ID NO: 934080 - protein, 9 aa, Homo Sapiens
NVSSWLPHL

SEQ ID NO: 934081 - protein, 9 aa, Homo Sapiens
SKRQWDRLY

SEQ ID NO: 934082 - protein, 9 aa, Homo Sapiens
ELLKQQGID

SEQ ID NO: 934083 - protein, 9 aa, Homo Sapiens
PCTWWSGTW

SEQ ID NO: 934084 - protein, 9 aa, Homo Sapiens
TFQHPPPPP

SEQ ID NO: 934085 - protein, 9 aa, Homo Sapiens
GERGPKGEK

SEQ ID NO: 934086 - protein, 9 aa, Homo Sapiens
PEHGSAKQN

SEQ ID NO: 934087 - protein, 9 aa, Homo Sapiens
EENITSNDG

SEQ ID NO: 934088 - protein, 9 aa, Homo Sapiens
PGNPKQSGL

SEQ ID NO: 934089 - protein, 9 aa, Homo Sapiens
PKIAAEEEA

SEQ ID NO: 934090 - protein, 9 aa, Homo Sapiens
SMWSNQTWN

SEQ ID NO: 934091 - protein, 9 aa, Homo Sapiens
IKSHSYLSQ

SEQ ID NO: 934092 - protein, 9 aa, Homo Sapiens
VLVRKEQSS

SEQ ID NO: 934093 - protein, 9 aa, Homo Sapiens
IGTIFSVIF

SEQ ID NO: 934094 - protein, 9 aa, Homo Sapiens
LSNPKFGVH

SEQ ID NO: 934095 - protein, 9 aa, Homo Sapiens
ATGDFGDIE

SEQ ID NO: 934096 - protein, 9 aa, Homo Sapiens
NRVKTSLNQ

SEQ ID NO: 934097 - protein, 9 aa, Homo Sapiens
IIKAIGNVI

SEQ ID NO: 934098 - protein, 9 aa, Homo Sapiens
EDSAPRYAD

SEQ ID NO: 934099 - protein, 9 aa, Homo Sapiens
RLRDPISLY

SEQ ID NO: 934100 - protein, 9 aa, Homo Sapiens
VFGAKARRH

SEQ ID NO: 934101 - protein, 9 aa, Homo Sapiens
PPLMKKIKQ

SEQ ID NO: 934102 - protein, 9 aa, Homo Sapiens
YEGVAVIKM

SEQ ID NO: 934103 - protein, 9 aa, Homo Sapiens
TPKSCSKVA

SEQ ID NO: 934104 - protein, 9 aa, Homo Sapiens
PYDWFGNFS

SEQ ID NO: 934105 - protein, 9 aa, Homo Sapiens
YLEFFQSNS

SEQ ID NO: 934106 - protein, 9 aa, Homo Sapiens
QQVFGAKAR

SEQ ID NO: 934107 - protein, 9 aa, Homo Sapiens
QWKGLPEPP

SEQ ID NO: 934108 - protein, 9 aa, Homo Sapiens
SNLCVMANP

SEQ ID NO: 934109 - protein, 9 aa, Homo Sapiens
LTADSLRPA

SEQ ID NO: 934110 - protein, 9 aa, Homo Sapiens
HEEMEAHTP

SEQ ID NO: 934111 - protein, 9 aa, Homo Sapiens
AMVDANNGI

SEQ ID NO: 934112 - protein, 9 aa, Homo Sapiens
PWSSTSGTS

SEQ ID NO: 934113 - protein, 9 aa, Homo Sapiens
SKKYRKYYY

SEQ ID NO: 934114 - protein, 9 aa, Homo Sapiens
GVSVLRSFR

SEQ ID NO: 934115 - protein, 9 aa, Homo Sapiens
WRWGRRPWP

SEQ ID NO: 934116 - protein, 9 aa, Homo Sapiens
HTPVKEAED

SEQ ID NO: 934117 - protein, 9 aa, Homo Sapiens
LSKKYRKYY

SEQ ID NO: 934118 - protein, 9 aa, Homo Sapiens
PPSGPPSGS

SEQ ID NO: 934119 - protein, 9 aa, Homo Sapiens
ATGKAFSGQ

SEQ ID NO: 934120 - protein, 9 aa, Homo Sapiens
KGLPEPPRA

SEQ ID NO: 934121 - protein, 9 aa, Homo Sapiens
SNPKFGVHL

SEQ ID NO: 934122 - protein, 9 aa, Homo Sapiens
KSKILAKRL

SEQ ID NO: 934123 - protein, 9 aa, Homo Sapiens
QTFIASSGI

SEQ ID NO: 934124 - protein, 9 aa, Homo Sapiens
WIIMELYSY

SEQ ID NO: 934125 - protein, 9 aa, Homo Sapiens
RKEQSSTVL

SEQ ID NO: 934126 - protein, 9 aa, Homo Sapiens
AWHPIKPYG

SEQ ID NO: 934127 - protein, 9 aa, Homo Sapiens
AAEAVLSSS

SEQ ID NO: 934128 - protein, 9 aa, Homo Sapiens
RKEVIKNKI

SEQ ID NO: 934129 - protein, 9 aa, Homo Sapiens
GRVGFLQGD

SEQ ID NO: 934130 - protein, 9 aa, Homo Sapiens
GTISSANMG

SEQ ID NO: 934131 - protein, 9 aa, Homo Sapiens
GQGHAQASL

SEQ ID NO: 934132 - protein, 9 aa, Homo Sapiens
KMLAAREDR

SEQ ID NO: 934133 - protein, 9 aa, Homo Sapiens
SIGTIFSVI

SEQ ID NO: 934134 - protein, 9 aa, Homo Sapiens
EFFQSNSMN

SEQ ID NO: 934135 - protein, 9 aa, Homo Sapiens
DFIIKPVHS

SEQ ID NO: 934136 - protein, 9 aa, Homo Sapiens
QTHSLPSEP

SEQ ID NO: 934137 - protein, 9 aa, Homo Sapiens
LDMNLSTGA

SEQ ID NO: 934138 - protein, 9 aa, Homo Sapiens
STPQNPATF

SEQ ID NO: 934139 - protein, 9 aa, Homo Sapiens
VVKGEAGLQ

SEQ ID NO: 934140 - protein, 9 aa, Homo Sapiens
SSRIKSHSY

SEQ ID NO: 934141 - protein, 9 aa, Homo Sapiens
NKTLEKLDL

SEQ ID NO: 934142 - protein, 9 aa, Homo Sapiens
ENSPLETEF

SEQ ID NO: 934143 - protein, 9 aa, Homo Sapiens
SKILAKRLQ

SEQ ID NO: 934144 - protein, 9 aa, Homo Sapiens
FMLLGLTSR

SEQ ID NO: 934145 - protein, 9 aa, Homo Sapiens
LSANVSSWL

SEQ ID NO: 934146 - protein, 9 aa, Homo Sapiens
MEQRDQQKE

SEQ ID NO: 934147 - protein, 9 aa, Homo Sapiens
GRVGSTFEN

SEQ ID NO: 934148 - protein, 9 aa, Homo Sapiens
CAQKCKEWE

SEQ ID NO: 934149 - protein, 9 aa, Homo Sapiens
ELYSYGELG

SEQ ID NO: 934150 - protein, 9 aa, Homo Sapiens
AEKVQAPEG

SEQ ID NO: 934151 - protein, 9 aa, Homo Sapiens
RVIYPAPCD

SEQ ID NO: 934152 - protein, 9 aa, Homo Sapiens
LRTWLKVIQ

SEQ ID NO: 934153 - protein, 9 aa, Homo Sapiens
RNPELERNR

SEQ ID NO: 934154 - protein, 9 aa, Homo Sapiens
DAQMLDIPN

SEQ ID NO: 934155 - protein, 9 aa, Homo Sapiens
PGGLRSLGP

SEQ ID NO: 934156 - protein, 9 aa, Homo Sapiens
TGNLSMWSN

SEQ ID NO: 934157 - protein, 9 aa, Homo Sapiens
IVTKLKSRV

SEQ ID NO: 934158 - protein, 9 aa, Homo Sapiens
LETEFPLNH

SEQ ID NO: 934159 - protein, 9 aa, Homo Sapiens
AEEWSCLCL

SEQ ID NO: 934160 - protein, 9 aa, Homo Sapiens
RGYQGRVFL

SEQ ID NO: 934161 - protein, 9 aa, Homo Sapiens
SFYSPLSSP

SEQ ID NO: 934162 - protein, 9 aa, Homo Sapiens
GPLDHSSSK

SEQ ID NO: 934163 - protein, 9 aa, Homo Sapiens
CGRFVKKDG

SEQ ID NO: 934164 - protein, 9 aa, Homo Sapiens
PTGNLSMWS

SEQ ID NO: 934165 - protein, 9 aa, Homo Sapiens
ENRVKTSLN

SEQ ID NO: 934166 - protein, 9 aa, Homo Sapiens
IVLIYDEQI

SEQ ID NO: 934167 - protein, 9 aa, Homo Sapiens
TTFFFGYHL

SEQ ID NO: 934168 - protein, 9 aa, Homo Sapiens
TKKVSSKEK

SEQ ID NO: 934169 - protein, 9 aa, Homo Sapiens
RLQDTTFFF

SEQ ID NO: 934170 - protein, 9 aa, Homo Sapiens
GSTPLVGSL

SEQ ID NO: 934171 - protein, 9 aa, Homo Sapiens
GLQGPKGMK

SEQ ID NO: 934172 - protein, 9 aa, Homo Sapiens
KFGVHLGQP

SEQ ID NO: 934173 - protein, 9 aa, Homo Sapiens
KQSGLGELP

SEQ ID NO: 934174 - protein, 9 aa, Homo Sapiens
DANPILPSM

SEQ ID NO: 934175 - protein, 9 aa, Homo Sapiens
APGTNAGKA

SEQ ID NO: 934176 - protein, 9 aa, Homo Sapiens
IEDKVIFYN

SEQ ID NO: 934177 - protein, 9 aa, Homo Sapiens
PSDSLKPGL

SEQ ID NO: 934178 - protein, 9 aa, Homo Sapiens
SSKRQWDRL

SEQ ID NO: 934179 - protein, 9 aa, Homo Sapiens
TPWCWWSGR

SEQ ID NO: 934180 - protein, 9 aa, Homo Sapiens
MKHSLKIVL

SEQ ID NO: 934181 - protein, 9 aa, Homo Sapiens
KMVNQLAVC

SEQ ID NO: 934182 - protein, 9 aa, Homo Sapiens
FSQYTVVDK

SEQ ID NO: 934183 - protein, 9 aa, Homo Sapiens
SLKPGLGPH

SEQ ID NO: 934184 - protein, 9 aa, Homo Sapiens
GPPGERGPK

SEQ ID NO: 934185 - protein, 9 aa, Homo Sapiens
PDAQMLDIP

SEQ ID NO: 934186 - protein, 9 aa, Homo Sapiens
GNTREALSS

SEQ ID NO: 934187 - protein, 9 aa, Homo Sapiens
YFFGPNSSA

SEQ ID NO: 934188 - protein, 9 aa, Homo Sapiens
YPEPIYSTL

SEQ ID NO: 934189 - protein, 9 aa, Homo Sapiens
GPPVVKGEA

SEQ ID NO: 934190 - protein, 9 aa, Homo Sapiens
SSKRPAAVG

SEQ ID NO: 934191 - protein, 9 aa, Homo Sapiens
NFTACHQSY

SEQ ID NO: 934192 - protein, 9 aa, Homo Sapiens
PFASLVSRL

SEQ ID NO: 934193 - protein, 9 aa, Homo Sapiens
SLLEAIIFA

SEQ ID NO: 934194 - protein, 9 aa, Homo Sapiens
SDLQAQSKE

SEQ ID NO: 934195 - protein, 9 aa, Homo Sapiens
VNQLAVCFH

SEQ ID NO: 934196 - protein, 9 aa, Homo Sapiens
IGDFGLATE

SEQ ID NO: 934197 - protein, 9 aa, Homo Sapiens
DRLQEYTEQ

SEQ ID NO: 934198 - protein, 9 aa, Homo Sapiens
CKSRGREGG

SEQ ID NO: 934199 - protein, 9 aa, Homo Sapiens
VEPSERPAV

SEQ ID NO: 934200 - protein, 9 aa, Homo Sapiens
FGDIEDTIN

SEQ ID NO: 934201 - protein, 9 aa, Homo Sapiens
FLKLCLNSR

SEQ ID NO: 934202 - protein, 9 aa, Homo Sapiens
TPRIVSRVD

SEQ ID NO: 934203 - protein, 9 aa, Homo Sapiens
EAALSRMPF

SEQ ID NO: 934204 - protein, 9 aa, Homo Sapiens
LSYYITDGN

SEQ ID NO: 934205 - protein, 9 aa, Homo Sapiens
KRWQRLQSQ

SEQ ID NO: 934206 - protein, 9 aa, Homo Sapiens
ALPPSQKMT

SEQ ID NO: 934207 - protein, 9 aa, Homo Sapiens
RPRPQTPWC

SEQ ID NO: 934208 - protein, 9 aa, Homo Sapiens
LGPHAEQPA

SEQ ID NO: 934209 - protein, 9 aa, Homo Sapiens
NRRQRENRV

SEQ ID NO: 934210 - protein, 9 aa, Homo Sapiens
LDTAQKKLY

SEQ ID NO: 934211 - protein, 9 aa, Homo Sapiens
PIQDSHDFS

SEQ ID NO: 934212 - protein, 9 aa, Homo Sapiens
KELLKQQGI

SEQ ID NO: 934213 - protein, 9 aa, Homo Sapiens
PVAVTFPIT

SEQ ID NO: 934214 - protein, 9 aa, Homo Sapiens
TTPVVIVLY

SEQ ID NO: 934215 - protein, 9 aa, Homo Sapiens
LWESMAKGL

SEQ ID NO: 934216 - protein, 9 aa, Homo Sapiens
SPFFREKAP

SEQ ID NO: 934217 - protein, 9 aa, Homo Sapiens
HAEQPAAEP

SEQ ID NO: 934218 - protein, 9 aa, Homo Sapiens
NGPPLMKKI

SEQ ID NO: 934219 - protein, 9 aa, Homo Sapiens
TASISSTSI

SEQ ID NO: 934220 - protein, 9 aa, Homo Sapiens
TDVTEFMLL

SEQ ID NO: 934221 - protein, 9 aa, Homo Sapiens
GPPSGSSRG

SEQ ID NO: 934222 - protein, 9 aa, Homo Sapiens
KKGLASKAG

SEQ ID NO: 934223 - protein, 9 aa, Homo Sapiens
KGLEGTAGL

SEQ ID NO: 934224 - protein, 9 aa, Homo Sapiens
QLSNPKFGV

SEQ ID NO: 934225 - protein, 9 aa, Homo Sapiens
SPSDSLKPG

SEQ ID NO: 934226 - protein, 9 aa, Homo Sapiens
TIGGSHALM

SEQ ID NO: 934227 - protein, 9 aa, Homo Sapiens
QSKENPEQT

SEQ ID NO: 934228 - protein, 9 aa, Homo Sapiens
TLEKLDLGF

SEQ ID NO: 934229 - protein, 9 aa, Homo Sapiens
GVPETIAFL

SEQ ID NO: 934230 - protein, 9 aa, Homo Sapiens
QNIPIIRDN

SEQ ID NO: 934231 - protein, 9 aa, Homo Sapiens
ETIAFLTLA

SEQ ID NO: 934232 - protein, 9 aa, Homo Sapiens
NIRNLVRRC

SEQ ID NO: 934233 - protein, 9 aa, Homo Sapiens
YHSCLILIP

SEQ ID NO: 934234 - protein, 9 aa, Homo Sapiens
REKAPGMQR

SEQ ID NO: 934235 - protein, 9 aa, Homo Sapiens
STPRIVSRV

SEQ ID NO: 934236 - protein, 9 aa, Homo Sapiens
TKTASISST

SEQ ID NO: 934237 - protein, 9 aa, Homo Sapiens
AQMLDIPNL

SEQ ID NO: 934238 - protein, 9 aa, Homo Sapiens
KKHKLYVSF

SEQ ID NO: 934239 - protein, 9 aa, Homo Sapiens
KACVTPFLT

SEQ ID NO: 934240 - protein, 9 aa, Homo Sapiens
FREKAPGMQ

SEQ ID NO: 934241 - protein, 9 aa, Homo Sapiens
GLGELPDKF

SEQ ID NO: 934242 - protein, 9 aa, Homo Sapiens
TFLILVLFN

SEQ ID NO: 934243 - protein, 9 aa, Homo Sapiens
KLGNRLEEV

SEQ ID NO: 934244 - protein, 9 aa, Homo Sapiens
RDDRVIGDY

SEQ ID NO: 934245 - protein, 9 aa, Homo Sapiens
SKEKKKVTW

SEQ ID NO: 934246 - protein, 9 aa, Homo Sapiens
EDQIFIAVF

SEQ ID NO: 934247 - protein, 9 aa, Homo Sapiens
GISINYEEN

SEQ ID NO: 934248 - protein, 9 aa, Homo Sapiens
TTQLCAQKC

SEQ ID NO: 934249 - protein, 9 aa, Homo Sapiens
CSKDKVVES

SEQ ID NO: 934250 - protein, 9 aa, Homo Sapiens
PVRLHEAAE

SEQ ID NO: 934251 - protein, 9 aa, Homo Sapiens
AIFVRENNG

SEQ ID NO: 934252 - protein, 9 aa, Homo Sapiens
IQSNIGASE

SEQ ID NO: 934253 - protein, 9 aa, Homo Sapiens
EQPAAEPGG

SEQ ID NO: 934254 - protein, 9 aa, Homo Sapiens
NECKVEPCK

SEQ ID NO: 934255 - protein, 9 aa, Homo Sapiens
EVKYSTVAS

SEQ ID NO: 934256 - protein, 9 aa, Homo Sapiens
ENEEEPQWE

SEQ ID NO: 934257 - protein, 9 aa, Homo Sapiens
TVILEEIDP

SEQ ID NO: 934258 - protein, 9 aa, Homo Sapiens
IIKKNEEKN

SEQ ID NO: 934259 - protein, 9 aa, Homo Sapiens
WGQKEMREK

SEQ ID NO: 934260 - protein, 9 aa, Homo Sapiens
IQQVEVDLS

SEQ ID NO: 934261 - protein, 9 aa, Homo Sapiens
PEGVPYYAE

SEQ ID NO: 934262 - protein, 9 aa, Homo Sapiens
QEGREGPVP

SEQ ID NO: 934263 - protein, 9 aa, Homo Sapiens
VMVLKKVQP

SEQ ID NO: 934264 - protein, 9 aa, Homo Sapiens
YDKYYMASP

SEQ ID NO: 934265 - protein, 9 aa, Homo Sapiens
RVDGTPGKC

SEQ ID NO: 934266 - protein, 9 aa, Homo Sapiens
ALCTPLSCL

SEQ ID NO: 934267 - protein, 9 aa, Homo Sapiens
DEAKKYNLV

SEQ ID NO: 934268 - protein, 9 aa, Homo Sapiens
TATGYLLRK

SEQ ID NO: 934269 - protein, 9 aa, Homo Sapiens
WVECVDLLV

SEQ ID NO: 934270 - protein, 9 aa, Homo Sapiens
PKDCEDGKD

SEQ ID NO: 934271 - protein, 9 aa, Homo Sapiens
PIANIQSNI

SEQ ID NO: 934272 - protein, 9 aa, Homo Sapiens
ILIPDQTAQ

SEQ ID NO: 934273 - protein, 9 aa, Homo Sapiens
EKTRNGKAN

SEQ ID NO: 934274 - protein, 9 aa, Homo Sapiens
KPYSCSHCE

SEQ ID NO: 934275 - protein, 9 aa, Homo Sapiens
ILPEVKVEE

SEQ ID NO: 934276 - protein, 9 aa, Homo Sapiens
TREALSSCP

SEQ ID NO: 934277 - protein, 9 aa, Homo Sapiens
RLAREPRLS

SEQ ID NO: 934278 - protein, 9 aa, Homo Sapiens
PGSLSGSED

SEQ ID NO: 934279 - protein, 9 aa, Homo Sapiens
NKCEEAFND

SEQ ID NO: 934280 - protein, 9 aa, Homo Sapiens
KLLIILPFK

SEQ ID NO: 934281 - protein, 9 aa, Homo Sapiens
IWEIRILPN

SEQ ID NO: 934282 - protein, 9 aa, Homo Sapiens
LRGRGVTLM

SEQ ID NO: 934283 - protein, 9 aa, Homo Sapiens
CTLIVILSW

SEQ ID NO: 934284 - protein, 9 aa, Homo Sapiens
HFVSNAYNF

SEQ ID NO: 934285 - protein, 9 aa, Homo Sapiens
AVGSWSLSQ

SEQ ID NO: 934286 - protein, 9 aa, Homo Sapiens
CCRCFWVEC

SEQ ID NO: 934287 - protein, 9 aa, Homo Sapiens
VLSYYITDG

SEQ ID NO: 934288 - protein, 9 aa, Homo Sapiens
CMERPPSGP

SEQ ID NO: 934289 - protein, 9 aa, Homo Sapiens
MVNQLAVCF

SEQ ID NO: 934290 - protein, 9 aa, Homo Sapiens
QTSFVGMKS

SEQ ID NO: 934291 - protein, 9 aa, Homo Sapiens
TVVDKNAVA

SEQ ID NO: 934292 - protein, 9 aa, Homo Sapiens
LLEAIIFAL

SEQ ID NO: 934293 - protein, 9 aa, Homo Sapiens
GIQQVFGAK

SEQ ID NO: 934294 - protein, 9 aa, Homo Sapiens
KEKKKVTWA

SEQ ID NO: 934295 - protein, 9 aa, Homo Sapiens
EALSSCPST

SEQ ID NO: 934296 - protein, 9 aa, Homo Sapiens
NVLIQLDQE

SEQ ID NO: 934297 - protein, 9 aa, Homo Sapiens
LGELPDKFI

SEQ ID NO: 934298 - protein, 9 aa, Homo Sapiens
NSMNSLPPA

SEQ ID NO: 934299 - protein, 9 aa, Homo Sapiens
WLKVIQVEP

SEQ ID NO: 934300 - protein, 9 aa, Homo Sapiens
FPNNPHVQY

SEQ ID NO: 934301 - protein, 9 aa, Homo Sapiens
PLVAGPAAQ

SEQ ID NO: 934302 - protein, 9 aa, Homo Sapiens
DQEIAKTGK

SEQ ID NO: 934303 - protein, 9 aa, Homo Sapiens
QPKDCEDGK

SEQ ID NO: 934304 - protein, 9 aa, Homo Sapiens
EALDTYLAQ

SEQ ID NO: 934305 - protein, 9 aa, Homo Sapiens
RNRLYPAYT

SEQ ID NO: 934306 - protein, 9 aa, Homo Sapiens
GGDQEIAKT

SEQ ID NO: 934307 - protein, 9 aa, Homo Sapiens
HSLPSEPVG

SEQ ID NO: 934308 - protein, 9 aa, Homo Sapiens
EPQVYALPP

SEQ ID NO: 934309 - protein, 9 aa, Homo Sapiens
ERLGYAFSV

SEQ ID NO: 934310 - protein, 9 aa, Homo Sapiens
GYLLRKQQR

SEQ ID NO: 934311 - protein, 9 aa, Homo Sapiens
FFREKAPGM

SEQ ID NO: 934312 - protein, 9 aa, Homo Sapiens
GQAYVALSP

SEQ ID NO: 934313 - protein, 9 aa, Homo Sapiens
WSSTSGTSG

SEQ ID NO: 934314 - protein, 9 aa, Homo Sapiens
WSLSQQRRQ

SEQ ID NO: 934315 - protein, 9 aa, Homo Sapiens
SSCPSTVST

SEQ ID NO: 934316 - protein, 9 aa, Homo Sapiens
IVWTKLDMN

SEQ ID NO: 934317 - protein, 9 aa, Homo Sapiens
IPKRNPISV

SEQ ID NO: 934318 - protein, 9 aa, Homo Sapiens
SRGRMSLFA

SEQ ID NO: 934319 - protein, 9 aa, Homo Sapiens
EKLPLSSKR

SEQ ID NO: 934320 - protein, 9 aa, Homo Sapiens
SLVSRLTLA

SEQ ID NO: 934321 - protein, 9 aa, Homo Sapiens
SCLILIPDQ

SEQ ID NO: 934322 - protein, 9 aa, Homo Sapiens
VEIFCNHFV

SEQ ID NO: 934323 - protein, 9 aa, Homo Sapiens
PRRPREALD

SEQ ID NO: 934324 - protein, 9 aa, Homo Sapiens
ALPSPYHVG

SEQ ID NO: 934325 - protein, 9 aa, Homo Sapiens
KKNEEKNNG

SEQ ID NO: 934326 - protein, 9 aa, Homo Sapiens
PRWCMERPP

SEQ ID NO: 934327 - protein, 9 aa, Homo Sapiens
SLLIIKAIG

SEQ ID NO: 934328 - protein, 9 aa, Homo Sapiens
LSPLLEKPA

SEQ ID NO: 934329 - protein, 9 aa, Homo Sapiens
TTFSSRIKS

SEQ ID NO: 934330 - protein, 9 aa, Homo Sapiens
RDPISLYCG

SEQ ID NO: 934331 - protein, 9 aa, Homo Sapiens
FEKNVDIAC

SEQ ID NO: 934332 - protein, 9 aa, Homo Sapiens
QAEEWSCLC

SEQ ID NO: 934333 - protein, 9 aa, Homo Sapiens
GPVRLHEAA

SEQ ID NO: 934334 - protein, 9 aa, Homo Sapiens
HAQASLEIR

SEQ ID NO: 934335 - protein, 9 aa, Homo Sapiens
DYSELGEHP

SEQ ID NO: 934336 - protein, 9 aa, Homo Sapiens
GPNSSASLY

SEQ ID NO: 934337 - protein, 9 aa, Homo Sapiens
KIQDAGPAS

SEQ ID NO: 934338 - protein, 9 aa, Homo Sapiens
AQKELLKQQ

SEQ ID NO: 934339 - protein, 9 aa, Homo Sapiens
LSCLKQEVA

SEQ ID NO: 934340 - protein, 9 aa, Homo Sapiens
LVAGPAAQR

SEQ ID NO: 934341 - protein, 9 aa, Homo Sapiens
SSTSGTSGD

SEQ ID NO: 934342 - protein, 9 aa, Homo Sapiens
WKKHCQIVK

SEQ ID NO: 934343 - protein, 9 aa, Homo Sapiens
KLDMNLSTG

SEQ ID NO: 934344 - protein, 9 aa, Homo Sapiens
VCGVRKACV

SEQ ID NO: 934345 - protein, 9 aa, Homo Sapiens
LLEKPAPSW

SEQ ID NO: 934346 - protein, 9 aa, Homo Sapiens
KLYVSFRDL

SEQ ID NO: 934347 - protein, 9 aa, Homo Sapiens
EAKKYNLVL

SEQ ID NO: 934348 - protein, 9 aa, Homo Sapiens
ASIYVPSPA

SEQ ID NO: 934349 - protein, 9 aa, Homo Sapiens
NLNDDGLTE

SEQ ID NO: 934350 - protein, 9 aa, Homo Sapiens
WKGLPEPPR

SEQ ID NO: 934351 - protein, 9 aa, Homo Sapiens
FRLFNFTAC

SEQ ID NO: 934352 - protein, 9 aa, Homo Sapiens
LNLDEDFII

SEQ ID NO: 934353 - protein, 9 aa, Homo Sapiens
MSRSQFARV

SEQ ID NO: 934354 - protein, 9 aa, Homo Sapiens
VLIQLDQEG

SEQ ID NO: 934355 - protein, 9 aa, Homo Sapiens
HMNDALVLY

SEQ ID NO: 934356 - protein, 9 aa, Homo Sapiens
TSVPEDQIF

SEQ ID NO: 934357 - protein, 9 aa, Homo Sapiens
SKRPAAVGA

SEQ ID NO: 934358 - protein, 9 aa, Homo Sapiens
VSRGRMSLF

SEQ ID NO: 934359 - protein, 9 aa, Homo Sapiens
SAKQNGQKS

SEQ ID NO: 934360 - protein, 9 aa, Homo Sapiens
IPVLCIFPP

SEQ ID NO: 934361 - protein, 9 aa, Homo Sapiens
SGRKMLSAL

SEQ ID NO: 934362 - protein, 9 aa, Homo Sapiens
SERGPIDTS

SEQ ID NO: 934363 - protein, 9 aa, Homo Sapiens
IIESGRIGF

SEQ ID NO: 934364 - protein, 9 aa, Homo Sapiens
SRMPFPGGR

SEQ ID NO: 934365 - protein, 9 aa, Homo Sapiens
KTYQGNKCE

SEQ ID NO: 934366 - protein, 9 aa, Homo Sapiens
SRVDGTPGK

SEQ ID NO: 934367 - protein, 9 aa, Homo Sapiens
YDWFGNFSS

SEQ ID NO: 934368 - protein, 9 aa, Homo Sapiens
QIFIAVFPG

SEQ ID NO: 934369 - protein, 9 aa, Homo Sapiens
SCPSTVSTK

SEQ ID NO: 934370 - protein, 9 aa, Homo Sapiens
SVPEDQIFI

SEQ ID NO: 934371 - protein, 9 aa, Homo Sapiens
SCTKHDECG

SEQ ID NO: 934372 - protein, 9 aa, Homo Sapiens
PAPCDGRLY

SEQ ID NO: 934373 - protein, 9 aa, Homo Sapiens
LCAQKCKEW

SEQ ID NO: 934374 - protein, 9 aa, Homo Sapiens
SAPRYADTL

SEQ ID NO: 934375 - protein, 9 aa, Homo Sapiens
LPIQDSHDF

SEQ ID NO: 934376 - protein, 9 aa, Homo Sapiens
MPLPAGVPN

SEQ ID NO: 934377 - protein, 9 aa, Homo Sapiens
PFMKHSLKI

SEQ ID NO: 934378 - protein, 9 aa, Homo Sapiens
FFFGYHLTL

SEQ ID NO: 934379 - protein, 9 aa, Homo Sapiens
VADEAKKYN

SEQ ID NO: 934380 - protein, 9 aa, Homo Sapiens
TSNDGPRGP

SEQ ID NO: 934381 - protein, 9 aa, Homo Sapiens
KIPFASLVS

SEQ ID NO: 934382 - protein, 9 aa, Homo Sapiens
GSLRPYMVS

SEQ ID NO: 934383 - protein, 9 aa, Homo Sapiens
LSGSEDKGN

SEQ ID NO: 934384 - protein, 9 aa, Homo Sapiens
VRKEQSSTV

SEQ ID NO: 934385 - protein, 9 aa, Homo Sapiens
ATAVVEFGS

SEQ ID NO: 934386 - protein, 9 aa, Homo Sapiens
KKILIFAFA

SEQ ID NO: 934387 - protein, 9 aa, Homo Sapiens
ALNEIIESG

SEQ ID NO: 934388 - protein, 9 aa, Homo Sapiens
WGRRPWPTS

SEQ ID NO: 934389 - protein, 9 aa, Homo Sapiens
YSELGEHPP

SEQ ID NO: 934390 - protein, 9 aa, Homo Sapiens
CLLMILFAM

SEQ ID NO: 934391 - protein, 9 aa, Homo Sapiens
KVNLQKCDI

SEQ ID NO: 934392 - protein, 9 aa, Homo Sapiens
GPPRWCMER

SEQ ID NO: 934393 - protein, 9 aa, Homo Sapiens
LLMILFAMA

SEQ ID NO: 934394 - protein, 9 aa, Homo Sapiens
DHRPVCQAR

SEQ ID NO: 934395 - protein, 9 aa, Homo Sapiens
AARKEVIKN

SEQ ID NO: 934396 - protein, 9 aa, Homo Sapiens
NTTVFFFSS

SEQ ID NO: 934397 - protein, 9 aa, Homo Sapiens
TPLFWRLES

SEQ ID NO: 934398 - protein, 9 aa, Homo Sapiens
HSSSKRQWD

SEQ ID NO: 934399 - protein, 9 aa, Homo Sapiens
SLFALNPRS

SEQ ID NO: 934400 - protein, 9 aa, Homo Sapiens
RCGRFVKKD

SEQ ID NO: 934401 - protein, 9 aa, Homo Sapiens
PAGVPNLPN

SEQ ID NO: 934402 - protein, 9 aa, Homo Sapiens
STVHKILCK

SEQ ID NO: 934403 - protein, 9 aa, Homo Sapiens
VPNLPNLNL

SEQ ID NO: 934404 - protein, 9 aa, Homo Sapiens
GPEGVPYYA

SEQ ID NO: 934405 - protein, 9 aa, Homo Sapiens
RGFQQFSFL

SEQ ID NO: 934406 - protein, 9 aa, Homo Sapiens
YGILILGQE

SEQ ID NO: 934407 - protein, 9 aa, Homo Sapiens
KNNGPLITL

SEQ ID NO: 934408 - protein, 9 aa, Homo Sapiens
DQQKEQAVI

SEQ ID NO: 934409 - protein, 9 aa, Homo Sapiens
SYGELGHYL

SEQ ID NO: 934410 - protein, 9 aa, Homo Sapiens
YQGTLLPAN

SEQ ID NO: 934411 - protein, 9 aa, Homo Sapiens
YSEENGPLI

SEQ ID NO: 934412 - protein, 9 aa, Homo Sapiens
SNSMNSLPP

SEQ ID NO: 934413 - protein, 9 aa, Homo Sapiens
ETLDKLGNR

SEQ ID NO: 934414 - protein, 9 aa, Homo Sapiens
HKILCKLSL

SEQ ID NO: 934415 - protein, 9 aa, Homo Sapiens
THMKKILIF

SEQ ID NO: 934416 - protein, 9 aa, Homo Sapiens
FFTALAGWG

SEQ ID NO: 934417 - protein, 9 aa, Homo Sapiens
HEAAEAVLS

SEQ ID NO: 934418 - protein, 9 aa, Homo Sapiens
IFWSERPTK

SEQ ID NO: 934419 - protein, 9 aa, Homo Sapiens
NCCRCFWVE

SEQ ID NO: 934420 - protein, 9 aa, Homo Sapiens
AWPLSTSAS

SEQ ID NO: 934421 - protein, 9 aa, Homo Sapiens
TGDFGDIED

SEQ ID NO: 934422 - protein, 9 aa, Homo Sapiens
RLQEYTEQR

SEQ ID NO: 934423 - protein, 9 aa, Homo Sapiens
SRGREGGGG

SEQ ID NO: 934424 - protein, 9 aa, Homo Sapiens
PRYADTLHS

SEQ ID NO: 934425 - protein, 9 aa, Homo Sapiens
EHPCILSLN

SEQ ID NO: 934426 - protein, 9 aa, Homo Sapiens
HRPVCQARM

SEQ ID NO: 934427 - protein, 9 aa, Homo Sapiens
WPNPKLEGG

SEQ ID NO: 934428 - protein, 9 aa, Homo Sapiens
KARSCEKEG

SEQ ID NO: 934429 - protein, 9 aa, Homo Sapiens
KDFSRPKAS

SEQ ID NO: 934430 - protein, 9 aa, Homo Sapiens
APIKEKLSQ

SEQ ID NO: 934431 - protein, 9 aa, Homo Sapiens
VLCIFPPPH

SEQ ID NO: 934432 - protein, 9 aa, Homo Sapiens
AEPAEKVQA

SEQ ID NO: 934433 - protein, 9 aa, Homo Sapiens
RYHSCLILI

SEQ ID NO: 934434 - protein, 9 aa, Homo Sapiens
GQKEMREKE

SEQ ID NO: 934435 - protein, 9 aa, Homo Sapiens
SDTHMKKIL

SEQ ID NO: 934436 - protein, 9 aa, Homo Sapiens
IFSVIFLLK

SEQ ID NO: 934437 - protein, 9 aa, Homo Sapiens
RTEAEISDH

SEQ ID NO: 934438 - protein, 9 aa, Homo Sapiens
MQYEGVAVI

SEQ ID NO: 934439 - protein, 9 aa, Homo Sapiens
EEAERRAPE

SEQ ID NO: 934440 - protein, 9 aa, Homo Sapiens
DGLTEVVSK

SEQ ID NO: 934441 - protein, 9 aa, Homo Sapiens
VHTLREEKV

SEQ ID NO: 934442 - protein, 9 aa, Homo Sapiens
HWFDYHGHM

SEQ ID NO: 934443 - protein, 9 aa, Homo Sapiens
YPDGGDQEI

SEQ ID NO: 934444 - protein, 9 aa, Homo Sapiens
SMEQRDQQK

SEQ ID NO: 934445 - protein, 9 aa, Homo Sapiens
LHDVQNILD

SEQ ID NO: 934446 - protein, 9 aa, Homo Sapiens
GHAQASLEI

SEQ ID NO: 934447 - protein, 9 aa, Homo Sapiens
TISSANMGL

SEQ ID NO: 934448 - protein, 9 aa, Homo Sapiens
KKKKKKNRK

SEQ ID NO: 934449 - protein, 9 aa, Homo Sapiens
FMKHSLKIV

SEQ ID NO: 934450 - protein, 9 aa, Homo Sapiens
EKLTIQIKG

SEQ ID NO: 934451 - protein, 9 aa, Homo Sapiens
PNSSASLYQ

SEQ ID NO: 934452 - protein, 9 aa, Homo Sapiens
MWGQKEMRE

SEQ ID NO: 934453 - protein, 9 aa, Homo Sapiens
RVDDFSCTK

SEQ ID NO: 934454 - protein, 9 aa, Homo Sapiens
PFPEENITS

SEQ ID NO: 934455 - protein, 9 aa, Homo Sapiens
HAATGKAFS

SEQ ID NO: 934456 - protein, 9 aa, Homo Sapiens
LGCNKEKER

SEQ ID NO: 934457 - protein, 9 aa, Homo Sapiens
GRLAREPRL

SEQ ID NO: 934458 - protein, 9 aa, Homo Sapiens
KTTFSSRIK

SEQ ID NO: 934459 - protein, 9 aa, Homo Sapiens
RGREGGGGG

SEQ ID NO: 934460 - protein, 9 aa, Homo Sapiens
KITTQLCAQ

SEQ ID NO: 934461 - protein, 9 aa, Homo Sapiens
FITHGEANG

SEQ ID NO: 934462 - protein, 9 aa, Homo Sapiens
ENTYVEYFI

SEQ ID NO: 934463 - protein, 9 aa, Homo Sapiens
EAERRAPEG

SEQ ID NO: 934464 - protein, 9 aa, Homo Sapiens
RLFNFTACH

SEQ ID NO: 934465 - protein, 9 aa, Homo Sapiens
DQSQNQAQV

SEQ ID NO: 934466 - protein, 9 aa, Homo Sapiens
RWEIFWSER

SEQ ID NO: 934467 - protein, 9 aa, Homo Sapiens
PIPKDFSRP

SEQ ID NO: 934468 - protein, 9 aa, Homo Sapiens
KAPSPGPSR

SEQ ID NO: 934469 - protein, 9 aa, Homo Sapiens
VEIRQFFSC

SEQ ID NO: 934470 - protein, 9 aa, Homo Sapiens
GVYCYCAPG

SEQ ID NO: 934471 - protein, 9 aa, Homo Sapiens
GRHGLLGKK

SEQ ID NO: 934472 - protein, 9 aa, Homo Sapiens
SRRARPEDL

SEQ ID NO: 934473 - protein, 9 aa, Homo Sapiens
HPLNALGGP

SEQ ID NO: 934474 - protein, 9 aa, Homo Sapiens
RLPSLLVLL

SEQ ID NO: 934475 - protein, 9 aa, Homo Sapiens
IRISFAKGW

SEQ ID NO: 934476 - protein, 9 aa, Homo Sapiens
LLVLLPRSA

SEQ ID NO: 934477 - protein, 9 aa, Homo Sapiens
SLLVLLPRS

SEQ ID NO: 934478 - protein, 9 aa, Homo Sapiens
QPNRVCNAL

SEQ ID NO: 934479 - protein, 9 aa, Homo Sapiens
GDVSEVRSE

SEQ ID NO: 934480 - protein, 9 aa, Homo Sapiens
SRVLCNFHT

SEQ ID NO: 934481 - protein, 9 aa, Homo Sapiens
SHDVSLTNR

SEQ ID NO: 934482 - protein, 9 aa, Homo Sapiens
HLSIQPPST

SEQ ID NO: 934483 - protein, 9 aa, Homo Sapiens
RSAKRSLRG

SEQ ID NO: 934484 - protein, 9 aa, Homo Sapiens
VSEVRSEKD

SEQ ID NO: 934485 - protein, 9 aa, Homo Sapiens
EKDQNQFIS

SEQ ID NO: 934486 - protein, 9 aa, Homo Sapiens
ATLNWRPEA

SEQ ID NO: 934487 - protein, 9 aa, Homo Sapiens
CPDCTSRVL

SEQ ID NO: 934488 - protein, 9 aa, Homo Sapiens
KGRLPSLLV

SEQ ID NO: 934489 - protein, 9 aa, Homo Sapiens
NIQVITKPA

SEQ ID NO: 934490 - protein, 9 aa, Homo Sapiens
DVSLTNRME

SEQ ID NO: 934491 - protein, 9 aa, Homo Sapiens
GTLKTYLKL

SEQ ID NO: 934492 - protein, 9 aa, Homo Sapiens
SGTASPMEG

SEQ ID NO: 934493 - protein, 9 aa, Homo Sapiens
NYSIRPEAL

SEQ ID NO: 934494 - protein, 9 aa, Homo Sapiens
ASRASSRRA

SEQ ID NO: 934495 - protein, 9 aa, Homo Sapiens
EQLLVAKQA

SEQ ID NO: 934496 - protein, 9 aa, Homo Sapiens
NVWPQRHFK

SEQ ID NO: 934497 - protein, 9 aa, Homo Sapiens
IGIEGVLIT

SEQ ID NO: 934498 - protein, 9 aa, Homo Sapiens
GVLITIPVQ

SEQ ID NO: 934499 - protein, 9 aa, Homo Sapiens
PNRVCNALA

SEQ ID NO: 934500 - protein, 9 aa, Homo Sapiens
DPNSIRISF

SEQ ID NO: 934501 - protein, 9 aa, Homo Sapiens
YQVLKLSYK

SEQ ID NO: 934502 - protein, 9 aa, Homo Sapiens
VATERQKRH

SEQ ID NO: 934503 - protein, 9 aa, Homo Sapiens
HEGTILDTG

SEQ ID NO: 934504 - protein, 9 aa, Homo Sapiens
INSFKNPNY

SEQ ID NO: 934505 - protein, 9 aa, Homo Sapiens
FGVYCYCAP

SEQ ID NO: 934506 - protein, 9 aa, Homo Sapiens
STLASELVR

SEQ ID NO: 934507 - protein, 9 aa, Homo Sapiens
PTLPSINYS

SEQ ID NO: 934508 - protein, 9 aa, Homo Sapiens
LTAHQPNRV

SEQ ID NO: 934509 - protein, 9 aa, Homo Sapiens
HLNVWPQRH

SEQ ID NO: 934510 - protein, 9 aa, Homo Sapiens
WPQRHFKID

SEQ ID NO: 934511 - protein, 9 aa, Homo Sapiens
NPEPWNILG

SEQ ID NO: 934512 - protein, 9 aa, Homo Sapiens
SSSHWALEK

SEQ ID NO: 934513 - protein, 9 aa, Homo Sapiens
SLTNRMEAA

SEQ ID NO: 934514 - protein, 9 aa, Homo Sapiens
PSTDLEVQA

SEQ ID NO: 934515 - protein, 9 aa, Homo Sapiens
MMIGIEGVL

SEQ ID NO: 934516 - protein, 9 aa, Homo Sapiens
YATMNGSLV

SEQ ID NO: 934517 - protein, 9 aa, Homo Sapiens
AHGYADFPS

SEQ ID NO: 934518 - protein, 9 aa, Homo Sapiens
WNILGPNDQ

SEQ ID NO: 934519 - protein, 9 aa, Homo Sapiens
WKGRLPSLL

SEQ ID NO: 934520 - protein, 9 aa, Homo Sapiens
RHPLNALGG

SEQ ID NO: 934521 - protein, 9 aa, Homo Sapiens
SINYSIRPE

SEQ ID NO: 934522 - protein, 9 aa, Homo Sapiens
NTPTLPSIN

SEQ ID NO: 934523 - protein, 9 aa, Homo Sapiens
DQPFKCKRC

SEQ ID NO: 934524 - protein, 9 aa, Homo Sapiens
GRLPSLLVL

SEQ ID NO: 934525 - protein, 9 aa, Homo Sapiens
TVYLVVALP

SEQ ID NO: 934526 - protein, 9 aa, Homo Sapiens
VLHCDAIVD

SEQ ID NO: 934527 - protein, 9 aa, Homo Sapiens
KGSTGRHGL

SEQ ID NO: 934528 - protein, 9 aa, Homo Sapiens
KRHQEIEQK

SEQ ID NO: 934529 - protein, 9 aa, Homo Sapiens
YLLGQHRRI

SEQ ID NO: 934530 - protein, 9 aa, Homo Sapiens
IKKKLTYAK

SEQ ID NO: 934531 - protein, 9 aa, Homo Sapiens
PFKCKRCKR

SEQ ID NO: 934532 - protein, 9 aa, Homo Sapiens
ATMNGSLVG

SEQ ID NO: 934533 - protein, 9 aa, Homo Sapiens
KSQSPRSPP

SEQ ID NO: 934534 - protein, 9 aa, Homo Sapiens
SSLNYQVLK

SEQ ID NO: 934535 - protein, 9 aa, Homo Sapiens
RQKRHQEIE

SEQ ID NO: 934536 - protein, 9 aa, Homo Sapiens
GWKGRLPSL

SEQ ID NO: 934537 - protein, 9 aa, Homo Sapiens
TPTLPSINY

SEQ ID NO: 934538 - protein, 9 aa, Homo Sapiens
LVVALPSVS

SEQ ID NO: 934539 - protein, 9 aa, Homo Sapiens
LNWRPEAER

SEQ ID NO: 934540 - protein, 9 aa, Homo Sapiens
TASPMEGTS

SEQ ID NO: 934541 - protein, 9 aa, Homo Sapiens
QNYGGAMRH

SEQ ID NO: 934542 - protein, 9 aa, Homo Sapiens
LQLSTLASE

SEQ ID NO: 934543 - protein, 9 aa, Homo Sapiens
QVITKPAIR

SEQ ID NO: 934544 - protein, 9 aa, Homo Sapiens
LLGQHRRIA

SEQ ID NO: 934545 - protein, 9 aa, Homo Sapiens
EHRSLIKKK

SEQ ID NO: 934546 - protein, 9 aa, Homo Sapiens
TLTAHQPNR

SEQ ID NO: 934547 - protein, 9 aa, Homo Sapiens
LKLFKVMKP

SEQ ID NO: 934548 - protein, 9 aa, Homo Sapiens
GAKGSTGRH

SEQ ID NO: 934549 - protein, 9 aa, Homo Sapiens
RLFGVYCYC

SEQ ID NO: 934550 - protein, 9 aa, Homo Sapiens
QFEGSPGLR

SEQ ID NO: 934551 - protein, 9 aa, Homo Sapiens
ALPSVSSLF

SEQ ID NO: 934552 - protein, 9 aa, Homo Sapiens
LHEQLLVAK

SEQ ID NO: 934553 - protein, 9 aa, Homo Sapiens
STDLEVQAG

SEQ ID NO: 934554 - protein, 9 aa, Homo Sapiens
YGNWTVKGV

SEQ ID NO: 934555 - protein, 9 aa, Homo Sapiens
TYEDIVEGL

SEQ ID NO: 934556 - protein, 9 aa, Homo Sapiens
CAPGAPDPA

SEQ ID NO: 934557 - protein, 9 aa, Homo Sapiens
MRHPLNALG

SEQ ID NO: 934558 - protein, 9 aa, Homo Sapiens
SFKNPNYGR

SEQ ID NO: 934559 - protein, 9 aa, Homo Sapiens
SVLQLSTLA

SEQ ID NO: 934560 - protein, 9 aa, Homo Sapiens
QPPSTDLEV

SEQ ID NO: 934561 - protein, 9 aa, Homo Sapiens
KQAVTGHHD

SEQ ID NO: 934562 - protein, 9 aa, Homo Sapiens
QNIRNRATL

SEQ ID NO: 934563 - protein, 9 aa, Homo Sapiens
PNSIRISFA

SEQ ID NO: 934564 - protein, 9 aa, Homo Sapiens
WTVKGVLIH

SEQ ID NO: 934565 - protein, 9 aa, Homo Sapiens
AKGSTGRHG

SEQ ID NO: 934566 - protein, 9 aa, Homo Sapiens
KLFKVMKPK

SEQ ID NO: 934567 - protein, 9 aa, Homo Sapiens
HDVSLTNRM

SEQ ID NO: 934568 - protein, 9 aa, Homo Sapiens
TAHQPNRVC

SEQ ID NO: 934569 - protein, 9 aa, Homo Sapiens
LSEKSGTHV

SEQ ID NO: 934570 - protein, 9 aa, Homo Sapiens
KKHLNVWPQ

SEQ ID NO: 934571 - protein, 9 aa, Homo Sapiens
HRSLIKKKL

SEQ ID NO: 934572 - protein, 9 aa, Homo Sapiens
SVEHRSLIK

SEQ ID NO: 934573 - protein, 9 aa, Homo Sapiens
EDIVEGLRV

SEQ ID NO: 934574 - protein, 9 aa, Homo Sapiens
SVHTKDQPF

SEQ ID NO: 934575 - protein, 9 aa, Homo Sapiens
PLPPVPSQY

SEQ ID NO: 934576 - protein, 9 aa, Homo Sapiens
AYLLGQHRR

SEQ ID NO: 934577 - protein, 9 aa, Homo Sapiens
HVLLLVLHE

SEQ ID NO: 934578 - protein, 9 aa, Homo Sapiens
HQEIEQKLE

SEQ ID NO: 934579 - protein, 9 aa, Homo Sapiens
EGLSEKSGT

SEQ ID NO: 934580 - protein, 9 aa, Homo Sapiens
EGVLITIPV

SEQ ID NO: 934581 - protein, 9 aa, Homo Sapiens
PWNILGPND

SEQ ID NO: 934582 - protein, 9 aa, Homo Sapiens
GFQFEGSPG

SEQ ID NO: 934583 - protein, 9 aa, Homo Sapiens
PSINYSIRP

SEQ ID NO: 934584 - protein, 9 aa, Homo Sapiens
LKTYLKLFK

SEQ ID NO: 934585 - protein, 9 aa, Homo Sapiens
LIKKKLTYA

SEQ ID NO: 934586 - protein, 9 aa, Homo Sapiens
YLVVALPSV

SEQ ID NO: 934587 - protein, 9 aa, Homo Sapiens
AYATMNGSL

SEQ ID NO: 934588 - protein, 9 aa, Homo Sapiens
HCDAIVDLI

SEQ ID NO: 934589 - protein, 9 aa, Homo Sapiens
HQPNRVCNA

SEQ ID NO: 934590 - protein, 9 aa, Homo Sapiens
EVRSEKDQN

SEQ ID NO: 934591 - protein, 9 aa, Homo Sapiens
CQHCDYGNW

SEQ ID NO: 934592 - protein, 9 aa, Homo Sapiens
LPSVSSLFL

SEQ ID NO: 934593 - protein, 9 aa, Homo Sapiens
GIEGVLITI

SEQ ID NO: 934594 - protein, 9 aa, Homo Sapiens
SQSPRSPPG

SEQ ID NO: 934595 - protein, 9 aa, Homo Sapiens
VHTKDQPFK

SEQ ID NO: 934596 - protein, 9 aa, Homo Sapiens
AAAVRSAKR

SEQ ID NO: 934597 - protein, 9 aa, Homo Sapiens
VRSEKDQNQ

SEQ ID NO: 934598 - protein, 9 aa, Homo Sapiens
SEVRSEKDQ

SEQ ID NO: 934599 - protein, 9 aa, Homo Sapiens
KLSYKGDEF

SEQ ID NO: 934600 - protein, 9 aa, Homo Sapiens
QAGGGGFQF

SEQ ID NO: 934601 - protein, 9 aa, Homo Sapiens
LFKVMKPKV

SEQ ID NO: 934602 - protein, 9 aa, Homo Sapiens
CDYGNWTVK

SEQ ID NO: 934603 - protein, 9 aa, Homo Sapiens
PMEGTSAVE

SEQ ID NO: 934604 - protein, 9 aa, Homo Sapiens
GNWTVKGVL

SEQ ID NO: 934605 - protein, 9 aa, Homo Sapiens
QGTYEDIVE

SEQ ID NO: 934606 - protein, 9 aa, Homo Sapiens
QSPRSPPGK

SEQ ID NO: 934607 - protein, 9 aa, Homo Sapiens
RNNPEPWNI

SEQ ID NO: 934608 - protein, 9 aa, Homo Sapiens
GQHRRIADI

SEQ ID NO: 934609 - protein, 9 aa, Homo Sapiens
DSVLQLSTL

SEQ ID NO: 934610 - protein, 9 aa, Homo Sapiens
RHGLLGKKG

SEQ ID NO: 934611 - protein, 9 aa, Homo Sapiens
SQYQVPGNL

SEQ ID NO: 934612 - protein, 9 aa, Homo Sapiens
TERQKRHQE

SEQ ID NO: 934613 - protein, 9 aa, Homo Sapiens
RDNIQVITK

SEQ ID NO: 934614 - protein, 9 aa, Homo Sapiens
GGGGFQFEG

SEQ ID NO: 934615 - protein, 9 aa, Homo Sapiens
MNGSLVGWD

SEQ ID NO: 934616 - protein, 9 aa, Homo Sapiens
YCYCAPGAP

SEQ ID NO: 934617 - protein, 9 aa, Homo Sapiens
KVLRDNIQV

SEQ ID NO: 934618 - protein, 9 aa, Homo Sapiens
VLRDNIQVI

SEQ ID NO: 934619 - protein, 9 aa, Homo Sapiens
TSRVLCNFH

SEQ ID NO: 934620 - protein, 9 aa, Homo Sapiens
AGGGGFQFE

SEQ ID NO: 934621 - protein, 9 aa, Homo Sapiens
PPVPSQYQV

SEQ ID NO: 934622 - protein, 9 aa, Homo Sapiens
INYSIRPEA

SEQ ID NO: 934623 - protein, 9 aa, Homo Sapiens
PDCTSRVLC

SEQ ID NO: 934624 - protein, 9 aa, Homo Sapiens
LASELVRKH

SEQ ID NO: 934625 - protein, 9 aa, Homo Sapiens
NYQVLKLSY

SEQ ID NO: 934626 - protein, 9 aa, Homo Sapiens
WSHDVSLTN

SEQ ID NO: 934627 - protein, 9 aa, Homo Sapiens
PSVSSLFLF

SEQ ID NO: 934628 - protein, 9 aa, Homo Sapiens
SLNYQVLKL

SEQ ID NO: 934629 - protein, 9 aa, Homo Sapiens
YGGAMRHPL

SEQ ID NO: 934630 - protein, 9 aa, Homo Sapiens
LSSSHWALE

SEQ ID NO: 934631 - protein, 9 aa, Homo Sapiens
VYCYCAPGA

SEQ ID NO: 934632 - protein, 9 aa, Homo Sapiens
AAVRSAKRS

SEQ ID NO: 934633 - protein, 9 aa, Homo Sapiens
ADFPSATPA

SEQ ID NO: 934634 - protein, 9 aa, Homo Sapiens
TTGQVLHCD

SEQ ID NO: 934635 - protein, 9 aa, Homo Sapiens
ERQKRHQEI

SEQ ID NO: 934636 - protein, 9 aa, Homo Sapiens
RHQEIEQKL

SEQ ID NO: 934637 - protein, 9 aa, Homo Sapiens
SSHWALEKQ

SEQ ID NO: 934638 - protein, 9 aa, Homo Sapiens
GQAGGGGFQ

SEQ ID NO: 934639 - protein, 9 aa, Homo Sapiens
LKLSYKGDE

SEQ ID NO: 934640 - protein, 9 aa, Homo Sapiens
YDPNSIRIS

SEQ ID NO: 934641 - protein, 9 aa, Homo Sapiens
LAYATMNGS

SEQ ID NO: 934642 - protein, 9 aa, Homo Sapiens
FPSATPASR

SEQ ID NO: 934643 - protein, 9 aa, Homo Sapiens
QSAYLLGQH

SEQ ID NO: 934644 - protein, 9 aa, Homo Sapiens
SPINSFKNP

SEQ ID NO: 934645 - protein, 9 aa, Homo Sapiens
TYLKLFKVM

SEQ ID NO: 934646 - protein, 9 aa, Homo Sapiens
KEQGTYEDI

SEQ ID NO: 934647 - protein, 9 aa, Homo Sapiens
QGDKSQSPR

SEQ ID NO: 934648 - protein, 9 aa, Homo Sapiens
KDQPFKCKR

SEQ ID NO: 934649 - protein, 9 aa, Homo Sapiens
NYGGAMRHP

SEQ ID NO: 934650 - protein, 9 aa, Homo Sapiens
PQRHFKIDA

SEQ ID NO: 934651 - protein, 9 aa, Homo Sapiens
TLPSINYSI

SEQ ID NO: 934652 - protein, 9 aa, Homo Sapiens
VVALPSVSS

SEQ ID NO: 934653 - protein, 9 aa, Homo Sapiens
KSPINSFKN

SEQ ID NO: 934654 - protein, 9 aa, Homo Sapiens
NIRNRATLN

SEQ ID NO: 934655 - protein, 9 aa, Homo Sapiens
QVLHCDAIV

SEQ ID NO: 934656 - protein, 9 aa, Homo Sapiens
QPLPPVPSQ

SEQ ID NO: 934657 - protein, 9 aa, Homo Sapiens
VALPSVSSL

SEQ ID NO: 934658 - protein, 9 aa, Homo Sapiens
LVLHEGTIL

SEQ ID NO: 934659 - protein, 9 aa, Homo Sapiens
KSGTHVSAE

SEQ ID NO: 934660 - protein, 9 aa, Homo Sapiens
DITTGQVLH

SEQ ID NO: 934661 - protein, 9 aa, Homo Sapiens
GDKSQSPRS

SEQ ID NO: 934662 - protein, 9 aa, Homo Sapiens
ASPMEGTSA

SEQ ID NO: 934663 - protein, 9 aa, Homo Sapiens
VLLLVLHEG

SEQ ID NO: 934664 - protein, 9 aa, Homo Sapiens
LNVWPQRHF

SEQ ID NO: 934665 - protein, 9 aa, Homo Sapiens
GAHGYADFP

SEQ ID NO: 934666 - protein, 9 aa, Homo Sapiens
DNIQVITKP

SEQ ID NO: 934667 - protein, 9 aa, Homo Sapiens
LVAKQAVTG

SEQ ID NO: 934668 - protein, 9 aa, Homo Sapiens
SIRISFAKG

SEQ ID NO: 934669 - protein, 9 aa, Homo Sapiens
SEKSGTHVS

SEQ ID NO: 934670 - protein, 9 aa, Homo Sapiens
TGSGTASPM

SEQ ID NO: 934671 - protein, 9 aa, Homo Sapiens
QHRRIADIP

SEQ ID NO: 934672 - protein, 9 aa, Homo Sapiens
TLASELVRK

SEQ ID NO: 934673 - protein, 9 aa, Homo Sapiens
PRSCPDCTS

SEQ ID NO: 934674 - protein, 9 aa, Homo Sapiens
IYKSPINSF

SEQ ID NO: 934675 - protein, 9 aa, Homo Sapiens
TMNGSLVGW

SEQ ID NO: 934676 - protein, 9 aa, Homo Sapiens
PTLTAHQPN

SEQ ID NO: 934677 - protein, 9 aa, Homo Sapiens
VPSQYQVPG

SEQ ID NO: 934678 - protein, 9 aa, Homo Sapiens
GTYEDIVEG

SEQ ID NO: 934679 - protein, 9 aa, Homo Sapiens
KKKLTYAKE

SEQ ID NO: 934680 - protein, 9 aa, Homo Sapiens
YADFPSATP

SEQ ID NO: 934681 - protein, 9 aa, Homo Sapiens
WALEKQIDT

SEQ ID NO: 934682 - protein, 9 aa, Homo Sapiens
GSTGRHGLL

SEQ ID NO: 934683 - protein, 9 aa, Homo Sapiens
EKSGTHVSA

SEQ ID NO: 934684 - protein, 9 aa, Homo Sapiens
PINSFKNPN

SEQ ID NO: 934685 - protein, 9 aa, Homo Sapiens
HWALEKQID

SEQ ID NO: 934686 - protein, 9 aa, Homo Sapiens
SVLAYATMN

SEQ ID NO: 934687 - protein, 9 aa, Homo Sapiens
HCDYGNWTV

SEQ ID NO: 934688 - protein, 9 aa, Homo Sapiens
PSLLVLLPR

SEQ ID NO: 934689 - protein, 9 aa, Homo Sapiens
TGRHGLLGK

SEQ ID NO: 934690 - protein, 9 aa, Homo Sapiens
LPSLLVLLP

SEQ ID NO: 934691 - protein, 9 aa, Homo Sapiens
PIYKSPINS

SEQ ID NO: 934692 - protein, 9 aa, Homo Sapiens
PGAHGYADF

SEQ ID NO: 934693 - protein, 9 aa, Homo Sapiens
PQGDKSQSP

SEQ ID NO: 934694 - protein, 9 aa, Homo Sapiens
GSGTASPME

SEQ ID NO: 934695 - protein, 9 aa, Homo Sapiens
QHCDYGNWT

SEQ ID NO: 934696 - protein, 9 aa, Homo Sapiens
GGGFQFEGS

SEQ ID NO: 934697 - protein, 9 aa, Homo Sapiens
GTHVSAEEK

SEQ ID NO: 934698 - protein, 9 aa, Homo Sapiens
VLKLSYKGD

SEQ ID NO: 934699 - protein, 9 aa, Homo Sapiens
TNRMEAAGV

SEQ ID NO: 934700 - protein, 9 aa, Homo Sapiens
GPYDPNSIR

SEQ ID NO: 934701 - protein, 9 aa, Homo Sapiens
SMMIGIEGV

SEQ ID NO: 934702 - protein, 9 aa, Homo Sapiens
MAAAAVRSA

SEQ ID NO: 934703 - protein, 9 aa, Homo Sapiens
DYGNWTVKG

SEQ ID NO: 934704 - protein, 9 aa, Homo Sapiens
NILGPNDQY

SEQ ID NO: 934705 - protein, 9 aa, Homo Sapiens
IEGVLITIP

SEQ ID NO: 934706 - protein, 9 aa, Homo Sapiens
LNYQVLKLS

SEQ ID NO: 934707 - protein, 9 aa, Homo Sapiens
PEPWNILGP

SEQ ID NO: 934708 - protein, 9 aa, Homo Sapiens
RNRATLNWR

SEQ ID NO: 934709 - protein, 9 aa, Homo Sapiens
LLVAKQAVT

SEQ ID NO: 934710 - protein, 9 aa, Homo Sapiens
GGFQFEGSP

SEQ ID NO: 934711 - protein, 9 aa, Homo Sapiens
RASSRRARP

SEQ ID NO: 934712 - protein, 9 aa, Homo Sapiens
VEHRSLIKK

SEQ ID NO: 934713 - protein, 9 aa, Homo Sapiens
RSCPDCTSR

SEQ ID NO: 934714 - protein, 9 aa, Homo Sapiens
TLNWRPEAE

SEQ ID NO: 934715 - protein, 9 aa, Homo Sapiens
TGQVLHCDA

SEQ ID NO: 934716 - protein, 9 aa, Homo Sapiens
KTYLKLFKV

SEQ ID NO: 934717 - protein, 9 aa, Homo Sapiens
TDLEVQAGQ

SEQ ID NO: 934718 - protein, 9 aa, Homo Sapiens
LLLVLHEGT

SEQ ID NO: 934719 - protein, 9 aa, Homo Sapiens
DFPSATPAS

SEQ ID NO: 934720 - protein, 9 aa, Homo Sapiens
TLKTYLKLF

SEQ ID NO: 934721 - protein, 9 aa, Homo Sapiens
GTASPMEGT

SEQ ID NO: 934722 - protein, 9 aa, Homo Sapiens
QQNLSSSHW

SEQ ID NO: 934723 - protein, 9 aa, Homo Sapiens
VYLVVALPS

SEQ ID NO: 934724 - protein, 9 aa, Homo Sapiens
VRSAKRSLR

SEQ ID NO: 934725 - protein, 9 aa, Homo Sapiens
VAKQAVTGH

SEQ ID NO: 934726 - protein, 9 aa, Homo Sapiens
QLSTLASEL

SEQ ID NO: 934727 - protein, 9 aa, Homo Sapiens
GAMRHPLNA

SEQ ID NO: 934728 - protein, 9 aa, Homo Sapiens
LTNRMEAAG

SEQ ID NO: 934729 - protein, 9 aa, Homo Sapiens
GLSEKSGTH

SEQ ID NO: 934730 - protein, 9 aa, Homo Sapiens
VSLTNRMEA

SEQ ID NO: 934731 - protein, 9 aa, Homo Sapiens
SSRRARPED

SEQ ID NO: 934732 - protein, 9 aa, Homo Sapiens
RRARPEDLA

SEQ ID NO: 934733 - protein, 9 aa, Homo Sapiens
RSLIKKKLT

SEQ ID NO: 934734 - protein, 9 aa, Homo Sapiens
EPWNILGPN

SEQ ID NO: 934735 - protein, 9 aa, Homo Sapiens
SCPDCTSRV

SEQ ID NO: 934736 - protein, 9 aa, Homo Sapiens
VITKPAIRR

SEQ ID NO: 934737 - protein, 9 aa, Homo Sapiens
ILGPNDQYK

SEQ ID NO: 934738 - protein, 9 aa, Homo Sapiens
FQFEGSPGL

SEQ ID NO: 934739 - protein, 9 aa, Homo Sapiens
GYADFPSAT

SEQ ID NO: 934740 - protein, 9 aa, Homo Sapiens
LGQHRRIAD

SEQ ID NO: 934741 - protein, 9 aa, Homo Sapiens
PVPSQYQVP

SEQ ID NO: 934742 - protein, 9 aa, Homo Sapiens
AHQPNRVCN

SEQ ID NO: 934743 - protein, 9 aa, Homo Sapiens
NRATLNWRP

SEQ ID NO: 934744 - protein, 9 aa, Homo Sapiens
PPSTDLEVQ

SEQ ID NO: 934745 - protein, 9 aa, Homo Sapiens
AVRSAKRSL

SEQ ID NO: 934746 - protein, 9 aa, Homo Sapiens
AMRHPLNAL

SEQ ID NO: 934747 - protein, 9 aa, Homo Sapiens
CYCAPGAPD

SEQ ID NO: 934748 - protein, 9 aa, Homo Sapiens
CTSRVLCNF

SEQ ID NO: 934749 - protein, 9 aa, Homo Sapiens
YCAPGAPDP

SEQ ID NO: 934750 - protein, 9 aa, Homo Sapiens
RSEKDQNQF

SEQ ID NO: 934751 - protein, 9 aa, Homo Sapiens
LFGVYCYCA

SEQ ID NO: 934752 - protein, 9 aa, Homo Sapiens
HGYADFPSA

SEQ ID NO: 934753 - protein, 9 aa, Homo Sapiens
ASSRRARPE

SEQ ID NO: 934754 - protein, 9 aa, Homo Sapiens
DCTSRVLCN

SEQ ID NO: 934755 - protein, 9 aa, Homo Sapiens
LPPVPSQYQ

SEQ ID NO: 934756 - protein, 9 aa, Homo Sapiens
RQSAYLLGQ

SEQ ID NO: 934757 - protein, 9 aa, Homo Sapiens
VLHEGTILD

SEQ ID NO: 934758 - protein, 9 aa, Homo Sapiens
NLSSSHWAL

SEQ ID NO: 934759 - protein, 9 aa, Homo Sapiens
MEGTSAVEW

SEQ ID NO: 934760 - protein, 9 aa, Homo Sapiens
SLIKKKLTY

SEQ ID NO: 934761 - protein, 9 aa, Homo Sapiens
SEKDQNQFI

SEQ ID NO: 934762 - protein, 9 aa, Homo Sapiens
RATLNWRPE

SEQ ID NO: 934763 - protein, 9 aa, Homo Sapiens
DGPYDPNSI

SEQ ID NO: 934764 - protein, 9 aa, Homo Sapiens
AKQAVTGHH

SEQ ID NO: 934765 - protein, 9 aa, Homo Sapiens
DVSEVRSEK

SEQ ID NO: 934766 - protein, 9 aa, Homo Sapiens
IRNRATLNW

SEQ ID NO: 934767 - protein, 9 aa, Homo Sapiens
HTKDQPFKC

SEQ ID NO: 934768 - protein, 9 aa, Homo Sapiens
PSQYQVPGN

SEQ ID NO: 934769 - protein, 9 aa, Homo Sapiens
LLVLHEGTI

SEQ ID NO: 934770 - protein, 9 aa, Homo Sapiens
NWTVKGVLI

SEQ ID NO: 934771 - protein, 9 aa, Homo Sapiens
VWSHDVSLT

SEQ ID NO: 934772 - protein, 9 aa, Homo Sapiens
QQPLPPVPS

SEQ ID NO: 934773 - protein, 9 aa, Homo Sapiens
YKSPINSFK

SEQ ID NO: 934774 - protein, 9 aa, Homo Sapiens
ITTGQVLHC

SEQ ID NO: 934775 - protein, 9 aa, Homo Sapiens
HGLLGKKGE

SEQ ID NO: 934776 - protein, 9 aa, Homo Sapiens
NSIRISFAK

SEQ ID NO: 934777 - protein, 9 aa, Homo Sapiens
SKASRASSR

SEQ ID NO: 934778 - protein, 9 aa, Homo Sapiens
PPPQGDKSQ

SEQ ID NO: 934779 - protein, 9 aa, Homo Sapiens
LRDNIQVIT

SEQ ID NO: 934780 - protein, 9 aa, Homo Sapiens
QVLKLSYKG

SEQ ID NO: 934781 - protein, 9 aa, Homo Sapiens
QKRHQEIEQ

SEQ ID NO: 934782 - protein, 9 aa, Homo Sapiens
KASRASSRR

SEQ ID NO: 934783 - protein, 9 aa, Homo Sapiens
SHWALEKQI

SEQ ID NO: 934784 - protein, 9 aa, Homo Sapiens
AAAAVRSAK

SEQ ID NO: 934785 - protein, 9 aa, Homo Sapiens
LPSINYSIR

SEQ ID NO: 934786 - protein, 9 aa, Homo Sapiens
NNPEPWNIL

SEQ ID NO: 934787 - protein, 9 aa, Homo Sapiens
MIGIEGVLI

SEQ ID NO: 934788 - protein, 9 aa, Homo Sapiens
TKDQPFKCK

SEQ ID NO: 934789 - protein, 9 aa, Homo Sapiens
GQVLHCDAI

SEQ ID NO: 934790 - protein, 9 aa, Homo Sapiens
IVEGLRVFD

SEQ ID NO: 934791 - protein, 9 aa, Homo Sapiens
STGRHGLLG

SEQ ID NO: 934792 - protein, 9 aa, Homo Sapiens
VLAYATMNG

SEQ ID NO: 934793 - protein, 9 aa, Homo Sapiens
ATERQKRHQ

SEQ ID NO: 934794 - protein, 9 aa, Homo Sapiens
QSVLAYATM

SEQ ID NO: 934795 - protein, 9 aa, Homo Sapiens
DKSQSPRSP

SEQ ID NO: 934796 - protein, 9 aa, Homo Sapiens
SRASSRRAR

SEQ ID NO: 934797 - protein, 9 aa, Homo Sapiens
QLLVAKQAV

SEQ ID NO: 934798 - protein, 9 aa, Homo Sapiens
VLQLSTLAS

SEQ ID NO: 934799 - protein, 9 aa, Homo Sapiens
EGTILDTGA

SEQ ID NO: 934800 - protein, 9 aa, Homo Sapiens
PPTLTAHQP

SEQ ID NO: 934801 - protein, 9 aa, Homo Sapiens
NSFKNPNYG

SEQ ID NO: 934802 - protein, 9 aa, Homo Sapiens
LSTLASELV

SEQ ID NO: 934803 - protein, 9 aa, Homo Sapiens
GGAMRHPLN

SEQ ID NO: 934804 - protein, 9 aa, Homo Sapiens
THVSAEEKE

SEQ ID NO: 934805 - protein, 9 aa, Homo Sapiens
YLKLFKVMK

SEQ ID NO: 934806 - protein, 9 aa, Homo Sapiens
SAYLLGQHR

SEQ ID NO: 934807 - protein, 9 aa, Homo Sapiens
EQGTYEDIV

SEQ ID NO: 934808 - protein, 9 aa, Homo Sapiens
QPFKCKRCK

SEQ ID NO: 934809 - protein, 9 aa, Homo Sapiens
LHCDAIVDL

SEQ ID NO: 934810 - protein, 9 aa, Homo Sapiens
HEQLLVAKQ

SEQ ID NO: 934811 - protein, 9 aa, Homo Sapiens
YEDIVEGLR

SEQ ID NO: 934812 - protein, 9 aa, Homo Sapiens
SGTHVSAEE

SEQ ID NO: 934813 - protein, 9 aa, Homo Sapiens
DIVEGLRVF

SEQ ID NO: 934814 - protein, 9 aa, Homo Sapiens
FKCKRCKRG

SEQ ID NO: 934815 - protein, 9 aa, Homo Sapiens
RSMMIGIEG

SEQ ID NO: 934816 - protein, 9 aa, Homo Sapiens
PYDPNSIRI

SEQ ID NO: 934817 - protein, 9 aa, Homo Sapiens
SPMEGTSAV

SEQ ID NO: 934818 - protein, 9 aa, Homo Sapiens
LHEGTILDT

SEQ ID NO: 934819 - protein, 9 aa, Homo Sapiens
PPQGDKSQS

SEQ ID NO: 934820 - protein, 9 aa, Homo Sapiens
QNLSSSHWA

SEQ ID NO: 934821 - protein, 9 aa, Homo Sapiens
KHLNVWPQR

SEQ ID NO: 934822 - protein, 9 aa, Homo Sapiens
QRHFKIDAS

SEQ ID NO: 934823 - protein, 9 aa, Homo Sapiens
VWPQRHFKI

SEQ ID NO: 934824 - protein, 9 aa, Homo Sapiens
IQVITKPAI

SEQ ID NO: 934825 - protein, 9 aa, Homo Sapiens
QENHSRILS

SEQ ID NO: 934826 - protein, 9 aa, Homo Sapiens
IYFNRSNQN

SEQ ID NO: 934827 - protein, 9 aa, Homo Sapiens
NYKLKPSCV

SEQ ID NO: 934828 - protein, 9 aa, Homo Sapiens
CGCKGPLFQ

SEQ ID NO: 934829 - protein, 9 aa, Homo Sapiens
LEKVLVVVG

SEQ ID NO: 934830 - protein, 9 aa, Homo Sapiens
SLRSALRLL

SEQ ID NO: 934831 - protein, 9 aa, Homo Sapiens
RVIYLQDSA

SEQ ID NO: 934832 - protein, 9 aa, Homo Sapiens
VQLEQDEYA

SEQ ID NO: 934833 - protein, 9 aa, Homo Sapiens
LRIVQAIRA

SEQ ID NO: 934834 - protein, 9 aa, Homo Sapiens
SSQLDGEAR

SEQ ID NO: 934835 - protein, 9 aa, Homo Sapiens
SYLSDRAQH

SEQ ID NO: 934836 - protein, 9 aa, Homo Sapiens
SITRMLVMY

SEQ ID NO: 934837 - protein, 9 aa, Homo Sapiens
LAKLIKLPS

SEQ ID NO: 934838 - protein, 9 aa, Homo Sapiens
IISLYFQMQ

SEQ ID NO: 934839 - protein, 9 aa, Homo Sapiens
NSQSKFSIF

SEQ ID NO: 934840 - protein, 9 aa, Homo Sapiens
QSLFAILSF

SEQ ID NO: 934841 - protein, 9 aa, Homo Sapiens
NCNLIQIGG

SEQ ID NO: 934842 - protein, 9 aa, Homo Sapiens
SPEGPQSYE

SEQ ID NO: 934843 - protein, 9 aa, Homo Sapiens
VLRLKDEMF

SEQ ID NO: 934844 - protein, 9 aa, Homo Sapiens
RALGSASRP

SEQ ID NO: 934845 - protein, 9 aa, Homo Sapiens
EINFCCAEA

SEQ ID NO: 934846 - protein, 9 aa, Homo Sapiens
NDYCPNIFS

SEQ ID NO: 934847 - protein, 9 aa, Homo Sapiens
VLPTSLLLR

SEQ ID NO: 934848 - protein, 9 aa, Homo Sapiens
RRPGEPFNS

SEQ ID NO: 934849 - protein, 9 aa, Homo Sapiens
LPPPGKPQG

SEQ ID NO: 934850 - protein, 9 aa, Homo Sapiens
TSVHWFSVQ

SEQ ID NO: 934851 - protein, 9 aa, Homo Sapiens
STANTEQTV

SEQ ID NO: 934852 - protein, 9 aa, Homo Sapiens
NYSSYLAKV

SEQ ID NO: 934853 - protein, 9 aa, Homo Sapiens
KVQVGSTLQ

SEQ ID NO: 934854 - protein, 9 aa, Homo Sapiens
HGPDFPGPR

SEQ ID NO: 934855 - protein, 9 aa, Homo Sapiens
ESSNLFESP

SEQ ID NO: 934856 - protein, 9 aa, Homo Sapiens
AAAAATSGL

SEQ ID NO: 934857 - protein, 9 aa, Homo Sapiens
KDSLYGARH

SEQ ID NO: 934858 - protein, 9 aa, Homo Sapiens
SNMVEYKRT

SEQ ID NO: 934859 - protein, 9 aa, Homo Sapiens
FFVINFFSF

SEQ ID NO: 934860 - protein, 9 aa, Homo Sapiens
IRGLRSVGA

SEQ ID NO: 934861 - protein, 9 aa, Homo Sapiens
KEYRQEGPR

SEQ ID NO: 934862 - protein, 9 aa, Homo Sapiens
EAWWIGFLL

SEQ ID NO: 934863 - protein, 9 aa, Homo Sapiens
LRDEGPNGS

SEQ ID NO: 934864 - protein, 9 aa, Homo Sapiens
KRWIHSKYE

SEQ ID NO: 934865 - protein, 9 aa, Homo Sapiens
GSASRPHFR

SEQ ID NO: 934866 - protein, 9 aa, Homo Sapiens
PMAWGDSGV

SEQ ID NO: 934867 - protein, 9 aa, Homo Sapiens
RLIKKLRCY

SEQ ID NO: 934868 - protein, 9 aa, Homo Sapiens
FHMIVVSMT

SEQ ID NO: 934869 - protein, 9 aa, Homo Sapiens
VEQTPKLSM

SEQ ID NO: 934870 - protein, 9 aa, Homo Sapiens
LWNPEILIL

SEQ ID NO: 934871 - protein, 9 aa, Homo Sapiens
NLTGFQNLK

SEQ ID NO: 934872 - protein, 9 aa, Homo Sapiens
DALEIYKQF

SEQ ID NO: 934873 - protein, 9 aa, Homo Sapiens
LPSPSTSVQ

SEQ ID NO: 934874 - protein, 9 aa, Homo Sapiens
EDANFLFLE

SEQ ID NO: 934875 - protein, 9 aa, Homo Sapiens
LSLWAVPAI

SEQ ID NO: 934876 - protein, 9 aa, Homo Sapiens
IVHAVQGGI

SEQ ID NO: 934877 - protein, 9 aa, Homo Sapiens
VLLNKKDNH

SEQ ID NO: 934878 - protein, 9 aa, Homo Sapiens
NWVESNLDQ

SEQ ID NO: 934879 - protein, 9 aa, Homo Sapiens
IISAASPTI

SEQ ID NO: 934880 - protein, 9 aa, Homo Sapiens
PALACPDPS

SEQ ID NO: 934881 - protein, 9 aa, Homo Sapiens
AGGRSVFVS

SEQ ID NO: 934882 - protein, 9 aa, Homo Sapiens
LGSASRPHF

SEQ ID NO: 934883 - protein, 9 aa, Homo Sapiens
EVFAHGLHN

SEQ ID NO: 934884 - protein, 9 aa, Homo Sapiens
VHAGPIVVY

SEQ ID NO: 934885 - protein, 9 aa, Homo Sapiens
EGKNVTVEI

SEQ ID NO: 934886 - protein, 9 aa, Homo Sapiens
LCNLDQYFE

SEQ ID NO: 934887 - protein, 9 aa, Homo Sapiens
PSFFRALTE

SEQ ID NO: 934888 - protein, 9 aa, Homo Sapiens
FGGFKSKEC

SEQ ID NO: 934889 - protein, 9 aa, Homo Sapiens
SGHLSFCRF

SEQ ID NO: 934890 - protein, 9 aa, Homo Sapiens
QLQLKETQP

SEQ ID NO: 934891 - protein, 9 aa, Homo Sapiens
PLAALNIFG

SEQ ID NO: 934892 - protein, 9 aa, Homo Sapiens
LRILKIISL

SEQ ID NO: 934893 - protein, 9 aa, Homo Sapiens
MAWGDSGVY

SEQ ID NO: 934894 - protein, 9 aa, Homo Sapiens
KRTTLRDED

SEQ ID NO: 934895 - protein, 9 aa, Homo Sapiens
LRSSLTKLK

SEQ ID NO: 934896 - protein, 9 aa, Homo Sapiens
WSQEDANFL

SEQ ID NO: 934897 - protein, 9 aa, Homo Sapiens
HEILGWTTP

SEQ ID NO: 934898 - protein, 9 aa, Homo Sapiens
VQTEAFSKK

SEQ ID NO: 934899 - protein, 9 aa, Homo Sapiens
ETQSGQLVD

SEQ ID NO: 934900 - protein, 9 aa, Homo Sapiens
PCSSCLLCC

SEQ ID NO: 934901 - protein, 9 aa, Homo Sapiens
SMALPAAAP

SEQ ID NO: 934902 - protein, 9 aa, Homo Sapiens
PLRIVQAIR

SEQ ID NO: 934903 - protein, 9 aa, Homo Sapiens
SLKQVQLEQ

SEQ ID NO: 934904 - protein, 9 aa, Homo Sapiens
NFQENYAGI

SEQ ID NO: 934905 - protein, 9 aa, Homo Sapiens
KGIVLLLLQ

SEQ ID NO: 934906 - protein, 9 aa, Homo Sapiens
SCVKTTANE

SEQ ID NO: 934907 - protein, 9 aa, Homo Sapiens
RWLRSPVPQ

SEQ ID NO: 934908 - protein, 9 aa, Homo Sapiens
YLSDRAQHQ

SEQ ID NO: 934909 - protein, 9 aa, Homo Sapiens
YVKCPTLCQ

SEQ ID NO: 934910 - protein, 9 aa, Homo Sapiens
TGFQNLKIL

SEQ ID NO: 934911 - protein, 9 aa, Homo Sapiens
TAADTHILV

SEQ ID NO: 934912 - protein, 9 aa, Homo Sapiens
SVTALSCWL

SEQ ID NO: 934913 - protein, 9 aa, Homo Sapiens
EFFWPDQNL

SEQ ID NO: 934914 - protein, 9 aa, Homo Sapiens
QNVHEERMK

SEQ ID NO: 934915 - protein, 9 aa, Homo Sapiens
LSFCRFRLR

SEQ ID NO: 934916 - protein, 9 aa, Homo Sapiens
QADARTVLG

SEQ ID NO: 934917 - protein, 9 aa, Homo Sapiens
AVHKYKCTA

SEQ ID NO: 934918 - protein, 9 aa, Homo Sapiens
YEIFTPDQH

SEQ ID NO: 934919 - protein, 9 aa, Homo Sapiens
SVPSRFRRG

SEQ ID NO: 934920 - protein, 9 aa, Homo Sapiens
QSLKEISAE

SEQ ID NO: 934921 - protein, 9 aa, Homo Sapiens
CVKTTANEA

SEQ ID NO: 934922 - protein, 9 aa, Homo Sapiens
VRTPGGCVK

SEQ ID NO: 934923 - protein, 9 aa, Homo Sapiens
DPLESSRNF

SEQ ID NO: 934924 - protein, 9 aa, Homo Sapiens
AMKCSYCDF

SEQ ID NO: 934925 - protein, 9 aa, Homo Sapiens
VSLPELEDR

SEQ ID NO: 934926 - protein, 9 aa, Homo Sapiens
EIKLEDVEC

SEQ ID NO: 934927 - protein, 9 aa, Homo Sapiens
KDEMFSLSL

SEQ ID NO: 934928 - protein, 9 aa, Homo Sapiens
HRAPVRGGD

SEQ ID NO: 934929 - protein, 9 aa, Homo Sapiens
MAWQVSLPE

SEQ ID NO: 934930 - protein, 9 aa, Homo Sapiens
AKHENKKMK

SEQ ID NO: 934931 - protein, 9 aa, Homo Sapiens
IGFSTFLGL

SEQ ID NO: 934932 - protein, 9 aa, Homo Sapiens
KVVHEQLAA

SEQ ID NO: 934933 - protein, 9 aa, Homo Sapiens
LSHTDVLLY

SEQ ID NO: 934934 - protein, 9 aa, Homo Sapiens
HGDICNMCG

SEQ ID NO: 934935 - protein, 9 aa, Homo Sapiens
RAMKCSYCD

SEQ ID NO: 934936 - protein, 9 aa, Homo Sapiens
NREAGIPFN

SEQ ID NO: 934937 - protein, 9 aa, Homo Sapiens
EYKRTTLRD

SEQ ID NO: 934938 - protein, 9 aa, Homo Sapiens
YTGEKPYEC

SEQ ID NO: 934939 - protein, 9 aa, Homo Sapiens
AQQQGETPA

SEQ ID NO: 934940 - protein, 9 aa, Homo Sapiens
QVLRNPPFA

SEQ ID NO: 934941 - protein, 9 aa, Homo Sapiens
KVMYLLVPF

SEQ ID NO: 934942 - protein, 9 aa, Homo Sapiens
AKKLLSAVL

SEQ ID NO: 934943 - protein, 9 aa, Homo Sapiens
LKIISLNQG

SEQ ID NO: 934944 - protein, 9 aa, Homo Sapiens
EKAKGMFCV

SEQ ID NO: 934945 - protein, 9 aa, Homo Sapiens
DEFWTEETY

SEQ ID NO: 934946 - protein, 9 aa, Homo Sapiens
SPHYVISLK

SEQ ID NO: 934947 - protein, 9 aa, Homo Sapiens
VDRDHVILQ

SEQ ID NO: 934948 - protein, 9 aa, Homo Sapiens
LAGEPADLS

SEQ ID NO: 934949 - protein, 9 aa, Homo Sapiens
MLEAKKLLS

SEQ ID NO: 934950 - protein, 9 aa, Homo Sapiens
LLDHGASLF

SEQ ID NO: 934951 - protein, 9 aa, Homo Sapiens
LSALRSPAD

SEQ ID NO: 934952 - protein, 9 aa, Homo Sapiens
LLKLSCVKT

SEQ ID NO: 934953 - protein, 9 aa, Homo Sapiens
DICNMCGLQ

SEQ ID NO: 934954 - protein, 9 aa, Homo Sapiens
LIKKLRCYL

SEQ ID NO: 934955 - protein, 9 aa, Homo Sapiens
ELRRGFDWS

SEQ ID NO: 934956 - protein, 9 aa, Homo Sapiens
EVKDALCRT

SEQ ID NO: 934957 - protein, 9 aa, Homo Sapiens
GDCLSPFHR

SEQ ID NO: 934958 - protein, 9 aa, Homo Sapiens
AQQIYGTEI

SEQ ID NO: 934959 - protein, 9 aa, Homo Sapiens
KKKKMFLHV

SEQ ID NO: 934960 - protein, 9 aa, Homo Sapiens
LCNTIESGI

SEQ ID NO: 934961 - protein, 9 aa, Homo Sapiens
FLSYSSKKK

SEQ ID NO: 934962 - protein, 9 aa, Homo Sapiens
ELLLVMTAP

SEQ ID NO: 934963 - protein, 9 aa, Homo Sapiens
FIPIHICLA

SEQ ID NO: 934964 - protein, 9 aa, Homo Sapiens
DQRAPGIEK

SEQ ID NO: 934965 - protein, 9 aa, Homo Sapiens
KLASVTALS

SEQ ID NO: 934966 - protein, 9 aa, Homo Sapiens
VLDQVGTFI

SEQ ID NO: 934967 - protein, 9 aa, Homo Sapiens
PDELFLRSQ

SEQ ID NO: 934968 - protein, 9 aa, Homo Sapiens
LPEAVAAGH

SEQ ID NO: 934969 - protein, 9 aa, Homo Sapiens
QQKLASVTA

SEQ ID NO: 934970 - protein, 9 aa, Homo Sapiens
RETKCYVKS

SEQ ID NO: 934971 - protein, 9 aa, Homo Sapiens
SNSFGSTSG

SEQ ID NO: 934972 - protein, 9 aa, Homo Sapiens
SSLTKLKGP

SEQ ID NO: 934973 - protein, 9 aa, Homo Sapiens
LLDCKGSWK

SEQ ID NO: 934974 - protein, 9 aa, Homo Sapiens
NVFQGMNNE

SEQ ID NO: 934975 - protein, 9 aa, Homo Sapiens
LQNPLENLK

SEQ ID NO: 934976 - protein, 9 aa, Homo Sapiens
QPVTIHEIL

SEQ ID NO: 934977 - protein, 9 aa, Homo Sapiens
LLHPLTGPR

SEQ ID NO: 934978 - protein, 9 aa, Homo Sapiens
HLELGSDRK

SEQ ID NO: 934979 - protein, 9 aa, Homo Sapiens
DDPRWLEAW

SEQ ID NO: 934980 - protein, 9 aa, Homo Sapiens
QEDANFLFL

SEQ ID NO: 934981 - protein, 9 aa, Homo Sapiens
FVGKESISL

SEQ ID NO: 934982 - protein, 9 aa, Homo Sapiens
QTENQKVGW

SEQ ID NO: 934983 - protein, 9 aa, Homo Sapiens
LKGDHSDAP

SEQ ID NO: 934984 - protein, 9 aa, Homo Sapiens
VPFLNRGND

SEQ ID NO: 934985 - protein, 9 aa, Homo Sapiens
KLASEFVYV

SEQ ID NO: 934986 - protein, 9 aa, Homo Sapiens
HLEEILALV

SEQ ID NO: 934987 - protein, 9 aa, Homo Sapiens
GVLFAASLE

SEQ ID NO: 934988 - protein, 9 aa, Homo Sapiens
LKLSCVKTT

SEQ ID NO: 934989 - protein, 9 aa, Homo Sapiens
DKVGVQNFV

SEQ ID NO: 934990 - protein, 9 aa, Homo Sapiens
RQEGPRGPH

SEQ ID NO: 934991 - protein, 9 aa, Homo Sapiens
HLQSYVIYF

SEQ ID NO: 934992 - protein, 9 aa, Homo Sapiens
GRDFYEENP

SEQ ID NO: 934993 - protein, 9 aa, Homo Sapiens
IDARIFYEL

SEQ ID NO: 934994 - protein, 9 aa, Homo Sapiens
YVSSTTGER

SEQ ID NO: 934995 - protein, 9 aa, Homo Sapiens
SGQLVDATA

SEQ ID NO: 934996 - protein, 9 aa, Homo Sapiens
CTFHMIVVS

SEQ ID NO: 934997 - protein, 9 aa, Homo Sapiens
NLPENLGYY

SEQ ID NO: 934998 - protein, 9 aa, Homo Sapiens
CGGYCGCGT

SEQ ID NO: 934999 - protein, 9 aa, Homo Sapiens
ESTTEEIKL

SEQ ID NO: 935000 - protein, 9 aa, Homo Sapiens
LASEFVYVV

SEQ ID NO: 935001 - protein, 9 aa, Homo Sapiens
KGMFCVGLR

SEQ ID NO: 935002 - protein, 9 aa, Homo Sapiens
TIVNHILNS

SEQ ID NO: 935003 - protein, 9 aa, Homo Sapiens
KPDPARPVP

SEQ ID NO: 935004 - protein, 9 aa, Homo Sapiens
NQMEKDKVK

SEQ ID NO: 935005 - protein, 9 aa, Homo Sapiens
DGSATSGEN

SEQ ID NO: 935006 - protein, 9 aa, Homo Sapiens
QEISHDACF

SEQ ID NO: 935007 - protein, 9 aa, Homo Sapiens
VAPNQPGLG

SEQ ID NO: 935008 - protein, 9 aa, Homo Sapiens
PMLQDFPLD

SEQ ID NO: 935009 - protein, 9 aa, Homo Sapiens
QPQKRSQAA

SEQ ID NO: 935010 - protein, 9 aa, Homo Sapiens
IYTLKNAQI

SEQ ID NO: 935011 - protein, 9 aa, Homo Sapiens
WINPSPQPQ

SEQ ID NO: 935012 - protein, 9 aa, Homo Sapiens
VPYEMAVVV

SEQ ID NO: 935013 - protein, 9 aa, Homo Sapiens
RNWVKIYFN

SEQ ID NO: 935014 - protein, 9 aa, Homo Sapiens
KMRAIQVEE

SEQ ID NO: 935015 - protein, 9 aa, Homo Sapiens
VLLDKENKE

SEQ ID NO: 935016 - protein, 9 aa, Homo Sapiens
VSNISITRM

SEQ ID NO: 935017 - protein, 9 aa, Homo Sapiens
EAMIVLGRY

SEQ ID NO: 935018 - protein, 9 aa, Homo Sapiens
YGTEIDMKV

SEQ ID NO: 935019 - protein, 9 aa, Homo Sapiens
KKSENIAFL

SEQ ID NO: 935020 - protein, 9 aa, Homo Sapiens
REDVPAHLM

SEQ ID NO: 935021 - protein, 9 aa, Homo Sapiens
ELGNEVPEK

SEQ ID NO: 935022 - protein, 9 aa, Homo Sapiens
AAIDARIFY

SEQ ID NO: 935023 - protein, 9 aa, Homo Sapiens
EKKRWIHSK

SEQ ID NO: 935024 - protein, 9 aa, Homo Sapiens
QSQAKDSDL

SEQ ID NO: 935025 - protein, 9 aa, Homo Sapiens
AVLVYNGII

SEQ ID NO: 935026 - protein, 9 aa, Homo Sapiens
GEDFVNIPE

SEQ ID NO: 935027 - protein, 9 aa, Homo Sapiens
MATSWQSVF

SEQ ID NO: 935028 - protein, 9 aa, Homo Sapiens
LQDSALKDQ

SEQ ID NO: 935029 - protein, 9 aa, Homo Sapiens
TPLHYLERI

SEQ ID NO: 935030 - protein, 9 aa, Homo Sapiens
ICLAWEFFS

SEQ ID NO: 935031 - protein, 9 aa, Homo Sapiens
AENIYITDN

SEQ ID NO: 935032 - protein, 9 aa, Homo Sapiens
PIILIGRSD

SEQ ID NO: 935033 - protein, 9 aa, Homo Sapiens
ARYSSQLDG

SEQ ID NO: 935034 - protein, 9 aa, Homo Sapiens
ENSNSTANT

SEQ ID NO: 935035 - protein, 9 aa, Homo Sapiens
GLSHTDVLL

SEQ ID NO: 935036 - protein, 9 aa, Homo Sapiens
IQKCDFSIM

SEQ ID NO: 935037 - protein, 9 aa, Homo Sapiens
NLTSQYVKL

SEQ ID NO: 935038 - protein, 9 aa, Homo Sapiens
PVRYQVLRN

SEQ ID NO: 935039 - protein, 9 aa, Homo Sapiens
RQVLSGHLS

SEQ ID NO: 935040 - protein, 9 aa, Homo Sapiens
STTGERVIT

SEQ ID NO: 935041 - protein, 9 aa, Homo Sapiens
GVFQMALED

SEQ ID NO: 935042 - protein, 9 aa, Homo Sapiens
NSNSTANTE

SEQ ID NO: 935043 - protein, 9 aa, Homo Sapiens
FGEKKLCTH

SEQ ID NO: 935044 - protein, 9 aa, Homo Sapiens
IHEILGWTT

SEQ ID NO: 935045 - protein, 9 aa, Homo Sapiens
KDKQLEDGY

SEQ ID NO: 935046 - protein, 9 aa, Homo Sapiens
LDCWVSINH

SEQ ID NO: 935047 - protein, 9 aa, Homo Sapiens
GFHGCIYEV

SEQ ID NO: 935048 - protein, 9 aa, Homo Sapiens
CPNIFSERR

SEQ ID NO: 935049 - protein, 9 aa, Homo Sapiens
QVRAHASRG

SEQ ID NO: 935050 - protein, 9 aa, Homo Sapiens
ENYHPVSEE

SEQ ID NO: 935051 - protein, 9 aa, Homo Sapiens
FECSPSLPR

SEQ ID NO: 935052 - protein, 9 aa, Homo Sapiens
NETSGSKVL

SEQ ID NO: 935053 - protein, 9 aa, Homo Sapiens
LFMDLDVVM

SEQ ID NO: 935054 - protein, 9 aa, Homo Sapiens
LSFYVSVSA

SEQ ID NO: 935055 - protein, 9 aa, Homo Sapiens
SKETKDKQL

SEQ ID NO: 935056 - protein, 9 aa, Homo Sapiens
TGITIGEKE

SEQ ID NO: 935057 - protein, 9 aa, Homo Sapiens
SIQLQLKET

SEQ ID NO: 935058 - protein, 9 aa, Homo Sapiens
AESLCSPLD

SEQ ID NO: 935059 - protein, 9 aa, Homo Sapiens
RPYSFVPAG

SEQ ID NO: 935060 - protein, 9 aa, Homo Sapiens
ICDHRWNLI

SEQ ID NO: 935061 - protein, 9 aa, Homo Sapiens
KCSYCDFYF

SEQ ID NO: 935062 - protein, 9 aa, Homo Sapiens
FESFFGEKK

SEQ ID NO: 935063 - protein, 9 aa, Homo Sapiens
SVFVKWDPP

SEQ ID NO: 935064 - protein, 9 aa, Homo Sapiens
LNHFIGFST

SEQ ID NO: 935065 - protein, 9 aa, Homo Sapiens
ERLEGSQGG

SEQ ID NO: 935066 - protein, 9 aa, Homo Sapiens
QRDRSSSAS

SEQ ID NO: 935067 - protein, 9 aa, Homo Sapiens
LFDSLPGTE

SEQ ID NO: 935068 - protein, 9 aa, Homo Sapiens
FNGVKVLPV

SEQ ID NO: 935069 - protein, 9 aa, Homo Sapiens
ASFFFSSAL

SEQ ID NO: 935070 - protein, 9 aa, Homo Sapiens
AWGDSGVYQ

SEQ ID NO: 935071 - protein, 9 aa, Homo Sapiens
ILLDLYDNQ

SEQ ID NO: 935072 - protein, 9 aa, Homo Sapiens
MRLLNRFYR

SEQ ID NO: 935073 - protein, 9 aa, Homo Sapiens
VGTFIEELI

SEQ ID NO: 935074 - protein, 9 aa, Homo Sapiens
NIQEKGPMD

SEQ ID NO: 935075 - protein, 9 aa, Homo Sapiens
SSLSALRSP

SEQ ID NO: 935076 - protein, 9 aa, Homo Sapiens
TSWQSVFVK

SEQ ID NO: 935077 - protein, 9 aa, Homo Sapiens
RILKIISLN

SEQ ID NO: 935078 - protein, 9 aa, Homo Sapiens
VNIPENFFG

SEQ ID NO: 935079 - protein, 9 aa, Homo Sapiens
GLVTWLVLS

SEQ ID NO: 935080 - protein, 9 aa, Homo Sapiens
SLLSFISLP

SEQ ID NO: 935081 - protein, 9 aa, Homo Sapiens
DFYEENPDF

SEQ ID NO: 935082 - protein, 9 aa, Homo Sapiens
RSEHVQESD

SEQ ID NO: 935083 - protein, 9 aa, Homo Sapiens
VLQSLFAIL

SEQ ID NO: 935084 - protein, 9 aa, Homo Sapiens
IVIARALVR

SEQ ID NO: 935085 - protein, 9 aa, Homo Sapiens
RSTLSLSPE

SEQ ID NO: 935086 - protein, 9 aa, Homo Sapiens
FYVSVSARS

SEQ ID NO: 935087 - protein, 9 aa, Homo Sapiens
RGSEAGEKP

SEQ ID NO: 935088 - protein, 9 aa, Homo Sapiens
QKQLFMDLD

SEQ ID NO: 935089 - protein, 9 aa, Homo Sapiens
EDFVNIPEN

SEQ ID NO: 935090 - protein, 9 aa, Homo Sapiens
LILLDLYDN

SEQ ID NO: 935091 - protein, 9 aa, Homo Sapiens
AVRKYFQKI

SEQ ID NO: 935092 - protein, 9 aa, Homo Sapiens
NLTLCFSYK

SEQ ID NO: 935093 - protein, 9 aa, Homo Sapiens
GNQPQGPLP

SEQ ID NO: 935094 - protein, 9 aa, Homo Sapiens
SSMALPAAA

SEQ ID NO: 935095 - protein, 9 aa, Homo Sapiens
DGDKEDELV

SEQ ID NO: 935096 - protein, 9 aa, Homo Sapiens
WFEKAKGMF

SEQ ID NO: 935097 - protein, 9 aa, Homo Sapiens
SFCRFRLRY

SEQ ID NO: 935098 - protein, 9 aa, Homo Sapiens
ASLEKTEET

SEQ ID NO: 935099 - protein, 9 aa, Homo Sapiens
RRKRMDQIT

SEQ ID NO: 935100 - protein, 9 aa, Homo Sapiens
QSYSTIVNH

SEQ ID NO: 935101 - protein, 9 aa, Homo Sapiens
HVQESDGER

SEQ ID NO: 935102 - protein, 9 aa, Homo Sapiens
GPEEISLSL

SEQ ID NO: 935103 - protein, 9 aa, Homo Sapiens
TACFAHGSE

SEQ ID NO: 935104 - protein, 9 aa, Homo Sapiens
NMVEYKRTT

SEQ ID NO: 935105 - protein, 9 aa, Homo Sapiens
DGEAMIVLG

SEQ ID NO: 935106 - protein, 9 aa, Homo Sapiens
PRWLEAWWI

SEQ ID NO: 935107 - protein, 9 aa, Homo Sapiens
AAEAERLEG

SEQ ID NO: 935108 - protein, 9 aa, Homo Sapiens
EKYGESRHS

SEQ ID NO: 935109 - protein, 9 aa, Homo Sapiens
ALACPDPSL

SEQ ID NO: 935110 - protein, 9 aa, Homo Sapiens
VHAVQGGIF

SEQ ID NO: 935111 - protein, 9 aa, Homo Sapiens
IILLIRTNS

SEQ ID NO: 935112 - protein, 9 aa, Homo Sapiens
PCGDSPSFP

SEQ ID NO: 935113 - protein, 9 aa, Homo Sapiens
LIGRSDTGK

SEQ ID NO: 935114 - protein, 9 aa, Homo Sapiens
SLLKRFLLH

SEQ ID NO: 935115 - protein, 9 aa, Homo Sapiens
PSSSFLSSS

SEQ ID NO: 935116 - protein, 9 aa, Homo Sapiens
SATSGENYH

SEQ ID NO: 935117 - protein, 9 aa, Homo Sapiens
AQGCHSKPD

SEQ ID NO: 935118 - protein, 9 aa, Homo Sapiens
SPTQKRLTT

SEQ ID NO: 935119 - protein, 9 aa, Homo Sapiens
NANANAVHK

SEQ ID NO: 935120 - protein, 9 aa, Homo Sapiens
KVLTSVSDP

SEQ ID NO: 935121 - protein, 9 aa, Homo Sapiens
GMLYVMILR

SEQ ID NO: 935122 - protein, 9 aa, Homo Sapiens
PKLSMDGLF

SEQ ID NO: 935123 - protein, 9 aa, Homo Sapiens
MKNNQPQPS

SEQ ID NO: 935124 - protein, 9 aa, Homo Sapiens
EQVRAHASR

SEQ ID NO: 935125 - protein, 9 aa, Homo Sapiens
LKVQVGSTL

SEQ ID NO: 935126 - protein, 9 aa, Homo Sapiens
MLAIMKFIY

SEQ ID NO: 935127 - protein, 9 aa, Homo Sapiens
TIRNTKMAV

SEQ ID NO: 935128 - protein, 9 aa, Homo Sapiens
KEQKQLFMD

SEQ ID NO: 935129 - protein, 9 aa, Homo Sapiens
VKMDTRAAA

SEQ ID NO: 935130 - protein, 9 aa, Homo Sapiens
DLSKRFEIQ

SEQ ID NO: 935131 - protein, 9 aa, Homo Sapiens
TKMAVGIVI

SEQ ID NO: 935132 - protein, 9 aa, Homo Sapiens
PNVIKGNRD

SEQ ID NO: 935133 - protein, 9 aa, Homo Sapiens
GFRVGTVWE

SEQ ID NO: 935134 - protein, 9 aa, Homo Sapiens
SNYKLKPSC

SEQ ID NO: 935135 - protein, 9 aa, Homo Sapiens
KKLASEFVY

SEQ ID NO: 935136 - protein, 9 aa, Homo Sapiens
ELREINFCC

SEQ ID NO: 935137 - protein, 9 aa, Homo Sapiens
HSHNGSGDD

SEQ ID NO: 935138 - protein, 9 aa, Homo Sapiens
IPSFFRALT

SEQ ID NO: 935139 - protein, 9 aa, Homo Sapiens
GKLCHGLYE

SEQ ID NO: 935140 - protein, 9 aa, Homo Sapiens
GSATSGENY

SEQ ID NO: 935141 - protein, 9 aa, Homo Sapiens
CLAWEFFSK

SEQ ID NO: 935142 - protein, 9 aa, Homo Sapiens
RLSEHITKF

SEQ ID NO: 935143 - protein, 9 aa, Homo Sapiens
IVRVPSKFV

SEQ ID NO: 935144 - protein, 9 aa, Homo Sapiens
PDFPGPRGP

SEQ ID NO: 935145 - protein, 9 aa, Homo Sapiens
ISAASPTII

SEQ ID NO: 935146 - protein, 9 aa, Homo Sapiens
AHLHREQHS

SEQ ID NO: 935147 - protein, 9 aa, Homo Sapiens
VRVPSKFVV

SEQ ID NO: 935148 - protein, 9 aa, Homo Sapiens
PGLGQPGRA

SEQ ID NO: 935149 - protein, 9 aa, Homo Sapiens
AKGDRGFDE

SEQ ID NO: 935150 - protein, 9 aa, Homo Sapiens
ASAGAGQQA

SEQ ID NO: 935151 - protein, 9 aa, Homo Sapiens
VTQRNCNLI

SEQ ID NO: 935152 - protein, 9 aa, Homo Sapiens
SWREGFIHS

SEQ ID NO: 935153 - protein, 9 aa, Homo Sapiens
YTGEKPYVC

SEQ ID NO: 935154 - protein, 9 aa, Homo Sapiens
RKKRVVYNA

SEQ ID NO: 935155 - protein, 9 aa, Homo Sapiens
GYPVMIKVV

SEQ ID NO: 935156 - protein, 9 aa, Homo Sapiens
REVQGALHR

SEQ ID NO: 935157 - protein, 9 aa, Homo Sapiens
SILITACFA

SEQ ID NO: 935158 - protein, 9 aa, Homo Sapiens
HRTNLNEKY

SEQ ID NO: 935159 - protein, 9 aa, Homo Sapiens
SVQDTAYLY

SEQ ID NO: 935160 - protein, 9 aa, Homo Sapiens
FYELTQTDK

SEQ ID NO: 935161 - protein, 9 aa, Homo Sapiens
CRKEVNKCD

SEQ ID NO: 935162 - protein, 9 aa, Homo Sapiens
ENIAFLGES

SEQ ID NO: 935163 - protein, 9 aa, Homo Sapiens
GCHSKPDPA

SEQ ID NO: 935164 - protein, 9 aa, Homo Sapiens
PTSVIEHQL

SEQ ID NO: 935165 - protein, 9 aa, Homo Sapiens
IFFVINFFS

SEQ ID NO: 935166 - protein, 9 aa, Homo Sapiens
NRDRPLNDN

SEQ ID NO: 935167 - protein, 9 aa, Homo Sapiens
GLLDCKGSW

SEQ ID NO: 935168 - protein, 9 aa, Homo Sapiens
PDPSLCLSD

SEQ ID NO: 935169 - protein, 9 aa, Homo Sapiens
ENKEMLFNR

SEQ ID NO: 935170 - protein, 9 aa, Homo Sapiens
NVHEERMKN

SEQ ID NO: 935171 - protein, 9 aa, Homo Sapiens
TRPQYSSPS

SEQ ID NO: 935172 - protein, 9 aa, Homo Sapiens
LSMDGLFLI

SEQ ID NO: 935173 - protein, 9 aa, Homo Sapiens
NTTSNSFGS

SEQ ID NO: 935174 - protein, 9 aa, Homo Sapiens
ALHRAPVRG

SEQ ID NO: 935175 - protein, 9 aa, Homo Sapiens
QEQLKVVHE

SEQ ID NO: 935176 - protein, 9 aa, Homo Sapiens
DQIPNTPVP

SEQ ID NO: 935177 - protein, 9 aa, Homo Sapiens
QGGKKDKMP

SEQ ID NO: 935178 - protein, 9 aa, Homo Sapiens
KIWKQSKKF

SEQ ID NO: 935179 - protein, 9 aa, Homo Sapiens
SIDYDECNI

SEQ ID NO: 935180 - protein, 9 aa, Homo Sapiens
ANANAVHKY

SEQ ID NO: 935181 - protein, 9 aa, Homo Sapiens
PTQKRLTTY

SEQ ID NO: 935182 - protein, 9 aa, Homo Sapiens
QSYVIYFLG

SEQ ID NO: 935183 - protein, 9 aa, Homo Sapiens
QKCDFSIMK

SEQ ID NO: 935184 - protein, 9 aa, Homo Sapiens
ILAGEPADL

SEQ ID NO: 935185 - protein, 9 aa, Homo Sapiens
VHQRIYTGE

SEQ ID NO: 935186 - protein, 9 aa, Homo Sapiens
SQMVTEGRS

SEQ ID NO: 935187 - protein, 9 aa, Homo Sapiens
DVGNDTKAV

SEQ ID NO: 935188 - protein, 9 aa, Homo Sapiens
RARAECSAC

SEQ ID NO: 935189 - protein, 9 aa, Homo Sapiens
QLKGATQVV

SEQ ID NO: 935190 - protein, 9 aa, Homo Sapiens
YKNFLEQER

SEQ ID NO: 935191 - protein, 9 aa, Homo Sapiens
HFKSCHYNI

SEQ ID NO: 935192 - protein, 9 aa, Homo Sapiens
EQKQLFMDL

SEQ ID NO: 935193 - protein, 9 aa, Homo Sapiens
ERIYTGEKP

SEQ ID NO: 935194 - protein, 9 aa, Homo Sapiens
YDNFLDEFM

SEQ ID NO: 935195 - protein, 9 aa, Homo Sapiens
ALGSASRPH

SEQ ID NO: 935196 - protein, 9 aa, Homo Sapiens
LGPLLCQED

SEQ ID NO: 935197 - protein, 9 aa, Homo Sapiens
LAVPRLLNR

SEQ ID NO: 935198 - protein, 9 aa, Homo Sapiens
KVPSRFANH

SEQ ID NO: 935199 - protein, 9 aa, Homo Sapiens
LSENFGSVR

SEQ ID NO: 935200 - protein, 9 aa, Homo Sapiens
ALFLAKLIK

SEQ ID NO: 935201 - protein, 9 aa, Homo Sapiens
YFFFTHLSF

SEQ ID NO: 935202 - protein, 9 aa, Homo Sapiens
SPPTGTASS

SEQ ID NO: 935203 - protein, 9 aa, Homo Sapiens
LHNPGRCAV

SEQ ID NO: 935204 - protein, 9 aa, Homo Sapiens
AQGFRVGTV

SEQ ID NO: 935205 - protein, 9 aa, Homo Sapiens
ERKPFSSGP

SEQ ID NO: 935206 - protein, 9 aa, Homo Sapiens
EEMLAIMKF

SEQ ID NO: 935207 - protein, 9 aa, Homo Sapiens
QLDLRDQEL

SEQ ID NO: 935208 - protein, 9 aa, Homo Sapiens
TQTENQKVG

SEQ ID NO: 935209 - protein, 9 aa, Homo Sapiens
GIAGSPRSQ

SEQ ID NO: 935210 - protein, 9 aa, Homo Sapiens
QLECPFSVF

SEQ ID NO: 935211 - protein, 9 aa, Homo Sapiens
DYCPNIFSE

SEQ ID NO: 935212 - protein, 9 aa, Homo Sapiens
LLLVVPNII

SEQ ID NO: 935213 - protein, 9 aa, Homo Sapiens
GDYNDSAFM

SEQ ID NO: 935214 - protein, 9 aa, Homo Sapiens
SQAAFSHTQ

SEQ ID NO: 935215 - protein, 9 aa, Homo Sapiens
LSSPTQKRL

SEQ ID NO: 935216 - protein, 9 aa, Homo Sapiens
FSFGFGLVT

SEQ ID NO: 935217 - protein, 9 aa, Homo Sapiens
DEVLDQVGT

SEQ ID NO: 935218 - protein, 9 aa, Homo Sapiens
EERMKNNQP

SEQ ID NO: 935219 - protein, 9 aa, Homo Sapiens
LCQTYVKCP

SEQ ID NO: 935220 - protein, 9 aa, Homo Sapiens
LFCGQRGRF

SEQ ID NO: 935221 - protein, 9 aa, Homo Sapiens
NICFDTFKL

SEQ ID NO: 935222 - protein, 9 aa, Homo Sapiens
RNTLASVFR

SEQ ID NO: 935223 - protein, 9 aa, Homo Sapiens
FLSSSSPLS

SEQ ID NO: 935224 - protein, 9 aa, Homo Sapiens
SESKSFRAA

SEQ ID NO: 935225 - protein, 9 aa, Homo Sapiens
QSGQLVDAT

SEQ ID NO: 935226 - protein, 9 aa, Homo Sapiens
ETSGSKVLT

SEQ ID NO: 935227 - protein, 9 aa, Homo Sapiens
KILNFRNGS

SEQ ID NO: 935228 - protein, 9 aa, Homo Sapiens
HDLFTPLHY

SEQ ID NO: 935229 - protein, 9 aa, Homo Sapiens
PQTTPSLQG

SEQ ID NO: 935230 - protein, 9 aa, Homo Sapiens
MHMGDQIPN

SEQ ID NO: 935231 - protein, 9 aa, Homo Sapiens
LINKSETTV

SEQ ID NO: 935232 - protein, 9 aa, Homo Sapiens
PPELREINF

SEQ ID NO: 935233 - protein, 9 aa, Homo Sapiens
DKMPTTSRV

SEQ ID NO: 935234 - protein, 9 aa, Homo Sapiens
LLRNVQLDM

SEQ ID NO: 935235 - protein, 9 aa, Homo Sapiens
SDRAQHQAF

SEQ ID NO: 935236 - protein, 9 aa, Homo Sapiens
LPELEDRLQ

SEQ ID NO: 935237 - protein, 9 aa, Homo Sapiens
SQYVKLLDR

SEQ ID NO: 935238 - protein, 9 aa, Homo Sapiens
FQNLKILNF

SEQ ID NO: 935239 - protein, 9 aa, Homo Sapiens
RRKQKQQKR

SEQ ID NO: 935240 - protein, 9 aa, Homo Sapiens
AFSFGFGLV

SEQ ID NO: 935241 - protein, 9 aa, Homo Sapiens
IFYELTQTD

SEQ ID NO: 935242 - protein, 9 aa, Homo Sapiens
DLWVNINQM

SEQ ID NO: 935243 - protein, 9 aa, Homo Sapiens
SDTYQMDGT

SEQ ID NO: 935244 - protein, 9 aa, Homo Sapiens
QVVWNCNKE

SEQ ID NO: 935245 - protein, 9 aa, Homo Sapiens
GKRAMKCSY

SEQ ID NO: 935246 - protein, 9 aa, Homo Sapiens
RDLWVNINQ

SEQ ID NO: 935247 - protein, 9 aa, Homo Sapiens
ELFLRSQGT

SEQ ID NO: 935248 - protein, 9 aa, Homo Sapiens
WPIPEFFWP

SEQ ID NO: 935249 - protein, 9 aa, Homo Sapiens
CHILKCCDG

SEQ ID NO: 935250 - protein, 9 aa, Homo Sapiens
RCQTKLHSL

SEQ ID NO: 935251 - protein, 9 aa, Homo Sapiens
QLEDGYFRI

SEQ ID NO: 935252 - protein, 9 aa, Homo Sapiens
SRLPEAVAA

SEQ ID NO: 935253 - protein, 9 aa, Homo Sapiens
HSQKFPTCL

SEQ ID NO: 935254 - protein, 9 aa, Homo Sapiens
PKNDSWIFS

SEQ ID NO: 935255 - protein, 9 aa, Homo Sapiens
RSDGDKEDE

SEQ ID NO: 935256 - protein, 9 aa, Homo Sapiens
SYFGAGFGL

SEQ ID NO: 935257 - protein, 9 aa, Homo Sapiens
IGLGFVASL

SEQ ID NO: 935258 - protein, 9 aa, Homo Sapiens
EFVYVVSLQ

SEQ ID NO: 935259 - protein, 9 aa, Homo Sapiens
SVAFELVIG

SEQ ID NO: 935260 - protein, 9 aa, Homo Sapiens
LKCCDGLAQ

SEQ ID NO: 935261 - protein, 9 aa, Homo Sapiens
YQILPLRAL

SEQ ID NO: 935262 - protein, 9 aa, Homo Sapiens
AIMKFIYDM

SEQ ID NO: 935263 - protein, 9 aa, Homo Sapiens
GGCDRDYGD

SEQ ID NO: 935264 - protein, 9 aa, Homo Sapiens
QKQQKRLLE

SEQ ID NO: 935265 - protein, 9 aa, Homo Sapiens
HCGPKFSEC

SEQ ID NO: 935266 - protein, 9 aa, Homo Sapiens
YLKMKDGVV

SEQ ID NO: 935267 - protein, 9 aa, Homo Sapiens
RKKMRRKQK

SEQ ID NO: 935268 - protein, 9 aa, Homo Sapiens
DALCRTVGG

SEQ ID NO: 935269 - protein, 9 aa, Homo Sapiens
GEAMIVLGR

SEQ ID NO: 935270 - protein, 9 aa, Homo Sapiens
SFFRALTEG

SEQ ID NO: 935271 - protein, 9 aa, Homo Sapiens
PRPYSFVPA

SEQ ID NO: 935272 - protein, 9 aa, Homo Sapiens
EILGWTTPQ

SEQ ID NO: 935273 - protein, 9 aa, Homo Sapiens
EQVARKHEE

SEQ ID NO: 935274 - protein, 9 aa, Homo Sapiens
TCVNLPDEY

SEQ ID NO: 935275 - protein, 9 aa, Homo Sapiens
IFSERRTIC

SEQ ID NO: 935276 - protein, 9 aa, Homo Sapiens
RQSVPYEMA

SEQ ID NO: 935277 - protein, 9 aa, Homo Sapiens
LKILNFRNG

SEQ ID NO: 935278 - protein, 9 aa, Homo Sapiens
FRKKRVVYN

SEQ ID NO: 935279 - protein, 9 aa, Homo Sapiens
LVEKNTVSY

SEQ ID NO: 935280 - protein, 9 aa, Homo Sapiens
SAGAGQQAG

SEQ ID NO: 935281 - protein, 9 aa, Homo Sapiens
NDSAFMEPR

SEQ ID NO: 935282 - protein, 9 aa, Homo Sapiens
YFLGQPLEK

SEQ ID NO: 935283 - protein, 9 aa, Homo Sapiens
GESSNLFES

SEQ ID NO: 935284 - protein, 9 aa, Homo Sapiens
LQSLFAILS

SEQ ID NO: 935285 - protein, 9 aa, Homo Sapiens
TPDFFMDPA

SEQ ID NO: 935286 - protein, 9 aa, Homo Sapiens
FSIFRFPSS

SEQ ID NO: 935287 - protein, 9 aa, Homo Sapiens
TLAGNLCII

SEQ ID NO: 935288 - protein, 9 aa, Homo Sapiens
NLLDYLRKC

SEQ ID NO: 935289 - protein, 9 aa, Homo Sapiens
TSRLPEAVA

SEQ ID NO: 935290 - protein, 9 aa, Homo Sapiens
LGVVLPTSL

SEQ ID NO: 935291 - protein, 9 aa, Homo Sapiens
LLTLTSWLA

SEQ ID NO: 935292 - protein, 9 aa, Homo Sapiens
HWIIINEKI

SEQ ID NO: 935293 - protein, 9 aa, Homo Sapiens
LVQRCGGYC

SEQ ID NO: 935294 - protein, 9 aa, Homo Sapiens
SPTIIPVLD

SEQ ID NO: 935295 - protein, 9 aa, Homo Sapiens
DPIYKIFYV

SEQ ID NO: 935296 - protein, 9 aa, Homo Sapiens
KNTVSYLGC

SEQ ID NO: 935297 - protein, 9 aa, Homo Sapiens
FRQNSSSTG

SEQ ID NO: 935298 - protein, 9 aa, Homo Sapiens
RGCTATLDN

SEQ ID NO: 935299 - protein, 9 aa, Homo Sapiens
NVIKGNRDR

SEQ ID NO: 935300 - protein, 9 aa, Homo Sapiens
PKDSLYGAR

SEQ ID NO: 935301 - protein, 9 aa, Homo Sapiens
LLLVMTAPP

SEQ ID NO: 935302 - protein, 9 aa, Homo Sapiens
GLMEKPIKS

SEQ ID NO: 935303 - protein, 9 aa, Homo Sapiens
YKLKPSCVY

SEQ ID NO: 935304 - protein, 9 aa, Homo Sapiens
CNEDPDDNL

SEQ ID NO: 935305 - protein, 9 aa, Homo Sapiens
FQEALMELF

SEQ ID NO: 935306 - protein, 9 aa, Homo Sapiens
IQNFPDNIE

SEQ ID NO: 935307 - protein, 9 aa, Homo Sapiens
DKEDELVGS

SEQ ID NO: 935308 - protein, 9 aa, Homo Sapiens
KAGVNGRYN

SEQ ID NO: 935309 - protein, 9 aa, Homo Sapiens
PSGPEKVPL

SEQ ID NO: 935310 - protein, 9 aa, Homo Sapiens
TDRSLVCYG

SEQ ID NO: 935311 - protein, 9 aa, Homo Sapiens
LAVRKYFQK

SEQ ID NO: 935312 - protein, 9 aa, Homo Sapiens
TTSNSFGST

SEQ ID NO: 935313 - protein, 9 aa, Homo Sapiens
THILVGAHR

SEQ ID NO: 935314 - protein, 9 aa, Homo Sapiens
QHRLQCKNF

SEQ ID NO: 935315 - protein, 9 aa, Homo Sapiens
ILITACFAH

SEQ ID NO: 935316 - protein, 9 aa, Homo Sapiens
QLKVVHEQL

SEQ ID NO: 935317 - protein, 9 aa, Homo Sapiens
TMLRYNILP

SEQ ID NO: 935318 - protein, 9 aa, Homo Sapiens
SLAVLLCST

SEQ ID NO: 935319 - protein, 9 aa, Homo Sapiens
QKSTTGKVA

SEQ ID NO: 935320 - protein, 9 aa, Homo Sapiens
YFQKITLYL

SEQ ID NO: 935321 - protein, 9 aa, Homo Sapiens
NVTVEIMYQ

SEQ ID NO: 935322 - protein, 9 aa, Homo Sapiens
RVGTVWESS

SEQ ID NO: 935323 - protein, 9 aa, Homo Sapiens
EKPCGDSPS

SEQ ID NO: 935324 - protein, 9 aa, Homo Sapiens
PDLFDSLPG

SEQ ID NO: 935325 - protein, 9 aa, Homo Sapiens
CIYEVRINN

SEQ ID NO: 935326 - protein, 9 aa, Homo Sapiens
AFEETLMLV

SEQ ID NO: 935327 - protein, 9 aa, Homo Sapiens
EKGRLSEHI

SEQ ID NO: 935328 - protein, 9 aa, Homo Sapiens
NTKMAVGIV

SEQ ID NO: 935329 - protein, 9 aa, Homo Sapiens
VRCLEEWQK

SEQ ID NO: 935330 - protein, 9 aa, Homo Sapiens
DYLRKCNRE

SEQ ID NO: 935331 - protein, 9 aa, Homo Sapiens
SVQKLEQLS

SEQ ID NO: 935332 - protein, 9 aa, Homo Sapiens
VPQKSTTGK

SEQ ID NO: 935333 - protein, 9 aa, Homo Sapiens
DLKRQGLLS

SEQ ID NO: 935334 - protein, 9 aa, Homo Sapiens
PEDGVKMDT

SEQ ID NO: 935335 - protein, 9 aa, Homo Sapiens
SLSALRSPA

SEQ ID NO: 935336 - protein, 9 aa, Homo Sapiens
GCTIRNTKM

SEQ ID NO: 935337 - protein, 9 aa, Homo Sapiens
ACPDPSLCL

SEQ ID NO: 935338 - protein, 9 aa, Homo Sapiens
SFGSTSGSL

SEQ ID NO: 935339 - protein, 9 aa, Homo Sapiens
EHDLTPMNG

SEQ ID NO: 935340 - protein, 9 aa, Homo Sapiens
YFQMQDLKE

SEQ ID NO: 935341 - protein, 9 aa, Homo Sapiens
TNLYVQHAI

SEQ ID NO: 935342 - protein, 9 aa, Homo Sapiens
AEAERLEGS

SEQ ID NO: 935343 - protein, 9 aa, Homo Sapiens
KRFLLHPLT

SEQ ID NO: 935344 - protein, 9 aa, Homo Sapiens
QEKGPMDVV

SEQ ID NO: 935345 - protein, 9 aa, Homo Sapiens
IKGNRDRPL

SEQ ID NO: 935346 - protein, 9 aa, Homo Sapiens
VCDEIKSKF

SEQ ID NO: 935347 - protein, 9 aa, Homo Sapiens
GARHLAQLM

SEQ ID NO: 935348 - protein, 9 aa, Homo Sapiens
QGPLPPPGK

SEQ ID NO: 935349 - protein, 9 aa, Homo Sapiens
RILSENFGS

SEQ ID NO: 935350 - protein, 9 aa, Homo Sapiens
ADTHILVGA

SEQ ID NO: 935351 - protein, 9 aa, Homo Sapiens
KKIISFVGC

SEQ ID NO: 935352 - protein, 9 aa, Homo Sapiens
AQEISHDAC

SEQ ID NO: 935353 - protein, 9 aa, Homo Sapiens
EEKPCGDSP

SEQ ID NO: 935354 - protein, 9 aa, Homo Sapiens
HFLFPSSSF

SEQ ID NO: 935355 - protein, 9 aa, Homo Sapiens
DCLSPFHRR

SEQ ID NO: 935356 - protein, 9 aa, Homo Sapiens
CSACLETFG

SEQ ID NO: 935357 - protein, 9 aa, Homo Sapiens
RRGFDWSLH

SEQ ID NO: 935358 - protein, 9 aa, Homo Sapiens
KRGTSEIVA

SEQ ID NO: 935359 - protein, 9 aa, Homo Sapiens
LIQHERIYT

SEQ ID NO: 935360 - protein, 9 aa, Homo Sapiens
SHARYSSQL

SEQ ID NO: 935361 - protein, 9 aa, Homo Sapiens
CPSGPEKVP

SEQ ID NO: 935362 - protein, 9 aa, Homo Sapiens
RHPSSLSAL

SEQ ID NO: 935363 - protein, 9 aa, Homo Sapiens
AECSACLET

SEQ ID NO: 935364 - protein, 9 aa, Homo Sapiens
GVKVLPVPV

SEQ ID NO: 935365 - protein, 9 aa, Homo Sapiens
LCRTVGGKF

SEQ ID NO: 935366 - protein, 9 aa, Homo Sapiens
KLIFYATSR

SEQ ID NO: 935367 - protein, 9 aa, Homo Sapiens
ATGEKSSTS

SEQ ID NO: 935368 - protein, 9 aa, Homo Sapiens
LFFVTGILA

SEQ ID NO: 935369 - protein, 9 aa, Homo Sapiens
GNVFQGMNN

SEQ ID NO: 935370 - protein, 9 aa, Homo Sapiens
GPSAPWINP

SEQ ID NO: 935371 - protein, 9 aa, Homo Sapiens
LSSVGKLSE

SEQ ID NO: 935372 - protein, 9 aa, Homo Sapiens
RNTKMAVGI

SEQ ID NO: 935373 - protein, 9 aa, Homo Sapiens
SEPEEEDVG

SEQ ID NO: 935374 - protein, 9 aa, Homo Sapiens
ASRPHFRRA

SEQ ID NO: 935375 - protein, 9 aa, Homo Sapiens
SKDTDSKKS

SEQ ID NO: 935376 - protein, 9 aa, Homo Sapiens
PNLSSPTQK

SEQ ID NO: 935377 - protein, 9 aa, Homo Sapiens
GHWPIPEFF

SEQ ID NO: 935378 - protein, 9 aa, Homo Sapiens
GEAAVLAVG

SEQ ID NO: 935379 - protein, 9 aa, Homo Sapiens
ISTSGDHHI

SEQ ID NO: 935380 - protein, 9 aa, Homo Sapiens
VVLVFPLNF

SEQ ID NO: 935381 - protein, 9 aa, Homo Sapiens
DQITRLGDV

SEQ ID NO: 935382 - protein, 9 aa, Homo Sapiens
FSGKEFGPL

SEQ ID NO: 935383 - protein, 9 aa, Homo Sapiens
LSPAVVVRF

SEQ ID NO: 935384 - protein, 9 aa, Homo Sapiens
HTAADTHIL

SEQ ID NO: 935385 - protein, 9 aa, Homo Sapiens
PKGIVLLLL

SEQ ID NO: 935386 - protein, 9 aa, Homo Sapiens
FLPMAWGDS

SEQ ID NO: 935387 - protein, 9 aa, Homo Sapiens
KTLQKVVSH

SEQ ID NO: 935388 - protein, 9 aa, Homo Sapiens
GSDRKVPSR

SEQ ID NO: 935389 - protein, 9 aa, Homo Sapiens
IKSTREEKK

SEQ ID NO: 935390 - protein, 9 aa, Homo Sapiens
QAGPARGTE

SEQ ID NO: 935391 - protein, 9 aa, Homo Sapiens
LHEPIPSFF

SEQ ID NO: 935392 - protein, 9 aa, Homo Sapiens
VVVRFSAAL

SEQ ID NO: 935393 - protein, 9 aa, Homo Sapiens
VLVFPLNFR

SEQ ID NO: 935394 - protein, 9 aa, Homo Sapiens
RKRMDQITA

SEQ ID NO: 935395 - protein, 9 aa, Homo Sapiens
TIIPSESKS

SEQ ID NO: 935396 - protein, 9 aa, Homo Sapiens
EISLSLWAV

SEQ ID NO: 935397 - protein, 9 aa, Homo Sapiens
DRVSCFGSG

SEQ ID NO: 935398 - protein, 9 aa, Homo Sapiens
HDLTPMNGE

SEQ ID NO: 935399 - protein, 9 aa, Homo Sapiens
SLTNLYVQH

SEQ ID NO: 935400 - protein, 9 aa, Homo Sapiens
DNICFDTFK

SEQ ID NO: 935401 - protein, 9 aa, Homo Sapiens
AFLGESLAM

SEQ ID NO: 935402 - protein, 9 aa, Homo Sapiens
VMIKVVRGG

SEQ ID NO: 935403 - protein, 9 aa, Homo Sapiens
KITFPVDFV

SEQ ID NO: 935404 - protein, 9 aa, Homo Sapiens
PIDFTMYTT

SEQ ID NO: 935405 - protein, 9 aa, Homo Sapiens
TGEDGVFQM

SEQ ID NO: 935406 - protein, 9 aa, Homo Sapiens
EVFSQSVSN

SEQ ID NO: 935407 - protein, 9 aa, Homo Sapiens
SLYGARHLA

SEQ ID NO: 935408 - protein, 9 aa, Homo Sapiens
EIFGSAEPT

SEQ ID NO: 935409 - protein, 9 aa, Homo Sapiens
TEETLLTLK

SEQ ID NO: 935410 - protein, 9 aa, Homo Sapiens
NIFAIFRQN

SEQ ID NO: 935411 - protein, 9 aa, Homo Sapiens
TLAAAAGEA

SEQ ID NO: 935412 - protein, 9 aa, Homo Sapiens
LARYNFTPD

SEQ ID NO: 935413 - protein, 9 aa, Homo Sapiens
RKEVNKCDL

SEQ ID NO: 935414 - protein, 9 aa, Homo Sapiens
VDKSSKYIF

SEQ ID NO: 935415 - protein, 9 aa, Homo Sapiens
CSPEQGPPT

SEQ ID NO: 935416 - protein, 9 aa, Homo Sapiens
PQTVGPLQL

SEQ ID NO: 935417 - protein, 9 aa, Homo Sapiens
KGALVTAAR

SEQ ID NO: 935418 - protein, 9 aa, Homo Sapiens
DTYYCGFLT

SEQ ID NO: 935419 - protein, 9 aa, Homo Sapiens
FNFFFWVGE

SEQ ID NO: 935420 - protein, 9 aa, Homo Sapiens
DARIFYELT

SEQ ID NO: 935421 - protein, 9 aa, Homo Sapiens
SACPSGPEK

SEQ ID NO: 935422 - protein, 9 aa, Homo Sapiens
FHGCIYEVR

SEQ ID NO: 935423 - protein, 9 aa, Homo Sapiens
ISLNQGLKS

SEQ ID NO: 935424 - protein, 9 aa, Homo Sapiens
LEAANRLCM

SEQ ID NO: 935425 - protein, 9 aa, Homo Sapiens
ENHSRILSE

SEQ ID NO: 935426 - protein, 9 aa, Homo Sapiens
TTNTTSNSF

SEQ ID NO: 935427 - protein, 9 aa, Homo Sapiens
SSYLAKVDQ

SEQ ID NO: 935428 - protein, 9 aa, Homo Sapiens
SPPVPPGTP

SEQ ID NO: 935429 - protein, 9 aa, Homo Sapiens
KSKFASLKD

SEQ ID NO: 935430 - protein, 9 aa, Homo Sapiens
TGEDFVNIP

SEQ ID NO: 935431 - protein, 9 aa, Homo Sapiens
VKTKEELLL

SEQ ID NO: 935432 - protein, 9 aa, Homo Sapiens
GPNGSPGSN

SEQ ID NO: 935433 - protein, 9 aa, Homo Sapiens
PSDFKKAHH

SEQ ID NO: 935434 - protein, 9 aa, Homo Sapiens
VNKDSLTNL

SEQ ID NO: 935435 - protein, 9 aa, Homo Sapiens
TARSKKTLQ

SEQ ID NO: 935436 - protein, 9 aa, Homo Sapiens
PFLNRGNDK

SEQ ID NO: 935437 - protein, 9 aa, Homo Sapiens
FFVTGILAE

SEQ ID NO: 935438 - protein, 9 aa, Homo Sapiens
LKEISAENI

SEQ ID NO: 935439 - protein, 9 aa, Homo Sapiens
QDPIYKIFY

SEQ ID NO: 935440 - protein, 9 aa, Homo Sapiens
NQPGLGQPG

SEQ ID NO: 935441 - protein, 9 aa, Homo Sapiens
GWPSVCINL

SEQ ID NO: 935442 - protein, 9 aa, Homo Sapiens
RSMGGKKDL

SEQ ID NO: 935443 - protein, 9 aa, Homo Sapiens
SKPDPARPV

SEQ ID NO: 935444 - protein, 9 aa, Homo Sapiens
IRMHMGDQI

SEQ ID NO: 935445 - protein, 9 aa, Homo Sapiens
IKTVAQQIY

SEQ ID NO: 935446 - protein, 9 aa, Homo Sapiens
TLQDQRIVG

SEQ ID NO: 935447 - protein, 9 aa, Homo Sapiens
KTCRQTVTE

SEQ ID NO: 935448 - protein, 9 aa, Homo Sapiens
FFDVLLSHK

SEQ ID NO: 935449 - protein, 9 aa, Homo Sapiens
RSKKTLQKV

SEQ ID NO: 935450 - protein, 9 aa, Homo Sapiens
NGWPSVCIN

SEQ ID NO: 935451 - protein, 9 aa, Homo Sapiens
PTSLLLRHY

SEQ ID NO: 935452 - protein, 9 aa, Homo Sapiens
ALQSLEGME

SEQ ID NO: 935453 - protein, 9 aa, Homo Sapiens
KKEASADMQ

SEQ ID NO: 935454 - protein, 9 aa, Homo Sapiens
VNKCDLPEW

SEQ ID NO: 935455 - protein, 9 aa, Homo Sapiens
NAVHKYKCT

SEQ ID NO: 935456 - protein, 9 aa, Homo Sapiens
EAGEKPYEC

SEQ ID NO: 935457 - protein, 9 aa, Homo Sapiens
IRPFKLSEQ

SEQ ID NO: 935458 - protein, 9 aa, Homo Sapiens
VRWLRSPVP

SEQ ID NO: 935459 - protein, 9 aa, Homo Sapiens
LVMQDPIYK

SEQ ID NO: 935460 - protein, 9 aa, Homo Sapiens
YVQTMLRYN

SEQ ID NO: 935461 - protein, 9 aa, Homo Sapiens
EKNTVSYLG

SEQ ID NO: 935462 - protein, 9 aa, Homo Sapiens
RSARHPSSL

SEQ ID NO: 935463 - protein, 9 aa, Homo Sapiens
LQSLEGMER

SEQ ID NO: 935464 - protein, 9 aa, Homo Sapiens
YVIYFLGQP

SEQ ID NO: 935465 - protein, 9 aa, Homo Sapiens
KALDAIIDT

SEQ ID NO: 935466 - protein, 9 aa, Homo Sapiens
IQASVQDTA

SEQ ID NO: 935467 - protein, 9 aa, Homo Sapiens
EKEQKQLFM

SEQ ID NO: 935468 - protein, 9 aa, Homo Sapiens
LQLKETQPF

SEQ ID NO: 935469 - protein, 9 aa, Homo Sapiens
VQRCGGYCG

SEQ ID NO: 935470 - protein, 9 aa, Homo Sapiens
QLVDATADR

SEQ ID NO: 935471 - protein, 9 aa, Homo Sapiens
MMAGGRSVF

SEQ ID NO: 935472 - protein, 9 aa, Homo Sapiens
PRALGSASR

SEQ ID NO: 935473 - protein, 9 aa, Homo Sapiens
NWVKIYFNR

SEQ ID NO: 935474 - protein, 9 aa, Homo Sapiens
GIDFRKKRV

SEQ ID NO: 935475 - protein, 9 aa, Homo Sapiens
AKGMFCVGL

SEQ ID NO: 935476 - protein, 9 aa, Homo Sapiens
RFRRGKVEA

SEQ ID NO: 935477 - protein, 9 aa, Homo Sapiens
RMKNNQPQP

SEQ ID NO: 935478 - protein, 9 aa, Homo Sapiens
SSPEGPQSY

SEQ ID NO: 935479 - protein, 9 aa, Homo Sapiens
RSHHKDRAG

SEQ ID NO: 935480 - protein, 9 aa, Homo Sapiens
QLKETQPFP

SEQ ID NO: 935481 - protein, 9 aa, Homo Sapiens
EAWMQANYN

SEQ ID NO: 935482 - protein, 9 aa, Homo Sapiens
FLAKLIKLP

SEQ ID NO: 935483 - protein, 9 aa, Homo Sapiens
RSIVHAVQG

SEQ ID NO: 935484 - protein, 9 aa, Homo Sapiens
SLFITTKKG

SEQ ID NO: 935485 - protein, 9 aa, Homo Sapiens
ELNENPDML

SEQ ID NO: 935486 - protein, 9 aa, Homo Sapiens
LKKEASADM

SEQ ID NO: 935487 - protein, 9 aa, Homo Sapiens
EDRSFWNSA

SEQ ID NO: 935488 - protein, 9 aa, Homo Sapiens
LRGLLDCKG

SEQ ID NO: 935489 - protein, 9 aa, Homo Sapiens
TDLVPGQKY

SEQ ID NO: 935490 - protein, 9 aa, Homo Sapiens
VQGALHRAP

SEQ ID NO: 935491 - protein, 9 aa, Homo Sapiens
SLYFQMQDL

SEQ ID NO: 935492 - protein, 9 aa, Homo Sapiens
DLGKKETLA

SEQ ID NO: 935493 - protein, 9 aa, Homo Sapiens
FPLDCWVSI

SEQ ID NO: 935494 - protein, 9 aa, Homo Sapiens
ARSDGDKED

SEQ ID NO: 935495 - protein, 9 aa, Homo Sapiens
SPVPQRSQA

SEQ ID NO: 935496 - protein, 9 aa, Homo Sapiens
GATQVVWNC

SEQ ID NO: 935497 - protein, 9 aa, Homo Sapiens
TTPMPQGNG

SEQ ID NO: 935498 - protein, 9 aa, Homo Sapiens
EKSSTSLTV

SEQ ID NO: 935499 - protein, 9 aa, Homo Sapiens
GAGRDFYEE

SEQ ID NO: 935500 - protein, 9 aa, Homo Sapiens
PAVLVYNGI

SEQ ID NO: 935501 - protein, 9 aa, Homo Sapiens
DELFLRSQG

SEQ ID NO: 935502 - protein, 9 aa, Homo Sapiens
LPPDELFLR

SEQ ID NO: 935503 - protein, 9 aa, Homo Sapiens
RAVSPAVLV

SEQ ID NO: 935504 - protein, 9 aa, Homo Sapiens
RPLAALNIF

SEQ ID NO: 935505 - protein, 9 aa, Homo Sapiens
GNEVPEKAL

SEQ ID NO: 935506 - protein, 9 aa, Homo Sapiens
ECSACLETF

SEQ ID NO: 935507 - protein, 9 aa, Homo Sapiens
SASELRRGF

SEQ ID NO: 935508 - protein, 9 aa, Homo Sapiens
HNPGRCAVD

SEQ ID NO: 935509 - protein, 9 aa, Homo Sapiens
INQMEKDKV

SEQ ID NO: 935510 - protein, 9 aa, Homo Sapiens
KRRKRMDQI

SEQ ID NO: 935511 - protein, 9 aa, Homo Sapiens
KGDHSDAPM

SEQ ID NO: 935512 - protein, 9 aa, Homo Sapiens
VFSQSVSNS

SEQ ID NO: 935513 - protein, 9 aa, Homo Sapiens
MIVLGRYLD

SEQ ID NO: 935514 - protein, 9 aa, Homo Sapiens
EALSIQLQL

SEQ ID NO: 935515 - protein, 9 aa, Homo Sapiens
ETPVQPVFS

SEQ ID NO: 935516 - protein, 9 aa, Homo Sapiens
CMINEFGYC

SEQ ID NO: 935517 - protein, 9 aa, Homo Sapiens
IYTGEKPYV

SEQ ID NO: 935518 - protein, 9 aa, Homo Sapiens
FLARYNFTP

SEQ ID NO: 935519 - protein, 9 aa, Homo Sapiens
GAQEISHDA

SEQ ID NO: 935520 - protein, 9 aa, Homo Sapiens
SRILSENFG

SEQ ID NO: 935521 - protein, 9 aa, Homo Sapiens
ALEIYKQFL

SEQ ID NO: 935522 - protein, 9 aa, Homo Sapiens
RMIQNFPDN

SEQ ID NO: 935523 - protein, 9 aa, Homo Sapiens
QSKFSIFRF

SEQ ID NO: 935524 - protein, 9 aa, Homo Sapiens
IGMLYVMIL

SEQ ID NO: 935525 - protein, 9 aa, Homo Sapiens
SGSIDYDEC

SEQ ID NO: 935526 - protein, 9 aa, Homo Sapiens
DFTMYTTCI

SEQ ID NO: 935527 - protein, 9 aa, Homo Sapiens
LYEIFTPDQ

SEQ ID NO: 935528 - protein, 9 aa, Homo Sapiens
PEKALDAII

SEQ ID NO: 935529 - protein, 9 aa, Homo Sapiens
DLRDFPSDF

SEQ ID NO: 935530 - protein, 9 aa, Homo Sapiens
RIPSTPDFF

SEQ ID NO: 935531 - protein, 9 aa, Homo Sapiens
EIKKLASEF

SEQ ID NO: 935532 - protein, 9 aa, Homo Sapiens
AFELVIGGM

SEQ ID NO: 935533 - protein, 9 aa, Homo Sapiens
SQKFPTCLQ

SEQ ID NO: 935534 - protein, 9 aa, Homo Sapiens
IQEKGPMDV

SEQ ID NO: 935535 - protein, 9 aa, Homo Sapiens
ELQEQLKVV

SEQ ID NO: 935536 - protein, 9 aa, Homo Sapiens
TGERVITRE

SEQ ID NO: 935537 - protein, 9 aa, Homo Sapiens
DSPSFPHTI

SEQ ID NO: 935538 - protein, 9 aa, Homo Sapiens
PGNVFQGMN

SEQ ID NO: 935539 - protein, 9 aa, Homo Sapiens
FRQDVICIP

SEQ ID NO: 935540 - protein, 9 aa, Homo Sapiens
DKENKEMLF

SEQ ID NO: 935541 - protein, 9 aa, Homo Sapiens
LSFISLPHT

SEQ ID NO: 935542 - protein, 9 aa, Homo Sapiens
DEGPNGSPG

SEQ ID NO: 935543 - protein, 9 aa, Homo Sapiens
GVAPNQPGL

SEQ ID NO: 935544 - protein, 9 aa, Homo Sapiens
VQTMLRYNI

SEQ ID NO: 935545 - protein, 9 aa, Homo Sapiens
VTARSKKTL

SEQ ID NO: 935546 - protein, 9 aa, Homo Sapiens
CNSHFKSCH

SEQ ID NO: 935547 - protein, 9 aa, Homo Sapiens
LVVFSVAFE

SEQ ID NO: 935548 - protein, 9 aa, Homo Sapiens
ISLSLWAVP

SEQ ID NO: 935549 - protein, 9 aa, Homo Sapiens
EEDVGNDTK

SEQ ID NO: 935550 - protein, 9 aa, Homo Sapiens
LYGARHLAQ

SEQ ID NO: 935551 - protein, 9 aa, Homo Sapiens
TEDDPRWLE

SEQ ID NO: 935552 - protein, 9 aa, Homo Sapiens
QITRLGDVQ

SEQ ID NO: 935553 - protein, 9 aa, Homo Sapiens
RDRSSSASN

SEQ ID NO: 935554 - protein, 9 aa, Homo Sapiens
KHKNQKMFT

SEQ ID NO: 935555 - protein, 9 aa, Homo Sapiens
AQICKSVCH

SEQ ID NO: 935556 - protein, 9 aa, Homo Sapiens
ESASELRRG

SEQ ID NO: 935557 - protein, 9 aa, Homo Sapiens
DFPLDCWVS

SEQ ID NO: 935558 - protein, 9 aa, Homo Sapiens
VSCFGSGSC

SEQ ID NO: 935559 - protein, 9 aa, Homo Sapiens
YSSKKKKMF

SEQ ID NO: 935560 - protein, 9 aa, Homo Sapiens
KDSDLKTLF

SEQ ID NO: 935561 - protein, 9 aa, Homo Sapiens
DSGTETELA

SEQ ID NO: 935562 - protein, 9 aa, Homo Sapiens
ILIGRSDTG

SEQ ID NO: 935563 - protein, 9 aa, Homo Sapiens
LSAVLRALK

SEQ ID NO: 935564 - protein, 9 aa, Homo Sapiens
LLNRFYRRL

SEQ ID NO: 935565 - protein, 9 aa, Homo Sapiens
MGFLARYNF

SEQ ID NO: 935566 - protein, 9 aa, Homo Sapiens
DFPSDFKKA

SEQ ID NO: 935567 - protein, 9 aa, Homo Sapiens
ARNTLASVF

SEQ ID NO: 935568 - protein, 9 aa, Homo Sapiens
KDNSYFGAG

SEQ ID NO: 935569 - protein, 9 aa, Homo Sapiens
VSWYPSPSP

SEQ ID NO: 935570 - protein, 9 aa, Homo Sapiens
SVSSISRIR

SEQ ID NO: 935571 - protein, 9 aa, Homo Sapiens
EIYKQFLTR

SEQ ID NO: 935572 - protein, 9 aa, Homo Sapiens
HITTIPGNV

SEQ ID NO: 935573 - protein, 9 aa, Homo Sapiens
HERIYTGEK

SEQ ID NO: 935574 - protein, 9 aa, Homo Sapiens
RPPSCGARA

SEQ ID NO: 935575 - protein, 9 aa, Homo Sapiens
IPSTPDFFM

SEQ ID NO: 935576 - protein, 9 aa, Homo Sapiens
LLEQVARKH

SEQ ID NO: 935577 - protein, 9 aa, Homo Sapiens
VFIPIHICL

SEQ ID NO: 935578 - protein, 9 aa, Homo Sapiens
KNSRHTIKV

SEQ ID NO: 935579 - protein, 9 aa, Homo Sapiens
LSPEPVDII

SEQ ID NO: 935580 - protein, 9 aa, Homo Sapiens
NLIQIGGLI

SEQ ID NO: 935581 - protein, 9 aa, Homo Sapiens
KTGTCSPEQ

SEQ ID NO: 935582 - protein, 9 aa, Homo Sapiens
QASPRPYSF

SEQ ID NO: 935583 - protein, 9 aa, Homo Sapiens
GIGLGFVAS

SEQ ID NO: 935584 - protein, 9 aa, Homo Sapiens
PNQPGLGQP

SEQ ID NO: 935585 - protein, 9 aa, Homo Sapiens
RVKRRIENK

SEQ ID NO: 935586 - protein, 9 aa, Homo Sapiens
MNGETFSQH

SEQ ID NO: 935587 - protein, 9 aa, Homo Sapiens
LSPSSGFDG

SEQ ID NO: 935588 - protein, 9 aa, Homo Sapiens
QLLWNPEIL

SEQ ID NO: 935589 - protein, 9 aa, Homo Sapiens
CDEIKSKFA

SEQ ID NO: 935590 - protein, 9 aa, Homo Sapiens
KPESGVLFA

SEQ ID NO: 935591 - protein, 9 aa, Homo Sapiens
EQTPKLSMD

SEQ ID NO: 935592 - protein, 9 aa, Homo Sapiens
CHWIIINEK

SEQ ID NO: 935593 - protein, 9 aa, Homo Sapiens
MVAVKMLKK

SEQ ID NO: 935594 - protein, 9 aa, Homo Sapiens
RVSCFGSGS

SEQ ID NO: 935595 - protein, 9 aa, Homo Sapiens
LVTGTYKIS

SEQ ID NO: 935596 - protein, 9 aa, Homo Sapiens
KQLFMDLDV

SEQ ID NO: 935597 - protein, 9 aa, Homo Sapiens
ETESVPSRF

SEQ ID NO: 935598 - protein, 9 aa, Homo Sapiens
HFIGFSTFL

SEQ ID NO: 935599 - protein, 9 aa, Homo Sapiens
VDPSEALQP

SEQ ID NO: 935600 - protein, 9 aa, Homo Sapiens
RGTLSVISF

SEQ ID NO: 935601 - protein, 9 aa, Homo Sapiens
IDQSFWEIF

SEQ ID NO: 935602 - protein, 9 aa, Homo Sapiens
LNEKYGESR

SEQ ID NO: 935603 - protein, 9 aa, Homo Sapiens
NMCGLQTLH

SEQ ID NO: 935604 - protein, 9 aa, Homo Sapiens
HRSSCSEYL

SEQ ID NO: 935605 - protein, 9 aa, Homo Sapiens
QGCVYVQTM

SEQ ID NO: 935606 - protein, 9 aa, Homo Sapiens
PDFFMDPAS

SEQ ID NO: 935607 - protein, 9 aa, Homo Sapiens
VRMIQNFPD

SEQ ID NO: 935608 - protein, 9 aa, Homo Sapiens
QGCHSKPDP

SEQ ID NO: 935609 - protein, 9 aa, Homo Sapiens
NGETFSQHL

SEQ ID NO: 935610 - protein, 9 aa, Homo Sapiens
LALKDNSYF

SEQ ID NO: 935611 - protein, 9 aa, Homo Sapiens
NPDMLHQDI

SEQ ID NO: 935612 - protein, 9 aa, Homo Sapiens
EDEFWTEET

SEQ ID NO: 935613 - protein, 9 aa, Homo Sapiens
SGGLSPSSG

SEQ ID NO: 935614 - protein, 9 aa, Homo Sapiens
SLVSRLQAD

SEQ ID NO: 935615 - protein, 9 aa, Homo Sapiens
NEKYGESRH

SEQ ID NO: 935616 - protein, 9 aa, Homo Sapiens
FFLFITYIL

SEQ ID NO: 935617 - protein, 9 aa, Homo Sapiens
KNANANAVH

SEQ ID NO: 935618 - protein, 9 aa, Homo Sapiens
FFFSSALLS

SEQ ID NO: 935619 - protein, 9 aa, Homo Sapiens
TSGLGPLQL

SEQ ID NO: 935620 - protein, 9 aa, Homo Sapiens
DTHILVGAH

SEQ ID NO: 935621 - protein, 9 aa, Homo Sapiens
QLWFEKAKG

SEQ ID NO: 935622 - protein, 9 aa, Homo Sapiens
GRASAGAGQ

SEQ ID NO: 935623 - protein, 9 aa, Homo Sapiens
KAHLEEILA

SEQ ID NO: 935624 - protein, 9 aa, Homo Sapiens
VKRRIENKI

SEQ ID NO: 935625 - protein, 9 aa, Homo Sapiens
MDGTDDRSD

SEQ ID NO: 935626 - protein, 9 aa, Homo Sapiens
EKIPDLFDS

SEQ ID NO: 935627 - protein, 9 aa, Homo Sapiens
IRMRLLNRF

SEQ ID NO: 935628 - protein, 9 aa, Homo Sapiens
YGARHLAQL

SEQ ID NO: 935629 - protein, 9 aa, Homo Sapiens
VAFELVIGG

SEQ ID NO: 935630 - protein, 9 aa, Homo Sapiens
PRLGSHTID

SEQ ID NO: 935631 - protein, 9 aa, Homo Sapiens
LHTPMYFFF

SEQ ID NO: 935632 - protein, 9 aa, Homo Sapiens
LFTPLHYLE

SEQ ID NO: 935633 - protein, 9 aa, Homo Sapiens
FSLAVLLCS

SEQ ID NO: 935634 - protein, 9 aa, Homo Sapiens
NLRMQNGTI

SEQ ID NO: 935635 - protein, 9 aa, Homo Sapiens
DNHLSLRIA

SEQ ID NO: 935636 - protein, 9 aa, Homo Sapiens
AANRLCMIN

SEQ ID NO: 935637 - protein, 9 aa, Homo Sapiens
IFAIFRQNS

SEQ ID NO: 935638 - protein, 9 aa, Homo Sapiens
LVKTKEELL

SEQ ID NO: 935639 - protein, 9 aa, Homo Sapiens
ISRIRRNKI

SEQ ID NO: 935640 - protein, 9 aa, Homo Sapiens
QRIVIARAL

SEQ ID NO: 935641 - protein, 9 aa, Homo Sapiens
VCKQLECPF

SEQ ID NO: 935642 - protein, 9 aa, Homo Sapiens
VEERLDMEK

SEQ ID NO: 935643 - protein, 9 aa, Homo Sapiens
LNRFYRRLS

SEQ ID NO: 935644 - protein, 9 aa, Homo Sapiens
FFLRFFFLS

SEQ ID NO: 935645 - protein, 9 aa, Homo Sapiens
WCRVLSTVD

SEQ ID NO: 935646 - protein, 9 aa, Homo Sapiens
CLCCCCGGG

SEQ ID NO: 935647 - protein, 9 aa, Homo Sapiens
KNSNPCDFF

SEQ ID NO: 935648 - protein, 9 aa, Homo Sapiens
RSDTGKTTC

SEQ ID NO: 935649 - protein, 9 aa, Homo Sapiens
FFWVGEAAV

SEQ ID NO: 935650 - protein, 9 aa, Homo Sapiens
IENKILILP

SEQ ID NO: 935651 - protein, 9 aa, Homo Sapiens
VGVIESLLM

SEQ ID NO: 935652 - protein, 9 aa, Homo Sapiens
VSTGEDGVF

SEQ ID NO: 935653 - protein, 9 aa, Homo Sapiens
RHTIKVASV

SEQ ID NO: 935654 - protein, 9 aa, Homo Sapiens
IPDLFDSLP

SEQ ID NO: 935655 - protein, 9 aa, Homo Sapiens
SMVSVVPQK

SEQ ID NO: 935656 - protein, 9 aa, Homo Sapiens
PLENLKLTC

SEQ ID NO: 935657 - protein, 9 aa, Homo Sapiens
IAFLGESLA

SEQ ID NO: 935658 - protein, 9 aa, Homo Sapiens
IQRNYLSSV

SEQ ID NO: 935659 - protein, 9 aa, Homo Sapiens
PFSSGPGSG

SEQ ID NO: 935660 - protein, 9 aa, Homo Sapiens
RNKTCRQTV

SEQ ID NO: 935661 - protein, 9 aa, Homo Sapiens
KEVNKCDLP

SEQ ID NO: 935662 - protein, 9 aa, Homo Sapiens
GGEQDIPYT

SEQ ID NO: 935663 - protein, 9 aa, Homo Sapiens
WVKIYFNRS

SEQ ID NO: 935664 - protein, 9 aa, Homo Sapiens
YDCYVAISK

SEQ ID NO: 935665 - protein, 9 aa, Homo Sapiens
LRRAESLCS

SEQ ID NO: 935666 - protein, 9 aa, Homo Sapiens
DWNNYKNFL

SEQ ID NO: 935667 - protein, 9 aa, Homo Sapiens
EMAVVVRSP

SEQ ID NO: 935668 - protein, 9 aa, Homo Sapiens
EVRWLRSPV

SEQ ID NO: 935669 - protein, 9 aa, Homo Sapiens
GKLIFYATS

SEQ ID NO: 935670 - protein, 9 aa, Homo Sapiens
NTLASVFRL

SEQ ID NO: 935671 - protein, 9 aa, Homo Sapiens
KLLDREQLT

SEQ ID NO: 935672 - protein, 9 aa, Homo Sapiens
LLCCNNRHF

SEQ ID NO: 935673 - protein, 9 aa, Homo Sapiens
ENPDMLHQD

SEQ ID NO: 935674 - protein, 9 aa, Homo Sapiens
KLCHGLYEI

SEQ ID NO: 935675 - protein, 9 aa, Homo Sapiens
RVVPRDQNF

SEQ ID NO: 935676 - protein, 9 aa, Homo Sapiens
GYVNFLINP

SEQ ID NO: 935677 - protein, 9 aa, Homo Sapiens
VDLVSPKKI

SEQ ID NO: 935678 - protein, 9 aa, Homo Sapiens
QNLKGDHSD

SEQ ID NO: 935679 - protein, 9 aa, Homo Sapiens
CDFFAFGVF

SEQ ID NO: 935680 - protein, 9 aa, Homo Sapiens
ITACFAHGS

SEQ ID NO: 935681 - protein, 9 aa, Homo Sapiens
GVKMDTRAA

SEQ ID NO: 935682 - protein, 9 aa, Homo Sapiens
LTSQYVKLL

SEQ ID NO: 935683 - protein, 9 aa, Homo Sapiens
RKVPSRFAN

SEQ ID NO: 935684 - protein, 9 aa, Homo Sapiens
WPSVCINLT

SEQ ID NO: 935685 - protein, 9 aa, Homo Sapiens
QKVGWDLEP

SEQ ID NO: 935686 - protein, 9 aa, Homo Sapiens
KILILPSVT

SEQ ID NO: 935687 - protein, 9 aa, Homo Sapiens
KDLIWELLN

SEQ ID NO: 935688 - protein, 9 aa, Homo Sapiens
ASEFVYVVS

SEQ ID NO: 935689 - protein, 9 aa, Homo Sapiens
SVGKLSEYR

SEQ ID NO: 935690 - protein, 9 aa, Homo Sapiens
LGSHTIDFF

SEQ ID NO: 935691 - protein, 9 aa, Homo Sapiens
SASRPHFRR

SEQ ID NO: 935692 - protein, 9 aa, Homo Sapiens
FILAGEPAD

SEQ ID NO: 935693 - protein, 9 aa, Homo Sapiens
GNRDRPLND

SEQ ID NO: 935694 - protein, 9 aa, Homo Sapiens
SKKKKMFLH

SEQ ID NO: 935695 - protein, 9 aa, Homo Sapiens
DVMTYMRET

SEQ ID NO: 935696 - protein, 9 aa, Homo Sapiens
LLDKENKEM

SEQ ID NO: 935697 - protein, 9 aa, Homo Sapiens
PLDCWVSIN

SEQ ID NO: 935698 - protein, 9 aa, Homo Sapiens
MSGLHGPDF

SEQ ID NO: 935699 - protein, 9 aa, Homo Sapiens
LGIFWVGAQ

SEQ ID NO: 935700 - protein, 9 aa, Homo Sapiens
LPENLGYYL

SEQ ID NO: 935701 - protein, 9 aa, Homo Sapiens
SDTGKTTCC

SEQ ID NO: 935702 - protein, 9 aa, Homo Sapiens
STSVQSPHP

SEQ ID NO: 935703 - protein, 9 aa, Homo Sapiens
VRGSEYDNF

SEQ ID NO: 935704 - protein, 9 aa, Homo Sapiens
GEQDIPYTH

SEQ ID NO: 935705 - protein, 9 aa, Homo Sapiens
VSPKKIISF

SEQ ID NO: 935706 - protein, 9 aa, Homo Sapiens
EQDEYAKHI

SEQ ID NO: 935707 - protein, 9 aa, Homo Sapiens
SVIEHQLSD

SEQ ID NO: 935708 - protein, 9 aa, Homo Sapiens
NEKINDVDV

SEQ ID NO: 935709 - protein, 9 aa, Homo Sapiens
FMDLDVVMR

SEQ ID NO: 935710 - protein, 9 aa, Homo Sapiens
VVNKFLDNL

SEQ ID NO: 935711 - protein, 9 aa, Homo Sapiens
DFRKKRVVY

SEQ ID NO: 935712 - protein, 9 aa, Homo Sapiens
ASLFITTKK

SEQ ID NO: 935713 - protein, 9 aa, Homo Sapiens
NEPGIAGSP

SEQ ID NO: 935714 - protein, 9 aa, Homo Sapiens
DQSFWEIFG

SEQ ID NO: 935715 - protein, 9 aa, Homo Sapiens
LLVQRCGGY

SEQ ID NO: 935716 - protein, 9 aa, Homo Sapiens
RNPPFASGL

SEQ ID NO: 935717 - protein, 9 aa, Homo Sapiens
EDLINKSET

SEQ ID NO: 935718 - protein, 9 aa, Homo Sapiens
RRGSEAGEK

SEQ ID NO: 935719 - protein, 9 aa, Homo Sapiens
SHTDVLLYT

SEQ ID NO: 935720 - protein, 9 aa, Homo Sapiens
ESDGERSPS

SEQ ID NO: 935721 - protein, 9 aa, Homo Sapiens
YQARSDGDK

SEQ ID NO: 935722 - protein, 9 aa, Homo Sapiens
FLFPSSSFL

SEQ ID NO: 935723 - protein, 9 aa, Homo Sapiens
ALCRTVGGK

SEQ ID NO: 935724 - protein, 9 aa, Homo Sapiens
LGFVASLAS

SEQ ID NO: 935725 - protein, 9 aa, Homo Sapiens
LMNRQWGTI

SEQ ID NO: 935726 - protein, 9 aa, Homo Sapiens
SNTGIGLGF

SEQ ID NO: 935727 - protein, 9 aa, Homo Sapiens
AHTAADTHI

SEQ ID NO: 935728 - protein, 9 aa, Homo Sapiens
KTKEELLLV

SEQ ID NO: 935729 - protein, 9 aa, Homo Sapiens
SQEDANFLF

SEQ ID NO: 935730 - protein, 9 aa, Homo Sapiens
ERISVTREG

SEQ ID NO: 935731 - protein, 9 aa, Homo Sapiens
KETLAAAAG

SEQ ID NO: 935732 - protein, 9 aa, Homo Sapiens
SEPSACPSG

SEQ ID NO: 935733 - protein, 9 aa, Homo Sapiens
LEQVARKHE

SEQ ID NO: 935734 - protein, 9 aa, Homo Sapiens
LESSPHYVI

SEQ ID NO: 935735 - protein, 9 aa, Homo Sapiens
SSEQALLRN

SEQ ID NO: 935736 - protein, 9 aa, Homo Sapiens
GDWYMVNDV

SEQ ID NO: 935737 - protein, 9 aa, Homo Sapiens
KHENKKMKE

SEQ ID NO: 935738 - protein, 9 aa, Homo Sapiens
SKDIFFVIN

SEQ ID NO: 935739 - protein, 9 aa, Homo Sapiens
VKDALCRTV

SEQ ID NO: 935740 - protein, 9 aa, Homo Sapiens
SKTRPQYSS

SEQ ID NO: 935741 - protein, 9 aa, Homo Sapiens
EATRWADFF

SEQ ID NO: 935742 - protein, 9 aa, Homo Sapiens
EYDNFLDEF

SEQ ID NO: 935743 - protein, 9 aa, Homo Sapiens
TTEEIKLED

SEQ ID NO: 935744 - protein, 9 aa, Homo Sapiens
PVTIHEILG

SEQ ID NO: 935745 - protein, 9 aa, Homo Sapiens
LHGPDFPGP

SEQ ID NO: 935746 - protein, 9 aa, Homo Sapiens
SLNQGLKSL

SEQ ID NO: 935747 - protein, 9 aa, Homo Sapiens
QKYMATVTS

SEQ ID NO: 935748 - protein, 9 aa, Homo Sapiens
PYSFVPAGS

SEQ ID NO: 935749 - protein, 9 aa, Homo Sapiens
SISRIRRNK

SEQ ID NO: 935750 - protein, 9 aa, Homo Sapiens
SLEGMERIS

SEQ ID NO: 935751 - protein, 9 aa, Homo Sapiens
NKTCRQTVT

SEQ ID NO: 935752 - protein, 9 aa, Homo Sapiens
CNIMKDFMI

SEQ ID NO: 935753 - protein, 9 aa, Homo Sapiens
VTLPQTVGP

SEQ ID NO: 935754 - protein, 9 aa, Homo Sapiens
PSPSTSVQS

SEQ ID NO: 935755 - protein, 9 aa, Homo Sapiens
NHLSLRIAD

SEQ ID NO: 935756 - protein, 9 aa, Homo Sapiens
QVSLPELED

SEQ ID NO: 935757 - protein, 9 aa, Homo Sapiens
AQKNGVKIT

SEQ ID NO: 935758 - protein, 9 aa, Homo Sapiens
PDEYRCVCS

SEQ ID NO: 935759 - protein, 9 aa, Homo Sapiens
PVMIKVVRG

SEQ ID NO: 935760 - protein, 9 aa, Homo Sapiens
TGKLQEPCV

SEQ ID NO: 935761 - protein, 9 aa, Homo Sapiens
QAQQQGETP

SEQ ID NO: 935762 - protein, 9 aa, Homo Sapiens
GHLSFCRFR

SEQ ID NO: 935763 - protein, 9 aa, Homo Sapiens
TIGEKENIG

SEQ ID NO: 935764 - protein, 9 aa, Homo Sapiens
YIIEVFSQS

SEQ ID NO: 935765 - protein, 9 aa, Homo Sapiens
DSLVSRLQA

SEQ ID NO: 935766 - protein, 9 aa, Homo Sapiens
LCQEDRSFW

SEQ ID NO: 935767 - protein, 9 aa, Homo Sapiens
SLVCYGKRG

SEQ ID NO: 935768 - protein, 9 aa, Homo Sapiens
VGHWPIPEF

SEQ ID NO: 935769 - protein, 9 aa, Homo Sapiens
TGYKIPLCN

SEQ ID NO: 935770 - protein, 9 aa, Homo Sapiens
GMSGLHGPD

SEQ ID NO: 935771 - protein, 9 aa, Homo Sapiens
KPFSSGPGS

SEQ ID NO: 935772 - protein, 9 aa, Homo Sapiens
APPRALGSA

SEQ ID NO: 935773 - protein, 9 aa, Homo Sapiens
QAKDSDLKT

SEQ ID NO: 935774 - protein, 9 aa, Homo Sapiens
LAIMKFIYD

SEQ ID NO: 935775 - protein, 9 aa, Homo Sapiens
LKDEMFSLS

SEQ ID NO: 935776 - protein, 9 aa, Homo Sapiens
LEKTEETLL

SEQ ID NO: 935777 - protein, 9 aa, Homo Sapiens
SMGFLARYN

SEQ ID NO: 935778 - protein, 9 aa, Homo Sapiens
PSLQGRQSP

SEQ ID NO: 935779 - protein, 9 aa, Homo Sapiens
FLNRGNDKH

SEQ ID NO: 935780 - protein, 9 aa, Homo Sapiens
PTIIPVLDA

SEQ ID NO: 935781 - protein, 9 aa, Homo Sapiens
TVSNISITR

SEQ ID NO: 935782 - protein, 9 aa, Homo Sapiens
VVTLPQTVG

SEQ ID NO: 935783 - protein, 9 aa, Homo Sapiens
YSLERDTVA

SEQ ID NO: 935784 - protein, 9 aa, Homo Sapiens
NCLSHTVPE

SEQ ID NO: 935785 - protein, 9 aa, Homo Sapiens
FVNIPENFF

SEQ ID NO: 935786 - protein, 9 aa, Homo Sapiens
DSALKDQDL

SEQ ID NO: 935787 - protein, 9 aa, Homo Sapiens
KKDNHLSLR

SEQ ID NO: 935788 - protein, 9 aa, Homo Sapiens
DWSQEDANF

SEQ ID NO: 935789 - protein, 9 aa, Homo Sapiens
CTDGTDRVS

SEQ ID NO: 935790 - protein, 9 aa, Homo Sapiens
RVSWYPSPS

SEQ ID NO: 935791 - protein, 9 aa, Homo Sapiens
ILKIISLNQ

SEQ ID NO: 935792 - protein, 9 aa, Homo Sapiens
LHYLERIHL

SEQ ID NO: 935793 - protein, 9 aa, Homo Sapiens
NSSSTGWNE

SEQ ID NO: 935794 - protein, 9 aa, Homo Sapiens
GWWGGEQDI

SEQ ID NO: 935795 - protein, 9 aa, Homo Sapiens
CTIRNTKMA

SEQ ID NO: 935796 - protein, 9 aa, Homo Sapiens
WVGEAAVLA

SEQ ID NO: 935797 - protein, 9 aa, Homo Sapiens
KRLTTYKDT

SEQ ID NO: 935798 - protein, 9 aa, Homo Sapiens
YIFLFIRDS

SEQ ID NO: 935799 - protein, 9 aa, Homo Sapiens
TSGENYHPV

SEQ ID NO: 935800 - protein, 9 aa, Homo Sapiens
GVIESLLMY

SEQ ID NO: 935801 - protein, 9 aa, Homo Sapiens
QCNSHFKSC

SEQ ID NO: 935802 - protein, 9 aa, Homo Sapiens
SIFRFPSSF

SEQ ID NO: 935803 - protein, 9 aa, Homo Sapiens
ENIYITDNS

SEQ ID NO: 935804 - protein, 9 aa, Homo Sapiens
VLRNPPFAS

SEQ ID NO: 935805 - protein, 9 aa, Homo Sapiens
APNQPGLGQ

SEQ ID NO: 935806 - protein, 9 aa, Homo Sapiens
EISAENIYI

SEQ ID NO: 935807 - protein, 9 aa, Homo Sapiens
PSSFLRITV

SEQ ID NO: 935808 - protein, 9 aa, Homo Sapiens
GPKFSECNC

SEQ ID NO: 935809 - protein, 9 aa, Homo Sapiens
PASAYIIEV

SEQ ID NO: 935810 - protein, 9 aa, Homo Sapiens
SFVPAGSEK

SEQ ID NO: 935811 - protein, 9 aa, Homo Sapiens
KIPDLFDSL

SEQ ID NO: 935812 - protein, 9 aa, Homo Sapiens
MEKPIKSVP

SEQ ID NO: 935813 - protein, 9 aa, Homo Sapiens
MKCSYCDFY

SEQ ID NO: 935814 - protein, 9 aa, Homo Sapiens
CCLCCCCGG

SEQ ID NO: 935815 - protein, 9 aa, Homo Sapiens
QKNGVKITF

SEQ ID NO: 935816 - protein, 9 aa, Homo Sapiens
AILFCGQRG

SEQ ID NO: 935817 - protein, 9 aa, Homo Sapiens
CRTVGGKFS

SEQ ID NO: 935818 - protein, 9 aa, Homo Sapiens
NPEILILDE

SEQ ID NO: 935819 - protein, 9 aa, Homo Sapiens
TDGTDRVSC

SEQ ID NO: 935820 - protein, 9 aa, Homo Sapiens
QLIVRVPSK

SEQ ID NO: 935821 - protein, 9 aa, Homo Sapiens
NDTSVHWFS

SEQ ID NO: 935822 - protein, 9 aa, Homo Sapiens
NTGKLQEPC

SEQ ID NO: 935823 - protein, 9 aa, Homo Sapiens
LSVLFPDVT

SEQ ID NO: 935824 - protein, 9 aa, Homo Sapiens
GKKDLIWEL

SEQ ID NO: 935825 - protein, 9 aa, Homo Sapiens
ATLHAARNT

SEQ ID NO: 935826 - protein, 9 aa, Homo Sapiens
WQSVFVKWD

SEQ ID NO: 935827 - protein, 9 aa, Homo Sapiens
SENIAFLGE

SEQ ID NO: 935828 - protein, 9 aa, Homo Sapiens
VSSTTGERV

SEQ ID NO: 935829 - protein, 9 aa, Homo Sapiens
CFAHGSEEQ

SEQ ID NO: 935830 - protein, 9 aa, Homo Sapiens
CSSCLLCCN

SEQ ID NO: 935831 - protein, 9 aa, Homo Sapiens
KDKMPTTSR

SEQ ID NO: 935832 - protein, 9 aa, Homo Sapiens
TAKFQELGL

SEQ ID NO: 935833 - protein, 9 aa, Homo Sapiens
FSGGLSPSS

SEQ ID NO: 935834 - protein, 9 aa, Homo Sapiens
FSKDIFFVI

SEQ ID NO: 935835 - protein, 9 aa, Homo Sapiens
SAKHENKKM

SEQ ID NO: 935836 - protein, 9 aa, Homo Sapiens
RIFYELTQT

SEQ ID NO: 935837 - protein, 9 aa, Homo Sapiens
KPIDFTMYT

SEQ ID NO: 935838 - protein, 9 aa, Homo Sapiens
RVSHSDTTP

SEQ ID NO: 935839 - protein, 9 aa, Homo Sapiens
SECNCPSMD

SEQ ID NO: 935840 - protein, 9 aa, Homo Sapiens
SLIQHERIY

SEQ ID NO: 935841 - protein, 9 aa, Homo Sapiens
LEDFVDRDH

SEQ ID NO: 935842 - protein, 9 aa, Homo Sapiens
LEKKRLFFL

SEQ ID NO: 935843 - protein, 9 aa, Homo Sapiens
LLSAVLRAL

SEQ ID NO: 935844 - protein, 9 aa, Homo Sapiens
NFFFWVGEA

SEQ ID NO: 935845 - protein, 9 aa, Homo Sapiens
YVKLLDREQ

SEQ ID NO: 935846 - protein, 9 aa, Homo Sapiens
TLHAARNTL

SEQ ID NO: 935847 - protein, 9 aa, Homo Sapiens
LQDFPLDCW

SEQ ID NO: 935848 - protein, 9 aa, Homo Sapiens
ALMFAKRRK

SEQ ID NO: 935849 - protein, 9 aa, Homo Sapiens
GEKSSTSLT

SEQ ID NO: 935850 - protein, 9 aa, Homo Sapiens
KFIYDMMGR

SEQ ID NO: 935851 - protein, 9 aa, Homo Sapiens
DFVDRDHVI

SEQ ID NO: 935852 - protein, 9 aa, Homo Sapiens
TLKPTLFLA

SEQ ID NO: 935853 - protein, 9 aa, Homo Sapiens
KPTLFLAVP

SEQ ID NO: 935854 - protein, 9 aa, Homo Sapiens
IFWVGAQEI

SEQ ID NO: 935855 - protein, 9 aa, Homo Sapiens
NSNPCDFFA

SEQ ID NO: 935856 - protein, 9 aa, Homo Sapiens
TIDFFEMCA

SEQ ID NO: 935857 - protein, 9 aa, Homo Sapiens
STVDPSEAL

SEQ ID NO: 935858 - protein, 9 aa, Homo Sapiens
KTEETLLTL

SEQ ID NO: 935859 - protein, 9 aa, Homo Sapiens
LEAKKLLSA

SEQ ID NO: 935860 - protein, 9 aa, Homo Sapiens
LDPLESSRN

SEQ ID NO: 935861 - protein, 9 aa, Homo Sapiens
VMYLLVPFL

SEQ ID NO: 935862 - protein, 9 aa, Homo Sapiens
KFSIFRFPS

SEQ ID NO: 935863 - protein, 9 aa, Homo Sapiens
KAQICKSVC

SEQ ID NO: 935864 - protein, 9 aa, Homo Sapiens
CSEYLPSIE

SEQ ID NO: 935865 - protein, 9 aa, Homo Sapiens
VQSQAKDSD

SEQ ID NO: 935866 - protein, 9 aa, Homo Sapiens
HPRSHHKDR

SEQ ID NO: 935867 - protein, 9 aa, Homo Sapiens
FKSCHYNIS

SEQ ID NO: 935868 - protein, 9 aa, Homo Sapiens
SVRTPGGCV

SEQ ID NO: 935869 - protein, 9 aa, Homo Sapiens
GCVKEGGLK

SEQ ID NO: 935870 - protein, 9 aa, Homo Sapiens
LHSLRSALR

SEQ ID NO: 935871 - protein, 9 aa, Homo Sapiens
PFHRRLCPG

SEQ ID NO: 935872 - protein, 9 aa, Homo Sapiens
DFSIMKFSL

SEQ ID NO: 935873 - protein, 9 aa, Homo Sapiens
RNYLSSVGK

SEQ ID NO: 935874 - protein, 9 aa, Homo Sapiens
IKKLRCYLK

SEQ ID NO: 935875 - protein, 9 aa, Homo Sapiens
MGDQIPNTP

SEQ ID NO: 935876 - protein, 9 aa, Homo Sapiens
HQAFLETRR

SEQ ID NO: 935877 - protein, 9 aa, Homo Sapiens
GPSSFLRIT

SEQ ID NO: 935878 - protein, 9 aa, Homo Sapiens
MKDIRNYFQ

SEQ ID NO: 935879 - protein, 9 aa, Homo Sapiens
DFKKAHHLK

SEQ ID NO: 935880 - protein, 9 aa, Homo Sapiens
GPARGTERC

SEQ ID NO: 935881 - protein, 9 aa, Homo Sapiens
PELEDRLQC

SEQ ID NO: 935882 - protein, 9 aa, Homo Sapiens
ESVPSRFRR

SEQ ID NO: 935883 - protein, 9 aa, Homo Sapiens
ASPRPYSFV

SEQ ID NO: 935884 - protein, 9 aa, Homo Sapiens
VQESDGERS

SEQ ID NO: 935885 - protein, 9 aa, Homo Sapiens
CPKGIVLLL

SEQ ID NO: 935886 - protein, 9 aa, Homo Sapiens
RHLPGKDVK

SEQ ID NO: 935887 - protein, 9 aa, Homo Sapiens
GKEFGPLTR

SEQ ID NO: 935888 - protein, 9 aa, Homo Sapiens
TVLLNKKDN

SEQ ID NO: 935889 - protein, 9 aa, Homo Sapiens
TTYVKCPTL

SEQ ID NO: 935890 - protein, 9 aa, Homo Sapiens
AASSMALPA

SEQ ID NO: 935891 - protein, 9 aa, Homo Sapiens
MLVDLVSPK

SEQ ID NO: 935892 - protein, 9 aa, Homo Sapiens
NFLEQERAA

SEQ ID NO: 935893 - protein, 9 aa, Homo Sapiens
FSECNCPSM

SEQ ID NO: 935894 - protein, 9 aa, Homo Sapiens
QMDGTDDRS

SEQ ID NO: 935895 - protein, 9 aa, Homo Sapiens
PSTSVQSPH

SEQ ID NO: 935896 - protein, 9 aa, Homo Sapiens
VKMLKKEAS

SEQ ID NO: 935897 - protein, 9 aa, Homo Sapiens
LKVVHEQLA

SEQ ID NO: 935898 - protein, 9 aa, Homo Sapiens
NKEMLFNRR

SEQ ID NO: 935899 - protein, 9 aa, Homo Sapiens
SHFKSCHYN

SEQ ID NO: 935900 - protein, 9 aa, Homo Sapiens
DQCPKGIVL

SEQ ID NO: 935901 - protein, 9 aa, Homo Sapiens
VLPVPVLSD

SEQ ID NO: 935902 - protein, 9 aa, Homo Sapiens
SIMKFSLYF

SEQ ID NO: 935903 - protein, 9 aa, Homo Sapiens
EEATTPMPQ

SEQ ID NO: 935904 - protein, 9 aa, Homo Sapiens
ALLRNVQLD

SEQ ID NO: 935905 - protein, 9 aa, Homo Sapiens
SIRPFKLSE

SEQ ID NO: 935906 - protein, 9 aa, Homo Sapiens
ENIGLPGLP

SEQ ID NO: 935907 - protein, 9 aa, Homo Sapiens
ARAECSACL

SEQ ID NO: 935908 - protein, 9 aa, Homo Sapiens
CYVAISKPL

SEQ ID NO: 935909 - protein, 9 aa, Homo Sapiens
QVEERLDME

SEQ ID NO: 935910 - protein, 9 aa, Homo Sapiens
AFDTYYCGF

SEQ ID NO: 935911 - protein, 9 aa, Homo Sapiens
HRGFYCNNE

SEQ ID NO: 935912 - protein, 9 aa, Homo Sapiens
NPSPQPQSL

SEQ ID NO: 935913 - protein, 9 aa, Homo Sapiens
SNVHINTIE

SEQ ID NO: 935914 - protein, 9 aa, Homo Sapiens
KPCGDSPSF

SEQ ID NO: 935915 - protein, 9 aa, Homo Sapiens
VFSLPKGER

SEQ ID NO: 935916 - protein, 9 aa, Homo Sapiens
YLSPAVVVR

SEQ ID NO: 935917 - protein, 9 aa, Homo Sapiens
AKVDQKRGK

SEQ ID NO: 935918 - protein, 9 aa, Homo Sapiens
LSGHLSFCR

SEQ ID NO: 935919 - protein, 9 aa, Homo Sapiens
EETLLTLKN

SEQ ID NO: 935920 - protein, 9 aa, Homo Sapiens
VYVQTMLRY

SEQ ID NO: 935921 - protein, 9 aa, Homo Sapiens
VGEAAVLAV

SEQ ID NO: 935922 - protein, 9 aa, Homo Sapiens
QQQGETPAV

SEQ ID NO: 935923 - protein, 9 aa, Homo Sapiens
ASPTIIPVL

SEQ ID NO: 935924 - protein, 9 aa, Homo Sapiens
KLIKLPSSS

SEQ ID NO: 935925 - protein, 9 aa, Homo Sapiens
LMEKPIKSV

SEQ ID NO: 935926 - protein, 9 aa, Homo Sapiens
LSEQYLEAM

SEQ ID NO: 935927 - protein, 9 aa, Homo Sapiens
IINEKINDV

SEQ ID NO: 935928 - protein, 9 aa, Homo Sapiens
KLRGLLDCK

SEQ ID NO: 935929 - protein, 9 aa, Homo Sapiens
TGIGLGFVA

SEQ ID NO: 935930 - protein, 9 aa, Homo Sapiens
EVNKCDLPE

SEQ ID NO: 935931 - protein, 9 aa, Homo Sapiens
PEILILDEP

SEQ ID NO: 935932 - protein, 9 aa, Homo Sapiens
KMFTVFLHC

SEQ ID NO: 935933 - protein, 9 aa, Homo Sapiens
SDLKTLFTK

SEQ ID NO: 935934 - protein, 9 aa, Homo Sapiens
GRSVFVSLK

SEQ ID NO: 935935 - protein, 9 aa, Homo Sapiens
VRAHASRGN

SEQ ID NO: 935936 - protein, 9 aa, Homo Sapiens
FAIFRQNSS

SEQ ID NO: 935937 - protein, 9 aa, Homo Sapiens
VKHKNQKMF

SEQ ID NO: 935938 - protein, 9 aa, Homo Sapiens
DTYQMDGTD

SEQ ID NO: 935939 - protein, 9 aa, Homo Sapiens
DNFLDEFME

SEQ ID NO: 935940 - protein, 9 aa, Homo Sapiens
SEHDLTPMN

SEQ ID NO: 935941 - protein, 9 aa, Homo Sapiens
CLPSPSTSV

SEQ ID NO: 935942 - protein, 9 aa, Homo Sapiens
KKMFLHVKG

SEQ ID NO: 935943 - protein, 9 aa, Homo Sapiens
IRTLFFVTG

SEQ ID NO: 935944 - protein, 9 aa, Homo Sapiens
CSPSLPRLQ

SEQ ID NO: 935945 - protein, 9 aa, Homo Sapiens
LSHTVPETS

SEQ ID NO: 935946 - protein, 9 aa, Homo Sapiens
NKPESGVLF

SEQ ID NO: 935947 - protein, 9 aa, Homo Sapiens
SKFASLKDV

SEQ ID NO: 935948 - protein, 9 aa, Homo Sapiens
QRAPGIEKK

SEQ ID NO: 935949 - protein, 9 aa, Homo Sapiens
LEEILALVV

SEQ ID NO: 935950 - protein, 9 aa, Homo Sapiens
QTTPSLQGR

SEQ ID NO: 935951 - protein, 9 aa, Homo Sapiens
MERISVTRE

SEQ ID NO: 935952 - protein, 9 aa, Homo Sapiens
GPLLCQEDR

SEQ ID NO: 935953 - protein, 9 aa, Homo Sapiens
KLTCGNLLE

SEQ ID NO: 935954 - protein, 9 aa, Homo Sapiens
KTVAQQIYG

SEQ ID NO: 935955 - protein, 9 aa, Homo Sapiens
RFEIQHRLQ

SEQ ID NO: 935956 - protein, 9 aa, Homo Sapiens
LDCKGSWKK

SEQ ID NO: 935957 - protein, 9 aa, Homo Sapiens
LTSWLAPIV

SEQ ID NO: 935958 - protein, 9 aa, Homo Sapiens
ARHLAQLME

SEQ ID NO: 935959 - protein, 9 aa, Homo Sapiens
HEERMKNNQ

SEQ ID NO: 935960 - protein, 9 aa, Homo Sapiens
SHSDTTPLV

SEQ ID NO: 935961 - protein, 9 aa, Homo Sapiens
EVQGALHRA

SEQ ID NO: 935962 - protein, 9 aa, Homo Sapiens
PYEMAVVVR

SEQ ID NO: 935963 - protein, 9 aa, Homo Sapiens
IERLESSPH

SEQ ID NO: 935964 - protein, 9 aa, Homo Sapiens
DLGLNPTSV

SEQ ID NO: 935965 - protein, 9 aa, Homo Sapiens
GGESSNLFE

SEQ ID NO: 935966 - protein, 9 aa, Homo Sapiens
SLCNTIESG

SEQ ID NO: 935967 - protein, 9 aa, Homo Sapiens
QKLNAKEGN

SEQ ID NO: 935968 - protein, 9 aa, Homo Sapiens
RGPHIEDGK

SEQ ID NO: 935969 - protein, 9 aa, Homo Sapiens
VSVVPQKST

SEQ ID NO: 935970 - protein, 9 aa, Homo Sapiens
KDALEIYKQ

SEQ ID NO: 935971 - protein, 9 aa, Homo Sapiens
KVLEDFVDR

SEQ ID NO: 935972 - protein, 9 aa, Homo Sapiens
KIKDMFSGK

SEQ ID NO: 935973 - protein, 9 aa, Homo Sapiens
VVGTVFIIR

SEQ ID NO: 935974 - protein, 9 aa, Homo Sapiens
TLFFVTGIL

SEQ ID NO: 935975 - protein, 9 aa, Homo Sapiens
GVKITFPVD

SEQ ID NO: 935976 - protein, 9 aa, Homo Sapiens
SPGSNGGWT

SEQ ID NO: 935977 - protein, 9 aa, Homo Sapiens
GHSQKFPTC

SEQ ID NO: 935978 - protein, 9 aa, Homo Sapiens
ISDSKIIST

SEQ ID NO: 935979 - protein, 9 aa, Homo Sapiens
KVDQKRGKK

SEQ ID NO: 935980 - protein, 9 aa, Homo Sapiens
SYCDFYFMK

SEQ ID NO: 935981 - protein, 9 aa, Homo Sapiens
TWILFLPMA

SEQ ID NO: 935982 - protein, 9 aa, Homo Sapiens
DEKEQKQLF

SEQ ID NO: 935983 - protein, 9 aa, Homo Sapiens
LSSESSWYN

SEQ ID NO: 935984 - protein, 9 aa, Homo Sapiens
GGVAPNQPG

SEQ ID NO: 935985 - protein, 9 aa, Homo Sapiens
VPQRSQAVH

SEQ ID NO: 935986 - protein, 9 aa, Homo Sapiens
EVLLLLPLQ

SEQ ID NO: 935987 - protein, 9 aa, Homo Sapiens
IQHERIYTG

SEQ ID NO: 935988 - protein, 9 aa, Homo Sapiens
LGNQNLRLI

SEQ ID NO: 935989 - protein, 9 aa, Homo Sapiens
FVPAGSEKP

SEQ ID NO: 935990 - protein, 9 aa, Homo Sapiens
TQSGQLVDA

SEQ ID NO: 935991 - protein, 9 aa, Homo Sapiens
CKQLECPFS

SEQ ID NO: 935992 - protein, 9 aa, Homo Sapiens
SMGGKKDLI

SEQ ID NO: 935993 - protein, 9 aa, Homo Sapiens
ARKHEEYQA

SEQ ID NO: 935994 - protein, 9 aa, Homo Sapiens
RMLVMYLLA

SEQ ID NO: 935995 - protein, 9 aa, Homo Sapiens
SKFSIFRFP

SEQ ID NO: 935996 - protein, 9 aa, Homo Sapiens
QGPEEISLS

SEQ ID NO: 935997 - protein, 9 aa, Homo Sapiens
FAHGLHNPG

SEQ ID NO: 935998 - protein, 9 aa, Homo Sapiens
EGNVPQLDA

SEQ ID NO: 935999 - protein, 9 aa, Homo Sapiens
SPRLGSHTI

SEQ ID NO: 936000 - protein, 9 aa, Homo Sapiens
FHRRLCPGA

SEQ ID NO: 936001 - protein, 9 aa, Homo Sapiens
PPSHARYSS

SEQ ID NO: 936002 - protein, 9 aa, Homo Sapiens
VGKLSEYRN

SEQ ID NO: 936003 - protein, 9 aa, Homo Sapiens
HENKKMKEK

SEQ ID NO: 936004 - protein, 9 aa, Homo Sapiens
TTGERVITR

SEQ ID NO: 936005 - protein, 9 aa, Homo Sapiens
MQSYSTIVN

SEQ ID NO: 936006 - protein, 9 aa, Homo Sapiens
ILALKDNSY

SEQ ID NO: 936007 - protein, 9 aa, Homo Sapiens
DPSLCLSDP

SEQ ID NO: 936008 - protein, 9 aa, Homo Sapiens
EYLPSIESD

SEQ ID NO: 936009 - protein, 9 aa, Homo Sapiens
LQQKLEKVL

SEQ ID NO: 936010 - protein, 9 aa, Homo Sapiens
NELELGNQN

SEQ ID NO: 936011 - protein, 9 aa, Homo Sapiens
FFWPDQNLP

SEQ ID NO: 936012 - protein, 9 aa, Homo Sapiens
FPSSSFLSS

SEQ ID NO: 936013 - protein, 9 aa, Homo Sapiens
FLINPLLYT

SEQ ID NO: 936014 - protein, 9 aa, Homo Sapiens
NLNEKYGES

SEQ ID NO: 936015 - protein, 9 aa, Homo Sapiens
TMMAGGRSV

SEQ ID NO: 936016 - protein, 9 aa, Homo Sapiens
RWLEAWWIG

SEQ ID NO: 936017 - protein, 9 aa, Homo Sapiens
LVYNGIIFL

SEQ ID NO: 936018 - protein, 9 aa, Homo Sapiens
PSAPWINPS

SEQ ID NO: 936019 - protein, 9 aa, Homo Sapiens
KSSAHLHRE

SEQ ID NO: 936020 - protein, 9 aa, Homo Sapiens
EYRCVCSPG

SEQ ID NO: 936021 - protein, 9 aa, Homo Sapiens
NTQVTDIDY

SEQ ID NO: 936022 - protein, 9 aa, Homo Sapiens
GVRQSVPYE

SEQ ID NO: 936023 - protein, 9 aa, Homo Sapiens
VFQMALEDL

SEQ ID NO: 936024 - protein, 9 aa, Homo Sapiens
FILALKDNS

SEQ ID NO: 936025 - protein, 9 aa, Homo Sapiens
FISFILAGE

SEQ ID NO: 936026 - protein, 9 aa, Homo Sapiens
IYKQFLTRM

SEQ ID NO: 936027 - protein, 9 aa, Homo Sapiens
VVLPTSLLL

SEQ ID NO: 936028 - protein, 9 aa, Homo Sapiens
IRRNKIGSL

SEQ ID NO: 936029 - protein, 9 aa, Homo Sapiens
EAANRLCMI

SEQ ID NO: 936030 - protein, 9 aa, Homo Sapiens
SLEKTEETL

SEQ ID NO: 936031 - protein, 9 aa, Homo Sapiens
ISKETKDKQ

SEQ ID NO: 936032 - protein, 9 aa, Homo Sapiens
KQPQKRSQA

SEQ ID NO: 936033 - protein, 9 aa, Homo Sapiens
DHGASLFIT

SEQ ID NO: 936034 - protein, 9 aa, Homo Sapiens
WLGYVNFLI

SEQ ID NO: 936035 - protein, 9 aa, Homo Sapiens
SSCLLCCNN

SEQ ID NO: 936036 - protein, 9 aa, Homo Sapiens
RSIISLYFQ

SEQ ID NO: 936037 - protein, 9 aa, Homo Sapiens
DFVNIPENF

SEQ ID NO: 936038 - protein, 9 aa, Homo Sapiens
RSSLTKLKG

SEQ ID NO: 936039 - protein, 9 aa, Homo Sapiens
RRIENKILI

SEQ ID NO: 936040 - protein, 9 aa, Homo Sapiens
LRRGFDWSL

SEQ ID NO: 936041 - protein, 9 aa, Homo Sapiens
QARSDGDKE

SEQ ID NO: 936042 - protein, 9 aa, Homo Sapiens
AAAATSGLG

SEQ ID NO: 936043 - protein, 9 aa, Homo Sapiens
KNNQPQPSY

SEQ ID NO: 936044 - protein, 9 aa, Homo Sapiens
RLLNRFYRR

SEQ ID NO: 936045 - protein, 9 aa, Homo Sapiens
PFKLSEQYL

SEQ ID NO: 936046 - protein, 9 aa, Homo Sapiens
KGATQVVWN

SEQ ID NO: 936047 - protein, 9 aa, Homo Sapiens
KKMRRKQKQ

SEQ ID NO: 936048 - protein, 9 aa, Homo Sapiens
RLEGSQGGV

SEQ ID NO: 936049 - protein, 9 aa, Homo Sapiens
LVALSWREG

SEQ ID NO: 936050 - protein, 9 aa, Homo Sapiens
PSLCLSDPE

SEQ ID NO: 936051 - protein, 9 aa, Homo Sapiens
NLQKLILLD

SEQ ID NO: 936052 - protein, 9 aa, Homo Sapiens
KIFYVSHDS

SEQ ID NO: 936053 - protein, 9 aa, Homo Sapiens
QWGTICDHR

SEQ ID NO: 936054 - protein, 9 aa, Homo Sapiens
SYLSLVLQH

SEQ ID NO: 936055 - protein, 9 aa, Homo Sapiens
LTPMNGETF

SEQ ID NO: 936056 - protein, 9 aa, Homo Sapiens
DEKKPFKKK

SEQ ID NO: 936057 - protein, 9 aa, Homo Sapiens
RLQADARTV

SEQ ID NO: 936058 - protein, 9 aa, Homo Sapiens
SGPEKVPLP

SEQ ID NO: 936059 - protein, 9 aa, Homo Sapiens
GEPADLSGE

SEQ ID NO: 936060 - protein, 9 aa, Homo Sapiens
RNCNLIQIG

SEQ ID NO: 936061 - protein, 9 aa, Homo Sapiens
SPSSGFDGG

SEQ ID NO: 936062 - protein, 9 aa, Homo Sapiens
IVEQTPKLS

SEQ ID NO: 936063 - protein, 9 aa, Homo Sapiens
VWNCNKEKW

SEQ ID NO: 936064 - protein, 9 aa, Homo Sapiens
KTTANEAEL

SEQ ID NO: 936065 - protein, 9 aa, Homo Sapiens
VCYGKRGLL

SEQ ID NO: 936066 - protein, 9 aa, Homo Sapiens
ETYRGVNLR

SEQ ID NO: 936067 - protein, 9 aa, Homo Sapiens
GASLFITTK

SEQ ID NO: 936068 - protein, 9 aa, Homo Sapiens
AFECSPSLP

SEQ ID NO: 936069 - protein, 9 aa, Homo Sapiens
PEEEDVGND

SEQ ID NO: 936070 - protein, 9 aa, Homo Sapiens
QANYNLLSA

SEQ ID NO: 936071 - protein, 9 aa, Homo Sapiens
LPVPVLSDN

SEQ ID NO: 936072 - protein, 9 aa, Homo Sapiens
YPSPSPVLG

SEQ ID NO: 936073 - protein, 9 aa, Homo Sapiens
PNSQSKFSI

SEQ ID NO: 936074 - protein, 9 aa, Homo Sapiens
RIENKILIL

SEQ ID NO: 936075 - protein, 9 aa, Homo Sapiens
EQLKVVHEQ

SEQ ID NO: 936076 - protein, 9 aa, Homo Sapiens
HGHGPSSFL

SEQ ID NO: 936077 - protein, 9 aa, Homo Sapiens
MGGKKDLIW

SEQ ID NO: 936078 - protein, 9 aa, Homo Sapiens
IQLQLKETQ

SEQ ID NO: 936079 - protein, 9 aa, Homo Sapiens
GFVASLASY

SEQ ID NO: 936080 - protein, 9 aa, Homo Sapiens
TDTAKFQEL

SEQ ID NO: 936081 - protein, 9 aa, Homo Sapiens
QNFVLLDAY

SEQ ID NO: 936082 - protein, 9 aa, Homo Sapiens
VQGGIFVER

SEQ ID NO: 936083 - protein, 9 aa, Homo Sapiens
RGSEYDNFL

SEQ ID NO: 936084 - protein, 9 aa, Homo Sapiens
SRNFLSHGL

SEQ ID NO: 936085 - protein, 9 aa, Homo Sapiens
GKNVTVEIM

SEQ ID NO: 936086 - protein, 9 aa, Homo Sapiens
YSLLKRFLL

SEQ ID NO: 936087 - protein, 9 aa, Homo Sapiens
GRWRGTSRL

SEQ ID NO: 936088 - protein, 9 aa, Homo Sapiens
YVKSSVGCV

SEQ ID NO: 936089 - protein, 9 aa, Homo Sapiens
KNAQIKNAI

SEQ ID NO: 936090 - protein, 9 aa, Homo Sapiens
WNPEILILD

SEQ ID NO: 936091 - protein, 9 aa, Homo Sapiens
SWPRLIKKL

SEQ ID NO: 936092 - protein, 9 aa, Homo Sapiens
LLIVANRGT

SEQ ID NO: 936093 - protein, 9 aa, Homo Sapiens
KMAVGIVIY

SEQ ID NO: 936094 - protein, 9 aa, Homo Sapiens
VLFAASLEM

SEQ ID NO: 936095 - protein, 9 aa, Homo Sapiens
FELVIGGMK

SEQ ID NO: 936096 - protein, 9 aa, Homo Sapiens
LQAQQQGET

SEQ ID NO: 936097 - protein, 9 aa, Homo Sapiens
MFTVFLHCV

SEQ ID NO: 936098 - protein, 9 aa, Homo Sapiens
ITCNQKRKH

SEQ ID NO: 936099 - protein, 9 aa, Homo Sapiens
AKAQKNGVK

SEQ ID NO: 936100 - protein, 9 aa, Homo Sapiens
LKSSAHLHR

SEQ ID NO: 936101 - protein, 9 aa, Homo Sapiens
VFIIRGLRS

SEQ ID NO: 936102 - protein, 9 aa, Homo Sapiens
FAHGSEEQI

SEQ ID NO: 936103 - protein, 9 aa, Homo Sapiens
LEPLATMSH

SEQ ID NO: 936104 - protein, 9 aa, Homo Sapiens
QCPKGIVLL

SEQ ID NO: 936105 - protein, 9 aa, Homo Sapiens
SLSLWAVPA

SEQ ID NO: 936106 - protein, 9 aa, Homo Sapiens
NFLFLEVDH

SEQ ID NO: 936107 - protein, 9 aa, Homo Sapiens
IVLGRYLDS

SEQ ID NO: 936108 - protein, 9 aa, Homo Sapiens
SFFFSSALL

SEQ ID NO: 936109 - protein, 9 aa, Homo Sapiens
YMYRHSHNG

SEQ ID NO: 936110 - protein, 9 aa, Homo Sapiens
EKALDAIID

SEQ ID NO: 936111 - protein, 9 aa, Homo Sapiens
YPVMIKVVR

SEQ ID NO: 936112 - protein, 9 aa, Homo Sapiens
ILAPGSYLS

SEQ ID NO: 936113 - protein, 9 aa, Homo Sapiens
ASETQSGQL

SEQ ID NO: 936114 - protein, 9 aa, Homo Sapiens
ILNHFIGFS

SEQ ID NO: 936115 - protein, 9 aa, Homo Sapiens
CNMCGLQTL

SEQ ID NO: 936116 - protein, 9 aa, Homo Sapiens
HPSPWARLL

SEQ ID NO: 936117 - protein, 9 aa, Homo Sapiens
NRRACHILK

SEQ ID NO: 936118 - protein, 9 aa, Homo Sapiens
YLERIHLHH

SEQ ID NO: 936119 - protein, 9 aa, Homo Sapiens
KVGAWGDYN

SEQ ID NO: 936120 - protein, 9 aa, Homo Sapiens
EQDIPYTHT

SEQ ID NO: 936121 - protein, 9 aa, Homo Sapiens
KFLDNLGNA

SEQ ID NO: 936122 - protein, 9 aa, Homo Sapiens
ASVTALSCW

SEQ ID NO: 936123 - protein, 9 aa, Homo Sapiens
NPCDFFAFG

SEQ ID NO: 936124 - protein, 9 aa, Homo Sapiens
VCSIRPFKL

SEQ ID NO: 936125 - protein, 9 aa, Homo Sapiens
SNLQKLILL

SEQ ID NO: 936126 - protein, 9 aa, Homo Sapiens
TLRILKIIS

SEQ ID NO: 936127 - protein, 9 aa, Homo Sapiens
FTAFDTYYC

SEQ ID NO: 936128 - protein, 9 aa, Homo Sapiens
LCCNNRHFW

SEQ ID NO: 936129 - protein, 9 aa, Homo Sapiens
TQRNCNLIQ

SEQ ID NO: 936130 - protein, 9 aa, Homo Sapiens
KENIGLPGL

SEQ ID NO: 936131 - protein, 9 aa, Homo Sapiens
TCRQTVTEG

SEQ ID NO: 936132 - protein, 9 aa, Homo Sapiens
LHGDICNMC

SEQ ID NO: 936133 - protein, 9 aa, Homo Sapiens
RRYTRDEFD

SEQ ID NO: 936134 - protein, 9 aa, Homo Sapiens
LFLPMAWGD

SEQ ID NO: 936135 - protein, 9 aa, Homo Sapiens
YLQDSALKD

SEQ ID NO: 936136 - protein, 9 aa, Homo Sapiens
DSLYGARHL

SEQ ID NO: 936137 - protein, 9 aa, Homo Sapiens
SKVLTSVSD

SEQ ID NO: 936138 - protein, 9 aa, Homo Sapiens
IESASELRR

SEQ ID NO: 936139 - protein, 9 aa, Homo Sapiens
EDWNNYKNF

SEQ ID NO: 936140 - protein, 9 aa, Homo Sapiens
TSGSKVLTS

SEQ ID NO: 936141 - protein, 9 aa, Homo Sapiens
GPNVIKGNR

SEQ ID NO: 936142 - protein, 9 aa, Homo Sapiens
SAASPTIIP

SEQ ID NO: 936143 - protein, 9 aa, Homo Sapiens
KNVTVEIMY

SEQ ID NO: 936144 - protein, 9 aa, Homo Sapiens
LCCCCGGGG

SEQ ID NO: 936145 - protein, 9 aa, Homo Sapiens
VIGMLYVMI

SEQ ID NO: 936146 - protein, 9 aa, Homo Sapiens
GGYCGCGTV

SEQ ID NO: 936147 - protein, 9 aa, Homo Sapiens
IWKQSKKFS

SEQ ID NO: 936148 - protein, 9 aa, Homo Sapiens
FIYDMMGRH

SEQ ID NO: 936149 - protein, 9 aa, Homo Sapiens
STCTFHMIV

SEQ ID NO: 936150 - protein, 9 aa, Homo Sapiens
ETKDKQLED

SEQ ID NO: 936151 - protein, 9 aa, Homo Sapiens
RELSFYVSV

SEQ ID NO: 936152 - protein, 9 aa, Homo Sapiens
QVLSGHLSF

SEQ ID NO: 936153 - protein, 9 aa, Homo Sapiens
TATLDNFAK

SEQ ID NO: 936154 - protein, 9 aa, Homo Sapiens
DKQLEDGYF

SEQ ID NO: 936155 - protein, 9 aa, Homo Sapiens
WYMVNDVLS

SEQ ID NO: 936156 - protein, 9 aa, Homo Sapiens
HIEDGKLVK

SEQ ID NO: 936157 - protein, 9 aa, Homo Sapiens
LFESFFGEK

SEQ ID NO: 936158 - protein, 9 aa, Homo Sapiens
PGGCVKEGG

SEQ ID NO: 936159 - protein, 9 aa, Homo Sapiens
NPLENLKLT

SEQ ID NO: 936160 - protein, 9 aa, Homo Sapiens
PEEISLSLW

SEQ ID NO: 936161 - protein, 9 aa, Homo Sapiens
PIKEYRQEG

SEQ ID NO: 936162 - protein, 9 aa, Homo Sapiens
FSSGPGSGT

SEQ ID NO: 936163 - protein, 9 aa, Homo Sapiens
LQDQRIVGY

SEQ ID NO: 936164 - protein, 9 aa, Homo Sapiens
QFLTRMTRV

SEQ ID NO: 936165 - protein, 9 aa, Homo Sapiens
PQYSSPSLG

SEQ ID NO: 936166 - protein, 9 aa, Homo Sapiens
EAKKLLSAV

SEQ ID NO: 936167 - protein, 9 aa, Homo Sapiens
PIPSFFRAL

SEQ ID NO: 936168 - protein, 9 aa, Homo Sapiens
ELSFYVSVS

SEQ ID NO: 936169 - protein, 9 aa, Homo Sapiens
FTPLHYLER

SEQ ID NO: 936170 - protein, 9 aa, Homo Sapiens
LLKRFLLHP

SEQ ID NO: 936171 - protein, 9 aa, Homo Sapiens
FEETLMLVA

SEQ ID NO: 936172 - protein, 9 aa, Homo Sapiens
HWPIPEFFW

SEQ ID NO: 936173 - protein, 9 aa, Homo Sapiens
LLRHLEPLA

SEQ ID NO: 936174 - protein, 9 aa, Homo Sapiens
PHYVISLKA

SEQ ID NO: 936175 - protein, 9 aa, Homo Sapiens
QESDGERSP

SEQ ID NO: 936176 - protein, 9 aa, Homo Sapiens
NESKDTDSK

SEQ ID NO: 936177 - protein, 9 aa, Homo Sapiens
SVHWFSVQK

SEQ ID NO: 936178 - protein, 9 aa, Homo Sapiens
MLHQDIQEV

SEQ ID NO: 936179 - protein, 9 aa, Homo Sapiens
AKLIKLPSS

SEQ ID NO: 936180 - protein, 9 aa, Homo Sapiens
ADPRHLPGK

SEQ ID NO: 936181 - protein, 9 aa, Homo Sapiens
ISLPHTISK

SEQ ID NO: 936182 - protein, 9 aa, Homo Sapiens
PAVVVRFSA

SEQ ID NO: 936183 - protein, 9 aa, Homo Sapiens
DTQPEDGVK

SEQ ID NO: 936184 - protein, 9 aa, Homo Sapiens
SDRDGYGGC

SEQ ID NO: 936185 - protein, 9 aa, Homo Sapiens
EPRELSFYV

SEQ ID NO: 936186 - protein, 9 aa, Homo Sapiens
TVAALFYTV

SEQ ID NO: 936187 - protein, 9 aa, Homo Sapiens
LEQDEYAKH

SEQ ID NO: 936188 - protein, 9 aa, Homo Sapiens
VSISLSVLF

SEQ ID NO: 936189 - protein, 9 aa, Homo Sapiens
NDVDSNDLK

SEQ ID NO: 936190 - protein, 9 aa, Homo Sapiens
DFFMDPASA

SEQ ID NO: 936191 - protein, 9 aa, Homo Sapiens
YHGHGPSSF

SEQ ID NO: 936192 - protein, 9 aa, Homo Sapiens
AGRDFYEEN

SEQ ID NO: 936193 - protein, 9 aa, Homo Sapiens
NEAFEETLM

SEQ ID NO: 936194 - protein, 9 aa, Homo Sapiens
PTLCQTYVK

SEQ ID NO: 936195 - protein, 9 aa, Homo Sapiens
FSTCTFHMI

SEQ ID NO: 936196 - protein, 9 aa, Homo Sapiens
VPEKALDAI

SEQ ID NO: 936197 - protein, 9 aa, Homo Sapiens
AVRMIQNFP

SEQ ID NO: 936198 - protein, 9 aa, Homo Sapiens
LSDRAQHQA

SEQ ID NO: 936199 - protein, 9 aa, Homo Sapiens
CCNNRHFWM

SEQ ID NO: 936200 - protein, 9 aa, Homo Sapiens
LSWREGFIH

SEQ ID NO: 936201 - protein, 9 aa, Homo Sapiens
GIPFNTQVT

SEQ ID NO: 936202 - protein, 9 aa, Homo Sapiens
QDPSNSDSG

SEQ ID NO: 936203 - protein, 9 aa, Homo Sapiens
VNHILNSKS

SEQ ID NO: 936204 - protein, 9 aa, Homo Sapiens
QASVQDTAY

SEQ ID NO: 936205 - protein, 9 aa, Homo Sapiens
HAGPIVVYC

SEQ ID NO: 936206 - protein, 9 aa, Homo Sapiens
VIFFFLFIT

SEQ ID NO: 936207 - protein, 9 aa, Homo Sapiens
NRGTLSVIS

SEQ ID NO: 936208 - protein, 9 aa, Homo Sapiens
YTRDEFDLD

SEQ ID NO: 936209 - protein, 9 aa, Homo Sapiens
SIERLESSP

SEQ ID NO: 936210 - protein, 9 aa, Homo Sapiens
KLPPDELFL

SEQ ID NO: 936211 - protein, 9 aa, Homo Sapiens
SLEEATTPM

SEQ ID NO: 936212 - protein, 9 aa, Homo Sapiens
SSNYKLKPS

SEQ ID NO: 936213 - protein, 9 aa, Homo Sapiens
FQKITLYLT

SEQ ID NO: 936214 - protein, 9 aa, Homo Sapiens
QDIPYTHTT

SEQ ID NO: 936215 - protein, 9 aa, Homo Sapiens
QSDTYQMDG

SEQ ID NO: 936216 - protein, 9 aa, Homo Sapiens
LKNAQIKNA

SEQ ID NO: 936217 - protein, 9 aa, Homo Sapiens
TPMNGETFS

SEQ ID NO: 936218 - protein, 9 aa, Homo Sapiens
ADFFDVLLS

SEQ ID NO: 936219 - protein, 9 aa, Homo Sapiens
GMERISVTR

SEQ ID NO: 936220 - protein, 9 aa, Homo Sapiens
SGENYHPVS

SEQ ID NO: 936221 - protein, 9 aa, Homo Sapiens
YNNKIWKQS

SEQ ID NO: 936222 - protein, 9 aa, Homo Sapiens
CEGDCLSPF

SEQ ID NO: 936223 - protein, 9 aa, Homo Sapiens
ENKILILPS

SEQ ID NO: 936224 - protein, 9 aa, Homo Sapiens
STLQPRPPS

SEQ ID NO: 936225 - protein, 9 aa, Homo Sapiens
VSHSDTTPL

SEQ ID NO: 936226 - protein, 9 aa, Homo Sapiens
TALPLRRAE

SEQ ID NO: 936227 - protein, 9 aa, Homo Sapiens
VRQSVPYEM

SEQ ID NO: 936228 - protein, 9 aa, Homo Sapiens
PKQPQKRSQ

SEQ ID NO: 936229 - protein, 9 aa, Homo Sapiens
EETYRGVNL

SEQ ID NO: 936230 - protein, 9 aa, Homo Sapiens
ENLKLTCGN

SEQ ID NO: 936231 - protein, 9 aa, Homo Sapiens
GVQSQAKDS

SEQ ID NO: 936232 - protein, 9 aa, Homo Sapiens
GHGPSSFLR

SEQ ID NO: 936233 - protein, 9 aa, Homo Sapiens
LEAWWIGFL

SEQ ID NO: 936234 - protein, 9 aa, Homo Sapiens
GTICDHRWN

SEQ ID NO: 936235 - protein, 9 aa, Homo Sapiens
RIVQAIRAP

SEQ ID NO: 936236 - protein, 9 aa, Homo Sapiens
LNELELGNQ

SEQ ID NO: 936237 - protein, 9 aa, Homo Sapiens
INLTLCFSY

SEQ ID NO: 936238 - protein, 9 aa, Homo Sapiens
LLLLPLQDT

SEQ ID NO: 936239 - protein, 9 aa, Homo Sapiens
PFNTQVTDI

SEQ ID NO: 936240 - protein, 9 aa, Homo Sapiens
WLEAWWIGF

SEQ ID NO: 936241 - protein, 9 aa, Homo Sapiens
LQGRQSPWP

SEQ ID NO: 936242 - protein, 9 aa, Homo Sapiens
FWTEETYRG

SEQ ID NO: 936243 - protein, 9 aa, Homo Sapiens
IKVASVFYT

SEQ ID NO: 936244 - protein, 9 aa, Homo Sapiens
KRRYTRDEF

SEQ ID NO: 936245 - protein, 9 aa, Homo Sapiens
NEVPEKALD

SEQ ID NO: 936246 - protein, 9 aa, Homo Sapiens
GGFHGCIYE

SEQ ID NO: 936247 - protein, 9 aa, Homo Sapiens
DGVKMDTRA

SEQ ID NO: 936248 - protein, 9 aa, Homo Sapiens
EFWTEETYR

SEQ ID NO: 936249 - protein, 9 aa, Homo Sapiens
TRDEFDLDL

SEQ ID NO: 936250 - protein, 9 aa, Homo Sapiens
HLMKDIRNY

SEQ ID NO: 936251 - protein, 9 aa, Homo Sapiens
KKKMFLHVK

SEQ ID NO: 936252 - protein, 9 aa, Homo Sapiens
GFDELPGLP

SEQ ID NO: 936253 - protein, 9 aa, Homo Sapiens
VLFPDVTSN

SEQ ID NO: 936254 - protein, 9 aa, Homo Sapiens
ECPFSVFGS

SEQ ID NO: 936255 - protein, 9 aa, Homo Sapiens
CFLRNKTCR

SEQ ID NO: 936256 - protein, 9 aa, Homo Sapiens
NNESIKYPL

SEQ ID NO: 936257 - protein, 9 aa, Homo Sapiens
REAGIPFNT

SEQ ID NO: 936258 - protein, 9 aa, Homo Sapiens
VIYLQDSAL

SEQ ID NO: 936259 - protein, 9 aa, Homo Sapiens
SRGRAILFC

SEQ ID NO: 936260 - protein, 9 aa, Homo Sapiens
GSKTRPQYS

SEQ ID NO: 936261 - protein, 9 aa, Homo Sapiens
DRAQHQAFL

SEQ ID NO: 936262 - protein, 9 aa, Homo Sapiens
HGPSSFLRI

SEQ ID NO: 936263 - protein, 9 aa, Homo Sapiens
DSNDLKRQG

SEQ ID NO: 936264 - protein, 9 aa, Homo Sapiens
SLKNTGKLQ

SEQ ID NO: 936265 - protein, 9 aa, Homo Sapiens
NLLSAFEAM

SEQ ID NO: 936266 - protein, 9 aa, Homo Sapiens
MTYMRETCG

SEQ ID NO: 936267 - protein, 9 aa, Homo Sapiens
DCKGSWKKL

SEQ ID NO: 936268 - protein, 9 aa, Homo Sapiens
FQMALEDLA

SEQ ID NO: 936269 - protein, 9 aa, Homo Sapiens
GDQIPNTPV

SEQ ID NO: 936270 - protein, 9 aa, Homo Sapiens
PIPEFFWPD

SEQ ID NO: 936271 - protein, 9 aa, Homo Sapiens
GFGLVTWLV

SEQ ID NO: 936272 - protein, 9 aa, Homo Sapiens
ISVATTISV

SEQ ID NO: 936273 - protein, 9 aa, Homo Sapiens
QSLEGMERI

SEQ ID NO: 936274 - protein, 9 aa, Homo Sapiens
LENLKLTCG

SEQ ID NO: 936275 - protein, 9 aa, Homo Sapiens
ASSPEGPQS

SEQ ID NO: 936276 - protein, 9 aa, Homo Sapiens
NSLKNTGKL

SEQ ID NO: 936277 - protein, 9 aa, Homo Sapiens
FVDRDHVIL

SEQ ID NO: 936278 - protein, 9 aa, Homo Sapiens
EGGAGRDFY

SEQ ID NO: 936279 - protein, 9 aa, Homo Sapiens
WIIINEKIN

SEQ ID NO: 936280 - protein, 9 aa, Homo Sapiens
LLTLWGFYT

SEQ ID NO: 936281 - protein, 9 aa, Homo Sapiens
LVDATADRH

SEQ ID NO: 936282 - protein, 9 aa, Homo Sapiens
KKRVVYNAQ

SEQ ID NO: 936283 - protein, 9 aa, Homo Sapiens
DLEPRELSF

SEQ ID NO: 936284 - protein, 9 aa, Homo Sapiens
APWINPSPQ

SEQ ID NO: 936285 - protein, 9 aa, Homo Sapiens
GRSDTGKTT

SEQ ID NO: 936286 - protein, 9 aa, Homo Sapiens
SPAVVVRFS

SEQ ID NO: 936287 - protein, 9 aa, Homo Sapiens
NSIKIGDWY

SEQ ID NO: 936288 - protein, 9 aa, Homo Sapiens
TSLLLRHYH

SEQ ID NO: 936289 - protein, 9 aa, Homo Sapiens
SLQGRQSPW

SEQ ID NO: 936290 - protein, 9 aa, Homo Sapiens
ESKSFRAAL

SEQ ID NO: 936291 - protein, 9 aa, Homo Sapiens
KIFLIQASV

SEQ ID NO: 936292 - protein, 9 aa, Homo Sapiens
SPRPYSFVP

SEQ ID NO: 936293 - protein, 9 aa, Homo Sapiens
IFLFIRDSQ

SEQ ID NO: 936294 - protein, 9 aa, Homo Sapiens
LQIVIFFFL

SEQ ID NO: 936295 - protein, 9 aa, Homo Sapiens
ANAVHKYKC

SEQ ID NO: 936296 - protein, 9 aa, Homo Sapiens
IPIHICLAW

SEQ ID NO: 936297 - protein, 9 aa, Homo Sapiens
QEDRSFWNS

SEQ ID NO: 936298 - protein, 9 aa, Homo Sapiens
GTTNTTSNS

SEQ ID NO: 936299 - protein, 9 aa, Homo Sapiens
SSRNFLSHG

SEQ ID NO: 936300 - protein, 9 aa, Homo Sapiens
EGMERISVT

SEQ ID NO: 936301 - protein, 9 aa, Homo Sapiens
TTLRDEDAP

SEQ ID NO: 936302 - protein, 9 aa, Homo Sapiens
RALETQLDL

SEQ ID NO: 936303 - protein, 9 aa, Homo Sapiens
TICDHRWNL

SEQ ID NO: 936304 - protein, 9 aa, Homo Sapiens
TYKISDQSG

SEQ ID NO: 936305 - protein, 9 aa, Homo Sapiens
SGKEFGPLT

SEQ ID NO: 936306 - protein, 9 aa, Homo Sapiens
VPRDQNFQE

SEQ ID NO: 936307 - protein, 9 aa, Homo Sapiens
LSPFHRRLC

SEQ ID NO: 936308 - protein, 9 aa, Homo Sapiens
EGSQGGVAP

SEQ ID NO: 936309 - protein, 9 aa, Homo Sapiens
EIQHRLQCK

SEQ ID NO: 936310 - protein, 9 aa, Homo Sapiens
ASMVSVVPQ

SEQ ID NO: 936311 - protein, 9 aa, Homo Sapiens
LEPIKEYRQ

SEQ ID NO: 936312 - protein, 9 aa, Homo Sapiens
KRLFFLRFF

SEQ ID NO: 936313 - protein, 9 aa, Homo Sapiens
LHRAPVRGG

SEQ ID NO: 936314 - protein, 9 aa, Homo Sapiens
EVVNKFLDN

SEQ ID NO: 936315 - protein, 9 aa, Homo Sapiens
RPQYSSPSL

SEQ ID NO: 936316 - protein, 9 aa, Homo Sapiens
SVPYEMAVV

SEQ ID NO: 936317 - protein, 9 aa, Homo Sapiens
YKQGLRSSL

SEQ ID NO: 936318 - protein, 9 aa, Homo Sapiens
PRPPSCGAR

SEQ ID NO: 936319 - protein, 9 aa, Homo Sapiens
NQSDTYQMD

SEQ ID NO: 936320 - protein, 9 aa, Homo Sapiens
AKDSDLKTL

SEQ ID NO: 936321 - protein, 9 aa, Homo Sapiens
PRDQNFQEN

SEQ ID NO: 936322 - protein, 9 aa, Homo Sapiens
YRHSHNGSG

SEQ ID NO: 936323 - protein, 9 aa, Homo Sapiens
LHAARNTLA

SEQ ID NO: 936324 - protein, 9 aa, Homo Sapiens
ISLCNTIES

SEQ ID NO: 936325 - protein, 9 aa, Homo Sapiens
KKDKMPTTS

SEQ ID NO: 936326 - protein, 9 aa, Homo Sapiens
SPDEKIPDL

SEQ ID NO: 936327 - protein, 9 aa, Homo Sapiens
KLGPLLCQE

SEQ ID NO: 936328 - protein, 9 aa, Homo Sapiens
YLSSVGKLS

SEQ ID NO: 936329 - protein, 9 aa, Homo Sapiens
GSYLSLVLQ

SEQ ID NO: 936330 - protein, 9 aa, Homo Sapiens
GVRVENSNS

SEQ ID NO: 936331 - protein, 9 aa, Homo Sapiens
HILVGAHRL

SEQ ID NO: 936332 - protein, 9 aa, Homo Sapiens
NRLCMINEF

SEQ ID NO: 936333 - protein, 9 aa, Homo Sapiens
DQVGTFIEE

SEQ ID NO: 936334 - protein, 9 aa, Homo Sapiens
GYSSNYKLK

SEQ ID NO: 936335 - protein, 9 aa, Homo Sapiens
SLSVLFPDV

SEQ ID NO: 936336 - protein, 9 aa, Homo Sapiens
WMQANYNLL

SEQ ID NO: 936337 - protein, 9 aa, Homo Sapiens
CNLIQIGGL

SEQ ID NO: 936338 - protein, 9 aa, Homo Sapiens
SCLPSPSTS

SEQ ID NO: 936339 - protein, 9 aa, Homo Sapiens
RKITCNQKR

SEQ ID NO: 936340 - protein, 9 aa, Homo Sapiens
HARYSSQLD

SEQ ID NO: 936341 - protein, 9 aa, Homo Sapiens
SLKEISAEN

SEQ ID NO: 936342 - protein, 9 aa, Homo Sapiens
SSFLRITVA

SEQ ID NO: 936343 - protein, 9 aa, Homo Sapiens
RKPFSSGPG

SEQ ID NO: 936344 - protein, 9 aa, Homo Sapiens
ILSENFGSV

SEQ ID NO: 936345 - protein, 9 aa, Homo Sapiens
LRNKTCRQT

SEQ ID NO: 936346 - protein, 9 aa, Homo Sapiens
LAAASSMAL

SEQ ID NO: 936347 - protein, 9 aa, Homo Sapiens
TLQPRPPSC

SEQ ID NO: 936348 - protein, 9 aa, Homo Sapiens
GGNQPQGPL

SEQ ID NO: 936349 - protein, 9 aa, Homo Sapiens
GNINWVESN

SEQ ID NO: 936350 - protein, 9 aa, Homo Sapiens
LVPFLNRGN

SEQ ID NO: 936351 - protein, 9 aa, Homo Sapiens
PSAKHENKK

SEQ ID NO: 936352 - protein, 9 aa, Homo Sapiens
NKILILPSV

SEQ ID NO: 936353 - protein, 9 aa, Homo Sapiens
YQMDGTDDR

SEQ ID NO: 936354 - protein, 9 aa, Homo Sapiens
SHHKDRAGH

SEQ ID NO: 936355 - protein, 9 aa, Homo Sapiens
YMRETCGCC

SEQ ID NO: 936356 - protein, 9 aa, Homo Sapiens
AMIVLGRYL

SEQ ID NO: 936357 - protein, 9 aa, Homo Sapiens
PSKFVVQPR

SEQ ID NO: 936358 - protein, 9 aa, Homo Sapiens
DYEMRVSHS

SEQ ID NO: 936359 - protein, 9 aa, Homo Sapiens
LGKKETLAA

SEQ ID NO: 936360 - protein, 9 aa, Homo Sapiens
RWRGTSRLP

SEQ ID NO: 936361 - protein, 9 aa, Homo Sapiens
YSTIVNHIL

SEQ ID NO: 936362 - protein, 9 aa, Homo Sapiens
GSSEQALLR

SEQ ID NO: 936363 - protein, 9 aa, Homo Sapiens
FLFIRDSQP

SEQ ID NO: 936364 - protein, 9 aa, Homo Sapiens
YNLLSAFEA

SEQ ID NO: 936365 - protein, 9 aa, Homo Sapiens
VLLLLPLQD

SEQ ID NO: 936366 - protein, 9 aa, Homo Sapiens
DFFAFGVFG

SEQ ID NO: 936367 - protein, 9 aa, Homo Sapiens
ILPLRALDV

SEQ ID NO: 936368 - protein, 9 aa, Homo Sapiens
RFSAALGYR

SEQ ID NO: 936369 - protein, 9 aa, Homo Sapiens
IIRGLRSVG

SEQ ID NO: 936370 - protein, 9 aa, Homo Sapiens
LIVRVPSKF

SEQ ID NO: 936371 - protein, 9 aa, Homo Sapiens
KKRWIHSKY

SEQ ID NO: 936372 - protein, 9 aa, Homo Sapiens
SQSKFSIFR

SEQ ID NO: 936373 - protein, 9 aa, Homo Sapiens
GDSPSFPHT

SEQ ID NO: 936374 - protein, 9 aa, Homo Sapiens
SVIEKQNLK

SEQ ID NO: 936375 - protein, 9 aa, Homo Sapiens
SNISITRML

SEQ ID NO: 936376 - protein, 9 aa, Homo Sapiens
QEVGVIESL

SEQ ID NO: 936377 - protein, 9 aa, Homo Sapiens
INPSPQPQS

SEQ ID NO: 936378 - protein, 9 aa, Homo Sapiens
LNQSDTYQM

SEQ ID NO: 936379 - protein, 9 aa, Homo Sapiens
NSATGEKSS

SEQ ID NO: 936380 - protein, 9 aa, Homo Sapiens
RNSATGEKS

SEQ ID NO: 936381 - protein, 9 aa, Homo Sapiens
IESLLMYED

SEQ ID NO: 936382 - protein, 9 aa, Homo Sapiens
NIPENFFGV

SEQ ID NO: 936383 - protein, 9 aa, Homo Sapiens
SCLLCCNNR

SEQ ID NO: 936384 - protein, 9 aa, Homo Sapiens
RTVAANVIE

SEQ ID NO: 936385 - protein, 9 aa, Homo Sapiens
IKEYRQEGP

SEQ ID NO: 936386 - protein, 9 aa, Homo Sapiens
GDICNMCGL

SEQ ID NO: 936387 - protein, 9 aa, Homo Sapiens
GPKDSLYGA

SEQ ID NO: 936388 - protein, 9 aa, Homo Sapiens
IKLPSSSSK

SEQ ID NO: 936389 - protein, 9 aa, Homo Sapiens
ASSMALPAA

SEQ ID NO: 936390 - protein, 9 aa, Homo Sapiens
NYNLLSAFE

SEQ ID NO: 936391 - protein, 9 aa, Homo Sapiens
KQVQLEQDE

SEQ ID NO: 936392 - protein, 9 aa, Homo Sapiens
ESKDTDSKK

SEQ ID NO: 936393 - protein, 9 aa, Homo Sapiens
STIVNHILN

SEQ ID NO: 936394 - protein, 9 aa, Homo Sapiens
KDALCRTVG

SEQ ID NO: 936395 - protein, 9 aa, Homo Sapiens
PLCNLDQYF

SEQ ID NO: 936396 - protein, 9 aa, Homo Sapiens
KRMDQITAQ

SEQ ID NO: 936397 - protein, 9 aa, Homo Sapiens
GQLVDATAD

SEQ ID NO: 936398 - protein, 9 aa, Homo Sapiens
QNPASFFFS

SEQ ID NO: 936399 - protein, 9 aa, Homo Sapiens
HLASLEKTE

SEQ ID NO: 936400 - protein, 9 aa, Homo Sapiens
VFVKWDPPK

SEQ ID NO: 936401 - protein, 9 aa, Homo Sapiens
YSLLSFISL

SEQ ID NO: 936402 - protein, 9 aa, Homo Sapiens
VVFSVAFEL

SEQ ID NO: 936403 - protein, 9 aa, Homo Sapiens
SSSEPEEED

SEQ ID NO: 936404 - protein, 9 aa, Homo Sapiens
NPTSVIEHQ

SEQ ID NO: 936405 - protein, 9 aa, Homo Sapiens
KKETLAAAA

SEQ ID NO: 936406 - protein, 9 aa, Homo Sapiens
GSTLQDQRI

SEQ ID NO: 936407 - protein, 9 aa, Homo Sapiens
FFRALTEGD

SEQ ID NO: 936408 - protein, 9 aa, Homo Sapiens
HTVPETSAP

SEQ ID NO: 936409 - protein, 9 aa, Homo Sapiens
HKYKCTALM

SEQ ID NO: 936410 - protein, 9 aa, Homo Sapiens
PLATMSHQL

SEQ ID NO: 936411 - protein, 9 aa, Homo Sapiens
RAECSACLE

SEQ ID NO: 936412 - protein, 9 aa, Homo Sapiens
GGWWGGEQD

SEQ ID NO: 936413 - protein, 9 aa, Homo Sapiens
RGLRSVGAS

SEQ ID NO: 936414 - protein, 9 aa, Homo Sapiens
GLRSSLTKL

SEQ ID NO: 936415 - protein, 9 aa, Homo Sapiens
DEDEFWTEE

SEQ ID NO: 936416 - protein, 9 aa, Homo Sapiens
WNNYKNFLE

SEQ ID NO: 936417 - protein, 9 aa, Homo Sapiens
LESSRNFLS

SEQ ID NO: 936418 - protein, 9 aa, Homo Sapiens
SISLSVLFP

SEQ ID NO: 936419 - protein, 9 aa, Homo Sapiens
LCIILLIRT

SEQ ID NO: 936420 - protein, 9 aa, Homo Sapiens
SYTLFESFF

SEQ ID NO: 936421 - protein, 9 aa, Homo Sapiens
RPPELREIN

SEQ ID NO: 936422 - protein, 9 aa, Homo Sapiens
ESGVLFAAS

SEQ ID NO: 936423 - protein, 9 aa, Homo Sapiens
KGDRGFDEL

SEQ ID NO: 936424 - protein, 9 aa, Homo Sapiens
VRFSAALGY

SEQ ID NO: 936425 - protein, 9 aa, Homo Sapiens
LAGDLAYQI

SEQ ID NO: 936426 - protein, 9 aa, Homo Sapiens
FPGFSPPVP

SEQ ID NO: 936427 - protein, 9 aa, Homo Sapiens
CHCGPKFSE

SEQ ID NO: 936428 - protein, 9 aa, Homo Sapiens
NSTANTEQT

SEQ ID NO: 936429 - protein, 9 aa, Homo Sapiens
KPIKSVPQD

SEQ ID NO: 936430 - protein, 9 aa, Homo Sapiens
KETKDKQLE

SEQ ID NO: 936431 - protein, 9 aa, Homo Sapiens
DRKVPSRFA

SEQ ID NO: 936432 - protein, 9 aa, Homo Sapiens
NFLVEKNTV

SEQ ID NO: 936433 - protein, 9 aa, Homo Sapiens
CDFSIMKFS

SEQ ID NO: 936434 - protein, 9 aa, Homo Sapiens
KEGNVPQLD

SEQ ID NO: 936435 - protein, 9 aa, Homo Sapiens
QALLRNVQL

SEQ ID NO: 936436 - protein, 9 aa, Homo Sapiens
GGGWWGGEQ

SEQ ID NO: 936437 - protein, 9 aa, Homo Sapiens
STPQTTPSL

SEQ ID NO: 936438 - protein, 9 aa, Homo Sapiens
LRNVQLDMG

SEQ ID NO: 936439 - protein, 9 aa, Homo Sapiens
VIKGNRDRP

SEQ ID NO: 936440 - protein, 9 aa, Homo Sapiens
EEIKLEDVE

SEQ ID NO: 936441 - protein, 9 aa, Homo Sapiens
ACFAHGSEE

SEQ ID NO: 936442 - protein, 9 aa, Homo Sapiens
KKKGKTAFS

SEQ ID NO: 936443 - protein, 9 aa, Homo Sapiens
VQKLNAKEG

SEQ ID NO: 936444 - protein, 9 aa, Homo Sapiens
ENIQEKGPM

SEQ ID NO: 936445 - protein, 9 aa, Homo Sapiens
VGSTLQDQR

SEQ ID NO: 936446 - protein, 9 aa, Homo Sapiens
LESMGFLAR

SEQ ID NO: 936447 - protein, 9 aa, Homo Sapiens
QDEYAKHIK

SEQ ID NO: 936448 - protein, 9 aa, Homo Sapiens
GGKKDKMPT

SEQ ID NO: 936449 - protein, 9 aa, Homo Sapiens
NFPDNIELI

SEQ ID NO: 936450 - protein, 9 aa, Homo Sapiens
SGTETELAD

SEQ ID NO: 936451 - protein, 9 aa, Homo Sapiens
EPIPSFFRA

SEQ ID NO: 936452 - protein, 9 aa, Homo Sapiens
ELPGLPGDK

SEQ ID NO: 936453 - protein, 9 aa, Homo Sapiens
SLPELEDRL

SEQ ID NO: 936454 - protein, 9 aa, Homo Sapiens
DVSISLSVL

SEQ ID NO: 936455 - protein, 9 aa, Homo Sapiens
IVVYCSAGV

SEQ ID NO: 936456 - protein, 9 aa, Homo Sapiens
RCARGHSQK

SEQ ID NO: 936457 - protein, 9 aa, Homo Sapiens
GSVRTPGGC

SEQ ID NO: 936458 - protein, 9 aa, Homo Sapiens
LRCQTKLHS

SEQ ID NO: 936459 - protein, 9 aa, Homo Sapiens
AQIKNAIRK

SEQ ID NO: 936460 - protein, 9 aa, Homo Sapiens
VTGTYKISD

SEQ ID NO: 936461 - protein, 9 aa, Homo Sapiens
LSKRFEIQH

SEQ ID NO: 936462 - protein, 9 aa, Homo Sapiens
EDGVFQMAL

SEQ ID NO: 936463 - protein, 9 aa, Homo Sapiens
ESSPHYVIS

SEQ ID NO: 936464 - protein, 9 aa, Homo Sapiens
IEKQNLKGD

SEQ ID NO: 936465 - protein, 9 aa, Homo Sapiens
TSQYVKLLD

SEQ ID NO: 936466 - protein, 9 aa, Homo Sapiens
YLAKVDQKR

SEQ ID NO: 936467 - protein, 9 aa, Homo Sapiens
SSFLSSSSP

SEQ ID NO: 936468 - protein, 9 aa, Homo Sapiens
ESSRNFLSH

SEQ ID NO: 936469 - protein, 9 aa, Homo Sapiens
FLGESLAMK

SEQ ID NO: 936470 - protein, 9 aa, Homo Sapiens
TEEIKLEDV

SEQ ID NO: 936471 - protein, 9 aa, Homo Sapiens
PCQCNSHFK

SEQ ID NO: 936472 - protein, 9 aa, Homo Sapiens
KGNRDRPLN

SEQ ID NO: 936473 - protein, 9 aa, Homo Sapiens
GLHGPDFPG

SEQ ID NO: 936474 - protein, 9 aa, Homo Sapiens
QGFRVGTVW

SEQ ID NO: 936475 - protein, 9 aa, Homo Sapiens
SGGQKQRIV

SEQ ID NO: 936476 - protein, 9 aa, Homo Sapiens
WQKAGVNGR

SEQ ID NO: 936477 - protein, 9 aa, Homo Sapiens
HGCIYEVRI

SEQ ID NO: 936478 - protein, 9 aa, Homo Sapiens
LNPTSVIEH

SEQ ID NO: 936479 - protein, 9 aa, Homo Sapiens
VVRFSAALG

SEQ ID NO: 936480 - protein, 9 aa, Homo Sapiens
EIFTPDQHL

SEQ ID NO: 936481 - protein, 9 aa, Homo Sapiens
KRFEIQHRL

SEQ ID NO: 936482 - protein, 9 aa, Homo Sapiens
VVPQKSTTG

SEQ ID NO: 936483 - protein, 9 aa, Homo Sapiens
GENYHPVSE

SEQ ID NO: 936484 - protein, 9 aa, Homo Sapiens
QPRPPSCGA

SEQ ID NO: 936485 - protein, 9 aa, Homo Sapiens
GVQLLWNPE

SEQ ID NO: 936486 - protein, 9 aa, Homo Sapiens
TLSLSPEPV

SEQ ID NO: 936487 - protein, 9 aa, Homo Sapiens
LVPGQKYMA

SEQ ID NO: 936488 - protein, 9 aa, Homo Sapiens
RGTSRLPEA

SEQ ID NO: 936489 - protein, 9 aa, Homo Sapiens
GSHTIDFFE

SEQ ID NO: 936490 - protein, 9 aa, Homo Sapiens
QVGSTLQDQ

SEQ ID NO: 936491 - protein, 9 aa, Homo Sapiens
VITDQCPKG

SEQ ID NO: 936492 - protein, 9 aa, Homo Sapiens
HLHREQHSL

SEQ ID NO: 936493 - protein, 9 aa, Homo Sapiens
SYSTIVNHI

SEQ ID NO: 936494 - protein, 9 aa, Homo Sapiens
GKLQEPCVA

SEQ ID NO: 936495 - protein, 9 aa, Homo Sapiens
YTGEDFVNI

SEQ ID NO: 936496 - protein, 9 aa, Homo Sapiens
DASRGRAIL

SEQ ID NO: 936497 - protein, 9 aa, Homo Sapiens
LYVMILRAV

SEQ ID NO: 936498 - protein, 9 aa, Homo Sapiens
VPVLSDNYS

SEQ ID NO: 936499 - protein, 9 aa, Homo Sapiens
LFAILSFAD

SEQ ID NO: 936500 - protein, 9 aa, Homo Sapiens
ELHEPIPSF

SEQ ID NO: 936501 - protein, 9 aa, Homo Sapiens
GVVLPTSLL

SEQ ID NO: 936502 - protein, 9 aa, Homo Sapiens
RDQITRLGD

SEQ ID NO: 936503 - protein, 9 aa, Homo Sapiens
EKVLVVVGG

SEQ ID NO: 936504 - protein, 9 aa, Homo Sapiens
LRHLEPLAT

SEQ ID NO: 936505 - protein, 9 aa, Homo Sapiens
YTKLNDCHK

SEQ ID NO: 936506 - protein, 9 aa, Homo Sapiens
GFYTKLNDC

SEQ ID NO: 936507 - protein, 9 aa, Homo Sapiens
SNSTANTEQ

SEQ ID NO: 936508 - protein, 9 aa, Homo Sapiens
YELTQTDKA

SEQ ID NO: 936509 - protein, 9 aa, Homo Sapiens
QVARKHEEY

SEQ ID NO: 936510 - protein, 9 aa, Homo Sapiens
KDDGEAMIV

SEQ ID NO: 936511 - protein, 9 aa, Homo Sapiens
GPHPSPWAR

SEQ ID NO: 936512 - protein, 9 aa, Homo Sapiens
GFSPPVPPG

SEQ ID NO: 936513 - protein, 9 aa, Homo Sapiens
LFQEALMEL

SEQ ID NO: 936514 - protein, 9 aa, Homo Sapiens
KSENIAFLG

SEQ ID NO: 936515 - protein, 9 aa, Homo Sapiens
EEKKRWIHS

SEQ ID NO: 936516 - protein, 9 aa, Homo Sapiens
KCPTLCQTY

SEQ ID NO: 936517 - protein, 9 aa, Homo Sapiens
HLSFCRFRL

SEQ ID NO: 936518 - protein, 9 aa, Homo Sapiens
IKKLASEFV

SEQ ID NO: 936519 - protein, 9 aa, Homo Sapiens
ANRGTLSVI

SEQ ID NO: 936520 - protein, 9 aa, Homo Sapiens
CTATLDNFA

SEQ ID NO: 936521 - protein, 9 aa, Homo Sapiens
GTSRLPEAV

SEQ ID NO: 936522 - protein, 9 aa, Homo Sapiens
VENSNSTAN

SEQ ID NO: 936523 - protein, 9 aa, Homo Sapiens
EKKPFKKKG

SEQ ID NO: 936524 - protein, 9 aa, Homo Sapiens
FRVSWYPSP

SEQ ID NO: 936525 - protein, 9 aa, Homo Sapiens
NMSWPRLIK

SEQ ID NO: 936526 - protein, 9 aa, Homo Sapiens
VKIYFNRSN

SEQ ID NO: 936527 - protein, 9 aa, Homo Sapiens
NYKNFLEQE

SEQ ID NO: 936528 - protein, 9 aa, Homo Sapiens
RASAGAGQQ

SEQ ID NO: 936529 - protein, 9 aa, Homo Sapiens
QVGTFIEEL

SEQ ID NO: 936530 - protein, 9 aa, Homo Sapiens
FIKENIQEK

SEQ ID NO: 936531 - protein, 9 aa, Homo Sapiens
HKDRAGHGH

SEQ ID NO: 936532 - protein, 9 aa, Homo Sapiens
ALETQLDLR

SEQ ID NO: 936533 - protein, 9 aa, Homo Sapiens
AYIIEVFSQ

SEQ ID NO: 936534 - protein, 9 aa, Homo Sapiens
TLFLAVPRL

SEQ ID NO: 936535 - protein, 9 aa, Homo Sapiens
VGTVFIIRG

SEQ ID NO: 936536 - protein, 9 aa, Homo Sapiens
SHNEPGIAG

SEQ ID NO: 936537 - protein, 9 aa, Homo Sapiens
EAKPIDFTM

SEQ ID NO: 936538 - protein, 9 aa, Homo Sapiens
FLGQPLEKL

SEQ ID NO: 936539 - protein, 9 aa, Homo Sapiens
TLKNAQIKN

SEQ ID NO: 936540 - protein, 9 aa, Homo Sapiens
LFFLRFFFL

SEQ ID NO: 936541 - protein, 9 aa, Homo Sapiens
SRSTLSLSP

SEQ ID NO: 936542 - protein, 9 aa, Homo Sapiens
TLWGFYTKL

SEQ ID NO: 936543 - protein, 9 aa, Homo Sapiens
LGSDRKVPS

SEQ ID NO: 936544 - protein, 9 aa, Homo Sapiens
AYDCYVAIS

SEQ ID NO: 936545 - protein, 9 aa, Homo Sapiens
HIRMHMGDQ

SEQ ID NO: 936546 - protein, 9 aa, Homo Sapiens
CRVLSTVDP

SEQ ID NO: 936547 - protein, 9 aa, Homo Sapiens
YCNNESIKY

SEQ ID NO: 936548 - protein, 9 aa, Homo Sapiens
KISDQSGGT

SEQ ID NO: 936549 - protein, 9 aa, Homo Sapiens
KDNHLSLRI

SEQ ID NO: 936550 - protein, 9 aa, Homo Sapiens
VPCSSCLLC

SEQ ID NO: 936551 - protein, 9 aa, Homo Sapiens
WVNINQMEK

SEQ ID NO: 936552 - protein, 9 aa, Homo Sapiens
SEFVYVVSL

SEQ ID NO: 936553 - protein, 9 aa, Homo Sapiens
IISTSGDHH

SEQ ID NO: 936554 - protein, 9 aa, Homo Sapiens
SSPTQKRLT

SEQ ID NO: 936555 - protein, 9 aa, Homo Sapiens
KNGVKITFP

SEQ ID NO: 936556 - protein, 9 aa, Homo Sapiens
EFDLDLTYV

SEQ ID NO: 936557 - protein, 9 aa, Homo Sapiens
HHKDRAGHG

SEQ ID NO: 936558 - protein, 9 aa, Homo Sapiens
NDSLVSRLQ

SEQ ID NO: 936559 - protein, 9 aa, Homo Sapiens
MIQNFPDNI

SEQ ID NO: 936560 - protein, 9 aa, Homo Sapiens
ALPAAAPTT

SEQ ID NO: 936561 - protein, 9 aa, Homo Sapiens
SPSTSVQSP

SEQ ID NO: 936562 - protein, 9 aa, Homo Sapiens
LLYTDQHGG

SEQ ID NO: 936563 - protein, 9 aa, Homo Sapiens
NSYFGAGFG

SEQ ID NO: 936564 - protein, 9 aa, Homo Sapiens
YFNRSNQNS

SEQ ID NO: 936565 - protein, 9 aa, Homo Sapiens
YNSPWGNAG

SEQ ID NO: 936566 - protein, 9 aa, Homo Sapiens
PGPSAPWIN

SEQ ID NO: 936567 - protein, 9 aa, Homo Sapiens
YDECNIMKD

SEQ ID NO: 936568 - protein, 9 aa, Homo Sapiens
MIVIGMLYV

SEQ ID NO: 936569 - protein, 9 aa, Homo Sapiens
RCGGYCGCG

SEQ ID NO: 936570 - protein, 9 aa, Homo Sapiens
INKSETTVP

SEQ ID NO: 936571 - protein, 9 aa, Homo Sapiens
SAVLRALKG

SEQ ID NO: 936572 - protein, 9 aa, Homo Sapiens
SAHLHREQH

SEQ ID NO: 936573 - protein, 9 aa, Homo Sapiens
TTQQKLASV

SEQ ID NO: 936574 - protein, 9 aa, Homo Sapiens
LYKQGLRSS

SEQ ID NO: 936575 - protein, 9 aa, Homo Sapiens
FFFWVGEAA

SEQ ID NO: 936576 - protein, 9 aa, Homo Sapiens
NLKILNFRN

SEQ ID NO: 936577 - protein, 9 aa, Homo Sapiens
VRNSATGEK

SEQ ID NO: 936578 - protein, 9 aa, Homo Sapiens
TKEELLLVM

SEQ ID NO: 936579 - protein, 9 aa, Homo Sapiens
EPFNSQMVT

SEQ ID NO: 936580 - protein, 9 aa, Homo Sapiens
ETLMLVAVL

SEQ ID NO: 936581 - protein, 9 aa, Homo Sapiens
SLWAVPAIV

SEQ ID NO: 936582 - protein, 9 aa, Homo Sapiens
VNKFLDNLG

SEQ ID NO: 936583 - protein, 9 aa, Homo Sapiens
IGRSDTGKT

SEQ ID NO: 936584 - protein, 9 aa, Homo Sapiens
LLSFISLPH

SEQ ID NO: 936585 - protein, 9 aa, Homo Sapiens
DGYGGCDRD

SEQ ID NO: 936586 - protein, 9 aa, Homo Sapiens
LHKLPPDEL

SEQ ID NO: 936587 - protein, 9 aa, Homo Sapiens
QIYGTEIDM

SEQ ID NO: 936588 - protein, 9 aa, Homo Sapiens
LITACFAHG

SEQ ID NO: 936589 - protein, 9 aa, Homo Sapiens
SEIVAIKIL

SEQ ID NO: 936590 - protein, 9 aa, Homo Sapiens
REINFCCAE

SEQ ID NO: 936591 - protein, 9 aa, Homo Sapiens
SFFGEKKLC

SEQ ID NO: 936592 - protein, 9 aa, Homo Sapiens
ASRGNAPPR

SEQ ID NO: 936593 - protein, 9 aa, Homo Sapiens
CYVKSSVGC

SEQ ID NO: 936594 - protein, 9 aa, Homo Sapiens
PFNSQMVTE

SEQ ID NO: 936595 - protein, 9 aa, Homo Sapiens
LIQKCDFSI

SEQ ID NO: 936596 - protein, 9 aa, Homo Sapiens
QMQDLKEQQ

SEQ ID NO: 936597 - protein, 9 aa, Homo Sapiens
NIFSERRTI

SEQ ID NO: 936598 - protein, 9 aa, Homo Sapiens
MKEEGKLIF

SEQ ID NO: 936599 - protein, 9 aa, Homo Sapiens
QQIYGTEID

SEQ ID NO: 936600 - protein, 9 aa, Homo Sapiens
SGVLFAASL

SEQ ID NO: 936601 - protein, 9 aa, Homo Sapiens
QHQAFLETR

SEQ ID NO: 936602 - protein, 9 aa, Homo Sapiens
SSEKGRLSE

SEQ ID NO: 936603 - protein, 9 aa, Homo Sapiens
PVQPVFSLP

SEQ ID NO: 936604 - protein, 9 aa, Homo Sapiens
QMKEEGKLI

SEQ ID NO: 936605 - protein, 9 aa, Homo Sapiens
GNLCIILLI

SEQ ID NO: 936606 - protein, 9 aa, Homo Sapiens
LFAASLEMG

SEQ ID NO: 936607 - protein, 9 aa, Homo Sapiens
EKQNLKGDH

SEQ ID NO: 936608 - protein, 9 aa, Homo Sapiens
ESFFGEKKL

SEQ ID NO: 936609 - protein, 9 aa, Homo Sapiens
QNFPDNIEL

SEQ ID NO: 936610 - protein, 9 aa, Homo Sapiens
SDEKKPFKK

SEQ ID NO: 936611 - protein, 9 aa, Homo Sapiens
RDQNFQENY

SEQ ID NO: 936612 - protein, 9 aa, Homo Sapiens
TTVGIDFRK

SEQ ID NO: 936613 - protein, 9 aa, Homo Sapiens
RSSCSEYLP

SEQ ID NO: 936614 - protein, 9 aa, Homo Sapiens
QLEQDEYAK

SEQ ID NO: 936615 - protein, 9 aa, Homo Sapiens
KKTLQKVVS

SEQ ID NO: 936616 - protein, 9 aa, Homo Sapiens
PSRFRRGKV

SEQ ID NO: 936617 - protein, 9 aa, Homo Sapiens
LVFPLNFRQ

SEQ ID NO: 936618 - protein, 9 aa, Homo Sapiens
TKCYVKSSV

SEQ ID NO: 936619 - protein, 9 aa, Homo Sapiens
DNFAKATFD

SEQ ID NO: 936620 - protein, 9 aa, Homo Sapiens
STTEEIKLE

SEQ ID NO: 936621 - protein, 9 aa, Homo Sapiens
DDGEAMIVL

SEQ ID NO: 936622 - protein, 9 aa, Homo Sapiens
LYTDQHGGL

SEQ ID NO: 936623 - protein, 9 aa, Homo Sapiens
HPSSLSALR

SEQ ID NO: 936624 - protein, 9 aa, Homo Sapiens
EEQVRAHAS

SEQ ID NO: 936625 - protein, 9 aa, Homo Sapiens
FVTGILAEQ

SEQ ID NO: 936626 - protein, 9 aa, Homo Sapiens
KQNLKGDHS

SEQ ID NO: 936627 - protein, 9 aa, Homo Sapiens
FFTHLSFID

SEQ ID NO: 936628 - protein, 9 aa, Homo Sapiens
DLQIVIFFF

SEQ ID NO: 936629 - protein, 9 aa, Homo Sapiens
NYHPVSEEI

SEQ ID NO: 936630 - protein, 9 aa, Homo Sapiens
SIVHAVQGG

SEQ ID NO: 936631 - protein, 9 aa, Homo Sapiens
VGAWGDYND

SEQ ID NO: 936632 - protein, 9 aa, Homo Sapiens
FDNICFDTF

SEQ ID NO: 936633 - protein, 9 aa, Homo Sapiens
RTPGGCVKE

SEQ ID NO: 936634 - protein, 9 aa, Homo Sapiens
YRQEGPRGP

SEQ ID NO: 936635 - protein, 9 aa, Homo Sapiens
GGWRARAEC

SEQ ID NO: 936636 - protein, 9 aa, Homo Sapiens
SLFAILSFA

SEQ ID NO: 936637 - protein, 9 aa, Homo Sapiens
PLHYLERIH

SEQ ID NO: 936638 - protein, 9 aa, Homo Sapiens
LNIFGNLLL

SEQ ID NO: 936639 - protein, 9 aa, Homo Sapiens
SRHTIKVAS

SEQ ID NO: 936640 - protein, 9 aa, Homo Sapiens
CRQTVTEGH

SEQ ID NO: 936641 - protein, 9 aa, Homo Sapiens
LVSPKKIIS

SEQ ID NO: 936642 - protein, 9 aa, Homo Sapiens
NVIEIGEPS

SEQ ID NO: 936643 - protein, 9 aa, Homo Sapiens
LNFRQDVIC

SEQ ID NO: 936644 - protein, 9 aa, Homo Sapiens
SKFVVQPRD

SEQ ID NO: 936645 - protein, 9 aa, Homo Sapiens
HTPMYFFFT

SEQ ID NO: 936646 - protein, 9 aa, Homo Sapiens
MYRHSHNGS

SEQ ID NO: 936647 - protein, 9 aa, Homo Sapiens
RSSSASNVH

SEQ ID NO: 936648 - protein, 9 aa, Homo Sapiens
LWFEKAKGM

SEQ ID NO: 936649 - protein, 9 aa, Homo Sapiens
QSILITACF

SEQ ID NO: 936650 - protein, 9 aa, Homo Sapiens
RHLEPLATM

SEQ ID NO: 936651 - protein, 9 aa, Homo Sapiens
VKVLPVPVL

SEQ ID NO: 936652 - protein, 9 aa, Homo Sapiens
DPRHLPGKD

SEQ ID NO: 936653 - protein, 9 aa, Homo Sapiens
CPDPSLCLS

SEQ ID NO: 936654 - protein, 9 aa, Homo Sapiens
CPASTLQPR

SEQ ID NO: 936655 - protein, 9 aa, Homo Sapiens
EKGPMDVVI

SEQ ID NO: 936656 - protein, 9 aa, Homo Sapiens
PGIAGSPRS

SEQ ID NO: 936657 - protein, 9 aa, Homo Sapiens
QKMFTVFLH

SEQ ID NO: 936658 - protein, 9 aa, Homo Sapiens
GSKVLTSVS

SEQ ID NO: 936659 - protein, 9 aa, Homo Sapiens
WCHCGPKFS

SEQ ID NO: 936660 - protein, 9 aa, Homo Sapiens
RLCMINEFG

SEQ ID NO: 936661 - protein, 9 aa, Homo Sapiens
TRMLVMYLL

SEQ ID NO: 936662 - protein, 9 aa, Homo Sapiens
PKKIISFVG

SEQ ID NO: 936663 - protein, 9 aa, Homo Sapiens
WQVSLPELE

SEQ ID NO: 936664 - protein, 9 aa, Homo Sapiens
PLRYDLRDQ

SEQ ID NO: 936665 - protein, 9 aa, Homo Sapiens
FQKTGTCSP

SEQ ID NO: 936666 - protein, 9 aa, Homo Sapiens
TPTISVATT

SEQ ID NO: 936667 - protein, 9 aa, Homo Sapiens
YEMRVSHSD

SEQ ID NO: 936668 - protein, 9 aa, Homo Sapiens
QKRSQAAFS

SEQ ID NO: 936669 - protein, 9 aa, Homo Sapiens
YKISDQSGG

SEQ ID NO: 936670 - protein, 9 aa, Homo Sapiens
SAPWINPSP

SEQ ID NO: 936671 - protein, 9 aa, Homo Sapiens
RHPRSHHKD

SEQ ID NO: 936672 - protein, 9 aa, Homo Sapiens
QIVIFFFLF

SEQ ID NO: 936673 - protein, 9 aa, Homo Sapiens
PELREINFC

SEQ ID NO: 936674 - protein, 9 aa, Homo Sapiens
SNPCDFFAF

SEQ ID NO: 936675 - protein, 9 aa, Homo Sapiens
TYQMDGTDD

SEQ ID NO: 936676 - protein, 9 aa, Homo Sapiens
TLPQTVGPL

SEQ ID NO: 936677 - protein, 9 aa, Homo Sapiens
GKKDKMPTT

SEQ ID NO: 936678 - protein, 9 aa, Homo Sapiens
KKLLSAVLR

SEQ ID NO: 936679 - protein, 9 aa, Homo Sapiens
QPVFSLPKG

SEQ ID NO: 936680 - protein, 9 aa, Homo Sapiens
PEFFWPDQN

SEQ ID NO: 936681 - protein, 9 aa, Homo Sapiens
PAQGFRVGT

SEQ ID NO: 936682 - protein, 9 aa, Homo Sapiens
ARIFYELTQ

SEQ ID NO: 936683 - protein, 9 aa, Homo Sapiens
GSQGGVAPN

SEQ ID NO: 936684 - protein, 9 aa, Homo Sapiens
RKCNREEVT

SEQ ID NO: 936685 - protein, 9 aa, Homo Sapiens
ESMGFLARY

SEQ ID NO: 936686 - protein, 9 aa, Homo Sapiens
DGVFQMALE

SEQ ID NO: 936687 - protein, 9 aa, Homo Sapiens
MLLLVVPNI

SEQ ID NO: 936688 - protein, 9 aa, Homo Sapiens
SSSFLSSSS

SEQ ID NO: 936689 - protein, 9 aa, Homo Sapiens
WLRSPVPQR

SEQ ID NO: 936690 - protein, 9 aa, Homo Sapiens
PCDFFAFGV

SEQ ID NO: 936691 - protein, 9 aa, Homo Sapiens
RLHKLPPDE

SEQ ID NO: 936692 - protein, 9 aa, Homo Sapiens
RDTVAALFY

SEQ ID NO: 936693 - protein, 9 aa, Homo Sapiens
PENLGYYLK

SEQ ID NO: 936694 - protein, 9 aa, Homo Sapiens
TPGGCVKEG

SEQ ID NO: 936695 - protein, 9 aa, Homo Sapiens
FLRFFFLSN

SEQ ID NO: 936696 - protein, 9 aa, Homo Sapiens
VFDNICFDT

SEQ ID NO: 936697 - protein, 9 aa, Homo Sapiens
AVKMLKKEA

SEQ ID NO: 936698 - protein, 9 aa, Homo Sapiens
VRYQVLRNP

SEQ ID NO: 936699 - protein, 9 aa, Homo Sapiens
AHGLHNPGR

SEQ ID NO: 936700 - protein, 9 aa, Homo Sapiens
TGEKSSTSL

SEQ ID NO: 936701 - protein, 9 aa, Homo Sapiens
DPSNSDSGT

SEQ ID NO: 936702 - protein, 9 aa, Homo Sapiens
VVCKQLECP

SEQ ID NO: 936703 - protein, 9 aa, Homo Sapiens
YCPNIFSER

SEQ ID NO: 936704 - protein, 9 aa, Homo Sapiens
EEILALVVD

SEQ ID NO: 936705 - protein, 9 aa, Homo Sapiens
VQNFVLLDA

SEQ ID NO: 936706 - protein, 9 aa, Homo Sapiens
ESPEEATPS

SEQ ID NO: 936707 - protein, 9 aa, Homo Sapiens
EAERLEGSQ

SEQ ID NO: 936708 - protein, 9 aa, Homo Sapiens
GTVFIIRGL

SEQ ID NO: 936709 - protein, 9 aa, Homo Sapiens
IIPSESKSF

SEQ ID NO: 936710 - protein, 9 aa, Homo Sapiens
QKRLTTYKD

SEQ ID NO: 936711 - protein, 9 aa, Homo Sapiens
CYGKRGLLT

SEQ ID NO: 936712 - protein, 9 aa, Homo Sapiens
GAWGDYNDS

SEQ ID NO: 936713 - protein, 9 aa, Homo Sapiens
SKRFEIQHR

SEQ ID NO: 936714 - protein, 9 aa, Homo Sapiens
HSLRSALRL

SEQ ID NO: 936715 - protein, 9 aa, Homo Sapiens
SAFSFGFGL

SEQ ID NO: 936716 - protein, 9 aa, Homo Sapiens
ERSPRRGSE

SEQ ID NO: 936717 - protein, 9 aa, Homo Sapiens
VGTVWESSA

SEQ ID NO: 936718 - protein, 9 aa, Homo Sapiens
TESVPSRFR

SEQ ID NO: 936719 - protein, 9 aa, Homo Sapiens
KMRALETQL

SEQ ID NO: 936720 - protein, 9 aa, Homo Sapiens
GCTATLDNF

SEQ ID NO: 936721 - protein, 9 aa, Homo Sapiens
EMLAIMKFI

SEQ ID NO: 936722 - protein, 9 aa, Homo Sapiens
YSSYLAKVD

SEQ ID NO: 936723 - protein, 9 aa, Homo Sapiens
SLPHTISKI

SEQ ID NO: 936724 - protein, 9 aa, Homo Sapiens
KSSKYIFLF

SEQ ID NO: 936725 - protein, 9 aa, Homo Sapiens
HAVQGGIFV

SEQ ID NO: 936726 - protein, 9 aa, Homo Sapiens
MNRQWGTIC

SEQ ID NO: 936727 - protein, 9 aa, Homo Sapiens
VNFLVEKNT

SEQ ID NO: 936728 - protein, 9 aa, Homo Sapiens
LFPSSSFLS

SEQ ID NO: 936729 - protein, 9 aa, Homo Sapiens
LLNKKDNHL

SEQ ID NO: 936730 - protein, 9 aa, Homo Sapiens
ELESMGFLA

SEQ ID NO: 936731 - protein, 9 aa, Homo Sapiens
NTDRSLVCY

SEQ ID NO: 936732 - protein, 9 aa, Homo Sapiens
PRHLPGKDV

SEQ ID NO: 936733 - protein, 9 aa, Homo Sapiens
QPPSHARYS

SEQ ID NO: 936734 - protein, 9 aa, Homo Sapiens
FPLNFRQDV

SEQ ID NO: 936735 - protein, 9 aa, Homo Sapiens
SESSWYNSP

SEQ ID NO: 936736 - protein, 9 aa, Homo Sapiens
FASLKDVPS

SEQ ID NO: 936737 - protein, 9 aa, Homo Sapiens
SLPRLQYKD

SEQ ID NO: 936738 - protein, 9 aa, Homo Sapiens
EVGVIESLL

SEQ ID NO: 936739 - protein, 9 aa, Homo Sapiens
HLEPLATMS

SEQ ID NO: 936740 - protein, 9 aa, Homo Sapiens
YLPSIESDP

SEQ ID NO: 936741 - protein, 9 aa, Homo Sapiens
SVATTISVS

SEQ ID NO: 936742 - protein, 9 aa, Homo Sapiens
QAASPDKGA

SEQ ID NO: 936743 - protein, 9 aa, Homo Sapiens
EKAHLEEIL

SEQ ID NO: 936744 - protein, 9 aa, Homo Sapiens
SEAGEKPYE

SEQ ID NO: 936745 - protein, 9 aa, Homo Sapiens
VFQGMNNES

SEQ ID NO: 936746 - protein, 9 aa, Homo Sapiens
EMFQKTGTC

SEQ ID NO: 936747 - protein, 9 aa, Homo Sapiens
ILALVVDKQ

SEQ ID NO: 936748 - protein, 9 aa, Homo Sapiens
DLRDQITRL

SEQ ID NO: 936749 - protein, 9 aa, Homo Sapiens
LKGATQVVW

SEQ ID NO: 936750 - protein, 9 aa, Homo Sapiens
GQKYMATVT

SEQ ID NO: 936751 - protein, 9 aa, Homo Sapiens
QKLILLDLY

SEQ ID NO: 936752 - protein, 9 aa, Homo Sapiens
SMDGLFLIQ

SEQ ID NO: 936753 - protein, 9 aa, Homo Sapiens
HGLHNPGRC

SEQ ID NO: 936754 - protein, 9 aa, Homo Sapiens
DLVSPKKII

SEQ ID NO: 936755 - protein, 9 aa, Homo Sapiens
NKKDNHLSL

SEQ ID NO: 936756 - protein, 9 aa, Homo Sapiens
LNENPDMLH

SEQ ID NO: 936757 - protein, 9 aa, Homo Sapiens
CDVMTYMRE

SEQ ID NO: 936758 - protein, 9 aa, Homo Sapiens
LDHGASLFI

SEQ ID NO: 936759 - protein, 9 aa, Homo Sapiens
ILVALSWRE

SEQ ID NO: 936760 - protein, 9 aa, Homo Sapiens
AERLEGSQG

SEQ ID NO: 936761 - protein, 9 aa, Homo Sapiens
FLIQASVQD

SEQ ID NO: 936762 - protein, 9 aa, Homo Sapiens
AGDLAYQIL

SEQ ID NO: 936763 - protein, 9 aa, Homo Sapiens
TLIVHQRIY

SEQ ID NO: 936764 - protein, 9 aa, Homo Sapiens
YKIPLCNLD

SEQ ID NO: 936765 - protein, 9 aa, Homo Sapiens
LGGFHGCIY

SEQ ID NO: 936766 - protein, 9 aa, Homo Sapiens
KKAAENGAL

SEQ ID NO: 936767 - protein, 9 aa, Homo Sapiens
PTLFLAVPR

SEQ ID NO: 936768 - protein, 9 aa, Homo Sapiens
MLKKEASAD

SEQ ID NO: 936769 - protein, 9 aa, Homo Sapiens
QKAGVNGRY

SEQ ID NO: 936770 - protein, 9 aa, Homo Sapiens
DCCLCCCCG

SEQ ID NO: 936771 - protein, 9 aa, Homo Sapiens
FGSKTRPQY

SEQ ID NO: 936772 - protein, 9 aa, Homo Sapiens
MYLLVPFLN

SEQ ID NO: 936773 - protein, 9 aa, Homo Sapiens
RVITREMVE

SEQ ID NO: 936774 - protein, 9 aa, Homo Sapiens
SLSPEPVDI

SEQ ID NO: 936775 - protein, 9 aa, Homo Sapiens
SDRKVPSRF

SEQ ID NO: 936776 - protein, 9 aa, Homo Sapiens
MLMLLLVVP

SEQ ID NO: 936777 - protein, 9 aa, Homo Sapiens
LQEQLKVVH

SEQ ID NO: 936778 - protein, 9 aa, Homo Sapiens
VVHEQLAAL

SEQ ID NO: 936779 - protein, 9 aa, Homo Sapiens
IMKFIYDMM

SEQ ID NO: 936780 - protein, 9 aa, Homo Sapiens
GAGQQAGPA

SEQ ID NO: 936781 - protein, 9 aa, Homo Sapiens
WRARAECSA

SEQ ID NO: 936782 - protein, 9 aa, Homo Sapiens
STYSLERDT

SEQ ID NO: 936783 - protein, 9 aa, Homo Sapiens
ASPDKGALV

SEQ ID NO: 936784 - protein, 9 aa, Homo Sapiens
EPSACPSGP

SEQ ID NO: 936785 - protein, 9 aa, Homo Sapiens
TSRSTLSLS

SEQ ID NO: 936786 - protein, 9 aa, Homo Sapiens
NHSRILSEN

SEQ ID NO: 936787 - protein, 9 aa, Homo Sapiens
AIQVEERLD

SEQ ID NO: 936788 - protein, 9 aa, Homo Sapiens
VMTYMRETC

SEQ ID NO: 936789 - protein, 9 aa, Homo Sapiens
KQLECPFSV

SEQ ID NO: 936790 - protein, 9 aa, Homo Sapiens
DLFDSLPGT

SEQ ID NO: 936791 - protein, 9 aa, Homo Sapiens
SETQSGQLV

SEQ ID NO: 936792 - protein, 9 aa, Homo Sapiens
HTIDFFEMC

SEQ ID NO: 936793 - protein, 9 aa, Homo Sapiens
TASSPEGPQ

SEQ ID NO: 936794 - protein, 9 aa, Homo Sapiens
FLDNLGNAK

SEQ ID NO: 936795 - protein, 9 aa, Homo Sapiens
QEGPRGPHL

SEQ ID NO: 936796 - protein, 9 aa, Homo Sapiens
SSNLFESPE

SEQ ID NO: 936797 - protein, 9 aa, Homo Sapiens
SYSSKKKKM

SEQ ID NO: 936798 - protein, 9 aa, Homo Sapiens
WRGTSRLPE

SEQ ID NO: 936799 - protein, 9 aa, Homo Sapiens
RGFYCNNES

SEQ ID NO: 936800 - protein, 9 aa, Homo Sapiens
DRGFDELPG

SEQ ID NO: 936801 - protein, 9 aa, Homo Sapiens
FSTFLGLGF

SEQ ID NO: 936802 - protein, 9 aa, Homo Sapiens
VPETSAPRK

SEQ ID NO: 936803 - protein, 9 aa, Homo Sapiens
SQGGVAPNQ

SEQ ID NO: 936804 - protein, 9 aa, Homo Sapiens
LLVVMAYDC

SEQ ID NO: 936805 - protein, 9 aa, Homo Sapiens
RAHASRGNA

SEQ ID NO: 936806 - protein, 9 aa, Homo Sapiens
FSIMKFSLY

SEQ ID NO: 936807 - protein, 9 aa, Homo Sapiens
ESISLCNTI

SEQ ID NO: 936808 - protein, 9 aa, Homo Sapiens
EPNSQSKFS

SEQ ID NO: 936809 - protein, 9 aa, Homo Sapiens
QALLRHLEP

SEQ ID NO: 936810 - protein, 9 aa, Homo Sapiens
CQCNSHFKS

SEQ ID NO: 936811 - protein, 9 aa, Homo Sapiens
LVVCKQLEC

SEQ ID NO: 936812 - protein, 9 aa, Homo Sapiens
LWVNINQME

SEQ ID NO: 936813 - protein, 9 aa, Homo Sapiens
SIKIGDWYM

SEQ ID NO: 936814 - protein, 9 aa, Homo Sapiens
LRFFFLSND

SEQ ID NO: 936815 - protein, 9 aa, Homo Sapiens
NFVLLDAYT

SEQ ID NO: 936816 - protein, 9 aa, Homo Sapiens
SNSIKIGDW

SEQ ID NO: 936817 - protein, 9 aa, Homo Sapiens
DECNIMKDF

SEQ ID NO: 936818 - protein, 9 aa, Homo Sapiens
WKQSKKFSL

SEQ ID NO: 936819 - protein, 9 aa, Homo Sapiens
TQKRLTTYK

SEQ ID NO: 936820 - protein, 9 aa, Homo Sapiens
VEGYSSNYK

SEQ ID NO: 936821 - protein, 9 aa, Homo Sapiens
CQEDRSFWN

SEQ ID NO: 936822 - protein, 9 aa, Homo Sapiens
AATSGLGPL

SEQ ID NO: 936823 - protein, 9 aa, Homo Sapiens
GQQAGPARG

SEQ ID NO: 936824 - protein, 9 aa, Homo Sapiens
AWQVSLPEL

SEQ ID NO: 936825 - protein, 9 aa, Homo Sapiens
QQGETPAVS

SEQ ID NO: 936826 - protein, 9 aa, Homo Sapiens
AADTHILVG

SEQ ID NO: 936827 - protein, 9 aa, Homo Sapiens
LGYYLKMKD

SEQ ID NO: 936828 - protein, 9 aa, Homo Sapiens
SQRVIYLQD

SEQ ID NO: 936829 - protein, 9 aa, Homo Sapiens
NQKVGWDLE

SEQ ID NO: 936830 - protein, 9 aa, Homo Sapiens
STLQDQRIV

SEQ ID NO: 936831 - protein, 9 aa, Homo Sapiens
RTTLRDEDA

SEQ ID NO: 936832 - protein, 9 aa, Homo Sapiens
QKQRIVIAR

SEQ ID NO: 936833 - protein, 9 aa, Homo Sapiens
VQVGSTLQD

SEQ ID NO: 936834 - protein, 9 aa, Homo Sapiens
SENFGSVRS

SEQ ID NO: 936835 - protein, 9 aa, Homo Sapiens
DFPGPRGPA

SEQ ID NO: 936836 - protein, 9 aa, Homo Sapiens
NFRQDVICI

SEQ ID NO: 936837 - protein, 9 aa, Homo Sapiens
QRSEHVQES

SEQ ID NO: 936838 - protein, 9 aa, Homo Sapiens
SFLRITVAL

SEQ ID NO: 936839 - protein, 9 aa, Homo Sapiens
GTCVNLPDE

SEQ ID NO: 936840 - protein, 9 aa, Homo Sapiens
TQPEDGVKM

SEQ ID NO: 936841 - protein, 9 aa, Homo Sapiens
IKSKFASLK

SEQ ID NO: 936842 - protein, 9 aa, Homo Sapiens
AAASSMALP

SEQ ID NO: 936843 - protein, 9 aa, Homo Sapiens
LYTCNECGK

SEQ ID NO: 936844 - protein, 9 aa, Homo Sapiens
SRLQADART

SEQ ID NO: 936845 - protein, 9 aa, Homo Sapiens
IISLNQGLK

SEQ ID NO: 936846 - protein, 9 aa, Homo Sapiens
ITTIPGNVF

SEQ ID NO: 936847 - protein, 9 aa, Homo Sapiens
TCSPEQGPP

SEQ ID NO: 936848 - protein, 9 aa, Homo Sapiens
LIVANRGTL

SEQ ID NO: 936849 - protein, 9 aa, Homo Sapiens
IKENIQEKG

SEQ ID NO: 936850 - protein, 9 aa, Homo Sapiens
ATSWQSVFV

SEQ ID NO: 936851 - protein, 9 aa, Homo Sapiens
GPDFPGPRG

SEQ ID NO: 936852 - protein, 9 aa, Homo Sapiens
PESGVLFAA

SEQ ID NO: 936853 - protein, 9 aa, Homo Sapiens
LASLEKTEE

SEQ ID NO: 936854 - protein, 9 aa, Homo Sapiens
ATRWADFFD

SEQ ID NO: 936855 - protein, 9 aa, Homo Sapiens
SWIFSLAVL

SEQ ID NO: 936856 - protein, 9 aa, Homo Sapiens
PLEAANRLC

SEQ ID NO: 936857 - protein, 9 aa, Homo Sapiens
EIKSKFASL

SEQ ID NO: 936858 - protein, 9 aa, Homo Sapiens
GLLIVANRG

SEQ ID NO: 936859 - protein, 9 aa, Homo Sapiens
KIPLCNLDQ

SEQ ID NO: 936860 - protein, 9 aa, Homo Sapiens
AGEPADLSG

SEQ ID NO: 936861 - protein, 9 aa, Homo Sapiens
ETQTENQKV

SEQ ID NO: 936862 - protein, 9 aa, Homo Sapiens
YTIRMRLLN

SEQ ID NO: 936863 - protein, 9 aa, Homo Sapiens
EKPIKSVPQ

SEQ ID NO: 936864 - protein, 9 aa, Homo Sapiens
NINWVESNL

SEQ ID NO: 936865 - protein, 9 aa, Homo Sapiens
HSRILSENF

SEQ ID NO: 936866 - protein, 9 aa, Homo Sapiens
PMNGETFSQ

SEQ ID NO: 936867 - protein, 9 aa, Homo Sapiens
KYIFLFIRD

SEQ ID NO: 936868 - protein, 9 aa, Homo Sapiens
FVYVVSLQS

SEQ ID NO: 936869 - protein, 9 aa, Homo Sapiens
EIGEPSRPS

SEQ ID NO: 936870 - protein, 9 aa, Homo Sapiens
RGLLDCKGS

SEQ ID NO: 936871 - protein, 9 aa, Homo Sapiens
ISLSVLFPD

SEQ ID NO: 936872 - protein, 9 aa, Homo Sapiens
PTISVATTI

SEQ ID NO: 936873 - protein, 9 aa, Homo Sapiens
NLKGDHSDA

SEQ ID NO: 936874 - protein, 9 aa, Homo Sapiens
AHLMKDIRN

SEQ ID NO: 936875 - protein, 9 aa, Homo Sapiens
GYGGCDRDY

SEQ ID NO: 936876 - protein, 9 aa, Homo Sapiens
KLSEQYLEA

SEQ ID NO: 936877 - protein, 9 aa, Homo Sapiens
WILFLPMAW

SEQ ID NO: 936878 - protein, 9 aa, Homo Sapiens
IYGTEIDMK

SEQ ID NO: 936879 - protein, 9 aa, Homo Sapiens
YVNFLINPL

SEQ ID NO: 936880 - protein, 9 aa, Homo Sapiens
SGSKVLTSV

SEQ ID NO: 936881 - protein, 9 aa, Homo Sapiens
VTIHEILGW

SEQ ID NO: 936882 - protein, 9 aa, Homo Sapiens
KQFLTRMTR

SEQ ID NO: 936883 - protein, 9 aa, Homo Sapiens
RCLEEWQKA

SEQ ID NO: 936884 - protein, 9 aa, Homo Sapiens
EGPNGSPGS

SEQ ID NO: 936885 - protein, 9 aa, Homo Sapiens
SFLSSSSPL

SEQ ID NO: 936886 - protein, 9 aa, Homo Sapiens
ASTPTISVA

SEQ ID NO: 936887 - protein, 9 aa, Homo Sapiens
FLVEKNTVS

SEQ ID NO: 936888 - protein, 9 aa, Homo Sapiens
VVPRDQNFQ

SEQ ID NO: 936889 - protein, 9 aa, Homo Sapiens
LRLKDEMFS

SEQ ID NO: 936890 - protein, 9 aa, Homo Sapiens
FFFTHLSFI

SEQ ID NO: 936891 - protein, 9 aa, Homo Sapiens
QQAGPARGT

SEQ ID NO: 936892 - protein, 9 aa, Homo Sapiens
LMLVAVLTY

SEQ ID NO: 936893 - protein, 9 aa, Homo Sapiens
CGFLTLEDF

SEQ ID NO: 936894 - protein, 9 aa, Homo Sapiens
SNDLKRQGL

SEQ ID NO: 936895 - protein, 9 aa, Homo Sapiens
EEGGAGRDF

SEQ ID NO: 936896 - protein, 9 aa, Homo Sapiens
KFPTCLQCH

SEQ ID NO: 936897 - protein, 9 aa, Homo Sapiens
SRHPRSHHK

SEQ ID NO: 936898 - protein, 9 aa, Homo Sapiens
WGGEQDIPY

SEQ ID NO: 936899 - protein, 9 aa, Homo Sapiens
GFSGGLSPS

SEQ ID NO: 936900 - protein, 9 aa, Homo Sapiens
VDWIAGNIN

SEQ ID NO: 936901 - protein, 9 aa, Homo Sapiens
ALPLRRAES

SEQ ID NO: 936902 - protein, 9 aa, Homo Sapiens
TIKVASVFY

SEQ ID NO: 936903 - protein, 9 aa, Homo Sapiens
GGCVKEGGL

SEQ ID NO: 936904 - protein, 9 aa, Homo Sapiens
RVLSTVDPS

SEQ ID NO: 936905 - protein, 9 aa, Homo Sapiens
QDFPLDCWV

SEQ ID NO: 936906 - protein, 9 aa, Homo Sapiens
TAFDTYYCG

SEQ ID NO: 936907 - protein, 9 aa, Homo Sapiens
NQPQGPLPP

SEQ ID NO: 936908 - protein, 9 aa, Homo Sapiens
GFQNLKILN

SEQ ID NO: 936909 - protein, 9 aa, Homo Sapiens
ESLLMYEDS

SEQ ID NO: 936910 - protein, 9 aa, Homo Sapiens
RNETSGSKV

SEQ ID NO: 936911 - protein, 9 aa, Homo Sapiens
LNKKDNHLS

SEQ ID NO: 936912 - protein, 9 aa, Homo Sapiens
LPHTISKIL

SEQ ID NO: 936913 - protein, 9 aa, Homo Sapiens
IFGNLLLYV

SEQ ID NO: 936914 - protein, 9 aa, Homo Sapiens
TPKLSMDGL

SEQ ID NO: 936915 - protein, 9 aa, Homo Sapiens
RDHVILQKY

SEQ ID NO: 936916 - protein, 9 aa, Homo Sapiens
VAQQIYGTE

SEQ ID NO: 936917 - protein, 9 aa, Homo Sapiens
IDFRKKRVV

SEQ ID NO: 936918 - protein, 9 aa, Homo Sapiens
STSGDHHIF

SEQ ID NO: 936919 - protein, 9 aa, Homo Sapiens
RAPVRGGDR

SEQ ID NO: 936920 - protein, 9 aa, Homo Sapiens
SSKYIFLFI

SEQ ID NO: 936921 - protein, 9 aa, Homo Sapiens
LAKVDQKRG

SEQ ID NO: 936922 - protein, 9 aa, Homo Sapiens
DWIAGNINW

SEQ ID NO: 936923 - protein, 9 aa, Homo Sapiens
FDMIVIGML

SEQ ID NO: 936924 - protein, 9 aa, Homo Sapiens
YCSAGVGRT

SEQ ID NO: 936925 - protein, 9 aa, Homo Sapiens
DPSEALQPL

SEQ ID NO: 936926 - protein, 9 aa, Homo Sapiens
DLTPMNGET

SEQ ID NO: 936927 - protein, 9 aa, Homo Sapiens
SEQALLRNV

SEQ ID NO: 936928 - protein, 9 aa, Homo Sapiens
SSWYNSPWG

SEQ ID NO: 936929 - protein, 9 aa, Homo Sapiens
EGDCLSPFH

SEQ ID NO: 936930 - protein, 9 aa, Homo Sapiens
VLSTVDPSE

SEQ ID NO: 936931 - protein, 9 aa, Homo Sapiens
WIFSLAVLL

SEQ ID NO: 936932 - protein, 9 aa, Homo Sapiens
GKKETLAAA

SEQ ID NO: 936933 - protein, 9 aa, Homo Sapiens
LMKDIRNYF

SEQ ID NO: 936934 - protein, 9 aa, Homo Sapiens
QHIRMHMGD

SEQ ID NO: 936935 - protein, 9 aa, Homo Sapiens
WEIFGSAEP

SEQ ID NO: 936936 - protein, 9 aa, Homo Sapiens
SYLAKVDQK

SEQ ID NO: 936937 - protein, 9 aa, Homo Sapiens
KIYFNRSNQ

SEQ ID NO: 936938 - protein, 9 aa, Homo Sapiens
LDYLRKCNR

SEQ ID NO: 936939 - protein, 9 aa, Homo Sapiens
SLGVVLPTS

SEQ ID NO: 936940 - protein, 9 aa, Homo Sapiens
LKMRAIQVE

SEQ ID NO: 936941 - protein, 9 aa, Homo Sapiens
KIGDWYMVN

SEQ ID NO: 936942 - protein, 9 aa, Homo Sapiens
PVFSLPKGE

SEQ ID NO: 936943 - protein, 9 aa, Homo Sapiens
NSRHTIKVA

SEQ ID NO: 936944 - protein, 9 aa, Homo Sapiens
VSSISRIRR

SEQ ID NO: 936945 - protein, 9 aa, Homo Sapiens
ATLDNFAKA

SEQ ID NO: 936946 - protein, 9 aa, Homo Sapiens
SDSGTETEL

SEQ ID NO: 936947 - protein, 9 aa, Homo Sapiens
KENKEMLFN

SEQ ID NO: 936948 - protein, 9 aa, Homo Sapiens
LYTIRMRLL

SEQ ID NO: 936949 - protein, 9 aa, Homo Sapiens
KLNELELGN

SEQ ID NO: 936950 - protein, 9 aa, Homo Sapiens
RRACHILKC

SEQ ID NO: 936951 - protein, 9 aa, Homo Sapiens
LFGSKTRPQ

SEQ ID NO: 936952 - protein, 9 aa, Homo Sapiens
NLPDEYRCV

SEQ ID NO: 936953 - protein, 9 aa, Homo Sapiens
LSFADDLLT

SEQ ID NO: 936954 - protein, 9 aa, Homo Sapiens
NYLSSVGKL

SEQ ID NO: 936955 - protein, 9 aa, Homo Sapiens
VLEDFVDRD

SEQ ID NO: 936956 - protein, 9 aa, Homo Sapiens
FSVAFELVI

SEQ ID NO: 936957 - protein, 9 aa, Homo Sapiens
KVLVVVGGQ

SEQ ID NO: 936958 - protein, 9 aa, Homo Sapiens
TQVVWNCNK

SEQ ID NO: 936959 - protein, 9 aa, Homo Sapiens
RGFDWSLHF

SEQ ID NO: 936960 - protein, 9 aa, Homo Sapiens
MNESKDTDS

SEQ ID NO: 936961 - protein, 9 aa, Homo Sapiens
SFRAALSSQ

SEQ ID NO: 936962 - protein, 9 aa, Homo Sapiens
GGIFVERMY

SEQ ID NO: 936963 - protein, 9 aa, Homo Sapiens
SDGDKEDEL

SEQ ID NO: 936964 - protein, 9 aa, Homo Sapiens
LVDLVSPKK

SEQ ID NO: 936965 - protein, 9 aa, Homo Sapiens
LAYQILPLR

SEQ ID NO: 936966 - protein, 9 aa, Homo Sapiens
KNFLEQERA

SEQ ID NO: 936967 - protein, 9 aa, Homo Sapiens
YEDLINKSE

SEQ ID NO: 936968 - protein, 9 aa, Homo Sapiens
AQHQAFLET

SEQ ID NO: 936969 - protein, 9 aa, Homo Sapiens
NIAFLGESL

SEQ ID NO: 936970 - protein, 9 aa, Homo Sapiens
MFSGKEFGP

SEQ ID NO: 936971 - protein, 9 aa, Homo Sapiens
RCFLRNKTC

SEQ ID NO: 936972 - protein, 9 aa, Homo Sapiens
HKLPPDELF

SEQ ID NO: 936973 - protein, 9 aa, Homo Sapiens
IFFFLFITY

SEQ ID NO: 936974 - protein, 9 aa, Homo Sapiens
NLGNAKSHL

SEQ ID NO: 936975 - protein, 9 aa, Homo Sapiens
NKKMKEKQP

SEQ ID NO: 936976 - protein, 9 aa, Homo Sapiens
LTLWGFYTK

SEQ ID NO: 936977 - protein, 9 aa, Homo Sapiens
RRAESLCSP

SEQ ID NO: 936978 - protein, 9 aa, Homo Sapiens
GYHGHGPSS

SEQ ID NO: 936979 - protein, 9 aa, Homo Sapiens
CKGSWKKLD

SEQ ID NO: 936980 - protein, 9 aa, Homo Sapiens
IKIGDWYMV

SEQ ID NO: 936981 - protein, 9 aa, Homo Sapiens
IKSVPQDLD

SEQ ID NO: 936982 - protein, 9 aa, Homo Sapiens
RQNSSSTGW

SEQ ID NO: 936983 - protein, 9 aa, Homo Sapiens
QSVFVKWDP

SEQ ID NO: 936984 - protein, 9 aa, Homo Sapiens
VLSGHLSFC

SEQ ID NO: 936985 - protein, 9 aa, Homo Sapiens
ERKITCNQK

SEQ ID NO: 936986 - protein, 9 aa, Homo Sapiens
CLSPFHRRL

SEQ ID NO: 936987 - protein, 9 aa, Homo Sapiens
TFHMIVVSM

SEQ ID NO: 936988 - protein, 9 aa, Homo Sapiens
RDGYGGCDR

SEQ ID NO: 936989 - protein, 9 aa, Homo Sapiens
PTQLLTLTS

SEQ ID NO: 936990 - protein, 9 aa, Homo Sapiens
LKQVQLEQD

SEQ ID NO: 936991 - protein, 9 aa, Homo Sapiens
NISITRMLV

SEQ ID NO: 936992 - protein, 9 aa, Homo Sapiens
AKFQELGLN

SEQ ID NO: 936993 - protein, 9 aa, Homo Sapiens
LDKENKEML

SEQ ID NO: 936994 - protein, 9 aa, Homo Sapiens
PSESKSFRA

SEQ ID NO: 936995 - protein, 9 aa, Homo Sapiens
EDPDDNLRM

SEQ ID NO: 936996 - protein, 9 aa, Homo Sapiens
ARSMGGKKD

SEQ ID NO: 936997 - protein, 9 aa, Homo Sapiens
QPGLGQPGR

SEQ ID NO: 936998 - protein, 9 aa, Homo Sapiens
EDDPRWLEA

SEQ ID NO: 936999 - protein, 9 aa, Homo Sapiens
VKTTANEAE

SEQ ID NO: 937000 - protein, 9 aa, Homo Sapiens
ILKCCDGLA

SEQ ID NO: 937001 - protein, 9 aa, Homo Sapiens
VHWFSVQKL

SEQ ID NO: 937002 - protein, 9 aa, Homo Sapiens
TQLLTLTSW

SEQ ID NO: 937003 - protein, 9 aa, Homo Sapiens
FYTKLNDCH

SEQ ID NO: 937004 - protein, 9 aa, Homo Sapiens
HHPAQGFRV

SEQ ID NO: 937005 - protein, 9 aa, Homo Sapiens
CLLCCNNRH

SEQ ID NO: 937006 - protein, 9 aa, Homo Sapiens
RSLVCYGKR

SEQ ID NO: 937007 - protein, 9 aa, Homo Sapiens
MRVSHSDTT

SEQ ID NO: 937008 - protein, 9 aa, Homo Sapiens
KVGWDLEPL

SEQ ID NO: 937009 - protein, 9 aa, Homo Sapiens
ERRNWVKIY

SEQ ID NO: 937010 - protein, 9 aa, Homo Sapiens
SERKPFSSG

SEQ ID NO: 937011 - protein, 9 aa, Homo Sapiens
DEFDLDLTY

SEQ ID NO: 937012 - protein, 9 aa, Homo Sapiens
IGYPVMIKV

SEQ ID NO: 937013 - protein, 9 aa, Homo Sapiens
SYMYRHSHN

SEQ ID NO: 937014 - protein, 9 aa, Homo Sapiens
VMQDPIYKI

SEQ ID NO: 937015 - protein, 9 aa, Homo Sapiens
YLHGDICNM

SEQ ID NO: 937016 - protein, 9 aa, Homo Sapiens
QGETPAVSS

SEQ ID NO: 937017 - protein, 9 aa, Homo Sapiens
SWYPSPSPV

SEQ ID NO: 937018 - protein, 9 aa, Homo Sapiens
TISVATTIS

SEQ ID NO: 937019 - protein, 9 aa, Homo Sapiens
KLLSAVLRA

SEQ ID NO: 937020 - protein, 9 aa, Homo Sapiens
DPDDNLRMQ

SEQ ID NO: 937021 - protein, 9 aa, Homo Sapiens
SNSDSGTET

SEQ ID NO: 937022 - protein, 9 aa, Homo Sapiens
FSPPVPPGT

SEQ ID NO: 937023 - protein, 9 aa, Homo Sapiens
YHRGFYCNN

SEQ ID NO: 937024 - protein, 9 aa, Homo Sapiens
SQVVTLPQT

SEQ ID NO: 937025 - protein, 9 aa, Homo Sapiens
TRFRVSWYP

SEQ ID NO: 937026 - protein, 9 aa, Homo Sapiens
DNSYFGAGF

SEQ ID NO: 937027 - protein, 9 aa, Homo Sapiens
GFLARYNFT

SEQ ID NO: 937028 - protein, 9 aa, Homo Sapiens
GEKENIGLP

SEQ ID NO: 937029 - protein, 9 aa, Homo Sapiens
LLIILAPGS

SEQ ID NO: 937030 - protein, 9 aa, Homo Sapiens
LRSPVPQRS

SEQ ID NO: 937031 - protein, 9 aa, Homo Sapiens
REQHSLFSR

SEQ ID NO: 937032 - protein, 9 aa, Homo Sapiens
LAPGSYLSL

SEQ ID NO: 937033 - protein, 9 aa, Homo Sapiens
AIDARIFYE

SEQ ID NO: 937034 - protein, 9 aa, Homo Sapiens
SSAHLHREQ

SEQ ID NO: 937035 - protein, 9 aa, Homo Sapiens
QVVTLPQTV

SEQ ID NO: 937036 - protein, 9 aa, Homo Sapiens
RLESSPHYV

SEQ ID NO: 937037 - protein, 9 aa, Homo Sapiens
VGKESISLC

SEQ ID NO: 937038 - protein, 9 aa, Homo Sapiens
DNLGNAKSH

SEQ ID NO: 937039 - protein, 9 aa, Homo Sapiens
GEDGVFQMA

SEQ ID NO: 937040 - protein, 9 aa, Homo Sapiens
GKAKAQICK

SEQ ID NO: 937041 - protein, 9 aa, Homo Sapiens
TKDKQLEDG

SEQ ID NO: 937042 - protein, 9 aa, Homo Sapiens
KQSKKFSLF

SEQ ID NO: 937043 - protein, 9 aa, Homo Sapiens
KKPFKKKGK

SEQ ID NO: 937044 - protein, 9 aa, Homo Sapiens
MKLRGLLDC

SEQ ID NO: 937045 - protein, 9 aa, Homo Sapiens
MYLHGDICN

SEQ ID NO: 937046 - protein, 9 aa, Homo Sapiens
TVAANVIEI

SEQ ID NO: 937047 - protein, 9 aa, Homo Sapiens
ILVGAHRLR

SEQ ID NO: 937048 - protein, 9 aa, Homo Sapiens
TVDPSEALQ

SEQ ID NO: 937049 - protein, 9 aa, Homo Sapiens
LKETQPFPK

SEQ ID NO: 937050 - protein, 9 aa, Homo Sapiens
SSEPEEEDV

SEQ ID NO: 937051 - protein, 9 aa, Homo Sapiens
LECPFSVFG

SEQ ID NO: 937052 - protein, 9 aa, Homo Sapiens
VIESLLMYE

SEQ ID NO: 937053 - protein, 9 aa, Homo Sapiens
SETTVPPSG

SEQ ID NO: 937054 - protein, 9 aa, Homo Sapiens
RGHSQKFPT

SEQ ID NO: 937055 - protein, 9 aa, Homo Sapiens
SSESSWYNS

SEQ ID NO: 937056 - protein, 9 aa, Homo Sapiens
KVLPVPVLS

SEQ ID NO: 937057 - protein, 9 aa, Homo Sapiens
KCDLPEWCN

SEQ ID NO: 937058 - protein, 9 aa, Homo Sapiens
AVSPAVLVY

SEQ ID NO: 937059 - protein, 9 aa, Homo Sapiens
LCMINEFGY

SEQ ID NO: 937060 - protein, 9 aa, Homo Sapiens
EKKRLFFLR

SEQ ID NO: 937061 - protein, 9 aa, Homo Sapiens
CVKEGGLKG

SEQ ID NO: 937062 - protein, 9 aa, Homo Sapiens
RSVFVSLKP

SEQ ID NO: 937063 - protein, 9 aa, Homo Sapiens
LKDNSYFGA

SEQ ID NO: 937064 - protein, 9 aa, Homo Sapiens
KCCDGLAQD

SEQ ID NO: 937065 - protein, 9 aa, Homo Sapiens
NLCIILLIR

SEQ ID NO: 937066 - protein, 9 aa, Homo Sapiens
AYQILPLRA

SEQ ID NO: 937067 - protein, 9 aa, Homo Sapiens
TVFIIRGLR

SEQ ID NO: 937068 - protein, 9 aa, Homo Sapiens
GTYKISDQS

SEQ ID NO: 937069 - protein, 9 aa, Homo Sapiens
STREEKKRW

SEQ ID NO: 937070 - protein, 9 aa, Homo Sapiens
KSSTSLTVK

SEQ ID NO: 937071 - protein, 9 aa, Homo Sapiens
IDFFEMCAS

SEQ ID NO: 937072 - protein, 9 aa, Homo Sapiens
SPEPVDIIR

SEQ ID NO: 937073 - protein, 9 aa, Homo Sapiens
GGLSPSSGF

SEQ ID NO: 937074 - protein, 9 aa, Homo Sapiens
LSLSPEPVD

SEQ ID NO: 937075 - protein, 9 aa, Homo Sapiens
LEGMERISV

SEQ ID NO: 937076 - protein, 9 aa, Homo Sapiens
LLVVPNIIL

SEQ ID NO: 937077 - protein, 9 aa, Homo Sapiens
IVHQRIYTG

SEQ ID NO: 937078 - protein, 9 aa, Homo Sapiens
GYSLLKRFL

SEQ ID NO: 937079 - protein, 9 aa, Homo Sapiens
YSFVPAGSE

SEQ ID NO: 937080 - protein, 9 aa, Homo Sapiens
LQNPASFFF

SEQ ID NO: 937081 - protein, 9 aa, Homo Sapiens
YTRFRVSWY

SEQ ID NO: 937082 - protein, 9 aa, Homo Sapiens
RKMRALETQ

SEQ ID NO: 937083 - protein, 9 aa, Homo Sapiens
PSTPDFFMD

SEQ ID NO: 937084 - protein, 9 aa, Homo Sapiens
LACPDPSLC

SEQ ID NO: 937085 - protein, 9 aa, Homo Sapiens
LPDEYRCVC

SEQ ID NO: 937086 - protein, 9 aa, Homo Sapiens
NCHRTNLNE

SEQ ID NO: 937087 - protein, 9 aa, Homo Sapiens
IGKRAMKCS

SEQ ID NO: 937088 - protein, 9 aa, Homo Sapiens
LTNLYVQHA

SEQ ID NO: 937089 - protein, 9 aa, Homo Sapiens
VFAHGLHNP

SEQ ID NO: 937090 - protein, 9 aa, Homo Sapiens
EAAVLAVGI

SEQ ID NO: 937091 - protein, 9 aa, Homo Sapiens
KTLKPTLFL

SEQ ID NO: 937092 - protein, 9 aa, Homo Sapiens
DDNLRMQNG

SEQ ID NO: 937093 - protein, 9 aa, Homo Sapiens
WKRGTSEIV

SEQ ID NO: 937094 - protein, 9 aa, Homo Sapiens
KCNREEVTA

SEQ ID NO: 937095 - protein, 9 aa, Homo Sapiens
FESPEEATP

SEQ ID NO: 937096 - protein, 9 aa, Homo Sapiens
EKLYTCNEC

SEQ ID NO: 937097 - protein, 9 aa, Homo Sapiens
GSIDYDECN

SEQ ID NO: 937098 - protein, 9 aa, Homo Sapiens
VYCSAGVGR

SEQ ID NO: 937099 - protein, 9 aa, Homo Sapiens
LPRLQYKDD

SEQ ID NO: 937100 - protein, 9 aa, Homo Sapiens
VNINQMEKD

SEQ ID NO: 937101 - protein, 9 aa, Homo Sapiens
GRGPHIEDG

SEQ ID NO: 937102 - protein, 9 aa, Homo Sapiens
PTGTASSPE

SEQ ID NO: 937103 - protein, 9 aa, Homo Sapiens
NSHFKSCHY

SEQ ID NO: 937104 - protein, 9 aa, Homo Sapiens
PGIEKKAAE

SEQ ID NO: 937105 - protein, 9 aa, Homo Sapiens
GETPAVSSS

SEQ ID NO: 937106 - protein, 9 aa, Homo Sapiens
LPQTVGPLQ

SEQ ID NO: 937107 - protein, 9 aa, Homo Sapiens
RYTRDEFDL

SEQ ID NO: 937108 - protein, 9 aa, Homo Sapiens
SRGNAPPRG

SEQ ID NO: 937109 - protein, 9 aa, Homo Sapiens
VSRLQADAR

SEQ ID NO: 937110 - protein, 9 aa, Homo Sapiens
FAASLEMGN

SEQ ID NO: 937111 - protein, 9 aa, Homo Sapiens
SLLLRHYHY

SEQ ID NO: 937112 - protein, 9 aa, Homo Sapiens
DKSSKYIFL

SEQ ID NO: 937113 - protein, 9 aa, Homo Sapiens
TLCQTYVKC

SEQ ID NO: 937114 - protein, 9 aa, Homo Sapiens
AIRTLFFVT

SEQ ID NO: 937115 - protein, 9 aa, Homo Sapiens
SPLQNPASF

SEQ ID NO: 937116 - protein, 9 aa, Homo Sapiens
EGSLEEATT

SEQ ID NO: 937117 - protein, 9 aa, Homo Sapiens
KSETTVPPS

SEQ ID NO: 937118 - protein, 9 aa, Homo Sapiens
GLHNPGRCA

SEQ ID NO: 937119 - protein, 9 aa, Homo Sapiens
VDSNDLKRQ

SEQ ID NO: 937120 - protein, 9 aa, Homo Sapiens
IVQAIRAPR

SEQ ID NO: 937121 - protein, 9 aa, Homo Sapiens
PDEKIPDLF

SEQ ID NO: 937122 - protein, 9 aa, Homo Sapiens
LSIQLQLKE

SEQ ID NO: 937123 - protein, 9 aa, Homo Sapiens
FTVFLHCVT

SEQ ID NO: 937124 - protein, 9 aa, Homo Sapiens
QRCGGYCGC

SEQ ID NO: 937125 - protein, 9 aa, Homo Sapiens
GGKKDLIWE

SEQ ID NO: 937126 - protein, 9 aa, Homo Sapiens
SPVFDNICF

SEQ ID NO: 937127 - protein, 9 aa, Homo Sapiens
IGDWYMVND

SEQ ID NO: 937128 - protein, 9 aa, Homo Sapiens
NIFGNLLLY

SEQ ID NO: 937129 - protein, 9 aa, Homo Sapiens
EELLLVMTA

SEQ ID NO: 937130 - protein, 9 aa, Homo Sapiens
GLSPSSGFD

SEQ ID NO: 937131 - protein, 9 aa, Homo Sapiens
EDVPAHLMK

SEQ ID NO: 937132 - protein, 9 aa, Homo Sapiens
TCTFHMIVV

SEQ ID NO: 937133 - protein, 9 aa, Homo Sapiens
PIYKIFYVS

SEQ ID NO: 937134 - protein, 9 aa, Homo Sapiens
KTRPQYSSP

SEQ ID NO: 937135 - protein, 9 aa, Homo Sapiens
FGFGLVTWL

SEQ ID NO: 937136 - protein, 9 aa, Homo Sapiens
GFYCNNESI

SEQ ID NO: 937137 - protein, 9 aa, Homo Sapiens
YTLFESFFG

SEQ ID NO: 937138 - protein, 9 aa, Homo Sapiens
VQPVFSLPK

SEQ ID NO: 937139 - protein, 9 aa, Homo Sapiens
CKSVCHVLG

SEQ ID NO: 937140 - protein, 9 aa, Homo Sapiens
DRSSSASNV

SEQ ID NO: 937141 - protein, 9 aa, Homo Sapiens
DTSVHWFSV

SEQ ID NO: 937142 - protein, 9 aa, Homo Sapiens
TSNSFGSTS

SEQ ID NO: 937143 - protein, 9 aa, Homo Sapiens
EPLATMSHQ

SEQ ID NO: 937144 - protein, 9 aa, Homo Sapiens
TSEIVAIKI

SEQ ID NO: 937145 - protein, 9 aa, Homo Sapiens
LSCVKTTAN

SEQ ID NO: 937146 - protein, 9 aa, Homo Sapiens
ITRMLVMYL

SEQ ID NO: 937147 - protein, 9 aa, Homo Sapiens
SDSKIISTS

SEQ ID NO: 937148 - protein, 9 aa, Homo Sapiens
KRKKMRRKQ

SEQ ID NO: 937149 - protein, 9 aa, Homo Sapiens
VQDTAYLYA

SEQ ID NO: 937150 - protein, 9 aa, Homo Sapiens
SCSEYLPSI

SEQ ID NO: 937151 - protein, 9 aa, Homo Sapiens
MVEYKRTTL

SEQ ID NO: 937152 - protein, 9 aa, Homo Sapiens
STPTISVAT

SEQ ID NO: 937153 - protein, 9 aa, Homo Sapiens
FFFLFITYI

SEQ ID NO: 937154 - protein, 9 aa, Homo Sapiens
RNFLSHGLN

SEQ ID NO: 937155 - protein, 9 aa, Homo Sapiens
GSEAGEKPY

SEQ ID NO: 937156 - protein, 9 aa, Homo Sapiens
HNEPGIAGS

SEQ ID NO: 937157 - protein, 9 aa, Homo Sapiens
ACPSGPEKV

SEQ ID NO: 937158 - protein, 9 aa, Homo Sapiens
LFLAVPRLL

SEQ ID NO: 937159 - protein, 9 aa, Homo Sapiens
KLSMDGLFL

SEQ ID NO: 937160 - protein, 9 aa, Homo Sapiens
GIEKKAAEN

SEQ ID NO: 937161 - protein, 9 aa, Homo Sapiens
LASVTALSC

SEQ ID NO: 937162 - protein, 9 aa, Homo Sapiens
ESLCSPLDE

SEQ ID NO: 937163 - protein, 9 aa, Homo Sapiens
FNTQVTDID

SEQ ID NO: 937164 - protein, 9 aa, Homo Sapiens
LEEATTPMP

SEQ ID NO: 937165 - protein, 9 aa, Homo Sapiens
NSDSGTETE

SEQ ID NO: 937166 - protein, 9 aa, Homo Sapiens
GTASSPEGP

SEQ ID NO: 937167 - protein, 9 aa, Homo Sapiens
GSEYDNFLD

SEQ ID NO: 937168 - protein, 9 aa, Homo Sapiens
LFESPEEAT

SEQ ID NO: 937169 - protein, 9 aa, Homo Sapiens
TLIQKCDFS

SEQ ID NO: 937170 - protein, 9 aa, Homo Sapiens
VIEIGEPSR

SEQ ID NO: 937171 - protein, 9 aa, Homo Sapiens
AHLEEILAL

SEQ ID NO: 937172 - protein, 9 aa, Homo Sapiens
FFMDPASAL

SEQ ID NO: 937173 - protein, 9 aa, Homo Sapiens
AAIRTLFFV

SEQ ID NO: 937174 - protein, 9 aa, Homo Sapiens
LLVMTAPPP

SEQ ID NO: 937175 - protein, 9 aa, Homo Sapiens
AELQEQLKV

SEQ ID NO: 937176 - protein, 9 aa, Homo Sapiens
KNQKMFTVF

SEQ ID NO: 937177 - protein, 9 aa, Homo Sapiens
QKLASVTAL

SEQ ID NO: 937178 - protein, 9 aa, Homo Sapiens
LLETPVQPV

SEQ ID NO: 937179 - protein, 9 aa, Homo Sapiens
KLPSSSSKD

SEQ ID NO: 937180 - protein, 9 aa, Homo Sapiens
EAFEETLML

SEQ ID NO: 937181 - protein, 9 aa, Homo Sapiens
EMFSLSLHY

SEQ ID NO: 937182 - protein, 9 aa, Homo Sapiens
LCHGLYEIF

SEQ ID NO: 937183 - protein, 9 aa, Homo Sapiens
HILKCCDGL

SEQ ID NO: 937184 - protein, 9 aa, Homo Sapiens
KLQEPCVAF

SEQ ID NO: 937185 - protein, 9 aa, Homo Sapiens
GGRSVFVSL

SEQ ID NO: 937186 - protein, 9 aa, Homo Sapiens
NKDSLTNLY

SEQ ID NO: 937187 - protein, 9 aa, Homo Sapiens
PSSGFDGGL

SEQ ID NO: 937188 - protein, 9 aa, Homo Sapiens
SEHITKFLI

SEQ ID NO: 937189 - protein, 9 aa, Homo Sapiens
TIQPVTIHE

SEQ ID NO: 937190 - protein, 9 aa, Homo Sapiens
VKCWKRGTS

SEQ ID NO: 937191 - protein, 9 aa, Homo Sapiens
CKDDGEAMI

SEQ ID NO: 937192 - protein, 9 aa, Homo Sapiens
ICNMCGLQT

SEQ ID NO: 937193 - protein, 9 aa, Homo Sapiens
NAQIKNAIR

SEQ ID NO: 937194 - protein, 9 aa, Homo Sapiens
PFKKKGKTA

SEQ ID NO: 937195 - protein, 9 aa, Homo Sapiens
FLRNKTCRQ

SEQ ID NO: 937196 - protein, 9 aa, Homo Sapiens
DPARPVPLK

SEQ ID NO: 937197 - protein, 9 aa, Homo Sapiens
LQKLILLDL

SEQ ID NO: 937198 - protein, 9 aa, Homo Sapiens
AWMQANYNL

SEQ ID NO: 937199 - protein, 9 aa, Homo Sapiens
AALNIFGNL

SEQ ID NO: 937200 - protein, 9 aa, Homo Sapiens
MFQKTGTCS

SEQ ID NO: 937201 - protein, 9 aa, Homo Sapiens
LGYVNFLIN

SEQ ID NO: 937202 - protein, 9 aa, Homo Sapiens
SASNVHINT

SEQ ID NO: 937203 - protein, 9 aa, Homo Sapiens
QKLEKVLVV

SEQ ID NO: 937204 - protein, 9 aa, Homo Sapiens
IPFNTQVTD

SEQ ID NO: 937205 - protein, 9 aa, Homo Sapiens
GPHIEDGKL

SEQ ID NO: 937206 - protein, 9 aa, Homo Sapiens
VIYFLGQPL

SEQ ID NO: 937207 - protein, 9 aa, Homo Sapiens
DLAYQILPL

SEQ ID NO: 937208 - protein, 9 aa, Homo Sapiens
SRDLWVNIN

SEQ ID NO: 937209 - protein, 9 aa, Homo Sapiens
KLNAKEGNV

SEQ ID NO: 937210 - protein, 9 aa, Homo Sapiens
KQKQQKRLL

SEQ ID NO: 937211 - protein, 9 aa, Homo Sapiens
IQPVTIHEI

SEQ ID NO: 937212 - protein, 9 aa, Homo Sapiens
TPMYFFFTH

SEQ ID NO: 937213 - protein, 9 aa, Homo Sapiens
PGEPFNSQM

SEQ ID NO: 937214 - protein, 9 aa, Homo Sapiens
YSSNYKLKP

SEQ ID NO: 937215 - protein, 9 aa, Homo Sapiens
TVPETSAPR

SEQ ID NO: 937216 - protein, 9 aa, Homo Sapiens
EKKAAENGA

SEQ ID NO: 937217 - protein, 9 aa, Homo Sapiens
WVGAQEISH

SEQ ID NO: 937218 - protein, 9 aa, Homo Sapiens
RACHILKCC

SEQ ID NO: 937219 - protein, 9 aa, Homo Sapiens
QVQLEQDEY

SEQ ID NO: 937220 - protein, 9 aa, Homo Sapiens
SISLCNTIE

SEQ ID NO: 937221 - protein, 9 aa, Homo Sapiens
ECDVMTYMR

SEQ ID NO: 937222 - protein, 9 aa, Homo Sapiens
AILSFADDL

SEQ ID NO: 937223 - protein, 9 aa, Homo Sapiens
RIRRNKIGS

SEQ ID NO: 937224 - protein, 9 aa, Homo Sapiens
RVNKDSLTN

SEQ ID NO: 937225 - protein, 9 aa, Homo Sapiens
DMFSGKEFG

SEQ ID NO: 937226 - protein, 9 aa, Homo Sapiens
IIPVLDALA

SEQ ID NO: 937227 - protein, 9 aa, Homo Sapiens
YKIFYVSHD

SEQ ID NO: 937228 - protein, 9 aa, Homo Sapiens
NENPDMLHQ

SEQ ID NO: 937229 - protein, 9 aa, Homo Sapiens
PGSYLSLVL

SEQ ID NO: 937230 - protein, 9 aa, Homo Sapiens
FGLVTWLVL

SEQ ID NO: 937231 - protein, 9 aa, Homo Sapiens
RMHMGDQIP

SEQ ID NO: 937232 - protein, 9 aa, Homo Sapiens
QTKLHSLRS

SEQ ID NO: 937233 - protein, 9 aa, Homo Sapiens
KEEGKLIFY

SEQ ID NO: 937234 - protein, 9 aa, Homo Sapiens
RNVQLDMGR

SEQ ID NO: 937235 - protein, 9 aa, Homo Sapiens
SVPQDLDNF

SEQ ID NO: 937236 - protein, 9 aa, Homo Sapiens
FVINFFSFF

SEQ ID NO: 937237 - protein, 9 aa, Homo Sapiens
MLQDFPLDC

SEQ ID NO: 937238 - protein, 9 aa, Homo Sapiens
SSTTGERVI

SEQ ID NO: 937239 - protein, 9 aa, Homo Sapiens
VQLLWNPEI

SEQ ID NO: 937240 - protein, 9 aa, Homo Sapiens
TLDNFAKAT

SEQ ID NO: 937241 - protein, 9 aa, Homo Sapiens
EGKLIFYAT

SEQ ID NO: 937242 - protein, 9 aa, Homo Sapiens
AASPTIIPV

SEQ ID NO: 937243 - protein, 9 aa, Homo Sapiens
RDFPSDFKK

SEQ ID NO: 937244 - protein, 9 aa, Homo Sapiens
DTVAALFYT

SEQ ID NO: 937245 - protein, 9 aa, Homo Sapiens
RFRVSWYPS

SEQ ID NO: 937246 - protein, 9 aa, Homo Sapiens
IRNTKMAVG

SEQ ID NO: 937247 - protein, 9 aa, Homo Sapiens
FVKWDPPKK

SEQ ID NO: 937248 - protein, 9 aa, Homo Sapiens
KMPTTSRVG

SEQ ID NO: 937249 - protein, 9 aa, Homo Sapiens
LELGNQNLR

SEQ ID NO: 937250 - protein, 9 aa, Homo Sapiens
VARSMGGKK

SEQ ID NO: 937251 - protein, 9 aa, Homo Sapiens
SEYLPSIES

SEQ ID NO: 937252 - protein, 9 aa, Homo Sapiens
LNAKEGNVP

SEQ ID NO: 937253 - protein, 9 aa, Homo Sapiens
AKRRKRMDQ

SEQ ID NO: 937254 - protein, 9 aa, Homo Sapiens
PSHARYSSQ

SEQ ID NO: 937255 - protein, 9 aa, Homo Sapiens
LLDLYDNQI

SEQ ID NO: 937256 - protein, 9 aa, Homo Sapiens
SPAVLVYNG

SEQ ID NO: 937257 - protein, 9 aa, Homo Sapiens
AQDPSNSDS

SEQ ID NO: 937258 - protein, 9 aa, Homo Sapiens
DELPGLPGD

SEQ ID NO: 937259 - protein, 9 aa, Homo Sapiens
NRQWGTICD

SEQ ID NO: 937260 - protein, 9 aa, Homo Sapiens
NGVKVLPVP

SEQ ID NO: 937261 - protein, 9 aa, Homo Sapiens
IIINEKIND

SEQ ID NO: 937262 - protein, 9 aa, Homo Sapiens
LQSYVIYFL

SEQ ID NO: 937263 - protein, 9 aa, Homo Sapiens
PETSAPRKK

SEQ ID NO: 937264 - protein, 9 aa, Homo Sapiens
RDRPLNDNQ

SEQ ID NO: 937265 - protein, 9 aa, Homo Sapiens
WGTICDHRW

SEQ ID NO: 937266 - protein, 9 aa, Homo Sapiens
TVEIMYQIG

SEQ ID NO: 937267 - protein, 9 aa, Homo Sapiens
QRNCNLIQI

SEQ ID NO: 937268 - protein, 9 aa, Homo Sapiens
KDRAGHGHS

SEQ ID NO: 937269 - protein, 9 aa, Homo Sapiens
GEKLYTCNE

SEQ ID NO: 937270 - protein, 9 aa, Homo Sapiens
SSPHYVISL

SEQ ID NO: 937271 - protein, 9 aa, Homo Sapiens
LEIYKQFLT

SEQ ID NO: 937272 - protein, 9 aa, Homo Sapiens
LRKCNREEV

SEQ ID NO: 937273 - protein, 9 aa, Homo Sapiens
LVNFLVEKN

SEQ ID NO: 937274 - protein, 9 aa, Homo Sapiens
LALVVDKQQ

SEQ ID NO: 937275 - protein, 9 aa, Homo Sapiens
CHSKPDPAR

SEQ ID NO: 937276 - protein, 9 aa, Homo Sapiens
LYFQMQDLK

SEQ ID NO: 937277 - protein, 9 aa, Homo Sapiens
TSVQSPHPQ

SEQ ID NO: 937278 - protein, 9 aa, Homo Sapiens
DYDECNIMK

SEQ ID NO: 937279 - protein, 9 aa, Homo Sapiens
PQKRSQAAF

SEQ ID NO: 937280 - protein, 9 aa, Homo Sapiens
KRSQAAFSH

SEQ ID NO: 937281 - protein, 9 aa, Homo Sapiens
KIISLNQGL

SEQ ID NO: 937282 - protein, 9 aa, Homo Sapiens
LRNPPFASG

SEQ ID NO: 937283 - protein, 9 aa, Homo Sapiens
TTIPGNVFQ

SEQ ID NO: 937284 - protein, 9 aa, Homo Sapiens
TNLNEKYGE

SEQ ID NO: 937285 - protein, 9 aa, Homo Sapiens
NFLINPLLY

SEQ ID NO: 937286 - protein, 9 aa, Homo Sapiens
GYYLKMKDG

SEQ ID NO: 937287 - protein, 9 aa, Homo Sapiens
LVVPNIILT

SEQ ID NO: 937288 - protein, 9 aa, Homo Sapiens
TIHEILGWT

SEQ ID NO: 937289 - protein, 9 aa, Homo Sapiens
VQAIRAPRY

SEQ ID NO: 937290 - protein, 9 aa, Homo Sapiens
PPTGTASSP

SEQ ID NO: 937291 - protein, 9 aa, Homo Sapiens
NKCDLPEWC

SEQ ID NO: 937292 - protein, 9 aa, Homo Sapiens
KSFRAALSS

SEQ ID NO: 937293 - protein, 9 aa, Homo Sapiens
SWLAPIVSE

SEQ ID NO: 937294 - protein, 9 aa, Homo Sapiens
RDKVGVQNF

SEQ ID NO: 937295 - protein, 9 aa, Homo Sapiens
ALNIFGNLL

SEQ ID NO: 937296 - protein, 9 aa, Homo Sapiens
NKRRYTRDE

SEQ ID NO: 937297 - protein, 9 aa, Homo Sapiens
RGCTIRNTK

SEQ ID NO: 937298 - protein, 9 aa, Homo Sapiens
PGQKYMATV

SEQ ID NO: 937299 - protein, 9 aa, Homo Sapiens
LDNFAKATF

SEQ ID NO: 937300 - protein, 9 aa, Homo Sapiens
IFRQNSSST

SEQ ID NO: 937301 - protein, 9 aa, Homo Sapiens
KALRKVLVE

SEQ ID NO: 937302 - protein, 9 aa, Homo Sapiens
RLPEAVAAG

SEQ ID NO: 937303 - protein, 9 aa, Homo Sapiens
ANYNLLSAF

SEQ ID NO: 937304 - protein, 9 aa, Homo Sapiens
PQKSTTGKV

SEQ ID NO: 937305 - protein, 9 aa, Homo Sapiens
SVQSPHPQF

SEQ ID NO: 937306 - protein, 9 aa, Homo Sapiens
RAPRYKIRE

SEQ ID NO: 937307 - protein, 9 aa, Homo Sapiens
ELVIGGMKH

SEQ ID NO: 937308 - protein, 9 aa, Homo Sapiens
CLEEWQKAG

SEQ ID NO: 937309 - protein, 9 aa, Homo Sapiens
ARHPSSLSA

SEQ ID NO: 937310 - protein, 9 aa, Homo Sapiens
FKLSEQYLE

SEQ ID NO: 937311 - protein, 9 aa, Homo Sapiens
AAATSGLGP

SEQ ID NO: 937312 - protein, 9 aa, Homo Sapiens
LLMYEDSIL

SEQ ID NO: 937313 - protein, 9 aa, Homo Sapiens
IAGSPRSQV

SEQ ID NO: 937314 - protein, 9 aa, Homo Sapiens
RGFDELPGL

SEQ ID NO: 937315 - protein, 9 aa, Homo Sapiens
ELYKQGLRS

SEQ ID NO: 937316 - protein, 9 aa, Homo Sapiens
IRPPELREI

SEQ ID NO: 937317 - protein, 9 aa, Homo Sapiens
SKSFRAALS

SEQ ID NO: 937318 - protein, 9 aa, Homo Sapiens
SVFVSLKPG

SEQ ID NO: 937319 - protein, 9 aa, Homo Sapiens
IPGNVFQGM

SEQ ID NO: 937320 - protein, 9 aa, Homo Sapiens
GLNPTSVIE

SEQ ID NO: 937321 - protein, 9 aa, Homo Sapiens
QTVGPLQLL

SEQ ID NO: 937322 - protein, 9 aa, Homo Sapiens
ISITRMLVM

SEQ ID NO: 937323 - protein, 9 aa, Homo Sapiens
GDRGFDELP

SEQ ID NO: 937324 - protein, 9 aa, Homo Sapiens
ATTPMPQGN

SEQ ID NO: 937325 - protein, 9 aa, Homo Sapiens
KNTGKLQEP

SEQ ID NO: 937326 - protein, 9 aa, Homo Sapiens
KNDSWIFSL

SEQ ID NO: 937327 - protein, 9 aa, Homo Sapiens
GVQNFVLLD

SEQ ID NO: 937328 - protein, 9 aa, Homo Sapiens
SAYIIEVFS

SEQ ID NO: 937329 - protein, 9 aa, Homo Sapiens
LDQVGTFIE

SEQ ID NO: 937330 - protein, 9 aa, Homo Sapiens
ISNLQKLIL

SEQ ID NO: 937331 - protein, 9 aa, Homo Sapiens
CNLDQYFEY

SEQ ID NO: 937332 - protein, 9 aa, Homo Sapiens
DWYMVNDVL

SEQ ID NO: 937333 - protein, 9 aa, Homo Sapiens
DEIKSKFAS

SEQ ID NO: 937334 - protein, 9 aa, Homo Sapiens
QYVKLLDRE

SEQ ID NO: 937335 - protein, 9 aa, Homo Sapiens
SLLMYEDSI

SEQ ID NO: 937336 - protein, 9 aa, Homo Sapiens
IDYDECNIM

SEQ ID NO: 937337 - protein, 9 aa, Homo Sapiens
FRVGTVWES

SEQ ID NO: 937338 - protein, 9 aa, Homo Sapiens
KDSLTNLYV

SEQ ID NO: 937339 - protein, 9 aa, Homo Sapiens
SRPLAALNI

SEQ ID NO: 937340 - protein, 9 aa, Homo Sapiens
DTASTPTIS

SEQ ID NO: 937341 - protein, 9 aa, Homo Sapiens
LPLRRAESL

SEQ ID NO: 937342 - protein, 9 aa, Homo Sapiens
HGASLFITT

SEQ ID NO: 937343 - protein, 9 aa, Homo Sapiens
CSYCDFYFM

SEQ ID NO: 937344 - protein, 9 aa, Homo Sapiens
PGKDVKGDG

SEQ ID NO: 937345 - protein, 9 aa, Homo Sapiens
WIAGNINWV

SEQ ID NO: 937346 - protein, 9 aa, Homo Sapiens
MRETCGCCD

SEQ ID NO: 937347 - protein, 9 aa, Homo Sapiens
IEDGKLVKN

SEQ ID NO: 937348 - protein, 9 aa, Homo Sapiens
REEKKRWIH

SEQ ID NO: 937349 - protein, 9 aa, Homo Sapiens
ITDQCPKGI

SEQ ID NO: 937350 - protein, 9 aa, Homo Sapiens
QKFPTCLQC

SEQ ID NO: 937351 - protein, 9 aa, Homo Sapiens
LKNTGKLQE

SEQ ID NO: 937352 - protein, 9 aa, Homo Sapiens
RSPVPQRSQ

SEQ ID NO: 937353 - protein, 9 aa, Homo Sapiens
TENQKVGWD

SEQ ID NO: 937354 - protein, 9 aa, Homo Sapiens
FNEAFEETL

SEQ ID NO: 937355 - protein, 9 aa, Homo Sapiens
PRELSFYVS

SEQ ID NO: 937356 - protein, 9 aa, Homo Sapiens
QTEAFSKKR

SEQ ID NO: 937357 - protein, 9 aa, Homo Sapiens
PHPSPWARL

SEQ ID NO: 937358 - protein, 9 aa, Homo Sapiens
GLGFVASLA

SEQ ID NO: 937359 - protein, 9 aa, Homo Sapiens
RLKDEMFSL

SEQ ID NO: 937360 - protein, 9 aa, Homo Sapiens
FEIQHRLQC

SEQ ID NO: 937361 - protein, 9 aa, Homo Sapiens
MIKVVRGGG

SEQ ID NO: 937362 - protein, 9 aa, Homo Sapiens
NGSPGSNGG

SEQ ID NO: 937363 - protein, 9 aa, Homo Sapiens
FRRGKVEAA

SEQ ID NO: 937364 - protein, 9 aa, Homo Sapiens
KLHSLRSAL

SEQ ID NO: 937365 - protein, 9 aa, Homo Sapiens
QPQGPLPPP

SEQ ID NO: 937366 - protein, 9 aa, Homo Sapiens
QPERKITCN

SEQ ID NO: 937367 - protein, 9 aa, Homo Sapiens
NFLSHGLNQ

SEQ ID NO: 937368 - protein, 9 aa, Homo Sapiens
ACHILKCCD

SEQ ID NO: 937369 - protein, 9 aa, Homo Sapiens
KGRLSEHIT

SEQ ID NO: 937370 - protein, 9 aa, Homo Sapiens
DEKIPDLFD

SEQ ID NO: 937371 - protein, 9 aa, Homo Sapiens
FLFLEVDHF

SEQ ID NO: 937372 - protein, 9 aa, Homo Sapiens
SHTVPETSA

SEQ ID NO: 937373 - protein, 9 aa, Homo Sapiens
NLDQYFEYI

SEQ ID NO: 937374 - protein, 9 aa, Homo Sapiens
PLFQEALME

SEQ ID NO: 937375 - protein, 9 aa, Homo Sapiens
AKPIDFTMY

SEQ ID NO: 937376 - protein, 9 aa, Homo Sapiens
NLSSPTQKR

SEQ ID NO: 937377 - protein, 9 aa, Homo Sapiens
DMLHQDIQE

SEQ ID NO: 937378 - protein, 9 aa, Homo Sapiens
GQKQRIVIA

SEQ ID NO: 937379 - protein, 9 aa, Homo Sapiens
SPFHRRLCP

SEQ ID NO: 937380 - protein, 9 aa, Homo Sapiens
GSPGSNGGW

SEQ ID NO: 937381 - protein, 9 aa, Homo Sapiens
FKKAHHLKR

SEQ ID NO: 937382 - protein, 9 aa, Homo Sapiens
RYQVLRNPP

SEQ ID NO: 937383 - protein, 9 aa, Homo Sapiens
GLGQPGRAS

SEQ ID NO: 937384 - protein, 9 aa, Homo Sapiens
KESISLCNT

SEQ ID NO: 937385 - protein, 9 aa, Homo Sapiens
PERKITCNQ

SEQ ID NO: 937386 - protein, 9 aa, Homo Sapiens
VVRGGGGKG

SEQ ID NO: 937387 - protein, 9 aa, Homo Sapiens
VFPLNFRQD

SEQ ID NO: 937388 - protein, 9 aa, Homo Sapiens
LVSRLQADA

SEQ ID NO: 937389 - protein, 9 aa, Homo Sapiens
QNFQENYAG

SEQ ID NO: 937390 - protein, 9 aa, Homo Sapiens
SLERDTVAA

SEQ ID NO: 937391 - protein, 9 aa, Homo Sapiens
ELGSDRKVP

SEQ ID NO: 937392 - protein, 9 aa, Homo Sapiens
TSEPSACPS

SEQ ID NO: 937393 - protein, 9 aa, Homo Sapiens
NSFGSTSGS

SEQ ID NO: 937394 - protein, 9 aa, Homo Sapiens
LELNENPDM

SEQ ID NO: 937395 - protein, 9 aa, Homo Sapiens
QQKLEKVLV

SEQ ID NO: 937396 - protein, 9 aa, Homo Sapiens
CGDSPSFPH

SEQ ID NO: 937397 - protein, 9 aa, Homo Sapiens
ALQQKLEKV

SEQ ID NO: 937398 - protein, 9 aa, Homo Sapiens
YYLKMKDGV

SEQ ID NO: 937399 - protein, 9 aa, Homo Sapiens
KRRIENKIL

SEQ ID NO: 937400 - protein, 9 aa, Homo Sapiens
VPAHLMKDI

SEQ ID NO: 937401 - protein, 9 aa, Homo Sapiens
TRAVSPAVL

SEQ ID NO: 937402 - protein, 9 aa, Homo Sapiens
LIILAPGSY

SEQ ID NO: 937403 - protein, 9 aa, Homo Sapiens
GRLSEHITK

SEQ ID NO: 937404 - protein, 9 aa, Homo Sapiens
TLFESFFGE

SEQ ID NO: 937405 - protein, 9 aa, Homo Sapiens
WYPSPSPVL

SEQ ID NO: 937406 - protein, 9 aa, Homo Sapiens
SPSFPHTIL

SEQ ID NO: 937407 - protein, 9 aa, Homo Sapiens
AGNLCIILL

SEQ ID NO: 937408 - protein, 9 aa, Homo Sapiens
LAALNIFGN

SEQ ID NO: 937409 - protein, 9 aa, Homo Sapiens
GDEVLDQVG

SEQ ID NO: 937410 - protein, 9 aa, Homo Sapiens
LGLNPTSVI

SEQ ID NO: 937411 - protein, 9 aa, Homo Sapiens
QNLKILNFR

SEQ ID NO: 937412 - protein, 9 aa, Homo Sapiens
TRWADFFDV

SEQ ID NO: 937413 - protein, 9 aa, Homo Sapiens
MRALETQLD

SEQ ID NO: 937414 - protein, 9 aa, Homo Sapiens
RHSHNGSGD

SEQ ID NO: 937415 - protein, 9 aa, Homo Sapiens
ITLAGNLCI

SEQ ID NO: 937416 - protein, 9 aa, Homo Sapiens
IDFTMYTTC

SEQ ID NO: 937417 - protein, 9 aa, Homo Sapiens
PSVCINLTL

SEQ ID NO: 937418 - protein, 9 aa, Homo Sapiens
QTPKLSMDG

SEQ ID NO: 937419 - protein, 9 aa, Homo Sapiens
NKAFSTCTF

SEQ ID NO: 937420 - protein, 9 aa, Homo Sapiens
FWVGEAAVL

SEQ ID NO: 937421 - protein, 9 aa, Homo Sapiens
PPDELFLRS

SEQ ID NO: 937422 - protein, 9 aa, Homo Sapiens
KHEEYQAGV

SEQ ID NO: 937423 - protein, 9 aa, Homo Sapiens
ETPAVSSSV

SEQ ID NO: 937424 - protein, 9 aa, Homo Sapiens
YEMAVVVRS

SEQ ID NO: 937425 - protein, 9 aa, Homo Sapiens
LSSEKGRLS

SEQ ID NO: 937426 - protein, 9 aa, Homo Sapiens
LWGFYTKLN

SEQ ID NO: 937427 - protein, 9 aa, Homo Sapiens
EETLMLVAV

SEQ ID NO: 937428 - protein, 9 aa, Homo Sapiens
RYSSQLDGE

SEQ ID NO: 937429 - protein, 9 aa, Homo Sapiens
WWGGEQDIP

SEQ ID NO: 937430 - protein, 9 aa, Homo Sapiens
NSPWGNAGE

SEQ ID NO: 937431 - protein, 9 aa, Homo Sapiens
HKNQKMFTV

SEQ ID NO: 937432 - protein, 9 aa, Homo Sapiens
EPEEEDVGN

SEQ ID NO: 937433 - protein, 9 aa, Homo Sapiens
SNLFESPEE

SEQ ID NO: 937434 - protein, 9 aa, Homo Sapiens
VRVENSNST

SEQ ID NO: 937435 - protein, 9 aa, Homo Sapiens
KEISAENIY

SEQ ID NO: 937436 - protein, 9 aa, Homo Sapiens
TIRMRLLNR

SEQ ID NO: 937437 - protein, 9 aa, Homo Sapiens
GTDRVSCFG

SEQ ID NO: 937438 - protein, 9 aa, Homo Sapiens
FLAVPRLLN

SEQ ID NO: 937439 - protein, 9 aa, Homo Sapiens
IYKIFYVSH

SEQ ID NO: 937440 - protein, 9 aa, Homo Sapiens
VARKHEEYQ

SEQ ID NO: 937441 - protein, 9 aa, Homo Sapiens
AVQGGIFVE

SEQ ID NO: 937442 - protein, 9 aa, Homo Sapiens
DQNFQENYA

SEQ ID NO: 937443 - protein, 9 aa, Homo Sapiens
ILSFADDLL

SEQ ID NO: 937444 - protein, 9 aa, Homo Sapiens
AHASRGNAP

SEQ ID NO: 937445 - protein, 9 aa, Homo Sapiens
PWINPSPQP

SEQ ID NO: 937446 - protein, 9 aa, Homo Sapiens
IQHRLQCKN

SEQ ID NO: 937447 - protein, 9 aa, Homo Sapiens
PETQTENQK

SEQ ID NO: 937448 - protein, 9 aa, Homo Sapiens
FIIRGLRSV

SEQ ID NO: 937449 - protein, 9 aa, Homo Sapiens
RGRAILFCG

SEQ ID NO: 937450 - protein, 9 aa, Homo Sapiens
AVVVRFSAA

SEQ ID NO: 937451 - protein, 9 aa, Homo Sapiens
NQKMFTVFL

SEQ ID NO: 937452 - protein, 9 aa, Homo Sapiens
VDQKRGKKQ

SEQ ID NO: 937453 - protein, 9 aa, Homo Sapiens
TLTSWLAPI

SEQ ID NO: 937454 - protein, 9 aa, Homo Sapiens
LEGSQGGVA

SEQ ID NO: 937455 - protein, 9 aa, Homo Sapiens
SWYNSPWGN

SEQ ID NO: 937456 - protein, 9 aa, Homo Sapiens
WADFFDVLL

SEQ ID NO: 937457 - protein, 9 aa, Homo Sapiens
NDLKRQGLL

SEQ ID NO: 937458 - protein, 9 aa, Homo Sapiens
DEMFSLSLH

SEQ ID NO: 937459 - protein, 9 aa, Homo Sapiens
ELELGNQNL

SEQ ID NO: 937460 - protein, 9 aa, Homo Sapiens
RAPGIEKKA

SEQ ID NO: 937461 - protein, 9 aa, Homo Sapiens
VTVEIMYQI

SEQ ID NO: 937462 - protein, 9 aa, Homo Sapiens
SFGFGLVTW

SEQ ID NO: 937463 - protein, 9 aa, Homo Sapiens
TPSLQGRQS

SEQ ID NO: 937464 - protein, 9 aa, Homo Sapiens
VAVKMLKKE

SEQ ID NO: 937465 - protein, 9 aa, Homo Sapiens
KGPLFQEAL

SEQ ID NO: 937466 - protein, 9 aa, Homo Sapiens
RLFFLRFFF

SEQ ID NO: 937467 - protein, 9 aa, Homo Sapiens
PIHICLAWE

SEQ ID NO: 937468 - protein, 9 aa, Homo Sapiens
PVFDNICFD

SEQ ID NO: 937469 - protein, 9 aa, Homo Sapiens
PSACPSGPE

SEQ ID NO: 937470 - protein, 9 aa, Homo Sapiens
PVPVLSDNY

SEQ ID NO: 937471 - protein, 9 aa, Homo Sapiens
VGAQEISHD

SEQ ID NO: 937472 - protein, 9 aa, Homo Sapiens
QPEDGVKMD

SEQ ID NO: 937473 - protein, 9 aa, Homo Sapiens
IEVFSQSVS

SEQ ID NO: 937474 - protein, 9 aa, Homo Sapiens
AGFSGGLSP

SEQ ID NO: 937475 - protein, 9 aa, Homo Sapiens
ARSKKTLQK

SEQ ID NO: 937476 - protein, 9 aa, Homo Sapiens
TEETYRGVN

SEQ ID NO: 937477 - protein, 9 aa, Homo Sapiens
CNNESIKYP

SEQ ID NO: 937478 - protein, 9 aa, Homo Sapiens
APGSYLSLV

SEQ ID NO: 937479 - protein, 9 aa, Homo Sapiens
ISLYFQMQD

SEQ ID NO: 937480 - protein, 9 aa, Homo Sapiens
SAENIYITD

SEQ ID NO: 937481 - protein, 9 aa, Homo Sapiens
LTWLGYVNF

SEQ ID NO: 937482 - protein, 9 aa, Homo Sapiens
QRIYTGEKP

SEQ ID NO: 937483 - protein, 9 aa, Homo Sapiens
GPLPPPGKP

SEQ ID NO: 937484 - protein, 9 aa, Homo Sapiens
IPEFFWPDQ

SEQ ID NO: 937485 - protein, 9 aa, Homo Sapiens
ARDKVGVQN

SEQ ID NO: 937486 - protein, 9 aa, Homo Sapiens
NSKNSRHTI

SEQ ID NO: 937487 - protein, 9 aa, Homo Sapiens
PLAAASSMA

SEQ ID NO: 937488 - protein, 9 aa, Homo Sapiens
ETSAPRKKQ

SEQ ID NO: 937489 - protein, 9 aa, Homo Sapiens
LTLTSWLAP

SEQ ID NO: 937490 - protein, 9 aa, Homo Sapiens
LCGCKGPLF

SEQ ID NO: 937491 - protein, 9 aa, Homo Sapiens
MGDEVLDQV

SEQ ID NO: 937492 - protein, 9 aa, Homo Sapiens
GQPGRASAG

SEQ ID NO: 937493 - protein, 9 aa, Homo Sapiens
ALVVCKQLE

SEQ ID NO: 937494 - protein, 9 aa, Homo Sapiens
WYNSPWGNA

SEQ ID NO: 937495 - protein, 9 aa, Homo Sapiens
AGPARGTER

SEQ ID NO: 937496 - protein, 9 aa, Homo Sapiens
KQRIVIARA

SEQ ID NO: 937497 - protein, 9 aa, Homo Sapiens
SVVPQKSTT

SEQ ID NO: 937498 - protein, 9 aa, Homo Sapiens
LAGNLCIIL

SEQ ID NO: 937499 - protein, 9 aa, Homo Sapiens
ASELRRGFD

SEQ ID NO: 937500 - protein, 9 aa, Homo Sapiens
SERRTICID

SEQ ID NO: 937501 - protein, 9 aa, Homo Sapiens
VHKYKCTAL

SEQ ID NO: 937502 - protein, 9 aa, Homo Sapiens
WREGFIHSI

SEQ ID NO: 937503 - protein, 9 aa, Homo Sapiens
LKRQGLLSG

SEQ ID NO: 937504 - protein, 9 aa, Homo Sapiens
STPDFFMDP

SEQ ID NO: 937505 - protein, 9 aa, Homo Sapiens
KFSECNCPS

SEQ ID NO: 937506 - protein, 9 aa, Homo Sapiens
FWVGAQEIS

SEQ ID NO: 937507 - protein, 9 aa, Homo Sapiens
TVGIDFRKK

SEQ ID NO: 937508 - protein, 9 aa, Homo Sapiens
RAESLCSPL

SEQ ID NO: 937509 - protein, 9 aa, Homo Sapiens
LQPRPPSCG

SEQ ID NO: 937510 - protein, 9 aa, Homo Sapiens
MAGPHPSPW

SEQ ID NO: 937511 - protein, 9 aa, Homo Sapiens
RVITDQCPK

SEQ ID NO: 937512 - protein, 9 aa, Homo Sapiens
NINQMEKDK

SEQ ID NO: 937513 - protein, 9 aa, Homo Sapiens
GKDVKGDGN

SEQ ID NO: 937514 - protein, 9 aa, Homo Sapiens
YDLRDQITR

SEQ ID NO: 937515 - protein, 9 aa, Homo Sapiens
HEPIPSFFR

SEQ ID NO: 937516 - protein, 9 aa, Homo Sapiens
PGFSPPVPP

SEQ ID NO: 937517 - protein, 9 aa, Homo Sapiens
VIEHQLSDL

SEQ ID NO: 937518 - protein, 9 aa, Homo Sapiens
PIKSVPQDL

SEQ ID NO: 937519 - protein, 9 aa, Homo Sapiens
SSKKKKMFL

SEQ ID NO: 937520 - protein, 9 aa, Homo Sapiens
IGLLIVANR

SEQ ID NO: 937521 - protein, 9 aa, Homo Sapiens
RKHEEYQAG

SEQ ID NO: 937522 - protein, 9 aa, Homo Sapiens
GSLEEATTP

SEQ ID NO: 937523 - protein, 9 aa, Homo Sapiens
LVVMAYDCY

SEQ ID NO: 937524 - protein, 9 aa, Homo Sapiens
ALLRHLEPL

SEQ ID NO: 937525 - protein, 9 aa, Homo Sapiens
MRAIQVEER

SEQ ID NO: 937526 - protein, 9 aa, Homo Sapiens
TQQKLASVT

SEQ ID NO: 937527 - protein, 9 aa, Homo Sapiens
FNSQMVTEG

SEQ ID NO: 937528 - protein, 9 aa, Homo Sapiens
HSKPDPARP

SEQ ID NO: 937529 - protein, 9 aa, Homo Sapiens
ISFILAGEP

SEQ ID NO: 937530 - protein, 9 aa, Homo Sapiens
LVSHNEPGI

SEQ ID NO: 937531 - protein, 9 aa, Homo Sapiens
IRNETSGSK

SEQ ID NO: 937532 - protein, 9 aa, Homo Sapiens
KKDLIWELL

SEQ ID NO: 937533 - protein, 9 aa, Homo Sapiens
ASAYIIEVF

SEQ ID NO: 937534 - protein, 9 aa, Homo Sapiens
RRNKIGSLA

SEQ ID NO: 937535 - protein, 9 aa, Homo Sapiens
FLLTLWGFY

SEQ ID NO: 937536 - protein, 9 aa, Homo Sapiens
INEKINDVD

SEQ ID NO: 937537 - protein, 9 aa, Homo Sapiens
VLVYNGIIF

SEQ ID NO: 937538 - protein, 9 aa, Homo Sapiens
AGAGQQAGP

SEQ ID NO: 937539 - protein, 9 aa, Homo Sapiens
ALSIQLQLK

SEQ ID NO: 937540 - protein, 9 aa, Homo Sapiens
FLLHPLTGP

SEQ ID NO: 937541 - protein, 9 aa, Homo Sapiens
ETLAAAAGE

SEQ ID NO: 937542 - protein, 9 aa, Homo Sapiens
GDKEDELVG

SEQ ID NO: 937543 - protein, 9 aa, Homo Sapiens
TTPSLQGRQ

SEQ ID NO: 937544 - protein, 9 aa, Homo Sapiens
LMLLLVVPN

SEQ ID NO: 937545 - protein, 9 aa, Homo Sapiens
ANVIEIGEP

SEQ ID NO: 937546 - protein, 9 aa, Homo Sapiens
LREINFCCA

SEQ ID NO: 937547 - protein, 9 aa, Homo Sapiens
VLLYTDQHG

SEQ ID NO: 937548 - protein, 9 aa, Homo Sapiens
PMYFFFTHL

SEQ ID NO: 937549 - protein, 9 aa, Homo Sapiens
WFSVQKLEQ

SEQ ID NO: 937550 - protein, 9 aa, Homo Sapiens
PNGSPGSNG

SEQ ID NO: 937551 - protein, 9 aa, Homo Sapiens
MQDPIYKIF

SEQ ID NO: 937552 - protein, 9 aa, Homo Sapiens
MLRYNILPP

SEQ ID NO: 937553 - protein, 9 aa, Homo Sapiens
SLCLSDPET

SEQ ID NO: 937554 - protein, 9 aa, Homo Sapiens
VIARALVRQ

SEQ ID NO: 937555 - protein, 9 aa, Homo Sapiens
ARGHSQKFP

SEQ ID NO: 937556 - protein, 9 aa, Homo Sapiens
PDDNLRMQN

SEQ ID NO: 937557 - protein, 9 aa, Homo Sapiens
MTMMAGGRS

SEQ ID NO: 937558 - protein, 9 aa, Homo Sapiens
GTSEIVAIK

SEQ ID NO: 937559 - protein, 9 aa, Homo Sapiens
IGEKENIGL

SEQ ID NO: 937560 - protein, 9 aa, Homo Sapiens
LYQAASPDK

SEQ ID NO: 937561 - protein, 9 aa, Homo Sapiens
EILILDEPT

SEQ ID NO: 937562 - protein, 9 aa, Homo Sapiens
ASTLQPRPP

SEQ ID NO: 937563 - protein, 9 aa, Homo Sapiens
SQLIVRVPS

SEQ ID NO: 937564 - protein, 9 aa, Homo Sapiens
ETKCYVKSS

SEQ ID NO: 937565 - protein, 9 aa, Homo Sapiens
IKNAIRKLC

SEQ ID NO: 937566 - protein, 9 aa, Homo Sapiens
VIEKQNLKG

SEQ ID NO: 937567 - protein, 9 aa, Homo Sapiens
TGTASSPEG

SEQ ID NO: 937568 - protein, 9 aa, Homo Sapiens
PSSLSALRS

SEQ ID NO: 937569 - protein, 9 aa, Homo Sapiens
LDNLGNAKS

SEQ ID NO: 937570 - protein, 9 aa, Homo Sapiens
VNLPDEYRC

SEQ ID NO: 937571 - protein, 9 aa, Homo Sapiens
QTMLRYNIL

SEQ ID NO: 937572 - protein, 9 aa, Homo Sapiens
FQMQDLKEQ

SEQ ID NO: 937573 - protein, 9 aa, Homo Sapiens
FSLSLHYSN

SEQ ID NO: 937574 - protein, 9 aa, Homo Sapiens
KEMLFNRRR

SEQ ID NO: 937575 - protein, 9 aa, Homo Sapiens
IYLQDSALK

SEQ ID NO: 937576 - protein, 9 aa, Homo Sapiens
YYCGFLTLE

SEQ ID NO: 937577 - protein, 9 aa, Homo Sapiens
VKCPTLCQT

SEQ ID NO: 937578 - protein, 9 aa, Homo Sapiens
MFSLSLHYS

SEQ ID NO: 937579 - protein, 9 aa, Homo Sapiens
VCRKEVNKC

SEQ ID NO: 937580 - protein, 9 aa, Homo Sapiens
DSDLKTLFT

SEQ ID NO: 937581 - protein, 9 aa, Homo Sapiens
KSTREEKKR

SEQ ID NO: 937582 - protein, 9 aa, Homo Sapiens
EIMYQIGTF

SEQ ID NO: 937583 - protein, 9 aa, Homo Sapiens
FAKRRKRMD

SEQ ID NO: 937584 - protein, 9 aa, Homo Sapiens
ERMKNNQPQ

SEQ ID NO: 937585 - protein, 9 aa, Homo Sapiens
GGQKQRIVI

SEQ ID NO: 937586 - protein, 9 aa, Homo Sapiens
ESSWYNSPW

SEQ ID NO: 937587 - protein, 9 aa, Homo Sapiens
IILIGRSDT

SEQ ID NO: 937588 - protein, 9 aa, Homo Sapiens
DNLRMQNGT

SEQ ID NO: 937589 - protein, 9 aa, Homo Sapiens
NANAVHKYK

SEQ ID NO: 937590 - protein, 9 aa, Homo Sapiens
RGTSEIVAI

SEQ ID NO: 937591 - protein, 9 aa, Homo Sapiens
EQPERKITC

SEQ ID NO: 937592 - protein, 9 aa, Homo Sapiens
EPIKEYRQE

SEQ ID NO: 937593 - protein, 9 aa, Homo Sapiens
MVSVVPQKS

SEQ ID NO: 937594 - protein, 9 aa, Homo Sapiens
STGEDGVFQ

SEQ ID NO: 937595 - protein, 9 aa, Homo Sapiens
LLCQEDRSF

SEQ ID NO: 937596 - protein, 9 aa, Homo Sapiens
STLSLSPEP

SEQ ID NO: 937597 - protein, 9 aa, Homo Sapiens
RLGSHTIDF

SEQ ID NO: 937598 - protein, 9 aa, Homo Sapiens
SRFRRGKVE

SEQ ID NO: 937599 - protein, 9 aa, Homo Sapiens
PNIFSERRT

SEQ ID NO: 937600 - protein, 9 aa, Homo Sapiens
LELGSDRKV

SEQ ID NO: 937601 - protein, 9 aa, Homo Sapiens
PLPPPGKPQ

SEQ ID NO: 937602 - protein, 9 aa, Homo Sapiens
TGTCSPEQG

SEQ ID NO: 937603 - protein, 9 aa, Homo Sapiens
CFDTFKLDK

SEQ ID NO: 937604 - protein, 9 aa, Homo Sapiens
AARNTLASV

SEQ ID NO: 937605 - protein, 9 aa, Homo Sapiens
RMRLLNRFY

SEQ ID NO: 937606 - protein, 9 aa, Homo Sapiens
QATLHAARN

SEQ ID NO: 937607 - protein, 9 aa, Homo Sapiens
SFILAGEPA

SEQ ID NO: 937608 - protein, 9 aa, Homo Sapiens
IFGSAEPTK

SEQ ID NO: 937609 - protein, 9 aa, Homo Sapiens
SEKGRLSEH

SEQ ID NO: 937610 - protein, 9 aa, Homo Sapiens
LPTSLLLRH

SEQ ID NO: 937611 - protein, 9 aa, Homo Sapiens
DTGKTTCCL

SEQ ID NO: 937612 - protein, 9 aa, Homo Sapiens
GITIGEKEN

SEQ ID NO: 937613 - protein, 9 aa, Homo Sapiens
ILFLPMAWG

SEQ ID NO: 937614 - protein, 9 aa, Homo Sapiens
GTCSPEQGP

SEQ ID NO: 937615 - protein, 9 aa, Homo Sapiens
YGKRGLLTR

SEQ ID NO: 937616 - protein, 9 aa, Homo Sapiens
FITTKKGFT

SEQ ID NO: 937617 - protein, 9 aa, Homo Sapiens
AGPIVVYCS

SEQ ID NO: 937618 - protein, 9 aa, Homo Sapiens
DCYVAISKP

SEQ ID NO: 937619 - protein, 9 aa, Homo Sapiens
ASNVHINTI

SEQ ID NO: 937620 - protein, 9 aa, Homo Sapiens
PRRGSEAGE

SEQ ID NO: 937621 - protein, 9 aa, Homo Sapiens
PAHLMKDIR

SEQ ID NO: 937622 - protein, 9 aa, Homo Sapiens
PPPQFPGFS

SEQ ID NO: 937623 - protein, 9 aa, Homo Sapiens
PASTLQPRP

SEQ ID NO: 937624 - protein, 9 aa, Homo Sapiens
EVPEKALDA

SEQ ID NO: 937625 - protein, 9 aa, Homo Sapiens
GLYEIFTPD

SEQ ID NO: 937626 - protein, 9 aa, Homo Sapiens
DRDHVILQK

SEQ ID NO: 937627 - protein, 9 aa, Homo Sapiens
IMYQIGTFK

SEQ ID NO: 937628 - protein, 9 aa, Homo Sapiens
CYTGEDFVN

SEQ ID NO: 937629 - protein, 9 aa, Homo Sapiens
TDQCPKGIV

SEQ ID NO: 937630 - protein, 9 aa, Homo Sapiens
SGLGPLQLQ

SEQ ID NO: 937631 - protein, 9 aa, Homo Sapiens
MAAAAAATS

SEQ ID NO: 937632 - protein, 9 aa, Homo Sapiens
VVWNCNKEK

SEQ ID NO: 937633 - protein, 9 aa, Homo Sapiens
NTGIGLGFV

SEQ ID NO: 937634 - protein, 9 aa, Homo Sapiens
NGVKITFPV

SEQ ID NO: 937635 - protein, 9 aa, Homo Sapiens
FVASLASYM

SEQ ID NO: 937636 - protein, 9 aa, Homo Sapiens
GEPFNSQMV

SEQ ID NO: 937637 - protein, 9 aa, Homo Sapiens
IPSESKSFR

SEQ ID NO: 937638 - protein, 9 aa, Homo Sapiens
LAFECSPSL

SEQ ID NO: 937639 - protein, 9 aa, Homo Sapiens
TWLGYVNFL

SEQ ID NO: 937640 - protein, 9 aa, Homo Sapiens
FFGEKKLCT

SEQ ID NO: 937641 - protein, 9 aa, Homo Sapiens
KAQKNGVKI

SEQ ID NO: 937642 - protein, 9 aa, Homo Sapiens
LSEHITKFL

SEQ ID NO: 937643 - protein, 9 aa, Homo Sapiens
LKRFLLHPL

SEQ ID NO: 937644 - protein, 9 aa, Homo Sapiens
ATQVVWNCN

SEQ ID NO: 937645 - protein, 9 aa, Homo Sapiens
SWQSVFVKW

SEQ ID NO: 937646 - protein, 9 aa, Homo Sapiens
LGQPGRASA

SEQ ID NO: 937647 - protein, 9 aa, Homo Sapiens
VPSRFRRGK

SEQ ID NO: 937648 - protein, 9 aa, Homo Sapiens
MRRKQKQQK

SEQ ID NO: 937649 - protein, 9 aa, Homo Sapiens
LQADARTVL

SEQ ID NO: 937650 - protein, 9 aa, Homo Sapiens
KMRRKQKQQ

SEQ ID NO: 937651 - protein, 9 aa, Homo Sapiens
IHICLAWEF

SEQ ID NO: 937652 - protein, 9 aa, Homo Sapiens
QDYEMRVSH

SEQ ID NO: 937653 - protein, 9 aa, Homo Sapiens
GCVYVQTML

SEQ ID NO: 937654 - protein, 9 aa, Homo Sapiens
SDFKKAHHL

SEQ ID NO: 937655 - protein, 9 aa, Homo Sapiens
FTDLVPGQK

SEQ ID NO: 937656 - protein, 9 aa, Homo Sapiens
FYCNNESIK

SEQ ID NO: 937657 - protein, 9 aa, Homo Sapiens
NPPFASGLP

SEQ ID NO: 937658 - protein, 9 aa, Homo Sapiens
DGTDRVSCF

SEQ ID NO: 937659 - protein, 9 aa, Homo Sapiens
LETPVQPVF

SEQ ID NO: 937660 - protein, 9 aa, Homo Sapiens
LHREQHSLF

SEQ ID NO: 937661 - protein, 9 aa, Homo Sapiens
DSKIISTSG

SEQ ID NO: 937662 - protein, 9 aa, Homo Sapiens
EATTPMPQG

SEQ ID NO: 937663 - protein, 9 aa, Homo Sapiens
YQAASPDKG

SEQ ID NO: 937664 - protein, 9 aa, Homo Sapiens
SHNGSGDDA

SEQ ID NO: 937665 - protein, 9 aa, Homo Sapiens
DRDGYGGCD

SEQ ID NO: 937666 - protein, 9 aa, Homo Sapiens
PGRASAGAG

SEQ ID NO: 937667 - protein, 9 aa, Homo Sapiens
WGDYNDSAF

SEQ ID NO: 937668 - protein, 9 aa, Homo Sapiens
PLQNPASFF

SEQ ID NO: 937669 - protein, 9 aa, Homo Sapiens
SPSLPRLQY

SEQ ID NO: 937670 - protein, 9 aa, Homo Sapiens
NYNNKIWKQ

SEQ ID NO: 937671 - protein, 9 aa, Homo Sapiens
SSCSEYLPS

SEQ ID NO: 937672 - protein, 9 aa, Homo Sapiens
SPDKGALVT

SEQ ID NO: 937673 - protein, 9 aa, Homo Sapiens
YCGFLTLED

SEQ ID NO: 937674 - protein, 9 aa, Homo Sapiens
ERVITREMV

SEQ ID NO: 937675 - protein, 9 aa, Homo Sapiens
KLSCVKTTA

SEQ ID NO: 937676 - protein, 9 aa, Homo Sapiens
DEEKPCGDS

SEQ ID NO: 937677 - protein, 9 aa, Homo Sapiens
NKSETTVPP

SEQ ID NO: 937678 - protein, 9 aa, Homo Sapiens
RKYFQKITL

SEQ ID NO: 937679 - protein, 9 aa, Homo Sapiens
ENQKVGWDL

SEQ ID NO: 937680 - protein, 9 aa, Homo Sapiens
RAQHQAFLE

SEQ ID NO: 937681 - protein, 9 aa, Homo Sapiens
LIQIGGLID

SEQ ID NO: 937682 - protein, 9 aa, Homo Sapiens
FIGFSTFLG

SEQ ID NO: 937683 - protein, 9 aa, Homo Sapiens
IRAPRYKIR

SEQ ID NO: 937684 - protein, 9 aa, Homo Sapiens
PQFPGFSPP

SEQ ID NO: 937685 - protein, 9 aa, Homo Sapiens
RSQAAFSHT

SEQ ID NO: 937686 - protein, 9 aa, Homo Sapiens
EEISLSLWA

SEQ ID NO: 937687 - protein, 9 aa, Homo Sapiens
NESIKYPLK

SEQ ID NO: 937688 - protein, 9 aa, Homo Sapiens
PRLIKKLRC

SEQ ID NO: 937689 - protein, 9 aa, Homo Sapiens
TPVQPVFSL

SEQ ID NO: 937690 - protein, 9 aa, Homo Sapiens
MYFFFTHLS

SEQ ID NO: 937691 - protein, 9 aa, Homo Sapiens
ECSPSLPRL

SEQ ID NO: 937692 - protein, 9 aa, Homo Sapiens
DVPAHLMKD

SEQ ID NO: 937693 - protein, 9 aa, Homo Sapiens
AKAQICKSV

SEQ ID NO: 937694 - protein, 9 aa, Homo Sapiens
IGRGPHIED

SEQ ID NO: 937695 - protein, 9 aa, Homo Sapiens
FDTYYCGFL

SEQ ID NO: 937696 - protein, 9 aa, Homo Sapiens
LGNEVPEKA

SEQ ID NO: 937697 - protein, 9 aa, Homo Sapiens
SVLFPDVTS

SEQ ID NO: 937698 - protein, 9 aa, Homo Sapiens
SFWEIFGSA

SEQ ID NO: 937699 - protein, 9 aa, Homo Sapiens
TGEKLYTCN

SEQ ID NO: 937700 - protein, 9 aa, Homo Sapiens
KQGLRSSLT

SEQ ID NO: 937701 - protein, 9 aa, Homo Sapiens
KINDVDVQE

SEQ ID NO: 937702 - protein, 9 aa, Homo Sapiens
FDELPGLPG

SEQ ID NO: 937703 - protein, 9 aa, Homo Sapiens
PEPSAKHEN

SEQ ID NO: 937704 - protein, 9 aa, Homo Sapiens
YCGCGTVNW

SEQ ID NO: 937705 - protein, 9 aa, Homo Sapiens
LQRSEHVQE

SEQ ID NO: 937706 - protein, 9 aa, Homo Sapiens
REGFIHSII

SEQ ID NO: 937707 - protein, 9 aa, Homo Sapiens
VVYCSAGVG

SEQ ID NO: 937708 - protein, 9 aa, Homo Sapiens
QPGRASAGA

SEQ ID NO: 937709 - protein, 9 aa, Homo Sapiens
NLFESPEEA

SEQ ID NO: 937710 - protein, 9 aa, Homo Sapiens
QKITLYLTE

SEQ ID NO: 937711 - protein, 9 aa, Homo Sapiens
VGIDFRKKR

SEQ ID NO: 937712 - protein, 9 aa, Homo Sapiens
PSNSDSGTE

SEQ ID NO: 937713 - protein, 9 aa, Homo Sapiens
FYEENPDFE

SEQ ID NO: 937714 - protein, 9 aa, Homo Sapiens
PRSHHKDRA

SEQ ID NO: 937715 - protein, 9 aa, Homo Sapiens
IAGNINWVE

SEQ ID NO: 937716 - protein, 9 aa, Homo Sapiens
LLVTGTYKI

SEQ ID NO: 937717 - protein, 9 aa, Homo Sapiens
QIKNAIRKL

SEQ ID NO: 937718 - protein, 9 aa, Homo Sapiens
TLQAQQQGE

SEQ ID NO: 937719 - protein, 9 aa, Homo Sapiens
IFLIQASVQ

SEQ ID NO: 937720 - protein, 9 aa, Homo Sapiens
RRNWVKIYF

SEQ ID NO: 937721 - protein, 9 aa, Homo Sapiens
EWQKAGVNG

SEQ ID NO: 937722 - protein, 9 aa, Homo Sapiens
KDVKGDGNP

SEQ ID NO: 937723 - protein, 9 aa, Homo Sapiens
SSSASNVHI

SEQ ID NO: 937724 - protein, 9 aa, Homo Sapiens
NPASFFFSS

SEQ ID NO: 937725 - protein, 9 aa, Homo Sapiens
YNDSAFMEP

SEQ ID NO: 937726 - protein, 9 aa, Homo Sapiens
VCINLTLCF

SEQ ID NO: 937727 - protein, 9 aa, Homo Sapiens
RPGEPFNSQ

SEQ ID NO: 937728 - protein, 9 aa, Homo Sapiens
TLMLVAVLT

SEQ ID NO: 937729 - protein, 9 aa, Homo Sapiens
HAARNTLAS

SEQ ID NO: 937730 - protein, 9 aa, Homo Sapiens
AWGDYNDSA

SEQ ID NO: 937731 - protein, 9 aa, Homo Sapiens
GIFWVGAQE

SEQ ID NO: 937732 - protein, 9 aa, Homo Sapiens
RVRGSEYDN

SEQ ID NO: 937733 - protein, 9 aa, Homo Sapiens
ALKDNSYFG

SEQ ID NO: 937734 - protein, 9 aa, Homo Sapiens
GCIYEVRIN

SEQ ID NO: 937735 - protein, 9 aa, Homo Sapiens
KQLEDGYFR

SEQ ID NO: 937736 - protein, 9 aa, Homo Sapiens
RKQKQQKRL

SEQ ID NO: 937737 - protein, 9 aa, Homo Sapiens
KMDTRAAAS

SEQ ID NO: 937738 - protein, 9 aa, Homo Sapiens
RAILFCGQR

SEQ ID NO: 937739 - protein, 9 aa, Homo Sapiens
QNSSSTGWN

SEQ ID NO: 937740 - protein, 9 aa, Homo Sapiens
LMFAKRRKR

SEQ ID NO: 937741 - protein, 9 aa, Homo Sapiens
SRIRRNKIG

SEQ ID NO: 937742 - protein, 9 aa, Homo Sapiens
FRIGRGPHI

SEQ ID NO: 937743 - protein, 9 aa, Homo Sapiens
RSPRRGSEA

SEQ ID NO: 937744 - protein, 9 aa, Homo Sapiens
MLVNFLVEK

SEQ ID NO: 937745 - protein, 9 aa, Homo Sapiens
GPIVVYCSA

SEQ ID NO: 937746 - protein, 9 aa, Homo Sapiens
PLNFRQDVI

SEQ ID NO: 937747 - protein, 9 aa, Homo Sapiens
EGYSSNYKL

SEQ ID NO: 937748 - protein, 9 aa, Homo Sapiens
TVGPLQLLA

SEQ ID NO: 937749 - protein, 9 aa, Homo Sapiens
QLFMDLDVV

SEQ ID NO: 937750 - protein, 9 aa, Homo Sapiens
MQANYNLLS

SEQ ID NO: 937751 - protein, 9 aa, Homo Sapiens
NEAKPIDFT

SEQ ID NO: 937752 - protein, 9 aa, Homo Sapiens
KYFQKITLY

SEQ ID NO: 937753 - protein, 9 aa, Homo Sapiens
ATSGENYHP

SEQ ID NO: 937754 - protein, 9 aa, Homo Sapiens
PQGPLPPPG

SEQ ID NO: 937755 - protein, 9 aa, Homo Sapiens
LLVPFLNRG

SEQ ID NO: 937756 - protein, 9 aa, Homo Sapiens
KGPMDVVIV

SEQ ID NO: 937757 - protein, 9 aa, Homo Sapiens
KEDELVGSN

SEQ ID NO: 937758 - protein, 9 aa, Homo Sapiens
KESTTEEIK

SEQ ID NO: 937759 - protein, 9 aa, Homo Sapiens
IKVVRGGGG

SEQ ID NO: 937760 - protein, 9 aa, Homo Sapiens
ICKSVCHVL

SEQ ID NO: 937761 - protein, 9 aa, Homo Sapiens
PDMLHQDIQ

SEQ ID NO: 937762 - protein, 9 aa, Homo Sapiens
NPGRCAVDR

SEQ ID NO: 937763 - protein, 9 aa, Homo Sapiens
KLYTCNECG

SEQ ID NO: 937764 - protein, 9 aa, Homo Sapiens
VFSVAFELV

SEQ ID NO: 937765 - protein, 9 aa, Homo Sapiens
YGGCDRDYG

SEQ ID NO: 937766 - protein, 9 aa, Homo Sapiens
QAAFSHTQV

SEQ ID NO: 937767 - protein, 9 aa, Homo Sapiens
KAFSTCTFH

SEQ ID NO: 937768 - protein, 9 aa, Homo Sapiens
RVENSNSTA

SEQ ID NO: 937769 - protein, 9 aa, Homo Sapiens
RYDLRDQIT

SEQ ID NO: 937770 - protein, 9 aa, Homo Sapiens
WGFYTKLND

SEQ ID NO: 937771 - protein, 9 aa, Homo Sapiens
INFCCAEAT

SEQ ID NO: 937772 - protein, 9 aa, Homo Sapiens
ELKMRAIQV

SEQ ID NO: 937773 - protein, 9 aa, Homo Sapiens
IKDMFSGKE

SEQ ID NO: 937774 - protein, 9 aa, Homo Sapiens
SGLHGPDFP

SEQ ID NO: 937775 - protein, 9 aa, Homo Sapiens
KAKGMFCVG

SEQ ID NO: 937776 - protein, 9 aa, Homo Sapiens
ANFLFLEVD

SEQ ID NO: 937777 - protein, 9 aa, Homo Sapiens
KSSVGCVEP

SEQ ID NO: 937778 - protein, 9 aa, Homo Sapiens
IYEVRINNE

SEQ ID NO: 937779 - protein, 9 aa, Homo Sapiens
KAKAQICKS

SEQ ID NO: 937780 - protein, 9 aa, Homo Sapiens
FKKKGKTAF

SEQ ID NO: 937781 - protein, 9 aa, Homo Sapiens
VRKYFQKIT

SEQ ID NO: 937782 - protein, 9 aa, Homo Sapiens
LALQQKLEK

SEQ ID NO: 937783 - protein, 9 aa, Homo Sapiens
KKRLFFLRF

SEQ ID NO: 937784 - protein, 9 aa, Homo Sapiens
QSFWEIFGS

SEQ ID NO: 937785 - protein, 9 aa, Homo Sapiens
NNYKNFLEQ

SEQ ID NO: 937786 - protein, 9 aa, Homo Sapiens
IEDWNNYKN

SEQ ID NO: 937787 - protein, 9 aa, Homo Sapiens
YRIPSTPDF

SEQ ID NO: 937788 - protein, 9 aa, Homo Sapiens
KIISTSGDH

SEQ ID NO: 937789 - protein, 9 aa, Homo Sapiens
VWMLMLLLV

SEQ ID NO: 937790 - protein, 9 aa, Homo Sapiens
RTNLNEKYG

SEQ ID NO: 937791 - protein, 9 aa, Homo Sapiens
KENIQEKGP

SEQ ID NO: 937792 - protein, 9 aa, Homo Sapiens
VKLLDREQL

SEQ ID NO: 937793 - protein, 9 aa, Homo Sapiens
AGNINWVES

SEQ ID NO: 937794 - protein, 9 aa, Homo Sapiens
CNQKRKHDE

SEQ ID NO: 937795 - protein, 9 aa, Homo Sapiens
NHFIGFSTF

SEQ ID NO: 937796 - protein, 9 aa, Homo Sapiens
QSVPYEMAV

SEQ ID NO: 937797 - protein, 9 aa, Homo Sapiens
HYLERIHLH

SEQ ID NO: 937798 - protein, 9 aa, Homo Sapiens
EKTEETLLT

SEQ ID NO: 937799 - protein, 9 aa, Homo Sapiens
DRSLVCYGK

SEQ ID NO: 937800 - protein, 9 aa, Homo Sapiens
LTTQQKLAS

SEQ ID NO: 937801 - protein, 9 aa, Homo Sapiens
YTLKNAQIK

SEQ ID NO: 937802 - protein, 9 aa, Homo Sapiens
GPLFQEALM

SEQ ID NO: 937803 - protein, 9 aa, Homo Sapiens
SKYIFLFIR

SEQ ID NO: 937804 - protein, 9 aa, Homo Sapiens
VVVTARSKK

SEQ ID NO: 937805 - protein, 9 aa, Homo Sapiens
ALSWREGFI

SEQ ID NO: 937806 - protein, 9 aa, Homo Sapiens
NLKLTCGNL

SEQ ID NO: 937807 - protein, 9 aa, Homo Sapiens
EAGIPFNTQ

SEQ ID NO: 937808 - protein, 9 aa, Homo Sapiens
LRDQITRLG

SEQ ID NO: 937809 - protein, 9 aa, Homo Sapiens
LIQASVQDT

SEQ ID NO: 937810 - protein, 9 aa, Homo Sapiens
ATSGLGPLQ

SEQ ID NO: 937811 - protein, 9 aa, Homo Sapiens
IVIGMLYVM

SEQ ID NO: 937812 - protein, 9 aa, Homo Sapiens
APGIEKKAA

SEQ ID NO: 937813 - protein, 9 aa, Homo Sapiens
MKPSERKPF

SEQ ID NO: 937814 - protein, 9 aa, Homo Sapiens
VVPNIILTN

SEQ ID NO: 937815 - protein, 9 aa, Homo Sapiens
KPSERKPFS

SEQ ID NO: 937816 - protein, 9 aa, Homo Sapiens
EEGKLIFYA

SEQ ID NO: 937817 - protein, 9 aa, Homo Sapiens
FFAFGVFGC

SEQ ID NO: 937818 - protein, 9 aa, Homo Sapiens
FAILSFADD

SEQ ID NO: 937819 - protein, 9 aa, Homo Sapiens
NAKEGNVPQ

SEQ ID NO: 937820 - protein, 9 aa, Homo Sapiens
ECNIMKDFM

SEQ ID NO: 937821 - protein, 9 aa, Homo Sapiens
CARGHSQKF

SEQ ID NO: 937822 - protein, 9 aa, Homo Sapiens
EEATRWADF

SEQ ID NO: 937823 - protein, 9 aa, Homo Sapiens
EPSAKHENK

SEQ ID NO: 937824 - protein, 9 aa, Homo Sapiens
SELRRGFDW

SEQ ID NO: 937825 - protein, 9 aa, Homo Sapiens
ENKKMKEKQ

SEQ ID NO: 937826 - protein, 9 aa, Homo Sapiens
TYMRETCGC

SEQ ID NO: 937827 - protein, 9 aa, Homo Sapiens
IQGGKKDKM

SEQ ID NO: 937828 - protein, 9 aa, Homo Sapiens
EEWQKAGVN

SEQ ID NO: 937829 - protein, 9 aa, Homo Sapiens
ALRKVLVEK

SEQ ID NO: 937830 - protein, 9 aa, Homo Sapiens
CTDTAKFQE

SEQ ID NO: 937831 - protein, 9 aa, Homo Sapiens
TFTDLVPGQ

SEQ ID NO: 937832 - protein, 9 aa, Homo Sapiens
EDFVDRDHV

SEQ ID NO: 937833 - protein, 9 aa, Homo Sapiens
QFPGFSPPV

SEQ ID NO: 937834 - protein, 9 aa, Homo Sapiens
NLGYYLKMK

SEQ ID NO: 937835 - protein, 9 aa, Homo Sapiens
SSVGKLSEY

SEQ ID NO: 937836 - protein, 9 aa, Homo Sapiens
KCDFSIMKF

SEQ ID NO: 937837 - protein, 9 aa, Homo Sapiens
NLYVQHAIP

SEQ ID NO: 937838 - protein, 9 aa, Homo Sapiens
AGIPFNTQV

SEQ ID NO: 937839 - protein, 9 aa, Homo Sapiens
QYSSPSLGT

SEQ ID NO: 937840 - protein, 9 aa, Homo Sapiens
NIDQSFWEI

SEQ ID NO: 937841 - protein, 9 aa, Homo Sapiens
SSISRIRRN

SEQ ID NO: 937842 - protein, 9 aa, Homo Sapiens
VKITFPVDF

SEQ ID NO: 937843 - protein, 9 aa, Homo Sapiens
HNGSGDDAP

SEQ ID NO: 937844 - protein, 9 aa, Homo Sapiens
DVDSNDLKR

SEQ ID NO: 937845 - protein, 9 aa, Homo Sapiens
ASVQDTAYL

SEQ ID NO: 937846 - protein, 9 aa, Homo Sapiens
HREQHSLFS

SEQ ID NO: 937847 - protein, 9 aa, Homo Sapiens
LKLTCGNLL

SEQ ID NO: 937848 - protein, 9 aa, Homo Sapiens
RDEGPNGSP

SEQ ID NO: 937849 - protein, 9 aa, Homo Sapiens
CWKRGTSEI

SEQ ID NO: 937850 - protein, 9 aa, Homo Sapiens
IVANRGTLS

SEQ ID NO: 937851 - protein, 9 aa, Homo Sapiens
GCDRDYGDH

SEQ ID NO: 937852 - protein, 9 aa, Homo Sapiens
GYCGCGTVN

SEQ ID NO: 937853 - protein, 9 aa, Homo Sapiens
EEEDVGNDT

SEQ ID NO: 937854 - protein, 9 aa, Homo Sapiens
YAFSKDIFF

SEQ ID NO: 937855 - protein, 9 aa, Homo Sapiens
TREEKKRWI

SEQ ID NO: 937856 - protein, 9 aa, Homo Sapiens
YLLVPFLNR

SEQ ID NO: 937857 - protein, 9 aa, Homo Sapiens
KMQSYSTIV

SEQ ID NO: 937858 - protein, 9 aa, Homo Sapiens
FISLPHTIS

SEQ ID NO: 937859 - protein, 9 aa, Homo Sapiens
AIFRQNSSS

SEQ ID NO: 937860 - protein, 9 aa, Homo Sapiens
VPGQKYMAT

SEQ ID NO: 937861 - protein, 9 aa, Homo Sapiens
VNFLINPLL

SEQ ID NO: 937862 - protein, 9 aa, Homo Sapiens
TGTYKISDQ

SEQ ID NO: 937863 - protein, 9 aa, Homo Sapiens
CGPKFSECN

SEQ ID NO: 937864 - protein, 9 aa, Homo Sapiens
WPRLIKKLR

SEQ ID NO: 937865 - protein, 9 aa, Homo Sapiens
LFLAKLIKL

SEQ ID NO: 937866 - protein, 9 aa, Homo Sapiens
IVIFFFLFI

SEQ ID NO: 937867 - protein, 9 aa, Homo Sapiens
GYKIPLCNL

SEQ ID NO: 937868 - protein, 9 aa, Homo Sapiens
LEEWQKAGV

SEQ ID NO: 937869 - protein, 9 aa, Homo Sapiens
IPLCNLDQY

SEQ ID NO: 937870 - protein, 9 aa, Homo Sapiens
CKGPLFQEA

SEQ ID NO: 937871 - protein, 9 aa, Homo Sapiens
KEELLLVMT

SEQ ID NO: 937872 - protein, 9 aa, Homo Sapiens
TSWLAPIVS

SEQ ID NO: 937873 - protein, 9 aa, Homo Sapiens
AGPHPSPWA

SEQ ID NO: 937874 - protein, 9 aa, Homo Sapiens
RWADFFDVL

SEQ ID NO: 937875 - protein, 9 aa, Homo Sapiens
HICLAWEFF

SEQ ID NO: 937876 - protein, 9 aa, Homo Sapiens
WMLMLLLVV

SEQ ID NO: 937877 - protein, 9 aa, Homo Sapiens
EKENIGLPG

SEQ ID NO: 937878 - protein, 9 aa, Homo Sapiens
LPSIESDPE

SEQ ID NO: 937879 - protein, 9 aa, Homo Sapiens
AEVLLLLPL

SEQ ID NO: 937880 - protein, 9 aa, Homo Sapiens
LVCYGKRGL

SEQ ID NO: 937881 - protein, 9 aa, Homo Sapiens
KPCQCNSHF

SEQ ID NO: 937882 - protein, 9 aa, Homo Sapiens
TDVLLYTDQ

SEQ ID NO: 937883 - protein, 9 aa, Homo Sapiens
PSERKPFSS

SEQ ID NO: 937884 - protein, 9 aa, Homo Sapiens
QDSALKDQD

SEQ ID NO: 937885 - protein, 9 aa, Homo Sapiens
CIILLIRTN

SEQ ID NO: 937886 - protein, 9 aa, Homo Sapiens
FWEIFGSAE

SEQ ID NO: 937887 - protein, 9 aa, Homo Sapiens
LTGFQNLKI

SEQ ID NO: 937888 - protein, 9 aa, Homo Sapiens
DFFDVLLSH

SEQ ID NO: 937889 - protein, 9 aa, Homo Sapiens
VSPAVLVYN

SEQ ID NO: 937890 - protein, 9 aa, Homo Sapiens
GGAGRDFYE

SEQ ID NO: 937891 - protein, 9 aa, Homo Sapiens
SIISLYFQM

SEQ ID NO: 937892 - protein, 9 aa, Homo Sapiens
VALSWREGF

SEQ ID NO: 937893 - protein, 9 aa, Homo Sapiens
HWFSVQKLE

SEQ ID NO: 937894 - protein, 9 aa, Homo Sapiens
QGALHRAPV

SEQ ID NO: 937895 - protein, 9 aa, Homo Sapiens
LSYSSKKKK

SEQ ID NO: 937896 - protein, 9 aa, Homo Sapiens
HPAQGFRVG

SEQ ID NO: 937897 - protein, 9 aa, Homo Sapiens
DYNDSAFME

SEQ ID NO: 937898 - protein, 9 aa, Homo Sapiens
ETQLDLRDQ

SEQ ID NO: 937899 - protein, 9 aa, Homo Sapiens
NDSWIFSLA

SEQ ID NO: 937900 - protein, 9 aa, Homo Sapiens
AFSKDIFFV

SEQ ID NO: 937901 - protein, 9 aa, Homo Sapiens
CHGLYEIFT

SEQ ID NO: 937902 - protein, 9 aa, Homo Sapiens
QNYNNKIWK

SEQ ID NO: 937903 - protein, 9 aa, Homo Sapiens
RDFYEENPD

SEQ ID NO: 937904 - protein, 9 aa, Homo Sapiens
SVCINLTLC

SEQ ID NO: 937905 - protein, 9 aa, Homo Sapiens
CQTKLHSLR

SEQ ID NO: 937906 - protein, 9 aa, Homo Sapiens
GRAILFCGQ

SEQ ID NO: 937907 - protein, 9 aa, Homo Sapiens
TASTPTISV

SEQ ID NO: 937908 - protein, 9 aa, Homo Sapiens
KITCNQKRK

SEQ ID NO: 937909 - protein, 9 aa, Homo Sapiens
LERDTVAAL

SEQ ID NO: 937910 - protein, 9 aa, Homo Sapiens
MFAKRRKRM

SEQ ID NO: 937911 - protein, 9 aa, Homo Sapiens
GKESISLCN

SEQ ID NO: 937912 - protein, 9 aa, Homo Sapiens
AANVIEIGE

SEQ ID NO: 937913 - protein, 9 aa, Homo Sapiens
DIFFVINFF

SEQ ID NO: 937914 - protein, 9 aa, Homo Sapiens
LLWNPEILI

SEQ ID NO: 937915 - protein, 9 aa, Homo Sapiens
ELGNQNLRL

SEQ ID NO: 937916 - protein, 9 aa, Homo Sapiens
EYRQEGPRG

SEQ ID NO: 937917 - protein, 9 aa, Homo Sapiens
DPRWLEAWW

SEQ ID NO: 937918 - protein, 9 aa, Homo Sapiens
SQAKDSDLK

SEQ ID NO: 937919 - protein, 9 aa, Homo Sapiens
GALHRAPVR

SEQ ID NO: 937920 - protein, 9 aa, Homo Sapiens
IQVEERLDM

SEQ ID NO: 937921 - protein, 9 aa, Homo Sapiens
QAIRAPRYK

SEQ ID NO: 937922 - protein, 9 aa, Homo Sapiens
SPKKIISFV

SEQ ID NO: 937923 - protein, 9 aa, Homo Sapiens
DLVPGQKYM

SEQ ID NO: 937924 - protein, 9 aa, Homo Sapiens
KLKPSCVYQ

SEQ ID NO: 937925 - protein, 9 aa, Homo Sapiens
KVCRKEVNK

SEQ ID NO: 937926 - protein, 9 aa, Homo Sapiens
ILFCGQRGR

SEQ ID NO: 937927 - protein, 9 aa, Homo Sapiens
CHRTNLNEK

SEQ ID NO: 937928 - protein, 9 aa, Homo Sapiens
CDRDYGDHL

SEQ ID NO: 937929 - protein, 9 aa, Homo Sapiens
DVLLYTDQH

SEQ ID NO: 937930 - protein, 9 aa, Homo Sapiens
LNLTSQYVK

SEQ ID NO: 937931 - protein, 9 aa, Homo Sapiens
ENLGYYLKM

SEQ ID NO: 937932 - protein, 9 aa, Homo Sapiens
ERLESSPHY

SEQ ID NO: 937933 - protein, 9 aa, Homo Sapiens
KRAMKCSYC

SEQ ID NO: 937934 - protein, 9 aa, Homo Sapiens
YKQFLTRMT

SEQ ID NO: 937935 - protein, 9 aa, Homo Sapiens
SSASNVHIN

SEQ ID NO: 937936 - protein, 9 aa, Homo Sapiens
PVPQRSQAV

SEQ ID NO: 937937 - protein, 9 aa, Homo Sapiens
QRVIYLQDS

SEQ ID NO: 937938 - protein, 9 aa, Homo Sapiens
MAVRMIQNF

SEQ ID NO: 937939 - protein, 9 aa, Homo Sapiens
ICNEDPDDN

SEQ ID NO: 937940 - protein, 9 aa, Homo Sapiens
DQLWFEKAK

SEQ ID NO: 937941 - protein, 9 aa, Homo Sapiens
DANFLFLEV

SEQ ID NO: 937942 - protein, 9 aa, Homo Sapiens
SKNSRHTIK

SEQ ID NO: 937943 - protein, 9 aa, Homo Sapiens
DLLEQVARK

SEQ ID NO: 937944 - protein, 9 aa, Homo Sapiens
HASRGNAPP

SEQ ID NO: 937945 - protein, 9 aa, Homo Sapiens
MALPAAAPT

SEQ ID NO: 937946 - protein, 9 aa, Homo Sapiens
SFYVSVSAR

SEQ ID NO: 937947 - protein, 9 aa, Homo Sapiens
RQWGTICDH

SEQ ID NO: 937948 - protein, 9 aa, Homo Sapiens
VEKNTVSYL

SEQ ID NO: 937949 - protein, 9 aa, Homo Sapiens
KKLRCYLKE

SEQ ID NO: 937950 - protein, 9 aa, Homo Sapiens
DKKSENIAF

SEQ ID NO: 937951 - protein, 9 aa, Homo Sapiens
QILPLRALD

SEQ ID NO: 937952 - protein, 9 aa, Homo Sapiens
KCYVKSSVG

SEQ ID NO: 937953 - protein, 9 aa, Homo Sapiens
GELESMGFL

SEQ ID NO: 937954 - protein, 9 aa, Homo Sapiens
PLESSRNFL

SEQ ID NO: 937955 - protein, 9 aa, Homo Sapiens
DTAKFQELG

SEQ ID NO: 937956 - protein, 9 aa, Homo Sapiens
DSWIFSLAV

SEQ ID NO: 937957 - protein, 9 aa, Homo Sapiens
TNTTSNSFG

SEQ ID NO: 937958 - protein, 9 aa, Homo Sapiens
LEPRELSFY

SEQ ID NO: 937959 - protein, 9 aa, Homo Sapiens
IFYATSRAY

SEQ ID NO: 937960 - protein, 9 aa, Homo Sapiens
GNQNLRLIN

SEQ ID NO: 937961 - protein, 9 aa, Homo Sapiens
YRVVPRDQN

SEQ ID NO: 937962 - protein, 9 aa, Homo Sapiens
NNKIWKQSK

SEQ ID NO: 937963 - protein, 9 aa, Homo Sapiens
HQRIYTGEK

SEQ ID NO: 937964 - protein, 9 aa, Homo Sapiens
PASFFFSSA

SEQ ID NO: 937965 - protein, 9 aa, Homo Sapiens
CLSHTVPET

SEQ ID NO: 937966 - protein, 9 aa, Homo Sapiens
FSERRTICI

SEQ ID NO: 937967 - protein, 9 aa, Homo Sapiens
QHERIYTGE

SEQ ID NO: 937968 - protein, 9 aa, Homo Sapiens
RDEFDLDLT

SEQ ID NO: 937969 - protein, 9 aa, Homo Sapiens
TYSLERDTV

SEQ ID NO: 937970 - protein, 9 aa, Homo Sapiens
NKIWKQSKK

SEQ ID NO: 937971 - protein, 9 aa, Homo Sapiens
TECDVMTYM

SEQ ID NO: 937972 - protein, 9 aa, Homo Sapiens
SKKTLQKVV

SEQ ID NO: 937973 - protein, 9 aa, Homo Sapiens
EPADLSGEL

SEQ ID NO: 937974 - protein, 9 aa, Homo Sapiens
SKIISTSGD

SEQ ID NO: 937975 - protein, 9 aa, Homo Sapiens
RPFKLSEQY

SEQ ID NO: 937976 - protein, 9 aa, Homo Sapiens
WTEETYRGV

SEQ ID NO: 937977 - protein, 9 aa, Homo Sapiens
SYVIYFLGQ

SEQ ID NO: 937978 - protein, 9 aa, Homo Sapiens
VPSKFVVQP

SEQ ID NO: 937979 - protein, 9 aa, Homo Sapiens
TIPGNVFQG

SEQ ID NO: 937980 - protein, 9 aa, Homo Sapiens
CPTLCQTYV

SEQ ID NO: 937981 - protein, 9 aa, Homo Sapiens
QICKSVCHV

SEQ ID NO: 937982 - protein, 9 aa, Homo Sapiens
LVTWLVLSE

SEQ ID NO: 937983 - protein, 9 aa, Homo Sapiens
NFLDEFMEA

SEQ ID NO: 937984 - protein, 9 aa, Homo Sapiens
LKPTLFLAV

SEQ ID NO: 937985 - protein, 9 aa, Homo Sapiens
YSSQLDGEA

SEQ ID NO: 937986 - protein, 9 aa, Homo Sapiens
LRYDLRDQI

SEQ ID NO: 937987 - protein, 9 aa, Homo Sapiens
RIGRGPHIE

SEQ ID NO: 937988 - protein, 9 aa, Homo Sapiens
INWVESNLD

SEQ ID NO: 937989 - protein, 9 aa, Homo Sapiens
EHVQESDGE

SEQ ID NO: 937990 - protein, 9 aa, Homo Sapiens
VHEERMKNN

SEQ ID NO: 937991 - protein, 9 aa, Homo Sapiens
QNPLENLKL

SEQ ID NO: 937992 - protein, 9 aa, Homo Sapiens
DEYRCVCSP

SEQ ID NO: 937993 - protein, 9 aa, Homo Sapiens
RIVIARALV

SEQ ID NO: 937994 - protein, 9 aa, Homo Sapiens
VKSSVGCVE

SEQ ID NO: 937995 - protein, 9 aa, Homo Sapiens
QRNYLSSVG

SEQ ID NO: 937996 - protein, 9 aa, Homo Sapiens
DMIVIGMLY

SEQ ID NO: 937997 - protein, 9 aa, Homo Sapiens
CVNLPDEYR

SEQ ID NO: 937998 - protein, 9 aa, Homo Sapiens
MLYVMILRA

SEQ ID NO: 937999 - protein, 9 aa, Homo Sapiens
KFASLKDVP

SEQ ID NO: 938000 - protein, 9 aa, Homo Sapiens
YLRKCNREE

SEQ ID NO: 938001 - protein, 9 aa, Homo Sapiens
GERVITREM

SEQ ID NO: 938002 - protein, 9 aa, Homo Sapiens
SPRRGSEAG

SEQ ID NO: 938003 - protein, 9 aa, Homo Sapiens
HSDTTPLVS

SEQ ID NO: 938004 - protein, 9 aa, Homo Sapiens
MAGGRSVFV

SEQ ID NO: 938005 - protein, 9 aa, Homo Sapiens
VSHNEPGIA

SEQ ID NO: 938006 - protein, 9 aa, Homo Sapiens
GCKGPLFQE

SEQ ID NO: 938007 - protein, 9 aa, Homo Sapiens
ANRLCMINE

SEQ ID NO: 938008 - protein, 9 aa, Homo Sapiens
KITLYLTEK

SEQ ID NO: 938009 - protein, 9 aa, Homo Sapiens
KSVPQDLDN

SEQ ID NO: 938010 - protein, 9 aa, Homo Sapiens
EKINDVDVQ

SEQ ID NO: 938011 - protein, 9 aa, Homo Sapiens
YEVRINNEL

SEQ ID NO: 938012 - protein, 9 aa, Homo Sapiens
EQALLRNVQ

SEQ ID NO: 938013 - protein, 9 aa, Homo Sapiens
SEHVQESDG

SEQ ID NO: 938014 - protein, 9 aa, Homo Sapiens
LLDYLRKCN

SEQ ID NO: 938015 - protein, 9 aa, Homo Sapiens
KLILLDLYD

SEQ ID NO: 938016 - protein, 9 aa, Homo Sapiens
IEKKAAENG

SEQ ID NO: 938017 - protein, 9 aa, Homo Sapiens
LIFYATSRA

SEQ ID NO: 938018 - protein, 9 aa, Homo Sapiens
QGGIFVERM

SEQ ID NO: 938019 - protein, 9 aa, Homo Sapiens
IIEVFSQSV

SEQ ID NO: 938020 - protein, 9 aa, Homo Sapiens
EGFIHSIIQ

SEQ ID NO: 938021 - protein, 9 aa, Homo Sapiens
QGGVAPNQP

SEQ ID NO: 938022 - protein, 9 aa, Homo Sapiens
GDLAYQILP

SEQ ID NO: 938023 - protein, 9 aa, Homo Sapiens
FEKAKGMFC

SEQ ID NO: 938024 - protein, 9 aa, Homo Sapiens
NEDPDDNLR

SEQ ID NO: 938025 - protein, 9 aa, Homo Sapiens
PCTDGTDRV

SEQ ID NO: 938026 - protein, 9 aa, Homo Sapiens
EVLDQVGTF

SEQ ID NO: 938027 - protein, 9 aa, Homo Sapiens
ICFDTFKLD

SEQ ID NO: 938028 - protein, 9 aa, Homo Sapiens
SHTIDFFEM

SEQ ID NO: 938029 - protein, 9 aa, Homo Sapiens
DLFTPLHYL

SEQ ID NO: 938030 - protein, 9 aa, Homo Sapiens
TYYCGFLTL

SEQ ID NO: 938031 - protein, 9 aa, Homo Sapiens
VEIMYQIGT

SEQ ID NO: 938032 - protein, 9 aa, Homo Sapiens
PLRRAESLC

SEQ ID NO: 938033 - protein, 9 aa, Homo Sapiens
IYTGEKPYE

SEQ ID NO: 938034 - protein, 9 aa, Homo Sapiens
VANRGTLSV

SEQ ID NO: 938035 - protein, 9 aa, Homo Sapiens
MSWPRLIKK

SEQ ID NO: 938036 - protein, 9 aa, Homo Sapiens
DSLTNLYVQ

SEQ ID NO: 938037 - protein, 9 aa, Homo Sapiens
IQIGGLIDS

SEQ ID NO: 938038 - protein, 9 aa, Homo Sapiens
LIVHQRIYT

SEQ ID NO: 938039 - protein, 9 aa, Homo Sapiens
TSVIEHQLS

SEQ ID NO: 938040 - protein, 9 aa, Homo Sapiens
IILAPGSYL

SEQ ID NO: 938041 - protein, 9 aa, Homo Sapiens
KPFKKKGKT

SEQ ID NO: 938042 - protein, 9 aa, Homo Sapiens
DLINKSETT

SEQ ID NO: 938043 - protein, 9 aa, Homo Sapiens
KVGVQNFVL

SEQ ID NO: 938044 - protein, 9 aa, Homo Sapiens
SEYDNFLDE

SEQ ID NO: 938045 - protein, 9 aa, Homo Sapiens
IYFLGQPLE

SEQ ID NO: 938046 - protein, 9 aa, Homo Sapiens
AIRAPRYKI

SEQ ID NO: 938047 - protein, 9 aa, Homo Sapiens
TQLDLRDQE

SEQ ID NO: 938048 - protein, 9 aa, Homo Sapiens
EMRVSHSDT

SEQ ID NO: 938049 - protein, 9 aa, Homo Sapiens
EDGVKMDTR

SEQ ID NO: 938050 - protein, 9 aa, Homo Sapiens
LRDFPSDFK

SEQ ID NO: 938051 - protein, 9 aa, Homo Sapiens
CSIRPFKLS

SEQ ID NO: 938052 - protein, 9 aa, Homo Sapiens
HTIKVASVF

SEQ ID NO: 938053 - protein, 9 aa, Homo Sapiens
TKLHSLRSA

SEQ ID NO: 938054 - protein, 9 aa, Homo Sapiens
LPGKDVKGD

SEQ ID NO: 938055 - protein, 9 aa, Homo Sapiens
PIVVYCSAG

SEQ ID NO: 938056 - protein, 9 aa, Homo Sapiens
KLEKVLVVV

SEQ ID NO: 938057 - protein, 9 aa, Homo Sapiens
TVAQQIYGT

SEQ ID NO: 938058 - protein, 9 aa, Homo Sapiens
SFISLPHTI

SEQ ID NO: 938059 - protein, 9 aa, Homo Sapiens
VKLNELELG

SEQ ID NO: 938060 - protein, 9 aa, Homo Sapiens
TDRVSCFGS

SEQ ID NO: 938061 - protein, 9 aa, Homo Sapiens
GFSTFLGLG

SEQ ID NO: 938062 - protein, 9 aa, Homo Sapiens
PPQFPGFSP

SEQ ID NO: 938063 - protein, 9 aa, Homo Sapiens
NSQMVTEGR

SEQ ID NO: 938064 - protein, 9 aa, Homo Sapiens
HTDVLLYTD

SEQ ID NO: 938065 - protein, 9 aa, Homo Sapiens
IEIGEPSRP

SEQ ID NO: 938066 - protein, 9 aa, Homo Sapiens
ERDTVAALF

SEQ ID NO: 938067 - protein, 9 aa, Homo Sapiens
TYVKCPTLC

SEQ ID NO: 938068 - protein, 9 aa, Homo Sapiens
ASRGRAILF

SEQ ID NO: 938069 - protein, 9 aa, Homo Sapiens
TFNEAKPID

SEQ ID NO: 938070 - protein, 9 aa, Homo Sapiens
QGLRSSLTK

SEQ ID NO: 938071 - protein, 9 aa, Homo Sapiens
SARHPSSLS

SEQ ID NO: 938072 - protein, 9 aa, Homo Sapiens
RVPSKFVVQ

SEQ ID NO: 938073 - protein, 9 aa, Homo Sapiens
YVFIPIHIC

SEQ ID NO: 938074 - protein, 9 aa, Homo Sapiens
QVQKLNAKE

SEQ ID NO: 938075 - protein, 9 aa, Homo Sapiens
TYEDLINKS

SEQ ID NO: 938076 - protein, 9 aa, Homo Sapiens
RFLLHPLTG

SEQ ID NO: 938077 - protein, 9 aa, Homo Sapiens
QLLTLTSWL

SEQ ID NO: 938078 - protein, 9 aa, Homo Sapiens
YQVLRNPPF

SEQ ID NO: 938079 - protein, 9 aa, Homo Sapiens
KEFGPLTRL

SEQ ID NO: 938080 - protein, 9 aa, Homo Sapiens
IFSLAVLLC

SEQ ID NO: 938081 - protein, 9 aa, Homo Sapiens
GNLLDYLRK

SEQ ID NO: 938082 - protein, 9 aa, Homo Sapiens
VEYKRTTLR

SEQ ID NO: 938083 - protein, 9 aa, Homo Sapiens
EAAIRTLFF

SEQ ID NO: 938084 - protein, 9 aa, Homo Sapiens
YKRTTLRDE

SEQ ID NO: 938085 - protein, 9 aa, Homo Sapiens
MPTTSRVGF

SEQ ID NO: 938086 - protein, 9 aa, Homo Sapiens
LSTVDPSEA

SEQ ID NO: 938087 - protein, 9 aa, Homo Sapiens
MKFIYDMMG

SEQ ID NO: 938088 - protein, 9 aa, Homo Sapiens
EEGSLEEAT

SEQ ID NO: 938089 - protein, 9 aa, Homo Sapiens
ARETKCYVK

SEQ ID NO: 938090 - protein, 9 aa, Homo Sapiens
RTLFFVTGI

SEQ ID NO: 938091 - protein, 9 aa, Homo Sapiens
PSLPRLQYK

SEQ ID NO: 938092 - protein, 9 aa, Homo Sapiens
DLLVTGTYK

SEQ ID NO: 938093 - protein, 9 aa, Homo Sapiens
EPGIAGSPR

SEQ ID NO: 938094 - protein, 9 aa, Homo Sapiens
SNSLKNTGK

SEQ ID NO: 938095 - protein, 9 aa, Homo Sapiens
TPQTTPSLQ

SEQ ID NO: 938096 - protein, 9 aa, Homo Sapiens
TCNQKRKHD

SEQ ID NO: 938097 - protein, 9 aa, Homo Sapiens
IVNHILNSK

SEQ ID NO: 938098 - protein, 9 aa, Homo Sapiens
DKGALVTAA

SEQ ID NO: 938099 - protein, 9 aa, Homo Sapiens
GWRARAECS

SEQ ID NO: 938100 - protein, 9 aa, Homo Sapiens
PPRALGSAS

SEQ ID NO: 938101 - protein, 9 aa, Homo Sapiens
KDMFSGKEF

SEQ ID NO: 938102 - protein, 9 aa, Homo Sapiens
KVVRGGGGK

SEQ ID NO: 938103 - protein, 9 aa, Homo Sapiens
PDLQIVIFF

SEQ ID NO: 938104 - protein, 9 aa, Homo Sapiens
KRQGLLSGA

SEQ ID NO: 938105 - protein, 9 aa, Homo Sapiens
STFLGLGFE

SEQ ID NO: 938106 - protein, 9 aa, Homo Sapiens
VPMLQDFPL

SEQ ID NO: 938107 - protein, 9 aa, Homo Sapiens
AFSTCTFHM

SEQ ID NO: 938108 - protein, 9 aa, Homo Sapiens
SATGEKSST

SEQ ID NO: 938109 - protein, 9 aa, Homo Sapiens
TEAFSKKRW

SEQ ID NO: 938110 - protein, 9 aa, Homo Sapiens
KMLKKEASA

SEQ ID NO: 938111 - protein, 9 aa, Homo Sapiens
VGVQNFVLL

SEQ ID NO: 938112 - protein, 9 aa, Homo Sapiens
EILALVVDK

SEQ ID NO: 938113 - protein, 9 aa, Homo Sapiens
NKFLDNLGN

SEQ ID NO: 938114 - protein, 9 aa, Homo Sapiens
EDVGNDTKA

SEQ ID NO: 938115 - protein, 9 aa, Homo Sapiens
ARGCTATLD

SEQ ID NO: 938116 - protein, 9 aa, Homo Sapiens
PKFSECNCP

SEQ ID NO: 938117 - protein, 9 aa, Homo Sapiens
PLLCQEDRS

SEQ ID NO: 938118 - protein, 9 aa, Homo Sapiens
HMGDQIPNT

SEQ ID NO: 938119 - protein, 9 aa, Homo Sapiens
ALLKLSCVK

SEQ ID NO: 938120 - protein, 9 aa, Homo Sapiens
LFITTKKGF

SEQ ID NO: 938121 - protein, 9 aa, Homo Sapiens
ISAENIYIT

SEQ ID NO: 938122 - protein, 9 aa, Homo Sapiens
CINLTLCFS

SEQ ID NO: 938123 - protein, 9 aa, Homo Sapiens
FTHLSFIDL

SEQ ID NO: 938124 - protein, 9 aa, Homo Sapiens
TIIPVLDAL

SEQ ID NO: 938125 - protein, 9 aa, Homo Sapiens
LPMAWGDSG

SEQ ID NO: 938126 - protein, 9 aa, Homo Sapiens
KCWKRGTSE

SEQ ID NO: 938127 - protein, 9 aa, Homo Sapiens
LFPDVTSNM

SEQ ID NO: 938128 - protein, 9 aa, Homo Sapiens
ITIGEKENI

SEQ ID NO: 938129 - protein, 9 aa, Homo Sapiens
VVTARSKKT

SEQ ID NO: 938130 - protein, 9 aa, Homo Sapiens
FSVQKLEQL

SEQ ID NO: 938131 - protein, 9 aa, Homo Sapiens
PHIEDGKLV

SEQ ID NO: 938132 - protein, 9 aa, Homo Sapiens
PDKGALVTA

SEQ ID NO: 938133 - protein, 9 aa, Homo Sapiens
AKEGNVPQL

SEQ ID NO: 938134 - protein, 9 aa, Homo Sapiens
HGLYEIFTP

SEQ ID NO: 938135 - protein, 9 aa, Homo Sapiens
FPSDFKKAH

SEQ ID NO: 938136 - protein, 9 aa, Homo Sapiens
RAIQVEERL

SEQ ID NO: 938137 - protein, 9 aa, Homo Sapiens
FPDNIELII

SEQ ID NO: 938138 - protein, 9 aa, Homo Sapiens
QKTGTCSPE

SEQ ID NO: 938139 - protein, 9 aa, Homo Sapiens
KSVCHVLGK

SEQ ID NO: 938140 - protein, 9 aa, Homo Sapiens
VAANVIEIG

SEQ ID NO: 938141 - protein, 9 aa, Homo Sapiens
QVLLDKENK

SEQ ID NO: 938142 - protein, 9 aa, Homo Sapiens
KKGKTAFSH

SEQ ID NO: 938143 - protein, 9 aa, Homo Sapiens
VSPVFDNIC

SEQ ID NO: 938144 - protein, 9 aa, Homo Sapiens
AGQQAGPAR

SEQ ID NO: 938145 - protein, 9 aa, Homo Sapiens
KDIFFVINF

SEQ ID NO: 938146 - protein, 9 aa, Homo Sapiens
AASPDKGAL

SEQ ID NO: 938147 - protein, 9 aa, Homo Sapiens
LETQLDLRD

SEQ ID NO: 938148 - protein, 9 aa, Homo Sapiens
NGSGDDAPE

SEQ ID NO: 938149 - protein, 9 aa, Homo Sapiens
PDPARPVPL

SEQ ID NO: 938150 - protein, 9 aa, Homo Sapiens
CVYVQTMLR

SEQ ID NO: 938151 - protein, 9 aa, Homo Sapiens
KEASADMQA

SEQ ID NO: 938152 - protein, 9 aa, Homo Sapiens
FAFGVFGCQ

SEQ ID NO: 938153 - protein, 9 aa, Homo Sapiens
LIKLPSSSS

SEQ ID NO: 938154 - protein, 9 aa, Homo Sapiens
PISDSKIIS

SEQ ID NO: 938155 - protein, 9 aa, Homo Sapiens
HLPGKDVKG

SEQ ID NO: 938156 - protein, 9 aa, Homo Sapiens
FNEAKPIDF

SEQ ID NO: 938157 - protein, 9 aa, Homo Sapiens
MEEELPGEA

SEQ ID NO: 938158 - protein, 9 aa, Homo Sapiens
TSKIDLPMK

SEQ ID NO: 938159 - protein, 9 aa, Homo Sapiens
PAGPKPRAA

SEQ ID NO: 938160 - protein, 9 aa, Homo Sapiens
SLLLIAQLF

SEQ ID NO: 938161 - protein, 9 aa, Homo Sapiens
NDLEKHKCS

SEQ ID NO: 938162 - protein, 9 aa, Homo Sapiens
VSCQECICI

SEQ ID NO: 938163 - protein, 9 aa, Homo Sapiens
LCLRARPPG

SEQ ID NO: 938164 - protein, 9 aa, Homo Sapiens
SGVQSFDEK

SEQ ID NO: 938165 - protein, 9 aa, Homo Sapiens
ERASLIFSL

SEQ ID NO: 938166 - protein, 9 aa, Homo Sapiens
IDHPWTVPT

SEQ ID NO: 938167 - protein, 9 aa, Homo Sapiens
NSLAGGLLT

SEQ ID NO: 938168 - protein, 9 aa, Homo Sapiens
SLVLRNPQP

SEQ ID NO: 938169 - protein, 9 aa, Homo Sapiens
DVCRKNLEI

SEQ ID NO: 938170 - protein, 9 aa, Homo Sapiens
PFPVTDASS

SEQ ID NO: 938171 - protein, 9 aa, Homo Sapiens
DKIYFFFCE

SEQ ID NO: 938172 - protein, 9 aa, Homo Sapiens
CVSYLGMYL

SEQ ID NO: 938173 - protein, 9 aa, Homo Sapiens
VNLCQSWII

SEQ ID NO: 938174 - protein, 9 aa, Homo Sapiens
FLHLLRRLV

SEQ ID NO: 938175 - protein, 9 aa, Homo Sapiens
GKGCGHRLS

SEQ ID NO: 938176 - protein, 9 aa, Homo Sapiens
FRKWARIWE

SEQ ID NO: 938177 - protein, 9 aa, Homo Sapiens
PFSLSPDVC

SEQ ID NO: 938178 - protein, 9 aa, Homo Sapiens
LRFYVWGSP

SEQ ID NO: 938179 - protein, 9 aa, Homo Sapiens
DKLHSELSL

SEQ ID NO: 938180 - protein, 9 aa, Homo Sapiens
FLTTTFRRS

SEQ ID NO: 938181 - protein, 9 aa, Homo Sapiens
SGVFNEPST

SEQ ID NO: 938182 - protein, 9 aa, Homo Sapiens
VKPLVRKLV

SEQ ID NO: 938183 - protein, 9 aa, Homo Sapiens
KLQKQEKTC

SEQ ID NO: 938184 - protein, 9 aa, Homo Sapiens
YFTCRAEEN

SEQ ID NO: 938185 - protein, 9 aa, Homo Sapiens
SKDPKHFKS

SEQ ID NO: 938186 - protein, 9 aa, Homo Sapiens
ERSLTWGEA

SEQ ID NO: 938187 - protein, 9 aa, Homo Sapiens
GALKRVFWK

SEQ ID NO: 938188 - protein, 9 aa, Homo Sapiens
HAYASENNL

SEQ ID NO: 938189 - protein, 9 aa, Homo Sapiens
IYHRKPHGP

SEQ ID NO: 938190 - protein, 9 aa, Homo Sapiens
GLGYSARPS

SEQ ID NO: 938191 - protein, 9 aa, Homo Sapiens
DKQPLTSKK

SEQ ID NO: 938192 - protein, 9 aa, Homo Sapiens
HRAFDREQV

SEQ ID NO: 938193 - protein, 9 aa, Homo Sapiens
EHEGGKFEG

SEQ ID NO: 938194 - protein, 9 aa, Homo Sapiens
GWHEGVPTL

SEQ ID NO: 938195 - protein, 9 aa, Homo Sapiens
KVKEGCPQA

SEQ ID NO: 938196 - protein, 9 aa, Homo Sapiens
EELVGKLAF

SEQ ID NO: 938197 - protein, 9 aa, Homo Sapiens
FSGLKDGAE

SEQ ID NO: 938198 - protein, 9 aa, Homo Sapiens
EHYELYCEM

SEQ ID NO: 938199 - protein, 9 aa, Homo Sapiens
GKSSLGSHQ

SEQ ID NO: 938200 - protein, 9 aa, Homo Sapiens
FSTVALNAS

SEQ ID NO: 938201 - protein, 9 aa, Homo Sapiens
PSKSPSTET

SEQ ID NO: 938202 - protein, 9 aa, Homo Sapiens
PPIKLIDFG

SEQ ID NO: 938203 - protein, 9 aa, Homo Sapiens
TFFYCFAIL

SEQ ID NO: 938204 - protein, 9 aa, Homo Sapiens
KRFFSPHQS

SEQ ID NO: 938205 - protein, 9 aa, Homo Sapiens
HLSTISWGL

SEQ ID NO: 938206 - protein, 9 aa, Homo Sapiens
NCSYADFIK

SEQ ID NO: 938207 - protein, 9 aa, Homo Sapiens
KKCVHYWPT

SEQ ID NO: 938208 - protein, 9 aa, Homo Sapiens
LPKDVDPTS

SEQ ID NO: 938209 - protein, 9 aa, Homo Sapiens
GPPPLPQKL

SEQ ID NO: 938210 - protein, 9 aa, Homo Sapiens
LDFISHSSG

SEQ ID NO: 938211 - protein, 9 aa, Homo Sapiens
KMKSEPDKG

SEQ ID NO: 938212 - protein, 9 aa, Homo Sapiens
SREGLFKET

SEQ ID NO: 938213 - protein, 9 aa, Homo Sapiens
CLEDNRYNW

SEQ ID NO: 938214 - protein, 9 aa, Homo Sapiens
QINKDPDLP

SEQ ID NO: 938215 - protein, 9 aa, Homo Sapiens
VAEPFFSNI

SEQ ID NO: 938216 - protein, 9 aa, Homo Sapiens
SRRKPRLTA

SEQ ID NO: 938217 - protein, 9 aa, Homo Sapiens
VPLNALPSV

SEQ ID NO: 938218 - protein, 9 aa, Homo Sapiens
KHKERCHNY

SEQ ID NO: 938219 - protein, 9 aa, Homo Sapiens
GYKPESIEE

SEQ ID NO: 938220 - protein, 9 aa, Homo Sapiens
QNKYKYKEC

SEQ ID NO: 938221 - protein, 9 aa, Homo Sapiens
GARGSPGDT

SEQ ID NO: 938222 - protein, 9 aa, Homo Sapiens
ENFILKVAY

SEQ ID NO: 938223 - protein, 9 aa, Homo Sapiens
TKRTSLSRE

SEQ ID NO: 938224 - protein, 9 aa, Homo Sapiens
SRREGLICA

SEQ ID NO: 938225 - protein, 9 aa, Homo Sapiens
HGPFCDQNT

SEQ ID NO: 938226 - protein, 9 aa, Homo Sapiens
EVEELLGSG

SEQ ID NO: 938227 - protein, 9 aa, Homo Sapiens
KSSQQWREL

SEQ ID NO: 938228 - protein, 9 aa, Homo Sapiens
SRNSSSTQM

SEQ ID NO: 938229 - protein, 9 aa, Homo Sapiens
ESQFVEEAL

SEQ ID NO: 938230 - protein, 9 aa, Homo Sapiens
IDNSQNIAK

SEQ ID NO: 938231 - protein, 9 aa, Homo Sapiens
QPSLLQSSP

SEQ ID NO: 938232 - protein, 9 aa, Homo Sapiens
KIKVLEQDM

SEQ ID NO: 938233 - protein, 9 aa, Homo Sapiens
HFETASSTG

SEQ ID NO: 938234 - protein, 9 aa, Homo Sapiens
KRDAHSLFW

SEQ ID NO: 938235 - protein, 9 aa, Homo Sapiens
CLLVIGIWV

SEQ ID NO: 938236 - protein, 9 aa, Homo Sapiens
KFLRTSCGS

SEQ ID NO: 938237 - protein, 9 aa, Homo Sapiens
LSTVPLAVF

SEQ ID NO: 938238 - protein, 9 aa, Homo Sapiens
ESPEKKEER

SEQ ID NO: 938239 - protein, 9 aa, Homo Sapiens
YRLVIHRAF

SEQ ID NO: 938240 - protein, 9 aa, Homo Sapiens
YGHCPNGVT

SEQ ID NO: 938241 - protein, 9 aa, Homo Sapiens
LLAYCAIQG

SEQ ID NO: 938242 - protein, 9 aa, Homo Sapiens
QKLLGQFFE

SEQ ID NO: 938243 - protein, 9 aa, Homo Sapiens
LMHPCFCHL

SEQ ID NO: 938244 - protein, 9 aa, Homo Sapiens
VFLVELYEN

SEQ ID NO: 938245 - protein, 9 aa, Homo Sapiens
AFHLSVVSL

SEQ ID NO: 938246 - protein, 9 aa, Homo Sapiens
SPFPPRLTE

SEQ ID NO: 938247 - protein, 9 aa, Homo Sapiens
PALPTKREV

SEQ ID NO: 938248 - protein, 9 aa, Homo Sapiens
LEDESKFLK

SEQ ID NO: 938249 - protein, 9 aa, Homo Sapiens
NASLKKSRK

SEQ ID NO: 938250 - protein, 9 aa, Homo Sapiens
CGRGRKPSA

SEQ ID NO: 938251 - protein, 9 aa, Homo Sapiens
NDEDLVDQR

SEQ ID NO: 938252 - protein, 9 aa, Homo Sapiens
GAKACGRGR

SEQ ID NO: 938253 - protein, 9 aa, Homo Sapiens
AWGGNYWRL

SEQ ID NO: 938254 - protein, 9 aa, Homo Sapiens
GGSLLGAAC

SEQ ID NO: 938255 - protein, 9 aa, Homo Sapiens
FTRVDHINF

SEQ ID NO: 938256 - protein, 9 aa, Homo Sapiens
KPDAFNLCE

SEQ ID NO: 938257 - protein, 9 aa, Homo Sapiens
RGSQQYWAL

SEQ ID NO: 938258 - protein, 9 aa, Homo Sapiens
GLKDGAETA

SEQ ID NO: 938259 - protein, 9 aa, Homo Sapiens
PANFITWCL

SEQ ID NO: 938260 - protein, 9 aa, Homo Sapiens
NTPSLITHS

SEQ ID NO: 938261 - protein, 9 aa, Homo Sapiens
FIPTSPTRV

SEQ ID NO: 938262 - protein, 9 aa, Homo Sapiens
TGHCSCALG

SEQ ID NO: 938263 - protein, 9 aa, Homo Sapiens
GILGRKEAR

SEQ ID NO: 938264 - protein, 9 aa, Homo Sapiens
FYVWGSPWV

SEQ ID NO: 938265 - protein, 9 aa, Homo Sapiens
FCMTESHLL

SEQ ID NO: 938266 - protein, 9 aa, Homo Sapiens
LPQAPAFFL

SEQ ID NO: 938267 - protein, 9 aa, Homo Sapiens
VRNTTGLTT

SEQ ID NO: 938268 - protein, 9 aa, Homo Sapiens
QNIERSSGN

SEQ ID NO: 938269 - protein, 9 aa, Homo Sapiens
TEKLDSNTL

SEQ ID NO: 938270 - protein, 9 aa, Homo Sapiens
PMDFQCDRL

SEQ ID NO: 938271 - protein, 9 aa, Homo Sapiens
NVPILSADI

SEQ ID NO: 938272 - protein, 9 aa, Homo Sapiens
TLRALRPLC

SEQ ID NO: 938273 - protein, 9 aa, Homo Sapiens
IGHAGTCLR

SEQ ID NO: 938274 - protein, 9 aa, Homo Sapiens
NKFIAAQGL

SEQ ID NO: 938275 - protein, 9 aa, Homo Sapiens
HEFENAESL

SEQ ID NO: 938276 - protein, 9 aa, Homo Sapiens
RNPCFHPGY

SEQ ID NO: 938277 - protein, 9 aa, Homo Sapiens
RDSKEIEWD

SEQ ID NO: 938278 - protein, 9 aa, Homo Sapiens
STGTLSQGH

SEQ ID NO: 938279 - protein, 9 aa, Homo Sapiens
RELLLGAFS

SEQ ID NO: 938280 - protein, 9 aa, Homo Sapiens
WVTDSRFLI

SEQ ID NO: 938281 - protein, 9 aa, Homo Sapiens
PEFPGNGSF

SEQ ID NO: 938282 - protein, 9 aa, Homo Sapiens
EQSNPNYDK

SEQ ID NO: 938283 - protein, 9 aa, Homo Sapiens
LDLCYILVT

SEQ ID NO: 938284 - protein, 9 aa, Homo Sapiens
ENPMEVFKE

SEQ ID NO: 938285 - protein, 9 aa, Homo Sapiens
KLKRFYSSP

SEQ ID NO: 938286 - protein, 9 aa, Homo Sapiens
VFQEKTVTL

SEQ ID NO: 938287 - protein, 9 aa, Homo Sapiens
PSAVLGSNV

SEQ ID NO: 938288 - protein, 9 aa, Homo Sapiens
GMSLEVPSD

SEQ ID NO: 938289 - protein, 9 aa, Homo Sapiens
QDLKEKFLI

SEQ ID NO: 938290 - protein, 9 aa, Homo Sapiens
KNSEGILLT

SEQ ID NO: 938291 - protein, 9 aa, Homo Sapiens
FLGDIKRLM

SEQ ID NO: 938292 - protein, 9 aa, Homo Sapiens
RLELKKLLH

SEQ ID NO: 938293 - protein, 9 aa, Homo Sapiens
SSSHQGWEI

SEQ ID NO: 938294 - protein, 9 aa, Homo Sapiens
EYNWATVGE

SEQ ID NO: 938295 - protein, 9 aa, Homo Sapiens
LAALHEPPP

SEQ ID NO: 938296 - protein, 9 aa, Homo Sapiens
IEEHAPPSW

SEQ ID NO: 938297 - protein, 9 aa, Homo Sapiens
LPLWLPFVF

SEQ ID NO: 938298 - protein, 9 aa, Homo Sapiens
VLGFAVSFS

SEQ ID NO: 938299 - protein, 9 aa, Homo Sapiens
NLKGSPSRS

SEQ ID NO: 938300 - protein, 9 aa, Homo Sapiens
IASEKEINP

SEQ ID NO: 938301 - protein, 9 aa, Homo Sapiens
ESFLSNKWK

SEQ ID NO: 938302 - protein, 9 aa, Homo Sapiens
EKLDSNTLE

SEQ ID NO: 938303 - protein, 9 aa, Homo Sapiens
LDCRQITCP

SEQ ID NO: 938304 - protein, 9 aa, Homo Sapiens
SSVENSRHN

SEQ ID NO: 938305 - protein, 9 aa, Homo Sapiens
CEIMVVLKL

SEQ ID NO: 938306 - protein, 9 aa, Homo Sapiens
GTSLGIVLI

SEQ ID NO: 938307 - protein, 9 aa, Homo Sapiens
NPMPCGSGR

SEQ ID NO: 938308 - protein, 9 aa, Homo Sapiens
FCTTLFGDT

SEQ ID NO: 938309 - protein, 9 aa, Homo Sapiens
FACPNCFFL

SEQ ID NO: 938310 - protein, 9 aa, Homo Sapiens
QGNLPLHQE

SEQ ID NO: 938311 - protein, 9 aa, Homo Sapiens
FLMAAFILI

SEQ ID NO: 938312 - protein, 9 aa, Homo Sapiens
VGIEGGAQK

SEQ ID NO: 938313 - protein, 9 aa, Homo Sapiens
SYLLHGSNE

SEQ ID NO: 938314 - protein, 9 aa, Homo Sapiens
IDFLCSNPK

SEQ ID NO: 938315 - protein, 9 aa, Homo Sapiens
RGPQEPPGL

SEQ ID NO: 938316 - protein, 9 aa, Homo Sapiens
VKVSLLLFL

SEQ ID NO: 938317 - protein, 9 aa, Homo Sapiens
GSDSFATDP

SEQ ID NO: 938318 - protein, 9 aa, Homo Sapiens
EKREARTVP

SEQ ID NO: 938319 - protein, 9 aa, Homo Sapiens
NLHWGPWER

SEQ ID NO: 938320 - protein, 9 aa, Homo Sapiens
LLIRDVLQK

SEQ ID NO: 938321 - protein, 9 aa, Homo Sapiens
SLKWNNITK

SEQ ID NO: 938322 - protein, 9 aa, Homo Sapiens
SVRSGLGTD

SEQ ID NO: 938323 - protein, 9 aa, Homo Sapiens
AEEAEISHL

SEQ ID NO: 938324 - protein, 9 aa, Homo Sapiens
DLKTDVADD

SEQ ID NO: 938325 - protein, 9 aa, Homo Sapiens
ATVHELIVS

SEQ ID NO: 938326 - protein, 9 aa, Homo Sapiens
QLENFILKV

SEQ ID NO: 938327 - protein, 9 aa, Homo Sapiens
VEGNYMVYR

SEQ ID NO: 938328 - protein, 9 aa, Homo Sapiens
SPHILRKVS

SEQ ID NO: 938329 - protein, 9 aa, Homo Sapiens
KAQEALICT

SEQ ID NO: 938330 - protein, 9 aa, Homo Sapiens
DTVTLEAKN

SEQ ID NO: 938331 - protein, 9 aa, Homo Sapiens
KGKPALFSR

SEQ ID NO: 938332 - protein, 9 aa, Homo Sapiens
PEVVGQSRG

SEQ ID NO: 938333 - protein, 9 aa, Homo Sapiens
SVSGCNIII

SEQ ID NO: 938334 - protein, 9 aa, Homo Sapiens
DVWILVEME

SEQ ID NO: 938335 - protein, 9 aa, Homo Sapiens
ARKSQLQRK

SEQ ID NO: 938336 - protein, 9 aa, Homo Sapiens
SPRSPEWMD

SEQ ID NO: 938337 - protein, 9 aa, Homo Sapiens
FQGKLKPQA

SEQ ID NO: 938338 - protein, 9 aa, Homo Sapiens
TGKKPYQCE

SEQ ID NO: 938339 - protein, 9 aa, Homo Sapiens
KDQFRVNRF

SEQ ID NO: 938340 - protein, 9 aa, Homo Sapiens
RILRLLQTY

SEQ ID NO: 938341 - protein, 9 aa, Homo Sapiens
DGHSMTLDW

SEQ ID NO: 938342 - protein, 9 aa, Homo Sapiens
SEDKMKASE

SEQ ID NO: 938343 - protein, 9 aa, Homo Sapiens
FVMEVGEAA

SEQ ID NO: 938344 - protein, 9 aa, Homo Sapiens
NEKLRSQLA

SEQ ID NO: 938345 - protein, 9 aa, Homo Sapiens
EQLNTWNFS

SEQ ID NO: 938346 - protein, 9 aa, Homo Sapiens
TQKFYLKCH

SEQ ID NO: 938347 - protein, 9 aa, Homo Sapiens
QGGRPFLIA

SEQ ID NO: 938348 - protein, 9 aa, Homo Sapiens
VNGYRRFDS

SEQ ID NO: 938349 - protein, 9 aa, Homo Sapiens
MSWQQKTNP

SEQ ID NO: 938350 - protein, 9 aa, Homo Sapiens
EPEVVGQSR

SEQ ID NO: 938351 - protein, 9 aa, Homo Sapiens
LQMVLKCAD

SEQ ID NO: 938352 - protein, 9 aa, Homo Sapiens
LISYSYIVS

SEQ ID NO: 938353 - protein, 9 aa, Homo Sapiens
NYFEGYSLE

SEQ ID NO: 938354 - protein, 9 aa, Homo Sapiens
TNSSLTDLM

SEQ ID NO: 938355 - protein, 9 aa, Homo Sapiens
PLTLLIAFL

SEQ ID NO: 938356 - protein, 9 aa, Homo Sapiens
SGSSHSFQG

SEQ ID NO: 938357 - protein, 9 aa, Homo Sapiens
TGISQSWIS

SEQ ID NO: 938358 - protein, 9 aa, Homo Sapiens
PAHLFRHLR

SEQ ID NO: 938359 - protein, 9 aa, Homo Sapiens
SGAGQRLRK

SEQ ID NO: 938360 - protein, 9 aa, Homo Sapiens
VLEQDMARL

SEQ ID NO: 938361 - protein, 9 aa, Homo Sapiens
QLKSDTIAD

SEQ ID NO: 938362 - protein, 9 aa, Homo Sapiens
NPGPLGEAG

SEQ ID NO: 938363 - protein, 9 aa, Homo Sapiens
KIWVYGVLG

SEQ ID NO: 938364 - protein, 9 aa, Homo Sapiens
PGPLGSPGL

SEQ ID NO: 938365 - protein, 9 aa, Homo Sapiens
ILKVAYIPD

SEQ ID NO: 938366 - protein, 9 aa, Homo Sapiens
DSVYYDALQ

SEQ ID NO: 938367 - protein, 9 aa, Homo Sapiens
LFVSAKGNG

SEQ ID NO: 938368 - protein, 9 aa, Homo Sapiens
LENLHWGPW

SEQ ID NO: 938369 - protein, 9 aa, Homo Sapiens
YRFFYEDVT

SEQ ID NO: 938370 - protein, 9 aa, Homo Sapiens
DFSLSIYGQ

SEQ ID NO: 938371 - protein, 9 aa, Homo Sapiens
CGFVKEMRE

SEQ ID NO: 938372 - protein, 9 aa, Homo Sapiens
DENLDVQRE

SEQ ID NO: 938373 - protein, 9 aa, Homo Sapiens
LYSPVHCRL

SEQ ID NO: 938374 - protein, 9 aa, Homo Sapiens
PYKVKVGVY

SEQ ID NO: 938375 - protein, 9 aa, Homo Sapiens
KTEGCRSDS

SEQ ID NO: 938376 - protein, 9 aa, Homo Sapiens
SFDEKEGEA

SEQ ID NO: 938377 - protein, 9 aa, Homo Sapiens
QDELCPPSD

SEQ ID NO: 938378 - protein, 9 aa, Homo Sapiens
RIKGFPSPR

SEQ ID NO: 938379 - protein, 9 aa, Homo Sapiens
PCFCHLLAV

SEQ ID NO: 938380 - protein, 9 aa, Homo Sapiens
KKKQKPKKS

SEQ ID NO: 938381 - protein, 9 aa, Homo Sapiens
NTAGDHKKK

SEQ ID NO: 938382 - protein, 9 aa, Homo Sapiens
FKGDKTEGC

SEQ ID NO: 938383 - protein, 9 aa, Homo Sapiens
PPPPDNPSI

SEQ ID NO: 938384 - protein, 9 aa, Homo Sapiens
IERFTRSLF

SEQ ID NO: 938385 - protein, 9 aa, Homo Sapiens
IFNNFDWLF

SEQ ID NO: 938386 - protein, 9 aa, Homo Sapiens
PWGVYSANL

SEQ ID NO: 938387 - protein, 9 aa, Homo Sapiens
SQKGLNSGT

SEQ ID NO: 938388 - protein, 9 aa, Homo Sapiens
LEKQVFSFW

SEQ ID NO: 938389 - protein, 9 aa, Homo Sapiens
SSESKQEED

SEQ ID NO: 938390 - protein, 9 aa, Homo Sapiens
GDTVELLKR

SEQ ID NO: 938391 - protein, 9 aa, Homo Sapiens
TLNHLPAQV

SEQ ID NO: 938392 - protein, 9 aa, Homo Sapiens
TSPLPRGDA

SEQ ID NO: 938393 - protein, 9 aa, Homo Sapiens
YETFSDDLS

SEQ ID NO: 938394 - protein, 9 aa, Homo Sapiens
GGLADLSFG

SEQ ID NO: 938395 - protein, 9 aa, Homo Sapiens
NEEENTHAR

SEQ ID NO: 938396 - protein, 9 aa, Homo Sapiens
REQKGELQA

SEQ ID NO: 938397 - protein, 9 aa, Homo Sapiens
SPGGCSPLS

SEQ ID NO: 938398 - protein, 9 aa, Homo Sapiens
LQSSPCPSF

SEQ ID NO: 938399 - protein, 9 aa, Homo Sapiens
PPGFPGSPR

SEQ ID NO: 938400 - protein, 9 aa, Homo Sapiens
DKQDALISI

SEQ ID NO: 938401 - protein, 9 aa, Homo Sapiens
ASKYEEIYS

SEQ ID NO: 938402 - protein, 9 aa, Homo Sapiens
SCALGWTGF

SEQ ID NO: 938403 - protein, 9 aa, Homo Sapiens
QTLVHLINP

SEQ ID NO: 938404 - protein, 9 aa, Homo Sapiens
IDKNWYEGM

SEQ ID NO: 938405 - protein, 9 aa, Homo Sapiens
LLKRTSRPA

SEQ ID NO: 938406 - protein, 9 aa, Homo Sapiens
CGNVELVET

SEQ ID NO: 938407 - protein, 9 aa, Homo Sapiens
NTINGTQNY

SEQ ID NO: 938408 - protein, 9 aa, Homo Sapiens
ERAQEVMRR

SEQ ID NO: 938409 - protein, 9 aa, Homo Sapiens
VEEQCHLLN

SEQ ID NO: 938410 - protein, 9 aa, Homo Sapiens
TQIMFKTFN

SEQ ID NO: 938411 - protein, 9 aa, Homo Sapiens
SQLNASDWL

SEQ ID NO: 938412 - protein, 9 aa, Homo Sapiens
FTILVSNAS

SEQ ID NO: 938413 - protein, 9 aa, Homo Sapiens
KETVSRNKR

SEQ ID NO: 938414 - protein, 9 aa, Homo Sapiens
IKDDLEDLK

SEQ ID NO: 938415 - protein, 9 aa, Homo Sapiens
QKETRDRFH

SEQ ID NO: 938416 - protein, 9 aa, Homo Sapiens
EMKAIALKG

SEQ ID NO: 938417 - protein, 9 aa, Homo Sapiens
VGYSWLSLL

SEQ ID NO: 938418 - protein, 9 aa, Homo Sapiens
QKSQHGSAT

SEQ ID NO: 938419 - protein, 9 aa, Homo Sapiens
TEDSAQVLI

SEQ ID NO: 938420 - protein, 9 aa, Homo Sapiens
SRNAWREDV

SEQ ID NO: 938421 - protein, 9 aa, Homo Sapiens
APPKKPETP

SEQ ID NO: 938422 - protein, 9 aa, Homo Sapiens
QGGGHSNKV

SEQ ID NO: 938423 - protein, 9 aa, Homo Sapiens
TNQAAGQEK

SEQ ID NO: 938424 - protein, 9 aa, Homo Sapiens
EYTFAFPFL

SEQ ID NO: 938425 - protein, 9 aa, Homo Sapiens
SRRVCFRGE

SEQ ID NO: 938426 - protein, 9 aa, Homo Sapiens
RGIQRITGP

SEQ ID NO: 938427 - protein, 9 aa, Homo Sapiens
KLAFVMEPR

SEQ ID NO: 938428 - protein, 9 aa, Homo Sapiens
DTLLASFIP

SEQ ID NO: 938429 - protein, 9 aa, Homo Sapiens
SPLHLSTLS

SEQ ID NO: 938430 - protein, 9 aa, Homo Sapiens
AERRTSKAQ

SEQ ID NO: 938431 - protein, 9 aa, Homo Sapiens
YNKELNIKL

SEQ ID NO: 938432 - protein, 9 aa, Homo Sapiens
SPSGSALAA

SEQ ID NO: 938433 - protein, 9 aa, Homo Sapiens
CPGQAKFIA

SEQ ID NO: 938434 - protein, 9 aa, Homo Sapiens
YQDFFTEIP

SEQ ID NO: 938435 - protein, 9 aa, Homo Sapiens
AKFFARIKK

SEQ ID NO: 938436 - protein, 9 aa, Homo Sapiens
TLLIAFLSS

SEQ ID NO: 938437 - protein, 9 aa, Homo Sapiens
KLVQVDYMK

SEQ ID NO: 938438 - protein, 9 aa, Homo Sapiens
ATKVFIQRN

SEQ ID NO: 938439 - protein, 9 aa, Homo Sapiens
LYQELKIEE

SEQ ID NO: 938440 - protein, 9 aa, Homo Sapiens
TVIRGPGPS

SEQ ID NO: 938441 - protein, 9 aa, Homo Sapiens
AGLQLVSKW

SEQ ID NO: 938442 - protein, 9 aa, Homo Sapiens
VVASLVRAQ

SEQ ID NO: 938443 - protein, 9 aa, Homo Sapiens
AFRGKSSPV

SEQ ID NO: 938444 - protein, 9 aa, Homo Sapiens
RMETAKKEK

SEQ ID NO: 938445 - protein, 9 aa, Homo Sapiens
KHHKKCEEL

SEQ ID NO: 938446 - protein, 9 aa, Homo Sapiens
FRIGYQQLF

SEQ ID NO: 938447 - protein, 9 aa, Homo Sapiens
TSHLTGLLS

SEQ ID NO: 938448 - protein, 9 aa, Homo Sapiens
EMNLNAGRF

SEQ ID NO: 938449 - protein, 9 aa, Homo Sapiens
DKDVRQKLK

SEQ ID NO: 938450 - protein, 9 aa, Homo Sapiens
TAPTSPLCE

SEQ ID NO: 938451 - protein, 9 aa, Homo Sapiens
SPPNIPIKF

SEQ ID NO: 938452 - protein, 9 aa, Homo Sapiens
ERHRTIHGQ

SEQ ID NO: 938453 - protein, 9 aa, Homo Sapiens
EILRNPCFH

SEQ ID NO: 938454 - protein, 9 aa, Homo Sapiens
AGQRLRKDV

SEQ ID NO: 938455 - protein, 9 aa, Homo Sapiens
VLTLAYSAS

SEQ ID NO: 938456 - protein, 9 aa, Homo Sapiens
GWSSYLDTL

SEQ ID NO: 938457 - protein, 9 aa, Homo Sapiens
NEWPAKALK

SEQ ID NO: 938458 - protein, 9 aa, Homo Sapiens
IHLRGKGRA

SEQ ID NO: 938459 - protein, 9 aa, Homo Sapiens
MRRNRFKWW

SEQ ID NO: 938460 - protein, 9 aa, Homo Sapiens
TKEPSMIEY

SEQ ID NO: 938461 - protein, 9 aa, Homo Sapiens
VTCNQLLMY

SEQ ID NO: 938462 - protein, 9 aa, Homo Sapiens
PELIKEEKQ

SEQ ID NO: 938463 - protein, 9 aa, Homo Sapiens
TSSTRHSFF

SEQ ID NO: 938464 - protein, 9 aa, Homo Sapiens
KLSLSTSIL

SEQ ID NO: 938465 - protein, 9 aa, Homo Sapiens
VTILALCFP

SEQ ID NO: 938466 - protein, 9 aa, Homo Sapiens
PGFPGSPRP

SEQ ID NO: 938467 - protein, 9 aa, Homo Sapiens
YDSKSSQQW

SEQ ID NO: 938468 - protein, 9 aa, Homo Sapiens
MLCSKCVHR

SEQ ID NO: 938469 - protein, 9 aa, Homo Sapiens
PRSAEYFMQ

SEQ ID NO: 938470 - protein, 9 aa, Homo Sapiens
TCEENSVSY

SEQ ID NO: 938471 - protein, 9 aa, Homo Sapiens
RNFYFLSKL

SEQ ID NO: 938472 - protein, 9 aa, Homo Sapiens
PLPQKLLET

SEQ ID NO: 938473 - protein, 9 aa, Homo Sapiens
RNRDRYFKG

SEQ ID NO: 938474 - protein, 9 aa, Homo Sapiens
AEENPKPEI

SEQ ID NO: 938475 - protein, 9 aa, Homo Sapiens
NVTFGMVVC

SEQ ID NO: 938476 - protein, 9 aa, Homo Sapiens
QKLSSYNGE

SEQ ID NO: 938477 - protein, 9 aa, Homo Sapiens
LADNNTDVC

SEQ ID NO: 938478 - protein, 9 aa, Homo Sapiens
AYKNQKKIR

SEQ ID NO: 938479 - protein, 9 aa, Homo Sapiens
YLNLTQGTA

SEQ ID NO: 938480 - protein, 9 aa, Homo Sapiens
VPSELIFAV

SEQ ID NO: 938481 - protein, 9 aa, Homo Sapiens
PTPEGFTIL

SEQ ID NO: 938482 - protein, 9 aa, Homo Sapiens
VSGGVVQAA

SEQ ID NO: 938483 - protein, 9 aa, Homo Sapiens
VENSRHNSP

SEQ ID NO: 938484 - protein, 9 aa, Homo Sapiens
QSRRAQAKP

SEQ ID NO: 938485 - protein, 9 aa, Homo Sapiens
LSQPGLQMP

SEQ ID NO: 938486 - protein, 9 aa, Homo Sapiens
YRSPFASRY

SEQ ID NO: 938487 - protein, 9 aa, Homo Sapiens
DGVLHIDTQ

SEQ ID NO: 938488 - protein, 9 aa, Homo Sapiens
TDSRFLIGF

SEQ ID NO: 938489 - protein, 9 aa, Homo Sapiens
DGFKGDKTE

SEQ ID NO: 938490 - protein, 9 aa, Homo Sapiens
HQVNYTFDR

SEQ ID NO: 938491 - protein, 9 aa, Homo Sapiens
TLVPSELIF

SEQ ID NO: 938492 - protein, 9 aa, Homo Sapiens
MYGKVCKAA

SEQ ID NO: 938493 - protein, 9 aa, Homo Sapiens
GRVVEGNYM

SEQ ID NO: 938494 - protein, 9 aa, Homo Sapiens
PTKGSVYGM

SEQ ID NO: 938495 - protein, 9 aa, Homo Sapiens
ISFVNEISW

SEQ ID NO: 938496 - protein, 9 aa, Homo Sapiens
SLHAEPLES

SEQ ID NO: 938497 - protein, 9 aa, Homo Sapiens
QKAVEEAEC

SEQ ID NO: 938498 - protein, 9 aa, Homo Sapiens
ERVYEMYVT

SEQ ID NO: 938499 - protein, 9 aa, Homo Sapiens
PRIDTAPVV

SEQ ID NO: 938500 - protein, 9 aa, Homo Sapiens
VDRVVAIFY

SEQ ID NO: 938501 - protein, 9 aa, Homo Sapiens
CIVSGWGQE

SEQ ID NO: 938502 - protein, 9 aa, Homo Sapiens
PTMTLLPLW

SEQ ID NO: 938503 - protein, 9 aa, Homo Sapiens
QWFQDLKKC

SEQ ID NO: 938504 - protein, 9 aa, Homo Sapiens
RAGGPSPGG

SEQ ID NO: 938505 - protein, 9 aa, Homo Sapiens
YRPHKVSSY

SEQ ID NO: 938506 - protein, 9 aa, Homo Sapiens
RASSSASLL

SEQ ID NO: 938507 - protein, 9 aa, Homo Sapiens
RGSPSRIWG

SEQ ID NO: 938508 - protein, 9 aa, Homo Sapiens
VQVKGTNKL

SEQ ID NO: 938509 - protein, 9 aa, Homo Sapiens
QLNRIAKMN

SEQ ID NO: 938510 - protein, 9 aa, Homo Sapiens
ELVGKLAFV

SEQ ID NO: 938511 - protein, 9 aa, Homo Sapiens
KSQSGVSKR

SEQ ID NO: 938512 - protein, 9 aa, Homo Sapiens
NTLEGVPSA

SEQ ID NO: 938513 - protein, 9 aa, Homo Sapiens
ALNRDFRIG

SEQ ID NO: 938514 - protein, 9 aa, Homo Sapiens
QPVCFDFCC

SEQ ID NO: 938515 - protein, 9 aa, Homo Sapiens
PKKFSFSEF

SEQ ID NO: 938516 - protein, 9 aa, Homo Sapiens
SDKASEETL

SEQ ID NO: 938517 - protein, 9 aa, Homo Sapiens
KERTQFFSK

SEQ ID NO: 938518 - protein, 9 aa, Homo Sapiens
SSIGGMVLS

SEQ ID NO: 938519 - protein, 9 aa, Homo Sapiens
KSPYNVACC

SEQ ID NO: 938520 - protein, 9 aa, Homo Sapiens
AAVSTGPFL

SEQ ID NO: 938521 - protein, 9 aa, Homo Sapiens
LKRGDDSVP

SEQ ID NO: 938522 - protein, 9 aa, Homo Sapiens
LEQECVEET

SEQ ID NO: 938523 - protein, 9 aa, Homo Sapiens
AGREVLTNL

SEQ ID NO: 938524 - protein, 9 aa, Homo Sapiens
HCINCVHLY

SEQ ID NO: 938525 - protein, 9 aa, Homo Sapiens
STTIAMRGS

SEQ ID NO: 938526 - protein, 9 aa, Homo Sapiens
IPNDAEELF

SEQ ID NO: 938527 - protein, 9 aa, Homo Sapiens
NGQVSEMGP

SEQ ID NO: 938528 - protein, 9 aa, Homo Sapiens
MRGPQEPPG

SEQ ID NO: 938529 - protein, 9 aa, Homo Sapiens
ARKKHHKKC

SEQ ID NO: 938530 - protein, 9 aa, Homo Sapiens
TYFSEGMSE

SEQ ID NO: 938531 - protein, 9 aa, Homo Sapiens
GIVKIRLEQ

SEQ ID NO: 938532 - protein, 9 aa, Homo Sapiens
EKQKPVFAD

SEQ ID NO: 938533 - protein, 9 aa, Homo Sapiens
IVQTLVHLI

SEQ ID NO: 938534 - protein, 9 aa, Homo Sapiens
FIERPKKEY

SEQ ID NO: 938535 - protein, 9 aa, Homo Sapiens
EEFETFFKK

SEQ ID NO: 938536 - protein, 9 aa, Homo Sapiens
LDNQVALLR

SEQ ID NO: 938537 - protein, 9 aa, Homo Sapiens
RRKPRLTAS

SEQ ID NO: 938538 - protein, 9 aa, Homo Sapiens
DHKADFRTL

SEQ ID NO: 938539 - protein, 9 aa, Homo Sapiens
AQPEFNVYL

SEQ ID NO: 938540 - protein, 9 aa, Homo Sapiens
DKDSKQNIF

SEQ ID NO: 938541 - protein, 9 aa, Homo Sapiens
HCCAYKNQK

SEQ ID NO: 938542 - protein, 9 aa, Homo Sapiens
TLFGDTSDT

SEQ ID NO: 938543 - protein, 9 aa, Homo Sapiens
GVEELVGKL

SEQ ID NO: 938544 - protein, 9 aa, Homo Sapiens
FPGINGFPG

SEQ ID NO: 938545 - protein, 9 aa, Homo Sapiens
PHPSSALRS

SEQ ID NO: 938546 - protein, 9 aa, Homo Sapiens
ISLDSHTFQ

SEQ ID NO: 938547 - protein, 9 aa, Homo Sapiens
SEEKRDPNK

SEQ ID NO: 938548 - protein, 9 aa, Homo Sapiens
IIYIKEAHP

SEQ ID NO: 938549 - protein, 9 aa, Homo Sapiens
GGSREGLFK

SEQ ID NO: 938550 - protein, 9 aa, Homo Sapiens
SVQVKGTNK

SEQ ID NO: 938551 - protein, 9 aa, Homo Sapiens
IVQPNSSVL

SEQ ID NO: 938552 - protein, 9 aa, Homo Sapiens
DDMRCKENE

SEQ ID NO: 938553 - protein, 9 aa, Homo Sapiens
RPSPDDNEQ

SEQ ID NO: 938554 - protein, 9 aa, Homo Sapiens
GSKHKVCMN

SEQ ID NO: 938555 - protein, 9 aa, Homo Sapiens
QDIEACIAL

SEQ ID NO: 938556 - protein, 9 aa, Homo Sapiens
RARVQRHFE

SEQ ID NO: 938557 - protein, 9 aa, Homo Sapiens
EMKKTKGQQ

SEQ ID NO: 938558 - protein, 9 aa, Homo Sapiens
ADSQDQQAG

SEQ ID NO: 938559 - protein, 9 aa, Homo Sapiens
LLKIMDAKH

SEQ ID NO: 938560 - protein, 9 aa, Homo Sapiens
GLMMRPGLP

SEQ ID NO: 938561 - protein, 9 aa, Homo Sapiens
NEQRHNGLL

SEQ ID NO: 938562 - protein, 9 aa, Homo Sapiens
VVTTVWRVT

SEQ ID NO: 938563 - protein, 9 aa, Homo Sapiens
SSTLCPLCR

SEQ ID NO: 938564 - protein, 9 aa, Homo Sapiens
DERSKETPE

SEQ ID NO: 938565 - protein, 9 aa, Homo Sapiens
TLMNLVQET

SEQ ID NO: 938566 - protein, 9 aa, Homo Sapiens
KEFLLGFIL

SEQ ID NO: 938567 - protein, 9 aa, Homo Sapiens
PGPSPRPGP

SEQ ID NO: 938568 - protein, 9 aa, Homo Sapiens
ALDANEAAL

SEQ ID NO: 938569 - protein, 9 aa, Homo Sapiens
NLVQETREE

SEQ ID NO: 938570 - protein, 9 aa, Homo Sapiens
QPRLPPSRR

SEQ ID NO: 938571 - protein, 9 aa, Homo Sapiens
KKCEELLEQ

SEQ ID NO: 938572 - protein, 9 aa, Homo Sapiens
LQYGRIITS

SEQ ID NO: 938573 - protein, 9 aa, Homo Sapiens
QNALPSVQP

SEQ ID NO: 938574 - protein, 9 aa, Homo Sapiens
ANRKIVYSF

SEQ ID NO: 938575 - protein, 9 aa, Homo Sapiens
LVNAVYFKE

SEQ ID NO: 938576 - protein, 9 aa, Homo Sapiens
LFGDTSDTG

SEQ ID NO: 938577 - protein, 9 aa, Homo Sapiens
NITEENPME

SEQ ID NO: 938578 - protein, 9 aa, Homo Sapiens
HRHTLTSRI

SEQ ID NO: 938579 - protein, 9 aa, Homo Sapiens
SATPEPEAR

SEQ ID NO: 938580 - protein, 9 aa, Homo Sapiens
DWNPSLFRY

SEQ ID NO: 938581 - protein, 9 aa, Homo Sapiens
TRLPDRPAG

SEQ ID NO: 938582 - protein, 9 aa, Homo Sapiens
LADLVVRIQ

SEQ ID NO: 938583 - protein, 9 aa, Homo Sapiens
DNLEKRTEE

SEQ ID NO: 938584 - protein, 9 aa, Homo Sapiens
PDRVFNTLE

SEQ ID NO: 938585 - protein, 9 aa, Homo Sapiens
SYSYIVSAV

SEQ ID NO: 938586 - protein, 9 aa, Homo Sapiens
SGTLNILVR

SEQ ID NO: 938587 - protein, 9 aa, Homo Sapiens
AVRGSDVSV

SEQ ID NO: 938588 - protein, 9 aa, Homo Sapiens
AFDREQVSS

SEQ ID NO: 938589 - protein, 9 aa, Homo Sapiens
LWDGLDSGK

SEQ ID NO: 938590 - protein, 9 aa, Homo Sapiens
EREFKPLCG

SEQ ID NO: 938591 - protein, 9 aa, Homo Sapiens
YLRTHEFSP

SEQ ID NO: 938592 - protein, 9 aa, Homo Sapiens
EISVTSNLE

SEQ ID NO: 938593 - protein, 9 aa, Homo Sapiens
KNNDRCGCC

SEQ ID NO: 938594 - protein, 9 aa, Homo Sapiens
PLDNQVALL

SEQ ID NO: 938595 - protein, 9 aa, Homo Sapiens
KALKKTLLL

SEQ ID NO: 938596 - protein, 9 aa, Homo Sapiens
GNSASVSLP

SEQ ID NO: 938597 - protein, 9 aa, Homo Sapiens
LESRVSHLC

SEQ ID NO: 938598 - protein, 9 aa, Homo Sapiens
KFFARIKKW

SEQ ID NO: 938599 - protein, 9 aa, Homo Sapiens
SQLKLYTNR

SEQ ID NO: 938600 - protein, 9 aa, Homo Sapiens
LDQILQNIE

SEQ ID NO: 938601 - protein, 9 aa, Homo Sapiens
YYYNSFTCK

SEQ ID NO: 938602 - protein, 9 aa, Homo Sapiens
LPSNITLGV

SEQ ID NO: 938603 - protein, 9 aa, Homo Sapiens
ALSHCFQLT

SEQ ID NO: 938604 - protein, 9 aa, Homo Sapiens
YLTALQICN

SEQ ID NO: 938605 - protein, 9 aa, Homo Sapiens
IKLDPGLTA

SEQ ID NO: 938606 - protein, 9 aa, Homo Sapiens
SQHSTPLRG

SEQ ID NO: 938607 - protein, 9 aa, Homo Sapiens
LISYFYILL

SEQ ID NO: 938608 - protein, 9 aa, Homo Sapiens
VVVSLAWDK

SEQ ID NO: 938609 - protein, 9 aa, Homo Sapiens
LEKSQAFMV

SEQ ID NO: 938610 - protein, 9 aa, Homo Sapiens
DEFYPFIEA

SEQ ID NO: 938611 - protein, 9 aa, Homo Sapiens
KICYNKFVP

SEQ ID NO: 938612 - protein, 9 aa, Homo Sapiens
YVNANKEVV

SEQ ID NO: 938613 - protein, 9 aa, Homo Sapiens
ILETVLQVQ

SEQ ID NO: 938614 - protein, 9 aa, Homo Sapiens
VLAGTAVTP

SEQ ID NO: 938615 - protein, 9 aa, Homo Sapiens
LVVASLVRA

SEQ ID NO: 938616 - protein, 9 aa, Homo Sapiens
LTNAYSSVQ

SEQ ID NO: 938617 - protein, 9 aa, Homo Sapiens
QHKQLLRFR

SEQ ID NO: 938618 - protein, 9 aa, Homo Sapiens
YSCSCLPGF

SEQ ID NO: 938619 - protein, 9 aa, Homo Sapiens
FRKELEGLI

SEQ ID NO: 938620 - protein, 9 aa, Homo Sapiens
SHQGWEILR

SEQ ID NO: 938621 - protein, 9 aa, Homo Sapiens
AESNQQFQD

SEQ ID NO: 938622 - protein, 9 aa, Homo Sapiens
SLDSHTFQL

SEQ ID NO: 938623 - protein, 9 aa, Homo Sapiens
ILRNPCFHP

SEQ ID NO: 938624 - protein, 9 aa, Homo Sapiens
GVVQAAGSG

SEQ ID NO: 938625 - protein, 9 aa, Homo Sapiens
RRWAGVLSC

SEQ ID NO: 938626 - protein, 9 aa, Homo Sapiens
SFASVLSSL

SEQ ID NO: 938627 - protein, 9 aa, Homo Sapiens
KERIFQEIC

SEQ ID NO: 938628 - protein, 9 aa, Homo Sapiens
FSDSTYQAC

SEQ ID NO: 938629 - protein, 9 aa, Homo Sapiens
TELLLCKFA

SEQ ID NO: 938630 - protein, 9 aa, Homo Sapiens
LLNNGLNFS

SEQ ID NO: 938631 - protein, 9 aa, Homo Sapiens
ESESSCCPR

SEQ ID NO: 938632 - protein, 9 aa, Homo Sapiens
KVCMNLRAN

SEQ ID NO: 938633 - protein, 9 aa, Homo Sapiens
EPSVFLWQF

SEQ ID NO: 938634 - protein, 9 aa, Homo Sapiens
ALSEDNSGR

SEQ ID NO: 938635 - protein, 9 aa, Homo Sapiens
PCFYQDFFT

SEQ ID NO: 938636 - protein, 9 aa, Homo Sapiens
AFVTFFYCF

SEQ ID NO: 938637 - protein, 9 aa, Homo Sapiens
QLAAGWGLC

SEQ ID NO: 938638 - protein, 9 aa, Homo Sapiens
SGHRPSIHP

SEQ ID NO: 938639 - protein, 9 aa, Homo Sapiens
NSGKTVLAV

SEQ ID NO: 938640 - protein, 9 aa, Homo Sapiens
QDSVSTDPN

SEQ ID NO: 938641 - protein, 9 aa, Homo Sapiens
CQKQFTQKF

SEQ ID NO: 938642 - protein, 9 aa, Homo Sapiens
VLKVRNKSC

SEQ ID NO: 938643 - protein, 9 aa, Homo Sapiens
GSEKADSSH

SEQ ID NO: 938644 - protein, 9 aa, Homo Sapiens
GTLFDLSHN

SEQ ID NO: 938645 - protein, 9 aa, Homo Sapiens
KWPVAPKKI

SEQ ID NO: 938646 - protein, 9 aa, Homo Sapiens
GPKGQKGKK

SEQ ID NO: 938647 - protein, 9 aa, Homo Sapiens
MYKIKAGGS

SEQ ID NO: 938648 - protein, 9 aa, Homo Sapiens
GNLTIITFT

SEQ ID NO: 938649 - protein, 9 aa, Homo Sapiens
KTTKIPLIG

SEQ ID NO: 938650 - protein, 9 aa, Homo Sapiens
ENFCALSTG

SEQ ID NO: 938651 - protein, 9 aa, Homo Sapiens
PRKFYVCPA

SEQ ID NO: 938652 - protein, 9 aa, Homo Sapiens
LLATMAYDC

SEQ ID NO: 938653 - protein, 9 aa, Homo Sapiens
AQVQVLQEK

SEQ ID NO: 938654 - protein, 9 aa, Homo Sapiens
VEEITGTQS

SEQ ID NO: 938655 - protein, 9 aa, Homo Sapiens
LDIDKLFYV

SEQ ID NO: 938656 - protein, 9 aa, Homo Sapiens
TGLLSLVLR

SEQ ID NO: 938657 - protein, 9 aa, Homo Sapiens
HKKDAAVNC

SEQ ID NO: 938658 - protein, 9 aa, Homo Sapiens
PPADQSPHI

SEQ ID NO: 938659 - protein, 9 aa, Homo Sapiens
CNVRNSRKN

SEQ ID NO: 938660 - protein, 9 aa, Homo Sapiens
QRSIAFRLR

SEQ ID NO: 938661 - protein, 9 aa, Homo Sapiens
SNMMSDGKF

SEQ ID NO: 938662 - protein, 9 aa, Homo Sapiens
KVISDWKEQ

SEQ ID NO: 938663 - protein, 9 aa, Homo Sapiens
PDAFNLCED

SEQ ID NO: 938664 - protein, 9 aa, Homo Sapiens
TFMHFSPKG

SEQ ID NO: 938665 - protein, 9 aa, Homo Sapiens
WGYGCGVKN

SEQ ID NO: 938666 - protein, 9 aa, Homo Sapiens
IKEVLTPEM

SEQ ID NO: 938667 - protein, 9 aa, Homo Sapiens
SGHVGAPLS

SEQ ID NO: 938668 - protein, 9 aa, Homo Sapiens
CAFHLSVVS

SEQ ID NO: 938669 - protein, 9 aa, Homo Sapiens
DQNTTFSVM

SEQ ID NO: 938670 - protein, 9 aa, Homo Sapiens
ICTVFQTYA

SEQ ID NO: 938671 - protein, 9 aa, Homo Sapiens
FMTAVAFDR

SEQ ID NO: 938672 - protein, 9 aa, Homo Sapiens
LFHLQLHWA

SEQ ID NO: 938673 - protein, 9 aa, Homo Sapiens
EGEGSVRSA

SEQ ID NO: 938674 - protein, 9 aa, Homo Sapiens
TSSIDPNDM

SEQ ID NO: 938675 - protein, 9 aa, Homo Sapiens
PIVHYNMGG

SEQ ID NO: 938676 - protein, 9 aa, Homo Sapiens
QGAVPDSTG

SEQ ID NO: 938677 - protein, 9 aa, Homo Sapiens
ANTTLQMTI

SEQ ID NO: 938678 - protein, 9 aa, Homo Sapiens
FLSSPLYSS

SEQ ID NO: 938679 - protein, 9 aa, Homo Sapiens
HSEFSKPQI

SEQ ID NO: 938680 - protein, 9 aa, Homo Sapiens
YGKVCKAAS

SEQ ID NO: 938681 - protein, 9 aa, Homo Sapiens
SEGMSETLI

SEQ ID NO: 938682 - protein, 9 aa, Homo Sapiens
LCARTGSGR

SEQ ID NO: 938683 - protein, 9 aa, Homo Sapiens
SRVTTVSDL

SEQ ID NO: 938684 - protein, 9 aa, Homo Sapiens
APEIYHRKP

SEQ ID NO: 938685 - protein, 9 aa, Homo Sapiens
AVVSHSKRH

SEQ ID NO: 938686 - protein, 9 aa, Homo Sapiens
CNIIIFAVM

SEQ ID NO: 938687 - protein, 9 aa, Homo Sapiens
KNLSINNNL

SEQ ID NO: 938688 - protein, 9 aa, Homo Sapiens
PNCDGWLLL

SEQ ID NO: 938689 - protein, 9 aa, Homo Sapiens
VKVNGGPQR

SEQ ID NO: 938690 - protein, 9 aa, Homo Sapiens
RMATARIKT

SEQ ID NO: 938691 - protein, 9 aa, Homo Sapiens
VTHAYASEN

SEQ ID NO: 938692 - protein, 9 aa, Homo Sapiens
ACLCKHGFT

SEQ ID NO: 938693 - protein, 9 aa, Homo Sapiens
RDGSQTSNS

SEQ ID NO: 938694 - protein, 9 aa, Homo Sapiens
FATATGATP

SEQ ID NO: 938695 - protein, 9 aa, Homo Sapiens
DFTDNPRWL

SEQ ID NO: 938696 - protein, 9 aa, Homo Sapiens
KEKTDLENA

SEQ ID NO: 938697 - protein, 9 aa, Homo Sapiens
TQRGCVWTT

SEQ ID NO: 938698 - protein, 9 aa, Homo Sapiens
SECGHKKDA

SEQ ID NO: 938699 - protein, 9 aa, Homo Sapiens
SQSLTQIYV

SEQ ID NO: 938700 - protein, 9 aa, Homo Sapiens
EQRRFTVST

SEQ ID NO: 938701 - protein, 9 aa, Homo Sapiens
LLRTSSFLL

SEQ ID NO: 938702 - protein, 9 aa, Homo Sapiens
EAHWPQYLP

SEQ ID NO: 938703 - protein, 9 aa, Homo Sapiens
QDFLLKDKH

SEQ ID NO: 938704 - protein, 9 aa, Homo Sapiens
VYLRVSSHL

SEQ ID NO: 938705 - protein, 9 aa, Homo Sapiens
DKYNVPILS

SEQ ID NO: 938706 - protein, 9 aa, Homo Sapiens
SGRYCGSVH

SEQ ID NO: 938707 - protein, 9 aa, Homo Sapiens
LEGYFYIPP

SEQ ID NO: 938708 - protein, 9 aa, Homo Sapiens
CDRKIEVAF

SEQ ID NO: 938709 - protein, 9 aa, Homo Sapiens
ASVCRHFRF

SEQ ID NO: 938710 - protein, 9 aa, Homo Sapiens
GPSGCKRKF

SEQ ID NO: 938711 - protein, 9 aa, Homo Sapiens
LCNGENLAV

SEQ ID NO: 938712 - protein, 9 aa, Homo Sapiens
EQKRQKKAI

SEQ ID NO: 938713 - protein, 9 aa, Homo Sapiens
KYFKNFSSA

SEQ ID NO: 938714 - protein, 9 aa, Homo Sapiens
SFSSSAGLG

SEQ ID NO: 938715 - protein, 9 aa, Homo Sapiens
PATLPAELQ

SEQ ID NO: 938716 - protein, 9 aa, Homo Sapiens
PFCDQNTTF

SEQ ID NO: 938717 - protein, 9 aa, Homo Sapiens
RLKEELEKA

SEQ ID NO: 938718 - protein, 9 aa, Homo Sapiens
NVRLYFILG

SEQ ID NO: 938719 - protein, 9 aa, Homo Sapiens
CTYGNQILF

SEQ ID NO: 938720 - protein, 9 aa, Homo Sapiens
IRSPFFSNV

SEQ ID NO: 938721 - protein, 9 aa, Homo Sapiens
NREWVCAAD

SEQ ID NO: 938722 - protein, 9 aa, Homo Sapiens
ENNLSEIEN

SEQ ID NO: 938723 - protein, 9 aa, Homo Sapiens
DKVIFSGKE

SEQ ID NO: 938724 - protein, 9 aa, Homo Sapiens
LLKTLGNHF

SEQ ID NO: 938725 - protein, 9 aa, Homo Sapiens
DSCDREIFC

SEQ ID NO: 938726 - protein, 9 aa, Homo Sapiens
FLHNPAGTS

SEQ ID NO: 938727 - protein, 9 aa, Homo Sapiens
CSYFPQDLW

SEQ ID NO: 938728 - protein, 9 aa, Homo Sapiens
SERIQGYVV

SEQ ID NO: 938729 - protein, 9 aa, Homo Sapiens
EKGNPEKVF

SEQ ID NO: 938730 - protein, 9 aa, Homo Sapiens
GLQTTNNRL

SEQ ID NO: 938731 - protein, 9 aa, Homo Sapiens
ILFLMAAFI

SEQ ID NO: 938732 - protein, 9 aa, Homo Sapiens
EDTKRQLRE

SEQ ID NO: 938733 - protein, 9 aa, Homo Sapiens
VIISEKLDS

SEQ ID NO: 938734 - protein, 9 aa, Homo Sapiens
TKIPLIGLI

SEQ ID NO: 938735 - protein, 9 aa, Homo Sapiens
IFQEICVVM

SEQ ID NO: 938736 - protein, 9 aa, Homo Sapiens
SLVMDDKIE

SEQ ID NO: 938737 - protein, 9 aa, Homo Sapiens
KSICTVLTF

SEQ ID NO: 938738 - protein, 9 aa, Homo Sapiens
KKTLLLYKK

SEQ ID NO: 938739 - protein, 9 aa, Homo Sapiens
RKELEGLIQ

SEQ ID NO: 938740 - protein, 9 aa, Homo Sapiens
PPPLRLTPV

SEQ ID NO: 938741 - protein, 9 aa, Homo Sapiens
APACVGLGI

SEQ ID NO: 938742 - protein, 9 aa, Homo Sapiens
PEGIVKIRL

SEQ ID NO: 938743 - protein, 9 aa, Homo Sapiens
TQGLMMRPG

SEQ ID NO: 938744 - protein, 9 aa, Homo Sapiens
FWYKLAKIR

SEQ ID NO: 938745 - protein, 9 aa, Homo Sapiens
VQHNRFYYE

SEQ ID NO: 938746 - protein, 9 aa, Homo Sapiens
DFCGIERVD

SEQ ID NO: 938747 - protein, 9 aa, Homo Sapiens
SLAVVEKNY

SEQ ID NO: 938748 - protein, 9 aa, Homo Sapiens
VLIQLPGQK

SEQ ID NO: 938749 - protein, 9 aa, Homo Sapiens
ILAGQGKAS

SEQ ID NO: 938750 - protein, 9 aa, Homo Sapiens
VLPEDIISS

SEQ ID NO: 938751 - protein, 9 aa, Homo Sapiens
PTFMHFSPK

SEQ ID NO: 938752 - protein, 9 aa, Homo Sapiens
NAYEKSLDQ

SEQ ID NO: 938753 - protein, 9 aa, Homo Sapiens
FSEGMSETL

SEQ ID NO: 938754 - protein, 9 aa, Homo Sapiens
ALRRHYHSI

SEQ ID NO: 938755 - protein, 9 aa, Homo Sapiens
IFSGPAIFR

SEQ ID NO: 938756 - protein, 9 aa, Homo Sapiens
VNVLPISDH

SEQ ID NO: 938757 - protein, 9 aa, Homo Sapiens
DITELFMQL

SEQ ID NO: 938758 - protein, 9 aa, Homo Sapiens
PPRALPKGP

SEQ ID NO: 938759 - protein, 9 aa, Homo Sapiens
SGQLVSGGL

SEQ ID NO: 938760 - protein, 9 aa, Homo Sapiens
NQEEETEFM

SEQ ID NO: 938761 - protein, 9 aa, Homo Sapiens
SCHVFEQGH

SEQ ID NO: 938762 - protein, 9 aa, Homo Sapiens
VTEKLDSNT

SEQ ID NO: 938763 - protein, 9 aa, Homo Sapiens
AHWPQYLPL

SEQ ID NO: 938764 - protein, 9 aa, Homo Sapiens
MERSLTWGE

SEQ ID NO: 938765 - protein, 9 aa, Homo Sapiens
KGQKGKKGS

SEQ ID NO: 938766 - protein, 9 aa, Homo Sapiens
PRAFIGKDC

SEQ ID NO: 938767 - protein, 9 aa, Homo Sapiens
EVTLNGDIS

SEQ ID NO: 938768 - protein, 9 aa, Homo Sapiens
SASVSLPLV

SEQ ID NO: 938769 - protein, 9 aa, Homo Sapiens
PVHCRLELK

SEQ ID NO: 938770 - protein, 9 aa, Homo Sapiens
LTRQRRTWR

SEQ ID NO: 938771 - protein, 9 aa, Homo Sapiens
HTLGFDFVR

SEQ ID NO: 938772 - protein, 9 aa, Homo Sapiens
NGWPGAVAY

SEQ ID NO: 938773 - protein, 9 aa, Homo Sapiens
EQSMNMLNF

SEQ ID NO: 938774 - protein, 9 aa, Homo Sapiens
QSRETAKTD

SEQ ID NO: 938775 - protein, 9 aa, Homo Sapiens
DNSSFDSIS

SEQ ID NO: 938776 - protein, 9 aa, Homo Sapiens
QIKIDDKEQ

SEQ ID NO: 938777 - protein, 9 aa, Homo Sapiens
ADKEYYFDW

SEQ ID NO: 938778 - protein, 9 aa, Homo Sapiens
FMQLLLASG

SEQ ID NO: 938779 - protein, 9 aa, Homo Sapiens
EEDDKDSKQ

SEQ ID NO: 938780 - protein, 9 aa, Homo Sapiens
IPLSYAFIV

SEQ ID NO: 938781 - protein, 9 aa, Homo Sapiens
VPFLEFKVS

SEQ ID NO: 938782 - protein, 9 aa, Homo Sapiens
WGCWYYLRY

SEQ ID NO: 938783 - protein, 9 aa, Homo Sapiens
NVPLNALPS

SEQ ID NO: 938784 - protein, 9 aa, Homo Sapiens
HLLHYRIIM

SEQ ID NO: 938785 - protein, 9 aa, Homo Sapiens
ERIQGYVVS

SEQ ID NO: 938786 - protein, 9 aa, Homo Sapiens
DTLFSSRRG

SEQ ID NO: 938787 - protein, 9 aa, Homo Sapiens
KKGKAGNVK

SEQ ID NO: 938788 - protein, 9 aa, Homo Sapiens
SACNLFLTN

SEQ ID NO: 938789 - protein, 9 aa, Homo Sapiens
ARERPAEGD

SEQ ID NO: 938790 - protein, 9 aa, Homo Sapiens
WSEGEPVCV

SEQ ID NO: 938791 - protein, 9 aa, Homo Sapiens
LRKRIIFCK

SEQ ID NO: 938792 - protein, 9 aa, Homo Sapiens
YTGEKPYEC

SEQ ID NO: 938793 - protein, 9 aa, Homo Sapiens
VADWKAGQL

SEQ ID NO: 938794 - protein, 9 aa, Homo Sapiens
HLIPGGFLP

SEQ ID NO: 938795 - protein, 9 aa, Homo Sapiens
GLICARLQG

SEQ ID NO: 938796 - protein, 9 aa, Homo Sapiens
ALQQYELKV

SEQ ID NO: 938797 - protein, 9 aa, Homo Sapiens
QRVDKALPP

SEQ ID NO: 938798 - protein, 9 aa, Homo Sapiens
RTSESPLHA

SEQ ID NO: 938799 - protein, 9 aa, Homo Sapiens
SYNALIGPN

SEQ ID NO: 938800 - protein, 9 aa, Homo Sapiens
GKKPYQCEE

SEQ ID NO: 938801 - protein, 9 aa, Homo Sapiens
FDQWTPIAA

SEQ ID NO: 938802 - protein, 9 aa, Homo Sapiens
YKDLFCSKN

SEQ ID NO: 938803 - protein, 9 aa, Homo Sapiens
GIYVNLYYA

SEQ ID NO: 938804 - protein, 9 aa, Homo Sapiens
RLYLQENPL

SEQ ID NO: 938805 - protein, 9 aa, Homo Sapiens
MNFITHPYV

SEQ ID NO: 938806 - protein, 9 aa, Homo Sapiens
RPLYLRKIV

SEQ ID NO: 938807 - protein, 9 aa, Homo Sapiens
CASVSFQIT

SEQ ID NO: 938808 - protein, 9 aa, Homo Sapiens
TGKGCGHRL

SEQ ID NO: 938809 - protein, 9 aa, Homo Sapiens
ILPGSLFWF

SEQ ID NO: 938810 - protein, 9 aa, Homo Sapiens
LEGKPVLFF

SEQ ID NO: 938811 - protein, 9 aa, Homo Sapiens
PVHLAGSRF

SEQ ID NO: 938812 - protein, 9 aa, Homo Sapiens
ETEVGEIHQ

SEQ ID NO: 938813 - protein, 9 aa, Homo Sapiens
EEEKEVEEE

SEQ ID NO: 938814 - protein, 9 aa, Homo Sapiens
PDKQDALIS

SEQ ID NO: 938815 - protein, 9 aa, Homo Sapiens
NKSKTIFRF

SEQ ID NO: 938816 - protein, 9 aa, Homo Sapiens
AQKPRPFSP

SEQ ID NO: 938817 - protein, 9 aa, Homo Sapiens
SLNRHCVVY

SEQ ID NO: 938818 - protein, 9 aa, Homo Sapiens
CSAKKSAEP

SEQ ID NO: 938819 - protein, 9 aa, Homo Sapiens
QNLKDHGPQ

SEQ ID NO: 938820 - protein, 9 aa, Homo Sapiens
PRSPEKEEP

SEQ ID NO: 938821 - protein, 9 aa, Homo Sapiens
QFTYTLDHF

SEQ ID NO: 938822 - protein, 9 aa, Homo Sapiens
LEDINVSPE

SEQ ID NO: 938823 - protein, 9 aa, Homo Sapiens
AYAGLVGSS

SEQ ID NO: 938824 - protein, 9 aa, Homo Sapiens
FNEWPAKAL

SEQ ID NO: 938825 - protein, 9 aa, Homo Sapiens
PLPTKGAES

SEQ ID NO: 938826 - protein, 9 aa, Homo Sapiens
VTKDTLQGA

SEQ ID NO: 938827 - protein, 9 aa, Homo Sapiens
SGPENHRAG

SEQ ID NO: 938828 - protein, 9 aa, Homo Sapiens
MRKRESQFV

SEQ ID NO: 938829 - protein, 9 aa, Homo Sapiens
RTEGGTCEV

SEQ ID NO: 938830 - protein, 9 aa, Homo Sapiens
PPTPSLASA

SEQ ID NO: 938831 - protein, 9 aa, Homo Sapiens
AMGTSGETS

SEQ ID NO: 938832 - protein, 9 aa, Homo Sapiens
GPSVCFFEI

SEQ ID NO: 938833 - protein, 9 aa, Homo Sapiens
HFQQQAFAL

SEQ ID NO: 938834 - protein, 9 aa, Homo Sapiens
KRMKVVVRA

SEQ ID NO: 938835 - protein, 9 aa, Homo Sapiens
IIVLANGQV

SEQ ID NO: 938836 - protein, 9 aa, Homo Sapiens
EIFCRGERI

SEQ ID NO: 938837 - protein, 9 aa, Homo Sapiens
LPIVLSSEA

SEQ ID NO: 938838 - protein, 9 aa, Homo Sapiens
YVQHNRFYY

SEQ ID NO: 938839 - protein, 9 aa, Homo Sapiens
FIYLRPGFR

SEQ ID NO: 938840 - protein, 9 aa, Homo Sapiens
QDEFYPFIE

SEQ ID NO: 938841 - protein, 9 aa, Homo Sapiens
YAQSEDYVD

SEQ ID NO: 938842 - protein, 9 aa, Homo Sapiens
LVWTDNPKS

SEQ ID NO: 938843 - protein, 9 aa, Homo Sapiens
NLQKEISDL

SEQ ID NO: 938844 - protein, 9 aa, Homo Sapiens
ADMSWQQKT

SEQ ID NO: 938845 - protein, 9 aa, Homo Sapiens
RSLHANGRQ

SEQ ID NO: 938846 - protein, 9 aa, Homo Sapiens
KKSVFENYY

SEQ ID NO: 938847 - protein, 9 aa, Homo Sapiens
LPNAQGLAW

SEQ ID NO: 938848 - protein, 9 aa, Homo Sapiens
EGYWTRNVD

SEQ ID NO: 938849 - protein, 9 aa, Homo Sapiens
PKPRAAPSL

SEQ ID NO: 938850 - protein, 9 aa, Homo Sapiens
GGRPFLIAR

SEQ ID NO: 938851 - protein, 9 aa, Homo Sapiens
SLRPQRSIA

SEQ ID NO: 938852 - protein, 9 aa, Homo Sapiens
PLNALPSVL

SEQ ID NO: 938853 - protein, 9 aa, Homo Sapiens
QMLKGLLPL

SEQ ID NO: 938854 - protein, 9 aa, Homo Sapiens
DIEACIALV

SEQ ID NO: 938855 - protein, 9 aa, Homo Sapiens
LQKQEKTCR

SEQ ID NO: 938856 - protein, 9 aa, Homo Sapiens
ELSIEEVER

SEQ ID NO: 938857 - protein, 9 aa, Homo Sapiens
LWGLLDCRQ

SEQ ID NO: 938858 - protein, 9 aa, Homo Sapiens
KTDLENARA

SEQ ID NO: 938859 - protein, 9 aa, Homo Sapiens
CHTPVTNKE

SEQ ID NO: 938860 - protein, 9 aa, Homo Sapiens
QSDIVEIPL

SEQ ID NO: 938861 - protein, 9 aa, Homo Sapiens
SKRDKRSRH

SEQ ID NO: 938862 - protein, 9 aa, Homo Sapiens
EVVDRTCSS

SEQ ID NO: 938863 - protein, 9 aa, Homo Sapiens
SARHQVHGP

SEQ ID NO: 938864 - protein, 9 aa, Homo Sapiens
PLARKEAYG

SEQ ID NO: 938865 - protein, 9 aa, Homo Sapiens
KEFKNQPSL

SEQ ID NO: 938866 - protein, 9 aa, Homo Sapiens
RAKVRRYLE

SEQ ID NO: 938867 - protein, 9 aa, Homo Sapiens
LGPLPRFLN

SEQ ID NO: 938868 - protein, 9 aa, Homo Sapiens
DEKIYFQHT

SEQ ID NO: 938869 - protein, 9 aa, Homo Sapiens
RVFLQIGFF

SEQ ID NO: 938870 - protein, 9 aa, Homo Sapiens
KWVSVLAAK

SEQ ID NO: 938871 - protein, 9 aa, Homo Sapiens
TTNKTMCKT

SEQ ID NO: 938872 - protein, 9 aa, Homo Sapiens
PTWGEPSKP

SEQ ID NO: 938873 - protein, 9 aa, Homo Sapiens
AAAVSTGPF

SEQ ID NO: 938874 - protein, 9 aa, Homo Sapiens
LTSEDFPDF

SEQ ID NO: 938875 - protein, 9 aa, Homo Sapiens
FAAWASGGP

SEQ ID NO: 938876 - protein, 9 aa, Homo Sapiens
ENETSHEIK

SEQ ID NO: 938877 - protein, 9 aa, Homo Sapiens
RRKFKKNVP

SEQ ID NO: 938878 - protein, 9 aa, Homo Sapiens
QSNPNYDKT

SEQ ID NO: 938879 - protein, 9 aa, Homo Sapiens
SKIGGKSLR

SEQ ID NO: 938880 - protein, 9 aa, Homo Sapiens
ERPAEGDRG

SEQ ID NO: 938881 - protein, 9 aa, Homo Sapiens
TSTTLSYAL

SEQ ID NO: 938882 - protein, 9 aa, Homo Sapiens
EMSKAFAFE

SEQ ID NO: 938883 - protein, 9 aa, Homo Sapiens
LYCWLQAQK

SEQ ID NO: 938884 - protein, 9 aa, Homo Sapiens
TLFDLSHNR

SEQ ID NO: 938885 - protein, 9 aa, Homo Sapiens
QNTLLETPV

SEQ ID NO: 938886 - protein, 9 aa, Homo Sapiens
SCACNSLGT

SEQ ID NO: 938887 - protein, 9 aa, Homo Sapiens
DLSNCTLHW

SEQ ID NO: 938888 - protein, 9 aa, Homo Sapiens
NVSLDATGG

SEQ ID NO: 938889 - protein, 9 aa, Homo Sapiens
IAAACIHMM

SEQ ID NO: 938890 - protein, 9 aa, Homo Sapiens
LKGFLQRLQ

SEQ ID NO: 938891 - protein, 9 aa, Homo Sapiens
FMPVDMGFL

SEQ ID NO: 938892 - protein, 9 aa, Homo Sapiens
VDKALPPNW

SEQ ID NO: 938893 - protein, 9 aa, Homo Sapiens
MWLIRTYWN

SEQ ID NO: 938894 - protein, 9 aa, Homo Sapiens
GAMERSLTW

SEQ ID NO: 938895 - protein, 9 aa, Homo Sapiens
SSVEGTDLE

SEQ ID NO: 938896 - protein, 9 aa, Homo Sapiens
VLTQRMQSF

SEQ ID NO: 938897 - protein, 9 aa, Homo Sapiens
GFLASAWEV

SEQ ID NO: 938898 - protein, 9 aa, Homo Sapiens
PRGIQRITG

SEQ ID NO: 938899 - protein, 9 aa, Homo Sapiens
FRMATARIK

SEQ ID NO: 938900 - protein, 9 aa, Homo Sapiens
ELLQSQKAM

SEQ ID NO: 938901 - protein, 9 aa, Homo Sapiens
KNDVVFFMD

SEQ ID NO: 938902 - protein, 9 aa, Homo Sapiens
GRTCIIKVF

SEQ ID NO: 938903 - protein, 9 aa, Homo Sapiens
LSQHGIYDG

SEQ ID NO: 938904 - protein, 9 aa, Homo Sapiens
KITDLSRGV

SEQ ID NO: 938905 - protein, 9 aa, Homo Sapiens
NFITHPYVY

SEQ ID NO: 938906 - protein, 9 aa, Homo Sapiens
AETAVVTSS

SEQ ID NO: 938907 - protein, 9 aa, Homo Sapiens
AEENNLSEE

SEQ ID NO: 938908 - protein, 9 aa, Homo Sapiens
LEGVPSAPS

SEQ ID NO: 938909 - protein, 9 aa, Homo Sapiens
GASKALLGR

SEQ ID NO: 938910 - protein, 9 aa, Homo Sapiens
TPFWYATRP

SEQ ID NO: 938911 - protein, 9 aa, Homo Sapiens
DISFHRPRP

SEQ ID NO: 938912 - protein, 9 aa, Homo Sapiens
DRVFLQIGF

SEQ ID NO: 938913 - protein, 9 aa, Homo Sapiens
SLAWDKSLA

SEQ ID NO: 938914 - protein, 9 aa, Homo Sapiens
AIGIHPHPY

SEQ ID NO: 938915 - protein, 9 aa, Homo Sapiens
CNSDSPCYE

SEQ ID NO: 938916 - protein, 9 aa, Homo Sapiens
FNSLAGGLL

SEQ ID NO: 938917 - protein, 9 aa, Homo Sapiens
VDADESPNA

SEQ ID NO: 938918 - protein, 9 aa, Homo Sapiens
GKEATPQPR

SEQ ID NO: 938919 - protein, 9 aa, Homo Sapiens
CLHCQTQAC

SEQ ID NO: 938920 - protein, 9 aa, Homo Sapiens
LLYGLQTTN

SEQ ID NO: 938921 - protein, 9 aa, Homo Sapiens
IPTMTKKIK

SEQ ID NO: 938922 - protein, 9 aa, Homo Sapiens
CTVFQTYAK

SEQ ID NO: 938923 - protein, 9 aa, Homo Sapiens
KQSPDYKFN

SEQ ID NO: 938924 - protein, 9 aa, Homo Sapiens
DRTCSSREH

SEQ ID NO: 938925 - protein, 9 aa, Homo Sapiens
TQIKIDDKE

SEQ ID NO: 938926 - protein, 9 aa, Homo Sapiens
IRAVNKAGV

SEQ ID NO: 938927 - protein, 9 aa, Homo Sapiens
NVTYKHKEK

SEQ ID NO: 938928 - protein, 9 aa, Homo Sapiens
EEGKAFAES

SEQ ID NO: 938929 - protein, 9 aa, Homo Sapiens
SEEPRALGI

SEQ ID NO: 938930 - protein, 9 aa, Homo Sapiens
AAFATDKYQ

SEQ ID NO: 938931 - protein, 9 aa, Homo Sapiens
FSNVYPGER

SEQ ID NO: 938932 - protein, 9 aa, Homo Sapiens
KDNKMCATV

SEQ ID NO: 938933 - protein, 9 aa, Homo Sapiens
SSVVLESDD

SEQ ID NO: 938934 - protein, 9 aa, Homo Sapiens
RANTDVFLS

SEQ ID NO: 938935 - protein, 9 aa, Homo Sapiens
RSETISLQI

SEQ ID NO: 938936 - protein, 9 aa, Homo Sapiens
MLYLVTLME

SEQ ID NO: 938937 - protein, 9 aa, Homo Sapiens
AFRSRPWNK

SEQ ID NO: 938938 - protein, 9 aa, Homo Sapiens
EVRVFEGLP

SEQ ID NO: 938939 - protein, 9 aa, Homo Sapiens
LDLLCLRAR

SEQ ID NO: 938940 - protein, 9 aa, Homo Sapiens
VGEIHQNKS

SEQ ID NO: 938941 - protein, 9 aa, Homo Sapiens
MSLVGPFPG

SEQ ID NO: 938942 - protein, 9 aa, Homo Sapiens
TQHKIKYKA

SEQ ID NO: 938943 - protein, 9 aa, Homo Sapiens
RTAKNVIGK

SEQ ID NO: 938944 - protein, 9 aa, Homo Sapiens
PTGSESLFQ

SEQ ID NO: 938945 - protein, 9 aa, Homo Sapiens
NAVYFKEKW

SEQ ID NO: 938946 - protein, 9 aa, Homo Sapiens
EQFVFEVLV

SEQ ID NO: 938947 - protein, 9 aa, Homo Sapiens
SNYVFNTAS

SEQ ID NO: 938948 - protein, 9 aa, Homo Sapiens
RFKWWPASQ

SEQ ID NO: 938949 - protein, 9 aa, Homo Sapiens
FYLRTHEFS

SEQ ID NO: 938950 - protein, 9 aa, Homo Sapiens
TLTMTCISV

SEQ ID NO: 938951 - protein, 9 aa, Homo Sapiens
KLGLKEPEE

SEQ ID NO: 938952 - protein, 9 aa, Homo Sapiens
IVTVEPRRQ

SEQ ID NO: 938953 - protein, 9 aa, Homo Sapiens
YNKASGGRY

SEQ ID NO: 938954 - protein, 9 aa, Homo Sapiens
REFQITCGS

SEQ ID NO: 938955 - protein, 9 aa, Homo Sapiens
KITYYFPCQ

SEQ ID NO: 938956 - protein, 9 aa, Homo Sapiens
GSVDTTVFS

SEQ ID NO: 938957 - protein, 9 aa, Homo Sapiens
LHLCSAKKS

SEQ ID NO: 938958 - protein, 9 aa, Homo Sapiens
LQFLENEHQ

SEQ ID NO: 938959 - protein, 9 aa, Homo Sapiens
NYPDAGALI

SEQ ID NO: 938960 - protein, 9 aa, Homo Sapiens
ETIFDNFLI

SEQ ID NO: 938961 - protein, 9 aa, Homo Sapiens
FFRRHLPRQ

SEQ ID NO: 938962 - protein, 9 aa, Homo Sapiens
LASERLMFH

SEQ ID NO: 938963 - protein, 9 aa, Homo Sapiens
HIKETPATS

SEQ ID NO: 938964 - protein, 9 aa, Homo Sapiens
ASSTPYGHC

SEQ ID NO: 938965 - protein, 9 aa, Homo Sapiens
RHFRFPPPW

SEQ ID NO: 938966 - protein, 9 aa, Homo Sapiens
EAPSSFSKV

SEQ ID NO: 938967 - protein, 9 aa, Homo Sapiens
TSFLNKHRR

SEQ ID NO: 938968 - protein, 9 aa, Homo Sapiens
CLEKQKPVF

SEQ ID NO: 938969 - protein, 9 aa, Homo Sapiens
WERFRLSRQ

SEQ ID NO: 938970 - protein, 9 aa, Homo Sapiens
ELTQLKLLR

SEQ ID NO: 938971 - protein, 9 aa, Homo Sapiens
PNVPYFDLS

SEQ ID NO: 938972 - protein, 9 aa, Homo Sapiens
PENCTLELK

SEQ ID NO: 938973 - protein, 9 aa, Homo Sapiens
LSAEVVFEK

SEQ ID NO: 938974 - protein, 9 aa, Homo Sapiens
NQPQSSDEC

SEQ ID NO: 938975 - protein, 9 aa, Homo Sapiens
CFSKRLLLS

SEQ ID NO: 938976 - protein, 9 aa, Homo Sapiens
QLRAQKQQS

SEQ ID NO: 938977 - protein, 9 aa, Homo Sapiens
MVHIRQEIE

SEQ ID NO: 938978 - protein, 9 aa, Homo Sapiens
LSKQPEFHI

SEQ ID NO: 938979 - protein, 9 aa, Homo Sapiens
ECASLSSGL

SEQ ID NO: 938980 - protein, 9 aa, Homo Sapiens
VFIACCQTS

SEQ ID NO: 938981 - protein, 9 aa, Homo Sapiens
FLQVQYAIL

SEQ ID NO: 938982 - protein, 9 aa, Homo Sapiens
SQAFMVINS

SEQ ID NO: 938983 - protein, 9 aa, Homo Sapiens
VGLMADSVQ

SEQ ID NO: 938984 - protein, 9 aa, Homo Sapiens
MRRRLHYNK

SEQ ID NO: 938985 - protein, 9 aa, Homo Sapiens
RVPGGREQP

SEQ ID NO: 938986 - protein, 9 aa, Homo Sapiens
TLSYALLLL

SEQ ID NO: 938987 - protein, 9 aa, Homo Sapiens
NANKEVVSH

SEQ ID NO: 938988 - protein, 9 aa, Homo Sapiens
IISNLDKVG

SEQ ID NO: 938989 - protein, 9 aa, Homo Sapiens
DFIVKPLVR

SEQ ID NO: 938990 - protein, 9 aa, Homo Sapiens
CVGLGITTV

SEQ ID NO: 938991 - protein, 9 aa, Homo Sapiens
RKIEVAFMV

SEQ ID NO: 938992 - protein, 9 aa, Homo Sapiens
QNTGHEGKA

SEQ ID NO: 938993 - protein, 9 aa, Homo Sapiens
YSSTLTMTC

SEQ ID NO: 938994 - protein, 9 aa, Homo Sapiens
HYAFPYCDK

SEQ ID NO: 938995 - protein, 9 aa, Homo Sapiens
PKDVDPTSV

SEQ ID NO: 938996 - protein, 9 aa, Homo Sapiens
QVKGTNKLR

SEQ ID NO: 938997 - protein, 9 aa, Homo Sapiens
SNAASSKEA

SEQ ID NO: 938998 - protein, 9 aa, Homo Sapiens
SCQECICIY

SEQ ID NO: 938999 - protein, 9 aa, Homo Sapiens
KVRFYRNRD

SEQ ID NO: 939000 - protein, 9 aa, Homo Sapiens
PSVYPETRH

SEQ ID NO: 939001 - protein, 9 aa, Homo Sapiens
KGDPFSFEG

SEQ ID NO: 939002 - protein, 9 aa, Homo Sapiens
ICVMTGKSR

SEQ ID NO: 939003 - protein, 9 aa, Homo Sapiens
VLHSVPQPT

SEQ ID NO: 939004 - protein, 9 aa, Homo Sapiens
GENSLPGEN

SEQ ID NO: 939005 - protein, 9 aa, Homo Sapiens
GYLVFGQHK

SEQ ID NO: 939006 - protein, 9 aa, Homo Sapiens
GLSVFSRFS

SEQ ID NO: 939007 - protein, 9 aa, Homo Sapiens
NALPSVQPH

SEQ ID NO: 939008 - protein, 9 aa, Homo Sapiens
TVFSLLMTL

SEQ ID NO: 939009 - protein, 9 aa, Homo Sapiens
VHLAGSRFL

SEQ ID NO: 939010 - protein, 9 aa, Homo Sapiens
SRADFCGIE

SEQ ID NO: 939011 - protein, 9 aa, Homo Sapiens
LHDFFSYFM

SEQ ID NO: 939012 - protein, 9 aa, Homo Sapiens
SHSNYPYSD

SEQ ID NO: 939013 - protein, 9 aa, Homo Sapiens
RIWEFVPPF

SEQ ID NO: 939014 - protein, 9 aa, Homo Sapiens
TLYIAPVTK

SEQ ID NO: 939015 - protein, 9 aa, Homo Sapiens
LFGKYIDRL

SEQ ID NO: 939016 - protein, 9 aa, Homo Sapiens
AQPMGPEYV

SEQ ID NO: 939017 - protein, 9 aa, Homo Sapiens
SLKPTSTIF

SEQ ID NO: 939018 - protein, 9 aa, Homo Sapiens
VEDIKSLVK

SEQ ID NO: 939019 - protein, 9 aa, Homo Sapiens
KEELEKARD

SEQ ID NO: 939020 - protein, 9 aa, Homo Sapiens
KDGAETAVV

SEQ ID NO: 939021 - protein, 9 aa, Homo Sapiens
RNTTGLTTL

SEQ ID NO: 939022 - protein, 9 aa, Homo Sapiens
LAALYVLYP

SEQ ID NO: 939023 - protein, 9 aa, Homo Sapiens
FKKETPVTH

SEQ ID NO: 939024 - protein, 9 aa, Homo Sapiens
VACSYLSSK

SEQ ID NO: 939025 - protein, 9 aa, Homo Sapiens
QPHAHLQSL

SEQ ID NO: 939026 - protein, 9 aa, Homo Sapiens
SEGEEKGNP

SEQ ID NO: 939027 - protein, 9 aa, Homo Sapiens
IMSGFSNTE

SEQ ID NO: 939028 - protein, 9 aa, Homo Sapiens
KEGPEFWAK

SEQ ID NO: 939029 - protein, 9 aa, Homo Sapiens
LNYELAHKP

SEQ ID NO: 939030 - protein, 9 aa, Homo Sapiens
GVSKRQEAQ

SEQ ID NO: 939031 - protein, 9 aa, Homo Sapiens
IHLLPDLYA

SEQ ID NO: 939032 - protein, 9 aa, Homo Sapiens
SEFSKPQIL

SEQ ID NO: 939033 - protein, 9 aa, Homo Sapiens
REMFEVMGL

SEQ ID NO: 939034 - protein, 9 aa, Homo Sapiens
ISNYVFNTA

SEQ ID NO: 939035 - protein, 9 aa, Homo Sapiens
SEAKVAQSP

SEQ ID NO: 939036 - protein, 9 aa, Homo Sapiens
IACSFPGIN

SEQ ID NO: 939037 - protein, 9 aa, Homo Sapiens
TLHPLDSEE

SEQ ID NO: 939038 - protein, 9 aa, Homo Sapiens
MEHPAQNVE

SEQ ID NO: 939039 - protein, 9 aa, Homo Sapiens
CIIKVFSLL

SEQ ID NO: 939040 - protein, 9 aa, Homo Sapiens
EFCSANGIT

SEQ ID NO: 939041 - protein, 9 aa, Homo Sapiens
KMIKSPYNV

SEQ ID NO: 939042 - protein, 9 aa, Homo Sapiens
TPDEFDSVP

SEQ ID NO: 939043 - protein, 9 aa, Homo Sapiens
LCVFFVSHF

SEQ ID NO: 939044 - protein, 9 aa, Homo Sapiens
IPYATMGGL

SEQ ID NO: 939045 - protein, 9 aa, Homo Sapiens
QLLEEDSDP

SEQ ID NO: 939046 - protein, 9 aa, Homo Sapiens
DEDKDANLD

SEQ ID NO: 939047 - protein, 9 aa, Homo Sapiens
LESFKRTSK

SEQ ID NO: 939048 - protein, 9 aa, Homo Sapiens
QLPGQKVSH

SEQ ID NO: 939049 - protein, 9 aa, Homo Sapiens
RTPDEFDSV

SEQ ID NO: 939050 - protein, 9 aa, Homo Sapiens
QGVYAPLHF

SEQ ID NO: 939051 - protein, 9 aa, Homo Sapiens
AEPFFSNIA

SEQ ID NO: 939052 - protein, 9 aa, Homo Sapiens
RRAVLHGVP

SEQ ID NO: 939053 - protein, 9 aa, Homo Sapiens
WGLPSFAHC

SEQ ID NO: 939054 - protein, 9 aa, Homo Sapiens
PQTLPPAVL

SEQ ID NO: 939055 - protein, 9 aa, Homo Sapiens
VEELSVEEL

SEQ ID NO: 939056 - protein, 9 aa, Homo Sapiens
QIRSLKNLV

SEQ ID NO: 939057 - protein, 9 aa, Homo Sapiens
MIEYVLYPL

SEQ ID NO: 939058 - protein, 9 aa, Homo Sapiens
ERRLPPAPG

SEQ ID NO: 939059 - protein, 9 aa, Homo Sapiens
LHRLCTSRH

SEQ ID NO: 939060 - protein, 9 aa, Homo Sapiens
SLSLGEAPR

SEQ ID NO: 939061 - protein, 9 aa, Homo Sapiens
KMDKLLPLI

SEQ ID NO: 939062 - protein, 9 aa, Homo Sapiens
EAFEICPYN

SEQ ID NO: 939063 - protein, 9 aa, Homo Sapiens
VLQQVGNYC

SEQ ID NO: 939064 - protein, 9 aa, Homo Sapiens
QNLFTGHRF

SEQ ID NO: 939065 - protein, 9 aa, Homo Sapiens
AIALKGGRA

SEQ ID NO: 939066 - protein, 9 aa, Homo Sapiens
LSGACDKKG

SEQ ID NO: 939067 - protein, 9 aa, Homo Sapiens
TLMPPISSV

SEQ ID NO: 939068 - protein, 9 aa, Homo Sapiens
DCRRGFIQK

SEQ ID NO: 939069 - protein, 9 aa, Homo Sapiens
GFLDKLYNE

SEQ ID NO: 939070 - protein, 9 aa, Homo Sapiens
QGHFLLDPD

SEQ ID NO: 939071 - protein, 9 aa, Homo Sapiens
RNGKIYKNP

SEQ ID NO: 939072 - protein, 9 aa, Homo Sapiens
FLKSQVAEA

SEQ ID NO: 939073 - protein, 9 aa, Homo Sapiens
PRLPPSRRR

SEQ ID NO: 939074 - protein, 9 aa, Homo Sapiens
KYLLSSKTG

SEQ ID NO: 939075 - protein, 9 aa, Homo Sapiens
EKGGVESKG

SEQ ID NO: 939076 - protein, 9 aa, Homo Sapiens
KIYAGPKFA

SEQ ID NO: 939077 - protein, 9 aa, Homo Sapiens
CRKAPPKHF

SEQ ID NO: 939078 - protein, 9 aa, Homo Sapiens
VWLGELDKL

SEQ ID NO: 939079 - protein, 9 aa, Homo Sapiens
RGKGRANGT

SEQ ID NO: 939080 - protein, 9 aa, Homo Sapiens
LLTFYLNLT

SEQ ID NO: 939081 - protein, 9 aa, Homo Sapiens
PALQPPGRV

SEQ ID NO: 939082 - protein, 9 aa, Homo Sapiens
DIQLVGELV

SEQ ID NO: 939083 - protein, 9 aa, Homo Sapiens
HKEIAAACI

SEQ ID NO: 939084 - protein, 9 aa, Homo Sapiens
VYIILFQPQ

SEQ ID NO: 939085 - protein, 9 aa, Homo Sapiens
PHSQKSQHG

SEQ ID NO: 939086 - protein, 9 aa, Homo Sapiens
RWAVFSVMT

SEQ ID NO: 939087 - protein, 9 aa, Homo Sapiens
VKRTAKNVI

SEQ ID NO: 939088 - protein, 9 aa, Homo Sapiens
ESEEKRDPN

SEQ ID NO: 939089 - protein, 9 aa, Homo Sapiens
LQMTIWLEA

SEQ ID NO: 939090 - protein, 9 aa, Homo Sapiens
QKEGHFSRV

SEQ ID NO: 939091 - protein, 9 aa, Homo Sapiens
KKFSFSEFV

SEQ ID NO: 939092 - protein, 9 aa, Homo Sapiens
RQKVEFLVS

SEQ ID NO: 939093 - protein, 9 aa, Homo Sapiens
VRVPRQSFL

SEQ ID NO: 939094 - protein, 9 aa, Homo Sapiens
QEPPGLPGP

SEQ ID NO: 939095 - protein, 9 aa, Homo Sapiens
QHNRFYYEE

SEQ ID NO: 939096 - protein, 9 aa, Homo Sapiens
LSQFKRMKV

SEQ ID NO: 939097 - protein, 9 aa, Homo Sapiens
CTSVPLWMI

SEQ ID NO: 939098 - protein, 9 aa, Homo Sapiens
YSYIVSAVL

SEQ ID NO: 939099 - protein, 9 aa, Homo Sapiens
DLSRNCFTE

SEQ ID NO: 939100 - protein, 9 aa, Homo Sapiens
GGTCHCCRD

SEQ ID NO: 939101 - protein, 9 aa, Homo Sapiens
TMETLRDYA

SEQ ID NO: 939102 - protein, 9 aa, Homo Sapiens
EPTKKLPQG

SEQ ID NO: 939103 - protein, 9 aa, Homo Sapiens
ESNQQFQDL

SEQ ID NO: 939104 - protein, 9 aa, Homo Sapiens
TRLPTQEAR

SEQ ID NO: 939105 - protein, 9 aa, Homo Sapiens
TPKSITSLS

SEQ ID NO: 939106 - protein, 9 aa, Homo Sapiens
QDQLPSFPE

SEQ ID NO: 939107 - protein, 9 aa, Homo Sapiens
QIGMISVGP

SEQ ID NO: 939108 - protein, 9 aa, Homo Sapiens
EDKMKASED

SEQ ID NO: 939109 - protein, 9 aa, Homo Sapiens
KVPKKIVPE

SEQ ID NO: 939110 - protein, 9 aa, Homo Sapiens
FTVFIAINK

SEQ ID NO: 939111 - protein, 9 aa, Homo Sapiens
GTLYSFFLD

SEQ ID NO: 939112 - protein, 9 aa, Homo Sapiens
QNLSEENRL

SEQ ID NO: 939113 - protein, 9 aa, Homo Sapiens
HLNAIPILY

SEQ ID NO: 939114 - protein, 9 aa, Homo Sapiens
VMGMFTRLF

SEQ ID NO: 939115 - protein, 9 aa, Homo Sapiens
TKLILDGNK

SEQ ID NO: 939116 - protein, 9 aa, Homo Sapiens
LEEPAGPKS

SEQ ID NO: 939117 - protein, 9 aa, Homo Sapiens
LEEPAGPKP

SEQ ID NO: 939118 - protein, 9 aa, Homo Sapiens
MPSFGVSAS

SEQ ID NO: 939119 - protein, 8 aa, Homo Sapiens
SYSCGLPS

SEQ ID NO: 939120 - protein, 9 aa, Homo Sapiens
LLTRQRRTW

SEQ ID NO: 939121 - protein, 9 aa, Homo Sapiens
ETPPPVKDS

SEQ ID NO: 939122 - protein, 9 aa, Homo Sapiens
KSTKTFRSQ

SEQ ID NO: 939123 - protein, 9 aa, Homo Sapiens
SVVTTVWRV

SEQ ID NO: 939124 - protein, 9 aa, Homo Sapiens
DQEYDSKSS

SEQ ID NO: 939125 - protein, 9 aa, Homo Sapiens
IYFQHTAEL

SEQ ID NO: 939126 - protein, 9 aa, Homo Sapiens
QLHLSRMKS

SEQ ID NO: 939127 - protein, 9 aa, Homo Sapiens
SLWQKVISD

SEQ ID NO: 939128 - protein, 9 aa, Homo Sapiens
GSQLNASDW

SEQ ID NO: 939129 - protein, 9 aa, Homo Sapiens
DKLGPNSKT

SEQ ID NO: 939130 - protein, 9 aa, Homo Sapiens
LLLAPGRSA

SEQ ID NO: 939131 - protein, 9 aa, Homo Sapiens
YKKNKRRHE

SEQ ID NO: 939132 - protein, 9 aa, Homo Sapiens
VKDSEYVFV

SEQ ID NO: 939133 - protein, 9 aa, Homo Sapiens
LPEDIISSE

SEQ ID NO: 939134 - protein, 9 aa, Homo Sapiens
ELLGSGPSV

SEQ ID NO: 939135 - protein, 9 aa, Homo Sapiens
SLSKIQNAV

SEQ ID NO: 939136 - protein, 9 aa, Homo Sapiens
FGATNLKNF

SEQ ID NO: 939137 - protein, 9 aa, Homo Sapiens
GLIIITTPN

SEQ ID NO: 939138 - protein, 9 aa, Homo Sapiens
AGLVGSSQA

SEQ ID NO: 939139 - protein, 9 aa, Homo Sapiens
VNRFPCKNS

SEQ ID NO: 939140 - protein, 9 aa, Homo Sapiens
YNQNSQVEG

SEQ ID NO: 939141 - protein, 9 aa, Homo Sapiens
EGDAHFDED

SEQ ID NO: 939142 - protein, 9 aa, Homo Sapiens
IRCNEAGNI

SEQ ID NO: 939143 - protein, 9 aa, Homo Sapiens
KSCTCWGRN

SEQ ID NO: 939144 - protein, 9 aa, Homo Sapiens
VITKFGRKK

SEQ ID NO: 939145 - protein, 9 aa, Homo Sapiens
LDATGGPPA

SEQ ID NO: 939146 - protein, 9 aa, Homo Sapiens
KWARIWEFV

SEQ ID NO: 939147 - protein, 9 aa, Homo Sapiens
PTKKMYKIK

SEQ ID NO: 939148 - protein, 9 aa, Homo Sapiens
AFKHFLALR

SEQ ID NO: 939149 - protein, 9 aa, Homo Sapiens
LAVIKLACA

SEQ ID NO: 939150 - protein, 9 aa, Homo Sapiens
LINPEYVPK

SEQ ID NO: 939151 - protein, 9 aa, Homo Sapiens
KIKIPSFSE

SEQ ID NO: 939152 - protein, 9 aa, Homo Sapiens
LENFILKVA

SEQ ID NO: 939153 - protein, 9 aa, Homo Sapiens
CFWSFFLRD

SEQ ID NO: 939154 - protein, 9 aa, Homo Sapiens
SVLPPQRQD

SEQ ID NO: 939155 - protein, 9 aa, Homo Sapiens
QRELFRKRR

SEQ ID NO: 939156 - protein, 9 aa, Homo Sapiens
EVPLVWTDN

SEQ ID NO: 939157 - protein, 9 aa, Homo Sapiens
ILYTLSRAQ

SEQ ID NO: 939158 - protein, 9 aa, Homo Sapiens
DPYKLGDDG

SEQ ID NO: 939159 - protein, 9 aa, Homo Sapiens
IIKETVSRN

SEQ ID NO: 939160 - protein, 9 aa, Homo Sapiens
EEEEKEVEE

SEQ ID NO: 939161 - protein, 9 aa, Homo Sapiens
ASWLCPLLL

SEQ ID NO: 939162 - protein, 9 aa, Homo Sapiens
TSKKEEERR

SEQ ID NO: 939163 - protein, 9 aa, Homo Sapiens
AYACNPSTL

SEQ ID NO: 939164 - protein, 9 aa, Homo Sapiens
AITQVTFVF

SEQ ID NO: 939165 - protein, 9 aa, Homo Sapiens
LQGDNLEKR

SEQ ID NO: 939166 - protein, 9 aa, Homo Sapiens
HAQKSCTCW

SEQ ID NO: 939167 - protein, 9 aa, Homo Sapiens
FCALSTGEK

SEQ ID NO: 939168 - protein, 9 aa, Homo Sapiens
YCAIQGDLE

SEQ ID NO: 939169 - protein, 9 aa, Homo Sapiens
QNAVISEEH

SEQ ID NO: 939170 - protein, 9 aa, Homo Sapiens
PFSVPGRMV

SEQ ID NO: 939171 - protein, 9 aa, Homo Sapiens
PKKPKIQAS

SEQ ID NO: 939172 - protein, 9 aa, Homo Sapiens
SKNVEKILV

SEQ ID NO: 939173 - protein, 9 aa, Homo Sapiens
KRESQFVEE

SEQ ID NO: 939174 - protein, 9 aa, Homo Sapiens
LCLLGAGSL

SEQ ID NO: 939175 - protein, 9 aa, Homo Sapiens
DSAQVLIRE

SEQ ID NO: 939176 - protein, 9 aa, Homo Sapiens
RTRYSVPYG

SEQ ID NO: 939177 - protein, 9 aa, Homo Sapiens
RIEPSVFLW

SEQ ID NO: 939178 - protein, 9 aa, Homo Sapiens
LLRQVADWK

SEQ ID NO: 939179 - protein, 9 aa, Homo Sapiens
SPQSTSVQV

SEQ ID NO: 939180 - protein, 9 aa, Homo Sapiens
IPFEVLTLG

SEQ ID NO: 939181 - protein, 9 aa, Homo Sapiens
TLNAQISEL

SEQ ID NO: 939182 - protein, 9 aa, Homo Sapiens
RTSKKKSDT

SEQ ID NO: 939183 - protein, 9 aa, Homo Sapiens
EKWKTPFEK

SEQ ID NO: 939184 - protein, 9 aa, Homo Sapiens
NSQLKLYTN

SEQ ID NO: 939185 - protein, 9 aa, Homo Sapiens
EILFYNVTD

SEQ ID NO: 939186 - protein, 9 aa, Homo Sapiens
ALKALKKTL

SEQ ID NO: 939187 - protein, 9 aa, Homo Sapiens
VPLEEDSER

SEQ ID NO: 939188 - protein, 9 aa, Homo Sapiens
PFVCKDCRR

SEQ ID NO: 939189 - protein, 9 aa, Homo Sapiens
LRARSSSFS

SEQ ID NO: 939190 - protein, 9 aa, Homo Sapiens
HDFFSYFMD

SEQ ID NO: 939191 - protein, 9 aa, Homo Sapiens
QEALICTVF

SEQ ID NO: 939192 - protein, 9 aa, Homo Sapiens
VSGRYCGSV

SEQ ID NO: 939193 - protein, 9 aa, Homo Sapiens
MEVGEAADP

SEQ ID NO: 939194 - protein, 9 aa, Homo Sapiens
SQMLKGLLP

SEQ ID NO: 939195 - protein, 9 aa, Homo Sapiens
SQVEGKYIW

SEQ ID NO: 939196 - protein, 9 aa, Homo Sapiens
LKDGAETAV

SEQ ID NO: 939197 - protein, 9 aa, Homo Sapiens
TPVIIITEF

SEQ ID NO: 939198 - protein, 9 aa, Homo Sapiens
IEMDDEEDL

SEQ ID NO: 939199 - protein, 9 aa, Homo Sapiens
PALDRELPA

SEQ ID NO: 939200 - protein, 9 aa, Homo Sapiens
GYPDVEQPC

SEQ ID NO: 939201 - protein, 9 aa, Homo Sapiens
SEETNSSLI

SEQ ID NO: 939202 - protein, 9 aa, Homo Sapiens
KHKASLSRV

SEQ ID NO: 939203 - protein, 9 aa, Homo Sapiens
IELRRKFKK

SEQ ID NO: 939204 - protein, 9 aa, Homo Sapiens
KFATATGAT

SEQ ID NO: 939205 - protein, 9 aa, Homo Sapiens
EIKFLGDIK

SEQ ID NO: 939206 - protein, 9 aa, Homo Sapiens
VVLGFAVSF

SEQ ID NO: 939207 - protein, 9 aa, Homo Sapiens
IPLIVTETP

SEQ ID NO: 939208 - protein, 9 aa, Homo Sapiens
YESIGFLRQ

SEQ ID NO: 939209 - protein, 9 aa, Homo Sapiens
YFKEKWKTP

SEQ ID NO: 939210 - protein, 9 aa, Homo Sapiens
TEKQCVNRI

SEQ ID NO: 939211 - protein, 9 aa, Homo Sapiens
QERVYEMYV

SEQ ID NO: 939212 - protein, 9 aa, Homo Sapiens
KIGGKSLRR

SEQ ID NO: 939213 - protein, 9 aa, Homo Sapiens
AVPRVGGLF

SEQ ID NO: 939214 - protein, 9 aa, Homo Sapiens
FVAICHLLH

SEQ ID NO: 939215 - protein, 9 aa, Homo Sapiens
VFLMALSEN

SEQ ID NO: 939216 - protein, 9 aa, Homo Sapiens
IFCVNCMDC

SEQ ID NO: 939217 - protein, 9 aa, Homo Sapiens
QEYDSKSSQ

SEQ ID NO: 939218 - protein, 9 aa, Homo Sapiens
RSAEYFMQE

SEQ ID NO: 939219 - protein, 9 aa, Homo Sapiens
VTETPSKGF

SEQ ID NO: 939220 - protein, 9 aa, Homo Sapiens
SASWDLPST

SEQ ID NO: 939221 - protein, 9 aa, Homo Sapiens
LFCLHCGGT

SEQ ID NO: 939222 - protein, 9 aa, Homo Sapiens
YSPVHCRLE

SEQ ID NO: 939223 - protein, 9 aa, Homo Sapiens
SQMEKQSAV

SEQ ID NO: 939224 - protein, 9 aa, Homo Sapiens
FPFNSFDLT

SEQ ID NO: 939225 - protein, 9 aa, Homo Sapiens
EEPRALGIP

SEQ ID NO: 939226 - protein, 9 aa, Homo Sapiens
CNVTFRLSK

SEQ ID NO: 939227 - protein, 9 aa, Homo Sapiens
KDEKVISSY

SEQ ID NO: 939228 - protein, 9 aa, Homo Sapiens
LQREGMRQY

SEQ ID NO: 939229 - protein, 9 aa, Homo Sapiens
PPPDNPSIK

SEQ ID NO: 939230 - protein, 9 aa, Homo Sapiens
SSWEQAISN

SEQ ID NO: 939231 - protein, 9 aa, Homo Sapiens
ICNPANDAQ

SEQ ID NO: 939232 - protein, 9 aa, Homo Sapiens
LETKEPSMI

SEQ ID NO: 939233 - protein, 9 aa, Homo Sapiens
VDMGFLASA

SEQ ID NO: 939234 - protein, 9 aa, Homo Sapiens
YPDSVLPPQ

SEQ ID NO: 939235 - protein, 9 aa, Homo Sapiens
HHPREMKKK

SEQ ID NO: 939236 - protein, 9 aa, Homo Sapiens
GLGTDGSDE

SEQ ID NO: 939237 - protein, 9 aa, Homo Sapiens
CSCPRAFIG

SEQ ID NO: 939238 - protein, 9 aa, Homo Sapiens
QDRYTRNWF

SEQ ID NO: 939239 - protein, 9 aa, Homo Sapiens
EKVLQLSSF

SEQ ID NO: 939240 - protein, 9 aa, Homo Sapiens
YSYPVYARY

SEQ ID NO: 939241 - protein, 9 aa, Homo Sapiens
NKIDVRPCP

SEQ ID NO: 939242 - protein, 9 aa, Homo Sapiens
GGLNYFEGY

SEQ ID NO: 939243 - protein, 9 aa, Homo Sapiens
ILQNLKDHG

SEQ ID NO: 939244 - protein, 9 aa, Homo Sapiens
KPTSQVPAL

SEQ ID NO: 939245 - protein, 9 aa, Homo Sapiens
CNCICSSRP

SEQ ID NO: 939246 - protein, 9 aa, Homo Sapiens
KKFEVTVHV

SEQ ID NO: 939247 - protein, 9 aa, Homo Sapiens
KSRKTRVQM

SEQ ID NO: 939248 - protein, 9 aa, Homo Sapiens
QVQVLQEKE

SEQ ID NO: 939249 - protein, 9 aa, Homo Sapiens
ETLLLHKKS

SEQ ID NO: 939250 - protein, 9 aa, Homo Sapiens
FFFSDFGLM

SEQ ID NO: 939251 - protein, 9 aa, Homo Sapiens
DDKIESEAK

SEQ ID NO: 939252 - protein, 9 aa, Homo Sapiens
KIVGSATRY

SEQ ID NO: 939253 - protein, 9 aa, Homo Sapiens
SESEYVVKI

SEQ ID NO: 939254 - protein, 9 aa, Homo Sapiens
PGGCSPLSY

SEQ ID NO: 939255 - protein, 9 aa, Homo Sapiens
RINVYYNKA

SEQ ID NO: 939256 - protein, 9 aa, Homo Sapiens
SESEYVVKP

SEQ ID NO: 939257 - protein, 9 aa, Homo Sapiens
LKGNGDAVL

SEQ ID NO: 939258 - protein, 9 aa, Homo Sapiens
SESEYVVKV

SEQ ID NO: 939259 - protein, 9 aa, Homo Sapiens
FFFVLCQTQ

SEQ ID NO: 939260 - protein, 9 aa, Homo Sapiens
LKEIIEELR

SEQ ID NO: 939261 - protein, 9 aa, Homo Sapiens
TASQSSSHQ

SEQ ID NO: 939262 - protein, 9 aa, Homo Sapiens
ITDSETTTA

SEQ ID NO: 939263 - protein, 9 aa, Homo Sapiens
SKRTPDEFD

SEQ ID NO: 939264 - protein, 9 aa, Homo Sapiens
GIVQPNSSV

SEQ ID NO: 939265 - protein, 9 aa, Homo Sapiens
FTRSLFLSG

SEQ ID NO: 939266 - protein, 9 aa, Homo Sapiens
ISVLGCSYA

SEQ ID NO: 939267 - protein, 9 aa, Homo Sapiens
SYADFIKTT

SEQ ID NO: 939268 - protein, 9 aa, Homo Sapiens
EENTHARER

SEQ ID NO: 939269 - protein, 9 aa, Homo Sapiens
PSLREMKEG

SEQ ID NO: 939270 - protein, 9 aa, Homo Sapiens
ASENNLKPA

SEQ ID NO: 939271 - protein, 9 aa, Homo Sapiens
QISELKSDL

SEQ ID NO: 939272 - protein, 9 aa, Homo Sapiens
GIMVKEFKN

SEQ ID NO: 939273 - protein, 9 aa, Homo Sapiens
DVTESPRPG

SEQ ID NO: 939274 - protein, 9 aa, Homo Sapiens
VSGWGQEKD

SEQ ID NO: 939275 - protein, 9 aa, Homo Sapiens
GGSYACAGF

SEQ ID NO: 939276 - protein, 9 aa, Homo Sapiens
QQHYLGASY

SEQ ID NO: 939277 - protein, 9 aa, Homo Sapiens
KVSGIPSGM

SEQ ID NO: 939278 - protein, 9 aa, Homo Sapiens
NLEGKPVLF

SEQ ID NO: 939279 - protein, 9 aa, Homo Sapiens
YPSVYPETR

SEQ ID NO: 939280 - protein, 9 aa, Homo Sapiens
FQKGDQIVV

SEQ ID NO: 939281 - protein, 9 aa, Homo Sapiens
LNAQISELK

SEQ ID NO: 939282 - protein, 9 aa, Homo Sapiens
DQQIGQKVQ

SEQ ID NO: 939283 - protein, 9 aa, Homo Sapiens
SVWIEMDDE

SEQ ID NO: 939284 - protein, 9 aa, Homo Sapiens
CLRARPPGP

SEQ ID NO: 939285 - protein, 9 aa, Homo Sapiens
GFLMKKKLD

SEQ ID NO: 939286 - protein, 9 aa, Homo Sapiens
HVLQSVGGH

SEQ ID NO: 939287 - protein, 9 aa, Homo Sapiens
LPFWAITIF

SEQ ID NO: 939288 - protein, 9 aa, Homo Sapiens
SAGLMAPLV

SEQ ID NO: 939289 - protein, 9 aa, Homo Sapiens
LPAPQLGAQ

SEQ ID NO: 939290 - protein, 9 aa, Homo Sapiens
TEDSFTGFV

SEQ ID NO: 939291 - protein, 9 aa, Homo Sapiens
ALREPGRSK

SEQ ID NO: 939292 - protein, 9 aa, Homo Sapiens
FPIGDKVIF

SEQ ID NO: 939293 - protein, 9 aa, Homo Sapiens
VALFCTTLF

SEQ ID NO: 939294 - protein, 9 aa, Homo Sapiens
MFLQMKHTD

SEQ ID NO: 939295 - protein, 9 aa, Homo Sapiens
DQKTRQPVQ

SEQ ID NO: 939296 - protein, 9 aa, Homo Sapiens
RVQMSVGIF

SEQ ID NO: 939297 - protein, 9 aa, Homo Sapiens
WIEMDDEED

SEQ ID NO: 939298 - protein, 9 aa, Homo Sapiens
VSARAKVRR

SEQ ID NO: 939299 - protein, 9 aa, Homo Sapiens
GGPSPGGGA

SEQ ID NO: 939300 - protein, 9 aa, Homo Sapiens
EPWELLARV

SEQ ID NO: 939301 - protein, 9 aa, Homo Sapiens
DLGGGAERR

SEQ ID NO: 939302 - protein, 9 aa, Homo Sapiens
IVAITQVTF

SEQ ID NO: 939303 - protein, 9 aa, Homo Sapiens
PFSPAVTSL

SEQ ID NO: 939304 - protein, 9 aa, Homo Sapiens
GSTRLTLNG

SEQ ID NO: 939305 - protein, 9 aa, Homo Sapiens
WGLCEVLLS

SEQ ID NO: 939306 - protein, 9 aa, Homo Sapiens
WEGSLSSRT

SEQ ID NO: 939307 - protein, 9 aa, Homo Sapiens
LSEKDLNKV

SEQ ID NO: 939308 - protein, 9 aa, Homo Sapiens
ELPGSLENS

SEQ ID NO: 939309 - protein, 9 aa, Homo Sapiens
AKNVTFGMV

SEQ ID NO: 939310 - protein, 9 aa, Homo Sapiens
TLEGVPSAP

SEQ ID NO: 939311 - protein, 9 aa, Homo Sapiens
DSLEHKKLT

SEQ ID NO: 939312 - protein, 9 aa, Homo Sapiens
SLQEEKGKK

SEQ ID NO: 939313 - protein, 9 aa, Homo Sapiens
PPLPPLPGA

SEQ ID NO: 939314 - protein, 9 aa, Homo Sapiens
PSASPPASS

SEQ ID NO: 939315 - protein, 9 aa, Homo Sapiens
GILVFFLET

SEQ ID NO: 939316 - protein, 9 aa, Homo Sapiens
GIQKAVEEA

SEQ ID NO: 939317 - protein, 9 aa, Homo Sapiens
QPPGRVPSS

SEQ ID NO: 939318 - protein, 9 aa, Homo Sapiens
IHQQLYDCQ

SEQ ID NO: 939319 - protein, 9 aa, Homo Sapiens
QAEDINPEN

SEQ ID NO: 939320 - protein, 9 aa, Homo Sapiens
DFGQEVALN

SEQ ID NO: 939321 - protein, 9 aa, Homo Sapiens
ARDCFLHLL

SEQ ID NO: 939322 - protein, 9 aa, Homo Sapiens
WNKVFEFMV

SEQ ID NO: 939323 - protein, 9 aa, Homo Sapiens
REGLFKETI

SEQ ID NO: 939324 - protein, 9 aa, Homo Sapiens
GQDIPYATM

SEQ ID NO: 939325 - protein, 9 aa, Homo Sapiens
WISHWLLQQ

SEQ ID NO: 939326 - protein, 9 aa, Homo Sapiens
CGDSFPDDG

SEQ ID NO: 939327 - protein, 9 aa, Homo Sapiens
CIELCCGFV

SEQ ID NO: 939328 - protein, 9 aa, Homo Sapiens
LPNGSLEDC

SEQ ID NO: 939329 - protein, 9 aa, Homo Sapiens
KLGPNSKTD

SEQ ID NO: 939330 - protein, 9 aa, Homo Sapiens
LPRFLNDIS

SEQ ID NO: 939331 - protein, 9 aa, Homo Sapiens
TRVGILKTT

SEQ ID NO: 939332 - protein, 9 aa, Homo Sapiens
KTLQQVKII

SEQ ID NO: 939333 - protein, 9 aa, Homo Sapiens
ITELFMQLL

SEQ ID NO: 939334 - protein, 9 aa, Homo Sapiens
CQSKNCSKK

SEQ ID NO: 939335 - protein, 9 aa, Homo Sapiens
SAENIMPTT

SEQ ID NO: 939336 - protein, 9 aa, Homo Sapiens
FKRMKVVVR

SEQ ID NO: 939337 - protein, 9 aa, Homo Sapiens
AFAPGTGLE

SEQ ID NO: 939338 - protein, 9 aa, Homo Sapiens
KMTQIMFKT

SEQ ID NO: 939339 - protein, 9 aa, Homo Sapiens
EAEGYPDVE

SEQ ID NO: 939340 - protein, 9 aa, Homo Sapiens
IEARSTEDS

SEQ ID NO: 939341 - protein, 9 aa, Homo Sapiens
RDKELRHQQ

SEQ ID NO: 939342 - protein, 9 aa, Homo Sapiens
LHTLGFDFV

SEQ ID NO: 939343 - protein, 9 aa, Homo Sapiens
RKQQLQARG

SEQ ID NO: 939344 - protein, 9 aa, Homo Sapiens
YGRVLWNSE

SEQ ID NO: 939345 - protein, 9 aa, Homo Sapiens
SQHLPETGI

SEQ ID NO: 939346 - protein, 9 aa, Homo Sapiens
LLLSLPIRP

SEQ ID NO: 939347 - protein, 9 aa, Homo Sapiens
SYPSHGWKE

SEQ ID NO: 939348 - protein, 9 aa, Homo Sapiens
PKSSGPARV

SEQ ID NO: 939349 - protein, 9 aa, Homo Sapiens
QPALPTKRE

SEQ ID NO: 939350 - protein, 9 aa, Homo Sapiens
PSDLKENSK

SEQ ID NO: 939351 - protein, 9 aa, Homo Sapiens
SSTNYQEKK

SEQ ID NO: 939352 - protein, 9 aa, Homo Sapiens
MKEGPEFWA

SEQ ID NO: 939353 - protein, 9 aa, Homo Sapiens
NEAALGRAA

SEQ ID NO: 939354 - protein, 9 aa, Homo Sapiens
IFLLFINLY

SEQ ID NO: 939355 - protein, 9 aa, Homo Sapiens
EILLGSLAD

SEQ ID NO: 939356 - protein, 9 aa, Homo Sapiens
TISLQIWCS

SEQ ID NO: 939357 - protein, 9 aa, Homo Sapiens
RAVLHGVPS

SEQ ID NO: 939358 - protein, 9 aa, Homo Sapiens
LPISDHKLI

SEQ ID NO: 939359 - protein, 9 aa, Homo Sapiens
PRFLGQGEA

SEQ ID NO: 939360 - protein, 9 aa, Homo Sapiens
GNLSARHQV

SEQ ID NO: 939361 - protein, 9 aa, Homo Sapiens
GWEQQFLHL

SEQ ID NO: 939362 - protein, 9 aa, Homo Sapiens
LEKRTEESL

SEQ ID NO: 939363 - protein, 9 aa, Homo Sapiens
NKYKYKECK

SEQ ID NO: 939364 - protein, 9 aa, Homo Sapiens
QLRKLENEV

SEQ ID NO: 939365 - protein, 9 aa, Homo Sapiens
LDKNIPIPP

SEQ ID NO: 939366 - protein, 9 aa, Homo Sapiens
TPQPRFEAP

SEQ ID NO: 939367 - protein, 9 aa, Homo Sapiens
NPRKLLTIH

SEQ ID NO: 939368 - protein, 9 aa, Homo Sapiens
LFLTMIISY

SEQ ID NO: 939369 - protein, 9 aa, Homo Sapiens
VQQPGPRKI

SEQ ID NO: 939370 - protein, 9 aa, Homo Sapiens
TYHFWVFVV

SEQ ID NO: 939371 - protein, 9 aa, Homo Sapiens
PLANPPDIE

SEQ ID NO: 939372 - protein, 9 aa, Homo Sapiens
GEHTNVCVQ

SEQ ID NO: 939373 - protein, 9 aa, Homo Sapiens
TSPNTVSPS

SEQ ID NO: 939374 - protein, 9 aa, Homo Sapiens
LRGLFPSPT

SEQ ID NO: 939375 - protein, 9 aa, Homo Sapiens
QIADLFQPK

SEQ ID NO: 939376 - protein, 9 aa, Homo Sapiens
QNESNLELY

SEQ ID NO: 939377 - protein, 9 aa, Homo Sapiens
LALSNALRY

SEQ ID NO: 939378 - protein, 9 aa, Homo Sapiens
GRETFFLTF

SEQ ID NO: 939379 - protein, 9 aa, Homo Sapiens
DGSVRSGLG

SEQ ID NO: 939380 - protein, 9 aa, Homo Sapiens
TWCLIMAHS

SEQ ID NO: 939381 - protein, 9 aa, Homo Sapiens
CVWTTGSSL

SEQ ID NO: 939382 - protein, 9 aa, Homo Sapiens
EERKKKQKP

SEQ ID NO: 939383 - protein, 9 aa, Homo Sapiens
LLHYRIIMN

SEQ ID NO: 939384 - protein, 9 aa, Homo Sapiens
FNDKYNLVG

SEQ ID NO: 939385 - protein, 9 aa, Homo Sapiens
VKGTNKLRK

SEQ ID NO: 939386 - protein, 9 aa, Homo Sapiens
LSLLKDGRV

SEQ ID NO: 939387 - protein, 9 aa, Homo Sapiens
YTSKLFTPE

SEQ ID NO: 939388 - protein, 9 aa, Homo Sapiens
FLVKPGLNC

SEQ ID NO: 939389 - protein, 9 aa, Homo Sapiens
RGGRAETQG

SEQ ID NO: 939390 - protein, 9 aa, Homo Sapiens
GSESEAESF

SEQ ID NO: 939391 - protein, 9 aa, Homo Sapiens
SKDSRFAVA

SEQ ID NO: 939392 - protein, 9 aa, Homo Sapiens
ICKKRSLHA

SEQ ID NO: 939393 - protein, 9 aa, Homo Sapiens
PGSTSSRLK

SEQ ID NO: 939394 - protein, 9 aa, Homo Sapiens
KEPIPVLPI

SEQ ID NO: 939395 - protein, 9 aa, Homo Sapiens
LSSFRELCI

SEQ ID NO: 939396 - protein, 9 aa, Homo Sapiens
RNKSCENIH

SEQ ID NO: 939397 - protein, 9 aa, Homo Sapiens
NEPGIRSSK

SEQ ID NO: 939398 - protein, 9 aa, Homo Sapiens
NEAGNIEAK

SEQ ID NO: 939399 - protein, 9 aa, Homo Sapiens
PPFTGCGCP

SEQ ID NO: 939400 - protein, 9 aa, Homo Sapiens
NMDAAPACV

SEQ ID NO: 939401 - protein, 9 aa, Homo Sapiens
GIHPHPYPQ

SEQ ID NO: 939402 - protein, 9 aa, Homo Sapiens
DSEVVPVLA

SEQ ID NO: 939403 - protein, 9 aa, Homo Sapiens
SQFKRMKVV

SEQ ID NO: 939404 - protein, 9 aa, Homo Sapiens
KLGFYPQEA

SEQ ID NO: 939405 - protein, 9 aa, Homo Sapiens
KWNYSNLIH

SEQ ID NO: 939406 - protein, 9 aa, Homo Sapiens
LAEEAKQAL

SEQ ID NO: 939407 - protein, 9 aa, Homo Sapiens
KEAIKLLES

SEQ ID NO: 939408 - protein, 9 aa, Homo Sapiens
QLLRFRRKR

SEQ ID NO: 939409 - protein, 9 aa, Homo Sapiens
YQKIDENIL

SEQ ID NO: 939410 - protein, 9 aa, Homo Sapiens
CCGILVFFL

SEQ ID NO: 939411 - protein, 9 aa, Homo Sapiens
TKTFRSQAI

SEQ ID NO: 939412 - protein, 9 aa, Homo Sapiens
FSFCRNPIC

SEQ ID NO: 939413 - protein, 9 aa, Homo Sapiens
LQQRGQAST

SEQ ID NO: 939414 - protein, 9 aa, Homo Sapiens
ENEEPSLCA

SEQ ID NO: 939415 - protein, 9 aa, Homo Sapiens
VVDEVSVSF

SEQ ID NO: 939416 - protein, 9 aa, Homo Sapiens
EVLLKIMDA

SEQ ID NO: 939417 - protein, 9 aa, Homo Sapiens
KQKELQSEI

SEQ ID NO: 939418 - protein, 9 aa, Homo Sapiens
LTYEKRFFS

SEQ ID NO: 939419 - protein, 9 aa, Homo Sapiens
IRGHESEVF

SEQ ID NO: 939420 - protein, 9 aa, Homo Sapiens
EQRHNGLLC

SEQ ID NO: 939421 - protein, 9 aa, Homo Sapiens
KTLLKLSGE

SEQ ID NO: 939422 - protein, 9 aa, Homo Sapiens
RNAWREDVA

SEQ ID NO: 939423 - protein, 9 aa, Homo Sapiens
LAKLGFYPQ

SEQ ID NO: 939424 - protein, 9 aa, Homo Sapiens
NKITDLSRG

SEQ ID NO: 939425 - protein, 9 aa, Homo Sapiens
SARSRSSSP

SEQ ID NO: 939426 - protein, 9 aa, Homo Sapiens
WQKVISDWK

SEQ ID NO: 939427 - protein, 9 aa, Homo Sapiens
THSKNVRFP

SEQ ID NO: 939428 - protein, 9 aa, Homo Sapiens
CINCVHLYH

SEQ ID NO: 939429 - protein, 9 aa, Homo Sapiens
YAGLVGSSQ

SEQ ID NO: 939430 - protein, 9 aa, Homo Sapiens
PFPPRLTED

SEQ ID NO: 939431 - protein, 9 aa, Homo Sapiens
YEEIYSPEV

SEQ ID NO: 939432 - protein, 9 aa, Homo Sapiens
GEPGPEENA

SEQ ID NO: 939433 - protein, 9 aa, Homo Sapiens
RVSSKSPFP

SEQ ID NO: 939434 - protein, 9 aa, Homo Sapiens
VEMGPPDSI

SEQ ID NO: 939435 - protein, 9 aa, Homo Sapiens
ISQSWISHW

SEQ ID NO: 939436 - protein, 9 aa, Homo Sapiens
NKNIGLNRP

SEQ ID NO: 939437 - protein, 9 aa, Homo Sapiens
QLLTRQRRT

SEQ ID NO: 939438 - protein, 9 aa, Homo Sapiens
RNYSDGTIC

SEQ ID NO: 939439 - protein, 9 aa, Homo Sapiens
VHPENIKVW

SEQ ID NO: 939440 - protein, 9 aa, Homo Sapiens
KPEVPTEDV

SEQ ID NO: 939441 - protein, 9 aa, Homo Sapiens
AASVRPDGC

SEQ ID NO: 939442 - protein, 9 aa, Homo Sapiens
RGGLFLPPP

SEQ ID NO: 939443 - protein, 9 aa, Homo Sapiens
AIGFEKRLK

SEQ ID NO: 939444 - protein, 9 aa, Homo Sapiens
LMALSENAV

SEQ ID NO: 939445 - protein, 9 aa, Homo Sapiens
GKYIWSTMQ

SEQ ID NO: 939446 - protein, 9 aa, Homo Sapiens
RGSPGDTGK

SEQ ID NO: 939447 - protein, 9 aa, Homo Sapiens
DFIIVLANG

SEQ ID NO: 939448 - protein, 9 aa, Homo Sapiens
TDLLADLVV

SEQ ID NO: 939449 - protein, 9 aa, Homo Sapiens
GAAAALRVV

SEQ ID NO: 939450 - protein, 9 aa, Homo Sapiens
GLSRARDSK

SEQ ID NO: 939451 - protein, 9 aa, Homo Sapiens
DVFSEPKAV

SEQ ID NO: 939452 - protein, 9 aa, Homo Sapiens
KTLVSELIK

SEQ ID NO: 939453 - protein, 9 aa, Homo Sapiens
FFVLCQTQF

SEQ ID NO: 939454 - protein, 9 aa, Homo Sapiens
EQLFLQYGR

SEQ ID NO: 939455 - protein, 9 aa, Homo Sapiens
DYPLPSAER

SEQ ID NO: 939456 - protein, 9 aa, Homo Sapiens
LVPSELIFA

SEQ ID NO: 939457 - protein, 9 aa, Homo Sapiens
ALKRVFWKQ

SEQ ID NO: 939458 - protein, 9 aa, Homo Sapiens
FRQMNTNND

SEQ ID NO: 939459 - protein, 9 aa, Homo Sapiens
LPKPPGNLF

SEQ ID NO: 939460 - protein, 9 aa, Homo Sapiens
LQKKRLSNV

SEQ ID NO: 939461 - protein, 9 aa, Homo Sapiens
PECREKQSQ

SEQ ID NO: 939462 - protein, 9 aa, Homo Sapiens
LHYNKELNI

SEQ ID NO: 939463 - protein, 9 aa, Homo Sapiens
LWEAEATSA

SEQ ID NO: 939464 - protein, 9 aa, Homo Sapiens
EAVKSAMNT

SEQ ID NO: 939465 - protein, 9 aa, Homo Sapiens
PGPLGEAGV

SEQ ID NO: 939466 - protein, 9 aa, Homo Sapiens
SASSFAPNK

SEQ ID NO: 939467 - protein, 9 aa, Homo Sapiens
NKEVVSHPG

SEQ ID NO: 939468 - protein, 9 aa, Homo Sapiens
GVCLVTPVT

SEQ ID NO: 939469 - protein, 9 aa, Homo Sapiens
SSYLLHGSN

SEQ ID NO: 939470 - protein, 9 aa, Homo Sapiens
SCPVLLHLA

SEQ ID NO: 939471 - protein, 9 aa, Homo Sapiens
LSRARDSKT

SEQ ID NO: 939472 - protein, 9 aa, Homo Sapiens
AGAIPQERV

SEQ ID NO: 939473 - protein, 9 aa, Homo Sapiens
LFCTTLFGD

SEQ ID NO: 939474 - protein, 9 aa, Homo Sapiens
VSAKGNGCC

SEQ ID NO: 939475 - protein, 9 aa, Homo Sapiens
KWINDTIKK

SEQ ID NO: 939476 - protein, 9 aa, Homo Sapiens
SPDRVFNTL

SEQ ID NO: 939477 - protein, 9 aa, Homo Sapiens
HADIKTSYL

SEQ ID NO: 939478 - protein, 9 aa, Homo Sapiens
ARIKTTVFQ

SEQ ID NO: 939479 - protein, 9 aa, Homo Sapiens
APTSPLCET

SEQ ID NO: 939480 - protein, 9 aa, Homo Sapiens
KSLAPKHPG

SEQ ID NO: 939481 - protein, 9 aa, Homo Sapiens
NPPDIEFAK

SEQ ID NO: 939482 - protein, 9 aa, Homo Sapiens
PIGDKVIFS

SEQ ID NO: 939483 - protein, 9 aa, Homo Sapiens
VYPETRHWT

SEQ ID NO: 939484 - protein, 9 aa, Homo Sapiens
AHLQNVFML

SEQ ID NO: 939485 - protein, 9 aa, Homo Sapiens
LQKECETAG

SEQ ID NO: 939486 - protein, 9 aa, Homo Sapiens
QKELEQLFL

SEQ ID NO: 939487 - protein, 9 aa, Homo Sapiens
SLDINKTEG

SEQ ID NO: 939488 - protein, 9 aa, Homo Sapiens
SDAQPMGPE

SEQ ID NO: 939489 - protein, 9 aa, Homo Sapiens
PSTTFFTPG

SEQ ID NO: 939490 - protein, 9 aa, Homo Sapiens
KERIVAAFF

SEQ ID NO: 939491 - protein, 9 aa, Homo Sapiens
EENNLSEEI

SEQ ID NO: 939492 - protein, 9 aa, Homo Sapiens
VSVKMLAAP

SEQ ID NO: 939493 - protein, 9 aa, Homo Sapiens
FWDNSIPNH

SEQ ID NO: 939494 - protein, 9 aa, Homo Sapiens
AVSFSIIAV

SEQ ID NO: 939495 - protein, 9 aa, Homo Sapiens
LNRPLSPHI

SEQ ID NO: 939496 - protein, 9 aa, Homo Sapiens
ISLLIPSQV

SEQ ID NO: 939497 - protein, 9 aa, Homo Sapiens
ASGSVEDLL

SEQ ID NO: 939498 - protein, 9 aa, Homo Sapiens
SDKHLNAIP

SEQ ID NO: 939499 - protein, 9 aa, Homo Sapiens
VSLPLVLQP

SEQ ID NO: 939500 - protein, 9 aa, Homo Sapiens
KAEKENQVQ

SEQ ID NO: 939501 - protein, 9 aa, Homo Sapiens
EGYYYNSFT

SEQ ID NO: 939502 - protein, 9 aa, Homo Sapiens
FMELDGLRE

SEQ ID NO: 939503 - protein, 9 aa, Homo Sapiens
LTGLLSLVL

SEQ ID NO: 939504 - protein, 9 aa, Homo Sapiens
RDVVDRVVA

SEQ ID NO: 939505 - protein, 9 aa, Homo Sapiens
KHLKTLCHP

SEQ ID NO: 939506 - protein, 9 aa, Homo Sapiens
LENSNNDCF

SEQ ID NO: 939507 - protein, 9 aa, Homo Sapiens
MWNNIAAAD

SEQ ID NO: 939508 - protein, 9 aa, Homo Sapiens
GKQESLQEE

SEQ ID NO: 939509 - protein, 9 aa, Homo Sapiens
MALSENAVL

SEQ ID NO: 939510 - protein, 9 aa, Homo Sapiens
HVSLLLIAQ

SEQ ID NO: 939511 - protein, 9 aa, Homo Sapiens
KTKLKITQL

SEQ ID NO: 939512 - protein, 9 aa, Homo Sapiens
TAKEEFLFP

SEQ ID NO: 939513 - protein, 9 aa, Homo Sapiens
PTNGQPQTQ

SEQ ID NO: 939514 - protein, 9 aa, Homo Sapiens
DRVKLFSHR

SEQ ID NO: 939515 - protein, 9 aa, Homo Sapiens
QVLIREVLI

SEQ ID NO: 939516 - protein, 9 aa, Homo Sapiens
TLLVRLVRS

SEQ ID NO: 939517 - protein, 9 aa, Homo Sapiens
KQKEKLWEQ

SEQ ID NO: 939518 - protein, 9 aa, Homo Sapiens
FIYKVTEGR

SEQ ID NO: 939519 - protein, 9 aa, Homo Sapiens
TTYVNANKE

SEQ ID NO: 939520 - protein, 9 aa, Homo Sapiens
EVRNTTGLT

SEQ ID NO: 939521 - protein, 9 aa, Homo Sapiens
FFSYFMDHF

SEQ ID NO: 939522 - protein, 9 aa, Homo Sapiens
PPSRGPCDS

SEQ ID NO: 939523 - protein, 9 aa, Homo Sapiens
PSLVSMGRS

SEQ ID NO: 939524 - protein, 9 aa, Homo Sapiens
VLFYKTYHF

SEQ ID NO: 939525 - protein, 9 aa, Homo Sapiens
NIINLLTSD

SEQ ID NO: 939526 - protein, 9 aa, Homo Sapiens
CETLVHLNL

SEQ ID NO: 939527 - protein, 9 aa, Homo Sapiens
MEFQVKNVS

SEQ ID NO: 939528 - protein, 9 aa, Homo Sapiens
VDSDGLIII

SEQ ID NO: 939529 - protein, 9 aa, Homo Sapiens
QSTSVQVKG

SEQ ID NO: 939530 - protein, 9 aa, Homo Sapiens
STEATDIGF

SEQ ID NO: 939531 - protein, 9 aa, Homo Sapiens
NSDSFASHS

SEQ ID NO: 939532 - protein, 9 aa, Homo Sapiens
DFLIIYIKE

SEQ ID NO: 939533 - protein, 9 aa, Homo Sapiens
RALPKGPLV

SEQ ID NO: 939534 - protein, 9 aa, Homo Sapiens
RCHRRKDRK

SEQ ID NO: 939535 - protein, 9 aa, Homo Sapiens
LHTLYLLDK

SEQ ID NO: 939536 - protein, 9 aa, Homo Sapiens
KNVRFPGFI

SEQ ID NO: 939537 - protein, 9 aa, Homo Sapiens
RFLVRTHIL

SEQ ID NO: 939538 - protein, 9 aa, Homo Sapiens
FTGCGCPPG

SEQ ID NO: 939539 - protein, 9 aa, Homo Sapiens
LGAGSLEAQ

SEQ ID NO: 939540 - protein, 9 aa, Homo Sapiens
IIFCKISDV

SEQ ID NO: 939541 - protein, 9 aa, Homo Sapiens
VKNVSSERI

SEQ ID NO: 939542 - protein, 9 aa, Homo Sapiens
HRTIHGQTG

SEQ ID NO: 939543 - protein, 9 aa, Homo Sapiens
SKKAPREHL

SEQ ID NO: 939544 - protein, 9 aa, Homo Sapiens
DTVELLKRD

SEQ ID NO: 939545 - protein, 9 aa, Homo Sapiens
PCVAMLRLL

SEQ ID NO: 939546 - protein, 9 aa, Homo Sapiens
ETLLQQNFE

SEQ ID NO: 939547 - protein, 9 aa, Homo Sapiens
SGCRNQRYK

SEQ ID NO: 939548 - protein, 9 aa, Homo Sapiens
VTVEPRRQK

SEQ ID NO: 939549 - protein, 9 aa, Homo Sapiens
SEERESTEA

SEQ ID NO: 939550 - protein, 9 aa, Homo Sapiens
FASRYASPE

SEQ ID NO: 939551 - protein, 9 aa, Homo Sapiens
SSDPGAFVL

SEQ ID NO: 939552 - protein, 9 aa, Homo Sapiens
DQFLEQVTL

SEQ ID NO: 939553 - protein, 9 aa, Homo Sapiens
FLGSLSKDQ

SEQ ID NO: 939554 - protein, 9 aa, Homo Sapiens
EKADSSHFE

SEQ ID NO: 939555 - protein, 9 aa, Homo Sapiens
ADPEVRNTT

SEQ ID NO: 939556 - protein, 9 aa, Homo Sapiens
AKHLKTLCH

SEQ ID NO: 939557 - protein, 9 aa, Homo Sapiens
LPDPRNECY

SEQ ID NO: 939558 - protein, 9 aa, Homo Sapiens
KDDIQLVGE

SEQ ID NO: 939559 - protein, 9 aa, Homo Sapiens
KVSHVAADP

SEQ ID NO: 939560 - protein, 9 aa, Homo Sapiens
SINNNLNLR

SEQ ID NO: 939561 - protein, 9 aa, Homo Sapiens
FAEAKKFVK

SEQ ID NO: 939562 - protein, 9 aa, Homo Sapiens
PLNLPVANG

SEQ ID NO: 939563 - protein, 9 aa, Homo Sapiens
FTSKRTPDE

SEQ ID NO: 939564 - protein, 9 aa, Homo Sapiens
GQNVNIILQ

SEQ ID NO: 939565 - protein, 9 aa, Homo Sapiens
EKKRIKRAG

SEQ ID NO: 939566 - protein, 9 aa, Homo Sapiens
EELPGEACT

SEQ ID NO: 939567 - protein, 9 aa, Homo Sapiens
RNIPLMLND

SEQ ID NO: 939568 - protein, 9 aa, Homo Sapiens
PFMPPRNLP

SEQ ID NO: 939569 - protein, 9 aa, Homo Sapiens
KSPTWGEPS

SEQ ID NO: 939570 - protein, 9 aa, Homo Sapiens
VRVSWANNS

SEQ ID NO: 939571 - protein, 9 aa, Homo Sapiens
EEKRTLLVR

SEQ ID NO: 939572 - protein, 9 aa, Homo Sapiens
QGHLEKYGK

SEQ ID NO: 939573 - protein, 9 aa, Homo Sapiens
YVFIACCQT

SEQ ID NO: 939574 - protein, 9 aa, Homo Sapiens
PSFRKELEG

SEQ ID NO: 939575 - protein, 9 aa, Homo Sapiens
AVYPIILLF

SEQ ID NO: 939576 - protein, 9 aa, Homo Sapiens
VVSHSKRHK

SEQ ID NO: 939577 - protein, 9 aa, Homo Sapiens
YNWATVGER

SEQ ID NO: 939578 - protein, 9 aa, Homo Sapiens
GLEGDAHFD

SEQ ID NO: 939579 - protein, 9 aa, Homo Sapiens
CSYLSSKDS

SEQ ID NO: 939580 - protein, 9 aa, Homo Sapiens
YLRPGFRKA

SEQ ID NO: 939581 - protein, 9 aa, Homo Sapiens
AAAALRVVA

SEQ ID NO: 939582 - protein, 9 aa, Homo Sapiens
DHLNGLLWE

SEQ ID NO: 939583 - protein, 9 aa, Homo Sapiens
VLNDMGCIN

SEQ ID NO: 939584 - protein, 9 aa, Homo Sapiens
DKTHYPDAF

SEQ ID NO: 939585 - protein, 9 aa, Homo Sapiens
KSVFVMEVG

SEQ ID NO: 939586 - protein, 9 aa, Homo Sapiens
IPKGRKKDC

SEQ ID NO: 939587 - protein, 9 aa, Homo Sapiens
QEGIFCVNC

SEQ ID NO: 939588 - protein, 9 aa, Homo Sapiens
LQEKEPPCF

SEQ ID NO: 939589 - protein, 9 aa, Homo Sapiens
GGREQPAQP

SEQ ID NO: 939590 - protein, 9 aa, Homo Sapiens
RLTASLQIS

SEQ ID NO: 939591 - protein, 9 aa, Homo Sapiens
FGEMGSPPA

SEQ ID NO: 939592 - protein, 9 aa, Homo Sapiens
KREQISENS

SEQ ID NO: 939593 - protein, 9 aa, Homo Sapiens
PEKKEEREP

SEQ ID NO: 939594 - protein, 9 aa, Homo Sapiens
YYDALQQYE

SEQ ID NO: 939595 - protein, 9 aa, Homo Sapiens
VTQTCTTKF

SEQ ID NO: 939596 - protein, 9 aa, Homo Sapiens
SETISLQIW

SEQ ID NO: 939597 - protein, 9 aa, Homo Sapiens
RPRPCLFKG

SEQ ID NO: 939598 - protein, 9 aa, Homo Sapiens
LKGGKRKEE

SEQ ID NO: 939599 - protein, 9 aa, Homo Sapiens
PRDTISKQD

SEQ ID NO: 939600 - protein, 9 aa, Homo Sapiens
SYEDEPCRP

SEQ ID NO: 939601 - protein, 9 aa, Homo Sapiens
PPGAGPQQF

SEQ ID NO: 939602 - protein, 9 aa, Homo Sapiens
RAFIGKDCG

SEQ ID NO: 939603 - protein, 9 aa, Homo Sapiens
YDPEKENIK

SEQ ID NO: 939604 - protein, 9 aa, Homo Sapiens
KRDALAALH

SEQ ID NO: 939605 - protein, 9 aa, Homo Sapiens
SIVPYSPYK

SEQ ID NO: 939606 - protein, 9 aa, Homo Sapiens
TCALLHQTL

SEQ ID NO: 939607 - protein, 9 aa, Homo Sapiens
KSGLAFRKN

SEQ ID NO: 939608 - protein, 9 aa, Homo Sapiens
VMYDEIKSQ

SEQ ID NO: 939609 - protein, 9 aa, Homo Sapiens
CANPIFYGF

SEQ ID NO: 939610 - protein, 9 aa, Homo Sapiens
KHQHYKKTK

SEQ ID NO: 939611 - protein, 9 aa, Homo Sapiens
MLAAHCVAN

SEQ ID NO: 939612 - protein, 9 aa, Homo Sapiens
PHLQNLFTG

SEQ ID NO: 939613 - protein, 9 aa, Homo Sapiens
AFCELPLDN

SEQ ID NO: 939614 - protein, 9 aa, Homo Sapiens
NKNRRKSCQ

SEQ ID NO: 939615 - protein, 9 aa, Homo Sapiens
DLLAYCAIQ

SEQ ID NO: 939616 - protein, 9 aa, Homo Sapiens
LQKKKQSMS

SEQ ID NO: 939617 - protein, 9 aa, Homo Sapiens
EFQVKNVSS

SEQ ID NO: 939618 - protein, 9 aa, Homo Sapiens
QDMVHIRQE

SEQ ID NO: 939619 - protein, 9 aa, Homo Sapiens
RALRPLCAL

SEQ ID NO: 939620 - protein, 9 aa, Homo Sapiens
WPASSGSLT

SEQ ID NO: 939621 - protein, 9 aa, Homo Sapiens
ARALKIWEE

SEQ ID NO: 939622 - protein, 9 aa, Homo Sapiens
WFSIFNPER

SEQ ID NO: 939623 - protein, 9 aa, Homo Sapiens
EQGHQLFHI

SEQ ID NO: 939624 - protein, 9 aa, Homo Sapiens
GLSGRETFF

SEQ ID NO: 939625 - protein, 9 aa, Homo Sapiens
GTEGGGSGG

SEQ ID NO: 939626 - protein, 9 aa, Homo Sapiens
TQRMQSFNE

SEQ ID NO: 939627 - protein, 9 aa, Homo Sapiens
WYRQILRQK

SEQ ID NO: 939628 - protein, 9 aa, Homo Sapiens
GHPGPSTTF

SEQ ID NO: 939629 - protein, 9 aa, Homo Sapiens
LPGQKVSHV

SEQ ID NO: 939630 - protein, 9 aa, Homo Sapiens
APTYLSDSH

SEQ ID NO: 939631 - protein, 9 aa, Homo Sapiens
CRLELKKLL

SEQ ID NO: 939632 - protein, 9 aa, Homo Sapiens
TRKSDDEDD

SEQ ID NO: 939633 - protein, 9 aa, Homo Sapiens
FQCDRLDDC

SEQ ID NO: 939634 - protein, 9 aa, Homo Sapiens
FLQQQMPTL

SEQ ID NO: 939635 - protein, 9 aa, Homo Sapiens
LGVRFEDYE

SEQ ID NO: 939636 - protein, 9 aa, Homo Sapiens
LGLSEWPEK

SEQ ID NO: 939637 - protein, 9 aa, Homo Sapiens
SLTKFRVNI

SEQ ID NO: 939638 - protein, 9 aa, Homo Sapiens
ACNSLGTIP

SEQ ID NO: 939639 - protein, 9 aa, Homo Sapiens
MNGSLYQEL

SEQ ID NO: 939640 - protein, 9 aa, Homo Sapiens
FPECAYETR

SEQ ID NO: 939641 - protein, 9 aa, Homo Sapiens
KKNKRRHET

SEQ ID NO: 939642 - protein, 9 aa, Homo Sapiens
QSSSLGSSD

SEQ ID NO: 939643 - protein, 9 aa, Homo Sapiens
PSSSISLGR

SEQ ID NO: 939644 - protein, 9 aa, Homo Sapiens
WEEMKKTKG

SEQ ID NO: 939645 - protein, 9 aa, Homo Sapiens
GAQVQVLQE

SEQ ID NO: 939646 - protein, 9 aa, Homo Sapiens
SSFLNWEFA

SEQ ID NO: 939647 - protein, 9 aa, Homo Sapiens
HNGLGYSAR

SEQ ID NO: 939648 - protein, 9 aa, Homo Sapiens
SEIPLDFLD

SEQ ID NO: 939649 - protein, 9 aa, Homo Sapiens
LDESKEHIE

SEQ ID NO: 939650 - protein, 9 aa, Homo Sapiens
DDFTDNPRW

SEQ ID NO: 939651 - protein, 9 aa, Homo Sapiens
GNIIHYIFD

SEQ ID NO: 939652 - protein, 9 aa, Homo Sapiens
KENQVQELV

SEQ ID NO: 939653 - protein, 9 aa, Homo Sapiens
KSSGPARVI

SEQ ID NO: 939654 - protein, 9 aa, Homo Sapiens
CDQFLEQVT

SEQ ID NO: 939655 - protein, 9 aa, Homo Sapiens
IDKPNAIVS

SEQ ID NO: 939656 - protein, 9 aa, Homo Sapiens
SPNDHVNSN

SEQ ID NO: 939657 - protein, 9 aa, Homo Sapiens
GQFASPAGK

SEQ ID NO: 939658 - protein, 9 aa, Homo Sapiens
LQEMPGERG

SEQ ID NO: 939659 - protein, 9 aa, Homo Sapiens
FSLAPGFIR

SEQ ID NO: 939660 - protein, 9 aa, Homo Sapiens
GYWAEGLIL

SEQ ID NO: 939661 - protein, 9 aa, Homo Sapiens
WRTKYEIDA

SEQ ID NO: 939662 - protein, 9 aa, Homo Sapiens
IEKNDVVFF

SEQ ID NO: 939663 - protein, 9 aa, Homo Sapiens
INGTQNYIP

SEQ ID NO: 939664 - protein, 9 aa, Homo Sapiens
IKSLVKGHP

SEQ ID NO: 939665 - protein, 9 aa, Homo Sapiens
FSRSKLQTV

SEQ ID NO: 939666 - protein, 9 aa, Homo Sapiens
KGTYECVVL

SEQ ID NO: 939667 - protein, 9 aa, Homo Sapiens
QLPSFPENC

SEQ ID NO: 939668 - protein, 9 aa, Homo Sapiens
NGHVIKMKH

SEQ ID NO: 939669 - protein, 9 aa, Homo Sapiens
QQFRPLAAL

SEQ ID NO: 939670 - protein, 9 aa, Homo Sapiens
GEHTWSLAK

SEQ ID NO: 939671 - protein, 9 aa, Homo Sapiens
SDSFASHSN

SEQ ID NO: 939672 - protein, 9 aa, Homo Sapiens
AEKATSRRS

SEQ ID NO: 939673 - protein, 9 aa, Homo Sapiens
YGQLPMLFS

SEQ ID NO: 939674 - protein, 9 aa, Homo Sapiens
LPEGWSSYL

SEQ ID NO: 939675 - protein, 9 aa, Homo Sapiens
QLQVQAKAD

SEQ ID NO: 939676 - protein, 9 aa, Homo Sapiens
KKLIQLPSA

SEQ ID NO: 939677 - protein, 9 aa, Homo Sapiens
AAVFASIYF

SEQ ID NO: 939678 - protein, 9 aa, Homo Sapiens
ELRQGLSKL

SEQ ID NO: 939679 - protein, 9 aa, Homo Sapiens
GQYYDYDFS

SEQ ID NO: 939680 - protein, 9 aa, Homo Sapiens
ATPRMHHFS

SEQ ID NO: 939681 - protein, 9 aa, Homo Sapiens
VSGRRYNLK

SEQ ID NO: 939682 - protein, 9 aa, Homo Sapiens
DVDGLRVWF

SEQ ID NO: 939683 - protein, 9 aa, Homo Sapiens
PDHDLEIIL

SEQ ID NO: 939684 - protein, 9 aa, Homo Sapiens
NQTLLNQPA

SEQ ID NO: 939685 - protein, 9 aa, Homo Sapiens
NSKTDHVTP

SEQ ID NO: 939686 - protein, 9 aa, Homo Sapiens
DTIFPSCIC

SEQ ID NO: 939687 - protein, 9 aa, Homo Sapiens
LKGSAVPPE

SEQ ID NO: 939688 - protein, 9 aa, Homo Sapiens
VLWNSEQNL

SEQ ID NO: 939689 - protein, 9 aa, Homo Sapiens
NFSYSAGTE

SEQ ID NO: 939690 - protein, 9 aa, Homo Sapiens
EKLRSQLAE

SEQ ID NO: 939691 - protein, 9 aa, Homo Sapiens
LGEVVMRVT

SEQ ID NO: 939692 - protein, 9 aa, Homo Sapiens
GKMIQVPET

SEQ ID NO: 939693 - protein, 9 aa, Homo Sapiens
EAAHQDLWS

SEQ ID NO: 939694 - protein, 9 aa, Homo Sapiens
DAKFFARIK

SEQ ID NO: 939695 - protein, 9 aa, Homo Sapiens
RYQRVDKAL

SEQ ID NO: 939696 - protein, 9 aa, Homo Sapiens
PTMTKKIKE

SEQ ID NO: 939697 - protein, 9 aa, Homo Sapiens
LSPDVCRKN

SEQ ID NO: 939698 - protein, 9 aa, Homo Sapiens
DHFPLLSRK

SEQ ID NO: 939699 - protein, 9 aa, Homo Sapiens
AQIRSLKNL

SEQ ID NO: 939700 - protein, 9 aa, Homo Sapiens
RTKYEIDAI

SEQ ID NO: 939701 - protein, 9 aa, Homo Sapiens
NNFHDKNGM

SEQ ID NO: 939702 - protein, 9 aa, Homo Sapiens
LQLVSKWQA

SEQ ID NO: 939703 - protein, 9 aa, Homo Sapiens
AGLGLLKAY

SEQ ID NO: 939704 - protein, 9 aa, Homo Sapiens
TQQLPALGN

SEQ ID NO: 939705 - protein, 9 aa, Homo Sapiens
GGHGLCSES

SEQ ID NO: 939706 - protein, 9 aa, Homo Sapiens
QSYLMVLQY

SEQ ID NO: 939707 - protein, 9 aa, Homo Sapiens
LKPLYFCRI

SEQ ID NO: 939708 - protein, 9 aa, Homo Sapiens
LDPSSFQTI

SEQ ID NO: 939709 - protein, 9 aa, Homo Sapiens
ASVRPDGCP

SEQ ID NO: 939710 - protein, 9 aa, Homo Sapiens
YFAISNYVF

SEQ ID NO: 939711 - protein, 9 aa, Homo Sapiens
KCSHEQSVH

SEQ ID NO: 939712 - protein, 9 aa, Homo Sapiens
SLGGIIYLV

SEQ ID NO: 939713 - protein, 9 aa, Homo Sapiens
SGSALAAVA

SEQ ID NO: 939714 - protein, 9 aa, Homo Sapiens
VPPTKAPKV

SEQ ID NO: 939715 - protein, 9 aa, Homo Sapiens
PEKREARTV

SEQ ID NO: 939716 - protein, 9 aa, Homo Sapiens
VKQATLNSA

SEQ ID NO: 939717 - protein, 9 aa, Homo Sapiens
LLEHEETNM

SEQ ID NO: 939718 - protein, 9 aa, Homo Sapiens
AVFPGSSSS

SEQ ID NO: 939719 - protein, 9 aa, Homo Sapiens
CKAASSIDQ

SEQ ID NO: 939720 - protein, 9 aa, Homo Sapiens
KPNAIVSDG

SEQ ID NO: 939721 - protein, 9 aa, Homo Sapiens
KQSPLESPI

SEQ ID NO: 939722 - protein, 9 aa, Homo Sapiens
NVTVLVSDV

SEQ ID NO: 939723 - protein, 9 aa, Homo Sapiens
HLTGLLSLV

SEQ ID NO: 939724 - protein, 9 aa, Homo Sapiens
LEKRMGVCL

SEQ ID NO: 939725 - protein, 9 aa, Homo Sapiens
PVLFFWQNS

SEQ ID NO: 939726 - protein, 9 aa, Homo Sapiens
QPWPRFLGQ

SEQ ID NO: 939727 - protein, 9 aa, Homo Sapiens
LSLRMARRT

SEQ ID NO: 939728 - protein, 9 aa, Homo Sapiens
MKYFKNFSS

SEQ ID NO: 939729 - protein, 9 aa, Homo Sapiens
SNKWPMGGN

SEQ ID NO: 939730 - protein, 9 aa, Homo Sapiens
LVPKTDKTK

SEQ ID NO: 939731 - protein, 9 aa, Homo Sapiens
MGDVVNILA

SEQ ID NO: 939732 - protein, 9 aa, Homo Sapiens
FYASNYVPK

SEQ ID NO: 939733 - protein, 9 aa, Homo Sapiens
MPLCNGENL

SEQ ID NO: 939734 - protein, 9 aa, Homo Sapiens
ETKEPSMIE

SEQ ID NO: 939735 - protein, 9 aa, Homo Sapiens
RKKKNSLDW

SEQ ID NO: 939736 - protein, 9 aa, Homo Sapiens
IFQSMFSTV

SEQ ID NO: 939737 - protein, 9 aa, Homo Sapiens
AAETLLQQN

SEQ ID NO: 939738 - protein, 9 aa, Homo Sapiens
HKKKYMELE

SEQ ID NO: 939739 - protein, 9 aa, Homo Sapiens
LQVQYAILS

SEQ ID NO: 939740 - protein, 9 aa, Homo Sapiens
QLLISYSYI

SEQ ID NO: 939741 - protein, 9 aa, Homo Sapiens
LSVVTTVWR

SEQ ID NO: 939742 - protein, 9 aa, Homo Sapiens
ETAKKLTPF

SEQ ID NO: 939743 - protein, 9 aa, Homo Sapiens
STSILVSLT

SEQ ID NO: 939744 - protein, 9 aa, Homo Sapiens
FDDMPRSAE

SEQ ID NO: 939745 - protein, 9 aa, Homo Sapiens
PLPNAQGLA

SEQ ID NO: 939746 - protein, 9 aa, Homo Sapiens
TISWGLPRT

SEQ ID NO: 939747 - protein, 9 aa, Homo Sapiens
RGPRAGSTR

SEQ ID NO: 939748 - protein, 9 aa, Homo Sapiens
QVTFVFRLP

SEQ ID NO: 939749 - protein, 9 aa, Homo Sapiens
FGYEKHFLP

SEQ ID NO: 939750 - protein, 9 aa, Homo Sapiens
TEFMELDGL

SEQ ID NO: 939751 - protein, 9 aa, Homo Sapiens
LYQSYLMVL

SEQ ID NO: 939752 - protein, 9 aa, Homo Sapiens
FRIRAVNKA

SEQ ID NO: 939753 - protein, 9 aa, Homo Sapiens
VYHRHTLTS

SEQ ID NO: 939754 - protein, 9 aa, Homo Sapiens
KSNADVRAF

SEQ ID NO: 939755 - protein, 9 aa, Homo Sapiens
ELCCGFVKE

SEQ ID NO: 939756 - protein, 9 aa, Homo Sapiens
ACRLQEELK

SEQ ID NO: 939757 - protein, 9 aa, Homo Sapiens
KAFAESWNA

SEQ ID NO: 939758 - protein, 9 aa, Homo Sapiens
TDSECKEIL

SEQ ID NO: 939759 - protein, 9 aa, Homo Sapiens
GFDFVRKRM

SEQ ID NO: 939760 - protein, 9 aa, Homo Sapiens
IDTLNSNYC

SEQ ID NO: 939761 - protein, 9 aa, Homo Sapiens
EDDDAAGQF

SEQ ID NO: 939762 - protein, 9 aa, Homo Sapiens
CSGGYSEWG

SEQ ID NO: 939763 - protein, 9 aa, Homo Sapiens
STIMSGFSN

SEQ ID NO: 939764 - protein, 9 aa, Homo Sapiens
PKFFSFDYS

SEQ ID NO: 939765 - protein, 9 aa, Homo Sapiens
RDPNKPSGF

SEQ ID NO: 939766 - protein, 9 aa, Homo Sapiens
PSLITHSLY

SEQ ID NO: 939767 - protein, 9 aa, Homo Sapiens
TPNLLTLDK

SEQ ID NO: 939768 - protein, 9 aa, Homo Sapiens
LQLLVVASL

SEQ ID NO: 939769 - protein, 9 aa, Homo Sapiens
SVFLWQFYL

SEQ ID NO: 939770 - protein, 9 aa, Homo Sapiens
YYFDWNPSL

SEQ ID NO: 939771 - protein, 9 aa, Homo Sapiens
GPRGIQRIT

SEQ ID NO: 939772 - protein, 9 aa, Homo Sapiens
LLLIAQLFD

SEQ ID NO: 939773 - protein, 9 aa, Homo Sapiens
SLIASEKEI

SEQ ID NO: 939774 - protein, 9 aa, Homo Sapiens
IHSGSVLCS

SEQ ID NO: 939775 - protein, 9 aa, Homo Sapiens
GVLHIDTQA

SEQ ID NO: 939776 - protein, 9 aa, Homo Sapiens
EIIEELRCV

SEQ ID NO: 939777 - protein, 9 aa, Homo Sapiens
KRVFWKQRS

SEQ ID NO: 939778 - protein, 9 aa, Homo Sapiens
GPRGVLAGT

SEQ ID NO: 939779 - protein, 9 aa, Homo Sapiens
ADQELAEAF

SEQ ID NO: 939780 - protein, 9 aa, Homo Sapiens
FFVESILKR

SEQ ID NO: 939781 - protein, 9 aa, Homo Sapiens
LLIAQLFDF

SEQ ID NO: 939782 - protein, 9 aa, Homo Sapiens
LQERVLFHH

SEQ ID NO: 939783 - protein, 9 aa, Homo Sapiens
PCLGASEAG

SEQ ID NO: 939784 - protein, 9 aa, Homo Sapiens
VLEDLESRE

SEQ ID NO: 939785 - protein, 9 aa, Homo Sapiens
SEAVKSAMN

SEQ ID NO: 939786 - protein, 9 aa, Homo Sapiens
CGSVHFGLV

SEQ ID NO: 939787 - protein, 9 aa, Homo Sapiens
HHSAKKFLK

SEQ ID NO: 939788 - protein, 9 aa, Homo Sapiens
GVAADLYEL

SEQ ID NO: 939789 - protein, 9 aa, Homo Sapiens
ITCLDYENE

SEQ ID NO: 939790 - protein, 9 aa, Homo Sapiens
MKTPAWPRV

SEQ ID NO: 939791 - protein, 9 aa, Homo Sapiens
MCLEDNRYN

SEQ ID NO: 939792 - protein, 9 aa, Homo Sapiens
TRFGGDWVI

SEQ ID NO: 939793 - protein, 9 aa, Homo Sapiens
TIFNNFDWL

SEQ ID NO: 939794 - protein, 9 aa, Homo Sapiens
AEGDRGPRA

SEQ ID NO: 939795 - protein, 9 aa, Homo Sapiens
CLDYENEKV

SEQ ID NO: 939796 - protein, 9 aa, Homo Sapiens
PTSPLCETL

SEQ ID NO: 939797 - protein, 9 aa, Homo Sapiens
ITNEDASHN

SEQ ID NO: 939798 - protein, 9 aa, Homo Sapiens
YYNSFTCKK

SEQ ID NO: 939799 - protein, 9 aa, Homo Sapiens
GGGPINPTS

SEQ ID NO: 939800 - protein, 9 aa, Homo Sapiens
IPVLPIVHY

SEQ ID NO: 939801 - protein, 9 aa, Homo Sapiens
RSYWDLEQK

SEQ ID NO: 939802 - protein, 9 aa, Homo Sapiens
FSWLIMNEE

SEQ ID NO: 939803 - protein, 9 aa, Homo Sapiens
PCPPSRGPC

SEQ ID NO: 939804 - protein, 9 aa, Homo Sapiens
KNWYEGMIH

SEQ ID NO: 939805 - protein, 9 aa, Homo Sapiens
DLAHTLSQL

SEQ ID NO: 939806 - protein, 9 aa, Homo Sapiens
GGKRKEEKP

SEQ ID NO: 939807 - protein, 9 aa, Homo Sapiens
GDYSLIGRI

SEQ ID NO: 939808 - protein, 9 aa, Homo Sapiens
CRLQEELKK

SEQ ID NO: 939809 - protein, 9 aa, Homo Sapiens
WNPSLFRYV

SEQ ID NO: 939810 - protein, 9 aa, Homo Sapiens
PENSGKTVL

SEQ ID NO: 939811 - protein, 9 aa, Homo Sapiens
VINGTYANK

SEQ ID NO: 939812 - protein, 9 aa, Homo Sapiens
ADESPNAIV

SEQ ID NO: 939813 - protein, 9 aa, Homo Sapiens
RAGGSSWGC

SEQ ID NO: 939814 - protein, 9 aa, Homo Sapiens
VLIIDNGSG

SEQ ID NO: 939815 - protein, 9 aa, Homo Sapiens
WVCAADILL

SEQ ID NO: 939816 - protein, 9 aa, Homo Sapiens
QSPPADTLF

SEQ ID NO: 939817 - protein, 9 aa, Homo Sapiens
KEIKDEKVI

SEQ ID NO: 939818 - protein, 9 aa, Homo Sapiens
WAITIFNNF

SEQ ID NO: 939819 - protein, 9 aa, Homo Sapiens
PSRGPCDSD

SEQ ID NO: 939820 - protein, 9 aa, Homo Sapiens
NATFNSSWA

SEQ ID NO: 939821 - protein, 9 aa, Homo Sapiens
SYLSSKDSR

SEQ ID NO: 939822 - protein, 9 aa, Homo Sapiens
LRLLQSCCP

SEQ ID NO: 939823 - protein, 9 aa, Homo Sapiens
SISKSPELC

SEQ ID NO: 939824 - protein, 9 aa, Homo Sapiens
FLHLHSGSL

SEQ ID NO: 939825 - protein, 9 aa, Homo Sapiens
NPPPPPLRL

SEQ ID NO: 939826 - protein, 9 aa, Homo Sapiens
GRRLAGGNS

SEQ ID NO: 939827 - protein, 9 aa, Homo Sapiens
NEEPSLCAR

SEQ ID NO: 939828 - protein, 9 aa, Homo Sapiens
IGSVLISYF

SEQ ID NO: 939829 - protein, 9 aa, Homo Sapiens
VTRLPDRPA

SEQ ID NO: 939830 - protein, 9 aa, Homo Sapiens
DEDSADKDR

SEQ ID NO: 939831 - protein, 9 aa, Homo Sapiens
CFLHLLRRL

SEQ ID NO: 939832 - protein, 9 aa, Homo Sapiens
SDKGTYECV

SEQ ID NO: 939833 - protein, 9 aa, Homo Sapiens
IQNLSEENR

SEQ ID NO: 939834 - protein, 9 aa, Homo Sapiens
TTFFTPGSG

SEQ ID NO: 939835 - protein, 9 aa, Homo Sapiens
PSLKDLFNF

SEQ ID NO: 939836 - protein, 9 aa, Homo Sapiens
KRQEAQVKK

SEQ ID NO: 939837 - protein, 9 aa, Homo Sapiens
VLDGLEKKG

SEQ ID NO: 939838 - protein, 9 aa, Homo Sapiens
PAASSTPYG

SEQ ID NO: 939839 - protein, 9 aa, Homo Sapiens
MKSEPDKGD

SEQ ID NO: 939840 - protein, 9 aa, Homo Sapiens
FRKAVDGVV

SEQ ID NO: 939841 - protein, 9 aa, Homo Sapiens
SVVQCCVED

SEQ ID NO: 939842 - protein, 9 aa, Homo Sapiens
LLETRAQKK

SEQ ID NO: 939843 - protein, 9 aa, Homo Sapiens
TLSQLEGLD

SEQ ID NO: 939844 - protein, 9 aa, Homo Sapiens
NMPLQGPGY

SEQ ID NO: 939845 - protein, 9 aa, Homo Sapiens
YVSCQECIC

SEQ ID NO: 939846 - protein, 9 aa, Homo Sapiens
LFLKRGDDS

SEQ ID NO: 939847 - protein, 9 aa, Homo Sapiens
MSVGIFQSM

SEQ ID NO: 939848 - protein, 9 aa, Homo Sapiens
ALNHLDTVE

SEQ ID NO: 939849 - protein, 9 aa, Homo Sapiens
AALTPFWYA

SEQ ID NO: 939850 - protein, 9 aa, Homo Sapiens
SEPSEMKAI

SEQ ID NO: 939851 - protein, 9 aa, Homo Sapiens
ESEEEELTT

SEQ ID NO: 939852 - protein, 9 aa, Homo Sapiens
LSWHNDLTQ

SEQ ID NO: 939853 - protein, 9 aa, Homo Sapiens
RVPQNWFSI

SEQ ID NO: 939854 - protein, 9 aa, Homo Sapiens
PPKCPSQCP

SEQ ID NO: 939855 - protein, 9 aa, Homo Sapiens
ISSIGGMVL

SEQ ID NO: 939856 - protein, 9 aa, Homo Sapiens
QTCTTKFLA

SEQ ID NO: 939857 - protein, 9 aa, Homo Sapiens
HSQKSQHGS

SEQ ID NO: 939858 - protein, 9 aa, Homo Sapiens
MLNSELQKK

SEQ ID NO: 939859 - protein, 9 aa, Homo Sapiens
LSHNRMKTY

SEQ ID NO: 939860 - protein, 9 aa, Homo Sapiens
QKVALSLWL

SEQ ID NO: 939861 - protein, 9 aa, Homo Sapiens
HTSYFPDFA

SEQ ID NO: 939862 - protein, 9 aa, Homo Sapiens
IQLATPPPP

SEQ ID NO: 939863 - protein, 9 aa, Homo Sapiens
PEDSSLASR

SEQ ID NO: 939864 - protein, 9 aa, Homo Sapiens
VFIQRNYSD

SEQ ID NO: 939865 - protein, 9 aa, Homo Sapiens
EQRALQVSS

SEQ ID NO: 939866 - protein, 9 aa, Homo Sapiens
IGFQTTMLE

SEQ ID NO: 939867 - protein, 9 aa, Homo Sapiens
IGSLLENLH

SEQ ID NO: 939868 - protein, 9 aa, Homo Sapiens
FNNFDWLFG

SEQ ID NO: 939869 - protein, 9 aa, Homo Sapiens
DAGINEELS

SEQ ID NO: 939870 - protein, 9 aa, Homo Sapiens
HKDRQLLQG

SEQ ID NO: 939871 - protein, 9 aa, Homo Sapiens
TGSGLREDL

SEQ ID NO: 939872 - protein, 9 aa, Homo Sapiens
YGSSLGRLS

SEQ ID NO: 939873 - protein, 9 aa, Homo Sapiens
CFEDNPLFA

SEQ ID NO: 939874 - protein, 9 aa, Homo Sapiens
SAIPSSSIS

SEQ ID NO: 939875 - protein, 9 aa, Homo Sapiens
ILWDGLDSG

SEQ ID NO: 939876 - protein, 9 aa, Homo Sapiens
HPLNLPVAN

SEQ ID NO: 939877 - protein, 9 aa, Homo Sapiens
SFTCKKGKV

SEQ ID NO: 939878 - protein, 9 aa, Homo Sapiens
RRQAFRGKS

SEQ ID NO: 939879 - protein, 9 aa, Homo Sapiens
SHIVRYYDV

SEQ ID NO: 939880 - protein, 9 aa, Homo Sapiens
NSRGSNTKG

SEQ ID NO: 939881 - protein, 9 aa, Homo Sapiens
KTFIVLNKS

SEQ ID NO: 939882 - protein, 9 aa, Homo Sapiens
HPYPQPLAQ

SEQ ID NO: 939883 - protein, 9 aa, Homo Sapiens
LNRNKIYLI

SEQ ID NO: 939884 - protein, 9 aa, Homo Sapiens
RAIHNIFCM

SEQ ID NO: 939885 - protein, 9 aa, Homo Sapiens
FYNVTWFKV

SEQ ID NO: 939886 - protein, 9 aa, Homo Sapiens
GSIRFTAEE

SEQ ID NO: 939887 - protein, 9 aa, Homo Sapiens
LPWWRESSL

SEQ ID NO: 939888 - protein, 9 aa, Homo Sapiens
WNSEQNLNS

SEQ ID NO: 939889 - protein, 9 aa, Homo Sapiens
ATSKLVQVD

SEQ ID NO: 939890 - protein, 9 aa, Homo Sapiens
YNKLQKQEK

SEQ ID NO: 939891 - protein, 9 aa, Homo Sapiens
FSCFSNSAT

SEQ ID NO: 939892 - protein, 9 aa, Homo Sapiens
KTTKEEWSQ

SEQ ID NO: 939893 - protein, 9 aa, Homo Sapiens
LPLSCPVLL

SEQ ID NO: 939894 - protein, 9 aa, Homo Sapiens
CIHLLPDLY

SEQ ID NO: 939895 - protein, 9 aa, Homo Sapiens
NWATVGERR

SEQ ID NO: 939896 - protein, 9 aa, Homo Sapiens
ILKCMFCGD

SEQ ID NO: 939897 - protein, 9 aa, Homo Sapiens
YWGLVLKEP

SEQ ID NO: 939898 - protein, 9 aa, Homo Sapiens
VVNDEDLVD

SEQ ID NO: 939899 - protein, 9 aa, Homo Sapiens
ERKLLQIIA

SEQ ID NO: 939900 - protein, 9 aa, Homo Sapiens
SLGVGLQNL

SEQ ID NO: 939901 - protein, 9 aa, Homo Sapiens
KVRRYLEGT

SEQ ID NO: 939902 - protein, 9 aa, Homo Sapiens
TIPLIVTET

SEQ ID NO: 939903 - protein, 9 aa, Homo Sapiens
YPALIQRPF

SEQ ID NO: 939904 - protein, 9 aa, Homo Sapiens
QHSILYTLS

SEQ ID NO: 939905 - protein, 9 aa, Homo Sapiens
YAGLKDVAK

SEQ ID NO: 939906 - protein, 9 aa, Homo Sapiens
ASLLPNVPL

SEQ ID NO: 939907 - protein, 9 aa, Homo Sapiens
NKPQPLPTK

SEQ ID NO: 939908 - protein, 9 aa, Homo Sapiens
PFTGCGCPP

SEQ ID NO: 939909 - protein, 9 aa, Homo Sapiens
RLDVWNGWK

SEQ ID NO: 939910 - protein, 9 aa, Homo Sapiens
ARGSPGDTG

SEQ ID NO: 939911 - protein, 9 aa, Homo Sapiens
LDTAVKVLL

SEQ ID NO: 939912 - protein, 9 aa, Homo Sapiens
LKWNNITKE

SEQ ID NO: 939913 - protein, 9 aa, Homo Sapiens
QKQQSLIHT

SEQ ID NO: 939914 - protein, 9 aa, Homo Sapiens
VKEGCPQAF

SEQ ID NO: 939915 - protein, 9 aa, Homo Sapiens
PSKEEEEPK

SEQ ID NO: 939916 - protein, 9 aa, Homo Sapiens
GQQKDESQS

SEQ ID NO: 939917 - protein, 9 aa, Homo Sapiens
LKCFEDNPL

SEQ ID NO: 939918 - protein, 9 aa, Homo Sapiens
SFWRQKMFQ

SEQ ID NO: 939919 - protein, 9 aa, Homo Sapiens
GHPGAPGPL

SEQ ID NO: 939920 - protein, 9 aa, Homo Sapiens
AQEALICTV

SEQ ID NO: 939921 - protein, 9 aa, Homo Sapiens
ASVSLPLVL

SEQ ID NO: 939922 - protein, 9 aa, Homo Sapiens
LGLKNNDRC

SEQ ID NO: 939923 - protein, 9 aa, Homo Sapiens
RVEQVKIYA

SEQ ID NO: 939924 - protein, 9 aa, Homo Sapiens
VNKAGVGEP

SEQ ID NO: 939925 - protein, 9 aa, Homo Sapiens
RDITELFMQ

SEQ ID NO: 939926 - protein, 9 aa, Homo Sapiens
LEDLKPVID

SEQ ID NO: 939927 - protein, 9 aa, Homo Sapiens
QQLLWKGFF

SEQ ID NO: 939928 - protein, 9 aa, Homo Sapiens
PKVYIILFQ

SEQ ID NO: 939929 - protein, 9 aa, Homo Sapiens
TQADLSRNC

SEQ ID NO: 939930 - protein, 9 aa, Homo Sapiens
AIFDEDHNE

SEQ ID NO: 939931 - protein, 9 aa, Homo Sapiens
RGAGFANQG

SEQ ID NO: 939932 - protein, 9 aa, Homo Sapiens
NFQNITEEN

SEQ ID NO: 939933 - protein, 9 aa, Homo Sapiens
PGLKGENSL

SEQ ID NO: 939934 - protein, 9 aa, Homo Sapiens
HFWGIYPES

SEQ ID NO: 939935 - protein, 9 aa, Homo Sapiens
RDFLSQMEK

SEQ ID NO: 939936 - protein, 9 aa, Homo Sapiens
TILPDPRNE

SEQ ID NO: 939937 - protein, 9 aa, Homo Sapiens
NLVGASELR

SEQ ID NO: 939938 - protein, 9 aa, Homo Sapiens
RSSTMETLR

SEQ ID NO: 939939 - protein, 9 aa, Homo Sapiens
LAIVDIFYA

SEQ ID NO: 939940 - protein, 9 aa, Homo Sapiens
CQAWRRAVL

SEQ ID NO: 939941 - protein, 9 aa, Homo Sapiens
FTHSKNVRF

SEQ ID NO: 939942 - protein, 9 aa, Homo Sapiens
EALREQSNP

SEQ ID NO: 939943 - protein, 9 aa, Homo Sapiens
GLQEMPGER

SEQ ID NO: 939944 - protein, 9 aa, Homo Sapiens
SARAKVRRY

SEQ ID NO: 939945 - protein, 9 aa, Homo Sapiens
LAKLIQALV

SEQ ID NO: 939946 - protein, 9 aa, Homo Sapiens
SKPFSPPNI

SEQ ID NO: 939947 - protein, 9 aa, Homo Sapiens
IQHRSHECQ

SEQ ID NO: 939948 - protein, 9 aa, Homo Sapiens
LFAAWASGG

SEQ ID NO: 939949 - protein, 9 aa, Homo Sapiens
EQSRRAQAK

SEQ ID NO: 939950 - protein, 9 aa, Homo Sapiens
YNDLEKHKC

SEQ ID NO: 939951 - protein, 9 aa, Homo Sapiens
DLKGSAVPP

SEQ ID NO: 939952 - protein, 9 aa, Homo Sapiens
LDKLYNEIT

SEQ ID NO: 939953 - protein, 9 aa, Homo Sapiens
QIWCSCVAG

SEQ ID NO: 939954 - protein, 9 aa, Homo Sapiens
PDSVLPPQR

SEQ ID NO: 939955 - protein, 9 aa, Homo Sapiens
IRTYWNFEF

SEQ ID NO: 939956 - protein, 9 aa, Homo Sapiens
ATFQRHPMN

SEQ ID NO: 939957 - protein, 9 aa, Homo Sapiens
ALAAGQTPK

SEQ ID NO: 939958 - protein, 9 aa, Homo Sapiens
AGGPSPGGG

SEQ ID NO: 939959 - protein, 9 aa, Homo Sapiens
PNLFHLQLH

SEQ ID NO: 939960 - protein, 9 aa, Homo Sapiens
MFSTVTPLA

SEQ ID NO: 939961 - protein, 9 aa, Homo Sapiens
PTADEKIYF

SEQ ID NO: 939962 - protein, 9 aa, Homo Sapiens
SNEILRNPC

SEQ ID NO: 939963 - protein, 9 aa, Homo Sapiens
LVSGGLAEE

SEQ ID NO: 939964 - protein, 9 aa, Homo Sapiens
NWDKKLSID

SEQ ID NO: 939965 - protein, 9 aa, Homo Sapiens
RSPLYPRRG

SEQ ID NO: 939966 - protein, 9 aa, Homo Sapiens
NSHYGQSER

SEQ ID NO: 939967 - protein, 9 aa, Homo Sapiens
HDLEDLQWI

SEQ ID NO: 939968 - protein, 9 aa, Homo Sapiens
TILALCFPS

SEQ ID NO: 939969 - protein, 9 aa, Homo Sapiens
VRFRRDSKE

SEQ ID NO: 939970 - protein, 9 aa, Homo Sapiens
TQPPQQLNV

SEQ ID NO: 939971 - protein, 9 aa, Homo Sapiens
DLSNGEPTK

SEQ ID NO: 939972 - protein, 9 aa, Homo Sapiens
TDSISKSPE

SEQ ID NO: 939973 - protein, 9 aa, Homo Sapiens
QVLGEKAFL

SEQ ID NO: 939974 - protein, 9 aa, Homo Sapiens
RLRKDVSRP

SEQ ID NO: 939975 - protein, 9 aa, Homo Sapiens
KATSRRSNS

SEQ ID NO: 939976 - protein, 9 aa, Homo Sapiens
SLMLQPAQQ

SEQ ID NO: 939977 - protein, 9 aa, Homo Sapiens
SASLSKIQN

SEQ ID NO: 939978 - protein, 9 aa, Homo Sapiens
EAFLAGMRN

SEQ ID NO: 939979 - protein, 9 aa, Homo Sapiens
HDLVSGRYC

SEQ ID NO: 939980 - protein, 9 aa, Homo Sapiens
LETVSWKTH

SEQ ID NO: 939981 - protein, 9 aa, Homo Sapiens
DGTLFDLSH

SEQ ID NO: 939982 - protein, 9 aa, Homo Sapiens
FRVNILDEA

SEQ ID NO: 939983 - protein, 9 aa, Homo Sapiens
RRVFSTCSF

SEQ ID NO: 939984 - protein, 9 aa, Homo Sapiens
LATGTFFWM

SEQ ID NO: 939985 - protein, 9 aa, Homo Sapiens
FSIFDLVEN

SEQ ID NO: 939986 - protein, 9 aa, Homo Sapiens
LSAGLMAPL

SEQ ID NO: 939987 - protein, 9 aa, Homo Sapiens
SDNENKSDN

SEQ ID NO: 939988 - protein, 9 aa, Homo Sapiens
GACLHKRME

SEQ ID NO: 939989 - protein, 9 aa, Homo Sapiens
KDVTESPRP

SEQ ID NO: 939990 - protein, 9 aa, Homo Sapiens
ASGRRSQYQ

SEQ ID NO: 939991 - protein, 9 aa, Homo Sapiens
HPGAPGPLG

SEQ ID NO: 939992 - protein, 9 aa, Homo Sapiens
FVNEISWVI

SEQ ID NO: 939993 - protein, 9 aa, Homo Sapiens
DSKTYRRSY

SEQ ID NO: 939994 - protein, 9 aa, Homo Sapiens
RTITNLKGS

SEQ ID NO: 939995 - protein, 9 aa, Homo Sapiens
PYYLVGRRL

SEQ ID NO: 939996 - protein, 9 aa, Homo Sapiens
QVSGRRYNL

SEQ ID NO: 939997 - protein, 9 aa, Homo Sapiens
ETLSQDEEE

SEQ ID NO: 939998 - protein, 9 aa, Homo Sapiens
DPEAEGLGG

SEQ ID NO: 939999 - protein, 9 aa, Homo Sapiens
ETFPFNSFD

SEQ ID NO: 940000 - protein, 9 aa, Homo Sapiens
FRKRREREQ

SEQ ID NO: 940001 - protein, 9 aa, Homo Sapiens
GQATGMSLE

SEQ ID NO: 940002 - protein, 9 aa, Homo Sapiens
GIRSSKESL

SEQ ID NO: 940003 - protein, 9 aa, Homo Sapiens
SWFSAAPTS

SEQ ID NO: 940004 - protein, 9 aa, Homo Sapiens
YMAAETAKK

SEQ ID NO: 940005 - protein, 9 aa, Homo Sapiens
EVVPVLAWP

SEQ ID NO: 940006 - protein, 9 aa, Homo Sapiens
KMRVFLLGM

SEQ ID NO: 940007 - protein, 9 aa, Homo Sapiens
PIYCVCVTK

SEQ ID NO: 940008 - protein, 9 aa, Homo Sapiens
RELEPKSPK

SEQ ID NO: 940009 - protein, 9 aa, Homo Sapiens
ACKSSYLLH

SEQ ID NO: 940010 - protein, 9 aa, Homo Sapiens
VELSIEEVE

SEQ ID NO: 940011 - protein, 9 aa, Homo Sapiens
PRPCLFKGT

SEQ ID NO: 940012 - protein, 9 aa, Homo Sapiens
EEEELTTGS

SEQ ID NO: 940013 - protein, 9 aa, Homo Sapiens
GGPLLRARS

SEQ ID NO: 940014 - protein, 9 aa, Homo Sapiens
SLPWMHPHF

SEQ ID NO: 940015 - protein, 9 aa, Homo Sapiens
MKTTSSIDP

SEQ ID NO: 940016 - protein, 9 aa, Homo Sapiens
GEHDFSEHD

SEQ ID NO: 940017 - protein, 9 aa, Homo Sapiens
DVLQKLSSY

SEQ ID NO: 940018 - protein, 9 aa, Homo Sapiens
SQTSNSSMK

SEQ ID NO: 940019 - protein, 9 aa, Homo Sapiens
FWRQKMFQH

SEQ ID NO: 940020 - protein, 9 aa, Homo Sapiens
IWEFVPPFG

SEQ ID NO: 940021 - protein, 9 aa, Homo Sapiens
ECGKAFCYD

SEQ ID NO: 940022 - protein, 9 aa, Homo Sapiens
IVSHILQSE

SEQ ID NO: 940023 - protein, 9 aa, Homo Sapiens
LEPFAAEAK

SEQ ID NO: 940024 - protein, 9 aa, Homo Sapiens
QHKWNYSNL

SEQ ID NO: 940025 - protein, 9 aa, Homo Sapiens
VTQEHYELY

SEQ ID NO: 940026 - protein, 9 aa, Homo Sapiens
NTWNFSIFD

SEQ ID NO: 940027 - protein, 9 aa, Homo Sapiens
KFEVTVHVP

SEQ ID NO: 940028 - protein, 9 aa, Homo Sapiens
TLNSNYCRS

SEQ ID NO: 940029 - protein, 9 aa, Homo Sapiens
KDLFNFCSR

SEQ ID NO: 940030 - protein, 9 aa, Homo Sapiens
VLILHWRWG

SEQ ID NO: 940031 - protein, 9 aa, Homo Sapiens
EKTDLENAR

SEQ ID NO: 940032 - protein, 9 aa, Homo Sapiens
DTGFLNQGN

SEQ ID NO: 940033 - protein, 9 aa, Homo Sapiens
PLQGPGYPP

SEQ ID NO: 940034 - protein, 9 aa, Homo Sapiens
YYKKNKRRH

SEQ ID NO: 940035 - protein, 9 aa, Homo Sapiens
ESAVIARNG

SEQ ID NO: 940036 - protein, 9 aa, Homo Sapiens
ENKFKSLWI

SEQ ID NO: 940037 - protein, 9 aa, Homo Sapiens
ICYNKFVPC

SEQ ID NO: 940038 - protein, 9 aa, Homo Sapiens
TALDGGSPL

SEQ ID NO: 940039 - protein, 9 aa, Homo Sapiens
DENCGQQKD

SEQ ID NO: 940040 - protein, 9 aa, Homo Sapiens
DQSSSLGSS

SEQ ID NO: 940041 - protein, 9 aa, Homo Sapiens
EPGAKACGR

SEQ ID NO: 940042 - protein, 9 aa, Homo Sapiens
PVKDSEYVF

SEQ ID NO: 940043 - protein, 9 aa, Homo Sapiens
SFSEFVPKV

SEQ ID NO: 940044 - protein, 9 aa, Homo Sapiens
KELEGLIQE

SEQ ID NO: 940045 - protein, 9 aa, Homo Sapiens
FWMKVEQIQ

SEQ ID NO: 940046 - protein, 9 aa, Homo Sapiens
HRKSKSQEK

SEQ ID NO: 940047 - protein, 9 aa, Homo Sapiens
VLAWPFSLV

SEQ ID NO: 940048 - protein, 9 aa, Homo Sapiens
MKMNGSLYQ

SEQ ID NO: 940049 - protein, 9 aa, Homo Sapiens
WNNIAAADK

SEQ ID NO: 940050 - protein, 9 aa, Homo Sapiens
EDITYLSQT

SEQ ID NO: 940051 - protein, 9 aa, Homo Sapiens
VDTTVFSLL

SEQ ID NO: 940052 - protein, 9 aa, Homo Sapiens
LIFQANEEL

SEQ ID NO: 940053 - protein, 9 aa, Homo Sapiens
HECQGSGRP

SEQ ID NO: 940054 - protein, 9 aa, Homo Sapiens
NSSLTDLMT

SEQ ID NO: 940055 - protein, 9 aa, Homo Sapiens
HSLERERAS

SEQ ID NO: 940056 - protein, 9 aa, Homo Sapiens
VPPRLLSGP

SEQ ID NO: 940057 - protein, 9 aa, Homo Sapiens
TFDCRCLSG

SEQ ID NO: 940058 - protein, 9 aa, Homo Sapiens
WSLRKSFAS

SEQ ID NO: 940059 - protein, 9 aa, Homo Sapiens
PPPPLRLTP

SEQ ID NO: 940060 - protein, 9 aa, Homo Sapiens
LDQEYDSKS

SEQ ID NO: 940061 - protein, 9 aa, Homo Sapiens
ASASLLEEV

SEQ ID NO: 940062 - protein, 9 aa, Homo Sapiens
GLSKPFSPP

SEQ ID NO: 940063 - protein, 9 aa, Homo Sapiens
LLVIGIWVM

SEQ ID NO: 940064 - protein, 9 aa, Homo Sapiens
FPNLIFSFC

SEQ ID NO: 940065 - protein, 9 aa, Homo Sapiens
NADVRAFTY

SEQ ID NO: 940066 - protein, 9 aa, Homo Sapiens
PSGCKRKFL

SEQ ID NO: 940067 - protein, 9 aa, Homo Sapiens
FNHELPDVS

SEQ ID NO: 940068 - protein, 9 aa, Homo Sapiens
EFQITCGSD

SEQ ID NO: 940069 - protein, 9 aa, Homo Sapiens
YEDYRWAVF

SEQ ID NO: 940070 - protein, 9 aa, Homo Sapiens
TQVGYSWLS

SEQ ID NO: 940071 - protein, 9 aa, Homo Sapiens
QLKLYTNRE

SEQ ID NO: 940072 - protein, 9 aa, Homo Sapiens
IARKKHHKK

SEQ ID NO: 940073 - protein, 9 aa, Homo Sapiens
SLQIWCSCV

SEQ ID NO: 940074 - protein, 9 aa, Homo Sapiens
SSSPSPLPS

SEQ ID NO: 940075 - protein, 9 aa, Homo Sapiens
WAAFATDKY

SEQ ID NO: 940076 - protein, 9 aa, Homo Sapiens
EHTWSLAKL

SEQ ID NO: 940077 - protein, 9 aa, Homo Sapiens
GIYEAIYYG

SEQ ID NO: 940078 - protein, 9 aa, Homo Sapiens
SFFVKVEMF

SEQ ID NO: 940079 - protein, 9 aa, Homo Sapiens
LARASTKKK

SEQ ID NO: 940080 - protein, 9 aa, Homo Sapiens
CSHLHRSDP

SEQ ID NO: 940081 - protein, 9 aa, Homo Sapiens
ATHNPMPCG

SEQ ID NO: 940082 - protein, 9 aa, Homo Sapiens
EKQVFSFWR

SEQ ID NO: 940083 - protein, 9 aa, Homo Sapiens
PVHFLVISK

SEQ ID NO: 940084 - protein, 9 aa, Homo Sapiens
QEEETEFME

SEQ ID NO: 940085 - protein, 9 aa, Homo Sapiens
QAETFPFNS

SEQ ID NO: 940086 - protein, 9 aa, Homo Sapiens
LAAGWGLCE

SEQ ID NO: 940087 - protein, 9 aa, Homo Sapiens
LYTLSRAQT

SEQ ID NO: 940088 - protein, 9 aa, Homo Sapiens
LRANTDVFL

SEQ ID NO: 940089 - protein, 9 aa, Homo Sapiens
KSPFPPRLT

SEQ ID NO: 940090 - protein, 9 aa, Homo Sapiens
YPDVEQPCK

SEQ ID NO: 940091 - protein, 9 aa, Homo Sapiens
SKEANFQRE

SEQ ID NO: 940092 - protein, 9 aa, Homo Sapiens
SQGAPGLQE

SEQ ID NO: 940093 - protein, 9 aa, Homo Sapiens
FLDGTLFDL

SEQ ID NO: 940094 - protein, 9 aa, Homo Sapiens
RDTTTLSGP

SEQ ID NO: 940095 - protein, 9 aa, Homo Sapiens
NGWKEFLMG

SEQ ID NO: 940096 - protein, 9 aa, Homo Sapiens
APKFFSFDY

SEQ ID NO: 940097 - protein, 9 aa, Homo Sapiens
AGGLADLSF

SEQ ID NO: 940098 - protein, 9 aa, Homo Sapiens
SISLDSHTF

SEQ ID NO: 940099 - protein, 9 aa, Homo Sapiens
KPPRIDTAP

SEQ ID NO: 940100 - protein, 9 aa, Homo Sapiens
IDGLVVGNQ

SEQ ID NO: 940101 - protein, 9 aa, Homo Sapiens
YKCCQSKNC

SEQ ID NO: 940102 - protein, 9 aa, Homo Sapiens
ALVSGGVVQ

SEQ ID NO: 940103 - protein, 9 aa, Homo Sapiens
LCQSWIINN

SEQ ID NO: 940104 - protein, 9 aa, Homo Sapiens
LPPAVLHSV

SEQ ID NO: 940105 - protein, 9 aa, Homo Sapiens
TSPSLVSMG

SEQ ID NO: 940106 - protein, 9 aa, Homo Sapiens
KDNPSSTLC

SEQ ID NO: 940107 - protein, 9 aa, Homo Sapiens
ADCGNVELV

SEQ ID NO: 940108 - protein, 9 aa, Homo Sapiens
IMVVLKLAC

SEQ ID NO: 940109 - protein, 9 aa, Homo Sapiens
RILGVKRNI

SEQ ID NO: 940110 - protein, 9 aa, Homo Sapiens
QYWALTVPE

SEQ ID NO: 940111 - protein, 9 aa, Homo Sapiens
LSEAKVAQS

SEQ ID NO: 940112 - protein, 9 aa, Homo Sapiens
QGDVLTGRP

SEQ ID NO: 940113 - protein, 9 aa, Homo Sapiens
GVQQLYPAL

SEQ ID NO: 940114 - protein, 9 aa, Homo Sapiens
CLVTPVTVS

SEQ ID NO: 940115 - protein, 9 aa, Homo Sapiens
GWKEISGVD

SEQ ID NO: 940116 - protein, 9 aa, Homo Sapiens
LYLQVLGEK

SEQ ID NO: 940117 - protein, 9 aa, Homo Sapiens
CSCLPGFHF

SEQ ID NO: 940118 - protein, 9 aa, Homo Sapiens
VGKLAFVME

SEQ ID NO: 940119 - protein, 9 aa, Homo Sapiens
KRKHQHYKK

SEQ ID NO: 940120 - protein, 9 aa, Homo Sapiens
CHLLHYRII

SEQ ID NO: 940121 - protein, 9 aa, Homo Sapiens
RAQKQQSLI

SEQ ID NO: 940122 - protein, 9 aa, Homo Sapiens
RSKETPESD

SEQ ID NO: 940123 - protein, 9 aa, Homo Sapiens
VGQACRVSP

SEQ ID NO: 940124 - protein, 9 aa, Homo Sapiens
QPLPTIRWL

SEQ ID NO: 940125 - protein, 9 aa, Homo Sapiens
IVLANGQVS

SEQ ID NO: 940126 - protein, 9 aa, Homo Sapiens
GAEVLLLPL

SEQ ID NO: 940127 - protein, 9 aa, Homo Sapiens
WPVAPKKIT

SEQ ID NO: 940128 - protein, 9 aa, Homo Sapiens
AAFILIGSL

SEQ ID NO: 940129 - protein, 9 aa, Homo Sapiens
PVDMGFLAS

SEQ ID NO: 940130 - protein, 9 aa, Homo Sapiens
AHQDLWSAG

SEQ ID NO: 940131 - protein, 9 aa, Homo Sapiens
DLLGPSLKD

SEQ ID NO: 940132 - protein, 9 aa, Homo Sapiens
GGRTYVDVV

SEQ ID NO: 940133 - protein, 9 aa, Homo Sapiens
RKKAAPVSS

SEQ ID NO: 940134 - protein, 9 aa, Homo Sapiens
INDTIKKHR

SEQ ID NO: 940135 - protein, 9 aa, Homo Sapiens
EDTLSEEFD

SEQ ID NO: 940136 - protein, 9 aa, Homo Sapiens
SPDVCRKNL

SEQ ID NO: 940137 - protein, 9 aa, Homo Sapiens
QCLCADPYK

SEQ ID NO: 940138 - protein, 9 aa, Homo Sapiens
RVKLFSHRN

SEQ ID NO: 940139 - protein, 9 aa, Homo Sapiens
EKDCPCETC

SEQ ID NO: 940140 - protein, 9 aa, Homo Sapiens
FRSRPWNKV

SEQ ID NO: 940141 - protein, 9 aa, Homo Sapiens
QNPHGRDLA

SEQ ID NO: 940142 - protein, 9 aa, Homo Sapiens
YFHCDNDYS

SEQ ID NO: 940143 - protein, 9 aa, Homo Sapiens
ELYENSLLL

SEQ ID NO: 940144 - protein, 9 aa, Homo Sapiens
FILKVAYIP

SEQ ID NO: 940145 - protein, 9 aa, Homo Sapiens
PGQANKIVL

SEQ ID NO: 940146 - protein, 9 aa, Homo Sapiens
LTHTATSVL

SEQ ID NO: 940147 - protein, 9 aa, Homo Sapiens
IFCMTESHL

SEQ ID NO: 940148 - protein, 9 aa, Homo Sapiens
SGQHPDLRQ

SEQ ID NO: 940149 - protein, 9 aa, Homo Sapiens
PSIHLRGKG

SEQ ID NO: 940150 - protein, 9 aa, Homo Sapiens
PDDLPVTCA

SEQ ID NO: 940151 - protein, 9 aa, Homo Sapiens
GSESLFQGM

SEQ ID NO: 940152 - protein, 9 aa, Homo Sapiens
DTTPFPVTD

SEQ ID NO: 940153 - protein, 9 aa, Homo Sapiens
EANVEPVVL

SEQ ID NO: 940154 - protein, 9 aa, Homo Sapiens
LNEQRHNGL

SEQ ID NO: 940155 - protein, 9 aa, Homo Sapiens
CSCTFCEIC

SEQ ID NO: 940156 - protein, 9 aa, Homo Sapiens
AVLGSNVSI

SEQ ID NO: 940157 - protein, 9 aa, Homo Sapiens
AYKDYLLFG

SEQ ID NO: 940158 - protein, 9 aa, Homo Sapiens
LNKHKKIYA

SEQ ID NO: 940159 - protein, 9 aa, Homo Sapiens
ILEEKFSNL

SEQ ID NO: 940160 - protein, 9 aa, Homo Sapiens
KQSQSQPCP

SEQ ID NO: 940161 - protein, 9 aa, Homo Sapiens
LRSQLAEKK

SEQ ID NO: 940162 - protein, 9 aa, Homo Sapiens
MDKEDAQKI

SEQ ID NO: 940163 - protein, 9 aa, Homo Sapiens
FAISNYVFN

SEQ ID NO: 940164 - protein, 9 aa, Homo Sapiens
YLKKPPQPQ

SEQ ID NO: 940165 - protein, 9 aa, Homo Sapiens
SGGVVQAAG

SEQ ID NO: 940166 - protein, 9 aa, Homo Sapiens
KKQKPKKSC

SEQ ID NO: 940167 - protein, 9 aa, Homo Sapiens
LRPGFRKAV

SEQ ID NO: 940168 - protein, 9 aa, Homo Sapiens
LEFKVSGIP

SEQ ID NO: 940169 - protein, 9 aa, Homo Sapiens
SLKNLVPKT

SEQ ID NO: 940170 - protein, 9 aa, Homo Sapiens
AWRRAVLHG

SEQ ID NO: 940171 - protein, 9 aa, Homo Sapiens
SWGCWYYLR

SEQ ID NO: 940172 - protein, 9 aa, Homo Sapiens
PSFGVSASG

SEQ ID NO: 940173 - protein, 9 aa, Homo Sapiens
CSAPLSYVP

SEQ ID NO: 940174 - protein, 9 aa, Homo Sapiens
RLAGGNSSG

SEQ ID NO: 940175 - protein, 9 aa, Homo Sapiens
SKSPELCNE

SEQ ID NO: 940176 - protein, 9 aa, Homo Sapiens
RGPRRLSGP

SEQ ID NO: 940177 - protein, 9 aa, Homo Sapiens
RNFLKCFED

SEQ ID NO: 940178 - protein, 9 aa, Homo Sapiens
VFSVMTRQN

SEQ ID NO: 940179 - protein, 9 aa, Homo Sapiens
SASLQCELD

SEQ ID NO: 940180 - protein, 9 aa, Homo Sapiens
FPRDTISKQ

SEQ ID NO: 940181 - protein, 9 aa, Homo Sapiens
DNENGRPIP

SEQ ID NO: 940182 - protein, 9 aa, Homo Sapiens
QIGQKVQLP

SEQ ID NO: 940183 - protein, 9 aa, Homo Sapiens
SIRKELKRT

SEQ ID NO: 940184 - protein, 9 aa, Homo Sapiens
ICSARGHSD

SEQ ID NO: 940185 - protein, 9 aa, Homo Sapiens
FVRPILPVS

SEQ ID NO: 940186 - protein, 9 aa, Homo Sapiens
EEPINEETL

SEQ ID NO: 940187 - protein, 9 aa, Homo Sapiens
GANRKIVYS

SEQ ID NO: 940188 - protein, 9 aa, Homo Sapiens
CVAMLRLLT

SEQ ID NO: 940189 - protein, 9 aa, Homo Sapiens
SIGFLRQVL

SEQ ID NO: 940190 - protein, 9 aa, Homo Sapiens
EALSEDNSG

SEQ ID NO: 940191 - protein, 9 aa, Homo Sapiens
LCLGLLCVF

SEQ ID NO: 940192 - protein, 9 aa, Homo Sapiens
TGGFTTLQP

SEQ ID NO: 940193 - protein, 9 aa, Homo Sapiens
CLVRMYMVR

SEQ ID NO: 940194 - protein, 9 aa, Homo Sapiens
TLPVALSLR

SEQ ID NO: 940195 - protein, 9 aa, Homo Sapiens
FEVMGLHDV

SEQ ID NO: 940196 - protein, 9 aa, Homo Sapiens
KWAQQVEKK

SEQ ID NO: 940197 - protein, 9 aa, Homo Sapiens
AEGLILDTS

SEQ ID NO: 940198 - protein, 9 aa, Homo Sapiens
LAESNQQFQ

SEQ ID NO: 940199 - protein, 9 aa, Homo Sapiens
SQLLRTYFS

SEQ ID NO: 940200 - protein, 9 aa, Homo Sapiens
PLLSRKPSF

SEQ ID NO: 940201 - protein, 9 aa, Homo Sapiens
LSRGVFGGL

SEQ ID NO: 940202 - protein, 9 aa, Homo Sapiens
TMLEGYFYI

SEQ ID NO: 940203 - protein, 9 aa, Homo Sapiens
LEDLESREA

SEQ ID NO: 940204 - protein, 9 aa, Homo Sapiens
VSERAEASD

SEQ ID NO: 940205 - protein, 9 aa, Homo Sapiens
KFVPCKNGI

SEQ ID NO: 940206 - protein, 9 aa, Homo Sapiens
NPKSSITEL

SEQ ID NO: 940207 - protein, 9 aa, Homo Sapiens
EKQCVNRII

SEQ ID NO: 940208 - protein, 9 aa, Homo Sapiens
KNGQLKCVR

SEQ ID NO: 940209 - protein, 9 aa, Homo Sapiens
QKTRQPVQT

SEQ ID NO: 940210 - protein, 9 aa, Homo Sapiens
VSWKTHDAS

SEQ ID NO: 940211 - protein, 9 aa, Homo Sapiens
YGGGLSVFS

SEQ ID NO: 940212 - protein, 9 aa, Homo Sapiens
CKKRSLHAN

SEQ ID NO: 940213 - protein, 9 aa, Homo Sapiens
TLCHPCLLR

SEQ ID NO: 940214 - protein, 9 aa, Homo Sapiens
ILTNSRNAW

SEQ ID NO: 940215 - protein, 9 aa, Homo Sapiens
KACGRGRKP

SEQ ID NO: 940216 - protein, 9 aa, Homo Sapiens
KCFEDNPLF

SEQ ID NO: 940217 - protein, 9 aa, Homo Sapiens
MPEQEYKFP

SEQ ID NO: 940218 - protein, 9 aa, Homo Sapiens
DGRWSEGEP

SEQ ID NO: 940219 - protein, 9 aa, Homo Sapiens
TTFRRSRPC

SEQ ID NO: 940220 - protein, 9 aa, Homo Sapiens
HDLASLSPV

SEQ ID NO: 940221 - protein, 9 aa, Homo Sapiens
QKVYLRVSS

SEQ ID NO: 940222 - protein, 9 aa, Homo Sapiens
PHPGPSPRP

SEQ ID NO: 940223 - protein, 9 aa, Homo Sapiens
RSGKSICTV

SEQ ID NO: 940224 - protein, 9 aa, Homo Sapiens
RWAHLDWPV

SEQ ID NO: 940225 - protein, 9 aa, Homo Sapiens
VGNKWVSVL

SEQ ID NO: 940226 - protein, 9 aa, Homo Sapiens
AAAAETLES

SEQ ID NO: 940227 - protein, 9 aa, Homo Sapiens
ACGVRCYPG

SEQ ID NO: 940228 - protein, 9 aa, Homo Sapiens
MVCVLLLCN

SEQ ID NO: 940229 - protein, 9 aa, Homo Sapiens
EGKIGKGNL

SEQ ID NO: 940230 - protein, 9 aa, Homo Sapiens
GCNIIIFAV

SEQ ID NO: 940231 - protein, 9 aa, Homo Sapiens
PEIRCSSCC

SEQ ID NO: 940232 - protein, 9 aa, Homo Sapiens
RCLSGFSGQ

SEQ ID NO: 940233 - protein, 9 aa, Homo Sapiens
LFVLRSLDY

SEQ ID NO: 940234 - protein, 9 aa, Homo Sapiens
QNSQVEGKY

SEQ ID NO: 940235 - protein, 9 aa, Homo Sapiens
SSCDSSDTP

SEQ ID NO: 940236 - protein, 9 aa, Homo Sapiens
CHDTNSSLT

SEQ ID NO: 940237 - protein, 9 aa, Homo Sapiens
TAKNVTFGM

SEQ ID NO: 940238 - protein, 9 aa, Homo Sapiens
HKRPLYLRK

SEQ ID NO: 940239 - protein, 9 aa, Homo Sapiens
SYPSHCCAY

SEQ ID NO: 940240 - protein, 9 aa, Homo Sapiens
SPSRIWGDS

SEQ ID NO: 940241 - protein, 9 aa, Homo Sapiens
PWPHPLGKK

SEQ ID NO: 940242 - protein, 9 aa, Homo Sapiens
GHRPSIHPV

SEQ ID NO: 940243 - protein, 9 aa, Homo Sapiens
SSSAGLGLL

SEQ ID NO: 940244 - protein, 9 aa, Homo Sapiens
LTLSPNDHV

SEQ ID NO: 940245 - protein, 9 aa, Homo Sapiens
MRNFYFLSK

SEQ ID NO: 940246 - protein, 9 aa, Homo Sapiens
PEISQVKPG

SEQ ID NO: 940247 - protein, 9 aa, Homo Sapiens
LCHPCLLRF

SEQ ID NO: 940248 - protein, 9 aa, Homo Sapiens
GAWDPHSGQ

SEQ ID NO: 940249 - protein, 9 aa, Homo Sapiens
LSLPIRPEQ

SEQ ID NO: 940250 - protein, 9 aa, Homo Sapiens
NVPYFDLSA

SEQ ID NO: 940251 - protein, 9 aa, Homo Sapiens
NKWVSVLAA

SEQ ID NO: 940252 - protein, 9 aa, Homo Sapiens
LLQSQKAMQ

SEQ ID NO: 940253 - protein, 9 aa, Homo Sapiens
VPYSPYKVK

SEQ ID NO: 940254 - protein, 9 aa, Homo Sapiens
QNLGFILTY

SEQ ID NO: 940255 - protein, 9 aa, Homo Sapiens
RGSFWREAA

SEQ ID NO: 940256 - protein, 9 aa, Homo Sapiens
NSSLIIVNA

SEQ ID NO: 940257 - protein, 9 aa, Homo Sapiens
LFRHLRGHG

SEQ ID NO: 940258 - protein, 9 aa, Homo Sapiens
FYAFNSLAG

SEQ ID NO: 940259 - protein, 9 aa, Homo Sapiens
KVCPRRWKL

SEQ ID NO: 940260 - protein, 9 aa, Homo Sapiens
RARNQLNRI

SEQ ID NO: 940261 - protein, 9 aa, Homo Sapiens
SRYQRVDKA

SEQ ID NO: 940262 - protein, 9 aa, Homo Sapiens
SETLEPFAA

SEQ ID NO: 940263 - protein, 9 aa, Homo Sapiens
WLNPWERNM

SEQ ID NO: 940264 - protein, 9 aa, Homo Sapiens
YCYHDLEDL

SEQ ID NO: 940265 - protein, 9 aa, Homo Sapiens
GGHSNKVMY

SEQ ID NO: 940266 - protein, 9 aa, Homo Sapiens
PKHERAQEV

SEQ ID NO: 940267 - protein, 9 aa, Homo Sapiens
KQPRLPPSR

SEQ ID NO: 940268 - protein, 9 aa, Homo Sapiens
CNGENLAVT

SEQ ID NO: 940269 - protein, 9 aa, Homo Sapiens
EIGSRDGSQ

SEQ ID NO: 940270 - protein, 9 aa, Homo Sapiens
GRVLECSSI

SEQ ID NO: 940271 - protein, 9 aa, Homo Sapiens
CLFAPKVYI

SEQ ID NO: 940272 - protein, 9 aa, Homo Sapiens
LIDFIYKVT

SEQ ID NO: 940273 - protein, 9 aa, Homo Sapiens
NWHKPPKQV

SEQ ID NO: 940274 - protein, 9 aa, Homo Sapiens
KFRACLKIF

SEQ ID NO: 940275 - protein, 9 aa, Homo Sapiens
NGEPTKKLP

SEQ ID NO: 940276 - protein, 9 aa, Homo Sapiens
TLDWKVPKF

SEQ ID NO: 940277 - protein, 9 aa, Homo Sapiens
EKIFRQMNT

SEQ ID NO: 940278 - protein, 9 aa, Homo Sapiens
MKAIALKGG

SEQ ID NO: 940279 - protein, 9 aa, Homo Sapiens
DGKFLRTSC

SEQ ID NO: 940280 - protein, 9 aa, Homo Sapiens
TTHLNVTVL

SEQ ID NO: 940281 - protein, 9 aa, Homo Sapiens
HSLFTDEQV

SEQ ID NO: 940282 - protein, 9 aa, Homo Sapiens
TSGETSGLP

SEQ ID NO: 940283 - protein, 9 aa, Homo Sapiens
FLKRDMDRA

SEQ ID NO: 940284 - protein, 9 aa, Homo Sapiens
ITYLSQTEV

SEQ ID NO: 940285 - protein, 9 aa, Homo Sapiens
LGKQEMVCV

SEQ ID NO: 940286 - protein, 9 aa, Homo Sapiens
ILAVIKLAC

SEQ ID NO: 940287 - protein, 9 aa, Homo Sapiens
AFQDIEACI

SEQ ID NO: 940288 - protein, 9 aa, Homo Sapiens
YSVTKDTLQ

SEQ ID NO: 940289 - protein, 9 aa, Homo Sapiens
ALGAAAALR

SEQ ID NO: 940290 - protein, 9 aa, Homo Sapiens
DALLAQKVC

SEQ ID NO: 940291 - protein, 9 aa, Homo Sapiens
VPDSTGQSV

SEQ ID NO: 940292 - protein, 9 aa, Homo Sapiens
LTAPTSPLC

SEQ ID NO: 940293 - protein, 9 aa, Homo Sapiens
IFPSQFYIR

SEQ ID NO: 940294 - protein, 9 aa, Homo Sapiens
DLEDLQWIC

SEQ ID NO: 940295 - protein, 9 aa, Homo Sapiens
QDRNKEAIK

SEQ ID NO: 940296 - protein, 9 aa, Homo Sapiens
KIYTGEKPF

SEQ ID NO: 940297 - protein, 9 aa, Homo Sapiens
AKPINLDSC

SEQ ID NO: 940298 - protein, 9 aa, Homo Sapiens
LFPHLYFLA

SEQ ID NO: 940299 - protein, 9 aa, Homo Sapiens
IPDTQIADE

SEQ ID NO: 940300 - protein, 9 aa, Homo Sapiens
STTRQREST

SEQ ID NO: 940301 - protein, 9 aa, Homo Sapiens
FFFFFFVLC

SEQ ID NO: 940302 - protein, 9 aa, Homo Sapiens
KINILLKNL

SEQ ID NO: 940303 - protein, 9 aa, Homo Sapiens
SQDTLRSMK

SEQ ID NO: 940304 - protein, 9 aa, Homo Sapiens
NSASVSLPL

SEQ ID NO: 940305 - protein, 9 aa, Homo Sapiens
DTSCLTCRM

SEQ ID NO: 940306 - protein, 9 aa, Homo Sapiens
QHYKKTKRK

SEQ ID NO: 940307 - protein, 9 aa, Homo Sapiens
APNLFHLQL

SEQ ID NO: 940308 - protein, 9 aa, Homo Sapiens
PYPQPLAQV

SEQ ID NO: 940309 - protein, 9 aa, Homo Sapiens
KPELPQNGT

SEQ ID NO: 940310 - protein, 9 aa, Homo Sapiens
FLNKHRRFC

SEQ ID NO: 940311 - protein, 9 aa, Homo Sapiens
LLSGPENHR

SEQ ID NO: 940312 - protein, 9 aa, Homo Sapiens
QEEKGKKGE

SEQ ID NO: 940313 - protein, 9 aa, Homo Sapiens
GYSSYDFMK

SEQ ID NO: 940314 - protein, 9 aa, Homo Sapiens
PRPFSPAVT

SEQ ID NO: 940315 - protein, 9 aa, Homo Sapiens
GRAGGPSPG

SEQ ID NO: 940316 - protein, 9 aa, Homo Sapiens
PGNLFSLIG

SEQ ID NO: 940317 - protein, 9 aa, Homo Sapiens
GADPEVRNT

SEQ ID NO: 940318 - protein, 9 aa, Homo Sapiens
PYFDLSAGL

SEQ ID NO: 940319 - protein, 9 aa, Homo Sapiens
FFAFELMQD

SEQ ID NO: 940320 - protein, 9 aa, Homo Sapiens
LHSELSLDV

SEQ ID NO: 940321 - protein, 9 aa, Homo Sapiens
STRLTLNGS

SEQ ID NO: 940322 - protein, 9 aa, Homo Sapiens
MFYINPEKG

SEQ ID NO: 940323 - protein, 9 aa, Homo Sapiens
EEDEWDSSH

SEQ ID NO: 940324 - protein, 9 aa, Homo Sapiens
RVGILKTTH

SEQ ID NO: 940325 - protein, 9 aa, Homo Sapiens
DKPNAIVSD

SEQ ID NO: 940326 - protein, 9 aa, Homo Sapiens
CNQLLMYQA

SEQ ID NO: 940327 - protein, 9 aa, Homo Sapiens
VSIRKELKR

SEQ ID NO: 940328 - protein, 9 aa, Homo Sapiens
YKKTKRKHG

SEQ ID NO: 940329 - protein, 9 aa, Homo Sapiens
ADLSRNCFT

SEQ ID NO: 940330 - protein, 9 aa, Homo Sapiens
TITNLKGSP

SEQ ID NO: 940331 - protein, 9 aa, Homo Sapiens
NTVSPSLSP

SEQ ID NO: 940332 - protein, 9 aa, Homo Sapiens
SGCKRKFLK

SEQ ID NO: 940333 - protein, 9 aa, Homo Sapiens
RGGPLLRAR

SEQ ID NO: 940334 - protein, 9 aa, Homo Sapiens
THNPMPCGS

SEQ ID NO: 940335 - protein, 9 aa, Homo Sapiens
GAACHGDII

SEQ ID NO: 940336 - protein, 9 aa, Homo Sapiens
EQKRLNLDC

SEQ ID NO: 940337 - protein, 9 aa, Homo Sapiens
PKDDIQLVG

SEQ ID NO: 940338 - protein, 9 aa, Homo Sapiens
IKIPSFSET

SEQ ID NO: 940339 - protein, 9 aa, Homo Sapiens
SPEKKEERE

SEQ ID NO: 940340 - protein, 9 aa, Homo Sapiens
FFYCFAILP

SEQ ID NO: 940341 - protein, 9 aa, Homo Sapiens
EPKAVFYAA

SEQ ID NO: 940342 - protein, 9 aa, Homo Sapiens
TQIYVLPEI

SEQ ID NO: 940343 - protein, 9 aa, Homo Sapiens
PKVGASGPA

SEQ ID NO: 940344 - protein, 9 aa, Homo Sapiens
VLCQTQFSI

SEQ ID NO: 940345 - protein, 9 aa, Homo Sapiens
YAEIEKRYA

SEQ ID NO: 940346 - protein, 9 aa, Homo Sapiens
ATMGGLTGF

SEQ ID NO: 940347 - protein, 9 aa, Homo Sapiens
WLWEGSLSS

SEQ ID NO: 940348 - protein, 9 aa, Homo Sapiens
LDANEAALG

SEQ ID NO: 940349 - protein, 9 aa, Homo Sapiens
REGSLSPVK

SEQ ID NO: 940350 - protein, 9 aa, Homo Sapiens
FPGFILDQK

SEQ ID NO: 940351 - protein, 9 aa, Homo Sapiens
LSADWGLVL

SEQ ID NO: 940352 - protein, 9 aa, Homo Sapiens
YCVCVTKEY

SEQ ID NO: 940353 - protein, 9 aa, Homo Sapiens
LKENSKTWK

SEQ ID NO: 940354 - protein, 9 aa, Homo Sapiens
CTTIEHLFC

SEQ ID NO: 940355 - protein, 9 aa, Homo Sapiens
GAFAALTPF

SEQ ID NO: 940356 - protein, 9 aa, Homo Sapiens
SKEEEEPKK

SEQ ID NO: 940357 - protein, 9 aa, Homo Sapiens
LLGCFLLIP

SEQ ID NO: 940358 - protein, 9 aa, Homo Sapiens
QSMFSTVTP

SEQ ID NO: 940359 - protein, 9 aa, Homo Sapiens
EAKHDYRPT

SEQ ID NO: 940360 - protein, 9 aa, Homo Sapiens
CNEAGNIEA

SEQ ID NO: 940361 - protein, 9 aa, Homo Sapiens
PQGQLLILK

SEQ ID NO: 940362 - protein, 9 aa, Homo Sapiens
AMGTPWRDY

SEQ ID NO: 940363 - protein, 9 aa, Homo Sapiens
IIEELRCVQ

SEQ ID NO: 940364 - protein, 9 aa, Homo Sapiens
LVVRKYFQR

SEQ ID NO: 940365 - protein, 9 aa, Homo Sapiens
EEGAQCSAP

SEQ ID NO: 940366 - protein, 9 aa, Homo Sapiens
KMGTGGSSS

SEQ ID NO: 940367 - protein, 9 aa, Homo Sapiens
ETNIILNIG

SEQ ID NO: 940368 - protein, 9 aa, Homo Sapiens
LDHLESGAF

SEQ ID NO: 940369 - protein, 9 aa, Homo Sapiens
GANTTLQMT

SEQ ID NO: 940370 - protein, 9 aa, Homo Sapiens
SYALLLLLK

SEQ ID NO: 940371 - protein, 9 aa, Homo Sapiens
SRSRGTGLF

SEQ ID NO: 940372 - protein, 9 aa, Homo Sapiens
CNKKKWLYA

SEQ ID NO: 940373 - protein, 9 aa, Homo Sapiens
EWPAKALKS

SEQ ID NO: 940374 - protein, 9 aa, Homo Sapiens
LNISISLDS

SEQ ID NO: 940375 - protein, 9 aa, Homo Sapiens
EIKEVLTPE

SEQ ID NO: 940376 - protein, 9 aa, Homo Sapiens
IINLLTSDS

SEQ ID NO: 940377 - protein, 9 aa, Homo Sapiens
NTDFFAKKI

SEQ ID NO: 940378 - protein, 9 aa, Homo Sapiens
IMLLNLAYK

SEQ ID NO: 940379 - protein, 9 aa, Homo Sapiens
IWSLRKSFA

SEQ ID NO: 940380 - protein, 9 aa, Homo Sapiens
GSLTHTATS

SEQ ID NO: 940381 - protein, 9 aa, Homo Sapiens
ELYYLASFS

SEQ ID NO: 940382 - protein, 9 aa, Homo Sapiens
SENNLKPAE

SEQ ID NO: 940383 - protein, 9 aa, Homo Sapiens
GHLEKYGKG

SEQ ID NO: 940384 - protein, 9 aa, Homo Sapiens
VLLKIMDAK

SEQ ID NO: 940385 - protein, 9 aa, Homo Sapiens
AIPSSSISL

SEQ ID NO: 940386 - protein, 9 aa, Homo Sapiens
SPTGSESLF

SEQ ID NO: 940387 - protein, 9 aa, Homo Sapiens
QSPAPPATL

SEQ ID NO: 940388 - protein, 9 aa, Homo Sapiens
ENTLTIHGL

SEQ ID NO: 940389 - protein, 9 aa, Homo Sapiens
LQSLMELPN

SEQ ID NO: 940390 - protein, 9 aa, Homo Sapiens
ECETAGLKK

SEQ ID NO: 940391 - protein, 9 aa, Homo Sapiens
GDCEELQQT

SEQ ID NO: 940392 - protein, 9 aa, Homo Sapiens
GKKGSGNTL

SEQ ID NO: 940393 - protein, 9 aa, Homo Sapiens
DITYLSQTE

SEQ ID NO: 940394 - protein, 9 aa, Homo Sapiens
FIRCNEAGN

SEQ ID NO: 940395 - protein, 9 aa, Homo Sapiens
VIGIWVMVD

SEQ ID NO: 940396 - protein, 9 aa, Homo Sapiens
QFDVFFRHS

SEQ ID NO: 940397 - protein, 9 aa, Homo Sapiens
LVEQFVFEV

SEQ ID NO: 940398 - protein, 9 aa, Homo Sapiens
PNFVMLAAH

SEQ ID NO: 940399 - protein, 9 aa, Homo Sapiens
LQSRETAKT

SEQ ID NO: 940400 - protein, 9 aa, Homo Sapiens
EFDSVPLKT

SEQ ID NO: 940401 - protein, 9 aa, Homo Sapiens
AEKENQVQE

SEQ ID NO: 940402 - protein, 9 aa, Homo Sapiens
GGRAETQGA

SEQ ID NO: 940403 - protein, 9 aa, Homo Sapiens
ATCTTNKTM

SEQ ID NO: 940404 - protein, 9 aa, Homo Sapiens
GLPEGSESE

SEQ ID NO: 940405 - protein, 9 aa, Homo Sapiens
HGDCEELQQ

SEQ ID NO: 940406 - protein, 9 aa, Homo Sapiens
QMTIWLEAS

SEQ ID NO: 940407 - protein, 9 aa, Homo Sapiens
QWRNMNTIN

SEQ ID NO: 940408 - protein, 9 aa, Homo Sapiens
QKELQSEIR

SEQ ID NO: 940409 - protein, 9 aa, Homo Sapiens
PIVLSSEAN

SEQ ID NO: 940410 - protein, 9 aa, Homo Sapiens
KVCFEIKED

SEQ ID NO: 940411 - protein, 9 aa, Homo Sapiens
DFEDITYLS

SEQ ID NO: 940412 - protein, 9 aa, Homo Sapiens
KTSKAEKEN

SEQ ID NO: 940413 - protein, 9 aa, Homo Sapiens
KGALKRVFW

SEQ ID NO: 940414 - protein, 9 aa, Homo Sapiens
RMQSFNEKF

SEQ ID NO: 940415 - protein, 9 aa, Homo Sapiens
GPLLRARSS

SEQ ID NO: 940416 - protein, 9 aa, Homo Sapiens
IPNHVVPEM

SEQ ID NO: 940417 - protein, 9 aa, Homo Sapiens
KRFYSSPDI

SEQ ID NO: 940418 - protein, 9 aa, Homo Sapiens
PILVKSVNI

SEQ ID NO: 940419 - protein, 9 aa, Homo Sapiens
LLALPPVRP

SEQ ID NO: 940420 - protein, 9 aa, Homo Sapiens
EEELPGEAC

SEQ ID NO: 940421 - protein, 9 aa, Homo Sapiens
RLRGPRGVL

SEQ ID NO: 940422 - protein, 9 aa, Homo Sapiens
QTIDHPWTV

SEQ ID NO: 940423 - protein, 9 aa, Homo Sapiens
VIARNGKIY

SEQ ID NO: 940424 - protein, 9 aa, Homo Sapiens
LSSKDSRPL

SEQ ID NO: 940425 - protein, 9 aa, Homo Sapiens
HRYQELQRL

SEQ ID NO: 940426 - protein, 9 aa, Homo Sapiens
NHLSTISWG

SEQ ID NO: 940427 - protein, 9 aa, Homo Sapiens
VIDAKFFAR

SEQ ID NO: 940428 - protein, 9 aa, Homo Sapiens
FSLSIYGQS

SEQ ID NO: 940429 - protein, 9 aa, Homo Sapiens
ASSKEAFKM

SEQ ID NO: 940430 - protein, 9 aa, Homo Sapiens
EENPMEVFK

SEQ ID NO: 940431 - protein, 9 aa, Homo Sapiens
SEVTFFTPA

SEQ ID NO: 940432 - protein, 9 aa, Homo Sapiens
KYMELEISP

SEQ ID NO: 940433 - protein, 9 aa, Homo Sapiens
IFQANEELC

SEQ ID NO: 940434 - protein, 9 aa, Homo Sapiens
FRPWEGTDE

SEQ ID NO: 940435 - protein, 9 aa, Homo Sapiens
GQLPMLFSF

SEQ ID NO: 940436 - protein, 9 aa, Homo Sapiens
QHGDNASEE

SEQ ID NO: 940437 - protein, 9 aa, Homo Sapiens
GGACLLVIG

SEQ ID NO: 940438 - protein, 9 aa, Homo Sapiens
KIKNAYEKS

SEQ ID NO: 940439 - protein, 9 aa, Homo Sapiens
KTLQKFLER

SEQ ID NO: 940440 - protein, 9 aa, Homo Sapiens
RTSRPASTH

SEQ ID NO: 940441 - protein, 9 aa, Homo Sapiens
PINLESIFQ

SEQ ID NO: 940442 - protein, 9 aa, Homo Sapiens
GVSSFIGTE

SEQ ID NO: 940443 - protein, 9 aa, Homo Sapiens
PVSKPDVIF

SEQ ID NO: 940444 - protein, 9 aa, Homo Sapiens
PAAVAAAAS

SEQ ID NO: 940445 - protein, 9 aa, Homo Sapiens
FYQKIDENI

SEQ ID NO: 940446 - protein, 9 aa, Homo Sapiens
ICWPKGTVG

SEQ ID NO: 940447 - protein, 9 aa, Homo Sapiens
RLSGPAELG

SEQ ID NO: 940448 - protein, 9 aa, Homo Sapiens
WSMKTTSSI

SEQ ID NO: 940449 - protein, 9 aa, Homo Sapiens
GFCKCKKCK

SEQ ID NO: 940450 - protein, 9 aa, Homo Sapiens
WLALQPKEQ

SEQ ID NO: 940451 - protein, 9 aa, Homo Sapiens
VVRKYFQRI

SEQ ID NO: 940452 - protein, 9 aa, Homo Sapiens
AVDVSARAK

SEQ ID NO: 940453 - protein, 9 aa, Homo Sapiens
YKIFKGTLK

SEQ ID NO: 940454 - protein, 9 aa, Homo Sapiens
AKPKKRFSK

SEQ ID NO: 940455 - protein, 9 aa, Homo Sapiens
EDETLGQLL

SEQ ID NO: 940456 - protein, 9 aa, Homo Sapiens
DPEVRNTTG

SEQ ID NO: 940457 - protein, 9 aa, Homo Sapiens
SRLKNMCSG

SEQ ID NO: 940458 - protein, 9 aa, Homo Sapiens
LPPAPGLQP

SEQ ID NO: 940459 - protein, 9 aa, Homo Sapiens
NIILQSVGP

SEQ ID NO: 940460 - protein, 9 aa, Homo Sapiens
FSPPNIPIK

SEQ ID NO: 940461 - protein, 9 aa, Homo Sapiens
QEELKKLRT

SEQ ID NO: 940462 - protein, 9 aa, Homo Sapiens
KLHDGGLNY

SEQ ID NO: 940463 - protein, 9 aa, Homo Sapiens
EETPEKIQM

SEQ ID NO: 940464 - protein, 9 aa, Homo Sapiens
ILRKHQRIH

SEQ ID NO: 940465 - protein, 9 aa, Homo Sapiens
GESGRQSVT

SEQ ID NO: 940466 - protein, 9 aa, Homo Sapiens
GSESESSCC

SEQ ID NO: 940467 - protein, 9 aa, Homo Sapiens
NSLPGENGA

SEQ ID NO: 940468 - protein, 9 aa, Homo Sapiens
TASLQISPQ

SEQ ID NO: 940469 - protein, 9 aa, Homo Sapiens
VDEVSVSFR

SEQ ID NO: 940470 - protein, 9 aa, Homo Sapiens
ETSFSLSKK

SEQ ID NO: 940471 - protein, 9 aa, Homo Sapiens
LSVEELLLF

SEQ ID NO: 940472 - protein, 9 aa, Homo Sapiens
ALCFPSPGN

SEQ ID NO: 940473 - protein, 9 aa, Homo Sapiens
RVKNLMLSV

SEQ ID NO: 940474 - protein, 9 aa, Homo Sapiens
TFFKKETPV

SEQ ID NO: 940475 - protein, 9 aa, Homo Sapiens
RPAEGDRGP

SEQ ID NO: 940476 - protein, 9 aa, Homo Sapiens
DLDHNVKFN

SEQ ID NO: 940477 - protein, 9 aa, Homo Sapiens
AVKVLLHKA

SEQ ID NO: 940478 - protein, 9 aa, Homo Sapiens
WNCNKKKWL

SEQ ID NO: 940479 - protein, 9 aa, Homo Sapiens
KKKEKESFL

SEQ ID NO: 940480 - protein, 9 aa, Homo Sapiens
SCVSDHKHH

SEQ ID NO: 940481 - protein, 9 aa, Homo Sapiens
SLDKNLGPR

SEQ ID NO: 940482 - protein, 9 aa, Homo Sapiens
TGKSRRNLS

SEQ ID NO: 940483 - protein, 9 aa, Homo Sapiens
MTAIIKETV

SEQ ID NO: 940484 - protein, 9 aa, Homo Sapiens
HLDWPVQQR

SEQ ID NO: 940485 - protein, 9 aa, Homo Sapiens
PVLPIVHYN

SEQ ID NO: 940486 - protein, 9 aa, Homo Sapiens
GADSQDQQA

SEQ ID NO: 940487 - protein, 9 aa, Homo Sapiens
ATPEISQVK

SEQ ID NO: 940488 - protein, 9 aa, Homo Sapiens
PQPWPRFLG

SEQ ID NO: 940489 - protein, 9 aa, Homo Sapiens
PTCPATVSF

SEQ ID NO: 940490 - protein, 9 aa, Homo Sapiens
SKSPFPPRL

SEQ ID NO: 940491 - protein, 9 aa, Homo Sapiens
TDLKGEKRD

SEQ ID NO: 940492 - protein, 9 aa, Homo Sapiens
DKELRHQQE

SEQ ID NO: 940493 - protein, 9 aa, Homo Sapiens
QKEISDLTE

SEQ ID NO: 940494 - protein, 9 aa, Homo Sapiens
VLANGQVSE

SEQ ID NO: 940495 - protein, 9 aa, Homo Sapiens
KNIGLNRPL

SEQ ID NO: 940496 - protein, 9 aa, Homo Sapiens
YLSQTEVPT

SEQ ID NO: 940497 - protein, 9 aa, Homo Sapiens
RNPVWNVSG

SEQ ID NO: 940498 - protein, 9 aa, Homo Sapiens
TNNRLLHFV

SEQ ID NO: 940499 - protein, 9 aa, Homo Sapiens
SGGLAEEAK

SEQ ID NO: 940500 - protein, 9 aa, Homo Sapiens
NKHKKIYAG

SEQ ID NO: 940501 - protein, 9 aa, Homo Sapiens
FCDFLKINH

SEQ ID NO: 940502 - protein, 9 aa, Homo Sapiens
DCFLHLLRR

SEQ ID NO: 940503 - protein, 9 aa, Homo Sapiens
TLVHLINPE

SEQ ID NO: 940504 - protein, 9 aa, Homo Sapiens
CETAGLKKL

SEQ ID NO: 940505 - protein, 9 aa, Homo Sapiens
AFLAGMRNR

SEQ ID NO: 940506 - protein, 9 aa, Homo Sapiens
KEEAAGGER

SEQ ID NO: 940507 - protein, 9 aa, Homo Sapiens
VTRFGGDWV

SEQ ID NO: 940508 - protein, 9 aa, Homo Sapiens
RDSKTYRRS

SEQ ID NO: 940509 - protein, 9 aa, Homo Sapiens
AGSTRLTLN

SEQ ID NO: 940510 - protein, 9 aa, Homo Sapiens
ATGMSLEVP

SEQ ID NO: 940511 - protein, 9 aa, Homo Sapiens
KGPLVFVAL

SEQ ID NO: 940512 - protein, 9 aa, Homo Sapiens
VCLVTPVTV

SEQ ID NO: 940513 - protein, 9 aa, Homo Sapiens
VQTAVDTIL

SEQ ID NO: 940514 - protein, 9 aa, Homo Sapiens
SKNMRDNNM

SEQ ID NO: 940515 - protein, 9 aa, Homo Sapiens
TVHELIVSG

SEQ ID NO: 940516 - protein, 9 aa, Homo Sapiens
CPVLILHWR

SEQ ID NO: 940517 - protein, 9 aa, Homo Sapiens
LDHHERCNC

SEQ ID NO: 940518 - protein, 9 aa, Homo Sapiens
EQCSLLDTN

SEQ ID NO: 940519 - protein, 9 aa, Homo Sapiens
SGACDKKGC

SEQ ID NO: 940520 - protein, 9 aa, Homo Sapiens
FAPKVYIIL

SEQ ID NO: 940521 - protein, 9 aa, Homo Sapiens
EVVGQSRGR

SEQ ID NO: 940522 - protein, 9 aa, Homo Sapiens
IAETFKNKK

SEQ ID NO: 940523 - protein, 9 aa, Homo Sapiens
SVCFFEISS

SEQ ID NO: 940524 - protein, 9 aa, Homo Sapiens
LLRTILQAS

SEQ ID NO: 940525 - protein, 9 aa, Homo Sapiens
MSTMTSWES

SEQ ID NO: 940526 - protein, 9 aa, Homo Sapiens
LLPQAPAFF

SEQ ID NO: 940527 - protein, 9 aa, Homo Sapiens
PVAPKKITV

SEQ ID NO: 940528 - protein, 9 aa, Homo Sapiens
PEVLAKIFS

SEQ ID NO: 940529 - protein, 9 aa, Homo Sapiens
AWDKSLAPK

SEQ ID NO: 940530 - protein, 9 aa, Homo Sapiens
VTFGMVVCN

SEQ ID NO: 940531 - protein, 9 aa, Homo Sapiens
LYSGRDIPG

SEQ ID NO: 940532 - protein, 9 aa, Homo Sapiens
ATVIQKAYW

SEQ ID NO: 940533 - protein, 9 aa, Homo Sapiens
GQLKEIMAN

SEQ ID NO: 940534 - protein, 9 aa, Homo Sapiens
AVEGEGSVR

SEQ ID NO: 940535 - protein, 9 aa, Homo Sapiens
RKKKQKPKK

SEQ ID NO: 940536 - protein, 9 aa, Homo Sapiens
SQAPPSPLT

SEQ ID NO: 940537 - protein, 9 aa, Homo Sapiens
TLFSSRRGR

SEQ ID NO: 940538 - protein, 9 aa, Homo Sapiens
KLPAIHDLH

SEQ ID NO: 940539 - protein, 9 aa, Homo Sapiens
AFNMPLQGP

SEQ ID NO: 940540 - protein, 9 aa, Homo Sapiens
TKVFIQRNY

SEQ ID NO: 940541 - protein, 9 aa, Homo Sapiens
WPVQQRAWE

SEQ ID NO: 940542 - protein, 9 aa, Homo Sapiens
LKKGHRQDG

SEQ ID NO: 940543 - protein, 9 aa, Homo Sapiens
RKPPHEPHV

SEQ ID NO: 940544 - protein, 9 aa, Homo Sapiens
TLLLYKKEE

SEQ ID NO: 940545 - protein, 9 aa, Homo Sapiens
YQELKIEEN

SEQ ID NO: 940546 - protein, 9 aa, Homo Sapiens
PFWYATRPK

SEQ ID NO: 940547 - protein, 9 aa, Homo Sapiens
AEVLLLPLD

SEQ ID NO: 940548 - protein, 9 aa, Homo Sapiens
PEGPIPGHL

SEQ ID NO: 940549 - protein, 9 aa, Homo Sapiens
EATPQPRFE

SEQ ID NO: 940550 - protein, 9 aa, Homo Sapiens
EAAGGERDA

SEQ ID NO: 940551 - protein, 9 aa, Homo Sapiens
LQRCCQGHC

SEQ ID NO: 940552 - protein, 9 aa, Homo Sapiens
ITGTQSPYG

SEQ ID NO: 940553 - protein, 9 aa, Homo Sapiens
ALLAQKVCP

SEQ ID NO: 940554 - protein, 9 aa, Homo Sapiens
PSSLMLQPA

SEQ ID NO: 940555 - protein, 9 aa, Homo Sapiens
KEIAAACIH

SEQ ID NO: 940556 - protein, 9 aa, Homo Sapiens
LGLYGSSLG

SEQ ID NO: 940557 - protein, 9 aa, Homo Sapiens
RFYVWGSPW

SEQ ID NO: 940558 - protein, 9 aa, Homo Sapiens
PNCFFLFSR

SEQ ID NO: 940559 - protein, 9 aa, Homo Sapiens
ETQGLMMRP

SEQ ID NO: 940560 - protein, 9 aa, Homo Sapiens
DPKKLIQLP

SEQ ID NO: 940561 - protein, 9 aa, Homo Sapiens
WKTHDASGQ

SEQ ID NO: 940562 - protein, 9 aa, Homo Sapiens
SSRTQVSER

SEQ ID NO: 940563 - protein, 9 aa, Homo Sapiens
TDGSVRSGL

SEQ ID NO: 940564 - protein, 9 aa, Homo Sapiens
QCSLLDTNS

SEQ ID NO: 940565 - protein, 9 aa, Homo Sapiens
QIGFFCIIS

SEQ ID NO: 940566 - protein, 9 aa, Homo Sapiens
EMSLVGPFP

SEQ ID NO: 940567 - protein, 9 aa, Homo Sapiens
DKKGCREDL

SEQ ID NO: 940568 - protein, 9 aa, Homo Sapiens
LRKMQEEET

SEQ ID NO: 940569 - protein, 9 aa, Homo Sapiens
ENKNLQKEI

SEQ ID NO: 940570 - protein, 9 aa, Homo Sapiens
EGPIPGHLV

SEQ ID NO: 940571 - protein, 9 aa, Homo Sapiens
HEFSPEYFV

SEQ ID NO: 940572 - protein, 9 aa, Homo Sapiens
IVLNKSKTI

SEQ ID NO: 940573 - protein, 9 aa, Homo Sapiens
FLEQVTLDA

SEQ ID NO: 940574 - protein, 9 aa, Homo Sapiens
AFAALTPFW

SEQ ID NO: 940575 - protein, 9 aa, Homo Sapiens
HLLLLRQVA

SEQ ID NO: 940576 - protein, 9 aa, Homo Sapiens
RSNSGMDSN

SEQ ID NO: 940577 - protein, 9 aa, Homo Sapiens
KEKMDKLLP

SEQ ID NO: 940578 - protein, 9 aa, Homo Sapiens
SEFLLLSLP

SEQ ID NO: 940579 - protein, 9 aa, Homo Sapiens
LFMQLLLAS

SEQ ID NO: 940580 - protein, 9 aa, Homo Sapiens
NNKESSEQG

SEQ ID NO: 940581 - protein, 9 aa, Homo Sapiens
LLFGPRGAS

SEQ ID NO: 940582 - protein, 9 aa, Homo Sapiens
LQQQMPTLE

SEQ ID NO: 940583 - protein, 9 aa, Homo Sapiens
YVITKFGRK

SEQ ID NO: 940584 - protein, 9 aa, Homo Sapiens
IQNSHYGQS

SEQ ID NO: 940585 - protein, 9 aa, Homo Sapiens
LSYYKKIHT

SEQ ID NO: 940586 - protein, 9 aa, Homo Sapiens
KETEAREAK

SEQ ID NO: 940587 - protein, 9 aa, Homo Sapiens
KECKDLIKS

SEQ ID NO: 940588 - protein, 9 aa, Homo Sapiens
PKPDAFNLC

SEQ ID NO: 940589 - protein, 9 aa, Homo Sapiens
KEAPKFFSF

SEQ ID NO: 940590 - protein, 9 aa, Homo Sapiens
FFKKETPVT

SEQ ID NO: 940591 - protein, 9 aa, Homo Sapiens
ERRTSKAQR

SEQ ID NO: 940592 - protein, 9 aa, Homo Sapiens
MLNGYLLAF

SEQ ID NO: 940593 - protein, 9 aa, Homo Sapiens
LDGGSPLRT

SEQ ID NO: 940594 - protein, 9 aa, Homo Sapiens
TSEDFPDFS

SEQ ID NO: 940595 - protein, 9 aa, Homo Sapiens
MKKTKGQQI

SEQ ID NO: 940596 - protein, 9 aa, Homo Sapiens
RGDDSVPEY

SEQ ID NO: 940597 - protein, 9 aa, Homo Sapiens
KTEVLLKIM

SEQ ID NO: 940598 - protein, 9 aa, Homo Sapiens
SGDLQQHYL

SEQ ID NO: 940599 - protein, 9 aa, Homo Sapiens
DCPCETCGK

SEQ ID NO: 940600 - protein, 9 aa, Homo Sapiens
RPFSPAVTS

SEQ ID NO: 940601 - protein, 9 aa, Homo Sapiens
RCNEAGNIE

SEQ ID NO: 940602 - protein, 9 aa, Homo Sapiens
GSCISQPRP

SEQ ID NO: 940603 - protein, 9 aa, Homo Sapiens
FAPNKNQLD

SEQ ID NO: 940604 - protein, 9 aa, Homo Sapiens
FVSRQHKQL

SEQ ID NO: 940605 - protein, 9 aa, Homo Sapiens
RLIRQLLEE

SEQ ID NO: 940606 - protein, 9 aa, Homo Sapiens
SKSSQQWRE

SEQ ID NO: 940607 - protein, 9 aa, Homo Sapiens
LEIKFLGDI

SEQ ID NO: 940608 - protein, 9 aa, Homo Sapiens
SFFLWQRGR

SEQ ID NO: 940609 - protein, 9 aa, Homo Sapiens
CRAMAEPDP

SEQ ID NO: 940610 - protein, 9 aa, Homo Sapiens
ILVSSANKI

SEQ ID NO: 940611 - protein, 9 aa, Homo Sapiens
RDSRRLEPK

SEQ ID NO: 940612 - protein, 9 aa, Homo Sapiens
EEPKKTEAP

SEQ ID NO: 940613 - protein, 9 aa, Homo Sapiens
LIIVNAKFE

SEQ ID NO: 940614 - protein, 9 aa, Homo Sapiens
VLQSVGGHG

SEQ ID NO: 940615 - protein, 9 aa, Homo Sapiens
AKADALADA

SEQ ID NO: 940616 - protein, 9 aa, Homo Sapiens
SGVKRTAKN

SEQ ID NO: 940617 - protein, 9 aa, Homo Sapiens
KLHSELSLD

SEQ ID NO: 940618 - protein, 9 aa, Homo Sapiens
QQASASSFA

SEQ ID NO: 940619 - protein, 9 aa, Homo Sapiens
ATMAYDCYV

SEQ ID NO: 940620 - protein, 9 aa, Homo Sapiens
KAYWSYVLH

SEQ ID NO: 940621 - protein, 9 aa, Homo Sapiens
SESPLHAVQ

SEQ ID NO: 940622 - protein, 9 aa, Homo Sapiens
LQSVGGHGL

SEQ ID NO: 940623 - protein, 9 aa, Homo Sapiens
LSCNHIKLV

SEQ ID NO: 940624 - protein, 9 aa, Homo Sapiens
KELEQLFLQ

SEQ ID NO: 940625 - protein, 9 aa, Homo Sapiens
EALICTVFQ

SEQ ID NO: 940626 - protein, 9 aa, Homo Sapiens
VIIHVAQNP

SEQ ID NO: 940627 - protein, 9 aa, Homo Sapiens
TLRKSAKYR

SEQ ID NO: 940628 - protein, 9 aa, Homo Sapiens
GVGLFGPPM

SEQ ID NO: 940629 - protein, 9 aa, Homo Sapiens
QLRNFLKCF

SEQ ID NO: 940630 - protein, 9 aa, Homo Sapiens
RYESITLQS

SEQ ID NO: 940631 - protein, 9 aa, Homo Sapiens
YLQRRPCNV

SEQ ID NO: 940632 - protein, 9 aa, Homo Sapiens
FSVMTRQNQ

SEQ ID NO: 940633 - protein, 9 aa, Homo Sapiens
LGCFLLIPL

SEQ ID NO: 940634 - protein, 9 aa, Homo Sapiens
RVPRQSFLN

SEQ ID NO: 940635 - protein, 9 aa, Homo Sapiens
QARGQLKEI

SEQ ID NO: 940636 - protein, 9 aa, Homo Sapiens
YSAGTELSL

SEQ ID NO: 940637 - protein, 9 aa, Homo Sapiens
SMLEDSGFK

SEQ ID NO: 940638 - protein, 9 aa, Homo Sapiens
RDVLQKLSS

SEQ ID NO: 940639 - protein, 9 aa, Homo Sapiens
LALAAGQTP

SEQ ID NO: 940640 - protein, 9 aa, Homo Sapiens
KLWGEEYNW

SEQ ID NO: 940641 - protein, 9 aa, Homo Sapiens
KLIQALVLL

SEQ ID NO: 940642 - protein, 9 aa, Homo Sapiens
VRKGNLEQE

SEQ ID NO: 940643 - protein, 9 aa, Homo Sapiens
LYLQENPLS

SEQ ID NO: 940644 - protein, 9 aa, Homo Sapiens
YFVFPTLFR

SEQ ID NO: 940645 - protein, 9 aa, Homo Sapiens
GNYMVYRIS

SEQ ID NO: 940646 - protein, 9 aa, Homo Sapiens
VMASCTSVP

SEQ ID NO: 940647 - protein, 9 aa, Homo Sapiens
REMSLVGPF

SEQ ID NO: 940648 - protein, 9 aa, Homo Sapiens
KSRRNLSDF

SEQ ID NO: 940649 - protein, 9 aa, Homo Sapiens
ALDGGSPLR

SEQ ID NO: 940650 - protein, 9 aa, Homo Sapiens
YRWAVFSVM

SEQ ID NO: 940651 - protein, 9 aa, Homo Sapiens
SSEDQNTLI

SEQ ID NO: 940652 - protein, 9 aa, Homo Sapiens
SRTQVSERA

SEQ ID NO: 940653 - protein, 9 aa, Homo Sapiens
KSTDKKERK

SEQ ID NO: 940654 - protein, 9 aa, Homo Sapiens
GLFSNARFS

SEQ ID NO: 940655 - protein, 9 aa, Homo Sapiens
QNPDFAGSS

SEQ ID NO: 940656 - protein, 9 aa, Homo Sapiens
SRGLRGSQA

SEQ ID NO: 940657 - protein, 9 aa, Homo Sapiens
SRWGLCINR

SEQ ID NO: 940658 - protein, 9 aa, Homo Sapiens
ITKEAHKTV

SEQ ID NO: 940659 - protein, 9 aa, Homo Sapiens
GNKIEEISG

SEQ ID NO: 940660 - protein, 9 aa, Homo Sapiens
RRFTVSTLR

SEQ ID NO: 940661 - protein, 9 aa, Homo Sapiens
RLREDTLSE

SEQ ID NO: 940662 - protein, 9 aa, Homo Sapiens
DVRQKLKNC

SEQ ID NO: 940663 - protein, 9 aa, Homo Sapiens
LVQVDYMKT

SEQ ID NO: 940664 - protein, 9 aa, Homo Sapiens
VATSKLVQV

SEQ ID NO: 940665 - protein, 9 aa, Homo Sapiens
TCIIKVFSL

SEQ ID NO: 940666 - protein, 9 aa, Homo Sapiens
RQEAQVKKR

SEQ ID NO: 940667 - protein, 9 aa, Homo Sapiens
CYLYEFWYK

SEQ ID NO: 940668 - protein, 9 aa, Homo Sapiens
PDSLGGSFA

SEQ ID NO: 940669 - protein, 9 aa, Homo Sapiens
SCEYYSPIF

SEQ ID NO: 940670 - protein, 9 aa, Homo Sapiens
FPPRLTEDR

SEQ ID NO: 940671 - protein, 9 aa, Homo Sapiens
AFEICPYNP

SEQ ID NO: 940672 - protein, 9 aa, Homo Sapiens
YKDSSNFGA

SEQ ID NO: 940673 - protein, 9 aa, Homo Sapiens
LLQRCCQGH

SEQ ID NO: 940674 - protein, 9 aa, Homo Sapiens
EELSVEELL

SEQ ID NO: 940675 - protein, 9 aa, Homo Sapiens
LSTCQRANF

SEQ ID NO: 940676 - protein, 9 aa, Homo Sapiens
SSFAPNKNQ

SEQ ID NO: 940677 - protein, 9 aa, Homo Sapiens
LIIITTPNK

SEQ ID NO: 940678 - protein, 9 aa, Homo Sapiens
ASEEKTVEV

SEQ ID NO: 940679 - protein, 9 aa, Homo Sapiens
PVNNKESSE

SEQ ID NO: 940680 - protein, 9 aa, Homo Sapiens
KECGKAFCY

SEQ ID NO: 940681 - protein, 9 aa, Homo Sapiens
GVRVTCNQL

SEQ ID NO: 940682 - protein, 9 aa, Homo Sapiens
DFFAKKIIP

SEQ ID NO: 940683 - protein, 9 aa, Homo Sapiens
DQGCHQKLT

SEQ ID NO: 940684 - protein, 9 aa, Homo Sapiens
SEPEVVGQS

SEQ ID NO: 940685 - protein, 9 aa, Homo Sapiens
ISIENKTTK

SEQ ID NO: 940686 - protein, 9 aa, Homo Sapiens
NYCFLPGLG

SEQ ID NO: 940687 - protein, 9 aa, Homo Sapiens
LRPWPPSSL

SEQ ID NO: 940688 - protein, 9 aa, Homo Sapiens
KEEKPFRDC

SEQ ID NO: 940689 - protein, 9 aa, Homo Sapiens
SSYDFMKQS

SEQ ID NO: 940690 - protein, 9 aa, Homo Sapiens
SRQRHKEEE

SEQ ID NO: 940691 - protein, 9 aa, Homo Sapiens
GYSYNALIG

SEQ ID NO: 940692 - protein, 9 aa, Homo Sapiens
SEMKAIALK

SEQ ID NO: 940693 - protein, 9 aa, Homo Sapiens
VCCCVKPQK

SEQ ID NO: 940694 - protein, 9 aa, Homo Sapiens
ERGGRTYVD

SEQ ID NO: 940695 - protein, 9 aa, Homo Sapiens
LSGDRARGG

SEQ ID NO: 940696 - protein, 9 aa, Homo Sapiens
ALTPFWYAT

SEQ ID NO: 940697 - protein, 9 aa, Homo Sapiens
LHGVPSQRL

SEQ ID NO: 940698 - protein, 9 aa, Homo Sapiens
STPVIIITE

SEQ ID NO: 940699 - protein, 9 aa, Homo Sapiens
VGEIMLLSA

SEQ ID NO: 940700 - protein, 9 aa, Homo Sapiens
PPRIRKTSK

SEQ ID NO: 940701 - protein, 9 aa, Homo Sapiens
YDPRKFYVC

SEQ ID NO: 940702 - protein, 9 aa, Homo Sapiens
REINKSTDK

SEQ ID NO: 940703 - protein, 9 aa, Homo Sapiens
TDDAAPTNG

SEQ ID NO: 940704 - protein, 9 aa, Homo Sapiens
YSHTQENVS

SEQ ID NO: 940705 - protein, 9 aa, Homo Sapiens
TLAYSASWD

SEQ ID NO: 940706 - protein, 9 aa, Homo Sapiens
IYGGCEENQ

SEQ ID NO: 940707 - protein, 9 aa, Homo Sapiens
PAPPRELLM

SEQ ID NO: 940708 - protein, 9 aa, Homo Sapiens
DSERIQGYV

SEQ ID NO: 940709 - protein, 9 aa, Homo Sapiens
YALLLQRCC

SEQ ID NO: 940710 - protein, 9 aa, Homo Sapiens
DGYPVKKET

SEQ ID NO: 940711 - protein, 9 aa, Homo Sapiens
NLSDLYCWL

SEQ ID NO: 940712 - protein, 9 aa, Homo Sapiens
WRESSLLVL

SEQ ID NO: 940713 - protein, 9 aa, Homo Sapiens
HPTADEKIY

SEQ ID NO: 940714 - protein, 9 aa, Homo Sapiens
TKGAESTHQ

SEQ ID NO: 940715 - protein, 9 aa, Homo Sapiens
EIEKEKTDL

SEQ ID NO: 940716 - protein, 9 aa, Homo Sapiens
FQTTMLEGY

SEQ ID NO: 940717 - protein, 9 aa, Homo Sapiens
NQPGGNLSP

SEQ ID NO: 940718 - protein, 9 aa, Homo Sapiens
EFWYKLAKI

SEQ ID NO: 940719 - protein, 9 aa, Homo Sapiens
ALYYKKNKR

SEQ ID NO: 940720 - protein, 9 aa, Homo Sapiens
DKGIYTCYV

SEQ ID NO: 940721 - protein, 9 aa, Homo Sapiens
FLKINHGIL

SEQ ID NO: 940722 - protein, 9 aa, Homo Sapiens
TLLKLSGED

SEQ ID NO: 940723 - protein, 9 aa, Homo Sapiens
CDKSILRKH

SEQ ID NO: 940724 - protein, 9 aa, Homo Sapiens
TIWSLRKSF

SEQ ID NO: 940725 - protein, 9 aa, Homo Sapiens
VAEYRASEE

SEQ ID NO: 940726 - protein, 9 aa, Homo Sapiens
FAKPSPSAS

SEQ ID NO: 940727 - protein, 9 aa, Homo Sapiens
RFYYEELNA

SEQ ID NO: 940728 - protein, 9 aa, Homo Sapiens
VLPPRALPK

SEQ ID NO: 940729 - protein, 9 aa, Homo Sapiens
RVFLLGMPE

SEQ ID NO: 940730 - protein, 9 aa, Homo Sapiens
RKDRKQRSL

SEQ ID NO: 940731 - protein, 9 aa, Homo Sapiens
FNAVDGQWG

SEQ ID NO: 940732 - protein, 9 aa, Homo Sapiens
ANGQVSEMG

SEQ ID NO: 940733 - protein, 9 aa, Homo Sapiens
YYKKIHTGE

SEQ ID NO: 940734 - protein, 9 aa, Homo Sapiens
SSTIAEGTS

SEQ ID NO: 940735 - protein, 9 aa, Homo Sapiens
SPLKPPRID

SEQ ID NO: 940736 - protein, 9 aa, Homo Sapiens
LISIENSIY

SEQ ID NO: 940737 - protein, 9 aa, Homo Sapiens
KPQPLPTKG

SEQ ID NO: 940738 - protein, 9 aa, Homo Sapiens
LFCFWSFFL

SEQ ID NO: 940739 - protein, 9 aa, Homo Sapiens
HHKKCEELL

SEQ ID NO: 940740 - protein, 9 aa, Homo Sapiens
DKDGKLYCK

SEQ ID NO: 940741 - protein, 9 aa, Homo Sapiens
AALRVVAAA

SEQ ID NO: 940742 - protein, 9 aa, Homo Sapiens
RAFTCHCRK

SEQ ID NO: 940743 - protein, 9 aa, Homo Sapiens
YLLFQNGSV

SEQ ID NO: 940744 - protein, 9 aa, Homo Sapiens
FRRVSLLDK

SEQ ID NO: 940745 - protein, 9 aa, Homo Sapiens
KLQLLSQIC

SEQ ID NO: 940746 - protein, 9 aa, Homo Sapiens
SMESPLASL

SEQ ID NO: 940747 - protein, 9 aa, Homo Sapiens
CRHFRFPPP

SEQ ID NO: 940748 - protein, 9 aa, Homo Sapiens
QMVLKCADI

SEQ ID NO: 940749 - protein, 9 aa, Homo Sapiens
VTDSRFLIG

SEQ ID NO: 940750 - protein, 9 aa, Homo Sapiens
MGPEYVEEV

SEQ ID NO: 940751 - protein, 9 aa, Homo Sapiens
FCCIDQSPF

SEQ ID NO: 940752 - protein, 9 aa, Homo Sapiens
TDKDGKLYC

SEQ ID NO: 940753 - protein, 9 aa, Homo Sapiens
FSPHQSLLS

SEQ ID NO: 940754 - protein, 9 aa, Homo Sapiens
LNTFSFCRN

SEQ ID NO: 940755 - protein, 9 aa, Homo Sapiens
GTLKPGNII

SEQ ID NO: 940756 - protein, 9 aa, Homo Sapiens
RKRIIFCKI

SEQ ID NO: 940757 - protein, 9 aa, Homo Sapiens
ICFVCLDAP

SEQ ID NO: 940758 - protein, 9 aa, Homo Sapiens
KVKTEMDSK

SEQ ID NO: 940759 - protein, 9 aa, Homo Sapiens
SRETAKTDA

SEQ ID NO: 940760 - protein, 9 aa, Homo Sapiens
IMHETLQYH

SEQ ID NO: 940761 - protein, 9 aa, Homo Sapiens
DQELAEAFQ

SEQ ID NO: 940762 - protein, 9 aa, Homo Sapiens
PGTHGPFCD

SEQ ID NO: 940763 - protein, 9 aa, Homo Sapiens
NINKNNIQL

SEQ ID NO: 940764 - protein, 9 aa, Homo Sapiens
SPLASLVLD

SEQ ID NO: 940765 - protein, 9 aa, Homo Sapiens
IQEALREQS

SEQ ID NO: 940766 - protein, 9 aa, Homo Sapiens
IHQNKSVTY

SEQ ID NO: 940767 - protein, 9 aa, Homo Sapiens
WEFVPPFGI

SEQ ID NO: 940768 - protein, 9 aa, Homo Sapiens
SPPASSLQS

SEQ ID NO: 940769 - protein, 9 aa, Homo Sapiens
TQLREGKKK

SEQ ID NO: 940770 - protein, 9 aa, Homo Sapiens
THTGEKVCE

SEQ ID NO: 940771 - protein, 9 aa, Homo Sapiens
PYPEVLNQE

SEQ ID NO: 940772 - protein, 9 aa, Homo Sapiens
RLFDKTHYP

SEQ ID NO: 940773 - protein, 9 aa, Homo Sapiens
IQLVGELVT

SEQ ID NO: 940774 - protein, 9 aa, Homo Sapiens
SVFVMEVGE

SEQ ID NO: 940775 - protein, 9 aa, Homo Sapiens
STLAPELLW

SEQ ID NO: 940776 - protein, 9 aa, Homo Sapiens
HERAQEVMR

SEQ ID NO: 940777 - protein, 9 aa, Homo Sapiens
YPSHCCAYK

SEQ ID NO: 940778 - protein, 9 aa, Homo Sapiens
DQCSLETFS

SEQ ID NO: 940779 - protein, 9 aa, Homo Sapiens
FAESWNAAF

SEQ ID NO: 940780 - protein, 9 aa, Homo Sapiens
ENINKNNIQ

SEQ ID NO: 940781 - protein, 9 aa, Homo Sapiens
PCLVRMYMV

SEQ ID NO: 940782 - protein, 9 aa, Homo Sapiens
CVEDETLGQ

SEQ ID NO: 940783 - protein, 9 aa, Homo Sapiens
TKGSVYGMN

SEQ ID NO: 940784 - protein, 9 aa, Homo Sapiens
KVSLIASEK

SEQ ID NO: 940785 - protein, 9 aa, Homo Sapiens
LYTGEKPYE

SEQ ID NO: 940786 - protein, 9 aa, Homo Sapiens
QELAEAFQK

SEQ ID NO: 940787 - protein, 9 aa, Homo Sapiens
SRSLDCRKS

SEQ ID NO: 940788 - protein, 9 aa, Homo Sapiens
NVNIILQSV

SEQ ID NO: 940789 - protein, 9 aa, Homo Sapiens
CEDAGVICS

SEQ ID NO: 940790 - protein, 9 aa, Homo Sapiens
RKPLRFYVW

SEQ ID NO: 940791 - protein, 9 aa, Homo Sapiens
FFFFVLCQT

SEQ ID NO: 940792 - protein, 9 aa, Homo Sapiens
GWSGYSHTQ

SEQ ID NO: 940793 - protein, 9 aa, Homo Sapiens
KRQLRECTR

SEQ ID NO: 940794 - protein, 9 aa, Homo Sapiens
TCENFMALC

SEQ ID NO: 940795 - protein, 9 aa, Homo Sapiens
KDVAKERKR

SEQ ID NO: 940796 - protein, 9 aa, Homo Sapiens
QGLSWHNDL

SEQ ID NO: 940797 - protein, 9 aa, Homo Sapiens
YKDILLQMD

SEQ ID NO: 940798 - protein, 9 aa, Homo Sapiens
EMGPPDSIL

SEQ ID NO: 940799 - protein, 9 aa, Homo Sapiens
FICCGILVF

SEQ ID NO: 940800 - protein, 9 aa, Homo Sapiens
NTDVCLIGE

SEQ ID NO: 940801 - protein, 9 aa, Homo Sapiens
ISELKSDLE

SEQ ID NO: 940802 - protein, 9 aa, Homo Sapiens
IKETPATSA

SEQ ID NO: 940803 - protein, 9 aa, Homo Sapiens
CKDCRRGFI

SEQ ID NO: 940804 - protein, 9 aa, Homo Sapiens
TPEISQVKP

SEQ ID NO: 940805 - protein, 9 aa, Homo Sapiens
WDSGEHTNV

SEQ ID NO: 940806 - protein, 9 aa, Homo Sapiens
VAERPFGEM

SEQ ID NO: 940807 - protein, 9 aa, Homo Sapiens
PGPSSVGQA

SEQ ID NO: 940808 - protein, 9 aa, Homo Sapiens
APECREKQS

SEQ ID NO: 940809 - protein, 9 aa, Homo Sapiens
IPSSKATVI

SEQ ID NO: 940810 - protein, 9 aa, Homo Sapiens
LESRAQLSF

SEQ ID NO: 940811 - protein, 9 aa, Homo Sapiens
LVRLVRSMR

SEQ ID NO: 940812 - protein, 9 aa, Homo Sapiens
DKDRCEDSE

SEQ ID NO: 940813 - protein, 9 aa, Homo Sapiens
LTEKQCVNR

SEQ ID NO: 940814 - protein, 9 aa, Homo Sapiens
PEPRGAFRP

SEQ ID NO: 940815 - protein, 9 aa, Homo Sapiens
VALSLRMAR

SEQ ID NO: 940816 - protein, 9 aa, Homo Sapiens
AIVLKIAMI

SEQ ID NO: 940817 - protein, 9 aa, Homo Sapiens
PRLTASLQI

SEQ ID NO: 940818 - protein, 9 aa, Homo Sapiens
RGASKALLG

SEQ ID NO: 940819 - protein, 9 aa, Homo Sapiens
EAPTTVYKK

SEQ ID NO: 940820 - protein, 9 aa, Homo Sapiens
KCTLPLTEK

SEQ ID NO: 940821 - protein, 9 aa, Homo Sapiens
FKNFSSAKD

SEQ ID NO: 940822 - protein, 9 aa, Homo Sapiens
SYQVSLNSG

SEQ ID NO: 940823 - protein, 9 aa, Homo Sapiens
PGVSAPTEL

SEQ ID NO: 940824 - protein, 9 aa, Homo Sapiens
SFRKELEGL

SEQ ID NO: 940825 - protein, 9 aa, Homo Sapiens
QNWDKKLSI

SEQ ID NO: 940826 - protein, 9 aa, Homo Sapiens
GVWLGELDK

SEQ ID NO: 940827 - protein, 9 aa, Homo Sapiens
FLALRKHKI

SEQ ID NO: 940828 - protein, 9 aa, Homo Sapiens
KGAESTHQA

SEQ ID NO: 940829 - protein, 9 aa, Homo Sapiens
SKGLYIFNL

SEQ ID NO: 940830 - protein, 9 aa, Homo Sapiens
FQDIEACIA

SEQ ID NO: 940831 - protein, 9 aa, Homo Sapiens
DLYCWLQAQ

SEQ ID NO: 940832 - protein, 9 aa, Homo Sapiens
SKSQEKSKA

SEQ ID NO: 940833 - protein, 9 aa, Homo Sapiens
EASEEREST

SEQ ID NO: 940834 - protein, 9 aa, Homo Sapiens
DKGDPFSFE

SEQ ID NO: 940835 - protein, 9 aa, Homo Sapiens
QASSQQVHP

SEQ ID NO: 940836 - protein, 9 aa, Homo Sapiens
LPTKGAEST

SEQ ID NO: 940837 - protein, 9 aa, Homo Sapiens
AKERKRKLE

SEQ ID NO: 940838 - protein, 9 aa, Homo Sapiens
GFVQDMRLV

SEQ ID NO: 940839 - protein, 9 aa, Homo Sapiens
FDIQAINRV

SEQ ID NO: 940840 - protein, 9 aa, Homo Sapiens
LSLPIVLSS

SEQ ID NO: 940841 - protein, 9 aa, Homo Sapiens
ITIDKPNAI

SEQ ID NO: 940842 - protein, 9 aa, Homo Sapiens
ITTLSSMGS

SEQ ID NO: 940843 - protein, 9 aa, Homo Sapiens
DVNVLPISD

SEQ ID NO: 940844 - protein, 9 aa, Homo Sapiens
IENKTTKIP

SEQ ID NO: 940845 - protein, 9 aa, Homo Sapiens
FLQSRETAK

SEQ ID NO: 940846 - protein, 9 aa, Homo Sapiens
EKQKELQSE

SEQ ID NO: 940847 - protein, 9 aa, Homo Sapiens
LDCLGLCFS

SEQ ID NO: 940848 - protein, 9 aa, Homo Sapiens
VLLTGLVMG

SEQ ID NO: 940849 - protein, 9 aa, Homo Sapiens
YLMVLQYRP

SEQ ID NO: 940850 - protein, 9 aa, Homo Sapiens
GGPGGTEGG

SEQ ID NO: 940851 - protein, 9 aa, Homo Sapiens
ICYDPRKFY

SEQ ID NO: 940852 - protein, 9 aa, Homo Sapiens
EGLICARLQ

SEQ ID NO: 940853 - protein, 9 aa, Homo Sapiens
SWDLPSTPC

SEQ ID NO: 940854 - protein, 9 aa, Homo Sapiens
GSDKDNKMC

SEQ ID NO: 940855 - protein, 9 aa, Homo Sapiens
FATDKYQWL

SEQ ID NO: 940856 - protein, 9 aa, Homo Sapiens
EPPGLPGPP

SEQ ID NO: 940857 - protein, 9 aa, Homo Sapiens
LFSFGPLNQ

SEQ ID NO: 940858 - protein, 9 aa, Homo Sapiens
KTWEKVLQL

SEQ ID NO: 940859 - protein, 9 aa, Homo Sapiens
YYEELNAPI

SEQ ID NO: 940860 - protein, 9 aa, Homo Sapiens
NNIAAADKQ

SEQ ID NO: 940861 - protein, 9 aa, Homo Sapiens
EQQFLHLHS

SEQ ID NO: 940862 - protein, 9 aa, Homo Sapiens
TWELFPHLY

SEQ ID NO: 940863 - protein, 9 aa, Homo Sapiens
LDKADATWT

SEQ ID NO: 940864 - protein, 9 aa, Homo Sapiens
VWLLFEYPK

SEQ ID NO: 940865 - protein, 9 aa, Homo Sapiens
KIEARSTED

SEQ ID NO: 940866 - protein, 9 aa, Homo Sapiens
MSLEVPSDA

SEQ ID NO: 940867 - protein, 9 aa, Homo Sapiens
GNYWRLLTP

SEQ ID NO: 940868 - protein, 9 aa, Homo Sapiens
WVSVFQEKT

SEQ ID NO: 940869 - protein, 9 aa, Homo Sapiens
ARAGGSSWG

SEQ ID NO: 940870 - protein, 9 aa, Homo Sapiens
PYVFIACCQ

SEQ ID NO: 940871 - protein, 9 aa, Homo Sapiens
TSKLTFYRP

SEQ ID NO: 940872 - protein, 9 aa, Homo Sapiens
RANTTTILA

SEQ ID NO: 940873 - protein, 9 aa, Homo Sapiens
NDYSLAGAE

SEQ ID NO: 940874 - protein, 9 aa, Homo Sapiens
LRARPPGPH

SEQ ID NO: 940875 - protein, 9 aa, Homo Sapiens
YVVKIWNFN

SEQ ID NO: 940876 - protein, 9 aa, Homo Sapiens
KPLRFYVWG

SEQ ID NO: 940877 - protein, 9 aa, Homo Sapiens
LIEESAEQA

SEQ ID NO: 940878 - protein, 9 aa, Homo Sapiens
SQVKPGSSE

SEQ ID NO: 940879 - protein, 9 aa, Homo Sapiens
KNYEEQEIF

SEQ ID NO: 940880 - protein, 9 aa, Homo Sapiens
SKALLGRCL

SEQ ID NO: 940881 - protein, 9 aa, Homo Sapiens
DLVSGRYCG

SEQ ID NO: 940882 - protein, 9 aa, Homo Sapiens
DSANVEMKW

SEQ ID NO: 940883 - protein, 9 aa, Homo Sapiens
VPYFDLSAG

SEQ ID NO: 940884 - protein, 9 aa, Homo Sapiens
YFTPGMKPQ

SEQ ID NO: 940885 - protein, 9 aa, Homo Sapiens
KFCDQFLEQ

SEQ ID NO: 940886 - protein, 9 aa, Homo Sapiens
KKETSKIKA

SEQ ID NO: 940887 - protein, 9 aa, Homo Sapiens
NLEKRTEES

SEQ ID NO: 940888 - protein, 9 aa, Homo Sapiens
FGVQQLYPA

SEQ ID NO: 940889 - protein, 9 aa, Homo Sapiens
HNRFYYEEL

SEQ ID NO: 940890 - protein, 9 aa, Homo Sapiens
LPALEYPNE

SEQ ID NO: 940891 - protein, 9 aa, Homo Sapiens
SFDSISPEP

SEQ ID NO: 940892 - protein, 9 aa, Homo Sapiens
IFKNIACLM

SEQ ID NO: 940893 - protein, 9 aa, Homo Sapiens
DEAKAETIW

SEQ ID NO: 940894 - protein, 9 aa, Homo Sapiens
ENESQWIRT

SEQ ID NO: 940895 - protein, 9 aa, Homo Sapiens
GAHLQNVFM

SEQ ID NO: 940896 - protein, 9 aa, Homo Sapiens
GGGGPINPT

SEQ ID NO: 940897 - protein, 9 aa, Homo Sapiens
CSDNCTALI

SEQ ID NO: 940898 - protein, 9 aa, Homo Sapiens
EEDVVKSTK

SEQ ID NO: 940899 - protein, 9 aa, Homo Sapiens
EKQSQSQPC

SEQ ID NO: 940900 - protein, 9 aa, Homo Sapiens
DPFIIIYSI

SEQ ID NO: 940901 - protein, 9 aa, Homo Sapiens
PSGAMERSL

SEQ ID NO: 940902 - protein, 9 aa, Homo Sapiens
PHYPDHDLE

SEQ ID NO: 940903 - protein, 9 aa, Homo Sapiens
EMPPATSPL

SEQ ID NO: 940904 - protein, 9 aa, Homo Sapiens
KDKGLLPPN

SEQ ID NO: 940905 - protein, 9 aa, Homo Sapiens
PAPEIRCSS

SEQ ID NO: 940906 - protein, 9 aa, Homo Sapiens
KFKKSVFEN

SEQ ID NO: 940907 - protein, 9 aa, Homo Sapiens
RNLNPTWNK

SEQ ID NO: 940908 - protein, 9 aa, Homo Sapiens
VCKAASSID

SEQ ID NO: 940909 - protein, 9 aa, Homo Sapiens
WLSLLKDGR

SEQ ID NO: 940910 - protein, 9 aa, Homo Sapiens
FWREAATSL

SEQ ID NO: 940911 - protein, 9 aa, Homo Sapiens
CSYVGRREN

SEQ ID NO: 940912 - protein, 9 aa, Homo Sapiens
ESIFQGYID

SEQ ID NO: 940913 - protein, 9 aa, Homo Sapiens
AAACIHMMP

SEQ ID NO: 940914 - protein, 9 aa, Homo Sapiens
PGVGIPPLP

SEQ ID NO: 940915 - protein, 9 aa, Homo Sapiens
VQTLVHLIN

SEQ ID NO: 940916 - protein, 9 aa, Homo Sapiens
EDSGFKKKF

SEQ ID NO: 940917 - protein, 9 aa, Homo Sapiens
QDIPYATMG

SEQ ID NO: 940918 - protein, 9 aa, Homo Sapiens
IEVRANKQE

SEQ ID NO: 940919 - protein, 9 aa, Homo Sapiens
SNALRMIQL

SEQ ID NO: 940920 - protein, 9 aa, Homo Sapiens
SCQGNLPLH

SEQ ID NO: 940921 - protein, 9 aa, Homo Sapiens
PALEYPNEK

SEQ ID NO: 940922 - protein, 9 aa, Homo Sapiens
AFPYCDKTS

SEQ ID NO: 940923 - protein, 9 aa, Homo Sapiens
ALPSVLLSV

SEQ ID NO: 940924 - protein, 9 aa, Homo Sapiens
SQDYPLPSA

SEQ ID NO: 940925 - protein, 9 aa, Homo Sapiens
QACRVSPGS

SEQ ID NO: 940926 - protein, 9 aa, Homo Sapiens
RGAFRPWEG

SEQ ID NO: 940927 - protein, 9 aa, Homo Sapiens
NRSSNITAT

SEQ ID NO: 940928 - protein, 9 aa, Homo Sapiens
EGANRKIVY

SEQ ID NO: 940929 - protein, 9 aa, Homo Sapiens
FGPRGASKA

SEQ ID NO: 940930 - protein, 9 aa, Homo Sapiens
HRQNEYPFV

SEQ ID NO: 940931 - protein, 9 aa, Homo Sapiens
AETLESKGL

SEQ ID NO: 940932 - protein, 9 aa, Homo Sapiens
YFQHTAELI

SEQ ID NO: 940933 - protein, 9 aa, Homo Sapiens
SNVIMHETL

SEQ ID NO: 940934 - protein, 9 aa, Homo Sapiens
GNGDAVLSM

SEQ ID NO: 940935 - protein, 9 aa, Homo Sapiens
LPSVTRNKT

SEQ ID NO: 940936 - protein, 9 aa, Homo Sapiens
TDIQNLSEE

SEQ ID NO: 940937 - protein, 9 aa, Homo Sapiens
RHAGGRPAR

SEQ ID NO: 940938 - protein, 9 aa, Homo Sapiens
ERCNCICSS

SEQ ID NO: 940939 - protein, 9 aa, Homo Sapiens
ILTIIASFC

SEQ ID NO: 940940 - protein, 9 aa, Homo Sapiens
KLLQKKRLS

SEQ ID NO: 940941 - protein, 9 aa, Homo Sapiens
VSTDPNHTS

SEQ ID NO: 940942 - protein, 9 aa, Homo Sapiens
RSSSPSPLP

SEQ ID NO: 940943 - protein, 9 aa, Homo Sapiens
KCETDFYNV

SEQ ID NO: 940944 - protein, 9 aa, Homo Sapiens
GPSSVGQAC

SEQ ID NO: 940945 - protein, 9 aa, Homo Sapiens
GYNGNDVEF

SEQ ID NO: 940946 - protein, 9 aa, Homo Sapiens
IIHRQNEYP

SEQ ID NO: 940947 - protein, 9 aa, Homo Sapiens
NKKQSGDGS

SEQ ID NO: 940948 - protein, 9 aa, Homo Sapiens
SLDATGGPP

SEQ ID NO: 940949 - protein, 9 aa, Homo Sapiens
VLGCSYACG

SEQ ID NO: 940950 - protein, 9 aa, Homo Sapiens
RFLVNQLDS

SEQ ID NO: 940951 - protein, 9 aa, Homo Sapiens
VFSEPKAVF

SEQ ID NO: 940952 - protein, 9 aa, Homo Sapiens
FVMEFLPSV

SEQ ID NO: 940953 - protein, 9 aa, Homo Sapiens
FAVIYYLLL

SEQ ID NO: 940954 - protein, 9 aa, Homo Sapiens
LGNHFWGIY

SEQ ID NO: 940955 - protein, 9 aa, Homo Sapiens
AGHKTLVSE

SEQ ID NO: 940956 - protein, 9 aa, Homo Sapiens
VKEGSWYIQ

SEQ ID NO: 940957 - protein, 9 aa, Homo Sapiens
EIPLDFLDL

SEQ ID NO: 940958 - protein, 9 aa, Homo Sapiens
SISPEPKSR

SEQ ID NO: 940959 - protein, 9 aa, Homo Sapiens
LSQICSHLH

SEQ ID NO: 940960 - protein, 9 aa, Homo Sapiens
KQKPKKSCV

SEQ ID NO: 940961 - protein, 9 aa, Homo Sapiens
YNRNPLARK

SEQ ID NO: 940962 - protein, 9 aa, Homo Sapiens
YNRYMAICH

SEQ ID NO: 940963 - protein, 9 aa, Homo Sapiens
MNDLTLLDL

SEQ ID NO: 940964 - protein, 9 aa, Homo Sapiens
FSNSATLAT

SEQ ID NO: 940965 - protein, 9 aa, Homo Sapiens
YNPHHRIPL

SEQ ID NO: 940966 - protein, 9 aa, Homo Sapiens
QLSGSSHSF

SEQ ID NO: 940967 - protein, 9 aa, Homo Sapiens
YWTRNVDAF

SEQ ID NO: 940968 - protein, 9 aa, Homo Sapiens
FYANMYSST

SEQ ID NO: 940969 - protein, 9 aa, Homo Sapiens
GKIGKGNLG

SEQ ID NO: 940970 - protein, 9 aa, Homo Sapiens
LLASFIPAV

SEQ ID NO: 940971 - protein, 9 aa, Homo Sapiens
AEGRRRVFS

SEQ ID NO: 940972 - protein, 9 aa, Homo Sapiens
TQAEDINPE

SEQ ID NO: 940973 - protein, 9 aa, Homo Sapiens
KLASLDINK

SEQ ID NO: 940974 - protein, 9 aa, Homo Sapiens
AQISELKSD

SEQ ID NO: 940975 - protein, 9 aa, Homo Sapiens
KEEPHLLSS

SEQ ID NO: 940976 - protein, 9 aa, Homo Sapiens
QKKAIKRRE

SEQ ID NO: 940977 - protein, 9 aa, Homo Sapiens
LELYKYDLI

SEQ ID NO: 940978 - protein, 9 aa, Homo Sapiens
HTLHPLDSE

SEQ ID NO: 940979 - protein, 9 aa, Homo Sapiens
RVPSPPPIA

SEQ ID NO: 940980 - protein, 9 aa, Homo Sapiens
KTDSPSSKR

SEQ ID NO: 940981 - protein, 9 aa, Homo Sapiens
TIVYEIDSA

SEQ ID NO: 940982 - protein, 9 aa, Homo Sapiens
KFIPWEEGL

SEQ ID NO: 940983 - protein, 9 aa, Homo Sapiens
KDPKHFKSE

SEQ ID NO: 940984 - protein, 9 aa, Homo Sapiens
PPAENSHRE

SEQ ID NO: 940985 - protein, 9 aa, Homo Sapiens
GNLFSLIGL

SEQ ID NO: 940986 - protein, 9 aa, Homo Sapiens
LKIWEERSG

SEQ ID NO: 940987 - protein, 9 aa, Homo Sapiens
IVTETPSKG

SEQ ID NO: 940988 - protein, 9 aa, Homo Sapiens
FIIVLANGQ

SEQ ID NO: 940989 - protein, 9 aa, Homo Sapiens
DDKEQKSKD

SEQ ID NO: 940990 - protein, 9 aa, Homo Sapiens
PFGEDDDNF

SEQ ID NO: 940991 - protein, 9 aa, Homo Sapiens
SSQDYPLPS

SEQ ID NO: 940992 - protein, 9 aa, Homo Sapiens
LTTTFRRSR

SEQ ID NO: 940993 - protein, 9 aa, Homo Sapiens
YFGICYVDP

SEQ ID NO: 940994 - protein, 9 aa, Homo Sapiens
INEETLSQD

SEQ ID NO: 940995 - protein, 9 aa, Homo Sapiens
TPKQFDVFF

SEQ ID NO: 940996 - protein, 9 aa, Homo Sapiens
SNVSIGKGV

SEQ ID NO: 940997 - protein, 9 aa, Homo Sapiens
LQRKQQLQA

SEQ ID NO: 940998 - protein, 9 aa, Homo Sapiens
VPRVGGLFG

SEQ ID NO: 940999 - protein, 9 aa, Homo Sapiens
CICIYDVHT

SEQ ID NO: 941000 - protein, 9 aa, Homo Sapiens
LARLGGQKV

SEQ ID NO: 941001 - protein, 9 aa, Homo Sapiens
RIRKTSKLT

SEQ ID NO: 941002 - protein, 9 aa, Homo Sapiens
PRKDKGLLP

SEQ ID NO: 941003 - protein, 9 aa, Homo Sapiens
LWWINGQSL

SEQ ID NO: 941004 - protein, 9 aa, Homo Sapiens
RARDSKTYR

SEQ ID NO: 941005 - protein, 9 aa, Homo Sapiens
PSSKATVIR

SEQ ID NO: 941006 - protein, 9 aa, Homo Sapiens
PYLHTLYLL

SEQ ID NO: 941007 - protein, 9 aa, Homo Sapiens
CWPKGTVGK

SEQ ID NO: 941008 - protein, 9 aa, Homo Sapiens
NPLARKEAY

SEQ ID NO: 941009 - protein, 9 aa, Homo Sapiens
KDLNRNKIY

SEQ ID NO: 941010 - protein, 9 aa, Homo Sapiens
ATGLERFTD

SEQ ID NO: 941011 - protein, 9 aa, Homo Sapiens
KSSLGSHQL

SEQ ID NO: 941012 - protein, 9 aa, Homo Sapiens
IKNGQLKCV

SEQ ID NO: 941013 - protein, 9 aa, Homo Sapiens
DGAPKNRTR

SEQ ID NO: 941014 - protein, 9 aa, Homo Sapiens
WEAEATSAV

SEQ ID NO: 941015 - protein, 9 aa, Homo Sapiens
APQLGAQKC

SEQ ID NO: 941016 - protein, 9 aa, Homo Sapiens
EKKFFDIWI

SEQ ID NO: 941017 - protein, 9 aa, Homo Sapiens
ICHDTNSSL

SEQ ID NO: 941018 - protein, 9 aa, Homo Sapiens
SQCPAPCFP

SEQ ID NO: 941019 - protein, 9 aa, Homo Sapiens
VAPKKITVE

SEQ ID NO: 941020 - protein, 9 aa, Homo Sapiens
PDHNGLGYS

SEQ ID NO: 941021 - protein, 9 aa, Homo Sapiens
RFTDSLQQL

SEQ ID NO: 941022 - protein, 9 aa, Homo Sapiens
TTIEHLFCM

SEQ ID NO: 941023 - protein, 9 aa, Homo Sapiens
PKDIIYFFR

SEQ ID NO: 941024 - protein, 9 aa, Homo Sapiens
FDSISPEPK

SEQ ID NO: 941025 - protein, 9 aa, Homo Sapiens
EACIALVSV

SEQ ID NO: 941026 - protein, 9 aa, Homo Sapiens
EPLESRVSH

SEQ ID NO: 941027 - protein, 9 aa, Homo Sapiens
WGRNECLIL

SEQ ID NO: 941028 - protein, 9 aa, Homo Sapiens
VCKDCRRGF

SEQ ID NO: 941029 - protein, 9 aa, Homo Sapiens
NKWPMGGNG

SEQ ID NO: 941030 - protein, 9 aa, Homo Sapiens
TCLRILAND

SEQ ID NO: 941031 - protein, 9 aa, Homo Sapiens
VDIFYASNY

SEQ ID NO: 941032 - protein, 9 aa, Homo Sapiens
RLDFFWKLQ

SEQ ID NO: 941033 - protein, 9 aa, Homo Sapiens
AACIHMMPN

SEQ ID NO: 941034 - protein, 9 aa, Homo Sapiens
LERYHSLLD

SEQ ID NO: 941035 - protein, 9 aa, Homo Sapiens
WATVGERRR

SEQ ID NO: 941036 - protein, 9 aa, Homo Sapiens
SVSRQTRNK

SEQ ID NO: 941037 - protein, 9 aa, Homo Sapiens
GATPSLGHT

SEQ ID NO: 941038 - protein, 9 aa, Homo Sapiens
CINPTAGSF

SEQ ID NO: 941039 - protein, 9 aa, Homo Sapiens
MNNKITYYF

SEQ ID NO: 941040 - protein, 9 aa, Homo Sapiens
EGAQAPLVV

SEQ ID NO: 941041 - protein, 9 aa, Homo Sapiens
VLKEPRRVV

SEQ ID NO: 941042 - protein, 9 aa, Homo Sapiens
VFGQHKWNY

SEQ ID NO: 941043 - protein, 9 aa, Homo Sapiens
PELLWWDLA

SEQ ID NO: 941044 - protein, 9 aa, Homo Sapiens
YVVKVSLLL

SEQ ID NO: 941045 - protein, 9 aa, Homo Sapiens
MDVVVKFVN

SEQ ID NO: 941046 - protein, 9 aa, Homo Sapiens
SADWGLVLM

SEQ ID NO: 941047 - protein, 9 aa, Homo Sapiens
YVSFRHVKE

SEQ ID NO: 941048 - protein, 9 aa, Homo Sapiens
KSTPVIIIT

SEQ ID NO: 941049 - protein, 9 aa, Homo Sapiens
DKNLGPRNR

SEQ ID NO: 941050 - protein, 9 aa, Homo Sapiens
FLVRTHILL

SEQ ID NO: 941051 - protein, 9 aa, Homo Sapiens
IIVFATEYT

SEQ ID NO: 941052 - protein, 9 aa, Homo Sapiens
KHFLALRKH

SEQ ID NO: 941053 - protein, 9 aa, Homo Sapiens
EPRALGIPF

SEQ ID NO: 941054 - protein, 9 aa, Homo Sapiens
IRIQRKKKN

SEQ ID NO: 941055 - protein, 9 aa, Homo Sapiens
AAVYPIILL

SEQ ID NO: 941056 - protein, 9 aa, Homo Sapiens
TIDHPWTVP

SEQ ID NO: 941057 - protein, 9 aa, Homo Sapiens
HLNGLLWEA

SEQ ID NO: 941058 - protein, 9 aa, Homo Sapiens
SSWGCWYYL

SEQ ID NO: 941059 - protein, 9 aa, Homo Sapiens
YSQKGLNSG

SEQ ID NO: 941060 - protein, 9 aa, Homo Sapiens
QDLWSAGLS

SEQ ID NO: 941061 - protein, 9 aa, Homo Sapiens
SFCRNPICM

SEQ ID NO: 941062 - protein, 9 aa, Homo Sapiens
MVERSGLLL

SEQ ID NO: 941063 - protein, 9 aa, Homo Sapiens
KEEERRIAE

SEQ ID NO: 941064 - protein, 9 aa, Homo Sapiens
IALKGGRAE

SEQ ID NO: 941065 - protein, 9 aa, Homo Sapiens
LGLKGNGDA

SEQ ID NO: 941066 - protein, 9 aa, Homo Sapiens
GSPLRTGTS

SEQ ID NO: 941067 - protein, 9 aa, Homo Sapiens
AVILRNQEG

SEQ ID NO: 941068 - protein, 9 aa, Homo Sapiens
QKPRPFSPA

SEQ ID NO: 941069 - protein, 9 aa, Homo Sapiens
SKSRRKKGP

SEQ ID NO: 941070 - protein, 9 aa, Homo Sapiens
NHVPDLEAR

SEQ ID NO: 941071 - protein, 9 aa, Homo Sapiens
FETLLYFDS

SEQ ID NO: 941072 - protein, 9 aa, Homo Sapiens
CRVSPGSTS

SEQ ID NO: 941073 - protein, 9 aa, Homo Sapiens
TRQHGDNAS

SEQ ID NO: 941074 - protein, 9 aa, Homo Sapiens
VLLKGGKRK

SEQ ID NO: 941075 - protein, 9 aa, Homo Sapiens
LESKGLYIF

SEQ ID NO: 941076 - protein, 9 aa, Homo Sapiens
IIVPSLFLL

SEQ ID NO: 941077 - protein, 9 aa, Homo Sapiens
IRQLLEEDS

SEQ ID NO: 941078 - protein, 9 aa, Homo Sapiens
SQDDQSSSL

SEQ ID NO: 941079 - protein, 9 aa, Homo Sapiens
FAPGTGLEG

SEQ ID NO: 941080 - protein, 9 aa, Homo Sapiens
YFYILLTIF

SEQ ID NO: 941081 - protein, 9 aa, Homo Sapiens
WGLCINRLR

SEQ ID NO: 941082 - protein, 9 aa, Homo Sapiens
NRKTRVHFH

SEQ ID NO: 941083 - protein, 9 aa, Homo Sapiens
KKITALAPS

SEQ ID NO: 941084 - protein, 9 aa, Homo Sapiens
PELRGLFPS

SEQ ID NO: 941085 - protein, 9 aa, Homo Sapiens
ILNQSDIVE

SEQ ID NO: 941086 - protein, 9 aa, Homo Sapiens
PLTEKQCVN

SEQ ID NO: 941087 - protein, 9 aa, Homo Sapiens
LERFTDSLQ

SEQ ID NO: 941088 - protein, 9 aa, Homo Sapiens
DRMQKKITA

SEQ ID NO: 941089 - protein, 9 aa, Homo Sapiens
STIAEGTSL

SEQ ID NO: 941090 - protein, 9 aa, Homo Sapiens
VNPKSSITE

SEQ ID NO: 941091 - protein, 9 aa, Homo Sapiens
GDQIVVLEE

SEQ ID NO: 941092 - protein, 9 aa, Homo Sapiens
SYMRCDRKI

SEQ ID NO: 941093 - protein, 9 aa, Homo Sapiens
DLYELNLTT

SEQ ID NO: 941094 - protein, 9 aa, Homo Sapiens
LPALRAVIL

SEQ ID NO: 941095 - protein, 9 aa, Homo Sapiens
QPYWGLVLK

SEQ ID NO: 941096 - protein, 9 aa, Homo Sapiens
GREMFEVMG

SEQ ID NO: 941097 - protein, 9 aa, Homo Sapiens
FCYLYEFWY

SEQ ID NO: 941098 - protein, 9 aa, Homo Sapiens
NLESIFQGY

SEQ ID NO: 941099 - protein, 9 aa, Homo Sapiens
SEGEPVCVD

SEQ ID NO: 941100 - protein, 9 aa, Homo Sapiens
LYFILGTTL

SEQ ID NO: 941101 - protein, 9 aa, Homo Sapiens
FNEPSTSKE

SEQ ID NO: 941102 - protein, 9 aa, Homo Sapiens
NCGEILDKW

SEQ ID NO: 941103 - protein, 9 aa, Homo Sapiens
DWNEVMYDE

SEQ ID NO: 941104 - protein, 9 aa, Homo Sapiens
AHTYVSEEP

SEQ ID NO: 941105 - protein, 9 aa, Homo Sapiens
KMVYFAISN

SEQ ID NO: 941106 - protein, 9 aa, Homo Sapiens
FKRTSKKKS

SEQ ID NO: 941107 - protein, 9 aa, Homo Sapiens
KWWPASQQI

SEQ ID NO: 941108 - protein, 9 aa, Homo Sapiens
AEFHVSLLL

SEQ ID NO: 941109 - protein, 9 aa, Homo Sapiens
MDDDTAVLI

SEQ ID NO: 941110 - protein, 9 aa, Homo Sapiens
CLFKGTLTA

SEQ ID NO: 941111 - protein, 9 aa, Homo Sapiens
QERVLFHHS

SEQ ID NO: 941112 - protein, 9 aa, Homo Sapiens
AQNVEAGAY

SEQ ID NO: 941113 - protein, 9 aa, Homo Sapiens
AYASENNLK

SEQ ID NO: 941114 - protein, 9 aa, Homo Sapiens
QAKPINLDS

SEQ ID NO: 941115 - protein, 9 aa, Homo Sapiens
TESPRPGGD

SEQ ID NO: 941116 - protein, 9 aa, Homo Sapiens
LKKPPQPQV

SEQ ID NO: 941117 - protein, 9 aa, Homo Sapiens
NCICSSRPP

SEQ ID NO: 941118 - protein, 9 aa, Homo Sapiens
VEDETLGQL

SEQ ID NO: 941119 - protein, 9 aa, Homo Sapiens
GSSLGRLST

SEQ ID NO: 941120 - protein, 9 aa, Homo Sapiens
GFRLLCWVL

SEQ ID NO: 941121 - protein, 9 aa, Homo Sapiens
ANPPDIEFA

SEQ ID NO: 941122 - protein, 9 aa, Homo Sapiens
TPGRDSKII

SEQ ID NO: 941123 - protein, 9 aa, Homo Sapiens
TETPSKGFD

SEQ ID NO: 941124 - protein, 9 aa, Homo Sapiens
EIILLSVIL

SEQ ID NO: 941125 - protein, 9 aa, Homo Sapiens
EIKDEKVIS

SEQ ID NO: 941126 - protein, 9 aa, Homo Sapiens
EEPHVEEHL

SEQ ID NO: 941127 - protein, 9 aa, Homo Sapiens
FVLHRLCTS

SEQ ID NO: 941128 - protein, 9 aa, Homo Sapiens
VLGEKAFLE

SEQ ID NO: 941129 - protein, 9 aa, Homo Sapiens
CWGRNECLI

SEQ ID NO: 941130 - protein, 9 aa, Homo Sapiens
VKNRPTSIL

SEQ ID NO: 941131 - protein, 9 aa, Homo Sapiens
DSEPEVVGQ

SEQ ID NO: 941132 - protein, 9 aa, Homo Sapiens
NSSVVLESD

SEQ ID NO: 941133 - protein, 9 aa, Homo Sapiens
GQEGFGINK

SEQ ID NO: 941134 - protein, 9 aa, Homo Sapiens
HSMTLDWKV

SEQ ID NO: 941135 - protein, 9 aa, Homo Sapiens
PALILFAAW

SEQ ID NO: 941136 - protein, 9 aa, Homo Sapiens
LQYHVQHLA

SEQ ID NO: 941137 - protein, 9 aa, Homo Sapiens
LKKSRKTRV

SEQ ID NO: 941138 - protein, 9 aa, Homo Sapiens
SGKSSLGSH

SEQ ID NO: 941139 - protein, 9 aa, Homo Sapiens
KVKVGVYNN

SEQ ID NO: 941140 - protein, 9 aa, Homo Sapiens
ETAKKEKVE

SEQ ID NO: 941141 - protein, 9 aa, Homo Sapiens
ILLEGSQLN

SEQ ID NO: 941142 - protein, 9 aa, Homo Sapiens
QSCRKAPPK

SEQ ID NO: 941143 - protein, 9 aa, Homo Sapiens
KQRYKECCR

SEQ ID NO: 941144 - protein, 9 aa, Homo Sapiens
LFYKTYHFW

SEQ ID NO: 941145 - protein, 9 aa, Homo Sapiens
SSIQCNVRN

SEQ ID NO: 941146 - protein, 9 aa, Homo Sapiens
EDFPDFSSQ

SEQ ID NO: 941147 - protein, 9 aa, Homo Sapiens
GFFKPSEHV

SEQ ID NO: 941148 - protein, 9 aa, Homo Sapiens
KIESEAKKE

SEQ ID NO: 941149 - protein, 9 aa, Homo Sapiens
SDKDNKMCA

SEQ ID NO: 941150 - protein, 9 aa, Homo Sapiens
RLMFCNHKT

SEQ ID NO: 941151 - protein, 9 aa, Homo Sapiens
HLESGAFGC

SEQ ID NO: 941152 - protein, 9 aa, Homo Sapiens
FTLLDPHLQ

SEQ ID NO: 941153 - protein, 9 aa, Homo Sapiens
SSPVGPLSG

SEQ ID NO: 941154 - protein, 9 aa, Homo Sapiens
MYFFHSLKN

SEQ ID NO: 941155 - protein, 9 aa, Homo Sapiens
FFFCESSQE

SEQ ID NO: 941156 - protein, 9 aa, Homo Sapiens
DGKLYCKVC

SEQ ID NO: 941157 - protein, 9 aa, Homo Sapiens
DKEYYFDWN

SEQ ID NO: 941158 - protein, 9 aa, Homo Sapiens
YLQENPLSC

SEQ ID NO: 941159 - protein, 9 aa, Homo Sapiens
KYEEIYSPE

SEQ ID NO: 941160 - protein, 9 aa, Homo Sapiens
HRARLRRWK

SEQ ID NO: 941161 - protein, 9 aa, Homo Sapiens
PVGPLSGLQ

SEQ ID NO: 941162 - protein, 9 aa, Homo Sapiens
PVRSPPGFP

SEQ ID NO: 941163 - protein, 9 aa, Homo Sapiens
TGTFFWMEI

SEQ ID NO: 941164 - protein, 9 aa, Homo Sapiens
APEIRCSSC

SEQ ID NO: 941165 - protein, 9 aa, Homo Sapiens
TLSSMGSGA

SEQ ID NO: 941166 - protein, 9 aa, Homo Sapiens
KESLDFISH

SEQ ID NO: 941167 - protein, 9 aa, Homo Sapiens
SSKDSRFAV

SEQ ID NO: 941168 - protein, 9 aa, Homo Sapiens
GGAERRTSK

SEQ ID NO: 941169 - protein, 9 aa, Homo Sapiens
TPSLITHSL

SEQ ID NO: 941170 - protein, 9 aa, Homo Sapiens
AALYYKKNK

SEQ ID NO: 941171 - protein, 9 aa, Homo Sapiens
AMNTIDLDS

SEQ ID NO: 941172 - protein, 9 aa, Homo Sapiens
EEPGAKACG

SEQ ID NO: 941173 - protein, 9 aa, Homo Sapiens
SSRSLDCRK

SEQ ID NO: 941174 - protein, 9 aa, Homo Sapiens
VLQMVLKCA

SEQ ID NO: 941175 - protein, 9 aa, Homo Sapiens
GCKSCACNS

SEQ ID NO: 941176 - protein, 9 aa, Homo Sapiens
EQDMARLQR

SEQ ID NO: 941177 - protein, 9 aa, Homo Sapiens
LQQTGRFCG

SEQ ID NO: 941178 - protein, 9 aa, Homo Sapiens
LVSLGVGLQ

SEQ ID NO: 941179 - protein, 9 aa, Homo Sapiens
KDSSNFGAP

SEQ ID NO: 941180 - protein, 9 aa, Homo Sapiens
YLTLSPNDH

SEQ ID NO: 941181 - protein, 9 aa, Homo Sapiens
PDEDKDANL

SEQ ID NO: 941182 - protein, 9 aa, Homo Sapiens
QAFALSILR

SEQ ID NO: 941183 - protein, 9 aa, Homo Sapiens
INRVSSKSP

SEQ ID NO: 941184 - protein, 9 aa, Homo Sapiens
FLIIFTIKL

SEQ ID NO: 941185 - protein, 9 aa, Homo Sapiens
DFFTEIPAD

SEQ ID NO: 941186 - protein, 9 aa, Homo Sapiens
ARKDGAPKN

SEQ ID NO: 941187 - protein, 9 aa, Homo Sapiens
DMEEDDKDS

SEQ ID NO: 941188 - protein, 9 aa, Homo Sapiens
SIGSLLENL

SEQ ID NO: 941189 - protein, 9 aa, Homo Sapiens
TQGCFSKRL

SEQ ID NO: 941190 - protein, 9 aa, Homo Sapiens
ACAGFCKCK

SEQ ID NO: 941191 - protein, 9 aa, Homo Sapiens
TARIKTTVF

SEQ ID NO: 941192 - protein, 9 aa, Homo Sapiens
LIIFTIKLD

SEQ ID NO: 941193 - protein, 9 aa, Homo Sapiens
LYDCQLYRG

SEQ ID NO: 941194 - protein, 9 aa, Homo Sapiens
PMGGVCLVT

SEQ ID NO: 941195 - protein, 9 aa, Homo Sapiens
SALSSSAEN

SEQ ID NO: 941196 - protein, 9 aa, Homo Sapiens
SVSLRPQRS

SEQ ID NO: 941197 - protein, 9 aa, Homo Sapiens
LLLPLDELH

SEQ ID NO: 941198 - protein, 9 aa, Homo Sapiens
LTSKKEEER

SEQ ID NO: 941199 - protein, 9 aa, Homo Sapiens
YYNKASGGR

SEQ ID NO: 941200 - protein, 9 aa, Homo Sapiens
ELLWWDLAR

SEQ ID NO: 941201 - protein, 9 aa, Homo Sapiens
TLMAQFVPP

SEQ ID NO: 941202 - protein, 9 aa, Homo Sapiens
LPMLFSFGP

SEQ ID NO: 941203 - protein, 9 aa, Homo Sapiens
QKVCPRRWK

SEQ ID NO: 941204 - protein, 9 aa, Homo Sapiens
QLSESEYVV

SEQ ID NO: 941205 - protein, 9 aa, Homo Sapiens
PLHLSTLST

SEQ ID NO: 941206 - protein, 9 aa, Homo Sapiens
SWLLFALIL

SEQ ID NO: 941207 - protein, 9 aa, Homo Sapiens
FGKYIDRLI

SEQ ID NO: 941208 - protein, 9 aa, Homo Sapiens
PVYVVTFQE

SEQ ID NO: 941209 - protein, 9 aa, Homo Sapiens
LSGRETFFL

SEQ ID NO: 941210 - protein, 9 aa, Homo Sapiens
VEPVVLSEA

SEQ ID NO: 941211 - protein, 9 aa, Homo Sapiens
RQKLKNCTK

SEQ ID NO: 941212 - protein, 9 aa, Homo Sapiens
LKVRNKSCE

SEQ ID NO: 941213 - protein, 9 aa, Homo Sapiens
HNDLTQYVI

SEQ ID NO: 941214 - protein, 9 aa, Homo Sapiens
TINKNRRKS

SEQ ID NO: 941215 - protein, 9 aa, Homo Sapiens
FKVSGIPSG

SEQ ID NO: 941216 - protein, 9 aa, Homo Sapiens
MEREAEENN

SEQ ID NO: 941217 - protein, 9 aa, Homo Sapiens
ACLCHNLDH

SEQ ID NO: 941218 - protein, 9 aa, Homo Sapiens
SSSISLGRQ

SEQ ID NO: 941219 - protein, 9 aa, Homo Sapiens
LRRLYLQEN

SEQ ID NO: 941220 - protein, 9 aa, Homo Sapiens
PLRLLEHEE

SEQ ID NO: 941221 - protein, 9 aa, Homo Sapiens
AAKRLLGWK

SEQ ID NO: 941222 - protein, 9 aa, Homo Sapiens
LDAGINEEL

SEQ ID NO: 941223 - protein, 9 aa, Homo Sapiens
QLKCVRWMV

SEQ ID NO: 941224 - protein, 9 aa, Homo Sapiens
PGSIRFTAE

SEQ ID NO: 941225 - protein, 9 aa, Homo Sapiens
SFHRPRPRI

SEQ ID NO: 941226 - protein, 9 aa, Homo Sapiens
VVNILAGQG

SEQ ID NO: 941227 - protein, 9 aa, Homo Sapiens
KRELELRDR

SEQ ID NO: 941228 - protein, 9 aa, Homo Sapiens
RSLKNLVPK

SEQ ID NO: 941229 - protein, 9 aa, Homo Sapiens
LAYCAIQGD

SEQ ID NO: 941230 - protein, 9 aa, Homo Sapiens
KDGILFGIV

SEQ ID NO: 941231 - protein, 9 aa, Homo Sapiens
QSFNEKFQN

SEQ ID NO: 941232 - protein, 9 aa, Homo Sapiens
NYEEQEIFL

SEQ ID NO: 941233 - protein, 9 aa, Homo Sapiens
TLLETPVGY

SEQ ID NO: 941234 - protein, 9 aa, Homo Sapiens
SVPQNALPS

SEQ ID NO: 941235 - protein, 9 aa, Homo Sapiens
GNTWSSPRE

SEQ ID NO: 941236 - protein, 9 aa, Homo Sapiens
SFRKWARIW

SEQ ID NO: 941237 - protein, 9 aa, Homo Sapiens
VVFLMALSE

SEQ ID NO: 941238 - protein, 9 aa, Homo Sapiens
GNLEQECVE

SEQ ID NO: 941239 - protein, 9 aa, Homo Sapiens
SPKPDAFNL

SEQ ID NO: 941240 - protein, 9 aa, Homo Sapiens
HSLKNSEGI

SEQ ID NO: 941241 - protein, 9 aa, Homo Sapiens
ASERLMFHG

SEQ ID NO: 941242 - protein, 9 aa, Homo Sapiens
SLTHTATSV

SEQ ID NO: 941243 - protein, 9 aa, Homo Sapiens
YCFAILPVI

SEQ ID NO: 941244 - protein, 9 aa, Homo Sapiens
GSFGVTTAT

SEQ ID NO: 941245 - protein, 9 aa, Homo Sapiens
YDQAVYQEA

SEQ ID NO: 941246 - protein, 9 aa, Homo Sapiens
AVIDAKFFA

SEQ ID NO: 941247 - protein, 9 aa, Homo Sapiens
NVSPEMRQR

SEQ ID NO: 941248 - protein, 9 aa, Homo Sapiens
QDLDKMFGV

SEQ ID NO: 941249 - protein, 9 aa, Homo Sapiens
TRRATGWHE

SEQ ID NO: 941250 - protein, 9 aa, Homo Sapiens
CHQKLTVNN

SEQ ID NO: 941251 - protein, 9 aa, Homo Sapiens
SMDQELDTA

SEQ ID NO: 941252 - protein, 9 aa, Homo Sapiens
DLQDFLLKD

SEQ ID NO: 941253 - protein, 9 aa, Homo Sapiens
SVILMNLEY

SEQ ID NO: 941254 - protein, 9 aa, Homo Sapiens
ERILRLLQT

SEQ ID NO: 941255 - protein, 9 aa, Homo Sapiens
INRKTRVHF

SEQ ID NO: 941256 - protein, 9 aa, Homo Sapiens
LSTSILVSL

SEQ ID NO: 941257 - protein, 9 aa, Homo Sapiens
PGLVLSGDP

SEQ ID NO: 941258 - protein, 9 aa, Homo Sapiens
YFNGPEKRE

SEQ ID NO: 941259 - protein, 9 aa, Homo Sapiens
IEGGAQKGV

SEQ ID NO: 941260 - protein, 9 aa, Homo Sapiens
KGDKTEGCR

SEQ ID NO: 941261 - protein, 9 aa, Homo Sapiens
RPRKDKGLL

SEQ ID NO: 941262 - protein, 9 aa, Homo Sapiens
PNGSLEDCL

SEQ ID NO: 941263 - protein, 9 aa, Homo Sapiens
LEKDYFGIC

SEQ ID NO: 941264 - protein, 9 aa, Homo Sapiens
FVFEVLVIY

SEQ ID NO: 941265 - protein, 9 aa, Homo Sapiens
SESSCCPRT

SEQ ID NO: 941266 - protein, 9 aa, Homo Sapiens
EFMELDGLR

SEQ ID NO: 941267 - protein, 9 aa, Homo Sapiens
YLSIVGILT

SEQ ID NO: 941268 - protein, 9 aa, Homo Sapiens
PGRVPSSLA

SEQ ID NO: 941269 - protein, 9 aa, Homo Sapiens
PNMFYINPE

SEQ ID NO: 941270 - protein, 9 aa, Homo Sapiens
PVLILHWRW

SEQ ID NO: 941271 - protein, 9 aa, Homo Sapiens
YRRFDSARG

SEQ ID NO: 941272 - protein, 9 aa, Homo Sapiens
FGSKRGSCA

SEQ ID NO: 941273 - protein, 9 aa, Homo Sapiens
EEAGAEVLL

SEQ ID NO: 941274 - protein, 9 aa, Homo Sapiens
NGPEKREAR

SEQ ID NO: 941275 - protein, 9 aa, Homo Sapiens
FQSGGSRSF

SEQ ID NO: 941276 - protein, 9 aa, Homo Sapiens
LQLADDFTD

SEQ ID NO: 941277 - protein, 9 aa, Homo Sapiens
GDCCRSLTG

SEQ ID NO: 941278 - protein, 9 aa, Homo Sapiens
FFLFSRKEE

SEQ ID NO: 941279 - protein, 9 aa, Homo Sapiens
FMLSCNFLR

SEQ ID NO: 941280 - protein, 9 aa, Homo Sapiens
VETLNVIIS

SEQ ID NO: 941281 - protein, 9 aa, Homo Sapiens
VLSQELAED

SEQ ID NO: 941282 - protein, 9 aa, Homo Sapiens
VDSVYYDAL

SEQ ID NO: 941283 - protein, 9 aa, Homo Sapiens
LKARALKIW

SEQ ID NO: 941284 - protein, 9 aa, Homo Sapiens
FDEDHNEMV

SEQ ID NO: 941285 - protein, 9 aa, Homo Sapiens
LYNEITRTL

SEQ ID NO: 941286 - protein, 9 aa, Homo Sapiens
GEKRDKGAM

SEQ ID NO: 941287 - protein, 9 aa, Homo Sapiens
IPPSLREMK

SEQ ID NO: 941288 - protein, 9 aa, Homo Sapiens
PWVSVFQEK

SEQ ID NO: 941289 - protein, 9 aa, Homo Sapiens
CGQQKDESQ

SEQ ID NO: 941290 - protein, 9 aa, Homo Sapiens
STVTPLAKP

SEQ ID NO: 941291 - protein, 9 aa, Homo Sapiens
RRKDRKQRS

SEQ ID NO: 941292 - protein, 9 aa, Homo Sapiens
TSTGTLSQG

SEQ ID NO: 941293 - protein, 9 aa, Homo Sapiens
DVVNILAGQ

SEQ ID NO: 941294 - protein, 9 aa, Homo Sapiens
KDCPRVIRK

SEQ ID NO: 941295 - protein, 9 aa, Homo Sapiens
KRPLYLRKI

SEQ ID NO: 941296 - protein, 9 aa, Homo Sapiens
WIINNLMST

SEQ ID NO: 941297 - protein, 9 aa, Homo Sapiens
SQVPALPPP

SEQ ID NO: 941298 - protein, 9 aa, Homo Sapiens
KLALAFRAR

SEQ ID NO: 941299 - protein, 9 aa, Homo Sapiens
VKGEVLKVR

SEQ ID NO: 941300 - protein, 9 aa, Homo Sapiens
AGLNYELAH

SEQ ID NO: 941301 - protein, 9 aa, Homo Sapiens
TNFQLEVTP

SEQ ID NO: 941302 - protein, 9 aa, Homo Sapiens
MNMLNFNHE

SEQ ID NO: 941303 - protein, 9 aa, Homo Sapiens
NKDPDLPSN

SEQ ID NO: 941304 - protein, 9 aa, Homo Sapiens
ERSGFPHSS

SEQ ID NO: 941305 - protein, 9 aa, Homo Sapiens
LDDQEGILF

SEQ ID NO: 941306 - protein, 9 aa, Homo Sapiens
ARERVQLLG

SEQ ID NO: 941307 - protein, 9 aa, Homo Sapiens
SETTQEQDF

SEQ ID NO: 941308 - protein, 9 aa, Homo Sapiens
QRIKGFPSP

SEQ ID NO: 941309 - protein, 9 aa, Homo Sapiens
PPDALAALY

SEQ ID NO: 941310 - protein, 9 aa, Homo Sapiens
RWAGVLSCL

SEQ ID NO: 941311 - protein, 9 aa, Homo Sapiens
SYGQLPMLF

SEQ ID NO: 941312 - protein, 9 aa, Homo Sapiens
RVPPTKAPK

SEQ ID NO: 941313 - protein, 9 aa, Homo Sapiens
KKNSLDWED

SEQ ID NO: 941314 - protein, 9 aa, Homo Sapiens
EWNCNKKKW

SEQ ID NO: 941315 - protein, 9 aa, Homo Sapiens
GYRRFDSAR

SEQ ID NO: 941316 - protein, 9 aa, Homo Sapiens
PRGVLAGTA

SEQ ID NO: 941317 - protein, 9 aa, Homo Sapiens
CCSYVGRRE

SEQ ID NO: 941318 - protein, 9 aa, Homo Sapiens
SKPQILKHA

SEQ ID NO: 941319 - protein, 9 aa, Homo Sapiens
GEAGNPGPL

SEQ ID NO: 941320 - protein, 9 aa, Homo Sapiens
FAHCISHEY

SEQ ID NO: 941321 - protein, 9 aa, Homo Sapiens
SCYLLFQNG

SEQ ID NO: 941322 - protein, 9 aa, Homo Sapiens
VAADLYELN

SEQ ID NO: 941323 - protein, 9 aa, Homo Sapiens
TPPPVKDSE

SEQ ID NO: 941324 - protein, 9 aa, Homo Sapiens
FGINKIGGN

SEQ ID NO: 941325 - protein, 9 aa, Homo Sapiens
RSQIKNGKL

SEQ ID NO: 941326 - protein, 9 aa, Homo Sapiens
ALPPPAQPP

SEQ ID NO: 941327 - protein, 9 aa, Homo Sapiens
SHLAIVDIF

SEQ ID NO: 941328 - protein, 9 aa, Homo Sapiens
STRHSFFRR

SEQ ID NO: 941329 - protein, 9 aa, Homo Sapiens
PMGGNGVVE

SEQ ID NO: 941330 - protein, 9 aa, Homo Sapiens
ATFCDFLKI

SEQ ID NO: 941331 - protein, 9 aa, Homo Sapiens
PAPQLGAQK

SEQ ID NO: 941332 - protein, 9 aa, Homo Sapiens
TYHKVDLCL

SEQ ID NO: 941333 - protein, 9 aa, Homo Sapiens
VTGISQSWI

SEQ ID NO: 941334 - protein, 9 aa, Homo Sapiens
KEGEGKKKG

SEQ ID NO: 941335 - protein, 9 aa, Homo Sapiens
KFFDIWICA

SEQ ID NO: 941336 - protein, 9 aa, Homo Sapiens
SARPSVHEH

SEQ ID NO: 941337 - protein, 9 aa, Homo Sapiens
PKELFPTMT

SEQ ID NO: 941338 - protein, 9 aa, Homo Sapiens
LIPLSYAFI

SEQ ID NO: 941339 - protein, 9 aa, Homo Sapiens
RTSLSREIS

SEQ ID NO: 941340 - protein, 9 aa, Homo Sapiens
LMMRPGLPN

SEQ ID NO: 941341 - protein, 9 aa, Homo Sapiens
GGGSREGLF

SEQ ID NO: 941342 - protein, 9 aa, Homo Sapiens
QKKNEPGIR

SEQ ID NO: 941343 - protein, 9 aa, Homo Sapiens
TTRQRESTT

SEQ ID NO: 941344 - protein, 9 aa, Homo Sapiens
QLGKQEMVC

SEQ ID NO: 941345 - protein, 9 aa, Homo Sapiens
DDSVPEYDP

SEQ ID NO: 941346 - protein, 9 aa, Homo Sapiens
QQQRLPKQK

SEQ ID NO: 941347 - protein, 9 aa, Homo Sapiens
CKENESFLW

SEQ ID NO: 941348 - protein, 9 aa, Homo Sapiens
LALKLASLD

SEQ ID NO: 941349 - protein, 9 aa, Homo Sapiens
SPDGYYAQS

SEQ ID NO: 941350 - protein, 9 aa, Homo Sapiens
AFILIGSLI

SEQ ID NO: 941351 - protein, 9 aa, Homo Sapiens
ANMYSSTLT

SEQ ID NO: 941352 - protein, 9 aa, Homo Sapiens
DSKSSQQWR

SEQ ID NO: 941353 - protein, 9 aa, Homo Sapiens
PGLPPLPFM

SEQ ID NO: 941354 - protein, 9 aa, Homo Sapiens
SSIDPNDMM

SEQ ID NO: 941355 - protein, 9 aa, Homo Sapiens
HGDNASEEK

SEQ ID NO: 941356 - protein, 9 aa, Homo Sapiens
YLDTLGSKS

SEQ ID NO: 941357 - protein, 9 aa, Homo Sapiens
QAKFIASAP

SEQ ID NO: 941358 - protein, 9 aa, Homo Sapiens
ELLLCKFAD

SEQ ID NO: 941359 - protein, 9 aa, Homo Sapiens
PPGRVPSSL

SEQ ID NO: 941360 - protein, 9 aa, Homo Sapiens
CCCVKPQKL

SEQ ID NO: 941361 - protein, 9 aa, Homo Sapiens
NEKPMRVVN

SEQ ID NO: 941362 - protein, 9 aa, Homo Sapiens
TYVSEEPRA

SEQ ID NO: 941363 - protein, 9 aa, Homo Sapiens
NNIYYSDLM

SEQ ID NO: 941364 - protein, 9 aa, Homo Sapiens
LGPNSKTDH

SEQ ID NO: 941365 - protein, 9 aa, Homo Sapiens
CHGDIIPWD

SEQ ID NO: 941366 - protein, 9 aa, Homo Sapiens
KKATWFIMV

SEQ ID NO: 941367 - protein, 9 aa, Homo Sapiens
DNPSSTLCP

SEQ ID NO: 941368 - protein, 9 aa, Homo Sapiens
EQLRKLENE

SEQ ID NO: 941369 - protein, 9 aa, Homo Sapiens
FRHLRGHGP

SEQ ID NO: 941370 - protein, 9 aa, Homo Sapiens
SYTVEVLLS

SEQ ID NO: 941371 - protein, 9 aa, Homo Sapiens
PQKSGIIKQ

SEQ ID NO: 941372 - protein, 9 aa, Homo Sapiens
RPCNVTFRL

SEQ ID NO: 941373 - protein, 9 aa, Homo Sapiens
DCRQITCPE

SEQ ID NO: 941374 - protein, 9 aa, Homo Sapiens
TLQYHVQHL

SEQ ID NO: 941375 - protein, 9 aa, Homo Sapiens
LIDNSQNIA

SEQ ID NO: 941376 - protein, 9 aa, Homo Sapiens
LDKMFGVWL

SEQ ID NO: 941377 - protein, 9 aa, Homo Sapiens
MSRLDVYFL

SEQ ID NO: 941378 - protein, 9 aa, Homo Sapiens
TNSSLIIVN

SEQ ID NO: 941379 - protein, 9 aa, Homo Sapiens
ANPATNFQL

SEQ ID NO: 941380 - protein, 9 aa, Homo Sapiens
KQLLRFRRK

SEQ ID NO: 941381 - protein, 9 aa, Homo Sapiens
TAPEAINYE

SEQ ID NO: 941382 - protein, 9 aa, Homo Sapiens
FFMDQTESL

SEQ ID NO: 941383 - protein, 9 aa, Homo Sapiens
EVLTNLLFA

SEQ ID NO: 941384 - protein, 9 aa, Homo Sapiens
VLRSLDYEA

SEQ ID NO: 941385 - protein, 9 aa, Homo Sapiens
PEVRNTTGL

SEQ ID NO: 941386 - protein, 9 aa, Homo Sapiens
NVTPTKGSV

SEQ ID NO: 941387 - protein, 9 aa, Homo Sapiens
HNCNHCEDA

SEQ ID NO: 941388 - protein, 9 aa, Homo Sapiens
IQKAVEEAE

SEQ ID NO: 941389 - protein, 9 aa, Homo Sapiens
PPPDALAAL

SEQ ID NO: 941390 - protein, 9 aa, Homo Sapiens
RKSKSQEKS

SEQ ID NO: 941391 - protein, 9 aa, Homo Sapiens
ISDWKEQEW

SEQ ID NO: 941392 - protein, 9 aa, Homo Sapiens
GKEMIPFEV

SEQ ID NO: 941393 - protein, 9 aa, Homo Sapiens
ERFRLSRQR

SEQ ID NO: 941394 - protein, 9 aa, Homo Sapiens
LLMYQAQER

SEQ ID NO: 941395 - protein, 9 aa, Homo Sapiens
DDMRNFYFL

SEQ ID NO: 941396 - protein, 9 aa, Homo Sapiens
NKITYYFPC

SEQ ID NO: 941397 - protein, 9 aa, Homo Sapiens
VCRKNLEIY

SEQ ID NO: 941398 - protein, 9 aa, Homo Sapiens
PDYPGSQQN

SEQ ID NO: 941399 - protein, 9 aa, Homo Sapiens
WMKVEQIQQ

SEQ ID NO: 941400 - protein, 9 aa, Homo Sapiens
RLFGATNLK

SEQ ID NO: 941401 - protein, 9 aa, Homo Sapiens
MKWVKQYAI

SEQ ID NO: 941402 - protein, 9 aa, Homo Sapiens
ATKTRLYTL

SEQ ID NO: 941403 - protein, 9 aa, Homo Sapiens
GICYVDPEK

SEQ ID NO: 941404 - protein, 9 aa, Homo Sapiens
QGPRALALA

SEQ ID NO: 941405 - protein, 9 aa, Homo Sapiens
AIDTLNSNY

SEQ ID NO: 941406 - protein, 9 aa, Homo Sapiens
VSARSRSSS

SEQ ID NO: 941407 - protein, 9 aa, Homo Sapiens
AWSPVRGSF

SEQ ID NO: 941408 - protein, 9 aa, Homo Sapiens
RVNRFPCKN

SEQ ID NO: 941409 - protein, 9 aa, Homo Sapiens
FQLRYESIT

SEQ ID NO: 941410 - protein, 9 aa, Homo Sapiens
QHLPETGIT

SEQ ID NO: 941411 - protein, 9 aa, Homo Sapiens
GPQEPPGLP

SEQ ID NO: 941412 - protein, 9 aa, Homo Sapiens
PGASDAELV

SEQ ID NO: 941413 - protein, 9 aa, Homo Sapiens
DFYNVTWFK

SEQ ID NO: 941414 - protein, 9 aa, Homo Sapiens
LLKLSGEDD

SEQ ID NO: 941415 - protein, 9 aa, Homo Sapiens
VPWGVYSAN

SEQ ID NO: 941416 - protein, 9 aa, Homo Sapiens
LQPRIDPFL

SEQ ID NO: 941417 - protein, 9 aa, Homo Sapiens
RDSKIIQKG

SEQ ID NO: 941418 - protein, 9 aa, Homo Sapiens
YSSVQQGVI

SEQ ID NO: 941419 - protein, 9 aa, Homo Sapiens
QVNYTFDRN

SEQ ID NO: 941420 - protein, 9 aa, Homo Sapiens
KRLLGWKWG

SEQ ID NO: 941421 - protein, 9 aa, Homo Sapiens
IDTAPVVAS

SEQ ID NO: 941422 - protein, 9 aa, Homo Sapiens
LICNECGKI

SEQ ID NO: 941423 - protein, 9 aa, Homo Sapiens
YACKSSYLL

SEQ ID NO: 941424 - protein, 9 aa, Homo Sapiens
IKKQRSPDD

SEQ ID NO: 941425 - protein, 9 aa, Homo Sapiens
GPEKREART

SEQ ID NO: 941426 - protein, 9 aa, Homo Sapiens
NFGAPHPQV

SEQ ID NO: 941427 - protein, 9 aa, Homo Sapiens
SILYTLSRA

SEQ ID NO: 941428 - protein, 9 aa, Homo Sapiens
TPPIFSWFS

SEQ ID NO: 941429 - protein, 9 aa, Homo Sapiens
VQMSVGIFQ

SEQ ID NO: 941430 - protein, 9 aa, Homo Sapiens
PVQQPGPRK

SEQ ID NO: 941431 - protein, 9 aa, Homo Sapiens
SQHGPSVCF

SEQ ID NO: 941432 - protein, 9 aa, Homo Sapiens
HLSRMKSSD

SEQ ID NO: 941433 - protein, 9 aa, Homo Sapiens
ERLFDKTHY

SEQ ID NO: 941434 - protein, 9 aa, Homo Sapiens
DDKIYFFFC

SEQ ID NO: 941435 - protein, 9 aa, Homo Sapiens
KKITVEDSF

SEQ ID NO: 941436 - protein, 9 aa, Homo Sapiens
DLSGFYQKI

SEQ ID NO: 941437 - protein, 9 aa, Homo Sapiens
LSNGEPTKK

SEQ ID NO: 941438 - protein, 9 aa, Homo Sapiens
SKAEKENQV

SEQ ID NO: 941439 - protein, 9 aa, Homo Sapiens
SSSASLLPN

SEQ ID NO: 941440 - protein, 9 aa, Homo Sapiens
LFYVRPVTQ

SEQ ID NO: 941441 - protein, 9 aa, Homo Sapiens
ELLKRDAHS

SEQ ID NO: 941442 - protein, 9 aa, Homo Sapiens
PVQQRAWEA

SEQ ID NO: 941443 - protein, 9 aa, Homo Sapiens
SSRLKNMCS

SEQ ID NO: 941444 - protein, 9 aa, Homo Sapiens
EAEGLGGAP

SEQ ID NO: 941445 - protein, 9 aa, Homo Sapiens
YMKQSPLES

SEQ ID NO: 941446 - protein, 9 aa, Homo Sapiens
SKKSKTLQK

SEQ ID NO: 941447 - protein, 9 aa, Homo Sapiens
RLRGGRAET

SEQ ID NO: 941448 - protein, 9 aa, Homo Sapiens
KVFEFMVYE

SEQ ID NO: 941449 - protein, 9 aa, Homo Sapiens
DAYMNFITH

SEQ ID NO: 941450 - protein, 9 aa, Homo Sapiens
HPYVYEILV

SEQ ID NO: 941451 - protein, 9 aa, Homo Sapiens
FFWMEIVLV

SEQ ID NO: 941452 - protein, 9 aa, Homo Sapiens
GSFWREAAT

SEQ ID NO: 941453 - protein, 9 aa, Homo Sapiens
EYIIFPSQF

SEQ ID NO: 941454 - protein, 9 aa, Homo Sapiens
FFLDLSPKG

SEQ ID NO: 941455 - protein, 9 aa, Homo Sapiens
PCRPCLGAS

SEQ ID NO: 941456 - protein, 9 aa, Homo Sapiens
ALGWTGFSC

SEQ ID NO: 941457 - protein, 9 aa, Homo Sapiens
ARVPSPPPI

SEQ ID NO: 941458 - protein, 9 aa, Homo Sapiens
HLAPAHPLN

SEQ ID NO: 941459 - protein, 9 aa, Homo Sapiens
SVSAMSGHR

SEQ ID NO: 941460 - protein, 9 aa, Homo Sapiens
LNASLKKSR

SEQ ID NO: 941461 - protein, 9 aa, Homo Sapiens
GRRENGPQA

SEQ ID NO: 941462 - protein, 9 aa, Homo Sapiens
DDKDSKQNI

SEQ ID NO: 941463 - protein, 9 aa, Homo Sapiens
DKYQWLQID

SEQ ID NO: 941464 - protein, 9 aa, Homo Sapiens
LCFSDSTYQ

SEQ ID NO: 941465 - protein, 9 aa, Homo Sapiens
YLRTRYSVP

SEQ ID NO: 941466 - protein, 9 aa, Homo Sapiens
GYLLAFKAY

SEQ ID NO: 941467 - protein, 9 aa, Homo Sapiens
GVKNSPGVY

SEQ ID NO: 941468 - protein, 9 aa, Homo Sapiens
TRTLMAQFV

SEQ ID NO: 941469 - protein, 9 aa, Homo Sapiens
GTPPIFSWF

SEQ ID NO: 941470 - protein, 9 aa, Homo Sapiens
EERKLLQII

SEQ ID NO: 941471 - protein, 9 aa, Homo Sapiens
GVRNPGDRK

SEQ ID NO: 941472 - protein, 9 aa, Homo Sapiens
ISQVKPGSS

SEQ ID NO: 941473 - protein, 9 aa, Homo Sapiens
MSQGLSWHN

SEQ ID NO: 941474 - protein, 9 aa, Homo Sapiens
LTTHLNVTV

SEQ ID NO: 941475 - protein, 9 aa, Homo Sapiens
ESIVHERHR

SEQ ID NO: 941476 - protein, 9 aa, Homo Sapiens
EKEEGPFHS

SEQ ID NO: 941477 - protein, 9 aa, Homo Sapiens
NEYPFVEDV

SEQ ID NO: 941478 - protein, 9 aa, Homo Sapiens
LWEGSLSSR

SEQ ID NO: 941479 - protein, 9 aa, Homo Sapiens
LVSGRYCGS

SEQ ID NO: 941480 - protein, 9 aa, Homo Sapiens
MALCASNYY

SEQ ID NO: 941481 - protein, 9 aa, Homo Sapiens
KEKESFLSN

SEQ ID NO: 941482 - protein, 9 aa, Homo Sapiens
DFRIGYQQL

SEQ ID NO: 941483 - protein, 9 aa, Homo Sapiens
FVLLPLCPI

SEQ ID NO: 941484 - protein, 9 aa, Homo Sapiens
KLSAFVRVV

SEQ ID NO: 941485 - protein, 9 aa, Homo Sapiens
SKLKRFYSS

SEQ ID NO: 941486 - protein, 9 aa, Homo Sapiens
LGAQKCDNF

SEQ ID NO: 941487 - protein, 9 aa, Homo Sapiens
DMRLMFCNH

SEQ ID NO: 941488 - protein, 9 aa, Homo Sapiens
CQLYRGLGG

SEQ ID NO: 941489 - protein, 9 aa, Homo Sapiens
FSRTSITLH

SEQ ID NO: 941490 - protein, 9 aa, Homo Sapiens
ASDAELVQH

SEQ ID NO: 941491 - protein, 9 aa, Homo Sapiens
GVLAGTAVT

SEQ ID NO: 941492 - protein, 9 aa, Homo Sapiens
QSSQNWDKK

SEQ ID NO: 941493 - protein, 9 aa, Homo Sapiens
SLGSSDILG

SEQ ID NO: 941494 - protein, 9 aa, Homo Sapiens
TAKNVIGKA

SEQ ID NO: 941495 - protein, 9 aa, Homo Sapiens
CQRASSSAS

SEQ ID NO: 941496 - protein, 9 aa, Homo Sapiens
EKDTPAEAR

SEQ ID NO: 941497 - protein, 9 aa, Homo Sapiens
AGPKSRAAP

SEQ ID NO: 941498 - protein, 9 aa, Homo Sapiens
IKEGFPSKE

SEQ ID NO: 941499 - protein, 9 aa, Homo Sapiens
KKHRFTDKV

SEQ ID NO: 941500 - protein, 9 aa, Homo Sapiens
QLPKDVDPT

SEQ ID NO: 941501 - protein, 9 aa, Homo Sapiens
WYKRLTLYS

SEQ ID NO: 941502 - protein, 9 aa, Homo Sapiens
TVFLERLCF

SEQ ID NO: 941503 - protein, 9 aa, Homo Sapiens
ISLILENLP

SEQ ID NO: 941504 - protein, 9 aa, Homo Sapiens
EISQVKPGS

SEQ ID NO: 941505 - protein, 9 aa, Homo Sapiens
DLSFGSSGE

SEQ ID NO: 941506 - protein, 9 aa, Homo Sapiens
ETLEPFAAE

SEQ ID NO: 941507 - protein, 9 aa, Homo Sapiens
APLVVEEDA

SEQ ID NO: 941508 - protein, 9 aa, Homo Sapiens
CLKIFMTEL

SEQ ID NO: 941509 - protein, 9 aa, Homo Sapiens
FCGVSKGAC

SEQ ID NO: 941510 - protein, 9 aa, Homo Sapiens
PLCALSQFE

SEQ ID NO: 941511 - protein, 9 aa, Homo Sapiens
AIFRINNAA

SEQ ID NO: 941512 - protein, 9 aa, Homo Sapiens
IVGILTIIA

SEQ ID NO: 941513 - protein, 9 aa, Homo Sapiens
DEKVISSYE

SEQ ID NO: 941514 - protein, 9 aa, Homo Sapiens
ESFSGGELD

SEQ ID NO: 941515 - protein, 9 aa, Homo Sapiens
GGVESKGPQ

SEQ ID NO: 941516 - protein, 9 aa, Homo Sapiens
NMTSLENDK

SEQ ID NO: 941517 - protein, 9 aa, Homo Sapiens
SKLTFYRPD

SEQ ID NO: 941518 - protein, 9 aa, Homo Sapiens
KVALSLWLS

SEQ ID NO: 941519 - protein, 9 aa, Homo Sapiens
IWLALQPKE

SEQ ID NO: 941520 - protein, 9 aa, Homo Sapiens
LRALRPLCA

SEQ ID NO: 941521 - protein, 9 aa, Homo Sapiens
SYPVYARYW

SEQ ID NO: 941522 - protein, 9 aa, Homo Sapiens
YLVTLMENI

SEQ ID NO: 941523 - protein, 9 aa, Homo Sapiens
SPVKSQKIT

SEQ ID NO: 941524 - protein, 9 aa, Homo Sapiens
SEGTVQTAV

SEQ ID NO: 941525 - protein, 9 aa, Homo Sapiens
APAGVAADL

SEQ ID NO: 941526 - protein, 9 aa, Homo Sapiens
MKSGPKLLS

SEQ ID NO: 941527 - protein, 9 aa, Homo Sapiens
GNIEAKSKT

SEQ ID NO: 941528 - protein, 9 aa, Homo Sapiens
PEAEGLGGA

SEQ ID NO: 941529 - protein, 9 aa, Homo Sapiens
RCISRTGIL

SEQ ID NO: 941530 - protein, 9 aa, Homo Sapiens
ALAQRDKEL

SEQ ID NO: 941531 - protein, 9 aa, Homo Sapiens
TQEARSSAA

SEQ ID NO: 941532 - protein, 9 aa, Homo Sapiens
ETVEIEKEK

SEQ ID NO: 941533 - protein, 9 aa, Homo Sapiens
LSVFSRFSS

SEQ ID NO: 941534 - protein, 9 aa, Homo Sapiens
LFGATNLKN

SEQ ID NO: 941535 - protein, 9 aa, Homo Sapiens
SPGSTSSRL

SEQ ID NO: 941536 - protein, 9 aa, Homo Sapiens
PSSFQTIDH

SEQ ID NO: 941537 - protein, 9 aa, Homo Sapiens
DKKLSIDSS

SEQ ID NO: 941538 - protein, 9 aa, Homo Sapiens
NFVMLAAHC

SEQ ID NO: 941539 - protein, 9 aa, Homo Sapiens
TERADSPRP

SEQ ID NO: 941540 - protein, 9 aa, Homo Sapiens
ACLHKRMEF

SEQ ID NO: 941541 - protein, 9 aa, Homo Sapiens
ALSILRSGP

SEQ ID NO: 941542 - protein, 9 aa, Homo Sapiens
RTLLVRLVR

SEQ ID NO: 941543 - protein, 9 aa, Homo Sapiens
LETSDRTSP

SEQ ID NO: 941544 - protein, 9 aa, Homo Sapiens
GLNILPLPN

SEQ ID NO: 941545 - protein, 9 aa, Homo Sapiens
EFSPEYFVI

SEQ ID NO: 941546 - protein, 9 aa, Homo Sapiens
LVFLHSRRG

SEQ ID NO: 941547 - protein, 9 aa, Homo Sapiens
NEPSTSKET

SEQ ID NO: 941548 - protein, 9 aa, Homo Sapiens
DIISSESSS

SEQ ID NO: 941549 - protein, 9 aa, Homo Sapiens
LKLGTDIFK

SEQ ID NO: 941550 - protein, 9 aa, Homo Sapiens
VFCGVSKGA

SEQ ID NO: 941551 - protein, 9 aa, Homo Sapiens
KKGPFRQYP

SEQ ID NO: 941552 - protein, 9 aa, Homo Sapiens
KRTSRPAST

SEQ ID NO: 941553 - protein, 9 aa, Homo Sapiens
LNFSYSAGT

SEQ ID NO: 941554 - protein, 9 aa, Homo Sapiens
LSFFVESIL

SEQ ID NO: 941555 - protein, 9 aa, Homo Sapiens
VCFEIKEDY

SEQ ID NO: 941556 - protein, 9 aa, Homo Sapiens
GSVLCSVLG

SEQ ID NO: 941557 - protein, 9 aa, Homo Sapiens
HAGTCLRIL

SEQ ID NO: 941558 - protein, 9 aa, Homo Sapiens
LVELYENSL

SEQ ID NO: 941559 - protein, 9 aa, Homo Sapiens
FNLCEDIMG

SEQ ID NO: 941560 - protein, 9 aa, Homo Sapiens
ILSADIAQN

SEQ ID NO: 941561 - protein, 9 aa, Homo Sapiens
SNLDKVGQQ

SEQ ID NO: 941562 - protein, 9 aa, Homo Sapiens
AAFFFSDFG

SEQ ID NO: 941563 - protein, 9 aa, Homo Sapiens
NNITKEAHK

SEQ ID NO: 941564 - protein, 9 aa, Homo Sapiens
KKTKGQQIC

SEQ ID NO: 941565 - protein, 9 aa, Homo Sapiens
QNVNIILQS

SEQ ID NO: 941566 - protein, 9 aa, Homo Sapiens
DTSPNTVSP

SEQ ID NO: 941567 - protein, 9 aa, Homo Sapiens
WAEGLILDT

SEQ ID NO: 941568 - protein, 9 aa, Homo Sapiens
QEMPGERGA

SEQ ID NO: 941569 - protein, 9 aa, Homo Sapiens
ELKEKMDKL

SEQ ID NO: 941570 - protein, 9 aa, Homo Sapiens
KEATPQPRF

SEQ ID NO: 941571 - protein, 9 aa, Homo Sapiens
FNSSWASPT

SEQ ID NO: 941572 - protein, 9 aa, Homo Sapiens
APKPAWFCQ

SEQ ID NO: 941573 - protein, 9 aa, Homo Sapiens
RERSGFPHS

SEQ ID NO: 941574 - protein, 9 aa, Homo Sapiens
YINPEKGDI

SEQ ID NO: 941575 - protein, 9 aa, Homo Sapiens
TVEPRRQKF

SEQ ID NO: 941576 - protein, 9 aa, Homo Sapiens
WNFEFPRPF

SEQ ID NO: 941577 - protein, 9 aa, Homo Sapiens
SSLMLQPAQ

SEQ ID NO: 941578 - protein, 9 aa, Homo Sapiens
LPLDNQVAL

SEQ ID NO: 941579 - protein, 9 aa, Homo Sapiens
IFSEHARTY

SEQ ID NO: 941580 - protein, 9 aa, Homo Sapiens
SKIQNAVIS

SEQ ID NO: 941581 - protein, 9 aa, Homo Sapiens
LPIYCVCVT

SEQ ID NO: 941582 - protein, 9 aa, Homo Sapiens
STMTSWESI

SEQ ID NO: 941583 - protein, 9 aa, Homo Sapiens
KAETIWSLR

SEQ ID NO: 941584 - protein, 9 aa, Homo Sapiens
LAHTLSQLE

SEQ ID NO: 941585 - protein, 9 aa, Homo Sapiens
FMHFSPKGR

SEQ ID NO: 941586 - protein, 9 aa, Homo Sapiens
VLECSSIRI

SEQ ID NO: 941587 - protein, 9 aa, Homo Sapiens
HHLHKPHEH

SEQ ID NO: 941588 - protein, 9 aa, Homo Sapiens
KKVSLIASE

SEQ ID NO: 941589 - protein, 9 aa, Homo Sapiens
WTILPDPRN

SEQ ID NO: 941590 - protein, 9 aa, Homo Sapiens
KLGDDGRTC

SEQ ID NO: 941591 - protein, 9 aa, Homo Sapiens
YVLPEIPQD

SEQ ID NO: 941592 - protein, 9 aa, Homo Sapiens
PSVCFFEIS

SEQ ID NO: 941593 - protein, 9 aa, Homo Sapiens
CCGFVKEMR

SEQ ID NO: 941594 - protein, 9 aa, Homo Sapiens
KKIKEALLS

SEQ ID NO: 941595 - protein, 9 aa, Homo Sapiens
LKDDMRNFY

SEQ ID NO: 941596 - protein, 9 aa, Homo Sapiens
TPGMKPQVP

SEQ ID NO: 941597 - protein, 9 aa, Homo Sapiens
LSGKWTILP

SEQ ID NO: 941598 - protein, 9 aa, Homo Sapiens
LPAVILQNL

SEQ ID NO: 941599 - protein, 9 aa, Homo Sapiens
RCTCPVLIL

SEQ ID NO: 941600 - protein, 9 aa, Homo Sapiens
CTTLFGDTS

SEQ ID NO: 941601 - protein, 9 aa, Homo Sapiens
QGCFSKRLL

SEQ ID NO: 941602 - protein, 9 aa, Homo Sapiens
IYAAYPHSP

SEQ ID NO: 941603 - protein, 9 aa, Homo Sapiens
SLEVPSDAL

SEQ ID NO: 941604 - protein, 9 aa, Homo Sapiens
TLHWVNQLA

SEQ ID NO: 941605 - protein, 9 aa, Homo Sapiens
QREGMRQYG

SEQ ID NO: 941606 - protein, 9 aa, Homo Sapiens
QQLAEEAEI

SEQ ID NO: 941607 - protein, 9 aa, Homo Sapiens
EHFIYGNPR

SEQ ID NO: 941608 - protein, 9 aa, Homo Sapiens
QDMRLVFHN

SEQ ID NO: 941609 - protein, 9 aa, Homo Sapiens
SWANNSVPK

SEQ ID NO: 941610 - protein, 9 aa, Homo Sapiens
TDADSVWIE

SEQ ID NO: 941611 - protein, 9 aa, Homo Sapiens
VTVLVSDVN

SEQ ID NO: 941612 - protein, 9 aa, Homo Sapiens
LRAQKQQSL

SEQ ID NO: 941613 - protein, 9 aa, Homo Sapiens
GFLRQVLEA

SEQ ID NO: 941614 - protein, 9 aa, Homo Sapiens
DELQKECET

SEQ ID NO: 941615 - protein, 9 aa, Homo Sapiens
VEPRRQKFH

SEQ ID NO: 941616 - protein, 9 aa, Homo Sapiens
KKRIKRAGG

SEQ ID NO: 941617 - protein, 9 aa, Homo Sapiens
FNTAIKGSD

SEQ ID NO: 941618 - protein, 9 aa, Homo Sapiens
QENSGQHPD

SEQ ID NO: 941619 - protein, 9 aa, Homo Sapiens
IYYGTQHKI

SEQ ID NO: 941620 - protein, 9 aa, Homo Sapiens
IHVAQNPHG

SEQ ID NO: 941621 - protein, 9 aa, Homo Sapiens
AQAPLVVEE

SEQ ID NO: 941622 - protein, 9 aa, Homo Sapiens
DSISKSPEL

SEQ ID NO: 941623 - protein, 9 aa, Homo Sapiens
VPLAVFPGS

SEQ ID NO: 941624 - protein, 9 aa, Homo Sapiens
LEARPSSYK

SEQ ID NO: 941625 - protein, 9 aa, Homo Sapiens
PPQQLNVSS

SEQ ID NO: 941626 - protein, 9 aa, Homo Sapiens
SSSLGSSDI

SEQ ID NO: 941627 - protein, 9 aa, Homo Sapiens
LETFSLDAA

SEQ ID NO: 941628 - protein, 9 aa, Homo Sapiens
KGNPEKVFK

SEQ ID NO: 941629 - protein, 9 aa, Homo Sapiens
VPLVWTDNP

SEQ ID NO: 941630 - protein, 9 aa, Homo Sapiens
METLRDYAD

SEQ ID NO: 941631 - protein, 9 aa, Homo Sapiens
YNRNSSVVL

SEQ ID NO: 941632 - protein, 9 aa, Homo Sapiens
ENKTTKIPL

SEQ ID NO: 941633 - protein, 9 aa, Homo Sapiens
SSHFELLKV

SEQ ID NO: 941634 - protein, 9 aa, Homo Sapiens
YHSIVQRFA

SEQ ID NO: 941635 - protein, 9 aa, Homo Sapiens
GGFTRKYLL

SEQ ID NO: 941636 - protein, 9 aa, Homo Sapiens
TVTEKLDSN

SEQ ID NO: 941637 - protein, 9 aa, Homo Sapiens
LLRAMAAVP

SEQ ID NO: 941638 - protein, 8 aa, Homo Sapiens
GGGAGERL

SEQ ID NO: 941639 - protein, 9 aa, Homo Sapiens
DLAIGFEKR

SEQ ID NO: 941640 - protein, 9 aa, Homo Sapiens
KLYSLTSED

SEQ ID NO: 941641 - protein, 9 aa, Homo Sapiens
FLMALSENA

SEQ ID NO: 941642 - protein, 9 aa, Homo Sapiens
PKDKENKFK

SEQ ID NO: 941643 - protein, 9 aa, Homo Sapiens
CNPANDAQI

SEQ ID NO: 941644 - protein, 9 aa, Homo Sapiens
PSLCARTGS

SEQ ID NO: 941645 - protein, 9 aa, Homo Sapiens
GGAQKGVSQ

SEQ ID NO: 941646 - protein, 9 aa, Homo Sapiens
LLLQRCCQG

SEQ ID NO: 941647 - protein, 9 aa, Homo Sapiens
SKATVIRGH

SEQ ID NO: 941648 - protein, 9 aa, Homo Sapiens
NKVEDRLRA

SEQ ID NO: 941649 - protein, 9 aa, Homo Sapiens
VIRSPFFSN

SEQ ID NO: 941650 - protein, 9 aa, Homo Sapiens
MTSWESIKG

SEQ ID NO: 941651 - protein, 9 aa, Homo Sapiens
LNGLLWEAE

SEQ ID NO: 941652 - protein, 9 aa, Homo Sapiens
IESGQLREK

SEQ ID NO: 941653 - protein, 9 aa, Homo Sapiens
EKEAAHQDL

SEQ ID NO: 941654 - protein, 9 aa, Homo Sapiens
PMPSVLEDL

SEQ ID NO: 941655 - protein, 9 aa, Homo Sapiens
KNRPTSILW

SEQ ID NO: 941656 - protein, 9 aa, Homo Sapiens
VPTKKMYKI

SEQ ID NO: 941657 - protein, 9 aa, Homo Sapiens
LPGADSQDQ

SEQ ID NO: 941658 - protein, 9 aa, Homo Sapiens
QKGLNSGTL

SEQ ID NO: 941659 - protein, 9 aa, Homo Sapiens
DTLNSNYCR

SEQ ID NO: 941660 - protein, 9 aa, Homo Sapiens
GLNSGTLNI

SEQ ID NO: 941661 - protein, 9 aa, Homo Sapiens
GAGQRLRKD

SEQ ID NO: 941662 - protein, 9 aa, Homo Sapiens
EELQQTGRF

SEQ ID NO: 941663 - protein, 9 aa, Homo Sapiens
ATSRRSNSG

SEQ ID NO: 941664 - protein, 9 aa, Homo Sapiens
ERDALDLYQ

SEQ ID NO: 941665 - protein, 9 aa, Homo Sapiens
YFILGTTLK

SEQ ID NO: 941666 - protein, 9 aa, Homo Sapiens
RGMPTFSWD

SEQ ID NO: 941667 - protein, 9 aa, Homo Sapiens
NTTGLTTLN

SEQ ID NO: 941668 - protein, 9 aa, Homo Sapiens
KESKDPKHF

SEQ ID NO: 941669 - protein, 9 aa, Homo Sapiens
TESQSLIFQ

SEQ ID NO: 941670 - protein, 9 aa, Homo Sapiens
SITLQSDHC

SEQ ID NO: 941671 - protein, 9 aa, Homo Sapiens
SCLALEQER

SEQ ID NO: 941672 - protein, 9 aa, Homo Sapiens
ERTQFFSKK

SEQ ID NO: 941673 - protein, 9 aa, Homo Sapiens
TSSRLKNMC

SEQ ID NO: 941674 - protein, 9 aa, Homo Sapiens
LCHNLDHRG

SEQ ID NO: 941675 - protein, 9 aa, Homo Sapiens
AYRAGLQLV

SEQ ID NO: 941676 - protein, 9 aa, Homo Sapiens
LSNCTLHWV

SEQ ID NO: 941677 - protein, 9 aa, Homo Sapiens
IYFMTAVAF

SEQ ID NO: 941678 - protein, 9 aa, Homo Sapiens
PDGSDKDNK

SEQ ID NO: 941679 - protein, 9 aa, Homo Sapiens
DTLRSMKSG

SEQ ID NO: 941680 - protein, 9 aa, Homo Sapiens
AKLGFYPQE

SEQ ID NO: 941681 - protein, 9 aa, Homo Sapiens
FPSSQDYPL

SEQ ID NO: 941682 - protein, 9 aa, Homo Sapiens
PQQFRPLAA

SEQ ID NO: 941683 - protein, 9 aa, Homo Sapiens
INGTYANKT

SEQ ID NO: 941684 - protein, 9 aa, Homo Sapiens
PAGAIPQER

SEQ ID NO: 941685 - protein, 9 aa, Homo Sapiens
LIRQLLEED

SEQ ID NO: 941686 - protein, 9 aa, Homo Sapiens
KELFPTMTL

SEQ ID NO: 941687 - protein, 9 aa, Homo Sapiens
SGSLTHTAT

SEQ ID NO: 941688 - protein, 9 aa, Homo Sapiens
AQLSFLAMR

SEQ ID NO: 941689 - protein, 9 aa, Homo Sapiens
HDFSEHDGD

SEQ ID NO: 941690 - protein, 9 aa, Homo Sapiens
VLDLHKQEA

SEQ ID NO: 941691 - protein, 9 aa, Homo Sapiens
GRDSKIIQK

SEQ ID NO: 941692 - protein, 9 aa, Homo Sapiens
MVTRLPDRP

SEQ ID NO: 941693 - protein, 9 aa, Homo Sapiens
EGLPKPEEP

SEQ ID NO: 941694 - protein, 9 aa, Homo Sapiens
VFSTCSFHL

SEQ ID NO: 941695 - protein, 9 aa, Homo Sapiens
WEVEELSVE

SEQ ID NO: 941696 - protein, 9 aa, Homo Sapiens
PELCNEISL

SEQ ID NO: 941697 - protein, 9 aa, Homo Sapiens
PLPEGWSSY

SEQ ID NO: 941698 - protein, 9 aa, Homo Sapiens
SLPIVLSSE

SEQ ID NO: 941699 - protein, 9 aa, Homo Sapiens
LDFGYEKHF

SEQ ID NO: 941700 - protein, 9 aa, Homo Sapiens
FGPSGCKRK

SEQ ID NO: 941701 - protein, 9 aa, Homo Sapiens
ASCTSVPLW

SEQ ID NO: 941702 - protein, 9 aa, Homo Sapiens
CHGLGLSLW

SEQ ID NO: 941703 - protein, 9 aa, Homo Sapiens
GFEPGPPAA

SEQ ID NO: 941704 - protein, 9 aa, Homo Sapiens
LIRTYWNFE

SEQ ID NO: 941705 - protein, 9 aa, Homo Sapiens
SSQMLKGLL

SEQ ID NO: 941706 - protein, 9 aa, Homo Sapiens
LRYESITLQ

SEQ ID NO: 941707 - protein, 9 aa, Homo Sapiens
LRVWFTDLW

SEQ ID NO: 941708 - protein, 9 aa, Homo Sapiens
FQQHHLHRT

SEQ ID NO: 941709 - protein, 9 aa, Homo Sapiens
KPQKSGIIK

SEQ ID NO: 941710 - protein, 9 aa, Homo Sapiens
SRQSSVSFQ

SEQ ID NO: 941711 - protein, 9 aa, Homo Sapiens
GQEKDNERV

SEQ ID NO: 941712 - protein, 9 aa, Homo Sapiens
GKPALFSRT

SEQ ID NO: 941713 - protein, 9 aa, Homo Sapiens
FEQKVLNVF

SEQ ID NO: 941714 - protein, 9 aa, Homo Sapiens
GRNREEGYW

SEQ ID NO: 941715 - protein, 9 aa, Homo Sapiens
KGSPSRSPR

SEQ ID NO: 941716 - protein, 9 aa, Homo Sapiens
ERIWLALQP

SEQ ID NO: 941717 - protein, 9 aa, Homo Sapiens
DDLEDLKPV

SEQ ID NO: 941718 - protein, 9 aa, Homo Sapiens
EKTTKEEWS

SEQ ID NO: 941719 - protein, 9 aa, Homo Sapiens
LATPPPPTT

SEQ ID NO: 941720 - protein, 9 aa, Homo Sapiens
HPSSALRSA

SEQ ID NO: 941721 - protein, 9 aa, Homo Sapiens
CPRAFIGKD

SEQ ID NO: 941722 - protein, 9 aa, Homo Sapiens
NSRREGLIC

SEQ ID NO: 941723 - protein, 9 aa, Homo Sapiens
SIDPNDMMR

SEQ ID NO: 941724 - protein, 9 aa, Homo Sapiens
LIPTMTKKI

SEQ ID NO: 941725 - protein, 9 aa, Homo Sapiens
AVYQEAQMP

SEQ ID NO: 941726 - protein, 9 aa, Homo Sapiens
SGLSSRGST

SEQ ID NO: 941727 - protein, 9 aa, Homo Sapiens
SAQVLIREV

SEQ ID NO: 941728 - protein, 9 aa, Homo Sapiens
ITFTLLDPH

SEQ ID NO: 941729 - protein, 9 aa, Homo Sapiens
AFVLLPLCP

SEQ ID NO: 941730 - protein, 9 aa, Homo Sapiens
YHKVDLCLQ

SEQ ID NO: 941731 - protein, 9 aa, Homo Sapiens
LLEEVDYEL

SEQ ID NO: 941732 - protein, 9 aa, Homo Sapiens
IERPKKEYF

SEQ ID NO: 941733 - protein, 9 aa, Homo Sapiens
VQATKKVNL

SEQ ID NO: 941734 - protein, 9 aa, Homo Sapiens
GLYLCVGNK

SEQ ID NO: 941735 - protein, 9 aa, Homo Sapiens
MTLLPLWLP

SEQ ID NO: 941736 - protein, 9 aa, Homo Sapiens
SARATHNPM

SEQ ID NO: 941737 - protein, 9 aa, Homo Sapiens
EEKGNPEKV

SEQ ID NO: 941738 - protein, 9 aa, Homo Sapiens
NLELYKYDL

SEQ ID NO: 941739 - protein, 9 aa, Homo Sapiens
GLKGENSLP

SEQ ID NO: 941740 - protein, 9 aa, Homo Sapiens
LTCACPSHD

SEQ ID NO: 941741 - protein, 9 aa, Homo Sapiens
DFIYKVTEG

SEQ ID NO: 941742 - protein, 9 aa, Homo Sapiens
NVNPKSSIT

SEQ ID NO: 941743 - protein, 9 aa, Homo Sapiens
GGQKVATLN

SEQ ID NO: 941744 - protein, 9 aa, Homo Sapiens
SLKKSRKTR

SEQ ID NO: 941745 - protein, 9 aa, Homo Sapiens
HKEEKTLMP

SEQ ID NO: 941746 - protein, 9 aa, Homo Sapiens
ILEDINVSP

SEQ ID NO: 941747 - protein, 9 aa, Homo Sapiens
DLLTRSELL

SEQ ID NO: 941748 - protein, 9 aa, Homo Sapiens
PATSPLPRG

SEQ ID NO: 941749 - protein, 9 aa, Homo Sapiens
LSRKPSFPF

SEQ ID NO: 941750 - protein, 9 aa, Homo Sapiens
LTIIASFCS

SEQ ID NO: 941751 - protein, 9 aa, Homo Sapiens
AENIMPTTY

SEQ ID NO: 941752 - protein, 9 aa, Homo Sapiens
QKRQQLSEN

SEQ ID NO: 941753 - protein, 9 aa, Homo Sapiens
KYNVPILSA

SEQ ID NO: 941754 - protein, 9 aa, Homo Sapiens
GNPGPLGEA

SEQ ID NO: 941755 - protein, 9 aa, Homo Sapiens
RHNCKFYIY

SEQ ID NO: 941756 - protein, 9 aa, Homo Sapiens
GEILDKWQY

SEQ ID NO: 941757 - protein, 9 aa, Homo Sapiens
VPDPTVGFI

SEQ ID NO: 941758 - protein, 9 aa, Homo Sapiens
STASDPQHH

SEQ ID NO: 941759 - protein, 9 aa, Homo Sapiens
EGLFKETIT

SEQ ID NO: 941760 - protein, 9 aa, Homo Sapiens
AESPEKKEE

SEQ ID NO: 941761 - protein, 9 aa, Homo Sapiens
KWVKQYAIS

SEQ ID NO: 941762 - protein, 9 aa, Homo Sapiens
QKRLNLDCW

SEQ ID NO: 941763 - protein, 9 aa, Homo Sapiens
SPLSYRSLP

SEQ ID NO: 941764 - protein, 9 aa, Homo Sapiens
WSYVLHRSM

SEQ ID NO: 941765 - protein, 9 aa, Homo Sapiens
VVDRTCSSR

SEQ ID NO: 941766 - protein, 9 aa, Homo Sapiens
CKRKSCRNS

SEQ ID NO: 941767 - protein, 9 aa, Homo Sapiens
FCLHCGGTS

SEQ ID NO: 941768 - protein, 9 aa, Homo Sapiens
QLNTWNFSI

SEQ ID NO: 941769 - protein, 9 aa, Homo Sapiens
LDCRKSGKN

SEQ ID NO: 941770 - protein, 9 aa, Homo Sapiens
DNFETNWCI

SEQ ID NO: 941771 - protein, 9 aa, Homo Sapiens
VAKERKRKL

SEQ ID NO: 941772 - protein, 9 aa, Homo Sapiens
SVPGQANKI

SEQ ID NO: 941773 - protein, 9 aa, Homo Sapiens
WGEPSKPKS

SEQ ID NO: 941774 - protein, 9 aa, Homo Sapiens
DLEDLKPVI

SEQ ID NO: 941775 - protein, 9 aa, Homo Sapiens
SWHNDLTQY

SEQ ID NO: 941776 - protein, 9 aa, Homo Sapiens
SYNRYMAIC

SEQ ID NO: 941777 - protein, 9 aa, Homo Sapiens
RKESLDFIS

SEQ ID NO: 941778 - protein, 9 aa, Homo Sapiens
LYKKKEKES

SEQ ID NO: 941779 - protein, 9 aa, Homo Sapiens
RFASLTHLN

SEQ ID NO: 941780 - protein, 9 aa, Homo Sapiens
SIISNLDKV

SEQ ID NO: 941781 - protein, 9 aa, Homo Sapiens
FSDSDSSEK

SEQ ID NO: 941782 - protein, 9 aa, Homo Sapiens
EDNRYNWSF

SEQ ID NO: 941783 - protein, 9 aa, Homo Sapiens
ATVIRGHES

SEQ ID NO: 941784 - protein, 9 aa, Homo Sapiens
FKGTLTAAF

SEQ ID NO: 941785 - protein, 9 aa, Homo Sapiens
TYKHKEKQK

SEQ ID NO: 941786 - protein, 9 aa, Homo Sapiens
RATHNPMPC

SEQ ID NO: 941787 - protein, 9 aa, Homo Sapiens
AMRLPIYCV

SEQ ID NO: 941788 - protein, 9 aa, Homo Sapiens
HVFEQGHQL

SEQ ID NO: 941789 - protein, 9 aa, Homo Sapiens
YQEAQMPHG

SEQ ID NO: 941790 - protein, 9 aa, Homo Sapiens
LEMPPATSP

SEQ ID NO: 941791 - protein, 9 aa, Homo Sapiens
SELIFAVPT

SEQ ID NO: 941792 - protein, 9 aa, Homo Sapiens
RAVILRNQE

SEQ ID NO: 941793 - protein, 9 aa, Homo Sapiens
CSSREHVLL

SEQ ID NO: 941794 - protein, 9 aa, Homo Sapiens
RQVRFRRDS

SEQ ID NO: 941795 - protein, 9 aa, Homo Sapiens
VILMNLEYM

SEQ ID NO: 941796 - protein, 9 aa, Homo Sapiens
DWGDYSLIG

SEQ ID NO: 941797 - protein, 9 aa, Homo Sapiens
DNEQRPSGA

SEQ ID NO: 941798 - protein, 9 aa, Homo Sapiens
GSNVSIGKG

SEQ ID NO: 941799 - protein, 9 aa, Homo Sapiens
CESSQEGST

SEQ ID NO: 941800 - protein, 9 aa, Homo Sapiens
PTSTIFTSP

SEQ ID NO: 941801 - protein, 9 aa, Homo Sapiens
DALQQYELK

SEQ ID NO: 941802 - protein, 9 aa, Homo Sapiens
LTYHQKIYT

SEQ ID NO: 941803 - protein, 9 aa, Homo Sapiens
VVDRVVAIF

SEQ ID NO: 941804 - protein, 9 aa, Homo Sapiens
AFNSLAGGL

SEQ ID NO: 941805 - protein, 9 aa, Homo Sapiens
FLHSRRGAK

SEQ ID NO: 941806 - protein, 9 aa, Homo Sapiens
ESLDFISHS

SEQ ID NO: 941807 - protein, 9 aa, Homo Sapiens
DLDKMFGVW

SEQ ID NO: 941808 - protein, 9 aa, Homo Sapiens
TPISLLIPS

SEQ ID NO: 941809 - protein, 9 aa, Homo Sapiens
LSLVLFYKT

SEQ ID NO: 941810 - protein, 9 aa, Homo Sapiens
RPGFRKAVD

SEQ ID NO: 941811 - protein, 9 aa, Homo Sapiens
ELTQHQRLY

SEQ ID NO: 941812 - protein, 9 aa, Homo Sapiens
KENIKAGPN

SEQ ID NO: 941813 - protein, 9 aa, Homo Sapiens
ARGHSDPKL

SEQ ID NO: 941814 - protein, 9 aa, Homo Sapiens
RGRGGKPRA

SEQ ID NO: 941815 - protein, 9 aa, Homo Sapiens
SPQNNTLYI

SEQ ID NO: 941816 - protein, 9 aa, Homo Sapiens
KPRAAPSLE

SEQ ID NO: 941817 - protein, 9 aa, Homo Sapiens
SVECYDSRT

SEQ ID NO: 941818 - protein, 9 aa, Homo Sapiens
LGTDGSDEK

SEQ ID NO: 941819 - protein, 9 aa, Homo Sapiens
KYQRIKGFP

SEQ ID NO: 941820 - protein, 9 aa, Homo Sapiens
YGKELYYLA

SEQ ID NO: 941821 - protein, 9 aa, Homo Sapiens
FPSPGNAQA

SEQ ID NO: 941822 - protein, 9 aa, Homo Sapiens
WFQDLKKCY

SEQ ID NO: 941823 - protein, 9 aa, Homo Sapiens
TWEKVLQLS

SEQ ID NO: 941824 - protein, 9 aa, Homo Sapiens
QKAYWSYVL

SEQ ID NO: 941825 - protein, 9 aa, Homo Sapiens
IVARDMSKK

SEQ ID NO: 941826 - protein, 9 aa, Homo Sapiens
ENQPQSSDE

SEQ ID NO: 941827 - protein, 9 aa, Homo Sapiens
TVSRNKRRY

SEQ ID NO: 941828 - protein, 9 aa, Homo Sapiens
SIGQKLLQK

SEQ ID NO: 941829 - protein, 9 aa, Homo Sapiens
LAGTAVTPN

SEQ ID NO: 941830 - protein, 9 aa, Homo Sapiens
LDWKVPKFS

SEQ ID NO: 941831 - protein, 9 aa, Homo Sapiens
EPHSLFTDE

SEQ ID NO: 941832 - protein, 9 aa, Homo Sapiens
ILRNQEGPG

SEQ ID NO: 941833 - protein, 9 aa, Homo Sapiens
RFEAPDGQP

SEQ ID NO: 941834 - protein, 9 aa, Homo Sapiens
KFIASAPGK

SEQ ID NO: 941835 - protein, 9 aa, Homo Sapiens
LRKSAKYRL

SEQ ID NO: 941836 - protein, 9 aa, Homo Sapiens
FMDHFIPSS

SEQ ID NO: 941837 - protein, 9 aa, Homo Sapiens
CFDFCCIDQ

SEQ ID NO: 941838 - protein, 9 aa, Homo Sapiens
PLSGDRARG

SEQ ID NO: 941839 - protein, 9 aa, Homo Sapiens
FLQREGMRQ

SEQ ID NO: 941840 - protein, 9 aa, Homo Sapiens
RGREVMILK

SEQ ID NO: 941841 - protein, 9 aa, Homo Sapiens
LGNLFSISA

SEQ ID NO: 941842 - protein, 9 aa, Homo Sapiens
FRSQIKNGK

SEQ ID NO: 941843 - protein, 9 aa, Homo Sapiens
SAKKSAEPP

SEQ ID NO: 941844 - protein, 9 aa, Homo Sapiens
LDGNKIEEI

SEQ ID NO: 941845 - protein, 9 aa, Homo Sapiens
SDTPETDDS

SEQ ID NO: 941846 - protein, 9 aa, Homo Sapiens
LQNLFTGHR

SEQ ID NO: 941847 - protein, 9 aa, Homo Sapiens
QAFMVINSD

SEQ ID NO: 941848 - protein, 9 aa, Homo Sapiens
RDMSKKSLW

SEQ ID NO: 941849 - protein, 9 aa, Homo Sapiens
EAALGRAAC

SEQ ID NO: 941850 - protein, 9 aa, Homo Sapiens
NLPVANGPA

SEQ ID NO: 941851 - protein, 9 aa, Homo Sapiens
IYVLPEIPQ

SEQ ID NO: 941852 - protein, 9 aa, Homo Sapiens
TSHEIKKQT

SEQ ID NO: 941853 - protein, 9 aa, Homo Sapiens
FPSQFYIRI

SEQ ID NO: 941854 - protein, 9 aa, Homo Sapiens
EMFSSGELI

SEQ ID NO: 941855 - protein, 9 aa, Homo Sapiens
VFFPGGAAF

SEQ ID NO: 941856 - protein, 9 aa, Homo Sapiens
LQLLSQICS

SEQ ID NO: 941857 - protein, 9 aa, Homo Sapiens
ADQSPHILR

SEQ ID NO: 941858 - protein, 9 aa, Homo Sapiens
PGAPGPLGS

SEQ ID NO: 941859 - protein, 9 aa, Homo Sapiens
SEKADSSHF

SEQ ID NO: 941860 - protein, 9 aa, Homo Sapiens
ITHPYVYEI

SEQ ID NO: 941861 - protein, 9 aa, Homo Sapiens
EDQNTLIEE

SEQ ID NO: 941862 - protein, 9 aa, Homo Sapiens
ATPGRDSKI

SEQ ID NO: 941863 - protein, 9 aa, Homo Sapiens
PTLDVFCHK

SEQ ID NO: 941864 - protein, 9 aa, Homo Sapiens
HWEEMKKTK

SEQ ID NO: 941865 - protein, 9 aa, Homo Sapiens
RSLDCRKSG

SEQ ID NO: 941866 - protein, 9 aa, Homo Sapiens
SPDSYRSPF

SEQ ID NO: 941867 - protein, 9 aa, Homo Sapiens
INNNLNLRY

SEQ ID NO: 941868 - protein, 9 aa, Homo Sapiens
LCIWELSAQ

SEQ ID NO: 941869 - protein, 9 aa, Homo Sapiens
VPRPKTTAP

SEQ ID NO: 941870 - protein, 9 aa, Homo Sapiens
NMYSSTLTM

SEQ ID NO: 941871 - protein, 9 aa, Homo Sapiens
SESLFQGMG

SEQ ID NO: 941872 - protein, 9 aa, Homo Sapiens
MTILFLTMI

SEQ ID NO: 941873 - protein, 9 aa, Homo Sapiens
YFMDHFIPS

SEQ ID NO: 941874 - protein, 9 aa, Homo Sapiens
CVNCMDCLD

SEQ ID NO: 941875 - protein, 9 aa, Homo Sapiens
QKKRLSNVI

SEQ ID NO: 941876 - protein, 9 aa, Homo Sapiens
QKDESQSFY

SEQ ID NO: 941877 - protein, 9 aa, Homo Sapiens
KEILEITGG

SEQ ID NO: 941878 - protein, 9 aa, Homo Sapiens
PSPHPSSAL

SEQ ID NO: 941879 - protein, 9 aa, Homo Sapiens
LKLLRTILQ

SEQ ID NO: 941880 - protein, 9 aa, Homo Sapiens
LSINIVFMN

SEQ ID NO: 941881 - protein, 9 aa, Homo Sapiens
PGSQQNPDF

SEQ ID NO: 941882 - protein, 9 aa, Homo Sapiens
IFEGKIGKG

SEQ ID NO: 941883 - protein, 9 aa, Homo Sapiens
FHLSVVSLF

SEQ ID NO: 941884 - protein, 9 aa, Homo Sapiens
DSADKDRCE

SEQ ID NO: 941885 - protein, 9 aa, Homo Sapiens
MTSKVSGCR

SEQ ID NO: 941886 - protein, 9 aa, Homo Sapiens
RFTPISLLI

SEQ ID NO: 941887 - protein, 9 aa, Homo Sapiens
DCCRSLTGK

SEQ ID NO: 941888 - protein, 9 aa, Homo Sapiens
YVSPRSPEW

SEQ ID NO: 941889 - protein, 9 aa, Homo Sapiens
YLRVSSHLQ

SEQ ID NO: 941890 - protein, 9 aa, Homo Sapiens
VDGLRVWFT

SEQ ID NO: 941891 - protein, 9 aa, Homo Sapiens
RSAEGRRRV

SEQ ID NO: 941892 - protein, 9 aa, Homo Sapiens
VSPGSTSSR

SEQ ID NO: 941893 - protein, 9 aa, Homo Sapiens
QVFSFWRQK

SEQ ID NO: 941894 - protein, 9 aa, Homo Sapiens
KIQKGREMS

SEQ ID NO: 941895 - protein, 9 aa, Homo Sapiens
RQLAAGWGL

SEQ ID NO: 941896 - protein, 9 aa, Homo Sapiens
RLPKQKEKL

SEQ ID NO: 941897 - protein, 9 aa, Homo Sapiens
ETLQYHVQH

SEQ ID NO: 941898 - protein, 9 aa, Homo Sapiens
ETPEKIQMT

SEQ ID NO: 941899 - protein, 9 aa, Homo Sapiens
MGTRQHGDN

SEQ ID NO: 941900 - protein, 9 aa, Homo Sapiens
TEPGFEPGP

SEQ ID NO: 941901 - protein, 9 aa, Homo Sapiens
PRRTAPEIY

SEQ ID NO: 941902 - protein, 9 aa, Homo Sapiens
GNTEILNQS

SEQ ID NO: 941903 - protein, 9 aa, Homo Sapiens
YQSSWEQAI

SEQ ID NO: 941904 - protein, 9 aa, Homo Sapiens
CKSSYLLHG

SEQ ID NO: 941905 - protein, 9 aa, Homo Sapiens
TVIKGKGMQ

SEQ ID NO: 941906 - protein, 9 aa, Homo Sapiens
EAFQKSAED

SEQ ID NO: 941907 - protein, 9 aa, Homo Sapiens
STSPSLVSM

SEQ ID NO: 941908 - protein, 9 aa, Homo Sapiens
PIKLIDFGL

SEQ ID NO: 941909 - protein, 9 aa, Homo Sapiens
PITIVYEID

SEQ ID NO: 941910 - protein, 9 aa, Homo Sapiens
SYLGMYLTD

SEQ ID NO: 941911 - protein, 9 aa, Homo Sapiens
SVCRHFRFP

SEQ ID NO: 941912 - protein, 9 aa, Homo Sapiens
HLCSAKKSA

SEQ ID NO: 941913 - protein, 9 aa, Homo Sapiens
LQKLSSYNG

SEQ ID NO: 941914 - protein, 9 aa, Homo Sapiens
WWPASQQIL

SEQ ID NO: 941915 - protein, 9 aa, Homo Sapiens
LGPRNRADN

SEQ ID NO: 941916 - protein, 9 aa, Homo Sapiens
IVGAYDWGG

SEQ ID NO: 941917 - protein, 9 aa, Homo Sapiens
PAFNMPLQG

SEQ ID NO: 941918 - protein, 9 aa, Homo Sapiens
ILFLTMIIS

SEQ ID NO: 941919 - protein, 9 aa, Homo Sapiens
ENMSEELVV

SEQ ID NO: 941920 - protein, 9 aa, Homo Sapiens
RLPIYCVCV

SEQ ID NO: 941921 - protein, 9 aa, Homo Sapiens
KPETPIVPV

SEQ ID NO: 941922 - protein, 9 aa, Homo Sapiens
IIVNAKFED

SEQ ID NO: 941923 - protein, 9 aa, Homo Sapiens
KIDKLHSEL

SEQ ID NO: 941924 - protein, 9 aa, Homo Sapiens
GQMFSTTSF

SEQ ID NO: 941925 - protein, 9 aa, Homo Sapiens
VFFAFELMQ

SEQ ID NO: 941926 - protein, 9 aa, Homo Sapiens
SHRNSSKCK

SEQ ID NO: 941927 - protein, 9 aa, Homo Sapiens
RLTTHLNVT

SEQ ID NO: 941928 - protein, 9 aa, Homo Sapiens
RGGRTYVDV

SEQ ID NO: 941929 - protein, 9 aa, Homo Sapiens
QKDFSGQHN

SEQ ID NO: 941930 - protein, 9 aa, Homo Sapiens
EQISENSTE

SEQ ID NO: 941931 - protein, 9 aa, Homo Sapiens
ICSHLHRSD

SEQ ID NO: 941932 - protein, 9 aa, Homo Sapiens
VKFNTAIKG

SEQ ID NO: 941933 - protein, 9 aa, Homo Sapiens
EASNKLTFY

SEQ ID NO: 941934 - protein, 9 aa, Homo Sapiens
EKGKKGETA

SEQ ID NO: 941935 - protein, 9 aa, Homo Sapiens
SQSWISHWL

SEQ ID NO: 941936 - protein, 9 aa, Homo Sapiens
SLYFNGPEK

SEQ ID NO: 941937 - protein, 9 aa, Homo Sapiens
FVTFFYCFA

SEQ ID NO: 941938 - protein, 9 aa, Homo Sapiens
NLDCWKRKR

SEQ ID NO: 941939 - protein, 9 aa, Homo Sapiens
LNRIAKMNW

SEQ ID NO: 941940 - protein, 9 aa, Homo Sapiens
VWRVTNTSQ

SEQ ID NO: 941941 - protein, 9 aa, Homo Sapiens
HCFQLTTFN

SEQ ID NO: 941942 - protein, 9 aa, Homo Sapiens
LQVQAKADA

SEQ ID NO: 941943 - protein, 9 aa, Homo Sapiens
MNTIDLDSL

SEQ ID NO: 941944 - protein, 9 aa, Homo Sapiens
QKFYLKCHK

SEQ ID NO: 941945 - protein, 9 aa, Homo Sapiens
VFLHSRRGA

SEQ ID NO: 941946 - protein, 9 aa, Homo Sapiens
NGSGHIGSF

SEQ ID NO: 941947 - protein, 9 aa, Homo Sapiens
LLHKKSLKF

SEQ ID NO: 941948 - protein, 9 aa, Homo Sapiens
STISALEVF

SEQ ID NO: 941949 - protein, 9 aa, Homo Sapiens
APEAINYET

SEQ ID NO: 941950 - protein, 9 aa, Homo Sapiens
KVSGCRNQR

SEQ ID NO: 941951 - protein, 9 aa, Homo Sapiens
NFSVSIRKE

SEQ ID NO: 941952 - protein, 9 aa, Homo Sapiens
LLSDKASEE

SEQ ID NO: 941953 - protein, 9 aa, Homo Sapiens
PPPLPQKLL

SEQ ID NO: 941954 - protein, 9 aa, Homo Sapiens
EGAQCSAPL

SEQ ID NO: 941955 - protein, 9 aa, Homo Sapiens
DLDKKHRFT

SEQ ID NO: 941956 - protein, 9 aa, Homo Sapiens
VMYVRVSFD

SEQ ID NO: 941957 - protein, 9 aa, Homo Sapiens
LIKMEKEKH

SEQ ID NO: 941958 - protein, 9 aa, Homo Sapiens
LRTGTSQVL

SEQ ID NO: 941959 - protein, 9 aa, Homo Sapiens
EKFPSSQDY

SEQ ID NO: 941960 - protein, 9 aa, Homo Sapiens
PVTAVLVVL

SEQ ID NO: 941961 - protein, 9 aa, Homo Sapiens
NEVMYDEIK

SEQ ID NO: 941962 - protein, 9 aa, Homo Sapiens
INLPPFTGC

SEQ ID NO: 941963 - protein, 9 aa, Homo Sapiens
SFHDFPDFG

SEQ ID NO: 941964 - protein, 9 aa, Homo Sapiens
EGLPALEYP

SEQ ID NO: 941965 - protein, 9 aa, Homo Sapiens
CASLSSGLN

SEQ ID NO: 941966 - protein, 9 aa, Homo Sapiens
MHHFSRNSS

SEQ ID NO: 941967 - protein, 9 aa, Homo Sapiens
VDFLIIYIK

SEQ ID NO: 941968 - protein, 9 aa, Homo Sapiens
PQVLDLHKQ

SEQ ID NO: 941969 - protein, 9 aa, Homo Sapiens
KVTYACKSS

SEQ ID NO: 941970 - protein, 9 aa, Homo Sapiens
PNLIFSFCK

SEQ ID NO: 941971 - protein, 9 aa, Homo Sapiens
SLLPNVPLN

SEQ ID NO: 941972 - protein, 9 aa, Homo Sapiens
PFDDSLEHK

SEQ ID NO: 941973 - protein, 9 aa, Homo Sapiens
SGWSGYSHT

SEQ ID NO: 941974 - protein, 9 aa, Homo Sapiens
AGPKPRAAP

SEQ ID NO: 941975 - protein, 9 aa, Homo Sapiens
KIQASGETF

SEQ ID NO: 941976 - protein, 9 aa, Homo Sapiens
EIFLEIVDN

SEQ ID NO: 941977 - protein, 9 aa, Homo Sapiens
MRGMPTFSW

SEQ ID NO: 941978 - protein, 9 aa, Homo Sapiens
YEEGKAFAE

SEQ ID NO: 941979 - protein, 9 aa, Homo Sapiens
QTLPPAVLH

SEQ ID NO: 941980 - protein, 9 aa, Homo Sapiens
DMRNFYFLS

SEQ ID NO: 941981 - protein, 9 aa, Homo Sapiens
DSVPEYDPS

SEQ ID NO: 941982 - protein, 9 aa, Homo Sapiens
LGFAVSFSI

SEQ ID NO: 941983 - protein, 9 aa, Homo Sapiens
KLIQLPSAT

SEQ ID NO: 941984 - protein, 9 aa, Homo Sapiens
SVLDLCYIL

SEQ ID NO: 941985 - protein, 9 aa, Homo Sapiens
EYVVKIWNF

SEQ ID NO: 941986 - protein, 9 aa, Homo Sapiens
VIKMKHGEA

SEQ ID NO: 941987 - protein, 9 aa, Homo Sapiens
LLPLCPIWA

SEQ ID NO: 941988 - protein, 9 aa, Homo Sapiens
LPPVRPHGP

SEQ ID NO: 941989 - protein, 9 aa, Homo Sapiens
HQHYKKTKR

SEQ ID NO: 941990 - protein, 9 aa, Homo Sapiens
YTWELFPHL

SEQ ID NO: 941991 - protein, 9 aa, Homo Sapiens
PSDRVKLFS

SEQ ID NO: 941992 - protein, 9 aa, Homo Sapiens
RSVSGCNII

SEQ ID NO: 941993 - protein, 9 aa, Homo Sapiens
SLVSMGRSL

SEQ ID NO: 941994 - protein, 9 aa, Homo Sapiens
SIKKQRSPD

SEQ ID NO: 941995 - protein, 9 aa, Homo Sapiens
ETPSKGFDE

SEQ ID NO: 941996 - protein, 9 aa, Homo Sapiens
TLGNHFWGI

SEQ ID NO: 941997 - protein, 9 aa, Homo Sapiens
LSIVGILTI

SEQ ID NO: 941998 - protein, 9 aa, Homo Sapiens
YSFPARVPS

SEQ ID NO: 941999 - protein, 9 aa, Homo Sapiens
QPMGPEYVE

SEQ ID NO: 942000 - protein, 9 aa, Homo Sapiens
VIIHRQNEY

SEQ ID NO: 942001 - protein, 9 aa, Homo Sapiens
DIKSLVKGH

SEQ ID NO: 942002 - protein, 9 aa, Homo Sapiens
EHDFSEHDG

SEQ ID NO: 942003 - protein, 9 aa, Homo Sapiens
SAESLDKNL

SEQ ID NO: 942004 - protein, 9 aa, Homo Sapiens
QATKKVNLD

SEQ ID NO: 942005 - protein, 9 aa, Homo Sapiens
ENSLPGENG

SEQ ID NO: 942006 - protein, 9 aa, Homo Sapiens
RETFFLTFP

SEQ ID NO: 942007 - protein, 9 aa, Homo Sapiens
FVFRLPFCA

SEQ ID NO: 942008 - protein, 9 aa, Homo Sapiens
QILRQKVEF

SEQ ID NO: 942009 - protein, 9 aa, Homo Sapiens
ASKALLGRC

SEQ ID NO: 942010 - protein, 9 aa, Homo Sapiens
GPSTTFFTP

SEQ ID NO: 942011 - protein, 9 aa, Homo Sapiens
AAEMSKAFA

SEQ ID NO: 942012 - protein, 9 aa, Homo Sapiens
YACNPSTLG

SEQ ID NO: 942013 - protein, 9 aa, Homo Sapiens
TLIEESAEQ

SEQ ID NO: 942014 - protein, 9 aa, Homo Sapiens
LDDRARMET

SEQ ID NO: 942015 - protein, 9 aa, Homo Sapiens
EKEGEGKKK

SEQ ID NO: 942016 - protein, 9 aa, Homo Sapiens
RKIEARSTE

SEQ ID NO: 942017 - protein, 9 aa, Homo Sapiens
YSVPGQANK

SEQ ID NO: 942018 - protein, 9 aa, Homo Sapiens
GPECPTVFL

SEQ ID NO: 942019 - protein, 9 aa, Homo Sapiens
DFLKINHGI

SEQ ID NO: 942020 - protein, 9 aa, Homo Sapiens
FFSNVYPGE

SEQ ID NO: 942021 - protein, 9 aa, Homo Sapiens
FTDKKETSK

SEQ ID NO: 942022 - protein, 9 aa, Homo Sapiens
AYEKSLDQL

SEQ ID NO: 942023 - protein, 9 aa, Homo Sapiens
IFYGFLSDN

SEQ ID NO: 942024 - protein, 9 aa, Homo Sapiens
EETLLLHKK

SEQ ID NO: 942025 - protein, 9 aa, Homo Sapiens
TDVANAIYA

SEQ ID NO: 942026 - protein, 9 aa, Homo Sapiens
NNNLNLRYC

SEQ ID NO: 942027 - protein, 9 aa, Homo Sapiens
AIYYGIPMV

SEQ ID NO: 942028 - protein, 9 aa, Homo Sapiens
SKRGCVFCG

SEQ ID NO: 942029 - protein, 9 aa, Homo Sapiens
AAGGERDAL

SEQ ID NO: 942030 - protein, 9 aa, Homo Sapiens
KFKSLWIER

SEQ ID NO: 942031 - protein, 9 aa, Homo Sapiens
KRLLLSASI

SEQ ID NO: 942032 - protein, 9 aa, Homo Sapiens
QLDESKEHI

SEQ ID NO: 942033 - protein, 9 aa, Homo Sapiens
RRRQAFRGK

SEQ ID NO: 942034 - protein, 9 aa, Homo Sapiens
NIYLTLSPN

SEQ ID NO: 942035 - protein, 9 aa, Homo Sapiens
WAGREVLTN

SEQ ID NO: 942036 - protein, 9 aa, Homo Sapiens
SANVEMKWV

SEQ ID NO: 942037 - protein, 9 aa, Homo Sapiens
QLLRTYFSE

SEQ ID NO: 942038 - protein, 9 aa, Homo Sapiens
SSENMSEEL

SEQ ID NO: 942039 - protein, 9 aa, Homo Sapiens
LDRVRLSNS

SEQ ID NO: 942040 - protein, 9 aa, Homo Sapiens
LQICNPAND

SEQ ID NO: 942041 - protein, 9 aa, Homo Sapiens
VSEENINKN

SEQ ID NO: 942042 - protein, 9 aa, Homo Sapiens
LPLEVELST

SEQ ID NO: 942043 - protein, 9 aa, Homo Sapiens
VICSYFPQD

SEQ ID NO: 942044 - protein, 9 aa, Homo Sapiens
LPTIRWLLN

SEQ ID NO: 942045 - protein, 9 aa, Homo Sapiens
QKPPASGGS

SEQ ID NO: 942046 - protein, 9 aa, Homo Sapiens
KKQSMSRLE

SEQ ID NO: 942047 - protein, 9 aa, Homo Sapiens
HYKKTKRKH

SEQ ID NO: 942048 - protein, 9 aa, Homo Sapiens
GLEKKGRFS

SEQ ID NO: 942049 - protein, 9 aa, Homo Sapiens
LRKDVSRPA

SEQ ID NO: 942050 - protein, 9 aa, Homo Sapiens
ISGVFNEPS

SEQ ID NO: 942051 - protein, 9 aa, Homo Sapiens
VLIREVLIK

SEQ ID NO: 942052 - protein, 9 aa, Homo Sapiens
FDLSAGLMA

SEQ ID NO: 942053 - protein, 9 aa, Homo Sapiens
PKSITSLSP

SEQ ID NO: 942054 - protein, 9 aa, Homo Sapiens
YENQPQSSD

SEQ ID NO: 942055 - protein, 9 aa, Homo Sapiens
TRELEALSE

SEQ ID NO: 942056 - protein, 9 aa, Homo Sapiens
PGTGLEGDA

SEQ ID NO: 942057 - protein, 9 aa, Homo Sapiens
GENESQWIR

SEQ ID NO: 942058 - protein, 9 aa, Homo Sapiens
TLYSGRDIP

SEQ ID NO: 942059 - protein, 9 aa, Homo Sapiens
VTDNQTLLN

SEQ ID NO: 942060 - protein, 9 aa, Homo Sapiens
KEGHFSRVT

SEQ ID NO: 942061 - protein, 9 aa, Homo Sapiens
GPMEEELPG

SEQ ID NO: 942062 - protein, 9 aa, Homo Sapiens
PLHPVNNKE

SEQ ID NO: 942063 - protein, 9 aa, Homo Sapiens
GAQGGRPFL

SEQ ID NO: 942064 - protein, 9 aa, Homo Sapiens
LQKICYNKF

SEQ ID NO: 942065 - protein, 9 aa, Homo Sapiens
SAPLSYVPR

SEQ ID NO: 942066 - protein, 9 aa, Homo Sapiens
NQNSQVEGK

SEQ ID NO: 942067 - protein, 9 aa, Homo Sapiens
IKEALLSIG

SEQ ID NO: 942068 - protein, 9 aa, Homo Sapiens
NNLSEIENK

SEQ ID NO: 942069 - protein, 9 aa, Homo Sapiens
KVSSYEDEP

SEQ ID NO: 942070 - protein, 9 aa, Homo Sapiens
GDNLEKRTE

SEQ ID NO: 942071 - protein, 9 aa, Homo Sapiens
KGNGCCLMQ

SEQ ID NO: 942072 - protein, 9 aa, Homo Sapiens
STMETLRDY

SEQ ID NO: 942073 - protein, 9 aa, Homo Sapiens
NMNTINGTQ

SEQ ID NO: 942074 - protein, 9 aa, Homo Sapiens
PYKLGDDGR

SEQ ID NO: 942075 - protein, 9 aa, Homo Sapiens
NSFTCKKGK

SEQ ID NO: 942076 - protein, 9 aa, Homo Sapiens
RAGSTRLTL

SEQ ID NO: 942077 - protein, 9 aa, Homo Sapiens
EHKKLTVDE

SEQ ID NO: 942078 - protein, 9 aa, Homo Sapiens
CHIKETPAT

SEQ ID NO: 942079 - protein, 9 aa, Homo Sapiens
GRDFLSQME

SEQ ID NO: 942080 - protein, 9 aa, Homo Sapiens
QGDNLEKRT

SEQ ID NO: 942081 - protein, 9 aa, Homo Sapiens
CSIVSRSSK

SEQ ID NO: 942082 - protein, 9 aa, Homo Sapiens
AGGSSWGCW

SEQ ID NO: 942083 - protein, 9 aa, Homo Sapiens
STDKKERKY

SEQ ID NO: 942084 - protein, 9 aa, Homo Sapiens
DRPAGSWEQ

SEQ ID NO: 942085 - protein, 9 aa, Homo Sapiens
EEKTLMPPI

SEQ ID NO: 942086 - protein, 9 aa, Homo Sapiens
FLQMKHTDL

SEQ ID NO: 942087 - protein, 9 aa, Homo Sapiens
STVCDIDPQ

SEQ ID NO: 942088 - protein, 9 aa, Homo Sapiens
KRTSKKKSD

SEQ ID NO: 942089 - protein, 9 aa, Homo Sapiens
GGSKRGCVF

SEQ ID NO: 942090 - protein, 9 aa, Homo Sapiens
FVCLDAPGG

SEQ ID NO: 942091 - protein, 9 aa, Homo Sapiens
MESPLASLV

SEQ ID NO: 942092 - protein, 9 aa, Homo Sapiens
VLLSVLPSV

SEQ ID NO: 942093 - protein, 9 aa, Homo Sapiens
AFSLAPGFI

SEQ ID NO: 942094 - protein, 9 aa, Homo Sapiens
FCDQNTTFS

SEQ ID NO: 942095 - protein, 9 aa, Homo Sapiens
CRKSCYSTE

SEQ ID NO: 942096 - protein, 9 aa, Homo Sapiens
PVKKETNII

SEQ ID NO: 942097 - protein, 9 aa, Homo Sapiens
HNIFCMTES

SEQ ID NO: 942098 - protein, 9 aa, Homo Sapiens
SSERIATQK

SEQ ID NO: 942099 - protein, 9 aa, Homo Sapiens
LFCMYDADQ

SEQ ID NO: 942100 - protein, 9 aa, Homo Sapiens
HRRKDRKQR

SEQ ID NO: 942101 - protein, 9 aa, Homo Sapiens
PLSCPVLLH

SEQ ID NO: 942102 - protein, 9 aa, Homo Sapiens
SNARFSWLL

SEQ ID NO: 942103 - protein, 9 aa, Homo Sapiens
EIMLLSAAT

SEQ ID NO: 942104 - protein, 9 aa, Homo Sapiens
SGIPSGMET

SEQ ID NO: 942105 - protein, 9 aa, Homo Sapiens
LCEKADTRT

SEQ ID NO: 942106 - protein, 9 aa, Homo Sapiens
NVIMHETLQ

SEQ ID NO: 942107 - protein, 9 aa, Homo Sapiens
ASQSSSHQG

SEQ ID NO: 942108 - protein, 9 aa, Homo Sapiens
SSYEDEPCR

SEQ ID NO: 942109 - protein, 9 aa, Homo Sapiens
NVQYVSCIN

SEQ ID NO: 942110 - protein, 9 aa, Homo Sapiens
TLMGATVHE

SEQ ID NO: 942111 - protein, 9 aa, Homo Sapiens
YNHFAVIYY

SEQ ID NO: 942112 - protein, 9 aa, Homo Sapiens
ARLGGQKVA

SEQ ID NO: 942113 - protein, 9 aa, Homo Sapiens
LYEFWYKLA

SEQ ID NO: 942114 - protein, 9 aa, Homo Sapiens
EIEKRYAEE

SEQ ID NO: 942115 - protein, 9 aa, Homo Sapiens
RTDLKGEKR

SEQ ID NO: 942116 - protein, 9 aa, Homo Sapiens
KICKKRSLH

SEQ ID NO: 942117 - protein, 9 aa, Homo Sapiens
IISYFGCMK

SEQ ID NO: 942118 - protein, 9 aa, Homo Sapiens
KKIAYLLTN

SEQ ID NO: 942119 - protein, 9 aa, Homo Sapiens
PPSSLPWMH

SEQ ID NO: 942120 - protein, 9 aa, Homo Sapiens
YVSEEPRAL

SEQ ID NO: 942121 - protein, 9 aa, Homo Sapiens
LALAFRARL

SEQ ID NO: 942122 - protein, 9 aa, Homo Sapiens
GLCINRLRE

SEQ ID NO: 942123 - protein, 9 aa, Homo Sapiens
AVLIIDNGS

SEQ ID NO: 942124 - protein, 9 aa, Homo Sapiens
LMAAFILIG

SEQ ID NO: 942125 - protein, 9 aa, Homo Sapiens
SLSREISVT

SEQ ID NO: 942126 - protein, 9 aa, Homo Sapiens
LKLSGEDDD

SEQ ID NO: 942127 - protein, 9 aa, Homo Sapiens
FVKVEMFSS

SEQ ID NO: 942128 - protein, 9 aa, Homo Sapiens
QRHFELLLR

SEQ ID NO: 942129 - protein, 9 aa, Homo Sapiens
HGEEEQLRK

SEQ ID NO: 942130 - protein, 9 aa, Homo Sapiens
QPCLVRMYM

SEQ ID NO: 942131 - protein, 9 aa, Homo Sapiens
LPKPEEPLK

SEQ ID NO: 942132 - protein, 9 aa, Homo Sapiens
IFDQWTPIA

SEQ ID NO: 942133 - protein, 9 aa, Homo Sapiens
KVAQSPRYK

SEQ ID NO: 942134 - protein, 9 aa, Homo Sapiens
GYYYNSFTC

SEQ ID NO: 942135 - protein, 9 aa, Homo Sapiens
CTCWGRNEC

SEQ ID NO: 942136 - protein, 9 aa, Homo Sapiens
KNVTFGMVV

SEQ ID NO: 942137 - protein, 9 aa, Homo Sapiens
TLHLCSAKK

SEQ ID NO: 942138 - protein, 9 aa, Homo Sapiens
PRGPRRLSG

SEQ ID NO: 942139 - protein, 9 aa, Homo Sapiens
LMNEDSILV

SEQ ID NO: 942140 - protein, 9 aa, Homo Sapiens
DRNKEAIKL

SEQ ID NO: 942141 - protein, 9 aa, Homo Sapiens
VVSLAWDKS

SEQ ID NO: 942142 - protein, 9 aa, Homo Sapiens
YYHHHCINC

SEQ ID NO: 942143 - protein, 9 aa, Homo Sapiens
NHFETASST

SEQ ID NO: 942144 - protein, 9 aa, Homo Sapiens
SLMELPNQY

SEQ ID NO: 942145 - protein, 9 aa, Homo Sapiens
YPVKKETNI

SEQ ID NO: 942146 - protein, 9 aa, Homo Sapiens
FSPKQWLPL

SEQ ID NO: 942147 - protein, 9 aa, Homo Sapiens
PIPPIKLID

SEQ ID NO: 942148 - protein, 9 aa, Homo Sapiens
SCISQPRPV

SEQ ID NO: 942149 - protein, 9 aa, Homo Sapiens
SLGRQPMAQ

SEQ ID NO: 942150 - protein, 9 aa, Homo Sapiens
EEKFSNLPP

SEQ ID NO: 942151 - protein, 9 aa, Homo Sapiens
SRGVFGGLY

SEQ ID NO: 942152 - protein, 9 aa, Homo Sapiens
GVISSFTVF

SEQ ID NO: 942153 - protein, 9 aa, Homo Sapiens
GAELSEAKV

SEQ ID NO: 942154 - protein, 9 aa, Homo Sapiens
RLTYEKRFF

SEQ ID NO: 942155 - protein, 9 aa, Homo Sapiens
TYHQKIYTG

SEQ ID NO: 942156 - protein, 9 aa, Homo Sapiens
IAVLGEHDF

SEQ ID NO: 942157 - protein, 9 aa, Homo Sapiens
ADHKADFRT

SEQ ID NO: 942158 - protein, 9 aa, Homo Sapiens
QKIFQTEMT

SEQ ID NO: 942159 - protein, 9 aa, Homo Sapiens
GTGLEGDAH

SEQ ID NO: 942160 - protein, 9 aa, Homo Sapiens
LLIACLCHN

SEQ ID NO: 942161 - protein, 9 aa, Homo Sapiens
PAIFRINNA

SEQ ID NO: 942162 - protein, 9 aa, Homo Sapiens
EPIPVLPIV

SEQ ID NO: 942163 - protein, 9 aa, Homo Sapiens
FTPGMKPQV

SEQ ID NO: 942164 - protein, 9 aa, Homo Sapiens
VSVSFRLWD

SEQ ID NO: 942165 - protein, 9 aa, Homo Sapiens
KRDLETVIK

SEQ ID NO: 942166 - protein, 9 aa, Homo Sapiens
AFGVQQLYP

SEQ ID NO: 942167 - protein, 9 aa, Homo Sapiens
DVVDGENEL

SEQ ID NO: 942168 - protein, 9 aa, Homo Sapiens
WEKVLQLSS

SEQ ID NO: 942169 - protein, 9 aa, Homo Sapiens
INILLKNLV

SEQ ID NO: 942170 - protein, 9 aa, Homo Sapiens
MRVTLRKSA

SEQ ID NO: 942171 - protein, 9 aa, Homo Sapiens
KKSAEPPLT

SEQ ID NO: 942172 - protein, 9 aa, Homo Sapiens
QLSSCDSSD

SEQ ID NO: 942173 - protein, 9 aa, Homo Sapiens
RPWYSYPVY

SEQ ID NO: 942174 - protein, 9 aa, Homo Sapiens
FQLTTFNFH

SEQ ID NO: 942175 - protein, 9 aa, Homo Sapiens
KFGFRFFQK

SEQ ID NO: 942176 - protein, 9 aa, Homo Sapiens
PALDANEAA

SEQ ID NO: 942177 - protein, 9 aa, Homo Sapiens
SQGHFLLDP

SEQ ID NO: 942178 - protein, 9 aa, Homo Sapiens
ELETVSWKT

SEQ ID NO: 942179 - protein, 9 aa, Homo Sapiens
LVMMSYNRY

SEQ ID NO: 942180 - protein, 9 aa, Homo Sapiens
AYETRYLDD

SEQ ID NO: 942181 - protein, 9 aa, Homo Sapiens
SLDQEYDSK

SEQ ID NO: 942182 - protein, 9 aa, Homo Sapiens
SVLISYFYI

SEQ ID NO: 942183 - protein, 9 aa, Homo Sapiens
VDVSARAKV

SEQ ID NO: 942184 - protein, 9 aa, Homo Sapiens
AKVIIHRQN

SEQ ID NO: 942185 - protein, 9 aa, Homo Sapiens
KDMMEEEAS

SEQ ID NO: 942186 - protein, 9 aa, Homo Sapiens
SASPPASSL

SEQ ID NO: 942187 - protein, 9 aa, Homo Sapiens
EAINYETFT

SEQ ID NO: 942188 - protein, 9 aa, Homo Sapiens
LCSNPKIWN

SEQ ID NO: 942189 - protein, 9 aa, Homo Sapiens
RNMNTINGT

SEQ ID NO: 942190 - protein, 9 aa, Homo Sapiens
ISKIGGKSL

SEQ ID NO: 942191 - protein, 9 aa, Homo Sapiens
NARFSWLLF

SEQ ID NO: 942192 - protein, 9 aa, Homo Sapiens
VGANTTLQM

SEQ ID NO: 942193 - protein, 9 aa, Homo Sapiens
RIWGDSPED

SEQ ID NO: 942194 - protein, 9 aa, Homo Sapiens
QRRTWRDRD

SEQ ID NO: 942195 - protein, 9 aa, Homo Sapiens
LHDGGLNYF

SEQ ID NO: 942196 - protein, 9 aa, Homo Sapiens
QVTYSVTKD

SEQ ID NO: 942197 - protein, 9 aa, Homo Sapiens
KSCYSTEYS

SEQ ID NO: 942198 - protein, 9 aa, Homo Sapiens
TGLSCVSDH

SEQ ID NO: 942199 - protein, 9 aa, Homo Sapiens
DGSDKDNKM

SEQ ID NO: 942200 - protein, 9 aa, Homo Sapiens
SRNHLSTIS

SEQ ID NO: 942201 - protein, 9 aa, Homo Sapiens
QQIGQKVQL

SEQ ID NO: 942202 - protein, 9 aa, Homo Sapiens
SVTRNKTGP

SEQ ID NO: 942203 - protein, 9 aa, Homo Sapiens
GVSASGKSI

SEQ ID NO: 942204 - protein, 9 aa, Homo Sapiens
RALALAAGQ

SEQ ID NO: 942205 - protein, 9 aa, Homo Sapiens
QKVLNVFFA

SEQ ID NO: 942206 - protein, 9 aa, Homo Sapiens
VSCGIPEFP

SEQ ID NO: 942207 - protein, 9 aa, Homo Sapiens
GGCSPLSYR

SEQ ID NO: 942208 - protein, 9 aa, Homo Sapiens
GPDLSNCTL

SEQ ID NO: 942209 - protein, 9 aa, Homo Sapiens
SVSTDPNHT

SEQ ID NO: 942210 - protein, 9 aa, Homo Sapiens
EKLSLSTSI

SEQ ID NO: 942211 - protein, 9 aa, Homo Sapiens
GRKEARTTP

SEQ ID NO: 942212 - protein, 9 aa, Homo Sapiens
FFISLILEN

SEQ ID NO: 942213 - protein, 9 aa, Homo Sapiens
FDDSLEHKK

SEQ ID NO: 942214 - protein, 9 aa, Homo Sapiens
FYGFLSDNF

SEQ ID NO: 942215 - protein, 9 aa, Homo Sapiens
GACLLVIGI

SEQ ID NO: 942216 - protein, 9 aa, Homo Sapiens
KDTLQGAPL

SEQ ID NO: 942217 - protein, 9 aa, Homo Sapiens
RVCFRGESC

SEQ ID NO: 942218 - protein, 9 aa, Homo Sapiens
RPLSPRTPS

SEQ ID NO: 942219 - protein, 9 aa, Homo Sapiens
LNLAYKKIA

SEQ ID NO: 942220 - protein, 9 aa, Homo Sapiens
LLQKKRLSN

SEQ ID NO: 942221 - protein, 9 aa, Homo Sapiens
LGASLGGII

SEQ ID NO: 942222 - protein, 9 aa, Homo Sapiens
SEPKAVFYA

SEQ ID NO: 942223 - protein, 9 aa, Homo Sapiens
ENSTEATDI

SEQ ID NO: 942224 - protein, 9 aa, Homo Sapiens
SKKEEERRI

SEQ ID NO: 942225 - protein, 9 aa, Homo Sapiens
PTKAPKVPK

SEQ ID NO: 942226 - protein, 9 aa, Homo Sapiens
PKKPETPIV

SEQ ID NO: 942227 - protein, 9 aa, Homo Sapiens
TRPWYSYPV

SEQ ID NO: 942228 - protein, 9 aa, Homo Sapiens
SGISVLGCS

SEQ ID NO: 942229 - protein, 9 aa, Homo Sapiens
NKKCIPMDF

SEQ ID NO: 942230 - protein, 9 aa, Homo Sapiens
GSLSPVKSQ

SEQ ID NO: 942231 - protein, 9 aa, Homo Sapiens
QEALREQSN

SEQ ID NO: 942232 - protein, 9 aa, Homo Sapiens
FNCANRTIL

SEQ ID NO: 942233 - protein, 9 aa, Homo Sapiens
YNVTWFKVM

SEQ ID NO: 942234 - protein, 9 aa, Homo Sapiens
KGSAVPPEL

SEQ ID NO: 942235 - protein, 9 aa, Homo Sapiens
FIIIYSISL

SEQ ID NO: 942236 - protein, 9 aa, Homo Sapiens
ALAALHEPP

SEQ ID NO: 942237 - protein, 9 aa, Homo Sapiens
GTPWRDYIS

SEQ ID NO: 942238 - protein, 9 aa, Homo Sapiens
RFLTNAYSS

SEQ ID NO: 942239 - protein, 9 aa, Homo Sapiens
LANPPDIEF

SEQ ID NO: 942240 - protein, 9 aa, Homo Sapiens
KESAVIARN

SEQ ID NO: 942241 - protein, 9 aa, Homo Sapiens
QSLEDESKF

SEQ ID NO: 942242 - protein, 9 aa, Homo Sapiens
CPFLCFSDS

SEQ ID NO: 942243 - protein, 9 aa, Homo Sapiens
DPSSFQTID

SEQ ID NO: 942244 - protein, 9 aa, Homo Sapiens
SAVLGSNVS

SEQ ID NO: 942245 - protein, 9 aa, Homo Sapiens
EEFLFPVPP

SEQ ID NO: 942246 - protein, 9 aa, Homo Sapiens
AVLVVLKRL

SEQ ID NO: 942247 - protein, 9 aa, Homo Sapiens
ITKEIKDEK

SEQ ID NO: 942248 - protein, 9 aa, Homo Sapiens
IGFLRQVLE

SEQ ID NO: 942249 - protein, 9 aa, Homo Sapiens
CSFPGINGF

SEQ ID NO: 942250 - protein, 9 aa, Homo Sapiens
EKNDVVFFM

SEQ ID NO: 942251 - protein, 9 aa, Homo Sapiens
KPVFADTNI

SEQ ID NO: 942252 - protein, 9 aa, Homo Sapiens
FGVWLGELD

SEQ ID NO: 942253 - protein, 9 aa, Homo Sapiens
FHGKEFLLG

SEQ ID NO: 942254 - protein, 9 aa, Homo Sapiens
GAFSPKQWL

SEQ ID NO: 942255 - protein, 9 aa, Homo Sapiens
EILDKWQYI

SEQ ID NO: 942256 - protein, 9 aa, Homo Sapiens
LPSSGKSSL

SEQ ID NO: 942257 - protein, 9 aa, Homo Sapiens
VKRNIPLML

SEQ ID NO: 942258 - protein, 9 aa, Homo Sapiens
ETVRLGVSK

SEQ ID NO: 942259 - protein, 9 aa, Homo Sapiens
CQSWIINNL

SEQ ID NO: 942260 - protein, 9 aa, Homo Sapiens
NPSSTLCPL

SEQ ID NO: 942261 - protein, 9 aa, Homo Sapiens
GLFGKYIDR

SEQ ID NO: 942262 - protein, 9 aa, Homo Sapiens
PSPTPCPPS

SEQ ID NO: 942263 - protein, 9 aa, Homo Sapiens
DGAGIQKAV

SEQ ID NO: 942264 - protein, 9 aa, Homo Sapiens
RQRHKEEEE

SEQ ID NO: 942265 - protein, 9 aa, Homo Sapiens
HYELYCEMG

SEQ ID NO: 942266 - protein, 9 aa, Homo Sapiens
QIHQQLYDC

SEQ ID NO: 942267 - protein, 9 aa, Homo Sapiens
QLGAQKCDN

SEQ ID NO: 942268 - protein, 9 aa, Homo Sapiens
KECETAGLK

SEQ ID NO: 942269 - protein, 9 aa, Homo Sapiens
IDTDIQNLS

SEQ ID NO: 942270 - protein, 9 aa, Homo Sapiens
RAVLKFATA

SEQ ID NO: 942271 - protein, 9 aa, Homo Sapiens
APLSCNHIK

SEQ ID NO: 942272 - protein, 9 aa, Homo Sapiens
NDTILWIIA

SEQ ID NO: 942273 - protein, 9 aa, Homo Sapiens
DYKRDLETV

SEQ ID NO: 942274 - protein, 9 aa, Homo Sapiens
GGNLSARHQ

SEQ ID NO: 942275 - protein, 9 aa, Homo Sapiens
ARSTEDSFT

SEQ ID NO: 942276 - protein, 9 aa, Homo Sapiens
YGNPRKLLT

SEQ ID NO: 942277 - protein, 9 aa, Homo Sapiens
SWEQAISND

SEQ ID NO: 942278 - protein, 9 aa, Homo Sapiens
PDPTVGFIP

SEQ ID NO: 942279 - protein, 9 aa, Homo Sapiens
QSWIINNLM

SEQ ID NO: 942280 - protein, 9 aa, Homo Sapiens
PGGPNATFN

SEQ ID NO: 942281 - protein, 9 aa, Homo Sapiens
EAELETVSW

SEQ ID NO: 942282 - protein, 9 aa, Homo Sapiens
LRLQEFFLS

SEQ ID NO: 942283 - protein, 9 aa, Homo Sapiens
ALISDLKTD

SEQ ID NO: 942284 - protein, 9 aa, Homo Sapiens
LPKGPLVFV

SEQ ID NO: 942285 - protein, 9 aa, Homo Sapiens
VVLSEASEP

SEQ ID NO: 942286 - protein, 9 aa, Homo Sapiens
NADNGHLFV

SEQ ID NO: 942287 - protein, 9 aa, Homo Sapiens
PVCFDFCCI

SEQ ID NO: 942288 - protein, 9 aa, Homo Sapiens
KEANFQRES

SEQ ID NO: 942289 - protein, 9 aa, Homo Sapiens
FCDQFLEQV

SEQ ID NO: 942290 - protein, 9 aa, Homo Sapiens
VKNLMLSVL

SEQ ID NO: 942291 - protein, 9 aa, Homo Sapiens
LMFCNHKTF

SEQ ID NO: 942292 - protein, 9 aa, Homo Sapiens
KPGSPRSAY

SEQ ID NO: 942293 - protein, 9 aa, Homo Sapiens
LGGSFASVL

SEQ ID NO: 942294 - protein, 9 aa, Homo Sapiens
MSPLRLLEH

SEQ ID NO: 942295 - protein, 9 aa, Homo Sapiens
DMRCKENES

SEQ ID NO: 942296 - protein, 9 aa, Homo Sapiens
ALGNLFSIS

SEQ ID NO: 942297 - protein, 9 aa, Homo Sapiens
LCSVLGLRK

SEQ ID NO: 942298 - protein, 9 aa, Homo Sapiens
PNQYNYGMY

SEQ ID NO: 942299 - protein, 9 aa, Homo Sapiens
NSNYCRSKG

SEQ ID NO: 942300 - protein, 9 aa, Homo Sapiens
SIFQGYIDS

SEQ ID NO: 942301 - protein, 9 aa, Homo Sapiens
RTYVDVVDG

SEQ ID NO: 942302 - protein, 9 aa, Homo Sapiens
GKPRAYFMS

SEQ ID NO: 942303 - protein, 9 aa, Homo Sapiens
YLYLQVLGE

SEQ ID NO: 942304 - protein, 9 aa, Homo Sapiens
IIIESTKEG

SEQ ID NO: 942305 - protein, 9 aa, Homo Sapiens
NICYDPRKF

SEQ ID NO: 942306 - protein, 9 aa, Homo Sapiens
KLKNCTKIF

SEQ ID NO: 942307 - protein, 9 aa, Homo Sapiens
TEGGGSGGG

SEQ ID NO: 942308 - protein, 9 aa, Homo Sapiens
LIACLCHNL

SEQ ID NO: 942309 - protein, 9 aa, Homo Sapiens
NPENNFHDK

SEQ ID NO: 942310 - protein, 9 aa, Homo Sapiens
GQANKIVLL

SEQ ID NO: 942311 - protein, 9 aa, Homo Sapiens
ATDKYQWLQ

SEQ ID NO: 942312 - protein, 9 aa, Homo Sapiens
YKAFSTCAF

SEQ ID NO: 942313 - protein, 9 aa, Homo Sapiens
SFLAMRSLK

SEQ ID NO: 942314 - protein, 9 aa, Homo Sapiens
APKKITVED

SEQ ID NO: 942315 - protein, 9 aa, Homo Sapiens
LQSQKAMQT

SEQ ID NO: 942316 - protein, 9 aa, Homo Sapiens
RGLRGSQAP

SEQ ID NO: 942317 - protein, 9 aa, Homo Sapiens
FSFWRQKMF

SEQ ID NO: 942318 - protein, 9 aa, Homo Sapiens
PDSILGVTE

SEQ ID NO: 942319 - protein, 9 aa, Homo Sapiens
NQGCQLSGS

SEQ ID NO: 942320 - protein, 9 aa, Homo Sapiens
SSPCPSFLP

SEQ ID NO: 942321 - protein, 9 aa, Homo Sapiens
EFLLLSLPI

SEQ ID NO: 942322 - protein, 9 aa, Homo Sapiens
HGIYDGLTV

SEQ ID NO: 942323 - protein, 9 aa, Homo Sapiens
RNHLSTISW

SEQ ID NO: 942324 - protein, 9 aa, Homo Sapiens
EIRCSSCCL

SEQ ID NO: 942325 - protein, 9 aa, Homo Sapiens
WTRNVDAFL

SEQ ID NO: 942326 - protein, 9 aa, Homo Sapiens
KHLNAIPIL

SEQ ID NO: 942327 - protein, 9 aa, Homo Sapiens
TPVQQPGPR

SEQ ID NO: 942328 - protein, 9 aa, Homo Sapiens
LETKDTLLA

SEQ ID NO: 942329 - protein, 9 aa, Homo Sapiens
LHIDTQAGW

SEQ ID NO: 942330 - protein, 9 aa, Homo Sapiens
VEGEGSVRS

SEQ ID NO: 942331 - protein, 9 aa, Homo Sapiens
YLSSKDSRP

SEQ ID NO: 942332 - protein, 9 aa, Homo Sapiens
GNKWVSVLA

SEQ ID NO: 942333 - protein, 9 aa, Homo Sapiens
CHLLNNGLN

SEQ ID NO: 942334 - protein, 9 aa, Homo Sapiens
FLLIPLSYA

SEQ ID NO: 942335 - protein, 9 aa, Homo Sapiens
QKLTVNNED

SEQ ID NO: 942336 - protein, 9 aa, Homo Sapiens
HKHKASLSR

SEQ ID NO: 942337 - protein, 9 aa, Homo Sapiens
RPTSILWDG

SEQ ID NO: 942338 - protein, 9 aa, Homo Sapiens
MFSTTSFLN

SEQ ID NO: 942339 - protein, 9 aa, Homo Sapiens
QDDQSSSLG

SEQ ID NO: 942340 - protein, 9 aa, Homo Sapiens
RLPPSRRRR

SEQ ID NO: 942341 - protein, 9 aa, Homo Sapiens
HSGSVLCSV

SEQ ID NO: 942342 - protein, 9 aa, Homo Sapiens
HAEPLESRV

SEQ ID NO: 942343 - protein, 9 aa, Homo Sapiens
PKCQLRAQK

SEQ ID NO: 942344 - protein, 9 aa, Homo Sapiens
GPLGEAGVG

SEQ ID NO: 942345 - protein, 9 aa, Homo Sapiens
DSSLASRDT

SEQ ID NO: 942346 - protein, 9 aa, Homo Sapiens
GLKDVAKER

SEQ ID NO: 942347 - protein, 9 aa, Homo Sapiens
QEIKRLSPE

SEQ ID NO: 942348 - protein, 9 aa, Homo Sapiens
RVLFHHSVR

SEQ ID NO: 942349 - protein, 9 aa, Homo Sapiens
VLCSVLGLR

SEQ ID NO: 942350 - protein, 9 aa, Homo Sapiens
TMTKKIKEA

SEQ ID NO: 942351 - protein, 9 aa, Homo Sapiens
KTSYLSIIM

SEQ ID NO: 942352 - protein, 9 aa, Homo Sapiens
SSSSDNQGS

SEQ ID NO: 942353 - protein, 9 aa, Homo Sapiens
SNSATLATT

SEQ ID NO: 942354 - protein, 9 aa, Homo Sapiens
LAEEAEISH

SEQ ID NO: 942355 - protein, 9 aa, Homo Sapiens
PPARDSRRL

SEQ ID NO: 942356 - protein, 9 aa, Homo Sapiens
DEVSVSFRL

SEQ ID NO: 942357 - protein, 9 aa, Homo Sapiens
WARIWEFVP

SEQ ID NO: 942358 - protein, 9 aa, Homo Sapiens
THPYVYEIL

SEQ ID NO: 942359 - protein, 9 aa, Homo Sapiens
TYKDLFCSK

SEQ ID NO: 942360 - protein, 9 aa, Homo Sapiens
ENRALKKGH

SEQ ID NO: 942361 - protein, 9 aa, Homo Sapiens
EINEKLRSQ

SEQ ID NO: 942362 - protein, 9 aa, Homo Sapiens
SIKEGFPSK

SEQ ID NO: 942363 - protein, 9 aa, Homo Sapiens
SWKLQELSK

SEQ ID NO: 942364 - protein, 9 aa, Homo Sapiens
LEKARDIAR

SEQ ID NO: 942365 - protein, 9 aa, Homo Sapiens
KSAMNTIDL

SEQ ID NO: 942366 - protein, 9 aa, Homo Sapiens
WPAKALKSV

SEQ ID NO: 942367 - protein, 9 aa, Homo Sapiens
LLTAGGKLY

SEQ ID NO: 942368 - protein, 9 aa, Homo Sapiens
YSICRLIKA

SEQ ID NO: 942369 - protein, 9 aa, Homo Sapiens
LGVRGSCIS

SEQ ID NO: 942370 - protein, 9 aa, Homo Sapiens
KAKSTVCDI

SEQ ID NO: 942371 - protein, 9 aa, Homo Sapiens
ELIFAVPTT

SEQ ID NO: 942372 - protein, 9 aa, Homo Sapiens
LHGAWPLGT

SEQ ID NO: 942373 - protein, 9 aa, Homo Sapiens
SFRHVKEGS

SEQ ID NO: 942374 - protein, 9 aa, Homo Sapiens
LKDGILFGI

SEQ ID NO: 942375 - protein, 9 aa, Homo Sapiens
FQSMFSTVT

SEQ ID NO: 942376 - protein, 9 aa, Homo Sapiens
IPSDLKENS

SEQ ID NO: 942377 - protein, 9 aa, Homo Sapiens
EATRLPTQE

SEQ ID NO: 942378 - protein, 9 aa, Homo Sapiens
NLFSISAYV

SEQ ID NO: 942379 - protein, 9 aa, Homo Sapiens
SSDGAGIQK

SEQ ID NO: 942380 - protein, 9 aa, Homo Sapiens
GLVLKEPRR

SEQ ID NO: 942381 - protein, 9 aa, Homo Sapiens
GGFTTLQPG

SEQ ID NO: 942382 - protein, 9 aa, Homo Sapiens
AANRRPTRK

SEQ ID NO: 942383 - protein, 9 aa, Homo Sapiens
GTLSQGHFL

SEQ ID NO: 942384 - protein, 9 aa, Homo Sapiens
TRKYLLSSK

SEQ ID NO: 942385 - protein, 9 aa, Homo Sapiens
SWTSGEGVH

SEQ ID NO: 942386 - protein, 9 aa, Homo Sapiens
IVPYSPYKV

SEQ ID NO: 942387 - protein, 9 aa, Homo Sapiens
REGRTLIFS

SEQ ID NO: 942388 - protein, 9 aa, Homo Sapiens
KLYTNREGA

SEQ ID NO: 942389 - protein, 9 aa, Homo Sapiens
VHIRQEIEI

SEQ ID NO: 942390 - protein, 9 aa, Homo Sapiens
APGTGLEGD

SEQ ID NO: 942391 - protein, 9 aa, Homo Sapiens
LVLSGDPGP

SEQ ID NO: 942392 - protein, 9 aa, Homo Sapiens
DDTAVLIID

SEQ ID NO: 942393 - protein, 9 aa, Homo Sapiens
PQNNTLYIA

SEQ ID NO: 942394 - protein, 9 aa, Homo Sapiens
CEENSVSYQ

SEQ ID NO: 942395 - protein, 9 aa, Homo Sapiens
TIYFHCDND

SEQ ID NO: 942396 - protein, 9 aa, Homo Sapiens
QEKDNERVF

SEQ ID NO: 942397 - protein, 9 aa, Homo Sapiens
ESIIKERIF

SEQ ID NO: 942398 - protein, 9 aa, Homo Sapiens
PSTGNSASV

SEQ ID NO: 942399 - protein, 9 aa, Homo Sapiens
HRLCTSRHL

SEQ ID NO: 942400 - protein, 9 aa, Homo Sapiens
PPGARGSPG

SEQ ID NO: 942401 - protein, 9 aa, Homo Sapiens
INPEYVPKP

SEQ ID NO: 942402 - protein, 9 aa, Homo Sapiens
REKVEKLNM

SEQ ID NO: 942403 - protein, 9 aa, Homo Sapiens
CMNLRANLK

SEQ ID NO: 942404 - protein, 9 aa, Homo Sapiens
VCFPNLIFS

SEQ ID NO: 942405 - protein, 9 aa, Homo Sapiens
DESPNAIVY

SEQ ID NO: 942406 - protein, 9 aa, Homo Sapiens
PSFAHCISH

SEQ ID NO: 942407 - protein, 9 aa, Homo Sapiens
PGTFILYLH

SEQ ID NO: 942408 - protein, 9 aa, Homo Sapiens
KEISDLTEQ

SEQ ID NO: 942409 - protein, 9 aa, Homo Sapiens
DLSAGLMAP

SEQ ID NO: 942410 - protein, 9 aa, Homo Sapiens
KSISNAASS

SEQ ID NO: 942411 - protein, 9 aa, Homo Sapiens
AVFSVMTRQ

SEQ ID NO: 942412 - protein, 9 aa, Homo Sapiens
SQSLIFQAN

SEQ ID NO: 942413 - protein, 9 aa, Homo Sapiens
DLGVPSDPG

SEQ ID NO: 942414 - protein, 9 aa, Homo Sapiens
TKEGTTEYG

SEQ ID NO: 942415 - protein, 9 aa, Homo Sapiens
LSALGNDTI

SEQ ID NO: 942416 - protein, 9 aa, Homo Sapiens
WPLGTGERW

SEQ ID NO: 942417 - protein, 9 aa, Homo Sapiens
LLNLAYKKI

SEQ ID NO: 942418 - protein, 9 aa, Homo Sapiens
LRRRQAFRG

SEQ ID NO: 942419 - protein, 9 aa, Homo Sapiens
FRRDSKEKN

SEQ ID NO: 942420 - protein, 9 aa, Homo Sapiens
FPQPCLVRM

SEQ ID NO: 942421 - protein, 9 aa, Homo Sapiens
RSMKSGPKL

SEQ ID NO: 942422 - protein, 9 aa, Homo Sapiens
PRALALAAG

SEQ ID NO: 942423 - protein, 9 aa, Homo Sapiens
IIITTPNKL

SEQ ID NO: 942424 - protein, 9 aa, Homo Sapiens
RRFDSARGM

SEQ ID NO: 942425 - protein, 9 aa, Homo Sapiens
VRNPGDRKC

SEQ ID NO: 942426 - protein, 9 aa, Homo Sapiens
DKTLESILY

SEQ ID NO: 942427 - protein, 9 aa, Homo Sapiens
TGLVMGTEW

SEQ ID NO: 942428 - protein, 9 aa, Homo Sapiens
LCSAKKSAE

SEQ ID NO: 942429 - protein, 9 aa, Homo Sapiens
HPKFRHNCK

SEQ ID NO: 942430 - protein, 9 aa, Homo Sapiens
RSSPGDSSS

SEQ ID NO: 942431 - protein, 9 aa, Homo Sapiens
IRAAVRNEK

SEQ ID NO: 942432 - protein, 9 aa, Homo Sapiens
SEDQNTLIE

SEQ ID NO: 942433 - protein, 9 aa, Homo Sapiens
GFGINKIGG

SEQ ID NO: 942434 - protein, 9 aa, Homo Sapiens
MRTLESQLF

SEQ ID NO: 942435 - protein, 9 aa, Homo Sapiens
NRNPLARKE

SEQ ID NO: 942436 - protein, 9 aa, Homo Sapiens
PMEEELPGE

SEQ ID NO: 942437 - protein, 9 aa, Homo Sapiens
DATGGPPAG

SEQ ID NO: 942438 - protein, 9 aa, Homo Sapiens
LRGSQAPLI

SEQ ID NO: 942439 - protein, 9 aa, Homo Sapiens
VVIILLRAM

SEQ ID NO: 942440 - protein, 9 aa, Homo Sapiens
GEILFYNVT

SEQ ID NO: 942441 - protein, 9 aa, Homo Sapiens
TLIFSTHHL

SEQ ID NO: 942442 - protein, 9 aa, Homo Sapiens
ADGELESIG

SEQ ID NO: 942443 - protein, 9 aa, Homo Sapiens
WNGWKEFLM

SEQ ID NO: 942444 - protein, 9 aa, Homo Sapiens
HHRCHRRKD

SEQ ID NO: 942445 - protein, 9 aa, Homo Sapiens
TLSFFVKVE

SEQ ID NO: 942446 - protein, 9 aa, Homo Sapiens
FKWWPASQQ

SEQ ID NO: 942447 - protein, 9 aa, Homo Sapiens
SCTSVPLWM

SEQ ID NO: 942448 - protein, 9 aa, Homo Sapiens
IFQGNPDLI

SEQ ID NO: 942449 - protein, 9 aa, Homo Sapiens
TLLNQPAFS

SEQ ID NO: 942450 - protein, 9 aa, Homo Sapiens
HLAIVDIFY

SEQ ID NO: 942451 - protein, 9 aa, Homo Sapiens
FRHNCKFYI

SEQ ID NO: 942452 - protein, 9 aa, Homo Sapiens
VRGSFWREA

SEQ ID NO: 942453 - protein, 9 aa, Homo Sapiens
FDVFFRHSK

SEQ ID NO: 942454 - protein, 9 aa, Homo Sapiens
TTLSYALLL

SEQ ID NO: 942455 - protein, 9 aa, Homo Sapiens
PPRIDTAPV

SEQ ID NO: 942456 - protein, 9 aa, Homo Sapiens
TCSSREHVL

SEQ ID NO: 942457 - protein, 9 aa, Homo Sapiens
DVVFFMDQT

SEQ ID NO: 942458 - protein, 9 aa, Homo Sapiens
LGPPGFPGI

SEQ ID NO: 942459 - protein, 9 aa, Homo Sapiens
KRTSLSREI

SEQ ID NO: 942460 - protein, 9 aa, Homo Sapiens
CRINALSHS

SEQ ID NO: 942461 - protein, 9 aa, Homo Sapiens
NEETLSQDE

SEQ ID NO: 942462 - protein, 9 aa, Homo Sapiens
EELKKLRTA

SEQ ID NO: 942463 - protein, 9 aa, Homo Sapiens
QLVSKWQAY

SEQ ID NO: 942464 - protein, 9 aa, Homo Sapiens
YRNRDRYFK

SEQ ID NO: 942465 - protein, 9 aa, Homo Sapiens
SKRHKSSRQ

SEQ ID NO: 942466 - protein, 9 aa, Homo Sapiens
NFMALCASN

SEQ ID NO: 942467 - protein, 9 aa, Homo Sapiens
DTLMNLVQE

SEQ ID NO: 942468 - protein, 9 aa, Homo Sapiens
QTRNKKQSG

SEQ ID NO: 942469 - protein, 9 aa, Homo Sapiens
DGGSPLRTG

SEQ ID NO: 942470 - protein, 9 aa, Homo Sapiens
DDPYPEVLN

SEQ ID NO: 942471 - protein, 9 aa, Homo Sapiens
LSGFYQKID

SEQ ID NO: 942472 - protein, 9 aa, Homo Sapiens
SSSAVSPNL

SEQ ID NO: 942473 - protein, 9 aa, Homo Sapiens
LRNPCFHPG

SEQ ID NO: 942474 - protein, 9 aa, Homo Sapiens
QQQAFALSI

SEQ ID NO: 942475 - protein, 9 aa, Homo Sapiens
ITTDQLLRQ

SEQ ID NO: 942476 - protein, 9 aa, Homo Sapiens
YGCGVKNSP

SEQ ID NO: 942477 - protein, 9 aa, Homo Sapiens
YSMKYFKNF

SEQ ID NO: 942478 - protein, 9 aa, Homo Sapiens
LKNLSINNN

SEQ ID NO: 942479 - protein, 9 aa, Homo Sapiens
SPYGGGTMV

SEQ ID NO: 942480 - protein, 9 aa, Homo Sapiens
KADSSHFEL

SEQ ID NO: 942481 - protein, 9 aa, Homo Sapiens
INKNNIQLK

SEQ ID NO: 942482 - protein, 9 aa, Homo Sapiens
SVLLSVLPS

SEQ ID NO: 942483 - protein, 9 aa, Homo Sapiens
LSPRTPSGD

SEQ ID NO: 942484 - protein, 9 aa, Homo Sapiens
ESLWQKVIS

SEQ ID NO: 942485 - protein, 9 aa, Homo Sapiens
RAQEVMRRH

SEQ ID NO: 942486 - protein, 9 aa, Homo Sapiens
LSFLAMRSL

SEQ ID NO: 942487 - protein, 9 aa, Homo Sapiens
QPRFEAPDG

SEQ ID NO: 942488 - protein, 9 aa, Homo Sapiens
KYKYKECKD

SEQ ID NO: 942489 - protein, 9 aa, Homo Sapiens
HLAKTLQKI

SEQ ID NO: 942490 - protein, 9 aa, Homo Sapiens
LEHKKLTVD

SEQ ID NO: 942491 - protein, 9 aa, Homo Sapiens
FIVLNKSKT

SEQ ID NO: 942492 - protein, 9 aa, Homo Sapiens
TTNNRLLHF

SEQ ID NO: 942493 - protein, 9 aa, Homo Sapiens
SASPGGCSP

SEQ ID NO: 942494 - protein, 9 aa, Homo Sapiens
LVIGIWVMV

SEQ ID NO: 942495 - protein, 9 aa, Homo Sapiens
QQTGRFCGG

SEQ ID NO: 942496 - protein, 9 aa, Homo Sapiens
TAGDHKKKF

SEQ ID NO: 942497 - protein, 9 aa, Homo Sapiens
VEMFSSGEL

SEQ ID NO: 942498 - protein, 9 aa, Homo Sapiens
DSISPEPKS

SEQ ID NO: 942499 - protein, 9 aa, Homo Sapiens
LQEFFLSKS

SEQ ID NO: 942500 - protein, 9 aa, Homo Sapiens
SISLGRQPM

SEQ ID NO: 942501 - protein, 9 aa, Homo Sapiens
GSRRKPRLT

SEQ ID NO: 942502 - protein, 9 aa, Homo Sapiens
LYENSLLLT

SEQ ID NO: 942503 - protein, 9 aa, Homo Sapiens
KSLYFNGPE

SEQ ID NO: 942504 - protein, 9 aa, Homo Sapiens
KTLQKIFQT

SEQ ID NO: 942505 - protein, 9 aa, Homo Sapiens
ILIDFIYKV

SEQ ID NO: 942506 - protein, 9 aa, Homo Sapiens
RGKDQPRRL

SEQ ID NO: 942507 - protein, 9 aa, Homo Sapiens
EDDDNFETN

SEQ ID NO: 942508 - protein, 9 aa, Homo Sapiens
LYLCVGNKW

SEQ ID NO: 942509 - protein, 9 aa, Homo Sapiens
KFNDKYNLV

SEQ ID NO: 942510 - protein, 9 aa, Homo Sapiens
SPTRANTTT

SEQ ID NO: 942511 - protein, 9 aa, Homo Sapiens
SRITTLSSM

SEQ ID NO: 942512 - protein, 9 aa, Homo Sapiens
KDRDSKEIE

SEQ ID NO: 942513 - protein, 9 aa, Homo Sapiens
LLSERFLVN

SEQ ID NO: 942514 - protein, 9 aa, Homo Sapiens
DPDKQDALI

SEQ ID NO: 942515 - protein, 9 aa, Homo Sapiens
ASITDSETT

SEQ ID NO: 942516 - protein, 9 aa, Homo Sapiens
HFFTGAFLF

SEQ ID NO: 942517 - protein, 9 aa, Homo Sapiens
IEILLGSLA

SEQ ID NO: 942518 - protein, 9 aa, Homo Sapiens
ERYYKESKD

SEQ ID NO: 942519 - protein, 9 aa, Homo Sapiens
DHHERCNCI

SEQ ID NO: 942520 - protein, 9 aa, Homo Sapiens
IYDGLTVHL

SEQ ID NO: 942521 - protein, 9 aa, Homo Sapiens
FPHSSRRCS

SEQ ID NO: 942522 - protein, 9 aa, Homo Sapiens
EARPSSYKW

SEQ ID NO: 942523 - protein, 9 aa, Homo Sapiens
LLGSLADPA

SEQ ID NO: 942524 - protein, 9 aa, Homo Sapiens
EQEIFLEIV

SEQ ID NO: 942525 - protein, 9 aa, Homo Sapiens
FVLCQTQFS

SEQ ID NO: 942526 - protein, 9 aa, Homo Sapiens
LKNLVPKTD

SEQ ID NO: 942527 - protein, 9 aa, Homo Sapiens
GSFASVLSS

SEQ ID NO: 942528 - protein, 9 aa, Homo Sapiens
TRHSFFRRH

SEQ ID NO: 942529 - protein, 9 aa, Homo Sapiens
SEQPGLPLH

SEQ ID NO: 942530 - protein, 9 aa, Homo Sapiens
RFEDYEGLP

SEQ ID NO: 942531 - protein, 9 aa, Homo Sapiens
VLFHHSVRG

SEQ ID NO: 942532 - protein, 9 aa, Homo Sapiens
FYFLSKLVL

SEQ ID NO: 942533 - protein, 9 aa, Homo Sapiens
GKTVLAVFS

SEQ ID NO: 942534 - protein, 9 aa, Homo Sapiens
NKGNSKQYK

SEQ ID NO: 942535 - protein, 9 aa, Homo Sapiens
FKNQPSLLN

SEQ ID NO: 942536 - protein, 9 aa, Homo Sapiens
GFTTLQPGS

SEQ ID NO: 942537 - protein, 9 aa, Homo Sapiens
GKKKCVHYW

SEQ ID NO: 942538 - protein, 9 aa, Homo Sapiens
TDVFSEPKA

SEQ ID NO: 942539 - protein, 9 aa, Homo Sapiens
EKKEEREPA

SEQ ID NO: 942540 - protein, 9 aa, Homo Sapiens
GNPEKVFKS

SEQ ID NO: 942541 - protein, 9 aa, Homo Sapiens
NCTLHWVNQ

SEQ ID NO: 942542 - protein, 9 aa, Homo Sapiens
VMRTLESQL

SEQ ID NO: 942543 - protein, 9 aa, Homo Sapiens
STNYQEKKF

SEQ ID NO: 942544 - protein, 9 aa, Homo Sapiens
AGFANQGDV

SEQ ID NO: 942545 - protein, 9 aa, Homo Sapiens
LSENTLTIH

SEQ ID NO: 942546 - protein, 9 aa, Homo Sapiens
PSSKRDKRS

SEQ ID NO: 942547 - protein, 9 aa, Homo Sapiens
CYDTQLSLH

SEQ ID NO: 942548 - protein, 9 aa, Homo Sapiens
LCQTQFSII

SEQ ID NO: 942549 - protein, 9 aa, Homo Sapiens
FRRSRPCTW

SEQ ID NO: 942550 - protein, 9 aa, Homo Sapiens
PIPENSGKT

SEQ ID NO: 942551 - protein, 9 aa, Homo Sapiens
GRGKDQPRR

SEQ ID NO: 942552 - protein, 9 aa, Homo Sapiens
YLLAFKAYL

SEQ ID NO: 942553 - protein, 9 aa, Homo Sapiens
LLKGGKRKE

SEQ ID NO: 942554 - protein, 9 aa, Homo Sapiens
KAAYIDILE

SEQ ID NO: 942555 - protein, 9 aa, Homo Sapiens
TAWGGNYWR

SEQ ID NO: 942556 - protein, 9 aa, Homo Sapiens
NKSTDKKER

SEQ ID NO: 942557 - protein, 9 aa, Homo Sapiens
HEYTRQPAF

SEQ ID NO: 942558 - protein, 9 aa, Homo Sapiens
SLLDTNSCK

SEQ ID NO: 942559 - protein, 9 aa, Homo Sapiens
WINDTIKKH

SEQ ID NO: 942560 - protein, 9 aa, Homo Sapiens
EQLLREQKG

SEQ ID NO: 942561 - protein, 9 aa, Homo Sapiens
SPPLEIKFL

SEQ ID NO: 942562 - protein, 9 aa, Homo Sapiens
NLFTGHRFS

SEQ ID NO: 942563 - protein, 9 aa, Homo Sapiens
LSATFQRHP

SEQ ID NO: 942564 - protein, 9 aa, Homo Sapiens
INRLREMVE

SEQ ID NO: 942565 - protein, 9 aa, Homo Sapiens
MTPQGQLLI

SEQ ID NO: 942566 - protein, 9 aa, Homo Sapiens
QTGRFCGGL

SEQ ID NO: 942567 - protein, 9 aa, Homo Sapiens
ELIVSGAHR

SEQ ID NO: 942568 - protein, 9 aa, Homo Sapiens
LRQVADWKA

SEQ ID NO: 942569 - protein, 9 aa, Homo Sapiens
PLDSEENTK

SEQ ID NO: 942570 - protein, 9 aa, Homo Sapiens
SVNIEERGD

SEQ ID NO: 942571 - protein, 9 aa, Homo Sapiens
DLKGEKRDK

SEQ ID NO: 942572 - protein, 9 aa, Homo Sapiens
GCLFAPKVY

SEQ ID NO: 942573 - protein, 9 aa, Homo Sapiens
GVLGGAFLI

SEQ ID NO: 942574 - protein, 9 aa, Homo Sapiens
KRTLLVRLV

SEQ ID NO: 942575 - protein, 9 aa, Homo Sapiens
RTLIFSTHH

SEQ ID NO: 942576 - protein, 9 aa, Homo Sapiens
CQGHCEEFC

SEQ ID NO: 942577 - protein, 9 aa, Homo Sapiens
FILGTTLKD

SEQ ID NO: 942578 - protein, 9 aa, Homo Sapiens
PEGSESESS

SEQ ID NO: 942579 - protein, 9 aa, Homo Sapiens
NSYTWELFP

SEQ ID NO: 942580 - protein, 9 aa, Homo Sapiens
IVDIFYASN

SEQ ID NO: 942581 - protein, 9 aa, Homo Sapiens
CSKCVHRNK

SEQ ID NO: 942582 - protein, 9 aa, Homo Sapiens
LEKKGRFSS

SEQ ID NO: 942583 - protein, 9 aa, Homo Sapiens
PKNRTRKDG

SEQ ID NO: 942584 - protein, 9 aa, Homo Sapiens
TILFLTMII

SEQ ID NO: 942585 - protein, 9 aa, Homo Sapiens
ENNLKPAEA

SEQ ID NO: 942586 - protein, 9 aa, Homo Sapiens
SCANPIFYG

SEQ ID NO: 942587 - protein, 9 aa, Homo Sapiens
ALETVIRGP

SEQ ID NO: 942588 - protein, 9 aa, Homo Sapiens
KVATSKLVQ

SEQ ID NO: 942589 - protein, 9 aa, Homo Sapiens
CSLETFSLD

SEQ ID NO: 942590 - protein, 9 aa, Homo Sapiens
NRFKWWPAS

SEQ ID NO: 942591 - protein, 9 aa, Homo Sapiens
VYDLDHNVK

SEQ ID NO: 942592 - protein, 9 aa, Homo Sapiens
CKSCACNSL

SEQ ID NO: 942593 - protein, 9 aa, Homo Sapiens
PSFGTLYSF

SEQ ID NO: 942594 - protein, 9 aa, Homo Sapiens
KKNPVTAVL

SEQ ID NO: 942595 - protein, 9 aa, Homo Sapiens
YPSSLMLQP

SEQ ID NO: 942596 - protein, 9 aa, Homo Sapiens
DLQMNQALQ

SEQ ID NO: 942597 - protein, 9 aa, Homo Sapiens
EEPLGPMEE

SEQ ID NO: 942598 - protein, 9 aa, Homo Sapiens
DNSSQATGK

SEQ ID NO: 942599 - protein, 9 aa, Homo Sapiens
ITATTKFVS

SEQ ID NO: 942600 - protein, 9 aa, Homo Sapiens
CGQPKVGAS

SEQ ID NO: 942601 - protein, 9 aa, Homo Sapiens
GLDSTAMTS

SEQ ID NO: 942602 - protein, 9 aa, Homo Sapiens
LQPAQQPSY

SEQ ID NO: 942603 - protein, 9 aa, Homo Sapiens
RALQVSSPT

SEQ ID NO: 942604 - protein, 9 aa, Homo Sapiens
PIFSWFSAA

SEQ ID NO: 942605 - protein, 9 aa, Homo Sapiens
TIFPSCICH

SEQ ID NO: 942606 - protein, 9 aa, Homo Sapiens
KEEKFSDSS

SEQ ID NO: 942607 - protein, 9 aa, Homo Sapiens
NKAGVGEPV

SEQ ID NO: 942608 - protein, 9 aa, Homo Sapiens
RSLTWGEAA

SEQ ID NO: 942609 - protein, 9 aa, Homo Sapiens
LQEPWERPQ

SEQ ID NO: 942610 - protein, 9 aa, Homo Sapiens
QLLSQICSH

SEQ ID NO: 942611 - protein, 9 aa, Homo Sapiens
RVVAIFYTV

SEQ ID NO: 942612 - protein, 9 aa, Homo Sapiens
GASLGGIIY

SEQ ID NO: 942613 - protein, 9 aa, Homo Sapiens
LEETLLLHK

SEQ ID NO: 942614 - protein, 9 aa, Homo Sapiens
SCGIPEFPG

SEQ ID NO: 942615 - protein, 9 aa, Homo Sapiens
QKIDENILP

SEQ ID NO: 942616 - protein, 9 aa, Homo Sapiens
SGHIGSFVG

SEQ ID NO: 942617 - protein, 9 aa, Homo Sapiens
APVHFLVIS

SEQ ID NO: 942618 - protein, 9 aa, Homo Sapiens
FREINKSTD

SEQ ID NO: 942619 - protein, 9 aa, Homo Sapiens
AVLHSVPQP

SEQ ID NO: 942620 - protein, 9 aa, Homo Sapiens
FKNIACLMY

SEQ ID NO: 942621 - protein, 9 aa, Homo Sapiens
GETEVGEIH

SEQ ID NO: 942622 - protein, 9 aa, Homo Sapiens
PPGGPNATF

SEQ ID NO: 942623 - protein, 9 aa, Homo Sapiens
LHLLLLRQV

SEQ ID NO: 942624 - protein, 9 aa, Homo Sapiens
SARGHSDPK

SEQ ID NO: 942625 - protein, 9 aa, Homo Sapiens
PRMHHFSRN

SEQ ID NO: 942626 - protein, 9 aa, Homo Sapiens
ESITLQSDH

SEQ ID NO: 942627 - protein, 9 aa, Homo Sapiens
APSAVLGSN

SEQ ID NO: 942628 - protein, 9 aa, Homo Sapiens
SGDPGPKGD

SEQ ID NO: 942629 - protein, 9 aa, Homo Sapiens
SSGDLQQHY

SEQ ID NO: 942630 - protein, 9 aa, Homo Sapiens
NNLSEEILG

SEQ ID NO: 942631 - protein, 9 aa, Homo Sapiens
SMIEYVLYP

SEQ ID NO: 942632 - protein, 9 aa, Homo Sapiens
KYNLVGASE

SEQ ID NO: 942633 - protein, 9 aa, Homo Sapiens
AADCGNVEL

SEQ ID NO: 942634 - protein, 9 aa, Homo Sapiens
QSPHILRKV

SEQ ID NO: 942635 - protein, 9 aa, Homo Sapiens
NNYKCCQSK

SEQ ID NO: 942636 - protein, 9 aa, Homo Sapiens
VSLLLIAQL

SEQ ID NO: 942637 - protein, 9 aa, Homo Sapiens
NFCALSTGE

SEQ ID NO: 942638 - protein, 9 aa, Homo Sapiens
HKPYQLKEK

SEQ ID NO: 942639 - protein, 9 aa, Homo Sapiens
CNSLGTIPG

SEQ ID NO: 942640 - protein, 9 aa, Homo Sapiens
RRGFIQKST

SEQ ID NO: 942641 - protein, 9 aa, Homo Sapiens
QKQNTLLET

SEQ ID NO: 942642 - protein, 9 aa, Homo Sapiens
AQDELCPPS

SEQ ID NO: 942643 - protein, 9 aa, Homo Sapiens
ATRLPTQEA

SEQ ID NO: 942644 - protein, 9 aa, Homo Sapiens
DSYRSPFAS

SEQ ID NO: 942645 - protein, 9 aa, Homo Sapiens
KNCSKKYVT

SEQ ID NO: 942646 - protein, 9 aa, Homo Sapiens
RTQFFSKKY

SEQ ID NO: 942647 - protein, 9 aa, Homo Sapiens
QPGPRKIPA

SEQ ID NO: 942648 - protein, 9 aa, Homo Sapiens
SILGVTEAF

SEQ ID NO: 942649 - protein, 9 aa, Homo Sapiens
GLQNLCGQS

SEQ ID NO: 942650 - protein, 9 aa, Homo Sapiens
SLTHLNIRG

SEQ ID NO: 942651 - protein, 9 aa, Homo Sapiens
GILRLYKDI

SEQ ID NO: 942652 - protein, 9 aa, Homo Sapiens
EYAFICVRS

SEQ ID NO: 942653 - protein, 9 aa, Homo Sapiens
GMRGPQEPP

SEQ ID NO: 942654 - protein, 9 aa, Homo Sapiens
RESTTFQSW

SEQ ID NO: 942655 - protein, 9 aa, Homo Sapiens
RRKMSPLRL

SEQ ID NO: 942656 - protein, 9 aa, Homo Sapiens
ATGTFFWME

SEQ ID NO: 942657 - protein, 9 aa, Homo Sapiens
SLDCRKSGK

SEQ ID NO: 942658 - protein, 9 aa, Homo Sapiens
APVSSKSQA

SEQ ID NO: 942659 - protein, 9 aa, Homo Sapiens
LSTLSTVIH

SEQ ID NO: 942660 - protein, 9 aa, Homo Sapiens
PGPEENAAA

SEQ ID NO: 942661 - protein, 9 aa, Homo Sapiens
RNSSVVLES

SEQ ID NO: 942662 - protein, 9 aa, Homo Sapiens
CREKQSQSQ

SEQ ID NO: 942663 - protein, 9 aa, Homo Sapiens
LMENILIVT

SEQ ID NO: 942664 - protein, 9 aa, Homo Sapiens
CAAVYPIIL

SEQ ID NO: 942665 - protein, 9 aa, Homo Sapiens
TRANTTTIL

SEQ ID NO: 942666 - protein, 9 aa, Homo Sapiens
KRKEEKPFR

SEQ ID NO: 942667 - protein, 9 aa, Homo Sapiens
TKKIKEALL

SEQ ID NO: 942668 - protein, 9 aa, Homo Sapiens
GPPGLVLSG

SEQ ID NO: 942669 - protein, 9 aa, Homo Sapiens
RYTRNWFKV

SEQ ID NO: 942670 - protein, 9 aa, Homo Sapiens
EKDYFGICY

SEQ ID NO: 942671 - protein, 9 aa, Homo Sapiens
AAHQDLWSA

SEQ ID NO: 942672 - protein, 9 aa, Homo Sapiens
GGKLYAATA

SEQ ID NO: 942673 - protein, 9 aa, Homo Sapiens
VQQLYPALI

SEQ ID NO: 942674 - protein, 9 aa, Homo Sapiens
KTLESILYP

SEQ ID NO: 942675 - protein, 9 aa, Homo Sapiens
LYALEHTYS

SEQ ID NO: 942676 - protein, 9 aa, Homo Sapiens
TFKISVTPT

SEQ ID NO: 942677 - protein, 9 aa, Homo Sapiens
VSSLHAEPL

SEQ ID NO: 942678 - protein, 9 aa, Homo Sapiens
FSDDLSPGA

SEQ ID NO: 942679 - protein, 9 aa, Homo Sapiens
KNCTKIFEK

SEQ ID NO: 942680 - protein, 9 aa, Homo Sapiens
VILQNLKDH

SEQ ID NO: 942681 - protein, 9 aa, Homo Sapiens
LRPLSPRTP

SEQ ID NO: 942682 - protein, 9 aa, Homo Sapiens
WAHLDWPVQ

SEQ ID NO: 942683 - protein, 9 aa, Homo Sapiens
EAKAETIWS

SEQ ID NO: 942684 - protein, 9 aa, Homo Sapiens
WRRERIWLA

SEQ ID NO: 942685 - protein, 9 aa, Homo Sapiens
FQQQAFALS

SEQ ID NO: 942686 - protein, 9 aa, Homo Sapiens
LGWTGFSCQ

SEQ ID NO: 942687 - protein, 9 aa, Homo Sapiens
HPVNNKESS

SEQ ID NO: 942688 - protein, 9 aa, Homo Sapiens
LFKETITLK

SEQ ID NO: 942689 - protein, 9 aa, Homo Sapiens
ANKQKASAC

SEQ ID NO: 942690 - protein, 9 aa, Homo Sapiens
PIDTDIQNL

SEQ ID NO: 942691 - protein, 9 aa, Homo Sapiens
VDAPDGCIL

SEQ ID NO: 942692 - protein, 9 aa, Homo Sapiens
FASPAGKMI

SEQ ID NO: 942693 - protein, 9 aa, Homo Sapiens
LRHNNWRLQ

SEQ ID NO: 942694 - protein, 9 aa, Homo Sapiens
KVATLNPTT

SEQ ID NO: 942695 - protein, 9 aa, Homo Sapiens
LEALSEDNS

SEQ ID NO: 942696 - protein, 9 aa, Homo Sapiens
RNPLARKEA

SEQ ID NO: 942697 - protein, 9 aa, Homo Sapiens
RESSLLVLR

SEQ ID NO: 942698 - protein, 9 aa, Homo Sapiens
LAFKAYLSA

SEQ ID NO: 942699 - protein, 9 aa, Homo Sapiens
REWVCAADI

SEQ ID NO: 942700 - protein, 9 aa, Homo Sapiens
YFKNFSSAK

SEQ ID NO: 942701 - protein, 9 aa, Homo Sapiens
EANFQRESV

SEQ ID NO: 942702 - protein, 9 aa, Homo Sapiens
SGDPEAEGL

SEQ ID NO: 942703 - protein, 9 aa, Homo Sapiens
SAMSGHRPS

SEQ ID NO: 942704 - protein, 9 aa, Homo Sapiens
AGAEVLLLP

SEQ ID NO: 942705 - protein, 9 aa, Homo Sapiens
GDKTEGCRS

SEQ ID NO: 942706 - protein, 9 aa, Homo Sapiens
CDQNTTFSV

SEQ ID NO: 942707 - protein, 9 aa, Homo Sapiens
LGSSDILGK

SEQ ID NO: 942708 - protein, 9 aa, Homo Sapiens
NEDSILVVR

SEQ ID NO: 942709 - protein, 9 aa, Homo Sapiens
RKLENEVIE

SEQ ID NO: 942710 - protein, 9 aa, Homo Sapiens
TVEDIKSLV

SEQ ID NO: 942711 - protein, 9 aa, Homo Sapiens
VSEFLLLSL

SEQ ID NO: 942712 - protein, 9 aa, Homo Sapiens
FPPPWPQSN

SEQ ID NO: 942713 - protein, 9 aa, Homo Sapiens
TFDIQAINR

SEQ ID NO: 942714 - protein, 9 aa, Homo Sapiens
HTDVFSEPK

SEQ ID NO: 942715 - protein, 9 aa, Homo Sapiens
MLEDSGFKK

SEQ ID NO: 942716 - protein, 9 aa, Homo Sapiens
PTWNKVFEF

SEQ ID NO: 942717 - protein, 9 aa, Homo Sapiens
KPRPFSPAV

SEQ ID NO: 942718 - protein, 9 aa, Homo Sapiens
YDGLTVHLV

SEQ ID NO: 942719 - protein, 9 aa, Homo Sapiens
SELQKKKQS

SEQ ID NO: 942720 - protein, 9 aa, Homo Sapiens
DFVRKRMSV

SEQ ID NO: 942721 - protein, 9 aa, Homo Sapiens
AVAAAASAS

SEQ ID NO: 942722 - protein, 9 aa, Homo Sapiens
ADKLGPNSK

SEQ ID NO: 942723 - protein, 9 aa, Homo Sapiens
GQQLLWKGF

SEQ ID NO: 942724 - protein, 9 aa, Homo Sapiens
SDRVKLFSH

SEQ ID NO: 942725 - protein, 9 aa, Homo Sapiens
LSNSRGSNT

SEQ ID NO: 942726 - protein, 9 aa, Homo Sapiens
AVKSAMNTI

SEQ ID NO: 942727 - protein, 9 aa, Homo Sapiens
EKSLDQLET

SEQ ID NO: 942728 - protein, 9 aa, Homo Sapiens
KSGKNGPHV

SEQ ID NO: 942729 - protein, 9 aa, Homo Sapiens
IIYSISLLN

SEQ ID NO: 942730 - protein, 9 aa, Homo Sapiens
RFSWLLFAL

SEQ ID NO: 942731 - protein, 9 aa, Homo Sapiens
RRVCFRGES

SEQ ID NO: 942732 - protein, 9 aa, Homo Sapiens
ADFIKTTLN

SEQ ID NO: 942733 - protein, 9 aa, Homo Sapiens
EDAQKILKC

SEQ ID NO: 942734 - protein, 9 aa, Homo Sapiens
QNGSVSRVP

SEQ ID NO: 942735 - protein, 9 aa, Homo Sapiens
ATGQNVNII

SEQ ID NO: 942736 - protein, 9 aa, Homo Sapiens
MSEELVVLS

SEQ ID NO: 942737 - protein, 9 aa, Homo Sapiens
HSTPLRGRY

SEQ ID NO: 942738 - protein, 9 aa, Homo Sapiens
ANDQRFSSE

SEQ ID NO: 942739 - protein, 9 aa, Homo Sapiens
PSRIWGDSP

SEQ ID NO: 942740 - protein, 9 aa, Homo Sapiens
LQNLKDHGS

SEQ ID NO: 942741 - protein, 9 aa, Homo Sapiens
LQNLKDHGP

SEQ ID NO: 942742 - protein, 9 aa, Homo Sapiens
GLLPLGPKE

SEQ ID NO: 942743 - protein, 9 aa, Homo Sapiens
LETSLEKRM

SEQ ID NO: 942744 - protein, 9 aa, Homo Sapiens
FTDQKKFSL

SEQ ID NO: 942745 - protein, 9 aa, Homo Sapiens
AFQKSAEDA

SEQ ID NO: 942746 - protein, 9 aa, Homo Sapiens
ARAKVRRYL

SEQ ID NO: 942747 - protein, 9 aa, Homo Sapiens
LNLPVANGP

SEQ ID NO: 942748 - protein, 9 aa, Homo Sapiens
VKPPNGEPV

SEQ ID NO: 942749 - protein, 9 aa, Homo Sapiens
YFDWNPSLF

SEQ ID NO: 942750 - protein, 9 aa, Homo Sapiens
PSSALRSAS

SEQ ID NO: 942751 - protein, 9 aa, Homo Sapiens
TCIATNHFE

SEQ ID NO: 942752 - protein, 9 aa, Homo Sapiens
INVYYNKAS

SEQ ID NO: 942753 - protein, 9 aa, Homo Sapiens
RCEKPIQNS

SEQ ID NO: 942754 - protein, 9 aa, Homo Sapiens
RQKFHRPIG

SEQ ID NO: 942755 - protein, 9 aa, Homo Sapiens
TFFWMEIVL

SEQ ID NO: 942756 - protein, 9 aa, Homo Sapiens
LVISKKPIP

SEQ ID NO: 942757 - protein, 9 aa, Homo Sapiens
AIIKETVSR

SEQ ID NO: 942758 - protein, 9 aa, Homo Sapiens
SVSEFLLLS

SEQ ID NO: 942759 - protein, 9 aa, Homo Sapiens
KAIALKGGR

SEQ ID NO: 942760 - protein, 9 aa, Homo Sapiens
PPPVKDSEY

SEQ ID NO: 942761 - protein, 9 aa, Homo Sapiens
AHKCQLPKD

SEQ ID NO: 942762 - protein, 9 aa, Homo Sapiens
HEAVGEIML

SEQ ID NO: 942763 - protein, 9 aa, Homo Sapiens
INALSHSYC

SEQ ID NO: 942764 - protein, 9 aa, Homo Sapiens
VLMVERSGL

SEQ ID NO: 942765 - protein, 9 aa, Homo Sapiens
QPPAENSHR

SEQ ID NO: 942766 - protein, 9 aa, Homo Sapiens
ISRTGILAQ

SEQ ID NO: 942767 - protein, 9 aa, Homo Sapiens
SNRSSNITA

SEQ ID NO: 942768 - protein, 9 aa, Homo Sapiens
RGSCISQPR

SEQ ID NO: 942769 - protein, 9 aa, Homo Sapiens
TATGATPIA

SEQ ID NO: 942770 - protein, 9 aa, Homo Sapiens
ADLVVRIQR

SEQ ID NO: 942771 - protein, 9 aa, Homo Sapiens
LALQPKEQQ

SEQ ID NO: 942772 - protein, 9 aa, Homo Sapiens
RPSSASFTS

SEQ ID NO: 942773 - protein, 9 aa, Homo Sapiens
ANVEMKWVK

SEQ ID NO: 942774 - protein, 9 aa, Homo Sapiens
VSSFIGTEP

SEQ ID NO: 942775 - protein, 9 aa, Homo Sapiens
EKHKCSVKH

SEQ ID NO: 942776 - protein, 9 aa, Homo Sapiens
LEQKMFGSM

SEQ ID NO: 942777 - protein, 9 aa, Homo Sapiens
VPVPRPKTT

SEQ ID NO: 942778 - protein, 9 aa, Homo Sapiens
INGQSLPMS

SEQ ID NO: 942779 - protein, 9 aa, Homo Sapiens
KKKCVHYWP

SEQ ID NO: 942780 - protein, 9 aa, Homo Sapiens
TLRLDVWNG

SEQ ID NO: 942781 - protein, 9 aa, Homo Sapiens
SLPIRPEQQ

SEQ ID NO: 942782 - protein, 9 aa, Homo Sapiens
QLQRKQQLQ

SEQ ID NO: 942783 - protein, 9 aa, Homo Sapiens
PKLSAEVVF

SEQ ID NO: 942784 - protein, 9 aa, Homo Sapiens
KHERAQEVM

SEQ ID NO: 942785 - protein, 9 aa, Homo Sapiens
NKFKSLWIE

SEQ ID NO: 942786 - protein, 9 aa, Homo Sapiens
SKVCFEIKE

SEQ ID NO: 942787 - protein, 9 aa, Homo Sapiens
IGGMVLSQE

SEQ ID NO: 942788 - protein, 9 aa, Homo Sapiens
SKLPAIHDL

SEQ ID NO: 942789 - protein, 9 aa, Homo Sapiens
PQNALPSVQ

SEQ ID NO: 942790 - protein, 9 aa, Homo Sapiens
NQSPAPPAT

SEQ ID NO: 942791 - protein, 9 aa, Homo Sapiens
LNSNYCRSK

SEQ ID NO: 942792 - protein, 9 aa, Homo Sapiens
CHKDRQLLQ

SEQ ID NO: 942793 - protein, 9 aa, Homo Sapiens
KGLLPPNLS

SEQ ID NO: 942794 - protein, 9 aa, Homo Sapiens
IEVAFMVCA

SEQ ID NO: 942795 - protein, 9 aa, Homo Sapiens
QHFLCKYQP

SEQ ID NO: 942796 - protein, 9 aa, Homo Sapiens
NTIDLDSLM

SEQ ID NO: 942797 - protein, 9 aa, Homo Sapiens
FLIIYIKEA

SEQ ID NO: 942798 - protein, 9 aa, Homo Sapiens
TKRSTLAPE

SEQ ID NO: 942799 - protein, 9 aa, Homo Sapiens
VSHSKRHKS

SEQ ID NO: 942800 - protein, 9 aa, Homo Sapiens
TEKIFRQMN

SEQ ID NO: 942801 - protein, 9 aa, Homo Sapiens
KARDIARRR

SEQ ID NO: 942802 - protein, 9 aa, Homo Sapiens
DDLSGFYQK

SEQ ID NO: 942803 - protein, 9 aa, Homo Sapiens
HFAVIYYLL

SEQ ID NO: 942804 - protein, 9 aa, Homo Sapiens
VHFFTGAFL

SEQ ID NO: 942805 - protein, 9 aa, Homo Sapiens
VSSKSQAKI

SEQ ID NO: 942806 - protein, 9 aa, Homo Sapiens
LPGSLENSN

SEQ ID NO: 942807 - protein, 9 aa, Homo Sapiens
VYKKTTPIE

SEQ ID NO: 942808 - protein, 9 aa, Homo Sapiens
DMARLQRLE

SEQ ID NO: 942809 - protein, 9 aa, Homo Sapiens
AVPDSTGQS

SEQ ID NO: 942810 - protein, 9 aa, Homo Sapiens
LEEDSDPML

SEQ ID NO: 942811 - protein, 9 aa, Homo Sapiens
KKDLAHTLS

SEQ ID NO: 942812 - protein, 9 aa, Homo Sapiens
VELLKRDAH

SEQ ID NO: 942813 - protein, 9 aa, Homo Sapiens
MIISYFGCM

SEQ ID NO: 942814 - protein, 9 aa, Homo Sapiens
MNTNNDGKL

SEQ ID NO: 942815 - protein, 9 aa, Homo Sapiens
DCGNVELVE

SEQ ID NO: 942816 - protein, 9 aa, Homo Sapiens
YPDAGALIE

SEQ ID NO: 942817 - protein, 9 aa, Homo Sapiens
SAGTELSLE

SEQ ID NO: 942818 - protein, 9 aa, Homo Sapiens
KIAMIVLFG

SEQ ID NO: 942819 - protein, 9 aa, Homo Sapiens
APGLKGENS

SEQ ID NO: 942820 - protein, 9 aa, Homo Sapiens
PMKLGLKEP

SEQ ID NO: 942821 - protein, 9 aa, Homo Sapiens
EINKSTDKK

SEQ ID NO: 942822 - protein, 9 aa, Homo Sapiens
EELRQGLSK

SEQ ID NO: 942823 - protein, 9 aa, Homo Sapiens
LSWKLQELS

SEQ ID NO: 942824 - protein, 9 aa, Homo Sapiens
PGQKVSHVA

SEQ ID NO: 942825 - protein, 9 aa, Homo Sapiens
PLGAPNLFH

SEQ ID NO: 942826 - protein, 9 aa, Homo Sapiens
KKRLSNVIW

SEQ ID NO: 942827 - protein, 9 aa, Homo Sapiens
LFSCFSNSA

SEQ ID NO: 942828 - protein, 9 aa, Homo Sapiens
DQEGILFVQ

SEQ ID NO: 942829 - protein, 9 aa, Homo Sapiens
AILSKQPEF

SEQ ID NO: 942830 - protein, 9 aa, Homo Sapiens
LKIAMIVLF

SEQ ID NO: 942831 - protein, 9 aa, Homo Sapiens
YPLPSAERY

SEQ ID NO: 942832 - protein, 9 aa, Homo Sapiens
AQKSCTCWG

SEQ ID NO: 942833 - protein, 9 aa, Homo Sapiens
FSPQNNTLY

SEQ ID NO: 942834 - protein, 9 aa, Homo Sapiens
QKFHRPIGL

SEQ ID NO: 942835 - protein, 9 aa, Homo Sapiens
APKVYIILF

SEQ ID NO: 942836 - protein, 9 aa, Homo Sapiens
TSRGSQQYW

SEQ ID NO: 942837 - protein, 9 aa, Homo Sapiens
HPAQNVEAG

SEQ ID NO: 942838 - protein, 9 aa, Homo Sapiens
VQDMRLVFH

SEQ ID NO: 942839 - protein, 9 aa, Homo Sapiens
YKVKVGVYN

SEQ ID NO: 942840 - protein, 9 aa, Homo Sapiens
TFQRHPMND

SEQ ID NO: 942841 - protein, 9 aa, Homo Sapiens
EGYLYTSKL

SEQ ID NO: 942842 - protein, 9 aa, Homo Sapiens
GSRDVVDRV

SEQ ID NO: 942843 - protein, 9 aa, Homo Sapiens
TTRRATGWH

SEQ ID NO: 942844 - protein, 9 aa, Homo Sapiens
GVRFEDYEG

SEQ ID NO: 942845 - protein, 9 aa, Homo Sapiens
PRALPKGPL

SEQ ID NO: 942846 - protein, 9 aa, Homo Sapiens
GDPFSFEGP

SEQ ID NO: 942847 - protein, 9 aa, Homo Sapiens
VERILRLLQ

SEQ ID NO: 942848 - protein, 9 aa, Homo Sapiens
VLNVERFLV

SEQ ID NO: 942849 - protein, 9 aa, Homo Sapiens
VLDIDKLFY

SEQ ID NO: 942850 - protein, 9 aa, Homo Sapiens
DFISHSSGS

SEQ ID NO: 942851 - protein, 9 aa, Homo Sapiens
NEDASHNIT

SEQ ID NO: 942852 - protein, 9 aa, Homo Sapiens
SVVLESDDV

SEQ ID NO: 942853 - protein, 9 aa, Homo Sapiens
GSYGQLPML

SEQ ID NO: 942854 - protein, 9 aa, Homo Sapiens
FTSPPLIHS

SEQ ID NO: 942855 - protein, 9 aa, Homo Sapiens
RVSSHLQAE

SEQ ID NO: 942856 - protein, 9 aa, Homo Sapiens
VTPTKGSVY

SEQ ID NO: 942857 - protein, 9 aa, Homo Sapiens
LSAFVRVVS

SEQ ID NO: 942858 - protein, 9 aa, Homo Sapiens
FSFCKSQCL

SEQ ID NO: 942859 - protein, 9 aa, Homo Sapiens
ICPYNPHHR

SEQ ID NO: 942860 - protein, 9 aa, Homo Sapiens
KRGDDSVPE

SEQ ID NO: 942861 - protein, 9 aa, Homo Sapiens
RDYMKQSPL

SEQ ID NO: 942862 - protein, 9 aa, Homo Sapiens
SLIFQANEE

SEQ ID NO: 942863 - protein, 9 aa, Homo Sapiens
NGLLNFSYS

SEQ ID NO: 942864 - protein, 9 aa, Homo Sapiens
FRGDCCRSL

SEQ ID NO: 942865 - protein, 9 aa, Homo Sapiens
DSKEIEWDD

SEQ ID NO: 942866 - protein, 9 aa, Homo Sapiens
FKSQQHRQS

SEQ ID NO: 942867 - protein, 9 aa, Homo Sapiens
SKIDLPMKR

SEQ ID NO: 942868 - protein, 9 aa, Homo Sapiens
RPLPHSQKS

SEQ ID NO: 942869 - protein, 9 aa, Homo Sapiens
TKEIKDEKV

SEQ ID NO: 942870 - protein, 9 aa, Homo Sapiens
SFQKGDQIV

SEQ ID NO: 942871 - protein, 9 aa, Homo Sapiens
KMNGSLYQE

SEQ ID NO: 942872 - protein, 9 aa, Homo Sapiens
RATGWHEGV

SEQ ID NO: 942873 - protein, 9 aa, Homo Sapiens
IESTKEGTT

SEQ ID NO: 942874 - protein, 9 aa, Homo Sapiens
RGITCLDYE

SEQ ID NO: 942875 - protein, 9 aa, Homo Sapiens
IVHYNMGGI

SEQ ID NO: 942876 - protein, 9 aa, Homo Sapiens
PLRPWPPSS

SEQ ID NO: 942877 - protein, 9 aa, Homo Sapiens
LDHFETIMK

SEQ ID NO: 942878 - protein, 9 aa, Homo Sapiens
CRNPICMAT

SEQ ID NO: 942879 - protein, 9 aa, Homo Sapiens
FEADTYKDL

SEQ ID NO: 942880 - protein, 9 aa, Homo Sapiens
ARASTKKKS

SEQ ID NO: 942881 - protein, 9 aa, Homo Sapiens
LVLQMVLKC

SEQ ID NO: 942882 - protein, 9 aa, Homo Sapiens
ELPDEDKDA

SEQ ID NO: 942883 - protein, 9 aa, Homo Sapiens
VPTPDPKKL

SEQ ID NO: 942884 - protein, 9 aa, Homo Sapiens
EGSASGSVE

SEQ ID NO: 942885 - protein, 9 aa, Homo Sapiens
CSARGHSDP

SEQ ID NO: 942886 - protein, 9 aa, Homo Sapiens
QAHYYHHHC

SEQ ID NO: 942887 - protein, 9 aa, Homo Sapiens
DTLSEEFDL

SEQ ID NO: 942888 - protein, 9 aa, Homo Sapiens
ARNVNPKSS

SEQ ID NO: 942889 - protein, 9 aa, Homo Sapiens
FCVQVKPPN

SEQ ID NO: 942890 - protein, 9 aa, Homo Sapiens
LILKGPLFS

SEQ ID NO: 942891 - protein, 9 aa, Homo Sapiens
SSASPGGCS

SEQ ID NO: 942892 - protein, 9 aa, Homo Sapiens
NGGPQRNPV

SEQ ID NO: 942893 - protein, 9 aa, Homo Sapiens
FLVELYENS

SEQ ID NO: 942894 - protein, 9 aa, Homo Sapiens
RLYTGEKPY

SEQ ID NO: 942895 - protein, 9 aa, Homo Sapiens
AVNGAHLQN

SEQ ID NO: 942896 - protein, 9 aa, Homo Sapiens
VFEQGHQLF

SEQ ID NO: 942897 - protein, 9 aa, Homo Sapiens
GLTVTEKLD

SEQ ID NO: 942898 - protein, 9 aa, Homo Sapiens
DPNHTSSQM

SEQ ID NO: 942899 - protein, 9 aa, Homo Sapiens
IWSCSRGRE

SEQ ID NO: 942900 - protein, 9 aa, Homo Sapiens
TLFCFWSFF

SEQ ID NO: 942901 - protein, 9 aa, Homo Sapiens
HEPHVYLPG

SEQ ID NO: 942902 - protein, 9 aa, Homo Sapiens
YHPQFTIFG

SEQ ID NO: 942903 - protein, 9 aa, Homo Sapiens
KDVSRPAVD

SEQ ID NO: 942904 - protein, 9 aa, Homo Sapiens
RQAFRGKSS

SEQ ID NO: 942905 - protein, 9 aa, Homo Sapiens
DGKKTPRGR

SEQ ID NO: 942906 - protein, 9 aa, Homo Sapiens
GFIPNDAEE

SEQ ID NO: 942907 - protein, 9 aa, Homo Sapiens
KSSYLLHGS

SEQ ID NO: 942908 - protein, 9 aa, Homo Sapiens
RITTLSSMG

SEQ ID NO: 942909 - protein, 9 aa, Homo Sapiens
NDGIVQPNS

SEQ ID NO: 942910 - protein, 9 aa, Homo Sapiens
GRGGKPRAY

SEQ ID NO: 942911 - protein, 9 aa, Homo Sapiens
GCSDAQPMG

SEQ ID NO: 942912 - protein, 9 aa, Homo Sapiens
LGGQKVATL

SEQ ID NO: 942913 - protein, 9 aa, Homo Sapiens
STGNSASVS

SEQ ID NO: 942914 - protein, 9 aa, Homo Sapiens
ERCICFVCL

SEQ ID NO: 942915 - protein, 9 aa, Homo Sapiens
WTPPGSIRF

SEQ ID NO: 942916 - protein, 9 aa, Homo Sapiens
VELYENSLL

SEQ ID NO: 942917 - protein, 9 aa, Homo Sapiens
PVPTPDPKK

SEQ ID NO: 942918 - protein, 9 aa, Homo Sapiens
LPAVVPALG

SEQ ID NO: 942919 - protein, 9 aa, Homo Sapiens
TFFTPALYI

SEQ ID NO: 942920 - protein, 9 aa, Homo Sapiens
APTNGQPQT

SEQ ID NO: 942921 - protein, 9 aa, Homo Sapiens
PLEVHKHKA

SEQ ID NO: 942922 - protein, 9 aa, Homo Sapiens
KEYYFDWNP

SEQ ID NO: 942923 - protein, 9 aa, Homo Sapiens
DITIDKPNA

SEQ ID NO: 942924 - protein, 9 aa, Homo Sapiens
LLPPNLSAS

SEQ ID NO: 942925 - protein, 9 aa, Homo Sapiens
IRKELKRTD

SEQ ID NO: 942926 - protein, 9 aa, Homo Sapiens
RFFSPHQSL

SEQ ID NO: 942927 - protein, 9 aa, Homo Sapiens
LWSAGLSSF

SEQ ID NO: 942928 - protein, 9 aa, Homo Sapiens
CPIDVDGLR

SEQ ID NO: 942929 - protein, 9 aa, Homo Sapiens
DGFWMKVEQ

SEQ ID NO: 942930 - protein, 9 aa, Homo Sapiens
SDDLSPGAI

SEQ ID NO: 942931 - protein, 9 aa, Homo Sapiens
RLKNMCSGG

SEQ ID NO: 942932 - protein, 9 aa, Homo Sapiens
RRLSFQKDF

SEQ ID NO: 942933 - protein, 9 aa, Homo Sapiens
KFVKQCSPI

SEQ ID NO: 942934 - protein, 9 aa, Homo Sapiens
FLNRMGDVT

SEQ ID NO: 942935 - protein, 9 aa, Homo Sapiens
VASNEILRN

SEQ ID NO: 942936 - protein, 9 aa, Homo Sapiens
VEKILVEVL

SEQ ID NO: 942937 - protein, 9 aa, Homo Sapiens
STLSYYKKI

SEQ ID NO: 942938 - protein, 9 aa, Homo Sapiens
ITNLKGSPS

SEQ ID NO: 942939 - protein, 9 aa, Homo Sapiens
KDRKQRSLE

SEQ ID NO: 942940 - protein, 9 aa, Homo Sapiens
TREKLYKCK

SEQ ID NO: 942941 - protein, 9 aa, Homo Sapiens
DSDGLIIIT

SEQ ID NO: 942942 - protein, 9 aa, Homo Sapiens
RPNCDGWLL

SEQ ID NO: 942943 - protein, 9 aa, Homo Sapiens
ALRAVILRN

SEQ ID NO: 942944 - protein, 9 aa, Homo Sapiens
FGVTTATEQ

SEQ ID NO: 942945 - protein, 9 aa, Homo Sapiens
GEEEQLRKL

SEQ ID NO: 942946 - protein, 9 aa, Homo Sapiens
DRVVAIFYT

SEQ ID NO: 942947 - protein, 9 aa, Homo Sapiens
PLEIKFLGD

SEQ ID NO: 942948 - protein, 9 aa, Homo Sapiens
QIVVLEESG

SEQ ID NO: 942949 - protein, 9 aa, Homo Sapiens
ELAEAFQKS

SEQ ID NO: 942950 - protein, 9 aa, Homo Sapiens
PESIEETVE

SEQ ID NO: 942951 - protein, 9 aa, Homo Sapiens
LTTRRATGW

SEQ ID NO: 942952 - protein, 9 aa, Homo Sapiens
ALSMSTMTS

SEQ ID NO: 942953 - protein, 9 aa, Homo Sapiens
RLLEHEETN

SEQ ID NO: 942954 - protein, 9 aa, Homo Sapiens
SSSSTIAEG

SEQ ID NO: 942955 - protein, 9 aa, Homo Sapiens
VKIWNFNLQ

SEQ ID NO: 942956 - protein, 9 aa, Homo Sapiens
SLREMKEGP

SEQ ID NO: 942957 - protein, 9 aa, Homo Sapiens
LNYFEGYSL

SEQ ID NO: 942958 - protein, 9 aa, Homo Sapiens
TSCQGNLPL

SEQ ID NO: 942959 - protein, 9 aa, Homo Sapiens
GGKPRAYFM

SEQ ID NO: 942960 - protein, 9 aa, Homo Sapiens
LKFATATGA

SEQ ID NO: 942961 - protein, 8 aa, Homo Sapiens
KNKTVLTE

SEQ ID NO: 942962 - protein, 9 aa, Homo Sapiens
SPTWGEPSK

SEQ ID NO: 942963 - protein, 9 aa, Homo Sapiens
ASQRLQGHL

SEQ ID NO: 942964 - protein, 9 aa, Homo Sapiens
GHFSRVTTV

SEQ ID NO: 942965 - protein, 9 aa, Homo Sapiens
SVQATKKVN

SEQ ID NO: 942966 - protein, 9 aa, Homo Sapiens
NFQLEVTPQ

SEQ ID NO: 942967 - protein, 9 aa, Homo Sapiens
KHKVCMNLR

SEQ ID NO: 942968 - protein, 9 aa, Homo Sapiens
GELESIGFS

SEQ ID NO: 942969 - protein, 9 aa, Homo Sapiens
YENSLLLTA

SEQ ID NO: 942970 - protein, 9 aa, Homo Sapiens
RDASDPWMC

SEQ ID NO: 942971 - protein, 9 aa, Homo Sapiens
MFEVMGLHD

SEQ ID NO: 942972 - protein, 9 aa, Homo Sapiens
FFCIISVLP

SEQ ID NO: 942973 - protein, 9 aa, Homo Sapiens
LSKPELPQN

SEQ ID NO: 942974 - protein, 9 aa, Homo Sapiens
EPEAREVSP

SEQ ID NO: 942975 - protein, 9 aa, Homo Sapiens
QVRSETIFD

SEQ ID NO: 942976 - protein, 9 aa, Homo Sapiens
DAGDYFLLC

SEQ ID NO: 942977 - protein, 9 aa, Homo Sapiens
VTLRKSAKY

SEQ ID NO: 942978 - protein, 9 aa, Homo Sapiens
LYTNREGAA

SEQ ID NO: 942979 - protein, 9 aa, Homo Sapiens
LKIFMTELR

SEQ ID NO: 942980 - protein, 9 aa, Homo Sapiens
FSSAKDNSI

SEQ ID NO: 942981 - protein, 9 aa, Homo Sapiens
ESTARLDFF

SEQ ID NO: 942982 - protein, 9 aa, Homo Sapiens
AKDNPSSTL

SEQ ID NO: 942983 - protein, 9 aa, Homo Sapiens
CGSDSFATD

SEQ ID NO: 942984 - protein, 9 aa, Homo Sapiens
ISISLDSHT

SEQ ID NO: 942985 - protein, 9 aa, Homo Sapiens
RFFYEDVTL

SEQ ID NO: 942986 - protein, 9 aa, Homo Sapiens
EYKFPEPRN

SEQ ID NO: 942987 - protein, 9 aa, Homo Sapiens
YKEQKRQKK

SEQ ID NO: 942988 - protein, 9 aa, Homo Sapiens
EKAKILIDF

SEQ ID NO: 942989 - protein, 9 aa, Homo Sapiens
KTTHINTVS

SEQ ID NO: 942990 - protein, 9 aa, Homo Sapiens
AFRVKFNTA

SEQ ID NO: 942991 - protein, 9 aa, Homo Sapiens
ESEYVVKPR

SEQ ID NO: 942992 - protein, 9 aa, Homo Sapiens
SEKEEGPFH

SEQ ID NO: 942993 - protein, 9 aa, Homo Sapiens
IDVIIHVAQ

SEQ ID NO: 942994 - protein, 9 aa, Homo Sapiens
TCGSDSFAT

SEQ ID NO: 942995 - protein, 9 aa, Homo Sapiens
EVVFEKCSQ

SEQ ID NO: 942996 - protein, 9 aa, Homo Sapiens
KRKKAAPVS

SEQ ID NO: 942997 - protein, 9 aa, Homo Sapiens
SAKKFLKRD

SEQ ID NO: 942998 - protein, 9 aa, Homo Sapiens
SCQTQDWVL

SEQ ID NO: 942999 - protein, 9 aa, Homo Sapiens
KQKPVFADT

SEQ ID NO: 943000 - protein, 9 aa, Homo Sapiens
SVGGHGLCS

SEQ ID NO: 943001 - protein, 9 aa, Homo Sapiens
TAVDTILEI

SEQ ID NO: 943002 - protein, 9 aa, Homo Sapiens
KFPSSQDYP

SEQ ID NO: 943003 - protein, 9 aa, Homo Sapiens
DLTAKNVTF

SEQ ID NO: 943004 - protein, 9 aa, Homo Sapiens
IRISKIGGK

SEQ ID NO: 943005 - protein, 9 aa, Homo Sapiens
SCDSSDTPE

SEQ ID NO: 943006 - protein, 9 aa, Homo Sapiens
FSRNSSSTQ

SEQ ID NO: 943007 - protein, 9 aa, Homo Sapiens
IPPIKLIDF

SEQ ID NO: 943008 - protein, 9 aa, Homo Sapiens
YETFTIKSD

SEQ ID NO: 943009 - protein, 9 aa, Homo Sapiens
PGQSFFLWQ

SEQ ID NO: 943010 - protein, 9 aa, Homo Sapiens
LTLLASERL

SEQ ID NO: 943011 - protein, 9 aa, Homo Sapiens
LPPFTGCGC

SEQ ID NO: 943012 - protein, 9 aa, Homo Sapiens
AKNVIGKAK

SEQ ID NO: 943013 - protein, 9 aa, Homo Sapiens
FFAKKIIPS

SEQ ID NO: 943014 - protein, 9 aa, Homo Sapiens
PQAPAFFLV

SEQ ID NO: 943015 - protein, 9 aa, Homo Sapiens
SGRETFFLT

SEQ ID NO: 943016 - protein, 9 aa, Homo Sapiens
PYATMGGLT

SEQ ID NO: 943017 - protein, 9 aa, Homo Sapiens
KCPPKCPSQ

SEQ ID NO: 943018 - protein, 9 aa, Homo Sapiens
FLLYSYFSP

SEQ ID NO: 943019 - protein, 9 aa, Homo Sapiens
KLFYVRPVT

SEQ ID NO: 943020 - protein, 9 aa, Homo Sapiens
PSSASFTSS

SEQ ID NO: 943021 - protein, 9 aa, Homo Sapiens
IFCRGERIR

SEQ ID NO: 943022 - protein, 9 aa, Homo Sapiens
NVAPGTFIL

SEQ ID NO: 943023 - protein, 9 aa, Homo Sapiens
SDLKTDVAD

SEQ ID NO: 943024 - protein, 9 aa, Homo Sapiens
CRAEENPKP

SEQ ID NO: 943025 - protein, 9 aa, Homo Sapiens
FPVTDASSA

SEQ ID NO: 943026 - protein, 9 aa, Homo Sapiens
FAYKDYLLF

SEQ ID NO: 943027 - protein, 9 aa, Homo Sapiens
DQPRRLKKV

SEQ ID NO: 943028 - protein, 9 aa, Homo Sapiens
YIEWLKKNL

SEQ ID NO: 943029 - protein, 9 aa, Homo Sapiens
FGRKKTEDA

SEQ ID NO: 943030 - protein, 9 aa, Homo Sapiens
RHTLTSRIL

SEQ ID NO: 943031 - protein, 9 aa, Homo Sapiens
LTAKNVTFG

SEQ ID NO: 943032 - protein, 9 aa, Homo Sapiens
ISSLFSCFS

SEQ ID NO: 943033 - protein, 9 aa, Homo Sapiens
HFSRVTTVS

SEQ ID NO: 943034 - protein, 9 aa, Homo Sapiens
KNIPIPPIK

SEQ ID NO: 943035 - protein, 9 aa, Homo Sapiens
ADSSHFELL

SEQ ID NO: 943036 - protein, 9 aa, Homo Sapiens
EEKRDPNKP

SEQ ID NO: 943037 - protein, 9 aa, Homo Sapiens
IRFLQQQMP

SEQ ID NO: 943038 - protein, 9 aa, Homo Sapiens
QCHLLNNGL

SEQ ID NO: 943039 - protein, 9 aa, Homo Sapiens
IVLIISLNL

SEQ ID NO: 943040 - protein, 9 aa, Homo Sapiens
DNSIPNHVV

SEQ ID NO: 943041 - protein, 9 aa, Homo Sapiens
IWCSCVAGQ

SEQ ID NO: 943042 - protein, 9 aa, Homo Sapiens
YSQLPLESL

SEQ ID NO: 943043 - protein, 9 aa, Homo Sapiens
CGILVFFLE

SEQ ID NO: 943044 - protein, 9 aa, Homo Sapiens
SHEQSVHLF

SEQ ID NO: 943045 - protein, 9 aa, Homo Sapiens
GPRGASKAL

SEQ ID NO: 943046 - protein, 9 aa, Homo Sapiens
QRALQVSSP

SEQ ID NO: 943047 - protein, 9 aa, Homo Sapiens
SERFLVNQL

SEQ ID NO: 943048 - protein, 9 aa, Homo Sapiens
PINSQLKLY

SEQ ID NO: 943049 - protein, 9 aa, Homo Sapiens
RASTKKKSR

SEQ ID NO: 943050 - protein, 9 aa, Homo Sapiens
VVFFMDQTE

SEQ ID NO: 943051 - protein, 9 aa, Homo Sapiens
YPIILLFSN

SEQ ID NO: 943052 - protein, 9 aa, Homo Sapiens
EEDSERIQG

SEQ ID NO: 943053 - protein, 9 aa, Homo Sapiens
TFSFCRNPI

SEQ ID NO: 943054 - protein, 9 aa, Homo Sapiens
LTSPQPWPR

SEQ ID NO: 943055 - protein, 9 aa, Homo Sapiens
RLQERVLFH

SEQ ID NO: 943056 - protein, 9 aa, Homo Sapiens
MYDEIKSQG

SEQ ID NO: 943057 - protein, 9 aa, Homo Sapiens
TFNSSWASP

SEQ ID NO: 943058 - protein, 9 aa, Homo Sapiens
NIEERGDMS

SEQ ID NO: 943059 - protein, 9 aa, Homo Sapiens
LALLRANTD

SEQ ID NO: 943060 - protein, 9 aa, Homo Sapiens
DKFPGQSFF

SEQ ID NO: 943061 - protein, 9 aa, Homo Sapiens
VIILLRAMA

SEQ ID NO: 943062 - protein, 9 aa, Homo Sapiens
TTVFSLLMT

SEQ ID NO: 943063 - protein, 9 aa, Homo Sapiens
ALQPPGRVP

SEQ ID NO: 943064 - protein, 9 aa, Homo Sapiens
THRINLPPF

SEQ ID NO: 943065 - protein, 9 aa, Homo Sapiens
GFPHSSRRC

SEQ ID NO: 943066 - protein, 9 aa, Homo Sapiens
EKEEEEDEE

SEQ ID NO: 943067 - protein, 9 aa, Homo Sapiens
ICARLQGWK

SEQ ID NO: 943068 - protein, 9 aa, Homo Sapiens
KQEGIFCVN

SEQ ID NO: 943069 - protein, 9 aa, Homo Sapiens
CKSVFVMEV

SEQ ID NO: 943070 - protein, 9 aa, Homo Sapiens
DLFCSKNLS

SEQ ID NO: 943071 - protein, 9 aa, Homo Sapiens
YIKEAHPSD

SEQ ID NO: 943072 - protein, 9 aa, Homo Sapiens
PAVLHSVPQ

SEQ ID NO: 943073 - protein, 9 aa, Homo Sapiens
CFPNLIFSF

SEQ ID NO: 943074 - protein, 9 aa, Homo Sapiens
FTKWINDTI

SEQ ID NO: 943075 - protein, 9 aa, Homo Sapiens
LQRKESLDF

SEQ ID NO: 943076 - protein, 9 aa, Homo Sapiens
AEGLGGAPS

SEQ ID NO: 943077 - protein, 9 aa, Homo Sapiens
EKVLLTGLV

SEQ ID NO: 943078 - protein, 9 aa, Homo Sapiens
VYFKEKWKT

SEQ ID NO: 943079 - protein, 9 aa, Homo Sapiens
LETSLRLIR

SEQ ID NO: 943080 - protein, 9 aa, Homo Sapiens
TPWRDYISI

SEQ ID NO: 943081 - protein, 9 aa, Homo Sapiens
VAKEFCSAN

SEQ ID NO: 943082 - protein, 9 aa, Homo Sapiens
ARPGLIEIL

SEQ ID NO: 943083 - protein, 9 aa, Homo Sapiens
KKKYMELEI

SEQ ID NO: 943084 - protein, 9 aa, Homo Sapiens
MAIDTLNSN

SEQ ID NO: 943085 - protein, 9 aa, Homo Sapiens
KCYSSKRLF

SEQ ID NO: 943086 - protein, 9 aa, Homo Sapiens
RACLKIFMT

SEQ ID NO: 943087 - protein, 9 aa, Homo Sapiens
QITCGSDSF

SEQ ID NO: 943088 - protein, 9 aa, Homo Sapiens
KVRVPRQSF

SEQ ID NO: 943089 - protein, 9 aa, Homo Sapiens
LTLDKADAT

SEQ ID NO: 943090 - protein, 9 aa, Homo Sapiens
SKETPESDR

SEQ ID NO: 943091 - protein, 9 aa, Homo Sapiens
DFKINILLK

SEQ ID NO: 943092 - protein, 9 aa, Homo Sapiens
DAVRVSWAN

SEQ ID NO: 943093 - protein, 9 aa, Homo Sapiens
HKAVKAIAL

SEQ ID NO: 943094 - protein, 9 aa, Homo Sapiens
TKDTLLASF

SEQ ID NO: 943095 - protein, 9 aa, Homo Sapiens
AFSTCAFHL

SEQ ID NO: 943096 - protein, 9 aa, Homo Sapiens
MLLSAATPK

SEQ ID NO: 943097 - protein, 9 aa, Homo Sapiens
KRENKNLQK

SEQ ID NO: 943098 - protein, 9 aa, Homo Sapiens
VSLRPQRSI

SEQ ID NO: 943099 - protein, 9 aa, Homo Sapiens
KVAERPFGE

SEQ ID NO: 943100 - protein, 9 aa, Homo Sapiens
SEAESFSGG

SEQ ID NO: 943101 - protein, 9 aa, Homo Sapiens
LWWEWYHPQ

SEQ ID NO: 943102 - protein, 9 aa, Homo Sapiens
NGVVEVPFL

SEQ ID NO: 943103 - protein, 9 aa, Homo Sapiens
GTRELEALS

SEQ ID NO: 943104 - protein, 9 aa, Homo Sapiens
PWEEGLYAV

SEQ ID NO: 943105 - protein, 9 aa, Homo Sapiens
FTREGSFGV

SEQ ID NO: 943106 - protein, 9 aa, Homo Sapiens
TVVSFHQVN

SEQ ID NO: 943107 - protein, 9 aa, Homo Sapiens
VQQASASSF

SEQ ID NO: 943108 - protein, 9 aa, Homo Sapiens
PLCNGENLA

SEQ ID NO: 943109 - protein, 9 aa, Homo Sapiens
TPLHFAISA

SEQ ID NO: 943110 - protein, 9 aa, Homo Sapiens
IVNGSHYKY

SEQ ID NO: 943111 - protein, 9 aa, Homo Sapiens
HSNYPYSDE

SEQ ID NO: 943112 - protein, 9 aa, Homo Sapiens
VGQDIPYAT

SEQ ID NO: 943113 - protein, 9 aa, Homo Sapiens
YYGTQHKIK

SEQ ID NO: 943114 - protein, 9 aa, Homo Sapiens
VDGNVRLYF

SEQ ID NO: 943115 - protein, 9 aa, Homo Sapiens
DRVRLSNSR

SEQ ID NO: 943116 - protein, 9 aa, Homo Sapiens
AKFIPWEEG

SEQ ID NO: 943117 - protein, 9 aa, Homo Sapiens
QYVSCINPT

SEQ ID NO: 943118 - protein, 9 aa, Homo Sapiens
FTPECKFKK

SEQ ID NO: 943119 - protein, 9 aa, Homo Sapiens
TGLEGDAHF

SEQ ID NO: 943120 - protein, 9 aa, Homo Sapiens
NMSEELVVL

SEQ ID NO: 943121 - protein, 9 aa, Homo Sapiens
ASASLYGAS

SEQ ID NO: 943122 - protein, 9 aa, Homo Sapiens
ILYRFFYED

SEQ ID NO: 943123 - protein, 9 aa, Homo Sapiens
VNSNNNRGV

SEQ ID NO: 943124 - protein, 9 aa, Homo Sapiens
FFFLQREGM

SEQ ID NO: 943125 - protein, 9 aa, Homo Sapiens
GPKPRAAPS

SEQ ID NO: 943126 - protein, 9 aa, Homo Sapiens
FFVKVEMFS

SEQ ID NO: 943127 - protein, 9 aa, Homo Sapiens
KEGSWYIQS

SEQ ID NO: 943128 - protein, 9 aa, Homo Sapiens
SKRIEPSVF

SEQ ID NO: 943129 - protein, 9 aa, Homo Sapiens
KESFWIPAT

SEQ ID NO: 943130 - protein, 9 aa, Homo Sapiens
SWLSLLKDG

SEQ ID NO: 943131 - protein, 9 aa, Homo Sapiens
YDLDHNVKF

SEQ ID NO: 943132 - protein, 9 aa, Homo Sapiens
LSNALRYFP

SEQ ID NO: 943133 - protein, 9 aa, Homo Sapiens
KSKSPFPPR

SEQ ID NO: 943134 - protein, 9 aa, Homo Sapiens
HHHCINCVH

SEQ ID NO: 943135 - protein, 9 aa, Homo Sapiens
LSQLEGLDP

SEQ ID NO: 943136 - protein, 9 aa, Homo Sapiens
APCRPCLGA

SEQ ID NO: 943137 - protein, 9 aa, Homo Sapiens
KLFFFLQRE

SEQ ID NO: 943138 - protein, 9 aa, Homo Sapiens
RKKDCPRVI

SEQ ID NO: 943139 - protein, 9 aa, Homo Sapiens
TLNGDISFH

SEQ ID NO: 943140 - protein, 9 aa, Homo Sapiens
EMIPFEVLT

SEQ ID NO: 943141 - protein, 9 aa, Homo Sapiens
PDSYRSPFA

SEQ ID NO: 943142 - protein, 9 aa, Homo Sapiens
PGFEPGPPA

SEQ ID NO: 943143 - protein, 9 aa, Homo Sapiens
IDPNDMMRE

SEQ ID NO: 943144 - protein, 9 aa, Homo Sapiens
ISCWPFSVP

SEQ ID NO: 943145 - protein, 9 aa, Homo Sapiens
PMRVVNDED

SEQ ID NO: 943146 - protein, 9 aa, Homo Sapiens
FISHSSGSE

SEQ ID NO: 943147 - protein, 9 aa, Homo Sapiens
GINEELSYS

SEQ ID NO: 943148 - protein, 9 aa, Homo Sapiens
PAEGDRGPR

SEQ ID NO: 943149 - protein, 9 aa, Homo Sapiens
LIVSETKLK

SEQ ID NO: 943150 - protein, 9 aa, Homo Sapiens
SSQQVHPEN

SEQ ID NO: 943151 - protein, 9 aa, Homo Sapiens
PAKALKSVA

SEQ ID NO: 943152 - protein, 9 aa, Homo Sapiens
SEYVVKPRQ

SEQ ID NO: 943153 - protein, 9 aa, Homo Sapiens
KSGIIKQQR

SEQ ID NO: 943154 - protein, 9 aa, Homo Sapiens
GWGLCEVLL

SEQ ID NO: 943155 - protein, 9 aa, Homo Sapiens
CVLMVERSG

SEQ ID NO: 943156 - protein, 9 aa, Homo Sapiens
NIWKEVVDW

SEQ ID NO: 943157 - protein, 9 aa, Homo Sapiens
HKCSVKHDD

SEQ ID NO: 943158 - protein, 9 aa, Homo Sapiens
SRRSNSGMD

SEQ ID NO: 943159 - protein, 9 aa, Homo Sapiens
RFYSSPDIT

SEQ ID NO: 943160 - protein, 9 aa, Homo Sapiens
QPEFNVYLK

SEQ ID NO: 943161 - protein, 9 aa, Homo Sapiens
KLLARASTK

SEQ ID NO: 943162 - protein, 9 aa, Homo Sapiens
SDKYNVPIL

SEQ ID NO: 943163 - protein, 9 aa, Homo Sapiens
RFRRDSKEK

SEQ ID NO: 943164 - protein, 9 aa, Homo Sapiens
CYNKFVPCK

SEQ ID NO: 943165 - protein, 9 aa, Homo Sapiens
IYGLHYNPK

SEQ ID NO: 943166 - protein, 9 aa, Homo Sapiens
HCSCPRAFI

SEQ ID NO: 943167 - protein, 9 aa, Homo Sapiens
YPEQEKTTK

SEQ ID NO: 943168 - protein, 9 aa, Homo Sapiens
CQLRAQKQQ

SEQ ID NO: 943169 - protein, 9 aa, Homo Sapiens
ELLLGAFSP

SEQ ID NO: 943170 - protein, 9 aa, Homo Sapiens
TPVTNKETE

SEQ ID NO: 943171 - protein, 9 aa, Homo Sapiens
KNCDPPCVS

SEQ ID NO: 943172 - protein, 9 aa, Homo Sapiens
NSLGEVVMR

SEQ ID NO: 943173 - protein, 9 aa, Homo Sapiens
NQLLMYQAQ

SEQ ID NO: 943174 - protein, 9 aa, Homo Sapiens
WSLAKLIQA

SEQ ID NO: 943175 - protein, 9 aa, Homo Sapiens
YFFRHREQK

SEQ ID NO: 943176 - protein, 9 aa, Homo Sapiens
LQEELKKLR

SEQ ID NO: 943177 - protein, 9 aa, Homo Sapiens
TFLERVKNL

SEQ ID NO: 943178 - protein, 9 aa, Homo Sapiens
EELLGSGPS

SEQ ID NO: 943179 - protein, 9 aa, Homo Sapiens
IRDVLQKLS

SEQ ID NO: 943180 - protein, 9 aa, Homo Sapiens
SEFVLHRLC

SEQ ID NO: 943181 - protein, 9 aa, Homo Sapiens
ELQPRIDPF

SEQ ID NO: 943182 - protein, 9 aa, Homo Sapiens
SATFQRHPM

SEQ ID NO: 943183 - protein, 9 aa, Homo Sapiens
TSVPLWMIA

SEQ ID NO: 943184 - protein, 9 aa, Homo Sapiens
SFGTLYSFF

SEQ ID NO: 943185 - protein, 9 aa, Homo Sapiens
TLESKGLYI

SEQ ID NO: 943186 - protein, 9 aa, Homo Sapiens
RPSIHPVLS

SEQ ID NO: 943187 - protein, 9 aa, Homo Sapiens
LAFQDIEAC

SEQ ID NO: 943188 - protein, 9 aa, Homo Sapiens
DQLPSFPEN

SEQ ID NO: 943189 - protein, 9 aa, Homo Sapiens
VFFMDQTES

SEQ ID NO: 943190 - protein, 9 aa, Homo Sapiens
STETTEISS

SEQ ID NO: 943191 - protein, 9 aa, Homo Sapiens
RRLYLQENP

SEQ ID NO: 943192 - protein, 9 aa, Homo Sapiens
FFFFFVLCQ

SEQ ID NO: 943193 - protein, 9 aa, Homo Sapiens
GILFGIVGA

SEQ ID NO: 943194 - protein, 9 aa, Homo Sapiens
RPPLSGDRA

SEQ ID NO: 943195 - protein, 9 aa, Homo Sapiens
PGIRSSKES

SEQ ID NO: 943196 - protein, 9 aa, Homo Sapiens
GDNASEEKK

SEQ ID NO: 943197 - protein, 9 aa, Homo Sapiens
QTPGYEMNL

SEQ ID NO: 943198 - protein, 9 aa, Homo Sapiens
LLISYSICR

SEQ ID NO: 943199 - protein, 9 aa, Homo Sapiens
RTPSGDADP

SEQ ID NO: 943200 - protein, 9 aa, Homo Sapiens
KRTAKNVIG

SEQ ID NO: 943201 - protein, 9 aa, Homo Sapiens
KKEYFQEVG

SEQ ID NO: 943202 - protein, 9 aa, Homo Sapiens
ETAVVTSSE

SEQ ID NO: 943203 - protein, 9 aa, Homo Sapiens
FRTWPDLGV

SEQ ID NO: 943204 - protein, 9 aa, Homo Sapiens
LPDRPAGSW

SEQ ID NO: 943205 - protein, 9 aa, Homo Sapiens
NSKQYKIFK

SEQ ID NO: 943206 - protein, 9 aa, Homo Sapiens
GSLFWFAVP

SEQ ID NO: 943207 - protein, 9 aa, Homo Sapiens
QCISSRWIC

SEQ ID NO: 943208 - protein, 9 aa, Homo Sapiens
EGIVRQVRF

SEQ ID NO: 943209 - protein, 9 aa, Homo Sapiens
ATNFQLEVT

SEQ ID NO: 943210 - protein, 9 aa, Homo Sapiens
LKEELEKAR

SEQ ID NO: 943211 - protein, 9 aa, Homo Sapiens
EPHVEEHLK

SEQ ID NO: 943212 - protein, 9 aa, Homo Sapiens
SPAQSSLEE

SEQ ID NO: 943213 - protein, 9 aa, Homo Sapiens
LTTGSGLRE

SEQ ID NO: 943214 - protein, 9 aa, Homo Sapiens
PAHADIKTS

SEQ ID NO: 943215 - protein, 9 aa, Homo Sapiens
EYYSPIFDQ

SEQ ID NO: 943216 - protein, 9 aa, Homo Sapiens
QRANFLGDL

SEQ ID NO: 943217 - protein, 9 aa, Homo Sapiens
LKGLLPLGP

SEQ ID NO: 943218 - protein, 9 aa, Homo Sapiens
EKRTLLVRL

SEQ ID NO: 943219 - protein, 9 aa, Homo Sapiens
LLGASLGGI

SEQ ID NO: 943220 - protein, 9 aa, Homo Sapiens
YKFPEPRNL

SEQ ID NO: 943221 - protein, 9 aa, Homo Sapiens
PNPPPPPLR

SEQ ID NO: 943222 - protein, 9 aa, Homo Sapiens
LVKGHPQEN

SEQ ID NO: 943223 - protein, 9 aa, Homo Sapiens
PQKLLETRA

SEQ ID NO: 943224 - protein, 9 aa, Homo Sapiens
KHHSAKKFL

SEQ ID NO: 943225 - protein, 9 aa, Homo Sapiens
FPGQSFFLW

SEQ ID NO: 943226 - protein, 9 aa, Homo Sapiens
NSFDLTKVW

SEQ ID NO: 943227 - protein, 9 aa, Homo Sapiens
RADMSWQQK

SEQ ID NO: 943228 - protein, 9 aa, Homo Sapiens
PPNVSLDAT

SEQ ID NO: 943229 - protein, 9 aa, Homo Sapiens
QEFFLSKSK

SEQ ID NO: 943230 - protein, 9 aa, Homo Sapiens
GEGSVRSAT

SEQ ID NO: 943231 - protein, 9 aa, Homo Sapiens
DMPRSAEYF

SEQ ID NO: 943232 - protein, 9 aa, Homo Sapiens
GTSEKDCPC

SEQ ID NO: 943233 - protein, 9 aa, Homo Sapiens
YKIKAGGSI

SEQ ID NO: 943234 - protein, 9 aa, Homo Sapiens
RLNLDCWKR

SEQ ID NO: 943235 - protein, 9 aa, Homo Sapiens
LMPPISSVL

SEQ ID NO: 943236 - protein, 9 aa, Homo Sapiens
EGSLSPVKS

SEQ ID NO: 943237 - protein, 9 aa, Homo Sapiens
AVIARNGKI

SEQ ID NO: 943238 - protein, 9 aa, Homo Sapiens
EELTTGSGL

SEQ ID NO: 943239 - protein, 9 aa, Homo Sapiens
SGIYVNLYY

SEQ ID NO: 943240 - protein, 9 aa, Homo Sapiens
DKDNKMCAT

SEQ ID NO: 943241 - protein, 9 aa, Homo Sapiens
QQAFALSIL

SEQ ID NO: 943242 - protein, 9 aa, Homo Sapiens
ILENLPEIT

SEQ ID NO: 943243 - protein, 9 aa, Homo Sapiens
DGLIIITTP

SEQ ID NO: 943244 - protein, 9 aa, Homo Sapiens
FQETLHLKV

SEQ ID NO: 943245 - protein, 9 aa, Homo Sapiens
EWPEKQPLL

SEQ ID NO: 943246 - protein, 9 aa, Homo Sapiens
QQFLHLHSG

SEQ ID NO: 943247 - protein, 9 aa, Homo Sapiens
KKAIKRREA

SEQ ID NO: 943248 - protein, 9 aa, Homo Sapiens
GLSPGASDA

SEQ ID NO: 943249 - protein, 9 aa, Homo Sapiens
KNAYEKSLD

SEQ ID NO: 943250 - protein, 9 aa, Homo Sapiens
SGFPHSSRR

SEQ ID NO: 943251 - protein, 9 aa, Homo Sapiens
PEVPTEDVE

SEQ ID NO: 943252 - protein, 9 aa, Homo Sapiens
CINPMYQFS

SEQ ID NO: 943253 - protein, 9 aa, Homo Sapiens
NGNCCGGVR

SEQ ID NO: 943254 - protein, 9 aa, Homo Sapiens
PAPKQKVAL

SEQ ID NO: 943255 - protein, 9 aa, Homo Sapiens
RSPPLEIKF

SEQ ID NO: 943256 - protein, 9 aa, Homo Sapiens
IVDSVYYDA

SEQ ID NO: 943257 - protein, 9 aa, Homo Sapiens
DSRRLEPKP

SEQ ID NO: 943258 - protein, 9 aa, Homo Sapiens
GYWTRNVDA

SEQ ID NO: 943259 - protein, 9 aa, Homo Sapiens
VFIAINKEL

SEQ ID NO: 943260 - protein, 9 aa, Homo Sapiens
SSLEKHKER

SEQ ID NO: 943261 - protein, 9 aa, Homo Sapiens
LHWVNQLAQ

SEQ ID NO: 943262 - protein, 9 aa, Homo Sapiens
PVEKQLALS

SEQ ID NO: 943263 - protein, 9 aa, Homo Sapiens
RLYTLERYH

SEQ ID NO: 943264 - protein, 9 aa, Homo Sapiens
LREGKKKCV

SEQ ID NO: 943265 - protein, 9 aa, Homo Sapiens
SLSPDVCRK

SEQ ID NO: 943266 - protein, 9 aa, Homo Sapiens
GLFPSPTSA

SEQ ID NO: 943267 - protein, 9 aa, Homo Sapiens
SYSRSPLYP

SEQ ID NO: 943268 - protein, 9 aa, Homo Sapiens
PLAQKPPAS

SEQ ID NO: 943269 - protein, 9 aa, Homo Sapiens
LHSGWEQQF

SEQ ID NO: 943270 - protein, 9 aa, Homo Sapiens
QENPLSCCG

SEQ ID NO: 943271 - protein, 9 aa, Homo Sapiens
ETFTIKSDV

SEQ ID NO: 943272 - protein, 9 aa, Homo Sapiens
YQRIKGFPS

SEQ ID NO: 943273 - protein, 9 aa, Homo Sapiens
FSTTSFLNK

SEQ ID NO: 943274 - protein, 9 aa, Homo Sapiens
EPVFHILRD

SEQ ID NO: 943275 - protein, 9 aa, Homo Sapiens
YSIISNLDK

SEQ ID NO: 943276 - protein, 9 aa, Homo Sapiens
LPAPEIRCS

SEQ ID NO: 943277 - protein, 9 aa, Homo Sapiens
LYPRRGRGK

SEQ ID NO: 943278 - protein, 9 aa, Homo Sapiens
QESLQEEKG

SEQ ID NO: 943279 - protein, 9 aa, Homo Sapiens
MAAETAKKL

SEQ ID NO: 943280 - protein, 9 aa, Homo Sapiens
SSREHVLLG

SEQ ID NO: 943281 - protein, 9 aa, Homo Sapiens
RKFLKSIVM

SEQ ID NO: 943282 - protein, 9 aa, Homo Sapiens
SYNHFAVIY

SEQ ID NO: 943283 - protein, 9 aa, Homo Sapiens
SRDHHHLHK

SEQ ID NO: 943284 - protein, 9 aa, Homo Sapiens
MPRSAEYFM

SEQ ID NO: 943285 - protein, 9 aa, Homo Sapiens
GRTLIFSTH

SEQ ID NO: 943286 - protein, 9 aa, Homo Sapiens
VDYELLMKS

SEQ ID NO: 943287 - protein, 9 aa, Homo Sapiens
FYINPEKGD

SEQ ID NO: 943288 - protein, 9 aa, Homo Sapiens
LLREQKGEL

SEQ ID NO: 943289 - protein, 9 aa, Homo Sapiens
GSETLEPFA

SEQ ID NO: 943290 - protein, 9 aa, Homo Sapiens
WDLGGGAER

SEQ ID NO: 943291 - protein, 9 aa, Homo Sapiens
QNGTSTLRE

SEQ ID NO: 943292 - protein, 9 aa, Homo Sapiens
VLTPDDVWI

SEQ ID NO: 943293 - protein, 9 aa, Homo Sapiens
HYDQQIGQK

SEQ ID NO: 943294 - protein, 9 aa, Homo Sapiens
VLKIAMIVL

SEQ ID NO: 943295 - protein, 9 aa, Homo Sapiens
RRLKKVQGI

SEQ ID NO: 943296 - protein, 9 aa, Homo Sapiens
VYVVTFQEP

SEQ ID NO: 943297 - protein, 9 aa, Homo Sapiens
VELSTASDP

SEQ ID NO: 943298 - protein, 9 aa, Homo Sapiens
YWSYVLHRS

SEQ ID NO: 943299 - protein, 9 aa, Homo Sapiens
PLAMRLPIY

SEQ ID NO: 943300 - protein, 9 aa, Homo Sapiens
ATLSATFQR

SEQ ID NO: 943301 - protein, 9 aa, Homo Sapiens
GCSPLSYRS

SEQ ID NO: 943302 - protein, 9 aa, Homo Sapiens
MASCTSVPL

SEQ ID NO: 943303 - protein, 9 aa, Homo Sapiens
REVSPPVGA

SEQ ID NO: 943304 - protein, 9 aa, Homo Sapiens
STGPFLELC

SEQ ID NO: 943305 - protein, 9 aa, Homo Sapiens
TLESQLFSI

SEQ ID NO: 943306 - protein, 9 aa, Homo Sapiens
ALSLRMARR

SEQ ID NO: 943307 - protein, 9 aa, Homo Sapiens
GLLPPNLSA

SEQ ID NO: 943308 - protein, 9 aa, Homo Sapiens
VLSGDPGPK

SEQ ID NO: 943309 - protein, 9 aa, Homo Sapiens
FWAITIFNN

SEQ ID NO: 943310 - protein, 9 aa, Homo Sapiens
GDPFIIIYS

SEQ ID NO: 943311 - protein, 9 aa, Homo Sapiens
ISFHRPRPR

SEQ ID NO: 943312 - protein, 9 aa, Homo Sapiens
AASPSLSQP

SEQ ID NO: 943313 - protein, 9 aa, Homo Sapiens
NMLCSKCVH

SEQ ID NO: 943314 - protein, 9 aa, Homo Sapiens
PLRLTPVKC

SEQ ID NO: 943315 - protein, 9 aa, Homo Sapiens
ESRAQLSFL

SEQ ID NO: 943316 - protein, 9 aa, Homo Sapiens
TLDHFETIM

SEQ ID NO: 943317 - protein, 9 aa, Homo Sapiens
SENAVLILL

SEQ ID NO: 943318 - protein, 9 aa, Homo Sapiens
LVMDDKIES

SEQ ID NO: 943319 - protein, 9 aa, Homo Sapiens
KPINLDSCL

SEQ ID NO: 943320 - protein, 9 aa, Homo Sapiens
PDPEIYWVT

SEQ ID NO: 943321 - protein, 9 aa, Homo Sapiens
LYWTDWGDY

SEQ ID NO: 943322 - protein, 9 aa, Homo Sapiens
RIDPFLGQQ

SEQ ID NO: 943323 - protein, 9 aa, Homo Sapiens
TYVDVVDGE

SEQ ID NO: 943324 - protein, 9 aa, Homo Sapiens
VEELVGKLA

SEQ ID NO: 943325 - protein, 9 aa, Homo Sapiens
SFLNWEFAR

SEQ ID NO: 943326 - protein, 9 aa, Homo Sapiens
RDSLKEIIE

SEQ ID NO: 943327 - protein, 9 aa, Homo Sapiens
DSVWIEMDD

SEQ ID NO: 943328 - protein, 9 aa, Homo Sapiens
TDDITIDKP

SEQ ID NO: 943329 - protein, 9 aa, Homo Sapiens
MTLDWKVPK

SEQ ID NO: 943330 - protein, 9 aa, Homo Sapiens
FLSQMEKQS

SEQ ID NO: 943331 - protein, 9 aa, Homo Sapiens
RRVPQNWFS

SEQ ID NO: 943332 - protein, 9 aa, Homo Sapiens
YQRVDKALP

SEQ ID NO: 943333 - protein, 9 aa, Homo Sapiens
PQWEVEELS

SEQ ID NO: 943334 - protein, 9 aa, Homo Sapiens
ETFSLDAAN

SEQ ID NO: 943335 - protein, 9 aa, Homo Sapiens
LSSCDSSDT

SEQ ID NO: 943336 - protein, 9 aa, Homo Sapiens
ESLQEEKGK

SEQ ID NO: 943337 - protein, 9 aa, Homo Sapiens
EETLSQDEE

SEQ ID NO: 943338 - protein, 9 aa, Homo Sapiens
VSERLRGGR

SEQ ID NO: 943339 - protein, 9 aa, Homo Sapiens
SPFASRYAS

SEQ ID NO: 943340 - protein, 9 aa, Homo Sapiens
YLHTLYLLD

SEQ ID NO: 943341 - protein, 9 aa, Homo Sapiens
MQKKITALA

SEQ ID NO: 943342 - protein, 9 aa, Homo Sapiens
KCIPMDFQC

SEQ ID NO: 943343 - protein, 9 aa, Homo Sapiens
KFLKRDMDR

SEQ ID NO: 943344 - protein, 9 aa, Homo Sapiens
FSLLVFGPS

SEQ ID NO: 943345 - protein, 9 aa, Homo Sapiens
LELKKLLHG

SEQ ID NO: 943346 - protein, 9 aa, Homo Sapiens
ETVSRNKRR

SEQ ID NO: 943347 - protein, 9 aa, Homo Sapiens
VRLSNSRGS

SEQ ID NO: 943348 - protein, 9 aa, Homo Sapiens
FLPSVPSTE

SEQ ID NO: 943349 - protein, 9 aa, Homo Sapiens
WEERSGMTT

SEQ ID NO: 943350 - protein, 9 aa, Homo Sapiens
FHPKFRHNC

SEQ ID NO: 943351 - protein, 9 aa, Homo Sapiens
QHHLHRTEG

SEQ ID NO: 943352 - protein, 9 aa, Homo Sapiens
SLTYHQKIY

SEQ ID NO: 943353 - protein, 9 aa, Homo Sapiens
LSLGEAPRG

SEQ ID NO: 943354 - protein, 9 aa, Homo Sapiens
ECREKQSQS

SEQ ID NO: 943355 - protein, 9 aa, Homo Sapiens
SWIINNLMS

SEQ ID NO: 943356 - protein, 9 aa, Homo Sapiens
EKRTEESLP

SEQ ID NO: 943357 - protein, 9 aa, Homo Sapiens
CALLHQTLY

SEQ ID NO: 943358 - protein, 9 aa, Homo Sapiens
VSFLVKPGL

SEQ ID NO: 943359 - protein, 9 aa, Homo Sapiens
ETGITTDQL

SEQ ID NO: 943360 - protein, 9 aa, Homo Sapiens
SLQQRGQAS

SEQ ID NO: 943361 - protein, 9 aa, Homo Sapiens
LAFVMEPRQ

SEQ ID NO: 943362 - protein, 9 aa, Homo Sapiens
LLENLHWGP

SEQ ID NO: 943363 - protein, 9 aa, Homo Sapiens
SQIKNGKLI

SEQ ID NO: 943364 - protein, 9 aa, Homo Sapiens
TTPFPVTDA

SEQ ID NO: 943365 - protein, 9 aa, Homo Sapiens
MGVGLFGPP

SEQ ID NO: 943366 - protein, 9 aa, Homo Sapiens
SARGMEYTL

SEQ ID NO: 943367 - protein, 9 aa, Homo Sapiens
VDFEDITYL

SEQ ID NO: 943368 - protein, 9 aa, Homo Sapiens
LHAEPLESR

SEQ ID NO: 943369 - protein, 9 aa, Homo Sapiens
LSPLKPPRI

SEQ ID NO: 943370 - protein, 9 aa, Homo Sapiens
ALQFLENEH

SEQ ID NO: 943371 - protein, 9 aa, Homo Sapiens
ATRVGILKT

SEQ ID NO: 943372 - protein, 9 aa, Homo Sapiens
PKQFDVFFR

SEQ ID NO: 943373 - protein, 9 aa, Homo Sapiens
ILLISYSIC

SEQ ID NO: 943374 - protein, 9 aa, Homo Sapiens
FLLRLAGLN

SEQ ID NO: 943375 - protein, 9 aa, Homo Sapiens
RSRSSSPSP

SEQ ID NO: 943376 - protein, 9 aa, Homo Sapiens
KIGKGNLGG

SEQ ID NO: 943377 - protein, 9 aa, Homo Sapiens
LNAIPILYY

SEQ ID NO: 943378 - protein, 9 aa, Homo Sapiens
QCTINKNRR

SEQ ID NO: 943379 - protein, 9 aa, Homo Sapiens
SDGLIIITT

SEQ ID NO: 943380 - protein, 9 aa, Homo Sapiens
KSDTIADLP

SEQ ID NO: 943381 - protein, 9 aa, Homo Sapiens
GREHFIYGN

SEQ ID NO: 943382 - protein, 9 aa, Homo Sapiens
NSEQNLNSA

SEQ ID NO: 943383 - protein, 9 aa, Homo Sapiens
TVEVLLSDK

SEQ ID NO: 943384 - protein, 9 aa, Homo Sapiens
AARPPLSGD

SEQ ID NO: 943385 - protein, 9 aa, Homo Sapiens
TMKAKSTVC

SEQ ID NO: 943386 - protein, 9 aa, Homo Sapiens
NAQLHLSRM

SEQ ID NO: 943387 - protein, 9 aa, Homo Sapiens
VQPPPPDNP

SEQ ID NO: 943388 - protein, 9 aa, Homo Sapiens
PTFSWDEDP

SEQ ID NO: 943389 - protein, 9 aa, Homo Sapiens
PKPAWFCQS

SEQ ID NO: 943390 - protein, 9 aa, Homo Sapiens
VWGSPWVSV

SEQ ID NO: 943391 - protein, 9 aa, Homo Sapiens
RRKKGPFRQ

SEQ ID NO: 943392 - protein, 9 aa, Homo Sapiens
ADVRAFTYC

SEQ ID NO: 943393 - protein, 9 aa, Homo Sapiens
DMMEEEASE

SEQ ID NO: 943394 - protein, 9 aa, Homo Sapiens
FAVGYSSYD

SEQ ID NO: 943395 - protein, 9 aa, Homo Sapiens
VQPHAHLQS

SEQ ID NO: 943396 - protein, 9 aa, Homo Sapiens
EDSAQVLIR

SEQ ID NO: 943397 - protein, 9 aa, Homo Sapiens
DYRWAVFSV

SEQ ID NO: 943398 - protein, 9 aa, Homo Sapiens
ANKEVVSHP

SEQ ID NO: 943399 - protein, 9 aa, Homo Sapiens
SNVYPGERT

SEQ ID NO: 943400 - protein, 9 aa, Homo Sapiens
APPRELLMP

SEQ ID NO: 943401 - protein, 9 aa, Homo Sapiens
TFCEICLHE

SEQ ID NO: 943402 - protein, 9 aa, Homo Sapiens
RATRVGILK

SEQ ID NO: 943403 - protein, 9 aa, Homo Sapiens
TVTPLAKPK

SEQ ID NO: 943404 - protein, 9 aa, Homo Sapiens
DNDYSLAGA

SEQ ID NO: 943405 - protein, 9 aa, Homo Sapiens
ALALAAGQT

SEQ ID NO: 943406 - protein, 9 aa, Homo Sapiens
EGYFYIPPV

SEQ ID NO: 943407 - protein, 9 aa, Homo Sapiens
EGDRGPRAA

SEQ ID NO: 943408 - protein, 9 aa, Homo Sapiens
EPSREGLQK

SEQ ID NO: 943409 - protein, 9 aa, Homo Sapiens
LTWGEAAEL

SEQ ID NO: 943410 - protein, 9 aa, Homo Sapiens
LFLQYGRII

SEQ ID NO: 943411 - protein, 9 aa, Homo Sapiens
SRSHHLEMV

SEQ ID NO: 943412 - protein, 9 aa, Homo Sapiens
KKGRFSSFL

SEQ ID NO: 943413 - protein, 9 aa, Homo Sapiens
DKYNLVGAS

SEQ ID NO: 943414 - protein, 9 aa, Homo Sapiens
FGDTSDTGE

SEQ ID NO: 943415 - protein, 9 aa, Homo Sapiens
QLSENTLTI

SEQ ID NO: 943416 - protein, 9 aa, Homo Sapiens
QRSTDREEE

SEQ ID NO: 943417 - protein, 9 aa, Homo Sapiens
KEEDEWDSS

SEQ ID NO: 943418 - protein, 9 aa, Homo Sapiens
MENILIVTV

SEQ ID NO: 943419 - protein, 9 aa, Homo Sapiens
CIPMDFQCD

SEQ ID NO: 943420 - protein, 9 aa, Homo Sapiens
LERVKNLML

SEQ ID NO: 943421 - protein, 9 aa, Homo Sapiens
EEPSKEEEE

SEQ ID NO: 943422 - protein, 9 aa, Homo Sapiens
LIVSHILQS

SEQ ID NO: 943423 - protein, 9 aa, Homo Sapiens
HNLDHRGFS

SEQ ID NO: 943424 - protein, 9 aa, Homo Sapiens
ETVEFKNVS

SEQ ID NO: 943425 - protein, 9 aa, Homo Sapiens
YNQKEGHFS

SEQ ID NO: 943426 - protein, 9 aa, Homo Sapiens
VQYVSCINP

SEQ ID NO: 943427 - protein, 9 aa, Homo Sapiens
PSNITLGVR

SEQ ID NO: 943428 - protein, 9 aa, Homo Sapiens
LYTLERYHS

SEQ ID NO: 943429 - protein, 9 aa, Homo Sapiens
RKTRVHFHP

SEQ ID NO: 943430 - protein, 9 aa, Homo Sapiens
KFLKSQVAE

SEQ ID NO: 943431 - protein, 9 aa, Homo Sapiens
HFELLLRDL

SEQ ID NO: 943432 - protein, 9 aa, Homo Sapiens
GPSLKDLFN

SEQ ID NO: 943433 - protein, 9 aa, Homo Sapiens
VVVKFVNWI

SEQ ID NO: 943434 - protein, 9 aa, Homo Sapiens
ALRPSDKGT

SEQ ID NO: 943435 - protein, 9 aa, Homo Sapiens
SVQVMLDKW

SEQ ID NO: 943436 - protein, 9 aa, Homo Sapiens
MNLVQETRE

SEQ ID NO: 943437 - protein, 9 aa, Homo Sapiens
LPALGNLFS

SEQ ID NO: 943438 - protein, 9 aa, Homo Sapiens
DRGPRAARG

SEQ ID NO: 943439 - protein, 9 aa, Homo Sapiens
GLPSFAHCI

SEQ ID NO: 943440 - protein, 9 aa, Homo Sapiens
IGGPGGTEG

SEQ ID NO: 943441 - protein, 9 aa, Homo Sapiens
CHCCRDEVH

SEQ ID NO: 943442 - protein, 9 aa, Homo Sapiens
RCICFVCLD

SEQ ID NO: 943443 - protein, 9 aa, Homo Sapiens
LGYSARPSV

SEQ ID NO: 943444 - protein, 9 aa, Homo Sapiens
LFDLSHNRM

SEQ ID NO: 943445 - protein, 9 aa, Homo Sapiens
QFFEKELAA

SEQ ID NO: 943446 - protein, 9 aa, Homo Sapiens
SRNCFTEIP

SEQ ID NO: 943447 - protein, 9 aa, Homo Sapiens
AAALALLRA

SEQ ID NO: 943448 - protein, 9 aa, Homo Sapiens
KQFTQKFYL

SEQ ID NO: 943449 - protein, 9 aa, Homo Sapiens
VLSEASEPV

SEQ ID NO: 943450 - protein, 9 aa, Homo Sapiens
MTEDSAQVL

SEQ ID NO: 943451 - protein, 9 aa, Homo Sapiens
KEPSREGLQ

SEQ ID NO: 943452 - protein, 9 aa, Homo Sapiens
HPENIKVWA

SEQ ID NO: 943453 - protein, 9 aa, Homo Sapiens
RKNPPPEPS

SEQ ID NO: 943454 - protein, 9 aa, Homo Sapiens
DLSPGAIDS

SEQ ID NO: 943455 - protein, 9 aa, Homo Sapiens
NTESQSLIF

SEQ ID NO: 943456 - protein, 9 aa, Homo Sapiens
GSLENSNND

SEQ ID NO: 943457 - protein, 9 aa, Homo Sapiens
SKCVHRNKV

SEQ ID NO: 943458 - protein, 9 aa, Homo Sapiens
KEGTTEYGL

SEQ ID NO: 943459 - protein, 9 aa, Homo Sapiens
FFCEIMVVL

SEQ ID NO: 943460 - protein, 9 aa, Homo Sapiens
GLSKLPAIH

SEQ ID NO: 943461 - protein, 9 aa, Homo Sapiens
CKFYIYYSC

SEQ ID NO: 943462 - protein, 9 aa, Homo Sapiens
SCQRASSSA

SEQ ID NO: 943463 - protein, 9 aa, Homo Sapiens
LFGPRGASK

SEQ ID NO: 943464 - protein, 9 aa, Homo Sapiens
NRYNWSFIH

SEQ ID NO: 943465 - protein, 9 aa, Homo Sapiens
ADGSETLEP

SEQ ID NO: 943466 - protein, 9 aa, Homo Sapiens
QKSWFVQFS

SEQ ID NO: 943467 - protein, 9 aa, Homo Sapiens
ESEYVVKVS

SEQ ID NO: 943468 - protein, 9 aa, Homo Sapiens
LVQETREEG

SEQ ID NO: 943469 - protein, 9 aa, Homo Sapiens
REISVTSNL

SEQ ID NO: 943470 - protein, 9 aa, Homo Sapiens
KLGTDIFKN

SEQ ID NO: 943471 - protein, 9 aa, Homo Sapiens
TQARGQLKE

SEQ ID NO: 943472 - protein, 9 aa, Homo Sapiens
CEREFKPLC

SEQ ID NO: 943473 - protein, 9 aa, Homo Sapiens
PDSTGQSVN

SEQ ID NO: 943474 - protein, 9 aa, Homo Sapiens
PGPPALILF

SEQ ID NO: 943475 - protein, 9 aa, Homo Sapiens
CILCSCDPE

SEQ ID NO: 943476 - protein, 9 aa, Homo Sapiens
TVSFLVKPG

SEQ ID NO: 943477 - protein, 9 aa, Homo Sapiens
ETERADSPR

SEQ ID NO: 943478 - protein, 9 aa, Homo Sapiens
TGLVSCEHE

SEQ ID NO: 943479 - protein, 9 aa, Homo Sapiens
SPKPTAPSA

SEQ ID NO: 943480 - protein, 9 aa, Homo Sapiens
IKVTQEHYE

SEQ ID NO: 943481 - protein, 9 aa, Homo Sapiens
HSECGHKKD

SEQ ID NO: 943482 - protein, 9 aa, Homo Sapiens
GTQHKIKYK

SEQ ID NO: 943483 - protein, 9 aa, Homo Sapiens
DVVVKFVNW

SEQ ID NO: 943484 - protein, 9 aa, Homo Sapiens
YREQWSQRL

SEQ ID NO: 943485 - protein, 9 aa, Homo Sapiens
RQKKAIKRR

SEQ ID NO: 943486 - protein, 9 aa, Homo Sapiens
HPQFTIFGT

SEQ ID NO: 943487 - protein, 9 aa, Homo Sapiens
ETFKNKKHQ

SEQ ID NO: 943488 - protein, 9 aa, Homo Sapiens
RIIFCKISD

SEQ ID NO: 943489 - protein, 9 aa, Homo Sapiens
CLTCRMSLN

SEQ ID NO: 943490 - protein, 9 aa, Homo Sapiens
EDSSLASRD

SEQ ID NO: 943491 - protein, 9 aa, Homo Sapiens
AFSPKQWLP

SEQ ID NO: 943492 - protein, 9 aa, Homo Sapiens
EIYHRKPHG

SEQ ID NO: 943493 - protein, 9 aa, Homo Sapiens
RMGTSEKDC

SEQ ID NO: 943494 - protein, 9 aa, Homo Sapiens
CEKPIQNSH

SEQ ID NO: 943495 - protein, 9 aa, Homo Sapiens
EKQPLLFGI

SEQ ID NO: 943496 - protein, 9 aa, Homo Sapiens
VGIFQSMFS

SEQ ID NO: 943497 - protein, 9 aa, Homo Sapiens
GGSSKPGSP

SEQ ID NO: 943498 - protein, 9 aa, Homo Sapiens
AEDINPENE

SEQ ID NO: 943499 - protein, 9 aa, Homo Sapiens
SESEAESFS

SEQ ID NO: 943500 - protein, 9 aa, Homo Sapiens
DQHSILYTL

SEQ ID NO: 943501 - protein, 9 aa, Homo Sapiens
VSETKLKEN

SEQ ID NO: 943502 - protein, 9 aa, Homo Sapiens
SGLILPREG

SEQ ID NO: 943503 - protein, 9 aa, Homo Sapiens
SWAGREVLT

SEQ ID NO: 943504 - protein, 9 aa, Homo Sapiens
PPSLREMKE

SEQ ID NO: 943505 - protein, 9 aa, Homo Sapiens
SNQKGALQT

SEQ ID NO: 943506 - protein, 9 aa, Homo Sapiens
GSSKPGSPR

SEQ ID NO: 943507 - protein, 9 aa, Homo Sapiens
YASRRVCFR

SEQ ID NO: 943508 - protein, 9 aa, Homo Sapiens
VLNKSKTIF

SEQ ID NO: 943509 - protein, 9 aa, Homo Sapiens
SYFPDFAVV

SEQ ID NO: 943510 - protein, 9 aa, Homo Sapiens
SGYSHTQEN

SEQ ID NO: 943511 - protein, 9 aa, Homo Sapiens
SWGLPRTIE

SEQ ID NO: 943512 - protein, 9 aa, Homo Sapiens
WLIRTYWNF

SEQ ID NO: 943513 - protein, 9 aa, Homo Sapiens
ASLSKIQNA

SEQ ID NO: 943514 - protein, 9 aa, Homo Sapiens
FFLWQRGRK

SEQ ID NO: 943515 - protein, 9 aa, Homo Sapiens
FSNIANIPR

SEQ ID NO: 943516 - protein, 9 aa, Homo Sapiens
SGPAIFRIN

SEQ ID NO: 943517 - protein, 9 aa, Homo Sapiens
VGPVGPREP

SEQ ID NO: 943518 - protein, 9 aa, Homo Sapiens
FFLVQKSPP

SEQ ID NO: 943519 - protein, 9 aa, Homo Sapiens
LDALLTHRA

SEQ ID NO: 943520 - protein, 9 aa, Homo Sapiens
PPQGPVFFP

SEQ ID NO: 943521 - protein, 9 aa, Homo Sapiens
RKSGKNGPH

SEQ ID NO: 943522 - protein, 9 aa, Homo Sapiens
EEIDFLCSN

SEQ ID NO: 943523 - protein, 9 aa, Homo Sapiens
DSLTLLASE

SEQ ID NO: 943524 - protein, 9 aa, Homo Sapiens
KRGGNLSAR

SEQ ID NO: 943525 - protein, 9 aa, Homo Sapiens
STTSFLNKH

SEQ ID NO: 943526 - protein, 9 aa, Homo Sapiens
QVKPPNGEP

SEQ ID NO: 943527 - protein, 9 aa, Homo Sapiens
PEKENIKAG

SEQ ID NO: 943528 - protein, 9 aa, Homo Sapiens
NSASLQCEL

SEQ ID NO: 943529 - protein, 9 aa, Homo Sapiens
SALEVFPGA

SEQ ID NO: 943530 - protein, 9 aa, Homo Sapiens
NENLHTSYF

SEQ ID NO: 943531 - protein, 9 aa, Homo Sapiens
LLRRLVAQL

SEQ ID NO: 943532 - protein, 9 aa, Homo Sapiens
TSPQPWPRF

SEQ ID NO: 943533 - protein, 9 aa, Homo Sapiens
ILALCFPSP

SEQ ID NO: 943534 - protein, 9 aa, Homo Sapiens
KKSRKTRVQ

SEQ ID NO: 943535 - protein, 9 aa, Homo Sapiens
GSWTSGEGV

SEQ ID NO: 943536 - protein, 9 aa, Homo Sapiens
LSQPVCFDF

SEQ ID NO: 943537 - protein, 9 aa, Homo Sapiens
PKKEYFQEV

SEQ ID NO: 943538 - protein, 9 aa, Homo Sapiens
GPNSKTDHV

SEQ ID NO: 943539 - protein, 9 aa, Homo Sapiens
NVKFNGVYQ

SEQ ID NO: 943540 - protein, 9 aa, Homo Sapiens
LSKIQNAVI

SEQ ID NO: 943541 - protein, 9 aa, Homo Sapiens
KLLETRAQK

SEQ ID NO: 943542 - protein, 9 aa, Homo Sapiens
WVLLETQGL

SEQ ID NO: 943543 - protein, 9 aa, Homo Sapiens
EQVTLDADP

SEQ ID NO: 943544 - protein, 9 aa, Homo Sapiens
FFPEDSSLA

SEQ ID NO: 943545 - protein, 9 aa, Homo Sapiens
QEGFGINKI

SEQ ID NO: 943546 - protein, 9 aa, Homo Sapiens
ARMKKATWF

SEQ ID NO: 943547 - protein, 9 aa, Homo Sapiens
MGTPWRDYI

SEQ ID NO: 943548 - protein, 9 aa, Homo Sapiens
KTHYPDAFM

SEQ ID NO: 943549 - protein, 9 aa, Homo Sapiens
PPGNLFSLI

SEQ ID NO: 943550 - protein, 9 aa, Homo Sapiens
NDMEEDDKD

SEQ ID NO: 943551 - protein, 9 aa, Homo Sapiens
FYLKCHKRS

SEQ ID NO: 943552 - protein, 9 aa, Homo Sapiens
PPVRPHGPE

SEQ ID NO: 943553 - protein, 9 aa, Homo Sapiens
ELKATPEIS

SEQ ID NO: 943554 - protein, 9 aa, Homo Sapiens
LIASEKEIN

SEQ ID NO: 943555 - protein, 9 aa, Homo Sapiens
QARMKKATW

SEQ ID NO: 943556 - protein, 9 aa, Homo Sapiens
SVSFRLWDT

SEQ ID NO: 943557 - protein, 9 aa, Homo Sapiens
FPLLSRKPS

SEQ ID NO: 943558 - protein, 9 aa, Homo Sapiens
EVLKVRNKS

SEQ ID NO: 943559 - protein, 9 aa, Homo Sapiens
KILKCMFCG

SEQ ID NO: 943560 - protein, 9 aa, Homo Sapiens
GHLQNNMTS

SEQ ID NO: 943561 - protein, 9 aa, Homo Sapiens
RKIVYSFSS

SEQ ID NO: 943562 - protein, 9 aa, Homo Sapiens
HVKEGSWYI

SEQ ID NO: 943563 - protein, 9 aa, Homo Sapiens
SKTIFRFSA

SEQ ID NO: 943564 - protein, 9 aa, Homo Sapiens
NLTIITFTL

SEQ ID NO: 943565 - protein, 9 aa, Homo Sapiens
PPATLPAEL

SEQ ID NO: 943566 - protein, 9 aa, Homo Sapiens
LNIEDAENW

SEQ ID NO: 943567 - protein, 9 aa, Homo Sapiens
LLPALSHCF

SEQ ID NO: 943568 - protein, 9 aa, Homo Sapiens
EKTVTLHCE

SEQ ID NO: 943569 - protein, 9 aa, Homo Sapiens
GQAKFIASA

SEQ ID NO: 943570 - protein, 9 aa, Homo Sapiens
KAPKVPKKI

SEQ ID NO: 943571 - protein, 9 aa, Homo Sapiens
PTPDPKKLI

SEQ ID NO: 943572 - protein, 9 aa, Homo Sapiens
QAVYQEAQM

SEQ ID NO: 943573 - protein, 9 aa, Homo Sapiens
QASGQPLPT

SEQ ID NO: 943574 - protein, 9 aa, Homo Sapiens
ALQICNPAN

SEQ ID NO: 943575 - protein, 9 aa, Homo Sapiens
VPALPPPAQ

SEQ ID NO: 943576 - protein, 9 aa, Homo Sapiens
SSKATVIRG

SEQ ID NO: 943577 - protein, 9 aa, Homo Sapiens
HDTNSSLTD

SEQ ID NO: 943578 - protein, 9 aa, Homo Sapiens
ETNLQAVPS

SEQ ID NO: 943579 - protein, 9 aa, Homo Sapiens
VKVEMFSSG

SEQ ID NO: 943580 - protein, 9 aa, Homo Sapiens
EKEVEEEEV

SEQ ID NO: 943581 - protein, 9 aa, Homo Sapiens
SDSFATDPS

SEQ ID NO: 943582 - protein, 9 aa, Homo Sapiens
VLQKLSSYN

SEQ ID NO: 943583 - protein, 9 aa, Homo Sapiens
VPVYVVTFQ

SEQ ID NO: 943584 - protein, 9 aa, Homo Sapiens
EQKMFGSMF

SEQ ID NO: 943585 - protein, 9 aa, Homo Sapiens
SLAKLIQAL

SEQ ID NO: 943586 - protein, 9 aa, Homo Sapiens
TFKGRGILN

SEQ ID NO: 943587 - protein, 9 aa, Homo Sapiens
VTLMENILI

SEQ ID NO: 943588 - protein, 9 aa, Homo Sapiens
LVEVLPQYV

SEQ ID NO: 943589 - protein, 9 aa, Homo Sapiens
NVLDGLEKK

SEQ ID NO: 943590 - protein, 9 aa, Homo Sapiens
DLSRGVFGG

SEQ ID NO: 943591 - protein, 9 aa, Homo Sapiens
YAFNSLAGG

SEQ ID NO: 943592 - protein, 9 aa, Homo Sapiens
LDCDETNLQ

SEQ ID NO: 943593 - protein, 9 aa, Homo Sapiens
TSILWDGLD

SEQ ID NO: 943594 - protein, 9 aa, Homo Sapiens
EFVLHRLCT

SEQ ID NO: 943595 - protein, 9 aa, Homo Sapiens
LLSYLRTRY

SEQ ID NO: 943596 - protein, 9 aa, Homo Sapiens
KEFCSANGI

SEQ ID NO: 943597 - protein, 9 aa, Homo Sapiens
DWLRVGFVL

SEQ ID NO: 943598 - protein, 9 aa, Homo Sapiens
LEEKFSNLP

SEQ ID NO: 943599 - protein, 9 aa, Homo Sapiens
NGSLEDCLH

SEQ ID NO: 943600 - protein, 9 aa, Homo Sapiens
SPLCETLVH

SEQ ID NO: 943601 - protein, 9 aa, Homo Sapiens
KKKFEVTVH

SEQ ID NO: 943602 - protein, 9 aa, Homo Sapiens
RVDHINFMK

SEQ ID NO: 943603 - protein, 9 aa, Homo Sapiens
ACNLFLTNS

SEQ ID NO: 943604 - protein, 9 aa, Homo Sapiens
STDPNHTSS

SEQ ID NO: 943605 - protein, 9 aa, Homo Sapiens
TSLSLPIVL

SEQ ID NO: 943606 - protein, 9 aa, Homo Sapiens
CSECGKASN

SEQ ID NO: 943607 - protein, 9 aa, Homo Sapiens
TTSSIDPND

SEQ ID NO: 943608 - protein, 9 aa, Homo Sapiens
PEIYHRKPH

SEQ ID NO: 943609 - protein, 9 aa, Homo Sapiens
NSRKNFAIL

SEQ ID NO: 943610 - protein, 9 aa, Homo Sapiens
DNCTALIVS

SEQ ID NO: 943611 - protein, 9 aa, Homo Sapiens
IFCKISDVK

SEQ ID NO: 943612 - protein, 9 aa, Homo Sapiens
GPIPGHLVD

SEQ ID NO: 943613 - protein, 9 aa, Homo Sapiens
RRPTRKSDD

SEQ ID NO: 943614 - protein, 9 aa, Homo Sapiens
SRSSSPSPL

SEQ ID NO: 943615 - protein, 9 aa, Homo Sapiens
RKQLDCLGL

SEQ ID NO: 943616 - protein, 9 aa, Homo Sapiens
TRVDHINFM

SEQ ID NO: 943617 - protein, 9 aa, Homo Sapiens
GLSCVSDHK

SEQ ID NO: 943618 - protein, 9 aa, Homo Sapiens
HIKVTQEHY

SEQ ID NO: 943619 - protein, 9 aa, Homo Sapiens
RSYNKLQKQ

SEQ ID NO: 943620 - protein, 9 aa, Homo Sapiens
ENESFLWDC

SEQ ID NO: 943621 - protein, 9 aa, Homo Sapiens
PPKKPETPI

SEQ ID NO: 943622 - protein, 9 aa, Homo Sapiens
RADFCGIER

SEQ ID NO: 943623 - protein, 9 aa, Homo Sapiens
SREGLQKRE

SEQ ID NO: 943624 - protein, 9 aa, Homo Sapiens
GLRFYAFNS

SEQ ID NO: 943625 - protein, 9 aa, Homo Sapiens
VSSYEDEPC

SEQ ID NO: 943626 - protein, 9 aa, Homo Sapiens
QEARSSAAF

SEQ ID NO: 943627 - protein, 9 aa, Homo Sapiens
WLLFEYPKS

SEQ ID NO: 943628 - protein, 9 aa, Homo Sapiens
LKKLRTAGP

SEQ ID NO: 943629 - protein, 9 aa, Homo Sapiens
DNMLCSKCV

SEQ ID NO: 943630 - protein, 9 aa, Homo Sapiens
ISALEVFPG

SEQ ID NO: 943631 - protein, 9 aa, Homo Sapiens
LTNQIDKNW

SEQ ID NO: 943632 - protein, 9 aa, Homo Sapiens
RDCFLHLLR

SEQ ID NO: 943633 - protein, 9 aa, Homo Sapiens
TNQIDKNWY

SEQ ID NO: 943634 - protein, 9 aa, Homo Sapiens
ATAHKPVIS

SEQ ID NO: 943635 - protein, 9 aa, Homo Sapiens
VAQNPHGRD

SEQ ID NO: 943636 - protein, 9 aa, Homo Sapiens
FCESSQEGS

SEQ ID NO: 943637 - protein, 9 aa, Homo Sapiens
GILNIEDAE

SEQ ID NO: 943638 - protein, 9 aa, Homo Sapiens
GRPLPHSQK

SEQ ID NO: 943639 - protein, 9 aa, Homo Sapiens
PAENSHRER

SEQ ID NO: 943640 - protein, 9 aa, Homo Sapiens
LIQLPGQKV

SEQ ID NO: 943641 - protein, 9 aa, Homo Sapiens
SSMCLEDNR

SEQ ID NO: 943642 - protein, 9 aa, Homo Sapiens
APLHFMNDL

SEQ ID NO: 943643 - protein, 9 aa, Homo Sapiens
FASIYFMTA

SEQ ID NO: 943644 - protein, 9 aa, Homo Sapiens
CFFEISSLH

SEQ ID NO: 943645 - protein, 9 aa, Homo Sapiens
SGQPLPTIR

SEQ ID NO: 943646 - protein, 9 aa, Homo Sapiens
QRELILQDA

SEQ ID NO: 943647 - protein, 9 aa, Homo Sapiens
QVLDLHKQE

SEQ ID NO: 943648 - protein, 9 aa, Homo Sapiens
CFEIKEDYK

SEQ ID NO: 943649 - protein, 9 aa, Homo Sapiens
SPEVLAKIF

SEQ ID NO: 943650 - protein, 9 aa, Homo Sapiens
LEQDTSCLT

SEQ ID NO: 943651 - protein, 9 aa, Homo Sapiens
SDDKTLCIW

SEQ ID NO: 943652 - protein, 9 aa, Homo Sapiens
EVHKHKASL

SEQ ID NO: 943653 - protein, 9 aa, Homo Sapiens
FPGSPRPRR

SEQ ID NO: 943654 - protein, 9 aa, Homo Sapiens
SSFLLYSYF

SEQ ID NO: 943655 - protein, 9 aa, Homo Sapiens
KGNLEQECV

SEQ ID NO: 943656 - protein, 9 aa, Homo Sapiens
GRWSEGEPV

SEQ ID NO: 943657 - protein, 9 aa, Homo Sapiens
LFPSPTSAH

SEQ ID NO: 943658 - protein, 9 aa, Homo Sapiens
EILNQSDIV

SEQ ID NO: 943659 - protein, 9 aa, Homo Sapiens
QNWFSIFNP

SEQ ID NO: 943660 - protein, 9 aa, Homo Sapiens
NGYRRFDSA

SEQ ID NO: 943661 - protein, 9 aa, Homo Sapiens
ENPLSCCGN

SEQ ID NO: 943662 - protein, 9 aa, Homo Sapiens
YGGCEENQN

SEQ ID NO: 943663 - protein, 9 aa, Homo Sapiens
NSGTLNILV

SEQ ID NO: 943664 - protein, 9 aa, Homo Sapiens
VANPKDIIY

SEQ ID NO: 943665 - protein, 9 aa, Homo Sapiens
QKRQKKAIK

SEQ ID NO: 943666 - protein, 9 aa, Homo Sapiens
EEEIMFLQM

SEQ ID NO: 943667 - protein, 9 aa, Homo Sapiens
PTQEARSSA

SEQ ID NO: 943668 - protein, 9 aa, Homo Sapiens
TYGKELYYL

SEQ ID NO: 943669 - protein, 9 aa, Homo Sapiens
CGHKKDAAV

SEQ ID NO: 943670 - protein, 9 aa, Homo Sapiens
TDGMRVTLR

SEQ ID NO: 943671 - protein, 9 aa, Homo Sapiens
PFNFFPEDS

SEQ ID NO: 943672 - protein, 9 aa, Homo Sapiens
RDIPKGRKK

SEQ ID NO: 943673 - protein, 9 aa, Homo Sapiens
ELFPHLYFL

SEQ ID NO: 943674 - protein, 9 aa, Homo Sapiens
QSGGSRSFS

SEQ ID NO: 943675 - protein, 9 aa, Homo Sapiens
PYNPHHRIP

SEQ ID NO: 943676 - protein, 9 aa, Homo Sapiens
ARAIHNIFC

SEQ ID NO: 943677 - protein, 9 aa, Homo Sapiens
LKKCYSSKR

SEQ ID NO: 943678 - protein, 9 aa, Homo Sapiens
GHSNKVMYV

SEQ ID NO: 943679 - protein, 9 aa, Homo Sapiens
QPKVGASGP

SEQ ID NO: 943680 - protein, 9 aa, Homo Sapiens
PLRVLSQFK

SEQ ID NO: 943681 - protein, 9 aa, Homo Sapiens
EDGRWSEGE

SEQ ID NO: 943682 - protein, 9 aa, Homo Sapiens
LIAFVTFFY

SEQ ID NO: 943683 - protein, 9 aa, Homo Sapiens
WGLQKSLVF

SEQ ID NO: 943684 - protein, 9 aa, Homo Sapiens
KDLFFSRSK

SEQ ID NO: 943685 - protein, 9 aa, Homo Sapiens
DPEIYWVTP

SEQ ID NO: 943686 - protein, 9 aa, Homo Sapiens
RQHFLCKYQ

SEQ ID NO: 943687 - protein, 9 aa, Homo Sapiens
EQRPSGAWK

SEQ ID NO: 943688 - protein, 9 aa, Homo Sapiens
YLGASYLLR

SEQ ID NO: 943689 - protein, 9 aa, Homo Sapiens
KNYTEKKTY

SEQ ID NO: 943690 - protein, 9 aa, Homo Sapiens
FKKKFKEDL

SEQ ID NO: 943691 - protein, 9 aa, Homo Sapiens
AAPTNGQPQ

SEQ ID NO: 943692 - protein, 9 aa, Homo Sapiens
SENTLTIHG

SEQ ID NO: 943693 - protein, 9 aa, Homo Sapiens
HPLGKKEEK

SEQ ID NO: 943694 - protein, 9 aa, Homo Sapiens
HDQIGMISV

SEQ ID NO: 943695 - protein, 9 aa, Homo Sapiens
EENINKNNI

SEQ ID NO: 943696 - protein, 9 aa, Homo Sapiens
SLYQELKIE

SEQ ID NO: 943697 - protein, 9 aa, Homo Sapiens
DEWDSSHIV

SEQ ID NO: 943698 - protein, 9 aa, Homo Sapiens
TSKRTPDEF

SEQ ID NO: 943699 - protein, 9 aa, Homo Sapiens
LSSRGSTCH

SEQ ID NO: 943700 - protein, 9 aa, Homo Sapiens
RRATGWHEG

SEQ ID NO: 943701 - protein, 9 aa, Homo Sapiens
MSSRVHKAV

SEQ ID NO: 943702 - protein, 9 aa, Homo Sapiens
REPGRSKES

SEQ ID NO: 943703 - protein, 9 aa, Homo Sapiens
EDIKSLVKG

SEQ ID NO: 943704 - protein, 9 aa, Homo Sapiens
TDLSRGVFG

SEQ ID NO: 943705 - protein, 9 aa, Homo Sapiens
QHGPSVCFF

SEQ ID NO: 943706 - protein, 9 aa, Homo Sapiens
EIHQNKSVT

SEQ ID NO: 943707 - protein, 9 aa, Homo Sapiens
SEEPGAKAC

SEQ ID NO: 943708 - protein, 9 aa, Homo Sapiens
AQAKPINLD

SEQ ID NO: 943709 - protein, 9 aa, Homo Sapiens
CYILVTVPK

SEQ ID NO: 943710 - protein, 9 aa, Homo Sapiens
KRWTPPGSI

SEQ ID NO: 943711 - protein, 9 aa, Homo Sapiens
TIYDPEKEN

SEQ ID NO: 943712 - protein, 9 aa, Homo Sapiens
DQKKFSLQD

SEQ ID NO: 943713 - protein, 9 aa, Homo Sapiens
PEGFTILVS

SEQ ID NO: 943714 - protein, 9 aa, Homo Sapiens
PQERVYEMY

SEQ ID NO: 943715 - protein, 9 aa, Homo Sapiens
RAMAEPDPE

SEQ ID NO: 943716 - protein, 9 aa, Homo Sapiens
ASIYFMTAV

SEQ ID NO: 943717 - protein, 9 aa, Homo Sapiens
GACDKKGCR

SEQ ID NO: 943718 - protein, 9 aa, Homo Sapiens
WRNMNTING

SEQ ID NO: 943719 - protein, 9 aa, Homo Sapiens
LILVMMSYN

SEQ ID NO: 943720 - protein, 9 aa, Homo Sapiens
SSAENIMPT

SEQ ID NO: 943721 - protein, 9 aa, Homo Sapiens
AFATDKYQW

SEQ ID NO: 943722 - protein, 9 aa, Homo Sapiens
ATENSAFSL

SEQ ID NO: 943723 - protein, 9 aa, Homo Sapiens
SWFVQFSWL

SEQ ID NO: 943724 - protein, 9 aa, Homo Sapiens
AAAETLESK

SEQ ID NO: 943725 - protein, 9 aa, Homo Sapiens
DKGKPALFS

SEQ ID NO: 943726 - protein, 9 aa, Homo Sapiens
PPLEIKFLG

SEQ ID NO: 943727 - protein, 9 aa, Homo Sapiens
GKKKKKEKE

SEQ ID NO: 943728 - protein, 9 aa, Homo Sapiens
SVKMLAAPI

SEQ ID NO: 943729 - protein, 9 aa, Homo Sapiens
KKPYQCEEC

SEQ ID NO: 943730 - protein, 9 aa, Homo Sapiens
GGPQRNPVW

SEQ ID NO: 943731 - protein, 9 aa, Homo Sapiens
ANFITWCLI

SEQ ID NO: 943732 - protein, 9 aa, Homo Sapiens
PLSGLQASV

SEQ ID NO: 943733 - protein, 9 aa, Homo Sapiens
KMQEEETRK

SEQ ID NO: 943734 - protein, 9 aa, Homo Sapiens
LPLHDLASL

SEQ ID NO: 943735 - protein, 9 aa, Homo Sapiens
FSAAPTSLG

SEQ ID NO: 943736 - protein, 9 aa, Homo Sapiens
HVEMGPPDS

SEQ ID NO: 943737 - protein, 9 aa, Homo Sapiens
EGEEKGNPE

SEQ ID NO: 943738 - protein, 9 aa, Homo Sapiens
TSSFLLYSY

SEQ ID NO: 943739 - protein, 9 aa, Homo Sapiens
SVSIRKELK

SEQ ID NO: 943740 - protein, 9 aa, Homo Sapiens
LLPLWLPFV

SEQ ID NO: 943741 - protein, 9 aa, Homo Sapiens
GAQCSAPLS

SEQ ID NO: 943742 - protein, 9 aa, Homo Sapiens
WRVTNTSQS

SEQ ID NO: 943743 - protein, 9 aa, Homo Sapiens
CKHGFTGDR

SEQ ID NO: 943744 - protein, 9 aa, Homo Sapiens
SWVIEPVYI

SEQ ID NO: 943745 - protein, 9 aa, Homo Sapiens
QISGVFNEP

SEQ ID NO: 943746 - protein, 9 aa, Homo Sapiens
CRRGFIQKS

SEQ ID NO: 943747 - protein, 9 aa, Homo Sapiens
HCISHEYRY

SEQ ID NO: 943748 - protein, 9 aa, Homo Sapiens
ATARIKTTV

SEQ ID NO: 943749 - protein, 9 aa, Homo Sapiens
LCVGNKWVS

SEQ ID NO: 943750 - protein, 9 aa, Homo Sapiens
HVGAPLSCN

SEQ ID NO: 943751 - protein, 9 aa, Homo Sapiens
SNQQFQDLK

SEQ ID NO: 943752 - protein, 9 aa, Homo Sapiens
VRFYRNRDR

SEQ ID NO: 943753 - protein, 9 aa, Homo Sapiens
AAKHLKTLC

SEQ ID NO: 943754 - protein, 9 aa, Homo Sapiens
VFEVLVIYM

SEQ ID NO: 943755 - protein, 9 aa, Homo Sapiens
KRKFLKSIV

SEQ ID NO: 943756 - protein, 9 aa, Homo Sapiens
DTIKDLLAY

SEQ ID NO: 943757 - protein, 9 aa, Homo Sapiens
MVNSNNNRG

SEQ ID NO: 943758 - protein, 9 aa, Homo Sapiens
FSSESKQEE

SEQ ID NO: 943759 - protein, 9 aa, Homo Sapiens
GLVLSGDPG

SEQ ID NO: 943760 - protein, 9 aa, Homo Sapiens
VYYDALQQY

SEQ ID NO: 943761 - protein, 9 aa, Homo Sapiens
TLLQQNFEL

SEQ ID NO: 943762 - protein, 9 aa, Homo Sapiens
FCEICLHEG

SEQ ID NO: 943763 - protein, 9 aa, Homo Sapiens
NRALPGADS

SEQ ID NO: 943764 - protein, 9 aa, Homo Sapiens
LSQELAEDL

SEQ ID NO: 943765 - protein, 9 aa, Homo Sapiens
ARDWLRVGF

SEQ ID NO: 943766 - protein, 9 aa, Homo Sapiens
PLYQSYLMV

SEQ ID NO: 943767 - protein, 9 aa, Homo Sapiens
DADSVWIEM

SEQ ID NO: 943768 - protein, 9 aa, Homo Sapiens
GDWVIEKVL

SEQ ID NO: 943769 - protein, 9 aa, Homo Sapiens
NTHARERVQ

SEQ ID NO: 943770 - protein, 9 aa, Homo Sapiens
CDIDPQNDL

SEQ ID NO: 943771 - protein, 9 aa, Homo Sapiens
TEKKSYECK

SEQ ID NO: 943772 - protein, 9 aa, Homo Sapiens
YYASRRVCF

SEQ ID NO: 943773 - protein, 9 aa, Homo Sapiens
LCEDIMGYN

SEQ ID NO: 943774 - protein, 9 aa, Homo Sapiens
NHFFCEIMV

SEQ ID NO: 943775 - protein, 9 aa, Homo Sapiens
FRINNAAFE

SEQ ID NO: 943776 - protein, 9 aa, Homo Sapiens
HFRTWPDLG

SEQ ID NO: 943777 - protein, 9 aa, Homo Sapiens
ETRKLQQKR

SEQ ID NO: 943778 - protein, 9 aa, Homo Sapiens
DYSLIGRIG

SEQ ID NO: 943779 - protein, 9 aa, Homo Sapiens
LGLLCVFFV

SEQ ID NO: 943780 - protein, 9 aa, Homo Sapiens
LQKLGMWYK

SEQ ID NO: 943781 - protein, 9 aa, Homo Sapiens
FLNPIPSDL

SEQ ID NO: 943782 - protein, 9 aa, Homo Sapiens
LSHCFQLTT

SEQ ID NO: 943783 - protein, 9 aa, Homo Sapiens
DSYPEQEKT

SEQ ID NO: 943784 - protein, 9 aa, Homo Sapiens
ERADSPRPE

SEQ ID NO: 943785 - protein, 9 aa, Homo Sapiens
NGDAVLSMA

SEQ ID NO: 943786 - protein, 9 aa, Homo Sapiens
QITCPEGWL

SEQ ID NO: 943787 - protein, 9 aa, Homo Sapiens
NIGLNRPLS

SEQ ID NO: 943788 - protein, 9 aa, Homo Sapiens
IDFIYKVTE

SEQ ID NO: 943789 - protein, 9 aa, Homo Sapiens
EEPAGPKSR

SEQ ID NO: 943790 - protein, 9 aa, Homo Sapiens
LKEPRRVVA

SEQ ID NO: 943791 - protein, 9 aa, Homo Sapiens
ERLMFHGPA

SEQ ID NO: 943792 - protein, 9 aa, Homo Sapiens
LFGIVGAYD

SEQ ID NO: 943793 - protein, 9 aa, Homo Sapiens
PHAHLQSLP

SEQ ID NO: 943794 - protein, 9 aa, Homo Sapiens
EYDSKSSQQ

SEQ ID NO: 943795 - protein, 9 aa, Homo Sapiens
LFGLPWIYA

SEQ ID NO: 943796 - protein, 9 aa, Homo Sapiens
EPDPEIYWV

SEQ ID NO: 943797 - protein, 9 aa, Homo Sapiens
SGALISDLK

SEQ ID NO: 943798 - protein, 9 aa, Homo Sapiens
IAAADKQFY

SEQ ID NO: 943799 - protein, 9 aa, Homo Sapiens
GEPVVYHRH

SEQ ID NO: 943800 - protein, 9 aa, Homo Sapiens
ASAPLASVP

SEQ ID NO: 943801 - protein, 9 aa, Homo Sapiens
VKPQKLPPP

SEQ ID NO: 943802 - protein, 9 aa, Homo Sapiens
QAKADALAD

SEQ ID NO: 943803 - protein, 9 aa, Homo Sapiens
GAIPQERVY

SEQ ID NO: 943804 - protein, 9 aa, Homo Sapiens
LFGYVYVGL

SEQ ID NO: 943805 - protein, 9 aa, Homo Sapiens
CGKAFCYDT

SEQ ID NO: 943806 - protein, 9 aa, Homo Sapiens
DEAKICHGL

SEQ ID NO: 943807 - protein, 9 aa, Homo Sapiens
LFDKTHYPD

SEQ ID NO: 943808 - protein, 9 aa, Homo Sapiens
HRCHRRKDR

SEQ ID NO: 943809 - protein, 9 aa, Homo Sapiens
RHNNWRLQA

SEQ ID NO: 943810 - protein, 9 aa, Homo Sapiens
RFPPPWPQS

SEQ ID NO: 943811 - protein, 9 aa, Homo Sapiens
VCRHFRFPP

SEQ ID NO: 943812 - protein, 9 aa, Homo Sapiens
KQRSPDDEL

SEQ ID NO: 943813 - protein, 9 aa, Homo Sapiens
NKVFEFMVY

SEQ ID NO: 943814 - protein, 9 aa, Homo Sapiens
SLTWGEAAE

SEQ ID NO: 943815 - protein, 9 aa, Homo Sapiens
VIYLCAAVY

SEQ ID NO: 943816 - protein, 9 aa, Homo Sapiens
GTRQHGDNA

SEQ ID NO: 943817 - protein, 9 aa, Homo Sapiens
SAGLSKPFS

SEQ ID NO: 943818 - protein, 9 aa, Homo Sapiens
VDVVDGENE

SEQ ID NO: 943819 - protein, 9 aa, Homo Sapiens
ATRPWYSYP

SEQ ID NO: 943820 - protein, 9 aa, Homo Sapiens
NECSCTFCE

SEQ ID NO: 943821 - protein, 9 aa, Homo Sapiens
PCEAGKEGE

SEQ ID NO: 943822 - protein, 9 aa, Homo Sapiens
QCNVRNSRK

SEQ ID NO: 943823 - protein, 9 aa, Homo Sapiens
SVEGSASGS

SEQ ID NO: 943824 - protein, 9 aa, Homo Sapiens
QVMLDKWEE

SEQ ID NO: 943825 - protein, 9 aa, Homo Sapiens
TSKLVQVDY

SEQ ID NO: 943826 - protein, 9 aa, Homo Sapiens
RGGKPRAYF

SEQ ID NO: 943827 - protein, 9 aa, Homo Sapiens
QEGILFVQT

SEQ ID NO: 943828 - protein, 9 aa, Homo Sapiens
ELLPCVAML

SEQ ID NO: 943829 - protein, 9 aa, Homo Sapiens
ALPGADSQD

SEQ ID NO: 943830 - protein, 9 aa, Homo Sapiens
DLLCLRARP

SEQ ID NO: 943831 - protein, 9 aa, Homo Sapiens
NMMSDGKFL

SEQ ID NO: 943832 - protein, 9 aa, Homo Sapiens
TLCPLCRTI

SEQ ID NO: 943833 - protein, 9 aa, Homo Sapiens
CQYPGPGEN

SEQ ID NO: 943834 - protein, 9 aa, Homo Sapiens
TLAPELLWW

SEQ ID NO: 943835 - protein, 9 aa, Homo Sapiens
RGPGPSSVG

SEQ ID NO: 943836 - protein, 9 aa, Homo Sapiens
GKELYYLAS

SEQ ID NO: 943837 - protein, 9 aa, Homo Sapiens
IGSRDGSQT

SEQ ID NO: 943838 - protein, 9 aa, Homo Sapiens
AVGEIMLLS

SEQ ID NO: 943839 - protein, 9 aa, Homo Sapiens
DDLSPGAID

SEQ ID NO: 943840 - protein, 9 aa, Homo Sapiens
LCGQPKVGA

SEQ ID NO: 943841 - protein, 9 aa, Homo Sapiens
GIADRMQKK

SEQ ID NO: 943842 - protein, 9 aa, Homo Sapiens
QASASSFAP

SEQ ID NO: 943843 - protein, 9 aa, Homo Sapiens
KTYHFWVFV

SEQ ID NO: 943844 - protein, 9 aa, Homo Sapiens
FFSFDYSYW

SEQ ID NO: 943845 - protein, 9 aa, Homo Sapiens
LFAPKVYII

SEQ ID NO: 943846 - protein, 9 aa, Homo Sapiens
SCNFLRRPD

SEQ ID NO: 943847 - protein, 9 aa, Homo Sapiens
FSFSEFVPK

SEQ ID NO: 943848 - protein, 9 aa, Homo Sapiens
FGTLYSFFL

SEQ ID NO: 943849 - protein, 9 aa, Homo Sapiens
ANTTTILAA

SEQ ID NO: 943850 - protein, 9 aa, Homo Sapiens
EPGLLGPPG

SEQ ID NO: 943851 - protein, 9 aa, Homo Sapiens
KTRVQMSVG

SEQ ID NO: 943852 - protein, 9 aa, Homo Sapiens
LRRHYHSIV

SEQ ID NO: 943853 - protein, 9 aa, Homo Sapiens
GCHQKLTVN

SEQ ID NO: 943854 - protein, 9 aa, Homo Sapiens
KDGKLYCKV

SEQ ID NO: 943855 - protein, 9 aa, Homo Sapiens
LKRVFWKQR

SEQ ID NO: 943856 - protein, 9 aa, Homo Sapiens
LRGITCLDY

SEQ ID NO: 943857 - protein, 9 aa, Homo Sapiens
EKSQAFMVI

SEQ ID NO: 943858 - protein, 9 aa, Homo Sapiens
QPTQPPQQL

SEQ ID NO: 943859 - protein, 9 aa, Homo Sapiens
AIHTEKKSY

SEQ ID NO: 943860 - protein, 9 aa, Homo Sapiens
DYCPFLCFS

SEQ ID NO: 943861 - protein, 9 aa, Homo Sapiens
QQLPALGNL

SEQ ID NO: 943862 - protein, 9 aa, Homo Sapiens
TCHCRKSCY

SEQ ID NO: 943863 - protein, 9 aa, Homo Sapiens
RSKESFWIP

SEQ ID NO: 943864 - protein, 9 aa, Homo Sapiens
RLLKRTSRP

SEQ ID NO: 943865 - protein, 9 aa, Homo Sapiens
SRPASTHDS

SEQ ID NO: 943866 - protein, 9 aa, Homo Sapiens
LRQGLSKLP

SEQ ID NO: 943867 - protein, 9 aa, Homo Sapiens
FSHNCNHCE

SEQ ID NO: 943868 - protein, 9 aa, Homo Sapiens
PFWAITIFN

SEQ ID NO: 943869 - protein, 9 aa, Homo Sapiens
FYQDFFTEI

SEQ ID NO: 943870 - protein, 9 aa, Homo Sapiens
LQGPGYPPP

SEQ ID NO: 943871 - protein, 9 aa, Homo Sapiens
GNQPGGNLS

SEQ ID NO: 943872 - protein, 9 aa, Homo Sapiens
FFPGGAAFS

SEQ ID NO: 943873 - protein, 9 aa, Homo Sapiens
AIIVPSLFL

SEQ ID NO: 943874 - protein, 9 aa, Homo Sapiens
KGEPGLLGP

SEQ ID NO: 943875 - protein, 9 aa, Homo Sapiens
INSQLKLYT

SEQ ID NO: 943876 - protein, 9 aa, Homo Sapiens
LLARASTKK

SEQ ID NO: 943877 - protein, 9 aa, Homo Sapiens
PSPRPGPSP

SEQ ID NO: 943878 - protein, 9 aa, Homo Sapiens
VNCPDGSDK

SEQ ID NO: 943879 - protein, 9 aa, Homo Sapiens
QPKDQIAYS

SEQ ID NO: 943880 - protein, 9 aa, Homo Sapiens
LDSRQALPR

SEQ ID NO: 943881 - protein, 9 aa, Homo Sapiens
QFLEQVTLD

SEQ ID NO: 943882 - protein, 9 aa, Homo Sapiens
LSERFLVNQ

SEQ ID NO: 943883 - protein, 9 aa, Homo Sapiens
AINYETFTI

SEQ ID NO: 943884 - protein, 9 aa, Homo Sapiens
VSRSSKDSR

SEQ ID NO: 943885 - protein, 9 aa, Homo Sapiens
PHKYPSVYP

SEQ ID NO: 943886 - protein, 9 aa, Homo Sapiens
SPEYFVIGN

SEQ ID NO: 943887 - protein, 9 aa, Homo Sapiens
GASRGLRGS

SEQ ID NO: 943888 - protein, 9 aa, Homo Sapiens
LHKPHEHGP

SEQ ID NO: 943889 - protein, 9 aa, Homo Sapiens
RGSCASVSF

SEQ ID NO: 943890 - protein, 9 aa, Homo Sapiens
HDSIKDDLE

SEQ ID NO: 943891 - protein, 9 aa, Homo Sapiens
KFYLKCHKR

SEQ ID NO: 943892 - protein, 9 aa, Homo Sapiens
YMTPKDDIQ

SEQ ID NO: 943893 - protein, 9 aa, Homo Sapiens
LPVTCALLH

SEQ ID NO: 943894 - protein, 9 aa, Homo Sapiens
NKELNIKLA

SEQ ID NO: 943895 - protein, 9 aa, Homo Sapiens
PEEAGAEVL

SEQ ID NO: 943896 - protein, 9 aa, Homo Sapiens
ADGLSEKDL

SEQ ID NO: 943897 - protein, 9 aa, Homo Sapiens
SLSPVKSQK

SEQ ID NO: 943898 - protein, 9 aa, Homo Sapiens
EEEEPKKTE

SEQ ID NO: 943899 - protein, 9 aa, Homo Sapiens
VRPILPVSP

SEQ ID NO: 943900 - protein, 9 aa, Homo Sapiens
FILFETLLY

SEQ ID NO: 943901 - protein, 9 aa, Homo Sapiens
PPDSILGVT

SEQ ID NO: 943902 - protein, 9 aa, Homo Sapiens
LETVLQVQC

SEQ ID NO: 943903 - protein, 9 aa, Homo Sapiens
QFLENEHQQ

SEQ ID NO: 943904 - protein, 9 aa, Homo Sapiens
VAAFQRELF

SEQ ID NO: 943905 - protein, 9 aa, Homo Sapiens
KTDVADDDA

SEQ ID NO: 943906 - protein, 9 aa, Homo Sapiens
GILTIIASF

SEQ ID NO: 943907 - protein, 9 aa, Homo Sapiens
LARPRPCLF

SEQ ID NO: 943908 - protein, 9 aa, Homo Sapiens
PRQSFLNRM

SEQ ID NO: 943909 - protein, 9 aa, Homo Sapiens
KIIQKGSES

SEQ ID NO: 943910 - protein, 9 aa, Homo Sapiens
FKISVTPTP

SEQ ID NO: 943911 - protein, 9 aa, Homo Sapiens
VWTDNPKSW

SEQ ID NO: 943912 - protein, 9 aa, Homo Sapiens
KQRSSLEKH

SEQ ID NO: 943913 - protein, 9 aa, Homo Sapiens
FSAVIDAKF

SEQ ID NO: 943914 - protein, 9 aa, Homo Sapiens
LILFAAWAS

SEQ ID NO: 943915 - protein, 9 aa, Homo Sapiens
AFIGKDCGT

SEQ ID NO: 943916 - protein, 9 aa, Homo Sapiens
PQNWFSIFN

SEQ ID NO: 943917 - protein, 9 aa, Homo Sapiens
RHRTIHGQT

SEQ ID NO: 943918 - protein, 9 aa, Homo Sapiens
DIQNLSEEN

SEQ ID NO: 943919 - protein, 9 aa, Homo Sapiens
PVLLHLAPS

SEQ ID NO: 943920 - protein, 9 aa, Homo Sapiens
GDLQQHYLG

SEQ ID NO: 943921 - protein, 9 aa, Homo Sapiens
ANKIVLLEA

SEQ ID NO: 943922 - protein, 9 aa, Homo Sapiens
VYIRAAVRN

SEQ ID NO: 943923 - protein, 9 aa, Homo Sapiens
TGGFGLNLA

SEQ ID NO: 943924 - protein, 9 aa, Homo Sapiens
KVYIILFQP

SEQ ID NO: 943925 - protein, 9 aa, Homo Sapiens
NVERFLVRT

SEQ ID NO: 943926 - protein, 9 aa, Homo Sapiens
PQKLPPPGQ

SEQ ID NO: 943927 - protein, 9 aa, Homo Sapiens
TNKETEARE

SEQ ID NO: 943928 - protein, 9 aa, Homo Sapiens
EPSEMKAIA

SEQ ID NO: 943929 - protein, 9 aa, Homo Sapiens
LPVSPAQSS

SEQ ID NO: 943930 - protein, 9 aa, Homo Sapiens
VTAVLVVLK

SEQ ID NO: 943931 - protein, 9 aa, Homo Sapiens
WFAVPPALG

SEQ ID NO: 943932 - protein, 9 aa, Homo Sapiens
LLNFSYSAG

SEQ ID NO: 943933 - protein, 9 aa, Homo Sapiens
SIVSRSSKD

SEQ ID NO: 943934 - protein, 9 aa, Homo Sapiens
NIIIFAVMF

SEQ ID NO: 943935 - protein, 9 aa, Homo Sapiens
AQEYDSSFL

SEQ ID NO: 943936 - protein, 9 aa, Homo Sapiens
FPGSSSSGP

SEQ ID NO: 943937 - protein, 9 aa, Homo Sapiens
QSATAHKPV

SEQ ID NO: 943938 - protein, 9 aa, Homo Sapiens
QAVPSVSSN

SEQ ID NO: 943939 - protein, 9 aa, Homo Sapiens
QVEWNCNKK

SEQ ID NO: 943940 - protein, 9 aa, Homo Sapiens
RLKAAMGTP

SEQ ID NO: 943941 - protein, 9 aa, Homo Sapiens
RNKEAIKLL

SEQ ID NO: 943942 - protein, 9 aa, Homo Sapiens
IKGSDLDKK

SEQ ID NO: 943943 - protein, 9 aa, Homo Sapiens
EYFMQEAKR

SEQ ID NO: 943944 - protein, 9 aa, Homo Sapiens
REVLLPVEH

SEQ ID NO: 943945 - protein, 9 aa, Homo Sapiens
GIPPLPPLP

SEQ ID NO: 943946 - protein, 9 aa, Homo Sapiens
RCISKMNRL

SEQ ID NO: 943947 - protein, 9 aa, Homo Sapiens
PTELLLCKF

SEQ ID NO: 943948 - protein, 9 aa, Homo Sapiens
GYPVKKETN

SEQ ID NO: 943949 - protein, 9 aa, Homo Sapiens
TMKKEKVSS

SEQ ID NO: 943950 - protein, 9 aa, Homo Sapiens
PQPLPTKGA

SEQ ID NO: 943951 - protein, 9 aa, Homo Sapiens
PGRGGSSKP

SEQ ID NO: 943952 - protein, 9 aa, Homo Sapiens
RNSPDPVNG

SEQ ID NO: 943953 - protein, 9 aa, Homo Sapiens
LPQNGTSTL

SEQ ID NO: 943954 - protein, 9 aa, Homo Sapiens
HRGRGGKPR

SEQ ID NO: 943955 - protein, 9 aa, Homo Sapiens
GIERVDYVK

SEQ ID NO: 943956 - protein, 9 aa, Homo Sapiens
KHMRKQLDC

SEQ ID NO: 943957 - protein, 9 aa, Homo Sapiens
KKRKHQHYK

SEQ ID NO: 943958 - protein, 9 aa, Homo Sapiens
EKRMGVCLF

SEQ ID NO: 943959 - protein, 9 aa, Homo Sapiens
QKHHSAKKF

SEQ ID NO: 943960 - protein, 9 aa, Homo Sapiens
QHRQSRSHH

SEQ ID NO: 943961 - protein, 9 aa, Homo Sapiens
PGPRKIPAQ

SEQ ID NO: 943962 - protein, 9 aa, Homo Sapiens
EPRGAFRPW

SEQ ID NO: 943963 - protein, 9 aa, Homo Sapiens
PALPPPAQP

SEQ ID NO: 943964 - protein, 9 aa, Homo Sapiens
LLGSGPSVL

SEQ ID NO: 943965 - protein, 9 aa, Homo Sapiens
SVDITKESI

SEQ ID NO: 943966 - protein, 9 aa, Homo Sapiens
FLSGKWTIL

SEQ ID NO: 943967 - protein, 9 aa, Homo Sapiens
ALHEPPPEP

SEQ ID NO: 943968 - protein, 9 aa, Homo Sapiens
SGLKDGAET

SEQ ID NO: 943969 - protein, 9 aa, Homo Sapiens
IYAGPKFAS

SEQ ID NO: 943970 - protein, 9 aa, Homo Sapiens
GRRSQYQRS

SEQ ID NO: 943971 - protein, 9 aa, Homo Sapiens
FYYEELNAP

SEQ ID NO: 943972 - protein, 9 aa, Homo Sapiens
PGGADGVLH

SEQ ID NO: 943973 - protein, 9 aa, Homo Sapiens
HLDTVEGLV

SEQ ID NO: 943974 - protein, 9 aa, Homo Sapiens
GPAIFRINN

SEQ ID NO: 943975 - protein, 9 aa, Homo Sapiens
ESIGFLRQV

SEQ ID NO: 943976 - protein, 9 aa, Homo Sapiens
EGYPYPYLH

SEQ ID NO: 943977 - protein, 9 aa, Homo Sapiens
VHCRLELKK

SEQ ID NO: 943978 - protein, 9 aa, Homo Sapiens
NRGSPSRIW

SEQ ID NO: 943979 - protein, 9 aa, Homo Sapiens
GGNLSPGGA

SEQ ID NO: 943980 - protein, 9 aa, Homo Sapiens
NNTDVCLIG

SEQ ID NO: 943981 - protein, 9 aa, Homo Sapiens
QNKSNCRFR

SEQ ID NO: 943982 - protein, 9 aa, Homo Sapiens
ARLDFFWKL

SEQ ID NO: 943983 - protein, 9 aa, Homo Sapiens
YNEPAADGL

SEQ ID NO: 943984 - protein, 9 aa, Homo Sapiens
DLCYILVTV

SEQ ID NO: 943985 - protein, 9 aa, Homo Sapiens
VLNVFFAFE

SEQ ID NO: 943986 - protein, 9 aa, Homo Sapiens
HTFDCRCLS

SEQ ID NO: 943987 - protein, 9 aa, Homo Sapiens
DRCGCCGNE

SEQ ID NO: 943988 - protein, 9 aa, Homo Sapiens
HTNVCVQQN

SEQ ID NO: 943989 - protein, 9 aa, Homo Sapiens
LSLRRRQAF

SEQ ID NO: 943990 - protein, 9 aa, Homo Sapiens
LGAFSPKQW

SEQ ID NO: 943991 - protein, 9 aa, Homo Sapiens
DAQPMGPEY

SEQ ID NO: 943992 - protein, 9 aa, Homo Sapiens
LLTLDKADA

SEQ ID NO: 943993 - protein, 9 aa, Homo Sapiens
RCSSFRGGR

SEQ ID NO: 943994 - protein, 9 aa, Homo Sapiens
RQLRQTVKA

SEQ ID NO: 943995 - protein, 9 aa, Homo Sapiens
NDQRFSSES

SEQ ID NO: 943996 - protein, 9 aa, Homo Sapiens
EVMILKLPF

SEQ ID NO: 943997 - protein, 9 aa, Homo Sapiens
VVPALGAAA

SEQ ID NO: 943998 - protein, 9 aa, Homo Sapiens
FYLAFQDIE

SEQ ID NO: 943999 - protein, 9 aa, Homo Sapiens
PKDQFRVNR

SEQ ID NO: 944000 - protein, 9 aa, Homo Sapiens
DSVLPPQRQ

SEQ ID NO: 944001 - protein, 9 aa, Homo Sapiens
FSTHHLDEA

SEQ ID NO: 944002 - protein, 9 aa, Homo Sapiens
YSLTSEDFP

SEQ ID NO: 944003 - protein, 9 aa, Homo Sapiens
EEIYSPEVD

SEQ ID NO: 944004 - protein, 9 aa, Homo Sapiens
DHIKVTQEH

SEQ ID NO: 944005 - protein, 9 aa, Homo Sapiens
DKNWYEGMI

SEQ ID NO: 944006 - protein, 9 aa, Homo Sapiens
SRQALPRAH

SEQ ID NO: 944007 - protein, 9 aa, Homo Sapiens
SILVSLTVF

SEQ ID NO: 944008 - protein, 9 aa, Homo Sapiens
VQKLLGQFF

SEQ ID NO: 944009 - protein, 9 aa, Homo Sapiens
NQGKMREIK

SEQ ID NO: 944010 - protein, 9 aa, Homo Sapiens
TLYSFFLDL

SEQ ID NO: 944011 - protein, 9 aa, Homo Sapiens
ACRVSPGST

SEQ ID NO: 944012 - protein, 9 aa, Homo Sapiens
QRHNGLLCD

SEQ ID NO: 944013 - protein, 9 aa, Homo Sapiens
AKKSAEPPL

SEQ ID NO: 944014 - protein, 9 aa, Homo Sapiens
ALKLASLDI

SEQ ID NO: 944015 - protein, 9 aa, Homo Sapiens
EPWERPQEG

SEQ ID NO: 944016 - protein, 9 aa, Homo Sapiens
VRMYMVRAI

SEQ ID NO: 944017 - protein, 9 aa, Homo Sapiens
QFFSKKYSQ

SEQ ID NO: 944018 - protein, 9 aa, Homo Sapiens
GNVAPGTFI

SEQ ID NO: 944019 - protein, 9 aa, Homo Sapiens
QDPLTSDLP

SEQ ID NO: 944020 - protein, 9 aa, Homo Sapiens
QFVFEVLVI

SEQ ID NO: 944021 - protein, 9 aa, Homo Sapiens
NLNPTWNKV

SEQ ID NO: 944022 - protein, 9 aa, Homo Sapiens
AETFKNKKH

SEQ ID NO: 944023 - protein, 9 aa, Homo Sapiens
LRPQRSIAF

SEQ ID NO: 944024 - protein, 9 aa, Homo Sapiens
KLSIDSSLP

SEQ ID NO: 944025 - protein, 9 aa, Homo Sapiens
NRRPTRKSD

SEQ ID NO: 944026 - protein, 9 aa, Homo Sapiens
TSQVPALPP

SEQ ID NO: 944027 - protein, 9 aa, Homo Sapiens
PKFRHNCKF

SEQ ID NO: 944028 - protein, 9 aa, Homo Sapiens
PGSCHVFEQ

SEQ ID NO: 944029 - protein, 9 aa, Homo Sapiens
FLNISISLD

SEQ ID NO: 944030 - protein, 9 aa, Homo Sapiens
GLPKPEEPL

SEQ ID NO: 944031 - protein, 9 aa, Homo Sapiens
ISSFTVFIA

SEQ ID NO: 944032 - protein, 9 aa, Homo Sapiens
RMYMVRAIN

SEQ ID NO: 944033 - protein, 9 aa, Homo Sapiens
QNGHVIKMK

SEQ ID NO: 944034 - protein, 9 aa, Homo Sapiens
SILVVRKYF

SEQ ID NO: 944035 - protein, 9 aa, Homo Sapiens
KDSRFAVAW

SEQ ID NO: 944036 - protein, 9 aa, Homo Sapiens
PLGKKEEKF

SEQ ID NO: 944037 - protein, 9 aa, Homo Sapiens
KESIKEGFP

SEQ ID NO: 944038 - protein, 9 aa, Homo Sapiens
WKLQELSKV

SEQ ID NO: 944039 - protein, 9 aa, Homo Sapiens
FKHFLALRK

SEQ ID NO: 944040 - protein, 9 aa, Homo Sapiens
KATWFIMVV

SEQ ID NO: 944041 - protein, 9 aa, Homo Sapiens
KAVEEAECA

SEQ ID NO: 944042 - protein, 9 aa, Homo Sapiens
EVELSTASD

SEQ ID NO: 944043 - protein, 9 aa, Homo Sapiens
VASLVRAQT

SEQ ID NO: 944044 - protein, 9 aa, Homo Sapiens
DSRQALPRA

SEQ ID NO: 944045 - protein, 9 aa, Homo Sapiens
YPYPYLHTL

SEQ ID NO: 944046 - protein, 9 aa, Homo Sapiens
YDALQQYEL

SEQ ID NO: 944047 - protein, 9 aa, Homo Sapiens
NKQKASACN

SEQ ID NO: 944048 - protein, 9 aa, Homo Sapiens
FLGDLYAQK

SEQ ID NO: 944049 - protein, 9 aa, Homo Sapiens
LQQNFELVV

SEQ ID NO: 944050 - protein, 9 aa, Homo Sapiens
TCIVSGWGQ

SEQ ID NO: 944051 - protein, 9 aa, Homo Sapiens
ALLPQAPAF

SEQ ID NO: 944052 - protein, 9 aa, Homo Sapiens
PKTENFCAL

SEQ ID NO: 944053 - protein, 9 aa, Homo Sapiens
LFYNVTDGS

SEQ ID NO: 944054 - protein, 9 aa, Homo Sapiens
LMEQDRNKE

SEQ ID NO: 944055 - protein, 9 aa, Homo Sapiens
GATVHELIV

SEQ ID NO: 944056 - protein, 9 aa, Homo Sapiens
YTGLSCVSD

SEQ ID NO: 944057 - protein, 9 aa, Homo Sapiens
KGLLPLGPK

SEQ ID NO: 944058 - protein, 9 aa, Homo Sapiens
DYPGSQQNP

SEQ ID NO: 944059 - protein, 9 aa, Homo Sapiens
LSYLRTRYS

SEQ ID NO: 944060 - protein, 9 aa, Homo Sapiens
HVEEHLKGD

SEQ ID NO: 944061 - protein, 9 aa, Homo Sapiens
LSSEANKVL

SEQ ID NO: 944062 - protein, 9 aa, Homo Sapiens
QNGNCCGGV

SEQ ID NO: 944063 - protein, 9 aa, Homo Sapiens
SIGFSARYN

SEQ ID NO: 944064 - protein, 9 aa, Homo Sapiens
APGTFILYL

SEQ ID NO: 944065 - protein, 9 aa, Homo Sapiens
DSTAMTSAA

SEQ ID NO: 944066 - protein, 9 aa, Homo Sapiens
SPEERRLPP

SEQ ID NO: 944067 - protein, 9 aa, Homo Sapiens
QKVATLNPT

SEQ ID NO: 944068 - protein, 9 aa, Homo Sapiens
RKDVSRPAV

SEQ ID NO: 944069 - protein, 9 aa, Homo Sapiens
SQPRPVPGS

SEQ ID NO: 944070 - protein, 9 aa, Homo Sapiens
YQRSTDREE

SEQ ID NO: 944071 - protein, 9 aa, Homo Sapiens
NGKIYKNPV

SEQ ID NO: 944072 - protein, 9 aa, Homo Sapiens
KPIQNSHYG

SEQ ID NO: 944073 - protein, 9 aa, Homo Sapiens
VSCINPTAG

SEQ ID NO: 944074 - protein, 9 aa, Homo Sapiens
LFEYPKSSG

SEQ ID NO: 944075 - protein, 9 aa, Homo Sapiens
KLKENTMQE

SEQ ID NO: 944076 - protein, 9 aa, Homo Sapiens
QDATENSAF

SEQ ID NO: 944077 - protein, 9 aa, Homo Sapiens
RIRAVNKAG

SEQ ID NO: 944078 - protein, 9 aa, Homo Sapiens
LYSFFLDLS

SEQ ID NO: 944079 - protein, 9 aa, Homo Sapiens
FPHLYFLAP

SEQ ID NO: 944080 - protein, 9 aa, Homo Sapiens
KEDYKNRQF

SEQ ID NO: 944081 - protein, 9 aa, Homo Sapiens
PPLPQKLLE

SEQ ID NO: 944082 - protein, 9 aa, Homo Sapiens
GSFNGVQVT

SEQ ID NO: 944083 - protein, 9 aa, Homo Sapiens
YNVPILSAD

SEQ ID NO: 944084 - protein, 9 aa, Homo Sapiens
LDKKHRFTD

SEQ ID NO: 944085 - protein, 9 aa, Homo Sapiens
GNPRKLLTI

SEQ ID NO: 944086 - protein, 9 aa, Homo Sapiens
SFDSGVSSF

SEQ ID NO: 944087 - protein, 9 aa, Homo Sapiens
NDRCGCCGN

SEQ ID NO: 944088 - protein, 9 aa, Homo Sapiens
KRNIPLMLN

SEQ ID NO: 944089 - protein, 9 aa, Homo Sapiens
CHCRKSCYS

SEQ ID NO: 944090 - protein, 9 aa, Homo Sapiens
WYSYPVYAR

SEQ ID NO: 944091 - protein, 9 aa, Homo Sapiens
ESKGLYIFN

SEQ ID NO: 944092 - protein, 9 aa, Homo Sapiens
KIEEISGLE

SEQ ID NO: 944093 - protein, 9 aa, Homo Sapiens
LFKGTLTAA

SEQ ID NO: 944094 - protein, 9 aa, Homo Sapiens
LPAPKQKVA

SEQ ID NO: 944095 - protein, 9 aa, Homo Sapiens
EPLGPMEEE

SEQ ID NO: 944096 - protein, 9 aa, Homo Sapiens
HSGWEQQFL

SEQ ID NO: 944097 - protein, 9 aa, Homo Sapiens
HLQNLFTGH

SEQ ID NO: 944098 - protein, 9 aa, Homo Sapiens
TALIVSHIL

SEQ ID NO: 944099 - protein, 9 aa, Homo Sapiens
DADESPNAI

SEQ ID NO: 944100 - protein, 9 aa, Homo Sapiens
PACSAFPRD

SEQ ID NO: 944101 - protein, 9 aa, Homo Sapiens
RRVSLLDKG

SEQ ID NO: 944102 - protein, 9 aa, Homo Sapiens
IRKTSKLTF

SEQ ID NO: 944103 - protein, 9 aa, Homo Sapiens
VGIPPLPPL

SEQ ID NO: 944104 - protein, 9 aa, Homo Sapiens
GYPYPYLHT

SEQ ID NO: 944105 - protein, 9 aa, Homo Sapiens
SKTLQQVKI

SEQ ID NO: 944106 - protein, 9 aa, Homo Sapiens
SKIKIPSFS

SEQ ID NO: 944107 - protein, 9 aa, Homo Sapiens
HYNPKVWPN

SEQ ID NO: 944108 - protein, 9 aa, Homo Sapiens
GYVSFRHVK

SEQ ID NO: 944109 - protein, 9 aa, Homo Sapiens
IYSPEVDEF

SEQ ID NO: 944110 - protein, 9 aa, Homo Sapiens
SLSQPGLQM

SEQ ID NO: 944111 - protein, 9 aa, Homo Sapiens
CPSQCPAPC

SEQ ID NO: 944112 - protein, 9 aa, Homo Sapiens
VFFICCGIL

SEQ ID NO: 944113 - protein, 9 aa, Homo Sapiens
SPFFSNVYP

SEQ ID NO: 944114 - protein, 9 aa, Homo Sapiens
SHGWKEISG

SEQ ID NO: 944115 - protein, 9 aa, Homo Sapiens
ILRLYKDIL

SEQ ID NO: 944116 - protein, 9 aa, Homo Sapiens
EPSLCARTG

SEQ ID NO: 944117 - protein, 9 aa, Homo Sapiens
SLTDLMTVT

SEQ ID NO: 944118 - protein, 9 aa, Homo Sapiens
YWNFEFPRP

SEQ ID NO: 944119 - protein, 9 aa, Homo Sapiens
VYFTCRAEE

SEQ ID NO: 944120 - protein, 9 aa, Homo Sapiens
ARVARAMFI

SEQ ID NO: 944121 - protein, 9 aa, Homo Sapiens
KFKKNVPEE

SEQ ID NO: 944122 - protein, 9 aa, Homo Sapiens
SEKEINPHT

SEQ ID NO: 944123 - protein, 9 aa, Homo Sapiens
TPDDVWILV

SEQ ID NO: 944124 - protein, 9 aa, Homo Sapiens
TYANKTKLK

SEQ ID NO: 944125 - protein, 9 aa, Homo Sapiens
VNNKESSEQ

SEQ ID NO: 944126 - protein, 9 aa, Homo Sapiens
VDACEETPE

SEQ ID NO: 944127 - protein, 9 aa, Homo Sapiens
LFLLLCLAL

SEQ ID NO: 944128 - protein, 9 aa, Homo Sapiens
NLIFSFCKS

SEQ ID NO: 944129 - protein, 9 aa, Homo Sapiens
RLLQSCCPR

SEQ ID NO: 944130 - protein, 9 aa, Homo Sapiens
GAFRPWEGT

SEQ ID NO: 944131 - protein, 9 aa, Homo Sapiens
LCPPSDADW

SEQ ID NO: 944132 - protein, 9 aa, Homo Sapiens
HGPSVCFFE

SEQ ID NO: 944133 - protein, 9 aa, Homo Sapiens
KKAAPVSSK

SEQ ID NO: 944134 - protein, 9 aa, Homo Sapiens
KNPKEAPKF

SEQ ID NO: 944135 - protein, 9 aa, Homo Sapiens
ANKIDVRPC

SEQ ID NO: 944136 - protein, 9 aa, Homo Sapiens
AASSTPYGH

SEQ ID NO: 944137 - protein, 9 aa, Homo Sapiens
AELETVSWK

SEQ ID NO: 944138 - protein, 9 aa, Homo Sapiens
AVILQNLKD

SEQ ID NO: 944139 - protein, 9 aa, Homo Sapiens
SLLDKGIYT

SEQ ID NO: 944140 - protein, 9 aa, Homo Sapiens
REDTLSEEF

SEQ ID NO: 944141 - protein, 9 aa, Homo Sapiens
MIPFEVLTL

SEQ ID NO: 944142 - protein, 9 aa, Homo Sapiens
SWPASSGSL

SEQ ID NO: 944143 - protein, 9 aa, Homo Sapiens
PAQVSGRRY

SEQ ID NO: 944144 - protein, 9 aa, Homo Sapiens
FSPEYFVIG

SEQ ID NO: 944145 - protein, 9 aa, Homo Sapiens
GDKVIFSGK

SEQ ID NO: 944146 - protein, 9 aa, Homo Sapiens
RLHYNKELN

SEQ ID NO: 944147 - protein, 9 aa, Homo Sapiens
PLKPPRIDT

SEQ ID NO: 944148 - protein, 9 aa, Homo Sapiens
ESKDPKHFK

SEQ ID NO: 944149 - protein, 9 aa, Homo Sapiens
QKGELQALR

SEQ ID NO: 944150 - protein, 9 aa, Homo Sapiens
ANSCANPIF

SEQ ID NO: 944151 - protein, 9 aa, Homo Sapiens
QLVGELVTV

SEQ ID NO: 944152 - protein, 9 aa, Homo Sapiens
AFRRPAHLF

SEQ ID NO: 944153 - protein, 9 aa, Homo Sapiens
FLTFPEELS

SEQ ID NO: 944154 - protein, 9 aa, Homo Sapiens
CTFCEICLH

SEQ ID NO: 944155 - protein, 9 aa, Homo Sapiens
SFDLTKVWP

SEQ ID NO: 944156 - protein, 9 aa, Homo Sapiens
DSTGQSVNA

SEQ ID NO: 944157 - protein, 9 aa, Homo Sapiens
HLKVKEGCP

SEQ ID NO: 944158 - protein, 9 aa, Homo Sapiens
NKQEAVFEN

SEQ ID NO: 944159 - protein, 9 aa, Homo Sapiens
EYVITKFGR

SEQ ID NO: 944160 - protein, 9 aa, Homo Sapiens
VLPSVPQNA

SEQ ID NO: 944161 - protein, 9 aa, Homo Sapiens
TFILYLHPV

SEQ ID NO: 944162 - protein, 9 aa, Homo Sapiens
PCNECGKFF

SEQ ID NO: 944163 - protein, 9 aa, Homo Sapiens
FSRVTTVSD

SEQ ID NO: 944164 - protein, 9 aa, Homo Sapiens
EEEEEKEVE

SEQ ID NO: 944165 - protein, 9 aa, Homo Sapiens
EPKSPKPTA

SEQ ID NO: 944166 - protein, 9 aa, Homo Sapiens
EGSESESSC

SEQ ID NO: 944167 - protein, 9 aa, Homo Sapiens
FLKCFEDNP

SEQ ID NO: 944168 - protein, 9 aa, Homo Sapiens
LVSELIKEL

SEQ ID NO: 944169 - protein, 9 aa, Homo Sapiens
ILDKWQYIR

SEQ ID NO: 944170 - protein, 9 aa, Homo Sapiens
ILKTTHINT

SEQ ID NO: 944171 - protein, 9 aa, Homo Sapiens
VQCCVEDET

SEQ ID NO: 944172 - protein, 9 aa, Homo Sapiens
ELSEAKVAQ

SEQ ID NO: 944173 - protein, 9 aa, Homo Sapiens
KPVLFFWQN

SEQ ID NO: 944174 - protein, 9 aa, Homo Sapiens
RFYRNRDRY

SEQ ID NO: 944175 - protein, 9 aa, Homo Sapiens
LGVPSDPGG

SEQ ID NO: 944176 - protein, 9 aa, Homo Sapiens
LSVLPSVPQ

SEQ ID NO: 944177 - protein, 9 aa, Homo Sapiens
SRSYSRSPL

SEQ ID NO: 944178 - protein, 9 aa, Homo Sapiens
RERIWLALQ

SEQ ID NO: 944179 - protein, 9 aa, Homo Sapiens
VGRRLAGGN

SEQ ID NO: 944180 - protein, 9 aa, Homo Sapiens
AIPQERVYE

SEQ ID NO: 944181 - protein, 9 aa, Homo Sapiens
AQLSSCDSS

SEQ ID NO: 944182 - protein, 9 aa, Homo Sapiens
DCRKSGKNG

SEQ ID NO: 944183 - protein, 9 aa, Homo Sapiens
HQKIYTGEK

SEQ ID NO: 944184 - protein, 9 aa, Homo Sapiens
QSVKQRYKE

SEQ ID NO: 944185 - protein, 9 aa, Homo Sapiens
FPGNGSFTG

SEQ ID NO: 944186 - protein, 9 aa, Homo Sapiens
PFPKPHPCS

SEQ ID NO: 944187 - protein, 9 aa, Homo Sapiens
RENKNLQKE

SEQ ID NO: 944188 - protein, 9 aa, Homo Sapiens
EDNMLCSKC

SEQ ID NO: 944189 - protein, 9 aa, Homo Sapiens
ALPSVQPHA

SEQ ID NO: 944190 - protein, 9 aa, Homo Sapiens
NLCEDIMGY

SEQ ID NO: 944191 - protein, 9 aa, Homo Sapiens
MIERCICFV

SEQ ID NO: 944192 - protein, 9 aa, Homo Sapiens
SSTMETLRD

SEQ ID NO: 944193 - protein, 9 aa, Homo Sapiens
QEEEIMFLQ

SEQ ID NO: 944194 - protein, 9 aa, Homo Sapiens
LFLMAAFIL

SEQ ID NO: 944195 - protein, 9 aa, Homo Sapiens
LSSRTHLRA

SEQ ID NO: 944196 - protein, 9 aa, Homo Sapiens
PRCTCPVLI

SEQ ID NO: 944197 - protein, 9 aa, Homo Sapiens
VRSGLGTDG

SEQ ID NO: 944198 - protein, 9 aa, Homo Sapiens
EREAEENNL

SEQ ID NO: 944199 - protein, 9 aa, Homo Sapiens
NLPLHQEVD

SEQ ID NO: 944200 - protein, 9 aa, Homo Sapiens
NMLNFNHEL

SEQ ID NO: 944201 - protein, 9 aa, Homo Sapiens
QHSTPLRGR

SEQ ID NO: 944202 - protein, 9 aa, Homo Sapiens
GKLQEPWER

SEQ ID NO: 944203 - protein, 9 aa, Homo Sapiens
DKALPPNWE

SEQ ID NO: 944204 - protein, 9 aa, Homo Sapiens
KVNLDSCTR

SEQ ID NO: 944205 - protein, 9 aa, Homo Sapiens
VEELLGSGP

SEQ ID NO: 944206 - protein, 9 aa, Homo Sapiens
GFSRSCQTQ

SEQ ID NO: 944207 - protein, 9 aa, Homo Sapiens
THEFENAES

SEQ ID NO: 944208 - protein, 9 aa, Homo Sapiens
ETKLKENTM

SEQ ID NO: 944209 - protein, 9 aa, Homo Sapiens
YKDYLLFGY

SEQ ID NO: 944210 - protein, 9 aa, Homo Sapiens
EFPGNGSFT

SEQ ID NO: 944211 - protein, 9 aa, Homo Sapiens
QKLPPPGQG

SEQ ID NO: 944212 - protein, 9 aa, Homo Sapiens
ELLMPQAEV

SEQ ID NO: 944213 - protein, 9 aa, Homo Sapiens
ECQGSGRPR

SEQ ID NO: 944214 - protein, 9 aa, Homo Sapiens
VIRGPGPSS

SEQ ID NO: 944215 - protein, 9 aa, Homo Sapiens
TWSLAKLIQ

SEQ ID NO: 944216 - protein, 9 aa, Homo Sapiens
VVKFVNWIC

SEQ ID NO: 944217 - protein, 9 aa, Homo Sapiens
YRLREDTLS

SEQ ID NO: 944218 - protein, 9 aa, Homo Sapiens
RQSFLNRMG

SEQ ID NO: 944219 - protein, 9 aa, Homo Sapiens
TPHKYPSVY

SEQ ID NO: 944220 - protein, 9 aa, Homo Sapiens
RCVNQQCIS

SEQ ID NO: 944221 - protein, 9 aa, Homo Sapiens
QVTGISQSW

SEQ ID NO: 944222 - protein, 9 aa, Homo Sapiens
PSPGGGAPW

SEQ ID NO: 944223 - protein, 9 aa, Homo Sapiens
IPSSSISLG

SEQ ID NO: 944224 - protein, 9 aa, Homo Sapiens
LVIHRAFDR

SEQ ID NO: 944225 - protein, 9 aa, Homo Sapiens
LPDLYALEH

SEQ ID NO: 944226 - protein, 9 aa, Homo Sapiens
KYFVFPTLF

SEQ ID NO: 944227 - protein, 9 aa, Homo Sapiens
ALPAPKQKV

SEQ ID NO: 944228 - protein, 9 aa, Homo Sapiens
NDLSSFREL

SEQ ID NO: 944229 - protein, 9 aa, Homo Sapiens
NTQDRYTRN

SEQ ID NO: 944230 - protein, 9 aa, Homo Sapiens
RPLCALSQF

SEQ ID NO: 944231 - protein, 9 aa, Homo Sapiens
DLQQHYLGA

SEQ ID NO: 944232 - protein, 9 aa, Homo Sapiens
PISDHKLIV

SEQ ID NO: 944233 - protein, 9 aa, Homo Sapiens
QQKLFFFLQ

SEQ ID NO: 944234 - protein, 9 aa, Homo Sapiens
GAVVIILLR

SEQ ID NO: 944235 - protein, 9 aa, Homo Sapiens
FIGTEPDSV

SEQ ID NO: 944236 - protein, 9 aa, Homo Sapiens
AQKQQSLIH

SEQ ID NO: 944237 - protein, 9 aa, Homo Sapiens
PRHAGGRPA

SEQ ID NO: 944238 - protein, 9 aa, Homo Sapiens
ESLFQGMGG

SEQ ID NO: 944239 - protein, 9 aa, Homo Sapiens
SSGITNRKT

SEQ ID NO: 944240 - protein, 9 aa, Homo Sapiens
NAACGVRCY

SEQ ID NO: 944241 - protein, 9 aa, Homo Sapiens
DPSIHLRGK

SEQ ID NO: 944242 - protein, 9 aa, Homo Sapiens
GQLLILKGP

SEQ ID NO: 944243 - protein, 9 aa, Homo Sapiens
LEIILLSVI

SEQ ID NO: 944244 - protein, 9 aa, Homo Sapiens
VGFVLDKLL

SEQ ID NO: 944245 - protein, 9 aa, Homo Sapiens
NNDRCGCCG

SEQ ID NO: 944246 - protein, 9 aa, Homo Sapiens
LFQGMGGEE

SEQ ID NO: 944247 - protein, 9 aa, Homo Sapiens
KMSQNTQDR

SEQ ID NO: 944248 - protein, 9 aa, Homo Sapiens
YKECKDLIK

SEQ ID NO: 944249 - protein, 9 aa, Homo Sapiens
SSPGDSSSA

SEQ ID NO: 944250 - protein, 9 aa, Homo Sapiens
TLLPLWLPF

SEQ ID NO: 944251 - protein, 9 aa, Homo Sapiens
PMPCGSGRG

SEQ ID NO: 944252 - protein, 9 aa, Homo Sapiens
SPSLVSMGR

SEQ ID NO: 944253 - protein, 9 aa, Homo Sapiens
DWKVPKFSG

SEQ ID NO: 944254 - protein, 9 aa, Homo Sapiens
KTPAWPRVP

SEQ ID NO: 944255 - protein, 9 aa, Homo Sapiens
PTSLPPGDP

SEQ ID NO: 944256 - protein, 9 aa, Homo Sapiens
LREKVEKLN

SEQ ID NO: 944257 - protein, 9 aa, Homo Sapiens
IHVLNVERF

SEQ ID NO: 944258 - protein, 9 aa, Homo Sapiens
TYIHIIDQK

SEQ ID NO: 944259 - protein, 9 aa, Homo Sapiens
PLEKSQAFM

SEQ ID NO: 944260 - protein, 9 aa, Homo Sapiens
IDQKTRQPV

SEQ ID NO: 944261 - protein, 9 aa, Homo Sapiens
HLNIRGNRI

SEQ ID NO: 944262 - protein, 9 aa, Homo Sapiens
HCRKSCYST

SEQ ID NO: 944263 - protein, 9 aa, Homo Sapiens
SFRLWDTFG

SEQ ID NO: 944264 - protein, 9 aa, Homo Sapiens
ERSKETPES

SEQ ID NO: 944265 - protein, 9 aa, Homo Sapiens
GMFTRLFNC

SEQ ID NO: 944266 - protein, 9 aa, Homo Sapiens
DEFRSQIKN

SEQ ID NO: 944267 - protein, 9 aa, Homo Sapiens
RGGSSKPGS

SEQ ID NO: 944268 - protein, 9 aa, Homo Sapiens
TFGMVVCNW

SEQ ID NO: 944269 - protein, 9 aa, Homo Sapiens
SRTQQWTAI

SEQ ID NO: 944270 - protein, 9 aa, Homo Sapiens
KNPVTAVLV

SEQ ID NO: 944271 - protein, 9 aa, Homo Sapiens
APAASSTPY

SEQ ID NO: 944272 - protein, 9 aa, Homo Sapiens
AENSHRERL

SEQ ID NO: 944273 - protein, 9 aa, Homo Sapiens
ELWQVRSET

SEQ ID NO: 944274 - protein, 9 aa, Homo Sapiens
HIRFLQQQM

SEQ ID NO: 944275 - protein, 9 aa, Homo Sapiens
DQAVYQEAQ

SEQ ID NO: 944276 - protein, 9 aa, Homo Sapiens
PAADGLSEK

SEQ ID NO: 944277 - protein, 9 aa, Homo Sapiens
FSGGELDDA

SEQ ID NO: 944278 - protein, 9 aa, Homo Sapiens
VVYHRHTLT

SEQ ID NO: 944279 - protein, 9 aa, Homo Sapiens
SCPIDVDGL

SEQ ID NO: 944280 - protein, 9 aa, Homo Sapiens
QICSHLHRS

SEQ ID NO: 944281 - protein, 9 aa, Homo Sapiens
EIDGLVVGN

SEQ ID NO: 944282 - protein, 9 aa, Homo Sapiens
WFRMATARI

SEQ ID NO: 944283 - protein, 9 aa, Homo Sapiens
HLRGKGRAN

SEQ ID NO: 944284 - protein, 9 aa, Homo Sapiens
HLPAQVSGR

SEQ ID NO: 944285 - protein, 9 aa, Homo Sapiens
FMVINSDTD

SEQ ID NO: 944286 - protein, 9 aa, Homo Sapiens
VIFLLFINL

SEQ ID NO: 944287 - protein, 9 aa, Homo Sapiens
QELKEKMDK

SEQ ID NO: 944288 - protein, 9 aa, Homo Sapiens
SLEDCLHCQ

SEQ ID NO: 944289 - protein, 9 aa, Homo Sapiens
GKIFQGNPD

SEQ ID NO: 944290 - protein, 9 aa, Homo Sapiens
DVNENLHTS

SEQ ID NO: 944291 - protein, 9 aa, Homo Sapiens
PWAAFATDK

SEQ ID NO: 944292 - protein, 9 aa, Homo Sapiens
FKVDACEET

SEQ ID NO: 944293 - protein, 9 aa, Homo Sapiens
WSQRLSPKE

SEQ ID NO: 944294 - protein, 9 aa, Homo Sapiens
KQEKTCRAY

SEQ ID NO: 944295 - protein, 9 aa, Homo Sapiens
FFSRSKLQT

SEQ ID NO: 944296 - protein, 9 aa, Homo Sapiens
ARPPLSGDR

SEQ ID NO: 944297 - protein, 9 aa, Homo Sapiens
ASMLEDSGF

SEQ ID NO: 944298 - protein, 9 aa, Homo Sapiens
LSKPFSPPN

SEQ ID NO: 944299 - protein, 9 aa, Homo Sapiens
ISEKLDSFI

SEQ ID NO: 944300 - protein, 9 aa, Homo Sapiens
REAEENNLS

SEQ ID NO: 944301 - protein, 9 aa, Homo Sapiens
FAVPTTKSN

SEQ ID NO: 944302 - protein, 9 aa, Homo Sapiens
FFWKLQATE

SEQ ID NO: 944303 - protein, 9 aa, Homo Sapiens
NGLLWEAEA

SEQ ID NO: 944304 - protein, 9 aa, Homo Sapiens
REGLQKREE

SEQ ID NO: 944305 - protein, 9 aa, Homo Sapiens
LRRKFKKNV

SEQ ID NO: 944306 - protein, 9 aa, Homo Sapiens
IGSFVGGAK

SEQ ID NO: 944307 - protein, 9 aa, Homo Sapiens
KFNGVYQSM

SEQ ID NO: 944308 - protein, 9 aa, Homo Sapiens
ANGACLCKH

SEQ ID NO: 944309 - protein, 9 aa, Homo Sapiens
GGDWVIEKV

SEQ ID NO: 944310 - protein, 9 aa, Homo Sapiens
KKLTPFLLK

SEQ ID NO: 944311 - protein, 9 aa, Homo Sapiens
GFRKAVDGV

SEQ ID NO: 944312 - protein, 9 aa, Homo Sapiens
DMNNKITYY

SEQ ID NO: 944313 - protein, 9 aa, Homo Sapiens
CTTKFLAMD

SEQ ID NO: 944314 - protein, 9 aa, Homo Sapiens
INVSPEMRQ

SEQ ID NO: 944315 - protein, 9 aa, Homo Sapiens
DKNIPIPPI

SEQ ID NO: 944316 - protein, 9 aa, Homo Sapiens
MFIALKQVF

SEQ ID NO: 944317 - protein, 9 aa, Homo Sapiens
NPHHRIPLS

SEQ ID NO: 944318 - protein, 9 aa, Homo Sapiens
IRSSKESLE

SEQ ID NO: 944319 - protein, 9 aa, Homo Sapiens
KEPSMIEYV

SEQ ID NO: 944320 - protein, 9 aa, Homo Sapiens
DESKFLKSQ

SEQ ID NO: 944321 - protein, 9 aa, Homo Sapiens
GHSDPKLSW

SEQ ID NO: 944322 - protein, 9 aa, Homo Sapiens
ASGFTDKKE

SEQ ID NO: 944323 - protein, 9 aa, Homo Sapiens
NKESSEQGS

SEQ ID NO: 944324 - protein, 9 aa, Homo Sapiens
RSCQTQDWV

SEQ ID NO: 944325 - protein, 9 aa, Homo Sapiens
PKVPKKIVP

SEQ ID NO: 944326 - protein, 9 aa, Homo Sapiens
TSAAAAQGL

SEQ ID NO: 944327 - protein, 9 aa, Homo Sapiens
RLEVEELLG

SEQ ID NO: 944328 - protein, 9 aa, Homo Sapiens
FLFSRKEEC

SEQ ID NO: 944329 - protein, 9 aa, Homo Sapiens
ARPRPCLFK

SEQ ID NO: 944330 - protein, 9 aa, Homo Sapiens
KQKEQCSLL

SEQ ID NO: 944331 - protein, 9 aa, Homo Sapiens
PRTPSGDAD

SEQ ID NO: 944332 - protein, 9 aa, Homo Sapiens
AVGANTTLQ

SEQ ID NO: 944333 - protein, 9 aa, Homo Sapiens
TGWHEGVPT

SEQ ID NO: 944334 - protein, 9 aa, Homo Sapiens
GAERRTSKA

SEQ ID NO: 944335 - protein, 9 aa, Homo Sapiens
LTCPGQAKF

SEQ ID NO: 944336 - protein, 9 aa, Homo Sapiens
NHLPAQVSG

SEQ ID NO: 944337 - protein, 9 aa, Homo Sapiens
YSPTRANTT

SEQ ID NO: 944338 - protein, 9 aa, Homo Sapiens
LVWKERTQF

SEQ ID NO: 944339 - protein, 9 aa, Homo Sapiens
TEDVEEERP

SEQ ID NO: 944340 - protein, 9 aa, Homo Sapiens
LSENAVLIL

SEQ ID NO: 944341 - protein, 9 aa, Homo Sapiens
PRGAGFANQ

SEQ ID NO: 944342 - protein, 9 aa, Homo Sapiens
GDTTPFPVT

SEQ ID NO: 944343 - protein, 9 aa, Homo Sapiens
VHLINPEYV

SEQ ID NO: 944344 - protein, 9 aa, Homo Sapiens
AKKFLKRDM

SEQ ID NO: 944345 - protein, 9 aa, Homo Sapiens
VCEDTKRQL

SEQ ID NO: 944346 - protein, 9 aa, Homo Sapiens
NIFREINKS

SEQ ID NO: 944347 - protein, 9 aa, Homo Sapiens
KLQHRYQEL

SEQ ID NO: 944348 - protein, 9 aa, Homo Sapiens
FGIVGAYDW

SEQ ID NO: 944349 - protein, 9 aa, Homo Sapiens
MELEISPTI

SEQ ID NO: 944350 - protein, 9 aa, Homo Sapiens
PEWDTVTLE

SEQ ID NO: 944351 - protein, 9 aa, Homo Sapiens
RGVLAGTAV

SEQ ID NO: 944352 - protein, 9 aa, Homo Sapiens
YPYLHTLYL

SEQ ID NO: 944353 - protein, 9 aa, Homo Sapiens
GGNGVVEVP

SEQ ID NO: 944354 - protein, 9 aa, Homo Sapiens
DLEKHKCSV

SEQ ID NO: 944355 - protein, 9 aa, Homo Sapiens
GKPFLSADW

SEQ ID NO: 944356 - protein, 9 aa, Homo Sapiens
STTFFTPGS

SEQ ID NO: 944357 - protein, 9 aa, Homo Sapiens
PSVVQCCVE

SEQ ID NO: 944358 - protein, 9 aa, Homo Sapiens
HRINLPPFT

SEQ ID NO: 944359 - protein, 9 aa, Homo Sapiens
GVRCYPGFD

SEQ ID NO: 944360 - protein, 9 aa, Homo Sapiens
RALKKGHRQ

SEQ ID NO: 944361 - protein, 9 aa, Homo Sapiens
VTNKETEAR

SEQ ID NO: 944362 - protein, 9 aa, Homo Sapiens
VSAMSGHRP

SEQ ID NO: 944363 - protein, 9 aa, Homo Sapiens
QPLAQKPPA

SEQ ID NO: 944364 - protein, 9 aa, Homo Sapiens
AAAASASLY

SEQ ID NO: 944365 - protein, 9 aa, Homo Sapiens
SIERLFFFP

SEQ ID NO: 944366 - protein, 9 aa, Homo Sapiens
NNNRGVVQG

SEQ ID NO: 944367 - protein, 9 aa, Homo Sapiens
GRGSGISVL

SEQ ID NO: 944368 - protein, 9 aa, Homo Sapiens
KESGWSGYS

SEQ ID NO: 944369 - protein, 9 aa, Homo Sapiens
NSQNIAKDE

SEQ ID NO: 944370 - protein, 9 aa, Homo Sapiens
NVACCVKMI

SEQ ID NO: 944371 - protein, 9 aa, Homo Sapiens
QQLYPALIQ

SEQ ID NO: 944372 - protein, 9 aa, Homo Sapiens
IYGNPRKLL

SEQ ID NO: 944373 - protein, 9 aa, Homo Sapiens
SHLTGLLSL

SEQ ID NO: 944374 - protein, 9 aa, Homo Sapiens
VRDTTTLSG

SEQ ID NO: 944375 - protein, 9 aa, Homo Sapiens
FQDLKKCYS

SEQ ID NO: 944376 - protein, 9 aa, Homo Sapiens
YWGLPSFAH

SEQ ID NO: 944377 - protein, 9 aa, Homo Sapiens
SSMGSGAAP

SEQ ID NO: 944378 - protein, 9 aa, Homo Sapiens
APELLWWDL

SEQ ID NO: 944379 - protein, 9 aa, Homo Sapiens
VVYTGKKPN

SEQ ID NO: 944380 - protein, 9 aa, Homo Sapiens
LQQHYLGAS

SEQ ID NO: 944381 - protein, 9 aa, Homo Sapiens
KEIMANTTI

SEQ ID NO: 944382 - protein, 9 aa, Homo Sapiens
SYRSPFASR

SEQ ID NO: 944383 - protein, 9 aa, Homo Sapiens
DEFDSVPLK

SEQ ID NO: 944384 - protein, 9 aa, Homo Sapiens
TVIRGHESE

SEQ ID NO: 944385 - protein, 9 aa, Homo Sapiens
LLKLLARAS

SEQ ID NO: 944386 - protein, 9 aa, Homo Sapiens
QLADDFTDN

SEQ ID NO: 944387 - protein, 9 aa, Homo Sapiens
YPETRHWTA

SEQ ID NO: 944388 - protein, 9 aa, Homo Sapiens
ETTEISSHE

SEQ ID NO: 944389 - protein, 9 aa, Homo Sapiens
VWNGWKEFL

SEQ ID NO: 944390 - protein, 9 aa, Homo Sapiens
SCLLLSTSK

SEQ ID NO: 944391 - protein, 9 aa, Homo Sapiens
KCDQCSLET

SEQ ID NO: 944392 - protein, 9 aa, Homo Sapiens
NKIGGNGMS

SEQ ID NO: 944393 - protein, 9 aa, Homo Sapiens
SDYCPFLCF

SEQ ID NO: 944394 - protein, 9 aa, Homo Sapiens
ENLHWGPWE

SEQ ID NO: 944395 - protein, 9 aa, Homo Sapiens
PKCDQCSLE

SEQ ID NO: 944396 - protein, 9 aa, Homo Sapiens
SVFSRFSSG

SEQ ID NO: 944397 - protein, 9 aa, Homo Sapiens
TSKVSGCRN

SEQ ID NO: 944398 - protein, 9 aa, Homo Sapiens
TVGFIPNDA

SEQ ID NO: 944399 - protein, 9 aa, Homo Sapiens
KDLFCSKNL

SEQ ID NO: 944400 - protein, 9 aa, Homo Sapiens
QNNMTSLEN

SEQ ID NO: 944401 - protein, 9 aa, Homo Sapiens
RLCTSRHLQ

SEQ ID NO: 944402 - protein, 9 aa, Homo Sapiens
AVGYSSYDF

SEQ ID NO: 944403 - protein, 9 aa, Homo Sapiens
VEQFVFEVL

SEQ ID NO: 944404 - protein, 9 aa, Homo Sapiens
RKWARIWEF

SEQ ID NO: 944405 - protein, 9 aa, Homo Sapiens
HPDPRHAGG

SEQ ID NO: 944406 - protein, 9 aa, Homo Sapiens
VHELIVSGA

SEQ ID NO: 944407 - protein, 9 aa, Homo Sapiens
TYVNANKEV

SEQ ID NO: 944408 - protein, 9 aa, Homo Sapiens
RKMSPLRLL

SEQ ID NO: 944409 - protein, 9 aa, Homo Sapiens
SDNENGRPI

SEQ ID NO: 944410 - protein, 9 aa, Homo Sapiens
LEDNMLCSK

SEQ ID NO: 944411 - protein, 9 aa, Homo Sapiens
NECGKIFQG

SEQ ID NO: 944412 - protein, 9 aa, Homo Sapiens
TFVFRLPFC

SEQ ID NO: 944413 - protein, 9 aa, Homo Sapiens
RGPRGVLAG

SEQ ID NO: 944414 - protein, 9 aa, Homo Sapiens
PLEEDSERI

SEQ ID NO: 944415 - protein, 9 aa, Homo Sapiens
SEEKRTLLV

SEQ ID NO: 944416 - protein, 9 aa, Homo Sapiens
INPTSLPPG

SEQ ID NO: 944417 - protein, 9 aa, Homo Sapiens
SPSLSQPGL

SEQ ID NO: 944418 - protein, 9 aa, Homo Sapiens
EIAAACIHM

SEQ ID NO: 944419 - protein, 9 aa, Homo Sapiens
LHKKSLKFY

SEQ ID NO: 944420 - protein, 9 aa, Homo Sapiens
DLPSNITLG

SEQ ID NO: 944421 - protein, 9 aa, Homo Sapiens
SQDQQAGRR

SEQ ID NO: 944422 - protein, 9 aa, Homo Sapiens
WPKGTVGKI

SEQ ID NO: 944423 - protein, 9 aa, Homo Sapiens
SMDGFWMKV

SEQ ID NO: 944424 - protein, 9 aa, Homo Sapiens
FTQKFYLKC

SEQ ID NO: 944425 - protein, 9 aa, Homo Sapiens
FVQFSWLIM

SEQ ID NO: 944426 - protein, 9 aa, Homo Sapiens
QRSPDDELL

SEQ ID NO: 944427 - protein, 9 aa, Homo Sapiens
GLFKETITL

SEQ ID NO: 944428 - protein, 9 aa, Homo Sapiens
VFLLGMPEL

SEQ ID NO: 944429 - protein, 9 aa, Homo Sapiens
HYLGASYLL

SEQ ID NO: 944430 - protein, 9 aa, Homo Sapiens
PGASRGLRG

SEQ ID NO: 944431 - protein, 9 aa, Homo Sapiens
RTVPMGGVC

SEQ ID NO: 944432 - protein, 9 aa, Homo Sapiens
PLGPHLQNL

SEQ ID NO: 944433 - protein, 9 aa, Homo Sapiens
YFENREWVC

SEQ ID NO: 944434 - protein, 9 aa, Homo Sapiens
GDTFFEEYT

SEQ ID NO: 944435 - protein, 9 aa, Homo Sapiens
LREPGRSKE

SEQ ID NO: 944436 - protein, 9 aa, Homo Sapiens
YHRHTLTSR

SEQ ID NO: 944437 - protein, 9 aa, Homo Sapiens
IQCNVRNSR

SEQ ID NO: 944438 - protein, 9 aa, Homo Sapiens
SQGLSWHND

SEQ ID NO: 944439 - protein, 9 aa, Homo Sapiens
RLEPKPDKS

SEQ ID NO: 944440 - protein, 9 aa, Homo Sapiens
LLNQPAFSS

SEQ ID NO: 944441 - protein, 9 aa, Homo Sapiens
LEINEKLRS

SEQ ID NO: 944442 - protein, 9 aa, Homo Sapiens
REHFIYGNP

SEQ ID NO: 944443 - protein, 9 aa, Homo Sapiens
LPVALSLRM

SEQ ID NO: 944444 - protein, 9 aa, Homo Sapiens
RLSNSRGSN

SEQ ID NO: 944445 - protein, 9 aa, Homo Sapiens
ESIKEGFPS

SEQ ID NO: 944446 - protein, 9 aa, Homo Sapiens
AGWGLCEVL

SEQ ID NO: 944447 - protein, 9 aa, Homo Sapiens
APLDFGYEK

SEQ ID NO: 944448 - protein, 9 aa, Homo Sapiens
LGAELSEAK

SEQ ID NO: 944449 - protein, 9 aa, Homo Sapiens
APLGAPNLF

SEQ ID NO: 944450 - protein, 9 aa, Homo Sapiens
RDALAALHE

SEQ ID NO: 944451 - protein, 9 aa, Homo Sapiens
QKLFFFLQR

SEQ ID NO: 944452 - protein, 9 aa, Homo Sapiens
LKEKSKSPF

SEQ ID NO: 944453 - protein, 9 aa, Homo Sapiens
CYDPRKFYV

SEQ ID NO: 944454 - protein, 9 aa, Homo Sapiens
RNQRYKRYS

SEQ ID NO: 944455 - protein, 9 aa, Homo Sapiens
DNISCWPFS

SEQ ID NO: 944456 - protein, 9 aa, Homo Sapiens
LFFFLQREG

SEQ ID NO: 944457 - protein, 9 aa, Homo Sapiens
TRLYTLERY

SEQ ID NO: 944458 - protein, 9 aa, Homo Sapiens
NPMEVFKEV

SEQ ID NO: 944459 - protein, 9 aa, Homo Sapiens
ILYLHPVDN

SEQ ID NO: 944460 - protein, 9 aa, Homo Sapiens
DAVLSMALP

SEQ ID NO: 944461 - protein, 9 aa, Homo Sapiens
FDLSHNRMK

SEQ ID NO: 944462 - protein, 9 aa, Homo Sapiens
EQVEEQCHL

SEQ ID NO: 944463 - protein, 9 aa, Homo Sapiens
EILEITGGP

SEQ ID NO: 944464 - protein, 9 aa, Homo Sapiens
VSRYQRVDK

SEQ ID NO: 944465 - protein, 9 aa, Homo Sapiens
VQRELILQD

SEQ ID NO: 944466 - protein, 9 aa, Homo Sapiens
ETFSDDLSP

SEQ ID NO: 944467 - protein, 9 aa, Homo Sapiens
FYCFAILPV

SEQ ID NO: 944468 - protein, 9 aa, Homo Sapiens
NFILKVAYI

SEQ ID NO: 944469 - protein, 9 aa, Homo Sapiens
APNFVMLAA

SEQ ID NO: 944470 - protein, 9 aa, Homo Sapiens
VDNVHFFTG

SEQ ID NO: 944471 - protein, 9 aa, Homo Sapiens
TGNSASVSL

SEQ ID NO: 944472 - protein, 9 aa, Homo Sapiens
NLDHRGFSN

SEQ ID NO: 944473 - protein, 9 aa, Homo Sapiens
VIHRAFDRE

SEQ ID NO: 944474 - protein, 9 aa, Homo Sapiens
RPDGCPELC

SEQ ID NO: 944475 - protein, 9 aa, Homo Sapiens
CSPLSYRSL

SEQ ID NO: 944476 - protein, 9 aa, Homo Sapiens
DHLESGAFG

SEQ ID NO: 944477 - protein, 9 aa, Homo Sapiens
VTKSTPVII

SEQ ID NO: 944478 - protein, 9 aa, Homo Sapiens
KPAASQLKS

SEQ ID NO: 944479 - protein, 9 aa, Homo Sapiens
EDEWDSSHI

SEQ ID NO: 944480 - protein, 9 aa, Homo Sapiens
KILVEVLPQ

SEQ ID NO: 944481 - protein, 9 aa, Homo Sapiens
PAVIACSFP

SEQ ID NO: 944482 - protein, 9 aa, Homo Sapiens
VFNEPSTSK

SEQ ID NO: 944483 - protein, 9 aa, Homo Sapiens
LGAPNLFHL

SEQ ID NO: 944484 - protein, 9 aa, Homo Sapiens
RSPFASRYA

SEQ ID NO: 944485 - protein, 9 aa, Homo Sapiens
VPLWMIALL

SEQ ID NO: 944486 - protein, 9 aa, Homo Sapiens
GPLGSPGLP

SEQ ID NO: 944487 - protein, 9 aa, Homo Sapiens
KAKEWEMKT

SEQ ID NO: 944488 - protein, 9 aa, Homo Sapiens
STAMTSAAA

SEQ ID NO: 944489 - protein, 9 aa, Homo Sapiens
RRQKFHRPI

SEQ ID NO: 944490 - protein, 9 aa, Homo Sapiens
EDESKFLKS

SEQ ID NO: 944491 - protein, 9 aa, Homo Sapiens
NFFRGDCCR

SEQ ID NO: 944492 - protein, 9 aa, Homo Sapiens
LLQSCCPRV

SEQ ID NO: 944493 - protein, 9 aa, Homo Sapiens
QEKTCRAYL

SEQ ID NO: 944494 - protein, 9 aa, Homo Sapiens
LLPCVAMLR

SEQ ID NO: 944495 - protein, 9 aa, Homo Sapiens
RPGPSPGPI

SEQ ID NO: 944496 - protein, 9 aa, Homo Sapiens
KCGNCGEIL

SEQ ID NO: 944497 - protein, 9 aa, Homo Sapiens
SSANKIDVR

SEQ ID NO: 944498 - protein, 9 aa, Homo Sapiens
KVLQLSSFP

SEQ ID NO: 944499 - protein, 9 aa, Homo Sapiens
REGLICARL

SEQ ID NO: 944500 - protein, 9 aa, Homo Sapiens
KFIAAQGLK

SEQ ID NO: 944501 - protein, 9 aa, Homo Sapiens
EFSKPQILK

SEQ ID NO: 944502 - protein, 9 aa, Homo Sapiens
LFRKRRERE

SEQ ID NO: 944503 - protein, 9 aa, Homo Sapiens
HRQSRSHHL

SEQ ID NO: 944504 - protein, 9 aa, Homo Sapiens
VDLCLQTLE

SEQ ID NO: 944505 - protein, 9 aa, Homo Sapiens
TTTLSGPRT

SEQ ID NO: 944506 - protein, 9 aa, Homo Sapiens
KKKKKEKEG

SEQ ID NO: 944507 - protein, 9 aa, Homo Sapiens
FSVPGRMVE

SEQ ID NO: 944508 - protein, 9 aa, Homo Sapiens
VCLIGEKLF

SEQ ID NO: 944509 - protein, 9 aa, Homo Sapiens
IGMISVGPS

SEQ ID NO: 944510 - protein, 9 aa, Homo Sapiens
GRYCGSVHF

SEQ ID NO: 944511 - protein, 9 aa, Homo Sapiens
PLCGHKCLL

SEQ ID NO: 944512 - protein, 9 aa, Homo Sapiens
MFCNHKTFY

SEQ ID NO: 944513 - protein, 9 aa, Homo Sapiens
EEEPKKTEA

SEQ ID NO: 944514 - protein, 9 aa, Homo Sapiens
VVDWGLQKS

SEQ ID NO: 944515 - protein, 9 aa, Homo Sapiens
KVNGGPQRN

SEQ ID NO: 944516 - protein, 9 aa, Homo Sapiens
QECICIYDV

SEQ ID NO: 944517 - protein, 9 aa, Homo Sapiens
RYYKESKDP

SEQ ID NO: 944518 - protein, 9 aa, Homo Sapiens
NVLPISDHK

SEQ ID NO: 944519 - protein, 9 aa, Homo Sapiens
SDNCTALIV

SEQ ID NO: 944520 - protein, 9 aa, Homo Sapiens
NALRMIQLA

SEQ ID NO: 944521 - protein, 9 aa, Homo Sapiens
PGPGENESQ

SEQ ID NO: 944522 - protein, 9 aa, Homo Sapiens
TFKNKKHQK

SEQ ID NO: 944523 - protein, 9 aa, Homo Sapiens
TETTEISSH

SEQ ID NO: 944524 - protein, 9 aa, Homo Sapiens
KTRLYTLER

SEQ ID NO: 944525 - protein, 9 aa, Homo Sapiens
FTACQKVPF

SEQ ID NO: 944526 - protein, 9 aa, Homo Sapiens
LKTLGNHFW

SEQ ID NO: 944527 - protein, 9 aa, Homo Sapiens
KVMYVRVSF

SEQ ID NO: 944528 - protein, 9 aa, Homo Sapiens
KIRLEQNSI

SEQ ID NO: 944529 - protein, 9 aa, Homo Sapiens
LCSCDPEHA

SEQ ID NO: 944530 - protein, 9 aa, Homo Sapiens
CKISDVKKE

SEQ ID NO: 944531 - protein, 9 aa, Homo Sapiens
HSKRHKSSR

SEQ ID NO: 944532 - protein, 9 aa, Homo Sapiens
QDRGGPLLR

SEQ ID NO: 944533 - protein, 9 aa, Homo Sapiens
LYGLQTTNN

SEQ ID NO: 944534 - protein, 9 aa, Homo Sapiens
SQYQRSTDR

SEQ ID NO: 944535 - protein, 9 aa, Homo Sapiens
ASWDLPSTP

SEQ ID NO: 944536 - protein, 9 aa, Homo Sapiens
SFSGGELDD

SEQ ID NO: 944537 - protein, 9 aa, Homo Sapiens
GLPWIYAAY

SEQ ID NO: 944538 - protein, 9 aa, Homo Sapiens
FEDITYLSQ

SEQ ID NO: 944539 - protein, 9 aa, Homo Sapiens
NHIRFLQQQ

SEQ ID NO: 944540 - protein, 9 aa, Homo Sapiens
AFNLCEDIM

SEQ ID NO: 944541 - protein, 9 aa, Homo Sapiens
DGGLNYFEG

SEQ ID NO: 944542 - protein, 9 aa, Homo Sapiens
KPSDKHLNA

SEQ ID NO: 944543 - protein, 9 aa, Homo Sapiens
SLFGLPWIY

SEQ ID NO: 944544 - protein, 9 aa, Homo Sapiens
PLDLKGSAV

SEQ ID NO: 944545 - protein, 9 aa, Homo Sapiens
SQSSSHQGW

SEQ ID NO: 944546 - protein, 9 aa, Homo Sapiens
NKDQHSILY

SEQ ID NO: 944547 - protein, 9 aa, Homo Sapiens
TVTLEAKNL

SEQ ID NO: 944548 - protein, 9 aa, Homo Sapiens
AHCISHEYR

SEQ ID NO: 944549 - protein, 9 aa, Homo Sapiens
CCQGHCEEF

SEQ ID NO: 944550 - protein, 9 aa, Homo Sapiens
LSADIAQNQ

SEQ ID NO: 944551 - protein, 9 aa, Homo Sapiens
WLEQDTSCL

SEQ ID NO: 944552 - protein, 9 aa, Homo Sapiens
SSFSKVPTP

SEQ ID NO: 944553 - protein, 9 aa, Homo Sapiens
VRADHKADF

SEQ ID NO: 944554 - protein, 9 aa, Homo Sapiens
SGLVFLHSR

SEQ ID NO: 944555 - protein, 9 aa, Homo Sapiens
FQNGSVSRV

SEQ ID NO: 944556 - protein, 9 aa, Homo Sapiens
KVIIHRQNE

SEQ ID NO: 944557 - protein, 9 aa, Homo Sapiens
GCINPMYQF

SEQ ID NO: 944558 - protein, 9 aa, Homo Sapiens
CRKNLEIYE

SEQ ID NO: 944559 - protein, 9 aa, Homo Sapiens
MNTINGTQN

SEQ ID NO: 944560 - protein, 9 aa, Homo Sapiens
SKTLQKFLE

SEQ ID NO: 944561 - protein, 9 aa, Homo Sapiens
YDSRTQQWT

SEQ ID NO: 944562 - protein, 9 aa, Homo Sapiens
EFRSQIKNG

SEQ ID NO: 944563 - protein, 9 aa, Homo Sapiens
EIMFLQMKH

SEQ ID NO: 944564 - protein, 9 aa, Homo Sapiens
LFLSGVGLG

SEQ ID NO: 944565 - protein, 9 aa, Homo Sapiens
NNRLLHFVA

SEQ ID NO: 944566 - protein, 9 aa, Homo Sapiens
LGSPGLPGV

SEQ ID NO: 944567 - protein, 9 aa, Homo Sapiens
LPEGSESES

SEQ ID NO: 944568 - protein, 9 aa, Homo Sapiens
QLLREQKGE

SEQ ID NO: 944569 - protein, 9 aa, Homo Sapiens
DLQWICAWQ

SEQ ID NO: 944570 - protein, 9 aa, Homo Sapiens
GERDALDLY

SEQ ID NO: 944571 - protein, 9 aa, Homo Sapiens
DYLLFGYVY

SEQ ID NO: 944572 - protein, 9 aa, Homo Sapiens
FKNVTYKHK

SEQ ID NO: 944573 - protein, 9 aa, Homo Sapiens
HKADFRTLC

SEQ ID NO: 944574 - protein, 9 aa, Homo Sapiens
MEEEASEER

SEQ ID NO: 944575 - protein, 9 aa, Homo Sapiens
PLILYRFFY

SEQ ID NO: 944576 - protein, 9 aa, Homo Sapiens
CINRLREMV

SEQ ID NO: 944577 - protein, 9 aa, Homo Sapiens
PYSPYKVKV

SEQ ID NO: 944578 - protein, 9 aa, Homo Sapiens
NCPDGSDKD

SEQ ID NO: 944579 - protein, 9 aa, Homo Sapiens
SYYKKIHTG

SEQ ID NO: 944580 - protein, 9 aa, Homo Sapiens
PRPKTTAPG

SEQ ID NO: 944581 - protein, 9 aa, Homo Sapiens
AMTSAAAAQ

SEQ ID NO: 944582 - protein, 9 aa, Homo Sapiens
VVKVSLLLF

SEQ ID NO: 944583 - protein, 9 aa, Homo Sapiens
PQLGAQKCD

SEQ ID NO: 944584 - protein, 9 aa, Homo Sapiens
FSKPQILKH

SEQ ID NO: 944585 - protein, 9 aa, Homo Sapiens
RTDGMRVTL

SEQ ID NO: 944586 - protein, 9 aa, Homo Sapiens
LGEAGVGGP

SEQ ID NO: 944587 - protein, 9 aa, Homo Sapiens
LKSDTIADL

SEQ ID NO: 944588 - protein, 9 aa, Homo Sapiens
FLLLCLALW

SEQ ID NO: 944589 - protein, 9 aa, Homo Sapiens
NGLLCDVLL

SEQ ID NO: 944590 - protein, 9 aa, Homo Sapiens
PPMSLRIVA

SEQ ID NO: 944591 - protein, 9 aa, Homo Sapiens
NTEILNQSD

SEQ ID NO: 944592 - protein, 9 aa, Homo Sapiens
DSARGMEYT

SEQ ID NO: 944593 - protein, 9 aa, Homo Sapiens
PWELLARVC

SEQ ID NO: 944594 - protein, 9 aa, Homo Sapiens
KSQKITLLL

SEQ ID NO: 944595 - protein, 9 aa, Homo Sapiens
CWPFSVPGR

SEQ ID NO: 944596 - protein, 9 aa, Homo Sapiens
IFTIKLDPG

SEQ ID NO: 944597 - protein, 9 aa, Homo Sapiens
FLTNAYSSV

SEQ ID NO: 944598 - protein, 9 aa, Homo Sapiens
LVLKEPRRV

SEQ ID NO: 944599 - protein, 9 aa, Homo Sapiens
EMKKKVEDL

SEQ ID NO: 944600 - protein, 9 aa, Homo Sapiens
EMVTRLPDR

SEQ ID NO: 944601 - protein, 9 aa, Homo Sapiens
LVSGGVVQA

SEQ ID NO: 944602 - protein, 9 aa, Homo Sapiens
NRLFGATNL

SEQ ID NO: 944603 - protein, 9 aa, Homo Sapiens
HQDLWSAGL

SEQ ID NO: 944604 - protein, 9 aa, Homo Sapiens
VNAVYFKEK

SEQ ID NO: 944605 - protein, 9 aa, Homo Sapiens
EMKEGPEFW

SEQ ID NO: 944606 - protein, 9 aa, Homo Sapiens
KAVFYAACV

SEQ ID NO: 944607 - protein, 9 aa, Homo Sapiens
PPLPFMPPR

SEQ ID NO: 944608 - protein, 9 aa, Homo Sapiens
DDIQLVGEL

SEQ ID NO: 944609 - protein, 9 aa, Homo Sapiens
FSEPKAVFY

SEQ ID NO: 944610 - protein, 9 aa, Homo Sapiens
VKIYAGPKF

SEQ ID NO: 944611 - protein, 9 aa, Homo Sapiens
LLVVASLVR

SEQ ID NO: 944612 - protein, 9 aa, Homo Sapiens
CLTQDEFYP

SEQ ID NO: 944613 - protein, 9 aa, Homo Sapiens
ASSSGITNR

SEQ ID NO: 944614 - protein, 9 aa, Homo Sapiens
RTHEFSPEY

SEQ ID NO: 944615 - protein, 9 aa, Homo Sapiens
DLEARPSSY

SEQ ID NO: 944616 - protein, 9 aa, Homo Sapiens
VGLQNLCGQ

SEQ ID NO: 944617 - protein, 9 aa, Homo Sapiens
MNLEGKPVL

SEQ ID NO: 944618 - protein, 9 aa, Homo Sapiens
PSHCCAYKN

SEQ ID NO: 944619 - protein, 9 aa, Homo Sapiens
LILPREGPG

SEQ ID NO: 944620 - protein, 9 aa, Homo Sapiens
VYAPLHFMN

SEQ ID NO: 944621 - protein, 9 aa, Homo Sapiens
GCQLSGSSH

SEQ ID NO: 944622 - protein, 9 aa, Homo Sapiens
MTKKIKEAL

SEQ ID NO: 944623 - protein, 9 aa, Homo Sapiens
HQQLYDCQL

SEQ ID NO: 944624 - protein, 9 aa, Homo Sapiens
LVLLKTWEK

SEQ ID NO: 944625 - protein, 9 aa, Homo Sapiens
YLVFGQHKW

SEQ ID NO: 944626 - protein, 9 aa, Homo Sapiens
EQPGLPLHD

SEQ ID NO: 944627 - protein, 9 aa, Homo Sapiens
AIAHYDQQI

SEQ ID NO: 944628 - protein, 9 aa, Homo Sapiens
MWYKAAELI

SEQ ID NO: 944629 - protein, 9 aa, Homo Sapiens
MRLMFCNHK

SEQ ID NO: 944630 - protein, 9 aa, Homo Sapiens
GINKIGGNG

SEQ ID NO: 944631 - protein, 9 aa, Homo Sapiens
LSGLQASVN

SEQ ID NO: 944632 - protein, 9 aa, Homo Sapiens
ERPFGEMGS

SEQ ID NO: 944633 - protein, 9 aa, Homo Sapiens
CQLPKDVDP

SEQ ID NO: 944634 - protein, 9 aa, Homo Sapiens
IERCICFVC

SEQ ID NO: 944635 - protein, 9 aa, Homo Sapiens
NPKEAPKFF

SEQ ID NO: 944636 - protein, 9 aa, Homo Sapiens
DFCVQVKPP

SEQ ID NO: 944637 - protein, 9 aa, Homo Sapiens
NLEYMICFY

SEQ ID NO: 944638 - protein, 9 aa, Homo Sapiens
SPLRLLEHE

SEQ ID NO: 944639 - protein, 9 aa, Homo Sapiens
PAASQLKSD

SEQ ID NO: 944640 - protein, 9 aa, Homo Sapiens
KRMEFFQPL

SEQ ID NO: 944641 - protein, 9 aa, Homo Sapiens
PNHVVPEML

SEQ ID NO: 944642 - protein, 9 aa, Homo Sapiens
LLKRDAHSL

SEQ ID NO: 944643 - protein, 9 aa, Homo Sapiens
NLAYKKIAY

SEQ ID NO: 944644 - protein, 9 aa, Homo Sapiens
GNGCCLMQI

SEQ ID NO: 944645 - protein, 9 aa, Homo Sapiens
QLLWKGFFK

SEQ ID NO: 944646 - protein, 9 aa, Homo Sapiens
KIKYKAPTD

SEQ ID NO: 944647 - protein, 9 aa, Homo Sapiens
TLLLHKKSL

SEQ ID NO: 944648 - protein, 9 aa, Homo Sapiens
VWIEMDDEE

SEQ ID NO: 944649 - protein, 9 aa, Homo Sapiens
KFNAVDGQW

SEQ ID NO: 944650 - protein, 9 aa, Homo Sapiens
ADTRTLMAQ

SEQ ID NO: 944651 - protein, 9 aa, Homo Sapiens
LEGAQAPLV

SEQ ID NO: 944652 - protein, 9 aa, Homo Sapiens
TQFFSKKYS

SEQ ID NO: 944653 - protein, 9 aa, Homo Sapiens
QQVGNYCFL

SEQ ID NO: 944654 - protein, 9 aa, Homo Sapiens
MVVLKLACA

SEQ ID NO: 944655 - protein, 9 aa, Homo Sapiens
APAFFLVQK

SEQ ID NO: 944656 - protein, 9 aa, Homo Sapiens
EPAGPKSRA

SEQ ID NO: 944657 - protein, 9 aa, Homo Sapiens
VTIDSAGSF

SEQ ID NO: 944658 - protein, 9 aa, Homo Sapiens
QSPSFRKEL

SEQ ID NO: 944659 - protein, 9 aa, Homo Sapiens
SNNNRGVVQ

SEQ ID NO: 944660 - protein, 9 aa, Homo Sapiens
SVQPHAHLQ

SEQ ID NO: 944661 - protein, 9 aa, Homo Sapiens
NNMTSLEND

SEQ ID NO: 944662 - protein, 9 aa, Homo Sapiens
TDWGDYSLI

SEQ ID NO: 944663 - protein, 9 aa, Homo Sapiens
IMFKTFNVP

SEQ ID NO: 944664 - protein, 9 aa, Homo Sapiens
YPGFDLVGS

SEQ ID NO: 944665 - protein, 9 aa, Homo Sapiens
FLERVKNLM

SEQ ID NO: 944666 - protein, 9 aa, Homo Sapiens
ADDWVTDSR

SEQ ID NO: 944667 - protein, 9 aa, Homo Sapiens
TTKNLNFWP

SEQ ID NO: 944668 - protein, 9 aa, Homo Sapiens
LCFPSPGNA

SEQ ID NO: 944669 - protein, 9 aa, Homo Sapiens
SPELCNEIS

SEQ ID NO: 944670 - protein, 9 aa, Homo Sapiens
RINLPPFTG

SEQ ID NO: 944671 - protein, 9 aa, Homo Sapiens
SSITELLEQ

SEQ ID NO: 944672 - protein, 9 aa, Homo Sapiens
EPAGPKPRA

SEQ ID NO: 944673 - protein, 9 aa, Homo Sapiens
RFYAFNSLA

SEQ ID NO: 944674 - protein, 9 aa, Homo Sapiens
PFLIARIPV

SEQ ID NO: 944675 - protein, 9 aa, Homo Sapiens
VNILAGQGK

SEQ ID NO: 944676 - protein, 9 aa, Homo Sapiens
SPCPSFLPL

SEQ ID NO: 944677 - protein, 9 aa, Homo Sapiens
HSTSPSLVS

SEQ ID NO: 944678 - protein, 9 aa, Homo Sapiens
RDAHSLFWQ

SEQ ID NO: 944679 - protein, 9 aa, Homo Sapiens
TLPAELQTT

SEQ ID NO: 944680 - protein, 9 aa, Homo Sapiens
YAAYPHSPL

SEQ ID NO: 944681 - protein, 9 aa, Homo Sapiens
MEDGFKGDK

SEQ ID NO: 944682 - protein, 9 aa, Homo Sapiens
KFFSRKSAL

SEQ ID NO: 944683 - protein, 9 aa, Homo Sapiens
VRQVRFRRD

SEQ ID NO: 944684 - protein, 9 aa, Homo Sapiens
GAETAVVTS

SEQ ID NO: 944685 - protein, 9 aa, Homo Sapiens
LFAVGYSSY

SEQ ID NO: 944686 - protein, 9 aa, Homo Sapiens
QLYPALIQR

SEQ ID NO: 944687 - protein, 9 aa, Homo Sapiens
YASENNLKP

SEQ ID NO: 944688 - protein, 9 aa, Homo Sapiens
ECAYETRYL

SEQ ID NO: 944689 - protein, 9 aa, Homo Sapiens
NKTTKIPLI

SEQ ID NO: 944690 - protein, 9 aa, Homo Sapiens
PQSTSVQVK

SEQ ID NO: 944691 - protein, 9 aa, Homo Sapiens
RRIHTGKKP

SEQ ID NO: 944692 - protein, 9 aa, Homo Sapiens
QALQFLENE

SEQ ID NO: 944693 - protein, 9 aa, Homo Sapiens
EFNVYLKKP

SEQ ID NO: 944694 - protein, 9 aa, Homo Sapiens
EEELTTGSG

SEQ ID NO: 944695 - protein, 9 aa, Homo Sapiens
PSEMKAIAL

SEQ ID NO: 944696 - protein, 9 aa, Homo Sapiens
ACQKVPFSR

SEQ ID NO: 944697 - protein, 9 aa, Homo Sapiens
RMTQIKIDD

SEQ ID NO: 944698 - protein, 9 aa, Homo Sapiens
AAEKATSRR

SEQ ID NO: 944699 - protein, 9 aa, Homo Sapiens
EWMDFIQHL

SEQ ID NO: 944700 - protein, 9 aa, Homo Sapiens
DALISIENS

SEQ ID NO: 944701 - protein, 9 aa, Homo Sapiens
LGQFFEKEL

SEQ ID NO: 944702 - protein, 9 aa, Homo Sapiens
TLMENILIV

SEQ ID NO: 944703 - protein, 9 aa, Homo Sapiens
ALATGTFFW

SEQ ID NO: 944704 - protein, 9 aa, Homo Sapiens
KQEMVCVLL

SEQ ID NO: 944705 - protein, 9 aa, Homo Sapiens
GIFSGPAIF

SEQ ID NO: 944706 - protein, 9 aa, Homo Sapiens
FSSSAGLGL

SEQ ID NO: 944707 - protein, 9 aa, Homo Sapiens
LLGPSLKDL

SEQ ID NO: 944708 - protein, 9 aa, Homo Sapiens
YDNFLQSRE

SEQ ID NO: 944709 - protein, 9 aa, Homo Sapiens
IDKLFYVRP

SEQ ID NO: 944710 - protein, 9 aa, Homo Sapiens
NCFFLFSRK

SEQ ID NO: 944711 - protein, 9 aa, Homo Sapiens
KADATWTLI

SEQ ID NO: 944712 - protein, 9 aa, Homo Sapiens
VILPTPEGF

SEQ ID NO: 944713 - protein, 9 aa, Homo Sapiens
SEKLDSFIN

SEQ ID NO: 944714 - protein, 9 aa, Homo Sapiens
FINLYIEDS

SEQ ID NO: 944715 - protein, 9 aa, Homo Sapiens
RIKCQTATG

SEQ ID NO: 944716 - protein, 9 aa, Homo Sapiens
CIWELSAQH

SEQ ID NO: 944717 - protein, 9 aa, Homo Sapiens
RRTAPEIYH

SEQ ID NO: 944718 - protein, 9 aa, Homo Sapiens
SVGPVGPRE

SEQ ID NO: 944719 - protein, 9 aa, Homo Sapiens
SKAVEKIVN

SEQ ID NO: 944720 - protein, 9 aa, Homo Sapiens
DCEELQQTG

SEQ ID NO: 944721 - protein, 9 aa, Homo Sapiens
WHKRGGNLS

SEQ ID NO: 944722 - protein, 9 aa, Homo Sapiens
YKESKDPKH

SEQ ID NO: 944723 - protein, 9 aa, Homo Sapiens
GGPNATFNS

SEQ ID NO: 944724 - protein, 9 aa, Homo Sapiens
ICIYDVHTC

SEQ ID NO: 944725 - protein, 9 aa, Homo Sapiens
KPCFYQDFF

SEQ ID NO: 944726 - protein, 9 aa, Homo Sapiens
LFTDEQVLS

SEQ ID NO: 944727 - protein, 9 aa, Homo Sapiens
WAGVLSCLA

SEQ ID NO: 944728 - protein, 9 aa, Homo Sapiens
EEPSLCART

SEQ ID NO: 944729 - protein, 9 aa, Homo Sapiens
FKKSVFENY

SEQ ID NO: 944730 - protein, 9 aa, Homo Sapiens
SANKIDVRP

SEQ ID NO: 944731 - protein, 9 aa, Homo Sapiens
RSGLLLGNL

SEQ ID NO: 944732 - protein, 9 aa, Homo Sapiens
PAVILQNLK

SEQ ID NO: 944733 - protein, 9 aa, Homo Sapiens
DLDAGINEE

SEQ ID NO: 944734 - protein, 9 aa, Homo Sapiens
HKKIYAGKK

SEQ ID NO: 944735 - protein, 9 aa, Homo Sapiens
EEYNWHKPP

SEQ ID NO: 944736 - protein, 9 aa, Homo Sapiens
YKAAELIWA

SEQ ID NO: 944737 - protein, 9 aa, Homo Sapiens
RKFCDQFLE

SEQ ID NO: 944738 - protein, 9 aa, Homo Sapiens
ERIFQEICV

SEQ ID NO: 944739 - protein, 9 aa, Homo Sapiens
HCCRDEVHF

SEQ ID NO: 944740 - protein, 9 aa, Homo Sapiens
ECICIYDVH

SEQ ID NO: 944741 - protein, 9 aa, Homo Sapiens
EAIYYGIPM

SEQ ID NO: 944742 - protein, 9 aa, Homo Sapiens
TFTLLDPHL

SEQ ID NO: 944743 - protein, 9 aa, Homo Sapiens
ARFSWLLFA

SEQ ID NO: 944744 - protein, 9 aa, Homo Sapiens
DQNTLIEES

SEQ ID NO: 944745 - protein, 9 aa, Homo Sapiens
TNLKGSPSR

SEQ ID NO: 944746 - protein, 9 aa, Homo Sapiens
LDVYFLHNP

SEQ ID NO: 944747 - protein, 9 aa, Homo Sapiens
PGSYSCSCL

SEQ ID NO: 944748 - protein, 9 aa, Homo Sapiens
YNSFTCKKG

SEQ ID NO: 944749 - protein, 9 aa, Homo Sapiens
PKMIKSPYN

SEQ ID NO: 944750 - protein, 9 aa, Homo Sapiens
VPEGPIPGH

SEQ ID NO: 944751 - protein, 9 aa, Homo Sapiens
YEAGEILFY

SEQ ID NO: 944752 - protein, 9 aa, Homo Sapiens
SVWGKAGKG

SEQ ID NO: 944753 - protein, 9 aa, Homo Sapiens
TSSVEGSAS

SEQ ID NO: 944754 - protein, 9 aa, Homo Sapiens
RARLRRWKL

SEQ ID NO: 944755 - protein, 9 aa, Homo Sapiens
LPDEDKDAN

SEQ ID NO: 944756 - protein, 9 aa, Homo Sapiens
GPRRLSGPA

SEQ ID NO: 944757 - protein, 9 aa, Homo Sapiens
LQPPGRVPS

SEQ ID NO: 944758 - protein, 9 aa, Homo Sapiens
EFKNQPSLL

SEQ ID NO: 944759 - protein, 9 aa, Homo Sapiens
AALHEPPPE

SEQ ID NO: 944760 - protein, 9 aa, Homo Sapiens
LGNKDLNRN

SEQ ID NO: 944761 - protein, 9 aa, Homo Sapiens
LDGLEKKGR

SEQ ID NO: 944762 - protein, 9 aa, Homo Sapiens
LSILEEKFS

SEQ ID NO: 944763 - protein, 9 aa, Homo Sapiens
PPCVSYLGM

SEQ ID NO: 944764 - protein, 9 aa, Homo Sapiens
PCTVCEDTK

SEQ ID NO: 944765 - protein, 9 aa, Homo Sapiens
SWKTHDASG

SEQ ID NO: 944766 - protein, 9 aa, Homo Sapiens
KRQKKAIKR

SEQ ID NO: 944767 - protein, 9 aa, Homo Sapiens
RKGNLEQEC

SEQ ID NO: 944768 - protein, 9 aa, Homo Sapiens
AQNPHGRDL

SEQ ID NO: 944769 - protein, 9 aa, Homo Sapiens
DLFQPKDQI

SEQ ID NO: 944770 - protein, 9 aa, Homo Sapiens
KDRQLLQGH

SEQ ID NO: 944771 - protein, 9 aa, Homo Sapiens
KKTGERPAN

SEQ ID NO: 944772 - protein, 9 aa, Homo Sapiens
LYFCRINAL

SEQ ID NO: 944773 - protein, 9 aa, Homo Sapiens
SIHLRGKGR

SEQ ID NO: 944774 - protein, 9 aa, Homo Sapiens
LILYRFFYE

SEQ ID NO: 944775 - protein, 9 aa, Homo Sapiens
TLERYHSLL

SEQ ID NO: 944776 - protein, 9 aa, Homo Sapiens
EGILFVQTL

SEQ ID NO: 944777 - protein, 9 aa, Homo Sapiens
HFSPKGRPK

SEQ ID NO: 944778 - protein, 9 aa, Homo Sapiens
VCMNLRANL

SEQ ID NO: 944779 - protein, 9 aa, Homo Sapiens
RALPGADSQ

SEQ ID NO: 944780 - protein, 9 aa, Homo Sapiens
FDFVRKRMS

SEQ ID NO: 944781 - protein, 9 aa, Homo Sapiens
SVYYDALQQ

SEQ ID NO: 944782 - protein, 9 aa, Homo Sapiens
IKMKHGEAY

SEQ ID NO: 944783 - protein, 9 aa, Homo Sapiens
NIYYSDLMK

SEQ ID NO: 944784 - protein, 9 aa, Homo Sapiens
LLEGSQLNA

SEQ ID NO: 944785 - protein, 9 aa, Homo Sapiens
LVFGQHKWN

SEQ ID NO: 944786 - protein, 9 aa, Homo Sapiens
HPLDSEENT

SEQ ID NO: 944787 - protein, 9 aa, Homo Sapiens
PKHFAEAKK

SEQ ID NO: 944788 - protein, 9 aa, Homo Sapiens
FQRESVTFK

SEQ ID NO: 944789 - protein, 9 aa, Homo Sapiens
KLRLQEFFL

SEQ ID NO: 944790 - protein, 9 aa, Homo Sapiens
GDPEAEGLG

SEQ ID NO: 944791 - protein, 9 aa, Homo Sapiens
LFFFPAAKP

SEQ ID NO: 944792 - protein, 9 aa, Homo Sapiens
SSQEAPSSF

SEQ ID NO: 944793 - protein, 9 aa, Homo Sapiens
HSGQGFGES

SEQ ID NO: 944794 - protein, 9 aa, Homo Sapiens
TSESPLHAV

SEQ ID NO: 944795 - protein, 9 aa, Homo Sapiens
LLAFKAYLS

SEQ ID NO: 944796 - protein, 9 aa, Homo Sapiens
IISEKLDSF

SEQ ID NO: 944797 - protein, 9 aa, Homo Sapiens
KQDALISIE

SEQ ID NO: 944798 - protein, 9 aa, Homo Sapiens
VVKPRQPNP

SEQ ID NO: 944799 - protein, 9 aa, Homo Sapiens
DPDDLPVTC

SEQ ID NO: 944800 - protein, 9 aa, Homo Sapiens
GEKVLLTGL

SEQ ID NO: 944801 - protein, 9 aa, Homo Sapiens
KGTLKPGNI

SEQ ID NO: 944802 - protein, 9 aa, Homo Sapiens
GVESKGPQG

SEQ ID NO: 944803 - protein, 9 aa, Homo Sapiens
ANLPEGIVK

SEQ ID NO: 944804 - protein, 9 aa, Homo Sapiens
FETFFKKET

SEQ ID NO: 944805 - protein, 9 aa, Homo Sapiens
TCNQLLMYQ

SEQ ID NO: 944806 - protein, 9 aa, Homo Sapiens
EAPKFFSFD

SEQ ID NO: 944807 - protein, 9 aa, Homo Sapiens
LIELRRKFK

SEQ ID NO: 944808 - protein, 9 aa, Homo Sapiens
AAETAKKLT

SEQ ID NO: 944809 - protein, 9 aa, Homo Sapiens
SEFKAMDFF

SEQ ID NO: 944810 - protein, 9 aa, Homo Sapiens
VSRQHKQLL

SEQ ID NO: 944811 - protein, 9 aa, Homo Sapiens
GLDSRQALP

SEQ ID NO: 944812 - protein, 9 aa, Homo Sapiens
LKDTIFPSC

SEQ ID NO: 944813 - protein, 9 aa, Homo Sapiens
TSPNFLFMC

SEQ ID NO: 944814 - protein, 9 aa, Homo Sapiens
LSSMGSGAA

SEQ ID NO: 944815 - protein, 9 aa, Homo Sapiens
PDQFTYTLD

SEQ ID NO: 944816 - protein, 9 aa, Homo Sapiens
SAEGRRRVF

SEQ ID NO: 944817 - protein, 9 aa, Homo Sapiens
KVIFSGKEC

SEQ ID NO: 944818 - protein, 9 aa, Homo Sapiens
CNVKETPLP

SEQ ID NO: 944819 - protein, 9 aa, Homo Sapiens
NSSQATGKG

SEQ ID NO: 944820 - protein, 9 aa, Homo Sapiens
ILLGSLADP

SEQ ID NO: 944821 - protein, 9 aa, Homo Sapiens
SSASLLPNV

SEQ ID NO: 944822 - protein, 9 aa, Homo Sapiens
RGSDVSVKM

SEQ ID NO: 944823 - protein, 9 aa, Homo Sapiens
PLSCNHIKL

SEQ ID NO: 944824 - protein, 9 aa, Homo Sapiens
TIFTSPPLI

SEQ ID NO: 944825 - protein, 9 aa, Homo Sapiens
DTQIADEKQ

SEQ ID NO: 944826 - protein, 9 aa, Homo Sapiens
IIIYSISLL

SEQ ID NO: 944827 - protein, 9 aa, Homo Sapiens
EDSILVVRK

SEQ ID NO: 944828 - protein, 9 aa, Homo Sapiens
LQTTNNRLL

SEQ ID NO: 944829 - protein, 9 aa, Homo Sapiens
SRRAQAKPI

SEQ ID NO: 944830 - protein, 9 aa, Homo Sapiens
IFAVPTTKS

SEQ ID NO: 944831 - protein, 9 aa, Homo Sapiens
VWILVEMED

SEQ ID NO: 944832 - protein, 9 aa, Homo Sapiens
KTTSSIDPN

SEQ ID NO: 944833 - protein, 9 aa, Homo Sapiens
NSLRCISKM

SEQ ID NO: 944834 - protein, 9 aa, Homo Sapiens
MRGSQPSWE

SEQ ID NO: 944835 - protein, 9 aa, Homo Sapiens
PSLFLLLCL

SEQ ID NO: 944836 - protein, 9 aa, Homo Sapiens
KIVLLEAGH

SEQ ID NO: 944837 - protein, 9 aa, Homo Sapiens
NFLRRPDSG

SEQ ID NO: 944838 - protein, 9 aa, Homo Sapiens
SNGEPTKKL

SEQ ID NO: 944839 - protein, 9 aa, Homo Sapiens
AHLDWPVQQ

SEQ ID NO: 944840 - protein, 9 aa, Homo Sapiens
AHLFRHLRG

SEQ ID NO: 944841 - protein, 9 aa, Homo Sapiens
GPSPRPGPS

SEQ ID NO: 944842 - protein, 9 aa, Homo Sapiens
NCDPPCVSY

SEQ ID NO: 944843 - protein, 9 aa, Homo Sapiens
PKGRKKDCP

SEQ ID NO: 944844 - protein, 9 aa, Homo Sapiens
LPAQVSGRR

SEQ ID NO: 944845 - protein, 9 aa, Homo Sapiens
QKVISDWKE

SEQ ID NO: 944846 - protein, 9 aa, Homo Sapiens
EGEPVCVDI

SEQ ID NO: 944847 - protein, 9 aa, Homo Sapiens
EAPTEYAFI

SEQ ID NO: 944848 - protein, 9 aa, Homo Sapiens
DIQAINRVS

SEQ ID NO: 944849 - protein, 9 aa, Homo Sapiens
GIVGAYDWG

SEQ ID NO: 944850 - protein, 9 aa, Homo Sapiens
AGSRFLIHS

SEQ ID NO: 944851 - protein, 9 aa, Homo Sapiens
FRARLVDHA

SEQ ID NO: 944852 - protein, 9 aa, Homo Sapiens
KQESLQEEK

SEQ ID NO: 944853 - protein, 9 aa, Homo Sapiens
QVSRERSGF

SEQ ID NO: 944854 - protein, 9 aa, Homo Sapiens
SKTYRRSYT

SEQ ID NO: 944855 - protein, 9 aa, Homo Sapiens
HDFPDFGQE

SEQ ID NO: 944856 - protein, 9 aa, Homo Sapiens
CQQKQNTLL

SEQ ID NO: 944857 - protein, 9 aa, Homo Sapiens
ASGFLMKKK

SEQ ID NO: 944858 - protein, 9 aa, Homo Sapiens
NVYLKKPPQ

SEQ ID NO: 944859 - protein, 9 aa, Homo Sapiens
RLLSERFLV

SEQ ID NO: 944860 - protein, 9 aa, Homo Sapiens
VALNASLKK

SEQ ID NO: 944861 - protein, 9 aa, Homo Sapiens
GAVPDSTGQ

SEQ ID NO: 944862 - protein, 9 aa, Homo Sapiens
VESKGPQGP

SEQ ID NO: 944863 - protein, 9 aa, Homo Sapiens
WDLEQKMFG

SEQ ID NO: 944864 - protein, 9 aa, Homo Sapiens
YMGVGLFGP

SEQ ID NO: 944865 - protein, 9 aa, Homo Sapiens
LTAGGKLYA

SEQ ID NO: 944866 - protein, 9 aa, Homo Sapiens
IYLRPGFRK

SEQ ID NO: 944867 - protein, 9 aa, Homo Sapiens
CLRLLQSCC

SEQ ID NO: 944868 - protein, 9 aa, Homo Sapiens
QGAPGLQEM

SEQ ID NO: 944869 - protein, 9 aa, Homo Sapiens
QKECETAGL

SEQ ID NO: 944870 - protein, 9 aa, Homo Sapiens
WERPQEGQL

SEQ ID NO: 944871 - protein, 9 aa, Homo Sapiens
HLVLQMVLK

SEQ ID NO: 944872 - protein, 9 aa, Homo Sapiens
GDISFHRPR

SEQ ID NO: 944873 - protein, 9 aa, Homo Sapiens
LRFYAFNSL

SEQ ID NO: 944874 - protein, 9 aa, Homo Sapiens
TLESILYPR

SEQ ID NO: 944875 - protein, 9 aa, Homo Sapiens
AGSFNGVQV

SEQ ID NO: 944876 - protein, 9 aa, Homo Sapiens
RVDKALPPN

SEQ ID NO: 944877 - protein, 9 aa, Homo Sapiens
PSSTLCPLC

SEQ ID NO: 944878 - protein, 9 aa, Homo Sapiens
FPSCYLLFQ

SEQ ID NO: 944879 - protein, 9 aa, Homo Sapiens
PQFTIFGTL

SEQ ID NO: 944880 - protein, 9 aa, Homo Sapiens
AMRGSQPSW

SEQ ID NO: 944881 - protein, 9 aa, Homo Sapiens
IMLLSAATP

SEQ ID NO: 944882 - protein, 9 aa, Homo Sapiens
DLCLQTLEI

SEQ ID NO: 944883 - protein, 9 aa, Homo Sapiens
YQELQRLVH

SEQ ID NO: 944884 - protein, 9 aa, Homo Sapiens
KLSGEDDDA

SEQ ID NO: 944885 - protein, 9 aa, Homo Sapiens
PGRSKESFW

SEQ ID NO: 944886 - protein, 9 aa, Homo Sapiens
PPIFSWFSA

SEQ ID NO: 944887 - protein, 9 aa, Homo Sapiens
IHRAFDREQ

SEQ ID NO: 944888 - protein, 9 aa, Homo Sapiens
IGLNRPLSP

SEQ ID NO: 944889 - protein, 9 aa, Homo Sapiens
VVSFHQVNY

SEQ ID NO: 944890 - protein, 9 aa, Homo Sapiens
SEEFDLLYK

SEQ ID NO: 944891 - protein, 9 aa, Homo Sapiens
GEPSKPKSQ

SEQ ID NO: 944892 - protein, 9 aa, Homo Sapiens
MPHPGPSPR

SEQ ID NO: 944893 - protein, 9 aa, Homo Sapiens
TLQKIFQTE

SEQ ID NO: 944894 - protein, 9 aa, Homo Sapiens
QEKTVTLHC

SEQ ID NO: 944895 - protein, 9 aa, Homo Sapiens
FFGLTVTEK

SEQ ID NO: 944896 - protein, 9 aa, Homo Sapiens
KNKRRHETH

SEQ ID NO: 944897 - protein, 9 aa, Homo Sapiens
MSDGKFLRT

SEQ ID NO: 944898 - protein, 9 aa, Homo Sapiens
LEDNRYNWS

SEQ ID NO: 944899 - protein, 9 aa, Homo Sapiens
DPEKENIKA

SEQ ID NO: 944900 - protein, 9 aa, Homo Sapiens
LFIYLRPGF

SEQ ID NO: 944901 - protein, 9 aa, Homo Sapiens
DNRYNWSFI

SEQ ID NO: 944902 - protein, 9 aa, Homo Sapiens
IVHERHRTI

SEQ ID NO: 944903 - protein, 9 aa, Homo Sapiens
LFVGTSLGI

SEQ ID NO: 944904 - protein, 9 aa, Homo Sapiens
TVFIAINKE

SEQ ID NO: 944905 - protein, 9 aa, Homo Sapiens
NPFGEDDDN

SEQ ID NO: 944906 - protein, 9 aa, Homo Sapiens
KPPSSTTMK

SEQ ID NO: 944907 - protein, 9 aa, Homo Sapiens
WTSGEGVHW

SEQ ID NO: 944908 - protein, 9 aa, Homo Sapiens
FTPISLLIP

SEQ ID NO: 944909 - protein, 9 aa, Homo Sapiens
HTWSLAKLI

SEQ ID NO: 944910 - protein, 9 aa, Homo Sapiens
DDQEGILFV

SEQ ID NO: 944911 - protein, 9 aa, Homo Sapiens
VFLQIGFFC

SEQ ID NO: 944912 - protein, 9 aa, Homo Sapiens
SKLFTPECK

SEQ ID NO: 944913 - protein, 9 aa, Homo Sapiens
YKRDLETVI

SEQ ID NO: 944914 - protein, 9 aa, Homo Sapiens
QLDDQEGIL

SEQ ID NO: 944915 - protein, 9 aa, Homo Sapiens
ERRRAVTFS

SEQ ID NO: 944916 - protein, 9 aa, Homo Sapiens
TVPMGGVCL

SEQ ID NO: 944917 - protein, 9 aa, Homo Sapiens
LPTPEGFTI

SEQ ID NO: 944918 - protein, 9 aa, Homo Sapiens
EDINPENED

SEQ ID NO: 944919 - protein, 9 aa, Homo Sapiens
VDITKESIK

SEQ ID NO: 944920 - protein, 9 aa, Homo Sapiens
PGAGPQQFR

SEQ ID NO: 944921 - protein, 9 aa, Homo Sapiens
LFDFCVQVK

SEQ ID NO: 944922 - protein, 9 aa, Homo Sapiens
LWAPPFPKP

SEQ ID NO: 944923 - protein, 9 aa, Homo Sapiens
SEQSCRKAP

SEQ ID NO: 944924 - protein, 9 aa, Homo Sapiens
EDGFKGDKT

SEQ ID NO: 944925 - protein, 9 aa, Homo Sapiens
CKRKFLKSI

SEQ ID NO: 944926 - protein, 9 aa, Homo Sapiens
LPTKREVLL

SEQ ID NO: 944927 - protein, 9 aa, Homo Sapiens
SPREAEGYP

SEQ ID NO: 944928 - protein, 9 aa, Homo Sapiens
IEHLFCMYD

SEQ ID NO: 944929 - protein, 9 aa, Homo Sapiens
ADPYKLGDD

SEQ ID NO: 944930 - protein, 9 aa, Homo Sapiens
AYYGYSYNA

SEQ ID NO: 944931 - protein, 9 aa, Homo Sapiens
RDMRLMFCN

SEQ ID NO: 944932 - protein, 9 aa, Homo Sapiens
EMAIDTLNS

SEQ ID NO: 944933 - protein, 9 aa, Homo Sapiens
QEKEPPCFL

SEQ ID NO: 944934 - protein, 9 aa, Homo Sapiens
SSTRHSFFR

SEQ ID NO: 944935 - protein, 9 aa, Homo Sapiens
SAVIARNGK

SEQ ID NO: 944936 - protein, 9 aa, Homo Sapiens
IHTEKKSYE

SEQ ID NO: 944937 - protein, 9 aa, Homo Sapiens
SLSIYGQSS

SEQ ID NO: 944938 - protein, 9 aa, Homo Sapiens
LRSGKSICT

SEQ ID NO: 944939 - protein, 9 aa, Homo Sapiens
FGQHKWNYS

SEQ ID NO: 944940 - protein, 9 aa, Homo Sapiens
PTVFLERLC

SEQ ID NO: 944941 - protein, 9 aa, Homo Sapiens
RPWNKVEDR

SEQ ID NO: 944942 - protein, 9 aa, Homo Sapiens
NQPSLLNGS

SEQ ID NO: 944943 - protein, 9 aa, Homo Sapiens
LLAQKVCPR

SEQ ID NO: 944944 - protein, 9 aa, Homo Sapiens
LERERASLI

SEQ ID NO: 944945 - protein, 9 aa, Homo Sapiens
GPMKICKKR

SEQ ID NO: 944946 - protein, 9 aa, Homo Sapiens
KISVTPTPQ

SEQ ID NO: 944947 - protein, 9 aa, Homo Sapiens
IDGYPVKKE

SEQ ID NO: 944948 - protein, 9 aa, Homo Sapiens
PSSGKSSLG

SEQ ID NO: 944949 - protein, 9 aa, Homo Sapiens
KLKPQATWT

SEQ ID NO: 944950 - protein, 9 aa, Homo Sapiens
NIAAADKQF

SEQ ID NO: 944951 - protein, 9 aa, Homo Sapiens
AKVRRYLEG

SEQ ID NO: 944952 - protein, 9 aa, Homo Sapiens
AGGERDALD

SEQ ID NO: 944953 - protein, 9 aa, Homo Sapiens
KKVRFYRNR

SEQ ID NO: 944954 - protein, 9 aa, Homo Sapiens
LGPHLQNLF

SEQ ID NO: 944955 - protein, 9 aa, Homo Sapiens
ESLDKNLGP

SEQ ID NO: 944956 - protein, 9 aa, Homo Sapiens
NLPEGIVKI

SEQ ID NO: 944957 - protein, 9 aa, Homo Sapiens
DDITIDKPN

SEQ ID NO: 944958 - protein, 9 aa, Homo Sapiens
PGLIEILLG

SEQ ID NO: 944959 - protein, 9 aa, Homo Sapiens
ITPGKMGTG

SEQ ID NO: 944960 - protein, 9 aa, Homo Sapiens
LQSCCPRVL

SEQ ID NO: 944961 - protein, 9 aa, Homo Sapiens
PDLGVPSDP

SEQ ID NO: 944962 - protein, 9 aa, Homo Sapiens
VLISYFYIL

SEQ ID NO: 944963 - protein, 9 aa, Homo Sapiens
LHELTKLSA

SEQ ID NO: 944964 - protein, 9 aa, Homo Sapiens
ATLNSASLQ

SEQ ID NO: 944965 - protein, 9 aa, Homo Sapiens
TIKCSHEQS

SEQ ID NO: 944966 - protein, 9 aa, Homo Sapiens
QRNPVWNVS

SEQ ID NO: 944967 - protein, 9 aa, Homo Sapiens
VKSAMNTID

SEQ ID NO: 944968 - protein, 9 aa, Homo Sapiens
SFWREAATS

SEQ ID NO: 944969 - protein, 9 aa, Homo Sapiens
KKAQEALIC

SEQ ID NO: 944970 - protein, 9 aa, Homo Sapiens
VTCALLHQT

SEQ ID NO: 944971 - protein, 9 aa, Homo Sapiens
ASNEILRNP

SEQ ID NO: 944972 - protein, 9 aa, Homo Sapiens
LRKIVGSAT

SEQ ID NO: 944973 - protein, 9 aa, Homo Sapiens
FQANEELCP

SEQ ID NO: 944974 - protein, 9 aa, Homo Sapiens
LIRDVLQKL

SEQ ID NO: 944975 - protein, 9 aa, Homo Sapiens
EIPDTQIAD

SEQ ID NO: 944976 - protein, 9 aa, Homo Sapiens
LRVGFVLDK

SEQ ID NO: 944977 - protein, 9 aa, Homo Sapiens
AQATAPLDF

SEQ ID NO: 944978 - protein, 9 aa, Homo Sapiens
RWGLCINRL

SEQ ID NO: 944979 - protein, 9 aa, Homo Sapiens
QSSWEQAIS

SEQ ID NO: 944980 - protein, 9 aa, Homo Sapiens
MGPAFNMPL

SEQ ID NO: 944981 - protein, 9 aa, Homo Sapiens
HSNKVMYVR

SEQ ID NO: 944982 - protein, 9 aa, Homo Sapiens
YYSPTRANT

SEQ ID NO: 944983 - protein, 9 aa, Homo Sapiens
GSQTSNSSM

SEQ ID NO: 944984 - protein, 9 aa, Homo Sapiens
PYGHCPNGV

SEQ ID NO: 944985 - protein, 9 aa, Homo Sapiens
DYFGICYVD

SEQ ID NO: 944986 - protein, 9 aa, Homo Sapiens
VQRHFELLL

SEQ ID NO: 944987 - protein, 9 aa, Homo Sapiens
PLESLVLVK

SEQ ID NO: 944988 - protein, 9 aa, Homo Sapiens
EKQSAVVLN

SEQ ID NO: 944989 - protein, 9 aa, Homo Sapiens
WQQQRLPKQ

SEQ ID NO: 944990 - protein, 9 aa, Homo Sapiens
QLLMYQAQE

SEQ ID NO: 944991 - protein, 9 aa, Homo Sapiens
FYKTYHFWV

SEQ ID NO: 944992 - protein, 9 aa, Homo Sapiens
RYNDLEKHK

SEQ ID NO: 944993 - protein, 9 aa, Homo Sapiens
GPKELFPTM

SEQ ID NO: 944994 - protein, 9 aa, Homo Sapiens
GSKIKIPSF

SEQ ID NO: 944995 - protein, 9 aa, Homo Sapiens
YCPFLCFSD

SEQ ID NO: 944996 - protein, 9 aa, Homo Sapiens
MLSCNFLRR

SEQ ID NO: 944997 - protein, 9 aa, Homo Sapiens
AISFVNEIS

SEQ ID NO: 944998 - protein, 9 aa, Homo Sapiens
SFHQVNYTF

SEQ ID NO: 944999 - protein, 9 aa, Homo Sapiens
GGRVLECSS

SEQ ID NO: 945000 - protein, 9 aa, Homo Sapiens
CLCKHGFTG

SEQ ID NO: 945001 - protein, 9 aa, Homo Sapiens
DWPVQQRAW

SEQ ID NO: 945002 - protein, 9 aa, Homo Sapiens
PTSSTRHSF

SEQ ID NO: 945003 - protein, 9 aa, Homo Sapiens
CEYYSPIFD

SEQ ID NO: 945004 - protein, 9 aa, Homo Sapiens
QRLSPKEHP

SEQ ID NO: 945005 - protein, 9 aa, Homo Sapiens
PVLAWPFSL

SEQ ID NO: 945006 - protein, 9 aa, Homo Sapiens
NRDFRIGYQ

SEQ ID NO: 945007 - protein, 9 aa, Homo Sapiens
WSPVRGSFW

SEQ ID NO: 945008 - protein, 9 aa, Homo Sapiens
KIVNTGVTV

SEQ ID NO: 945009 - protein, 9 aa, Homo Sapiens
KFPGQSFFL

SEQ ID NO: 945010 - protein, 9 aa, Homo Sapiens
GFQLENFIL

SEQ ID NO: 945011 - protein, 9 aa, Homo Sapiens
HFPLLSRKP

SEQ ID NO: 945012 - protein, 9 aa, Homo Sapiens
KEVVSHPGR

SEQ ID NO: 945013 - protein, 9 aa, Homo Sapiens
EILAVIKLA

SEQ ID NO: 945014 - protein, 9 aa, Homo Sapiens
SGLAFRKNP

SEQ ID NO: 945015 - protein, 9 aa, Homo Sapiens
ASYLWWING

SEQ ID NO: 945016 - protein, 9 aa, Homo Sapiens
PLAVFPGSS

SEQ ID NO: 945017 - protein, 9 aa, Homo Sapiens
DDQSSSLGS

SEQ ID NO: 945018 - protein, 9 aa, Homo Sapiens
DDKTLCIWE

SEQ ID NO: 945019 - protein, 9 aa, Homo Sapiens
PEGWSSYLD

SEQ ID NO: 945020 - protein, 9 aa, Homo Sapiens
SMTLDWKVP

SEQ ID NO: 945021 - protein, 9 aa, Homo Sapiens
STGDTTPFP

SEQ ID NO: 945022 - protein, 9 aa, Homo Sapiens
QDNSSFDSI

SEQ ID NO: 945023 - protein, 9 aa, Homo Sapiens
QFRPLAALA

SEQ ID NO: 945024 - protein, 9 aa, Homo Sapiens
ATNHFETAS

SEQ ID NO: 945025 - protein, 9 aa, Homo Sapiens
HNVKFNGVY

SEQ ID NO: 945026 - protein, 9 aa, Homo Sapiens
EQDRNKEAI

SEQ ID NO: 945027 - protein, 9 aa, Homo Sapiens
GLSEWPEKQ

SEQ ID NO: 945028 - protein, 9 aa, Homo Sapiens
SSIERLFFF

SEQ ID NO: 945029 - protein, 9 aa, Homo Sapiens
LIPGGFLPT

SEQ ID NO: 945030 - protein, 9 aa, Homo Sapiens
NTFSFCRNP

SEQ ID NO: 945031 - protein, 9 aa, Homo Sapiens
TVCDIDPQN

SEQ ID NO: 945032 - protein, 9 aa, Homo Sapiens
RAEENPKPE

SEQ ID NO: 945033 - protein, 9 aa, Homo Sapiens
LQMNQALQF

SEQ ID NO: 945034 - protein, 9 aa, Homo Sapiens
RAAVRNEKG

SEQ ID NO: 945035 - protein, 9 aa, Homo Sapiens
QDFFTEIPA

SEQ ID NO: 945036 - protein, 9 aa, Homo Sapiens
FIEPWELLA

SEQ ID NO: 945037 - protein, 9 aa, Homo Sapiens
QKEQCSLLD

SEQ ID NO: 945038 - protein, 9 aa, Homo Sapiens
SNKDQHSIL

SEQ ID NO: 945039 - protein, 9 aa, Homo Sapiens
PLVVEEDAS

SEQ ID NO: 945040 - protein, 9 aa, Homo Sapiens
HYYHHHCIN

SEQ ID NO: 945041 - protein, 9 aa, Homo Sapiens
GYLYTSKLF

SEQ ID NO: 945042 - protein, 9 aa, Homo Sapiens
LAIIVPSLF

SEQ ID NO: 945043 - protein, 9 aa, Homo Sapiens
NSSFDSISP

SEQ ID NO: 945044 - protein, 9 aa, Homo Sapiens
GYYAQSEDY

SEQ ID NO: 945045 - protein, 9 aa, Homo Sapiens
SHCFQLTTF

SEQ ID NO: 945046 - protein, 9 aa, Homo Sapiens
QSHKEEKTL

SEQ ID NO: 945047 - protein, 9 aa, Homo Sapiens
GGGGTCHCC

SEQ ID NO: 945048 - protein, 9 aa, Homo Sapiens
SRERSGFPH

SEQ ID NO: 945049 - protein, 9 aa, Homo Sapiens
YSWLSLLKD

SEQ ID NO: 945050 - protein, 9 aa, Homo Sapiens
SVFLVELYE

SEQ ID NO: 945051 - protein, 9 aa, Homo Sapiens
GGNYWRLLT

SEQ ID NO: 945052 - protein, 9 aa, Homo Sapiens
KEAHKTVSL

SEQ ID NO: 945053 - protein, 9 aa, Homo Sapiens
TCTTNKTMC

SEQ ID NO: 945054 - protein, 9 aa, Homo Sapiens
DTDIQNLSE

SEQ ID NO: 945055 - protein, 9 aa, Homo Sapiens
QFTPLANPP

SEQ ID NO: 945056 - protein, 9 aa, Homo Sapiens
ICHGLGLSL

SEQ ID NO: 945057 - protein, 9 aa, Homo Sapiens
KGEKRDKGA

SEQ ID NO: 945058 - protein, 9 aa, Homo Sapiens
SLKDLFNFC

SEQ ID NO: 945059 - protein, 9 aa, Homo Sapiens
MWSGLSSRG

SEQ ID NO: 945060 - protein, 9 aa, Homo Sapiens
SVTEPGFEP

SEQ ID NO: 945061 - protein, 9 aa, Homo Sapiens
AGGKLYAAT

SEQ ID NO: 945062 - protein, 9 aa, Homo Sapiens
RPKKEYFQE

SEQ ID NO: 945063 - protein, 9 aa, Homo Sapiens
KENKFKSLW

SEQ ID NO: 945064 - protein, 9 aa, Homo Sapiens
TVPLAVFPG

SEQ ID NO: 945065 - protein, 9 aa, Homo Sapiens
TSLEKRMGV

SEQ ID NO: 945066 - protein, 9 aa, Homo Sapiens
RAFDREQVS

SEQ ID NO: 945067 - protein, 9 aa, Homo Sapiens
PLGPKELFP

SEQ ID NO: 945068 - protein, 9 aa, Homo Sapiens
EIDAIQRTE

SEQ ID NO: 945069 - protein, 9 aa, Homo Sapiens
ILRLLQTYF

SEQ ID NO: 945070 - protein, 9 aa, Homo Sapiens
ETTQEQDFV

SEQ ID NO: 945071 - protein, 9 aa, Homo Sapiens
LFQPKDQIA

SEQ ID NO: 945072 - protein, 9 aa, Homo Sapiens
GCVFCGVSK

SEQ ID NO: 945073 - protein, 9 aa, Homo Sapiens
RECLEKQKP

SEQ ID NO: 945074 - protein, 9 aa, Homo Sapiens
SVLCSVLGL

SEQ ID NO: 945075 - protein, 9 aa, Homo Sapiens
EAPRGGLFL

SEQ ID NO: 945076 - protein, 9 aa, Homo Sapiens
SRIWGDSPE

SEQ ID NO: 945077 - protein, 9 aa, Homo Sapiens
EMDSKTLQQ

SEQ ID NO: 945078 - protein, 9 aa, Homo Sapiens
NVKSTTIAM

SEQ ID NO: 945079 - protein, 9 aa, Homo Sapiens
PGADSQDQQ

SEQ ID NO: 945080 - protein, 9 aa, Homo Sapiens
PSSTTMKKE

SEQ ID NO: 945081 - protein, 9 aa, Homo Sapiens
KKEKEGEGK

SEQ ID NO: 945082 - protein, 9 aa, Homo Sapiens
EKPIQNSHY

SEQ ID NO: 945083 - protein, 9 aa, Homo Sapiens
KSKTIFRFS

SEQ ID NO: 945084 - protein, 9 aa, Homo Sapiens
LNILPLPNA

SEQ ID NO: 945085 - protein, 9 aa, Homo Sapiens
KDESQSFYP

SEQ ID NO: 945086 - protein, 9 aa, Homo Sapiens
PKSSITELL

SEQ ID NO: 945087 - protein, 9 aa, Homo Sapiens
SLEAQVTQN

SEQ ID NO: 945088 - protein, 9 aa, Homo Sapiens
QCSAPLSYV

SEQ ID NO: 945089 - protein, 9 aa, Homo Sapiens
YAGPKFASY

SEQ ID NO: 945090 - protein, 9 aa, Homo Sapiens
LSKLPAIHD

SEQ ID NO: 945091 - protein, 9 aa, Homo Sapiens
LSVILMNLE

SEQ ID NO: 945092 - protein, 9 aa, Homo Sapiens
AQKILKCMF

SEQ ID NO: 945093 - protein, 9 aa, Homo Sapiens
YIIIESTKE

SEQ ID NO: 945094 - protein, 9 aa, Homo Sapiens
HSFFRRHLP

SEQ ID NO: 945095 - protein, 9 aa, Homo Sapiens
KHFAEAKKF

SEQ ID NO: 945096 - protein, 9 aa, Homo Sapiens
MNQALQFLE

SEQ ID NO: 945097 - protein, 9 aa, Homo Sapiens
RFDSARGME

SEQ ID NO: 945098 - protein, 9 aa, Homo Sapiens
QGWEILRQN

SEQ ID NO: 945099 - protein, 9 aa, Homo Sapiens
CGGTSHPDP

SEQ ID NO: 945100 - protein, 9 aa, Homo Sapiens
QRLYTGEKP

SEQ ID NO: 945101 - protein, 9 aa, Homo Sapiens
RLQGDNLEK

SEQ ID NO: 945102 - protein, 9 aa, Homo Sapiens
YDYDFSLSI

SEQ ID NO: 945103 - protein, 9 aa, Homo Sapiens
MPSKSPSTE

SEQ ID NO: 945104 - protein, 9 aa, Homo Sapiens
GTCHCCRDE

SEQ ID NO: 945105 - protein, 9 aa, Homo Sapiens
RMGVCLFNL

SEQ ID NO: 945106 - protein, 9 aa, Homo Sapiens
AFYTGLSCV

SEQ ID NO: 945107 - protein, 9 aa, Homo Sapiens
NLDKVGQQV

SEQ ID NO: 945108 - protein, 9 aa, Homo Sapiens
GPRALALAA

SEQ ID NO: 945109 - protein, 9 aa, Homo Sapiens
YVSCINPTA

SEQ ID NO: 945110 - protein, 9 aa, Homo Sapiens
TVALNASLK

SEQ ID NO: 945111 - protein, 9 aa, Homo Sapiens
GLNYELAHK

SEQ ID NO: 945112 - protein, 9 aa, Homo Sapiens
VLTLGTGQT

SEQ ID NO: 945113 - protein, 9 aa, Homo Sapiens
FQEICVVMD

SEQ ID NO: 945114 - protein, 9 aa, Homo Sapiens
NRILGVKRN

SEQ ID NO: 945115 - protein, 9 aa, Homo Sapiens
MNLRANLKQ

SEQ ID NO: 945116 - protein, 9 aa, Homo Sapiens
QKGDQIVVL

SEQ ID NO: 945117 - protein, 9 aa, Homo Sapiens
QPGLPLHDL

SEQ ID NO: 945118 - protein, 9 aa, Homo Sapiens
GRTYVDVVD

SEQ ID NO: 945119 - protein, 9 aa, Homo Sapiens
AAMGTPWRD

SEQ ID NO: 945120 - protein, 9 aa, Homo Sapiens
GLRGSQAPL

SEQ ID NO: 945121 - protein, 9 aa, Homo Sapiens
WNFSIFDLV

SEQ ID NO: 945122 - protein, 9 aa, Homo Sapiens
KVCECKECG

SEQ ID NO: 945123 - protein, 9 aa, Homo Sapiens
KDPDLPSNI

SEQ ID NO: 945124 - protein, 9 aa, Homo Sapiens
DKTLCIWEL

SEQ ID NO: 945125 - protein, 9 aa, Homo Sapiens
IFMTELRTL

SEQ ID NO: 945126 - protein, 9 aa, Homo Sapiens
KCSECGKAS

SEQ ID NO: 945127 - protein, 9 aa, Homo Sapiens
ITKESIKEG

SEQ ID NO: 945128 - protein, 9 aa, Homo Sapiens
NRPTSILWD

SEQ ID NO: 945129 - protein, 9 aa, Homo Sapiens
RSQYQRSTD

SEQ ID NO: 945130 - protein, 9 aa, Homo Sapiens
SLEKHKERC

SEQ ID NO: 945131 - protein, 9 aa, Homo Sapiens
RHVKEGSWY

SEQ ID NO: 945132 - protein, 9 aa, Homo Sapiens
CISKMNRLF

SEQ ID NO: 945133 - protein, 9 aa, Homo Sapiens
GSDLDKKHR

SEQ ID NO: 945134 - protein, 9 aa, Homo Sapiens
VFASIYFMT

SEQ ID NO: 945135 - protein, 9 aa, Homo Sapiens
LSEIPLDFL

SEQ ID NO: 945136 - protein, 9 aa, Homo Sapiens
CLQTLEIPF

SEQ ID NO: 945137 - protein, 9 aa, Homo Sapiens
KPYQLKEKK

SEQ ID NO: 945138 - protein, 9 aa, Homo Sapiens
EEESWLNPW

SEQ ID NO: 945139 - protein, 9 aa, Homo Sapiens
PSELIFAVP

SEQ ID NO: 945140 - protein, 9 aa, Homo Sapiens
VRANKQEAV

SEQ ID NO: 945141 - protein, 9 aa, Homo Sapiens
GSPCEAGKE

SEQ ID NO: 945142 - protein, 9 aa, Homo Sapiens
LVSEFVLHR

SEQ ID NO: 945143 - protein, 9 aa, Homo Sapiens
QNTHEFENA

SEQ ID NO: 945144 - protein, 9 aa, Homo Sapiens
DPRKFYVCP

SEQ ID NO: 945145 - protein, 9 aa, Homo Sapiens
SRGTGLFFS

SEQ ID NO: 945146 - protein, 9 aa, Homo Sapiens
LVSSANKID

SEQ ID NO: 945147 - protein, 9 aa, Homo Sapiens
GLGLYGSSL

SEQ ID NO: 945148 - protein, 9 aa, Homo Sapiens
SAMNTIDLD

SEQ ID NO: 945149 - protein, 9 aa, Homo Sapiens
KVPFSRVWC

SEQ ID NO: 945150 - protein, 9 aa, Homo Sapiens
VEGSASGSV

SEQ ID NO: 945151 - protein, 9 aa, Homo Sapiens
PCVVSEENI

SEQ ID NO: 945152 - protein, 9 aa, Homo Sapiens
AKSEQSCRK

SEQ ID NO: 945153 - protein, 9 aa, Homo Sapiens
PPVPVPRPK

SEQ ID NO: 945154 - protein, 9 aa, Homo Sapiens
PDGCILCSC

SEQ ID NO: 945155 - protein, 9 aa, Homo Sapiens
KETPLPTIT

SEQ ID NO: 945156 - protein, 9 aa, Homo Sapiens
GFTILVSNA

SEQ ID NO: 945157 - protein, 9 aa, Homo Sapiens
GLFFSAFSG

SEQ ID NO: 945158 - protein, 9 aa, Homo Sapiens
RAPCHIKET

SEQ ID NO: 945159 - protein, 9 aa, Homo Sapiens
CADPYKLGD

SEQ ID NO: 945160 - protein, 9 aa, Homo Sapiens
MGCINPMYQ

SEQ ID NO: 945161 - protein, 9 aa, Homo Sapiens
SDPGAFVLL

SEQ ID NO: 945162 - protein, 9 aa, Homo Sapiens
RANKQEAVF

SEQ ID NO: 945163 - protein, 9 aa, Homo Sapiens
LPLPNAQGL

SEQ ID NO: 945164 - protein, 9 aa, Homo Sapiens
YRASEEKTV

SEQ ID NO: 945165 - protein, 9 aa, Homo Sapiens
KKEEREPAA

SEQ ID NO: 945166 - protein, 9 aa, Homo Sapiens
AFMVINSDT

SEQ ID NO: 945167 - protein, 9 aa, Homo Sapiens
ALPTKREVL

SEQ ID NO: 945168 - protein, 9 aa, Homo Sapiens
DTYKDLFCS

SEQ ID NO: 945169 - protein, 9 aa, Homo Sapiens
KQLALSNAL

SEQ ID NO: 945170 - protein, 9 aa, Homo Sapiens
HGLCSESKY

SEQ ID NO: 945171 - protein, 9 aa, Homo Sapiens
KAAELIWAS

SEQ ID NO: 945172 - protein, 9 aa, Homo Sapiens
AHTLSQLEG

SEQ ID NO: 945173 - protein, 9 aa, Homo Sapiens
KKKWLYALE

SEQ ID NO: 945174 - protein, 9 aa, Homo Sapiens
KAVEGEGSV

SEQ ID NO: 945175 - protein, 9 aa, Homo Sapiens
NQILFLGSL

SEQ ID NO: 945176 - protein, 9 aa, Homo Sapiens
ISKMNRLFS

SEQ ID NO: 945177 - protein, 9 aa, Homo Sapiens
LTNSRNAWR

SEQ ID NO: 945178 - protein, 9 aa, Homo Sapiens
PGDSSSAVS

SEQ ID NO: 945179 - protein, 9 aa, Homo Sapiens
QRAVLKFAT

SEQ ID NO: 945180 - protein, 9 aa, Homo Sapiens
SLLGAACHG

SEQ ID NO: 945181 - protein, 9 aa, Homo Sapiens
TYLSQTEVP

SEQ ID NO: 945182 - protein, 9 aa, Homo Sapiens
SPYNVACCV

SEQ ID NO: 945183 - protein, 9 aa, Homo Sapiens
ERSGLLLGN

SEQ ID NO: 945184 - protein, 9 aa, Homo Sapiens
LDKVGQQVE

SEQ ID NO: 945185 - protein, 9 aa, Homo Sapiens
GALIEEHAP

SEQ ID NO: 945186 - protein, 9 aa, Homo Sapiens
LEQDMARLQ

SEQ ID NO: 945187 - protein, 9 aa, Homo Sapiens
SPFRCISRT

SEQ ID NO: 945188 - protein, 9 aa, Homo Sapiens
TQEHYELYC

SEQ ID NO: 945189 - protein, 9 aa, Homo Sapiens
LRQLRQTVK

SEQ ID NO: 945190 - protein, 9 aa, Homo Sapiens
STLNAQISE

SEQ ID NO: 945191 - protein, 9 aa, Homo Sapiens
YQVIFEGKI

SEQ ID NO: 945192 - protein, 9 aa, Homo Sapiens
VIIITEFME

SEQ ID NO: 945193 - protein, 9 aa, Homo Sapiens
VILRNQEGP

SEQ ID NO: 945194 - protein, 9 aa, Homo Sapiens
LHYNPKVWP

SEQ ID NO: 945195 - protein, 9 aa, Homo Sapiens
SIPDSLGGS

SEQ ID NO: 945196 - protein, 9 aa, Homo Sapiens
MAQDELCPP

SEQ ID NO: 945197 - protein, 9 aa, Homo Sapiens
FRFTRVDHI

SEQ ID NO: 945198 - protein, 9 aa, Homo Sapiens
RPGLIEILL

SEQ ID NO: 945199 - protein, 9 aa, Homo Sapiens
LNDLSSFRE

SEQ ID NO: 945200 - protein, 9 aa, Homo Sapiens
EDPPMSLRI

SEQ ID NO: 945201 - protein, 9 aa, Homo Sapiens
EASSSSTIA

SEQ ID NO: 945202 - protein, 9 aa, Homo Sapiens
QISENSTEA

SEQ ID NO: 945203 - protein, 9 aa, Homo Sapiens
GILKTTHIN

SEQ ID NO: 945204 - protein, 9 aa, Homo Sapiens
VVSEENINK

SEQ ID NO: 945205 - protein, 9 aa, Homo Sapiens
CPVLLHLAP

SEQ ID NO: 945206 - protein, 9 aa, Homo Sapiens
NTLFCFWSF

SEQ ID NO: 945207 - protein, 9 aa, Homo Sapiens
SSRVHKAVK

SEQ ID NO: 945208 - protein, 9 aa, Homo Sapiens
KKGCREDLS

SEQ ID NO: 945209 - protein, 9 aa, Homo Sapiens
LKPTSTIFT

SEQ ID NO: 945210 - protein, 9 aa, Homo Sapiens
ALIEEHAPP

SEQ ID NO: 945211 - protein, 9 aa, Homo Sapiens
FLGLKNNDR

SEQ ID NO: 945212 - protein, 9 aa, Homo Sapiens
HHLHRTEGG

SEQ ID NO: 945213 - protein, 9 aa, Homo Sapiens
AVRNEKGLP

SEQ ID NO: 945214 - protein, 9 aa, Homo Sapiens
TVCEDTKRQ

SEQ ID NO: 945215 - protein, 9 aa, Homo Sapiens
PASSGSLTH

SEQ ID NO: 945216 - protein, 9 aa, Homo Sapiens
CEICLHEGV

SEQ ID NO: 945217 - protein, 9 aa, Homo Sapiens
EPVVYHRHT

SEQ ID NO: 945218 - protein, 9 aa, Homo Sapiens
VSPEMRQRY

SEQ ID NO: 945219 - protein, 9 aa, Homo Sapiens
ACGRGRKPS

SEQ ID NO: 945220 - protein, 9 aa, Homo Sapiens
FFTPALYIY

SEQ ID NO: 945221 - protein, 9 aa, Homo Sapiens
WEQQFLHLH

SEQ ID NO: 945222 - protein, 9 aa, Homo Sapiens
AKLQHRYQE

SEQ ID NO: 945223 - protein, 9 aa, Homo Sapiens
SQLPLESLV

SEQ ID NO: 945224 - protein, 9 aa, Homo Sapiens
CCRSLTGKP

SEQ ID NO: 945225 - protein, 9 aa, Homo Sapiens
TNVTDKDGK

SEQ ID NO: 945226 - protein, 9 aa, Homo Sapiens
YHRKPHGPE

SEQ ID NO: 945227 - protein, 9 aa, Homo Sapiens
RKSCRNSPD

SEQ ID NO: 945228 - protein, 9 aa, Homo Sapiens
KRQQLSENT

SEQ ID NO: 945229 - protein, 9 aa, Homo Sapiens
KDLLAYCAI

SEQ ID NO: 945230 - protein, 9 aa, Homo Sapiens
FLQLLISYS

SEQ ID NO: 945231 - protein, 9 aa, Homo Sapiens
LIYYASKNM

SEQ ID NO: 945232 - protein, 9 aa, Homo Sapiens
FMALCASNY

SEQ ID NO: 945233 - protein, 9 aa, Homo Sapiens
CICFVCLDA

SEQ ID NO: 945234 - protein, 9 aa, Homo Sapiens
RNCFTEIPS

SEQ ID NO: 945235 - protein, 9 aa, Homo Sapiens
RPWPPSSLP

SEQ ID NO: 945236 - protein, 9 aa, Homo Sapiens
PLMAIVLKI

SEQ ID NO: 945237 - protein, 9 aa, Homo Sapiens
PVPLEEDSE

SEQ ID NO: 945238 - protein, 9 aa, Homo Sapiens
PFPKKFSFS

SEQ ID NO: 945239 - protein, 9 aa, Homo Sapiens
VLKCADICN

SEQ ID NO: 945240 - protein, 9 aa, Homo Sapiens
TDKGKPALF

SEQ ID NO: 945241 - protein, 9 aa, Homo Sapiens
NAQISELKS

SEQ ID NO: 945242 - protein, 9 aa, Homo Sapiens
RDHHHLHKP

SEQ ID NO: 945243 - protein, 9 aa, Homo Sapiens
LVNLCQSWI

SEQ ID NO: 945244 - protein, 9 aa, Homo Sapiens
TSGEGVHWY

SEQ ID NO: 945245 - protein, 9 aa, Homo Sapiens
IKIDDKEQK

SEQ ID NO: 945246 - protein, 9 aa, Homo Sapiens
PLCETLVHL

SEQ ID NO: 945247 - protein, 9 aa, Homo Sapiens
CPPSRGPCD

SEQ ID NO: 945248 - protein, 9 aa, Homo Sapiens
KFPEPRNLN

SEQ ID NO: 945249 - protein, 9 aa, Homo Sapiens
WSSYLDTLG

SEQ ID NO: 945250 - protein, 9 aa, Homo Sapiens
GFANQGDVL

SEQ ID NO: 945251 - protein, 9 aa, Homo Sapiens
LDVWNGWKE

SEQ ID NO: 945252 - protein, 9 aa, Homo Sapiens
QDSEVVPVL

SEQ ID NO: 945253 - protein, 9 aa, Homo Sapiens
LAGGNSSGQ

SEQ ID NO: 945254 - protein, 9 aa, Homo Sapiens
PSFPENCTL

SEQ ID NO: 945255 - protein, 9 aa, Homo Sapiens
DPPMSLRIV

SEQ ID NO: 945256 - protein, 9 aa, Homo Sapiens
MKVEQIQQR

SEQ ID NO: 945257 - protein, 9 aa, Homo Sapiens
GCGVKNSPG

SEQ ID NO: 945258 - protein, 9 aa, Homo Sapiens
TSNLNTDFF

SEQ ID NO: 945259 - protein, 9 aa, Homo Sapiens
MEKQSAVVL

SEQ ID NO: 945260 - protein, 9 aa, Homo Sapiens
LPSFPENCT

SEQ ID NO: 945261 - protein, 9 aa, Homo Sapiens
RHYHSIVQR

SEQ ID NO: 945262 - protein, 9 aa, Homo Sapiens
NFLGDLYAQ

SEQ ID NO: 945263 - protein, 9 aa, Homo Sapiens
LPLESLVLV

SEQ ID NO: 945264 - protein, 9 aa, Homo Sapiens
LAGMWNNIA

SEQ ID NO: 945265 - protein, 9 aa, Homo Sapiens
YILVTVPKS

SEQ ID NO: 945266 - protein, 9 aa, Homo Sapiens
KDQHSILYT

SEQ ID NO: 945267 - protein, 9 aa, Homo Sapiens
SPIFDQWTP

SEQ ID NO: 945268 - protein, 9 aa, Homo Sapiens
RTCSSREHV

SEQ ID NO: 945269 - protein, 9 aa, Homo Sapiens
KFSLQDIEV

SEQ ID NO: 945270 - protein, 9 aa, Homo Sapiens
LFVQTLMHL

SEQ ID NO: 945271 - protein, 9 aa, Homo Sapiens
EPSMIEYVL

SEQ ID NO: 945272 - protein, 9 aa, Homo Sapiens
FAVSFSIIA

SEQ ID NO: 945273 - protein, 9 aa, Homo Sapiens
LVVLKRLKA

SEQ ID NO: 945274 - protein, 9 aa, Homo Sapiens
DSPCYEFLW

SEQ ID NO: 945275 - protein, 9 aa, Homo Sapiens
QIKGSDLDK

SEQ ID NO: 945276 - protein, 9 aa, Homo Sapiens
SSFRGGRPG

SEQ ID NO: 945277 - protein, 9 aa, Homo Sapiens
FYVRPVTQT

SEQ ID NO: 945278 - protein, 9 aa, Homo Sapiens
SRENRALKK

SEQ ID NO: 945279 - protein, 9 aa, Homo Sapiens
ACSAFPRDT

SEQ ID NO: 945280 - protein, 9 aa, Homo Sapiens
AEAFQKSAE

SEQ ID NO: 945281 - protein, 9 aa, Homo Sapiens
RVFWKQRSM

SEQ ID NO: 945282 - protein, 9 aa, Homo Sapiens
AGRAGGPSP

SEQ ID NO: 945283 - protein, 9 aa, Homo Sapiens
WFIMVVAIV

SEQ ID NO: 945284 - protein, 9 aa, Homo Sapiens
YYDYDFSLS

SEQ ID NO: 945285 - protein, 9 aa, Homo Sapiens
PPRELLMPQ

SEQ ID NO: 945286 - protein, 9 aa, Homo Sapiens
IFSWFSAAP

SEQ ID NO: 945287 - protein, 9 aa, Homo Sapiens
SLKNSEGIL

SEQ ID NO: 945288 - protein, 9 aa, Homo Sapiens
ASLDINKTE

SEQ ID NO: 945289 - protein, 9 aa, Homo Sapiens
MKLGLKEPE

SEQ ID NO: 945290 - protein, 9 aa, Homo Sapiens
NSSVLIGNP

SEQ ID NO: 945291 - protein, 9 aa, Homo Sapiens
FAHKCQLPK

SEQ ID NO: 945292 - protein, 9 aa, Homo Sapiens
KGELQALRE

SEQ ID NO: 945293 - protein, 9 aa, Homo Sapiens
GLYGSSLGR

SEQ ID NO: 945294 - protein, 9 aa, Homo Sapiens
LQIWCSCVA

SEQ ID NO: 945295 - protein, 9 aa, Homo Sapiens
LAKPKKRFS

SEQ ID NO: 945296 - protein, 9 aa, Homo Sapiens
GGFLPTAMP

SEQ ID NO: 945297 - protein, 9 aa, Homo Sapiens
FCNHKTFYK

SEQ ID NO: 945298 - protein, 9 aa, Homo Sapiens
PPVICSYFP

SEQ ID NO: 945299 - protein, 9 aa, Homo Sapiens
FEDYEGLPT

SEQ ID NO: 945300 - protein, 9 aa, Homo Sapiens
QFTIFGTLA

SEQ ID NO: 945301 - protein, 9 aa, Homo Sapiens
RNEEENTHA

SEQ ID NO: 945302 - protein, 9 aa, Homo Sapiens
KQPLTSKKE

SEQ ID NO: 945303 - protein, 9 aa, Homo Sapiens
PAPTYLSDS

SEQ ID NO: 945304 - protein, 9 aa, Homo Sapiens
WKERTQFFS

SEQ ID NO: 945305 - protein, 9 aa, Homo Sapiens
AYSSVQQGV

SEQ ID NO: 945306 - protein, 9 aa, Homo Sapiens
LKTLCHPCL

SEQ ID NO: 945307 - protein, 9 aa, Homo Sapiens
TSYFPDFAV

SEQ ID NO: 945308 - protein, 9 aa, Homo Sapiens
RGGQLHGAW

SEQ ID NO: 945309 - protein, 9 aa, Homo Sapiens
LLTSDSPSV

SEQ ID NO: 945310 - protein, 9 aa, Homo Sapiens
SQLQRKQQL

SEQ ID NO: 945311 - protein, 9 aa, Homo Sapiens
HLHKPHEHG

SEQ ID NO: 945312 - protein, 9 aa, Homo Sapiens
KGSDLDKKH

SEQ ID NO: 945313 - protein, 9 aa, Homo Sapiens
GLMADSVQV

SEQ ID NO: 945314 - protein, 9 aa, Homo Sapiens
YAILDHLES

SEQ ID NO: 945315 - protein, 9 aa, Homo Sapiens
LAGSRFLIH

SEQ ID NO: 945316 - protein, 9 aa, Homo Sapiens
TWRTKYEID

SEQ ID NO: 945317 - protein, 9 aa, Homo Sapiens
QNTLIEESA

SEQ ID NO: 945318 - protein, 9 aa, Homo Sapiens
KWPMGGNGV

SEQ ID NO: 945319 - protein, 9 aa, Homo Sapiens
SLANILKSR

SEQ ID NO: 945320 - protein, 9 aa, Homo Sapiens
TSKLFTPEC

SEQ ID NO: 945321 - protein, 9 aa, Homo Sapiens
ERAEASDGE

SEQ ID NO: 945322 - protein, 9 aa, Homo Sapiens
LLSVLPSVP

SEQ ID NO: 945323 - protein, 9 aa, Homo Sapiens
TEILNQSDI

SEQ ID NO: 945324 - protein, 9 aa, Homo Sapiens
LAYYGYSYN

SEQ ID NO: 945325 - protein, 9 aa, Homo Sapiens
RRENGPQAI

SEQ ID NO: 945326 - protein, 9 aa, Homo Sapiens
RKHQHYKKT

SEQ ID NO: 945327 - protein, 9 aa, Homo Sapiens
AALALLRAN

SEQ ID NO: 945328 - protein, 9 aa, Homo Sapiens
KDRCEDSER

SEQ ID NO: 945329 - protein, 9 aa, Homo Sapiens
LTLYSGRDI

SEQ ID NO: 945330 - protein, 9 aa, Homo Sapiens
NITATTKFV

SEQ ID NO: 945331 - protein, 9 aa, Homo Sapiens
SVGPSHVAA

SEQ ID NO: 945332 - protein, 9 aa, Homo Sapiens
VFVMEVGEA

SEQ ID NO: 945333 - protein, 9 aa, Homo Sapiens
MSGHRPSIH

SEQ ID NO: 945334 - protein, 9 aa, Homo Sapiens
DLRKEASNK

SEQ ID NO: 945335 - protein, 9 aa, Homo Sapiens
TKTRLYTLE

SEQ ID NO: 945336 - protein, 9 aa, Homo Sapiens
EGLLCGQPK

SEQ ID NO: 945337 - protein, 9 aa, Homo Sapiens
TCWGRNECL

SEQ ID NO: 945338 - protein, 9 aa, Homo Sapiens
TWPDLGVPS

SEQ ID NO: 945339 - protein, 9 aa, Homo Sapiens
GSYACAGFC

SEQ ID NO: 945340 - protein, 9 aa, Homo Sapiens
IMDAKHKNC

SEQ ID NO: 945341 - protein, 9 aa, Homo Sapiens
SLPAVILQN

SEQ ID NO: 945342 - protein, 9 aa, Homo Sapiens
VPQNALPSV

SEQ ID NO: 945343 - protein, 9 aa, Homo Sapiens
GGADGVLHI

SEQ ID NO: 945344 - protein, 9 aa, Homo Sapiens
LTQDEFYPF

SEQ ID NO: 945345 - protein, 9 aa, Homo Sapiens
QSYPDSVLP

SEQ ID NO: 945346 - protein, 9 aa, Homo Sapiens
PWIYAAYPH

SEQ ID NO: 945347 - protein, 9 aa, Homo Sapiens
NKSNCRFRD

SEQ ID NO: 945348 - protein, 9 aa, Homo Sapiens
KGSVYGMNR

SEQ ID NO: 945349 - protein, 9 aa, Homo Sapiens
GTDIFKNIA

SEQ ID NO: 945350 - protein, 9 aa, Homo Sapiens
SFLVKPGLN

SEQ ID NO: 945351 - protein, 9 aa, Homo Sapiens
QDALISIEN

SEQ ID NO: 945352 - protein, 9 aa, Homo Sapiens
WAAESPEKK

SEQ ID NO: 945353 - protein, 9 aa, Homo Sapiens
YTRQPAFPV

SEQ ID NO: 945354 - protein, 9 aa, Homo Sapiens
GQLREKVEK

SEQ ID NO: 945355 - protein, 9 aa, Homo Sapiens
LAAHCVANV

SEQ ID NO: 945356 - protein, 9 aa, Homo Sapiens
EAGNPGPLG

SEQ ID NO: 945357 - protein, 9 aa, Homo Sapiens
SVPLWMIAL

SEQ ID NO: 945358 - protein, 9 aa, Homo Sapiens
RHSFFRRHL

SEQ ID NO: 945359 - protein, 9 aa, Homo Sapiens
QIKNGKLIC

SEQ ID NO: 945360 - protein, 9 aa, Homo Sapiens
KKKNSLDWE

SEQ ID NO: 945361 - protein, 9 aa, Homo Sapiens
GTRPINLES

SEQ ID NO: 945362 - protein, 9 aa, Homo Sapiens
EGIVKIRLE

SEQ ID NO: 945363 - protein, 9 aa, Homo Sapiens
DYKFNAVDG

SEQ ID NO: 945364 - protein, 9 aa, Homo Sapiens
CDTSPNTVS

SEQ ID NO: 945365 - protein, 9 aa, Homo Sapiens
GSFVGGAKF

SEQ ID NO: 945366 - protein, 9 aa, Homo Sapiens
CGQSATAHK

SEQ ID NO: 945367 - protein, 9 aa, Homo Sapiens
QIMFKTFNV

SEQ ID NO: 945368 - protein, 9 aa, Homo Sapiens
ECGHKKDAA

SEQ ID NO: 945369 - protein, 9 aa, Homo Sapiens
TLEKQVFSF

SEQ ID NO: 945370 - protein, 9 aa, Homo Sapiens
RPRIKCQTA

SEQ ID NO: 945371 - protein, 9 aa, Homo Sapiens
NMCSGGYSE

SEQ ID NO: 945372 - protein, 9 aa, Homo Sapiens
SDSSEKEEG

SEQ ID NO: 945373 - protein, 9 aa, Homo Sapiens
QVPLPVPRF

SEQ ID NO: 945374 - protein, 9 aa, Homo Sapiens
KCIELCCGF

SEQ ID NO: 945375 - protein, 9 aa, Homo Sapiens
EVMGLHDVD

SEQ ID NO: 945376 - protein, 9 aa, Homo Sapiens
YARAGGSSW

SEQ ID NO: 945377 - protein, 9 aa, Homo Sapiens
KATNSMNKN

SEQ ID NO: 945378 - protein, 9 aa, Homo Sapiens
DPPCVSYLG

SEQ ID NO: 945379 - protein, 9 aa, Homo Sapiens
GLADLSFGS

SEQ ID NO: 945380 - protein, 9 aa, Homo Sapiens
SENMSEELV

SEQ ID NO: 945381 - protein, 9 aa, Homo Sapiens
SIGGMVLSQ

SEQ ID NO: 945382 - protein, 9 aa, Homo Sapiens
FFEKELAAE

SEQ ID NO: 945383 - protein, 9 aa, Homo Sapiens
CEVPLVWTD

SEQ ID NO: 945384 - protein, 9 aa, Homo Sapiens
VFSFWRQKM

SEQ ID NO: 945385 - protein, 9 aa, Homo Sapiens
IYIKEAHPS

SEQ ID NO: 945386 - protein, 9 aa, Homo Sapiens
ICNECGKIF

SEQ ID NO: 945387 - protein, 9 aa, Homo Sapiens
LAQRDKELR

SEQ ID NO: 945388 - protein, 9 aa, Homo Sapiens
CVGNKWVSV

SEQ ID NO: 945389 - protein, 9 aa, Homo Sapiens
HYTVLMHPC

SEQ ID NO: 945390 - protein, 9 aa, Homo Sapiens
VEKKRELEL

SEQ ID NO: 945391 - protein, 9 aa, Homo Sapiens
TVLNDLSSF

SEQ ID NO: 945392 - protein, 9 aa, Homo Sapiens
DINVSPEMR

SEQ ID NO: 945393 - protein, 9 aa, Homo Sapiens
SPTILETSL

SEQ ID NO: 945394 - protein, 9 aa, Homo Sapiens
ARTITNLKG

SEQ ID NO: 945395 - protein, 9 aa, Homo Sapiens
SSAGLGLLK

SEQ ID NO: 945396 - protein, 9 aa, Homo Sapiens
VPGQANKIV

SEQ ID NO: 945397 - protein, 9 aa, Homo Sapiens
IIIFAVMFS

SEQ ID NO: 945398 - protein, 9 aa, Homo Sapiens
EEEEEEKEV

SEQ ID NO: 945399 - protein, 9 aa, Homo Sapiens
GGKSLRRKR

SEQ ID NO: 945400 - protein, 9 aa, Homo Sapiens
WDKKLSIDS

SEQ ID NO: 945401 - protein, 9 aa, Homo Sapiens
VYGATPSLG

SEQ ID NO: 945402 - protein, 9 aa, Homo Sapiens
AAGHKTLVS

SEQ ID NO: 945403 - protein, 9 aa, Homo Sapiens
AAVRNEKGL

SEQ ID NO: 945404 - protein, 9 aa, Homo Sapiens
MRLPIYCVC

SEQ ID NO: 945405 - protein, 9 aa, Homo Sapiens
LHKRMEFFQ

SEQ ID NO: 945406 - protein, 9 aa, Homo Sapiens
INEKLRSQL

SEQ ID NO: 945407 - protein, 9 aa, Homo Sapiens
RSRPWNKVE

SEQ ID NO: 945408 - protein, 9 aa, Homo Sapiens
AAASASLYG

SEQ ID NO: 945409 - protein, 9 aa, Homo Sapiens
FSWDEDPEE

SEQ ID NO: 945410 - protein, 9 aa, Homo Sapiens
ELDTAVKVL

SEQ ID NO: 945411 - protein, 9 aa, Homo Sapiens
SRRLSFQKD

SEQ ID NO: 945412 - protein, 9 aa, Homo Sapiens
SLEKRMGVC

SEQ ID NO: 945413 - protein, 9 aa, Homo Sapiens
KSKSQEKSK

SEQ ID NO: 945414 - protein, 9 aa, Homo Sapiens
ELESIGFSA

SEQ ID NO: 945415 - protein, 9 aa, Homo Sapiens
LLASERLMF

SEQ ID NO: 945416 - protein, 9 aa, Homo Sapiens
KKYMELEIS

SEQ ID NO: 945417 - protein, 9 aa, Homo Sapiens
LFSRTSITL

SEQ ID NO: 945418 - protein, 9 aa, Homo Sapiens
KEDAQKILK

SEQ ID NO: 945419 - protein, 9 aa, Homo Sapiens
NPATNFQLE

SEQ ID NO: 945420 - protein, 9 aa, Homo Sapiens
KTVLAVFSV

SEQ ID NO: 945421 - protein, 9 aa, Homo Sapiens
LYVLYPGFQ

SEQ ID NO: 945422 - protein, 9 aa, Homo Sapiens
KTSGLVFLH

SEQ ID NO: 945423 - protein, 9 aa, Homo Sapiens
RVNILDEAH

SEQ ID NO: 945424 - protein, 9 aa, Homo Sapiens
KGGKRKEEK

SEQ ID NO: 945425 - protein, 9 aa, Homo Sapiens
LQNIERSSG

SEQ ID NO: 945426 - protein, 9 aa, Homo Sapiens
LSRQRHKEE

SEQ ID NO: 945427 - protein, 9 aa, Homo Sapiens
VTLEAKNLI

SEQ ID NO: 945428 - protein, 9 aa, Homo Sapiens
NLHTSYFPD

SEQ ID NO: 945429 - protein, 9 aa, Homo Sapiens
EKYQRIKGF

SEQ ID NO: 945430 - protein, 9 aa, Homo Sapiens
KRDPNKPSG

SEQ ID NO: 945431 - protein, 9 aa, Homo Sapiens
FRACLKIFM

SEQ ID NO: 945432 - protein, 9 aa, Homo Sapiens
GANIINLLT

SEQ ID NO: 945433 - protein, 9 aa, Homo Sapiens
NVCVQQNSS

SEQ ID NO: 945434 - protein, 9 aa, Homo Sapiens
EKQSPDYKF

SEQ ID NO: 945435 - protein, 9 aa, Homo Sapiens
FCRNPICMA

SEQ ID NO: 945436 - protein, 9 aa, Homo Sapiens
AHADIKTSY

SEQ ID NO: 945437 - protein, 9 aa, Homo Sapiens
DLKENSKTW

SEQ ID NO: 945438 - protein, 9 aa, Homo Sapiens
LPNVPLNAL

SEQ ID NO: 945439 - protein, 9 aa, Homo Sapiens
LGIVLIISL

SEQ ID NO: 945440 - protein, 9 aa, Homo Sapiens
DRLDLLCLR

SEQ ID NO: 945441 - protein, 9 aa, Homo Sapiens
KTRQPVQTK

SEQ ID NO: 945442 - protein, 9 aa, Homo Sapiens
DTTTLSGPR

SEQ ID NO: 945443 - protein, 9 aa, Homo Sapiens
ILQSVGPVV

SEQ ID NO: 945444 - protein, 9 aa, Homo Sapiens
SYFYILLTI

SEQ ID NO: 945445 - protein, 9 aa, Homo Sapiens
AGIQKAVEE

SEQ ID NO: 945446 - protein, 9 aa, Homo Sapiens
FTDSLQQLT

SEQ ID NO: 945447 - protein, 9 aa, Homo Sapiens
LGKKKKKEK

SEQ ID NO: 945448 - protein, 9 aa, Homo Sapiens
DETNLQAVP

SEQ ID NO: 945449 - protein, 9 aa, Homo Sapiens
LQQVGNYCF

SEQ ID NO: 945450 - protein, 9 aa, Homo Sapiens
LAYKKIAYL

SEQ ID NO: 945451 - protein, 9 aa, Homo Sapiens
LSPDGYYAQ

SEQ ID NO: 945452 - protein, 9 aa, Homo Sapiens
FSKRLLLSA

SEQ ID NO: 945453 - protein, 9 aa, Homo Sapiens
LHTSYFPDF

SEQ ID NO: 945454 - protein, 9 aa, Homo Sapiens
FFLTFPEEL

SEQ ID NO: 945455 - protein, 9 aa, Homo Sapiens
KSQHGSATS

SEQ ID NO: 945456 - protein, 9 aa, Homo Sapiens
FQLSWKLQE

SEQ ID NO: 945457 - protein, 9 aa, Homo Sapiens
GSSQAPPSP

SEQ ID NO: 945458 - protein, 9 aa, Homo Sapiens
ALRPLCALS

SEQ ID NO: 945459 - protein, 9 aa, Homo Sapiens
NRFPCKNSE

SEQ ID NO: 945460 - protein, 9 aa, Homo Sapiens
PFLEFKVSG

SEQ ID NO: 945461 - protein, 9 aa, Homo Sapiens
QSKNCSKKY

SEQ ID NO: 945462 - protein, 9 aa, Homo Sapiens
VVTKSTPVI

SEQ ID NO: 945463 - protein, 9 aa, Homo Sapiens
GAPEPRGAF

SEQ ID NO: 945464 - protein, 9 aa, Homo Sapiens
CQECICIYD

SEQ ID NO: 945465 - protein, 9 aa, Homo Sapiens
GAAALALLR

SEQ ID NO: 945466 - protein, 9 aa, Homo Sapiens
GGQLHGAWP

SEQ ID NO: 945467 - protein, 9 aa, Homo Sapiens
GTCLRILAN

SEQ ID NO: 945468 - protein, 9 aa, Homo Sapiens
GNLPKPPGN

SEQ ID NO: 945469 - protein, 9 aa, Homo Sapiens
QVSERAEAS

SEQ ID NO: 945470 - protein, 9 aa, Homo Sapiens
EAVGEIMLL

SEQ ID NO: 945471 - protein, 9 aa, Homo Sapiens
TNVQYVSCI

SEQ ID NO: 945472 - protein, 9 aa, Homo Sapiens
LYLVTLMEN

SEQ ID NO: 945473 - protein, 9 aa, Homo Sapiens
HGPLLTFYL

SEQ ID NO: 945474 - protein, 9 aa, Homo Sapiens
PGGTEGGGS

SEQ ID NO: 945475 - protein, 9 aa, Homo Sapiens
LTNLLFALL

SEQ ID NO: 945476 - protein, 9 aa, Homo Sapiens
QSFDEKEGE

SEQ ID NO: 945477 - protein, 9 aa, Homo Sapiens
PNVSLDATG

SEQ ID NO: 945478 - protein, 9 aa, Homo Sapiens
LTQLREGKK

SEQ ID NO: 945479 - protein, 9 aa, Homo Sapiens
DKKETSKIK

SEQ ID NO: 945480 - protein, 9 aa, Homo Sapiens
RVFNTLEGV

SEQ ID NO: 945481 - protein, 9 aa, Homo Sapiens
CYLLFQNGS

SEQ ID NO: 945482 - protein, 9 aa, Homo Sapiens
PNVPLNALP

SEQ ID NO: 945483 - protein, 9 aa, Homo Sapiens
YMELEISPT

SEQ ID NO: 945484 - protein, 9 aa, Homo Sapiens
YENEKVNMY

SEQ ID NO: 945485 - protein, 9 aa, Homo Sapiens
EDCLHCQTQ

SEQ ID NO: 945486 - protein, 9 aa, Homo Sapiens
ILVTVPKSI

SEQ ID NO: 945487 - protein, 9 aa, Homo Sapiens
EVGMRGPQE

SEQ ID NO: 945488 - protein, 9 aa, Homo Sapiens
TLGFDFVRK

SEQ ID NO: 945489 - protein, 9 aa, Homo Sapiens
SLDFISHSS

SEQ ID NO: 945490 - protein, 9 aa, Homo Sapiens
GLAEEAKQA

SEQ ID NO: 945491 - protein, 9 aa, Homo Sapiens
ASNQKGALQ

SEQ ID NO: 945492 - protein, 9 aa, Homo Sapiens
SKQYKIFKG

SEQ ID NO: 945493 - protein, 9 aa, Homo Sapiens
WGDYSLIGR

SEQ ID NO: 945494 - protein, 9 aa, Homo Sapiens
KEKWKTPFE

SEQ ID NO: 945495 - protein, 9 aa, Homo Sapiens
AGTCLRILA

SEQ ID NO: 945496 - protein, 9 aa, Homo Sapiens
NREEGYWTR

SEQ ID NO: 945497 - protein, 9 aa, Homo Sapiens
RCGCCGNEG

SEQ ID NO: 945498 - protein, 9 aa, Homo Sapiens
DMRLVFHNH

SEQ ID NO: 945499 - protein, 9 aa, Homo Sapiens
ARGQLKEIM

SEQ ID NO: 945500 - protein, 9 aa, Homo Sapiens
LIFSTHHLD

SEQ ID NO: 945501 - protein, 8 aa, Homo Sapiens
DLELDEYY

SEQ ID NO: 945502 - protein, 9 aa, Homo Sapiens
GEDDDAAGQ

SEQ ID NO: 945503 - protein, 9 aa, Homo Sapiens
TAVLVVLKR

SEQ ID NO: 945504 - protein, 9 aa, Homo Sapiens
GVSAPTELL

SEQ ID NO: 945505 - protein, 9 aa, Homo Sapiens
ADFCGIERV

SEQ ID NO: 945506 - protein, 9 aa, Homo Sapiens
ISDLKTDVA

SEQ ID NO: 945507 - protein, 9 aa, Homo Sapiens
STKTFRSQA

SEQ ID NO: 945508 - protein, 9 aa, Homo Sapiens
AGSTTRQRE

SEQ ID NO: 945509 - protein, 9 aa, Homo Sapiens
EIKSQGGVQ

SEQ ID NO: 945510 - protein, 9 aa, Homo Sapiens
LVLQQVGNY

SEQ ID NO: 945511 - protein, 9 aa, Homo Sapiens
PQGPVFFPG

SEQ ID NO: 945512 - protein, 9 aa, Homo Sapiens
IIFPSQFYI

SEQ ID NO: 945513 - protein, 9 aa, Homo Sapiens
LCQYPGPGE

SEQ ID NO: 945514 - protein, 9 aa, Homo Sapiens
AFLSSPLYS

SEQ ID NO: 945515 - protein, 9 aa, Homo Sapiens
EEEIDFLCS

SEQ ID NO: 945516 - protein, 9 aa, Homo Sapiens
DDNFETNWC

SEQ ID NO: 945517 - protein, 9 aa, Homo Sapiens
LREDTLSEE

SEQ ID NO: 945518 - protein, 9 aa, Homo Sapiens
FFSKKYSQK

SEQ ID NO: 945519 - protein, 9 aa, Homo Sapiens
IYCVCVTKE

SEQ ID NO: 945520 - protein, 9 aa, Homo Sapiens
LNVTVLVSD

SEQ ID NO: 945521 - protein, 9 aa, Homo Sapiens
EGFGINKIG

SEQ ID NO: 945522 - protein, 9 aa, Homo Sapiens
TMGGLTGFS

SEQ ID NO: 945523 - protein, 9 aa, Homo Sapiens
AKTLQKIFQ

SEQ ID NO: 945524 - protein, 9 aa, Homo Sapiens
FQRHPMNDP

SEQ ID NO: 945525 - protein, 9 aa, Homo Sapiens
ISENSTEAT

SEQ ID NO: 945526 - protein, 9 aa, Homo Sapiens
PRIKCQTAT

SEQ ID NO: 945527 - protein, 9 aa, Homo Sapiens
RARMETAKK

SEQ ID NO: 945528 - protein, 9 aa, Homo Sapiens
VTDSISKSP

SEQ ID NO: 945529 - protein, 9 aa, Homo Sapiens
WINGQSLPM

SEQ ID NO: 945530 - protein, 9 aa, Homo Sapiens
YGKLQEPWE

SEQ ID NO: 945531 - protein, 9 aa, Homo Sapiens
FLLLSLPIR

SEQ ID NO: 945532 - protein, 9 aa, Homo Sapiens
LSGDPGPKG

SEQ ID NO: 945533 - protein, 9 aa, Homo Sapiens
PTYLSDSHY

SEQ ID NO: 945534 - protein, 9 aa, Homo Sapiens
SVSLPLVLQ

SEQ ID NO: 945535 - protein, 9 aa, Homo Sapiens
RVSWANNSV

SEQ ID NO: 945536 - protein, 9 aa, Homo Sapiens
SIKDDLEDL

SEQ ID NO: 945537 - protein, 9 aa, Homo Sapiens
AQVTYSVTK

SEQ ID NO: 945538 - protein, 9 aa, Homo Sapiens
RQHKQLLRF

SEQ ID NO: 945539 - protein, 9 aa, Homo Sapiens
GAPNLFHLQ

SEQ ID NO: 945540 - protein, 9 aa, Homo Sapiens
SFQSGGSRS

SEQ ID NO: 945541 - protein, 9 aa, Homo Sapiens
WGSWTSGEG

SEQ ID NO: 945542 - protein, 9 aa, Homo Sapiens
LLLGAFSPK

SEQ ID NO: 945543 - protein, 9 aa, Homo Sapiens
LSARHQVHG

SEQ ID NO: 945544 - protein, 9 aa, Homo Sapiens
PCLFKGTLT

SEQ ID NO: 945545 - protein, 9 aa, Homo Sapiens
LKNFNETFL

SEQ ID NO: 945546 - protein, 9 aa, Homo Sapiens
AGLKDVAKE

SEQ ID NO: 945547 - protein, 9 aa, Homo Sapiens
PVRGSFWRE

SEQ ID NO: 945548 - protein, 9 aa, Homo Sapiens
SSFQTIDHP

SEQ ID NO: 945549 - protein, 9 aa, Homo Sapiens
RRQKQPRLP

SEQ ID NO: 945550 - protein, 9 aa, Homo Sapiens
AAETLESKG

SEQ ID NO: 945551 - protein, 9 aa, Homo Sapiens
PEAINYETF

SEQ ID NO: 945552 - protein, 9 aa, Homo Sapiens
YNWHKPPKQ

SEQ ID NO: 945553 - protein, 9 aa, Homo Sapiens
QVPVYVVTF

SEQ ID NO: 945554 - protein, 9 aa, Homo Sapiens
VKEFKNQPS

SEQ ID NO: 945555 - protein, 9 aa, Homo Sapiens
LPEETVRLG

SEQ ID NO: 945556 - protein, 9 aa, Homo Sapiens
ECTTIEHLF

SEQ ID NO: 945557 - protein, 9 aa, Homo Sapiens
HIRQEIEIM

SEQ ID NO: 945558 - protein, 9 aa, Homo Sapiens
GRDITELFM

SEQ ID NO: 945559 - protein, 9 aa, Homo Sapiens
SANDQRFSS

SEQ ID NO: 945560 - protein, 9 aa, Homo Sapiens
SSQNWDKKL

SEQ ID NO: 945561 - protein, 9 aa, Homo Sapiens
RQNKSNCRF

SEQ ID NO: 945562 - protein, 9 aa, Homo Sapiens
IQRNYSDGT

SEQ ID NO: 945563 - protein, 9 aa, Homo Sapiens
TAIIKETVS

SEQ ID NO: 945564 - protein, 9 aa, Homo Sapiens
ENQVQELVE

SEQ ID NO: 945565 - protein, 9 aa, Homo Sapiens
TTGSGLRED

SEQ ID NO: 945566 - protein, 9 aa, Homo Sapiens
LYYATLPFC

SEQ ID NO: 945567 - protein, 9 aa, Homo Sapiens
DIVARDMSK

SEQ ID NO: 945568 - protein, 9 aa, Homo Sapiens
ITDMNNKIT

SEQ ID NO: 945569 - protein, 9 aa, Homo Sapiens
VNANKEVVS

SEQ ID NO: 945570 - protein, 9 aa, Homo Sapiens
KLYCKVCYA

SEQ ID NO: 945571 - protein, 9 aa, Homo Sapiens
AVRVSWANN

SEQ ID NO: 945572 - protein, 9 aa, Homo Sapiens
SRVHKAVKA

SEQ ID NO: 945573 - protein, 9 aa, Homo Sapiens
MPQAEVTAR

SEQ ID NO: 945574 - protein, 9 aa, Homo Sapiens
RKLLQIIAE

SEQ ID NO: 945575 - protein, 9 aa, Homo Sapiens
KYETFSDDL

SEQ ID NO: 945576 - protein, 9 aa, Homo Sapiens
WPRFLGQGE

SEQ ID NO: 945577 - protein, 9 aa, Homo Sapiens
CGIPEFPGN

SEQ ID NO: 945578 - protein, 9 aa, Homo Sapiens
EMFEVMGLH

SEQ ID NO: 945579 - protein, 9 aa, Homo Sapiens
ARVQRHFEL

SEQ ID NO: 945580 - protein, 9 aa, Homo Sapiens
HFYNRNPLA

SEQ ID NO: 945581 - protein, 9 aa, Homo Sapiens
FCEIMVVLK

SEQ ID NO: 945582 - protein, 9 aa, Homo Sapiens
ITIVYEIDS

SEQ ID NO: 945583 - protein, 9 aa, Homo Sapiens
RFLIHSRAE

SEQ ID NO: 945584 - protein, 9 aa, Homo Sapiens
GIFFILFET

SEQ ID NO: 945585 - protein, 9 aa, Homo Sapiens
EATFCDFLK

SEQ ID NO: 945586 - protein, 9 aa, Homo Sapiens
DEGANRKIV

SEQ ID NO: 945587 - protein, 9 aa, Homo Sapiens
EGNYMVYRI

SEQ ID NO: 945588 - protein, 9 aa, Homo Sapiens
QEPWERPQE

SEQ ID NO: 945589 - protein, 9 aa, Homo Sapiens
RKPQKSGII

SEQ ID NO: 945590 - protein, 9 aa, Homo Sapiens
PSGSALAAV

SEQ ID NO: 945591 - protein, 9 aa, Homo Sapiens
IFRQMNTNN

SEQ ID NO: 945592 - protein, 9 aa, Homo Sapiens
FTPTGGFGL

SEQ ID NO: 945593 - protein, 9 aa, Homo Sapiens
AFRPWEGTD

SEQ ID NO: 945594 - protein, 9 aa, Homo Sapiens
ADEKIYFQH

SEQ ID NO: 945595 - protein, 9 aa, Homo Sapiens
ALICTVFQT

SEQ ID NO: 945596 - protein, 9 aa, Homo Sapiens
PAGSTTRQR

SEQ ID NO: 945597 - protein, 9 aa, Homo Sapiens
IGQKLLQKK

SEQ ID NO: 945598 - protein, 9 aa, Homo Sapiens
LLWKGFFKP

SEQ ID NO: 945599 - protein, 9 aa, Homo Sapiens
KKLRTAGPL

SEQ ID NO: 945600 - protein, 9 aa, Homo Sapiens
TLNSASLQC

SEQ ID NO: 945601 - protein, 9 aa, Homo Sapiens
EAEENNLSE

SEQ ID NO: 945602 - protein, 9 aa, Homo Sapiens
SERAEASDG

SEQ ID NO: 945603 - protein, 9 aa, Homo Sapiens
SSKDSRPLC

SEQ ID NO: 945604 - protein, 9 aa, Homo Sapiens
QILQNIERS

SEQ ID NO: 945605 - protein, 9 aa, Homo Sapiens
TVKATNSMN

SEQ ID NO: 945606 - protein, 9 aa, Homo Sapiens
LYLRKIVGS

SEQ ID NO: 945607 - protein, 9 aa, Homo Sapiens
SSGSPSGSA

SEQ ID NO: 945608 - protein, 9 aa, Homo Sapiens
HLNVTVLVS

SEQ ID NO: 945609 - protein, 9 aa, Homo Sapiens
EEKEVEEEE

SEQ ID NO: 945610 - protein, 9 aa, Homo Sapiens
SGVISSFTV

SEQ ID NO: 945611 - protein, 9 aa, Homo Sapiens
PHVEEHLKG

SEQ ID NO: 945612 - protein, 9 aa, Homo Sapiens
ASLSSGLNH

SEQ ID NO: 945613 - protein, 9 aa, Homo Sapiens
GQFFEKELA

SEQ ID NO: 945614 - protein, 9 aa, Homo Sapiens
YTGEKPFEC

SEQ ID NO: 945615 - protein, 9 aa, Homo Sapiens
VFPGAPAGW

SEQ ID NO: 945616 - protein, 9 aa, Homo Sapiens
KDCPCETCG

SEQ ID NO: 945617 - protein, 9 aa, Homo Sapiens
NLSEIENKL

SEQ ID NO: 945618 - protein, 9 aa, Homo Sapiens
TDIFKNIAC

SEQ ID NO: 945619 - protein, 9 aa, Homo Sapiens
QAAGQEKKG

SEQ ID NO: 945620 - protein, 9 aa, Homo Sapiens
ALAFRARLV

SEQ ID NO: 945621 - protein, 9 aa, Homo Sapiens
PSCYLLFQN

SEQ ID NO: 945622 - protein, 9 aa, Homo Sapiens
FFLQREGMR

SEQ ID NO: 945623 - protein, 9 aa, Homo Sapiens
ASSPVGPLS

SEQ ID NO: 945624 - protein, 9 aa, Homo Sapiens
VGFIPNDAE

SEQ ID NO: 945625 - protein, 9 aa, Homo Sapiens
SGVSKRQEA

SEQ ID NO: 945626 - protein, 9 aa, Homo Sapiens
PRAGSTRLT

SEQ ID NO: 945627 - protein, 9 aa, Homo Sapiens
TLTNQIDKN

SEQ ID NO: 945628 - protein, 9 aa, Homo Sapiens
TSVQVKGTN

SEQ ID NO: 945629 - protein, 9 aa, Homo Sapiens
LEERKKKQK

SEQ ID NO: 945630 - protein, 9 aa, Homo Sapiens
STTMKKEKV

SEQ ID NO: 945631 - protein, 9 aa, Homo Sapiens
PEPEAREVS

SEQ ID NO: 945632 - protein, 9 aa, Homo Sapiens
PFEVLTLGT

SEQ ID NO: 945633 - protein, 9 aa, Homo Sapiens
RYSVPYGQC

SEQ ID NO: 945634 - protein, 9 aa, Homo Sapiens
VMEFLPSVP

SEQ ID NO: 945635 - protein, 9 aa, Homo Sapiens
VMTGKSRRN

SEQ ID NO: 945636 - protein, 9 aa, Homo Sapiens
LKPPRIDTA

SEQ ID NO: 945637 - protein, 9 aa, Homo Sapiens
KATRPWYSY

SEQ ID NO: 945638 - protein, 9 aa, Homo Sapiens
IHPHPYPQP

SEQ ID NO: 945639 - protein, 9 aa, Homo Sapiens
QGLSKLPAI

SEQ ID NO: 945640 - protein, 9 aa, Homo Sapiens
MISVGPSHV

SEQ ID NO: 945641 - protein, 9 aa, Homo Sapiens
GPGPSSVGQ

SEQ ID NO: 945642 - protein, 9 aa, Homo Sapiens
ETLNVIISE

SEQ ID NO: 945643 - protein, 9 aa, Homo Sapiens
KKLHDGGLN

SEQ ID NO: 945644 - protein, 9 aa, Homo Sapiens
NQYNYGMYA

SEQ ID NO: 945645 - protein, 9 aa, Homo Sapiens
GLLGPPGFP

SEQ ID NO: 945646 - protein, 9 aa, Homo Sapiens
FLGGACLLV

SEQ ID NO: 945647 - protein, 9 aa, Homo Sapiens
GPAFNMPLQ

SEQ ID NO: 945648 - protein, 9 aa, Homo Sapiens
NFHDKNGMQ

SEQ ID NO: 945649 - protein, 9 aa, Homo Sapiens
WRSEVTFFT

SEQ ID NO: 945650 - protein, 9 aa, Homo Sapiens
PKYYQSSWE

SEQ ID NO: 945651 - protein, 9 aa, Homo Sapiens
FMPPRNLPG

SEQ ID NO: 945652 - protein, 9 aa, Homo Sapiens
VNGSHYKYK

SEQ ID NO: 945653 - protein, 9 aa, Homo Sapiens
DVCLIGEKL

SEQ ID NO: 945654 - protein, 9 aa, Homo Sapiens
TNLKNFNET

SEQ ID NO: 945655 - protein, 9 aa, Homo Sapiens
TFISALQNT

SEQ ID NO: 945656 - protein, 9 aa, Homo Sapiens
PRFEAPDGQ

SEQ ID NO: 945657 - protein, 9 aa, Homo Sapiens
QDYPLPSAE

SEQ ID NO: 945658 - protein, 9 aa, Homo Sapiens
KLDPGLTAP

SEQ ID NO: 945659 - protein, 9 aa, Homo Sapiens
EFIYGGCEE

SEQ ID NO: 945660 - protein, 9 aa, Homo Sapiens
PTSQVPALP

SEQ ID NO: 945661 - protein, 9 aa, Homo Sapiens
PFLSADWGL

SEQ ID NO: 945662 - protein, 9 aa, Homo Sapiens
KKHHKKCEE

SEQ ID NO: 945663 - protein, 9 aa, Homo Sapiens
SPLYPRRGR

SEQ ID NO: 945664 - protein, 9 aa, Homo Sapiens
KCVRWMVSE

SEQ ID NO: 945665 - protein, 9 aa, Homo Sapiens
CQTQDWVLQ

SEQ ID NO: 945666 - protein, 9 aa, Homo Sapiens
KLGPLPRFL

SEQ ID NO: 945667 - protein, 9 aa, Homo Sapiens
KRDKGAMGE

SEQ ID NO: 945668 - protein, 9 aa, Homo Sapiens
DGPLYQSYL

SEQ ID NO: 945669 - protein, 9 aa, Homo Sapiens
WHEGVPTLE

SEQ ID NO: 945670 - protein, 9 aa, Homo Sapiens
ARPSSYKWT

SEQ ID NO: 945671 - protein, 9 aa, Homo Sapiens
CGIERVDYV

SEQ ID NO: 945672 - protein, 9 aa, Homo Sapiens
EGSQLNASD

SEQ ID NO: 945673 - protein, 9 aa, Homo Sapiens
KPFVCKDCR

SEQ ID NO: 945674 - protein, 9 aa, Homo Sapiens
HVLNVERFL

SEQ ID NO: 945675 - protein, 9 aa, Homo Sapiens
YQLKEKKRI

SEQ ID NO: 945676 - protein, 9 aa, Homo Sapiens
QETREEGYT

SEQ ID NO: 945677 - protein, 9 aa, Homo Sapiens
ELQRLVHPD

SEQ ID NO: 945678 - protein, 9 aa, Homo Sapiens
LEAKNLINQ

SEQ ID NO: 945679 - protein, 9 aa, Homo Sapiens
HKVCMNLRA

SEQ ID NO: 945680 - protein, 9 aa, Homo Sapiens
WNNITKEAH

SEQ ID NO: 945681 - protein, 9 aa, Homo Sapiens
THADMDGKK

SEQ ID NO: 945682 - protein, 9 aa, Homo Sapiens
LGFDFVRKR

SEQ ID NO: 945683 - protein, 9 aa, Homo Sapiens
PLSFFVESI

SEQ ID NO: 945684 - protein, 9 aa, Homo Sapiens
GSVSLRPQR

SEQ ID NO: 945685 - protein, 9 aa, Homo Sapiens
KVEMFSSGE

SEQ ID NO: 945686 - protein, 9 aa, Homo Sapiens
VKGEKGGVE

SEQ ID NO: 945687 - protein, 9 aa, Homo Sapiens
EETNSSLII

SEQ ID NO: 945688 - protein, 9 aa, Homo Sapiens
DCQLYRGLG

SEQ ID NO: 945689 - protein, 9 aa, Homo Sapiens
IKQQRVNPT

SEQ ID NO: 945690 - protein, 9 aa, Homo Sapiens
YKPESIEET

SEQ ID NO: 945691 - protein, 9 aa, Homo Sapiens
EQEKTTKEE

SEQ ID NO: 945692 - protein, 9 aa, Homo Sapiens
RNKTGPYQC

SEQ ID NO: 945693 - protein, 9 aa, Homo Sapiens
QTTNNRLLH

SEQ ID NO: 945694 - protein, 9 aa, Homo Sapiens
LGSQSPLHL

SEQ ID NO: 945695 - protein, 9 aa, Homo Sapiens
VNDEDLVDQ

SEQ ID NO: 945696 - protein, 9 aa, Homo Sapiens
AQRIQEIKR

SEQ ID NO: 945697 - protein, 9 aa, Homo Sapiens
QEHYELYCE

SEQ ID NO: 945698 - protein, 9 aa, Homo Sapiens
SNLPPREDI

SEQ ID NO: 945699 - protein, 9 aa, Homo Sapiens
DGCILCSCD

SEQ ID NO: 945700 - protein, 9 aa, Homo Sapiens
ENSGQHPDL

SEQ ID NO: 945701 - protein, 9 aa, Homo Sapiens
PRRLKKVQG

SEQ ID NO: 945702 - protein, 9 aa, Homo Sapiens
CTVCEDTKR

SEQ ID NO: 945703 - protein, 9 aa, Homo Sapiens
APKVPKKIV

SEQ ID NO: 945704 - protein, 9 aa, Homo Sapiens
VLSSEANKV

SEQ ID NO: 945705 - protein, 9 aa, Homo Sapiens
QATAPLDFG

SEQ ID NO: 945706 - protein, 9 aa, Homo Sapiens
INKIGGNGM

SEQ ID NO: 945707 - protein, 9 aa, Homo Sapiens
NFELVVFLD

SEQ ID NO: 945708 - protein, 9 aa, Homo Sapiens
ASNKLTFYP

SEQ ID NO: 945709 - protein, 9 aa, Homo Sapiens
VVTFQEPEN

SEQ ID NO: 945710 - protein, 9 aa, Homo Sapiens
PINEETLSQ

SEQ ID NO: 945711 - protein, 9 aa, Homo Sapiens
LGGGAERRT

SEQ ID NO: 945712 - protein, 9 aa, Homo Sapiens
GYGCGVKNS

SEQ ID NO: 945713 - protein, 9 aa, Homo Sapiens
SKHKVCMNL

SEQ ID NO: 945714 - protein, 9 aa, Homo Sapiens
QSPLHLSTL

SEQ ID NO: 945715 - protein, 9 aa, Homo Sapiens
PPVELSIEE

SEQ ID NO: 945716 - protein, 9 aa, Homo Sapiens
VCFFEISSL

SEQ ID NO: 945717 - protein, 9 aa, Homo Sapiens
ASLKKSRKT

SEQ ID NO: 945718 - protein, 9 aa, Homo Sapiens
LHLLRRLVA

SEQ ID NO: 945719 - protein, 9 aa, Homo Sapiens
STAKFIPWE

SEQ ID NO: 945720 - protein, 9 aa, Homo Sapiens
PVVLSEASE

SEQ ID NO: 945721 - protein, 9 aa, Homo Sapiens
QTIKCSHEQ

SEQ ID NO: 945722 - protein, 9 aa, Homo Sapiens
IPEAKHDYR

SEQ ID NO: 945723 - protein, 9 aa, Homo Sapiens
VCPRRWKLQ

SEQ ID NO: 945724 - protein, 9 aa, Homo Sapiens
EKYFVFPTL

SEQ ID NO: 945725 - protein, 9 aa, Homo Sapiens
YALNHLDTV

SEQ ID NO: 945726 - protein, 9 aa, Homo Sapiens
LMCNVKETP

SEQ ID NO: 945727 - protein, 9 aa, Homo Sapiens
PGMKPQVPF

SEQ ID NO: 945728 - protein, 9 aa, Homo Sapiens
QLAEEAEIS

SEQ ID NO: 945729 - protein, 9 aa, Homo Sapiens
QGNTWSSPR

SEQ ID NO: 945730 - protein, 9 aa, Homo Sapiens
VMDVVVKFV

SEQ ID NO: 945731 - protein, 9 aa, Homo Sapiens
IRGPGPSSV

SEQ ID NO: 945732 - protein, 9 aa, Homo Sapiens
GLIEILLGS

SEQ ID NO: 945733 - protein, 9 aa, Homo Sapiens
SFAHCISHE

SEQ ID NO: 945734 - protein, 9 aa, Homo Sapiens
FGFRFFQKN

SEQ ID NO: 945735 - protein, 9 aa, Homo Sapiens
VFVEYIIFP

SEQ ID NO: 945736 - protein, 9 aa, Homo Sapiens
VPPTPSLAS

SEQ ID NO: 945737 - protein, 9 aa, Homo Sapiens
VIKGKGMQV

SEQ ID NO: 945738 - protein, 9 aa, Homo Sapiens
SSRTHLRAM

SEQ ID NO: 945739 - protein, 9 aa, Homo Sapiens
PEAREVSPP

SEQ ID NO: 945740 - protein, 9 aa, Homo Sapiens
LNHLPAQVS

SEQ ID NO: 945741 - protein, 9 aa, Homo Sapiens
VNTPSLITH

SEQ ID NO: 945742 - protein, 9 aa, Homo Sapiens
AALVSGGVV

SEQ ID NO: 945743 - protein, 9 aa, Homo Sapiens
ETVIRGPGP

SEQ ID NO: 945744 - protein, 9 aa, Homo Sapiens
IYFFRHREQ

SEQ ID NO: 945745 - protein, 9 aa, Homo Sapiens
KVGQQVERL

SEQ ID NO: 945746 - protein, 9 aa, Homo Sapiens
ESGWSGYSH

SEQ ID NO: 945747 - protein, 9 aa, Homo Sapiens
ELFRKRRER

SEQ ID NO: 945748 - protein, 9 aa, Homo Sapiens
LSEDNSGRT

SEQ ID NO: 945749 - protein, 9 aa, Homo Sapiens
ECKFKKSVF

SEQ ID NO: 945750 - protein, 9 aa, Homo Sapiens
TDEQVLSIS

SEQ ID NO: 945751 - protein, 9 aa, Homo Sapiens
PSPPPIALA

SEQ ID NO: 945752 - protein, 9 aa, Homo Sapiens
KQNGHVIKM

SEQ ID NO: 945753 - protein, 9 aa, Homo Sapiens
RENRALKKG

SEQ ID NO: 945754 - protein, 9 aa, Homo Sapiens
VWKERTQFF

SEQ ID NO: 945755 - protein, 9 aa, Homo Sapiens
PKGQKGKKG

SEQ ID NO: 945756 - protein, 9 aa, Homo Sapiens
SSLLVLRHS

SEQ ID NO: 945757 - protein, 9 aa, Homo Sapiens
NKTKLKITQ

SEQ ID NO: 945758 - protein, 9 aa, Homo Sapiens
TKNLNFWPQ

SEQ ID NO: 945759 - protein, 9 aa, Homo Sapiens
DLWSAGLSS

SEQ ID NO: 945760 - protein, 9 aa, Homo Sapiens
FWNKNIGLN

SEQ ID NO: 945761 - protein, 9 aa, Homo Sapiens
DKNIYLTLS

SEQ ID NO: 945762 - protein, 9 aa, Homo Sapiens
FTRKYLLSS

SEQ ID NO: 945763 - protein, 9 aa, Homo Sapiens
TPSLGHTCD

SEQ ID NO: 945764 - protein, 9 aa, Homo Sapiens
CAGFCKCKK

SEQ ID NO: 945765 - protein, 9 aa, Homo Sapiens
GMPTFSWDE

SEQ ID NO: 945766 - protein, 9 aa, Homo Sapiens
GTFILYLHP

SEQ ID NO: 945767 - protein, 9 aa, Homo Sapiens
WGILGRKEA

SEQ ID NO: 945768 - protein, 9 aa, Homo Sapiens
GIFPECAYE

SEQ ID NO: 945769 - protein, 9 aa, Homo Sapiens
TGLPEGSES

SEQ ID NO: 945770 - protein, 9 aa, Homo Sapiens
DIPKGRKKD

SEQ ID NO: 945771 - protein, 9 aa, Homo Sapiens
GLLDCRQIT

SEQ ID NO: 945772 - protein, 9 aa, Homo Sapiens
LELWQVRSE

SEQ ID NO: 945773 - protein, 9 aa, Homo Sapiens
FADGELESI

SEQ ID NO: 945774 - protein, 9 aa, Homo Sapiens
CHNLDHRGF

SEQ ID NO: 945775 - protein, 9 aa, Homo Sapiens
LPLWMMLYA

SEQ ID NO: 945776 - protein, 9 aa, Homo Sapiens
EMNTLFCFW

SEQ ID NO: 945777 - protein, 9 aa, Homo Sapiens
QQNPDFAGS

SEQ ID NO: 945778 - protein, 9 aa, Homo Sapiens
QVPALPPPA

SEQ ID NO: 945779 - protein, 9 aa, Homo Sapiens
GPPDSILGV

SEQ ID NO: 945780 - protein, 9 aa, Homo Sapiens
LVHLINPEY

SEQ ID NO: 945781 - protein, 9 aa, Homo Sapiens
WAQQVEKKR

SEQ ID NO: 945782 - protein, 9 aa, Homo Sapiens
KRHKSSRQE

SEQ ID NO: 945783 - protein, 9 aa, Homo Sapiens
LSSGLNHVE

SEQ ID NO: 945784 - protein, 9 aa, Homo Sapiens
HERCNCICS

SEQ ID NO: 945785 - protein, 9 aa, Homo Sapiens
PSPKMDFKI

SEQ ID NO: 945786 - protein, 9 aa, Homo Sapiens
KELYYLASF

SEQ ID NO: 945787 - protein, 9 aa, Homo Sapiens
EARSTEDSF

SEQ ID NO: 945788 - protein, 9 aa, Homo Sapiens
VWGKAGKGL

SEQ ID NO: 945789 - protein, 9 aa, Homo Sapiens
SGFLMKKKL

SEQ ID NO: 945790 - protein, 9 aa, Homo Sapiens
DRVFNTLEG

SEQ ID NO: 945791 - protein, 9 aa, Homo Sapiens
ETPKQFDVF

SEQ ID NO: 945792 - protein, 9 aa, Homo Sapiens
VVEKNYTEK

SEQ ID NO: 945793 - protein, 9 aa, Homo Sapiens
QQVEKKREL

SEQ ID NO: 945794 - protein, 9 aa, Homo Sapiens
EGKPVLFFW

SEQ ID NO: 945795 - protein, 9 aa, Homo Sapiens
KMFGVWLGE

SEQ ID NO: 945796 - protein, 9 aa, Homo Sapiens
KGDQIVVLE

SEQ ID NO: 945797 - protein, 9 aa, Homo Sapiens
NKLTFYPPH

SEQ ID NO: 945798 - protein, 9 aa, Homo Sapiens
LTQLKLLRT

SEQ ID NO: 945799 - protein, 9 aa, Homo Sapiens
GLLNFSYSA

SEQ ID NO: 945800 - protein, 9 aa, Homo Sapiens
LCLRLLQSC

SEQ ID NO: 945801 - protein, 9 aa, Homo Sapiens
RNFSVSIRK

SEQ ID NO: 945802 - protein, 9 aa, Homo Sapiens
NQVALLRAH

SEQ ID NO: 945803 - protein, 9 aa, Homo Sapiens
NGHPGPSTT

SEQ ID NO: 945804 - protein, 9 aa, Homo Sapiens
LSSSAENIM

SEQ ID NO: 945805 - protein, 9 aa, Homo Sapiens
GDDSVPEYD

SEQ ID NO: 945806 - protein, 9 aa, Homo Sapiens
PSPDDNEQR

SEQ ID NO: 945807 - protein, 9 aa, Homo Sapiens
WWEWYHPQF

SEQ ID NO: 945808 - protein, 9 aa, Homo Sapiens
ARATHNPMP

SEQ ID NO: 945809 - protein, 9 aa, Homo Sapiens
KASNQKGAL

SEQ ID NO: 945810 - protein, 9 aa, Homo Sapiens
SSISLGRQP

SEQ ID NO: 945811 - protein, 9 aa, Homo Sapiens
RGPHPDPRH

SEQ ID NO: 945812 - protein, 9 aa, Homo Sapiens
HGKEFLLGF

SEQ ID NO: 945813 - protein, 9 aa, Homo Sapiens
YKFNAVDGQ

SEQ ID NO: 945814 - protein, 9 aa, Homo Sapiens
FPGSCHVFE

SEQ ID NO: 945815 - protein, 9 aa, Homo Sapiens
SGEEPHVEE

SEQ ID NO: 945816 - protein, 9 aa, Homo Sapiens
PSLASAPLA

SEQ ID NO: 945817 - protein, 9 aa, Homo Sapiens
FLVNQLDSD

SEQ ID NO: 945818 - protein, 9 aa, Homo Sapiens
ELQQTGRFC

SEQ ID NO: 945819 - protein, 9 aa, Homo Sapiens
EVTFFTPAL

SEQ ID NO: 945820 - protein, 9 aa, Homo Sapiens
ARLRRWKLQ

SEQ ID NO: 945821 - protein, 9 aa, Homo Sapiens
ETSHEIKKQ

SEQ ID NO: 945822 - protein, 9 aa, Homo Sapiens
LGRPNCDGW

SEQ ID NO: 945823 - protein, 9 aa, Homo Sapiens
PGPPGARGS

SEQ ID NO: 945824 - protein, 9 aa, Homo Sapiens
ESRKVMRTL

SEQ ID NO: 945825 - protein, 9 aa, Homo Sapiens
MRLVFHNHK

SEQ ID NO: 945826 - protein, 9 aa, Homo Sapiens
GKAFKHFLA

SEQ ID NO: 945827 - protein, 9 aa, Homo Sapiens
KQSVKQRYK

SEQ ID NO: 945828 - protein, 9 aa, Homo Sapiens
SLSKKAPRE

SEQ ID NO: 945829 - protein, 9 aa, Homo Sapiens
VLMHPCFCH

SEQ ID NO: 945830 - protein, 9 aa, Homo Sapiens
FFVSHFYTP

SEQ ID NO: 945831 - protein, 9 aa, Homo Sapiens
TYEKRFFSP

SEQ ID NO: 945832 - protein, 9 aa, Homo Sapiens
NLRANLKQV

SEQ ID NO: 945833 - protein, 9 aa, Homo Sapiens
SFRELCIKL

SEQ ID NO: 945834 - protein, 9 aa, Homo Sapiens
NSRHNSPTG

SEQ ID NO: 945835 - protein, 9 aa, Homo Sapiens
GLILPREGP

SEQ ID NO: 945836 - protein, 9 aa, Homo Sapiens
GRGGSSKPG

SEQ ID NO: 945837 - protein, 9 aa, Homo Sapiens
GGGRVLECS

SEQ ID NO: 945838 - protein, 9 aa, Homo Sapiens
NKTGPYQCE

SEQ ID NO: 945839 - protein, 9 aa, Homo Sapiens
ILPTPEGFT

SEQ ID NO: 945840 - protein, 9 aa, Homo Sapiens
LNQEPFHKV

SEQ ID NO: 945841 - protein, 9 aa, Homo Sapiens
PRALGIPFL

SEQ ID NO: 945842 - protein, 9 aa, Homo Sapiens
KMSPLRLLE

SEQ ID NO: 945843 - protein, 9 aa, Homo Sapiens
EPFANAIKS

SEQ ID NO: 945844 - protein, 9 aa, Homo Sapiens
NQYIEWLKK

SEQ ID NO: 945845 - protein, 9 aa, Homo Sapiens
SFGSSGEDD

SEQ ID NO: 945846 - protein, 9 aa, Homo Sapiens
CLHKRMEFF

SEQ ID NO: 945847 - protein, 9 aa, Homo Sapiens
TLCGDSFPD

SEQ ID NO: 945848 - protein, 9 aa, Homo Sapiens
NQGNTWSSP

SEQ ID NO: 945849 - protein, 9 aa, Homo Sapiens
SFTVFIAIN

SEQ ID NO: 945850 - protein, 9 aa, Homo Sapiens
DCDEDSADK

SEQ ID NO: 945851 - protein, 9 aa, Homo Sapiens
DALLTHRAR

SEQ ID NO: 945852 - protein, 9 aa, Homo Sapiens
KHKCSVKHD

SEQ ID NO: 945853 - protein, 9 aa, Homo Sapiens
LSLVMDDKI

SEQ ID NO: 945854 - protein, 9 aa, Homo Sapiens
EHFYNRNPL

SEQ ID NO: 945855 - protein, 9 aa, Homo Sapiens
RQVCNSDSP

SEQ ID NO: 945856 - protein, 9 aa, Homo Sapiens
VLKFATATG

SEQ ID NO: 945857 - protein, 9 aa, Homo Sapiens
LAAGQTPKV

SEQ ID NO: 945858 - protein, 9 aa, Homo Sapiens
LVRKLVHDK

SEQ ID NO: 945859 - protein, 9 aa, Homo Sapiens
GFRFFQKNF

SEQ ID NO: 945860 - protein, 9 aa, Homo Sapiens
TSDRTSPNF

SEQ ID NO: 945861 - protein, 9 aa, Homo Sapiens
SLLIPSQVR

SEQ ID NO: 945862 - protein, 9 aa, Homo Sapiens
GTYANKTKL

SEQ ID NO: 945863 - protein, 9 aa, Homo Sapiens
VPLPVPRFC

SEQ ID NO: 945864 - protein, 9 aa, Homo Sapiens
SFKRTSKKK

SEQ ID NO: 945865 - protein, 9 aa, Homo Sapiens
DFWDNSIPN

SEQ ID NO: 945866 - protein, 9 aa, Homo Sapiens
ENAESLKSL

SEQ ID NO: 945867 - protein, 9 aa, Homo Sapiens
GDYFLLCSG

SEQ ID NO: 945868 - protein, 9 aa, Homo Sapiens
SGFSGQFCE

SEQ ID NO: 945869 - protein, 9 aa, Homo Sapiens
VPLEKSQAF

SEQ ID NO: 945870 - protein, 9 aa, Homo Sapiens
SVVLGFAVS

SEQ ID NO: 945871 - protein, 9 aa, Homo Sapiens
RFPGFILDQ

SEQ ID NO: 945872 - protein, 9 aa, Homo Sapiens
VLGEHDFSE

SEQ ID NO: 945873 - protein, 9 aa, Homo Sapiens
FSRFSSGGA

SEQ ID NO: 945874 - protein, 9 aa, Homo Sapiens
SEEEIDFLC

SEQ ID NO: 945875 - protein, 9 aa, Homo Sapiens
SSHQGWEIL

SEQ ID NO: 945876 - protein, 9 aa, Homo Sapiens
PRLQERVLF

SEQ ID NO: 945877 - protein, 9 aa, Homo Sapiens
LPLGPKELF

SEQ ID NO: 945878 - protein, 9 aa, Homo Sapiens
VKPRQPNPD

SEQ ID NO: 945879 - protein, 9 aa, Homo Sapiens
TPLRGRYPG

SEQ ID NO: 945880 - protein, 9 aa, Homo Sapiens
RSTEDSFTG

SEQ ID NO: 945881 - protein, 9 aa, Homo Sapiens
ILFLGSLSK

SEQ ID NO: 945882 - protein, 9 aa, Homo Sapiens
AQGLKQETV

SEQ ID NO: 945883 - protein, 9 aa, Homo Sapiens
TGLFFSAFS

SEQ ID NO: 945884 - protein, 9 aa, Homo Sapiens
SLPAVVPAL

SEQ ID NO: 945885 - protein, 9 aa, Homo Sapiens
LPPLPFMPP

SEQ ID NO: 945886 - protein, 9 aa, Homo Sapiens
NFLQSRETA

SEQ ID NO: 945887 - protein, 9 aa, Homo Sapiens
LSEASEPVP

SEQ ID NO: 945888 - protein, 9 aa, Homo Sapiens
SCQASGQPL

SEQ ID NO: 945889 - protein, 9 aa, Homo Sapiens
LLVLRHSEA

SEQ ID NO: 945890 - protein, 9 aa, Homo Sapiens
YGLHYNPKV

SEQ ID NO: 945891 - protein, 9 aa, Homo Sapiens
GMWYKAAEL

SEQ ID NO: 945892 - protein, 9 aa, Homo Sapiens
AVYFKEKWK

SEQ ID NO: 945893 - protein, 9 aa, Homo Sapiens
RSSLEKHKE

SEQ ID NO: 945894 - protein, 9 aa, Homo Sapiens
GRCVALSCE

SEQ ID NO: 945895 - protein, 9 aa, Homo Sapiens
KPQKLPPPG

SEQ ID NO: 945896 - protein, 9 aa, Homo Sapiens
PPPPPLRLT

SEQ ID NO: 945897 - protein, 9 aa, Homo Sapiens
LALRPSDKG

SEQ ID NO: 945898 - protein, 9 aa, Homo Sapiens
PGFRKAVDG

SEQ ID NO: 945899 - protein, 9 aa, Homo Sapiens
ANNSVPKNQ

SEQ ID NO: 945900 - protein, 9 aa, Homo Sapiens
SVAQKPRPF

SEQ ID NO: 945901 - protein, 9 aa, Homo Sapiens
KIGGNGMSG

SEQ ID NO: 945902 - protein, 9 aa, Homo Sapiens
AEPDPEIYW

SEQ ID NO: 945903 - protein, 9 aa, Homo Sapiens
ATGHCSCAL

SEQ ID NO: 945904 - protein, 9 aa, Homo Sapiens
WSGLSSRGS

SEQ ID NO: 945905 - protein, 9 aa, Homo Sapiens
TACQKVPFS

SEQ ID NO: 945906 - protein, 9 aa, Homo Sapiens
LLSIYGLHY

SEQ ID NO: 945907 - protein, 9 aa, Homo Sapiens
HERHRTIHG

SEQ ID NO: 945908 - protein, 9 aa, Homo Sapiens
ALLRANTDV

SEQ ID NO: 945909 - protein, 9 aa, Homo Sapiens
SRSCQTQDW

SEQ ID NO: 945910 - protein, 9 aa, Homo Sapiens
TLQKFLERI

SEQ ID NO: 945911 - protein, 9 aa, Homo Sapiens
ISYSICRLI

SEQ ID NO: 945912 - protein, 9 aa, Homo Sapiens
RAMFIPTSP

SEQ ID NO: 945913 - protein, 9 aa, Homo Sapiens
PAPLWAPPF

SEQ ID NO: 945914 - protein, 9 aa, Homo Sapiens
VSLDATGGP

SEQ ID NO: 945915 - protein, 9 aa, Homo Sapiens
YFMTAVAFD

SEQ ID NO: 945916 - protein, 9 aa, Homo Sapiens
SSKEAFKMR

SEQ ID NO: 945917 - protein, 9 aa, Homo Sapiens
ICYVDPEKQ

SEQ ID NO: 945918 - protein, 9 aa, Homo Sapiens
APPATLPAE

SEQ ID NO: 945919 - protein, 9 aa, Homo Sapiens
FVDFEDITY

SEQ ID NO: 945920 - protein, 9 aa, Homo Sapiens
ISKSPELCN

SEQ ID NO: 945921 - protein, 9 aa, Homo Sapiens
LPCVAMLRL

SEQ ID NO: 945922 - protein, 9 aa, Homo Sapiens
DKKHRFTDK

SEQ ID NO: 945923 - protein, 9 aa, Homo Sapiens
GREMSLVGP

SEQ ID NO: 945924 - protein, 9 aa, Homo Sapiens
MNTLFCFWS

SEQ ID NO: 945925 - protein, 9 aa, Homo Sapiens
GPRKIPAQQ

SEQ ID NO: 945926 - protein, 9 aa, Homo Sapiens
SIVHERHRT

SEQ ID NO: 945927 - protein, 9 aa, Homo Sapiens
CCRDEVHFD

SEQ ID NO: 945928 - protein, 9 aa, Homo Sapiens
SCNHIKLVD

SEQ ID NO: 945929 - protein, 9 aa, Homo Sapiens
LEKQKPVFA

SEQ ID NO: 945930 - protein, 9 aa, Homo Sapiens
TEEDVVKST

SEQ ID NO: 945931 - protein, 9 aa, Homo Sapiens
WGLVLKEPR

SEQ ID NO: 945932 - protein, 9 aa, Homo Sapiens
KSQQHRQSR

SEQ ID NO: 945933 - protein, 9 aa, Homo Sapiens
SHEYTRQPA

SEQ ID NO: 945934 - protein, 9 aa, Homo Sapiens
SKKKSDTAG

SEQ ID NO: 945935 - protein, 9 aa, Homo Sapiens
VYFLHNPAG

SEQ ID NO: 945936 - protein, 9 aa, Homo Sapiens
ENLAVTGSW

SEQ ID NO: 945937 - protein, 9 aa, Homo Sapiens
QSPDYKFNA

SEQ ID NO: 945938 - protein, 9 aa, Homo Sapiens
YGTQHKIKY

SEQ ID NO: 945939 - protein, 9 aa, Homo Sapiens
YGNTEILNQ

SEQ ID NO: 945940 - protein, 9 aa, Homo Sapiens
TMIISYFGC

SEQ ID NO: 945941 - protein, 9 aa, Homo Sapiens
GETSGLPEV

SEQ ID NO: 945942 - protein, 9 aa, Homo Sapiens
VAQKPRPFS

SEQ ID NO: 945943 - protein, 9 aa, Homo Sapiens
LKNCTKIFE

SEQ ID NO: 945944 - protein, 9 aa, Homo Sapiens
EENQNRFES

SEQ ID NO: 945945 - protein, 9 aa, Homo Sapiens
LLPENNLSE

SEQ ID NO: 945946 - protein, 9 aa, Homo Sapiens
IIYFFRHRE

SEQ ID NO: 945947 - protein, 9 aa, Homo Sapiens
RRRLIPEAF

SEQ ID NO: 945948 - protein, 9 aa, Homo Sapiens
GLPLHDLAS

SEQ ID NO: 945949 - protein, 9 aa, Homo Sapiens
YYLVGRRLA

SEQ ID NO: 945950 - protein, 9 aa, Homo Sapiens
KDIVARDMS

SEQ ID NO: 945951 - protein, 9 aa, Homo Sapiens
VHPLRPRIK

SEQ ID NO: 945952 - protein, 9 aa, Homo Sapiens
SRLLSERFL

SEQ ID NO: 945953 - protein, 9 aa, Homo Sapiens
GKFLRTSCG

SEQ ID NO: 945954 - protein, 9 aa, Homo Sapiens
GHIGSFVGG

SEQ ID NO: 945955 - protein, 9 aa, Homo Sapiens
SLCARTGSG

SEQ ID NO: 945956 - protein, 9 aa, Homo Sapiens
ATVSFLVKP

SEQ ID NO: 945957 - protein, 9 aa, Homo Sapiens
RCSSCCLLS

SEQ ID NO: 945958 - protein, 9 aa, Homo Sapiens
KRSSTMETL

SEQ ID NO: 945959 - protein, 9 aa, Homo Sapiens
EKRDPNKPS

SEQ ID NO: 945960 - protein, 9 aa, Homo Sapiens
ELSVEELLL

SEQ ID NO: 945961 - protein, 9 aa, Homo Sapiens
FEICPYNPH

SEQ ID NO: 945962 - protein, 9 aa, Homo Sapiens
TQTCTTKFL

SEQ ID NO: 945963 - protein, 9 aa, Homo Sapiens
RPPQGPVFF

SEQ ID NO: 945964 - protein, 9 aa, Homo Sapiens
DKEDAQKIL

SEQ ID NO: 945965 - protein, 9 aa, Homo Sapiens
MTSIKKQRS

SEQ ID NO: 945966 - protein, 9 aa, Homo Sapiens
PVICSYFPQ

SEQ ID NO: 945967 - protein, 9 aa, Homo Sapiens
PSPSASPPA

SEQ ID NO: 945968 - protein, 9 aa, Homo Sapiens
SYIVSAVLK

SEQ ID NO: 945969 - protein, 9 aa, Homo Sapiens
GVRGSCISQ

SEQ ID NO: 945970 - protein, 9 aa, Homo Sapiens
NFVMEFLPS

SEQ ID NO: 945971 - protein, 9 aa, Homo Sapiens
YNVACCVKM

SEQ ID NO: 945972 - protein, 9 aa, Homo Sapiens
TRQRESTTF

SEQ ID NO: 945973 - protein, 9 aa, Homo Sapiens
FVSAKGNGC

SEQ ID NO: 945974 - protein, 9 aa, Homo Sapiens
GLFGPPMPL

SEQ ID NO: 945975 - protein, 9 aa, Homo Sapiens
SGEDDDAAG

SEQ ID NO: 945976 - protein, 9 aa, Homo Sapiens
RETAKTDAS

SEQ ID NO: 945977 - protein, 9 aa, Homo Sapiens
FKHLKSEDK

SEQ ID NO: 945978 - protein, 9 aa, Homo Sapiens
YDFSLSIYG

SEQ ID NO: 945979 - protein, 9 aa, Homo Sapiens
YNPKVWPNP

SEQ ID NO: 945980 - protein, 9 aa, Homo Sapiens
RGTGLFFSA

SEQ ID NO: 945981 - protein, 9 aa, Homo Sapiens
DMVHIRQEI

SEQ ID NO: 945982 - protein, 9 aa, Homo Sapiens
YSGRDIPGP

SEQ ID NO: 945983 - protein, 9 aa, Homo Sapiens
IQPQNESNL

SEQ ID NO: 945984 - protein, 9 aa, Homo Sapiens
MEEDDKDSK

SEQ ID NO: 945985 - protein, 9 aa, Homo Sapiens
HDGGLNYFE

SEQ ID NO: 945986 - protein, 9 aa, Homo Sapiens
YVDVVDGEN

SEQ ID NO: 945987 - protein, 9 aa, Homo Sapiens
EKEVERILR

SEQ ID NO: 945988 - protein, 9 aa, Homo Sapiens
QKASACNLF

SEQ ID NO: 945989 - protein, 9 aa, Homo Sapiens
SPKMDFKIN

SEQ ID NO: 945990 - protein, 9 aa, Homo Sapiens
LCLTQDEFY

SEQ ID NO: 945991 - protein, 9 aa, Homo Sapiens
CLIGEKLFH

SEQ ID NO: 945992 - protein, 9 aa, Homo Sapiens
MQSFNEKFQ

SEQ ID NO: 945993 - protein, 9 aa, Homo Sapiens
VEEHLKGDF

SEQ ID NO: 945994 - protein, 9 aa, Homo Sapiens
LEGSQLNAS

SEQ ID NO: 945995 - protein, 9 aa, Homo Sapiens
LMLQPAQQP

SEQ ID NO: 945996 - protein, 9 aa, Homo Sapiens
CNLFLTNSR

SEQ ID NO: 945997 - protein, 9 aa, Homo Sapiens
PSSLPWMHP

SEQ ID NO: 945998 - protein, 9 aa, Homo Sapiens
AYIDILETV

SEQ ID NO: 945999 - protein, 9 aa, Homo Sapiens
RFRLSRQRH

SEQ ID NO: 946000 - protein, 9 aa, Homo Sapiens
EPGFEPGPP

SEQ ID NO: 946001 - protein, 9 aa, Homo Sapiens
CLSGFSGQF

SEQ ID NO: 946002 - protein, 9 aa, Homo Sapiens
DKMFGVWLG

SEQ ID NO: 946003 - protein, 9 aa, Homo Sapiens
DKLLPLIPV

SEQ ID NO: 946004 - protein, 9 aa, Homo Sapiens
LMVERSGLL

SEQ ID NO: 946005 - protein, 9 aa, Homo Sapiens
YLWWINGQS

SEQ ID NO: 946006 - protein, 9 aa, Homo Sapiens
GIFQSMFST

SEQ ID NO: 946007 - protein, 9 aa, Homo Sapiens
TLCIWELSA

SEQ ID NO: 946008 - protein, 9 aa, Homo Sapiens
TENFCALST

SEQ ID NO: 946009 - protein, 9 aa, Homo Sapiens
KPAWFCQSL

SEQ ID NO: 946010 - protein, 9 aa, Homo Sapiens
CASWLCPLL

SEQ ID NO: 946011 - protein, 9 aa, Homo Sapiens
VLFLTTTFR

SEQ ID NO: 946012 - protein, 9 aa, Homo Sapiens
TSLSREISV

SEQ ID NO: 946013 - protein, 9 aa, Homo Sapiens
ENNFHDKNG

SEQ ID NO: 946014 - protein, 9 aa, Homo Sapiens
NETSHEIKK

SEQ ID NO: 946015 - protein, 9 aa, Homo Sapiens
NAQGLAWGA

SEQ ID NO: 946016 - protein, 9 aa, Homo Sapiens
GQLHGAWPL

SEQ ID NO: 946017 - protein, 9 aa, Homo Sapiens
RKTRVQMSV

SEQ ID NO: 946018 - protein, 9 aa, Homo Sapiens
GLILDTSLI

SEQ ID NO: 946019 - protein, 9 aa, Homo Sapiens
EKMTQIMFK

SEQ ID NO: 946020 - protein, 9 aa, Homo Sapiens
LEQLFLQYG

SEQ ID NO: 946021 - protein, 9 aa, Homo Sapiens
FISVQATKK

SEQ ID NO: 946022 - protein, 9 aa, Homo Sapiens
DWVTDSRFL

SEQ ID NO: 946023 - protein, 9 aa, Homo Sapiens
LPGSLFWFA

SEQ ID NO: 946024 - protein, 9 aa, Homo Sapiens
VHKAVKAIA

SEQ ID NO: 946025 - protein, 9 aa, Homo Sapiens
PDNPSIKDE

SEQ ID NO: 946026 - protein, 9 aa, Homo Sapiens
SPVHCRLEL

SEQ ID NO: 946027 - protein, 9 aa, Homo Sapiens
HNNWRLQAE

SEQ ID NO: 946028 - protein, 9 aa, Homo Sapiens
RNQLNRIAK

SEQ ID NO: 946029 - protein, 9 aa, Homo Sapiens
EEENTHARE

SEQ ID NO: 946030 - protein, 9 aa, Homo Sapiens
REMKEGPEF

SEQ ID NO: 946031 - protein, 9 aa, Homo Sapiens
IDVDGLRVW

SEQ ID NO: 946032 - protein, 9 aa, Homo Sapiens
LRGGRAETQ

SEQ ID NO: 946033 - protein, 9 aa, Homo Sapiens
YKHKEKQKV

SEQ ID NO: 946034 - protein, 9 aa, Homo Sapiens
ETSDRTSPN

SEQ ID NO: 946035 - protein, 9 aa, Homo Sapiens
DGSQTSNSS

SEQ ID NO: 946036 - protein, 9 aa, Homo Sapiens
EADGSETLE

SEQ ID NO: 946037 - protein, 9 aa, Homo Sapiens
PLVRKLVHD

SEQ ID NO: 946038 - protein, 9 aa, Homo Sapiens
DSECKEILE

SEQ ID NO: 946039 - protein, 9 aa, Homo Sapiens
GVRCSSFRG

SEQ ID NO: 946040 - protein, 9 aa, Homo Sapiens
RESQFVEEA

SEQ ID NO: 946041 - protein, 9 aa, Homo Sapiens
QEYKFPEPR

SEQ ID NO: 946042 - protein, 9 aa, Homo Sapiens
PGGREQPAQ

SEQ ID NO: 946043 - protein, 9 aa, Homo Sapiens
AFKAYLSAH

SEQ ID NO: 946044 - protein, 9 aa, Homo Sapiens
QSVGGHGLC

SEQ ID NO: 946045 - protein, 9 aa, Homo Sapiens
VPRQSFLNR

SEQ ID NO: 946046 - protein, 9 aa, Homo Sapiens
GSLEDCLHC

SEQ ID NO: 946047 - protein, 9 aa, Homo Sapiens
YYAQSEDYV

SEQ ID NO: 946048 - protein, 9 aa, Homo Sapiens
VRLVRSMRF

SEQ ID NO: 946049 - protein, 9 aa, Homo Sapiens
LSYALLLLL

SEQ ID NO: 946050 - protein, 9 aa, Homo Sapiens
EKILVEVLP

SEQ ID NO: 946051 - protein, 9 aa, Homo Sapiens
LQIIAEADG

SEQ ID NO: 946052 - protein, 9 aa, Homo Sapiens
RQEIEIMSS

SEQ ID NO: 946053 - protein, 9 aa, Homo Sapiens
AKPSPSASP

SEQ ID NO: 946054 - protein, 9 aa, Homo Sapiens
ILVSLTVFL

SEQ ID NO: 946055 - protein, 9 aa, Homo Sapiens
LPENNLSEI

SEQ ID NO: 946056 - protein, 9 aa, Homo Sapiens
GMKPQVPFS

SEQ ID NO: 946057 - protein, 9 aa, Homo Sapiens
NIERSSGNI

SEQ ID NO: 946058 - protein, 9 aa, Homo Sapiens
PCVDNVHFF

SEQ ID NO: 946059 - protein, 9 aa, Homo Sapiens
RREGLICAR

SEQ ID NO: 946060 - protein, 9 aa, Homo Sapiens
ESEAESFSG

SEQ ID NO: 946061 - protein, 9 aa, Homo Sapiens
LWHSEFSKP

SEQ ID NO: 946062 - protein, 9 aa, Homo Sapiens
ALPKGPLVF

SEQ ID NO: 946063 - protein, 9 aa, Homo Sapiens
LRLAGLNYE

SEQ ID NO: 946064 - protein, 9 aa, Homo Sapiens
EYYFDWNPS

SEQ ID NO: 946065 - protein, 9 aa, Homo Sapiens
VAASSGSPS

SEQ ID NO: 946066 - protein, 9 aa, Homo Sapiens
VYEIDSASP

SEQ ID NO: 946067 - protein, 9 aa, Homo Sapiens
LQRRPCNVT

SEQ ID NO: 946068 - protein, 9 aa, Homo Sapiens
AEEQKRLNL

SEQ ID NO: 946069 - protein, 9 aa, Homo Sapiens
LLSRKPSFP

SEQ ID NO: 946070 - protein, 9 aa, Homo Sapiens
CETDFYNVT

SEQ ID NO: 946071 - protein, 9 aa, Homo Sapiens
YLCAAVYPI

SEQ ID NO: 946072 - protein, 9 aa, Homo Sapiens
NDLTLLDLL

SEQ ID NO: 946073 - protein, 9 aa, Homo Sapiens
NYTFDRNVL

SEQ ID NO: 946074 - protein, 9 aa, Homo Sapiens
HYNKELNIK

SEQ ID NO: 946075 - protein, 9 aa, Homo Sapiens
PRVPGGREQ

SEQ ID NO: 946076 - protein, 9 aa, Homo Sapiens
QVDSDGLII

SEQ ID NO: 946077 - protein, 9 aa, Homo Sapiens
TPGYEMNLN

SEQ ID NO: 946078 - protein, 9 aa, Homo Sapiens
GSPGDTGKD

SEQ ID NO: 946079 - protein, 9 aa, Homo Sapiens
SLVKGHPQE

SEQ ID NO: 946080 - protein, 9 aa, Homo Sapiens
VAPLLGASL

SEQ ID NO: 946081 - protein, 9 aa, Homo Sapiens
ADSVWIEMD

SEQ ID NO: 946082 - protein, 9 aa, Homo Sapiens
TDKKETSKI

SEQ ID NO: 946083 - protein, 9 aa, Homo Sapiens
GLSSRGSTC

SEQ ID NO: 946084 - protein, 9 aa, Homo Sapiens
SKNCSKKYV

SEQ ID NO: 946085 - protein, 9 aa, Homo Sapiens
RDLETVIKG

SEQ ID NO: 946086 - protein, 9 aa, Homo Sapiens
FFTEIPADY

SEQ ID NO: 946087 - protein, 9 aa, Homo Sapiens
TKLSAFVRV

SEQ ID NO: 946088 - protein, 9 aa, Homo Sapiens
QFTQKFYLK

SEQ ID NO: 946089 - protein, 9 aa, Homo Sapiens
GQRLRKDVS

SEQ ID NO: 946090 - protein, 9 aa, Homo Sapiens
VSGIPSGME

SEQ ID NO: 946091 - protein, 9 aa, Homo Sapiens
IDILETVLQ

SEQ ID NO: 946092 - protein, 9 aa, Homo Sapiens
SKNVRFPGF

SEQ ID NO: 946093 - protein, 9 aa, Homo Sapiens
LNHLDTVEG

SEQ ID NO: 946094 - protein, 9 aa, Homo Sapiens
TNAYSSVQQ

SEQ ID NO: 946095 - protein, 9 aa, Homo Sapiens
GQPLPTIRW

SEQ ID NO: 946096 - protein, 9 aa, Homo Sapiens
AGAVVIILL

SEQ ID NO: 946097 - protein, 9 aa, Homo Sapiens
KEPLHPVNN

SEQ ID NO: 946098 - protein, 9 aa, Homo Sapiens
LLGMPELRL

SEQ ID NO: 946099 - protein, 9 aa, Homo Sapiens
PFFSNIANI

SEQ ID NO: 946100 - protein, 9 aa, Homo Sapiens
GAPLSCNHI

SEQ ID NO: 946101 - protein, 9 aa, Homo Sapiens
LLTGLVMGT

SEQ ID NO: 946102 - protein, 9 aa, Homo Sapiens
KLAGMWNNI

SEQ ID NO: 946103 - protein, 9 aa, Homo Sapiens
RSEVTFFTP

SEQ ID NO: 946104 - protein, 9 aa, Homo Sapiens
SELSLDVKR

SEQ ID NO: 946105 - protein, 9 aa, Homo Sapiens
TVSTLRNLG

SEQ ID NO: 946106 - protein, 9 aa, Homo Sapiens
LIPQVLDLH

SEQ ID NO: 946107 - protein, 9 aa, Homo Sapiens
AVVPALGAA

SEQ ID NO: 946108 - protein, 9 aa, Homo Sapiens
LNDMGCINP

SEQ ID NO: 946109 - protein, 9 aa, Homo Sapiens
VRCSSFRGG

SEQ ID NO: 946110 - protein, 9 aa, Homo Sapiens
SMKTTSSID

SEQ ID NO: 946111 - protein, 9 aa, Homo Sapiens
ESKGPQGPP

SEQ ID NO: 946112 - protein, 9 aa, Homo Sapiens
HEQSVHLFI

SEQ ID NO: 946113 - protein, 9 aa, Homo Sapiens
QPPPPDNPS

SEQ ID NO: 946114 - protein, 9 aa, Homo Sapiens
RQVADWKAG

SEQ ID NO: 946115 - protein, 9 aa, Homo Sapiens
RHFELLLRD

SEQ ID NO: 946116 - protein, 9 aa, Homo Sapiens
LGLLKAYSI

SEQ ID NO: 946117 - protein, 9 aa, Homo Sapiens
CTALIVSHI

SEQ ID NO: 946118 - protein, 9 aa, Homo Sapiens
YSANLFQQQ

SEQ ID NO: 946119 - protein, 9 aa, Homo Sapiens
ARDSRRLEP

SEQ ID NO: 946120 - protein, 9 aa, Homo Sapiens
PLESSPPVE

SEQ ID NO: 946121 - protein, 9 aa, Homo Sapiens
YSYENQPQS

SEQ ID NO: 946122 - protein, 9 aa, Homo Sapiens
RVLTLSEIP

SEQ ID NO: 946123 - protein, 9 aa, Homo Sapiens
MKENFVMEF

SEQ ID NO: 946124 - protein, 9 aa, Homo Sapiens
MEFLPSVPS

SEQ ID NO: 946125 - protein, 9 aa, Homo Sapiens
SRFLIGFGL

SEQ ID NO: 946126 - protein, 9 aa, Homo Sapiens
EDYRWAVFS

SEQ ID NO: 946127 - protein, 9 aa, Homo Sapiens
HLAGSRFLI

SEQ ID NO: 946128 - protein, 9 aa, Homo Sapiens
LYRFFYEDV

SEQ ID NO: 946129 - protein, 9 aa, Homo Sapiens
LLISYSYIV

SEQ ID NO: 946130 - protein, 9 aa, Homo Sapiens
LKGENSLPG

SEQ ID NO: 946131 - protein, 9 aa, Homo Sapiens
ISHEYTRQP

SEQ ID NO: 946132 - protein, 9 aa, Homo Sapiens
SRPWNKVED

SEQ ID NO: 946133 - protein, 9 aa, Homo Sapiens
FLRRPDSGD

SEQ ID NO: 946134 - protein, 9 aa, Homo Sapiens
EYTRQPAFP

SEQ ID NO: 946135 - protein, 9 aa, Homo Sapiens
GHAGTCLRI

SEQ ID NO: 946136 - protein, 9 aa, Homo Sapiens
DNENKSDNE

SEQ ID NO: 946137 - protein, 9 aa, Homo Sapiens
LYGSSLGRL

SEQ ID NO: 946138 - protein, 9 aa, Homo Sapiens
ANDMEEDDK

SEQ ID NO: 946139 - protein, 9 aa, Homo Sapiens
GLGGAPSPC

SEQ ID NO: 946140 - protein, 9 aa, Homo Sapiens
PQYLPLWMM

SEQ ID NO: 946141 - protein, 9 aa, Homo Sapiens
KVVAKEFCS

SEQ ID NO: 946142 - protein, 9 aa, Homo Sapiens
RCDRKIEVA

SEQ ID NO: 946143 - protein, 9 aa, Homo Sapiens
IIQKGSESG

SEQ ID NO: 946144 - protein, 9 aa, Homo Sapiens
STEDSFTGF

SEQ ID NO: 946145 - protein, 9 aa, Homo Sapiens
QMPTLEHTT

SEQ ID NO: 946146 - protein, 9 aa, Homo Sapiens
TLSYYKKIH

SEQ ID NO: 946147 - protein, 9 aa, Homo Sapiens
YVVKPRQPN

SEQ ID NO: 946148 - protein, 9 aa, Homo Sapiens
HLKSEDKMK

SEQ ID NO: 946149 - protein, 9 aa, Homo Sapiens
KNRTRKDGV

SEQ ID NO: 946150 - protein, 9 aa, Homo Sapiens
RLLGWKWGK

SEQ ID NO: 946151 - protein, 9 aa, Homo Sapiens
SLRRRQAFR

SEQ ID NO: 946152 - protein, 9 aa, Homo Sapiens
LGMWYKAAE

SEQ ID NO: 946153 - protein, 9 aa, Homo Sapiens
HKYPSVYPE

SEQ ID NO: 946154 - protein, 9 aa, Homo Sapiens
KESFLSNKW

SEQ ID NO: 946155 - protein, 9 aa, Homo Sapiens
LLKTWEKVL

SEQ ID NO: 946156 - protein, 9 aa, Homo Sapiens
ELKKLRTAG

SEQ ID NO: 946157 - protein, 9 aa, Homo Sapiens
SLGEAPRGG

SEQ ID NO: 946158 - protein, 9 aa, Homo Sapiens
ARMETAKKE

SEQ ID NO: 946159 - protein, 9 aa, Homo Sapiens
DKLYNEITR

SEQ ID NO: 946160 - protein, 9 aa, Homo Sapiens
NPVTAVLVV

SEQ ID NO: 946161 - protein, 9 aa, Homo Sapiens
NLLTLDKAD

SEQ ID NO: 946162 - protein, 9 aa, Homo Sapiens
YTNREGAAF

SEQ ID NO: 946163 - protein, 9 aa, Homo Sapiens
SYPEQEKTT

SEQ ID NO: 946164 - protein, 9 aa, Homo Sapiens
GADGVLHID

SEQ ID NO: 946165 - protein, 9 aa, Homo Sapiens
ISKKPIPRI

SEQ ID NO: 946166 - protein, 9 aa, Homo Sapiens
SWLNPWERN

SEQ ID NO: 946167 - protein, 9 aa, Homo Sapiens
RERASLIFS

SEQ ID NO: 946168 - protein, 9 aa, Homo Sapiens
LPTAMPTLP

SEQ ID NO: 946169 - protein, 9 aa, Homo Sapiens
TAPEIYHRK

SEQ ID NO: 946170 - protein, 9 aa, Homo Sapiens
NEISWVIEP

SEQ ID NO: 946171 - protein, 9 aa, Homo Sapiens
PRARNQLNR

SEQ ID NO: 946172 - protein, 9 aa, Homo Sapiens
FGQEVALNA

SEQ ID NO: 946173 - protein, 9 aa, Homo Sapiens
TVENEEPSL

SEQ ID NO: 946174 - protein, 9 aa, Homo Sapiens
GEKGGVESK

SEQ ID NO: 946175 - protein, 9 aa, Homo Sapiens
IKDEKVISS

SEQ ID NO: 946176 - protein, 9 aa, Homo Sapiens
STTLSYALL

SEQ ID NO: 946177 - protein, 9 aa, Homo Sapiens
NRFYYEELN

SEQ ID NO: 946178 - protein, 9 aa, Homo Sapiens
SDVSVKMLA

SEQ ID NO: 946179 - protein, 9 aa, Homo Sapiens
NDVVFFMDQ

SEQ ID NO: 946180 - protein, 9 aa, Homo Sapiens
TDVCLIGEK

SEQ ID NO: 946181 - protein, 9 aa, Homo Sapiens
GGSFASVLS

SEQ ID NO: 946182 - protein, 9 aa, Homo Sapiens
SPPPIALAV

SEQ ID NO: 946183 - protein, 9 aa, Homo Sapiens
TVLMHPCFC

SEQ ID NO: 946184 - protein, 9 aa, Homo Sapiens
GSSVEGTDL

SEQ ID NO: 946185 - protein, 9 aa, Homo Sapiens
IEACIALVS

SEQ ID NO: 946186 - protein, 9 aa, Homo Sapiens
PHPLGKKEE

SEQ ID NO: 946187 - protein, 9 aa, Homo Sapiens
LRPLCALSQ

SEQ ID NO: 946188 - protein, 9 aa, Homo Sapiens
DSVQVMLDK

SEQ ID NO: 946189 - protein, 9 aa, Homo Sapiens
RKTEVLLKI

SEQ ID NO: 946190 - protein, 9 aa, Homo Sapiens
KAGRAGGPS

SEQ ID NO: 946191 - protein, 9 aa, Homo Sapiens
YGVLGGAFL

SEQ ID NO: 946192 - protein, 9 aa, Homo Sapiens
SIYGLHYNP

SEQ ID NO: 946193 - protein, 9 aa, Homo Sapiens
KNSPGVYTK

SEQ ID NO: 946194 - protein, 9 aa, Homo Sapiens
GVYSANLFQ

SEQ ID NO: 946195 - protein, 9 aa, Homo Sapiens
LRGRYPGKF

SEQ ID NO: 946196 - protein, 9 aa, Homo Sapiens
KMKASEDLK

SEQ ID NO: 946197 - protein, 9 aa, Homo Sapiens
RDALDLYQH

SEQ ID NO: 946198 - protein, 9 aa, Homo Sapiens
AMVNSNNNR

SEQ ID NO: 946199 - protein, 9 aa, Homo Sapiens
VFKVDACEE

SEQ ID NO: 946200 - protein, 9 aa, Homo Sapiens
RSLFLSGVG

SEQ ID NO: 946201 - protein, 9 aa, Homo Sapiens
EFYPFIEAL

SEQ ID NO: 946202 - protein, 9 aa, Homo Sapiens
RLLLSASIL

SEQ ID NO: 946203 - protein, 9 aa, Homo Sapiens
TKKMYKIKA

SEQ ID NO: 946204 - protein, 9 aa, Homo Sapiens
PAQNVEAGA

SEQ ID NO: 946205 - protein, 9 aa, Homo Sapiens
GPVRSPPGF

SEQ ID NO: 946206 - protein, 9 aa, Homo Sapiens
NASDWLNPA

SEQ ID NO: 946207 - protein, 9 aa, Homo Sapiens
SWLCPLLLA

SEQ ID NO: 946208 - protein, 9 aa, Homo Sapiens
GLKGFLQRL

SEQ ID NO: 946209 - protein, 9 aa, Homo Sapiens
VIMHETLQY

SEQ ID NO: 946210 - protein, 9 aa, Homo Sapiens
SQQYWALTV

SEQ ID NO: 946211 - protein, 9 aa, Homo Sapiens
ELALKLASL

SEQ ID NO: 946212 - protein, 9 aa, Homo Sapiens
FDKTHYPDA

SEQ ID NO: 946213 - protein, 9 aa, Homo Sapiens
PGKMGTGGS

SEQ ID NO: 946214 - protein, 9 aa, Homo Sapiens
KRKSCRNSP

SEQ ID NO: 946215 - protein, 9 aa, Homo Sapiens
ADLYELNLT

SEQ ID NO: 946216 - protein, 9 aa, Homo Sapiens
NGSHYKYKT

SEQ ID NO: 946217 - protein, 9 aa, Homo Sapiens
NYVFNTASL

SEQ ID NO: 946218 - protein, 9 aa, Homo Sapiens
ALGNDTILW

SEQ ID NO: 946219 - protein, 9 aa, Homo Sapiens
SPPADTLFS

SEQ ID NO: 946220 - protein, 9 aa, Homo Sapiens
LKENTMQES

SEQ ID NO: 946221 - protein, 9 aa, Homo Sapiens
RKKGPFRQY

SEQ ID NO: 946222 - protein, 9 aa, Homo Sapiens
FEKELAAEK

SEQ ID NO: 946223 - protein, 9 aa, Homo Sapiens
QHQRLYTGE

SEQ ID NO: 946224 - protein, 9 aa, Homo Sapiens
SFSKVPTPL

SEQ ID NO: 946225 - protein, 9 aa, Homo Sapiens
DKHLNAIPI

SEQ ID NO: 946226 - protein, 9 aa, Homo Sapiens
SVTKDTLQG

SEQ ID NO: 946227 - protein, 9 aa, Homo Sapiens
YAGKKFYKC

SEQ ID NO: 946228 - protein, 9 aa, Homo Sapiens
HKEKQKVDL

SEQ ID NO: 946229 - protein, 9 aa, Homo Sapiens
KPFSPPNIP

SEQ ID NO: 946230 - protein, 9 aa, Homo Sapiens
NLSPGGATT

SEQ ID NO: 946231 - protein, 9 aa, Homo Sapiens
LRAVILRNQ

SEQ ID NO: 946232 - protein, 9 aa, Homo Sapiens
KDQPRRLKK

SEQ ID NO: 946233 - protein, 9 aa, Homo Sapiens
KGEVLKVRN

SEQ ID NO: 946234 - protein, 9 aa, Homo Sapiens
FRLSRQRHK

SEQ ID NO: 946235 - protein, 9 aa, Homo Sapiens
VGIRTFKIS

SEQ ID NO: 946236 - protein, 9 aa, Homo Sapiens
PSVLEDLES

SEQ ID NO: 946237 - protein, 9 aa, Homo Sapiens
NLRKRIIFC

SEQ ID NO: 946238 - protein, 9 aa, Homo Sapiens
IEKYFVFPT

SEQ ID NO: 946239 - protein, 9 aa, Homo Sapiens
CDKKGCRED

SEQ ID NO: 946240 - protein, 9 aa, Homo Sapiens
KQQLAEEAE

SEQ ID NO: 946241 - protein, 9 aa, Homo Sapiens
AEAKKFVKQ

SEQ ID NO: 946242 - protein, 9 aa, Homo Sapiens
GNLFSISAY

SEQ ID NO: 946243 - protein, 9 aa, Homo Sapiens
VLVVLKRLK

SEQ ID NO: 946244 - protein, 9 aa, Homo Sapiens
WPHPLGKKE

SEQ ID NO: 946245 - protein, 9 aa, Homo Sapiens
LCETLVHLN

SEQ ID NO: 946246 - protein, 9 aa, Homo Sapiens
PPGGLDSRQ

SEQ ID NO: 946247 - protein, 9 aa, Homo Sapiens
VIFEGKIGK

SEQ ID NO: 946248 - protein, 9 aa, Homo Sapiens
THLAKTLQK

SEQ ID NO: 946249 - protein, 9 aa, Homo Sapiens
RTSPNFLFM

SEQ ID NO: 946250 - protein, 9 aa, Homo Sapiens
CCGGVRNPG

SEQ ID NO: 946251 - protein, 9 aa, Homo Sapiens
GSYSCSCLP

SEQ ID NO: 946252 - protein, 9 aa, Homo Sapiens
TYGNQILFL

SEQ ID NO: 946253 - protein, 9 aa, Homo Sapiens
LLRSGKSIC

SEQ ID NO: 946254 - protein, 9 aa, Homo Sapiens
GPQQFRPLA

SEQ ID NO: 946255 - protein, 9 aa, Homo Sapiens
PLPRFLNDI

SEQ ID NO: 946256 - protein, 9 aa, Homo Sapiens
MDDLQDFLL

SEQ ID NO: 946257 - protein, 9 aa, Homo Sapiens
MYSSTLTMT

SEQ ID NO: 946258 - protein, 9 aa, Homo Sapiens
PHTLHPLDS

SEQ ID NO: 946259 - protein, 9 aa, Homo Sapiens
VLDQWSQKK

SEQ ID NO: 946260 - protein, 9 aa, Homo Sapiens
SQNWDKKLS

SEQ ID NO: 946261 - protein, 9 aa, Homo Sapiens
QYQRSTDRE

SEQ ID NO: 946262 - protein, 9 aa, Homo Sapiens
KAFRVKFNT

SEQ ID NO: 946263 - protein, 9 aa, Homo Sapiens
DVVKSTKTF

SEQ ID NO: 946264 - protein, 9 aa, Homo Sapiens
YFFHSLKNS

SEQ ID NO: 946265 - protein, 9 aa, Homo Sapiens
MELPNQYNY

SEQ ID NO: 946266 - protein, 9 aa, Homo Sapiens
QGPVFFPGG

SEQ ID NO: 946267 - protein, 9 aa, Homo Sapiens
TRNKKQSGD

SEQ ID NO: 946268 - protein, 9 aa, Homo Sapiens
TRNKTGPYQ

SEQ ID NO: 946269 - protein, 9 aa, Homo Sapiens
GSMEHPAQN

SEQ ID NO: 946270 - protein, 9 aa, Homo Sapiens
SVSYQVSLN

SEQ ID NO: 946271 - protein, 9 aa, Homo Sapiens
PPVKDSEYV

SEQ ID NO: 946272 - protein, 9 aa, Homo Sapiens
DKIRISKIG

SEQ ID NO: 946273 - protein, 9 aa, Homo Sapiens
NNWRLQAES

SEQ ID NO: 946274 - protein, 9 aa, Homo Sapiens
NPIPSDLKE

SEQ ID NO: 946275 - protein, 9 aa, Homo Sapiens
EQDTSCLTC

SEQ ID NO: 946276 - protein, 9 aa, Homo Sapiens
WYKAAELIW

SEQ ID NO: 946277 - protein, 9 aa, Homo Sapiens
SSLHAEPLE

SEQ ID NO: 946278 - protein, 9 aa, Homo Sapiens
VEKQLALSN

SEQ ID NO: 946279 - protein, 9 aa, Homo Sapiens
YIKNRVSII

SEQ ID NO: 946280 - protein, 9 aa, Homo Sapiens
SWQQKTNPV

SEQ ID NO: 946281 - protein, 9 aa, Homo Sapiens
GLKGSKIKI

SEQ ID NO: 946282 - protein, 9 aa, Homo Sapiens
AVIKLACAD

SEQ ID NO: 946283 - protein, 9 aa, Homo Sapiens
PSKPKSQHW

SEQ ID NO: 946284 - protein, 9 aa, Homo Sapiens
SDSDSSEKE

SEQ ID NO: 946285 - protein, 9 aa, Homo Sapiens
AEGYPDVEQ

SEQ ID NO: 946286 - protein, 9 aa, Homo Sapiens
GILFVQTLM

SEQ ID NO: 946287 - protein, 9 aa, Homo Sapiens
RYQELQRLV

SEQ ID NO: 946288 - protein, 9 aa, Homo Sapiens
CDPPCVSYL

SEQ ID NO: 946289 - protein, 9 aa, Homo Sapiens
GKLYAATAM

SEQ ID NO: 946290 - protein, 9 aa, Homo Sapiens
ELRRKFKKN

SEQ ID NO: 946291 - protein, 9 aa, Homo Sapiens
SCDREIFCR

SEQ ID NO: 946292 - protein, 9 aa, Homo Sapiens
LVFFLETAL

SEQ ID NO: 946293 - protein, 9 aa, Homo Sapiens
LKNMCSGGY

SEQ ID NO: 946294 - protein, 9 aa, Homo Sapiens
FQPKDQIAY

SEQ ID NO: 946295 - protein, 9 aa, Homo Sapiens
QQKQNTLLE

SEQ ID NO: 946296 - protein, 9 aa, Homo Sapiens
PSSFSKVPT

SEQ ID NO: 946297 - protein, 9 aa, Homo Sapiens
TRRELEPKS

SEQ ID NO: 946298 - protein, 9 aa, Homo Sapiens
IKYKAPTDY

SEQ ID NO: 946299 - protein, 9 aa, Homo Sapiens
DDDNFETNW

SEQ ID NO: 946300 - protein, 9 aa, Homo Sapiens
QGPTTKNLN

SEQ ID NO: 946301 - protein, 9 aa, Homo Sapiens
SRGSNTKGK

SEQ ID NO: 946302 - protein, 9 aa, Homo Sapiens
VQWFQDLKK

SEQ ID NO: 946303 - protein, 9 aa, Homo Sapiens
DKGTYECVV

SEQ ID NO: 946304 - protein, 9 aa, Homo Sapiens
ETSGLPEVT

SEQ ID NO: 946305 - protein, 9 aa, Homo Sapiens
VKSNRSSNI

SEQ ID NO: 946306 - protein, 9 aa, Homo Sapiens
RKDLFFSRS

SEQ ID NO: 946307 - protein, 9 aa, Homo Sapiens
DGSETLEPF

SEQ ID NO: 946308 - protein, 9 aa, Homo Sapiens
QNSYTWELF

SEQ ID NO: 946309 - protein, 9 aa, Homo Sapiens
KAVVSHSKR

SEQ ID NO: 946310 - protein, 9 aa, Homo Sapiens
HRRIHTGKK

SEQ ID NO: 946311 - protein, 9 aa, Homo Sapiens
STLTMTCIS

SEQ ID NO: 946312 - protein, 9 aa, Homo Sapiens
QHGIYDGLT

SEQ ID NO: 946313 - protein, 9 aa, Homo Sapiens
FLSKSKEPT

SEQ ID NO: 946314 - protein, 9 aa, Homo Sapiens
RLFIEPWEL

SEQ ID NO: 946315 - protein, 9 aa, Homo Sapiens
WDNISCWPF

SEQ ID NO: 946316 - protein, 9 aa, Homo Sapiens
IHNIFCMTE

SEQ ID NO: 946317 - protein, 9 aa, Homo Sapiens
CFQLTTFNF

SEQ ID NO: 946318 - protein, 9 aa, Homo Sapiens
FTSSKAPPS

SEQ ID NO: 946319 - protein, 9 aa, Homo Sapiens
GEPTKKLPQ

SEQ ID NO: 946320 - protein, 9 aa, Homo Sapiens
MKSSDSKPP

SEQ ID NO: 946321 - protein, 9 aa, Homo Sapiens
SPCEAGKEG

SEQ ID NO: 946322 - protein, 9 aa, Homo Sapiens
EVLAKIFSE

SEQ ID NO: 946323 - protein, 9 aa, Homo Sapiens
KFRVNILDE

SEQ ID NO: 946324 - protein, 9 aa, Homo Sapiens
FILYLHPVD

SEQ ID NO: 946325 - protein, 9 aa, Homo Sapiens
EVDYELLMK

SEQ ID NO: 946326 - protein, 9 aa, Homo Sapiens
FRVKFNTAI

SEQ ID NO: 946327 - protein, 9 aa, Homo Sapiens
KILIDFIYK

SEQ ID NO: 946328 - protein, 9 aa, Homo Sapiens
FIALKQVFN

SEQ ID NO: 946329 - protein, 9 aa, Homo Sapiens
CRELGRPNC

SEQ ID NO: 946330 - protein, 9 aa, Homo Sapiens
ITWCLIMAH

SEQ ID NO: 946331 - protein, 9 aa, Homo Sapiens
EPINEETLS

SEQ ID NO: 946332 - protein, 9 aa, Homo Sapiens
TSKKKSDTA

SEQ ID NO: 946333 - protein, 9 aa, Homo Sapiens
KRMGVCLFN

SEQ ID NO: 946334 - protein, 9 aa, Homo Sapiens
VISKKPIPR

SEQ ID NO: 946335 - protein, 9 aa, Homo Sapiens
LKETERADS

SEQ ID NO: 946336 - protein, 9 aa, Homo Sapiens
EETEFMELD

SEQ ID NO: 946337 - protein, 9 aa, Homo Sapiens
FRGKSSPVL

SEQ ID NO: 946338 - protein, 9 aa, Homo Sapiens
PLYPRRGRG

SEQ ID NO: 946339 - protein, 9 aa, Homo Sapiens
KSNCRFRDI

SEQ ID NO: 946340 - protein, 9 aa, Homo Sapiens
PINPTSLPP

SEQ ID NO: 946341 - protein, 9 aa, Homo Sapiens
SPAGKMIQV

SEQ ID NO: 946342 - protein, 9 aa, Homo Sapiens
KSWFVQFSW

SEQ ID NO: 946343 - protein, 9 aa, Homo Sapiens
TQDEFYPFI

SEQ ID NO: 946344 - protein, 9 aa, Homo Sapiens
PEQEKTTKE

SEQ ID NO: 946345 - protein, 9 aa, Homo Sapiens
YNKFVPCKN

SEQ ID NO: 946346 - protein, 9 aa, Homo Sapiens
SCRELGRPN

SEQ ID NO: 946347 - protein, 9 aa, Homo Sapiens
EKEKTDLEN

SEQ ID NO: 946348 - protein, 9 aa, Homo Sapiens
HKQLLRFRR

SEQ ID NO: 946349 - protein, 9 aa, Homo Sapiens
NTLTIHGLP

SEQ ID NO: 946350 - protein, 9 aa, Homo Sapiens
FTCRAEENP

SEQ ID NO: 946351 - protein, 9 aa, Homo Sapiens
FLSADWGLV

SEQ ID NO: 946352 - protein, 9 aa, Homo Sapiens
LSEFKAMDF

SEQ ID NO: 946353 - protein, 9 aa, Homo Sapiens
VECYDSRTQ

SEQ ID NO: 946354 - protein, 9 aa, Homo Sapiens
RAVQKETRD

SEQ ID NO: 946355 - protein, 9 aa, Homo Sapiens
RVARAMFIP

SEQ ID NO: 946356 - protein, 9 aa, Homo Sapiens
KYEIDAIQR

SEQ ID NO: 946357 - protein, 9 aa, Homo Sapiens
VKGALKRVF

SEQ ID NO: 946358 - protein, 9 aa, Homo Sapiens
KKQRSPDDE

SEQ ID NO: 946359 - protein, 9 aa, Homo Sapiens
ELSTASDPQ

SEQ ID NO: 946360 - protein, 9 aa, Homo Sapiens
LLGAGSLEA

SEQ ID NO: 946361 - protein, 9 aa, Homo Sapiens
SELIKELNS

SEQ ID NO: 946362 - protein, 9 aa, Homo Sapiens
EVRKGNLEQ

SEQ ID NO: 946363 - protein, 9 aa, Homo Sapiens
LEKYGKGEP

SEQ ID NO: 946364 - protein, 9 aa, Homo Sapiens
PMKICKKRS

SEQ ID NO: 946365 - protein, 9 aa, Homo Sapiens
VTPPNVSLD

SEQ ID NO: 946366 - protein, 9 aa, Homo Sapiens
FSWLLFALI

SEQ ID NO: 946367 - protein, 9 aa, Homo Sapiens
RPTRKSDDE

SEQ ID NO: 946368 - protein, 9 aa, Homo Sapiens
QNLCGQSSQ

SEQ ID NO: 946369 - protein, 9 aa, Homo Sapiens
PSLSQPGLQ

SEQ ID NO: 946370 - protein, 9 aa, Homo Sapiens
PDDVWILVE

SEQ ID NO: 946371 - protein, 9 aa, Homo Sapiens
EEAAGGERD

SEQ ID NO: 946372 - protein, 9 aa, Homo Sapiens
TPECKFKKS

SEQ ID NO: 946373 - protein, 9 aa, Homo Sapiens
GGFGLNLAL

SEQ ID NO: 946374 - protein, 9 aa, Homo Sapiens
RTCIIKVFS

SEQ ID NO: 946375 - protein, 9 aa, Homo Sapiens
KTLLLYKKE

SEQ ID NO: 946376 - protein, 9 aa, Homo Sapiens
SFPGINGFP

SEQ ID NO: 946377 - protein, 9 aa, Homo Sapiens
ISPEPKSRF

SEQ ID NO: 946378 - protein, 9 aa, Homo Sapiens
LAVVEKNYT

SEQ ID NO: 946379 - protein, 9 aa, Homo Sapiens
TFTREGSFG

SEQ ID NO: 946380 - protein, 9 aa, Homo Sapiens
LQIGFFCII

SEQ ID NO: 946381 - protein, 9 aa, Homo Sapiens
SYLMVLQYR

SEQ ID NO: 946382 - protein, 9 aa, Homo Sapiens
TCTTKFLAM

SEQ ID NO: 946383 - protein, 9 aa, Homo Sapiens
EKENIKAGP

SEQ ID NO: 946384 - protein, 9 aa, Homo Sapiens
IVLSSEANK

SEQ ID NO: 946385 - protein, 9 aa, Homo Sapiens
LQKIFQTEM

SEQ ID NO: 946386 - protein, 9 aa, Homo Sapiens
KCEELLEQA

SEQ ID NO: 946387 - protein, 9 aa, Homo Sapiens
AKICHGLGL

SEQ ID NO: 946388 - protein, 9 aa, Homo Sapiens
NIPIPPIKL

SEQ ID NO: 946389 - protein, 9 aa, Homo Sapiens
PKCPPKCPS

SEQ ID NO: 946390 - protein, 9 aa, Homo Sapiens
WELLARVCH

SEQ ID NO: 946391 - protein, 9 aa, Homo Sapiens
AVPKYYQSS

SEQ ID NO: 946392 - protein, 9 aa, Homo Sapiens
TPSLASAPL

SEQ ID NO: 946393 - protein, 9 aa, Homo Sapiens
KVFSLLVFG

SEQ ID NO: 946394 - protein, 9 aa, Homo Sapiens
ANFQRESVT

SEQ ID NO: 946395 - protein, 9 aa, Homo Sapiens
QSMNMLNFN

SEQ ID NO: 946396 - protein, 9 aa, Homo Sapiens
KHGFTGDRC

SEQ ID NO: 946397 - protein, 9 aa, Homo Sapiens
HKVDLCLQT

SEQ ID NO: 946398 - protein, 9 aa, Homo Sapiens
YAEEFALRD

SEQ ID NO: 946399 - protein, 9 aa, Homo Sapiens
GHGLCSESK

SEQ ID NO: 946400 - protein, 9 aa, Homo Sapiens
WSQENSGQH

SEQ ID NO: 946401 - protein, 9 aa, Homo Sapiens
SPRPGPSPG

SEQ ID NO: 946402 - protein, 9 aa, Homo Sapiens
EQFSMESPL

SEQ ID NO: 946403 - protein, 9 aa, Homo Sapiens
AGDYFLLCS

SEQ ID NO: 946404 - protein, 9 aa, Homo Sapiens
GFTDKKETS

SEQ ID NO: 946405 - protein, 9 aa, Homo Sapiens
YAEKDTPAE

SEQ ID NO: 946406 - protein, 9 aa, Homo Sapiens
GGVVQAAGS

SEQ ID NO: 946407 - protein, 9 aa, Homo Sapiens
PRFLNDIST

SEQ ID NO: 946408 - protein, 9 aa, Homo Sapiens
PVYPSSLML

SEQ ID NO: 946409 - protein, 9 aa, Homo Sapiens
EFFQPLDGF

SEQ ID NO: 946410 - protein, 9 aa, Homo Sapiens
LRVSSHLQA

SEQ ID NO: 946411 - protein, 9 aa, Homo Sapiens
GTIDDREPF

SEQ ID NO: 946412 - protein, 9 aa, Homo Sapiens
RNPICMATL

SEQ ID NO: 946413 - protein, 9 aa, Homo Sapiens
PKPPGNLFS

SEQ ID NO: 946414 - protein, 9 aa, Homo Sapiens
SGFYQKIDE

SEQ ID NO: 946415 - protein, 9 aa, Homo Sapiens
AMSGHRPSI

SEQ ID NO: 946416 - protein, 9 aa, Homo Sapiens
RPSDKGTYE

SEQ ID NO: 946417 - protein, 9 aa, Homo Sapiens
TTWRTKYEI

SEQ ID NO: 946418 - protein, 9 aa, Homo Sapiens
SSLGSSDIL

SEQ ID NO: 946419 - protein, 9 aa, Homo Sapiens
FGIFFILFE

SEQ ID NO: 946420 - protein, 9 aa, Homo Sapiens
IPLDFLDLE

SEQ ID NO: 946421 - protein, 9 aa, Homo Sapiens
EENAAAEGT

SEQ ID NO: 946422 - protein, 9 aa, Homo Sapiens
SLPARKPPH

SEQ ID NO: 946423 - protein, 9 aa, Homo Sapiens
HRKTSGLVF

SEQ ID NO: 946424 - protein, 9 aa, Homo Sapiens
IVSGWGQEK

SEQ ID NO: 946425 - protein, 9 aa, Homo Sapiens
NSVSYQVSL

SEQ ID NO: 946426 - protein, 9 aa, Homo Sapiens
YWDLEQKMF

SEQ ID NO: 946427 - protein, 9 aa, Homo Sapiens
FNSFDLTKV

SEQ ID NO: 946428 - protein, 9 aa, Homo Sapiens
CCHTPVTNK

SEQ ID NO: 946429 - protein, 9 aa, Homo Sapiens
CRKSGKNGP

SEQ ID NO: 946430 - protein, 9 aa, Homo Sapiens
QLSFLAMRS

SEQ ID NO: 946431 - protein, 9 aa, Homo Sapiens
GTSGETSGL

SEQ ID NO: 946432 - protein, 9 aa, Homo Sapiens
GWFHGKEFL

SEQ ID NO: 946433 - protein, 9 aa, Homo Sapiens
TNQCTINKN

SEQ ID NO: 946434 - protein, 9 aa, Homo Sapiens
NENGRPIPP

SEQ ID NO: 946435 - protein, 9 aa, Homo Sapiens
LENLPEITV

SEQ ID NO: 946436 - protein, 9 aa, Homo Sapiens
KMFRFTRVD

SEQ ID NO: 946437 - protein, 9 aa, Homo Sapiens
KKEEKFSDS

SEQ ID NO: 946438 - protein, 9 aa, Homo Sapiens
HKKSLKFYG

SEQ ID NO: 946439 - protein, 9 aa, Homo Sapiens
TAGGKLYAA

SEQ ID NO: 946440 - protein, 9 aa, Homo Sapiens
PHQIADLFQ

SEQ ID NO: 946441 - protein, 9 aa, Homo Sapiens
FTIKLDPGL

SEQ ID NO: 946442 - protein, 9 aa, Homo Sapiens
KSCRNSPDP

SEQ ID NO: 946443 - protein, 9 aa, Homo Sapiens
FDENLDVQR

SEQ ID NO: 946444 - protein, 9 aa, Homo Sapiens
PDALAALYV

SEQ ID NO: 946445 - protein, 9 aa, Homo Sapiens
YRPTEDVQV

SEQ ID NO: 946446 - protein, 9 aa, Homo Sapiens
IYLCAAVYP

SEQ ID NO: 946447 - protein, 9 aa, Homo Sapiens
DLEIILLSV

SEQ ID NO: 946448 - protein, 9 aa, Homo Sapiens
KPFLSADWG

SEQ ID NO: 946449 - protein, 9 aa, Homo Sapiens
NEPAADGLS

SEQ ID NO: 946450 - protein, 9 aa, Homo Sapiens
QQLSENTLT

SEQ ID NO: 946451 - protein, 9 aa, Homo Sapiens
RRLAGGNSS

SEQ ID NO: 946452 - protein, 9 aa, Homo Sapiens
THLNVTVLV

SEQ ID NO: 946453 - protein, 9 aa, Homo Sapiens
KKRELELRD

SEQ ID NO: 946454 - protein, 9 aa, Homo Sapiens
LGVGLQNLC

SEQ ID NO: 946455 - protein, 9 aa, Homo Sapiens
WDPHSGQGF

SEQ ID NO: 946456 - protein, 9 aa, Homo Sapiens
KNPPPEPSP

SEQ ID NO: 946457 - protein, 9 aa, Homo Sapiens
GREVMILKL

SEQ ID NO: 946458 - protein, 9 aa, Homo Sapiens
WVIEKVLIA

SEQ ID NO: 946459 - protein, 9 aa, Homo Sapiens
NFSIFDLVE

SEQ ID NO: 946460 - protein, 9 aa, Homo Sapiens
LMVLQYRPR

SEQ ID NO: 946461 - protein, 9 aa, Homo Sapiens
PATVSFLVK

SEQ ID NO: 946462 - protein, 9 aa, Homo Sapiens
FASHSNYPY

SEQ ID NO: 946463 - protein, 9 aa, Homo Sapiens
KFGRKKTED

SEQ ID NO: 946464 - protein, 9 aa, Homo Sapiens
GSLLENLHW

SEQ ID NO: 946465 - protein, 9 aa, Homo Sapiens
IQRITGPPG

SEQ ID NO: 946466 - protein, 9 aa, Homo Sapiens
KKLPQGVVY

SEQ ID NO: 946467 - protein, 9 aa, Homo Sapiens
GLRVWFTDL

SEQ ID NO: 946468 - protein, 9 aa, Homo Sapiens
NVRFPGFIL

SEQ ID NO: 946469 - protein, 9 aa, Homo Sapiens
YTGKKPNST

SEQ ID NO: 946470 - protein, 9 aa, Homo Sapiens
ERKKKQKPK

SEQ ID NO: 946471 - protein, 9 aa, Homo Sapiens
GTGDERSKE

SEQ ID NO: 946472 - protein, 9 aa, Homo Sapiens
SPDYKFNAV

SEQ ID NO: 946473 - protein, 9 aa, Homo Sapiens
MNLEYMICF

SEQ ID NO: 946474 - protein, 9 aa, Homo Sapiens
FNGPEKREA

SEQ ID NO: 946475 - protein, 9 aa, Homo Sapiens
TAKKLTPFL

SEQ ID NO: 946476 - protein, 9 aa, Homo Sapiens
APGLQEMPG

SEQ ID NO: 946477 - protein, 9 aa, Homo Sapiens
DSKTLQQVK

SEQ ID NO: 946478 - protein, 9 aa, Homo Sapiens
PEAFLAGMR

SEQ ID NO: 946479 - protein, 9 aa, Homo Sapiens
KFLGDIKRL

SEQ ID NO: 946480 - protein, 9 aa, Homo Sapiens
IISHEYTRQ

SEQ ID NO: 946481 - protein, 9 aa, Homo Sapiens
FPEDSSLAS

SEQ ID NO: 946482 - protein, 9 aa, Homo Sapiens
SYEEGKAFA

SEQ ID NO: 946483 - protein, 9 aa, Homo Sapiens
LGPMEEELP

SEQ ID NO: 946484 - protein, 9 aa, Homo Sapiens
QELLKDRDS

SEQ ID NO: 946485 - protein, 9 aa, Homo Sapiens
KIPSFSETL

SEQ ID NO: 946486 - protein, 9 aa, Homo Sapiens
YQEKKFFDI

SEQ ID NO: 946487 - protein, 9 aa, Homo Sapiens
PSGIYVNLY

SEQ ID NO: 946488 - protein, 9 aa, Homo Sapiens
SVYPETRHW

SEQ ID NO: 946489 - protein, 9 aa, Homo Sapiens
LKGSKIKIP

SEQ ID NO: 946490 - protein, 9 aa, Homo Sapiens
FQKDFSGQH

SEQ ID NO: 946491 - protein, 9 aa, Homo Sapiens
TYLSDSHYT

SEQ ID NO: 946492 - protein, 9 aa, Homo Sapiens
LSEWPEKQP

SEQ ID NO: 946493 - protein, 9 aa, Homo Sapiens
IYEAIYYGI

SEQ ID NO: 946494 - protein, 9 aa, Homo Sapiens
QDFIDCFLI

SEQ ID NO: 946495 - protein, 9 aa, Homo Sapiens
IKLACADIS

SEQ ID NO: 946496 - protein, 9 aa, Homo Sapiens
VSEFVLHRL

SEQ ID NO: 946497 - protein, 9 aa, Homo Sapiens
RKSDDEDDE

SEQ ID NO: 946498 - protein, 9 aa, Homo Sapiens
FSNLPPRED

SEQ ID NO: 946499 - protein, 9 aa, Homo Sapiens
DPFLGQQVK

SEQ ID NO: 946500 - protein, 9 aa, Homo Sapiens
ACSYLSSKD

SEQ ID NO: 946501 - protein, 9 aa, Homo Sapiens
YTEKKTYRC

SEQ ID NO: 946502 - protein, 9 aa, Homo Sapiens
RMHHFSRNS

SEQ ID NO: 946503 - protein, 9 aa, Homo Sapiens
TERDSLKEI

SEQ ID NO: 946504 - protein, 9 aa, Homo Sapiens
GPKDKENKF

SEQ ID NO: 946505 - protein, 9 aa, Homo Sapiens
MSVWGKAGK

SEQ ID NO: 946506 - protein, 9 aa, Homo Sapiens
PFSPPNIPI

SEQ ID NO: 946507 - protein, 9 aa, Homo Sapiens
CQASGQPLP

SEQ ID NO: 946508 - protein, 9 aa, Homo Sapiens
SNALRYFPP

SEQ ID NO: 946509 - protein, 9 aa, Homo Sapiens
HIFQDPLTS

SEQ ID NO: 946510 - protein, 9 aa, Homo Sapiens
GFMPVDMGF

SEQ ID NO: 946511 - protein, 9 aa, Homo Sapiens
SFFISLILE

SEQ ID NO: 946512 - protein, 9 aa, Homo Sapiens
KVDLCLQTL

SEQ ID NO: 946513 - protein, 9 aa, Homo Sapiens
AFQLSWKLQ

SEQ ID NO: 946514 - protein, 9 aa, Homo Sapiens
KSPSTETTE

SEQ ID NO: 946515 - protein, 9 aa, Homo Sapiens
SESESSCCP

SEQ ID NO: 946516 - protein, 9 aa, Homo Sapiens
DSSSAVSPN

SEQ ID NO: 946517 - protein, 9 aa, Homo Sapiens
FFICCGILV

SEQ ID NO: 946518 - protein, 9 aa, Homo Sapiens
LNIRGNRIQ

SEQ ID NO: 946519 - protein, 9 aa, Homo Sapiens
DREIFCRGE

SEQ ID NO: 946520 - protein, 9 aa, Homo Sapiens
DQRFSSESK

SEQ ID NO: 946521 - protein, 9 aa, Homo Sapiens
GSKRGSCAS

SEQ ID NO: 946522 - protein, 9 aa, Homo Sapiens
FVRKRMSVV

SEQ ID NO: 946523 - protein, 9 aa, Homo Sapiens
EGRRRVFST

SEQ ID NO: 946524 - protein, 9 aa, Homo Sapiens
FPKPHPCSA

SEQ ID NO: 946525 - protein, 9 aa, Homo Sapiens
WPMGGNGVV

SEQ ID NO: 946526 - protein, 9 aa, Homo Sapiens
AASASLYGA

SEQ ID NO: 946527 - protein, 9 aa, Homo Sapiens
EHYFTPGMK

SEQ ID NO: 946528 - protein, 9 aa, Homo Sapiens
TTSFLNKHR

SEQ ID NO: 946529 - protein, 9 aa, Homo Sapiens
CDGHSMTLD

SEQ ID NO: 946530 - protein, 9 aa, Homo Sapiens
LSNMMSDGK

SEQ ID NO: 946531 - protein, 9 aa, Homo Sapiens
KAPREHLDH

SEQ ID NO: 946532 - protein, 9 aa, Homo Sapiens
VFHILRDAS

SEQ ID NO: 946533 - protein, 9 aa, Homo Sapiens
ALREQSNPN

SEQ ID NO: 946534 - protein, 9 aa, Homo Sapiens
SGKTVLAVF

SEQ ID NO: 946535 - protein, 9 aa, Homo Sapiens
KMYKIKAGG

SEQ ID NO: 946536 - protein, 9 aa, Homo Sapiens
ILQSPSFRK

SEQ ID NO: 946537 - protein, 9 aa, Homo Sapiens
NISCWPFSV

SEQ ID NO: 946538 - protein, 9 aa, Homo Sapiens
GGGTCHCCR

SEQ ID NO: 946539 - protein, 9 aa, Homo Sapiens
DSRFLIGFG

SEQ ID NO: 946540 - protein, 9 aa, Homo Sapiens
EVVDWGLQK

SEQ ID NO: 946541 - protein, 9 aa, Homo Sapiens
VRPDGCPEL

SEQ ID NO: 946542 - protein, 9 aa, Homo Sapiens
DQIVVLEES

SEQ ID NO: 946543 - protein, 9 aa, Homo Sapiens
AISNYVFNT

SEQ ID NO: 946544 - protein, 9 aa, Homo Sapiens
ENSRHNSPT

SEQ ID NO: 946545 - protein, 9 aa, Homo Sapiens
IITTPNKLA

SEQ ID NO: 946546 - protein, 9 aa, Homo Sapiens
KEEKTLMPP

SEQ ID NO: 946547 - protein, 9 aa, Homo Sapiens
SKESFWIPA

SEQ ID NO: 946548 - protein, 9 aa, Homo Sapiens
TTGSSLSKA

SEQ ID NO: 946549 - protein, 9 aa, Homo Sapiens
GPLYQSYLM

SEQ ID NO: 946550 - protein, 9 aa, Homo Sapiens
FPENCTLEL

SEQ ID NO: 946551 - protein, 9 aa, Homo Sapiens
QQALAQRDK

SEQ ID NO: 946552 - protein, 9 aa, Homo Sapiens
RISKIGGKS

SEQ ID NO: 946553 - protein, 9 aa, Homo Sapiens
NGQLKCVRW

SEQ ID NO: 946554 - protein, 9 aa, Homo Sapiens
HVAADCGNV

SEQ ID NO: 946555 - protein, 9 aa, Homo Sapiens
PNTVSPSLS

SEQ ID NO: 946556 - protein, 9 aa, Homo Sapiens
PNLLTLDKA

SEQ ID NO: 946557 - protein, 9 aa, Homo Sapiens
PVPRPKTTA

SEQ ID NO: 946558 - protein, 9 aa, Homo Sapiens
RRRLHYNKE

SEQ ID NO: 946559 - protein, 9 aa, Homo Sapiens
GSTSSRLKN

SEQ ID NO: 946560 - protein, 9 aa, Homo Sapiens
PECPTVFLE

SEQ ID NO: 946561 - protein, 9 aa, Homo Sapiens
MFRFTRVDH

SEQ ID NO: 946562 - protein, 9 aa, Homo Sapiens
NYELAHKPG

SEQ ID NO: 946563 - protein, 9 aa, Homo Sapiens
SGSVSLRPQ

SEQ ID NO: 946564 - protein, 9 aa, Homo Sapiens
ASKNMRDNN

SEQ ID NO: 946565 - protein, 9 aa, Homo Sapiens
QRKIEARST

SEQ ID NO: 946566 - protein, 9 aa, Homo Sapiens
GLGLLKAYS

SEQ ID NO: 946567 - protein, 9 aa, Homo Sapiens
GHKKDAAVN

SEQ ID NO: 946568 - protein, 9 aa, Homo Sapiens
SPYKVKVGV

SEQ ID NO: 946569 - protein, 9 aa, Homo Sapiens
ISWVIEPVY

SEQ ID NO: 946570 - protein, 9 aa, Homo Sapiens
AALETVIRG

SEQ ID NO: 946571 - protein, 9 aa, Homo Sapiens
RWTPPGSIR

SEQ ID NO: 946572 - protein, 9 aa, Homo Sapiens
DEGDSEPEV

SEQ ID NO: 946573 - protein, 9 aa, Homo Sapiens
EKKGRFSSF

SEQ ID NO: 946574 - protein, 9 aa, Homo Sapiens
ILQNIERSS

SEQ ID NO: 946575 - protein, 9 aa, Homo Sapiens
KKEKVSSVF

SEQ ID NO: 946576 - protein, 9 aa, Homo Sapiens
VERSGLLLG

SEQ ID NO: 946577 - protein, 9 aa, Homo Sapiens
EQKVLNVFF

SEQ ID NO: 946578 - protein, 9 aa, Homo Sapiens
NKFVPCKNG

SEQ ID NO: 946579 - protein, 9 aa, Homo Sapiens
CEDTKRQLR

SEQ ID NO: 946580 - protein, 9 aa, Homo Sapiens
SSLGRLSTA

SEQ ID NO: 946581 - protein, 9 aa, Homo Sapiens
ITLTNQIDK

SEQ ID NO: 946582 - protein, 9 aa, Homo Sapiens
SLILENLPE

SEQ ID NO: 946583 - protein, 9 aa, Homo Sapiens
ADNNTDVCL

SEQ ID NO: 946584 - protein, 9 aa, Homo Sapiens
DSLGGSFAS

SEQ ID NO: 946585 - protein, 9 aa, Homo Sapiens
EEGYWTRNV

SEQ ID NO: 946586 - protein, 9 aa, Homo Sapiens
PSLGHTCDR

SEQ ID NO: 946587 - protein, 9 aa, Homo Sapiens
DWFNEWPAK

SEQ ID NO: 946588 - protein, 9 aa, Homo Sapiens
ADTLFSSRR

SEQ ID NO: 946589 - protein, 9 aa, Homo Sapiens
DELCPPSDA

SEQ ID NO: 946590 - protein, 9 aa, Homo Sapiens
ALNASLKKS

SEQ ID NO: 946591 - protein, 9 aa, Homo Sapiens
VRSPPGFPG

SEQ ID NO: 946592 - protein, 9 aa, Homo Sapiens
GMGDVVNIL

SEQ ID NO: 946593 - protein, 9 aa, Homo Sapiens
NLEQECVEE

SEQ ID NO: 946594 - protein, 9 aa, Homo Sapiens
TENSAFSLA

SEQ ID NO: 946595 - protein, 9 aa, Homo Sapiens
VSFHQVNYT

SEQ ID NO: 946596 - protein, 9 aa, Homo Sapiens
QMSVGIFQS

SEQ ID NO: 946597 - protein, 9 aa, Homo Sapiens
EMVCVLLLC

SEQ ID NO: 946598 - protein, 9 aa, Homo Sapiens
RKRESQFVE

SEQ ID NO: 946599 - protein, 9 aa, Homo Sapiens
SGITNRKTK

SEQ ID NO: 946600 - protein, 9 aa, Homo Sapiens
TTIAMRGSQ

SEQ ID NO: 946601 - protein, 9 aa, Homo Sapiens
NNTLYIAPV

SEQ ID NO: 946602 - protein, 9 aa, Homo Sapiens
AAFQRELFR

SEQ ID NO: 946603 - protein, 9 aa, Homo Sapiens
WAPECREKQ

SEQ ID NO: 946604 - protein, 9 aa, Homo Sapiens
VLPEIPQDQ

SEQ ID NO: 946605 - protein, 9 aa, Homo Sapiens
VNIILQSVG

SEQ ID NO: 946606 - protein, 9 aa, Homo Sapiens
SYLRTRYSV

SEQ ID NO: 946607 - protein, 9 aa, Homo Sapiens
KICHGLGLS

SEQ ID NO: 946608 - protein, 9 aa, Homo Sapiens
YEIDAIQRT

SEQ ID NO: 946609 - protein, 9 aa, Homo Sapiens
LRVKWPNNI

SEQ ID NO: 946610 - protein, 9 aa, Homo Sapiens
LLSLVLRNP

SEQ ID NO: 946611 - protein, 9 aa, Homo Sapiens
AYIIIESTK

SEQ ID NO: 946612 - protein, 9 aa, Homo Sapiens
QEQLLREQK

SEQ ID NO: 946613 - protein, 9 aa, Homo Sapiens
AFTCHCRKS

SEQ ID NO: 946614 - protein, 9 aa, Homo Sapiens
REIKEVLTP

SEQ ID NO: 946615 - protein, 9 aa, Homo Sapiens
RKVAERPFG

SEQ ID NO: 946616 - protein, 9 aa, Homo Sapiens
CMEDGRWSE

SEQ ID NO: 946617 - protein, 9 aa, Homo Sapiens
TIDDREPFA

SEQ ID NO: 946618 - protein, 9 aa, Homo Sapiens
PSPTGSESL

SEQ ID NO: 946619 - protein, 9 aa, Homo Sapiens
VSSERIATQ

SEQ ID NO: 946620 - protein, 9 aa, Homo Sapiens
VNLYYATLP

SEQ ID NO: 946621 - protein, 9 aa, Homo Sapiens
ENNLSEEIL

SEQ ID NO: 946622 - protein, 9 aa, Homo Sapiens
SLGTIPGGN

SEQ ID NO: 946623 - protein, 9 aa, Homo Sapiens
SGLGTDGSD

SEQ ID NO: 946624 - protein, 9 aa, Homo Sapiens
LYSLTSEDF

SEQ ID NO: 946625 - protein, 9 aa, Homo Sapiens
ALIVSHILQ

SEQ ID NO: 946626 - protein, 9 aa, Homo Sapiens
SATAHKPVI

SEQ ID NO: 946627 - protein, 9 aa, Homo Sapiens
EISPTIKKM

SEQ ID NO: 946628 - protein, 9 aa, Homo Sapiens
SEGLPALEY

SEQ ID NO: 946629 - protein, 9 aa, Homo Sapiens
PVALSLRMA

SEQ ID NO: 946630 - protein, 9 aa, Homo Sapiens
TCPGQAKFI

SEQ ID NO: 946631 - protein, 9 aa, Homo Sapiens
GIVRQVRFR

SEQ ID NO: 946632 - protein, 9 aa, Homo Sapiens
PEWMDFIQH

SEQ ID NO: 946633 - protein, 9 aa, Homo Sapiens
SKVSGCRNQ

SEQ ID NO: 946634 - protein, 9 aa, Homo Sapiens
CDQCSLETF

SEQ ID NO: 946635 - protein, 9 aa, Homo Sapiens
ESIGFSARY

SEQ ID NO: 946636 - protein, 9 aa, Homo Sapiens
EYNWHKPPK

SEQ ID NO: 946637 - protein, 9 aa, Homo Sapiens
LICSARGHS

SEQ ID NO: 946638 - protein, 9 aa, Homo Sapiens
IFDEDHNEM

SEQ ID NO: 946639 - protein, 9 aa, Homo Sapiens
ALSENAVLI

SEQ ID NO: 946640 - protein, 9 aa, Homo Sapiens
NEEEEEEEQ

SEQ ID NO: 946641 - protein, 9 aa, Homo Sapiens
HCSCALGWT

SEQ ID NO: 946642 - protein, 9 aa, Homo Sapiens
HSAKKFLKR

SEQ ID NO: 946643 - protein, 9 aa, Homo Sapiens
KPGNIIHYI

SEQ ID NO: 946644 - protein, 9 aa, Homo Sapiens
KSDDEDDEE

SEQ ID NO: 946645 - protein, 9 aa, Homo Sapiens
ASTGDTTPF

SEQ ID NO: 946646 - protein, 9 aa, Homo Sapiens
CRNSPDPVN

SEQ ID NO: 946647 - protein, 9 aa, Homo Sapiens
ARSRSSSPS

SEQ ID NO: 946648 - protein, 9 aa, Homo Sapiens
GISVLGCSY

SEQ ID NO: 946649 - protein, 9 aa, Homo Sapiens
ETIWSLRKS

SEQ ID NO: 946650 - protein, 9 aa, Homo Sapiens
EVLVIYMES

SEQ ID NO: 946651 - protein, 9 aa, Homo Sapiens
SVQQGVIIK

SEQ ID NO: 946652 - protein, 9 aa, Homo Sapiens
ANQGDVLTG

SEQ ID NO: 946653 - protein, 9 aa, Homo Sapiens
CVLLLCNAR

SEQ ID NO: 946654 - protein, 9 aa, Homo Sapiens
KNFSSAKDN

SEQ ID NO: 946655 - protein, 9 aa, Homo Sapiens
GSASGSVED

SEQ ID NO: 946656 - protein, 9 aa, Homo Sapiens
LSRMKSSDS

SEQ ID NO: 946657 - protein, 9 aa, Homo Sapiens
ENAVLILLI

SEQ ID NO: 946658 - protein, 9 aa, Homo Sapiens
DIFYASNYV

SEQ ID NO: 946659 - protein, 9 aa, Homo Sapiens
LGILRLYKD

SEQ ID NO: 946660 - protein, 9 aa, Homo Sapiens
RYAEEFALR

SEQ ID NO: 946661 - protein, 9 aa, Homo Sapiens
PLIVTETPS

SEQ ID NO: 946662 - protein, 9 aa, Homo Sapiens
LAQLLTRQR

SEQ ID NO: 946663 - protein, 9 aa, Homo Sapiens
FCRGERIRD

SEQ ID NO: 946664 - protein, 9 aa, Homo Sapiens
DAPDGCILC

SEQ ID NO: 946665 - protein, 9 aa, Homo Sapiens
HIGSFVGGA

SEQ ID NO: 946666 - protein, 9 aa, Homo Sapiens
ESIEETVEF

SEQ ID NO: 946667 - protein, 9 aa, Homo Sapiens
VSRQTRNKK

SEQ ID NO: 946668 - protein, 9 aa, Homo Sapiens
STISWGLPR

SEQ ID NO: 946669 - protein, 9 aa, Homo Sapiens
LETVIRGPG

SEQ ID NO: 946670 - protein, 9 aa, Homo Sapiens
YIAPVTKED

SEQ ID NO: 946671 - protein, 9 aa, Homo Sapiens
RVTCNQLLM

SEQ ID NO: 946672 - protein, 9 aa, Homo Sapiens
LNSGTLNIL

SEQ ID NO: 946673 - protein, 9 aa, Homo Sapiens
LKRFYSSPD

SEQ ID NO: 946674 - protein, 9 aa, Homo Sapiens
TDPDEGANR

SEQ ID NO: 946675 - protein, 9 aa, Homo Sapiens
AEPLESRVS

SEQ ID NO: 946676 - protein, 9 aa, Homo Sapiens
DPDLPSNIT

SEQ ID NO: 946677 - protein, 9 aa, Homo Sapiens
DKVGQQVER

SEQ ID NO: 946678 - protein, 9 aa, Homo Sapiens
ADKTAKEEF

SEQ ID NO: 946679 - protein, 9 aa, Homo Sapiens
DILETVLQV

SEQ ID NO: 946680 - protein, 9 aa, Homo Sapiens
SLRHNNWRL

SEQ ID NO: 946681 - protein, 9 aa, Homo Sapiens
PSVLLSVLP

SEQ ID NO: 946682 - protein, 9 aa, Homo Sapiens
DRPSPDDNE

SEQ ID NO: 946683 - protein, 9 aa, Homo Sapiens
RQSSVSFQS

SEQ ID NO: 946684 - protein, 9 aa, Homo Sapiens
YACAGFCKC

SEQ ID NO: 946685 - protein, 9 aa, Homo Sapiens
LLETPVGYT

SEQ ID NO: 946686 - protein, 9 aa, Homo Sapiens
FHILRDASD

SEQ ID NO: 946687 - protein, 9 aa, Homo Sapiens
KEEKQKELQ

SEQ ID NO: 946688 - protein, 9 aa, Homo Sapiens
IFRINNAAF

SEQ ID NO: 946689 - protein, 9 aa, Homo Sapiens
SLSTSILVS

SEQ ID NO: 946690 - protein, 9 aa, Homo Sapiens
GKEGEGGVC

SEQ ID NO: 946691 - protein, 9 aa, Homo Sapiens
QLRQTVKAT

SEQ ID NO: 946692 - protein, 9 aa, Homo Sapiens
NLSINNNLN

SEQ ID NO: 946693 - protein, 9 aa, Homo Sapiens
WSCSRGREV

SEQ ID NO: 946694 - protein, 9 aa, Homo Sapiens
FSHRNSSKC

SEQ ID NO: 946695 - protein, 9 aa, Homo Sapiens
ALKKTLLLY

SEQ ID NO: 946696 - protein, 9 aa, Homo Sapiens
AKACGRGRK

SEQ ID NO: 946697 - protein, 9 aa, Homo Sapiens
ENILIVTVT

SEQ ID NO: 946698 - protein, 9 aa, Homo Sapiens
SPRTPSGDA

SEQ ID NO: 946699 - protein, 9 aa, Homo Sapiens
SCQQKQNTL

SEQ ID NO: 946700 - protein, 9 aa, Homo Sapiens
IGQKVQLPM

SEQ ID NO: 946701 - protein, 9 aa, Homo Sapiens
GNHFWGIYP

SEQ ID NO: 946702 - protein, 9 aa, Homo Sapiens
LPALSHCFQ

SEQ ID NO: 946703 - protein, 9 aa, Homo Sapiens
VTVDLAIGF

SEQ ID NO: 946704 - protein, 9 aa, Homo Sapiens
GQGAVPDST

SEQ ID NO: 946705 - protein, 9 aa, Homo Sapiens
LDGTLFDLS

SEQ ID NO: 946706 - protein, 9 aa, Homo Sapiens
NPTWNKVFE

SEQ ID NO: 946707 - protein, 9 aa, Homo Sapiens
TKFLAMDKV

SEQ ID NO: 946708 - protein, 9 aa, Homo Sapiens
PSRITTLSS

SEQ ID NO: 946709 - protein, 9 aa, Homo Sapiens
IFSGKECVC

SEQ ID NO: 946710 - protein, 9 aa, Homo Sapiens
KIFRQMNTN

SEQ ID NO: 946711 - protein, 9 aa, Homo Sapiens
GDRLDLLCL

SEQ ID NO: 946712 - protein, 9 aa, Homo Sapiens
TDQGCHQKL

SEQ ID NO: 946713 - protein, 9 aa, Homo Sapiens
SLTLLASER

SEQ ID NO: 946714 - protein, 9 aa, Homo Sapiens
RFWNKNIGL

SEQ ID NO: 946715 - protein, 9 aa, Homo Sapiens
VGPSHVAAM

SEQ ID NO: 946716 - protein, 9 aa, Homo Sapiens
KRTPDEFDS

SEQ ID NO: 946717 - protein, 9 aa, Homo Sapiens
EIPEAKHDY

SEQ ID NO: 946718 - protein, 9 aa, Homo Sapiens
GEEPSKEEE

SEQ ID NO: 946719 - protein, 9 aa, Homo Sapiens
KRLEVEELL

SEQ ID NO: 946720 - protein, 9 aa, Homo Sapiens
PEETVRLGV

SEQ ID NO: 946721 - protein, 9 aa, Homo Sapiens
LFSSRRGRQ

SEQ ID NO: 946722 - protein, 9 aa, Homo Sapiens
QMYFFHSLK

SEQ ID NO: 946723 - protein, 9 aa, Homo Sapiens
KPNPPPPPL

SEQ ID NO: 946724 - protein, 9 aa, Homo Sapiens
LRLTPVKCE

SEQ ID NO: 946725 - protein, 9 aa, Homo Sapiens
KELRHQQER

SEQ ID NO: 946726 - protein, 9 aa, Homo Sapiens
VSVAEPFFS

SEQ ID NO: 946727 - protein, 9 aa, Homo Sapiens
GKSICTVLT

SEQ ID NO: 946728 - protein, 9 aa, Homo Sapiens
KSAEPPLTQ

SEQ ID NO: 946729 - protein, 9 aa, Homo Sapiens
GPHPDPRHA

SEQ ID NO: 946730 - protein, 9 aa, Homo Sapiens
INPENEDEG

SEQ ID NO: 946731 - protein, 9 aa, Homo Sapiens
PEFNVYLKK

SEQ ID NO: 946732 - protein, 9 aa, Homo Sapiens
DRKIEVAFM

SEQ ID NO: 946733 - protein, 9 aa, Homo Sapiens
AADGLSEKD

SEQ ID NO: 946734 - protein, 9 aa, Homo Sapiens
GRSKESFWI

SEQ ID NO: 946735 - protein, 9 aa, Homo Sapiens
HVAQNPHGR

SEQ ID NO: 946736 - protein, 9 aa, Homo Sapiens
SVENSRHNS

SEQ ID NO: 946737 - protein, 9 aa, Homo Sapiens
FTEIPADYQ

SEQ ID NO: 946738 - protein, 9 aa, Homo Sapiens
CPRRWKLQV

SEQ ID NO: 946739 - protein, 9 aa, Homo Sapiens
NQQCISSRW

SEQ ID NO: 946740 - protein, 9 aa, Homo Sapiens
LPIVHYNMG

SEQ ID NO: 946741 - protein, 9 aa, Homo Sapiens
QNLSDLYCW

SEQ ID NO: 946742 - protein, 9 aa, Homo Sapiens
TSSQMLKGL

SEQ ID NO: 946743 - protein, 9 aa, Homo Sapiens
GQVPVYVVT

SEQ ID NO: 946744 - protein, 9 aa, Homo Sapiens
LSCPVLLHL

SEQ ID NO: 946745 - protein, 9 aa, Homo Sapiens
GNLSPGGAT

SEQ ID NO: 946746 - protein, 9 aa, Homo Sapiens
GEKAFLEHL

SEQ ID NO: 946747 - protein, 9 aa, Homo Sapiens
AFRKNPPPE

SEQ ID NO: 946748 - protein, 9 aa, Homo Sapiens
PQNGTSTLR

SEQ ID NO: 946749 - protein, 9 aa, Homo Sapiens
QKSKAVEKI

SEQ ID NO: 946750 - protein, 9 aa, Homo Sapiens
SRKPSFPFQ

SEQ ID NO: 946751 - protein, 9 aa, Homo Sapiens
DTYHKVDLC

SEQ ID NO: 946752 - protein, 9 aa, Homo Sapiens
DSGVSSFIG

SEQ ID NO: 946753 - protein, 9 aa, Homo Sapiens
NYMGVGLFG

SEQ ID NO: 946754 - protein, 9 aa, Homo Sapiens
SLRMARRTE

SEQ ID NO: 946755 - protein, 9 aa, Homo Sapiens
LKATPEISQ

SEQ ID NO: 946756 - protein, 9 aa, Homo Sapiens
WNKVEDRLR

SEQ ID NO: 946757 - protein, 9 aa, Homo Sapiens
PTVGFIPND

SEQ ID NO: 946758 - protein, 9 aa, Homo Sapiens
KAKILIDFI

SEQ ID NO: 946759 - protein, 9 aa, Homo Sapiens
DAQKILKCM

SEQ ID NO: 946760 - protein, 9 aa, Homo Sapiens
SVGIFQSMF

SEQ ID NO: 946761 - protein, 9 aa, Homo Sapiens
DDREPFANA

SEQ ID NO: 946762 - protein, 9 aa, Homo Sapiens
SSTPYGHCP

SEQ ID NO: 946763 - protein, 9 aa, Homo Sapiens
DWSQENSGQ

SEQ ID NO: 946764 - protein, 9 aa, Homo Sapiens
QHKIKYKAP

SEQ ID NO: 946765 - protein, 9 aa, Homo Sapiens
RKMQEEETR

SEQ ID NO: 946766 - protein, 9 aa, Homo Sapiens
KGEKGGVES

SEQ ID NO: 946767 - protein, 9 aa, Homo Sapiens
ASSSASLLP

SEQ ID NO: 946768 - protein, 9 aa, Homo Sapiens
DISEGTVQT

SEQ ID NO: 946769 - protein, 9 aa, Homo Sapiens
FDCRCLSGF

SEQ ID NO: 946770 - protein, 9 aa, Homo Sapiens
IWYKRLTLY

SEQ ID NO: 946771 - protein, 9 aa, Homo Sapiens
LPPSRRRRP

SEQ ID NO: 946772 - protein, 9 aa, Homo Sapiens
EELVVLSFP

SEQ ID NO: 946773 - protein, 9 aa, Homo Sapiens
SPKATGGFT

SEQ ID NO: 946774 - protein, 9 aa, Homo Sapiens
KDCRRGFIQ

SEQ ID NO: 946775 - protein, 9 aa, Homo Sapiens
GFLPTAMPT

SEQ ID NO: 946776 - protein, 9 aa, Homo Sapiens
TRVHFHPKQ

SEQ ID NO: 946777 - protein, 9 aa, Homo Sapiens
AICHLLHYR

SEQ ID NO: 946778 - protein, 9 aa, Homo Sapiens
CIATNHFET

SEQ ID NO: 946779 - protein, 9 aa, Homo Sapiens
ISRRLSFQK

SEQ ID NO: 946780 - protein, 9 aa, Homo Sapiens
MSETTQEQD

SEQ ID NO: 946781 - protein, 9 aa, Homo Sapiens
PNHTSSQML

SEQ ID NO: 946782 - protein, 9 aa, Homo Sapiens
ILCSCDPEH

SEQ ID NO: 946783 - protein, 9 aa, Homo Sapiens
LDELQKECE

SEQ ID NO: 946784 - protein, 9 aa, Homo Sapiens
SWESIKGSS

SEQ ID NO: 946785 - protein, 9 aa, Homo Sapiens
MATARIKTT

SEQ ID NO: 946786 - protein, 9 aa, Homo Sapiens
WREQRRFTV

SEQ ID NO: 946787 - protein, 9 aa, Homo Sapiens
SEVVPVLAW

SEQ ID NO: 946788 - protein, 9 aa, Homo Sapiens
EVPTEDVEE

SEQ ID NO: 946789 - protein, 9 aa, Homo Sapiens
DACEETPEK

SEQ ID NO: 946790 - protein, 9 aa, Homo Sapiens
FCDKSILRK

SEQ ID NO: 946791 - protein, 9 aa, Homo Sapiens
VMDDKIESE

SEQ ID NO: 946792 - protein, 9 aa, Homo Sapiens
KHDYRPTED

SEQ ID NO: 946793 - protein, 9 aa, Homo Sapiens
QVCNSDSPC

SEQ ID NO: 946794 - protein, 9 aa, Homo Sapiens
SFPARVPSP

SEQ ID NO: 946795 - protein, 9 aa, Homo Sapiens
RTHTGEKVC

SEQ ID NO: 946796 - protein, 9 aa, Homo Sapiens
VSGGLAEEA

SEQ ID NO: 946797 - protein, 9 aa, Homo Sapiens
HHHLHKPHE

SEQ ID NO: 946798 - protein, 9 aa, Homo Sapiens
SECGKASNQ

SEQ ID NO: 946799 - protein, 9 aa, Homo Sapiens
LGGACLLVI

SEQ ID NO: 946800 - protein, 9 aa, Homo Sapiens
QVIFEGKIG

SEQ ID NO: 946801 - protein, 9 aa, Homo Sapiens
VVQCCVEDE

SEQ ID NO: 946802 - protein, 9 aa, Homo Sapiens
EEQCHLLNN

SEQ ID NO: 946803 - protein, 9 aa, Homo Sapiens
CGKIFQGNP

SEQ ID NO: 946804 - protein, 9 aa, Homo Sapiens
TLNVIISEK

SEQ ID NO: 946805 - protein, 9 aa, Homo Sapiens
AQSEDYVDI

SEQ ID NO: 946806 - protein, 9 aa, Homo Sapiens
KSITSLSPR

SEQ ID NO: 946807 - protein, 9 aa, Homo Sapiens
NVKETPLPT

SEQ ID NO: 946808 - protein, 9 aa, Homo Sapiens
IKERIFQEI

SEQ ID NO: 946809 - protein, 9 aa, Homo Sapiens
KSEQSCRKA

SEQ ID NO: 946810 - protein, 9 aa, Homo Sapiens
RDTISKQDV

SEQ ID NO: 946811 - protein, 9 aa, Homo Sapiens
RFVAICHLL

SEQ ID NO: 946812 - protein, 9 aa, Homo Sapiens
LHLIPQVLD

SEQ ID NO: 946813 - protein, 9 aa, Homo Sapiens
GPGGADGVL

SEQ ID NO: 946814 - protein, 9 aa, Homo Sapiens
KIYAGKKFY

SEQ ID NO: 946815 - protein, 9 aa, Homo Sapiens
GSSWGCWYY

SEQ ID NO: 946816 - protein, 9 aa, Homo Sapiens
SVDTTVFSL

SEQ ID NO: 946817 - protein, 9 aa, Homo Sapiens
QLRYESITL

SEQ ID NO: 946818 - protein, 9 aa, Homo Sapiens
RYSVRQNKS

SEQ ID NO: 946819 - protein, 9 aa, Homo Sapiens
GTPKSITSL

SEQ ID NO: 946820 - protein, 9 aa, Homo Sapiens
DGCPELCRP

SEQ ID NO: 946821 - protein, 9 aa, Homo Sapiens
IIKQQRVNP

SEQ ID NO: 946822 - protein, 9 aa, Homo Sapiens
MAIVLKIAM

SEQ ID NO: 946823 - protein, 9 aa, Homo Sapiens
LPKLSAEVV

SEQ ID NO: 946824 - protein, 9 aa, Homo Sapiens
WPFSVPGRM

SEQ ID NO: 946825 - protein, 9 aa, Homo Sapiens
AEERKLLQI

SEQ ID NO: 946826 - protein, 9 aa, Homo Sapiens
ISYSYIVSA

SEQ ID NO: 946827 - protein, 9 aa, Homo Sapiens
RPILPVSPA

SEQ ID NO: 946828 - protein, 9 aa, Homo Sapiens
TPLAKPKKR

SEQ ID NO: 946829 - protein, 9 aa, Homo Sapiens
FSWFSAAPT

SEQ ID NO: 946830 - protein, 9 aa, Homo Sapiens
AEKDTPAEA

SEQ ID NO: 946831 - protein, 9 aa, Homo Sapiens
QRDKELRHQ

SEQ ID NO: 946832 - protein, 9 aa, Homo Sapiens
STCQRANFL

SEQ ID NO: 946833 - protein, 9 aa, Homo Sapiens
WERNMAIRS

SEQ ID NO: 946834 - protein, 9 aa, Homo Sapiens
GVLSCLALE

SEQ ID NO: 946835 - protein, 9 aa, Homo Sapiens
NLPKPPGNL

SEQ ID NO: 946836 - protein, 9 aa, Homo Sapiens
HSIVQRFAA

SEQ ID NO: 946837 - protein, 9 aa, Homo Sapiens
SSKSQAKIE

SEQ ID NO: 946838 - protein, 9 aa, Homo Sapiens
DASYLWWIN

SEQ ID NO: 946839 - protein, 9 aa, Homo Sapiens
PKATLCGDS

SEQ ID NO: 946840 - protein, 9 aa, Homo Sapiens
GVFNEPSTS

SEQ ID NO: 946841 - protein, 9 aa, Homo Sapiens
IIKERIFQE

SEQ ID NO: 946842 - protein, 9 aa, Homo Sapiens
NKIVLLEAG

SEQ ID NO: 946843 - protein, 9 aa, Homo Sapiens
EGPRVPGGR

SEQ ID NO: 946844 - protein, 9 aa, Homo Sapiens
LIFSFCKSQ

SEQ ID NO: 946845 - protein, 9 aa, Homo Sapiens
MPTFSWDED

SEQ ID NO: 946846 - protein, 9 aa, Homo Sapiens
LGNDTILWI

SEQ ID NO: 946847 - protein, 9 aa, Homo Sapiens
ILVKSVNIE

SEQ ID NO: 946848 - protein, 9 aa, Homo Sapiens
DSSFLNWEF

SEQ ID NO: 946849 - protein, 9 aa, Homo Sapiens
SKIIQKGSE

SEQ ID NO: 946850 - protein, 9 aa, Homo Sapiens
NELERLFDK

SEQ ID NO: 946851 - protein, 9 aa, Homo Sapiens
MHPCFCHLL

SEQ ID NO: 946852 - protein, 9 aa, Homo Sapiens
LEKHKCSVK

SEQ ID NO: 946853 - protein, 9 aa, Homo Sapiens
SHCCAYKNQ

SEQ ID NO: 946854 - protein, 9 aa, Homo Sapiens
PDAGALIEE

SEQ ID NO: 946855 - protein, 9 aa, Homo Sapiens
WTDWGDYSL

SEQ ID NO: 946856 - protein, 9 aa, Homo Sapiens
PGGLDSRQA

SEQ ID NO: 946857 - protein, 9 aa, Homo Sapiens
LDYENEKVN

SEQ ID NO: 946858 - protein, 9 aa, Homo Sapiens
SIYFMTAVA

SEQ ID NO: 946859 - protein, 9 aa, Homo Sapiens
SSVQQGVII

SEQ ID NO: 946860 - protein, 9 aa, Homo Sapiens
INLESIFQG

SEQ ID NO: 946861 - protein, 9 aa, Homo Sapiens
ERDSLKEII

SEQ ID NO: 946862 - protein, 9 aa, Homo Sapiens
KPLYFCRIN

SEQ ID NO: 946863 - protein, 9 aa, Homo Sapiens
CQLSGSSHS

SEQ ID NO: 946864 - protein, 9 aa, Homo Sapiens
YSFFLDLSP

SEQ ID NO: 946865 - protein, 9 aa, Homo Sapiens
YLPLWMMLY

SEQ ID NO: 946866 - protein, 9 aa, Homo Sapiens
ASSQQVHPE

SEQ ID NO: 946867 - protein, 9 aa, Homo Sapiens
VIRGHESEV

SEQ ID NO: 946868 - protein, 9 aa, Homo Sapiens
RELPAPERP

SEQ ID NO: 946869 - protein, 9 aa, Homo Sapiens
QRLPKQKEK

SEQ ID NO: 946870 - protein, 9 aa, Homo Sapiens
GCKRKFLKS

SEQ ID NO: 946871 - protein, 9 aa, Homo Sapiens
LPSVQPHAH

SEQ ID NO: 946872 - protein, 9 aa, Homo Sapiens
ELARLGGQK

SEQ ID NO: 946873 - protein, 9 aa, Homo Sapiens
TAQAVRDTT

SEQ ID NO: 946874 - protein, 9 aa, Homo Sapiens
KIKAGGSIA

SEQ ID NO: 946875 - protein, 9 aa, Homo Sapiens
FLFPVPPSK

SEQ ID NO: 946876 - protein, 9 aa, Homo Sapiens
LSPVKSQKI

SEQ ID NO: 946877 - protein, 9 aa, Homo Sapiens
DSQDQQAGR

SEQ ID NO: 946878 - protein, 9 aa, Homo Sapiens
RQMNTNNDG

SEQ ID NO: 946879 - protein, 9 aa, Homo Sapiens
SCSRGREVM

SEQ ID NO: 946880 - protein, 9 aa, Homo Sapiens
RPCLGASEA

SEQ ID NO: 946881 - protein, 9 aa, Homo Sapiens
YGVPWGVYS

SEQ ID NO: 946882 - protein, 9 aa, Homo Sapiens
LCLQTLEIP

SEQ ID NO: 946883 - protein, 9 aa, Homo Sapiens
EEKQKELQS

SEQ ID NO: 946884 - protein, 9 aa, Homo Sapiens
NKTDSPSSK

SEQ ID NO: 946885 - protein, 9 aa, Homo Sapiens
LQNNMTSLE

SEQ ID NO: 946886 - protein, 9 aa, Homo Sapiens
VSGCRNQRY

SEQ ID NO: 946887 - protein, 9 aa, Homo Sapiens
FEDLSEIDG

SEQ ID NO: 946888 - protein, 9 aa, Homo Sapiens
NGQPQTQPS

SEQ ID NO: 946889 - protein, 9 aa, Homo Sapiens
PSCKDIVAR

SEQ ID NO: 946890 - protein, 9 aa, Homo Sapiens
ITCGSDSFA

SEQ ID NO: 946891 - protein, 9 aa, Homo Sapiens
CVQVKPPNG

SEQ ID NO: 946892 - protein, 9 aa, Homo Sapiens
SEPDKGDPF

SEQ ID NO: 946893 - protein, 9 aa, Homo Sapiens
GGVRCSSFR

SEQ ID NO: 946894 - protein, 9 aa, Homo Sapiens
GLVFLHSRR

SEQ ID NO: 946895 - protein, 9 aa, Homo Sapiens
FGLQLADDF

SEQ ID NO: 946896 - protein, 9 aa, Homo Sapiens
SKRGSCASV

SEQ ID NO: 946897 - protein, 9 aa, Homo Sapiens
VEMKWVKQY

SEQ ID NO: 946898 - protein, 9 aa, Homo Sapiens
AKIFSEHAR

SEQ ID NO: 946899 - protein, 9 aa, Homo Sapiens
PDRPAGSWE

SEQ ID NO: 946900 - protein, 9 aa, Homo Sapiens
AVAYACNPS

SEQ ID NO: 946901 - protein, 9 aa, Homo Sapiens
FNTLEGVPS

SEQ ID NO: 946902 - protein, 9 aa, Homo Sapiens
YLAFQDIEA

SEQ ID NO: 946903 - protein, 9 aa, Homo Sapiens
RGCVWTTGS

SEQ ID NO: 946904 - protein, 9 aa, Homo Sapiens
TGTQSPYGG

SEQ ID NO: 946905 - protein, 9 aa, Homo Sapiens
SSHLQAETL

SEQ ID NO: 946906 - protein, 9 aa, Homo Sapiens
QEEETRKLQ

SEQ ID NO: 946907 - protein, 9 aa, Homo Sapiens
YMVYRISAP

SEQ ID NO: 946908 - protein, 9 aa, Homo Sapiens
AETFPFNSF

SEQ ID NO: 946909 - protein, 9 aa, Homo Sapiens
IYAGKKFYK

SEQ ID NO: 946910 - protein, 9 aa, Homo Sapiens
LDSTAMTSA

SEQ ID NO: 946911 - protein, 9 aa, Homo Sapiens
RPHKVSSYE

SEQ ID NO: 946912 - protein, 9 aa, Homo Sapiens
ILALRPSDK

SEQ ID NO: 946913 - protein, 9 aa, Homo Sapiens
YKKKEKESF

SEQ ID NO: 946914 - protein, 9 aa, Homo Sapiens
HFFQNLGFI

SEQ ID NO: 946915 - protein, 9 aa, Homo Sapiens
TIDSAGSFN

SEQ ID NO: 946916 - protein, 9 aa, Homo Sapiens
VIQKAYWSY

SEQ ID NO: 946917 - protein, 9 aa, Homo Sapiens
ASQLKSDTI

SEQ ID NO: 946918 - protein, 9 aa, Homo Sapiens
VGSSQAPPS

SEQ ID NO: 946919 - protein, 9 aa, Homo Sapiens
KDGAPKNRT

SEQ ID NO: 946920 - protein, 9 aa, Homo Sapiens
SSESSSLSD

SEQ ID NO: 946921 - protein, 9 aa, Homo Sapiens
WFHGKEFLL

SEQ ID NO: 946922 - protein, 9 aa, Homo Sapiens
KPFTACQKV

SEQ ID NO: 946923 - protein, 9 aa, Homo Sapiens
GFKGDKTEG

SEQ ID NO: 946924 - protein, 9 aa, Homo Sapiens
SRGREVMIL

SEQ ID NO: 946925 - protein, 9 aa, Homo Sapiens
AWREQRRFT

SEQ ID NO: 946926 - protein, 9 aa, Homo Sapiens
PSPPGGLDS

SEQ ID NO: 946927 - protein, 9 aa, Homo Sapiens
EEETEFMEL

SEQ ID NO: 946928 - protein, 9 aa, Homo Sapiens
ENSLLLTAV

SEQ ID NO: 946929 - protein, 9 aa, Homo Sapiens
IPGHLVDVR

SEQ ID NO: 946930 - protein, 9 aa, Homo Sapiens
GPFLELCTL

SEQ ID NO: 946931 - protein, 9 aa, Homo Sapiens
GSTTRQRES

SEQ ID NO: 946932 - protein, 9 aa, Homo Sapiens
SPAPTYLSD

SEQ ID NO: 946933 - protein, 9 aa, Homo Sapiens
SGETFPTDW

SEQ ID NO: 946934 - protein, 9 aa, Homo Sapiens
QADLSRNCF

SEQ ID NO: 946935 - protein, 9 aa, Homo Sapiens
DLFAVGYSS

SEQ ID NO: 946936 - protein, 9 aa, Homo Sapiens
HPGPSTTFF

SEQ ID NO: 946937 - protein, 9 aa, Homo Sapiens
ISYFYILLT

SEQ ID NO: 946938 - protein, 9 aa, Homo Sapiens
ALSNALRYF

SEQ ID NO: 946939 - protein, 9 aa, Homo Sapiens
SSVSFQSGG

SEQ ID NO: 946940 - protein, 9 aa, Homo Sapiens
SEKDCPCET

SEQ ID NO: 946941 - protein, 9 aa, Homo Sapiens
YKKIAYLLT

SEQ ID NO: 946942 - protein, 9 aa, Homo Sapiens
NRNKIYLIC

SEQ ID NO: 946943 - protein, 9 aa, Homo Sapiens
QLPLESLVL

SEQ ID NO: 946944 - protein, 9 aa, Homo Sapiens
SSQATGKGC

SEQ ID NO: 946945 - protein, 9 aa, Homo Sapiens
LLVLQQVGN

SEQ ID NO: 946946 - protein, 9 aa, Homo Sapiens
AACGVRCYP

SEQ ID NO: 946947 - protein, 9 aa, Homo Sapiens
TPYGHCPNG

SEQ ID NO: 946948 - protein, 9 aa, Homo Sapiens
GGSPLRTGT

SEQ ID NO: 946949 - protein, 9 aa, Homo Sapiens
QSFLNRMGD

SEQ ID NO: 946950 - protein, 9 aa, Homo Sapiens
RHKSSRQEK

SEQ ID NO: 946951 - protein, 9 aa, Homo Sapiens
EEIMFLQMK

SEQ ID NO: 946952 - protein, 9 aa, Homo Sapiens
PSDEAPMKL

SEQ ID NO: 946953 - protein, 9 aa, Homo Sapiens
LVQPPPPDN

SEQ ID NO: 946954 - protein, 9 aa, Homo Sapiens
KATGGFTTL

SEQ ID NO: 946955 - protein, 9 aa, Homo Sapiens
KKETNIILN

SEQ ID NO: 946956 - protein, 9 aa, Homo Sapiens
PLVWTDNPK

SEQ ID NO: 946957 - protein, 9 aa, Homo Sapiens
VIFSGKECV

SEQ ID NO: 946958 - protein, 9 aa, Homo Sapiens
PLSGFSRSC

SEQ ID NO: 946959 - protein, 9 aa, Homo Sapiens
ASEQPLAQK

SEQ ID NO: 946960 - protein, 9 aa, Homo Sapiens
AKALKSVAT

SEQ ID NO: 946961 - protein, 9 aa, Homo Sapiens
WFSHNCNHC

SEQ ID NO: 946962 - protein, 9 aa, Homo Sapiens
LLMEQDRNK

SEQ ID NO: 946963 - protein, 9 aa, Homo Sapiens
KLLQIIAEA

SEQ ID NO: 946964 - protein, 9 aa, Homo Sapiens
PFLGQQVKD

SEQ ID NO: 946965 - protein, 9 aa, Homo Sapiens
GSAVPPELD

SEQ ID NO: 946966 - protein, 9 aa, Homo Sapiens
KLQEPWERP

SEQ ID NO: 946967 - protein, 9 aa, Homo Sapiens
PRKIPAQQA

SEQ ID NO: 946968 - protein, 9 aa, Homo Sapiens
LEVHKHKAS

SEQ ID NO: 946969 - protein, 9 aa, Homo Sapiens
TISALEVFP

SEQ ID NO: 946970 - protein, 9 aa, Homo Sapiens
VFLIDNSQN

SEQ ID NO: 946971 - protein, 9 aa, Homo Sapiens
AESLDKNLG

SEQ ID NO: 946972 - protein, 9 aa, Homo Sapiens
GNQILFLGS

SEQ ID NO: 946973 - protein, 9 aa, Homo Sapiens
TTIYDPEKE

SEQ ID NO: 946974 - protein, 9 aa, Homo Sapiens
RTWPDLGVP

SEQ ID NO: 946975 - protein, 9 aa, Homo Sapiens
LQLLISYSY

SEQ ID NO: 946976 - protein, 9 aa, Homo Sapiens
TKREVLLPV

SEQ ID NO: 946977 - protein, 9 aa, Homo Sapiens
RNVNPKSSI

SEQ ID NO: 946978 - protein, 9 aa, Homo Sapiens
TFRRSRPCT

SEQ ID NO: 946979 - protein, 9 aa, Homo Sapiens
ELPLDNQVA

SEQ ID NO: 946980 - protein, 9 aa, Homo Sapiens
KNVEKILVE

SEQ ID NO: 946981 - protein, 9 aa, Homo Sapiens
GFLNQGNTW

SEQ ID NO: 946982 - protein, 9 aa, Homo Sapiens
KTLCHPCLL

SEQ ID NO: 946983 - protein, 9 aa, Homo Sapiens
RLSPKEHPV

SEQ ID NO: 946984 - protein, 9 aa, Homo Sapiens
PKGEPGLLG

SEQ ID NO: 946985 - protein, 9 aa, Homo Sapiens
NPEKGDIVT

SEQ ID NO: 946986 - protein, 9 aa, Homo Sapiens
QSIDTYGKE

SEQ ID NO: 946987 - protein, 9 aa, Homo Sapiens
EHLFCMYDA

SEQ ID NO: 946988 - protein, 9 aa, Homo Sapiens
SVEELLLFE

SEQ ID NO: 946989 - protein, 9 aa, Homo Sapiens
QTVKATNSM

SEQ ID NO: 946990 - protein, 9 aa, Homo Sapiens
GGLSVFSRF

SEQ ID NO: 946991 - protein, 9 aa, Homo Sapiens
KATLCGDSF

SEQ ID NO: 946992 - protein, 9 aa, Homo Sapiens
GGLAEEAKQ

SEQ ID NO: 946993 - protein, 9 aa, Homo Sapiens
VRSETIFDN

SEQ ID NO: 946994 - protein, 9 aa, Homo Sapiens
YPVYARYWQ

SEQ ID NO: 946995 - protein, 9 aa, Homo Sapiens
SLNEQRHNG

SEQ ID NO: 946996 - protein, 9 aa, Homo Sapiens
YTLDHFETI

SEQ ID NO: 946997 - protein, 9 aa, Homo Sapiens
CLLLSTSKI

SEQ ID NO: 946998 - protein, 9 aa, Homo Sapiens
RVSLLDKGI

SEQ ID NO: 946999 - protein, 9 aa, Homo Sapiens
AYKKIAYLL

SEQ ID NO: 947000 - protein, 9 aa, Homo Sapiens
CLGLCFSWD

SEQ ID NO: 947001 - protein, 9 aa, Homo Sapiens
GATNLKNFN

SEQ ID NO: 947002 - protein, 9 aa, Homo Sapiens
PCNVTFRLS

SEQ ID NO: 947003 - protein, 9 aa, Homo Sapiens
CTCPVLILH

SEQ ID NO: 947004 - protein, 9 aa, Homo Sapiens
SGKSIEVLV

SEQ ID NO: 947005 - protein, 9 aa, Homo Sapiens
DSSHFELLK

SEQ ID NO: 947006 - protein, 9 aa, Homo Sapiens
LLETQGLMM

SEQ ID NO: 947007 - protein, 9 aa, Homo Sapiens
AMAEPDPEI

SEQ ID NO: 947008 - protein, 9 aa, Homo Sapiens
FLQYGRIIT

SEQ ID NO: 947009 - protein, 9 aa, Homo Sapiens
LKDRDSKEI

SEQ ID NO: 947010 - protein, 9 aa, Homo Sapiens
APKQKVALS

SEQ ID NO: 947011 - protein, 9 aa, Homo Sapiens
PNAQGLAWG

SEQ ID NO: 947012 - protein, 9 aa, Homo Sapiens
QKKFSLQDI

SEQ ID NO: 947013 - protein, 9 aa, Homo Sapiens
HENETSHEI

SEQ ID NO: 947014 - protein, 9 aa, Homo Sapiens
FWGIYPESI

SEQ ID NO: 947015 - protein, 9 aa, Homo Sapiens
IYLQRRPCN

SEQ ID NO: 947016 - protein, 9 aa, Homo Sapiens
YPGSQQNPD

SEQ ID NO: 947017 - protein, 9 aa, Homo Sapiens
MDGFWMKVE

SEQ ID NO: 947018 - protein, 9 aa, Homo Sapiens
EEITGTQSP

SEQ ID NO: 947019 - protein, 9 aa, Homo Sapiens
KLFSHRNSS

SEQ ID NO: 947020 - protein, 9 aa, Homo Sapiens
NHLIPGGFL

SEQ ID NO: 947021 - protein, 9 aa, Homo Sapiens
YLLSSKTGT

SEQ ID NO: 947022 - protein, 9 aa, Homo Sapiens
KITVEDSFV

SEQ ID NO: 947023 - protein, 9 aa, Homo Sapiens
PECKFKKSV

SEQ ID NO: 947024 - protein, 9 aa, Homo Sapiens
SETIFDNFL

SEQ ID NO: 947025 - protein, 9 aa, Homo Sapiens
FLIHSRAEQ

SEQ ID NO: 947026 - protein, 9 aa, Homo Sapiens
NRGVVQGQW

SEQ ID NO: 947027 - protein, 9 aa, Homo Sapiens
TLEAKNLIN

SEQ ID NO: 947028 - protein, 9 aa, Homo Sapiens
YETRYLDDL

SEQ ID NO: 947029 - protein, 9 aa, Homo Sapiens
QQVHPENIK

SEQ ID NO: 947030 - protein, 9 aa, Homo Sapiens
CCPRVLPKK

SEQ ID NO: 947031 - protein, 9 aa, Homo Sapiens
LVKSVNIEE

SEQ ID NO: 947032 - protein, 9 aa, Homo Sapiens
LFIEPWELL

SEQ ID NO: 947033 - protein, 9 aa, Homo Sapiens
KNLGPRNRA

SEQ ID NO: 947034 - protein, 9 aa, Homo Sapiens
LPAPERPPE

SEQ ID NO: 947035 - protein, 9 aa, Homo Sapiens
NQAAGQEKK

SEQ ID NO: 947036 - protein, 9 aa, Homo Sapiens
GGLDSRQAL

SEQ ID NO: 947037 - protein, 9 aa, Homo Sapiens
DKLFYVRPV

SEQ ID NO: 947038 - protein, 9 aa, Homo Sapiens
TLKPGNIIH

SEQ ID NO: 947039 - protein, 9 aa, Homo Sapiens
GFPGSPRPR

SEQ ID NO: 947040 - protein, 9 aa, Homo Sapiens
SVYGMNRLP

SEQ ID NO: 947041 - protein, 9 aa, Homo Sapiens
ILPREGPGG

SEQ ID NO: 947042 - protein, 9 aa, Homo Sapiens
EYVVKVSLL

SEQ ID NO: 947043 - protein, 9 aa, Homo Sapiens
ITKFGRKKT

SEQ ID NO: 947044 - protein, 9 aa, Homo Sapiens
NKEAIKLLE

SEQ ID NO: 947045 - protein, 9 aa, Homo Sapiens
EEEASEERE

SEQ ID NO: 947046 - protein, 9 aa, Homo Sapiens
SGCNIIIFA

SEQ ID NO: 947047 - protein, 9 aa, Homo Sapiens
PADTLFSSR

SEQ ID NO: 947048 - protein, 9 aa, Homo Sapiens
TNRKTKVFH

SEQ ID NO: 947049 - protein, 9 aa, Homo Sapiens
PIFDQWTPI

SEQ ID NO: 947050 - protein, 9 aa, Homo Sapiens
HQIADLFQP

SEQ ID NO: 947051 - protein, 9 aa, Homo Sapiens
SSFDSISPE

SEQ ID NO: 947052 - protein, 9 aa, Homo Sapiens
IPWEEGLYA

SEQ ID NO: 947053 - protein, 9 aa, Homo Sapiens
LWQVRSETI

SEQ ID NO: 947054 - protein, 9 aa, Homo Sapiens
LGSNVSIGK

SEQ ID NO: 947055 - protein, 9 aa, Homo Sapiens
HRSHECQGS

SEQ ID NO: 947056 - protein, 9 aa, Homo Sapiens
KRYAEEFAL

SEQ ID NO: 947057 - protein, 9 aa, Homo Sapiens
VKETPLPTI

SEQ ID NO: 947058 - protein, 9 aa, Homo Sapiens
CEHEGGKFE

SEQ ID NO: 947059 - protein, 9 aa, Homo Sapiens
NRVSSKSPF

SEQ ID NO: 947060 - protein, 9 aa, Homo Sapiens
KCCQSKNCS

SEQ ID NO: 947061 - protein, 9 aa, Homo Sapiens
PEQEYKFPE

SEQ ID NO: 947062 - protein, 9 aa, Homo Sapiens
PGAKACGRG

SEQ ID NO: 947063 - protein, 9 aa, Homo Sapiens
NQQFQDLKE

SEQ ID NO: 947064 - protein, 9 aa, Homo Sapiens
DESKEHIEL

SEQ ID NO: 947065 - protein, 9 aa, Homo Sapiens
METAKKEKV

SEQ ID NO: 947066 - protein, 9 aa, Homo Sapiens
VHERHRTIH

SEQ ID NO: 947067 - protein, 9 aa, Homo Sapiens
LFETLLYFD

SEQ ID NO: 947068 - protein, 9 aa, Homo Sapiens
TPDPKKLIQ

SEQ ID NO: 947069 - protein, 9 aa, Homo Sapiens
QEKTTKEEW

SEQ ID NO: 947070 - protein, 9 aa, Homo Sapiens
YADFIKTTL

SEQ ID NO: 947071 - protein, 9 aa, Homo Sapiens
TECTTIEHL

SEQ ID NO: 947072 - protein, 9 aa, Homo Sapiens
ALYVLYPGF

SEQ ID NO: 947073 - protein, 9 aa, Homo Sapiens
ADLSFGSSG

SEQ ID NO: 947074 - protein, 9 aa, Homo Sapiens
DLRFTPISL

SEQ ID NO: 947075 - protein, 9 aa, Homo Sapiens
NITKEAHKT

SEQ ID NO: 947076 - protein, 9 aa, Homo Sapiens
NYETFTIKS

SEQ ID NO: 947077 - protein, 9 aa, Homo Sapiens
FSNARFSWL

SEQ ID NO: 947078 - protein, 9 aa, Homo Sapiens
VGYWAEGLI

SEQ ID NO: 947079 - protein, 9 aa, Homo Sapiens
NLGFILTYA

SEQ ID NO: 947080 - protein, 9 aa, Homo Sapiens
EELPEETVR

SEQ ID NO: 947081 - protein, 9 aa, Homo Sapiens
SLFLLLCLA

SEQ ID NO: 947082 - protein, 9 aa, Homo Sapiens
KKVNLDSCT

SEQ ID NO: 947083 - protein, 9 aa, Homo Sapiens
TITKEIKDE

SEQ ID NO: 947084 - protein, 9 aa, Homo Sapiens
SALPAPKQK

SEQ ID NO: 947085 - protein, 9 aa, Homo Sapiens
AFTYCDLHK

SEQ ID NO: 947086 - protein, 9 aa, Homo Sapiens
EFHVSLLLI

SEQ ID NO: 947087 - protein, 9 aa, Homo Sapiens
KVEDRLRAI

SEQ ID NO: 947088 - protein, 9 aa, Homo Sapiens
GYSHTQENV

SEQ ID NO: 947089 - protein, 9 aa, Homo Sapiens
IFQDPLTSD

SEQ ID NO: 947090 - protein, 9 aa, Homo Sapiens
DLKKCYSSK

SEQ ID NO: 947091 - protein, 9 aa, Homo Sapiens
RHNSPTGGP

SEQ ID NO: 947092 - protein, 9 aa, Homo Sapiens
LPARKPPHE

SEQ ID NO: 947093 - protein, 9 aa, Homo Sapiens
FQITCGSDS

SEQ ID NO: 947094 - protein, 9 aa, Homo Sapiens
VEGKYIWST

SEQ ID NO: 947095 - protein, 9 aa, Homo Sapiens
PTPRGPRRL

SEQ ID NO: 947096 - protein, 9 aa, Homo Sapiens
LKDKHADPD

SEQ ID NO: 947097 - protein, 9 aa, Homo Sapiens
FGMVVCNWV

SEQ ID NO: 947098 - protein, 9 aa, Homo Sapiens
SNCTLHWVN

SEQ ID NO: 947099 - protein, 9 aa, Homo Sapiens
CSCALGWTG

SEQ ID NO: 947100 - protein, 9 aa, Homo Sapiens
VYPIILLFS

SEQ ID NO: 947101 - protein, 9 aa, Homo Sapiens
SKPKSQHWG

SEQ ID NO: 947102 - protein, 9 aa, Homo Sapiens
FAKAFRVKF

SEQ ID NO: 947103 - protein, 9 aa, Homo Sapiens
DIFKNIACL

SEQ ID NO: 947104 - protein, 9 aa, Homo Sapiens
LSDKASEET

SEQ ID NO: 947105 - protein, 9 aa, Homo Sapiens
TDFYNVTWF

SEQ ID NO: 947106 - protein, 9 aa, Homo Sapiens
PLHFAISAG

SEQ ID NO: 947107 - protein, 9 aa, Homo Sapiens
SVNTPSLIT

SEQ ID NO: 947108 - protein, 9 aa, Homo Sapiens
TNLLFALLL

SEQ ID NO: 947109 - protein, 9 aa, Homo Sapiens
QKLKNCTKI

SEQ ID NO: 947110 - protein, 9 aa, Homo Sapiens
SFNEKFQNI

SEQ ID NO: 947111 - protein, 9 aa, Homo Sapiens
CDSSDTPET

SEQ ID NO: 947112 - protein, 9 aa, Homo Sapiens
CNHCEDAGV

SEQ ID NO: 947113 - protein, 9 aa, Homo Sapiens
SPGASDAEL

SEQ ID NO: 947114 - protein, 9 aa, Homo Sapiens
AVIYYLLLE

SEQ ID NO: 947115 - protein, 9 aa, Homo Sapiens
KCQLRAQKQ

SEQ ID NO: 947116 - protein, 9 aa, Homo Sapiens
LCKHGFTGD

SEQ ID NO: 947117 - protein, 9 aa, Homo Sapiens
PETPIVPVP

SEQ ID NO: 947118 - protein, 9 aa, Homo Sapiens
KLHDFFSYF

SEQ ID NO: 947119 - protein, 9 aa, Homo Sapiens
ARGPRAGST

SEQ ID NO: 947120 - protein, 9 aa, Homo Sapiens
YFDLSAGLM

SEQ ID NO: 947121 - protein, 9 aa, Homo Sapiens
LKSEDKMKA

SEQ ID NO: 947122 - protein, 9 aa, Homo Sapiens
PKGTVGKIS

SEQ ID NO: 947123 - protein, 9 aa, Homo Sapiens
EPSDEAPMK

SEQ ID NO: 947124 - protein, 9 aa, Homo Sapiens
FIVKPLVRK

SEQ ID NO: 947125 - protein, 9 aa, Homo Sapiens
GNCCGGVRN

SEQ ID NO: 947126 - protein, 9 aa, Homo Sapiens
VQQRAWEAE

SEQ ID NO: 947127 - protein, 9 aa, Homo Sapiens
FLNQGNTWS

SEQ ID NO: 947128 - protein, 9 aa, Homo Sapiens
GQLVSGGLA

SEQ ID NO: 947129 - protein, 9 aa, Homo Sapiens
LSTASDPQH

SEQ ID NO: 947130 - protein, 9 aa, Homo Sapiens
WKEISGVDE

SEQ ID NO: 947131 - protein, 9 aa, Homo Sapiens
ACHGDIIPW

SEQ ID NO: 947132 - protein, 9 aa, Homo Sapiens
AVLFLTTTF

SEQ ID NO: 947133 - protein, 9 aa, Homo Sapiens
TAHKPVISV

SEQ ID NO: 947134 - protein, 9 aa, Homo Sapiens
WIYAAYPHS

SEQ ID NO: 947135 - protein, 9 aa, Homo Sapiens
PGSRDVVDR

SEQ ID NO: 947136 - protein, 9 aa, Homo Sapiens
ADIKTSYLS

SEQ ID NO: 947137 - protein, 9 aa, Homo Sapiens
YFLHNPAGT

SEQ ID NO: 947138 - protein, 9 aa, Homo Sapiens
DSRTQQWTA

SEQ ID NO: 947139 - protein, 9 aa, Homo Sapiens
LIIDNGSGM

SEQ ID NO: 947140 - protein, 9 aa, Homo Sapiens
LDPGLTAPL

SEQ ID NO: 947141 - protein, 9 aa, Homo Sapiens
PDLYALEHT

SEQ ID NO: 947142 - protein, 9 aa, Homo Sapiens
QPLTSKKEE

SEQ ID NO: 947143 - protein, 9 aa, Homo Sapiens
VVLKLACAD

SEQ ID NO: 947144 - protein, 9 aa, Homo Sapiens
TPEGFTILV

SEQ ID NO: 947145 - protein, 9 aa, Homo Sapiens
STFISALQN

SEQ ID NO: 947146 - protein, 9 aa, Homo Sapiens
ELVVLSFPR

SEQ ID NO: 947147 - protein, 9 aa, Homo Sapiens
TIEHLFCMY

SEQ ID NO: 947148 - protein, 9 aa, Homo Sapiens
YPFIEALLP

SEQ ID NO: 947149 - protein, 9 aa, Homo Sapiens
HQKLTVNNE

SEQ ID NO: 947150 - protein, 9 aa, Homo Sapiens
YMRCDRKIE

SEQ ID NO: 947151 - protein, 9 aa, Homo Sapiens
LDFFWKLQA

SEQ ID NO: 947152 - protein, 9 aa, Homo Sapiens
VQSFDEKEG

SEQ ID NO: 947153 - protein, 9 aa, Homo Sapiens
EEMKKTKGQ

SEQ ID NO: 947154 - protein, 9 aa, Homo Sapiens
SSEKEEGPF

SEQ ID NO: 947155 - protein, 9 aa, Homo Sapiens
TKRQLRECT

SEQ ID NO: 947156 - protein, 9 aa, Homo Sapiens
TVIQKAYWS

SEQ ID NO: 947157 - protein, 9 aa, Homo Sapiens
QAVRDTTTL

SEQ ID NO: 947158 - protein, 9 aa, Homo Sapiens
FTVSTLRNL

SEQ ID NO: 947159 - protein, 9 aa, Homo Sapiens
TIDKPNAIV

SEQ ID NO: 947160 - protein, 9 aa, Homo Sapiens
DKENKFKSL

SEQ ID NO: 947161 - protein, 9 aa, Homo Sapiens
PGSLFWFAV

SEQ ID NO: 947162 - protein, 9 aa, Homo Sapiens
TLPLTEKQC

SEQ ID NO: 947163 - protein, 9 aa, Homo Sapiens
VNEISWVIE

SEQ ID NO: 947164 - protein, 9 aa, Homo Sapiens
GSVRSGLGT

SEQ ID NO: 947165 - protein, 9 aa, Homo Sapiens
GGSSWGCWY

SEQ ID NO: 947166 - protein, 9 aa, Homo Sapiens
ATLPAELQT

SEQ ID NO: 947167 - protein, 9 aa, Homo Sapiens
KKAPREHLD

SEQ ID NO: 947168 - protein, 9 aa, Homo Sapiens
FHKEIAAAC

SEQ ID NO: 947169 - protein, 9 aa, Homo Sapiens
PPLRLTPVK

SEQ ID NO: 947170 - protein, 9 aa, Homo Sapiens
HNPMPCGSG

SEQ ID NO: 947171 - protein, 9 aa, Homo Sapiens
EDDKDSKQN

SEQ ID NO: 947172 - protein, 9 aa, Homo Sapiens
LSGFSGQFC

SEQ ID NO: 947173 - protein, 9 aa, Homo Sapiens
ADHLNGLLW

SEQ ID NO: 947174 - protein, 9 aa, Homo Sapiens
NRPSSASFT

SEQ ID NO: 947175 - protein, 9 aa, Homo Sapiens
KEARTTPGR

SEQ ID NO: 947176 - protein, 9 aa, Homo Sapiens
SLITHSLYG

SEQ ID NO: 947177 - protein, 9 aa, Homo Sapiens
FTYCDLHKI

SEQ ID NO: 947178 - protein, 9 aa, Homo Sapiens
DSFASHSNY

SEQ ID NO: 947179 - protein, 9 aa, Homo Sapiens
KKFLKRDMD

SEQ ID NO: 947180 - protein, 9 aa, Homo Sapiens
TFSDDLSPG

SEQ ID NO: 947181 - protein, 9 aa, Homo Sapiens
RRLSGPAEL

SEQ ID NO: 947182 - protein, 9 aa, Homo Sapiens
GNVRLYFIL

SEQ ID NO: 947183 - protein, 9 aa, Homo Sapiens
LLLSTSKID

SEQ ID NO: 947184 - protein, 9 aa, Homo Sapiens
PREPQGLQG

SEQ ID NO: 947185 - protein, 9 aa, Homo Sapiens
MAASGFTDK

SEQ ID NO: 947186 - protein, 9 aa, Homo Sapiens
PQNESNLEL

SEQ ID NO: 947187 - protein, 9 aa, Homo Sapiens
NYKCCQSKN

SEQ ID NO: 947188 - protein, 9 aa, Homo Sapiens
EWQQQRLPK

SEQ ID NO: 947189 - protein, 9 aa, Homo Sapiens
GMWNNIAAA

SEQ ID NO: 947190 - protein, 9 aa, Homo Sapiens
IKKQTLKSL

SEQ ID NO: 947191 - protein, 9 aa, Homo Sapiens
KVMRTLESQ

SEQ ID NO: 947192 - protein, 9 aa, Homo Sapiens
LLLCKFADG

SEQ ID NO: 947193 - protein, 9 aa, Homo Sapiens
VLESDDVGH

SEQ ID NO: 947194 - protein, 9 aa, Homo Sapiens
LNSASLQCE

SEQ ID NO: 947195 - protein, 9 aa, Homo Sapiens
YFSEGMSET

SEQ ID NO: 947196 - protein, 9 aa, Homo Sapiens
GITNRKTKV

SEQ ID NO: 947197 - protein, 9 aa, Homo Sapiens
WRPPQGPVF

SEQ ID NO: 947198 - protein, 9 aa, Homo Sapiens
NLFHLQLHW

SEQ ID NO: 947199 - protein, 9 aa, Homo Sapiens
IGIHPHPYP

SEQ ID NO: 947200 - protein, 9 aa, Homo Sapiens
SVRQNKSNC

SEQ ID NO: 947201 - protein, 9 aa, Homo Sapiens
SGFKKKFKE

SEQ ID NO: 947202 - protein, 9 aa, Homo Sapiens
NDKYNLVGA

SEQ ID NO: 947203 - protein, 9 aa, Homo Sapiens
WFVQFSWLI

SEQ ID NO: 947204 - protein, 9 aa, Homo Sapiens
AGVLSCLAL

SEQ ID NO: 947205 - protein, 9 aa, Homo Sapiens
SLVLFYKTY

SEQ ID NO: 947206 - protein, 9 aa, Homo Sapiens
NFSSAKDNS

SEQ ID NO: 947207 - protein, 9 aa, Homo Sapiens
RSLRHNNWR

SEQ ID NO: 947208 - protein, 9 aa, Homo Sapiens
VFCHKDRQL

SEQ ID NO: 947209 - protein, 9 aa, Homo Sapiens
LNALPSVLL

SEQ ID NO: 947210 - protein, 9 aa, Homo Sapiens
MSTFISALQ

SEQ ID NO: 947211 - protein, 9 aa, Homo Sapiens
TPTKGSVYG

SEQ ID NO: 947212 - protein, 9 aa, Homo Sapiens
CYVDPEKQR

SEQ ID NO: 947213 - protein, 9 aa, Homo Sapiens
VMGLHDVDQ

SEQ ID NO: 947214 - protein, 9 aa, Homo Sapiens
PVTCALLHQ

SEQ ID NO: 947215 - protein, 9 aa, Homo Sapiens
HDLEIILLS

SEQ ID NO: 947216 - protein, 9 aa, Homo Sapiens
VVPVLAWPF

SEQ ID NO: 947217 - protein, 9 aa, Homo Sapiens
NLYYATLPF

SEQ ID NO: 947218 - protein, 9 aa, Homo Sapiens
LTMIISYFG

SEQ ID NO: 947219 - protein, 9 aa, Homo Sapiens
NMFYINPEK

SEQ ID NO: 947220 - protein, 9 aa, Homo Sapiens
PCVSYLGMY

SEQ ID NO: 947221 - protein, 9 aa, Homo Sapiens
EQCHLLNNG

SEQ ID NO: 947222 - protein, 9 aa, Homo Sapiens
VNYTFDRNV

SEQ ID NO: 947223 - protein, 9 aa, Homo Sapiens
REMKKKVED

SEQ ID NO: 947224 - protein, 9 aa, Homo Sapiens
KAAPVSSKS

SEQ ID NO: 947225 - protein, 9 aa, Homo Sapiens
FKAYLSAHL

SEQ ID NO: 947226 - protein, 9 aa, Homo Sapiens
PGYEMNLNA

SEQ ID NO: 947227 - protein, 9 aa, Homo Sapiens
KAGVGEPVE

SEQ ID NO: 947228 - protein, 9 aa, Homo Sapiens
NLNLRYCMG

SEQ ID NO: 947229 - protein, 9 aa, Homo Sapiens
LRLLEHEET

SEQ ID NO: 947230 - protein, 9 aa, Homo Sapiens
KMNRLFSGK

SEQ ID NO: 947231 - protein, 9 aa, Homo Sapiens
ENQNRFESL

SEQ ID NO: 947232 - protein, 9 aa, Homo Sapiens
PIPVLPIVH

SEQ ID NO: 947233 - protein, 9 aa, Homo Sapiens
ERIVAAFFE

SEQ ID NO: 947234 - protein, 9 aa, Homo Sapiens
RQTRNKKQS

SEQ ID NO: 947235 - protein, 9 aa, Homo Sapiens
INPTAGSFT

SEQ ID NO: 947236 - protein, 9 aa, Homo Sapiens
AKQNGHVIK

SEQ ID NO: 947237 - protein, 9 aa, Homo Sapiens
KDSKQNIFH

SEQ ID NO: 947238 - protein, 9 aa, Homo Sapiens
SSVNTPSLI

SEQ ID NO: 947239 - protein, 9 aa, Homo Sapiens
YTVEVLLSD

SEQ ID NO: 947240 - protein, 9 aa, Homo Sapiens
GKEFLLGFI

SEQ ID NO: 947241 - protein, 9 aa, Homo Sapiens
DKGLLPPNL

SEQ ID NO: 947242 - protein, 9 aa, Homo Sapiens
AAALRVVAA

SEQ ID NO: 947243 - protein, 9 aa, Homo Sapiens
RQILRQKVE

SEQ ID NO: 947244 - protein, 9 aa, Homo Sapiens
LLVRLVRSM

SEQ ID NO: 947245 - protein, 9 aa, Homo Sapiens
DYKDSSNFG

SEQ ID NO: 947246 - protein, 9 aa, Homo Sapiens
FILFLMAAF

SEQ ID NO: 947247 - protein, 9 aa, Homo Sapiens
PFPIGDKVI

SEQ ID NO: 947248 - protein, 9 aa, Homo Sapiens
SEENTKSFG

SEQ ID NO: 947249 - protein, 9 aa, Homo Sapiens
FCLFSESFV

SEQ ID NO: 947250 - protein, 9 aa, Homo Sapiens
DGILFGIVG

SEQ ID NO: 947251 - protein, 9 aa, Homo Sapiens
PATNQCTIN

SEQ ID NO: 947252 - protein, 9 aa, Homo Sapiens
EYPKSSGPA

SEQ ID NO: 947253 - protein, 9 aa, Homo Sapiens
AVVEKNYTE

SEQ ID NO: 947254 - protein, 9 aa, Homo Sapiens
SPITIVYEI

SEQ ID NO: 947255 - protein, 9 aa, Homo Sapiens
VSSHLQAET

SEQ ID NO: 947256 - protein, 9 aa, Homo Sapiens
SLFWFAVPP

SEQ ID NO: 947257 - protein, 9 aa, Homo Sapiens
GKQEMVCVL

SEQ ID NO: 947258 - protein, 9 aa, Homo Sapiens
QGLMMRPGL

SEQ ID NO: 947259 - protein, 9 aa, Homo Sapiens
NKKKWLYAL

SEQ ID NO: 947260 - protein, 9 aa, Homo Sapiens
EVMRRHQKP

SEQ ID NO: 947261 - protein, 9 aa, Homo Sapiens
DDAAPTNGQ

SEQ ID NO: 947262 - protein, 9 aa, Homo Sapiens
PQPCLVRMY

SEQ ID NO: 947263 - protein, 9 aa, Homo Sapiens
NGYLLAFKA

SEQ ID NO: 947264 - protein, 9 aa, Homo Sapiens
THGPFCDQN

SEQ ID NO: 947265 - protein, 9 aa, Homo Sapiens
DTSCQGNLP

SEQ ID NO: 947266 - protein, 9 aa, Homo Sapiens
FELLLRDLE

SEQ ID NO: 947267 - protein, 9 aa, Homo Sapiens
ELQKKKQSM

SEQ ID NO: 947268 - protein, 9 aa, Homo Sapiens
GRSFCDKSI

SEQ ID NO: 947269 - protein, 9 aa, Homo Sapiens
TFFLTFPEE

SEQ ID NO: 947270 - protein, 9 aa, Homo Sapiens
IILLRAMAA

SEQ ID NO: 947271 - protein, 9 aa, Homo Sapiens
FSEHDGDEQ

SEQ ID NO: 947272 - protein, 9 aa, Homo Sapiens
PEERRLPPA

SEQ ID NO: 947273 - protein, 9 aa, Homo Sapiens
TSILVSLTV

SEQ ID NO: 947274 - protein, 9 aa, Homo Sapiens
VAAAASASL

SEQ ID NO: 947275 - protein, 9 aa, Homo Sapiens
SFGVSASGK

SEQ ID NO: 947276 - protein, 9 aa, Homo Sapiens
SVLPSVPQN

SEQ ID NO: 947277 - protein, 9 aa, Homo Sapiens
KGRGILNIE

SEQ ID NO: 947278 - protein, 9 aa, Homo Sapiens
LDTVEGLVL

SEQ ID NO: 947279 - protein, 9 aa, Homo Sapiens
FGLTVTEKL

SEQ ID NO: 947280 - protein, 9 aa, Homo Sapiens
LAKIFSEHA

SEQ ID NO: 947281 - protein, 9 aa, Homo Sapiens
SKYEEIYSP

SEQ ID NO: 947282 - protein, 9 aa, Homo Sapiens
RKSCYSTEY

SEQ ID NO: 947283 - protein, 9 aa, Homo Sapiens
KKKSDTAGE

SEQ ID NO: 947284 - protein, 9 aa, Homo Sapiens
ASACNLFLT

SEQ ID NO: 947285 - protein, 9 aa, Homo Sapiens
YLCVGNKWV

SEQ ID NO: 947286 - protein, 9 aa, Homo Sapiens
PFRCISRTG

SEQ ID NO: 947287 - protein, 9 aa, Homo Sapiens
ERSSGNIFH

SEQ ID NO: 947288 - protein, 9 aa, Homo Sapiens
SRRNLSDFW

SEQ ID NO: 947289 - protein, 9 aa, Homo Sapiens
PKEAPKFFS

SEQ ID NO: 947290 - protein, 9 aa, Homo Sapiens
QFVEEALKK

SEQ ID NO: 947291 - protein, 9 aa, Homo Sapiens
PGLPLHDLA

SEQ ID NO: 947292 - protein, 9 aa, Homo Sapiens
TKLKENTMQ

SEQ ID NO: 947293 - protein, 9 aa, Homo Sapiens
PPPALDREL

SEQ ID NO: 947294 - protein, 9 aa, Homo Sapiens
KGLNSGTLN

SEQ ID NO: 947295 - protein, 9 aa, Homo Sapiens
CTINKNRRK

SEQ ID NO: 947296 - protein, 9 aa, Homo Sapiens
LEGYYYNSF

SEQ ID NO: 947297 - protein, 9 aa, Homo Sapiens
AYCAIQGDL

SEQ ID NO: 947298 - protein, 9 aa, Homo Sapiens
FGLPWIYAA

SEQ ID NO: 947299 - protein, 9 aa, Homo Sapiens
SQPGLQMPG

SEQ ID NO: 947300 - protein, 9 aa, Homo Sapiens
VFPTLFRVI

SEQ ID NO: 947301 - protein, 9 aa, Homo Sapiens
RRELEPKSP

SEQ ID NO: 947302 - protein, 9 aa, Homo Sapiens
QKLLETRAQ

SEQ ID NO: 947303 - protein, 9 aa, Homo Sapiens
LLYSYFSPL

SEQ ID NO: 947304 - protein, 9 aa, Homo Sapiens
GLLKLLARA

SEQ ID NO: 947305 - protein, 9 aa, Homo Sapiens
KIFSEHART

SEQ ID NO: 947306 - protein, 9 aa, Homo Sapiens
DLPVTCALL

SEQ ID NO: 947307 - protein, 9 aa, Homo Sapiens
RKAPPKHFH

SEQ ID NO: 947308 - protein, 9 aa, Homo Sapiens
LGMPELRLG

SEQ ID NO: 947309 - protein, 9 aa, Homo Sapiens
KLLGQFFEK

SEQ ID NO: 947310 - protein, 9 aa, Homo Sapiens
VSFRHVKEG

SEQ ID NO: 947311 - protein, 9 aa, Homo Sapiens
LAFRKNPPP

SEQ ID NO: 947312 - protein, 9 aa, Homo Sapiens
TDPNHTSSQ

SEQ ID NO: 947313 - protein, 9 aa, Homo Sapiens
KAGSEKADS

SEQ ID NO: 947314 - protein, 9 aa, Homo Sapiens
EKFSNLPPR

SEQ ID NO: 947315 - protein, 9 aa, Homo Sapiens
TPEPEAREV

SEQ ID NO: 947316 - protein, 9 aa, Homo Sapiens
KGDYKDSSN

SEQ ID NO: 947317 - protein, 9 aa, Homo Sapiens
GRVLWNSEQ

SEQ ID NO: 947318 - protein, 9 aa, Homo Sapiens
TAPLDFGYE

SEQ ID NO: 947319 - protein, 9 aa, Homo Sapiens
CQGSGRPRP

SEQ ID NO: 947320 - protein, 9 aa, Homo Sapiens
QFLHLHSGS

SEQ ID NO: 947321 - protein, 9 aa, Homo Sapiens
HAGGRPARA

SEQ ID NO: 947322 - protein, 9 aa, Homo Sapiens
LTDLMTVTK

SEQ ID NO: 947323 - protein, 9 aa, Homo Sapiens
HLLPDLYAL

SEQ ID NO: 947324 - protein, 9 aa, Homo Sapiens
YTVLMHPCF

SEQ ID NO: 947325 - protein, 9 aa, Homo Sapiens
NAASSKEAF

SEQ ID NO: 947326 - protein, 9 aa, Homo Sapiens
LVIFLLFIN

SEQ ID NO: 947327 - protein, 9 aa, Homo Sapiens
DRYTRNWFK

SEQ ID NO: 947328 - protein, 9 aa, Homo Sapiens
SPGGGAPWH

SEQ ID NO: 947329 - protein, 9 aa, Homo Sapiens
SFVGGAKFD

SEQ ID NO: 947330 - protein, 9 aa, Homo Sapiens
YSPFRCISR

SEQ ID NO: 947331 - protein, 9 aa, Homo Sapiens
NFITWCLIM

SEQ ID NO: 947332 - protein, 9 aa, Homo Sapiens
CFLLIPLSY

SEQ ID NO: 947333 - protein, 9 aa, Homo Sapiens
SILEEKFSN

SEQ ID NO: 947334 - protein, 9 aa, Homo Sapiens
ILPAPQLGA

SEQ ID NO: 947335 - protein, 9 aa, Homo Sapiens
PLRPRIKCQ

SEQ ID NO: 947336 - protein, 9 aa, Homo Sapiens
TCDEFRSQI

SEQ ID NO: 947337 - protein, 9 aa, Homo Sapiens
NKVMYVRVS

SEQ ID NO: 947338 - protein, 9 aa, Homo Sapiens
LRNFLKCFE

SEQ ID NO: 947339 - protein, 9 aa, Homo Sapiens
GIIKQQRVN

SEQ ID NO: 947340 - protein, 9 aa, Homo Sapiens
ACEETPEKI

SEQ ID NO: 947341 - protein, 9 aa, Homo Sapiens
KGREMSLVG

SEQ ID NO: 947342 - protein, 9 aa, Homo Sapiens
WLYKKKEKE

SEQ ID NO: 947343 - protein, 9 aa, Homo Sapiens
RVFDAGDYF

SEQ ID NO: 947344 - protein, 9 aa, Homo Sapiens
TNSRNAWRE

SEQ ID NO: 947345 - protein, 9 aa, Homo Sapiens
NHCEDAGVI

SEQ ID NO: 947346 - protein, 9 aa, Homo Sapiens
VLGGAFLIM

SEQ ID NO: 947347 - protein, 9 aa, Homo Sapiens
NRHCVVYTG

SEQ ID NO: 947348 - protein, 9 aa, Homo Sapiens
ICHLLHYRI

SEQ ID NO: 947349 - protein, 9 aa, Homo Sapiens
DDMPRSAEY

SEQ ID NO: 947350 - protein, 9 aa, Homo Sapiens
NWFSIFNPE

SEQ ID NO: 947351 - protein, 9 aa, Homo Sapiens
ELPAPERPP

SEQ ID NO: 947352 - protein, 9 aa, Homo Sapiens
EYRASEEKT

SEQ ID NO: 947353 - protein, 9 aa, Homo Sapiens
AAFFEDGEG

SEQ ID NO: 947354 - protein, 9 aa, Homo Sapiens
LYPALIQRP

SEQ ID NO: 947355 - protein, 9 aa, Homo Sapiens
RILPAPQLG

SEQ ID NO: 947356 - protein, 9 aa, Homo Sapiens
IAFVTFFYC

SEQ ID NO: 947357 - protein, 9 aa, Homo Sapiens
ETNSSLIIV

SEQ ID NO: 947358 - protein, 9 aa, Homo Sapiens
PGNIIHYIF

SEQ ID NO: 947359 - protein, 9 aa, Homo Sapiens
WSGYSHTQE

SEQ ID NO: 947360 - protein, 9 aa, Homo Sapiens
EKAFLEHLQ

SEQ ID NO: 947361 - protein, 9 aa, Homo Sapiens
QVGNYCFLP

SEQ ID NO: 947362 - protein, 9 aa, Homo Sapiens
LFLGSLSKD

SEQ ID NO: 947363 - protein, 9 aa, Homo Sapiens
AGALIEEHA

SEQ ID NO: 947364 - protein, 9 aa, Homo Sapiens
FTDVANAIY

SEQ ID NO: 947365 - protein, 9 aa, Homo Sapiens
KIRISKIGG

SEQ ID NO: 947366 - protein, 9 aa, Homo Sapiens
LETVIKGKG

SEQ ID NO: 947367 - protein, 9 aa, Homo Sapiens
EPSKLKRFY

SEQ ID NO: 947368 - protein, 9 aa, Homo Sapiens
GSKRGCVFC

SEQ ID NO: 947369 - protein, 9 aa, Homo Sapiens
LSCNFLRRP

SEQ ID NO: 947370 - protein, 9 aa, Homo Sapiens
TCHCCRDEV

SEQ ID NO: 947371 - protein, 9 aa, Homo Sapiens
KLQELSKVE

SEQ ID NO: 947372 - protein, 9 aa, Homo Sapiens
FETASSTGN

SEQ ID NO: 947373 - protein, 9 aa, Homo Sapiens
ILMNLEYMI

SEQ ID NO: 947374 - protein, 9 aa, Homo Sapiens
RGWFHGKEF

SEQ ID NO: 947375 - protein, 9 aa, Homo Sapiens
KDVDPTSVT

SEQ ID NO: 947376 - protein, 9 aa, Homo Sapiens
LQEEKGKKG

SEQ ID NO: 947377 - protein, 9 aa, Homo Sapiens
QYLPLWMML

SEQ ID NO: 947378 - protein, 9 aa, Homo Sapiens
NFLKCFEDN

SEQ ID NO: 947379 - protein, 9 aa, Homo Sapiens
NNRGVVQGQ

SEQ ID NO: 947380 - protein, 9 aa, Homo Sapiens
SLAWGSWTS

SEQ ID NO: 947381 - protein, 9 aa, Homo Sapiens
WPASQQILY

SEQ ID NO: 947382 - protein, 9 aa, Homo Sapiens
LCADPYKLG

SEQ ID NO: 947383 - protein, 9 aa, Homo Sapiens
PAGPKSRAA

SEQ ID NO: 947384 - protein, 9 aa, Homo Sapiens
IILQSVGPV

SEQ ID NO: 947385 - protein, 9 aa, Homo Sapiens
KPQVPFSDY

SEQ ID NO: 947386 - protein, 9 aa, Homo Sapiens
AFAFEIIQK

SEQ ID NO: 947387 - protein, 9 aa, Homo Sapiens
TLSQDEEEG

SEQ ID NO: 947388 - protein, 9 aa, Homo Sapiens
FLEIVDNFW

SEQ ID NO: 947389 - protein, 9 aa, Homo Sapiens
ILGVKRNIP

SEQ ID NO: 947390 - protein, 9 aa, Homo Sapiens
TRPINLESI

SEQ ID NO: 947391 - protein, 9 aa, Homo Sapiens
TTAWGGNYW

SEQ ID NO: 947392 - protein, 9 aa, Homo Sapiens
KSPKPTAPS

SEQ ID NO: 947393 - protein, 9 aa, Homo Sapiens
VLLHLAPSC

SEQ ID NO: 947394 - protein, 9 aa, Homo Sapiens
LSEDNSLGE

SEQ ID NO: 947395 - protein, 9 aa, Homo Sapiens
KKKRKHQHY

SEQ ID NO: 947396 - protein, 9 aa, Homo Sapiens
LEVFPGAPA

SEQ ID NO: 947397 - protein, 9 aa, Homo Sapiens
VLSQFKRMK

SEQ ID NO: 947398 - protein, 9 aa, Homo Sapiens
ALRMIQLAT

SEQ ID NO: 947399 - protein, 9 aa, Homo Sapiens
ILFVQTLMH

SEQ ID NO: 947400 - protein, 9 aa, Homo Sapiens
DYFLLCSGP

SEQ ID NO: 947401 - protein, 9 aa, Homo Sapiens
KWNNITKEA

SEQ ID NO: 947402 - protein, 9 aa, Homo Sapiens
LDQWSQKKK

SEQ ID NO: 947403 - protein, 9 aa, Homo Sapiens
DFPDFGQEV

SEQ ID NO: 947404 - protein, 9 aa, Homo Sapiens
KTDHVTPMI

SEQ ID NO: 947405 - protein, 9 aa, Homo Sapiens
EELGHLQNN

SEQ ID NO: 947406 - protein, 9 aa, Homo Sapiens
SEEEELTTG

SEQ ID NO: 947407 - protein, 9 aa, Homo Sapiens
PTKREVLLP

SEQ ID NO: 947408 - protein, 9 aa, Homo Sapiens
FVMLAAHCV

SEQ ID NO: 947409 - protein, 9 aa, Homo Sapiens
KQATLNSAS

SEQ ID NO: 947410 - protein, 9 aa, Homo Sapiens
LFINLYIED

SEQ ID NO: 947411 - protein, 9 aa, Homo Sapiens
GEAPRGGLF

SEQ ID NO: 947412 - protein, 9 aa, Homo Sapiens
KETPESDRA

SEQ ID NO: 947413 - protein, 9 aa, Homo Sapiens
VLLPLCPIW

SEQ ID NO: 947414 - protein, 9 aa, Homo Sapiens
PYNVACCVK

SEQ ID NO: 947415 - protein, 9 aa, Homo Sapiens
IEPSVFLWQ

SEQ ID NO: 947416 - protein, 9 aa, Homo Sapiens
PGQAKFIAS

SEQ ID NO: 947417 - protein, 9 aa, Homo Sapiens
PNSKTDHVT

SEQ ID NO: 947418 - protein, 9 aa, Homo Sapiens
RKIVGSATR

SEQ ID NO: 947419 - protein, 9 aa, Homo Sapiens
SQNIAKDEF

SEQ ID NO: 947420 - protein, 9 aa, Homo Sapiens
FLQIGFFCI

SEQ ID NO: 947421 - protein, 9 aa, Homo Sapiens
LRKDLFFSR

SEQ ID NO: 947422 - protein, 9 aa, Homo Sapiens
ITQAEDINP

SEQ ID NO: 947423 - protein, 9 aa, Homo Sapiens
HTLSQLEGL

SEQ ID NO: 947424 - protein, 9 aa, Homo Sapiens
DGLRVWFTD

SEQ ID NO: 947425 - protein, 9 aa, Homo Sapiens
EAGEILFYN

SEQ ID NO: 947426 - protein, 9 aa, Homo Sapiens
LESSPPVEL

SEQ ID NO: 947427 - protein, 9 aa, Homo Sapiens
ETVLQVQCT

SEQ ID NO: 947428 - protein, 9 aa, Homo Sapiens
QALAQRDKE

SEQ ID NO: 947429 - protein, 9 aa, Homo Sapiens
AKEFCSANG

SEQ ID NO: 947430 - protein, 9 aa, Homo Sapiens
TIATCTTNK

SEQ ID NO: 947431 - protein, 9 aa, Homo Sapiens
LDLHKQEAP

SEQ ID NO: 947432 - protein, 9 aa, Homo Sapiens
PWWRESSLL

SEQ ID NO: 947433 - protein, 9 aa, Homo Sapiens
INLLTSDSP

SEQ ID NO: 947434 - protein, 9 aa, Homo Sapiens
SKDSRPLCH

SEQ ID NO: 947435 - protein, 9 aa, Homo Sapiens
IKFLGDIKR

SEQ ID NO: 947436 - protein, 9 aa, Homo Sapiens
EIMVVLKLA

SEQ ID NO: 947437 - protein, 9 aa, Homo Sapiens
TVTILALCF

SEQ ID NO: 947438 - protein, 9 aa, Homo Sapiens
DDWVTDSRF

SEQ ID NO: 947439 - protein, 9 aa, Homo Sapiens
KATVIRGHE

SEQ ID NO: 947440 - protein, 9 aa, Homo Sapiens
VPSLFLLLC

SEQ ID NO: 947441 - protein, 9 aa, Homo Sapiens
FIAAQGLKQ

SEQ ID NO: 947442 - protein, 9 aa, Homo Sapiens
KKCIPMDFQ

SEQ ID NO: 947443 - protein, 9 aa, Homo Sapiens
ELSLDVKRM

SEQ ID NO: 947444 - protein, 9 aa, Homo Sapiens
YKKIHTGEK

SEQ ID NO: 947445 - protein, 9 aa, Homo Sapiens
KPPASGGSP

SEQ ID NO: 947446 - protein, 9 aa, Homo Sapiens
NEKGLPILV

SEQ ID NO: 947447 - protein, 9 aa, Homo Sapiens
GKIQKGREM

SEQ ID NO: 947448 - protein, 9 aa, Homo Sapiens
EKESFLSNK

SEQ ID NO: 947449 - protein, 9 aa, Homo Sapiens
VKMFRFTRV

SEQ ID NO: 947450 - protein, 9 aa, Homo Sapiens
PLGEAGVGG

SEQ ID NO: 947451 - protein, 9 aa, Homo Sapiens
KFLKSIVMH

SEQ ID NO: 947452 - protein, 9 aa, Homo Sapiens
HGWKEISGV

SEQ ID NO: 947453 - protein, 9 aa, Homo Sapiens
SEEKTVEVP

SEQ ID NO: 947454 - protein, 9 aa, Homo Sapiens
MLFSFGPLN

SEQ ID NO: 947455 - protein, 9 aa, Homo Sapiens
VPGGREQPA

SEQ ID NO: 947456 - protein, 9 aa, Homo Sapiens
LRELLLGAF

SEQ ID NO: 947457 - protein, 9 aa, Homo Sapiens
TVDLAIGFE

SEQ ID NO: 947458 - protein, 9 aa, Homo Sapiens
GFQTTMLEG

SEQ ID NO: 947459 - protein, 9 aa, Homo Sapiens
FNMPLQGPG

SEQ ID NO: 947460 - protein, 9 aa, Homo Sapiens
AINRVSSKS

SEQ ID NO: 947461 - protein, 9 aa, Homo Sapiens
RCYPGFDLV

SEQ ID NO: 947462 - protein, 9 aa, Homo Sapiens
ASSSSTIAE

SEQ ID NO: 947463 - protein, 9 aa, Homo Sapiens
GQEKKGKAG

SEQ ID NO: 947464 - protein, 9 aa, Homo Sapiens
LEDSGFKKK

SEQ ID NO: 947465 - protein, 9 aa, Homo Sapiens
DAFHIFQDP

SEQ ID NO: 947466 - protein, 9 aa, Homo Sapiens
LRLIRKALE

SEQ ID NO: 947467 - protein, 9 aa, Homo Sapiens
YESITLQSD

SEQ ID NO: 947468 - protein, 9 aa, Homo Sapiens
PKMDFKINI

SEQ ID NO: 947469 - protein, 9 aa, Homo Sapiens
RLEEPAGPK

SEQ ID NO: 947470 - protein, 9 aa, Homo Sapiens
KTSKLTFYR

SEQ ID NO: 947471 - protein, 9 aa, Homo Sapiens
SASLYGASG

SEQ ID NO: 947472 - protein, 9 aa, Homo Sapiens
SASLPSSGK

SEQ ID NO: 947473 - protein, 9 aa, Homo Sapiens
LSPKEHPVL

SEQ ID NO: 947474 - protein, 9 aa, Homo Sapiens
EKADTRTLM

SEQ ID NO: 947475 - protein, 9 aa, Homo Sapiens
RELILQDAF

SEQ ID NO: 947476 - protein, 9 aa, Homo Sapiens
LGPYVFIAC

SEQ ID NO: 947477 - protein, 9 aa, Homo Sapiens
KKSISNAAS

SEQ ID NO: 947478 - protein, 9 aa, Homo Sapiens
PKKRFSKHS

SEQ ID NO: 947479 - protein, 9 aa, Homo Sapiens
GDVVNILAG

SEQ ID NO: 947480 - protein, 9 aa, Homo Sapiens
ALTCACPSH

SEQ ID NO: 947481 - protein, 9 aa, Homo Sapiens
YHHHCINCV

SEQ ID NO: 947482 - protein, 9 aa, Homo Sapiens
IKCSHEQSV

SEQ ID NO: 947483 - protein, 9 aa, Homo Sapiens
RSSNITATT

SEQ ID NO: 947484 - protein, 9 aa, Homo Sapiens
WDTVTLEAK

SEQ ID NO: 947485 - protein, 9 aa, Homo Sapiens
ATPSLGHTC

SEQ ID NO: 947486 - protein, 9 aa, Homo Sapiens
AQVLIREVL

SEQ ID NO: 947487 - protein, 9 aa, Homo Sapiens
IRRQKQPRL

SEQ ID NO: 947488 - protein, 9 aa, Homo Sapiens
FFSNIANIP

SEQ ID NO: 947489 - protein, 9 aa, Homo Sapiens
KKVEDLHVG

SEQ ID NO: 947490 - protein, 9 aa, Homo Sapiens
ENPKPEIIW

SEQ ID NO: 947491 - protein, 9 aa, Homo Sapiens
ALQNTGHEG

SEQ ID NO: 947492 - protein, 9 aa, Homo Sapiens
TVSWKTHDA

SEQ ID NO: 947493 - protein, 9 aa, Homo Sapiens
QKVPFSRVW

SEQ ID NO: 947494 - protein, 9 aa, Homo Sapiens
KEMIPFEVL

SEQ ID NO: 947495 - protein, 9 aa, Homo Sapiens
SSVGQACRV

SEQ ID NO: 947496 - protein, 9 aa, Homo Sapiens
ETLESKGLY

SEQ ID NO: 947497 - protein, 9 aa, Homo Sapiens
FPTMTLLPL

SEQ ID NO: 947498 - protein, 9 aa, Homo Sapiens
LESLVLVKL

SEQ ID NO: 947499 - protein, 9 aa, Homo Sapiens
VTFVFRLPF

SEQ ID NO: 947500 - protein, 9 aa, Homo Sapiens
VYYNKASGG

SEQ ID NO: 947501 - protein, 9 aa, Homo Sapiens
LWQKVISDW

SEQ ID NO: 947502 - protein, 9 aa, Homo Sapiens
RVLWNSEQN

SEQ ID NO: 947503 - protein, 9 aa, Homo Sapiens
SYFPQDLWA

SEQ ID NO: 947504 - protein, 9 aa, Homo Sapiens
SPPVELSIE

SEQ ID NO: 947505 - protein, 9 aa, Homo Sapiens
CFPSPGNAQ

SEQ ID NO: 947506 - protein, 9 aa, Homo Sapiens
EETVRLGVS

SEQ ID NO: 947507 - protein, 9 aa, Homo Sapiens
INEELSYSF

SEQ ID NO: 947508 - protein, 9 aa, Homo Sapiens
FTRLFNCAN

SEQ ID NO: 947509 - protein, 9 aa, Homo Sapiens
TNKTMCKTT

SEQ ID NO: 947510 - protein, 9 aa, Homo Sapiens
SPHPSSALR

SEQ ID NO: 947511 - protein, 9 aa, Homo Sapiens
ILDHLESGA

SEQ ID NO: 947512 - protein, 9 aa, Homo Sapiens
LVGASELRD

SEQ ID NO: 947513 - protein, 9 aa, Homo Sapiens
TSGLPEVTL

SEQ ID NO: 947514 - protein, 9 aa, Homo Sapiens
PPAVLHSVP

SEQ ID NO: 947515 - protein, 9 aa, Homo Sapiens
MKKEKVSSV

SEQ ID NO: 947516 - protein, 9 aa, Homo Sapiens
ILEITGGPI

SEQ ID NO: 947517 - protein, 9 aa, Homo Sapiens
LNFNHELPD

SEQ ID NO: 947518 - protein, 9 aa, Homo Sapiens
EPQGLQGQQ

SEQ ID NO: 947519 - protein, 9 aa, Homo Sapiens
ITQVTFVFR

SEQ ID NO: 947520 - protein, 9 aa, Homo Sapiens
DSPSSKRDK

SEQ ID NO: 947521 - protein, 9 aa, Homo Sapiens
KVEDLHVGA

SEQ ID NO: 947522 - protein, 9 aa, Homo Sapiens
TAMTSAAAA

SEQ ID NO: 947523 - protein, 9 aa, Homo Sapiens
FRLWDTFGD

SEQ ID NO: 947524 - protein, 9 aa, Homo Sapiens
GQHKWNYSN

SEQ ID NO: 947525 - protein, 9 aa, Homo Sapiens
GHVIKMKHG

SEQ ID NO: 947526 - protein, 9 aa, Homo Sapiens
RENGPQAIS

SEQ ID NO: 947527 - protein, 9 aa, Homo Sapiens
NISISLDSH

SEQ ID NO: 947528 - protein, 9 aa, Homo Sapiens
LKALKKTLL

SEQ ID NO: 947529 - protein, 9 aa, Homo Sapiens
YKLGDDGRT

SEQ ID NO: 947530 - protein, 9 aa, Homo Sapiens
LASAPLASV

SEQ ID NO: 947531 - protein, 9 aa, Homo Sapiens
SIEETVEFK

SEQ ID NO: 947532 - protein, 9 aa, Homo Sapiens
PWERNMAIR

SEQ ID NO: 947533 - protein, 9 aa, Homo Sapiens
MFIPTSPTR

SEQ ID NO: 947534 - protein, 9 aa, Homo Sapiens
FIGKDCGTE

SEQ ID NO: 947535 - protein, 9 aa, Homo Sapiens
SRLFIEPWE

SEQ ID NO: 947536 - protein, 9 aa, Homo Sapiens
VTESPRPGG

SEQ ID NO: 947537 - protein, 9 aa, Homo Sapiens
LTASLQISP

SEQ ID NO: 947538 - protein, 9 aa, Homo Sapiens
YLEEGAQCS

SEQ ID NO: 947539 - protein, 9 aa, Homo Sapiens
GQKGKKGSG

SEQ ID NO: 947540 - protein, 9 aa, Homo Sapiens
TCQRANFLG

SEQ ID NO: 947541 - protein, 9 aa, Homo Sapiens
LSFFVKVEM

SEQ ID NO: 947542 - protein, 9 aa, Homo Sapiens
RKPEVPTED

SEQ ID NO: 947543 - protein, 9 aa, Homo Sapiens
ANFLGDLYA

SEQ ID NO: 947544 - protein, 9 aa, Homo Sapiens
LLRARSSSF

SEQ ID NO: 947545 - protein, 9 aa, Homo Sapiens
SASLLEEVD

SEQ ID NO: 947546 - protein, 9 aa, Homo Sapiens
NRKIVYSFS

SEQ ID NO: 947547 - protein, 9 aa, Homo Sapiens
PLRFYVWGS

SEQ ID NO: 947548 - protein, 9 aa, Homo Sapiens
GLKGNGDAV

SEQ ID NO: 947549 - protein, 9 aa, Homo Sapiens
GMVLSQELA

SEQ ID NO: 947550 - protein, 9 aa, Homo Sapiens
HGADPEVRN

SEQ ID NO: 947551 - protein, 9 aa, Homo Sapiens
IIDQKTRQP

SEQ ID NO: 947552 - protein, 9 aa, Homo Sapiens
LEEDSERIQ

SEQ ID NO: 947553 - protein, 9 aa, Homo Sapiens
LKPGNIIHY

SEQ ID NO: 947554 - protein, 9 aa, Homo Sapiens
KQQLQARGR

SEQ ID NO: 947555 - protein, 9 aa, Homo Sapiens
GERRRAVTF

SEQ ID NO: 947556 - protein, 9 aa, Homo Sapiens
KIWEERSGM

SEQ ID NO: 947557 - protein, 9 aa, Homo Sapiens
EFLPSVPST

SEQ ID NO: 947558 - protein, 9 aa, Homo Sapiens
EEGLKETER

SEQ ID NO: 947559 - protein, 9 aa, Homo Sapiens
AGEGEPGPE

SEQ ID NO: 947560 - protein, 9 aa, Homo Sapiens
SFQTIDHPW

SEQ ID NO: 947561 - protein, 9 aa, Homo Sapiens
GQSFFLWQR

SEQ ID NO: 947562 - protein, 9 aa, Homo Sapiens
FVLRSLDYE

SEQ ID NO: 947563 - protein, 9 aa, Homo Sapiens
PVFHILRDA

SEQ ID NO: 947564 - protein, 9 aa, Homo Sapiens
SSASFTSSK

SEQ ID NO: 947565 - protein, 9 aa, Homo Sapiens
AVNKAGVGE

SEQ ID NO: 947566 - protein, 9 aa, Homo Sapiens
FCYYASRRV

SEQ ID NO: 947567 - protein, 9 aa, Homo Sapiens
FLCSNPKIW

SEQ ID NO: 947568 - protein, 9 aa, Homo Sapiens
FSMESPLAS

SEQ ID NO: 947569 - protein, 9 aa, Homo Sapiens
LTFYLNLTQ

SEQ ID NO: 947570 - protein, 9 aa, Homo Sapiens
GIQRITGPP

SEQ ID NO: 947571 - protein, 9 aa, Homo Sapiens
GRAETQGAN

SEQ ID NO: 947572 - protein, 9 aa, Homo Sapiens
RRSQYQRST

SEQ ID NO: 947573 - protein, 9 aa, Homo Sapiens
VLQEKEPPC

SEQ ID NO: 947574 - protein, 9 aa, Homo Sapiens
LPPRALPKG

SEQ ID NO: 947575 - protein, 9 aa, Homo Sapiens
ARNGKIYKN

SEQ ID NO: 947576 - protein, 9 aa, Homo Sapiens
HCRLELKKL

SEQ ID NO: 947577 - protein, 9 aa, Homo Sapiens
GLQLADDFT

SEQ ID NO: 947578 - protein, 9 aa, Homo Sapiens
DQFRVNRFP

SEQ ID NO: 947579 - protein, 9 aa, Homo Sapiens
TDFFAKKII

SEQ ID NO: 947580 - protein, 9 aa, Homo Sapiens
PAPPATLPA

SEQ ID NO: 947581 - protein, 9 aa, Homo Sapiens
GGPINPTSL

SEQ ID NO: 947582 - protein, 9 aa, Homo Sapiens
SCEHEGGKF

SEQ ID NO: 947583 - protein, 9 aa, Homo Sapiens
SAGSFNGVQ

SEQ ID NO: 947584 - protein, 9 aa, Homo Sapiens
HILRKVSKK

SEQ ID NO: 947585 - protein, 9 aa, Homo Sapiens
RGSGISVLG

SEQ ID NO: 947586 - protein, 9 aa, Homo Sapiens
SDTPLHFAI

SEQ ID NO: 947587 - protein, 9 aa, Homo Sapiens
ERFTDSLQQ

SEQ ID NO: 947588 - protein, 9 aa, Homo Sapiens
KTMCKTTLY

SEQ ID NO: 947589 - protein, 9 aa, Homo Sapiens
QAQFTPLAN

SEQ ID NO: 947590 - protein, 9 aa, Homo Sapiens
PVELSIEEV

SEQ ID NO: 947591 - protein, 9 aa, Homo Sapiens
APVCGQSAT

SEQ ID NO: 947592 - protein, 9 aa, Homo Sapiens
FEVLVIYME

SEQ ID NO: 947593 - protein, 9 aa, Homo Sapiens
VQVMLDKWE

SEQ ID NO: 947594 - protein, 9 aa, Homo Sapiens
FVTDNQTLL

SEQ ID NO: 947595 - protein, 9 aa, Homo Sapiens
FIPWEEGLY

SEQ ID NO: 947596 - protein, 9 aa, Homo Sapiens
TTLFGDTSD

SEQ ID NO: 947597 - protein, 9 aa, Homo Sapiens
YEELNAPIR

SEQ ID NO: 947598 - protein, 9 aa, Homo Sapiens
LHWGPWERK

SEQ ID NO: 947599 - protein, 9 aa, Homo Sapiens
SGSVLCSVL

SEQ ID NO: 947600 - protein, 9 aa, Homo Sapiens
VGMRGPQEP

SEQ ID NO: 947601 - protein, 9 aa, Homo Sapiens
PTTVYKKTT

SEQ ID NO: 947602 - protein, 9 aa, Homo Sapiens
EDLSEIDGL

SEQ ID NO: 947603 - protein, 9 aa, Homo Sapiens
SQSGVSKRQ

SEQ ID NO: 947604 - protein, 9 aa, Homo Sapiens
RTTYVNANK

SEQ ID NO: 947605 - protein, 9 aa, Homo Sapiens
VEQVKIYAG

SEQ ID NO: 947606 - protein, 9 aa, Homo Sapiens
QVEKKRELE

SEQ ID NO: 947607 - protein, 9 aa, Homo Sapiens
SERLRGGRA

SEQ ID NO: 947608 - protein, 9 aa, Homo Sapiens
GQKVATLNP

SEQ ID NO: 947609 - protein, 9 aa, Homo Sapiens
NTWSSPREV

SEQ ID NO: 947610 - protein, 9 aa, Homo Sapiens
TYSVTKDTL

SEQ ID NO: 947611 - protein, 9 aa, Homo Sapiens
KEHIELVVL

SEQ ID NO: 947612 - protein, 9 aa, Homo Sapiens
TSRPASTHD

SEQ ID NO: 947613 - protein, 9 aa, Homo Sapiens
DITDMNNKI

SEQ ID NO: 947614 - protein, 9 aa, Homo Sapiens
KSHSTSPSL

SEQ ID NO: 947615 - protein, 9 aa, Homo Sapiens
LSDLYCWLQ

SEQ ID NO: 947616 - protein, 9 aa, Homo Sapiens
GTQGCFSKR

SEQ ID NO: 947617 - protein, 9 aa, Homo Sapiens
VRGSCISQP

SEQ ID NO: 947618 - protein, 9 aa, Homo Sapiens
YKQRSSLEK

SEQ ID NO: 947619 - protein, 9 aa, Homo Sapiens
DLSEIDGLV

SEQ ID NO: 947620 - protein, 9 aa, Homo Sapiens
EITTASITD

SEQ ID NO: 947621 - protein, 9 aa, Homo Sapiens
HLQSLPAVV

SEQ ID NO: 947622 - protein, 9 aa, Homo Sapiens
PSPNMFYIN

SEQ ID NO: 947623 - protein, 9 aa, Homo Sapiens
LSGPENHRA

SEQ ID NO: 947624 - protein, 9 aa, Homo Sapiens
KTENFCALS

SEQ ID NO: 947625 - protein, 9 aa, Homo Sapiens
TMAYDCYVA

SEQ ID NO: 947626 - protein, 9 aa, Homo Sapiens
QKLGMWYKA

SEQ ID NO: 947627 - protein, 9 aa, Homo Sapiens
VALETKDTL

SEQ ID NO: 947628 - protein, 9 aa, Homo Sapiens
ASRRVCFRG

SEQ ID NO: 947629 - protein, 9 aa, Homo Sapiens
TCACPSHDT

SEQ ID NO: 947630 - protein, 9 aa, Homo Sapiens
RESPRSPEK

SEQ ID NO: 947631 - protein, 9 aa, Homo Sapiens
RLYKDILLQ

SEQ ID NO: 947632 - protein, 9 aa, Homo Sapiens
QIADEKQLE

SEQ ID NO: 947633 - protein, 9 aa, Homo Sapiens
NYAILDHLE

SEQ ID NO: 947634 - protein, 9 aa, Homo Sapiens
GKLKPQATW

SEQ ID NO: 947635 - protein, 9 aa, Homo Sapiens
CIYDVHTCK

SEQ ID NO: 947636 - protein, 9 aa, Homo Sapiens
TQSPYGGGT

SEQ ID NO: 947637 - protein, 9 aa, Homo Sapiens
KDTIFPSCI

SEQ ID NO: 947638 - protein, 9 aa, Homo Sapiens
IQMTSIKKQ

SEQ ID NO: 947639 - protein, 9 aa, Homo Sapiens
EKNYTEKKT

SEQ ID NO: 947640 - protein, 9 aa, Homo Sapiens
SGGGGTCHC

SEQ ID NO: 947641 - protein, 9 aa, Homo Sapiens
YMNFITHPY

SEQ ID NO: 947642 - protein, 9 aa, Homo Sapiens
VYLKKPPQP

SEQ ID NO: 947643 - protein, 9 aa, Homo Sapiens
CYHDLEDLQ

SEQ ID NO: 947644 - protein, 9 aa, Homo Sapiens
EFENAESLK

SEQ ID NO: 947645 - protein, 9 aa, Homo Sapiens
TPCVDNVHF

SEQ ID NO: 947646 - protein, 9 aa, Homo Sapiens
RLGGQKVAT

SEQ ID NO: 947647 - protein, 9 aa, Homo Sapiens
NLRVKWPNN

SEQ ID NO: 947648 - protein, 9 aa, Homo Sapiens
SRKTRVQMS

SEQ ID NO: 947649 - protein, 9 aa, Homo Sapiens
SVGQACRVS

SEQ ID NO: 947650 - protein, 9 aa, Homo Sapiens
DHKKKFEVT

SEQ ID NO: 947651 - protein, 9 aa, Homo Sapiens
SWISHWLLQ

SEQ ID NO: 947652 - protein, 9 aa, Homo Sapiens
KFNTAIKGS

SEQ ID NO: 947653 - protein, 9 aa, Homo Sapiens
VEVRVFEGL

SEQ ID NO: 947654 - protein, 9 aa, Homo Sapiens
PGAFVLLPL

SEQ ID NO: 947655 - protein, 9 aa, Homo Sapiens
LKGSPSRSP

SEQ ID NO: 947656 - protein, 9 aa, Homo Sapiens
EQEYKFPEP

SEQ ID NO: 947657 - protein, 9 aa, Homo Sapiens
YYATLPFCM

SEQ ID NO: 947658 - protein, 9 aa, Homo Sapiens
DSVSTDPNH

SEQ ID NO: 947659 - protein, 9 aa, Homo Sapiens
SREISVTSN

SEQ ID NO: 947660 - protein, 9 aa, Homo Sapiens
SGQGFGESM

SEQ ID NO: 947661 - protein, 9 aa, Homo Sapiens
VLLSDKASE

SEQ ID NO: 947662 - protein, 9 aa, Homo Sapiens
NLEMPPATS

SEQ ID NO: 947663 - protein, 9 aa, Homo Sapiens
PPLSGDRAR

SEQ ID NO: 947664 - protein, 9 aa, Homo Sapiens
LRSMKSGPK

SEQ ID NO: 947665 - protein, 9 aa, Homo Sapiens
SAFPRDTIS

SEQ ID NO: 947666 - protein, 9 aa, Homo Sapiens
TSDSPSVSY

SEQ ID NO: 947667 - protein, 9 aa, Homo Sapiens
GKVCKAASS

SEQ ID NO: 947668 - protein, 9 aa, Homo Sapiens
AAPVSSKSQ

SEQ ID NO: 947669 - protein, 9 aa, Homo Sapiens
PLLGASLGG

SEQ ID NO: 947670 - protein, 9 aa, Homo Sapiens
EGRTLIFST

SEQ ID NO: 947671 - protein, 9 aa, Homo Sapiens
VYSANLFQQ

SEQ ID NO: 947672 - protein, 9 aa, Homo Sapiens
DSAGSFNGV

SEQ ID NO: 947673 - protein, 9 aa, Homo Sapiens
CPCETCGKN

SEQ ID NO: 947674 - protein, 9 aa, Homo Sapiens
KVYLRVSSH

SEQ ID NO: 947675 - protein, 9 aa, Homo Sapiens
NPGLPPLPF

SEQ ID NO: 947676 - protein, 9 aa, Homo Sapiens
INKSTDKKE

SEQ ID NO: 947677 - protein, 9 aa, Homo Sapiens
LYKDILLQM

SEQ ID NO: 947678 - protein, 9 aa, Homo Sapiens
LLDCRQITC

SEQ ID NO: 947679 - protein, 9 aa, Homo Sapiens
HLIELRRKF

SEQ ID NO: 947680 - protein, 9 aa, Homo Sapiens
RRAQAKPIN

SEQ ID NO: 947681 - protein, 9 aa, Homo Sapiens
PVSSKSQAK

SEQ ID NO: 947682 - protein, 9 aa, Homo Sapiens
AETLLQQNF

SEQ ID NO: 947683 - protein, 9 aa, Homo Sapiens
QCEVPLVWT

SEQ ID NO: 947684 - protein, 9 aa, Homo Sapiens
RCKENESFL

SEQ ID NO: 947685 - protein, 9 aa, Homo Sapiens
LAARPPLSG

SEQ ID NO: 947686 - protein, 9 aa, Homo Sapiens
LLILKGPLF

SEQ ID NO: 947687 - protein, 9 aa, Homo Sapiens
RSPPGFPGS

SEQ ID NO: 947688 - protein, 9 aa, Homo Sapiens
PAWFCQSLK

SEQ ID NO: 947689 - protein, 9 aa, Homo Sapiens
SRSSPGDSS

SEQ ID NO: 947690 - protein, 9 aa, Homo Sapiens
DEDHNEMVI

SEQ ID NO: 947691 - protein, 9 aa, Homo Sapiens
MYVLLPENN

SEQ ID NO: 947692 - protein, 9 aa, Homo Sapiens
LSMSTMTSW

SEQ ID NO: 947693 - protein, 9 aa, Homo Sapiens
MIKSPYNVA

SEQ ID NO: 947694 - protein, 9 aa, Homo Sapiens
VSVPPRLLS

SEQ ID NO: 947695 - protein, 9 aa, Homo Sapiens
KQLDCLGLC

SEQ ID NO: 947696 - protein, 9 aa, Homo Sapiens
GRPNCDGWL

SEQ ID NO: 947697 - protein, 9 aa, Homo Sapiens
NLNFWPQLI

SEQ ID NO: 947698 - protein, 9 aa, Homo Sapiens
LREQKGELQ

SEQ ID NO: 947699 - protein, 9 aa, Homo Sapiens
TALLTAGGK

SEQ ID NO: 947700 - protein, 9 aa, Homo Sapiens
ERFLVRTHI

SEQ ID NO: 947701 - protein, 9 aa, Homo Sapiens
HPHPYPQPL

SEQ ID NO: 947702 - protein, 9 aa, Homo Sapiens
YYVGDTFFE

SEQ ID NO: 947703 - protein, 9 aa, Homo Sapiens
KAINRKTRV

SEQ ID NO: 947704 - protein, 9 aa, Homo Sapiens
SSIRITSIS

SEQ ID NO: 947705 - protein, 9 aa, Homo Sapiens
LLIPLSYAF

SEQ ID NO: 947706 - protein, 9 aa, Homo Sapiens
SFTSSKAPP

SEQ ID NO: 947707 - protein, 9 aa, Homo Sapiens
SPEWDTVTL

SEQ ID NO: 947708 - protein, 9 aa, Homo Sapiens
LKLGPLPRF

SEQ ID NO: 947709 - protein, 9 aa, Homo Sapiens
RCSVPEGPI

SEQ ID NO: 947710 - protein, 9 aa, Homo Sapiens
QRITGPPGD

SEQ ID NO: 947711 - protein, 9 aa, Homo Sapiens
DRARMETAK

SEQ ID NO: 947712 - protein, 9 aa, Homo Sapiens
WQQKTNPVV

SEQ ID NO: 947713 - protein, 9 aa, Homo Sapiens
PDEGANRKI

SEQ ID NO: 947714 - protein, 9 aa, Homo Sapiens
INKNRRKSC

SEQ ID NO: 947715 - protein, 9 aa, Homo Sapiens
PHQAQRIQE

SEQ ID NO: 947716 - protein, 9 aa, Homo Sapiens
AFHIFQDPL

SEQ ID NO: 947717 - protein, 9 aa, Homo Sapiens
FATEYTFAF

SEQ ID NO: 947718 - protein, 9 aa, Homo Sapiens
EVMYDEIKS

SEQ ID NO: 947719 - protein, 9 aa, Homo Sapiens
YYGYSYNAL

SEQ ID NO: 947720 - protein, 9 aa, Homo Sapiens
GDRGPRAAR

SEQ ID NO: 947721 - protein, 9 aa, Homo Sapiens
RINALSHSY

SEQ ID NO: 947722 - protein, 9 aa, Homo Sapiens
VEWNCNKKK

SEQ ID NO: 947723 - protein, 9 aa, Homo Sapiens
KVFIQRNYS

SEQ ID NO: 947724 - protein, 9 aa, Homo Sapiens
LRVEQVKIY

SEQ ID NO: 947725 - protein, 9 aa, Homo Sapiens
DSILVVRKY

SEQ ID NO: 947726 - protein, 9 aa, Homo Sapiens
PLSPRTPSG

SEQ ID NO: 947727 - protein, 9 aa, Homo Sapiens
KTFNVPAMY

SEQ ID NO: 947728 - protein, 9 aa, Homo Sapiens
GPFRQYPAH

SEQ ID NO: 947729 - protein, 9 aa, Homo Sapiens
SGEGVHWYP

SEQ ID NO: 947730 - protein, 9 aa, Homo Sapiens
DNSQNIAKD

SEQ ID NO: 947731 - protein, 9 aa, Homo Sapiens
QEIFLEIVD

SEQ ID NO: 947732 - protein, 9 aa, Homo Sapiens
GIANPATNF

SEQ ID NO: 947733 - protein, 9 aa, Homo Sapiens
NAWREDVAF

SEQ ID NO: 947734 - protein, 9 aa, Homo Sapiens
SLAKLGFYP

SEQ ID NO: 947735 - protein, 9 aa, Homo Sapiens
FTDEQVLSI

SEQ ID NO: 947736 - protein, 9 aa, Homo Sapiens
AELSEAKVA

SEQ ID NO: 947737 - protein, 9 aa, Homo Sapiens
TAVLIIDNG

SEQ ID NO: 947738 - protein, 9 aa, Homo Sapiens
PTKGAESTH

SEQ ID NO: 947739 - protein, 9 aa, Homo Sapiens
GSLLGAACH

SEQ ID NO: 947740 - protein, 9 aa, Homo Sapiens
KQVFSFWRQ

SEQ ID NO: 947741 - protein, 9 aa, Homo Sapiens
SALGNDTIL

SEQ ID NO: 947742 - protein, 9 aa, Homo Sapiens
KSVFENYYV

SEQ ID NO: 947743 - protein, 9 aa, Homo Sapiens
KKEEERRIA

SEQ ID NO: 947744 - protein, 9 aa, Homo Sapiens
VAPGTFILY

SEQ ID NO: 947745 - protein, 9 aa, Homo Sapiens
LWNSEQNLN

SEQ ID NO: 947746 - protein, 9 aa, Homo Sapiens
DEAPMKLGL

SEQ ID NO: 947747 - protein, 9 aa, Homo Sapiens
GHKTLVSEL

SEQ ID NO: 947748 - protein, 9 aa, Homo Sapiens
KEYFQEVGR

SEQ ID NO: 947749 - protein, 9 aa, Homo Sapiens
LFQNGSVSR

SEQ ID NO: 947750 - protein, 9 aa, Homo Sapiens
KKRSTIMSG

SEQ ID NO: 947751 - protein, 9 aa, Homo Sapiens
CNFLRRPDS

SEQ ID NO: 947752 - protein, 9 aa, Homo Sapiens
SAEPLEVHK

SEQ ID NO: 947753 - protein, 9 aa, Homo Sapiens
NSNNDCFGT

SEQ ID NO: 947754 - protein, 9 aa, Homo Sapiens
LRPSDKGTY

SEQ ID NO: 947755 - protein, 9 aa, Homo Sapiens
EGFTILVSN

SEQ ID NO: 947756 - protein, 9 aa, Homo Sapiens
SLGIVLIIS

SEQ ID NO: 947757 - protein, 9 aa, Homo Sapiens
SRQTRNKKQ

SEQ ID NO: 947758 - protein, 9 aa, Homo Sapiens
RLVFHNHKE

SEQ ID NO: 947759 - protein, 9 aa, Homo Sapiens
VGEAADPTT

SEQ ID NO: 947760 - protein, 9 aa, Homo Sapiens
NTLIEESAE

SEQ ID NO: 947761 - protein, 9 aa, Homo Sapiens
CLALEQERI

SEQ ID NO: 947762 - protein, 9 aa, Homo Sapiens
NSGQHPDLR

SEQ ID NO: 947763 - protein, 9 aa, Homo Sapiens
RNICYDPRK

SEQ ID NO: 947764 - protein, 9 aa, Homo Sapiens
IPPLPPLPG

SEQ ID NO: 947765 - protein, 9 aa, Homo Sapiens
QNITEENPM

SEQ ID NO: 947766 - protein, 9 aa, Homo Sapiens
HIIEGLKGF

SEQ ID NO: 947767 - protein, 9 aa, Homo Sapiens
KRSTLAPEL

SEQ ID NO: 947768 - protein, 9 aa, Homo Sapiens
WAPPFPKPH

SEQ ID NO: 947769 - protein, 9 aa, Homo Sapiens
ENLDVQREL

SEQ ID NO: 947770 - protein, 9 aa, Homo Sapiens
LLDKGIYTC

SEQ ID NO: 947771 - protein, 9 aa, Homo Sapiens
LSGTPKSIT

SEQ ID NO: 947772 - protein, 9 aa, Homo Sapiens
QVHPENIKV

SEQ ID NO: 947773 - protein, 9 aa, Homo Sapiens
NVTDKDGKL

SEQ ID NO: 947774 - protein, 9 aa, Homo Sapiens
DYSLAGAET

SEQ ID NO: 947775 - protein, 9 aa, Homo Sapiens
ETRYLDDLC

SEQ ID NO: 947776 - protein, 9 aa, Homo Sapiens
KSCACNSLG

SEQ ID NO: 947777 - protein, 9 aa, Homo Sapiens
NQGSSVEGT

SEQ ID NO: 947778 - protein, 9 aa, Homo Sapiens
NPEKVFKSE

SEQ ID NO: 947779 - protein, 9 aa, Homo Sapiens
DPDEGANRK

SEQ ID NO: 947780 - protein, 9 aa, Homo Sapiens
KTAKEEFLF

SEQ ID NO: 947781 - protein, 9 aa, Homo Sapiens
GQACRVSPG

SEQ ID NO: 947782 - protein, 9 aa, Homo Sapiens
RTIHGQTGD

SEQ ID NO: 947783 - protein, 9 aa, Homo Sapiens
NIEAKSKTA

SEQ ID NO: 947784 - protein, 9 aa, Homo Sapiens
YKSGLILPR

SEQ ID NO: 947785 - protein, 9 aa, Homo Sapiens
DLNRNKIYL

SEQ ID NO: 947786 - protein, 9 aa, Homo Sapiens
SQATGKGCG

SEQ ID NO: 947787 - protein, 9 aa, Homo Sapiens
WALTVPELT

SEQ ID NO: 947788 - protein, 9 aa, Homo Sapiens
DWVIEKVLI

SEQ ID NO: 947789 - protein, 9 aa, Homo Sapiens
YGNKITDLS

SEQ ID NO: 947790 - protein, 9 aa, Homo Sapiens
QHGPLLTFY

SEQ ID NO: 947791 - protein, 9 aa, Homo Sapiens
EDEAKICHG

SEQ ID NO: 947792 - protein, 9 aa, Homo Sapiens
LICWPKGTV

SEQ ID NO: 947793 - protein, 9 aa, Homo Sapiens
VSSANKIDV

SEQ ID NO: 947794 - protein, 9 aa, Homo Sapiens
CSNPKIWNV

SEQ ID NO: 947795 - protein, 9 aa, Homo Sapiens
QAQRIQEIK

SEQ ID NO: 947796 - protein, 9 aa, Homo Sapiens
LFFSAFSGF

SEQ ID NO: 947797 - protein, 9 aa, Homo Sapiens
MGGNGVVEV

SEQ ID NO: 947798 - protein, 9 aa, Homo Sapiens
KEEEEPKKT

SEQ ID NO: 947799 - protein, 9 aa, Homo Sapiens
WLPFVFLCQ

SEQ ID NO: 947800 - protein, 9 aa, Homo Sapiens
RVGGLFGKY

SEQ ID NO: 947801 - protein, 9 aa, Homo Sapiens
CYDSRTQQW

SEQ ID NO: 947802 - protein, 9 aa, Homo Sapiens
AVQKETRDR

SEQ ID NO: 947803 - protein, 9 aa, Homo Sapiens
QRGCVWTTG

SEQ ID NO: 947804 - protein, 9 aa, Homo Sapiens
VLGSNVSIG

SEQ ID NO: 947805 - protein, 9 aa, Homo Sapiens
ERVLFHHSV

SEQ ID NO: 947806 - protein, 9 aa, Homo Sapiens
SIVQRFAAH

SEQ ID NO: 947807 - protein, 9 aa, Homo Sapiens
HKRMEFFQP

SEQ ID NO: 947808 - protein, 9 aa, Homo Sapiens
ADGPKATLC

SEQ ID NO: 947809 - protein, 9 aa, Homo Sapiens
VLVIYMESL

SEQ ID NO: 947810 - protein, 9 aa, Homo Sapiens
PDEFDSVPL

SEQ ID NO: 947811 - protein, 9 aa, Homo Sapiens
FIYGGCEEN

SEQ ID NO: 947812 - protein, 9 aa, Homo Sapiens
MAAFFFSDF

SEQ ID NO: 947813 - protein, 9 aa, Homo Sapiens
DSGFKKKFK

SEQ ID NO: 947814 - protein, 9 aa, Homo Sapiens
PVIIITEFM

SEQ ID NO: 947815 - protein, 9 aa, Homo Sapiens
ETDFYNVTW

SEQ ID NO: 947816 - protein, 9 aa, Homo Sapiens
HDYRPTEDV

SEQ ID NO: 947817 - protein, 9 aa, Homo Sapiens
KEKQKVDLS

SEQ ID NO: 947818 - protein, 9 aa, Homo Sapiens
KKDAAVNCT

SEQ ID NO: 947819 - protein, 9 aa, Homo Sapiens
SSNITATTK

SEQ ID NO: 947820 - protein, 9 aa, Homo Sapiens
FYPFIEALL

SEQ ID NO: 947821 - protein, 9 aa, Homo Sapiens
GVGESGRQS

SEQ ID NO: 947822 - protein, 9 aa, Homo Sapiens
PTPCPPSRG

SEQ ID NO: 947823 - protein, 9 aa, Homo Sapiens
SFRGGRPGL

SEQ ID NO: 947824 - protein, 9 aa, Homo Sapiens
QQPGPRKIP

SEQ ID NO: 947825 - protein, 9 aa, Homo Sapiens
IQASGETFP

SEQ ID NO: 947826 - protein, 9 aa, Homo Sapiens
DFLLKDKHA

SEQ ID NO: 947827 - protein, 9 aa, Homo Sapiens
RGGVRCSSF

SEQ ID NO: 947828 - protein, 9 aa, Homo Sapiens
FLGQQVKDG

SEQ ID NO: 947829 - protein, 9 aa, Homo Sapiens
TEMDSKTLQ

SEQ ID NO: 947830 - protein, 9 aa, Homo Sapiens
VLCLLGAGS

SEQ ID NO: 947831 - protein, 9 aa, Homo Sapiens
ALETKDTLL

SEQ ID NO: 947832 - protein, 9 aa, Homo Sapiens
ILVFFLETA

SEQ ID NO: 947833 - protein, 9 aa, Homo Sapiens
NPTSLPPGD

SEQ ID NO: 947834 - protein, 9 aa, Homo Sapiens
YHDLEDLQW

SEQ ID NO: 947835 - protein, 9 aa, Homo Sapiens
DVVDRVVAI

SEQ ID NO: 947836 - protein, 9 aa, Homo Sapiens
DLQLQVQAK

SEQ ID NO: 947837 - protein, 9 aa, Homo Sapiens
KFLERIHLQ

SEQ ID NO: 947838 - protein, 9 aa, Homo Sapiens
HGSRDHHHL

SEQ ID NO: 947839 - protein, 9 aa, Homo Sapiens
ETPIVPVPE

SEQ ID NO: 947840 - protein, 9 aa, Homo Sapiens
VGYSSYDFM

SEQ ID NO: 947841 - protein, 9 aa, Homo Sapiens
APCHIKETP

SEQ ID NO: 947842 - protein, 9 aa, Homo Sapiens
LEVEELLGS

SEQ ID NO: 947843 - protein, 9 aa, Homo Sapiens
FYSSPDITQ

SEQ ID NO: 947844 - protein, 9 aa, Homo Sapiens
ISNLDKVGQ

SEQ ID NO: 947845 - protein, 9 aa, Homo Sapiens
LSTSKIDLP

SEQ ID NO: 947846 - protein, 9 aa, Homo Sapiens
FISALQNTG

SEQ ID NO: 947847 - protein, 9 aa, Homo Sapiens
HKIKYKAPT

SEQ ID NO: 947848 - protein, 9 aa, Homo Sapiens
NPENEDEGM

SEQ ID NO: 947849 - protein, 9 aa, Homo Sapiens
VGDTFFEEY

SEQ ID NO: 947850 - protein, 9 aa, Homo Sapiens
SGKWTILPD

SEQ ID NO: 947851 - protein, 9 aa, Homo Sapiens
DGNKIEEIS

SEQ ID NO: 947852 - protein, 9 aa, Homo Sapiens
AQKSKAVEK

SEQ ID NO: 947853 - protein, 9 aa, Homo Sapiens
DILEDINVS

SEQ ID NO: 947854 - protein, 9 aa, Homo Sapiens
IPENSGKTV

SEQ ID NO: 947855 - protein, 9 aa, Homo Sapiens
EQDMVHIRQ

SEQ ID NO: 947856 - protein, 9 aa, Homo Sapiens
VYIKNRVSI

SEQ ID NO: 947857 - protein, 9 aa, Homo Sapiens
QPNSSVLIG

SEQ ID NO: 947858 - protein, 9 aa, Homo Sapiens
SSQAPPSPL

SEQ ID NO: 947859 - protein, 9 aa, Homo Sapiens
AALATGTFF

SEQ ID NO: 947860 - protein, 9 aa, Homo Sapiens
KDYLLFGYV

SEQ ID NO: 947861 - protein, 9 aa, Homo Sapiens
WHKPPKQVD

SEQ ID NO: 947862 - protein, 9 aa, Homo Sapiens
EETVEFKNV

SEQ ID NO: 947863 - protein, 9 aa, Homo Sapiens
PSSVGQACR

SEQ ID NO: 947864 - protein, 9 aa, Homo Sapiens
PLLTFYLNL

SEQ ID NO: 947865 - protein, 9 aa, Homo Sapiens
FQKSAEDAE

SEQ ID NO: 947866 - protein, 9 aa, Homo Sapiens
GLLSLVLRN

SEQ ID NO: 947867 - protein, 9 aa, Homo Sapiens
FSRADFCGI

SEQ ID NO: 947868 - protein, 9 aa, Homo Sapiens
EQSVHLFID

SEQ ID NO: 947869 - protein, 9 aa, Homo Sapiens
ILETSLRLI

SEQ ID NO: 947870 - protein, 9 aa, Homo Sapiens
QEIEIMSSL

SEQ ID NO: 947871 - protein, 9 aa, Homo Sapiens
QSSDECTLL

SEQ ID NO: 947872 - protein, 9 aa, Homo Sapiens
GISQSWISH

SEQ ID NO: 947873 - protein, 9 aa, Homo Sapiens
SLLMTLFEL

SEQ ID NO: 947874 - protein, 9 aa, Homo Sapiens
VARAMFIPT

SEQ ID NO: 947875 - protein, 9 aa, Homo Sapiens
MCSGGYSEW

SEQ ID NO: 947876 - protein, 9 aa, Homo Sapiens
PWYSYPVYA

SEQ ID NO: 947877 - protein, 9 aa, Homo Sapiens
AKFIASAPG

SEQ ID NO: 947878 - protein, 9 aa, Homo Sapiens
GLVMGTEWT

SEQ ID NO: 947879 - protein, 9 aa, Homo Sapiens
HHCINCVHL

SEQ ID NO: 947880 - protein, 9 aa, Homo Sapiens
KFRHNCKFY

SEQ ID NO: 947881 - protein, 9 aa, Homo Sapiens
YSISLLNAE

SEQ ID NO: 947882 - protein, 9 aa, Homo Sapiens
ELEQLFLQY

SEQ ID NO: 947883 - protein, 9 aa, Homo Sapiens
PHEPHVYLP

SEQ ID NO: 947884 - protein, 9 aa, Homo Sapiens
GCRNQRYKR

SEQ ID NO: 947885 - protein, 9 aa, Homo Sapiens
GDYKDSSNF

SEQ ID NO: 947886 - protein, 9 aa, Homo Sapiens
RKEASNKLT

SEQ ID NO: 947887 - protein, 9 aa, Homo Sapiens
CSLNEQRHN

SEQ ID NO: 947888 - protein, 9 aa, Homo Sapiens
TLSQGHFLL

SEQ ID NO: 947889 - protein, 9 aa, Homo Sapiens
RFLQQQMPT

SEQ ID NO: 947890 - protein, 9 aa, Homo Sapiens
SEDHFPLLS

SEQ ID NO: 947891 - protein, 9 aa, Homo Sapiens
AKAFRVKFN

SEQ ID NO: 947892 - protein, 9 aa, Homo Sapiens
IKEEKQKEL

SEQ ID NO: 947893 - protein, 9 aa, Homo Sapiens
VKMPEQEYK

SEQ ID NO: 947894 - protein, 9 aa, Homo Sapiens
RVKFNTAIK

SEQ ID NO: 947895 - protein, 9 aa, Homo Sapiens
MRVFLLGMP

SEQ ID NO: 947896 - protein, 9 aa, Homo Sapiens
RQTVKATNS

SEQ ID NO: 947897 - protein, 9 aa, Homo Sapiens
AIKNGQLKC

SEQ ID NO: 947898 - protein, 9 aa, Homo Sapiens
KMDFKINIL

SEQ ID NO: 947899 - protein, 9 aa, Homo Sapiens
AVIACSFPG

SEQ ID NO: 947900 - protein, 9 aa, Homo Sapiens
TLRSMKSGP

SEQ ID NO: 947901 - protein, 9 aa, Homo Sapiens
ELRGLFPSP

SEQ ID NO: 947902 - protein, 9 aa, Homo Sapiens
TQVSERAEA

SEQ ID NO: 947903 - protein, 9 aa, Homo Sapiens
SHEIKKQTL

SEQ ID NO: 947904 - protein, 9 aa, Homo Sapiens
WSPREAEGY

SEQ ID NO: 947905 - protein, 9 aa, Homo Sapiens
CFFLFSRKE

SEQ ID NO: 947906 - protein, 9 aa, Homo Sapiens
RGPPGLVLS

SEQ ID NO: 947907 - protein, 9 aa, Homo Sapiens
AVSCGIPEF

SEQ ID NO: 947908 - protein, 9 aa, Homo Sapiens
SLLQSSPCP

SEQ ID NO: 947909 - protein, 9 aa, Homo Sapiens
RLLQTYFRE

SEQ ID NO: 947910 - protein, 9 aa, Homo Sapiens
YSVRQNKSN

SEQ ID NO: 947911 - protein, 9 aa, Homo Sapiens
TLSEIPLDF

SEQ ID NO: 947912 - protein, 9 aa, Homo Sapiens
NPWERNMAI

SEQ ID NO: 947913 - protein, 9 aa, Homo Sapiens
EHRRIHTGK

SEQ ID NO: 947914 - protein, 9 aa, Homo Sapiens
SCCPRVLPK

SEQ ID NO: 947915 - protein, 9 aa, Homo Sapiens
CSDAQPMGP

SEQ ID NO: 947916 - protein, 9 aa, Homo Sapiens
YATMGGLTG

SEQ ID NO: 947917 - protein, 9 aa, Homo Sapiens
EGKAFAESW

SEQ ID NO: 947918 - protein, 9 aa, Homo Sapiens
DTISKQDVC

SEQ ID NO: 947919 - protein, 9 aa, Homo Sapiens
QSEDYVDIV

SEQ ID NO: 947920 - protein, 9 aa, Homo Sapiens
SDAELVQHV

SEQ ID NO: 947921 - protein, 9 aa, Homo Sapiens
LLSAATPKH

SEQ ID NO: 947922 - protein, 9 aa, Homo Sapiens
PSVTRNKTG

SEQ ID NO: 947923 - protein, 9 aa, Homo Sapiens
QGCHQKLTV

SEQ ID NO: 947924 - protein, 9 aa, Homo Sapiens
LIEVRANKQ

SEQ ID NO: 947925 - protein, 9 aa, Homo Sapiens
RSPEKEEPH

SEQ ID NO: 947926 - protein, 9 aa, Homo Sapiens
VKVVAKEFC

SEQ ID NO: 947927 - protein, 9 aa, Homo Sapiens
KKKVEDLHV

SEQ ID NO: 947928 - protein, 9 aa, Homo Sapiens
LRRLVAQLH

SEQ ID NO: 947929 - protein, 9 aa, Homo Sapiens
SIDTYGKEL

SEQ ID NO: 947930 - protein, 9 aa, Homo Sapiens
RLVIHRAFD

SEQ ID NO: 947931 - protein, 9 aa, Homo Sapiens
TMTSWESIK

SEQ ID NO: 947932 - protein, 9 aa, Homo Sapiens
IKMRVFLLG

SEQ ID NO: 947933 - protein, 9 aa, Homo Sapiens
ILGRKEART

SEQ ID NO: 947934 - protein, 9 aa, Homo Sapiens
ETFFKKETP

SEQ ID NO: 947935 - protein, 9 aa, Homo Sapiens
QGSGRPRPQ

SEQ ID NO: 947936 - protein, 9 aa, Homo Sapiens
RQITCPEGW

SEQ ID NO: 947937 - protein, 9 aa, Homo Sapiens
SAVIDAKFF

SEQ ID NO: 947938 - protein, 9 aa, Homo Sapiens
GEDDDNFET

SEQ ID NO: 947939 - protein, 9 aa, Homo Sapiens
ANFTDQKKF

SEQ ID NO: 947940 - protein, 9 aa, Homo Sapiens
CTQRGCVWT

SEQ ID NO: 947941 - protein, 9 aa, Homo Sapiens
TKFGRKKTE

SEQ ID NO: 947942 - protein, 9 aa, Homo Sapiens
DKAINRKTR

SEQ ID NO: 947943 - protein, 9 aa, Homo Sapiens
FITHPYVYE

SEQ ID NO: 947944 - protein, 9 aa, Homo Sapiens
LMKKKLDYF

SEQ ID NO: 947945 - protein, 9 aa, Homo Sapiens
SSVEGSASG

SEQ ID NO: 947946 - protein, 9 aa, Homo Sapiens
LRKLENEVI

SEQ ID NO: 947947 - protein, 9 aa, Homo Sapiens
PLTSKKEEE

SEQ ID NO: 947948 - protein, 9 aa, Homo Sapiens
TEGGTCEVI

SEQ ID NO: 947949 - protein, 9 aa, Homo Sapiens
CLCHNLDHR

SEQ ID NO: 947950 - protein, 9 aa, Homo Sapiens
EPGIRSSKE

SEQ ID NO: 947951 - protein, 9 aa, Homo Sapiens
ESVECYDSR

SEQ ID NO: 947952 - protein, 9 aa, Homo Sapiens
CVFFVSHFY

SEQ ID NO: 947953 - protein, 9 aa, Homo Sapiens
GPGGTEGGG

SEQ ID NO: 947954 - protein, 9 aa, Homo Sapiens
SRTGILAQC

SEQ ID NO: 947955 - protein, 9 aa, Homo Sapiens
NSHRERLFQ

SEQ ID NO: 947956 - protein, 9 aa, Homo Sapiens
GREVLTNLL

SEQ ID NO: 947957 - protein, 9 aa, Homo Sapiens
LKAAMGTPW

SEQ ID NO: 947958 - protein, 9 aa, Homo Sapiens
QSVHLFIDS

SEQ ID NO: 947959 - protein, 9 aa, Homo Sapiens
AHLQSLPAV

SEQ ID NO: 947960 - protein, 9 aa, Homo Sapiens
QEGYPYPYL

SEQ ID NO: 947961 - protein, 9 aa, Homo Sapiens
SDPKLSWSQ

SEQ ID NO: 947962 - protein, 9 aa, Homo Sapiens
DQELDTAVK

SEQ ID NO: 947963 - protein, 9 aa, Homo Sapiens
KKQQLAEEA

SEQ ID NO: 947964 - protein, 9 aa, Homo Sapiens
KVLNVFFAF

SEQ ID NO: 947965 - protein, 9 aa, Homo Sapiens
LESPILVHC

SEQ ID NO: 947966 - protein, 9 aa, Homo Sapiens
PLASLVLDP

SEQ ID NO: 947967 - protein, 9 aa, Homo Sapiens
IDKLHSELS

SEQ ID NO: 947968 - protein, 9 aa, Homo Sapiens
VTDLLADLV

SEQ ID NO: 947969 - protein, 9 aa, Homo Sapiens
LHRTEGGTC

SEQ ID NO: 947970 - protein, 9 aa, Homo Sapiens
ILSKQPEFH

SEQ ID NO: 947971 - protein, 9 aa, Homo Sapiens
SRRLEPKPD

SEQ ID NO: 947972 - protein, 9 aa, Homo Sapiens
ERFLVNQLD

SEQ ID NO: 947973 - protein, 9 aa, Homo Sapiens
VTFFYCFAI

SEQ ID NO: 947974 - protein, 9 aa, Homo Sapiens
LNSELQKKK

SEQ ID NO: 947975 - protein, 9 aa, Homo Sapiens
PERYYKESK

SEQ ID NO: 947976 - protein, 9 aa, Homo Sapiens
FESVECYDS

SEQ ID NO: 947977 - protein, 9 aa, Homo Sapiens
GSQQNPDFA

SEQ ID NO: 947978 - protein, 9 aa, Homo Sapiens
AEVVFEKCS

SEQ ID NO: 947979 - protein, 9 aa, Homo Sapiens
GPKSRAAPS

SEQ ID NO: 947980 - protein, 9 aa, Homo Sapiens
KAAMGTPWR

SEQ ID NO: 947981 - protein, 9 aa, Homo Sapiens
PCHIKETPA

SEQ ID NO: 947982 - protein, 9 aa, Homo Sapiens
VRGSDVSVK

SEQ ID NO: 947983 - protein, 9 aa, Homo Sapiens
QTAVDTILE

SEQ ID NO: 947984 - protein, 9 aa, Homo Sapiens
DLETVIKGK

SEQ ID NO: 947985 - protein, 9 aa, Homo Sapiens
LKDVAKERK

SEQ ID NO: 947986 - protein, 9 aa, Homo Sapiens
IVHPLRPRI

SEQ ID NO: 947987 - protein, 9 aa, Homo Sapiens
KQFDVFFRH

SEQ ID NO: 947988 - protein, 9 aa, Homo Sapiens
PVSPAQSSL

SEQ ID NO: 947989 - protein, 9 aa, Homo Sapiens
RVHKAVKAI

SEQ ID NO: 947990 - protein, 9 aa, Homo Sapiens
EDSADKDRC

SEQ ID NO: 947991 - protein, 9 aa, Homo Sapiens
VLPISDHKL

SEQ ID NO: 947992 - protein, 9 aa, Homo Sapiens
QSCCPRVLP

SEQ ID NO: 947993 - protein, 9 aa, Homo Sapiens
ILVVRKYFQ

SEQ ID NO: 947994 - protein, 9 aa, Homo Sapiens
LPSVPQNAL

SEQ ID NO: 947995 - protein, 9 aa, Homo Sapiens
ICCGILVFF

SEQ ID NO: 947996 - protein, 9 aa, Homo Sapiens
PILPVSPAQ

SEQ ID NO: 947997 - protein, 9 aa, Homo Sapiens
PTTKNLNFW

SEQ ID NO: 947998 - protein, 9 aa, Homo Sapiens
TKDTLQGAP

SEQ ID NO: 947999 - protein, 9 aa, Homo Sapiens
SAPTFMHFS

SEQ ID NO: 948000 - protein, 9 aa, Homo Sapiens
NAIPILYYI

SEQ ID NO: 948001 - protein, 9 aa, Homo Sapiens
PRRQKFHRP

SEQ ID NO: 948002 - protein, 9 aa, Homo Sapiens
FEVLTLGTG

SEQ ID NO: 948003 - protein, 9 aa, Homo Sapiens
DMGFLASAW

SEQ ID NO: 948004 - protein, 9 aa, Homo Sapiens
IKMEKEKHN

SEQ ID NO: 948005 - protein, 9 aa, Homo Sapiens
KTTAPGAHQ

SEQ ID NO: 948006 - protein, 9 aa, Homo Sapiens
SFFLDLSPK

SEQ ID NO: 948007 - protein, 9 aa, Homo Sapiens
APTFMHFSP

SEQ ID NO: 948008 - protein, 9 aa, Homo Sapiens
MAEPDPEIY

SEQ ID NO: 948009 - protein, 9 aa, Homo Sapiens
EKMDKLLPL

SEQ ID NO: 948010 - protein, 9 aa, Homo Sapiens
LLLLRQVAD

SEQ ID NO: 948011 - protein, 9 aa, Homo Sapiens
VQETREEGY

SEQ ID NO: 948012 - protein, 9 aa, Homo Sapiens
EISWVIEPV

SEQ ID NO: 948013 - protein, 9 aa, Homo Sapiens
AKKFVKQCS

SEQ ID NO: 948014 - protein, 9 aa, Homo Sapiens
VRFEDYEGL

SEQ ID NO: 948015 - protein, 9 aa, Homo Sapiens
KETPVTHLY

SEQ ID NO: 948016 - protein, 9 aa, Homo Sapiens
ELNTFSFCR

SEQ ID NO: 948017 - protein, 9 aa, Homo Sapiens
SLSSRTHLR

SEQ ID NO: 948018 - protein, 9 aa, Homo Sapiens
NFWPQLITL

SEQ ID NO: 948019 - protein, 9 aa, Homo Sapiens
TLDKADATW

SEQ ID NO: 948020 - protein, 9 aa, Homo Sapiens
DCVLMVERS

SEQ ID NO: 948021 - protein, 9 aa, Homo Sapiens
LEDLQWICA

SEQ ID NO: 948022 - protein, 9 aa, Homo Sapiens
EKEEPHLLS

SEQ ID NO: 948023 - protein, 9 aa, Homo Sapiens
TKAPKVPKK

SEQ ID NO: 948024 - protein, 9 aa, Homo Sapiens
KIDENILPS

SEQ ID NO: 948025 - protein, 9 aa, Homo Sapiens
SSSTIAEGT

SEQ ID NO: 948026 - protein, 9 aa, Homo Sapiens
FLIDNSQNI

SEQ ID NO: 948027 - protein, 9 aa, Homo Sapiens
SDLDKKHRF

SEQ ID NO: 948028 - protein, 9 aa, Homo Sapiens
YPCNECGKF

SEQ ID NO: 948029 - protein, 9 aa, Homo Sapiens
CVVSEENIN

SEQ ID NO: 948030 - protein, 9 aa, Homo Sapiens
RSELLQSQK

SEQ ID NO: 948031 - protein, 9 aa, Homo Sapiens
LFLTTTFRR

SEQ ID NO: 948032 - protein, 9 aa, Homo Sapiens
VTEEELPEE

SEQ ID NO: 948033 - protein, 9 aa, Homo Sapiens
FYNRNPLAR

SEQ ID NO: 948034 - protein, 9 aa, Homo Sapiens
PTILETSLR

SEQ ID NO: 948035 - protein, 9 aa, Homo Sapiens
KSQHSTPLR

SEQ ID NO: 948036 - protein, 9 aa, Homo Sapiens
LWKGFFKPS

SEQ ID NO: 948037 - protein, 9 aa, Homo Sapiens
GHCSCALGW

SEQ ID NO: 948038 - protein, 9 aa, Homo Sapiens
AAKQNGHVI

SEQ ID NO: 948039 - protein, 9 aa, Homo Sapiens
GCFLLIPLS

SEQ ID NO: 948040 - protein, 9 aa, Homo Sapiens
STARLDFFW

SEQ ID NO: 948041 - protein, 9 aa, Homo Sapiens
RSTIMSGFS

SEQ ID NO: 948042 - protein, 9 aa, Homo Sapiens
ANKQEAVFE

SEQ ID NO: 948043 - protein, 9 aa, Homo Sapiens
WLDDMRCKE

SEQ ID NO: 948044 - protein, 9 aa, Homo Sapiens
AAGQEKKGK

SEQ ID NO: 948045 - protein, 9 aa, Homo Sapiens
MDFKINILL

SEQ ID NO: 948046 - protein, 9 aa, Homo Sapiens
KKKQSMSRL

SEQ ID NO: 948047 - protein, 9 aa, Homo Sapiens
RLSFQKDFS

SEQ ID NO: 948048 - protein, 9 aa, Homo Sapiens
CQKVPFSRV

SEQ ID NO: 948049 - protein, 9 aa, Homo Sapiens
LAPELLWWD

SEQ ID NO: 948050 - protein, 9 aa, Homo Sapiens
PLPFMPPRN

SEQ ID NO: 948051 - protein, 9 aa, Homo Sapiens
LIAFLSSPL

SEQ ID NO: 948052 - protein, 9 aa, Homo Sapiens
HILRDASDP

SEQ ID NO: 948053 - protein, 9 aa, Homo Sapiens
MQVAVNGAH

SEQ ID NO: 948054 - protein, 9 aa, Homo Sapiens
HFIYGNPRK

SEQ ID NO: 948055 - protein, 9 aa, Homo Sapiens
RRLHYNKEL

SEQ ID NO: 948056 - protein, 9 aa, Homo Sapiens
GKAFCYDTQ

SEQ ID NO: 948057 - protein, 9 aa, Homo Sapiens
EDWGILGRK

SEQ ID NO: 948058 - protein, 9 aa, Homo Sapiens
LHLSTLSTV

SEQ ID NO: 948059 - protein, 9 aa, Homo Sapiens
VLLKTWEKV

SEQ ID NO: 948060 - protein, 9 aa, Homo Sapiens
RAFTYCDLH

SEQ ID NO: 948061 - protein, 9 aa, Homo Sapiens
IIEGLKGFL

SEQ ID NO: 948062 - protein, 9 aa, Homo Sapiens
LAGLNYELA

SEQ ID NO: 948063 - protein, 9 aa, Homo Sapiens
TDSETTTAS

SEQ ID NO: 948064 - protein, 9 aa, Homo Sapiens
SVKQATLNS

SEQ ID NO: 948065 - protein, 9 aa, Homo Sapiens
STPLRGRYP

SEQ ID NO: 948066 - protein, 9 aa, Homo Sapiens
WPGAVAYAC

SEQ ID NO: 948067 - protein, 9 aa, Homo Sapiens
QSGVSKRQE

SEQ ID NO: 948068 - protein, 9 aa, Homo Sapiens
STCAFHLSV

SEQ ID NO: 948069 - protein, 9 aa, Homo Sapiens
MEDGRWSEG

SEQ ID NO: 948070 - protein, 9 aa, Homo Sapiens
RMKSSDSKP

SEQ ID NO: 948071 - protein, 9 aa, Homo Sapiens
SPNTVSPSL

SEQ ID NO: 948072 - protein, 9 aa, Homo Sapiens
GACLCKHGF

SEQ ID NO: 948073 - protein, 9 aa, Homo Sapiens
TFYLNLTQG

SEQ ID NO: 948074 - protein, 9 aa, Homo Sapiens
FLLGMPELR

SEQ ID NO: 948075 - protein, 9 aa, Homo Sapiens
ATPQPRFEA

SEQ ID NO: 948076 - protein, 9 aa, Homo Sapiens
QQQMPTLEH

SEQ ID NO: 948077 - protein, 9 aa, Homo Sapiens
VFPGSSSSG

SEQ ID NO: 948078 - protein, 9 aa, Homo Sapiens
AQLLTRQRR

SEQ ID NO: 948079 - protein, 9 aa, Homo Sapiens
RVFSTCSFH

SEQ ID NO: 948080 - protein, 9 aa, Homo Sapiens
LKLYTNREG

SEQ ID NO: 948081 - protein, 9 aa, Homo Sapiens
DTILWIIAL

SEQ ID NO: 948082 - protein, 9 aa, Homo Sapiens
FLLFINLYI

SEQ ID NO: 948083 - protein, 9 aa, Homo Sapiens
IVVLEESGE

SEQ ID NO: 948084 - protein, 9 aa, Homo Sapiens
RDLFAVGYS

SEQ ID NO: 948085 - protein, 9 aa, Homo Sapiens
SEQPLAQKP

SEQ ID NO: 948086 - protein, 9 aa, Homo Sapiens
TPAASPSLS

SEQ ID NO: 948087 - protein, 9 aa, Homo Sapiens
EQWSQRLSP

SEQ ID NO: 948088 - protein, 9 aa, Homo Sapiens
PRIDPFLGQ

SEQ ID NO: 948089 - protein, 9 aa, Homo Sapiens
FQRELFRKR

SEQ ID NO: 948090 - protein, 9 aa, Homo Sapiens
NAVISEEHL

SEQ ID NO: 948091 - protein, 9 aa, Homo Sapiens
ACPNCFFLF

SEQ ID NO: 948092 - protein, 9 aa, Homo Sapiens
PASSPVGPL

SEQ ID NO: 948093 - protein, 9 aa, Homo Sapiens
TRSLFLSGV

SEQ ID NO: 948094 - protein, 9 aa, Homo Sapiens
VPTEDVEEE

SEQ ID NO: 948095 - protein, 9 aa, Homo Sapiens
EELPDEDKD

SEQ ID NO: 948096 - protein, 9 aa, Homo Sapiens
NKRRHETHR

SEQ ID NO: 948097 - protein, 9 aa, Homo Sapiens
ISWGLPRTI

SEQ ID NO: 948098 - protein, 9 aa, Homo Sapiens
NQGDVLTGR

SEQ ID NO: 948099 - protein, 9 aa, Homo Sapiens
RERPAEGDR

SEQ ID NO: 948100 - protein, 9 aa, Homo Sapiens
EKKRELELR

SEQ ID NO: 948101 - protein, 9 aa, Homo Sapiens
KGTVGKISA

SEQ ID NO: 948102 - protein, 9 aa, Homo Sapiens
DGRVVEGNY

SEQ ID NO: 948103 - protein, 9 aa, Homo Sapiens
ASEERESTE

SEQ ID NO: 948104 - protein, 9 aa, Homo Sapiens
VLHIDTQAG

SEQ ID NO: 948105 - protein, 9 aa, Homo Sapiens
KKPETPIVP

SEQ ID NO: 948106 - protein, 9 aa, Homo Sapiens
AQEVMRRHQ

SEQ ID NO: 948107 - protein, 9 aa, Homo Sapiens
NSAFSLAPG

SEQ ID NO: 948108 - protein, 9 aa, Homo Sapiens
SFVNEISWV

SEQ ID NO: 948109 - protein, 9 aa, Homo Sapiens
ILFGIVGAY

SEQ ID NO: 948110 - protein, 9 aa, Homo Sapiens
NKLQKQEKT

SEQ ID NO: 948111 - protein, 9 aa, Homo Sapiens
VSKRQEAQV

SEQ ID NO: 948112 - protein, 9 aa, Homo Sapiens
DTAVLIIDN

SEQ ID NO: 948113 - protein, 9 aa, Homo Sapiens
FQLENFILK

SEQ ID NO: 948114 - protein, 9 aa, Homo Sapiens
LLVGVGESG

SEQ ID NO: 948115 - protein, 9 aa, Homo Sapiens
CPSHDTGQP

SEQ ID NO: 948116 - protein, 9 aa, Homo Sapiens
SQRLQGHLE

SEQ ID NO: 948117 - protein, 9 aa, Homo Sapiens
KRSTIMSGF

SEQ ID NO: 948118 - protein, 9 aa, Homo Sapiens
SSLIIVNAK

SEQ ID NO: 948119 - protein, 9 aa, Homo Sapiens
MEAPTTVYK

SEQ ID NO: 948120 - protein, 9 aa, Homo Sapiens
VKQRYKECC

SEQ ID NO: 948121 - protein, 9 aa, Homo Sapiens
EKTVEVPFK

SEQ ID NO: 948122 - protein, 9 aa, Homo Sapiens
QFRVNRFPC

SEQ ID NO: 948123 - protein, 9 aa, Homo Sapiens
SAFSLAPGF

SEQ ID NO: 948124 - protein, 9 aa, Homo Sapiens
LESIGFSAR

SEQ ID NO: 948125 - protein, 9 aa, Homo Sapiens
FEEYTGSSL

SEQ ID NO: 948126 - protein, 9 aa, Homo Sapiens
ARIWEFVPP

SEQ ID NO: 948127 - protein, 9 aa, Homo Sapiens
AANFTDQKK

SEQ ID NO: 948128 - protein, 9 aa, Homo Sapiens
LAPAHPLNL

SEQ ID NO: 948129 - protein, 9 aa, Homo Sapiens
FEIKEDYKN

SEQ ID NO: 948130 - protein, 9 aa, Homo Sapiens
GSVYGMNRL

SEQ ID NO: 948131 - protein, 9 aa, Homo Sapiens
FLMKKKLDY

SEQ ID NO: 948132 - protein, 9 aa, Homo Sapiens
LYGRVLWNS

SEQ ID NO: 948133 - protein, 9 aa, Homo Sapiens
VNGAHLQNV

SEQ ID NO: 948134 - protein, 9 aa, Homo Sapiens
SQFVEEALK

SEQ ID NO: 948135 - protein, 9 aa, Homo Sapiens
YEGLPTVVK

SEQ ID NO: 948136 - protein, 9 aa, Homo Sapiens
PRGGLFLPP

SEQ ID NO: 948137 - protein, 9 aa, Homo Sapiens
ASASSFAPN

SEQ ID NO: 948138 - protein, 9 aa, Homo Sapiens
ESGQVPVYV

SEQ ID NO: 948139 - protein, 9 aa, Homo Sapiens
RTAPEIYHR

SEQ ID NO: 948140 - protein, 9 aa, Homo Sapiens
FSVSIRKEL

SEQ ID NO: 948141 - protein, 9 aa, Homo Sapiens
KVEQIQQRD

SEQ ID NO: 948142 - protein, 9 aa, Homo Sapiens
SSECASLSS

SEQ ID NO: 948143 - protein, 9 aa, Homo Sapiens
LKAVEGEGS

SEQ ID NO: 948144 - protein, 9 aa, Homo Sapiens
LQNLCGQSS

SEQ ID NO: 948145 - protein, 9 aa, Homo Sapiens
NTTTILAAG

SEQ ID NO: 948146 - protein, 9 aa, Homo Sapiens
PKTTAPGAH

SEQ ID NO: 948147 - protein, 9 aa, Homo Sapiens
DKKDLAHTL

SEQ ID NO: 948148 - protein, 9 aa, Homo Sapiens
RTMSSRVHK

SEQ ID NO: 948149 - protein, 9 aa, Homo Sapiens
GVPWGVYSA

SEQ ID NO: 948150 - protein, 9 aa, Homo Sapiens
QFKRMKVVV

SEQ ID NO: 948151 - protein, 9 aa, Homo Sapiens
FVEYIIFPS

SEQ ID NO: 948152 - protein, 9 aa, Homo Sapiens
KQKVALSLW

SEQ ID NO: 948153 - protein, 9 aa, Homo Sapiens
KALPPNWEA

SEQ ID NO: 948154 - protein, 9 aa, Homo Sapiens
RPAGSWEQL

SEQ ID NO: 948155 - protein, 9 aa, Homo Sapiens
IFLEIVDNF

SEQ ID NO: 948156 - protein, 9 aa, Homo Sapiens
FSLSPDVCR

SEQ ID NO: 948157 - protein, 9 aa, Homo Sapiens
SPCYEFLWG

SEQ ID NO: 948158 - protein, 9 aa, Homo Sapiens
GKKRSTIMS

SEQ ID NO: 948159 - protein, 9 aa, Homo Sapiens
LRQKVEFLV

SEQ ID NO: 948160 - protein, 9 aa, Homo Sapiens
TYACKSSYL

SEQ ID NO: 948161 - protein, 9 aa, Homo Sapiens
FDFCVQVKP

SEQ ID NO: 948162 - protein, 9 aa, Homo Sapiens
NQCTINKNR

SEQ ID NO: 948163 - protein, 9 aa, Homo Sapiens
LHVAADCGN

SEQ ID NO: 948164 - protein, 9 aa, Homo Sapiens
KREVLLPVE

SEQ ID NO: 948165 - protein, 9 aa, Homo Sapiens
YIDILETVL

SEQ ID NO: 948166 - protein, 9 aa, Homo Sapiens
DQWSQKKKT

SEQ ID NO: 948167 - protein, 9 aa, Homo Sapiens
KLRKDLFFS

SEQ ID NO: 948168 - protein, 9 aa, Homo Sapiens
SLFLSGVGL

SEQ ID NO: 948169 - protein, 9 aa, Homo Sapiens
FQTIDHPWT

SEQ ID NO: 948170 - protein, 9 aa, Homo Sapiens
SGAMERSLT

SEQ ID NO: 948171 - protein, 9 aa, Homo Sapiens
EKQLALSNA

SEQ ID NO: 948172 - protein, 9 aa, Homo Sapiens
SHTQENVSK

SEQ ID NO: 948173 - protein, 9 aa, Homo Sapiens
SRQHKQLLR

SEQ ID NO: 948174 - protein, 9 aa, Homo Sapiens
PLESRAQLS

SEQ ID NO: 948175 - protein, 9 aa, Homo Sapiens
QNNTLYIAP

SEQ ID NO: 948176 - protein, 9 aa, Homo Sapiens
SVAEPFFSN

SEQ ID NO: 948177 - protein, 9 aa, Homo Sapiens
CKDIVARDM

SEQ ID NO: 948178 - protein, 9 aa, Homo Sapiens
NILDEAHER

SEQ ID NO: 948179 - protein, 9 aa, Homo Sapiens
DCLGLCFSW

SEQ ID NO: 948180 - protein, 9 aa, Homo Sapiens
KMPEQEYKF

SEQ ID NO: 948181 - protein, 9 aa, Homo Sapiens
RMEFFQPLD

SEQ ID NO: 948182 - protein, 9 aa, Homo Sapiens
LNTWNFSIF

SEQ ID NO: 948183 - protein, 9 aa, Homo Sapiens
GGGLSVFSR

SEQ ID NO: 948184 - protein, 9 aa, Homo Sapiens
AERPFGEMG

SEQ ID NO: 948185 - protein, 9 aa, Homo Sapiens
VRDMRLMFC

SEQ ID NO: 948186 - protein, 9 aa, Homo Sapiens
ELQKECETA

SEQ ID NO: 948187 - protein, 9 aa, Homo Sapiens
SILWDGLDS

SEQ ID NO: 948188 - protein, 9 aa, Homo Sapiens
HVMDVVVKF

SEQ ID NO: 948189 - protein, 9 aa, Homo Sapiens
NGTSTLREN

SEQ ID NO: 948190 - protein, 9 aa, Homo Sapiens
DSKIIQKGS

SEQ ID NO: 948191 - protein, 9 aa, Homo Sapiens
SPSASPPAS

SEQ ID NO: 948192 - protein, 9 aa, Homo Sapiens
SCLTCRMSL

SEQ ID NO: 948193 - protein, 9 aa, Homo Sapiens
RMKKATWFI

SEQ ID NO: 948194 - protein, 9 aa, Homo Sapiens
SLHRVFHKS

SEQ ID NO: 948195 - protein, 9 aa, Homo Sapiens
QHRSHECQG

SEQ ID NO: 948196 - protein, 9 aa, Homo Sapiens
TDMNNKITY

SEQ ID NO: 948197 - protein, 9 aa, Homo Sapiens
EGLGGAPSP

SEQ ID NO: 948198 - protein, 9 aa, Homo Sapiens
MPPATSPLP

SEQ ID NO: 948199 - protein, 9 aa, Homo Sapiens
RQRESTTFQ

SEQ ID NO: 948200 - protein, 9 aa, Homo Sapiens
ANKTDSPSS

SEQ ID NO: 948201 - protein, 9 aa, Homo Sapiens
APTEYAFIC

SEQ ID NO: 948202 - protein, 9 aa, Homo Sapiens
YNLVGASEL

SEQ ID NO: 948203 - protein, 9 aa, Homo Sapiens
LLADLVVRI

SEQ ID NO: 948204 - protein, 9 aa, Homo Sapiens
KKRSLHANG

SEQ ID NO: 948205 - protein, 9 aa, Homo Sapiens
QRKESLDFI

SEQ ID NO: 948206 - protein, 9 aa, Homo Sapiens
IVLKIAMIV

SEQ ID NO: 948207 - protein, 9 aa, Homo Sapiens
NESNLELYK

SEQ ID NO: 948208 - protein, 9 aa, Homo Sapiens
STKEGTTEY

SEQ ID NO: 948209 - protein, 9 aa, Homo Sapiens
PLPTIRWLL

SEQ ID NO: 948210 - protein, 9 aa, Homo Sapiens
KEKKRIKRA

SEQ ID NO: 948211 - protein, 9 aa, Homo Sapiens
EEQLRKLEN

SEQ ID NO: 948212 - protein, 9 aa, Homo Sapiens
ENCTLELKG

SEQ ID NO: 948213 - protein, 9 aa, Homo Sapiens
MDLLGPSLK

SEQ ID NO: 948214 - protein, 9 aa, Homo Sapiens
EGIFCVNCM

SEQ ID NO: 948215 - protein, 9 aa, Homo Sapiens
GGAWDPHSG

SEQ ID NO: 948216 - protein, 9 aa, Homo Sapiens
AQSLHRVFH

SEQ ID NO: 948217 - protein, 9 aa, Homo Sapiens
LDDMRCKEN

SEQ ID NO: 948218 - protein, 9 aa, Homo Sapiens
ITSLSPRSS

SEQ ID NO: 948219 - protein, 9 aa, Homo Sapiens
CGVRCYPGF

SEQ ID NO: 948220 - protein, 9 aa, Homo Sapiens
IHIIDQKTR

SEQ ID NO: 948221 - protein, 9 aa, Homo Sapiens
FNEKFQNIT

SEQ ID NO: 948222 - protein, 9 aa, Homo Sapiens
WGLVLMPGE

SEQ ID NO: 948223 - protein, 9 aa, Homo Sapiens
IQRKKKNSL

SEQ ID NO: 948224 - protein, 9 aa, Homo Sapiens
VRAFTYCDL

SEQ ID NO: 948225 - protein, 9 aa, Homo Sapiens
AADLYELNL

SEQ ID NO: 948226 - protein, 9 aa, Homo Sapiens
KLDYFAKAL

SEQ ID NO: 948227 - protein, 9 aa, Homo Sapiens
PLESRVSHL

SEQ ID NO: 948228 - protein, 9 aa, Homo Sapiens
TNHFETASS

SEQ ID NO: 948229 - protein, 9 aa, Homo Sapiens
AYWSYVLHR

SEQ ID NO: 948230 - protein, 9 aa, Homo Sapiens
QETLHLKVK

SEQ ID NO: 948231 - protein, 9 aa, Homo Sapiens
FLQRLQLEY

SEQ ID NO: 948232 - protein, 9 aa, Homo Sapiens
EDYEGLPTV

SEQ ID NO: 948233 - protein, 9 aa, Homo Sapiens
EARSSAAFP

SEQ ID NO: 948234 - protein, 9 aa, Homo Sapiens
LNVERFLVR

SEQ ID NO: 948235 - protein, 9 aa, Homo Sapiens
RITGPPGDP

SEQ ID NO: 948236 - protein, 9 aa, Homo Sapiens
DDVWILVEM

SEQ ID NO: 948237 - protein, 9 aa, Homo Sapiens
PSSQDYPLP

SEQ ID NO: 948238 - protein, 9 aa, Homo Sapiens
IYFHCDNDY

SEQ ID NO: 948239 - protein, 9 aa, Homo Sapiens
AETAKKLTP

SEQ ID NO: 948240 - protein, 9 aa, Homo Sapiens
LEGDAHFDE

SEQ ID NO: 948241 - protein, 9 aa, Homo Sapiens
IWKEVVDWG

SEQ ID NO: 948242 - protein, 9 aa, Homo Sapiens
TTASITDSE

SEQ ID NO: 948243 - protein, 9 aa, Homo Sapiens
GFYQKIDEN

SEQ ID NO: 948244 - protein, 9 aa, Homo Sapiens
TWNKVFEFM

SEQ ID NO: 948245 - protein, 9 aa, Homo Sapiens
PSDKGTYEC

SEQ ID NO: 948246 - protein, 9 aa, Homo Sapiens
LHDLASLSP

SEQ ID NO: 948247 - protein, 9 aa, Homo Sapiens
VTTAWGGNY

SEQ ID NO: 948248 - protein, 9 aa, Homo Sapiens
RGGNLSARH

SEQ ID NO: 948249 - protein, 9 aa, Homo Sapiens
LVMGTEWTL

SEQ ID NO: 948250 - protein, 9 aa, Homo Sapiens
APEPRGAFR

SEQ ID NO: 948251 - protein, 9 aa, Homo Sapiens
RSRGTGLFF

SEQ ID NO: 948252 - protein, 9 aa, Homo Sapiens
PRGASKALL

SEQ ID NO: 948253 - protein, 9 aa, Homo Sapiens
REQSNPNYD

SEQ ID NO: 948254 - protein, 9 aa, Homo Sapiens
GIVLIISLN

SEQ ID NO: 948255 - protein, 9 aa, Homo Sapiens
SPSFRKELE

SEQ ID NO: 948256 - protein, 9 aa, Homo Sapiens
DVAKERKRK

SEQ ID NO: 948257 - protein, 9 aa, Homo Sapiens
QWEVEELSV

SEQ ID NO: 948258 - protein, 9 aa, Homo Sapiens
VNQQCISSR

SEQ ID NO: 948259 - protein, 9 aa, Homo Sapiens
QELQRLVHP

SEQ ID NO: 948260 - protein, 9 aa, Homo Sapiens
NGIYEAIYY

SEQ ID NO: 948261 - protein, 9 aa, Homo Sapiens
EAGNIEAKS

SEQ ID NO: 948262 - protein, 9 aa, Homo Sapiens
GMRVTLRKS

SEQ ID NO: 948263 - protein, 9 aa, Homo Sapiens
KTVTLHCEV

SEQ ID NO: 948264 - protein, 9 aa, Homo Sapiens
SRLDVYFLH

SEQ ID NO: 948265 - protein, 9 aa, Homo Sapiens
KPKKRFSKH

SEQ ID NO: 948266 - protein, 9 aa, Homo Sapiens
AQRDKELRH

SEQ ID NO: 948267 - protein, 9 aa, Homo Sapiens
NHTSSQMLK

SEQ ID NO: 948268 - protein, 9 aa, Homo Sapiens
TDFIIVLAN

SEQ ID NO: 948269 - protein, 9 aa, Homo Sapiens
ADRMQKKIT

SEQ ID NO: 948270 - protein, 9 aa, Homo Sapiens
PFANAIKSD

SEQ ID NO: 948271 - protein, 9 aa, Homo Sapiens
GWIAPCRPC

SEQ ID NO: 948272 - protein, 9 aa, Homo Sapiens
HELTKLSAF

SEQ ID NO: 948273 - protein, 9 aa, Homo Sapiens
IVYEIDSAS

SEQ ID NO: 948274 - protein, 9 aa, Homo Sapiens
PPFPKPHPC

SEQ ID NO: 948275 - protein, 9 aa, Homo Sapiens
KISPEERRL

SEQ ID NO: 948276 - protein, 9 aa, Homo Sapiens
PDGCPELCR

SEQ ID NO: 948277 - protein, 9 aa, Homo Sapiens
LLGPPGFPG

SEQ ID NO: 948278 - protein, 9 aa, Homo Sapiens
TDLDAGINE

SEQ ID NO: 948279 - protein, 9 aa, Homo Sapiens
DAAPACVGL

SEQ ID NO: 948280 - protein, 9 aa, Homo Sapiens
GPTTKNLNF

SEQ ID NO: 948281 - protein, 9 aa, Homo Sapiens
LILDTSLIP

SEQ ID NO: 948282 - protein, 9 aa, Homo Sapiens
AQKPPASGG

SEQ ID NO: 948283 - protein, 9 aa, Homo Sapiens
NSSMCLEDN

SEQ ID NO: 948284 - protein, 9 aa, Homo Sapiens
GPSPGGGAP

SEQ ID NO: 948285 - protein, 9 aa, Homo Sapiens
HPREMKKKV

SEQ ID NO: 948286 - protein, 9 aa, Homo Sapiens
WDNSIPNHV

SEQ ID NO: 948287 - protein, 9 aa, Homo Sapiens
CQGNLPLHQ

SEQ ID NO: 948288 - protein, 9 aa, Homo Sapiens
SLRCISKMN

SEQ ID NO: 948289 - protein, 9 aa, Homo Sapiens
IDSAGSFNG

SEQ ID NO: 948290 - protein, 9 aa, Homo Sapiens
NLCQSWIIN

SEQ ID NO: 948291 - protein, 9 aa, Homo Sapiens
LFPTMTLLP

SEQ ID NO: 948292 - protein, 9 aa, Homo Sapiens
LGEHDFSEH

SEQ ID NO: 948293 - protein, 9 aa, Homo Sapiens
NDMGCINPM

SEQ ID NO: 948294 - protein, 9 aa, Homo Sapiens
RPFLIARIP

SEQ ID NO: 948295 - protein, 9 aa, Homo Sapiens
WGGNYWRLL

SEQ ID NO: 948296 - protein, 9 aa, Homo Sapiens
SKFLKSQVA

SEQ ID NO: 948297 - protein, 9 aa, Homo Sapiens
GVTTATEQA

SEQ ID NO: 948298 - protein, 9 aa, Homo Sapiens
VSLAWDKSL

SEQ ID NO: 948299 - protein, 9 aa, Homo Sapiens
VCECKECGK

SEQ ID NO: 948300 - protein, 9 aa, Homo Sapiens
ANPKDIIYF

SEQ ID NO: 948301 - protein, 9 aa, Homo Sapiens
FVFPTLFRV

SEQ ID NO: 948302 - protein, 9 aa, Homo Sapiens
LNPIPSDLK

SEQ ID NO: 948303 - protein, 9 aa, Homo Sapiens
QEKKFFDIW

SEQ ID NO: 948304 - protein, 9 aa, Homo Sapiens
TETTSTTLS

SEQ ID NO: 948305 - protein, 9 aa, Homo Sapiens
FPDFGQEVA

SEQ ID NO: 948306 - protein, 9 aa, Homo Sapiens
SSFIGTEPD

SEQ ID NO: 948307 - protein, 9 aa, Homo Sapiens
CNHKTFYKA

SEQ ID NO: 948308 - protein, 9 aa, Homo Sapiens
EAGKEGEGG

SEQ ID NO: 948309 - protein, 9 aa, Homo Sapiens
RADHKADFR

SEQ ID NO: 948310 - protein, 9 aa, Homo Sapiens
LQKEISDLT

SEQ ID NO: 948311 - protein, 9 aa, Homo Sapiens
AGQEKKGKA

SEQ ID NO: 948312 - protein, 9 aa, Homo Sapiens
SVLEDLESR

SEQ ID NO: 948313 - protein, 9 aa, Homo Sapiens
MDSKTLQQV

SEQ ID NO: 948314 - protein, 9 aa, Homo Sapiens
EEASEERES

SEQ ID NO: 948315 - protein, 9 aa, Homo Sapiens
DNVHFFTGA

SEQ ID NO: 948316 - protein, 9 aa, Homo Sapiens
DITKESIKE

SEQ ID NO: 948317 - protein, 9 aa, Homo Sapiens
VSTLNAQIS

SEQ ID NO: 948318 - protein, 9 aa, Homo Sapiens
HSLPAVILQ

SEQ ID NO: 948319 - protein, 9 aa, Homo Sapiens
AFFEDGEGN

SEQ ID NO: 948320 - protein, 9 aa, Homo Sapiens
VFNTLEGVP

SEQ ID NO: 948321 - protein, 9 aa, Homo Sapiens
AAESPEKKE

SEQ ID NO: 948322 - protein, 9 aa, Homo Sapiens
YAAEMSKAF

SEQ ID NO: 948323 - protein, 9 aa, Homo Sapiens
NHFAVIYYL

SEQ ID NO: 948324 - protein, 9 aa, Homo Sapiens
EAESFSGGE

SEQ ID NO: 948325 - protein, 9 aa, Homo Sapiens
KQNTLLETP

SEQ ID NO: 948326 - protein, 9 aa, Homo Sapiens
AFAESWNAA

SEQ ID NO: 948327 - protein, 9 aa, Homo Sapiens
DTPAEARTT

SEQ ID NO: 948328 - protein, 9 aa, Homo Sapiens
TQVTFVFRL

SEQ ID NO: 948329 - protein, 9 aa, Homo Sapiens
TPTGGFGLN

SEQ ID NO: 948330 - protein, 9 aa, Homo Sapiens
DGPKATLCG

SEQ ID NO: 948331 - protein, 9 aa, Homo Sapiens
PSVFLWQFY

SEQ ID NO: 948332 - protein, 9 aa, Homo Sapiens
LVFHNHKEF

SEQ ID NO: 948333 - protein, 9 aa, Homo Sapiens
DPRHAGGRP

SEQ ID NO: 948334 - protein, 9 aa, Homo Sapiens
LAFRARLVD

SEQ ID NO: 948335 - protein, 9 aa, Homo Sapiens
VGILTIIAS

SEQ ID NO: 948336 - protein, 9 aa, Homo Sapiens
RPKTTAPGA

SEQ ID NO: 948337 - protein, 9 aa, Homo Sapiens
NLAARPPLS

SEQ ID NO: 948338 - protein, 9 aa, Homo Sapiens
YLYEFWYKL

SEQ ID NO: 948339 - protein, 9 aa, Homo Sapiens
NQVQELVEL

SEQ ID NO: 948340 - protein, 9 aa, Homo Sapiens
NIRGNRIQK

SEQ ID NO: 948341 - protein, 9 aa, Homo Sapiens
KKSKTLQKF

SEQ ID NO: 948342 - protein, 9 aa, Homo Sapiens
CTTNKTMCK

SEQ ID NO: 948343 - protein, 9 aa, Homo Sapiens
RSHECQGSG

SEQ ID NO: 948344 - protein, 9 aa, Homo Sapiens
SPSSKRDKR

SEQ ID NO: 948345 - protein, 9 aa, Homo Sapiens
DMGCINPMY

SEQ ID NO: 948346 - protein, 9 aa, Homo Sapiens
YLSDSHYTS

SEQ ID NO: 948347 - protein, 9 aa, Homo Sapiens
ESQSLIFQA

SEQ ID NO: 948348 - protein, 9 aa, Homo Sapiens
QMFSTTSFL

SEQ ID NO: 948349 - protein, 9 aa, Homo Sapiens
ECGKASNQK

SEQ ID NO: 948350 - protein, 9 aa, Homo Sapiens
KETRDRFHL

SEQ ID NO: 948351 - protein, 9 aa, Homo Sapiens
IIHVAQNPH

SEQ ID NO: 948352 - protein, 9 aa, Homo Sapiens
NKRWTPPGS

SEQ ID NO: 948353 - protein, 9 aa, Homo Sapiens
GNSKQYKIF

SEQ ID NO: 948354 - protein, 9 aa, Homo Sapiens
LANGQVSEM

SEQ ID NO: 948355 - protein, 9 aa, Homo Sapiens
FLELCTLPS

SEQ ID NO: 948356 - protein, 9 aa, Homo Sapiens
LGAACHGDI

SEQ ID NO: 948357 - protein, 9 aa, Homo Sapiens
STLCPLCRT

SEQ ID NO: 948358 - protein, 9 aa, Homo Sapiens
QSPAPTYLS

SEQ ID NO: 948359 - protein, 9 aa, Homo Sapiens
RQQLSENTL

SEQ ID NO: 948360 - protein, 9 aa, Homo Sapiens
QLYDCQLYR

SEQ ID NO: 948361 - protein, 9 aa, Homo Sapiens
ESPNAIVYY

SEQ ID NO: 948362 - protein, 9 aa, Homo Sapiens
RELGRPNCD

SEQ ID NO: 948363 - protein, 9 aa, Homo Sapiens
EQECVEETC

SEQ ID NO: 948364 - protein, 9 aa, Homo Sapiens
RMQKKITAL

SEQ ID NO: 948365 - protein, 9 aa, Homo Sapiens
IFYASNYVP

SEQ ID NO: 948366 - protein, 9 aa, Homo Sapiens
VYFAISNYV

SEQ ID NO: 948367 - protein, 9 aa, Homo Sapiens
LGGGSREGL

SEQ ID NO: 948368 - protein, 9 aa, Homo Sapiens
FAISAGTGA

SEQ ID NO: 948369 - protein, 9 aa, Homo Sapiens
IVSRSSKDS

SEQ ID NO: 948370 - protein, 9 aa, Homo Sapiens
NYSDGTICQ

SEQ ID NO: 948371 - protein, 9 aa, Homo Sapiens
GPLSGLQAS

SEQ ID NO: 948372 - protein, 9 aa, Homo Sapiens
YFFFCESSQ

SEQ ID NO: 948373 - protein, 9 aa, Homo Sapiens
NKASGGRYV

SEQ ID NO: 948374 - protein, 9 aa, Homo Sapiens
WIAPCRPCL

SEQ ID NO: 948375 - protein, 9 aa, Homo Sapiens
TWGEPSKPK

SEQ ID NO: 948376 - protein, 9 aa, Homo Sapiens
SAPTELLLC

SEQ ID NO: 948377 - protein, 9 aa, Homo Sapiens
IYLTLSPND

SEQ ID NO: 948378 - protein, 9 aa, Homo Sapiens
NGDISFHRP

SEQ ID NO: 948379 - protein, 9 aa, Homo Sapiens
NLVPKTDKT

SEQ ID NO: 948380 - protein, 9 aa, Homo Sapiens
FVTRFGGDW

SEQ ID NO: 948381 - protein, 9 aa, Homo Sapiens
QEVMRRHQK

SEQ ID NO: 948382 - protein, 9 aa, Homo Sapiens
HLIPQVLDL

SEQ ID NO: 948383 - protein, 9 aa, Homo Sapiens
PKATGGFTT

SEQ ID NO: 948384 - protein, 9 aa, Homo Sapiens
GKLAFVMEP

SEQ ID NO: 948385 - protein, 9 aa, Homo Sapiens
WITQAEDIN

SEQ ID NO: 948386 - protein, 9 aa, Homo Sapiens
LMNLEYMIC

SEQ ID NO: 948387 - protein, 9 aa, Homo Sapiens
RFTVSTLRN

SEQ ID NO: 948388 - protein, 9 aa, Homo Sapiens
GFGLNLALN

SEQ ID NO: 948389 - protein, 9 aa, Homo Sapiens
SGTPKSITS

SEQ ID NO: 948390 - protein, 9 aa, Homo Sapiens
HQAQRIQEI

SEQ ID NO: 948391 - protein, 9 aa, Homo Sapiens
EGKKKCVHY

SEQ ID NO: 948392 - protein, 9 aa, Homo Sapiens
PHPDPRHAG

SEQ ID NO: 948393 - protein, 9 aa, Homo Sapiens
NSLGTIPGG

SEQ ID NO: 948394 - protein, 9 aa, Homo Sapiens
RKVATSKLV

SEQ ID NO: 948395 - protein, 9 aa, Homo Sapiens
PARDSRRLE

SEQ ID NO: 948396 - protein, 9 aa, Homo Sapiens
KSQAFMVIN

SEQ ID NO: 948397 - protein, 9 aa, Homo Sapiens
SQSPAPTYL

SEQ ID NO: 948398 - protein, 9 aa, Homo Sapiens
VKWPNNIYY

SEQ ID NO: 948399 - protein, 9 aa, Homo Sapiens
NPKDIIYFF

SEQ ID NO: 948400 - protein, 9 aa, Homo Sapiens
SRRKKGPFR

SEQ ID NO: 948401 - protein, 9 aa, Homo Sapiens
QRRFTVSTL

SEQ ID NO: 948402 - protein, 9 aa, Homo Sapiens
ATFNSSWAS

SEQ ID NO: 948403 - protein, 9 aa, Homo Sapiens
YSSVNTPSL

SEQ ID NO: 948404 - protein, 9 aa, Homo Sapiens
ATKKVNLDS

SEQ ID NO: 948405 - protein, 9 aa, Homo Sapiens
LKDLFNFCS

SEQ ID NO: 948406 - protein, 9 aa, Homo Sapiens
WWRESSLLV

SEQ ID NO: 948407 - protein, 9 aa, Homo Sapiens
PDASYLWWI

SEQ ID NO: 948408 - protein, 9 aa, Homo Sapiens
QRKKKNSLD

SEQ ID NO: 948409 - protein, 9 aa, Homo Sapiens
SGGAWDPHS

SEQ ID NO: 948410 - protein, 9 aa, Homo Sapiens
LLCGQPKVG

SEQ ID NO: 948411 - protein, 9 aa, Homo Sapiens
RNQGCQLSG

SEQ ID NO: 948412 - protein, 9 aa, Homo Sapiens
GITCLDYEN

SEQ ID NO: 948413 - protein, 9 aa, Homo Sapiens
NENKSDNEN

SEQ ID NO: 948414 - protein, 9 aa, Homo Sapiens
VSDDKTLCI

SEQ ID NO: 948415 - protein, 9 aa, Homo Sapiens
VPSPPPIAL

SEQ ID NO: 948416 - protein, 9 aa, Homo Sapiens
LLFEYPKSS

SEQ ID NO: 948417 - protein, 9 aa, Homo Sapiens
VMLAAHCVA

SEQ ID NO: 948418 - protein, 9 aa, Homo Sapiens
LECSSIRIT

SEQ ID NO: 948419 - protein, 9 aa, Homo Sapiens
HKCQLPKDV

SEQ ID NO: 948420 - protein, 9 aa, Homo Sapiens
VCDIDPQND

SEQ ID NO: 948421 - protein, 9 aa, Homo Sapiens
GPLPRFLND

SEQ ID NO: 948422 - protein, 9 aa, Homo Sapiens
YWALTVPEL

SEQ ID NO: 948423 - protein, 9 aa, Homo Sapiens
LFQLDESKE

SEQ ID NO: 948424 - protein, 9 aa, Homo Sapiens
QKKITALAP

SEQ ID NO: 948425 - protein, 9 aa, Homo Sapiens
QQKTNPVVE

SEQ ID NO: 948426 - protein, 9 aa, Homo Sapiens
LISYSICRL

SEQ ID NO: 948427 - protein, 9 aa, Homo Sapiens
VVKIWNFNL

SEQ ID NO: 948428 - protein, 9 aa, Homo Sapiens
NSPTGGPRG

SEQ ID NO: 948429 - protein, 9 aa, Homo Sapiens
KLPPPGQGE

SEQ ID NO: 948430 - protein, 9 aa, Homo Sapiens
SIKMRVFLL

SEQ ID NO: 948431 - protein, 9 aa, Homo Sapiens
HEGGKFEGQ

SEQ ID NO: 948432 - protein, 9 aa, Homo Sapiens
SDHKLIVSV

SEQ ID NO: 948433 - protein, 9 aa, Homo Sapiens
LLEEDSDPM

SEQ ID NO: 948434 - protein, 9 aa, Homo Sapiens
SHYKYKTKV

SEQ ID NO: 948435 - protein, 9 aa, Homo Sapiens
ATPEPEARE

SEQ ID NO: 948436 - protein, 9 aa, Homo Sapiens
NLKNFNETF

SEQ ID NO: 948437 - protein, 9 aa, Homo Sapiens
PKTCENFMA

SEQ ID NO: 948438 - protein, 9 aa, Homo Sapiens
RRNRFKWWP

SEQ ID NO: 948439 - protein, 9 aa, Homo Sapiens
QKPVFADTN

SEQ ID NO: 948440 - protein, 9 aa, Homo Sapiens
CVNQQCISS

SEQ ID NO: 948441 - protein, 9 aa, Homo Sapiens
AVRDTTTLS

SEQ ID NO: 948442 - protein, 9 aa, Homo Sapiens
TSGLVFLHS

SEQ ID NO: 948443 - protein, 9 aa, Homo Sapiens
GCFSKRLLL

SEQ ID NO: 948444 - protein, 9 aa, Homo Sapiens
KGPFRQYPA

SEQ ID NO: 948445 - protein, 9 aa, Homo Sapiens
VLTLSEIPL

SEQ ID NO: 948446 - protein, 9 aa, Homo Sapiens
HLQNVFMLL

SEQ ID NO: 948447 - protein, 9 aa, Homo Sapiens
QRNYSDGTI

SEQ ID NO: 948448 - protein, 9 aa, Homo Sapiens
LPLGPHLQN

SEQ ID NO: 948449 - protein, 9 aa, Homo Sapiens
KPPNGEPVA

SEQ ID NO: 948450 - protein, 9 aa, Homo Sapiens
AKKLTPFLL

SEQ ID NO: 948451 - protein, 9 aa, Homo Sapiens
DKLRKDLFF

SEQ ID NO: 948452 - protein, 9 aa, Homo Sapiens
ASLRPLSPR

SEQ ID NO: 948453 - protein, 9 aa, Homo Sapiens
SQNTQDRYT

SEQ ID NO: 948454 - protein, 9 aa, Homo Sapiens
QICNPANDA

SEQ ID NO: 948455 - protein, 9 aa, Homo Sapiens
SKKPIPRIS

SEQ ID NO: 948456 - protein, 9 aa, Homo Sapiens
SNKLTFYPP

SEQ ID NO: 948457 - protein, 9 aa, Homo Sapiens
RVVEGNYMV

SEQ ID NO: 948458 - protein, 9 aa, Homo Sapiens
QAINRVSSK

SEQ ID NO: 948459 - protein, 9 aa, Homo Sapiens
NNLNLRYCM

SEQ ID NO: 948460 - protein, 9 aa, Homo Sapiens
DVWNGWKEF

SEQ ID NO: 948461 - protein, 9 aa, Homo Sapiens
RDRYFKGIV

SEQ ID NO: 948462 - protein, 9 aa, Homo Sapiens
RSSKDSRFA

SEQ ID NO: 948463 - protein, 9 aa, Homo Sapiens
AITIFNNFD

SEQ ID NO: 948464 - protein, 9 aa, Homo Sapiens
CPATVSFLV

SEQ ID NO: 948465 - protein, 9 aa, Homo Sapiens
PEKQPLLFG

SEQ ID NO: 948466 - protein, 9 aa, Homo Sapiens
TRYSVPYGQ

SEQ ID NO: 948467 - protein, 9 aa, Homo Sapiens
KMIQVPETV

SEQ ID NO: 948468 - protein, 9 aa, Homo Sapiens
FAFGVQQLY

SEQ ID NO: 948469 - protein, 9 aa, Homo Sapiens
GKMREIKEV

SEQ ID NO: 948470 - protein, 9 aa, Homo Sapiens
RSYSRSPLY

SEQ ID NO: 948471 - protein, 9 aa, Homo Sapiens
AYSASWDLP

SEQ ID NO: 948472 - protein, 9 aa, Homo Sapiens
RVLSQFKRM

SEQ ID NO: 948473 - protein, 9 aa, Homo Sapiens
RHNGLLCDV

SEQ ID NO: 948474 - protein, 9 aa, Homo Sapiens
VTTVWRVTN

SEQ ID NO: 948475 - protein, 9 aa, Homo Sapiens
VGAPLSCNH

SEQ ID NO: 948476 - protein, 9 aa, Homo Sapiens
NVIISEKLD

SEQ ID NO: 948477 - protein, 9 aa, Homo Sapiens
CKFKKSVFE

SEQ ID NO: 948478 - protein, 9 aa, Homo Sapiens
GPKATLCGD

SEQ ID NO: 948479 - protein, 9 aa, Homo Sapiens
ESWGYNGND

SEQ ID NO: 948480 - protein, 9 aa, Homo Sapiens
RNEKGLPIL

SEQ ID NO: 948481 - protein, 9 aa, Homo Sapiens
TWNFSIFDL

SEQ ID NO: 948482 - protein, 9 aa, Homo Sapiens
SLEHKKLTV

SEQ ID NO: 948483 - protein, 9 aa, Homo Sapiens
FYKEQKRQK

SEQ ID NO: 948484 - protein, 9 aa, Homo Sapiens
EVLNQEPFH

SEQ ID NO: 948485 - protein, 9 aa, Homo Sapiens
HCGGTSHPD

SEQ ID NO: 948486 - protein, 9 aa, Homo Sapiens
VLPIVHYNM

SEQ ID NO: 948487 - protein, 9 aa, Homo Sapiens
DLYALEHTY

SEQ ID NO: 948488 - protein, 9 aa, Homo Sapiens
ANKRWTPPG

SEQ ID NO: 948489 - protein, 9 aa, Homo Sapiens
GLVGSSQAP

SEQ ID NO: 948490 - protein, 9 aa, Homo Sapiens
ITIFNNFDW

SEQ ID NO: 948491 - protein, 9 aa, Homo Sapiens
MFTRLFNCA

SEQ ID NO: 948492 - protein, 9 aa, Homo Sapiens
FENAESLKS

SEQ ID NO: 948493 - protein, 9 aa, Homo Sapiens
SECASLSSG

SEQ ID NO: 948494 - protein, 9 aa, Homo Sapiens
VQYAILSKQ

SEQ ID NO: 948495 - protein, 9 aa, Homo Sapiens
HLFRHLRGH

SEQ ID NO: 948496 - protein, 9 aa, Homo Sapiens
QLREKVEKL

SEQ ID NO: 948497 - protein, 9 aa, Homo Sapiens
GFLQRLQLE

SEQ ID NO: 948498 - protein, 9 aa, Homo Sapiens
SVPEGPIPG

SEQ ID NO: 948499 - protein, 9 aa, Homo Sapiens
RTYFSEGMS

SEQ ID NO: 948500 - protein, 9 aa, Homo Sapiens
DVQRELILQ

SEQ ID NO: 948501 - protein, 9 aa, Homo Sapiens
YSASWDLPS

SEQ ID NO: 948502 - protein, 9 aa, Homo Sapiens
RAEASDGES

SEQ ID NO: 948503 - protein, 9 aa, Homo Sapiens
DKTAKEEFL

SEQ ID NO: 948504 - protein, 9 aa, Homo Sapiens
FRCISRTGI

SEQ ID NO: 948505 - protein, 9 aa, Homo Sapiens
KEAAHQDLW

SEQ ID NO: 948506 - protein, 9 aa, Homo Sapiens
HKKCEELLE

SEQ ID NO: 948507 - protein, 9 aa, Homo Sapiens
LSEGEEKGN

SEQ ID NO: 948508 - protein, 9 aa, Homo Sapiens
YNVLDGLEK

SEQ ID NO: 948509 - protein, 9 aa, Homo Sapiens
LRILANDGV

SEQ ID NO: 948510 - protein, 9 aa, Homo Sapiens
ETLHLKVKE

SEQ ID NO: 948511 - protein, 9 aa, Homo Sapiens
FFARIKKWL

SEQ ID NO: 948512 - protein, 9 aa, Homo Sapiens
YYASKNMRD

SEQ ID NO: 948513 - protein, 9 aa, Homo Sapiens
FKIKNAYEK

SEQ ID NO: 948514 - protein, 9 aa, Homo Sapiens
SITELLEQN

SEQ ID NO: 948515 - protein, 9 aa, Homo Sapiens
ENLHTSYFP

SEQ ID NO: 948516 - protein, 9 aa, Homo Sapiens
GLKETERAD

SEQ ID NO: 948517 - protein, 9 aa, Homo Sapiens
SYLWWINGQ

SEQ ID NO: 948518 - protein, 9 aa, Homo Sapiens
QCCVEDETL

SEQ ID NO: 948519 - protein, 9 aa, Homo Sapiens
DSLKEIIEE

SEQ ID NO: 948520 - protein, 9 aa, Homo Sapiens
SWDEDPEED

SEQ ID NO: 948521 - protein, 9 aa, Homo Sapiens
DNNTDVCLI

SEQ ID NO: 948522 - protein, 9 aa, Homo Sapiens
RNKIYLICQ

SEQ ID NO: 948523 - protein, 9 aa, Homo Sapiens
AEPVFHILR

SEQ ID NO: 948524 - protein, 9 aa, Homo Sapiens
LTIITFTLL

SEQ ID NO: 948525 - protein, 9 aa, Homo Sapiens
KKFVKQCSP

SEQ ID NO: 948526 - protein, 9 aa, Homo Sapiens
MARLQRLED

SEQ ID NO: 948527 - protein, 9 aa, Homo Sapiens
EQVLSISLG

SEQ ID NO: 948528 - protein, 9 aa, Homo Sapiens
SIPNHVVPE

SEQ ID NO: 948529 - protein, 9 aa, Homo Sapiens
KKFSLQDIE

SEQ ID NO: 948530 - protein, 9 aa, Homo Sapiens
PFQGKLKPQ

SEQ ID NO: 948531 - protein, 9 aa, Homo Sapiens
NLSEENRLF

SEQ ID NO: 948532 - protein, 9 aa, Homo Sapiens
LATMAYDCY

SEQ ID NO: 948533 - protein, 9 aa, Homo Sapiens
YSARPSVHE

SEQ ID NO: 948534 - protein, 9 aa, Homo Sapiens
HFLALRKHK

SEQ ID NO: 948535 - protein, 9 aa, Homo Sapiens
NPPPEPSPS

SEQ ID NO: 948536 - protein, 9 aa, Homo Sapiens
SFAPNKNQL

SEQ ID NO: 948537 - protein, 9 aa, Homo Sapiens
SKRQEAQVK

SEQ ID NO: 948538 - protein, 9 aa, Homo Sapiens
NQKEGHFSR

SEQ ID NO: 948539 - protein, 9 aa, Homo Sapiens
NQEPFHKVT

SEQ ID NO: 948540 - protein, 9 aa, Homo Sapiens
NCKFYIYYS

SEQ ID NO: 948541 - protein, 9 aa, Homo Sapiens
KSTTIAMRG

SEQ ID NO: 948542 - protein, 9 aa, Homo Sapiens
ESWLNPWER

SEQ ID NO: 948543 - protein, 9 aa, Homo Sapiens
HKVSSYEDE

SEQ ID NO: 948544 - protein, 9 aa, Homo Sapiens
TNLQAVPSV

SEQ ID NO: 948545 - protein, 9 aa, Homo Sapiens
ADKDRCEDS

SEQ ID NO: 948546 - protein, 9 aa, Homo Sapiens
QSFFLWQRG

SEQ ID NO: 948547 - protein, 9 aa, Homo Sapiens
ASFTSSKAP

SEQ ID NO: 948548 - protein, 9 aa, Homo Sapiens
SKMNRLFSG

SEQ ID NO: 948549 - protein, 9 aa, Homo Sapiens
GGGAERRTS

SEQ ID NO: 948550 - protein, 9 aa, Homo Sapiens
NEPLSFFVE

SEQ ID NO: 948551 - protein, 9 aa, Homo Sapiens
GRKKDCPRV

SEQ ID NO: 948552 - protein, 9 aa, Homo Sapiens
AFQRELFRK

SEQ ID NO: 948553 - protein, 9 aa, Homo Sapiens
SLIVSETKL

SEQ ID NO: 948554 - protein, 9 aa, Homo Sapiens
SSLFSCFSN

SEQ ID NO: 948555 - protein, 9 aa, Homo Sapiens
VVEGNYMVY

SEQ ID NO: 948556 - protein, 9 aa, Homo Sapiens
GRLIRQLLE

SEQ ID NO: 948557 - protein, 9 aa, Homo Sapiens
PAVVPALGA

SEQ ID NO: 948558 - protein, 9 aa, Homo Sapiens
VAPKPAWFC

SEQ ID NO: 948559 - protein, 9 aa, Homo Sapiens
KEEGPFHSL

SEQ ID NO: 948560 - protein, 9 aa, Homo Sapiens
LRVLSQFKR

SEQ ID NO: 948561 - protein, 9 aa, Homo Sapiens
LIFAVPTTK

SEQ ID NO: 948562 - protein, 9 aa, Homo Sapiens
EPSKPKSQH

SEQ ID NO: 948563 - protein, 9 aa, Homo Sapiens
IEESAEQAQ

SEQ ID NO: 948564 - protein, 9 aa, Homo Sapiens
KDLAHTLSQ

SEQ ID NO: 948565 - protein, 9 aa, Homo Sapiens
CICHRELYS

SEQ ID NO: 948566 - protein, 9 aa, Homo Sapiens
FHCDNDYSL

SEQ ID NO: 948567 - protein, 9 aa, Homo Sapiens
MMEEEASEE

SEQ ID NO: 948568 - protein, 9 aa, Homo Sapiens
TTSTTLSYA

SEQ ID NO: 948569 - protein, 9 aa, Homo Sapiens
NFETNWCID

SEQ ID NO: 948570 - protein, 9 aa, Homo Sapiens
IFPSCICHR

SEQ ID NO: 948571 - protein, 9 aa, Homo Sapiens
QMNTNNDGK

SEQ ID NO: 948572 - protein, 9 aa, Homo Sapiens
TSEKDCPCE

SEQ ID NO: 948573 - protein, 9 aa, Homo Sapiens
AFPRDTISK

SEQ ID NO: 948574 - protein, 9 aa, Homo Sapiens
DDSLEHKKL

SEQ ID NO: 948575 - protein, 9 aa, Homo Sapiens
NQQNKYKYK

SEQ ID NO: 948576 - protein, 9 aa, Homo Sapiens
GLAFRKNPP

SEQ ID NO: 948577 - protein, 9 aa, Homo Sapiens
FAFEIIQKY

SEQ ID NO: 948578 - protein, 9 aa, Homo Sapiens
IQLPGQKVS

SEQ ID NO: 948579 - protein, 9 aa, Homo Sapiens
GFILTYAFL

SEQ ID NO: 948580 - protein, 9 aa, Homo Sapiens
MGLHDVDQG

SEQ ID NO: 948581 - protein, 9 aa, Homo Sapiens
NTLYIAPVT

SEQ ID NO: 948582 - protein, 9 aa, Homo Sapiens
EEAEISHLA

SEQ ID NO: 948583 - protein, 9 aa, Homo Sapiens
ELERLFDKT

SEQ ID NO: 948584 - protein, 9 aa, Homo Sapiens
LSPNDHVNS

SEQ ID NO: 948585 - protein, 9 aa, Homo Sapiens
MGPPDSILG

SEQ ID NO: 948586 - protein, 9 aa, Homo Sapiens
NGNDVEFTW

SEQ ID NO: 948587 - protein, 9 aa, Homo Sapiens
VEKKQQLAE

SEQ ID NO: 948588 - protein, 9 aa, Homo Sapiens
MDDKIESEA

SEQ ID NO: 948589 - protein, 9 aa, Homo Sapiens
ISLQIWCSC

SEQ ID NO: 948590 - protein, 9 aa, Homo Sapiens
AGFCKCKKC

SEQ ID NO: 948591 - protein, 9 aa, Homo Sapiens
QIYVLPEIP

SEQ ID NO: 948592 - protein, 9 aa, Homo Sapiens
SHSKRHKSS

SEQ ID NO: 948593 - protein, 9 aa, Homo Sapiens
KSNRSSNIT

SEQ ID NO: 948594 - protein, 9 aa, Homo Sapiens
ENTHARERV

SEQ ID NO: 948595 - protein, 9 aa, Homo Sapiens
LSFGSSGED

SEQ ID NO: 948596 - protein, 9 aa, Homo Sapiens
SEWPEKQPL

SEQ ID NO: 948597 - protein, 9 aa, Homo Sapiens
LQLQVQAKA

SEQ ID NO: 948598 - protein, 9 aa, Homo Sapiens
TSSKEANFQ

SEQ ID NO: 948599 - protein, 9 aa, Homo Sapiens
EVLLSDKAS

SEQ ID NO: 948600 - protein, 9 aa, Homo Sapiens
LESEEKRDP

SEQ ID NO: 948601 - protein, 9 aa, Homo Sapiens
QKQEKTCRA

SEQ ID NO: 948602 - protein, 9 aa, Homo Sapiens
LLHLAPSCH

SEQ ID NO: 948603 - protein, 9 aa, Homo Sapiens
WFNEWPAKA

SEQ ID NO: 948604 - protein, 9 aa, Homo Sapiens
KVLEQDMAR

SEQ ID NO: 948605 - protein, 9 aa, Homo Sapiens
TPCPPSRGP

SEQ ID NO: 948606 - protein, 9 aa, Homo Sapiens
GVKRTAKNV

SEQ ID NO: 948607 - protein, 9 aa, Homo Sapiens
RRETPKQFD

SEQ ID NO: 948608 - protein, 9 aa, Homo Sapiens
CLSLVMDDK

SEQ ID NO: 948609 - protein, 9 aa, Homo Sapiens
PSVQPHAHL

SEQ ID NO: 948610 - protein, 9 aa, Homo Sapiens
ETLLYFDSV

SEQ ID NO: 948611 - protein, 9 aa, Homo Sapiens
VAYACNPST

SEQ ID NO: 948612 - protein, 9 aa, Homo Sapiens
TGSESLFQG

SEQ ID NO: 948613 - protein, 9 aa, Homo Sapiens
LGGAPSPCN

SEQ ID NO: 948614 - protein, 9 aa, Homo Sapiens
NFNHELPDV

SEQ ID NO: 948615 - protein, 9 aa, Homo Sapiens
ALAQLLTRQ

SEQ ID NO: 948616 - protein, 9 aa, Homo Sapiens
IYVSPRSPE

SEQ ID NO: 948617 - protein, 9 aa, Homo Sapiens
LSLSTSILV

SEQ ID NO: 948618 - protein, 9 aa, Homo Sapiens
RIWLALQPK

SEQ ID NO: 948619 - protein, 9 aa, Homo Sapiens
GKGRANGTV

SEQ ID NO: 948620 - protein, 9 aa, Homo Sapiens
FRRPAHLFR

SEQ ID NO: 948621 - protein, 9 aa, Homo Sapiens
PTGGFGLNL

SEQ ID NO: 948622 - protein, 9 aa, Homo Sapiens
REQPAQPNG

SEQ ID NO: 948623 - protein, 9 aa, Homo Sapiens
SYWDLEQKM

SEQ ID NO: 948624 - protein, 9 aa, Homo Sapiens
NEMVIVKDI

SEQ ID NO: 948625 - protein, 9 aa, Homo Sapiens
EKARDIARR

SEQ ID NO: 948626 - protein, 9 aa, Homo Sapiens
FRFPPPWPQ

SEQ ID NO: 948627 - protein, 9 aa, Homo Sapiens
YTLAYYGYS

SEQ ID NO: 948628 - protein, 9 aa, Homo Sapiens
EPLSFFVES

SEQ ID NO: 948629 - protein, 9 aa, Homo Sapiens
RAQAKPINL

SEQ ID NO: 948630 - protein, 9 aa, Homo Sapiens
FAALTPFWY

SEQ ID NO: 948631 - protein, 9 aa, Homo Sapiens
ISQPRPVPG

SEQ ID NO: 948632 - protein, 9 aa, Homo Sapiens
TSYLSIIMD

SEQ ID NO: 948633 - protein, 9 aa, Homo Sapiens
EDLQWICAW

SEQ ID NO: 948634 - protein, 9 aa, Homo Sapiens
SYFMDHFIP

SEQ ID NO: 948635 - protein, 9 aa, Homo Sapiens
SEDNSLGEV

SEQ ID NO: 948636 - protein, 9 aa, Homo Sapiens
ETISLQIWC

SEQ ID NO: 948637 - protein, 9 aa, Homo Sapiens
YYKESKDPK

SEQ ID NO: 948638 - protein, 9 aa, Homo Sapiens
HCVVYTGKK

SEQ ID NO: 948639 - protein, 9 aa, Homo Sapiens
ATATGATPI

SEQ ID NO: 948640 - protein, 9 aa, Homo Sapiens
TKFRVNILD

SEQ ID NO: 948641 - protein, 9 aa, Homo Sapiens
WEEGLYAVD

SEQ ID NO: 948642 - protein, 9 aa, Homo Sapiens
VCVQQNSSF

SEQ ID NO: 948643 - protein, 9 aa, Homo Sapiens
RPAHLFRHL

SEQ ID NO: 948644 - protein, 9 aa, Homo Sapiens
SNLELYKYD

SEQ ID NO: 948645 - protein, 9 aa, Homo Sapiens
KKRDALAAL

SEQ ID NO: 948646 - protein, 9 aa, Homo Sapiens
RIQRKKKNS

SEQ ID NO: 948647 - protein, 9 aa, Homo Sapiens
IACLCHNLD

SEQ ID NO: 948648 - protein, 9 aa, Homo Sapiens
PALGAAAAL

SEQ ID NO: 948649 - protein, 9 aa, Homo Sapiens
LRGPRGVLA

SEQ ID NO: 948650 - protein, 9 aa, Homo Sapiens
ETLRDYADA

SEQ ID NO: 948651 - protein, 9 aa, Homo Sapiens
PADQSPHIL

SEQ ID NO: 948652 - protein, 9 aa, Homo Sapiens
SSHIVRYYD

SEQ ID NO: 948653 - protein, 9 aa, Homo Sapiens
TLLASFIPA

SEQ ID NO: 948654 - protein, 9 aa, Homo Sapiens
NGFQLENFI

SEQ ID NO: 948655 - protein, 9 aa, Homo Sapiens
RAVNKAGVG

SEQ ID NO: 948656 - protein, 9 aa, Homo Sapiens
FQTPGYEMN

SEQ ID NO: 948657 - protein, 9 aa, Homo Sapiens
KDDLEDLKP

SEQ ID NO: 948658 - protein, 9 aa, Homo Sapiens
TSIKKQRSP

SEQ ID NO: 948659 - protein, 9 aa, Homo Sapiens
GLNRPLSPH

SEQ ID NO: 948660 - protein, 9 aa, Homo Sapiens
SQQHRQSRS

SEQ ID NO: 948661 - protein, 9 aa, Homo Sapiens
ISSESSSLS

SEQ ID NO: 948662 - protein, 9 aa, Homo Sapiens
ITNFFRGDC

SEQ ID NO: 948663 - protein, 9 aa, Homo Sapiens
EYDSSFLNW

SEQ ID NO: 948664 - protein, 9 aa, Homo Sapiens
AGPQQFRPL

SEQ ID NO: 948665 - protein, 9 aa, Homo Sapiens
SQICSHLHR

SEQ ID NO: 948666 - protein, 9 aa, Homo Sapiens
LAIGFEKRL

SEQ ID NO: 948667 - protein, 9 aa, Homo Sapiens
CFACPNCFF

SEQ ID NO: 948668 - protein, 9 aa, Homo Sapiens
CTLHWVNQL

SEQ ID NO: 948669 - protein, 9 aa, Homo Sapiens
TAKKEKVEQ

SEQ ID NO: 948670 - protein, 9 aa, Homo Sapiens
FLLKDKHAD

SEQ ID NO: 948671 - protein, 9 aa, Homo Sapiens
VSPITIVYE

SEQ ID NO: 948672 - protein, 9 aa, Homo Sapiens
QLDHHERCN

SEQ ID NO: 948673 - protein, 9 aa, Homo Sapiens
TRVQMSVGI

SEQ ID NO: 948674 - protein, 9 aa, Homo Sapiens
TPRGPRRLS

SEQ ID NO: 948675 - protein, 9 aa, Homo Sapiens
IGFSARYNF

SEQ ID NO: 948676 - protein, 9 aa, Homo Sapiens
WNKNIGLNR

SEQ ID NO: 948677 - protein, 9 aa, Homo Sapiens
VQFSWLIMN

SEQ ID NO: 948678 - protein, 9 aa, Homo Sapiens
SLSGTPKSI

SEQ ID NO: 948679 - protein, 9 aa, Homo Sapiens
KGGVESKGP

SEQ ID NO: 948680 - protein, 9 aa, Homo Sapiens
NKDLNRNKI

SEQ ID NO: 948681 - protein, 9 aa, Homo Sapiens
SRQISGVFN

SEQ ID NO: 948682 - protein, 9 aa, Homo Sapiens
GALISDLKT

SEQ ID NO: 948683 - protein, 9 aa, Homo Sapiens
DHDLEIILL

SEQ ID NO: 948684 - protein, 9 aa, Homo Sapiens
LLFINLYIE

SEQ ID NO: 948685 - protein, 9 aa, Homo Sapiens
LEPKSPKPT

SEQ ID NO: 948686 - protein, 9 aa, Homo Sapiens
AGNQPGGNL

SEQ ID NO: 948687 - protein, 9 aa, Homo Sapiens
VTYSVTKDT

SEQ ID NO: 948688 - protein, 9 aa, Homo Sapiens
FKINILLKN

SEQ ID NO: 948689 - protein, 9 aa, Homo Sapiens
TRQPAFPVI

SEQ ID NO: 948690 - protein, 9 aa, Homo Sapiens
LICARLQGW

SEQ ID NO: 948691 - protein, 9 aa, Homo Sapiens
CSHEQSVHL

SEQ ID NO: 948692 - protein, 9 aa, Homo Sapiens
KVLLTGLVM

SEQ ID NO: 948693 - protein, 9 aa, Homo Sapiens
SSLTDLMTV

SEQ ID NO: 948694 - protein, 9 aa, Homo Sapiens
CLIMAHSFT

SEQ ID NO: 948695 - protein, 9 aa, Homo Sapiens
GAFVLLPLC

SEQ ID NO: 948696 - protein, 9 aa, Homo Sapiens
PSREGLQKR

SEQ ID NO: 948697 - protein, 9 aa, Homo Sapiens
VYPSSLMLQ

SEQ ID NO: 948698 - protein, 9 aa, Homo Sapiens
SYSICRLIK

SEQ ID NO: 948699 - protein, 9 aa, Homo Sapiens
REKLYKCKE

SEQ ID NO: 948700 - protein, 9 aa, Homo Sapiens
LETQGLMMR

SEQ ID NO: 948701 - protein, 9 aa, Homo Sapiens
SCWPFSVPG

SEQ ID NO: 948702 - protein, 9 aa, Homo Sapiens
AFFGLTVTE

SEQ ID NO: 948703 - protein, 9 aa, Homo Sapiens
ISPEERRLP

SEQ ID NO: 948704 - protein, 9 aa, Homo Sapiens
PFNSFDLTK

SEQ ID NO: 948705 - protein, 9 aa, Homo Sapiens
NRTRKDGVP

SEQ ID NO: 948706 - protein, 9 aa, Homo Sapiens
KWTILPDPR

SEQ ID NO: 948707 - protein, 9 aa, Homo Sapiens
FNGVQVTGY

SEQ ID NO: 948708 - protein, 9 aa, Homo Sapiens
SGVSSFIGT

SEQ ID NO: 948709 - protein, 9 aa, Homo Sapiens
KKGSGNTLT

SEQ ID NO: 948710 - protein, 9 aa, Homo Sapiens
YSLIGRIGM

SEQ ID NO: 948711 - protein, 9 aa, Homo Sapiens
LKPQATWTH

SEQ ID NO: 948712 - protein, 9 aa, Homo Sapiens
NVRNSRKNF

SEQ ID NO: 948713 - protein, 9 aa, Homo Sapiens
ENGPQAISI

SEQ ID NO: 948714 - protein, 9 aa, Homo Sapiens
CELPLDNQV

SEQ ID NO: 948715 - protein, 9 aa, Homo Sapiens
LFGPPMPLH

SEQ ID NO: 948716 - protein, 9 aa, Homo Sapiens
ETVIKGKGM

SEQ ID NO: 948717 - protein, 9 aa, Homo Sapiens
SAGLGLLKA

SEQ ID NO: 948718 - protein, 9 aa, Homo Sapiens
ESGRQSVTR

SEQ ID NO: 948719 - protein, 9 aa, Homo Sapiens
FVQDMRLVF

SEQ ID NO: 948720 - protein, 9 aa, Homo Sapiens
QMTSIKKQR

SEQ ID NO: 948721 - protein, 9 aa, Homo Sapiens
IKCQTATGL

SEQ ID NO: 948722 - protein, 9 aa, Homo Sapiens
NCCGGVRNP

SEQ ID NO: 948723 - protein, 9 aa, Homo Sapiens
LLTHRARLR

SEQ ID NO: 948724 - protein, 9 aa, Homo Sapiens
GILPGSLFW

SEQ ID NO: 948725 - protein, 9 aa, Homo Sapiens
GHSECGHKK

SEQ ID NO: 948726 - protein, 9 aa, Homo Sapiens
PKSRAAPSP

SEQ ID NO: 948727 - protein, 9 aa, Homo Sapiens
RYEIPDTQI

SEQ ID NO: 948728 - protein, 9 aa, Homo Sapiens
EAGAEVLLL

SEQ ID NO: 948729 - protein, 9 aa, Homo Sapiens
IKEDYKNRQ

SEQ ID NO: 948730 - protein, 9 aa, Homo Sapiens
FYLNLTQGT

SEQ ID NO: 948731 - protein, 9 aa, Homo Sapiens
TILETSLRL

SEQ ID NO: 948732 - protein, 9 aa, Homo Sapiens
DSIKDDLED

SEQ ID NO: 948733 - protein, 9 aa, Homo Sapiens
VFHNHKEFY

SEQ ID NO: 948734 - protein, 9 aa, Homo Sapiens
SPDDNEQRP

SEQ ID NO: 948735 - protein, 9 aa, Homo Sapiens
AQCSAPLSY

SEQ ID NO: 948736 - protein, 9 aa, Homo Sapiens
CSAFPRDTI

SEQ ID NO: 948737 - protein, 9 aa, Homo Sapiens
RQHGDNASE

SEQ ID NO: 948738 - protein, 9 aa, Homo Sapiens
HSGEEPHVE

SEQ ID NO: 948739 - protein, 9 aa, Homo Sapiens
LLCVFFVSH

SEQ ID NO: 948740 - protein, 9 aa, Homo Sapiens
GSRDGSQTS

SEQ ID NO: 948741 - protein, 9 aa, Homo Sapiens
VAPPKKPET

SEQ ID NO: 948742 - protein, 9 aa, Homo Sapiens
REAEGYPDV

SEQ ID NO: 948743 - protein, 9 aa, Homo Sapiens
FLRQVLEAK

SEQ ID NO: 948744 - protein, 9 aa, Homo Sapiens
GLLCVFFVS

SEQ ID NO: 948745 - protein, 9 aa, Homo Sapiens
KETNIILNI

SEQ ID NO: 948746 - protein, 9 aa, Homo Sapiens
LSGFSRSCQ

SEQ ID NO: 948747 - protein, 9 aa, Homo Sapiens
FLWQFYLSK

SEQ ID NO: 948748 - protein, 9 aa, Homo Sapiens
NSPDPVNGM

SEQ ID NO: 948749 - protein, 9 aa, Homo Sapiens
SSFTVFIAI

SEQ ID NO: 948750 - protein, 9 aa, Homo Sapiens
LMPQAEVTA

SEQ ID NO: 948751 - protein, 9 aa, Homo Sapiens
HQRLYTGEK

SEQ ID NO: 948752 - protein, 9 aa, Homo Sapiens
LNFWPQLIT

SEQ ID NO: 948753 - protein, 9 aa, Homo Sapiens
LVGRRLAGG

SEQ ID NO: 948754 - protein, 9 aa, Homo Sapiens
VVKSTKTFR

SEQ ID NO: 948755 - protein, 9 aa, Homo Sapiens
LKGEKRDKG

SEQ ID NO: 948756 - protein, 9 aa, Homo Sapiens
IKTTLNQGS

SEQ ID NO: 948757 - protein, 9 aa, Homo Sapiens
LLSTSKIDL

SEQ ID NO: 948758 - protein, 9 aa, Homo Sapiens
LVSKWQAYG

SEQ ID NO: 948759 - protein, 9 aa, Homo Sapiens
RRERIWLAL

SEQ ID NO: 948760 - protein, 9 aa, Homo Sapiens
DNPSIKDEA

SEQ ID NO: 948761 - protein, 9 aa, Homo Sapiens
FMNDLRVPF

SEQ ID NO: 948762 - protein, 9 aa, Homo Sapiens
LGPKELFPT

SEQ ID NO: 948763 - protein, 9 aa, Homo Sapiens
DVIIHVAQN

SEQ ID NO: 948764 - protein, 9 aa, Homo Sapiens
DDLPVTCAL

SEQ ID NO: 948765 - protein, 9 aa, Homo Sapiens
ANVEPVVLS

SEQ ID NO: 948766 - protein, 9 aa, Homo Sapiens
IWEERSGMT

SEQ ID NO: 948767 - protein, 9 aa, Homo Sapiens
RVFEGLPKP

SEQ ID NO: 948768 - protein, 9 aa, Homo Sapiens
CGEILDKWQ

SEQ ID NO: 948769 - protein, 9 aa, Homo Sapiens
GPVFFPGGA

SEQ ID NO: 948770 - protein, 9 aa, Homo Sapiens
MDKLLPLIP

SEQ ID NO: 948771 - protein, 9 aa, Homo Sapiens
MAFYTGLSC

SEQ ID NO: 948772 - protein, 9 aa, Homo Sapiens
KDTPAEART

SEQ ID NO: 948773 - protein, 9 aa, Homo Sapiens
KVTQEHYEL

SEQ ID NO: 948774 - protein, 9 aa, Homo Sapiens
SHNCNHCED

SEQ ID NO: 948775 - protein, 9 aa, Homo Sapiens
LLPNVPLNA

SEQ ID NO: 948776 - protein, 9 aa, Homo Sapiens
DRELPAPER

SEQ ID NO: 948777 - protein, 9 aa, Homo Sapiens
CKLALAFRA

SEQ ID NO: 948778 - protein, 9 aa, Homo Sapiens
FGICYVDPE

SEQ ID NO: 948779 - protein, 9 aa, Homo Sapiens
VGPREPQGL

SEQ ID NO: 948780 - protein, 9 aa, Homo Sapiens
GVYAPLHFM

SEQ ID NO: 948781 - protein, 9 aa, Homo Sapiens
RHFFQNLGF

SEQ ID NO: 948782 - protein, 9 aa, Homo Sapiens
EMIEKYFVF

SEQ ID NO: 948783 - protein, 9 aa, Homo Sapiens
QKSCTCWGR

SEQ ID NO: 948784 - protein, 9 aa, Homo Sapiens
NKIEEISGL

SEQ ID NO: 948785 - protein, 9 aa, Homo Sapiens
KCPSQCPAP

SEQ ID NO: 948786 - protein, 9 aa, Homo Sapiens
LPFMPPRNL

SEQ ID NO: 948787 - protein, 9 aa, Homo Sapiens
NGTYANKTK

SEQ ID NO: 948788 - protein, 9 aa, Homo Sapiens
LLQQNFELV

SEQ ID NO: 948789 - protein, 9 aa, Homo Sapiens
LLMPQAEVT

SEQ ID NO: 948790 - protein, 9 aa, Homo Sapiens
MRKQLDCLG

SEQ ID NO: 948791 - protein, 9 aa, Homo Sapiens
KSILRKHQR

SEQ ID NO: 948792 - protein, 9 aa, Homo Sapiens
KKSLKFYGS

SEQ ID NO: 948793 - protein, 9 aa, Homo Sapiens
GWPGAVAYA

SEQ ID NO: 948794 - protein, 9 aa, Homo Sapiens
GMISVGPSH

SEQ ID NO: 948795 - protein, 9 aa, Homo Sapiens
KFSFSEFVP

SEQ ID NO: 948796 - protein, 9 aa, Homo Sapiens
RKEARTTPG

SEQ ID NO: 948797 - protein, 9 aa, Homo Sapiens
EKPMRVVND

SEQ ID NO: 948798 - protein, 9 aa, Homo Sapiens
ATGGFTTLQ

SEQ ID NO: 948799 - protein, 9 aa, Homo Sapiens
LAIKNGQLK

SEQ ID NO: 948800 - protein, 9 aa, Homo Sapiens
AMFIPTSPT

SEQ ID NO: 948801 - protein, 9 aa, Homo Sapiens
EGTVQTAVD

SEQ ID NO: 948802 - protein, 9 aa, Homo Sapiens
DDDTAVLII

SEQ ID NO: 948803 - protein, 9 aa, Homo Sapiens
KHKKIYAGK

SEQ ID NO: 948804 - protein, 9 aa, Homo Sapiens
PIQNSHYGQ

SEQ ID NO: 948805 - protein, 9 aa, Homo Sapiens
GAPKNRTRK

SEQ ID NO: 948806 - protein, 9 aa, Homo Sapiens
TKSTPVIII

SEQ ID NO: 948807 - protein, 9 aa, Homo Sapiens
LPHSQKSQH

SEQ ID NO: 948808 - protein, 9 aa, Homo Sapiens
KARALKIWE

SEQ ID NO: 948809 - protein, 9 aa, Homo Sapiens
GLNYFEGYS

SEQ ID NO: 948810 - protein, 9 aa, Homo Sapiens
CYSSVNTPS

SEQ ID NO: 948811 - protein, 9 aa, Homo Sapiens
LASLVLDPP

SEQ ID NO: 948812 - protein, 9 aa, Homo Sapiens
GSRDHHHLH

SEQ ID NO: 948813 - protein, 9 aa, Homo Sapiens
GTFFWMEIV

SEQ ID NO: 948814 - protein, 9 aa, Homo Sapiens
HQGWEILRQ

SEQ ID NO: 948815 - protein, 9 aa, Homo Sapiens
GPREPQGLQ

SEQ ID NO: 948816 - protein, 9 aa, Homo Sapiens
DVYFLHNPA

SEQ ID NO: 948817 - protein, 9 aa, Homo Sapiens
ALKIWEERS

SEQ ID NO: 948818 - protein, 9 aa, Homo Sapiens
KKGHRQDGE

SEQ ID NO: 948819 - protein, 9 aa, Homo Sapiens
SVSARSRSS

SEQ ID NO: 948820 - protein, 9 aa, Homo Sapiens
TIKLDPGLT

SEQ ID NO: 948821 - protein, 9 aa, Homo Sapiens
LARKEAYGD

SEQ ID NO: 948822 - protein, 9 aa, Homo Sapiens
TYGGGLSVF

SEQ ID NO: 948823 - protein, 9 aa, Homo Sapiens
RARLVDHAY

SEQ ID NO: 948824 - protein, 9 aa, Homo Sapiens
IPIPPIKLI

SEQ ID NO: 948825 - protein, 9 aa, Homo Sapiens
SMFSTVTPL

SEQ ID NO: 948826 - protein, 9 aa, Homo Sapiens
HAQEEEIMF

SEQ ID NO: 948827 - protein, 9 aa, Homo Sapiens
IDDKEQKSK

SEQ ID NO: 948828 - protein, 9 aa, Homo Sapiens
TLSQHGIYD

SEQ ID NO: 948829 - protein, 9 aa, Homo Sapiens
PLPVPRFCL

SEQ ID NO: 948830 - protein, 9 aa, Homo Sapiens
SECKEILEI

SEQ ID NO: 948831 - protein, 9 aa, Homo Sapiens
SWLIMNEEQ

SEQ ID NO: 948832 - protein, 9 aa, Homo Sapiens
RLPTQEARS

SEQ ID NO: 948833 - protein, 9 aa, Homo Sapiens
KVDACEETP

SEQ ID NO: 948834 - protein, 9 aa, Homo Sapiens
PQSSDECTL

SEQ ID NO: 948835 - protein, 9 aa, Homo Sapiens
LRLLQTYFR

SEQ ID NO: 948836 - protein, 9 aa, Homo Sapiens
LAEYVITKF

SEQ ID NO: 948837 - protein, 9 aa, Homo Sapiens
MAAFILIGS

SEQ ID NO: 948838 - protein, 9 aa, Homo Sapiens
LSGPAELGT

SEQ ID NO: 948839 - protein, 9 aa, Homo Sapiens
NCNKKKWLY

SEQ ID NO: 948840 - protein, 9 aa, Homo Sapiens
ALFQLDESK

SEQ ID NO: 948841 - protein, 9 aa, Homo Sapiens
GDSEPEVVG

SEQ ID NO: 948842 - protein, 9 aa, Homo Sapiens
ELGRPNCDG

SEQ ID NO: 948843 - protein, 9 aa, Homo Sapiens
YKECCRFFG

SEQ ID NO: 948844 - protein, 9 aa, Homo Sapiens
ETTSTTLSY

SEQ ID NO: 948845 - protein, 9 aa, Homo Sapiens
GDSSSAVSP

SEQ ID NO: 948846 - protein, 9 aa, Homo Sapiens
PQQLNVSSA

SEQ ID NO: 948847 - protein, 9 aa, Homo Sapiens
TNCSYADFI

SEQ ID NO: 948848 - protein, 9 aa, Homo Sapiens
ECLEKQKPV

SEQ ID NO: 948849 - protein, 9 aa, Homo Sapiens
QPPQQLNVS

SEQ ID NO: 948850 - protein, 9 aa, Homo Sapiens
MRCDRKIEV

SEQ ID NO: 948851 - protein, 9 aa, Homo Sapiens
RRHYHSIVQ

SEQ ID NO: 948852 - protein, 9 aa, Homo Sapiens
VKLFSHRNS

SEQ ID NO: 948853 - protein, 9 aa, Homo Sapiens
NEMEAPTTV

SEQ ID NO: 948854 - protein, 9 aa, Homo Sapiens
SEDFPDFSS

SEQ ID NO: 948855 - protein, 9 aa, Homo Sapiens
SERLMFHGP

SEQ ID NO: 948856 - protein, 9 aa, Homo Sapiens
AKILIDFIY

SEQ ID NO: 948857 - protein, 9 aa, Homo Sapiens
GLSEKDLNK

SEQ ID NO: 948858 - protein, 9 aa, Homo Sapiens
IYYGIPMVG

SEQ ID NO: 948859 - protein, 9 aa, Homo Sapiens
DPGAFVLLP

SEQ ID NO: 948860 - protein, 9 aa, Homo Sapiens
HTPVTNKET

SEQ ID NO: 948861 - protein, 9 aa, Homo Sapiens
PACVGLGIT

SEQ ID NO: 948862 - protein, 9 aa, Homo Sapiens
AVVIILLRA

SEQ ID NO: 948863 - protein, 9 aa, Homo Sapiens
KHLKSEDKM

SEQ ID NO: 948864 - protein, 9 aa, Homo Sapiens
SSRGSTCHT

SEQ ID NO: 948865 - protein, 9 aa, Homo Sapiens
YGLQTTNNR

SEQ ID NO: 948866 - protein, 9 aa, Homo Sapiens
CPPKCPSQC

SEQ ID NO: 948867 - protein, 9 aa, Homo Sapiens
SLGLGPYVF

SEQ ID NO: 948868 - protein, 9 aa, Homo Sapiens
KNMCSGGYS

SEQ ID NO: 948869 - protein, 9 aa, Homo Sapiens
NLSEEILGK

SEQ ID NO: 948870 - protein, 9 aa, Homo Sapiens
LESILYPRG

SEQ ID NO: 948871 - protein, 9 aa, Homo Sapiens
QRYKECCRF

SEQ ID NO: 948872 - protein, 9 aa, Homo Sapiens
VSLGVGLQN

SEQ ID NO: 948873 - protein, 9 aa, Homo Sapiens
EAKICHGLG

SEQ ID NO: 948874 - protein, 9 aa, Homo Sapiens
PRIRKTSKL

SEQ ID NO: 948875 - protein, 9 aa, Homo Sapiens
TPIVPVPEA

SEQ ID NO: 948876 - protein, 9 aa, Homo Sapiens
ERGWFHGKE

SEQ ID NO: 948877 - protein, 9 aa, Homo Sapiens
AKHDYRPTE

SEQ ID NO: 948878 - protein, 9 aa, Homo Sapiens
RLPPAPGLQ

SEQ ID NO: 948879 - protein, 9 aa, Homo Sapiens
KDKENKFKS

SEQ ID NO: 948880 - protein, 9 aa, Homo Sapiens
YRQVCNSDS

SEQ ID NO: 948881 - protein, 9 aa, Homo Sapiens
LCGDSFPDD

SEQ ID NO: 948882 - protein, 9 aa, Homo Sapiens
SKPGSPRSA

SEQ ID NO: 948883 - protein, 9 aa, Homo Sapiens
NPIFYGFLS

SEQ ID NO: 948884 - protein, 9 aa, Homo Sapiens
DGIVQPNSS

SEQ ID NO: 948885 - protein, 9 aa, Homo Sapiens
EFETFFKKE

SEQ ID NO: 948886 - protein, 9 aa, Homo Sapiens
ELPEETVRL

SEQ ID NO: 948887 - protein, 9 aa, Homo Sapiens
DSSEKEEGP

SEQ ID NO: 948888 - protein, 9 aa, Homo Sapiens
ASPSLSQPG

SEQ ID NO: 948889 - protein, 9 aa, Homo Sapiens
IIITEFMEN

SEQ ID NO: 948890 - protein, 9 aa, Homo Sapiens
QEKKGKAGN

SEQ ID NO: 948891 - protein, 9 aa, Homo Sapiens
LPPNLSASV

SEQ ID NO: 948892 - protein, 9 aa, Homo Sapiens
GNDTILWII

SEQ ID NO: 948893 - protein, 9 aa, Homo Sapiens
ANIINLLTS

SEQ ID NO: 948894 - protein, 9 aa, Homo Sapiens
LLGAFSPKQ

SEQ ID NO: 948895 - protein, 9 aa, Homo Sapiens
LPREGPGGR

SEQ ID NO: 948896 - protein, 9 aa, Homo Sapiens
SMCLEDNRY

SEQ ID NO: 948897 - protein, 9 aa, Homo Sapiens
CRNQRYKRY

SEQ ID NO: 948898 - protein, 9 aa, Homo Sapiens
LQENPLSCC

SEQ ID NO: 948899 - protein, 9 aa, Homo Sapiens
RQLLEEDSD

SEQ ID NO: 948900 - protein, 9 aa, Homo Sapiens
GPPGARGSP

SEQ ID NO: 948901 - protein, 9 aa, Homo Sapiens
ISSRWICDH

SEQ ID NO: 948902 - protein, 9 aa, Homo Sapiens
LDRELPAPE

SEQ ID NO: 948903 - protein, 9 aa, Homo Sapiens
QPRIDPFLG

SEQ ID NO: 948904 - protein, 9 aa, Homo Sapiens
NRNSSVVLE

SEQ ID NO: 948905 - protein, 9 aa, Homo Sapiens
SEKYQRIKG

SEQ ID NO: 948906 - protein, 9 aa, Homo Sapiens
VKIWVYGVL

SEQ ID NO: 948907 - protein, 9 aa, Homo Sapiens
LLGQFFEKE

SEQ ID NO: 948908 - protein, 9 aa, Homo Sapiens
LSINNNLNL

SEQ ID NO: 948909 - protein, 9 aa, Homo Sapiens
DQIGMISVG

SEQ ID NO: 948910 - protein, 9 aa, Homo Sapiens
AINRKTRVH

SEQ ID NO: 948911 - protein, 9 aa, Homo Sapiens
QGKMREIKE

SEQ ID NO: 948912 - protein, 9 aa, Homo Sapiens
CHVFEQGHQ

SEQ ID NO: 948913 - protein, 9 aa, Homo Sapiens
IEKEKTDLE

SEQ ID NO: 948914 - protein, 9 aa, Homo Sapiens
TKGFLDKLY

SEQ ID NO: 948915 - protein, 9 aa, Homo Sapiens
DIKTSYLSI

SEQ ID NO: 948916 - protein, 9 aa, Homo Sapiens
QDTLRSMKS

SEQ ID NO: 948917 - protein, 9 aa, Homo Sapiens
NELALKLAS

SEQ ID NO: 948918 - protein, 9 aa, Homo Sapiens
PPSSTTMKK

SEQ ID NO: 948919 - protein, 9 aa, Homo Sapiens
TSLPPGDPQ

SEQ ID NO: 948920 - protein, 9 aa, Homo Sapiens
SRDVVDRVV

SEQ ID NO: 948921 - protein, 9 aa, Homo Sapiens
QAPAFFLVQ

SEQ ID NO: 948922 - protein, 9 aa, Homo Sapiens
PGGNLSPGG

SEQ ID NO: 948923 - protein, 9 aa, Homo Sapiens
EDSANVEMK

SEQ ID NO: 948924 - protein, 9 aa, Homo Sapiens
ILLSYLRTR

SEQ ID NO: 948925 - protein, 9 aa, Homo Sapiens
RVKWPNNIY

SEQ ID NO: 948926 - protein, 9 aa, Homo Sapiens
KGSKIKIPS

SEQ ID NO: 948927 - protein, 9 aa, Homo Sapiens
RWSEGEPVC

SEQ ID NO: 948928 - protein, 9 aa, Homo Sapiens
QVDTSCQGN

SEQ ID NO: 948929 - protein, 9 aa, Homo Sapiens
TDSPSSKRD

SEQ ID NO: 948930 - protein, 9 aa, Homo Sapiens
NYWRLLTPG

SEQ ID NO: 948931 - protein, 9 aa, Homo Sapiens
GGERDALDL

SEQ ID NO: 948932 - protein, 9 aa, Homo Sapiens
KGKKGSGNT

SEQ ID NO: 948933 - protein, 9 aa, Homo Sapiens
QPRRLKKVQ

SEQ ID NO: 948934 - protein, 9 aa, Homo Sapiens
IGYQQLFCC

SEQ ID NO: 948935 - protein, 9 aa, Homo Sapiens
KFYVCPAVL

SEQ ID NO: 948936 - protein, 9 aa, Homo Sapiens
AGKDVTESP

SEQ ID NO: 948937 - protein, 9 aa, Homo Sapiens
KIPLIGLIP

SEQ ID NO: 948938 - protein, 9 aa, Homo Sapiens
YGATPSLGH

SEQ ID NO: 948939 - protein, 9 aa, Homo Sapiens
CENFMALCA

SEQ ID NO: 948940 - protein, 9 aa, Homo Sapiens
KITALAPST

SEQ ID NO: 948941 - protein, 9 aa, Homo Sapiens
ESGAFGCVY

SEQ ID NO: 948942 - protein, 9 aa, Homo Sapiens
YEKSLDQLE

SEQ ID NO: 948943 - protein, 9 aa, Homo Sapiens
LLIAFLSSP

SEQ ID NO: 948944 - protein, 9 aa, Homo Sapiens
QDHWEEMKK

SEQ ID NO: 948945 - protein, 9 aa, Homo Sapiens
PLWMIALLV

SEQ ID NO: 948946 - protein, 9 aa, Homo Sapiens
SSGLNHVES

SEQ ID NO: 948947 - protein, 9 aa, Homo Sapiens
FQEKTVTLH

SEQ ID NO: 948948 - protein, 9 aa, Homo Sapiens
LLHTLGFDF

SEQ ID NO: 948949 - protein, 9 aa, Homo Sapiens
RLTLYSGRD

SEQ ID NO: 948950 - protein, 9 aa, Homo Sapiens
FFSRKSALS

SEQ ID NO: 948951 - protein, 9 aa, Homo Sapiens
FIKTTLNQG

SEQ ID NO: 948952 - protein, 9 aa, Homo Sapiens
FSYSAGTEL

SEQ ID NO: 948953 - protein, 9 aa, Homo Sapiens
SRARDSKTY

SEQ ID NO: 948954 - protein, 9 aa, Homo Sapiens
KSKTLQKFL

SEQ ID NO: 948955 - protein, 9 aa, Homo Sapiens
RSFCDKSIL

SEQ ID NO: 948956 - protein, 9 aa, Homo Sapiens
SCKDIVARD

SEQ ID NO: 948957 - protein, 9 aa, Homo Sapiens
KENFVMEFL

SEQ ID NO: 948958 - protein, 9 aa, Homo Sapiens
CNECGKIFQ

SEQ ID NO: 948959 - protein, 9 aa, Homo Sapiens
QELDTAVKV

SEQ ID NO: 948960 - protein, 9 aa, Homo Sapiens
VQKETRDRF

SEQ ID NO: 948961 - protein, 9 aa, Homo Sapiens
WGQEKDNER

SEQ ID NO: 948962 - protein, 9 aa, Homo Sapiens
SLLVLRHSE

SEQ ID NO: 948963 - protein, 9 aa, Homo Sapiens
AQQVEKKRE

SEQ ID NO: 948964 - protein, 9 aa, Homo Sapiens
SSRWICDHY

SEQ ID NO: 948965 - protein, 9 aa, Homo Sapiens
KLTPFLLKS

SEQ ID NO: 948966 - protein, 9 aa, Homo Sapiens
SRMKSSDSK

SEQ ID NO: 948967 - protein, 9 aa, Homo Sapiens
FENREWVCA

SEQ ID NO: 948968 - protein, 9 aa, Homo Sapiens
MEQDRNKEA

SEQ ID NO: 948969 - protein, 9 aa, Homo Sapiens
EDHFPLLSR

SEQ ID NO: 948970 - protein, 9 aa, Homo Sapiens
QSRSHHLEM

SEQ ID NO: 948971 - protein, 9 aa, Homo Sapiens
ARYALNHLD

SEQ ID NO: 948972 - protein, 9 aa, Homo Sapiens
EENPKPEII

SEQ ID NO: 948973 - protein, 9 aa, Homo Sapiens
RAQLSFLAM

SEQ ID NO: 948974 - protein, 9 aa, Homo Sapiens
YLQVLGEKA

SEQ ID NO: 948975 - protein, 9 aa, Homo Sapiens
KVPTKKMYK

SEQ ID NO: 948976 - protein, 9 aa, Homo Sapiens
VSLIASEKE

SEQ ID NO: 948977 - protein, 9 aa, Homo Sapiens
KGPKDKENK

SEQ ID NO: 948978 - protein, 9 aa, Homo Sapiens
RQNEYPFVE

SEQ ID NO: 948979 - protein, 9 aa, Homo Sapiens
EICPYNPHH

SEQ ID NO: 948980 - protein, 9 aa, Homo Sapiens
RHPMNDPTR

SEQ ID NO: 948981 - protein, 9 aa, Homo Sapiens
CALSQFEGM

SEQ ID NO: 948982 - protein, 9 aa, Homo Sapiens
LGTDIFKNI

SEQ ID NO: 948983 - protein, 9 aa, Homo Sapiens
TPRARNQLN

SEQ ID NO: 948984 - protein, 9 aa, Homo Sapiens
EGTRELEAL

SEQ ID NO: 948985 - protein, 9 aa, Homo Sapiens
MGTSEKDCP

SEQ ID NO: 948986 - protein, 9 aa, Homo Sapiens
DENPENNFH

SEQ ID NO: 948987 - protein, 9 aa, Homo Sapiens
ALDRELPAP

SEQ ID NO: 948988 - protein, 9 aa, Homo Sapiens
NDLTQYVIS

SEQ ID NO: 948989 - protein, 9 aa, Homo Sapiens
SPGDSSSAV

SEQ ID NO: 948990 - protein, 9 aa, Homo Sapiens
ENSGKTVLA

SEQ ID NO: 948991 - protein, 9 aa, Homo Sapiens
PKGPRGIQR

SEQ ID NO: 948992 - protein, 9 aa, Homo Sapiens
HFRFPPPWP

SEQ ID NO: 948993 - protein, 9 aa, Homo Sapiens
IITFTLLDP

SEQ ID NO: 948994 - protein, 9 aa, Homo Sapiens
VTYKHKEKQ

SEQ ID NO: 948995 - protein, 9 aa, Homo Sapiens
IDPFLGQQV

SEQ ID NO: 948996 - protein, 9 aa, Homo Sapiens
FVNWICSRG

SEQ ID NO: 948997 - protein, 9 aa, Homo Sapiens
QGSSVEGTD

SEQ ID NO: 948998 - protein, 9 aa, Homo Sapiens
AGKEGEGGV

SEQ ID NO: 948999 - protein, 9 aa, Homo Sapiens
VKKETNIIL

SEQ ID NO: 949000 - protein, 9 aa, Homo Sapiens
DSSNFGAPH

SEQ ID NO: 949001 - protein, 9 aa, Homo Sapiens
REVLTNLLF

SEQ ID NO: 949002 - protein, 9 aa, Homo Sapiens
MLNFNHELP

SEQ ID NO: 949003 - protein, 9 aa, Homo Sapiens
WRRAVLHGV

SEQ ID NO: 949004 - protein, 9 aa, Homo Sapiens
AFFFSDFGL

SEQ ID NO: 949005 - protein, 9 aa, Homo Sapiens
TPQGQLLIL

SEQ ID NO: 949006 - protein, 9 aa, Homo Sapiens
SQRLSPKEH

SEQ ID NO: 949007 - protein, 9 aa, Homo Sapiens
FLPTAMPTL

SEQ ID NO: 949008 - protein, 9 aa, Homo Sapiens
LQSPSFRKE

SEQ ID NO: 949009 - protein, 9 aa, Homo Sapiens
KAFSTCAFH

SEQ ID NO: 949010 - protein, 9 aa, Homo Sapiens
RYKECCRFF

SEQ ID NO: 949011 - protein, 9 aa, Homo Sapiens
MGMFTRLFN

SEQ ID NO: 949012 - protein, 9 aa, Homo Sapiens
HKRGGNLSA

SEQ ID NO: 949013 - protein, 9 aa, Homo Sapiens
AEYFMQEAK

SEQ ID NO: 949014 - protein, 9 aa, Homo Sapiens
NILAGQGKA

SEQ ID NO: 949015 - protein, 9 aa, Homo Sapiens
KTLGNHFWG

SEQ ID NO: 949016 - protein, 9 aa, Homo Sapiens
VCFDFCCID

SEQ ID NO: 949017 - protein, 9 aa, Homo Sapiens
STPYGHCPN

SEQ ID NO: 949018 - protein, 9 aa, Homo Sapiens
IEKRYAEEF

SEQ ID NO: 949019 - protein, 9 aa, Homo Sapiens
PKGPLVFVA

SEQ ID NO: 949020 - protein, 9 aa, Homo Sapiens
NSSYNHFAV

SEQ ID NO: 949021 - protein, 9 aa, Homo Sapiens
LLGAACHGD

SEQ ID NO: 949022 - protein, 9 aa, Homo Sapiens
SSPPVELSI

SEQ ID NO: 949023 - protein, 9 aa, Homo Sapiens
GQLKCVRWM

SEQ ID NO: 949024 - protein, 9 aa, Homo Sapiens
VRVFEGLPK

SEQ ID NO: 949025 - protein, 9 aa, Homo Sapiens
PGLLGPPGF

SEQ ID NO: 949026 - protein, 9 aa, Homo Sapiens
FFSPHQSLL

SEQ ID NO: 949027 - protein, 9 aa, Homo Sapiens
DTKRQLREC

SEQ ID NO: 949028 - protein, 9 aa, Homo Sapiens
ELIKEEKQK

SEQ ID NO: 949029 - protein, 9 aa, Homo Sapiens
SPEVDEFVY

SEQ ID NO: 949030 - protein, 9 aa, Homo Sapiens
FYWYRQILR

SEQ ID NO: 949031 - protein, 9 aa, Homo Sapiens
QNVEAGAYV

SEQ ID NO: 949032 - protein, 9 aa, Homo Sapiens
MGSRTSESP

SEQ ID NO: 949033 - protein, 9 aa, Homo Sapiens
DGNVRLYFI

SEQ ID NO: 949034 - protein, 9 aa, Homo Sapiens
QPAFPVIHL

SEQ ID NO: 949035 - protein, 9 aa, Homo Sapiens
DATENSAFS

SEQ ID NO: 949036 - protein, 9 aa, Homo Sapiens
GPYVFIACC

SEQ ID NO: 949037 - protein, 9 aa, Homo Sapiens
VLFFWQNSP

SEQ ID NO: 949038 - protein, 9 aa, Homo Sapiens
LILDGNKIE

SEQ ID NO: 949039 - protein, 9 aa, Homo Sapiens
LTAFQLSWK

SEQ ID NO: 949040 - protein, 9 aa, Homo Sapiens
VRVTCNQLL

SEQ ID NO: 949041 - protein, 9 aa, Homo Sapiens
MGAQGGRPF

SEQ ID NO: 949042 - protein, 9 aa, Homo Sapiens
RSGFPHSSR

SEQ ID NO: 949043 - protein, 9 aa, Homo Sapiens
SGQLREKVE

SEQ ID NO: 949044 - protein, 9 aa, Homo Sapiens
PNATFNSSW

SEQ ID NO: 949045 - protein, 9 aa, Homo Sapiens
SVLGCSYAC

SEQ ID NO: 949046 - protein, 9 aa, Homo Sapiens
EGWSSYLDT

SEQ ID NO: 949047 - protein, 9 aa, Homo Sapiens
IYDPEKENI

SEQ ID NO: 949048 - protein, 9 aa, Homo Sapiens
RIGYQQLFC

SEQ ID NO: 949049 - protein, 9 aa, Homo Sapiens
LNQGNTWSS

SEQ ID NO: 949050 - protein, 9 aa, Homo Sapiens
QQRLPKQKE

SEQ ID NO: 949051 - protein, 9 aa, Homo Sapiens
SNYPYSDEY

SEQ ID NO: 949052 - protein, 9 aa, Homo Sapiens
LTSDSPSVS

SEQ ID NO: 949053 - protein, 9 aa, Homo Sapiens
CPELCRPLR

SEQ ID NO: 949054 - protein, 9 aa, Homo Sapiens
ISVQATKKV

SEQ ID NO: 949055 - protein, 9 aa, Homo Sapiens
KEQCSLLDT

SEQ ID NO: 949056 - protein, 9 aa, Homo Sapiens
LFFSRSKLQ

SEQ ID NO: 949057 - protein, 9 aa, Homo Sapiens
SFLNRMGDV

SEQ ID NO: 949058 - protein, 9 aa, Homo Sapiens
NVEMKWVKQ

SEQ ID NO: 949059 - protein, 9 aa, Homo Sapiens
VTLNGDISF

SEQ ID NO: 949060 - protein, 9 aa, Homo Sapiens
RTQLFCLHC

SEQ ID NO: 949061 - protein, 9 aa, Homo Sapiens
KALKSVATV

SEQ ID NO: 949062 - protein, 9 aa, Homo Sapiens
LQIPFQGKL

SEQ ID NO: 949063 - protein, 9 aa, Homo Sapiens
SNYCRSKGE

SEQ ID NO: 949064 - protein, 9 aa, Homo Sapiens
LEPKPDKSR

SEQ ID NO: 949065 - protein, 9 aa, Homo Sapiens
YIERFTRSL

SEQ ID NO: 949066 - protein, 9 aa, Homo Sapiens
RVFCYLYEF

SEQ ID NO: 949067 - protein, 9 aa, Homo Sapiens
FQVKNVSSE

SEQ ID NO: 949068 - protein, 9 aa, Homo Sapiens
KMREIKEVL

SEQ ID NO: 949069 - protein, 9 aa, Homo Sapiens
VFLWQFYLS

SEQ ID NO: 949070 - protein, 9 aa, Homo Sapiens
GIFCVNCMD

SEQ ID NO: 949071 - protein, 9 aa, Homo Sapiens
ISLGRQPMA

SEQ ID NO: 949072 - protein, 9 aa, Homo Sapiens
LRPRIKCQT

SEQ ID NO: 949073 - protein, 9 aa, Homo Sapiens
HQNKSVTYD

SEQ ID NO: 949074 - protein, 9 aa, Homo Sapiens
EILESEEKR

SEQ ID NO: 949075 - protein, 9 aa, Homo Sapiens
NPNYMGVGL

SEQ ID NO: 949076 - protein, 9 aa, Homo Sapiens
KLILDGNKI

SEQ ID NO: 949077 - protein, 9 aa, Homo Sapiens
SDSPCYEFL

SEQ ID NO: 949078 - protein, 9 aa, Homo Sapiens
YRAPCHIKE

SEQ ID NO: 949079 - protein, 9 aa, Homo Sapiens
EGLQKREEL

SEQ ID NO: 949080 - protein, 9 aa, Homo Sapiens
QGKYDQAVY

SEQ ID NO: 949081 - protein, 9 aa, Homo Sapiens
RERLFQLEL

SEQ ID NO: 949082 - protein, 9 aa, Homo Sapiens
GLSWHNDLT

SEQ ID NO: 949083 - protein, 9 aa, Homo Sapiens
KADTRTLMA

SEQ ID NO: 949084 - protein, 9 aa, Homo Sapiens
ESNLELYKY

SEQ ID NO: 949085 - protein, 9 aa, Homo Sapiens
SSYNHFAVI

SEQ ID NO: 949086 - protein, 9 aa, Homo Sapiens
KEEFLFPVP

SEQ ID NO: 949087 - protein, 9 aa, Homo Sapiens
QSPLESPIL

SEQ ID NO: 949088 - protein, 9 aa, Homo Sapiens
STGQSVNAP

SEQ ID NO: 949089 - protein, 9 aa, Homo Sapiens
CYKSGLILP

SEQ ID NO: 949090 - protein, 9 aa, Homo Sapiens
QEMNTLFCF

SEQ ID NO: 949091 - protein, 9 aa, Homo Sapiens
FGAFAALTP

SEQ ID NO: 949092 - protein, 9 aa, Homo Sapiens
FLAMDKVAH

SEQ ID NO: 949093 - protein, 9 aa, Homo Sapiens
LLDTNSCKQ

SEQ ID NO: 949094 - protein, 9 aa, Homo Sapiens
VISSFTVFI

SEQ ID NO: 949095 - protein, 9 aa, Homo Sapiens
EVRANKQEA

SEQ ID NO: 949096 - protein, 9 aa, Homo Sapiens
DGLICWPKG

SEQ ID NO: 949097 - protein, 9 aa, Homo Sapiens
EWYHPQFTI

SEQ ID NO: 949098 - protein, 9 aa, Homo Sapiens
LVGSSQAPP

SEQ ID NO: 949099 - protein, 9 aa, Homo Sapiens
GVGLQNLCG

SEQ ID NO: 949100 - protein, 9 aa, Homo Sapiens
LTCRMSLNI

SEQ ID NO: 949101 - protein, 9 aa, Homo Sapiens
QYAILSKQP

SEQ ID NO: 949102 - protein, 9 aa, Homo Sapiens
DFCCIDQSP

SEQ ID NO: 949103 - protein, 9 aa, Homo Sapiens
QLVSGGLAE

SEQ ID NO: 949104 - protein, 9 aa, Homo Sapiens
NSDSPCYEF

SEQ ID NO: 949105 - protein, 9 aa, Homo Sapiens
KAFKHFLAL

SEQ ID NO: 949106 - protein, 9 aa, Homo Sapiens
PTEYAFICV

SEQ ID NO: 949107 - protein, 9 aa, Homo Sapiens
CLPGFHFWQ

SEQ ID NO: 949108 - protein, 9 aa, Homo Sapiens
FLVISKKPI

SEQ ID NO: 949109 - protein, 9 aa, Homo Sapiens
LKVKEGCPQ

SEQ ID NO: 949110 - protein, 9 aa, Homo Sapiens
FDSARGMEY

SEQ ID NO: 949111 - protein, 9 aa, Homo Sapiens
IALKALKKT

SEQ ID NO: 949112 - protein, 9 aa, Homo Sapiens
AASQLKSDT

SEQ ID NO: 949113 - protein, 9 aa, Homo Sapiens
KFPKTENFC

SEQ ID NO: 949114 - protein, 9 aa, Homo Sapiens
ETKDTLLAS

SEQ ID NO: 949115 - protein, 9 aa, Homo Sapiens
KEPRRVVAA

SEQ ID NO: 949116 - protein, 9 aa, Homo Sapiens
PSALSSSAE

SEQ ID NO: 949117 - protein, 9 aa, Homo Sapiens
GCPELCRPL

SEQ ID NO: 949118 - protein, 9 aa, Homo Sapiens
PKCPSQCPA

SEQ ID NO: 949119 - protein, 9 aa, Homo Sapiens
SFFVESILK

SEQ ID NO: 949120 - protein, 9 aa, Homo Sapiens
KLYNEITRT

SEQ ID NO: 949121 - protein, 9 aa, Homo Sapiens
GPFCDQNTT

SEQ ID NO: 949122 - protein, 9 aa, Homo Sapiens
MSCQRASSS

SEQ ID NO: 949123 - protein, 9 aa, Homo Sapiens
ESPRPGGDG

SEQ ID NO: 949124 - protein, 9 aa, Homo Sapiens
PLESPILVH

SEQ ID NO: 949125 - protein, 9 aa, Homo Sapiens
NFYFLSKLV

SEQ ID NO: 949126 - protein, 9 aa, Homo Sapiens
DKMKASEDL

SEQ ID NO: 949127 - protein, 9 aa, Homo Sapiens
HSELSLDVK

SEQ ID NO: 949128 - protein, 9 aa, Homo Sapiens
LPEGIVKIR

SEQ ID NO: 949129 - protein, 9 aa, Homo Sapiens
VHKHKASLS

SEQ ID NO: 949130 - protein, 9 aa, Homo Sapiens
FRHVKEGSW

SEQ ID NO: 949131 - protein, 9 aa, Homo Sapiens
FITWCLIMA

SEQ ID NO: 949132 - protein, 9 aa, Homo Sapiens
LPGVGIPPL

SEQ ID NO: 949133 - protein, 9 aa, Homo Sapiens
VQVLQEKEP

SEQ ID NO: 949134 - protein, 9 aa, Homo Sapiens
SFLLYSYFS

SEQ ID NO: 949135 - protein, 9 aa, Homo Sapiens
ELCPPSDAD

SEQ ID NO: 949136 - protein, 9 aa, Homo Sapiens
GEPGLLGPP

SEQ ID NO: 949137 - protein, 9 aa, Homo Sapiens
TTVYKKTTP

SEQ ID NO: 949138 - protein, 9 aa, Homo Sapiens
AGSEKADSS

SEQ ID NO: 949139 - protein, 9 aa, Homo Sapiens
PKQKEKLWE

SEQ ID NO: 949140 - protein, 9 aa, Homo Sapiens
TFIVLNKSK

SEQ ID NO: 949141 - protein, 9 aa, Homo Sapiens
KTCENFMAL

SEQ ID NO: 949142 - protein, 9 aa, Homo Sapiens
SKRLLLSAS

SEQ ID NO: 949143 - protein, 9 aa, Homo Sapiens
PQRSIAFRL

SEQ ID NO: 949144 - protein, 9 aa, Homo Sapiens
VVFLIDNSQ

SEQ ID NO: 949145 - protein, 9 aa, Homo Sapiens
EKKSYECKE

SEQ ID NO: 949146 - protein, 9 aa, Homo Sapiens
APMKLGLKE

SEQ ID NO: 949147 - protein, 9 aa, Homo Sapiens
VPQNWFSIF

SEQ ID NO: 949148 - protein, 9 aa, Homo Sapiens
EGLKGFLQR

SEQ ID NO: 949149 - protein, 9 aa, Homo Sapiens
SGSPSGSAL

SEQ ID NO: 949150 - protein, 9 aa, Homo Sapiens
ASHSNYPYS

SEQ ID NO: 949151 - protein, 9 aa, Homo Sapiens
EPGPEENAA

SEQ ID NO: 949152 - protein, 9 aa, Homo Sapiens
SSRLFIEPW

SEQ ID NO: 949153 - protein, 9 aa, Homo Sapiens
YKYKECKDL

SEQ ID NO: 949154 - protein, 9 aa, Homo Sapiens
ADTYKDLFC

SEQ ID NO: 949155 - protein, 9 aa, Homo Sapiens
ASPAGKMIQ

SEQ ID NO: 949156 - protein, 9 aa, Homo Sapiens
IFTSPPLIH

SEQ ID NO: 949157 - protein, 9 aa, Homo Sapiens
FGLNLALNP

SEQ ID NO: 949158 - protein, 9 aa, Homo Sapiens
SDGAGIQKA

SEQ ID NO: 949159 - protein, 9 aa, Homo Sapiens
FPTLFRVIR

SEQ ID NO: 949160 - protein, 9 aa, Homo Sapiens
KQKKNEPGI

SEQ ID NO: 949161 - protein, 9 aa, Homo Sapiens
LAWPFSLVV

SEQ ID NO: 949162 - protein, 9 aa, Homo Sapiens
SLSSGLNHV

SEQ ID NO: 949163 - protein, 9 aa, Homo Sapiens
LCCGFVKEM

SEQ ID NO: 949164 - protein, 9 aa, Homo Sapiens
EYVVKPRQP

SEQ ID NO: 949165 - protein, 9 aa, Homo Sapiens
DGLEKKGRF

SEQ ID NO: 949166 - protein, 9 aa, Homo Sapiens
PLPHSQKSQ

SEQ ID NO: 949167 - protein, 9 aa, Homo Sapiens
NLNAGRFLV

SEQ ID NO: 949168 - protein, 9 aa, Homo Sapiens
LKGTLKPGN

SEQ ID NO: 949169 - protein, 9 aa, Homo Sapiens
GQCEVPLVW

SEQ ID NO: 949170 - protein, 9 aa, Homo Sapiens
KFVNWICSR

SEQ ID NO: 949171 - protein, 9 aa, Homo Sapiens
HPLRPRIKC

SEQ ID NO: 949172 - protein, 9 aa, Homo Sapiens
GAWPLGTGE

SEQ ID NO: 949173 - protein, 9 aa, Homo Sapiens
REPQGLQGQ

SEQ ID NO: 949174 - protein, 9 aa, Homo Sapiens
PFLCFSDST

SEQ ID NO: 949175 - protein, 9 aa, Homo Sapiens
SVGIEGGAQ

SEQ ID NO: 949176 - protein, 9 aa, Homo Sapiens
RFGGDWVIE

SEQ ID NO: 949177 - protein, 9 aa, Homo Sapiens
TQLKLLRTI

SEQ ID NO: 949178 - protein, 9 aa, Homo Sapiens
PDYKFNAVD

SEQ ID NO: 949179 - protein, 9 aa, Homo Sapiens
SIFNPERSD

SEQ ID NO: 949180 - protein, 9 aa, Homo Sapiens
WPEKQPLLF

SEQ ID NO: 949181 - protein, 9 aa, Homo Sapiens
FTYTLDHFE

SEQ ID NO: 949182 - protein, 9 aa, Homo Sapiens
VSCEHEGGK

SEQ ID NO: 949183 - protein, 9 aa, Homo Sapiens
AKLIQALVL

SEQ ID NO: 949184 - protein, 9 aa, Homo Sapiens
KKTPRGRRG

SEQ ID NO: 949185 - protein, 9 aa, Homo Sapiens
SLERERASL

SEQ ID NO: 949186 - protein, 9 aa, Homo Sapiens
EKENQVQEL

SEQ ID NO: 949187 - protein, 9 aa, Homo Sapiens
RLPDRPAGS

SEQ ID NO: 949188 - protein, 9 aa, Homo Sapiens
APDGCILCS

SEQ ID NO: 949189 - protein, 9 aa, Homo Sapiens
DSSHIVRYY

SEQ ID NO: 949190 - protein, 9 aa, Homo Sapiens
IIESTKEGT

SEQ ID NO: 949191 - protein, 9 aa, Homo Sapiens
DNFLQSRET

SEQ ID NO: 949192 - protein, 9 aa, Homo Sapiens
GHVGAPLSC

SEQ ID NO: 949193 - protein, 9 aa, Homo Sapiens
KRLTLYSGR

SEQ ID NO: 949194 - protein, 9 aa, Homo Sapiens
SRSPLYPRR

SEQ ID NO: 949195 - protein, 9 aa, Homo Sapiens
RLDLLCLRA

SEQ ID NO: 949196 - protein, 9 aa, Homo Sapiens
ASANDQRFS

SEQ ID NO: 949197 - protein, 9 aa, Homo Sapiens
RIVNGSHYK

SEQ ID NO: 949198 - protein, 9 aa, Homo Sapiens
YWAEGLILD

SEQ ID NO: 949199 - protein, 9 aa, Homo Sapiens
YPGPGENES

SEQ ID NO: 949200 - protein, 9 aa, Homo Sapiens
HTEKKSYEC

SEQ ID NO: 949201 - protein, 9 aa, Homo Sapiens
YVGDTFFEE

SEQ ID NO: 949202 - protein, 9 aa, Homo Sapiens
KNLVPKTDK

SEQ ID NO: 949203 - protein, 9 aa, Homo Sapiens
ETSLRLIRK

SEQ ID NO: 949204 - protein, 9 aa, Homo Sapiens
KRIEPSVFL

SEQ ID NO: 949205 - protein, 9 aa, Homo Sapiens
CMTESHLLV

SEQ ID NO: 949206 - protein, 9 aa, Homo Sapiens
GSVLISYFY

SEQ ID NO: 949207 - protein, 9 aa, Homo Sapiens
ENSAFSLAP

SEQ ID NO: 949208 - protein, 9 aa, Homo Sapiens
CVFCGVSKG

SEQ ID NO: 949209 - protein, 9 aa, Homo Sapiens
SSTLTMTCI

SEQ ID NO: 949210 - protein, 9 aa, Homo Sapiens
DDRARMETA

SEQ ID NO: 949211 - protein, 9 aa, Homo Sapiens
RVVNDEDLV

SEQ ID NO: 949212 - protein, 9 aa, Homo Sapiens
FGGDWVIEK

SEQ ID NO: 949213 - protein, 9 aa, Homo Sapiens
WDGLICWPK

SEQ ID NO: 949214 - protein, 9 aa, Homo Sapiens
IKDLLAYCA

SEQ ID NO: 949215 - protein, 9 aa, Homo Sapiens
YTCEENSVS

SEQ ID NO: 949216 - protein, 9 aa, Homo Sapiens
KIYFFFCES

SEQ ID NO: 949217 - protein, 9 aa, Homo Sapiens
SCASVSFQI

SEQ ID NO: 949218 - protein, 9 aa, Homo Sapiens
LGEAPRGGL

SEQ ID NO: 949219 - protein, 9 aa, Homo Sapiens
EEKGKKGET

SEQ ID NO: 949220 - protein, 9 aa, Homo Sapiens
KTLCIWELS

SEQ ID NO: 949221 - protein, 9 aa, Homo Sapiens
GEKVCECKE

SEQ ID NO: 949222 - protein, 9 aa, Homo Sapiens
QPQNESNLE

SEQ ID NO: 949223 - protein, 9 aa, Homo Sapiens
EITGTQSPY

SEQ ID NO: 949224 - protein, 9 aa, Homo Sapiens
NRKTKVFHP

SEQ ID NO: 949225 - protein, 9 aa, Homo Sapiens
MLLNLAYKK

SEQ ID NO: 949226 - protein, 9 aa, Homo Sapiens
RHLVLQMVL

SEQ ID NO: 949227 - protein, 9 aa, Homo Sapiens
QSSPCPSFL

SEQ ID NO: 949228 - protein, 9 aa, Homo Sapiens
VTDADSVWI

SEQ ID NO: 949229 - protein, 9 aa, Homo Sapiens
TARLDFFWK

SEQ ID NO: 949230 - protein, 9 aa, Homo Sapiens
TGPFLELCT

SEQ ID NO: 949231 - protein, 9 aa, Homo Sapiens
ESTKEGTTE

SEQ ID NO: 949232 - protein, 9 aa, Homo Sapiens
EEQEIFLEI

SEQ ID NO: 949233 - protein, 9 aa, Homo Sapiens
RQISGVFNE

SEQ ID NO: 949234 - protein, 9 aa, Homo Sapiens
TEVLLKIMD

SEQ ID NO: 949235 - protein, 9 aa, Homo Sapiens
FDREQVSSY

SEQ ID NO: 949236 - protein, 9 aa, Homo Sapiens
WHSEFSKPQ

SEQ ID NO: 949237 - protein, 9 aa, Homo Sapiens
YEKRFFSPH

SEQ ID NO: 949238 - protein, 9 aa, Homo Sapiens
QWRRERIWL

SEQ ID NO: 949239 - protein, 9 aa, Homo Sapiens
IYFFFCESS

SEQ ID NO: 949240 - protein, 9 aa, Homo Sapiens
PDTQIADEK

SEQ ID NO: 949241 - protein, 9 aa, Homo Sapiens
ARLVDHAYE

SEQ ID NO: 949242 - protein, 9 aa, Homo Sapiens
TINGTQNYI

SEQ ID NO: 949243 - protein, 9 aa, Homo Sapiens
DFQCDRLDD

SEQ ID NO: 949244 - protein, 9 aa, Homo Sapiens
KYPSVYPET

SEQ ID NO: 949245 - protein, 9 aa, Homo Sapiens
NKIYLICQI

SEQ ID NO: 949246 - protein, 9 aa, Homo Sapiens
LGRKEARTT

SEQ ID NO: 949247 - protein, 9 aa, Homo Sapiens
FFFPAAKPK

SEQ ID NO: 949248 - protein, 9 aa, Homo Sapiens
GNYCFLPGL

SEQ ID NO: 949249 - protein, 9 aa, Homo Sapiens
AGTGDERSK

SEQ ID NO: 949250 - protein, 9 aa, Homo Sapiens
YREGRTLIF

SEQ ID NO: 949251 - protein, 9 aa, Homo Sapiens
DCDETNLQA

SEQ ID NO: 949252 - protein, 9 aa, Homo Sapiens
VPDLEARPS

SEQ ID NO: 949253 - protein, 9 aa, Homo Sapiens
SYPDSVLPP

SEQ ID NO: 949254 - protein, 9 aa, Homo Sapiens
ASRGLRGSQ

SEQ ID NO: 949255 - protein, 9 aa, Homo Sapiens
THARERVQL

SEQ ID NO: 949256 - protein, 9 aa, Homo Sapiens
QPQSSDECT

SEQ ID NO: 949257 - protein, 9 aa, Homo Sapiens
EKATSRRSN

SEQ ID NO: 949258 - protein, 9 aa, Homo Sapiens
SLLENLHWG

SEQ ID NO: 949259 - protein, 9 aa, Homo Sapiens
GGMVLSQEL

SEQ ID NO: 949260 - protein, 9 aa, Homo Sapiens
TCPELRGLF

SEQ ID NO: 949261 - protein, 9 aa, Homo Sapiens
NAYRAGLQL

SEQ ID NO: 949262 - protein, 9 aa, Homo Sapiens
VLDLCYILV

SEQ ID NO: 949263 - protein, 9 aa, Homo Sapiens
PLLLAPGRS

SEQ ID NO: 949264 - protein, 9 aa, Homo Sapiens
QRKQQLQAR

SEQ ID NO: 949265 - protein, 9 aa, Homo Sapiens
SFGVTTATE

SEQ ID NO: 949266 - protein, 9 aa, Homo Sapiens
LRQTVKATN

SEQ ID NO: 949267 - protein, 9 aa, Homo Sapiens
LCPLCRTII

SEQ ID NO: 949268 - protein, 9 aa, Homo Sapiens
LAGQGKASP

SEQ ID NO: 949269 - protein, 9 aa, Homo Sapiens
ILRDASDPW

SEQ ID NO: 949270 - protein, 9 aa, Homo Sapiens
GSCASVSFQ

SEQ ID NO: 949271 - protein, 9 aa, Homo Sapiens
LLCLRARPP

SEQ ID NO: 949272 - protein, 9 aa, Homo Sapiens
LSDSHYTSL

SEQ ID NO: 949273 - protein, 9 aa, Homo Sapiens
TCAFHLSVV

SEQ ID NO: 949274 - protein, 9 aa, Homo Sapiens
FSLSKKAPR

SEQ ID NO: 949275 - protein, 9 aa, Homo Sapiens
QIPFQGKLK

SEQ ID NO: 949276 - protein, 9 aa, Homo Sapiens
DKIESEAKK

SEQ ID NO: 949277 - protein, 9 aa, Homo Sapiens
IRKVATSKL

SEQ ID NO: 949278 - protein, 9 aa, Homo Sapiens
YNGNDVEFT

SEQ ID NO: 949279 - protein, 9 aa, Homo Sapiens
QKMFGSMFH

SEQ ID NO: 949280 - protein, 9 aa, Homo Sapiens
IEYVLYPLD

SEQ ID NO: 949281 - protein, 9 aa, Homo Sapiens
LSESEYVVK

SEQ ID NO: 949282 - protein, 9 aa, Homo Sapiens
QMNQALQFL

SEQ ID NO: 949283 - protein, 9 aa, Homo Sapiens
LKQETVNDF

SEQ ID NO: 949284 - protein, 9 aa, Homo Sapiens
MGRCVALSC

SEQ ID NO: 949285 - protein, 9 aa, Homo Sapiens
GHLFVLRSL

SEQ ID NO: 949286 - protein, 9 aa, Homo Sapiens
GGVCLVTPV

SEQ ID NO: 949287 - protein, 9 aa, Homo Sapiens
EFKPLCGHK

SEQ ID NO: 949288 - protein, 9 aa, Homo Sapiens
MREIKEVLT

SEQ ID NO: 949289 - protein, 9 aa, Homo Sapiens
REGSFGVTT

SEQ ID NO: 949290 - protein, 9 aa, Homo Sapiens
APGPLGSPG

SEQ ID NO: 949291 - protein, 9 aa, Homo Sapiens
RGHSDPKLS

SEQ ID NO: 949292 - protein, 9 aa, Homo Sapiens
WHNDLTQYV

SEQ ID NO: 949293 - protein, 9 aa, Homo Sapiens
PQPRFEAPD

SEQ ID NO: 949294 - protein, 9 aa, Homo Sapiens
FFYEDVTLG

SEQ ID NO: 949295 - protein, 9 aa, Homo Sapiens
LQKFLERIH

SEQ ID NO: 949296 - protein, 9 aa, Homo Sapiens
PLGSPGLPG

SEQ ID NO: 949297 - protein, 9 aa, Homo Sapiens
YEFWYKLAK

SEQ ID NO: 949298 - protein, 9 aa, Homo Sapiens
LKNSEGILL

SEQ ID NO: 949299 - protein, 9 aa, Homo Sapiens
TAVKVLLHK

SEQ ID NO: 949300 - protein, 9 aa, Homo Sapiens
YNEITRTLE

SEQ ID NO: 949301 - protein, 9 aa, Homo Sapiens
FQLDESKEH

SEQ ID NO: 949302 - protein, 9 aa, Homo Sapiens
ESSPPVELS

SEQ ID NO: 949303 - protein, 9 aa, Homo Sapiens
DNGHLFVLR

SEQ ID NO: 949304 - protein, 9 aa, Homo Sapiens
PHPYPQPLA

SEQ ID NO: 949305 - protein, 9 aa, Homo Sapiens
VKIRLEQNS

SEQ ID NO: 949306 - protein, 9 aa, Homo Sapiens
SSGKSSLGS

SEQ ID NO: 949307 - protein, 9 aa, Homo Sapiens
YSPEVDEFV

SEQ ID NO: 949308 - protein, 9 aa, Homo Sapiens
KNSLDWEDW

SEQ ID NO: 949309 - protein, 9 aa, Homo Sapiens
CFCHLLAVA

SEQ ID NO: 949310 - protein, 9 aa, Homo Sapiens
SLASAPLAS

SEQ ID NO: 949311 - protein, 9 aa, Homo Sapiens
PYWGLVLKE

SEQ ID NO: 949312 - protein, 9 aa, Homo Sapiens
GRLKEELEK

SEQ ID NO: 949313 - protein, 9 aa, Homo Sapiens
DTRTLMAQF

SEQ ID NO: 949314 - protein, 9 aa, Homo Sapiens
SSALRSAST

SEQ ID NO: 949315 - protein, 9 aa, Homo Sapiens
WCLIMAHSF

SEQ ID NO: 949316 - protein, 9 aa, Homo Sapiens
PDPRHAGGR

SEQ ID NO: 949317 - protein, 9 aa, Homo Sapiens
QSLHRVFHK

SEQ ID NO: 949318 - protein, 9 aa, Homo Sapiens
GAQAPLVVE

SEQ ID NO: 949319 - protein, 9 aa, Homo Sapiens
EADTYKDLF

SEQ ID NO: 949320 - protein, 9 aa, Homo Sapiens
EGLILDTSL

SEQ ID NO: 949321 - protein, 9 aa, Homo Sapiens
SSDTPETDD

SEQ ID NO: 949322 - protein, 9 aa, Homo Sapiens
ACSFPGING

SEQ ID NO: 949323 - protein, 9 aa, Homo Sapiens
STEASSSST

SEQ ID NO: 949324 - protein, 9 aa, Homo Sapiens
NEELSYSFS

SEQ ID NO: 949325 - protein, 9 aa, Homo Sapiens
ELGVRFEDY

SEQ ID NO: 949326 - protein, 9 aa, Homo Sapiens
MIQLATPPP

SEQ ID NO: 949327 - protein, 9 aa, Homo Sapiens
CQRANFLGD

SEQ ID NO: 949328 - protein, 9 aa, Homo Sapiens
PGLQEMPGE

SEQ ID NO: 949329 - protein, 9 aa, Homo Sapiens
YHFRTWPDL

SEQ ID NO: 949330 - protein, 9 aa, Homo Sapiens
PIPGHLVDV

SEQ ID NO: 949331 - protein, 9 aa, Homo Sapiens
SSGSLTHTA

SEQ ID NO: 949332 - protein, 9 aa, Homo Sapiens
QQHRQSRSH

SEQ ID NO: 949333 - protein, 9 aa, Homo Sapiens
EKRYAEEFA

SEQ ID NO: 949334 - protein, 9 aa, Homo Sapiens
SSQDTLRSM

SEQ ID NO: 949335 - protein, 9 aa, Homo Sapiens
LMGATVHEL

SEQ ID NO: 949336 - protein, 9 aa, Homo Sapiens
SASFTSSKA

SEQ ID NO: 949337 - protein, 9 aa, Homo Sapiens
EVLLLPLDE

SEQ ID NO: 949338 - protein, 9 aa, Homo Sapiens
FMRKRESQF

SEQ ID NO: 949339 - protein, 9 aa, Homo Sapiens
QQMPTLEHT

SEQ ID NO: 949340 - protein, 9 aa, Homo Sapiens
QVQYAILSK

SEQ ID NO: 949341 - protein, 9 aa, Homo Sapiens
AIAETFKNK

SEQ ID NO: 949342 - protein, 9 aa, Homo Sapiens
SEGYLYTSK

SEQ ID NO: 949343 - protein, 9 aa, Homo Sapiens
LEISPTIKK

SEQ ID NO: 949344 - protein, 9 aa, Homo Sapiens
NCDGWLLLR

SEQ ID NO: 949345 - protein, 9 aa, Homo Sapiens
NTTLQMTIW

SEQ ID NO: 949346 - protein, 9 aa, Homo Sapiens
RPMPSVLED

SEQ ID NO: 949347 - protein, 9 aa, Homo Sapiens
HLPETGITT

SEQ ID NO: 949348 - protein, 9 aa, Homo Sapiens
SAVPPELDK

SEQ ID NO: 949349 - protein, 9 aa, Homo Sapiens
LHPVNNKES

SEQ ID NO: 949350 - protein, 9 aa, Homo Sapiens
ELEKARDIA

SEQ ID NO: 949351 - protein, 9 aa, Homo Sapiens
RKELKRTDT

SEQ ID NO: 949352 - protein, 9 aa, Homo Sapiens
MPCGSGRGP

SEQ ID NO: 949353 - protein, 9 aa, Homo Sapiens
ILDTSLIPW

SEQ ID NO: 949354 - protein, 9 aa, Homo Sapiens
RMIQLATPP

SEQ ID NO: 949355 - protein, 9 aa, Homo Sapiens
FYEDVTLGN

SEQ ID NO: 949356 - protein, 9 aa, Homo Sapiens
WPNNIYYSD

SEQ ID NO: 949357 - protein, 9 aa, Homo Sapiens
TGQNVNIIL

SEQ ID NO: 949358 - protein, 9 aa, Homo Sapiens
ILFYNVTDG

SEQ ID NO: 949359 - protein, 9 aa, Homo Sapiens
NLNTDFFAK

SEQ ID NO: 949360 - protein, 9 aa, Homo Sapiens
FEDGEGNLT

SEQ ID NO: 949361 - protein, 9 aa, Homo Sapiens
CDREIFCRG

SEQ ID NO: 949362 - protein, 9 aa, Homo Sapiens
LVSPITIVY

SEQ ID NO: 949363 - protein, 9 aa, Homo Sapiens
KETERADSP

SEQ ID NO: 949364 - protein, 9 aa, Homo Sapiens
RDWLRVGFV

SEQ ID NO: 949365 - protein, 9 aa, Homo Sapiens
TSKAEKENQ

SEQ ID NO: 949366 - protein, 9 aa, Homo Sapiens
FEDNPLFAG

SEQ ID NO: 949367 - protein, 9 aa, Homo Sapiens
TRSELLQSQ

SEQ ID NO: 949368 - protein, 9 aa, Homo Sapiens
PFIIIYSIS

SEQ ID NO: 949369 - protein, 9 aa, Homo Sapiens
WPDLGVPSD

SEQ ID NO: 949370 - protein, 9 aa, Homo Sapiens
AKRLLGWKW

SEQ ID NO: 949371 - protein, 9 aa, Homo Sapiens
IVKMFRFTR

SEQ ID NO: 949372 - protein, 9 aa, Homo Sapiens
LQLESWGYN

SEQ ID NO: 949373 - protein, 9 aa, Homo Sapiens
QKLLQKKRL

SEQ ID NO: 949374 - protein, 9 aa, Homo Sapiens
APPFPKPHP

SEQ ID NO: 949375 - protein, 9 aa, Homo Sapiens
KVRNKSCEN

SEQ ID NO: 949376 - protein, 9 aa, Homo Sapiens
QLATPPPPT

SEQ ID NO: 949377 - protein, 9 aa, Homo Sapiens
SCLPGFHFW

SEQ ID NO: 949378 - protein, 9 aa, Homo Sapiens
ETSLEKRMG

SEQ ID NO: 949379 - protein, 9 aa, Homo Sapiens
RGDCCRSLT

SEQ ID NO: 949380 - protein, 9 aa, Homo Sapiens
MGATVHELI

SEQ ID NO: 949381 - protein, 9 aa, Homo Sapiens
SPPGFPGSP

SEQ ID NO: 949382 - protein, 9 aa, Homo Sapiens
AGLSRARDS

SEQ ID NO: 949383 - protein, 9 aa, Homo Sapiens
FPARVPSPP

SEQ ID NO: 949384 - protein, 9 aa, Homo Sapiens
GAGIQKAVE

SEQ ID NO: 949385 - protein, 9 aa, Homo Sapiens
GGCEENQNR

SEQ ID NO: 949386 - protein, 9 aa, Homo Sapiens
GLCEVLLSN

SEQ ID NO: 949387 - protein, 9 aa, Homo Sapiens
RLQEELKKL

SEQ ID NO: 949388 - protein, 9 aa, Homo Sapiens
NIFCMTESH

SEQ ID NO: 949389 - protein, 9 aa, Homo Sapiens
LAVFPGSSS

SEQ ID NO: 949390 - protein, 9 aa, Homo Sapiens
IRTFKISVT

SEQ ID NO: 949391 - protein, 9 aa, Homo Sapiens
RFPCKNSEG

SEQ ID NO: 949392 - protein, 9 aa, Homo Sapiens
QPDYPGSQQ

SEQ ID NO: 949393 - protein, 9 aa, Homo Sapiens
LQHRYQELQ

SEQ ID NO: 949394 - protein, 9 aa, Homo Sapiens
DMIERCICF

SEQ ID NO: 949395 - protein, 9 aa, Homo Sapiens
EDVVKSTKT

SEQ ID NO: 949396 - protein, 9 aa, Homo Sapiens
CISSRWICD

SEQ ID NO: 949397 - protein, 9 aa, Homo Sapiens
SYVGRRENG

SEQ ID NO: 949398 - protein, 9 aa, Homo Sapiens
ACLLVIGIW

SEQ ID NO: 949399 - protein, 9 aa, Homo Sapiens
LQSLPAVVP

SEQ ID NO: 949400 - protein, 9 aa, Homo Sapiens
PEKEEPHLL

SEQ ID NO: 949401 - protein, 9 aa, Homo Sapiens
KIDDKEQKS

SEQ ID NO: 949402 - protein, 9 aa, Homo Sapiens
ARDMSKKSL

SEQ ID NO: 949403 - protein, 9 aa, Homo Sapiens
FVGTSLGIV

SEQ ID NO: 949404 - protein, 9 aa, Homo Sapiens
NLMLSVLFH

SEQ ID NO: 949405 - protein, 9 aa, Homo Sapiens
NLDVQRELI

SEQ ID NO: 949406 - protein, 9 aa, Homo Sapiens
VFEGLPKPE

SEQ ID NO: 949407 - protein, 9 aa, Homo Sapiens
ALPAPEIRC

SEQ ID NO: 949408 - protein, 9 aa, Homo Sapiens
GEGEPGPEE

SEQ ID NO: 949409 - protein, 9 aa, Homo Sapiens
PVPRFCLFS

SEQ ID NO: 949410 - protein, 9 aa, Homo Sapiens
FLTMIISYF

SEQ ID NO: 949411 - protein, 9 aa, Homo Sapiens
IIFTIKLDP

SEQ ID NO: 949412 - protein, 9 aa, Homo Sapiens
KCSVKHDDV

SEQ ID NO: 949413 - protein, 9 aa, Homo Sapiens
RIDTAPVVA

SEQ ID NO: 949414 - protein, 9 aa, Homo Sapiens
QRFSSESKQ

SEQ ID NO: 949415 - protein, 9 aa, Homo Sapiens
PSTETTEIS

SEQ ID NO: 949416 - protein, 9 aa, Homo Sapiens
TSTEASSSS

SEQ ID NO: 949417 - protein, 9 aa, Homo Sapiens
MDFQCDRLD

SEQ ID NO: 949418 - protein, 9 aa, Homo Sapiens
SLGHTCDRP

SEQ ID NO: 949419 - protein, 9 aa, Homo Sapiens
MNLNAGRFL

SEQ ID NO: 949420 - protein, 9 aa, Homo Sapiens
DVRAFTYCD

SEQ ID NO: 949421 - protein, 9 aa, Homo Sapiens
DFFSYFMDH

SEQ ID NO: 949422 - protein, 9 aa, Homo Sapiens
EGLKETERA

SEQ ID NO: 949423 - protein, 9 aa, Homo Sapiens
SFPENCTLE

SEQ ID NO: 949424 - protein, 9 aa, Homo Sapiens
VAITQVTFV

SEQ ID NO: 949425 - protein, 9 aa, Homo Sapiens
REQISENST

SEQ ID NO: 949426 - protein, 9 aa, Homo Sapiens
LGEKAFLEH

SEQ ID NO: 949427 - protein, 9 aa, Homo Sapiens
RILANDGVL

SEQ ID NO: 949428 - protein, 9 aa, Homo Sapiens
LPSFAHCIS

SEQ ID NO: 949429 - protein, 9 aa, Homo Sapiens
LDVFCHKDR

SEQ ID NO: 949430 - protein, 9 aa, Homo Sapiens
DYDFSLSIY

SEQ ID NO: 949431 - protein, 9 aa, Homo Sapiens
KEVLTPEML

SEQ ID NO: 949432 - protein, 9 aa, Homo Sapiens
SAFVRVVSA

SEQ ID NO: 949433 - protein, 9 aa, Homo Sapiens
FSTCAFHLS

SEQ ID NO: 949434 - protein, 9 aa, Homo Sapiens
DTYGKELYY

SEQ ID NO: 949435 - protein, 9 aa, Homo Sapiens
RPCLFKGTL

SEQ ID NO: 949436 - protein, 9 aa, Homo Sapiens
SLFSCFSNS

SEQ ID NO: 949437 - protein, 9 aa, Homo Sapiens
KRLNLDCWK

SEQ ID NO: 949438 - protein, 9 aa, Homo Sapiens
APLLGASLG

SEQ ID NO: 949439 - protein, 9 aa, Homo Sapiens
RLQGHLEKY

SEQ ID NO: 949440 - protein, 9 aa, Homo Sapiens
QQCISSRWI

SEQ ID NO: 949441 - protein, 9 aa, Homo Sapiens
LCYILVTVP

SEQ ID NO: 949442 - protein, 9 aa, Homo Sapiens
HAHLQSLPA

SEQ ID NO: 949443 - protein, 9 aa, Homo Sapiens
SDEAPMKLG

SEQ ID NO: 949444 - protein, 9 aa, Homo Sapiens
ILFETLLYF

SEQ ID NO: 949445 - protein, 9 aa, Homo Sapiens
QRRPCNVTF

SEQ ID NO: 949446 - protein, 9 aa, Homo Sapiens
FALSILRSG

SEQ ID NO: 949447 - protein, 9 aa, Homo Sapiens
RQGLSKLPA

SEQ ID NO: 949448 - protein, 9 aa, Homo Sapiens
FVTHAYASE

SEQ ID NO: 949449 - protein, 9 aa, Homo Sapiens
KELNIKLAR

SEQ ID NO: 949450 - protein, 9 aa, Homo Sapiens
KIDLPMKRR

SEQ ID NO: 949451 - protein, 9 aa, Homo Sapiens
ALSSSAENI

SEQ ID NO: 949452 - protein, 9 aa, Homo Sapiens
NLFSLIGLK

SEQ ID NO: 949453 - protein, 9 aa, Homo Sapiens
TMSSRVHKA

SEQ ID NO: 949454 - protein, 9 aa, Homo Sapiens
SLFQGMGGE

SEQ ID NO: 949455 - protein, 9 aa, Homo Sapiens
KSRRKKGPF

SEQ ID NO: 949456 - protein, 9 aa, Homo Sapiens
GCVWTTGSS

SEQ ID NO: 949457 - protein, 9 aa, Homo Sapiens
RSTLAPELL

SEQ ID NO: 949458 - protein, 9 aa, Homo Sapiens
VRSLRHNNW

SEQ ID NO: 949459 - protein, 9 aa, Homo Sapiens
QLLVVASLV

SEQ ID NO: 949460 - protein, 9 aa, Homo Sapiens
NKDHSLERE

SEQ ID NO: 949461 - protein, 9 aa, Homo Sapiens
AFMLSCNFL

SEQ ID NO: 949462 - protein, 9 aa, Homo Sapiens
ASPPASSLQ

SEQ ID NO: 949463 - protein, 9 aa, Homo Sapiens
DGYYAQSED

SEQ ID NO: 949464 - protein, 9 aa, Homo Sapiens
SCRKAPPKH

SEQ ID NO: 949465 - protein, 9 aa, Homo Sapiens
IPSFSETLS

SEQ ID NO: 949466 - protein, 9 aa, Homo Sapiens
LKTTHINTV

SEQ ID NO: 949467 - protein, 9 aa, Homo Sapiens
GITTDQLLR

SEQ ID NO: 949468 - protein, 9 aa, Homo Sapiens
EHTNVCVQQ

SEQ ID NO: 949469 - protein, 9 aa, Homo Sapiens
NRIAKMNWN

SEQ ID NO: 949470 - protein, 9 aa, Homo Sapiens
AEIEKRYAE

SEQ ID NO: 949471 - protein, 9 aa, Homo Sapiens
MTQIMFKTF

SEQ ID NO: 949472 - protein, 9 aa, Homo Sapiens
LYQVIFEGK

SEQ ID NO: 949473 - protein, 9 aa, Homo Sapiens
HKWNYSNLI

SEQ ID NO: 949474 - protein, 9 aa, Homo Sapiens
EAPMKLGLK

SEQ ID NO: 949475 - protein, 9 aa, Homo Sapiens
QRASSSASL

SEQ ID NO: 949476 - protein, 9 aa, Homo Sapiens
EEQKRLNLD

SEQ ID NO: 949477 - protein, 9 aa, Homo Sapiens
KNVSSERIA

SEQ ID NO: 949478 - protein, 9 aa, Homo Sapiens
PTEDVEEER

SEQ ID NO: 949479 - protein, 9 aa, Homo Sapiens
DYEAGEILF

SEQ ID NO: 949480 - protein, 9 aa, Homo Sapiens
REEGYWTRN

SEQ ID NO: 949481 - protein, 9 aa, Homo Sapiens
SRTSESPLH

SEQ ID NO: 949482 - protein, 9 aa, Homo Sapiens
VCGQSATAH

SEQ ID NO: 949483 - protein, 9 aa, Homo Sapiens
CEETPEKIQ

SEQ ID NO: 949484 - protein, 9 aa, Homo Sapiens
SQENSGQHP

SEQ ID NO: 949485 - protein, 9 aa, Homo Sapiens
PLYLRKIVG

SEQ ID NO: 949486 - protein, 9 aa, Homo Sapiens
TTLSSMGSG

SEQ ID NO: 949487 - protein, 9 aa, Homo Sapiens
PGGFLPTAM

SEQ ID NO: 949488 - protein, 9 aa, Homo Sapiens
GSGISVLGC

SEQ ID NO: 949489 - protein, 9 aa, Homo Sapiens
ESPKATGGF

SEQ ID NO: 949490 - protein, 9 aa, Homo Sapiens
HNCKFYIYY

SEQ ID NO: 949491 - protein, 9 aa, Homo Sapiens
TIKDLLAYC

SEQ ID NO: 949492 - protein, 9 aa, Homo Sapiens
EKVCECKEC

SEQ ID NO: 949493 - protein, 9 aa, Homo Sapiens
GDSEKYQRI

SEQ ID NO: 949494 - protein, 9 aa, Homo Sapiens
PIFYGFLSD

SEQ ID NO: 949495 - protein, 9 aa, Homo Sapiens
DSDSSEKEE

SEQ ID NO: 949496 - protein, 9 aa, Homo Sapiens
DAAPTNGQP

SEQ ID NO: 949497 - protein, 9 aa, Homo Sapiens
IYLSGACDK

SEQ ID NO: 949498 - protein, 9 aa, Homo Sapiens
SALRSASTP

SEQ ID NO: 949499 - protein, 9 aa, Homo Sapiens
PARVPSPPP

SEQ ID NO: 949500 - protein, 9 aa, Homo Sapiens
IFFILFETL

SEQ ID NO: 949501 - protein, 9 aa, Homo Sapiens
NWRLQAESE

SEQ ID NO: 949502 - protein, 9 aa, Homo Sapiens
TTCPELRGL

SEQ ID NO: 949503 - protein, 9 aa, Homo Sapiens
REGKKKCVH

SEQ ID NO: 949504 - protein, 9 aa, Homo Sapiens
GLLWEAEAT

SEQ ID NO: 949505 - protein, 9 aa, Homo Sapiens
DPTVGFIPN

SEQ ID NO: 949506 - protein, 9 aa, Homo Sapiens
SCDTSPNTV

SEQ ID NO: 949507 - protein, 9 aa, Homo Sapiens
KTPRGRRGW

SEQ ID NO: 949508 - protein, 9 aa, Homo Sapiens
DVFCHKDRQ

SEQ ID NO: 949509 - protein, 9 aa, Homo Sapiens
QKIYTGEKP

SEQ ID NO: 949510 - protein, 9 aa, Homo Sapiens
IATCTTNKT

SEQ ID NO: 949511 - protein, 9 aa, Homo Sapiens
CLGASEAGD

SEQ ID NO: 949512 - protein, 9 aa, Homo Sapiens
ETREEGYTD

SEQ ID NO: 949513 - protein, 9 aa, Homo Sapiens
ESEYVVKIW

SEQ ID NO: 949514 - protein, 9 aa, Homo Sapiens
RLDVYFLHN

SEQ ID NO: 949515 - protein, 9 aa, Homo Sapiens
SMNMLNFNH

SEQ ID NO: 949516 - protein, 9 aa, Homo Sapiens
SPDPVNGMA

SEQ ID NO: 949517 - protein, 9 aa, Homo Sapiens
LLRLAGLNY

SEQ ID NO: 949518 - protein, 9 aa, Homo Sapiens
FLNDISTAL

SEQ ID NO: 949519 - protein, 9 aa, Homo Sapiens
LQGPRALAL

SEQ ID NO: 949520 - protein, 9 aa, Homo Sapiens
QEAPSSFSK

SEQ ID NO: 949521 - protein, 9 aa, Homo Sapiens
NPARAVQKE

SEQ ID NO: 949522 - protein, 9 aa, Homo Sapiens
TGAVDADES

SEQ ID NO: 949523 - protein, 9 aa, Homo Sapiens
LPGFHFWQD

SEQ ID NO: 949524 - protein, 9 aa, Homo Sapiens
PMGPEYVEE

SEQ ID NO: 949525 - protein, 9 aa, Homo Sapiens
LIEEHAPPS

SEQ ID NO: 949526 - protein, 9 aa, Homo Sapiens
SMKSGPKLL

SEQ ID NO: 949527 - protein, 9 aa, Homo Sapiens
LESQLFSIE

SEQ ID NO: 949528 - protein, 9 aa, Homo Sapiens
VSASGKSIE

SEQ ID NO: 949529 - protein, 9 aa, Homo Sapiens
LFHHSVRGG

SEQ ID NO: 949530 - protein, 9 aa, Homo Sapiens
LKNNDRCGC

SEQ ID NO: 949531 - protein, 9 aa, Homo Sapiens
MFGVWLGEL

SEQ ID NO: 949532 - protein, 9 aa, Homo Sapiens
TASITDSET

SEQ ID NO: 949533 - protein, 9 aa, Homo Sapiens
QDMARLQRL

SEQ ID NO: 949534 - protein, 9 aa, Homo Sapiens
QPLPTKGAE

SEQ ID NO: 949535 - protein, 9 aa, Homo Sapiens
DKFNDKYNL

SEQ ID NO: 949536 - protein, 9 aa, Homo Sapiens
RRPCNVTFR

SEQ ID NO: 949537 - protein, 9 aa, Homo Sapiens
ENFVMEFLP

SEQ ID NO: 949538 - protein, 9 aa, Homo Sapiens
QPLDLKGSA

SEQ ID NO: 949539 - protein, 9 aa, Homo Sapiens
INMDAAPAC

SEQ ID NO: 949540 - protein, 9 aa, Homo Sapiens
SREHVLLGR

SEQ ID NO: 949541 - protein, 9 aa, Homo Sapiens
QTDDAAPTN

SEQ ID NO: 949542 - protein, 9 aa, Homo Sapiens
KKLTVDEWK

SEQ ID NO: 949543 - protein, 9 aa, Homo Sapiens
QPGGNLSPG

SEQ ID NO: 949544 - protein, 9 aa, Homo Sapiens
IDAKFFARI

SEQ ID NO: 949545 - protein, 9 aa, Homo Sapiens
QAFRGKSSP

SEQ ID NO: 949546 - protein, 9 aa, Homo Sapiens
QLKLLRTIL

SEQ ID NO: 949547 - protein, 9 aa, Homo Sapiens
GGVRNPGDR

SEQ ID NO: 949548 - protein, 9 aa, Homo Sapiens
EQKGELQAL

SEQ ID NO: 949549 - protein, 9 aa, Homo Sapiens
LVVLSFPRF

SEQ ID NO: 949550 - protein, 9 aa, Homo Sapiens
AACHGDIIP

SEQ ID NO: 949551 - protein, 9 aa, Homo Sapiens
LVTVPKSIR

SEQ ID NO: 949552 - protein, 9 aa, Homo Sapiens
LARYALNHL

SEQ ID NO: 949553 - protein, 9 aa, Homo Sapiens
QSLTQIYVL

SEQ ID NO: 949554 - protein, 9 aa, Homo Sapiens
WEWYHPQFT

SEQ ID NO: 949555 - protein, 9 aa, Homo Sapiens
THLNIRGNR

SEQ ID NO: 949556 - protein, 9 aa, Homo Sapiens
SPNMFYINP

SEQ ID NO: 949557 - protein, 9 aa, Homo Sapiens
TDNQTLLNQ

SEQ ID NO: 949558 - protein, 9 aa, Homo Sapiens
ILPSVTRNK

SEQ ID NO: 949559 - protein, 9 aa, Homo Sapiens
ASPGGCSPL

SEQ ID NO: 949560 - protein, 9 aa, Homo Sapiens
FFEISSLHS

SEQ ID NO: 949561 - protein, 9 aa, Homo Sapiens
ILVEVLPQY

SEQ ID NO: 949562 - protein, 9 aa, Homo Sapiens
TYLTALQIC

SEQ ID NO: 949563 - protein, 9 aa, Homo Sapiens
GWGQEKDNE

SEQ ID NO: 949564 - protein, 9 aa, Homo Sapiens
REPSKLKRF

SEQ ID NO: 949565 - protein, 9 aa, Homo Sapiens
YDCQLYRGL

SEQ ID NO: 949566 - protein, 9 aa, Homo Sapiens
IERLFFFPA

SEQ ID NO: 949567 - protein, 9 aa, Homo Sapiens
ITEENPMEV

SEQ ID NO: 949568 - protein, 9 aa, Homo Sapiens
IGGKSLRRK

SEQ ID NO: 949569 - protein, 9 aa, Homo Sapiens
VLNKHKKIY

SEQ ID NO: 949570 - protein, 9 aa, Homo Sapiens
QECVEETCS

SEQ ID NO: 949571 - protein, 9 aa, Homo Sapiens
QLKEIMANT

SEQ ID NO: 949572 - protein, 9 aa, Homo Sapiens
YPDHDLEII

SEQ ID NO: 949573 - protein, 9 aa, Homo Sapiens
LEKHKERCH

SEQ ID NO: 949574 - protein, 9 aa, Homo Sapiens
SGQVPVYVV

SEQ ID NO: 949575 - protein, 9 aa, Homo Sapiens
VPILSADIA

SEQ ID NO: 949576 - protein, 9 aa, Homo Sapiens
TCEILAVIK

SEQ ID NO: 949577 - protein, 9 aa, Homo Sapiens
LVGVGESGR

SEQ ID NO: 949578 - protein, 9 aa, Homo Sapiens
TLSATFQRH

SEQ ID NO: 949579 - protein, 9 aa, Homo Sapiens
LPQKLLETR

SEQ ID NO: 949580 - protein, 9 aa, Homo Sapiens
PNYMGVGLF

SEQ ID NO: 949581 - protein, 9 aa, Homo Sapiens
FLDKLYNEI

SEQ ID NO: 949582 - protein, 9 aa, Homo Sapiens
FFLSKSKEP

SEQ ID NO: 949583 - protein, 9 aa, Homo Sapiens
NYMVYRISA

SEQ ID NO: 949584 - protein, 9 aa, Homo Sapiens
REPFANAIK

SEQ ID NO: 949585 - protein, 9 aa, Homo Sapiens
IVRQVRFRR

SEQ ID NO: 949586 - protein, 9 aa, Homo Sapiens
SPGASRGLR

SEQ ID NO: 949587 - protein, 9 aa, Homo Sapiens
VTFFTPALY

SEQ ID NO: 949588 - protein, 9 aa, Homo Sapiens
KSQLQRKQQ

SEQ ID NO: 949589 - protein, 9 aa, Homo Sapiens
ELTKLSAFV

SEQ ID NO: 949590 - protein, 9 aa, Homo Sapiens
EKRDKGAMG

SEQ ID NO: 949591 - protein, 9 aa, Homo Sapiens
CVMTGKSRR

SEQ ID NO: 949592 - protein, 9 aa, Homo Sapiens
TPRMHHFSR

SEQ ID NO: 949593 - protein, 9 aa, Homo Sapiens
TEYAFICVR

SEQ ID NO: 949594 - protein, 9 aa, Homo Sapiens
CPDGSDKDN

SEQ ID NO: 949595 - protein, 9 aa, Homo Sapiens
HKTLVSELI

SEQ ID NO: 949596 - protein, 9 aa, Homo Sapiens
QKGREMSLV

SEQ ID NO: 949597 - protein, 9 aa, Homo Sapiens
LSEENRLFT

SEQ ID NO: 949598 - protein, 9 aa, Homo Sapiens
PLHFMNDLR

SEQ ID NO: 949599 - protein, 9 aa, Homo Sapiens
SFIGTEPDS

SEQ ID NO: 949600 - protein, 9 aa, Homo Sapiens
LNQSDIVEI

SEQ ID NO: 949601 - protein, 9 aa, Homo Sapiens
PDKGDPFSF

SEQ ID NO: 949602 - protein, 9 aa, Homo Sapiens
YGNQILFLG

SEQ ID NO: 949603 - protein, 9 aa, Homo Sapiens
SFCKSQCLH

SEQ ID NO: 949604 - protein, 9 aa, Homo Sapiens
VGNYCFLPG

SEQ ID NO: 949605 - protein, 9 aa, Homo Sapiens
NPSIKDEAR

SEQ ID NO: 949606 - protein, 9 aa, Homo Sapiens
LRTHEFSPE

SEQ ID NO: 949607 - protein, 9 aa, Homo Sapiens
PENNFHDKN

SEQ ID NO: 949608 - protein, 9 aa, Homo Sapiens
VKSTKTFRS

SEQ ID NO: 949609 - protein, 9 aa, Homo Sapiens
ILNIEDAEN

SEQ ID NO: 949610 - protein, 9 aa, Homo Sapiens
TAVYESIGF

SEQ ID NO: 949611 - protein, 9 aa, Homo Sapiens
INPMYQFSL

SEQ ID NO: 949612 - protein, 9 aa, Homo Sapiens
PQEPPGLPG

SEQ ID NO: 949613 - protein, 9 aa, Homo Sapiens
TFFTPGSGM

SEQ ID NO: 949614 - protein, 9 aa, Homo Sapiens
CKQEGIFCV

SEQ ID NO: 949615 - protein, 9 aa, Homo Sapiens
CYYASRRVC

SEQ ID NO: 949616 - protein, 9 aa, Homo Sapiens
VKSVNIEER

SEQ ID NO: 949617 - protein, 9 aa, Homo Sapiens
GTGLFFSAF

SEQ ID NO: 949618 - protein, 9 aa, Homo Sapiens
AKAETIWSL

SEQ ID NO: 949619 - protein, 9 aa, Homo Sapiens
SRAQLSFLA

SEQ ID NO: 949620 - protein, 9 aa, Homo Sapiens
VDTSCQGNL

SEQ ID NO: 949621 - protein, 9 aa, Homo Sapiens
DWGILGRKE

SEQ ID NO: 949622 - protein, 9 aa, Homo Sapiens
QKPSDKHLN

SEQ ID NO: 949623 - protein, 9 aa, Homo Sapiens
PFGEMGSPP

SEQ ID NO: 949624 - protein, 9 aa, Homo Sapiens
GLKNNDRCG

SEQ ID NO: 949625 - protein, 9 aa, Homo Sapiens
ERINVYYNK

SEQ ID NO: 949626 - protein, 9 aa, Homo Sapiens
VVGQSRGRR

SEQ ID NO: 949627 - protein, 9 aa, Homo Sapiens
DTTVFSLLM

SEQ ID NO: 949628 - protein, 9 aa, Homo Sapiens
EGGAQKGVS

SEQ ID NO: 949629 - protein, 9 aa, Homo Sapiens
CSSFRGGRP

SEQ ID NO: 949630 - protein, 9 aa, Homo Sapiens
SSDNQGSSV

SEQ ID NO: 949631 - protein, 9 aa, Homo Sapiens
NLIEVRANK

SEQ ID NO: 949632 - protein, 9 aa, Homo Sapiens
NCNHCEDAG

SEQ ID NO: 949633 - protein, 9 aa, Homo Sapiens
REVMILKLP

SEQ ID NO: 949634 - protein, 9 aa, Homo Sapiens
PPDNPSIKD

SEQ ID NO: 949635 - protein, 9 aa, Homo Sapiens
SEELVVLSF

SEQ ID NO: 949636 - protein, 9 aa, Homo Sapiens
SDLKENSKT

SEQ ID NO: 949637 - protein, 9 aa, Homo Sapiens
HSILYTLSR

SEQ ID NO: 949638 - protein, 9 aa, Homo Sapiens
KDDMRNFYF

SEQ ID NO: 949639 - protein, 9 aa, Homo Sapiens
GKPVLFFWQ

SEQ ID NO: 949640 - protein, 9 aa, Homo Sapiens
NRALKKGHR

SEQ ID NO: 949641 - protein, 9 aa, Homo Sapiens
GSPSGSALA

SEQ ID NO: 949642 - protein, 9 aa, Homo Sapiens
CTFEDLSEI

SEQ ID NO: 949643 - protein, 9 aa, Homo Sapiens
PALGNLFSI

SEQ ID NO: 949644 - protein, 9 aa, Homo Sapiens
CACNSLGTI

SEQ ID NO: 949645 - protein, 9 aa, Homo Sapiens
ITNRKTKVF

SEQ ID NO: 949646 - protein, 9 aa, Homo Sapiens
DTPLHFAIS

SEQ ID NO: 949647 - protein, 9 aa, Homo Sapiens
QNIAKDEFK

SEQ ID NO: 949648 - protein, 9 aa, Homo Sapiens
VSYQVSLNS

SEQ ID NO: 949649 - protein, 9 aa, Homo Sapiens
KYYQSSWEQ

SEQ ID NO: 949650 - protein, 9 aa, Homo Sapiens
LILENLPEI

SEQ ID NO: 949651 - protein, 9 aa, Homo Sapiens
MVYFAISNY

SEQ ID NO: 949652 - protein, 9 aa, Homo Sapiens
TDGPECPTV

SEQ ID NO: 949653 - protein, 9 aa, Homo Sapiens
MRVVNDEDL

SEQ ID NO: 949654 - protein, 9 aa, Homo Sapiens
RAPLGAPNL

SEQ ID NO: 949655 - protein, 9 aa, Homo Sapiens
PRSPEWMDF

SEQ ID NO: 949656 - protein, 9 aa, Homo Sapiens
AVLKFATAT

SEQ ID NO: 949657 - protein, 9 aa, Homo Sapiens
IKETVSRNK

SEQ ID NO: 949658 - protein, 9 aa, Homo Sapiens
GENLAVTGS

SEQ ID NO: 949659 - protein, 9 aa, Homo Sapiens
ATLCGDSFP

SEQ ID NO: 949660 - protein, 9 aa, Homo Sapiens
HLHRTEGGT

SEQ ID NO: 949661 - protein, 9 aa, Homo Sapiens
ALAALYVLY

SEQ ID NO: 949662 - protein, 9 aa, Homo Sapiens
RTDQGCHQK

SEQ ID NO: 949663 - protein, 9 aa, Homo Sapiens
YVWGSPWVS

SEQ ID NO: 949664 - protein, 9 aa, Homo Sapiens
GPGENESQW

SEQ ID NO: 949665 - protein, 9 aa, Homo Sapiens
QMRGMPTFS

SEQ ID NO: 949666 - protein, 9 aa, Homo Sapiens
STSSRLKNM

SEQ ID NO: 949667 - protein, 9 aa, Homo Sapiens
YKTYHFWVF

SEQ ID NO: 949668 - protein, 9 aa, Homo Sapiens
AQGGRPFLI

SEQ ID NO: 949669 - protein, 9 aa, Homo Sapiens
IFPECAYET

SEQ ID NO: 949670 - protein, 9 aa, Homo Sapiens
ARAMFIPTS

SEQ ID NO: 949671 - protein, 9 aa, Homo Sapiens
HCDNDYSLA

SEQ ID NO: 949672 - protein, 9 aa, Homo Sapiens
KAFAFEIIQ

SEQ ID NO: 949673 - protein, 9 aa, Homo Sapiens
FRKNPPPEP

SEQ ID NO: 949674 - protein, 9 aa, Homo Sapiens
EQPSLLQSS

SEQ ID NO: 949675 - protein, 9 aa, Homo Sapiens
LQNTGHEGK

SEQ ID NO: 949676 - protein, 9 aa, Homo Sapiens
LEELPDEDK

SEQ ID NO: 949677 - protein, 9 aa, Homo Sapiens
SQPVCFDFC

SEQ ID NO: 949678 - protein, 9 aa, Homo Sapiens
HLEDNMLCS

SEQ ID NO: 949679 - protein, 9 aa, Homo Sapiens
AGCSDAQPM

SEQ ID NO: 949680 - protein, 9 aa, Homo Sapiens
ILRKVSKKL

SEQ ID NO: 949681 - protein, 9 aa, Homo Sapiens
LQVLGEKAF

SEQ ID NO: 949682 - protein, 9 aa, Homo Sapiens
IERVDYVKG

SEQ ID NO: 949683 - protein, 9 aa, Homo Sapiens
QKGKKGSGN

SEQ ID NO: 949684 - protein, 9 aa, Homo Sapiens
ENSNNDCFG

SEQ ID NO: 949685 - protein, 9 aa, Homo Sapiens
VTPLAKPKK

SEQ ID NO: 949686 - protein, 9 aa, Homo Sapiens
GMYGKVCKA

SEQ ID NO: 949687 - protein, 9 aa, Homo Sapiens
QRCCQGHCE

SEQ ID NO: 949688 - protein, 9 aa, Homo Sapiens
QLHELTKLS

SEQ ID NO: 949689 - protein, 9 aa, Homo Sapiens
LYTSKLFTP

SEQ ID NO: 949690 - protein, 9 aa, Homo Sapiens
VSWANNSVP

SEQ ID NO: 949691 - protein, 9 aa, Homo Sapiens
GLGILRLYK

SEQ ID NO: 949692 - protein, 9 aa, Homo Sapiens
VSYLGMYLT

SEQ ID NO: 949693 - protein, 9 aa, Homo Sapiens
QLALSNALR

SEQ ID NO: 949694 - protein, 9 aa, Homo Sapiens
SYACAGFCK

SEQ ID NO: 949695 - protein, 9 aa, Homo Sapiens
DRTSPNFLF

SEQ ID NO: 949696 - protein, 9 aa, Homo Sapiens
TADEKIYFQ

SEQ ID NO: 949697 - protein, 9 aa, Homo Sapiens
VLTNLLFAL

SEQ ID NO: 949698 - protein, 9 aa, Homo Sapiens
TIMSGFSNT

SEQ ID NO: 949699 - protein, 9 aa, Homo Sapiens
IFSFCKSQC

SEQ ID NO: 949700 - protein, 9 aa, Homo Sapiens
ECSCTFCEI

SEQ ID NO: 949701 - protein, 9 aa, Homo Sapiens
CCVEDETLG

SEQ ID NO: 949702 - protein, 9 aa, Homo Sapiens
LNGDISFHR

SEQ ID NO: 949703 - protein, 9 aa, Homo Sapiens
YANMYSSTL

SEQ ID NO: 949704 - protein, 9 aa, Homo Sapiens
SLKEIIEEL

SEQ ID NO: 949705 - protein, 9 aa, Homo Sapiens
DINPENEDE

SEQ ID NO: 949706 - protein, 9 aa, Homo Sapiens
QLHGAWPLG

SEQ ID NO: 949707 - protein, 9 aa, Homo Sapiens
AVEKIVNTG

SEQ ID NO: 949708 - protein, 9 aa, Homo Sapiens
EDIISSESS

SEQ ID NO: 949709 - protein, 9 aa, Homo Sapiens
GVFVEYIIF

SEQ ID NO: 949710 - protein, 9 aa, Homo Sapiens
QKICYNKFV

SEQ ID NO: 949711 - protein, 9 aa, Homo Sapiens
SLRPLSPRT

SEQ ID NO: 949712 - protein, 9 aa, Homo Sapiens
TGFLNQGNT

SEQ ID NO: 949713 - protein, 9 aa, Homo Sapiens
YFLSKLVLS

SEQ ID NO: 949714 - protein, 9 aa, Homo Sapiens
RADSPRPED

SEQ ID NO: 949715 - protein, 9 aa, Homo Sapiens
MEFFQPLDG

SEQ ID NO: 949716 - protein, 9 aa, Homo Sapiens
QSLMELPNQ

SEQ ID NO: 949717 - protein, 9 aa, Homo Sapiens
CSSIRITSI

SEQ ID NO: 949718 - protein, 9 aa, Homo Sapiens
ISEGTVQTA

SEQ ID NO: 949719 - protein, 9 aa, Homo Sapiens
FASLTHLNI

SEQ ID NO: 949720 - protein, 9 aa, Homo Sapiens
LSLDVKRMG

SEQ ID NO: 949721 - protein, 9 aa, Homo Sapiens
HHERCNCIC

SEQ ID NO: 949722 - protein, 9 aa, Homo Sapiens
DHHHLHKPH

SEQ ID NO: 949723 - protein, 9 aa, Homo Sapiens
CFSNSATLA

SEQ ID NO: 949724 - protein, 9 aa, Homo Sapiens
CLRILANDG

SEQ ID NO: 949725 - protein, 9 aa, Homo Sapiens
CIQEALREQ

SEQ ID NO: 949726 - protein, 9 aa, Homo Sapiens
ALFCTTLFG

SEQ ID NO: 949727 - protein, 9 aa, Homo Sapiens
TLQMTIWLE

SEQ ID NO: 949728 - protein, 9 aa, Homo Sapiens
SPNFLFMCS

SEQ ID NO: 949729 - protein, 9 aa, Homo Sapiens
KDSEYVFVV

SEQ ID NO: 949730 - protein, 9 aa, Homo Sapiens
QSSSHQGWE

SEQ ID NO: 949731 - protein, 9 aa, Homo Sapiens
TSTIFTSPP

SEQ ID NO: 949732 - protein, 9 aa, Homo Sapiens
GFWMKVEQI

SEQ ID NO: 949733 - protein, 9 aa, Homo Sapiens
RHCVVYTGK

SEQ ID NO: 949734 - protein, 9 aa, Homo Sapiens
GSPSRIWGD

SEQ ID NO: 949735 - protein, 9 aa, Homo Sapiens
LRNQEGPGE

SEQ ID NO: 949736 - protein, 9 aa, Homo Sapiens
RYCGSVHFG

SEQ ID NO: 949737 - protein, 9 aa, Homo Sapiens
PPRLLSGPE

SEQ ID NO: 949738 - protein, 9 aa, Homo Sapiens
QTLLNQPAF

SEQ ID NO: 949739 - protein, 9 aa, Homo Sapiens
QRIQEIKRL

SEQ ID NO: 949740 - protein, 9 aa, Homo Sapiens
LHFAISAGT

SEQ ID NO: 949741 - protein, 9 aa, Homo Sapiens
TTTFRRSRP

SEQ ID NO: 949742 - protein, 9 aa, Homo Sapiens
VGSMEHPAQ

SEQ ID NO: 949743 - protein, 9 aa, Homo Sapiens
PGRDSKIIQ

SEQ ID NO: 949744 - protein, 9 aa, Homo Sapiens
ACPSHDTGQ

SEQ ID NO: 949745 - protein, 9 aa, Homo Sapiens
FAKKIIPSK

SEQ ID NO: 949746 - protein, 9 aa, Homo Sapiens
KEISGVDEH

SEQ ID NO: 949747 - protein, 9 aa, Homo Sapiens
KQQSLIHTN

SEQ ID NO: 949748 - protein, 9 aa, Homo Sapiens
DIPYATMGG

SEQ ID NO: 949749 - protein, 9 aa, Homo Sapiens
NKNLQKEIS

SEQ ID NO: 949750 - protein, 9 aa, Homo Sapiens
SYNKLQKQE

SEQ ID NO: 949751 - protein, 9 aa, Homo Sapiens
EFFLSKSKE

SEQ ID NO: 949752 - protein, 9 aa, Homo Sapiens
ASKVCFEIK

SEQ ID NO: 949753 - protein, 9 aa, Homo Sapiens
LGLGPYVFI

SEQ ID NO: 949754 - protein, 9 aa, Homo Sapiens
ECPTVFLER

SEQ ID NO: 949755 - protein, 9 aa, Homo Sapiens
HRLLKRTSR

SEQ ID NO: 949756 - protein, 9 aa, Homo Sapiens
SILRKHQRI

SEQ ID NO: 949757 - protein, 9 aa, Homo Sapiens
QKILKCMFC

SEQ ID NO: 949758 - protein, 9 aa, Homo Sapiens
RLFFFPAAK

SEQ ID NO: 949759 - protein, 9 aa, Homo Sapiens
TEYTFAFPF

SEQ ID NO: 949760 - protein, 9 aa, Homo Sapiens
HSDTPLHFA

SEQ ID NO: 949761 - protein, 9 aa, Homo Sapiens
QNTQDRYTR

SEQ ID NO: 949762 - protein, 9 aa, Homo Sapiens
ATAPLDFGY

SEQ ID NO: 949763 - protein, 9 aa, Homo Sapiens
MLKGLLPLG

SEQ ID NO: 949764 - protein, 9 aa, Homo Sapiens
LNKSKTIFR

SEQ ID NO: 949765 - protein, 9 aa, Homo Sapiens
GTQSPYGGG

SEQ ID NO: 949766 - protein, 9 aa, Homo Sapiens
QKSGIIKQQ

SEQ ID NO: 949767 - protein, 9 aa, Homo Sapiens
DNSLGEVVM

SEQ ID NO: 949768 - protein, 9 aa, Homo Sapiens
TLSEEFDLL

SEQ ID NO: 949769 - protein, 9 aa, Homo Sapiens
CRKVAERPF

SEQ ID NO: 949770 - protein, 9 aa, Homo Sapiens
SVRPDGCPE

SEQ ID NO: 949771 - protein, 9 aa, Homo Sapiens
TALQICNPA

SEQ ID NO: 949772 - protein, 9 aa, Homo Sapiens
ATGKGCGHR

SEQ ID NO: 949773 - protein, 9 aa, Homo Sapiens
FTPALYIYT

SEQ ID NO: 949774 - protein, 9 aa, Homo Sapiens
LYIAPVTKE

SEQ ID NO: 949775 - protein, 9 aa, Homo Sapiens
VLWHSEFSK

SEQ ID NO: 949776 - protein, 9 aa, Homo Sapiens
ELFMQLLLA

SEQ ID NO: 949777 - protein, 9 aa, Homo Sapiens
SQLAEKKQQ

SEQ ID NO: 949778 - protein, 9 aa, Homo Sapiens
PALSHCFQL

SEQ ID NO: 949779 - protein, 9 aa, Homo Sapiens
CQPLDLKGS

SEQ ID NO: 949780 - protein, 9 aa, Homo Sapiens
MGGVCLVTP

SEQ ID NO: 949781 - protein, 9 aa, Homo Sapiens
MDAAPACVG

SEQ ID NO: 949782 - protein, 9 aa, Homo Sapiens
QFTPTGGFG

SEQ ID NO: 949783 - protein, 9 aa, Homo Sapiens
ELEALSEDN

SEQ ID NO: 949784 - protein, 9 aa, Homo Sapiens
IQAINRVSS

SEQ ID NO: 949785 - protein, 9 aa, Homo Sapiens
NRCEKPIQN

SEQ ID NO: 949786 - protein, 9 aa, Homo Sapiens
TQIADEKQL

SEQ ID NO: 949787 - protein, 9 aa, Homo Sapiens
ENPENNFHD

SEQ ID NO: 949788 - protein, 9 aa, Homo Sapiens
AASSGSPSG

SEQ ID NO: 949789 - protein, 9 aa, Homo Sapiens
KGCGHRLSS

SEQ ID NO: 949790 - protein, 9 aa, Homo Sapiens
VAMGTSGET

SEQ ID NO: 949791 - protein, 9 aa, Homo Sapiens
LLKDRDSKE

SEQ ID NO: 949792 - protein, 9 aa, Homo Sapiens
RETPKQFDV

SEQ ID NO: 949793 - protein, 9 aa, Homo Sapiens
IKVFSLLVF

SEQ ID NO: 949794 - protein, 9 aa, Homo Sapiens
KKNEPGIRS

SEQ ID NO: 949795 - protein, 9 aa, Homo Sapiens
PARGPRAGS

SEQ ID NO: 949796 - protein, 9 aa, Homo Sapiens
GKWTILPDP

SEQ ID NO: 949797 - protein, 9 aa, Homo Sapiens
GLPKLSAEV

SEQ ID NO: 949798 - protein, 9 aa, Homo Sapiens
EIYSPEVDE

SEQ ID NO: 949799 - protein, 9 aa, Homo Sapiens
VQVKPPNGE

SEQ ID NO: 949800 - protein, 9 aa, Homo Sapiens
VLLETQGLM

SEQ ID NO: 949801 - protein, 9 aa, Homo Sapiens
SGSVEDLLS

SEQ ID NO: 949802 - protein, 9 aa, Homo Sapiens
RTLESQLFS

SEQ ID NO: 949803 - protein, 9 aa, Homo Sapiens
HLEKYGKGE

SEQ ID NO: 949804 - protein, 9 aa, Homo Sapiens
QGLKQETVN

SEQ ID NO: 949805 - protein, 9 aa, Homo Sapiens
SAEYFMQEA

SEQ ID NO: 949806 - protein, 9 aa, Homo Sapiens
EPLHPVNNK

SEQ ID NO: 949807 - protein, 9 aa, Homo Sapiens
NNKITYYFP

SEQ ID NO: 949808 - protein, 9 aa, Homo Sapiens
TSLANILKS

SEQ ID NO: 949809 - protein, 9 aa, Homo Sapiens
LSGEDDDAA

SEQ ID NO: 949810 - protein, 9 aa, Homo Sapiens
PELLPCVAM

SEQ ID NO: 949811 - protein, 9 aa, Homo Sapiens
ILPDPRNEC

SEQ ID NO: 949812 - protein, 9 aa, Homo Sapiens
QFASPAGKM

SEQ ID NO: 949813 - protein, 9 aa, Homo Sapiens
VQPNSSVLI

SEQ ID NO: 949814 - protein, 9 aa, Homo Sapiens
QIDKNWYEG

SEQ ID NO: 949815 - protein, 9 aa, Homo Sapiens
PSHGWKEIS

SEQ ID NO: 949816 - protein, 9 aa, Homo Sapiens
GASDAELVQ

SEQ ID NO: 949817 - protein, 9 aa, Homo Sapiens
VGRRENGPQ

SEQ ID NO: 949818 - protein, 9 aa, Homo Sapiens
QVEEQCHLL

SEQ ID NO: 949819 - protein, 9 aa, Homo Sapiens
WGSPWVSVV

SEQ ID NO: 949820 - protein, 9 aa, Homo Sapiens
CPAVIACSF

SEQ ID NO: 949821 - protein, 9 aa, Homo Sapiens
RKRLEVEEL

SEQ ID NO: 949822 - protein, 9 aa, Homo Sapiens
IATNHFETA

SEQ ID NO: 949823 - protein, 9 aa, Homo Sapiens
YLYTSKLFT

SEQ ID NO: 949824 - protein, 9 aa, Homo Sapiens
NSIPNHVVP

SEQ ID NO: 949825 - protein, 9 aa, Homo Sapiens
HLSTLSTVI

SEQ ID NO: 949826 - protein, 9 aa, Homo Sapiens
NIIHYIFDR

SEQ ID NO: 949827 - protein, 9 aa, Homo Sapiens
NVTFRLSKC

SEQ ID NO: 949828 - protein, 9 aa, Homo Sapiens
GGSPCEAGK

SEQ ID NO: 949829 - protein, 9 aa, Homo Sapiens
SKEHIELVV

SEQ ID NO: 949830 - protein, 9 aa, Homo Sapiens
QDTSCLTCR

SEQ ID NO: 949831 - protein, 9 aa, Homo Sapiens
CWLQAQKDK

SEQ ID NO: 949832 - protein, 9 aa, Homo Sapiens
QQFQDLKEK

SEQ ID NO: 949833 - protein, 9 aa, Homo Sapiens
LAWDKSLAP

SEQ ID NO: 949834 - protein, 9 aa, Homo Sapiens
NVYYNKASG

SEQ ID NO: 949835 - protein, 9 aa, Homo Sapiens
AWREDVAFA

SEQ ID NO: 949836 - protein, 9 aa, Homo Sapiens
YPQPLAQVH

SEQ ID NO: 949837 - protein, 9 aa, Homo Sapiens
TVYKKTTPI

SEQ ID NO: 949838 - protein, 9 aa, Homo Sapiens
KEVVDWGLQ

SEQ ID NO: 949839 - protein, 9 aa, Homo Sapiens
WYHPQFTIF

SEQ ID NO: 949840 - protein, 9 aa, Homo Sapiens
GNLAARPPL

SEQ ID NO: 949841 - protein, 9 aa, Homo Sapiens
TNFFRGDCC

SEQ ID NO: 949842 - protein, 9 aa, Homo Sapiens
FRELCIKLD

SEQ ID NO: 949843 - protein, 9 aa, Homo Sapiens
GRRRVFSTC

SEQ ID NO: 949844 - protein, 9 aa, Homo Sapiens
GSCHVFEQG

SEQ ID NO: 949845 - protein, 9 aa, Homo Sapiens
FLEFKVSGI

SEQ ID NO: 949846 - protein, 9 aa, Homo Sapiens
EVFPGAPAG

SEQ ID NO: 949847 - protein, 9 aa, Homo Sapiens
AFIERPKKE

SEQ ID NO: 949848 - protein, 9 aa, Homo Sapiens
RASEEKTVE

SEQ ID NO: 949849 - protein, 9 aa, Homo Sapiens
LRLDVWNGW

SEQ ID NO: 949850 - protein, 9 aa, Homo Sapiens
PTRANTTTI

SEQ ID NO: 949851 - protein, 9 aa, Homo Sapiens
DFFWKLQAT

SEQ ID NO: 949852 - protein, 9 aa, Homo Sapiens
LTQIYVLPE

SEQ ID NO: 949853 - protein, 9 aa, Homo Sapiens
QCYKSGLIL

SEQ ID NO: 949854 - protein, 9 aa, Homo Sapiens
VFATEYTFA

SEQ ID NO: 949855 - protein, 9 aa, Homo Sapiens
LIPEAFLAG

SEQ ID NO: 949856 - protein, 9 aa, Homo Sapiens
KMFGSMFHA

SEQ ID NO: 949857 - protein, 9 aa, Homo Sapiens
LEVELSTAS

SEQ ID NO: 949858 - protein, 9 aa, Homo Sapiens
LGAAAALRV

SEQ ID NO: 949859 - protein, 9 aa, Homo Sapiens
VRQNKSNCR

SEQ ID NO: 949860 - protein, 9 aa, Homo Sapiens
LPLTEKQCV

SEQ ID NO: 949861 - protein, 9 aa, Homo Sapiens
GLLCGQPKV

SEQ ID NO: 949862 - protein, 9 aa, Homo Sapiens
PQRNPVWNV

SEQ ID NO: 949863 - protein, 9 aa, Homo Sapiens
KASGGRYVP

SEQ ID NO: 949864 - protein, 9 aa, Homo Sapiens
ADVNVLPIS

SEQ ID NO: 949865 - protein, 9 aa, Homo Sapiens
GSCDTSPNT

SEQ ID NO: 949866 - protein, 9 aa, Homo Sapiens
KPTSTIFTS

SEQ ID NO: 949867 - protein, 9 aa, Homo Sapiens
RSQLAEKKQ

SEQ ID NO: 949868 - protein, 9 aa, Homo Sapiens
LNTDFFAKK

SEQ ID NO: 949869 - protein, 9 aa, Homo Sapiens
SEIDGLVVG

SEQ ID NO: 949870 - protein, 9 aa, Homo Sapiens
RVHFHPKQT

SEQ ID NO: 949871 - protein, 9 aa, Homo Sapiens
LEVPSDALK

SEQ ID NO: 949872 - protein, 9 aa, Homo Sapiens
SVFQEKTVT

SEQ ID NO: 949873 - protein, 9 aa, Homo Sapiens
YAFPYCDKT

SEQ ID NO: 949874 - protein, 9 aa, Homo Sapiens
ALKKGHRQD

SEQ ID NO: 949875 - protein, 9 aa, Homo Sapiens
CQKVYLRVS

SEQ ID NO: 949876 - protein, 9 aa, Homo Sapiens
GKSQHSTPL

SEQ ID NO: 949877 - protein, 9 aa, Homo Sapiens
VCEREFKPL

SEQ ID NO: 949878 - protein, 9 aa, Homo Sapiens
TTKFLAMDK

SEQ ID NO: 949879 - protein, 9 aa, Homo Sapiens
YAPLHFMND

SEQ ID NO: 949880 - protein, 9 aa, Homo Sapiens
LEEVDYELL

SEQ ID NO: 949881 - protein, 9 aa, Homo Sapiens
PALFSRTSI

SEQ ID NO: 949882 - protein, 9 aa, Homo Sapiens
NVEKILVEV

SEQ ID NO: 949883 - protein, 9 aa, Homo Sapiens
GEEKGNPEK

SEQ ID NO: 949884 - protein, 9 aa, Homo Sapiens
KAGKDVTES

SEQ ID NO: 949885 - protein, 9 aa, Homo Sapiens
WWINGQSLP

SEQ ID NO: 949886 - protein, 9 aa, Homo Sapiens
EIRIQRKKK

SEQ ID NO: 949887 - protein, 9 aa, Homo Sapiens
GAGPQQFRP

SEQ ID NO: 949888 - protein, 9 aa, Homo Sapiens
TGMSLEVPS

SEQ ID NO: 949889 - protein, 9 aa, Homo Sapiens
HPGPSPRPG

SEQ ID NO: 949890 - protein, 9 aa, Homo Sapiens
MPSVLEDLE

SEQ ID NO: 949891 - protein, 9 aa, Homo Sapiens
CRECLEKQK

SEQ ID NO: 949892 - protein, 9 aa, Homo Sapiens
ALQLLVVAS

SEQ ID NO: 949893 - protein, 9 aa, Homo Sapiens
VPMGGVCLV

SEQ ID NO: 949894 - protein, 9 aa, Homo Sapiens
FEPGPPAAA

SEQ ID NO: 949895 - protein, 9 aa, Homo Sapiens
EGSVRSATV

SEQ ID NO: 949896 - protein, 9 aa, Homo Sapiens
LNQPAFSSI

SEQ ID NO: 949897 - protein, 9 aa, Homo Sapiens
LGDPFIIIY

SEQ ID NO: 949898 - protein, 9 aa, Homo Sapiens
PEAKHDYRP

SEQ ID NO: 949899 - protein, 9 aa, Homo Sapiens
LTALQICNP

SEQ ID NO: 949900 - protein, 9 aa, Homo Sapiens
DFPDFSSQS

SEQ ID NO: 949901 - protein, 9 aa, Homo Sapiens
KCQLPKDVD

SEQ ID NO: 949902 - protein, 9 aa, Homo Sapiens
QRLQGHLEK

SEQ ID NO: 949903 - protein, 9 aa, Homo Sapiens
EKSKSPFPP

SEQ ID NO: 949904 - protein, 9 aa, Homo Sapiens
GSVRSATVP

SEQ ID NO: 949905 - protein, 9 aa, Homo Sapiens
GFQLRYESI

SEQ ID NO: 949906 - protein, 9 aa, Homo Sapiens
ESSLLVLRH

SEQ ID NO: 949907 - protein, 9 aa, Homo Sapiens
ASEKEINPH

SEQ ID NO: 949908 - protein, 9 aa, Homo Sapiens
LTHRARLRR

SEQ ID NO: 949909 - protein, 9 aa, Homo Sapiens
FPKTENFCA

SEQ ID NO: 949910 - protein, 9 aa, Homo Sapiens
VYSQLPLES

SEQ ID NO: 949911 - protein, 9 aa, Homo Sapiens
AHYYHHHCI

SEQ ID NO: 949912 - protein, 9 aa, Homo Sapiens
INKDPDLPS

SEQ ID NO: 949913 - protein, 9 aa, Homo Sapiens
EELEKARDI

SEQ ID NO: 949914 - protein, 9 aa, Homo Sapiens
HETLQYHVQ

SEQ ID NO: 949915 - protein, 9 aa, Homo Sapiens
RVSPGSTSS

SEQ ID NO: 949916 - protein, 9 aa, Homo Sapiens
AAKSEQSCR

SEQ ID NO: 949917 - protein, 9 aa, Homo Sapiens
PLAKPKKRF

SEQ ID NO: 949918 - protein, 9 aa, Homo Sapiens
TEENPMEVF

SEQ ID NO: 949919 - protein, 9 aa, Homo Sapiens
PLRGRYPGK

SEQ ID NO: 949920 - protein, 9 aa, Homo Sapiens
TNGQPQTQP

SEQ ID NO: 949921 - protein, 9 aa, Homo Sapiens
ENCGQQKDE

SEQ ID NO: 949922 - protein, 9 aa, Homo Sapiens
DHWEEMKKT

SEQ ID NO: 949923 - protein, 9 aa, Homo Sapiens
LNWEFARMI

SEQ ID NO: 949924 - protein, 9 aa, Homo Sapiens
NYTEKKTYR

SEQ ID NO: 949925 - protein, 9 aa, Homo Sapiens
EKEINPHTW

SEQ ID NO: 949926 - protein, 9 aa, Homo Sapiens
QATGMSLEV

SEQ ID NO: 949927 - protein, 9 aa, Homo Sapiens
PWPPSSLPW

SEQ ID NO: 949928 - protein, 9 aa, Homo Sapiens
TSLGIVLII

SEQ ID NO: 949929 - protein, 9 aa, Homo Sapiens
APLWAPPFP

SEQ ID NO: 949930 - protein, 9 aa, Homo Sapiens
NLQAVPSVS

SEQ ID NO: 949931 - protein, 9 aa, Homo Sapiens
DFLSQMEKQ

SEQ ID NO: 949932 - protein, 9 aa, Homo Sapiens
IILVSSANK

SEQ ID NO: 949933 - protein, 9 aa, Homo Sapiens
VRNSRKNFA

SEQ ID NO: 949934 - protein, 9 aa, Homo Sapiens
KEAPTEYAF

SEQ ID NO: 949935 - protein, 9 aa, Homo Sapiens
ECYDSRTQQ

SEQ ID NO: 949936 - protein, 9 aa, Homo Sapiens
KKKEKEGEG

SEQ ID NO: 949937 - protein, 9 aa, Homo Sapiens
KPLCGHKCL

SEQ ID NO: 949938 - protein, 9 aa, Homo Sapiens
HNGLLCDVL

SEQ ID NO: 949939 - protein, 9 aa, Homo Sapiens
SIGGPGGTE

SEQ ID NO: 949940 - protein, 9 aa, Homo Sapiens
CPNCFFLFS

SEQ ID NO: 949941 - protein, 9 aa, Homo Sapiens
DREPFANAI

SEQ ID NO: 949942 - protein, 9 aa, Homo Sapiens
SSAVSPNLS

SEQ ID NO: 949943 - protein, 9 aa, Homo Sapiens
KFLAMDKVA

SEQ ID NO: 949944 - protein, 9 aa, Homo Sapiens
TAKFIPWEE

SEQ ID NO: 949945 - protein, 9 aa, Homo Sapiens
RKTKVFHPV

SEQ ID NO: 949946 - protein, 9 aa, Homo Sapiens
RTSSFLLYS

SEQ ID NO: 949947 - protein, 9 aa, Homo Sapiens
FVLDKLLFH

SEQ ID NO: 949948 - protein, 9 aa, Homo Sapiens
TLEPFAAEA

SEQ ID NO: 949949 - protein, 9 aa, Homo Sapiens
LCSKCVHRN

SEQ ID NO: 949950 - protein, 9 aa, Homo Sapiens
IRCSSCCLL

SEQ ID NO: 949951 - protein, 9 aa, Homo Sapiens
YQSYLMVLQ

SEQ ID NO: 949952 - protein, 9 aa, Homo Sapiens
VFDAGDYFL

SEQ ID NO: 949953 - protein, 9 aa, Homo Sapiens
LSPGGATTS

SEQ ID NO: 949954 - protein, 9 aa, Homo Sapiens
YSPIFDQWT

SEQ ID NO: 949955 - protein, 9 aa, Homo Sapiens
SIIKERIFQ

SEQ ID NO: 949956 - protein, 9 aa, Homo Sapiens
GNGVVEVPF

SEQ ID NO: 949957 - protein, 9 aa, Homo Sapiens
DSLQQLTVH

SEQ ID NO: 949958 - protein, 9 aa, Homo Sapiens
YEIPDTQIA

SEQ ID NO: 949959 - protein, 9 aa, Homo Sapiens
ASLVRAQTC

SEQ ID NO: 949960 - protein, 9 aa, Homo Sapiens
TVLPEDIIS

SEQ ID NO: 949961 - protein, 9 aa, Homo Sapiens
SWAPECREK

SEQ ID NO: 949962 - protein, 9 aa, Homo Sapiens
EGGGSGGGK

SEQ ID NO: 949963 - protein, 9 aa, Homo Sapiens
VRFPGFILD

SEQ ID NO: 949964 - protein, 9 aa, Homo Sapiens
IPDSLGGSF

SEQ ID NO: 949965 - protein, 9 aa, Homo Sapiens
CDKTSSVPK

SEQ ID NO: 949966 - protein, 9 aa, Homo Sapiens
FHVSLLLIA

SEQ ID NO: 949967 - protein, 9 aa, Homo Sapiens
LLRANTDVF

SEQ ID NO: 949968 - protein, 9 aa, Homo Sapiens
DWGLVLMPG

SEQ ID NO: 949969 - protein, 9 aa, Homo Sapiens
YAILSKQPE

SEQ ID NO: 949970 - protein, 9 aa, Homo Sapiens
SRSSKDSRF

SEQ ID NO: 949971 - protein, 9 aa, Homo Sapiens
ELFPTMTLL

SEQ ID NO: 949972 - protein, 9 aa, Homo Sapiens
PGARGSPGD

SEQ ID NO: 949973 - protein, 9 aa, Homo Sapiens
LSPGASDAE

SEQ ID NO: 949974 - protein, 9 aa, Homo Sapiens
GKAFAESWN

SEQ ID NO: 949975 - protein, 9 aa, Homo Sapiens
DPALQPPGR

SEQ ID NO: 949976 - protein, 9 aa, Homo Sapiens
AEYVITKFG

SEQ ID NO: 949977 - protein, 9 aa, Homo Sapiens
RNKKQSGDG

SEQ ID NO: 949978 - protein, 9 aa, Homo Sapiens
GKSRRNLSD

SEQ ID NO: 949979 - protein, 9 aa, Homo Sapiens
GFTRKYLLS

SEQ ID NO: 949980 - protein, 9 aa, Homo Sapiens
DLFFSRSKL

SEQ ID NO: 949981 - protein, 9 aa, Homo Sapiens
CEILAVIKL

SEQ ID NO: 949982 - protein, 9 aa, Homo Sapiens
GSHYKYKTK

SEQ ID NO: 949983 - protein, 9 aa, Homo Sapiens
FCYDTQLSL

SEQ ID NO: 949984 - protein, 9 aa, Homo Sapiens
LCALSQFEG

SEQ ID NO: 949985 - protein, 9 aa, Homo Sapiens
KLRSQLAEK

SEQ ID NO: 949986 - protein, 9 aa, Homo Sapiens
PWRDYISIC

SEQ ID NO: 949987 - protein, 9 aa, Homo Sapiens
KKKLDYFAK

SEQ ID NO: 949988 - protein, 9 aa, Homo Sapiens
IPFQGKLKP

SEQ ID NO: 949989 - protein, 9 aa, Homo Sapiens
NGHLFVLRS

SEQ ID NO: 949990 - protein, 9 aa, Homo Sapiens
DNQVALLRA

SEQ ID NO: 949991 - protein, 9 aa, Homo Sapiens
SLAGGLLTG

SEQ ID NO: 949992 - protein, 9 aa, Homo Sapiens
RIQEIKRLS

SEQ ID NO: 949993 - protein, 9 aa, Homo Sapiens
ARILPAPQL

SEQ ID NO: 949994 - protein, 9 aa, Homo Sapiens
VQFTPTGGF

SEQ ID NO: 949995 - protein, 9 aa, Homo Sapiens
SDRTSPNFL

SEQ ID NO: 949996 - protein, 9 aa, Homo Sapiens
VEKNYTEKK

SEQ ID NO: 949997 - protein, 9 aa, Homo Sapiens
IEGLKGFLQ

SEQ ID NO: 949998 - protein, 9 aa, Homo Sapiens
YAALATGTF

SEQ ID NO: 949999 - protein, 9 aa, Homo Sapiens
GNCGEILDK

SEQ ID NO: 950000 - protein, 9 aa, Homo Sapiens
KRTEESLPI

SEQ ID NO: 950001 - protein, 9 aa, Homo Sapiens
CYDNFLQSR

SEQ ID NO: 950002 - protein, 9 aa, Homo Sapiens
DTLSQHGIY

SEQ ID NO: 950003 - protein, 9 aa, Homo Sapiens
TYTLDHFET

SEQ ID NO: 950004 - protein, 9 aa, Homo Sapiens
CAYKNQKKI

SEQ ID NO: 950005 - protein, 9 aa, Homo Sapiens
SKLVQVDYM

SEQ ID NO: 950006 - protein, 9 aa, Homo Sapiens
ETEFMELDG

SEQ ID NO: 950007 - protein, 9 aa, Homo Sapiens
VLLLPLDEL

SEQ ID NO: 950008 - protein, 9 aa, Homo Sapiens
KDVRQKLKN

SEQ ID NO: 950009 - protein, 9 aa, Homo Sapiens
KEAHPSDGW

SEQ ID NO: 950010 - protein, 9 aa, Homo Sapiens
FCQSLKGLR

SEQ ID NO: 950011 - protein, 9 aa, Homo Sapiens
HLFVLRSLD

SEQ ID NO: 950012 - protein, 9 aa, Homo Sapiens
AIVDIFYAS

SEQ ID NO: 950013 - protein, 9 aa, Homo Sapiens
NKTMCKTTL

SEQ ID NO: 950014 - protein, 9 aa, Homo Sapiens
LSFQKGDQI

SEQ ID NO: 950015 - protein, 9 aa, Homo Sapiens
MQEEETRKL

SEQ ID NO: 950016 - protein, 9 aa, Homo Sapiens
KKKKEKEGE

SEQ ID NO: 950017 - protein, 9 aa, Homo Sapiens
ALEVFPGAP

SEQ ID NO: 950018 - protein, 9 aa, Homo Sapiens
LAKTLQKIF

SEQ ID NO: 950019 - protein, 9 aa, Homo Sapiens
VSLMCNVKE

SEQ ID NO: 950020 - protein, 9 aa, Homo Sapiens
SFSIIAVFY

SEQ ID NO: 950021 - protein, 9 aa, Homo Sapiens
VGKKRSTIM

SEQ ID NO: 950022 - protein, 9 aa, Homo Sapiens
QKKKQSMSR

SEQ ID NO: 950023 - protein, 9 aa, Homo Sapiens
KYKECKDLI

SEQ ID NO: 950024 - protein, 9 aa, Homo Sapiens
KWPNNIYYS

SEQ ID NO: 950025 - protein, 9 aa, Homo Sapiens
FFKPSEHVK

SEQ ID NO: 950026 - protein, 9 aa, Homo Sapiens
TVSVAEPFF

SEQ ID NO: 950027 - protein, 9 aa, Homo Sapiens
LSILRSGPT

SEQ ID NO: 950028 - protein, 9 aa, Homo Sapiens
VAVNGAHLQ

SEQ ID NO: 950029 - protein, 9 aa, Homo Sapiens
CALGWTGFS

SEQ ID NO: 950030 - protein, 9 aa, Homo Sapiens
TIAMRGSQP

SEQ ID NO: 950031 - protein, 9 aa, Homo Sapiens
ADGVLHIDT

SEQ ID NO: 950032 - protein, 9 aa, Homo Sapiens
RWLWEGSLS

SEQ ID NO: 950033 - protein, 9 aa, Homo Sapiens
ATWFIMVVA

SEQ ID NO: 950034 - protein, 9 aa, Homo Sapiens
HLINPEYVP

SEQ ID NO: 950035 - protein, 9 aa, Homo Sapiens
VGGLFGKYI

SEQ ID NO: 950036 - protein, 9 aa, Homo Sapiens
LPWIYAAYP

SEQ ID NO: 950037 - protein, 9 aa, Homo Sapiens
VKSTTIAMR

SEQ ID NO: 950038 - protein, 9 aa, Homo Sapiens
QLNASDWLN

SEQ ID NO: 950039 - protein, 9 aa, Homo Sapiens
VTYACKSSY

SEQ ID NO: 950040 - protein, 9 aa, Homo Sapiens
DKCETDFYN

SEQ ID NO: 950041 - protein, 9 aa, Homo Sapiens
FLLCSGPSE

SEQ ID NO: 950042 - protein, 9 aa, Homo Sapiens
PREAEGYPD

SEQ ID NO: 950043 - protein, 9 aa, Homo Sapiens
LQGHLEKYG

SEQ ID NO: 950044 - protein, 9 aa, Homo Sapiens
VKFNGVYQS

SEQ ID NO: 950045 - protein, 9 aa, Homo Sapiens
FLETSDRTS

SEQ ID NO: 950046 - protein, 9 aa, Homo Sapiens
CFTEIPSDV

SEQ ID NO: 950047 - protein, 9 aa, Homo Sapiens
IKNGKLICT

SEQ ID NO: 950048 - protein, 9 aa, Homo Sapiens
CEENQNRFE

SEQ ID NO: 950049 - protein, 9 aa, Homo Sapiens
VRCYPGFDL

SEQ ID NO: 950050 - protein, 9 aa, Homo Sapiens
STSVQVKGT

SEQ ID NO: 950051 - protein, 9 aa, Homo Sapiens
KTNPVVETH

SEQ ID NO: 950052 - protein, 9 aa, Homo Sapiens
ACLKIFMTE

SEQ ID NO: 950053 - protein, 9 aa, Homo Sapiens
QKPKKSCVC

SEQ ID NO: 950054 - protein, 9 aa, Homo Sapiens
LGNLTIITF

SEQ ID NO: 950055 - protein, 9 aa, Homo Sapiens
NVHFFTGAF

SEQ ID NO: 950056 - protein, 9 aa, Homo Sapiens
SLPSSGKSS

SEQ ID NO: 950057 - protein, 9 aa, Homo Sapiens
KEKSKSPFP

SEQ ID NO: 950058 - protein, 9 aa, Homo Sapiens
PHKVSSYED

SEQ ID NO: 950059 - protein, 9 aa, Homo Sapiens
QSPYGGGTM

SEQ ID NO: 950060 - protein, 9 aa, Homo Sapiens
KPDQFTYTL

SEQ ID NO: 950061 - protein, 9 aa, Homo Sapiens
LERLFDKTH

SEQ ID NO: 950062 - protein, 9 aa, Homo Sapiens
LLQSSPCPS

SEQ ID NO: 950063 - protein, 9 aa, Homo Sapiens
DVTDLLADL

SEQ ID NO: 950064 - protein, 9 aa, Homo Sapiens
PKSPKPTAP

SEQ ID NO: 950065 - protein, 9 aa, Homo Sapiens
KDFSGQHNS

SEQ ID NO: 950066 - protein, 9 aa, Homo Sapiens
LLWEAEATS

SEQ ID NO: 950067 - protein, 9 aa, Homo Sapiens
GIPEFPGNG

SEQ ID NO: 950068 - protein, 9 aa, Homo Sapiens
APRGGLFLP

SEQ ID NO: 950069 - protein, 9 aa, Homo Sapiens
GTDDITIDK

SEQ ID NO: 950070 - protein, 9 aa, Homo Sapiens
LRTSSFLLY

SEQ ID NO: 950071 - protein, 9 aa, Homo Sapiens
EMPGERGAA

SEQ ID NO: 950072 - protein, 9 aa, Homo Sapiens
QLDCLGLCF

SEQ ID NO: 950073 - protein, 9 aa, Homo Sapiens
FDFCCIDQS

SEQ ID NO: 950074 - protein, 9 aa, Homo Sapiens
ESPRSPEKE

SEQ ID NO: 950075 - protein, 9 aa, Homo Sapiens
KDAAVNCTD

SEQ ID NO: 950076 - protein, 9 aa, Homo Sapiens
NCTALIVSH

SEQ ID NO: 950077 - protein, 9 aa, Homo Sapiens
QESPKATGG

SEQ ID NO: 950078 - protein, 9 aa, Homo Sapiens
FMDQTESLF

SEQ ID NO: 950079 - protein, 9 aa, Homo Sapiens
LTQHQRLYT

SEQ ID NO: 950080 - protein, 9 aa, Homo Sapiens
APSSFSKVP

SEQ ID NO: 950081 - protein, 9 aa, Homo Sapiens
KGHRQDGEG

SEQ ID NO: 950082 - protein, 9 aa, Homo Sapiens
TTLSGPRTQ

SEQ ID NO: 950083 - protein, 9 aa, Homo Sapiens
SFLNKHRRF

SEQ ID NO: 950084 - protein, 9 aa, Homo Sapiens
HFSRNSSST

SEQ ID NO: 950085 - protein, 9 aa, Homo Sapiens
AGRDITELF

SEQ ID NO: 950086 - protein, 9 aa, Homo Sapiens
ISALQNTGH

SEQ ID NO: 950087 - protein, 9 aa, Homo Sapiens
HGITPGKMG

SEQ ID NO: 950088 - protein, 9 aa, Homo Sapiens
TGLERFTDS

SEQ ID NO: 950089 - protein, 9 aa, Homo Sapiens
RSPEWMDFI

SEQ ID NO: 950090 - protein, 9 aa, Homo Sapiens
QLSWKLQEL

SEQ ID NO: 950091 - protein, 9 aa, Homo Sapiens
GTHGPFCDQ

SEQ ID NO: 950092 - protein, 9 aa, Homo Sapiens
GNKDLNRNK

SEQ ID NO: 950093 - protein, 9 aa, Homo Sapiens
LRYSVRQNK

SEQ ID NO: 950094 - protein, 9 aa, Homo Sapiens
TTKIPLIGL

SEQ ID NO: 950095 - protein, 9 aa, Homo Sapiens
LRGKGRANG

SEQ ID NO: 950096 - protein, 9 aa, Homo Sapiens
KPSPSASPP

SEQ ID NO: 950097 - protein, 9 aa, Homo Sapiens
EDNSLGEVV

SEQ ID NO: 950098 - protein, 9 aa, Homo Sapiens
GKKEEKFSD

SEQ ID NO: 950099 - protein, 9 aa, Homo Sapiens
IHRQNEYPF

SEQ ID NO: 950100 - protein, 9 aa, Homo Sapiens
EKKGKAGNV

SEQ ID NO: 950101 - protein, 9 aa, Homo Sapiens
ILFAAWASG

SEQ ID NO: 950102 - protein, 9 aa, Homo Sapiens
TKKVNLDSC

SEQ ID NO: 950103 - protein, 9 aa, Homo Sapiens
PLHDLASLS

SEQ ID NO: 950104 - protein, 9 aa, Homo Sapiens
DRDSKEIEW

SEQ ID NO: 950105 - protein, 9 aa, Homo Sapiens
GVQSFDEKE

SEQ ID NO: 950106 - protein, 9 aa, Homo Sapiens
IVSETKLKE

SEQ ID NO: 950107 - protein, 9 aa, Homo Sapiens
SVACSYLSS

SEQ ID NO: 950108 - protein, 9 aa, Homo Sapiens
PTPSLASAP

SEQ ID NO: 950109 - protein, 9 aa, Homo Sapiens
GYEMNLNAG

SEQ ID NO: 950110 - protein, 9 aa, Homo Sapiens
LRTYFSEGM

SEQ ID NO: 950111 - protein, 9 aa, Homo Sapiens
EKIYFQHTA

SEQ ID NO: 950112 - protein, 9 aa, Homo Sapiens
GSRTSESPL

SEQ ID NO: 950113 - protein, 9 aa, Homo Sapiens
WSQKKKTGE

SEQ ID NO: 950114 - protein, 9 aa, Homo Sapiens
LSQMEKQSA

SEQ ID NO: 950115 - protein, 9 aa, Homo Sapiens
NGTQNYIPA

SEQ ID NO: 950116 - protein, 9 aa, Homo Sapiens
ARKRSSTME

SEQ ID NO: 950117 - protein, 9 aa, Homo Sapiens
MRCKENESF

SEQ ID NO: 950118 - protein, 9 aa, Homo Sapiens
HWPQYLPLW

SEQ ID NO: 950119 - protein, 9 aa, Homo Sapiens
ELEISPTIK

SEQ ID NO: 950120 - protein, 9 aa, Homo Sapiens
PLLALPPVR

SEQ ID NO: 950121 - protein, 9 aa, Homo Sapiens
CSSCCLLSP

SEQ ID NO: 950122 - protein, 9 aa, Homo Sapiens
EKQKEQCSL

SEQ ID NO: 950123 - protein, 9 aa, Homo Sapiens
LKRDAHSLF

SEQ ID NO: 950124 - protein, 9 aa, Homo Sapiens
NTNNDGKLS

SEQ ID NO: 950125 - protein, 9 aa, Homo Sapiens
GEIHQNKSV

SEQ ID NO: 950126 - protein, 9 aa, Homo Sapiens
DPYPEVLNQ

SEQ ID NO: 950127 - protein, 9 aa, Homo Sapiens
WPPSSLPWM

SEQ ID NO: 950128 - protein, 9 aa, Homo Sapiens
ANKTKLKIT

SEQ ID NO: 950129 - protein, 9 aa, Homo Sapiens
ICSYFPQDL

SEQ ID NO: 950130 - protein, 9 aa, Homo Sapiens
LDYEAGEIL

SEQ ID NO: 950131 - protein, 9 aa, Homo Sapiens
GLGPYVFIA

SEQ ID NO: 950132 - protein, 9 aa, Homo Sapiens
KIKEALLSI

SEQ ID NO: 950133 - protein, 9 aa, Homo Sapiens
INPEKGDIV

SEQ ID NO: 950134 - protein, 9 aa, Homo Sapiens
GSDVSVKML

SEQ ID NO: 950135 - protein, 9 aa, Homo Sapiens
ELGHLQNNM

SEQ ID NO: 950136 - protein, 9 aa, Homo Sapiens
RPFGEMGSP

SEQ ID NO: 950137 - protein, 9 aa, Homo Sapiens
FVEEALKKL

SEQ ID NO: 950138 - protein, 9 aa, Homo Sapiens
LRCISKMNR

SEQ ID NO: 950139 - protein, 9 aa, Homo Sapiens
TLVSELIKE

SEQ ID NO: 950140 - protein, 9 aa, Homo Sapiens
EGHFSRVTT

SEQ ID NO: 950141 - protein, 9 aa, Homo Sapiens
QEMVCVLLL

SEQ ID NO: 950142 - protein, 9 aa, Homo Sapiens
FFQNLGFIL

SEQ ID NO: 950143 - protein, 9 aa, Homo Sapiens
FFHSLKNSE

SEQ ID NO: 950144 - protein, 9 aa, Homo Sapiens
GEVLKVRNK

SEQ ID NO: 950145 - protein, 9 aa, Homo Sapiens
SAMVNSNNN

SEQ ID NO: 950146 - protein, 9 aa, Homo Sapiens
FIASAPGKC

SEQ ID NO: 950147 - protein, 9 aa, Homo Sapiens
LTHLNIRGN

SEQ ID NO: 950148 - protein, 9 aa, Homo Sapiens
KLFTPECKF

SEQ ID NO: 950149 - protein, 9 aa, Homo Sapiens
KERKRKLEN

SEQ ID NO: 950150 - protein, 9 aa, Homo Sapiens
MTPKDDIQL

SEQ ID NO: 950151 - protein, 9 aa, Homo Sapiens
LDKNLGPRN

SEQ ID NO: 950152 - protein, 9 aa, Homo Sapiens
PSTLSYYKK

SEQ ID NO: 950153 - protein, 9 aa, Homo Sapiens
DCRCLSGFS

SEQ ID NO: 950154 - protein, 9 aa, Homo Sapiens
YLVGRRLAG

SEQ ID NO: 950155 - protein, 9 aa, Homo Sapiens
QFSWLIMNE

SEQ ID NO: 950156 - protein, 9 aa, Homo Sapiens
SNKVMYVRV

SEQ ID NO: 950157 - protein, 9 aa, Homo Sapiens
EFLLGFILH

SEQ ID NO: 950158 - protein, 9 aa, Homo Sapiens
SLGEVVMRV

SEQ ID NO: 950159 - protein, 9 aa, Homo Sapiens
SKPELPQNG

SEQ ID NO: 950160 - protein, 9 aa, Homo Sapiens
RQKQPRLPP

SEQ ID NO: 950161 - protein, 9 aa, Homo Sapiens
IGFFCIISV

SEQ ID NO: 950162 - protein, 9 aa, Homo Sapiens
AKGNGCCLM

SEQ ID NO: 950163 - protein, 9 aa, Homo Sapiens
ASSGSPSGS

SEQ ID NO: 950164 - protein, 9 aa, Homo Sapiens
QLESWGYNG

SEQ ID NO: 950165 - protein, 9 aa, Homo Sapiens
LNRGSPSRI

SEQ ID NO: 950166 - protein, 9 aa, Homo Sapiens
TLPLEVELS

SEQ ID NO: 950167 - protein, 9 aa, Homo Sapiens
HRERLFQLE

SEQ ID NO: 950168 - protein, 9 aa, Homo Sapiens
RQRRTWRDR

SEQ ID NO: 950169 - protein, 9 aa, Homo Sapiens
PRVLTLSEI

SEQ ID NO: 950170 - protein, 9 aa, Homo Sapiens
VCNSDSPCY

SEQ ID NO: 950171 - protein, 9 aa, Homo Sapiens
RPSSYKWTH

SEQ ID NO: 950172 - protein, 9 aa, Homo Sapiens
FRGGRPGLS

SEQ ID NO: 950173 - protein, 9 aa, Homo Sapiens
WGVYSANLF

SEQ ID NO: 950174 - protein, 9 aa, Homo Sapiens
FQNITEENP

SEQ ID NO: 950175 - protein, 9 aa, Homo Sapiens
GITPGKMGT

SEQ ID NO: 950176 - protein, 9 aa, Homo Sapiens
LIMAHSFTQ

SEQ ID NO: 950177 - protein, 9 aa, Homo Sapiens
QFSMESPLA

SEQ ID NO: 950178 - protein, 9 aa, Homo Sapiens
NVEPVVLSE

SEQ ID NO: 950179 - protein, 9 aa, Homo Sapiens
PSLLQSSPC

SEQ ID NO: 950180 - protein, 9 aa, Homo Sapiens
FKTFNVPAM

SEQ ID NO: 950181 - protein, 9 aa, Homo Sapiens
PSKLKRFYS

SEQ ID NO: 950182 - protein, 9 aa, Homo Sapiens
TCLDYENEK

SEQ ID NO: 950183 - protein, 9 aa, Homo Sapiens
ENKSDNENG

SEQ ID NO: 950184 - protein, 9 aa, Homo Sapiens
AKVAQSPRY

SEQ ID NO: 950185 - protein, 9 aa, Homo Sapiens
RELFRKRRE

SEQ ID NO: 950186 - protein, 9 aa, Homo Sapiens
GLVSCEHEG

SEQ ID NO: 950187 - protein, 9 aa, Homo Sapiens
LDCWKRKRT

SEQ ID NO: 950188 - protein, 9 aa, Homo Sapiens
SLTSEDFPD

SEQ ID NO: 950189 - protein, 9 aa, Homo Sapiens
QRLRKDVSR

SEQ ID NO: 950190 - protein, 9 aa, Homo Sapiens
IYYASKNMR

SEQ ID NO: 950191 - protein, 9 aa, Homo Sapiens
DFIKTTLNQ

SEQ ID NO: 950192 - protein, 9 aa, Homo Sapiens
IPEAFLAGM

SEQ ID NO: 950193 - protein, 9 aa, Homo Sapiens
LALCFPSPG

SEQ ID NO: 950194 - protein, 9 aa, Homo Sapiens
KVEKLNMLS

SEQ ID NO: 950195 - protein, 9 aa, Homo Sapiens
AKPPVICSY

SEQ ID NO: 950196 - protein, 9 aa, Homo Sapiens
EMKWVKQYA

SEQ ID NO: 950197 - protein, 9 aa, Homo Sapiens
LKRTSRPAS

SEQ ID NO: 950198 - protein, 9 aa, Homo Sapiens
INYETFTIK

SEQ ID NO: 950199 - protein, 9 aa, Homo Sapiens
YDQQIGQKV

SEQ ID NO: 950200 - protein, 9 aa, Homo Sapiens
KECCRFFGD

SEQ ID NO: 950201 - protein, 9 aa, Homo Sapiens
IDAIQRTEE

SEQ ID NO: 950202 - protein, 9 aa, Homo Sapiens
KIDVRPCPL

SEQ ID NO: 950203 - protein, 9 aa, Homo Sapiens
NNSVPKNQK

SEQ ID NO: 950204 - protein, 9 aa, Homo Sapiens
ALLVGVGES

SEQ ID NO: 950205 - protein, 9 aa, Homo Sapiens
NLSARHQVH

SEQ ID NO: 950206 - protein, 9 aa, Homo Sapiens
VEVLPQYVD

SEQ ID NO: 950207 - protein, 9 aa, Homo Sapiens
FYRNRDRYF

SEQ ID NO: 950208 - protein, 9 aa, Homo Sapiens
ILVMMSYNR

SEQ ID NO: 950209 - protein, 9 aa, Homo Sapiens
PHSGQGFGE

SEQ ID NO: 950210 - protein, 9 aa, Homo Sapiens
SDGKFLRTS

SEQ ID NO: 950211 - protein, 9 aa, Homo Sapiens
VVQAAGSGG

SEQ ID NO: 950212 - protein, 9 aa, Homo Sapiens
REDEAKICH

SEQ ID NO: 950213 - protein, 9 aa, Homo Sapiens
LGVKRNIPL

SEQ ID NO: 950214 - protein, 9 aa, Homo Sapiens
YVGRRENGP

SEQ ID NO: 950215 - protein, 9 aa, Homo Sapiens
LTKLSAFVR

SEQ ID NO: 950216 - protein, 9 aa, Homo Sapiens
GIEGGAQKG

SEQ ID NO: 950217 - protein, 9 aa, Homo Sapiens
LKTWEKVLQ

SEQ ID NO: 950218 - protein, 9 aa, Homo Sapiens
LYSQKGLNS

SEQ ID NO: 950219 - protein, 9 aa, Homo Sapiens
DHNEMVIVK

SEQ ID NO: 950220 - protein, 9 aa, Homo Sapiens
ASLLEEVDY

SEQ ID NO: 950221 - protein, 9 aa, Homo Sapiens
LFSHRNSSK

SEQ ID NO: 950222 - protein, 9 aa, Homo Sapiens
DSGEHTNVC

SEQ ID NO: 950223 - protein, 9 aa, Homo Sapiens
IQPALPTKR

SEQ ID NO: 950224 - protein, 9 aa, Homo Sapiens
AFALSILRS

SEQ ID NO: 950225 - protein, 9 aa, Homo Sapiens
SIVGILTII

SEQ ID NO: 950226 - protein, 9 aa, Homo Sapiens
KEKEGEGKK

SEQ ID NO: 950227 - protein, 9 aa, Homo Sapiens
TLPPAVLHS

SEQ ID NO: 950228 - protein, 9 aa, Homo Sapiens
HPALDANEA

SEQ ID NO: 950229 - protein, 9 aa, Homo Sapiens
NTVEDIKSL

SEQ ID NO: 950230 - protein, 9 aa, Homo Sapiens
LSKKAPREH

SEQ ID NO: 950231 - protein, 9 aa, Homo Sapiens
SGFTDKKET

SEQ ID NO: 950232 - protein, 9 aa, Homo Sapiens
GKKTPRGRR

SEQ ID NO: 950233 - protein, 9 aa, Homo Sapiens
GSREGLFKE

SEQ ID NO: 950234 - protein, 9 aa, Homo Sapiens
NLPPFTGCG

SEQ ID NO: 950235 - protein, 9 aa, Homo Sapiens
HYKYKTKVV

SEQ ID NO: 950236 - protein, 9 aa, Homo Sapiens
MLNRGSPSR

SEQ ID NO: 950237 - protein, 9 aa, Homo Sapiens
GSVTEPGFE

SEQ ID NO: 950238 - protein, 9 aa, Homo Sapiens
SHDTGQPRA

SEQ ID NO: 950239 - protein, 9 aa, Homo Sapiens
DKTEGCRSD

SEQ ID NO: 950240 - protein, 9 aa, Homo Sapiens
IKVLEQDMA

SEQ ID NO: 950241 - protein, 9 aa, Homo Sapiens
KLLPLIPVL

SEQ ID NO: 950242 - protein, 9 aa, Homo Sapiens
EEELPEETV

SEQ ID NO: 950243 - protein, 9 aa, Homo Sapiens
ITDLSRGVF

SEQ ID NO: 950244 - protein, 9 aa, Homo Sapiens
LPKQKEKLW

SEQ ID NO: 950245 - protein, 9 aa, Homo Sapiens
FHDFPDFGQ

SEQ ID NO: 950246 - protein, 9 aa, Homo Sapiens
YCDKTSSVP

SEQ ID NO: 950247 - protein, 9 aa, Homo Sapiens
VIACSFPGI

SEQ ID NO: 950248 - protein, 9 aa, Homo Sapiens
ELLKDRDSK

SEQ ID NO: 950249 - protein, 9 aa, Homo Sapiens
MKICKKRSL

SEQ ID NO: 950250 - protein, 9 aa, Homo Sapiens
AALNRDFRI

SEQ ID NO: 950251 - protein, 9 aa, Homo Sapiens
AQEEEIMFL

SEQ ID NO: 950252 - protein, 9 aa, Homo Sapiens
SADKDRCED

SEQ ID NO: 950253 - protein, 9 aa, Homo Sapiens
ENSHRERLF

SEQ ID NO: 950254 - protein, 9 aa, Homo Sapiens
SNSRGSNTK

SEQ ID NO: 950255 - protein, 9 aa, Homo Sapiens
KKFFDIWIC

SEQ ID NO: 950256 - protein, 9 aa, Homo Sapiens
IDLRKEASN

SEQ ID NO: 950257 - protein, 9 aa, Homo Sapiens
EWDTVTLEA

SEQ ID NO: 950258 - protein, 9 aa, Homo Sapiens
MKPQVPFSD

SEQ ID NO: 950259 - protein, 9 aa, Homo Sapiens
QQYWALTVP

SEQ ID NO: 950260 - protein, 9 aa, Homo Sapiens
SASGKSIEV

SEQ ID NO: 950261 - protein, 9 aa, Homo Sapiens
SINIVFMNI

SEQ ID NO: 950262 - protein, 9 aa, Homo Sapiens
IAPNFVMLA

SEQ ID NO: 950263 - protein, 9 aa, Homo Sapiens
GFVLDKLLF

SEQ ID NO: 950264 - protein, 9 aa, Homo Sapiens
VHRLLKRTS

SEQ ID NO: 950265 - protein, 9 aa, Homo Sapiens
GVGIPPLPP

SEQ ID NO: 950266 - protein, 9 aa, Homo Sapiens
TRKLQQKRA

SEQ ID NO: 950267 - protein, 9 aa, Homo Sapiens
GQKVSHVAA

SEQ ID NO: 950268 - protein, 9 aa, Homo Sapiens
PVKSQKITL

SEQ ID NO: 950269 - protein, 9 aa, Homo Sapiens
PAFFLVQKS

SEQ ID NO: 950270 - protein, 9 aa, Homo Sapiens
YKNQKKIRG

SEQ ID NO: 950271 - protein, 9 aa, Homo Sapiens
KSLDQLETL

SEQ ID NO: 950272 - protein, 9 aa, Homo Sapiens
MGTSGETSG

SEQ ID NO: 950273 - protein, 9 aa, Homo Sapiens
LLRTYFSEG

SEQ ID NO: 950274 - protein, 9 aa, Homo Sapiens
KRIIFCKIS

SEQ ID NO: 950275 - protein, 9 aa, Homo Sapiens
CDEFRSQIK

SEQ ID NO: 950276 - protein, 9 aa, Homo Sapiens
IYSISLLNA

SEQ ID NO: 950277 - protein, 9 aa, Homo Sapiens
DWGLQKSLV

SEQ ID NO: 950278 - protein, 9 aa, Homo Sapiens
EMEAPTTVY

SEQ ID NO: 950279 - protein, 9 aa, Homo Sapiens
KSTVCDIDP

SEQ ID NO: 950280 - protein, 9 aa, Homo Sapiens
ADLFQPKDQ

SEQ ID NO: 950281 - protein, 9 aa, Homo Sapiens
HFLVISKKP

SEQ ID NO: 950282 - protein, 9 aa, Homo Sapiens
ESGQLREKV

SEQ ID NO: 950283 - protein, 9 aa, Homo Sapiens
NTLLETPVG

SEQ ID NO: 950284 - protein, 9 aa, Homo Sapiens
LKLLARAST

SEQ ID NO: 950285 - protein, 9 aa, Homo Sapiens
RFTRVDHIN

SEQ ID NO: 950286 - protein, 9 aa, Homo Sapiens
ARAVQKETR

SEQ ID NO: 950287 - protein, 9 aa, Homo Sapiens
LEITGGPIN

SEQ ID NO: 950288 - protein, 9 aa, Homo Sapiens
EIKKQTLKS

SEQ ID NO: 950289 - protein, 9 aa, Homo Sapiens
LTLSEIPLD

SEQ ID NO: 950290 - protein, 9 aa, Homo Sapiens
KPMRVVNDE

SEQ ID NO: 950291 - protein, 9 aa, Homo Sapiens
EQPLAQKPP

SEQ ID NO: 950292 - protein, 9 aa, Homo Sapiens
LALRKHKII

SEQ ID NO: 950293 - protein, 9 aa, Homo Sapiens
DGLSEKDLN

SEQ ID NO: 950294 - protein, 9 aa, Homo Sapiens
LMAIVLKIA

SEQ ID NO: 950295 - protein, 9 aa, Homo Sapiens
PFLELCTLP

SEQ ID NO: 950296 - protein, 9 aa, Homo Sapiens
NSLSVILMN

SEQ ID NO: 950297 - protein, 9 aa, Homo Sapiens
PRFCLFSES

SEQ ID NO: 950298 - protein, 9 aa, Homo Sapiens
WDSSHIVRY

SEQ ID NO: 950299 - protein, 9 aa, Homo Sapiens
KNIYLTLSP

SEQ ID NO: 950300 - protein, 9 aa, Homo Sapiens
SRGSQQYWA

SEQ ID NO: 950301 - protein, 9 aa, Homo Sapiens
GCEENQNRF

SEQ ID NO: 950302 - protein, 9 aa, Homo Sapiens
DVTTAWGGN

SEQ ID NO: 950303 - protein, 9 aa, Homo Sapiens
FANQGDVLT

SEQ ID NO: 950304 - protein, 9 aa, Homo Sapiens
KPRLTASLQ

SEQ ID NO: 950305 - protein, 9 aa, Homo Sapiens
PLWAPPFPK

SEQ ID NO: 950306 - protein, 9 aa, Homo Sapiens
ISYEEGKAF

SEQ ID NO: 950307 - protein, 9 aa, Homo Sapiens
VRNKSCENI

SEQ ID NO: 950308 - protein, 9 aa, Homo Sapiens
VMKMNGSLY

SEQ ID NO: 950309 - protein, 9 aa, Homo Sapiens
VPRFCLFSE

SEQ ID NO: 950310 - protein, 9 aa, Homo Sapiens
PEVLNQEPF

SEQ ID NO: 950311 - protein, 9 aa, Homo Sapiens
EWVCAADIL

SEQ ID NO: 950312 - protein, 9 aa, Homo Sapiens
PKKITVEDS

SEQ ID NO: 950313 - protein, 9 aa, Homo Sapiens
DSSDTPETD

SEQ ID NO: 950314 - protein, 9 aa, Homo Sapiens
SMSTMTSWE

SEQ ID NO: 950315 - protein, 9 aa, Homo Sapiens
KELKRTDTI

SEQ ID NO: 950316 - protein, 9 aa, Homo Sapiens
IIFAVMFSH

SEQ ID NO: 950317 - protein, 9 aa, Homo Sapiens
KIYFQHTAE

SEQ ID NO: 950318 - protein, 9 aa, Homo Sapiens
NCGQQKDES

SEQ ID NO: 950319 - protein, 9 aa, Homo Sapiens
SGRRSQYQR

SEQ ID NO: 950320 - protein, 9 aa, Homo Sapiens
FCHKDRQLL

SEQ ID NO: 950321 - protein, 9 aa, Homo Sapiens
ASLGGIIYL

SEQ ID NO: 950322 - protein, 9 aa, Homo Sapiens
SGETSGLPE

SEQ ID NO: 950323 - protein, 9 aa, Homo Sapiens
HLLRRLVAQ

SEQ ID NO: 950324 - protein, 9 aa, Homo Sapiens
SALQNTGHE

SEQ ID NO: 950325 - protein, 9 aa, Homo Sapiens
AAVRGSDVS

SEQ ID NO: 950326 - protein, 9 aa, Homo Sapiens
KIEVAFMVC

SEQ ID NO: 950327 - protein, 9 aa, Homo Sapiens
KENESFLWD

SEQ ID NO: 950328 - protein, 9 aa, Homo Sapiens
TPLHVAADC

SEQ ID NO: 950329 - protein, 9 aa, Homo Sapiens
SKTDHVTPM

SEQ ID NO: 950330 - protein, 9 aa, Homo Sapiens
KTEMDSKTL

SEQ ID NO: 950331 - protein, 9 aa, Homo Sapiens
FNVYLKKPP

SEQ ID NO: 950332 - protein, 9 aa, Homo Sapiens
GLKQETVND

SEQ ID NO: 950333 - protein, 9 aa, Homo Sapiens
GGGHSNKVM

SEQ ID NO: 950334 - protein, 9 aa, Homo Sapiens
PKAVFYAAC

SEQ ID NO: 950335 - protein, 9 aa, Homo Sapiens
FHSLKNSEG

SEQ ID NO: 950336 - protein, 9 aa, Homo Sapiens
KGENSLPGE

SEQ ID NO: 950337 - protein, 9 aa, Homo Sapiens
TGTLSQGHF

SEQ ID NO: 950338 - protein, 9 aa, Homo Sapiens
NQLNRIAKM

SEQ ID NO: 950339 - protein, 9 aa, Homo Sapiens
TGDERSKET

SEQ ID NO: 950340 - protein, 9 aa, Homo Sapiens
AAYIDILET

SEQ ID NO: 950341 - protein, 9 aa, Homo Sapiens
NRDRYFKGI

SEQ ID NO: 950342 - protein, 9 aa, Homo Sapiens
RTFKISVTP

SEQ ID NO: 950343 - protein, 9 aa, Homo Sapiens
LHLAPSCHP

SEQ ID NO: 950344 - protein, 9 aa, Homo Sapiens
YADDWVTDS

SEQ ID NO: 950345 - protein, 9 aa, Homo Sapiens
APKNRTRKD

SEQ ID NO: 950346 - protein, 9 aa, Homo Sapiens
CFYQDFFTE

SEQ ID NO: 950347 - protein, 9 aa, Homo Sapiens
IPMDFQCDR

SEQ ID NO: 950348 - protein, 9 aa, Homo Sapiens
LHCGGTSHP

SEQ ID NO: 950349 - protein, 9 aa, Homo Sapiens
IKSPYNVAC

SEQ ID NO: 950350 - protein, 9 aa, Homo Sapiens
DAIFDEDHN

SEQ ID NO: 950351 - protein, 9 aa, Homo Sapiens
KAVKAIALC

SEQ ID NO: 950352 - protein, 9 aa, Homo Sapiens
LLSSKTGTL

SEQ ID NO: 950353 - protein, 9 aa, Homo Sapiens
CLLGAGSLE

SEQ ID NO: 950354 - protein, 9 aa, Homo Sapiens
RRNLSDFWE

SEQ ID NO: 950355 - protein, 9 aa, Homo Sapiens
HSSRWGLCI

SEQ ID NO: 950356 - protein, 9 aa, Homo Sapiens
RFCYYASRR

SEQ ID NO: 950357 - protein, 9 aa, Homo Sapiens
SKSPSTETT

SEQ ID NO: 950358 - protein, 9 aa, Homo Sapiens
YVNLYYATL

SEQ ID NO: 950359 - protein, 9 aa, Homo Sapiens
KEASNKLTF

SEQ ID NO: 950360 - protein, 9 aa, Homo Sapiens
PTKKLPQGV

SEQ ID NO: 950361 - protein, 9 aa, Homo Sapiens
CPLLLAPGR

SEQ ID NO: 950362 - protein, 9 aa, Homo Sapiens
GDHKKKFEV

SEQ ID NO: 950363 - protein, 9 aa, Homo Sapiens
VLNDLSSFR

SEQ ID NO: 950364 - protein, 9 aa, Homo Sapiens
CAADILLPA

SEQ ID NO: 950365 - protein, 9 aa, Homo Sapiens
NSTAKFIPW

SEQ ID NO: 950366 - protein, 9 aa, Homo Sapiens
RARVARAMF

SEQ ID NO: 950367 - protein, 9 aa, Homo Sapiens
SETKLKENT

SEQ ID NO: 950368 - protein, 9 aa, Homo Sapiens
EKCTLPLTE

SEQ ID NO: 950369 - protein, 9 aa, Homo Sapiens
PRNQGCQLS

SEQ ID NO: 950370 - protein, 9 aa, Homo Sapiens
CPYNPHHRI

SEQ ID NO: 950371 - protein, 9 aa, Homo Sapiens
QVLQEKEPP

SEQ ID NO: 950372 - protein, 9 aa, Homo Sapiens
LSEEFDLLY

SEQ ID NO: 950373 - protein, 9 aa, Homo Sapiens
SGKSICTVL

SEQ ID NO: 950374 - protein, 9 aa, Homo Sapiens
LNRDFRIGY

SEQ ID NO: 950375 - protein, 9 aa, Homo Sapiens
GPNATFNSS

SEQ ID NO: 950376 - protein, 9 aa, Homo Sapiens
SSYLDTLGS

SEQ ID NO: 950377 - protein, 9 aa, Homo Sapiens
GFVKEMRER

SEQ ID NO: 950378 - protein, 9 aa, Homo Sapiens
RELEALSED

SEQ ID NO: 950379 - protein, 9 aa, Homo Sapiens
LAGMYGKVC

SEQ ID NO: 950380 - protein, 9 aa, Homo Sapiens
MPVDMGFLA

SEQ ID NO: 950381 - protein, 9 aa, Homo Sapiens
LPPPAQPPP

SEQ ID NO: 950382 - protein, 9 aa, Homo Sapiens
LNPTWNKVF

SEQ ID NO: 950383 - protein, 9 aa, Homo Sapiens
MLGLKGNGD

SEQ ID NO: 950384 - protein, 9 aa, Homo Sapiens
CCVKPQKLP

SEQ ID NO: 950385 - protein, 9 aa, Homo Sapiens
SFNGVQVTG

SEQ ID NO: 950386 - protein, 9 aa, Homo Sapiens
QQNKYKYKE

SEQ ID NO: 950387 - protein, 9 aa, Homo Sapiens
VGPLSGLQA

SEQ ID NO: 950388 - protein, 9 aa, Homo Sapiens
KIFKGTLKP

SEQ ID NO: 950389 - protein, 9 aa, Homo Sapiens
IDDREPFAN

SEQ ID NO: 950390 - protein, 9 aa, Homo Sapiens
HRHLVLQMV

SEQ ID NO: 950391 - protein, 9 aa, Homo Sapiens
FQDLKEKFL

SEQ ID NO: 950392 - protein, 9 aa, Homo Sapiens
VNGGPQRNP

SEQ ID NO: 950393 - protein, 9 aa, Homo Sapiens
KDIIYFFRH

SEQ ID NO: 950394 - protein, 9 aa, Homo Sapiens
LLSQICSHL

SEQ ID NO: 950395 - protein, 9 aa, Homo Sapiens
MSQNTQDRY

SEQ ID NO: 950396 - protein, 9 aa, Homo Sapiens
DCRAMAEPD

SEQ ID NO: 950397 - protein, 9 aa, Homo Sapiens
PLEVELSTA

SEQ ID NO: 950398 - protein, 9 aa, Homo Sapiens
AIHNIFCMT

SEQ ID NO: 950399 - protein, 9 aa, Homo Sapiens
LNGYLLAFK

SEQ ID NO: 950400 - protein, 9 aa, Homo Sapiens
HELIVSGAH

SEQ ID NO: 950401 - protein, 9 aa, Homo Sapiens
INLYIEDSY

SEQ ID NO: 950402 - protein, 9 aa, Homo Sapiens
GVKRNIPLM

SEQ ID NO: 950403 - protein, 9 aa, Homo Sapiens
PVCGQSATA

SEQ ID NO: 950404 - protein, 9 aa, Homo Sapiens
YASKNMRDN

SEQ ID NO: 950405 - protein, 9 aa, Homo Sapiens
PILSADIAQ

SEQ ID NO: 950406 - protein, 9 aa, Homo Sapiens
KSDNENGRP

SEQ ID NO: 950407 - protein, 9 aa, Homo Sapiens
PDGYYAQSE

SEQ ID NO: 950408 - protein, 9 aa, Homo Sapiens
LAWGSWTSG

SEQ ID NO: 950409 - protein, 9 aa, Homo Sapiens
NSPGVYTKV

SEQ ID NO: 950410 - protein, 9 aa, Homo Sapiens
DKSILRKHQ

SEQ ID NO: 950411 - protein, 9 aa, Homo Sapiens
LLSALGNDT

SEQ ID NO: 950412 - protein, 9 aa, Homo Sapiens
LYYKKNKRR

SEQ ID NO: 950413 - protein, 9 aa, Homo Sapiens
SCSCLPGFH

SEQ ID NO: 950414 - protein, 9 aa, Homo Sapiens
PFASRYASP

SEQ ID NO: 950415 - protein, 9 aa, Homo Sapiens
MTSAAAAQG

SEQ ID NO: 950416 - protein, 9 aa, Homo Sapiens
GAGSLEAQV

SEQ ID NO: 950417 - protein, 9 aa, Homo Sapiens
IKNAYEKSL

SEQ ID NO: 950418 - protein, 9 aa, Homo Sapiens
HNEMVIVKD

SEQ ID NO: 950419 - protein, 9 aa, Homo Sapiens
RLFNCANRT

SEQ ID NO: 950420 - protein, 9 aa, Homo Sapiens
SQEMNTLFC

SEQ ID NO: 950421 - protein, 9 aa, Homo Sapiens
DTNSSLTDL

SEQ ID NO: 950422 - protein, 9 aa, Homo Sapiens
LSQGHFLLD

SEQ ID NO: 950423 - protein, 9 aa, Homo Sapiens
IAAQGLKQE

SEQ ID NO: 950424 - protein, 9 aa, Homo Sapiens
SDWKEQEWD

SEQ ID NO: 950425 - protein, 9 aa, Homo Sapiens
IINNLMSTV

SEQ ID NO: 950426 - protein, 9 aa, Homo Sapiens
VSVFQEKTV

SEQ ID NO: 950427 - protein, 9 aa, Homo Sapiens
ETFFLTFPE

SEQ ID NO: 950428 - protein, 9 aa, Homo Sapiens
VGTSLGIVL

SEQ ID NO: 950429 - protein, 9 aa, Homo Sapiens
EGKYIWSTM

SEQ ID NO: 950430 - protein, 9 aa, Homo Sapiens
LPRLQERVL

SEQ ID NO: 950431 - protein, 9 aa, Homo Sapiens
RQSRSHHLE

SEQ ID NO: 950432 - protein, 9 aa, Homo Sapiens
FLKRGDDSV

SEQ ID NO: 950433 - protein, 9 aa, Homo Sapiens
QAWRRAVLH

SEQ ID NO: 950434 - protein, 9 aa, Homo Sapiens
FDENPENNF

SEQ ID NO: 950435 - protein, 9 aa, Homo Sapiens
PRLTTHLNV

SEQ ID NO: 950436 - protein, 9 aa, Homo Sapiens
EDFIVKPLV

SEQ ID NO: 950437 - protein, 9 aa, Homo Sapiens
LRLYKDILL

SEQ ID NO: 950438 - protein, 9 aa, Homo Sapiens
VCVLLLCNA

SEQ ID NO: 950439 - protein, 9 aa, Homo Sapiens
HYHSIVQRF

SEQ ID NO: 950440 - protein, 9 aa, Homo Sapiens
LKCVRWMVS

SEQ ID NO: 950441 - protein, 9 aa, Homo Sapiens
GGTEGGGSG

SEQ ID NO: 950442 - protein, 9 aa, Homo Sapiens
FNFFPEDSS

SEQ ID NO: 950443 - protein, 9 aa, Homo Sapiens
THAYASENN

SEQ ID NO: 950444 - protein, 9 aa, Homo Sapiens
GRVPSSLAE

SEQ ID NO: 950445 - protein, 9 aa, Homo Sapiens
GPVGPREPQ

SEQ ID NO: 950446 - protein, 9 aa, Homo Sapiens
FRPLAALAP

SEQ ID NO: 950447 - protein, 9 aa, Homo Sapiens
QSWISHWLL

SEQ ID NO: 950448 - protein, 9 aa, Homo Sapiens
ENREWVCAA

SEQ ID NO: 950449 - protein, 9 aa, Homo Sapiens
RSETIFDNF

SEQ ID NO: 950450 - protein, 9 aa, Homo Sapiens
SNITATTKF

SEQ ID NO: 950451 - protein, 9 aa, Homo Sapiens
KPRAYFMSD

SEQ ID NO: 950452 - protein, 9 aa, Homo Sapiens
EGSLSSRTH

SEQ ID NO: 950453 - protein, 9 aa, Homo Sapiens
FWFAVPPAL

SEQ ID NO: 950454 - protein, 9 aa, Homo Sapiens
TTMKKEKVS

SEQ ID NO: 950455 - protein, 9 aa, Homo Sapiens
DVLTPDDVW

SEQ ID NO: 950456 - protein, 9 aa, Homo Sapiens
WELFPHLYF

SEQ ID NO: 950457 - protein, 9 aa, Homo Sapiens
NSNNNRGVV

SEQ ID NO: 950458 - protein, 9 aa, Homo Sapiens
QRSSLEKHK

SEQ ID NO: 950459 - protein, 9 aa, Homo Sapiens
VPKYYQSSW

SEQ ID NO: 950460 - protein, 9 aa, Homo Sapiens
EQVKIYAGP

SEQ ID NO: 950461 - protein, 9 aa, Homo Sapiens
LLFGYVYVG

SEQ ID NO: 950462 - protein, 9 aa, Homo Sapiens
GKLYCKVCY

SEQ ID NO: 950463 - protein, 9 aa, Homo Sapiens
FGVSASGKS

SEQ ID NO: 950464 - protein, 9 aa, Homo Sapiens
AVLHGVPSQ

SEQ ID NO: 950465 - protein, 9 aa, Homo Sapiens
LVLFYKTYH

SEQ ID NO: 950466 - protein, 9 aa, Homo Sapiens
KIFQTEMTI

SEQ ID NO: 950467 - protein, 9 aa, Homo Sapiens
GFFCIISVL

SEQ ID NO: 950468 - protein, 9 aa, Homo Sapiens
QYPGPGENE

SEQ ID NO: 950469 - protein, 9 aa, Homo Sapiens
LEQVTLDAD

SEQ ID NO: 950470 - protein, 9 aa, Homo Sapiens
WANNSVPKN

SEQ ID NO: 950471 - protein, 9 aa, Homo Sapiens
ALFSRTSIT

SEQ ID NO: 950472 - protein, 9 aa, Homo Sapiens
CGGVRNPGD

SEQ ID NO: 950473 - protein, 9 aa, Homo Sapiens
APTELLLCK

SEQ ID NO: 950474 - protein, 9 aa, Homo Sapiens
YYQSSWEQA

SEQ ID NO: 950475 - protein, 9 aa, Homo Sapiens
EKVEKLNML

SEQ ID NO: 950476 - protein, 9 aa, Homo Sapiens
FCKCKKCKC

SEQ ID NO: 950477 - protein, 9 aa, Homo Sapiens
TIITFTLLD

SEQ ID NO: 950478 - protein, 9 aa, Homo Sapiens
CISQPRPVP

SEQ ID NO: 950479 - protein, 9 aa, Homo Sapiens
GNKITDLSR

SEQ ID NO: 950480 - protein, 9 aa, Homo Sapiens
PFTACQKVP

SEQ ID NO: 950481 - protein, 9 aa, Homo Sapiens
IAHYDQQIG

SEQ ID NO: 950482 - protein, 9 aa, Homo Sapiens
DNQGSSVEG

SEQ ID NO: 950483 - protein, 9 aa, Homo Sapiens
NLLTSDSPS

SEQ ID NO: 950484 - protein, 9 aa, Homo Sapiens
NHVVPEMLR

SEQ ID NO: 950485 - protein, 9 aa, Homo Sapiens
SFCDKSILR

SEQ ID NO: 950486 - protein, 9 aa, Homo Sapiens
EAREVSPPV

SEQ ID NO: 950487 - protein, 9 aa, Homo Sapiens
IKEAHPSDG

SEQ ID NO: 950488 - protein, 9 aa, Homo Sapiens
KIMDAKHKN

SEQ ID NO: 950489 - protein, 9 aa, Homo Sapiens
HGAWPLGTG

SEQ ID NO: 950490 - protein, 9 aa, Homo Sapiens
SASLLPNVP

SEQ ID NO: 950491 - protein, 9 aa, Homo Sapiens
VGEEEEEKE

SEQ ID NO: 950492 - protein, 9 aa, Homo Sapiens
YEDFIVKPL

SEQ ID NO: 950493 - protein, 9 aa, Homo Sapiens
HFAEAKKFV

SEQ ID NO: 950494 - protein, 9 aa, Homo Sapiens
DKTSSVPKP

SEQ ID NO: 950495 - protein, 9 aa, Homo Sapiens
GQKLLQKKR

SEQ ID NO: 950496 - protein, 9 aa, Homo Sapiens
ERVKNLMLS

SEQ ID NO: 950497 - protein, 9 aa, Homo Sapiens
KQYKIFKGT

SEQ ID NO: 950498 - protein, 9 aa, Homo Sapiens
LCPLLLAPG

SEQ ID NO: 950499 - protein, 9 aa, Homo Sapiens
DFLCSNPKI

SEQ ID NO: 950500 - protein, 9 aa, Homo Sapiens
LDSEENTKS

SEQ ID NO: 950501 - protein, 9 aa, Homo Sapiens
SGLLKLLAR

SEQ ID NO: 950502 - protein, 9 aa, Homo Sapiens
SGLDSTAMT

SEQ ID NO: 950503 - protein, 9 aa, Homo Sapiens
VVFEKCSQI

SEQ ID NO: 950504 - protein, 9 aa, Homo Sapiens
TQLFCLHCG

SEQ ID NO: 950505 - protein, 9 aa, Homo Sapiens
FIQRNYSDG

SEQ ID NO: 950506 - protein, 9 aa, Homo Sapiens
VSEEPRALG

SEQ ID NO: 950507 - protein, 9 aa, Homo Sapiens
KDYFGICYV

SEQ ID NO: 950508 - protein, 9 aa, Homo Sapiens
NVTWFKVMT

SEQ ID NO: 950509 - protein, 9 aa, Homo Sapiens
FSTVTPLAK

SEQ ID NO: 950510 - protein, 9 aa, Homo Sapiens
TREGSFGVT

SEQ ID NO: 950511 - protein, 9 aa, Homo Sapiens
EGGKFEGQS

SEQ ID NO: 950512 - protein, 9 aa, Homo Sapiens
NGSLYQELK

SEQ ID NO: 950513 - protein, 9 aa, Homo Sapiens
RKDGAPKNR

SEQ ID NO: 950514 - protein, 9 aa, Homo Sapiens
PLGPMEEEL

SEQ ID NO: 950515 - protein, 9 aa, Homo Sapiens
NFTDQKKFS

SEQ ID NO: 950516 - protein, 9 aa, Homo Sapiens
SPLPRGDAP

SEQ ID NO: 950517 - protein, 9 aa, Homo Sapiens
THEFSPEYF

SEQ ID NO: 950518 - protein, 9 aa, Homo Sapiens
LDHNVKFNG

SEQ ID NO: 950519 - protein, 9 aa, Homo Sapiens
EFKVSGIPS

SEQ ID NO: 950520 - protein, 9 aa, Homo Sapiens
APAHPLNLP

SEQ ID NO: 950521 - protein, 9 aa, Homo Sapiens
QLKEKKRIK

SEQ ID NO: 950522 - protein, 9 aa, Homo Sapiens
AREVSPPVG

SEQ ID NO: 950523 - protein, 9 aa, Homo Sapiens
LPSVLLSVL

SEQ ID NO: 950524 - protein, 9 aa, Homo Sapiens
QWSQKKKTG

SEQ ID NO: 950525 - protein, 9 aa, Homo Sapiens
SFFRRHLPR

SEQ ID NO: 950526 - protein, 9 aa, Homo Sapiens
IPQERVYEM

SEQ ID NO: 950527 - protein, 9 aa, Homo Sapiens
FVESILKRP

SEQ ID NO: 950528 - protein, 9 aa, Homo Sapiens
QAPLVVEED

SEQ ID NO: 950529 - protein, 9 aa, Homo Sapiens
VSTGPFLEL

SEQ ID NO: 950530 - protein, 9 aa, Homo Sapiens
DTSSKEANF

SEQ ID NO: 950531 - protein, 9 aa, Homo Sapiens
YANKTKLKI

SEQ ID NO: 950532 - protein, 9 aa, Homo Sapiens
KDHSLERER

SEQ ID NO: 950533 - protein, 9 aa, Homo Sapiens
SSSAENIMP

SEQ ID NO: 950534 - protein, 9 aa, Homo Sapiens
HKKKFEVTV

SEQ ID NO: 950535 - protein, 9 aa, Homo Sapiens
YALEHTYSD

SEQ ID NO: 950536 - protein, 9 aa, Homo Sapiens
GNLPLHQEV

SEQ ID NO: 950537 - protein, 9 aa, Homo Sapiens
FFEEYTGSS

SEQ ID NO: 950538 - protein, 9 aa, Homo Sapiens
DLETSLEKR

SEQ ID NO: 950539 - protein, 9 aa, Homo Sapiens
VKSQKITLL

SEQ ID NO: 950540 - protein, 9 aa, Homo Sapiens
LEEGAQCSA

SEQ ID NO: 950541 - protein, 9 aa, Homo Sapiens
VFSLLMTLF

SEQ ID NO: 950542 - protein, 9 aa, Homo Sapiens
KLTVNNEDI

SEQ ID NO: 950543 - protein, 9 aa, Homo Sapiens
SLTQIYVLP

SEQ ID NO: 950544 - protein, 9 aa, Homo Sapiens
NQIDKNWYE

SEQ ID NO: 950545 - protein, 9 aa, Homo Sapiens
TVGERRRAV

SEQ ID NO: 950546 - protein, 9 aa, Homo Sapiens
IADEKQLEI

SEQ ID NO: 950547 - protein, 9 aa, Homo Sapiens
HFFCEIMVV

SEQ ID NO: 950548 - protein, 9 aa, Homo Sapiens
QNFELVVFL

SEQ ID NO: 950549 - protein, 9 aa, Homo Sapiens
LLKDKHADP

SEQ ID NO: 950550 - protein, 9 aa, Homo Sapiens
PSHDTGQPR

SEQ ID NO: 950551 - protein, 9 aa, Homo Sapiens
LALPPVRPH

SEQ ID NO: 950552 - protein, 9 aa, Homo Sapiens
RKDKGLLPP

SEQ ID NO: 950553 - protein, 9 aa, Homo Sapiens
SCTFCEICL

SEQ ID NO: 950554 - protein, 9 aa, Homo Sapiens
AWGSWTSGE

SEQ ID NO: 950555 - protein, 9 aa, Homo Sapiens
VFSRFSSGG

SEQ ID NO: 950556 - protein, 9 aa, Homo Sapiens
TSRRSNSGM

SEQ ID NO: 950557 - protein, 9 aa, Homo Sapiens
SSDECTLLS

SEQ ID NO: 950558 - protein, 9 aa, Homo Sapiens
FHIFQDPLT

SEQ ID NO: 950559 - protein, 9 aa, Homo Sapiens
SVKQRYKEC

SEQ ID NO: 950560 - protein, 9 aa, Homo Sapiens
RLQEFFLSK

SEQ ID NO: 950561 - protein, 9 aa, Homo Sapiens
NGCCLMQID

SEQ ID NO: 950562 - protein, 9 aa, Homo Sapiens
ARDSKTYRR

SEQ ID NO: 950563 - protein, 9 aa, Homo Sapiens
LPETGITTD

SEQ ID NO: 950564 - protein, 9 aa, Homo Sapiens
KEVERILRL

SEQ ID NO: 950565 - protein, 9 aa, Homo Sapiens
ALLTAGGKL

SEQ ID NO: 950566 - protein, 9 aa, Homo Sapiens
FTCHCRKSC

SEQ ID NO: 950567 - protein, 9 aa, Homo Sapiens
AQVSGRRYN

SEQ ID NO: 950568 - protein, 9 aa, Homo Sapiens
RHHRGRGGK

SEQ ID NO: 950569 - protein, 9 aa, Homo Sapiens
KNMRDNNML

SEQ ID NO: 950570 - protein, 9 aa, Homo Sapiens
DLHKQEAPE

SEQ ID NO: 950571 - protein, 9 aa, Homo Sapiens
FKGRGILNI

SEQ ID NO: 950572 - protein, 9 aa, Homo Sapiens
FIACCQTSL

SEQ ID NO: 950573 - protein, 9 aa, Homo Sapiens
FQNLGFILT

SEQ ID NO: 950574 - protein, 9 aa, Homo Sapiens
SGFSRSCQT

SEQ ID NO: 950575 - protein, 9 aa, Homo Sapiens
ATVGERRRA

SEQ ID NO: 950576 - protein, 9 aa, Homo Sapiens
YFLLCSGPS

SEQ ID NO: 950577 - protein, 9 aa, Homo Sapiens
FLNWEFARM

SEQ ID NO: 950578 - protein, 9 aa, Homo Sapiens
AEEFALRDQ

SEQ ID NO: 950579 - protein, 9 aa, Homo Sapiens
SSLPWMHPH

SEQ ID NO: 950580 - protein, 9 aa, Homo Sapiens
YEMNLNAGR

SEQ ID NO: 950581 - protein, 9 aa, Homo Sapiens
LTGLVMGTE

SEQ ID NO: 950582 - protein, 9 aa, Homo Sapiens
HVLWHSEFS

SEQ ID NO: 950583 - protein, 9 aa, Homo Sapiens
RNSLRCISK

SEQ ID NO: 950584 - protein, 9 aa, Homo Sapiens
KPPVICSYF

SEQ ID NO: 950585 - protein, 9 aa, Homo Sapiens
KTFKGRGIL

SEQ ID NO: 950586 - protein, 9 aa, Homo Sapiens
PDFGQEVAL

SEQ ID NO: 950587 - protein, 9 aa, Homo Sapiens
GSQQYWALT

SEQ ID NO: 950588 - protein, 9 aa, Homo Sapiens
CEKADTRTL

SEQ ID NO: 950589 - protein, 9 aa, Homo Sapiens
QKVSHVAAD

SEQ ID NO: 950590 - protein, 9 aa, Homo Sapiens
RQDRGGPLL

SEQ ID NO: 950591 - protein, 9 aa, Homo Sapiens
GPEENAAAE

SEQ ID NO: 950592 - protein, 9 aa, Homo Sapiens
TLHLKVKEG

SEQ ID NO: 950593 - protein, 9 aa, Homo Sapiens
TIIASFCSG

SEQ ID NO: 950594 - protein, 9 aa, Homo Sapiens
KGPRGIQRI

SEQ ID NO: 950595 - protein, 9 aa, Homo Sapiens
LHLKVKEGC

SEQ ID NO: 950596 - protein, 9 aa, Homo Sapiens
FGEDDDNFE

SEQ ID NO: 950597 - protein, 9 aa, Homo Sapiens
WQVRSETIF

SEQ ID NO: 950598 - protein, 9 aa, Homo Sapiens
DTFFEEYTG

SEQ ID NO: 950599 - protein, 9 aa, Homo Sapiens
MKKKVEDLH

SEQ ID NO: 950600 - protein, 9 aa, Homo Sapiens
VRLYFILGT

SEQ ID NO: 950601 - protein, 9 aa, Homo Sapiens
KKKTGERPA

SEQ ID NO: 950602 - protein, 9 aa, Homo Sapiens
HFGSKRGSC

SEQ ID NO: 950603 - protein, 9 aa, Homo Sapiens
HARERVQLL

SEQ ID NO: 950604 - protein, 9 aa, Homo Sapiens
NILPLPNAQ

SEQ ID NO: 950605 - protein, 9 aa, Homo Sapiens
AFAYKDYLL

SEQ ID NO: 950606 - protein, 9 aa, Homo Sapiens
VTEPGFEPG

SEQ ID NO: 950607 - protein, 9 aa, Homo Sapiens
AALYVLYPG

SEQ ID NO: 950608 - protein, 9 aa, Homo Sapiens
GFAVSFSII

SEQ ID NO: 950609 - protein, 9 aa, Homo Sapiens
DLLADLVVR

SEQ ID NO: 950610 - protein, 9 aa, Homo Sapiens
RFLGQGEAL

SEQ ID NO: 950611 - protein, 9 aa, Homo Sapiens
SYLDTLGSK

SEQ ID NO: 950612 - protein, 9 aa, Homo Sapiens
TKEAHKTVS

SEQ ID NO: 950613 - protein, 9 aa, Homo Sapiens
TPFPVTDAS

SEQ ID NO: 950614 - protein, 9 aa, Homo Sapiens
SYLSIIMDP

SEQ ID NO: 950615 - protein, 9 aa, Homo Sapiens
FFTGAFLFS

SEQ ID NO: 950616 - protein, 9 aa, Homo Sapiens
RKSQLQRKQ

SEQ ID NO: 950617 - protein, 9 aa, Homo Sapiens
IPAGAIPQE

SEQ ID NO: 950618 - protein, 9 aa, Homo Sapiens
EEVDYELLM

SEQ ID NO: 950619 - protein, 9 aa, Homo Sapiens
YLLSALGND

SEQ ID NO: 950620 - protein, 9 aa, Homo Sapiens
QIIAEADGE

SEQ ID NO: 950621 - protein, 9 aa, Homo Sapiens
RKFYVCPAV

SEQ ID NO: 950622 - protein, 9 aa, Homo Sapiens
PVRPHGPED

SEQ ID NO: 950623 - protein, 9 aa, Homo Sapiens
PVVYHRHTL

SEQ ID NO: 950624 - protein, 9 aa, Homo Sapiens
TNEDASHNI

SEQ ID NO: 950625 - protein, 9 aa, Homo Sapiens
VLVIFLLFI

SEQ ID NO: 950626 - protein, 9 aa, Homo Sapiens
VTRNKTGPY

SEQ ID NO: 950627 - protein, 9 aa, Homo Sapiens
AFRARLVDH

SEQ ID NO: 950628 - protein, 9 aa, Homo Sapiens
EVEELSVEE

SEQ ID NO: 950629 - protein, 9 aa, Homo Sapiens
GSGHIGSFV

SEQ ID NO: 950630 - protein, 9 aa, Homo Sapiens
VMRRHQKPP

SEQ ID NO: 950631 - protein, 9 aa, Homo Sapiens
TLSPNDHVN

SEQ ID NO: 950632 - protein, 9 aa, Homo Sapiens
PRGAFRPWE

SEQ ID NO: 950633 - protein, 9 aa, Homo Sapiens
EDSERIQGY

SEQ ID NO: 950634 - protein, 9 aa, Homo Sapiens
CALSTGEKG

SEQ ID NO: 950635 - protein, 9 aa, Homo Sapiens
RRPAHLFRH

SEQ ID NO: 950636 - protein, 9 aa, Homo Sapiens
SAPLASVPS

SEQ ID NO: 950637 - protein, 9 aa, Homo Sapiens
KNEPGIRSS

SEQ ID NO: 950638 - protein, 9 aa, Homo Sapiens
FPLTLLIAF

SEQ ID NO: 950639 - protein, 9 aa, Homo Sapiens
TVELLKRDA

SEQ ID NO: 950640 - protein, 9 aa, Homo Sapiens
IIDNGSGMC

SEQ ID NO: 950641 - protein, 9 aa, Homo Sapiens
SRDGSQTSN

SEQ ID NO: 950642 - protein, 9 aa, Homo Sapiens
GFKKKFKED

SEQ ID NO: 950643 - protein, 9 aa, Homo Sapiens
LHNPAGTSV

SEQ ID NO: 950644 - protein, 9 aa, Homo Sapiens
VSLLDKGIY

SEQ ID NO: 950645 - protein, 9 aa, Homo Sapiens
TSPLCETLV

SEQ ID NO: 950646 - protein, 9 aa, Homo Sapiens
NGACLCKHG

SEQ ID NO: 950647 - protein, 9 aa, Homo Sapiens
TVEIEKEKT

SEQ ID NO: 950648 - protein, 9 aa, Homo Sapiens
GKDVTESPR

SEQ ID NO: 950649 - protein, 9 aa, Homo Sapiens
VCAADILLP

SEQ ID NO: 950650 - protein, 9 aa, Homo Sapiens
STIFTSPPL

SEQ ID NO: 950651 - protein, 9 aa, Homo Sapiens
SSKRDKRSR

SEQ ID NO: 950652 - protein, 9 aa, Homo Sapiens
LGHLQNNMT

SEQ ID NO: 950653 - protein, 9 aa, Homo Sapiens
SLETFSLDA

SEQ ID NO: 950654 - protein, 9 aa, Homo Sapiens
QGKLKPQAT

SEQ ID NO: 950655 - protein, 9 aa, Homo Sapiens
SNLNTDFFA

SEQ ID NO: 950656 - protein, 9 aa, Homo Sapiens
SANLFQQQA

SEQ ID NO: 950657 - protein, 9 aa, Homo Sapiens
VFFVSHFYT

SEQ ID NO: 950658 - protein, 9 aa, Homo Sapiens
NSRNAWRED

SEQ ID NO: 950659 - protein, 9 aa, Homo Sapiens
QRHPMNDPT

SEQ ID NO: 950660 - protein, 9 aa, Homo Sapiens
KNIACLMYD

SEQ ID NO: 950661 - protein, 9 aa, Homo Sapiens
HMRKQLDCL

SEQ ID NO: 950662 - protein, 9 aa, Homo Sapiens
VEIEKEKTD

SEQ ID NO: 950663 - protein, 9 aa, Homo Sapiens
SDLYCWLQA

SEQ ID NO: 950664 - protein, 9 aa, Homo Sapiens
FFEDGEGNL

SEQ ID NO: 950665 - protein, 9 aa, Homo Sapiens
PLDFGYEKH

SEQ ID NO: 950666 - protein, 9 aa, Homo Sapiens
YIHIIDQKT

SEQ ID NO: 950667 - protein, 9 aa, Homo Sapiens
SAKGNGCCL

SEQ ID NO: 950668 - protein, 9 aa, Homo Sapiens
QKGVSQKNN

SEQ ID NO: 950669 - protein, 9 aa, Homo Sapiens
GSQSPLHLS

SEQ ID NO: 950670 - protein, 9 aa, Homo Sapiens
LESWGYNGN

SEQ ID NO: 950671 - protein, 9 aa, Homo Sapiens
LMNLVQETR

SEQ ID NO: 950672 - protein, 9 aa, Homo Sapiens
PSVPQNALP

SEQ ID NO: 950673 - protein, 9 aa, Homo Sapiens
EGYPDVEQP

SEQ ID NO: 950674 - protein, 9 aa, Homo Sapiens
GPRAGSTRL

SEQ ID NO: 950675 - protein, 9 aa, Homo Sapiens
YVLLPENNL

SEQ ID NO: 950676 - protein, 9 aa, Homo Sapiens
YVRPVTQTD

SEQ ID NO: 950677 - protein, 9 aa, Homo Sapiens
WGKAGKGLG

SEQ ID NO: 950678 - protein, 9 aa, Homo Sapiens
SQQVHPENI

SEQ ID NO: 950679 - protein, 9 aa, Homo Sapiens
ICKQEGIFC

SEQ ID NO: 950680 - protein, 9 aa, Homo Sapiens
MADSVQVML

SEQ ID NO: 950681 - protein, 9 aa, Homo Sapiens
FFILFETLL

SEQ ID NO: 950682 - protein, 9 aa, Homo Sapiens
CSYADFIKT

SEQ ID NO: 950683 - protein, 9 aa, Homo Sapiens
RKEEKPFRD

SEQ ID NO: 950684 - protein, 9 aa, Homo Sapiens
MLEGYFYIP

SEQ ID NO: 950685 - protein, 9 aa, Homo Sapiens
EKTLMPPIS

SEQ ID NO: 950686 - protein, 9 aa, Homo Sapiens
ETVSWKTHD

SEQ ID NO: 950687 - protein, 9 aa, Homo Sapiens
SHKEEKTLM

SEQ ID NO: 950688 - protein, 9 aa, Homo Sapiens
RGCVFCGVS

SEQ ID NO: 950689 - protein, 9 aa, Homo Sapiens
VNILDEAHE

SEQ ID NO: 950690 - protein, 9 aa, Homo Sapiens
PDLPSNITL

SEQ ID NO: 950691 - protein, 9 aa, Homo Sapiens
DRGGPLLRA

SEQ ID NO: 950692 - protein, 9 aa, Homo Sapiens
LIVTETPSK

SEQ ID NO: 950693 - protein, 9 aa, Homo Sapiens
CGVKNSPGV

SEQ ID NO: 950694 - protein, 9 aa, Homo Sapiens
QGCQLSGSS

SEQ ID NO: 950695 - protein, 9 aa, Homo Sapiens
KSGLILPRE

SEQ ID NO: 950696 - protein, 9 aa, Homo Sapiens
GSRFLIHSR

SEQ ID NO: 950697 - protein, 9 aa, Homo Sapiens
AILDHLESG

SEQ ID NO: 950698 - protein, 9 aa, Homo Sapiens
QVKNVSSER

SEQ ID NO: 950699 - protein, 9 aa, Homo Sapiens
AGSLEAQVT

SEQ ID NO: 950700 - protein, 9 aa, Homo Sapiens
LILHWRWGE

SEQ ID NO: 950701 - protein, 9 aa, Homo Sapiens
ERLFFFPAA

SEQ ID NO: 950702 - protein, 9 aa, Homo Sapiens
KDILLQMDF

SEQ ID NO: 950703 - protein, 9 aa, Homo Sapiens
DLSSFRELC

SEQ ID NO: 950704 - protein, 9 aa, Homo Sapiens
RVGFVLDKL

SEQ ID NO: 950705 - protein, 9 aa, Homo Sapiens
MELDGLREA

SEQ ID NO: 950706 - protein, 9 aa, Homo Sapiens
ALISIENSI

SEQ ID NO: 950707 - protein, 9 aa, Homo Sapiens
YYGIPMVGI

SEQ ID NO: 950708 - protein, 9 aa, Homo Sapiens
VVAKEFCSA

SEQ ID NO: 950709 - protein, 9 aa, Homo Sapiens
AETIWSLRK

SEQ ID NO: 950710 - protein, 9 aa, Homo Sapiens
YSPYKVKVG

SEQ ID NO: 950711 - protein, 9 aa, Homo Sapiens
GEEYNWHKP

SEQ ID NO: 950712 - protein, 9 aa, Homo Sapiens
AHSDTPLHF

SEQ ID NO: 950713 - protein, 9 aa, Homo Sapiens
LVVRIQRKY

SEQ ID NO: 950714 - protein, 9 aa, Homo Sapiens
ISVGPSHVA

SEQ ID NO: 950715 - protein, 9 aa, Homo Sapiens
EIKEDYKNR

SEQ ID NO: 950716 - protein, 9 aa, Homo Sapiens
QHYLGASYL

SEQ ID NO: 950717 - protein, 9 aa, Homo Sapiens
QYIEWLKKN

SEQ ID NO: 950718 - protein, 9 aa, Homo Sapiens
EDHNEMVIV

SEQ ID NO: 950719 - protein, 9 aa, Homo Sapiens
RCNCICSSR

SEQ ID NO: 950720 - protein, 9 aa, Homo Sapiens
LWLPFVFLC

SEQ ID NO: 950721 - protein, 9 aa, Homo Sapiens
MVLKCADIC

SEQ ID NO: 950722 - protein, 9 aa, Homo Sapiens
IRKPEVPTE

SEQ ID NO: 950723 - protein, 9 aa, Homo Sapiens
SIQCNVRNS

SEQ ID NO: 950724 - protein, 9 aa, Homo Sapiens
DYYSPTRAN

SEQ ID NO: 950725 - protein, 9 aa, Homo Sapiens
KIQNAVISE

SEQ ID NO: 950726 - protein, 9 aa, Homo Sapiens
HTGEKVCEC

SEQ ID NO: 950727 - protein, 9 aa, Homo Sapiens
GPINPTSLP

SEQ ID NO: 950728 - protein, 9 aa, Homo Sapiens
STVALNASL

SEQ ID NO: 950729 - protein, 9 aa, Homo Sapiens
KSRAAPSPE

SEQ ID NO: 950730 - protein, 9 aa, Homo Sapiens
IFSTHHLDE

SEQ ID NO: 950731 - protein, 9 aa, Homo Sapiens
QLREGKKKC

SEQ ID NO: 950732 - protein, 9 aa, Homo Sapiens
TMTLLPLWL

SEQ ID NO: 950733 - protein, 9 aa, Homo Sapiens
LDVQRELIL

SEQ ID NO: 950734 - protein, 9 aa, Homo Sapiens
TRQRRTWRD

SEQ ID NO: 950735 - protein, 9 aa, Homo Sapiens
QKAGKDVTE

SEQ ID NO: 950736 - protein, 9 aa, Homo Sapiens
GAVDADESP

SEQ ID NO: 950737 - protein, 9 aa, Homo Sapiens
RFLNDISTA

SEQ ID NO: 950738 - protein, 9 aa, Homo Sapiens
DANEAALGR

SEQ ID NO: 950739 - protein, 9 aa, Homo Sapiens
CCQSKNCSK

SEQ ID NO: 950740 - protein, 9 aa, Homo Sapiens
VAICHLLHY

SEQ ID NO: 950741 - protein, 9 aa, Homo Sapiens
EEETRKLQQ

SEQ ID NO: 950742 - protein, 8 aa, Homo Sapiens
IPSASKNC

SEQ ID NO: 950743 - protein, 9 aa, Homo Sapiens
CVSDHKHHP

SEQ ID NO: 950744 - protein, 9 aa, Homo Sapiens
AVFASIYFM

SEQ ID NO: 950745 - protein, 9 aa, Homo Sapiens
CLCADPYKL

SEQ ID NO: 950746 - protein, 9 aa, Homo Sapiens
SGIIKQQRV

SEQ ID NO: 950747 - protein, 9 aa, Homo Sapiens
IANPATNFQ

SEQ ID NO: 950748 - protein, 9 aa, Homo Sapiens
FLCFSDSTY

SEQ ID NO: 950749 - protein, 9 aa, Homo Sapiens
HTYVSEEPR

SEQ ID NO: 950750 - protein, 9 aa, Homo Sapiens
HLLNNGLNF

SEQ ID NO: 950751 - protein, 9 aa, Homo Sapiens
KKLSIDSSL

SEQ ID NO: 950752 - protein, 9 aa, Homo Sapiens
YLRKIVGSA

SEQ ID NO: 950753 - protein, 9 aa, Homo Sapiens
RELLMPQAE

SEQ ID NO: 950754 - protein, 9 aa, Homo Sapiens
ADWGLVLMP

SEQ ID NO: 950755 - protein, 9 aa, Homo Sapiens
DLSHNRMKT

SEQ ID NO: 950756 - protein, 9 aa, Homo Sapiens
CRCLSGFSG

SEQ ID NO: 950757 - protein, 9 aa, Homo Sapiens
IQEIKRLSP

SEQ ID NO: 950758 - protein, 9 aa, Homo Sapiens
ILKGPLFSG

SEQ ID NO: 950759 - protein, 9 aa, Homo Sapiens
EIKRLSPED

SEQ ID NO: 950760 - protein, 9 aa, Homo Sapiens
EKRFFSPHQ

SEQ ID NO: 950761 - protein, 9 aa, Homo Sapiens
PPALILFAA

SEQ ID NO: 950762 - protein, 9 aa, Homo Sapiens
KATPEISQV

SEQ ID NO: 950763 - protein, 9 aa, Homo Sapiens
PWPRFLGQG

SEQ ID NO: 950764 - protein, 9 aa, Homo Sapiens
AEPLEVHKH

SEQ ID NO: 950765 - protein, 9 aa, Homo Sapiens
GEIGSRDGS

SEQ ID NO: 950766 - protein, 9 aa, Homo Sapiens
CAYETRYLD

SEQ ID NO: 950767 - protein, 9 aa, Homo Sapiens
EFLFPVPPS

SEQ ID NO: 950768 - protein, 9 aa, Homo Sapiens
FCKISDVKK

SEQ ID NO: 950769 - protein, 9 aa, Homo Sapiens
KRGSCASVS

SEQ ID NO: 950770 - protein, 9 aa, Homo Sapiens
TNYQEKKFF

SEQ ID NO: 950771 - protein, 9 aa, Homo Sapiens
KPKIQASGE

SEQ ID NO: 950772 - protein, 9 aa, Homo Sapiens
VAADCGNVE

SEQ ID NO: 950773 - protein, 9 aa, Homo Sapiens
TTQEQDFVI

SEQ ID NO: 950774 - protein, 9 aa, Homo Sapiens
RRRVFSTCS

SEQ ID NO: 950775 - protein, 9 aa, Homo Sapiens
NQALQFLEN

SEQ ID NO: 950776 - protein, 9 aa, Homo Sapiens
AWFCQSLKG

SEQ ID NO: 950777 - protein, 9 aa, Homo Sapiens
WLRVGFVLD

SEQ ID NO: 950778 - protein, 9 aa, Homo Sapiens
PAFIERPKK

SEQ ID NO: 950779 - protein, 9 aa, Homo Sapiens
CRQITCPEG

SEQ ID NO: 950780 - protein, 9 aa, Homo Sapiens
DFGYEKHFL

SEQ ID NO: 950781 - protein, 9 aa, Homo Sapiens
AQAVRDTTT

SEQ ID NO: 950782 - protein, 9 aa, Homo Sapiens
DEKEGEANN

SEQ ID NO: 950783 - protein, 9 aa, Homo Sapiens
SQKKKTGER

SEQ ID NO: 950784 - protein, 9 aa, Homo Sapiens
PPTKAPKVP

SEQ ID NO: 950785 - protein, 9 aa, Homo Sapiens
KSEDKMKAS

SEQ ID NO: 950786 - protein, 9 aa, Homo Sapiens
LSFQKDFSG

SEQ ID NO: 950787 - protein, 9 aa, Homo Sapiens
QDLKKCYSS

SEQ ID NO: 950788 - protein, 9 aa, Homo Sapiens
EWDSSHIVR

SEQ ID NO: 950789 - protein, 9 aa, Homo Sapiens
TPKTCENFM

SEQ ID NO: 950790 - protein, 9 aa, Homo Sapiens
MKQSPLESP

SEQ ID NO: 950791 - protein, 9 aa, Homo Sapiens
VDRTCSSRE

SEQ ID NO: 950792 - protein, 9 aa, Homo Sapiens
PALRAVILR

SEQ ID NO: 950793 - protein, 9 aa, Homo Sapiens
HRPSIHPVL

SEQ ID NO: 950794 - protein, 9 aa, Homo Sapiens
CFSDSTYQA

SEQ ID NO: 950795 - protein, 9 aa, Homo Sapiens
SWGYNGNDV

SEQ ID NO: 950796 - protein, 9 aa, Homo Sapiens
LDLKGSAVP

SEQ ID NO: 950797 - protein, 9 aa, Homo Sapiens
PGSVTEPGF

SEQ ID NO: 950798 - protein, 9 aa, Homo Sapiens
TKPAASQLK

SEQ ID NO: 950799 - protein, 9 aa, Homo Sapiens
PTRKSDDED

SEQ ID NO: 950800 - protein, 9 aa, Homo Sapiens
AGNIEAKSK

SEQ ID NO: 950801 - protein, 9 aa, Homo Sapiens
QCSLETFSL

SEQ ID NO: 950802 - protein, 9 aa, Homo Sapiens
KIFQGNPDL

SEQ ID NO: 950803 - protein, 9 aa, Homo Sapiens
LKTDVADDD

SEQ ID NO: 950804 - protein, 9 aa, Homo Sapiens
YLSGACDKK

SEQ ID NO: 950805 - protein, 9 aa, Homo Sapiens
GLPPLPFMP

SEQ ID NO: 950806 - protein, 9 aa, Homo Sapiens
AALTCACPS

SEQ ID NO: 950807 - protein, 9 aa, Homo Sapiens
RKYLLSSKT

SEQ ID NO: 950808 - protein, 9 aa, Homo Sapiens
PRELLMPQA

SEQ ID NO: 950809 - protein, 9 aa, Homo Sapiens
NIPLMLNDS

SEQ ID NO: 950810 - protein, 9 aa, Homo Sapiens
YEAIYYGIP

SEQ ID NO: 950811 - protein, 9 aa, Homo Sapiens
MMSDGKFLR

SEQ ID NO: 950812 - protein, 9 aa, Homo Sapiens
SYRAPCHIK

SEQ ID NO: 950813 - protein, 9 aa, Homo Sapiens
ADSYPEQEK

SEQ ID NO: 950814 - protein, 9 aa, Homo Sapiens
LCAAVYPII

SEQ ID NO: 950815 - protein, 9 aa, Homo Sapiens
LLTRSELLQ

SEQ ID NO: 950816 - protein, 9 aa, Homo Sapiens
SPAPPATLP

SEQ ID NO: 950817 - protein, 9 aa, Homo Sapiens
LPTQEARSS

SEQ ID NO: 950818 - protein, 9 aa, Homo Sapiens
SISNAASSK

SEQ ID NO: 950819 - protein, 9 aa, Homo Sapiens
ANRRPTRKS

SEQ ID NO: 950820 - protein, 9 aa, Homo Sapiens
TGEKVCECK

SEQ ID NO: 950821 - protein, 9 aa, Homo Sapiens
LADDFTDNP

SEQ ID NO: 950822 - protein, 9 aa, Homo Sapiens
PPADTLFSS

SEQ ID NO: 950823 - protein, 9 aa, Homo Sapiens
ALPPVRPHG

SEQ ID NO: 950824 - protein, 9 aa, Homo Sapiens
HYPDHDLEI

SEQ ID NO: 950825 - protein, 9 aa, Homo Sapiens
WAVFSVMTR

SEQ ID NO: 950826 - protein, 9 aa, Homo Sapiens
MMSYNRYMA

SEQ ID NO: 950827 - protein, 9 aa, Homo Sapiens
GYSWLSLLK

SEQ ID NO: 950828 - protein, 9 aa, Homo Sapiens
SPTPCPPSR

SEQ ID NO: 950829 - protein, 9 aa, Homo Sapiens
SGPKGQKGK

SEQ ID NO: 950830 - protein, 9 aa, Homo Sapiens
LGKKEEKFS

SEQ ID NO: 950831 - protein, 9 aa, Homo Sapiens
LVSCEHEGG

SEQ ID NO: 950832 - protein, 9 aa, Homo Sapiens
KRGCVFCGV

SEQ ID NO: 950833 - protein, 9 aa, Homo Sapiens
WGLLDCRQI

SEQ ID NO: 950834 - protein, 9 aa, Homo Sapiens
LKIMDAKHK

SEQ ID NO: 950835 - protein, 9 aa, Homo Sapiens
SPGDTGKDG

SEQ ID NO: 950836 - protein, 9 aa, Homo Sapiens
AHPLNLPVA

SEQ ID NO: 950837 - protein, 9 aa, Homo Sapiens
PGSLENSNN

SEQ ID NO: 950838 - protein, 9 aa, Homo Sapiens
PLSYAFIVA

SEQ ID NO: 950839 - protein, 9 aa, Homo Sapiens
AVGKKRSTI

SEQ ID NO: 950840 - protein, 9 aa, Homo Sapiens
TFLNISISL

SEQ ID NO: 950841 - protein, 9 aa, Homo Sapiens
LSPGAIDSN

SEQ ID NO: 950842 - protein, 9 aa, Homo Sapiens
SEYVVKVSL

SEQ ID NO: 950843 - protein, 9 aa, Homo Sapiens
VVEEDASSS

SEQ ID NO: 950844 - protein, 9 aa, Homo Sapiens
KLYAATAMD

SEQ ID NO: 950845 - protein, 9 aa, Homo Sapiens
KHKEKQKVD

SEQ ID NO: 950846 - protein, 9 aa, Homo Sapiens
VNENLHTSY

SEQ ID NO: 950847 - protein, 9 aa, Homo Sapiens
LRTRYSVPY

SEQ ID NO: 950848 - protein, 9 aa, Homo Sapiens
EYSPFRCIS

SEQ ID NO: 950849 - protein, 9 aa, Homo Sapiens
HYFTPGMKP

SEQ ID NO: 950850 - protein, 9 aa, Homo Sapiens
DQSPHILRK

SEQ ID NO: 950851 - protein, 9 aa, Homo Sapiens
PNSSVLIGN

SEQ ID NO: 950852 - protein, 9 aa, Homo Sapiens
RIKTTVFQR

SEQ ID NO: 950853 - protein, 9 aa, Homo Sapiens
AGINEELSY

SEQ ID NO: 950854 - protein, 9 aa, Homo Sapiens
QVGYSWLSL

SEQ ID NO: 950855 - protein, 9 aa, Homo Sapiens
FDSGVSSFI

SEQ ID NO: 950856 - protein, 9 aa, Homo Sapiens
DDLQDFLLK

SEQ ID NO: 950857 - protein, 9 aa, Homo Sapiens
AGNPGPLGE

SEQ ID NO: 950858 - protein, 9 aa, Homo Sapiens
NVSSERIAT

SEQ ID NO: 950859 - protein, 9 aa, Homo Sapiens
TWFIMVVAI

SEQ ID NO: 950860 - protein, 9 aa, Homo Sapiens
LSQDEEEGV

SEQ ID NO: 950861 - protein, 9 aa, Homo Sapiens
DEIKSQGGV

SEQ ID NO: 950862 - protein, 9 aa, Homo Sapiens
PVFFPGGAA

SEQ ID NO: 950863 - protein, 9 aa, Homo Sapiens
NTQARGQLK

SEQ ID NO: 950864 - protein, 9 aa, Homo Sapiens
SIENKTTKI

SEQ ID NO: 950865 - protein, 9 aa, Homo Sapiens
EGGFTRKYL

SEQ ID NO: 950866 - protein, 9 aa, Homo Sapiens
MFKTFNVPA

SEQ ID NO: 950867 - protein, 9 aa, Homo Sapiens
PENNLSEIE

SEQ ID NO: 950868 - protein, 9 aa, Homo Sapiens
NASEEKKAR

SEQ ID NO: 950869 - protein, 9 aa, Homo Sapiens
NGPELLPCV

SEQ ID NO: 950870 - protein, 9 aa, Homo Sapiens
KSVNIEERG

SEQ ID NO: 950871 - protein, 9 aa, Homo Sapiens
IKTSYLSII

SEQ ID NO: 950872 - protein, 9 aa, Homo Sapiens
LVYGATPSL

SEQ ID NO: 950873 - protein, 9 aa, Homo Sapiens
SSMDGFWMK

SEQ ID NO: 950874 - protein, 9 aa, Homo Sapiens
DPHSGQGFG

SEQ ID NO: 950875 - protein, 9 aa, Homo Sapiens
ENIMPTTYI

SEQ ID NO: 950876 - protein, 9 aa, Homo Sapiens
IAMRGSQPS

SEQ ID NO: 950877 - protein, 9 aa, Homo Sapiens
EEKTVEVPF

SEQ ID NO: 950878 - protein, 9 aa, Homo Sapiens
FFPAAKPKE

SEQ ID NO: 950879 - protein, 9 aa, Homo Sapiens
RLIPEAFLA

SEQ ID NO: 950880 - protein, 9 aa, Homo Sapiens
LGFILTYAF

SEQ ID NO: 950881 - protein, 9 aa, Homo Sapiens
PARKPPHEP

SEQ ID NO: 950882 - protein, 9 aa, Homo Sapiens
KEGEGGVCL

SEQ ID NO: 950883 - protein, 9 aa, Homo Sapiens
KSSITELLE

SEQ ID NO: 950884 - protein, 9 aa, Homo Sapiens
VSRERSGFP

SEQ ID NO: 950885 - protein, 9 aa, Homo Sapiens
DHSLERERA

SEQ ID NO: 950886 - protein, 9 aa, Homo Sapiens
VGLFGPPMP

SEQ ID NO: 950887 - protein, 9 aa, Homo Sapiens
SLVRAQTCP

SEQ ID NO: 950888 - protein, 9 aa, Homo Sapiens
GPPALILFA

SEQ ID NO: 950889 - protein, 9 aa, Homo Sapiens
QVAVNGAHL

SEQ ID NO: 950890 - protein, 9 aa, Homo Sapiens
GHSMTLDWK

SEQ ID NO: 950891 - protein, 9 aa, Homo Sapiens
SPRSPEKEE

SEQ ID NO: 950892 - protein, 9 aa, Homo Sapiens
SVSFQSGGS

SEQ ID NO: 950893 - protein, 9 aa, Homo Sapiens
YKYKTKVVF

SEQ ID NO: 950894 - protein, 9 aa, Homo Sapiens
ELPQNGTST

SEQ ID NO: 950895 - protein, 9 aa, Homo Sapiens
IKGFPSPRI

SEQ ID NO: 950896 - protein, 9 aa, Homo Sapiens
LRRPDSGDV

SEQ ID NO: 950897 - protein, 9 aa, Homo Sapiens
RFSSESKQE

SEQ ID NO: 950898 - protein, 9 aa, Homo Sapiens
SMEHPAQNV

SEQ ID NO: 950899 - protein, 9 aa, Homo Sapiens
GQSYPDSVL

SEQ ID NO: 950900 - protein, 9 aa, Homo Sapiens
LTPDDVWIL

SEQ ID NO: 950901 - protein, 9 aa, Homo Sapiens
FSLLMTLFE

SEQ ID NO: 950902 - protein, 9 aa, Homo Sapiens
CSVLGLRKW

SEQ ID NO: 950903 - protein, 9 aa, Homo Sapiens
ASGQPLPTI

SEQ ID NO: 950904 - protein, 9 aa, Homo Sapiens
RVSERLRGG

SEQ ID NO: 950905 - protein, 9 aa, Homo Sapiens
IMVKEFKNQ

SEQ ID NO: 950906 - protein, 9 aa, Homo Sapiens
DSILGVTEA

SEQ ID NO: 950907 - protein, 9 aa, Homo Sapiens
RIFQEICVV

SEQ ID NO: 950908 - protein, 9 aa, Homo Sapiens
LSTISWGLP

SEQ ID NO: 950909 - protein, 9 aa, Homo Sapiens
KQRPVGPRN

SEQ ID NO: 950910 - protein, 9 aa, Homo Sapiens
MHETLQYHV

SEQ ID NO: 950911 - protein, 9 aa, Homo Sapiens
ECSSIRITS

SEQ ID NO: 950912 - protein, 9 aa, Homo Sapiens
EIDFLCSNP

SEQ ID NO: 950913 - protein, 9 aa, Homo Sapiens
DALAALYVL

SEQ ID NO: 950914 - protein, 9 aa, Homo Sapiens
DRARVQRHF

SEQ ID NO: 950915 - protein, 9 aa, Homo Sapiens
SSFHDFPDF

SEQ ID NO: 950916 - protein, 9 aa, Homo Sapiens
PAHPLNLPV

SEQ ID NO: 950917 - protein, 9 aa, Homo Sapiens
KTSSVPKPR

SEQ ID NO: 950918 - protein, 9 aa, Homo Sapiens
WDKSLAPKH

SEQ ID NO: 950919 - protein, 9 aa, Homo Sapiens
KTRVHFHPK

SEQ ID NO: 950920 - protein, 9 aa, Homo Sapiens
NPCFHPGYK

SEQ ID NO: 950921 - protein, 9 aa, Homo Sapiens
VYESIGFLR

SEQ ID NO: 950922 - protein, 9 aa, Homo Sapiens
WFCQSLKGL

SEQ ID NO: 950923 - protein, 9 aa, Homo Sapiens
TCPVLILHW

SEQ ID NO: 950924 - protein, 9 aa, Homo Sapiens
HVPDLEARP

SEQ ID NO: 950925 - protein, 9 aa, Homo Sapiens
QSSVSFQSG

SEQ ID NO: 950926 - protein, 9 aa, Homo Sapiens
YTLERYHSL

SEQ ID NO: 950927 - protein, 9 aa, Homo Sapiens
GKFFSRKSA

SEQ ID NO: 950928 - protein, 9 aa, Homo Sapiens
ECKEILEIT

SEQ ID NO: 950929 - protein, 9 aa, Homo Sapiens
LICTVFQTY

SEQ ID NO: 950930 - protein, 9 aa, Homo Sapiens
NQSDIVEIP

SEQ ID NO: 950931 - protein, 9 aa, Homo Sapiens
QVEGKYIWS

SEQ ID NO: 950932 - protein, 9 aa, Homo Sapiens
LPVPRFCLF

SEQ ID NO: 950933 - protein, 9 aa, Homo Sapiens
RLFLKRGDD

SEQ ID NO: 950934 - protein, 9 aa, Homo Sapiens
AFCYDTQLS

SEQ ID NO: 950935 - protein, 9 aa, Homo Sapiens
LQNTHEFEN

SEQ ID NO: 950936 - protein, 9 aa, Homo Sapiens
SELPGSLEN

SEQ ID NO: 950937 - protein, 9 aa, Homo Sapiens
FEYPKSSGP

SEQ ID NO: 950938 - protein, 9 aa, Homo Sapiens
GIRTFKISV

SEQ ID NO: 950939 - protein, 9 aa, Homo Sapiens
HLFCMYDAD

SEQ ID NO: 950940 - protein, 9 aa, Homo Sapiens
AGKMIQVPE

SEQ ID NO: 950941 - protein, 9 aa, Homo Sapiens
FSPAVTSLA

SEQ ID NO: 950942 - protein, 9 aa, Homo Sapiens
VLNQEPFHK

SEQ ID NO: 950943 - protein, 9 aa, Homo Sapiens
VVAPLLGAS

SEQ ID NO: 950944 - protein, 9 aa, Homo Sapiens
ITTASITDS

SEQ ID NO: 950945 - protein, 9 aa, Homo Sapiens
MKAKSTVCD

SEQ ID NO: 950946 - protein, 9 aa, Homo Sapiens
QSLPAVVPA

SEQ ID NO: 950947 - protein, 9 aa, Homo Sapiens
FSEHARTYI

SEQ ID NO: 950948 - protein, 9 aa, Homo Sapiens
GQSATAHKP

SEQ ID NO: 950949 - protein, 9 aa, Homo Sapiens
DGMRVTLRK

SEQ ID NO: 950950 - protein, 9 aa, Homo Sapiens
SSNFGAPHP

SEQ ID NO: 950951 - protein, 9 aa, Homo Sapiens
LVTLMENIL

SEQ ID NO: 950952 - protein, 9 aa, Homo Sapiens
SQHGIYDGL

SEQ ID NO: 950953 - protein, 9 aa, Homo Sapiens
YSSYDFMKQ

SEQ ID NO: 950954 - protein, 9 aa, Homo Sapiens
KGNSKQYKI

SEQ ID NO: 950955 - protein, 9 aa, Homo Sapiens
FVGGAKFDL

SEQ ID NO: 950956 - protein, 9 aa, Homo Sapiens
KFFSFDYSY

SEQ ID NO: 950957 - protein, 9 aa, Homo Sapiens
NKSDNENGR

SEQ ID NO: 950958 - protein, 9 aa, Homo Sapiens
KGRKKDCPR

SEQ ID NO: 950959 - protein, 9 aa, Homo Sapiens
IGFEKRLKI

SEQ ID NO: 950960 - protein, 9 aa, Homo Sapiens
ECGKIFQGN

SEQ ID NO: 950961 - protein, 9 aa, Homo Sapiens
DLEQKMFGS

SEQ ID NO: 950962 - protein, 9 aa, Homo Sapiens
SYSAGTELS

SEQ ID NO: 950963 - protein, 9 aa, Homo Sapiens
LNPWERNMA

SEQ ID NO: 950964 - protein, 9 aa, Homo Sapiens
HHRGRGGKP

SEQ ID NO: 950965 - protein, 9 aa, Homo Sapiens
SSSDNQGSS

SEQ ID NO: 950966 - protein, 9 aa, Homo Sapiens
MGFRLLCWV

SEQ ID NO: 950967 - protein, 9 aa, Homo Sapiens
SHECQGSGR

SEQ ID NO: 950968 - protein, 9 aa, Homo Sapiens
QVADWKAGQ

SEQ ID NO: 950969 - protein, 9 aa, Homo Sapiens
RFCLFSESF

SEQ ID NO: 950970 - protein, 9 aa, Homo Sapiens
SSTTMKKEK

SEQ ID NO: 950971 - protein, 9 aa, Homo Sapiens
VNIEERGDM

SEQ ID NO: 950972 - protein, 9 aa, Homo Sapiens
GLFVSAKGN

SEQ ID NO: 950973 - protein, 9 aa, Homo Sapiens
KYDQAVYQE

SEQ ID NO: 950974 - protein, 9 aa, Homo Sapiens
GQPKVGASG

SEQ ID NO: 950975 - protein, 9 aa, Homo Sapiens
TKWINDTIK

SEQ ID NO: 950976 - protein, 9 aa, Homo Sapiens
YWTDWGDYS

SEQ ID NO: 950977 - protein, 9 aa, Homo Sapiens
SFASHSNYP

SEQ ID NO: 950978 - protein, 9 aa, Homo Sapiens
PIDVDGLRV

SEQ ID NO: 950979 - protein, 9 aa, Homo Sapiens
AWPLGTGER

SEQ ID NO: 950980 - protein, 9 aa, Homo Sapiens
VLLPENNLS

SEQ ID NO: 950981 - protein, 9 aa, Homo Sapiens
NGAHLQNVF

SEQ ID NO: 950982 - protein, 9 aa, Homo Sapiens
DTAVKVLLH

SEQ ID NO: 950983 - protein, 9 aa, Homo Sapiens
YIIFPSQFY

SEQ ID NO: 950984 - protein, 9 aa, Homo Sapiens
ANPIFYGFL

SEQ ID NO: 950985 - protein, 9 aa, Homo Sapiens
NFVSRQHKQ

SEQ ID NO: 950986 - protein, 9 aa, Homo Sapiens
CDNDYSLAG

SEQ ID NO: 950987 - protein, 9 aa, Homo Sapiens
TQSPPADTL

SEQ ID NO: 950988 - protein, 9 aa, Homo Sapiens
QSLIFQANE

SEQ ID NO: 950989 - protein, 9 aa, Homo Sapiens
HKKLTVDEW

SEQ ID NO: 950990 - protein, 9 aa, Homo Sapiens
REFKPLCGH

SEQ ID NO: 950991 - protein, 9 aa, Homo Sapiens
GHFLLDPDS

SEQ ID NO: 950992 - protein, 9 aa, Homo Sapiens
DAFNLCEDI

SEQ ID NO: 950993 - protein, 9 aa, Homo Sapiens
RLYFILGTT

SEQ ID NO: 950994 - protein, 9 aa, Homo Sapiens
KKEKESFLS

SEQ ID NO: 950995 - protein, 9 aa, Homo Sapiens
IRQEIEIMS

SEQ ID NO: 950996 - protein, 9 aa, Homo Sapiens
QRESTTFQS

SEQ ID NO: 950997 - protein, 9 aa, Homo Sapiens
HALLVGVGE

SEQ ID NO: 950998 - protein, 9 aa, Homo Sapiens
PFRQYPAHV

SEQ ID NO: 950999 - protein, 9 aa, Homo Sapiens
EDAFHIFQD

SEQ ID NO: 951000 - protein, 9 aa, Homo Sapiens
ASGKSIEVL

SEQ ID NO: 951001 - protein, 9 aa, Homo Sapiens
KNLNFWPQL

SEQ ID NO: 951002 - protein, 9 aa, Homo Sapiens
PAASPSLSQ

SEQ ID NO: 951003 - protein, 9 aa, Homo Sapiens
DRFVAICHL

SEQ ID NO: 951004 - protein, 9 aa, Homo Sapiens
EAEERKLLQ

SEQ ID NO: 951005 - protein, 9 aa, Homo Sapiens
KEVEEEEVE

SEQ ID NO: 951006 - protein, 9 aa, Homo Sapiens
CFVCLDAPG

SEQ ID NO: 951007 - protein, 9 aa, Homo Sapiens
LEDCLHCQT

SEQ ID NO: 951008 - protein, 9 aa, Homo Sapiens
SQQNPDFAG

SEQ ID NO: 951009 - protein, 9 aa, Homo Sapiens
IPEFPGNGS

SEQ ID NO: 951010 - protein, 9 aa, Homo Sapiens
ASSFAPNKN

SEQ ID NO: 951011 - protein, 9 aa, Homo Sapiens
MIEKYFVFP

SEQ ID NO: 951012 - protein, 9 aa, Homo Sapiens
KQPLLFGIF

SEQ ID NO: 951013 - protein, 9 aa, Homo Sapiens
GRPFLIARI

SEQ ID NO: 951014 - protein, 9 aa, Homo Sapiens
LIIYIKEAH

SEQ ID NO: 951015 - protein, 9 aa, Homo Sapiens
MHFSPKGRP

SEQ ID NO: 951016 - protein, 9 aa, Homo Sapiens
KKWLYALED

SEQ ID NO: 951017 - protein, 9 aa, Homo Sapiens
KKETPVTHL

SEQ ID NO: 951018 - protein, 9 aa, Homo Sapiens
YKRLTLYSG

SEQ ID NO: 951019 - protein, 9 aa, Homo Sapiens
LQDFLLKDK

SEQ ID NO: 951020 - protein, 9 aa, Homo Sapiens
CGKASNQKG

SEQ ID NO: 951021 - protein, 9 aa, Homo Sapiens
FTPLANPPD

SEQ ID NO: 951022 - protein, 9 aa, Homo Sapiens
GDERSKETP

SEQ ID NO: 951023 - protein, 9 aa, Homo Sapiens
GDAVLSMAL

SEQ ID NO: 951024 - protein, 9 aa, Homo Sapiens
LHLSRMKSS

SEQ ID NO: 951025 - protein, 9 aa, Homo Sapiens
GREQPAQPN

SEQ ID NO: 951026 - protein, 9 aa, Homo Sapiens
LHEPPPEPE

SEQ ID NO: 951027 - protein, 9 aa, Homo Sapiens
SAEVVFEKC

SEQ ID NO: 951028 - protein, 9 aa, Homo Sapiens
LKKTLLLYK

SEQ ID NO: 951029 - protein, 9 aa, Homo Sapiens
MVLSQELAE

SEQ ID NO: 951030 - protein, 9 aa, Homo Sapiens
SPKGRPKRA

SEQ ID NO: 951031 - protein, 9 aa, Homo Sapiens
SWRSEVTFF

SEQ ID NO: 951032 - protein, 9 aa, Homo Sapiens
CLGLLCVFF

SEQ ID NO: 951033 - protein, 9 aa, Homo Sapiens
GAPGLQEMP

SEQ ID NO: 951034 - protein, 9 aa, Homo Sapiens
ISYPSHGWK

SEQ ID NO: 951035 - protein, 9 aa, Homo Sapiens
SYTWELFPH

SEQ ID NO: 951036 - protein, 9 aa, Homo Sapiens
GTVQTAVDT

SEQ ID NO: 951037 - protein, 9 aa, Homo Sapiens
RNSRKNFAI

SEQ ID NO: 951038 - protein, 9 aa, Homo Sapiens
FIPNDAEEL

SEQ ID NO: 951039 - protein, 9 aa, Homo Sapiens
FFRIRAVNK

SEQ ID NO: 951040 - protein, 9 aa, Homo Sapiens
TGSCDTSPN

SEQ ID NO: 951041 - protein, 9 aa, Homo Sapiens
ACIHMMPNA

SEQ ID NO: 951042 - protein, 9 aa, Homo Sapiens
TVSDDKTLC

SEQ ID NO: 951043 - protein, 9 aa, Homo Sapiens
RFTRSLFLS

SEQ ID NO: 951044 - protein, 9 aa, Homo Sapiens
RRLIPEAFL

SEQ ID NO: 951045 - protein, 9 aa, Homo Sapiens
TELFMQLLL

SEQ ID NO: 951046 - protein, 9 aa, Homo Sapiens
SLENSNNDC

SEQ ID NO: 951047 - protein, 9 aa, Homo Sapiens
SEENINKNN

SEQ ID NO: 951048 - protein, 9 aa, Homo Sapiens
LWDLGGGAE

SEQ ID NO: 951049 - protein, 9 aa, Homo Sapiens
NHFWGIYPE

SEQ ID NO: 951050 - protein, 9 aa, Homo Sapiens
QPFPKKFSF

SEQ ID NO: 951051 - protein, 9 aa, Homo Sapiens
YIILFQPQK

SEQ ID NO: 951052 - protein, 9 aa, Homo Sapiens
FSSIERLFF

SEQ ID NO: 951053 - protein, 9 aa, Homo Sapiens
ATNLKNFNE

SEQ ID NO: 951054 - protein, 9 aa, Homo Sapiens
AGLSKPFSP

SEQ ID NO: 951055 - protein, 9 aa, Homo Sapiens
IKTTVFQRS

SEQ ID NO: 951056 - protein, 9 aa, Homo Sapiens
FDAGDYFLL

SEQ ID NO: 951057 - protein, 9 aa, Homo Sapiens
RCCQGHCEE

SEQ ID NO: 951058 - protein, 9 aa, Homo Sapiens
FEKRLKIFF

SEQ ID NO: 951059 - protein, 9 aa, Homo Sapiens
FDWNPSLFR

SEQ ID NO: 951060 - protein, 9 aa, Homo Sapiens
REVKVVAKE

SEQ ID NO: 951061 - protein, 9 aa, Homo Sapiens
FFFFFFFVL

SEQ ID NO: 951062 - protein, 9 aa, Homo Sapiens
RKPRLTASL

SEQ ID NO: 951063 - protein, 9 aa, Homo Sapiens
NVIGKAKSL

SEQ ID NO: 951064 - protein, 9 aa, Homo Sapiens
NEQRPSGAW

SEQ ID NO: 951065 - protein, 9 aa, Homo Sapiens
DIDKLFYVR

SEQ ID NO: 951066 - protein, 9 aa, Homo Sapiens
LREMKEGPE

SEQ ID NO: 951067 - protein, 9 aa, Homo Sapiens
SQEAPSSFS

SEQ ID NO: 951068 - protein, 9 aa, Homo Sapiens
PPGLVLSGD

SEQ ID NO: 951069 - protein, 9 aa, Homo Sapiens
EGDSEPEVV

SEQ ID NO: 951070 - protein, 9 aa, Homo Sapiens
KIFMTELRT

SEQ ID NO: 951071 - protein, 9 aa, Homo Sapiens
VQAAGSGGL

SEQ ID NO: 951072 - protein, 9 aa, Homo Sapiens
ACVGLGITT

SEQ ID NO: 951073 - protein, 9 aa, Homo Sapiens
CGNCGEILD

SEQ ID NO: 951074 - protein, 9 aa, Homo Sapiens
LNLDCWKRK

SEQ ID NO: 951075 - protein, 9 aa, Homo Sapiens
MKKKLDYFA

SEQ ID NO: 951076 - protein, 9 aa, Homo Sapiens
SPEKEEPHL

SEQ ID NO: 951077 - protein, 9 aa, Homo Sapiens
ALDELQKEC

SEQ ID NO: 951078 - protein, 9 aa, Homo Sapiens
EVGEAADPT

SEQ ID NO: 951079 - protein, 9 aa, Homo Sapiens
QLLILKGPL

SEQ ID NO: 951080 - protein, 9 aa, Homo Sapiens
FILTYAFLG

SEQ ID NO: 951081 - protein, 9 aa, Homo Sapiens
YRAGLQLVS

SEQ ID NO: 951082 - protein, 9 aa, Homo Sapiens
PPALDRELP

SEQ ID NO: 951083 - protein, 9 aa, Homo Sapiens
KPPHEPHVY

SEQ ID NO: 951084 - protein, 9 aa, Homo Sapiens
DQFTYTLDH

SEQ ID NO: 951085 - protein, 9 aa, Homo Sapiens
PFFSNVYPG

SEQ ID NO: 951086 - protein, 9 aa, Homo Sapiens
LSRNCFTEI

SEQ ID NO: 951087 - protein, 9 aa, Homo Sapiens
CDFLKINHG

SEQ ID NO: 951088 - protein, 9 aa, Homo Sapiens
AHYDQQIGQ

SEQ ID NO: 951089 - protein, 9 aa, Homo Sapiens
QWSQRLSPK

SEQ ID NO: 951090 - protein, 9 aa, Homo Sapiens
AESFSGGEL

SEQ ID NO: 951091 - protein, 9 aa, Homo Sapiens
SLPGENGAP

SEQ ID NO: 951092 - protein, 9 aa, Homo Sapiens
HLQNNMTSL

SEQ ID NO: 951093 - protein, 9 aa, Homo Sapiens
RVPSSLAES

SEQ ID NO: 951094 - protein, 9 aa, Homo Sapiens
YLLFGYVYV

SEQ ID NO: 951095 - protein, 9 aa, Homo Sapiens
LTLAYSASW

SEQ ID NO: 951096 - protein, 9 aa, Homo Sapiens
ERERASLIF

SEQ ID NO: 951097 - protein, 9 aa, Homo Sapiens
EERRLPPAP

SEQ ID NO: 951098 - protein, 9 aa, Homo Sapiens
SDNQGSSVE

SEQ ID NO: 951099 - protein, 9 aa, Homo Sapiens
TFSWDEDPE

SEQ ID NO: 951100 - protein, 9 aa, Homo Sapiens
YGYSYNALI

SEQ ID NO: 951101 - protein, 9 aa, Homo Sapiens
LGIANPATN

SEQ ID NO: 951102 - protein, 9 aa, Homo Sapiens
STSKIDLPM

SEQ ID NO: 951103 - protein, 9 aa, Homo Sapiens
EDINVSPEM

SEQ ID NO: 951104 - protein, 9 aa, Homo Sapiens
EKKQQLAEE

SEQ ID NO: 951105 - protein, 9 aa, Homo Sapiens
DKSLAPKHP

SEQ ID NO: 951106 - protein, 9 aa, Homo Sapiens
QQNFELVVF

SEQ ID NO: 951107 - protein, 9 aa, Homo Sapiens
VSPRSPEWM

SEQ ID NO: 951108 - protein, 9 aa, Homo Sapiens
VWTTGSSLS

SEQ ID NO: 951109 - protein, 9 aa, Homo Sapiens
EPGRSKESF

SEQ ID NO: 951110 - protein, 9 aa, Homo Sapiens
AQFTPLANP

SEQ ID NO: 951111 - protein, 9 aa, Homo Sapiens
ASGETFPTD

SEQ ID NO: 951112 - protein, 9 aa, Homo Sapiens
GAGFANQGD

SEQ ID NO: 951113 - protein, 9 aa, Homo Sapiens
AKEEFLFPV

SEQ ID NO: 951114 - protein, 9 aa, Homo Sapiens
GQHPDLRQN

SEQ ID NO: 951115 - protein, 9 aa, Homo Sapiens
TKKLPQGVV

SEQ ID NO: 951116 - protein, 9 aa, Homo Sapiens
AASGFTDKK

SEQ ID NO: 951117 - protein, 9 aa, Homo Sapiens
PPHEPHVYL

SEQ ID NO: 951118 - protein, 9 aa, Homo Sapiens
VSPAQSSLE

SEQ ID NO: 951119 - protein, 9 aa, Homo Sapiens
DYEGLPTVV

SEQ ID NO: 951120 - protein, 9 aa, Homo Sapiens
PDLEARPSS

SEQ ID NO: 951121 - protein, 9 aa, Homo Sapiens
QANKIVLLE

SEQ ID NO: 951122 - protein, 9 aa, Homo Sapiens
TFEDLSEID

SEQ ID NO: 951123 - protein, 9 aa, Homo Sapiens
EPRRQKFHR

SEQ ID NO: 951124 - protein, 9 aa, Homo Sapiens
RREDEAKIC

SEQ ID NO: 951125 - protein, 9 aa, Homo Sapiens
KVCKAASSI

SEQ ID NO: 951126 - protein, 9 aa, Homo Sapiens
LSEIDGLVV

SEQ ID NO: 951127 - protein, 9 aa, Homo Sapiens
VLHRLCTSR

SEQ ID NO: 951128 - protein, 9 aa, Homo Sapiens
IRSLKNLVP

SEQ ID NO: 951129 - protein, 9 aa, Homo Sapiens
LYFNGPEKR

SEQ ID NO: 951130 - protein, 9 aa, Homo Sapiens
MSFFISLIL

SEQ ID NO: 951131 - protein, 9 aa, Homo Sapiens
CVKPQKLPP

SEQ ID NO: 951132 - protein, 9 aa, Homo Sapiens
EKEPPCFLQ

SEQ ID NO: 951133 - protein, 9 aa, Homo Sapiens
ESKFLKSQV

SEQ ID NO: 951134 - protein, 9 aa, Homo Sapiens
EPDKGDPFS

SEQ ID NO: 951135 - protein, 9 aa, Homo Sapiens
MYMVRAINL

SEQ ID NO: 951136 - protein, 9 aa, Homo Sapiens
VFLERLCFE

SEQ ID NO: 951137 - protein, 9 aa, Homo Sapiens
LGCSYACGG

SEQ ID NO: 951138 - protein, 9 aa, Homo Sapiens
EFILFLMAA

SEQ ID NO: 951139 - protein, 9 aa, Homo Sapiens
KASACNLFL

SEQ ID NO: 951140 - protein, 9 aa, Homo Sapiens
LWGEEYNWH

SEQ ID NO: 951141 - protein, 9 aa, Homo Sapiens
QQKDESQSF

SEQ ID NO: 951142 - protein, 9 aa, Homo Sapiens
AVYESIGFL

SEQ ID NO: 951143 - protein, 9 aa, Homo Sapiens
LFNCANRTI

SEQ ID NO: 951144 - protein, 9 aa, Homo Sapiens
PLYFCRINA

SEQ ID NO: 951145 - protein, 9 aa, Homo Sapiens
IADRMQKKI

SEQ ID NO: 951146 - protein, 9 aa, Homo Sapiens
CVVYTGKKP

SEQ ID NO: 951147 - protein, 9 aa, Homo Sapiens
VEKIVNTGV

SEQ ID NO: 951148 - protein, 9 aa, Homo Sapiens
PLLRARSSS

SEQ ID NO: 951149 - protein, 9 aa, Homo Sapiens
VKNSPGVYT

SEQ ID NO: 951150 - protein, 9 aa, Homo Sapiens
CHRRKDRKQ

SEQ ID NO: 951151 - protein, 9 aa, Homo Sapiens
HHGITPGKM

SEQ ID NO: 951152 - protein, 9 aa, Homo Sapiens
LMADSVQVM

SEQ ID NO: 951153 - protein, 9 aa, Homo Sapiens
ALLTHRARL

SEQ ID NO: 951154 - protein, 9 aa, Homo Sapiens
IDTYGKELY

SEQ ID NO: 951155 - protein, 9 aa, Homo Sapiens
GKASNQKGA

SEQ ID NO: 951156 - protein, 9 aa, Homo Sapiens
RKTSKLTFY

SEQ ID NO: 951157 - protein, 9 aa, Homo Sapiens
NHLDTVEGL

SEQ ID NO: 951158 - protein, 9 aa, Homo Sapiens
KGFFKPSEH

SEQ ID NO: 951159 - protein, 9 aa, Homo Sapiens
PRLLSGPEN

SEQ ID NO: 951160 - protein, 9 aa, Homo Sapiens
QLFCLHCGG

SEQ ID NO: 951161 - protein, 9 aa, Homo Sapiens
AYMNFITHP

SEQ ID NO: 951162 - protein, 9 aa, Homo Sapiens
VYGVLGGAF

SEQ ID NO: 951163 - protein, 9 aa, Homo Sapiens
SKEIEWDDL

SEQ ID NO: 951164 - protein, 9 aa, Homo Sapiens
QRHKEEEEF

SEQ ID NO: 951165 - protein, 9 aa, Homo Sapiens
LVVEEDASS

SEQ ID NO: 951166 - protein, 9 aa, Homo Sapiens
QYYDYDFSL

SEQ ID NO: 951167 - protein, 9 aa, Homo Sapiens
PMSLRIVAL

SEQ ID NO: 951168 - protein, 9 aa, Homo Sapiens
FFCESSQEG

SEQ ID NO: 951169 - protein, 9 aa, Homo Sapiens
NAESLKSLL

SEQ ID NO: 951170 - protein, 9 aa, Homo Sapiens
NGENLAVTG

SEQ ID NO: 951171 - protein, 9 aa, Homo Sapiens
LVNQLDSDH

SEQ ID NO: 951172 - protein, 9 aa, Homo Sapiens
NALPSVLLS

SEQ ID NO: 951173 - protein, 9 aa, Homo Sapiens
KPALFSRTS

SEQ ID NO: 951174 - protein, 9 aa, Homo Sapiens
VPVLAWPFS

SEQ ID NO: 951175 - protein, 9 aa, Homo Sapiens
TLLASERLM

SEQ ID NO: 951176 - protein, 9 aa, Homo Sapiens
SLGGSFASV

SEQ ID NO: 951177 - protein, 9 aa, Homo Sapiens
RPQRSIAFR

SEQ ID NO: 951178 - protein, 9 aa, Homo Sapiens
MVKEFKNQP

SEQ ID NO: 951179 - protein, 9 aa, Homo Sapiens
LFCSKNLSL

SEQ ID NO: 951180 - protein, 9 aa, Homo Sapiens
SIFDLVENI

SEQ ID NO: 951181 - protein, 9 aa, Homo Sapiens
QKQFTQKFY

SEQ ID NO: 951182 - protein, 9 aa, Homo Sapiens
MTQIKIDDK

SEQ ID NO: 951183 - protein, 9 aa, Homo Sapiens
SMGSGAAPS

SEQ ID NO: 951184 - protein, 9 aa, Homo Sapiens
PSCICHREL

SEQ ID NO: 951185 - protein, 9 aa, Homo Sapiens
WPQYLPLWM

SEQ ID NO: 951186 - protein, 9 aa, Homo Sapiens
DYENEKVNM

SEQ ID NO: 951187 - protein, 9 aa, Homo Sapiens
SSKPGSPRS

SEQ ID NO: 951188 - protein, 9 aa, Homo Sapiens
PTLPVALSL

SEQ ID NO: 951189 - protein, 9 aa, Homo Sapiens
GPQRNPVWN

SEQ ID NO: 951190 - protein, 9 aa, Homo Sapiens
QYKIFKGTL

SEQ ID NO: 951191 - protein, 9 aa, Homo Sapiens
SLEDESKFL

SEQ ID NO: 951192 - protein, 9 aa, Homo Sapiens
KPPGNLFSL

SEQ ID NO: 951193 - protein, 9 aa, Homo Sapiens
EESWLNPWE

SEQ ID NO: 951194 - protein, 9 aa, Homo Sapiens
YWYRQILRQ

SEQ ID NO: 951195 - protein, 9 aa, Homo Sapiens
ISDHKLIVS

SEQ ID NO: 951196 - protein, 9 aa, Homo Sapiens
YPEVLNQEP

SEQ ID NO: 951197 - protein, 9 aa, Homo Sapiens
RKIPAQQAG

SEQ ID NO: 951198 - protein, 9 aa, Homo Sapiens
YCGSVHFGL

SEQ ID NO: 951199 - protein, 9 aa, Homo Sapiens
NGLGYSARP

SEQ ID NO: 951200 - protein, 9 aa, Homo Sapiens
GKDQPRRLK

SEQ ID NO: 951201 - protein, 9 aa, Homo Sapiens
LCINRLREM

SEQ ID NO: 951202 - protein, 9 aa, Homo Sapiens
LDWPVQQRA

SEQ ID NO: 951203 - protein, 9 aa, Homo Sapiens
QKKKTGERP

SEQ ID NO: 951204 - protein, 9 aa, Homo Sapiens
PRPMPSVLE

SEQ ID NO: 951205 - protein, 9 aa, Homo Sapiens
DNQTLLNQP

SEQ ID NO: 951206 - protein, 9 aa, Homo Sapiens
GIYDGLTVH

SEQ ID NO: 951207 - protein, 9 aa, Homo Sapiens
TTLQMTIWL

SEQ ID NO: 951208 - protein, 9 aa, Homo Sapiens
TSWESIKGS

SEQ ID NO: 951209 - protein, 9 aa, Homo Sapiens
NFEFPRPFL

SEQ ID NO: 951210 - protein, 9 aa, Homo Sapiens
GPRVPGGRE

SEQ ID NO: 951211 - protein, 9 aa, Homo Sapiens
CDETNLQAV

SEQ ID NO: 951212 - protein, 9 aa, Homo Sapiens
PRRLSGPAE

SEQ ID NO: 951213 - protein, 9 aa, Homo Sapiens
SCINPTAGS

SEQ ID NO: 951214 - protein, 9 aa, Homo Sapiens
TKYEIDAIQ

SEQ ID NO: 951215 - protein, 9 aa, Homo Sapiens
RSPFFSNVY

SEQ ID NO: 951216 - protein, 9 aa, Homo Sapiens
LSLVLRNPQ

SEQ ID NO: 951217 - protein, 9 aa, Homo Sapiens
TNVCVQQNS

SEQ ID NO: 951218 - protein, 9 aa, Homo Sapiens
YEDVTLGNR

SEQ ID NO: 951219 - protein, 9 aa, Homo Sapiens
FSRSCQTQD

SEQ ID NO: 951220 - protein, 9 aa, Homo Sapiens
SLFTDEQVL

SEQ ID NO: 951221 - protein, 9 aa, Homo Sapiens
EKHKERCHN

SEQ ID NO: 951222 - protein, 9 aa, Homo Sapiens
APRPMPSVL

SEQ ID NO: 951223 - protein, 9 aa, Homo Sapiens
VHFLVISKK

SEQ ID NO: 951224 - protein, 9 aa, Homo Sapiens
RALKIWEER

SEQ ID NO: 951225 - protein, 9 aa, Homo Sapiens
QHRYQELQR

SEQ ID NO: 951226 - protein, 9 aa, Homo Sapiens
VNEPLSFFV

SEQ ID NO: 951227 - protein, 9 aa, Homo Sapiens
PSQCPAPCF

SEQ ID NO: 951228 - protein, 9 aa, Homo Sapiens
RNRFKWWPA

SEQ ID NO: 951229 - protein, 9 aa, Homo Sapiens
LTLLIAFLS

SEQ ID NO: 951230 - protein, 9 aa, Homo Sapiens
DGQGAVPDS

SEQ ID NO: 951231 - protein, 9 aa, Homo Sapiens
LGGAFLIMI

SEQ ID NO: 951232 - protein, 9 aa, Homo Sapiens
ELTTGSGLR

SEQ ID NO: 951233 - protein, 9 aa, Homo Sapiens
ERLRGGRAE

SEQ ID NO: 951234 - protein, 9 aa, Homo Sapiens
PENIKVWAP

SEQ ID NO: 951235 - protein, 9 aa, Homo Sapiens
HCEDAGVIC

SEQ ID NO: 951236 - protein, 9 aa, Homo Sapiens
NNECSCTFC

SEQ ID NO: 951237 - protein, 9 aa, Homo Sapiens
HHHRCHRRK

SEQ ID NO: 951238 - protein, 9 aa, Homo Sapiens
SRKVMRTLE

SEQ ID NO: 951239 - protein, 9 aa, Homo Sapiens
IARNGKIYK

SEQ ID NO: 951240 - protein, 9 aa, Homo Sapiens
VEYIIFPSQ

SEQ ID NO: 951241 - protein, 9 aa, Homo Sapiens
SSRWGLCIN

SEQ ID NO: 951242 - protein, 9 aa, Homo Sapiens
VGVGESGRQ

SEQ ID NO: 951243 - protein, 9 aa, Homo Sapiens
GLERFTDSL

SEQ ID NO: 951244 - protein, 9 aa, Homo Sapiens
VDWGLQKSL

SEQ ID NO: 951245 - protein, 9 aa, Homo Sapiens
ARNQLNRIA

SEQ ID NO: 951246 - protein, 9 aa, Homo Sapiens
FDEKEGEAN

SEQ ID NO: 951247 - protein, 9 aa, Homo Sapiens
KGIYTCYVG

SEQ ID NO: 951248 - protein, 9 aa, Homo Sapiens
AVDADESPN

SEQ ID NO: 951249 - protein, 9 aa, Homo Sapiens
NSQVEGKYI

SEQ ID NO: 951250 - protein, 9 aa, Homo Sapiens
FCGIERVDY

SEQ ID NO: 951251 - protein, 9 aa, Homo Sapiens
FHQVNYTFD

SEQ ID NO: 951252 - protein, 9 aa, Homo Sapiens
READGSETL

SEQ ID NO: 951253 - protein, 9 aa, Homo Sapiens
MSPGASRGL

SEQ ID NO: 951254 - protein, 9 aa, Homo Sapiens
HALRRHYHS

SEQ ID NO: 951255 - protein, 9 aa, Homo Sapiens
AAPACVGLG

SEQ ID NO: 951256 - protein, 9 aa, Homo Sapiens
QMEKQSAVV

SEQ ID NO: 951257 - protein, 9 aa, Homo Sapiens
NTHEFENAE

SEQ ID NO: 951258 - protein, 9 aa, Homo Sapiens
LSREISVTS

SEQ ID NO: 951259 - protein, 9 aa, Homo Sapiens
VGILKTTHI

SEQ ID NO: 951260 - protein, 9 aa, Homo Sapiens
KHDSIKDDL

SEQ ID NO: 951261 - protein, 9 aa, Homo Sapiens
SCPRAFIGK

SEQ ID NO: 951262 - protein, 9 aa, Homo Sapiens
LHSVPQPTT

SEQ ID NO: 951263 - protein, 9 aa, Homo Sapiens
SSPSPLPSP

SEQ ID NO: 951264 - protein, 9 aa, Homo Sapiens
LASLDINKT

SEQ ID NO: 951265 - protein, 9 aa, Homo Sapiens
PHILRKVSK

SEQ ID NO: 951266 - protein, 9 aa, Homo Sapiens
QKQPRLPPS

SEQ ID NO: 951267 - protein, 9 aa, Homo Sapiens
CGKAFKHFL

SEQ ID NO: 951268 - protein, 9 aa, Homo Sapiens
ILLRAMAAV

SEQ ID NO: 951269 - protein, 9 aa, Homo Sapiens
PGPSTTFFT

SEQ ID NO: 951270 - protein, 9 aa, Homo Sapiens
LLLRQVADW

SEQ ID NO: 951271 - protein, 9 aa, Homo Sapiens
LTQRMQSFN

SEQ ID NO: 951272 - protein, 9 aa, Homo Sapiens
QQLYDCQLY

SEQ ID NO: 951273 - protein, 9 aa, Homo Sapiens
LHFMNDLRV

SEQ ID NO: 951274 - protein, 9 aa, Homo Sapiens
LLQIIAEAD

SEQ ID NO: 951275 - protein, 9 aa, Homo Sapiens
SVPPRLLSG

SEQ ID NO: 951276 - protein, 9 aa, Homo Sapiens
NSCANPIFY

SEQ ID NO: 951277 - protein, 9 aa, Homo Sapiens
GLHYNPKVW

SEQ ID NO: 951278 - protein, 9 aa, Homo Sapiens
VLAKIFSEH

SEQ ID NO: 951279 - protein, 9 aa, Homo Sapiens
WRLQAESES

SEQ ID NO: 951280 - protein, 9 aa, Homo Sapiens
LHSGEEPHV

SEQ ID NO: 951281 - protein, 9 aa, Homo Sapiens
LAQKPPASG

SEQ ID NO: 951282 - protein, 9 aa, Homo Sapiens
ILDGNKIEE

SEQ ID NO: 951283 - protein, 9 aa, Homo Sapiens
VRNEKGLPI

SEQ ID NO: 951284 - protein, 9 aa, Homo Sapiens
HFMNDLRVP

SEQ ID NO: 951285 - protein, 9 aa, Homo Sapiens
LNVFFAFEL

SEQ ID NO: 951286 - protein, 9 aa, Homo Sapiens
YYSPIFDQW

SEQ ID NO: 951287 - protein, 9 aa, Homo Sapiens
NKETEAREA

SEQ ID NO: 951288 - protein, 9 aa, Homo Sapiens
WGEEYNWHK

SEQ ID NO: 951289 - protein, 9 aa, Homo Sapiens
EPVVLSEAS

SEQ ID NO: 951290 - protein, 9 aa, Homo Sapiens
KSLVKGHPQ

SEQ ID NO: 951291 - protein, 9 aa, Homo Sapiens
FSKVPTPLP

SEQ ID NO: 951292 - protein, 9 aa, Homo Sapiens
KTKGQQICR

SEQ ID NO: 951293 - protein, 9 aa, Homo Sapiens
SEQNLNSAY

SEQ ID NO: 951294 - protein, 9 aa, Homo Sapiens
SPQPWPRFL

SEQ ID NO: 951295 - protein, 9 aa, Homo Sapiens
YHQKIYTGE

SEQ ID NO: 951296 - protein, 9 aa, Homo Sapiens
GCILCSCDP

SEQ ID NO: 951297 - protein, 9 aa, Homo Sapiens
LESGAFGCV

SEQ ID NO: 951298 - protein, 9 aa, Homo Sapiens
SNADVRAFT

SEQ ID NO: 951299 - protein, 9 aa, Homo Sapiens
LCGHKCLLL

SEQ ID NO: 951300 - protein, 9 aa, Homo Sapiens
DAGALIEEH

SEQ ID NO: 951301 - protein, 9 aa, Homo Sapiens
LSGSSHSFQ

SEQ ID NO: 951302 - protein, 9 aa, Homo Sapiens
TCPATVSFL

SEQ ID NO: 951303 - protein, 9 aa, Homo Sapiens
GKMGTGGSS

SEQ ID NO: 951304 - protein, 9 aa, Homo Sapiens
KYKTKVVFS

SEQ ID NO: 951305 - protein, 9 aa, Homo Sapiens
LVSMGRSLT

SEQ ID NO: 951306 - protein, 9 aa, Homo Sapiens
ESKEHIELV

SEQ ID NO: 951307 - protein, 9 aa, Homo Sapiens
STVPLAVFP

SEQ ID NO: 951308 - protein, 9 aa, Homo Sapiens
DIIYFFRHR

SEQ ID NO: 951309 - protein, 9 aa, Homo Sapiens
SELKSDLEK

SEQ ID NO: 951310 - protein, 9 aa, Homo Sapiens
LDKGIYTCY

SEQ ID NO: 951311 - protein, 9 aa, Homo Sapiens
PARAVQKET

SEQ ID NO: 951312 - protein, 9 aa, Homo Sapiens
RLIYYASKN

SEQ ID NO: 951313 - protein, 9 aa, Homo Sapiens
PTSILWDGL

SEQ ID NO: 951314 - protein, 9 aa, Homo Sapiens
PNNIYYSDL

SEQ ID NO: 951315 - protein, 9 aa, Homo Sapiens
HLKTLCHPC

SEQ ID NO: 951316 - protein, 9 aa, Homo Sapiens
DHNGLGYSA

SEQ ID NO: 951317 - protein, 9 aa, Homo Sapiens
THRARLRRW

SEQ ID NO: 951318 - protein, 9 aa, Homo Sapiens
QNSHYGQSE

SEQ ID NO: 951319 - protein, 9 aa, Homo Sapiens
KSPELCNEI

SEQ ID NO: 951320 - protein, 9 aa, Homo Sapiens
RLAGLNYEL

SEQ ID NO: 951321 - protein, 9 aa, Homo Sapiens
QFQDLKEKF

SEQ ID NO: 951322 - protein, 9 aa, Homo Sapiens
LKEKMDKLL

SEQ ID NO: 951323 - protein, 9 aa, Homo Sapiens
LLLHKKSLK

SEQ ID NO: 951324 - protein, 9 aa, Homo Sapiens
TPPGSIRFT

SEQ ID NO: 951325 - protein, 9 aa, Homo Sapiens
IVYSQLPLE

SEQ ID NO: 951326 - protein, 9 aa, Homo Sapiens
VARDMSKKS

SEQ ID NO: 951327 - protein, 9 aa, Homo Sapiens
CEELQQTGR

SEQ ID NO: 951328 - protein, 9 aa, Homo Sapiens
SASGSVEDL

SEQ ID NO: 951329 - protein, 9 aa, Homo Sapiens
SLSVILMNL

SEQ ID NO: 951330 - protein, 9 aa, Homo Sapiens
YDEIKSQGG

SEQ ID NO: 951331 - protein, 9 aa, Homo Sapiens
LKLASLDIN

SEQ ID NO: 951332 - protein, 9 aa, Homo Sapiens
NPLLALPPV

SEQ ID NO: 951333 - protein, 9 aa, Homo Sapiens
AASSKEAFK

SEQ ID NO: 951334 - protein, 9 aa, Homo Sapiens
LSCLALEQE

SEQ ID NO: 951335 - protein, 9 aa, Homo Sapiens
KGFLQRLQL

SEQ ID NO: 951336 - protein, 9 aa, Homo Sapiens
SARTITNLK

SEQ ID NO: 951337 - protein, 9 aa, Homo Sapiens
SGEPVVYHR

SEQ ID NO: 951338 - protein, 9 aa, Homo Sapiens
PYPYLHTLY

SEQ ID NO: 951339 - protein, 9 aa, Homo Sapiens
LQWICAWQT

SEQ ID NO: 951340 - protein, 9 aa, Homo Sapiens
WNEVMYDEI

SEQ ID NO: 951341 - protein, 9 aa, Homo Sapiens
NCFTEIPSD

SEQ ID NO: 951342 - protein, 9 aa, Homo Sapiens
ERFTRSLFL

SEQ ID NO: 951343 - protein, 9 aa, Homo Sapiens
VIYYLLLER

SEQ ID NO: 951344 - protein, 9 aa, Homo Sapiens
ILPVSPAQS

SEQ ID NO: 951345 - protein, 9 aa, Homo Sapiens
FFRGDCCRS

SEQ ID NO: 951346 - protein, 9 aa, Homo Sapiens
CEAGKEGEG

SEQ ID NO: 951347 - protein, 9 aa, Homo Sapiens
PLLRTSSFL

SEQ ID NO: 951348 - protein, 9 aa, Homo Sapiens
KTGPYQCEI

SEQ ID NO: 951349 - protein, 9 aa, Homo Sapiens
GVIRSPFFS

SEQ ID NO: 951350 - protein, 9 aa, Homo Sapiens
KLSAEVVFE

SEQ ID NO: 951351 - protein, 9 aa, Homo Sapiens
KLLRTILQA

SEQ ID NO: 951352 - protein, 9 aa, Homo Sapiens
LADLSFGSS

SEQ ID NO: 951353 - protein, 9 aa, Homo Sapiens
REDAFHIFQ

SEQ ID NO: 951354 - protein, 9 aa, Homo Sapiens
DLSEDNSLG

SEQ ID NO: 951355 - protein, 9 aa, Homo Sapiens
PVPVPRPKT

SEQ ID NO: 951356 - protein, 9 aa, Homo Sapiens
GDSCDREIF

SEQ ID NO: 951357 - protein, 9 aa, Homo Sapiens
VAPSAVLGS

SEQ ID NO: 951358 - protein, 9 aa, Homo Sapiens
KGNGDAVLS

SEQ ID NO: 951359 - protein, 9 aa, Homo Sapiens
DKADATWTL

SEQ ID NO: 951360 - protein, 9 aa, Homo Sapiens
WTTGSSLSK

SEQ ID NO: 951361 - protein, 9 aa, Homo Sapiens
TSFSLSKKA

SEQ ID NO: 951362 - protein, 9 aa, Homo Sapiens
KSEPDKGDP

SEQ ID NO: 951363 - protein, 9 aa, Homo Sapiens
IPGGFLPTA

SEQ ID NO: 951364 - protein, 9 aa, Homo Sapiens
IEPWELLAR

SEQ ID NO: 951365 - protein, 9 aa, Homo Sapiens
TKESIKEGF

SEQ ID NO: 951366 - protein, 9 aa, Homo Sapiens
ESLVLVKLQ

SEQ ID NO: 951367 - protein, 9 aa, Homo Sapiens
HNSPTGGPR

SEQ ID NO: 951368 - protein, 9 aa, Homo Sapiens
LVRMYMVRA

SEQ ID NO: 951369 - protein, 9 aa, Homo Sapiens
RTIPLIVTE

SEQ ID NO: 951370 - protein, 9 aa, Homo Sapiens
KNLQKEISD

SEQ ID NO: 951371 - protein, 9 aa, Homo Sapiens
RSGLGTDGS

SEQ ID NO: 951372 - protein, 9 aa, Homo Sapiens
TSCLTCRMS

SEQ ID NO: 951373 - protein, 9 aa, Homo Sapiens
RDKGAMGEP

SEQ ID NO: 951374 - protein, 9 aa, Homo Sapiens
ATSPLPRGD

SEQ ID NO: 951375 - protein, 9 aa, Homo Sapiens
KQKASACNL

SEQ ID NO: 951376 - protein, 9 aa, Homo Sapiens
FISLILENL

SEQ ID NO: 951377 - protein, 9 aa, Homo Sapiens
RGILNIEDA

SEQ ID NO: 951378 - protein, 9 aa, Homo Sapiens
ERPKKEYFQ

SEQ ID NO: 951379 - protein, 9 aa, Homo Sapiens
PWERPQEGQ

SEQ ID NO: 951380 - protein, 9 aa, Homo Sapiens
SKAFAFEII

SEQ ID NO: 951381 - protein, 9 aa, Homo Sapiens
REQWSQRLS

SEQ ID NO: 951382 - protein, 9 aa, Homo Sapiens
RGLFPSPTS

SEQ ID NO: 951383 - protein, 9 aa, Homo Sapiens
TRLFNCANR

SEQ ID NO: 951384 - protein, 9 aa, Homo Sapiens
LAMRLPIYC

SEQ ID NO: 951385 - protein, 9 aa, Homo Sapiens
VSFSIIAVF

SEQ ID NO: 951386 - protein, 9 aa, Homo Sapiens
LTPFWYATR

SEQ ID NO: 951387 - protein, 9 aa, Homo Sapiens
VGESGRQSV

SEQ ID NO: 951388 - protein, 9 aa, Homo Sapiens
HSDPKLSWS

SEQ ID NO: 951389 - protein, 9 aa, Homo Sapiens
LGPSLKDLF

SEQ ID NO: 951390 - protein, 9 aa, Homo Sapiens
GAQKGVSQK

SEQ ID NO: 951391 - protein, 9 aa, Homo Sapiens
HPCFCHLLA

SEQ ID NO: 951392 - protein, 9 aa, Homo Sapiens
LKEKKRIKR

SEQ ID NO: 951393 - protein, 9 aa, Homo Sapiens
LQAVPSVSS

SEQ ID NO: 951394 - protein, 9 aa, Homo Sapiens
FEQGHQLFH

SEQ ID NO: 951395 - protein, 9 aa, Homo Sapiens
EDKFPGQSF

SEQ ID NO: 951396 - protein, 9 aa, Homo Sapiens
IDITDMNNK

SEQ ID NO: 951397 - protein, 9 aa, Homo Sapiens
SRFLIHSRA

SEQ ID NO: 951398 - protein, 9 aa, Homo Sapiens
VLSCLALEQ

SEQ ID NO: 951399 - protein, 9 aa, Homo Sapiens
FRLLCWVLL

SEQ ID NO: 951400 - protein, 9 aa, Homo Sapiens
SYSCSCLPG

SEQ ID NO: 951401 - protein, 9 aa, Homo Sapiens
ADNGHLFVL

SEQ ID NO: 951402 - protein, 9 aa, Homo Sapiens
ISIENSIYR

SEQ ID NO: 951403 - protein, 9 aa, Homo Sapiens
ATNQCTINK

SEQ ID NO: 951404 - protein, 9 aa, Homo Sapiens
AAQGLKQET

SEQ ID NO: 951405 - protein, 9 aa, Homo Sapiens
IERSSGNIF

SEQ ID NO: 951406 - protein, 9 aa, Homo Sapiens
DGPECPTVF

SEQ ID NO: 951407 - protein, 9 aa, Homo Sapiens
VKLRLQEFF

SEQ ID NO: 951408 - protein, 9 aa, Homo Sapiens
LDKWQYIRL

SEQ ID NO: 951409 - protein, 9 aa, Homo Sapiens
TTMLEGYFY

SEQ ID NO: 951410 - protein, 9 aa, Homo Sapiens
TDKYQWLQI

SEQ ID NO: 951411 - protein, 9 aa, Homo Sapiens
RQPAFPVIH

SEQ ID NO: 951412 - protein, 9 aa, Homo Sapiens
MSYNRYMAI

SEQ ID NO: 951413 - protein, 9 aa, Homo Sapiens
EKIVNTGVT

SEQ ID NO: 951414 - protein, 9 aa, Homo Sapiens
DSEKYQRIK

SEQ ID NO: 951415 - protein, 9 aa, Homo Sapiens
SCTCWGRNE

SEQ ID NO: 951416 - protein, 9 aa, Homo Sapiens
ALALLRANT

SEQ ID NO: 951417 - protein, 9 aa, Homo Sapiens
LMELPNQYN

SEQ ID NO: 951418 - protein, 9 aa, Homo Sapiens
SCRNSPDPV

SEQ ID NO: 951419 - protein, 9 aa, Homo Sapiens
LTRSELLQS

SEQ ID NO: 951420 - protein, 9 aa, Homo Sapiens
AGEILFYNV

SEQ ID NO: 951421 - protein, 9 aa, Homo Sapiens
TPPNVSLDA

SEQ ID NO: 951422 - protein, 9 aa, Homo Sapiens
IADLFQPKD

SEQ ID NO: 951423 - protein, 9 aa, Homo Sapiens
PHSLFTDEQ

SEQ ID NO: 951424 - protein, 9 aa, Homo Sapiens
PTQPPQQLN

SEQ ID NO: 951425 - protein, 9 aa, Homo Sapiens
NRYMAICHP

SEQ ID NO: 951426 - protein, 9 aa, Homo Sapiens
LVGKLAFVM

SEQ ID NO: 951427 - protein, 9 aa, Homo Sapiens
KSKAVEKIV

SEQ ID NO: 951428 - protein, 9 aa, Homo Sapiens
MSLAKLGFY

SEQ ID NO: 951429 - protein, 9 aa, Homo Sapiens
VFCYLYEFW

SEQ ID NO: 951430 - protein, 9 aa, Homo Sapiens
SPEWMDFIQ

SEQ ID NO: 951431 - protein, 9 aa, Homo Sapiens
DCLHCQTQA

SEQ ID NO: 951432 - protein, 9 aa, Homo Sapiens
TLDVFCHKD

SEQ ID NO: 951433 - protein, 9 aa, Homo Sapiens
KQPFPKKFS

SEQ ID NO: 951434 - protein, 9 aa, Homo Sapiens
ILRQKVEFL

SEQ ID NO: 951435 - protein, 9 aa, Homo Sapiens
VTDKDGKLY

SEQ ID NO: 951436 - protein, 9 aa, Homo Sapiens
RDFRIGYQQ

SEQ ID NO: 951437 - protein, 9 aa, Homo Sapiens
SLRLIRKAL

SEQ ID NO: 951438 - protein, 9 aa, Homo Sapiens
VSELIKELN

SEQ ID NO: 951439 - protein, 9 aa, Homo Sapiens
GPELLPCVA

SEQ ID NO: 951440 - protein, 9 aa, Homo Sapiens
KGFLDKLYN

SEQ ID NO: 951441 - protein, 9 aa, Homo Sapiens
CHPCLLRFL

SEQ ID NO: 951442 - protein, 9 aa, Homo Sapiens
CSRGREVMI

SEQ ID NO: 951443 - protein, 9 aa, Homo Sapiens
LRAMAAVPQ

SEQ ID NO: 951444 - protein, 9 aa, Homo Sapiens
FEGKIGKGN

SEQ ID NO: 951445 - protein, 9 aa, Homo Sapiens
LHPLDSEEN

SEQ ID NO: 951446 - protein, 9 aa, Homo Sapiens
HEIKKQTLK

SEQ ID NO: 951447 - protein, 9 aa, Homo Sapiens
IVFATEYTF

SEQ ID NO: 951448 - protein, 9 aa, Homo Sapiens
TFCDFLKIN

SEQ ID NO: 951449 - protein, 9 aa, Homo Sapiens
FIYGNPRKL

SEQ ID NO: 951450 - protein, 9 aa, Homo Sapiens
SQLKSDTIA

SEQ ID NO: 951451 - protein, 9 aa, Homo Sapiens
SHSTSPSLV

SEQ ID NO: 951452 - protein, 9 aa, Homo Sapiens
PDVCRKNLE

SEQ ID NO: 951453 - protein, 9 aa, Homo Sapiens
FLIARIPVA

SEQ ID NO: 951454 - protein, 9 aa, Homo Sapiens
FPLMAIVLK

SEQ ID NO: 951455 - protein, 9 aa, Homo Sapiens
CPELRGLFP

SEQ ID NO: 951456 - protein, 9 aa, Homo Sapiens
LAQKVCPRR

SEQ ID NO: 951457 - protein, 9 aa, Homo Sapiens
FMTELRTLA

SEQ ID NO: 951458 - protein, 9 aa, Homo Sapiens
YYRPHKVSS

SEQ ID NO: 951459 - protein, 9 aa, Homo Sapiens
DEAHWPQYL

SEQ ID NO: 951460 - protein, 9 aa, Homo Sapiens
SLIIVNAKF

SEQ ID NO: 951461 - protein, 9 aa, Homo Sapiens
TEEELPEET

SEQ ID NO: 951462 - protein, 9 aa, Homo Sapiens
YEIDSASPL

SEQ ID NO: 951463 - protein, 9 aa, Homo Sapiens
QGRGKDQPR

SEQ ID NO: 951464 - protein, 9 aa, Homo Sapiens
YGIPMVGIP

SEQ ID NO: 951465 - protein, 9 aa, Homo Sapiens
MKKATWFIM

SEQ ID NO: 951466 - protein, 9 aa, Homo Sapiens
ENIKAGPNM

SEQ ID NO: 951467 - protein, 9 aa, Homo Sapiens
EETRKLQQK

SEQ ID NO: 951468 - protein, 9 aa, Homo Sapiens
LTVTEKLDS

SEQ ID NO: 951469 - protein, 9 aa, Homo Sapiens
KAVEKIVNT

SEQ ID NO: 951470 - protein, 9 aa, Homo Sapiens
VGGHGLCSE

SEQ ID NO: 951471 - protein, 9 aa, Homo Sapiens
RKVMRTLES

SEQ ID NO: 951472 - protein, 9 aa, Homo Sapiens
LLSLPIRPE

SEQ ID NO: 951473 - protein, 9 aa, Homo Sapiens
NMRDNNMLR

SEQ ID NO: 951474 - protein, 9 aa, Homo Sapiens
FCRINALSH

SEQ ID NO: 951475 - protein, 9 aa, Homo Sapiens
ESFKRTSKK

SEQ ID NO: 951476 - protein, 9 aa, Homo Sapiens
ATGWHEGVP

SEQ ID NO: 951477 - protein, 9 aa, Homo Sapiens
AKSTVCDID

SEQ ID NO: 951478 - protein, 9 aa, Homo Sapiens
DLVYGATPS

SEQ ID NO: 951479 - protein, 9 aa, Homo Sapiens
AGMYGKVCK

SEQ ID NO: 951480 - protein, 9 aa, Homo Sapiens
SPPGGLDSR

SEQ ID NO: 951481 - protein, 9 aa, Homo Sapiens
QPTLPVALS

SEQ ID NO: 951482 - protein, 9 aa, Homo Sapiens
LIAQLFDFA

SEQ ID NO: 951483 - protein, 9 aa, Homo Sapiens
CIHMMPNAV

SEQ ID NO: 951484 - protein, 9 aa, Homo Sapiens
IISSESSSL

SEQ ID NO: 951485 - protein, 9 aa, Homo Sapiens
FKEKWKTPF

SEQ ID NO: 951486 - protein, 9 aa, Homo Sapiens
QEYDSSFLN

SEQ ID NO: 951487 - protein, 9 aa, Homo Sapiens
PELPQNGTS

SEQ ID NO: 951488 - protein, 9 aa, Homo Sapiens
MGFLASAWE

SEQ ID NO: 951489 - protein, 9 aa, Homo Sapiens
SRHNSPTGG

SEQ ID NO: 951490 - protein, 9 aa, Homo Sapiens
SVGEEEEEK

SEQ ID NO: 951491 - protein, 9 aa, Homo Sapiens
RKRSSTMET

SEQ ID NO: 951492 - protein, 9 aa, Homo Sapiens
EPSKEEEEP

SEQ ID NO: 951493 - protein, 9 aa, Homo Sapiens
ARKPPHEPH

SEQ ID NO: 951494 - protein, 9 aa, Homo Sapiens
FKPLCGHKC

SEQ ID NO: 951495 - protein, 9 aa, Homo Sapiens
CACPSHDTG

SEQ ID NO: 951496 - protein, 9 aa, Homo Sapiens
ENGPELLPC

SEQ ID NO: 951497 - protein, 9 aa, Homo Sapiens
PIPSDLKEN

SEQ ID NO: 951498 - protein, 9 aa, Homo Sapiens
SLSLPIVLS

SEQ ID NO: 951499 - protein, 9 aa, Homo Sapiens
IVPSLFLLL

SEQ ID NO: 951500 - protein, 9 aa, Homo Sapiens
WKGFFKPSE

SEQ ID NO: 951501 - protein, 9 aa, Homo Sapiens
VFSLLVFGP

SEQ ID NO: 951502 - protein, 9 aa, Homo Sapiens
ETASSTGNL

SEQ ID NO: 951503 - protein, 9 aa, Homo Sapiens
DKEQKSKDF

SEQ ID NO: 951504 - protein, 9 aa, Homo Sapiens
FWKLQATEE

SEQ ID NO: 951505 - protein, 9 aa, Homo Sapiens
PATNFQLEV

SEQ ID NO: 951506 - protein, 9 aa, Homo Sapiens
LESIFQGYI

SEQ ID NO: 951507 - protein, 9 aa, Homo Sapiens
LIKEEKQKE

SEQ ID NO: 951508 - protein, 9 aa, Homo Sapiens
EKVISSYEH

SEQ ID NO: 951509 - protein, 9 aa, Homo Sapiens
YVVTFQEPE

SEQ ID NO: 951510 - protein, 9 aa, Homo Sapiens
SCFSNSATL

SEQ ID NO: 951511 - protein, 9 aa, Homo Sapiens
VSFRLWDTF

SEQ ID NO: 951512 - protein, 9 aa, Homo Sapiens
RGQLKEIMA

SEQ ID NO: 951513 - protein, 9 aa, Homo Sapiens
EVLTLGTGQ

SEQ ID NO: 951514 - protein, 9 aa, Homo Sapiens
LIAPNFVML

SEQ ID NO: 951515 - protein, 9 aa, Homo Sapiens
APTTVYKKT

SEQ ID NO: 951516 - protein, 9 aa, Homo Sapiens
CKEILEITG

SEQ ID NO: 951517 - protein, 9 aa, Homo Sapiens
VISDWKEQE

SEQ ID NO: 951518 - protein, 9 aa, Homo Sapiens
PPGSIRFTA

SEQ ID NO: 951519 - protein, 9 aa, Homo Sapiens
RKFKKNVPE

SEQ ID NO: 951520 - protein, 9 aa, Homo Sapiens
SQKSQHGSA

SEQ ID NO: 951521 - protein, 9 aa, Homo Sapiens
DSEENTKSF

SEQ ID NO: 951522 - protein, 9 aa, Homo Sapiens
CYPGFDLVG

SEQ ID NO: 951523 - protein, 9 aa, Homo Sapiens
AGMWNNIAA

SEQ ID NO: 951524 - protein, 9 aa, Homo Sapiens
RTQVSERAE

SEQ ID NO: 951525 - protein, 9 aa, Homo Sapiens
VSFQSGGSR

SEQ ID NO: 951526 - protein, 9 aa, Homo Sapiens
IELCCGFVK

SEQ ID NO: 951527 - protein, 9 aa, Homo Sapiens
KLENEVIEC

SEQ ID NO: 951528 - protein, 9 aa, Homo Sapiens
DALAALHEP

SEQ ID NO: 951529 - protein, 9 aa, Homo Sapiens
TFFEEYTGS

SEQ ID NO: 951530 - protein, 9 aa, Homo Sapiens
LANILKSRL

SEQ ID NO: 951531 - protein, 9 aa, Homo Sapiens
RTYWNFEFP

SEQ ID NO: 951532 - protein, 9 aa, Homo Sapiens
AMERSLTWG

SEQ ID NO: 951533 - protein, 9 aa, Homo Sapiens
WTDNPKSWY

SEQ ID NO: 951534 - protein, 9 aa, Homo Sapiens
VMEVGEAAD

SEQ ID NO: 951535 - protein, 9 aa, Homo Sapiens
LISDLKTDV

SEQ ID NO: 951536 - protein, 9 aa, Homo Sapiens
FLAGMRNRE

SEQ ID NO: 951537 - protein, 9 aa, Homo Sapiens
KEEREPAAN

SEQ ID NO: 951538 - protein, 9 aa, Homo Sapiens
TKEPSREGL

SEQ ID NO: 951539 - protein, 9 aa, Homo Sapiens
SGWGQEKDN

SEQ ID NO: 951540 - protein, 9 aa, Homo Sapiens
PSMIEYVLY

SEQ ID NO: 951541 - protein, 9 aa, Homo Sapiens
FAALYYKKN

SEQ ID NO: 951542 - protein, 9 aa, Homo Sapiens
ALLLQRCCQ

SEQ ID NO: 951543 - protein, 9 aa, Homo Sapiens
FSPKGRPKR

SEQ ID NO: 951544 - protein, 9 aa, Homo Sapiens
TPGKMGTGG

SEQ ID NO: 951545 - protein, 9 aa, Homo Sapiens
LLPLGPKEL

SEQ ID NO: 951546 - protein, 9 aa, Homo Sapiens
DQNLSDLYC

SEQ ID NO: 951547 - protein, 9 aa, Homo Sapiens
FVKEMRERY

SEQ ID NO: 951548 - protein, 9 aa, Homo Sapiens
VQAKADALA

SEQ ID NO: 951549 - protein, 9 aa, Homo Sapiens
LSIYGLHYN

SEQ ID NO: 951550 - protein, 9 aa, Homo Sapiens
YFCRINALS

SEQ ID NO: 951551 - protein, 9 aa, Homo Sapiens
KLGMWYKAA

SEQ ID NO: 951552 - protein, 9 aa, Homo Sapiens
SMKYFKNFS

SEQ ID NO: 951553 - protein, 9 aa, Homo Sapiens
IGFQLRYES

SEQ ID NO: 951554 - protein, 9 aa, Homo Sapiens
PANGACLCK

SEQ ID NO: 951555 - protein, 9 aa, Homo Sapiens
SGEHTNVCV

SEQ ID NO: 951556 - protein, 9 aa, Homo Sapiens
GKRKEEKPF

SEQ ID NO: 951557 - protein, 9 aa, Homo Sapiens
SSFRELCIK

SEQ ID NO: 951558 - protein, 9 aa, Homo Sapiens
AEYRASEEK

SEQ ID NO: 951559 - protein, 9 aa, Homo Sapiens
AWDPHSGQG

SEQ ID NO: 951560 - protein, 9 aa, Homo Sapiens
SLRRLYLQE

SEQ ID NO: 951561 - protein, 9 aa, Homo Sapiens
IYTGEKPFE

SEQ ID NO: 951562 - protein, 9 aa, Homo Sapiens
GGLFGKYID

SEQ ID NO: 951563 - protein, 9 aa, Homo Sapiens
EAKVAQSPR

SEQ ID NO: 951564 - protein, 9 aa, Homo Sapiens
WILVEMEDE

SEQ ID NO: 951565 - protein, 9 aa, Homo Sapiens
AVLGEHDFS

SEQ ID NO: 951566 - protein, 9 aa, Homo Sapiens
FCELPLDNQ

SEQ ID NO: 951567 - protein, 9 aa, Homo Sapiens
ADDFTDNPR

SEQ ID NO: 951568 - protein, 9 aa, Homo Sapiens
DFSEHDGDE

SEQ ID NO: 951569 - protein, 9 aa, Homo Sapiens
PGQSYPDSV

SEQ ID NO: 951570 - protein, 9 aa, Homo Sapiens
HSKNVRFPG

SEQ ID NO: 951571 - protein, 9 aa, Homo Sapiens
KADALADAE

SEQ ID NO: 951572 - protein, 9 aa, Homo Sapiens
NEILRNPCF

SEQ ID NO: 951573 - protein, 9 aa, Homo Sapiens
CPTVFLERL

SEQ ID NO: 951574 - protein, 9 aa, Homo Sapiens
FSYFMDHFI

SEQ ID NO: 951575 - protein, 9 aa, Homo Sapiens
KPESIEETV

SEQ ID NO: 951576 - protein, 9 aa, Homo Sapiens
HDILEDINV

SEQ ID NO: 951577 - protein, 9 aa, Homo Sapiens
TTVWRVTNT

SEQ ID NO: 951578 - protein, 9 aa, Homo Sapiens
IQNAVISEE

SEQ ID NO: 951579 - protein, 9 aa, Homo Sapiens
IQKGREMSL

SEQ ID NO: 951580 - protein, 9 aa, Homo Sapiens
YCWLQAQKD

SEQ ID NO: 951581 - protein, 9 aa, Homo Sapiens
SRGPCDSDG

SEQ ID NO: 951582 - protein, 9 aa, Homo Sapiens
FRVNRFPCK

SEQ ID NO: 951583 - protein, 9 aa, Homo Sapiens
TCRAEENPK

SEQ ID NO: 951584 - protein, 9 aa, Homo Sapiens
SEYVVKIWN

SEQ ID NO: 951585 - protein, 9 aa, Homo Sapiens
AQKGVSQKN

SEQ ID NO: 951586 - protein, 9 aa, Homo Sapiens
RVTNTSQSQ

SEQ ID NO: 951587 - protein, 9 aa, Homo Sapiens
WVYGVLGGA

SEQ ID NO: 951588 - protein, 9 aa, Homo Sapiens
RDCVLMVER

SEQ ID NO: 951589 - protein, 9 aa, Homo Sapiens
ELQKICYNK

SEQ ID NO: 951590 - protein, 9 aa, Homo Sapiens
DHNVKFNGV

SEQ ID NO: 951591 - protein, 9 aa, Homo Sapiens
HMNLEGKPV

SEQ ID NO: 951592 - protein, 9 aa, Homo Sapiens
HRTEGGTCE

SEQ ID NO: 951593 - protein, 9 aa, Homo Sapiens
ADSVQVMLD

SEQ ID NO: 951594 - protein, 9 aa, Homo Sapiens
PKQKVALSL

SEQ ID NO: 951595 - protein, 9 aa, Homo Sapiens
TLAYYGYSY

SEQ ID NO: 951596 - protein, 9 aa, Homo Sapiens
EEPAGPKPR

SEQ ID NO: 951597 - protein, 9 aa, Homo Sapiens
QKFLERIHL

SEQ ID NO: 951598 - protein, 9 aa, Homo Sapiens
KKPKIQASG

SEQ ID NO: 951599 - protein, 9 aa, Homo Sapiens
VRPHGPEDK

SEQ ID NO: 951600 - protein, 9 aa, Homo Sapiens
IEETVEFKN

SEQ ID NO: 951601 - protein, 9 aa, Homo Sapiens
TVWRVTNTS

SEQ ID NO: 951602 - protein, 9 aa, Homo Sapiens
DIIVFATEY

SEQ ID NO: 951603 - protein, 9 aa, Homo Sapiens
VDLAIGFEK

SEQ ID NO: 951604 - protein, 9 aa, Homo Sapiens
YPKSSGPAR

SEQ ID NO: 951605 - protein, 9 aa, Homo Sapiens
PKIQASGET

SEQ ID NO: 951606 - protein, 9 aa, Homo Sapiens
KKCYSSKRL

SEQ ID NO: 951607 - protein, 9 aa, Homo Sapiens
IWVYGVLGG

SEQ ID NO: 951608 - protein, 9 aa, Homo Sapiens
RKTSGLVFL

SEQ ID NO: 951609 - protein, 9 aa, Homo Sapiens
IFREINKST

SEQ ID NO: 951610 - protein, 9 aa, Homo Sapiens
PLHVAADCG

SEQ ID NO: 951611 - protein, 9 aa, Homo Sapiens
QILFLGSLS

SEQ ID NO: 951612 - protein, 9 aa, Homo Sapiens
KNVTYKHKE

SEQ ID NO: 951613 - protein, 9 aa, Homo Sapiens
CVDNVHFFT

SEQ ID NO: 951614 - protein, 9 aa, Homo Sapiens
FYILLTIFR

SEQ ID NO: 951615 - protein, 9 aa, Homo Sapiens
SGLNHVESG

SEQ ID NO: 951616 - protein, 9 aa, Homo Sapiens
LKINHGILY

SEQ ID NO: 951617 - protein, 9 aa, Homo Sapiens
LRDASDPWM

SEQ ID NO: 951618 - protein, 9 aa, Homo Sapiens
KGRANGTVS

SEQ ID NO: 951619 - protein, 9 aa, Homo Sapiens
GFEKRLKIF

SEQ ID NO: 951620 - protein, 9 aa, Homo Sapiens
FHHGITPGK

SEQ ID NO: 951621 - protein, 9 aa, Homo Sapiens
NLGPRNRAD

SEQ ID NO: 951622 - protein, 9 aa, Homo Sapiens
LREQSNPNY

SEQ ID NO: 951623 - protein, 9 aa, Homo Sapiens
SPIPENSGK

SEQ ID NO: 951624 - protein, 9 aa, Homo Sapiens
LNVIISEKL

SEQ ID NO: 951625 - protein, 9 aa, Homo Sapiens
IIKVFSLLV

SEQ ID NO: 951626 - protein, 9 aa, Homo Sapiens
VKATNSMNK

SEQ ID NO: 951627 - protein, 9 aa, Homo Sapiens
HHFSRNSSS

SEQ ID NO: 951628 - protein, 9 aa, Homo Sapiens
RRLEPKPDK

SEQ ID NO: 951629 - protein, 9 aa, Homo Sapiens
YFPQDLWAE

SEQ ID NO: 951630 - protein, 9 aa, Homo Sapiens
TYWNFEFPR

SEQ ID NO: 951631 - protein, 9 aa, Homo Sapiens
LTKFRVNIL

SEQ ID NO: 951632 - protein, 9 aa, Homo Sapiens
SPVGPLSGL

SEQ ID NO: 951633 - protein, 9 aa, Homo Sapiens
PREMKKKVE

SEQ ID NO: 951634 - protein, 9 aa, Homo Sapiens
QKTNPVVET

SEQ ID NO: 951635 - protein, 9 aa, Homo Sapiens
EVERILRLL

SEQ ID NO: 951636 - protein, 9 aa, Homo Sapiens
EPAADGLSE

SEQ ID NO: 951637 - protein, 9 aa, Homo Sapiens
KKDCPRVIR

SEQ ID NO: 951638 - protein, 9 aa, Homo Sapiens
KHLIELRRK

SEQ ID NO: 951639 - protein, 9 aa, Homo Sapiens
YEEQEIFLE

SEQ ID NO: 951640 - protein, 9 aa, Homo Sapiens
CSVPEGPIP

SEQ ID NO: 951641 - protein, 9 aa, Homo Sapiens
DYMKQSPLE

SEQ ID NO: 951642 - protein, 9 aa, Homo Sapiens
RANFLGDLY

SEQ ID NO: 951643 - protein, 9 aa, Homo Sapiens
AHPALDANE

SEQ ID NO: 951644 - protein, 9 aa, Homo Sapiens
DEQVLSISL

SEQ ID NO: 951645 - protein, 9 aa, Homo Sapiens
SLLEEVDYE

SEQ ID NO: 951646 - protein, 9 aa, Homo Sapiens
REQRRFTVS

SEQ ID NO: 951647 - protein, 9 aa, Homo Sapiens
PVTNKETEA

SEQ ID NO: 951648 - protein, 9 aa, Homo Sapiens
SENSTEATD

SEQ ID NO: 951649 - protein, 9 aa, Homo Sapiens
KFSNLPPRE

SEQ ID NO: 951650 - protein, 9 aa, Homo Sapiens
DMSWQQKTN

SEQ ID NO: 951651 - protein, 9 aa, Homo Sapiens
DAELVQHVC

SEQ ID NO: 951652 - protein, 9 aa, Homo Sapiens
SSVLIGNPI

SEQ ID NO: 951653 - protein, 9 aa, Homo Sapiens
TDSLQQLTV

SEQ ID NO: 951654 - protein, 9 aa, Homo Sapiens
LLAPGRSAL

SEQ ID NO: 951655 - protein, 9 aa, Homo Sapiens
LMLSVLFHF

SEQ ID NO: 951656 - protein, 9 aa, Homo Sapiens
VENEEPSLC

SEQ ID NO: 951657 - protein, 9 aa, Homo Sapiens
LRMIQLATP

SEQ ID NO: 951658 - protein, 9 aa, Homo Sapiens
KNLMLSVLF

SEQ ID NO: 951659 - protein, 9 aa, Homo Sapiens
AGDHKKKFE

SEQ ID NO: 951660 - protein, 9 aa, Homo Sapiens
ASSGSLTHT

SEQ ID NO: 951661 - protein, 9 aa, Homo Sapiens
PEENAAAEG

SEQ ID NO: 951662 - protein, 9 aa, Homo Sapiens
DVSARAKVR

SEQ ID NO: 951663 - protein, 9 aa, Homo Sapiens
QTTMLEGYF

SEQ ID NO: 951664 - protein, 9 aa, Homo Sapiens
EELSYSFSH

SEQ ID NO: 951665 - protein, 9 aa, Homo Sapiens
ACDKKGCRE

SEQ ID NO: 951666 - protein, 9 aa, Homo Sapiens
VSGCNIIIF

SEQ ID NO: 951667 - protein, 9 aa, Homo Sapiens
MNEDSILVV

SEQ ID NO: 951668 - protein, 9 aa, Homo Sapiens
SPVRGSFWR

SEQ ID NO: 951669 - protein, 9 aa, Homo Sapiens
IDIIVFATE

SEQ ID NO: 951670 - protein, 9 aa, Homo Sapiens
EEDSDPMLS

SEQ ID NO: 951671 - protein, 9 aa, Homo Sapiens
WPSTLSYYK

SEQ ID NO: 951672 - protein, 9 aa, Homo Sapiens
QATGKGCGH

SEQ ID NO: 951673 - protein, 9 aa, Homo Sapiens
DQILQNIER

SEQ ID NO: 951674 - protein, 9 aa, Homo Sapiens
ALRSASTPR

SEQ ID NO: 951675 - protein, 9 aa, Homo Sapiens
QLPALGNLF

SEQ ID NO: 951676 - protein, 9 aa, Homo Sapiens
NSELQKKKQ

SEQ ID NO: 951677 - protein, 9 aa, Homo Sapiens
PEDIISSES

SEQ ID NO: 951678 - protein, 9 aa, Homo Sapiens
FTCKKGKVF

SEQ ID NO: 951679 - protein, 9 aa, Homo Sapiens
SELLQSQKA

SEQ ID NO: 951680 - protein, 9 aa, Homo Sapiens
AQKVCPRRW

SEQ ID NO: 951681 - protein, 9 aa, Homo Sapiens
ENSVSYQVS

SEQ ID NO: 951682 - protein, 9 aa, Homo Sapiens
CARLQGWKA

SEQ ID NO: 951683 - protein, 9 aa, Homo Sapiens
NNPARAVQK

SEQ ID NO: 951684 - protein, 9 aa, Homo Sapiens
QASGETFPT

SEQ ID NO: 951685 - protein, 9 aa, Homo Sapiens
FTCEILAVI

SEQ ID NO: 951686 - protein, 9 aa, Homo Sapiens
PYCDKTSSV

SEQ ID NO: 951687 - protein, 9 aa, Homo Sapiens
VGERRRAVT

SEQ ID NO: 951688 - protein, 9 aa, Homo Sapiens
TQHQRLYTG

SEQ ID NO: 951689 - protein, 9 aa, Homo Sapiens
TGITTDQLL

SEQ ID NO: 951690 - protein, 9 aa, Homo Sapiens
IELTQLKLL

SEQ ID NO: 951691 - protein, 9 aa, Homo Sapiens
FTDNPRWLD

SEQ ID NO: 951692 - protein, 9 aa, Homo Sapiens
MCNVKETPL

SEQ ID NO: 951693 - protein, 9 aa, Homo Sapiens
WLCPLLLAP

SEQ ID NO: 951694 - protein, 9 aa, Homo Sapiens
QLFLQYGRI

SEQ ID NO: 951695 - protein, 9 aa, Homo Sapiens
KKQSGDGSR

SEQ ID NO: 951696 - protein, 9 aa, Homo Sapiens
KEIIEELRC

SEQ ID NO: 951697 - protein, 9 aa, Homo Sapiens
GLQLVSKWQ

SEQ ID NO: 951698 - protein, 9 aa, Homo Sapiens
IMFLQMKHT

SEQ ID NO: 951699 - protein, 9 aa, Homo Sapiens
FVCKDCRRG

SEQ ID NO: 951700 - protein, 9 aa, Homo Sapiens
VYTGKKPNS

SEQ ID NO: 951701 - protein, 9 aa, Homo Sapiens
GSLEAQVTQ

SEQ ID NO: 951702 - protein, 9 aa, Homo Sapiens
QNEYPFVED

SEQ ID NO: 951703 - protein, 9 aa, Homo Sapiens
AAGWGLCEV

SEQ ID NO: 951704 - protein, 9 aa, Homo Sapiens
IGKDCGTEK

SEQ ID NO: 951705 - protein, 9 aa, Homo Sapiens
FGSSGEDDD

SEQ ID NO: 951706 - protein, 9 aa, Homo Sapiens
RPINLESIF

SEQ ID NO: 951707 - protein, 9 aa, Homo Sapiens
KTLMPPISS

SEQ ID NO: 951708 - protein, 9 aa, Homo Sapiens
DGELESIGF

SEQ ID NO: 951709 - protein, 9 aa, Homo Sapiens
SLLKDGRVV

SEQ ID NO: 951710 - protein, 9 aa, Homo Sapiens
ESPLASLVL

SEQ ID NO: 951711 - protein, 9 aa, Homo Sapiens
IVAAFFEDG

SEQ ID NO: 951712 - protein, 9 aa, Homo Sapiens
EENSVSYQV

SEQ ID NO: 951713 - protein, 9 aa, Homo Sapiens
FPYCDKTSS

SEQ ID NO: 951714 - protein, 9 aa, Homo Sapiens
FPGAPAGWW

SEQ ID NO: 951715 - protein, 9 aa, Homo Sapiens
LRTILQASL

SEQ ID NO: 951716 - protein, 9 aa, Homo Sapiens
PKKLIQLPS

SEQ ID NO: 951717 - protein, 9 aa, Homo Sapiens
RKKHHKKCE

SEQ ID NO: 951718 - protein, 9 aa, Homo Sapiens
FANAIKSDS

SEQ ID NO: 951719 - protein, 9 aa, Homo Sapiens
QRMQSFNEK

SEQ ID NO: 951720 - protein, 9 aa, Homo Sapiens
GDLRFTPIS

SEQ ID NO: 951721 - protein, 9 aa, Homo Sapiens
FSGPAIFRI

SEQ ID NO: 951722 - protein, 9 aa, Homo Sapiens
LCEVLLSNA

SEQ ID NO: 951723 - protein, 9 aa, Homo Sapiens
TEASSSSTI

SEQ ID NO: 951724 - protein, 9 aa, Homo Sapiens
CDEDSADKD

SEQ ID NO: 951725 - protein, 9 aa, Homo Sapiens
DVSVKMLAA

SEQ ID NO: 951726 - protein, 9 aa, Homo Sapiens
PGENESQWI

SEQ ID NO: 951727 - protein, 9 aa, Homo Sapiens
SSLASRDTV

SEQ ID NO: 951728 - protein, 9 aa, Homo Sapiens
TGDTTPFPV

SEQ ID NO: 951729 - protein, 9 aa, Homo Sapiens
PLRTGTSQV

SEQ ID NO: 951730 - protein, 9 aa, Homo Sapiens
FSIFNPERS

SEQ ID NO: 951731 - protein, 9 aa, Homo Sapiens
ETPLPTITW

SEQ ID NO: 951732 - protein, 9 aa, Homo Sapiens
GEATFCDFL

SEQ ID NO: 951733 - protein, 9 aa, Homo Sapiens
NAYSSVQQG

SEQ ID NO: 951734 - protein, 9 aa, Homo Sapiens
NFFPEDSSL

SEQ ID NO: 951735 - protein, 9 aa, Homo Sapiens
NPMYQFSLD

SEQ ID NO: 951736 - protein, 9 aa, Homo Sapiens
HIIDQKTRQ

SEQ ID NO: 951737 - protein, 9 aa, Homo Sapiens
VPALGAAAA

SEQ ID NO: 951738 - protein, 9 aa, Homo Sapiens
AEMSKAFAF

SEQ ID NO: 951739 - protein, 9 aa, Homo Sapiens
WSYRAPCHI

SEQ ID NO: 951740 - protein, 9 aa, Homo Sapiens
LRSASTPRG

SEQ ID NO: 951741 - protein, 9 aa, Homo Sapiens
FCVNCMDCL

SEQ ID NO: 951742 - protein, 9 aa, Homo Sapiens
IVKPLVRKL

SEQ ID NO: 951743 - protein, 9 aa, Homo Sapiens
QHPDLRQNL

SEQ ID NO: 951744 - protein, 9 aa, Homo Sapiens
TTLRLDVWN

SEQ ID NO: 951745 - protein, 9 aa, Homo Sapiens
SGWEQQFLH

SEQ ID NO: 951746 - protein, 9 aa, Homo Sapiens
RYALNHLDT

SEQ ID NO: 951747 - protein, 9 aa, Homo Sapiens
IVKIRLEQN

SEQ ID NO: 951748 - protein, 9 aa, Homo Sapiens
SPLESPILV

SEQ ID NO: 951749 - protein, 9 aa, Homo Sapiens
LPNQYNYGM

SEQ ID NO: 951750 - protein, 9 aa, Homo Sapiens
CSLLDTNSC

SEQ ID NO: 951751 - protein, 9 aa, Homo Sapiens
SVLGLRKWQ

SEQ ID NO: 951752 - protein, 9 aa, Homo Sapiens
ATEYTFAFP

SEQ ID NO: 951753 - protein, 9 aa, Homo Sapiens
TFPFNSFDL

SEQ ID NO: 951754 - protein, 9 aa, Homo Sapiens
IGDKVIFSG

SEQ ID NO: 951755 - protein, 9 aa, Homo Sapiens
VKFVNWICS

SEQ ID NO: 951756 - protein, 9 aa, Homo Sapiens
QGQLLILKG

SEQ ID NO: 951757 - protein, 9 aa, Homo Sapiens
FPSCICHRE

SEQ ID NO: 951758 - protein, 9 aa, Homo Sapiens
GPLLTFYLN

SEQ ID NO: 951759 - protein, 9 aa, Homo Sapiens
YRQILRQKV

SEQ ID NO: 951760 - protein, 9 aa, Homo Sapiens
ILPLPNAQG

SEQ ID NO: 951761 - protein, 9 aa, Homo Sapiens
YPSHGWKEI

SEQ ID NO: 951762 - protein, 9 aa, Homo Sapiens
KAFCYDTQL

SEQ ID NO: 951763 - protein, 9 aa, Homo Sapiens
TQDRYTRNW

SEQ ID NO: 951764 - protein, 9 aa, Homo Sapiens
LRKEASNKL

SEQ ID NO: 951765 - protein, 9 aa, Homo Sapiens
TVQTAVDTI

SEQ ID NO: 951766 - protein, 9 aa, Homo Sapiens
TPKDDIQLV

SEQ ID NO: 951767 - protein, 9 aa, Homo Sapiens
HTSSQMLKG

SEQ ID NO: 951768 - protein, 9 aa, Homo Sapiens
AQLHLSRMK

SEQ ID NO: 951769 - protein, 9 aa, Homo Sapiens
MDQELDTAV

SEQ ID NO: 951770 - protein, 9 aa, Homo Sapiens
LLPDLYALE

SEQ ID NO: 951771 - protein, 9 aa, Homo Sapiens
EGSFGVTTA

SEQ ID NO: 951772 - protein, 9 aa, Homo Sapiens
YSRSPLYPR

SEQ ID NO: 951773 - protein, 9 aa, Homo Sapiens
KNVIGKAKS

SEQ ID NO: 951774 - protein, 9 aa, Homo Sapiens
KDTLLASFI

SEQ ID NO: 951775 - protein, 9 aa, Homo Sapiens
IEERGDMSI

SEQ ID NO: 951776 - protein, 9 aa, Homo Sapiens
KRSLHANGR

SEQ ID NO: 951777 - protein, 9 aa, Homo Sapiens
DDNEQRPSG

SEQ ID NO: 951778 - protein, 9 aa, Homo Sapiens
TAFQLSWKL

SEQ ID NO: 951779 - protein, 9 aa, Homo Sapiens
GSRSRGTGL

SEQ ID NO: 951780 - protein, 9 aa, Homo Sapiens
GEIMLLSAA

SEQ ID NO: 951781 - protein, 9 aa, Homo Sapiens
VVLESDDVG

SEQ ID NO: 951782 - protein, 9 aa, Homo Sapiens
MTGKSRRNL

SEQ ID NO: 951783 - protein, 9 aa, Homo Sapiens
WFSAAPTSL

SEQ ID NO: 951784 - protein, 9 aa, Homo Sapiens
CISRTGILA

SEQ ID NO: 951785 - protein, 9 aa, Homo Sapiens
VERFLVRTH

SEQ ID NO: 951786 - protein, 9 aa, Homo Sapiens
LFWFAVPPA

SEQ ID NO: 951787 - protein, 9 aa, Homo Sapiens
WGYNGNDVE

SEQ ID NO: 951788 - protein, 9 aa, Homo Sapiens
GRGILNIED

SEQ ID NO: 951789 - protein, 9 aa, Homo Sapiens
FLASAWEVE

SEQ ID NO: 951790 - protein, 9 aa, Homo Sapiens
TEVGEIHQN

SEQ ID NO: 951791 - protein, 9 aa, Homo Sapiens
EPFFSNIAN

SEQ ID NO: 951792 - protein, 9 aa, Homo Sapiens
VMMSYNRYM

SEQ ID NO: 951793 - protein, 9 aa, Homo Sapiens
QDENCGQQK

SEQ ID NO: 951794 - protein, 9 aa, Homo Sapiens
QRPVGPRNA

SEQ ID NO: 951795 - protein, 9 aa, Homo Sapiens
PLWLPFVFL

SEQ ID NO: 951796 - protein, 9 aa, Homo Sapiens
SHRERLFQL

SEQ ID NO: 951797 - protein, 9 aa, Homo Sapiens
SNFGAPHPQ

SEQ ID NO: 951798 - protein, 9 aa, Homo Sapiens
FPKKFSFSE

SEQ ID NO: 951799 - protein, 9 aa, Homo Sapiens
SLMCNVKET

SEQ ID NO: 951800 - protein, 9 aa, Homo Sapiens
LLFQNGSVS

SEQ ID NO: 951801 - protein, 9 aa, Homo Sapiens
VAAFFEDGE

SEQ ID NO: 951802 - protein, 9 aa, Homo Sapiens
ANEAALGRA

SEQ ID NO: 951803 - protein, 9 aa, Homo Sapiens
WAPAGVAAD

SEQ ID NO: 951804 - protein, 9 aa, Homo Sapiens
PRRETPKQF

SEQ ID NO: 951805 - protein, 9 aa, Homo Sapiens
AVSTGPFLE

SEQ ID NO: 951806 - protein, 9 aa, Homo Sapiens
IQKAYWSYV

SEQ ID NO: 951807 - protein, 9 aa, Homo Sapiens
KNLIEVRAN

SEQ ID NO: 951808 - protein, 9 aa, Homo Sapiens
ELEPKSPKP

SEQ ID NO: 951809 - protein, 9 aa, Homo Sapiens
EAKKFVKQC

SEQ ID NO: 951810 - protein, 9 aa, Homo Sapiens
SPGRGGSSK

SEQ ID NO: 951811 - protein, 9 aa, Homo Sapiens
EPLEVHKHK

SEQ ID NO: 951812 - protein, 9 aa, Homo Sapiens
RAGLQLVSK

SEQ ID NO: 951813 - protein, 9 aa, Homo Sapiens
PDLSNCTLH

SEQ ID NO: 951814 - protein, 9 aa, Homo Sapiens
ENFMALCAS

SEQ ID NO: 951815 - protein, 9 aa, Homo Sapiens
SYENQPQSS

SEQ ID NO: 951816 - protein, 9 aa, Homo Sapiens
PVGPREPQG

SEQ ID NO: 951817 - protein, 9 aa, Homo Sapiens
QQHHLHRTE

SEQ ID NO: 951818 - protein, 9 aa, Homo Sapiens
LIEILLGSL

SEQ ID NO: 951819 - protein, 9 aa, Homo Sapiens
SQSPLHLST

SEQ ID NO: 951820 - protein, 9 aa, Homo Sapiens
AELVQHVCA

SEQ ID NO: 951821 - protein, 9 aa, Homo Sapiens
MPLQGPGYP

SEQ ID NO: 951822 - protein, 9 aa, Homo Sapiens
TPLANPPDI

SEQ ID NO: 951823 - protein, 9 aa, Homo Sapiens
TSLRLIRKA

SEQ ID NO: 951824 - protein, 9 aa, Homo Sapiens
ERPQEGQLR

SEQ ID NO: 951825 - protein, 9 aa, Homo Sapiens
KLSSYNGEE

SEQ ID NO: 951826 - protein, 9 aa, Homo Sapiens
PDPKKLIQL

SEQ ID NO: 951827 - protein, 9 aa, Homo Sapiens
SFSLSKKAP

SEQ ID NO: 951828 - protein, 9 aa, Homo Sapiens
GYSARPSVH

SEQ ID NO: 951829 - protein, 9 aa, Homo Sapiens
GKYDQAVYQ

SEQ ID NO: 951830 - protein, 9 aa, Homo Sapiens
EFSTVALNA

SEQ ID NO: 951831 - protein, 9 aa, Homo Sapiens
CCAYKNQKK

SEQ ID NO: 951832 - protein, 9 aa, Homo Sapiens
VKTEMDSKT

SEQ ID NO: 951833 - protein, 9 aa, Homo Sapiens
VYYVGDTFF

SEQ ID NO: 951834 - protein, 9 aa, Homo Sapiens
RRLPPAPGL

SEQ ID NO: 951835 - protein, 9 aa, Homo Sapiens
VSAPTELLL

SEQ ID NO: 951836 - protein, 9 aa, Homo Sapiens
LAYSASWDL

SEQ ID NO: 951837 - protein, 9 aa, Homo Sapiens
QATLNSASL

SEQ ID NO: 951838 - protein, 9 aa, Homo Sapiens
TFDENPENN

SEQ ID NO: 951839 - protein, 9 aa, Homo Sapiens
PWNKVEDRL

SEQ ID NO: 951840 - protein, 9 aa, Homo Sapiens
KNQPSLLNG

SEQ ID NO: 951841 - protein, 9 aa, Homo Sapiens
TDQKKFSLQ

SEQ ID NO: 951842 - protein, 9 aa, Homo Sapiens
NFQRESVTF

SEQ ID NO: 951843 - protein, 9 aa, Homo Sapiens
RVQRHFELL

SEQ ID NO: 951844 - protein, 9 aa, Homo Sapiens
PECAYETRY

SEQ ID NO: 951845 - protein, 9 aa, Homo Sapiens
ALILFAAWA

SEQ ID NO: 951846 - protein, 9 aa, Homo Sapiens
SITSLSPRS

SEQ ID NO: 951847 - protein, 9 aa, Homo Sapiens
SPLRTGTSQ

SEQ ID NO: 951848 - protein, 9 aa, Homo Sapiens
WKEVVDWGL

SEQ ID NO: 951849 - protein, 9 aa, Homo Sapiens
VLHGVPSQR

SEQ ID NO: 951850 - protein, 9 aa, Homo Sapiens
IPQVLDLHK

SEQ ID NO: 951851 - protein, 9 aa, Homo Sapiens
SVRSATVPV

SEQ ID NO: 951852 - protein, 9 aa, Homo Sapiens
IAPCRPCLG

SEQ ID NO: 951853 - protein, 9 aa, Homo Sapiens
IYVNLYYAT

SEQ ID NO: 951854 - protein, 9 aa, Homo Sapiens
ISNAASSKE

SEQ ID NO: 951855 - protein, 9 aa, Homo Sapiens
REKQSQSQP

SEQ ID NO: 951856 - protein, 9 aa, Homo Sapiens
LRTHTGEKV

SEQ ID NO: 951857 - protein, 9 aa, Homo Sapiens
EVGEIHQNK

SEQ ID NO: 951858 - protein, 9 aa, Homo Sapiens
YDSSFLNWE

SEQ ID NO: 951859 - protein, 9 aa, Homo Sapiens
SGQATGMSL

SEQ ID NO: 951860 - protein, 9 aa, Homo Sapiens
FCFWSFFLR

SEQ ID NO: 951861 - protein, 9 aa, Homo Sapiens
DYRPTEDVQ

SEQ ID NO: 951862 - protein, 9 aa, Homo Sapiens
GSLYQELKI

SEQ ID NO: 951863 - protein, 9 aa, Homo Sapiens
DNASEEKKA

SEQ ID NO: 951864 - protein, 9 aa, Homo Sapiens
EQSCRKAPP

SEQ ID NO: 951865 - protein, 9 aa, Homo Sapiens
GPHLQNLFT

SEQ ID NO: 951866 - protein, 9 aa, Homo Sapiens
RVLECSSIR

SEQ ID NO: 951867 - protein, 9 aa, Homo Sapiens
KVGASGPAM

SEQ ID NO: 951868 - protein, 9 aa, Homo Sapiens
QVRFRRDSK

SEQ ID NO: 951869 - protein, 9 aa, Homo Sapiens
HVIKMKHGE

SEQ ID NO: 951870 - protein, 9 aa, Homo Sapiens
LSFSSSAGL

SEQ ID NO: 951871 - protein, 9 aa, Homo Sapiens
FPPRIRKTS

SEQ ID NO: 951872 - protein, 9 aa, Homo Sapiens
AFFLVQKSP

SEQ ID NO: 951873 - protein, 9 aa, Homo Sapiens
PRVGGLFGK

SEQ ID NO: 951874 - protein, 9 aa, Homo Sapiens
GLICWPKGT

SEQ ID NO: 951875 - protein, 9 aa, Homo Sapiens
CRPCLGASE

SEQ ID NO: 951876 - protein, 9 aa, Homo Sapiens
PDDNEQRPS

SEQ ID NO: 951877 - protein, 9 aa, Homo Sapiens
EVSVSFRLW

SEQ ID NO: 951878 - protein, 9 aa, Homo Sapiens
FEGLPKPEE

SEQ ID NO: 951879 - protein, 9 aa, Homo Sapiens
EVKVVAKEF

SEQ ID NO: 951880 - protein, 9 aa, Homo Sapiens
VLPPQRQDR

SEQ ID NO: 951881 - protein, 9 aa, Homo Sapiens
FQDPLTSDL

SEQ ID NO: 951882 - protein, 9 aa, Homo Sapiens
CQSLKGLRN

SEQ ID NO: 951883 - protein, 9 aa, Homo Sapiens
DMTEDSAQV

SEQ ID NO: 951884 - protein, 9 aa, Homo Sapiens
SPSTETTEI

SEQ ID NO: 951885 - protein, 9 aa, Homo Sapiens
LSCVSDHKH

SEQ ID NO: 951886 - protein, 9 aa, Homo Sapiens
EHPAQNVEA

SEQ ID NO: 951887 - protein, 9 aa, Homo Sapiens
KPLVRKLVH

SEQ ID NO: 951888 - protein, 9 aa, Homo Sapiens
GLPALEYPN

SEQ ID NO: 951889 - protein, 9 aa, Homo Sapiens
PISLLIPSQ

SEQ ID NO: 951890 - protein, 9 aa, Homo Sapiens
SSSGITNRK

SEQ ID NO: 951891 - protein, 9 aa, Homo Sapiens
PMLFSFGPL

SEQ ID NO: 951892 - protein, 9 aa, Homo Sapiens
QNLKDHGST

SEQ ID NO: 951893 - protein, 9 aa, Homo Sapiens
FYTGLSCVS

SEQ ID NO: 951894 - protein, 9 aa, Homo Sapiens
PSLTKFRVN

SEQ ID NO: 951895 - protein, 9 aa, Homo Sapiens
ILESEEKRD

SEQ ID NO: 951896 - protein, 9 aa, Homo Sapiens
KKMYKIKAG

SEQ ID NO: 951897 - protein, 9 aa, Homo Sapiens
PSDKHLNAI

SEQ ID NO: 951898 - protein, 9 aa, Homo Sapiens
EDLSEDNSL

SEQ ID NO: 951899 - protein, 9 aa, Homo Sapiens
QVKIYAGPK

SEQ ID NO: 951900 - protein, 9 aa, Homo Sapiens
SVNEPLSFF

SEQ ID NO: 951901 - protein, 9 aa, Homo Sapiens
HFAISAGTG

SEQ ID NO: 951902 - protein, 9 aa, Homo Sapiens
SSKEANFQR

SEQ ID NO: 951903 - protein, 9 aa, Homo Sapiens
DGAETAVVT

SEQ ID NO: 951904 - protein, 9 aa, Homo Sapiens
MLQPAQQPS

SEQ ID NO: 951905 - protein, 9 aa, Homo Sapiens
PAGVAADLY

SEQ ID NO: 951906 - protein, 9 aa, Homo Sapiens
CTLPLTEKQ

SEQ ID NO: 951907 - protein, 9 aa, Homo Sapiens
RNREEGYWT

SEQ ID NO: 951908 - protein, 9 aa, Homo Sapiens
QLPMLFSFG

SEQ ID NO: 951909 - protein, 9 aa, Homo Sapiens
LNASDWLNP

SEQ ID NO: 951910 - protein, 9 aa, Homo Sapiens
EDVEEERPP

SEQ ID NO: 951911 - protein, 9 aa, Homo Sapiens
GNRPSSASF

SEQ ID NO: 951912 - protein, 9 aa, Homo Sapiens
EGEPGPEEN

SEQ ID NO: 951913 - protein, 9 aa, Homo Sapiens
KWPSTLSYY

SEQ ID NO: 951914 - protein, 9 aa, Homo Sapiens
PETGITTDQ

SEQ ID NO: 951915 - protein, 9 aa, Homo Sapiens
GEEPHVEEH

SEQ ID NO: 951916 - protein, 9 aa, Homo Sapiens
LNRHCVVYT

SEQ ID NO: 951917 - protein, 9 aa, Homo Sapiens
KKIYAGKKF

SEQ ID NO: 951918 - protein, 9 aa, Homo Sapiens
GAPGPLGSP

SEQ ID NO: 951919 - protein, 9 aa, Homo Sapiens
KKLDYFAKA

SEQ ID NO: 951920 - protein, 9 aa, Homo Sapiens
RGREMFEVM

SEQ ID NO: 951921 - protein, 9 aa, Homo Sapiens
MSKAFAFEI

SEQ ID NO: 951922 - protein, 9 aa, Homo Sapiens
RTLMAQFVP

SEQ ID NO: 951923 - protein, 9 aa, Homo Sapiens
LAEAFQKSA

SEQ ID NO: 951924 - protein, 9 aa, Homo Sapiens
RVTLRKSAK

SEQ ID NO: 951925 - protein, 9 aa, Homo Sapiens
RVRLSNSRG

SEQ ID NO: 951926 - protein, 9 aa, Homo Sapiens
SPNAIVYYF

SEQ ID NO: 951927 - protein, 9 aa, Homo Sapiens
ASLTHLNIR

SEQ ID NO: 951928 - protein, 9 aa, Homo Sapiens
GSLSSRTHL

SEQ ID NO: 951929 - protein, 9 aa, Homo Sapiens
NYQEKKFFD

SEQ ID NO: 951930 - protein, 9 aa, Homo Sapiens
ATFLNISIS

SEQ ID NO: 951931 - protein, 9 aa, Homo Sapiens
DLVVRIQRK

SEQ ID NO: 951932 - protein, 9 aa, Homo Sapiens
NVFFAFELM

SEQ ID NO: 951933 - protein, 9 aa, Homo Sapiens
RLLSGPENH

SEQ ID NO: 951934 - protein, 9 aa, Homo Sapiens
LRFTPISLL

SEQ ID NO: 951935 - protein, 9 aa, Homo Sapiens
RIVAAFFED

SEQ ID NO: 951936 - protein, 9 aa, Homo Sapiens
RRSNSGMDS

SEQ ID NO: 951937 - protein, 9 aa, Homo Sapiens
SFQKDFSGQ

SEQ ID NO: 951938 - protein, 9 aa, Homo Sapiens
KEQKRQKKA

SEQ ID NO: 951939 - protein, 9 aa, Homo Sapiens
RLSRQRHKE

SEQ ID NO: 951940 - protein, 9 aa, Homo Sapiens
ASLPSSGKS

SEQ ID NO: 951941 - protein, 9 aa, Homo Sapiens
IKPFTACQK

SEQ ID NO: 951942 - protein, 9 aa, Homo Sapiens
YIRAAVRNE

SEQ ID NO: 951943 - protein, 9 aa, Homo Sapiens
LKEIMANTT

SEQ ID NO: 951944 - protein, 9 aa, Homo Sapiens
VRQKLKNCT

SEQ ID NO: 951945 - protein, 9 aa, Homo Sapiens
CLHCGGTSH

SEQ ID NO: 951946 - protein, 9 aa, Homo Sapiens
REIFCRGER

SEQ ID NO: 951947 - protein, 9 aa, Homo Sapiens
IAFLSSPLY

SEQ ID NO: 951948 - protein, 9 aa, Homo Sapiens
PAGKMIQVP

SEQ ID NO: 951949 - protein, 9 aa, Homo Sapiens
ELPNQYNYG

SEQ ID NO: 951950 - protein, 9 aa, Homo Sapiens
VYQEAQMPH

SEQ ID NO: 951951 - protein, 9 aa, Homo Sapiens
PYQLKEKKR

SEQ ID NO: 951952 - protein, 9 aa, Homo Sapiens
YSYNALIGP

SEQ ID NO: 951953 - protein, 9 aa, Homo Sapiens
QVQAKADAL

SEQ ID NO: 951954 - protein, 9 aa, Homo Sapiens
NSTEATDIG

SEQ ID NO: 951955 - protein, 9 aa, Homo Sapiens
LFSNARFSW

SEQ ID NO: 951956 - protein, 9 aa, Homo Sapiens
AGVAADLYE

SEQ ID NO: 951957 - protein, 9 aa, Homo Sapiens
HKWPVAPKK

SEQ ID NO: 951958 - protein, 9 aa, Homo Sapiens
SCICHRELY

SEQ ID NO: 951959 - protein, 9 aa, Homo Sapiens
CLEDSNPSN

SEQ ID NO: 951960 - protein, 9 aa, Homo Sapiens
GNLCYDGSH

SEQ ID NO: 951961 - protein, 9 aa, Homo Sapiens
GVFYMFLVA

SEQ ID NO: 951962 - protein, 9 aa, Homo Sapiens
RPQKDFCFL

SEQ ID NO: 951963 - protein, 9 aa, Homo Sapiens
SHGSNSFLY

SEQ ID NO: 951964 - protein, 9 aa, Homo Sapiens
KRRSTNKTD

SEQ ID NO: 951965 - protein, 9 aa, Homo Sapiens
ATGVSDCPV

SEQ ID NO: 951966 - protein, 9 aa, Homo Sapiens
LTHSDLESS

SEQ ID NO: 951967 - protein, 9 aa, Homo Sapiens
QLNSNGVQA

SEQ ID NO: 951968 - protein, 9 aa, Homo Sapiens
KPVVDTYIE

SEQ ID NO: 951969 - protein, 9 aa, Homo Sapiens
QQDQLKNAK

SEQ ID NO: 951970 - protein, 9 aa, Homo Sapiens
FCVITPQQK

SEQ ID NO: 951971 - protein, 9 aa, Homo Sapiens
PDIFTGVRG

SEQ ID NO: 951972 - protein, 9 aa, Homo Sapiens
NNDIPEEKS

SEQ ID NO: 951973 - protein, 9 aa, Homo Sapiens
ARTEERESS

SEQ ID NO: 951974 - protein, 9 aa, Homo Sapiens
PISKKKKEL

SEQ ID NO: 951975 - protein, 9 aa, Homo Sapiens
FKFAMYPPL

SEQ ID NO: 951976 - protein, 9 aa, Homo Sapiens
PEDFSKKHK

SEQ ID NO: 951977 - protein, 9 aa, Homo Sapiens
YTVAMSDKK

SEQ ID NO: 951978 - protein, 9 aa, Homo Sapiens
QRLKILCER

SEQ ID NO: 951979 - protein, 9 aa, Homo Sapiens
EDGPFPCSE

SEQ ID NO: 951980 - protein, 9 aa, Homo Sapiens
LHIAAQKDD

SEQ ID NO: 951981 - protein, 9 aa, Homo Sapiens
EGDVTDKDE

SEQ ID NO: 951982 - protein, 9 aa, Homo Sapiens
EHQRTPTGE

SEQ ID NO: 951983 - protein, 9 aa, Homo Sapiens
ENIDYLGFF

SEQ ID NO: 951984 - protein, 9 aa, Homo Sapiens
FNTMAIING

SEQ ID NO: 951985 - protein, 9 aa, Homo Sapiens
KFAMYPPLM

SEQ ID NO: 951986 - protein, 9 aa, Homo Sapiens
KMAGDMSSS

SEQ ID NO: 951987 - protein, 9 aa, Homo Sapiens
LSKENSLII

SEQ ID NO: 951988 - protein, 9 aa, Homo Sapiens
MFLVAMGLS

SEQ ID NO: 951989 - protein, 9 aa, Homo Sapiens
ETSNENPGY

SEQ ID NO: 951990 - protein, 9 aa, Homo Sapiens
QRTPTGEKP

SEQ ID NO: 951991 - protein, 9 aa, Homo Sapiens
QALRASLEI

SEQ ID NO: 951992 - protein, 9 aa, Homo Sapiens
LESSLHMSD

SEQ ID NO: 951993 - protein, 9 aa, Homo Sapiens
GKSCLVRRF

SEQ ID NO: 951994 - protein, 9 aa, Homo Sapiens
PTGEKPYEC

SEQ ID NO: 951995 - protein, 9 aa, Homo Sapiens
SLDHLYEKP

SEQ ID NO: 951996 - protein, 9 aa, Homo Sapiens
ERLCRNMQS

SEQ ID NO: 951997 - protein, 9 aa, Homo Sapiens
MEEIIFNLA

SEQ ID NO: 951998 - protein, 9 aa, Homo Sapiens
PPKAESLGT

SEQ ID NO: 951999 - protein, 9 aa, Homo Sapiens
DTDFFWNPN

SEQ ID NO: 952000 - protein, 9 aa, Homo Sapiens
WKETSLDHL

SEQ ID NO: 952001 - protein, 9 aa, Homo Sapiens
IQALNNDIP

SEQ ID NO: 952002 - protein, 9 aa, Homo Sapiens
GEQMGCPAG

SEQ ID NO: 952003 - protein, 9 aa, Homo Sapiens
PGLFGDDGL

SEQ ID NO: 952004 - protein, 9 aa, Homo Sapiens
TPQQKITLA

SEQ ID NO: 952005 - protein, 9 aa, Homo Sapiens
YNFGQKNGR

SEQ ID NO: 952006 - protein, 9 aa, Homo Sapiens
SCQKKLYSY

SEQ ID NO: 952007 - protein, 9 aa, Homo Sapiens
HLYYQMGLL

SEQ ID NO: 952008 - protein, 9 aa, Homo Sapiens
SGEEGGEEA

SEQ ID NO: 952009 - protein, 9 aa, Homo Sapiens
TEERESSRA

SEQ ID NO: 952010 - protein, 9 aa, Homo Sapiens
LTITRIESF

SEQ ID NO: 952011 - protein, 9 aa, Homo Sapiens
QDQLKNAKM

SEQ ID NO: 952012 - protein, 9 aa, Homo Sapiens
PDFFVPCVA

SEQ ID NO: 952013 - protein, 9 aa, Homo Sapiens
EVDFFDGHH

SEQ ID NO: 952014 - protein, 9 aa, Homo Sapiens
NIYFFSGPK

SEQ ID NO: 952015 - protein, 9 aa, Homo Sapiens
QSSNTSLAF

SEQ ID NO: 952016 - protein, 9 aa, Homo Sapiens
QRTSLAYIH

SEQ ID NO: 952017 - protein, 9 aa, Homo Sapiens
SPRKTPNIE

SEQ ID NO: 952018 - protein, 9 aa, Homo Sapiens
IYERIHCTD

SEQ ID NO: 952019 - protein, 9 aa, Homo Sapiens
MESSLEEPQ

SEQ ID NO: 952020 - protein, 9 aa, Homo Sapiens
ESLCGEVTL

SEQ ID NO: 952021 - protein, 9 aa, Homo Sapiens
QVKEMRAQL

SEQ ID NO: 952022 - protein, 9 aa, Homo Sapiens
FAMYPPLMI

SEQ ID NO: 952023 - protein, 9 aa, Homo Sapiens
PPLMIATGS

SEQ ID NO: 952024 - protein, 9 aa, Homo Sapiens
HALDSADNQ

SEQ ID NO: 952025 - protein, 9 aa, Homo Sapiens
MERVLPSTC

SEQ ID NO: 952026 - protein, 9 aa, Homo Sapiens
TLGLRMEEI

SEQ ID NO: 952027 - protein, 9 aa, Homo Sapiens
DKKCVELVT

SEQ ID NO: 952028 - protein, 9 aa, Homo Sapiens
KKELGLTKQ

SEQ ID NO: 952029 - protein, 9 aa, Homo Sapiens
KFQEERQDK

SEQ ID NO: 952030 - protein, 9 aa, Homo Sapiens
AIVSISALS

SEQ ID NO: 952031 - protein, 9 aa, Homo Sapiens
TADKFTSTS

SEQ ID NO: 952032 - protein, 9 aa, Homo Sapiens
EARLCGSLK

SEQ ID NO: 952033 - protein, 9 aa, Homo Sapiens
KEEYSAMRD

SEQ ID NO: 952034 - protein, 9 aa, Homo Sapiens
YYTTFDWPP

SEQ ID NO: 952035 - protein, 9 aa, Homo Sapiens
SQLGVRKMA

SEQ ID NO: 952036 - protein, 9 aa, Homo Sapiens
GNSYLSFYF

SEQ ID NO: 952037 - protein, 9 aa, Homo Sapiens
TQCPSAHTA

SEQ ID NO: 952038 - protein, 9 aa, Homo Sapiens
SADNQPAER

SEQ ID NO: 952039 - protein, 9 aa, Homo Sapiens
HLESFHDYL

SEQ ID NO: 952040 - protein, 9 aa, Homo Sapiens
VNLVPGDPQ

SEQ ID NO: 952041 - protein, 9 aa, Homo Sapiens
KEKKATFKE

SEQ ID NO: 952042 - protein, 9 aa, Homo Sapiens
DIDEIKEVP

SEQ ID NO: 952043 - protein, 9 aa, Homo Sapiens
EEQKPLFAV

SEQ ID NO: 952044 - protein, 9 aa, Homo Sapiens
GLAIEVQAD

SEQ ID NO: 952045 - protein, 9 aa, Homo Sapiens
QADQQAWFG

SEQ ID NO: 952046 - protein, 9 aa, Homo Sapiens
FEPDTIDER

SEQ ID NO: 952047 - protein, 9 aa, Homo Sapiens
FYFGESTTG

SEQ ID NO: 952048 - protein, 9 aa, Homo Sapiens
AMNCQGSII

SEQ ID NO: 952049 - protein, 9 aa, Homo Sapiens
IPGLFGDDG

SEQ ID NO: 952050 - protein, 9 aa, Homo Sapiens
VTDKDEGAE

SEQ ID NO: 952051 - protein, 9 aa, Homo Sapiens
EQNKNLQTR

SEQ ID NO: 952052 - protein, 9 aa, Homo Sapiens
RARSVPAAA

SEQ ID NO: 952053 - protein, 9 aa, Homo Sapiens
PVVDTYIES

SEQ ID NO: 952054 - protein, 9 aa, Homo Sapiens
PFRSRFPSD

SEQ ID NO: 952055 - protein, 9 aa, Homo Sapiens
DNGKIGIPN

SEQ ID NO: 952056 - protein, 9 aa, Homo Sapiens
LIVQGLGES

SEQ ID NO: 952057 - protein, 9 aa, Homo Sapiens
CCYWFSNKM

SEQ ID NO: 952058 - protein, 9 aa, Homo Sapiens
LLMKPQHYS

SEQ ID NO: 952059 - protein, 9 aa, Homo Sapiens
QPGLFPATH

SEQ ID NO: 952060 - protein, 9 aa, Homo Sapiens
TFLGKDWGP

SEQ ID NO: 952061 - protein, 9 aa, Homo Sapiens
IYGDLEDTG

SEQ ID NO: 952062 - protein, 9 aa, Homo Sapiens
SLATTATTA

SEQ ID NO: 952063 - protein, 9 aa, Homo Sapiens
ILKNRMYEC

SEQ ID NO: 952064 - protein, 9 aa, Homo Sapiens
FDPGLNQTW

SEQ ID NO: 952065 - protein, 9 aa, Homo Sapiens
HQYEGVTKT

SEQ ID NO: 952066 - protein, 9 aa, Homo Sapiens
LFMFAMNCQ

SEQ ID NO: 952067 - protein, 9 aa, Homo Sapiens
YPIANRNNQ

SEQ ID NO: 952068 - protein, 9 aa, Homo Sapiens
NQFDPGLNQ

SEQ ID NO: 952069 - protein, 9 aa, Homo Sapiens
HSDLESSLH

SEQ ID NO: 952070 - protein, 9 aa, Homo Sapiens
TCPATRIPE

SEQ ID NO: 952071 - protein, 9 aa, Homo Sapiens
AHKGVHTGE

SEQ ID NO: 952072 - protein, 9 aa, Homo Sapiens
KNLQTRVRQ

SEQ ID NO: 952073 - protein, 9 aa, Homo Sapiens
PIQPLVLRR

SEQ ID NO: 952074 - protein, 9 aa, Homo Sapiens
VEYPAGDLF

SEQ ID NO: 952075 - protein, 9 aa, Homo Sapiens
KAGKGHRRT

SEQ ID NO: 952076 - protein, 9 aa, Homo Sapiens
DHRYYADGC

SEQ ID NO: 952077 - protein, 9 aa, Homo Sapiens
RRARSVPAA

SEQ ID NO: 952078 - protein, 9 aa, Homo Sapiens
SKVIVVVGD

SEQ ID NO: 952079 - protein, 9 aa, Homo Sapiens
SSISQFPIT

SEQ ID NO: 952080 - protein, 9 aa, Homo Sapiens
YSSSFQAHK

SEQ ID NO: 952081 - protein, 9 aa, Homo Sapiens
DDLIVQGLG

SEQ ID NO: 952082 - protein, 9 aa, Homo Sapiens
PQFSVPSTA

SEQ ID NO: 952083 - protein, 9 aa, Homo Sapiens
ENGVLKDVW

SEQ ID NO: 952084 - protein, 9 aa, Homo Sapiens
MIVHQGIIL

SEQ ID NO: 952085 - protein, 9 aa, Homo Sapiens
DSLVLPPRP

SEQ ID NO: 952086 - protein, 9 aa, Homo Sapiens
HINHRYSYC

SEQ ID NO: 952087 - protein, 9 aa, Homo Sapiens
KEQSHTQAL

SEQ ID NO: 952088 - protein, 9 aa, Homo Sapiens
SLEDAMVTE

SEQ ID NO: 952089 - protein, 9 aa, Homo Sapiens
YLVRYNNKE

SEQ ID NO: 952090 - protein, 9 aa, Homo Sapiens
CRNMQSILY

SEQ ID NO: 952091 - protein, 9 aa, Homo Sapiens
ETEVEHFFL

SEQ ID NO: 952092 - protein, 9 aa, Homo Sapiens
NAGVGKSCL

SEQ ID NO: 952093 - protein, 9 aa, Homo Sapiens
TMAIINGKK

SEQ ID NO: 952094 - protein, 9 aa, Homo Sapiens
LDRCYSIPS

SEQ ID NO: 952095 - protein, 9 aa, Homo Sapiens
GGKIYKVSS

SEQ ID NO: 952096 - protein, 9 aa, Homo Sapiens
STVDTEEVW

SEQ ID NO: 952097 - protein, 9 aa, Homo Sapiens
TKKQRQALR

SEQ ID NO: 952098 - protein, 9 aa, Homo Sapiens
PGSMEKGML

SEQ ID NO: 952099 - protein, 9 aa, Homo Sapiens
QWIGAWWLG

SEQ ID NO: 952100 - protein, 9 aa, Homo Sapiens
SENGVLKDV

SEQ ID NO: 952101 - protein, 9 aa, Homo Sapiens
LIEHQRTPT

SEQ ID NO: 952102 - protein, 9 aa, Homo Sapiens
KAIQLNSNG

SEQ ID NO: 952103 - protein, 9 aa, Homo Sapiens
PGSSVAQTS

SEQ ID NO: 952104 - protein, 9 aa, Homo Sapiens
SQTNVHMSS

SEQ ID NO: 952105 - protein, 9 aa, Homo Sapiens
ASMPRERRN

SEQ ID NO: 952106 - protein, 9 aa, Homo Sapiens
MEPQGFFVV

SEQ ID NO: 952107 - protein, 9 aa, Homo Sapiens
LSPHLGRSK

SEQ ID NO: 952108 - protein, 9 aa, Homo Sapiens
SHLCLVMSL

SEQ ID NO: 952109 - protein, 9 aa, Homo Sapiens
PPEDAKASQ

SEQ ID NO: 952110 - protein, 9 aa, Homo Sapiens
GDVTDKDEG

SEQ ID NO: 952111 - protein, 9 aa, Homo Sapiens
SQCGKTSAS

SEQ ID NO: 952112 - protein, 9 aa, Homo Sapiens
SELSVKCEA

SEQ ID NO: 952113 - protein, 9 aa, Homo Sapiens
AKKADLDVA

SEQ ID NO: 952114 - protein, 9 aa, Homo Sapiens
KKNVTKFIL

SEQ ID NO: 952115 - protein, 9 aa, Homo Sapiens
VEVDFFDGH

SEQ ID NO: 952116 - protein, 9 aa, Homo Sapiens
EQNVTLYID

SEQ ID NO: 952117 - protein, 9 aa, Homo Sapiens
AMEPQGFFV

SEQ ID NO: 952118 - protein, 9 aa, Homo Sapiens
FLYNFGQKN

SEQ ID NO: 952119 - protein, 9 aa, Homo Sapiens
QSNTGQKTQ

SEQ ID NO: 952120 - protein, 9 aa, Homo Sapiens
NAEVEYQII

SEQ ID NO: 952121 - protein, 9 aa, Homo Sapiens
EVSPPTTPP

SEQ ID NO: 952122 - protein, 9 aa, Homo Sapiens
VMTKLISRN

SEQ ID NO: 952123 - protein, 9 aa, Homo Sapiens
LREQNKNLQ

SEQ ID NO: 952124 - protein, 9 aa, Homo Sapiens
AQRLKILCE

SEQ ID NO: 952125 - protein, 9 aa, Homo Sapiens
ISQFPITSD

SEQ ID NO: 952126 - protein, 9 aa, Homo Sapiens
FAMNCQGSI

SEQ ID NO: 952127 - protein, 9 aa, Homo Sapiens
SREAQDEVP

SEQ ID NO: 952128 - protein, 9 aa, Homo Sapiens
PSDSLVLPP

SEQ ID NO: 952129 - protein, 9 aa, Homo Sapiens
MALSSIVLI

SEQ ID NO: 952130 - protein, 9 aa, Homo Sapiens
ERRNSGVGA

SEQ ID NO: 952131 - protein, 9 aa, Homo Sapiens
YGSEEFPPG

SEQ ID NO: 952132 - protein, 9 aa, Homo Sapiens
SKENSLIIQ

SEQ ID NO: 952133 - protein, 9 aa, Homo Sapiens
ISSNQFDPG

SEQ ID NO: 952134 - protein, 9 aa, Homo Sapiens
TSVLLDKIL

SEQ ID NO: 952135 - protein, 9 aa, Homo Sapiens
SIPEGSEVG

SEQ ID NO: 952136 - protein, 9 aa, Homo Sapiens
GSGEEGGEE

SEQ ID NO: 952137 - protein, 9 aa, Homo Sapiens
SSIVLIPGY

SEQ ID NO: 952138 - protein, 9 aa, Homo Sapiens
LTVLAYTSK

SEQ ID NO: 952139 - protein, 9 aa, Homo Sapiens
KFNTMAIIN

SEQ ID NO: 952140 - protein, 9 aa, Homo Sapiens
ILGNSYLSF

SEQ ID NO: 952141 - protein, 9 aa, Homo Sapiens
LQRTSLAYI

SEQ ID NO: 952142 - protein, 9 aa, Homo Sapiens
NKMKSWSDS

SEQ ID NO: 952143 - protein, 9 aa, Homo Sapiens
ARPRSRSPE

SEQ ID NO: 952144 - protein, 9 aa, Homo Sapiens
NPSNLGYEL

SEQ ID NO: 952145 - protein, 9 aa, Homo Sapiens
KEERKKAFT

SEQ ID NO: 952146 - protein, 9 aa, Homo Sapiens
GTEIPPPPL

SEQ ID NO: 952147 - protein, 9 aa, Homo Sapiens
SEEEESLCG

SEQ ID NO: 952148 - protein, 9 aa, Homo Sapiens
VRGPPKGIL

SEQ ID NO: 952149 - protein, 9 aa, Homo Sapiens
SIVLIPGYM

SEQ ID NO: 952150 - protein, 9 aa, Homo Sapiens
YAFESKSHL

SEQ ID NO: 952151 - protein, 9 aa, Homo Sapiens
PSSASRDVQ

SEQ ID NO: 952152 - protein, 9 aa, Homo Sapiens
PSQPAPVDE

SEQ ID NO: 952153 - protein, 9 aa, Homo Sapiens
VLPTLVAEH

SEQ ID NO: 952154 - protein, 9 aa, Homo Sapiens
LELAKKADL

SEQ ID NO: 952155 - protein, 9 aa, Homo Sapiens
LDHRYYADG

SEQ ID NO: 952156 - protein, 9 aa, Homo Sapiens
PHSCQSFVD

SEQ ID NO: 952157 - protein, 9 aa, Homo Sapiens
EIDPQIRQV

SEQ ID NO: 952158 - protein, 9 aa, Homo Sapiens
KIGIPNLEH

SEQ ID NO: 952159 - protein, 9 aa, Homo Sapiens
PNGPWAMVG

SEQ ID NO: 952160 - protein, 9 aa, Homo Sapiens
QALRKMVID

SEQ ID NO: 952161 - protein, 9 aa, Homo Sapiens
NVTLYIDDQ

SEQ ID NO: 952162 - protein, 9 aa, Homo Sapiens
NMAGVFYMF

SEQ ID NO: 952163 - protein, 9 aa, Homo Sapiens
GLPGRPRLR

SEQ ID NO: 952164 - protein, 9 aa, Homo Sapiens
RLCGSLKMF

SEQ ID NO: 952165 - protein, 9 aa, Homo Sapiens
AGVMGENDT

SEQ ID NO: 952166 - protein, 9 aa, Homo Sapiens
EAGRDIGDL

SEQ ID NO: 952167 - protein, 9 aa, Homo Sapiens
TKERIEQNY

SEQ ID NO: 952168 - protein, 9 aa, Homo Sapiens
VEKGGSGEE

SEQ ID NO: 952169 - protein, 9 aa, Homo Sapiens
LGLTKQDII

SEQ ID NO: 952170 - protein, 9 aa, Homo Sapiens
ELGEPLGNA

SEQ ID NO: 952171 - protein, 9 aa, Homo Sapiens
IIKTPVQMY

SEQ ID NO: 952172 - protein, 9 aa, Homo Sapiens
VDCITGKDE

SEQ ID NO: 952173 - protein, 9 aa, Homo Sapiens
RFLFTSLAT

SEQ ID NO: 952174 - protein, 9 aa, Homo Sapiens
FGLRLEIPI

SEQ ID NO: 952175 - protein, 9 aa, Homo Sapiens
LKNAKMEHT

SEQ ID NO: 952176 - protein, 9 aa, Homo Sapiens
PLGNAPEDP

SEQ ID NO: 952177 - protein, 9 aa, Homo Sapiens
ADSVLPTLV

SEQ ID NO: 952178 - protein, 9 aa, Homo Sapiens
TIKEPKDKS

SEQ ID NO: 952179 - protein, 9 aa, Homo Sapiens
ANRNNQSPV

SEQ ID NO: 952180 - protein, 9 aa, Homo Sapiens
DLGSGMASC

SEQ ID NO: 952181 - protein, 9 aa, Homo Sapiens
EKKATFKEA

SEQ ID NO: 952182 - protein, 9 aa, Homo Sapiens
SDCPVSTLL

SEQ ID NO: 952183 - protein, 9 aa, Homo Sapiens
AAAVQSNTG

SEQ ID NO: 952184 - protein, 9 aa, Homo Sapiens
TQPISKKKK

SEQ ID NO: 952185 - protein, 9 aa, Homo Sapiens
YASPRTYQD

SEQ ID NO: 952186 - protein, 9 aa, Homo Sapiens
NVHMSSMVI

SEQ ID NO: 952187 - protein, 9 aa, Homo Sapiens
LGLSSRPEE

SEQ ID NO: 952188 - protein, 9 aa, Homo Sapiens
HLFDQDKSR

SEQ ID NO: 952189 - protein, 9 aa, Homo Sapiens
IFTGVRGPP

SEQ ID NO: 952190 - protein, 9 aa, Homo Sapiens
ALASRSTHS

SEQ ID NO: 952191 - protein, 9 aa, Homo Sapiens
KGGKIYKVS

SEQ ID NO: 952192 - protein, 9 aa, Homo Sapiens
KGCDKHINN

SEQ ID NO: 952193 - protein, 9 aa, Homo Sapiens
VKSSLANNH

SEQ ID NO: 952194 - protein, 9 aa, Homo Sapiens
PESPEAKKE

SEQ ID NO: 952195 - protein, 9 aa, Homo Sapiens
IEVQADQQA

SEQ ID NO: 952196 - protein, 9 aa, Homo Sapiens
MAGDMSSSP

SEQ ID NO: 952197 - protein, 9 aa, Homo Sapiens
PIPPDLEAM

SEQ ID NO: 952198 - protein, 9 aa, Homo Sapiens
PGHYGPESI

SEQ ID NO: 952199 - protein, 9 aa, Homo Sapiens
NKDVKDAIQ

SEQ ID NO: 952200 - protein, 9 aa, Homo Sapiens
DQSESSDLN

SEQ ID NO: 952201 - protein, 9 aa, Homo Sapiens
PPPSQPAPV

SEQ ID NO: 952202 - protein, 9 aa, Homo Sapiens
LLYDATRVP

SEQ ID NO: 952203 - protein, 9 aa, Homo Sapiens
AEVEYQIID

SEQ ID NO: 952204 - protein, 9 aa, Homo Sapiens
NLYYRIYHA

SEQ ID NO: 952205 - protein, 9 aa, Homo Sapiens
TNGVKSSLA

SEQ ID NO: 952206 - protein, 9 aa, Homo Sapiens
FFVPCVAAL

SEQ ID NO: 952207 - protein, 9 aa, Homo Sapiens
IDEIKEVPT

SEQ ID NO: 952208 - protein, 9 aa, Homo Sapiens
MYPPLMIAT

SEQ ID NO: 952209 - protein, 9 aa, Homo Sapiens
CGLQSISSD

SEQ ID NO: 952210 - protein, 9 aa, Homo Sapiens
HQRTPTGEK

SEQ ID NO: 952211 - protein, 9 aa, Homo Sapiens
SFTPQCFLI

SEQ ID NO: 952212 - protein, 9 aa, Homo Sapiens
NLFEPDTID

SEQ ID NO: 952213 - protein, 9 aa, Homo Sapiens
LMNKKLPSF

SEQ ID NO: 952214 - protein, 9 aa, Homo Sapiens
NRMYECDSV

SEQ ID NO: 952215 - protein, 9 aa, Homo Sapiens
RSTNKTDAS

SEQ ID NO: 952216 - protein, 9 aa, Homo Sapiens
KVSSTEAEA

SEQ ID NO: 952217 - protein, 9 aa, Homo Sapiens
QGLQRTSLA

SEQ ID NO: 952218 - protein, 9 aa, Homo Sapiens
IPSGPWQKA

SEQ ID NO: 952219 - protein, 9 aa, Homo Sapiens
CSQTQCPSA

SEQ ID NO: 952220 - protein, 9 aa, Homo Sapiens
DLEDTGERY

SEQ ID NO: 952221 - protein, 9 aa, Homo Sapiens
DFSKKHKAP

SEQ ID NO: 952222 - protein, 9 aa, Homo Sapiens
VFTRTCGIQ

SEQ ID NO: 952223 - protein, 9 aa, Homo Sapiens
SLGTEPTAN

SEQ ID NO: 952224 - protein, 9 aa, Homo Sapiens
LVNAVYFKR

SEQ ID NO: 952225 - protein, 9 aa, Homo Sapiens
TLVAEHSLE

SEQ ID NO: 952226 - protein, 9 aa, Homo Sapiens
YIQIKFVCG

SEQ ID NO: 952227 - protein, 9 aa, Homo Sapiens
EHYDLDMDK

SEQ ID NO: 952228 - protein, 9 aa, Homo Sapiens
AIQLNSNGV

SEQ ID NO: 952229 - protein, 9 aa, Homo Sapiens
SAIVSISAL

SEQ ID NO: 952230 - protein, 9 aa, Homo Sapiens
VLLLSAIVS

SEQ ID NO: 952231 - protein, 9 aa, Homo Sapiens
VVSPLSEFR

SEQ ID NO: 952232 - protein, 9 aa, Homo Sapiens
KCEAGRDIG

SEQ ID NO: 952233 - protein, 9 aa, Homo Sapiens
TWANLVHPD

SEQ ID NO: 952234 - protein, 9 aa, Homo Sapiens
PQWIGAWWL

SEQ ID NO: 952235 - protein, 9 aa, Homo Sapiens
PDPKDPGHY

SEQ ID NO: 952236 - protein, 9 aa, Homo Sapiens
QYNVWSNDV

SEQ ID NO: 952237 - protein, 9 aa, Homo Sapiens
ESRTGPDQP

SEQ ID NO: 952238 - protein, 9 aa, Homo Sapiens
LGAYKLARH

SEQ ID NO: 952239 - protein, 9 aa, Homo Sapiens
IVVVGDRSS

SEQ ID NO: 952240 - protein, 9 aa, Homo Sapiens
LTKKQRQAL

SEQ ID NO: 952241 - protein, 9 aa, Homo Sapiens
WKIPKNKTR

SEQ ID NO: 952242 - protein, 9 aa, Homo Sapiens
ALRKMVIDM

SEQ ID NO: 952243 - protein, 9 aa, Homo Sapiens
REAQDEVPA

SEQ ID NO: 952244 - protein, 9 aa, Homo Sapiens
RTADKFTST

SEQ ID NO: 952245 - protein, 9 aa, Homo Sapiens
LRLGVEVDF

SEQ ID NO: 952246 - protein, 9 aa, Homo Sapiens
RRVTLAKGW

SEQ ID NO: 952247 - protein, 9 aa, Homo Sapiens
LVLPPRPSI

SEQ ID NO: 952248 - protein, 9 aa, Homo Sapiens
SEEFPPGVK

SEQ ID NO: 952249 - protein, 9 aa, Homo Sapiens
EQMGCPAGC

SEQ ID NO: 952250 - protein, 9 aa, Homo Sapiens
EAVRWPYFC

SEQ ID NO: 952251 - protein, 9 aa, Homo Sapiens
IVQGLGESE

SEQ ID NO: 952252 - protein, 9 aa, Homo Sapiens
QSASFNPPT

SEQ ID NO: 952253 - protein, 9 aa, Homo Sapiens
MDPHSCQSF

SEQ ID NO: 952254 - protein, 9 aa, Homo Sapiens
NDIPEEKSF

SEQ ID NO: 952255 - protein, 9 aa, Homo Sapiens
RELTLSGFF

SEQ ID NO: 952256 - protein, 9 aa, Homo Sapiens
KELGLTKQD

SEQ ID NO: 952257 - protein, 9 aa, Homo Sapiens
ALRRARSVP

SEQ ID NO: 952258 - protein, 9 aa, Homo Sapiens
GVMTKLISR

SEQ ID NO: 952259 - protein, 9 aa, Homo Sapiens
PDPHLYYQM

SEQ ID NO: 952260 - protein, 9 aa, Homo Sapiens
AIFWFRDWE

SEQ ID NO: 952261 - protein, 9 aa, Homo Sapiens
RSRIKVLKR

SEQ ID NO: 952262 - protein, 9 aa, Homo Sapiens
LPGSSVAQT

SEQ ID NO: 952263 - protein, 9 aa, Homo Sapiens
RNEMIETEC

SEQ ID NO: 952264 - protein, 9 aa, Homo Sapiens
EEFPPGVKD

SEQ ID NO: 952265 - protein, 9 aa, Homo Sapiens
ETYGCIEKQ

SEQ ID NO: 952266 - protein, 9 aa, Homo Sapiens
TLGNTKETS

SEQ ID NO: 952267 - protein, 9 aa, Homo Sapiens
DPQFSVPST

SEQ ID NO: 952268 - protein, 9 aa, Homo Sapiens
ADNQPAERT

SEQ ID NO: 952269 - protein, 9 aa, Homo Sapiens
QCGKTSASQ

SEQ ID NO: 952270 - protein, 9 aa, Homo Sapiens
LREGGIFSN

SEQ ID NO: 952271 - protein, 9 aa, Homo Sapiens
GNGGQALVE

SEQ ID NO: 952272 - protein, 9 aa, Homo Sapiens
IPDFFVPCV

SEQ ID NO: 952273 - protein, 9 aa, Homo Sapiens
LCCTNFSTK

SEQ ID NO: 952274 - protein, 9 aa, Homo Sapiens
QSPCRSKIS

SEQ ID NO: 952275 - protein, 9 aa, Homo Sapiens
LPSKRVFLF

SEQ ID NO: 952276 - protein, 9 aa, Homo Sapiens
KIDVNKEEK

SEQ ID NO: 952277 - protein, 9 aa, Homo Sapiens
DIFTGVRGP

SEQ ID NO: 952278 - protein, 9 aa, Homo Sapiens
TTLLFDLAK

SEQ ID NO: 952279 - protein, 9 aa, Homo Sapiens
AVRWPYFCL

SEQ ID NO: 952280 - protein, 9 aa, Homo Sapiens
QAPSSASRD

SEQ ID NO: 952281 - protein, 9 aa, Homo Sapiens
LYPIANRNN

SEQ ID NO: 952282 - protein, 9 aa, Homo Sapiens
TEHLFDQDK

SEQ ID NO: 952283 - protein, 9 aa, Homo Sapiens
DWGPEEMSE

SEQ ID NO: 952284 - protein, 9 aa, Homo Sapiens
SEKEGDLCR

SEQ ID NO: 952285 - protein, 9 aa, Homo Sapiens
LFGDDGLPG

SEQ ID NO: 952286 - protein, 9 aa, Homo Sapiens
GAELRLYHC

SEQ ID NO: 952287 - protein, 9 aa, Homo Sapiens
HLYEKPRKS

SEQ ID NO: 952288 - protein, 9 aa, Homo Sapiens
QPVPPTLRR

SEQ ID NO: 952289 - protein, 9 aa, Homo Sapiens
LFDLAKKKN

SEQ ID NO: 952290 - protein, 9 aa, Homo Sapiens
IIFNLADTH

SEQ ID NO: 952291 - protein, 9 aa, Homo Sapiens
GAYKLARHA

SEQ ID NO: 952292 - protein, 9 aa, Homo Sapiens
FTSLATTAT

SEQ ID NO: 952293 - protein, 9 aa, Homo Sapiens
GIPNLEHAL

SEQ ID NO: 952294 - protein, 9 aa, Homo Sapiens
AQASSVEPE

SEQ ID NO: 952295 - protein, 9 aa, Homo Sapiens
VNCGSHGVC

SEQ ID NO: 952296 - protein, 9 aa, Homo Sapiens
LGNTKETSL

SEQ ID NO: 952297 - protein, 9 aa, Homo Sapiens
VQADQQAWF

SEQ ID NO: 952298 - protein, 9 aa, Homo Sapiens
KSHLCLVMS

SEQ ID NO: 952299 - protein, 9 aa, Homo Sapiens
TLLFDLAKK

SEQ ID NO: 952300 - protein, 9 aa, Homo Sapiens
PWQKAKCSY

SEQ ID NO: 952301 - protein, 9 aa, Homo Sapiens
IWHLVFYND

SEQ ID NO: 952302 - protein, 9 aa, Homo Sapiens
LRASLEIKC

SEQ ID NO: 952303 - protein, 9 aa, Homo Sapiens
LVTEQNVTL

SEQ ID NO: 952304 - protein, 9 aa, Homo Sapiens
INLFEPDTI

SEQ ID NO: 952305 - protein, 9 aa, Homo Sapiens
PVQMYPGPT

SEQ ID NO: 952306 - protein, 9 aa, Homo Sapiens
SSASRDVQA

SEQ ID NO: 952307 - protein, 9 aa, Homo Sapiens
WFQLSSSGS

SEQ ID NO: 952308 - protein, 9 aa, Homo Sapiens
PTLVAEHSL

SEQ ID NO: 952309 - protein, 9 aa, Homo Sapiens
AGTLVNVQR

SEQ ID NO: 952310 - protein, 9 aa, Homo Sapiens
PHHDQRSLS

SEQ ID NO: 952311 - protein, 9 aa, Homo Sapiens
STHNLWLLF

SEQ ID NO: 952312 - protein, 9 aa, Homo Sapiens
PESRTGPDQ

SEQ ID NO: 952313 - protein, 9 aa, Homo Sapiens
SDTDKLLSS

SEQ ID NO: 952314 - protein, 9 aa, Homo Sapiens
TQVKEMRAQ

SEQ ID NO: 952315 - protein, 9 aa, Homo Sapiens
FFGTLASSE

SEQ ID NO: 952316 - protein, 9 aa, Homo Sapiens
QKINAEPEY

SEQ ID NO: 952317 - protein, 9 aa, Homo Sapiens
DPGLNQTWH

SEQ ID NO: 952318 - protein, 9 aa, Homo Sapiens
IFEIYLPSK

SEQ ID NO: 952319 - protein, 9 aa, Homo Sapiens
EKGMLPYDV

SEQ ID NO: 952320 - protein, 9 aa, Homo Sapiens
KADLDVATI

SEQ ID NO: 952321 - protein, 9 aa, Homo Sapiens
LRLYHCLLC

SEQ ID NO: 952322 - protein, 9 aa, Homo Sapiens
FESAAFMYL

SEQ ID NO: 952323 - protein, 9 aa, Homo Sapiens
ELGQGLQRT

SEQ ID NO: 952324 - protein, 9 aa, Homo Sapiens
FLVAMGLSL

SEQ ID NO: 952325 - protein, 9 aa, Homo Sapiens
PSPIPPDLE

SEQ ID NO: 952326 - protein, 9 aa, Homo Sapiens
MASCCQQSK

SEQ ID NO: 952327 - protein, 9 aa, Homo Sapiens
SGSNSRLYM

SEQ ID NO: 952328 - protein, 9 aa, Homo Sapiens
TEEVWANPG

SEQ ID NO: 952329 - protein, 9 aa, Homo Sapiens
HNLWLLFFL

SEQ ID NO: 952330 - protein, 9 aa, Homo Sapiens
QGLTTLLFD

SEQ ID NO: 952331 - protein, 9 aa, Homo Sapiens
EPLKSHFTL

SEQ ID NO: 952332 - protein, 9 aa, Homo Sapiens
IHWKGCFLS

SEQ ID NO: 952333 - protein, 9 aa, Homo Sapiens
TLLCLVFTR

SEQ ID NO: 952334 - protein, 9 aa, Homo Sapiens
CSWHDIEKD

SEQ ID NO: 952335 - protein, 9 aa, Homo Sapiens
FQLSSSGSN

SEQ ID NO: 952336 - protein, 9 aa, Homo Sapiens
PHLECSQTQ

SEQ ID NO: 952337 - protein, 9 aa, Homo Sapiens
ARLCGSLKM

SEQ ID NO: 952338 - protein, 9 aa, Homo Sapiens
LGQSPCRSK

SEQ ID NO: 952339 - protein, 9 aa, Homo Sapiens
LRRARSVPA

SEQ ID NO: 952340 - protein, 9 aa, Homo Sapiens
EDTGERYLG

SEQ ID NO: 952341 - protein, 9 aa, Homo Sapiens
TVLAYTSKG

SEQ ID NO: 952342 - protein, 9 aa, Homo Sapiens
AQKDDTKAA

SEQ ID NO: 952343 - protein, 9 aa, Homo Sapiens
YPPLMIATG

SEQ ID NO: 952344 - protein, 9 aa, Homo Sapiens
KTIMKHVRD

SEQ ID NO: 952345 - protein, 9 aa, Homo Sapiens
EALDSFIDS

SEQ ID NO: 952346 - protein, 9 aa, Homo Sapiens
NSGLYWCEV

SEQ ID NO: 952347 - protein, 9 aa, Homo Sapiens
MIYSTINTL

SEQ ID NO: 952348 - protein, 9 aa, Homo Sapiens
MLPTYVRSI

SEQ ID NO: 952349 - protein, 9 aa, Homo Sapiens
TSLATTATT

SEQ ID NO: 952350 - protein, 9 aa, Homo Sapiens
SLTEESTAF

SEQ ID NO: 952351 - protein, 9 aa, Homo Sapiens
NGGQALVEN

SEQ ID NO: 952352 - protein, 9 aa, Homo Sapiens
WPYFCLRRY

SEQ ID NO: 952353 - protein, 9 aa, Homo Sapiens
TFHLESFHD

SEQ ID NO: 952354 - protein, 9 aa, Homo Sapiens
ENLHYSPST

SEQ ID NO: 952355 - protein, 9 aa, Homo Sapiens
WFLYNFGQK

SEQ ID NO: 952356 - protein, 9 aa, Homo Sapiens
SLLEEDSEK

SEQ ID NO: 952357 - protein, 9 aa, Homo Sapiens
PEEVSPPTT

SEQ ID NO: 952358 - protein, 9 aa, Homo Sapiens
MKTDPVVSP

SEQ ID NO: 952359 - protein, 9 aa, Homo Sapiens
TDSSMERVL

SEQ ID NO: 952360 - protein, 9 aa, Homo Sapiens
AEAGAELRL

SEQ ID NO: 952361 - protein, 9 aa, Homo Sapiens
TISREAQDE

SEQ ID NO: 952362 - protein, 9 aa, Homo Sapiens
ACASEPGIP

SEQ ID NO: 952363 - protein, 9 aa, Homo Sapiens
SASFNPPTQ

SEQ ID NO: 952364 - protein, 9 aa, Homo Sapiens
SSHCTDLYF

SEQ ID NO: 952365 - protein, 9 aa, Homo Sapiens
TSLAFFCNK

SEQ ID NO: 952366 - protein, 9 aa, Homo Sapiens
FLYLQLVET

SEQ ID NO: 952367 - protein, 9 aa, Homo Sapiens
SSNQFDPGL

SEQ ID NO: 952368 - protein, 9 aa, Homo Sapiens
AKKEPIQPL

SEQ ID NO: 952369 - protein, 9 aa, Homo Sapiens
LVHLLQLDQ

SEQ ID NO: 952370 - protein, 9 aa, Homo Sapiens
NTLIAATLP

SEQ ID NO: 952371 - protein, 9 aa, Homo Sapiens
LYTVAMSDK

SEQ ID NO: 952372 - protein, 9 aa, Homo Sapiens
IYLPSKRVF

SEQ ID NO: 952373 - protein, 9 aa, Homo Sapiens
KSMTCPATR

SEQ ID NO: 952374 - protein, 9 aa, Homo Sapiens
LCKMINLFE

SEQ ID NO: 952375 - protein, 9 aa, Homo Sapiens
LPPPSQPAP

SEQ ID NO: 952376 - protein, 9 aa, Homo Sapiens
AAVQSNTGQ

SEQ ID NO: 952377 - protein, 9 aa, Homo Sapiens
DYRFVLKHP

SEQ ID NO: 952378 - protein, 9 aa, Homo Sapiens
LAYAFESKS

SEQ ID NO: 952379 - protein, 9 aa, Homo Sapiens
TYQDFFEAI

SEQ ID NO: 952380 - protein, 9 aa, Homo Sapiens
LRASRMMIQ

SEQ ID NO: 952381 - protein, 9 aa, Homo Sapiens
YHMHSKEER

SEQ ID NO: 952382 - protein, 9 aa, Homo Sapiens
SFIQSLQDL

SEQ ID NO: 952383 - protein, 9 aa, Homo Sapiens
VFYMFLVAM

SEQ ID NO: 952384 - protein, 9 aa, Homo Sapiens
LGQGLQRTS

SEQ ID NO: 952385 - protein, 9 aa, Homo Sapiens
WEINFFACL

SEQ ID NO: 952386 - protein, 9 aa, Homo Sapiens
HLVFYNDGK

SEQ ID NO: 952387 - protein, 9 aa, Homo Sapiens
CKMINLFEP

SEQ ID NO: 952388 - protein, 9 aa, Homo Sapiens
PRDEKEEMM

SEQ ID NO: 952389 - protein, 9 aa, Homo Sapiens
LPQPSPIPP

SEQ ID NO: 952390 - protein, 9 aa, Homo Sapiens
LMIATGSVG

SEQ ID NO: 952391 - protein, 9 aa, Homo Sapiens
QIKFVCGST

SEQ ID NO: 952392 - protein, 9 aa, Homo Sapiens
TRRGSICNG

SEQ ID NO: 952393 - protein, 9 aa, Homo Sapiens
KNRMYECDS

SEQ ID NO: 952394 - protein, 9 aa, Homo Sapiens
LMKPQHYSP

SEQ ID NO: 952395 - protein, 9 aa, Homo Sapiens
MDKILDVPY

SEQ ID NO: 952396 - protein, 9 aa, Homo Sapiens
FHLTVLAYT

SEQ ID NO: 952397 - protein, 9 aa, Homo Sapiens
PAACASEPG

SEQ ID NO: 952398 - protein, 9 aa, Homo Sapiens
VKEKKATFK

SEQ ID NO: 952399 - protein, 9 aa, Homo Sapiens
NCQGSIIFL

SEQ ID NO: 952400 - protein, 9 aa, Homo Sapiens
ESFHDYLLI

SEQ ID NO: 952401 - protein, 9 aa, Homo Sapiens
VIVVVGDRS

SEQ ID NO: 952402 - protein, 9 aa, Homo Sapiens
RGHYSLVIW

SEQ ID NO: 952403 - protein, 9 aa, Homo Sapiens
FTRHLNIIF

SEQ ID NO: 952404 - protein, 9 aa, Homo Sapiens
IEHQRTPTG

SEQ ID NO: 952405 - protein, 9 aa, Homo Sapiens
ISSSSISQF

SEQ ID NO: 952406 - protein, 9 aa, Homo Sapiens
RSTHSAELP

SEQ ID NO: 952407 - protein, 9 aa, Homo Sapiens
VYYASPRTY

SEQ ID NO: 952408 - protein, 9 aa, Homo Sapiens
VEWKIPKNK

SEQ ID NO: 952409 - protein, 9 aa, Homo Sapiens
TLVNVQRRE

SEQ ID NO: 952410 - protein, 9 aa, Homo Sapiens
LAYTSKGAG

SEQ ID NO: 952411 - protein, 9 aa, Homo Sapiens
HALQNPESP

SEQ ID NO: 952412 - protein, 9 aa, Homo Sapiens
GQSPCRSKI

SEQ ID NO: 952413 - protein, 9 aa, Homo Sapiens
KIYKVSSTE

SEQ ID NO: 952414 - protein, 9 aa, Homo Sapiens
VVIQALNND

SEQ ID NO: 952415 - protein, 9 aa, Homo Sapiens
SRSTHSAEL

SEQ ID NO: 952416 - protein, 9 aa, Homo Sapiens
EQNYWQVPR

SEQ ID NO: 952417 - protein, 9 aa, Homo Sapiens
ESGFDPNIC

SEQ ID NO: 952418 - protein, 9 aa, Homo Sapiens
VLKDVWVYD

SEQ ID NO: 952419 - protein, 9 aa, Homo Sapiens
QVTARLLAH

SEQ ID NO: 952420 - protein, 9 aa, Homo Sapiens
QLQFFGTLA

SEQ ID NO: 952421 - protein, 9 aa, Homo Sapiens
YSTINTLIA

SEQ ID NO: 952422 - protein, 9 aa, Homo Sapiens
RNSGVGASL

SEQ ID NO: 952423 - protein, 9 aa, Homo Sapiens
AGDMSSSPR

SEQ ID NO: 952424 - protein, 9 aa, Homo Sapiens
VPSTANTPT

SEQ ID NO: 952425 - protein, 9 aa, Homo Sapiens
CGKTSASQA

SEQ ID NO: 952426 - protein, 9 aa, Homo Sapiens
SGMASCCQQ

SEQ ID NO: 952427 - protein, 9 aa, Homo Sapiens
LNSNGVQAL

SEQ ID NO: 952428 - protein, 9 aa, Homo Sapiens
PALHIAAQK

SEQ ID NO: 952429 - protein, 9 aa, Homo Sapiens
EQAKKEQSH

SEQ ID NO: 952430 - protein, 9 aa, Homo Sapiens
LYNFGQKNG

SEQ ID NO: 952431 - protein, 9 aa, Homo Sapiens
RWALVVLWC

SEQ ID NO: 952432 - protein, 9 aa, Homo Sapiens
TPQCFLIRS

SEQ ID NO: 952433 - protein, 9 aa, Homo Sapiens
MHSKEERKK

SEQ ID NO: 952434 - protein, 9 aa, Homo Sapiens
PGTEIPPPP

SEQ ID NO: 952435 - protein, 9 aa, Homo Sapiens
CQGSIIFLT

SEQ ID NO: 952436 - protein, 9 aa, Homo Sapiens
AVAVFFESA

SEQ ID NO: 952437 - protein, 9 aa, Homo Sapiens
GCFLSEYER

SEQ ID NO: 952438 - protein, 9 aa, Homo Sapiens
EEGGEEAPL

SEQ ID NO: 952439 - protein, 9 aa, Homo Sapiens
FGLAIEVQA

SEQ ID NO: 952440 - protein, 9 aa, Homo Sapiens
SKALGAYKL

SEQ ID NO: 952441 - protein, 9 aa, Homo Sapiens
GLRLEIPIP

SEQ ID NO: 952442 - protein, 9 aa, Homo Sapiens
IIQFTSFVA

SEQ ID NO: 952443 - protein, 9 aa, Homo Sapiens
KTPNIESGV

SEQ ID NO: 952444 - protein, 9 aa, Homo Sapiens
EEVWANPGE

SEQ ID NO: 952445 - protein, 9 aa, Homo Sapiens
YSQHINHRY

SEQ ID NO: 952446 - protein, 9 aa, Homo Sapiens
LYDATRVPL

SEQ ID NO: 952447 - protein, 9 aa, Homo Sapiens
RFKFFLSDK

SEQ ID NO: 952448 - protein, 9 aa, Homo Sapiens
TGVLTRRGS

SEQ ID NO: 952449 - protein, 9 aa, Homo Sapiens
RPDIFTGVR

SEQ ID NO: 952450 - protein, 9 aa, Homo Sapiens
ESAAFMYLQ

SEQ ID NO: 952451 - protein, 9 aa, Homo Sapiens
KRWALVVLW

SEQ ID NO: 952452 - protein, 9 aa, Homo Sapiens
LFTSLATTA

SEQ ID NO: 952453 - protein, 9 aa, Homo Sapiens
QIRQVKAQE

SEQ ID NO: 952454 - protein, 9 aa, Homo Sapiens
PWRNEMIET

SEQ ID NO: 952455 - protein, 9 aa, Homo Sapiens
TPNIESGVP

SEQ ID NO: 952456 - protein, 9 aa, Homo Sapiens
MVGMGEARR

SEQ ID NO: 952457 - protein, 9 aa, Homo Sapiens
FESKSHLCL

SEQ ID NO: 952458 - protein, 9 aa, Homo Sapiens
TDFEDLQDG

SEQ ID NO: 952459 - protein, 9 aa, Homo Sapiens
YDLDMDKIL

SEQ ID NO: 952460 - protein, 9 aa, Homo Sapiens
SARTEERES

SEQ ID NO: 952461 - protein, 9 aa, Homo Sapiens
SMTCPATRI

SEQ ID NO: 952462 - protein, 9 aa, Homo Sapiens
RMMIQPLDI

SEQ ID NO: 952463 - protein, 9 aa, Homo Sapiens
SDKKCVELV

SEQ ID NO: 952464 - protein, 9 aa, Homo Sapiens
ETWANLVHP

SEQ ID NO: 952465 - protein, 9 aa, Homo Sapiens
RNGQISRHI

SEQ ID NO: 952466 - protein, 9 aa, Homo Sapiens
VTKFILIGL

SEQ ID NO: 952467 - protein, 9 aa, Homo Sapiens
IINGKKEHV

SEQ ID NO: 952468 - protein, 9 aa, Homo Sapiens
NHQYEGVTK

SEQ ID NO: 952469 - protein, 9 aa, Homo Sapiens
LRQPAFDIS

SEQ ID NO: 952470 - protein, 9 aa, Homo Sapiens
VLPPRPSIH

SEQ ID NO: 952471 - protein, 9 aa, Homo Sapiens
AAQKDDTKA

SEQ ID NO: 952472 - protein, 9 aa, Homo Sapiens
DLTHSDLES

SEQ ID NO: 952473 - protein, 9 aa, Homo Sapiens
AVSKDEINR

SEQ ID NO: 952474 - protein, 9 aa, Homo Sapiens
ESSRAFPSP

SEQ ID NO: 952475 - protein, 9 aa, Homo Sapiens
WANLVHPDA

SEQ ID NO: 952476 - protein, 9 aa, Homo Sapiens
ARSVPAAAI

SEQ ID NO: 952477 - protein, 9 aa, Homo Sapiens
TTGQKTLTF

SEQ ID NO: 952478 - protein, 9 aa, Homo Sapiens
AALRIYERI

SEQ ID NO: 952479 - protein, 9 aa, Homo Sapiens
LVAMEPQGF

SEQ ID NO: 952480 - protein, 9 aa, Homo Sapiens
FDQDKSRSK

SEQ ID NO: 952481 - protein, 9 aa, Homo Sapiens
SICNGDGGT

SEQ ID NO: 952482 - protein, 9 aa, Homo Sapiens
VCQLRMNRG

SEQ ID NO: 952483 - protein, 9 aa, Homo Sapiens
YDQYAYDGK

SEQ ID NO: 952484 - protein, 9 aa, Homo Sapiens
YTSKGAGPE

SEQ ID NO: 952485 - protein, 9 aa, Homo Sapiens
RSVPAAAIA

SEQ ID NO: 952486 - protein, 9 aa, Homo Sapiens
MRAQLTEQM

SEQ ID NO: 952487 - protein, 9 aa, Homo Sapiens
SRMMIQPLD

SEQ ID NO: 952488 - protein, 9 aa, Homo Sapiens
LLFDLAKKK

SEQ ID NO: 952489 - protein, 9 aa, Homo Sapiens
DLRSRIKVL

SEQ ID NO: 952490 - protein, 9 aa, Homo Sapiens
TLILNLYYR

SEQ ID NO: 952491 - protein, 9 aa, Homo Sapiens
DAAVELNGN

SEQ ID NO: 952492 - protein, 9 aa, Homo Sapiens
SSEAKAGKG

SEQ ID NO: 952493 - protein, 9 aa, Homo Sapiens
PRRNGQISR

SEQ ID NO: 952494 - protein, 9 aa, Homo Sapiens
LPALHIAAQ

SEQ ID NO: 952495 - protein, 9 aa, Homo Sapiens
PTYVRSIPE

SEQ ID NO: 952496 - protein, 9 aa, Homo Sapiens
KDWGPEEMS

SEQ ID NO: 952497 - protein, 9 aa, Homo Sapiens
FPCSECADD

SEQ ID NO: 952498 - protein, 9 aa, Homo Sapiens
HRYYADGCS

SEQ ID NO: 952499 - protein, 9 aa, Homo Sapiens
KPQHYSPKA

SEQ ID NO: 952500 - protein, 9 aa, Homo Sapiens
RLEELHFKV

SEQ ID NO: 952501 - protein, 9 aa, Homo Sapiens
FSQTNVHMS

SEQ ID NO: 952502 - protein, 9 aa, Homo Sapiens
LPGGLPSLE

SEQ ID NO: 952503 - protein, 9 aa, Homo Sapiens
YGSPEDTDF

SEQ ID NO: 952504 - protein, 9 aa, Homo Sapiens
FLSEYERNG

SEQ ID NO: 952505 - protein, 9 aa, Homo Sapiens
EPAAEALDS

SEQ ID NO: 952506 - protein, 9 aa, Homo Sapiens
MNRGGMVQT

SEQ ID NO: 952507 - protein, 9 aa, Homo Sapiens
LWLLFFLRR

SEQ ID NO: 952508 - protein, 9 aa, Homo Sapiens
HTNAEHALQ

SEQ ID NO: 952509 - protein, 9 aa, Homo Sapiens
GQISRHIKE

SEQ ID NO: 952510 - protein, 9 aa, Homo Sapiens
GSICNGDGG

SEQ ID NO: 952511 - protein, 9 aa, Homo Sapiens
QFFGTLASS

SEQ ID NO: 952512 - protein, 9 aa, Homo Sapiens
QNYWQVPRK

SEQ ID NO: 952513 - protein, 9 aa, Homo Sapiens
NKTDASNIE

SEQ ID NO: 952514 - protein, 9 aa, Homo Sapiens
KMKSWSDSY

SEQ ID NO: 952515 - protein, 9 aa, Homo Sapiens
SSSFQAHKG

SEQ ID NO: 952516 - protein, 9 aa, Homo Sapiens
KPTDFEDLQ

SEQ ID NO: 952517 - protein, 9 aa, Homo Sapiens
PLQPVPPTL

SEQ ID NO: 952518 - protein, 9 aa, Homo Sapiens
QPLVLRRTY

SEQ ID NO: 952519 - protein, 9 aa, Homo Sapiens
LAWLGYGSE

SEQ ID NO: 952520 - protein, 9 aa, Homo Sapiens
DCPVSTLLP

SEQ ID NO: 952521 - protein, 9 aa, Homo Sapiens
IENIDYLGF

SEQ ID NO: 952522 - protein, 9 aa, Homo Sapiens
SMENSPTIK

SEQ ID NO: 952523 - protein, 9 aa, Homo Sapiens
LIYMDPHSC

SEQ ID NO: 952524 - protein, 9 aa, Homo Sapiens
PSFAAAVQS

SEQ ID NO: 952525 - protein, 9 aa, Homo Sapiens
PARKRWALV

SEQ ID NO: 952526 - protein, 9 aa, Homo Sapiens
EEIIFNLAD

SEQ ID NO: 952527 - protein, 9 aa, Homo Sapiens
EPQGFFVVM

SEQ ID NO: 952528 - protein, 9 aa, Homo Sapiens
KPGSMEKGM

SEQ ID NO: 952529 - protein, 9 aa, Homo Sapiens
TSWKQEPQL

SEQ ID NO: 952530 - protein, 9 aa, Homo Sapiens
TSSLTEEST

SEQ ID NO: 952531 - protein, 9 aa, Homo Sapiens
HEPPEDAKA

SEQ ID NO: 952532 - protein, 9 aa, Homo Sapiens
GDLTHSDLE

SEQ ID NO: 952533 - protein, 9 aa, Homo Sapiens
KTNGVKSSL

SEQ ID NO: 952534 - protein, 9 aa, Homo Sapiens
LCGEVTLKR

SEQ ID NO: 952535 - protein, 9 aa, Homo Sapiens
QSSLPGSSV

SEQ ID NO: 952536 - protein, 9 aa, Homo Sapiens
THQPWPTVA

SEQ ID NO: 952537 - protein, 9 aa, Homo Sapiens
SRTYPSFRE

SEQ ID NO: 952538 - protein, 9 aa, Homo Sapiens
QPRRNGQIS

SEQ ID NO: 952539 - protein, 9 aa, Homo Sapiens
CQLRMNRGG

SEQ ID NO: 952540 - protein, 9 aa, Homo Sapiens
ERKKAFTTI

SEQ ID NO: 952541 - protein, 9 aa, Homo Sapiens
PLPGGLPSL

SEQ ID NO: 952542 - protein, 9 aa, Homo Sapiens
LRGYDQYAY

SEQ ID NO: 952543 - protein, 9 aa, Homo Sapiens
SWSCQKKLY

SEQ ID NO: 952544 - protein, 9 aa, Homo Sapiens
FFFMVLALN

SEQ ID NO: 952545 - protein, 9 aa, Homo Sapiens
RLFRGAVAI

SEQ ID NO: 952546 - protein, 9 aa, Homo Sapiens
PAGDLFGHL

SEQ ID NO: 952547 - protein, 9 aa, Homo Sapiens
ECSQTQCPS

SEQ ID NO: 952548 - protein, 9 aa, Homo Sapiens
MELREQNKN

SEQ ID NO: 952549 - protein, 9 aa, Homo Sapiens
SSVAQTSLI

SEQ ID NO: 952550 - protein, 9 aa, Homo Sapiens
MPARKRWAL

SEQ ID NO: 952551 - protein, 9 aa, Homo Sapiens
GKGHRRTMS

SEQ ID NO: 952552 - protein, 9 aa, Homo Sapiens
RYNNKESLA

SEQ ID NO: 952553 - protein, 9 aa, Homo Sapiens
DGCSPHYIL

SEQ ID NO: 952554 - protein, 9 aa, Homo Sapiens
RNLTTYRKE

SEQ ID NO: 952555 - protein, 9 aa, Homo Sapiens
DNQPAERTP

SEQ ID NO: 952556 - protein, 9 aa, Homo Sapiens
LEKGEQMGC

SEQ ID NO: 952557 - protein, 9 aa, Homo Sapiens
SPIPPDLEA

SEQ ID NO: 952558 - protein, 9 aa, Homo Sapiens
ISKKKKELP

SEQ ID NO: 952559 - protein, 9 aa, Homo Sapiens
ALVVLWCLT

SEQ ID NO: 952560 - protein, 9 aa, Homo Sapiens
LRPDIFTGV

SEQ ID NO: 952561 - protein, 9 aa, Homo Sapiens
PNWELGEPL

SEQ ID NO: 952562 - protein, 9 aa, Homo Sapiens
TVQRFLFTS

SEQ ID NO: 952563 - protein, 9 aa, Homo Sapiens
RIEQNYWQV

SEQ ID NO: 952564 - protein, 9 aa, Homo Sapiens
LTTLLFDLA

SEQ ID NO: 952565 - protein, 9 aa, Homo Sapiens
AKEGNSGLY

SEQ ID NO: 952566 - protein, 9 aa, Homo Sapiens
YSWVTPPVS

SEQ ID NO: 952567 - protein, 9 aa, Homo Sapiens
SEAKAGKGH

SEQ ID NO: 952568 - protein, 9 aa, Homo Sapiens
ATASKVIVV

SEQ ID NO: 952569 - protein, 9 aa, Homo Sapiens
SLKMFNYFK

SEQ ID NO: 952570 - protein, 9 aa, Homo Sapiens
AEALDSFID

SEQ ID NO: 952571 - protein, 9 aa, Homo Sapiens
KVIVVVGDR

SEQ ID NO: 952572 - protein, 9 aa, Homo Sapiens
MSHGSNSFL

SEQ ID NO: 952573 - protein, 9 aa, Homo Sapiens
FGHLLAYLS

SEQ ID NO: 952574 - protein, 9 aa, Homo Sapiens
GCDKHINNL

SEQ ID NO: 952575 - protein, 9 aa, Homo Sapiens
LDMDKILDV

SEQ ID NO: 952576 - protein, 9 aa, Homo Sapiens
ARLFRGAVA

SEQ ID NO: 952577 - protein, 9 aa, Homo Sapiens
SMQPTSWKQ

SEQ ID NO: 952578 - protein, 9 aa, Homo Sapiens
GYGSEEFPP

SEQ ID NO: 952579 - protein, 9 aa, Homo Sapiens
LGNAPEDPS

SEQ ID NO: 952580 - protein, 9 aa, Homo Sapiens
EDLQDGEDL

SEQ ID NO: 952581 - protein, 9 aa, Homo Sapiens
PLLGQSPCR

SEQ ID NO: 952582 - protein, 9 aa, Homo Sapiens
PRTYQDFFE

SEQ ID NO: 952583 - protein, 9 aa, Homo Sapiens
SMLQKFQEE

SEQ ID NO: 952584 - protein, 9 aa, Homo Sapiens
CIPGAKEGN

SEQ ID NO: 952585 - protein, 9 aa, Homo Sapiens
TSKGAGPES

SEQ ID NO: 952586 - protein, 9 aa, Homo Sapiens
ADQQAWFGF

SEQ ID NO: 952587 - protein, 9 aa, Homo Sapiens
GIPGLFGDD

SEQ ID NO: 952588 - protein, 9 aa, Homo Sapiens
TTSSLTEES

SEQ ID NO: 952589 - protein, 9 aa, Homo Sapiens
LRLEIPIPS

SEQ ID NO: 952590 - protein, 9 aa, Homo Sapiens
PLPAEEKFT

SEQ ID NO: 952591 - protein, 9 aa, Homo Sapiens
RCYSIPSSC

SEQ ID NO: 952592 - protein, 9 aa, Homo Sapiens
QKNGRTWKI

SEQ ID NO: 952593 - protein, 9 aa, Homo Sapiens
TLNSRNPAE

SEQ ID NO: 952594 - protein, 9 aa, Homo Sapiens
IGIPNLEHA

SEQ ID NO: 952595 - protein, 9 aa, Homo Sapiens
HDQRSLSPH

SEQ ID NO: 952596 - protein, 9 aa, Homo Sapiens
LRLREGGIF

SEQ ID NO: 952597 - protein, 9 aa, Homo Sapiens
DPVVSPLSE

SEQ ID NO: 952598 - protein, 9 aa, Homo Sapiens
GHYSLVIWL

SEQ ID NO: 952599 - protein, 9 aa, Homo Sapiens
TKTVYNLIR

SEQ ID NO: 952600 - protein, 9 aa, Homo Sapiens
IAKWHMLCD

SEQ ID NO: 952601 - protein, 9 aa, Homo Sapiens
FHDYLLITE

SEQ ID NO: 952602 - protein, 9 aa, Homo Sapiens
ALDSFIDSQ

SEQ ID NO: 952603 - protein, 9 aa, Homo Sapiens
SVPSTANTP

SEQ ID NO: 952604 - protein, 9 aa, Homo Sapiens
SDLESSLHM

SEQ ID NO: 952605 - protein, 9 aa, Homo Sapiens
PARPRSRSP

SEQ ID NO: 952606 - protein, 9 aa, Homo Sapiens
APTDYRFVL

SEQ ID NO: 952607 - protein, 9 aa, Homo Sapiens
LRMRQLNGN

SEQ ID NO: 952608 - protein, 9 aa, Homo Sapiens
LVRYNNKES

SEQ ID NO: 952609 - protein, 9 aa, Homo Sapiens
PVRKNLFYF

SEQ ID NO: 952610 - protein, 9 aa, Homo Sapiens
EVEYQIIDG

SEQ ID NO: 952611 - protein, 9 aa, Homo Sapiens
EHLFDQDKS

SEQ ID NO: 952612 - protein, 9 aa, Homo Sapiens
LVVLWCLTG

SEQ ID NO: 952613 - protein, 9 aa, Homo Sapiens
SISSDYIEA

SEQ ID NO: 952614 - protein, 9 aa, Homo Sapiens
QLSSSGSNS

SEQ ID NO: 952615 - protein, 9 aa, Homo Sapiens
EDPQFSVPS

SEQ ID NO: 952616 - protein, 9 aa, Homo Sapiens
PPTLRRQSS

SEQ ID NO: 952617 - protein, 9 aa, Homo Sapiens
VCIATNALR

SEQ ID NO: 952618 - protein, 9 aa, Homo Sapiens
RIAELMNKK

SEQ ID NO: 952619 - protein, 9 aa, Homo Sapiens
SIKYMARLF

SEQ ID NO: 952620 - protein, 9 aa, Homo Sapiens
DWEINFFAC

SEQ ID NO: 952621 - protein, 9 aa, Homo Sapiens
KNKTRTVNL

SEQ ID NO: 952622 - protein, 9 aa, Homo Sapiens
EPPEEVSPP

SEQ ID NO: 952623 - protein, 9 aa, Homo Sapiens
STCFSFIGC

SEQ ID NO: 952624 - protein, 9 aa, Homo Sapiens
QNPESPETT

SEQ ID NO: 952625 - protein, 9 aa, Homo Sapiens
SGIWHLVFY

SEQ ID NO: 952626 - protein, 9 aa, Homo Sapiens
QKIINTKYF

SEQ ID NO: 952627 - protein, 9 aa, Homo Sapiens
FVCGSTFKE

SEQ ID NO: 952628 - protein, 9 aa, Homo Sapiens
SGFFLRTLY

SEQ ID NO: 952629 - protein, 9 aa, Homo Sapiens
PPGTEIPPP

SEQ ID NO: 952630 - protein, 9 aa, Homo Sapiens
WELGEPLGN

SEQ ID NO: 952631 - protein, 9 aa, Homo Sapiens
AISSSSISQ

SEQ ID NO: 952632 - protein, 9 aa, Homo Sapiens
SLDRCYSIP

SEQ ID NO: 952633 - protein, 9 aa, Homo Sapiens
GPWQKAKCS

SEQ ID NO: 952634 - protein, 9 aa, Homo Sapiens
YPSFREASV

SEQ ID NO: 952635 - protein, 9 aa, Homo Sapiens
LLEEDSEKE

SEQ ID NO: 952636 - protein, 9 aa, Homo Sapiens
CFLSEYERN

SEQ ID NO: 952637 - protein, 9 aa, Homo Sapiens
QPSPIPPDL

SEQ ID NO: 952638 - protein, 9 aa, Homo Sapiens
QFDPGLNQT

SEQ ID NO: 952639 - protein, 9 aa, Homo Sapiens
FTRTCGIQH

SEQ ID NO: 952640 - protein, 9 aa, Homo Sapiens
ITRIESFIQ

SEQ ID NO: 952641 - protein, 9 aa, Homo Sapiens
KDFCFLSSK

SEQ ID NO: 952642 - protein, 9 aa, Homo Sapiens
SNGVQALLL

SEQ ID NO: 952643 - protein, 9 aa, Homo Sapiens
STANTPTPI

SEQ ID NO: 952644 - protein, 9 aa, Homo Sapiens
DPQTGEIYY

SEQ ID NO: 952645 - protein, 9 aa, Homo Sapiens
MKHVRDNLY

SEQ ID NO: 952646 - protein, 9 aa, Homo Sapiens
LGLPGRPRL

SEQ ID NO: 952647 - protein, 9 aa, Homo Sapiens
DKFNIATGK

SEQ ID NO: 952648 - protein, 9 aa, Homo Sapiens
YGPESITFI

SEQ ID NO: 952649 - protein, 9 aa, Homo Sapiens
FFESAAFMY

SEQ ID NO: 952650 - protein, 9 aa, Homo Sapiens
RIENIDYLG

SEQ ID NO: 952651 - protein, 9 aa, Homo Sapiens
NTKETSLSV

SEQ ID NO: 952652 - protein, 9 aa, Homo Sapiens
FPATHQPWP

SEQ ID NO: 952653 - protein, 9 aa, Homo Sapiens
PSLEDAMVT

SEQ ID NO: 952654 - protein, 9 aa, Homo Sapiens
SKAALRIYE

SEQ ID NO: 952655 - protein, 9 aa, Homo Sapiens
LPSTCCSEN

SEQ ID NO: 952656 - protein, 9 aa, Homo Sapiens
MPRERRNSG

SEQ ID NO: 952657 - protein, 9 aa, Homo Sapiens
VFYNDGKES

SEQ ID NO: 952658 - protein, 9 aa, Homo Sapiens
LLLSAIVSI

SEQ ID NO: 952659 - protein, 9 aa, Homo Sapiens
LGLKTIMKH

SEQ ID NO: 952660 - protein, 9 aa, Homo Sapiens
IYSLRNREG

SEQ ID NO: 952661 - protein, 9 aa, Homo Sapiens
PNLEHALKC

SEQ ID NO: 952662 - protein, 9 aa, Homo Sapiens
SLCGEVTLK

SEQ ID NO: 952663 - protein, 9 aa, Homo Sapiens
RQALRKMVI

SEQ ID NO: 952664 - protein, 9 aa, Homo Sapiens
RPRLRAPPA

SEQ ID NO: 952665 - protein, 9 aa, Homo Sapiens
NRGGMVQTS

SEQ ID NO: 952666 - protein, 9 aa, Homo Sapiens
PIANRNNQS

SEQ ID NO: 952667 - protein, 9 aa, Homo Sapiens
HIAAQKDDT

SEQ ID NO: 952668 - protein, 9 aa, Homo Sapiens
TYRKELVGH

SEQ ID NO: 952669 - protein, 9 aa, Homo Sapiens
KALGAYKLA

SEQ ID NO: 952670 - protein, 9 aa, Homo Sapiens
DTDKLLSSD

SEQ ID NO: 952671 - protein, 9 aa, Homo Sapiens
SDKFNIATG

SEQ ID NO: 952672 - protein, 9 aa, Homo Sapiens
KETSLSVSG

SEQ ID NO: 952673 - protein, 9 aa, Homo Sapiens
TGQKTLTFV

SEQ ID NO: 952674 - protein, 9 aa, Homo Sapiens
SLVLPPRPS

SEQ ID NO: 952675 - protein, 9 aa, Homo Sapiens
ENPGYDEEA

SEQ ID NO: 952676 - protein, 9 aa, Homo Sapiens
ERESSRAFP

SEQ ID NO: 952677 - protein, 9 aa, Homo Sapiens
LILNLYYRI

SEQ ID NO: 952678 - protein, 9 aa, Homo Sapiens
PQHYSPKAD

SEQ ID NO: 952679 - protein, 9 aa, Homo Sapiens
NFTCEPKSK

SEQ ID NO: 952680 - protein, 9 aa, Homo Sapiens
EIKEVPTTS

SEQ ID NO: 952681 - protein, 9 aa, Homo Sapiens
QVYYASPRT

SEQ ID NO: 952682 - protein, 9 aa, Homo Sapiens
LNGNIYFFS

SEQ ID NO: 952683 - protein, 9 aa, Homo Sapiens
HCTDLYFTP

SEQ ID NO: 952684 - protein, 9 aa, Homo Sapiens
NLHYSPSTC

SEQ ID NO: 952685 - protein, 9 aa, Homo Sapiens
VSPLSEFRR

SEQ ID NO: 952686 - protein, 9 aa, Homo Sapiens
FLRTLYASS

SEQ ID NO: 952687 - protein, 9 aa, Homo Sapiens
LPTYVRSIP

SEQ ID NO: 952688 - protein, 9 aa, Homo Sapiens
YWFSNKMKS

SEQ ID NO: 952689 - protein, 9 aa, Homo Sapiens
GEVDCITGK

SEQ ID NO: 952690 - protein, 9 aa, Homo Sapiens
SKEERKKAF

SEQ ID NO: 952691 - protein, 9 aa, Homo Sapiens
ICFNYLDNR

SEQ ID NO: 952692 - protein, 9 aa, Homo Sapiens
TDKDVIKVS

SEQ ID NO: 952693 - protein, 9 aa, Homo Sapiens
QNLEQKINA

SEQ ID NO: 952694 - protein, 9 aa, Homo Sapiens
TEQNVTLYI

SEQ ID NO: 952695 - protein, 9 aa, Homo Sapiens
FKFFLSDKF

SEQ ID NO: 952696 - protein, 9 aa, Homo Sapiens
RGSICNGDG

SEQ ID NO: 952697 - protein, 9 aa, Homo Sapiens
LLTRNLTTY

SEQ ID NO: 952698 - protein, 9 aa, Homo Sapiens
DRCYSIPSS

SEQ ID NO: 952699 - protein, 9 aa, Homo Sapiens
VSIPWRNEM

SEQ ID NO: 952700 - protein, 9 aa, Homo Sapiens
MENSPTIKE

SEQ ID NO: 952701 - protein, 9 aa, Homo Sapiens
LVIWLVTFT

SEQ ID NO: 952702 - protein, 9 aa, Homo Sapiens
EKEEMMEVS

SEQ ID NO: 952703 - protein, 9 aa, Homo Sapiens
KNVTKFILI

SEQ ID NO: 952704 - protein, 9 aa, Homo Sapiens
NNKESLAGQ

SEQ ID NO: 952705 - protein, 9 aa, Homo Sapiens
LRSRIKVLK

SEQ ID NO: 952706 - protein, 9 aa, Homo Sapiens
VELNGNIYF

SEQ ID NO: 952707 - protein, 9 aa, Homo Sapiens
SEQAPSSAS

SEQ ID NO: 952708 - protein, 9 aa, Homo Sapiens
DYLGFFIYR

SEQ ID NO: 952709 - protein, 9 aa, Homo Sapiens
KLARHAYDK

SEQ ID NO: 952710 - protein, 9 aa, Homo Sapiens
SFNPPTQKP

SEQ ID NO: 952711 - protein, 9 aa, Homo Sapiens
VRSIPEGSE

SEQ ID NO: 952712 - protein, 9 aa, Homo Sapiens
LPAEEKFTE

SEQ ID NO: 952713 - protein, 9 aa, Homo Sapiens
QRSLSPHLG

SEQ ID NO: 952714 - protein, 9 aa, Homo Sapiens
GSVSIPWRN

SEQ ID NO: 952715 - protein, 9 aa, Homo Sapiens
SSLEEPQET

SEQ ID NO: 952716 - protein, 9 aa, Homo Sapiens
TDKDEGAEM

SEQ ID NO: 952717 - protein, 9 aa, Homo Sapiens
DFFVPCVAA

SEQ ID NO: 952718 - protein, 9 aa, Homo Sapiens
QRFLFTSLA

SEQ ID NO: 952719 - protein, 9 aa, Homo Sapiens
TRTCGIQHL

SEQ ID NO: 952720 - protein, 9 aa, Homo Sapiens
TLAKGWGEL

SEQ ID NO: 952721 - protein, 9 aa, Homo Sapiens
WKQEPQLCG

SEQ ID NO: 952722 - protein, 9 aa, Homo Sapiens
ALGAYKLAR

SEQ ID NO: 952723 - protein, 9 aa, Homo Sapiens
AIINGKKEH

SEQ ID NO: 952724 - protein, 9 aa, Homo Sapiens
KMINLFEPD

SEQ ID NO: 952725 - protein, 9 aa, Homo Sapiens
TVADIWRLV

SEQ ID NO: 952726 - protein, 9 aa, Homo Sapiens
IPEGSEVGD

SEQ ID NO: 952727 - protein, 9 aa, Homo Sapiens
PATHQPWPT

SEQ ID NO: 952728 - protein, 9 aa, Homo Sapiens
FYFSTGQNP

SEQ ID NO: 952729 - protein, 9 aa, Homo Sapiens
DILDTAGKE

SEQ ID NO: 952730 - protein, 9 aa, Homo Sapiens
RHLNIIFIN

SEQ ID NO: 952731 - protein, 9 aa, Homo Sapiens
VIQALNNDI

SEQ ID NO: 952732 - protein, 9 aa, Homo Sapiens
AFDISFVLC

SEQ ID NO: 952733 - protein, 9 aa, Homo Sapiens
IDYLGFFIY

SEQ ID NO: 952734 - protein, 9 aa, Homo Sapiens
VPESPEAKK

SEQ ID NO: 952735 - protein, 9 aa, Homo Sapiens
DKFTSTSDP

SEQ ID NO: 952736 - protein, 9 aa, Homo Sapiens
QPAFDISFV

SEQ ID NO: 952737 - protein, 9 aa, Homo Sapiens
HHDQRSLSP

SEQ ID NO: 952738 - protein, 9 aa, Homo Sapiens
PICSWHDIE

SEQ ID NO: 952739 - protein, 9 aa, Homo Sapiens
KFHHFKPVV

SEQ ID NO: 952740 - protein, 9 aa, Homo Sapiens
CTNFSTKEG

SEQ ID NO: 952741 - protein, 9 aa, Homo Sapiens
VLFMFAMNC

SEQ ID NO: 952742 - protein, 9 aa, Homo Sapiens
AAEALDSFI

SEQ ID NO: 952743 - protein, 9 aa, Homo Sapiens
FVSNQVREF

SEQ ID NO: 952744 - protein, 9 aa, Homo Sapiens
DPTPGNLCY

SEQ ID NO: 952745 - protein, 9 aa, Homo Sapiens
SSMERVLPS

SEQ ID NO: 952746 - protein, 9 aa, Homo Sapiens
WGPEEMSEY

SEQ ID NO: 952747 - protein, 9 aa, Homo Sapiens
PEEQKPLFA

SEQ ID NO: 952748 - protein, 9 aa, Homo Sapiens
PLTLILNLY

SEQ ID NO: 952749 - protein, 9 aa, Homo Sapiens
LGVRKMAGD

SEQ ID NO: 952750 - protein, 9 aa, Homo Sapiens
EDSTTSSLT

SEQ ID NO: 952751 - protein, 9 aa, Homo Sapiens
DPHSCQSFV

SEQ ID NO: 952752 - protein, 9 aa, Homo Sapiens
AAVELNGNI

SEQ ID NO: 952753 - protein, 9 aa, Homo Sapiens
GETSNENPG

SEQ ID NO: 952754 - protein, 9 aa, Homo Sapiens
IAETYGCIE

SEQ ID NO: 952755 - protein, 9 aa, Homo Sapiens
KTRTVNLTD

SEQ ID NO: 952756 - protein, 9 aa, Homo Sapiens
ANLVHPDAQ

SEQ ID NO: 952757 - protein, 9 aa, Homo Sapiens
YMARLFRGA

SEQ ID NO: 952758 - protein, 9 aa, Homo Sapiens
SGSYSQHIN

SEQ ID NO: 952759 - protein, 9 aa, Homo Sapiens
ALRASLEIK

SEQ ID NO: 952760 - protein, 9 aa, Homo Sapiens
YSIPSSCLE

SEQ ID NO: 952761 - protein, 9 aa, Homo Sapiens
ALHIAAQKD

SEQ ID NO: 952762 - protein, 9 aa, Homo Sapiens
GSEEFPPGV

SEQ ID NO: 952763 - protein, 9 aa, Homo Sapiens
GVEGDVTDK

SEQ ID NO: 952764 - protein, 9 aa, Homo Sapiens
IQIKFVCGS

SEQ ID NO: 952765 - protein, 9 aa, Homo Sapiens
LVFTRTCGI

SEQ ID NO: 952766 - protein, 9 aa, Homo Sapiens
VAVFFESAA

SEQ ID NO: 952767 - protein, 9 aa, Homo Sapiens
CGSLKMFNY

SEQ ID NO: 952768 - protein, 9 aa, Homo Sapiens
KEGNSGLYW

SEQ ID NO: 952769 - protein, 9 aa, Homo Sapiens
EVPESPEAK

SEQ ID NO: 952770 - protein, 9 aa, Homo Sapiens
AVISSNQFD

SEQ ID NO: 952771 - protein, 9 aa, Homo Sapiens
KNGRTWKIY

SEQ ID NO: 952772 - protein, 9 aa, Homo Sapiens
FKRKWKTPF

SEQ ID NO: 952773 - protein, 9 aa, Homo Sapiens
KSCLVRRFT

SEQ ID NO: 952774 - protein, 9 aa, Homo Sapiens
YLSFYFSTG

SEQ ID NO: 952775 - protein, 9 aa, Homo Sapiens
PRERRNSGV

SEQ ID NO: 952776 - protein, 9 aa, Homo Sapiens
RLGVEVDFF

SEQ ID NO: 952777 - protein, 9 aa, Homo Sapiens
SESSDLNDV

SEQ ID NO: 952778 - protein, 9 aa, Homo Sapiens
TGEIYYTTF

SEQ ID NO: 952779 - protein, 9 aa, Homo Sapiens
GDELKIPIC

SEQ ID NO: 952780 - protein, 9 aa, Homo Sapiens
NTVADIWRL

SEQ ID NO: 952781 - protein, 9 aa, Homo Sapiens
LEDAMVTEL

SEQ ID NO: 952782 - protein, 9 aa, Homo Sapiens
SWVTPPVSD

SEQ ID NO: 952783 - protein, 9 aa, Homo Sapiens
ITGKDEVGC

SEQ ID NO: 952784 - protein, 9 aa, Homo Sapiens
ENDTLVWKY

SEQ ID NO: 952785 - protein, 9 aa, Homo Sapiens
RQATHYYYS

SEQ ID NO: 952786 - protein, 9 aa, Homo Sapiens
SRPEEQKPL

SEQ ID NO: 952787 - protein, 9 aa, Homo Sapiens
FDISFVLCI

SEQ ID NO: 952788 - protein, 9 aa, Homo Sapiens
DLYFTPIPV

SEQ ID NO: 952789 - protein, 9 aa, Homo Sapiens
KEEMMEVSL

SEQ ID NO: 952790 - protein, 9 aa, Homo Sapiens
KQRQALRKM

SEQ ID NO: 952791 - protein, 9 aa, Homo Sapiens
RSIPEGSEV

SEQ ID NO: 952792 - protein, 9 aa, Homo Sapiens
KKADLDVAT

SEQ ID NO: 952793 - protein, 9 aa, Homo Sapiens
LEIKCKCHG

SEQ ID NO: 952794 - protein, 9 aa, Homo Sapiens
TSEEEESLC

SEQ ID NO: 952795 - protein, 9 aa, Homo Sapiens
FPLPAEEKF

SEQ ID NO: 952796 - protein, 9 aa, Homo Sapiens
LDILDTAGK

SEQ ID NO: 952797 - protein, 9 aa, Homo Sapiens
PYFCLRRYG

SEQ ID NO: 952798 - protein, 9 aa, Homo Sapiens
HEKYSWVTP

SEQ ID NO: 952799 - protein, 9 aa, Homo Sapiens
TNAEHALQN

SEQ ID NO: 952800 - protein, 9 aa, Homo Sapiens
SGKNAASSS

SEQ ID NO: 952801 - protein, 9 aa, Homo Sapiens
PFPCSECAD

SEQ ID NO: 952802 - protein, 9 aa, Homo Sapiens
PTSWKQEPQ

SEQ ID NO: 952803 - protein, 9 aa, Homo Sapiens
RFVLKHPQI

SEQ ID NO: 952804 - protein, 9 aa, Homo Sapiens
PRAPAACAS

SEQ ID NO: 952805 - protein, 9 aa, Homo Sapiens
SRIKVLKRK

SEQ ID NO: 952806 - protein, 9 aa, Homo Sapiens
CSNEICSVN

SEQ ID NO: 952807 - protein, 9 aa, Homo Sapiens
KKLYSYLLG

SEQ ID NO: 952808 - protein, 9 aa, Homo Sapiens
VKGCDKHIN

SEQ ID NO: 952809 - protein, 9 aa, Homo Sapiens
CASEPGIPG

SEQ ID NO: 952810 - protein, 9 aa, Homo Sapiens
FKVNDLKEL

SEQ ID NO: 952811 - protein, 9 aa, Homo Sapiens
REFPDLFSE

SEQ ID NO: 952812 - protein, 9 aa, Homo Sapiens
PRLRAPPAA

SEQ ID NO: 952813 - protein, 9 aa, Homo Sapiens
RLSQDDRNG

SEQ ID NO: 952814 - protein, 9 aa, Homo Sapiens
AKYWSQISL

SEQ ID NO: 952815 - protein, 9 aa, Homo Sapiens
GLFPATHQP

SEQ ID NO: 952816 - protein, 9 aa, Homo Sapiens
VQSNTGQKT

SEQ ID NO: 952817 - protein, 9 aa, Homo Sapiens
GVRKMAGDM

SEQ ID NO: 952818 - protein, 9 aa, Homo Sapiens
ATNALRKAV

SEQ ID NO: 952819 - protein, 9 aa, Homo Sapiens
GVSDCPVST

SEQ ID NO: 952820 - protein, 9 aa, Homo Sapiens
FINAFEDDI

SEQ ID NO: 952821 - protein, 9 aa, Homo Sapiens
PTLRRQSSL

SEQ ID NO: 952822 - protein, 9 aa, Homo Sapiens
APNGPWAMV

SEQ ID NO: 952823 - protein, 9 aa, Homo Sapiens
SLANNHNHH

SEQ ID NO: 952824 - protein, 9 aa, Homo Sapiens
GLKTIMKHV

SEQ ID NO: 952825 - protein, 9 aa, Homo Sapiens
SFLYLQLVE

SEQ ID NO: 952826 - protein, 9 aa, Homo Sapiens
DPQIRQVKA

SEQ ID NO: 952827 - protein, 9 aa, Homo Sapiens
TIYGDLEDT

SEQ ID NO: 952828 - protein, 9 aa, Homo Sapiens
LISRNTVVP

SEQ ID NO: 952829 - protein, 9 aa, Homo Sapiens
RRQSSLPGS

SEQ ID NO: 952830 - protein, 9 aa, Homo Sapiens
KKQRQALRK

SEQ ID NO: 952831 - protein, 9 aa, Homo Sapiens
YRLSQDDRN

SEQ ID NO: 952832 - protein, 9 aa, Homo Sapiens
EHALQNPES

SEQ ID NO: 952833 - protein, 9 aa, Homo Sapiens
EIYYTTFDW

SEQ ID NO: 952834 - protein, 9 aa, Homo Sapiens
SNTSLAFFC

SEQ ID NO: 952835 - protein, 9 aa, Homo Sapiens
LGETSNENP

SEQ ID NO: 952836 - protein, 9 aa, Homo Sapiens
SQFPITSDS

SEQ ID NO: 952837 - protein, 9 aa, Homo Sapiens
CDSRGRTGL

SEQ ID NO: 952838 - protein, 9 aa, Homo Sapiens
LNSRNPAEP

SEQ ID NO: 952839 - protein, 9 aa, Homo Sapiens
FYMFLVAMG

SEQ ID NO: 952840 - protein, 9 aa, Homo Sapiens
CVITPQQKI

SEQ ID NO: 952841 - protein, 9 aa, Homo Sapiens
RASLEIKCK

SEQ ID NO: 952842 - protein, 9 aa, Homo Sapiens
IKEPKDKSS

SEQ ID NO: 952843 - protein, 9 aa, Homo Sapiens
CRSKISGSD

SEQ ID NO: 952844 - protein, 9 aa, Homo Sapiens
MINLFEPDT

SEQ ID NO: 952845 - protein, 9 aa, Homo Sapiens
KDEGAEMSQ

SEQ ID NO: 952846 - protein, 9 aa, Homo Sapiens
KGEQMGCPA

SEQ ID NO: 952847 - protein, 9 aa, Homo Sapiens
LTLSGFFLR

SEQ ID NO: 952848 - protein, 9 aa, Homo Sapiens
ALRKAVATS

SEQ ID NO: 952849 - protein, 9 aa, Homo Sapiens
PKDPGHYGP

SEQ ID NO: 952850 - protein, 9 aa, Homo Sapiens
ILDTAGKEE

SEQ ID NO: 952851 - protein, 9 aa, Homo Sapiens
KENSLIIQF

SEQ ID NO: 952852 - protein, 9 aa, Homo Sapiens
FEIYLPSKR

SEQ ID NO: 952853 - protein, 9 aa, Homo Sapiens
HKRAQRLKI

SEQ ID NO: 952854 - protein, 9 aa, Homo Sapiens
QISLPHGTH

SEQ ID NO: 952855 - protein, 9 aa, Homo Sapiens
RWPYFCLRR

SEQ ID NO: 952856 - protein, 9 aa, Homo Sapiens
EHFFLLTSK

SEQ ID NO: 952857 - protein, 9 aa, Homo Sapiens
CDKHINNLK

SEQ ID NO: 952858 - protein, 9 aa, Homo Sapiens
WRNEMIETE

SEQ ID NO: 952859 - protein, 9 aa, Homo Sapiens
PPRKAPPPK

SEQ ID NO: 952860 - protein, 9 aa, Homo Sapiens
FCLRRYGYD

SEQ ID NO: 952861 - protein, 9 aa, Homo Sapiens
TGVRGPPKG

SEQ ID NO: 952862 - protein, 9 aa, Homo Sapiens
NVWSNDVTL

SEQ ID NO: 952863 - protein, 9 aa, Homo Sapiens
EKGEQMGCP

SEQ ID NO: 952864 - protein, 9 aa, Homo Sapiens
EMRAQLTEQ

SEQ ID NO: 952865 - protein, 9 aa, Homo Sapiens
VKCEAGRDI

SEQ ID NO: 952866 - protein, 9 aa, Homo Sapiens
VRYNNKESL

SEQ ID NO: 952867 - protein, 9 aa, Homo Sapiens
VHLFFFMVL

SEQ ID NO: 952868 - protein, 9 aa, Homo Sapiens
SWKQEPQLC

SEQ ID NO: 952869 - protein, 9 aa, Homo Sapiens
YVRSIPEGS

SEQ ID NO: 952870 - protein, 9 aa, Homo Sapiens
AATGVSDCP

SEQ ID NO: 952871 - protein, 9 aa, Homo Sapiens
GSSVAQTSL

SEQ ID NO: 952872 - protein, 9 aa, Homo Sapiens
EAKAGKGHR

SEQ ID NO: 952873 - protein, 9 aa, Homo Sapiens
LKTIMKHVR

SEQ ID NO: 952874 - protein, 9 aa, Homo Sapiens
IRLLVTEQN

SEQ ID NO: 952875 - protein, 9 aa, Homo Sapiens
NSPTIKEPK

SEQ ID NO: 952876 - protein, 9 aa, Homo Sapiens
KMSHGSNSF

SEQ ID NO: 952877 - protein, 9 aa, Homo Sapiens
KGHRRTMSQ

SEQ ID NO: 952878 - protein, 9 aa, Homo Sapiens
IPKNKTRTV

SEQ ID NO: 952879 - protein, 9 aa, Homo Sapiens
RLLRGYDQY

SEQ ID NO: 952880 - protein, 9 aa, Homo Sapiens
NDRSATSVL

SEQ ID NO: 952881 - protein, 9 aa, Homo Sapiens
SNQFDPGLN

SEQ ID NO: 952882 - protein, 9 aa, Homo Sapiens
CSQCGKTSA

SEQ ID NO: 952883 - protein, 9 aa, Homo Sapiens
SQDDRNGLQ

SEQ ID NO: 952884 - protein, 9 aa, Homo Sapiens
KDEVGCAGF

SEQ ID NO: 952885 - protein, 9 aa, Homo Sapiens
GKIYKVSST

SEQ ID NO: 952886 - protein, 9 aa, Homo Sapiens
LCGSLKMFN

SEQ ID NO: 952887 - protein, 9 aa, Homo Sapiens
PSSEAKAGK

SEQ ID NO: 952888 - protein, 9 aa, Homo Sapiens
LSEYERNGL

SEQ ID NO: 952889 - protein, 9 aa, Homo Sapiens
KTSASQAAS

SEQ ID NO: 952890 - protein, 9 aa, Homo Sapiens
MYECDSVKQ

SEQ ID NO: 952891 - protein, 9 aa, Homo Sapiens
QELIPDFFV

SEQ ID NO: 952892 - protein, 9 aa, Homo Sapiens
GPEEMSEYS

SEQ ID NO: 952893 - protein, 9 aa, Homo Sapiens
RVLPSTCCS

SEQ ID NO: 952894 - protein, 9 aa, Homo Sapiens
FFLSDKFNI

SEQ ID NO: 952895 - protein, 9 aa, Homo Sapiens
IIFVLLLSA

SEQ ID NO: 952896 - protein, 9 aa, Homo Sapiens
MAIINGKKE

SEQ ID NO: 952897 - protein, 9 aa, Homo Sapiens
FDLEYKTVG

SEQ ID NO: 952898 - protein, 9 aa, Homo Sapiens
LAKGWGELE

SEQ ID NO: 952899 - protein, 9 aa, Homo Sapiens
IPFRSRFPS

SEQ ID NO: 952900 - protein, 9 aa, Homo Sapiens
RTPTGEKPY

SEQ ID NO: 952901 - protein, 9 aa, Homo Sapiens
MQLQFFGTL

SEQ ID NO: 952902 - protein, 9 aa, Homo Sapiens
QEARLCGSL

SEQ ID NO: 952903 - protein, 9 aa, Homo Sapiens
YITIYGDLE

SEQ ID NO: 952904 - protein, 9 aa, Homo Sapiens
PKNKTRTVN

SEQ ID NO: 952905 - protein, 9 aa, Homo Sapiens
KYWSQISLP

SEQ ID NO: 952906 - protein, 9 aa, Homo Sapiens
CIEKQPVLR

SEQ ID NO: 952907 - protein, 9 aa, Homo Sapiens
KAPPPKAPP

SEQ ID NO: 952908 - protein, 9 aa, Homo Sapiens
DSADNQPAE

SEQ ID NO: 952909 - protein, 9 aa, Homo Sapiens
DIICFNYLD

SEQ ID NO: 952910 - protein, 9 aa, Homo Sapiens
LPGRPRLRA

SEQ ID NO: 952911 - protein, 9 aa, Homo Sapiens
LKNRMYECD

SEQ ID NO: 952912 - protein, 9 aa, Homo Sapiens
FMQRVKEKK

SEQ ID NO: 952913 - protein, 9 aa, Homo Sapiens
FLIRSLTPT

SEQ ID NO: 952914 - protein, 9 aa, Homo Sapiens
IAELMNKKL

SEQ ID NO: 952915 - protein, 9 aa, Homo Sapiens
FRSRFPSDV

SEQ ID NO: 952916 - protein, 9 aa, Homo Sapiens
QPTSWKQEP

SEQ ID NO: 952917 - protein, 9 aa, Homo Sapiens
DELKIPICS

SEQ ID NO: 952918 - protein, 9 aa, Homo Sapiens
TRIESFIQS

SEQ ID NO: 952919 - protein, 9 aa, Homo Sapiens
ECQHEAVSK

SEQ ID NO: 952920 - protein, 9 aa, Homo Sapiens
MARLFRGAV

SEQ ID NO: 952921 - protein, 9 aa, Homo Sapiens
SKKKKELPL

SEQ ID NO: 952922 - protein, 9 aa, Homo Sapiens
QLKNAKMEH

SEQ ID NO: 952923 - protein, 9 aa, Homo Sapiens
CCTNFSTKE

SEQ ID NO: 952924 - protein, 9 aa, Homo Sapiens
PTDIICFNY

SEQ ID NO: 952925 - protein, 9 aa, Homo Sapiens
PGNLCYDGS

SEQ ID NO: 952926 - protein, 9 aa, Homo Sapiens
FFCNKVKKI

SEQ ID NO: 952927 - protein, 9 aa, Homo Sapiens
IPNLEHALK

SEQ ID NO: 952928 - protein, 9 aa, Homo Sapiens
DHLYEKPRK

SEQ ID NO: 952929 - protein, 9 aa, Homo Sapiens
YNVWSNDVT

SEQ ID NO: 952930 - protein, 9 aa, Homo Sapiens
KWQYNVWSN

SEQ ID NO: 952931 - protein, 9 aa, Homo Sapiens
PEDTDFFWN

SEQ ID NO: 952932 - protein, 9 aa, Homo Sapiens
YRKEISKLK

SEQ ID NO: 952933 - protein, 9 aa, Homo Sapiens
VYHMHSKEE

SEQ ID NO: 952934 - protein, 9 aa, Homo Sapiens
GVRGPPKGI

SEQ ID NO: 952935 - protein, 9 aa, Homo Sapiens
RDSTLGNTK

SEQ ID NO: 952936 - protein, 9 aa, Homo Sapiens
QAHKGVHTG

SEQ ID NO: 952937 - protein, 9 aa, Homo Sapiens
YNNKESLAG

SEQ ID NO: 952938 - protein, 9 aa, Homo Sapiens
FRDWEINFF

SEQ ID NO: 952939 - protein, 9 aa, Homo Sapiens
DLDMDKILD

SEQ ID NO: 952940 - protein, 9 aa, Homo Sapiens
AKASQRQFE

SEQ ID NO: 952941 - protein, 9 aa, Homo Sapiens
CLVFTRTCG

SEQ ID NO: 952942 - protein, 9 aa, Homo Sapiens
RRGSICNGD

SEQ ID NO: 952943 - protein, 9 aa, Homo Sapiens
APPARPRSR

SEQ ID NO: 952944 - protein, 9 aa, Homo Sapiens
NTMAIINGK

SEQ ID NO: 952945 - protein, 9 aa, Homo Sapiens
TYPSFREAS

SEQ ID NO: 952946 - protein, 9 aa, Homo Sapiens
IPLTLILNL

SEQ ID NO: 952947 - protein, 9 aa, Homo Sapiens
RKWKTPFEK

SEQ ID NO: 952948 - protein, 9 aa, Homo Sapiens
KAESLGTEP

SEQ ID NO: 952949 - protein, 9 aa, Homo Sapiens
LKEMASSNS

SEQ ID NO: 952950 - protein, 9 aa, Homo Sapiens
EKFTEAIVD

SEQ ID NO: 952951 - protein, 9 aa, Homo Sapiens
TKQDIIDLP

SEQ ID NO: 952952 - protein, 9 aa, Homo Sapiens
GSMQPTSWK

SEQ ID NO: 952953 - protein, 9 aa, Homo Sapiens
LTRNLTTYR

SEQ ID NO: 952954 - protein, 9 aa, Homo Sapiens
KEGDLCRIC

SEQ ID NO: 952955 - protein, 9 aa, Homo Sapiens
RKSLLMKPQ

SEQ ID NO: 952956 - protein, 9 aa, Homo Sapiens
LPPRPSIHT

SEQ ID NO: 952957 - protein, 9 aa, Homo Sapiens
LSFSQTNVH

SEQ ID NO: 952958 - protein, 9 aa, Homo Sapiens
AKKESDQAC

SEQ ID NO: 952959 - protein, 9 aa, Homo Sapiens
QQKITLAAP

SEQ ID NO: 952960 - protein, 9 aa, Homo Sapiens
SLIIQFTSF

SEQ ID NO: 952961 - protein, 9 aa, Homo Sapiens
IKVLKRKVI

SEQ ID NO: 952962 - protein, 9 aa, Homo Sapiens
ADKFTSTSD

SEQ ID NO: 952963 - protein, 9 aa, Homo Sapiens
NSYLSFYFS

SEQ ID NO: 952964 - protein, 9 aa, Homo Sapiens
GVLKDVWVY

SEQ ID NO: 952965 - protein, 9 aa, Homo Sapiens
HLFFFMVLA

SEQ ID NO: 952966 - protein, 9 aa, Homo Sapiens
GEEGGEEAP

SEQ ID NO: 952967 - protein, 9 aa, Homo Sapiens
WAMVGMGEA

SEQ ID NO: 952968 - protein, 9 aa, Homo Sapiens
ATFRPQKDF

SEQ ID NO: 952969 - protein, 9 aa, Homo Sapiens
LSFYFSTGQ

SEQ ID NO: 952970 - protein, 9 aa, Homo Sapiens
EDFSKKHKA

SEQ ID NO: 952971 - protein, 9 aa, Homo Sapiens
VNKEEKLVN

SEQ ID NO: 952972 - protein, 9 aa, Homo Sapiens
DTQVKEMRA

SEQ ID NO: 952973 - protein, 9 aa, Homo Sapiens
EDAKASQRQ

SEQ ID NO: 952974 - protein, 9 aa, Homo Sapiens
VVVGDRSSN

SEQ ID NO: 952975 - protein, 9 aa, Homo Sapiens
SWGSTDYRK

SEQ ID NO: 952976 - protein, 9 aa, Homo Sapiens
WSQISLPHG

SEQ ID NO: 952977 - protein, 9 aa, Homo Sapiens
RGYDQYAYD

SEQ ID NO: 952978 - protein, 9 aa, Homo Sapiens
IFWFRDWEI

SEQ ID NO: 952979 - protein, 9 aa, Homo Sapiens
GRPRLRAPP

SEQ ID NO: 952980 - protein, 9 aa, Homo Sapiens
GSNSFLYLQ

SEQ ID NO: 952981 - protein, 9 aa, Homo Sapiens
GDLFGHLLA

SEQ ID NO: 952982 - protein, 9 aa, Homo Sapiens
QDEVPASDS

SEQ ID NO: 952983 - protein, 9 aa, Homo Sapiens
WSCQKKLYS

SEQ ID NO: 952984 - protein, 9 aa, Homo Sapiens
IMKHVRDNL

SEQ ID NO: 952985 - protein, 9 aa, Homo Sapiens
RMPLGAGTL

SEQ ID NO: 952986 - protein, 9 aa, Homo Sapiens
VRKNLFYFG

SEQ ID NO: 952987 - protein, 9 aa, Homo Sapiens
PVPPTLRRQ

SEQ ID NO: 952988 - protein, 9 aa, Homo Sapiens
DQRSLSPHL

SEQ ID NO: 952989 - protein, 9 aa, Homo Sapiens
EAVSKDEIN

SEQ ID NO: 952990 - protein, 9 aa, Homo Sapiens
LGYGSEEFP

SEQ ID NO: 952991 - protein, 9 aa, Homo Sapiens
LQKFQEERQ

SEQ ID NO: 952992 - protein, 9 aa, Homo Sapiens
EPESRTGPD

SEQ ID NO: 952993 - protein, 9 aa, Homo Sapiens
HSGSYSQHI

SEQ ID NO: 952994 - protein, 9 aa, Homo Sapiens
FSVPSTANT

SEQ ID NO: 952995 - protein, 9 aa, Homo Sapiens
NSNGVQALL

SEQ ID NO: 952996 - protein, 9 aa, Homo Sapiens
LCRNMQSIL

SEQ ID NO: 952997 - protein, 9 aa, Homo Sapiens
LYFTPIPVL

SEQ ID NO: 952998 - protein, 9 aa, Homo Sapiens
LQFFFDVLQ

SEQ ID NO: 952999 - protein, 9 aa, Homo Sapiens
IQFTSFVAV

SEQ ID NO: 953000 - protein, 9 aa, Homo Sapiens
LNDVSTPSG

SEQ ID NO: 953001 - protein, 9 aa, Homo Sapiens
IKFVCGSTF

SEQ ID NO: 953002 - protein, 9 aa, Homo Sapiens
YFGESTTGS

SEQ ID NO: 953003 - protein, 9 aa, Homo Sapiens
VKEMRAQLT

SEQ ID NO: 953004 - protein, 9 aa, Homo Sapiens
IYKVSSTEA

SEQ ID NO: 953005 - protein, 9 aa, Homo Sapiens
LDTQQDQLK

SEQ ID NO: 953006 - protein, 9 aa, Homo Sapiens
QKITLAAPN

SEQ ID NO: 953007 - protein, 9 aa, Homo Sapiens
ISDDEIENL

SEQ ID NO: 953008 - protein, 9 aa, Homo Sapiens
NENPGYDEE

SEQ ID NO: 953009 - protein, 9 aa, Homo Sapiens
QFFFDVLQK

SEQ ID NO: 953010 - protein, 9 aa, Homo Sapiens
SAKYWSQIS

SEQ ID NO: 953011 - protein, 9 aa, Homo Sapiens
NIIFINAFE

SEQ ID NO: 953012 - protein, 9 aa, Homo Sapiens
SIPWRNEMI

SEQ ID NO: 953013 - protein, 9 aa, Homo Sapiens
FFWNPNAFE

SEQ ID NO: 953014 - protein, 9 aa, Homo Sapiens
TDRIENIDY

SEQ ID NO: 953015 - protein, 9 aa, Homo Sapiens
YYASPRTYQ

SEQ ID NO: 953016 - protein, 9 aa, Homo Sapiens
KTHEKYSWV

SEQ ID NO: 953017 - protein, 9 aa, Homo Sapiens
YRFVLKHPQ

SEQ ID NO: 953018 - protein, 9 aa, Homo Sapiens
DSLDRCYSI

SEQ ID NO: 953019 - protein, 9 aa, Homo Sapiens
KEPIQPLVL

SEQ ID NO: 953020 - protein, 9 aa, Homo Sapiens
ALQNPESPE

SEQ ID NO: 953021 - protein, 9 aa, Homo Sapiens
RGSENGVLK

SEQ ID NO: 953022 - protein, 9 aa, Homo Sapiens
PSTANTPTP

SEQ ID NO: 953023 - protein, 9 aa, Homo Sapiens
NTSLAFFCN

SEQ ID NO: 953024 - protein, 9 aa, Homo Sapiens
HGAPPRKAP

SEQ ID NO: 953025 - protein, 9 aa, Homo Sapiens
GEPLGNAPE

SEQ ID NO: 953026 - protein, 9 aa, Homo Sapiens
YWSQISLPH

SEQ ID NO: 953027 - protein, 9 aa, Homo Sapiens
GGSGEEGGE

SEQ ID NO: 953028 - protein, 9 aa, Homo Sapiens
GCIEKQPVL

SEQ ID NO: 953029 - protein, 9 aa, Homo Sapiens
LVLRRTYNP

SEQ ID NO: 953030 - protein, 9 aa, Homo Sapiens
SSNSVYMEM

SEQ ID NO: 953031 - protein, 9 aa, Homo Sapiens
SSRPEEQKP

SEQ ID NO: 953032 - protein, 9 aa, Homo Sapiens
YQMGLLLKH

SEQ ID NO: 953033 - protein, 9 aa, Homo Sapiens
SPPTTPPVP

SEQ ID NO: 953034 - protein, 9 aa, Homo Sapiens
IKPGSMEKG

SEQ ID NO: 953035 - protein, 9 aa, Homo Sapiens
WKGCFLSEY

SEQ ID NO: 953036 - protein, 9 aa, Homo Sapiens
FTSTSDPVI

SEQ ID NO: 953037 - protein, 9 aa, Homo Sapiens
PGRPRLRAP

SEQ ID NO: 953038 - protein, 9 aa, Homo Sapiens
DFEDLQDGE

SEQ ID NO: 953039 - protein, 9 aa, Homo Sapiens
KKKELPLWE

SEQ ID NO: 953040 - protein, 9 aa, Homo Sapiens
TAMLEKGEQ

SEQ ID NO: 953041 - protein, 9 aa, Homo Sapiens
FKPVVDTYI

SEQ ID NO: 953042 - protein, 9 aa, Homo Sapiens
AFESKSHLC

SEQ ID NO: 953043 - protein, 9 aa, Homo Sapiens
MGENDTLVW

SEQ ID NO: 953044 - protein, 9 aa, Homo Sapiens
LGLRKWQYN

SEQ ID NO: 953045 - protein, 9 aa, Homo Sapiens
IFVLLLSAI

SEQ ID NO: 953046 - protein, 9 aa, Homo Sapiens
HPLWETWAN

SEQ ID NO: 953047 - protein, 9 aa, Homo Sapiens
NFSTKEGIH

SEQ ID NO: 953048 - protein, 9 aa, Homo Sapiens
CEAGRDIGD

SEQ ID NO: 953049 - protein, 9 aa, Homo Sapiens
EYQIIDGDG

SEQ ID NO: 953050 - protein, 9 aa, Homo Sapiens
EAISSSSIS

SEQ ID NO: 953051 - protein, 9 aa, Homo Sapiens
PPARPRSRS

SEQ ID NO: 953052 - protein, 9 aa, Homo Sapiens
SSTEAEALA

SEQ ID NO: 953053 - protein, 9 aa, Homo Sapiens
RAQRLKILC

SEQ ID NO: 953054 - protein, 9 aa, Homo Sapiens
ELKIPICSW

SEQ ID NO: 953055 - protein, 9 aa, Homo Sapiens
STHSAELPP

SEQ ID NO: 953056 - protein, 9 aa, Homo Sapiens
GLQRTSLAY

SEQ ID NO: 953057 - protein, 9 aa, Homo Sapiens
VTIIKTPVQ

SEQ ID NO: 953058 - protein, 9 aa, Homo Sapiens
AGVGKSCLV

SEQ ID NO: 953059 - protein, 9 aa, Homo Sapiens
HMHSKEERK

SEQ ID NO: 953060 - protein, 9 aa, Homo Sapiens
HELLCCTNF

SEQ ID NO: 953061 - protein, 9 aa, Homo Sapiens
YFKRKWKTP

SEQ ID NO: 953062 - protein, 9 aa, Homo Sapiens
LGAGTLVNV

SEQ ID NO: 953063 - protein, 9 aa, Homo Sapiens
LDTAGKEEY

SEQ ID NO: 953064 - protein, 9 aa, Homo Sapiens
DSGIWHLVF

SEQ ID NO: 953065 - protein, 9 aa, Homo Sapiens
EGGEEAPLS

SEQ ID NO: 953066 - protein, 9 aa, Homo Sapiens
LTFVGYQSV

SEQ ID NO: 953067 - protein, 9 aa, Homo Sapiens
QRQALRKMV

SEQ ID NO: 953068 - protein, 9 aa, Homo Sapiens
YECDSVKQP

SEQ ID NO: 953069 - protein, 9 aa, Homo Sapiens
MQRVKEKKA

SEQ ID NO: 953070 - protein, 9 aa, Homo Sapiens
NLCYDGSHM

SEQ ID NO: 953071 - protein, 9 aa, Homo Sapiens
VAMSDKKCV

SEQ ID NO: 953072 - protein, 9 aa, Homo Sapiens
KKCVELVTG

SEQ ID NO: 953073 - protein, 9 aa, Homo Sapiens
GHYGPESIT

SEQ ID NO: 953074 - protein, 9 aa, Homo Sapiens
RASRMMIQP

SEQ ID NO: 953075 - protein, 9 aa, Homo Sapiens
AFFCNKVKK

SEQ ID NO: 953076 - protein, 9 aa, Homo Sapiens
SPEDTDFFW

SEQ ID NO: 953077 - protein, 9 aa, Homo Sapiens
TLRRQSSLP

SEQ ID NO: 953078 - protein, 9 aa, Homo Sapiens
LGVEVDFFD

SEQ ID NO: 953079 - protein, 9 aa, Homo Sapiens
GVEVDFFDG

SEQ ID NO: 953080 - protein, 9 aa, Homo Sapiens
LESFHDYLL

SEQ ID NO: 953081 - protein, 9 aa, Homo Sapiens
PDLPPPSQP

SEQ ID NO: 953082 - protein, 9 aa, Homo Sapiens
SFAAAVQSN

SEQ ID NO: 953083 - protein, 9 aa, Homo Sapiens
CQKKLYSYL

SEQ ID NO: 953084 - protein, 9 aa, Homo Sapiens
FHHFKPVVD

SEQ ID NO: 953085 - protein, 9 aa, Homo Sapiens
RQSSLPGSS

SEQ ID NO: 953086 - protein, 9 aa, Homo Sapiens
SKLYPIANR

SEQ ID NO: 953087 - protein, 9 aa, Homo Sapiens
LPSLEDAMV

SEQ ID NO: 953088 - protein, 9 aa, Homo Sapiens
VQMYPGPTV

SEQ ID NO: 953089 - protein, 9 aa, Homo Sapiens
RTEHLFDQD

SEQ ID NO: 953090 - protein, 9 aa, Homo Sapiens
FSQDVQVTA

SEQ ID NO: 953091 - protein, 9 aa, Homo Sapiens
LYYQMGLLL

SEQ ID NO: 953092 - protein, 9 aa, Homo Sapiens
RQIAKWHML

SEQ ID NO: 953093 - protein, 9 aa, Homo Sapiens
MRQLNGNGG

SEQ ID NO: 953094 - protein, 9 aa, Homo Sapiens
LQFFGTLAS

SEQ ID NO: 953095 - protein, 9 aa, Homo Sapiens
GMPDPHLYY

SEQ ID NO: 953096 - protein, 9 aa, Homo Sapiens
LIIQFTSFV

SEQ ID NO: 953097 - protein, 9 aa, Homo Sapiens
WFRDWEINF

SEQ ID NO: 953098 - protein, 9 aa, Homo Sapiens
TDKLLSSDH

SEQ ID NO: 953099 - protein, 9 aa, Homo Sapiens
DVTDKDEGA

SEQ ID NO: 953100 - protein, 9 aa, Homo Sapiens
RVTLAKGWG

SEQ ID NO: 953101 - protein, 9 aa, Homo Sapiens
DYRKEISKL

SEQ ID NO: 953102 - protein, 9 aa, Homo Sapiens
PLMIATGSV

SEQ ID NO: 953103 - protein, 9 aa, Homo Sapiens
LRNREGKNA

SEQ ID NO: 953104 - protein, 9 aa, Homo Sapiens
VILQLQFFF

SEQ ID NO: 953105 - protein, 9 aa, Homo Sapiens
SASWGSTDY

SEQ ID NO: 953106 - protein, 9 aa, Homo Sapiens
SYSQHINHR

SEQ ID NO: 953107 - protein, 9 aa, Homo Sapiens
LKDVWVYDT

SEQ ID NO: 953108 - protein, 9 aa, Homo Sapiens
RLEIPIPST

SEQ ID NO: 953109 - protein, 9 aa, Homo Sapiens
NGVKSSLAN

SEQ ID NO: 953110 - protein, 9 aa, Homo Sapiens
HKGVHTGEK

SEQ ID NO: 953111 - protein, 9 aa, Homo Sapiens
KYIQIKFVC

SEQ ID NO: 953112 - protein, 9 aa, Homo Sapiens
WLMALSSIV

SEQ ID NO: 953113 - protein, 9 aa, Homo Sapiens
SSSSVPSHP

SEQ ID NO: 953114 - protein, 9 aa, Homo Sapiens
AACASEPGI

SEQ ID NO: 953115 - protein, 9 aa, Homo Sapiens
GFFVVMPDA

SEQ ID NO: 953116 - protein, 9 aa, Homo Sapiens
KELPLWETF

SEQ ID NO: 953117 - protein, 9 aa, Homo Sapiens
FSNKMKSWS

SEQ ID NO: 953118 - protein, 9 aa, Homo Sapiens
NGKKEHVSL

SEQ ID NO: 953119 - protein, 9 aa, Homo Sapiens
TCFSFIGCK

SEQ ID NO: 953120 - protein, 9 aa, Homo Sapiens
NLVHPDAQD

SEQ ID NO: 953121 - protein, 9 aa, Homo Sapiens
KRTADKFTS

SEQ ID NO: 953122 - protein, 9 aa, Homo Sapiens
EIENLHYSP

SEQ ID NO: 953123 - protein, 9 aa, Homo Sapiens
LRSTPSLTT

SEQ ID NO: 953124 - protein, 9 aa, Homo Sapiens
KNAASSSSV

SEQ ID NO: 953125 - protein, 9 aa, Homo Sapiens
KSSLANNHN

SEQ ID NO: 953126 - protein, 9 aa, Homo Sapiens
INGKKEHVS

SEQ ID NO: 953127 - protein, 9 aa, Homo Sapiens
LAKKADLDV

SEQ ID NO: 953128 - protein, 9 aa, Homo Sapiens
IAAQKDDTK

SEQ ID NO: 953129 - protein, 9 aa, Homo Sapiens
FEDLQDGED

SEQ ID NO: 953130 - protein, 9 aa, Homo Sapiens
VYFKRKWKT

SEQ ID NO: 953131 - protein, 9 aa, Homo Sapiens
PQCFLIRSL

SEQ ID NO: 953132 - protein, 9 aa, Homo Sapiens
VQVTARLLA

SEQ ID NO: 953133 - protein, 9 aa, Homo Sapiens
EERVKGCDK

SEQ ID NO: 953134 - protein, 9 aa, Homo Sapiens
QKDFCFLSS

SEQ ID NO: 953135 - protein, 9 aa, Homo Sapiens
EKEGDLCRI

SEQ ID NO: 953136 - protein, 9 aa, Homo Sapiens
PEETCGLQS

SEQ ID NO: 953137 - protein, 9 aa, Homo Sapiens
LRLEELHFK

SEQ ID NO: 953138 - protein, 9 aa, Homo Sapiens
YPAGDLFGH

SEQ ID NO: 953139 - protein, 9 aa, Homo Sapiens
LQLDQVWRY

SEQ ID NO: 953140 - protein, 9 aa, Homo Sapiens
KNAEVEYQI

SEQ ID NO: 953141 - protein, 9 aa, Homo Sapiens
IVVIQALNN

SEQ ID NO: 953142 - protein, 9 aa, Homo Sapiens
SELEQAKKE

SEQ ID NO: 953143 - protein, 9 aa, Homo Sapiens
MPDPHLYYQ

SEQ ID NO: 953144 - protein, 9 aa, Homo Sapiens
TTYRKELVG

SEQ ID NO: 953145 - protein, 9 aa, Homo Sapiens
AMVGMGEAR

SEQ ID NO: 953146 - protein, 9 aa, Homo Sapiens
LGSGMASCC

SEQ ID NO: 953147 - protein, 9 aa, Homo Sapiens
KARPMESSL

SEQ ID NO: 953148 - protein, 9 aa, Homo Sapiens
PQKDFCFLS

SEQ ID NO: 953149 - protein, 9 aa, Homo Sapiens
IQLNSNGVQ

SEQ ID NO: 953150 - protein, 9 aa, Homo Sapiens
VDFFDGHHY

SEQ ID NO: 953151 - protein, 9 aa, Homo Sapiens
ISVSAAGFD

SEQ ID NO: 953152 - protein, 9 aa, Homo Sapiens
KLLSSDHEK

SEQ ID NO: 953153 - protein, 9 aa, Homo Sapiens
APSSASRDV

SEQ ID NO: 953154 - protein, 9 aa, Homo Sapiens
AVQSNTGQK

SEQ ID NO: 953155 - protein, 9 aa, Homo Sapiens
GLFGDDGLP

SEQ ID NO: 953156 - protein, 9 aa, Homo Sapiens
RSLSPHLGR

SEQ ID NO: 953157 - protein, 9 aa, Homo Sapiens
LYHEPPEDA

SEQ ID NO: 953158 - protein, 9 aa, Homo Sapiens
MTCPATRIP

SEQ ID NO: 953159 - protein, 9 aa, Homo Sapiens
KNAKMEHTN

SEQ ID NO: 953160 - protein, 9 aa, Homo Sapiens
TYGCIEKQP

SEQ ID NO: 953161 - protein, 9 aa, Homo Sapiens
FIQSLQDLS

SEQ ID NO: 953162 - protein, 9 aa, Homo Sapiens
VTKTVYNLI

SEQ ID NO: 953163 - protein, 9 aa, Homo Sapiens
WGLRSTPSL

SEQ ID NO: 953164 - protein, 9 aa, Homo Sapiens
VECKSTDKD

SEQ ID NO: 953165 - protein, 9 aa, Homo Sapiens
KKELPLWET

SEQ ID NO: 953166 - protein, 9 aa, Homo Sapiens
LNLYYRIYH

SEQ ID NO: 953167 - protein, 9 aa, Homo Sapiens
PPSWSCQKK

SEQ ID NO: 953168 - protein, 9 aa, Homo Sapiens
SNSRLYMKL

SEQ ID NO: 953169 - protein, 9 aa, Homo Sapiens
IDVNKEEKL

SEQ ID NO: 953170 - protein, 9 aa, Homo Sapiens
SPVRKNLFY

SEQ ID NO: 953171 - protein, 9 aa, Homo Sapiens
RKAPTNKAH

SEQ ID NO: 953172 - protein, 9 aa, Homo Sapiens
LVKTHEKYS

SEQ ID NO: 953173 - protein, 9 aa, Homo Sapiens
LIPDFFVPC

SEQ ID NO: 953174 - protein, 9 aa, Homo Sapiens
KVTIIKTPV

SEQ ID NO: 953175 - protein, 9 aa, Homo Sapiens
APPRKAPPP

SEQ ID NO: 953176 - protein, 9 aa, Homo Sapiens
KDVIKVSER

SEQ ID NO: 953177 - protein, 9 aa, Homo Sapiens
EAQDEVPAS

SEQ ID NO: 953178 - protein, 9 aa, Homo Sapiens
DVFGLRLEI

SEQ ID NO: 953179 - protein, 9 aa, Homo Sapiens
RMNRGGMVQ

SEQ ID NO: 953180 - protein, 9 aa, Homo Sapiens
ICDSRGRTG

SEQ ID NO: 953181 - protein, 9 aa, Homo Sapiens
PGAKEGNSG

SEQ ID NO: 953182 - protein, 9 aa, Homo Sapiens
DACDIDEIK

SEQ ID NO: 953183 - protein, 9 aa, Homo Sapiens
TVAMSDKKC

SEQ ID NO: 953184 - protein, 9 aa, Homo Sapiens
LTRRGSICN

SEQ ID NO: 953185 - protein, 9 aa, Homo Sapiens
DLQDGEDLF

SEQ ID NO: 953186 - protein, 9 aa, Homo Sapiens
GSNSRLYMK

SEQ ID NO: 953187 - protein, 9 aa, Homo Sapiens
CFLIRSLTP

SEQ ID NO: 953188 - protein, 9 aa, Homo Sapiens
ASSSSVPSH

SEQ ID NO: 953189 - protein, 9 aa, Homo Sapiens
GTLVNVQRR

SEQ ID NO: 953190 - protein, 9 aa, Homo Sapiens
NKNLQTRVR

SEQ ID NO: 953191 - protein, 9 aa, Homo Sapiens
FFLRTLYAS

SEQ ID NO: 953192 - protein, 9 aa, Homo Sapiens
IVLIPGYMA

SEQ ID NO: 953193 - protein, 9 aa, Homo Sapiens
RLREGGIFS

SEQ ID NO: 953194 - protein, 9 aa, Homo Sapiens
QLNGNGGQA

SEQ ID NO: 953195 - protein, 9 aa, Homo Sapiens
SLVIWLVTF

SEQ ID NO: 953196 - protein, 9 aa, Homo Sapiens
SIAETYGCI

SEQ ID NO: 953197 - protein, 9 aa, Homo Sapiens
NSVYMEMEK

SEQ ID NO: 953198 - protein, 9 aa, Homo Sapiens
HEAVSKDEI

SEQ ID NO: 953199 - protein, 9 aa, Homo Sapiens
GAPPARPRS

SEQ ID NO: 953200 - protein, 9 aa, Homo Sapiens
DAKASQRQF

SEQ ID NO: 953201 - protein, 9 aa, Homo Sapiens
ARPMESSLE

SEQ ID NO: 953202 - protein, 9 aa, Homo Sapiens
SEDLRSRIK

SEQ ID NO: 953203 - protein, 9 aa, Homo Sapiens
PLGAGTLVN

SEQ ID NO: 953204 - protein, 9 aa, Homo Sapiens
LDSFIDSQF

SEQ ID NO: 953205 - protein, 9 aa, Homo Sapiens
LEELHFKVN

SEQ ID NO: 953206 - protein, 9 aa, Homo Sapiens
AVYFKRKWK

SEQ ID NO: 953207 - protein, 9 aa, Homo Sapiens
TGKDEVGCA

SEQ ID NO: 953208 - protein, 9 aa, Homo Sapiens
YSLRNREGK

SEQ ID NO: 953209 - protein, 9 aa, Homo Sapiens
KTDPVVSPL

SEQ ID NO: 953210 - protein, 9 aa, Homo Sapiens
YSEAFKGQM

SEQ ID NO: 953211 - protein, 9 aa, Homo Sapiens
TRIPEDMLT

SEQ ID NO: 953212 - protein, 9 aa, Homo Sapiens
KDVFGLRLE

SEQ ID NO: 953213 - protein, 9 aa, Homo Sapiens
DSVLPTLVA

SEQ ID NO: 953214 - protein, 9 aa, Homo Sapiens
SSGSNSRLY

SEQ ID NO: 953215 - protein, 9 aa, Homo Sapiens
SECADDCWQ

SEQ ID NO: 953216 - protein, 9 aa, Homo Sapiens
FREASVDEK

SEQ ID NO: 953217 - protein, 9 aa, Homo Sapiens
NMQSILYHG

SEQ ID NO: 953218 - protein, 9 aa, Homo Sapiens
KSTDKDVIK

SEQ ID NO: 953219 - protein, 9 aa, Homo Sapiens
KRKWKTPFE

SEQ ID NO: 953220 - protein, 9 aa, Homo Sapiens
YKAPTDYRF

SEQ ID NO: 953221 - protein, 9 aa, Homo Sapiens
DDRNGLQQL

SEQ ID NO: 953222 - protein, 9 aa, Homo Sapiens
QLQFFFDVL

SEQ ID NO: 953223 - protein, 9 aa, Homo Sapiens
KKATFKEAE

SEQ ID NO: 953224 - protein, 9 aa, Homo Sapiens
AWLGYGSEE

SEQ ID NO: 953225 - protein, 9 aa, Homo Sapiens
QKAKCSYPY

SEQ ID NO: 953226 - protein, 9 aa, Homo Sapiens
DPLLGQSPC

SEQ ID NO: 953227 - protein, 9 aa, Homo Sapiens
FQAHKGVHT

SEQ ID NO: 953228 - protein, 9 aa, Homo Sapiens
GKDWGPEEM

SEQ ID NO: 953229 - protein, 9 aa, Homo Sapiens
VKARPMESS

SEQ ID NO: 953230 - protein, 9 aa, Homo Sapiens
VQRFLFTSL

SEQ ID NO: 953231 - protein, 9 aa, Homo Sapiens
VLAYTSKGA

SEQ ID NO: 953232 - protein, 9 aa, Homo Sapiens
GGLPSLEDA

SEQ ID NO: 953233 - protein, 9 aa, Homo Sapiens
PQQKITLAA

SEQ ID NO: 953234 - protein, 9 aa, Homo Sapiens
RKRWALVVL

SEQ ID NO: 953235 - protein, 9 aa, Homo Sapiens
KRRKAPTNK

SEQ ID NO: 953236 - protein, 9 aa, Homo Sapiens
VSPPTTPPV

SEQ ID NO: 953237 - protein, 9 aa, Homo Sapiens
GTLPQPSPI

SEQ ID NO: 953238 - protein, 9 aa, Homo Sapiens
RAPAACASE

SEQ ID NO: 953239 - protein, 9 aa, Homo Sapiens
KKKNVTKFI

SEQ ID NO: 953240 - protein, 9 aa, Homo Sapiens
PRSRSPECR

SEQ ID NO: 953241 - protein, 9 aa, Homo Sapiens
GRGSENGVL

SEQ ID NO: 953242 - protein, 9 aa, Homo Sapiens
EIKPGSMEK

SEQ ID NO: 953243 - protein, 9 aa, Homo Sapiens
AEHALQNPE

SEQ ID NO: 953244 - protein, 9 aa, Homo Sapiens
LQNPESPET

SEQ ID NO: 953245 - protein, 9 aa, Homo Sapiens
CSECADDCW

SEQ ID NO: 953246 - protein, 9 aa, Homo Sapiens
EYDTQVKEM

SEQ ID NO: 953247 - protein, 9 aa, Homo Sapiens
IFINAFEDD

SEQ ID NO: 953248 - protein, 9 aa, Homo Sapiens
HFTLNSRNP

SEQ ID NO: 953249 - protein, 9 aa, Homo Sapiens
GDPQWIGAW

SEQ ID NO: 953250 - protein, 9 aa, Homo Sapiens
KHPTDIICF

SEQ ID NO: 953251 - protein, 9 aa, Homo Sapiens
AIEVQADQQ

SEQ ID NO: 953252 - protein, 9 aa, Homo Sapiens
DHYFSQDVQ

SEQ ID NO: 953253 - protein, 9 aa, Homo Sapiens
QLDQVWRYL

SEQ ID NO: 953254 - protein, 9 aa, Homo Sapiens
SPMKTDPVV

SEQ ID NO: 953255 - protein, 9 aa, Homo Sapiens
MASSNSVYM

SEQ ID NO: 953256 - protein, 9 aa, Homo Sapiens
SNSVYMEME

SEQ ID NO: 953257 - protein, 9 aa, Homo Sapiens
ESPEAKKES

SEQ ID NO: 953258 - protein, 9 aa, Homo Sapiens
SFQAHKGVH

SEQ ID NO: 953259 - protein, 9 aa, Homo Sapiens
LQSISSDYI

SEQ ID NO: 953260 - protein, 9 aa, Homo Sapiens
KNRYKNILL

SEQ ID NO: 953261 - protein, 9 aa, Homo Sapiens
QHYSPKADC

SEQ ID NO: 953262 - protein, 9 aa, Homo Sapiens
ITPQQKITL

SEQ ID NO: 953263 - protein, 9 aa, Homo Sapiens
GVMGENDTL

SEQ ID NO: 953264 - protein, 9 aa, Homo Sapiens
PLPNTVADI

SEQ ID NO: 953265 - protein, 9 aa, Homo Sapiens
AYKLARHAY

SEQ ID NO: 953266 - protein, 9 aa, Homo Sapiens
RTYPSFREA

SEQ ID NO: 953267 - protein, 9 aa, Homo Sapiens
LGNSYLSFY

SEQ ID NO: 953268 - protein, 9 aa, Homo Sapiens
TALRRARSV

SEQ ID NO: 953269 - protein, 9 aa, Homo Sapiens
AMLEKGEQM

SEQ ID NO: 953270 - protein, 9 aa, Homo Sapiens
LFDQDKSRS

SEQ ID NO: 953271 - protein, 9 aa, Homo Sapiens
PNTVADIWR

SEQ ID NO: 953272 - protein, 9 aa, Homo Sapiens
FALRRVTLA

SEQ ID NO: 953273 - protein, 9 aa, Homo Sapiens
AGFDLEYKT

SEQ ID NO: 953274 - protein, 9 aa, Homo Sapiens
RPMESSLEE

SEQ ID NO: 953275 - protein, 9 aa, Homo Sapiens
PGIPGLFGD

SEQ ID NO: 953276 - protein, 9 aa, Homo Sapiens
PEDAKASQR

SEQ ID NO: 953277 - protein, 9 aa, Homo Sapiens
GMASCCQQS

SEQ ID NO: 953278 - protein, 9 aa, Homo Sapiens
DKDEGAEMS

SEQ ID NO: 953279 - protein, 9 aa, Homo Sapiens
HLTVLAYTS

SEQ ID NO: 953280 - protein, 9 aa, Homo Sapiens
NGKIGIPNL

SEQ ID NO: 953281 - protein, 9 aa, Homo Sapiens
KTLTFVGYQ

SEQ ID NO: 953282 - protein, 9 aa, Homo Sapiens
RDWEINFFA

SEQ ID NO: 953283 - protein, 9 aa, Homo Sapiens
EGNSGLYWC

SEQ ID NO: 953284 - protein, 9 aa, Homo Sapiens
ALDSADNQP

SEQ ID NO: 953285 - protein, 9 aa, Homo Sapiens
YEGVTKTVY

SEQ ID NO: 953286 - protein, 9 aa, Homo Sapiens
KTDASNIED

SEQ ID NO: 953287 - protein, 9 aa, Homo Sapiens
QCFLIRSLT

SEQ ID NO: 953288 - protein, 9 aa, Homo Sapiens
EGKNALIRV

SEQ ID NO: 953289 - protein, 9 aa, Homo Sapiens
LNYSPRDEK

SEQ ID NO: 953290 - protein, 9 aa, Homo Sapiens
QISRHIKEF

SEQ ID NO: 953291 - protein, 9 aa, Homo Sapiens
VTEQNVTLY

SEQ ID NO: 953292 - protein, 9 aa, Homo Sapiens
FNPPTQKPS

SEQ ID NO: 953293 - protein, 9 aa, Homo Sapiens
FTLNSRNPA

SEQ ID NO: 953294 - protein, 9 aa, Homo Sapiens
GSLKMFNYF

SEQ ID NO: 953295 - protein, 9 aa, Homo Sapiens
FGTLASSEK

SEQ ID NO: 953296 - protein, 9 aa, Homo Sapiens
LRRVTLAKG

SEQ ID NO: 953297 - protein, 9 aa, Homo Sapiens
EKYSWVTPP

SEQ ID NO: 953298 - protein, 9 aa, Homo Sapiens
LCLVFTRTC

SEQ ID NO: 953299 - protein, 9 aa, Homo Sapiens
NGQISRHIK

SEQ ID NO: 953300 - protein, 9 aa, Homo Sapiens
KILCERNDK

SEQ ID NO: 953301 - protein, 9 aa, Homo Sapiens
PRKTPNIES

SEQ ID NO: 953302 - protein, 9 aa, Homo Sapiens
ENSPTIKEP

SEQ ID NO: 953303 - protein, 9 aa, Homo Sapiens
GFDPNICDS

SEQ ID NO: 953304 - protein, 9 aa, Homo Sapiens
NQPAERTPS

SEQ ID NO: 953305 - protein, 9 aa, Homo Sapiens
EEDGPFPCS

SEQ ID NO: 953306 - protein, 9 aa, Homo Sapiens
QSKALGAYK

SEQ ID NO: 953307 - protein, 9 aa, Homo Sapiens
RSRSPECRM

SEQ ID NO: 953308 - protein, 9 aa, Homo Sapiens
WFSNKMKSW

SEQ ID NO: 953309 - protein, 9 aa, Homo Sapiens
CKSTDKDVI

SEQ ID NO: 953310 - protein, 9 aa, Homo Sapiens
NLQTRVRQL

SEQ ID NO: 953311 - protein, 9 aa, Homo Sapiens
QDVQVTARL

SEQ ID NO: 953312 - protein, 9 aa, Homo Sapiens
YKVSSTEAE

SEQ ID NO: 953313 - protein, 9 aa, Homo Sapiens
KIPFRSRFP

SEQ ID NO: 953314 - protein, 9 aa, Homo Sapiens
PLWETWANL

SEQ ID NO: 953315 - protein, 9 aa, Homo Sapiens
HYGPESITF

SEQ ID NO: 953316 - protein, 9 aa, Homo Sapiens
QATHYYYSE

SEQ ID NO: 953317 - protein, 9 aa, Homo Sapiens
QHINHRYSY

SEQ ID NO: 953318 - protein, 9 aa, Homo Sapiens
DISFVLCIS

SEQ ID NO: 953319 - protein, 9 aa, Homo Sapiens
RLKILCERN

SEQ ID NO: 953320 - protein, 9 aa, Homo Sapiens
PNICDSRGR

SEQ ID NO: 953321 - protein, 9 aa, Homo Sapiens
ATHQPWPTV

SEQ ID NO: 953322 - protein, 9 aa, Homo Sapiens
ETCGLQSIS

SEQ ID NO: 953323 - protein, 9 aa, Homo Sapiens
TRHLNIIFI

SEQ ID NO: 953324 - protein, 9 aa, Homo Sapiens
LPGIPGLFG

SEQ ID NO: 953325 - protein, 9 aa, Homo Sapiens
CYSIPSSCL

SEQ ID NO: 953326 - protein, 9 aa, Homo Sapiens
SVECKSTDK

SEQ ID NO: 953327 - protein, 9 aa, Homo Sapiens
RSATSVLLD

SEQ ID NO: 953328 - protein, 9 aa, Homo Sapiens
QSISSDYIE

SEQ ID NO: 953329 - protein, 9 aa, Homo Sapiens
LLFFLRRWN

SEQ ID NO: 953330 - protein, 9 aa, Homo Sapiens
ADGCSPHYI

SEQ ID NO: 953331 - protein, 9 aa, Homo Sapiens
WHLVFYNDG

SEQ ID NO: 953332 - protein, 9 aa, Homo Sapiens
HYDLDMDKI

SEQ ID NO: 953333 - protein, 9 aa, Homo Sapiens
RRKAPTNKA

SEQ ID NO: 953334 - protein, 9 aa, Homo Sapiens
WGSTDYRKE

SEQ ID NO: 953335 - protein, 9 aa, Homo Sapiens
QKTLTFVGY

SEQ ID NO: 953336 - protein, 9 aa, Homo Sapiens
LKILCERND

SEQ ID NO: 953337 - protein, 9 aa, Homo Sapiens
NVTKFILIG

SEQ ID NO: 953338 - protein, 9 aa, Homo Sapiens
VGKSCLVRR

SEQ ID NO: 953339 - protein, 9 aa, Homo Sapiens
LEDSNPSNL

SEQ ID NO: 953340 - protein, 9 aa, Homo Sapiens
VKTHEKYSW

SEQ ID NO: 953341 - protein, 9 aa, Homo Sapiens
GLPGIPGLF

SEQ ID NO: 953342 - protein, 9 aa, Homo Sapiens
YLPSKRVFL

SEQ ID NO: 953343 - protein, 9 aa, Homo Sapiens
SLIYMDPHS

SEQ ID NO: 953344 - protein, 9 aa, Homo Sapiens
VEGDVTDKD

SEQ ID NO: 953345 - protein, 9 aa, Homo Sapiens
DSEKEGDLC

SEQ ID NO: 953346 - protein, 9 aa, Homo Sapiens
LPSDSLVLP

SEQ ID NO: 953347 - protein, 9 aa, Homo Sapiens
HSKEERKKA

SEQ ID NO: 953348 - protein, 9 aa, Homo Sapiens
GSGMASCCQ

SEQ ID NO: 953349 - protein, 9 aa, Homo Sapiens
AESLGTEPT

SEQ ID NO: 953350 - protein, 9 aa, Homo Sapiens
FFMVLALNV

SEQ ID NO: 953351 - protein, 9 aa, Homo Sapiens
KRVFLFGAE

SEQ ID NO: 953352 - protein, 9 aa, Homo Sapiens
KLGETSNEN

SEQ ID NO: 953353 - protein, 9 aa, Homo Sapiens
KEMASSNSV

SEQ ID NO: 953354 - protein, 9 aa, Homo Sapiens
VADIWRLVF

SEQ ID NO: 953355 - protein, 9 aa, Homo Sapiens
TSLDHLYEK

SEQ ID NO: 953356 - protein, 9 aa, Homo Sapiens
INHRYSYCK

SEQ ID NO: 953357 - protein, 9 aa, Homo Sapiens
LFYFGESTT

SEQ ID NO: 953358 - protein, 9 aa, Homo Sapiens
HQPWPTVAG

SEQ ID NO: 953359 - protein, 9 aa, Homo Sapiens
FSTKEGIHL

SEQ ID NO: 953360 - protein, 9 aa, Homo Sapiens
SVEPESRTG

SEQ ID NO: 953361 - protein, 9 aa, Homo Sapiens
EQKPLFAVF

SEQ ID NO: 953362 - protein, 9 aa, Homo Sapiens
VVGDRSSNL

SEQ ID NO: 953363 - protein, 9 aa, Homo Sapiens
TKETSLSVS

SEQ ID NO: 953364 - protein, 9 aa, Homo Sapiens
NVEIDPQIR

SEQ ID NO: 953365 - protein, 9 aa, Homo Sapiens
VTLAKGWGE

SEQ ID NO: 953366 - protein, 9 aa, Homo Sapiens
SNEICSVNC

SEQ ID NO: 953367 - protein, 9 aa, Homo Sapiens
ENSCLEDSN

SEQ ID NO: 953368 - protein, 9 aa, Homo Sapiens
LVAEHSLEL

SEQ ID NO: 953369 - protein, 9 aa, Homo Sapiens
GQSASFNPP

SEQ ID NO: 953370 - protein, 9 aa, Homo Sapiens
GVKSSLANN

SEQ ID NO: 953371 - protein, 9 aa, Homo Sapiens
NKEEKLVNE

SEQ ID NO: 953372 - protein, 9 aa, Homo Sapiens
ERVLPSTCC

SEQ ID NO: 953373 - protein, 9 aa, Homo Sapiens
ASCCQQSKP

SEQ ID NO: 953374 - protein, 9 aa, Homo Sapiens
SFREASVDE

SEQ ID NO: 953375 - protein, 9 aa, Homo Sapiens
VPPTLRRQS

SEQ ID NO: 953376 - protein, 9 aa, Homo Sapiens
THSDLESSL

SEQ ID NO: 953377 - protein, 9 aa, Homo Sapiens
LHFKVNDLK

SEQ ID NO: 953378 - protein, 9 aa, Homo Sapiens
KGVHTGEKP

SEQ ID NO: 953379 - protein, 9 aa, Homo Sapiens
PPLPPPGTE

SEQ ID NO: 953380 - protein, 9 aa, Homo Sapiens
KIPSGPWQK

SEQ ID NO: 953381 - protein, 9 aa, Homo Sapiens
RRNGQISRH

SEQ ID NO: 953382 - protein, 9 aa, Homo Sapiens
EQKINAEPE

SEQ ID NO: 953383 - protein, 9 aa, Homo Sapiens
SSFQAHKGV

SEQ ID NO: 953384 - protein, 9 aa, Homo Sapiens
MSDKKCVEL

SEQ ID NO: 953385 - protein, 9 aa, Homo Sapiens
KKKKELPLW

SEQ ID NO: 953386 - protein, 9 aa, Homo Sapiens
QGFFVVMPD

SEQ ID NO: 953387 - protein, 9 aa, Homo Sapiens
TLIAATLPI

SEQ ID NO: 953388 - protein, 9 aa, Homo Sapiens
LWETWANLV

SEQ ID NO: 953389 - protein, 9 aa, Homo Sapiens
ELHFKVNDL

SEQ ID NO: 953390 - protein, 9 aa, Homo Sapiens
IILDNVKNL

SEQ ID NO: 953391 - protein, 9 aa, Homo Sapiens
KGGSGEEGG

SEQ ID NO: 953392 - protein, 9 aa, Homo Sapiens
EEVSPPTTP

SEQ ID NO: 953393 - protein, 9 aa, Homo Sapiens
HYFSQDVQV

SEQ ID NO: 953394 - protein, 9 aa, Homo Sapiens
GKIGIPNLE

SEQ ID NO: 953395 - protein, 9 aa, Homo Sapiens
NIDYLGFFI

SEQ ID NO: 953396 - protein, 9 aa, Homo Sapiens
PPSQPAPVD

SEQ ID NO: 953397 - protein, 9 aa, Homo Sapiens
GKNAEVEYQ

SEQ ID NO: 953398 - protein, 9 aa, Homo Sapiens
MAGVFYMFL

SEQ ID NO: 953399 - protein, 9 aa, Homo Sapiens
VIWLVTFTD

SEQ ID NO: 953400 - protein, 9 aa, Homo Sapiens
RQLNGNGGQ

SEQ ID NO: 953401 - protein, 9 aa, Homo Sapiens
ATRIPEDML

SEQ ID NO: 953402 - protein, 9 aa, Homo Sapiens
NGVQALLLK

SEQ ID NO: 953403 - protein, 9 aa, Homo Sapiens
FMFAMNCQG

SEQ ID NO: 953404 - protein, 9 aa, Homo Sapiens
KNLFYFGES

SEQ ID NO: 953405 - protein, 9 aa, Homo Sapiens
KLYPIANRN

SEQ ID NO: 953406 - protein, 9 aa, Homo Sapiens
KTVYNLIRS

SEQ ID NO: 953407 - protein, 9 aa, Homo Sapiens
SLEIKCKCH

SEQ ID NO: 953408 - protein, 9 aa, Homo Sapiens
PNIESGVPS

SEQ ID NO: 953409 - protein, 9 aa, Homo Sapiens
GALASRSTH

SEQ ID NO: 953410 - protein, 9 aa, Homo Sapiens
AKWHMLCDG

SEQ ID NO: 953411 - protein, 9 aa, Homo Sapiens
GLLRLREGG

SEQ ID NO: 953412 - protein, 9 aa, Homo Sapiens
SPCRSKISG

SEQ ID NO: 953413 - protein, 9 aa, Homo Sapiens
KTEESDTDK

SEQ ID NO: 953414 - protein, 9 aa, Homo Sapiens
AELRLYHCL

SEQ ID NO: 953415 - protein, 9 aa, Homo Sapiens
VFFESAAFM

SEQ ID NO: 953416 - protein, 9 aa, Homo Sapiens
IQKIINTKY

SEQ ID NO: 953417 - protein, 9 aa, Homo Sapiens
ATSVLLDKI

SEQ ID NO: 953418 - protein, 9 aa, Homo Sapiens
YFCLRRYGY

SEQ ID NO: 953419 - protein, 9 aa, Homo Sapiens
PEEMSEYSD

SEQ ID NO: 953420 - protein, 9 aa, Homo Sapiens
ERIEQNYWQ

SEQ ID NO: 953421 - protein, 9 aa, Homo Sapiens
PSWSCQKKL

SEQ ID NO: 953422 - protein, 9 aa, Homo Sapiens
LHYSPSTCL

SEQ ID NO: 953423 - protein, 9 aa, Homo Sapiens
KTPVQMYPG

SEQ ID NO: 953424 - protein, 9 aa, Homo Sapiens
EGGIFSNLR

SEQ ID NO: 953425 - protein, 9 aa, Homo Sapiens
LPNTVADIW

SEQ ID NO: 953426 - protein, 9 aa, Homo Sapiens
QRVKEKKAT

SEQ ID NO: 953427 - protein, 9 aa, Homo Sapiens
LFPATHQPW

SEQ ID NO: 953428 - protein, 9 aa, Homo Sapiens
TFVGYQSVT

SEQ ID NO: 953429 - protein, 9 aa, Homo Sapiens
RRSTNKTDA

SEQ ID NO: 953430 - protein, 9 aa, Homo Sapiens
TGSVSIPWR

SEQ ID NO: 953431 - protein, 9 aa, Homo Sapiens
ERVKGCDKH

SEQ ID NO: 953432 - protein, 9 aa, Homo Sapiens
GQKNGRTWK

SEQ ID NO: 953433 - protein, 9 aa, Homo Sapiens
PAGVMGEND

SEQ ID NO: 953434 - protein, 9 aa, Homo Sapiens
AGKGHRRTM

SEQ ID NO: 953435 - protein, 9 aa, Homo Sapiens
HLNIIFINA

SEQ ID NO: 953436 - protein, 9 aa, Homo Sapiens
LPTLVAEHS

SEQ ID NO: 953437 - protein, 9 aa, Homo Sapiens
VPPDLPPPS

SEQ ID NO: 953438 - protein, 9 aa, Homo Sapiens
GSTDYRKEI

SEQ ID NO: 953439 - protein, 9 aa, Homo Sapiens
VLLDKILTK

SEQ ID NO: 953440 - protein, 9 aa, Homo Sapiens
RKAVATSVL

SEQ ID NO: 953441 - protein, 9 aa, Homo Sapiens
FWFRDWEIN

SEQ ID NO: 953442 - protein, 9 aa, Homo Sapiens
HILKNRMYE

SEQ ID NO: 953443 - protein, 9 aa, Homo Sapiens
FVGYQSVTP

SEQ ID NO: 953444 - protein, 9 aa, Homo Sapiens
GLSSRPEEQ

SEQ ID NO: 953445 - protein, 9 aa, Homo Sapiens
QLRMNRGGM

SEQ ID NO: 953446 - protein, 9 aa, Homo Sapiens
QEIKPGSME

SEQ ID NO: 953447 - protein, 9 aa, Homo Sapiens
YYADGCSPH

SEQ ID NO: 953448 - protein, 9 aa, Homo Sapiens
GDLEDTGER

SEQ ID NO: 953449 - protein, 9 aa, Homo Sapiens
RMEEIIFNL

SEQ ID NO: 953450 - protein, 9 aa, Homo Sapiens
GKNALIRVM

SEQ ID NO: 953451 - protein, 9 aa, Homo Sapiens
TSNENPGYD

SEQ ID NO: 953452 - protein, 9 aa, Homo Sapiens
YYYSEAFKG

SEQ ID NO: 953453 - protein, 9 aa, Homo Sapiens
DLFGHLLAY

SEQ ID NO: 953454 - protein, 9 aa, Homo Sapiens
PGGLPSLED

SEQ ID NO: 953455 - protein, 9 aa, Homo Sapiens
DSFIDSQFE

SEQ ID NO: 953456 - protein, 9 aa, Homo Sapiens
SLSPHLGRS

SEQ ID NO: 953457 - protein, 9 aa, Homo Sapiens
YMFLVAMGL

SEQ ID NO: 953458 - protein, 9 aa, Homo Sapiens
GYDQYAYDG

SEQ ID NO: 953459 - protein, 9 aa, Homo Sapiens
SVPAAAIAA

SEQ ID NO: 953460 - protein, 9 aa, Homo Sapiens
ACDIDEIKE

SEQ ID NO: 953461 - protein, 9 aa, Homo Sapiens
KIPKNKTRT

SEQ ID NO: 953462 - protein, 9 aa, Homo Sapiens
NAASSSSVP

SEQ ID NO: 953463 - protein, 9 aa, Homo Sapiens
PSGPWQKAK

SEQ ID NO: 953464 - protein, 9 aa, Homo Sapiens
LQLQFFFDV

SEQ ID NO: 953465 - protein, 9 aa, Homo Sapiens
VEPESRTGP

SEQ ID NO: 953466 - protein, 9 aa, Homo Sapiens
AYAFESKSH

SEQ ID NO: 953467 - protein, 9 aa, Homo Sapiens
LGQSASFNP

SEQ ID NO: 953468 - protein, 9 aa, Homo Sapiens
ASRMMIQPL

SEQ ID NO: 953469 - protein, 9 aa, Homo Sapiens
ALSSIVLIP

SEQ ID NO: 953470 - protein, 9 aa, Homo Sapiens
RLRQPAFDI

SEQ ID NO: 953471 - protein, 9 aa, Homo Sapiens
EKGGSGEEG

SEQ ID NO: 953472 - protein, 9 aa, Homo Sapiens
ITIYGDLED

SEQ ID NO: 953473 - protein, 9 aa, Homo Sapiens
QLGVRKMAG

SEQ ID NO: 953474 - protein, 9 aa, Homo Sapiens
PTIKEPKDK

SEQ ID NO: 953475 - protein, 9 aa, Homo Sapiens
TLTFVGYQS

SEQ ID NO: 953476 - protein, 9 aa, Homo Sapiens
TQQDQLKNA

SEQ ID NO: 953477 - protein, 9 aa, Homo Sapiens
GVTKTVYNL

SEQ ID NO: 953478 - protein, 9 aa, Homo Sapiens
ILAVAVFFE

SEQ ID NO: 953479 - protein, 9 aa, Homo Sapiens
CITGKDEVG

SEQ ID NO: 953480 - protein, 9 aa, Homo Sapiens
FLSDKFNIA

SEQ ID NO: 953481 - protein, 9 aa, Homo Sapiens
EERKKAFTT

SEQ ID NO: 953482 - protein, 9 aa, Homo Sapiens
QKKLYSYLL

SEQ ID NO: 953483 - protein, 9 aa, Homo Sapiens
FSKKHKAPV

SEQ ID NO: 953484 - protein, 9 aa, Homo Sapiens
FTGVRGPPK

SEQ ID NO: 953485 - protein, 9 aa, Homo Sapiens
KYSWVTPPV

SEQ ID NO: 953486 - protein, 9 aa, Homo Sapiens
GLRMEEIIF

SEQ ID NO: 953487 - protein, 9 aa, Homo Sapiens
GLTTLLFDL

SEQ ID NO: 953488 - protein, 9 aa, Homo Sapiens
IYSTINTLI

SEQ ID NO: 953489 - protein, 9 aa, Homo Sapiens
AVFFESAAF

SEQ ID NO: 953490 - protein, 9 aa, Homo Sapiens
EVEHFFLLT

SEQ ID NO: 953491 - protein, 9 aa, Homo Sapiens
GVGKSCLVR

SEQ ID NO: 953492 - protein, 9 aa, Homo Sapiens
DGDDLIVQG

SEQ ID NO: 953493 - protein, 9 aa, Homo Sapiens
LCYDGSHMC

SEQ ID NO: 953494 - protein, 9 aa, Homo Sapiens
CGSTFKEIP

SEQ ID NO: 953495 - protein, 9 aa, Homo Sapiens
THNLWLLFF

SEQ ID NO: 953496 - protein, 9 aa, Homo Sapiens
PGDPQWIGA

SEQ ID NO: 953497 - protein, 9 aa, Homo Sapiens
SPTIKEPKD

SEQ ID NO: 953498 - protein, 9 aa, Homo Sapiens
PSSHCTDLY

SEQ ID NO: 953499 - protein, 9 aa, Homo Sapiens
RTRTEHLFD

SEQ ID NO: 953500 - protein, 9 aa, Homo Sapiens
RMYECDSVK

SEQ ID NO: 953501 - protein, 9 aa, Homo Sapiens
ASPRTYQDF

SEQ ID NO: 953502 - protein, 9 aa, Homo Sapiens
ASKVIVVVG

SEQ ID NO: 953503 - protein, 9 aa, Homo Sapiens
EDLRSRIKV

SEQ ID NO: 953504 - protein, 9 aa, Homo Sapiens
SQDVQVTAR

SEQ ID NO: 953505 - protein, 9 aa, Homo Sapiens
VNAVYFKRK

SEQ ID NO: 953506 - protein, 9 aa, Homo Sapiens
VHMSSMVIK

SEQ ID NO: 953507 - protein, 9 aa, Homo Sapiens
NFALRRVTL

SEQ ID NO: 953508 - protein, 9 aa, Homo Sapiens
GLRKWQYNV

SEQ ID NO: 953509 - protein, 9 aa, Homo Sapiens
ECKSTDKDV

SEQ ID NO: 953510 - protein, 9 aa, Homo Sapiens
NECQHEAVS

SEQ ID NO: 953511 - protein, 9 aa, Homo Sapiens
LDSGIWHLV

SEQ ID NO: 953512 - protein, 9 aa, Homo Sapiens
YFQNLEQKI

SEQ ID NO: 953513 - protein, 9 aa, Homo Sapiens
LLCCTNFST

SEQ ID NO: 953514 - protein, 9 aa, Homo Sapiens
LECSQTQCP

SEQ ID NO: 953515 - protein, 9 aa, Homo Sapiens
YGCIEKQPV

SEQ ID NO: 953516 - protein, 9 aa, Homo Sapiens
FTPQCFLIR

SEQ ID NO: 953517 - protein, 9 aa, Homo Sapiens
KEPKDKSSE

SEQ ID NO: 953518 - protein, 9 aa, Homo Sapiens
MQPTSWKQE

SEQ ID NO: 953519 - protein, 9 aa, Homo Sapiens
NIESGVPSL

SEQ ID NO: 953520 - protein, 9 aa, Homo Sapiens
PFNSVHLFF

SEQ ID NO: 953521 - protein, 9 aa, Homo Sapiens
DVKDAIQKI

SEQ ID NO: 953522 - protein, 9 aa, Homo Sapiens
KYMARLFRG

SEQ ID NO: 953523 - protein, 9 aa, Homo Sapiens
GPFPCSECA

SEQ ID NO: 953524 - protein, 9 aa, Homo Sapiens
TIMKHVRDN

SEQ ID NO: 953525 - protein, 9 aa, Homo Sapiens
RKNLFYFGE

SEQ ID NO: 953526 - protein, 9 aa, Homo Sapiens
RKWQYNVWS

SEQ ID NO: 953527 - protein, 9 aa, Homo Sapiens
NWELGEPLG

SEQ ID NO: 953528 - protein, 9 aa, Homo Sapiens
PADSVLPTL

SEQ ID NO: 953529 - protein, 9 aa, Homo Sapiens
FDGDDLIVQ

SEQ ID NO: 953530 - protein, 9 aa, Homo Sapiens
ELGLTKQDI

SEQ ID NO: 953531 - protein, 9 aa, Homo Sapiens
YDTQVKEMR

SEQ ID NO: 953532 - protein, 9 aa, Homo Sapiens
NSLIIQFTS

SEQ ID NO: 953533 - protein, 9 aa, Homo Sapiens
ILCERNDKV

SEQ ID NO: 953534 - protein, 9 aa, Homo Sapiens
QIIDGDGTD

SEQ ID NO: 953535 - protein, 9 aa, Homo Sapiens
SPRDEKEEM

SEQ ID NO: 953536 - protein, 9 aa, Homo Sapiens
PGLPGIPGL

SEQ ID NO: 953537 - protein, 9 aa, Homo Sapiens
KFTSTSDPV

SEQ ID NO: 953538 - protein, 9 aa, Homo Sapiens
KGCFLSEYE

SEQ ID NO: 953539 - protein, 9 aa, Homo Sapiens
LSSSGSNSR

SEQ ID NO: 953540 - protein, 9 aa, Homo Sapiens
SSMLQKFQE

SEQ ID NO: 953541 - protein, 9 aa, Homo Sapiens
ETSLDHLYE

SEQ ID NO: 953542 - protein, 9 aa, Homo Sapiens
VPAAAIAAR

SEQ ID NO: 953543 - protein, 9 aa, Homo Sapiens
TRTRTEHLF

SEQ ID NO: 953544 - protein, 9 aa, Homo Sapiens
IGNAGVGKS

SEQ ID NO: 953545 - protein, 9 aa, Homo Sapiens
SISQFPITS

SEQ ID NO: 953546 - protein, 9 aa, Homo Sapiens
KKESDQACG

SEQ ID NO: 953547 - protein, 9 aa, Homo Sapiens
SVKCEAGRD

SEQ ID NO: 953548 - protein, 9 aa, Homo Sapiens
TNKTDASNI

SEQ ID NO: 953549 - protein, 9 aa, Homo Sapiens
VMGENDTLV

SEQ ID NO: 953550 - protein, 9 aa, Homo Sapiens
KCCYWFSNK

SEQ ID NO: 953551 - protein, 9 aa, Homo Sapiens
GPEPPEEVS

SEQ ID NO: 953552 - protein, 9 aa, Homo Sapiens
MTKLISRNT

SEQ ID NO: 953553 - protein, 9 aa, Homo Sapiens
PTDFEDLQD

SEQ ID NO: 953554 - protein, 9 aa, Homo Sapiens
NDTLVWKYA

SEQ ID NO: 953555 - protein, 9 aa, Homo Sapiens
DSTTSSLTE

SEQ ID NO: 953556 - protein, 9 aa, Homo Sapiens
SLPHGTHAF

SEQ ID NO: 953557 - protein, 9 aa, Homo Sapiens
KRAQRLKIL

SEQ ID NO: 953558 - protein, 9 aa, Homo Sapiens
PEAKKESDQ

SEQ ID NO: 953559 - protein, 9 aa, Homo Sapiens
LERLCRNMQ

SEQ ID NO: 953560 - protein, 9 aa, Homo Sapiens
DPNICDSRG

SEQ ID NO: 953561 - protein, 9 aa, Homo Sapiens
LFFLRRWNG

SEQ ID NO: 953562 - protein, 9 aa, Homo Sapiens
WQYNVWSND

SEQ ID NO: 953563 - protein, 9 aa, Homo Sapiens
WQKAKCSYP

SEQ ID NO: 953564 - protein, 9 aa, Homo Sapiens
LNGNGGQAL

SEQ ID NO: 953565 - protein, 9 aa, Homo Sapiens
VPRIAELMN

SEQ ID NO: 953566 - protein, 9 aa, Homo Sapiens
QTQCPSAHT

SEQ ID NO: 953567 - protein, 9 aa, Homo Sapiens
RYYADGCSP

SEQ ID NO: 953568 - protein, 9 aa, Homo Sapiens
NLEHALKCL

SEQ ID NO: 953569 - protein, 9 aa, Homo Sapiens
SFHDYLLIT

SEQ ID NO: 953570 - protein, 9 aa, Homo Sapiens
HFFLLTSKP

SEQ ID NO: 953571 - protein, 9 aa, Homo Sapiens
LSAIVSISA

SEQ ID NO: 953572 - protein, 9 aa, Homo Sapiens
DTAGKEEYS

SEQ ID NO: 953573 - protein, 9 aa, Homo Sapiens
DLEYKTVGL

SEQ ID NO: 953574 - protein, 9 aa, Homo Sapiens
VSNQVREFP

SEQ ID NO: 953575 - protein, 9 aa, Homo Sapiens
GSELSVKCE

SEQ ID NO: 953576 - protein, 9 aa, Homo Sapiens
WETWANLVH

SEQ ID NO: 953577 - protein, 9 aa, Homo Sapiens
GAGTLVNVQ

SEQ ID NO: 953578 - protein, 9 aa, Homo Sapiens
EVQADQQAW

SEQ ID NO: 953579 - protein, 9 aa, Homo Sapiens
TSLAYIHSY

SEQ ID NO: 953580 - protein, 9 aa, Homo Sapiens
TLPQPSPIP

SEQ ID NO: 953581 - protein, 9 aa, Homo Sapiens
ICSVNCGSH

SEQ ID NO: 953582 - protein, 9 aa, Homo Sapiens
LLRGYDQYA

SEQ ID NO: 953583 - protein, 9 aa, Homo Sapiens
KQEERVKGC

SEQ ID NO: 953584 - protein, 9 aa, Homo Sapiens
DVNKEEKLV

SEQ ID NO: 953585 - protein, 9 aa, Homo Sapiens
IICFNYLDN

SEQ ID NO: 953586 - protein, 9 aa, Homo Sapiens
LGKDWGPEE

SEQ ID NO: 953587 - protein, 9 aa, Homo Sapiens
NKKLPSFGP

SEQ ID NO: 953588 - protein, 9 aa, Homo Sapiens
EAGAELRLY

SEQ ID NO: 953589 - protein, 9 aa, Homo Sapiens
RTEERESSR

SEQ ID NO: 953590 - protein, 9 aa, Homo Sapiens
PHLYYQMGL

SEQ ID NO: 953591 - protein, 9 aa, Homo Sapiens
ESSLEEPQE

SEQ ID NO: 953592 - protein, 9 aa, Homo Sapiens
LQFVSNQVR

SEQ ID NO: 953593 - protein, 9 aa, Homo Sapiens
IPGAKEGNS

SEQ ID NO: 953594 - protein, 9 aa, Homo Sapiens
SMPRERRNS

SEQ ID NO: 953595 - protein, 9 aa, Homo Sapiens
PLPPPGTEI

SEQ ID NO: 953596 - protein, 9 aa, Homo Sapiens
LNIIFINAF

SEQ ID NO: 953597 - protein, 9 aa, Homo Sapiens
LSGFFLRTL

SEQ ID NO: 953598 - protein, 9 aa, Homo Sapiens
NSCLEDSNP

SEQ ID NO: 953599 - protein, 9 aa, Homo Sapiens
AGVFYMFLV

SEQ ID NO: 953600 - protein, 9 aa, Homo Sapiens
MNCQGSIIF

SEQ ID NO: 953601 - protein, 9 aa, Homo Sapiens
PCRSKISGS

SEQ ID NO: 953602 - protein, 9 aa, Homo Sapiens
SSLANNHNH

SEQ ID NO: 953603 - protein, 9 aa, Homo Sapiens
GENDTLVWK

SEQ ID NO: 953604 - protein, 9 aa, Homo Sapiens
VLTRRGSIC

SEQ ID NO: 953605 - protein, 9 aa, Homo Sapiens
SSSSSMLQK

SEQ ID NO: 953606 - protein, 9 aa, Homo Sapiens
QASSVEPES

SEQ ID NO: 953607 - protein, 9 aa, Homo Sapiens
ASSVEPESR

SEQ ID NO: 953608 - protein, 9 aa, Homo Sapiens
FAAAVQSNT

SEQ ID NO: 953609 - protein, 9 aa, Homo Sapiens
AAGALASRS

SEQ ID NO: 953610 - protein, 9 aa, Homo Sapiens
DKHPTDIIC

SEQ ID NO: 953611 - protein, 9 aa, Homo Sapiens
PPHGAPPRK

SEQ ID NO: 953612 - protein, 9 aa, Homo Sapiens
YQIIDGDGT

SEQ ID NO: 953613 - protein, 9 aa, Homo Sapiens
VITPQQKIT

SEQ ID NO: 953614 - protein, 9 aa, Homo Sapiens
NVVCEWGLR

SEQ ID NO: 953615 - protein, 9 aa, Homo Sapiens
TATFRPQKD

SEQ ID NO: 953616 - protein, 9 aa, Homo Sapiens
AKKEQSHTQ

SEQ ID NO: 953617 - protein, 9 aa, Homo Sapiens
QDGEDLFTS

SEQ ID NO: 953618 - protein, 9 aa, Homo Sapiens
PQPSPIPPD

SEQ ID NO: 953619 - protein, 9 aa, Homo Sapiens
PVVSPLSEF

SEQ ID NO: 953620 - protein, 9 aa, Homo Sapiens
TATPEDFSK

SEQ ID NO: 953621 - protein, 9 aa, Homo Sapiens
SCSQCGKTS

SEQ ID NO: 953622 - protein, 9 aa, Homo Sapiens
VFGLRLEIP

SEQ ID NO: 953623 - protein, 9 aa, Homo Sapiens
VSDCPVSTL

SEQ ID NO: 953624 - protein, 9 aa, Homo Sapiens
DTLVWKYAD

SEQ ID NO: 953625 - protein, 9 aa, Homo Sapiens
SRHIKEFLD

SEQ ID NO: 953626 - protein, 9 aa, Homo Sapiens
EEEESLCGE

SEQ ID NO: 953627 - protein, 9 aa, Homo Sapiens
IPPDLEAMA

SEQ ID NO: 953628 - protein, 9 aa, Homo Sapiens
KHALDSADN

SEQ ID NO: 953629 - protein, 9 aa, Homo Sapiens
LGDLTHSDL

SEQ ID NO: 953630 - protein, 9 aa, Homo Sapiens
ELEQAKKEQ

SEQ ID NO: 953631 - protein, 9 aa, Homo Sapiens
DPPKAESLG

SEQ ID NO: 953632 - protein, 9 aa, Homo Sapiens
NGPWAMVGM

SEQ ID NO: 953633 - protein, 9 aa, Homo Sapiens
LSDKFNIAT

SEQ ID NO: 953634 - protein, 9 aa, Homo Sapiens
SMERVLPST

SEQ ID NO: 953635 - protein, 9 aa, Homo Sapiens
TPVQMYPGP

SEQ ID NO: 953636 - protein, 9 aa, Homo Sapiens
GSYSQHINH

SEQ ID NO: 953637 - protein, 9 aa, Homo Sapiens
RNNQSPVDI

SEQ ID NO: 953638 - protein, 9 aa, Homo Sapiens
YLGFFIYRL

SEQ ID NO: 953639 - protein, 9 aa, Homo Sapiens
ASLEIKCKC

SEQ ID NO: 953640 - protein, 9 aa, Homo Sapiens
LANNHNHHA

SEQ ID NO: 953641 - protein, 9 aa, Homo Sapiens
QFSVPSTAN

SEQ ID NO: 953642 - protein, 9 aa, Homo Sapiens
ISREAQDEV

SEQ ID NO: 953643 - protein, 9 aa, Homo Sapiens
FGQKNGRTW

SEQ ID NO: 953644 - protein, 9 aa, Homo Sapiens
QHEAVSKDE

SEQ ID NO: 953645 - protein, 9 aa, Homo Sapiens
ELTLSGFFL

SEQ ID NO: 953646 - protein, 9 aa, Homo Sapiens
GKNAASSSS

SEQ ID NO: 953647 - protein, 9 aa, Homo Sapiens
RIYERIHCT

SEQ ID NO: 953648 - protein, 9 aa, Homo Sapiens
YFSQDVQVT

SEQ ID NO: 953649 - protein, 9 aa, Homo Sapiens
FLFTSLATT

SEQ ID NO: 953650 - protein, 9 aa, Homo Sapiens
DMDKILDVP

SEQ ID NO: 953651 - protein, 9 aa, Homo Sapiens
RKRTADKFT

SEQ ID NO: 953652 - protein, 9 aa, Homo Sapiens
WLGYGSEEF

SEQ ID NO: 953653 - protein, 9 aa, Homo Sapiens
KFVCGSTFK

SEQ ID NO: 953654 - protein, 9 aa, Homo Sapiens
EIKCKCHGV

SEQ ID NO: 953655 - protein, 9 aa, Homo Sapiens
SSDLNDVST

SEQ ID NO: 953656 - protein, 9 aa, Homo Sapiens
RKRRSTNKT

SEQ ID NO: 953657 - protein, 9 aa, Homo Sapiens
LTKQDIIDL

SEQ ID NO: 953658 - protein, 9 aa, Homo Sapiens
SQPAPVDEE

SEQ ID NO: 953659 - protein, 9 aa, Homo Sapiens
KQDIIDLPA

SEQ ID NO: 953660 - protein, 9 aa, Homo Sapiens
INTLIAATL

SEQ ID NO: 953661 - protein, 9 aa, Homo Sapiens
DKLLSSDHE

SEQ ID NO: 953662 - protein, 9 aa, Homo Sapiens
YFPLPAEEK

SEQ ID NO: 953663 - protein, 9 aa, Homo Sapiens
AELMNKKLP

SEQ ID NO: 953664 - protein, 9 aa, Homo Sapiens
KERIEQNYW

SEQ ID NO: 953665 - protein, 9 aa, Homo Sapiens
VISSNQFDP

SEQ ID NO: 953666 - protein, 9 aa, Homo Sapiens
HLLQLDQVW

SEQ ID NO: 953667 - protein, 9 aa, Homo Sapiens
GKEEYSAMR

SEQ ID NO: 953668 - protein, 9 aa, Homo Sapiens
PGLFPATHQ

SEQ ID NO: 953669 - protein, 9 aa, Homo Sapiens
RYKNILLYD

SEQ ID NO: 953670 - protein, 9 aa, Homo Sapiens
TCGLQSISS

SEQ ID NO: 953671 - protein, 9 aa, Homo Sapiens
GLRSTPSLT

SEQ ID NO: 953672 - protein, 9 aa, Homo Sapiens
GVLTRRGSI

SEQ ID NO: 953673 - protein, 9 aa, Homo Sapiens
GNIYFFSGP

SEQ ID NO: 953674 - protein, 9 aa, Homo Sapiens
CFNYLDNRD

SEQ ID NO: 953675 - protein, 9 aa, Homo Sapiens
LMALSSIVL

SEQ ID NO: 953676 - protein, 9 aa, Homo Sapiens
ELNGNIYFF

SEQ ID NO: 953677 - protein, 9 aa, Homo Sapiens
NLFYFGEST

SEQ ID NO: 953678 - protein, 9 aa, Homo Sapiens
EERESSRAF

SEQ ID NO: 953679 - protein, 9 aa, Homo Sapiens
HFKPVVDTY

SEQ ID NO: 953680 - protein, 9 aa, Homo Sapiens
SSKAALRIY

SEQ ID NO: 953681 - protein, 9 aa, Homo Sapiens
QIAKWHMLC

SEQ ID NO: 953682 - protein, 9 aa, Homo Sapiens
SRSPECRMI

SEQ ID NO: 953683 - protein, 9 aa, Homo Sapiens
GQGLTTLLF

SEQ ID NO: 953684 - protein, 9 aa, Homo Sapiens
CMIVHQGII

SEQ ID NO: 953685 - protein, 9 aa, Homo Sapiens
DCITGKDEV

SEQ ID NO: 953686 - protein, 9 aa, Homo Sapiens
SCQSFVDVS

SEQ ID NO: 953687 - protein, 9 aa, Homo Sapiens
VHQGIILDN

SEQ ID NO: 953688 - protein, 9 aa, Homo Sapiens
EICSVNCGS

SEQ ID NO: 953689 - protein, 9 aa, Homo Sapiens
THYYYSEAF

SEQ ID NO: 953690 - protein, 9 aa, Homo Sapiens
KSHFTLNSR

SEQ ID NO: 953691 - protein, 9 aa, Homo Sapiens
CSVNCGSHG

SEQ ID NO: 953692 - protein, 9 aa, Homo Sapiens
IESGVPSLP

SEQ ID NO: 953693 - protein, 9 aa, Homo Sapiens
DPGHYGPES

SEQ ID NO: 953694 - protein, 9 aa, Homo Sapiens
PTDYRFVLK

SEQ ID NO: 953695 - protein, 9 aa, Homo Sapiens
SVSIPWRNE

SEQ ID NO: 953696 - protein, 9 aa, Homo Sapiens
RDEKEEMME

SEQ ID NO: 953697 - protein, 9 aa, Homo Sapiens
HPTDIICFN

SEQ ID NO: 953698 - protein, 9 aa, Homo Sapiens
KETSLDHLY

SEQ ID NO: 953699 - protein, 9 aa, Homo Sapiens
DQLKNAKME

SEQ ID NO: 953700 - protein, 9 aa, Homo Sapiens
NGNIYFFSG

SEQ ID NO: 953701 - protein, 9 aa, Homo Sapiens
PMKTDPVVS

SEQ ID NO: 953702 - protein, 9 aa, Homo Sapiens
IPICSWHDI

SEQ ID NO: 953703 - protein, 9 aa, Homo Sapiens
LDQVWRYLR

SEQ ID NO: 953704 - protein, 9 aa, Homo Sapiens
ELAKKADLD

SEQ ID NO: 953705 - protein, 9 aa, Homo Sapiens
AGKEEYSAM

SEQ ID NO: 953706 - protein, 9 aa, Homo Sapiens
CLELAKKAD

SEQ ID NO: 953707 - protein, 9 aa, Homo Sapiens
RMRQLNGNG

SEQ ID NO: 953708 - protein, 9 aa, Homo Sapiens
LFGHLLAYL

SEQ ID NO: 953709 - protein, 9 aa, Homo Sapiens
PSKRVFLFG

SEQ ID NO: 953710 - protein, 9 aa, Homo Sapiens
AYTSKGAGP

SEQ ID NO: 953711 - protein, 9 aa, Homo Sapiens
TEESDTDKL

SEQ ID NO: 953712 - protein, 9 aa, Homo Sapiens
FFLRRWNGS

SEQ ID NO: 953713 - protein, 9 aa, Homo Sapiens
EWGLRSTPS

SEQ ID NO: 953714 - protein, 9 aa, Homo Sapiens
SVLPTLVAE

SEQ ID NO: 953715 - protein, 9 aa, Homo Sapiens
GRQATHYYY

SEQ ID NO: 953716 - protein, 9 aa, Homo Sapiens
ASRSTHSAE

SEQ ID NO: 953717 - protein, 9 aa, Homo Sapiens
NGNGGQALV

SEQ ID NO: 953718 - protein, 9 aa, Homo Sapiens
HYYYSEAFK

SEQ ID NO: 953719 - protein, 9 aa, Homo Sapiens
YMDPHSCQS

SEQ ID NO: 953720 - protein, 9 aa, Homo Sapiens
LLCLVFTRT

SEQ ID NO: 953721 - protein, 9 aa, Homo Sapiens
GNTKETSLS

SEQ ID NO: 953722 - protein, 9 aa, Homo Sapiens
LRMEEIIFN

SEQ ID NO: 953723 - protein, 9 aa, Homo Sapiens
PCSECADDC

SEQ ID NO: 953724 - protein, 9 aa, Homo Sapiens
NLTKKQRQA

SEQ ID NO: 953725 - protein, 9 aa, Homo Sapiens
PRKAPPPKA

SEQ ID NO: 953726 - protein, 9 aa, Homo Sapiens
KAPTDYRFV

SEQ ID NO: 953727 - protein, 9 aa, Homo Sapiens
MSTCFSFIG

SEQ ID NO: 953728 - protein, 9 aa, Homo Sapiens
TVDTEEVWA

SEQ ID NO: 953729 - protein, 9 aa, Homo Sapiens
FVLLLSAIV

SEQ ID NO: 953730 - protein, 9 aa, Homo Sapiens
VKDAIQKII

SEQ ID NO: 953731 - protein, 9 aa, Homo Sapiens
SCLEDSNPS

SEQ ID NO: 953732 - protein, 9 aa, Homo Sapiens
SVNCGSHGV

SEQ ID NO: 953733 - protein, 9 aa, Homo Sapiens
YSPRDEKEE

SEQ ID NO: 953734 - protein, 9 aa, Homo Sapiens
TASKVIVVV

SEQ ID NO: 953735 - protein, 9 aa, Homo Sapiens
RKMAGDMSS

SEQ ID NO: 953736 - protein, 9 aa, Homo Sapiens
DEKEEMMEV

SEQ ID NO: 953737 - protein, 9 aa, Homo Sapiens
EPIQPLVLR

SEQ ID NO: 953738 - protein, 9 aa, Homo Sapiens
DRIENIDYL

SEQ ID NO: 953739 - protein, 9 aa, Homo Sapiens
CRLRQPAFD

SEQ ID NO: 953740 - protein, 9 aa, Homo Sapiens
SLPGSSVAQ

SEQ ID NO: 953741 - protein, 9 aa, Homo Sapiens
KEMRAQLTE

SEQ ID NO: 953742 - protein, 9 aa, Homo Sapiens
WLLFFLRRW

SEQ ID NO: 953743 - protein, 9 aa, Homo Sapiens
RKAPPPKAP

SEQ ID NO: 953744 - protein, 9 aa, Homo Sapiens
LEQAKKEQS

SEQ ID NO: 953745 - protein, 9 aa, Homo Sapiens
NYWQVPRKG

SEQ ID NO: 953746 - protein, 9 aa, Homo Sapiens
RIESFIQSL

SEQ ID NO: 953747 - protein, 9 aa, Homo Sapiens
RPHHDQRSL

SEQ ID NO: 953748 - protein, 9 aa, Homo Sapiens
DGLLRLREG

SEQ ID NO: 953749 - protein, 9 aa, Homo Sapiens
QKDDTKAAA

SEQ ID NO: 953750 - protein, 9 aa, Homo Sapiens
IYYTTFDWP

SEQ ID NO: 953751 - protein, 9 aa, Homo Sapiens
NICDSRGRT

SEQ ID NO: 953752 - protein, 9 aa, Homo Sapiens
HLIEHQRTP

SEQ ID NO: 953753 - protein, 9 aa, Homo Sapiens
TLSGFFLRT

SEQ ID NO: 953754 - protein, 9 aa, Homo Sapiens
IVHQGIILD

SEQ ID NO: 953755 - protein, 9 aa, Homo Sapiens
HSCQSFVDV

SEQ ID NO: 953756 - protein, 9 aa, Homo Sapiens
LQPVPPTLR

SEQ ID NO: 953757 - protein, 9 aa, Homo Sapiens
LEDTGERYL

SEQ ID NO: 953758 - protein, 9 aa, Homo Sapiens
DRSATSVLL

SEQ ID NO: 953759 - protein, 9 aa, Homo Sapiens
ASWGSTDYR

SEQ ID NO: 953760 - protein, 9 aa, Homo Sapiens
SQISLPHGT

SEQ ID NO: 953761 - protein, 9 aa, Homo Sapiens
DSSMERVLP

SEQ ID NO: 953762 - protein, 9 aa, Homo Sapiens
RQPAFDISF

SEQ ID NO: 953763 - protein, 9 aa, Homo Sapiens
LGEPLGNAP

SEQ ID NO: 953764 - protein, 9 aa, Homo Sapiens
ARGHYSLVI

SEQ ID NO: 953765 - protein, 9 aa, Homo Sapiens
GLERLCRNM

SEQ ID NO: 953766 - protein, 9 aa, Homo Sapiens
DDEIENLHY

SEQ ID NO: 953767 - protein, 9 aa, Homo Sapiens
TKYLVRYNN

SEQ ID NO: 953768 - protein, 9 aa, Homo Sapiens
SSSSMLQKF

SEQ ID NO: 953769 - protein, 9 aa, Homo Sapiens
NSVHLFFFM

SEQ ID NO: 953770 - protein, 9 aa, Homo Sapiens
KFILIGLTQ

SEQ ID NO: 953771 - protein, 9 aa, Homo Sapiens
TNVHMSSMV

SEQ ID NO: 953772 - protein, 9 aa, Homo Sapiens
KINAEPEYV

SEQ ID NO: 953773 - protein, 9 aa, Homo Sapiens
PKAESLGTE

SEQ ID NO: 953774 - protein, 9 aa, Homo Sapiens
YERIHCTDR

SEQ ID NO: 953775 - protein, 9 aa, Homo Sapiens
TRTEHLFDQ

SEQ ID NO: 953776 - protein, 9 aa, Homo Sapiens
LEEDSEKEG

SEQ ID NO: 953777 - protein, 9 aa, Homo Sapiens
MFAMNCQGS

SEQ ID NO: 953778 - protein, 9 aa, Homo Sapiens
DEVPASDSK

SEQ ID NO: 953779 - protein, 9 aa, Homo Sapiens
TDFFWNPNA

SEQ ID NO: 953780 - protein, 9 aa, Homo Sapiens
LPPPGTEIP

SEQ ID NO: 953781 - protein, 9 aa, Homo Sapiens
ECDSVKQPR

SEQ ID NO: 953782 - protein, 9 aa, Homo Sapiens
LYFQNLEQK

SEQ ID NO: 953783 - protein, 9 aa, Homo Sapiens
AMSDKKCVE

SEQ ID NO: 953784 - protein, 9 aa, Homo Sapiens
GNSGLYWCE

SEQ ID NO: 953785 - protein, 9 aa, Homo Sapiens
EVWANPGEL

SEQ ID NO: 953786 - protein, 9 aa, Homo Sapiens
EAKKESDQA

SEQ ID NO: 953787 - protein, 9 aa, Homo Sapiens
CQHEAVSKD

SEQ ID NO: 953788 - protein, 9 aa, Homo Sapiens
AGDLFGHLL

SEQ ID NO: 953789 - protein, 9 aa, Homo Sapiens
GQKTLTFVG

SEQ ID NO: 953790 - protein, 9 aa, Homo Sapiens
CPVSTLLPL

SEQ ID NO: 953791 - protein, 9 aa, Homo Sapiens
YDGLLRLRE

SEQ ID NO: 953792 - protein, 9 aa, Homo Sapiens
PAEEKFTEA

SEQ ID NO: 953793 - protein, 9 aa, Homo Sapiens
RLGQSASFN

SEQ ID NO: 953794 - protein, 9 aa, Homo Sapiens
TGVSDCPVS

SEQ ID NO: 953795 - protein, 9 aa, Homo Sapiens
SRDVQARML

SEQ ID NO: 953796 - protein, 9 aa, Homo Sapiens
AETYGCIEK

SEQ ID NO: 953797 - protein, 9 aa, Homo Sapiens
SNKMKSWSD

SEQ ID NO: 953798 - protein, 9 aa, Homo Sapiens
KRKRTADKF

SEQ ID NO: 953799 - protein, 9 aa, Homo Sapiens
NSFLYLQLV

SEQ ID NO: 953800 - protein, 9 aa, Homo Sapiens
DQVWRYLRA

SEQ ID NO: 953801 - protein, 9 aa, Homo Sapiens
NKTRTVNLT

SEQ ID NO: 953802 - protein, 9 aa, Homo Sapiens
MNKKLPSFG

SEQ ID NO: 953803 - protein, 9 aa, Homo Sapiens
LLSAIVSIS

SEQ ID NO: 953804 - protein, 9 aa, Homo Sapiens
GPWAMVGMG

SEQ ID NO: 953805 - protein, 9 aa, Homo Sapiens
RLYHCLLCA

SEQ ID NO: 953806 - protein, 9 aa, Homo Sapiens
ESLGTEPTA

SEQ ID NO: 953807 - protein, 9 aa, Homo Sapiens
WLGLKTIMK

SEQ ID NO: 953808 - protein, 9 aa, Homo Sapiens
ENSLIIQFT

SEQ ID NO: 953809 - protein, 9 aa, Homo Sapiens
GFDLEYKTV

SEQ ID NO: 953810 - protein, 9 aa, Homo Sapiens
RESSRAFPS

SEQ ID NO: 953811 - protein, 9 aa, Homo Sapiens
SKKHKAPVI

SEQ ID NO: 953812 - protein, 9 aa, Homo Sapiens
SLSTVDTEE

SEQ ID NO: 953813 - protein, 9 aa, Homo Sapiens
AASSSSVPS

SEQ ID NO: 953814 - protein, 9 aa, Homo Sapiens
VFDGDDLIV

SEQ ID NO: 953815 - protein, 9 aa, Homo Sapiens
VLDHRYYAD

SEQ ID NO: 953816 - protein, 9 aa, Homo Sapiens
SFCVITPQQ

SEQ ID NO: 953817 - protein, 9 aa, Homo Sapiens
TITRIESFI

SEQ ID NO: 953818 - protein, 9 aa, Homo Sapiens
IWRLVFDYN

SEQ ID NO: 953819 - protein, 9 aa, Homo Sapiens
GAEAGAELR

SEQ ID NO: 953820 - protein, 9 aa, Homo Sapiens
LSSRPEEQK

SEQ ID NO: 953821 - protein, 9 aa, Homo Sapiens
NILLYDATR

SEQ ID NO: 953822 - protein, 9 aa, Homo Sapiens
GIWHLVFYN

SEQ ID NO: 953823 - protein, 9 aa, Homo Sapiens
EEKLVNESL

SEQ ID NO: 953824 - protein, 9 aa, Homo Sapiens
ISRHIKEFL

SEQ ID NO: 953825 - protein, 9 aa, Homo Sapiens
TDPVVSPLS

SEQ ID NO: 953826 - protein, 9 aa, Homo Sapiens
FTATPEDFS

SEQ ID NO: 953827 - protein, 9 aa, Homo Sapiens
LSQDDRNGL

SEQ ID NO: 953828 - protein, 9 aa, Homo Sapiens
KDPGHYGPE

SEQ ID NO: 953829 - protein, 9 aa, Homo Sapiens
HGSNSFLYL

SEQ ID NO: 953830 - protein, 9 aa, Homo Sapiens
EESLCGEVT

SEQ ID NO: 953831 - protein, 9 aa, Homo Sapiens
SLLMKPQHY

SEQ ID NO: 953832 - protein, 9 aa, Homo Sapiens
TDYRKEISK

SEQ ID NO: 953833 - protein, 9 aa, Homo Sapiens
PLVLRRTYN

SEQ ID NO: 953834 - protein, 9 aa, Homo Sapiens
SKDEINRPR

SEQ ID NO: 953835 - protein, 9 aa, Homo Sapiens
LSVKCEAGR

SEQ ID NO: 953836 - protein, 9 aa, Homo Sapiens
IVCQLRMNR

SEQ ID NO: 953837 - protein, 9 aa, Homo Sapiens
SVQELIPDF

SEQ ID NO: 953838 - protein, 9 aa, Homo Sapiens
MLQKFQEER

SEQ ID NO: 953839 - protein, 9 aa, Homo Sapiens
KFFLSDKFN

SEQ ID NO: 953840 - protein, 9 aa, Homo Sapiens
VQELIPDFF

SEQ ID NO: 953841 - protein, 9 aa, Homo Sapiens
QPSFAAAVQ

SEQ ID NO: 953842 - protein, 9 aa, Homo Sapiens
GRKRRSTNK

SEQ ID NO: 953843 - protein, 9 aa, Homo Sapiens
SFIDSQFED

SEQ ID NO: 953844 - protein, 9 aa, Homo Sapiens
STTSSLTEE

SEQ ID NO: 953845 - protein, 9 aa, Homo Sapiens
DPQWIGAWW

SEQ ID NO: 953846 - protein, 9 aa, Homo Sapiens
DPKDPGHYG

SEQ ID NO: 953847 - protein, 9 aa, Homo Sapiens
VLPSTCCSE

SEQ ID NO: 953848 - protein, 9 aa, Homo Sapiens
EDTDFFWNP

SEQ ID NO: 953849 - protein, 9 aa, Homo Sapiens
QTNVHMSSM

SEQ ID NO: 953850 - protein, 9 aa, Homo Sapiens
AKAGKGHRR

SEQ ID NO: 953851 - protein, 9 aa, Homo Sapiens
SQTQCPSAH

SEQ ID NO: 953852 - protein, 9 aa, Homo Sapiens
DSNPSNLGY

SEQ ID NO: 953853 - protein, 9 aa, Homo Sapiens
FNSVHLFFF

SEQ ID NO: 953854 - protein, 9 aa, Homo Sapiens
HWKGCFLSE

SEQ ID NO: 953855 - protein, 9 aa, Homo Sapiens
KYLVRYNNK

SEQ ID NO: 953856 - protein, 9 aa, Homo Sapiens
PTPGNLCYD

SEQ ID NO: 953857 - protein, 9 aa, Homo Sapiens
PQTGEIYYT

SEQ ID NO: 953858 - protein, 9 aa, Homo Sapiens
DSDPTPGNL

SEQ ID NO: 953859 - protein, 9 aa, Homo Sapiens
ITKYLVRYN

SEQ ID NO: 953860 - protein, 9 aa, Homo Sapiens
RCMIVHQGI

SEQ ID NO: 953861 - protein, 9 aa, Homo Sapiens
VPGDPQWIG

SEQ ID NO: 953862 - protein, 9 aa, Homo Sapiens
LRMNRGGMV

SEQ ID NO: 953863 - protein, 9 aa, Homo Sapiens
PVILQLQFF

SEQ ID NO: 953864 - protein, 9 aa, Homo Sapiens
AVELNGNIY

SEQ ID NO: 953865 - protein, 9 aa, Homo Sapiens
FLGKDWGPE

SEQ ID NO: 953866 - protein, 9 aa, Homo Sapiens
EELHFKVND

SEQ ID NO: 953867 - protein, 9 aa, Homo Sapiens
KAALRIYER

SEQ ID NO: 953868 - protein, 9 aa, Homo Sapiens
FDPNICDSR

SEQ ID NO: 953869 - protein, 9 aa, Homo Sapiens
ETKERIEQN

SEQ ID NO: 953870 - protein, 9 aa, Homo Sapiens
IYMDPHSCQ

SEQ ID NO: 953871 - protein, 9 aa, Homo Sapiens
ELREQNKNL

SEQ ID NO: 953872 - protein, 9 aa, Homo Sapiens
VDTEEVWAN

SEQ ID NO: 953873 - protein, 9 aa, Homo Sapiens
NPGYDEEAD

SEQ ID NO: 953874 - protein, 9 aa, Homo Sapiens
ESDTDKLLS

SEQ ID NO: 953875 - protein, 9 aa, Homo Sapiens
ASEPGIPGE

SEQ ID NO: 953876 - protein, 9 aa, Homo Sapiens
REAVRWPYF

SEQ ID NO: 953877 - protein, 9 aa, Homo Sapiens
QALNNDIPE

SEQ ID NO: 953878 - protein, 9 aa, Homo Sapiens
RTSLAYIHS

SEQ ID NO: 953879 - protein, 9 aa, Homo Sapiens
HQGIILDNV

SEQ ID NO: 953880 - protein, 9 aa, Homo Sapiens
TFRPQKDFC

SEQ ID NO: 953881 - protein, 9 aa, Homo Sapiens
GLTKQDIID

SEQ ID NO: 953882 - protein, 9 aa, Homo Sapiens
LVFYNDGKE

SEQ ID NO: 953883 - protein, 9 aa, Homo Sapiens
QCPSAHTAP

SEQ ID NO: 953884 - protein, 9 aa, Homo Sapiens
YIPLTLILN

SEQ ID NO: 953885 - protein, 9 aa, Homo Sapiens
NAEHALQNP

SEQ ID NO: 953886 - protein, 9 aa, Homo Sapiens
QTGEIYYTT

SEQ ID NO: 953887 - protein, 9 aa, Homo Sapiens
ATHYYYSEA

SEQ ID NO: 953888 - protein, 9 aa, Homo Sapiens
FQNLEQKIN

SEQ ID NO: 953889 - protein, 9 aa, Homo Sapiens
ELIPDFFVP

SEQ ID NO: 953890 - protein, 9 aa, Homo Sapiens
PPEEVSPPT

SEQ ID NO: 953891 - protein, 9 aa, Homo Sapiens
HHCLELAKK

SEQ ID NO: 953892 - protein, 9 aa, Homo Sapiens
LLRLREGGI

SEQ ID NO: 953893 - protein, 9 aa, Homo Sapiens
SQHINHRYS

SEQ ID NO: 953894 - protein, 9 aa, Homo Sapiens
EWKIPKNKT

SEQ ID NO: 953895 - protein, 9 aa, Homo Sapiens
YGDLEDTGE

SEQ ID NO: 953896 - protein, 9 aa, Homo Sapiens
SDSLVLPPR

SEQ ID NO: 953897 - protein, 9 aa, Homo Sapiens
PEPPEEVSP

SEQ ID NO: 953898 - protein, 9 aa, Homo Sapiens
KQEPQLCGM

SEQ ID NO: 953899 - protein, 9 aa, Homo Sapiens
LPSSHCTDL

SEQ ID NO: 953900 - protein, 9 aa, Homo Sapiens
DPHLYYQMG

SEQ ID NO: 953901 - protein, 9 aa, Homo Sapiens
NGLQQLYGK

SEQ ID NO: 953902 - protein, 9 aa, Homo Sapiens
QNVTLYIDD

SEQ ID NO: 953903 - protein, 9 aa, Homo Sapiens
IKEVPTTSH

SEQ ID NO: 953904 - protein, 9 aa, Homo Sapiens
ILNLYYRIY

SEQ ID NO: 953905 - protein, 9 aa, Homo Sapiens
QNKNLQTRV

SEQ ID NO: 953906 - protein, 9 aa, Homo Sapiens
FFDGHHYIS

SEQ ID NO: 953907 - protein, 9 aa, Homo Sapiens
LLVTEQNVT

SEQ ID NO: 953908 - protein, 9 aa, Homo Sapiens
HFKVNDLKE

SEQ ID NO: 953909 - protein, 9 aa, Homo Sapiens
GSMEKGMLP

SEQ ID NO: 953910 - protein, 9 aa, Homo Sapiens
DVQVTARLL

SEQ ID NO: 953911 - protein, 9 aa, Homo Sapiens
DRNGLQQLY

SEQ ID NO: 953912 - protein, 9 aa, Homo Sapiens
RVKEKKATF

SEQ ID NO: 953913 - protein, 9 aa, Homo Sapiens
ICSWHDIEK

SEQ ID NO: 953914 - protein, 9 aa, Homo Sapiens
TPPSWSCQK

SEQ ID NO: 953915 - protein, 9 aa, Homo Sapiens
SVLLDKILT

SEQ ID NO: 953916 - protein, 9 aa, Homo Sapiens
SSVPSHPSV

SEQ ID NO: 953917 - protein, 9 aa, Homo Sapiens
KATFKEAEK

SEQ ID NO: 953918 - protein, 9 aa, Homo Sapiens
PLKSHFTLN

SEQ ID NO: 953919 - protein, 9 aa, Homo Sapiens
KEEKLVNES

SEQ ID NO: 953920 - protein, 9 aa, Homo Sapiens
RRQIAKWHM

SEQ ID NO: 953921 - protein, 9 aa, Homo Sapiens
KNILLYDAT

SEQ ID NO: 953922 - protein, 9 aa, Homo Sapiens
LKKELGLTK

SEQ ID NO: 953923 - protein, 9 aa, Homo Sapiens
PRLGQSASF

SEQ ID NO: 953924 - protein, 9 aa, Homo Sapiens
AAGFDLEYK

SEQ ID NO: 953925 - protein, 9 aa, Homo Sapiens
YYQMGLLLK

SEQ ID NO: 953926 - protein, 9 aa, Homo Sapiens
SPRTYQDFF

SEQ ID NO: 953927 - protein, 9 aa, Homo Sapiens
KLISRNTVV

SEQ ID NO: 953928 - protein, 9 aa, Homo Sapiens
ELRLYHCLL

SEQ ID NO: 953929 - protein, 9 aa, Homo Sapiens
MLEKGEQMG

SEQ ID NO: 953930 - protein, 9 aa, Homo Sapiens
MEKGMLPYD

SEQ ID NO: 953931 - protein, 9 aa, Homo Sapiens
SSNTSLAFF

SEQ ID NO: 953932 - protein, 9 aa, Homo Sapiens
PWAMVGMGE

SEQ ID NO: 953933 - protein, 9 aa, Homo Sapiens
LAVAVFFES

SEQ ID NO: 953934 - protein, 9 aa, Homo Sapiens
DFFDGHHYI

SEQ ID NO: 953935 - protein, 9 aa, Homo Sapiens
CPATRIPED

SEQ ID NO: 953936 - protein, 9 aa, Homo Sapiens
KIPICSWHD

SEQ ID NO: 953937 - protein, 9 aa, Homo Sapiens
IPSSCLEQP

SEQ ID NO: 953938 - protein, 9 aa, Homo Sapiens
PAAEALDSF

SEQ ID NO: 953939 - protein, 9 aa, Homo Sapiens
SGFDPNICD

SEQ ID NO: 953940 - protein, 9 aa, Homo Sapiens
STDYRKEIS

SEQ ID NO: 953941 - protein, 9 aa, Homo Sapiens
NYSPRDEKE

SEQ ID NO: 953942 - protein, 9 aa, Homo Sapiens
SKSHLCLVM

SEQ ID NO: 953943 - protein, 9 aa, Homo Sapiens
THEKYSWVT

SEQ ID NO: 953944 - protein, 9 aa, Homo Sapiens
DGPFPCSEC

SEQ ID NO: 953945 - protein, 9 aa, Homo Sapiens
AGAELRLYH

SEQ ID NO: 953946 - protein, 9 aa, Homo Sapiens
NGVLKDVWV

SEQ ID NO: 953947 - protein, 9 aa, Homo Sapiens
WALVVLWCL

SEQ ID NO: 953948 - protein, 9 aa, Homo Sapiens
LFEPDTIDE

SEQ ID NO: 953949 - protein, 9 aa, Homo Sapiens
GIILDNVKN

SEQ ID NO: 953950 - protein, 9 aa, Homo Sapiens
SSVEPESRT

SEQ ID NO: 953951 - protein, 9 aa, Homo Sapiens
REGKNALIR

SEQ ID NO: 953952 - protein, 9 aa, Homo Sapiens
SVYMEMEKG

SEQ ID NO: 953953 - protein, 9 aa, Homo Sapiens
ELLCCTNFS

SEQ ID NO: 953954 - protein, 9 aa, Homo Sapiens
SSLTEESTA

SEQ ID NO: 953955 - protein, 9 aa, Homo Sapiens
LEIPIPSTG

SEQ ID NO: 953956 - protein, 9 aa, Homo Sapiens
YHEPPEDAK

SEQ ID NO: 953957 - protein, 9 aa, Homo Sapiens
RTYQDFFEA

SEQ ID NO: 953958 - protein, 9 aa, Homo Sapiens
PSFREASVD

SEQ ID NO: 953959 - protein, 9 aa, Homo Sapiens
FTEDSTTSS

SEQ ID NO: 953960 - protein, 9 aa, Homo Sapiens
ILLYDATRV

SEQ ID NO: 953961 - protein, 9 aa, Homo Sapiens
TDIICFNYL

SEQ ID NO: 953962 - protein, 9 aa, Homo Sapiens
RLRAPPAAS

SEQ ID NO: 953963 - protein, 9 aa, Homo Sapiens
LRKWQYNVW

SEQ ID NO: 953964 - protein, 9 aa, Homo Sapiens
SHFTLNSRN

SEQ ID NO: 953965 - protein, 9 aa, Homo Sapiens
EDSNPSNLG

SEQ ID NO: 953966 - protein, 9 aa, Homo Sapiens
LSTVDTEEV

SEQ ID NO: 953967 - protein, 9 aa, Homo Sapiens
DSTLGNTKE

SEQ ID NO: 953968 - protein, 9 aa, Homo Sapiens
STINTLIAA

SEQ ID NO: 953969 - protein, 9 aa, Homo Sapiens
RPEEQKPLF

SEQ ID NO: 953970 - protein, 9 aa, Homo Sapiens
LTATFRPQK

SEQ ID NO: 953971 - protein, 9 aa, Homo Sapiens
GWLMALSSI

SEQ ID NO: 953972 - protein, 9 aa, Homo Sapiens
EMASSNSVY

SEQ ID NO: 953973 - protein, 9 aa, Homo Sapiens
NEICSVNCG

SEQ ID NO: 953974 - protein, 9 aa, Homo Sapiens
VDTYIESHF

SEQ ID NO: 953975 - protein, 9 aa, Homo Sapiens
GKSRTYPSF

SEQ ID NO: 953976 - protein, 9 aa, Homo Sapiens
TEVEHFFLL

SEQ ID NO: 953977 - protein, 9 aa, Homo Sapiens
ESKSHLCLV

SEQ ID NO: 953978 - protein, 9 aa, Homo Sapiens
TPEDFSKKH

SEQ ID NO: 953979 - protein, 9 aa, Homo Sapiens
SSLPGSSVA

SEQ ID NO: 953980 - protein, 9 aa, Homo Sapiens
NSGVGASLT

SEQ ID NO: 953981 - protein, 9 aa, Homo Sapiens
SLAFFCNKV

SEQ ID NO: 953982 - protein, 9 aa, Homo Sapiens
TNFSTKEGI

SEQ ID NO: 953983 - protein, 9 aa, Homo Sapiens
TEDSTTSSL

SEQ ID NO: 953984 - protein, 9 aa, Homo Sapiens
TKFILIGLT

SEQ ID NO: 953985 - protein, 9 aa, Homo Sapiens
EDSEKEGDL

SEQ ID NO: 953986 - protein, 9 aa, Homo Sapiens
CIATNALRK

SEQ ID NO: 953987 - protein, 9 aa, Homo Sapiens
QYFPLPAEE

SEQ ID NO: 953988 - protein, 9 aa, Homo Sapiens
SIPSSCLEQ

SEQ ID NO: 953989 - protein, 9 aa, Homo Sapiens
LRIYERIHC

SEQ ID NO: 953990 - protein, 9 aa, Homo Sapiens
QSFTPQCFL

SEQ ID NO: 953991 - protein, 9 aa, Homo Sapiens
FRPQKDFCF

SEQ ID NO: 953992 - protein, 9 aa, Homo Sapiens
YYSEAFKGQ

SEQ ID NO: 953993 - protein, 9 aa, Homo Sapiens
QVREFPDLF

SEQ ID NO: 953994 - protein, 9 aa, Homo Sapiens
VSSTEAEAL

SEQ ID NO: 953995 - protein, 9 aa, Homo Sapiens
EEKFTEAIV

SEQ ID NO: 953996 - protein, 9 aa, Homo Sapiens
LLDKILTKE

SEQ ID NO: 953997 - protein, 9 aa, Homo Sapiens
EIPPPPLLP

SEQ ID NO: 953998 - protein, 9 aa, Homo Sapiens
STDKDVIKV

SEQ ID NO: 953999 - protein, 9 aa, Homo Sapiens
EEESLCGEV

SEQ ID NO: 954000 - protein, 9 aa, Homo Sapiens
ITISREAQD

SEQ ID NO: 954001 - protein, 9 aa, Homo Sapiens
SYLSFYFST

SEQ ID NO: 954002 - protein, 9 aa, Homo Sapiens
EKKKNVTKF

SEQ ID NO: 954003 - protein, 9 aa, Homo Sapiens
STLGNTKET

SEQ ID NO: 954004 - protein, 9 aa, Homo Sapiens
SEPGIPGET

SEQ ID NO: 954005 - protein, 9 aa, Homo Sapiens
RRNSGVGAS

SEQ ID NO: 954006 - protein, 9 aa, Homo Sapiens
LLQLDQVWR

SEQ ID NO: 954007 - protein, 9 aa, Homo Sapiens
SFSQTNVHM

SEQ ID NO: 954008 - protein, 9 aa, Homo Sapiens
DIWRLVFDY

SEQ ID NO: 954009 - protein, 9 aa, Homo Sapiens
TRNLTTYRK

SEQ ID NO: 954010 - protein, 9 aa, Homo Sapiens
IEQNYWQVP

SEQ ID NO: 954011 - protein, 9 aa, Homo Sapiens
QQSFTPQCF

SEQ ID NO: 954012 - protein, 9 aa, Homo Sapiens
SLRNREGKN

SEQ ID NO: 954013 - protein, 9 aa, Homo Sapiens
ISRNTVVPT

SEQ ID NO: 954014 - protein, 9 aa, Homo Sapiens
NLTTYRKEL

SEQ ID NO: 954015 - protein, 9 aa, Homo Sapiens
PMESSLEEP

SEQ ID NO: 954016 - protein, 9 aa, Homo Sapiens
GKTSASQAA

SEQ ID NO: 954017 - protein, 9 aa, Homo Sapiens
HCLELAKKA

SEQ ID NO: 954018 - protein, 9 aa, Homo Sapiens
RERRNSGVG

SEQ ID NO: 954019 - protein, 9 aa, Homo Sapiens
SFYFSTGQN

SEQ ID NO: 954020 - protein, 9 aa, Homo Sapiens
MPLGAGTLV

SEQ ID NO: 954021 - protein, 9 aa, Homo Sapiens
KKEPIQPLV

SEQ ID NO: 954022 - protein, 9 aa, Homo Sapiens
GGLERLCRN

SEQ ID NO: 954023 - protein, 9 aa, Homo Sapiens
VCEWGLRST

SEQ ID NO: 954024 - protein, 9 aa, Homo Sapiens
QAKKEQSHT

SEQ ID NO: 954025 - protein, 9 aa, Homo Sapiens
ESSDLNDVS

SEQ ID NO: 954026 - protein, 9 aa, Homo Sapiens
GAPPRKAPP

SEQ ID NO: 954027 - protein, 9 aa, Homo Sapiens
LLCKMINLF

SEQ ID NO: 954028 - protein, 9 aa, Homo Sapiens
KKEQSHTQA

SEQ ID NO: 954029 - protein, 9 aa, Homo Sapiens
PQIRQVKAQ

SEQ ID NO: 954030 - protein, 9 aa, Homo Sapiens
EDPPKAESL

SEQ ID NO: 954031 - protein, 9 aa, Homo Sapiens
QEERVKGCD

SEQ ID NO: 954032 - protein, 9 aa, Homo Sapiens
NFGQKNGRT

SEQ ID NO: 954033 - protein, 9 aa, Homo Sapiens
TPTGEKPYE

SEQ ID NO: 954034 - protein, 9 aa, Homo Sapiens
ISLPHGTHA

SEQ ID NO: 954035 - protein, 9 aa, Homo Sapiens
RIKVLKRKV

SEQ ID NO: 954036 - protein, 9 aa, Homo Sapiens
DEIENLHYS

SEQ ID NO: 954037 - protein, 9 aa, Homo Sapiens
VEHFFLLTS

SEQ ID NO: 954038 - protein, 9 aa, Homo Sapiens
GSPEDTDFF

SEQ ID NO: 954039 - protein, 9 aa, Homo Sapiens
DLPPPSQPA

SEQ ID NO: 954040 - protein, 9 aa, Homo Sapiens
TKLISRNTV

SEQ ID NO: 954041 - protein, 9 aa, Homo Sapiens
DLIVQGLGE

SEQ ID NO: 954042 - protein, 9 aa, Homo Sapiens
SPEAKKESD

SEQ ID NO: 954043 - protein, 9 aa, Homo Sapiens
LKIPICSWH

SEQ ID NO: 954044 - protein, 9 aa, Homo Sapiens
IQPLVLRRT

SEQ ID NO: 954045 - protein, 9 aa, Homo Sapiens
LIAATLPIT

SEQ ID NO: 954046 - protein, 9 aa, Homo Sapiens
VRWPYFCLR

SEQ ID NO: 954047 - protein, 9 aa, Homo Sapiens
HYSLVIWLV

SEQ ID NO: 954048 - protein, 9 aa, Homo Sapiens
LAFFCNKVK

SEQ ID NO: 954049 - protein, 9 aa, Homo Sapiens
LKMFNYFKS

SEQ ID NO: 954050 - protein, 9 aa, Homo Sapiens
EYPAGDLFG

SEQ ID NO: 954051 - protein, 9 aa, Homo Sapiens
GNAGVGKSC

SEQ ID NO: 954052 - protein, 9 aa, Homo Sapiens
LQDGEDLFT

SEQ ID NO: 954053 - protein, 9 aa, Homo Sapiens
ASSNSVYME

SEQ ID NO: 954054 - protein, 9 aa, Homo Sapiens
PPPGTEIPP

SEQ ID NO: 954055 - protein, 9 aa, Homo Sapiens
EPLGNAPED

SEQ ID NO: 954056 - protein, 9 aa, Homo Sapiens
YSLVIWLVT

SEQ ID NO: 954057 - protein, 9 aa, Homo Sapiens
SNENPGYDE

SEQ ID NO: 954058 - protein, 9 aa, Homo Sapiens
FHLESFHDY

SEQ ID NO: 954059 - protein, 9 aa, Homo Sapiens
ALNNDIPEE

SEQ ID NO: 954060 - protein, 9 aa, Homo Sapiens
TIIKTPVQM

SEQ ID NO: 954061 - protein, 9 aa, Homo Sapiens
REGGIFSNL

SEQ ID NO: 954062 - protein, 9 aa, Homo Sapiens
APAACASEP

SEQ ID NO: 954063 - protein, 9 aa, Homo Sapiens
RLCRNMQSI

SEQ ID NO: 954064 - protein, 9 aa, Homo Sapiens
RNGLQQLYG

SEQ ID NO: 954065 - protein, 9 aa, Homo Sapiens
PATRIPEDM

SEQ ID NO: 954066 - protein, 9 aa, Homo Sapiens
AEEKFTEAI

SEQ ID NO: 954067 - protein, 9 aa, Homo Sapiens
TDYRFVLKH

SEQ ID NO: 954068 - protein, 9 aa, Homo Sapiens
ESIAETYGC

SEQ ID NO: 954069 - protein, 9 aa, Homo Sapiens
KSELEQAKK

SEQ ID NO: 954070 - protein, 9 aa, Homo Sapiens
NLWLLFFLR

SEQ ID NO: 954071 - protein, 9 aa, Homo Sapiens
EPPEDAKAS

SEQ ID NO: 954072 - protein, 9 aa, Homo Sapiens
DEIKEVPTT

SEQ ID NO: 954073 - protein, 9 aa, Homo Sapiens
LRRQSSLPG

SEQ ID NO: 954074 - protein, 9 aa, Homo Sapiens
LNNDIPEEK

SEQ ID NO: 954075 - protein, 9 aa, Homo Sapiens
KKDVFGLRL

SEQ ID NO: 954076 - protein, 9 aa, Homo Sapiens
ELSVKCEAG

SEQ ID NO: 954077 - protein, 9 aa, Homo Sapiens
ADIWRLVFD

SEQ ID NO: 954078 - protein, 9 aa, Homo Sapiens
SATSVLLDK

SEQ ID NO: 954079 - protein, 9 aa, Homo Sapiens
SHCTDLYFT

SEQ ID NO: 954080 - protein, 9 aa, Homo Sapiens
GSENGVLKD

SEQ ID NO: 954081 - protein, 9 aa, Homo Sapiens
LEQKINAEP

SEQ ID NO: 954082 - protein, 9 aa, Homo Sapiens
DLESSLHMS

SEQ ID NO: 954083 - protein, 9 aa, Homo Sapiens
MEKKKNVTK

SEQ ID NO: 954084 - protein, 9 aa, Homo Sapiens
DKILDVPYI

SEQ ID NO: 954085 - protein, 9 aa, Homo Sapiens
DSPRKTPNI

SEQ ID NO: 954086 - protein, 9 aa, Homo Sapiens
LLGQSPCRS

SEQ ID NO: 954087 - protein, 9 aa, Homo Sapiens
RKTPNIESG

SEQ ID NO: 954088 - protein, 9 aa, Homo Sapiens
VEYQIIDGD

SEQ ID NO: 954089 - protein, 9 aa, Homo Sapiens
NCGSHGVCM

SEQ ID NO: 954090 - protein, 9 aa, Homo Sapiens
ASRDVQARM

SEQ ID NO: 954091 - protein, 9 aa, Homo Sapiens
NTSEEEESL

SEQ ID NO: 954092 - protein, 9 aa, Homo Sapiens
VSKDEINRP

SEQ ID NO: 954093 - protein, 9 aa, Homo Sapiens
SVSAAGFDL

SEQ ID NO: 954094 - protein, 9 aa, Homo Sapiens
YTTFDWPPE

SEQ ID NO: 954095 - protein, 9 aa, Homo Sapiens
LSIKYMARL

SEQ ID NO: 954096 - protein, 9 aa, Homo Sapiens
IENLHYSPS

SEQ ID NO: 954097 - protein, 9 aa, Homo Sapiens
KYKAPTDYR

SEQ ID NO: 954098 - protein, 9 aa, Homo Sapiens
SVFDGDDLI

SEQ ID NO: 954099 - protein, 9 aa, Homo Sapiens
SASRDVQAR

SEQ ID NO: 954100 - protein, 9 aa, Homo Sapiens
LDHLYEKPR

SEQ ID NO: 954101 - protein, 9 aa, Homo Sapiens
GDDLIVQGL

SEQ ID NO: 954102 - protein, 9 aa, Homo Sapiens
PRIAELMNK

SEQ ID NO: 954103 - protein, 9 aa, Homo Sapiens
QGIILDNVK

SEQ ID NO: 954104 - protein, 9 aa, Homo Sapiens
SDDEIENLH

SEQ ID NO: 954105 - protein, 9 aa, Homo Sapiens
LFRGAVAIV

SEQ ID NO: 954106 - protein, 9 aa, Homo Sapiens
PPDLPPPSQ

SEQ ID NO: 954107 - protein, 9 aa, Homo Sapiens
VCGSTFKEI

SEQ ID NO: 954108 - protein, 9 aa, Homo Sapiens
LFFFMVLAL

SEQ ID NO: 954109 - protein, 9 aa, Homo Sapiens
CTDLYFTPI

SEQ ID NO: 954110 - protein, 9 aa, Homo Sapiens
ARKRWALVV

SEQ ID NO: 954111 - protein, 9 aa, Homo Sapiens
VVCEWGLRS

SEQ ID NO: 954112 - protein, 9 aa, Homo Sapiens
IWLVTFTDI

SEQ ID NO: 954113 - protein, 9 aa, Homo Sapiens
HTFHLESFH

SEQ ID NO: 954114 - protein, 9 aa, Homo Sapiens
GFFLRTLYA

SEQ ID NO: 954115 - protein, 9 aa, Homo Sapiens
GGVMTKLIS

SEQ ID NO: 954116 - protein, 9 aa, Homo Sapiens
ESFIQSLQD

SEQ ID NO: 954117 - protein, 9 aa, Homo Sapiens
QSESSDLND

SEQ ID NO: 954118 - protein, 9 aa, Homo Sapiens
ALRRVTLAK

SEQ ID NO: 954119 - protein, 9 aa, Homo Sapiens
TEIPPPPLL

SEQ ID NO: 954120 - protein, 9 aa, Homo Sapiens
DAATGVSDC

SEQ ID NO: 954121 - protein, 9 aa, Homo Sapiens
DKDVIKVSE

SEQ ID NO: 954122 - protein, 9 aa, Homo Sapiens
LVNVQRRED

SEQ ID NO: 954123 - protein, 9 aa, Homo Sapiens
QMGCPAGCP

SEQ ID NO: 954124 - protein, 9 aa, Homo Sapiens
EESDTDKLL

SEQ ID NO: 954125 - protein, 9 aa, Homo Sapiens
STNKTDASN

SEQ ID NO: 954126 - protein, 9 aa, Homo Sapiens
NDVSTPSGS

SEQ ID NO: 954127 - protein, 9 aa, Homo Sapiens
AQDEVPASD

SEQ ID NO: 954128 - protein, 9 aa, Homo Sapiens
SCLVRRFTQ

SEQ ID NO: 954129 - protein, 9 aa, Homo Sapiens
GQGLQRTSL

SEQ ID NO: 954130 - protein, 9 aa, Homo Sapiens
HMSSMVIKS

SEQ ID NO: 954131 - protein, 9 aa, Homo Sapiens
GAPNGPWAM

SEQ ID NO: 954132 - protein, 9 aa, Homo Sapiens
EEDSEKEGD

SEQ ID NO: 954133 - protein, 9 aa, Homo Sapiens
SSSGSNSRL

SEQ ID NO: 954134 - protein, 9 aa, Homo Sapiens
PQGFFVVMP

SEQ ID NO: 954135 - protein, 9 aa, Homo Sapiens
LVPGDPQWI

SEQ ID NO: 954136 - protein, 9 aa, Homo Sapiens
YKLARHAYD

SEQ ID NO: 954137 - protein, 9 aa, Homo Sapiens
VEIDPQIRQ

SEQ ID NO: 954138 - protein, 9 aa, Homo Sapiens
AMYPPLMIA

SEQ ID NO: 954139 - protein, 9 aa, Homo Sapiens
IIFINAFED

SEQ ID NO: 954140 - protein, 9 aa, Homo Sapiens
MKIDVNKEE

SEQ ID NO: 954141 - protein, 9 aa, Homo Sapiens
QYEGVTKTV

SEQ ID NO: 954142 - protein, 9 aa, Homo Sapiens
FFFDVLQKT

SEQ ID NO: 954143 - protein, 9 aa, Homo Sapiens
RNREGKNAL

SEQ ID NO: 954144 - protein, 9 aa, Homo Sapiens
EQAPSSASR

SEQ ID NO: 954145 - protein, 9 aa, Homo Sapiens
EKLVNESLC

SEQ ID NO: 954146 - protein, 9 aa, Homo Sapiens
VHLLQLDQV

SEQ ID NO: 954147 - protein, 9 aa, Homo Sapiens
NLEQKINAE

SEQ ID NO: 954148 - protein, 9 aa, Homo Sapiens
IKCKCHGVS

SEQ ID NO: 954149 - protein, 9 aa, Homo Sapiens
AGALASRST

SEQ ID NO: 954150 - protein, 9 aa, Homo Sapiens
SNPSNLGYE

SEQ ID NO: 954151 - protein, 9 aa, Homo Sapiens
FDLAKKKNP

SEQ ID NO: 954152 - protein, 9 aa, Homo Sapiens
SDLNDVSTP

SEQ ID NO: 954153 - protein, 9 aa, Homo Sapiens
EETCGLQSI

SEQ ID NO: 954154 - protein, 9 aa, Homo Sapiens
MKPQHYSPK

SEQ ID NO: 954155 - protein, 9 aa, Homo Sapiens
CYWFSNKMK

SEQ ID NO: 954156 - protein, 9 aa, Homo Sapiens
QDDRNGLQQ

SEQ ID NO: 954157 - protein, 9 aa, Homo Sapiens
LGTEPTANS

SEQ ID NO: 954158 - protein, 9 aa, Homo Sapiens
SMEKGMLPY

SEQ ID NO: 954159 - protein, 9 aa, Homo Sapiens
RVKGCDKHI

SEQ ID NO: 954160 - protein, 9 aa, Homo Sapiens
VREFPDLFS

SEQ ID NO: 954161 - protein, 9 aa, Homo Sapiens
KEVPTTSHR

SEQ ID NO: 954162 - protein, 9 aa, Homo Sapiens
VVKARPMES

SEQ ID NO: 954163 - protein, 9 aa, Homo Sapiens
SAAGFDLEY

SEQ ID NO: 954164 - protein, 9 aa, Homo Sapiens
NQVREFPDL

SEQ ID NO: 954165 - protein, 9 aa, Homo Sapiens
DFFWNPNAF

SEQ ID NO: 954166 - protein, 9 aa, Homo Sapiens
KILDVPYIK

SEQ ID NO: 954167 - protein, 9 aa, Homo Sapiens
NLVPGDPQW

SEQ ID NO: 954168 - protein, 9 aa, Homo Sapiens
PAFDISFVL

SEQ ID NO: 954169 - protein, 9 aa, Homo Sapiens
FFDVLQKTL

SEQ ID NO: 954170 - protein, 9 aa, Homo Sapiens
QFVSNQVRE

SEQ ID NO: 954171 - protein, 9 aa, Homo Sapiens
LSSIVLIPG

SEQ ID NO: 954172 - protein, 9 aa, Homo Sapiens
IATNALRKA

SEQ ID NO: 954173 - protein, 9 aa, Homo Sapiens
ATPEDFSKK

SEQ ID NO: 954174 - protein, 9 aa, Homo Sapiens
LKSHFTLNS

SEQ ID NO: 954175 - protein, 9 aa, Homo Sapiens
SKRVFLFGA

SEQ ID NO: 954176 - protein, 9 aa, Homo Sapiens
YKNILLYDA

SEQ ID NO: 954177 - protein, 9 aa, Homo Sapiens
RQVKAQERE

SEQ ID NO: 954178 - protein, 9 aa, Homo Sapiens
SSSISQFPI

SEQ ID NO: 954179 - protein, 9 aa, Homo Sapiens
DTQQDQLKN

SEQ ID NO: 954180 - protein, 9 aa, Homo Sapiens
GLQSISSDY

SEQ ID NO: 954181 - protein, 9 aa, Homo Sapiens
REQNKNLQT

SEQ ID NO: 954182 - protein, 9 aa, Homo Sapiens
ALRLEELHF

SEQ ID NO: 954183 - protein, 9 aa, Homo Sapiens
TAGKEEYSA

SEQ ID NO: 954184 - protein, 9 aa, Homo Sapiens
IDPQIRQVK

SEQ ID NO: 954185 - protein, 9 aa, Homo Sapiens
KSRTYPSFR

SEQ ID NO: 954186 - protein, 9 aa, Homo Sapiens
LAIFWFRDW

SEQ ID NO: 954187 - protein, 9 aa, Homo Sapiens
FHTFHLESF

SEQ ID NO: 954188 - protein, 9 aa, Homo Sapiens
LTTYRKELV

SEQ ID NO: 954189 - protein, 9 aa, Homo Sapiens
TDLYFTPIP

SEQ ID NO: 954190 - protein, 9 aa, Homo Sapiens
LTLILNLYY

SEQ ID NO: 954191 - protein, 9 aa, Homo Sapiens
SSRAFPSPL

SEQ ID NO: 954192 - protein, 9 aa, Homo Sapiens
TYVRSIPEG

SEQ ID NO: 954193 - protein, 9 aa, Homo Sapiens
KVLKRKVIE

SEQ ID NO: 954194 - protein, 9 aa, Homo Sapiens
LDSADNQPA

SEQ ID NO: 954195 - protein, 9 aa, Homo Sapiens
ASFNPPTQK

SEQ ID NO: 954196 - protein, 9 aa, Homo Sapiens
GVQALLLKG

SEQ ID NO: 954197 - protein, 9 aa, Homo Sapiens
VAMEPQGFF

SEQ ID NO: 954198 - protein, 9 aa, Homo Sapiens
GAKEGNSGL

SEQ ID NO: 954199 - protein, 9 aa, Homo Sapiens
HHFKPVVDT

SEQ ID NO: 954200 - protein, 9 aa, Homo Sapiens
SSSMLQKFQ

SEQ ID NO: 954201 - protein, 9 aa, Homo Sapiens
QPISKKKKE

SEQ ID NO: 954202 - protein, 9 aa, Homo Sapiens
LASRSTHSA

SEQ ID NO: 954203 - protein, 9 aa, Homo Sapiens
KAKCSYPYH

SEQ ID NO: 954204 - protein, 9 aa, Homo Sapiens
HLECSQTQC

SEQ ID NO: 954205 - protein, 9 aa, Homo Sapiens
NRYKNILLY

SEQ ID NO: 954206 - protein, 9 aa, Homo Sapiens
EIYLPSKRV

SEQ ID NO: 954207 - protein, 9 aa, Homo Sapiens
IKYMARLFR

SEQ ID NO: 954208 - protein, 9 aa, Homo Sapiens
IANRNNQSP

SEQ ID NO: 954209 - protein, 9 aa, Homo Sapiens
RPRSRSPEC

SEQ ID NO: 954210 - protein, 9 aa, Homo Sapiens
DLNDVSTPS

SEQ ID NO: 954211 - protein, 9 aa, Homo Sapiens
SKIPFRSRF

SEQ ID NO: 954212 - protein, 9 aa, Homo Sapiens
SDPTPGNLC

SEQ ID NO: 954213 - protein, 9 aa, Homo Sapiens
VVDTYIESH

SEQ ID NO: 954214 - protein, 9 aa, Homo Sapiens
IKTPVQMYP

SEQ ID NO: 954215 - protein, 9 aa, Homo Sapiens
EIIFNLADT

SEQ ID NO: 954216 - protein, 9 aa, Homo Sapiens
VRKMAGDMS

SEQ ID NO: 954217 - protein, 9 aa, Homo Sapiens
SNSFLYLQL

SEQ ID NO: 954218 - protein, 9 aa, Homo Sapiens
TLVHLLQLD

SEQ ID NO: 954219 - protein, 9 aa, Homo Sapiens
CDIDEIKEV

SEQ ID NO: 954220 - protein, 9 aa, Homo Sapiens
AIQKIINTK

SEQ ID NO: 954221 - protein, 9 aa, Homo Sapiens
NAVYFKRKW

SEQ ID NO: 954222 - protein, 9 aa, Homo Sapiens
LAIEVQADQ

SEQ ID NO: 954223 - protein, 9 aa, Homo Sapiens
NREGKNALI

SEQ ID NO: 954224 - protein, 9 aa, Homo Sapiens
SGPWQKAKC

SEQ ID NO: 954225 - protein, 9 aa, Homo Sapiens
LRAPPAASR

SEQ ID NO: 954226 - protein, 9 aa, Homo Sapiens
GEIYYTTFD

SEQ ID NO: 954227 - protein, 9 aa, Homo Sapiens
GLPSLEDAM

SEQ ID NO: 954228 - protein, 9 aa, Homo Sapiens
LYEKPRKSS

SEQ ID NO: 954229 - protein, 9 aa, Homo Sapiens
RNMQSILYH

SEQ ID NO: 954230 - protein, 9 aa, Homo Sapiens
ALRIYERIH

SEQ ID NO: 954231 - protein, 9 aa, Homo Sapiens
LGLRMEEII

SEQ ID NO: 954232 - protein, 9 aa, Homo Sapiens
SSSSISQFP

SEQ ID NO: 954233 - protein, 9 aa, Homo Sapiens
DAIQKIINT

SEQ ID NO: 954234 - protein, 9 aa, Homo Sapiens
ELMNKKLPS

SEQ ID NO: 954235 - protein, 9 aa, Homo Sapiens
SIVCQLRMN

SEQ ID NO: 954236 - protein, 9 aa, Homo Sapiens
QKFQEERQD

SEQ ID NO: 954237 - protein, 9 aa, Homo Sapiens
KDAIQKIIN

SEQ ID NO: 954238 - protein, 9 aa, Homo Sapiens
CEWGLRSTP

SEQ ID NO: 954239 - protein, 9 aa, Homo Sapiens
SNQVREFPD

SEQ ID NO: 954240 - protein, 9 aa, Homo Sapiens
YADGCSPHY

SEQ ID NO: 954241 - protein, 9 aa, Homo Sapiens
PHGAPPRKA

SEQ ID NO: 954242 - protein, 9 aa, Homo Sapiens
RIPEDMLTH

SEQ ID NO: 954243 - protein, 9 aa, Homo Sapiens
NALRKAVAT

SEQ ID NO: 954244 - protein, 9 aa, Homo Sapiens
SNVVCEWGL

SEQ ID NO: 954245 - protein, 9 aa, Homo Sapiens
LIHWKGCFL

SEQ ID NO: 954246 - protein, 9 aa, Homo Sapiens
LRKAVATSV

SEQ ID NO: 954247 - protein, 9 aa, Homo Sapiens
TNALRKAVA

SEQ ID NO: 954248 - protein, 9 aa, Homo Sapiens
VSAAGFDLE

SEQ ID NO: 954249 - protein, 9 aa, Homo Sapiens
DTEEVWANP

SEQ ID NO: 954250 - protein, 9 aa, Homo Sapiens
IRQVKAQER

SEQ ID NO: 954251 - protein, 9 aa, Homo Sapiens
QLLTRNLTT

SEQ ID NO: 954252 - protein, 9 aa, Homo Sapiens
IESFIQSLQ

SEQ ID NO: 954253 - protein, 9 aa, Homo Sapiens
SVHLFFFMV

SEQ ID NO: 954254 - protein, 9 aa, Homo Sapiens
ILQLQFFFD

SEQ ID NO: 954255 - protein, 9 aa, Homo Sapiens
TPGNLCYDG

SEQ ID NO: 954256 - protein, 9 aa, Homo Sapiens
SRNTVVPTK

SEQ ID NO: 954257 - protein, 9 aa, Homo Sapiens
KSLLMKPQH

SEQ ID NO: 954258 - protein, 9 aa, Homo Sapiens
NRNNQSPVD

SEQ ID NO: 954259 - protein, 9 aa, Homo Sapiens
IPWRNEMIE

SEQ ID NO: 954260 - protein, 9 aa, Homo Sapiens
EVDCITGKD

SEQ ID NO: 954261 - protein, 9 aa, Homo Sapiens
PLPSDSLVL

SEQ ID NO: 954262 - protein, 9 aa, Homo Sapiens
TINTLIAAT

SEQ ID NO: 954263 - protein, 9 aa, Homo Sapiens
RLLVTEQNV

SEQ ID NO: 954264 - protein, 9 aa, Homo Sapiens
FFVVMPDAV

SEQ ID NO: 954265 - protein, 9 aa, Homo Sapiens
KDVKDAIQK

SEQ ID NO: 954266 - protein, 9 aa, Homo Sapiens
EGVTKTVYN

SEQ ID NO: 954267 - protein, 9 aa, Homo Sapiens
GKDEVGCAG

SEQ ID NO: 954268 - protein, 9 aa, Homo Sapiens
KFNIATGKL

SEQ ID NO: 954269 - protein, 9 aa, Homo Sapiens
SSSVPSHPS

SEQ ID NO: 954270 - protein, 9 aa, Homo Sapiens
SKSLLYAQA

SEQ ID NO: 954271 - protein, 9 aa, Homo Sapiens
VVTSSPMIV

SEQ ID NO: 954272 - protein, 9 aa, Homo Sapiens
DLRKKDGAL

SEQ ID NO: 954273 - protein, 9 aa, Homo Sapiens
NLEIFQAVL

SEQ ID NO: 954274 - protein, 9 aa, Homo Sapiens
SFFHFLQSL

SEQ ID NO: 954275 - protein, 9 aa, Homo Sapiens
GTTNTAITA

SEQ ID NO: 954276 - protein, 9 aa, Homo Sapiens
PFRKKAFHH

SEQ ID NO: 954277 - protein, 9 aa, Homo Sapiens
QCFPSSTPL

SEQ ID NO: 954278 - protein, 9 aa, Homo Sapiens
PTDTAQAMK

SEQ ID NO: 954279 - protein, 9 aa, Homo Sapiens
SIYTNVYKY

SEQ ID NO: 954280 - protein, 9 aa, Homo Sapiens
FDLRKKDGA

SEQ ID NO: 954281 - protein, 9 aa, Homo Sapiens
PAVSISCPP

SEQ ID NO: 954282 - protein, 9 aa, Homo Sapiens
PDLRDGEQP

SEQ ID NO: 954283 - protein, 9 aa, Homo Sapiens
FQAVLEGLD

SEQ ID NO: 954284 - protein, 9 aa, Homo Sapiens
PLPQKPQLL

SEQ ID NO: 954285 - protein, 9 aa, Homo Sapiens
VGEAEKEYE

SEQ ID NO: 954286 - protein, 9 aa, Homo Sapiens
GNIPQRVME

SEQ ID NO: 954287 - protein, 9 aa, Homo Sapiens
VFFSYMVFS

SEQ ID NO: 954288 - protein, 9 aa, Homo Sapiens
LHYEQGKLT

SEQ ID NO: 954289 - protein, 9 aa, Homo Sapiens
RVHCRALGH

SEQ ID NO: 954290 - protein, 9 aa, Homo Sapiens
MNRQASQML

SEQ ID NO: 954291 - protein, 9 aa, Homo Sapiens
CYYIDKERR

SEQ ID NO: 954292 - protein, 9 aa, Homo Sapiens
IRSVAFLCI

SEQ ID NO: 954293 - protein, 9 aa, Homo Sapiens
VHCRALGHP

SEQ ID NO: 954294 - protein, 9 aa, Homo Sapiens
QMELKELKI

SEQ ID NO: 954295 - protein, 9 aa, Homo Sapiens
FSGTKKLPK

SEQ ID NO: 954296 - protein, 9 aa, Homo Sapiens
VSKCRSAEI

SEQ ID NO: 954297 - protein, 9 aa, Homo Sapiens
MIVQRLGLI

SEQ ID NO: 954298 - protein, 9 aa, Homo Sapiens
PQLLPNAQS

SEQ ID NO: 954299 - protein, 9 aa, Homo Sapiens
SASKQEEIL

SEQ ID NO: 954300 - protein, 9 aa, Homo Sapiens
REEITKHWN

SEQ ID NO: 954301 - protein, 9 aa, Homo Sapiens
GFNGSKENS

SEQ ID NO: 954302 - protein, 9 aa, Homo Sapiens
NDRQMELKE

SEQ ID NO: 954303 - protein, 9 aa, Homo Sapiens
AYNPKHFHN

SEQ ID NO: 954304 - protein, 9 aa, Homo Sapiens
NLIITGFLD

SEQ ID NO: 954305 - protein, 9 aa, Homo Sapiens
KKRGLGGGR

SEQ ID NO: 954306 - protein, 9 aa, Homo Sapiens
VISLPTFRK

SEQ ID NO: 954307 - protein, 9 aa, Homo Sapiens
ATKITTIPS

SEQ ID NO: 954308 - protein, 9 aa, Homo Sapiens
GLVPSFPTT

SEQ ID NO: 954309 - protein, 9 aa, Homo Sapiens
KSLTLIVEG

SEQ ID NO: 954310 - protein, 9 aa, Homo Sapiens
LSAFFILLP

SEQ ID NO: 954311 - protein, 9 aa, Homo Sapiens
WICHPEKYM

SEQ ID NO: 954312 - protein, 9 aa, Homo Sapiens
VEEQEEKED

SEQ ID NO: 954313 - protein, 9 aa, Homo Sapiens
AADYGVFSR

SEQ ID NO: 954314 - protein, 9 aa, Homo Sapiens
LSGSSENTS

SEQ ID NO: 954315 - protein, 9 aa, Homo Sapiens
WLKNFIRSL

SEQ ID NO: 954316 - protein, 9 aa, Homo Sapiens
KQMMYLTTK

SEQ ID NO: 954317 - protein, 9 aa, Homo Sapiens
GEEAGPKVG

SEQ ID NO: 954318 - protein, 9 aa, Homo Sapiens
MPSPEARVL

SEQ ID NO: 954319 - protein, 9 aa, Homo Sapiens
YTSKTSTGT

SEQ ID NO: 954320 - protein, 9 aa, Homo Sapiens
EEKDEEDEE

SEQ ID NO: 954321 - protein, 9 aa, Homo Sapiens
QVLATTTPK

SEQ ID NO: 954322 - protein, 9 aa, Homo Sapiens
TNLYRKGHS

SEQ ID NO: 954323 - protein, 9 aa, Homo Sapiens
LVKVNISFV

SEQ ID NO: 954324 - protein, 9 aa, Homo Sapiens
HPQVTSSGP

SEQ ID NO: 954325 - protein, 9 aa, Homo Sapiens
THLILCILR

SEQ ID NO: 954326 - protein, 9 aa, Homo Sapiens
PKPLFLKLL

SEQ ID NO: 954327 - protein, 9 aa, Homo Sapiens
DSRDTFFLT

SEQ ID NO: 954328 - protein, 9 aa, Homo Sapiens
VLALERGHD

SEQ ID NO: 954329 - protein, 9 aa, Homo Sapiens
EPEPPGQQG

SEQ ID NO: 954330 - protein, 9 aa, Homo Sapiens
STPLVVIWN

SEQ ID NO: 954331 - protein, 9 aa, Homo Sapiens
CGLRAMPSP

SEQ ID NO: 954332 - protein, 9 aa, Homo Sapiens
NISFVRLNY

SEQ ID NO: 954333 - protein, 9 aa, Homo Sapiens
RLPVNLNFT

SEQ ID NO: 954334 - protein, 9 aa, Homo Sapiens
TSEAPPPLL

SEQ ID NO: 954335 - protein, 9 aa, Homo Sapiens
EGVKWLSFY

SEQ ID NO: 954336 - protein, 9 aa, Homo Sapiens
RPEEKLKKE

SEQ ID NO: 954337 - protein, 9 aa, Homo Sapiens
LPGVLQGTL

SEQ ID NO: 954338 - protein, 9 aa, Homo Sapiens
GSHSSPETP

SEQ ID NO: 954339 - protein, 9 aa, Homo Sapiens
EEDEENAHP

SEQ ID NO: 954340 - protein, 9 aa, Homo Sapiens
RSWFSNASS

SEQ ID NO: 954341 - protein, 9 aa, Homo Sapiens
KSSWLRKNG

SEQ ID NO: 954342 - protein, 9 aa, Homo Sapiens
GRVVLALER

SEQ ID NO: 954343 - protein, 9 aa, Homo Sapiens
EKNSQIYKF

SEQ ID NO: 954344 - protein, 9 aa, Homo Sapiens
FETLPSPLP

SEQ ID NO: 954345 - protein, 9 aa, Homo Sapiens
SSEKIAIPG

SEQ ID NO: 954346 - protein, 9 aa, Homo Sapiens
AATQCKHGV

SEQ ID NO: 954347 - protein, 9 aa, Homo Sapiens
GGVQYGAEV

SEQ ID NO: 954348 - protein, 9 aa, Homo Sapiens
EFCGIHETT

SEQ ID NO: 954349 - protein, 9 aa, Homo Sapiens
GLLNLQQVG

SEQ ID NO: 954350 - protein, 9 aa, Homo Sapiens
ARSDGDKED

SEQ ID NO: 954351 - protein, 9 aa, Homo Sapiens
MRDPLTKRF

SEQ ID NO: 954352 - protein, 9 aa, Homo Sapiens
LETKKERVS

SEQ ID NO: 954353 - protein, 9 aa, Homo Sapiens
FILAYAFLG

SEQ ID NO: 954354 - protein, 9 aa, Homo Sapiens
ADKISFDFS

SEQ ID NO: 954355 - protein, 9 aa, Homo Sapiens
RQLILSGSS

SEQ ID NO: 954356 - protein, 9 aa, Homo Sapiens
KAVLQELES

SEQ ID NO: 954357 - protein, 9 aa, Homo Sapiens
TLSSLMKEL

SEQ ID NO: 954358 - protein, 9 aa, Homo Sapiens
RQMELKELK

SEQ ID NO: 954359 - protein, 9 aa, Homo Sapiens
NLNFTLKDN

SEQ ID NO: 954360 - protein, 9 aa, Homo Sapiens
PDSFSYRIL

SEQ ID NO: 954361 - protein, 9 aa, Homo Sapiens
DIPDVRGSS

SEQ ID NO: 954362 - protein, 9 aa, Homo Sapiens
GKLTFFDAD

SEQ ID NO: 954363 - protein, 9 aa, Homo Sapiens
KETMMVMTE

SEQ ID NO: 954364 - protein, 9 aa, Homo Sapiens
RFLQQQMPT

SEQ ID NO: 954365 - protein, 9 aa, Homo Sapiens
SCGGSKWGC

SEQ ID NO: 954366 - protein, 9 aa, Homo Sapiens
KEINAVLPN

SEQ ID NO: 954367 - protein, 9 aa, Homo Sapiens
TLFNLISVG

SEQ ID NO: 954368 - protein, 9 aa, Homo Sapiens
GVVYDTCGP

SEQ ID NO: 954369 - protein, 9 aa, Homo Sapiens
KCWLDGKGG

SEQ ID NO: 954370 - protein, 9 aa, Homo Sapiens
SDYSRFWLL

SEQ ID NO: 954371 - protein, 9 aa, Homo Sapiens
QASQMLLMF

SEQ ID NO: 954372 - protein, 9 aa, Homo Sapiens
VSELSKKLW

SEQ ID NO: 954373 - protein, 9 aa, Homo Sapiens
PDSSPHPAQ

SEQ ID NO: 954374 - protein, 9 aa, Homo Sapiens
FWLLVHHLC

SEQ ID NO: 954375 - protein, 9 aa, Homo Sapiens
FSNASSCES

SEQ ID NO: 954376 - protein, 9 aa, Homo Sapiens
PNIIGVKKK

SEQ ID NO: 954377 - protein, 9 aa, Homo Sapiens
ARFFTYSNF

SEQ ID NO: 954378 - protein, 9 aa, Homo Sapiens
FSLARGLDY

SEQ ID NO: 954379 - protein, 9 aa, Homo Sapiens
SKVHFRSAR

SEQ ID NO: 954380 - protein, 9 aa, Homo Sapiens
EKDEKIDQM

SEQ ID NO: 954381 - protein, 9 aa, Homo Sapiens
NFFANTWES

SEQ ID NO: 954382 - protein, 9 aa, Homo Sapiens
ALARGLLLF

SEQ ID NO: 954383 - protein, 9 aa, Homo Sapiens
RTNQFFVTR

SEQ ID NO: 954384 - protein, 9 aa, Homo Sapiens
IYFSDFEDV

SEQ ID NO: 954385 - protein, 9 aa, Homo Sapiens
MVEVAHLEE

SEQ ID NO: 954386 - protein, 9 aa, Homo Sapiens
ERDAVKNLL

SEQ ID NO: 954387 - protein, 9 aa, Homo Sapiens
SFGKNLNLS

SEQ ID NO: 954388 - protein, 9 aa, Homo Sapiens
WVQNRQPHL

SEQ ID NO: 954389 - protein, 9 aa, Homo Sapiens
KGKDAFGNK

SEQ ID NO: 954390 - protein, 9 aa, Homo Sapiens
KFCHGLLKI

SEQ ID NO: 954391 - protein, 9 aa, Homo Sapiens
GNVGSIISN

SEQ ID NO: 954392 - protein, 9 aa, Homo Sapiens
PIWGRSTRP

SEQ ID NO: 954393 - protein, 9 aa, Homo Sapiens
EIQEEAEHM

SEQ ID NO: 954394 - protein, 9 aa, Homo Sapiens
VDLETKETA

SEQ ID NO: 954395 - protein, 9 aa, Homo Sapiens
YYIDKERRT

SEQ ID NO: 954396 - protein, 9 aa, Homo Sapiens
VDIEAADLA

SEQ ID NO: 954397 - protein, 9 aa, Homo Sapiens
RLEDQGCYR

SEQ ID NO: 954398 - protein, 9 aa, Homo Sapiens
QKPQLLPNA

SEQ ID NO: 954399 - protein, 9 aa, Homo Sapiens
VNDIFKRIA

SEQ ID NO: 954400 - protein, 9 aa, Homo Sapiens
SVGLRVVAI

SEQ ID NO: 954401 - protein, 9 aa, Homo Sapiens
SLLDDLASG

SEQ ID NO: 954402 - protein, 9 aa, Homo Sapiens
GGSFGGGSS

SEQ ID NO: 954403 - protein, 9 aa, Homo Sapiens
YVAISKSLL

SEQ ID NO: 954404 - protein, 9 aa, Homo Sapiens
NELKAVLQE

SEQ ID NO: 954405 - protein, 9 aa, Homo Sapiens
FGGGSSGGG

SEQ ID NO: 954406 - protein, 9 aa, Homo Sapiens
FVFEAPYIL

SEQ ID NO: 954407 - protein, 9 aa, Homo Sapiens
KAKPAVGRG

SEQ ID NO: 954408 - protein, 9 aa, Homo Sapiens
IDLRHNKIY

SEQ ID NO: 954409 - protein, 9 aa, Homo Sapiens
TEKSRWSGS

SEQ ID NO: 954410 - protein, 9 aa, Homo Sapiens
VQKAIGKYR

SEQ ID NO: 954411 - protein, 9 aa, Homo Sapiens
HSPVLLPRN

SEQ ID NO: 954412 - protein, 9 aa, Homo Sapiens
KETSFELIE

SEQ ID NO: 954413 - protein, 9 aa, Homo Sapiens
FIGQKFCHG

SEQ ID NO: 954414 - protein, 9 aa, Homo Sapiens
GLRAMPSPE

SEQ ID NO: 954415 - protein, 9 aa, Homo Sapiens
EELPIYFSD

SEQ ID NO: 954416 - protein, 9 aa, Homo Sapiens
VFWGDYPCA

SEQ ID NO: 954417 - protein, 9 aa, Homo Sapiens
HTSVSQNFS

SEQ ID NO: 954418 - protein, 9 aa, Homo Sapiens
LAKDLEFGV

SEQ ID NO: 954419 - protein, 9 aa, Homo Sapiens
LVGRSYPVR

SEQ ID NO: 954420 - protein, 9 aa, Homo Sapiens
SLILSYVED

SEQ ID NO: 954421 - protein, 9 aa, Homo Sapiens
HYEQGKLTF

SEQ ID NO: 954422 - protein, 9 aa, Homo Sapiens
PMGINNRFS

SEQ ID NO: 954423 - protein, 9 aa, Homo Sapiens
EAEHMFTRE

SEQ ID NO: 954424 - protein, 9 aa, Homo Sapiens
ADYGVFSRR

SEQ ID NO: 954425 - protein, 9 aa, Homo Sapiens
LYTKPRMPP

SEQ ID NO: 954426 - protein, 9 aa, Homo Sapiens
KDEKIDQMK

SEQ ID NO: 954427 - protein, 9 aa, Homo Sapiens
SSLDCKLLE

SEQ ID NO: 954428 - protein, 9 aa, Homo Sapiens
AFNLSSSHL

SEQ ID NO: 954429 - protein, 9 aa, Homo Sapiens
GEIWLKNFI

SEQ ID NO: 954430 - protein, 9 aa, Homo Sapiens
YGIFLKMME

SEQ ID NO: 954431 - protein, 9 aa, Homo Sapiens
KVPVSKNPK

SEQ ID NO: 954432 - protein, 9 aa, Homo Sapiens
LNLSRNRQY

SEQ ID NO: 954433 - protein, 9 aa, Homo Sapiens
WNKNYFGNF

SEQ ID NO: 954434 - protein, 9 aa, Homo Sapiens
LGMEFCGIH

SEQ ID NO: 954435 - protein, 9 aa, Homo Sapiens
VLQELESEQ

SEQ ID NO: 954436 - protein, 9 aa, Homo Sapiens
ALPLEREDS

SEQ ID NO: 954437 - protein, 9 aa, Homo Sapiens
LWNQQHFAL

SEQ ID NO: 954438 - protein, 9 aa, Homo Sapiens
CILRFMRRM

SEQ ID NO: 954439 - protein, 9 aa, Homo Sapiens
PPLPPPQGG

SEQ ID NO: 954440 - protein, 9 aa, Homo Sapiens
IVQRLGLIS

SEQ ID NO: 954441 - protein, 9 aa, Homo Sapiens
QGKALQATV

SEQ ID NO: 954442 - protein, 9 aa, Homo Sapiens
DEGFEGKFL

SEQ ID NO: 954443 - protein, 9 aa, Homo Sapiens
HSFRKPRLL

SEQ ID NO: 954444 - protein, 9 aa, Homo Sapiens
SVQKLKSNQ

SEQ ID NO: 954445 - protein, 9 aa, Homo Sapiens
GLATEKSRW

SEQ ID NO: 954446 - protein, 9 aa, Homo Sapiens
QALRLFILN

SEQ ID NO: 954447 - protein, 9 aa, Homo Sapiens
ELQEADEQL

SEQ ID NO: 954448 - protein, 9 aa, Homo Sapiens
NASSCESLS

SEQ ID NO: 954449 - protein, 9 aa, Homo Sapiens
SEEPSSFLF

SEQ ID NO: 954450 - protein, 9 aa, Homo Sapiens
DGDKEDELV

SEQ ID NO: 954451 - protein, 9 aa, Homo Sapiens
LKMMEARSR

SEQ ID NO: 954452 - protein, 9 aa, Homo Sapiens
RCERRLVEQ

SEQ ID NO: 954453 - protein, 9 aa, Homo Sapiens
EQASNHPFF

SEQ ID NO: 954454 - protein, 9 aa, Homo Sapiens
NGYAVSREF

SEQ ID NO: 954455 - protein, 9 aa, Homo Sapiens
IEHYRVHTG

SEQ ID NO: 954456 - protein, 9 aa, Homo Sapiens
TAADYGVFS

SEQ ID NO: 954457 - protein, 9 aa, Homo Sapiens
VRGSSVLAT

SEQ ID NO: 954458 - protein, 9 aa, Homo Sapiens
CHGLLKILA

SEQ ID NO: 954459 - protein, 9 aa, Homo Sapiens
LNFLISLED

SEQ ID NO: 954460 - protein, 9 aa, Homo Sapiens
KWGRPGADG

SEQ ID NO: 954461 - protein, 9 aa, Homo Sapiens
EEIQEEAEH

SEQ ID NO: 954462 - protein, 9 aa, Homo Sapiens
RKIAEKDEK

SEQ ID NO: 954463 - protein, 9 aa, Homo Sapiens
DNLDKIHDK

SEQ ID NO: 954464 - protein, 9 aa, Homo Sapiens
IPDVRGSSV

SEQ ID NO: 954465 - protein, 9 aa, Homo Sapiens
NEKETSFEL

SEQ ID NO: 954466 - protein, 9 aa, Homo Sapiens
LSHLSSELE

SEQ ID NO: 954467 - protein, 9 aa, Homo Sapiens
VSEALSKDS

SEQ ID NO: 954468 - protein, 9 aa, Homo Sapiens
SVLATLSLR

SEQ ID NO: 954469 - protein, 9 aa, Homo Sapiens
TKISEDDIH

SEQ ID NO: 954470 - protein, 9 aa, Homo Sapiens
SLLEVLDTI

SEQ ID NO: 954471 - protein, 9 aa, Homo Sapiens
ERGHDLTAI

SEQ ID NO: 954472 - protein, 9 aa, Homo Sapiens
NPKHFHNRV

SEQ ID NO: 954473 - protein, 9 aa, Homo Sapiens
HFSEALGHV

SEQ ID NO: 954474 - protein, 9 aa, Homo Sapiens
KAIQRIASS

SEQ ID NO: 954475 - protein, 9 aa, Homo Sapiens
SGTAESVTC

SEQ ID NO: 954476 - protein, 9 aa, Homo Sapiens
HYEDIPFTK

SEQ ID NO: 954477 - protein, 9 aa, Homo Sapiens
NLYKLVTDG

SEQ ID NO: 954478 - protein, 9 aa, Homo Sapiens
LKEERSSHV

SEQ ID NO: 954479 - protein, 9 aa, Homo Sapiens
GIILPSLES

SEQ ID NO: 954480 - protein, 9 aa, Homo Sapiens
FISIPVKSD

SEQ ID NO: 954481 - protein, 9 aa, Homo Sapiens
LYCGLCGEF

SEQ ID NO: 954482 - protein, 9 aa, Homo Sapiens
FLTVTTTAV

SEQ ID NO: 954483 - protein, 9 aa, Homo Sapiens
KELKSPNEG

SEQ ID NO: 954484 - protein, 9 aa, Homo Sapiens
SFLTVTTTA

SEQ ID NO: 954485 - protein, 9 aa, Homo Sapiens
PDVRGSSVL

SEQ ID NO: 954486 - protein, 9 aa, Homo Sapiens
VKWLSFYSG

SEQ ID NO: 954487 - protein, 9 aa, Homo Sapiens
FFHFLQSLN

SEQ ID NO: 954488 - protein, 9 aa, Homo Sapiens
LFLKSATPE

SEQ ID NO: 954489 - protein, 9 aa, Homo Sapiens
MMLSKAKPA

SEQ ID NO: 954490 - protein, 9 aa, Homo Sapiens
LTKRFRGFG

SEQ ID NO: 954491 - protein, 9 aa, Homo Sapiens
PGLHTWARV

SEQ ID NO: 954492 - protein, 9 aa, Homo Sapiens
SLEEPDREK

SEQ ID NO: 954493 - protein, 9 aa, Homo Sapiens
VVHALLLYR

SEQ ID NO: 954494 - protein, 9 aa, Homo Sapiens
TASGDEVRA

SEQ ID NO: 954495 - protein, 9 aa, Homo Sapiens
ADMLRPDSR

SEQ ID NO: 954496 - protein, 9 aa, Homo Sapiens
VKNLLQQLL

SEQ ID NO: 954497 - protein, 9 aa, Homo Sapiens
RFFTYSNFP

SEQ ID NO: 954498 - protein, 9 aa, Homo Sapiens
YMNRQASQM

SEQ ID NO: 954499 - protein, 9 aa, Homo Sapiens
DPFNVSDRQ

SEQ ID NO: 954500 - protein, 9 aa, Homo Sapiens
EAIEELGKA

SEQ ID NO: 954501 - protein, 9 aa, Homo Sapiens
ILSNHGLSE

SEQ ID NO: 954502 - protein, 9 aa, Homo Sapiens
FLVIYVVTV

SEQ ID NO: 954503 - protein, 9 aa, Homo Sapiens
VREERHRRR

SEQ ID NO: 954504 - protein, 9 aa, Homo Sapiens
LTEEHSENY

SEQ ID NO: 954505 - protein, 9 aa, Homo Sapiens
SVREGNSSV

SEQ ID NO: 954506 - protein, 9 aa, Homo Sapiens
RLFILNWFG

SEQ ID NO: 954507 - protein, 9 aa, Homo Sapiens
KWGCGSCGG

SEQ ID NO: 954508 - protein, 9 aa, Homo Sapiens
LLKEERSSH

SEQ ID NO: 954509 - protein, 9 aa, Homo Sapiens
KTRKPEEES

SEQ ID NO: 954510 - protein, 9 aa, Homo Sapiens
LFLRKVFSV

SEQ ID NO: 954511 - protein, 9 aa, Homo Sapiens
LAENEATGP

SEQ ID NO: 954512 - protein, 9 aa, Homo Sapiens
FSTGDKHSR

SEQ ID NO: 954513 - protein, 9 aa, Homo Sapiens
LGLEGAHMG

SEQ ID NO: 954514 - protein, 9 aa, Homo Sapiens
SAFFILLPD

SEQ ID NO: 954515 - protein, 9 aa, Homo Sapiens
EHMFTREFS

SEQ ID NO: 954516 - protein, 9 aa, Homo Sapiens
CLGPARGTS

SEQ ID NO: 954517 - protein, 9 aa, Homo Sapiens
VVGDQQAEA

SEQ ID NO: 954518 - protein, 9 aa, Homo Sapiens
FRSARRLCE

SEQ ID NO: 954519 - protein, 9 aa, Homo Sapiens
TGLRALARG

SEQ ID NO: 954520 - protein, 9 aa, Homo Sapiens
LKSATPEQS

SEQ ID NO: 954521 - protein, 9 aa, Homo Sapiens
SLSDYFSSV

SEQ ID NO: 954522 - protein, 9 aa, Homo Sapiens
VQNRQPHLG

SEQ ID NO: 954523 - protein, 9 aa, Homo Sapiens
TLFLGCQLA

SEQ ID NO: 954524 - protein, 9 aa, Homo Sapiens
GLVFWGDYP

SEQ ID NO: 954525 - protein, 9 aa, Homo Sapiens
RARTAADYG

SEQ ID NO: 954526 - protein, 9 aa, Homo Sapiens
FQGKGSISE

SEQ ID NO: 954527 - protein, 9 aa, Homo Sapiens
DYTLFNLIS

SEQ ID NO: 954528 - protein, 9 aa, Homo Sapiens
TTMVFFSYM

SEQ ID NO: 954529 - protein, 9 aa, Homo Sapiens
LRAMPSPEA

SEQ ID NO: 954530 - protein, 9 aa, Homo Sapiens
FGLATEKSR

SEQ ID NO: 954531 - protein, 9 aa, Homo Sapiens
EEQSPAEGD

SEQ ID NO: 954532 - protein, 9 aa, Homo Sapiens
SCYYIDKER

SEQ ID NO: 954533 - protein, 9 aa, Homo Sapiens
DAFFTRLFY

SEQ ID NO: 954534 - protein, 9 aa, Homo Sapiens
LFNISEAEA

SEQ ID NO: 954535 - protein, 9 aa, Homo Sapiens
QYGAEVACS

SEQ ID NO: 954536 - protein, 9 aa, Homo Sapiens
SHLSSELEE

SEQ ID NO: 954537 - protein, 9 aa, Homo Sapiens
GRRQLILSG

SEQ ID NO: 954538 - protein, 9 aa, Homo Sapiens
IVKKNFDLC

SEQ ID NO: 954539 - protein, 9 aa, Homo Sapiens
QAPTSLNGR

SEQ ID NO: 954540 - protein, 9 aa, Homo Sapiens
PDVHRDETA

SEQ ID NO: 954541 - protein, 9 aa, Homo Sapiens
TAQAMKNGL

SEQ ID NO: 954542 - protein, 9 aa, Homo Sapiens
PPPLPPPQG

SEQ ID NO: 954543 - protein, 9 aa, Homo Sapiens
KCRSAEIKV

SEQ ID NO: 954544 - protein, 9 aa, Homo Sapiens
EADSLITTP

SEQ ID NO: 954545 - protein, 9 aa, Homo Sapiens
LFGICQIKA

SEQ ID NO: 954546 - protein, 9 aa, Homo Sapiens
TGTTNTAIT

SEQ ID NO: 954547 - protein, 9 aa, Homo Sapiens
SELEEMSTS

SEQ ID NO: 954548 - protein, 9 aa, Homo Sapiens
EKLKKEGFI

SEQ ID NO: 954549 - protein, 9 aa, Homo Sapiens
CKQRMLVRE

SEQ ID NO: 954550 - protein, 9 aa, Homo Sapiens
YPVRRNGIR

SEQ ID NO: 954551 - protein, 9 aa, Homo Sapiens
FWICHPEKY

SEQ ID NO: 954552 - protein, 9 aa, Homo Sapiens
DIPFTKTDP

SEQ ID NO: 954553 - protein, 9 aa, Homo Sapiens
LFENLLCLG

SEQ ID NO: 954554 - protein, 9 aa, Homo Sapiens
RGPVSLSVS

SEQ ID NO: 954555 - protein, 9 aa, Homo Sapiens
SKENLSAFF

SEQ ID NO: 954556 - protein, 9 aa, Homo Sapiens
LNEKETSFE

SEQ ID NO: 954557 - protein, 9 aa, Homo Sapiens
NNFGSVARM

SEQ ID NO: 954558 - protein, 9 aa, Homo Sapiens
DYSRFWLLV

SEQ ID NO: 954559 - protein, 9 aa, Homo Sapiens
SLFGICQIK

SEQ ID NO: 954560 - protein, 9 aa, Homo Sapiens
EALSKDSFI

SEQ ID NO: 954561 - protein, 9 aa, Homo Sapiens
SSSHLRPIT

SEQ ID NO: 954562 - protein, 9 aa, Homo Sapiens
LVTITNNFG

SEQ ID NO: 954563 - protein, 9 aa, Homo Sapiens
APFEKAAKK

SEQ ID NO: 954564 - protein, 9 aa, Homo Sapiens
ENLSAFFIL

SEQ ID NO: 954565 - protein, 9 aa, Homo Sapiens
PTSLNGRPM

SEQ ID NO: 954566 - protein, 9 aa, Homo Sapiens
IEADSLITT

SEQ ID NO: 954567 - protein, 9 aa, Homo Sapiens
RPSAAALQA

SEQ ID NO: 954568 - protein, 9 aa, Homo Sapiens
DTAQAMKNG

SEQ ID NO: 954569 - protein, 9 aa, Homo Sapiens
DKIHDKNGN

SEQ ID NO: 954570 - protein, 9 aa, Homo Sapiens
GMEFCGIHE

SEQ ID NO: 954571 - protein, 9 aa, Homo Sapiens
YRKGHSTSL

SEQ ID NO: 954572 - protein, 9 aa, Homo Sapiens
ENELKAVLQ

SEQ ID NO: 954573 - protein, 9 aa, Homo Sapiens
LHSGTAESV

SEQ ID NO: 954574 - protein, 9 aa, Homo Sapiens
AIQRIASSS

SEQ ID NO: 954575 - protein, 9 aa, Homo Sapiens
FIRSLDALH

SEQ ID NO: 954576 - protein, 9 aa, Homo Sapiens
SEAPPPLLQ

SEQ ID NO: 954577 - protein, 9 aa, Homo Sapiens
RTAADYGVF

SEQ ID NO: 954578 - protein, 9 aa, Homo Sapiens
SVVKEEANA

SEQ ID NO: 954579 - protein, 9 aa, Homo Sapiens
RSDGDKEDE

SEQ ID NO: 954580 - protein, 9 aa, Homo Sapiens
ETAWQLPMF

SEQ ID NO: 954581 - protein, 9 aa, Homo Sapiens
VKLFSKGEG

SEQ ID NO: 954582 - protein, 9 aa, Homo Sapiens
YEGGHINTA

SEQ ID NO: 954583 - protein, 9 aa, Homo Sapiens
GGQLPVEDQ

SEQ ID NO: 954584 - protein, 9 aa, Homo Sapiens
RAEALPLER

SEQ ID NO: 954585 - protein, 9 aa, Homo Sapiens
KLSEEGRQK

SEQ ID NO: 954586 - protein, 9 aa, Homo Sapiens
AMPSPEARV

SEQ ID NO: 954587 - protein, 9 aa, Homo Sapiens
SSPHPAQDS

SEQ ID NO: 954588 - protein, 9 aa, Homo Sapiens
LSKDSFIAL

SEQ ID NO: 954589 - protein, 9 aa, Homo Sapiens
IAAILKIPT

SEQ ID NO: 954590 - protein, 9 aa, Homo Sapiens
KLVSNGVQI

SEQ ID NO: 954591 - protein, 9 aa, Homo Sapiens
DHPAVSISC

SEQ ID NO: 954592 - protein, 9 aa, Homo Sapiens
EVVGEAEKE

SEQ ID NO: 954593 - protein, 9 aa, Homo Sapiens
FILNWFGWT

SEQ ID NO: 954594 - protein, 9 aa, Homo Sapiens
SSSVNFADL

SEQ ID NO: 954595 - protein, 9 aa, Homo Sapiens
LATTTPKIL

SEQ ID NO: 954596 - protein, 9 aa, Homo Sapiens
GANSDKILK

SEQ ID NO: 954597 - protein, 9 aa, Homo Sapiens
NEVLKNFNR

SEQ ID NO: 954598 - protein, 9 aa, Homo Sapiens
MKHLRTHDA

SEQ ID NO: 954599 - protein, 9 aa, Homo Sapiens
AKSQELQEA

SEQ ID NO: 954600 - protein, 9 aa, Homo Sapiens
LTDPNFDLR

SEQ ID NO: 954601 - protein, 9 aa, Homo Sapiens
LQAENGPAA

SEQ ID NO: 954602 - protein, 9 aa, Homo Sapiens
LAASLVFTE

SEQ ID NO: 954603 - protein, 9 aa, Homo Sapiens
INGYAVSRE

SEQ ID NO: 954604 - protein, 9 aa, Homo Sapiens
SKNLYKLVT

SEQ ID NO: 954605 - protein, 9 aa, Homo Sapiens
QQEELPIYF

SEQ ID NO: 954606 - protein, 9 aa, Homo Sapiens
WFSNASSCE

SEQ ID NO: 954607 - protein, 9 aa, Homo Sapiens
PYILSGKKQ

SEQ ID NO: 954608 - protein, 9 aa, Homo Sapiens
PSLVSEALS

SEQ ID NO: 954609 - protein, 9 aa, Homo Sapiens
NLLQTILNF

SEQ ID NO: 954610 - protein, 9 aa, Homo Sapiens
TQCKHGVVY

SEQ ID NO: 954611 - protein, 9 aa, Homo Sapiens
PNEGFEGKS

SEQ ID NO: 954612 - protein, 9 aa, Homo Sapiens
MTYLFNISE

SEQ ID NO: 954613 - protein, 9 aa, Homo Sapiens
EGLTDSEFF

SEQ ID NO: 954614 - protein, 9 aa, Homo Sapiens
HFKHSFRKP

SEQ ID NO: 954615 - protein, 9 aa, Homo Sapiens
ANSDKILKK

SEQ ID NO: 954616 - protein, 9 aa, Homo Sapiens
QRMLVREER

SEQ ID NO: 954617 - protein, 9 aa, Homo Sapiens
LWSELDVGA

SEQ ID NO: 954618 - protein, 9 aa, Homo Sapiens
DKHSRGNWG

SEQ ID NO: 954619 - protein, 9 aa, Homo Sapiens
LEEPDREKV

SEQ ID NO: 954620 - protein, 9 aa, Homo Sapiens
SYMVFSILF

SEQ ID NO: 954621 - protein, 9 aa, Homo Sapiens
EPNEVLKNF

SEQ ID NO: 954622 - protein, 9 aa, Homo Sapiens
DKEDELVGS

SEQ ID NO: 954623 - protein, 9 aa, Homo Sapiens
SAEIKVIMV

SEQ ID NO: 954624 - protein, 9 aa, Homo Sapiens
VFRKSPLAE

SEQ ID NO: 954625 - protein, 9 aa, Homo Sapiens
EKNCTLQCN

SEQ ID NO: 954626 - protein, 9 aa, Homo Sapiens
NLLDNRAPL

SEQ ID NO: 954627 - protein, 9 aa, Homo Sapiens
PMIVQRLGL

SEQ ID NO: 954628 - protein, 9 aa, Homo Sapiens
HSSPETPVL

SEQ ID NO: 954629 - protein, 9 aa, Homo Sapiens
VVLALERGH

SEQ ID NO: 954630 - protein, 9 aa, Homo Sapiens
GDLVLYNFF

SEQ ID NO: 954631 - protein, 9 aa, Homo Sapiens
NIRKSYNSV

SEQ ID NO: 954632 - protein, 9 aa, Homo Sapiens
HLGLLQSGV

SEQ ID NO: 954633 - protein, 9 aa, Homo Sapiens
FSSVPSTPS

SEQ ID NO: 954634 - protein, 9 aa, Homo Sapiens
IGEGLTDSE

SEQ ID NO: 954635 - protein, 9 aa, Homo Sapiens
AIIEADSLI

SEQ ID NO: 954636 - protein, 9 aa, Homo Sapiens
LPQKPQLLP

SEQ ID NO: 954637 - protein, 9 aa, Homo Sapiens
VEDQHTVLS

SEQ ID NO: 954638 - protein, 9 aa, Homo Sapiens
SVHPQVTSS

SEQ ID NO: 954639 - protein, 9 aa, Homo Sapiens
KEPNEVLKN

SEQ ID NO: 954640 - protein, 9 aa, Homo Sapiens
VKVNISFVR

SEQ ID NO: 954641 - protein, 9 aa, Homo Sapiens
LAPNPVDNA

SEQ ID NO: 954642 - protein, 9 aa, Homo Sapiens
RESQNLLDN

SEQ ID NO: 954643 - protein, 9 aa, Homo Sapiens
FLCISTGIY

SEQ ID NO: 954644 - protein, 9 aa, Homo Sapiens
CKYHCDGGY

SEQ ID NO: 954645 - protein, 9 aa, Homo Sapiens
VRLEDQGCY

SEQ ID NO: 954646 - protein, 9 aa, Homo Sapiens
DVRLEDQGC

SEQ ID NO: 954647 - protein, 9 aa, Homo Sapiens
QREAIEELG

SEQ ID NO: 954648 - protein, 9 aa, Homo Sapiens
PSDSQVSKE

SEQ ID NO: 954649 - protein, 9 aa, Homo Sapiens
ARFETKISE

SEQ ID NO: 954650 - protein, 9 aa, Homo Sapiens
ELKAVLQEL

SEQ ID NO: 954651 - protein, 9 aa, Homo Sapiens
GFMVEVAHL

SEQ ID NO: 954652 - protein, 9 aa, Homo Sapiens
VLQGTLLSP

SEQ ID NO: 954653 - protein, 9 aa, Homo Sapiens
PFWNKNYFG

SEQ ID NO: 954654 - protein, 9 aa, Homo Sapiens
AGLVPSFPT

SEQ ID NO: 954655 - protein, 9 aa, Homo Sapiens
SFYSGYDFG

SEQ ID NO: 954656 - protein, 9 aa, Homo Sapiens
GYTPGDTMD

SEQ ID NO: 954657 - protein, 9 aa, Homo Sapiens
ISSSKNLYK

SEQ ID NO: 954658 - protein, 9 aa, Homo Sapiens
TWIFSGRCR

SEQ ID NO: 954659 - protein, 9 aa, Homo Sapiens
VPDSSLLAE

SEQ ID NO: 954660 - protein, 9 aa, Homo Sapiens
APYILSGKK

SEQ ID NO: 954661 - protein, 9 aa, Homo Sapiens
YSNSCYYID

SEQ ID NO: 954662 - protein, 9 aa, Homo Sapiens
GVITFDCQN

SEQ ID NO: 954663 - protein, 9 aa, Homo Sapiens
LISVGLRVV

SEQ ID NO: 954664 - protein, 9 aa, Homo Sapiens
EAELQANSF

SEQ ID NO: 954665 - protein, 9 aa, Homo Sapiens
EKAAKKKTK

SEQ ID NO: 954666 - protein, 9 aa, Homo Sapiens
FSSSEVMNK

SEQ ID NO: 954667 - protein, 9 aa, Homo Sapiens
YAQQNLYRD

SEQ ID NO: 954668 - protein, 9 aa, Homo Sapiens
SLIILEEKN

SEQ ID NO: 954669 - protein, 9 aa, Homo Sapiens
PVDNAGLLS

SEQ ID NO: 954670 - protein, 9 aa, Homo Sapiens
QARSDGDKE

SEQ ID NO: 954671 - protein, 9 aa, Homo Sapiens
SFGGGSSGG

SEQ ID NO: 954672 - protein, 9 aa, Homo Sapiens
NFSRSVPGT

SEQ ID NO: 954673 - protein, 9 aa, Homo Sapiens
LRKKDGALH

SEQ ID NO: 954674 - protein, 9 aa, Homo Sapiens
LFLLILLSY

SEQ ID NO: 954675 - protein, 9 aa, Homo Sapiens
QMLIGPDDR

SEQ ID NO: 954676 - protein, 9 aa, Homo Sapiens
EVEGLKKRK

SEQ ID NO: 954677 - protein, 9 aa, Homo Sapiens
RALGHPVVG

SEQ ID NO: 954678 - protein, 9 aa, Homo Sapiens
IDEYTSKTS

SEQ ID NO: 954679 - protein, 9 aa, Homo Sapiens
HDKNGNNLL

SEQ ID NO: 954680 - protein, 9 aa, Homo Sapiens
HCRALGHPV

SEQ ID NO: 954681 - protein, 9 aa, Homo Sapiens
PSTTASPTT

SEQ ID NO: 954682 - protein, 9 aa, Homo Sapiens
ERISHSIFS

SEQ ID NO: 954683 - protein, 9 aa, Homo Sapiens
LEFGVGDLP

SEQ ID NO: 954684 - protein, 9 aa, Homo Sapiens
QDWVPLHSG

SEQ ID NO: 954685 - protein, 9 aa, Homo Sapiens
SELSKKLWN

SEQ ID NO: 954686 - protein, 9 aa, Homo Sapiens
LKKEGFIRS

SEQ ID NO: 954687 - protein, 9 aa, Homo Sapiens
EAALGLEGA

SEQ ID NO: 954688 - protein, 9 aa, Homo Sapiens
SQGKALQAT

SEQ ID NO: 954689 - protein, 9 aa, Homo Sapiens
NSSVINCTY

SEQ ID NO: 954690 - protein, 9 aa, Homo Sapiens
NFADLPALF

SEQ ID NO: 954691 - protein, 9 aa, Homo Sapiens
ALRLFILNW

SEQ ID NO: 954692 - protein, 9 aa, Homo Sapiens
SNHGLSENP

SEQ ID NO: 954693 - protein, 9 aa, Homo Sapiens
KKERVSLLE

SEQ ID NO: 954694 - protein, 9 aa, Homo Sapiens
LSIRDKEGY

SEQ ID NO: 954695 - protein, 9 aa, Homo Sapiens
ENNLIITGF

SEQ ID NO: 954696 - protein, 9 aa, Homo Sapiens
EVACSETAP

SEQ ID NO: 954697 - protein, 9 aa, Homo Sapiens
LSKSSWLRK

SEQ ID NO: 954698 - protein, 9 aa, Homo Sapiens
HGVVYDTCG

SEQ ID NO: 954699 - protein, 9 aa, Homo Sapiens
TNQFFVTRH

SEQ ID NO: 954700 - protein, 9 aa, Homo Sapiens
SLWGRPQSL

SEQ ID NO: 954701 - protein, 9 aa, Homo Sapiens
VLYVSRHRY

SEQ ID NO: 954702 - protein, 9 aa, Homo Sapiens
NVGGLLGLA

SEQ ID NO: 954703 - protein, 9 aa, Homo Sapiens
DYAQQNLYR

SEQ ID NO: 954704 - protein, 9 aa, Homo Sapiens
ASGDEVRAS

SEQ ID NO: 954705 - protein, 9 aa, Homo Sapiens
TAESVTCTY

SEQ ID NO: 954706 - protein, 9 aa, Homo Sapiens
ERLVKVNIS

SEQ ID NO: 954707 - protein, 9 aa, Homo Sapiens
LNLQQVGLL

SEQ ID NO: 954708 - protein, 9 aa, Homo Sapiens
RNLSVVKEE

SEQ ID NO: 954709 - protein, 9 aa, Homo Sapiens
ILVLFLLIL

SEQ ID NO: 954710 - protein, 9 aa, Homo Sapiens
AGNVVHALL

SEQ ID NO: 954711 - protein, 9 aa, Homo Sapiens
MNLEGLKMI

SEQ ID NO: 954712 - protein, 9 aa, Homo Sapiens
LPHPDSSPH

SEQ ID NO: 954713 - protein, 9 aa, Homo Sapiens
GQYLREGKC

SEQ ID NO: 954714 - protein, 9 aa, Homo Sapiens
DMVFLEKKP

SEQ ID NO: 954715 - protein, 9 aa, Homo Sapiens
RDAVKNLLQ

SEQ ID NO: 954716 - protein, 9 aa, Homo Sapiens
SPMIVQRLG

SEQ ID NO: 954717 - protein, 9 aa, Homo Sapiens
VAISQGIIL

SEQ ID NO: 954718 - protein, 9 aa, Homo Sapiens
DVIIGEGLT

SEQ ID NO: 954719 - protein, 9 aa, Homo Sapiens
TILNFLISL

SEQ ID NO: 954720 - protein, 9 aa, Homo Sapiens
SDKILKKFY

SEQ ID NO: 954721 - protein, 9 aa, Homo Sapiens
YGATCKYHC

SEQ ID NO: 954722 - protein, 9 aa, Homo Sapiens
IGVKKKEGY

SEQ ID NO: 954723 - protein, 9 aa, Homo Sapiens
LRTNQFFVT

SEQ ID NO: 954724 - protein, 9 aa, Homo Sapiens
TNVMSGFNG

SEQ ID NO: 954725 - protein, 9 aa, Homo Sapiens
NLSAFFILL

SEQ ID NO: 954726 - protein, 9 aa, Homo Sapiens
PAVDIEAAD

SEQ ID NO: 954727 - protein, 9 aa, Homo Sapiens
LVDFQQRPG

SEQ ID NO: 954728 - protein, 9 aa, Homo Sapiens
EDMKGHFFI

SEQ ID NO: 954729 - protein, 9 aa, Homo Sapiens
REKVVTYLA

SEQ ID NO: 954730 - protein, 9 aa, Homo Sapiens
TFDCQNRGW

SEQ ID NO: 954731 - protein, 9 aa, Homo Sapiens
VESLKRKLQ

SEQ ID NO: 954732 - protein, 9 aa, Homo Sapiens
PQRVMEQMG

SEQ ID NO: 954733 - protein, 9 aa, Homo Sapiens
SSGPEHPEG

SEQ ID NO: 954734 - protein, 9 aa, Homo Sapiens
PVEEQEEKE

SEQ ID NO: 954735 - protein, 9 aa, Homo Sapiens
SRHRYDHGT

SEQ ID NO: 954736 - protein, 9 aa, Homo Sapiens
SGDDVIKKD

SEQ ID NO: 954737 - protein, 9 aa, Homo Sapiens
TSLNGRPMQ

SEQ ID NO: 954738 - protein, 9 aa, Homo Sapiens
LPEKSQGKA

SEQ ID NO: 954739 - protein, 9 aa, Homo Sapiens
KWWYNKGEC

SEQ ID NO: 954740 - protein, 9 aa, Homo Sapiens
RIHFSEALG

SEQ ID NO: 954741 - protein, 9 aa, Homo Sapiens
DEEDEENAH

SEQ ID NO: 954742 - protein, 9 aa, Homo Sapiens
SGDEVRASE

SEQ ID NO: 954743 - protein, 9 aa, Homo Sapiens
TLVRPKPLF

SEQ ID NO: 954744 - protein, 9 aa, Homo Sapiens
SKDSFIALV

SEQ ID NO: 954745 - protein, 9 aa, Homo Sapiens
QYEWTPLMY

SEQ ID NO: 954746 - protein, 9 aa, Homo Sapiens
RVMEQMGRS

SEQ ID NO: 954747 - protein, 9 aa, Homo Sapiens
GDWRGEPVQ

SEQ ID NO: 954748 - protein, 9 aa, Homo Sapiens
GKDAFGNKV

SEQ ID NO: 954749 - protein, 9 aa, Homo Sapiens
VLDTILPPT

SEQ ID NO: 954750 - protein, 9 aa, Homo Sapiens
TKKERVSLL

SEQ ID NO: 954751 - protein, 9 aa, Homo Sapiens
LSSLMKELV

SEQ ID NO: 954752 - protein, 9 aa, Homo Sapiens
GNLAKDLEF

SEQ ID NO: 954753 - protein, 9 aa, Homo Sapiens
AEKEYEEEE

SEQ ID NO: 954754 - protein, 9 aa, Homo Sapiens
GETPAVDIE

SEQ ID NO: 954755 - protein, 9 aa, Homo Sapiens
GPKVGEDND

SEQ ID NO: 954756 - protein, 9 aa, Homo Sapiens
HFLQSLNGV

SEQ ID NO: 954757 - protein, 9 aa, Homo Sapiens
VASKLSEAS

SEQ ID NO: 954758 - protein, 9 aa, Homo Sapiens
GSFGGGSSG

SEQ ID NO: 954759 - protein, 9 aa, Homo Sapiens
NYGATCKYH

SEQ ID NO: 954760 - protein, 9 aa, Homo Sapiens
SQSQERIGP

SEQ ID NO: 954761 - protein, 9 aa, Homo Sapiens
EIFQAVLEG

SEQ ID NO: 954762 - protein, 9 aa, Homo Sapiens
LDIIRRYKL

SEQ ID NO: 954763 - protein, 9 aa, Homo Sapiens
SNARFFTYS

SEQ ID NO: 954764 - protein, 9 aa, Homo Sapiens
SSTPLVVIW

SEQ ID NO: 954765 - protein, 9 aa, Homo Sapiens
NKSVRSRFS

SEQ ID NO: 954766 - protein, 9 aa, Homo Sapiens
GDNYGATCK

SEQ ID NO: 954767 - protein, 9 aa, Homo Sapiens
TRIHFSEAL

SEQ ID NO: 954768 - protein, 9 aa, Homo Sapiens
FLLFALFLV

SEQ ID NO: 954769 - protein, 9 aa, Homo Sapiens
VLKACALND

SEQ ID NO: 954770 - protein, 9 aa, Homo Sapiens
LIEHYRVHT

SEQ ID NO: 954771 - protein, 9 aa, Homo Sapiens
KLKNKWWYN

SEQ ID NO: 954772 - protein, 9 aa, Homo Sapiens
QSLILSYVE

SEQ ID NO: 954773 - protein, 9 aa, Homo Sapiens
VKEEANAFV

SEQ ID NO: 954774 - protein, 9 aa, Homo Sapiens
FSSEKIAIP

SEQ ID NO: 954775 - protein, 9 aa, Homo Sapiens
GGRKWKREE

SEQ ID NO: 954776 - protein, 9 aa, Homo Sapiens
LCRLRVQKA

SEQ ID NO: 954777 - protein, 9 aa, Homo Sapiens
DYFSSVPST

SEQ ID NO: 954778 - protein, 9 aa, Homo Sapiens
GLTDSEFFH

SEQ ID NO: 954779 - protein, 9 aa, Homo Sapiens
ATPEQSHVV

SEQ ID NO: 954780 - protein, 9 aa, Homo Sapiens
GPGTRLFLA

SEQ ID NO: 954781 - protein, 9 aa, Homo Sapiens
LSINKSVRS

SEQ ID NO: 954782 - protein, 9 aa, Homo Sapiens
AALIASVAQ

SEQ ID NO: 954783 - protein, 9 aa, Homo Sapiens
MFLLLKEER

SEQ ID NO: 954784 - protein, 9 aa, Homo Sapiens
ALERGHDLT

SEQ ID NO: 954785 - protein, 9 aa, Homo Sapiens
IELKEPNEV

SEQ ID NO: 954786 - protein, 9 aa, Homo Sapiens
FTKTDPVVA

SEQ ID NO: 954787 - protein, 9 aa, Homo Sapiens
GKFLYESWT

SEQ ID NO: 954788 - protein, 9 aa, Homo Sapiens
MTNQKKWAH

SEQ ID NO: 954789 - protein, 9 aa, Homo Sapiens
EMQRVKRNK

SEQ ID NO: 954790 - protein, 9 aa, Homo Sapiens
LILSGSSEN

SEQ ID NO: 954791 - protein, 9 aa, Homo Sapiens
RLVKLFSKG

SEQ ID NO: 954792 - protein, 9 aa, Homo Sapiens
PAEGDGNCV

SEQ ID NO: 954793 - protein, 9 aa, Homo Sapiens
TFLIILVLF

SEQ ID NO: 954794 - protein, 9 aa, Homo Sapiens
FGNKVKAEP

SEQ ID NO: 954795 - protein, 9 aa, Homo Sapiens
KGVFRKSPL

SEQ ID NO: 954796 - protein, 9 aa, Homo Sapiens
SVDSNFQYE

SEQ ID NO: 954797 - protein, 9 aa, Homo Sapiens
LLGMSGTES

SEQ ID NO: 954798 - protein, 9 aa, Homo Sapiens
YEKLSINKS

SEQ ID NO: 954799 - protein, 9 aa, Homo Sapiens
FSYRILNLS

SEQ ID NO: 954800 - protein, 9 aa, Homo Sapiens
RSNIRKSYN

SEQ ID NO: 954801 - protein, 9 aa, Homo Sapiens
YSKDKVTGE

SEQ ID NO: 954802 - protein, 9 aa, Homo Sapiens
VQVVIEKKV

SEQ ID NO: 954803 - protein, 9 aa, Homo Sapiens
EEWQCLDYA

SEQ ID NO: 954804 - protein, 9 aa, Homo Sapiens
IMCDVTIVV

SEQ ID NO: 954805 - protein, 9 aa, Homo Sapiens
KRFRGFGFV

SEQ ID NO: 954806 - protein, 9 aa, Homo Sapiens
NLSVVKEEA

SEQ ID NO: 954807 - protein, 9 aa, Homo Sapiens
VMRLVKLFS

SEQ ID NO: 954808 - protein, 9 aa, Homo Sapiens
MTLPVSPDQ

SEQ ID NO: 954809 - protein, 9 aa, Homo Sapiens
EAADLAHAQ

SEQ ID NO: 954810 - protein, 9 aa, Homo Sapiens
SKLSEASLL

SEQ ID NO: 954811 - protein, 9 aa, Homo Sapiens
NTAITATSN

SEQ ID NO: 954812 - protein, 9 aa, Homo Sapiens
SREFKDLEL

SEQ ID NO: 954813 - protein, 9 aa, Homo Sapiens
SLYTKPRMP

SEQ ID NO: 954814 - protein, 9 aa, Homo Sapiens
NIYKDPDYV

SEQ ID NO: 954815 - protein, 9 aa, Homo Sapiens
NAVLPNKAP

SEQ ID NO: 954816 - protein, 9 aa, Homo Sapiens
ALFLVIYVV

SEQ ID NO: 954817 - protein, 9 aa, Homo Sapiens
LQNDANLSI

SEQ ID NO: 954818 - protein, 9 aa, Homo Sapiens
LQRPSAAAL

SEQ ID NO: 954819 - protein, 9 aa, Homo Sapiens
LVAFSGTKK

SEQ ID NO: 954820 - protein, 9 aa, Homo Sapiens
LQGLVFWGD

SEQ ID NO: 954821 - protein, 9 aa, Homo Sapiens
ANHGFMVEV

SEQ ID NO: 954822 - protein, 9 aa, Homo Sapiens
KHLRTHDAE

SEQ ID NO: 954823 - protein, 9 aa, Homo Sapiens
QPLPQKPQL

SEQ ID NO: 954824 - protein, 9 aa, Homo Sapiens
GPDDRLIRS

SEQ ID NO: 954825 - protein, 9 aa, Homo Sapiens
VTSSGPEHP

SEQ ID NO: 954826 - protein, 9 aa, Homo Sapiens
PEKSQGKAL

SEQ ID NO: 954827 - protein, 9 aa, Homo Sapiens
FFSTGDKHS

SEQ ID NO: 954828 - protein, 9 aa, Homo Sapiens
QEEAEHMFT

SEQ ID NO: 954829 - protein, 9 aa, Homo Sapiens
QSRHRAEAL

SEQ ID NO: 954830 - protein, 9 aa, Homo Sapiens
ERLPVNLNF

SEQ ID NO: 954831 - protein, 9 aa, Homo Sapiens
DKILKKFYD

SEQ ID NO: 954832 - protein, 9 aa, Homo Sapiens
GFETLPSPL

SEQ ID NO: 954833 - protein, 9 aa, Homo Sapiens
ILTDPNFDL

SEQ ID NO: 954834 - protein, 9 aa, Homo Sapiens
SGFQAKKRA

SEQ ID NO: 954835 - protein, 9 aa, Homo Sapiens
LVVTSSPMI

SEQ ID NO: 954836 - protein, 9 aa, Homo Sapiens
FIGEKNSRL

SEQ ID NO: 954837 - protein, 9 aa, Homo Sapiens
SHFKHSFRK

SEQ ID NO: 954838 - protein, 9 aa, Homo Sapiens
IHFSEALGH

SEQ ID NO: 954839 - protein, 9 aa, Homo Sapiens
LYVSRHRYD

SEQ ID NO: 954840 - protein, 9 aa, Homo Sapiens
GHFMGGDVS

SEQ ID NO: 954841 - protein, 9 aa, Homo Sapiens
KEEANAFVG

SEQ ID NO: 954842 - protein, 9 aa, Homo Sapiens
PEEKLKKEG

SEQ ID NO: 954843 - protein, 9 aa, Homo Sapiens
KEVLKACAL

SEQ ID NO: 954844 - protein, 9 aa, Homo Sapiens
KQMESSKGS

SEQ ID NO: 954845 - protein, 9 aa, Homo Sapiens
ITGFLDALI

SEQ ID NO: 954846 - protein, 9 aa, Homo Sapiens
SSSEVMNKS

SEQ ID NO: 954847 - protein, 9 aa, Homo Sapiens
GQKFCHGLL

SEQ ID NO: 954848 - protein, 9 aa, Homo Sapiens
LLPNAQSSQ

SEQ ID NO: 954849 - protein, 9 aa, Homo Sapiens
GATCKYHCD

SEQ ID NO: 954850 - protein, 9 aa, Homo Sapiens
TDRSYTSQS

SEQ ID NO: 954851 - protein, 9 aa, Homo Sapiens
SRDTFFLTP

SEQ ID NO: 954852 - protein, 9 aa, Homo Sapiens
FFTYSNFPL

SEQ ID NO: 954853 - protein, 9 aa, Homo Sapiens
EGLKKRKSL

SEQ ID NO: 954854 - protein, 9 aa, Homo Sapiens
NIPQRVMEQ

SEQ ID NO: 954855 - protein, 9 aa, Homo Sapiens
EGAHMGMFT

SEQ ID NO: 954856 - protein, 9 aa, Homo Sapiens
FLSVREGNS

SEQ ID NO: 954857 - protein, 9 aa, Homo Sapiens
VTITNNFGS

SEQ ID NO: 954858 - protein, 9 aa, Homo Sapiens
HSTSLELVP

SEQ ID NO: 954859 - protein, 9 aa, Homo Sapiens
LSSSHLRPI

SEQ ID NO: 954860 - protein, 9 aa, Homo Sapiens
LFTGLRALA

SEQ ID NO: 954861 - protein, 9 aa, Homo Sapiens
LPRNLSVVK

SEQ ID NO: 954862 - protein, 9 aa, Homo Sapiens
LVEQVLYHG

SEQ ID NO: 954863 - protein, 9 aa, Homo Sapiens
IFQAVLEGL

SEQ ID NO: 954864 - protein, 9 aa, Homo Sapiens
DLRHNKIYE

SEQ ID NO: 954865 - protein, 9 aa, Homo Sapiens
SDYFSSVPS

SEQ ID NO: 954866 - protein, 9 aa, Homo Sapiens
RPDSRDTFF

SEQ ID NO: 954867 - protein, 9 aa, Homo Sapiens
PPTLQGQDW

SEQ ID NO: 954868 - protein, 9 aa, Homo Sapiens
LSKRTSGFQ

SEQ ID NO: 954869 - protein, 9 aa, Homo Sapiens
ARKISFGKN

SEQ ID NO: 954870 - protein, 9 aa, Homo Sapiens
RILNLSRNR

SEQ ID NO: 954871 - protein, 9 aa, Homo Sapiens
LSLYTKPRM

SEQ ID NO: 954872 - protein, 9 aa, Homo Sapiens
SKSSWLRKN

SEQ ID NO: 954873 - protein, 9 aa, Homo Sapiens
FFRNLGFIL

SEQ ID NO: 954874 - protein, 9 aa, Homo Sapiens
RTHDAESVL

SEQ ID NO: 954875 - protein, 9 aa, Homo Sapiens
SWRAEPVEE

SEQ ID NO: 954876 - protein, 9 aa, Homo Sapiens
ISFGKNLNL

SEQ ID NO: 954877 - protein, 9 aa, Homo Sapiens
CGGSKWGCG

SEQ ID NO: 954878 - protein, 9 aa, Homo Sapiens
SKNPKKTHS

SEQ ID NO: 954879 - protein, 9 aa, Homo Sapiens
HPDSSPHPA

SEQ ID NO: 954880 - protein, 9 aa, Homo Sapiens
TGDKHSRGN

SEQ ID NO: 954881 - protein, 9 aa, Homo Sapiens
SRGPVSLSV

SEQ ID NO: 954882 - protein, 9 aa, Homo Sapiens
VKAEVTQTP

SEQ ID NO: 954883 - protein, 9 aa, Homo Sapiens
ISGWSPQIG

SEQ ID NO: 954884 - protein, 9 aa, Homo Sapiens
TRPCGSSLL

SEQ ID NO: 954885 - protein, 9 aa, Homo Sapiens
GGSKWGCGS

SEQ ID NO: 954886 - protein, 9 aa, Homo Sapiens
GTFLIILVL

SEQ ID NO: 954887 - protein, 9 aa, Homo Sapiens
IADKISFDF

SEQ ID NO: 954888 - protein, 9 aa, Homo Sapiens
TTSFLTVTT

SEQ ID NO: 954889 - protein, 9 aa, Homo Sapiens
ENLLCLGPA

SEQ ID NO: 954890 - protein, 9 aa, Homo Sapiens
FLKMMEARS

SEQ ID NO: 954891 - protein, 9 aa, Homo Sapiens
SKQEEILAG

SEQ ID NO: 954892 - protein, 9 aa, Homo Sapiens
YVEDETDVE

SEQ ID NO: 954893 - protein, 9 aa, Homo Sapiens
SINKSVRSR

SEQ ID NO: 954894 - protein, 9 aa, Homo Sapiens
NARFFTYSN

SEQ ID NO: 954895 - protein, 9 aa, Homo Sapiens
VKKNFDLCP

SEQ ID NO: 954896 - protein, 9 aa, Homo Sapiens
LYKLVTDGT

SEQ ID NO: 954897 - protein, 9 aa, Homo Sapiens
DAFGNKVKA

SEQ ID NO: 954898 - protein, 9 aa, Homo Sapiens
LVSEALSKD

SEQ ID NO: 954899 - protein, 9 aa, Homo Sapiens
TGWLKDLVK

SEQ ID NO: 954900 - protein, 9 aa, Homo Sapiens
ESVTCTYSP

SEQ ID NO: 954901 - protein, 9 aa, Homo Sapiens
MHDQKEKIR

SEQ ID NO: 954902 - protein, 9 aa, Homo Sapiens
GAHMGMFTE

SEQ ID NO: 954903 - protein, 9 aa, Homo Sapiens
HLFENLLCL

SEQ ID NO: 954904 - protein, 9 aa, Homo Sapiens
NHGFMVEVA

SEQ ID NO: 954905 - protein, 9 aa, Homo Sapiens
VTLSSLMKE

SEQ ID NO: 954906 - protein, 9 aa, Homo Sapiens
FFVFFFITL

SEQ ID NO: 954907 - protein, 9 aa, Homo Sapiens
NNRFSSEKI

SEQ ID NO: 954908 - protein, 9 aa, Homo Sapiens
QLRSKVHFR

SEQ ID NO: 954909 - protein, 9 aa, Homo Sapiens
TTIPSVKKI

SEQ ID NO: 954910 - protein, 9 aa, Homo Sapiens
IPQRVMEQM

SEQ ID NO: 954911 - protein, 9 aa, Homo Sapiens
GEGLTDSEF

SEQ ID NO: 954912 - protein, 9 aa, Homo Sapiens
PGKWGRPGA

SEQ ID NO: 954913 - protein, 9 aa, Homo Sapiens
VGNLAKDLE

SEQ ID NO: 954914 - protein, 9 aa, Homo Sapiens
LATEKSRWS

SEQ ID NO: 954915 - protein, 9 aa, Homo Sapiens
SYTSQSPPF

SEQ ID NO: 954916 - protein, 9 aa, Homo Sapiens
YSNFPLEQH

SEQ ID NO: 954917 - protein, 9 aa, Homo Sapiens
DLCPGVIVR

SEQ ID NO: 954918 - protein, 9 aa, Homo Sapiens
SAAALQAEN

SEQ ID NO: 954919 - protein, 9 aa, Homo Sapiens
LYLHYEQGK

SEQ ID NO: 954920 - protein, 9 aa, Homo Sapiens
PGAKSQELQ

SEQ ID NO: 954921 - protein, 9 aa, Homo Sapiens
LVIYVVTVL

SEQ ID NO: 954922 - protein, 9 aa, Homo Sapiens
ENRSPKEIR

SEQ ID NO: 954923 - protein, 9 aa, Homo Sapiens
SQSPPFLFN

SEQ ID NO: 954924 - protein, 9 aa, Homo Sapiens
AMKNGLVSL

SEQ ID NO: 954925 - protein, 9 aa, Homo Sapiens
YQARSDGDK

SEQ ID NO: 954926 - protein, 9 aa, Homo Sapiens
KEGANSDKI

SEQ ID NO: 954927 - protein, 9 aa, Homo Sapiens
EGFEGKFLY

SEQ ID NO: 954928 - protein, 9 aa, Homo Sapiens
DMLRPDSRD

SEQ ID NO: 954929 - protein, 9 aa, Homo Sapiens
QVGLLMEVS

SEQ ID NO: 954930 - protein, 9 aa, Homo Sapiens
LGLLQSGVI

SEQ ID NO: 954931 - protein, 9 aa, Homo Sapiens
SLNGRPMQG

SEQ ID NO: 954932 - protein, 9 aa, Homo Sapiens
SLVSEALSK

SEQ ID NO: 954933 - protein, 9 aa, Homo Sapiens
RKETMMVMT

SEQ ID NO: 954934 - protein, 9 aa, Homo Sapiens
TKHWNWLEQ

SEQ ID NO: 954935 - protein, 9 aa, Homo Sapiens
ELPIYFSDF

SEQ ID NO: 954936 - protein, 9 aa, Homo Sapiens
FGSVARMCA

SEQ ID NO: 954937 - protein, 9 aa, Homo Sapiens
FPTCKGQVQ

SEQ ID NO: 954938 - protein, 9 aa, Homo Sapiens
DERLPVNLN

SEQ ID NO: 954939 - protein, 9 aa, Homo Sapiens
EIKVIMVTG

SEQ ID NO: 954940 - protein, 9 aa, Homo Sapiens
AIIAAILKI

SEQ ID NO: 954941 - protein, 9 aa, Homo Sapiens
WRGEPVQSG

SEQ ID NO: 954942 - protein, 9 aa, Homo Sapiens
QGQDWVPLH

SEQ ID NO: 954943 - protein, 9 aa, Homo Sapiens
NQFFVTRHE

SEQ ID NO: 954944 - protein, 9 aa, Homo Sapiens
IILPSLESF

SEQ ID NO: 954945 - protein, 9 aa, Homo Sapiens
DDVIKKDSP

SEQ ID NO: 954946 - protein, 9 aa, Homo Sapiens
LKLSSGKDE

SEQ ID NO: 954947 - protein, 9 aa, Homo Sapiens
TQGFETLPS

SEQ ID NO: 954948 - protein, 9 aa, Homo Sapiens
EDLLRTLND

SEQ ID NO: 954949 - protein, 9 aa, Homo Sapiens
LVQFKNGNG

SEQ ID NO: 954950 - protein, 9 aa, Homo Sapiens
KGHSTSLEL

SEQ ID NO: 954951 - protein, 9 aa, Homo Sapiens
PPLLQPETN

SEQ ID NO: 954952 - protein, 9 aa, Homo Sapiens
LQQVGLLME

SEQ ID NO: 954953 - protein, 9 aa, Homo Sapiens
QRCERRLVE

SEQ ID NO: 954954 - protein, 9 aa, Homo Sapiens
GTEPSAAEF

SEQ ID NO: 954955 - protein, 9 aa, Homo Sapiens
MSGFNGSKE

SEQ ID NO: 954956 - protein, 9 aa, Homo Sapiens
RVMRLVKLF

SEQ ID NO: 954957 - protein, 9 aa, Homo Sapiens
GKKKKQMMY

SEQ ID NO: 954958 - protein, 9 aa, Homo Sapiens
TRKPEEESS

SEQ ID NO: 954959 - protein, 9 aa, Homo Sapiens
VVPPTLQGQ

SEQ ID NO: 954960 - protein, 9 aa, Homo Sapiens
SGRCRLTGR

SEQ ID NO: 954961 - protein, 9 aa, Homo Sapiens
CYRCLIQVG

SEQ ID NO: 954962 - protein, 9 aa, Homo Sapiens
VKRNKENIS

SEQ ID NO: 954963 - protein, 9 aa, Homo Sapiens
PEPPGQQGT

SEQ ID NO: 954964 - protein, 9 aa, Homo Sapiens
ELQANSFYD

SEQ ID NO: 954965 - protein, 9 aa, Homo Sapiens
ALQATVVAV

SEQ ID NO: 954966 - protein, 9 aa, Homo Sapiens
QQKLQKEIN

SEQ ID NO: 954967 - protein, 9 aa, Homo Sapiens
HLRTHDAES

SEQ ID NO: 954968 - protein, 9 aa, Homo Sapiens
PDREKVVTY

SEQ ID NO: 954969 - protein, 9 aa, Homo Sapiens
LRAIIEADS

SEQ ID NO: 954970 - protein, 9 aa, Homo Sapiens
DQHTVLSSG

SEQ ID NO: 954971 - protein, 9 aa, Homo Sapiens
IVGNVGSII

SEQ ID NO: 954972 - protein, 9 aa, Homo Sapiens
ARGAAHEKN

SEQ ID NO: 954973 - protein, 9 aa, Homo Sapiens
TSVSQNFSR

SEQ ID NO: 954974 - protein, 9 aa, Homo Sapiens
DCKLLELLW

SEQ ID NO: 954975 - protein, 9 aa, Homo Sapiens
FLFEELPAQ

SEQ ID NO: 954976 - protein, 9 aa, Homo Sapiens
WGRPGADGG

SEQ ID NO: 954977 - protein, 9 aa, Homo Sapiens
CFPSSTPLV

SEQ ID NO: 954978 - protein, 9 aa, Homo Sapiens
FLLLKEERS

SEQ ID NO: 954979 - protein, 9 aa, Homo Sapiens
RRNLPSKIS

SEQ ID NO: 954980 - protein, 9 aa, Homo Sapiens
MEQMGRSLL

SEQ ID NO: 954981 - protein, 9 aa, Homo Sapiens
SPQVLATTT

SEQ ID NO: 954982 - protein, 9 aa, Homo Sapiens
IGQKFCHGL

SEQ ID NO: 954983 - protein, 9 aa, Homo Sapiens
PEEESSQYL

SEQ ID NO: 954984 - protein, 9 aa, Homo Sapiens
HSENYSCEA

SEQ ID NO: 954985 - protein, 9 aa, Homo Sapiens
ALSLEEPDR

SEQ ID NO: 954986 - protein, 9 aa, Homo Sapiens
ELFTGLRAL

SEQ ID NO: 954987 - protein, 9 aa, Homo Sapiens
GQSDRGGDW

SEQ ID NO: 954988 - protein, 9 aa, Homo Sapiens
EPSSFLFEE

SEQ ID NO: 954989 - protein, 9 aa, Homo Sapiens
SSRSWFSNA

SEQ ID NO: 954990 - protein, 9 aa, Homo Sapiens
KHSFRKPRL

SEQ ID NO: 954991 - protein, 9 aa, Homo Sapiens
TKTDPVVAD

SEQ ID NO: 954992 - protein, 9 aa, Homo Sapiens
YLREGKCWL

SEQ ID NO: 954993 - protein, 9 aa, Homo Sapiens
PSFPNLTLF

SEQ ID NO: 954994 - protein, 9 aa, Homo Sapiens
LLFLKSATP

SEQ ID NO: 954995 - protein, 9 aa, Homo Sapiens
FLYESWTKK

SEQ ID NO: 954996 - protein, 9 aa, Homo Sapiens
APNPVDNAG

SEQ ID NO: 954997 - protein, 9 aa, Homo Sapiens
FPSSTPLVV

SEQ ID NO: 954998 - protein, 9 aa, Homo Sapiens
CKLLELLWN

SEQ ID NO: 954999 - protein, 9 aa, Homo Sapiens
MGINNRFSS

SEQ ID NO: 955000 - protein, 9 aa, Homo Sapiens
GLARNIYKD

SEQ ID NO: 955001 - protein, 9 aa, Homo Sapiens
FSYMVFSIL

SEQ ID NO: 955002 - protein, 9 aa, Homo Sapiens
YRILNLSRN

SEQ ID NO: 955003 - protein, 9 aa, Homo Sapiens
KRKSLTLIV

SEQ ID NO: 955004 - protein, 9 aa, Homo Sapiens
LSDYFSSVP

SEQ ID NO: 955005 - protein, 9 aa, Homo Sapiens
EQSPAEGDG

SEQ ID NO: 955006 - protein, 9 aa, Homo Sapiens
RAEPVEEQE

SEQ ID NO: 955007 - protein, 9 aa, Homo Sapiens
NNVGGLLGL

SEQ ID NO: 955008 - protein, 9 aa, Homo Sapiens
GAKSQELQE

SEQ ID NO: 955009 - protein, 9 aa, Homo Sapiens
IREVASKLS

SEQ ID NO: 955010 - protein, 9 aa, Homo Sapiens
FFISIPVKS

SEQ ID NO: 955011 - protein, 9 aa, Homo Sapiens
VGRSYPVRR

SEQ ID NO: 955012 - protein, 9 aa, Homo Sapiens
AEGDGNCVT

SEQ ID NO: 955013 - protein, 9 aa, Homo Sapiens
DVHRDETAV

SEQ ID NO: 955014 - protein, 9 aa, Homo Sapiens
QGIILPSLE

SEQ ID NO: 955015 - protein, 9 aa, Homo Sapiens
GSCGGSKWG

SEQ ID NO: 955016 - protein, 9 aa, Homo Sapiens
KKKEGYVLY

SEQ ID NO: 955017 - protein, 9 aa, Homo Sapiens
VSISCPPHP

SEQ ID NO: 955018 - protein, 9 aa, Homo Sapiens
DRKRQDKAL

SEQ ID NO: 955019 - protein, 9 aa, Homo Sapiens
LKNFIRSLD

SEQ ID NO: 955020 - protein, 9 aa, Homo Sapiens
CGSCGGSKW

SEQ ID NO: 955021 - protein, 9 aa, Homo Sapiens
GKALQATVV

SEQ ID NO: 955022 - protein, 9 aa, Homo Sapiens
EEKMHDQKE

SEQ ID NO: 955023 - protein, 9 aa, Homo Sapiens
DKATVVGDQ

SEQ ID NO: 955024 - protein, 9 aa, Homo Sapiens
KEDELVGSN

SEQ ID NO: 955025 - protein, 9 aa, Homo Sapiens
NIRSVAFLC

SEQ ID NO: 955026 - protein, 9 aa, Homo Sapiens
GLKKRKSLT

SEQ ID NO: 955027 - protein, 9 aa, Homo Sapiens
RHFFRNLGF

SEQ ID NO: 955028 - protein, 9 aa, Homo Sapiens
GLCGEFIGE

SEQ ID NO: 955029 - protein, 9 aa, Homo Sapiens
CLDYAQQNL

SEQ ID NO: 955030 - protein, 9 aa, Homo Sapiens
WALKYMNRQ

SEQ ID NO: 955031 - protein, 9 aa, Homo Sapiens
SFVRLNYQH

SEQ ID NO: 955032 - protein, 9 aa, Homo Sapiens
YLFNISEAE

SEQ ID NO: 955033 - protein, 9 aa, Homo Sapiens
EPSAAEFQG

SEQ ID NO: 955034 - protein, 9 aa, Homo Sapiens
NLCSERAYN

SEQ ID NO: 955035 - protein, 9 aa, Homo Sapiens
KMMEARSRG

SEQ ID NO: 955036 - protein, 9 aa, Homo Sapiens
WLLRKYTRM

SEQ ID NO: 955037 - protein, 9 aa, Homo Sapiens
SEPGLHTWA

SEQ ID NO: 955038 - protein, 9 aa, Homo Sapiens
KDLEFGVGD

SEQ ID NO: 955039 - protein, 9 aa, Homo Sapiens
KHGVVYDTC

SEQ ID NO: 955040 - protein, 9 aa, Homo Sapiens
NSSLIEHYR

SEQ ID NO: 955041 - protein, 9 aa, Homo Sapiens
PVSLSVSFQ

SEQ ID NO: 955042 - protein, 9 aa, Homo Sapiens
NLQQVGLLM

SEQ ID NO: 955043 - protein, 9 aa, Homo Sapiens
EEVPGVFSR

SEQ ID NO: 955044 - protein, 9 aa, Homo Sapiens
LARNIYKDP

SEQ ID NO: 955045 - protein, 9 aa, Homo Sapiens
VPPTLQGQD

SEQ ID NO: 955046 - protein, 9 aa, Homo Sapiens
TSGTPFFLP

SEQ ID NO: 955047 - protein, 9 aa, Homo Sapiens
GLSLRFNSV

SEQ ID NO: 955048 - protein, 9 aa, Homo Sapiens
SYVEDETDV

SEQ ID NO: 955049 - protein, 9 aa, Homo Sapiens
DLEFGVGDL

SEQ ID NO: 955050 - protein, 9 aa, Homo Sapiens
ERPEEKLKK

SEQ ID NO: 955051 - protein, 9 aa, Homo Sapiens
IITGFLDAL

SEQ ID NO: 955052 - protein, 9 aa, Homo Sapiens
LYKEVLKAC

SEQ ID NO: 955053 - protein, 9 aa, Homo Sapiens
RQPHLGLLQ

SEQ ID NO: 955054 - protein, 9 aa, Homo Sapiens
CRSGTPDLR

SEQ ID NO: 955055 - protein, 9 aa, Homo Sapiens
SFDFSLARG

SEQ ID NO: 955056 - protein, 9 aa, Homo Sapiens
SIISNMNAS

SEQ ID NO: 955057 - protein, 9 aa, Homo Sapiens
GSAESPSTT

SEQ ID NO: 955058 - protein, 9 aa, Homo Sapiens
HFFRNLGFI

SEQ ID NO: 955059 - protein, 9 aa, Homo Sapiens
PPNIIGVKK

SEQ ID NO: 955060 - protein, 9 aa, Homo Sapiens
TPSRGPVSL

SEQ ID NO: 955061 - protein, 9 aa, Homo Sapiens
LGLLGMSGT

SEQ ID NO: 955062 - protein, 9 aa, Homo Sapiens
TWARVSLKD

SEQ ID NO: 955063 - protein, 9 aa, Homo Sapiens
LRKYTRMEI

SEQ ID NO: 955064 - protein, 9 aa, Homo Sapiens
SGERFSSSE

SEQ ID NO: 955065 - protein, 9 aa, Homo Sapiens
MSGILSNHG

SEQ ID NO: 955066 - protein, 9 aa, Homo Sapiens
GDVSIYTNV

SEQ ID NO: 955067 - protein, 9 aa, Homo Sapiens
KWLSFYSGY

SEQ ID NO: 955068 - protein, 9 aa, Homo Sapiens
MKAAMYSKD

SEQ ID NO: 955069 - protein, 9 aa, Homo Sapiens
GISGWSPQI

SEQ ID NO: 955070 - protein, 9 aa, Homo Sapiens
DKERRTWEE

SEQ ID NO: 955071 - protein, 9 aa, Homo Sapiens
ALDGSQSKR

SEQ ID NO: 955072 - protein, 9 aa, Homo Sapiens
QSLGRGCHR

SEQ ID NO: 955073 - protein, 9 aa, Homo Sapiens
GDKATVVGD

SEQ ID NO: 955074 - protein, 9 aa, Homo Sapiens
DPRESQNLL

SEQ ID NO: 955075 - protein, 9 aa, Homo Sapiens
LLAENEATG

SEQ ID NO: 955076 - protein, 9 aa, Homo Sapiens
SLCLLTLDS

SEQ ID NO: 955077 - protein, 9 aa, Homo Sapiens
ATASGDEVR

SEQ ID NO: 955078 - protein, 9 aa, Homo Sapiens
EGKGKDAFG

SEQ ID NO: 955079 - protein, 9 aa, Homo Sapiens
LFALFLVIY

SEQ ID NO: 955080 - protein, 9 aa, Homo Sapiens
PTCKGQVQS

SEQ ID NO: 955081 - protein, 9 aa, Homo Sapiens
LPSKISLPT

SEQ ID NO: 955082 - protein, 9 aa, Homo Sapiens
SKAKPAVGR

SEQ ID NO: 955083 - protein, 9 aa, Homo Sapiens
ALGLEGAHM

SEQ ID NO: 955084 - protein, 9 aa, Homo Sapiens
SQVSKEVKT

SEQ ID NO: 955085 - protein, 9 aa, Homo Sapiens
LREEVPGVF

SEQ ID NO: 955086 - protein, 9 aa, Homo Sapiens
SKENELKAV

SEQ ID NO: 955087 - protein, 9 aa, Homo Sapiens
VFFFITLPL

SEQ ID NO: 955088 - protein, 9 aa, Homo Sapiens
GLRPLWSEL

SEQ ID NO: 955089 - protein, 9 aa, Homo Sapiens
GKCWLDGKG

SEQ ID NO: 955090 - protein, 9 aa, Homo Sapiens
QGQYLREGK

SEQ ID NO: 955091 - protein, 9 aa, Homo Sapiens
LSKAKPAVG

SEQ ID NO: 955092 - protein, 9 aa, Homo Sapiens
IQRIASSSL

SEQ ID NO: 955093 - protein, 9 aa, Homo Sapiens
KLSINKSVR

SEQ ID NO: 955094 - protein, 9 aa, Homo Sapiens
FEGKFLYES

SEQ ID NO: 955095 - protein, 9 aa, Homo Sapiens
RRQLILSGS

SEQ ID NO: 955096 - protein, 9 aa, Homo Sapiens
IASSSLQDP

SEQ ID NO: 955097 - protein, 9 aa, Homo Sapiens
QKAIGKYRI

SEQ ID NO: 955098 - protein, 9 aa, Homo Sapiens
QMPTLEHTT

SEQ ID NO: 955099 - protein, 9 aa, Homo Sapiens
IIEADSLIT

SEQ ID NO: 955100 - protein, 9 aa, Homo Sapiens
ISHSIFSLH

SEQ ID NO: 955101 - protein, 9 aa, Homo Sapiens
KVFSVHPWS

SEQ ID NO: 955102 - protein, 9 aa, Homo Sapiens
SSLMKELVL

SEQ ID NO: 955103 - protein, 9 aa, Homo Sapiens
ERRLVEQVL

SEQ ID NO: 955104 - protein, 9 aa, Homo Sapiens
LLLKEERSS

SEQ ID NO: 955105 - protein, 9 aa, Homo Sapiens
PTGKPGKWG

SEQ ID NO: 955106 - protein, 9 aa, Homo Sapiens
LQANSFYDR

SEQ ID NO: 955107 - protein, 9 aa, Homo Sapiens
GRKKKKKQN

SEQ ID NO: 955108 - protein, 9 aa, Homo Sapiens
GPQIQLSGQ

SEQ ID NO: 955109 - protein, 9 aa, Homo Sapiens
RLVKVNISF

SEQ ID NO: 955110 - protein, 9 aa, Homo Sapiens
GMISAHCNF

SEQ ID NO: 955111 - protein, 9 aa, Homo Sapiens
NLEGLKMIA

SEQ ID NO: 955112 - protein, 9 aa, Homo Sapiens
KVPDSSLLA

SEQ ID NO: 955113 - protein, 9 aa, Homo Sapiens
GKPGKWGRP

SEQ ID NO: 955114 - protein, 9 aa, Homo Sapiens
SNIRKSYNS

SEQ ID NO: 955115 - protein, 9 aa, Homo Sapiens
LPVNLNFTL

SEQ ID NO: 955116 - protein, 9 aa, Homo Sapiens
KEAPSFWIC

SEQ ID NO: 955117 - protein, 9 aa, Homo Sapiens
RLGPGTRLF

SEQ ID NO: 955118 - protein, 9 aa, Homo Sapiens
LDYAQQNLY

SEQ ID NO: 955119 - protein, 9 aa, Homo Sapiens
QCKHGVVYD

SEQ ID NO: 955120 - protein, 9 aa, Homo Sapiens
SEALSKDSF

SEQ ID NO: 955121 - protein, 9 aa, Homo Sapiens
KKRKSLTLI

SEQ ID NO: 955122 - protein, 9 aa, Homo Sapiens
ERFSSSEVM

SEQ ID NO: 955123 - protein, 9 aa, Homo Sapiens
PFFLPSPAT

SEQ ID NO: 955124 - protein, 9 aa, Homo Sapiens
ENYSCEANN

SEQ ID NO: 955125 - protein, 9 aa, Homo Sapiens
LGLLREEAM

SEQ ID NO: 955126 - protein, 9 aa, Homo Sapiens
LSVSFQPLA

SEQ ID NO: 955127 - protein, 9 aa, Homo Sapiens
AKDLEFGVG

SEQ ID NO: 955128 - protein, 9 aa, Homo Sapiens
GEPEPPGQQ

SEQ ID NO: 955129 - protein, 9 aa, Homo Sapiens
LGPGTRLFL

SEQ ID NO: 955130 - protein, 9 aa, Homo Sapiens
KENLSAFFI

SEQ ID NO: 955131 - protein, 9 aa, Homo Sapiens
MGGDVSIYT

SEQ ID NO: 955132 - protein, 9 aa, Homo Sapiens
LSYVEDETD

SEQ ID NO: 955133 - protein, 9 aa, Homo Sapiens
RHRAEALPL

SEQ ID NO: 955134 - protein, 9 aa, Homo Sapiens
ETGYTPGDT

SEQ ID NO: 955135 - protein, 9 aa, Homo Sapiens
VEVESLKRK

SEQ ID NO: 955136 - protein, 9 aa, Homo Sapiens
TSVTKLSLY

SEQ ID NO: 955137 - protein, 9 aa, Homo Sapiens
VGSIISNMN

SEQ ID NO: 955138 - protein, 9 aa, Homo Sapiens
IRRYKLSEE

SEQ ID NO: 955139 - protein, 9 aa, Homo Sapiens
YTPGDTMDS

SEQ ID NO: 955140 - protein, 9 aa, Homo Sapiens
YVSRHRYDH

SEQ ID NO: 955141 - protein, 9 aa, Homo Sapiens
AEFQGKGSI

SEQ ID NO: 955142 - protein, 9 aa, Homo Sapiens
EAPSFWICH

SEQ ID NO: 955143 - protein, 9 aa, Homo Sapiens
AEALPLERE

SEQ ID NO: 955144 - protein, 9 aa, Homo Sapiens
FILLPDLEL

SEQ ID NO: 955145 - protein, 9 aa, Homo Sapiens
LQKEINAVL

SEQ ID NO: 955146 - protein, 9 aa, Homo Sapiens
EKDEEDEEN

SEQ ID NO: 955147 - protein, 9 aa, Homo Sapiens
AEVACSETA

SEQ ID NO: 955148 - protein, 9 aa, Homo Sapiens
PVNLNFTLK

SEQ ID NO: 955149 - protein, 9 aa, Homo Sapiens
SLSGKKKKQ

SEQ ID NO: 955150 - protein, 9 aa, Homo Sapiens
GINNRFSSE

SEQ ID NO: 955151 - protein, 9 aa, Homo Sapiens
FPENRSPKE

SEQ ID NO: 955152 - protein, 9 aa, Homo Sapiens
FLRKVFSVH

SEQ ID NO: 955153 - protein, 9 aa, Homo Sapiens
PQALRLFIL

SEQ ID NO: 955154 - protein, 9 aa, Homo Sapiens
AAILKIPTS

SEQ ID NO: 955155 - protein, 9 aa, Homo Sapiens
LPLEREDSG

SEQ ID NO: 955156 - protein, 9 aa, Homo Sapiens
KSGPFRKKA

SEQ ID NO: 955157 - protein, 9 aa, Homo Sapiens
QNLLDNRAP

SEQ ID NO: 955158 - protein, 9 aa, Homo Sapiens
LSEPGLHTW

SEQ ID NO: 955159 - protein, 9 aa, Homo Sapiens
TSGERFSSS

SEQ ID NO: 955160 - protein, 9 aa, Homo Sapiens
QSCGPPPQL

SEQ ID NO: 955161 - protein, 9 aa, Homo Sapiens
YTLFNLISV

SEQ ID NO: 955162 - protein, 9 aa, Homo Sapiens
ETGTTNTAI

SEQ ID NO: 955163 - protein, 9 aa, Homo Sapiens
DANLSIRDK

SEQ ID NO: 955164 - protein, 9 aa, Homo Sapiens
RFRGFGFVT

SEQ ID NO: 955165 - protein, 9 aa, Homo Sapiens
TGFLDALIQ

SEQ ID NO: 955166 - protein, 9 aa, Homo Sapiens
VFLEKKPDV

SEQ ID NO: 955167 - protein, 9 aa, Homo Sapiens
LPTFRKFTR

SEQ ID NO: 955168 - protein, 9 aa, Homo Sapiens
NAGLLSFAT

SEQ ID NO: 955169 - protein, 9 aa, Homo Sapiens
TVALDGSQS

SEQ ID NO: 955170 - protein, 9 aa, Homo Sapiens
PSTRTTSFL

SEQ ID NO: 955171 - protein, 9 aa, Homo Sapiens
GTRLFLARM

SEQ ID NO: 955172 - protein, 9 aa, Homo Sapiens
GLGGGRKWK

SEQ ID NO: 955173 - protein, 9 aa, Homo Sapiens
GCYRCLIQV

SEQ ID NO: 955174 - protein, 9 aa, Homo Sapiens
KEERSSHVQ

SEQ ID NO: 955175 - protein, 9 aa, Homo Sapiens
HYMTLPVSP

SEQ ID NO: 955176 - protein, 9 aa, Homo Sapiens
AHLCRLRVQ

SEQ ID NO: 955177 - protein, 9 aa, Homo Sapiens
HQLRVHCRA

SEQ ID NO: 955178 - protein, 9 aa, Homo Sapiens
FRKSPLAEE

SEQ ID NO: 955179 - protein, 9 aa, Homo Sapiens
LSEIMCDVT

SEQ ID NO: 955180 - protein, 9 aa, Homo Sapiens
RQLPQLSPK

SEQ ID NO: 955181 - protein, 9 aa, Homo Sapiens
AAMYSKDKV

SEQ ID NO: 955182 - protein, 9 aa, Homo Sapiens
FWNKNYFGN

SEQ ID NO: 955183 - protein, 9 aa, Homo Sapiens
GLQREAIEE

SEQ ID NO: 955184 - protein, 9 aa, Homo Sapiens
GGHINTAVN

SEQ ID NO: 955185 - protein, 9 aa, Homo Sapiens
EDIPFTKTD

SEQ ID NO: 955186 - protein, 9 aa, Homo Sapiens
LLNLQQVGL

SEQ ID NO: 955187 - protein, 9 aa, Homo Sapiens
PDVIIGEGL

SEQ ID NO: 955188 - protein, 9 aa, Homo Sapiens
EYEGGHINT

SEQ ID NO: 955189 - protein, 9 aa, Homo Sapiens
DFSLARGLD

SEQ ID NO: 955190 - protein, 9 aa, Homo Sapiens
FFSYMVFSI

SEQ ID NO: 955191 - protein, 9 aa, Homo Sapiens
LGTSGTPFF

SEQ ID NO: 955192 - protein, 9 aa, Homo Sapiens
FKKAIQRIA

SEQ ID NO: 955193 - protein, 9 aa, Homo Sapiens
RLVEQVLYH

SEQ ID NO: 955194 - protein, 9 aa, Homo Sapiens
YEWTPLMYA

SEQ ID NO: 955195 - protein, 9 aa, Homo Sapiens
QNYGIFLKM

SEQ ID NO: 955196 - protein, 9 aa, Homo Sapiens
CQIKAFGLS

SEQ ID NO: 955197 - protein, 9 aa, Homo Sapiens
ISFDFSLAR

SEQ ID NO: 955198 - protein, 9 aa, Homo Sapiens
DQQAEAPDS

SEQ ID NO: 955199 - protein, 9 aa, Homo Sapiens
KDAFGNKVK

SEQ ID NO: 955200 - protein, 9 aa, Homo Sapiens
NRQASQMLL

SEQ ID NO: 955201 - protein, 9 aa, Homo Sapiens
IPVVALAAS

SEQ ID NO: 955202 - protein, 9 aa, Homo Sapiens
FFILLPDLE

SEQ ID NO: 955203 - protein, 9 aa, Homo Sapiens
LPPPQGGSQ

SEQ ID NO: 955204 - protein, 9 aa, Homo Sapiens
LCISTGIYG

SEQ ID NO: 955205 - protein, 9 aa, Homo Sapiens
LQGQDWVPL

SEQ ID NO: 955206 - protein, 9 aa, Homo Sapiens
VREGNSSVI

SEQ ID NO: 955207 - protein, 9 aa, Homo Sapiens
KACALNDDL

SEQ ID NO: 955208 - protein, 9 aa, Homo Sapiens
QGGVQYGAE

SEQ ID NO: 955209 - protein, 9 aa, Homo Sapiens
RKYTRMEIF

SEQ ID NO: 955210 - protein, 9 aa, Homo Sapiens
QNFSRSVPG

SEQ ID NO: 955211 - protein, 9 aa, Homo Sapiens
AQAMKNGLV

SEQ ID NO: 955212 - protein, 9 aa, Homo Sapiens
GLAKREAWL

SEQ ID NO: 955213 - protein, 9 aa, Homo Sapiens
PDEGFEGKF

SEQ ID NO: 955214 - protein, 9 aa, Homo Sapiens
LFILNWFGW

SEQ ID NO: 955215 - protein, 9 aa, Homo Sapiens
VLATTTPKI

SEQ ID NO: 955216 - protein, 9 aa, Homo Sapiens
HPSLCLLTL

SEQ ID NO: 955217 - protein, 9 aa, Homo Sapiens
VRTILVLQV

SEQ ID NO: 955218 - protein, 9 aa, Homo Sapiens
DEKIDQMKR

SEQ ID NO: 955219 - protein, 9 aa, Homo Sapiens
QKWLLRKYT

SEQ ID NO: 955220 - protein, 9 aa, Homo Sapiens
EKETSFELI

SEQ ID NO: 955221 - protein, 9 aa, Homo Sapiens
LRALARGLL

SEQ ID NO: 955222 - protein, 9 aa, Homo Sapiens
RFNSVQKLK

SEQ ID NO: 955223 - protein, 9 aa, Homo Sapiens
VSQNFSRSV

SEQ ID NO: 955224 - protein, 9 aa, Homo Sapiens
LREGKCWLD

SEQ ID NO: 955225 - protein, 9 aa, Homo Sapiens
KKKKKQNQQ

SEQ ID NO: 955226 - protein, 9 aa, Homo Sapiens
VDFQQRPGR

SEQ ID NO: 955227 - protein, 9 aa, Homo Sapiens
IDKERRTWE

SEQ ID NO: 955228 - protein, 9 aa, Homo Sapiens
GHSTSLELV

SEQ ID NO: 955229 - protein, 9 aa, Homo Sapiens
KCRLSEIMC

SEQ ID NO: 955230 - protein, 9 aa, Homo Sapiens
SSSKNLYKL

SEQ ID NO: 955231 - protein, 9 aa, Homo Sapiens
VNLNFTLKD

SEQ ID NO: 955232 - protein, 9 aa, Homo Sapiens
LEEQVRTIL

SEQ ID NO: 955233 - protein, 9 aa, Homo Sapiens
PENRSPKEI

SEQ ID NO: 955234 - protein, 9 aa, Homo Sapiens
GDMVFLEKK

SEQ ID NO: 955235 - protein, 9 aa, Homo Sapiens
LKMIAVLIV

SEQ ID NO: 955236 - protein, 9 aa, Homo Sapiens
FKRIAGEAS

SEQ ID NO: 955237 - protein, 9 aa, Homo Sapiens
GDTMDSGET

SEQ ID NO: 955238 - protein, 9 aa, Homo Sapiens
HGFMVEVAH

SEQ ID NO: 955239 - protein, 9 aa, Homo Sapiens
TPDLRDGEQ

SEQ ID NO: 955240 - protein, 9 aa, Homo Sapiens
AEKDEKIDQ

SEQ ID NO: 955241 - protein, 9 aa, Homo Sapiens
QSDRGGDWR

SEQ ID NO: 955242 - protein, 9 aa, Homo Sapiens
GICQIKAFG

SEQ ID NO: 955243 - protein, 9 aa, Homo Sapiens
GLVDFQQRP

SEQ ID NO: 955244 - protein, 9 aa, Homo Sapiens
KETAWQLPM

SEQ ID NO: 955245 - protein, 9 aa, Homo Sapiens
GVKKKEGYV

SEQ ID NO: 955246 - protein, 9 aa, Homo Sapiens
RDPLTKRFR

SEQ ID NO: 955247 - protein, 9 aa, Homo Sapiens
LCLGPARGT

SEQ ID NO: 955248 - protein, 9 aa, Homo Sapiens
RTILVLQVK

SEQ ID NO: 955249 - protein, 9 aa, Homo Sapiens
TLFLRKVFS

SEQ ID NO: 955250 - protein, 9 aa, Homo Sapiens
QYPDVHRDE

SEQ ID NO: 955251 - protein, 9 aa, Homo Sapiens
MKELVLKSN

SEQ ID NO: 955252 - protein, 9 aa, Homo Sapiens
PFFVGLHSC

SEQ ID NO: 955253 - protein, 9 aa, Homo Sapiens
LRFNSVQKL

SEQ ID NO: 955254 - protein, 9 aa, Homo Sapiens
LVREERHRR

SEQ ID NO: 955255 - protein, 9 aa, Homo Sapiens
GHANHGFMV

SEQ ID NO: 955256 - protein, 9 aa, Homo Sapiens
RFSSSEVMN

SEQ ID NO: 955257 - protein, 9 aa, Homo Sapiens
RHRYDHGTF

SEQ ID NO: 955258 - protein, 9 aa, Homo Sapiens
TARFETKIS

SEQ ID NO: 955259 - protein, 9 aa, Homo Sapiens
QGCYRCLIQ

SEQ ID NO: 955260 - protein, 9 aa, Homo Sapiens
TSKLVSNGV

SEQ ID NO: 955261 - protein, 9 aa, Homo Sapiens
DPNFDLRKK

SEQ ID NO: 955262 - protein, 9 aa, Homo Sapiens
DFQQRPGRH

SEQ ID NO: 955263 - protein, 9 aa, Homo Sapiens
SSQYLSSRK

SEQ ID NO: 955264 - protein, 9 aa, Homo Sapiens
CERRLVEQV

SEQ ID NO: 955265 - protein, 9 aa, Homo Sapiens
KFKIKITSK

SEQ ID NO: 955266 - protein, 9 aa, Homo Sapiens
LFLGCQLAD

SEQ ID NO: 955267 - protein, 9 aa, Homo Sapiens
VALAASLVF

SEQ ID NO: 955268 - protein, 9 aa, Homo Sapiens
IQDAKQRLT

SEQ ID NO: 955269 - protein, 9 aa, Homo Sapiens
LEDQGCYRC

SEQ ID NO: 955270 - protein, 9 aa, Homo Sapiens
TGEIWLKNF

SEQ ID NO: 955271 - protein, 9 aa, Homo Sapiens
EINAVLPNK

SEQ ID NO: 955272 - protein, 9 aa, Homo Sapiens
AWDPRESQN

SEQ ID NO: 955273 - protein, 9 aa, Homo Sapiens
GNGQPKAVR

SEQ ID NO: 955274 - protein, 9 aa, Homo Sapiens
PRNLSVVKE

SEQ ID NO: 955275 - protein, 9 aa, Homo Sapiens
HLCRLRVQK

SEQ ID NO: 955276 - protein, 9 aa, Homo Sapiens
MVFLEKKPD

SEQ ID NO: 955277 - protein, 9 aa, Homo Sapiens
EEHSENYSC

SEQ ID NO: 955278 - protein, 9 aa, Homo Sapiens
QRPSAAALQ

SEQ ID NO: 955279 - protein, 9 aa, Homo Sapiens
EFQGKGSIS

SEQ ID NO: 955280 - protein, 9 aa, Homo Sapiens
SLMKELVLK

SEQ ID NO: 955281 - protein, 9 aa, Homo Sapiens
GSSVLATLS

SEQ ID NO: 955282 - protein, 9 aa, Homo Sapiens
LRVKLTVAL

SEQ ID NO: 955283 - protein, 9 aa, Homo Sapiens
FLQSLNGVW

SEQ ID NO: 955284 - protein, 9 aa, Homo Sapiens
FANTWESWD

SEQ ID NO: 955285 - protein, 9 aa, Homo Sapiens
QFFVTRHEK

SEQ ID NO: 955286 - protein, 9 aa, Homo Sapiens
SFVNDIFKR

SEQ ID NO: 955287 - protein, 9 aa, Homo Sapiens
LLSPSLPAS

SEQ ID NO: 955288 - protein, 9 aa, Homo Sapiens
DFGLATEKS

SEQ ID NO: 955289 - protein, 9 aa, Homo Sapiens
ALKLSSGKD

SEQ ID NO: 955290 - protein, 9 aa, Homo Sapiens
QDKALVGLK

SEQ ID NO: 955291 - protein, 9 aa, Homo Sapiens
GDQQAEAPD

SEQ ID NO: 955292 - protein, 9 aa, Homo Sapiens
LLCLGPARG

SEQ ID NO: 955293 - protein, 9 aa, Homo Sapiens
GMSGTESQD

SEQ ID NO: 955294 - protein, 9 aa, Homo Sapiens
ISSFFHFLQ

SEQ ID NO: 955295 - protein, 9 aa, Homo Sapiens
TVVGDQQAE

SEQ ID NO: 955296 - protein, 9 aa, Homo Sapiens
KEYEEEEWA

SEQ ID NO: 955297 - protein, 9 aa, Homo Sapiens
KPLFLKLLK

SEQ ID NO: 955298 - protein, 9 aa, Homo Sapiens
EPQALRLFI

SEQ ID NO: 955299 - protein, 9 aa, Homo Sapiens
RMLVREERH

SEQ ID NO: 955300 - protein, 9 aa, Homo Sapiens
HTWARVSLK

SEQ ID NO: 955301 - protein, 9 aa, Homo Sapiens
TFRKFTRPE

SEQ ID NO: 955302 - protein, 9 aa, Homo Sapiens
ELKEPNEVL

SEQ ID NO: 955303 - protein, 9 aa, Homo Sapiens
PSLCLLTLD

SEQ ID NO: 955304 - protein, 9 aa, Homo Sapiens
NLLQQLLPK

SEQ ID NO: 955305 - protein, 9 aa, Homo Sapiens
IKITSKLVS

SEQ ID NO: 955306 - protein, 9 aa, Homo Sapiens
EYTSKTSTG

SEQ ID NO: 955307 - protein, 9 aa, Homo Sapiens
MSGTESQDT

SEQ ID NO: 955308 - protein, 9 aa, Homo Sapiens
IYKDPSIEN

SEQ ID NO: 955309 - protein, 9 aa, Homo Sapiens
RKGVFRKSP

SEQ ID NO: 955310 - protein, 9 aa, Homo Sapiens
RISHSIFSL

SEQ ID NO: 955311 - protein, 9 aa, Homo Sapiens
EIMCDVTIV

SEQ ID NO: 955312 - protein, 9 aa, Homo Sapiens
KNKWWYNKG

SEQ ID NO: 955313 - protein, 9 aa, Homo Sapiens
EKEINDRQM

SEQ ID NO: 955314 - protein, 9 aa, Homo Sapiens
DAFNLSSSH

SEQ ID NO: 955315 - protein, 9 aa, Homo Sapiens
QYLREGKCW

SEQ ID NO: 955316 - protein, 9 aa, Homo Sapiens
LKEPNEVLK

SEQ ID NO: 955317 - protein, 9 aa, Homo Sapiens
TITNNFGSV

SEQ ID NO: 955318 - protein, 9 aa, Homo Sapiens
RSYTSQSPP

SEQ ID NO: 955319 - protein, 9 aa, Homo Sapiens
PVVALAASL

SEQ ID NO: 955320 - protein, 9 aa, Homo Sapiens
KKQNQQIDY

SEQ ID NO: 955321 - protein, 9 aa, Homo Sapiens
MRLVKLFSK

SEQ ID NO: 955322 - protein, 9 aa, Homo Sapiens
KLSSGKDEI

SEQ ID NO: 955323 - protein, 9 aa, Homo Sapiens
YMTLPVSPD

SEQ ID NO: 955324 - protein, 9 aa, Homo Sapiens
QGHANHGFM

SEQ ID NO: 955325 - protein, 9 aa, Homo Sapiens
AVSISCPPH

SEQ ID NO: 955326 - protein, 9 aa, Homo Sapiens
IRKSYNSVI

SEQ ID NO: 955327 - protein, 9 aa, Homo Sapiens
YNSVIRELL

SEQ ID NO: 955328 - protein, 9 aa, Homo Sapiens
KISFGKNLN

SEQ ID NO: 955329 - protein, 9 aa, Homo Sapiens
LKIPTSRGR

SEQ ID NO: 955330 - protein, 9 aa, Homo Sapiens
KAEVTQTPR

SEQ ID NO: 955331 - protein, 9 aa, Homo Sapiens
FETKISEDD

SEQ ID NO: 955332 - protein, 9 aa, Homo Sapiens
NQQIDYSRG

SEQ ID NO: 955333 - protein, 9 aa, Homo Sapiens
KQNQQIDYS

SEQ ID NO: 955334 - protein, 9 aa, Homo Sapiens
KPQLLPNAQ

SEQ ID NO: 955335 - protein, 9 aa, Homo Sapiens
IENADARNE

SEQ ID NO: 955336 - protein, 9 aa, Homo Sapiens
LTLDSLSAF

SEQ ID NO: 955337 - protein, 9 aa, Homo Sapiens
IFSGRCRLT

SEQ ID NO: 955338 - protein, 9 aa, Homo Sapiens
KDPSIENLI

SEQ ID NO: 955339 - protein, 9 aa, Homo Sapiens
AVKNLLQQL

SEQ ID NO: 955340 - protein, 9 aa, Homo Sapiens
EHSENYSCE

SEQ ID NO: 955341 - protein, 9 aa, Homo Sapiens
SAHCNFCLT

SEQ ID NO: 955342 - protein, 9 aa, Homo Sapiens
AISKSLLYA

SEQ ID NO: 955343 - protein, 9 aa, Homo Sapiens
VAISKSLLY

SEQ ID NO: 955344 - protein, 9 aa, Homo Sapiens
WDPRESQNL

SEQ ID NO: 955345 - protein, 9 aa, Homo Sapiens
ICDFGLARN

SEQ ID NO: 955346 - protein, 9 aa, Homo Sapiens
PSFWICHPE

SEQ ID NO: 955347 - protein, 9 aa, Homo Sapiens
IHTSVSQNF

SEQ ID NO: 955348 - protein, 9 aa, Homo Sapiens
RFSSEKIAI

SEQ ID NO: 955349 - protein, 9 aa, Homo Sapiens
EMKARKISF

SEQ ID NO: 955350 - protein, 9 aa, Homo Sapiens
SSPETPVLT

SEQ ID NO: 955351 - protein, 9 aa, Homo Sapiens
ADSLITTPE

SEQ ID NO: 955352 - protein, 9 aa, Homo Sapiens
GNSSVINCT

SEQ ID NO: 955353 - protein, 9 aa, Homo Sapiens
RGRQLPQLS

SEQ ID NO: 955354 - protein, 9 aa, Homo Sapiens
ATCKYHCDG

SEQ ID NO: 955355 - protein, 9 aa, Homo Sapiens
VVGEAEKEY

SEQ ID NO: 955356 - protein, 9 aa, Homo Sapiens
EDQGCYRCL

SEQ ID NO: 955357 - protein, 9 aa, Homo Sapiens
WEKKESLRA

SEQ ID NO: 955358 - protein, 9 aa, Homo Sapiens
FMGGDVSIY

SEQ ID NO: 955359 - protein, 9 aa, Homo Sapiens
GLGLLREEA

SEQ ID NO: 955360 - protein, 9 aa, Homo Sapiens
APTSLNGRP

SEQ ID NO: 955361 - protein, 9 aa, Homo Sapiens
LNFTLKDNE

SEQ ID NO: 955362 - protein, 9 aa, Homo Sapiens
NKGECGPKD

SEQ ID NO: 955363 - protein, 9 aa, Homo Sapiens
SGWSPQIGD

SEQ ID NO: 955364 - protein, 9 aa, Homo Sapiens
ETPAVDIEA

SEQ ID NO: 955365 - protein, 9 aa, Homo Sapiens
FLQQQMPTL

SEQ ID NO: 955366 - protein, 9 aa, Homo Sapiens
RLTGRPGFG

SEQ ID NO: 955367 - protein, 9 aa, Homo Sapiens
TFKKAIQRI

SEQ ID NO: 955368 - protein, 9 aa, Homo Sapiens
SRFWLLVHH

SEQ ID NO: 955369 - protein, 9 aa, Homo Sapiens
FKIKITSKL

SEQ ID NO: 955370 - protein, 9 aa, Homo Sapiens
HGISGWSPQ

SEQ ID NO: 955371 - protein, 9 aa, Homo Sapiens
ELPGLVDFQ

SEQ ID NO: 955372 - protein, 9 aa, Homo Sapiens
DDRLIRSLG

SEQ ID NO: 955373 - protein, 9 aa, Homo Sapiens
FLIILVLFL

SEQ ID NO: 955374 - protein, 9 aa, Homo Sapiens
AEVTQTPRY

SEQ ID NO: 955375 - protein, 9 aa, Homo Sapiens
YILSGKKQG

SEQ ID NO: 955376 - protein, 9 aa, Homo Sapiens
LEKEINDRQ

SEQ ID NO: 955377 - protein, 9 aa, Homo Sapiens
QKEINAVLP

SEQ ID NO: 955378 - protein, 9 aa, Homo Sapiens
KKWAHLSPS

SEQ ID NO: 955379 - protein, 9 aa, Homo Sapiens
TKELKSPNE

SEQ ID NO: 955380 - protein, 9 aa, Homo Sapiens
VFFVFFFIT

SEQ ID NO: 955381 - protein, 9 aa, Homo Sapiens
TKETAWQLP

SEQ ID NO: 955382 - protein, 9 aa, Homo Sapiens
SNHPFFVGL

SEQ ID NO: 955383 - protein, 9 aa, Homo Sapiens
VVKEEANAF

SEQ ID NO: 955384 - protein, 9 aa, Homo Sapiens
QNDANLSIR

SEQ ID NO: 955385 - protein, 9 aa, Homo Sapiens
KSQELQEAD

SEQ ID NO: 955386 - protein, 9 aa, Homo Sapiens
QGRRQLILS

SEQ ID NO: 955387 - protein, 9 aa, Homo Sapiens
KENELKAVL

SEQ ID NO: 955388 - protein, 9 aa, Homo Sapiens
DQNYGIFLK

SEQ ID NO: 955389 - protein, 9 aa, Homo Sapiens
DNAGLLSFA

SEQ ID NO: 955390 - protein, 9 aa, Homo Sapiens
PQVLATTTP

SEQ ID NO: 955391 - protein, 9 aa, Homo Sapiens
AAGLLNLQQ

SEQ ID NO: 955392 - protein, 9 aa, Homo Sapiens
RNEDLLRTL

SEQ ID NO: 955393 - protein, 9 aa, Homo Sapiens
NYGIFLKMM

SEQ ID NO: 955394 - protein, 9 aa, Homo Sapiens
NWLEQNIMK

SEQ ID NO: 955395 - protein, 9 aa, Homo Sapiens
KERDAVKNL

SEQ ID NO: 955396 - protein, 9 aa, Homo Sapiens
IRFLQQQMP

SEQ ID NO: 955397 - protein, 9 aa, Homo Sapiens
QNQSSHSPV

SEQ ID NO: 955398 - protein, 9 aa, Homo Sapiens
ASNHPFFVG

SEQ ID NO: 955399 - protein, 9 aa, Homo Sapiens
QPHLGLLQS

SEQ ID NO: 955400 - protein, 9 aa, Homo Sapiens
RVKRNKENI

SEQ ID NO: 955401 - protein, 9 aa, Homo Sapiens
TEEQSPAEG

SEQ ID NO: 955402 - protein, 9 aa, Homo Sapiens
NFQYEWTPL

SEQ ID NO: 955403 - protein, 9 aa, Homo Sapiens
YSDYSRFWL

SEQ ID NO: 955404 - protein, 9 aa, Homo Sapiens
GVKWLSFYS

SEQ ID NO: 955405 - protein, 9 aa, Homo Sapiens
LDKIHDKNG

SEQ ID NO: 955406 - protein, 9 aa, Homo Sapiens
NLTLFLGCQ

SEQ ID NO: 955407 - protein, 9 aa, Homo Sapiens
KNPKKTHSD

SEQ ID NO: 955408 - protein, 9 aa, Homo Sapiens
EEAGPKVGE

SEQ ID NO: 955409 - protein, 9 aa, Homo Sapiens
DQGCYRCLI

SEQ ID NO: 955410 - protein, 9 aa, Homo Sapiens
RKSLTLIVE

SEQ ID NO: 955411 - protein, 9 aa, Homo Sapiens
KKKQMMYLT

SEQ ID NO: 955412 - protein, 9 aa, Homo Sapiens
GRQLPQLSP

SEQ ID NO: 955413 - protein, 9 aa, Homo Sapiens
PQKPQLLPN

SEQ ID NO: 955414 - protein, 9 aa, Homo Sapiens
ALKYMNRQA

SEQ ID NO: 955415 - protein, 9 aa, Homo Sapiens
IASVAQGGY

SEQ ID NO: 955416 - protein, 9 aa, Homo Sapiens
RSVAFLCIS

SEQ ID NO: 955417 - protein, 9 aa, Homo Sapiens
TKLSLYTKP

SEQ ID NO: 955418 - protein, 9 aa, Homo Sapiens
EGKFLYESW

SEQ ID NO: 955419 - protein, 9 aa, Homo Sapiens
SLRFNSVQK

SEQ ID NO: 955420 - protein, 9 aa, Homo Sapiens
YGGGSFGGG

SEQ ID NO: 955421 - protein, 9 aa, Homo Sapiens
VLAIDEYTS

SEQ ID NO: 955422 - protein, 9 aa, Homo Sapiens
IEKKVVFSS

SEQ ID NO: 955423 - protein, 9 aa, Homo Sapiens
TGKPGKWGR

SEQ ID NO: 955424 - protein, 9 aa, Homo Sapiens
IRCDLERIS

SEQ ID NO: 955425 - protein, 9 aa, Homo Sapiens
MYSKDKVTG

SEQ ID NO: 955426 - protein, 9 aa, Homo Sapiens
IWLKNFIRS

SEQ ID NO: 955427 - protein, 9 aa, Homo Sapiens
CKHGVVYDT

SEQ ID NO: 955428 - protein, 9 aa, Homo Sapiens
DMKGHFFIS

SEQ ID NO: 955429 - protein, 9 aa, Homo Sapiens
TLVTITNNF

SEQ ID NO: 955430 - protein, 9 aa, Homo Sapiens
FLPSPATAG

SEQ ID NO: 955431 - protein, 9 aa, Homo Sapiens
SVTKLSLYT

SEQ ID NO: 955432 - protein, 9 aa, Homo Sapiens
LAQRKGVFR

SEQ ID NO: 955433 - protein, 9 aa, Homo Sapiens
SKISLPTAM

SEQ ID NO: 955434 - protein, 9 aa, Homo Sapiens
QLILSGSSE

SEQ ID NO: 955435 - protein, 9 aa, Homo Sapiens
IEELGKALA

SEQ ID NO: 955436 - protein, 9 aa, Homo Sapiens
PVSKNPKKT

SEQ ID NO: 955437 - protein, 9 aa, Homo Sapiens
ERSSHVQRG

SEQ ID NO: 955438 - protein, 9 aa, Homo Sapiens
ALPHPDSSP

SEQ ID NO: 955439 - protein, 9 aa, Homo Sapiens
RKVFSVHPW

SEQ ID NO: 955440 - protein, 9 aa, Homo Sapiens
AGLLNLQQV

SEQ ID NO: 955441 - protein, 9 aa, Homo Sapiens
HSGTAESVT

SEQ ID NO: 955442 - protein, 9 aa, Homo Sapiens
EAPPPLLQP

SEQ ID NO: 955443 - protein, 9 aa, Homo Sapiens
LGGGRKWKR

SEQ ID NO: 955444 - protein, 9 aa, Homo Sapiens
NLLCLGPAR

SEQ ID NO: 955445 - protein, 9 aa, Homo Sapiens
TLVAFSGTK

SEQ ID NO: 955446 - protein, 9 aa, Homo Sapiens
NNIRSVAFL

SEQ ID NO: 955447 - protein, 9 aa, Homo Sapiens
AIMTYLFNI

SEQ ID NO: 955448 - protein, 9 aa, Homo Sapiens
LRPDSRDTF

SEQ ID NO: 955449 - protein, 9 aa, Homo Sapiens
SAATASGDE

SEQ ID NO: 955450 - protein, 9 aa, Homo Sapiens
AAALQAENG

SEQ ID NO: 955451 - protein, 9 aa, Homo Sapiens
ARNIYKDPD

SEQ ID NO: 955452 - protein, 9 aa, Homo Sapiens
LDERLPVNL

SEQ ID NO: 955453 - protein, 9 aa, Homo Sapiens
ICGLRAMPS

SEQ ID NO: 955454 - protein, 9 aa, Homo Sapiens
DPTSGERFS

SEQ ID NO: 955455 - protein, 9 aa, Homo Sapiens
TILVLQVKI

SEQ ID NO: 955456 - protein, 9 aa, Homo Sapiens
ILNLSRNRQ

SEQ ID NO: 955457 - protein, 9 aa, Homo Sapiens
TTVGSHSSP

SEQ ID NO: 955458 - protein, 9 aa, Homo Sapiens
RLSEIMCDV

SEQ ID NO: 955459 - protein, 9 aa, Homo Sapiens
QKIDLRHNK

SEQ ID NO: 955460 - protein, 9 aa, Homo Sapiens
VALDGSQSK

SEQ ID NO: 955461 - protein, 9 aa, Homo Sapiens
PVSELSKKL

SEQ ID NO: 955462 - protein, 9 aa, Homo Sapiens
VDNAGLLSF

SEQ ID NO: 955463 - protein, 9 aa, Homo Sapiens
WIFSGRCRL

SEQ ID NO: 955464 - protein, 9 aa, Homo Sapiens
SQGIILPSL

SEQ ID NO: 955465 - protein, 9 aa, Homo Sapiens
PKAWNFRGQ

SEQ ID NO: 955466 - protein, 9 aa, Homo Sapiens
NRSPKEIRE

SEQ ID NO: 955467 - protein, 9 aa, Homo Sapiens
LASGSGKSE

SEQ ID NO: 955468 - protein, 9 aa, Homo Sapiens
CDLERISHS

SEQ ID NO: 955469 - protein, 9 aa, Homo Sapiens
VLRTNQFFV

SEQ ID NO: 955470 - protein, 9 aa, Homo Sapiens
KLSLYTKPR

SEQ ID NO: 955471 - protein, 9 aa, Homo Sapiens
SNSCYYIDK

SEQ ID NO: 955472 - protein, 9 aa, Homo Sapiens
WGFFSTGDK

SEQ ID NO: 955473 - protein, 9 aa, Homo Sapiens
PSAPPPPLP

SEQ ID NO: 955474 - protein, 9 aa, Homo Sapiens
SPHPAQDSG

SEQ ID NO: 955475 - protein, 9 aa, Homo Sapiens
EPGLHTWAR

SEQ ID NO: 955476 - protein, 9 aa, Homo Sapiens
HFMGGDVSI

SEQ ID NO: 955477 - protein, 9 aa, Homo Sapiens
WSPQIGDPN

SEQ ID NO: 955478 - protein, 9 aa, Homo Sapiens
IIGVKKKEG

SEQ ID NO: 955479 - protein, 9 aa, Homo Sapiens
PCRSGTPDL

SEQ ID NO: 955480 - protein, 9 aa, Homo Sapiens
SPKEIREKI

SEQ ID NO: 955481 - protein, 9 aa, Homo Sapiens
FFPENRSPK

SEQ ID NO: 955482 - protein, 9 aa, Homo Sapiens
EEITKHWNW

SEQ ID NO: 955483 - protein, 9 aa, Homo Sapiens
QNRGWYIQA

SEQ ID NO: 955484 - protein, 9 aa, Homo Sapiens
WECKQRMLV

SEQ ID NO: 955485 - protein, 9 aa, Homo Sapiens
TRLFYKALL

SEQ ID NO: 955486 - protein, 9 aa, Homo Sapiens
ISFVRLNYQ

SEQ ID NO: 955487 - protein, 9 aa, Homo Sapiens
IISNMNASR

SEQ ID NO: 955488 - protein, 9 aa, Homo Sapiens
FYSGYDFGY

SEQ ID NO: 955489 - protein, 9 aa, Homo Sapiens
LATEEQSPA

SEQ ID NO: 955490 - protein, 9 aa, Homo Sapiens
LQSLNGVWL

SEQ ID NO: 955491 - protein, 9 aa, Homo Sapiens
GPGAKSQEL

SEQ ID NO: 955492 - protein, 9 aa, Homo Sapiens
RLAPNPVDN

SEQ ID NO: 955493 - protein, 9 aa, Homo Sapiens
GPTGKPGKW

SEQ ID NO: 955494 - protein, 9 aa, Homo Sapiens
PLTKRFRGF

SEQ ID NO: 955495 - protein, 9 aa, Homo Sapiens
NVSASKQEE

SEQ ID NO: 955496 - protein, 9 aa, Homo Sapiens
GAGPVKAEV

SEQ ID NO: 955497 - protein, 9 aa, Homo Sapiens
DDLASGSGK

SEQ ID NO: 955498 - protein, 9 aa, Homo Sapiens
NHPFFVGLH

SEQ ID NO: 955499 - protein, 9 aa, Homo Sapiens
INAVLPNKA

SEQ ID NO: 955500 - protein, 9 aa, Homo Sapiens
PGEEAGPKV

SEQ ID NO: 955501 - protein, 9 aa, Homo Sapiens
LPQLSPKGT

SEQ ID NO: 955502 - protein, 9 aa, Homo Sapiens
DQKEKIREQ

SEQ ID NO: 955503 - protein, 9 aa, Homo Sapiens
FLKLLKSVG

SEQ ID NO: 955504 - protein, 9 aa, Homo Sapiens
VLKNFNRAL

SEQ ID NO: 955505 - protein, 9 aa, Homo Sapiens
SIENLIHIV

SEQ ID NO: 955506 - protein, 9 aa, Homo Sapiens
CRALGHPVV

SEQ ID NO: 955507 - protein, 9 aa, Homo Sapiens
KGQVQSCGP

SEQ ID NO: 955508 - protein, 9 aa, Homo Sapiens
SLLYAQAMS

SEQ ID NO: 955509 - protein, 9 aa, Homo Sapiens
IKAFGLSDI

SEQ ID NO: 955510 - protein, 9 aa, Homo Sapiens
GGGRKWKRE

SEQ ID NO: 955511 - protein, 9 aa, Homo Sapiens
KSSLDCKLL

SEQ ID NO: 955512 - protein, 9 aa, Homo Sapiens
KWLLRKYTR

SEQ ID NO: 955513 - protein, 9 aa, Homo Sapiens
NYFGNFYGK

SEQ ID NO: 955514 - protein, 9 aa, Homo Sapiens
PSVKKIGKV

SEQ ID NO: 955515 - protein, 9 aa, Homo Sapiens
FLLQNDANL

SEQ ID NO: 955516 - protein, 9 aa, Homo Sapiens
TFMKLSKSS

SEQ ID NO: 955517 - protein, 9 aa, Homo Sapiens
TRTTSFLTV

SEQ ID NO: 955518 - protein, 9 aa, Homo Sapiens
FFVGLHSCF

SEQ ID NO: 955519 - protein, 9 aa, Homo Sapiens
LEEWQCLDY

SEQ ID NO: 955520 - protein, 9 aa, Homo Sapiens
LSFQEEALK

SEQ ID NO: 955521 - protein, 9 aa, Homo Sapiens
VAFLCISTG

SEQ ID NO: 955522 - protein, 9 aa, Homo Sapiens
GVFRKSPLA

SEQ ID NO: 955523 - protein, 9 aa, Homo Sapiens
MKARKISFG

SEQ ID NO: 955524 - protein, 9 aa, Homo Sapiens
KITTIPSVK

SEQ ID NO: 955525 - protein, 9 aa, Homo Sapiens
STRTTSFLT

SEQ ID NO: 955526 - protein, 9 aa, Homo Sapiens
QAALIASVA

SEQ ID NO: 955527 - protein, 9 aa, Homo Sapiens
VSLLEVLDT

SEQ ID NO: 955528 - protein, 9 aa, Homo Sapiens
AGPKVGEDN

SEQ ID NO: 955529 - protein, 9 aa, Homo Sapiens
FFVTRHEKV

SEQ ID NO: 955530 - protein, 9 aa, Homo Sapiens
VFSVHPWSR

SEQ ID NO: 955531 - protein, 9 aa, Homo Sapiens
VPVSKNPKK

SEQ ID NO: 955532 - protein, 9 aa, Homo Sapiens
FLEKKPDVQ

SEQ ID NO: 955533 - protein, 9 aa, Homo Sapiens
GIFLKMMEA

SEQ ID NO: 955534 - protein, 9 aa, Homo Sapiens
VTDRSYTSQ

SEQ ID NO: 955535 - protein, 9 aa, Homo Sapiens
LRKVFSVHP

SEQ ID NO: 955536 - protein, 9 aa, Homo Sapiens
YFSDFEDVP

SEQ ID NO: 955537 - protein, 9 aa, Homo Sapiens
MQRVKRNKE

SEQ ID NO: 955538 - protein, 9 aa, Homo Sapiens
RAYNPKHFH

SEQ ID NO: 955539 - protein, 9 aa, Homo Sapiens
VLFLLILLS

SEQ ID NO: 955540 - protein, 9 aa, Homo Sapiens
LKKRKSLTL

SEQ ID NO: 955541 - protein, 9 aa, Homo Sapiens
LEIFQAVLE

SEQ ID NO: 955542 - protein, 9 aa, Homo Sapiens
SHSSPETPV

SEQ ID NO: 955543 - protein, 9 aa, Homo Sapiens
RAAQEALSI

SEQ ID NO: 955544 - protein, 9 aa, Homo Sapiens
PDSRDTFFL

SEQ ID NO: 955545 - protein, 9 aa, Homo Sapiens
ETKETAWQL

SEQ ID NO: 955546 - protein, 9 aa, Homo Sapiens
DPSIENLIH

SEQ ID NO: 955547 - protein, 9 aa, Homo Sapiens
FKSSLDCKL

SEQ ID NO: 955548 - protein, 9 aa, Homo Sapiens
TAIIAAILK

SEQ ID NO: 955549 - protein, 9 aa, Homo Sapiens
CPGVIVRDL

SEQ ID NO: 955550 - protein, 9 aa, Homo Sapiens
YLHYEQGKL

SEQ ID NO: 955551 - protein, 9 aa, Homo Sapiens
RKRQDKALV

SEQ ID NO: 955552 - protein, 9 aa, Homo Sapiens
QGLVFWGDY

SEQ ID NO: 955553 - protein, 9 aa, Homo Sapiens
HPFFVGLHS

SEQ ID NO: 955554 - protein, 9 aa, Homo Sapiens
WLKDLVKCI

SEQ ID NO: 955555 - protein, 9 aa, Homo Sapiens
DARNEDLLR

SEQ ID NO: 955556 - protein, 9 aa, Homo Sapiens
INKSVRSRF

SEQ ID NO: 955557 - protein, 9 aa, Homo Sapiens
DAKQRLTLL

SEQ ID NO: 955558 - protein, 9 aa, Homo Sapiens
KIDLRHNKI

SEQ ID NO: 955559 - protein, 9 aa, Homo Sapiens
DIIRRYKLS

SEQ ID NO: 955560 - protein, 9 aa, Homo Sapiens
KISLPTAMT

SEQ ID NO: 955561 - protein, 9 aa, Homo Sapiens
RKKKKKQNQ

SEQ ID NO: 955562 - protein, 9 aa, Homo Sapiens
FSEALGHVA

SEQ ID NO: 955563 - protein, 9 aa, Homo Sapiens
WLSFYSGYD

SEQ ID NO: 955564 - protein, 9 aa, Homo Sapiens
PPSAPPPPL

SEQ ID NO: 955565 - protein, 9 aa, Homo Sapiens
PWEKKESLR

SEQ ID NO: 955566 - protein, 9 aa, Homo Sapiens
AWQLPMFSK

SEQ ID NO: 955567 - protein, 9 aa, Homo Sapiens
QKRKQSTQD

SEQ ID NO: 955568 - protein, 9 aa, Homo Sapiens
WNFRGQKRK

SEQ ID NO: 955569 - protein, 9 aa, Homo Sapiens
EQGKLTFFD

SEQ ID NO: 955570 - protein, 9 aa, Homo Sapiens
GLLGMSGTE

SEQ ID NO: 955571 - protein, 9 aa, Homo Sapiens
SQNLLDNRA

SEQ ID NO: 955572 - protein, 9 aa, Homo Sapiens
GFQAKKRAL

SEQ ID NO: 955573 - protein, 9 aa, Homo Sapiens
KISFDFSLA

SEQ ID NO: 955574 - protein, 9 aa, Homo Sapiens
RAMPSPEAR

SEQ ID NO: 955575 - protein, 9 aa, Homo Sapiens
KFTRPEEII

SEQ ID NO: 955576 - protein, 9 aa, Homo Sapiens
VEFAPFEKA

SEQ ID NO: 955577 - protein, 9 aa, Homo Sapiens
LQGTLLSPS

SEQ ID NO: 955578 - protein, 9 aa, Homo Sapiens
CLLTLDSLS

SEQ ID NO: 955579 - protein, 9 aa, Homo Sapiens
SCNLEIFQA

SEQ ID NO: 955580 - protein, 9 aa, Homo Sapiens
KMIAVLIVI

SEQ ID NO: 955581 - protein, 9 aa, Homo Sapiens
LDDLASGSG

SEQ ID NO: 955582 - protein, 9 aa, Homo Sapiens
NNLIITGFL

SEQ ID NO: 955583 - protein, 9 aa, Homo Sapiens
FSGRCRLTG

SEQ ID NO: 955584 - protein, 9 aa, Homo Sapiens
VQKLKSNQF

SEQ ID NO: 955585 - protein, 9 aa, Homo Sapiens
FFTRLFYKA

SEQ ID NO: 955586 - protein, 9 aa, Homo Sapiens
NDIFKRIAG

SEQ ID NO: 955587 - protein, 9 aa, Homo Sapiens
ANSFYDRYR

SEQ ID NO: 955588 - protein, 9 aa, Homo Sapiens
SLSVSFQPL

SEQ ID NO: 955589 - protein, 9 aa, Homo Sapiens
KARKISFGK

SEQ ID NO: 955590 - protein, 9 aa, Homo Sapiens
DPLTKRFRG

SEQ ID NO: 955591 - protein, 9 aa, Homo Sapiens
NLAKDLEFG

SEQ ID NO: 955592 - protein, 9 aa, Homo Sapiens
FLISLEDLD

SEQ ID NO: 955593 - protein, 9 aa, Homo Sapiens
TSFLTVTTT

SEQ ID NO: 955594 - protein, 9 aa, Homo Sapiens
LSLQYPDVH

SEQ ID NO: 955595 - protein, 9 aa, Homo Sapiens
WGRPQSLGR

SEQ ID NO: 955596 - protein, 9 aa, Homo Sapiens
CKGQVQSCG

SEQ ID NO: 955597 - protein, 9 aa, Homo Sapiens
LSKKLWNQQ

SEQ ID NO: 955598 - protein, 9 aa, Homo Sapiens
ARAGNVVHA

SEQ ID NO: 955599 - protein, 9 aa, Homo Sapiens
GGDWRGEPV

SEQ ID NO: 955600 - protein, 9 aa, Homo Sapiens
FTGLRALAR

SEQ ID NO: 955601 - protein, 9 aa, Homo Sapiens
SLTEEHSEN

SEQ ID NO: 955602 - protein, 9 aa, Homo Sapiens
QFKNGNGQP

SEQ ID NO: 955603 - protein, 9 aa, Homo Sapiens
VKKKEGYVL

SEQ ID NO: 955604 - protein, 9 aa, Homo Sapiens
ERIGPQIQL

SEQ ID NO: 955605 - protein, 9 aa, Homo Sapiens
FRKFTRPEE

SEQ ID NO: 955606 - protein, 9 aa, Homo Sapiens
FKNGNGQPK

SEQ ID NO: 955607 - protein, 9 aa, Homo Sapiens
EALKLSSGK

SEQ ID NO: 955608 - protein, 9 aa, Homo Sapiens
RPCGSSLLL

SEQ ID NO: 955609 - protein, 9 aa, Homo Sapiens
YKDPSIENL

SEQ ID NO: 955610 - protein, 9 aa, Homo Sapiens
VSKEVKTRH

SEQ ID NO: 955611 - protein, 9 aa, Homo Sapiens
SFPNLTLFL

SEQ ID NO: 955612 - protein, 9 aa, Homo Sapiens
SSKNLYKLV

SEQ ID NO: 955613 - protein, 9 aa, Homo Sapiens
THQLRVHCR

SEQ ID NO: 955614 - protein, 9 aa, Homo Sapiens
AQRKGVFRK

SEQ ID NO: 955615 - protein, 9 aa, Homo Sapiens
ATQCKHGVV

SEQ ID NO: 955616 - protein, 9 aa, Homo Sapiens
LVLYNFFAN

SEQ ID NO: 955617 - protein, 9 aa, Homo Sapiens
SVSQNFSRS

SEQ ID NO: 955618 - protein, 9 aa, Homo Sapiens
ILCILRFMR

SEQ ID NO: 955619 - protein, 9 aa, Homo Sapiens
LNKCRLSEI

SEQ ID NO: 955620 - protein, 9 aa, Homo Sapiens
LCQMQLETK

SEQ ID NO: 955621 - protein, 9 aa, Homo Sapiens
EERSSHVQR

SEQ ID NO: 955622 - protein, 9 aa, Homo Sapiens
AVTRIHFSE

SEQ ID NO: 955623 - protein, 9 aa, Homo Sapiens
LLEVLDTIL

SEQ ID NO: 955624 - protein, 9 aa, Homo Sapiens
AASLVFTEL

SEQ ID NO: 955625 - protein, 9 aa, Homo Sapiens
GASKSGPFR

SEQ ID NO: 955626 - protein, 9 aa, Homo Sapiens
RLFYKALLR

SEQ ID NO: 955627 - protein, 9 aa, Homo Sapiens
NFDLRKKDG

SEQ ID NO: 955628 - protein, 9 aa, Homo Sapiens
KHTHLILCI

SEQ ID NO: 955629 - protein, 9 aa, Homo Sapiens
LSSELEEMS

SEQ ID NO: 955630 - protein, 9 aa, Homo Sapiens
VGDQQAEAP

SEQ ID NO: 955631 - protein, 9 aa, Homo Sapiens
KEIREKILN

SEQ ID NO: 955632 - protein, 9 aa, Homo Sapiens
LIGPDDRLI

SEQ ID NO: 955633 - protein, 9 aa, Homo Sapiens
LPVSPDQLP

SEQ ID NO: 955634 - protein, 9 aa, Homo Sapiens
QEEILAGFP

SEQ ID NO: 955635 - protein, 9 aa, Homo Sapiens
RVKLTVALD

SEQ ID NO: 955636 - protein, 9 aa, Homo Sapiens
PPPLLQPET

SEQ ID NO: 955637 - protein, 9 aa, Homo Sapiens
TGYTPGDTM

SEQ ID NO: 955638 - protein, 9 aa, Homo Sapiens
TPAVDIEAA

SEQ ID NO: 955639 - protein, 9 aa, Homo Sapiens
RSPKEIREK

SEQ ID NO: 955640 - protein, 9 aa, Homo Sapiens
EFKDLELDT

SEQ ID NO: 955641 - protein, 9 aa, Homo Sapiens
ERAYNPKHF

SEQ ID NO: 955642 - protein, 9 aa, Homo Sapiens
LEEMSTSNF

SEQ ID NO: 955643 - protein, 9 aa, Homo Sapiens
FWGDYPCAR

SEQ ID NO: 955644 - protein, 9 aa, Homo Sapiens
QRVKRNKEN

SEQ ID NO: 955645 - protein, 9 aa, Homo Sapiens
NKNYFGNFY

SEQ ID NO: 955646 - protein, 9 aa, Homo Sapiens
EAPYILSGK

SEQ ID NO: 955647 - protein, 9 aa, Homo Sapiens
ATLFLRKVF

SEQ ID NO: 955648 - protein, 9 aa, Homo Sapiens
ALQAENGPA

SEQ ID NO: 955649 - protein, 9 aa, Homo Sapiens
LEGLKMIAV

SEQ ID NO: 955650 - protein, 9 aa, Homo Sapiens
YTKPRMPPC

SEQ ID NO: 955651 - protein, 9 aa, Homo Sapiens
QERIGPQIQ

SEQ ID NO: 955652 - protein, 9 aa, Homo Sapiens
DIREVASKL

SEQ ID NO: 955653 - protein, 9 aa, Homo Sapiens
QVSKEVKTR

SEQ ID NO: 955654 - protein, 9 aa, Homo Sapiens
QEDMKGHFF

SEQ ID NO: 955655 - protein, 9 aa, Homo Sapiens
RFETKISED

SEQ ID NO: 955656 - protein, 9 aa, Homo Sapiens
PLAQRKGVF

SEQ ID NO: 955657 - protein, 9 aa, Homo Sapiens
LSPKGTLDR

SEQ ID NO: 955658 - protein, 9 aa, Homo Sapiens
KTSETVPRL

SEQ ID NO: 955659 - protein, 9 aa, Homo Sapiens
ILPSLESFH

SEQ ID NO: 955660 - protein, 9 aa, Homo Sapiens
AIDEYTSKT

SEQ ID NO: 955661 - protein, 9 aa, Homo Sapiens
QVVIEKKVV

SEQ ID NO: 955662 - protein, 9 aa, Homo Sapiens
GLEGAHMGM

SEQ ID NO: 955663 - protein, 9 aa, Homo Sapiens
GLKMIAVLI

SEQ ID NO: 955664 - protein, 9 aa, Homo Sapiens
WWYNKGECG

SEQ ID NO: 955665 - protein, 9 aa, Homo Sapiens
REGNSSVIN

SEQ ID NO: 955666 - protein, 9 aa, Homo Sapiens
IRKVPVSKN

SEQ ID NO: 955667 - protein, 9 aa, Homo Sapiens
LAIDEYTSK

SEQ ID NO: 955668 - protein, 9 aa, Homo Sapiens
ADARNEDLL

SEQ ID NO: 955669 - protein, 9 aa, Homo Sapiens
VHRDETAVQ

SEQ ID NO: 955670 - protein, 9 aa, Homo Sapiens
QAKKRALEL

SEQ ID NO: 955671 - protein, 9 aa, Homo Sapiens
PQIGDPNPW

SEQ ID NO: 955672 - protein, 9 aa, Homo Sapiens
SNFQYEWTP

SEQ ID NO: 955673 - protein, 9 aa, Homo Sapiens
LIITGFLDA

SEQ ID NO: 955674 - protein, 9 aa, Homo Sapiens
LVGLKNVGN

SEQ ID NO: 955675 - protein, 9 aa, Homo Sapiens
YPSDSQVSK

SEQ ID NO: 955676 - protein, 9 aa, Homo Sapiens
HINTAVNLP

SEQ ID NO: 955677 - protein, 9 aa, Homo Sapiens
LDCKLLELL

SEQ ID NO: 955678 - protein, 9 aa, Homo Sapiens
PNPVDNAGL

SEQ ID NO: 955679 - protein, 9 aa, Homo Sapiens
FVGLHSCFQ

SEQ ID NO: 955680 - protein, 9 aa, Homo Sapiens
NSFVNDIFK

SEQ ID NO: 955681 - protein, 9 aa, Homo Sapiens
FDFSLARGL

SEQ ID NO: 955682 - protein, 9 aa, Homo Sapiens
QEELPIYFS

SEQ ID NO: 955683 - protein, 9 aa, Homo Sapiens
KILKKFYDW

SEQ ID NO: 955684 - protein, 9 aa, Homo Sapiens
LGPQGEPEP

SEQ ID NO: 955685 - protein, 9 aa, Homo Sapiens
AVIPFWNKN

SEQ ID NO: 955686 - protein, 9 aa, Homo Sapiens
LDGSQSKRS

SEQ ID NO: 955687 - protein, 9 aa, Homo Sapiens
TSFELIEAL

SEQ ID NO: 955688 - protein, 9 aa, Homo Sapiens
QVRTILVLQ

SEQ ID NO: 955689 - protein, 9 aa, Homo Sapiens
GKWGRPGAD

SEQ ID NO: 955690 - protein, 9 aa, Homo Sapiens
NKCRLSEIM

SEQ ID NO: 955691 - protein, 9 aa, Homo Sapiens
LDAFFTRLF

SEQ ID NO: 955692 - protein, 9 aa, Homo Sapiens
GRSYPVRRN

SEQ ID NO: 955693 - protein, 9 aa, Homo Sapiens
EGGHINTAV

SEQ ID NO: 955694 - protein, 9 aa, Homo Sapiens
ALIASVAQG

SEQ ID NO: 955695 - protein, 9 aa, Homo Sapiens
LTDSEFFHQ

SEQ ID NO: 955696 - protein, 9 aa, Homo Sapiens
LMKELVLKS

SEQ ID NO: 955697 - protein, 9 aa, Homo Sapiens
PDDRLIRSL

SEQ ID NO: 955698 - protein, 9 aa, Homo Sapiens
GYAVSREFK

SEQ ID NO: 955699 - protein, 9 aa, Homo Sapiens
GSLQGLVFW

SEQ ID NO: 955700 - protein, 9 aa, Homo Sapiens
YNFFANTWE

SEQ ID NO: 955701 - protein, 9 aa, Homo Sapiens
ALVGLKNVG

SEQ ID NO: 955702 - protein, 9 aa, Homo Sapiens
MLSKAKPAV

SEQ ID NO: 955703 - protein, 9 aa, Homo Sapiens
YPDVHRDET

SEQ ID NO: 955704 - protein, 9 aa, Homo Sapiens
LSVVKEEAN

SEQ ID NO: 955705 - protein, 9 aa, Homo Sapiens
PEPQALRLF

SEQ ID NO: 955706 - protein, 9 aa, Homo Sapiens
LEGAHMGMF

SEQ ID NO: 955707 - protein, 9 aa, Homo Sapiens
KKKKQNQQI

SEQ ID NO: 955708 - protein, 9 aa, Homo Sapiens
LKNKWWYNK

SEQ ID NO: 955709 - protein, 9 aa, Homo Sapiens
VLGTGWLKD

SEQ ID NO: 955710 - protein, 9 aa, Homo Sapiens
RKPEEESSQ

SEQ ID NO: 955711 - protein, 9 aa, Homo Sapiens
LALERGHDL

SEQ ID NO: 955712 - protein, 9 aa, Homo Sapiens
LAKREAWLQ

SEQ ID NO: 955713 - protein, 9 aa, Homo Sapiens
CNFCLTGSS

SEQ ID NO: 955714 - protein, 9 aa, Homo Sapiens
SLIEHYRVH

SEQ ID NO: 955715 - protein, 9 aa, Homo Sapiens
FVTRHEKVA

SEQ ID NO: 955716 - protein, 9 aa, Homo Sapiens
EGKCWLDGK

SEQ ID NO: 955717 - protein, 9 aa, Homo Sapiens
EVRASEAAV

SEQ ID NO: 955718 - protein, 9 aa, Homo Sapiens
RKGHSTSLE

SEQ ID NO: 955719 - protein, 9 aa, Homo Sapiens
GTLLSPSLP

SEQ ID NO: 955720 - protein, 9 aa, Homo Sapiens
TSGFQAKKR

SEQ ID NO: 955721 - protein, 9 aa, Homo Sapiens
HFRSARRLC

SEQ ID NO: 955722 - protein, 9 aa, Homo Sapiens
PTSGERFSS

SEQ ID NO: 955723 - protein, 9 aa, Homo Sapiens
SYFKSSLDC

SEQ ID NO: 955724 - protein, 9 aa, Homo Sapiens
PVSPDQLPC

SEQ ID NO: 955725 - protein, 9 aa, Homo Sapiens
RYKLSEEGR

SEQ ID NO: 955726 - protein, 9 aa, Homo Sapiens
CRLSEIMCD

SEQ ID NO: 955727 - protein, 9 aa, Homo Sapiens
PCPTAGLGL

SEQ ID NO: 955728 - protein, 9 aa, Homo Sapiens
NSSSVNFAD

SEQ ID NO: 955729 - protein, 9 aa, Homo Sapiens
LQYPDVHRD

SEQ ID NO: 955730 - protein, 9 aa, Homo Sapiens
DSQVSKEVK

SEQ ID NO: 955731 - protein, 9 aa, Homo Sapiens
RPKPLFLKL

SEQ ID NO: 955732 - protein, 9 aa, Homo Sapiens
LFYKALLRI

SEQ ID NO: 955733 - protein, 9 aa, Homo Sapiens
IGPQIQLSG

SEQ ID NO: 955734 - protein, 9 aa, Homo Sapiens
EFAPFEKAA

SEQ ID NO: 955735 - protein, 9 aa, Homo Sapiens
AALQAENGP

SEQ ID NO: 955736 - protein, 9 aa, Homo Sapiens
SSWLRKNGV

SEQ ID NO: 955737 - protein, 9 aa, Homo Sapiens
ARNEDLLRT

SEQ ID NO: 955738 - protein, 9 aa, Homo Sapiens
VAFSGTKKL

SEQ ID NO: 955739 - protein, 9 aa, Homo Sapiens
KVSGDDVIK

SEQ ID NO: 955740 - protein, 9 aa, Homo Sapiens
IADAFNLSS

SEQ ID NO: 955741 - protein, 9 aa, Homo Sapiens
VVIEKKVVF

SEQ ID NO: 955742 - protein, 9 aa, Homo Sapiens
VGGLLGLAK

SEQ ID NO: 955743 - protein, 9 aa, Homo Sapiens
MYMKHLRTH

SEQ ID NO: 955744 - protein, 9 aa, Homo Sapiens
LQTILNFLI

SEQ ID NO: 955745 - protein, 9 aa, Homo Sapiens
FKHSFRKPR

SEQ ID NO: 955746 - protein, 9 aa, Homo Sapiens
HPAVSISCP

SEQ ID NO: 955747 - protein, 9 aa, Homo Sapiens
LPIYFSDFE

SEQ ID NO: 955748 - protein, 9 aa, Homo Sapiens
EVASKLSEA

SEQ ID NO: 955749 - protein, 9 aa, Homo Sapiens
DIFKRIAGE

SEQ ID NO: 955750 - protein, 9 aa, Homo Sapiens
SLRAAQEAL

SEQ ID NO: 955751 - protein, 9 aa, Homo Sapiens
QDAKQRLTL

SEQ ID NO: 955752 - protein, 9 aa, Homo Sapiens
WYNKGECGP

SEQ ID NO: 955753 - protein, 9 aa, Homo Sapiens
LCSERAYNP

SEQ ID NO: 955754 - protein, 9 aa, Homo Sapiens
SLSSSSLSS

SEQ ID NO: 955755 - protein, 9 aa, Homo Sapiens
GNVVHALLL

SEQ ID NO: 955756 - protein, 9 aa, Homo Sapiens
LYRKGHSTS

SEQ ID NO: 955757 - protein, 9 aa, Homo Sapiens
PICGLRAMP

SEQ ID NO: 955758 - protein, 9 aa, Homo Sapiens
AITATSNMA

SEQ ID NO: 955759 - protein, 9 aa, Homo Sapiens
EEAEHMFTR

SEQ ID NO: 955760 - protein, 9 aa, Homo Sapiens
QNQQIDYSR

SEQ ID NO: 955761 - protein, 9 aa, Homo Sapiens
DVAISQGII

SEQ ID NO: 955762 - protein, 9 aa, Homo Sapiens
GTKKLPKAP

SEQ ID NO: 955763 - protein, 9 aa, Homo Sapiens
QSLIILEEK

SEQ ID NO: 955764 - protein, 9 aa, Homo Sapiens
NPVDNAGLL

SEQ ID NO: 955765 - protein, 9 aa, Homo Sapiens
DLRDGEQPC

SEQ ID NO: 955766 - protein, 9 aa, Homo Sapiens
SLDCKLLEL

SEQ ID NO: 955767 - protein, 9 aa, Homo Sapiens
FCLTGSSNS

SEQ ID NO: 955768 - protein, 9 aa, Homo Sapiens
IPMSGILSN

SEQ ID NO: 955769 - protein, 9 aa, Homo Sapiens
SCPPHPTPR

SEQ ID NO: 955770 - protein, 9 aa, Homo Sapiens
KEVKTRHSE

SEQ ID NO: 955771 - protein, 9 aa, Homo Sapiens
VSLSVSFQP

SEQ ID NO: 955772 - protein, 9 aa, Homo Sapiens
REAIEELGK

SEQ ID NO: 955773 - protein, 9 aa, Homo Sapiens
LLDAFFTRL

SEQ ID NO: 955774 - protein, 9 aa, Homo Sapiens
SFLFEELPA

SEQ ID NO: 955775 - protein, 9 aa, Homo Sapiens
ISLPTAMTS

SEQ ID NO: 955776 - protein, 9 aa, Homo Sapiens
LNTNVMSGF

SEQ ID NO: 955777 - protein, 9 aa, Homo Sapiens
ASKLSEASL

SEQ ID NO: 955778 - protein, 9 aa, Homo Sapiens
KVQVVIEKK

SEQ ID NO: 955779 - protein, 9 aa, Homo Sapiens
LSNHGLSEN

SEQ ID NO: 955780 - protein, 9 aa, Homo Sapiens
LCILRFMRR

SEQ ID NO: 955781 - protein, 9 aa, Homo Sapiens
QEEKMHDQK

SEQ ID NO: 955782 - protein, 9 aa, Homo Sapiens
YIHTSVSQN

SEQ ID NO: 955783 - protein, 9 aa, Homo Sapiens
LFEELPAQF

SEQ ID NO: 955784 - protein, 9 aa, Homo Sapiens
GPQGEPEPP

SEQ ID NO: 955785 - protein, 9 aa, Homo Sapiens
FPNLTLFLG

SEQ ID NO: 955786 - protein, 9 aa, Homo Sapiens
STTASPTTS

SEQ ID NO: 955787 - protein, 9 aa, Homo Sapiens
CSERAYNPK

SEQ ID NO: 955788 - protein, 9 aa, Homo Sapiens
NFLISLEDL

SEQ ID NO: 955789 - protein, 9 aa, Homo Sapiens
WQCLDYAQQ

SEQ ID NO: 955790 - protein, 9 aa, Homo Sapiens
DPSVLYVSR

SEQ ID NO: 955791 - protein, 9 aa, Homo Sapiens
EVESLKRKL

SEQ ID NO: 955792 - protein, 9 aa, Homo Sapiens
SKCRSAEIK

SEQ ID NO: 955793 - protein, 9 aa, Homo Sapiens
GAEVACSET

SEQ ID NO: 955794 - protein, 9 aa, Homo Sapiens
TPEQSHVVQ

SEQ ID NO: 955795 - protein, 9 aa, Homo Sapiens
CRLRVQKAI

SEQ ID NO: 955796 - protein, 9 aa, Homo Sapiens
SEEKDEEDE

SEQ ID NO: 955797 - protein, 9 aa, Homo Sapiens
LHTWARVSL

SEQ ID NO: 955798 - protein, 9 aa, Homo Sapiens
EAVTRIHFS

SEQ ID NO: 955799 - protein, 9 aa, Homo Sapiens
KALVGLKNV

SEQ ID NO: 955800 - protein, 9 aa, Homo Sapiens
SDRGGDWRG

SEQ ID NO: 955801 - protein, 9 aa, Homo Sapiens
TPFFLPSPA

SEQ ID NO: 955802 - protein, 9 aa, Homo Sapiens
NKENISSVL

SEQ ID NO: 955803 - protein, 9 aa, Homo Sapiens
FGICQIKAF

SEQ ID NO: 955804 - protein, 9 aa, Homo Sapiens
QMESSKGSS

SEQ ID NO: 955805 - protein, 9 aa, Homo Sapiens
VSPDQLPCG

SEQ ID NO: 955806 - protein, 9 aa, Homo Sapiens
SAPPPPLPP

SEQ ID NO: 955807 - protein, 9 aa, Homo Sapiens
SSSLSSSSL

SEQ ID NO: 955808 - protein, 9 aa, Homo Sapiens
SIPMSGILS

SEQ ID NO: 955809 - protein, 9 aa, Homo Sapiens
SAAEFQGKG

SEQ ID NO: 955810 - protein, 9 aa, Homo Sapiens
SPQIGDPNP

SEQ ID NO: 955811 - protein, 9 aa, Homo Sapiens
DKISFDFSL

SEQ ID NO: 955812 - protein, 9 aa, Homo Sapiens
NLPSKISLP

SEQ ID NO: 955813 - protein, 9 aa, Homo Sapiens
NQKKWAHLS

SEQ ID NO: 955814 - protein, 9 aa, Homo Sapiens
ILKIPTSRG

SEQ ID NO: 955815 - protein, 9 aa, Homo Sapiens
DEYTSKTST

SEQ ID NO: 955816 - protein, 9 aa, Homo Sapiens
NLDKIHDKN

SEQ ID NO: 955817 - protein, 9 aa, Homo Sapiens
PSKISLPTA

SEQ ID NO: 955818 - protein, 9 aa, Homo Sapiens
RQASQMLLM

SEQ ID NO: 955819 - protein, 9 aa, Homo Sapiens
VIIGEGLTD

SEQ ID NO: 955820 - protein, 9 aa, Homo Sapiens
SLVFTELTT

SEQ ID NO: 955821 - protein, 9 aa, Homo Sapiens
LDGLQREAI

SEQ ID NO: 955822 - protein, 9 aa, Homo Sapiens
QVFFVFFFI

SEQ ID NO: 955823 - protein, 9 aa, Homo Sapiens
SQLNEKETS

SEQ ID NO: 955824 - protein, 9 aa, Homo Sapiens
KGSSNTTEA

SEQ ID NO: 955825 - protein, 9 aa, Homo Sapiens
SSLSSSSLS

SEQ ID NO: 955826 - protein, 9 aa, Homo Sapiens
ISSRSWFSN

SEQ ID NO: 955827 - protein, 9 aa, Homo Sapiens
EEALKLSSG

SEQ ID NO: 955828 - protein, 9 aa, Homo Sapiens
VITFDCQNR

SEQ ID NO: 955829 - protein, 9 aa, Homo Sapiens
VSIYTNVYK

SEQ ID NO: 955830 - protein, 9 aa, Homo Sapiens
YMKHLRTHD

SEQ ID NO: 955831 - protein, 9 aa, Homo Sapiens
LVRPKPLFL

SEQ ID NO: 955832 - protein, 9 aa, Homo Sapiens
FLARMPPPL

SEQ ID NO: 955833 - protein, 9 aa, Homo Sapiens
FALFLVIYV

SEQ ID NO: 955834 - protein, 9 aa, Homo Sapiens
ESPSTTASP

SEQ ID NO: 955835 - protein, 9 aa, Homo Sapiens
TQSHFKHSF

SEQ ID NO: 955836 - protein, 9 aa, Homo Sapiens
SLITTPEVA

SEQ ID NO: 955837 - protein, 9 aa, Homo Sapiens
LETKETAWQ

SEQ ID NO: 955838 - protein, 9 aa, Homo Sapiens
IKKDSPESP

SEQ ID NO: 955839 - protein, 9 aa, Homo Sapiens
QGEPEPPGQ

SEQ ID NO: 955840 - protein, 9 aa, Homo Sapiens
LTVALDGSQ

SEQ ID NO: 955841 - protein, 9 aa, Homo Sapiens
EGLRPLWSE

SEQ ID NO: 955842 - protein, 9 aa, Homo Sapiens
AALGLEGAH

SEQ ID NO: 955843 - protein, 9 aa, Homo Sapiens
GSLSDYFSS

SEQ ID NO: 955844 - protein, 9 aa, Homo Sapiens
EHYRVHTGE

SEQ ID NO: 955845 - protein, 9 aa, Homo Sapiens
PTAGLGLLR

SEQ ID NO: 955846 - protein, 9 aa, Homo Sapiens
KKLPKAPVI

SEQ ID NO: 955847 - protein, 9 aa, Homo Sapiens
VTTMVFFSY

SEQ ID NO: 955848 - protein, 9 aa, Homo Sapiens
VMEQMGRSL

SEQ ID NO: 955849 - protein, 9 aa, Homo Sapiens
ANLSIRDKE

SEQ ID NO: 955850 - protein, 9 aa, Homo Sapiens
NVSDRQSFL

SEQ ID NO: 955851 - protein, 9 aa, Homo Sapiens
GGSLSDYFS

SEQ ID NO: 955852 - protein, 9 aa, Homo Sapiens
GTSGTPFFL

SEQ ID NO: 955853 - protein, 9 aa, Homo Sapiens
LSGKKKKQM

SEQ ID NO: 955854 - protein, 9 aa, Homo Sapiens
HANHGFMVE

SEQ ID NO: 955855 - protein, 9 aa, Homo Sapiens
SPNEGFEGK

SEQ ID NO: 955856 - protein, 9 aa, Homo Sapiens
YCGLCGEFI

SEQ ID NO: 955857 - protein, 9 aa, Homo Sapiens
IIAAILKIP

SEQ ID NO: 955858 - protein, 9 aa, Homo Sapiens
KIKITSKLV

SEQ ID NO: 955859 - protein, 9 aa, Homo Sapiens
GWQVFFVFF

SEQ ID NO: 955860 - protein, 9 aa, Homo Sapiens
DEVRASEAA

SEQ ID NO: 955861 - protein, 9 aa, Homo Sapiens
DIEAADLAH

SEQ ID NO: 955862 - protein, 9 aa, Homo Sapiens
LSLRFNSVQ

SEQ ID NO: 955863 - protein, 9 aa, Homo Sapiens
REGKCWLDG

SEQ ID NO: 955864 - protein, 9 aa, Homo Sapiens
KQEEILAGF

SEQ ID NO: 955865 - protein, 9 aa, Homo Sapiens
GTPFFLPSP

SEQ ID NO: 955866 - protein, 9 aa, Homo Sapiens
GWLKDLVKC

SEQ ID NO: 955867 - protein, 9 aa, Homo Sapiens
EALPLERED

SEQ ID NO: 955868 - protein, 9 aa, Homo Sapiens
LSSSSLSSS

SEQ ID NO: 955869 - protein, 9 aa, Homo Sapiens
ELSKKLWNQ

SEQ ID NO: 955870 - protein, 9 aa, Homo Sapiens
FNISEAEAS

SEQ ID NO: 955871 - protein, 9 aa, Homo Sapiens
QLYKEVLKA

SEQ ID NO: 955872 - protein, 9 aa, Homo Sapiens
KKKQNQQID

SEQ ID NO: 955873 - protein, 9 aa, Homo Sapiens
TTASPTTSV

SEQ ID NO: 955874 - protein, 9 aa, Homo Sapiens
VQYGAEVAC

SEQ ID NO: 955875 - protein, 9 aa, Homo Sapiens
PSAAEFQGK

SEQ ID NO: 955876 - protein, 9 aa, Homo Sapiens
PVKAEVTQT

SEQ ID NO: 955877 - protein, 9 aa, Homo Sapiens
QELQEADEQ

SEQ ID NO: 955878 - protein, 9 aa, Homo Sapiens
DRSYTSQSP

SEQ ID NO: 955879 - protein, 9 aa, Homo Sapiens
TLQGQDWVP

SEQ ID NO: 955880 - protein, 9 aa, Homo Sapiens
SLKRKLQDK

SEQ ID NO: 955881 - protein, 9 aa, Homo Sapiens
LLDDLASGS

SEQ ID NO: 955882 - protein, 9 aa, Homo Sapiens
YIQDAKQRL

SEQ ID NO: 955883 - protein, 9 aa, Homo Sapiens
YIDKERRTW

SEQ ID NO: 955884 - protein, 9 aa, Homo Sapiens
FENLLCLGP

SEQ ID NO: 955885 - protein, 9 aa, Homo Sapiens
SDGDKEDEL

SEQ ID NO: 955886 - protein, 9 aa, Homo Sapiens
KVGEDNDRN

SEQ ID NO: 955887 - protein, 9 aa, Homo Sapiens
RQSFLQRYW

SEQ ID NO: 955888 - protein, 9 aa, Homo Sapiens
SSFFHFLQS

SEQ ID NO: 955889 - protein, 9 aa, Homo Sapiens
MLVREERHR

SEQ ID NO: 955890 - protein, 9 aa, Homo Sapiens
LQREAIEEL

SEQ ID NO: 955891 - protein, 9 aa, Homo Sapiens
AESVTCTYS

SEQ ID NO: 955892 - protein, 9 aa, Homo Sapiens
SLPTFRKFT

SEQ ID NO: 955893 - protein, 9 aa, Homo Sapiens
YFSSVPSTP

SEQ ID NO: 955894 - protein, 9 aa, Homo Sapiens
PKVGEDNDR

SEQ ID NO: 955895 - protein, 9 aa, Homo Sapiens
DVIKKDSPE

SEQ ID NO: 955896 - protein, 9 aa, Homo Sapiens
ITNNFGSVA

SEQ ID NO: 955897 - protein, 9 aa, Homo Sapiens
TVRKETMMV

SEQ ID NO: 955898 - protein, 9 aa, Homo Sapiens
SGPEHPEGG

SEQ ID NO: 955899 - protein, 9 aa, Homo Sapiens
RFWLLVHHL

SEQ ID NO: 955900 - protein, 9 aa, Homo Sapiens
SGTKKLPKA

SEQ ID NO: 955901 - protein, 9 aa, Homo Sapiens
YEDIPFTKT

SEQ ID NO: 955902 - protein, 9 aa, Homo Sapiens
AHCNFCLTG

SEQ ID NO: 955903 - protein, 9 aa, Homo Sapiens
REVASKLSE

SEQ ID NO: 955904 - protein, 9 aa, Homo Sapiens
GQVQSCGPP

SEQ ID NO: 955905 - protein, 9 aa, Homo Sapiens
KNYFGNFYG

SEQ ID NO: 955906 - protein, 9 aa, Homo Sapiens
EWTPLMYAA

SEQ ID NO: 955907 - protein, 9 aa, Homo Sapiens
TYLFNISEA

SEQ ID NO: 955908 - protein, 9 aa, Homo Sapiens
WVTDRSYTS

SEQ ID NO: 955909 - protein, 9 aa, Homo Sapiens
FEKAAKKKT

SEQ ID NO: 955910 - protein, 9 aa, Homo Sapiens
AEPVEEQEE

SEQ ID NO: 955911 - protein, 9 aa, Homo Sapiens
FQAKKRALE

SEQ ID NO: 955912 - protein, 9 aa, Homo Sapiens
PSVLYVSRH

SEQ ID NO: 955913 - protein, 9 aa, Homo Sapiens
GLGLLGMSG

SEQ ID NO: 955914 - protein, 9 aa, Homo Sapiens
SGKKKKQMM

SEQ ID NO: 955915 - protein, 8 aa, Homo Sapiens
EDSSTDTE

SEQ ID NO: 955916 - protein, 9 aa, Homo Sapiens
RGHDLTAIC

SEQ ID NO: 955917 - protein, 9 aa, Homo Sapiens
VTKLSLYTK

SEQ ID NO: 955918 - protein, 9 aa, Homo Sapiens
PHLGLLQSG

SEQ ID NO: 955919 - protein, 9 aa, Homo Sapiens
KYHCDGGYD

SEQ ID NO: 955920 - protein, 9 aa, Homo Sapiens
QQGRRQLIL

SEQ ID NO: 955921 - protein, 9 aa, Homo Sapiens
ECKQRMLVR

SEQ ID NO: 955922 - protein, 9 aa, Homo Sapiens
LKAVLQELE

SEQ ID NO: 955923 - protein, 9 aa, Homo Sapiens
LQKWLLRKY

SEQ ID NO: 955924 - protein, 9 aa, Homo Sapiens
LLLFLKSAT

SEQ ID NO: 955925 - protein, 9 aa, Homo Sapiens
LEDNSSSVN

SEQ ID NO: 955926 - protein, 9 aa, Homo Sapiens
SSLIEHYRV

SEQ ID NO: 955927 - protein, 9 aa, Homo Sapiens
VTRIHFSEA

SEQ ID NO: 955928 - protein, 9 aa, Homo Sapiens
GDFGLATEK

SEQ ID NO: 955929 - protein, 9 aa, Homo Sapiens
TPGEEAGPK

SEQ ID NO: 955930 - protein, 9 aa, Homo Sapiens
ITKHWNWLE

SEQ ID NO: 955931 - protein, 9 aa, Homo Sapiens
VSRHRYDHG

SEQ ID NO: 955932 - protein, 9 aa, Homo Sapiens
NIIGVKKKE

SEQ ID NO: 955933 - protein, 9 aa, Homo Sapiens
TASPTTSVS

SEQ ID NO: 955934 - protein, 9 aa, Homo Sapiens
LGMSGTESQ

SEQ ID NO: 955935 - protein, 9 aa, Homo Sapiens
PQLSPKGTL

SEQ ID NO: 955936 - protein, 9 aa, Homo Sapiens
AVSREFKDL

SEQ ID NO: 955937 - protein, 9 aa, Homo Sapiens
QSFLQRYWV

SEQ ID NO: 955938 - protein, 9 aa, Homo Sapiens
FLDALIQVW

SEQ ID NO: 955939 - protein, 9 aa, Homo Sapiens
DLERISHSI

SEQ ID NO: 955940 - protein, 9 aa, Homo Sapiens
KESLRAAQE

SEQ ID NO: 955941 - protein, 9 aa, Homo Sapiens
TAGLGLLRE

SEQ ID NO: 955942 - protein, 9 aa, Homo Sapiens
DRYVAISKS

SEQ ID NO: 955943 - protein, 9 aa, Homo Sapiens
GYGGGSFGG

SEQ ID NO: 955944 - protein, 9 aa, Homo Sapiens
QIRARTAAD

SEQ ID NO: 955945 - protein, 9 aa, Homo Sapiens
GPVSLSVSF

SEQ ID NO: 955946 - protein, 9 aa, Homo Sapiens
DAVKNLLQQ

SEQ ID NO: 955947 - protein, 9 aa, Homo Sapiens
FVNDIFKRI

SEQ ID NO: 955948 - protein, 9 aa, Homo Sapiens
ARTAADYGV

SEQ ID NO: 955949 - protein, 9 aa, Homo Sapiens
IHTVRKETM

SEQ ID NO: 955950 - protein, 9 aa, Homo Sapiens
LTLFLGCQL

SEQ ID NO: 955951 - protein, 9 aa, Homo Sapiens
DREKVVTYL

SEQ ID NO: 955952 - protein, 9 aa, Homo Sapiens
KDEEDEENA

SEQ ID NO: 955953 - protein, 9 aa, Homo Sapiens
QANSFYDRY

SEQ ID NO: 955954 - protein, 9 aa, Homo Sapiens
FDNVSASKQ

SEQ ID NO: 955955 - protein, 9 aa, Homo Sapiens
GRSTRPCGS

SEQ ID NO: 955956 - protein, 9 aa, Homo Sapiens
GDKEDELVG

SEQ ID NO: 955957 - protein, 9 aa, Homo Sapiens
SGVSLLEVL

SEQ ID NO: 955958 - protein, 9 aa, Homo Sapiens
SPAEGDGNC

SEQ ID NO: 955959 - protein, 9 aa, Homo Sapiens
TDTAQAMKN

SEQ ID NO: 955960 - protein, 9 aa, Homo Sapiens
NSDKILKKF

SEQ ID NO: 955961 - protein, 9 aa, Homo Sapiens
EPICGLRAM

SEQ ID NO: 955962 - protein, 9 aa, Homo Sapiens
SLGPQGEPE

SEQ ID NO: 955963 - protein, 9 aa, Homo Sapiens
KSVRSRFSP

SEQ ID NO: 955964 - protein, 9 aa, Homo Sapiens
LCLLTLDSL

SEQ ID NO: 955965 - protein, 9 aa, Homo Sapiens
EPVEEQEEK

SEQ ID NO: 955966 - protein, 9 aa, Homo Sapiens
RHNKIYEIK

SEQ ID NO: 955967 - protein, 9 aa, Homo Sapiens
WLLVHHLCT

SEQ ID NO: 955968 - protein, 9 aa, Homo Sapiens
NEDLLRTLN

SEQ ID NO: 955969 - protein, 9 aa, Homo Sapiens
EGLKMIAVL

SEQ ID NO: 955970 - protein, 9 aa, Homo Sapiens
APSFWICHP

SEQ ID NO: 955971 - protein, 9 aa, Homo Sapiens
QQQAALIAS

SEQ ID NO: 955972 - protein, 9 aa, Homo Sapiens
PLFLKLLKS

SEQ ID NO: 955973 - protein, 9 aa, Homo Sapiens
QNSSLIEHY

SEQ ID NO: 955974 - protein, 9 aa, Homo Sapiens
LRAAQEALS

SEQ ID NO: 955975 - protein, 9 aa, Homo Sapiens
NRFSSEKIA

SEQ ID NO: 955976 - protein, 9 aa, Homo Sapiens
MQQQAALIA

SEQ ID NO: 955977 - protein, 9 aa, Homo Sapiens
KIISSSKNL

SEQ ID NO: 955978 - protein, 9 aa, Homo Sapiens
WGRSTRPCG

SEQ ID NO: 955979 - protein, 9 aa, Homo Sapiens
RFVFEAPYI

SEQ ID NO: 955980 - protein, 9 aa, Homo Sapiens
NPKKTHSDA

SEQ ID NO: 955981 - protein, 9 aa, Homo Sapiens
EDQHTVLSS

SEQ ID NO: 955982 - protein, 9 aa, Homo Sapiens
TIPSVKKIG

SEQ ID NO: 955983 - protein, 9 aa, Homo Sapiens
KLTFFDADR

SEQ ID NO: 955984 - protein, 9 aa, Homo Sapiens
LLRKYTRME

SEQ ID NO: 955985 - protein, 9 aa, Homo Sapiens
PTLQGQDWV

SEQ ID NO: 955986 - protein, 9 aa, Homo Sapiens
LGTGWLKDL

SEQ ID NO: 955987 - protein, 9 aa, Homo Sapiens
ETKKERVSL

SEQ ID NO: 955988 - protein, 9 aa, Homo Sapiens
NRQPHLGLL

SEQ ID NO: 955989 - protein, 9 aa, Homo Sapiens
SSVLATLSL

SEQ ID NO: 955990 - protein, 9 aa, Homo Sapiens
CFLGMEFCG

SEQ ID NO: 955991 - protein, 9 aa, Homo Sapiens
AHEKNSQIY

SEQ ID NO: 955992 - protein, 9 aa, Homo Sapiens
KISEDDIHA

SEQ ID NO: 955993 - protein, 9 aa, Homo Sapiens
FNSVQKLKS

SEQ ID NO: 955994 - protein, 9 aa, Homo Sapiens
FCGIHETTF

SEQ ID NO: 955995 - protein, 9 aa, Homo Sapiens
VSASKQEEI

SEQ ID NO: 955996 - protein, 9 aa, Homo Sapiens
VIKKDSPES

SEQ ID NO: 955997 - protein, 9 aa, Homo Sapiens
RALARGLLL

SEQ ID NO: 955998 - protein, 9 aa, Homo Sapiens
ASGVSLLEV

SEQ ID NO: 955999 - protein, 9 aa, Homo Sapiens
EVLRTNQFF

SEQ ID NO: 956000 - protein, 9 aa, Homo Sapiens
PCFLGMEFC

SEQ ID NO: 956001 - protein, 9 aa, Homo Sapiens
YNKGECGPK

SEQ ID NO: 956002 - protein, 9 aa, Homo Sapiens
GAAHEKNSQ

SEQ ID NO: 956003 - protein, 9 aa, Homo Sapiens
KNGLVSLHA

SEQ ID NO: 956004 - protein, 9 aa, Homo Sapiens
YEQGKLTFF

SEQ ID NO: 956005 - protein, 9 aa, Homo Sapiens
WNWLEQNIM

SEQ ID NO: 956006 - protein, 9 aa, Homo Sapiens
SGFNGSKEN

SEQ ID NO: 956007 - protein, 9 aa, Homo Sapiens
ILNFLISLE

SEQ ID NO: 956008 - protein, 9 aa, Homo Sapiens
LKDLVKCIS

SEQ ID NO: 956009 - protein, 9 aa, Homo Sapiens
AQAASPQVL

SEQ ID NO: 956010 - protein, 9 aa, Homo Sapiens
RPSFPNLTL

SEQ ID NO: 956011 - protein, 9 aa, Homo Sapiens
DVSIYTNVY

SEQ ID NO: 956012 - protein, 9 aa, Homo Sapiens
EFGVGDLPT

SEQ ID NO: 956013 - protein, 9 aa, Homo Sapiens
TKRFRGFGF

SEQ ID NO: 956014 - protein, 9 aa, Homo Sapiens
QAVLEGLDA

SEQ ID NO: 956015 - protein, 9 aa, Homo Sapiens
QQAALIASV

SEQ ID NO: 956016 - protein, 9 aa, Homo Sapiens
CGLCGEFIG

SEQ ID NO: 956017 - protein, 9 aa, Homo Sapiens
EVLDTILPP

SEQ ID NO: 956018 - protein, 9 aa, Homo Sapiens
SSFLFEELP

SEQ ID NO: 956019 - protein, 9 aa, Homo Sapiens
HLSSELEEM

SEQ ID NO: 956020 - protein, 9 aa, Homo Sapiens
SATPEQSHV

SEQ ID NO: 956021 - protein, 9 aa, Homo Sapiens
SWFSNASSC

SEQ ID NO: 956022 - protein, 9 aa, Homo Sapiens
NGQPKAVRV

SEQ ID NO: 956023 - protein, 9 aa, Homo Sapiens
IHDKNGNNL

SEQ ID NO: 956024 - protein, 9 aa, Homo Sapiens
AFFILLPDL

SEQ ID NO: 956025 - protein, 9 aa, Homo Sapiens
LIILVLFLL

SEQ ID NO: 956026 - protein, 9 aa, Homo Sapiens
KNGNGQPKA

SEQ ID NO: 956027 - protein, 9 aa, Homo Sapiens
ILVLQVKIS

SEQ ID NO: 956028 - protein, 9 aa, Homo Sapiens
GTPDLRDGE

SEQ ID NO: 956029 - protein, 9 aa, Homo Sapiens
VIPFWNKNY

SEQ ID NO: 956030 - protein, 9 aa, Homo Sapiens
PLVVIWNTW

SEQ ID NO: 956031 - protein, 9 aa, Homo Sapiens
KIDQMKRNH

SEQ ID NO: 956032 - protein, 9 aa, Homo Sapiens
INDRQMELK

SEQ ID NO: 956033 - protein, 9 aa, Homo Sapiens
LPGDMVFLE

SEQ ID NO: 956034 - protein, 9 aa, Homo Sapiens
EITKHWNWL

SEQ ID NO: 956035 - protein, 9 aa, Homo Sapiens
EVLKNFNRA

SEQ ID NO: 956036 - protein, 9 aa, Homo Sapiens
DFGLARNIY

SEQ ID NO: 956037 - protein, 9 aa, Homo Sapiens
EDEENAHPY

SEQ ID NO: 956038 - protein, 9 aa, Homo Sapiens
IIGEGLTDS

SEQ ID NO: 956039 - protein, 9 aa, Homo Sapiens
SSHSPVLLP

SEQ ID NO: 956040 - protein, 9 aa, Homo Sapiens
NSVIRELLQ

SEQ ID NO: 956041 - protein, 9 aa, Homo Sapiens
LVPSFPTTT

SEQ ID NO: 956042 - protein, 9 aa, Homo Sapiens
GSKWGCGSC

SEQ ID NO: 956043 - protein, 9 aa, Homo Sapiens
KRTSGFQAK

SEQ ID NO: 956044 - protein, 9 aa, Homo Sapiens
LYNFFANTW

SEQ ID NO: 956045 - protein, 9 aa, Homo Sapiens
SISCPPHPT

SEQ ID NO: 956046 - protein, 9 aa, Homo Sapiens
NSFYDRYRD

SEQ ID NO: 956047 - protein, 9 aa, Homo Sapiens
STTVGSHSS

SEQ ID NO: 956048 - protein, 9 aa, Homo Sapiens
TLLSPSLPA

SEQ ID NO: 956049 - protein, 9 aa, Homo Sapiens
RPIWGRSTR

SEQ ID NO: 956050 - protein, 9 aa, Homo Sapiens
KMHDQKEKI

SEQ ID NO: 956051 - protein, 9 aa, Homo Sapiens
KHSRGNWGH

SEQ ID NO: 956052 - protein, 9 aa, Homo Sapiens
ETKISEDDI

SEQ ID NO: 956053 - protein, 9 aa, Homo Sapiens
SVLYVSRHR

SEQ ID NO: 956054 - protein, 9 aa, Homo Sapiens
AFSGTKKLP

SEQ ID NO: 956055 - protein, 9 aa, Homo Sapiens
FQEEALKLS

SEQ ID NO: 956056 - protein, 9 aa, Homo Sapiens
ESSKGSSNT

SEQ ID NO: 956057 - protein, 9 aa, Homo Sapiens
KSSWRAEPV

SEQ ID NO: 956058 - protein, 9 aa, Homo Sapiens
RQNQSSHSP

SEQ ID NO: 956059 - protein, 9 aa, Homo Sapiens
RVVLALERG

SEQ ID NO: 956060 - protein, 9 aa, Homo Sapiens
SETGYTPGD

SEQ ID NO: 956061 - protein, 9 aa, Homo Sapiens
ASPQVLATT

SEQ ID NO: 956062 - protein, 9 aa, Homo Sapiens
SSLLAENEA

SEQ ID NO: 956063 - protein, 9 aa, Homo Sapiens
SSPMIVQRL

SEQ ID NO: 956064 - protein, 9 aa, Homo Sapiens
RRLVEQVLY

SEQ ID NO: 956065 - protein, 9 aa, Homo Sapiens
LVTTMVFFS

SEQ ID NO: 956066 - protein, 9 aa, Homo Sapiens
EKSRWSGSH

SEQ ID NO: 956067 - protein, 9 aa, Homo Sapiens
PSIENLIHI

SEQ ID NO: 956068 - protein, 9 aa, Homo Sapiens
TTNTAITAT

SEQ ID NO: 956069 - protein, 9 aa, Homo Sapiens
EIWLKNFIR

SEQ ID NO: 956070 - protein, 9 aa, Homo Sapiens
SFELIEALL

SEQ ID NO: 956071 - protein, 9 aa, Homo Sapiens
LFLSVREGN

SEQ ID NO: 956072 - protein, 9 aa, Homo Sapiens
EEKNCTLQC

SEQ ID NO: 956073 - protein, 9 aa, Homo Sapiens
NFIRSLDAL

SEQ ID NO: 956074 - protein, 9 aa, Homo Sapiens
CRSAEIKVI

SEQ ID NO: 956075 - protein, 9 aa, Homo Sapiens
TNQKKWAHL

SEQ ID NO: 956076 - protein, 9 aa, Homo Sapiens
PSAAALQAE

SEQ ID NO: 956077 - protein, 9 aa, Homo Sapiens
QRVMEQMGR

SEQ ID NO: 956078 - protein, 9 aa, Homo Sapiens
DGLQREAIE

SEQ ID NO: 956079 - protein, 9 aa, Homo Sapiens
WARVSLKDL

SEQ ID NO: 956080 - protein, 9 aa, Homo Sapiens
DSSLLAENE

SEQ ID NO: 956081 - protein, 9 aa, Homo Sapiens
ILRFMRRMI

SEQ ID NO: 956082 - protein, 9 aa, Homo Sapiens
ILSGKKQGC

SEQ ID NO: 956083 - protein, 9 aa, Homo Sapiens
VSKNPKKTH

SEQ ID NO: 956084 - protein, 9 aa, Homo Sapiens
PQVTSSGPE

SEQ ID NO: 956085 - protein, 9 aa, Homo Sapiens
KPGKWGRPG

SEQ ID NO: 956086 - protein, 9 aa, Homo Sapiens
VVALAASLV

SEQ ID NO: 956087 - protein, 9 aa, Homo Sapiens
NLSSSHLRP

SEQ ID NO: 956088 - protein, 9 aa, Homo Sapiens
FFLPSPATA

SEQ ID NO: 956089 - protein, 9 aa, Homo Sapiens
FTYSNFPLE

SEQ ID NO: 956090 - protein, 9 aa, Homo Sapiens
EKSQGKALQ

SEQ ID NO: 956091 - protein, 9 aa, Homo Sapiens
LVVIWNTWH

SEQ ID NO: 956092 - protein, 9 aa, Homo Sapiens
EVPGVFSRS

SEQ ID NO: 956093 - protein, 9 aa, Homo Sapiens
LLQTILNFL

SEQ ID NO: 956094 - protein, 9 aa, Homo Sapiens
FGLARNIYK

SEQ ID NO: 956095 - protein, 9 aa, Homo Sapiens
KALPHPDSS

SEQ ID NO: 956096 - protein, 9 aa, Homo Sapiens
MKNGLVSLH

SEQ ID NO: 956097 - protein, 9 aa, Homo Sapiens
EESSQYLSS

SEQ ID NO: 956098 - protein, 9 aa, Homo Sapiens
QMQLETKKE

SEQ ID NO: 956099 - protein, 9 aa, Homo Sapiens
KALQATVVA

SEQ ID NO: 956100 - protein, 9 aa, Homo Sapiens
KRQDKALVG

SEQ ID NO: 956101 - protein, 9 aa, Homo Sapiens
QSPAEGDGN

SEQ ID NO: 956102 - protein, 9 aa, Homo Sapiens
EFIGEKNSR

SEQ ID NO: 956103 - protein, 9 aa, Homo Sapiens
LPGLVDFQQ

SEQ ID NO: 956104 - protein, 9 aa, Homo Sapiens
RGAAHEKNS

SEQ ID NO: 956105 - protein, 9 aa, Homo Sapiens
SSWRAEPVE

SEQ ID NO: 956106 - protein, 9 aa, Homo Sapiens
YKLSEEGRQ

SEQ ID NO: 956107 - protein, 9 aa, Homo Sapiens
EGNSSVINC

SEQ ID NO: 956108 - protein, 9 aa, Homo Sapiens
ESQNLLDNR

SEQ ID NO: 956109 - protein, 9 aa, Homo Sapiens
HTVRKETMM

SEQ ID NO: 956110 - protein, 9 aa, Homo Sapiens
APPPLLQPE

SEQ ID NO: 956111 - protein, 9 aa, Homo Sapiens
ITATSNMAG

SEQ ID NO: 956112 - protein, 9 aa, Homo Sapiens
YAVSREFKD

SEQ ID NO: 956113 - protein, 9 aa, Homo Sapiens
KKLWNQQHF

SEQ ID NO: 956114 - protein, 9 aa, Homo Sapiens
QCLDYAQQN

SEQ ID NO: 956115 - protein, 9 aa, Homo Sapiens
VRKETMMVM

SEQ ID NO: 956116 - protein, 9 aa, Homo Sapiens
KSATPEQSH

SEQ ID NO: 956117 - protein, 9 aa, Homo Sapiens
FFFITLPLS

SEQ ID NO: 956118 - protein, 9 aa, Homo Sapiens
ISCPPHPTP

SEQ ID NO: 956119 - protein, 9 aa, Homo Sapiens
LVKLFSKGE

SEQ ID NO: 956120 - protein, 9 aa, Homo Sapiens
VVYDTCGPG

SEQ ID NO: 956121 - protein, 9 aa, Homo Sapiens
KNLYKLVTD

SEQ ID NO: 956122 - protein, 9 aa, Homo Sapiens
NVVHALLLY

SEQ ID NO: 956123 - protein, 9 aa, Homo Sapiens
EENAHPYRN

SEQ ID NO: 956124 - protein, 9 aa, Homo Sapiens
LLFALFLVI

SEQ ID NO: 956125 - protein, 9 aa, Homo Sapiens
TLVGRSYPV

SEQ ID NO: 956126 - protein, 9 aa, Homo Sapiens
GHFFISIPV

SEQ ID NO: 956127 - protein, 9 aa, Homo Sapiens
LKVPDSSLL

SEQ ID NO: 956128 - protein, 9 aa, Homo Sapiens
IPFTKTDPV

SEQ ID NO: 956129 - protein, 9 aa, Homo Sapiens
GLPGDMVFL

SEQ ID NO: 956130 - protein, 9 aa, Homo Sapiens
DKALVGLKN

SEQ ID NO: 956131 - protein, 9 aa, Homo Sapiens
GRPQSLGRG

SEQ ID NO: 956132 - protein, 9 aa, Homo Sapiens
AEAELQANS

SEQ ID NO: 956133 - protein, 9 aa, Homo Sapiens
YKEVLKACA

SEQ ID NO: 956134 - protein, 9 aa, Homo Sapiens
NFCLTGSSN

SEQ ID NO: 956135 - protein, 9 aa, Homo Sapiens
NKIYEIKVD

SEQ ID NO: 956136 - protein, 9 aa, Homo Sapiens
RTSGFQAKK

SEQ ID NO: 956137 - protein, 9 aa, Homo Sapiens
RGLGGGRKW

SEQ ID NO: 956138 - protein, 9 aa, Homo Sapiens
NGNGQPKAV

SEQ ID NO: 956139 - protein, 9 aa, Homo Sapiens
EAGPKVGED

SEQ ID NO: 956140 - protein, 9 aa, Homo Sapiens
SKKLWNQQH

SEQ ID NO: 956141 - protein, 9 aa, Homo Sapiens
FNLSSSHLR

SEQ ID NO: 956142 - protein, 9 aa, Homo Sapiens
TNNFGSVAR

SEQ ID NO: 956143 - protein, 9 aa, Homo Sapiens
LIILEEKNC

SEQ ID NO: 956144 - protein, 9 aa, Homo Sapiens
GEAEKEYEE

SEQ ID NO: 956145 - protein, 9 aa, Homo Sapiens
PSSFLFEEL

SEQ ID NO: 956146 - protein, 9 aa, Homo Sapiens
MVFFSYMVF

SEQ ID NO: 956147 - protein, 9 aa, Homo Sapiens
ETARFETKI

SEQ ID NO: 956148 - protein, 9 aa, Homo Sapiens
EINDRQMEL

SEQ ID NO: 956149 - protein, 9 aa, Homo Sapiens
RGSSVLATL

SEQ ID NO: 956150 - protein, 9 aa, Homo Sapiens
YTSQSPPFL

SEQ ID NO: 956151 - protein, 9 aa, Homo Sapiens
PSLWGRPQS

SEQ ID NO: 956152 - protein, 9 aa, Homo Sapiens
LKRKLQDKK

SEQ ID NO: 956153 - protein, 9 aa, Homo Sapiens
SFWICHPEK

SEQ ID NO: 956154 - protein, 9 aa, Homo Sapiens
QKFCHGLLK

SEQ ID NO: 956155 - protein, 9 aa, Homo Sapiens
DRLIRSLGQ

SEQ ID NO: 956156 - protein, 9 aa, Homo Sapiens
FDLCPGVIV

SEQ ID NO: 956157 - protein, 9 aa, Homo Sapiens
VKERDAVKN

SEQ ID NO: 956158 - protein, 9 aa, Homo Sapiens
PDHPAVSIS

SEQ ID NO: 956159 - protein, 9 aa, Homo Sapiens
NDANLSIRD

SEQ ID NO: 956160 - protein, 9 aa, Homo Sapiens
RRYKLSEEG

SEQ ID NO: 956161 - protein, 9 aa, Homo Sapiens
VQFKNGNGQ

SEQ ID NO: 956162 - protein, 9 aa, Homo Sapiens
KEINDRQME

SEQ ID NO: 956163 - protein, 9 aa, Homo Sapiens
PVEDQHTVL

SEQ ID NO: 956164 - protein, 9 aa, Homo Sapiens
INNRFSSEK

SEQ ID NO: 956165 - protein, 9 aa, Homo Sapiens
ASKQEEILA

SEQ ID NO: 956166 - protein, 9 aa, Homo Sapiens
SLQGLVFWG

SEQ ID NO: 956167 - protein, 9 aa, Homo Sapiens
QIKAFGLSD

SEQ ID NO: 956168 - protein, 9 aa, Homo Sapiens
QMMYLTTKN

SEQ ID NO: 956169 - protein, 9 aa, Homo Sapiens
SGPFRKKAF

SEQ ID NO: 956170 - protein, 9 aa, Homo Sapiens
LTSEAPPPL

SEQ ID NO: 956171 - protein, 9 aa, Homo Sapiens
RNLGFILAY

SEQ ID NO: 956172 - protein, 9 aa, Homo Sapiens
RKVPVSKNP

SEQ ID NO: 956173 - protein, 9 aa, Homo Sapiens
GPVKAEVTQ

SEQ ID NO: 956174 - protein, 9 aa, Homo Sapiens
SPETPVLTR

SEQ ID NO: 956175 - protein, 9 aa, Homo Sapiens
KSCNLEIFQ

SEQ ID NO: 956176 - protein, 9 aa, Homo Sapiens
ADAFNLSSS

SEQ ID NO: 956177 - protein, 9 aa, Homo Sapiens
GDDVIKKDS

SEQ ID NO: 956178 - protein, 9 aa, Homo Sapiens
RKSYNSVIR

SEQ ID NO: 956179 - protein, 9 aa, Homo Sapiens
MEFCGIHET

SEQ ID NO: 956180 - protein, 9 aa, Homo Sapiens
NLSIRDKEG

SEQ ID NO: 956181 - protein, 9 aa, Homo Sapiens
QLLPNAQSS

SEQ ID NO: 956182 - protein, 9 aa, Homo Sapiens
FSKGEGIRT

SEQ ID NO: 956183 - protein, 9 aa, Homo Sapiens
ICHPEKYME

SEQ ID NO: 956184 - protein, 9 aa, Homo Sapiens
SLGRGCHRN

SEQ ID NO: 956185 - protein, 9 aa, Homo Sapiens
GSIISNMNA

SEQ ID NO: 956186 - protein, 9 aa, Homo Sapiens
GVLQGTLLS

SEQ ID NO: 956187 - protein, 9 aa, Homo Sapiens
KAWNFRGQK

SEQ ID NO: 956188 - protein, 9 aa, Homo Sapiens
SVKKIGKVV

SEQ ID NO: 956189 - protein, 9 aa, Homo Sapiens
TGLGLLGMS

SEQ ID NO: 956190 - protein, 9 aa, Homo Sapiens
SKSGPFRKK

SEQ ID NO: 956191 - protein, 9 aa, Homo Sapiens
ESSQYLSSR

SEQ ID NO: 956192 - protein, 9 aa, Homo Sapiens
REFKDLELD

SEQ ID NO: 956193 - protein, 9 aa, Homo Sapiens
TEPSAAEFQ

SEQ ID NO: 956194 - protein, 9 aa, Homo Sapiens
AIADAFNLS

SEQ ID NO: 956195 - protein, 9 aa, Homo Sapiens
NTNVMSGFN

SEQ ID NO: 956196 - protein, 9 aa, Homo Sapiens
PQGEPEPPG

SEQ ID NO: 956197 - protein, 9 aa, Homo Sapiens
FLHSGTAES

SEQ ID NO: 956198 - protein, 9 aa, Homo Sapiens
LISSFFHFL

SEQ ID NO: 956199 - protein, 9 aa, Homo Sapiens
EPDREKVVT

SEQ ID NO: 956200 - protein, 9 aa, Homo Sapiens
NKWWYNKGE

SEQ ID NO: 956201 - protein, 9 aa, Homo Sapiens
FTRLFYKAL

SEQ ID NO: 956202 - protein, 9 aa, Homo Sapiens
IIRRYKLSE

SEQ ID NO: 956203 - protein, 9 aa, Homo Sapiens
ELEEMSTSN

SEQ ID NO: 956204 - protein, 9 aa, Homo Sapiens
AATASGDEV

SEQ ID NO: 956205 - protein, 9 aa, Homo Sapiens
YEYEGGHIN

SEQ ID NO: 956206 - protein, 9 aa, Homo Sapiens
REGLRPLWS

SEQ ID NO: 956207 - protein, 9 aa, Homo Sapiens
KNGNNLLHI

SEQ ID NO: 956208 - protein, 9 aa, Homo Sapiens
HWNWLEQNI

SEQ ID NO: 956209 - protein, 9 aa, Homo Sapiens
GPQAPTSLN

SEQ ID NO: 956210 - protein, 9 aa, Homo Sapiens
AISQGIILP

SEQ ID NO: 956211 - protein, 9 aa, Homo Sapiens
LLTLDSLSA

SEQ ID NO: 956212 - protein, 9 aa, Homo Sapiens
LRLFILNWF

SEQ ID NO: 956213 - protein, 9 aa, Homo Sapiens
AIEELGKAL

SEQ ID NO: 956214 - protein, 9 aa, Homo Sapiens
KNLLQQLLP

SEQ ID NO: 956215 - protein, 9 aa, Homo Sapiens
SEALGHVAL

SEQ ID NO: 956216 - protein, 9 aa, Homo Sapiens
AKQRLTLLS

SEQ ID NO: 956217 - protein, 9 aa, Homo Sapiens
FRKPRLLQS

SEQ ID NO: 956218 - protein, 9 aa, Homo Sapiens
RSTRPCGSS

SEQ ID NO: 956219 - protein, 9 aa, Homo Sapiens
EKIDQMKRN

SEQ ID NO: 956220 - protein, 9 aa, Homo Sapiens
HMFTREFSK

SEQ ID NO: 956221 - protein, 9 aa, Homo Sapiens
QSHFKHSFR

SEQ ID NO: 956222 - protein, 9 aa, Homo Sapiens
RGQKRKQST

SEQ ID NO: 956223 - protein, 9 aa, Homo Sapiens
DSLITTPEV

SEQ ID NO: 956224 - protein, 9 aa, Homo Sapiens
GLRALARGL

SEQ ID NO: 956225 - protein, 9 aa, Homo Sapiens
TVGSHSSPE

SEQ ID NO: 956226 - protein, 9 aa, Homo Sapiens
STSLELVPP

SEQ ID NO: 956227 - protein, 9 aa, Homo Sapiens
TEEHSENYS

SEQ ID NO: 956228 - protein, 9 aa, Homo Sapiens
CDLKVQVVI

SEQ ID NO: 956229 - protein, 9 aa, Homo Sapiens
LLQNDANLS

SEQ ID NO: 956230 - protein, 9 aa, Homo Sapiens
LVLQVKISV

SEQ ID NO: 956231 - protein, 9 aa, Homo Sapiens
LCGEFIGEK

SEQ ID NO: 956232 - protein, 9 aa, Homo Sapiens
LERGHDLTA

SEQ ID NO: 956233 - protein, 9 aa, Homo Sapiens
MAYIQDAKQ

SEQ ID NO: 956234 - protein, 9 aa, Homo Sapiens
ITSKLVSNG

SEQ ID NO: 956235 - protein, 9 aa, Homo Sapiens
TPLVVIWNT

SEQ ID NO: 956236 - protein, 9 aa, Homo Sapiens
SHPSLCLLT

SEQ ID NO: 956237 - protein, 9 aa, Homo Sapiens
FHFLQSLNG

SEQ ID NO: 956238 - protein, 9 aa, Homo Sapiens
VHFRSARRL

SEQ ID NO: 956239 - protein, 9 aa, Homo Sapiens
TSSGPEHPE

SEQ ID NO: 956240 - protein, 9 aa, Homo Sapiens
KNFIRSLDA

SEQ ID NO: 956241 - protein, 9 aa, Homo Sapiens
PGTRLFLAR

SEQ ID NO: 956242 - protein, 9 aa, Homo Sapiens
VHPQVTSSG

SEQ ID NO: 956243 - protein, 9 aa, Homo Sapiens
QLSPKGTLD

SEQ ID NO: 956244 - protein, 9 aa, Homo Sapiens
EEKLKKEGF

SEQ ID NO: 956245 - protein, 9 aa, Homo Sapiens
AGPVKAEVT

SEQ ID NO: 956246 - protein, 9 aa, Homo Sapiens
GLLGLAKRE

SEQ ID NO: 956247 - protein, 9 aa, Homo Sapiens
IVEFAPFEK

SEQ ID NO: 956248 - protein, 9 aa, Homo Sapiens
SLLAENEAT

SEQ ID NO: 956249 - protein, 9 aa, Homo Sapiens
KENISSVLY

SEQ ID NO: 956250 - protein, 9 aa, Homo Sapiens
TSSPMIVQR

SEQ ID NO: 956251 - protein, 9 aa, Homo Sapiens
VGSHSSPET

SEQ ID NO: 956252 - protein, 9 aa, Homo Sapiens
KGHFFISIP

SEQ ID NO: 956253 - protein, 9 aa, Homo Sapiens
SDSQVSKEV

SEQ ID NO: 956254 - protein, 9 aa, Homo Sapiens
LSLTEEHSE

SEQ ID NO: 956255 - protein, 9 aa, Homo Sapiens
QKKWAHLSP

SEQ ID NO: 956256 - protein, 9 aa, Homo Sapiens
QPCFLGMEF

SEQ ID NO: 956257 - protein, 9 aa, Homo Sapiens
GHINTAVNL

SEQ ID NO: 956258 - protein, 9 aa, Homo Sapiens
AMYSKDKVT

SEQ ID NO: 956259 - protein, 9 aa, Homo Sapiens
RLRVQKAIG

SEQ ID NO: 956260 - protein, 9 aa, Homo Sapiens
FFANTWESW

SEQ ID NO: 956261 - protein, 9 aa, Homo Sapiens
GERFSSSEV

SEQ ID NO: 956262 - protein, 9 aa, Homo Sapiens
KNSQIYKFL

SEQ ID NO: 956263 - protein, 9 aa, Homo Sapiens
GLLREEAMK

SEQ ID NO: 956264 - protein, 9 aa, Homo Sapiens
MISAHCNFC

SEQ ID NO: 956265 - protein, 9 aa, Homo Sapiens
SYPVRRNGI

SEQ ID NO: 956266 - protein, 9 aa, Homo Sapiens
LARGLLLFG

SEQ ID NO: 956267 - protein, 9 aa, Homo Sapiens
KATVVGDQQ

SEQ ID NO: 956268 - protein, 9 aa, Homo Sapiens
LILCILRFM

SEQ ID NO: 956269 - protein, 9 aa, Homo Sapiens
SKRTSGFQA

SEQ ID NO: 956270 - protein, 9 aa, Homo Sapiens
VNISFVRLN

SEQ ID NO: 956271 - protein, 9 aa, Homo Sapiens
PHPDSSPHP

SEQ ID NO: 956272 - protein, 9 aa, Homo Sapiens
DSFSYRILN

SEQ ID NO: 956273 - protein, 9 aa, Homo Sapiens
MKGHFFISI

SEQ ID NO: 956274 - protein, 9 aa, Homo Sapiens
LLGLAKREA

SEQ ID NO: 956275 - protein, 9 aa, Homo Sapiens
LKACALNDD

SEQ ID NO: 956276 - protein, 9 aa, Homo Sapiens
VQSCGPPPQ

SEQ ID NO: 956277 - protein, 9 aa, Homo Sapiens
MLRPDSRDT

SEQ ID NO: 956278 - protein, 9 aa, Homo Sapiens
YSGYDFGYL

SEQ ID NO: 956279 - protein, 9 aa, Homo Sapiens
GWSPQIGDP

SEQ ID NO: 956280 - protein, 9 aa, Homo Sapiens
AAHEKNSQI

SEQ ID NO: 956281 - protein, 9 aa, Homo Sapiens
IILVLFLLI

SEQ ID NO: 956282 - protein, 9 aa, Homo Sapiens
YSRFWLLVH

SEQ ID NO: 956283 - protein, 9 aa, Homo Sapiens
SFYDRYRDK

SEQ ID NO: 956284 - protein, 9 aa, Homo Sapiens
LTVTTTAVP

SEQ ID NO: 956285 - protein, 9 aa, Homo Sapiens
DRGGDWRGE

SEQ ID NO: 956286 - protein, 9 aa, Homo Sapiens
NADARNEDL

SEQ ID NO: 956287 - protein, 9 aa, Homo Sapiens
FNLISVGLR

SEQ ID NO: 956288 - protein, 9 aa, Homo Sapiens
NTAVNLPLE

SEQ ID NO: 956289 - protein, 9 aa, Homo Sapiens
IFKRIAGEA

SEQ ID NO: 956290 - protein, 9 aa, Homo Sapiens
HIRFLQQQM

SEQ ID NO: 956291 - protein, 9 aa, Homo Sapiens
EKEYEEEEW

SEQ ID NO: 956292 - protein, 9 aa, Homo Sapiens
KSLLYAQAM

SEQ ID NO: 956293 - protein, 9 aa, Homo Sapiens
SGTPDLRDG

SEQ ID NO: 956294 - protein, 9 aa, Homo Sapiens
LGAGPVKAE

SEQ ID NO: 956295 - protein, 9 aa, Homo Sapiens
RAGNVVHAL

SEQ ID NO: 956296 - protein, 9 aa, Homo Sapiens
KQRLTLLSA

SEQ ID NO: 956297 - protein, 9 aa, Homo Sapiens
AGLGLLREE

SEQ ID NO: 956298 - protein, 9 aa, Homo Sapiens
SYRILNLSR

SEQ ID NO: 956299 - protein, 9 aa, Homo Sapiens
RGREGLRPL

SEQ ID NO: 956300 - protein, 9 aa, Homo Sapiens
KVHFRSARR

SEQ ID NO: 956301 - protein, 9 aa, Homo Sapiens
PNFDLRKKD

SEQ ID NO: 956302 - protein, 9 aa, Homo Sapiens
KIHDKNGNN

SEQ ID NO: 956303 - protein, 9 aa, Homo Sapiens
QLRVHCRAL

SEQ ID NO: 956304 - protein, 9 aa, Homo Sapiens
CQMQLETKK

SEQ ID NO: 956305 - protein, 9 aa, Homo Sapiens
FLGMEFCGI

SEQ ID NO: 956306 - protein, 9 aa, Homo Sapiens
RIGPQIQLS

SEQ ID NO: 956307 - protein, 9 aa, Homo Sapiens
GGGSLSDYF

SEQ ID NO: 956308 - protein, 9 aa, Homo Sapiens
RSAEIKVIM

SEQ ID NO: 956309 - protein, 9 aa, Homo Sapiens
AFIGQKFCH

SEQ ID NO: 956310 - protein, 9 aa, Homo Sapiens
GGYGGGSFG

SEQ ID NO: 956311 - protein, 9 aa, Homo Sapiens
GVQYGAEVA

SEQ ID NO: 956312 - protein, 9 aa, Homo Sapiens
KSPNEGFEG

SEQ ID NO: 956313 - protein, 9 aa, Homo Sapiens
PMSGILSNH

SEQ ID NO: 956314 - protein, 9 aa, Homo Sapiens
KLQDKKQHL

SEQ ID NO: 956315 - protein, 9 aa, Homo Sapiens
IFLKMMEAR

SEQ ID NO: 956316 - protein, 9 aa, Homo Sapiens
VGNVGSIIS

SEQ ID NO: 956317 - protein, 9 aa, Homo Sapiens
MLIGPDDRL

SEQ ID NO: 956318 - protein, 9 aa, Homo Sapiens
YAFIGQKFC

SEQ ID NO: 956319 - protein, 9 aa, Homo Sapiens
VIEKKVVFS

SEQ ID NO: 956320 - protein, 9 aa, Homo Sapiens
KQRMLVREE

SEQ ID NO: 956321 - protein, 9 aa, Homo Sapiens
DLKVQVVIE

SEQ ID NO: 956322 - protein, 9 aa, Homo Sapiens
ASLVFTELT

SEQ ID NO: 956323 - protein, 9 aa, Homo Sapiens
ESQSQERIG

SEQ ID NO: 956324 - protein, 9 aa, Homo Sapiens
LRPLWSELD

SEQ ID NO: 956325 - protein, 9 aa, Homo Sapiens
AFLCISTGI

SEQ ID NO: 956326 - protein, 9 aa, Homo Sapiens
ISKSLLYAQ

SEQ ID NO: 956327 - protein, 9 aa, Homo Sapiens
FLKSATPEQ

SEQ ID NO: 956328 - protein, 9 aa, Homo Sapiens
TSQSPPFLF

SEQ ID NO: 956329 - protein, 9 aa, Homo Sapiens
IENLIHIVV

SEQ ID NO: 956330 - protein, 9 aa, Homo Sapiens
PSSTPLVVI

SEQ ID NO: 956331 - protein, 9 aa, Homo Sapiens
KKNFDLCPG

SEQ ID NO: 956332 - protein, 9 aa, Homo Sapiens
QLPQLSPKG

SEQ ID NO: 956333 - protein, 9 aa, Homo Sapiens
HCNFCLTGS

SEQ ID NO: 956334 - protein, 9 aa, Homo Sapiens
LGFILAYAF

SEQ ID NO: 956335 - protein, 9 aa, Homo Sapiens
LQAARAGNV

SEQ ID NO: 956336 - protein, 9 aa, Homo Sapiens
GGDVSIYTN

SEQ ID NO: 956337 - protein, 9 aa, Homo Sapiens
ATVVGDQQA

SEQ ID NO: 956338 - protein, 9 aa, Homo Sapiens
TGGQLPVED

SEQ ID NO: 956339 - protein, 9 aa, Homo Sapiens
PQSLGRGCH

SEQ ID NO: 956340 - protein, 9 aa, Homo Sapiens
KLQKEINAV

SEQ ID NO: 956341 - protein, 9 aa, Homo Sapiens
LGLAKREAW

SEQ ID NO: 956342 - protein, 9 aa, Homo Sapiens
PGDMVFLEK

SEQ ID NO: 956343 - protein, 9 aa, Homo Sapiens
QQVGLLMEV

SEQ ID NO: 956344 - protein, 9 aa, Homo Sapiens
EQVRTILVL

SEQ ID NO: 956345 - protein, 9 aa, Homo Sapiens
KKDSPESPF

SEQ ID NO: 956346 - protein, 9 aa, Homo Sapiens
EPPGQQGTP

SEQ ID NO: 956347 - protein, 9 aa, Homo Sapiens
KSYNSVIRE

SEQ ID NO: 956348 - protein, 9 aa, Homo Sapiens
SNFPLEQHL

SEQ ID NO: 956349 - protein, 9 aa, Homo Sapiens
SQELQEADE

SEQ ID NO: 956350 - protein, 9 aa, Homo Sapiens
TSETVPRLA

SEQ ID NO: 956351 - protein, 9 aa, Homo Sapiens
GILSNHGLS

SEQ ID NO: 956352 - protein, 9 aa, Homo Sapiens
PQAPTSLNG

SEQ ID NO: 956353 - protein, 9 aa, Homo Sapiens
LKYMNRQAS

SEQ ID NO: 956354 - protein, 9 aa, Homo Sapiens
AQIHTVRKE

SEQ ID NO: 956355 - protein, 9 aa, Homo Sapiens
ETSFELIEA

SEQ ID NO: 956356 - protein, 9 aa, Homo Sapiens
SFRKPRLLQ

SEQ ID NO: 956357 - protein, 9 aa, Homo Sapiens
PFEKAAKKK

SEQ ID NO: 956358 - protein, 9 aa, Homo Sapiens
PKEIREKIL

SEQ ID NO: 956359 - protein, 9 aa, Homo Sapiens
GDEVRASEA

SEQ ID NO: 956360 - protein, 9 aa, Homo Sapiens
LFSKGEGIR

SEQ ID NO: 956361 - protein, 9 aa, Homo Sapiens
KRKLQDKKQ

SEQ ID NO: 956362 - protein, 9 aa, Homo Sapiens
HEKNSQIYK

SEQ ID NO: 956363 - protein, 9 aa, Homo Sapiens
FQQRPGRHG

SEQ ID NO: 956364 - protein, 9 aa, Homo Sapiens
KRIAGEASR

SEQ ID NO: 956365 - protein, 9 aa, Homo Sapiens
LSLEEPDRE

SEQ ID NO: 956366 - protein, 9 aa, Homo Sapiens
SENYSCEAN

SEQ ID NO: 956367 - protein, 9 aa, Homo Sapiens
LSVREGNSS

SEQ ID NO: 956368 - protein, 9 aa, Homo Sapiens
GGGYGGGSF

SEQ ID NO: 956369 - protein, 9 aa, Homo Sapiens
KAFGLSDIT

SEQ ID NO: 956370 - protein, 9 aa, Homo Sapiens
AEIKVIMVT

SEQ ID NO: 956371 - protein, 9 aa, Homo Sapiens
RTTSFLTVT

SEQ ID NO: 956372 - protein, 9 aa, Homo Sapiens
WGCGSCGGS

SEQ ID NO: 956373 - protein, 9 aa, Homo Sapiens
FDCQNRGWY

SEQ ID NO: 956374 - protein, 9 aa, Homo Sapiens
INTAVNLPL

SEQ ID NO: 956375 - protein, 9 aa, Homo Sapiens
KKQMMYLTT

SEQ ID NO: 956376 - protein, 9 aa, Homo Sapiens
FSDFEDVPN

SEQ ID NO: 956377 - protein, 9 aa, Homo Sapiens
LTKELKSPN

SEQ ID NO: 956378 - protein, 9 aa, Homo Sapiens
QKLQKEINA

SEQ ID NO: 956379 - protein, 9 aa, Homo Sapiens
DNYGATCKY

SEQ ID NO: 956380 - protein, 9 aa, Homo Sapiens
SSKQMESSK

SEQ ID NO: 956381 - protein, 9 aa, Homo Sapiens
QAMKNGLVS

SEQ ID NO: 956382 - protein, 9 aa, Homo Sapiens
KFLYESWTK

SEQ ID NO: 956383 - protein, 9 aa, Homo Sapiens
TCKYHCDGG

SEQ ID NO: 956384 - protein, 9 aa, Homo Sapiens
TDPNFDLRK

SEQ ID NO: 956385 - protein, 9 aa, Homo Sapiens
DSSPHPAQD

SEQ ID NO: 956386 - protein, 9 aa, Homo Sapiens
SVAFLCIST

SEQ ID NO: 956387 - protein, 9 aa, Homo Sapiens
DRQSFLQRY

SEQ ID NO: 956388 - protein, 9 aa, Homo Sapiens
ASKSGPFRK

SEQ ID NO: 956389 - protein, 9 aa, Homo Sapiens
YNPKHFHNR

SEQ ID NO: 956390 - protein, 9 aa, Homo Sapiens
LWGRPQSLG

SEQ ID NO: 956391 - protein, 9 aa, Homo Sapiens
VNFADLPAL

SEQ ID NO: 956392 - protein, 9 aa, Homo Sapiens
SFQEEALKL

SEQ ID NO: 956393 - protein, 9 aa, Homo Sapiens
FSVHPWSRP

SEQ ID NO: 956394 - protein, 9 aa, Homo Sapiens
NVMSGFNGS

SEQ ID NO: 956395 - protein, 9 aa, Homo Sapiens
GVSLLEVLD

SEQ ID NO: 956396 - protein, 9 aa, Homo Sapiens
ATEKSRWSG

SEQ ID NO: 956397 - protein, 9 aa, Homo Sapiens
RYVAISKSL

SEQ ID NO: 956398 - protein, 9 aa, Homo Sapiens
VKLTVALDG

SEQ ID NO: 956399 - protein, 9 aa, Homo Sapiens
TCKGQVQSC

SEQ ID NO: 956400 - protein, 9 aa, Homo Sapiens
DKNGNNLLH

SEQ ID NO: 956401 - protein, 9 aa, Homo Sapiens
SVNFADLPA

SEQ ID NO: 956402 - protein, 9 aa, Homo Sapiens
GFILAYAFL

SEQ ID NO: 956403 - protein, 9 aa, Homo Sapiens
DRQMELKEL

SEQ ID NO: 956404 - protein, 9 aa, Homo Sapiens
FRGQKRKQS

SEQ ID NO: 956405 - protein, 9 aa, Homo Sapiens
AYIQDAKQR

SEQ ID NO: 956406 - protein, 9 aa, Homo Sapiens
KVTLSSLMK

SEQ ID NO: 956407 - protein, 9 aa, Homo Sapiens
ATEEQSPAE

SEQ ID NO: 956408 - protein, 9 aa, Homo Sapiens
KKESLRAAQ

SEQ ID NO: 956409 - protein, 9 aa, Homo Sapiens
GLHTWARVS

SEQ ID NO: 956410 - protein, 9 aa, Homo Sapiens
TIVGNVGSI

SEQ ID NO: 956411 - protein, 9 aa, Homo Sapiens
VSDRQSFLQ

SEQ ID NO: 956412 - protein, 9 aa, Homo Sapiens
NSVQKLKSN

SEQ ID NO: 956413 - protein, 9 aa, Homo Sapiens
GDKHSRGNW

SEQ ID NO: 956414 - protein, 9 aa, Homo Sapiens
EKMHDQKEK

SEQ ID NO: 956415 - protein, 9 aa, Homo Sapiens
SKWGCGSCG

SEQ ID NO: 956416 - protein, 9 aa, Homo Sapiens
PSRGPVSLS

SEQ ID NO: 956417 - protein, 9 aa, Homo Sapiens
CPTAGLGLL

SEQ ID NO: 956418 - protein, 9 aa, Homo Sapiens
IQEEAEHMF

SEQ ID NO: 956419 - protein, 9 aa, Homo Sapiens
HARGAAHEK

SEQ ID NO: 956420 - protein, 9 aa, Homo Sapiens
SHSPVLLPR

SEQ ID NO: 956421 - protein, 9 aa, Homo Sapiens
QAARAGNVV

SEQ ID NO: 956422 - protein, 9 aa, Homo Sapiens
SYNSVIREL

SEQ ID NO: 956423 - protein, 9 aa, Homo Sapiens
AFGNKVKAE

SEQ ID NO: 956424 - protein, 9 aa, Homo Sapiens
ILEEKNCTL

SEQ ID NO: 956425 - protein, 9 aa, Homo Sapiens
GQLPVEDQH

SEQ ID NO: 956426 - protein, 9 aa, Homo Sapiens
IEAADLAHA

SEQ ID NO: 956427 - protein, 9 aa, Homo Sapiens
QLNEKETSF

SEQ ID NO: 956428 - protein, 9 aa, Homo Sapiens
PGDTMDSGE

SEQ ID NO: 956429 - protein, 9 aa, Homo Sapiens
ISLPTFRKF

SEQ ID NO: 956430 - protein, 9 aa, Homo Sapiens
RAIIEADSL

SEQ ID NO: 956431 - protein, 9 aa, Homo Sapiens
NFRGQKRKQ

SEQ ID NO: 956432 - protein, 9 aa, Homo Sapiens
LRHNKIYEI

SEQ ID NO: 956433 - protein, 9 aa, Homo Sapiens
ENADARNED

SEQ ID NO: 956434 - protein, 9 aa, Homo Sapiens
GRQNQSSHS

SEQ ID NO: 956435 - protein, 9 aa, Homo Sapiens
SERAYNPKH

SEQ ID NO: 956436 - protein, 9 aa, Homo Sapiens
NSETGYTPG

SEQ ID NO: 956437 - protein, 9 aa, Homo Sapiens
NEGFEGKSL

SEQ ID NO: 956438 - protein, 9 aa, Homo Sapiens
EEPDREKVV

SEQ ID NO: 956439 - protein, 9 aa, Homo Sapiens
AELQANSFY

SEQ ID NO: 956440 - protein, 9 aa, Homo Sapiens
KNFDLCPGV

SEQ ID NO: 956441 - protein, 9 aa, Homo Sapiens
LLREEAMKP

SEQ ID NO: 956442 - protein, 9 aa, Homo Sapiens
TNTAITATS

SEQ ID NO: 956443 - protein, 9 aa, Homo Sapiens
AWNFRGQKR

SEQ ID NO: 956444 - protein, 9 aa, Homo Sapiens
NLGFILAYA

SEQ ID NO: 956445 - protein, 9 aa, Homo Sapiens
HNKIYEIKV

SEQ ID NO: 956446 - protein, 9 aa, Homo Sapiens
TYSNFPLEQ

SEQ ID NO: 956447 - protein, 9 aa, Homo Sapiens
LLQPETNDV

SEQ ID NO: 956448 - protein, 9 aa, Homo Sapiens
NQSSHSPVL

SEQ ID NO: 956449 - protein, 9 aa, Homo Sapiens
ESLRAAQEA

SEQ ID NO: 956450 - protein, 9 aa, Homo Sapiens
RSYPVRRNG

SEQ ID NO: 956451 - protein, 9 aa, Homo Sapiens
VMSGFNGSK

SEQ ID NO: 956452 - protein, 9 aa, Homo Sapiens
ITFDCQNRG

SEQ ID NO: 956453 - protein, 9 aa, Homo Sapiens
EAEKEYEEE

SEQ ID NO: 956454 - protein, 9 aa, Homo Sapiens
AIVEFAPFE

SEQ ID NO: 956455 - protein, 9 aa, Homo Sapiens
STGDKHSRG

SEQ ID NO: 956456 - protein, 9 aa, Homo Sapiens
QGKLTFFDA

SEQ ID NO: 956457 - protein, 9 aa, Homo Sapiens
SKQMESSKG

SEQ ID NO: 956458 - protein, 9 aa, Homo Sapiens
RKLQDKKQH

SEQ ID NO: 956459 - protein, 9 aa, Homo Sapiens
NLISVGLRV

SEQ ID NO: 956460 - protein, 9 aa, Homo Sapiens
NVGSIISNM

SEQ ID NO: 956461 - protein, 9 aa, Homo Sapiens
IGDFGLATE

SEQ ID NO: 956462 - protein, 9 aa, Homo Sapiens
PLLQPETND

SEQ ID NO: 956463 - protein, 9 aa, Homo Sapiens
NHIRFLQQQ

SEQ ID NO: 956464 - protein, 9 aa, Homo Sapiens
KAAMYSKDK

SEQ ID NO: 956465 - protein, 9 aa, Homo Sapiens
GQDWVPLHS

SEQ ID NO: 956466 - protein, 9 aa, Homo Sapiens
PQSLIILEE

SEQ ID NO: 956467 - protein, 9 aa, Homo Sapiens
DLETKETAW

SEQ ID NO: 956468 - protein, 9 aa, Homo Sapiens
QQMPTLEHT

SEQ ID NO: 956469 - protein, 9 aa, Homo Sapiens
SKTSTGTVY

SEQ ID NO: 956470 - protein, 9 aa, Homo Sapiens
SRHRAEALP

SEQ ID NO: 956471 - protein, 9 aa, Homo Sapiens
PIYFSDFED

SEQ ID NO: 956472 - protein, 9 aa, Homo Sapiens
NISEAEASG

SEQ ID NO: 956473 - protein, 9 aa, Homo Sapiens
LSEASLLEG

SEQ ID NO: 956474 - protein, 9 aa, Homo Sapiens
PDSSLLAEN

SEQ ID NO: 956475 - protein, 9 aa, Homo Sapiens
GKGKDAFGN

SEQ ID NO: 956476 - protein, 9 aa, Homo Sapiens
TAWQLPMFS

SEQ ID NO: 956477 - protein, 9 aa, Homo Sapiens
EQMGRSLLP

SEQ ID NO: 956478 - protein, 9 aa, Homo Sapiens
VEDETDVEG

SEQ ID NO: 956479 - protein, 9 aa, Homo Sapiens
RPQSLGRGC

SEQ ID NO: 956480 - protein, 9 aa, Homo Sapiens
VPGVFSRSV

SEQ ID NO: 956481 - protein, 9 aa, Homo Sapiens
QASNHPFFV

SEQ ID NO: 956482 - protein, 9 aa, Homo Sapiens
KLTVALDGS

SEQ ID NO: 956483 - protein, 9 aa, Homo Sapiens
STRPCGSSL

SEQ ID NO: 956484 - protein, 9 aa, Homo Sapiens
SYEKLSINK

SEQ ID NO: 956485 - protein, 9 aa, Homo Sapiens
GPFRKKAFH

SEQ ID NO: 956486 - protein, 9 aa, Homo Sapiens
GREGLRPLW

SEQ ID NO: 956487 - protein, 9 aa, Homo Sapiens
RKISFGKNL

SEQ ID NO: 956488 - protein, 9 aa, Homo Sapiens
NAIMTYLFN

SEQ ID NO: 956489 - protein, 9 aa, Homo Sapiens
IWGRSTRPC

SEQ ID NO: 956490 - protein, 9 aa, Homo Sapiens
QIHTVRKET

SEQ ID NO: 956491 - protein, 9 aa, Homo Sapiens
QNRQPHLGL

SEQ ID NO: 956492 - protein, 9 aa, Homo Sapiens
TIYKDPSIE

SEQ ID NO: 956493 - protein, 9 aa, Homo Sapiens
DLVLYNFFA

SEQ ID NO: 956494 - protein, 9 aa, Homo Sapiens
LERISHSIF

SEQ ID NO: 956495 - protein, 9 aa, Homo Sapiens
GFLHSGTAE

SEQ ID NO: 956496 - protein, 9 aa, Homo Sapiens
KRGLGGGRK

SEQ ID NO: 956497 - protein, 9 aa, Homo Sapiens
AVSKCRSAE

SEQ ID NO: 956498 - protein, 9 aa, Homo Sapiens
GRKWKREEG

SEQ ID NO: 956499 - protein, 9 aa, Homo Sapiens
QRLTLLSAQ

SEQ ID NO: 956500 - protein, 9 aa, Homo Sapiens
EFLLFALFL

SEQ ID NO: 956501 - protein, 9 aa, Homo Sapiens
ALAASLVFT

SEQ ID NO: 956502 - protein, 9 aa, Homo Sapiens
IRARTAADY

SEQ ID NO: 956503 - protein, 9 aa, Homo Sapiens
KLSEASLLE

SEQ ID NO: 956504 - protein, 9 aa, Homo Sapiens
KIPTSRGRH

SEQ ID NO: 956505 - protein, 9 aa, Homo Sapiens
NGSLQGLVF

SEQ ID NO: 956506 - protein, 9 aa, Homo Sapiens
RGGDWRGEP

SEQ ID NO: 956507 - protein, 9 aa, Homo Sapiens
MESSKGSSN

SEQ ID NO: 956508 - protein, 9 aa, Homo Sapiens
SHSIFSLHN

SEQ ID NO: 956509 - protein, 9 aa, Homo Sapiens
IMTYLFNIS

SEQ ID NO: 956510 - protein, 9 aa, Homo Sapiens
AESPSTTAS

SEQ ID NO: 956511 - protein, 9 aa, Homo Sapiens
IILEEKNCT

SEQ ID NO: 956512 - protein, 9 aa, Homo Sapiens
GFLDALIQV

SEQ ID NO: 956513 - protein, 9 aa, Homo Sapiens
CGEFIGEKN

SEQ ID NO: 956514 - protein, 9 aa, Homo Sapiens
SQNFSRSVP

SEQ ID NO: 956515 - protein, 9 aa, Homo Sapiens
QTILNFLIS

SEQ ID NO: 956516 - protein, 9 aa, Homo Sapiens
KYTRMEIFR

SEQ ID NO: 956517 - protein, 9 aa, Homo Sapiens
LRTHDAESV

SEQ ID NO: 956518 - protein, 9 aa, Homo Sapiens
DEENAHPYR

SEQ ID NO: 956519 - protein, 9 aa, Homo Sapiens
EVTQTPRYL

SEQ ID NO: 956520 - protein, 9 aa, Homo Sapiens
FAQIHTVRK

SEQ ID NO: 956521 - protein, 9 aa, Homo Sapiens
LKVQVVIEK

SEQ ID NO: 956522 - protein, 9 aa, Homo Sapiens
LVLFLLILL

SEQ ID NO: 956523 - protein, 9 aa, Homo Sapiens
SFSYRILNL

SEQ ID NO: 956524 - protein, 9 aa, Homo Sapiens
KLFSKGEGI

SEQ ID NO: 956525 - protein, 9 aa, Homo Sapiens
CQNRGWYIQ

SEQ ID NO: 956526 - protein, 9 aa, Homo Sapiens
PFTKTDPVV

SEQ ID NO: 956527 - protein, 9 aa, Homo Sapiens
KEMKARKIS

SEQ ID NO: 956528 - protein, 9 aa, Homo Sapiens
TSKTSTGTV

SEQ ID NO: 956529 - protein, 9 aa, Homo Sapiens
HDQKEKIRE

SEQ ID NO: 956530 - protein, 9 aa, Homo Sapiens
LEEKNCTLQ

SEQ ID NO: 956531 - protein, 9 aa, Homo Sapiens
EEQVRTILV

SEQ ID NO: 956532 - protein, 9 aa, Homo Sapiens
KIAEKDEKI

SEQ ID NO: 956533 - protein, 9 aa, Homo Sapiens
FNGSKENSH

SEQ ID NO: 956534 - protein, 9 aa, Homo Sapiens
QQSLILSYV

SEQ ID NO: 956535 - protein, 9 aa, Homo Sapiens
HPPNIIGVK

SEQ ID NO: 956536 - protein, 9 aa, Homo Sapiens
ESLKRKLQD

SEQ ID NO: 956537 - protein, 9 aa, Homo Sapiens
KYMNRQASQ

SEQ ID NO: 956538 - protein, 9 aa, Homo Sapiens
KLWNQQHFA

SEQ ID NO: 956539 - protein, 9 aa, Homo Sapiens
SPSTTASPT

SEQ ID NO: 956540 - protein, 9 aa, Homo Sapiens
SKLVSNGVQ

SEQ ID NO: 956541 - protein, 9 aa, Homo Sapiens
RKFTRPEEI

SEQ ID NO: 956542 - protein, 9 aa, Homo Sapiens
KKAIQRIAS

SEQ ID NO: 956543 - protein, 9 aa, Homo Sapiens
SSVNFADLP

SEQ ID NO: 956544 - protein, 9 aa, Homo Sapiens
MKLSKSSWL

SEQ ID NO: 956545 - protein, 9 aa, Homo Sapiens
LRSKVHFRS

SEQ ID NO: 956546 - protein, 9 aa, Homo Sapiens
KELVLKSNY

SEQ ID NO: 956547 - protein, 9 aa, Homo Sapiens
SNASSCESL

SEQ ID NO: 956548 - protein, 9 aa, Homo Sapiens
TLQKWLLRK

SEQ ID NO: 956549 - protein, 9 aa, Homo Sapiens
DNSSSVNFA

SEQ ID NO: 956550 - protein, 9 aa, Homo Sapiens
ENLIHIVVV

SEQ ID NO: 956551 - protein, 9 aa, Homo Sapiens
FLVQFKNGN

SEQ ID NO: 956552 - protein, 9 aa, Homo Sapiens
SKGSSNTTE

SEQ ID NO: 956553 - protein, 9 aa, Homo Sapiens
LRVQKAIGK

SEQ ID NO: 956554 - protein, 9 aa, Homo Sapiens
VFEAPYILS

SEQ ID NO: 956555 - protein, 9 aa, Homo Sapiens
AVLQELESE

SEQ ID NO: 956556 - protein, 9 aa, Homo Sapiens
VLYNFFANT

SEQ ID NO: 956557 - protein, 9 aa, Homo Sapiens
DGHYMTLPV

SEQ ID NO: 956558 - protein, 9 aa, Homo Sapiens
AEHMFTREF

SEQ ID NO: 956559 - protein, 9 aa, Homo Sapiens
TLPVSPDQL

SEQ ID NO: 956560 - protein, 9 aa, Homo Sapiens
ITTIPSVKK

SEQ ID NO: 956561 - protein, 9 aa, Homo Sapiens
PNEVLKNFN

SEQ ID NO: 956562 - protein, 9 aa, Homo Sapiens
LFLKLLKSV

SEQ ID NO: 956563 - protein, 9 aa, Homo Sapiens
HFFISIPVK

SEQ ID NO: 956564 - protein, 9 aa, Homo Sapiens
FRNLGFILA

SEQ ID NO: 956565 - protein, 9 aa, Homo Sapiens
KIYEIKVDT

SEQ ID NO: 956566 - protein, 9 aa, Homo Sapiens
IPFWNKNYF

SEQ ID NO: 956567 - protein, 9 aa, Homo Sapiens
ETLVGRSYP

SEQ ID NO: 956568 - protein, 9 aa, Homo Sapiens
SADMLRPDS

SEQ ID NO: 956569 - protein, 9 aa, Homo Sapiens
SGSGKSEPR

SEQ ID NO: 956570 - protein, 9 aa, Homo Sapiens
EGASKSGPF

SEQ ID NO: 956571 - protein, 9 aa, Homo Sapiens
REEVPGVFS

SEQ ID NO: 956572 - protein, 9 aa, Homo Sapiens
SSELEEMST

SEQ ID NO: 956573 - protein, 9 aa, Homo Sapiens
PNLTLFLGC

SEQ ID NO: 956574 - protein, 9 aa, Homo Sapiens
PELPGLVDF

SEQ ID NO: 956575 - protein, 9 aa, Homo Sapiens
TKKLPKAPV

SEQ ID NO: 956576 - protein, 9 aa, Homo Sapiens
LQRCERRLV

SEQ ID NO: 956577 - protein, 9 aa, Homo Sapiens
DSNFQYEWT

SEQ ID NO: 956578 - protein, 9 aa, Homo Sapiens
FEAPYILSG

SEQ ID NO: 956579 - protein, 9 aa, Homo Sapiens
TKITTIPSV

SEQ ID NO: 956580 - protein, 9 aa, Homo Sapiens
DCQNRGWYI

SEQ ID NO: 956581 - protein, 9 aa, Homo Sapiens
PLPPPQGGS

SEQ ID NO: 956582 - protein, 9 aa, Homo Sapiens
IISSSKNLY

SEQ ID NO: 956583 - protein, 9 aa, Homo Sapiens
RSKVHFRSA

SEQ ID NO: 956584 - protein, 9 aa, Homo Sapiens
QVTSSGPEH

SEQ ID NO: 956585 - protein, 9 aa, Homo Sapiens
GTGWLKDLV

SEQ ID NO: 956586 - protein, 9 aa, Homo Sapiens
KPEEESSQY

SEQ ID NO: 956587 - protein, 9 aa, Homo Sapiens
NFGSVARMC

SEQ ID NO: 956588 - protein, 9 aa, Homo Sapiens
DVRGSSVLA

SEQ ID NO: 956589 - protein, 9 aa, Homo Sapiens
LNGRPMQGG

SEQ ID NO: 956590 - protein, 9 aa, Homo Sapiens
FMKLSKSSW

SEQ ID NO: 956591 - protein, 9 aa, Homo Sapiens
LLQRCERRL

SEQ ID NO: 956592 - protein, 9 aa, Homo Sapiens
RVQKAIGKY

SEQ ID NO: 956593 - protein, 9 aa, Homo Sapiens
AKEGANSDK

SEQ ID NO: 956594 - protein, 9 aa, Homo Sapiens
PTFRKFTRP

SEQ ID NO: 956595 - protein, 9 aa, Homo Sapiens
GEVVGEAEK

SEQ ID NO: 956596 - protein, 9 aa, Homo Sapiens
CLDIIRRYK

SEQ ID NO: 956597 - protein, 9 aa, Homo Sapiens
EGANSDKIL

SEQ ID NO: 956598 - protein, 9 aa, Homo Sapiens
SQERIGPQI

SEQ ID NO: 956599 - protein, 9 aa, Homo Sapiens
RCDLERISH

SEQ ID NO: 956600 - protein, 9 aa, Homo Sapiens
WRAEPVEEQ

SEQ ID NO: 956601 - protein, 9 aa, Homo Sapiens
RSVLGTGWL

SEQ ID NO: 956602 - protein, 9 aa, Homo Sapiens
NLYRKGHST

SEQ ID NO: 956603 - protein, 9 aa, Homo Sapiens
CHPEKYMEE

SEQ ID NO: 956604 - protein, 9 aa, Homo Sapiens
TPGDTMDSG

SEQ ID NO: 956605 - protein, 9 aa, Homo Sapiens
QRKGVFRKS

SEQ ID NO: 956606 - protein, 9 aa, Homo Sapiens
LQQQMPTLE

SEQ ID NO: 956607 - protein, 9 aa, Homo Sapiens
CRLTGRPGF

SEQ ID NO: 956608 - protein, 9 aa, Homo Sapiens
LILSYVEDE

SEQ ID NO: 956609 - protein, 9 aa, Homo Sapiens
QHLFENLLC

SEQ ID NO: 956610 - protein, 9 aa, Homo Sapiens
ISQGIILPS

SEQ ID NO: 956611 - protein, 9 aa, Homo Sapiens
QGTLLSPSL

SEQ ID NO: 956612 - protein, 9 aa, Homo Sapiens
HRDETAVQD

SEQ ID NO: 956613 - protein, 9 aa, Homo Sapiens
ILSYVEDET

SEQ ID NO: 956614 - protein, 9 aa, Homo Sapiens
CDFGLARNI

SEQ ID NO: 956615 - protein, 9 aa, Homo Sapiens
MTQGFETLP

SEQ ID NO: 956616 - protein, 9 aa, Homo Sapiens
YFKSSLDCK

SEQ ID NO: 956617 - protein, 9 aa, Homo Sapiens
SWLRKNGVK

SEQ ID NO: 956618 - protein, 9 aa, Homo Sapiens
TETARFETK

SEQ ID NO: 956619 - protein, 9 aa, Homo Sapiens
SLQYPDVHR

SEQ ID NO: 956620 - protein, 9 aa, Homo Sapiens
IGPDDRLIR

SEQ ID NO: 956621 - protein, 9 aa, Homo Sapiens
FRKKAFHHE

SEQ ID NO: 956622 - protein, 9 aa, Homo Sapiens
ELKSPNEGF

SEQ ID NO: 956623 - protein, 9 aa, Homo Sapiens
QIGDPNPWL

SEQ ID NO: 956624 - protein, 9 aa, Homo Sapiens
QLETKKERV

SEQ ID NO: 956625 - protein, 9 aa, Homo Sapiens
EWQCLDYAQ

SEQ ID NO: 956626 - protein, 9 aa, Homo Sapiens
SPKGTLDRK

SEQ ID NO: 956627 - protein, 9 aa, Homo Sapiens
LRVHCRALG

SEQ ID NO: 956628 - protein, 9 aa, Homo Sapiens
LFLARMPPP

SEQ ID NO: 956629 - protein, 9 aa, Homo Sapiens
RNIYKDPDY

SEQ ID NO: 956630 - protein, 9 aa, Homo Sapiens
NSCYYIDKE

SEQ ID NO: 956631 - protein, 9 aa, Homo Sapiens
DGRQNQSSH

SEQ ID NO: 956632 - protein, 9 aa, Homo Sapiens
TMVFFSYMV

SEQ ID NO: 956633 - protein, 9 aa, Homo Sapiens
LMQQQAALI

SEQ ID NO: 956634 - protein, 9 aa, Homo Sapiens
LEAALGLEG

SEQ ID NO: 956635 - protein, 9 aa, Homo Sapiens
KLSKSSWLR

SEQ ID NO: 956636 - protein, 9 aa, Homo Sapiens
EEGKGKDAF

SEQ ID NO: 956637 - protein, 9 aa, Homo Sapiens
WQVFFVFFF

SEQ ID NO: 956638 - protein, 9 aa, Homo Sapiens
QGFETLPSP

SEQ ID NO: 956639 - protein, 9 aa, Homo Sapiens
HLILCILRF

SEQ ID NO: 956640 - protein, 9 aa, Homo Sapiens
KKKKQMMYL

SEQ ID NO: 956641 - protein, 9 aa, Homo Sapiens
TLDSLSAFY

SEQ ID NO: 956642 - protein, 9 aa, Homo Sapiens
SKDKVTGET

SEQ ID NO: 956643 - protein, 9 aa, Homo Sapiens
TAITATSNM

SEQ ID NO: 956644 - protein, 9 aa, Homo Sapiens
GSEEPSSFL

SEQ ID NO: 956645 - protein, 9 aa, Homo Sapiens
LETLVGRSY

SEQ ID NO: 956646 - protein, 9 aa, Homo Sapiens
RPLWSELDV

SEQ ID NO: 956647 - protein, 9 aa, Homo Sapiens
RNKENISSV

SEQ ID NO: 956648 - protein, 9 aa, Homo Sapiens
PGLVDFQQR

SEQ ID NO: 956649 - protein, 9 aa, Homo Sapiens
TRLFLARMP

SEQ ID NO: 956650 - protein, 9 aa, Homo Sapiens
SRSWFSNAS

SEQ ID NO: 956651 - protein, 9 aa, Homo Sapiens
GQKRKQSTQ

SEQ ID NO: 956652 - protein, 9 aa, Homo Sapiens
CNLEIFQAV

SEQ ID NO: 956653 - protein, 9 aa, Homo Sapiens
VSREFKDLE

SEQ ID NO: 956654 - protein, 9 aa, Homo Sapiens
PFNVSDRQS

SEQ ID NO: 956655 - protein, 9 aa, Homo Sapiens
SEIMCDVTI

SEQ ID NO: 956656 - protein, 9 aa, Homo Sapiens
QSQERIGPQ

SEQ ID NO: 956657 - protein, 9 aa, Homo Sapiens
FVFFFITLP

SEQ ID NO: 956658 - protein, 9 aa, Homo Sapiens
HTHLILCIL

SEQ ID NO: 956659 - protein, 9 aa, Homo Sapiens
KTDPVVADY

SEQ ID NO: 956660 - protein, 9 aa, Homo Sapiens
YYSDYSRFW

SEQ ID NO: 956661 - protein, 9 aa, Homo Sapiens
VRPKPLFLK

SEQ ID NO: 956662 - protein, 9 aa, Homo Sapiens
EDNSSSVNF

SEQ ID NO: 956663 - protein, 9 aa, Homo Sapiens
KITSKLVSN

SEQ ID NO: 956664 - protein, 9 aa, Homo Sapiens
VTSSPMIVQ

SEQ ID NO: 956665 - protein, 9 aa, Homo Sapiens
VSGDDVIKK

SEQ ID NO: 956666 - protein, 9 aa, Homo Sapiens
EEESSQYLS

SEQ ID NO: 956667 - protein, 9 aa, Homo Sapiens
DNVSASKQE

SEQ ID NO: 956668 - protein, 9 aa, Homo Sapiens
FAPFEKAAK

SEQ ID NO: 956669 - protein, 9 aa, Homo Sapiens
KLKKEGFIR

SEQ ID NO: 956670 - protein, 9 aa, Homo Sapiens
ICQIKAFGL

SEQ ID NO: 956671 - protein, 9 aa, Homo Sapiens
GGLLGLAKR

SEQ ID NO: 956672 - protein, 9 aa, Homo Sapiens
ISVGLRVVA

SEQ ID NO: 956673 - protein, 9 aa, Homo Sapiens
RNLPSKISL

SEQ ID NO: 956674 - protein, 9 aa, Homo Sapiens
LIASVAQGG

SEQ ID NO: 956675 - protein, 9 aa, Homo Sapiens
LEVLDTILP

SEQ ID NO: 956676 - protein, 9 aa, Homo Sapiens
SGTESQDTG

SEQ ID NO: 956677 - protein, 9 aa, Homo Sapiens
SGILSNHGL

SEQ ID NO: 956678 - protein, 9 aa, Homo Sapiens
SVLGTGWLK

SEQ ID NO: 956679 - protein, 9 aa, Homo Sapiens
VDSNFQYEW

SEQ ID NO: 956680 - protein, 9 aa, Homo Sapiens
LKSPNEGFE

SEQ ID NO: 956681 - protein, 9 aa, Homo Sapiens
LFNLISVGL

SEQ ID NO: 956682 - protein, 9 aa, Homo Sapiens
ASGSGKSEP

SEQ ID NO: 956683 - protein, 9 aa, Homo Sapiens
AVDIEAADL

SEQ ID NO: 956684 - protein, 9 aa, Homo Sapiens
IERPEEKLK

SEQ ID NO: 956685 - protein, 9 aa, Homo Sapiens
FQYEWTPLM

SEQ ID NO: 956686 - protein, 9 aa, Homo Sapiens
QEEALKLSS

SEQ ID NO: 956687 - protein, 9 aa, Homo Sapiens
AAEFQGKGS

SEQ ID NO: 956688 - protein, 9 aa, Homo Sapiens
SSKGSSNTT

SEQ ID NO: 956689 - protein, 9 aa, Homo Sapiens
AARAGNVVH

SEQ ID NO: 956690 - protein, 9 aa, Homo Sapiens
FNVSDRQSF

SEQ ID NO: 956691 - protein, 9 aa, Homo Sapiens
RQDKALVGL

SEQ ID NO: 956692 - protein, 9 aa, Homo Sapiens
SKEVKTRHS

SEQ ID NO: 956693 - protein, 9 aa, Homo Sapiens
FGLPGDMVF

SEQ ID NO: 956694 - protein, 9 aa, Homo Sapiens
ALSKDSFIA

SEQ ID NO: 956695 - protein, 9 aa, Homo Sapiens
SLPTAMTSG

SEQ ID NO: 956696 - protein, 9 aa, Homo Sapiens
QQQMPTLEH

SEQ ID NO: 956697 - protein, 9 aa, Homo Sapiens
FRGFGFVTF

SEQ ID NO: 956698 - protein, 9 aa, Homo Sapiens
LVFWGDYPC

SEQ ID NO: 956699 - protein, 9 aa, Homo Sapiens
LCPGVIVRD

SEQ ID NO: 956700 - protein, 9 aa, Homo Sapiens
GQMLIGPDD

SEQ ID NO: 956701 - protein, 9 aa, Homo Sapiens
LPVEDQHTV

SEQ ID NO: 956702 - protein, 9 aa, Homo Sapiens
GFEGKFLYE

SEQ ID NO: 956703 - protein, 9 aa, Homo Sapiens
GTAESVTCT

SEQ ID NO: 956704 - protein, 9 aa, Homo Sapiens
PLWSELDVG

SEQ ID NO: 956705 - protein, 9 aa, Homo Sapiens
KHWNWLEQN

SEQ ID NO: 956706 - protein, 9 aa, Homo Sapiens
DLASGSGKS

SEQ ID NO: 956707 - protein, 9 aa, Homo Sapiens
LQEADEQLV

SEQ ID NO: 956708 - protein, 9 aa, Homo Sapiens
QSSHSPVLL

SEQ ID NO: 956709 - protein, 9 aa, Homo Sapiens
AQLYKEVLK

SEQ ID NO: 956710 - protein, 9 aa, Homo Sapiens
AASPQVLAT

SEQ ID NO: 956711 - protein, 9 aa, Homo Sapiens
PIERPEEKL

SEQ ID NO: 956712 - protein, 9 aa, Homo Sapiens
ILSGSSENT

SEQ ID NO: 956713 - protein, 8 aa, Homo Sapiens
KGGNADSW

SEQ ID NO: 956714 - protein, 9 aa, Homo Sapiens
QRIASSSLQ

SEQ ID NO: 956715 - protein, 9 aa, Homo Sapiens
LQLRSKVHF

SEQ ID NO: 956716 - protein, 9 aa, Homo Sapiens
RLFLARMPP

SEQ ID NO: 956717 - protein, 9 aa, Homo Sapiens
RIASSSLQD

SEQ ID NO: 956718 - protein, 9 aa, Homo Sapiens
EEMSTSNFE

SEQ ID NO: 956719 - protein, 9 aa, Homo Sapiens
DYGVFSRRF

SEQ ID NO: 956720 - protein, 9 aa, Homo Sapiens
MMKAAMYSK

SEQ ID NO: 956721 - protein, 9 aa, Homo Sapiens
SDRQSFLQR

SEQ ID NO: 956722 - protein, 9 aa, Homo Sapiens
IPSVKKIGK

SEQ ID NO: 956723 - protein, 9 aa, Homo Sapiens
FCHGLLKIL

SEQ ID NO: 956724 - protein, 9 aa, Homo Sapiens
SGTPFFLPS

SEQ ID NO: 956725 - protein, 9 aa, Homo Sapiens
SAESPSTTA

SEQ ID NO: 956726 - protein, 9 aa, Homo Sapiens
AFFTRLFYK

SEQ ID NO: 956727 - protein, 9 aa, Homo Sapiens
QLPVEDQHT

SEQ ID NO: 956728 - protein, 9 aa, Homo Sapiens
EKLSINKSV

SEQ ID NO: 956729 - protein, 9 aa, Homo Sapiens
EVLKACALN

SEQ ID NO: 956730 - protein, 9 aa, Homo Sapiens
KSQGKALQA

SEQ ID NO: 956731 - protein, 9 aa, Homo Sapiens
FMVEVAHLE

SEQ ID NO: 956732 - protein, 9 aa, Homo Sapiens
IAEKDEKID

SEQ ID NO: 956733 - protein, 9 aa, Homo Sapiens
NFDLCPGVI

SEQ ID NO: 956734 - protein, 9 aa, Homo Sapiens
YGAEVACSE

SEQ ID NO: 956735 - protein, 9 aa, Homo Sapiens
PRESQNLLD

SEQ ID NO: 956736 - protein, 9 aa, Homo Sapiens
MQLETKKER

SEQ ID NO: 956737 - protein, 9 aa, Homo Sapiens
LSFYSGYDF

SEQ ID NO: 956738 - protein, 9 aa, Homo Sapiens
GHYMTLPVS

SEQ ID NO: 956739 - protein, 9 aa, Homo Sapiens
SMFLLLKEE

SEQ ID NO: 956740 - protein, 9 aa, Homo Sapiens
LRDGEQPCC

SEQ ID NO: 956741 - protein, 9 aa, Homo Sapiens
AILKIPTSR

SEQ ID NO: 956742 - protein, 9 aa, Homo Sapiens
EKKESLRAA

SEQ ID NO: 956743 - protein, 9 aa, Homo Sapiens
DWRGEPVQS

SEQ ID NO: 956744 - protein, 9 aa, Homo Sapiens
RKWKREEGG

SEQ ID NO: 956745 - protein, 9 aa, Homo Sapiens
KVNISFVRL

SEQ ID NO: 956746 - protein, 9 aa, Homo Sapiens
KRNKENISS

SEQ ID NO: 956747 - protein, 9 aa, Homo Sapiens
GEFIGEKNS

SEQ ID NO: 956748 - protein, 9 aa, Homo Sapiens
PGPQAPTSL

SEQ ID NO: 956749 - protein, 9 aa, Homo Sapiens
VEGLKKRKS

SEQ ID NO: 956750 - protein, 9 aa, Homo Sapiens
LFLVIYVVT

SEQ ID NO: 956751 - protein, 9 aa, Homo Sapiens
HRAEALPLE

SEQ ID NO: 956752 - protein, 9 aa, Homo Sapiens
NSLLDDLAS

SEQ ID NO: 956753 - protein, 9 aa, Homo Sapiens
GRCRLTGRP

SEQ ID NO: 956754 - protein, 9 aa, Homo Sapiens
QAASPQVLA

SEQ ID NO: 956755 - protein, 9 aa, Homo Sapiens
NGVITFDCQ

SEQ ID NO: 956756 - protein, 9 aa, Homo Sapiens
RCRLTGRPG

SEQ ID NO: 956757 - protein, 9 aa, Homo Sapiens
EEPSSFLFE

SEQ ID NO: 956758 - protein, 9 aa, Homo Sapiens
RSGTPDLRD

SEQ ID NO: 956759 - protein, 9 aa, Homo Sapiens
PGVLQGTLL

SEQ ID NO: 956760 - protein, 9 aa, Homo Sapiens
QPPPSQPAR

SEQ ID NO: 956761 - protein, 9 aa, Homo Sapiens
NVQTGNNGA

SEQ ID NO: 956762 - protein, 9 aa, Homo Sapiens
FQLETSGKL

SEQ ID NO: 956763 - protein, 9 aa, Homo Sapiens
DDILNESSS

SEQ ID NO: 956764 - protein, 9 aa, Homo Sapiens
VILFVQCGT

SEQ ID NO: 956765 - protein, 9 aa, Homo Sapiens
DQAVMIYGE

SEQ ID NO: 956766 - protein, 9 aa, Homo Sapiens
TFLFSSCSH

SEQ ID NO: 956767 - protein, 9 aa, Homo Sapiens
LGEDCTRSS

SEQ ID NO: 956768 - protein, 9 aa, Homo Sapiens
LVGLGLVVK

SEQ ID NO: 956769 - protein, 9 aa, Homo Sapiens
LHHSVETDT

SEQ ID NO: 956770 - protein, 9 aa, Homo Sapiens
QVQSQIFES

SEQ ID NO: 956771 - protein, 9 aa, Homo Sapiens
PCALDFHAE

SEQ ID NO: 956772 - protein, 9 aa, Homo Sapiens
LLLLLTDTA

SEQ ID NO: 956773 - protein, 9 aa, Homo Sapiens
PTTPVSPTT

SEQ ID NO: 956774 - protein, 9 aa, Homo Sapiens
EIVLKIYFE

SEQ ID NO: 956775 - protein, 9 aa, Homo Sapiens
VKALAEYFY

SEQ ID NO: 956776 - protein, 9 aa, Homo Sapiens
IDVSITGEP

SEQ ID NO: 956777 - protein, 9 aa, Homo Sapiens
EQSVAMNIR

SEQ ID NO: 956778 - protein, 9 aa, Homo Sapiens
TARGELSAR

SEQ ID NO: 956779 - protein, 9 aa, Homo Sapiens
LTPGHPAER

SEQ ID NO: 956780 - protein, 9 aa, Homo Sapiens
AEILEGEDS

SEQ ID NO: 956781 - protein, 9 aa, Homo Sapiens
LYSIFSGDV

SEQ ID NO: 956782 - protein, 9 aa, Homo Sapiens
MFETFNTLA

SEQ ID NO: 956783 - protein, 9 aa, Homo Sapiens
ALQHAFQAS

SEQ ID NO: 956784 - protein, 9 aa, Homo Sapiens
FRLFEFFDR

SEQ ID NO: 956785 - protein, 9 aa, Homo Sapiens
LSFQCLQGS

SEQ ID NO: 956786 - protein, 9 aa, Homo Sapiens
LDRCKCKKV

SEQ ID NO: 956787 - protein, 9 aa, Homo Sapiens
FKRRQDRIF

SEQ ID NO: 956788 - protein, 9 aa, Homo Sapiens
VPQFPIDLN

SEQ ID NO: 956789 - protein, 9 aa, Homo Sapiens
EKPSIPTKK

SEQ ID NO: 956790 - protein, 9 aa, Homo Sapiens
GPKEPCVLP

SEQ ID NO: 956791 - protein, 9 aa, Homo Sapiens
SQTAKKWDA

SEQ ID NO: 956792 - protein, 9 aa, Homo Sapiens
ARQGRKKAA

SEQ ID NO: 956793 - protein, 9 aa, Homo Sapiens
HRAWLWQIE

SEQ ID NO: 956794 - protein, 9 aa, Homo Sapiens
WNSEEGLTF

SEQ ID NO: 956795 - protein, 9 aa, Homo Sapiens
LARTPTQEP

SEQ ID NO: 956796 - protein, 9 aa, Homo Sapiens
LEVTVHQKN

SEQ ID NO: 956797 - protein, 9 aa, Homo Sapiens
IKEFSFKIV

SEQ ID NO: 956798 - protein, 9 aa, Homo Sapiens
QSEKEEAPN

SEQ ID NO: 956799 - protein, 9 aa, Homo Sapiens
FKLTRRFVG

SEQ ID NO: 956800 - protein, 9 aa, Homo Sapiens
NTEGVLLDN

SEQ ID NO: 956801 - protein, 9 aa, Homo Sapiens
PRAQARSVR

SEQ ID NO: 956802 - protein, 9 aa, Homo Sapiens
ENKEMYHFD

SEQ ID NO: 956803 - protein, 9 aa, Homo Sapiens
ALFLEKVLD

SEQ ID NO: 956804 - protein, 9 aa, Homo Sapiens
NGFGSKDAV

SEQ ID NO: 956805 - protein, 9 aa, Homo Sapiens
MTSEFEKML

SEQ ID NO: 956806 - protein, 9 aa, Homo Sapiens
AASPFWKAS

SEQ ID NO: 956807 - protein, 9 aa, Homo Sapiens
VTVFEIIIR

SEQ ID NO: 956808 - protein, 9 aa, Homo Sapiens
FFALKLMSI

SEQ ID NO: 956809 - protein, 9 aa, Homo Sapiens
FEQKGLVYV

SEQ ID NO: 956810 - protein, 9 aa, Homo Sapiens
ETKYMKQQY

SEQ ID NO: 956811 - protein, 9 aa, Homo Sapiens
HQKNQSSDA

SEQ ID NO: 956812 - protein, 9 aa, Homo Sapiens
EYVTQRNCS

SEQ ID NO: 956813 - protein, 9 aa, Homo Sapiens
TEKGKRHPY

SEQ ID NO: 956814 - protein, 9 aa, Homo Sapiens
TVHSSVANM

SEQ ID NO: 956815 - protein, 9 aa, Homo Sapiens
VLFYGSEIF

SEQ ID NO: 956816 - protein, 9 aa, Homo Sapiens
AAIYRRTSE

SEQ ID NO: 956817 - protein, 9 aa, Homo Sapiens
LDSQFRLHL

SEQ ID NO: 956818 - protein, 9 aa, Homo Sapiens
KNTTGKAAT

SEQ ID NO: 956819 - protein, 9 aa, Homo Sapiens
AAVFCVFLA

SEQ ID NO: 956820 - protein, 9 aa, Homo Sapiens
PKLREEFSK

SEQ ID NO: 956821 - protein, 9 aa, Homo Sapiens
CCQRNYGAV

SEQ ID NO: 956822 - protein, 9 aa, Homo Sapiens
GIKEFSFKI

SEQ ID NO: 956823 - protein, 9 aa, Homo Sapiens
HTSIWLLQT

SEQ ID NO: 956824 - protein, 9 aa, Homo Sapiens
EMYHFDADA

SEQ ID NO: 956825 - protein, 9 aa, Homo Sapiens
CLRYQMHWK

SEQ ID NO: 956826 - protein, 9 aa, Homo Sapiens
YEDMHRNLV

SEQ ID NO: 956827 - protein, 9 aa, Homo Sapiens
ATLFPISGP

SEQ ID NO: 956828 - protein, 9 aa, Homo Sapiens
MYSTYFKEF

SEQ ID NO: 956829 - protein, 9 aa, Homo Sapiens
LQQKKNLEV

SEQ ID NO: 956830 - protein, 9 aa, Homo Sapiens
PALKNSKHQ

SEQ ID NO: 956831 - protein, 9 aa, Homo Sapiens
KVDDEESVI

SEQ ID NO: 956832 - protein, 9 aa, Homo Sapiens
DDYERPNDD

SEQ ID NO: 956833 - protein, 9 aa, Homo Sapiens
VSCSGPLFQ

SEQ ID NO: 956834 - protein, 9 aa, Homo Sapiens
SGAAPPSTE

SEQ ID NO: 956835 - protein, 9 aa, Homo Sapiens
FISSRAGAN

SEQ ID NO: 956836 - protein, 9 aa, Homo Sapiens
ALGAFFLLS

SEQ ID NO: 956837 - protein, 9 aa, Homo Sapiens
GLVYVACQF

SEQ ID NO: 956838 - protein, 9 aa, Homo Sapiens
FSHRIFLTR

SEQ ID NO: 956839 - protein, 9 aa, Homo Sapiens
SPPFVKKTS

SEQ ID NO: 956840 - protein, 9 aa, Homo Sapiens
VRPLVSQTD

SEQ ID NO: 956841 - protein, 9 aa, Homo Sapiens
DREELCGPK

SEQ ID NO: 956842 - protein, 9 aa, Homo Sapiens
NETVCAPGS

SEQ ID NO: 956843 - protein, 9 aa, Homo Sapiens
NGRNGYTAV

SEQ ID NO: 956844 - protein, 9 aa, Homo Sapiens
FINVWKLSS

SEQ ID NO: 956845 - protein, 9 aa, Homo Sapiens
SMTDSEEDL

SEQ ID NO: 956846 - protein, 9 aa, Homo Sapiens
YIDTVCDCS

SEQ ID NO: 956847 - protein, 9 aa, Homo Sapiens
LDLAFNSNN

SEQ ID NO: 956848 - protein, 9 aa, Homo Sapiens
EASAETKYM

SEQ ID NO: 956849 - protein, 9 aa, Homo Sapiens
KALAEYFYI

SEQ ID NO: 956850 - protein, 9 aa, Homo Sapiens
CGPKEPCVL

SEQ ID NO: 956851 - protein, 9 aa, Homo Sapiens
TVYKASDPH

SEQ ID NO: 956852 - protein, 9 aa, Homo Sapiens
EAAEILEGE

SEQ ID NO: 956853 - protein, 9 aa, Homo Sapiens
MGFQKFSSF

SEQ ID NO: 956854 - protein, 9 aa, Homo Sapiens
VSSFRVAWT

SEQ ID NO: 956855 - protein, 9 aa, Homo Sapiens
FQKMHYPDV

SEQ ID NO: 956856 - protein, 9 aa, Homo Sapiens
KKDKMFRFW

SEQ ID NO: 956857 - protein, 9 aa, Homo Sapiens
VTVASINDS

SEQ ID NO: 956858 - protein, 9 aa, Homo Sapiens
ASRLELDIK

SEQ ID NO: 956859 - protein, 9 aa, Homo Sapiens
WPSPPFVKK

SEQ ID NO: 956860 - protein, 9 aa, Homo Sapiens
IQGKLQLQD

SEQ ID NO: 956861 - protein, 9 aa, Homo Sapiens
ESEMDFPEH

SEQ ID NO: 956862 - protein, 9 aa, Homo Sapiens
SFLALSILV

SEQ ID NO: 956863 - protein, 9 aa, Homo Sapiens
LKTIPELCQ

SEQ ID NO: 956864 - protein, 9 aa, Homo Sapiens
SEKEEAPNP

SEQ ID NO: 956865 - protein, 9 aa, Homo Sapiens
ASAGKHRSK

SEQ ID NO: 956866 - protein, 9 aa, Homo Sapiens
SIFSGDVAQ

SEQ ID NO: 956867 - protein, 9 aa, Homo Sapiens
RKESEMDFP

SEQ ID NO: 956868 - protein, 9 aa, Homo Sapiens
GYSKGYGFV

SEQ ID NO: 956869 - protein, 9 aa, Homo Sapiens
CGADSYEMK

SEQ ID NO: 956870 - protein, 9 aa, Homo Sapiens
TSEVHDGSL

SEQ ID NO: 956871 - protein, 9 aa, Homo Sapiens
GKPGLKGKA

SEQ ID NO: 956872 - protein, 9 aa, Homo Sapiens
KQSLLAFAE

SEQ ID NO: 956873 - protein, 9 aa, Homo Sapiens
NWPHSPNGP

SEQ ID NO: 956874 - protein, 9 aa, Homo Sapiens
NSLGPSIFG

SEQ ID NO: 956875 - protein, 9 aa, Homo Sapiens
SLNGKKRPF

SEQ ID NO: 956876 - protein, 9 aa, Homo Sapiens
CENPGIPNY

SEQ ID NO: 956877 - protein, 9 aa, Homo Sapiens
RSKQILSAT

SEQ ID NO: 956878 - protein, 9 aa, Homo Sapiens
QDRIFPEGS

SEQ ID NO: 956879 - protein, 9 aa, Homo Sapiens
RMEAHNNDY

SEQ ID NO: 956880 - protein, 9 aa, Homo Sapiens
CALFATGSY

SEQ ID NO: 956881 - protein, 9 aa, Homo Sapiens
IPLLAVASP

SEQ ID NO: 956882 - protein, 9 aa, Homo Sapiens
TENMHFSSS

SEQ ID NO: 956883 - protein, 9 aa, Homo Sapiens
EVLADLDCA

SEQ ID NO: 956884 - protein, 9 aa, Homo Sapiens
SDGYCVDQT

SEQ ID NO: 956885 - protein, 9 aa, Homo Sapiens
CNPTQQKFC

SEQ ID NO: 956886 - protein, 9 aa, Homo Sapiens
ENQHQVGEA

SEQ ID NO: 956887 - protein, 9 aa, Homo Sapiens
ESLPRPLCH

SEQ ID NO: 956888 - protein, 9 aa, Homo Sapiens
KKWDAVVRL

SEQ ID NO: 956889 - protein, 9 aa, Homo Sapiens
VAVKTPTKK

SEQ ID NO: 956890 - protein, 9 aa, Homo Sapiens
VPHERIHTG

SEQ ID NO: 956891 - protein, 9 aa, Homo Sapiens
KYIKRLASL

SEQ ID NO: 956892 - protein, 9 aa, Homo Sapiens
YLKLYYPER

SEQ ID NO: 956893 - protein, 9 aa, Homo Sapiens
TIMVFIGNF

SEQ ID NO: 956894 - protein, 9 aa, Homo Sapiens
LGLDVSYLS

SEQ ID NO: 956895 - protein, 9 aa, Homo Sapiens
CCTKCRLQF

SEQ ID NO: 956896 - protein, 9 aa, Homo Sapiens
QESDDDILN

SEQ ID NO: 956897 - protein, 9 aa, Homo Sapiens
APAPAKHPS

SEQ ID NO: 956898 - protein, 9 aa, Homo Sapiens
ERSRTLHFR

SEQ ID NO: 956899 - protein, 9 aa, Homo Sapiens
TNGRNGYTA

SEQ ID NO: 956900 - protein, 9 aa, Homo Sapiens
ERAFQKMHY

SEQ ID NO: 956901 - protein, 9 aa, Homo Sapiens
RFWVNTFFI

SEQ ID NO: 956902 - protein, 9 aa, Homo Sapiens
PGSRESPPQ

SEQ ID NO: 956903 - protein, 9 aa, Homo Sapiens
ENLRKGKDQ

SEQ ID NO: 956904 - protein, 9 aa, Homo Sapiens
HHHVPEPVF

SEQ ID NO: 956905 - protein, 9 aa, Homo Sapiens
WQAALVMGN

SEQ ID NO: 956906 - protein, 9 aa, Homo Sapiens
LFQLETSGK

SEQ ID NO: 956907 - protein, 9 aa, Homo Sapiens
ALARTPTQE

SEQ ID NO: 956908 - protein, 9 aa, Homo Sapiens
PISEETLFL

SEQ ID NO: 956909 - protein, 9 aa, Homo Sapiens
SWPRTSRPR

SEQ ID NO: 956910 - protein, 9 aa, Homo Sapiens
FPIDLNSKM

SEQ ID NO: 956911 - protein, 9 aa, Homo Sapiens
NCISIEEQL

SEQ ID NO: 956912 - protein, 9 aa, Homo Sapiens
NRGKPGLKG

SEQ ID NO: 956913 - protein, 9 aa, Homo Sapiens
AFGPKLREE

SEQ ID NO: 956914 - protein, 9 aa, Homo Sapiens
WECNWPHSP

SEQ ID NO: 956915 - protein, 9 aa, Homo Sapiens
TFRSWFANN

SEQ ID NO: 956916 - protein, 9 aa, Homo Sapiens
GEYNAADLQ

SEQ ID NO: 956917 - protein, 9 aa, Homo Sapiens
LLGYWSKSY

SEQ ID NO: 956918 - protein, 9 aa, Homo Sapiens
SEMARALRS

SEQ ID NO: 956919 - protein, 9 aa, Homo Sapiens
LKIYFEYLY

SEQ ID NO: 956920 - protein, 9 aa, Homo Sapiens
DDDCRSGIK

SEQ ID NO: 956921 - protein, 9 aa, Homo Sapiens
TRKKPGALR

SEQ ID NO: 956922 - protein, 9 aa, Homo Sapiens
CAELLVKDI

SEQ ID NO: 956923 - protein, 9 aa, Homo Sapiens
ALPGFSILA

SEQ ID NO: 956924 - protein, 9 aa, Homo Sapiens
FLLSSVTQG

SEQ ID NO: 956925 - protein, 9 aa, Homo Sapiens
EKQPERAGE

SEQ ID NO: 956926 - protein, 9 aa, Homo Sapiens
PSVPSSFLP

SEQ ID NO: 956927 - protein, 9 aa, Homo Sapiens
GVQSPERSR

SEQ ID NO: 956928 - protein, 9 aa, Homo Sapiens
WKTLDNLKC

SEQ ID NO: 956929 - protein, 9 aa, Homo Sapiens
AFNSNNDGA

SEQ ID NO: 956930 - protein, 9 aa, Homo Sapiens
FFKNVISLT

SEQ ID NO: 956931 - protein, 9 aa, Homo Sapiens
LRMKKDREI

SEQ ID NO: 956932 - protein, 9 aa, Homo Sapiens
SATFLFSSC

SEQ ID NO: 956933 - protein, 9 aa, Homo Sapiens
KNPNQFVPL

SEQ ID NO: 956934 - protein, 9 aa, Homo Sapiens
VGLGLVVKI

SEQ ID NO: 956935 - protein, 9 aa, Homo Sapiens
PEDVWNIKQ

SEQ ID NO: 956936 - protein, 9 aa, Homo Sapiens
KVALMGLGQ

SEQ ID NO: 956937 - protein, 9 aa, Homo Sapiens
LFLTRFIGD

SEQ ID NO: 956938 - protein, 9 aa, Homo Sapiens
QVDMEFPGS

SEQ ID NO: 956939 - protein, 9 aa, Homo Sapiens
RDQAVMIYG

SEQ ID NO: 956940 - protein, 9 aa, Homo Sapiens
HSVCPAEMI

SEQ ID NO: 956941 - protein, 9 aa, Homo Sapiens
KEASAETKY

SEQ ID NO: 956942 - protein, 9 aa, Homo Sapiens
LYLKLYYPE

SEQ ID NO: 956943 - protein, 9 aa, Homo Sapiens
LHSLVGVCS

SEQ ID NO: 956944 - protein, 9 aa, Homo Sapiens
YRNGYAIAR

SEQ ID NO: 956945 - protein, 9 aa, Homo Sapiens
PEDTAFTRS

SEQ ID NO: 956946 - protein, 9 aa, Homo Sapiens
GRKKAAGKS

SEQ ID NO: 956947 - protein, 9 aa, Homo Sapiens
NVVNEINNA

SEQ ID NO: 956948 - protein, 9 aa, Homo Sapiens
GRSDMQKHR

SEQ ID NO: 956949 - protein, 9 aa, Homo Sapiens
RVAVQNMLA

SEQ ID NO: 956950 - protein, 9 aa, Homo Sapiens
CCVSCFWTR

SEQ ID NO: 956951 - protein, 9 aa, Homo Sapiens
TISVPQFPI

SEQ ID NO: 956952 - protein, 9 aa, Homo Sapiens
SHVYWKKSG

SEQ ID NO: 956953 - protein, 9 aa, Homo Sapiens
EWLRFLDKI

SEQ ID NO: 956954 - protein, 9 aa, Homo Sapiens
QVTRKKPGA

SEQ ID NO: 956955 - protein, 9 aa, Homo Sapiens
MTAGVCALF

SEQ ID NO: 956956 - protein, 9 aa, Homo Sapiens
EDPFECNDL

SEQ ID NO: 956957 - protein, 9 aa, Homo Sapiens
GETGSEDQA

SEQ ID NO: 956958 - protein, 9 aa, Homo Sapiens
LQFFCAELL

SEQ ID NO: 956959 - protein, 9 aa, Homo Sapiens
LLYSIFSGD

SEQ ID NO: 956960 - protein, 9 aa, Homo Sapiens
ILNESSSPE

SEQ ID NO: 956961 - protein, 9 aa, Homo Sapiens
IRTLQEQSV

SEQ ID NO: 956962 - protein, 9 aa, Homo Sapiens
ADRPREDIK

SEQ ID NO: 956963 - protein, 9 aa, Homo Sapiens
HRPAKALRK

SEQ ID NO: 956964 - protein, 9 aa, Homo Sapiens
LKNVTELYL

SEQ ID NO: 956965 - protein, 9 aa, Homo Sapiens
DCSDPVFPT

SEQ ID NO: 956966 - protein, 9 aa, Homo Sapiens
FKRTGIDSN

SEQ ID NO: 956967 - protein, 9 aa, Homo Sapiens
IPNITQYSL

SEQ ID NO: 956968 - protein, 9 aa, Homo Sapiens
SVYWQKFED

SEQ ID NO: 956969 - protein, 9 aa, Homo Sapiens
EKELEGSGK

SEQ ID NO: 956970 - protein, 9 aa, Homo Sapiens
DDFVKFLSE

SEQ ID NO: 956971 - protein, 9 aa, Homo Sapiens
WTNLCSIFG

SEQ ID NO: 956972 - protein, 9 aa, Homo Sapiens
QVLLFSESP

SEQ ID NO: 956973 - protein, 9 aa, Homo Sapiens
GFPPSSFSF

SEQ ID NO: 956974 - protein, 9 aa, Homo Sapiens
KFPIKWTAS

SEQ ID NO: 956975 - protein, 9 aa, Homo Sapiens
WLRFLDKIL

SEQ ID NO: 956976 - protein, 9 aa, Homo Sapiens
VPSSFLPQT

SEQ ID NO: 956977 - protein, 9 aa, Homo Sapiens
DHVHRPAKA

SEQ ID NO: 956978 - protein, 9 aa, Homo Sapiens
HQLLHHSAN

SEQ ID NO: 956979 - protein, 9 aa, Homo Sapiens
FFKNWRDKD

SEQ ID NO: 956980 - protein, 9 aa, Homo Sapiens
PLATLFPIS

SEQ ID NO: 956981 - protein, 9 aa, Homo Sapiens
KEVRPLVSQ

SEQ ID NO: 956982 - protein, 9 aa, Homo Sapiens
LRLWNIKDK

SEQ ID NO: 956983 - protein, 9 aa, Homo Sapiens
ISLLQIGLL

SEQ ID NO: 956984 - protein, 9 aa, Homo Sapiens
FYILDVHGK

SEQ ID NO: 956985 - protein, 9 aa, Homo Sapiens
RKGPEDASD

SEQ ID NO: 956986 - protein, 9 aa, Homo Sapiens
TYFKEFDKN

SEQ ID NO: 956987 - protein, 9 aa, Homo Sapiens
PPKTDKSGA

SEQ ID NO: 956988 - protein, 9 aa, Homo Sapiens
SAPTTPVSP

SEQ ID NO: 956989 - protein, 9 aa, Homo Sapiens
QVTKNTTGK

SEQ ID NO: 956990 - protein, 9 aa, Homo Sapiens
YVVCNHHGN

SEQ ID NO: 956991 - protein, 9 aa, Homo Sapiens
SFSSDSFNF

SEQ ID NO: 956992 - protein, 9 aa, Homo Sapiens
TKKVEKMFP

SEQ ID NO: 956993 - protein, 9 aa, Homo Sapiens
SSECSASSD

SEQ ID NO: 956994 - protein, 9 aa, Homo Sapiens
YEKKCISRG

SEQ ID NO: 956995 - protein, 9 aa, Homo Sapiens
TKQEKDFLW

SEQ ID NO: 956996 - protein, 9 aa, Homo Sapiens
ELPSRKCRA

SEQ ID NO: 956997 - protein, 9 aa, Homo Sapiens
ITYSWYDNI

SEQ ID NO: 956998 - protein, 9 aa, Homo Sapiens
GEKLYACGD

SEQ ID NO: 956999 - protein, 9 aa, Homo Sapiens
MLSSHHSSE

SEQ ID NO: 957000 - protein, 9 aa, Homo Sapiens
QRCDTQNED

SEQ ID NO: 957001 - protein, 9 aa, Homo Sapiens
TRRLSSRRS

SEQ ID NO: 957002 - protein, 9 aa, Homo Sapiens
FLIGDKVTF

SEQ ID NO: 957003 - protein, 9 aa, Homo Sapiens
KCSIVIKMS

SEQ ID NO: 957004 - protein, 9 aa, Homo Sapiens
IGVQHTLAD

SEQ ID NO: 957005 - protein, 9 aa, Homo Sapiens
PGAPGSSGQ

SEQ ID NO: 957006 - protein, 9 aa, Homo Sapiens
PSDFLNKLM

SEQ ID NO: 957007 - protein, 9 aa, Homo Sapiens
NKLRIDVSI

SEQ ID NO: 957008 - protein, 9 aa, Homo Sapiens
GGRRLFLFG

SEQ ID NO: 957009 - protein, 9 aa, Homo Sapiens
YSKGYGFVE

SEQ ID NO: 957010 - protein, 9 aa, Homo Sapiens
LYEIRGLFG

SEQ ID NO: 957011 - protein, 9 aa, Homo Sapiens
IGTQGSLEN

SEQ ID NO: 957012 - protein, 9 aa, Homo Sapiens
KEHSPDKFI

SEQ ID NO: 957013 - protein, 9 aa, Homo Sapiens
PMAEHMLSS

SEQ ID NO: 957014 - protein, 9 aa, Homo Sapiens
VNTEGVLLD

SEQ ID NO: 957015 - protein, 9 aa, Homo Sapiens
KNCGFAFVE

SEQ ID NO: 957016 - protein, 9 aa, Homo Sapiens
VTEKGKRHP

SEQ ID NO: 957017 - protein, 9 aa, Homo Sapiens
TPDSNNVDS

SEQ ID NO: 957018 - protein, 9 aa, Homo Sapiens
CWQHSYKGI

SEQ ID NO: 957019 - protein, 9 aa, Homo Sapiens
TRLEKMVSG

SEQ ID NO: 957020 - protein, 9 aa, Homo Sapiens
QRNYGAVEY

SEQ ID NO: 957021 - protein, 9 aa, Homo Sapiens
INSKTKILI

SEQ ID NO: 957022 - protein, 9 aa, Homo Sapiens
EFTFLCDPW

SEQ ID NO: 957023 - protein, 9 aa, Homo Sapiens
FPISGPVLL

SEQ ID NO: 957024 - protein, 9 aa, Homo Sapiens
VDKETLQGA

SEQ ID NO: 957025 - protein, 9 aa, Homo Sapiens
HFFALKLMS

SEQ ID NO: 957026 - protein, 9 aa, Homo Sapiens
EDMHRNLVT

SEQ ID NO: 957027 - protein, 9 aa, Homo Sapiens
LLYLPGKQS

SEQ ID NO: 957028 - protein, 9 aa, Homo Sapiens
STKPAVGGT

SEQ ID NO: 957029 - protein, 9 aa, Homo Sapiens
SRFSEVRVL

SEQ ID NO: 957030 - protein, 9 aa, Homo Sapiens
RLFLFGAPR

SEQ ID NO: 957031 - protein, 9 aa, Homo Sapiens
EIGVQHTLA

SEQ ID NO: 957032 - protein, 9 aa, Homo Sapiens
KEASQMDLL

SEQ ID NO: 957033 - protein, 9 aa, Homo Sapiens
CRKPFLIGD

SEQ ID NO: 957034 - protein, 9 aa, Homo Sapiens
MTYQFSEPY

SEQ ID NO: 957035 - protein, 9 aa, Homo Sapiens
RFWLEEAKS

SEQ ID NO: 957036 - protein, 9 aa, Homo Sapiens
WSWRRIPSK

SEQ ID NO: 957037 - protein, 9 aa, Homo Sapiens
RKKAAGKSL

SEQ ID NO: 957038 - protein, 9 aa, Homo Sapiens
SMVHFSGFC

SEQ ID NO: 957039 - protein, 9 aa, Homo Sapiens
LADLDCAHE

SEQ ID NO: 957040 - protein, 9 aa, Homo Sapiens
HSLSSCVFG

SEQ ID NO: 957041 - protein, 9 aa, Homo Sapiens
AIPEDVWNI

SEQ ID NO: 957042 - protein, 9 aa, Homo Sapiens
VTAEHYVVT

SEQ ID NO: 957043 - protein, 9 aa, Homo Sapiens
TGNRGKPGL

SEQ ID NO: 957044 - protein, 9 aa, Homo Sapiens
ELLLLLTDT

SEQ ID NO: 957045 - protein, 9 aa, Homo Sapiens
LTMIFPNYR

SEQ ID NO: 957046 - protein, 9 aa, Homo Sapiens
RQSTTKKVL

SEQ ID NO: 957047 - protein, 9 aa, Homo Sapiens
TQGLYFHCR

SEQ ID NO: 957048 - protein, 9 aa, Homo Sapiens
IMTVVFWGH

SEQ ID NO: 957049 - protein, 9 aa, Homo Sapiens
EEEDFGDPK

SEQ ID NO: 957050 - protein, 9 aa, Homo Sapiens
IAVPPRLSE

SEQ ID NO: 957051 - protein, 9 aa, Homo Sapiens
MEMVGMYSL

SEQ ID NO: 957052 - protein, 9 aa, Homo Sapiens
DSFNFNSQN

SEQ ID NO: 957053 - protein, 9 aa, Homo Sapiens
SSDPLDILI

SEQ ID NO: 957054 - protein, 9 aa, Homo Sapiens
TFLCDPWNW

SEQ ID NO: 957055 - protein, 9 aa, Homo Sapiens
EKNWSFYPN

SEQ ID NO: 957056 - protein, 9 aa, Homo Sapiens
LDILTMIFP

SEQ ID NO: 957057 - protein, 9 aa, Homo Sapiens
FIQGWGLED

SEQ ID NO: 957058 - protein, 9 aa, Homo Sapiens
SALLSRQFL

SEQ ID NO: 957059 - protein, 9 aa, Homo Sapiens
KSFYQSSSL

SEQ ID NO: 957060 - protein, 9 aa, Homo Sapiens
ELKRKLTKR

SEQ ID NO: 957061 - protein, 9 aa, Homo Sapiens
LAALARTPT

SEQ ID NO: 957062 - protein, 9 aa, Homo Sapiens
ARKKEEGGP

SEQ ID NO: 957063 - protein, 9 aa, Homo Sapiens
AYEKKCISR

SEQ ID NO: 957064 - protein, 9 aa, Homo Sapiens
GEVTVASIN

SEQ ID NO: 957065 - protein, 9 aa, Homo Sapiens
QEMDSFQTL

SEQ ID NO: 957066 - protein, 9 aa, Homo Sapiens
IEVRPYKCE

SEQ ID NO: 957067 - protein, 9 aa, Homo Sapiens
FWLNISGGD

SEQ ID NO: 957068 - protein, 9 aa, Homo Sapiens
NSNLSMAQR

SEQ ID NO: 957069 - protein, 9 aa, Homo Sapiens
FSLNVQTGN

SEQ ID NO: 957070 - protein, 9 aa, Homo Sapiens
SKKNFLEGK

SEQ ID NO: 957071 - protein, 9 aa, Homo Sapiens
SPVSSFRVA

SEQ ID NO: 957072 - protein, 9 aa, Homo Sapiens
DNVFKKFDG

SEQ ID NO: 957073 - protein, 9 aa, Homo Sapiens
STGQCYEQF

SEQ ID NO: 957074 - protein, 9 aa, Homo Sapiens
RRQSTTKKV

SEQ ID NO: 957075 - protein, 9 aa, Homo Sapiens
ELFQLETSG

SEQ ID NO: 957076 - protein, 9 aa, Homo Sapiens
KQVTICCQR

SEQ ID NO: 957077 - protein, 9 aa, Homo Sapiens
IYYEYTVPV

SEQ ID NO: 957078 - protein, 9 aa, Homo Sapiens
LNSKKSPRS

SEQ ID NO: 957079 - protein, 9 aa, Homo Sapiens
SINDSEELL

SEQ ID NO: 957080 - protein, 9 aa, Homo Sapiens
SRTLLLSLE

SEQ ID NO: 957081 - protein, 9 aa, Homo Sapiens
VYWQKFEDT

SEQ ID NO: 957082 - protein, 9 aa, Homo Sapiens
MVNGMMLSV

SEQ ID NO: 957083 - protein, 9 aa, Homo Sapiens
CSAPPTESA

SEQ ID NO: 957084 - protein, 9 aa, Homo Sapiens
EPNLLNSLG

SEQ ID NO: 957085 - protein, 9 aa, Homo Sapiens
IEFLFQPVC

SEQ ID NO: 957086 - protein, 9 aa, Homo Sapiens
TGNNGAINP

SEQ ID NO: 957087 - protein, 9 aa, Homo Sapiens
ELMGPVSSR

SEQ ID NO: 957088 - protein, 9 aa, Homo Sapiens
NESSSPEGT

SEQ ID NO: 957089 - protein, 9 aa, Homo Sapiens
QPESDIDDF

SEQ ID NO: 957090 - protein, 9 aa, Homo Sapiens
WNIKDKMSR

SEQ ID NO: 957091 - protein, 9 aa, Homo Sapiens
NQRNLSGEK

SEQ ID NO: 957092 - protein, 8 aa, Homo Sapiens
TADKDKDK

SEQ ID NO: 957093 - protein, 9 aa, Homo Sapiens
AELRHRFWL

SEQ ID NO: 957094 - protein, 9 aa, Homo Sapiens
GAPGSSGQK

SEQ ID NO: 957095 - protein, 9 aa, Homo Sapiens
RNLRVKAQT

SEQ ID NO: 957096 - protein, 9 aa, Homo Sapiens
LGLEPNLLN

SEQ ID NO: 957097 - protein, 9 aa, Homo Sapiens
ALTVGFKHT

SEQ ID NO: 957098 - protein, 9 aa, Homo Sapiens
AFLVRSSLI

SEQ ID NO: 957099 - protein, 9 aa, Homo Sapiens
KGIHCCTKC

SEQ ID NO: 957100 - protein, 9 aa, Homo Sapiens
TLNQLTDAL

SEQ ID NO: 957101 - protein, 9 aa, Homo Sapiens
AVMIYGESG

SEQ ID NO: 957102 - protein, 9 aa, Homo Sapiens
AAEILEGED

SEQ ID NO: 957103 - protein, 9 aa, Homo Sapiens
LSSLEALSS

SEQ ID NO: 957104 - protein, 9 aa, Homo Sapiens
YLFFENSIH

SEQ ID NO: 957105 - protein, 9 aa, Homo Sapiens
LYDLYVVCN

SEQ ID NO: 957106 - protein, 9 aa, Homo Sapiens
VHLAAQEVH

SEQ ID NO: 957107 - protein, 9 aa, Homo Sapiens
ACARQDNVF

SEQ ID NO: 957108 - protein, 9 aa, Homo Sapiens
GYAIARRPT

SEQ ID NO: 957109 - protein, 9 aa, Homo Sapiens
YFSVKVNGI

SEQ ID NO: 957110 - protein, 9 aa, Homo Sapiens
LKFFRLFEF

SEQ ID NO: 957111 - protein, 9 aa, Homo Sapiens
WGVKSLHID

SEQ ID NO: 957112 - protein, 9 aa, Homo Sapiens
VLSMTDSEE

SEQ ID NO: 957113 - protein, 9 aa, Homo Sapiens
SGQKGHKGE

SEQ ID NO: 957114 - protein, 9 aa, Homo Sapiens
AADPAIPED

SEQ ID NO: 957115 - protein, 9 aa, Homo Sapiens
PDDSRAGVQ

SEQ ID NO: 957116 - protein, 9 aa, Homo Sapiens
SVTVFEIII

SEQ ID NO: 957117 - protein, 9 aa, Homo Sapiens
CPSEVSMPI

SEQ ID NO: 957118 - protein, 9 aa, Homo Sapiens
ELSEGSRTL

SEQ ID NO: 957119 - protein, 9 aa, Homo Sapiens
RIALAASIP

SEQ ID NO: 957120 - protein, 9 aa, Homo Sapiens
QGQSSWPRT

SEQ ID NO: 957121 - protein, 9 aa, Homo Sapiens
SACVVETEA

SEQ ID NO: 957122 - protein, 9 aa, Homo Sapiens
FFPSDGYCV

SEQ ID NO: 957123 - protein, 9 aa, Homo Sapiens
DESLREQLL

SEQ ID NO: 957124 - protein, 9 aa, Homo Sapiens
EQEETAFLL

SEQ ID NO: 957125 - protein, 9 aa, Homo Sapiens
LSEGSRTLL

SEQ ID NO: 957126 - protein, 9 aa, Homo Sapiens
LFEENKEMY

SEQ ID NO: 957127 - protein, 9 aa, Homo Sapiens
PPFFFKNVI

SEQ ID NO: 957128 - protein, 9 aa, Homo Sapiens
SKLHNPMYF

SEQ ID NO: 957129 - protein, 9 aa, Homo Sapiens
AVKHSRPRR

SEQ ID NO: 957130 - protein, 9 aa, Homo Sapiens
RREPHRAQQ

SEQ ID NO: 957131 - protein, 9 aa, Homo Sapiens
VRNLRVKAQ

SEQ ID NO: 957132 - protein, 9 aa, Homo Sapiens
KLRIDVSIT

SEQ ID NO: 957133 - protein, 9 aa, Homo Sapiens
KLEKQPERA

SEQ ID NO: 957134 - protein, 9 aa, Homo Sapiens
QIYFFYSLG

SEQ ID NO: 957135 - protein, 9 aa, Homo Sapiens
EEAPNPLHK

SEQ ID NO: 957136 - protein, 9 aa, Homo Sapiens
KENGHRHAL

SEQ ID NO: 957137 - protein, 9 aa, Homo Sapiens
SSRAGANWS

SEQ ID NO: 957138 - protein, 9 aa, Homo Sapiens
AIFSRVSSL

SEQ ID NO: 957139 - protein, 9 aa, Homo Sapiens
GLEPNLLNS

SEQ ID NO: 957140 - protein, 9 aa, Homo Sapiens
VRFYFSVKV

SEQ ID NO: 957141 - protein, 9 aa, Homo Sapiens
VTFKCWQHS

SEQ ID NO: 957142 - protein, 9 aa, Homo Sapiens
FSDLIIYTL

SEQ ID NO: 957143 - protein, 9 aa, Homo Sapiens
AQEVHVDMV

SEQ ID NO: 957144 - protein, 9 aa, Homo Sapiens
LLQTDFVLD

SEQ ID NO: 957145 - protein, 9 aa, Homo Sapiens
PQNKDKLEK

SEQ ID NO: 957146 - protein, 9 aa, Homo Sapiens
SLHSLVGVC

SEQ ID NO: 957147 - protein, 9 aa, Homo Sapiens
FFYSLGATE

SEQ ID NO: 957148 - protein, 9 aa, Homo Sapiens
FFCAELLVK

SEQ ID NO: 957149 - protein, 9 aa, Homo Sapiens
LNRERLCGQ

SEQ ID NO: 957150 - protein, 9 aa, Homo Sapiens
SSLLSPSGF

SEQ ID NO: 957151 - protein, 9 aa, Homo Sapiens
SSFRVAWTE

SEQ ID NO: 957152 - protein, 9 aa, Homo Sapiens
RLCLEHEQA

SEQ ID NO: 957153 - protein, 9 aa, Homo Sapiens
EGQSTCLLF

SEQ ID NO: 957154 - protein, 9 aa, Homo Sapiens
KATDSNGNC

SEQ ID NO: 957155 - protein, 9 aa, Homo Sapiens
LHTNAALEE

SEQ ID NO: 957156 - protein, 9 aa, Homo Sapiens
YDCYVAICF

SEQ ID NO: 957157 - protein, 9 aa, Homo Sapiens
VVETEASTH

SEQ ID NO: 957158 - protein, 9 aa, Homo Sapiens
LEKVLDLDD

SEQ ID NO: 957159 - protein, 9 aa, Homo Sapiens
STASTTQKG

SEQ ID NO: 957160 - protein, 9 aa, Homo Sapiens
KVLDLDDFL

SEQ ID NO: 957161 - protein, 9 aa, Homo Sapiens
NSNNDGADG

SEQ ID NO: 957162 - protein, 9 aa, Homo Sapiens
IFKQFFKNW

SEQ ID NO: 957163 - protein, 9 aa, Homo Sapiens
YFKFNCISI

SEQ ID NO: 957164 - protein, 9 aa, Homo Sapiens
AYGTVYKAS

SEQ ID NO: 957165 - protein, 9 aa, Homo Sapiens
KEMTARMSH

SEQ ID NO: 957166 - protein, 9 aa, Homo Sapiens
LLTPRIMHS

SEQ ID NO: 957167 - protein, 9 aa, Homo Sapiens
NCGFAFVEY

SEQ ID NO: 957168 - protein, 9 aa, Homo Sapiens
SQFESSQSG

SEQ ID NO: 957169 - protein, 9 aa, Homo Sapiens
ALSQTSQNF

SEQ ID NO: 957170 - protein, 9 aa, Homo Sapiens
FCGLLPRVP

SEQ ID NO: 957171 - protein, 9 aa, Homo Sapiens
DVDCKRLSL

SEQ ID NO: 957172 - protein, 9 aa, Homo Sapiens
LLKFFRLFE

SEQ ID NO: 957173 - protein, 9 aa, Homo Sapiens
FWLEEAKSR

SEQ ID NO: 957174 - protein, 9 aa, Homo Sapiens
DVLGLDVSY

SEQ ID NO: 957175 - protein, 9 aa, Homo Sapiens
IKNPNQFVP

SEQ ID NO: 957176 - protein, 9 aa, Homo Sapiens
PALLYLPGK

SEQ ID NO: 957177 - protein, 9 aa, Homo Sapiens
LALHHSVET

SEQ ID NO: 957178 - protein, 9 aa, Homo Sapiens
TLTLLSVKK

SEQ ID NO: 957179 - protein, 9 aa, Homo Sapiens
HVPEPVFRK

SEQ ID NO: 957180 - protein, 9 aa, Homo Sapiens
MKVLEDHGE

SEQ ID NO: 957181 - protein, 9 aa, Homo Sapiens
FWTRAVSGL

SEQ ID NO: 957182 - protein, 9 aa, Homo Sapiens
IDTVCDCSD

SEQ ID NO: 957183 - protein, 9 aa, Homo Sapiens
TFNTLAMYV

SEQ ID NO: 957184 - protein, 9 aa, Homo Sapiens
REVLQPIGM

SEQ ID NO: 957185 - protein, 9 aa, Homo Sapiens
GMMLSVEKL

SEQ ID NO: 957186 - protein, 9 aa, Homo Sapiens
DEKVRIKTL

SEQ ID NO: 957187 - protein, 9 aa, Homo Sapiens
FNCISIEEQ

SEQ ID NO: 957188 - protein, 9 aa, Homo Sapiens
LIVYVTGRS

SEQ ID NO: 957189 - protein, 9 aa, Homo Sapiens
EQFDPFCPL

SEQ ID NO: 957190 - protein, 9 aa, Homo Sapiens
LLYISCVVS

SEQ ID NO: 957191 - protein, 9 aa, Homo Sapiens
DPPVAEPVP

SEQ ID NO: 957192 - protein, 9 aa, Homo Sapiens
ILEGEDSAY

SEQ ID NO: 957193 - protein, 9 aa, Homo Sapiens
KHLRKKLQS

SEQ ID NO: 957194 - protein, 9 aa, Homo Sapiens
ISIEEQLQL

SEQ ID NO: 957195 - protein, 9 aa, Homo Sapiens
EQDPPVAEP

SEQ ID NO: 957196 - protein, 9 aa, Homo Sapiens
KLHNPMYFF

SEQ ID NO: 957197 - protein, 9 aa, Homo Sapiens
LQESLRLSA

SEQ ID NO: 957198 - protein, 9 aa, Homo Sapiens
ALSWGVKSL

SEQ ID NO: 957199 - protein, 9 aa, Homo Sapiens
TKILINISQ

SEQ ID NO: 957200 - protein, 9 aa, Homo Sapiens
REDIKGVRI

SEQ ID NO: 957201 - protein, 9 aa, Homo Sapiens
EMVKNLRMK

SEQ ID NO: 957202 - protein, 9 aa, Homo Sapiens
AFTRSSFTV

SEQ ID NO: 957203 - protein, 9 aa, Homo Sapiens
SIGELMAIQ

SEQ ID NO: 957204 - protein, 9 aa, Homo Sapiens
EYNAADLQN

SEQ ID NO: 957205 - protein, 9 aa, Homo Sapiens
VVNEINNAQ

SEQ ID NO: 957206 - protein, 9 aa, Homo Sapiens
RSPGPRSSL

SEQ ID NO: 957207 - protein, 9 aa, Homo Sapiens
LMGPVSSRF

SEQ ID NO: 957208 - protein, 9 aa, Homo Sapiens
AKHFFALKL

SEQ ID NO: 957209 - protein, 9 aa, Homo Sapiens
SLDRCKCKK

SEQ ID NO: 957210 - protein, 9 aa, Homo Sapiens
PGKEMELVT

SEQ ID NO: 957211 - protein, 9 aa, Homo Sapiens
VFEIIIRYS

SEQ ID NO: 957212 - protein, 9 aa, Homo Sapiens
FKEFDKNIA

SEQ ID NO: 957213 - protein, 9 aa, Homo Sapiens
LPLAIFSRV

SEQ ID NO: 957214 - protein, 9 aa, Homo Sapiens
KYHNANFIP

SEQ ID NO: 957215 - protein, 9 aa, Homo Sapiens
RVGGFDVFI

SEQ ID NO: 957216 - protein, 9 aa, Homo Sapiens
TVMSSCSPG

SEQ ID NO: 957217 - protein, 9 aa, Homo Sapiens
KWLREPNFV

SEQ ID NO: 957218 - protein, 9 aa, Homo Sapiens
DLQTVRTIL

SEQ ID NO: 957219 - protein, 9 aa, Homo Sapiens
IKFSEENNG

SEQ ID NO: 957220 - protein, 9 aa, Homo Sapiens
LQTVRTILA

SEQ ID NO: 957221 - protein, 9 aa, Homo Sapiens
IIRKIAVPP

SEQ ID NO: 957222 - protein, 9 aa, Homo Sapiens
VDRLKFNKI

SEQ ID NO: 957223 - protein, 9 aa, Homo Sapiens
SCYPPFLSF

SEQ ID NO: 957224 - protein, 9 aa, Homo Sapiens
NSKTKILIN

SEQ ID NO: 957225 - protein, 9 aa, Homo Sapiens
LMSIPDVIR

SEQ ID NO: 957226 - protein, 9 aa, Homo Sapiens
LKVALMGLG

SEQ ID NO: 957227 - protein, 9 aa, Homo Sapiens
SHIVPHERI

SEQ ID NO: 957228 - protein, 9 aa, Homo Sapiens
RKFMMQSRL

SEQ ID NO: 957229 - protein, 9 aa, Homo Sapiens
AFLLSSVTQ

SEQ ID NO: 957230 - protein, 9 aa, Homo Sapiens
LDYEGIKEF

SEQ ID NO: 957231 - protein, 9 aa, Homo Sapiens
GKKRPFSCR

SEQ ID NO: 957232 - protein, 9 aa, Homo Sapiens
ERPNDDQDG

SEQ ID NO: 957233 - protein, 9 aa, Homo Sapiens
DWEYPGSRE

SEQ ID NO: 957234 - protein, 9 aa, Homo Sapiens
LFLSQWSQS

SEQ ID NO: 957235 - protein, 9 aa, Homo Sapiens
LIGDKVTFS

SEQ ID NO: 957236 - protein, 9 aa, Homo Sapiens
SDLIIYTLE

SEQ ID NO: 957237 - protein, 9 aa, Homo Sapiens
GPKLREEFS

SEQ ID NO: 957238 - protein, 9 aa, Homo Sapiens
SWVILFVQC

SEQ ID NO: 957239 - protein, 9 aa, Homo Sapiens
LLDYEGIKE

SEQ ID NO: 957240 - protein, 9 aa, Homo Sapiens
KEMPKKKRE

SEQ ID NO: 957241 - protein, 9 aa, Homo Sapiens
GVTFKCWQH

SEQ ID NO: 957242 - protein, 9 aa, Homo Sapiens
SYSVVELRV

SEQ ID NO: 957243 - protein, 9 aa, Homo Sapiens
SSECPRDAR

SEQ ID NO: 957244 - protein, 9 aa, Homo Sapiens
FLVRSSLIT

SEQ ID NO: 957245 - protein, 9 aa, Homo Sapiens
CHSLSSCVF

SEQ ID NO: 957246 - protein, 9 aa, Homo Sapiens
AGVCALFAT

SEQ ID NO: 957247 - protein, 9 aa, Homo Sapiens
QLQNKFYLD

SEQ ID NO: 957248 - protein, 9 aa, Homo Sapiens
ILTNKVIGR

SEQ ID NO: 957249 - protein, 9 aa, Homo Sapiens
VSSNTEGQS

SEQ ID NO: 957250 - protein, 9 aa, Homo Sapiens
SMLGEQCAR

SEQ ID NO: 957251 - protein, 9 aa, Homo Sapiens
NEYQAYAGP

SEQ ID NO: 957252 - protein, 9 aa, Homo Sapiens
SDPPFFFKN

SEQ ID NO: 957253 - protein, 9 aa, Homo Sapiens
RSPCMSLRS

SEQ ID NO: 957254 - protein, 9 aa, Homo Sapiens
YYEYTVPVN

SEQ ID NO: 957255 - protein, 9 aa, Homo Sapiens
NRERLCGQA

SEQ ID NO: 957256 - protein, 9 aa, Homo Sapiens
RKYHNANFI

SEQ ID NO: 957257 - protein, 9 aa, Homo Sapiens
AALARTPTQ

SEQ ID NO: 957258 - protein, 9 aa, Homo Sapiens
PGLFWLNIS

SEQ ID NO: 957259 - protein, 9 aa, Homo Sapiens
QRKRRKFMM

SEQ ID NO: 957260 - protein, 9 aa, Homo Sapiens
DSFQTLDTS

SEQ ID NO: 957261 - protein, 9 aa, Homo Sapiens
PASALTPGH

SEQ ID NO: 957262 - protein, 9 aa, Homo Sapiens
VFCVFLAFV

SEQ ID NO: 957263 - protein, 9 aa, Homo Sapiens
REDLSHALG

SEQ ID NO: 957264 - protein, 9 aa, Homo Sapiens
PLQFFCAEL

SEQ ID NO: 957265 - protein, 9 aa, Homo Sapiens
KEEAPNPLH

SEQ ID NO: 957266 - protein, 9 aa, Homo Sapiens
SVETDTSGL

SEQ ID NO: 957267 - protein, 9 aa, Homo Sapiens
SLALKVALM

SEQ ID NO: 957268 - protein, 9 aa, Homo Sapiens
NNVDSNDLE

SEQ ID NO: 957269 - protein, 9 aa, Homo Sapiens
SLFLSQWSQ

SEQ ID NO: 957270 - protein, 9 aa, Homo Sapiens
IAGKILEIE

SEQ ID NO: 957271 - protein, 9 aa, Homo Sapiens
FPLLSAANL

SEQ ID NO: 957272 - protein, 9 aa, Homo Sapiens
FNTLAMYVA

SEQ ID NO: 957273 - protein, 9 aa, Homo Sapiens
KCNPTQQKF

SEQ ID NO: 957274 - protein, 9 aa, Homo Sapiens
VLKIYFEYL

SEQ ID NO: 957275 - protein, 9 aa, Homo Sapiens
CEQYVSSFC

SEQ ID NO: 957276 - protein, 9 aa, Homo Sapiens
RFGETKSIG

SEQ ID NO: 957277 - protein, 9 aa, Homo Sapiens
KDLEEYQAL

SEQ ID NO: 957278 - protein, 9 aa, Homo Sapiens
IKIKLGQPS

SEQ ID NO: 957279 - protein, 9 aa, Homo Sapiens
GKEIFHRLY

SEQ ID NO: 957280 - protein, 9 aa, Homo Sapiens
TPWVFSRIS

SEQ ID NO: 957281 - protein, 9 aa, Homo Sapiens
CFWTRAVSG

SEQ ID NO: 957282 - protein, 9 aa, Homo Sapiens
TRRFVGLRV

SEQ ID NO: 957283 - protein, 9 aa, Homo Sapiens
KFKSISASF

SEQ ID NO: 957284 - protein, 9 aa, Homo Sapiens
VNFSQPVAV

SEQ ID NO: 957285 - protein, 9 aa, Homo Sapiens
EGIKEFSFK

SEQ ID NO: 957286 - protein, 9 aa, Homo Sapiens
VEDHVHRPA

SEQ ID NO: 957287 - protein, 9 aa, Homo Sapiens
TSEFEKMLQ

SEQ ID NO: 957288 - protein, 9 aa, Homo Sapiens
KEEVEVGFD

SEQ ID NO: 957289 - protein, 9 aa, Homo Sapiens
RFLDKILVA

SEQ ID NO: 957290 - protein, 9 aa, Homo Sapiens
AGKHRSKIS

SEQ ID NO: 957291 - protein, 9 aa, Homo Sapiens
NRLLKFFRL

SEQ ID NO: 957292 - protein, 9 aa, Homo Sapiens
SSFLPQTPE

SEQ ID NO: 957293 - protein, 9 aa, Homo Sapiens
LNISGGDKD

SEQ ID NO: 957294 - protein, 9 aa, Homo Sapiens
MISLLQIGL

SEQ ID NO: 957295 - protein, 9 aa, Homo Sapiens
GASTKWKPR

SEQ ID NO: 957296 - protein, 9 aa, Homo Sapiens
IALTVGFKH

SEQ ID NO: 957297 - protein, 9 aa, Homo Sapiens
IPIFEKLDY

SEQ ID NO: 957298 - protein, 9 aa, Homo Sapiens
RAWLWQIEE

SEQ ID NO: 957299 - protein, 9 aa, Homo Sapiens
SHLLTPRIM

SEQ ID NO: 957300 - protein, 9 aa, Homo Sapiens
FSSSLQSYR

SEQ ID NO: 957301 - protein, 9 aa, Homo Sapiens
CGKLFSQIY

SEQ ID NO: 957302 - protein, 9 aa, Homo Sapiens
GITEKAPKE

SEQ ID NO: 957303 - protein, 9 aa, Homo Sapiens
SLVGVCSST

SEQ ID NO: 957304 - protein, 9 aa, Homo Sapiens
TFFPSDGYC

SEQ ID NO: 957305 - protein, 9 aa, Homo Sapiens
VGEFTFLCD

SEQ ID NO: 957306 - protein, 9 aa, Homo Sapiens
NNDYKAEIK

SEQ ID NO: 957307 - protein, 9 aa, Homo Sapiens
DSKLHNPMY

SEQ ID NO: 957308 - protein, 9 aa, Homo Sapiens
PVAVRPSLL

SEQ ID NO: 957309 - protein, 9 aa, Homo Sapiens
ARQLLKWID

SEQ ID NO: 957310 - protein, 9 aa, Homo Sapiens
GQSTCLLFL

SEQ ID NO: 957311 - protein, 9 aa, Homo Sapiens
WLREPNFVQ

SEQ ID NO: 957312 - protein, 9 aa, Homo Sapiens
SPPADGSKE

SEQ ID NO: 957313 - protein, 9 aa, Homo Sapiens
GLTRNVKEK

SEQ ID NO: 957314 - protein, 9 aa, Homo Sapiens
TFLWVNGEL

SEQ ID NO: 957315 - protein, 9 aa, Homo Sapiens
TIPLLAVAS

SEQ ID NO: 957316 - protein, 9 aa, Homo Sapiens
ENLVNPCAL

SEQ ID NO: 957317 - protein, 9 aa, Homo Sapiens
GASCTDVDR

SEQ ID NO: 957318 - protein, 9 aa, Homo Sapiens
SYFWSLRVI

SEQ ID NO: 957319 - protein, 9 aa, Homo Sapiens
GGSLAALAR

SEQ ID NO: 957320 - protein, 9 aa, Homo Sapiens
LQIYFFYSL

SEQ ID NO: 957321 - protein, 9 aa, Homo Sapiens
APGSSGQKG

SEQ ID NO: 957322 - protein, 9 aa, Homo Sapiens
YGSEIFTYM

SEQ ID NO: 957323 - protein, 9 aa, Homo Sapiens
GINLFADGM

SEQ ID NO: 957324 - protein, 9 aa, Homo Sapiens
AQGRVAVQN

SEQ ID NO: 957325 - protein, 9 aa, Homo Sapiens
LVRNNPSFE

SEQ ID NO: 957326 - protein, 9 aa, Homo Sapiens
RRKTESNWE

SEQ ID NO: 957327 - protein, 9 aa, Homo Sapiens
EGALYEIRG

SEQ ID NO: 957328 - protein, 9 aa, Homo Sapiens
SEENNGIKR

SEQ ID NO: 957329 - protein, 9 aa, Homo Sapiens
QSINSKTKI

SEQ ID NO: 957330 - protein, 9 aa, Homo Sapiens
VAMNIRLRN

SEQ ID NO: 957331 - protein, 9 aa, Homo Sapiens
APNPLHKVV

SEQ ID NO: 957332 - protein, 9 aa, Homo Sapiens
KLKWKWKLS

SEQ ID NO: 957333 - protein, 9 aa, Homo Sapiens
SDFLNKLMG

SEQ ID NO: 957334 - protein, 9 aa, Homo Sapiens
RACARQDNV

SEQ ID NO: 957335 - protein, 9 aa, Homo Sapiens
SEITKQEKD

SEQ ID NO: 957336 - protein, 9 aa, Homo Sapiens
QQKKNLEVT

SEQ ID NO: 957337 - protein, 9 aa, Homo Sapiens
SFTVTVPIA

SEQ ID NO: 957338 - protein, 9 aa, Homo Sapiens
EVSMPISEE

SEQ ID NO: 957339 - protein, 9 aa, Homo Sapiens
MKKDREICR

SEQ ID NO: 957340 - protein, 9 aa, Homo Sapiens
LTRNKKKAR

SEQ ID NO: 957341 - protein, 9 aa, Homo Sapiens
DRIFPEGSC

SEQ ID NO: 957342 - protein, 9 aa, Homo Sapiens
KEIFHRLYL

SEQ ID NO: 957343 - protein, 9 aa, Homo Sapiens
VVFLMALSE

SEQ ID NO: 957344 - protein, 9 aa, Homo Sapiens
GLTFLWVNG

SEQ ID NO: 957345 - protein, 9 aa, Homo Sapiens
PLAIFSRVS

SEQ ID NO: 957346 - protein, 9 aa, Homo Sapiens
NLFADGMGA

SEQ ID NO: 957347 - protein, 9 aa, Homo Sapiens
AKEVRPLVS

SEQ ID NO: 957348 - protein, 9 aa, Homo Sapiens
MLGEQCARI

SEQ ID NO: 957349 - protein, 9 aa, Homo Sapiens
STENMHFSS

SEQ ID NO: 957350 - protein, 9 aa, Homo Sapiens
YDNIILKGY

SEQ ID NO: 957351 - protein, 9 aa, Homo Sapiens
IKGVRIALD

SEQ ID NO: 957352 - protein, 9 aa, Homo Sapiens
IQNELLPPG

SEQ ID NO: 957353 - protein, 9 aa, Homo Sapiens
VGDAGLNRE

SEQ ID NO: 957354 - protein, 9 aa, Homo Sapiens
AYLITFEKR

SEQ ID NO: 957355 - protein, 9 aa, Homo Sapiens
CTNPVTPLC

SEQ ID NO: 957356 - protein, 9 aa, Homo Sapiens
LKSHDCLYI

SEQ ID NO: 957357 - protein, 9 aa, Homo Sapiens
SFLPQTPEQ

SEQ ID NO: 957358 - protein, 9 aa, Homo Sapiens
EIYDAFENI

SEQ ID NO: 957359 - protein, 9 aa, Homo Sapiens
RDTRLEKMV

SEQ ID NO: 957360 - protein, 9 aa, Homo Sapiens
TLDNLKCKS

SEQ ID NO: 957361 - protein, 9 aa, Homo Sapiens
ASPRKENGH

SEQ ID NO: 957362 - protein, 9 aa, Homo Sapiens
FPSDGYCVD

SEQ ID NO: 957363 - protein, 9 aa, Homo Sapiens
YEMKEDGVR

SEQ ID NO: 957364 - protein, 9 aa, Homo Sapiens
SIGQLLYIS

SEQ ID NO: 957365 - protein, 9 aa, Homo Sapiens
LGGVPPVPS

SEQ ID NO: 957366 - protein, 9 aa, Homo Sapiens
QDPPVAEPV

SEQ ID NO: 957367 - protein, 9 aa, Homo Sapiens
RAGVQRDEP

SEQ ID NO: 957368 - protein, 9 aa, Homo Sapiens
VLSLDQMPA

SEQ ID NO: 957369 - protein, 9 aa, Homo Sapiens
NGKKRPFSC

SEQ ID NO: 957370 - protein, 9 aa, Homo Sapiens
KILINISQE

SEQ ID NO: 957371 - protein, 9 aa, Homo Sapiens
VKSLHIDDI

SEQ ID NO: 957372 - protein, 9 aa, Homo Sapiens
TEDNSNLSM

SEQ ID NO: 957373 - protein, 9 aa, Homo Sapiens
GRKDFSATS

SEQ ID NO: 957374 - protein, 9 aa, Homo Sapiens
RQGCSREAS

SEQ ID NO: 957375 - protein, 9 aa, Homo Sapiens
FTSCLVPAA

SEQ ID NO: 957376 - protein, 9 aa, Homo Sapiens
MLPFWTNLC

SEQ ID NO: 957377 - protein, 9 aa, Homo Sapiens
FGSKDAVFD

SEQ ID NO: 957378 - protein, 9 aa, Homo Sapiens
LRSKQILSA

SEQ ID NO: 957379 - protein, 9 aa, Homo Sapiens
SSRFSEVRV

SEQ ID NO: 957380 - protein, 9 aa, Homo Sapiens
WPHSPNGPL

SEQ ID NO: 957381 - protein, 9 aa, Homo Sapiens
LLAVASPGV

SEQ ID NO: 957382 - protein, 9 aa, Homo Sapiens
RDELPTQTS

SEQ ID NO: 957383 - protein, 9 aa, Homo Sapiens
FSQPVAVRP

SEQ ID NO: 957384 - protein, 9 aa, Homo Sapiens
QGLSLLRSS

SEQ ID NO: 957385 - protein, 9 aa, Homo Sapiens
YLSQYFSPA

SEQ ID NO: 957386 - protein, 9 aa, Homo Sapiens
IPEDVWNIK

SEQ ID NO: 957387 - protein, 9 aa, Homo Sapiens
QKMTIMVFI

SEQ ID NO: 957388 - protein, 9 aa, Homo Sapiens
MSPSDFLNK

SEQ ID NO: 957389 - protein, 9 aa, Homo Sapiens
GDVLTIPVS

SEQ ID NO: 957390 - protein, 9 aa, Homo Sapiens
STMPGTVMS

SEQ ID NO: 957391 - protein, 9 aa, Homo Sapiens
ATDKTKNCG

SEQ ID NO: 957392 - protein, 9 aa, Homo Sapiens
VEEIFCKVR

SEQ ID NO: 957393 - protein, 9 aa, Homo Sapiens
ESLGGKCNP

SEQ ID NO: 957394 - protein, 9 aa, Homo Sapiens
ATRDCYHHS

SEQ ID NO: 957395 - protein, 9 aa, Homo Sapiens
PWVFSRISS

SEQ ID NO: 957396 - protein, 9 aa, Homo Sapiens
DKDEKVRIK

SEQ ID NO: 957397 - protein, 9 aa, Homo Sapiens
TRDCYHHSS

SEQ ID NO: 957398 - protein, 9 aa, Homo Sapiens
YHNANFIPT

SEQ ID NO: 957399 - protein, 9 aa, Homo Sapiens
DKAFGPKLR

SEQ ID NO: 957400 - protein, 9 aa, Homo Sapiens
KTDKSGAAP

SEQ ID NO: 957401 - protein, 9 aa, Homo Sapiens
RLCGGVTFK

SEQ ID NO: 957402 - protein, 9 aa, Homo Sapiens
AGLNRERLC

SEQ ID NO: 957403 - protein, 9 aa, Homo Sapiens
GKEMELVTQ

SEQ ID NO: 957404 - protein, 9 aa, Homo Sapiens
IRGLFGTGI

SEQ ID NO: 957405 - protein, 9 aa, Homo Sapiens
EGPSVPSSF

SEQ ID NO: 957406 - protein, 9 aa, Homo Sapiens
SSFCKMSRL

SEQ ID NO: 957407 - protein, 9 aa, Homo Sapiens
AEALGPAAA

SEQ ID NO: 957408 - protein, 9 aa, Homo Sapiens
MPIRIKNPN

SEQ ID NO: 957409 - protein, 9 aa, Homo Sapiens
LDNMGEQAK

SEQ ID NO: 957410 - protein, 9 aa, Homo Sapiens
RFNRLLKFF

SEQ ID NO: 957411 - protein, 9 aa, Homo Sapiens
FYQSSSLLR

SEQ ID NO: 957412 - protein, 9 aa, Homo Sapiens
KTESNWEAQ

SEQ ID NO: 957413 - protein, 9 aa, Homo Sapiens
CKVRFSFEQ

SEQ ID NO: 957414 - protein, 9 aa, Homo Sapiens
PKKKRELQF

SEQ ID NO: 957415 - protein, 9 aa, Homo Sapiens
PALTTPGQR

SEQ ID NO: 957416 - protein, 9 aa, Homo Sapiens
YLSNQELFC

SEQ ID NO: 957417 - protein, 9 aa, Homo Sapiens
CDVEEIFCK

SEQ ID NO: 957418 - protein, 9 aa, Homo Sapiens
LYISCVVSS

SEQ ID NO: 957419 - protein, 9 aa, Homo Sapiens
CVSCFWTRA

SEQ ID NO: 957420 - protein, 9 aa, Homo Sapiens
SESPQGKVL

SEQ ID NO: 957421 - protein, 9 aa, Homo Sapiens
ITEKAPKEK

SEQ ID NO: 957422 - protein, 9 aa, Homo Sapiens
LYNQVLLFS

SEQ ID NO: 957423 - protein, 9 aa, Homo Sapiens
THCHSLSSC

SEQ ID NO: 957424 - protein, 9 aa, Homo Sapiens
IARALPGFS

SEQ ID NO: 957425 - protein, 9 aa, Homo Sapiens
VRQMMEMVG

SEQ ID NO: 957426 - protein, 9 aa, Homo Sapiens
HDQDYGIYY

SEQ ID NO: 957427 - protein, 9 aa, Homo Sapiens
QAYAGPITK

SEQ ID NO: 957428 - protein, 9 aa, Homo Sapiens
DLLYSIFSG

SEQ ID NO: 957429 - protein, 9 aa, Homo Sapiens
LAVASPGVA

SEQ ID NO: 957430 - protein, 9 aa, Homo Sapiens
TLADMIAKD

SEQ ID NO: 957431 - protein, 9 aa, Homo Sapiens
FYFSVKVNG

SEQ ID NO: 957432 - protein, 9 aa, Homo Sapiens
LSVTEPATC

SEQ ID NO: 957433 - protein, 9 aa, Homo Sapiens
LFIKTIFHP

SEQ ID NO: 957434 - protein, 9 aa, Homo Sapiens
AMISLLQIG

SEQ ID NO: 957435 - protein, 9 aa, Homo Sapiens
FEKMLQVGN

SEQ ID NO: 957436 - protein, 9 aa, Homo Sapiens
VVAVAAVFC

SEQ ID NO: 957437 - protein, 9 aa, Homo Sapiens
GYCVDQTSM

SEQ ID NO: 957438 - protein, 9 aa, Homo Sapiens
GTELLLLLT

SEQ ID NO: 957439 - protein, 9 aa, Homo Sapiens
HKKTCKECT

SEQ ID NO: 957440 - protein, 9 aa, Homo Sapiens
NPVQFIQGK

SEQ ID NO: 957441 - protein, 9 aa, Homo Sapiens
NMQNMPAAV

SEQ ID NO: 957442 - protein, 9 aa, Homo Sapiens
WQIEEIHVG

SEQ ID NO: 957443 - protein, 9 aa, Homo Sapiens
SSTKPAVGG

SEQ ID NO: 957444 - protein, 9 aa, Homo Sapiens
YSTYFKEFD

SEQ ID NO: 957445 - protein, 9 aa, Homo Sapiens
AHRIALAAS

SEQ ID NO: 957446 - protein, 9 aa, Homo Sapiens
ARVILAVIY

SEQ ID NO: 957447 - protein, 9 aa, Homo Sapiens
EEDDYERPN

SEQ ID NO: 957448 - protein, 9 aa, Homo Sapiens
GRGLCTATT

SEQ ID NO: 957449 - protein, 9 aa, Homo Sapiens
VLLFSESPQ

SEQ ID NO: 957450 - protein, 9 aa, Homo Sapiens
TAFLLSSVT

SEQ ID NO: 957451 - protein, 9 aa, Homo Sapiens
PSQPARSAS

SEQ ID NO: 957452 - protein, 9 aa, Homo Sapiens
DGQITMKKT

SEQ ID NO: 957453 - protein, 9 aa, Homo Sapiens
HAQGRVAVQ

SEQ ID NO: 957454 - protein, 9 aa, Homo Sapiens
FRARPAGTG

SEQ ID NO: 957455 - protein, 9 aa, Homo Sapiens
FLEGKVDDE

SEQ ID NO: 957456 - protein, 9 aa, Homo Sapiens
PPEDTAFTR

SEQ ID NO: 957457 - protein, 9 aa, Homo Sapiens
NSYGGKFDR

SEQ ID NO: 957458 - protein, 9 aa, Homo Sapiens
KKNATRVAL

SEQ ID NO: 957459 - protein, 9 aa, Homo Sapiens
FWKASRRAL

SEQ ID NO: 957460 - protein, 9 aa, Homo Sapiens
SIVIKMSKF

SEQ ID NO: 957461 - protein, 9 aa, Homo Sapiens
QEETAFLLS

SEQ ID NO: 957462 - protein, 9 aa, Homo Sapiens
YNMTSEFEK

SEQ ID NO: 957463 - protein, 9 aa, Homo Sapiens
PSMSSSPRG

SEQ ID NO: 957464 - protein, 9 aa, Homo Sapiens
SRIPRPSVR

SEQ ID NO: 957465 - protein, 9 aa, Homo Sapiens
QEQNSYGGK

SEQ ID NO: 957466 - protein, 9 aa, Homo Sapiens
DFVKFLSEE

SEQ ID NO: 957467 - protein, 9 aa, Homo Sapiens
PVNTEGVLL

SEQ ID NO: 957468 - protein, 9 aa, Homo Sapiens
SGQALKDEK

SEQ ID NO: 957469 - protein, 9 aa, Homo Sapiens
PSVKATDSN

SEQ ID NO: 957470 - protein, 9 aa, Homo Sapiens
ALGPHFGTP

SEQ ID NO: 957471 - protein, 9 aa, Homo Sapiens
TDSNGNCVS

SEQ ID NO: 957472 - protein, 9 aa, Homo Sapiens
KKNFLEGKV

SEQ ID NO: 957473 - protein, 9 aa, Homo Sapiens
EHYVVTCGF

SEQ ID NO: 957474 - protein, 9 aa, Homo Sapiens
CVGEFTFLC

SEQ ID NO: 957475 - protein, 9 aa, Homo Sapiens
HCHSLSSCV

SEQ ID NO: 957476 - protein, 9 aa, Homo Sapiens
FHSVCPAEM

SEQ ID NO: 957477 - protein, 9 aa, Homo Sapiens
LEIEDMAVL

SEQ ID NO: 957478 - protein, 9 aa, Homo Sapiens
NEKEEVEVG

SEQ ID NO: 957479 - protein, 9 aa, Homo Sapiens
HPEPTLNQL

SEQ ID NO: 957480 - protein, 9 aa, Homo Sapiens
QHTLADMIA

SEQ ID NO: 957481 - protein, 9 aa, Homo Sapiens
MIQILAPLA

SEQ ID NO: 957482 - protein, 9 aa, Homo Sapiens
MIFPNYRRS

SEQ ID NO: 957483 - protein, 9 aa, Homo Sapiens
SYLSLALKV

SEQ ID NO: 957484 - protein, 9 aa, Homo Sapiens
GAFFLLSWG

SEQ ID NO: 957485 - protein, 9 aa, Homo Sapiens
VHFSGFCGL

SEQ ID NO: 957486 - protein, 9 aa, Homo Sapiens
PRPSVRQGC

SEQ ID NO: 957487 - protein, 9 aa, Homo Sapiens
EAPNPLHKV

SEQ ID NO: 957488 - protein, 9 aa, Homo Sapiens
KTSPPSSPL

SEQ ID NO: 957489 - protein, 9 aa, Homo Sapiens
YEGIKEFSF

SEQ ID NO: 957490 - protein, 9 aa, Homo Sapiens
SKHGDRFIS

SEQ ID NO: 957491 - protein, 9 aa, Homo Sapiens
HLCLHTGDR

SEQ ID NO: 957492 - protein, 9 aa, Homo Sapiens
SLVSANWPQ

SEQ ID NO: 957493 - protein, 9 aa, Homo Sapiens
ARRPTVGIG

SEQ ID NO: 957494 - protein, 9 aa, Homo Sapiens
ASTKWKPRV

SEQ ID NO: 957495 - protein, 9 aa, Homo Sapiens
RRLSSRRSG

SEQ ID NO: 957496 - protein, 9 aa, Homo Sapiens
LDLLERKLW

SEQ ID NO: 957497 - protein, 9 aa, Homo Sapiens
YENQHQVGE

SEQ ID NO: 957498 - protein, 9 aa, Homo Sapiens
QGNFYYGNL

SEQ ID NO: 957499 - protein, 9 aa, Homo Sapiens
LVYVACQFP

SEQ ID NO: 957500 - protein, 9 aa, Homo Sapiens
AQTNGRNGY

SEQ ID NO: 957501 - protein, 9 aa, Homo Sapiens
CQSINSKTK

SEQ ID NO: 957502 - protein, 9 aa, Homo Sapiens
NQELFCWQI

SEQ ID NO: 957503 - protein, 9 aa, Homo Sapiens
HVSGGKDVR

SEQ ID NO: 957504 - protein, 9 aa, Homo Sapiens
CKFYLFFEN

SEQ ID NO: 957505 - protein, 9 aa, Homo Sapiens
SFTGGMFDF

SEQ ID NO: 957506 - protein, 9 aa, Homo Sapiens
TGEGNMFTP

SEQ ID NO: 957507 - protein, 9 aa, Homo Sapiens
CGKAFLVRS

SEQ ID NO: 957508 - protein, 9 aa, Homo Sapiens
FESLVRNNP

SEQ ID NO: 957509 - protein, 9 aa, Homo Sapiens
CGECGKSFY

SEQ ID NO: 957510 - protein, 9 aa, Homo Sapiens
QGLMDKDEK

SEQ ID NO: 957511 - protein, 9 aa, Homo Sapiens
SGIKIKLGQ

SEQ ID NO: 957512 - protein, 9 aa, Homo Sapiens
SCFWTRAVS

SEQ ID NO: 957513 - protein, 9 aa, Homo Sapiens
LSGQALKDE

SEQ ID NO: 957514 - protein, 9 aa, Homo Sapiens
LLSAANLVI

SEQ ID NO: 957515 - protein, 9 aa, Homo Sapiens
RPPSPVSSF

SEQ ID NO: 957516 - protein, 9 aa, Homo Sapiens
ASINDSEEL

SEQ ID NO: 957517 - protein, 9 aa, Homo Sapiens
CPAEMIVKF

SEQ ID NO: 957518 - protein, 9 aa, Homo Sapiens
PEPTLNQLT

SEQ ID NO: 957519 - protein, 9 aa, Homo Sapiens
FGLVRTACT

SEQ ID NO: 957520 - protein, 9 aa, Homo Sapiens
GARKKEEGG

SEQ ID NO: 957521 - protein, 9 aa, Homo Sapiens
PSDFEHTIY

SEQ ID NO: 957522 - protein, 9 aa, Homo Sapiens
KFSEENNGI

SEQ ID NO: 957523 - protein, 9 aa, Homo Sapiens
ITQYSLHCK

SEQ ID NO: 957524 - protein, 9 aa, Homo Sapiens
PVEDHVHRP

SEQ ID NO: 957525 - protein, 9 aa, Homo Sapiens
PDKFIKDEQ

SEQ ID NO: 957526 - protein, 9 aa, Homo Sapiens
PSFTVTVPI

SEQ ID NO: 957527 - protein, 9 aa, Homo Sapiens
PFFFKNVIS

SEQ ID NO: 957528 - protein, 9 aa, Homo Sapiens
ERSEIYDAF

SEQ ID NO: 957529 - protein, 9 aa, Homo Sapiens
HFLQESLRL

SEQ ID NO: 957530 - protein, 9 aa, Homo Sapiens
HNNDYKAEI

SEQ ID NO: 957531 - protein, 9 aa, Homo Sapiens
VVELRVGER

SEQ ID NO: 957532 - protein, 9 aa, Homo Sapiens
DLIIYTLEN

SEQ ID NO: 957533 - protein, 9 aa, Homo Sapiens
GKTIISYKK

SEQ ID NO: 957534 - protein, 9 aa, Homo Sapiens
GKKHKKNAT

SEQ ID NO: 957535 - protein, 9 aa, Homo Sapiens
SPLVTEKGK

SEQ ID NO: 957536 - protein, 9 aa, Homo Sapiens
GALSQTSQN

SEQ ID NO: 957537 - protein, 9 aa, Homo Sapiens
MFQKLKWKW

SEQ ID NO: 957538 - protein, 9 aa, Homo Sapiens
PRKENGHRH

SEQ ID NO: 957539 - protein, 9 aa, Homo Sapiens
GDAGLNRER

SEQ ID NO: 957540 - protein, 9 aa, Homo Sapiens
RRACARQDN

SEQ ID NO: 957541 - protein, 9 aa, Homo Sapiens
KYLSNQELF

SEQ ID NO: 957542 - protein, 9 aa, Homo Sapiens
EMKEDGVRK

SEQ ID NO: 957543 - protein, 9 aa, Homo Sapiens
AGKILEIED

SEQ ID NO: 957544 - protein, 9 aa, Homo Sapiens
SEIFTYMRP

SEQ ID NO: 957545 - protein, 9 aa, Homo Sapiens
LHFDQVTKN

SEQ ID NO: 957546 - protein, 9 aa, Homo Sapiens
PTKKPTISM

SEQ ID NO: 957547 - protein, 9 aa, Homo Sapiens
LRSSECPRD

SEQ ID NO: 957548 - protein, 9 aa, Homo Sapiens
FENPLQFFC

SEQ ID NO: 957549 - protein, 9 aa, Homo Sapiens
IISYKKGAW

SEQ ID NO: 957550 - protein, 9 aa, Homo Sapiens
LAFNSNNDG

SEQ ID NO: 957551 - protein, 9 aa, Homo Sapiens
PLSEITKQE

SEQ ID NO: 957552 - protein, 9 aa, Homo Sapiens
KHRSKISVM

SEQ ID NO: 957553 - protein, 9 aa, Homo Sapiens
DFSVTVFEI

SEQ ID NO: 957554 - protein, 9 aa, Homo Sapiens
TWAPGLLIM

SEQ ID NO: 957555 - protein, 9 aa, Homo Sapiens
TRNKKKARG

SEQ ID NO: 957556 - protein, 9 aa, Homo Sapiens
GILETAGVS

SEQ ID NO: 957557 - protein, 9 aa, Homo Sapiens
DAGLNRERL

SEQ ID NO: 957558 - protein, 9 aa, Homo Sapiens
WSPLVTEKG

SEQ ID NO: 957559 - protein, 9 aa, Homo Sapiens
GLKGKAGAI

SEQ ID NO: 957560 - protein, 9 aa, Homo Sapiens
SSMLGEQCA

SEQ ID NO: 957561 - protein, 9 aa, Homo Sapiens
RRLFLFGAP

SEQ ID NO: 957562 - protein, 9 aa, Homo Sapiens
PSDGYCVDQ

SEQ ID NO: 957563 - protein, 9 aa, Homo Sapiens
GSRTLLLSL

SEQ ID NO: 957564 - protein, 9 aa, Homo Sapiens
DPDQPVLSL

SEQ ID NO: 957565 - protein, 9 aa, Homo Sapiens
LSATFLFSS

SEQ ID NO: 957566 - protein, 9 aa, Homo Sapiens
RPAKALRKA

SEQ ID NO: 957567 - protein, 9 aa, Homo Sapiens
SPTTASPVI

SEQ ID NO: 957568 - protein, 9 aa, Homo Sapiens
TGARKKEEG

SEQ ID NO: 957569 - protein, 9 aa, Homo Sapiens
FATGSYVSG

SEQ ID NO: 957570 - protein, 9 aa, Homo Sapiens
FPLRPFFCF

SEQ ID NO: 957571 - protein, 9 aa, Homo Sapiens
DTAFTRSSF

SEQ ID NO: 957572 - protein, 9 aa, Homo Sapiens
FQTLDTSQT

SEQ ID NO: 957573 - protein, 9 aa, Homo Sapiens
ALAASIPYF

SEQ ID NO: 957574 - protein, 9 aa, Homo Sapiens
RGELSARQL

SEQ ID NO: 957575 - protein, 9 aa, Homo Sapiens
LEGEDSAYS

SEQ ID NO: 957576 - protein, 9 aa, Homo Sapiens
STTKKVLLS

SEQ ID NO: 957577 - protein, 9 aa, Homo Sapiens
FKHTATGDT

SEQ ID NO: 957578 - protein, 9 aa, Homo Sapiens
GVQHTLADM

SEQ ID NO: 957579 - protein, 9 aa, Homo Sapiens
FPPALGPHF

SEQ ID NO: 957580 - protein, 9 aa, Homo Sapiens
QAKEQEDWK

SEQ ID NO: 957581 - protein, 9 aa, Homo Sapiens
TLYLFLTRF

SEQ ID NO: 957582 - protein, 9 aa, Homo Sapiens
DFATRDCYH

SEQ ID NO: 957583 - protein, 9 aa, Homo Sapiens
SILTNKVIG

SEQ ID NO: 957584 - protein, 9 aa, Homo Sapiens
VVAGNKLRI

SEQ ID NO: 957585 - protein, 9 aa, Homo Sapiens
LNQLTDALG

SEQ ID NO: 957586 - protein, 9 aa, Homo Sapiens
EIRGLFGTG

SEQ ID NO: 957587 - protein, 9 aa, Homo Sapiens
KNQSSDATP

SEQ ID NO: 957588 - protein, 9 aa, Homo Sapiens
EDGRMKFDK

SEQ ID NO: 957589 - protein, 9 aa, Homo Sapiens
LMDKDEKVR

SEQ ID NO: 957590 - protein, 9 aa, Homo Sapiens
APGDLSVTE

SEQ ID NO: 957591 - protein, 9 aa, Homo Sapiens
VVLKSHDCL

SEQ ID NO: 957592 - protein, 9 aa, Homo Sapiens
QFFCAELLV

SEQ ID NO: 957593 - protein, 9 aa, Homo Sapiens
YGESGAGKT

SEQ ID NO: 957594 - protein, 9 aa, Homo Sapiens
LHFQVTTYL

SEQ ID NO: 957595 - protein, 9 aa, Homo Sapiens
GSPKPRFLA

SEQ ID NO: 957596 - protein, 9 aa, Homo Sapiens
SPGVAALSI

SEQ ID NO: 957597 - protein, 9 aa, Homo Sapiens
YWSKSYSFL

SEQ ID NO: 957598 - protein, 9 aa, Homo Sapiens
ERDELPTQT

SEQ ID NO: 957599 - protein, 9 aa, Homo Sapiens
GKLQLQDVN

SEQ ID NO: 957600 - protein, 9 aa, Homo Sapiens
ILVAANKTD

SEQ ID NO: 957601 - protein, 9 aa, Homo Sapiens
SGGSLAALA

SEQ ID NO: 957602 - protein, 9 aa, Homo Sapiens
KGILKNVTE

SEQ ID NO: 957603 - protein, 9 aa, Homo Sapiens
AFQKMHYPD

SEQ ID NO: 957604 - protein, 9 aa, Homo Sapiens
DDSRAGVQR

SEQ ID NO: 957605 - protein, 9 aa, Homo Sapiens
EIFHRLYLS

SEQ ID NO: 957606 - protein, 9 aa, Homo Sapiens
SGSQFESSQ

SEQ ID NO: 957607 - protein, 9 aa, Homo Sapiens
FLLGLPPGK

SEQ ID NO: 957608 - protein, 9 aa, Homo Sapiens
IALAASIPY

SEQ ID NO: 957609 - protein, 9 aa, Homo Sapiens
SITYSWYDN

SEQ ID NO: 957610 - protein, 9 aa, Homo Sapiens
IYASHIVPH

SEQ ID NO: 957611 - protein, 9 aa, Homo Sapiens
EQKGLVYVA

SEQ ID NO: 957612 - protein, 9 aa, Homo Sapiens
YLSLALKVA

SEQ ID NO: 957613 - protein, 9 aa, Homo Sapiens
WPNSDPPFF

SEQ ID NO: 957614 - protein, 9 aa, Homo Sapiens
VEVGFDWSD

SEQ ID NO: 957615 - protein, 9 aa, Homo Sapiens
TVTLHFQVT

SEQ ID NO: 957616 - protein, 9 aa, Homo Sapiens
FLHTNAALE

SEQ ID NO: 957617 - protein, 9 aa, Homo Sapiens
TPEKEGGHR

SEQ ID NO: 957618 - protein, 9 aa, Homo Sapiens
LSLRAGHAD

SEQ ID NO: 957619 - protein, 9 aa, Homo Sapiens
SPDPDFSYA

SEQ ID NO: 957620 - protein, 9 aa, Homo Sapiens
LLSRQFLHT

SEQ ID NO: 957621 - protein, 9 aa, Homo Sapiens
HRSKISVMT

SEQ ID NO: 957622 - protein, 9 aa, Homo Sapiens
LREPNFVQA

SEQ ID NO: 957623 - protein, 9 aa, Homo Sapiens
DGSPKPRFL

SEQ ID NO: 957624 - protein, 9 aa, Homo Sapiens
QNKDKLEKQ

SEQ ID NO: 957625 - protein, 9 aa, Homo Sapiens
NPGIPNYGY

SEQ ID NO: 957626 - protein, 9 aa, Homo Sapiens
TVHQKNQSS

SEQ ID NO: 957627 - protein, 9 aa, Homo Sapiens
DCGMVPNTG

SEQ ID NO: 957628 - protein, 9 aa, Homo Sapiens
FFHSVCPAE

SEQ ID NO: 957629 - protein, 9 aa, Homo Sapiens
KFPSAQQMK

SEQ ID NO: 957630 - protein, 9 aa, Homo Sapiens
DFLNKLMGR

SEQ ID NO: 957631 - protein, 9 aa, Homo Sapiens
VCPAEMIVK

SEQ ID NO: 957632 - protein, 9 aa, Homo Sapiens
TFSPSFPLL

SEQ ID NO: 957633 - protein, 9 aa, Homo Sapiens
FYSASKKEQ

SEQ ID NO: 957634 - protein, 9 aa, Homo Sapiens
PVLSLDQMP

SEQ ID NO: 957635 - protein, 9 aa, Homo Sapiens
ENLDLAFNS

SEQ ID NO: 957636 - protein, 9 aa, Homo Sapiens
EKMKVLEDH

SEQ ID NO: 957637 - protein, 9 aa, Homo Sapiens
EVEVGFDWS

SEQ ID NO: 957638 - protein, 9 aa, Homo Sapiens
QLTTVDKET

SEQ ID NO: 957639 - protein, 9 aa, Homo Sapiens
LDKAFGPKL

SEQ ID NO: 957640 - protein, 9 aa, Homo Sapiens
LFPISGPVL

SEQ ID NO: 957641 - protein, 9 aa, Homo Sapiens
LYLSKAKMA

SEQ ID NO: 957642 - protein, 9 aa, Homo Sapiens
TGYSKGYGF

SEQ ID NO: 957643 - protein, 9 aa, Homo Sapiens
RLLKFFRLF

SEQ ID NO: 957644 - protein, 9 aa, Homo Sapiens
FPEHKEPRC

SEQ ID NO: 957645 - protein, 9 aa, Homo Sapiens
TPTKKVEKM

SEQ ID NO: 957646 - protein, 9 aa, Homo Sapiens
FTCAQTNGR

SEQ ID NO: 957647 - protein, 9 aa, Homo Sapiens
EMARALRSP

SEQ ID NO: 957648 - protein, 9 aa, Homo Sapiens
YGQLHETSS

SEQ ID NO: 957649 - protein, 9 aa, Homo Sapiens
SGMPIRIKN

SEQ ID NO: 957650 - protein, 9 aa, Homo Sapiens
LGEQCARIQ

SEQ ID NO: 957651 - protein, 9 aa, Homo Sapiens
LVRSSLITH

SEQ ID NO: 957652 - protein, 9 aa, Homo Sapiens
ALKHLRKKL

SEQ ID NO: 957653 - protein, 9 aa, Homo Sapiens
ACIPFGQGN

SEQ ID NO: 957654 - protein, 9 aa, Homo Sapiens
TEKAPKEKK

SEQ ID NO: 957655 - protein, 9 aa, Homo Sapiens
QTDFVLDYP

SEQ ID NO: 957656 - protein, 9 aa, Homo Sapiens
SNLSMAQRR

SEQ ID NO: 957657 - protein, 9 aa, Homo Sapiens
GDLSVTEPA

SEQ ID NO: 957658 - protein, 9 aa, Homo Sapiens
ISSRAGANW

SEQ ID NO: 957659 - protein, 9 aa, Homo Sapiens
CSIVIKMSK

SEQ ID NO: 957660 - protein, 9 aa, Homo Sapiens
SLRLSAQFE

SEQ ID NO: 957661 - protein, 9 aa, Homo Sapiens
GDRFISSRA

SEQ ID NO: 957662 - protein, 9 aa, Homo Sapiens
EDGPAFDST

SEQ ID NO: 957663 - protein, 9 aa, Homo Sapiens
EAHNNDYKA

SEQ ID NO: 957664 - protein, 9 aa, Homo Sapiens
LGINLFADG

SEQ ID NO: 957665 - protein, 9 aa, Homo Sapiens
VRKGDVLTI

SEQ ID NO: 957666 - protein, 9 aa, Homo Sapiens
LTIPVSISR

SEQ ID NO: 957667 - protein, 9 aa, Homo Sapiens
CLYIVQCFG

SEQ ID NO: 957668 - protein, 9 aa, Homo Sapiens
QKGELASTQ

SEQ ID NO: 957669 - protein, 9 aa, Homo Sapiens
KRWECNWPH

SEQ ID NO: 957670 - protein, 9 aa, Homo Sapiens
GQITMKKTP

SEQ ID NO: 957671 - protein, 9 aa, Homo Sapiens
TGSEDQAGG

SEQ ID NO: 957672 - protein, 9 aa, Homo Sapiens
RDPLDILTM

SEQ ID NO: 957673 - protein, 9 aa, Homo Sapiens
DASDPHPSL

SEQ ID NO: 957674 - protein, 9 aa, Homo Sapiens
YENQHKERT

SEQ ID NO: 957675 - protein, 9 aa, Homo Sapiens
PKVRFYFSV

SEQ ID NO: 957676 - protein, 9 aa, Homo Sapiens
TNPVTPLCT

SEQ ID NO: 957677 - protein, 9 aa, Homo Sapiens
EDQAGGEGK

SEQ ID NO: 957678 - protein, 9 aa, Homo Sapiens
KTIPELCQR

SEQ ID NO: 957679 - protein, 9 aa, Homo Sapiens
QRLCLEHEQ

SEQ ID NO: 957680 - protein, 9 aa, Homo Sapiens
IKRLSSLEA

SEQ ID NO: 957681 - protein, 9 aa, Homo Sapiens
KEMELVTQR

SEQ ID NO: 957682 - protein, 9 aa, Homo Sapiens
SEAARPEQD

SEQ ID NO: 957683 - protein, 9 aa, Homo Sapiens
ELSARQLLK

SEQ ID NO: 957684 - protein, 9 aa, Homo Sapiens
RLSLDRCKC

SEQ ID NO: 957685 - protein, 9 aa, Homo Sapiens
SFCKMSRLL

SEQ ID NO: 957686 - protein, 9 aa, Homo Sapiens
YGIYYEYTV

SEQ ID NO: 957687 - protein, 9 aa, Homo Sapiens
QIFESSSLP

SEQ ID NO: 957688 - protein, 9 aa, Homo Sapiens
QPIGMTYQF

SEQ ID NO: 957689 - protein, 9 aa, Homo Sapiens
EIFTYMRPN

SEQ ID NO: 957690 - protein, 9 aa, Homo Sapiens
ILERCVLYM

SEQ ID NO: 957691 - protein, 9 aa, Homo Sapiens
MSFINNPSF

SEQ ID NO: 957692 - protein, 9 aa, Homo Sapiens
GERRKTESN

SEQ ID NO: 957693 - protein, 9 aa, Homo Sapiens
VQSPERSRT

SEQ ID NO: 957694 - protein, 9 aa, Homo Sapiens
DQDYGIYYE

SEQ ID NO: 957695 - protein, 9 aa, Homo Sapiens
QFRLHLLDN

SEQ ID NO: 957696 - protein, 9 aa, Homo Sapiens
EDVWNIKQM

SEQ ID NO: 957697 - protein, 9 aa, Homo Sapiens
PAEMIVKFP

SEQ ID NO: 957698 - protein, 9 aa, Homo Sapiens
LGPHFGTPG

SEQ ID NO: 957699 - protein, 9 aa, Homo Sapiens
VSPTTASPV

SEQ ID NO: 957700 - protein, 9 aa, Homo Sapiens
GETKSIGEL

SEQ ID NO: 957701 - protein, 9 aa, Homo Sapiens
GQALKDEKE

SEQ ID NO: 957702 - protein, 9 aa, Homo Sapiens
FYDCNPEYF

SEQ ID NO: 957703 - protein, 9 aa, Homo Sapiens
YATIMNQPL

SEQ ID NO: 957704 - protein, 9 aa, Homo Sapiens
TEGVLLDNG

SEQ ID NO: 957705 - protein, 9 aa, Homo Sapiens
LIMTVVFWG

SEQ ID NO: 957706 - protein, 9 aa, Homo Sapiens
NITQYSLHC

SEQ ID NO: 957707 - protein, 9 aa, Homo Sapiens
KAQTTSSIS

SEQ ID NO: 957708 - protein, 9 aa, Homo Sapiens
GSEIFTYMR

SEQ ID NO: 957709 - protein, 9 aa, Homo Sapiens
DYKAEIKKL

SEQ ID NO: 957710 - protein, 9 aa, Homo Sapiens
GYGGTPEKE

SEQ ID NO: 957711 - protein, 9 aa, Homo Sapiens
AEHMLSSHH

SEQ ID NO: 957712 - protein, 9 aa, Homo Sapiens
QNLATGVGL

SEQ ID NO: 957713 - protein, 9 aa, Homo Sapiens
EKEEVEVGF

SEQ ID NO: 957714 - protein, 9 aa, Homo Sapiens
ITLRLWNIK

SEQ ID NO: 957715 - protein, 9 aa, Homo Sapiens
HTLADMIAK

SEQ ID NO: 957716 - protein, 9 aa, Homo Sapiens
NANFIPTVY

SEQ ID NO: 957717 - protein, 9 aa, Homo Sapiens
LPGFSILAT

SEQ ID NO: 957718 - protein, 9 aa, Homo Sapiens
CVFGCGILP

SEQ ID NO: 957719 - protein, 9 aa, Homo Sapiens
MEFPGSAPS

SEQ ID NO: 957720 - protein, 9 aa, Homo Sapiens
ISGILERCV

SEQ ID NO: 957721 - protein, 9 aa, Homo Sapiens
KKGIHCCTK

SEQ ID NO: 957722 - protein, 9 aa, Homo Sapiens
GALYEIRGL

SEQ ID NO: 957723 - protein, 9 aa, Homo Sapiens
LCGPKEPCV

SEQ ID NO: 957724 - protein, 9 aa, Homo Sapiens
GKCNPTQQK

SEQ ID NO: 957725 - protein, 9 aa, Homo Sapiens
DVLTIPVSI

SEQ ID NO: 957726 - protein, 9 aa, Homo Sapiens
SYLSQYFSP

SEQ ID NO: 957727 - protein, 9 aa, Homo Sapiens
QFPIDLNSK

SEQ ID NO: 957728 - protein, 9 aa, Homo Sapiens
VSELKRKLT

SEQ ID NO: 957729 - protein, 9 aa, Homo Sapiens
TCAQTNGRN

SEQ ID NO: 957730 - protein, 9 aa, Homo Sapiens
LQSYRSQPA

SEQ ID NO: 957731 - protein, 9 aa, Homo Sapiens
NSLIDGLTR

SEQ ID NO: 957732 - protein, 9 aa, Homo Sapiens
VSYLSQYFS

SEQ ID NO: 957733 - protein, 9 aa, Homo Sapiens
GMPIRIKNP

SEQ ID NO: 957734 - protein, 9 aa, Homo Sapiens
QTSQNFKHH

SEQ ID NO: 957735 - protein, 9 aa, Homo Sapiens
ENLTNKKKM

SEQ ID NO: 957736 - protein, 9 aa, Homo Sapiens
TLHFQVTTY

SEQ ID NO: 957737 - protein, 9 aa, Homo Sapiens
ETSGKLKVP

SEQ ID NO: 957738 - protein, 9 aa, Homo Sapiens
KTPTKKVEK

SEQ ID NO: 957739 - protein, 9 aa, Homo Sapiens
HLLSEEYEN

SEQ ID NO: 957740 - protein, 9 aa, Homo Sapiens
LTVGFKHTA

SEQ ID NO: 957741 - protein, 9 aa, Homo Sapiens
TASTTQKGE

SEQ ID NO: 957742 - protein, 9 aa, Homo Sapiens
TDVDRLKFN

SEQ ID NO: 957743 - protein, 9 aa, Homo Sapiens
ARQDNVFKK

SEQ ID NO: 957744 - protein, 9 aa, Homo Sapiens
SCLVPAAEP

SEQ ID NO: 957745 - protein, 9 aa, Homo Sapiens
IDGLTRNVK

SEQ ID NO: 957746 - protein, 9 aa, Homo Sapiens
LRKKLQSLR

SEQ ID NO: 957747 - protein, 9 aa, Homo Sapiens
RNYGAVEYQ

SEQ ID NO: 957748 - protein, 9 aa, Homo Sapiens
EENNGIKRQ

SEQ ID NO: 957749 - protein, 9 aa, Homo Sapiens
DCRSGIKIK

SEQ ID NO: 957750 - protein, 9 aa, Homo Sapiens
FINMFADTQ

SEQ ID NO: 957751 - protein, 9 aa, Homo Sapiens
CLLFLCCVS

SEQ ID NO: 957752 - protein, 9 aa, Homo Sapiens
NALSWGVKS

SEQ ID NO: 957753 - protein, 9 aa, Homo Sapiens
ASPGVAALS

SEQ ID NO: 957754 - protein, 9 aa, Homo Sapiens
NDCTNPVTP

SEQ ID NO: 957755 - protein, 9 aa, Homo Sapiens
LAYEKKCIS

SEQ ID NO: 957756 - protein, 9 aa, Homo Sapiens
GVKSLHIDD

SEQ ID NO: 957757 - protein, 9 aa, Homo Sapiens
VYKASDPHS

SEQ ID NO: 957758 - protein, 9 aa, Homo Sapiens
KHKRIHIEV

SEQ ID NO: 957759 - protein, 9 aa, Homo Sapiens
PNITQYSLH

SEQ ID NO: 957760 - protein, 9 aa, Homo Sapiens
LVPAAEPLP

SEQ ID NO: 957761 - protein, 9 aa, Homo Sapiens
YGTVYKASD

SEQ ID NO: 957762 - protein, 9 aa, Homo Sapiens
IVLKIYFEY

SEQ ID NO: 957763 - protein, 9 aa, Homo Sapiens
KKEASAETK

SEQ ID NO: 957764 - protein, 9 aa, Homo Sapiens
FKSISASFW

SEQ ID NO: 957765 - protein, 9 aa, Homo Sapiens
GHFLQESLR

SEQ ID NO: 957766 - protein, 9 aa, Homo Sapiens
SPGPRSSLD

SEQ ID NO: 957767 - protein, 9 aa, Homo Sapiens
MKAMISLLQ

SEQ ID NO: 957768 - protein, 9 aa, Homo Sapiens
TSCLVPAAE

SEQ ID NO: 957769 - protein, 9 aa, Homo Sapiens
EYENQHKER

SEQ ID NO: 957770 - protein, 9 aa, Homo Sapiens
DKLEKQPER

SEQ ID NO: 957771 - protein, 9 aa, Homo Sapiens
LNENQRNLS

SEQ ID NO: 957772 - protein, 9 aa, Homo Sapiens
GIYYEYTVP

SEQ ID NO: 957773 - protein, 9 aa, Homo Sapiens
VWSPLVTEK

SEQ ID NO: 957774 - protein, 9 aa, Homo Sapiens
IWLLQTDFV

SEQ ID NO: 957775 - protein, 9 aa, Homo Sapiens
ISTCKFYLF

SEQ ID NO: 957776 - protein, 9 aa, Homo Sapiens
WLNISGGDK

SEQ ID NO: 957777 - protein, 9 aa, Homo Sapiens
KFDKYIKRL

SEQ ID NO: 957778 - protein, 9 aa, Homo Sapiens
TCKFYLFFE

SEQ ID NO: 957779 - protein, 9 aa, Homo Sapiens
TSMAYDCYV

SEQ ID NO: 957780 - protein, 9 aa, Homo Sapiens
PGSQIEKTE

SEQ ID NO: 957781 - protein, 9 aa, Homo Sapiens
HKKNATRVA

SEQ ID NO: 957782 - protein, 9 aa, Homo Sapiens
VFIGNFAES

SEQ ID NO: 957783 - protein, 9 aa, Homo Sapiens
IFESSSLPE

SEQ ID NO: 957784 - protein, 9 aa, Homo Sapiens
MHRNLVTMV

SEQ ID NO: 957785 - protein, 9 aa, Homo Sapiens
LSSHHSSEM

SEQ ID NO: 957786 - protein, 9 aa, Homo Sapiens
PHRAQQQPQ

SEQ ID NO: 957787 - protein, 9 aa, Homo Sapiens
TKPAVGGTA

SEQ ID NO: 957788 - protein, 9 aa, Homo Sapiens
PVRNLRVKA

SEQ ID NO: 957789 - protein, 9 aa, Homo Sapiens
PIGMTYQFS

SEQ ID NO: 957790 - protein, 9 aa, Homo Sapiens
KNSKHQLLH

SEQ ID NO: 957791 - protein, 9 aa, Homo Sapiens
TSGKLKVPE

SEQ ID NO: 957792 - protein, 9 aa, Homo Sapiens
VGGTAPLPP

SEQ ID NO: 957793 - protein, 9 aa, Homo Sapiens
SPERSRTLH

SEQ ID NO: 957794 - protein, 9 aa, Homo Sapiens
EITKQEKDF

SEQ ID NO: 957795 - protein, 9 aa, Homo Sapiens
TIKFSEENN

SEQ ID NO: 957796 - protein, 9 aa, Homo Sapiens
FLSVCEMEG

SEQ ID NO: 957797 - protein, 9 aa, Homo Sapiens
SCRLCGGVT

SEQ ID NO: 957798 - protein, 9 aa, Homo Sapiens
FQKLKWKWK

SEQ ID NO: 957799 - protein, 9 aa, Homo Sapiens
DHGEWWKAK

SEQ ID NO: 957800 - protein, 9 aa, Homo Sapiens
GMFDFNYLH

SEQ ID NO: 957801 - protein, 9 aa, Homo Sapiens
ELTVTLNFI

SEQ ID NO: 957802 - protein, 9 aa, Homo Sapiens
FLYDLYVVC

SEQ ID NO: 957803 - protein, 9 aa, Homo Sapiens
AGVQRDEPE

SEQ ID NO: 957804 - protein, 9 aa, Homo Sapiens
KQEKDFLWS

SEQ ID NO: 957805 - protein, 9 aa, Homo Sapiens
RSKISVMTA

SEQ ID NO: 957806 - protein, 9 aa, Homo Sapiens
DKFIKDEQN

SEQ ID NO: 957807 - protein, 9 aa, Homo Sapiens
EHSPDKFIK

SEQ ID NO: 957808 - protein, 9 aa, Homo Sapiens
SDSFNFNSQ

SEQ ID NO: 957809 - protein, 9 aa, Homo Sapiens
SSGMPIRIK

SEQ ID NO: 957810 - protein, 9 aa, Homo Sapiens
ASTTQKGEL

SEQ ID NO: 957811 - protein, 9 aa, Homo Sapiens
AGELFQLET

SEQ ID NO: 957812 - protein, 9 aa, Homo Sapiens
KITLRLWNI

SEQ ID NO: 957813 - protein, 9 aa, Homo Sapiens
INNPSFTVT

SEQ ID NO: 957814 - protein, 9 aa, Homo Sapiens
KDGFSDLII

SEQ ID NO: 957815 - protein, 9 aa, Homo Sapiens
ASEAINFGS

SEQ ID NO: 957816 - protein, 9 aa, Homo Sapiens
EDRPPSPVS

SEQ ID NO: 957817 - protein, 9 aa, Homo Sapiens
LQDCGMVPN

SEQ ID NO: 957818 - protein, 9 aa, Homo Sapiens
PPTESACTA

SEQ ID NO: 957819 - protein, 9 aa, Homo Sapiens
ARALPGFSI

SEQ ID NO: 957820 - protein, 9 aa, Homo Sapiens
CVVETEAST

SEQ ID NO: 957821 - protein, 9 aa, Homo Sapiens
IFLTRHKRI

SEQ ID NO: 957822 - protein, 9 aa, Homo Sapiens
IMVFIGNFA

SEQ ID NO: 957823 - protein, 9 aa, Homo Sapiens
HSVETDTSG

SEQ ID NO: 957824 - protein, 9 aa, Homo Sapiens
ASPFWKASR

SEQ ID NO: 957825 - protein, 9 aa, Homo Sapiens
LMALSENAV

SEQ ID NO: 957826 - protein, 9 aa, Homo Sapiens
VRPGDCFGL

SEQ ID NO: 957827 - protein, 9 aa, Homo Sapiens
NLTNKKKMG

SEQ ID NO: 957828 - protein, 9 aa, Homo Sapiens
PARQGRKKA

SEQ ID NO: 957829 - protein, 9 aa, Homo Sapiens
PRFLASVIP

SEQ ID NO: 957830 - protein, 9 aa, Homo Sapiens
QGRVAVQNM

SEQ ID NO: 957831 - protein, 9 aa, Homo Sapiens
GSLFLSQWS

SEQ ID NO: 957832 - protein, 9 aa, Homo Sapiens
YFYENQHQV

SEQ ID NO: 957833 - protein, 9 aa, Homo Sapiens
VFLMALSEN

SEQ ID NO: 957834 - protein, 9 aa, Homo Sapiens
IVRQMMEMV

SEQ ID NO: 957835 - protein, 9 aa, Homo Sapiens
SGEKQYRCT

SEQ ID NO: 957836 - protein, 9 aa, Homo Sapiens
EDHGEWWKA

SEQ ID NO: 957837 - protein, 9 aa, Homo Sapiens
VTKNTTGKA

SEQ ID NO: 957838 - protein, 9 aa, Homo Sapiens
LKILDFGLV

SEQ ID NO: 957839 - protein, 9 aa, Homo Sapiens
LRFLDKILV

SEQ ID NO: 957840 - protein, 9 aa, Homo Sapiens
PNSDPPFFF

SEQ ID NO: 957841 - protein, 9 aa, Homo Sapiens
SVPSSFLPQ

SEQ ID NO: 957842 - protein, 9 aa, Homo Sapiens
TKYMKQQYE

SEQ ID NO: 957843 - protein, 9 aa, Homo Sapiens
KRMEAHNND

SEQ ID NO: 957844 - protein, 9 aa, Homo Sapiens
KKHKKNATR

SEQ ID NO: 957845 - protein, 9 aa, Homo Sapiens
TQKGELAST

SEQ ID NO: 957846 - protein, 9 aa, Homo Sapiens
GLSLRAGHA

SEQ ID NO: 957847 - protein, 9 aa, Homo Sapiens
AAEPLPDTA

SEQ ID NO: 957848 - protein, 9 aa, Homo Sapiens
GTQGSLENT

SEQ ID NO: 957849 - protein, 9 aa, Homo Sapiens
LRRACARQD

SEQ ID NO: 957850 - protein, 9 aa, Homo Sapiens
KSIGELMAI

SEQ ID NO: 957851 - protein, 9 aa, Homo Sapiens
RESPPQDKH

SEQ ID NO: 957852 - protein, 9 aa, Homo Sapiens
YVGFDAVTG

SEQ ID NO: 957853 - protein, 9 aa, Homo Sapiens
DLAFNSNND

SEQ ID NO: 957854 - protein, 9 aa, Homo Sapiens
DQPVLSLDQ

SEQ ID NO: 957855 - protein, 9 aa, Homo Sapiens
SASSDPLDI

SEQ ID NO: 957856 - protein, 9 aa, Homo Sapiens
EPPTMEVLS

SEQ ID NO: 957857 - protein, 9 aa, Homo Sapiens
EENKEMYHF

SEQ ID NO: 957858 - protein, 9 aa, Homo Sapiens
GMTYQFSEP

SEQ ID NO: 957859 - protein, 9 aa, Homo Sapiens
CKRLSLDRC

SEQ ID NO: 957860 - protein, 9 aa, Homo Sapiens
ISEETLFLP

SEQ ID NO: 957861 - protein, 9 aa, Homo Sapiens
NMGEQAKEQ

SEQ ID NO: 957862 - protein, 9 aa, Homo Sapiens
VLKLNATDQ

SEQ ID NO: 957863 - protein, 9 aa, Homo Sapiens
QSSMLGEQC

SEQ ID NO: 957864 - protein, 9 aa, Homo Sapiens
WKASRRALE

SEQ ID NO: 957865 - protein, 9 aa, Homo Sapiens
NAYIGTQGS

SEQ ID NO: 957866 - protein, 9 aa, Homo Sapiens
FVGLYTSLC

SEQ ID NO: 957867 - protein, 9 aa, Homo Sapiens
TLDGQITMK

SEQ ID NO: 957868 - protein, 9 aa, Homo Sapiens
PKGILKNVT

SEQ ID NO: 957869 - protein, 9 aa, Homo Sapiens
DQDEGVNGE

SEQ ID NO: 957870 - protein, 9 aa, Homo Sapiens
FSVTVFEII

SEQ ID NO: 957871 - protein, 9 aa, Homo Sapiens
VKCENPGIP

SEQ ID NO: 957872 - protein, 9 aa, Homo Sapiens
HFSGFCGLL

SEQ ID NO: 957873 - protein, 9 aa, Homo Sapiens
FSCRLCGGV

SEQ ID NO: 957874 - protein, 9 aa, Homo Sapiens
EPPKTDKSG

SEQ ID NO: 957875 - protein, 9 aa, Homo Sapiens
TDQDEGVNG

SEQ ID NO: 957876 - protein, 9 aa, Homo Sapiens
LIDGLTRNV

SEQ ID NO: 957877 - protein, 9 aa, Homo Sapiens
KEMYHFDAD

SEQ ID NO: 957878 - protein, 9 aa, Homo Sapiens
VTAILDSQF

SEQ ID NO: 957879 - protein, 9 aa, Homo Sapiens
SYEMKEDGV

SEQ ID NO: 957880 - protein, 9 aa, Homo Sapiens
GGTPEKEGG

SEQ ID NO: 957881 - protein, 9 aa, Homo Sapiens
NIILKGYKR

SEQ ID NO: 957882 - protein, 9 aa, Homo Sapiens
TCLLFLCCV

SEQ ID NO: 957883 - protein, 9 aa, Homo Sapiens
CAHEEFQQQ

SEQ ID NO: 957884 - protein, 9 aa, Homo Sapiens
SLHIDDIRY

SEQ ID NO: 957885 - protein, 9 aa, Homo Sapiens
SQPPPSQPA

SEQ ID NO: 957886 - protein, 9 aa, Homo Sapiens
IKDKMSRKV

SEQ ID NO: 957887 - protein, 9 aa, Homo Sapiens
NENQRNLSG

SEQ ID NO: 957888 - protein, 9 aa, Homo Sapiens
LRKESEMDF

SEQ ID NO: 957889 - protein, 9 aa, Homo Sapiens
RTILAVFGK

SEQ ID NO: 957890 - protein, 9 aa, Homo Sapiens
TAGVSLVSA

SEQ ID NO: 957891 - protein, 9 aa, Homo Sapiens
FSRISSQMW

SEQ ID NO: 957892 - protein, 9 aa, Homo Sapiens
VTQRNCSLT

SEQ ID NO: 957893 - protein, 9 aa, Homo Sapiens
LVLHGRMKE

SEQ ID NO: 957894 - protein, 9 aa, Homo Sapiens
TVGDAGLNR

SEQ ID NO: 957895 - protein, 9 aa, Homo Sapiens
LSLDQMPAR

SEQ ID NO: 957896 - protein, 9 aa, Homo Sapiens
VLFHRAWLW

SEQ ID NO: 957897 - protein, 9 aa, Homo Sapiens
EELCGPKEP

SEQ ID NO: 957898 - protein, 9 aa, Homo Sapiens
YDAFENIYP

SEQ ID NO: 957899 - protein, 9 aa, Homo Sapiens
GFQKFSSFL

SEQ ID NO: 957900 - protein, 9 aa, Homo Sapiens
ILAPLAPRS

SEQ ID NO: 957901 - protein, 9 aa, Homo Sapiens
NLSSECSAS

SEQ ID NO: 957902 - protein, 9 aa, Homo Sapiens
VFIQGWGLE

SEQ ID NO: 957903 - protein, 9 aa, Homo Sapiens
AVTYAAVKH

SEQ ID NO: 957904 - protein, 9 aa, Homo Sapiens
GELMAIQEK

SEQ ID NO: 957905 - protein, 9 aa, Homo Sapiens
LSQWSQSQK

SEQ ID NO: 957906 - protein, 9 aa, Homo Sapiens
SGFSQAASF

SEQ ID NO: 957907 - protein, 9 aa, Homo Sapiens
NPLQFFCAE

SEQ ID NO: 957908 - protein, 9 aa, Homo Sapiens
TAKKWDAVV

SEQ ID NO: 957909 - protein, 9 aa, Homo Sapiens
LVYSEVTGY

SEQ ID NO: 957910 - protein, 9 aa, Homo Sapiens
INVWKLSSS

SEQ ID NO: 957911 - protein, 9 aa, Homo Sapiens
PAKHPSLAT

SEQ ID NO: 957912 - protein, 9 aa, Homo Sapiens
WEGALYEIR

SEQ ID NO: 957913 - protein, 9 aa, Homo Sapiens
FDYLVLHGR

SEQ ID NO: 957914 - protein, 9 aa, Homo Sapiens
SKHILSFYS

SEQ ID NO: 957915 - protein, 9 aa, Homo Sapiens
DRPPSPVSS

SEQ ID NO: 957916 - protein, 9 aa, Homo Sapiens
QYSLHCKLL

SEQ ID NO: 957917 - protein, 9 aa, Homo Sapiens
LKEMTARMS

SEQ ID NO: 957918 - protein, 9 aa, Homo Sapiens
YSVVELRVG

SEQ ID NO: 957919 - protein, 9 aa, Homo Sapiens
QVGGNPKSH

SEQ ID NO: 957920 - protein, 9 aa, Homo Sapiens
SASFWWATI

SEQ ID NO: 957921 - protein, 9 aa, Homo Sapiens
DVDRLKFNK

SEQ ID NO: 957922 - protein, 9 aa, Homo Sapiens
GVSLVSANW

SEQ ID NO: 957923 - protein, 9 aa, Homo Sapiens
DPAIPEDVW

SEQ ID NO: 957924 - protein, 9 aa, Homo Sapiens
KILDFGLVR

SEQ ID NO: 957925 - protein, 9 aa, Homo Sapiens
HLLTPRIMH

SEQ ID NO: 957926 - protein, 9 aa, Homo Sapiens
VQTGNNGAI

SEQ ID NO: 957927 - protein, 9 aa, Homo Sapiens
ENPLQFFCA

SEQ ID NO: 957928 - protein, 9 aa, Homo Sapiens
NGELQDCGM

SEQ ID NO: 957929 - protein, 9 aa, Homo Sapiens
NATRVALLE

SEQ ID NO: 957930 - protein, 9 aa, Homo Sapiens
SFPPALGPH

SEQ ID NO: 957931 - protein, 9 aa, Homo Sapiens
MCQDCIHKK

SEQ ID NO: 957932 - protein, 9 aa, Homo Sapiens
VLLDNGSVV

SEQ ID NO: 957933 - protein, 9 aa, Homo Sapiens
DFLYDLYVV

SEQ ID NO: 957934 - protein, 9 aa, Homo Sapiens
VRVGGFDVF

SEQ ID NO: 957935 - protein, 9 aa, Homo Sapiens
KAFITLYSY

SEQ ID NO: 957936 - protein, 9 aa, Homo Sapiens
CLPQEMDSF

SEQ ID NO: 957937 - protein, 9 aa, Homo Sapiens
SSLLDYEGI

SEQ ID NO: 957938 - protein, 9 aa, Homo Sapiens
YQAYAGPIT

SEQ ID NO: 957939 - protein, 9 aa, Homo Sapiens
KHQKKGIHC

SEQ ID NO: 957940 - protein, 9 aa, Homo Sapiens
QDNVFKKFD

SEQ ID NO: 957941 - protein, 9 aa, Homo Sapiens
ADPDQPVLS

SEQ ID NO: 957942 - protein, 9 aa, Homo Sapiens
ILQEIQRLC

SEQ ID NO: 957943 - protein, 9 aa, Homo Sapiens
NLVNPCALD

SEQ ID NO: 957944 - protein, 9 aa, Homo Sapiens
SPDKFIKDE

SEQ ID NO: 957945 - protein, 9 aa, Homo Sapiens
FCVFLAFVI

SEQ ID NO: 957946 - protein, 9 aa, Homo Sapiens
FGPKLREEF

SEQ ID NO: 957947 - protein, 9 aa, Homo Sapiens
YAIARRPTV

SEQ ID NO: 957948 - protein, 9 aa, Homo Sapiens
PGQRTMYCR

SEQ ID NO: 957949 - protein, 9 aa, Homo Sapiens
LLSVKKNDA

SEQ ID NO: 957950 - protein, 9 aa, Homo Sapiens
NPEYFLFGS

SEQ ID NO: 957951 - protein, 9 aa, Homo Sapiens
GKSFYQSSS

SEQ ID NO: 957952 - protein, 9 aa, Homo Sapiens
MVHFSGFCG

SEQ ID NO: 957953 - protein, 9 aa, Homo Sapiens
AVIYMGSGE

SEQ ID NO: 957954 - protein, 9 aa, Homo Sapiens
DCTNPVTPL

SEQ ID NO: 957955 - protein, 9 aa, Homo Sapiens
PSICPPGSP

SEQ ID NO: 957956 - protein, 9 aa, Homo Sapiens
KLFSQIYSL

SEQ ID NO: 957957 - protein, 9 aa, Homo Sapiens
KGPEDASDP

SEQ ID NO: 957958 - protein, 9 aa, Homo Sapiens
QKGLVYVAC

SEQ ID NO: 957959 - protein, 9 aa, Homo Sapiens
DCGIPLCHL

SEQ ID NO: 957960 - protein, 9 aa, Homo Sapiens
RIHIEVRPY

SEQ ID NO: 957961 - protein, 9 aa, Homo Sapiens
ETEASTHSG

SEQ ID NO: 957962 - protein, 9 aa, Homo Sapiens
TIMNQPLCC

SEQ ID NO: 957963 - protein, 9 aa, Homo Sapiens
IMFQKLKWK

SEQ ID NO: 957964 - protein, 9 aa, Homo Sapiens
ELERAFQKM

SEQ ID NO: 957965 - protein, 9 aa, Homo Sapiens
SEAINFGSF

SEQ ID NO: 957966 - protein, 9 aa, Homo Sapiens
AVRPSLLRH

SEQ ID NO: 957967 - protein, 9 aa, Homo Sapiens
CWDQVDMEF

SEQ ID NO: 957968 - protein, 9 aa, Homo Sapiens
NHLCLHTGD

SEQ ID NO: 957969 - protein, 9 aa, Homo Sapiens
KPSWVILFV

SEQ ID NO: 957970 - protein, 9 aa, Homo Sapiens
CYHHSSLVN

SEQ ID NO: 957971 - protein, 9 aa, Homo Sapiens
TQGSLENTY

SEQ ID NO: 957972 - protein, 9 aa, Homo Sapiens
ASCTDVDRL

SEQ ID NO: 957973 - protein, 9 aa, Homo Sapiens
SEIYDAFEN

SEQ ID NO: 957974 - protein, 9 aa, Homo Sapiens
HWKDLEEYQ

SEQ ID NO: 957975 - protein, 9 aa, Homo Sapiens
DGYCVDQTS

SEQ ID NO: 957976 - protein, 9 aa, Homo Sapiens
RNLSGEKQY

SEQ ID NO: 957977 - protein, 9 aa, Homo Sapiens
ADTQLELPR

SEQ ID NO: 957978 - protein, 9 aa, Homo Sapiens
LFKRRQDRI

SEQ ID NO: 957979 - protein, 9 aa, Homo Sapiens
YQMHWKDLE

SEQ ID NO: 957980 - protein, 9 aa, Homo Sapiens
QSYRSQPAF

SEQ ID NO: 957981 - protein, 9 aa, Homo Sapiens
VHSSVANMQ

SEQ ID NO: 957982 - protein, 9 aa, Homo Sapiens
MFRFWVNTF

SEQ ID NO: 957983 - protein, 9 aa, Homo Sapiens
KVEAAEILE

SEQ ID NO: 957984 - protein, 9 aa, Homo Sapiens
ITGEGNMFT

SEQ ID NO: 957985 - protein, 9 aa, Homo Sapiens
NSDPPFFFK

SEQ ID NO: 957986 - protein, 9 aa, Homo Sapiens
LTFLWVNGE

SEQ ID NO: 957987 - protein, 9 aa, Homo Sapiens
TAGVCALFA

SEQ ID NO: 957988 - protein, 9 aa, Homo Sapiens
VKKNDAGSY

SEQ ID NO: 957989 - protein, 9 aa, Homo Sapiens
LIAGKILEI

SEQ ID NO: 957990 - protein, 9 aa, Homo Sapiens
NEINNAQVT

SEQ ID NO: 957991 - protein, 9 aa, Homo Sapiens
SQWSQSQKD

SEQ ID NO: 957992 - protein, 9 aa, Homo Sapiens
DPPFFFKNV

SEQ ID NO: 957993 - protein, 9 aa, Homo Sapiens
RRSPCMSLR

SEQ ID NO: 957994 - protein, 9 aa, Homo Sapiens
LLTSMAYDC

SEQ ID NO: 957995 - protein, 9 aa, Homo Sapiens
FCAELLVKD

SEQ ID NO: 957996 - protein, 9 aa, Homo Sapiens
PGFSILATG

SEQ ID NO: 957997 - protein, 9 aa, Homo Sapiens
SNGNCVSVG

SEQ ID NO: 957998 - protein, 9 aa, Homo Sapiens
LSSRRSGYA

SEQ ID NO: 957999 - protein, 9 aa, Homo Sapiens
LRAGHADLQ

SEQ ID NO: 958000 - protein, 9 aa, Homo Sapiens
KQILSATTV

SEQ ID NO: 958001 - protein, 9 aa, Homo Sapiens
VRTILAVFG

SEQ ID NO: 958002 - protein, 9 aa, Homo Sapiens
KFYLFFENS

SEQ ID NO: 958003 - protein, 9 aa, Homo Sapiens
NPVTPLCTQ

SEQ ID NO: 958004 - protein, 9 aa, Homo Sapiens
SKQILSATT

SEQ ID NO: 958005 - protein, 9 aa, Homo Sapiens
YFFYSLGAT

SEQ ID NO: 958006 - protein, 9 aa, Homo Sapiens
EVFVGLYTS

SEQ ID NO: 958007 - protein, 9 aa, Homo Sapiens
ALPKGILKN

SEQ ID NO: 958008 - protein, 9 aa, Homo Sapiens
GKDGSPKPR

SEQ ID NO: 958009 - protein, 9 aa, Homo Sapiens
FEKLDYGNL

SEQ ID NO: 958010 - protein, 9 aa, Homo Sapiens
PVSSFRVAW

SEQ ID NO: 958011 - protein, 9 aa, Homo Sapiens
DNLKCKSLR

SEQ ID NO: 958012 - protein, 9 aa, Homo Sapiens
ALVSYSVVE

SEQ ID NO: 958013 - protein, 9 aa, Homo Sapiens
VIYMGSGEG

SEQ ID NO: 958014 - protein, 9 aa, Homo Sapiens
PGTQVTRKK

SEQ ID NO: 958015 - protein, 9 aa, Homo Sapiens
LSLALKVAL

SEQ ID NO: 958016 - protein, 9 aa, Homo Sapiens
KVKAFITLY

SEQ ID NO: 958017 - protein, 9 aa, Homo Sapiens
EGERRKTES

SEQ ID NO: 958018 - protein, 9 aa, Homo Sapiens
DKTKNCGFA

SEQ ID NO: 958019 - protein, 9 aa, Homo Sapiens
APGLLIMTV

SEQ ID NO: 958020 - protein, 9 aa, Homo Sapiens
DNMGEQAKE

SEQ ID NO: 958021 - protein, 9 aa, Homo Sapiens
SAETKYMKQ

SEQ ID NO: 958022 - protein, 9 aa, Homo Sapiens
MKEDGVRKC

SEQ ID NO: 958023 - protein, 9 aa, Homo Sapiens
CADFKRTGI

SEQ ID NO: 958024 - protein, 9 aa, Homo Sapiens
FSSCSHQPQ

SEQ ID NO: 958025 - protein, 9 aa, Homo Sapiens
HFQVTTYLT

SEQ ID NO: 958026 - protein, 9 aa, Homo Sapiens
PISGPVLLL

SEQ ID NO: 958027 - protein, 9 aa, Homo Sapiens
KKLQSLRNR

SEQ ID NO: 958028 - protein, 9 aa, Homo Sapiens
EILEGEDSA

SEQ ID NO: 958029 - protein, 9 aa, Homo Sapiens
LWQIEEIHV

SEQ ID NO: 958030 - protein, 9 aa, Homo Sapiens
RMKFDKYIK

SEQ ID NO: 958031 - protein, 9 aa, Homo Sapiens
ETAFLLSSV

SEQ ID NO: 958032 - protein, 9 aa, Homo Sapiens
VNNVVNEIN

SEQ ID NO: 958033 - protein, 9 aa, Homo Sapiens
YIGTQGSLE

SEQ ID NO: 958034 - protein, 9 aa, Homo Sapiens
KIVLGQEQN

SEQ ID NO: 958035 - protein, 9 aa, Homo Sapiens
PADGSKEGS

SEQ ID NO: 958036 - protein, 9 aa, Homo Sapiens
TLRLWNIKD

SEQ ID NO: 958037 - protein, 9 aa, Homo Sapiens
GSTGARKKE

SEQ ID NO: 958038 - protein, 9 aa, Homo Sapiens
RVILAVIYM

SEQ ID NO: 958039 - protein, 9 aa, Homo Sapiens
EQDMVNGMM

SEQ ID NO: 958040 - protein, 9 aa, Homo Sapiens
FIQGKLQLQ

SEQ ID NO: 958041 - protein, 9 aa, Homo Sapiens
CLLQIYFFY

SEQ ID NO: 958042 - protein, 9 aa, Homo Sapiens
AVKTPTKKV

SEQ ID NO: 958043 - protein, 9 aa, Homo Sapiens
PKPRFLASV

SEQ ID NO: 958044 - protein, 9 aa, Homo Sapiens
FATRDCYHH

SEQ ID NO: 958045 - protein, 9 aa, Homo Sapiens
HSLVGVCSS

SEQ ID NO: 958046 - protein, 9 aa, Homo Sapiens
FECNDLGED

SEQ ID NO: 958047 - protein, 9 aa, Homo Sapiens
LTEDNSNLS

SEQ ID NO: 958048 - protein, 9 aa, Homo Sapiens
RALRSPGPR

SEQ ID NO: 958049 - protein, 9 aa, Homo Sapiens
NALVSYSVV

SEQ ID NO: 958050 - protein, 9 aa, Homo Sapiens
RRDQAVMIY

SEQ ID NO: 958051 - protein, 9 aa, Homo Sapiens
PEQDPPVAE

SEQ ID NO: 958052 - protein, 9 aa, Homo Sapiens
GLLIMTVVF

SEQ ID NO: 958053 - protein, 9 aa, Homo Sapiens
HWKTLDNLK

SEQ ID NO: 958054 - protein, 9 aa, Homo Sapiens
KKKCSIVIK

SEQ ID NO: 958055 - protein, 9 aa, Homo Sapiens
FRVKWLRRS

SEQ ID NO: 958056 - protein, 9 aa, Homo Sapiens
PGITEKAPK

SEQ ID NO: 958057 - protein, 9 aa, Homo Sapiens
NKFISSYHH

SEQ ID NO: 958058 - protein, 9 aa, Homo Sapiens
SRTSKLTLK

SEQ ID NO: 958059 - protein, 9 aa, Homo Sapiens
LTTPGQRTM

SEQ ID NO: 958060 - protein, 9 aa, Homo Sapiens
KEDGVRKCK

SEQ ID NO: 958061 - protein, 9 aa, Homo Sapiens
VKNLRMKKD

SEQ ID NO: 958062 - protein, 9 aa, Homo Sapiens
ALFEQKGLV

SEQ ID NO: 958063 - protein, 9 aa, Homo Sapiens
NGYAIARRP

SEQ ID NO: 958064 - protein, 9 aa, Homo Sapiens
IIDESLREQ

SEQ ID NO: 958065 - protein, 9 aa, Homo Sapiens
EYPGSRESP

SEQ ID NO: 958066 - protein, 9 aa, Homo Sapiens
LQNKFYLDQ

SEQ ID NO: 958067 - protein, 9 aa, Homo Sapiens
MEAHNNDYK

SEQ ID NO: 958068 - protein, 9 aa, Homo Sapiens
LTPRIMHSS

SEQ ID NO: 958069 - protein, 9 aa, Homo Sapiens
EMEGPCRSC

SEQ ID NO: 958070 - protein, 9 aa, Homo Sapiens
VASINDSEE

SEQ ID NO: 958071 - protein, 9 aa, Homo Sapiens
ASAETKYMK

SEQ ID NO: 958072 - protein, 9 aa, Homo Sapiens
LKHLRKKLQ

SEQ ID NO: 958073 - protein, 9 aa, Homo Sapiens
TAFTRSSFT

SEQ ID NO: 958074 - protein, 9 aa, Homo Sapiens
FGSSFSSDS

SEQ ID NO: 958075 - protein, 9 aa, Homo Sapiens
NLSGEKQYR

SEQ ID NO: 958076 - protein, 9 aa, Homo Sapiens
KCWQHSYKG

SEQ ID NO: 958077 - protein, 9 aa, Homo Sapiens
SPFWKASRR

SEQ ID NO: 958078 - protein, 9 aa, Homo Sapiens
CAQTNGRNG

SEQ ID NO: 958079 - protein, 9 aa, Homo Sapiens
DMHRNLVTM

SEQ ID NO: 958080 - protein, 9 aa, Homo Sapiens
SSGQKGHKG

SEQ ID NO: 958081 - protein, 9 aa, Homo Sapiens
KPGALRPCS

SEQ ID NO: 958082 - protein, 9 aa, Homo Sapiens
EGRPGLFWL

SEQ ID NO: 958083 - protein, 9 aa, Homo Sapiens
QDEGVNGEV

SEQ ID NO: 958084 - protein, 9 aa, Homo Sapiens
TVASINDSE

SEQ ID NO: 958085 - protein, 9 aa, Homo Sapiens
ALGTELLLL

SEQ ID NO: 958086 - protein, 9 aa, Homo Sapiens
FHCRALLSQ

SEQ ID NO: 958087 - protein, 9 aa, Homo Sapiens
SVANMQNMP

SEQ ID NO: 958088 - protein, 9 aa, Homo Sapiens
VTPLCTQPD

SEQ ID NO: 958089 - protein, 9 aa, Homo Sapiens
FPPSSFSFP

SEQ ID NO: 958090 - protein, 9 aa, Homo Sapiens
ALYEIRGLF

SEQ ID NO: 958091 - protein, 9 aa, Homo Sapiens
QDYGIYYEY

SEQ ID NO: 958092 - protein, 9 aa, Homo Sapiens
EEQVQSQIF

SEQ ID NO: 958093 - protein, 9 aa, Homo Sapiens
ALKLMSIPD

SEQ ID NO: 958094 - protein, 9 aa, Homo Sapiens
QALKDEKEL

SEQ ID NO: 958095 - protein, 9 aa, Homo Sapiens
EQVQSQIFE

SEQ ID NO: 958096 - protein, 9 aa, Homo Sapiens
DQIPIFEKL

SEQ ID NO: 958097 - protein, 9 aa, Homo Sapiens
STCKFYLFF

SEQ ID NO: 958098 - protein, 9 aa, Homo Sapiens
RERDELPTQ

SEQ ID NO: 958099 - protein, 9 aa, Homo Sapiens
ALITQGLYF

SEQ ID NO: 958100 - protein, 9 aa, Homo Sapiens
PEPVFRKLV

SEQ ID NO: 958101 - protein, 9 aa, Homo Sapiens
MNQPLCCIL

SEQ ID NO: 958102 - protein, 9 aa, Homo Sapiens
LAEYFYILD

SEQ ID NO: 958103 - protein, 9 aa, Homo Sapiens
APTTPVSPT

SEQ ID NO: 958104 - protein, 9 aa, Homo Sapiens
LLNSLGPSI

SEQ ID NO: 958105 - protein, 9 aa, Homo Sapiens
CYPPFLSFQ

SEQ ID NO: 958106 - protein, 9 aa, Homo Sapiens
LGLVVKIGD

SEQ ID NO: 958107 - protein, 9 aa, Homo Sapiens
HKFSAHRIA

SEQ ID NO: 958108 - protein, 9 aa, Homo Sapiens
SHEKNWSFY

SEQ ID NO: 958109 - protein, 9 aa, Homo Sapiens
YFHCRALLS

SEQ ID NO: 958110 - protein, 9 aa, Homo Sapiens
LMIQILAPL

SEQ ID NO: 958111 - protein, 9 aa, Homo Sapiens
SPKPRFLAS

SEQ ID NO: 958112 - protein, 9 aa, Homo Sapiens
DPLSEITKQ

SEQ ID NO: 958113 - protein, 9 aa, Homo Sapiens
QGRKKAAGK

SEQ ID NO: 958114 - protein, 9 aa, Homo Sapiens
YVTGRSDMQ

SEQ ID NO: 958115 - protein, 9 aa, Homo Sapiens
YSDFFQGER

SEQ ID NO: 958116 - protein, 9 aa, Homo Sapiens
TSIWLLQTD

SEQ ID NO: 958117 - protein, 9 aa, Homo Sapiens
EEIFCKVRF

SEQ ID NO: 958118 - protein, 9 aa, Homo Sapiens
TTQKGELAS

SEQ ID NO: 958119 - protein, 9 aa, Homo Sapiens
LGQEQNSYG

SEQ ID NO: 958120 - protein, 9 aa, Homo Sapiens
AFITLYSYS

SEQ ID NO: 958121 - protein, 9 aa, Homo Sapiens
LCLEHEQAS

SEQ ID NO: 958122 - protein, 9 aa, Homo Sapiens
QDCGMVPNT

SEQ ID NO: 958123 - protein, 9 aa, Homo Sapiens
ELQDCGMVP

SEQ ID NO: 958124 - protein, 9 aa, Homo Sapiens
SKEASQMDL

SEQ ID NO: 958125 - protein, 9 aa, Homo Sapiens
TVGFKHTAT

SEQ ID NO: 958126 - protein, 9 aa, Homo Sapiens
SWRRIPSKE

SEQ ID NO: 958127 - protein, 9 aa, Homo Sapiens
KRKLTKRDC

SEQ ID NO: 958128 - protein, 9 aa, Homo Sapiens
PGLKGKAGA

SEQ ID NO: 958129 - protein, 9 aa, Homo Sapiens
AQARSVRGR

SEQ ID NO: 958130 - protein, 9 aa, Homo Sapiens
RLELDIKIL

SEQ ID NO: 958131 - protein, 9 aa, Homo Sapiens
YSWYDNIIL

SEQ ID NO: 958132 - protein, 9 aa, Homo Sapiens
YLPGKQSLL

SEQ ID NO: 958133 - protein, 9 aa, Homo Sapiens
VILAVIYMG

SEQ ID NO: 958134 - protein, 9 aa, Homo Sapiens
FKRHHGFPF

SEQ ID NO: 958135 - protein, 9 aa, Homo Sapiens
NRDCGIPLC

SEQ ID NO: 958136 - protein, 9 aa, Homo Sapiens
VEAAEILEG

SEQ ID NO: 958137 - protein, 9 aa, Homo Sapiens
SPCMSLRSS

SEQ ID NO: 958138 - protein, 9 aa, Homo Sapiens
IYMGSGEGR

SEQ ID NO: 958139 - protein, 9 aa, Homo Sapiens
KEGSPLTSQ

SEQ ID NO: 958140 - protein, 9 aa, Homo Sapiens
IARRPTVGI

SEQ ID NO: 958141 - protein, 9 aa, Homo Sapiens
SEDQAGGEG

SEQ ID NO: 958142 - protein, 9 aa, Homo Sapiens
ALHHSVETD

SEQ ID NO: 958143 - protein, 9 aa, Homo Sapiens
FETFNTLAM

SEQ ID NO: 958144 - protein, 9 aa, Homo Sapiens
RDPLSEITK

SEQ ID NO: 958145 - protein, 9 aa, Homo Sapiens
MALSENAVL

SEQ ID NO: 958146 - protein, 9 aa, Homo Sapiens
KWKPRVSPP

SEQ ID NO: 958147 - protein, 9 aa, Homo Sapiens
PDPDFSYAL

SEQ ID NO: 958148 - protein, 9 aa, Homo Sapiens
GVQRDEPEP

SEQ ID NO: 958149 - protein, 9 aa, Homo Sapiens
QSSWPRTSR

SEQ ID NO: 958150 - protein, 9 aa, Homo Sapiens
CGIPLCHLQ

SEQ ID NO: 958151 - protein, 9 aa, Homo Sapiens
YHLLSEEYE

SEQ ID NO: 958152 - protein, 9 aa, Homo Sapiens
VLGLDVSYL

SEQ ID NO: 958153 - protein, 9 aa, Homo Sapiens
IILFIKTIF

SEQ ID NO: 958154 - protein, 9 aa, Homo Sapiens
STKWKPRVS

SEQ ID NO: 958155 - protein, 9 aa, Homo Sapiens
VSGGKDVRK

SEQ ID NO: 958156 - protein, 9 aa, Homo Sapiens
ERCVLYMSN

SEQ ID NO: 958157 - protein, 9 aa, Homo Sapiens
EVFDYLVLH

SEQ ID NO: 958158 - protein, 9 aa, Homo Sapiens
FSQAASFGK

SEQ ID NO: 958159 - protein, 9 aa, Homo Sapiens
ASHLLTPRI

SEQ ID NO: 958160 - protein, 9 aa, Homo Sapiens
EPRTPWVFS

SEQ ID NO: 958161 - protein, 9 aa, Homo Sapiens
VLADLDCAH

SEQ ID NO: 958162 - protein, 9 aa, Homo Sapiens
YKMAAELFR

SEQ ID NO: 958163 - protein, 9 aa, Homo Sapiens
MKKTPSYFV

SEQ ID NO: 958164 - protein, 9 aa, Homo Sapiens
PEPPKTDKS

SEQ ID NO: 958165 - protein, 9 aa, Homo Sapiens
MQNTLYLFL

SEQ ID NO: 958166 - protein, 9 aa, Homo Sapiens
LTVTLNFIN

SEQ ID NO: 958167 - protein, 9 aa, Homo Sapiens
KLYYPERLQ

SEQ ID NO: 958168 - protein, 9 aa, Homo Sapiens
FSSSISSQT

SEQ ID NO: 958169 - protein, 9 aa, Homo Sapiens
FFFKNVISL

SEQ ID NO: 958170 - protein, 9 aa, Homo Sapiens
EHTIYVGFD

SEQ ID NO: 958171 - protein, 9 aa, Homo Sapiens
QKLKWKWKL

SEQ ID NO: 958172 - protein, 9 aa, Homo Sapiens
GQGNFYYGN

SEQ ID NO: 958173 - protein, 9 aa, Homo Sapiens
NKFYLDQVA

SEQ ID NO: 958174 - protein, 9 aa, Homo Sapiens
ASGGSLAAL

SEQ ID NO: 958175 - protein, 9 aa, Homo Sapiens
ITFEKREEW

SEQ ID NO: 958176 - protein, 9 aa, Homo Sapiens
CISIEEQLQ

SEQ ID NO: 958177 - protein, 9 aa, Homo Sapiens
SFQTLDTSQ

SEQ ID NO: 958178 - protein, 9 aa, Homo Sapiens
LAELRNETV

SEQ ID NO: 958179 - protein, 9 aa, Homo Sapiens
QTARSASCL

SEQ ID NO: 958180 - protein, 9 aa, Homo Sapiens
CEMEGPCRS

SEQ ID NO: 958181 - protein, 9 aa, Homo Sapiens
KENLTNKKK

SEQ ID NO: 958182 - protein, 9 aa, Homo Sapiens
KGDVLTIPV

SEQ ID NO: 958183 - protein, 9 aa, Homo Sapiens
GNKLRIDVS

SEQ ID NO: 958184 - protein, 9 aa, Homo Sapiens
PGDCFGLLG

SEQ ID NO: 958185 - protein, 9 aa, Homo Sapiens
KHWKTLDNL

SEQ ID NO: 958186 - protein, 9 aa, Homo Sapiens
YFWSLRVID

SEQ ID NO: 958187 - protein, 9 aa, Homo Sapiens
AGGPASALT

SEQ ID NO: 958188 - protein, 9 aa, Homo Sapiens
MGPVSSRFS

SEQ ID NO: 958189 - protein, 9 aa, Homo Sapiens
PGSENLRKG

SEQ ID NO: 958190 - protein, 9 aa, Homo Sapiens
QMMEMVGMY

SEQ ID NO: 958191 - protein, 9 aa, Homo Sapiens
YERPNDDQD

SEQ ID NO: 958192 - protein, 9 aa, Homo Sapiens
KEFNEYQAY

SEQ ID NO: 958193 - protein, 9 aa, Homo Sapiens
FSSFLALSI

SEQ ID NO: 958194 - protein, 9 aa, Homo Sapiens
ILTMIFPNY

SEQ ID NO: 958195 - protein, 9 aa, Homo Sapiens
VGQGQSSWP

SEQ ID NO: 958196 - protein, 9 aa, Homo Sapiens
PLLSAANLV

SEQ ID NO: 958197 - protein, 9 aa, Homo Sapiens
DDTKFKSIS

SEQ ID NO: 958198 - protein, 9 aa, Homo Sapiens
FSRVSSLPK

SEQ ID NO: 958199 - protein, 9 aa, Homo Sapiens
PVEGSLEPQ

SEQ ID NO: 958200 - protein, 9 aa, Homo Sapiens
VTVHQKNQS

SEQ ID NO: 958201 - protein, 9 aa, Homo Sapiens
DSYEMKEDG

SEQ ID NO: 958202 - protein, 9 aa, Homo Sapiens
ALTTPGQRT

SEQ ID NO: 958203 - protein, 9 aa, Homo Sapiens
WSKSYSFLV

SEQ ID NO: 958204 - protein, 9 aa, Homo Sapiens
PPSQPARSA

SEQ ID NO: 958205 - protein, 9 aa, Homo Sapiens
SECSASSDP

SEQ ID NO: 958206 - protein, 9 aa, Homo Sapiens
PTESACTAD

SEQ ID NO: 958207 - protein, 9 aa, Homo Sapiens
ALVMGNELF

SEQ ID NO: 958208 - protein, 9 aa, Homo Sapiens
ARPEQDPPV

SEQ ID NO: 958209 - protein, 9 aa, Homo Sapiens
PSGATESLP

SEQ ID NO: 958210 - protein, 9 aa, Homo Sapiens
GDCFGLLGV

SEQ ID NO: 958211 - protein, 9 aa, Homo Sapiens
LLSEEYENQ

SEQ ID NO: 958212 - protein, 9 aa, Homo Sapiens
AAQEVHVDM

SEQ ID NO: 958213 - protein, 9 aa, Homo Sapiens
RKLWSLWRR

SEQ ID NO: 958214 - protein, 9 aa, Homo Sapiens
KGKRHPYKM

SEQ ID NO: 958215 - protein, 9 aa, Homo Sapiens
QEQSVAMNI

SEQ ID NO: 958216 - protein, 9 aa, Homo Sapiens
QRLEGERRK

SEQ ID NO: 958217 - protein, 9 aa, Homo Sapiens
MHWKDLEEY

SEQ ID NO: 958218 - protein, 9 aa, Homo Sapiens
PFVKKTSPP

SEQ ID NO: 958219 - protein, 9 aa, Homo Sapiens
YDNDCTNPV

SEQ ID NO: 958220 - protein, 9 aa, Homo Sapiens
MVHPKVRFY

SEQ ID NO: 958221 - protein, 9 aa, Homo Sapiens
KLDYGNLTL

SEQ ID NO: 958222 - protein, 9 aa, Homo Sapiens
RPRAQARSV

SEQ ID NO: 958223 - protein, 9 aa, Homo Sapiens
LALKVALMG

SEQ ID NO: 958224 - protein, 9 aa, Homo Sapiens
KFIKDEQNK

SEQ ID NO: 958225 - protein, 9 aa, Homo Sapiens
KISVMTATI

SEQ ID NO: 958226 - protein, 9 aa, Homo Sapiens
IDDFVKFLS

SEQ ID NO: 958227 - protein, 9 aa, Homo Sapiens
SKSSTKPAV

SEQ ID NO: 958228 - protein, 9 aa, Homo Sapiens
LSIQNELLP

SEQ ID NO: 958229 - protein, 9 aa, Homo Sapiens
FNEYQAYAG

SEQ ID NO: 958230 - protein, 9 aa, Homo Sapiens
KVRFYFSVK

SEQ ID NO: 958231 - protein, 9 aa, Homo Sapiens
TELLLLLTD

SEQ ID NO: 958232 - protein, 9 aa, Homo Sapiens
FSGFCGLLP

SEQ ID NO: 958233 - protein, 9 aa, Homo Sapiens
LDLQTVRTI

SEQ ID NO: 958234 - protein, 9 aa, Homo Sapiens
EDIKKAFSS

SEQ ID NO: 958235 - protein, 9 aa, Homo Sapiens
RDCGIPLCH

SEQ ID NO: 958236 - protein, 9 aa, Homo Sapiens
SDFFQGERT

SEQ ID NO: 958237 - protein, 9 aa, Homo Sapiens
HALGAFFLL

SEQ ID NO: 958238 - protein, 9 aa, Homo Sapiens
EYQAYAGPI

SEQ ID NO: 958239 - protein, 9 aa, Homo Sapiens
GQGQSSWPR

SEQ ID NO: 958240 - protein, 9 aa, Homo Sapiens
YFVSSNTEG

SEQ ID NO: 958241 - protein, 9 aa, Homo Sapiens
WNLQQKKNL

SEQ ID NO: 958242 - protein, 9 aa, Homo Sapiens
SVCEMEGPC

SEQ ID NO: 958243 - protein, 9 aa, Homo Sapiens
SVRQGCSRE

SEQ ID NO: 958244 - protein, 9 aa, Homo Sapiens
DCIHKKTCK

SEQ ID NO: 958245 - protein, 9 aa, Homo Sapiens
SLCRKPFLI

SEQ ID NO: 958246 - protein, 9 aa, Homo Sapiens
FNKFISSYH

SEQ ID NO: 958247 - protein, 9 aa, Homo Sapiens
VTRKKPGAL

SEQ ID NO: 958248 - protein, 9 aa, Homo Sapiens
GEKMKVLED

SEQ ID NO: 958249 - protein, 9 aa, Homo Sapiens
ETFQFIFKR

SEQ ID NO: 958250 - protein, 9 aa, Homo Sapiens
DSRAGVQRD

SEQ ID NO: 958251 - protein, 9 aa, Homo Sapiens
QIPPEDTAF

SEQ ID NO: 958252 - protein, 9 aa, Homo Sapiens
RFVGLRVLG

SEQ ID NO: 958253 - protein, 9 aa, Homo Sapiens
SGASTKWKP

SEQ ID NO: 958254 - protein, 9 aa, Homo Sapiens
WLNEKEEVE

SEQ ID NO: 958255 - protein, 9 aa, Homo Sapiens
TEGQSTCLL

SEQ ID NO: 958256 - protein, 9 aa, Homo Sapiens
PSALEPSMS

SEQ ID NO: 958257 - protein, 9 aa, Homo Sapiens
VGVRPGDCF

SEQ ID NO: 958258 - protein, 9 aa, Homo Sapiens
TAPGDLSVT

SEQ ID NO: 958259 - protein, 9 aa, Homo Sapiens
NGIKRQKKM

SEQ ID NO: 958260 - protein, 9 aa, Homo Sapiens
FSSDSFNFN

SEQ ID NO: 958261 - protein, 9 aa, Homo Sapiens
EDLSHALGA

SEQ ID NO: 958262 - protein, 9 aa, Homo Sapiens
REELCGPKE

SEQ ID NO: 958263 - protein, 9 aa, Homo Sapiens
RGLCTATTE

SEQ ID NO: 958264 - protein, 9 aa, Homo Sapiens
KLQSLRNRK

SEQ ID NO: 958265 - protein, 9 aa, Homo Sapiens
MLKKDKMFR

SEQ ID NO: 958266 - protein, 9 aa, Homo Sapiens
PALGPHFGT

SEQ ID NO: 958267 - protein, 9 aa, Homo Sapiens
VSLVSANWP

SEQ ID NO: 958268 - protein, 9 aa, Homo Sapiens
CQVGGNPKS

SEQ ID NO: 958269 - protein, 9 aa, Homo Sapiens
PKTYDPDFK

SEQ ID NO: 958270 - protein, 9 aa, Homo Sapiens
AETKYMKQQ

SEQ ID NO: 958271 - protein, 9 aa, Homo Sapiens
MPGTVMSSC

SEQ ID NO: 958272 - protein, 9 aa, Homo Sapiens
SRRPRTRRL

SEQ ID NO: 958273 - protein, 9 aa, Homo Sapiens
FLPQTPEQE

SEQ ID NO: 958274 - protein, 9 aa, Homo Sapiens
ATIMNQPLC

SEQ ID NO: 958275 - protein, 9 aa, Homo Sapiens
KTIFHPSEK

SEQ ID NO: 958276 - protein, 9 aa, Homo Sapiens
RIDVSITGE

SEQ ID NO: 958277 - protein, 9 aa, Homo Sapiens
TKKSQPPPS

SEQ ID NO: 958278 - protein, 9 aa, Homo Sapiens
SGPLFQKQA

SEQ ID NO: 958279 - protein, 9 aa, Homo Sapiens
DELPTQTSA

SEQ ID NO: 958280 - protein, 9 aa, Homo Sapiens
FVQCGTLLP

SEQ ID NO: 958281 - protein, 9 aa, Homo Sapiens
ANMQNMPAA

SEQ ID NO: 958282 - protein, 9 aa, Homo Sapiens
STCLLFLCC

SEQ ID NO: 958283 - protein, 9 aa, Homo Sapiens
RKENGHRHA

SEQ ID NO: 958284 - protein, 9 aa, Homo Sapiens
FDLVKCENP

SEQ ID NO: 958285 - protein, 9 aa, Homo Sapiens
GVGETGSED

SEQ ID NO: 958286 - protein, 9 aa, Homo Sapiens
FRKYHNANF

SEQ ID NO: 958287 - protein, 9 aa, Homo Sapiens
ILFVQCGTL

SEQ ID NO: 958288 - protein, 9 aa, Homo Sapiens
HMLPFWTNL

SEQ ID NO: 958289 - protein, 9 aa, Homo Sapiens
TKSIGELMA

SEQ ID NO: 958290 - protein, 9 aa, Homo Sapiens
VSYSVVELR

SEQ ID NO: 958291 - protein, 9 aa, Homo Sapiens
GILERCVLY

SEQ ID NO: 958292 - protein, 9 aa, Homo Sapiens
EHMLSSHHS

SEQ ID NO: 958293 - protein, 9 aa, Homo Sapiens
LYLFLTRFI

SEQ ID NO: 958294 - protein, 9 aa, Homo Sapiens
LCLHTGDRP

SEQ ID NO: 958295 - protein, 9 aa, Homo Sapiens
REQLTTVDK

SEQ ID NO: 958296 - protein, 9 aa, Homo Sapiens
RLWNIKDKM

SEQ ID NO: 958297 - protein, 9 aa, Homo Sapiens
SDDDILNES

SEQ ID NO: 958298 - protein, 9 aa, Homo Sapiens
DEGTSHEKN

SEQ ID NO: 958299 - protein, 9 aa, Homo Sapiens
QTGNNGAIN

SEQ ID NO: 958300 - protein, 9 aa, Homo Sapiens
QILSATTVR

SEQ ID NO: 958301 - protein, 9 aa, Homo Sapiens
EMIVKFPGT

SEQ ID NO: 958302 - protein, 9 aa, Homo Sapiens
LKMYSTYFK

SEQ ID NO: 958303 - protein, 9 aa, Homo Sapiens
SPSDFLNKL

SEQ ID NO: 958304 - protein, 9 aa, Homo Sapiens
DSQFRLHLL

SEQ ID NO: 958305 - protein, 9 aa, Homo Sapiens
LVGVCSSTG

SEQ ID NO: 958306 - protein, 9 aa, Homo Sapiens
DYKMAAELF

SEQ ID NO: 958307 - protein, 9 aa, Homo Sapiens
DIKKAFSSH

SEQ ID NO: 958308 - protein, 9 aa, Homo Sapiens
PPALGPHFG

SEQ ID NO: 958309 - protein, 9 aa, Homo Sapiens
SVAMNIRLR

SEQ ID NO: 958310 - protein, 9 aa, Homo Sapiens
TNKKKMGFQ

SEQ ID NO: 958311 - protein, 9 aa, Homo Sapiens
AGSLHSLVG

SEQ ID NO: 958312 - protein, 9 aa, Homo Sapiens
EEDGPAFDS

SEQ ID NO: 958313 - protein, 9 aa, Homo Sapiens
GSALGGVPP

SEQ ID NO: 958314 - protein, 9 aa, Homo Sapiens
RSSECPRDA

SEQ ID NO: 958315 - protein, 9 aa, Homo Sapiens
SPMAEHMLS

SEQ ID NO: 958316 - protein, 9 aa, Homo Sapiens
PGSPGPPGM

SEQ ID NO: 958317 - protein, 9 aa, Homo Sapiens
NTLYLFLTR

SEQ ID NO: 958318 - protein, 9 aa, Homo Sapiens
KNWSFYPNA

SEQ ID NO: 958319 - protein, 9 aa, Homo Sapiens
HHVPEPVFR

SEQ ID NO: 958320 - protein, 9 aa, Homo Sapiens
DRFISSRAG

SEQ ID NO: 958321 - protein, 9 aa, Homo Sapiens
AAGKSLASE

SEQ ID NO: 958322 - protein, 9 aa, Homo Sapiens
FHRAWLWQI

SEQ ID NO: 958323 - protein, 9 aa, Homo Sapiens
AWLWQIEEI

SEQ ID NO: 958324 - protein, 9 aa, Homo Sapiens
KRTGIDSNW

SEQ ID NO: 958325 - protein, 9 aa, Homo Sapiens
HHSVETDTS

SEQ ID NO: 958326 - protein, 9 aa, Homo Sapiens
SISASFWWA

SEQ ID NO: 958327 - protein, 9 aa, Homo Sapiens
PHHHVPEPV

SEQ ID NO: 958328 - protein, 9 aa, Homo Sapiens
HGPLMIQIL

SEQ ID NO: 958329 - protein, 9 aa, Homo Sapiens
AELPSRKCR

SEQ ID NO: 958330 - protein, 9 aa, Homo Sapiens
NATDQDEGV

SEQ ID NO: 958331 - protein, 9 aa, Homo Sapiens
EYFYILDVH

SEQ ID NO: 958332 - protein, 9 aa, Homo Sapiens
FPSAQQMKK

SEQ ID NO: 958333 - protein, 9 aa, Homo Sapiens
LAPVNTEGV

SEQ ID NO: 958334 - protein, 9 aa, Homo Sapiens
RTSEVHDGS

SEQ ID NO: 958335 - protein, 9 aa, Homo Sapiens
APAKHPSLA

SEQ ID NO: 958336 - protein, 9 aa, Homo Sapiens
LNATDQDEG

SEQ ID NO: 958337 - protein, 9 aa, Homo Sapiens
MWLNEKEEV

SEQ ID NO: 958338 - protein, 9 aa, Homo Sapiens
CNPEYFLFG

SEQ ID NO: 958339 - protein, 9 aa, Homo Sapiens
PLVTEKGKR

SEQ ID NO: 958340 - protein, 9 aa, Homo Sapiens
EDASDPHPS

SEQ ID NO: 958341 - protein, 9 aa, Homo Sapiens
PSWVILFVQ

SEQ ID NO: 958342 - protein, 9 aa, Homo Sapiens
RPEQDPPVA

SEQ ID NO: 958343 - protein, 9 aa, Homo Sapiens
VTGTPDSNN

SEQ ID NO: 958344 - protein, 9 aa, Homo Sapiens
GQRTMYCRH

SEQ ID NO: 958345 - protein, 9 aa, Homo Sapiens
IIHVSGGKD

SEQ ID NO: 958346 - protein, 9 aa, Homo Sapiens
SFYQSSSLL

SEQ ID NO: 958347 - protein, 9 aa, Homo Sapiens
TKNCGFAFV

SEQ ID NO: 958348 - protein, 9 aa, Homo Sapiens
PQFPIDLNS

SEQ ID NO: 958349 - protein, 9 aa, Homo Sapiens
GSLAALART

SEQ ID NO: 958350 - protein, 9 aa, Homo Sapiens
KKEEGGPVL

SEQ ID NO: 958351 - protein, 9 aa, Homo Sapiens
ADFKRTGID

SEQ ID NO: 958352 - protein, 9 aa, Homo Sapiens
PGDLSVTEP

SEQ ID NO: 958353 - protein, 9 aa, Homo Sapiens
GLNRERLCG

SEQ ID NO: 958354 - protein, 9 aa, Homo Sapiens
RNCSLTQIG

SEQ ID NO: 958355 - protein, 9 aa, Homo Sapiens
LPTQTSALN

SEQ ID NO: 958356 - protein, 9 aa, Homo Sapiens
DGSKEGSPL

SEQ ID NO: 958357 - protein, 9 aa, Homo Sapiens
ILETAGVSL

SEQ ID NO: 958358 - protein, 9 aa, Homo Sapiens
CQRCDTQNE

SEQ ID NO: 958359 - protein, 9 aa, Homo Sapiens
ADSYEMKED

SEQ ID NO: 958360 - protein, 9 aa, Homo Sapiens
SSSLQSYRS

SEQ ID NO: 958361 - protein, 9 aa, Homo Sapiens
GVLLDNGSV

SEQ ID NO: 958362 - protein, 9 aa, Homo Sapiens
RFISSRAGA

SEQ ID NO: 958363 - protein, 9 aa, Homo Sapiens
LCGGVTFKC

SEQ ID NO: 958364 - protein, 9 aa, Homo Sapiens
TRNCLVGLG

SEQ ID NO: 958365 - protein, 9 aa, Homo Sapiens
FKCWQHSYK

SEQ ID NO: 958366 - protein, 9 aa, Homo Sapiens
PAIPEDVWN

SEQ ID NO: 958367 - protein, 9 aa, Homo Sapiens
PVSPTTASP

SEQ ID NO: 958368 - protein, 9 aa, Homo Sapiens
EINNAQVTV

SEQ ID NO: 958369 - protein, 9 aa, Homo Sapiens
DYEGIKEFS

SEQ ID NO: 958370 - protein, 9 aa, Homo Sapiens
RFYFSVKVN

SEQ ID NO: 958371 - protein, 9 aa, Homo Sapiens
TMPGTVMSS

SEQ ID NO: 958372 - protein, 9 aa, Homo Sapiens
WKWKLSSFL

SEQ ID NO: 958373 - protein, 9 aa, Homo Sapiens
ETSSFKSSG

SEQ ID NO: 958374 - protein, 9 aa, Homo Sapiens
LQPIGMTYQ

SEQ ID NO: 958375 - protein, 9 aa, Homo Sapiens
AYIGTQGSL

SEQ ID NO: 958376 - protein, 9 aa, Homo Sapiens
QVGEAIQEK

SEQ ID NO: 958377 - protein, 9 aa, Homo Sapiens
SSCVFGCGI

SEQ ID NO: 958378 - protein, 9 aa, Homo Sapiens
TVDKETLQG

SEQ ID NO: 958379 - protein, 9 aa, Homo Sapiens
KFSSFLALS

SEQ ID NO: 958380 - protein, 9 aa, Homo Sapiens
FDQVTKNTT

SEQ ID NO: 958381 - protein, 9 aa, Homo Sapiens
RNGYAIARR

SEQ ID NO: 958382 - protein, 9 aa, Homo Sapiens
SLTQIGGLI

SEQ ID NO: 958383 - protein, 9 aa, Homo Sapiens
PTKKVEKMF

SEQ ID NO: 958384 - protein, 9 aa, Homo Sapiens
TICCQRNYG

SEQ ID NO: 958385 - protein, 9 aa, Homo Sapiens
KRRQDRIFP

SEQ ID NO: 958386 - protein, 9 aa, Homo Sapiens
KLRDTRLEK

SEQ ID NO: 958387 - protein, 9 aa, Homo Sapiens
QIAELPSRK

SEQ ID NO: 958388 - protein, 9 aa, Homo Sapiens
TRVALLEQL

SEQ ID NO: 958389 - protein, 9 aa, Homo Sapiens
SKWLREPNF

SEQ ID NO: 958390 - protein, 9 aa, Homo Sapiens
KSQPPPSQP

SEQ ID NO: 958391 - protein, 9 aa, Homo Sapiens
SRVSSLPKM

SEQ ID NO: 958392 - protein, 9 aa, Homo Sapiens
VHRPAKALR

SEQ ID NO: 958393 - protein, 9 aa, Homo Sapiens
SSKHILSFY

SEQ ID NO: 958394 - protein, 9 aa, Homo Sapiens
GKAFSHRIF

SEQ ID NO: 958395 - protein, 9 aa, Homo Sapiens
GPSVPSSFL

SEQ ID NO: 958396 - protein, 9 aa, Homo Sapiens
LSMTDSEED

SEQ ID NO: 958397 - protein, 9 aa, Homo Sapiens
RSEIYDAFE

SEQ ID NO: 958398 - protein, 9 aa, Homo Sapiens
HPAAPAPAK

SEQ ID NO: 958399 - protein, 9 aa, Homo Sapiens
QKKNLEVTI

SEQ ID NO: 958400 - protein, 9 aa, Homo Sapiens
LSPSGFSQA

SEQ ID NO: 958401 - protein, 9 aa, Homo Sapiens
EPSMSSSPR

SEQ ID NO: 958402 - protein, 9 aa, Homo Sapiens
ENGHRHALR

SEQ ID NO: 958403 - protein, 9 aa, Homo Sapiens
EFEKMLQVG

SEQ ID NO: 958404 - protein, 9 aa, Homo Sapiens
IPLCHLQVD

SEQ ID NO: 958405 - protein, 9 aa, Homo Sapiens
CKIIIHVSG

SEQ ID NO: 958406 - protein, 9 aa, Homo Sapiens
YPQNKDKLE

SEQ ID NO: 958407 - protein, 9 aa, Homo Sapiens
IVYVTGRSD

SEQ ID NO: 958408 - protein, 9 aa, Homo Sapiens
RNLVTMVEQ

SEQ ID NO: 958409 - protein, 9 aa, Homo Sapiens
KMKVLEDHG

SEQ ID NO: 958410 - protein, 9 aa, Homo Sapiens
AHNNDYKAE

SEQ ID NO: 958411 - protein, 9 aa, Homo Sapiens
MGEQAKEQE

SEQ ID NO: 958412 - protein, 9 aa, Homo Sapiens
EVRPLVSQT

SEQ ID NO: 958413 - protein, 9 aa, Homo Sapiens
QFIQGKLQL

SEQ ID NO: 958414 - protein, 9 aa, Homo Sapiens
LEGERRKTE

SEQ ID NO: 958415 - protein, 9 aa, Homo Sapiens
RKCRAGVVF

SEQ ID NO: 958416 - protein, 9 aa, Homo Sapiens
ALSENAVLI

SEQ ID NO: 958417 - protein, 9 aa, Homo Sapiens
EMPKKKREL

SEQ ID NO: 958418 - protein, 9 aa, Homo Sapiens
STYFKEFDK

SEQ ID NO: 958419 - protein, 9 aa, Homo Sapiens
KMAAELFRS

SEQ ID NO: 958420 - protein, 9 aa, Homo Sapiens
QPLCCILVA

SEQ ID NO: 958421 - protein, 9 aa, Homo Sapiens
ENVAKEVRP

SEQ ID NO: 958422 - protein, 9 aa, Homo Sapiens
DVFIQGWGL

SEQ ID NO: 958423 - protein, 9 aa, Homo Sapiens
KTKNCGFAF

SEQ ID NO: 958424 - protein, 9 aa, Homo Sapiens
TKWKPRVSP

SEQ ID NO: 958425 - protein, 9 aa, Homo Sapiens
KKPTISMEE

SEQ ID NO: 958426 - protein, 9 aa, Homo Sapiens
ELCGPKEPC

SEQ ID NO: 958427 - protein, 9 aa, Homo Sapiens
VNGKTIISY

SEQ ID NO: 958428 - protein, 9 aa, Homo Sapiens
SLSSCVFGC

SEQ ID NO: 958429 - protein, 9 aa, Homo Sapiens
LGAFFLLSW

SEQ ID NO: 958430 - protein, 9 aa, Homo Sapiens
QIEKTESSR

SEQ ID NO: 958431 - protein, 9 aa, Homo Sapiens
IPRPSVRQG

SEQ ID NO: 958432 - protein, 9 aa, Homo Sapiens
ATDSNGNCV

SEQ ID NO: 958433 - protein, 9 aa, Homo Sapiens
FDFNYLHTN

SEQ ID NO: 958434 - protein, 9 aa, Homo Sapiens
GKHRSKISV

SEQ ID NO: 958435 - protein, 9 aa, Homo Sapiens
WLWQIEEIH

SEQ ID NO: 958436 - protein, 9 aa, Homo Sapiens
IDLNSKMSS

SEQ ID NO: 958437 - protein, 9 aa, Homo Sapiens
EAVKQFRAR

SEQ ID NO: 958438 - protein, 9 aa, Homo Sapiens
GNNGAINPE

SEQ ID NO: 958439 - protein, 9 aa, Homo Sapiens
KRIKRLSSL

SEQ ID NO: 958440 - protein, 9 aa, Homo Sapiens
LQEQSVAMN

SEQ ID NO: 958441 - protein, 9 aa, Homo Sapiens
RAQARSVRG

SEQ ID NO: 958442 - protein, 9 aa, Homo Sapiens
AVQNMLAQE

SEQ ID NO: 958443 - protein, 9 aa, Homo Sapiens
GELQDCGMV

SEQ ID NO: 958444 - protein, 9 aa, Homo Sapiens
DSNGNCVSV

SEQ ID NO: 958445 - protein, 9 aa, Homo Sapiens
YPALKNSKH

SEQ ID NO: 958446 - protein, 9 aa, Homo Sapiens
NMHFSSSIS

SEQ ID NO: 958447 - protein, 9 aa, Homo Sapiens
HIEVRPYKC

SEQ ID NO: 958448 - protein, 9 aa, Homo Sapiens
SVGASCTDV

SEQ ID NO: 958449 - protein, 9 aa, Homo Sapiens
WLLQTDFVL

SEQ ID NO: 958450 - protein, 9 aa, Homo Sapiens
STGARKKEE

SEQ ID NO: 958451 - protein, 9 aa, Homo Sapiens
LCQRCDTQN

SEQ ID NO: 958452 - protein, 9 aa, Homo Sapiens
APVNTEGVL

SEQ ID NO: 958453 - protein, 9 aa, Homo Sapiens
SIPTKKPTI

SEQ ID NO: 958454 - protein, 9 aa, Homo Sapiens
TDKTKNCGF

SEQ ID NO: 958455 - protein, 9 aa, Homo Sapiens
RQQVSELKR

SEQ ID NO: 958456 - protein, 9 aa, Homo Sapiens
GNFYYGNLM

SEQ ID NO: 958457 - protein, 9 aa, Homo Sapiens
AILDSQFRL

SEQ ID NO: 958458 - protein, 9 aa, Homo Sapiens
LEVFVGLYT

SEQ ID NO: 958459 - protein, 9 aa, Homo Sapiens
ECNWPHSPN

SEQ ID NO: 958460 - protein, 9 aa, Homo Sapiens
PLFQKQAEF

SEQ ID NO: 958461 - protein, 9 aa, Homo Sapiens
FNSNNDGAD

SEQ ID NO: 958462 - protein, 9 aa, Homo Sapiens
ESACTADKP

SEQ ID NO: 958463 - protein, 9 aa, Homo Sapiens
RRKFMMQSR

SEQ ID NO: 958464 - protein, 9 aa, Homo Sapiens
FLTRHKRIH

SEQ ID NO: 958465 - protein, 9 aa, Homo Sapiens
LSSEFDSDN

SEQ ID NO: 958466 - protein, 9 aa, Homo Sapiens
KMTIMVFIG

SEQ ID NO: 958467 - protein, 9 aa, Homo Sapiens
RVKWLRRSR

SEQ ID NO: 958468 - protein, 9 aa, Homo Sapiens
DILNESSSP

SEQ ID NO: 958469 - protein, 9 aa, Homo Sapiens
SVCPAEMIV

SEQ ID NO: 958470 - protein, 9 aa, Homo Sapiens
GKQSLLAFA

SEQ ID NO: 958471 - protein, 9 aa, Homo Sapiens
IAELPSRKC

SEQ ID NO: 958472 - protein, 9 aa, Homo Sapiens
IVIKMSKFE

SEQ ID NO: 958473 - protein, 9 aa, Homo Sapiens
KNESVQNLP

SEQ ID NO: 958474 - protein, 9 aa, Homo Sapiens
MQTARSASC

SEQ ID NO: 958475 - protein, 9 aa, Homo Sapiens
RLKDKNESV

SEQ ID NO: 958476 - protein, 9 aa, Homo Sapiens
FKRWECNWP

SEQ ID NO: 958477 - protein, 9 aa, Homo Sapiens
YSLGATECY

SEQ ID NO: 958478 - protein, 9 aa, Homo Sapiens
LTCGKGRKD

SEQ ID NO: 958479 - protein, 9 aa, Homo Sapiens
ERREPHRAQ

SEQ ID NO: 958480 - protein, 9 aa, Homo Sapiens
YPPFLSFQC

SEQ ID NO: 958481 - protein, 9 aa, Homo Sapiens
PIRIKNPNQ

SEQ ID NO: 958482 - protein, 9 aa, Homo Sapiens
FWSLRVIDK

SEQ ID NO: 958483 - protein, 9 aa, Homo Sapiens
MTIMVFIGN

SEQ ID NO: 958484 - protein, 9 aa, Homo Sapiens
ARGELSARQ

SEQ ID NO: 958485 - protein, 9 aa, Homo Sapiens
VGFKHTATG

SEQ ID NO: 958486 - protein, 9 aa, Homo Sapiens
ALKDEKELE

SEQ ID NO: 958487 - protein, 9 aa, Homo Sapiens
RARPAGTGA

SEQ ID NO: 958488 - protein, 9 aa, Homo Sapiens
YRRTSEVHD

SEQ ID NO: 958489 - protein, 9 aa, Homo Sapiens
NKEMYHFDA

SEQ ID NO: 958490 - protein, 9 aa, Homo Sapiens
TQSLTRNKK

SEQ ID NO: 958491 - protein, 9 aa, Homo Sapiens
TGQCYEQFD

SEQ ID NO: 958492 - protein, 9 aa, Homo Sapiens
GFGSKDAVF

SEQ ID NO: 958493 - protein, 9 aa, Homo Sapiens
VLGQEQNSY

SEQ ID NO: 958494 - protein, 9 aa, Homo Sapiens
SPAGSLHSL

SEQ ID NO: 958495 - protein, 9 aa, Homo Sapiens
WTWAPGLLI

SEQ ID NO: 958496 - protein, 9 aa, Homo Sapiens
RAGHADLQV

SEQ ID NO: 958497 - protein, 9 aa, Homo Sapiens
ISGPVLLLL

SEQ ID NO: 958498 - protein, 9 aa, Homo Sapiens
IFGTFRSWF

SEQ ID NO: 958499 - protein, 9 aa, Homo Sapiens
CGMVPNTGQ

SEQ ID NO: 958500 - protein, 9 aa, Homo Sapiens
VLKSHDCLY

SEQ ID NO: 958501 - protein, 9 aa, Homo Sapiens
HSSVANMQN

SEQ ID NO: 958502 - protein, 9 aa, Homo Sapiens
CRSGIKIKL

SEQ ID NO: 958503 - protein, 9 aa, Homo Sapiens
ITMKKTPSY

SEQ ID NO: 958504 - protein, 9 aa, Homo Sapiens
MARALRSPG

SEQ ID NO: 958505 - protein, 9 aa, Homo Sapiens
MGNELFCSG

SEQ ID NO: 958506 - protein, 9 aa, Homo Sapiens
ITQGLYFHC

SEQ ID NO: 958507 - protein, 9 aa, Homo Sapiens
LLAVDSRTS

SEQ ID NO: 958508 - protein, 9 aa, Homo Sapiens
HGDRFISSR

SEQ ID NO: 958509 - protein, 9 aa, Homo Sapiens
TRNVKEKPR

SEQ ID NO: 958510 - protein, 9 aa, Homo Sapiens
GFSQAASFG

SEQ ID NO: 958511 - protein, 9 aa, Homo Sapiens
SWGVKSLHI

SEQ ID NO: 958512 - protein, 9 aa, Homo Sapiens
WSLWRRPFN

SEQ ID NO: 958513 - protein, 9 aa, Homo Sapiens
RRQDRIFPE

SEQ ID NO: 958514 - protein, 9 aa, Homo Sapiens
GNMFTPQMP

SEQ ID NO: 958515 - protein, 9 aa, Homo Sapiens
LQNLATGVG

SEQ ID NO: 958516 - protein, 9 aa, Homo Sapiens
SDMQKHRVV

SEQ ID NO: 958517 - protein, 9 aa, Homo Sapiens
CSASSDPLD

SEQ ID NO: 958518 - protein, 9 aa, Homo Sapiens
TSKLTLKNK

SEQ ID NO: 958519 - protein, 9 aa, Homo Sapiens
ENRKHIEFL

SEQ ID NO: 958520 - protein, 9 aa, Homo Sapiens
RHRFWLEEA

SEQ ID NO: 958521 - protein, 9 aa, Homo Sapiens
SVKATDSNG

SEQ ID NO: 958522 - protein, 9 aa, Homo Sapiens
RSDMQKHRV

SEQ ID NO: 958523 - protein, 9 aa, Homo Sapiens
TLPLAIFSR

SEQ ID NO: 958524 - protein, 9 aa, Homo Sapiens
KHKKNATRV

SEQ ID NO: 958525 - protein, 9 aa, Homo Sapiens
APPVEGSLE

SEQ ID NO: 958526 - protein, 9 aa, Homo Sapiens
QNHLAYEKK

SEQ ID NO: 958527 - protein, 9 aa, Homo Sapiens
QSTCLLFLC

SEQ ID NO: 958528 - protein, 9 aa, Homo Sapiens
AFDSTVESS

SEQ ID NO: 958529 - protein, 9 aa, Homo Sapiens
QKNQSSDAT

SEQ ID NO: 958530 - protein, 9 aa, Homo Sapiens
TASEAINFG

SEQ ID NO: 958531 - protein, 9 aa, Homo Sapiens
DKMFRFWVN

SEQ ID NO: 958532 - protein, 9 aa, Homo Sapiens
IQRLCLEHE

SEQ ID NO: 958533 - protein, 9 aa, Homo Sapiens
VCEMEGPCR

SEQ ID NO: 958534 - protein, 9 aa, Homo Sapiens
FFYSYFWSL

SEQ ID NO: 958535 - protein, 9 aa, Homo Sapiens
NPTQQKFCD

SEQ ID NO: 958536 - protein, 9 aa, Homo Sapiens
TLTCGKGRK

SEQ ID NO: 958537 - protein, 9 aa, Homo Sapiens
IYVGFDAVT

SEQ ID NO: 958538 - protein, 9 aa, Homo Sapiens
MSSSPRGST

SEQ ID NO: 958539 - protein, 9 aa, Homo Sapiens
LRNETVCAP

SEQ ID NO: 958540 - protein, 9 aa, Homo Sapiens
FEEDDYERP

SEQ ID NO: 958541 - protein, 9 aa, Homo Sapiens
GECGKSFYQ

SEQ ID NO: 958542 - protein, 9 aa, Homo Sapiens
IGQLLYISC

SEQ ID NO: 958543 - protein, 9 aa, Homo Sapiens
NPSFTVTVP

SEQ ID NO: 958544 - protein, 9 aa, Homo Sapiens
PRRSPCMSL

SEQ ID NO: 958545 - protein, 9 aa, Homo Sapiens
RKKEEGGPV

SEQ ID NO: 958546 - protein, 9 aa, Homo Sapiens
ELPTQTSAL

SEQ ID NO: 958547 - protein, 9 aa, Homo Sapiens
LHKLAELRN

SEQ ID NO: 958548 - protein, 9 aa, Homo Sapiens
RKIAVPPRL

SEQ ID NO: 958549 - protein, 9 aa, Homo Sapiens
KLQLQDVND

SEQ ID NO: 958550 - protein, 9 aa, Homo Sapiens
DIGERREPH

SEQ ID NO: 958551 - protein, 9 aa, Homo Sapiens
QKMHYPDVF

SEQ ID NO: 958552 - protein, 9 aa, Homo Sapiens
ETGSEDQAG

SEQ ID NO: 958553 - protein, 9 aa, Homo Sapiens
LITQGLYFH

SEQ ID NO: 958554 - protein, 9 aa, Homo Sapiens
LSTASTTQK

SEQ ID NO: 958555 - protein, 9 aa, Homo Sapiens
KDKLEKQPE

SEQ ID NO: 958556 - protein, 9 aa, Homo Sapiens
LVVAVAAVF

SEQ ID NO: 958557 - protein, 9 aa, Homo Sapiens
SVRGRGLLL

SEQ ID NO: 958558 - protein, 9 aa, Homo Sapiens
VYSEVTGYS

SEQ ID NO: 958559 - protein, 9 aa, Homo Sapiens
LNEKEEVEV

SEQ ID NO: 958560 - protein, 9 aa, Homo Sapiens
FLSQWSQSQ

SEQ ID NO: 958561 - protein, 9 aa, Homo Sapiens
DNSNLSMAQ

SEQ ID NO: 958562 - protein, 9 aa, Homo Sapiens
ILAVFGKGC

SEQ ID NO: 958563 - protein, 9 aa, Homo Sapiens
EPTLNQLTD

SEQ ID NO: 958564 - protein, 9 aa, Homo Sapiens
LPFWTNLCS

SEQ ID NO: 958565 - protein, 9 aa, Homo Sapiens
ALKNSKHQL

SEQ ID NO: 958566 - protein, 9 aa, Homo Sapiens
FESSQSGAA

SEQ ID NO: 958567 - protein, 9 aa, Homo Sapiens
YSEVTGYSK

SEQ ID NO: 958568 - protein, 9 aa, Homo Sapiens
HRNLVTMVE

SEQ ID NO: 958569 - protein, 9 aa, Homo Sapiens
CNWPHSPNG

SEQ ID NO: 958570 - protein, 9 aa, Homo Sapiens
FLFSSCSHQ

SEQ ID NO: 958571 - protein, 9 aa, Homo Sapiens
KDGSPKPRF

SEQ ID NO: 958572 - protein, 9 aa, Homo Sapiens
WQKFEDTCV

SEQ ID NO: 958573 - protein, 9 aa, Homo Sapiens
GADSYEMKE

SEQ ID NO: 958574 - protein, 9 aa, Homo Sapiens
GKVDDEESV

SEQ ID NO: 958575 - protein, 9 aa, Homo Sapiens
KPFLIGDKV

SEQ ID NO: 958576 - protein, 9 aa, Homo Sapiens
KFMMQSRLE

SEQ ID NO: 958577 - protein, 9 aa, Homo Sapiens
VAGNKLRID

SEQ ID NO: 958578 - protein, 9 aa, Homo Sapiens
GGPASALTP

SEQ ID NO: 958579 - protein, 9 aa, Homo Sapiens
KLWSLWRRP

SEQ ID NO: 958580 - protein, 9 aa, Homo Sapiens
NKVIGRTGL

SEQ ID NO: 958581 - protein, 9 aa, Homo Sapiens
LKFPSAQQM

SEQ ID NO: 958582 - protein, 9 aa, Homo Sapiens
EAELRHRFW

SEQ ID NO: 958583 - protein, 9 aa, Homo Sapiens
VHTGEKLYA

SEQ ID NO: 958584 - protein, 9 aa, Homo Sapiens
NKLMGRTSG

SEQ ID NO: 958585 - protein, 9 aa, Homo Sapiens
EVTVASIND

SEQ ID NO: 958586 - protein, 9 aa, Homo Sapiens
SCTDVDRLK

SEQ ID NO: 958587 - protein, 9 aa, Homo Sapiens
RGGRRLFLF

SEQ ID NO: 958588 - protein, 9 aa, Homo Sapiens
AEHYVVTCG

SEQ ID NO: 958589 - protein, 9 aa, Homo Sapiens
LNKLMGRTS

SEQ ID NO: 958590 - protein, 9 aa, Homo Sapiens
GTPDSNNVD

SEQ ID NO: 958591 - protein, 9 aa, Homo Sapiens
KHPSLATPP

SEQ ID NO: 958592 - protein, 9 aa, Homo Sapiens
HSPDKFIKD

SEQ ID NO: 958593 - protein, 9 aa, Homo Sapiens
GIDSNWWVL

SEQ ID NO: 958594 - protein, 9 aa, Homo Sapiens
LNSLGPSIF

SEQ ID NO: 958595 - protein, 9 aa, Homo Sapiens
KCENPGIPN

SEQ ID NO: 958596 - protein, 9 aa, Homo Sapiens
LFLCCVSCF

SEQ ID NO: 958597 - protein, 9 aa, Homo Sapiens
RMPFNKFIS

SEQ ID NO: 958598 - protein, 9 aa, Homo Sapiens
PPADGSKEG

SEQ ID NO: 958599 - protein, 9 aa, Homo Sapiens
EAARPEQDP

SEQ ID NO: 958600 - protein, 9 aa, Homo Sapiens
KKTSPPSSP

SEQ ID NO: 958601 - protein, 9 aa, Homo Sapiens
NCSLTQIGG

SEQ ID NO: 958602 - protein, 9 aa, Homo Sapiens
VNEINNAQV

SEQ ID NO: 958603 - protein, 9 aa, Homo Sapiens
WKDLEEYQA

SEQ ID NO: 958604 - protein, 9 aa, Homo Sapiens
EVHDGSLHK

SEQ ID NO: 958605 - protein, 9 aa, Homo Sapiens
RTLLLSLEG

SEQ ID NO: 958606 - protein, 9 aa, Homo Sapiens
ILSATTVRK

SEQ ID NO: 958607 - protein, 9 aa, Homo Sapiens
KLAELRNET

SEQ ID NO: 958608 - protein, 9 aa, Homo Sapiens
ETDTSGLRR

SEQ ID NO: 958609 - protein, 9 aa, Homo Sapiens
FLQESLRLS

SEQ ID NO: 958610 - protein, 9 aa, Homo Sapiens
STTQKGELA

SEQ ID NO: 958611 - protein, 9 aa, Homo Sapiens
DILTMIFPN

SEQ ID NO: 958612 - protein, 9 aa, Homo Sapiens
AREQRKRRK

SEQ ID NO: 958613 - protein, 9 aa, Homo Sapiens
SLVRNNPSF

SEQ ID NO: 958614 - protein, 9 aa, Homo Sapiens
LNNSVYWQK

SEQ ID NO: 958615 - protein, 9 aa, Homo Sapiens
KKVEKMFPH

SEQ ID NO: 958616 - protein, 9 aa, Homo Sapiens
LQEIQRLCL

SEQ ID NO: 958617 - protein, 9 aa, Homo Sapiens
SENAVLILL

SEQ ID NO: 958618 - protein, 9 aa, Homo Sapiens
AAIFGTFRS

SEQ ID NO: 958619 - protein, 9 aa, Homo Sapiens
GLMDKDEKV

SEQ ID NO: 958620 - protein, 9 aa, Homo Sapiens
DFKRTGIDS

SEQ ID NO: 958621 - protein, 9 aa, Homo Sapiens
RKHIEFLFQ

SEQ ID NO: 958622 - protein, 9 aa, Homo Sapiens
HADLQVRQD

SEQ ID NO: 958623 - protein, 9 aa, Homo Sapiens
KRIHIEVRP

SEQ ID NO: 958624 - protein, 9 aa, Homo Sapiens
WPSGATESL

SEQ ID NO: 958625 - protein, 9 aa, Homo Sapiens
CSRGRGLCT

SEQ ID NO: 958626 - protein, 9 aa, Homo Sapiens
EIFCKVRFS

SEQ ID NO: 958627 - protein, 9 aa, Homo Sapiens
LYSYSQLLM

SEQ ID NO: 958628 - protein, 9 aa, Homo Sapiens
VRQGCSREA

SEQ ID NO: 958629 - protein, 9 aa, Homo Sapiens
AKKWDAVVR

SEQ ID NO: 958630 - protein, 9 aa, Homo Sapiens
CESPDPDFS

SEQ ID NO: 958631 - protein, 9 aa, Homo Sapiens
LFWLNISGG

SEQ ID NO: 958632 - protein, 9 aa, Homo Sapiens
IYRRTSEVH

SEQ ID NO: 958633 - protein, 9 aa, Homo Sapiens
QAVMIYGES

SEQ ID NO: 958634 - protein, 9 aa, Homo Sapiens
SEEGLTFLW

SEQ ID NO: 958635 - protein, 9 aa, Homo Sapiens
QFESSQSGA

SEQ ID NO: 958636 - protein, 9 aa, Homo Sapiens
RCSAPPTES

SEQ ID NO: 958637 - protein, 9 aa, Homo Sapiens
PTLNQLTDA

SEQ ID NO: 958638 - protein, 9 aa, Homo Sapiens
NLRKGKDQM

SEQ ID NO: 958639 - protein, 9 aa, Homo Sapiens
LKLYYPERL

SEQ ID NO: 958640 - protein, 9 aa, Homo Sapiens
LEPNLLNSL

SEQ ID NO: 958641 - protein, 9 aa, Homo Sapiens
LRALPKGIL

SEQ ID NO: 958642 - protein, 9 aa, Homo Sapiens
QTWNLQQKK

SEQ ID NO: 958643 - protein, 9 aa, Homo Sapiens
NQSSDATPG

SEQ ID NO: 958644 - protein, 9 aa, Homo Sapiens
GSRESPPQD

SEQ ID NO: 958645 - protein, 9 aa, Homo Sapiens
LDGQITMKK

SEQ ID NO: 958646 - protein, 9 aa, Homo Sapiens
KKCSIVIKM

SEQ ID NO: 958647 - protein, 9 aa, Homo Sapiens
PAPPVEGSL

SEQ ID NO: 958648 - protein, 9 aa, Homo Sapiens
LSLLRSSEC

SEQ ID NO: 958649 - protein, 9 aa, Homo Sapiens
LDVSYLSQY

SEQ ID NO: 958650 - protein, 9 aa, Homo Sapiens
DPFECNDLG

SEQ ID NO: 958651 - protein, 9 aa, Homo Sapiens
VGASCTDVD

SEQ ID NO: 958652 - protein, 9 aa, Homo Sapiens
LCCVSCFWT

SEQ ID NO: 958653 - protein, 9 aa, Homo Sapiens
ALGPAAAAA

SEQ ID NO: 958654 - protein, 9 aa, Homo Sapiens
ASILTNKVI

SEQ ID NO: 958655 - protein, 9 aa, Homo Sapiens
VMSSCSPGN

SEQ ID NO: 958656 - protein, 9 aa, Homo Sapiens
SQALQHAFQ

SEQ ID NO: 958657 - protein, 9 aa, Homo Sapiens
EETAFLLSS

SEQ ID NO: 958658 - protein, 9 aa, Homo Sapiens
DPKTYDPDF

SEQ ID NO: 958659 - protein, 9 aa, Homo Sapiens
MFTPQMPCS

SEQ ID NO: 958660 - protein, 9 aa, Homo Sapiens
SLDQMPARS

SEQ ID NO: 958661 - protein, 9 aa, Homo Sapiens
VAVQNMLAQ

SEQ ID NO: 958662 - protein, 9 aa, Homo Sapiens
GIIDESLRE

SEQ ID NO: 958663 - protein, 9 aa, Homo Sapiens
RKRIKRLSS

SEQ ID NO: 958664 - protein, 9 aa, Homo Sapiens
RQDRIFPEG

SEQ ID NO: 958665 - protein, 9 aa, Homo Sapiens
LCDPWNWLD

SEQ ID NO: 958666 - protein, 9 aa, Homo Sapiens
FGAPRFRHR

SEQ ID NO: 958667 - protein, 9 aa, Homo Sapiens
NGKTIISYK

SEQ ID NO: 958668 - protein, 9 aa, Homo Sapiens
NDLGEDCTR

SEQ ID NO: 958669 - protein, 9 aa, Homo Sapiens
IPSKEASQM

SEQ ID NO: 958670 - protein, 9 aa, Homo Sapiens
IKHKRIHIE

SEQ ID NO: 958671 - protein, 9 aa, Homo Sapiens
PAVGGTAPL

SEQ ID NO: 958672 - protein, 9 aa, Homo Sapiens
PTQTSALNR

SEQ ID NO: 958673 - protein, 9 aa, Homo Sapiens
LLIMTVVFW

SEQ ID NO: 958674 - protein, 9 aa, Homo Sapiens
MAEHMLSSH

SEQ ID NO: 958675 - protein, 9 aa, Homo Sapiens
GPLFQKQAE

SEQ ID NO: 958676 - protein, 9 aa, Homo Sapiens
GEVFDYLVL

SEQ ID NO: 958677 - protein, 9 aa, Homo Sapiens
LIIYTLENI

SEQ ID NO: 958678 - protein, 9 aa, Homo Sapiens
SSFSSDSFN

SEQ ID NO: 958679 - protein, 9 aa, Homo Sapiens
DTKFKSISA

SEQ ID NO: 958680 - protein, 9 aa, Homo Sapiens
GFDVFIQGW

SEQ ID NO: 958681 - protein, 9 aa, Homo Sapiens
SALTPGHPA

SEQ ID NO: 958682 - protein, 9 aa, Homo Sapiens
HCCTKCRLQ

SEQ ID NO: 958683 - protein, 9 aa, Homo Sapiens
SKTKILINI

SEQ ID NO: 958684 - protein, 9 aa, Homo Sapiens
TCGKGRKDF

SEQ ID NO: 958685 - protein, 9 aa, Homo Sapiens
LMQKMTIMV

SEQ ID NO: 958686 - protein, 9 aa, Homo Sapiens
EKEEAPNPL

SEQ ID NO: 958687 - protein, 9 aa, Homo Sapiens
ACVVETEAS

SEQ ID NO: 958688 - protein, 9 aa, Homo Sapiens
LFSSCSHQP

SEQ ID NO: 958689 - protein, 9 aa, Homo Sapiens
SCSGPLFQK

SEQ ID NO: 958690 - protein, 9 aa, Homo Sapiens
IGMTYQFSE

SEQ ID NO: 958691 - protein, 9 aa, Homo Sapiens
FIKTIFHPS

SEQ ID NO: 958692 - protein, 9 aa, Homo Sapiens
AVASPGVAA

SEQ ID NO: 958693 - protein, 9 aa, Homo Sapiens
RNHPEPTLN

SEQ ID NO: 958694 - protein, 9 aa, Homo Sapiens
NDYKAEIKK

SEQ ID NO: 958695 - protein, 9 aa, Homo Sapiens
NHPEPTLNQ

SEQ ID NO: 958696 - protein, 9 aa, Homo Sapiens
SSLQSYRSQ

SEQ ID NO: 958697 - protein, 9 aa, Homo Sapiens
ATFLFSSCS

SEQ ID NO: 958698 - protein, 9 aa, Homo Sapiens
QEIQRLCLE

SEQ ID NO: 958699 - protein, 9 aa, Homo Sapiens
DLQNLATGV

SEQ ID NO: 958700 - protein, 9 aa, Homo Sapiens
LYVVCNHHG

SEQ ID NO: 958701 - protein, 9 aa, Homo Sapiens
NSEEGLTFL

SEQ ID NO: 958702 - protein, 9 aa, Homo Sapiens
AMSLSSTPQ

SEQ ID NO: 958703 - protein, 9 aa, Homo Sapiens
NTEGQSTCL

SEQ ID NO: 958704 - protein, 9 aa, Homo Sapiens
SYRNGYAIA

SEQ ID NO: 958705 - protein, 9 aa, Homo Sapiens
RDCYHHSSL

SEQ ID NO: 958706 - protein, 9 aa, Homo Sapiens
LCRKPFLIG

SEQ ID NO: 958707 - protein, 9 aa, Homo Sapiens
IVPHERIHT

SEQ ID NO: 958708 - protein, 9 aa, Homo Sapiens
GNPKSHVYW

SEQ ID NO: 958709 - protein, 9 aa, Homo Sapiens
GTPEKEGGH

SEQ ID NO: 958710 - protein, 9 aa, Homo Sapiens
NGNCVSVGI

SEQ ID NO: 958711 - protein, 9 aa, Homo Sapiens
EKLDYGNLT

SEQ ID NO: 958712 - protein, 9 aa, Homo Sapiens
ELDIKILMT

SEQ ID NO: 958713 - protein, 9 aa, Homo Sapiens
IMFETFNTL

SEQ ID NO: 958714 - protein, 9 aa, Homo Sapiens
KASDPHSGH

SEQ ID NO: 958715 - protein, 9 aa, Homo Sapiens
TARSASCLS

SEQ ID NO: 958716 - protein, 9 aa, Homo Sapiens
TESLPRPLC

SEQ ID NO: 958717 - protein, 9 aa, Homo Sapiens
RPAGTGAGC

SEQ ID NO: 958718 - protein, 9 aa, Homo Sapiens
GNKLRDTRL

SEQ ID NO: 958719 - protein, 9 aa, Homo Sapiens
IFEKLDYGN

SEQ ID NO: 958720 - protein, 9 aa, Homo Sapiens
RKKPGALRP

SEQ ID NO: 958721 - protein, 9 aa, Homo Sapiens
EKKDGFSDL

SEQ ID NO: 958722 - protein, 9 aa, Homo Sapiens
GSQIEKTES

SEQ ID NO: 958723 - protein, 9 aa, Homo Sapiens
PDFSYALTP

SEQ ID NO: 958724 - protein, 9 aa, Homo Sapiens
IPPEDTAFT

SEQ ID NO: 958725 - protein, 9 aa, Homo Sapiens
TASPRKENG

SEQ ID NO: 958726 - protein, 9 aa, Homo Sapiens
GVRPGDCFG

SEQ ID NO: 958727 - protein, 9 aa, Homo Sapiens
EKVLDLDDF

SEQ ID NO: 958728 - protein, 9 aa, Homo Sapiens
TMEVLSMTD

SEQ ID NO: 958729 - protein, 9 aa, Homo Sapiens
KAFSHRIFL

SEQ ID NO: 958730 - protein, 9 aa, Homo Sapiens
QFISQLQNK

SEQ ID NO: 958731 - protein, 9 aa, Homo Sapiens
LKDKNESVQ

SEQ ID NO: 958732 - protein, 9 aa, Homo Sapiens
VLQPIGMTY

SEQ ID NO: 958733 - protein, 9 aa, Homo Sapiens
IEKTESSRR

SEQ ID NO: 958734 - protein, 9 aa, Homo Sapiens
EDHVHRPAK

SEQ ID NO: 958735 - protein, 9 aa, Homo Sapiens
KHILSFYSA

SEQ ID NO: 958736 - protein, 9 aa, Homo Sapiens
KEPCVLPFQ

SEQ ID NO: 958737 - protein, 9 aa, Homo Sapiens
SAGKHRSKI

SEQ ID NO: 958738 - protein, 9 aa, Homo Sapiens
TNLCSIFGS

SEQ ID NO: 958739 - protein, 9 aa, Homo Sapiens
VAVRPSLLR

SEQ ID NO: 958740 - protein, 9 aa, Homo Sapiens
HAFQASGQP

SEQ ID NO: 958741 - protein, 9 aa, Homo Sapiens
FYLFFENSI

SEQ ID NO: 958742 - protein, 9 aa, Homo Sapiens
PGKQSLLAF

SEQ ID NO: 958743 - protein, 9 aa, Homo Sapiens
TAILDSQFR

SEQ ID NO: 958744 - protein, 9 aa, Homo Sapiens
CGLLPRVPW

SEQ ID NO: 958745 - protein, 9 aa, Homo Sapiens
CGFAFVEYE

SEQ ID NO: 958746 - protein, 9 aa, Homo Sapiens
CVGVRPGDC

SEQ ID NO: 958747 - protein, 9 aa, Homo Sapiens
AIILFIKTI

SEQ ID NO: 958748 - protein, 9 aa, Homo Sapiens
DKILVAANK

SEQ ID NO: 958749 - protein, 9 aa, Homo Sapiens
YASHIVPHE

SEQ ID NO: 958750 - protein, 9 aa, Homo Sapiens
ATFSPSFPL

SEQ ID NO: 958751 - protein, 9 aa, Homo Sapiens
ESVQNLPIQ

SEQ ID NO: 958752 - protein, 9 aa, Homo Sapiens
RNCLVGLGL

SEQ ID NO: 958753 - protein, 9 aa, Homo Sapiens
LGPAAAAAP

SEQ ID NO: 958754 - protein, 9 aa, Homo Sapiens
SQNFKHHSF

SEQ ID NO: 958755 - protein, 9 aa, Homo Sapiens
TVFEIIIRY

SEQ ID NO: 958756 - protein, 9 aa, Homo Sapiens
IEDMAVLGG

SEQ ID NO: 958757 - protein, 9 aa, Homo Sapiens
FFRLFEFFD

SEQ ID NO: 958758 - protein, 9 aa, Homo Sapiens
ELFCWQIWK

SEQ ID NO: 958759 - protein, 9 aa, Homo Sapiens
PESDIDDFV

SEQ ID NO: 958760 - protein, 9 aa, Homo Sapiens
RNKKKARGN

SEQ ID NO: 958761 - protein, 9 aa, Homo Sapiens
CARIQSVKT

SEQ ID NO: 958762 - protein, 9 aa, Homo Sapiens
WPRTSRPRG

SEQ ID NO: 958763 - protein, 9 aa, Homo Sapiens
RRTSEVHDG

SEQ ID NO: 958764 - protein, 9 aa, Homo Sapiens
YLVLHGRMK

SEQ ID NO: 958765 - protein, 9 aa, Homo Sapiens
IYGESGAGK

SEQ ID NO: 958766 - protein, 9 aa, Homo Sapiens
GHRHALRLL

SEQ ID NO: 958767 - protein, 9 aa, Homo Sapiens
DCKRLSLDR

SEQ ID NO: 958768 - protein, 9 aa, Homo Sapiens
FSQALQHAF

SEQ ID NO: 958769 - protein, 9 aa, Homo Sapiens
MHGPLMIQI

SEQ ID NO: 958770 - protein, 9 aa, Homo Sapiens
TQVTRKKPG

SEQ ID NO: 958771 - protein, 9 aa, Homo Sapiens
SNQELFCWQ

SEQ ID NO: 958772 - protein, 9 aa, Homo Sapiens
YEIRGLFGT

SEQ ID NO: 958773 - protein, 9 aa, Homo Sapiens
EECGKAFLV

SEQ ID NO: 958774 - protein, 9 aa, Homo Sapiens
VPTAMSLSS

SEQ ID NO: 958775 - protein, 9 aa, Homo Sapiens
KCRAGVVFM

SEQ ID NO: 958776 - protein, 9 aa, Homo Sapiens
SLLSPSGFS

SEQ ID NO: 958777 - protein, 9 aa, Homo Sapiens
FLSFQCLQG

SEQ ID NO: 958778 - protein, 9 aa, Homo Sapiens
PEDASDPHP

SEQ ID NO: 958779 - protein, 9 aa, Homo Sapiens
NFSQPVAVR

SEQ ID NO: 958780 - protein, 9 aa, Homo Sapiens
RKPFLIGDK

SEQ ID NO: 958781 - protein, 9 aa, Homo Sapiens
TIFHPSEKI

SEQ ID NO: 958782 - protein, 9 aa, Homo Sapiens
VQHTLADMI

SEQ ID NO: 958783 - protein, 9 aa, Homo Sapiens
VSCFWTRAV

SEQ ID NO: 958784 - protein, 9 aa, Homo Sapiens
LAVIYMGSG

SEQ ID NO: 958785 - protein, 9 aa, Homo Sapiens
SFRVKWLRR

SEQ ID NO: 958786 - protein, 9 aa, Homo Sapiens
LVSYSVVEL

SEQ ID NO: 958787 - protein, 9 aa, Homo Sapiens
AKEQEDWKK

SEQ ID NO: 958788 - protein, 9 aa, Homo Sapiens
ILEIEDMAV

SEQ ID NO: 958789 - protein, 9 aa, Homo Sapiens
EIEDMAVLG

SEQ ID NO: 958790 - protein, 9 aa, Homo Sapiens
QARSVRGRG

SEQ ID NO: 958791 - protein, 9 aa, Homo Sapiens
RFLASVIPV

SEQ ID NO: 958792 - protein, 9 aa, Homo Sapiens
KLYACGDCG

SEQ ID NO: 958793 - protein, 9 aa, Homo Sapiens
EFPGSAPSG

SEQ ID NO: 958794 - protein, 9 aa, Homo Sapiens
DFEHTIYVG

SEQ ID NO: 958795 - protein, 9 aa, Homo Sapiens
VLEDHGEWW

SEQ ID NO: 958796 - protein, 9 aa, Homo Sapiens
NMFADTQLE

SEQ ID NO: 958797 - protein, 9 aa, Homo Sapiens
KTKILINIS

SEQ ID NO: 958798 - protein, 9 aa, Homo Sapiens
RTGIDSNWW

SEQ ID NO: 958799 - protein, 9 aa, Homo Sapiens
GVTAEHYVV

SEQ ID NO: 958800 - protein, 9 aa, Homo Sapiens
ESLRLSAQF

SEQ ID NO: 958801 - protein, 9 aa, Homo Sapiens
WWPSGATES

SEQ ID NO: 958802 - protein, 9 aa, Homo Sapiens
DRPREDIKG

SEQ ID NO: 958803 - protein, 9 aa, Homo Sapiens
INDSEELLA

SEQ ID NO: 958804 - protein, 9 aa, Homo Sapiens
LETAGVSLV

SEQ ID NO: 958805 - protein, 9 aa, Homo Sapiens
DQVTKNTTG

SEQ ID NO: 958806 - protein, 9 aa, Homo Sapiens
RMKKDREIC

SEQ ID NO: 958807 - protein, 9 aa, Homo Sapiens
WVILFVQCG

SEQ ID NO: 958808 - protein, 9 aa, Homo Sapiens
KASRRALER

SEQ ID NO: 958809 - protein, 9 aa, Homo Sapiens
EKMLQVGNL

SEQ ID NO: 958810 - protein, 9 aa, Homo Sapiens
GIHCCTKCR

SEQ ID NO: 958811 - protein, 9 aa, Homo Sapiens
KERSEIYDA

SEQ ID NO: 958812 - protein, 9 aa, Homo Sapiens
LAVDSRTSK

SEQ ID NO: 958813 - protein, 9 aa, Homo Sapiens
RALPGFSIL

SEQ ID NO: 958814 - protein, 9 aa, Homo Sapiens
ICPPGSPGP

SEQ ID NO: 958815 - protein, 9 aa, Homo Sapiens
FEHTIYVGF

SEQ ID NO: 958816 - protein, 9 aa, Homo Sapiens
VFRKLVEDA

SEQ ID NO: 958817 - protein, 9 aa, Homo Sapiens
KCKIIIHVS

SEQ ID NO: 958818 - protein, 9 aa, Homo Sapiens
EEDFGDPKT

SEQ ID NO: 958819 - protein, 9 aa, Homo Sapiens
LKKDKMFRF

SEQ ID NO: 958820 - protein, 9 aa, Homo Sapiens
NKDKLEKQP

SEQ ID NO: 958821 - protein, 9 aa, Homo Sapiens
SGDVAQQLW

SEQ ID NO: 958822 - protein, 9 aa, Homo Sapiens
KFYLDQVAL

SEQ ID NO: 958823 - protein, 9 aa, Homo Sapiens
DAVEIIRKI

SEQ ID NO: 958824 - protein, 9 aa, Homo Sapiens
AQRPPAPPV

SEQ ID NO: 958825 - protein, 9 aa, Homo Sapiens
MSLSSTPQS

SEQ ID NO: 958826 - protein, 9 aa, Homo Sapiens
RPNDDQDGE

SEQ ID NO: 958827 - protein, 9 aa, Homo Sapiens
LLERKLWSL

SEQ ID NO: 958828 - protein, 9 aa, Homo Sapiens
PRTPWVFSR

SEQ ID NO: 958829 - protein, 9 aa, Homo Sapiens
SALEVFVGL

SEQ ID NO: 958830 - protein, 9 aa, Homo Sapiens
KAMISLLQI

SEQ ID NO: 958831 - protein, 9 aa, Homo Sapiens
YLFLTRFIG

SEQ ID NO: 958832 - protein, 9 aa, Homo Sapiens
VDCKRLSLD

SEQ ID NO: 958833 - protein, 9 aa, Homo Sapiens
LYLPGKQSL

SEQ ID NO: 958834 - protein, 9 aa, Homo Sapiens
EYCEQYVSS

SEQ ID NO: 958835 - protein, 9 aa, Homo Sapiens
SRLELDIKI

SEQ ID NO: 958836 - protein, 9 aa, Homo Sapiens
NGMMLSVEK

SEQ ID NO: 958837 - protein, 9 aa, Homo Sapiens
EIQRLCLEH

SEQ ID NO: 958838 - protein, 9 aa, Homo Sapiens
KEEGGPVLV

SEQ ID NO: 958839 - protein, 9 aa, Homo Sapiens
ESDIDDFVK

SEQ ID NO: 958840 - protein, 9 aa, Homo Sapiens
YASILTNKV

SEQ ID NO: 958841 - protein, 9 aa, Homo Sapiens
FVNNVVNEI

SEQ ID NO: 958842 - protein, 9 aa, Homo Sapiens
QITMKKTPS

SEQ ID NO: 958843 - protein, 9 aa, Homo Sapiens
DVWNIKQMI

SEQ ID NO: 958844 - protein, 9 aa, Homo Sapiens
LRLSAQFEN

SEQ ID NO: 958845 - protein, 9 aa, Homo Sapiens
LVNPCALDF

SEQ ID NO: 958846 - protein, 9 aa, Homo Sapiens
VHQKNQSSD

SEQ ID NO: 958847 - protein, 9 aa, Homo Sapiens
LSQTSQNFK

SEQ ID NO: 958848 - protein, 9 aa, Homo Sapiens
EMVGMYSLD

SEQ ID NO: 958849 - protein, 9 aa, Homo Sapiens
RQDNVFKKF

SEQ ID NO: 958850 - protein, 9 aa, Homo Sapiens
GTVMSSCSP

SEQ ID NO: 958851 - protein, 9 aa, Homo Sapiens
HSTMPGTVM

SEQ ID NO: 958852 - protein, 9 aa, Homo Sapiens
KMGFQQFLL

SEQ ID NO: 958853 - protein, 9 aa, Homo Sapiens
RPREDIKGV

SEQ ID NO: 958854 - protein, 9 aa, Homo Sapiens
EKREEWLTT

SEQ ID NO: 958855 - protein, 9 aa, Homo Sapiens
HEQDMVNGM

SEQ ID NO: 958856 - protein, 9 aa, Homo Sapiens
LREQLTTVD

SEQ ID NO: 958857 - protein, 9 aa, Homo Sapiens
CALDFHAET

SEQ ID NO: 958858 - protein, 9 aa, Homo Sapiens
EDDYERPND

SEQ ID NO: 958859 - protein, 9 aa, Homo Sapiens
PFWKASRRA

SEQ ID NO: 958860 - protein, 9 aa, Homo Sapiens
GRPGLFWLN

SEQ ID NO: 958861 - protein, 9 aa, Homo Sapiens
GQLLYISCV

SEQ ID NO: 958862 - protein, 9 aa, Homo Sapiens
FISQLQNKF

SEQ ID NO: 958863 - protein, 9 aa, Homo Sapiens
DLGEDCTRS

SEQ ID NO: 958864 - protein, 9 aa, Homo Sapiens
QVTICCQRN

SEQ ID NO: 958865 - protein, 9 aa, Homo Sapiens
SSWPRTSRP

SEQ ID NO: 958866 - protein, 9 aa, Homo Sapiens
QFRARPAGT

SEQ ID NO: 958867 - protein, 9 aa, Homo Sapiens
MDSFQTLDT

SEQ ID NO: 958868 - protein, 9 aa, Homo Sapiens
QPVLSLDQM

SEQ ID NO: 958869 - protein, 9 aa, Homo Sapiens
AQQMKKAFS

SEQ ID NO: 958870 - protein, 9 aa, Homo Sapiens
RPPAPPVEG

SEQ ID NO: 958871 - protein, 9 aa, Homo Sapiens
TDKSGAAPP

SEQ ID NO: 958872 - protein, 9 aa, Homo Sapiens
SSFSFPLRP

SEQ ID NO: 958873 - protein, 9 aa, Homo Sapiens
RRPRTRRLS

SEQ ID NO: 958874 - protein, 9 aa, Homo Sapiens
SCVVSSGDM

SEQ ID NO: 958875 - protein, 9 aa, Homo Sapiens
GLFWLNISG

SEQ ID NO: 958876 - protein, 9 aa, Homo Sapiens
SLRAGHADL

SEQ ID NO: 958877 - protein, 9 aa, Homo Sapiens
YSLHCKLLI

SEQ ID NO: 958878 - protein, 9 aa, Homo Sapiens
LYFHCRALL

SEQ ID NO: 958879 - protein, 9 aa, Homo Sapiens
ASDPHSGHF

SEQ ID NO: 958880 - protein, 9 aa, Homo Sapiens
RIKNPNQFV

SEQ ID NO: 958881 - protein, 9 aa, Homo Sapiens
APDDSRAGV

SEQ ID NO: 958882 - protein, 9 aa, Homo Sapiens
FNRLLKFFR

SEQ ID NO: 958883 - protein, 9 aa, Homo Sapiens
SENLRKGKD

SEQ ID NO: 958884 - protein, 9 aa, Homo Sapiens
SGPVLLLLL

SEQ ID NO: 958885 - protein, 9 aa, Homo Sapiens
PERSRTLHF

SEQ ID NO: 958886 - protein, 9 aa, Homo Sapiens
VGGNPKSHV

SEQ ID NO: 958887 - protein, 9 aa, Homo Sapiens
KAFGPKLRE

SEQ ID NO: 958888 - protein, 9 aa, Homo Sapiens
GPVSSRFSE

SEQ ID NO: 958889 - protein, 9 aa, Homo Sapiens
DMEFPGSAP

SEQ ID NO: 958890 - protein, 9 aa, Homo Sapiens
LIKHKRIHI

SEQ ID NO: 958891 - protein, 9 aa, Homo Sapiens
LSHALGAFF

SEQ ID NO: 958892 - protein, 9 aa, Homo Sapiens
NKKKMGFQQ

SEQ ID NO: 958893 - protein, 9 aa, Homo Sapiens
GPEDASDPH

SEQ ID NO: 958894 - protein, 9 aa, Homo Sapiens
GQEQNSYGG

SEQ ID NO: 958895 - protein, 9 aa, Homo Sapiens
EKGKRHPYK

SEQ ID NO: 958896 - protein, 9 aa, Homo Sapiens
KCWQNHLAY

SEQ ID NO: 958897 - protein, 9 aa, Homo Sapiens
FLTRFIGDS

SEQ ID NO: 958898 - protein, 9 aa, Homo Sapiens
VTYAAVKHS

SEQ ID NO: 958899 - protein, 9 aa, Homo Sapiens
NLLNSLGPS

SEQ ID NO: 958900 - protein, 9 aa, Homo Sapiens
ENQTWNLQQ

SEQ ID NO: 958901 - protein, 9 aa, Homo Sapiens
LEEDGPAFD

SEQ ID NO: 958902 - protein, 9 aa, Homo Sapiens
QKFSSFLAL

SEQ ID NO: 958903 - protein, 9 aa, Homo Sapiens
SCVFGCGIL

SEQ ID NO: 958904 - protein, 9 aa, Homo Sapiens
PFSCRLCGG

SEQ ID NO: 958905 - protein, 9 aa, Homo Sapiens
GELFQLETS

SEQ ID NO: 958906 - protein, 9 aa, Homo Sapiens
GLPPGKEME

SEQ ID NO: 958907 - protein, 9 aa, Homo Sapiens
IHKKTCKEC

SEQ ID NO: 958908 - protein, 9 aa, Homo Sapiens
ASHIVPHER

SEQ ID NO: 958909 - protein, 9 aa, Homo Sapiens
SFTSCLVPA

SEQ ID NO: 958910 - protein, 9 aa, Homo Sapiens
VNGMMLSVE

SEQ ID NO: 958911 - protein, 9 aa, Homo Sapiens
FADTQLELP

SEQ ID NO: 958912 - protein, 9 aa, Homo Sapiens
GEQCARIQS

SEQ ID NO: 958913 - protein, 9 aa, Homo Sapiens
VAAIFGTFR

SEQ ID NO: 958914 - protein, 9 aa, Homo Sapiens
VAKEVRPLV

SEQ ID NO: 958915 - protein, 9 aa, Homo Sapiens
PAGSALGGV

SEQ ID NO: 958916 - protein, 9 aa, Homo Sapiens
GALFEQKGL

SEQ ID NO: 958917 - protein, 9 aa, Homo Sapiens
SVHLAAQEV

SEQ ID NO: 958918 - protein, 9 aa, Homo Sapiens
VETEASTHS

SEQ ID NO: 958919 - protein, 9 aa, Homo Sapiens
ISASFWWAT

SEQ ID NO: 958920 - protein, 9 aa, Homo Sapiens
KSIMKAMIS

SEQ ID NO: 958921 - protein, 9 aa, Homo Sapiens
HQKKGIHCC

SEQ ID NO: 958922 - protein, 9 aa, Homo Sapiens
EVTGYSKGY

SEQ ID NO: 958923 - protein, 9 aa, Homo Sapiens
PFNKFISSY

SEQ ID NO: 958924 - protein, 9 aa, Homo Sapiens
KKSQPPPSQ

SEQ ID NO: 958925 - protein, 9 aa, Homo Sapiens
RQFLHTNAA

SEQ ID NO: 958926 - protein, 9 aa, Homo Sapiens
MPKKKRELQ

SEQ ID NO: 958927 - protein, 9 aa, Homo Sapiens
DGFSDLIIY

SEQ ID NO: 958928 - protein, 9 aa, Homo Sapiens
NQPLCCILV

SEQ ID NO: 958929 - protein, 9 aa, Homo Sapiens
LSWGVKSLH

SEQ ID NO: 958930 - protein, 9 aa, Homo Sapiens
TNKVIGRTG

SEQ ID NO: 958931 - protein, 9 aa, Homo Sapiens
KTISNGFGS

SEQ ID NO: 958932 - protein, 9 aa, Homo Sapiens
SFQCLQGSG

SEQ ID NO: 958933 - protein, 9 aa, Homo Sapiens
NSKHQLLHH

SEQ ID NO: 958934 - protein, 9 aa, Homo Sapiens
HILSFYSAS

SEQ ID NO: 958935 - protein, 9 aa, Homo Sapiens
QSPERSRTL

SEQ ID NO: 958936 - protein, 9 aa, Homo Sapiens
IPTKKPTIS

SEQ ID NO: 958937 - protein, 9 aa, Homo Sapiens
IPSALEPSM

SEQ ID NO: 958938 - protein, 9 aa, Homo Sapiens
LFLFGAPRF

SEQ ID NO: 958939 - protein, 9 aa, Homo Sapiens
LELDIKILM

SEQ ID NO: 958940 - protein, 9 aa, Homo Sapiens
YVVTCGFHH

SEQ ID NO: 958941 - protein, 9 aa, Homo Sapiens
QAVTYAAVK

SEQ ID NO: 958942 - protein, 9 aa, Homo Sapiens
TVTLNFINV

SEQ ID NO: 958943 - protein, 9 aa, Homo Sapiens
PSVRQGCSR

SEQ ID NO: 958944 - protein, 9 aa, Homo Sapiens
KKLFEENKE

SEQ ID NO: 958945 - protein, 9 aa, Homo Sapiens
CRLCGGVTF

SEQ ID NO: 958946 - protein, 9 aa, Homo Sapiens
SAPPTESAC

SEQ ID NO: 958947 - protein, 9 aa, Homo Sapiens
GRPRAQARS

SEQ ID NO: 958948 - protein, 9 aa, Homo Sapiens
FRLHLLDNA

SEQ ID NO: 958949 - protein, 9 aa, Homo Sapiens
CYEQFDPFC

SEQ ID NO: 958950 - protein, 9 aa, Homo Sapiens
DYERPNDDQ

SEQ ID NO: 958951 - protein, 9 aa, Homo Sapiens
SHALGAFFL

SEQ ID NO: 958952 - protein, 9 aa, Homo Sapiens
ARALRSPGP

SEQ ID NO: 958953 - protein, 9 aa, Homo Sapiens
ICCQRNYGA

SEQ ID NO: 958954 - protein, 9 aa, Homo Sapiens
LSGASTKWK

SEQ ID NO: 958955 - protein, 9 aa, Homo Sapiens
RKDFSATSG

SEQ ID NO: 958956 - protein, 9 aa, Homo Sapiens
ITLYSYSQL

SEQ ID NO: 958957 - protein, 9 aa, Homo Sapiens
ALLSRQFLH

SEQ ID NO: 958958 - protein, 9 aa, Homo Sapiens
QKKGIHCCT

SEQ ID NO: 958959 - protein, 9 aa, Homo Sapiens
PDQPVLSLD

SEQ ID NO: 958960 - protein, 9 aa, Homo Sapiens
NCLVGLGLV

SEQ ID NO: 958961 - protein, 9 aa, Homo Sapiens
NLRMKKDRE

SEQ ID NO: 958962 - protein, 9 aa, Homo Sapiens
KLMSIPDVI

SEQ ID NO: 958963 - protein, 9 aa, Homo Sapiens
KRPFSCRLC

SEQ ID NO: 958964 - protein, 9 aa, Homo Sapiens
GRMKFDKYI

SEQ ID NO: 958965 - protein, 9 aa, Homo Sapiens
AGHADLQVR

SEQ ID NO: 958966 - protein, 9 aa, Homo Sapiens
GLVRTACTN

SEQ ID NO: 958967 - protein, 9 aa, Homo Sapiens
LLRSSECPR

SEQ ID NO: 958968 - protein, 9 aa, Homo Sapiens
PLDILTMIF

SEQ ID NO: 958969 - protein, 9 aa, Homo Sapiens
SEVHDGSLH

SEQ ID NO: 958970 - protein, 9 aa, Homo Sapiens
YQPESDIDD

SEQ ID NO: 958971 - protein, 9 aa, Homo Sapiens
FPKEMPKKK

SEQ ID NO: 958972 - protein, 9 aa, Homo Sapiens
GSLNGKKRP

SEQ ID NO: 958973 - protein, 9 aa, Homo Sapiens
PTAMSLSST

SEQ ID NO: 958974 - protein, 9 aa, Homo Sapiens
CLVPAAEPL

SEQ ID NO: 958975 - protein, 9 aa, Homo Sapiens
FQVTTYLTQ

SEQ ID NO: 958976 - protein, 9 aa, Homo Sapiens
GFSILATGG

SEQ ID NO: 958977 - protein, 9 aa, Homo Sapiens
ADLDCAHEE

SEQ ID NO: 958978 - protein, 9 aa, Homo Sapiens
LSFYSASKK

SEQ ID NO: 958979 - protein, 9 aa, Homo Sapiens
GNRGKPGLK

SEQ ID NO: 958980 - protein, 9 aa, Homo Sapiens
LFSESPQGK

SEQ ID NO: 958981 - protein, 9 aa, Homo Sapiens
QMKKAFSTC

SEQ ID NO: 958982 - protein, 9 aa, Homo Sapiens
AVGGTAPLP

SEQ ID NO: 958983 - protein, 9 aa, Homo Sapiens
QHMLPFWTN

SEQ ID NO: 958984 - protein, 9 aa, Homo Sapiens
TDITLNSKK

SEQ ID NO: 958985 - protein, 9 aa, Homo Sapiens
QYVSSFCKM

SEQ ID NO: 958986 - protein, 9 aa, Homo Sapiens
DQVDMEFPG

SEQ ID NO: 958987 - protein, 9 aa, Homo Sapiens
TKKVLLSYY

SEQ ID NO: 958988 - protein, 9 aa, Homo Sapiens
KNWRDKDQS

SEQ ID NO: 958989 - protein, 9 aa, Homo Sapiens
ISQLQNKFY

SEQ ID NO: 958990 - protein, 9 aa, Homo Sapiens
NLRVKAQTT

SEQ ID NO: 958991 - protein, 9 aa, Homo Sapiens
QALQHAFQA

SEQ ID NO: 958992 - protein, 9 aa, Homo Sapiens
NNLTEDNSN

SEQ ID NO: 958993 - protein, 9 aa, Homo Sapiens
LDTVTLHFQ

SEQ ID NO: 958994 - protein, 9 aa, Homo Sapiens
WRRIPSKEA

SEQ ID NO: 958995 - protein, 9 aa, Homo Sapiens
AVEIIRKIA

SEQ ID NO: 958996 - protein, 9 aa, Homo Sapiens
SLEALSSGR

SEQ ID NO: 958997 - protein, 9 aa, Homo Sapiens
YVSSFCKMS

SEQ ID NO: 958998 - protein, 9 aa, Homo Sapiens
AVKQFRARP

SEQ ID NO: 958999 - protein, 9 aa, Homo Sapiens
PLLAVASPG

SEQ ID NO: 959000 - protein, 9 aa, Homo Sapiens
LSSECSASS

SEQ ID NO: 959001 - protein, 9 aa, Homo Sapiens
AALFLEKVL

SEQ ID NO: 959002 - protein, 9 aa, Homo Sapiens
ISPPADGSK

SEQ ID NO: 959003 - protein, 9 aa, Homo Sapiens
LFSQIYSLN

SEQ ID NO: 959004 - protein, 9 aa, Homo Sapiens
RGLFGTGIR

SEQ ID NO: 959005 - protein, 9 aa, Homo Sapiens
MRGTDITLN

SEQ ID NO: 959006 - protein, 9 aa, Homo Sapiens
DDCRSGIKI

SEQ ID NO: 959007 - protein, 9 aa, Homo Sapiens
AYFYENQHQ

SEQ ID NO: 959008 - protein, 9 aa, Homo Sapiens
LKRKLTKRD

SEQ ID NO: 959009 - protein, 9 aa, Homo Sapiens
MMLSVEKLI

SEQ ID NO: 959010 - protein, 9 aa, Homo Sapiens
RIKRLSSLE

SEQ ID NO: 959011 - protein, 9 aa, Homo Sapiens
GALKHLRKK

SEQ ID NO: 959012 - protein, 9 aa, Homo Sapiens
LSLDRCKCK

SEQ ID NO: 959013 - protein, 9 aa, Homo Sapiens
QGERTKITI

SEQ ID NO: 959014 - protein, 9 aa, Homo Sapiens
GTVYKASDP

SEQ ID NO: 959015 - protein, 9 aa, Homo Sapiens
WYSFTGGMF

SEQ ID NO: 959016 - protein, 9 aa, Homo Sapiens
RPRTRRLSS

SEQ ID NO: 959017 - protein, 9 aa, Homo Sapiens
LGLPPGKEM

SEQ ID NO: 959018 - protein, 9 aa, Homo Sapiens
EVLQPIGMT

SEQ ID NO: 959019 - protein, 9 aa, Homo Sapiens
LCTATTEEA

SEQ ID NO: 959020 - protein, 9 aa, Homo Sapiens
KLNATDQDE

SEQ ID NO: 959021 - protein, 9 aa, Homo Sapiens
KRRKFMMQS

SEQ ID NO: 959022 - protein, 9 aa, Homo Sapiens
GDYKMAAEL

SEQ ID NO: 959023 - protein, 9 aa, Homo Sapiens
PKEMPKKKR

SEQ ID NO: 959024 - protein, 9 aa, Homo Sapiens
CDCSDPVFP

SEQ ID NO: 959025 - protein, 9 aa, Homo Sapiens
ESLVRNNPS

SEQ ID NO: 959026 - protein, 9 aa, Homo Sapiens
SETQSLTRN

SEQ ID NO: 959027 - protein, 9 aa, Homo Sapiens
GDPKTYDPD

SEQ ID NO: 959028 - protein, 9 aa, Homo Sapiens
NQVLLFSES

SEQ ID NO: 959029 - protein, 9 aa, Homo Sapiens
NSTLKNHLC

SEQ ID NO: 959030 - protein, 9 aa, Homo Sapiens
GKVEAAEIL

SEQ ID NO: 959031 - protein, 9 aa, Homo Sapiens
YCEEGGIID

SEQ ID NO: 959032 - protein, 9 aa, Homo Sapiens
QFIFKRHHG

SEQ ID NO: 959033 - protein, 9 aa, Homo Sapiens
KRLSSLEAL

SEQ ID NO: 959034 - protein, 9 aa, Homo Sapiens
SVTEPATCF

SEQ ID NO: 959035 - protein, 9 aa, Homo Sapiens
QSVAMNIRL

SEQ ID NO: 959036 - protein, 9 aa, Homo Sapiens
EDNSNLSMA

SEQ ID NO: 959037 - protein, 9 aa, Homo Sapiens
QELFCWQIW

SEQ ID NO: 959038 - protein, 9 aa, Homo Sapiens
LSATTVRKI

SEQ ID NO: 959039 - protein, 9 aa, Homo Sapiens
RGTDITLNS

SEQ ID NO: 959040 - protein, 9 aa, Homo Sapiens
EAFRAGDYK

SEQ ID NO: 959041 - protein, 9 aa, Homo Sapiens
WEYPGSRES

SEQ ID NO: 959042 - protein, 9 aa, Homo Sapiens
TIYVGFDAV

SEQ ID NO: 959043 - protein, 9 aa, Homo Sapiens
KSGAAPPST

SEQ ID NO: 959044 - protein, 9 aa, Homo Sapiens
YILDVHGKN

SEQ ID NO: 959045 - protein, 9 aa, Homo Sapiens
EGGIIDESL

SEQ ID NO: 959046 - protein, 9 aa, Homo Sapiens
LTRNVKEKP

SEQ ID NO: 959047 - protein, 9 aa, Homo Sapiens
NRKHIEFLF

SEQ ID NO: 959048 - protein, 9 aa, Homo Sapiens
FRAGDYKMA

SEQ ID NO: 959049 - protein, 9 aa, Homo Sapiens
LNVQTGNNG

SEQ ID NO: 959050 - protein, 9 aa, Homo Sapiens
VMGNELFCS

SEQ ID NO: 959051 - protein, 9 aa, Homo Sapiens
NPSTGQCYE

SEQ ID NO: 959052 - protein, 9 aa, Homo Sapiens
QRERDELPT

SEQ ID NO: 959053 - protein, 9 aa, Homo Sapiens
NFVQALEHG

SEQ ID NO: 959054 - protein, 9 aa, Homo Sapiens
PSPVSSFRV

SEQ ID NO: 959055 - protein, 9 aa, Homo Sapiens
TKFKSISAS

SEQ ID NO: 959056 - protein, 9 aa, Homo Sapiens
DGLTRNVKE

SEQ ID NO: 959057 - protein, 9 aa, Homo Sapiens
VASPGVAAL

SEQ ID NO: 959058 - protein, 9 aa, Homo Sapiens
TKKPTISME

SEQ ID NO: 959059 - protein, 9 aa, Homo Sapiens
PNGELQDCG

SEQ ID NO: 959060 - protein, 9 aa, Homo Sapiens
RMQNTLYLF

SEQ ID NO: 959061 - protein, 9 aa, Homo Sapiens
FDSTVESSD

SEQ ID NO: 959062 - protein, 9 aa, Homo Sapiens
LYACGDCGK

SEQ ID NO: 959063 - protein, 9 aa, Homo Sapiens
AGNKLRIDV

SEQ ID NO: 959064 - protein, 9 aa, Homo Sapiens
AVFCVFLAF

SEQ ID NO: 959065 - protein, 9 aa, Homo Sapiens
IDESLREQL

SEQ ID NO: 959066 - protein, 9 aa, Homo Sapiens
KTLDNLKCK

SEQ ID NO: 959067 - protein, 9 aa, Homo Sapiens
ECSASSDPL

SEQ ID NO: 959068 - protein, 9 aa, Homo Sapiens
LLPPGPTEP

SEQ ID NO: 959069 - protein, 9 aa, Homo Sapiens
ALGGVPPVP

SEQ ID NO: 959070 - protein, 9 aa, Homo Sapiens
RIFLTRHKR

SEQ ID NO: 959071 - protein, 9 aa, Homo Sapiens
REPHRAQQQ

SEQ ID NO: 959072 - protein, 9 aa, Homo Sapiens
PSAQQMKKA

SEQ ID NO: 959073 - protein, 9 aa, Homo Sapiens
RNVKEKPRP

SEQ ID NO: 959074 - protein, 9 aa, Homo Sapiens
TGTPDSNNV

SEQ ID NO: 959075 - protein, 9 aa, Homo Sapiens
KSHVYWKKS

SEQ ID NO: 959076 - protein, 9 aa, Homo Sapiens
KWKWKLSSF

SEQ ID NO: 959077 - protein, 9 aa, Homo Sapiens
KEQEDWKKY

SEQ ID NO: 959078 - protein, 9 aa, Homo Sapiens
QNELLPPGP

SEQ ID NO: 959079 - protein, 9 aa, Homo Sapiens
TSQNFKHHS

SEQ ID NO: 959080 - protein, 9 aa, Homo Sapiens
GPASALTPG

SEQ ID NO: 959081 - protein, 9 aa, Homo Sapiens
SKHQLLHHS

SEQ ID NO: 959082 - protein, 9 aa, Homo Sapiens
TAEHYVVTC

SEQ ID NO: 959083 - protein, 9 aa, Homo Sapiens
EKLYACGDC

SEQ ID NO: 959084 - protein, 9 aa, Homo Sapiens
LKYEDMHRN

SEQ ID NO: 959085 - protein, 9 aa, Homo Sapiens
DYGQLHETS

SEQ ID NO: 959086 - protein, 9 aa, Homo Sapiens
DSKWLREPN

SEQ ID NO: 959087 - protein, 9 aa, Homo Sapiens
QDMVNGMML

SEQ ID NO: 959088 - protein, 9 aa, Homo Sapiens
NFKHHSFLI

SEQ ID NO: 959089 - protein, 9 aa, Homo Sapiens
KSSTKPAVG

SEQ ID NO: 959090 - protein, 9 aa, Homo Sapiens
ARSASCLSI

SEQ ID NO: 959091 - protein, 9 aa, Homo Sapiens
KTIISYKKG

SEQ ID NO: 959092 - protein, 9 aa, Homo Sapiens
NFLEGKVDD

SEQ ID NO: 959093 - protein, 9 aa, Homo Sapiens
NPCALDFHA

SEQ ID NO: 959094 - protein, 9 aa, Homo Sapiens
NSVYWQKFE

SEQ ID NO: 959095 - protein, 9 aa, Homo Sapiens
GERTKITIG

SEQ ID NO: 959096 - protein, 9 aa, Homo Sapiens
SVKKNDAGS

SEQ ID NO: 959097 - protein, 9 aa, Homo Sapiens
GPVEDHVHR

SEQ ID NO: 959098 - protein, 9 aa, Homo Sapiens
PREDIKGVR

SEQ ID NO: 959099 - protein, 9 aa, Homo Sapiens
KILEIEDMA

SEQ ID NO: 959100 - protein, 9 aa, Homo Sapiens
PPAPPVEGS

SEQ ID NO: 959101 - protein, 9 aa, Homo Sapiens
TISNGFGSK

SEQ ID NO: 959102 - protein, 9 aa, Homo Sapiens
QVPTAMSLS

SEQ ID NO: 959103 - protein, 9 aa, Homo Sapiens
GGLSIQNEL

SEQ ID NO: 959104 - protein, 9 aa, Homo Sapiens
DTRLEKMVS

SEQ ID NO: 959105 - protein, 9 aa, Homo Sapiens
HRIFLTRHK

SEQ ID NO: 959106 - protein, 9 aa, Homo Sapiens
KHGDRFISS

SEQ ID NO: 959107 - protein, 9 aa, Homo Sapiens
YEQFDPFCP

SEQ ID NO: 959108 - protein, 9 aa, Homo Sapiens
PCMSLRSSV

SEQ ID NO: 959109 - protein, 9 aa, Homo Sapiens
PAPAKHPSL

SEQ ID NO: 959110 - protein, 9 aa, Homo Sapiens
LCVGVRPGD

SEQ ID NO: 959111 - protein, 9 aa, Homo Sapiens
SKLTLKNKV

SEQ ID NO: 959112 - protein, 9 aa, Homo Sapiens
ATRNCLVGL

SEQ ID NO: 959113 - protein, 9 aa, Homo Sapiens
VMIYGESGA

SEQ ID NO: 959114 - protein, 9 aa, Homo Sapiens
IYFFYSLGA

SEQ ID NO: 959115 - protein, 9 aa, Homo Sapiens
LKLNATDQD

SEQ ID NO: 959116 - protein, 9 aa, Homo Sapiens
GLGINLFAD

SEQ ID NO: 959117 - protein, 9 aa, Homo Sapiens
CPPGSPGPP

SEQ ID NO: 959118 - protein, 9 aa, Homo Sapiens
ELRHRFWLE

SEQ ID NO: 959119 - protein, 9 aa, Homo Sapiens
WTASEAINF

SEQ ID NO: 959120 - protein, 9 aa, Homo Sapiens
VQSQIFESS

SEQ ID NO: 959121 - protein, 9 aa, Homo Sapiens
YLITFEKRE

SEQ ID NO: 959122 - protein, 9 aa, Homo Sapiens
FYSYFWSLR

SEQ ID NO: 959123 - protein, 9 aa, Homo Sapiens
IDAASPFWK

SEQ ID NO: 959124 - protein, 9 aa, Homo Sapiens
KIAVPPRLS

SEQ ID NO: 959125 - protein, 9 aa, Homo Sapiens
QTVRTILAV

SEQ ID NO: 959126 - protein, 9 aa, Homo Sapiens
DLDCAHEEF

SEQ ID NO: 959127 - protein, 9 aa, Homo Sapiens
IGELMAIQE

SEQ ID NO: 959128 - protein, 9 aa, Homo Sapiens
PSTGQCYEQ

SEQ ID NO: 959129 - protein, 9 aa, Homo Sapiens
PKSHVYWKK

SEQ ID NO: 959130 - protein, 9 aa, Homo Sapiens
AQRERDELP

SEQ ID NO: 959131 - protein, 9 aa, Homo Sapiens
PRIMHSSYR

SEQ ID NO: 959132 - protein, 9 aa, Homo Sapiens
TELSEGSRT

SEQ ID NO: 959133 - protein, 9 aa, Homo Sapiens
RKTESNWEA

SEQ ID NO: 959134 - protein, 9 aa, Homo Sapiens
PEQEETAFL

SEQ ID NO: 959135 - protein, 9 aa, Homo Sapiens
HRIALAASI

SEQ ID NO: 959136 - protein, 9 aa, Homo Sapiens
FCWQIWKQV

SEQ ID NO: 959137 - protein, 9 aa, Homo Sapiens
SKEGSPLTS

SEQ ID NO: 959138 - protein, 9 aa, Homo Sapiens
PIENLVNPC

SEQ ID NO: 959139 - protein, 9 aa, Homo Sapiens
IPELCQRCD

SEQ ID NO: 959140 - protein, 9 aa, Homo Sapiens
ALKVALMGL

SEQ ID NO: 959141 - protein, 9 aa, Homo Sapiens
PFRPRRSPC

SEQ ID NO: 959142 - protein, 9 aa, Homo Sapiens
DLVKCENPG

SEQ ID NO: 959143 - protein, 9 aa, Homo Sapiens
PMSPSDFLN

SEQ ID NO: 959144 - protein, 9 aa, Homo Sapiens
DFFQGERTK

SEQ ID NO: 959145 - protein, 9 aa, Homo Sapiens
EAGFLSVCE

SEQ ID NO: 959146 - protein, 9 aa, Homo Sapiens
TLQEQSVAM

SEQ ID NO: 959147 - protein, 9 aa, Homo Sapiens
NAHFRKYHN

SEQ ID NO: 959148 - protein, 9 aa, Homo Sapiens
TYAAVKHSR

SEQ ID NO: 959149 - protein, 9 aa, Homo Sapiens
VDSRTSKLT

SEQ ID NO: 959150 - protein, 9 aa, Homo Sapiens
LVMGNELFC

SEQ ID NO: 959151 - protein, 9 aa, Homo Sapiens
SRKCRAGVV

SEQ ID NO: 959152 - protein, 9 aa, Homo Sapiens
ILAVIYMGS

SEQ ID NO: 959153 - protein, 9 aa, Homo Sapiens
CSGPLFQKQ

SEQ ID NO: 959154 - protein, 9 aa, Homo Sapiens
SQTSQNFKH

SEQ ID NO: 959155 - protein, 9 aa, Homo Sapiens
KFFRLFEFF

SEQ ID NO: 959156 - protein, 9 aa, Homo Sapiens
GGVPPVPSR

SEQ ID NO: 959157 - protein, 9 aa, Homo Sapiens
AALVMGNEL

SEQ ID NO: 959158 - protein, 9 aa, Homo Sapiens
DVEEIFCKV

SEQ ID NO: 959159 - protein, 9 aa, Homo Sapiens
TILAVFGKG

SEQ ID NO: 959160 - protein, 9 aa, Homo Sapiens
RRFVGLRVL

SEQ ID NO: 959161 - protein, 9 aa, Homo Sapiens
GGLSLRAGH

SEQ ID NO: 959162 - protein, 9 aa, Homo Sapiens
SLQSYRSQP

SEQ ID NO: 959163 - protein, 9 aa, Homo Sapiens
VQFIQGKLQ

SEQ ID NO: 959164 - protein, 9 aa, Homo Sapiens
IHVSGGKDV

SEQ ID NO: 959165 - protein, 9 aa, Homo Sapiens
SIEEQLQLV

SEQ ID NO: 959166 - protein, 9 aa, Homo Sapiens
PIDLNSKMS

SEQ ID NO: 959167 - protein, 9 aa, Homo Sapiens
FQKQAEFFL

SEQ ID NO: 959168 - protein, 9 aa, Homo Sapiens
VITGEGNMF

SEQ ID NO: 959169 - protein, 9 aa, Homo Sapiens
NFYYGNLMV

SEQ ID NO: 959170 - protein, 9 aa, Homo Sapiens
SDPHSGHFV

SEQ ID NO: 959171 - protein, 9 aa, Homo Sapiens
RKRRKFMMQ

SEQ ID NO: 959172 - protein, 9 aa, Homo Sapiens
FRFWVNTFF

SEQ ID NO: 959173 - protein, 9 aa, Homo Sapiens
IRIKNPNQF

SEQ ID NO: 959174 - protein, 9 aa, Homo Sapiens
YQSSSLLRH

SEQ ID NO: 959175 - protein, 9 aa, Homo Sapiens
TMIFPNYRR

SEQ ID NO: 959176 - protein, 9 aa, Homo Sapiens
HTIYVGFDA

SEQ ID NO: 959177 - protein, 9 aa, Homo Sapiens
KGLVYVACQ

SEQ ID NO: 959178 - protein, 9 aa, Homo Sapiens
PGTVMSSCS

SEQ ID NO: 959179 - protein, 9 aa, Homo Sapiens
GTSHEKNWS

SEQ ID NO: 959180 - protein, 9 aa, Homo Sapiens
VCALFATGS

SEQ ID NO: 959181 - protein, 9 aa, Homo Sapiens
DFGDPKTYD

SEQ ID NO: 959182 - protein, 9 aa, Homo Sapiens
QQMKKAFST

SEQ ID NO: 959183 - protein, 9 aa, Homo Sapiens
MIYGESGAG

SEQ ID NO: 959184 - protein, 9 aa, Homo Sapiens
KDKNESVQN

SEQ ID NO: 959185 - protein, 9 aa, Homo Sapiens
LNGKKRPFS

SEQ ID NO: 959186 - protein, 9 aa, Homo Sapiens
LVKCENPGI

SEQ ID NO: 959187 - protein, 9 aa, Homo Sapiens
INNAQVTVL

SEQ ID NO: 959188 - protein, 9 aa, Homo Sapiens
FYENQHQVG

SEQ ID NO: 959189 - protein, 9 aa, Homo Sapiens
PNPLHKVVV

SEQ ID NO: 959190 - protein, 9 aa, Homo Sapiens
AELRNETVC

SEQ ID NO: 959191 - protein, 9 aa, Homo Sapiens
FSFRVKWLR

SEQ ID NO: 959192 - protein, 9 aa, Homo Sapiens
PSKEASQMD

SEQ ID NO: 959193 - protein, 9 aa, Homo Sapiens
IQILAPLAP

SEQ ID NO: 959194 - protein, 9 aa, Homo Sapiens
KTYDPDFKG

SEQ ID NO: 959195 - protein, 9 aa, Homo Sapiens
SWYDNIILK

SEQ ID NO: 959196 - protein, 9 aa, Homo Sapiens
HYVVTCGFH

SEQ ID NO: 959197 - protein, 9 aa, Homo Sapiens
PNLLNSLGP

SEQ ID NO: 959198 - protein, 9 aa, Homo Sapiens
LLSPSGFSQ

SEQ ID NO: 959199 - protein, 9 aa, Homo Sapiens
SDFEHTIYV

SEQ ID NO: 959200 - protein, 9 aa, Homo Sapiens
GEQAKEQED

SEQ ID NO: 959201 - protein, 9 aa, Homo Sapiens
EPHRAQQQP

SEQ ID NO: 959202 - protein, 9 aa, Homo Sapiens
YDLYVVCNH

SEQ ID NO: 959203 - protein, 9 aa, Homo Sapiens
CWWPSGATE

SEQ ID NO: 959204 - protein, 9 aa, Homo Sapiens
RPSVRQGCS

SEQ ID NO: 959205 - protein, 9 aa, Homo Sapiens
LHGRMKEKE

SEQ ID NO: 959206 - protein, 9 aa, Homo Sapiens
AAVKHSRPR

SEQ ID NO: 959207 - protein, 9 aa, Homo Sapiens
GVAVKTPTK

SEQ ID NO: 959208 - protein, 9 aa, Homo Sapiens
MSAEALGPA

SEQ ID NO: 959209 - protein, 9 aa, Homo Sapiens
CTDVDRLKF

SEQ ID NO: 959210 - protein, 9 aa, Homo Sapiens
ETKSIGELM

SEQ ID NO: 959211 - protein, 9 aa, Homo Sapiens
NLCSIFGSN

SEQ ID NO: 959212 - protein, 9 aa, Homo Sapiens
AGVGETGSE

SEQ ID NO: 959213 - protein, 9 aa, Homo Sapiens
WYDNIILKG

SEQ ID NO: 959214 - protein, 9 aa, Homo Sapiens
KMFRFWVNT

SEQ ID NO: 959215 - protein, 9 aa, Homo Sapiens
ISYKKGAWC

SEQ ID NO: 959216 - protein, 9 aa, Homo Sapiens
PFWTNLCSI

SEQ ID NO: 959217 - protein, 9 aa, Homo Sapiens
LTNKVIGRT

SEQ ID NO: 959218 - protein, 9 aa, Homo Sapiens
LFLEKVLDL

SEQ ID NO: 959219 - protein, 9 aa, Homo Sapiens
YSFTGGMFD

SEQ ID NO: 959220 - protein, 9 aa, Homo Sapiens
CVDQTSMNK

SEQ ID NO: 959221 - protein, 9 aa, Homo Sapiens
KNHLCLHTG

SEQ ID NO: 959222 - protein, 9 aa, Homo Sapiens
LNESSSPEG

SEQ ID NO: 959223 - protein, 9 aa, Homo Sapiens
QCYEQFDPF

SEQ ID NO: 959224 - protein, 9 aa, Homo Sapiens
PTMEVLSMT

SEQ ID NO: 959225 - protein, 9 aa, Homo Sapiens
DLLERKLWS

SEQ ID NO: 959226 - protein, 9 aa, Homo Sapiens
REEWLTTSP

SEQ ID NO: 959227 - protein, 9 aa, Homo Sapiens
VSMPISEET

SEQ ID NO: 959228 - protein, 9 aa, Homo Sapiens
SLLQIGLLL

SEQ ID NO: 959229 - protein, 9 aa, Homo Sapiens
LKDEKELEG

SEQ ID NO: 959230 - protein, 9 aa, Homo Sapiens
TKNTTGKAA

SEQ ID NO: 959231 - protein, 9 aa, Homo Sapiens
VTLNFINVW

SEQ ID NO: 959232 - protein, 9 aa, Homo Sapiens
NADFATRDC

SEQ ID NO: 959233 - protein, 9 aa, Homo Sapiens
RGRGLCTAT

SEQ ID NO: 959234 - protein, 9 aa, Homo Sapiens
QLLYISCVV

SEQ ID NO: 959235 - protein, 9 aa, Homo Sapiens
IKMSKFEAW

SEQ ID NO: 959236 - protein, 9 aa, Homo Sapiens
GTAPGDLSV

SEQ ID NO: 959237 - protein, 9 aa, Homo Sapiens
EDTAFTRSS

SEQ ID NO: 959238 - protein, 9 aa, Homo Sapiens
CLHTGDRPF

SEQ ID NO: 959239 - protein, 9 aa, Homo Sapiens
KAFSSHSES

SEQ ID NO: 959240 - protein, 9 aa, Homo Sapiens
KMYSTYFKE

SEQ ID NO: 959241 - protein, 9 aa, Homo Sapiens
GSKDAVFDG

SEQ ID NO: 959242 - protein, 9 aa, Homo Sapiens
QNKFYLDQV

SEQ ID NO: 959243 - protein, 9 aa, Homo Sapiens
ERKLWSLWR

SEQ ID NO: 959244 - protein, 9 aa, Homo Sapiens
GRRLFLFGA

SEQ ID NO: 959245 - protein, 9 aa, Homo Sapiens
DYGIYYEYT

SEQ ID NO: 959246 - protein, 9 aa, Homo Sapiens
VRTACTNFM

SEQ ID NO: 959247 - protein, 9 aa, Homo Sapiens
SDPHPSLLP

SEQ ID NO: 959248 - protein, 9 aa, Homo Sapiens
IPVSISRNS

SEQ ID NO: 959249 - protein, 9 aa, Homo Sapiens
LQTDFVLDY

SEQ ID NO: 959250 - protein, 9 aa, Homo Sapiens
HVHRPAKAL

SEQ ID NO: 959251 - protein, 9 aa, Homo Sapiens
QHQVGEAIQ

SEQ ID NO: 959252 - protein, 9 aa, Homo Sapiens
ASDPHPSLL

SEQ ID NO: 959253 - protein, 9 aa, Homo Sapiens
LRVKAQTTS

SEQ ID NO: 959254 - protein, 9 aa, Homo Sapiens
ALEVFVGLY

SEQ ID NO: 959255 - protein, 9 aa, Homo Sapiens
DLSVTEPAT

SEQ ID NO: 959256 - protein, 9 aa, Homo Sapiens
RIMHSSYRQ

SEQ ID NO: 959257 - protein, 9 aa, Homo Sapiens
IFSRVSSLP

SEQ ID NO: 959258 - protein, 9 aa, Homo Sapiens
SSFLALSIL

SEQ ID NO: 959259 - protein, 9 aa, Homo Sapiens
IPFGQGNFY

SEQ ID NO: 959260 - protein, 9 aa, Homo Sapiens
DCNPEYFLF

SEQ ID NO: 959261 - protein, 9 aa, Homo Sapiens
RYQMHWKDL

SEQ ID NO: 959262 - protein, 9 aa, Homo Sapiens
LEVLADLDC

SEQ ID NO: 959263 - protein, 9 aa, Homo Sapiens
VLHGRMKEK

SEQ ID NO: 959264 - protein, 9 aa, Homo Sapiens
LRDTRLEKM

SEQ ID NO: 959265 - protein, 9 aa, Homo Sapiens
SRGRGLCTA

SEQ ID NO: 959266 - protein, 9 aa, Homo Sapiens
KNALVSYSV

SEQ ID NO: 959267 - protein, 9 aa, Homo Sapiens
KRLSLDRCK

SEQ ID NO: 959268 - protein, 9 aa, Homo Sapiens
VKATDSNGN

SEQ ID NO: 959269 - protein, 9 aa, Homo Sapiens
SSCSHQPQP

SEQ ID NO: 959270 - protein, 9 aa, Homo Sapiens
GIKIKLGQP

SEQ ID NO: 959271 - protein, 9 aa, Homo Sapiens
QTNGRNGYT

SEQ ID NO: 959272 - protein, 9 aa, Homo Sapiens
PECGKLFSQ

SEQ ID NO: 959273 - protein, 9 aa, Homo Sapiens
SRESPPQDK

SEQ ID NO: 959274 - protein, 9 aa, Homo Sapiens
VEIIRKIAV

SEQ ID NO: 959275 - protein, 9 aa, Homo Sapiens
GERREPHRA

SEQ ID NO: 959276 - protein, 9 aa, Homo Sapiens
VRNNPSFEI

SEQ ID NO: 959277 - protein, 9 aa, Homo Sapiens
GSKEGSPLT

SEQ ID NO: 959278 - protein, 9 aa, Homo Sapiens
HTGEKLYAC

SEQ ID NO: 959279 - protein, 9 aa, Homo Sapiens
SGATESLPR

SEQ ID NO: 959280 - protein, 9 aa, Homo Sapiens
SLSSTPQSQ

SEQ ID NO: 959281 - protein, 9 aa, Homo Sapiens
ENQRNLSGE

SEQ ID NO: 959282 - protein, 9 aa, Homo Sapiens
IFKLTRRFV

SEQ ID NO: 959283 - protein, 9 aa, Homo Sapiens
HMLSSHHSS

SEQ ID NO: 959284 - protein, 9 aa, Homo Sapiens
RLYLSKAKM

SEQ ID NO: 959285 - protein, 9 aa, Homo Sapiens
LITFEKREE

SEQ ID NO: 959286 - protein, 9 aa, Homo Sapiens
RPFSCRLCG

SEQ ID NO: 959287 - protein, 9 aa, Homo Sapiens
PVSFPPALG

SEQ ID NO: 959288 - protein, 9 aa, Homo Sapiens
NLTEDNSNL

SEQ ID NO: 959289 - protein, 9 aa, Homo Sapiens
RCVLYMSNH

SEQ ID NO: 959290 - protein, 9 aa, Homo Sapiens
LGLALGTEL

SEQ ID NO: 959291 - protein, 9 aa, Homo Sapiens
AHAQGRVAV

SEQ ID NO: 959292 - protein, 9 aa, Homo Sapiens
FSGDVAQQL

SEQ ID NO: 959293 - protein, 9 aa, Homo Sapiens
TAWDSQTAK

SEQ ID NO: 959294 - protein, 9 aa, Homo Sapiens
SIWLLQTDF

SEQ ID NO: 959295 - protein, 9 aa, Homo Sapiens
SSDSFNFNS

SEQ ID NO: 959296 - protein, 9 aa, Homo Sapiens
SSQSGAAYI

SEQ ID NO: 959297 - protein, 9 aa, Homo Sapiens
GGKCNPTQQ

SEQ ID NO: 959298 - protein, 9 aa, Homo Sapiens
NVDSNDLER

SEQ ID NO: 959299 - protein, 9 aa, Homo Sapiens
SAEALGPAA

SEQ ID NO: 959300 - protein, 9 aa, Homo Sapiens
ATTVRKIMN

SEQ ID NO: 959301 - protein, 9 aa, Homo Sapiens
KFSAHRIAL

SEQ ID NO: 959302 - protein, 9 aa, Homo Sapiens
KYEDMHRNL

SEQ ID NO: 959303 - protein, 9 aa, Homo Sapiens
LSSCVFGCG

SEQ ID NO: 959304 - protein, 9 aa, Homo Sapiens
KPSIPTKKP

SEQ ID NO: 959305 - protein, 9 aa, Homo Sapiens
GHADLQVRQ

SEQ ID NO: 959306 - protein, 9 aa, Homo Sapiens
QFLLGYWSK

SEQ ID NO: 959307 - protein, 9 aa, Homo Sapiens
FPGSAPSGD

SEQ ID NO: 959308 - protein, 9 aa, Homo Sapiens
FKFNCISIE

SEQ ID NO: 959309 - protein, 9 aa, Homo Sapiens
KFEDTCVYE

SEQ ID NO: 959310 - protein, 9 aa, Homo Sapiens
LFFENSIHK

SEQ ID NO: 959311 - protein, 9 aa, Homo Sapiens
KKAFSSHSE

SEQ ID NO: 959312 - protein, 9 aa, Homo Sapiens
LWNIKDKMS

SEQ ID NO: 959313 - protein, 9 aa, Homo Sapiens
LFYGSEIFT

SEQ ID NO: 959314 - protein, 9 aa, Homo Sapiens
EPNFVQALE

SEQ ID NO: 959315 - protein, 9 aa, Homo Sapiens
SAHRIALAA

SEQ ID NO: 959316 - protein, 9 aa, Homo Sapiens
QRPPAPPVE

SEQ ID NO: 959317 - protein, 9 aa, Homo Sapiens
GSLENTYRD

SEQ ID NO: 959318 - protein, 9 aa, Homo Sapiens
LFSSSLQSY

SEQ ID NO: 959319 - protein, 9 aa, Homo Sapiens
VYVTGRSDM

SEQ ID NO: 959320 - protein, 9 aa, Homo Sapiens
PFLIGDKVT

SEQ ID NO: 959321 - protein, 9 aa, Homo Sapiens
EGSRTLLLS

SEQ ID NO: 959322 - protein, 9 aa, Homo Sapiens
KMSKFEAWS

SEQ ID NO: 959323 - protein, 9 aa, Homo Sapiens
SFSFPLRPF

SEQ ID NO: 959324 - protein, 9 aa, Homo Sapiens
EIIIRYSPL

SEQ ID NO: 959325 - protein, 9 aa, Homo Sapiens
YSYSQLLMF

SEQ ID NO: 959326 - protein, 9 aa, Homo Sapiens
LGGKCNPTQ

SEQ ID NO: 959327 - protein, 9 aa, Homo Sapiens
SGFCGLLPR

SEQ ID NO: 959328 - protein, 9 aa, Homo Sapiens
DTVCDCSDP

SEQ ID NO: 959329 - protein, 9 aa, Homo Sapiens
QHAFQASGQ

SEQ ID NO: 959330 - protein, 9 aa, Homo Sapiens
GATESLPRP

SEQ ID NO: 959331 - protein, 9 aa, Homo Sapiens
LLGLPPGKE

SEQ ID NO: 959332 - protein, 9 aa, Homo Sapiens
LEPSMSSSP

SEQ ID NO: 959333 - protein, 9 aa, Homo Sapiens
FPIKWTASE

SEQ ID NO: 959334 - protein, 9 aa, Homo Sapiens
GFKRWECNW

SEQ ID NO: 959335 - protein, 9 aa, Homo Sapiens
EFLFQPVCK

SEQ ID NO: 959336 - protein, 9 aa, Homo Sapiens
FHRLYLSKA

SEQ ID NO: 959337 - protein, 9 aa, Homo Sapiens
YCVDQTSMN

SEQ ID NO: 959338 - protein, 9 aa, Homo Sapiens
MVGMYSLDK

SEQ ID NO: 959339 - protein, 9 aa, Homo Sapiens
SDIDDFVKF

SEQ ID NO: 959340 - protein, 9 aa, Homo Sapiens
LEDHGEWWK

SEQ ID NO: 959341 - protein, 9 aa, Homo Sapiens
ITLNSKKSP

SEQ ID NO: 959342 - protein, 9 aa, Homo Sapiens
RIFKLTRRF

SEQ ID NO: 959343 - protein, 9 aa, Homo Sapiens
SNNVDSNDL

SEQ ID NO: 959344 - protein, 9 aa, Homo Sapiens
MQKMTIMVF

SEQ ID NO: 959345 - protein, 9 aa, Homo Sapiens
NELLPPGPT

SEQ ID NO: 959346 - protein, 9 aa, Homo Sapiens
ETAGVSLVS

SEQ ID NO: 959347 - protein, 9 aa, Homo Sapiens
GEFTFLCDP

SEQ ID NO: 959348 - protein, 9 aa, Homo Sapiens
TIPVSISRN

SEQ ID NO: 959349 - protein, 9 aa, Homo Sapiens
ECGKAFLVR

SEQ ID NO: 959350 - protein, 9 aa, Homo Sapiens
DALYLKLYY

SEQ ID NO: 959351 - protein, 9 aa, Homo Sapiens
TQRNCSLTQ

SEQ ID NO: 959352 - protein, 9 aa, Homo Sapiens
SLLRSSECP

SEQ ID NO: 959353 - protein, 9 aa, Homo Sapiens
KKPGALRPC

SEQ ID NO: 959354 - protein, 9 aa, Homo Sapiens
ADFATRDCY

SEQ ID NO: 959355 - protein, 9 aa, Homo Sapiens
EQNSYGGKF

SEQ ID NO: 959356 - protein, 9 aa, Homo Sapiens
YAGPITKML

SEQ ID NO: 959357 - protein, 9 aa, Homo Sapiens
MPFNKFISS

SEQ ID NO: 959358 - protein, 9 aa, Homo Sapiens
KGSTGARKK

SEQ ID NO: 959359 - protein, 9 aa, Homo Sapiens
TTPGQRTMY

SEQ ID NO: 959360 - protein, 9 aa, Homo Sapiens
VSFPPALGP

SEQ ID NO: 959361 - protein, 9 aa, Homo Sapiens
RGKPGLKGK

SEQ ID NO: 959362 - protein, 9 aa, Homo Sapiens
QMHWKDLEE

SEQ ID NO: 959363 - protein, 9 aa, Homo Sapiens
LFQKQAEFF

SEQ ID NO: 959364 - protein, 9 aa, Homo Sapiens
MVFIGNFAE

SEQ ID NO: 959365 - protein, 9 aa, Homo Sapiens
CGGVTFKCW

SEQ ID NO: 959366 - protein, 9 aa, Homo Sapiens
KPAVGGTAP

SEQ ID NO: 959367 - protein, 9 aa, Homo Sapiens
KWKLSSFLY

SEQ ID NO: 959368 - protein, 9 aa, Homo Sapiens
SIQNELLPP

SEQ ID NO: 959369 - protein, 9 aa, Homo Sapiens
DNDCTNPVT

SEQ ID NO: 959370 - protein, 9 aa, Homo Sapiens
CWQNHLAYE

SEQ ID NO: 959371 - protein, 9 aa, Homo Sapiens
YFKEFDKNI

SEQ ID NO: 959372 - protein, 9 aa, Homo Sapiens
GSSGQKGHK

SEQ ID NO: 959373 - protein, 9 aa, Homo Sapiens
HRLYLSKAK

SEQ ID NO: 959374 - protein, 9 aa, Homo Sapiens
GRVAVQNML

SEQ ID NO: 959375 - protein, 9 aa, Homo Sapiens
NNVVNEINN

SEQ ID NO: 959376 - protein, 9 aa, Homo Sapiens
VDLLYSIFS

SEQ ID NO: 959377 - protein, 9 aa, Homo Sapiens
KKDGFSDLI

SEQ ID NO: 959378 - protein, 9 aa, Homo Sapiens
TQLELPRGW

SEQ ID NO: 959379 - protein, 9 aa, Homo Sapiens
RPGDCFGLL

SEQ ID NO: 959380 - protein, 9 aa, Homo Sapiens
DNIILKGYK

SEQ ID NO: 959381 - protein, 9 aa, Homo Sapiens
KPRFLASVI

SEQ ID NO: 959382 - protein, 9 aa, Homo Sapiens
GFCGLLPRV

SEQ ID NO: 959383 - protein, 9 aa, Homo Sapiens
CMSLRSSVS

SEQ ID NO: 959384 - protein, 9 aa, Homo Sapiens
EQCARIQSV

SEQ ID NO: 959385 - protein, 9 aa, Homo Sapiens
KHFFALKLM

SEQ ID NO: 959386 - protein, 9 aa, Homo Sapiens
EIIRKIAVP

SEQ ID NO: 959387 - protein, 9 aa, Homo Sapiens
SLTRNKKKA

SEQ ID NO: 959388 - protein, 9 aa, Homo Sapiens
SLAALARTP

SEQ ID NO: 959389 - protein, 9 aa, Homo Sapiens
CYFKFNCIS

SEQ ID NO: 959390 - protein, 9 aa, Homo Sapiens
LSGEKQYRC

SEQ ID NO: 959391 - protein, 9 aa, Homo Sapiens
SFDLVKCEN

SEQ ID NO: 959392 - protein, 9 aa, Homo Sapiens
AAPAPAKHP

SEQ ID NO: 959393 - protein, 9 aa, Homo Sapiens
YKHWKTLDN

SEQ ID NO: 959394 - protein, 9 aa, Homo Sapiens
GPGSQIEKT

SEQ ID NO: 959395 - protein, 9 aa, Homo Sapiens
QFFKNWRDK

SEQ ID NO: 959396 - protein, 9 aa, Homo Sapiens
SATTVRKIM

SEQ ID NO: 959397 - protein, 9 aa, Homo Sapiens
VTLHFQVTT

SEQ ID NO: 959398 - protein, 9 aa, Homo Sapiens
TPSACVVET

SEQ ID NO: 959399 - protein, 9 aa, Homo Sapiens
DCLYIVQCF

SEQ ID NO: 959400 - protein, 9 aa, Homo Sapiens
HFDQVTKNT

SEQ ID NO: 959401 - protein, 9 aa, Homo Sapiens
LRQQVSELK

SEQ ID NO: 959402 - protein, 9 aa, Homo Sapiens
CGKGRKDFS

SEQ ID NO: 959403 - protein, 9 aa, Homo Sapiens
FINNPSFTV

SEQ ID NO: 959404 - protein, 9 aa, Homo Sapiens
YFYILDVHG

SEQ ID NO: 959405 - protein, 9 aa, Homo Sapiens
HYSDFFQGE

SEQ ID NO: 959406 - protein, 9 aa, Homo Sapiens
QTAKKWDAV

SEQ ID NO: 959407 - protein, 9 aa, Homo Sapiens
IFHRLYLSK

SEQ ID NO: 959408 - protein, 9 aa, Homo Sapiens
KHQLLHHSA

SEQ ID NO: 959409 - protein, 9 aa, Homo Sapiens
GFSDLIIYT

SEQ ID NO: 959410 - protein, 9 aa, Homo Sapiens
DTVTLHFQV

SEQ ID NO: 959411 - protein, 9 aa, Homo Sapiens
EGTSHEKNW

SEQ ID NO: 959412 - protein, 9 aa, Homo Sapiens
ALTPGHPAE

SEQ ID NO: 959413 - protein, 9 aa, Homo Sapiens
PSRKCRAGV

SEQ ID NO: 959414 - protein, 9 aa, Homo Sapiens
FQASGQPSL

SEQ ID NO: 959415 - protein, 9 aa, Homo Sapiens
KVIGRTGLA

SEQ ID NO: 959416 - protein, 9 aa, Homo Sapiens
FQGERTKIT

SEQ ID NO: 959417 - protein, 9 aa, Homo Sapiens
FGQGNFYYG

SEQ ID NO: 959418 - protein, 9 aa, Homo Sapiens
FVKKTSPPS

SEQ ID NO: 959419 - protein, 9 aa, Homo Sapiens
LNRRQSTTK

SEQ ID NO: 959420 - protein, 9 aa, Homo Sapiens
ETFNTLAMY

SEQ ID NO: 959421 - protein, 9 aa, Homo Sapiens
LKNSKHQLL

SEQ ID NO: 959422 - protein, 9 aa, Homo Sapiens
AHFRKYHNA

SEQ ID NO: 959423 - protein, 9 aa, Homo Sapiens
FYGSEIFTY

SEQ ID NO: 959424 - protein, 9 aa, Homo Sapiens
GQLHETSSF

SEQ ID NO: 959425 - protein, 9 aa, Homo Sapiens
LFEQKGLVY

SEQ ID NO: 959426 - protein, 9 aa, Homo Sapiens
TSETQSLTR

SEQ ID NO: 959427 - protein, 9 aa, Homo Sapiens
FSESPQGKV

SEQ ID NO: 959428 - protein, 9 aa, Homo Sapiens
PLCCILVAL

SEQ ID NO: 959429 - protein, 9 aa, Homo Sapiens
SPSGFSQAA

SEQ ID NO: 959430 - protein, 9 aa, Homo Sapiens
WLEEAKSRD

SEQ ID NO: 959431 - protein, 9 aa, Homo Sapiens
TPGHPAERP

SEQ ID NO: 959432 - protein, 9 aa, Homo Sapiens
SLHCKLLIV

SEQ ID NO: 959433 - protein, 9 aa, Homo Sapiens
VTICCQRNY

SEQ ID NO: 959434 - protein, 9 aa, Homo Sapiens
LTLLSVKKN

SEQ ID NO: 959435 - protein, 9 aa, Homo Sapiens
PIKWTASEA

SEQ ID NO: 959436 - protein, 9 aa, Homo Sapiens
GNIALTVGF

SEQ ID NO: 959437 - protein, 9 aa, Homo Sapiens
TPGQRTMYC

SEQ ID NO: 959438 - protein, 9 aa, Homo Sapiens
LDNLKCKSL

SEQ ID NO: 959439 - protein, 9 aa, Homo Sapiens
AIYRRTSEV

SEQ ID NO: 959440 - protein, 9 aa, Homo Sapiens
VVFYDCNPE

SEQ ID NO: 959441 - protein, 9 aa, Homo Sapiens
SQPARSASS

SEQ ID NO: 959442 - protein, 9 aa, Homo Sapiens
GFTCAQTNG

SEQ ID NO: 959443 - protein, 9 aa, Homo Sapiens
LDFLYDLYV

SEQ ID NO: 959444 - protein, 9 aa, Homo Sapiens
SEGSRTLLL

SEQ ID NO: 959445 - protein, 9 aa, Homo Sapiens
RQGLSLLRS

SEQ ID NO: 959446 - protein, 9 aa, Homo Sapiens
LFADGMGAF

SEQ ID NO: 959447 - protein, 9 aa, Homo Sapiens
KDKMFRFWV

SEQ ID NO: 959448 - protein, 9 aa, Homo Sapiens
VGGFDVFIQ

SEQ ID NO: 959449 - protein, 9 aa, Homo Sapiens
QGYGGTPEK

SEQ ID NO: 959450 - protein, 9 aa, Homo Sapiens
FLCCVSCFW

SEQ ID NO: 959451 - protein, 9 aa, Homo Sapiens
PPSPVSSFR

SEQ ID NO: 959452 - protein, 9 aa, Homo Sapiens
MDFPEHKEP

SEQ ID NO: 959453 - protein, 9 aa, Homo Sapiens
RALPKGILK

SEQ ID NO: 959454 - protein, 9 aa, Homo Sapiens
WQNHLAYEK

SEQ ID NO: 959455 - protein, 9 aa, Homo Sapiens
HRFWLEEAK

SEQ ID NO: 959456 - protein, 9 aa, Homo Sapiens
FGDPKTYDP

SEQ ID NO: 959457 - protein, 9 aa, Homo Sapiens
DLSHALGAF

SEQ ID NO: 959458 - protein, 9 aa, Homo Sapiens
QRNLSGEKQ

SEQ ID NO: 959459 - protein, 9 aa, Homo Sapiens
FRLSALEVF

SEQ ID NO: 959460 - protein, 9 aa, Homo Sapiens
IENLVNPCA

SEQ ID NO: 959461 - protein, 9 aa, Homo Sapiens
KKMGFQQFL

SEQ ID NO: 959462 - protein, 9 aa, Homo Sapiens
FYSLGATEC

SEQ ID NO: 959463 - protein, 9 aa, Homo Sapiens
NFINVWKLS

SEQ ID NO: 959464 - protein, 9 aa, Homo Sapiens
TEKPSIPTK

SEQ ID NO: 959465 - protein, 9 aa, Homo Sapiens
LRLKDKNES

SEQ ID NO: 959466 - protein, 9 aa, Homo Sapiens
VTGYSKGYG

SEQ ID NO: 959467 - protein, 9 aa, Homo Sapiens
FTVTVPIAV

SEQ ID NO: 959468 - protein, 9 aa, Homo Sapiens
KLFEENKEM

SEQ ID NO: 959469 - protein, 9 aa, Homo Sapiens
EMDSFQTLD

SEQ ID NO: 959470 - protein, 9 aa, Homo Sapiens
ALEPSMSSS

SEQ ID NO: 959471 - protein, 9 aa, Homo Sapiens
TIISYKKGA

SEQ ID NO: 959472 - protein, 9 aa, Homo Sapiens
KKNDAGSYE

SEQ ID NO: 959473 - protein, 9 aa, Homo Sapiens
YMGSGEGRR

SEQ ID NO: 959474 - protein, 9 aa, Homo Sapiens
NPVRNLRVK

SEQ ID NO: 959475 - protein, 9 aa, Homo Sapiens
DSQTAKKWD

SEQ ID NO: 959476 - protein, 9 aa, Homo Sapiens
GYWSKSYSF

SEQ ID NO: 959477 - protein, 9 aa, Homo Sapiens
DIKGVRIAL

SEQ ID NO: 959478 - protein, 9 aa, Homo Sapiens
YKASDPHSG

SEQ ID NO: 959479 - protein, 9 aa, Homo Sapiens
RLFKRRQDR

SEQ ID NO: 959480 - protein, 9 aa, Homo Sapiens
AEYFYILDV

SEQ ID NO: 959481 - protein, 9 aa, Homo Sapiens
PLMIQILAP

SEQ ID NO: 959482 - protein, 9 aa, Homo Sapiens
IFSGDVAQQ

SEQ ID NO: 959483 - protein, 9 aa, Homo Sapiens
FALKLMSIP

SEQ ID NO: 959484 - protein, 9 aa, Homo Sapiens
TLAMYVAIQ

SEQ ID NO: 959485 - protein, 9 aa, Homo Sapiens
IRKIAVPPR

SEQ ID NO: 959486 - protein, 9 aa, Homo Sapiens
VPAAEPLPD

SEQ ID NO: 959487 - protein, 9 aa, Homo Sapiens
SEVTGYSKG

SEQ ID NO: 959488 - protein, 9 aa, Homo Sapiens
KAAGKSLAS

SEQ ID NO: 959489 - protein, 9 aa, Homo Sapiens
LYIVQCFGT

SEQ ID NO: 959490 - protein, 9 aa, Homo Sapiens
FFENSIHKD

SEQ ID NO: 959491 - protein, 9 aa, Homo Sapiens
FFPKEMPKK

SEQ ID NO: 959492 - protein, 9 aa, Homo Sapiens
PVTPLCTQP

SEQ ID NO: 959493 - protein, 9 aa, Homo Sapiens
GLGLVVKIG

SEQ ID NO: 959494 - protein, 9 aa, Homo Sapiens
APPTESACT

SEQ ID NO: 959495 - protein, 9 aa, Homo Sapiens
FSSHSESSI

SEQ ID NO: 959496 - protein, 9 aa, Homo Sapiens
KMHYPDVFT

SEQ ID NO: 959497 - protein, 9 aa, Homo Sapiens
PPVEGSLEP

SEQ ID NO: 959498 - protein, 9 aa, Homo Sapiens
TLNFINVWK

SEQ ID NO: 959499 - protein, 9 aa, Homo Sapiens
ISSYHHHFG

SEQ ID NO: 959500 - protein, 9 aa, Homo Sapiens
FLFQPVCKA

SEQ ID NO: 959501 - protein, 9 aa, Homo Sapiens
ELCQRCDTQ

SEQ ID NO: 959502 - protein, 9 aa, Homo Sapiens
IEIGVQHTL

SEQ ID NO: 959503 - protein, 9 aa, Homo Sapiens
SFPLRPFFC

SEQ ID NO: 959504 - protein, 9 aa, Homo Sapiens
PSGFSQAAS

SEQ ID NO: 959505 - protein, 9 aa, Homo Sapiens
SQFRLHLLD

SEQ ID NO: 959506 - protein, 9 aa, Homo Sapiens
ILKEHSPDK

SEQ ID NO: 959507 - protein, 9 aa, Homo Sapiens
YNQVLLFSE

SEQ ID NO: 959508 - protein, 9 aa, Homo Sapiens
FLEKVLDLD

SEQ ID NO: 959509 - protein, 9 aa, Homo Sapiens
KDFSATSGL

SEQ ID NO: 959510 - protein, 9 aa, Homo Sapiens
DKYIKRLAS

SEQ ID NO: 959511 - protein, 9 aa, Homo Sapiens
GFLSVCEME

SEQ ID NO: 959512 - protein, 9 aa, Homo Sapiens
LAAQEVHVD

SEQ ID NO: 959513 - protein, 9 aa, Homo Sapiens
SIMKAMISL

SEQ ID NO: 959514 - protein, 9 aa, Homo Sapiens
ITKQEKDFL

SEQ ID NO: 959515 - protein, 9 aa, Homo Sapiens
VVTCGFHHI

SEQ ID NO: 959516 - protein, 9 aa, Homo Sapiens
LPGAPGSSG

SEQ ID NO: 959517 - protein, 9 aa, Homo Sapiens
TGFTCAQTN

SEQ ID NO: 959518 - protein, 9 aa, Homo Sapiens
GPVSFPPAL

SEQ ID NO: 959519 - protein, 9 aa, Homo Sapiens
VFYDCNPEY

SEQ ID NO: 959520 - protein, 9 aa, Homo Sapiens
SNNDGADGM

SEQ ID NO: 959521 - protein, 9 aa, Homo Sapiens
SSYHHHFGR

SEQ ID NO: 959522 - protein, 9 aa, Homo Sapiens
FSEENNGIK

SEQ ID NO: 959523 - protein, 9 aa, Homo Sapiens
TLYSYSQLL

SEQ ID NO: 959524 - protein, 9 aa, Homo Sapiens
IHIEVRPYK

SEQ ID NO: 959525 - protein, 9 aa, Homo Sapiens
DCFGLLGVN

SEQ ID NO: 959526 - protein, 9 aa, Homo Sapiens
LKWKWKLSS

SEQ ID NO: 959527 - protein, 9 aa, Homo Sapiens
FITLYSYSQ

SEQ ID NO: 959528 - protein, 9 aa, Homo Sapiens
HKRIHIEVR

SEQ ID NO: 959529 - protein, 9 aa, Homo Sapiens
GKGRKDFSA

SEQ ID NO: 959530 - protein, 9 aa, Homo Sapiens
PPFLSFQCL

SEQ ID NO: 959531 - protein, 9 aa, Homo Sapiens
KLTRRFVGL

SEQ ID NO: 959532 - protein, 9 aa, Homo Sapiens
VQRDEPEPG

SEQ ID NO: 959533 - protein, 9 aa, Homo Sapiens
SHDCLYIVQ

SEQ ID NO: 959534 - protein, 9 aa, Homo Sapiens
EKCSRGRGL

SEQ ID NO: 959535 - protein, 9 aa, Homo Sapiens
YCEQYVSSF

SEQ ID NO: 959536 - protein, 9 aa, Homo Sapiens
LRHRFWLEE

SEQ ID NO: 959537 - protein, 9 aa, Homo Sapiens
PHERIHTGG

SEQ ID NO: 959538 - protein, 9 aa, Homo Sapiens
PGSSGQKGH

SEQ ID NO: 959539 - protein, 9 aa, Homo Sapiens
NLKCKSLRL

SEQ ID NO: 959540 - protein, 9 aa, Homo Sapiens
GIPLCHLQV

SEQ ID NO: 959541 - protein, 9 aa, Homo Sapiens
PGLLIMTVV

SEQ ID NO: 959542 - protein, 9 aa, Homo Sapiens
GSSFSSDSF

SEQ ID NO: 959543 - protein, 9 aa, Homo Sapiens
GLCTATTEE

SEQ ID NO: 959544 - protein, 9 aa, Homo Sapiens
RDVGLGINL

SEQ ID NO: 959545 - protein, 9 aa, Homo Sapiens
WVFSRISSQ

SEQ ID NO: 959546 - protein, 9 aa, Homo Sapiens
GGNPKSHVY

SEQ ID NO: 959547 - protein, 9 aa, Homo Sapiens
LERAFQKMH

SEQ ID NO: 959548 - protein, 9 aa, Homo Sapiens
ADPAIPEDV

SEQ ID NO: 959549 - protein, 9 aa, Homo Sapiens
ESYLSLALK

SEQ ID NO: 959550 - protein, 9 aa, Homo Sapiens
PFLSFQCLQ

SEQ ID NO: 959551 - protein, 9 aa, Homo Sapiens
TLLSVKKND

SEQ ID NO: 959552 - protein, 9 aa, Homo Sapiens
SSNTEGQST

SEQ ID NO: 959553 - protein, 9 aa, Homo Sapiens
SATDKTKNC

SEQ ID NO: 959554 - protein, 9 aa, Homo Sapiens
LTNKKKMGF

SEQ ID NO: 959555 - protein, 9 aa, Homo Sapiens
FGTFRSWFA

SEQ ID NO: 959556 - protein, 9 aa, Homo Sapiens
TFKCWQHSY

SEQ ID NO: 959557 - protein, 9 aa, Homo Sapiens
KGRKDFSAT

SEQ ID NO: 959558 - protein, 9 aa, Homo Sapiens
RQLLKWIDT

SEQ ID NO: 959559 - protein, 9 aa, Homo Sapiens
GKILEIEDM

SEQ ID NO: 959560 - protein, 9 aa, Homo Sapiens
EQYVSSFCK

SEQ ID NO: 959561 - protein, 9 aa, Homo Sapiens
RGEIVLKIY

SEQ ID NO: 959562 - protein, 9 aa, Homo Sapiens
SEMDFPEHK

SEQ ID NO: 959563 - protein, 9 aa, Homo Sapiens
KKKRELQFR

SEQ ID NO: 959564 - protein, 9 aa, Homo Sapiens
LVTEKGKRH

SEQ ID NO: 959565 - protein, 9 aa, Homo Sapiens
LRYQMHWKD

SEQ ID NO: 959566 - protein, 9 aa, Homo Sapiens
IVLGQEQNS

SEQ ID NO: 959567 - protein, 9 aa, Homo Sapiens
GGIIDESLR

SEQ ID NO: 959568 - protein, 9 aa, Homo Sapiens
DGHFLQESL

SEQ ID NO: 959569 - protein, 9 aa, Homo Sapiens
RWECNWPHS

SEQ ID NO: 959570 - protein, 9 aa, Homo Sapiens
HETSSFKSS

SEQ ID NO: 959571 - protein, 9 aa, Homo Sapiens
HYATIMNQP

SEQ ID NO: 959572 - protein, 9 aa, Homo Sapiens
LFQPVCKAE

SEQ ID NO: 959573 - protein, 9 aa, Homo Sapiens
KYMKQQYEE

SEQ ID NO: 959574 - protein, 9 aa, Homo Sapiens
GKLFSQIYS

SEQ ID NO: 959575 - protein, 9 aa, Homo Sapiens
QIPIFEKLD

SEQ ID NO: 959576 - protein, 9 aa, Homo Sapiens
ARSVRGRGL

SEQ ID NO: 959577 - protein, 9 aa, Homo Sapiens
SKSYSFLVL

SEQ ID NO: 959578 - protein, 9 aa, Homo Sapiens
KKRELQFRR

SEQ ID NO: 959579 - protein, 9 aa, Homo Sapiens
SELKRKLTK

SEQ ID NO: 959580 - protein, 9 aa, Homo Sapiens
FEIIIRYSP

SEQ ID NO: 959581 - protein, 9 aa, Homo Sapiens
GNELFCSGV

SEQ ID NO: 959582 - protein, 9 aa, Homo Sapiens
AEMIVKFPG

SEQ ID NO: 959583 - protein, 9 aa, Homo Sapiens
MPGSENLRK

SEQ ID NO: 959584 - protein, 9 aa, Homo Sapiens
VPPVPSRPG

SEQ ID NO: 959585 - protein, 9 aa, Homo Sapiens
EGLTFLWVN

SEQ ID NO: 959586 - protein, 9 aa, Homo Sapiens
LSNQELFCW

SEQ ID NO: 959587 - protein, 9 aa, Homo Sapiens
AFSHRIFLT

SEQ ID NO: 959588 - protein, 9 aa, Homo Sapiens
LFVQCGTLL

SEQ ID NO: 959589 - protein, 9 aa, Homo Sapiens
SFNFNSQNG

SEQ ID NO: 959590 - protein, 9 aa, Homo Sapiens
KKRPFSCRL

SEQ ID NO: 959591 - protein, 9 aa, Homo Sapiens
FLWVNGELA

SEQ ID NO: 959592 - protein, 9 aa, Homo Sapiens
YVTQRNCSL

SEQ ID NO: 959593 - protein, 9 aa, Homo Sapiens
FTGGMFDFN

SEQ ID NO: 959594 - protein, 9 aa, Homo Sapiens
DPLDILTMI

SEQ ID NO: 959595 - protein, 9 aa, Homo Sapiens
HLAYEKKCI

SEQ ID NO: 959596 - protein, 9 aa, Homo Sapiens
LTSMAYDCY

SEQ ID NO: 959597 - protein, 9 aa, Homo Sapiens
SGGKDVRKT

SEQ ID NO: 959598 - protein, 9 aa, Homo Sapiens
GPAFDSTVE

SEQ ID NO: 959599 - protein, 9 aa, Homo Sapiens
SQSGAAYIG

SEQ ID NO: 959600 - protein, 9 aa, Homo Sapiens
QPVAVRPSL

SEQ ID NO: 959601 - protein, 9 aa, Homo Sapiens
GTDITLNSK

SEQ ID NO: 959602 - protein, 9 aa, Homo Sapiens
FQFIFKRHH

SEQ ID NO: 959603 - protein, 9 aa, Homo Sapiens
LVGQGQSSW

SEQ ID NO: 959604 - protein, 9 aa, Homo Sapiens
NPLHKVVVC

SEQ ID NO: 959605 - protein, 9 aa, Homo Sapiens
SQIFESSSL

SEQ ID NO: 959606 - protein, 9 aa, Homo Sapiens
TSHEKNWSF

SEQ ID NO: 959607 - protein, 9 aa, Homo Sapiens
GSENLRKGK

SEQ ID NO: 959608 - protein, 9 aa, Homo Sapiens
VIKMSKFEA

SEQ ID NO: 959609 - protein, 9 aa, Homo Sapiens
VFSRISSQM

SEQ ID NO: 959610 - protein, 9 aa, Homo Sapiens
LTRRFVGLR

SEQ ID NO: 959611 - protein, 9 aa, Homo Sapiens
FTPQMPCSV

SEQ ID NO: 959612 - protein, 9 aa, Homo Sapiens
YAAVKHSRP

SEQ ID NO: 959613 - protein, 9 aa, Homo Sapiens
NNPSFEIPA

SEQ ID NO: 959614 - protein, 9 aa, Homo Sapiens
NLDLAFNSN

SEQ ID NO: 959615 - protein, 9 aa, Homo Sapiens
GCESPDPDF

SEQ ID NO: 959616 - protein, 9 aa, Homo Sapiens
SFEEDDYER

SEQ ID NO: 959617 - protein, 9 aa, Homo Sapiens
ESPPQDKHL

SEQ ID NO: 959618 - protein, 9 aa, Homo Sapiens
GTFRSWFAN

SEQ ID NO: 959619 - protein, 9 aa, Homo Sapiens
RNETVCAPG

SEQ ID NO: 959620 - protein, 9 aa, Homo Sapiens
GSPGPPGMP

SEQ ID NO: 959621 - protein, 9 aa, Homo Sapiens
LGTELLLLL

SEQ ID NO: 959622 - protein, 9 aa, Homo Sapiens
INLFADGMG

SEQ ID NO: 959623 - protein, 9 aa, Homo Sapiens
KDEKVRIKT

SEQ ID NO: 959624 - protein, 9 aa, Homo Sapiens
IFHPSEKIP

SEQ ID NO: 959625 - protein, 9 aa, Homo Sapiens
ALRSPGPRS

SEQ ID NO: 959626 - protein, 9 aa, Homo Sapiens
WKPRVSPPA

SEQ ID NO: 959627 - protein, 9 aa, Homo Sapiens
KGVRIALDA

SEQ ID NO: 959628 - protein, 9 aa, Homo Sapiens
SACTADKPT

SEQ ID NO: 959629 - protein, 9 aa, Homo Sapiens
RSASCLSIS

SEQ ID NO: 959630 - protein, 9 aa, Homo Sapiens
KFISSYHHH

SEQ ID NO: 959631 - protein, 9 aa, Homo Sapiens
DITLNSKKS

SEQ ID NO: 959632 - protein, 9 aa, Homo Sapiens
VTEPATCFP

SEQ ID NO: 959633 - protein, 9 aa, Homo Sapiens
DVGLGINLF

SEQ ID NO: 959634 - protein, 9 aa, Homo Sapiens
DVSYLSQYF

SEQ ID NO: 959635 - protein, 9 aa, Homo Sapiens
GLSIQNELL

SEQ ID NO: 959636 - protein, 9 aa, Homo Sapiens
VLTIPVSIS

SEQ ID NO: 959637 - protein, 9 aa, Homo Sapiens
CEEGGIIDE

SEQ ID NO: 959638 - protein, 9 aa, Homo Sapiens
PSPPFVKKT

SEQ ID NO: 959639 - protein, 9 aa, Homo Sapiens
FLDTVTLHF

SEQ ID NO: 959640 - protein, 9 aa, Homo Sapiens
KDEKELEGS

SEQ ID NO: 959641 - protein, 9 aa, Homo Sapiens
GILKNVTEL

SEQ ID NO: 959642 - protein, 9 aa, Homo Sapiens
DSRTSKLTL

SEQ ID NO: 959643 - protein, 9 aa, Homo Sapiens
DTFFYSYFW

SEQ ID NO: 959644 - protein, 9 aa, Homo Sapiens
EEGGIIDES

SEQ ID NO: 959645 - protein, 9 aa, Homo Sapiens
LALGTELLL

SEQ ID NO: 959646 - protein, 9 aa, Homo Sapiens
FLDKILVAA

SEQ ID NO: 959647 - protein, 9 aa, Homo Sapiens
SKDAVFDGS

SEQ ID NO: 959648 - protein, 9 aa, Homo Sapiens
SARQLLKWI

SEQ ID NO: 959649 - protein, 9 aa, Homo Sapiens
PIFKQFFKN

SEQ ID NO: 959650 - protein, 9 aa, Homo Sapiens
AVAAVFCVF

SEQ ID NO: 959651 - protein, 9 aa, Homo Sapiens
KFNCISIEE

SEQ ID NO: 959652 - protein, 9 aa, Homo Sapiens
GEIVLKIYF

SEQ ID NO: 959653 - protein, 9 aa, Homo Sapiens
SEFEKMLQV

SEQ ID NO: 959654 - protein, 9 aa, Homo Sapiens
DAFENIYPI

SEQ ID NO: 959655 - protein, 9 aa, Homo Sapiens
VSSFCKMSR

SEQ ID NO: 959656 - protein, 9 aa, Homo Sapiens
NVAKEVRPL

SEQ ID NO: 959657 - protein, 9 aa, Homo Sapiens
VLDLDDFLW

SEQ ID NO: 959658 - protein, 9 aa, Homo Sapiens
NAADLQNLA

SEQ ID NO: 959659 - protein, 9 aa, Homo Sapiens
GGFDVFIQG

SEQ ID NO: 959660 - protein, 9 aa, Homo Sapiens
SHRIFLTRH

SEQ ID NO: 959661 - protein, 9 aa, Homo Sapiens
HIEFLFQPV

SEQ ID NO: 959662 - protein, 9 aa, Homo Sapiens
QNTLYLFLT

SEQ ID NO: 959663 - protein, 9 aa, Homo Sapiens
LDCAHEEFQ

SEQ ID NO: 959664 - protein, 9 aa, Homo Sapiens
HNANFIPTV

SEQ ID NO: 959665 - protein, 9 aa, Homo Sapiens
FLMALSENA

SEQ ID NO: 959666 - protein, 9 aa, Homo Sapiens
LDSKLHNPM

SEQ ID NO: 959667 - protein, 9 aa, Homo Sapiens
PSACVVETE

SEQ ID NO: 959668 - protein, 9 aa, Homo Sapiens
TFEKREEWL

SEQ ID NO: 959669 - protein, 9 aa, Homo Sapiens
QRNCSLTQI

SEQ ID NO: 959670 - protein, 9 aa, Homo Sapiens
SRAGVQRDE

SEQ ID NO: 959671 - protein, 9 aa, Homo Sapiens
PNFVQALEH

SEQ ID NO: 959672 - protein, 9 aa, Homo Sapiens
DFSYALTPR

SEQ ID NO: 959673 - protein, 9 aa, Homo Sapiens
LEGKVDDEE

SEQ ID NO: 959674 - protein, 9 aa, Homo Sapiens
RSGIKIKLG

SEQ ID NO: 959675 - protein, 9 aa, Homo Sapiens
NSKKSPRSC

SEQ ID NO: 959676 - protein, 9 aa, Homo Sapiens
RPLVSQTDI

SEQ ID NO: 959677 - protein, 9 aa, Homo Sapiens
SLLDYEGIK

SEQ ID NO: 959678 - protein, 9 aa, Homo Sapiens
HSAPTTPVS

SEQ ID NO: 959679 - protein, 9 aa, Homo Sapiens
VKPSWVILF

SEQ ID NO: 959680 - protein, 9 aa, Homo Sapiens
GVPPVPSRP

SEQ ID NO: 959681 - protein, 9 aa, Homo Sapiens
IIIHVSGGK

SEQ ID NO: 959682 - protein, 9 aa, Homo Sapiens
IKKAFSSHS

SEQ ID NO: 959683 - protein, 9 aa, Homo Sapiens
YPERLQHYI

SEQ ID NO: 959684 - protein, 9 aa, Homo Sapiens
LKLMSIPDV

SEQ ID NO: 959685 - protein, 9 aa, Homo Sapiens
PSSFSFPLR

SEQ ID NO: 959686 - protein, 9 aa, Homo Sapiens
PSIPTKKPT

SEQ ID NO: 959687 - protein, 9 aa, Homo Sapiens
VEPRTPWVF

SEQ ID NO: 959688 - protein, 9 aa, Homo Sapiens
KNATRVALL

SEQ ID NO: 959689 - protein, 9 aa, Homo Sapiens
LTVGDAGLN

SEQ ID NO: 959690 - protein, 9 aa, Homo Sapiens
KKKMGFQQF

SEQ ID NO: 959691 - protein, 9 aa, Homo Sapiens
SFYSASKKE

SEQ ID NO: 959692 - protein, 9 aa, Homo Sapiens
QSTTKKVLL

SEQ ID NO: 959693 - protein, 9 aa, Homo Sapiens
QAALVMGNE

SEQ ID NO: 959694 - protein, 9 aa, Homo Sapiens
GFKHTATGD

SEQ ID NO: 959695 - protein, 9 aa, Homo Sapiens
HDCLYIVQC

SEQ ID NO: 959696 - protein, 9 aa, Homo Sapiens
ELRNETVCA

SEQ ID NO: 959697 - protein, 9 aa, Homo Sapiens
PAAEPLPDT

SEQ ID NO: 959698 - protein, 9 aa, Homo Sapiens
VSSRFSEVR

SEQ ID NO: 959699 - protein, 9 aa, Homo Sapiens
PQAVTYAAV

SEQ ID NO: 959700 - protein, 9 aa, Homo Sapiens
SILATGGID

SEQ ID NO: 959701 - protein, 9 aa, Homo Sapiens
TQYSLHCKL

SEQ ID NO: 959702 - protein, 9 aa, Homo Sapiens
IFKRHHGFP

SEQ ID NO: 959703 - protein, 9 aa, Homo Sapiens
EQRKRRKFM

SEQ ID NO: 959704 - protein, 9 aa, Homo Sapiens
ECGKSFYQS

SEQ ID NO: 959705 - protein, 9 aa, Homo Sapiens
KVLEDHGEW

SEQ ID NO: 959706 - protein, 9 aa, Homo Sapiens
IFCKVRFSF

SEQ ID NO: 959707 - protein, 9 aa, Homo Sapiens
AIARRPTVG

SEQ ID NO: 959708 - protein, 9 aa, Homo Sapiens
DDDILNESS

SEQ ID NO: 959709 - protein, 9 aa, Homo Sapiens
PLCHLQVDG

SEQ ID NO: 959710 - protein, 9 aa, Homo Sapiens
TGGMFDFNY

SEQ ID NO: 959711 - protein, 9 aa, Homo Sapiens
FSFPLRPFF

SEQ ID NO: 959712 - protein, 9 aa, Homo Sapiens
EKTESSRRP

SEQ ID NO: 959713 - protein, 9 aa, Homo Sapiens
AWDSQTAKK

SEQ ID NO: 959714 - protein, 9 aa, Homo Sapiens
RLSALEVFV

SEQ ID NO: 959715 - protein, 9 aa, Homo Sapiens
KKDREICRL

SEQ ID NO: 959716 - protein, 9 aa, Homo Sapiens
SPSFPLLSA

SEQ ID NO: 959717 - protein, 9 aa, Homo Sapiens
EVSCSGPLF

SEQ ID NO: 959718 - protein, 9 aa, Homo Sapiens
NRRQSTTKK

SEQ ID NO: 959719 - protein, 9 aa, Homo Sapiens
IDSNWWVLK

SEQ ID NO: 959720 - protein, 9 aa, Homo Sapiens
CYHLLSEEY

SEQ ID NO: 959721 - protein, 9 aa, Homo Sapiens
PPFVKKTSP

SEQ ID NO: 959722 - protein, 9 aa, Homo Sapiens
EQAKEQEDW

SEQ ID NO: 959723 - protein, 9 aa, Homo Sapiens
VGETGSEDQ

SEQ ID NO: 959724 - protein, 9 aa, Homo Sapiens
ISVPQFPID

SEQ ID NO: 959725 - protein, 9 aa, Homo Sapiens
LFATGSYVS

SEQ ID NO: 959726 - protein, 9 aa, Homo Sapiens
GKAFLVRSS

SEQ ID NO: 959727 - protein, 9 aa, Homo Sapiens
HSPMAEHML

SEQ ID NO: 959728 - protein, 9 aa, Homo Sapiens
ILKNVTELY

SEQ ID NO: 959729 - protein, 9 aa, Homo Sapiens
SFINNPSFT

SEQ ID NO: 959730 - protein, 9 aa, Homo Sapiens
CNDLGEDCT

SEQ ID NO: 959731 - protein, 9 aa, Homo Sapiens
PDSNNVDSN

SEQ ID NO: 959732 - protein, 9 aa, Homo Sapiens
LPPGKEMEL

SEQ ID NO: 959733 - protein, 9 aa, Homo Sapiens
CIHKKTCKE

SEQ ID NO: 959734 - protein, 9 aa, Homo Sapiens
NIALTVGFK

SEQ ID NO: 959735 - protein, 9 aa, Homo Sapiens
QESLRLSAQ

SEQ ID NO: 959736 - protein, 9 aa, Homo Sapiens
ENNLTEDNS

SEQ ID NO: 959737 - protein, 9 aa, Homo Sapiens
NMTSEFEKM

SEQ ID NO: 959738 - protein, 9 aa, Homo Sapiens
IHCCTKCRL

SEQ ID NO: 959739 - protein, 9 aa, Homo Sapiens
PAGSLHSLV

SEQ ID NO: 959740 - protein, 9 aa, Homo Sapiens
ESSQSGAAY

SEQ ID NO: 959741 - protein, 9 aa, Homo Sapiens
KPGLKGKAG

SEQ ID NO: 959742 - protein, 9 aa, Homo Sapiens
GPLMIQILA

SEQ ID NO: 959743 - protein, 9 aa, Homo Sapiens
SLIDGLTRN

SEQ ID NO: 959744 - protein, 9 aa, Homo Sapiens
LLFLCCVSC

SEQ ID NO: 959745 - protein, 9 aa, Homo Sapiens
IMKAMISLL

SEQ ID NO: 959746 - protein, 9 aa, Homo Sapiens
SGILERCVL

SEQ ID NO: 959747 - protein, 9 aa, Homo Sapiens
NNGAINPEL

SEQ ID NO: 959748 - protein, 9 aa, Homo Sapiens
ALYLKLYYP

SEQ ID NO: 959749 - protein, 9 aa, Homo Sapiens
VAAVFCVFL

SEQ ID NO: 959750 - protein, 9 aa, Homo Sapiens
LGYWSKSYS

SEQ ID NO: 959751 - protein, 9 aa, Homo Sapiens
CQRNYGAVE

SEQ ID NO: 959752 - protein, 9 aa, Homo Sapiens
PSEVSMPIS

SEQ ID NO: 959753 - protein, 9 aa, Homo Sapiens
TPEQEETAF

SEQ ID NO: 959754 - protein, 9 aa, Homo Sapiens
QGSLENTYR

SEQ ID NO: 959755 - protein, 9 aa, Homo Sapiens
RPGLFWLNI

SEQ ID NO: 959756 - protein, 9 aa, Homo Sapiens
TPRIMHSSY

SEQ ID NO: 959757 - protein, 9 aa, Homo Sapiens
EGKVDDEES

SEQ ID NO: 959758 - protein, 9 aa, Homo Sapiens
PVQFIQGKL

SEQ ID NO: 959759 - protein, 9 aa, Homo Sapiens
ASSDPLDIL

SEQ ID NO: 959760 - protein, 9 aa, Homo Sapiens
GRKGPEDAS

SEQ ID NO: 959761 - protein, 9 aa, Homo Sapiens
FCKVRFSFE

SEQ ID NO: 959762 - protein, 9 aa, Homo Sapiens
RKKLQSLRN

SEQ ID NO: 959763 - protein, 9 aa, Homo Sapiens
CQDCIHKKT

SEQ ID NO: 959764 - protein, 9 aa, Homo Sapiens
YLKMYSTYF

SEQ ID NO: 959765 - protein, 9 aa, Homo Sapiens
AARPEQDPP

SEQ ID NO: 959766 - protein, 9 aa, Homo Sapiens
RAFQKMHYP

SEQ ID NO: 959767 - protein, 9 aa, Homo Sapiens
FTFLCDPWN

SEQ ID NO: 959768 - protein, 9 aa, Homo Sapiens
EGVLLDNGS

SEQ ID NO: 959769 - protein, 9 aa, Homo Sapiens
VQNMLAQEA

SEQ ID NO: 959770 - protein, 9 aa, Homo Sapiens
PAAPAPAKH

SEQ ID NO: 959771 - protein, 9 aa, Homo Sapiens
CSDPVFPTT

SEQ ID NO: 959772 - protein, 9 aa, Homo Sapiens
GLSLLRSSE

SEQ ID NO: 959773 - protein, 9 aa, Homo Sapiens
QLETSGKLK

SEQ ID NO: 959774 - protein, 9 aa, Homo Sapiens
IKTIFHPSE

SEQ ID NO: 959775 - protein, 9 aa, Homo Sapiens
CARQDNVFK

SEQ ID NO: 959776 - protein, 9 aa, Homo Sapiens
AGFLSVCEM

SEQ ID NO: 959777 - protein, 9 aa, Homo Sapiens
CPECGKLFS

SEQ ID NO: 959778 - protein, 9 aa, Homo Sapiens
ECNDLGEDC

SEQ ID NO: 959779 - protein, 9 aa, Homo Sapiens
NWRDKDQSD

SEQ ID NO: 959780 - protein, 9 aa, Homo Sapiens
LAIFSRVSS

SEQ ID NO: 959781 - protein, 9 aa, Homo Sapiens
LRSPGPRSS

SEQ ID NO: 959782 - protein, 9 aa, Homo Sapiens
CVAAIFGTF

SEQ ID NO: 959783 - protein, 9 aa, Homo Sapiens
LPGKQSLLA

SEQ ID NO: 959784 - protein, 9 aa, Homo Sapiens
SINSKTKIL

SEQ ID NO: 959785 - protein, 9 aa, Homo Sapiens
NGHRHALRL

SEQ ID NO: 959786 - protein, 9 aa, Homo Sapiens
LWSLWRRPF

SEQ ID NO: 959787 - protein, 9 aa, Homo Sapiens
TLNSKKSPR

SEQ ID NO: 959788 - protein, 9 aa, Homo Sapiens
PPSSFSFPL

SEQ ID NO: 959789 - protein, 9 aa, Homo Sapiens
GTLPLAIFS

SEQ ID NO: 959790 - protein, 9 aa, Homo Sapiens
LLFSESPQG

SEQ ID NO: 959791 - protein, 9 aa, Homo Sapiens
VVCNHHGNL

SEQ ID NO: 959792 - protein, 9 aa, Homo Sapiens
SNGFGSKDA

SEQ ID NO: 959793 - protein, 9 aa, Homo Sapiens
ETQSLTRNK

SEQ ID NO: 959794 - protein, 9 aa, Homo Sapiens
CVLYMSNHT

SEQ ID NO: 959795 - protein, 9 aa, Homo Sapiens
ILSFYSASK

SEQ ID NO: 959796 - protein, 9 aa, Homo Sapiens
ARPAGTGAG

SEQ ID NO: 959797 - protein, 9 aa, Homo Sapiens
MEDIKKAFS

SEQ ID NO: 959798 - protein, 9 aa, Homo Sapiens
LPQEMDSFQ

SEQ ID NO: 959799 - protein, 9 aa, Homo Sapiens
WSLRVIDKK

SEQ ID NO: 959800 - protein, 9 aa, Homo Sapiens
MPISEETLF

SEQ ID NO: 959801 - protein, 9 aa, Homo Sapiens
TTPVSPTTA

SEQ ID NO: 959802 - protein, 9 aa, Homo Sapiens
QRTMYCRHH

SEQ ID NO: 959803 - protein, 9 aa, Homo Sapiens
TYLDSKLHN

SEQ ID NO: 959804 - protein, 9 aa, Homo Sapiens
LEKQPERAG

SEQ ID NO: 959805 - protein, 9 aa, Homo Sapiens
DFGLVRTAC

SEQ ID NO: 959806 - protein, 9 aa, Homo Sapiens
RTSKLTLKN

SEQ ID NO: 959807 - protein, 9 aa, Homo Sapiens
GSLHSLVGV

SEQ ID NO: 959808 - protein, 9 aa, Homo Sapiens
MKFDKYIKR

SEQ ID NO: 959809 - protein, 9 aa, Homo Sapiens
GSQFESSQS

SEQ ID NO: 959810 - protein, 9 aa, Homo Sapiens
QSLTRNKKK

SEQ ID NO: 959811 - protein, 9 aa, Homo Sapiens
HLAAQEVHV

SEQ ID NO: 959812 - protein, 9 aa, Homo Sapiens
KKAAGKSLA

SEQ ID NO: 959813 - protein, 9 aa, Homo Sapiens
SALEPSMSS

SEQ ID NO: 959814 - protein, 9 aa, Homo Sapiens
DAASPFWKA

SEQ ID NO: 959815 - protein, 9 aa, Homo Sapiens
HEKNWSFYP

SEQ ID NO: 959816 - protein, 9 aa, Homo Sapiens
LLSGASTKW

SEQ ID NO: 959817 - protein, 9 aa, Homo Sapiens
DSNNVDSND

SEQ ID NO: 959818 - protein, 9 aa, Homo Sapiens
ENNGIKRQK

SEQ ID NO: 959819 - protein, 9 aa, Homo Sapiens
STVHSSVAN

SEQ ID NO: 959820 - protein, 9 aa, Homo Sapiens
STELSEGSR

SEQ ID NO: 959821 - protein, 9 aa, Homo Sapiens
VLDKAFGPK

SEQ ID NO: 959822 - protein, 9 aa, Homo Sapiens
SVQNLPIQK

SEQ ID NO: 959823 - protein, 9 aa, Homo Sapiens
QQVSELKRK

SEQ ID NO: 959824 - protein, 9 aa, Homo Sapiens
VCDCSDPVF

SEQ ID NO: 959825 - protein, 9 aa, Homo Sapiens
CSLCRKPFL

SEQ ID NO: 959826 - protein, 9 aa, Homo Sapiens
LFCWQIWKQ

SEQ ID NO: 959827 - protein, 9 aa, Homo Sapiens
VVLFYGSEI

SEQ ID NO: 959828 - protein, 9 aa, Homo Sapiens
ALFATGSYV

SEQ ID NO: 959829 - protein, 9 aa, Homo Sapiens
EMDFPEHKE

SEQ ID NO: 959830 - protein, 9 aa, Homo Sapiens
STLKNHLCL

SEQ ID NO: 959831 - protein, 9 aa, Homo Sapiens
VLHFDQVTK

SEQ ID NO: 959832 - protein, 9 aa, Homo Sapiens
GSEDQAGGE

SEQ ID NO: 959833 - protein, 9 aa, Homo Sapiens
KCSRGRGLC

SEQ ID NO: 959834 - protein, 9 aa, Homo Sapiens
KGELASTQS

SEQ ID NO: 959835 - protein, 9 aa, Homo Sapiens
ATRVALLEQ

SEQ ID NO: 959836 - protein, 9 aa, Homo Sapiens
TGRSDMQKH

SEQ ID NO: 959837 - protein, 9 aa, Homo Sapiens
GQSSWPRTS

SEQ ID NO: 959838 - protein, 9 aa, Homo Sapiens
RQMMEMVGM

SEQ ID NO: 959839 - protein, 9 aa, Homo Sapiens
GLPGAPGSS

SEQ ID NO: 959840 - protein, 9 aa, Homo Sapiens
LSARQLLKW

SEQ ID NO: 959841 - protein, 9 aa, Homo Sapiens
SSLEALSSG

SEQ ID NO: 959842 - protein, 9 aa, Homo Sapiens
SQPVAVRPS

SEQ ID NO: 959843 - protein, 9 aa, Homo Sapiens
NQHQVGEAI

SEQ ID NO: 959844 - protein, 9 aa, Homo Sapiens
RSVRGRGLL

SEQ ID NO: 959845 - protein, 9 aa, Homo Sapiens
DKSGAAPPS

SEQ ID NO: 959846 - protein, 9 aa, Homo Sapiens
MHFSSSISS

SEQ ID NO: 959847 - protein, 9 aa, Homo Sapiens
ALAEYFYIL

SEQ ID NO: 959848 - protein, 9 aa, Homo Sapiens
KVRIKTLSL

SEQ ID NO: 959849 - protein, 9 aa, Homo Sapiens
FISSYHHHF

SEQ ID NO: 959850 - protein, 9 aa, Homo Sapiens
SPGPPGMPG

SEQ ID NO: 959851 - protein, 9 aa, Homo Sapiens
SVVELRVGE

SEQ ID NO: 959852 - protein, 9 aa, Homo Sapiens
NESVQNLPI

SEQ ID NO: 959853 - protein, 9 aa, Homo Sapiens
RAGDYKMAA

SEQ ID NO: 959854 - protein, 9 aa, Homo Sapiens
GLALGTELL

SEQ ID NO: 959855 - protein, 9 aa, Homo Sapiens
GELSARQLL

SEQ ID NO: 959856 - protein, 9 aa, Homo Sapiens
NQVPTAMSL

SEQ ID NO: 959857 - protein, 9 aa, Homo Sapiens
DGRMKFDKY

SEQ ID NO: 959858 - protein, 9 aa, Homo Sapiens
FSPSFPLLS

SEQ ID NO: 959859 - protein, 9 aa, Homo Sapiens
PRTRRLSSR

SEQ ID NO: 959860 - protein, 9 aa, Homo Sapiens
NPKSHVYWK

SEQ ID NO: 959861 - protein, 9 aa, Homo Sapiens
LSRQFLHTN

SEQ ID NO: 959862 - protein, 9 aa, Homo Sapiens
FEKREEWLT

SEQ ID NO: 959863 - protein, 9 aa, Homo Sapiens
IQFLLGYWS

SEQ ID NO: 959864 - protein, 9 aa, Homo Sapiens
EEGLTFLWV

SEQ ID NO: 959865 - protein, 9 aa, Homo Sapiens
PPGKEMELV

SEQ ID NO: 959866 - protein, 9 aa, Homo Sapiens
LDLDDFLWK

SEQ ID NO: 959867 - protein, 9 aa, Homo Sapiens
PFGQGNFYY

SEQ ID NO: 959868 - protein, 9 aa, Homo Sapiens
VGMYSLDKP

SEQ ID NO: 959869 - protein, 9 aa, Homo Sapiens
NTLAMYVAI

SEQ ID NO: 959870 - protein, 9 aa, Homo Sapiens
AIFGTFRSW

SEQ ID NO: 959871 - protein, 9 aa, Homo Sapiens
FLFGAPRFR

SEQ ID NO: 959872 - protein, 9 aa, Homo Sapiens
PFECNDLGE

SEQ ID NO: 959873 - protein, 9 aa, Homo Sapiens
KISGILERC

SEQ ID NO: 959874 - protein, 9 aa, Homo Sapiens
VNPCALDFH

SEQ ID NO: 959875 - protein, 9 aa, Homo Sapiens
SRQFLHTNA

SEQ ID NO: 959876 - protein, 9 aa, Homo Sapiens
QEVHVDMVS

SEQ ID NO: 959877 - protein, 9 aa, Homo Sapiens
YDCNPEYFL

SEQ ID NO: 959878 - protein, 9 aa, Homo Sapiens
MFADTQLEL

SEQ ID NO: 959879 - protein, 9 aa, Homo Sapiens
TTKKVLLSY

SEQ ID NO: 959880 - protein, 9 aa, Homo Sapiens
KSLHIDDIR

SEQ ID NO: 959881 - protein, 9 aa, Homo Sapiens
ALLYLPGKQ

SEQ ID NO: 959882 - protein, 9 aa, Homo Sapiens
QDCIHKKTC

SEQ ID NO: 959883 - protein, 9 aa, Homo Sapiens
FKNWRDKDQ

SEQ ID NO: 959884 - protein, 9 aa, Homo Sapiens
VVVLFYGSE

SEQ ID NO: 959885 - protein, 9 aa, Homo Sapiens
TLFPISGPV

SEQ ID NO: 959886 - protein, 9 aa, Homo Sapiens
SLNVQTGNN

SEQ ID NO: 959887 - protein, 9 aa, Homo Sapiens
DCYHHSSLV

SEQ ID NO: 959888 - protein, 9 aa, Homo Sapiens
LLQIYFFYS

SEQ ID NO: 959889 - protein, 9 aa, Homo Sapiens
TGIDSNWWV

SEQ ID NO: 959890 - protein, 9 aa, Homo Sapiens
LAMYVAIQA

SEQ ID NO: 959891 - protein, 9 aa, Homo Sapiens
LSSTPQSQG

SEQ ID NO: 959892 - protein, 9 aa, Homo Sapiens
NMFTPQMPC

SEQ ID NO: 959893 - protein, 9 aa, Homo Sapiens
GLYFHCRAL

SEQ ID NO: 959894 - protein, 9 aa, Homo Sapiens
VKQFRARPA

SEQ ID NO: 959895 - protein, 9 aa, Homo Sapiens
FVSSNTEGQ

SEQ ID NO: 959896 - protein, 9 aa, Homo Sapiens
LKNHLCLHT

SEQ ID NO: 959897 - protein, 9 aa, Homo Sapiens
PAFDSTVES

SEQ ID NO: 959898 - protein, 9 aa, Homo Sapiens
ILDFGLVRT

SEQ ID NO: 959899 - protein, 9 aa, Homo Sapiens
PGPGSQIEK

SEQ ID NO: 959900 - protein, 9 aa, Homo Sapiens
QLHETSSFK

SEQ ID NO: 959901 - protein, 9 aa, Homo Sapiens
TVCDCSDPV

SEQ ID NO: 959902 - protein, 9 aa, Homo Sapiens
KIKLGQPSI

SEQ ID NO: 959903 - protein, 9 aa, Homo Sapiens
FLNKLMGRT

SEQ ID NO: 959904 - protein, 9 aa, Homo Sapiens
SLSATFLFS

SEQ ID NO: 959905 - protein, 9 aa, Homo Sapiens
TMKKTPSYF

SEQ ID NO: 959906 - protein, 9 aa, Homo Sapiens
NLQQKKNLE

SEQ ID NO: 959907 - protein, 9 aa, Homo Sapiens
RLSSLEALS

SEQ ID NO: 959908 - protein, 9 aa, Homo Sapiens
YSASKKEQE

SEQ ID NO: 959909 - protein, 9 aa, Homo Sapiens
ILEEDGPAF

SEQ ID NO: 959910 - protein, 9 aa, Homo Sapiens
VKAQTTSSI

SEQ ID NO: 959911 - protein, 9 aa, Homo Sapiens
ENPGIPNYG

SEQ ID NO: 959912 - protein, 9 aa, Homo Sapiens
VETDTSGLR

SEQ ID NO: 959913 - protein, 9 aa, Homo Sapiens
LERCVLYMS

SEQ ID NO: 959914 - protein, 9 aa, Homo Sapiens
MDKDEKVRI

SEQ ID NO: 959915 - protein, 9 aa, Homo Sapiens
RFSEVRVLF

SEQ ID NO: 959916 - protein, 9 aa, Homo Sapiens
TGEKLYACG

SEQ ID NO: 959917 - protein, 9 aa, Homo Sapiens
LKGKAGAIG

SEQ ID NO: 959918 - protein, 9 aa, Homo Sapiens
DEKELEGSG

SEQ ID NO: 959919 - protein, 9 aa, Homo Sapiens
LPSRKCRAG

SEQ ID NO: 959920 - protein, 9 aa, Homo Sapiens
LDFGLVRTA

SEQ ID NO: 959921 - protein, 9 aa, Homo Sapiens
SYRSQPAFM

SEQ ID NO: 959922 - protein, 9 aa, Homo Sapiens
KTESSRRPP

SEQ ID NO: 959923 - protein, 9 aa, Homo Sapiens
EVHVDMVSL

SEQ ID NO: 959924 - protein, 9 aa, Homo Sapiens
DIEIGVQHT

SEQ ID NO: 959925 - protein, 9 aa, Homo Sapiens
SMSSSPRGS

SEQ ID NO: 959926 - protein, 9 aa, Homo Sapiens
GTQVTRKKP

SEQ ID NO: 959927 - protein, 9 aa, Homo Sapiens
KAFLVRSSL

SEQ ID NO: 959928 - protein, 9 aa, Homo Sapiens
CHLQVDGGM

SEQ ID NO: 959929 - protein, 9 aa, Homo Sapiens
ERTKITIGV

SEQ ID NO: 959930 - protein, 9 aa, Homo Sapiens
LTTVDKETL

SEQ ID NO: 959931 - protein, 9 aa, Homo Sapiens
FESSSLPEN

SEQ ID NO: 959932 - protein, 9 aa, Homo Sapiens
HFRKYHNAN

SEQ ID NO: 959933 - protein, 9 aa, Homo Sapiens
ILDSQFRLH

SEQ ID NO: 959934 - protein, 9 aa, Homo Sapiens
FSILATGGI

SEQ ID NO: 959935 - protein, 9 aa, Homo Sapiens
FRGNKLRDT

SEQ ID NO: 959936 - protein, 9 aa, Homo Sapiens
HLRKKLQSL

SEQ ID NO: 959937 - protein, 9 aa, Homo Sapiens
ESPDPDFSY

SEQ ID NO: 959938 - protein, 9 aa, Homo Sapiens
AGVSLVSAN

SEQ ID NO: 959939 - protein, 9 aa, Homo Sapiens
KNLRMKKDR

SEQ ID NO: 959940 - protein, 9 aa, Homo Sapiens
LVRTACTNF

SEQ ID NO: 959941 - protein, 9 aa, Homo Sapiens
NNSVYWQKF

SEQ ID NO: 959942 - protein, 9 aa, Homo Sapiens
VAVAAVFCV

SEQ ID NO: 959943 - protein, 9 aa, Homo Sapiens
VFDYLVLHG

SEQ ID NO: 959944 - protein, 9 aa, Homo Sapiens
ISNGFGSKD

SEQ ID NO: 959945 - protein, 9 aa, Homo Sapiens
FRSWFANNA

SEQ ID NO: 959946 - protein, 9 aa, Homo Sapiens
KKTPSYFVT

SEQ ID NO: 959947 - protein, 9 aa, Homo Sapiens
KILVAANKT

SEQ ID NO: 959948 - protein, 9 aa, Homo Sapiens
KHIEFLFQP

SEQ ID NO: 959949 - protein, 9 aa, Homo Sapiens
FRPRRSPCM

SEQ ID NO: 959950 - protein, 9 aa, Homo Sapiens
CPSICPPGS

SEQ ID NO: 959951 - protein, 9 aa, Homo Sapiens
FSAHRIALA

SEQ ID NO: 959952 - protein, 9 aa, Homo Sapiens
GVCALFATG

SEQ ID NO: 959953 - protein, 9 aa, Homo Sapiens
ESDDDILNE

SEQ ID NO: 959954 - protein, 9 aa, Homo Sapiens
KQFRARPAG

SEQ ID NO: 959955 - protein, 9 aa, Homo Sapiens
FEENKEMYH

SEQ ID NO: 959956 - protein, 9 aa, Homo Sapiens
TSCYPPFLS

SEQ ID NO: 959957 - protein, 9 aa, Homo Sapiens
PWQAALVMG

SEQ ID NO: 959958 - protein, 9 aa, Homo Sapiens
RLEGERRKT

SEQ ID NO: 959959 - protein, 9 aa, Homo Sapiens
EEVEVGFDW

SEQ ID NO: 959960 - protein, 9 aa, Homo Sapiens
VFVGLYTSL

SEQ ID NO: 959961 - protein, 9 aa, Homo Sapiens
GEGNMFTPQ

SEQ ID NO: 959962 - protein, 9 aa, Homo Sapiens
HYASILTNK

SEQ ID NO: 959963 - protein, 9 aa, Homo Sapiens
DLYVVCNHH

SEQ ID NO: 959964 - protein, 9 aa, Homo Sapiens
YLSKAKMAH

SEQ ID NO: 959965 - protein, 9 aa, Homo Sapiens
SEEYENQHK

SEQ ID NO: 959966 - protein, 9 aa, Homo Sapiens
VHPKVRFYF

SEQ ID NO: 959967 - protein, 9 aa, Homo Sapiens
YWQKFEDTC

SEQ ID NO: 959968 - protein, 9 aa, Homo Sapiens
PIFEKLDYG

SEQ ID NO: 959969 - protein, 9 aa, Homo Sapiens
VPEPVFRKL

SEQ ID NO: 959970 - protein, 9 aa, Homo Sapiens
KMLQVGNLV

SEQ ID NO: 959971 - protein, 9 aa, Homo Sapiens
AYAGPITKM

SEQ ID NO: 959972 - protein, 9 aa, Homo Sapiens
SICPPGSPG

SEQ ID NO: 959973 - protein, 9 aa, Homo Sapiens
GLDVSYLSQ

SEQ ID NO: 959974 - protein, 9 aa, Homo Sapiens
KETFQFIFK

SEQ ID NO: 959975 - protein, 9 aa, Homo Sapiens
RTPWVFSRI

SEQ ID NO: 959976 - protein, 9 aa, Homo Sapiens
DLREQLTTV

SEQ ID NO: 959977 - protein, 9 aa, Homo Sapiens
RTRRLSSRR

SEQ ID NO: 959978 - protein, 9 aa, Homo Sapiens
RPRRSPCMS

SEQ ID NO: 959979 - protein, 9 aa, Homo Sapiens
LHCKLLIVT

SEQ ID NO: 959980 - protein, 9 aa, Homo Sapiens
YPSVKRMES

SEQ ID NO: 959981 - protein, 9 aa, Homo Sapiens
GPNGELQDC

SEQ ID NO: 959982 - protein, 9 aa, Homo Sapiens
DIDDFVKFL

SEQ ID NO: 959983 - protein, 9 aa, Homo Sapiens
SSSISSQTR

SEQ ID NO: 959984 - protein, 9 aa, Homo Sapiens
TVRTILAVF

SEQ ID NO: 959985 - protein, 9 aa, Homo Sapiens
QWSQSQKDA

SEQ ID NO: 959986 - protein, 9 aa, Homo Sapiens
PSFPLLSAA

SEQ ID NO: 959987 - protein, 9 aa, Homo Sapiens
TFQFIFKRH

SEQ ID NO: 959988 - protein, 9 aa, Homo Sapiens
LSENAVLIL

SEQ ID NO: 959989 - protein, 9 aa, Homo Sapiens
ATESLPRPL

SEQ ID NO: 959990 - protein, 9 aa, Homo Sapiens
EKVRIKTLS

SEQ ID NO: 959991 - protein, 9 aa, Homo Sapiens
SKISVMTAT

SEQ ID NO: 959992 - protein, 9 aa, Homo Sapiens
ASALTPGHP

SEQ ID NO: 959993 - protein, 9 aa, Homo Sapiens
DFPEHKEPR

SEQ ID NO: 959994 - protein, 9 aa, Homo Sapiens
ADLQNLATG

SEQ ID NO: 959995 - protein, 9 aa, Homo Sapiens
AGDYKMAAE

SEQ ID NO: 959996 - protein, 9 aa, Homo Sapiens
YFESLVRNN

SEQ ID NO: 959997 - protein, 9 aa, Homo Sapiens
LPKGILKNV

SEQ ID NO: 959998 - protein, 9 aa, Homo Sapiens
LYYPERLQH

SEQ ID NO: 959999 - protein, 9 aa, Homo Sapiens
FFQGERTKI

SEQ ID NO: 960000 - protein, 9 aa, Homo Sapiens
LYIDTVCDC

SEQ ID NO: 960001 - protein, 9 aa, Homo Sapiens
NNPSFTVTV

SEQ ID NO: 960002 - protein, 9 aa, Homo Sapiens
FDKYIKRLA

SEQ ID NO: 960003 - protein, 9 aa, Homo Sapiens
EKETFQFIF

SEQ ID NO: 960004 - protein, 9 aa, Homo Sapiens
VKKTSPPSS

SEQ ID NO: 960005 - protein, 9 aa, Homo Sapiens
NLVTMVEQL

SEQ ID NO: 960006 - protein, 9 aa, Homo Sapiens
DPDFSYALT

SEQ ID NO: 960007 - protein, 9 aa, Homo Sapiens
HIVPHERIH

SEQ ID NO: 960008 - protein, 9 aa, Homo Sapiens
CLEHEQASQ

SEQ ID NO: 960009 - protein, 9 aa, Homo Sapiens
ECGKLFSQI

SEQ ID NO: 960010 - protein, 9 aa, Homo Sapiens
SCDVEEIFC

SEQ ID NO: 960011 - protein, 9 aa, Homo Sapiens
CIPFGQGNF

SEQ ID NO: 960012 - protein, 9 aa, Homo Sapiens
EQLTTVDKE

SEQ ID NO: 960013 - protein, 9 aa, Homo Sapiens
EVLSMTDSE

SEQ ID NO: 960014 - protein, 9 aa, Homo Sapiens
KNFLEGKVD

SEQ ID NO: 960015 - protein, 9 aa, Homo Sapiens
EVTVHQKNQ

SEQ ID NO: 960016 - protein, 9 aa, Homo Sapiens
IKWTASEAI

SEQ ID NO: 960017 - protein, 9 aa, Homo Sapiens
RNNPSFEIP

SEQ ID NO: 960018 - protein, 9 aa, Homo Sapiens
LFGAPRFRH

SEQ ID NO: 960019 - protein, 9 aa, Homo Sapiens
FIFKRHHGF

SEQ ID NO: 960020 - protein, 9 aa, Homo Sapiens
NNGIKRQKK

SEQ ID NO: 960021 - protein, 9 aa, Homo Sapiens
DTQLELPRG

SEQ ID NO: 960022 - protein, 9 aa, Homo Sapiens
DPQAVTYAA

SEQ ID NO: 960023 - protein, 9 aa, Homo Sapiens
RKGDVLTIP

SEQ ID NO: 960024 - protein, 9 aa, Homo Sapiens
WSQSQKDAC

SEQ ID NO: 960025 - protein, 9 aa, Homo Sapiens
SQSQKDACG

SEQ ID NO: 960026 - protein, 9 aa, Homo Sapiens
QILAPLAPR

SEQ ID NO: 960027 - protein, 9 aa, Homo Sapiens
WAPGLLIMT

SEQ ID NO: 960028 - protein, 9 aa, Homo Sapiens
ENAVLILLI

SEQ ID NO: 960029 - protein, 9 aa, Homo Sapiens
FGSLNGKKR

SEQ ID NO: 960030 - protein, 9 aa, Homo Sapiens
EPVFRKLVE

SEQ ID NO: 960031 - protein, 9 aa, Homo Sapiens
FLCDPWNWL

SEQ ID NO: 960032 - protein, 9 aa, Homo Sapiens
SALGGVPPV

SEQ ID NO: 960033 - protein, 9 aa, Homo Sapiens
DDEGTSHEK

SEQ ID NO: 960034 - protein, 9 aa, Homo Sapiens
TESACTADK

SEQ ID NO: 960035 - protein, 9 aa, Homo Sapiens
DKNESVQNL

SEQ ID NO: 960036 - protein, 9 aa, Homo Sapiens
TFFYSYFWS

SEQ ID NO: 960037 - protein, 9 aa, Homo Sapiens
FWTNLCSIF

SEQ ID NO: 960038 - protein, 9 aa, Homo Sapiens
FGETKSIGE

SEQ ID NO: 960039 - protein, 9 aa, Homo Sapiens
LETSGKLKV

SEQ ID NO: 960040 - protein, 9 aa, Homo Sapiens
SMPISEETL

SEQ ID NO: 960041 - protein, 9 aa, Homo Sapiens
RTLQEQSVA

SEQ ID NO: 960042 - protein, 9 aa, Homo Sapiens
TPVSPTTAS

SEQ ID NO: 960043 - protein, 9 aa, Homo Sapiens
FHDQDYGIY

SEQ ID NO: 960044 - protein, 9 aa, Homo Sapiens
LDKILVAAN

SEQ ID NO: 960045 - protein, 9 aa, Homo Sapiens
KKTCKECTP

SEQ ID NO: 960046 - protein, 9 aa, Homo Sapiens
VRPSLLRHD

SEQ ID NO: 960047 - protein, 9 aa, Homo Sapiens
DGPAFDSTV

SEQ ID NO: 960048 - protein, 9 aa, Homo Sapiens
FSYALTPRT

SEQ ID NO: 960049 - protein, 9 aa, Homo Sapiens
LSALEVFVG

SEQ ID NO: 960050 - protein, 9 aa, Homo Sapiens
RQGRKKAAG

SEQ ID NO: 960051 - protein, 9 aa, Homo Sapiens
HRAQQQPQK

SEQ ID NO: 960052 - protein, 9 aa, Homo Sapiens
HPKVRFYFS

SEQ ID NO: 960053 - protein, 9 aa, Homo Sapiens
GGVTFKCWQ

SEQ ID NO: 960054 - protein, 9 aa, Homo Sapiens
QLNRRQSTT

SEQ ID NO: 960055 - protein, 9 aa, Homo Sapiens
YSIFSGDVA

SEQ ID NO: 960056 - protein, 9 aa, Homo Sapiens
SLENTYRDF

SEQ ID NO: 960057 - protein, 9 aa, Homo Sapiens
QNSYGGKFD

SEQ ID NO: 960058 - protein, 9 aa, Homo Sapiens
KSISASFWW

SEQ ID NO: 960059 - protein, 9 aa, Homo Sapiens
VKAFITLYS

SEQ ID NO: 960060 - protein, 9 aa, Homo Sapiens
ILFIKTIFH

SEQ ID NO: 960061 - protein, 9 aa, Homo Sapiens
LFHRAWLWQ

SEQ ID NO: 960062 - protein, 9 aa, Homo Sapiens
YNAADLQNL

SEQ ID NO: 960063 - protein, 9 aa, Homo Sapiens
KSHDCLYIV

SEQ ID NO: 960064 - protein, 9 aa, Homo Sapiens
DYLVLHGRM

SEQ ID NO: 960065 - protein, 9 aa, Homo Sapiens
EYFLFGSSV

SEQ ID NO: 960066 - protein, 9 aa, Homo Sapiens
NKLRDTRLE

SEQ ID NO: 960067 - protein, 9 aa, Homo Sapiens
LKEHSPDKF

SEQ ID NO: 960068 - protein, 9 aa, Homo Sapiens
WDQVDMEFP

SEQ ID NO: 960069 - protein, 9 aa, Homo Sapiens
INMFADTQL

SEQ ID NO: 960070 - protein, 9 aa, Homo Sapiens
WDSQTAKKW

SEQ ID NO: 960071 - protein, 9 aa, Homo Sapiens
QCARIQSVK

SEQ ID NO: 960072 - protein, 9 aa, Homo Sapiens
AFQASGQPS

SEQ ID NO: 960073 - protein, 9 aa, Homo Sapiens
IMNQPLCCI

SEQ ID NO: 960074 - protein, 9 aa, Homo Sapiens
GGMFDFNYL

SEQ ID NO: 960075 - protein, 9 aa, Homo Sapiens
AFRAGDYKM

SEQ ID NO: 960076 - protein, 9 aa, Homo Sapiens
NQTWNLQQK

SEQ ID NO: 960077 - protein, 9 aa, Homo Sapiens
LATLFPISG

SEQ ID NO: 960078 - protein, 9 aa, Homo Sapiens
MSSCSPGNN

SEQ ID NO: 960079 - protein, 9 aa, Homo Sapiens
ELFSSSLQS

SEQ ID NO: 960080 - protein, 9 aa, Homo Sapiens
PPPSQPARS

SEQ ID NO: 960081 - protein, 9 aa, Homo Sapiens
RLSSRRSGY

SEQ ID NO: 960082 - protein, 9 aa, Homo Sapiens
LRIDVSITG

SEQ ID NO: 960083 - protein, 9 aa, Homo Sapiens
QSGAAYIGG

SEQ ID NO: 960084 - protein, 9 aa, Homo Sapiens
VHVDMVSLL

SEQ ID NO: 960085 - protein, 9 aa, Homo Sapiens
ERRKTESNW

SEQ ID NO: 960086 - protein, 9 aa, Homo Sapiens
VANMQNMPA

SEQ ID NO: 960087 - protein, 9 aa, Homo Sapiens
TDTSGLRRV

SEQ ID NO: 960088 - protein, 9 aa, Homo Sapiens
TAMSLSSTP

SEQ ID NO: 960089 - protein, 9 aa, Homo Sapiens
TEASTHSGN

SEQ ID NO: 960090 - protein, 9 aa, Homo Sapiens
CGKSFYQSS

SEQ ID NO: 960091 - protein, 9 aa, Homo Sapiens
DMVNGMMLS

SEQ ID NO: 960092 - protein, 9 aa, Homo Sapiens
NHLAYEKKC

SEQ ID NO: 960093 - protein, 9 aa, Homo Sapiens
IIIRYSPLD

SEQ ID NO: 960094 - protein, 9 aa, Homo Sapiens
LSEEYENQH

SEQ ID NO: 960095 - protein, 9 aa, Homo Sapiens
MESLGGKCN

SEQ ID NO: 960096 - protein, 9 aa, Homo Sapiens
AVDSRTSKL

SEQ ID NO: 960097 - protein, 9 aa, Homo Sapiens
SFPLLSAAN

SEQ ID NO: 960098 - protein, 9 aa, Homo Sapiens
LSEITKQEK

SEQ ID NO: 960099 - protein, 9 aa, Homo Sapiens
EMCQDCIHK

SEQ ID NO: 960100 - protein, 9 aa, Homo Sapiens
MEVLSMTDS

SEQ ID NO: 960101 - protein, 9 aa, Homo Sapiens
RTMYCRHHP

SEQ ID NO: 960102 - protein, 9 aa, Homo Sapiens
RRIPSKEAS

SEQ ID NO: 960103 - protein, 9 aa, Homo Sapiens
PPTMEVLSM

SEQ ID NO: 960104 - protein, 9 aa, Homo Sapiens
FLLGYWSKS

SEQ ID NO: 960105 - protein, 9 aa, Homo Sapiens
ISCVVSSGD

SEQ ID NO: 960106 - protein, 9 aa, Homo Sapiens
KIIIHVSGG

SEQ ID NO: 960107 - protein, 9 aa, Homo Sapiens
LSVKKNDAG

SEQ ID NO: 960108 - protein, 9 aa, Homo Sapiens
LRIFKLTRR

SEQ ID NO: 960109 - protein, 9 aa, Homo Sapiens
HQVGEAIQE

SEQ ID NO: 960110 - protein, 9 aa, Homo Sapiens
HNPMYFFLR

SEQ ID NO: 960111 - protein, 9 aa, Homo Sapiens
SPRKENGHR

SEQ ID NO: 960112 - protein, 9 aa, Homo Sapiens
RVKAQTTSS

SEQ ID NO: 960113 - protein, 9 aa, Homo Sapiens
AADLQNLAT

SEQ ID NO: 960114 - protein, 9 aa, Homo Sapiens
QGKLQLQDV

SEQ ID NO: 960115 - protein, 9 aa, Homo Sapiens
KLREEFSKL

SEQ ID NO: 960116 - protein, 9 aa, Homo Sapiens
EGNMFTPQM

SEQ ID NO: 960117 - protein, 9 aa, Homo Sapiens
YPGSRESPP

SEQ ID NO: 960118 - protein, 9 aa, Homo Sapiens
NDSEELLAT

SEQ ID NO: 960119 - protein, 9 aa, Homo Sapiens
SHTSIWLLQ

SEQ ID NO: 960120 - protein, 9 aa, Homo Sapiens
NIKDKMSRK

SEQ ID NO: 960121 - protein, 9 aa, Homo Sapiens
SSVANMQNM

SEQ ID NO: 960122 - protein, 9 aa, Homo Sapiens
MMEMVGMYS

SEQ ID NO: 960123 - protein, 9 aa, Homo Sapiens
MHYPDVFTR

SEQ ID NO: 960124 - protein, 9 aa, Homo Sapiens
AKERSEIYD

SEQ ID NO: 960125 - protein, 9 aa, Homo Sapiens
SVPQFPIDL

SEQ ID NO: 960126 - protein, 9 aa, Homo Sapiens
YGGTPEKEG

SEQ ID NO: 960127 - protein, 9 aa, Homo Sapiens
EASHLLTPR

SEQ ID NO: 960128 - protein, 9 aa, Homo Sapiens
SAQQMKKAF

SEQ ID NO: 960129 - protein, 9 aa, Homo Sapiens
QNFKHHSFL

SEQ ID NO: 960130 - protein, 9 aa, Homo Sapiens
TWNLQQKKN

SEQ ID NO: 960131 - protein, 9 aa, Homo Sapiens
RIPRPSVRQ

SEQ ID NO: 960132 - protein, 9 aa, Homo Sapiens
FTRSSFTVQ

SEQ ID NO: 960133 - protein, 9 aa, Homo Sapiens
DCAHEEFQQ

SEQ ID NO: 960134 - protein, 9 aa, Homo Sapiens
SSHSESSIR

SEQ ID NO: 960135 - protein, 9 aa, Homo Sapiens
KREEWLTTS

SEQ ID NO: 960136 - protein, 9 aa, Homo Sapiens
RIPSKEASQ

SEQ ID NO: 960137 - protein, 9 aa, Homo Sapiens
EDIKGVRIA

SEQ ID NO: 960138 - protein, 9 aa, Homo Sapiens
GQCYEQFDP

SEQ ID NO: 960139 - protein, 9 aa, Homo Sapiens
YLDSKLHNP

SEQ ID NO: 960140 - protein, 9 aa, Homo Sapiens
REQRKRRKF

SEQ ID NO: 960141 - protein, 9 aa, Homo Sapiens
TLKNHLCLH

SEQ ID NO: 960142 - protein, 9 aa, Homo Sapiens
PSSFLPQTP

SEQ ID NO: 960143 - protein, 9 aa, Homo Sapiens
NQLTDALGG

SEQ ID NO: 960144 - protein, 9 aa, Homo Sapiens
MKKAFSTCS

SEQ ID NO: 960145 - protein, 9 aa, Homo Sapiens
MFDFNYLHT

SEQ ID NO: 960146 - protein, 9 aa, Homo Sapiens
YSYFWSLRV

SEQ ID NO: 960147 - protein, 9 aa, Homo Sapiens
AGSALGGVP

SEQ ID NO: 960148 - protein, 9 aa, Homo Sapiens
EFNEYQAYA

SEQ ID NO: 960149 - protein, 9 aa, Homo Sapiens
FQKFSSFLA

SEQ ID NO: 960150 - protein, 9 aa, Homo Sapiens
SNTEGQSTC

SEQ ID NO: 960151 - protein, 9 aa, Homo Sapiens
LNFINVWKL

SEQ ID NO: 960152 - protein, 9 aa, Homo Sapiens
YYPERLQHY

SEQ ID NO: 960153 - protein, 9 aa, Homo Sapiens
LDYGNLTLA

SEQ ID NO: 960154 - protein, 9 aa, Homo Sapiens
CGVTAEHYV

SEQ ID NO: 960155 - protein, 9 aa, Homo Sapiens
VKTPTKKVE

SEQ ID NO: 960156 - protein, 9 aa, Homo Sapiens
SEVSMPISE

SEQ ID NO: 960157 - protein, 9 aa, Homo Sapiens
ELLPPGPTE

SEQ ID NO: 960158 - protein, 9 aa, Homo Sapiens
YISCVVSSG

SEQ ID NO: 960159 - protein, 9 aa, Homo Sapiens
AFSSHSESS

SEQ ID NO: 960160 - protein, 9 aa, Homo Sapiens
PKTDKSGAA

SEQ ID NO: 960161 - protein, 9 aa, Homo Sapiens
PVSSRFSEV

SEQ ID NO: 960162 - protein, 9 aa, Homo Sapiens
SLGGKCNPT

SEQ ID NO: 960163 - protein, 9 aa, Homo Sapiens
HKLAELRNE

SEQ ID NO: 960164 - protein, 9 aa, Homo Sapiens
PQEMDSFQT

SEQ ID NO: 960165 - protein, 9 aa, Homo Sapiens
VGLGINLFA

SEQ ID NO: 960166 - protein, 9 aa, Homo Sapiens
LCHLQVDGG

SEQ ID NO: 960167 - protein, 9 aa, Homo Sapiens
SYKKGAWCS

SEQ ID NO: 960168 - protein, 9 aa, Homo Sapiens
KESEMDFPE

SEQ ID NO: 960169 - protein, 9 aa, Homo Sapiens
LSVCEMEGP

SEQ ID NO: 960170 - protein, 9 aa, Homo Sapiens
VEGSLEPQY

SEQ ID NO: 960171 - protein, 9 aa, Homo Sapiens
FIYASHIVP

SEQ ID NO: 960172 - protein, 9 aa, Homo Sapiens
RGNKLRDTR

SEQ ID NO: 960173 - protein, 9 aa, Homo Sapiens
IGERREPHR

SEQ ID NO: 960174 - protein, 9 aa, Homo Sapiens
EALGPAAAA

SEQ ID NO: 960175 - protein, 9 aa, Homo Sapiens
PSTENMHFS

SEQ ID NO: 960176 - protein, 9 aa, Homo Sapiens
QKFEDTCVY

SEQ ID NO: 960177 - protein, 9 aa, Homo Sapiens
IYDAFENIY

SEQ ID NO: 960178 - protein, 9 aa, Homo Sapiens
PVFRKLVED

SEQ ID NO: 960179 - protein, 9 aa, Homo Sapiens
REPNFVQAL

SEQ ID NO: 960180 - protein, 9 aa, Homo Sapiens
QSQIFESSS

SEQ ID NO: 960181 - protein, 9 aa, Homo Sapiens
ADGSKEGSP

SEQ ID NO: 960182 - protein, 9 aa, Homo Sapiens
EDFGDPKTY

SEQ ID NO: 960183 - protein, 9 aa, Homo Sapiens
HFSSSISSQ

SEQ ID NO: 960184 - protein, 9 aa, Homo Sapiens
TIPELCQRC

SEQ ID NO: 960185 - protein, 9 aa, Homo Sapiens
VDMEFPGSA

SEQ ID NO: 960186 - protein, 9 aa, Homo Sapiens
NPSFEIPAK

SEQ ID NO: 960187 - protein, 9 aa, Homo Sapiens
MVKNLRMKK

SEQ ID NO: 960188 - protein, 9 aa, Homo Sapiens
KWTASEAIN

SEQ ID NO: 960189 - protein, 9 aa, Homo Sapiens
LERKLWSLW

SEQ ID NO: 960190 - protein, 9 aa, Homo Sapiens
QGLYFHCRA

SEQ ID NO: 960191 - protein, 9 aa, Homo Sapiens
VTGRSDMQK

SEQ ID NO: 960192 - protein, 9 aa, Homo Sapiens
LQHAFQASG

SEQ ID NO: 960193 - protein, 9 aa, Homo Sapiens
TTVDKETLQ

SEQ ID NO: 960194 - protein, 9 aa, Homo Sapiens
AKHPSLATP

SEQ ID NO: 960195 - protein, 9 aa, Homo Sapiens
QFLHTNAAL

SEQ ID NO: 960196 - protein, 9 aa, Homo Sapiens
PELCQRCDT

SEQ ID NO: 960197 - protein, 9 aa, Homo Sapiens
KNDAGSYEC

SEQ ID NO: 960198 - protein, 9 aa, Homo Sapiens
SQIEKTESS

SEQ ID NO: 960199 - protein, 9 aa, Homo Sapiens
FDVFIQGWG

SEQ ID NO: 960200 - protein, 9 aa, Homo Sapiens
TYSWYDNII

SEQ ID NO: 960201 - protein, 9 aa, Homo Sapiens
CSLTQIGGL

SEQ ID NO: 960202 - protein, 9 aa, Homo Sapiens
PEYFLFGSS

SEQ ID NO: 960203 - protein, 9 aa, Homo Sapiens
LHETSSFKS

SEQ ID NO: 960204 - protein, 9 aa, Homo Sapiens
ENMHFSSSI

SEQ ID NO: 960205 - protein, 9 aa, Homo Sapiens
CDPWNWLDF

SEQ ID NO: 960206 - protein, 9 aa, Homo Sapiens
MENVAKEVR

SEQ ID NO: 960207 - protein, 9 aa, Homo Sapiens
PKEPCVLPF

SEQ ID NO: 960208 - protein, 9 aa, Homo Sapiens
EVNGKTIIS

SEQ ID NO: 960209 - protein, 9 aa, Homo Sapiens
QVSELKRKL

SEQ ID NO: 960210 - protein, 9 aa, Homo Sapiens
SQLQNKFYL

SEQ ID NO: 960211 - protein, 9 aa, Homo Sapiens
EEYENQHKE

SEQ ID NO: 960212 - protein, 9 aa, Homo Sapiens
ELENEVEQH

SEQ ID NO: 960213 - protein, 9 aa, Homo Sapiens
PSLTLEDYL

SEQ ID NO: 960214 - protein, 9 aa, Homo Sapiens
VVLRSLPEE

SEQ ID NO: 960215 - protein, 9 aa, Homo Sapiens
FHEEAVAIL

SEQ ID NO: 960216 - protein, 9 aa, Homo Sapiens
FEELLLQVC

SEQ ID NO: 960217 - protein, 9 aa, Homo Sapiens
ARRDLEKPP

SEQ ID NO: 960218 - protein, 9 aa, Homo Sapiens
HAMFQPFFE

SEQ ID NO: 960219 - protein, 9 aa, Homo Sapiens
RRSGQQTYS

SEQ ID NO: 960220 - protein, 9 aa, Homo Sapiens
VTRLPLLID

SEQ ID NO: 960221 - protein, 9 aa, Homo Sapiens
LCDKTQMSF

SEQ ID NO: 960222 - protein, 9 aa, Homo Sapiens
INPELQDGR

SEQ ID NO: 960223 - protein, 9 aa, Homo Sapiens
YSNLFPGGI

SEQ ID NO: 960224 - protein, 9 aa, Homo Sapiens
EEKNFYKCE

SEQ ID NO: 960225 - protein, 9 aa, Homo Sapiens
VQASHCEHA

SEQ ID NO: 960226 - protein, 9 aa, Homo Sapiens
FQQVKQWFA

SEQ ID NO: 960227 - protein, 9 aa, Homo Sapiens
GKDGVRGPT

SEQ ID NO: 960228 - protein, 9 aa, Homo Sapiens
EKGDPGEEE

SEQ ID NO: 960229 - protein, 9 aa, Homo Sapiens
GSLLTCCLS

SEQ ID NO: 960230 - protein, 9 aa, Homo Sapiens
TPNTTKDYD

SEQ ID NO: 960231 - protein, 9 aa, Homo Sapiens
RPDFCHAFH

SEQ ID NO: 960232 - protein, 9 aa, Homo Sapiens
ATRSLRGLE

SEQ ID NO: 960233 - protein, 9 aa, Homo Sapiens
VSTFLFFKN

SEQ ID NO: 960234 - protein, 9 aa, Homo Sapiens
LAPLRKTKS

SEQ ID NO: 960235 - protein, 9 aa, Homo Sapiens
WILNFTRNS

SEQ ID NO: 960236 - protein, 9 aa, Homo Sapiens
KNLLDQTRS

SEQ ID NO: 960237 - protein, 9 aa, Homo Sapiens
WDALDLGDC

SEQ ID NO: 960238 - protein, 9 aa, Homo Sapiens
SRLVALGRQ

SEQ ID NO: 960239 - protein, 9 aa, Homo Sapiens
YPSNQTTAE

SEQ ID NO: 960240 - protein, 9 aa, Homo Sapiens
KKLQMKITK

SEQ ID NO: 960241 - protein, 9 aa, Homo Sapiens
TVYNKPASF

SEQ ID NO: 960242 - protein, 9 aa, Homo Sapiens
NPRLFAEEK

SEQ ID NO: 960243 - protein, 9 aa, Homo Sapiens
RFSINDRIK

SEQ ID NO: 960244 - protein, 9 aa, Homo Sapiens
SCPHSSEIL

SEQ ID NO: 960245 - protein, 9 aa, Homo Sapiens
KNSGLASGL

SEQ ID NO: 960246 - protein, 9 aa, Homo Sapiens
LKRLALDVA

SEQ ID NO: 960247 - protein, 9 aa, Homo Sapiens
PAPRLQLPE

SEQ ID NO: 960248 - protein, 9 aa, Homo Sapiens
CNKNDAEHL

SEQ ID NO: 960249 - protein, 9 aa, Homo Sapiens
RMHQTLSAG

SEQ ID NO: 960250 - protein, 9 aa, Homo Sapiens
KTGSAEARG

SEQ ID NO: 960251 - protein, 9 aa, Homo Sapiens
MASPSGPST

SEQ ID NO: 960252 - protein, 9 aa, Homo Sapiens
HEALVRRLQ

SEQ ID NO: 960253 - protein, 9 aa, Homo Sapiens
SAKYLKSFH

SEQ ID NO: 960254 - protein, 9 aa, Homo Sapiens
AVSKSYDLK

SEQ ID NO: 960255 - protein, 9 aa, Homo Sapiens
SSPISQSSG

SEQ ID NO: 960256 - protein, 9 aa, Homo Sapiens
QMNAALMHR

SEQ ID NO: 960257 - protein, 9 aa, Homo Sapiens
ASEVQSKKK

SEQ ID NO: 960258 - protein, 9 aa, Homo Sapiens
CEQGFVLKR

SEQ ID NO: 960259 - protein, 9 aa, Homo Sapiens
LGDNTRELQ

SEQ ID NO: 960260 - protein, 9 aa, Homo Sapiens
WFLEMDLKP

SEQ ID NO: 960261 - protein, 9 aa, Homo Sapiens
GGSPPCEVT

SEQ ID NO: 960262 - protein, 9 aa, Homo Sapiens
GDDCPVFSG

SEQ ID NO: 960263 - protein, 9 aa, Homo Sapiens
NGEDGGSPP

SEQ ID NO: 960264 - protein, 9 aa, Homo Sapiens
NECYLLRLN

SEQ ID NO: 960265 - protein, 9 aa, Homo Sapiens
ISPTFPPAH

SEQ ID NO: 960266 - protein, 9 aa, Homo Sapiens
ELQVLRDFA

SEQ ID NO: 960267 - protein, 9 aa, Homo Sapiens
TAQRGSSSS

SEQ ID NO: 960268 - protein, 9 aa, Homo Sapiens
GYTHQWTVY

SEQ ID NO: 960269 - protein, 9 aa, Homo Sapiens
SRQSPANGY

SEQ ID NO: 960270 - protein, 9 aa, Homo Sapiens
FRRSVVGTS

SEQ ID NO: 960271 - protein, 9 aa, Homo Sapiens
RGSSSSATL

SEQ ID NO: 960272 - protein, 9 aa, Homo Sapiens
LAAYALTFS

SEQ ID NO: 960273 - protein, 9 aa, Homo Sapiens
DLLLGYMKS

SEQ ID NO: 960274 - protein, 9 aa, Homo Sapiens
HGALLLALL

SEQ ID NO: 960275 - protein, 9 aa, Homo Sapiens
PFSIATQRT

SEQ ID NO: 960276 - protein, 9 aa, Homo Sapiens
GPIVLDNVR

SEQ ID NO: 960277 - protein, 9 aa, Homo Sapiens
FSADVEVPD

SEQ ID NO: 960278 - protein, 9 aa, Homo Sapiens
VGSNFSLWI

SEQ ID NO: 960279 - protein, 9 aa, Homo Sapiens
GNNQIMPKT

SEQ ID NO: 960280 - protein, 9 aa, Homo Sapiens
SQANFILGP

SEQ ID NO: 960281 - protein, 9 aa, Homo Sapiens
GFIGIDSEY

SEQ ID NO: 960282 - protein, 9 aa, Homo Sapiens
TPDKAEPSF

SEQ ID NO: 960283 - protein, 9 aa, Homo Sapiens
KESRYSQNM

SEQ ID NO: 960284 - protein, 9 aa, Homo Sapiens
FLVGSGGFS

SEQ ID NO: 960285 - protein, 9 aa, Homo Sapiens
KNREAFLGE

SEQ ID NO: 960286 - protein, 9 aa, Homo Sapiens
DTNLKCTDC

SEQ ID NO: 960287 - protein, 9 aa, Homo Sapiens
SPTMQQRFT

SEQ ID NO: 960288 - protein, 9 aa, Homo Sapiens
RPSQVTLTQ

SEQ ID NO: 960289 - protein, 9 aa, Homo Sapiens
PQPTSQPQL

SEQ ID NO: 960290 - protein, 9 aa, Homo Sapiens
LSSAKPSQP

SEQ ID NO: 960291 - protein, 9 aa, Homo Sapiens
NVKAQKVWC

SEQ ID NO: 960292 - protein, 9 aa, Homo Sapiens
TREVLKVFL

SEQ ID NO: 960293 - protein, 9 aa, Homo Sapiens
PSKSVEKRL

SEQ ID NO: 960294 - protein, 9 aa, Homo Sapiens
KKWKEPCQI

SEQ ID NO: 960295 - protein, 9 aa, Homo Sapiens
VPMASRPRV

SEQ ID NO: 960296 - protein, 9 aa, Homo Sapiens
GERAQWQER

SEQ ID NO: 960297 - protein, 9 aa, Homo Sapiens
KQVMFEEGS

SEQ ID NO: 960298 - protein, 9 aa, Homo Sapiens
QVALGKLRR

SEQ ID NO: 960299 - protein, 9 aa, Homo Sapiens
RGLSPASSS

SEQ ID NO: 960300 - protein, 9 aa, Homo Sapiens
LHTFDGAFY

SEQ ID NO: 960301 - protein, 9 aa, Homo Sapiens
GDEHAENAV

SEQ ID NO: 960302 - protein, 9 aa, Homo Sapiens
NTVFIGGIN

SEQ ID NO: 960303 - protein, 9 aa, Homo Sapiens
LAQQRALAF

SEQ ID NO: 960304 - protein, 9 aa, Homo Sapiens
SHVPHSALI

SEQ ID NO: 960305 - protein, 9 aa, Homo Sapiens
PEYPNEKIT

SEQ ID NO: 960306 - protein, 9 aa, Homo Sapiens
AFHNLHSAC

SEQ ID NO: 960307 - protein, 9 aa, Homo Sapiens
CKEADNVIF

SEQ ID NO: 960308 - protein, 9 aa, Homo Sapiens
PITCSMQEN

SEQ ID NO: 960309 - protein, 9 aa, Homo Sapiens
LVTIVGNLD

SEQ ID NO: 960310 - protein, 9 aa, Homo Sapiens
LASGLTEED

SEQ ID NO: 960311 - protein, 9 aa, Homo Sapiens
LRIPSAQQK

SEQ ID NO: 960312 - protein, 9 aa, Homo Sapiens
PQGKGISGT

SEQ ID NO: 960313 - protein, 9 aa, Homo Sapiens
LAHPELQSE

SEQ ID NO: 960314 - protein, 9 aa, Homo Sapiens
NYLKELTKN

SEQ ID NO: 960315 - protein, 9 aa, Homo Sapiens
LPTLVEHIL

SEQ ID NO: 960316 - protein, 9 aa, Homo Sapiens
VKKSSTVAT

SEQ ID NO: 960317 - protein, 9 aa, Homo Sapiens
ELYVVVSNH

SEQ ID NO: 960318 - protein, 9 aa, Homo Sapiens
FCIYAPEAP

SEQ ID NO: 960319 - protein, 9 aa, Homo Sapiens
IEQPRNCDD

SEQ ID NO: 960320 - protein, 9 aa, Homo Sapiens
PSIWDVPQK

SEQ ID NO: 960321 - protein, 9 aa, Homo Sapiens
PRISVFFYH

SEQ ID NO: 960322 - protein, 9 aa, Homo Sapiens
NADVWPPFT

SEQ ID NO: 960323 - protein, 9 aa, Homo Sapiens
SSVKPSAAS

SEQ ID NO: 960324 - protein, 9 aa, Homo Sapiens
NPFYCDCNM

SEQ ID NO: 960325 - protein, 9 aa, Homo Sapiens
QQPDRLAVL

SEQ ID NO: 960326 - protein, 9 aa, Homo Sapiens
IWGCLQEAV

SEQ ID NO: 960327 - protein, 9 aa, Homo Sapiens
LSIQERENL

SEQ ID NO: 960328 - protein, 9 aa, Homo Sapiens
SNSRASAFR

SEQ ID NO: 960329 - protein, 9 aa, Homo Sapiens
QWVSFTRKE

SEQ ID NO: 960330 - protein, 9 aa, Homo Sapiens
WYLNRGCTR

SEQ ID NO: 960331 - protein, 9 aa, Homo Sapiens
KSFGWAFCL

SEQ ID NO: 960332 - protein, 9 aa, Homo Sapiens
CNRTSLGAD

SEQ ID NO: 960333 - protein, 9 aa, Homo Sapiens
HGEKTANEK

SEQ ID NO: 960334 - protein, 9 aa, Homo Sapiens
FQPVPASCG

SEQ ID NO: 960335 - protein, 9 aa, Homo Sapiens
LTEEELAPI

SEQ ID NO: 960336 - protein, 9 aa, Homo Sapiens
QHRKIYTGE

SEQ ID NO: 960337 - protein, 9 aa, Homo Sapiens
LLFQLIAEL

SEQ ID NO: 960338 - protein, 9 aa, Homo Sapiens
PAPFRPQIC

SEQ ID NO: 960339 - protein, 9 aa, Homo Sapiens
YYQTIRKKV

SEQ ID NO: 960340 - protein, 9 aa, Homo Sapiens
PCNSPRSDT

SEQ ID NO: 960341 - protein, 9 aa, Homo Sapiens
GLLAPLRKT

SEQ ID NO: 960342 - protein, 9 aa, Homo Sapiens
LLLGELQVL

SEQ ID NO: 960343 - protein, 9 aa, Homo Sapiens
YSRQLYGLG

SEQ ID NO: 960344 - protein, 9 aa, Homo Sapiens
FHFVLALYG

SEQ ID NO: 960345 - protein, 9 aa, Homo Sapiens
RRPSVLFRL

SEQ ID NO: 960346 - protein, 9 aa, Homo Sapiens
YDVCFCSDG

SEQ ID NO: 960347 - protein, 9 aa, Homo Sapiens
RNEARRDLE

SEQ ID NO: 960348 - protein, 9 aa, Homo Sapiens
TMQQRFTLQ

SEQ ID NO: 960349 - protein, 9 aa, Homo Sapiens
HSALFSPRY

SEQ ID NO: 960350 - protein, 9 aa, Homo Sapiens
PLSTFKDLD

SEQ ID NO: 960351 - protein, 9 aa, Homo Sapiens
EKAVIFPGF

SEQ ID NO: 960352 - protein, 9 aa, Homo Sapiens
PFTIIPCVL

SEQ ID NO: 960353 - protein, 9 aa, Homo Sapiens
VHFRLIYRG

SEQ ID NO: 960354 - protein, 9 aa, Homo Sapiens
SALVLLYRL

SEQ ID NO: 960355 - protein, 9 aa, Homo Sapiens
FHNLHSACV

SEQ ID NO: 960356 - protein, 9 aa, Homo Sapiens
FSYSQIASS

SEQ ID NO: 960357 - protein, 9 aa, Homo Sapiens
SFAQKITKS

SEQ ID NO: 960358 - protein, 9 aa, Homo Sapiens
IMPNTVFIG

SEQ ID NO: 960359 - protein, 9 aa, Homo Sapiens
VLHTFLLAK

SEQ ID NO: 960360 - protein, 9 aa, Homo Sapiens
KPNAVCAHG

SEQ ID NO: 960361 - protein, 9 aa, Homo Sapiens
QGQRGLPGL

SEQ ID NO: 960362 - protein, 9 aa, Homo Sapiens
SATSFAQKI

SEQ ID NO: 960363 - protein, 9 aa, Homo Sapiens
YTTALCCPS

SEQ ID NO: 960364 - protein, 9 aa, Homo Sapiens
KSDAGRYYC

SEQ ID NO: 960365 - protein, 9 aa, Homo Sapiens
AHGGSISLG

SEQ ID NO: 960366 - protein, 9 aa, Homo Sapiens
FIVVSRMLV

SEQ ID NO: 960367 - protein, 9 aa, Homo Sapiens
ASRPGFLIF

SEQ ID NO: 960368 - protein, 9 aa, Homo Sapiens
GIYTAHLVR

SEQ ID NO: 960369 - protein, 9 aa, Homo Sapiens
MKILEKGKS

SEQ ID NO: 960370 - protein, 9 aa, Homo Sapiens
MAKNILGEA

SEQ ID NO: 960371 - protein, 9 aa, Homo Sapiens
RTKISNDDD

SEQ ID NO: 960372 - protein, 9 aa, Homo Sapiens
EDFSIYPRF

SEQ ID NO: 960373 - protein, 9 aa, Homo Sapiens
VQYAHRPHT

SEQ ID NO: 960374 - protein, 9 aa, Homo Sapiens
LTSRLEMSA

SEQ ID NO: 960375 - protein, 9 aa, Homo Sapiens
QISFRSNGN

SEQ ID NO: 960376 - protein, 9 aa, Homo Sapiens
IPRWQPDNK

SEQ ID NO: 960377 - protein, 9 aa, Homo Sapiens
RVYLAEVFN

SEQ ID NO: 960378 - protein, 9 aa, Homo Sapiens
VGPWAPGRA

SEQ ID NO: 960379 - protein, 9 aa, Homo Sapiens
PTAANYSSS

SEQ ID NO: 960380 - protein, 9 aa, Homo Sapiens
VPNLSVFKL

SEQ ID NO: 960381 - protein, 9 aa, Homo Sapiens
RLLRKKGVD

SEQ ID NO: 960382 - protein, 9 aa, Homo Sapiens
EEEEEMEEV

SEQ ID NO: 960383 - protein, 9 aa, Homo Sapiens
FVSLVNPQP

SEQ ID NO: 960384 - protein, 9 aa, Homo Sapiens
SQSSLPPPA

SEQ ID NO: 960385 - protein, 9 aa, Homo Sapiens
IIQRLRSEI

SEQ ID NO: 960386 - protein, 9 aa, Homo Sapiens
RFVTSIYSS

SEQ ID NO: 960387 - protein, 9 aa, Homo Sapiens
YRIEQPRNC

SEQ ID NO: 960388 - protein, 9 aa, Homo Sapiens
HFVLALYGR

SEQ ID NO: 960389 - protein, 9 aa, Homo Sapiens
ERENLTVYC

SEQ ID NO: 960390 - protein, 9 aa, Homo Sapiens
SPLGLLETT

SEQ ID NO: 960391 - protein, 9 aa, Homo Sapiens
NLHGLPWDF

SEQ ID NO: 960392 - protein, 9 aa, Homo Sapiens
NCHLNKNIE

SEQ ID NO: 960393 - protein, 9 aa, Homo Sapiens
AENEAGRFG

SEQ ID NO: 960394 - protein, 9 aa, Homo Sapiens
DCYLAICYP

SEQ ID NO: 960395 - protein, 9 aa, Homo Sapiens
TFQTREEEM

SEQ ID NO: 960396 - protein, 9 aa, Homo Sapiens
PPLARPPAL

SEQ ID NO: 960397 - protein, 9 aa, Homo Sapiens
IIAAIGEQN

SEQ ID NO: 960398 - protein, 9 aa, Homo Sapiens
SMDQDDNQT

SEQ ID NO: 960399 - protein, 9 aa, Homo Sapiens
MFGLFPSSS

SEQ ID NO: 960400 - protein, 9 aa, Homo Sapiens
TSTGSDPQS

SEQ ID NO: 960401 - protein, 9 aa, Homo Sapiens
RLLSDDMKV

SEQ ID NO: 960402 - protein, 9 aa, Homo Sapiens
EKENAKDSG

SEQ ID NO: 960403 - protein, 9 aa, Homo Sapiens
QRLHSTEEE

SEQ ID NO: 960404 - protein, 9 aa, Homo Sapiens
GDHLDCVWL

SEQ ID NO: 960405 - protein, 9 aa, Homo Sapiens
LSRRFELRN

SEQ ID NO: 960406 - protein, 9 aa, Homo Sapiens
IFPGAAGGA

SEQ ID NO: 960407 - protein, 9 aa, Homo Sapiens
PSTQPPAEP

SEQ ID NO: 960408 - protein, 9 aa, Homo Sapiens
DAFVFFACE

SEQ ID NO: 960409 - protein, 9 aa, Homo Sapiens
LGMVWGHLP

SEQ ID NO: 960410 - protein, 9 aa, Homo Sapiens
ENSVKTVRS

SEQ ID NO: 960411 - protein, 9 aa, Homo Sapiens
PGPQDPAGR

SEQ ID NO: 960412 - protein, 9 aa, Homo Sapiens
ISRLTVQMK

SEQ ID NO: 960413 - protein, 9 aa, Homo Sapiens
HVLEDLLRT

SEQ ID NO: 960414 - protein, 9 aa, Homo Sapiens
RGPPPSGMR

SEQ ID NO: 960415 - protein, 9 aa, Homo Sapiens
SLGPPGPRR

SEQ ID NO: 960416 - protein, 9 aa, Homo Sapiens
WNFVLYLLE

SEQ ID NO: 960417 - protein, 9 aa, Homo Sapiens
RQGQTFPIK

SEQ ID NO: 960418 - protein, 9 aa, Homo Sapiens
VEEKEEEEE

SEQ ID NO: 960419 - protein, 9 aa, Homo Sapiens
MSNFTMGSP

SEQ ID NO: 960420 - protein, 9 aa, Homo Sapiens
IDDKGILWQ

SEQ ID NO: 960421 - protein, 9 aa, Homo Sapiens
AWSCAWFLN

SEQ ID NO: 960422 - protein, 9 aa, Homo Sapiens
QLEESKKQR

SEQ ID NO: 960423 - protein, 9 aa, Homo Sapiens
LRDRDDIVK

SEQ ID NO: 960424 - protein, 9 aa, Homo Sapiens
VRARFTRSI

SEQ ID NO: 960425 - protein, 9 aa, Homo Sapiens
KLWHLDSDV

SEQ ID NO: 960426 - protein, 9 aa, Homo Sapiens
KYKNRKPLM

SEQ ID NO: 960427 - protein, 9 aa, Homo Sapiens
RVPLNYAEA

SEQ ID NO: 960428 - protein, 9 aa, Homo Sapiens
SSGPGQALQ

SEQ ID NO: 960429 - protein, 9 aa, Homo Sapiens
ATALWNPVS

SEQ ID NO: 960430 - protein, 9 aa, Homo Sapiens
AVHPEQLLP

SEQ ID NO: 960431 - protein, 9 aa, Homo Sapiens
ARSLPSSLP

SEQ ID NO: 960432 - protein, 9 aa, Homo Sapiens
NKNIEKGLL

SEQ ID NO: 960433 - protein, 9 aa, Homo Sapiens
RIIEHYSSE

SEQ ID NO: 960434 - protein, 9 aa, Homo Sapiens
YQNILCNGS

SEQ ID NO: 960435 - protein, 9 aa, Homo Sapiens
AFVTSPLLS

SEQ ID NO: 960436 - protein, 9 aa, Homo Sapiens
QKHSSPRWR

SEQ ID NO: 960437 - protein, 9 aa, Homo Sapiens
LVGSGGFSG

SEQ ID NO: 960438 - protein, 9 aa, Homo Sapiens
LSTWYFSKP

SEQ ID NO: 960439 - protein, 9 aa, Homo Sapiens
SLWIVKKPP

SEQ ID NO: 960440 - protein, 9 aa, Homo Sapiens
PQICSELDV

SEQ ID NO: 960441 - protein, 9 aa, Homo Sapiens
VLHTFDGAF

SEQ ID NO: 960442 - protein, 9 aa, Homo Sapiens
SAGQLAFSG

SEQ ID NO: 960443 - protein, 9 aa, Homo Sapiens
ALDKFLRKK

SEQ ID NO: 960444 - protein, 9 aa, Homo Sapiens
SGGFSGKRT

SEQ ID NO: 960445 - protein, 9 aa, Homo Sapiens
PPGLLPSGV

SEQ ID NO: 960446 - protein, 9 aa, Homo Sapiens
KKRKEWVLT

SEQ ID NO: 960447 - protein, 9 aa, Homo Sapiens
KTSSVPVTG

SEQ ID NO: 960448 - protein, 9 aa, Homo Sapiens
PLCATYWDI

SEQ ID NO: 960449 - protein, 9 aa, Homo Sapiens
ERKLPCCLW

SEQ ID NO: 960450 - protein, 9 aa, Homo Sapiens
AHWALSIWE

SEQ ID NO: 960451 - protein, 9 aa, Homo Sapiens
SQSKACDTK

SEQ ID NO: 960452 - protein, 9 aa, Homo Sapiens
EANQTIATF

SEQ ID NO: 960453 - protein, 9 aa, Homo Sapiens
ENNGVASLC

SEQ ID NO: 960454 - protein, 9 aa, Homo Sapiens
EEQRTFQDE

SEQ ID NO: 960455 - protein, 9 aa, Homo Sapiens
EVVNVLKFL

SEQ ID NO: 960456 - protein, 9 aa, Homo Sapiens
PQENSFLEV

SEQ ID NO: 960457 - protein, 9 aa, Homo Sapiens
CVIKGQKYE

SEQ ID NO: 960458 - protein, 9 aa, Homo Sapiens
EAQCATKVH

SEQ ID NO: 960459 - protein, 9 aa, Homo Sapiens
TDSNTSLPS

SEQ ID NO: 960460 - protein, 9 aa, Homo Sapiens
VGILPPPPL

SEQ ID NO: 960461 - protein, 9 aa, Homo Sapiens
YLGNYISRF

SEQ ID NO: 960462 - protein, 9 aa, Homo Sapiens
KSSKRANIC

SEQ ID NO: 960463 - protein, 9 aa, Homo Sapiens
NRLSLPLQT

SEQ ID NO: 960464 - protein, 9 aa, Homo Sapiens
AWEFVEQEV

SEQ ID NO: 960465 - protein, 9 aa, Homo Sapiens
FFVFLTLGE

SEQ ID NO: 960466 - protein, 9 aa, Homo Sapiens
DMYVIDKYM

SEQ ID NO: 960467 - protein, 9 aa, Homo Sapiens
VSMPKLEGD

SEQ ID NO: 960468 - protein, 9 aa, Homo Sapiens
TQLSRHQLM

SEQ ID NO: 960469 - protein, 9 aa, Homo Sapiens
QLSNGNKTL

SEQ ID NO: 960470 - protein, 9 aa, Homo Sapiens
LCRYLTTPP

SEQ ID NO: 960471 - protein, 9 aa, Homo Sapiens
SPISQSSGN

SEQ ID NO: 960472 - protein, 9 aa, Homo Sapiens
VGGQDHGEA

SEQ ID NO: 960473 - protein, 9 aa, Homo Sapiens
FVLHTFLLA

SEQ ID NO: 960474 - protein, 9 aa, Homo Sapiens
LKSKWWYNK

SEQ ID NO: 960475 - protein, 9 aa, Homo Sapiens
KREFHNQYR

SEQ ID NO: 960476 - protein, 9 aa, Homo Sapiens
EKSLSPEAP

SEQ ID NO: 960477 - protein, 9 aa, Homo Sapiens
HGEAVQPCR

SEQ ID NO: 960478 - protein, 9 aa, Homo Sapiens
PQARLLEGS

SEQ ID NO: 960479 - protein, 9 aa, Homo Sapiens
TPLYQPGRI

SEQ ID NO: 960480 - protein, 9 aa, Homo Sapiens
KLSMFDVSR

SEQ ID NO: 960481 - protein, 9 aa, Homo Sapiens
FAPLVKTKP

SEQ ID NO: 960482 - protein, 9 aa, Homo Sapiens
PSPLHPAPA

SEQ ID NO: 960483 - protein, 9 aa, Homo Sapiens
EVANKVLCA

SEQ ID NO: 960484 - protein, 9 aa, Homo Sapiens
VGDDCPVFS

SEQ ID NO: 960485 - protein, 9 aa, Homo Sapiens
LSSQILLIY

SEQ ID NO: 960486 - protein, 9 aa, Homo Sapiens
LPPLPGLGA

SEQ ID NO: 960487 - protein, 9 aa, Homo Sapiens
HHLHPHHHP

SEQ ID NO: 960488 - protein, 9 aa, Homo Sapiens
PSIDVILVG

SEQ ID NO: 960489 - protein, 9 aa, Homo Sapiens
AWGQVKRQI

SEQ ID NO: 960490 - protein, 9 aa, Homo Sapiens
MVSSGGVPQ

SEQ ID NO: 960491 - protein, 9 aa, Homo Sapiens
FHTEGRAWP

SEQ ID NO: 960492 - protein, 9 aa, Homo Sapiens
NMNSSRMNS

SEQ ID NO: 960493 - protein, 9 aa, Homo Sapiens
FLEKSPDYC

SEQ ID NO: 960494 - protein, 9 aa, Homo Sapiens
SISPGIQGP

SEQ ID NO: 960495 - protein, 9 aa, Homo Sapiens
RLLSQAVRP

SEQ ID NO: 960496 - protein, 9 aa, Homo Sapiens
FNLCLKERD

SEQ ID NO: 960497 - protein, 9 aa, Homo Sapiens
SLFLDNTYF

SEQ ID NO: 960498 - protein, 9 aa, Homo Sapiens
YKRRVNCCW

SEQ ID NO: 960499 - protein, 9 aa, Homo Sapiens
MESSPISQS

SEQ ID NO: 960500 - protein, 9 aa, Homo Sapiens
EWITSTKTL

SEQ ID NO: 960501 - protein, 9 aa, Homo Sapiens
TSHSTVALS

SEQ ID NO: 960502 - protein, 9 aa, Homo Sapiens
KLLERKASI

SEQ ID NO: 960503 - protein, 9 aa, Homo Sapiens
MEEHQHQIH

SEQ ID NO: 960504 - protein, 9 aa, Homo Sapiens
LPIKSKKKR

SEQ ID NO: 960505 - protein, 9 aa, Homo Sapiens
SEVVYSAHA

SEQ ID NO: 960506 - protein, 9 aa, Homo Sapiens
NNGVASLCA

SEQ ID NO: 960507 - protein, 9 aa, Homo Sapiens
QYAHRPHTF

SEQ ID NO: 960508 - protein, 9 aa, Homo Sapiens
SPFFKEVLS

SEQ ID NO: 960509 - protein, 9 aa, Homo Sapiens
KEMTDSTPV

SEQ ID NO: 960510 - protein, 9 aa, Homo Sapiens
PPLPPACLS

SEQ ID NO: 960511 - protein, 9 aa, Homo Sapiens
LMSTTLIGT

SEQ ID NO: 960512 - protein, 9 aa, Homo Sapiens
CEKCWKAYI

SEQ ID NO: 960513 - protein, 9 aa, Homo Sapiens
NASWLMSLE

SEQ ID NO: 960514 - protein, 9 aa, Homo Sapiens
YLIHRFLLH

SEQ ID NO: 960515 - protein, 9 aa, Homo Sapiens
GLQRLAGPR

SEQ ID NO: 960516 - protein, 9 aa, Homo Sapiens
LTSEDAQPE

SEQ ID NO: 960517 - protein, 9 aa, Homo Sapiens
IGQENTLHP

SEQ ID NO: 960518 - protein, 9 aa, Homo Sapiens
RRADTSRNS

SEQ ID NO: 960519 - protein, 9 aa, Homo Sapiens
IHFDSDEPW

SEQ ID NO: 960520 - protein, 9 aa, Homo Sapiens
WHPESSLQR

SEQ ID NO: 960521 - protein, 9 aa, Homo Sapiens
RELWDDFLS

SEQ ID NO: 960522 - protein, 9 aa, Homo Sapiens
RASAFRAAG

SEQ ID NO: 960523 - protein, 9 aa, Homo Sapiens
RRGQKRSQA

SEQ ID NO: 960524 - protein, 9 aa, Homo Sapiens
MDVTEINVF

SEQ ID NO: 960525 - protein, 9 aa, Homo Sapiens
NSQKVGTYM

SEQ ID NO: 960526 - protein, 9 aa, Homo Sapiens
YHRVVFFIP

SEQ ID NO: 960527 - protein, 9 aa, Homo Sapiens
KPRPPHTHF

SEQ ID NO: 960528 - protein, 9 aa, Homo Sapiens
EVCSGCLKL

SEQ ID NO: 960529 - protein, 9 aa, Homo Sapiens
ALGPRGLSP

SEQ ID NO: 960530 - protein, 9 aa, Homo Sapiens
PDPSPRQRT

SEQ ID NO: 960531 - protein, 9 aa, Homo Sapiens
PDMALRQSS

SEQ ID NO: 960532 - protein, 9 aa, Homo Sapiens
APREETEKE

SEQ ID NO: 960533 - protein, 9 aa, Homo Sapiens
VIVSVKDAV

SEQ ID NO: 960534 - protein, 9 aa, Homo Sapiens
LAMGLWVIQ

SEQ ID NO: 960535 - protein, 9 aa, Homo Sapiens
LSPQENSFL

SEQ ID NO: 960536 - protein, 9 aa, Homo Sapiens
PRENTWQPL

SEQ ID NO: 960537 - protein, 9 aa, Homo Sapiens
LWELWDILQ

SEQ ID NO: 960538 - protein, 9 aa, Homo Sapiens
QVRRRPSVL

SEQ ID NO: 960539 - protein, 9 aa, Homo Sapiens
ESKKQRLGG

SEQ ID NO: 960540 - protein, 9 aa, Homo Sapiens
TIHIRTHTG

SEQ ID NO: 960541 - protein, 9 aa, Homo Sapiens
QKSGSLQGT

SEQ ID NO: 960542 - protein, 9 aa, Homo Sapiens
VCFCSDGRE

SEQ ID NO: 960543 - protein, 9 aa, Homo Sapiens
EMEEVGEEE

SEQ ID NO: 960544 - protein, 9 aa, Homo Sapiens
ARCMLAGSV

SEQ ID NO: 960545 - protein, 9 aa, Homo Sapiens
CPEQILQLG

SEQ ID NO: 960546 - protein, 9 aa, Homo Sapiens
DLSNSTVVT

SEQ ID NO: 960547 - protein, 9 aa, Homo Sapiens
LLQRNFSIN

SEQ ID NO: 960548 - protein, 9 aa, Homo Sapiens
PFQEDESIH

SEQ ID NO: 960549 - protein, 9 aa, Homo Sapiens
VEQEVLLKG

SEQ ID NO: 960550 - protein, 9 aa, Homo Sapiens
EKKFESMYV

SEQ ID NO: 960551 - protein, 9 aa, Homo Sapiens
REHELYVVV

SEQ ID NO: 960552 - protein, 9 aa, Homo Sapiens
GYPGSALLQ

SEQ ID NO: 960553 - protein, 9 aa, Homo Sapiens
SVISKVNLV

SEQ ID NO: 960554 - protein, 9 aa, Homo Sapiens
FLPFTHWNF

SEQ ID NO: 960555 - protein, 9 aa, Homo Sapiens
GLGKKWRIQ

SEQ ID NO: 960556 - protein, 9 aa, Homo Sapiens
FSGKRTSDK

SEQ ID NO: 960557 - protein, 9 aa, Homo Sapiens
LVDGSLLTR

SEQ ID NO: 960558 - protein, 9 aa, Homo Sapiens
EDMSEDLLM

SEQ ID NO: 960559 - protein, 9 aa, Homo Sapiens
FLYCEATLL

SEQ ID NO: 960560 - protein, 9 aa, Homo Sapiens
RARLLFRVR

SEQ ID NO: 960561 - protein, 9 aa, Homo Sapiens
TYLTLTEIC

SEQ ID NO: 960562 - protein, 9 aa, Homo Sapiens
NLEEWIKLT

SEQ ID NO: 960563 - protein, 9 aa, Homo Sapiens
HSSSSGDSS

SEQ ID NO: 960564 - protein, 9 aa, Homo Sapiens
FKKTFKMLL

SEQ ID NO: 960565 - protein, 9 aa, Homo Sapiens
YVAAVQEFY

SEQ ID NO: 960566 - protein, 9 aa, Homo Sapiens
HPSGTVGAI

SEQ ID NO: 960567 - protein, 9 aa, Homo Sapiens
CSSPCFSCP

SEQ ID NO: 960568 - protein, 9 aa, Homo Sapiens
NCVPDSALR

SEQ ID NO: 960569 - protein, 9 aa, Homo Sapiens
IHLNDIYFV

SEQ ID NO: 960570 - protein, 9 aa, Homo Sapiens
TETTGEKRK

SEQ ID NO: 960571 - protein, 9 aa, Homo Sapiens
RISYSKGQL

SEQ ID NO: 960572 - protein, 9 aa, Homo Sapiens
GPKGQKENP

SEQ ID NO: 960573 - protein, 9 aa, Homo Sapiens
GARSLPSSL

SEQ ID NO: 960574 - protein, 9 aa, Homo Sapiens
LRNRSDVEE

SEQ ID NO: 960575 - protein, 9 aa, Homo Sapiens
CTDLSINFL

SEQ ID NO: 960576 - protein, 9 aa, Homo Sapiens
YVGNEPKWC

SEQ ID NO: 960577 - protein, 9 aa, Homo Sapiens
NIQGITKPV

SEQ ID NO: 960578 - protein, 9 aa, Homo Sapiens
TAAAPETAA

SEQ ID NO: 960579 - protein, 9 aa, Homo Sapiens
RDKHWHQLM

SEQ ID NO: 960580 - protein, 9 aa, Homo Sapiens
LGKQNFHKA

SEQ ID NO: 960581 - protein, 9 aa, Homo Sapiens
TIVGNLDMI

SEQ ID NO: 960582 - protein, 9 aa, Homo Sapiens
FNVEEAQRR

SEQ ID NO: 960583 - protein, 9 aa, Homo Sapiens
FKRRQGKIF

SEQ ID NO: 960584 - protein, 9 aa, Homo Sapiens
RPGACLAEG

SEQ ID NO: 960585 - protein, 9 aa, Homo Sapiens
APNPANFVG

SEQ ID NO: 960586 - protein, 9 aa, Homo Sapiens
RKSVQCQRW

SEQ ID NO: 960587 - protein, 9 aa, Homo Sapiens
SYDLKNTLR

SEQ ID NO: 960588 - protein, 9 aa, Homo Sapiens
AILTQDFLQ

SEQ ID NO: 960589 - protein, 9 aa, Homo Sapiens
PEEAPPEEA

SEQ ID NO: 960590 - protein, 9 aa, Homo Sapiens
TFENITQKV

SEQ ID NO: 960591 - protein, 9 aa, Homo Sapiens
RREAKRQAQ

SEQ ID NO: 960592 - protein, 9 aa, Homo Sapiens
GIPVDMKDI

SEQ ID NO: 960593 - protein, 9 aa, Homo Sapiens
SCGSTQIWQ

SEQ ID NO: 960594 - protein, 9 aa, Homo Sapiens
AREAEREWE

SEQ ID NO: 960595 - protein, 9 aa, Homo Sapiens
QHDAGLGAL

SEQ ID NO: 960596 - protein, 9 aa, Homo Sapiens
PHVGQKEMS

SEQ ID NO: 960597 - protein, 9 aa, Homo Sapiens
ALTFSGCSW

SEQ ID NO: 960598 - protein, 9 aa, Homo Sapiens
VVITIPVIR

SEQ ID NO: 960599 - protein, 9 aa, Homo Sapiens
STAFCLFNL

SEQ ID NO: 960600 - protein, 9 aa, Homo Sapiens
TQIWQHGTS

SEQ ID NO: 960601 - protein, 9 aa, Homo Sapiens
NTKILKQSD

SEQ ID NO: 960602 - protein, 9 aa, Homo Sapiens
SPPGKKEFM

SEQ ID NO: 960603 - protein, 9 aa, Homo Sapiens
PGGDRSSSR

SEQ ID NO: 960604 - protein, 9 aa, Homo Sapiens
LGFFGEGDA

SEQ ID NO: 960605 - protein, 9 aa, Homo Sapiens
NSLDPPHEP

SEQ ID NO: 960606 - protein, 9 aa, Homo Sapiens
GQRPRPSKK

SEQ ID NO: 960607 - protein, 9 aa, Homo Sapiens
KNRKPLMPS

SEQ ID NO: 960608 - protein, 9 aa, Homo Sapiens
SLFFRTPKI

SEQ ID NO: 960609 - protein, 9 aa, Homo Sapiens
NKRETFRKS

SEQ ID NO: 960610 - protein, 9 aa, Homo Sapiens
PGSQSLSSE

SEQ ID NO: 960611 - protein, 9 aa, Homo Sapiens
SSRYPPQQQ

SEQ ID NO: 960612 - protein, 9 aa, Homo Sapiens
SREASPLVV

SEQ ID NO: 960613 - protein, 9 aa, Homo Sapiens
TRLRLGVIQ

SEQ ID NO: 960614 - protein, 9 aa, Homo Sapiens
NGLTHQSLL

SEQ ID NO: 960615 - protein, 9 aa, Homo Sapiens
VKKGEDILL

SEQ ID NO: 960616 - protein, 9 aa, Homo Sapiens
SLENDNDDD

SEQ ID NO: 960617 - protein, 9 aa, Homo Sapiens
SKERRKKAF

SEQ ID NO: 960618 - protein, 9 aa, Homo Sapiens
EAVISAKIA

SEQ ID NO: 960619 - protein, 9 aa, Homo Sapiens
IWEKLGKLY

SEQ ID NO: 960620 - protein, 9 aa, Homo Sapiens
WSPEVPRCT

SEQ ID NO: 960621 - protein, 9 aa, Homo Sapiens
QSSVLWKYF

SEQ ID NO: 960622 - protein, 9 aa, Homo Sapiens
LSGLHTDGH

SEQ ID NO: 960623 - protein, 9 aa, Homo Sapiens
SHFERHRRI

SEQ ID NO: 960624 - protein, 9 aa, Homo Sapiens
KFRVEAGEE

SEQ ID NO: 960625 - protein, 9 aa, Homo Sapiens
DPSLLRKHV

SEQ ID NO: 960626 - protein, 9 aa, Homo Sapiens
LLSSQILLI

SEQ ID NO: 960627 - protein, 9 aa, Homo Sapiens
VGLPEVEFF

SEQ ID NO: 960628 - protein, 9 aa, Homo Sapiens
LCQLTVPNV

SEQ ID NO: 960629 - protein, 9 aa, Homo Sapiens
QLSMRNAMF

SEQ ID NO: 960630 - protein, 9 aa, Homo Sapiens
NLKALFWTV

SEQ ID NO: 960631 - protein, 9 aa, Homo Sapiens
EMPVQFFQR

SEQ ID NO: 960632 - protein, 9 aa, Homo Sapiens
RICFLLQDT

SEQ ID NO: 960633 - protein, 9 aa, Homo Sapiens
NLDMITLIC

SEQ ID NO: 960634 - protein, 9 aa, Homo Sapiens
NPQPFLNEK

SEQ ID NO: 960635 - protein, 9 aa, Homo Sapiens
AMSTTPGTP

SEQ ID NO: 960636 - protein, 9 aa, Homo Sapiens
IFLPYNEVL

SEQ ID NO: 960637 - protein, 9 aa, Homo Sapiens
DEITVTFTC

SEQ ID NO: 960638 - protein, 9 aa, Homo Sapiens
PPLVPQFPP

SEQ ID NO: 960639 - protein, 9 aa, Homo Sapiens
LSQNKKEQA

SEQ ID NO: 960640 - protein, 9 aa, Homo Sapiens
QRQRAIVAV

SEQ ID NO: 960641 - protein, 9 aa, Homo Sapiens
SGTNSKLSY

SEQ ID NO: 960642 - protein, 9 aa, Homo Sapiens
AIQAWYKLH

SEQ ID NO: 960643 - protein, 9 aa, Homo Sapiens
RLLENALSG

SEQ ID NO: 960644 - protein, 9 aa, Homo Sapiens
VPDSALRCP

SEQ ID NO: 960645 - protein, 9 aa, Homo Sapiens
FPWQGLKAD

SEQ ID NO: 960646 - protein, 9 aa, Homo Sapiens
ELLRKTKGC

SEQ ID NO: 960647 - protein, 9 aa, Homo Sapiens
GNLIKVTPS

SEQ ID NO: 960648 - protein, 9 aa, Homo Sapiens
DTSRNSSQC

SEQ ID NO: 960649 - protein, 9 aa, Homo Sapiens
FQHGFKLPR

SEQ ID NO: 960650 - protein, 9 aa, Homo Sapiens
LSNLTVIYT

SEQ ID NO: 960651 - protein, 9 aa, Homo Sapiens
YFLRGSFPW

SEQ ID NO: 960652 - protein, 9 aa, Homo Sapiens
KGSKGEPEK

SEQ ID NO: 960653 - protein, 9 aa, Homo Sapiens
PPSPAFLWA

SEQ ID NO: 960654 - protein, 9 aa, Homo Sapiens
PDHYTFRKI

SEQ ID NO: 960655 - protein, 9 aa, Homo Sapiens
RSQRAGLQY

SEQ ID NO: 960656 - protein, 9 aa, Homo Sapiens
QIYCIKEGV

SEQ ID NO: 960657 - protein, 9 aa, Homo Sapiens
KLPPTAGLR

SEQ ID NO: 960658 - protein, 9 aa, Homo Sapiens
VTVRPSTQP

SEQ ID NO: 960659 - protein, 9 aa, Homo Sapiens
ESGYLIFWA

SEQ ID NO: 960660 - protein, 9 aa, Homo Sapiens
KTVIELLEK

SEQ ID NO: 960661 - protein, 9 aa, Homo Sapiens
MGNAENQHV

SEQ ID NO: 960662 - protein, 9 aa, Homo Sapiens
KVGTYMLLK

SEQ ID NO: 960663 - protein, 9 aa, Homo Sapiens
KERDWLPGQ

SEQ ID NO: 960664 - protein, 9 aa, Homo Sapiens
NEEKVKFDD

SEQ ID NO: 960665 - protein, 9 aa, Homo Sapiens
LPYLPHPAK

SEQ ID NO: 960666 - protein, 9 aa, Homo Sapiens
SPFTLLTTL

SEQ ID NO: 960667 - protein, 9 aa, Homo Sapiens
PLGCQGCPA

SEQ ID NO: 960668 - protein, 9 aa, Homo Sapiens
NRTSLGADG

SEQ ID NO: 960669 - protein, 9 aa, Homo Sapiens
IPPGVATEA

SEQ ID NO: 960670 - protein, 9 aa, Homo Sapiens
NKQCEFAFG

SEQ ID NO: 960671 - protein, 9 aa, Homo Sapiens
KELHLSGCF

SEQ ID NO: 960672 - protein, 9 aa, Homo Sapiens
VEDTYNGLV

SEQ ID NO: 960673 - protein, 9 aa, Homo Sapiens
FMSLRGGEN

SEQ ID NO: 960674 - protein, 9 aa, Homo Sapiens
KKPGYNESC

SEQ ID NO: 960675 - protein, 9 aa, Homo Sapiens
YLTVQPLYW

SEQ ID NO: 960676 - protein, 9 aa, Homo Sapiens
TWYFSKPPL

SEQ ID NO: 960677 - protein, 9 aa, Homo Sapiens
CVCDIGYGE

SEQ ID NO: 960678 - protein, 9 aa, Homo Sapiens
AENRGRKPR

SEQ ID NO: 960679 - protein, 9 aa, Homo Sapiens
SPDQGPTKS

SEQ ID NO: 960680 - protein, 9 aa, Homo Sapiens
GVKFGKNLG

SEQ ID NO: 960681 - protein, 9 aa, Homo Sapiens
APSNLPQGY

SEQ ID NO: 960682 - protein, 9 aa, Homo Sapiens
REKPLSTFK

SEQ ID NO: 960683 - protein, 9 aa, Homo Sapiens
SFSQIYNLN

SEQ ID NO: 960684 - protein, 9 aa, Homo Sapiens
SPGPGDPSF

SEQ ID NO: 960685 - protein, 9 aa, Homo Sapiens
SGLEEKEEE

SEQ ID NO: 960686 - protein, 9 aa, Homo Sapiens
KLFEETGVE

SEQ ID NO: 960687 - protein, 9 aa, Homo Sapiens
VVWPRDQIV

SEQ ID NO: 960688 - protein, 9 aa, Homo Sapiens
SVISESEVF

SEQ ID NO: 960689 - protein, 9 aa, Homo Sapiens
GFFSLQIMG

SEQ ID NO: 960690 - protein, 9 aa, Homo Sapiens
HGFKLPRLF

SEQ ID NO: 960691 - protein, 9 aa, Homo Sapiens
VHSWSTGKE

SEQ ID NO: 960692 - protein, 9 aa, Homo Sapiens
GMVWGHLPS

SEQ ID NO: 960693 - protein, 9 aa, Homo Sapiens
EEMYEDIQP

SEQ ID NO: 960694 - protein, 9 aa, Homo Sapiens
QIIFFFLAL

SEQ ID NO: 960695 - protein, 9 aa, Homo Sapiens
AAKVIVSVK

SEQ ID NO: 960696 - protein, 9 aa, Homo Sapiens
QLSEVSNKR

SEQ ID NO: 960697 - protein, 9 aa, Homo Sapiens
VTSLQHKGF

SEQ ID NO: 960698 - protein, 9 aa, Homo Sapiens
AVQQPDRLA

SEQ ID NO: 960699 - protein, 9 aa, Homo Sapiens
RQGKIFPEG

SEQ ID NO: 960700 - protein, 9 aa, Homo Sapiens
VQFSYVTPA

SEQ ID NO: 960701 - protein, 9 aa, Homo Sapiens
DIFNYTTAL

SEQ ID NO: 960702 - protein, 9 aa, Homo Sapiens
TGDAFVFFA

SEQ ID NO: 960703 - protein, 9 aa, Homo Sapiens
SPANGYSST

SEQ ID NO: 960704 - protein, 9 aa, Homo Sapiens
VMDEFFYNL

SEQ ID NO: 960705 - protein, 9 aa, Homo Sapiens
FQQGLHWLR

SEQ ID NO: 960706 - protein, 9 aa, Homo Sapiens
LLVTVSLCS

SEQ ID NO: 960707 - protein, 9 aa, Homo Sapiens
MDESTITDL

SEQ ID NO: 960708 - protein, 9 aa, Homo Sapiens
AGPGTPLKL

SEQ ID NO: 960709 - protein, 9 aa, Homo Sapiens
MLSNLTVIY

SEQ ID NO: 960710 - protein, 9 aa, Homo Sapiens
NACLQSTLW

SEQ ID NO: 960711 - protein, 9 aa, Homo Sapiens
LDGEIATYR

SEQ ID NO: 960712 - protein, 9 aa, Homo Sapiens
GREKITNCA

SEQ ID NO: 960713 - protein, 9 aa, Homo Sapiens
LRQVGKVCR

SEQ ID NO: 960714 - protein, 9 aa, Homo Sapiens
AGFGGRPNT

SEQ ID NO: 960715 - protein, 9 aa, Homo Sapiens
EPRCLRMVL

SEQ ID NO: 960716 - protein, 9 aa, Homo Sapiens
RDLSPQENS

SEQ ID NO: 960717 - protein, 9 aa, Homo Sapiens
LNWHVRIHT

SEQ ID NO: 960718 - protein, 9 aa, Homo Sapiens
SDPSLPGRA

SEQ ID NO: 960719 - protein, 9 aa, Homo Sapiens
KTRKSVQCQ

SEQ ID NO: 960720 - protein, 9 aa, Homo Sapiens
FILSFLKLS

SEQ ID NO: 960721 - protein, 9 aa, Homo Sapiens
QEFYLSVYF

SEQ ID NO: 960722 - protein, 9 aa, Homo Sapiens
TYDHPSKSV

SEQ ID NO: 960723 - protein, 9 aa, Homo Sapiens
HLFGSERLT

SEQ ID NO: 960724 - protein, 9 aa, Homo Sapiens
DYKRRLQHL

SEQ ID NO: 960725 - protein, 9 aa, Homo Sapiens
FQETLYVGN

SEQ ID NO: 960726 - protein, 9 aa, Homo Sapiens
CCRLLYYGG

SEQ ID NO: 960727 - protein, 9 aa, Homo Sapiens
PTPAATLSA

SEQ ID NO: 960728 - protein, 9 aa, Homo Sapiens
TILISAAVT

SEQ ID NO: 960729 - protein, 9 aa, Homo Sapiens
MAEFLGSAE

SEQ ID NO: 960730 - protein, 9 aa, Homo Sapiens
PRLGPQGGR

SEQ ID NO: 960731 - protein, 9 aa, Homo Sapiens
QRLQEEADA

SEQ ID NO: 960732 - protein, 9 aa, Homo Sapiens
AYQWRVSEG

SEQ ID NO: 960733 - protein, 9 aa, Homo Sapiens
EESLYQKIC

SEQ ID NO: 960734 - protein, 9 aa, Homo Sapiens
YKEGYCKQL

SEQ ID NO: 960735 - protein, 9 aa, Homo Sapiens
EDTYNGLVD

SEQ ID NO: 960736 - protein, 9 aa, Homo Sapiens
RLQNVKAQK

SEQ ID NO: 960737 - protein, 9 aa, Homo Sapiens
NFLCSMTAL

SEQ ID NO: 960738 - protein, 9 aa, Homo Sapiens
GKTSSVPVT

SEQ ID NO: 960739 - protein, 9 aa, Homo Sapiens
STSHSTVAL

SEQ ID NO: 960740 - protein, 9 aa, Homo Sapiens
NLIVELVRY

SEQ ID NO: 960741 - protein, 9 aa, Homo Sapiens
WAVTVYNKP

SEQ ID NO: 960742 - protein, 9 aa, Homo Sapiens
IEPENIREK

SEQ ID NO: 960743 - protein, 9 aa, Homo Sapiens
SPASPSPLG

SEQ ID NO: 960744 - protein, 9 aa, Homo Sapiens
ERRRRFSIN

SEQ ID NO: 960745 - protein, 9 aa, Homo Sapiens
GGWCGLRVH

SEQ ID NO: 960746 - protein, 9 aa, Homo Sapiens
EWSRDSPLF

SEQ ID NO: 960747 - protein, 9 aa, Homo Sapiens
LLIYDNKGA

SEQ ID NO: 960748 - protein, 9 aa, Homo Sapiens
LKKCYLMEN

SEQ ID NO: 960749 - protein, 9 aa, Homo Sapiens
DIYFVVGIP

SEQ ID NO: 960750 - protein, 9 aa, Homo Sapiens
LKNTLRTMG

SEQ ID NO: 960751 - protein, 9 aa, Homo Sapiens
LQNVKAQKV

SEQ ID NO: 960752 - protein, 9 aa, Homo Sapiens
EPFSNSTNL

SEQ ID NO: 960753 - protein, 9 aa, Homo Sapiens
TMSAERDLC

SEQ ID NO: 960754 - protein, 9 aa, Homo Sapiens
EPPDFNPKD

SEQ ID NO: 960755 - protein, 9 aa, Homo Sapiens
LFKRRQGKI

SEQ ID NO: 960756 - protein, 9 aa, Homo Sapiens
PSALATSIG

SEQ ID NO: 960757 - protein, 9 aa, Homo Sapiens
FQEDKPAPG

SEQ ID NO: 960758 - protein, 9 aa, Homo Sapiens
FLTLGESGY

SEQ ID NO: 960759 - protein, 9 aa, Homo Sapiens
DTCALASYL

SEQ ID NO: 960760 - protein, 9 aa, Homo Sapiens
GPGIGGDIH

SEQ ID NO: 960761 - protein, 9 aa, Homo Sapiens
VIDEQVEDE

SEQ ID NO: 960762 - protein, 9 aa, Homo Sapiens
NCTEPFSNS

SEQ ID NO: 960763 - protein, 9 aa, Homo Sapiens
IQGITKPVI

SEQ ID NO: 960764 - protein, 9 aa, Homo Sapiens
QEKENAKDS

SEQ ID NO: 960765 - protein, 9 aa, Homo Sapiens
SDDMKVLCP

SEQ ID NO: 960766 - protein, 9 aa, Homo Sapiens
AILGKMAPW

SEQ ID NO: 960767 - protein, 9 aa, Homo Sapiens
SSLNWHVRI

SEQ ID NO: 960768 - protein, 9 aa, Homo Sapiens
LEEPVQASH

SEQ ID NO: 960769 - protein, 9 aa, Homo Sapiens
TGSLVSMLN

SEQ ID NO: 960770 - protein, 9 aa, Homo Sapiens
QSPANGYSS

SEQ ID NO: 960771 - protein, 9 aa, Homo Sapiens
LCLNCSVLS

SEQ ID NO: 960772 - protein, 9 aa, Homo Sapiens
ELSREGERE

SEQ ID NO: 960773 - protein, 9 aa, Homo Sapiens
HRAHLQGLV

SEQ ID NO: 960774 - protein, 9 aa, Homo Sapiens
NDLDTKATL

SEQ ID NO: 960775 - protein, 9 aa, Homo Sapiens
STATVSTLA

SEQ ID NO: 960776 - protein, 9 aa, Homo Sapiens
AEGFSNRLC

SEQ ID NO: 960777 - protein, 9 aa, Homo Sapiens
FQTREEEMI

SEQ ID NO: 960778 - protein, 9 aa, Homo Sapiens
KKRHKGKNC

SEQ ID NO: 960779 - protein, 9 aa, Homo Sapiens
LWPASDRKK

SEQ ID NO: 960780 - protein, 9 aa, Homo Sapiens
LLSGSVLSI

SEQ ID NO: 960781 - protein, 9 aa, Homo Sapiens
NARKKLAES

SEQ ID NO: 960782 - protein, 9 aa, Homo Sapiens
LTTERKKKG

SEQ ID NO: 960783 - protein, 9 aa, Homo Sapiens
LPFLQQIPF

SEQ ID NO: 960784 - protein, 9 aa, Homo Sapiens
PPPQRGNQS

SEQ ID NO: 960785 - protein, 9 aa, Homo Sapiens
LVFSMVLYG

SEQ ID NO: 960786 - protein, 9 aa, Homo Sapiens
KFSDKEKGN

SEQ ID NO: 960787 - protein, 9 aa, Homo Sapiens
NKRECPASG

SEQ ID NO: 960788 - protein, 9 aa, Homo Sapiens
NERLKVVLR

SEQ ID NO: 960789 - protein, 9 aa, Homo Sapiens
EITLPALFR

SEQ ID NO: 960790 - protein, 9 aa, Homo Sapiens
SFNPCINLM

SEQ ID NO: 960791 - protein, 9 aa, Homo Sapiens
YKINITSIA

SEQ ID NO: 960792 - protein, 9 aa, Homo Sapiens
TPDPQAGNF

SEQ ID NO: 960793 - protein, 9 aa, Homo Sapiens
DVANRLEKR

SEQ ID NO: 960794 - protein, 9 aa, Homo Sapiens
ESNGEKLPC

SEQ ID NO: 960795 - protein, 9 aa, Homo Sapiens
VIGLEIEAY

SEQ ID NO: 960796 - protein, 9 aa, Homo Sapiens
TMRGDMVTK

SEQ ID NO: 960797 - protein, 9 aa, Homo Sapiens
DIPASKRGE

SEQ ID NO: 960798 - protein, 9 aa, Homo Sapiens
AEVFNGLKK

SEQ ID NO: 960799 - protein, 9 aa, Homo Sapiens
KNKRCKYKI

SEQ ID NO: 960800 - protein, 9 aa, Homo Sapiens
DLLQQAYAG

SEQ ID NO: 960801 - protein, 9 aa, Homo Sapiens
PLGQPGYPG

SEQ ID NO: 960802 - protein, 9 aa, Homo Sapiens
GLVSQYYSL

SEQ ID NO: 960803 - protein, 9 aa, Homo Sapiens
QLGSPLGSP

SEQ ID NO: 960804 - protein, 9 aa, Homo Sapiens
SSGSRRNAY

SEQ ID NO: 960805 - protein, 9 aa, Homo Sapiens
FWPGGMDES

SEQ ID NO: 960806 - protein, 9 aa, Homo Sapiens
GGRPNTGAG

SEQ ID NO: 960807 - protein, 9 aa, Homo Sapiens
ITHHKECVA

SEQ ID NO: 960808 - protein, 9 aa, Homo Sapiens
FSQKQNPIE

SEQ ID NO: 960809 - protein, 9 aa, Homo Sapiens
FTRNSIATL

SEQ ID NO: 960810 - protein, 9 aa, Homo Sapiens
DQPLTSTGS

SEQ ID NO: 960811 - protein, 9 aa, Homo Sapiens
QKWVEKADN

SEQ ID NO: 960812 - protein, 9 aa, Homo Sapiens
TLGSITILR

SEQ ID NO: 960813 - protein, 9 aa, Homo Sapiens
STGSDPQSG

SEQ ID NO: 960814 - protein, 9 aa, Homo Sapiens
EEPSGLEEK

SEQ ID NO: 960815 - protein, 9 aa, Homo Sapiens
NRLEKRLQQ

SEQ ID NO: 960816 - protein, 9 aa, Homo Sapiens
INFIKQKHG

SEQ ID NO: 960817 - protein, 9 aa, Homo Sapiens
ANRTSFLEN

SEQ ID NO: 960818 - protein, 9 aa, Homo Sapiens
QGHLRNLVL

SEQ ID NO: 960819 - protein, 9 aa, Homo Sapiens
ATSLKGFMR

SEQ ID NO: 960820 - protein, 9 aa, Homo Sapiens
IKDYSSGGS

SEQ ID NO: 960821 - protein, 9 aa, Homo Sapiens
LARALGPKL

SEQ ID NO: 960822 - protein, 9 aa, Homo Sapiens
SEAGNQDSG

SEQ ID NO: 960823 - protein, 9 aa, Homo Sapiens
QSHDCVSVL

SEQ ID NO: 960824 - protein, 9 aa, Homo Sapiens
AARKLLLAF

SEQ ID NO: 960825 - protein, 9 aa, Homo Sapiens
KKKKRHKGK

SEQ ID NO: 960826 - protein, 9 aa, Homo Sapiens
KSTSHHEDI

SEQ ID NO: 960827 - protein, 9 aa, Homo Sapiens
KFTEELLRK

SEQ ID NO: 960828 - protein, 9 aa, Homo Sapiens
SFMSLRGGE

SEQ ID NO: 960829 - protein, 9 aa, Homo Sapiens
CCVLMLLIL

SEQ ID NO: 960830 - protein, 9 aa, Homo Sapiens
KIYIFSFFL

SEQ ID NO: 960831 - protein, 9 aa, Homo Sapiens
PRLFLNLGP

SEQ ID NO: 960832 - protein, 9 aa, Homo Sapiens
PGKEFPTQP

SEQ ID NO: 960833 - protein, 9 aa, Homo Sapiens
VKWLEVCCV

SEQ ID NO: 960834 - protein, 9 aa, Homo Sapiens
LPELSEQDV

SEQ ID NO: 960835 - protein, 9 aa, Homo Sapiens
GSDPSLPGR

SEQ ID NO: 960836 - protein, 9 aa, Homo Sapiens
EIEAYVKVP

SEQ ID NO: 960837 - protein, 9 aa, Homo Sapiens
FSGLFEFCS

SEQ ID NO: 960838 - protein, 9 aa, Homo Sapiens
TKTIKRSLN

SEQ ID NO: 960839 - protein, 9 aa, Homo Sapiens
ISPSELGET

SEQ ID NO: 960840 - protein, 9 aa, Homo Sapiens
LLYYGGYGF

SEQ ID NO: 960841 - protein, 9 aa, Homo Sapiens
VQKNKPVFY

SEQ ID NO: 960842 - protein, 9 aa, Homo Sapiens
VCTKVFHDG

SEQ ID NO: 960843 - protein, 9 aa, Homo Sapiens
SEGWATSLK

SEQ ID NO: 960844 - protein, 9 aa, Homo Sapiens
KSIKRAPRE

SEQ ID NO: 960845 - protein, 9 aa, Homo Sapiens
GWAFCLLKH

SEQ ID NO: 960846 - protein, 9 aa, Homo Sapiens
VLADLSALK

SEQ ID NO: 960847 - protein, 9 aa, Homo Sapiens
VEDEVLNAP

SEQ ID NO: 960848 - protein, 9 aa, Homo Sapiens
YNEKNANQK

SEQ ID NO: 960849 - protein, 9 aa, Homo Sapiens
KRKINVSEY

SEQ ID NO: 960850 - protein, 9 aa, Homo Sapiens
YTTAFDMDT

SEQ ID NO: 960851 - protein, 9 aa, Homo Sapiens
AKYLKSFHN

SEQ ID NO: 960852 - protein, 9 aa, Homo Sapiens
VQRDEEGWE

SEQ ID NO: 960853 - protein, 9 aa, Homo Sapiens
SKNHPSQTH

SEQ ID NO: 960854 - protein, 9 aa, Homo Sapiens
IYERHQAQK

SEQ ID NO: 960855 - protein, 9 aa, Homo Sapiens
SVSLYQGFL

SEQ ID NO: 960856 - protein, 9 aa, Homo Sapiens
LPVDCSIKT

SEQ ID NO: 960857 - protein, 9 aa, Homo Sapiens
PAPWASLES

SEQ ID NO: 960858 - protein, 9 aa, Homo Sapiens
CFTKLFSQN

SEQ ID NO: 960859 - protein, 9 aa, Homo Sapiens
QSRTNRDDY

SEQ ID NO: 960860 - protein, 9 aa, Homo Sapiens
PLEKELSGK

SEQ ID NO: 960861 - protein, 9 aa, Homo Sapiens
REHSNPSPF

SEQ ID NO: 960862 - protein, 9 aa, Homo Sapiens
NKHQKIYNE

SEQ ID NO: 960863 - protein, 9 aa, Homo Sapiens
PQLRSATSQ

SEQ ID NO: 960864 - protein, 9 aa, Homo Sapiens
LHHEQKAKQ

SEQ ID NO: 960865 - protein, 9 aa, Homo Sapiens
YADRAVFSG

SEQ ID NO: 960866 - protein, 9 aa, Homo Sapiens
GAWSCAWFL

SEQ ID NO: 960867 - protein, 9 aa, Homo Sapiens
SLVLLGHYI

SEQ ID NO: 960868 - protein, 9 aa, Homo Sapiens
ESPQPKKII

SEQ ID NO: 960869 - protein, 9 aa, Homo Sapiens
EFSIVRNLL

SEQ ID NO: 960870 - protein, 9 aa, Homo Sapiens
EHELYVVVS

SEQ ID NO: 960871 - protein, 9 aa, Homo Sapiens
KQCEFAFGP

SEQ ID NO: 960872 - protein, 9 aa, Homo Sapiens
GKSAWIKDY

SEQ ID NO: 960873 - protein, 9 aa, Homo Sapiens
GILKYKKKY

SEQ ID NO: 960874 - protein, 9 aa, Homo Sapiens
KFLFYARRS

SEQ ID NO: 960875 - protein, 9 aa, Homo Sapiens
EKYEISSVS

SEQ ID NO: 960876 - protein, 9 aa, Homo Sapiens
SLVSMLNDL

SEQ ID NO: 960877 - protein, 9 aa, Homo Sapiens
KQMFGLFPS

SEQ ID NO: 960878 - protein, 9 aa, Homo Sapiens
PETLDSGPP

SEQ ID NO: 960879 - protein, 9 aa, Homo Sapiens
FCLQWCPKC

SEQ ID NO: 960880 - protein, 9 aa, Homo Sapiens
SLIKRLEEE

SEQ ID NO: 960881 - protein, 9 aa, Homo Sapiens
ELPPELDIF

SEQ ID NO: 960882 - protein, 9 aa, Homo Sapiens
PVQASHCEH

SEQ ID NO: 960883 - protein, 9 aa, Homo Sapiens
KDLPTRARL

SEQ ID NO: 960884 - protein, 9 aa, Homo Sapiens
PSFFEGKGP

SEQ ID NO: 960885 - protein, 9 aa, Homo Sapiens
QKPKQLQQQ

SEQ ID NO: 960886 - protein, 9 aa, Homo Sapiens
EKDCIGPKP

SEQ ID NO: 960887 - protein, 9 aa, Homo Sapiens
IAPMDIRGP

SEQ ID NO: 960888 - protein, 9 aa, Homo Sapiens
LRKTKGCSI

SEQ ID NO: 960889 - protein, 9 aa, Homo Sapiens
EFLKTCNKS

SEQ ID NO: 960890 - protein, 9 aa, Homo Sapiens
PPEYPNEKI

SEQ ID NO: 960891 - protein, 9 aa, Homo Sapiens
KAGAKEKAR

SEQ ID NO: 960892 - protein, 9 aa, Homo Sapiens
HMHSKERRK

SEQ ID NO: 960893 - protein, 9 aa, Homo Sapiens
NITLRYQLY

SEQ ID NO: 960894 - protein, 9 aa, Homo Sapiens
KSKKKKKKF

SEQ ID NO: 960895 - protein, 9 aa, Homo Sapiens
FLTTKAVLL

SEQ ID NO: 960896 - protein, 9 aa, Homo Sapiens
ATPLDFFHI

SEQ ID NO: 960897 - protein, 9 aa, Homo Sapiens
YSSFPEEAA

SEQ ID NO: 960898 - protein, 9 aa, Homo Sapiens
KQNFHKARR

SEQ ID NO: 960899 - protein, 9 aa, Homo Sapiens
ELSKNLVCT

SEQ ID NO: 960900 - protein, 9 aa, Homo Sapiens
VGEKVNTSS

SEQ ID NO: 960901 - protein, 9 aa, Homo Sapiens
ICFLLQDTV

SEQ ID NO: 960902 - protein, 9 aa, Homo Sapiens
PLRKTKSTN

SEQ ID NO: 960903 - protein, 9 aa, Homo Sapiens
CIFSFSADV

SEQ ID NO: 960904 - protein, 9 aa, Homo Sapiens
SCEPPSVAS

SEQ ID NO: 960905 - protein, 9 aa, Homo Sapiens
LGFGHGARE

SEQ ID NO: 960906 - protein, 9 aa, Homo Sapiens
RVLQLQGQE

SEQ ID NO: 960907 - protein, 9 aa, Homo Sapiens
TYGIIAAIG

SEQ ID NO: 960908 - protein, 9 aa, Homo Sapiens
TPDGRKINF

SEQ ID NO: 960909 - protein, 9 aa, Homo Sapiens
EVQSKKKEA

SEQ ID NO: 960910 - protein, 9 aa, Homo Sapiens
CLQEAVISA

SEQ ID NO: 960911 - protein, 9 aa, Homo Sapiens
LDTWYVIKL

SEQ ID NO: 960912 - protein, 9 aa, Homo Sapiens
ETYSSLVLL

SEQ ID NO: 960913 - protein, 9 aa, Homo Sapiens
KGVTGEWAR

SEQ ID NO: 960914 - protein, 9 aa, Homo Sapiens
KKSLTSEKD

SEQ ID NO: 960915 - protein, 9 aa, Homo Sapiens
QAFQHGFKL

SEQ ID NO: 960916 - protein, 9 aa, Homo Sapiens
ENEQDQNFI

SEQ ID NO: 960917 - protein, 9 aa, Homo Sapiens
EKGFGELFE

SEQ ID NO: 960918 - protein, 9 aa, Homo Sapiens
RRWAPITCS

SEQ ID NO: 960919 - protein, 9 aa, Homo Sapiens
VRNLLSHPP

SEQ ID NO: 960920 - protein, 9 aa, Homo Sapiens
CVKLDRLRF

SEQ ID NO: 960921 - protein, 9 aa, Homo Sapiens
PLRVLFFVA

SEQ ID NO: 960922 - protein, 9 aa, Homo Sapiens
TSVFFISTV

SEQ ID NO: 960923 - protein, 9 aa, Homo Sapiens
MRNAMFVKE

SEQ ID NO: 960924 - protein, 9 aa, Homo Sapiens
SVFSLPFVQ

SEQ ID NO: 960925 - protein, 9 aa, Homo Sapiens
SSPFLPSRT

SEQ ID NO: 960926 - protein, 9 aa, Homo Sapiens
EKHRLLSQA

SEQ ID NO: 960927 - protein, 9 aa, Homo Sapiens
NLCLKERDW

SEQ ID NO: 960928 - protein, 9 aa, Homo Sapiens
RRGSEAPEA

SEQ ID NO: 960929 - protein, 9 aa, Homo Sapiens
LGPSRDPDS

SEQ ID NO: 960930 - protein, 9 aa, Homo Sapiens
SHRRDSDLG

SEQ ID NO: 960931 - protein, 9 aa, Homo Sapiens
GKPEMNSEG

SEQ ID NO: 960932 - protein, 9 aa, Homo Sapiens
EMKKFLFYA

SEQ ID NO: 960933 - protein, 9 aa, Homo Sapiens
ELHSKVNYL

SEQ ID NO: 960934 - protein, 9 aa, Homo Sapiens
GGFLRGPAS

SEQ ID NO: 960935 - protein, 9 aa, Homo Sapiens
GFSTEQAVV

SEQ ID NO: 960936 - protein, 9 aa, Homo Sapiens
IVFNLEEWI

SEQ ID NO: 960937 - protein, 9 aa, Homo Sapiens
TQTGSRTTE

SEQ ID NO: 960938 - protein, 9 aa, Homo Sapiens
SKVYSVGSN

SEQ ID NO: 960939 - protein, 9 aa, Homo Sapiens
KRGLTVTSE

SEQ ID NO: 960940 - protein, 9 aa, Homo Sapiens
VPFTIIPCV

SEQ ID NO: 960941 - protein, 9 aa, Homo Sapiens
EEFQSSFAS

SEQ ID NO: 960942 - protein, 9 aa, Homo Sapiens
DPLGCQGCP

SEQ ID NO: 960943 - protein, 9 aa, Homo Sapiens
FDDENLLRK

SEQ ID NO: 960944 - protein, 9 aa, Homo Sapiens
HEKFVHPKM

SEQ ID NO: 960945 - protein, 9 aa, Homo Sapiens
LVFTMLADI

SEQ ID NO: 960946 - protein, 9 aa, Homo Sapiens
CRTHRRDSH

SEQ ID NO: 960947 - protein, 9 aa, Homo Sapiens
SEQGPYEEI

SEQ ID NO: 960948 - protein, 9 aa, Homo Sapiens
TDALQTVII

SEQ ID NO: 960949 - protein, 9 aa, Homo Sapiens
DLVEIKGED

SEQ ID NO: 960950 - protein, 9 aa, Homo Sapiens
LTYGIIAAI

SEQ ID NO: 960951 - protein, 9 aa, Homo Sapiens
IEPGVFVSL

SEQ ID NO: 960952 - protein, 9 aa, Homo Sapiens
SKSYDLKVS

SEQ ID NO: 960953 - protein, 9 aa, Homo Sapiens
DKEETPNHK

SEQ ID NO: 960954 - protein, 9 aa, Homo Sapiens
YGYSVRLSF

SEQ ID NO: 960955 - protein, 9 aa, Homo Sapiens
TVGAIGTHS

SEQ ID NO: 960956 - protein, 9 aa, Homo Sapiens
FARNQVFSQ

SEQ ID NO: 960957 - protein, 9 aa, Homo Sapiens
EEGLLLIPG

SEQ ID NO: 960958 - protein, 9 aa, Homo Sapiens
YSSTNNSVS

SEQ ID NO: 960959 - protein, 9 aa, Homo Sapiens
THDASGQLG

SEQ ID NO: 960960 - protein, 9 aa, Homo Sapiens
LLRKHVKTV

SEQ ID NO: 960961 - protein, 9 aa, Homo Sapiens
KDMISDIQF

SEQ ID NO: 960962 - protein, 9 aa, Homo Sapiens
SNSTFFSRT

SEQ ID NO: 960963 - protein, 9 aa, Homo Sapiens
SLQARKSSS

SEQ ID NO: 960964 - protein, 9 aa, Homo Sapiens
HPESSLQRE

SEQ ID NO: 960965 - protein, 9 aa, Homo Sapiens
PKPTVLASR

SEQ ID NO: 960966 - protein, 9 aa, Homo Sapiens
GDAAGHPGS

SEQ ID NO: 960967 - protein, 9 aa, Homo Sapiens
FTSRPGACL

SEQ ID NO: 960968 - protein, 9 aa, Homo Sapiens
LGIIFSYSQ

SEQ ID NO: 960969 - protein, 9 aa, Homo Sapiens
SCSPNTSVF

SEQ ID NO: 960970 - protein, 9 aa, Homo Sapiens
CDTKVLIED

SEQ ID NO: 960971 - protein, 9 aa, Homo Sapiens
EISSVSTFL

SEQ ID NO: 960972 - protein, 9 aa, Homo Sapiens
GPLPRESSP

SEQ ID NO: 960973 - protein, 9 aa, Homo Sapiens
SSRSSPRVS

SEQ ID NO: 960974 - protein, 9 aa, Homo Sapiens
TRLPLLIDT

SEQ ID NO: 960975 - protein, 9 aa, Homo Sapiens
KEKYKNRKP

SEQ ID NO: 960976 - protein, 9 aa, Homo Sapiens
SQRNQALNE

SEQ ID NO: 960977 - protein, 9 aa, Homo Sapiens
NSEWITSTK

SEQ ID NO: 960978 - protein, 9 aa, Homo Sapiens
SSAKPSQPS

SEQ ID NO: 960979 - protein, 9 aa, Homo Sapiens
NREAFLGEA

SEQ ID NO: 960980 - protein, 9 aa, Homo Sapiens
TTTTKQPTL

SEQ ID NO: 960981 - protein, 9 aa, Homo Sapiens
LVPQFPPGS

SEQ ID NO: 960982 - protein, 9 aa, Homo Sapiens
CRMAYQDHE

SEQ ID NO: 960983 - protein, 9 aa, Homo Sapiens
HFKIHVRKL

SEQ ID NO: 960984 - protein, 9 aa, Homo Sapiens
QDLNNCSVM

SEQ ID NO: 960985 - protein, 9 aa, Homo Sapiens
KAILISDDE

SEQ ID NO: 960986 - protein, 9 aa, Homo Sapiens
TRAPPSLGV

SEQ ID NO: 960987 - protein, 9 aa, Homo Sapiens
ADCSGPDLS

SEQ ID NO: 960988 - protein, 9 aa, Homo Sapiens
QEEENEEND

SEQ ID NO: 960989 - protein, 9 aa, Homo Sapiens
ESWKKSLRN

SEQ ID NO: 960990 - protein, 9 aa, Homo Sapiens
ILIEKAQGP

SEQ ID NO: 960991 - protein, 9 aa, Homo Sapiens
SALWVLLLF

SEQ ID NO: 960992 - protein, 9 aa, Homo Sapiens
DVSMPKLEG

SEQ ID NO: 960993 - protein, 9 aa, Homo Sapiens
ACCLADIFC

SEQ ID NO: 960994 - protein, 9 aa, Homo Sapiens
HSCPHSSEI

SEQ ID NO: 960995 - protein, 9 aa, Homo Sapiens
KYKEGYCKQ

SEQ ID NO: 960996 - protein, 9 aa, Homo Sapiens
SSESSFEYG

SEQ ID NO: 960997 - protein, 9 aa, Homo Sapiens
EIPPYRIRK

SEQ ID NO: 960998 - protein, 9 aa, Homo Sapiens
LGFGELWRG

SEQ ID NO: 960999 - protein, 9 aa, Homo Sapiens
YLEKRVKKL

SEQ ID NO: 961000 - protein, 9 aa, Homo Sapiens
RLCRHVSSQ

SEQ ID NO: 961001 - protein, 9 aa, Homo Sapiens
RSKRLQCGP

SEQ ID NO: 961002 - protein, 9 aa, Homo Sapiens
HRFLLHMKP

SEQ ID NO: 961003 - protein, 9 aa, Homo Sapiens
FFRTPKIVS

SEQ ID NO: 961004 - protein, 9 aa, Homo Sapiens
PPSVASTCQ

SEQ ID NO: 961005 - protein, 9 aa, Homo Sapiens
LDCRNVGIR

SEQ ID NO: 961006 - protein, 9 aa, Homo Sapiens
APGSGPLPR

SEQ ID NO: 961007 - protein, 9 aa, Homo Sapiens
GDDPTFSFE

SEQ ID NO: 961008 - protein, 9 aa, Homo Sapiens
VSLFLDNTY

SEQ ID NO: 961009 - protein, 9 aa, Homo Sapiens
ISAKYLKSF

SEQ ID NO: 961010 - protein, 9 aa, Homo Sapiens
LKYKKKYYT

SEQ ID NO: 961011 - protein, 9 aa, Homo Sapiens
ASFLRNVLS

SEQ ID NO: 961012 - protein, 9 aa, Homo Sapiens
ITSHTISPT

SEQ ID NO: 961013 - protein, 9 aa, Homo Sapiens
ALAAARRQS

SEQ ID NO: 961014 - protein, 9 aa, Homo Sapiens
SFTKIGIHL

SEQ ID NO: 961015 - protein, 9 aa, Homo Sapiens
SVFKLITEA

SEQ ID NO: 961016 - protein, 9 aa, Homo Sapiens
RPGFLIFWD

SEQ ID NO: 961017 - protein, 9 aa, Homo Sapiens
WPRLFSDGI

SEQ ID NO: 961018 - protein, 9 aa, Homo Sapiens
IIFFFLALT

SEQ ID NO: 961019 - protein, 9 aa, Homo Sapiens
PAKSEECDK

SEQ ID NO: 961020 - protein, 9 aa, Homo Sapiens
LLVGLFHEE

SEQ ID NO: 961021 - protein, 9 aa, Homo Sapiens
LGAHVGGIV

SEQ ID NO: 961022 - protein, 9 aa, Homo Sapiens
KSGTSGSWQ

SEQ ID NO: 961023 - protein, 9 aa, Homo Sapiens
ASYSFIVVS

SEQ ID NO: 961024 - protein, 9 aa, Homo Sapiens
IFSASCPIF

SEQ ID NO: 961025 - protein, 9 aa, Homo Sapiens
RESIRKFLY

SEQ ID NO: 961026 - protein, 9 aa, Homo Sapiens
PESLIKRLE

SEQ ID NO: 961027 - protein, 9 aa, Homo Sapiens
VKVLPIPVF

SEQ ID NO: 961028 - protein, 9 aa, Homo Sapiens
SRLSVAALS

SEQ ID NO: 961029 - protein, 9 aa, Homo Sapiens
PLTKTEQLL

SEQ ID NO: 961030 - protein, 9 aa, Homo Sapiens
ETAETVLPL

SEQ ID NO: 961031 - protein, 9 aa, Homo Sapiens
AAAAALSVC

SEQ ID NO: 961032 - protein, 9 aa, Homo Sapiens
TEHGEKTAN

SEQ ID NO: 961033 - protein, 9 aa, Homo Sapiens
NPLLTQALS

SEQ ID NO: 961034 - protein, 9 aa, Homo Sapiens
NYCGETVVL

SEQ ID NO: 961035 - protein, 9 aa, Homo Sapiens
MDWPQTFEK

SEQ ID NO: 961036 - protein, 9 aa, Homo Sapiens
ALFRELLTF

SEQ ID NO: 961037 - protein, 9 aa, Homo Sapiens
KADNNENLQ

SEQ ID NO: 961038 - protein, 9 aa, Homo Sapiens
RTQRREHEL

SEQ ID NO: 961039 - protein, 9 aa, Homo Sapiens
FPETMTRAE

SEQ ID NO: 961040 - protein, 9 aa, Homo Sapiens
PLWRQIRSG

SEQ ID NO: 961041 - protein, 9 aa, Homo Sapiens
VKRQSSSSK

SEQ ID NO: 961042 - protein, 9 aa, Homo Sapiens
RLGVIQKSG

SEQ ID NO: 961043 - protein, 9 aa, Homo Sapiens
ILGKMAPWD

SEQ ID NO: 961044 - protein, 9 aa, Homo Sapiens
STSGRQSFS

SEQ ID NO: 961045 - protein, 9 aa, Homo Sapiens
QKLKSFPKD

SEQ ID NO: 961046 - protein, 9 aa, Homo Sapiens
FLRNVLSSF

SEQ ID NO: 961047 - protein, 9 aa, Homo Sapiens
TYNGLVDGS

SEQ ID NO: 961048 - protein, 9 aa, Homo Sapiens
QRSVGRPSL

SEQ ID NO: 961049 - protein, 9 aa, Homo Sapiens
KVEDKLFEE

SEQ ID NO: 961050 - protein, 9 aa, Homo Sapiens
RAYLLGDIP

SEQ ID NO: 961051 - protein, 9 aa, Homo Sapiens
FLRKKDGEF

SEQ ID NO: 961052 - protein, 9 aa, Homo Sapiens
SRSDHLTIH

SEQ ID NO: 961053 - protein, 9 aa, Homo Sapiens
CRCKALKEK

SEQ ID NO: 961054 - protein, 9 aa, Homo Sapiens
KERTRYFSV

SEQ ID NO: 961055 - protein, 9 aa, Homo Sapiens
PDPCKNIFF

SEQ ID NO: 961056 - protein, 9 aa, Homo Sapiens
NIREKFFRS

SEQ ID NO: 961057 - protein, 9 aa, Homo Sapiens
TPEGTYVSS

SEQ ID NO: 961058 - protein, 9 aa, Homo Sapiens
EILPSSDRT

SEQ ID NO: 961059 - protein, 9 aa, Homo Sapiens
AACEKARQG

SEQ ID NO: 961060 - protein, 9 aa, Homo Sapiens
KAQPGSLWW

SEQ ID NO: 961061 - protein, 9 aa, Homo Sapiens
FIFLPYNEV

SEQ ID NO: 961062 - protein, 9 aa, Homo Sapiens
SRGAAAGVT

SEQ ID NO: 961063 - protein, 9 aa, Homo Sapiens
ETNTDTKVE

SEQ ID NO: 961064 - protein, 9 aa, Homo Sapiens
GWVGGLVPN

SEQ ID NO: 961065 - protein, 9 aa, Homo Sapiens
KIWHPESSL

SEQ ID NO: 961066 - protein, 9 aa, Homo Sapiens
LSSPDNFWY

SEQ ID NO: 961067 - protein, 9 aa, Homo Sapiens
LLGLPASSW

SEQ ID NO: 961068 - protein, 9 aa, Homo Sapiens
GPDFVPGAL

SEQ ID NO: 961069 - protein, 9 aa, Homo Sapiens
PFFLRQALR

SEQ ID NO: 961070 - protein, 9 aa, Homo Sapiens
NLFCFGEST

SEQ ID NO: 961071 - protein, 9 aa, Homo Sapiens
KALHFKSST

SEQ ID NO: 961072 - protein, 9 aa, Homo Sapiens
WAPLCATYW

SEQ ID NO: 961073 - protein, 9 aa, Homo Sapiens
LGADGCDTM

SEQ ID NO: 961074 - protein, 9 aa, Homo Sapiens
TGGCRSEPI

SEQ ID NO: 961075 - protein, 9 aa, Homo Sapiens
FIRLTPTQV

SEQ ID NO: 961076 - protein, 9 aa, Homo Sapiens
YVDCVIKGQ

SEQ ID NO: 961077 - protein, 9 aa, Homo Sapiens
QSQRNQALN

SEQ ID NO: 961078 - protein, 9 aa, Homo Sapiens
SLFLSDLLT

SEQ ID NO: 961079 - protein, 9 aa, Homo Sapiens
ETMNAACEL

SEQ ID NO: 961080 - protein, 9 aa, Homo Sapiens
KLSGGAPAA

SEQ ID NO: 961081 - protein, 9 aa, Homo Sapiens
KRWEHMGQE

SEQ ID NO: 961082 - protein, 9 aa, Homo Sapiens
VRGQRPGSL

SEQ ID NO: 961083 - protein, 9 aa, Homo Sapiens
KEGLLTNKA

SEQ ID NO: 961084 - protein, 9 aa, Homo Sapiens
LLIFKGINV

SEQ ID NO: 961085 - protein, 9 aa, Homo Sapiens
ASTVEYLLG

SEQ ID NO: 961086 - protein, 9 aa, Homo Sapiens
KKKYYTFNS

SEQ ID NO: 961087 - protein, 9 aa, Homo Sapiens
TTVSWGEWD

SEQ ID NO: 961088 - protein, 9 aa, Homo Sapiens
PHPAKPLHP

SEQ ID NO: 961089 - protein, 9 aa, Homo Sapiens
ILESANRLR

SEQ ID NO: 961090 - protein, 9 aa, Homo Sapiens
HCICRKPDI

SEQ ID NO: 961091 - protein, 9 aa, Homo Sapiens
QPGRIIHVV

SEQ ID NO: 961092 - protein, 9 aa, Homo Sapiens
AVARCFHSP

SEQ ID NO: 961093 - protein, 9 aa, Homo Sapiens
KKNEKPAVK

SEQ ID NO: 961094 - protein, 9 aa, Homo Sapiens
PVQYAHRPH

SEQ ID NO: 961095 - protein, 9 aa, Homo Sapiens
CILEKPFEY

SEQ ID NO: 961096 - protein, 9 aa, Homo Sapiens
RELQEKMDP

SEQ ID NO: 961097 - protein, 9 aa, Homo Sapiens
FHHLHPHHH

SEQ ID NO: 961098 - protein, 9 aa, Homo Sapiens
FNHVKTGIE

SEQ ID NO: 961099 - protein, 9 aa, Homo Sapiens
LEKRVKKLQ

SEQ ID NO: 961100 - protein, 9 aa, Homo Sapiens
YERHQAQKD

SEQ ID NO: 961101 - protein, 9 aa, Homo Sapiens
THQRIYVGE

SEQ ID NO: 961102 - protein, 9 aa, Homo Sapiens
MGNVPNRGG

SEQ ID NO: 961103 - protein, 9 aa, Homo Sapiens
GQEEGMDSE

SEQ ID NO: 961104 - protein, 9 aa, Homo Sapiens
ESNPELYKF

SEQ ID NO: 961105 - protein, 9 aa, Homo Sapiens
TTALCCPSD

SEQ ID NO: 961106 - protein, 9 aa, Homo Sapiens
VLAVRFSGF

SEQ ID NO: 961107 - protein, 9 aa, Homo Sapiens
IEIQKQESS

SEQ ID NO: 961108 - protein, 9 aa, Homo Sapiens
PCQIELYRV

SEQ ID NO: 961109 - protein, 9 aa, Homo Sapiens
PPLPPLPGL

SEQ ID NO: 961110 - protein, 9 aa, Homo Sapiens
QKEEIEIQK

SEQ ID NO: 961111 - protein, 9 aa, Homo Sapiens
NIPLDPLSG

SEQ ID NO: 961112 - protein, 9 aa, Homo Sapiens
FDQDNDKVY

SEQ ID NO: 961113 - protein, 9 aa, Homo Sapiens
EDPQNQRLS

SEQ ID NO: 961114 - protein, 9 aa, Homo Sapiens
THWNFDPYL

SEQ ID NO: 961115 - protein, 9 aa, Homo Sapiens
TYLIKVLKR

SEQ ID NO: 961116 - protein, 9 aa, Homo Sapiens
FKEVPRGST

SEQ ID NO: 961117 - protein, 9 aa, Homo Sapiens
AFWEKGFGE

SEQ ID NO: 961118 - protein, 9 aa, Homo Sapiens
ERRKKAFTT

SEQ ID NO: 961119 - protein, 9 aa, Homo Sapiens
LYCEATLLQ

SEQ ID NO: 961120 - protein, 9 aa, Homo Sapiens
QEEGMVIFH

SEQ ID NO: 961121 - protein, 9 aa, Homo Sapiens
NRIIQRLRS

SEQ ID NO: 961122 - protein, 9 aa, Homo Sapiens
LKDLGVPVT

SEQ ID NO: 961123 - protein, 9 aa, Homo Sapiens
SLLTPHHRT

SEQ ID NO: 961124 - protein, 9 aa, Homo Sapiens
PQQLEESKK

SEQ ID NO: 961125 - protein, 9 aa, Homo Sapiens
MALPIKSKK

SEQ ID NO: 961126 - protein, 9 aa, Homo Sapiens
DQGKEKARP

SEQ ID NO: 961127 - protein, 9 aa, Homo Sapiens
LIFKGINVL

SEQ ID NO: 961128 - protein, 9 aa, Homo Sapiens
QSLLNQKIR

SEQ ID NO: 961129 - protein, 9 aa, Homo Sapiens
TSHTISPTF

SEQ ID NO: 961130 - protein, 9 aa, Homo Sapiens
VNHGAFCLQ

SEQ ID NO: 961131 - protein, 9 aa, Homo Sapiens
PSPLGGGAP

SEQ ID NO: 961132 - protein, 9 aa, Homo Sapiens
HSALIISQV

SEQ ID NO: 961133 - protein, 9 aa, Homo Sapiens
IETNIRNQE

SEQ ID NO: 961134 - protein, 9 aa, Homo Sapiens
ISAAVTFVD

SEQ ID NO: 961135 - protein, 9 aa, Homo Sapiens
SFYVGSNGD

SEQ ID NO: 961136 - protein, 9 aa, Homo Sapiens
LQAELSKNL

SEQ ID NO: 961137 - protein, 9 aa, Homo Sapiens
GSTFENITQ

SEQ ID NO: 961138 - protein, 9 aa, Homo Sapiens
INKELYAGV

SEQ ID NO: 961139 - protein, 9 aa, Homo Sapiens
IGLLISAEK

SEQ ID NO: 961140 - protein, 9 aa, Homo Sapiens
QVCLAHPEL

SEQ ID NO: 961141 - protein, 9 aa, Homo Sapiens
EYNAVKKRE

SEQ ID NO: 961142 - protein, 9 aa, Homo Sapiens
VSKSYDLKV

SEQ ID NO: 961143 - protein, 9 aa, Homo Sapiens
VVFIVRCFN

SEQ ID NO: 961144 - protein, 9 aa, Homo Sapiens
TFDGAFYAF

SEQ ID NO: 961145 - protein, 9 aa, Homo Sapiens
VGKSIATIT

SEQ ID NO: 961146 - protein, 9 aa, Homo Sapiens
AHELILNFI

SEQ ID NO: 961147 - protein, 9 aa, Homo Sapiens
CKGTRHTAC

SEQ ID NO: 961148 - protein, 9 aa, Homo Sapiens
MAFVYTQCS

SEQ ID NO: 961149 - protein, 9 aa, Homo Sapiens
DQFEEKHAK

SEQ ID NO: 961150 - protein, 9 aa, Homo Sapiens
SACVQLFDS

SEQ ID NO: 961151 - protein, 9 aa, Homo Sapiens
LDNLLFQLI

SEQ ID NO: 961152 - protein, 9 aa, Homo Sapiens
QMLGNLIKV

SEQ ID NO: 961153 - protein, 9 aa, Homo Sapiens
NPSPFQDTD

SEQ ID NO: 961154 - protein, 9 aa, Homo Sapiens
RQSSSSKCH

SEQ ID NO: 961155 - protein, 9 aa, Homo Sapiens
INSSPALLS

SEQ ID NO: 961156 - protein, 9 aa, Homo Sapiens
RSILAQIIG

SEQ ID NO: 961157 - protein, 9 aa, Homo Sapiens
PIGIIQHLE

SEQ ID NO: 961158 - protein, 9 aa, Homo Sapiens
ANRLEKRLQ

SEQ ID NO: 961159 - protein, 9 aa, Homo Sapiens
PLFFLFLFM

SEQ ID NO: 961160 - protein, 9 aa, Homo Sapiens
SDESPEASL

SEQ ID NO: 961161 - protein, 9 aa, Homo Sapiens
WAPGRAPNQ

SEQ ID NO: 961162 - protein, 9 aa, Homo Sapiens
ISRSESLCC

SEQ ID NO: 961163 - protein, 9 aa, Homo Sapiens
RSSSRMLPP

SEQ ID NO: 961164 - protein, 9 aa, Homo Sapiens
ETEADRLIS

SEQ ID NO: 961165 - protein, 9 aa, Homo Sapiens
SIGKSWIDK

SEQ ID NO: 961166 - protein, 9 aa, Homo Sapiens
LILQHLLRF

SEQ ID NO: 961167 - protein, 9 aa, Homo Sapiens
KIHVRKLLT

SEQ ID NO: 961168 - protein, 9 aa, Homo Sapiens
LELRFLGLC

SEQ ID NO: 961169 - protein, 9 aa, Homo Sapiens
GMEIANCYR

SEQ ID NO: 961170 - protein, 9 aa, Homo Sapiens
SMDLFRTIF

SEQ ID NO: 961171 - protein, 9 aa, Homo Sapiens
RLASQSKAC

SEQ ID NO: 961172 - protein, 9 aa, Homo Sapiens
RAREKDCIG

SEQ ID NO: 961173 - protein, 9 aa, Homo Sapiens
LLGDDPTFS

SEQ ID NO: 961174 - protein, 9 aa, Homo Sapiens
IIYIVTVMV

SEQ ID NO: 961175 - protein, 9 aa, Homo Sapiens
KRRVLLIGS

SEQ ID NO: 961176 - protein, 9 aa, Homo Sapiens
QFPPGSPQR

SEQ ID NO: 961177 - protein, 9 aa, Homo Sapiens
ADLSTMSAE

SEQ ID NO: 961178 - protein, 9 aa, Homo Sapiens
SAFLDWPRM

SEQ ID NO: 961179 - protein, 9 aa, Homo Sapiens
FLNLGPPQG

SEQ ID NO: 961180 - protein, 9 aa, Homo Sapiens
KRISYSKGQ

SEQ ID NO: 961181 - protein, 9 aa, Homo Sapiens
ASDYLNALE

SEQ ID NO: 961182 - protein, 9 aa, Homo Sapiens
SCILPWLNK

SEQ ID NO: 961183 - protein, 9 aa, Homo Sapiens
CPEGFVFKH

SEQ ID NO: 961184 - protein, 9 aa, Homo Sapiens
PVLSEGLQR

SEQ ID NO: 961185 - protein, 9 aa, Homo Sapiens
ENGENAPIH

SEQ ID NO: 961186 - protein, 9 aa, Homo Sapiens
RRRFSINDR

SEQ ID NO: 961187 - protein, 9 aa, Homo Sapiens
WSTGKEVAG

SEQ ID NO: 961188 - protein, 9 aa, Homo Sapiens
SFSGALCPT

SEQ ID NO: 961189 - protein, 9 aa, Homo Sapiens
EEENEENDD

SEQ ID NO: 961190 - protein, 9 aa, Homo Sapiens
GGSFKNPSF

SEQ ID NO: 961191 - protein, 9 aa, Homo Sapiens
SLYQGFLII

SEQ ID NO: 961192 - protein, 9 aa, Homo Sapiens
MPNTVFIGG

SEQ ID NO: 961193 - protein, 9 aa, Homo Sapiens
IAHGPPAQK

SEQ ID NO: 961194 - protein, 9 aa, Homo Sapiens
LCNRTSLGA

SEQ ID NO: 961195 - protein, 9 aa, Homo Sapiens
SESPSCIRH

SEQ ID NO: 961196 - protein, 9 aa, Homo Sapiens
DNKGADATG

SEQ ID NO: 961197 - protein, 9 aa, Homo Sapiens
PQRGNQSQG

SEQ ID NO: 961198 - protein, 9 aa, Homo Sapiens
SKLLPASHS

SEQ ID NO: 961199 - protein, 9 aa, Homo Sapiens
YKAKMPSYL

SEQ ID NO: 961200 - protein, 9 aa, Homo Sapiens
KQPCQPPSV

SEQ ID NO: 961201 - protein, 9 aa, Homo Sapiens
RTHRRDSHK

SEQ ID NO: 961202 - protein, 9 aa, Homo Sapiens
QMIAVILES

SEQ ID NO: 961203 - protein, 9 aa, Homo Sapiens
ALISVNKFL

SEQ ID NO: 961204 - protein, 9 aa, Homo Sapiens
NQMLGNLIK

SEQ ID NO: 961205 - protein, 9 aa, Homo Sapiens
PKLKRAKEN

SEQ ID NO: 961206 - protein, 9 aa, Homo Sapiens
EAEPSIDVI

SEQ ID NO: 961207 - protein, 9 aa, Homo Sapiens
LLTTALPFM

SEQ ID NO: 961208 - protein, 9 aa, Homo Sapiens
FNMGEIETL

SEQ ID NO: 961209 - protein, 9 aa, Homo Sapiens
EGLLYKHLI

SEQ ID NO: 961210 - protein, 9 aa, Homo Sapiens
QHKNQRRNL

SEQ ID NO: 961211 - protein, 9 aa, Homo Sapiens
PAFLWAVTL

SEQ ID NO: 961212 - protein, 9 aa, Homo Sapiens
FSSPSFLNF

SEQ ID NO: 961213 - protein, 9 aa, Homo Sapiens
LPWLNKTNS

SEQ ID NO: 961214 - protein, 9 aa, Homo Sapiens
ITSIDARGS

SEQ ID NO: 961215 - protein, 9 aa, Homo Sapiens
KNEVCKQDY

SEQ ID NO: 961216 - protein, 9 aa, Homo Sapiens
DSKTSQVPG

SEQ ID NO: 961217 - protein, 9 aa, Homo Sapiens
KHWHQLMKA

SEQ ID NO: 961218 - protein, 9 aa, Homo Sapiens
NELESVLGC

SEQ ID NO: 961219 - protein, 9 aa, Homo Sapiens
PQAKDPWVY

SEQ ID NO: 961220 - protein, 9 aa, Homo Sapiens
GSTSGRQSF

SEQ ID NO: 961221 - protein, 9 aa, Homo Sapiens
APRISVFFY

SEQ ID NO: 961222 - protein, 9 aa, Homo Sapiens
LRKELDCLK

SEQ ID NO: 961223 - protein, 9 aa, Homo Sapiens
TVRERVRIP

SEQ ID NO: 961224 - protein, 9 aa, Homo Sapiens
FEEKHAKER

SEQ ID NO: 961225 - protein, 9 aa, Homo Sapiens
GTPYWMVPE

SEQ ID NO: 961226 - protein, 9 aa, Homo Sapiens
PETKEDVIS

SEQ ID NO: 961227 - protein, 9 aa, Homo Sapiens
RKTKGCSIT

SEQ ID NO: 961228 - protein, 9 aa, Homo Sapiens
FVYTQCSSA

SEQ ID NO: 961229 - protein, 9 aa, Homo Sapiens
LSGPGFSEK

SEQ ID NO: 961230 - protein, 9 aa, Homo Sapiens
YISRFWTFE

SEQ ID NO: 961231 - protein, 9 aa, Homo Sapiens
REFPNGPQI

SEQ ID NO: 961232 - protein, 9 aa, Homo Sapiens
FLFDQQNCT

SEQ ID NO: 961233 - protein, 9 aa, Homo Sapiens
LGSTSHSTV

SEQ ID NO: 961234 - protein, 9 aa, Homo Sapiens
LVLLYRLLI

SEQ ID NO: 961235 - protein, 9 aa, Homo Sapiens
VGVDSLNLC

SEQ ID NO: 961236 - protein, 9 aa, Homo Sapiens
AAKNISEVE

SEQ ID NO: 961237 - protein, 9 aa, Homo Sapiens
NFTRNSIAT

SEQ ID NO: 961238 - protein, 9 aa, Homo Sapiens
ISWPRLFSD

SEQ ID NO: 961239 - protein, 9 aa, Homo Sapiens
SRRNAYQGV

SEQ ID NO: 961240 - protein, 9 aa, Homo Sapiens
KMPGLPQYL

SEQ ID NO: 961241 - protein, 9 aa, Homo Sapiens
FSTSPLLPM

SEQ ID NO: 961242 - protein, 9 aa, Homo Sapiens
SDPPKLKRA

SEQ ID NO: 961243 - protein, 9 aa, Homo Sapiens
LLWPLSVPA

SEQ ID NO: 961244 - protein, 9 aa, Homo Sapiens
QLGLISQEL

SEQ ID NO: 961245 - protein, 9 aa, Homo Sapiens
ESKPKPRLF

SEQ ID NO: 961246 - protein, 9 aa, Homo Sapiens
FSQAEKPKP

SEQ ID NO: 961247 - protein, 9 aa, Homo Sapiens
DSADIIFFI

SEQ ID NO: 961248 - protein, 9 aa, Homo Sapiens
PEPLNQVTE

SEQ ID NO: 961249 - protein, 9 aa, Homo Sapiens
LGWVGGLVP

SEQ ID NO: 961250 - protein, 9 aa, Homo Sapiens
LTNKAVLSP

SEQ ID NO: 961251 - protein, 9 aa, Homo Sapiens
ALASYLDLL

SEQ ID NO: 961252 - protein, 9 aa, Homo Sapiens
LLLLLLSSQ

SEQ ID NO: 961253 - protein, 9 aa, Homo Sapiens
GEAKVFRLR

SEQ ID NO: 961254 - protein, 9 aa, Homo Sapiens
DLSPQENSF

SEQ ID NO: 961255 - protein, 9 aa, Homo Sapiens
EVIGLEIEA

SEQ ID NO: 961256 - protein, 9 aa, Homo Sapiens
PTQSEKEMT

SEQ ID NO: 961257 - protein, 9 aa, Homo Sapiens
ALKVAARGL

SEQ ID NO: 961258 - protein, 9 aa, Homo Sapiens
SKCHPPACE

SEQ ID NO: 961259 - protein, 9 aa, Homo Sapiens
RAPPQFVVW

SEQ ID NO: 961260 - protein, 9 aa, Homo Sapiens
HNLFAARDS

SEQ ID NO: 961261 - protein, 9 aa, Homo Sapiens
IEAHEKDMK

SEQ ID NO: 961262 - protein, 9 aa, Homo Sapiens
HYSSEGLDC

SEQ ID NO: 961263 - protein, 9 aa, Homo Sapiens
EKVNTSSVA

SEQ ID NO: 961264 - protein, 9 aa, Homo Sapiens
LGLPASSWW

SEQ ID NO: 961265 - protein, 9 aa, Homo Sapiens
MILIEKAQG

SEQ ID NO: 961266 - protein, 9 aa, Homo Sapiens
NAALSCNKN

SEQ ID NO: 961267 - protein, 9 aa, Homo Sapiens
LHAAKCPDI

SEQ ID NO: 961268 - protein, 9 aa, Homo Sapiens
AGGLIQDLN

SEQ ID NO: 961269 - protein, 9 aa, Homo Sapiens
RNQEELKGK

SEQ ID NO: 961270 - protein, 9 aa, Homo Sapiens
LFPTCQLKE

SEQ ID NO: 961271 - protein, 9 aa, Homo Sapiens
AAEKFRLEL

SEQ ID NO: 961272 - protein, 9 aa, Homo Sapiens
EMPRLFLNL

SEQ ID NO: 961273 - protein, 9 aa, Homo Sapiens
SVVVRRNLV

SEQ ID NO: 961274 - protein, 9 aa, Homo Sapiens
IIDDKGILW

SEQ ID NO: 961275 - protein, 9 aa, Homo Sapiens
FGSHSSSSE

SEQ ID NO: 961276 - protein, 9 aa, Homo Sapiens
ESRYSQNMP

SEQ ID NO: 961277 - protein, 9 aa, Homo Sapiens
LYCKEADNV

SEQ ID NO: 961278 - protein, 9 aa, Homo Sapiens
VEHILLEVL

SEQ ID NO: 961279 - protein, 9 aa, Homo Sapiens
GNAENQHVE

SEQ ID NO: 961280 - protein, 9 aa, Homo Sapiens
KRTPSSGPV

SEQ ID NO: 961281 - protein, 9 aa, Homo Sapiens
IENVKKQAF

SEQ ID NO: 961282 - protein, 9 aa, Homo Sapiens
IFTPVVFYT

SEQ ID NO: 961283 - protein, 9 aa, Homo Sapiens
TAANYSSSS

SEQ ID NO: 961284 - protein, 9 aa, Homo Sapiens
LRSATSQII

SEQ ID NO: 961285 - protein, 9 aa, Homo Sapiens
YLKEEEKKN

SEQ ID NO: 961286 - protein, 9 aa, Homo Sapiens
ASSLKIISA

SEQ ID NO: 961287 - protein, 9 aa, Homo Sapiens
QGCPAPWAS

SEQ ID NO: 961288 - protein, 9 aa, Homo Sapiens
QEGRSCNET

SEQ ID NO: 961289 - protein, 9 aa, Homo Sapiens
FYFQCVQRE

SEQ ID NO: 961290 - protein, 9 aa, Homo Sapiens
FSTEQAVVA

SEQ ID NO: 961291 - protein, 9 aa, Homo Sapiens
HHFPPSQLY

SEQ ID NO: 961292 - protein, 9 aa, Homo Sapiens
REKDCIGPK

SEQ ID NO: 961293 - protein, 9 aa, Homo Sapiens
ETSTPLIPS

SEQ ID NO: 961294 - protein, 9 aa, Homo Sapiens
SVLCDACAK

SEQ ID NO: 961295 - protein, 9 aa, Homo Sapiens
VVLNFFLAL

SEQ ID NO: 961296 - protein, 9 aa, Homo Sapiens
EVSEKVTVS

SEQ ID NO: 961297 - protein, 9 aa, Homo Sapiens
LVKKGEDIL

SEQ ID NO: 961298 - protein, 9 aa, Homo Sapiens
VIIVGGALV

SEQ ID NO: 961299 - protein, 9 aa, Homo Sapiens
IVGQLFGGQ

SEQ ID NO: 961300 - protein, 9 aa, Homo Sapiens
FFWMYLLAG

SEQ ID NO: 961301 - protein, 9 aa, Homo Sapiens
LFCFGESTT

SEQ ID NO: 961302 - protein, 9 aa, Homo Sapiens
LGSAAPPDK

SEQ ID NO: 961303 - protein, 9 aa, Homo Sapiens
YSSSSRTPQ

SEQ ID NO: 961304 - protein, 9 aa, Homo Sapiens
ILPWLNKTN

SEQ ID NO: 961305 - protein, 9 aa, Homo Sapiens
FIQEGSGKR

SEQ ID NO: 961306 - protein, 9 aa, Homo Sapiens
HEIKSPPSA

SEQ ID NO: 961307 - protein, 9 aa, Homo Sapiens
ALSESQRED

SEQ ID NO: 961308 - protein, 9 aa, Homo Sapiens
RTTVSWGEW

SEQ ID NO: 961309 - protein, 9 aa, Homo Sapiens
GPPPQRGNQ

SEQ ID NO: 961310 - protein, 9 aa, Homo Sapiens
HKVKNLHLP

SEQ ID NO: 961311 - protein, 9 aa, Homo Sapiens
SPSPADPSF

SEQ ID NO: 961312 - protein, 9 aa, Homo Sapiens
DGVGKSALT

SEQ ID NO: 961313 - protein, 9 aa, Homo Sapiens
HSSEILGTF

SEQ ID NO: 961314 - protein, 9 aa, Homo Sapiens
CTDCLDEDG

SEQ ID NO: 961315 - protein, 9 aa, Homo Sapiens
RVHGVHQGL

SEQ ID NO: 961316 - protein, 9 aa, Homo Sapiens
LSLENDNDD

SEQ ID NO: 961317 - protein, 9 aa, Homo Sapiens
LCNRTFKKT

SEQ ID NO: 961318 - protein, 9 aa, Homo Sapiens
VLYGQIGNK

SEQ ID NO: 961319 - protein, 9 aa, Homo Sapiens
KRQNVRTLV

SEQ ID NO: 961320 - protein, 9 aa, Homo Sapiens
SNALENNGV

SEQ ID NO: 961321 - protein, 9 aa, Homo Sapiens
VKTLEDNQV

SEQ ID NO: 961322 - protein, 9 aa, Homo Sapiens
AGLQYPVGR

SEQ ID NO: 961323 - protein, 9 aa, Homo Sapiens
SAKPSQPSH

SEQ ID NO: 961324 - protein, 9 aa, Homo Sapiens
FQKPKQLQQ

SEQ ID NO: 961325 - protein, 9 aa, Homo Sapiens
TTFSDMWSF

SEQ ID NO: 961326 - protein, 9 aa, Homo Sapiens
SANRLREEH

SEQ ID NO: 961327 - protein, 9 aa, Homo Sapiens
LELCSLKNH

SEQ ID NO: 961328 - protein, 9 aa, Homo Sapiens
LECATPLDK

SEQ ID NO: 961329 - protein, 9 aa, Homo Sapiens
ILAQIIGLR

SEQ ID NO: 961330 - protein, 9 aa, Homo Sapiens
MFPVLHFYV

SEQ ID NO: 961331 - protein, 9 aa, Homo Sapiens
YDCYLAICY

SEQ ID NO: 961332 - protein, 9 aa, Homo Sapiens
CVLMLLILF

SEQ ID NO: 961333 - protein, 9 aa, Homo Sapiens
FSPKPTVLA

SEQ ID NO: 961334 - protein, 9 aa, Homo Sapiens
EQGTGRKDD

SEQ ID NO: 961335 - protein, 9 aa, Homo Sapiens
DDEKEEQEV

SEQ ID NO: 961336 - protein, 9 aa, Homo Sapiens
SNMFIPGKE

SEQ ID NO: 961337 - protein, 9 aa, Homo Sapiens
VTEINVFFY

SEQ ID NO: 961338 - protein, 9 aa, Homo Sapiens
LGILLPSSI

SEQ ID NO: 961339 - protein, 9 aa, Homo Sapiens
VSSSPFLPS

SEQ ID NO: 961340 - protein, 9 aa, Homo Sapiens
APPQFVVWP

SEQ ID NO: 961341 - protein, 9 aa, Homo Sapiens
KRVKKLQMK

SEQ ID NO: 961342 - protein, 9 aa, Homo Sapiens
QPSFFKTAQ

SEQ ID NO: 961343 - protein, 9 aa, Homo Sapiens
RRKTDVPSG

SEQ ID NO: 961344 - protein, 9 aa, Homo Sapiens
CDACAKFLE

SEQ ID NO: 961345 - protein, 9 aa, Homo Sapiens
RYQKLGEED

SEQ ID NO: 961346 - protein, 9 aa, Homo Sapiens
TKDADPYVQ

SEQ ID NO: 961347 - protein, 9 aa, Homo Sapiens
AKPLHPARP

SEQ ID NO: 961348 - protein, 9 aa, Homo Sapiens
RKLLKCRMA

SEQ ID NO: 961349 - protein, 9 aa, Homo Sapiens
RYVLSEKSQ

SEQ ID NO: 961350 - protein, 9 aa, Homo Sapiens
GKLQTQSLG

SEQ ID NO: 961351 - protein, 9 aa, Homo Sapiens
AEKRKKSDK

SEQ ID NO: 961352 - protein, 9 aa, Homo Sapiens
GKQDFRLSS

SEQ ID NO: 961353 - protein, 9 aa, Homo Sapiens
SFSQKQNPI

SEQ ID NO: 961354 - protein, 9 aa, Homo Sapiens
DLEKSTLQH

SEQ ID NO: 961355 - protein, 9 aa, Homo Sapiens
CASVNDGRW

SEQ ID NO: 961356 - protein, 9 aa, Homo Sapiens
RARGPFAST

SEQ ID NO: 961357 - protein, 9 aa, Homo Sapiens
YVMEGSLSV

SEQ ID NO: 961358 - protein, 9 aa, Homo Sapiens
WKEPCQIEL

SEQ ID NO: 961359 - protein, 9 aa, Homo Sapiens
QLSRHQLMP

SEQ ID NO: 961360 - protein, 9 aa, Homo Sapiens
KTNGQLEDC

SEQ ID NO: 961361 - protein, 9 aa, Homo Sapiens
PGTFHTEGR

SEQ ID NO: 961362 - protein, 9 aa, Homo Sapiens
VKKSDAGRY

SEQ ID NO: 961363 - protein, 9 aa, Homo Sapiens
GFEVVENNF

SEQ ID NO: 961364 - protein, 9 aa, Homo Sapiens
RTFWTCPPC

SEQ ID NO: 961365 - protein, 9 aa, Homo Sapiens
SFSEVEEVD

SEQ ID NO: 961366 - protein, 9 aa, Homo Sapiens
PKPQLHAAA

SEQ ID NO: 961367 - protein, 9 aa, Homo Sapiens
NALENNGVA

SEQ ID NO: 961368 - protein, 9 aa, Homo Sapiens
AISPIHFYS

SEQ ID NO: 961369 - protein, 9 aa, Homo Sapiens
FSIPLDESS

SEQ ID NO: 961370 - protein, 9 aa, Homo Sapiens
DECETQGLP

SEQ ID NO: 961371 - protein, 9 aa, Homo Sapiens
WNFEKFLVE

SEQ ID NO: 961372 - protein, 9 aa, Homo Sapiens
SAMDWPQTF

SEQ ID NO: 961373 - protein, 9 aa, Homo Sapiens
EKHGKVGRM

SEQ ID NO: 961374 - protein, 9 aa, Homo Sapiens
QLEFRIVEQ

SEQ ID NO: 961375 - protein, 9 aa, Homo Sapiens
NCGYYLTQH

SEQ ID NO: 961376 - protein, 9 aa, Homo Sapiens
QKENPAYPA

SEQ ID NO: 961377 - protein, 9 aa, Homo Sapiens
ALCCPSDIN

SEQ ID NO: 961378 - protein, 9 aa, Homo Sapiens
VYKIYIFSF

SEQ ID NO: 961379 - protein, 9 aa, Homo Sapiens
AFPSQSSLP

SEQ ID NO: 961380 - protein, 9 aa, Homo Sapiens
EKCTWASEK

SEQ ID NO: 961381 - protein, 9 aa, Homo Sapiens
VIFHMAVSG

SEQ ID NO: 961382 - protein, 9 aa, Homo Sapiens
SGKRTSDKV

SEQ ID NO: 961383 - protein, 9 aa, Homo Sapiens
LHLPWILSE

SEQ ID NO: 961384 - protein, 9 aa, Homo Sapiens
SKGGGAGHT

SEQ ID NO: 961385 - protein, 9 aa, Homo Sapiens
MISQTVAMP

SEQ ID NO: 961386 - protein, 9 aa, Homo Sapiens
MASRPRVRA

SEQ ID NO: 961387 - protein, 9 aa, Homo Sapiens
MFQPFFEMI

SEQ ID NO: 961388 - protein, 9 aa, Homo Sapiens
SLSEDAEEE

SEQ ID NO: 961389 - protein, 9 aa, Homo Sapiens
FKHKRCIPA

SEQ ID NO: 961390 - protein, 9 aa, Homo Sapiens
PRGVQKNKP

SEQ ID NO: 961391 - protein, 9 aa, Homo Sapiens
SKWWYNKGE

SEQ ID NO: 961392 - protein, 9 aa, Homo Sapiens
HFERHRRIH

SEQ ID NO: 961393 - protein, 9 aa, Homo Sapiens
NSEGGEKEG

SEQ ID NO: 961394 - protein, 9 aa, Homo Sapiens
PPGSEGLAL

SEQ ID NO: 961395 - protein, 9 aa, Homo Sapiens
QMSFQQVKQ

SEQ ID NO: 961396 - protein, 9 aa, Homo Sapiens
VQSKKKEAT

SEQ ID NO: 961397 - protein, 9 aa, Homo Sapiens
PESVEQLEF

SEQ ID NO: 961398 - protein, 9 aa, Homo Sapiens
VALLLWPLS

SEQ ID NO: 961399 - protein, 9 aa, Homo Sapiens
NYISRFWTF

SEQ ID NO: 961400 - protein, 9 aa, Homo Sapiens
GRTFGYFLK

SEQ ID NO: 961401 - protein, 9 aa, Homo Sapiens
KKSDAGRYY

SEQ ID NO: 961402 - protein, 9 aa, Homo Sapiens
EKARPPEPL

SEQ ID NO: 961403 - protein, 9 aa, Homo Sapiens
KKSLRNKEA

SEQ ID NO: 961404 - protein, 9 aa, Homo Sapiens
PEWALPLFF

SEQ ID NO: 961405 - protein, 9 aa, Homo Sapiens
SLHMGLEGL

SEQ ID NO: 961406 - protein, 9 aa, Homo Sapiens
PQMLWELWD

SEQ ID NO: 961407 - protein, 9 aa, Homo Sapiens
KIISAVIES

SEQ ID NO: 961408 - protein, 9 aa, Homo Sapiens
CRHVSSQAV

SEQ ID NO: 961409 - protein, 9 aa, Homo Sapiens
LKKKKKRKK

SEQ ID NO: 961410 - protein, 9 aa, Homo Sapiens
AIQPDNIVF

SEQ ID NO: 961411 - protein, 9 aa, Homo Sapiens
EIEPENIRE

SEQ ID NO: 961412 - protein, 9 aa, Homo Sapiens
KGVDGGLFS

SEQ ID NO: 961413 - protein, 9 aa, Homo Sapiens
QRAIVAVTG

SEQ ID NO: 961414 - protein, 9 aa, Homo Sapiens
PPACLSPAL

SEQ ID NO: 961415 - protein, 9 aa, Homo Sapiens
QSSEKQINV

SEQ ID NO: 961416 - protein, 9 aa, Homo Sapiens
RTPSSGPVE

SEQ ID NO: 961417 - protein, 9 aa, Homo Sapiens
DAAPGQPGA

SEQ ID NO: 961418 - protein, 9 aa, Homo Sapiens
DEQVEDEVL

SEQ ID NO: 961419 - protein, 9 aa, Homo Sapiens
RQNVRTLVL

SEQ ID NO: 961420 - protein, 9 aa, Homo Sapiens
NSTFFSRTS

SEQ ID NO: 961421 - protein, 9 aa, Homo Sapiens
VCDIGYGEA

SEQ ID NO: 961422 - protein, 9 aa, Homo Sapiens
AFMLFCMSV

SEQ ID NO: 961423 - protein, 9 aa, Homo Sapiens
MGLELQETS

SEQ ID NO: 961424 - protein, 9 aa, Homo Sapiens
ELQETSEGV

SEQ ID NO: 961425 - protein, 9 aa, Homo Sapiens
DFVRRMVNL

SEQ ID NO: 961426 - protein, 9 aa, Homo Sapiens
DNIVFVMDA

SEQ ID NO: 961427 - protein, 9 aa, Homo Sapiens
SRTNRDDYV

SEQ ID NO: 961428 - protein, 9 aa, Homo Sapiens
QNYDNKQVC

SEQ ID NO: 961429 - protein, 9 aa, Homo Sapiens
QPAVSKSYD

SEQ ID NO: 961430 - protein, 9 aa, Homo Sapiens
PLNLTLRAG

SEQ ID NO: 961431 - protein, 9 aa, Homo Sapiens
GLQYPVGRI

SEQ ID NO: 961432 - protein, 9 aa, Homo Sapiens
HQEEGMVIF

SEQ ID NO: 961433 - protein, 9 aa, Homo Sapiens
EEKKNEKRQ

SEQ ID NO: 961434 - protein, 9 aa, Homo Sapiens
GKEKARPPE

SEQ ID NO: 961435 - protein, 9 aa, Homo Sapiens
VYVAAVQEF

SEQ ID NO: 961436 - protein, 9 aa, Homo Sapiens
DDPTFSFET

SEQ ID NO: 961437 - protein, 9 aa, Homo Sapiens
RSRARCMLA

SEQ ID NO: 961438 - protein, 9 aa, Homo Sapiens
KKWRIQREE

SEQ ID NO: 961439 - protein, 9 aa, Homo Sapiens
PPGSNGRWT

SEQ ID NO: 961440 - protein, 9 aa, Homo Sapiens
FSLAFREHK

SEQ ID NO: 961441 - protein, 9 aa, Homo Sapiens
SNKISKRIE

SEQ ID NO: 961442 - protein, 9 aa, Homo Sapiens
VFRLRDRDD

SEQ ID NO: 961443 - protein, 9 aa, Homo Sapiens
CFVSPVAKT

SEQ ID NO: 961444 - protein, 9 aa, Homo Sapiens
RMTTVFPGS

SEQ ID NO: 961445 - protein, 9 aa, Homo Sapiens
PIHFYSGTG

SEQ ID NO: 961446 - protein, 9 aa, Homo Sapiens
GPYEEIISE

SEQ ID NO: 961447 - protein, 9 aa, Homo Sapiens
GLPVASEEK

SEQ ID NO: 961448 - protein, 9 aa, Homo Sapiens
TKILKQSDQ

SEQ ID NO: 961449 - protein, 9 aa, Homo Sapiens
QYFQQGLHW

SEQ ID NO: 961450 - protein, 9 aa, Homo Sapiens
KLKGPLAKR

SEQ ID NO: 961451 - protein, 9 aa, Homo Sapiens
TNVCSVYSL

SEQ ID NO: 961452 - protein, 9 aa, Homo Sapiens
ASHCEHAFC

SEQ ID NO: 961453 - protein, 9 aa, Homo Sapiens
AHHFPPSQL

SEQ ID NO: 961454 - protein, 9 aa, Homo Sapiens
FSKGDIWWN

SEQ ID NO: 961455 - protein, 9 aa, Homo Sapiens
FFNFCSRRF

SEQ ID NO: 961456 - protein, 9 aa, Homo Sapiens
LVEILNEEK

SEQ ID NO: 961457 - protein, 9 aa, Homo Sapiens
YNIRPDGSG

SEQ ID NO: 961458 - protein, 9 aa, Homo Sapiens
KKIQYLTCG

SEQ ID NO: 961459 - protein, 9 aa, Homo Sapiens
PFYSSEVFP

SEQ ID NO: 961460 - protein, 9 aa, Homo Sapiens
PQLMPVREP

SEQ ID NO: 961461 - protein, 9 aa, Homo Sapiens
IVRNLLSHP

SEQ ID NO: 961462 - protein, 9 aa, Homo Sapiens
LLYKHLITH

SEQ ID NO: 961463 - protein, 9 aa, Homo Sapiens
LIEKAVIFP

SEQ ID NO: 961464 - protein, 9 aa, Homo Sapiens
ERFNMGEIE

SEQ ID NO: 961465 - protein, 9 aa, Homo Sapiens
SQVRRADTS

SEQ ID NO: 961466 - protein, 9 aa, Homo Sapiens
LIRAREKDC

SEQ ID NO: 961467 - protein, 9 aa, Homo Sapiens
IIVGGALVL

SEQ ID NO: 961468 - protein, 9 aa, Homo Sapiens
EIKSPPSAR

SEQ ID NO: 961469 - protein, 9 aa, Homo Sapiens
NRKPLMPSP

SEQ ID NO: 961470 - protein, 9 aa, Homo Sapiens
VSLYQGFLI

SEQ ID NO: 961471 - protein, 9 aa, Homo Sapiens
GKRVPLNYA

SEQ ID NO: 961472 - protein, 9 aa, Homo Sapiens
NSAGGRRSL

SEQ ID NO: 961473 - protein, 9 aa, Homo Sapiens
YDNKGADAT

SEQ ID NO: 961474 - protein, 9 aa, Homo Sapiens
QDGRADGFI

SEQ ID NO: 961475 - protein, 9 aa, Homo Sapiens
ENPAYPAIL

SEQ ID NO: 961476 - protein, 9 aa, Homo Sapiens
VSSFSEVEE

SEQ ID NO: 961477 - protein, 9 aa, Homo Sapiens
AYDCYLAIC

SEQ ID NO: 961478 - protein, 9 aa, Homo Sapiens
SRPLRVLFF

SEQ ID NO: 961479 - protein, 9 aa, Homo Sapiens
KVNLVGSSS

SEQ ID NO: 961480 - protein, 9 aa, Homo Sapiens
HSRVALACP

SEQ ID NO: 961481 - protein, 9 aa, Homo Sapiens
PVQFSYVTP

SEQ ID NO: 961482 - protein, 9 aa, Homo Sapiens
NYKAKMPSY

SEQ ID NO: 961483 - protein, 9 aa, Homo Sapiens
FKTDSFFSF

SEQ ID NO: 961484 - protein, 9 aa, Homo Sapiens
SFIRLTPTQ

SEQ ID NO: 961485 - protein, 9 aa, Homo Sapiens
KHQKIYSGE

SEQ ID NO: 961486 - protein, 9 aa, Homo Sapiens
KELDCLKDE

SEQ ID NO: 961487 - protein, 9 aa, Homo Sapiens
SALLPFGPF

SEQ ID NO: 961488 - protein, 9 aa, Homo Sapiens
ESLIKRLEE

SEQ ID NO: 961489 - protein, 9 aa, Homo Sapiens
KDGVFTTFS

SEQ ID NO: 961490 - protein, 9 aa, Homo Sapiens
ITTFSKEKT

SEQ ID NO: 961491 - protein, 9 aa, Homo Sapiens
GGMDESTIT

SEQ ID NO: 961492 - protein, 9 aa, Homo Sapiens
RNTLFNFSN

SEQ ID NO: 961493 - protein, 9 aa, Homo Sapiens
DNSRVVLLD

SEQ ID NO: 961494 - protein, 9 aa, Homo Sapiens
YDPVIFKLA

SEQ ID NO: 961495 - protein, 9 aa, Homo Sapiens
SYRKRRVLL

SEQ ID NO: 961496 - protein, 9 aa, Homo Sapiens
LSSGYSSQS

SEQ ID NO: 961497 - protein, 9 aa, Homo Sapiens
KRYTDPSLL

SEQ ID NO: 961498 - protein, 9 aa, Homo Sapiens
SLPLQTTSV

SEQ ID NO: 961499 - protein, 9 aa, Homo Sapiens
HLLVGLFHE

SEQ ID NO: 961500 - protein, 9 aa, Homo Sapiens
LQHERPQPT

SEQ ID NO: 961501 - protein, 9 aa, Homo Sapiens
LVQTERQER

SEQ ID NO: 961502 - protein, 9 aa, Homo Sapiens
LFRQHVLED

SEQ ID NO: 961503 - protein, 9 aa, Homo Sapiens
KQKTKTIKR

SEQ ID NO: 961504 - protein, 9 aa, Homo Sapiens
NIFFKAFSY

SEQ ID NO: 961505 - protein, 9 aa, Homo Sapiens
EKMPESINF

SEQ ID NO: 961506 - protein, 9 aa, Homo Sapiens
LLMLGVYTI

SEQ ID NO: 961507 - protein, 9 aa, Homo Sapiens
ELHVLTVKK

SEQ ID NO: 961508 - protein, 9 aa, Homo Sapiens
QASHCEHAF

SEQ ID NO: 961509 - protein, 9 aa, Homo Sapiens
KAVKEEGNQ

SEQ ID NO: 961510 - protein, 9 aa, Homo Sapiens
EPQSVLILQ

SEQ ID NO: 961511 - protein, 9 aa, Homo Sapiens
QNPSLGSCS

SEQ ID NO: 961512 - protein, 9 aa, Homo Sapiens
LSNGNKTLT

SEQ ID NO: 961513 - protein, 9 aa, Homo Sapiens
INFEFVKVS

SEQ ID NO: 961514 - protein, 9 aa, Homo Sapiens
ELEYSLKKI

SEQ ID NO: 961515 - protein, 9 aa, Homo Sapiens
VKRPIGNRI

SEQ ID NO: 961516 - protein, 9 aa, Homo Sapiens
SSVPQIAKA

SEQ ID NO: 961517 - protein, 9 aa, Homo Sapiens
KQTYLNQTR

SEQ ID NO: 961518 - protein, 9 aa, Homo Sapiens
FSYVTPAPH

SEQ ID NO: 961519 - protein, 9 aa, Homo Sapiens
FFSRIECES

SEQ ID NO: 961520 - protein, 9 aa, Homo Sapiens
FLEMDLKPD

SEQ ID NO: 961521 - protein, 9 aa, Homo Sapiens
TEEKKEIKK

SEQ ID NO: 961522 - protein, 9 aa, Homo Sapiens
NPERTNPVT

SEQ ID NO: 961523 - protein, 9 aa, Homo Sapiens
VELVRYLVD

SEQ ID NO: 961524 - protein, 9 aa, Homo Sapiens
PILPLGVSY

SEQ ID NO: 961525 - protein, 9 aa, Homo Sapiens
GQVKRQIYV

SEQ ID NO: 961526 - protein, 9 aa, Homo Sapiens
EEKSLSPEA

SEQ ID NO: 961527 - protein, 9 aa, Homo Sapiens
PLYWPYKQQ

SEQ ID NO: 961528 - protein, 9 aa, Homo Sapiens
SGCLKLPSK

SEQ ID NO: 961529 - protein, 9 aa, Homo Sapiens
LFNHVKTGI

SEQ ID NO: 961530 - protein, 9 aa, Homo Sapiens
ENSGMNLIQ

SEQ ID NO: 961531 - protein, 9 aa, Homo Sapiens
GACLAEGPE

SEQ ID NO: 961532 - protein, 9 aa, Homo Sapiens
LIRDEKKDP

SEQ ID NO: 961533 - protein, 9 aa, Homo Sapiens
EASLGPPGP

SEQ ID NO: 961534 - protein, 9 aa, Homo Sapiens
RILHSHGSS

SEQ ID NO: 961535 - protein, 9 aa, Homo Sapiens
TGLKANVEF

SEQ ID NO: 961536 - protein, 9 aa, Homo Sapiens
DALQTVIIV

SEQ ID NO: 961537 - protein, 9 aa, Homo Sapiens
LALSPKEST

SEQ ID NO: 961538 - protein, 9 aa, Homo Sapiens
ETPLQPFYS

SEQ ID NO: 961539 - protein, 9 aa, Homo Sapiens
QTGGCRSEP

SEQ ID NO: 961540 - protein, 9 aa, Homo Sapiens
SGISSRSSP

SEQ ID NO: 961541 - protein, 9 aa, Homo Sapiens
FKVRSLKMD

SEQ ID NO: 961542 - protein, 9 aa, Homo Sapiens
ARKLLLAFQ

SEQ ID NO: 961543 - protein, 9 aa, Homo Sapiens
SGAPRGRRF

SEQ ID NO: 961544 - protein, 9 aa, Homo Sapiens
RPVQFSYVT

SEQ ID NO: 961545 - protein, 9 aa, Homo Sapiens
KHSCPHSSE

SEQ ID NO: 961546 - protein, 9 aa, Homo Sapiens
PGVFVSLVN

SEQ ID NO: 961547 - protein, 9 aa, Homo Sapiens
PIYISRIIS

SEQ ID NO: 961548 - protein, 9 aa, Homo Sapiens
DFIDNLISN

SEQ ID NO: 961549 - protein, 9 aa, Homo Sapiens
FLSDLLTAL

SEQ ID NO: 961550 - protein, 9 aa, Homo Sapiens
LGLLAPLRK

SEQ ID NO: 961551 - protein, 9 aa, Homo Sapiens
SNKSGTVFY

SEQ ID NO: 961552 - protein, 9 aa, Homo Sapiens
NLHLPWILS

SEQ ID NO: 961553 - protein, 9 aa, Homo Sapiens
SSSGSRTAG

SEQ ID NO: 961554 - protein, 9 aa, Homo Sapiens
LWHLDSDVE

SEQ ID NO: 961555 - protein, 9 aa, Homo Sapiens
YTGVNDDRL

SEQ ID NO: 961556 - protein, 9 aa, Homo Sapiens
IISEYGRTI

SEQ ID NO: 961557 - protein, 9 aa, Homo Sapiens
EEGARYGLS

SEQ ID NO: 961558 - protein, 9 aa, Homo Sapiens
SQAEKPKPT

SEQ ID NO: 961559 - protein, 9 aa, Homo Sapiens
NVPCRALKR

SEQ ID NO: 961560 - protein, 9 aa, Homo Sapiens
VWPPFTYAS

SEQ ID NO: 961561 - protein, 9 aa, Homo Sapiens
LMEHKRTHT

SEQ ID NO: 961562 - protein, 9 aa, Homo Sapiens
YLKELTKNL

SEQ ID NO: 961563 - protein, 9 aa, Homo Sapiens
WIPTKFFEN

SEQ ID NO: 961564 - protein, 9 aa, Homo Sapiens
GELQVLRDF

SEQ ID NO: 961565 - protein, 9 aa, Homo Sapiens
DPEAEPSID

SEQ ID NO: 961566 - protein, 9 aa, Homo Sapiens
ISPEPLNQV

SEQ ID NO: 961567 - protein, 9 aa, Homo Sapiens
LQDVYLSNF

SEQ ID NO: 961568 - protein, 9 aa, Homo Sapiens
EKRVKKLQM

SEQ ID NO: 961569 - protein, 9 aa, Homo Sapiens
LERKASIQD

SEQ ID NO: 961570 - protein, 9 aa, Homo Sapiens
GPKDFKVRS

SEQ ID NO: 961571 - protein, 9 aa, Homo Sapiens
EFPGPPGLP

SEQ ID NO: 961572 - protein, 9 aa, Homo Sapiens
GSFPESLRH

SEQ ID NO: 961573 - protein, 9 aa, Homo Sapiens
TYVSSFKDV

SEQ ID NO: 961574 - protein, 9 aa, Homo Sapiens
QPDNKKLPE

SEQ ID NO: 961575 - protein, 9 aa, Homo Sapiens
LASNSTFFS

SEQ ID NO: 961576 - protein, 9 aa, Homo Sapiens
SDSSLLTPH

SEQ ID NO: 961577 - protein, 9 aa, Homo Sapiens
TSLKGFMRE

SEQ ID NO: 961578 - protein, 9 aa, Homo Sapiens
KNAAGSAHR

SEQ ID NO: 961579 - protein, 9 aa, Homo Sapiens
KAHWSTLRH

SEQ ID NO: 961580 - protein, 9 aa, Homo Sapiens
SLGAHVGGI

SEQ ID NO: 961581 - protein, 9 aa, Homo Sapiens
WDAFFQPVP

SEQ ID NO: 961582 - protein, 9 aa, Homo Sapiens
LAPIGIRVL

SEQ ID NO: 961583 - protein, 9 aa, Homo Sapiens
CFVEEWSPW

SEQ ID NO: 961584 - protein, 9 aa, Homo Sapiens
PAVSKSYDL

SEQ ID NO: 961585 - protein, 9 aa, Homo Sapiens
RSLNPEWNE

SEQ ID NO: 961586 - protein, 9 aa, Homo Sapiens
LLHMKPPSD

SEQ ID NO: 961587 - protein, 9 aa, Homo Sapiens
MPVGLVLQP

SEQ ID NO: 961588 - protein, 9 aa, Homo Sapiens
FSRSDHLTI

SEQ ID NO: 961589 - protein, 9 aa, Homo Sapiens
KRLLGWEWE

SEQ ID NO: 961590 - protein, 9 aa, Homo Sapiens
LSIPLHILD

SEQ ID NO: 961591 - protein, 9 aa, Homo Sapiens
TVTSEQINP

SEQ ID NO: 961592 - protein, 9 aa, Homo Sapiens
RLYCKEADN

SEQ ID NO: 961593 - protein, 9 aa, Homo Sapiens
MKLSMFDVS

SEQ ID NO: 961594 - protein, 9 aa, Homo Sapiens
HYYQQPPGL

SEQ ID NO: 961595 - protein, 9 aa, Homo Sapiens
VFVLHTFLL

SEQ ID NO: 961596 - protein, 9 aa, Homo Sapiens
LIYRGASAA

SEQ ID NO: 961597 - protein, 9 aa, Homo Sapiens
LDNSACPQP

SEQ ID NO: 961598 - protein, 9 aa, Homo Sapiens
KSKMTSNKI

SEQ ID NO: 961599 - protein, 9 aa, Homo Sapiens
EANQMLGNL

SEQ ID NO: 961600 - protein, 9 aa, Homo Sapiens
SQDLFSYCS

SEQ ID NO: 961601 - protein, 9 aa, Homo Sapiens
ASTPSPSEV

SEQ ID NO: 961602 - protein, 9 aa, Homo Sapiens
SPVYESWFK

SEQ ID NO: 961603 - protein, 9 aa, Homo Sapiens
HLCFYFFFL

SEQ ID NO: 961604 - protein, 9 aa, Homo Sapiens
FPADEAFIQ

SEQ ID NO: 961605 - protein, 9 aa, Homo Sapiens
SSVSSFTKI

SEQ ID NO: 961606 - protein, 9 aa, Homo Sapiens
VVLLDEIKE

SEQ ID NO: 961607 - protein, 9 aa, Homo Sapiens
WGPPRGFCP

SEQ ID NO: 961608 - protein, 9 aa, Homo Sapiens
GVPGTFANC

SEQ ID NO: 961609 - protein, 9 aa, Homo Sapiens
LEKELSGKQ

SEQ ID NO: 961610 - protein, 9 aa, Homo Sapiens
FYKNADVWP

SEQ ID NO: 961611 - protein, 9 aa, Homo Sapiens
DEEGSDPSL

SEQ ID NO: 961612 - protein, 9 aa, Homo Sapiens
GSAAPPDKA

SEQ ID NO: 961613 - protein, 9 aa, Homo Sapiens
SSSSATLPR

SEQ ID NO: 961614 - protein, 9 aa, Homo Sapiens
GQTAPETRN

SEQ ID NO: 961615 - protein, 9 aa, Homo Sapiens
LVLDKALDQ

SEQ ID NO: 961616 - protein, 9 aa, Homo Sapiens
LVAGRMVNM

SEQ ID NO: 961617 - protein, 9 aa, Homo Sapiens
MNSVFNEHS

SEQ ID NO: 961618 - protein, 9 aa, Homo Sapiens
GCQAGLDFF

SEQ ID NO: 961619 - protein, 9 aa, Homo Sapiens
HHKECVAAT

SEQ ID NO: 961620 - protein, 9 aa, Homo Sapiens
NGRWTWTSP

SEQ ID NO: 961621 - protein, 9 aa, Homo Sapiens
NSFLEVSAP

SEQ ID NO: 961622 - protein, 9 aa, Homo Sapiens
YPAILGKMA

SEQ ID NO: 961623 - protein, 9 aa, Homo Sapiens
PTGIEEFPG

SEQ ID NO: 961624 - protein, 9 aa, Homo Sapiens
ASVSLYQGF

SEQ ID NO: 961625 - protein, 9 aa, Homo Sapiens
TLVTLQSQR

SEQ ID NO: 961626 - protein, 9 aa, Homo Sapiens
KEVFIFLQL

SEQ ID NO: 961627 - protein, 9 aa, Homo Sapiens
IFQFIFLPY

SEQ ID NO: 961628 - protein, 9 aa, Homo Sapiens
YQQPPGLVP

SEQ ID NO: 961629 - protein, 9 aa, Homo Sapiens
YCRLFNHVK

SEQ ID NO: 961630 - protein, 9 aa, Homo Sapiens
TLEILDCRN

SEQ ID NO: 961631 - protein, 9 aa, Homo Sapiens
WNTHVRKLT

SEQ ID NO: 961632 - protein, 9 aa, Homo Sapiens
CFHSPLLPY

SEQ ID NO: 961633 - protein, 9 aa, Homo Sapiens
MTGYLPLEF

SEQ ID NO: 961634 - protein, 9 aa, Homo Sapiens
CLVKWLEVC

SEQ ID NO: 961635 - protein, 9 aa, Homo Sapiens
IERRRRFSI

SEQ ID NO: 961636 - protein, 9 aa, Homo Sapiens
AATALWNPV

SEQ ID NO: 961637 - protein, 9 aa, Homo Sapiens
PGGHQFLQS

SEQ ID NO: 961638 - protein, 9 aa, Homo Sapiens
HVGPSHQAK

SEQ ID NO: 961639 - protein, 9 aa, Homo Sapiens
TQGLPHCRN

SEQ ID NO: 961640 - protein, 9 aa, Homo Sapiens
CEILKMFFS

SEQ ID NO: 961641 - protein, 9 aa, Homo Sapiens
PLPPLPGLG

SEQ ID NO: 961642 - protein, 9 aa, Homo Sapiens
LGRPTSPLH

SEQ ID NO: 961643 - protein, 9 aa, Homo Sapiens
LGMLHSNCP

SEQ ID NO: 961644 - protein, 9 aa, Homo Sapiens
HVFFRSVIE

SEQ ID NO: 961645 - protein, 9 aa, Homo Sapiens
SGLASGLTE

SEQ ID NO: 961646 - protein, 9 aa, Homo Sapiens
RISPEPLNQ

SEQ ID NO: 961647 - protein, 9 aa, Homo Sapiens
KLALKYYPD

SEQ ID NO: 961648 - protein, 9 aa, Homo Sapiens
SVLHLSEAP

SEQ ID NO: 961649 - protein, 9 aa, Homo Sapiens
AGLKFINLF

SEQ ID NO: 961650 - protein, 9 aa, Homo Sapiens
LNFIRSRPP

SEQ ID NO: 961651 - protein, 9 aa, Homo Sapiens
SCDVSSSPF

SEQ ID NO: 961652 - protein, 9 aa, Homo Sapiens
FPRGVQKNK

SEQ ID NO: 961653 - protein, 9 aa, Homo Sapiens
SVLILQHLL

SEQ ID NO: 961654 - protein, 9 aa, Homo Sapiens
IDPNNRRYE

SEQ ID NO: 961655 - protein, 9 aa, Homo Sapiens
ILASVVVRR

SEQ ID NO: 961656 - protein, 9 aa, Homo Sapiens
IDIAPMDIR

SEQ ID NO: 961657 - protein, 9 aa, Homo Sapiens
TNIRNQEEL

SEQ ID NO: 961658 - protein, 9 aa, Homo Sapiens
LPGLEGPKG

SEQ ID NO: 961659 - protein, 9 aa, Homo Sapiens
FLENHDQMS

SEQ ID NO: 961660 - protein, 9 aa, Homo Sapiens
RLEESFKQY

SEQ ID NO: 961661 - protein, 9 aa, Homo Sapiens
RNCHLNKNI

SEQ ID NO: 961662 - protein, 9 aa, Homo Sapiens
ARPGGTPEA

SEQ ID NO: 961663 - protein, 9 aa, Homo Sapiens
CLSLTVGAQ

SEQ ID NO: 961664 - protein, 9 aa, Homo Sapiens
ASKRRSSLS

SEQ ID NO: 961665 - protein, 9 aa, Homo Sapiens
YELGIMVSK

SEQ ID NO: 961666 - protein, 9 aa, Homo Sapiens
YEVPKEFNF

SEQ ID NO: 961667 - protein, 9 aa, Homo Sapiens
NIPVIPETK

SEQ ID NO: 961668 - protein, 9 aa, Homo Sapiens
LDGSERLGK

SEQ ID NO: 961669 - protein, 9 aa, Homo Sapiens
NPRENTWQP

SEQ ID NO: 961670 - protein, 9 aa, Homo Sapiens
LGVPPKRAK

SEQ ID NO: 961671 - protein, 9 aa, Homo Sapiens
KFFLYAHRV

SEQ ID NO: 961672 - protein, 9 aa, Homo Sapiens
PYYNPELLC

SEQ ID NO: 961673 - protein, 9 aa, Homo Sapiens
RGQKRSQAS

SEQ ID NO: 961674 - protein, 9 aa, Homo Sapiens
SSKSMCFLS

SEQ ID NO: 961675 - protein, 9 aa, Homo Sapiens
PSFFKTAQD

SEQ ID NO: 961676 - protein, 9 aa, Homo Sapiens
PPKLKRAKE

SEQ ID NO: 961677 - protein, 9 aa, Homo Sapiens
VFIKIAFDK

SEQ ID NO: 961678 - protein, 9 aa, Homo Sapiens
ASESAESDP

SEQ ID NO: 961679 - protein, 9 aa, Homo Sapiens
HSLLTAFLP

SEQ ID NO: 961680 - protein, 9 aa, Homo Sapiens
RFNMGEIET

SEQ ID NO: 961681 - protein, 9 aa, Homo Sapiens
EEFPLPQKF

SEQ ID NO: 961682 - protein, 9 aa, Homo Sapiens
LVQYFQQGL

SEQ ID NO: 961683 - protein, 9 aa, Homo Sapiens
LLWGHSRVA

SEQ ID NO: 961684 - protein, 9 aa, Homo Sapiens
CYLLRLNAI

SEQ ID NO: 961685 - protein, 9 aa, Homo Sapiens
VNIPLDPLS

SEQ ID NO: 961686 - protein, 9 aa, Homo Sapiens
ILAPLQPPP

SEQ ID NO: 961687 - protein, 9 aa, Homo Sapiens
TKVENNTIH

SEQ ID NO: 961688 - protein, 9 aa, Homo Sapiens
SPLTKTEQL

SEQ ID NO: 961689 - protein, 9 aa, Homo Sapiens
INVLVKSKA

SEQ ID NO: 961690 - protein, 9 aa, Homo Sapiens
YLEPRCLRM

SEQ ID NO: 961691 - protein, 9 aa, Homo Sapiens
HRSLGPKDF

SEQ ID NO: 961692 - protein, 9 aa, Homo Sapiens
KLSLENDND

SEQ ID NO: 961693 - protein, 9 aa, Homo Sapiens
LAVRFSGFA

SEQ ID NO: 961694 - protein, 9 aa, Homo Sapiens
FGCKFFLYA

SEQ ID NO: 961695 - protein, 9 aa, Homo Sapiens
AEEKALDNS

SEQ ID NO: 961696 - protein, 9 aa, Homo Sapiens
TQSCDSKST

SEQ ID NO: 961697 - protein, 9 aa, Homo Sapiens
ITDCFSAMD

SEQ ID NO: 961698 - protein, 9 aa, Homo Sapiens
RLQEEADAA

SEQ ID NO: 961699 - protein, 9 aa, Homo Sapiens
SQAESSERT

SEQ ID NO: 961700 - protein, 9 aa, Homo Sapiens
ALQVCLAHP

SEQ ID NO: 961701 - protein, 9 aa, Homo Sapiens
FAKNLLDQT

SEQ ID NO: 961702 - protein, 9 aa, Homo Sapiens
TEPRGKWQE

SEQ ID NO: 961703 - protein, 9 aa, Homo Sapiens
RTNERLKVV

SEQ ID NO: 961704 - protein, 9 aa, Homo Sapiens
SGSPRLGPQ

SEQ ID NO: 961705 - protein, 9 aa, Homo Sapiens
ETKEDVISD

SEQ ID NO: 961706 - protein, 9 aa, Homo Sapiens
SPSLPRSPV

SEQ ID NO: 961707 - protein, 9 aa, Homo Sapiens
PATGVWESH

SEQ ID NO: 961708 - protein, 9 aa, Homo Sapiens
WFLNIQANN

SEQ ID NO: 961709 - protein, 9 aa, Homo Sapiens
KLNYETSHY

SEQ ID NO: 961710 - protein, 9 aa, Homo Sapiens
QTVIIVGGA

SEQ ID NO: 961711 - protein, 9 aa, Homo Sapiens
LYGQMIIYA

SEQ ID NO: 961712 - protein, 9 aa, Homo Sapiens
FTGRRMNFK

SEQ ID NO: 961713 - protein, 9 aa, Homo Sapiens
ETMALPIKS

SEQ ID NO: 961714 - protein, 9 aa, Homo Sapiens
KNAVFKLKN

SEQ ID NO: 961715 - protein, 9 aa, Homo Sapiens
TSDLYADDP

SEQ ID NO: 961716 - protein, 9 aa, Homo Sapiens
RKPLMPSPQ

SEQ ID NO: 961717 - protein, 9 aa, Homo Sapiens
LLEVLDLQH

SEQ ID NO: 961718 - protein, 9 aa, Homo Sapiens
PQILGFGMC

SEQ ID NO: 961719 - protein, 9 aa, Homo Sapiens
LGPKSFVLI

SEQ ID NO: 961720 - protein, 9 aa, Homo Sapiens
LPHPAKPLH

SEQ ID NO: 961721 - protein, 9 aa, Homo Sapiens
AFREHKPQL

SEQ ID NO: 961722 - protein, 9 aa, Homo Sapiens
FLSIQEREN

SEQ ID NO: 961723 - protein, 9 aa, Homo Sapiens
QQLERMGFS

SEQ ID NO: 961724 - protein, 9 aa, Homo Sapiens
RLQLPEAAV

SEQ ID NO: 961725 - protein, 9 aa, Homo Sapiens
INLFGLASA

SEQ ID NO: 961726 - protein, 9 aa, Homo Sapiens
QVNAIDKEI

SEQ ID NO: 961727 - protein, 9 aa, Homo Sapiens
PFYCDCNMQ

SEQ ID NO: 961728 - protein, 9 aa, Homo Sapiens
RGSFPWQGL

SEQ ID NO: 961729 - protein, 9 aa, Homo Sapiens
NLITRLSEI

SEQ ID NO: 961730 - protein, 9 aa, Homo Sapiens
VHSFFMELL

SEQ ID NO: 961731 - protein, 9 aa, Homo Sapiens
TSFAQKITK

SEQ ID NO: 961732 - protein, 9 aa, Homo Sapiens
RGAAAGVTV

SEQ ID NO: 961733 - protein, 9 aa, Homo Sapiens
NSYSMLHPQ

SEQ ID NO: 961734 - protein, 9 aa, Homo Sapiens
RNRSDVEEL

SEQ ID NO: 961735 - protein, 9 aa, Homo Sapiens
DRSSSRMLP

SEQ ID NO: 961736 - protein, 9 aa, Homo Sapiens
MRRDLEKST

SEQ ID NO: 961737 - protein, 9 aa, Homo Sapiens
ADNRIIITQ

SEQ ID NO: 961738 - protein, 9 aa, Homo Sapiens
HLPWILSEF

SEQ ID NO: 961739 - protein, 9 aa, Homo Sapiens
LPFSIATQR

SEQ ID NO: 961740 - protein, 9 aa, Homo Sapiens
GPIYSVCMG

SEQ ID NO: 961741 - protein, 9 aa, Homo Sapiens
IVSVKDAVP

SEQ ID NO: 961742 - protein, 9 aa, Homo Sapiens
TLRTTEINF

SEQ ID NO: 961743 - protein, 9 aa, Homo Sapiens
LWRGQEEGM

SEQ ID NO: 961744 - protein, 9 aa, Homo Sapiens
SKNQSSCGQ

SEQ ID NO: 961745 - protein, 9 aa, Homo Sapiens
DKLFEETGV

SEQ ID NO: 961746 - protein, 9 aa, Homo Sapiens
AVLDDGNES

SEQ ID NO: 961747 - protein, 9 aa, Homo Sapiens
ESPFFKEVL

SEQ ID NO: 961748 - protein, 9 aa, Homo Sapiens
MLALTTVKS

SEQ ID NO: 961749 - protein, 9 aa, Homo Sapiens
LVKTKPQRP

SEQ ID NO: 961750 - protein, 9 aa, Homo Sapiens
GGNKGQLPE

SEQ ID NO: 961751 - protein, 9 aa, Homo Sapiens
PKKIICMSR

SEQ ID NO: 961752 - protein, 9 aa, Homo Sapiens
PRLFSDGIV

SEQ ID NO: 961753 - protein, 9 aa, Homo Sapiens
KGWPLPFSI

SEQ ID NO: 961754 - protein, 9 aa, Homo Sapiens
LLFYVHFLL

SEQ ID NO: 961755 - protein, 9 aa, Homo Sapiens
LRTFWTCPP

SEQ ID NO: 961756 - protein, 9 aa, Homo Sapiens
QSLLYEAAK

SEQ ID NO: 961757 - protein, 9 aa, Homo Sapiens
TELPVDCSI

SEQ ID NO: 961758 - protein, 9 aa, Homo Sapiens
EEWSPWSGC

SEQ ID NO: 961759 - protein, 9 aa, Homo Sapiens
SSCEPPSVA

SEQ ID NO: 961760 - protein, 9 aa, Homo Sapiens
PRQRTCVKT

SEQ ID NO: 961761 - protein, 9 aa, Homo Sapiens
ALPMPRLMS

SEQ ID NO: 961762 - protein, 9 aa, Homo Sapiens
VFTTFSDMW

SEQ ID NO: 961763 - protein, 9 aa, Homo Sapiens
RAGEIKGFI

SEQ ID NO: 961764 - protein, 9 aa, Homo Sapiens
TEADRLISL

SEQ ID NO: 961765 - protein, 9 aa, Homo Sapiens
SPLWRQIRS

SEQ ID NO: 961766 - protein, 9 aa, Homo Sapiens
PGVATEAVG

SEQ ID NO: 961767 - protein, 9 aa, Homo Sapiens
GDVKNKQES

SEQ ID NO: 961768 - protein, 9 aa, Homo Sapiens
AKRNEEDEN

SEQ ID NO: 961769 - protein, 9 aa, Homo Sapiens
SPRSDTPRS

SEQ ID NO: 961770 - protein, 9 aa, Homo Sapiens
PWESMEKAG

SEQ ID NO: 961771 - protein, 9 aa, Homo Sapiens
CFLLQDTVE

SEQ ID NO: 961772 - protein, 9 aa, Homo Sapiens
NQRRNLRSH

SEQ ID NO: 961773 - protein, 9 aa, Homo Sapiens
DRLAVLGIF

SEQ ID NO: 961774 - protein, 9 aa, Homo Sapiens
KQAFNLETA

SEQ ID NO: 961775 - protein, 9 aa, Homo Sapiens
GSGPIVLDN

SEQ ID NO: 961776 - protein, 9 aa, Homo Sapiens
KVLCPTIFP

SEQ ID NO: 961777 - protein, 9 aa, Homo Sapiens
FFTYLTLTE

SEQ ID NO: 961778 - protein, 9 aa, Homo Sapiens
LSSLFAVVF

SEQ ID NO: 961779 - protein, 9 aa, Homo Sapiens
TDSFFSFMA

SEQ ID NO: 961780 - protein, 9 aa, Homo Sapiens
QAILRMQST

SEQ ID NO: 961781 - protein, 9 aa, Homo Sapiens
KARQGLAEL

SEQ ID NO: 961782 - protein, 9 aa, Homo Sapiens
PDNKKLPEP

SEQ ID NO: 961783 - protein, 9 aa, Homo Sapiens
PRLLASTAP

SEQ ID NO: 961784 - protein, 9 aa, Homo Sapiens
FGGGRRDGF

SEQ ID NO: 961785 - protein, 9 aa, Homo Sapiens
KCEKCWKAY

SEQ ID NO: 961786 - protein, 9 aa, Homo Sapiens
LDKEETPNH

SEQ ID NO: 961787 - protein, 9 aa, Homo Sapiens
NETILHLVV

SEQ ID NO: 961788 - protein, 9 aa, Homo Sapiens
FFFLGKELK

SEQ ID NO: 961789 - protein, 9 aa, Homo Sapiens
LPWILSEFH

SEQ ID NO: 961790 - protein, 9 aa, Homo Sapiens
ASLGPPGPR

SEQ ID NO: 961791 - protein, 9 aa, Homo Sapiens
DTFMILIED

SEQ ID NO: 961792 - protein, 9 aa, Homo Sapiens
YRFVTSIYS

SEQ ID NO: 961793 - protein, 9 aa, Homo Sapiens
PLTQEQFQD

SEQ ID NO: 961794 - protein, 9 aa, Homo Sapiens
SPSEVVYSA

SEQ ID NO: 961795 - protein, 9 aa, Homo Sapiens
PSNQTTAEK

SEQ ID NO: 961796 - protein, 9 aa, Homo Sapiens
LAFREHKPQ

SEQ ID NO: 961797 - protein, 9 aa, Homo Sapiens
KGAMGRDEA

SEQ ID NO: 961798 - protein, 9 aa, Homo Sapiens
GSQSLSSEE

SEQ ID NO: 961799 - protein, 9 aa, Homo Sapiens
VLGWVGGLV

SEQ ID NO: 961800 - protein, 9 aa, Homo Sapiens
ETIFELENE

SEQ ID NO: 961801 - protein, 9 aa, Homo Sapiens
PAPEEAPPE

SEQ ID NO: 961802 - protein, 9 aa, Homo Sapiens
NTGFLQTLG

SEQ ID NO: 961803 - protein, 9 aa, Homo Sapiens
GNYISRFWT

SEQ ID NO: 961804 - protein, 9 aa, Homo Sapiens
NSSQQVRSR

SEQ ID NO: 961805 - protein, 9 aa, Homo Sapiens
EERYVPRAF

SEQ ID NO: 961806 - protein, 9 aa, Homo Sapiens
LNLDVEKTP

SEQ ID NO: 961807 - protein, 9 aa, Homo Sapiens
AANLGIVGL

SEQ ID NO: 961808 - protein, 9 aa, Homo Sapiens
HILLEVLDL

SEQ ID NO: 961809 - protein, 9 aa, Homo Sapiens
GRAYLLGDI

SEQ ID NO: 961810 - protein, 9 aa, Homo Sapiens
GAPRIPGQP

SEQ ID NO: 961811 - protein, 9 aa, Homo Sapiens
PPLSPKKPA

SEQ ID NO: 961812 - protein, 9 aa, Homo Sapiens
SQPQPALLL

SEQ ID NO: 961813 - protein, 9 aa, Homo Sapiens
SYARIFFST

SEQ ID NO: 961814 - protein, 9 aa, Homo Sapiens
IQVQKRHKM

SEQ ID NO: 961815 - protein, 9 aa, Homo Sapiens
HPEFLFSTS

SEQ ID NO: 961816 - protein, 9 aa, Homo Sapiens
EEKVKFDDA

SEQ ID NO: 961817 - protein, 9 aa, Homo Sapiens
YMLQKGGNF

SEQ ID NO: 961818 - protein, 9 aa, Homo Sapiens
TCVKTVFSA

SEQ ID NO: 961819 - protein, 9 aa, Homo Sapiens
SILASVVVR

SEQ ID NO: 961820 - protein, 9 aa, Homo Sapiens
QKEEEVCGD

SEQ ID NO: 961821 - protein, 9 aa, Homo Sapiens
ALLLNQPHT

SEQ ID NO: 961822 - protein, 9 aa, Homo Sapiens
FLLVTVSLC

SEQ ID NO: 961823 - protein, 9 aa, Homo Sapiens
AEDILQEFV

SEQ ID NO: 961824 - protein, 9 aa, Homo Sapiens
LPRESSPDA

SEQ ID NO: 961825 - protein, 9 aa, Homo Sapiens
KKIRKTVSG

SEQ ID NO: 961826 - protein, 9 aa, Homo Sapiens
ILNARLIRN

SEQ ID NO: 961827 - protein, 9 aa, Homo Sapiens
RPSLLASGR

SEQ ID NO: 961828 - protein, 9 aa, Homo Sapiens
EASRNGTVH

SEQ ID NO: 961829 - protein, 9 aa, Homo Sapiens
SWFLEMDLK

SEQ ID NO: 961830 - protein, 9 aa, Homo Sapiens
KLDRGEGPG

SEQ ID NO: 961831 - protein, 9 aa, Homo Sapiens
EEGMVIFHM

SEQ ID NO: 961832 - protein, 9 aa, Homo Sapiens
SFSDGGDGV

SEQ ID NO: 961833 - protein, 9 aa, Homo Sapiens
GLQKQTESF

SEQ ID NO: 961834 - protein, 9 aa, Homo Sapiens
GEDILLMLG

SEQ ID NO: 961835 - protein, 9 aa, Homo Sapiens
MYSSSRYPP

SEQ ID NO: 961836 - protein, 9 aa, Homo Sapiens
ALSIPLHIL

SEQ ID NO: 961837 - protein, 9 aa, Homo Sapiens
SWSTGKEVA

SEQ ID NO: 961838 - protein, 9 aa, Homo Sapiens
CKGRLNCIM

SEQ ID NO: 961839 - protein, 9 aa, Homo Sapiens
GRQEKENAK

SEQ ID NO: 961840 - protein, 9 aa, Homo Sapiens
MRSGVSDDV

SEQ ID NO: 961841 - protein, 9 aa, Homo Sapiens
PSQLTTMGT

SEQ ID NO: 961842 - protein, 9 aa, Homo Sapiens
FLNFFSTLI

SEQ ID NO: 961843 - protein, 9 aa, Homo Sapiens
QDLKSLIQE

SEQ ID NO: 961844 - protein, 9 aa, Homo Sapiens
EDIQPAAWE

SEQ ID NO: 961845 - protein, 9 aa, Homo Sapiens
NALEHLIEV

SEQ ID NO: 961846 - protein, 9 aa, Homo Sapiens
FQEQGHLRN

SEQ ID NO: 961847 - protein, 9 aa, Homo Sapiens
TSIGKSWID

SEQ ID NO: 961848 - protein, 9 aa, Homo Sapiens
QALSKNHPS

SEQ ID NO: 961849 - protein, 9 aa, Homo Sapiens
TIKVNGTPL

SEQ ID NO: 961850 - protein, 9 aa, Homo Sapiens
QKQTESFSD

SEQ ID NO: 961851 - protein, 9 aa, Homo Sapiens
GWRELVLPD

SEQ ID NO: 961852 - protein, 9 aa, Homo Sapiens
GEEPVPSEE

SEQ ID NO: 961853 - protein, 9 aa, Homo Sapiens
KKGVDGGLF

SEQ ID NO: 961854 - protein, 9 aa, Homo Sapiens
PTLASHVPH

SEQ ID NO: 961855 - protein, 9 aa, Homo Sapiens
GVRGAVAFA

SEQ ID NO: 961856 - protein, 9 aa, Homo Sapiens
RLLSTWYFS

SEQ ID NO: 961857 - protein, 9 aa, Homo Sapiens
MKPENLKKK

SEQ ID NO: 961858 - protein, 9 aa, Homo Sapiens
GQDHGEAVQ

SEQ ID NO: 961859 - protein, 9 aa, Homo Sapiens
CHYRLQNVK

SEQ ID NO: 961860 - protein, 9 aa, Homo Sapiens
ERCEHQGQV

SEQ ID NO: 961861 - protein, 9 aa, Homo Sapiens
MSFQQVKQW

SEQ ID NO: 961862 - protein, 9 aa, Homo Sapiens
CLGMGLPFP

SEQ ID NO: 961863 - protein, 9 aa, Homo Sapiens
RKDMISDIQ

SEQ ID NO: 961864 - protein, 9 aa, Homo Sapiens
LHFSRWAKT

SEQ ID NO: 961865 - protein, 9 aa, Homo Sapiens
LAVVERLHL

SEQ ID NO: 961866 - protein, 9 aa, Homo Sapiens
NTGAYDSFM

SEQ ID NO: 961867 - protein, 9 aa, Homo Sapiens
YFLPEDGLT

SEQ ID NO: 961868 - protein, 9 aa, Homo Sapiens
CSVLSGDLY

SEQ ID NO: 961869 - protein, 9 aa, Homo Sapiens
KHNLFAARD

SEQ ID NO: 961870 - protein, 9 aa, Homo Sapiens
PVGLVLQPW

SEQ ID NO: 961871 - protein, 9 aa, Homo Sapiens
SQIASSIRK

SEQ ID NO: 961872 - protein, 9 aa, Homo Sapiens
LGEEDNWFE

SEQ ID NO: 961873 - protein, 9 aa, Homo Sapiens
SLEDFFNFC

SEQ ID NO: 961874 - protein, 9 aa, Homo Sapiens
VPELISRLP

SEQ ID NO: 961875 - protein, 9 aa, Homo Sapiens
FYMAKPDMI

SEQ ID NO: 961876 - protein, 9 aa, Homo Sapiens
SSRPLRVLF

SEQ ID NO: 961877 - protein, 9 aa, Homo Sapiens
EPGAAHEIK

SEQ ID NO: 961878 - protein, 9 aa, Homo Sapiens
IPLDPLSGH

SEQ ID NO: 961879 - protein, 9 aa, Homo Sapiens
SWWVGLPEV

SEQ ID NO: 961880 - protein, 9 aa, Homo Sapiens
VKTKPQRPV

SEQ ID NO: 961881 - protein, 9 aa, Homo Sapiens
LLFLGIYVI

SEQ ID NO: 961882 - protein, 9 aa, Homo Sapiens
DLFSYCSEE

SEQ ID NO: 961883 - protein, 9 aa, Homo Sapiens
LRCGSGLFE

SEQ ID NO: 961884 - protein, 9 aa, Homo Sapiens
SSSMRSGVS

SEQ ID NO: 961885 - protein, 9 aa, Homo Sapiens
SAFSHTMSQ

SEQ ID NO: 961886 - protein, 9 aa, Homo Sapiens
LERLKNTHQ

SEQ ID NO: 961887 - protein, 9 aa, Homo Sapiens
PPTPAATLS

SEQ ID NO: 961888 - protein, 9 aa, Homo Sapiens
MNVKLALDG

SEQ ID NO: 961889 - protein, 9 aa, Homo Sapiens
DKYMLHLLQ

SEQ ID NO: 961890 - protein, 9 aa, Homo Sapiens
WSRDSPLFL

SEQ ID NO: 961891 - protein, 9 aa, Homo Sapiens
PQPALLLNQ

SEQ ID NO: 961892 - protein, 9 aa, Homo Sapiens
PREETEKEE

SEQ ID NO: 961893 - protein, 9 aa, Homo Sapiens
LVAPNLIEK

SEQ ID NO: 961894 - protein, 9 aa, Homo Sapiens
ADRAVFSGG

SEQ ID NO: 961895 - protein, 9 aa, Homo Sapiens
KFVHPKMRP

SEQ ID NO: 961896 - protein, 9 aa, Homo Sapiens
DCSIKTRLL

SEQ ID NO: 961897 - protein, 9 aa, Homo Sapiens
KLGDNTREL

SEQ ID NO: 961898 - protein, 9 aa, Homo Sapiens
YKNEVCKQD

SEQ ID NO: 961899 - protein, 9 aa, Homo Sapiens
SLNLCDGDR

SEQ ID NO: 961900 - protein, 9 aa, Homo Sapiens
DMGVSSVKE

SEQ ID NO: 961901 - protein, 9 aa, Homo Sapiens
ALSKNHPSQ

SEQ ID NO: 961902 - protein, 9 aa, Homo Sapiens
SESLCCSSS

SEQ ID NO: 961903 - protein, 9 aa, Homo Sapiens
RCMLAGSVV

SEQ ID NO: 961904 - protein, 9 aa, Homo Sapiens
FLGSAELLR

SEQ ID NO: 961905 - protein, 9 aa, Homo Sapiens
RQCMKLLER

SEQ ID NO: 961906 - protein, 9 aa, Homo Sapiens
LPGVGILPP

SEQ ID NO: 961907 - protein, 9 aa, Homo Sapiens
LTKAGAKEK

SEQ ID NO: 961908 - protein, 9 aa, Homo Sapiens
GSGKSATEN

SEQ ID NO: 961909 - protein, 9 aa, Homo Sapiens
LLTSVVNAH

SEQ ID NO: 961910 - protein, 9 aa, Homo Sapiens
WLLLQYDAE

SEQ ID NO: 961911 - protein, 9 aa, Homo Sapiens
YTLSTLQQD

SEQ ID NO: 961912 - protein, 9 aa, Homo Sapiens
ITLRYQLYD

SEQ ID NO: 961913 - protein, 9 aa, Homo Sapiens
KLLKCRMAY

SEQ ID NO: 961914 - protein, 9 aa, Homo Sapiens
LWDMETEEA

SEQ ID NO: 961915 - protein, 9 aa, Homo Sapiens
IRHSKQAST

SEQ ID NO: 961916 - protein, 9 aa, Homo Sapiens
TAQFNWDPK

SEQ ID NO: 961917 - protein, 9 aa, Homo Sapiens
TPAATLSAP

SEQ ID NO: 961918 - protein, 9 aa, Homo Sapiens
ISRYVLSEK

SEQ ID NO: 961919 - protein, 9 aa, Homo Sapiens
LAFVLEIPG

SEQ ID NO: 961920 - protein, 9 aa, Homo Sapiens
QTIRKKVGP

SEQ ID NO: 961921 - protein, 9 aa, Homo Sapiens
KWRIQREES

SEQ ID NO: 961922 - protein, 9 aa, Homo Sapiens
YVIDKYMLH

SEQ ID NO: 961923 - protein, 9 aa, Homo Sapiens
DSALRCPGP

SEQ ID NO: 961924 - protein, 9 aa, Homo Sapiens
DQGHGHQRR

SEQ ID NO: 961925 - protein, 9 aa, Homo Sapiens
KRAPANPEP

SEQ ID NO: 961926 - protein, 9 aa, Homo Sapiens
LVTVSVNEW

SEQ ID NO: 961927 - protein, 9 aa, Homo Sapiens
SRHQLMPNE

SEQ ID NO: 961928 - protein, 9 aa, Homo Sapiens
RHRSEPQHL

SEQ ID NO: 961929 - protein, 9 aa, Homo Sapiens
FMILIEDVI

SEQ ID NO: 961930 - protein, 9 aa, Homo Sapiens
GGDILNARL

SEQ ID NO: 961931 - protein, 9 aa, Homo Sapiens
ENEVYKQVM

SEQ ID NO: 961932 - protein, 9 aa, Homo Sapiens
LFGSERLTL

SEQ ID NO: 961933 - protein, 9 aa, Homo Sapiens
LVQKLSLEN

SEQ ID NO: 961934 - protein, 9 aa, Homo Sapiens
IKKNEKPAV

SEQ ID NO: 961935 - protein, 9 aa, Homo Sapiens
KPQLHAAAT

SEQ ID NO: 961936 - protein, 9 aa, Homo Sapiens
VYQGVCQTG

SEQ ID NO: 961937 - protein, 9 aa, Homo Sapiens
PGSSPAGSR

SEQ ID NO: 961938 - protein, 9 aa, Homo Sapiens
EEHQHQIHN

SEQ ID NO: 961939 - protein, 9 aa, Homo Sapiens
NLGPPQGNS

SEQ ID NO: 961940 - protein, 9 aa, Homo Sapiens
TPSPSEVVY

SEQ ID NO: 961941 - protein, 9 aa, Homo Sapiens
RKLPCCLWP

SEQ ID NO: 961942 - protein, 9 aa, Homo Sapiens
VWVNHGAFC

SEQ ID NO: 961943 - protein, 9 aa, Homo Sapiens
PSSLSMAFV

SEQ ID NO: 961944 - protein, 9 aa, Homo Sapiens
FMISCTDLS

SEQ ID NO: 961945 - protein, 9 aa, Homo Sapiens
NYLGNYISR

SEQ ID NO: 961946 - protein, 9 aa, Homo Sapiens
YIFSFFLGY

SEQ ID NO: 961947 - protein, 9 aa, Homo Sapiens
YGDNSRVVL

SEQ ID NO: 961948 - protein, 9 aa, Homo Sapiens
PWASLESQV

SEQ ID NO: 961949 - protein, 9 aa, Homo Sapiens
EKSPDYCTC

SEQ ID NO: 961950 - protein, 9 aa, Homo Sapiens
EAPLYGQMI

SEQ ID NO: 961951 - protein, 9 aa, Homo Sapiens
ADGEVSGDA

SEQ ID NO: 961952 - protein, 9 aa, Homo Sapiens
SGDLYPGGA

SEQ ID NO: 961953 - protein, 9 aa, Homo Sapiens
SVKDAVPTI

SEQ ID NO: 961954 - protein, 9 aa, Homo Sapiens
TWYVIKLGN

SEQ ID NO: 961955 - protein, 9 aa, Homo Sapiens
DNVGPWAPG

SEQ ID NO: 961956 - protein, 9 aa, Homo Sapiens
LGDIQLRGQ

SEQ ID NO: 961957 - protein, 9 aa, Homo Sapiens
PEKKAKNPK

SEQ ID NO: 961958 - protein, 9 aa, Homo Sapiens
MGFSTEQAV

SEQ ID NO: 961959 - protein, 9 aa, Homo Sapiens
LCAMTDEIC

SEQ ID NO: 961960 - protein, 9 aa, Homo Sapiens
TNPLLTQAL

SEQ ID NO: 961961 - protein, 9 aa, Homo Sapiens
AFIQALKDE

SEQ ID NO: 961962 - protein, 9 aa, Homo Sapiens
ILSWPKEKP

SEQ ID NO: 961963 - protein, 9 aa, Homo Sapiens
PPKKEDMEL

SEQ ID NO: 961964 - protein, 9 aa, Homo Sapiens
LPRQAFSST

SEQ ID NO: 961965 - protein, 9 aa, Homo Sapiens
ALSIWEKLG

SEQ ID NO: 961966 - protein, 9 aa, Homo Sapiens
TIFLLVTVS

SEQ ID NO: 961967 - protein, 9 aa, Homo Sapiens
TALGRDLFC

SEQ ID NO: 961968 - protein, 9 aa, Homo Sapiens
EETREVLKV

SEQ ID NO: 961969 - protein, 9 aa, Homo Sapiens
APRLLASTA

SEQ ID NO: 961970 - protein, 9 aa, Homo Sapiens
LTGMLSNLT

SEQ ID NO: 961971 - protein, 9 aa, Homo Sapiens
STGKEVAGD

SEQ ID NO: 961972 - protein, 9 aa, Homo Sapiens
YDLKNTLRT

SEQ ID NO: 961973 - protein, 9 aa, Homo Sapiens
KNISEVEEW

SEQ ID NO: 961974 - protein, 9 aa, Homo Sapiens
YQTKFPVPL

SEQ ID NO: 961975 - protein, 9 aa, Homo Sapiens
DMKLSMFDV

SEQ ID NO: 961976 - protein, 9 aa, Homo Sapiens
SSLFAVVFL

SEQ ID NO: 961977 - protein, 9 aa, Homo Sapiens
ISYSKGQLR

SEQ ID NO: 961978 - protein, 9 aa, Homo Sapiens
LFSYCSEER

SEQ ID NO: 961979 - protein, 9 aa, Homo Sapiens
NQLIAKLQK

SEQ ID NO: 961980 - protein, 9 aa, Homo Sapiens
HKSDNKCKE

SEQ ID NO: 961981 - protein, 9 aa, Homo Sapiens
TGKEVAGDI

SEQ ID NO: 961982 - protein, 9 aa, Homo Sapiens
SGPGQALQN

SEQ ID NO: 961983 - protein, 9 aa, Homo Sapiens
NICSHGLCV

SEQ ID NO: 961984 - protein, 9 aa, Homo Sapiens
YGAIVQAIL

SEQ ID NO: 961985 - protein, 9 aa, Homo Sapiens
TSRPGACLA

SEQ ID NO: 961986 - protein, 9 aa, Homo Sapiens
FMELLKTGM

SEQ ID NO: 961987 - protein, 9 aa, Homo Sapiens
EGVYVAAVQ

SEQ ID NO: 961988 - protein, 9 aa, Homo Sapiens
CSAKISISF

SEQ ID NO: 961989 - protein, 9 aa, Homo Sapiens
GSGPLPRES

SEQ ID NO: 961990 - protein, 9 aa, Homo Sapiens
PPQRGNQSQ

SEQ ID NO: 961991 - protein, 9 aa, Homo Sapiens
KKKRHKGKN

SEQ ID NO: 961992 - protein, 9 aa, Homo Sapiens
AGLGALLHC

SEQ ID NO: 961993 - protein, 9 aa, Homo Sapiens
SQLYVVVSN

SEQ ID NO: 961994 - protein, 9 aa, Homo Sapiens
LYGRQGQPV

SEQ ID NO: 961995 - protein, 9 aa, Homo Sapiens
PPISFFLAI

SEQ ID NO: 961996 - protein, 9 aa, Homo Sapiens
RKNLFCFGE

SEQ ID NO: 961997 - protein, 9 aa, Homo Sapiens
LPPTAGLRA

SEQ ID NO: 961998 - protein, 9 aa, Homo Sapiens
DGKIYTVEH

SEQ ID NO: 961999 - protein, 9 aa, Homo Sapiens
SWTKNGKAL

SEQ ID NO: 962000 - protein, 9 aa, Homo Sapiens
SFVIRSAVS

SEQ ID NO: 962001 - protein, 9 aa, Homo Sapiens
LKDGVFTTF

SEQ ID NO: 962002 - protein, 9 aa, Homo Sapiens
GLLRQDPIE

SEQ ID NO: 962003 - protein, 9 aa, Homo Sapiens
HSQDTLFLN

SEQ ID NO: 962004 - protein, 9 aa, Homo Sapiens
LPFTHWNFD

SEQ ID NO: 962005 - protein, 9 aa, Homo Sapiens
GPGKEKVAL

SEQ ID NO: 962006 - protein, 9 aa, Homo Sapiens
QGLPGPDEC

SEQ ID NO: 962007 - protein, 9 aa, Homo Sapiens
GDIQLRGQT

SEQ ID NO: 962008 - protein, 9 aa, Homo Sapiens
MPAAQDTPD

SEQ ID NO: 962009 - protein, 9 aa, Homo Sapiens
FCMSVTRYL

SEQ ID NO: 962010 - protein, 9 aa, Homo Sapiens
EDYLVKEIA

SEQ ID NO: 962011 - protein, 9 aa, Homo Sapiens
RKVEGLLYK

SEQ ID NO: 962012 - protein, 9 aa, Homo Sapiens
RNSPAPPHP

SEQ ID NO: 962013 - protein, 9 aa, Homo Sapiens
RMAYQDHET

SEQ ID NO: 962014 - protein, 9 aa, Homo Sapiens
LFQISVLCD

SEQ ID NO: 962015 - protein, 9 aa, Homo Sapiens
PPFSGNDTD

SEQ ID NO: 962016 - protein, 9 aa, Homo Sapiens
PGSQAESSE

SEQ ID NO: 962017 - protein, 9 aa, Homo Sapiens
PEQLLPRPW

SEQ ID NO: 962018 - protein, 9 aa, Homo Sapiens
TGEKRKINV

SEQ ID NO: 962019 - protein, 9 aa, Homo Sapiens
SPTTENRLG

SEQ ID NO: 962020 - protein, 9 aa, Homo Sapiens
TTKSKKKKR

SEQ ID NO: 962021 - protein, 9 aa, Homo Sapiens
YYSNLFPGG

SEQ ID NO: 962022 - protein, 9 aa, Homo Sapiens
KLALDGEIA

SEQ ID NO: 962023 - protein, 9 aa, Homo Sapiens
PPPLARPPA

SEQ ID NO: 962024 - protein, 9 aa, Homo Sapiens
QPGSLWWRS

SEQ ID NO: 962025 - protein, 9 aa, Homo Sapiens
DIFCIYAPE

SEQ ID NO: 962026 - protein, 9 aa, Homo Sapiens
LEVCCVCPM

SEQ ID NO: 962027 - protein, 9 aa, Homo Sapiens
ERMGFSTEQ

SEQ ID NO: 962028 - protein, 9 aa, Homo Sapiens
TVKKSDAGR

SEQ ID NO: 962029 - protein, 9 aa, Homo Sapiens
NESCFNVEI

SEQ ID NO: 962030 - protein, 9 aa, Homo Sapiens
IRGPEQEFG

SEQ ID NO: 962031 - protein, 9 aa, Homo Sapiens
AYDSFMSLR

SEQ ID NO: 962032 - protein, 9 aa, Homo Sapiens
ARLLEGSSS

SEQ ID NO: 962033 - protein, 9 aa, Homo Sapiens
RTCVKTVFS

SEQ ID NO: 962034 - protein, 9 aa, Homo Sapiens
SQIISLLLK

SEQ ID NO: 962035 - protein, 9 aa, Homo Sapiens
NGLVDGSLL

SEQ ID NO: 962036 - protein, 9 aa, Homo Sapiens
GQISFRSNG

SEQ ID NO: 962037 - protein, 9 aa, Homo Sapiens
ESLVEATVR

SEQ ID NO: 962038 - protein, 9 aa, Homo Sapiens
KDSEFEFLK

SEQ ID NO: 962039 - protein, 9 aa, Homo Sapiens
PPFPPISFF

SEQ ID NO: 962040 - protein, 9 aa, Homo Sapiens
EDRVPADLR

SEQ ID NO: 962041 - protein, 9 aa, Homo Sapiens
RGPTGIEEF

SEQ ID NO: 962042 - protein, 9 aa, Homo Sapiens
PENIREKFF

SEQ ID NO: 962043 - protein, 9 aa, Homo Sapiens
VHVPSPLHP

SEQ ID NO: 962044 - protein, 9 aa, Homo Sapiens
AEIEPENIR

SEQ ID NO: 962045 - protein, 9 aa, Homo Sapiens
LTVKKSDAG

SEQ ID NO: 962046 - protein, 9 aa, Homo Sapiens
SESQREDLQ

SEQ ID NO: 962047 - protein, 9 aa, Homo Sapiens
FLSVLSSLT

SEQ ID NO: 962048 - protein, 9 aa, Homo Sapiens
ERKKKGKTV

SEQ ID NO: 962049 - protein, 9 aa, Homo Sapiens
ISLGKSWVS

SEQ ID NO: 962050 - protein, 9 aa, Homo Sapiens
AISPGGDRE

SEQ ID NO: 962051 - protein, 9 aa, Homo Sapiens
ENLNSILDD

SEQ ID NO: 962052 - protein, 9 aa, Homo Sapiens
PRSSWGDCA

SEQ ID NO: 962053 - protein, 9 aa, Homo Sapiens
TEEAEDILQ

SEQ ID NO: 962054 - protein, 9 aa, Homo Sapiens
RYTNCDTAY

SEQ ID NO: 962055 - protein, 9 aa, Homo Sapiens
AVKKREFHN

SEQ ID NO: 962056 - protein, 9 aa, Homo Sapiens
HLVQYFQQG

SEQ ID NO: 962057 - protein, 9 aa, Homo Sapiens
FYAFPSEFS

SEQ ID NO: 962058 - protein, 9 aa, Homo Sapiens
ANCDFPPSL

SEQ ID NO: 962059 - protein, 9 aa, Homo Sapiens
WYFSKPPLD

SEQ ID NO: 962060 - protein, 9 aa, Homo Sapiens
TDLSINFLM

SEQ ID NO: 962061 - protein, 9 aa, Homo Sapiens
LLATGETMN

SEQ ID NO: 962062 - protein, 9 aa, Homo Sapiens
ASRPRVRAQ

SEQ ID NO: 962063 - protein, 9 aa, Homo Sapiens
CAWFLNIQA

SEQ ID NO: 962064 - protein, 9 aa, Homo Sapiens
ALKRKKESQ

SEQ ID NO: 962065 - protein, 9 aa, Homo Sapiens
LPSSDRTPE

SEQ ID NO: 962066 - protein, 9 aa, Homo Sapiens
FHGKRVPLN

SEQ ID NO: 962067 - protein, 9 aa, Homo Sapiens
KALPTAPPL

SEQ ID NO: 962068 - protein, 9 aa, Homo Sapiens
MLFCMSVTR

SEQ ID NO: 962069 - protein, 9 aa, Homo Sapiens
SFFSFMAFF

SEQ ID NO: 962070 - protein, 9 aa, Homo Sapiens
MSPVGNTLR

SEQ ID NO: 962071 - protein, 9 aa, Homo Sapiens
QLERMGFST

SEQ ID NO: 962072 - protein, 9 aa, Homo Sapiens
FSNLKQDYP

SEQ ID NO: 962073 - protein, 9 aa, Homo Sapiens
EDISLLEDV

SEQ ID NO: 962074 - protein, 9 aa, Homo Sapiens
LSLSSGYSS

SEQ ID NO: 962075 - protein, 9 aa, Homo Sapiens
YDNKQVCIV

SEQ ID NO: 962076 - protein, 9 aa, Homo Sapiens
TVSLCSYSA

SEQ ID NO: 962077 - protein, 9 aa, Homo Sapiens
SEKVTVSSD

SEQ ID NO: 962078 - protein, 9 aa, Homo Sapiens
LVRDHEQEI

SEQ ID NO: 962079 - protein, 9 aa, Homo Sapiens
PAATLSAPA

SEQ ID NO: 962080 - protein, 9 aa, Homo Sapiens
LAEVFNGLK

SEQ ID NO: 962081 - protein, 9 aa, Homo Sapiens
LSWPKEKPG

SEQ ID NO: 962082 - protein, 9 aa, Homo Sapiens
MGVSSVKEK

SEQ ID NO: 962083 - protein, 9 aa, Homo Sapiens
YQREGRQCE

SEQ ID NO: 962084 - protein, 9 aa, Homo Sapiens
CGVLKELYT

SEQ ID NO: 962085 - protein, 9 aa, Homo Sapiens
PRWQPDNKK

SEQ ID NO: 962086 - protein, 9 aa, Homo Sapiens
LEQGDIKIE

SEQ ID NO: 962087 - protein, 9 aa, Homo Sapiens
HDAGLGALL

SEQ ID NO: 962088 - protein, 9 aa, Homo Sapiens
CRVCTKVFH

SEQ ID NO: 962089 - protein, 9 aa, Homo Sapiens
LWMKWRIDK

SEQ ID NO: 962090 - protein, 9 aa, Homo Sapiens
LYRLLITVC

SEQ ID NO: 962091 - protein, 9 aa, Homo Sapiens
YQKICILEK

SEQ ID NO: 962092 - protein, 9 aa, Homo Sapiens
DCPVFSGLF

SEQ ID NO: 962093 - protein, 9 aa, Homo Sapiens
VRRGSEAPE

SEQ ID NO: 962094 - protein, 9 aa, Homo Sapiens
SVFNEHSSR

SEQ ID NO: 962095 - protein, 9 aa, Homo Sapiens
CLLPRIVRY

SEQ ID NO: 962096 - protein, 9 aa, Homo Sapiens
ECATPLDKA

SEQ ID NO: 962097 - protein, 9 aa, Homo Sapiens
YLIKVLKRR

SEQ ID NO: 962098 - protein, 9 aa, Homo Sapiens
PLPLSGLHT

SEQ ID NO: 962099 - protein, 9 aa, Homo Sapiens
PTSQPQLTP

SEQ ID NO: 962100 - protein, 9 aa, Homo Sapiens
NFSNFLDKS

SEQ ID NO: 962101 - protein, 9 aa, Homo Sapiens
RSALVLLYR

SEQ ID NO: 962102 - protein, 9 aa, Homo Sapiens
ALKYYPDKN

SEQ ID NO: 962103 - protein, 9 aa, Homo Sapiens
IYDNKGADA

SEQ ID NO: 962104 - protein, 9 aa, Homo Sapiens
TPLDFFHIF

SEQ ID NO: 962105 - protein, 9 aa, Homo Sapiens
NMILWPASD

SEQ ID NO: 962106 - protein, 9 aa, Homo Sapiens
EPEKGEMVD

SEQ ID NO: 962107 - protein, 9 aa, Homo Sapiens
GFPPAVAAA

SEQ ID NO: 962108 - protein, 9 aa, Homo Sapiens
GSFPWQGLK

SEQ ID NO: 962109 - protein, 9 aa, Homo Sapiens
WFNLTAQNY

SEQ ID NO: 962110 - protein, 9 aa, Homo Sapiens
SEVVNVLKF

SEQ ID NO: 962111 - protein, 9 aa, Homo Sapiens
PCKNIFFKA

SEQ ID NO: 962112 - protein, 9 aa, Homo Sapiens
FNGQSGQIS

SEQ ID NO: 962113 - protein, 9 aa, Homo Sapiens
FLLHMKPPS

SEQ ID NO: 962114 - protein, 9 aa, Homo Sapiens
PSVASTCQE

SEQ ID NO: 962115 - protein, 9 aa, Homo Sapiens
VSLTQEKKF

SEQ ID NO: 962116 - protein, 9 aa, Homo Sapiens
SLRNRQCRG

SEQ ID NO: 962117 - protein, 9 aa, Homo Sapiens
TGREFKGEE

SEQ ID NO: 962118 - protein, 9 aa, Homo Sapiens
TGSLLRCGS

SEQ ID NO: 962119 - protein, 9 aa, Homo Sapiens
GLVDGSLLT

SEQ ID NO: 962120 - protein, 9 aa, Homo Sapiens
GSREASPLV

SEQ ID NO: 962121 - protein, 9 aa, Homo Sapiens
VGTSAYLAP

SEQ ID NO: 962122 - protein, 9 aa, Homo Sapiens
APSFSDSAT

SEQ ID NO: 962123 - protein, 9 aa, Homo Sapiens
NPSLGSCSS

SEQ ID NO: 962124 - protein, 9 aa, Homo Sapiens
EKEVFIFLQ

SEQ ID NO: 962125 - protein, 9 aa, Homo Sapiens
VTSPLLSPD

SEQ ID NO: 962126 - protein, 9 aa, Homo Sapiens
GEALSESQR

SEQ ID NO: 962127 - protein, 9 aa, Homo Sapiens
TAETVLPLT

SEQ ID NO: 962128 - protein, 9 aa, Homo Sapiens
LSWASVNRG

SEQ ID NO: 962129 - protein, 9 aa, Homo Sapiens
DPDSWFLEM

SEQ ID NO: 962130 - protein, 9 aa, Homo Sapiens
MRPDKLHLE

SEQ ID NO: 962131 - protein, 9 aa, Homo Sapiens
HLRNLVLGD

SEQ ID NO: 962132 - protein, 9 aa, Homo Sapiens
QQTYSRYQT

SEQ ID NO: 962133 - protein, 9 aa, Homo Sapiens
CETQGLPHC

SEQ ID NO: 962134 - protein, 9 aa, Homo Sapiens
LGNNQIMPK

SEQ ID NO: 962135 - protein, 9 aa, Homo Sapiens
PPCSPEVDP

SEQ ID NO: 962136 - protein, 9 aa, Homo Sapiens
DPSFSGALC

SEQ ID NO: 962137 - protein, 9 aa, Homo Sapiens
PSCIRHLVH

SEQ ID NO: 962138 - protein, 9 aa, Homo Sapiens
PTGREFKGE

SEQ ID NO: 962139 - protein, 9 aa, Homo Sapiens
PVCRTTVSW

SEQ ID NO: 962140 - protein, 9 aa, Homo Sapiens
VLSEGWATS

SEQ ID NO: 962141 - protein, 9 aa, Homo Sapiens
DLSGPGFSE

SEQ ID NO: 962142 - protein, 9 aa, Homo Sapiens
TAAPAPRRG

SEQ ID NO: 962143 - protein, 9 aa, Homo Sapiens
DTVTKVSLC

SEQ ID NO: 962144 - protein, 9 aa, Homo Sapiens
AVRPQESRS

SEQ ID NO: 962145 - protein, 9 aa, Homo Sapiens
LYVGNEPKW

SEQ ID NO: 962146 - protein, 9 aa, Homo Sapiens
DPFLSKANC

SEQ ID NO: 962147 - protein, 9 aa, Homo Sapiens
LEGPKGEPG

SEQ ID NO: 962148 - protein, 9 aa, Homo Sapiens
RFPADEAFI

SEQ ID NO: 962149 - protein, 9 aa, Homo Sapiens
GSTLGNPGK

SEQ ID NO: 962150 - protein, 9 aa, Homo Sapiens
GASDSGSGN

SEQ ID NO: 962151 - protein, 9 aa, Homo Sapiens
RSNMFIPGK

SEQ ID NO: 962152 - protein, 9 aa, Homo Sapiens
IFGRNELES

SEQ ID NO: 962153 - protein, 9 aa, Homo Sapiens
FNLEEWIKL

SEQ ID NO: 962154 - protein, 9 aa, Homo Sapiens
SGHPLRDPR

SEQ ID NO: 962155 - protein, 9 aa, Homo Sapiens
QQIPFKEPA

SEQ ID NO: 962156 - protein, 9 aa, Homo Sapiens
GKSFSQIYN

SEQ ID NO: 962157 - protein, 9 aa, Homo Sapiens
GETVVLFKN

SEQ ID NO: 962158 - protein, 9 aa, Homo Sapiens
IKLGNTKEK

SEQ ID NO: 962159 - protein, 9 aa, Homo Sapiens
TPYWMVPEL

SEQ ID NO: 962160 - protein, 9 aa, Homo Sapiens
LTAFLPPRR

SEQ ID NO: 962161 - protein, 9 aa, Homo Sapiens
VIEFFLEEW

SEQ ID NO: 962162 - protein, 9 aa, Homo Sapiens
SHSVSGSLL

SEQ ID NO: 962163 - protein, 9 aa, Homo Sapiens
PRITSIDAR

SEQ ID NO: 962164 - protein, 9 aa, Homo Sapiens
DHGEAVQPC

SEQ ID NO: 962165 - protein, 9 aa, Homo Sapiens
ILSLFLSDL

SEQ ID NO: 962166 - protein, 9 aa, Homo Sapiens
VKLDRLRFE

SEQ ID NO: 962167 - protein, 9 aa, Homo Sapiens
LGNTKEKVA

SEQ ID NO: 962168 - protein, 9 aa, Homo Sapiens
NKEASPPSN

SEQ ID NO: 962169 - protein, 9 aa, Homo Sapiens
FPAGSDMNF

SEQ ID NO: 962170 - protein, 9 aa, Homo Sapiens
PGACLAEGP

SEQ ID NO: 962171 - protein, 9 aa, Homo Sapiens
RDHEQEIEN

SEQ ID NO: 962172 - protein, 9 aa, Homo Sapiens
LVVVGADGV

SEQ ID NO: 962173 - protein, 9 aa, Homo Sapiens
SPDSKGGGA

SEQ ID NO: 962174 - protein, 9 aa, Homo Sapiens
LESANRLRE

SEQ ID NO: 962175 - protein, 9 aa, Homo Sapiens
GYATFFWMY

SEQ ID NO: 962176 - protein, 9 aa, Homo Sapiens
LAKVTRMGL

SEQ ID NO: 962177 - protein, 9 aa, Homo Sapiens
EQQRGGEGQ

SEQ ID NO: 962178 - protein, 9 aa, Homo Sapiens
SSKRANICP

SEQ ID NO: 962179 - protein, 9 aa, Homo Sapiens
FLGKKRELS

SEQ ID NO: 962180 - protein, 9 aa, Homo Sapiens
LAVESPFFK

SEQ ID NO: 962181 - protein, 9 aa, Homo Sapiens
RDDAPTHTL

SEQ ID NO: 962182 - protein, 9 aa, Homo Sapiens
PKLGPPGTN

SEQ ID NO: 962183 - protein, 9 aa, Homo Sapiens
RKLTLASID

SEQ ID NO: 962184 - protein, 9 aa, Homo Sapiens
YSSGEDDVI

SEQ ID NO: 962185 - protein, 9 aa, Homo Sapiens
GLGSPAMQR

SEQ ID NO: 962186 - protein, 9 aa, Homo Sapiens
GDNSRVVLL

SEQ ID NO: 962187 - protein, 9 aa, Homo Sapiens
NFILGPVSR

SEQ ID NO: 962188 - protein, 9 aa, Homo Sapiens
THVFFRSVI

SEQ ID NO: 962189 - protein, 9 aa, Homo Sapiens
EVCCVCPMC

SEQ ID NO: 962190 - protein, 9 aa, Homo Sapiens
NFSALLPFG

SEQ ID NO: 962191 - protein, 9 aa, Homo Sapiens
ALQKKSLTS

SEQ ID NO: 962192 - protein, 9 aa, Homo Sapiens
TPSEAGNQD

SEQ ID NO: 962193 - protein, 9 aa, Homo Sapiens
SEVLVKTLE

SEQ ID NO: 962194 - protein, 9 aa, Homo Sapiens
KTIKRSLNP

SEQ ID NO: 962195 - protein, 9 aa, Homo Sapiens
GPKLGPPGT

SEQ ID NO: 962196 - protein, 9 aa, Homo Sapiens
ASVNDGRWH

SEQ ID NO: 962197 - protein, 9 aa, Homo Sapiens
SPGGHQFLQ

SEQ ID NO: 962198 - protein, 9 aa, Homo Sapiens
VHEKFVHPK

SEQ ID NO: 962199 - protein, 9 aa, Homo Sapiens
RKQHHLDSS

SEQ ID NO: 962200 - protein, 9 aa, Homo Sapiens
LVGLFHEEA

SEQ ID NO: 962201 - protein, 9 aa, Homo Sapiens
SSLQREGYP

SEQ ID NO: 962202 - protein, 9 aa, Homo Sapiens
CLRMVLSLK

SEQ ID NO: 962203 - protein, 9 aa, Homo Sapiens
GPLAKRNEE

SEQ ID NO: 962204 - protein, 9 aa, Homo Sapiens
NVGPWAPGR

SEQ ID NO: 962205 - protein, 9 aa, Homo Sapiens
LPYNEVLSF

SEQ ID NO: 962206 - protein, 9 aa, Homo Sapiens
GAQVDLPEL

SEQ ID NO: 962207 - protein, 9 aa, Homo Sapiens
SREPGSGKS

SEQ ID NO: 962208 - protein, 9 aa, Homo Sapiens
CGQEKGPGY

SEQ ID NO: 962209 - protein, 9 aa, Homo Sapiens
TRKEGSLKL

SEQ ID NO: 962210 - protein, 9 aa, Homo Sapiens
FGLGRLVTH

SEQ ID NO: 962211 - protein, 9 aa, Homo Sapiens
GSPRLGPQG

SEQ ID NO: 962212 - protein, 9 aa, Homo Sapiens
GLSRGAAAG

SEQ ID NO: 962213 - protein, 9 aa, Homo Sapiens
SWGEWDRVG

SEQ ID NO: 962214 - protein, 9 aa, Homo Sapiens
KADLSTMSA

SEQ ID NO: 962215 - protein, 9 aa, Homo Sapiens
PIMPNTVFI

SEQ ID NO: 962216 - protein, 9 aa, Homo Sapiens
FLGSASASP

SEQ ID NO: 962217 - protein, 9 aa, Homo Sapiens
VPQRLHSTE

SEQ ID NO: 962218 - protein, 9 aa, Homo Sapiens
RSTPFLTTK

SEQ ID NO: 962219 - protein, 9 aa, Homo Sapiens
HMPQPLNLT

SEQ ID NO: 962220 - protein, 9 aa, Homo Sapiens
RIYVGERPY

SEQ ID NO: 962221 - protein, 9 aa, Homo Sapiens
LQVLRDFAQ

SEQ ID NO: 962222 - protein, 9 aa, Homo Sapiens
RLISLSKKK

SEQ ID NO: 962223 - protein, 9 aa, Homo Sapiens
GPLDAPGSL

SEQ ID NO: 962224 - protein, 9 aa, Homo Sapiens
SIVRNLLSH

SEQ ID NO: 962225 - protein, 9 aa, Homo Sapiens
HLVRTFDPP

SEQ ID NO: 962226 - protein, 9 aa, Homo Sapiens
LKELHLSGC

SEQ ID NO: 962227 - protein, 9 aa, Homo Sapiens
KKGKTVPEE

SEQ ID NO: 962228 - protein, 9 aa, Homo Sapiens
GWAVTVYNK

SEQ ID NO: 962229 - protein, 9 aa, Homo Sapiens
LLKSLFKKD

SEQ ID NO: 962230 - protein, 9 aa, Homo Sapiens
LYKHLITHH

SEQ ID NO: 962231 - protein, 9 aa, Homo Sapiens
FKFLGMAVE

SEQ ID NO: 962232 - protein, 9 aa, Homo Sapiens
NDIYFVVGI

SEQ ID NO: 962233 - protein, 9 aa, Homo Sapiens
MKNTYQLGP

SEQ ID NO: 962234 - protein, 9 aa, Homo Sapiens
EELLLQVCW

SEQ ID NO: 962235 - protein, 9 aa, Homo Sapiens
KPLLFNMNA

SEQ ID NO: 962236 - protein, 9 aa, Homo Sapiens
TPLKLAVVE

SEQ ID NO: 962237 - protein, 9 aa, Homo Sapiens
GTYFLPEDG

SEQ ID NO: 962238 - protein, 9 aa, Homo Sapiens
DRGAAPLCT

SEQ ID NO: 962239 - protein, 9 aa, Homo Sapiens
NPDSGMYSS

SEQ ID NO: 962240 - protein, 9 aa, Homo Sapiens
SLRGVHVPS

SEQ ID NO: 962241 - protein, 9 aa, Homo Sapiens
VKEKYELAH

SEQ ID NO: 962242 - protein, 9 aa, Homo Sapiens
RLSVAALSI

SEQ ID NO: 962243 - protein, 9 aa, Homo Sapiens
KEMSNFTMG

SEQ ID NO: 962244 - protein, 9 aa, Homo Sapiens
EPSKFVRLP

SEQ ID NO: 962245 - protein, 9 aa, Homo Sapiens
GVYVAAVQE

SEQ ID NO: 962246 - protein, 9 aa, Homo Sapiens
EFKGEEEYL

SEQ ID NO: 962247 - protein, 9 aa, Homo Sapiens
QAENEAGRF

SEQ ID NO: 962248 - protein, 9 aa, Homo Sapiens
FRTPKIVSG

SEQ ID NO: 962249 - protein, 9 aa, Homo Sapiens
FSSLCAERM

SEQ ID NO: 962250 - protein, 9 aa, Homo Sapiens
VNKAGYRKN

SEQ ID NO: 962251 - protein, 9 aa, Homo Sapiens
EPENIREKF

SEQ ID NO: 962252 - protein, 9 aa, Homo Sapiens
IPVDMKDIY

SEQ ID NO: 962253 - protein, 9 aa, Homo Sapiens
FHPSGTVGA

SEQ ID NO: 962254 - protein, 9 aa, Homo Sapiens
VMFEEGSWG

SEQ ID NO: 962255 - protein, 9 aa, Homo Sapiens
ADRGAAPLC

SEQ ID NO: 962256 - protein, 9 aa, Homo Sapiens
SLSINFEFV

SEQ ID NO: 962257 - protein, 9 aa, Homo Sapiens
VSRRGQKRS

SEQ ID NO: 962258 - protein, 9 aa, Homo Sapiens
APAPRRGPE

SEQ ID NO: 962259 - protein, 9 aa, Homo Sapiens
AGVSPEALL

SEQ ID NO: 962260 - protein, 9 aa, Homo Sapiens
AAEAATREQ

SEQ ID NO: 962261 - protein, 9 aa, Homo Sapiens
YSSFAAAVA

SEQ ID NO: 962262 - protein, 9 aa, Homo Sapiens
TNERLKVVL

SEQ ID NO: 962263 - protein, 9 aa, Homo Sapiens
NTHVRKLTL

SEQ ID NO: 962264 - protein, 9 aa, Homo Sapiens
YCQCKGRLN

SEQ ID NO: 962265 - protein, 9 aa, Homo Sapiens
RNQVFSQTP

SEQ ID NO: 962266 - protein, 9 aa, Homo Sapiens
SADRLEESF

SEQ ID NO: 962267 - protein, 9 aa, Homo Sapiens
AAGFPPAVA

SEQ ID NO: 962268 - protein, 9 aa, Homo Sapiens
SCKPGYQRE

SEQ ID NO: 962269 - protein, 9 aa, Homo Sapiens
LLLDGDDCD

SEQ ID NO: 962270 - protein, 9 aa, Homo Sapiens
SFIVVSRML

SEQ ID NO: 962271 - protein, 9 aa, Homo Sapiens
DLFRTIFAS

SEQ ID NO: 962272 - protein, 9 aa, Homo Sapiens
VSSVKEKYE

SEQ ID NO: 962273 - protein, 9 aa, Homo Sapiens
RDEEGWEES

SEQ ID NO: 962274 - protein, 9 aa, Homo Sapiens
GTFHTEGRA

SEQ ID NO: 962275 - protein, 9 aa, Homo Sapiens
KPLMPSPQF

SEQ ID NO: 962276 - protein, 9 aa, Homo Sapiens
EIPPGVATE

SEQ ID NO: 962277 - protein, 9 aa, Homo Sapiens
YVSSFKDVR

SEQ ID NO: 962278 - protein, 9 aa, Homo Sapiens
NLIEKQKKV

SEQ ID NO: 962279 - protein, 9 aa, Homo Sapiens
LTCCLSLTV

SEQ ID NO: 962280 - protein, 9 aa, Homo Sapiens
ISLQDVYLS

SEQ ID NO: 962281 - protein, 9 aa, Homo Sapiens
QDFRLSSLF

SEQ ID NO: 962282 - protein, 9 aa, Homo Sapiens
GRDEATGPS

SEQ ID NO: 962283 - protein, 9 aa, Homo Sapiens
GNASWLMSL

SEQ ID NO: 962284 - protein, 9 aa, Homo Sapiens
PSGRSCRST

SEQ ID NO: 962285 - protein, 9 aa, Homo Sapiens
AEFLGSAEL

SEQ ID NO: 962286 - protein, 9 aa, Homo Sapiens
SMFRESEFQ

SEQ ID NO: 962287 - protein, 9 aa, Homo Sapiens
HTHTLLFYV

SEQ ID NO: 962288 - protein, 9 aa, Homo Sapiens
VSLRVHGLY

SEQ ID NO: 962289 - protein, 9 aa, Homo Sapiens
VALGRQVGA

SEQ ID NO: 962290 - protein, 9 aa, Homo Sapiens
RGRKKRISY

SEQ ID NO: 962291 - protein, 9 aa, Homo Sapiens
NMFIPGKEF

SEQ ID NO: 962292 - protein, 9 aa, Homo Sapiens
SGPDLSWAS

SEQ ID NO: 962293 - protein, 9 aa, Homo Sapiens
EIHVGPSHQ

SEQ ID NO: 962294 - protein, 9 aa, Homo Sapiens
KLSSVPQIA

SEQ ID NO: 962295 - protein, 9 aa, Homo Sapiens
LRKTKSTNP

SEQ ID NO: 962296 - protein, 9 aa, Homo Sapiens
GTVFYLNTL

SEQ ID NO: 962297 - protein, 9 aa, Homo Sapiens
AKNLLDQTR

SEQ ID NO: 962298 - protein, 9 aa, Homo Sapiens
KLQVALGKL

SEQ ID NO: 962299 - protein, 9 aa, Homo Sapiens
FANCDFPPS

SEQ ID NO: 962300 - protein, 9 aa, Homo Sapiens
GFGSHSSSS

SEQ ID NO: 962301 - protein, 9 aa, Homo Sapiens
VVLGWVGGL

SEQ ID NO: 962302 - protein, 9 aa, Homo Sapiens
ADSYEETLS

SEQ ID NO: 962303 - protein, 9 aa, Homo Sapiens
KGTRHTACL

SEQ ID NO: 962304 - protein, 9 aa, Homo Sapiens
SFFEGKGPL

SEQ ID NO: 962305 - protein, 9 aa, Homo Sapiens
KKNEKRQKL

SEQ ID NO: 962306 - protein, 9 aa, Homo Sapiens
LPTSHTACP

SEQ ID NO: 962307 - protein, 9 aa, Homo Sapiens
PQGYRIEQP

SEQ ID NO: 962308 - protein, 9 aa, Homo Sapiens
TGSGKSATE

SEQ ID NO: 962309 - protein, 9 aa, Homo Sapiens
SKLGDNTRE

SEQ ID NO: 962310 - protein, 9 aa, Homo Sapiens
PLDKEETPN

SEQ ID NO: 962311 - protein, 9 aa, Homo Sapiens
KASSLKIIS

SEQ ID NO: 962312 - protein, 9 aa, Homo Sapiens
LGSNALENN

SEQ ID NO: 962313 - protein, 9 aa, Homo Sapiens
IQYLTCGEE

SEQ ID NO: 962314 - protein, 9 aa, Homo Sapiens
ELPALFREL

SEQ ID NO: 962315 - protein, 9 aa, Homo Sapiens
SFCRLDDKT

SEQ ID NO: 962316 - protein, 9 aa, Homo Sapiens
GNFGGGRRD

SEQ ID NO: 962317 - protein, 9 aa, Homo Sapiens
EEKQGITAR

SEQ ID NO: 962318 - protein, 9 aa, Homo Sapiens
RPFPCAQCG

SEQ ID NO: 962319 - protein, 9 aa, Homo Sapiens
PVAYALQKP

SEQ ID NO: 962320 - protein, 9 aa, Homo Sapiens
KNTYQLGPP

SEQ ID NO: 962321 - protein, 9 aa, Homo Sapiens
VKNLHLPWI

SEQ ID NO: 962322 - protein, 9 aa, Homo Sapiens
PGGDREALI

SEQ ID NO: 962323 - protein, 9 aa, Homo Sapiens
LLSSLKNAV

SEQ ID NO: 962324 - protein, 9 aa, Homo Sapiens
TKMQTEEGC

SEQ ID NO: 962325 - protein, 9 aa, Homo Sapiens
ECLEIPNIC

SEQ ID NO: 962326 - protein, 9 aa, Homo Sapiens
HPKMRPLHK

SEQ ID NO: 962327 - protein, 9 aa, Homo Sapiens
FIPGKEFPT

SEQ ID NO: 962328 - protein, 9 aa, Homo Sapiens
SLGSCSSEV

SEQ ID NO: 962329 - protein, 9 aa, Homo Sapiens
KSRCIVNNL

SEQ ID NO: 962330 - protein, 9 aa, Homo Sapiens
EGGHTDSNT

SEQ ID NO: 962331 - protein, 9 aa, Homo Sapiens
PGAWSCAWF

SEQ ID NO: 962332 - protein, 9 aa, Homo Sapiens
FDPYLSRRL

SEQ ID NO: 962333 - protein, 9 aa, Homo Sapiens
LKIISAVIE

SEQ ID NO: 962334 - protein, 9 aa, Homo Sapiens
ATVALPGDE

SEQ ID NO: 962335 - protein, 9 aa, Homo Sapiens
DTKATLSVS

SEQ ID NO: 962336 - protein, 9 aa, Homo Sapiens
GKMAPWDPL

SEQ ID NO: 962337 - protein, 9 aa, Homo Sapiens
SSLLKRLEV

SEQ ID NO: 962338 - protein, 9 aa, Homo Sapiens
SLLNQKIRN

SEQ ID NO: 962339 - protein, 9 aa, Homo Sapiens
KPQMLWELW

SEQ ID NO: 962340 - protein, 9 aa, Homo Sapiens
VFFISTVAT

SEQ ID NO: 962341 - protein, 9 aa, Homo Sapiens
LCPTGFFGN

SEQ ID NO: 962342 - protein, 9 aa, Homo Sapiens
QAGLDFFQP

SEQ ID NO: 962343 - protein, 9 aa, Homo Sapiens
EPVHFRLIY

SEQ ID NO: 962344 - protein, 9 aa, Homo Sapiens
QPQLTPPNS

SEQ ID NO: 962345 - protein, 9 aa, Homo Sapiens
FGLFPSSSA

SEQ ID NO: 962346 - protein, 9 aa, Homo Sapiens
PQKPAAFAA

SEQ ID NO: 962347 - protein, 9 aa, Homo Sapiens
ANGFSGASA

SEQ ID NO: 962348 - protein, 9 aa, Homo Sapiens
PRKFCLAGD

SEQ ID NO: 962349 - protein, 9 aa, Homo Sapiens
ETELFLTYV

SEQ ID NO: 962350 - protein, 9 aa, Homo Sapiens
LDSSAVEMR

SEQ ID NO: 962351 - protein, 9 aa, Homo Sapiens
WATSLKGFM

SEQ ID NO: 962352 - protein, 9 aa, Homo Sapiens
ASTAPGPPE

SEQ ID NO: 962353 - protein, 9 aa, Homo Sapiens
TKTLFQPLF

SEQ ID NO: 962354 - protein, 9 aa, Homo Sapiens
AQPGSLWWR

SEQ ID NO: 962355 - protein, 9 aa, Homo Sapiens
SVKEKYELA

SEQ ID NO: 962356 - protein, 9 aa, Homo Sapiens
NKHQMIHSE

SEQ ID NO: 962357 - protein, 9 aa, Homo Sapiens
NKHLIVISA

SEQ ID NO: 962358 - protein, 9 aa, Homo Sapiens
GQLGLISQE

SEQ ID NO: 962359 - protein, 9 aa, Homo Sapiens
PQFVVWPRD

SEQ ID NO: 962360 - protein, 9 aa, Homo Sapiens
SNPLRYNRQ

SEQ ID NO: 962361 - protein, 9 aa, Homo Sapiens
APRIPGQPG

SEQ ID NO: 962362 - protein, 9 aa, Homo Sapiens
EEFPGPPGL

SEQ ID NO: 962363 - protein, 9 aa, Homo Sapiens
DTTERQQPR

SEQ ID NO: 962364 - protein, 9 aa, Homo Sapiens
VFNLEEWIK

SEQ ID NO: 962365 - protein, 9 aa, Homo Sapiens
LSPLFSSLC

SEQ ID NO: 962366 - protein, 9 aa, Homo Sapiens
GTGEQQRGG

SEQ ID NO: 962367 - protein, 9 aa, Homo Sapiens
VGAIGTHSG

SEQ ID NO: 962368 - protein, 9 aa, Homo Sapiens
NAIDKEIPS

SEQ ID NO: 962369 - protein, 9 aa, Homo Sapiens
VSADRLEES

SEQ ID NO: 962370 - protein, 9 aa, Homo Sapiens
PGKTSSVPV

SEQ ID NO: 962371 - protein, 9 aa, Homo Sapiens
VCRKENSVK

SEQ ID NO: 962372 - protein, 9 aa, Homo Sapiens
PCLGMGLPF

SEQ ID NO: 962373 - protein, 9 aa, Homo Sapiens
APPLPLSGL

SEQ ID NO: 962374 - protein, 9 aa, Homo Sapiens
ESMFRESEF

SEQ ID NO: 962375 - protein, 9 aa, Homo Sapiens
LRVHGVHQG

SEQ ID NO: 962376 - protein, 9 aa, Homo Sapiens
ASISPSELG

SEQ ID NO: 962377 - protein, 9 aa, Homo Sapiens
QKRTMLERL

SEQ ID NO: 962378 - protein, 9 aa, Homo Sapiens
HTSREFNYF

SEQ ID NO: 962379 - protein, 9 aa, Homo Sapiens
HQKIYNEKN

SEQ ID NO: 962380 - protein, 9 aa, Homo Sapiens
PGEEEKHGK

SEQ ID NO: 962381 - protein, 9 aa, Homo Sapiens
QKRSQASGE

SEQ ID NO: 962382 - protein, 9 aa, Homo Sapiens
AHHAAGQAE

SEQ ID NO: 962383 - protein, 9 aa, Homo Sapiens
RQVRRRPSV

SEQ ID NO: 962384 - protein, 9 aa, Homo Sapiens
GFQETLYVG

SEQ ID NO: 962385 - protein, 9 aa, Homo Sapiens
VGRPSLLAS

SEQ ID NO: 962386 - protein, 9 aa, Homo Sapiens
VANKVLCAM

SEQ ID NO: 962387 - protein, 9 aa, Homo Sapiens
PSHLPTSLA

SEQ ID NO: 962388 - protein, 9 aa, Homo Sapiens
MIKAINQGS

SEQ ID NO: 962389 - protein, 9 aa, Homo Sapiens
EKITHYTIY

SEQ ID NO: 962390 - protein, 9 aa, Homo Sapiens
GTIAVGLVS

SEQ ID NO: 962391 - protein, 9 aa, Homo Sapiens
HNQCKCENL

SEQ ID NO: 962392 - protein, 9 aa, Homo Sapiens
FAAAVAASS

SEQ ID NO: 962393 - protein, 9 aa, Homo Sapiens
HLNDIYFVV

SEQ ID NO: 962394 - protein, 9 aa, Homo Sapiens
GEEEKHGKV

SEQ ID NO: 962395 - protein, 9 aa, Homo Sapiens
KKSEGVRIL

SEQ ID NO: 962396 - protein, 9 aa, Homo Sapiens
PSSILSLEF

SEQ ID NO: 962397 - protein, 9 aa, Homo Sapiens
LTLRAGPIT

SEQ ID NO: 962398 - protein, 9 aa, Homo Sapiens
NMLVQTERQ

SEQ ID NO: 962399 - protein, 9 aa, Homo Sapiens
KKYLEPRCL

SEQ ID NO: 962400 - protein, 9 aa, Homo Sapiens
QGEIHVGPS

SEQ ID NO: 962401 - protein, 9 aa, Homo Sapiens
GLKANVEFM

SEQ ID NO: 962402 - protein, 9 aa, Homo Sapiens
KVFSRKSHF

SEQ ID NO: 962403 - protein, 9 aa, Homo Sapiens
NTTADNRII

SEQ ID NO: 962404 - protein, 9 aa, Homo Sapiens
MSSNFLGII

SEQ ID NO: 962405 - protein, 9 aa, Homo Sapiens
IKRSLNPEW

SEQ ID NO: 962406 - protein, 9 aa, Homo Sapiens
CRYDVCFCS

SEQ ID NO: 962407 - protein, 9 aa, Homo Sapiens
YQKLGEEDN

SEQ ID NO: 962408 - protein, 9 aa, Homo Sapiens
DFFHIFHAI

SEQ ID NO: 962409 - protein, 9 aa, Homo Sapiens
PGGFLRGPA

SEQ ID NO: 962410 - protein, 9 aa, Homo Sapiens
VCRTTVSWG

SEQ ID NO: 962411 - protein, 9 aa, Homo Sapiens
SEETVPIPR

SEQ ID NO: 962412 - protein, 9 aa, Homo Sapiens
KSEGVRILS

SEQ ID NO: 962413 - protein, 9 aa, Homo Sapiens
LGPKLGPPG

SEQ ID NO: 962414 - protein, 9 aa, Homo Sapiens
SDNKCKESE

SEQ ID NO: 962415 - protein, 9 aa, Homo Sapiens
HPAKPLHPA

SEQ ID NO: 962416 - protein, 9 aa, Homo Sapiens
AKEKYKNRK

SEQ ID NO: 962417 - protein, 9 aa, Homo Sapiens
TDFLMPLTQ

SEQ ID NO: 962418 - protein, 9 aa, Homo Sapiens
AALSIPLHI

SEQ ID NO: 962419 - protein, 9 aa, Homo Sapiens
EKHQFVHHQ

SEQ ID NO: 962420 - protein, 9 aa, Homo Sapiens
KNGKALQLD

SEQ ID NO: 962421 - protein, 9 aa, Homo Sapiens
EMSNFTMGS

SEQ ID NO: 962422 - protein, 9 aa, Homo Sapiens
KLSFAVQRG

SEQ ID NO: 962423 - protein, 9 aa, Homo Sapiens
KYMLHLLQD

SEQ ID NO: 962424 - protein, 9 aa, Homo Sapiens
DHEQEIENL

SEQ ID NO: 962425 - protein, 9 aa, Homo Sapiens
FDETNLITR

SEQ ID NO: 962426 - protein, 9 aa, Homo Sapiens
KIGIHLNAY

SEQ ID NO: 962427 - protein, 9 aa, Homo Sapiens
SQEVSEKVT

SEQ ID NO: 962428 - protein, 9 aa, Homo Sapiens
PLDCPMEFW

SEQ ID NO: 962429 - protein, 9 aa, Homo Sapiens
RLFRFSFVI

SEQ ID NO: 962430 - protein, 9 aa, Homo Sapiens
KGRLNCIMG

SEQ ID NO: 962431 - protein, 9 aa, Homo Sapiens
SGPITHHKE

SEQ ID NO: 962432 - protein, 9 aa, Homo Sapiens
PTTENRLGA

SEQ ID NO: 962433 - protein, 9 aa, Homo Sapiens
EEDSGGNKG

SEQ ID NO: 962434 - protein, 9 aa, Homo Sapiens
GVSYIEDFA

SEQ ID NO: 962435 - protein, 9 aa, Homo Sapiens
KQPTLAPGQ

SEQ ID NO: 962436 - protein, 9 aa, Homo Sapiens
DGSERLGKQ

SEQ ID NO: 962437 - protein, 9 aa, Homo Sapiens
SAKGQKITP

SEQ ID NO: 962438 - protein, 9 aa, Homo Sapiens
SFKGVKFGK

SEQ ID NO: 962439 - protein, 9 aa, Homo Sapiens
CQDLKSLIQ

SEQ ID NO: 962440 - protein, 9 aa, Homo Sapiens
RKINVSEYT

SEQ ID NO: 962441 - protein, 9 aa, Homo Sapiens
GTPLDGTQV

SEQ ID NO: 962442 - protein, 9 aa, Homo Sapiens
WAPITCSMQ

SEQ ID NO: 962443 - protein, 9 aa, Homo Sapiens
FTMLADIEI

SEQ ID NO: 962444 - protein, 9 aa, Homo Sapiens
IIFSYSQIA

SEQ ID NO: 962445 - protein, 9 aa, Homo Sapiens
APFRPQICS

SEQ ID NO: 962446 - protein, 9 aa, Homo Sapiens
PELQDGRAD

SEQ ID NO: 962447 - protein, 9 aa, Homo Sapiens
REQRITETE

SEQ ID NO: 962448 - protein, 9 aa, Homo Sapiens
LAKKESFGG

SEQ ID NO: 962449 - protein, 9 aa, Homo Sapiens
SGTVGAIGT

SEQ ID NO: 962450 - protein, 9 aa, Homo Sapiens
ATRDAPPKK

SEQ ID NO: 962451 - protein, 9 aa, Homo Sapiens
FVFKHKRCI

SEQ ID NO: 962452 - protein, 9 aa, Homo Sapiens
FYPRVVYLI

SEQ ID NO: 962453 - protein, 9 aa, Homo Sapiens
KISKRIEAT

SEQ ID NO: 962454 - protein, 9 aa, Homo Sapiens
WVVLRFMDV

SEQ ID NO: 962455 - protein, 9 aa, Homo Sapiens
DTWYVIKLG

SEQ ID NO: 962456 - protein, 9 aa, Homo Sapiens
VKEEGNQCV

SEQ ID NO: 962457 - protein, 9 aa, Homo Sapiens
KNLVCTPPY

SEQ ID NO: 962458 - protein, 9 aa, Homo Sapiens
RPTGDAFVF

SEQ ID NO: 962459 - protein, 9 aa, Homo Sapiens
LPIPVFSDN

SEQ ID NO: 962460 - protein, 9 aa, Homo Sapiens
EAHEKDMKL

SEQ ID NO: 962461 - protein, 9 aa, Homo Sapiens
QKKSTGSST

SEQ ID NO: 962462 - protein, 9 aa, Homo Sapiens
HWALSIWEK

SEQ ID NO: 962463 - protein, 9 aa, Homo Sapiens
VIQVQKRHK

SEQ ID NO: 962464 - protein, 9 aa, Homo Sapiens
DDMKVLCPT

SEQ ID NO: 962465 - protein, 9 aa, Homo Sapiens
GKADLSTMS

SEQ ID NO: 962466 - protein, 9 aa, Homo Sapiens
SLTVGAQSR

SEQ ID NO: 962467 - protein, 9 aa, Homo Sapiens
CNKKVDIVK

SEQ ID NO: 962468 - protein, 9 aa, Homo Sapiens
KVNYLKELT

SEQ ID NO: 962469 - protein, 9 aa, Homo Sapiens
SIYSSGEDD

SEQ ID NO: 962470 - protein, 9 aa, Homo Sapiens
GLDFFQPFP

SEQ ID NO: 962471 - protein, 9 aa, Homo Sapiens
YYPLEKELS

SEQ ID NO: 962472 - protein, 9 aa, Homo Sapiens
DLNNCSVMA

SEQ ID NO: 962473 - protein, 9 aa, Homo Sapiens
IKVNGTPLD

SEQ ID NO: 962474 - protein, 9 aa, Homo Sapiens
VINSKIIMV

SEQ ID NO: 962475 - protein, 9 aa, Homo Sapiens
LYAWDNKRE

SEQ ID NO: 962476 - protein, 9 aa, Homo Sapiens
NLALGPRGL

SEQ ID NO: 962477 - protein, 9 aa, Homo Sapiens
ITKSPLTKT

SEQ ID NO: 962478 - protein, 9 aa, Homo Sapiens
TNKAVLSPG

SEQ ID NO: 962479 - protein, 9 aa, Homo Sapiens
MIIYAKFDK

SEQ ID NO: 962480 - protein, 9 aa, Homo Sapiens
FGLCYDYKR

SEQ ID NO: 962481 - protein, 9 aa, Homo Sapiens
RESSPDATG

SEQ ID NO: 962482 - protein, 9 aa, Homo Sapiens
MPGLPQYLQ

SEQ ID NO: 962483 - protein, 9 aa, Homo Sapiens
AQDIVTCTW

SEQ ID NO: 962484 - protein, 9 aa, Homo Sapiens
PQDPAGRDG

SEQ ID NO: 962485 - protein, 9 aa, Homo Sapiens
LKGSFPESL

SEQ ID NO: 962486 - protein, 9 aa, Homo Sapiens
YSFIVVSRM

SEQ ID NO: 962487 - protein, 9 aa, Homo Sapiens
PNRGGRPNE

SEQ ID NO: 962488 - protein, 9 aa, Homo Sapiens
KEEEEASGL

SEQ ID NO: 962489 - protein, 9 aa, Homo Sapiens
SGLFEFCSR

SEQ ID NO: 962490 - protein, 9 aa, Homo Sapiens
ISVFFYHVK

SEQ ID NO: 962491 - protein, 9 aa, Homo Sapiens
ESLYQKICI

SEQ ID NO: 962492 - protein, 9 aa, Homo Sapiens
ERSRARCML

SEQ ID NO: 962493 - protein, 9 aa, Homo Sapiens
AEPSIDVIL

SEQ ID NO: 962494 - protein, 9 aa, Homo Sapiens
WQERLTSFI

SEQ ID NO: 962495 - protein, 9 aa, Homo Sapiens
LPPEACPRN

SEQ ID NO: 962496 - protein, 9 aa, Homo Sapiens
QFVHHQELK

SEQ ID NO: 962497 - protein, 9 aa, Homo Sapiens
YPLPKSFSS

SEQ ID NO: 962498 - protein, 9 aa, Homo Sapiens
VAARGLFLL

SEQ ID NO: 962499 - protein, 9 aa, Homo Sapiens
VLPDTLHSL

SEQ ID NO: 962500 - protein, 9 aa, Homo Sapiens
PARPCFVEE

SEQ ID NO: 962501 - protein, 9 aa, Homo Sapiens
ERLGKQNFH

SEQ ID NO: 962502 - protein, 9 aa, Homo Sapiens
SGRFSSLLQ

SEQ ID NO: 962503 - protein, 9 aa, Homo Sapiens
LVTFVARNC

SEQ ID NO: 962504 - protein, 9 aa, Homo Sapiens
QPITAAAPE

SEQ ID NO: 962505 - protein, 9 aa, Homo Sapiens
GTYVSSFKD

SEQ ID NO: 962506 - protein, 9 aa, Homo Sapiens
MGLEGLALK

SEQ ID NO: 962507 - protein, 9 aa, Homo Sapiens
LSGHPLRDP

SEQ ID NO: 962508 - protein, 9 aa, Homo Sapiens
LFMPNLVPP

SEQ ID NO: 962509 - protein, 9 aa, Homo Sapiens
QAKITSVQL

SEQ ID NO: 962510 - protein, 9 aa, Homo Sapiens
LFGYATFFW

SEQ ID NO: 962511 - protein, 9 aa, Homo Sapiens
VELPALFRE

SEQ ID NO: 962512 - protein, 9 aa, Homo Sapiens
ELMIFARRS

SEQ ID NO: 962513 - protein, 9 aa, Homo Sapiens
GSRPVQFSY

SEQ ID NO: 962514 - protein, 9 aa, Homo Sapiens
EFLFSTSPL

SEQ ID NO: 962515 - protein, 9 aa, Homo Sapiens
LCLKLATRS

SEQ ID NO: 962516 - protein, 9 aa, Homo Sapiens
SDQETMALP

SEQ ID NO: 962517 - protein, 9 aa, Homo Sapiens
KAVQQPDRL

SEQ ID NO: 962518 - protein, 9 aa, Homo Sapiens
VEAGEEGIV

SEQ ID NO: 962519 - protein, 9 aa, Homo Sapiens
PEGFVFKHK

SEQ ID NO: 962520 - protein, 9 aa, Homo Sapiens
RPYSKLNYE

SEQ ID NO: 962521 - protein, 9 aa, Homo Sapiens
RDIKPAASP

SEQ ID NO: 962522 - protein, 9 aa, Homo Sapiens
TLDSGPPLE

SEQ ID NO: 962523 - protein, 9 aa, Homo Sapiens
ARNEARRDL

SEQ ID NO: 962524 - protein, 9 aa, Homo Sapiens
VQCHYRLQN

SEQ ID NO: 962525 - protein, 9 aa, Homo Sapiens
AKLDRGEGP

SEQ ID NO: 962526 - protein, 9 aa, Homo Sapiens
GHGAREAER

SEQ ID NO: 962527 - protein, 9 aa, Homo Sapiens
PRGPTGIEE

SEQ ID NO: 962528 - protein, 9 aa, Homo Sapiens
HCENNDKAS

SEQ ID NO: 962529 - protein, 9 aa, Homo Sapiens
GYPLPKSFS

SEQ ID NO: 962530 - protein, 9 aa, Homo Sapiens
VPMQVLLEG

SEQ ID NO: 962531 - protein, 9 aa, Homo Sapiens
VEEWYKSKV

SEQ ID NO: 962532 - protein, 9 aa, Homo Sapiens
SGSEESTPF

SEQ ID NO: 962533 - protein, 9 aa, Homo Sapiens
GSQAESSER

SEQ ID NO: 962534 - protein, 9 aa, Homo Sapiens
KRPIGNRIL

SEQ ID NO: 962535 - protein, 9 aa, Homo Sapiens
CLADIFCIY

SEQ ID NO: 962536 - protein, 9 aa, Homo Sapiens
LQLSNGNKT

SEQ ID NO: 962537 - protein, 9 aa, Homo Sapiens
YLLRLNAIF

SEQ ID NO: 962538 - protein, 9 aa, Homo Sapiens
LRGVHVPSP

SEQ ID NO: 962539 - protein, 9 aa, Homo Sapiens
CWKAYIWSS

SEQ ID NO: 962540 - protein, 9 aa, Homo Sapiens
DCRNVGIRE

SEQ ID NO: 962541 - protein, 9 aa, Homo Sapiens
AGEALSESQ

SEQ ID NO: 962542 - protein, 9 aa, Homo Sapiens
TRARLLFRV

SEQ ID NO: 962543 - protein, 9 aa, Homo Sapiens
RERVRIPAK

SEQ ID NO: 962544 - protein, 9 aa, Homo Sapiens
RDSSIVPDG

SEQ ID NO: 962545 - protein, 9 aa, Homo Sapiens
SGDLSQNKK

SEQ ID NO: 962546 - protein, 9 aa, Homo Sapiens
VLTITVPEP

SEQ ID NO: 962547 - protein, 9 aa, Homo Sapiens
TITDCFSAM

SEQ ID NO: 962548 - protein, 9 aa, Homo Sapiens
GQLTTNPLL

SEQ ID NO: 962549 - protein, 9 aa, Homo Sapiens
CSPNTSVFF

SEQ ID NO: 962550 - protein, 9 aa, Homo Sapiens
NYANICFRF

SEQ ID NO: 962551 - protein, 9 aa, Homo Sapiens
CFYFFFLGK

SEQ ID NO: 962552 - protein, 9 aa, Homo Sapiens
LSVSVSKNV

SEQ ID NO: 962553 - protein, 9 aa, Homo Sapiens
VLMLLILFS

SEQ ID NO: 962554 - protein, 9 aa, Homo Sapiens
PLDPLSGHP

SEQ ID NO: 962555 - protein, 9 aa, Homo Sapiens
DHPCLQVPK

SEQ ID NO: 962556 - protein, 9 aa, Homo Sapiens
TEEVANKVL

SEQ ID NO: 962557 - protein, 9 aa, Homo Sapiens
KTSTTLRTT

SEQ ID NO: 962558 - protein, 9 aa, Homo Sapiens
YPEGPIGII

SEQ ID NO: 962559 - protein, 9 aa, Homo Sapiens
QSKACDTKV

SEQ ID NO: 962560 - protein, 9 aa, Homo Sapiens
VIKLGNTKE

SEQ ID NO: 962561 - protein, 9 aa, Homo Sapiens
LLLGYMKSR

SEQ ID NO: 962562 - protein, 9 aa, Homo Sapiens
YRKLALKYY

SEQ ID NO: 962563 - protein, 9 aa, Homo Sapiens
VPLVAGRMV

SEQ ID NO: 962564 - protein, 9 aa, Homo Sapiens
ERREQGTGR

SEQ ID NO: 962565 - protein, 9 aa, Homo Sapiens
SLVSLASFE

SEQ ID NO: 962566 - protein, 9 aa, Homo Sapiens
WGRAKSRSL

SEQ ID NO: 962567 - protein, 9 aa, Homo Sapiens
ICSHGLCVD

SEQ ID NO: 962568 - protein, 9 aa, Homo Sapiens
SDRGKTPDP

SEQ ID NO: 962569 - protein, 9 aa, Homo Sapiens
FEVVENNFT

SEQ ID NO: 962570 - protein, 9 aa, Homo Sapiens
FLVKKAERF

SEQ ID NO: 962571 - protein, 9 aa, Homo Sapiens
LYFHGKRVP

SEQ ID NO: 962572 - protein, 9 aa, Homo Sapiens
VQSFLGSAS

SEQ ID NO: 962573 - protein, 9 aa, Homo Sapiens
DTLNPPAVP

SEQ ID NO: 962574 - protein, 9 aa, Homo Sapiens
LSMRNAMFV

SEQ ID NO: 962575 - protein, 9 aa, Homo Sapiens
MVTIRPEPK

SEQ ID NO: 962576 - protein, 9 aa, Homo Sapiens
QSPASPSPL

SEQ ID NO: 962577 - protein, 9 aa, Homo Sapiens
ADSVAKLGE

SEQ ID NO: 962578 - protein, 9 aa, Homo Sapiens
KKRISYSKG

SEQ ID NO: 962579 - protein, 9 aa, Homo Sapiens
VNDDRLEEL

SEQ ID NO: 962580 - protein, 9 aa, Homo Sapiens
FLKDLIQVV

SEQ ID NO: 962581 - protein, 9 aa, Homo Sapiens
ILESLFLIA

SEQ ID NO: 962582 - protein, 9 aa, Homo Sapiens
KFLTSRLEM

SEQ ID NO: 962583 - protein, 9 aa, Homo Sapiens
APLQPPPIL

SEQ ID NO: 962584 - protein, 9 aa, Homo Sapiens
PVVFYTTAF

SEQ ID NO: 962585 - protein, 9 aa, Homo Sapiens
RFLLENPLK

SEQ ID NO: 962586 - protein, 9 aa, Homo Sapiens
GKLVGVVTT

SEQ ID NO: 962587 - protein, 9 aa, Homo Sapiens
YALCNRTFK

SEQ ID NO: 962588 - protein, 9 aa, Homo Sapiens
KVEGLLYKH

SEQ ID NO: 962589 - protein, 9 aa, Homo Sapiens
QEVGGQDHG

SEQ ID NO: 962590 - protein, 9 aa, Homo Sapiens
DPCKNIFFK

SEQ ID NO: 962591 - protein, 9 aa, Homo Sapiens
NNQIMPKTG

SEQ ID NO: 962592 - protein, 9 aa, Homo Sapiens
LTYLTIFSA

SEQ ID NO: 962593 - protein, 9 aa, Homo Sapiens
NGKALQLDK

SEQ ID NO: 962594 - protein, 9 aa, Homo Sapiens
GILWQITVN

SEQ ID NO: 962595 - protein, 9 aa, Homo Sapiens
AGRYTCVAK

SEQ ID NO: 962596 - protein, 9 aa, Homo Sapiens
FSLVSLASF

SEQ ID NO: 962597 - protein, 9 aa, Homo Sapiens
AIGANPFYC

SEQ ID NO: 962598 - protein, 9 aa, Homo Sapiens
YPNEKITHY

SEQ ID NO: 962599 - protein, 9 aa, Homo Sapiens
CGHRFRQSL

SEQ ID NO: 962600 - protein, 9 aa, Homo Sapiens
TLVEHILLE

SEQ ID NO: 962601 - protein, 9 aa, Homo Sapiens
RPGGTPEAP

SEQ ID NO: 962602 - protein, 9 aa, Homo Sapiens
EDPQARLLE

SEQ ID NO: 962603 - protein, 9 aa, Homo Sapiens
SAEPDLSPR

SEQ ID NO: 962604 - protein, 9 aa, Homo Sapiens
TILHLVVAG

SEQ ID NO: 962605 - protein, 9 aa, Homo Sapiens
AQKKKKLAK

SEQ ID NO: 962606 - protein, 9 aa, Homo Sapiens
ADTVTKVSL

SEQ ID NO: 962607 - protein, 9 aa, Homo Sapiens
TTGLKANVE

SEQ ID NO: 962608 - protein, 9 aa, Homo Sapiens
EKQSDTLNP

SEQ ID NO: 962609 - protein, 9 aa, Homo Sapiens
IGYGEAQCA

SEQ ID NO: 962610 - protein, 9 aa, Homo Sapiens
APTVETSDL

SEQ ID NO: 962611 - protein, 9 aa, Homo Sapiens
TGAYDSFMS

SEQ ID NO: 962612 - protein, 9 aa, Homo Sapiens
DDFYIFGSI

SEQ ID NO: 962613 - protein, 9 aa, Homo Sapiens
SVITPNACL

SEQ ID NO: 962614 - protein, 9 aa, Homo Sapiens
LSVPAYPSI

SEQ ID NO: 962615 - protein, 9 aa, Homo Sapiens
EVGKRYREQ

SEQ ID NO: 962616 - protein, 9 aa, Homo Sapiens
ERGAPRIPG

SEQ ID NO: 962617 - protein, 9 aa, Homo Sapiens
DLKNTLRTM

SEQ ID NO: 962618 - protein, 9 aa, Homo Sapiens
RGQRPGSLE

SEQ ID NO: 962619 - protein, 9 aa, Homo Sapiens
TAMSTTPGT

SEQ ID NO: 962620 - protein, 9 aa, Homo Sapiens
GNYFTYYFI

SEQ ID NO: 962621 - protein, 9 aa, Homo Sapiens
GKAQPGSLW

SEQ ID NO: 962622 - protein, 9 aa, Homo Sapiens
EAGEVEKRV

SEQ ID NO: 962623 - protein, 9 aa, Homo Sapiens
DYKRRVNCC

SEQ ID NO: 962624 - protein, 9 aa, Homo Sapiens
GHTDSNTSL

SEQ ID NO: 962625 - protein, 9 aa, Homo Sapiens
VKIFRYGYS

SEQ ID NO: 962626 - protein, 9 aa, Homo Sapiens
KSSSLKVSG

SEQ ID NO: 962627 - protein, 9 aa, Homo Sapiens
GKLNLDVEK

SEQ ID NO: 962628 - protein, 9 aa, Homo Sapiens
LINKELYAG

SEQ ID NO: 962629 - protein, 9 aa, Homo Sapiens
ATENSILGR

SEQ ID NO: 962630 - protein, 9 aa, Homo Sapiens
YKNRKPLMP

SEQ ID NO: 962631 - protein, 9 aa, Homo Sapiens
VLPSQLTTM

SEQ ID NO: 962632 - protein, 9 aa, Homo Sapiens
LIYDNKGAD

SEQ ID NO: 962633 - protein, 9 aa, Homo Sapiens
SSMRSGVSD

SEQ ID NO: 962634 - protein, 9 aa, Homo Sapiens
LKERDWLPG

SEQ ID NO: 962635 - protein, 9 aa, Homo Sapiens
PIKEKLDAL

SEQ ID NO: 962636 - protein, 9 aa, Homo Sapiens
WIKDYSSGG

SEQ ID NO: 962637 - protein, 9 aa, Homo Sapiens
DTYNGLVDG

SEQ ID NO: 962638 - protein, 9 aa, Homo Sapiens
QWRVSEGRW

SEQ ID NO: 962639 - protein, 9 aa, Homo Sapiens
EFGEVCSGC

SEQ ID NO: 962640 - protein, 9 aa, Homo Sapiens
DSGTNSKLS

SEQ ID NO: 962641 - protein, 9 aa, Homo Sapiens
SNPSPFQDT

SEQ ID NO: 962642 - protein, 9 aa, Homo Sapiens
NFSQAEKPK

SEQ ID NO: 962643 - protein, 9 aa, Homo Sapiens
AHNARKKLA

SEQ ID NO: 962644 - protein, 9 aa, Homo Sapiens
DLGDCGVLK

SEQ ID NO: 962645 - protein, 9 aa, Homo Sapiens
QKVVKCLIG

SEQ ID NO: 962646 - protein, 9 aa, Homo Sapiens
AAYALTFSG

SEQ ID NO: 962647 - protein, 9 aa, Homo Sapiens
AAPLCTHAG

SEQ ID NO: 962648 - protein, 9 aa, Homo Sapiens
ISKLGDNTR

SEQ ID NO: 962649 - protein, 9 aa, Homo Sapiens
PITGLALIS

SEQ ID NO: 962650 - protein, 9 aa, Homo Sapiens
REHLASFIR

SEQ ID NO: 962651 - protein, 9 aa, Homo Sapiens
EKVDQKEEE

SEQ ID NO: 962652 - protein, 9 aa, Homo Sapiens
LKDSEFEFL

SEQ ID NO: 962653 - protein, 9 aa, Homo Sapiens
SILESANRL

SEQ ID NO: 962654 - protein, 9 aa, Homo Sapiens
TSFLENHDQ

SEQ ID NO: 962655 - protein, 9 aa, Homo Sapiens
LLLERLHAA

SEQ ID NO: 962656 - protein, 9 aa, Homo Sapiens
LGKKWRIQR

SEQ ID NO: 962657 - protein, 9 aa, Homo Sapiens
RLEELVSAL

SEQ ID NO: 962658 - protein, 9 aa, Homo Sapiens
RQSLHLSKH

SEQ ID NO: 962659 - protein, 9 aa, Homo Sapiens
LKSFHNSSR

SEQ ID NO: 962660 - protein, 9 aa, Homo Sapiens
SMRNAMFVK

SEQ ID NO: 962661 - protein, 9 aa, Homo Sapiens
SRQSPASPS

SEQ ID NO: 962662 - protein, 9 aa, Homo Sapiens
YATFFWMYL

SEQ ID NO: 962663 - protein, 9 aa, Homo Sapiens
IHFYSGTGV

SEQ ID NO: 962664 - protein, 9 aa, Homo Sapiens
KFPVPLECP

SEQ ID NO: 962665 - protein, 9 aa, Homo Sapiens
EVFNGLKKH

SEQ ID NO: 962666 - protein, 9 aa, Homo Sapiens
TTAMSTTPG

SEQ ID NO: 962667 - protein, 9 aa, Homo Sapiens
NAIQAWYKL

SEQ ID NO: 962668 - protein, 9 aa, Homo Sapiens
NLHSACVQL

SEQ ID NO: 962669 - protein, 9 aa, Homo Sapiens
EDSGGNKGQ

SEQ ID NO: 962670 - protein, 9 aa, Homo Sapiens
PFYPRVVYL

SEQ ID NO: 962671 - protein, 9 aa, Homo Sapiens
VGIWGCLQE

SEQ ID NO: 962672 - protein, 9 aa, Homo Sapiens
DQQSQEVSE

SEQ ID NO: 962673 - protein, 9 aa, Homo Sapiens
FAACNYPLE

SEQ ID NO: 962674 - protein, 9 aa, Homo Sapiens
EKFVHPKMR

SEQ ID NO: 962675 - protein, 9 aa, Homo Sapiens
LDIFPGAAG

SEQ ID NO: 962676 - protein, 9 aa, Homo Sapiens
VIPETKEDV

SEQ ID NO: 962677 - protein, 9 aa, Homo Sapiens
SLRVHGLYW

SEQ ID NO: 962678 - protein, 9 aa, Homo Sapiens
FLDMESTGC

SEQ ID NO: 962679 - protein, 9 aa, Homo Sapiens
IDSVTSLQH

SEQ ID NO: 962680 - protein, 9 aa, Homo Sapiens
NVEEAQRRL

SEQ ID NO: 962681 - protein, 9 aa, Homo Sapiens
LKANVEFMD

SEQ ID NO: 962682 - protein, 9 aa, Homo Sapiens
PASPSPLGG

SEQ ID NO: 962683 - protein, 9 aa, Homo Sapiens
GGGGAGVSP

SEQ ID NO: 962684 - protein, 9 aa, Homo Sapiens
MKDIYYKTP

SEQ ID NO: 962685 - protein, 9 aa, Homo Sapiens
PGRRSGQQT

SEQ ID NO: 962686 - protein, 9 aa, Homo Sapiens
FSPATGVWE

SEQ ID NO: 962687 - protein, 9 aa, Homo Sapiens
QKLSLENDN

SEQ ID NO: 962688 - protein, 9 aa, Homo Sapiens
RDVAPLPQQ

SEQ ID NO: 962689 - protein, 9 aa, Homo Sapiens
ALSCNKNDA

SEQ ID NO: 962690 - protein, 9 aa, Homo Sapiens
CTKVFHDGC

SEQ ID NO: 962691 - protein, 9 aa, Homo Sapiens
SLGADGCDT

SEQ ID NO: 962692 - protein, 9 aa, Homo Sapiens
RREQGTGRK

SEQ ID NO: 962693 - protein, 9 aa, Homo Sapiens
SEGVRILSW

SEQ ID NO: 962694 - protein, 9 aa, Homo Sapiens
SKGEPEKGE

SEQ ID NO: 962695 - protein, 9 aa, Homo Sapiens
LACTDTFMI

SEQ ID NO: 962696 - protein, 9 aa, Homo Sapiens
FTRKEGSLK

SEQ ID NO: 962697 - protein, 9 aa, Homo Sapiens
SKSDDFYIF

SEQ ID NO: 962698 - protein, 9 aa, Homo Sapiens
FRLIYRGAS

SEQ ID NO: 962699 - protein, 9 aa, Homo Sapiens
CLIKHQKIY

SEQ ID NO: 962700 - protein, 9 aa, Homo Sapiens
TVVSLTQEK

SEQ ID NO: 962701 - protein, 9 aa, Homo Sapiens
RQCKQFAKN

SEQ ID NO: 962702 - protein, 9 aa, Homo Sapiens
DENLLRKHT

SEQ ID NO: 962703 - protein, 9 aa, Homo Sapiens
NTSTTRSVL

SEQ ID NO: 962704 - protein, 9 aa, Homo Sapiens
PRLFMPNLV

SEQ ID NO: 962705 - protein, 9 aa, Homo Sapiens
LQKFAACNY

SEQ ID NO: 962706 - protein, 9 aa, Homo Sapiens
PTLVEHILL

SEQ ID NO: 962707 - protein, 9 aa, Homo Sapiens
LALYGRQGQ

SEQ ID NO: 962708 - protein, 9 aa, Homo Sapiens
CNLKNIPNL

SEQ ID NO: 962709 - protein, 9 aa, Homo Sapiens
PAENRGRKP

SEQ ID NO: 962710 - protein, 9 aa, Homo Sapiens
KENAKDSGR

SEQ ID NO: 962711 - protein, 9 aa, Homo Sapiens
CNSPRSDTP

SEQ ID NO: 962712 - protein, 9 aa, Homo Sapiens
RHTRWPDVA

SEQ ID NO: 962713 - protein, 9 aa, Homo Sapiens
LPVPSLPSD

SEQ ID NO: 962714 - protein, 9 aa, Homo Sapiens
DTKVENNTI

SEQ ID NO: 962715 - protein, 9 aa, Homo Sapiens
SLPLGFFGE

SEQ ID NO: 962716 - protein, 9 aa, Homo Sapiens
LWVIQVQKR

SEQ ID NO: 962717 - protein, 9 aa, Homo Sapiens
SLRNKEASP

SEQ ID NO: 962718 - protein, 9 aa, Homo Sapiens
KFLYCEATL

SEQ ID NO: 962719 - protein, 9 aa, Homo Sapiens
QGQAKITSV

SEQ ID NO: 962720 - protein, 9 aa, Homo Sapiens
LSCNKNDAE

SEQ ID NO: 962721 - protein, 9 aa, Homo Sapiens
VTYDHPSKS

SEQ ID NO: 962722 - protein, 9 aa, Homo Sapiens
LVEAILVFT

SEQ ID NO: 962723 - protein, 9 aa, Homo Sapiens
YPLEKELSG

SEQ ID NO: 962724 - protein, 9 aa, Homo Sapiens
TCGNYVMEG

SEQ ID NO: 962725 - protein, 9 aa, Homo Sapiens
VFWNTHVRK

SEQ ID NO: 962726 - protein, 9 aa, Homo Sapiens
ALFWTVAMM

SEQ ID NO: 962727 - protein, 9 aa, Homo Sapiens
CFGGRTWCK

SEQ ID NO: 962728 - protein, 9 aa, Homo Sapiens
SEKEMTDST

SEQ ID NO: 962729 - protein, 9 aa, Homo Sapiens
ALALSPKES

SEQ ID NO: 962730 - protein, 9 aa, Homo Sapiens
GEEKQTCEI

SEQ ID NO: 962731 - protein, 9 aa, Homo Sapiens
LFFVAAAFF

SEQ ID NO: 962732 - protein, 9 aa, Homo Sapiens
GSGLFEVGS

SEQ ID NO: 962733 - protein, 9 aa, Homo Sapiens
TDTFMILIE

SEQ ID NO: 962734 - protein, 9 aa, Homo Sapiens
NPAYPAILG

SEQ ID NO: 962735 - protein, 9 aa, Homo Sapiens
NLTAQNYVI

SEQ ID NO: 962736 - protein, 9 aa, Homo Sapiens
DGVFTTFSD

SEQ ID NO: 962737 - protein, 9 aa, Homo Sapiens
KVEAYQWRV

SEQ ID NO: 962738 - protein, 9 aa, Homo Sapiens
YRKNLGAPK

SEQ ID NO: 962739 - protein, 9 aa, Homo Sapiens
PSGTVGAIG

SEQ ID NO: 962740 - protein, 9 aa, Homo Sapiens
SVIWEITLP

SEQ ID NO: 962741 - protein, 9 aa, Homo Sapiens
VPRCTVKSC

SEQ ID NO: 962742 - protein, 9 aa, Homo Sapiens
LEYSLKKIR

SEQ ID NO: 962743 - protein, 9 aa, Homo Sapiens
RNQALNEED

SEQ ID NO: 962744 - protein, 9 aa, Homo Sapiens
PQKAFLAEK

SEQ ID NO: 962745 - protein, 9 aa, Homo Sapiens
RRPDFCHAF

SEQ ID NO: 962746 - protein, 9 aa, Homo Sapiens
HCGTGLGSQ

SEQ ID NO: 962747 - protein, 9 aa, Homo Sapiens
GQAENEAGR

SEQ ID NO: 962748 - protein, 9 aa, Homo Sapiens
DNVRCSGHE

SEQ ID NO: 962749 - protein, 9 aa, Homo Sapiens
CKPGYQREG

SEQ ID NO: 962750 - protein, 9 aa, Homo Sapiens
EKFFSRIEC

SEQ ID NO: 962751 - protein, 9 aa, Homo Sapiens
SAAGFPPAV

SEQ ID NO: 962752 - protein, 9 aa, Homo Sapiens
KVDQKEEEV

SEQ ID NO: 962753 - protein, 9 aa, Homo Sapiens
VLRDFAQLG

SEQ ID NO: 962754 - protein, 9 aa, Homo Sapiens
SWQHISPSA

SEQ ID NO: 962755 - protein, 9 aa, Homo Sapiens
PHPCEGQKL

SEQ ID NO: 962756 - protein, 9 aa, Homo Sapiens
KPAPGEWSV

SEQ ID NO: 962757 - protein, 9 aa, Homo Sapiens
KKKEATCPR

SEQ ID NO: 962758 - protein, 9 aa, Homo Sapiens
KEGKENEDK

SEQ ID NO: 962759 - protein, 9 aa, Homo Sapiens
SMLSSFLLP

SEQ ID NO: 962760 - protein, 9 aa, Homo Sapiens
YFLKDLIQV

SEQ ID NO: 962761 - protein, 9 aa, Homo Sapiens
RNEGHDLYV

SEQ ID NO: 962762 - protein, 9 aa, Homo Sapiens
AGSREASPL

SEQ ID NO: 962763 - protein, 9 aa, Homo Sapiens
STMSAERDL

SEQ ID NO: 962764 - protein, 9 aa, Homo Sapiens
RLSSLFAVV

SEQ ID NO: 962765 - protein, 9 aa, Homo Sapiens
DSSLLTPHH

SEQ ID NO: 962766 - protein, 9 aa, Homo Sapiens
TYYFIQEGS

SEQ ID NO: 962767 - protein, 9 aa, Homo Sapiens
FVRRMVNLH

SEQ ID NO: 962768 - protein, 9 aa, Homo Sapiens
SRTTERRSS

SEQ ID NO: 962769 - protein, 9 aa, Homo Sapiens
KNIFFKAFS

SEQ ID NO: 962770 - protein, 9 aa, Homo Sapiens
EEVCGDQIK

SEQ ID NO: 962771 - protein, 9 aa, Homo Sapiens
REGRQCEDI

SEQ ID NO: 962772 - protein, 9 aa, Homo Sapiens
STLEVTAMA

SEQ ID NO: 962773 - protein, 9 aa, Homo Sapiens
IWADIPASK

SEQ ID NO: 962774 - protein, 9 aa, Homo Sapiens
AEEFPLPQK

SEQ ID NO: 962775 - protein, 9 aa, Homo Sapiens
REKEVFIFL

SEQ ID NO: 962776 - protein, 9 aa, Homo Sapiens
NQTIATFGA

SEQ ID NO: 962777 - protein, 9 aa, Homo Sapiens
HSPQIIFFF

SEQ ID NO: 962778 - protein, 9 aa, Homo Sapiens
KSPDYCTCN

SEQ ID NO: 962779 - protein, 9 aa, Homo Sapiens
EITVTFTCL

SEQ ID NO: 962780 - protein, 9 aa, Homo Sapiens
PRGLSPASS

SEQ ID NO: 962781 - protein, 9 aa, Homo Sapiens
RTFGYFLKD

SEQ ID NO: 962782 - protein, 9 aa, Homo Sapiens
QQLEESKKQ

SEQ ID NO: 962783 - protein, 9 aa, Homo Sapiens
PLEFEFAVE

SEQ ID NO: 962784 - protein, 9 aa, Homo Sapiens
TPPTAANYS

SEQ ID NO: 962785 - protein, 9 aa, Homo Sapiens
SLSVPFVSK

SEQ ID NO: 962786 - protein, 9 aa, Homo Sapiens
GDADVSMPK

SEQ ID NO: 962787 - protein, 9 aa, Homo Sapiens
QSSRAVWWA

SEQ ID NO: 962788 - protein, 9 aa, Homo Sapiens
ESLFLIASV

SEQ ID NO: 962789 - protein, 9 aa, Homo Sapiens
TGPDFVPGA

SEQ ID NO: 962790 - protein, 9 aa, Homo Sapiens
APAASSGSE

SEQ ID NO: 962791 - protein, 9 aa, Homo Sapiens
FQPFFEMIH

SEQ ID NO: 962792 - protein, 9 aa, Homo Sapiens
IAEINRIIQ

SEQ ID NO: 962793 - protein, 9 aa, Homo Sapiens
ARNQVFSQT

SEQ ID NO: 962794 - protein, 9 aa, Homo Sapiens
KACDTKVLI

SEQ ID NO: 962795 - protein, 9 aa, Homo Sapiens
FSCPTLAKT

SEQ ID NO: 962796 - protein, 9 aa, Homo Sapiens
KHSSPRWRE

SEQ ID NO: 962797 - protein, 9 aa, Homo Sapiens
TPMLALTTV

SEQ ID NO: 962798 - protein, 9 aa, Homo Sapiens
LVEIKGEDR

SEQ ID NO: 962799 - protein, 9 aa, Homo Sapiens
ALVLLYRLL

SEQ ID NO: 962800 - protein, 9 aa, Homo Sapiens
KNILGEAGL

SEQ ID NO: 962801 - protein, 9 aa, Homo Sapiens
GQAKITSVQ

SEQ ID NO: 962802 - protein, 9 aa, Homo Sapiens
QISVLCDAC

SEQ ID NO: 962803 - protein, 9 aa, Homo Sapiens
KMQTEEGCD

SEQ ID NO: 962804 - protein, 9 aa, Homo Sapiens
FLGLCLEDL

SEQ ID NO: 962805 - protein, 9 aa, Homo Sapiens
KGADATGSP

SEQ ID NO: 962806 - protein, 9 aa, Homo Sapiens
PSFPLQHPA

SEQ ID NO: 962807 - protein, 9 aa, Homo Sapiens
AIQNPRLFA

SEQ ID NO: 962808 - protein, 9 aa, Homo Sapiens
HTGPRPFPC

SEQ ID NO: 962809 - protein, 9 aa, Homo Sapiens
PKLDEHLVE

SEQ ID NO: 962810 - protein, 9 aa, Homo Sapiens
AFKTDSFFS

SEQ ID NO: 962811 - protein, 9 aa, Homo Sapiens
AYQTKFPVP

SEQ ID NO: 962812 - protein, 9 aa, Homo Sapiens
VSLLTLFHY

SEQ ID NO: 962813 - protein, 9 aa, Homo Sapiens
LYGLGSPAM

SEQ ID NO: 962814 - protein, 9 aa, Homo Sapiens
NSWWVGLPE

SEQ ID NO: 962815 - protein, 9 aa, Homo Sapiens
SRVALACPH

SEQ ID NO: 962816 - protein, 9 aa, Homo Sapiens
PLGFFGEGD

SEQ ID NO: 962817 - protein, 9 aa, Homo Sapiens
PHTHFYTIS

SEQ ID NO: 962818 - protein, 9 aa, Homo Sapiens
KKEQAERFD

SEQ ID NO: 962819 - protein, 9 aa, Homo Sapiens
NQIEQFLVK

SEQ ID NO: 962820 - protein, 9 aa, Homo Sapiens
PGKHVYRVL

SEQ ID NO: 962821 - protein, 9 aa, Homo Sapiens
GVSHSQDTL

SEQ ID NO: 962822 - protein, 9 aa, Homo Sapiens
VPGGDRSSS

SEQ ID NO: 962823 - protein, 9 aa, Homo Sapiens
ARLLLERLH

SEQ ID NO: 962824 - protein, 9 aa, Homo Sapiens
PITAAAPET

SEQ ID NO: 962825 - protein, 9 aa, Homo Sapiens
PPAQKKSTG

SEQ ID NO: 962826 - protein, 9 aa, Homo Sapiens
GREFKGEEE

SEQ ID NO: 962827 - protein, 9 aa, Homo Sapiens
GYRIEQPRN

SEQ ID NO: 962828 - protein, 9 aa, Homo Sapiens
PAGSSPDSK

SEQ ID NO: 962829 - protein, 9 aa, Homo Sapiens
KKEGLLTNK

SEQ ID NO: 962830 - protein, 9 aa, Homo Sapiens
PALLLNQPH

SEQ ID NO: 962831 - protein, 9 aa, Homo Sapiens
RDSPAPRLQ

SEQ ID NO: 962832 - protein, 9 aa, Homo Sapiens
AQKRTMLER

SEQ ID NO: 962833 - protein, 9 aa, Homo Sapiens
STAPGPPER

SEQ ID NO: 962834 - protein, 9 aa, Homo Sapiens
ILTQDFLQM

SEQ ID NO: 962835 - protein, 9 aa, Homo Sapiens
FKGEEEYLE

SEQ ID NO: 962836 - protein, 9 aa, Homo Sapiens
KITNCASVN

SEQ ID NO: 962837 - protein, 9 aa, Homo Sapiens
RSDHLTIHI

SEQ ID NO: 962838 - protein, 9 aa, Homo Sapiens
EPGVFVSLV

SEQ ID NO: 962839 - protein, 9 aa, Homo Sapiens
SGLFEVGSE

SEQ ID NO: 962840 - protein, 9 aa, Homo Sapiens
QDHGEAVQP

SEQ ID NO: 962841 - protein, 9 aa, Homo Sapiens
TKSPTSWGC

SEQ ID NO: 962842 - protein, 9 aa, Homo Sapiens
EKHFNLCLK

SEQ ID NO: 962843 - protein, 9 aa, Homo Sapiens
GGIVGQLFG

SEQ ID NO: 962844 - protein, 9 aa, Homo Sapiens
IAAGVFMPV

SEQ ID NO: 962845 - protein, 9 aa, Homo Sapiens
ILHSHGSST

SEQ ID NO: 962846 - protein, 9 aa, Homo Sapiens
LIRAPLPED

SEQ ID NO: 962847 - protein, 9 aa, Homo Sapiens
DRAVFSGGG

SEQ ID NO: 962848 - protein, 9 aa, Homo Sapiens
RAPPAFSRA

SEQ ID NO: 962849 - protein, 9 aa, Homo Sapiens
VRREAKRQA

SEQ ID NO: 962850 - protein, 9 aa, Homo Sapiens
GENRGDGEP

SEQ ID NO: 962851 - protein, 9 aa, Homo Sapiens
DRKLLKCRM

SEQ ID NO: 962852 - protein, 9 aa, Homo Sapiens
RVSKVYWTK

SEQ ID NO: 962853 - protein, 9 aa, Homo Sapiens
RDEKKDPDP

SEQ ID NO: 962854 - protein, 9 aa, Homo Sapiens
SRLTVQMKN

SEQ ID NO: 962855 - protein, 9 aa, Homo Sapiens
KKWIPTKFF

SEQ ID NO: 962856 - protein, 9 aa, Homo Sapiens
EKTANEKTT

SEQ ID NO: 962857 - protein, 9 aa, Homo Sapiens
SAHGVQRDE

SEQ ID NO: 962858 - protein, 9 aa, Homo Sapiens
RVCTKVFHD

SEQ ID NO: 962859 - protein, 9 aa, Homo Sapiens
IYFVVGIPV

SEQ ID NO: 962860 - protein, 9 aa, Homo Sapiens
HRSEPQHLK

SEQ ID NO: 962861 - protein, 9 aa, Homo Sapiens
SRMNSPKRA

SEQ ID NO: 962862 - protein, 9 aa, Homo Sapiens
FLFYARRSE

SEQ ID NO: 962863 - protein, 9 aa, Homo Sapiens
LENALSGTL

SEQ ID NO: 962864 - protein, 9 aa, Homo Sapiens
LGMCNLKNI

SEQ ID NO: 962865 - protein, 9 aa, Homo Sapiens
SAARPYSKL

SEQ ID NO: 962866 - protein, 9 aa, Homo Sapiens
LNKNIEKGL

SEQ ID NO: 962867 - protein, 9 aa, Homo Sapiens
YKFDLIAVS

SEQ ID NO: 962868 - protein, 9 aa, Homo Sapiens
RGPKGQKEN

SEQ ID NO: 962869 - protein, 9 aa, Homo Sapiens
LVEHILLEV

SEQ ID NO: 962870 - protein, 9 aa, Homo Sapiens
GLGRLVTHK

SEQ ID NO: 962871 - protein, 9 aa, Homo Sapiens
PSCALQKKS

SEQ ID NO: 962872 - protein, 9 aa, Homo Sapiens
FYTGVNDDR

SEQ ID NO: 962873 - protein, 9 aa, Homo Sapiens
CQTEPCERC

SEQ ID NO: 962874 - protein, 9 aa, Homo Sapiens
QIPFKEPAV

SEQ ID NO: 962875 - protein, 9 aa, Homo Sapiens
GPDLSWASV

SEQ ID NO: 962876 - protein, 9 aa, Homo Sapiens
LQLQGQEVQ

SEQ ID NO: 962877 - protein, 9 aa, Homo Sapiens
GVSQLLPKF

SEQ ID NO: 962878 - protein, 9 aa, Homo Sapiens
KRNHKFVPG

SEQ ID NO: 962879 - protein, 9 aa, Homo Sapiens
CSACTYLAS

SEQ ID NO: 962880 - protein, 9 aa, Homo Sapiens
HTKEKPAKS

SEQ ID NO: 962881 - protein, 9 aa, Homo Sapiens
WRKQGYEHL

SEQ ID NO: 962882 - protein, 9 aa, Homo Sapiens
EKKNKRCKY

SEQ ID NO: 962883 - protein, 9 aa, Homo Sapiens
LSLFLSDLL

SEQ ID NO: 962884 - protein, 9 aa, Homo Sapiens
SEYGRTISS

SEQ ID NO: 962885 - protein, 9 aa, Homo Sapiens
KTLFQPLFE

SEQ ID NO: 962886 - protein, 9 aa, Homo Sapiens
LTQEQFQDV

SEQ ID NO: 962887 - protein, 9 aa, Homo Sapiens
LFLNLGPPQ

SEQ ID NO: 962888 - protein, 9 aa, Homo Sapiens
ILDDNKTLT

SEQ ID NO: 962889 - protein, 9 aa, Homo Sapiens
NKKEQAERF

SEQ ID NO: 962890 - protein, 9 aa, Homo Sapiens
HGLYWMHFC

SEQ ID NO: 962891 - protein, 9 aa, Homo Sapiens
PAKPLHPAR

SEQ ID NO: 962892 - protein, 9 aa, Homo Sapiens
ENKRTPSSG

SEQ ID NO: 962893 - protein, 9 aa, Homo Sapiens
GYLPLEFEF

SEQ ID NO: 962894 - protein, 9 aa, Homo Sapiens
DFDHTSREF

SEQ ID NO: 962895 - protein, 9 aa, Homo Sapiens
LENDNDDDE

SEQ ID NO: 962896 - protein, 9 aa, Homo Sapiens
SGKSATENS

SEQ ID NO: 962897 - protein, 9 aa, Homo Sapiens
KGFGSHSSS

SEQ ID NO: 962898 - protein, 9 aa, Homo Sapiens
KLKTRVQKE

SEQ ID NO: 962899 - protein, 9 aa, Homo Sapiens
RKWYSPIKE

SEQ ID NO: 962900 - protein, 9 aa, Homo Sapiens
TFSKEKTPE

SEQ ID NO: 962901 - protein, 9 aa, Homo Sapiens
LDLSGPGFS

SEQ ID NO: 962902 - protein, 9 aa, Homo Sapiens
QENSQKVGT

SEQ ID NO: 962903 - protein, 9 aa, Homo Sapiens
FTHWNFDPY

SEQ ID NO: 962904 - protein, 9 aa, Homo Sapiens
SPVGNTLRT

SEQ ID NO: 962905 - protein, 9 aa, Homo Sapiens
LHLSKHLLT

SEQ ID NO: 962906 - protein, 9 aa, Homo Sapiens
YALTFSGCS

SEQ ID NO: 962907 - protein, 9 aa, Homo Sapiens
MNSYSMLHP

SEQ ID NO: 962908 - protein, 9 aa, Homo Sapiens
PRVVYLIRA

SEQ ID NO: 962909 - protein, 9 aa, Homo Sapiens
PSLLASGRR

SEQ ID NO: 962910 - protein, 9 aa, Homo Sapiens
PVFSGLFEF

SEQ ID NO: 962911 - protein, 9 aa, Homo Sapiens
KKRELSDDY

SEQ ID NO: 962912 - protein, 9 aa, Homo Sapiens
SKELPARIC

SEQ ID NO: 962913 - protein, 9 aa, Homo Sapiens
SPLFLYTEP

SEQ ID NO: 962914 - protein, 9 aa, Homo Sapiens
LDAASSSSF

SEQ ID NO: 962915 - protein, 9 aa, Homo Sapiens
LGSCSSEVS

SEQ ID NO: 962916 - protein, 9 aa, Homo Sapiens
ASALINKEL

SEQ ID NO: 962917 - protein, 9 aa, Homo Sapiens
LHLSEAPPA

SEQ ID NO: 962918 - protein, 9 aa, Homo Sapiens
FVMDASIGQ

SEQ ID NO: 962919 - protein, 9 aa, Homo Sapiens
HSHGSSTRR

SEQ ID NO: 962920 - protein, 9 aa, Homo Sapiens
LDLGDCGVL

SEQ ID NO: 962921 - protein, 9 aa, Homo Sapiens
KTANEKTTP

SEQ ID NO: 962922 - protein, 9 aa, Homo Sapiens
LNIHKSDNK

SEQ ID NO: 962923 - protein, 9 aa, Homo Sapiens
ATQLSRHQL

SEQ ID NO: 962924 - protein, 9 aa, Homo Sapiens
ASGQLGLIS

SEQ ID NO: 962925 - protein, 9 aa, Homo Sapiens
MDEFFYNLS

SEQ ID NO: 962926 - protein, 9 aa, Homo Sapiens
MKKFLFYAR

SEQ ID NO: 962927 - protein, 9 aa, Homo Sapiens
HSSSSEKGS

SEQ ID NO: 962928 - protein, 9 aa, Homo Sapiens
TERQERTPT

SEQ ID NO: 962929 - protein, 9 aa, Homo Sapiens
LLRKTKGCS

SEQ ID NO: 962930 - protein, 9 aa, Homo Sapiens
EVGGQDHGE

SEQ ID NO: 962931 - protein, 9 aa, Homo Sapiens
GKWQERLTS

SEQ ID NO: 962932 - protein, 9 aa, Homo Sapiens
HQFVHHQEL

SEQ ID NO: 962933 - protein, 9 aa, Homo Sapiens
LEGSGISSR

SEQ ID NO: 962934 - protein, 9 aa, Homo Sapiens
QREGRQCED

SEQ ID NO: 962935 - protein, 9 aa, Homo Sapiens
SSSLKGDSS

SEQ ID NO: 962936 - protein, 9 aa, Homo Sapiens
PQAAFPSQS

SEQ ID NO: 962937 - protein, 9 aa, Homo Sapiens
SVLSSLTEW

SEQ ID NO: 962938 - protein, 9 aa, Homo Sapiens
LSQYKINIT

SEQ ID NO: 962939 - protein, 9 aa, Homo Sapiens
VKKREFHNQ

SEQ ID NO: 962940 - protein, 9 aa, Homo Sapiens
SNQTTAEKQ

SEQ ID NO: 962941 - protein, 9 aa, Homo Sapiens
PSYLMLARK

SEQ ID NO: 962942 - protein, 9 aa, Homo Sapiens
RARCMLAGS

SEQ ID NO: 962943 - protein, 9 aa, Homo Sapiens
VLLYRLLIT

SEQ ID NO: 962944 - protein, 9 aa, Homo Sapiens
VYLIRAPLP

SEQ ID NO: 962945 - protein, 9 aa, Homo Sapiens
MQQRFTLQP

SEQ ID NO: 962946 - protein, 9 aa, Homo Sapiens
QAAFPSQSS

SEQ ID NO: 962947 - protein, 9 aa, Homo Sapiens
LPGDEHAEN

SEQ ID NO: 962948 - protein, 9 aa, Homo Sapiens
SKKKEATCP

SEQ ID NO: 962949 - protein, 9 aa, Homo Sapiens
YGIIAAIGE

SEQ ID NO: 962950 - protein, 9 aa, Homo Sapiens
IKRAPREET

SEQ ID NO: 962951 - protein, 9 aa, Homo Sapiens
LEIEAYVKV

SEQ ID NO: 962952 - protein, 9 aa, Homo Sapiens
RKKGVDGGL

SEQ ID NO: 962953 - protein, 9 aa, Homo Sapiens
DPEKFFSRI

SEQ ID NO: 962954 - protein, 9 aa, Homo Sapiens
YKKKYYTFN

SEQ ID NO: 962955 - protein, 9 aa, Homo Sapiens
GVVLVSREP

SEQ ID NO: 962956 - protein, 9 aa, Homo Sapiens
LEDYANLKQ

SEQ ID NO: 962957 - protein, 9 aa, Homo Sapiens
LKGPLAKRN

SEQ ID NO: 962958 - protein, 9 aa, Homo Sapiens
SLTNMKGNI

SEQ ID NO: 962959 - protein, 9 aa, Homo Sapiens
VESPFFKEV

SEQ ID NO: 962960 - protein, 9 aa, Homo Sapiens
AFCLLKHQR

SEQ ID NO: 962961 - protein, 9 aa, Homo Sapiens
EVCFCDLGY

SEQ ID NO: 962962 - protein, 9 aa, Homo Sapiens
SLKNHGLLK

SEQ ID NO: 962963 - protein, 9 aa, Homo Sapiens
RNKNVKTAL

SEQ ID NO: 962964 - protein, 9 aa, Homo Sapiens
DSSSAVRKT

SEQ ID NO: 962965 - protein, 9 aa, Homo Sapiens
VITDAISRL

SEQ ID NO: 962966 - protein, 9 aa, Homo Sapiens
NYFGCKFFL

SEQ ID NO: 962967 - protein, 9 aa, Homo Sapiens
LGNPGKTSS

SEQ ID NO: 962968 - protein, 9 aa, Homo Sapiens
VNASSERFN

SEQ ID NO: 962969 - protein, 9 aa, Homo Sapiens
SPGGDREAL

SEQ ID NO: 962970 - protein, 9 aa, Homo Sapiens
TNCASVNDG

SEQ ID NO: 962971 - protein, 9 aa, Homo Sapiens
NIYVDCVIK

SEQ ID NO: 962972 - protein, 9 aa, Homo Sapiens
LLSTLKIKN

SEQ ID NO: 962973 - protein, 9 aa, Homo Sapiens
HLASFIRLT

SEQ ID NO: 962974 - protein, 9 aa, Homo Sapiens
FPNGPQILG

SEQ ID NO: 962975 - protein, 9 aa, Homo Sapiens
KNHPSQTHV

SEQ ID NO: 962976 - protein, 9 aa, Homo Sapiens
VRYLVDVRQ

SEQ ID NO: 962977 - protein, 9 aa, Homo Sapiens
TLIRAREKD

SEQ ID NO: 962978 - protein, 9 aa, Homo Sapiens
SLGTALKIL

SEQ ID NO: 962979 - protein, 9 aa, Homo Sapiens
PLPGVGILP

SEQ ID NO: 962980 - protein, 9 aa, Homo Sapiens
AQRRLRFNV

SEQ ID NO: 962981 - protein, 9 aa, Homo Sapiens
LRGPASSFT

SEQ ID NO: 962982 - protein, 9 aa, Homo Sapiens
TERQQPRRK

SEQ ID NO: 962983 - protein, 9 aa, Homo Sapiens
RPRGYRWSK

SEQ ID NO: 962984 - protein, 9 aa, Homo Sapiens
FFFSWLNSL

SEQ ID NO: 962985 - protein, 9 aa, Homo Sapiens
QAELSKNLV

SEQ ID NO: 962986 - protein, 9 aa, Homo Sapiens
ETSEGVRGA

SEQ ID NO: 962987 - protein, 9 aa, Homo Sapiens
PKFRENYLN

SEQ ID NO: 962988 - protein, 9 aa, Homo Sapiens
AAAPETAAA

SEQ ID NO: 962989 - protein, 9 aa, Homo Sapiens
KTKGCSITE

SEQ ID NO: 962990 - protein, 9 aa, Homo Sapiens
LFLSDLLTA

SEQ ID NO: 962991 - protein, 9 aa, Homo Sapiens
QGPPQPQSL

SEQ ID NO: 962992 - protein, 9 aa, Homo Sapiens
SWWPTPATP

SEQ ID NO: 962993 - protein, 9 aa, Homo Sapiens
FLNYLNQPS

SEQ ID NO: 962994 - protein, 9 aa, Homo Sapiens
RGAAPLCTH

SEQ ID NO: 962995 - protein, 9 aa, Homo Sapiens
IANCYRNGG

SEQ ID NO: 962996 - protein, 9 aa, Homo Sapiens
ITFDETNLI

SEQ ID NO: 962997 - protein, 9 aa, Homo Sapiens
HLSFIDLSN

SEQ ID NO: 962998 - protein, 9 aa, Homo Sapiens
ESHIVLDSI

SEQ ID NO: 962999 - protein, 9 aa, Homo Sapiens
PSSGPVESK

SEQ ID NO: 963000 - protein, 9 aa, Homo Sapiens
HLHPHHHPH

SEQ ID NO: 963001 - protein, 9 aa, Homo Sapiens
GALALSPKE

SEQ ID NO: 963002 - protein, 9 aa, Homo Sapiens
LSVCRCKAL

SEQ ID NO: 963003 - protein, 9 aa, Homo Sapiens
EQEIENLEK

SEQ ID NO: 963004 - protein, 9 aa, Homo Sapiens
ILSSKFLTS

SEQ ID NO: 963005 - protein, 9 aa, Homo Sapiens
QQSQEVSEK

SEQ ID NO: 963006 - protein, 9 aa, Homo Sapiens
NAVKKREFH

SEQ ID NO: 963007 - protein, 9 aa, Homo Sapiens
LRDKHWHQL

SEQ ID NO: 963008 - protein, 9 aa, Homo Sapiens
GLKFINLFG

SEQ ID NO: 963009 - protein, 9 aa, Homo Sapiens
LSEGWATSL

SEQ ID NO: 963010 - protein, 9 aa, Homo Sapiens
KPQRPVKEE

SEQ ID NO: 963011 - protein, 9 aa, Homo Sapiens
LQVCLAHPE

SEQ ID NO: 963012 - protein, 9 aa, Homo Sapiens
PCFVEEWSP

SEQ ID NO: 963013 - protein, 9 aa, Homo Sapiens
SAESDPLER

SEQ ID NO: 963014 - protein, 9 aa, Homo Sapiens
LSFLKLSSL

SEQ ID NO: 963015 - protein, 9 aa, Homo Sapiens
SLPASRMHQ

SEQ ID NO: 963016 - protein, 9 aa, Homo Sapiens
SNLPQGYPL

SEQ ID NO: 963017 - protein, 9 aa, Homo Sapiens
NPELLCRYL

SEQ ID NO: 963018 - protein, 9 aa, Homo Sapiens
PEASRNGTV

SEQ ID NO: 963019 - protein, 9 aa, Homo Sapiens
SPERTLSLS

SEQ ID NO: 963020 - protein, 9 aa, Homo Sapiens
PEEAPPKED

SEQ ID NO: 963021 - protein, 9 aa, Homo Sapiens
RYVPRAFYF

SEQ ID NO: 963022 - protein, 9 aa, Homo Sapiens
TGIEEFPGP

SEQ ID NO: 963023 - protein, 9 aa, Homo Sapiens
PAPRRGPEH

SEQ ID NO: 963024 - protein, 9 aa, Homo Sapiens
YKKRLKDLG

SEQ ID NO: 963025 - protein, 9 aa, Homo Sapiens
SEEKPYKCN

SEQ ID NO: 963026 - protein, 9 aa, Homo Sapiens
CATYWDIAD

SEQ ID NO: 963027 - protein, 9 aa, Homo Sapiens
QGKIFPEGS

SEQ ID NO: 963028 - protein, 9 aa, Homo Sapiens
ERTNPVTDP

SEQ ID NO: 963029 - protein, 9 aa, Homo Sapiens
EGPIGIIQH

SEQ ID NO: 963030 - protein, 9 aa, Homo Sapiens
ATHFSIPLD

SEQ ID NO: 963031 - protein, 9 aa, Homo Sapiens
TCTLKPNAV

SEQ ID NO: 963032 - protein, 9 aa, Homo Sapiens
VVYLIRAPL

SEQ ID NO: 963033 - protein, 9 aa, Homo Sapiens
MGRDEATGP

SEQ ID NO: 963034 - protein, 9 aa, Homo Sapiens
VQTERQERT

SEQ ID NO: 963035 - protein, 9 aa, Homo Sapiens
SFSPKPTVL

SEQ ID NO: 963036 - protein, 9 aa, Homo Sapiens
PRQAFSSTV

SEQ ID NO: 963037 - protein, 9 aa, Homo Sapiens
SYKNEVCKQ

SEQ ID NO: 963038 - protein, 9 aa, Homo Sapiens
FTCLTSAHK

SEQ ID NO: 963039 - protein, 9 aa, Homo Sapiens
VGQKEMSNF

SEQ ID NO: 963040 - protein, 9 aa, Homo Sapiens
FPPAVAAAG

SEQ ID NO: 963041 - protein, 9 aa, Homo Sapiens
INNEHIYGE

SEQ ID NO: 963042 - protein, 9 aa, Homo Sapiens
NTLHPDLSP

SEQ ID NO: 963043 - protein, 9 aa, Homo Sapiens
CKQFAKNLL

SEQ ID NO: 963044 - protein, 9 aa, Homo Sapiens
LNPPAVPLQ

SEQ ID NO: 963045 - protein, 9 aa, Homo Sapiens
PRAFYFQCV

SEQ ID NO: 963046 - protein, 9 aa, Homo Sapiens
WPYKQQNQV

SEQ ID NO: 963047 - protein, 9 aa, Homo Sapiens
QKEREKPLS

SEQ ID NO: 963048 - protein, 9 aa, Homo Sapiens
YSRFMGTIS

SEQ ID NO: 963049 - protein, 9 aa, Homo Sapiens
QFSYVTPAP

SEQ ID NO: 963050 - protein, 9 aa, Homo Sapiens
VPLLEDISL

SEQ ID NO: 963051 - protein, 9 aa, Homo Sapiens
REQQRQHKL

SEQ ID NO: 963052 - protein, 9 aa, Homo Sapiens
LTTPTQSEK

SEQ ID NO: 963053 - protein, 9 aa, Homo Sapiens
QNQRLSKNG

SEQ ID NO: 963054 - protein, 9 aa, Homo Sapiens
VAQKFQGVG

SEQ ID NO: 963055 - protein, 9 aa, Homo Sapiens
TTSLQQELG

SEQ ID NO: 963056 - protein, 9 aa, Homo Sapiens
TCGEESSSD

SEQ ID NO: 963057 - protein, 9 aa, Homo Sapiens
VDPDSWFLE

SEQ ID NO: 963058 - protein, 9 aa, Homo Sapiens
VRRRPSVLF

SEQ ID NO: 963059 - protein, 9 aa, Homo Sapiens
ELTASPKPQ

SEQ ID NO: 963060 - protein, 9 aa, Homo Sapiens
VLSSFISDW

SEQ ID NO: 963061 - protein, 9 aa, Homo Sapiens
PFVQAMQEK

SEQ ID NO: 963062 - protein, 9 aa, Homo Sapiens
LDKFLRKKD

SEQ ID NO: 963063 - protein, 9 aa, Homo Sapiens
TVIELLEKS

SEQ ID NO: 963064 - protein, 9 aa, Homo Sapiens
PGLVPGPAP

SEQ ID NO: 963065 - protein, 9 aa, Homo Sapiens
NKELYAGVY

SEQ ID NO: 963066 - protein, 9 aa, Homo Sapiens
PETAAAAAA

SEQ ID NO: 963067 - protein, 9 aa, Homo Sapiens
NELMIFARR

SEQ ID NO: 963068 - protein, 9 aa, Homo Sapiens
YEEVFKERN

SEQ ID NO: 963069 - protein, 9 aa, Homo Sapiens
GSSTRRRKC

SEQ ID NO: 963070 - protein, 9 aa, Homo Sapiens
GDKGEPGPL

SEQ ID NO: 963071 - protein, 9 aa, Homo Sapiens
LPGFPGPQD

SEQ ID NO: 963072 - protein, 9 aa, Homo Sapiens
STTTAMSTT

SEQ ID NO: 963073 - protein, 9 aa, Homo Sapiens
LLTCCLSLT

SEQ ID NO: 963074 - protein, 9 aa, Homo Sapiens
PNEKITHYT

SEQ ID NO: 963075 - protein, 9 aa, Homo Sapiens
IQDLNNCSV

SEQ ID NO: 963076 - protein, 9 aa, Homo Sapiens
SVCRCKALK

SEQ ID NO: 963077 - protein, 9 aa, Homo Sapiens
IEQFLVKKA

SEQ ID NO: 963078 - protein, 9 aa, Homo Sapiens
AWIKDYSSG

SEQ ID NO: 963079 - protein, 9 aa, Homo Sapiens
KNDAEHLDR

SEQ ID NO: 963080 - protein, 9 aa, Homo Sapiens
NLTLRAGPI

SEQ ID NO: 963081 - protein, 9 aa, Homo Sapiens
HGLPWDFVR

SEQ ID NO: 963082 - protein, 9 aa, Homo Sapiens
SNPELYKFD

SEQ ID NO: 963083 - protein, 9 aa, Homo Sapiens
AEVQHILGN

SEQ ID NO: 963084 - protein, 9 aa, Homo Sapiens
SSRMNSPKR

SEQ ID NO: 963085 - protein, 9 aa, Homo Sapiens
AKHNLFAAR

SEQ ID NO: 963086 - protein, 9 aa, Homo Sapiens
GKGISGTFV

SEQ ID NO: 963087 - protein, 9 aa, Homo Sapiens
EDAEEEGLL

SEQ ID NO: 963088 - protein, 9 aa, Homo Sapiens
QETMALPIK

SEQ ID NO: 963089 - protein, 9 aa, Homo Sapiens
SLLTCCLSL

SEQ ID NO: 963090 - protein, 9 aa, Homo Sapiens
PALLSNLTL

SEQ ID NO: 963091 - protein, 9 aa, Homo Sapiens
KYKKKYYTF

SEQ ID NO: 963092 - protein, 9 aa, Homo Sapiens
PKKPALCAG

SEQ ID NO: 963093 - protein, 9 aa, Homo Sapiens
YRCLNGSSK

SEQ ID NO: 963094 - protein, 9 aa, Homo Sapiens
AFSRAPPVP

SEQ ID NO: 963095 - protein, 9 aa, Homo Sapiens
SSSPFLPSR

SEQ ID NO: 963096 - protein, 9 aa, Homo Sapiens
GVRILSWPK

SEQ ID NO: 963097 - protein, 9 aa, Homo Sapiens
PTGNASWLM

SEQ ID NO: 963098 - protein, 9 aa, Homo Sapiens
DCLKDELSH

SEQ ID NO: 963099 - protein, 9 aa, Homo Sapiens
VGLLRQDPI

SEQ ID NO: 963100 - protein, 9 aa, Homo Sapiens
YVLVFLLSL

SEQ ID NO: 963101 - protein, 9 aa, Homo Sapiens
CYPEGPIGI

SEQ ID NO: 963102 - protein, 9 aa, Homo Sapiens
SPLSEDIKL

SEQ ID NO: 963103 - protein, 9 aa, Homo Sapiens
GYSSTNNSV

SEQ ID NO: 963104 - protein, 9 aa, Homo Sapiens
TTFSKEKTP

SEQ ID NO: 963105 - protein, 9 aa, Homo Sapiens
TTVFKFLGM

SEQ ID NO: 963106 - protein, 9 aa, Homo Sapiens
GNYVMEGSL

SEQ ID NO: 963107 - protein, 9 aa, Homo Sapiens
EKEGKENED

SEQ ID NO: 963108 - protein, 9 aa, Homo Sapiens
LFSPRYKMV

SEQ ID NO: 963109 - protein, 9 aa, Homo Sapiens
ITKPVIRRL

SEQ ID NO: 963110 - protein, 9 aa, Homo Sapiens
VDRIIYIVT

SEQ ID NO: 963111 - protein, 9 aa, Homo Sapiens
PRTPDGRKI

SEQ ID NO: 963112 - protein, 9 aa, Homo Sapiens
RLTEEELAP

SEQ ID NO: 963113 - protein, 9 aa, Homo Sapiens
MNLIQTMTE

SEQ ID NO: 963114 - protein, 9 aa, Homo Sapiens
GDREALISD

SEQ ID NO: 963115 - protein, 9 aa, Homo Sapiens
DMETEEAED

SEQ ID NO: 963116 - protein, 9 aa, Homo Sapiens
RIDKVISWI

SEQ ID NO: 963117 - protein, 9 aa, Homo Sapiens
WASLESQVR

SEQ ID NO: 963118 - protein, 9 aa, Homo Sapiens
KPLSTFKDL

SEQ ID NO: 963119 - protein, 9 aa, Homo Sapiens
EADNVIFER

SEQ ID NO: 963120 - protein, 9 aa, Homo Sapiens
LKGDSSLVK

SEQ ID NO: 963121 - protein, 9 aa, Homo Sapiens
CKRNHKFVP

SEQ ID NO: 963122 - protein, 9 aa, Homo Sapiens
IQKVVKCLI

SEQ ID NO: 963123 - protein, 9 aa, Homo Sapiens
SALFSPRYK

SEQ ID NO: 963124 - protein, 9 aa, Homo Sapiens
SPALPTPSL

SEQ ID NO: 963125 - protein, 9 aa, Homo Sapiens
NRTFKKTFK

SEQ ID NO: 963126 - protein, 9 aa, Homo Sapiens
VRKNLFCFG

SEQ ID NO: 963127 - protein, 9 aa, Homo Sapiens
LFKESRYSQ

SEQ ID NO: 963128 - protein, 9 aa, Homo Sapiens
GLRVHGVHQ

SEQ ID NO: 963129 - protein, 9 aa, Homo Sapiens
LPPGRQEKE

SEQ ID NO: 963130 - protein, 9 aa, Homo Sapiens
SKLSSVPQI

SEQ ID NO: 963131 - protein, 9 aa, Homo Sapiens
STLGDVKNK

SEQ ID NO: 963132 - protein, 9 aa, Homo Sapiens
KMRPLHKKL

SEQ ID NO: 963133 - protein, 9 aa, Homo Sapiens
SSDAAGKLP

SEQ ID NO: 963134 - protein, 9 aa, Homo Sapiens
EDEDDEKEE

SEQ ID NO: 963135 - protein, 9 aa, Homo Sapiens
TTVFPGSHL

SEQ ID NO: 963136 - protein, 9 aa, Homo Sapiens
SIQERENLT

SEQ ID NO: 963137 - protein, 9 aa, Homo Sapiens
SLKGFMREK

SEQ ID NO: 963138 - protein, 9 aa, Homo Sapiens
PRLMSTTLI

SEQ ID NO: 963139 - protein, 9 aa, Homo Sapiens
SLLLKRLAL

SEQ ID NO: 963140 - protein, 9 aa, Homo Sapiens
EGKIPWESM

SEQ ID NO: 963141 - protein, 9 aa, Homo Sapiens
ARCFHSPLL

SEQ ID NO: 963142 - protein, 9 aa, Homo Sapiens
IPGKEFPTQ

SEQ ID NO: 963143 - protein, 9 aa, Homo Sapiens
LSPKKPALC

SEQ ID NO: 963144 - protein, 9 aa, Homo Sapiens
TFHTEGRAW

SEQ ID NO: 963145 - protein, 9 aa, Homo Sapiens
EPKSERTEG

SEQ ID NO: 963146 - protein, 9 aa, Homo Sapiens
MDWGEGSTL

SEQ ID NO: 963147 - protein, 9 aa, Homo Sapiens
STQGEIHVG

SEQ ID NO: 963148 - protein, 9 aa, Homo Sapiens
EWDKYLESS

SEQ ID NO: 963149 - protein, 9 aa, Homo Sapiens
SRLGKECAR

SEQ ID NO: 963150 - protein, 9 aa, Homo Sapiens
PGFEVVENN

SEQ ID NO: 963151 - protein, 9 aa, Homo Sapiens
EFGFCCEKD

SEQ ID NO: 963152 - protein, 9 aa, Homo Sapiens
DFPRGVQKN

SEQ ID NO: 963153 - protein, 9 aa, Homo Sapiens
LRFMDVTPR

SEQ ID NO: 963154 - protein, 9 aa, Homo Sapiens
LGLLETTDE

SEQ ID NO: 963155 - protein, 9 aa, Homo Sapiens
ERNEGHDLY

SEQ ID NO: 963156 - protein, 9 aa, Homo Sapiens
GVHVPSPLH

SEQ ID NO: 963157 - protein, 9 aa, Homo Sapiens
TTERQQPRR

SEQ ID NO: 963158 - protein, 9 aa, Homo Sapiens
VKGDADVSM

SEQ ID NO: 963159 - protein, 9 aa, Homo Sapiens
RLIRNLQER

SEQ ID NO: 963160 - protein, 9 aa, Homo Sapiens
RDGFGGNDN

SEQ ID NO: 963161 - protein, 9 aa, Homo Sapiens
FKGVKFGKN

SEQ ID NO: 963162 - protein, 9 aa, Homo Sapiens
TNLITRLSE

SEQ ID NO: 963163 - protein, 9 aa, Homo Sapiens
DKRTGPEAS

SEQ ID NO: 963164 - protein, 9 aa, Homo Sapiens
TRGRAVPGL

SEQ ID NO: 963165 - protein, 9 aa, Homo Sapiens
QKTKTIKRS

SEQ ID NO: 963166 - protein, 9 aa, Homo Sapiens
LLSNLTLGY

SEQ ID NO: 963167 - protein, 9 aa, Homo Sapiens
QSQGMNSYS

SEQ ID NO: 963168 - protein, 9 aa, Homo Sapiens
PLPFSIATQ

SEQ ID NO: 963169 - protein, 9 aa, Homo Sapiens
QKELSATSF

SEQ ID NO: 963170 - protein, 9 aa, Homo Sapiens
IAYQTKFPV

SEQ ID NO: 963171 - protein, 9 aa, Homo Sapiens
CVPDSALRC

SEQ ID NO: 963172 - protein, 9 aa, Homo Sapiens
WWYNKGECG

SEQ ID NO: 963173 - protein, 9 aa, Homo Sapiens
DCVSVLSEH

SEQ ID NO: 963174 - protein, 9 aa, Homo Sapiens
LLHSTPMLA

SEQ ID NO: 963175 - protein, 9 aa, Homo Sapiens
LLKRLALDV

SEQ ID NO: 963176 - protein, 9 aa, Homo Sapiens
FRTIFASSS

SEQ ID NO: 963177 - protein, 9 aa, Homo Sapiens
FFRSVIEVI

SEQ ID NO: 963178 - protein, 9 aa, Homo Sapiens
TLGNPGKTS

SEQ ID NO: 963179 - protein, 9 aa, Homo Sapiens
EHLIEVGNG

SEQ ID NO: 963180 - protein, 9 aa, Homo Sapiens
STRRRKCAN

SEQ ID NO: 963181 - protein, 9 aa, Homo Sapiens
KQASTMAAT

SEQ ID NO: 963182 - protein, 9 aa, Homo Sapiens
YVGERPYEC

SEQ ID NO: 963183 - protein, 9 aa, Homo Sapiens
NRGGRPNEL

SEQ ID NO: 963184 - protein, 9 aa, Homo Sapiens
ERAITEASS

SEQ ID NO: 963185 - protein, 9 aa, Homo Sapiens
ASDSGSGNE

SEQ ID NO: 963186 - protein, 9 aa, Homo Sapiens
EARIKRGLT

SEQ ID NO: 963187 - protein, 9 aa, Homo Sapiens
RRRPSVLFR

SEQ ID NO: 963188 - protein, 9 aa, Homo Sapiens
FLYTEPPGA

SEQ ID NO: 963189 - protein, 9 aa, Homo Sapiens
WTCPPCGLH

SEQ ID NO: 963190 - protein, 9 aa, Homo Sapiens
KELSATSFA

SEQ ID NO: 963191 - protein, 9 aa, Homo Sapiens
ISDPPKLKR

SEQ ID NO: 963192 - protein, 9 aa, Homo Sapiens
SGQISFRSN

SEQ ID NO: 963193 - protein, 9 aa, Homo Sapiens
KKKKKFSNR

SEQ ID NO: 963194 - protein, 9 aa, Homo Sapiens
VYESWFKEG

SEQ ID NO: 963195 - protein, 9 aa, Homo Sapiens
NHPIWGRAK

SEQ ID NO: 963196 - protein, 9 aa, Homo Sapiens
AELPAACEK

SEQ ID NO: 963197 - protein, 9 aa, Homo Sapiens
KPFVVWFQS

SEQ ID NO: 963198 - protein, 9 aa, Homo Sapiens
VSALQIYCI

SEQ ID NO: 963199 - protein, 9 aa, Homo Sapiens
GVCQTGGCR

SEQ ID NO: 963200 - protein, 9 aa, Homo Sapiens
TFSFETVQI

SEQ ID NO: 963201 - protein, 9 aa, Homo Sapiens
DSSLVKGSL

SEQ ID NO: 963202 - protein, 9 aa, Homo Sapiens
VVGADGVGK

SEQ ID NO: 963203 - protein, 9 aa, Homo Sapiens
LVKTLEDNQ

SEQ ID NO: 963204 - protein, 9 aa, Homo Sapiens
ELQSRLVAL

SEQ ID NO: 963205 - protein, 9 aa, Homo Sapiens
PCPLGASPS

SEQ ID NO: 963206 - protein, 9 aa, Homo Sapiens
QDDNQTGQN

SEQ ID NO: 963207 - protein, 9 aa, Homo Sapiens
YKIYIFSFF

SEQ ID NO: 963208 - protein, 9 aa, Homo Sapiens
HEQSRTNRD

SEQ ID NO: 963209 - protein, 9 aa, Homo Sapiens
SVLSGDLYP

SEQ ID NO: 963210 - protein, 9 aa, Homo Sapiens
NESEVVTAV

SEQ ID NO: 963211 - protein, 9 aa, Homo Sapiens
RWPDVAQTP

SEQ ID NO: 963212 - protein, 9 aa, Homo Sapiens
LDSDVEYEI

SEQ ID NO: 963213 - protein, 9 aa, Homo Sapiens
YVPDMKLSM

SEQ ID NO: 963214 - protein, 9 aa, Homo Sapiens
SEEKQGITA

SEQ ID NO: 963215 - protein, 9 aa, Homo Sapiens
IATFGAYDW

SEQ ID NO: 963216 - protein, 9 aa, Homo Sapiens
VFNGLKKHY

SEQ ID NO: 963217 - protein, 9 aa, Homo Sapiens
VNAHLLSLM

SEQ ID NO: 963218 - protein, 9 aa, Homo Sapiens
YMLVHAEVQ

SEQ ID NO: 963219 - protein, 9 aa, Homo Sapiens
IIDPNNRRY

SEQ ID NO: 963220 - protein, 9 aa, Homo Sapiens
AVMAYDCYL

SEQ ID NO: 963221 - protein, 9 aa, Homo Sapiens
PSVLFRLTP

SEQ ID NO: 963222 - protein, 9 aa, Homo Sapiens
LPPELDIFP

SEQ ID NO: 963223 - protein, 9 aa, Homo Sapiens
LKMETRMIK

SEQ ID NO: 963224 - protein, 9 aa, Homo Sapiens
GIGGDIHFD

SEQ ID NO: 963225 - protein, 9 aa, Homo Sapiens
KSDNKCKES

SEQ ID NO: 963226 - protein, 9 aa, Homo Sapiens
SDYLNALEH

SEQ ID NO: 963227 - protein, 9 aa, Homo Sapiens
SNFLGIITP

SEQ ID NO: 963228 - protein, 9 aa, Homo Sapiens
VLFKNKVFS

SEQ ID NO: 963229 - protein, 9 aa, Homo Sapiens
MEKCTWASE

SEQ ID NO: 963230 - protein, 9 aa, Homo Sapiens
RPSTQPPAE

SEQ ID NO: 963231 - protein, 9 aa, Homo Sapiens
IYIVTVMVD

SEQ ID NO: 963232 - protein, 9 aa, Homo Sapiens
LIVELVRYL

SEQ ID NO: 963233 - protein, 9 aa, Homo Sapiens
ETPILPLGV

SEQ ID NO: 963234 - protein, 9 aa, Homo Sapiens
LNMLVQTER

SEQ ID NO: 963235 - protein, 9 aa, Homo Sapiens
SPSELGETE

SEQ ID NO: 963236 - protein, 9 aa, Homo Sapiens
FSIYPRFVQ

SEQ ID NO: 963237 - protein, 9 aa, Homo Sapiens
QASEVQSKK

SEQ ID NO: 963238 - protein, 9 aa, Homo Sapiens
NWDPKTVGL

SEQ ID NO: 963239 - protein, 9 aa, Homo Sapiens
ECVDKCNFL

SEQ ID NO: 963240 - protein, 9 aa, Homo Sapiens
VNVLKFLLS

SEQ ID NO: 963241 - protein, 9 aa, Homo Sapiens
GLSQANFIL

SEQ ID NO: 963242 - protein, 9 aa, Homo Sapiens
EKRQSPVNI

SEQ ID NO: 963243 - protein, 9 aa, Homo Sapiens
VAPNPANFV

SEQ ID NO: 963244 - protein, 9 aa, Homo Sapiens
PRTSSLNWH

SEQ ID NO: 963245 - protein, 9 aa, Homo Sapiens
QAGLGNHLF

SEQ ID NO: 963246 - protein, 9 aa, Homo Sapiens
SGPGAYELG

SEQ ID NO: 963247 - protein, 9 aa, Homo Sapiens
SALINKELY

SEQ ID NO: 963248 - protein, 9 aa, Homo Sapiens
CSGPDLSWA

SEQ ID NO: 963249 - protein, 9 aa, Homo Sapiens
SVSETPPFS

SEQ ID NO: 963250 - protein, 9 aa, Homo Sapiens
PKSERTEGD

SEQ ID NO: 963251 - protein, 9 aa, Homo Sapiens
GSRRNAYQG

SEQ ID NO: 963252 - protein, 9 aa, Homo Sapiens
PNIYVDCVI

SEQ ID NO: 963253 - protein, 9 aa, Homo Sapiens
QAVLYSRFM

SEQ ID NO: 963254 - protein, 9 aa, Homo Sapiens
GALDKFLRK

SEQ ID NO: 963255 - protein, 9 aa, Homo Sapiens
KTPDPQAGN

SEQ ID NO: 963256 - protein, 9 aa, Homo Sapiens
ADMSKVYSV

SEQ ID NO: 963257 - protein, 9 aa, Homo Sapiens
EEPVQASHC

SEQ ID NO: 963258 - protein, 9 aa, Homo Sapiens
YSSLLKRLE

SEQ ID NO: 963259 - protein, 9 aa, Homo Sapiens
LSSVPQIAK

SEQ ID NO: 963260 - protein, 9 aa, Homo Sapiens
RFSGFAISG

SEQ ID NO: 963261 - protein, 9 aa, Homo Sapiens
QSSVKPSAA

SEQ ID NO: 963262 - protein, 9 aa, Homo Sapiens
TRKSVQCQR

SEQ ID NO: 963263 - protein, 9 aa, Homo Sapiens
LASHVPHSA

SEQ ID NO: 963264 - protein, 9 aa, Homo Sapiens
GVGKSIATI

SEQ ID NO: 963265 - protein, 9 aa, Homo Sapiens
LGDVKNKQE

SEQ ID NO: 963266 - protein, 9 aa, Homo Sapiens
GLPEVEFFD

SEQ ID NO: 963267 - protein, 9 aa, Homo Sapiens
LKNIPNLTA

SEQ ID NO: 963268 - protein, 9 aa, Homo Sapiens
VKLALDGEI

SEQ ID NO: 963269 - protein, 9 aa, Homo Sapiens
DFYKIYENG

SEQ ID NO: 963270 - protein, 9 aa, Homo Sapiens
VKDAVPTIF

SEQ ID NO: 963271 - protein, 9 aa, Homo Sapiens
PRPPHTHFY

SEQ ID NO: 963272 - protein, 9 aa, Homo Sapiens
ARVLLQLRD

SEQ ID NO: 963273 - protein, 9 aa, Homo Sapiens
LFMISCTDL

SEQ ID NO: 963274 - protein, 9 aa, Homo Sapiens
SFTRKEGSL

SEQ ID NO: 963275 - protein, 9 aa, Homo Sapiens
PFLQQIPFK

SEQ ID NO: 963276 - protein, 9 aa, Homo Sapiens
QDAEVTCSD

SEQ ID NO: 963277 - protein, 9 aa, Homo Sapiens
KKVDIVKRL

SEQ ID NO: 963278 - protein, 9 aa, Homo Sapiens
PSFYVGSNG

SEQ ID NO: 963279 - protein, 9 aa, Homo Sapiens
LLGKQPQNS

SEQ ID NO: 963280 - protein, 9 aa, Homo Sapiens
LCRHVSSQA

SEQ ID NO: 963281 - protein, 9 aa, Homo Sapiens
SSSRYPPQQ

SEQ ID NO: 963282 - protein, 9 aa, Homo Sapiens
AKPESLIKR

SEQ ID NO: 963283 - protein, 9 aa, Homo Sapiens
ADPFLSKAN

SEQ ID NO: 963284 - protein, 9 aa, Homo Sapiens
MSKDSILES

SEQ ID NO: 963285 - protein, 9 aa, Homo Sapiens
PNTSVFFIS

SEQ ID NO: 963286 - protein, 9 aa, Homo Sapiens
AWFLNIQAN

SEQ ID NO: 963287 - protein, 9 aa, Homo Sapiens
PEGIQKVVK

SEQ ID NO: 963288 - protein, 9 aa, Homo Sapiens
WGHLPSRRH

SEQ ID NO: 963289 - protein, 9 aa, Homo Sapiens
SFIDLSNST

SEQ ID NO: 963290 - protein, 9 aa, Homo Sapiens
KRTMLERLK

SEQ ID NO: 963291 - protein, 9 aa, Homo Sapiens
SRNKIPEIP

SEQ ID NO: 963292 - protein, 9 aa, Homo Sapiens
GVCRKENSV

SEQ ID NO: 963293 - protein, 9 aa, Homo Sapiens
PSQPSHLPT

SEQ ID NO: 963294 - protein, 9 aa, Homo Sapiens
LIREEKNFY

SEQ ID NO: 963295 - protein, 9 aa, Homo Sapiens
ELKADYKRR

SEQ ID NO: 963296 - protein, 9 aa, Homo Sapiens
NGSLQARKS

SEQ ID NO: 963297 - protein, 9 aa, Homo Sapiens
CLAGDNPKE

SEQ ID NO: 963298 - protein, 9 aa, Homo Sapiens
GPEASRNGT

SEQ ID NO: 963299 - protein, 9 aa, Homo Sapiens
TQSPTQPSS

SEQ ID NO: 963300 - protein, 9 aa, Homo Sapiens
LQRLFRFSF

SEQ ID NO: 963301 - protein, 9 aa, Homo Sapiens
LDGDDCDCL

SEQ ID NO: 963302 - protein, 9 aa, Homo Sapiens
GNEKQSDTL

SEQ ID NO: 963303 - protein, 9 aa, Homo Sapiens
IGNLVVLNF

SEQ ID NO: 963304 - protein, 9 aa, Homo Sapiens
AVIFPGFDV

SEQ ID NO: 963305 - protein, 9 aa, Homo Sapiens
SFVWSTLEV

SEQ ID NO: 963306 - protein, 9 aa, Homo Sapiens
FSDMWSFGV

SEQ ID NO: 963307 - protein, 9 aa, Homo Sapiens
HIYGEKKEF

SEQ ID NO: 963308 - protein, 9 aa, Homo Sapiens
FEFVKVSLS

SEQ ID NO: 963309 - protein, 9 aa, Homo Sapiens
DNKRETFRK

SEQ ID NO: 963310 - protein, 9 aa, Homo Sapiens
ISNDDDEHT

SEQ ID NO: 963311 - protein, 9 aa, Homo Sapiens
CSLLQKFAA

SEQ ID NO: 963312 - protein, 9 aa, Homo Sapiens
EKKEIKKNE

SEQ ID NO: 963313 - protein, 9 aa, Homo Sapiens
VGNTLRTWC

SEQ ID NO: 963314 - protein, 9 aa, Homo Sapiens
KRLQQSWEL

SEQ ID NO: 963315 - protein, 9 aa, Homo Sapiens
SSNTSLLAT

SEQ ID NO: 963316 - protein, 9 aa, Homo Sapiens
SLLNLAPYP

SEQ ID NO: 963317 - protein, 9 aa, Homo Sapiens
RQQKEEIEI

SEQ ID NO: 963318 - protein, 9 aa, Homo Sapiens
EVLKVFLEN

SEQ ID NO: 963319 - protein, 9 aa, Homo Sapiens
LWGKLQTQS

SEQ ID NO: 963320 - protein, 9 aa, Homo Sapiens
KVVNASKVK

SEQ ID NO: 963321 - protein, 9 aa, Homo Sapiens
ACLSPALPT

SEQ ID NO: 963322 - protein, 9 aa, Homo Sapiens
LSDRGKTPD

SEQ ID NO: 963323 - protein, 9 aa, Homo Sapiens
KFLLSNLDE

SEQ ID NO: 963324 - protein, 9 aa, Homo Sapiens
LSTLKIKNE

SEQ ID NO: 963325 - protein, 9 aa, Homo Sapiens
YSYIDFKLE

SEQ ID NO: 963326 - protein, 9 aa, Homo Sapiens
RETHEALVR

SEQ ID NO: 963327 - protein, 9 aa, Homo Sapiens
LQETSEGVR

SEQ ID NO: 963328 - protein, 9 aa, Homo Sapiens
VVITDAISR

SEQ ID NO: 963329 - protein, 9 aa, Homo Sapiens
FENLSVPHV

SEQ ID NO: 963330 - protein, 9 aa, Homo Sapiens
FRRVPLVAG

SEQ ID NO: 963331 - protein, 9 aa, Homo Sapiens
LILNFIRSR

SEQ ID NO: 963332 - protein, 9 aa, Homo Sapiens
GLRYQKLGE

SEQ ID NO: 963333 - protein, 9 aa, Homo Sapiens
FQFIFLPYN

SEQ ID NO: 963334 - protein, 9 aa, Homo Sapiens
ATYWDIADA

SEQ ID NO: 963335 - protein, 9 aa, Homo Sapiens
KWWYNKGEC

SEQ ID NO: 963336 - protein, 9 aa, Homo Sapiens
FYHEQSRTN

SEQ ID NO: 963337 - protein, 9 aa, Homo Sapiens
TQPSSGPGQ

SEQ ID NO: 963338 - protein, 9 aa, Homo Sapiens
EVSGDATKT

SEQ ID NO: 963339 - protein, 9 aa, Homo Sapiens
HYLSSAILQ

SEQ ID NO: 963340 - protein, 9 aa, Homo Sapiens
SSWWPTPAT

SEQ ID NO: 963341 - protein, 9 aa, Homo Sapiens
VQAILRMQS

SEQ ID NO: 963342 - protein, 9 aa, Homo Sapiens
IHNVEIVVL

SEQ ID NO: 963343 - protein, 9 aa, Homo Sapiens
QPEIEIPFF

SEQ ID NO: 963344 - protein, 9 aa, Homo Sapiens
LGKQPQNSA

SEQ ID NO: 963345 - protein, 9 aa, Homo Sapiens
KPEGPPPQR

SEQ ID NO: 963346 - protein, 9 aa, Homo Sapiens
NICFRFMGI

SEQ ID NO: 963347 - protein, 9 aa, Homo Sapiens
YAKAGTKKD

SEQ ID NO: 963348 - protein, 9 aa, Homo Sapiens
RSLGPKDFK

SEQ ID NO: 963349 - protein, 9 aa, Homo Sapiens
LFPSSGNRS

SEQ ID NO: 963350 - protein, 9 aa, Homo Sapiens
ATTCTLKPN

SEQ ID NO: 963351 - protein, 9 aa, Homo Sapiens
TSSSMRSGV

SEQ ID NO: 963352 - protein, 9 aa, Homo Sapiens
LLLSSQILL

SEQ ID NO: 963353 - protein, 9 aa, Homo Sapiens
GALDNLLFQ

SEQ ID NO: 963354 - protein, 9 aa, Homo Sapiens
PPLSDKFFD

SEQ ID NO: 963355 - protein, 9 aa, Homo Sapiens
LLLLGELQV

SEQ ID NO: 963356 - protein, 9 aa, Homo Sapiens
KFLVEPDGV

SEQ ID NO: 963357 - protein, 9 aa, Homo Sapiens
QRIYVGERP

SEQ ID NO: 963358 - protein, 9 aa, Homo Sapiens
GMLSNLTVI

SEQ ID NO: 963359 - protein, 9 aa, Homo Sapiens
QKPAAFAAQ

SEQ ID NO: 963360 - protein, 9 aa, Homo Sapiens
GSISLGKSW

SEQ ID NO: 963361 - protein, 9 aa, Homo Sapiens
ALQKPWLLN

SEQ ID NO: 963362 - protein, 9 aa, Homo Sapiens
TEEGPGTFH

SEQ ID NO: 963363 - protein, 9 aa, Homo Sapiens
ATREQRITE

SEQ ID NO: 963364 - protein, 9 aa, Homo Sapiens
MKQPQGKGI

SEQ ID NO: 963365 - protein, 9 aa, Homo Sapiens
ENEAGRFGQ

SEQ ID NO: 963366 - protein, 9 aa, Homo Sapiens
KECVAATFF

SEQ ID NO: 963367 - protein, 9 aa, Homo Sapiens
AVILESLFL

SEQ ID NO: 963368 - protein, 9 aa, Homo Sapiens
GSETSTPLI

SEQ ID NO: 963369 - protein, 9 aa, Homo Sapiens
HNARKKLAE

SEQ ID NO: 963370 - protein, 9 aa, Homo Sapiens
PTMQQRFTL

SEQ ID NO: 963371 - protein, 9 aa, Homo Sapiens
YLPLEFEFA

SEQ ID NO: 963372 - protein, 9 aa, Homo Sapiens
RSVGRPSLL

SEQ ID NO: 963373 - protein, 9 aa, Homo Sapiens
TAADLLQQA

SEQ ID NO: 963374 - protein, 9 aa, Homo Sapiens
SLSSGYSSQ

SEQ ID NO: 963375 - protein, 9 aa, Homo Sapiens
PLLQKWVEK

SEQ ID NO: 963376 - protein, 9 aa, Homo Sapiens
SVRFLLLKD

SEQ ID NO: 963377 - protein, 9 aa, Homo Sapiens
TGYLPLEFE

SEQ ID NO: 963378 - protein, 9 aa, Homo Sapiens
EPQHLKEKP

SEQ ID NO: 963379 - protein, 9 aa, Homo Sapiens
CYNDKLLVC

SEQ ID NO: 963380 - protein, 9 aa, Homo Sapiens
SQNMPCVCY

SEQ ID NO: 963381 - protein, 9 aa, Homo Sapiens
GRSCNETIL

SEQ ID NO: 963382 - protein, 9 aa, Homo Sapiens
GLFPSSSAT

SEQ ID NO: 963383 - protein, 9 aa, Homo Sapiens
APKSFSKGD

SEQ ID NO: 963384 - protein, 9 aa, Homo Sapiens
GRLCNRTSL

SEQ ID NO: 963385 - protein, 9 aa, Homo Sapiens
ICGQEKGPG

SEQ ID NO: 963386 - protein, 9 aa, Homo Sapiens
RDSPLFLYT

SEQ ID NO: 963387 - protein, 9 aa, Homo Sapiens
EKVALLWHS

SEQ ID NO: 963388 - protein, 9 aa, Homo Sapiens
GCLQEAVIS

SEQ ID NO: 963389 - protein, 9 aa, Homo Sapiens
QTRAAVQNV

SEQ ID NO: 963390 - protein, 9 aa, Homo Sapiens
PLSDKFFDY

SEQ ID NO: 963391 - protein, 9 aa, Homo Sapiens
QNVRTLVLI

SEQ ID NO: 963392 - protein, 9 aa, Homo Sapiens
RLQNLIKND

SEQ ID NO: 963393 - protein, 9 aa, Homo Sapiens
TELFLTYVE

SEQ ID NO: 963394 - protein, 9 aa, Homo Sapiens
VGLFHEEAV

SEQ ID NO: 963395 - protein, 9 aa, Homo Sapiens
RLSLPLQTT

SEQ ID NO: 963396 - protein, 9 aa, Homo Sapiens
EEDGYTHQW

SEQ ID NO: 963397 - protein, 9 aa, Homo Sapiens
LDNPAENKR

SEQ ID NO: 963398 - protein, 9 aa, Homo Sapiens
DPSLTLEDY

SEQ ID NO: 963399 - protein, 9 aa, Homo Sapiens
NLLDQTRSS

SEQ ID NO: 963400 - protein, 9 aa, Homo Sapiens
YTAHLVRTF

SEQ ID NO: 963401 - protein, 9 aa, Homo Sapiens
PSNNSWNFV

SEQ ID NO: 963402 - protein, 9 aa, Homo Sapiens
SDGIVTVAN

SEQ ID NO: 963403 - protein, 9 aa, Homo Sapiens
HVRKLTLAS

SEQ ID NO: 963404 - protein, 9 aa, Homo Sapiens
KLAVVERLH

SEQ ID NO: 963405 - protein, 9 aa, Homo Sapiens
EPCNCVPDS

SEQ ID NO: 963406 - protein, 9 aa, Homo Sapiens
VTVMVDCID

SEQ ID NO: 963407 - protein, 9 aa, Homo Sapiens
DPTFSFETV

SEQ ID NO: 963408 - protein, 9 aa, Homo Sapiens
FSKEKTPES

SEQ ID NO: 963409 - protein, 9 aa, Homo Sapiens
RNCRYDVCF

SEQ ID NO: 963410 - protein, 9 aa, Homo Sapiens
VQRISDPSH

SEQ ID NO: 963411 - protein, 9 aa, Homo Sapiens
LDKALDQEE

SEQ ID NO: 963412 - protein, 9 aa, Homo Sapiens
AFYFQCVQR

SEQ ID NO: 963413 - protein, 9 aa, Homo Sapiens
RLGPKSFVL

SEQ ID NO: 963414 - protein, 9 aa, Homo Sapiens
FFSLQIMGP

SEQ ID NO: 963415 - protein, 9 aa, Homo Sapiens
DCVIKGQKY

SEQ ID NO: 963416 - protein, 9 aa, Homo Sapiens
LTQEKKFES

SEQ ID NO: 963417 - protein, 9 aa, Homo Sapiens
ANQTIATFG

SEQ ID NO: 963418 - protein, 9 aa, Homo Sapiens
IPCIFSFSA

SEQ ID NO: 963419 - protein, 9 aa, Homo Sapiens
KAQSHDCVS

SEQ ID NO: 963420 - protein, 9 aa, Homo Sapiens
QGCYPEGPI

SEQ ID NO: 963421 - protein, 9 aa, Homo Sapiens
AFVLEIPGN

SEQ ID NO: 963422 - protein, 9 aa, Homo Sapiens
KFIGQTLKL

SEQ ID NO: 963423 - protein, 9 aa, Homo Sapiens
GMTGCPGAA

SEQ ID NO: 963424 - protein, 9 aa, Homo Sapiens
AHLQGLVLV

SEQ ID NO: 963425 - protein, 9 aa, Homo Sapiens
IFSFFLGYL

SEQ ID NO: 963426 - protein, 9 aa, Homo Sapiens
LLFPTCQLK

SEQ ID NO: 963427 - protein, 9 aa, Homo Sapiens
GFYMAKPDM

SEQ ID NO: 963428 - protein, 9 aa, Homo Sapiens
LNLCDGDRW

SEQ ID NO: 963429 - protein, 9 aa, Homo Sapiens
KRWVLPALS

SEQ ID NO: 963430 - protein, 9 aa, Homo Sapiens
KAFLAEKFK

SEQ ID NO: 963431 - protein, 9 aa, Homo Sapiens
LDSCRTHRR

SEQ ID NO: 963432 - protein, 9 aa, Homo Sapiens
ILNFIRSRP

SEQ ID NO: 963433 - protein, 9 aa, Homo Sapiens
VTVSVNEWD

SEQ ID NO: 963434 - protein, 9 aa, Homo Sapiens
IPFFKQGLS

SEQ ID NO: 963435 - protein, 9 aa, Homo Sapiens
QDTPDAAPG

SEQ ID NO: 963436 - protein, 9 aa, Homo Sapiens
HAKERTRYF

SEQ ID NO: 963437 - protein, 9 aa, Homo Sapiens
WKRRSGGDW

SEQ ID NO: 963438 - protein, 9 aa, Homo Sapiens
LRKKGVDGG

SEQ ID NO: 963439 - protein, 9 aa, Homo Sapiens
RKKVGPELQ

SEQ ID NO: 963440 - protein, 9 aa, Homo Sapiens
LGSHRRDSD

SEQ ID NO: 963441 - protein, 9 aa, Homo Sapiens
TPNACLQST

SEQ ID NO: 963442 - protein, 9 aa, Homo Sapiens
HVVTDFIDN

SEQ ID NO: 963443 - protein, 9 aa, Homo Sapiens
GKLPAGALG

SEQ ID NO: 963444 - protein, 9 aa, Homo Sapiens
TDPSLLRKH

SEQ ID NO: 963445 - protein, 9 aa, Homo Sapiens
SYVTPAPHE

SEQ ID NO: 963446 - protein, 9 aa, Homo Sapiens
FREHKPQLG

SEQ ID NO: 963447 - protein, 9 aa, Homo Sapiens
ASRNTLFNF

SEQ ID NO: 963448 - protein, 9 aa, Homo Sapiens
VAGLECATP

SEQ ID NO: 963449 - protein, 9 aa, Homo Sapiens
QPQNSAGGR

SEQ ID NO: 963450 - protein, 9 aa, Homo Sapiens
IISGGVAER

SEQ ID NO: 963451 - protein, 9 aa, Homo Sapiens
VTVSLCSYS

SEQ ID NO: 963452 - protein, 9 aa, Homo Sapiens
DERTKLEDY

SEQ ID NO: 963453 - protein, 9 aa, Homo Sapiens
TLHTLCVGR

SEQ ID NO: 963454 - protein, 9 aa, Homo Sapiens
GPPGMTGCP

SEQ ID NO: 963455 - protein, 9 aa, Homo Sapiens
VLIVCTFTY

SEQ ID NO: 963456 - protein, 9 aa, Homo Sapiens
PEGPPPQRG

SEQ ID NO: 963457 - protein, 9 aa, Homo Sapiens
PGPLGQPGY

SEQ ID NO: 963458 - protein, 9 aa, Homo Sapiens
EACPRNLTW

SEQ ID NO: 963459 - protein, 9 aa, Homo Sapiens
HGSLFFRTP

SEQ ID NO: 963460 - protein, 9 aa, Homo Sapiens
LTAQNYVIQ

SEQ ID NO: 963461 - protein, 9 aa, Homo Sapiens
KSYDLKVSA

SEQ ID NO: 963462 - protein, 9 aa, Homo Sapiens
FIVRCFNLI

SEQ ID NO: 963463 - protein, 9 aa, Homo Sapiens
LSASTPLYQ

SEQ ID NO: 963464 - protein, 9 aa, Homo Sapiens
LSSLKNAVF

SEQ ID NO: 963465 - protein, 9 aa, Homo Sapiens
RLEKRLQQS

SEQ ID NO: 963466 - protein, 9 aa, Homo Sapiens
RRNAYQGVV

SEQ ID NO: 963467 - protein, 9 aa, Homo Sapiens
IVVSRMLVD

SEQ ID NO: 963468 - protein, 9 aa, Homo Sapiens
PVAKTVIEL

SEQ ID NO: 963469 - protein, 9 aa, Homo Sapiens
LNALEHLIE

SEQ ID NO: 963470 - protein, 9 aa, Homo Sapiens
SLLQKFAAC

SEQ ID NO: 963471 - protein, 9 aa, Homo Sapiens
SKVKTYGDN

SEQ ID NO: 963472 - protein, 9 aa, Homo Sapiens
ETVVLFKNK

SEQ ID NO: 963473 - protein, 9 aa, Homo Sapiens
FGYFLKDLI

SEQ ID NO: 963474 - protein, 9 aa, Homo Sapiens
VVKTHEPAF

SEQ ID NO: 963475 - protein, 9 aa, Homo Sapiens
IQKSGSLQG

SEQ ID NO: 963476 - protein, 9 aa, Homo Sapiens
RLGAAAGAG

SEQ ID NO: 963477 - protein, 9 aa, Homo Sapiens
QTARHTRWP

SEQ ID NO: 963478 - protein, 9 aa, Homo Sapiens
TAHNARKKL

SEQ ID NO: 963479 - protein, 9 aa, Homo Sapiens
NRLGAAAGA

SEQ ID NO: 963480 - protein, 9 aa, Homo Sapiens
EGLLRQVGK

SEQ ID NO: 963481 - protein, 9 aa, Homo Sapiens
NIPNLTALV

SEQ ID NO: 963482 - protein, 9 aa, Homo Sapiens
EKALDNSAC

SEQ ID NO: 963483 - protein, 9 aa, Homo Sapiens
AHEIKSPPS

SEQ ID NO: 963484 - protein, 9 aa, Homo Sapiens
QLQQEKHQF

SEQ ID NO: 963485 - protein, 9 aa, Homo Sapiens
PAKLDRGEG

SEQ ID NO: 963486 - protein, 9 aa, Homo Sapiens
DSPAPRLQL

SEQ ID NO: 963487 - protein, 9 aa, Homo Sapiens
RDTKFSDKE

SEQ ID NO: 963488 - protein, 9 aa, Homo Sapiens
QNGEDGGSP

SEQ ID NO: 963489 - protein, 9 aa, Homo Sapiens
PSPSCQPYL

SEQ ID NO: 963490 - protein, 9 aa, Homo Sapiens
KRIIEHYSS

SEQ ID NO: 963491 - protein, 9 aa, Homo Sapiens
PANGYSSTN

SEQ ID NO: 963492 - protein, 9 aa, Homo Sapiens
HRVVFFIPD

SEQ ID NO: 963493 - protein, 9 aa, Homo Sapiens
PKTVGLIHG

SEQ ID NO: 963494 - protein, 9 aa, Homo Sapiens
IKKWKEPCQ

SEQ ID NO: 963495 - protein, 9 aa, Homo Sapiens
FKEVAKSDP

SEQ ID NO: 963496 - protein, 9 aa, Homo Sapiens
QKGVTGEWA

SEQ ID NO: 963497 - protein, 9 aa, Homo Sapiens
FPTCQLKEL

SEQ ID NO: 963498 - protein, 9 aa, Homo Sapiens
ISFQEDKPA

SEQ ID NO: 963499 - protein, 9 aa, Homo Sapiens
RLNAIFSAL

SEQ ID NO: 963500 - protein, 9 aa, Homo Sapiens
DIAHGPPAQ

SEQ ID NO: 963501 - protein, 9 aa, Homo Sapiens
LCPATSFKE

SEQ ID NO: 963502 - protein, 9 aa, Homo Sapiens
LRKHTGSGI

SEQ ID NO: 963503 - protein, 9 aa, Homo Sapiens
LLGMLHSNC

SEQ ID NO: 963504 - protein, 9 aa, Homo Sapiens
QFLQSPYRS

SEQ ID NO: 963505 - protein, 9 aa, Homo Sapiens
ENRLGAAAG

SEQ ID NO: 963506 - protein, 9 aa, Homo Sapiens
RGPVAYALQ

SEQ ID NO: 963507 - protein, 9 aa, Homo Sapiens
GKVVNASKV

SEQ ID NO: 963508 - protein, 9 aa, Homo Sapiens
PETRNSPAP

SEQ ID NO: 963509 - protein, 9 aa, Homo Sapiens
ISSVSTFLF

SEQ ID NO: 963510 - protein, 9 aa, Homo Sapiens
ALVRRLQKR

SEQ ID NO: 963511 - protein, 9 aa, Homo Sapiens
GHSRVALAC

SEQ ID NO: 963512 - protein, 9 aa, Homo Sapiens
FLPEDGLTR

SEQ ID NO: 963513 - protein, 9 aa, Homo Sapiens
AKLQKMEAM

SEQ ID NO: 963514 - protein, 9 aa, Homo Sapiens
QVLLEGAEA

SEQ ID NO: 963515 - protein, 9 aa, Homo Sapiens
ALLLLLLSS

SEQ ID NO: 963516 - protein, 9 aa, Homo Sapiens
FPRTSSLNW

SEQ ID NO: 963517 - protein, 9 aa, Homo Sapiens
ESFSDGGDG

SEQ ID NO: 963518 - protein, 9 aa, Homo Sapiens
PCIFSFSAD

SEQ ID NO: 963519 - protein, 9 aa, Homo Sapiens
PGMRGPPPS

SEQ ID NO: 963520 - protein, 9 aa, Homo Sapiens
RSECKRNHK

SEQ ID NO: 963521 - protein, 9 aa, Homo Sapiens
VARCFHSPL

SEQ ID NO: 963522 - protein, 9 aa, Homo Sapiens
VPFVSKRVV

SEQ ID NO: 963523 - protein, 9 aa, Homo Sapiens
LIFWDQCTE

SEQ ID NO: 963524 - protein, 9 aa, Homo Sapiens
TKLKGPLAK

SEQ ID NO: 963525 - protein, 9 aa, Homo Sapiens
VLVRLRSAG

SEQ ID NO: 963526 - protein, 9 aa, Homo Sapiens
PLVKTKPQR

SEQ ID NO: 963527 - protein, 9 aa, Homo Sapiens
LLTLFHYSE

SEQ ID NO: 963528 - protein, 9 aa, Homo Sapiens
PDLSWASVN

SEQ ID NO: 963529 - protein, 9 aa, Homo Sapiens
ELRFLGLCL

SEQ ID NO: 963530 - protein, 9 aa, Homo Sapiens
NRKSKGRIV

SEQ ID NO: 963531 - protein, 9 aa, Homo Sapiens
AMSSNFLGI

SEQ ID NO: 963532 - protein, 9 aa, Homo Sapiens
LCLEDLARK

SEQ ID NO: 963533 - protein, 9 aa, Homo Sapiens
LENEQDQNF

SEQ ID NO: 963534 - protein, 9 aa, Homo Sapiens
FCAWEGCMK

SEQ ID NO: 963535 - protein, 9 aa, Homo Sapiens
PAADSYEET

SEQ ID NO: 963536 - protein, 9 aa, Homo Sapiens
AAWDAFFQP

SEQ ID NO: 963537 - protein, 9 aa, Homo Sapiens
PISFFLAIY

SEQ ID NO: 963538 - protein, 9 aa, Homo Sapiens
LLPASHSVS

SEQ ID NO: 963539 - protein, 9 aa, Homo Sapiens
YEISSVSTF

SEQ ID NO: 963540 - protein, 9 aa, Homo Sapiens
EHIYGEKKE

SEQ ID NO: 963541 - protein, 9 aa, Homo Sapiens
KRLALDVAN

SEQ ID NO: 963542 - protein, 9 aa, Homo Sapiens
VIFPGFDVF

SEQ ID NO: 963543 - protein, 9 aa, Homo Sapiens
DLSINFLMV

SEQ ID NO: 963544 - protein, 9 aa, Homo Sapiens
LYNKCQDLK

SEQ ID NO: 963545 - protein, 9 aa, Homo Sapiens
SPRARGPFA

SEQ ID NO: 963546 - protein, 9 aa, Homo Sapiens
EIYSLTNMK

SEQ ID NO: 963547 - protein, 9 aa, Homo Sapiens
RRSVVGTSA

SEQ ID NO: 963548 - protein, 9 aa, Homo Sapiens
PGMEIANCY

SEQ ID NO: 963549 - protein, 9 aa, Homo Sapiens
LPNITLRYQ

SEQ ID NO: 963550 - protein, 9 aa, Homo Sapiens
DLPELSEQD

SEQ ID NO: 963551 - protein, 9 aa, Homo Sapiens
RWAPITCSM

SEQ ID NO: 963552 - protein, 9 aa, Homo Sapiens
RAESTSLVI

SEQ ID NO: 963553 - protein, 9 aa, Homo Sapiens
HVLTVKKSD

SEQ ID NO: 963554 - protein, 9 aa, Homo Sapiens
VEGLLYKHL

SEQ ID NO: 963555 - protein, 9 aa, Homo Sapiens
HELILNFIR

SEQ ID NO: 963556 - protein, 9 aa, Homo Sapiens
LNSILDDNK

SEQ ID NO: 963557 - protein, 9 aa, Homo Sapiens
GGPCNSPRS

SEQ ID NO: 963558 - protein, 9 aa, Homo Sapiens
LGDDPTFSF

SEQ ID NO: 963559 - protein, 9 aa, Homo Sapiens
GLTGMLSNL

SEQ ID NO: 963560 - protein, 9 aa, Homo Sapiens
YSQVIPIEE

SEQ ID NO: 963561 - protein, 9 aa, Homo Sapiens
TEAVGPGGL

SEQ ID NO: 963562 - protein, 9 aa, Homo Sapiens
KCRMAYQDH

SEQ ID NO: 963563 - protein, 9 aa, Homo Sapiens
KKSSTVATL

SEQ ID NO: 963564 - protein, 9 aa, Homo Sapiens
SRSSPRVSS

SEQ ID NO: 963565 - protein, 9 aa, Homo Sapiens
NARLIRNLQ

SEQ ID NO: 963566 - protein, 9 aa, Homo Sapiens
MLSSFLLPV

SEQ ID NO: 963567 - protein, 9 aa, Homo Sapiens
LLCRYLTTP

SEQ ID NO: 963568 - protein, 9 aa, Homo Sapiens
TAGLRAPLN

SEQ ID NO: 963569 - protein, 9 aa, Homo Sapiens
PAILGKMAP

SEQ ID NO: 963570 - protein, 9 aa, Homo Sapiens
SSFISYLVV

SEQ ID NO: 963571 - protein, 9 aa, Homo Sapiens
WFVGVDSLN

SEQ ID NO: 963572 - protein, 9 aa, Homo Sapiens
FLIFWDQCT

SEQ ID NO: 963573 - protein, 9 aa, Homo Sapiens
WGCLQEAVI

SEQ ID NO: 963574 - protein, 9 aa, Homo Sapiens
EGARYGLSL

SEQ ID NO: 963575 - protein, 9 aa, Homo Sapiens
HYRLQNVKA

SEQ ID NO: 963576 - protein, 9 aa, Homo Sapiens
VTKEFFFCC

SEQ ID NO: 963577 - protein, 9 aa, Homo Sapiens
IDKEIPSMA

SEQ ID NO: 963578 - protein, 9 aa, Homo Sapiens
GSDMNFVYE

SEQ ID NO: 963579 - protein, 9 aa, Homo Sapiens
SKLNYETSH

SEQ ID NO: 963580 - protein, 9 aa, Homo Sapiens
RQSSRAVWW

SEQ ID NO: 963581 - protein, 9 aa, Homo Sapiens
GCPGAAGRT

SEQ ID NO: 963582 - protein, 9 aa, Homo Sapiens
KRRSSLSKD

SEQ ID NO: 963583 - protein, 9 aa, Homo Sapiens
HSACVQLFD

SEQ ID NO: 963584 - protein, 9 aa, Homo Sapiens
KYLKSFHNS

SEQ ID NO: 963585 - protein, 9 aa, Homo Sapiens
DDGNESEVV

SEQ ID NO: 963586 - protein, 9 aa, Homo Sapiens
LVEDTYNGL

SEQ ID NO: 963587 - protein, 9 aa, Homo Sapiens
VSETPPFSG

SEQ ID NO: 963588 - protein, 9 aa, Homo Sapiens
KSGTVFYLN

SEQ ID NO: 963589 - protein, 9 aa, Homo Sapiens
EPDTCALAS

SEQ ID NO: 963590 - protein, 9 aa, Homo Sapiens
VLAANLGIV

SEQ ID NO: 963591 - protein, 9 aa, Homo Sapiens
SSTRRRKCA

SEQ ID NO: 963592 - protein, 9 aa, Homo Sapiens
RHSKQASTM

SEQ ID NO: 963593 - protein, 9 aa, Homo Sapiens
GLGSAAPPD

SEQ ID NO: 963594 - protein, 9 aa, Homo Sapiens
RIEQPRNCD

SEQ ID NO: 963595 - protein, 9 aa, Homo Sapiens
DSEFEFLKT

SEQ ID NO: 963596 - protein, 9 aa, Homo Sapiens
KRKEWVLTI

SEQ ID NO: 963597 - protein, 9 aa, Homo Sapiens
TCSFQKPKQ

SEQ ID NO: 963598 - protein, 9 aa, Homo Sapiens
PLLFNMNAM

SEQ ID NO: 963599 - protein, 9 aa, Homo Sapiens
CSMTALLDP

SEQ ID NO: 963600 - protein, 9 aa, Homo Sapiens
QETLYVGNE

SEQ ID NO: 963601 - protein, 9 aa, Homo Sapiens
QRHVERRKA

SEQ ID NO: 963602 - protein, 9 aa, Homo Sapiens
EKSTLQHEA

SEQ ID NO: 963603 - protein, 9 aa, Homo Sapiens
ILKPQMLWE

SEQ ID NO: 963604 - protein, 9 aa, Homo Sapiens
MLERKLPCC

SEQ ID NO: 963605 - protein, 9 aa, Homo Sapiens
YARIFFSTA

SEQ ID NO: 963606 - protein, 9 aa, Homo Sapiens
NEYNAVKKR

SEQ ID NO: 963607 - protein, 9 aa, Homo Sapiens
VLVSREPGS

SEQ ID NO: 963608 - protein, 9 aa, Homo Sapiens
VVFYTTAFD

SEQ ID NO: 963609 - protein, 9 aa, Homo Sapiens
PKQLQQQKS

SEQ ID NO: 963610 - protein, 9 aa, Homo Sapiens
GVGILPPPP

SEQ ID NO: 963611 - protein, 9 aa, Homo Sapiens
IMMETAQTF

SEQ ID NO: 963612 - protein, 9 aa, Homo Sapiens
ELAKLKTRV

SEQ ID NO: 963613 - protein, 9 aa, Homo Sapiens
RNAMFVKEQ

SEQ ID NO: 963614 - protein, 9 aa, Homo Sapiens
VKCLIGVNY

SEQ ID NO: 963615 - protein, 9 aa, Homo Sapiens
LSPPLSDKF

SEQ ID NO: 963616 - protein, 9 aa, Homo Sapiens
ENFLGKKRE

SEQ ID NO: 963617 - protein, 9 aa, Homo Sapiens
VLEDLLRTP

SEQ ID NO: 963618 - protein, 9 aa, Homo Sapiens
QGKQGGKAR

SEQ ID NO: 963619 - protein, 9 aa, Homo Sapiens
LYADDPVRH

SEQ ID NO: 963620 - protein, 9 aa, Homo Sapiens
SGHGDCISE

SEQ ID NO: 963621 - protein, 9 aa, Homo Sapiens
YVVIIAYVL

SEQ ID NO: 963622 - protein, 9 aa, Homo Sapiens
KDADPYVQP

SEQ ID NO: 963623 - protein, 9 aa, Homo Sapiens
FTKLFSQNC

SEQ ID NO: 963624 - protein, 9 aa, Homo Sapiens
NNSVLFPSS

SEQ ID NO: 963625 - protein, 9 aa, Homo Sapiens
ELSEQDVRD

SEQ ID NO: 963626 - protein, 9 aa, Homo Sapiens
RELVLPDTL

SEQ ID NO: 963627 - protein, 9 aa, Homo Sapiens
IRNQEELKG

SEQ ID NO: 963628 - protein, 9 aa, Homo Sapiens
RTWCKGTRH

SEQ ID NO: 963629 - protein, 9 aa, Homo Sapiens
YSVCMGTKT

SEQ ID NO: 963630 - protein, 9 aa, Homo Sapiens
HEEKSLSPE

SEQ ID NO: 963631 - protein, 9 aa, Homo Sapiens
CSVEKRQSP

SEQ ID NO: 963632 - protein, 9 aa, Homo Sapiens
SKACDTKVL

SEQ ID NO: 963633 - protein, 9 aa, Homo Sapiens
LGDAAGHPG

SEQ ID NO: 963634 - protein, 9 aa, Homo Sapiens
NHLCFYFFF

SEQ ID NO: 963635 - protein, 9 aa, Homo Sapiens
HISRNSWLK

SEQ ID NO: 963636 - protein, 9 aa, Homo Sapiens
STKTLFQPL

SEQ ID NO: 963637 - protein, 9 aa, Homo Sapiens
GPTKSPTSW

SEQ ID NO: 963638 - protein, 9 aa, Homo Sapiens
CCVCPMCNK

SEQ ID NO: 963639 - protein, 9 aa, Homo Sapiens
DAHPCNPGF

SEQ ID NO: 963640 - protein, 9 aa, Homo Sapiens
GSGISSRSS

SEQ ID NO: 963641 - protein, 9 aa, Homo Sapiens
AYQGVVYSA

SEQ ID NO: 963642 - protein, 9 aa, Homo Sapiens
LRTTEINFK

SEQ ID NO: 963643 - protein, 9 aa, Homo Sapiens
PQLHAAATA

SEQ ID NO: 963644 - protein, 9 aa, Homo Sapiens
SYGAIVQAI

SEQ ID NO: 963645 - protein, 9 aa, Homo Sapiens
KVLCAMTDE

SEQ ID NO: 963646 - protein, 9 aa, Homo Sapiens
LFLGIYVIT

SEQ ID NO: 963647 - protein, 9 aa, Homo Sapiens
ASSWWPTPA

SEQ ID NO: 963648 - protein, 9 aa, Homo Sapiens
SLKKIGLLI

SEQ ID NO: 963649 - protein, 9 aa, Homo Sapiens
GRFSSLLQA

SEQ ID NO: 963650 - protein, 9 aa, Homo Sapiens
FLLENPLKL

SEQ ID NO: 963651 - protein, 9 aa, Homo Sapiens
CIYAPEAPY

SEQ ID NO: 963652 - protein, 9 aa, Homo Sapiens
RRGPEHRSA

SEQ ID NO: 963653 - protein, 9 aa, Homo Sapiens
DPSKAWGQV

SEQ ID NO: 963654 - protein, 9 aa, Homo Sapiens
SLEGGHTDS

SEQ ID NO: 963655 - protein, 9 aa, Homo Sapiens
PFPPISFFL

SEQ ID NO: 963656 - protein, 9 aa, Homo Sapiens
SYEEVFKER

SEQ ID NO: 963657 - protein, 9 aa, Homo Sapiens
SKEKTPESG

SEQ ID NO: 963658 - protein, 9 aa, Homo Sapiens
SIDARGSTS

SEQ ID NO: 963659 - protein, 9 aa, Homo Sapiens
VWPGFYLGD

SEQ ID NO: 963660 - protein, 9 aa, Homo Sapiens
LCFYFFFLG

SEQ ID NO: 963661 - protein, 9 aa, Homo Sapiens
KINITSIAP

SEQ ID NO: 963662 - protein, 9 aa, Homo Sapiens
LRLNAIFSA

SEQ ID NO: 963663 - protein, 9 aa, Homo Sapiens
EKTTVFKFL

SEQ ID NO: 963664 - protein, 9 aa, Homo Sapiens
SALLEEVAP

SEQ ID NO: 963665 - protein, 9 aa, Homo Sapiens
EMYEDIQPA

SEQ ID NO: 963666 - protein, 9 aa, Homo Sapiens
IWRKQGYEH

SEQ ID NO: 963667 - protein, 9 aa, Homo Sapiens
KVFRLRDRD

SEQ ID NO: 963668 - protein, 9 aa, Homo Sapiens
PNTVFIGGI

SEQ ID NO: 963669 - protein, 9 aa, Homo Sapiens
KRRLQHLTS

SEQ ID NO: 963670 - protein, 9 aa, Homo Sapiens
NLCSVEKRQ

SEQ ID NO: 963671 - protein, 9 aa, Homo Sapiens
LIKNDSGVY

SEQ ID NO: 963672 - protein, 9 aa, Homo Sapiens
QVGKVCRQD

SEQ ID NO: 963673 - protein, 9 aa, Homo Sapiens
CNRTFKKTF

SEQ ID NO: 963674 - protein, 9 aa, Homo Sapiens
LRAPLNIEC

SEQ ID NO: 963675 - protein, 9 aa, Homo Sapiens
TIKRSLNPE

SEQ ID NO: 963676 - protein, 9 aa, Homo Sapiens
ELLLQVCWL

SEQ ID NO: 963677 - protein, 9 aa, Homo Sapiens
PGAAHEIKS

SEQ ID NO: 963678 - protein, 9 aa, Homo Sapiens
LLTYLIKVL

SEQ ID NO: 963679 - protein, 9 aa, Homo Sapiens
LKNAVFKLK

SEQ ID NO: 963680 - protein, 9 aa, Homo Sapiens
ESRLASTLE

SEQ ID NO: 963681 - protein, 9 aa, Homo Sapiens
LDEEGSDPS

SEQ ID NO: 963682 - protein, 9 aa, Homo Sapiens
DPAGRDGAP

SEQ ID NO: 963683 - protein, 9 aa, Homo Sapiens
MAGLKFINL

SEQ ID NO: 963684 - protein, 9 aa, Homo Sapiens
FSRWAKTNG

SEQ ID NO: 963685 - protein, 9 aa, Homo Sapiens
VFSLPFVQA

SEQ ID NO: 963686 - protein, 9 aa, Homo Sapiens
GDGPQYFFP

SEQ ID NO: 963687 - protein, 9 aa, Homo Sapiens
ESWFKEGAD

SEQ ID NO: 963688 - protein, 9 aa, Homo Sapiens
GGLVPNLGP

SEQ ID NO: 963689 - protein, 9 aa, Homo Sapiens
WIENLNSIL

SEQ ID NO: 963690 - protein, 9 aa, Homo Sapiens
FFQRELLIQ

SEQ ID NO: 963691 - protein, 9 aa, Homo Sapiens
IEEFPGPPG

SEQ ID NO: 963692 - protein, 9 aa, Homo Sapiens
IEIPFFKQG

SEQ ID NO: 963693 - protein, 9 aa, Homo Sapiens
GEPGPLGQP

SEQ ID NO: 963694 - protein, 9 aa, Homo Sapiens
SGSGNEGEG

SEQ ID NO: 963695 - protein, 9 aa, Homo Sapiens
SVRRGSEAP

SEQ ID NO: 963696 - protein, 9 aa, Homo Sapiens
SDDFYIFGS

SEQ ID NO: 963697 - protein, 9 aa, Homo Sapiens
DMESTGCSL

SEQ ID NO: 963698 - protein, 9 aa, Homo Sapiens
ALSPKESTS

SEQ ID NO: 963699 - protein, 9 aa, Homo Sapiens
SFASQSRGY

SEQ ID NO: 963700 - protein, 9 aa, Homo Sapiens
RRDSDLGAQ

SEQ ID NO: 963701 - protein, 9 aa, Homo Sapiens
LPLLVTALL

SEQ ID NO: 963702 - protein, 9 aa, Homo Sapiens
IKEKLDALW

SEQ ID NO: 963703 - protein, 9 aa, Homo Sapiens
KSPLTKTEQ

SEQ ID NO: 963704 - protein, 9 aa, Homo Sapiens
FSINDRIKE

SEQ ID NO: 963705 - protein, 9 aa, Homo Sapiens
RGKWQERLT

SEQ ID NO: 963706 - protein, 9 aa, Homo Sapiens
VLIGQENTL

SEQ ID NO: 963707 - protein, 9 aa, Homo Sapiens
NKPASFFKE

SEQ ID NO: 963708 - protein, 9 aa, Homo Sapiens
KSGKGLGKK

SEQ ID NO: 963709 - protein, 9 aa, Homo Sapiens
PQHLKEKPF

SEQ ID NO: 963710 - protein, 9 aa, Homo Sapiens
AADSYEETL

SEQ ID NO: 963711 - protein, 9 aa, Homo Sapiens
VFTMLADIE

SEQ ID NO: 963712 - protein, 9 aa, Homo Sapiens
LRFLLENPL

SEQ ID NO: 963713 - protein, 9 aa, Homo Sapiens
KAIQNPRLF

SEQ ID NO: 963714 - protein, 9 aa, Homo Sapiens
RKVPNLSVF

SEQ ID NO: 963715 - protein, 9 aa, Homo Sapiens
KEPLDKEET

SEQ ID NO: 963716 - protein, 9 aa, Homo Sapiens
PRESSPDAT

SEQ ID NO: 963717 - protein, 9 aa, Homo Sapiens
KLEQGDIKI

SEQ ID NO: 963718 - protein, 9 aa, Homo Sapiens
SMPSVRFLL

SEQ ID NO: 963719 - protein, 9 aa, Homo Sapiens
TTERRSSGH

SEQ ID NO: 963720 - protein, 9 aa, Homo Sapiens
SSFASQSRG

SEQ ID NO: 963721 - protein, 9 aa, Homo Sapiens
ITILRPQGR

SEQ ID NO: 963722 - protein, 9 aa, Homo Sapiens
MNFVYERQG

SEQ ID NO: 963723 - protein, 9 aa, Homo Sapiens
CFSCPTLAK

SEQ ID NO: 963724 - protein, 9 aa, Homo Sapiens
VAAVQEFYL

SEQ ID NO: 963725 - protein, 9 aa, Homo Sapiens
LPAACEKAR

SEQ ID NO: 963726 - protein, 9 aa, Homo Sapiens
QRRNLRSHT

SEQ ID NO: 963727 - protein, 9 aa, Homo Sapiens
AGFPPAVAA

SEQ ID NO: 963728 - protein, 9 aa, Homo Sapiens
HSKQASTMA

SEQ ID NO: 963729 - protein, 9 aa, Homo Sapiens
LQSTLWPHS

SEQ ID NO: 963730 - protein, 9 aa, Homo Sapiens
AAQDTPDAA

SEQ ID NO: 963731 - protein, 9 aa, Homo Sapiens
PTQPSSGPG

SEQ ID NO: 963732 - protein, 9 aa, Homo Sapiens
FLGIYVITV

SEQ ID NO: 963733 - protein, 9 aa, Homo Sapiens
PSLGVPPKR

SEQ ID NO: 963734 - protein, 9 aa, Homo Sapiens
RCIVNNLAE

SEQ ID NO: 963735 - protein, 9 aa, Homo Sapiens
PKELSPPLS

SEQ ID NO: 963736 - protein, 9 aa, Homo Sapiens
KTQMSFQQV

SEQ ID NO: 963737 - protein, 9 aa, Homo Sapiens
IVGNLDMIT

SEQ ID NO: 963738 - protein, 9 aa, Homo Sapiens
SWGDCAEPS

SEQ ID NO: 963739 - protein, 9 aa, Homo Sapiens
QLTPPNSMP

SEQ ID NO: 963740 - protein, 9 aa, Homo Sapiens
PATSFKEVP

SEQ ID NO: 963741 - protein, 9 aa, Homo Sapiens
VRRNLVLVT

SEQ ID NO: 963742 - protein, 9 aa, Homo Sapiens
LTTALPFMA

SEQ ID NO: 963743 - protein, 9 aa, Homo Sapiens
TDSSVDEIP

SEQ ID NO: 963744 - protein, 9 aa, Homo Sapiens
DTKFSDKEK

SEQ ID NO: 963745 - protein, 9 aa, Homo Sapiens
LAPPPVDDS

SEQ ID NO: 963746 - protein, 9 aa, Homo Sapiens
IEVLTQLSE

SEQ ID NO: 963747 - protein, 9 aa, Homo Sapiens
KWVEKADNN

SEQ ID NO: 963748 - protein, 9 aa, Homo Sapiens
LPAGALGTP

SEQ ID NO: 963749 - protein, 9 aa, Homo Sapiens
IQERENLTV

SEQ ID NO: 963750 - protein, 9 aa, Homo Sapiens
EEEMEEVGE

SEQ ID NO: 963751 - protein, 9 aa, Homo Sapiens
KKIGLLISA

SEQ ID NO: 963752 - protein, 9 aa, Homo Sapiens
EKEEEEEDD

SEQ ID NO: 963753 - protein, 9 aa, Homo Sapiens
IDEQVEDEV

SEQ ID NO: 963754 - protein, 9 aa, Homo Sapiens
NINPRDIKP

SEQ ID NO: 963755 - protein, 9 aa, Homo Sapiens
VLKFLLSNL

SEQ ID NO: 963756 - protein, 9 aa, Homo Sapiens
QYLTCGEES

SEQ ID NO: 963757 - protein, 9 aa, Homo Sapiens
YWMVPELIS

SEQ ID NO: 963758 - protein, 9 aa, Homo Sapiens
VITPNACLQ

SEQ ID NO: 963759 - protein, 9 aa, Homo Sapiens
SYIDFKLEQ

SEQ ID NO: 963760 - protein, 9 aa, Homo Sapiens
NSTQGEIHV

SEQ ID NO: 963761 - protein, 9 aa, Homo Sapiens
DPSPRQRTC

SEQ ID NO: 963762 - protein, 9 aa, Homo Sapiens
SPQENSFLE

SEQ ID NO: 963763 - protein, 9 aa, Homo Sapiens
KVAARGLFL

SEQ ID NO: 963764 - protein, 9 aa, Homo Sapiens
LLEEVAPNP

SEQ ID NO: 963765 - protein, 9 aa, Homo Sapiens
ERKASIQDF

SEQ ID NO: 963766 - protein, 9 aa, Homo Sapiens
VPCRALKRK

SEQ ID NO: 963767 - protein, 9 aa, Homo Sapiens
FVTSIYSSG

SEQ ID NO: 963768 - protein, 9 aa, Homo Sapiens
RDLEKSTLQ

SEQ ID NO: 963769 - protein, 9 aa, Homo Sapiens
LCNGSSRTA

SEQ ID NO: 963770 - protein, 9 aa, Homo Sapiens
SSFKDVRQR

SEQ ID NO: 963771 - protein, 9 aa, Homo Sapiens
DSNSSTGTS

SEQ ID NO: 963772 - protein, 9 aa, Homo Sapiens
DSDIPEILP

SEQ ID NO: 963773 - protein, 9 aa, Homo Sapiens
YYFSSPSFL

SEQ ID NO: 963774 - protein, 9 aa, Homo Sapiens
TSQVPGKHV

SEQ ID NO: 963775 - protein, 9 aa, Homo Sapiens
SQLLPKFRE

SEQ ID NO: 963776 - protein, 9 aa, Homo Sapiens
AVFPETMTR

SEQ ID NO: 963777 - protein, 9 aa, Homo Sapiens
CKQPCQPPS

SEQ ID NO: 963778 - protein, 9 aa, Homo Sapiens
TPLQPFYSS

SEQ ID NO: 963779 - protein, 9 aa, Homo Sapiens
MDQDDNQTG

SEQ ID NO: 963780 - protein, 9 aa, Homo Sapiens
THEPAFFNL

SEQ ID NO: 963781 - protein, 9 aa, Homo Sapiens
IFVNYYSNL

SEQ ID NO: 963782 - protein, 9 aa, Homo Sapiens
RHVERRKAE

SEQ ID NO: 963783 - protein, 9 aa, Homo Sapiens
SQVPGKHVY

SEQ ID NO: 963784 - protein, 9 aa, Homo Sapiens
FVHPKMRPL

SEQ ID NO: 963785 - protein, 9 aa, Homo Sapiens
SCIRHLVHS

SEQ ID NO: 963786 - protein, 9 aa, Homo Sapiens
GKQPQNSAG

SEQ ID NO: 963787 - protein, 9 aa, Homo Sapiens
KWLEVCCVC

SEQ ID NO: 963788 - protein, 9 aa, Homo Sapiens
SSTQSCDSK

SEQ ID NO: 963789 - protein, 9 aa, Homo Sapiens
WKPEGRVGG

SEQ ID NO: 963790 - protein, 9 aa, Homo Sapiens
SISWQHISP

SEQ ID NO: 963791 - protein, 9 aa, Homo Sapiens
IRDEKKDPD

SEQ ID NO: 963792 - protein, 9 aa, Homo Sapiens
GRQGQPVEI

SEQ ID NO: 963793 - protein, 9 aa, Homo Sapiens
SSVSTFLFF

SEQ ID NO: 963794 - protein, 9 aa, Homo Sapiens
SADVEVPDG

SEQ ID NO: 963795 - protein, 9 aa, Homo Sapiens
EDYANLKQF

SEQ ID NO: 963796 - protein, 9 aa, Homo Sapiens
NPRDIKPAA

SEQ ID NO: 963797 - protein, 9 aa, Homo Sapiens
PALRDKHWH

SEQ ID NO: 963798 - protein, 9 aa, Homo Sapiens
EEARINSSN

SEQ ID NO: 963799 - protein, 9 aa, Homo Sapiens
TPFLTTKAV

SEQ ID NO: 963800 - protein, 9 aa, Homo Sapiens
LRLQNLIKN

SEQ ID NO: 963801 - protein, 9 aa, Homo Sapiens
ADIFCIYAP

SEQ ID NO: 963802 - protein, 9 aa, Homo Sapiens
IEEFNLHLT

SEQ ID NO: 963803 - protein, 9 aa, Homo Sapiens
WRGQEEGMD

SEQ ID NO: 963804 - protein, 9 aa, Homo Sapiens
TFTCLTSAH

SEQ ID NO: 963805 - protein, 9 aa, Homo Sapiens
SMILIEKAQ

SEQ ID NO: 963806 - protein, 9 aa, Homo Sapiens
DQKEEEVCG

SEQ ID NO: 963807 - protein, 9 aa, Homo Sapiens
TKSTVSVRR

SEQ ID NO: 963808 - protein, 9 aa, Homo Sapiens
GDPGEEEKH

SEQ ID NO: 963809 - protein, 9 aa, Homo Sapiens
SSRMLPPCT

SEQ ID NO: 963810 - protein, 9 aa, Homo Sapiens
PPGRQEKEN

SEQ ID NO: 963811 - protein, 9 aa, Homo Sapiens
SGTVFYLNT

SEQ ID NO: 963812 - protein, 9 aa, Homo Sapiens
LTVQMKNTY

SEQ ID NO: 963813 - protein, 9 aa, Homo Sapiens
FFQQGSPAS

SEQ ID NO: 963814 - protein, 9 aa, Homo Sapiens
GTAISDPPK

SEQ ID NO: 963815 - protein, 9 aa, Homo Sapiens
MIFARRSDR

SEQ ID NO: 963816 - protein, 9 aa, Homo Sapiens
PAFSRAPPV

SEQ ID NO: 963817 - protein, 9 aa, Homo Sapiens
VLYSRFMGT

SEQ ID NO: 963818 - protein, 9 aa, Homo Sapiens
FFKTAQDIV

SEQ ID NO: 963819 - protein, 9 aa, Homo Sapiens
RPHTFQFIG

SEQ ID NO: 963820 - protein, 9 aa, Homo Sapiens
LVPGPAPAP

SEQ ID NO: 963821 - protein, 9 aa, Homo Sapiens
GDDCDCLHP

SEQ ID NO: 963822 - protein, 9 aa, Homo Sapiens
SNSTNLLPT

SEQ ID NO: 963823 - protein, 9 aa, Homo Sapiens
KALDQEEQE

SEQ ID NO: 963824 - protein, 9 aa, Homo Sapiens
SHSALFSPR

SEQ ID NO: 963825 - protein, 9 aa, Homo Sapiens
VFNEHSSRR

SEQ ID NO: 963826 - protein, 9 aa, Homo Sapiens
QQPPGLVPG

SEQ ID NO: 963827 - protein, 9 aa, Homo Sapiens
AYQHGNLFM

SEQ ID NO: 963828 - protein, 9 aa, Homo Sapiens
KIRKTVSGT

SEQ ID NO: 963829 - protein, 9 aa, Homo Sapiens
PKGSKGEPE

SEQ ID NO: 963830 - protein, 9 aa, Homo Sapiens
NNQIEQFLV

SEQ ID NO: 963831 - protein, 9 aa, Homo Sapiens
KRVDASDST

SEQ ID NO: 963832 - protein, 9 aa, Homo Sapiens
EKCWKAYIW

SEQ ID NO: 963833 - protein, 9 aa, Homo Sapiens
YPRFVQLGQ

SEQ ID NO: 963834 - protein, 9 aa, Homo Sapiens
LYLEKRVKK

SEQ ID NO: 963835 - protein, 9 aa, Homo Sapiens
ENSEGGEKE

SEQ ID NO: 963836 - protein, 9 aa, Homo Sapiens
RRNLRSHTG

SEQ ID NO: 963837 - protein, 9 aa, Homo Sapiens
VALSSYYFC

SEQ ID NO: 963838 - protein, 9 aa, Homo Sapiens
TREEEMIYQ

SEQ ID NO: 963839 - protein, 9 aa, Homo Sapiens
SDRTPVVSL

SEQ ID NO: 963840 - protein, 9 aa, Homo Sapiens
WDVPQKHSS

SEQ ID NO: 963841 - protein, 9 aa, Homo Sapiens
NNRKSKGRI

SEQ ID NO: 963842 - protein, 9 aa, Homo Sapiens
HFYSGTGVR

SEQ ID NO: 963843 - protein, 9 aa, Homo Sapiens
VLAQQRALA

SEQ ID NO: 963844 - protein, 9 aa, Homo Sapiens
PKDFKVRSL

SEQ ID NO: 963845 - protein, 9 aa, Homo Sapiens
PEVEAAEPK

SEQ ID NO: 963846 - protein, 9 aa, Homo Sapiens
SDVEYEIRV

SEQ ID NO: 963847 - protein, 9 aa, Homo Sapiens
PFTHWNFDP

SEQ ID NO: 963848 - protein, 9 aa, Homo Sapiens
QDFLQMFLP

SEQ ID NO: 963849 - protein, 9 aa, Homo Sapiens
EEELAKLKT

SEQ ID NO: 963850 - protein, 9 aa, Homo Sapiens
YGLGSPAMQ

SEQ ID NO: 963851 - protein, 9 aa, Homo Sapiens
ASWLMSLEN

SEQ ID NO: 963852 - protein, 9 aa, Homo Sapiens
KYLEPRCLR

SEQ ID NO: 963853 - protein, 9 aa, Homo Sapiens
QYKINITSI

SEQ ID NO: 963854 - protein, 9 aa, Homo Sapiens
EAATREQRI

SEQ ID NO: 963855 - protein, 9 aa, Homo Sapiens
LGRPSLCLL

SEQ ID NO: 963856 - protein, 9 aa, Homo Sapiens
FQLELSQKG

SEQ ID NO: 963857 - protein, 9 aa, Homo Sapiens
TIFELENEV

SEQ ID NO: 963858 - protein, 9 aa, Homo Sapiens
SNLTVIYTF

SEQ ID NO: 963859 - protein, 9 aa, Homo Sapiens
YNNRKSKGR

SEQ ID NO: 963860 - protein, 9 aa, Homo Sapiens
IDKYMLHLL

SEQ ID NO: 963861 - protein, 9 aa, Homo Sapiens
SVVGTSAYL

SEQ ID NO: 963862 - protein, 9 aa, Homo Sapiens
FLLLKDNLW

SEQ ID NO: 963863 - protein, 9 aa, Homo Sapiens
KHIKGERAQ

SEQ ID NO: 963864 - protein, 9 aa, Homo Sapiens
ILVFTMLAD

SEQ ID NO: 963865 - protein, 9 aa, Homo Sapiens
AQSEEKQGI

SEQ ID NO: 963866 - protein, 9 aa, Homo Sapiens
SRPRVRAQP

SEQ ID NO: 963867 - protein, 9 aa, Homo Sapiens
GTNVCSVYS

SEQ ID NO: 963868 - protein, 9 aa, Homo Sapiens
AYPAILGKM

SEQ ID NO: 963869 - protein, 9 aa, Homo Sapiens
LRLGPKSFV

SEQ ID NO: 963870 - protein, 9 aa, Homo Sapiens
FFLEEWQCL

SEQ ID NO: 963871 - protein, 9 aa, Homo Sapiens
CSKSDDFYI

SEQ ID NO: 963872 - protein, 9 aa, Homo Sapiens
AGAKEKARK

SEQ ID NO: 963873 - protein, 9 aa, Homo Sapiens
LNTGKECED

SEQ ID NO: 963874 - protein, 9 aa, Homo Sapiens
PLGSPPGKK

SEQ ID NO: 963875 - protein, 9 aa, Homo Sapiens
AALKVAARG

SEQ ID NO: 963876 - protein, 9 aa, Homo Sapiens
HLQGLVLVT

SEQ ID NO: 963877 - protein, 9 aa, Homo Sapiens
PPGVATEAV

SEQ ID NO: 963878 - protein, 9 aa, Homo Sapiens
NLLFQLIAE

SEQ ID NO: 963879 - protein, 9 aa, Homo Sapiens
NLLSHPPPD

SEQ ID NO: 963880 - protein, 9 aa, Homo Sapiens
SSPDNFWYL

SEQ ID NO: 963881 - protein, 9 aa, Homo Sapiens
PCCLWPRSG

SEQ ID NO: 963882 - protein, 9 aa, Homo Sapiens
GEKVNTSSV

SEQ ID NO: 963883 - protein, 9 aa, Homo Sapiens
KGEEEYLEI

SEQ ID NO: 963884 - protein, 9 aa, Homo Sapiens
GPRSTPFLT

SEQ ID NO: 963885 - protein, 9 aa, Homo Sapiens
INQGSYGWQ

SEQ ID NO: 963886 - protein, 9 aa, Homo Sapiens
DDSSLLNLA

SEQ ID NO: 963887 - protein, 9 aa, Homo Sapiens
PGDEHAENA

SEQ ID NO: 963888 - protein, 9 aa, Homo Sapiens
WEITLPALF

SEQ ID NO: 963889 - protein, 9 aa, Homo Sapiens
SPIHFYSGT

SEQ ID NO: 963890 - protein, 9 aa, Homo Sapiens
SKRANICPH

SEQ ID NO: 963891 - protein, 9 aa, Homo Sapiens
AARSECKRN

SEQ ID NO: 963892 - protein, 9 aa, Homo Sapiens
FFKQGLSVS

SEQ ID NO: 963893 - protein, 9 aa, Homo Sapiens
KKRAPANPE

SEQ ID NO: 963894 - protein, 9 aa, Homo Sapiens
DLLATGETM

SEQ ID NO: 963895 - protein, 9 aa, Homo Sapiens
HGHQRRHGL

SEQ ID NO: 963896 - protein, 9 aa, Homo Sapiens
FSEVEEVDM

SEQ ID NO: 963897 - protein, 9 aa, Homo Sapiens
GHTGPRPFP

SEQ ID NO: 963898 - protein, 9 aa, Homo Sapiens
EGFVFKHKR

SEQ ID NO: 963899 - protein, 9 aa, Homo Sapiens
QNKKEQAER

SEQ ID NO: 963900 - protein, 9 aa, Homo Sapiens
LRFERVLGP

SEQ ID NO: 963901 - protein, 9 aa, Homo Sapiens
RNHKFVPGA

SEQ ID NO: 963902 - protein, 9 aa, Homo Sapiens
NVLSSFISD

SEQ ID NO: 963903 - protein, 9 aa, Homo Sapiens
HRLLSQAVR

SEQ ID NO: 963904 - protein, 9 aa, Homo Sapiens
NCRYDVCFC

SEQ ID NO: 963905 - protein, 9 aa, Homo Sapiens
YFGCKFFLY

SEQ ID NO: 963906 - protein, 9 aa, Homo Sapiens
KEVAKSDPS

SEQ ID NO: 963907 - protein, 9 aa, Homo Sapiens
PGTFANCDF

SEQ ID NO: 963908 - protein, 9 aa, Homo Sapiens
SLVEATVRE

SEQ ID NO: 963909 - protein, 9 aa, Homo Sapiens
LSFSPKPTV

SEQ ID NO: 963910 - protein, 9 aa, Homo Sapiens
VLLGHYITK

SEQ ID NO: 963911 - protein, 9 aa, Homo Sapiens
GDQTARHTR

SEQ ID NO: 963912 - protein, 9 aa, Homo Sapiens
LVRRLQKRV

SEQ ID NO: 963913 - protein, 9 aa, Homo Sapiens
GILLPSSIL

SEQ ID NO: 963914 - protein, 9 aa, Homo Sapiens
NSPKRAADF

SEQ ID NO: 963915 - protein, 9 aa, Homo Sapiens
NVNPERTNP

SEQ ID NO: 963916 - protein, 9 aa, Homo Sapiens
SSLRNRQCR

SEQ ID NO: 963917 - protein, 9 aa, Homo Sapiens
LGGLCSSNT

SEQ ID NO: 963918 - protein, 9 aa, Homo Sapiens
HLQYATHFS

SEQ ID NO: 963919 - protein, 9 aa, Homo Sapiens
EGFSNRLCF

SEQ ID NO: 963920 - protein, 9 aa, Homo Sapiens
KQINVYNSW

SEQ ID NO: 963921 - protein, 9 aa, Homo Sapiens
AGGENRGDG

SEQ ID NO: 963922 - protein, 9 aa, Homo Sapiens
QQRFTLQPD

SEQ ID NO: 963923 - protein, 9 aa, Homo Sapiens
VISRSQHQE

SEQ ID NO: 963924 - protein, 9 aa, Homo Sapiens
PTVETSDLY

SEQ ID NO: 963925 - protein, 9 aa, Homo Sapiens
QNVKAQKVW

SEQ ID NO: 963926 - protein, 9 aa, Homo Sapiens
EEIISEEQE

SEQ ID NO: 963927 - protein, 9 aa, Homo Sapiens
LIYSLRNKN

SEQ ID NO: 963928 - protein, 9 aa, Homo Sapiens
GAKEKARKE

SEQ ID NO: 963929 - protein, 9 aa, Homo Sapiens
PGSVPMQVL

SEQ ID NO: 963930 - protein, 9 aa, Homo Sapiens
VEATVRERV

SEQ ID NO: 963931 - protein, 9 aa, Homo Sapiens
RADTSRNSS

SEQ ID NO: 963932 - protein, 9 aa, Homo Sapiens
SVGEKVNTS

SEQ ID NO: 963933 - protein, 9 aa, Homo Sapiens
ASTPLYQPG

SEQ ID NO: 963934 - protein, 9 aa, Homo Sapiens
SPPLSDKFF

SEQ ID NO: 963935 - protein, 9 aa, Homo Sapiens
ASPTTENRL

SEQ ID NO: 963936 - protein, 9 aa, Homo Sapiens
NIHKSDNKC

SEQ ID NO: 963937 - protein, 9 aa, Homo Sapiens
DHYTFRKIS

SEQ ID NO: 963938 - protein, 9 aa, Homo Sapiens
LTEALPLLV

SEQ ID NO: 963939 - protein, 9 aa, Homo Sapiens
STPFIIYHC

SEQ ID NO: 963940 - protein, 9 aa, Homo Sapiens
RSMLSSFLL

SEQ ID NO: 963941 - protein, 9 aa, Homo Sapiens
RADTVTKVS

SEQ ID NO: 963942 - protein, 9 aa, Homo Sapiens
EIQKQESSY

SEQ ID NO: 963943 - protein, 9 aa, Homo Sapiens
EHLVQYFQQ

SEQ ID NO: 963944 - protein, 9 aa, Homo Sapiens
AATREQRIT

SEQ ID NO: 963945 - protein, 9 aa, Homo Sapiens
KVDIVKRLL

SEQ ID NO: 963946 - protein, 9 aa, Homo Sapiens
TGNASWLMS

SEQ ID NO: 963947 - protein, 9 aa, Homo Sapiens
LQYPVGRIH

SEQ ID NO: 963948 - protein, 9 aa, Homo Sapiens
NFGGGRRDG

SEQ ID NO: 963949 - protein, 9 aa, Homo Sapiens
LDTKATLSV

SEQ ID NO: 963950 - protein, 9 aa, Homo Sapiens
EEAARKLLL

SEQ ID NO: 963951 - protein, 9 aa, Homo Sapiens
YSSLVLLGH

SEQ ID NO: 963952 - protein, 9 aa, Homo Sapiens
LVLAVRFSG

SEQ ID NO: 963953 - protein, 9 aa, Homo Sapiens
HQGLPGPDE

SEQ ID NO: 963954 - protein, 9 aa, Homo Sapiens
GAAHEIKSP

SEQ ID NO: 963955 - protein, 9 aa, Homo Sapiens
GARYGLSLM

SEQ ID NO: 963956 - protein, 9 aa, Homo Sapiens
GKEFPTQPQ

SEQ ID NO: 963957 - protein, 9 aa, Homo Sapiens
FASTTKTLS

SEQ ID NO: 963958 - protein, 9 aa, Homo Sapiens
EPCQIELYR

SEQ ID NO: 963959 - protein, 9 aa, Homo Sapiens
PSMILIEKA

SEQ ID NO: 963960 - protein, 9 aa, Homo Sapiens
AHEKDMKLS

SEQ ID NO: 963961 - protein, 9 aa, Homo Sapiens
AGSSPDSKG

SEQ ID NO: 963962 - protein, 9 aa, Homo Sapiens
YFVVGIPVF

SEQ ID NO: 963963 - protein, 9 aa, Homo Sapiens
QVMFEEGSW

SEQ ID NO: 963964 - protein, 9 aa, Homo Sapiens
LIACRDTKF

SEQ ID NO: 963965 - protein, 9 aa, Homo Sapiens
FQGVGLLRQ

SEQ ID NO: 963966 - protein, 9 aa, Homo Sapiens
CCLADIFCI

SEQ ID NO: 963967 - protein, 9 aa, Homo Sapiens
KSSEVLVKT

SEQ ID NO: 963968 - protein, 9 aa, Homo Sapiens
ITNCASVND

SEQ ID NO: 963969 - protein, 9 aa, Homo Sapiens
VWGHLPSRR

SEQ ID NO: 963970 - protein, 9 aa, Homo Sapiens
LVRRPTGNA

SEQ ID NO: 963971 - protein, 9 aa, Homo Sapiens
FGNLCQLDI

SEQ ID NO: 963972 - protein, 9 aa, Homo Sapiens
PYLPHPAKP

SEQ ID NO: 963973 - protein, 9 aa, Homo Sapiens
AHPCNPGFE

SEQ ID NO: 963974 - protein, 9 aa, Homo Sapiens
QCHYRLQNV

SEQ ID NO: 963975 - protein, 9 aa, Homo Sapiens
GSTQIWQHG

SEQ ID NO: 963976 - protein, 9 aa, Homo Sapiens
WNDFYKIYE

SEQ ID NO: 963977 - protein, 9 aa, Homo Sapiens
LSSAILQLG

SEQ ID NO: 963978 - protein, 9 aa, Homo Sapiens
LIYEETREV

SEQ ID NO: 963979 - protein, 9 aa, Homo Sapiens
MTRAESTSL

SEQ ID NO: 963980 - protein, 9 aa, Homo Sapiens
RLHAAKCPD

SEQ ID NO: 963981 - protein, 9 aa, Homo Sapiens
INVFFYPRL

SEQ ID NO: 963982 - protein, 9 aa, Homo Sapiens
GFSGKRTSD

SEQ ID NO: 963983 - protein, 9 aa, Homo Sapiens
GSCSSEVSM

SEQ ID NO: 963984 - protein, 9 aa, Homo Sapiens
FSSTVTEDF

SEQ ID NO: 963985 - protein, 9 aa, Homo Sapiens
NKGECGSKD

SEQ ID NO: 963986 - protein, 9 aa, Homo Sapiens
PELSEQDVR

SEQ ID NO: 963987 - protein, 9 aa, Homo Sapiens
MPIAGTSVP

SEQ ID NO: 963988 - protein, 9 aa, Homo Sapiens
GGGAGVSPE

SEQ ID NO: 963989 - protein, 9 aa, Homo Sapiens
TFFWMYLLA

SEQ ID NO: 963990 - protein, 9 aa, Homo Sapiens
RKIYTGEKP

SEQ ID NO: 963991 - protein, 9 aa, Homo Sapiens
RQAFSSTVT

SEQ ID NO: 963992 - protein, 9 aa, Homo Sapiens
VEEAQRRLR

SEQ ID NO: 963993 - protein, 9 aa, Homo Sapiens
GNLIVELVR

SEQ ID NO: 963994 - protein, 9 aa, Homo Sapiens
LPRPWITLK

SEQ ID NO: 963995 - protein, 9 aa, Homo Sapiens
QRGLPGLEG

SEQ ID NO: 963996 - protein, 9 aa, Homo Sapiens
ETVLPLTMP

SEQ ID NO: 963997 - protein, 9 aa, Homo Sapiens
KPKPTNQGQ

SEQ ID NO: 963998 - protein, 9 aa, Homo Sapiens
ITVVGNLSM

SEQ ID NO: 963999 - protein, 9 aa, Homo Sapiens
ERLHAAKCP

SEQ ID NO: 964000 - protein, 9 aa, Homo Sapiens
SRPVQFSYV

SEQ ID NO: 964001 - protein, 9 aa, Homo Sapiens
ADRLISLSK

SEQ ID NO: 964002 - protein, 9 aa, Homo Sapiens
VAKTVIELL

SEQ ID NO: 964003 - protein, 9 aa, Homo Sapiens
PESPLATGT

SEQ ID NO: 964004 - protein, 9 aa, Homo Sapiens
SSEETVPIP

SEQ ID NO: 964005 - protein, 9 aa, Homo Sapiens
DSRPRHLSN

SEQ ID NO: 964006 - protein, 9 aa, Homo Sapiens
NCASVNDGR

SEQ ID NO: 964007 - protein, 9 aa, Homo Sapiens
KHNQCKCEN

SEQ ID NO: 964008 - protein, 9 aa, Homo Sapiens
MKRAAFLNY

SEQ ID NO: 964009 - protein, 9 aa, Homo Sapiens
ITAAAPETA

SEQ ID NO: 964010 - protein, 9 aa, Homo Sapiens
TGCPGAAGR

SEQ ID NO: 964011 - protein, 9 aa, Homo Sapiens
AFLDWPRMV

SEQ ID NO: 964012 - protein, 9 aa, Homo Sapiens
PEFLFSTSP

SEQ ID NO: 964013 - protein, 9 aa, Homo Sapiens
GETPLQPFY

SEQ ID NO: 964014 - protein, 9 aa, Homo Sapiens
PSAAFLMLP

SEQ ID NO: 964015 - protein, 9 aa, Homo Sapiens
PARICFLLQ

SEQ ID NO: 964016 - protein, 9 aa, Homo Sapiens
SFSSCPPCS

SEQ ID NO: 964017 - protein, 9 aa, Homo Sapiens
EPKALHFKS

SEQ ID NO: 964018 - protein, 9 aa, Homo Sapiens
PGHSPQIIF

SEQ ID NO: 964019 - protein, 9 aa, Homo Sapiens
VVVRRNLVL

SEQ ID NO: 964020 - protein, 9 aa, Homo Sapiens
LIEKQKKVK

SEQ ID NO: 964021 - protein, 9 aa, Homo Sapiens
LVTALLPSL

SEQ ID NO: 964022 - protein, 9 aa, Homo Sapiens
ADYKRRLQH

SEQ ID NO: 964023 - protein, 9 aa, Homo Sapiens
SSVKEKYEL

SEQ ID NO: 964024 - protein, 9 aa, Homo Sapiens
EKGEMVDYN

SEQ ID NO: 964025 - protein, 9 aa, Homo Sapiens
GRRMNFKMQ

SEQ ID NO: 964026 - protein, 9 aa, Homo Sapiens
NLIKVTPSS

SEQ ID NO: 964027 - protein, 9 aa, Homo Sapiens
QDGIYTAHL

SEQ ID NO: 964028 - protein, 9 aa, Homo Sapiens
SQRAGLQYP

SEQ ID NO: 964029 - protein, 9 aa, Homo Sapiens
CSIKTRLLF

SEQ ID NO: 964030 - protein, 9 aa, Homo Sapiens
NGTPLDGTQ

SEQ ID NO: 964031 - protein, 9 aa, Homo Sapiens
SEEVLGHFS

SEQ ID NO: 964032 - protein, 9 aa, Homo Sapiens
GAREAEREW

SEQ ID NO: 964033 - protein, 9 aa, Homo Sapiens
YKAFKTDSF

SEQ ID NO: 964034 - protein, 9 aa, Homo Sapiens
KFRLELSRE

SEQ ID NO: 964035 - protein, 9 aa, Homo Sapiens
QSKKKEATC

SEQ ID NO: 964036 - protein, 9 aa, Homo Sapiens
VSKVYWTKN

SEQ ID NO: 964037 - protein, 9 aa, Homo Sapiens
LWQITVNDL

SEQ ID NO: 964038 - protein, 9 aa, Homo Sapiens
LADLSALKA

SEQ ID NO: 964039 - protein, 9 aa, Homo Sapiens
TDERADTVT

SEQ ID NO: 964040 - protein, 9 aa, Homo Sapiens
ETTGEKRKI

SEQ ID NO: 964041 - protein, 9 aa, Homo Sapiens
GLPASSWWP

SEQ ID NO: 964042 - protein, 9 aa, Homo Sapiens
DVWPPFTYA

SEQ ID NO: 964043 - protein, 9 aa, Homo Sapiens
GEGKFRVEA

SEQ ID NO: 964044 - protein, 9 aa, Homo Sapiens
GANRTSFLE

SEQ ID NO: 964045 - protein, 9 aa, Homo Sapiens
YNTKILKQS

SEQ ID NO: 964046 - protein, 9 aa, Homo Sapiens
SQPSHLPTS

SEQ ID NO: 964047 - protein, 9 aa, Homo Sapiens
NCYRNGGWT

SEQ ID NO: 964048 - protein, 9 aa, Homo Sapiens
AEINRIIQR

SEQ ID NO: 964049 - protein, 9 aa, Homo Sapiens
FVVWPRDQI

SEQ ID NO: 964050 - protein, 9 aa, Homo Sapiens
SSEVSMPTS

SEQ ID NO: 964051 - protein, 9 aa, Homo Sapiens
GCLGSHRRD

SEQ ID NO: 964052 - protein, 9 aa, Homo Sapiens
ANFILGPVS

SEQ ID NO: 964053 - protein, 9 aa, Homo Sapiens
PSLLRKHVK

SEQ ID NO: 964054 - protein, 9 aa, Homo Sapiens
AEKFKVSGK

SEQ ID NO: 964055 - protein, 9 aa, Homo Sapiens
SRYTNCDTA

SEQ ID NO: 964056 - protein, 9 aa, Homo Sapiens
ISYMLVHAE

SEQ ID NO: 964057 - protein, 9 aa, Homo Sapiens
GGNFVTSRE

SEQ ID NO: 964058 - protein, 9 aa, Homo Sapiens
LVKKAERFR

SEQ ID NO: 964059 - protein, 9 aa, Homo Sapiens
RTPVVSLFL

SEQ ID NO: 964060 - protein, 9 aa, Homo Sapiens
CPSALATSI

SEQ ID NO: 964061 - protein, 9 aa, Homo Sapiens
IQVNAIDKE

SEQ ID NO: 964062 - protein, 9 aa, Homo Sapiens
NEVYKQVMF

SEQ ID NO: 964063 - protein, 9 aa, Homo Sapiens
PCRVCTKVF

SEQ ID NO: 964064 - protein, 9 aa, Homo Sapiens
KGERAQWQE

SEQ ID NO: 964065 - protein, 9 aa, Homo Sapiens
TEALPLLVT

SEQ ID NO: 964066 - protein, 9 aa, Homo Sapiens
NQCKCENLI

SEQ ID NO: 964067 - protein, 9 aa, Homo Sapiens
SSLLNLAPY

SEQ ID NO: 964068 - protein, 9 aa, Homo Sapiens
GDNTRELQE

SEQ ID NO: 964069 - protein, 9 aa, Homo Sapiens
GSVLSIPNS

SEQ ID NO: 964070 - protein, 9 aa, Homo Sapiens
QGHGHQRRH

SEQ ID NO: 964071 - protein, 9 aa, Homo Sapiens
SPVAKTVIE

SEQ ID NO: 964072 - protein, 9 aa, Homo Sapiens
RGPFASTTK

SEQ ID NO: 964073 - protein, 9 aa, Homo Sapiens
TFMILIEDV

SEQ ID NO: 964074 - protein, 9 aa, Homo Sapiens
LCCLLLLPC

SEQ ID NO: 964075 - protein, 9 aa, Homo Sapiens
IFARRSDRG

SEQ ID NO: 964076 - protein, 9 aa, Homo Sapiens
KTSGSHLVE

SEQ ID NO: 964077 - protein, 9 aa, Homo Sapiens
RRFELRNRS

SEQ ID NO: 964078 - protein, 9 aa, Homo Sapiens
DKVISWILL

SEQ ID NO: 964079 - protein, 9 aa, Homo Sapiens
ASPSPLGGG

SEQ ID NO: 964080 - protein, 9 aa, Homo Sapiens
NQSEDPQNQ

SEQ ID NO: 964081 - protein, 9 aa, Homo Sapiens
TFDETNLIT

SEQ ID NO: 964082 - protein, 9 aa, Homo Sapiens
RKAEAAMRN

SEQ ID NO: 964083 - protein, 9 aa, Homo Sapiens
REETEKEEE

SEQ ID NO: 964084 - protein, 9 aa, Homo Sapiens
TLSLSSGYS

SEQ ID NO: 964085 - protein, 9 aa, Homo Sapiens
SPALLSNLT

SEQ ID NO: 964086 - protein, 9 aa, Homo Sapiens
QDLFSYCSE

SEQ ID NO: 964087 - protein, 9 aa, Homo Sapiens
NLCDGDRWR

SEQ ID NO: 964088 - protein, 9 aa, Homo Sapiens
LSDKFFDYI

SEQ ID NO: 964089 - protein, 9 aa, Homo Sapiens
RRRRFSIND

SEQ ID NO: 964090 - protein, 9 aa, Homo Sapiens
LRSALVLLY

SEQ ID NO: 964091 - protein, 9 aa, Homo Sapiens
GENAPIHCI

SEQ ID NO: 964092 - protein, 9 aa, Homo Sapiens
TYHRVVFFI

SEQ ID NO: 964093 - protein, 9 aa, Homo Sapiens
GLRCPLYSS

SEQ ID NO: 964094 - protein, 9 aa, Homo Sapiens
AQDTPDAAP

SEQ ID NO: 964095 - protein, 9 aa, Homo Sapiens
VGFCYNDKL

SEQ ID NO: 964096 - protein, 9 aa, Homo Sapiens
LTLEDYLVK

SEQ ID NO: 964097 - protein, 9 aa, Homo Sapiens
EDFFNFCSR

SEQ ID NO: 964098 - protein, 9 aa, Homo Sapiens
AQRHVERRK

SEQ ID NO: 964099 - protein, 9 aa, Homo Sapiens
IGGDIHFDS

SEQ ID NO: 964100 - protein, 9 aa, Homo Sapiens
DPQARLLEG

SEQ ID NO: 964101 - protein, 9 aa, Homo Sapiens
PNRFRFKII

SEQ ID NO: 964102 - protein, 9 aa, Homo Sapiens
WMVPELISR

SEQ ID NO: 964103 - protein, 9 aa, Homo Sapiens
ALGPKLGPP

SEQ ID NO: 964104 - protein, 9 aa, Homo Sapiens
GSPPCEVTV

SEQ ID NO: 964105 - protein, 9 aa, Homo Sapiens
PSRDPDSLN

SEQ ID NO: 964106 - protein, 9 aa, Homo Sapiens
LSSFISDWL

SEQ ID NO: 964107 - protein, 9 aa, Homo Sapiens
RPSLCLLPT

SEQ ID NO: 964108 - protein, 9 aa, Homo Sapiens
TAFWEKGFG

SEQ ID NO: 964109 - protein, 9 aa, Homo Sapiens
VCIVMRRDQ

SEQ ID NO: 964110 - protein, 9 aa, Homo Sapiens
IYSGEKSFK

SEQ ID NO: 964111 - protein, 9 aa, Homo Sapiens
QKEMSNFTM

SEQ ID NO: 964112 - protein, 9 aa, Homo Sapiens
TEPFSNSTN

SEQ ID NO: 964113 - protein, 9 aa, Homo Sapiens
ARPCFVEEW

SEQ ID NO: 964114 - protein, 9 aa, Homo Sapiens
NKKVDIVKR

SEQ ID NO: 964115 - protein, 9 aa, Homo Sapiens
EAADLLLGY

SEQ ID NO: 964116 - protein, 9 aa, Homo Sapiens
FKGFGSHSS

SEQ ID NO: 964117 - protein, 9 aa, Homo Sapiens
RKELDCLKD

SEQ ID NO: 964118 - protein, 9 aa, Homo Sapiens
LILAPLQPP

SEQ ID NO: 964119 - protein, 9 aa, Homo Sapiens
GMPPLSPKK

SEQ ID NO: 964120 - protein, 9 aa, Homo Sapiens
QSFSTAAHG

SEQ ID NO: 964121 - protein, 9 aa, Homo Sapiens
RKNLGAPKG

SEQ ID NO: 964122 - protein, 9 aa, Homo Sapiens
LLTAFLPPR

SEQ ID NO: 964123 - protein, 9 aa, Homo Sapiens
VEAILVFTM

SEQ ID NO: 964124 - protein, 9 aa, Homo Sapiens
SVAKLGEQI

SEQ ID NO: 964125 - protein, 9 aa, Homo Sapiens
NSVTTDFSS

SEQ ID NO: 964126 - protein, 9 aa, Homo Sapiens
SIWDVPQKH

SEQ ID NO: 964127 - protein, 9 aa, Homo Sapiens
KALDNSACP

SEQ ID NO: 964128 - protein, 9 aa, Homo Sapiens
MLQKGGNFV

SEQ ID NO: 964129 - protein, 9 aa, Homo Sapiens
SERFNMGEI

SEQ ID NO: 964130 - protein, 9 aa, Homo Sapiens
HWNFDPYLS

SEQ ID NO: 964131 - protein, 9 aa, Homo Sapiens
HEKDMKLSF

SEQ ID NO: 964132 - protein, 9 aa, Homo Sapiens
EDKLFEETG

SEQ ID NO: 964133 - protein, 9 aa, Homo Sapiens
LPTRARLLF

SEQ ID NO: 964134 - protein, 9 aa, Homo Sapiens
GIWGCLQEA

SEQ ID NO: 964135 - protein, 9 aa, Homo Sapiens
IRGPKGQKE

SEQ ID NO: 964136 - protein, 9 aa, Homo Sapiens
LEEWIKLTK

SEQ ID NO: 964137 - protein, 9 aa, Homo Sapiens
LSNLTLGYR

SEQ ID NO: 964138 - protein, 9 aa, Homo Sapiens
NGENAPIHC

SEQ ID NO: 964139 - protein, 9 aa, Homo Sapiens
DPAIVQSFL

SEQ ID NO: 964140 - protein, 9 aa, Homo Sapiens
MEIANCYRN

SEQ ID NO: 964141 - protein, 9 aa, Homo Sapiens
YWILNFTRN

SEQ ID NO: 964142 - protein, 9 aa, Homo Sapiens
TPDHYTFRK

SEQ ID NO: 964143 - protein, 9 aa, Homo Sapiens
PFPCAQCGK

SEQ ID NO: 964144 - protein, 9 aa, Homo Sapiens
ATIKVNGTP

SEQ ID NO: 964145 - protein, 9 aa, Homo Sapiens
RIPSAQQKK

SEQ ID NO: 964146 - protein, 9 aa, Homo Sapiens
PSGLEEKEE

SEQ ID NO: 964147 - protein, 9 aa, Homo Sapiens
CQTGGCRSE

SEQ ID NO: 964148 - protein, 9 aa, Homo Sapiens
TPEAPAGQP

SEQ ID NO: 964149 - protein, 9 aa, Homo Sapiens
LELSQKGVT

SEQ ID NO: 964150 - protein, 9 aa, Homo Sapiens
DVCFCSDGR

SEQ ID NO: 964151 - protein, 9 aa, Homo Sapiens
VFVMDASIG

SEQ ID NO: 964152 - protein, 9 aa, Homo Sapiens
QHISPSAKP

SEQ ID NO: 964153 - protein, 9 aa, Homo Sapiens
VPNVSNQTA

SEQ ID NO: 964154 - protein, 9 aa, Homo Sapiens
IQKQESSYY

SEQ ID NO: 964155 - protein, 9 aa, Homo Sapiens
SRNSSQCSR

SEQ ID NO: 964156 - protein, 9 aa, Homo Sapiens
DFHPSGTVG

SEQ ID NO: 964157 - protein, 9 aa, Homo Sapiens
WPPFTYASL

SEQ ID NO: 964158 - protein, 9 aa, Homo Sapiens
VLFFVAAAF

SEQ ID NO: 964159 - protein, 9 aa, Homo Sapiens
QGTGRKDDD

SEQ ID NO: 964160 - protein, 9 aa, Homo Sapiens
AVQEFYLSV

SEQ ID NO: 964161 - protein, 9 aa, Homo Sapiens
DSYARIFFS

SEQ ID NO: 964162 - protein, 9 aa, Homo Sapiens
QSLHLSKHL

SEQ ID NO: 964163 - protein, 9 aa, Homo Sapiens
LQAVLYSRF

SEQ ID NO: 964164 - protein, 9 aa, Homo Sapiens
VVTDFIDNL

SEQ ID NO: 964165 - protein, 9 aa, Homo Sapiens
LLLKRLALD

SEQ ID NO: 964166 - protein, 9 aa, Homo Sapiens
TTNLVNNDG

SEQ ID NO: 964167 - protein, 9 aa, Homo Sapiens
DGSGAPRGR

SEQ ID NO: 964168 - protein, 9 aa, Homo Sapiens
DIVKRLLIK

SEQ ID NO: 964169 - protein, 9 aa, Homo Sapiens
MYEDIQPAA

SEQ ID NO: 964170 - protein, 9 aa, Homo Sapiens
QEEQEELSL

SEQ ID NO: 964171 - protein, 9 aa, Homo Sapiens
AVPFTIIPC

SEQ ID NO: 964172 - protein, 9 aa, Homo Sapiens
EVFKERNEG

SEQ ID NO: 964173 - protein, 9 aa, Homo Sapiens
CLLRISTIA

SEQ ID NO: 964174 - protein, 9 aa, Homo Sapiens
ESEFQDKEE

SEQ ID NO: 964175 - protein, 9 aa, Homo Sapiens
AEAFHNLHS

SEQ ID NO: 964176 - protein, 9 aa, Homo Sapiens
LEILDCRNV

SEQ ID NO: 964177 - protein, 9 aa, Homo Sapiens
PPPYGVLRF

SEQ ID NO: 964178 - protein, 9 aa, Homo Sapiens
IIMVTIRPE

SEQ ID NO: 964179 - protein, 9 aa, Homo Sapiens
PRSESPSCI

SEQ ID NO: 964180 - protein, 9 aa, Homo Sapiens
LTNMKGNIG

SEQ ID NO: 964181 - protein, 9 aa, Homo Sapiens
AQRGSSSSA

SEQ ID NO: 964182 - protein, 9 aa, Homo Sapiens
FSRAPPVPW

SEQ ID NO: 964183 - protein, 9 aa, Homo Sapiens
EFSIDSVTS

SEQ ID NO: 964184 - protein, 9 aa, Homo Sapiens
TPLDKAVLS

SEQ ID NO: 964185 - protein, 9 aa, Homo Sapiens
SGRQSFSTA

SEQ ID NO: 964186 - protein, 9 aa, Homo Sapiens
GPGTFHTEG

SEQ ID NO: 964187 - protein, 9 aa, Homo Sapiens
RVTRLPLLI

SEQ ID NO: 964188 - protein, 9 aa, Homo Sapiens
CFRFMGIEN

SEQ ID NO: 964189 - protein, 9 aa, Homo Sapiens
EAVGPGGLL

SEQ ID NO: 964190 - protein, 9 aa, Homo Sapiens
DKCNFLEGE

SEQ ID NO: 964191 - protein, 9 aa, Homo Sapiens
YHEQSRTNR

SEQ ID NO: 964192 - protein, 9 aa, Homo Sapiens
EVSNKRECP

SEQ ID NO: 964193 - protein, 9 aa, Homo Sapiens
YKNPSMILI

SEQ ID NO: 964194 - protein, 9 aa, Homo Sapiens
CCSSSYSQQ

SEQ ID NO: 964195 - protein, 9 aa, Homo Sapiens
FFLRQALRR

SEQ ID NO: 964196 - protein, 9 aa, Homo Sapiens
EGTYVSSFK

SEQ ID NO: 964197 - protein, 9 aa, Homo Sapiens
QVSLRVHGL

SEQ ID NO: 964198 - protein, 9 aa, Homo Sapiens
KITSVQLNN

SEQ ID NO: 964199 - protein, 9 aa, Homo Sapiens
LRLKRRHRC

SEQ ID NO: 964200 - protein, 9 aa, Homo Sapiens
IQGQAVKKS

SEQ ID NO: 964201 - protein, 9 aa, Homo Sapiens
KKKKLAKKW

SEQ ID NO: 964202 - protein, 9 aa, Homo Sapiens
GRPSLCLLP

SEQ ID NO: 964203 - protein, 9 aa, Homo Sapiens
NKISKRIEA

SEQ ID NO: 964204 - protein, 9 aa, Homo Sapiens
TVAMPIAGT

SEQ ID NO: 964205 - protein, 9 aa, Homo Sapiens
FSQIYNLNS

SEQ ID NO: 964206 - protein, 9 aa, Homo Sapiens
KTPRKFCLA

SEQ ID NO: 964207 - protein, 9 aa, Homo Sapiens
IPETKEDVI

SEQ ID NO: 964208 - protein, 9 aa, Homo Sapiens
FYCDCNMQW

SEQ ID NO: 964209 - protein, 9 aa, Homo Sapiens
LCLLPTSHT

SEQ ID NO: 964210 - protein, 9 aa, Homo Sapiens
ADVFSRKPF

SEQ ID NO: 964211 - protein, 9 aa, Homo Sapiens
ATFGAYDWE

SEQ ID NO: 964212 - protein, 9 aa, Homo Sapiens
LLGDIPEDL

SEQ ID NO: 964213 - protein, 9 aa, Homo Sapiens
DEIPPYRIR

SEQ ID NO: 964214 - protein, 9 aa, Homo Sapiens
SSHSALFSP

SEQ ID NO: 964215 - protein, 9 aa, Homo Sapiens
PEMPRLFLN

SEQ ID NO: 964216 - protein, 9 aa, Homo Sapiens
DVDSFTGSL

SEQ ID NO: 964217 - protein, 9 aa, Homo Sapiens
SNSSQQVRS

SEQ ID NO: 964218 - protein, 9 aa, Homo Sapiens
NGVCRKENS

SEQ ID NO: 964219 - protein, 9 aa, Homo Sapiens
VVKCLIGVN

SEQ ID NO: 964220 - protein, 9 aa, Homo Sapiens
KQESDCVSK

SEQ ID NO: 964221 - protein, 9 aa, Homo Sapiens
QEQGHLRNL

SEQ ID NO: 964222 - protein, 9 aa, Homo Sapiens
MTSTLCSAK

SEQ ID NO: 964223 - protein, 9 aa, Homo Sapiens
FAATKFVYP

SEQ ID NO: 964224 - protein, 9 aa, Homo Sapiens
SKTPRKFCL

SEQ ID NO: 964225 - protein, 9 aa, Homo Sapiens
NLPQGYPLP

SEQ ID NO: 964226 - protein, 9 aa, Homo Sapiens
EQEEENEEN

SEQ ID NO: 964227 - protein, 9 aa, Homo Sapiens
TCFTKLFSQ

SEQ ID NO: 964228 - protein, 9 aa, Homo Sapiens
LRDDAPTHT

SEQ ID NO: 964229 - protein, 9 aa, Homo Sapiens
RPNTGAGFG

SEQ ID NO: 964230 - protein, 9 aa, Homo Sapiens
SNGRWTWTS

SEQ ID NO: 964231 - protein, 9 aa, Homo Sapiens
LVLIVCTFT

SEQ ID NO: 964232 - protein, 9 aa, Homo Sapiens
EKQTCEIVE

SEQ ID NO: 964233 - protein, 9 aa, Homo Sapiens
PGRQEKENA

SEQ ID NO: 964234 - protein, 9 aa, Homo Sapiens
QTAPETRNS

SEQ ID NO: 964235 - protein, 9 aa, Homo Sapiens
KSTLQHEAT

SEQ ID NO: 964236 - protein, 9 aa, Homo Sapiens
FFVAAAFFL

SEQ ID NO: 964237 - protein, 9 aa, Homo Sapiens
LPVASEEKT

SEQ ID NO: 964238 - protein, 9 aa, Homo Sapiens
NSVLFPSSG

SEQ ID NO: 964239 - protein, 9 aa, Homo Sapiens
GAAPLCTHA

SEQ ID NO: 964240 - protein, 9 aa, Homo Sapiens
GVSQDLFSY

SEQ ID NO: 964241 - protein, 9 aa, Homo Sapiens
TKEDVISDP

SEQ ID NO: 964242 - protein, 9 aa, Homo Sapiens
TTKQPTLAP

SEQ ID NO: 964243 - protein, 9 aa, Homo Sapiens
MCRHSVISE

SEQ ID NO: 964244 - protein, 9 aa, Homo Sapiens
LDNVRCSGH

SEQ ID NO: 964245 - protein, 9 aa, Homo Sapiens
WHLDSDVEY

SEQ ID NO: 964246 - protein, 9 aa, Homo Sapiens
CFNLIDDSS

SEQ ID NO: 964247 - protein, 9 aa, Homo Sapiens
FWTCPPCGL

SEQ ID NO: 964248 - protein, 9 aa, Homo Sapiens
VTHKSWLWQ

SEQ ID NO: 964249 - protein, 9 aa, Homo Sapiens
VCFLLHSLR

SEQ ID NO: 964250 - protein, 9 aa, Homo Sapiens
LIERRRRFS

SEQ ID NO: 964251 - protein, 9 aa, Homo Sapiens
EVDPEKFFS

SEQ ID NO: 964252 - protein, 9 aa, Homo Sapiens
LRLLQIWRK

SEQ ID NO: 964253 - protein, 9 aa, Homo Sapiens
VLYANINFS

SEQ ID NO: 964254 - protein, 9 aa, Homo Sapiens
SLQREGYPH

SEQ ID NO: 964255 - protein, 9 aa, Homo Sapiens
EADRLISLS

SEQ ID NO: 964256 - protein, 9 aa, Homo Sapiens
RKDDYAKAG

SEQ ID NO: 964257 - protein, 9 aa, Homo Sapiens
FRAAGITDS

SEQ ID NO: 964258 - protein, 9 aa, Homo Sapiens
FILGPVSRS

SEQ ID NO: 964259 - protein, 9 aa, Homo Sapiens
LSENSGMNL

SEQ ID NO: 964260 - protein, 9 aa, Homo Sapiens
SLAFREHKP

SEQ ID NO: 964261 - protein, 9 aa, Homo Sapiens
SASRPGFLI

SEQ ID NO: 964262 - protein, 9 aa, Homo Sapiens
SQPGSQAES

SEQ ID NO: 964263 - protein, 9 aa, Homo Sapiens
VGEEEEQPR

SEQ ID NO: 964264 - protein, 9 aa, Homo Sapiens
LAPYPLVRR

SEQ ID NO: 964265 - protein, 9 aa, Homo Sapiens
LKSFPKDPQ

SEQ ID NO: 964266 - protein, 9 aa, Homo Sapiens
LKFINLFGL

SEQ ID NO: 964267 - protein, 9 aa, Homo Sapiens
ENILLSTLK

SEQ ID NO: 964268 - protein, 9 aa, Homo Sapiens
NSHLIWHQK

SEQ ID NO: 964269 - protein, 9 aa, Homo Sapiens
RCFHSPLLP

SEQ ID NO: 964270 - protein, 9 aa, Homo Sapiens
EATGPSGPQ

SEQ ID NO: 964271 - protein, 9 aa, Homo Sapiens
SSSAVRKTK

SEQ ID NO: 964272 - protein, 9 aa, Homo Sapiens
ILISAAVTF

SEQ ID NO: 964273 - protein, 9 aa, Homo Sapiens
NKNDAEHLD

SEQ ID NO: 964274 - protein, 9 aa, Homo Sapiens
RAQWQERMW

SEQ ID NO: 964275 - protein, 9 aa, Homo Sapiens
EPRGKWQER

SEQ ID NO: 964276 - protein, 9 aa, Homo Sapiens
GAMSSNFLG

SEQ ID NO: 964277 - protein, 9 aa, Homo Sapiens
GTQGKGTGE

SEQ ID NO: 964278 - protein, 9 aa, Homo Sapiens
PGPVPMASR

SEQ ID NO: 964279 - protein, 9 aa, Homo Sapiens
ENLQENSQK

SEQ ID NO: 964280 - protein, 9 aa, Homo Sapiens
KGPLAKRNE

SEQ ID NO: 964281 - protein, 9 aa, Homo Sapiens
LTIHIRTHT

SEQ ID NO: 964282 - protein, 9 aa, Homo Sapiens
SNSLDPPHE

SEQ ID NO: 964283 - protein, 9 aa, Homo Sapiens
MSKVYSVGS

SEQ ID NO: 964284 - protein, 9 aa, Homo Sapiens
FSNFLDKSG

SEQ ID NO: 964285 - protein, 9 aa, Homo Sapiens
PPPLGDAAG

SEQ ID NO: 964286 - protein, 9 aa, Homo Sapiens
DRLISLSKK

SEQ ID NO: 964287 - protein, 9 aa, Homo Sapiens
DPVIFKLAC

SEQ ID NO: 964288 - protein, 9 aa, Homo Sapiens
CQPYLCCLL

SEQ ID NO: 964289 - protein, 9 aa, Homo Sapiens
RPLRVLFFV

SEQ ID NO: 964290 - protein, 9 aa, Homo Sapiens
LAPLQPPPI

SEQ ID NO: 964291 - protein, 9 aa, Homo Sapiens
TDSDIPEIL

SEQ ID NO: 964292 - protein, 9 aa, Homo Sapiens
SDQGKEKAR

SEQ ID NO: 964293 - protein, 9 aa, Homo Sapiens
DNKQVCIVM

SEQ ID NO: 964294 - protein, 9 aa, Homo Sapiens
SEKQNINIM

SEQ ID NO: 964295 - protein, 9 aa, Homo Sapiens
LFLDNTYFG

SEQ ID NO: 964296 - protein, 9 aa, Homo Sapiens
VNAIDKEIP

SEQ ID NO: 964297 - protein, 9 aa, Homo Sapiens
DVTEINVFF

SEQ ID NO: 964298 - protein, 9 aa, Homo Sapiens
QPKKIICMS

SEQ ID NO: 964299 - protein, 9 aa, Homo Sapiens
RFKIIDPNN

SEQ ID NO: 964300 - protein, 9 aa, Homo Sapiens
DSGGNKGQL

SEQ ID NO: 964301 - protein, 9 aa, Homo Sapiens
GDYTLSTLQ

SEQ ID NO: 964302 - protein, 9 aa, Homo Sapiens
VAFADFYPF

SEQ ID NO: 964303 - protein, 9 aa, Homo Sapiens
TEEGCDASA

SEQ ID NO: 964304 - protein, 9 aa, Homo Sapiens
KIGLLISAE

SEQ ID NO: 964305 - protein, 9 aa, Homo Sapiens
PVVFIVRCF

SEQ ID NO: 964306 - protein, 9 aa, Homo Sapiens
RKKKGKTVP

SEQ ID NO: 964307 - protein, 9 aa, Homo Sapiens
KKGEDILLM

SEQ ID NO: 964308 - protein, 9 aa, Homo Sapiens
PDTCALASY

SEQ ID NO: 964309 - protein, 9 aa, Homo Sapiens
IQPDNIVFV

SEQ ID NO: 964310 - protein, 9 aa, Homo Sapiens
PGYQREGRQ

SEQ ID NO: 964311 - protein, 9 aa, Homo Sapiens
EFEFAVELT

SEQ ID NO: 964312 - protein, 9 aa, Homo Sapiens
QLLPRPWIT

SEQ ID NO: 964313 - protein, 9 aa, Homo Sapiens
SSTGTSEAA

SEQ ID NO: 964314 - protein, 9 aa, Homo Sapiens
KPKQLQQQK

SEQ ID NO: 964315 - protein, 9 aa, Homo Sapiens
QLYGLGSPA

SEQ ID NO: 964316 - protein, 9 aa, Homo Sapiens
LAVLDDGNE

SEQ ID NO: 964317 - protein, 9 aa, Homo Sapiens
SSLSMAFVY

SEQ ID NO: 964318 - protein, 9 aa, Homo Sapiens
QRNQALNEE

SEQ ID NO: 964319 - protein, 9 aa, Homo Sapiens
LKEEEKKNE

SEQ ID NO: 964320 - protein, 9 aa, Homo Sapiens
IPIEEFNLH

SEQ ID NO: 964321 - protein, 9 aa, Homo Sapiens
DIAPMDIRG

SEQ ID NO: 964322 - protein, 9 aa, Homo Sapiens
CTDTFMILI

SEQ ID NO: 964323 - protein, 9 aa, Homo Sapiens
VSNQTAYLY

SEQ ID NO: 964324 - protein, 9 aa, Homo Sapiens
DSKSTSHHE

SEQ ID NO: 964325 - protein, 8 aa, Homo Sapiens
EPAVGGPG

SEQ ID NO: 964326 - protein, 9 aa, Homo Sapiens
EIKGFIGID

SEQ ID NO: 964327 - protein, 9 aa, Homo Sapiens
GAIVQAILR

SEQ ID NO: 964328 - protein, 9 aa, Homo Sapiens
NSKKTNFLC

SEQ ID NO: 964329 - protein, 9 aa, Homo Sapiens
PLPQQRNPP

SEQ ID NO: 964330 - protein, 9 aa, Homo Sapiens
EKITNCASV

SEQ ID NO: 964331 - protein, 9 aa, Homo Sapiens
VLPLTMPCW

SEQ ID NO: 964332 - protein, 9 aa, Homo Sapiens
KDDYAKAGT

SEQ ID NO: 964333 - protein, 9 aa, Homo Sapiens
QRDEEGWEE

SEQ ID NO: 964334 - protein, 9 aa, Homo Sapiens
ALPLLVTAL

SEQ ID NO: 964335 - protein, 9 aa, Homo Sapiens
HCYSKNQSS

SEQ ID NO: 964336 - protein, 9 aa, Homo Sapiens
LQTVIIVGG

SEQ ID NO: 964337 - protein, 9 aa, Homo Sapiens
VLWKYFLNT

SEQ ID NO: 964338 - protein, 9 aa, Homo Sapiens
HGRWYADRA

SEQ ID NO: 964339 - protein, 9 aa, Homo Sapiens
RLVALGRQV

SEQ ID NO: 964340 - protein, 9 aa, Homo Sapiens
RTSLGADGC

SEQ ID NO: 964341 - protein, 9 aa, Homo Sapiens
LLFGYATFF

SEQ ID NO: 964342 - protein, 9 aa, Homo Sapiens
GPGDPSFPL

SEQ ID NO: 964343 - protein, 9 aa, Homo Sapiens
SYCSEERPP

SEQ ID NO: 964344 - protein, 9 aa, Homo Sapiens
WTASSPVYE

SEQ ID NO: 964345 - protein, 9 aa, Homo Sapiens
DPSLPGRAQ

SEQ ID NO: 964346 - protein, 9 aa, Homo Sapiens
NAHLLSLMV

SEQ ID NO: 964347 - protein, 9 aa, Homo Sapiens
KEKLDALWV

SEQ ID NO: 964348 - protein, 9 aa, Homo Sapiens
DEIELPQLR

SEQ ID NO: 964349 - protein, 9 aa, Homo Sapiens
AVLVPGVNI

SEQ ID NO: 964350 - protein, 9 aa, Homo Sapiens
EQDDTTERQ

SEQ ID NO: 964351 - protein, 9 aa, Homo Sapiens
RSKFIGQTL

SEQ ID NO: 964352 - protein, 9 aa, Homo Sapiens
VVNAHLLSL

SEQ ID NO: 964353 - protein, 9 aa, Homo Sapiens
EEKHAKERT

SEQ ID NO: 964354 - protein, 9 aa, Homo Sapiens
RISVFFYHV

SEQ ID NO: 964355 - protein, 9 aa, Homo Sapiens
PFSGNDTDS

SEQ ID NO: 964356 - protein, 9 aa, Homo Sapiens
VKEEGGKPE

SEQ ID NO: 964357 - protein, 9 aa, Homo Sapiens
CKSSKRANI

SEQ ID NO: 964358 - protein, 9 aa, Homo Sapiens
KSEYLEMKE

SEQ ID NO: 964359 - protein, 9 aa, Homo Sapiens
LSINFLMVF

SEQ ID NO: 964360 - protein, 9 aa, Homo Sapiens
CSAESNGEK

SEQ ID NO: 964361 - protein, 9 aa, Homo Sapiens
LDWQSSEKQ

SEQ ID NO: 964362 - protein, 9 aa, Homo Sapiens
DDKGILWQI

SEQ ID NO: 964363 - protein, 9 aa, Homo Sapiens
PAQKKSTGS

SEQ ID NO: 964364 - protein, 9 aa, Homo Sapiens
EIRHGGHWL

SEQ ID NO: 964365 - protein, 9 aa, Homo Sapiens
EFADMSKVY

SEQ ID NO: 964366 - protein, 9 aa, Homo Sapiens
GSSPLGLLE

SEQ ID NO: 964367 - protein, 9 aa, Homo Sapiens
TYFLPEDGL

SEQ ID NO: 964368 - protein, 9 aa, Homo Sapiens
AFESPQPKK

SEQ ID NO: 964369 - protein, 9 aa, Homo Sapiens
NYFTYYFIQ

SEQ ID NO: 964370 - protein, 9 aa, Homo Sapiens
RLELSREGE

SEQ ID NO: 964371 - protein, 9 aa, Homo Sapiens
FTFSYKNEV

SEQ ID NO: 964372 - protein, 9 aa, Homo Sapiens
LMGNVPNRG

SEQ ID NO: 964373 - protein, 9 aa, Homo Sapiens
GYKNPSMIL

SEQ ID NO: 964374 - protein, 9 aa, Homo Sapiens
ISGGVAERH

SEQ ID NO: 964375 - protein, 9 aa, Homo Sapiens
KPQAAFPSQ

SEQ ID NO: 964376 - protein, 9 aa, Homo Sapiens
LGCQGCPAP

SEQ ID NO: 964377 - protein, 9 aa, Homo Sapiens
PAAQDTPDA

SEQ ID NO: 964378 - protein, 9 aa, Homo Sapiens
KKDPDPRVQ

SEQ ID NO: 964379 - protein, 9 aa, Homo Sapiens
VSFSLAFRE

SEQ ID NO: 964380 - protein, 9 aa, Homo Sapiens
GRPNTGAGF

SEQ ID NO: 964381 - protein, 9 aa, Homo Sapiens
MLGNLIKVT

SEQ ID NO: 964382 - protein, 9 aa, Homo Sapiens
MIHSEEKPY

SEQ ID NO: 964383 - protein, 9 aa, Homo Sapiens
NYVIQFAQG

SEQ ID NO: 964384 - protein, 9 aa, Homo Sapiens
GHQRRHGLG

SEQ ID NO: 964385 - protein, 9 aa, Homo Sapiens
SADPEKKAK

SEQ ID NO: 964386 - protein, 9 aa, Homo Sapiens
SLTDSSVDE

SEQ ID NO: 964387 - protein, 9 aa, Homo Sapiens
FKEKASSLK

SEQ ID NO: 964388 - protein, 9 aa, Homo Sapiens
STITSHTIS

SEQ ID NO: 964389 - protein, 9 aa, Homo Sapiens
SDPSHLPLV

SEQ ID NO: 964390 - protein, 9 aa, Homo Sapiens
EEVFKERNE

SEQ ID NO: 964391 - protein, 9 aa, Homo Sapiens
KAVIFPGFD

SEQ ID NO: 964392 - protein, 9 aa, Homo Sapiens
KLPRQAFSS

SEQ ID NO: 964393 - protein, 9 aa, Homo Sapiens
VEKRVDASD

SEQ ID NO: 964394 - protein, 9 aa, Homo Sapiens
ADVWPPFTY

SEQ ID NO: 964395 - protein, 9 aa, Homo Sapiens
LDPLSGHPL

SEQ ID NO: 964396 - protein, 9 aa, Homo Sapiens
VGTEPKSER

SEQ ID NO: 964397 - protein, 9 aa, Homo Sapiens
VVRRNLVLV

SEQ ID NO: 964398 - protein, 9 aa, Homo Sapiens
AHPELQSEI

SEQ ID NO: 964399 - protein, 9 aa, Homo Sapiens
WYNKGECGS

SEQ ID NO: 964400 - protein, 9 aa, Homo Sapiens
LGEGKFRVE

SEQ ID NO: 964401 - protein, 9 aa, Homo Sapiens
LEGWLVFIK

SEQ ID NO: 964402 - protein, 9 aa, Homo Sapiens
GYRWSKKAE

SEQ ID NO: 964403 - protein, 9 aa, Homo Sapiens
VFYTTAFDM

SEQ ID NO: 964404 - protein, 9 aa, Homo Sapiens
GEVSGDATK

SEQ ID NO: 964405 - protein, 9 aa, Homo Sapiens
GSITILRPQ

SEQ ID NO: 964406 - protein, 9 aa, Homo Sapiens
SVGRPSLLA

SEQ ID NO: 964407 - protein, 9 aa, Homo Sapiens
NFNVEEAQR

SEQ ID NO: 964408 - protein, 9 aa, Homo Sapiens
VRRRPSAAF

SEQ ID NO: 964409 - protein, 9 aa, Homo Sapiens
SGMNLIQTM

SEQ ID NO: 964410 - protein, 9 aa, Homo Sapiens
GFGELWRGQ

SEQ ID NO: 964411 - protein, 9 aa, Homo Sapiens
LGKKRELSD

SEQ ID NO: 964412 - protein, 9 aa, Homo Sapiens
GTRAPPSLG

SEQ ID NO: 964413 - protein, 9 aa, Homo Sapiens
FLEGEPREF

SEQ ID NO: 964414 - protein, 9 aa, Homo Sapiens
VWFNLTAQN

SEQ ID NO: 964415 - protein, 9 aa, Homo Sapiens
RFMDVTPRE

SEQ ID NO: 964416 - protein, 9 aa, Homo Sapiens
ARHTRWPDV

SEQ ID NO: 964417 - protein, 9 aa, Homo Sapiens
SEPQHLKEK

SEQ ID NO: 964418 - protein, 9 aa, Homo Sapiens
DPPKLKRAK

SEQ ID NO: 964419 - protein, 9 aa, Homo Sapiens
SGDFAATKF

SEQ ID NO: 964420 - protein, 9 aa, Homo Sapiens
SEESTPFII

SEQ ID NO: 964421 - protein, 9 aa, Homo Sapiens
AAQSEEKQG

SEQ ID NO: 964422 - protein, 9 aa, Homo Sapiens
YDYKRRVNC

SEQ ID NO: 964423 - protein, 9 aa, Homo Sapiens
RRQSSVKPS

SEQ ID NO: 964424 - protein, 9 aa, Homo Sapiens
RREKEVFIF

SEQ ID NO: 964425 - protein, 9 aa, Homo Sapiens
PSPRQRTCV

SEQ ID NO: 964426 - protein, 9 aa, Homo Sapiens
ELTLEILDC

SEQ ID NO: 964427 - protein, 9 aa, Homo Sapiens
AAAALSVCR

SEQ ID NO: 964428 - protein, 9 aa, Homo Sapiens
LLTNKAVLS

SEQ ID NO: 964429 - protein, 9 aa, Homo Sapiens
ESIRKFLYC

SEQ ID NO: 964430 - protein, 9 aa, Homo Sapiens
DTASALINK

SEQ ID NO: 964431 - protein, 9 aa, Homo Sapiens
LQEEADAAK

SEQ ID NO: 964432 - protein, 9 aa, Homo Sapiens
NFDQDNDKV

SEQ ID NO: 964433 - protein, 9 aa, Homo Sapiens
KFVRLPEYD

SEQ ID NO: 964434 - protein, 9 aa, Homo Sapiens
HQIHNVEIV

SEQ ID NO: 964435 - protein, 9 aa, Homo Sapiens
PNVPCRALK

SEQ ID NO: 964436 - protein, 9 aa, Homo Sapiens
ITQSGSPRL

SEQ ID NO: 964437 - protein, 9 aa, Homo Sapiens
ATVSTLAPP

SEQ ID NO: 964438 - protein, 9 aa, Homo Sapiens
ILPSSDRTP

SEQ ID NO: 964439 - protein, 9 aa, Homo Sapiens
RHKGKNCII

SEQ ID NO: 964440 - protein, 9 aa, Homo Sapiens
EILNEEKVK

SEQ ID NO: 964441 - protein, 9 aa, Homo Sapiens
SWTGRICVV

SEQ ID NO: 964442 - protein, 9 aa, Homo Sapiens
GTVGAIGTH

SEQ ID NO: 964443 - protein, 9 aa, Homo Sapiens
NFEFVKVSL

SEQ ID NO: 964444 - protein, 9 aa, Homo Sapiens
LDPEAEPSI

SEQ ID NO: 964445 - protein, 9 aa, Homo Sapiens
PPTAGLRAP

SEQ ID NO: 964446 - protein, 9 aa, Homo Sapiens
PKPRLFMPN

SEQ ID NO: 964447 - protein, 9 aa, Homo Sapiens
GQRGLPGLE

SEQ ID NO: 964448 - protein, 9 aa, Homo Sapiens
GLCSSNTSL

SEQ ID NO: 964449 - protein, 9 aa, Homo Sapiens
FVLYLLEDR

SEQ ID NO: 964450 - protein, 9 aa, Homo Sapiens
KLCPATSFK

SEQ ID NO: 964451 - protein, 9 aa, Homo Sapiens
VGSERREKF

SEQ ID NO: 964452 - protein, 9 aa, Homo Sapiens
LEESKKQRL

SEQ ID NO: 964453 - protein, 9 aa, Homo Sapiens
YWPYKQQNQ

SEQ ID NO: 964454 - protein, 9 aa, Homo Sapiens
LAHSSLRNR

SEQ ID NO: 964455 - protein, 9 aa, Homo Sapiens
GLCYDYKRR

SEQ ID NO: 964456 - protein, 9 aa, Homo Sapiens
YYPDKNPDN

SEQ ID NO: 964457 - protein, 9 aa, Homo Sapiens
RARFTRSIL

SEQ ID NO: 964458 - protein, 9 aa, Homo Sapiens
GVQRDEEGW

SEQ ID NO: 964459 - protein, 9 aa, Homo Sapiens
GLSLMPGGN

SEQ ID NO: 964460 - protein, 9 aa, Homo Sapiens
GRNELESVL

SEQ ID NO: 964461 - protein, 9 aa, Homo Sapiens
VNYYSNLFP

SEQ ID NO: 964462 - protein, 9 aa, Homo Sapiens
YFQQGLHWL

SEQ ID NO: 964463 - protein, 9 aa, Homo Sapiens
IPNICSHGL

SEQ ID NO: 964464 - protein, 9 aa, Homo Sapiens
QSEEKQGIT

SEQ ID NO: 964465 - protein, 9 aa, Homo Sapiens
LQARKSSSL

SEQ ID NO: 964466 - protein, 9 aa, Homo Sapiens
GASPSLPRS

SEQ ID NO: 964467 - protein, 9 aa, Homo Sapiens
IRPDPPHPC

SEQ ID NO: 964468 - protein, 9 aa, Homo Sapiens
TTERKKKGK

SEQ ID NO: 964469 - protein, 9 aa, Homo Sapiens
RTNTGFLQT

SEQ ID NO: 964470 - protein, 9 aa, Homo Sapiens
PLRKELDCL

SEQ ID NO: 964471 - protein, 9 aa, Homo Sapiens
HNLHSACVQ

SEQ ID NO: 964472 - protein, 9 aa, Homo Sapiens
QEHYLSSAI

SEQ ID NO: 964473 - protein, 9 aa, Homo Sapiens
LRLGVIQKS

SEQ ID NO: 964474 - protein, 9 aa, Homo Sapiens
PDSGMYSSS

SEQ ID NO: 964475 - protein, 9 aa, Homo Sapiens
MPQPLNLTL

SEQ ID NO: 964476 - protein, 9 aa, Homo Sapiens
TSAYLAPEV

SEQ ID NO: 964477 - protein, 9 aa, Homo Sapiens
KTAQDIVTC

SEQ ID NO: 964478 - protein, 9 aa, Homo Sapiens
PTPIPTPLP

SEQ ID NO: 964479 - protein, 9 aa, Homo Sapiens
CPATSFKEV

SEQ ID NO: 964480 - protein, 9 aa, Homo Sapiens
SPRQRTCVK

SEQ ID NO: 964481 - protein, 9 aa, Homo Sapiens
DIPEILPSS

SEQ ID NO: 964482 - protein, 9 aa, Homo Sapiens
YYDFPRGVQ

SEQ ID NO: 964483 - protein, 9 aa, Homo Sapiens
GNIGKLNLD

SEQ ID NO: 964484 - protein, 9 aa, Homo Sapiens
SVQCQRWSA

SEQ ID NO: 964485 - protein, 9 aa, Homo Sapiens
LEEFKEVAK

SEQ ID NO: 964486 - protein, 9 aa, Homo Sapiens
PNTTKDYDT

SEQ ID NO: 964487 - protein, 9 aa, Homo Sapiens
SEAAKKDGT

SEQ ID NO: 964488 - protein, 9 aa, Homo Sapiens
VALLWHSSS

SEQ ID NO: 964489 - protein, 9 aa, Homo Sapiens
KELYAWDNK

SEQ ID NO: 964490 - protein, 9 aa, Homo Sapiens
VLSEGLQRL

SEQ ID NO: 964491 - protein, 9 aa, Homo Sapiens
KVIVSVKDA

SEQ ID NO: 964492 - protein, 9 aa, Homo Sapiens
DETNLITRL

SEQ ID NO: 964493 - protein, 9 aa, Homo Sapiens
EEEMIYQKV

SEQ ID NO: 964494 - protein, 9 aa, Homo Sapiens
AKQAGKLVG

SEQ ID NO: 964495 - protein, 9 aa, Homo Sapiens
PGSALLQRN

SEQ ID NO: 964496 - protein, 9 aa, Homo Sapiens
ESTEHGEKT

SEQ ID NO: 964497 - protein, 9 aa, Homo Sapiens
LPAVARCFH

SEQ ID NO: 964498 - protein, 9 aa, Homo Sapiens
PPLPLSGLH

SEQ ID NO: 964499 - protein, 9 aa, Homo Sapiens
LSGDLYPGG

SEQ ID NO: 964500 - protein, 9 aa, Homo Sapiens
RPSADPEKK

SEQ ID NO: 964501 - protein, 9 aa, Homo Sapiens
AHRPHTFQF

SEQ ID NO: 964502 - protein, 9 aa, Homo Sapiens
KWKEPCQIE

SEQ ID NO: 964503 - protein, 9 aa, Homo Sapiens
ESCFNVEIK

SEQ ID NO: 964504 - protein, 9 aa, Homo Sapiens
ELPAACEKA

SEQ ID NO: 964505 - protein, 9 aa, Homo Sapiens
ASAEPDLSP

SEQ ID NO: 964506 - protein, 9 aa, Homo Sapiens
LQKMEAMSD

SEQ ID NO: 964507 - protein, 9 aa, Homo Sapiens
NSPRSDTPR

SEQ ID NO: 964508 - protein, 9 aa, Homo Sapiens
QVCIVMRRD

SEQ ID NO: 964509 - protein, 9 aa, Homo Sapiens
VISAFSHTM

SEQ ID NO: 964510 - protein, 9 aa, Homo Sapiens
TSVSSFSEV

SEQ ID NO: 964511 - protein, 9 aa, Homo Sapiens
GKTGSAEAR

SEQ ID NO: 964512 - protein, 9 aa, Homo Sapiens
HQQDAEVTC

SEQ ID NO: 964513 - protein, 9 aa, Homo Sapiens
AADLLLGYM

SEQ ID NO: 964514 - protein, 9 aa, Homo Sapiens
FNPRENTWQ

SEQ ID NO: 964515 - protein, 9 aa, Homo Sapiens
IHTKEKPAK

SEQ ID NO: 964516 - protein, 9 aa, Homo Sapiens
CPVGFCYND

SEQ ID NO: 964517 - protein, 9 aa, Homo Sapiens
TFKKTFKML

SEQ ID NO: 964518 - protein, 9 aa, Homo Sapiens
KHRSTHMGF

SEQ ID NO: 964519 - protein, 9 aa, Homo Sapiens
PQDFNPQPF

SEQ ID NO: 964520 - protein, 9 aa, Homo Sapiens
SFLIIHQRM

SEQ ID NO: 964521 - protein, 9 aa, Homo Sapiens
HSSRRITDE

SEQ ID NO: 964522 - protein, 9 aa, Homo Sapiens
GPCNSPRSD

SEQ ID NO: 964523 - protein, 9 aa, Homo Sapiens
LLRLGPKSF

SEQ ID NO: 964524 - protein, 9 aa, Homo Sapiens
SDSGHEEKS

SEQ ID NO: 964525 - protein, 9 aa, Homo Sapiens
KGDPGEEEK

SEQ ID NO: 964526 - protein, 9 aa, Homo Sapiens
EQYCQCKGR

SEQ ID NO: 964527 - protein, 9 aa, Homo Sapiens
GQTFPIKPK

SEQ ID NO: 964528 - protein, 9 aa, Homo Sapiens
QRELLIQDI

SEQ ID NO: 964529 - protein, 9 aa, Homo Sapiens
DKPAPGEWS

SEQ ID NO: 964530 - protein, 9 aa, Homo Sapiens
QHTHTLLFY

SEQ ID NO: 964531 - protein, 9 aa, Homo Sapiens
RRQGKIFPE

SEQ ID NO: 964532 - protein, 9 aa, Homo Sapiens
VETSDLYAD

SEQ ID NO: 964533 - protein, 9 aa, Homo Sapiens
SSGDFAATK

SEQ ID NO: 964534 - protein, 9 aa, Homo Sapiens
SNELMIFAR

SEQ ID NO: 964535 - protein, 9 aa, Homo Sapiens
IKVLKRRTW

SEQ ID NO: 964536 - protein, 9 aa, Homo Sapiens
ENSFLEVSA

SEQ ID NO: 964537 - protein, 9 aa, Homo Sapiens
YREQQRQHK

SEQ ID NO: 964538 - protein, 9 aa, Homo Sapiens
TTKDYDTTT

SEQ ID NO: 964539 - protein, 9 aa, Homo Sapiens
RRLLRKKGV

SEQ ID NO: 964540 - protein, 9 aa, Homo Sapiens
NVLKFLLSN

SEQ ID NO: 964541 - protein, 9 aa, Homo Sapiens
DAHGGSISL

SEQ ID NO: 964542 - protein, 9 aa, Homo Sapiens
TGFPWAFKM

SEQ ID NO: 964543 - protein, 9 aa, Homo Sapiens
SHLIWHQKV

SEQ ID NO: 964544 - protein, 9 aa, Homo Sapiens
SQMNAALMH

SEQ ID NO: 964545 - protein, 9 aa, Homo Sapiens
STFENITQK

SEQ ID NO: 964546 - protein, 9 aa, Homo Sapiens
LNYLGNYIS

SEQ ID NO: 964547 - protein, 9 aa, Homo Sapiens
ALAHSSLRN

SEQ ID NO: 964548 - protein, 9 aa, Homo Sapiens
NVEVETELF

SEQ ID NO: 964549 - protein, 9 aa, Homo Sapiens
VVNASKVKT

SEQ ID NO: 964550 - protein, 9 aa, Homo Sapiens
SSWGDCAEP

SEQ ID NO: 964551 - protein, 9 aa, Homo Sapiens
AAARRQSSV

SEQ ID NO: 964552 - protein, 9 aa, Homo Sapiens
YALQKPWLL

SEQ ID NO: 964553 - protein, 9 aa, Homo Sapiens
HHINNEHIY

SEQ ID NO: 964554 - protein, 9 aa, Homo Sapiens
LWKYFLNTC

SEQ ID NO: 964555 - protein, 9 aa, Homo Sapiens
GNFVTSRET

SEQ ID NO: 964556 - protein, 9 aa, Homo Sapiens
PPELDIFPG

SEQ ID NO: 964557 - protein, 9 aa, Homo Sapiens
KAKMPSYLM

SEQ ID NO: 964558 - protein, 9 aa, Homo Sapiens
DRGNIGKLN

SEQ ID NO: 964559 - protein, 9 aa, Homo Sapiens
ELYAWDNKR

SEQ ID NO: 964560 - protein, 9 aa, Homo Sapiens
VLVKTLEDN

SEQ ID NO: 964561 - protein, 9 aa, Homo Sapiens
LFLTYVEGV

SEQ ID NO: 964562 - protein, 9 aa, Homo Sapiens
GLSPASSSS

SEQ ID NO: 964563 - protein, 9 aa, Homo Sapiens
MAPWDPLGC

SEQ ID NO: 964564 - protein, 9 aa, Homo Sapiens
DKALDQEEQ

SEQ ID NO: 964565 - protein, 9 aa, Homo Sapiens
YLSSAILQL

SEQ ID NO: 964566 - protein, 9 aa, Homo Sapiens
KEILHHEQK

SEQ ID NO: 964567 - protein, 9 aa, Homo Sapiens
QRLAGPRDS

SEQ ID NO: 964568 - protein, 9 aa, Homo Sapiens
PEDQPLTST

SEQ ID NO: 964569 - protein, 9 aa, Homo Sapiens
IKEGVKDVN

SEQ ID NO: 964570 - protein, 9 aa, Homo Sapiens
CDTAYQHGN

SEQ ID NO: 964571 - protein, 9 aa, Homo Sapiens
HGDCISEVC

SEQ ID NO: 964572 - protein, 9 aa, Homo Sapiens
MKEGVKESL

SEQ ID NO: 964573 - protein, 9 aa, Homo Sapiens
VAKLGEQID

SEQ ID NO: 964574 - protein, 9 aa, Homo Sapiens
FFNLNVTLK

SEQ ID NO: 964575 - protein, 9 aa, Homo Sapiens
TYEVSAKGQ

SEQ ID NO: 964576 - protein, 9 aa, Homo Sapiens
ASSERFNMG

SEQ ID NO: 964577 - protein, 9 aa, Homo Sapiens
LDCVWLLLQ

SEQ ID NO: 964578 - protein, 9 aa, Homo Sapiens
LQYATHFSI

SEQ ID NO: 964579 - protein, 9 aa, Homo Sapiens
SMPKLEGDL

SEQ ID NO: 964580 - protein, 9 aa, Homo Sapiens
NGPQILGFG

SEQ ID NO: 964581 - protein, 9 aa, Homo Sapiens
VFSRKPFVV

SEQ ID NO: 964582 - protein, 9 aa, Homo Sapiens
PGFYLGDQD

SEQ ID NO: 964583 - protein, 9 aa, Homo Sapiens
GPVAYALQK

SEQ ID NO: 964584 - protein, 9 aa, Homo Sapiens
RKKRKEWVL

SEQ ID NO: 964585 - protein, 9 aa, Homo Sapiens
SAEARGHTG

SEQ ID NO: 964586 - protein, 9 aa, Homo Sapiens
RDYSSLLKR

SEQ ID NO: 964587 - protein, 9 aa, Homo Sapiens
ARIASESAE

SEQ ID NO: 964588 - protein, 9 aa, Homo Sapiens
IGANPFYCD

SEQ ID NO: 964589 - protein, 9 aa, Homo Sapiens
CRTTVSWGE

SEQ ID NO: 964590 - protein, 9 aa, Homo Sapiens
ILKYKKKYY

SEQ ID NO: 964591 - protein, 9 aa, Homo Sapiens
EAKVFRLRD

SEQ ID NO: 964592 - protein, 9 aa, Homo Sapiens
KEFNFASYV

SEQ ID NO: 964593 - protein, 9 aa, Homo Sapiens
STLKIKNEM

SEQ ID NO: 964594 - protein, 9 aa, Homo Sapiens
VDSFTGSLV

SEQ ID NO: 964595 - protein, 9 aa, Homo Sapiens
FKKDCDRRC

SEQ ID NO: 964596 - protein, 9 aa, Homo Sapiens
LLQSSVLWK

SEQ ID NO: 964597 - protein, 9 aa, Homo Sapiens
LASQSKACD

SEQ ID NO: 964598 - protein, 9 aa, Homo Sapiens
ICSELDVGN

SEQ ID NO: 964599 - protein, 9 aa, Homo Sapiens
RGVQKNKPV

SEQ ID NO: 964600 - protein, 9 aa, Homo Sapiens
DSKGGGAGH

SEQ ID NO: 964601 - protein, 9 aa, Homo Sapiens
CSISLQDVY

SEQ ID NO: 964602 - protein, 9 aa, Homo Sapiens
GENSVLHLS

SEQ ID NO: 964603 - protein, 9 aa, Homo Sapiens
TQDFLQMFL

SEQ ID NO: 964604 - protein, 9 aa, Homo Sapiens
RLGKQNFHK

SEQ ID NO: 964605 - protein, 9 aa, Homo Sapiens
WGGKRRRLG

SEQ ID NO: 964606 - protein, 9 aa, Homo Sapiens
EFLGSAELL

SEQ ID NO: 964607 - protein, 9 aa, Homo Sapiens
SDHLTIHIR

SEQ ID NO: 964608 - protein, 9 aa, Homo Sapiens
QGPYEEIIS

SEQ ID NO: 964609 - protein, 9 aa, Homo Sapiens
EQSRTNRDD

SEQ ID NO: 964610 - protein, 9 aa, Homo Sapiens
CVDKCNFLE

SEQ ID NO: 964611 - protein, 9 aa, Homo Sapiens
PDNIVFVMD

SEQ ID NO: 964612 - protein, 9 aa, Homo Sapiens
LGIMVSKAV

SEQ ID NO: 964613 - protein, 9 aa, Homo Sapiens
RKTDVPSGR

SEQ ID NO: 964614 - protein, 9 aa, Homo Sapiens
KDGVRGPTG

SEQ ID NO: 964615 - protein, 9 aa, Homo Sapiens
TTHVFFRSV

SEQ ID NO: 964616 - protein, 9 aa, Homo Sapiens
RLRDRDDIV

SEQ ID NO: 964617 - protein, 9 aa, Homo Sapiens
FSDSSLLTP

SEQ ID NO: 964618 - protein, 9 aa, Homo Sapiens
NSGLASGLT

SEQ ID NO: 964619 - protein, 9 aa, Homo Sapiens
KKHADSVAK

SEQ ID NO: 964620 - protein, 9 aa, Homo Sapiens
VLRFLLENP

SEQ ID NO: 964621 - protein, 9 aa, Homo Sapiens
PVYESWFKE

SEQ ID NO: 964622 - protein, 9 aa, Homo Sapiens
ILWQITVND

SEQ ID NO: 964623 - protein, 9 aa, Homo Sapiens
KSKVEDKLF

SEQ ID NO: 964624 - protein, 9 aa, Homo Sapiens
WVLLLFVLS

SEQ ID NO: 964625 - protein, 9 aa, Homo Sapiens
RPTGNASWL

SEQ ID NO: 964626 - protein, 9 aa, Homo Sapiens
SSGGVPQGL

SEQ ID NO: 964627 - protein, 9 aa, Homo Sapiens
MIEDGKIYT

SEQ ID NO: 964628 - protein, 9 aa, Homo Sapiens
AFSDSSLLT

SEQ ID NO: 964629 - protein, 9 aa, Homo Sapiens
IFFSTAFCL

SEQ ID NO: 964630 - protein, 9 aa, Homo Sapiens
SCSISLQDV

SEQ ID NO: 964631 - protein, 9 aa, Homo Sapiens
VVIEFFLEE

SEQ ID NO: 964632 - protein, 9 aa, Homo Sapiens
LTSTGSDPQ

SEQ ID NO: 964633 - protein, 9 aa, Homo Sapiens
AAGVFMPVG

SEQ ID NO: 964634 - protein, 9 aa, Homo Sapiens
GLLPSGVPA

SEQ ID NO: 964635 - protein, 9 aa, Homo Sapiens
RLHSTEEEV

SEQ ID NO: 964636 - protein, 9 aa, Homo Sapiens
GDPSFPLQH

SEQ ID NO: 964637 - protein, 9 aa, Homo Sapiens
LLGYMKSRV

SEQ ID NO: 964638 - protein, 9 aa, Homo Sapiens
GPGAYELGI

SEQ ID NO: 964639 - protein, 9 aa, Homo Sapiens
KVLMGNVPN

SEQ ID NO: 964640 - protein, 9 aa, Homo Sapiens
SMYFFLAIL

SEQ ID NO: 964641 - protein, 9 aa, Homo Sapiens
GSFKNPSFF

SEQ ID NO: 964642 - protein, 9 aa, Homo Sapiens
GDWSPEVPR

SEQ ID NO: 964643 - protein, 9 aa, Homo Sapiens
PKLPPTAGL

SEQ ID NO: 964644 - protein, 9 aa, Homo Sapiens
VDLPELSEQ

SEQ ID NO: 964645 - protein, 9 aa, Homo Sapiens
VTLLTYHRV

SEQ ID NO: 964646 - protein, 9 aa, Homo Sapiens
VAALSIPLH

SEQ ID NO: 964647 - protein, 9 aa, Homo Sapiens
VATEAVGPG

SEQ ID NO: 964648 - protein, 9 aa, Homo Sapiens
LYKKRLKDL

SEQ ID NO: 964649 - protein, 9 aa, Homo Sapiens
SYWILNFTR

SEQ ID NO: 964650 - protein, 9 aa, Homo Sapiens
QSPAENRGR

SEQ ID NO: 964651 - protein, 9 aa, Homo Sapiens
KILEKGKSG

SEQ ID NO: 964652 - protein, 9 aa, Homo Sapiens
SSNCTEPFS

SEQ ID NO: 964653 - protein, 9 aa, Homo Sapiens
LERKLPCCL

SEQ ID NO: 964654 - protein, 9 aa, Homo Sapiens
IEKAVIFPG

SEQ ID NO: 964655 - protein, 9 aa, Homo Sapiens
EAGEKLSGG

SEQ ID NO: 964656 - protein, 9 aa, Homo Sapiens
EKRKKSDKT

SEQ ID NO: 964657 - protein, 9 aa, Homo Sapiens
RAHLQGLVL

SEQ ID NO: 964658 - protein, 9 aa, Homo Sapiens
ENQHVEHEF

SEQ ID NO: 964659 - protein, 9 aa, Homo Sapiens
IYCRLFNHV

SEQ ID NO: 964660 - protein, 9 aa, Homo Sapiens
EIANCYRNG

SEQ ID NO: 964661 - protein, 9 aa, Homo Sapiens
QLRGQTGVR

SEQ ID NO: 964662 - protein, 9 aa, Homo Sapiens
ISDDEEQRT

SEQ ID NO: 964663 - protein, 9 aa, Homo Sapiens
IVQAILRMQ

SEQ ID NO: 964664 - protein, 9 aa, Homo Sapiens
EDGYTHQWT

SEQ ID NO: 964665 - protein, 9 aa, Homo Sapiens
DLSTMSAER

SEQ ID NO: 964666 - protein, 9 aa, Homo Sapiens
QVYLKEEEK

SEQ ID NO: 964667 - protein, 9 aa, Homo Sapiens
SETPPFSGN

SEQ ID NO: 964668 - protein, 9 aa, Homo Sapiens
REPNIPRVA

SEQ ID NO: 964669 - protein, 9 aa, Homo Sapiens
LIRNLQERR

SEQ ID NO: 964670 - protein, 9 aa, Homo Sapiens
TVFKFLGMA

SEQ ID NO: 964671 - protein, 9 aa, Homo Sapiens
MREVIGLEI

SEQ ID NO: 964672 - protein, 9 aa, Homo Sapiens
LQKKSLTSE

SEQ ID NO: 964673 - protein, 9 aa, Homo Sapiens
QAGKLVGVV

SEQ ID NO: 964674 - protein, 9 aa, Homo Sapiens
GLLETTDEP

SEQ ID NO: 964675 - protein, 9 aa, Homo Sapiens
DHPSKSVEK

SEQ ID NO: 964676 - protein, 9 aa, Homo Sapiens
RHGLGHGHE

SEQ ID NO: 964677 - protein, 9 aa, Homo Sapiens
TRAAVQNVV

SEQ ID NO: 964678 - protein, 9 aa, Homo Sapiens
APSDQGKEK

SEQ ID NO: 964679 - protein, 9 aa, Homo Sapiens
YENGFFKDR

SEQ ID NO: 964680 - protein, 9 aa, Homo Sapiens
NVSNQTAYL

SEQ ID NO: 964681 - protein, 9 aa, Homo Sapiens
DESPEASLG

SEQ ID NO: 964682 - protein, 9 aa, Homo Sapiens
DFVPGALDY

SEQ ID NO: 964683 - protein, 9 aa, Homo Sapiens
EEMIYQKVH

SEQ ID NO: 964684 - protein, 9 aa, Homo Sapiens
KPLSCGSTQ

SEQ ID NO: 964685 - protein, 9 aa, Homo Sapiens
GAVAFADFY

SEQ ID NO: 964686 - protein, 9 aa, Homo Sapiens
QPSHLPTSL

SEQ ID NO: 964687 - protein, 9 aa, Homo Sapiens
LRIWVVLRF

SEQ ID NO: 964688 - protein, 9 aa, Homo Sapiens
CNFLEGEPR

SEQ ID NO: 964689 - protein, 9 aa, Homo Sapiens
APETRNSPA

SEQ ID NO: 964690 - protein, 9 aa, Homo Sapiens
RTFKKTFKM

SEQ ID NO: 964691 - protein, 9 aa, Homo Sapiens
SNCTEPFSN

SEQ ID NO: 964692 - protein, 9 aa, Homo Sapiens
QRTCVKTVF

SEQ ID NO: 964693 - protein, 9 aa, Homo Sapiens
RWTWTSPGE

SEQ ID NO: 964694 - protein, 9 aa, Homo Sapiens
HVGGIVGQL

SEQ ID NO: 964695 - protein, 9 aa, Homo Sapiens
QEDKPAPGE

SEQ ID NO: 964696 - protein, 9 aa, Homo Sapiens
KWIPTKFFE

SEQ ID NO: 964697 - protein, 9 aa, Homo Sapiens
RCECPVGFC

SEQ ID NO: 964698 - protein, 9 aa, Homo Sapiens
EGLLTNKAV

SEQ ID NO: 964699 - protein, 9 aa, Homo Sapiens
YDLKVSAHP

SEQ ID NO: 964700 - protein, 9 aa, Homo Sapiens
SSSSRTPQA

SEQ ID NO: 964701 - protein, 9 aa, Homo Sapiens
RAPSDQGKE

SEQ ID NO: 964702 - protein, 9 aa, Homo Sapiens
GGHTDSNTS

SEQ ID NO: 964703 - protein, 9 aa, Homo Sapiens
QPLTSTGSD

SEQ ID NO: 964704 - protein, 9 aa, Homo Sapiens
SRQLYGLGS

SEQ ID NO: 964705 - protein, 9 aa, Homo Sapiens
LTITVPEPF

SEQ ID NO: 964706 - protein, 9 aa, Homo Sapiens
KREEDGYTH

SEQ ID NO: 964707 - protein, 9 aa, Homo Sapiens
KLEGWLVFI

SEQ ID NO: 964708 - protein, 9 aa, Homo Sapiens
VLTVKKSDA

SEQ ID NO: 964709 - protein, 9 aa, Homo Sapiens
HGKRVPLNY

SEQ ID NO: 964710 - protein, 9 aa, Homo Sapiens
KFFSRIECE

SEQ ID NO: 964711 - protein, 9 aa, Homo Sapiens
KANCLPANS

SEQ ID NO: 964712 - protein, 9 aa, Homo Sapiens
AELQSRLVA

SEQ ID NO: 964713 - protein, 9 aa, Homo Sapiens
QVPGKHVYR

SEQ ID NO: 964714 - protein, 9 aa, Homo Sapiens
IDVILVGSS

SEQ ID NO: 964715 - protein, 9 aa, Homo Sapiens
GKGTGEQQR

SEQ ID NO: 964716 - protein, 9 aa, Homo Sapiens
VREPNIPRV

SEQ ID NO: 964717 - protein, 9 aa, Homo Sapiens
QSPTAADLL

SEQ ID NO: 964718 - protein, 9 aa, Homo Sapiens
YPDKNPDNP

SEQ ID NO: 964719 - protein, 9 aa, Homo Sapiens
GWATSLKGF

SEQ ID NO: 964720 - protein, 9 aa, Homo Sapiens
GYYLTQHER

SEQ ID NO: 964721 - protein, 9 aa, Homo Sapiens
RNELESVLG

SEQ ID NO: 964722 - protein, 9 aa, Homo Sapiens
DRTSVSSFS

SEQ ID NO: 964723 - protein, 9 aa, Homo Sapiens
CLSPALPTP

SEQ ID NO: 964724 - protein, 9 aa, Homo Sapiens
KENSEGGEK

SEQ ID NO: 964725 - protein, 9 aa, Homo Sapiens
PVIFKLACQ

SEQ ID NO: 964726 - protein, 9 aa, Homo Sapiens
SQCSRSLGR

SEQ ID NO: 964727 - protein, 9 aa, Homo Sapiens
LSVFKLITE

SEQ ID NO: 964728 - protein, 9 aa, Homo Sapiens
ARKRLFKEE

SEQ ID NO: 964729 - protein, 9 aa, Homo Sapiens
IGLEIEAYV

SEQ ID NO: 964730 - protein, 9 aa, Homo Sapiens
RSFKGVKFG

SEQ ID NO: 964731 - protein, 9 aa, Homo Sapiens
LEQVVAIEV

SEQ ID NO: 964732 - protein, 9 aa, Homo Sapiens
RIISGGVAE

SEQ ID NO: 964733 - protein, 9 aa, Homo Sapiens
DLKSLIQEK

SEQ ID NO: 964734 - protein, 9 aa, Homo Sapiens
RNCSACTYL

SEQ ID NO: 964735 - protein, 9 aa, Homo Sapiens
LGNYISRFW

SEQ ID NO: 964736 - protein, 9 aa, Homo Sapiens
ESPEASLGP

SEQ ID NO: 964737 - protein, 9 aa, Homo Sapiens
FRLSSLFAV

SEQ ID NO: 964738 - protein, 9 aa, Homo Sapiens
ASSGSETST

SEQ ID NO: 964739 - protein, 9 aa, Homo Sapiens
GGLIQDLNN

SEQ ID NO: 964740 - protein, 9 aa, Homo Sapiens
SQAVLFLLF

SEQ ID NO: 964741 - protein, 9 aa, Homo Sapiens
PQSVLILQH

SEQ ID NO: 964742 - protein, 9 aa, Homo Sapiens
NKCQDLKSL

SEQ ID NO: 964743 - protein, 9 aa, Homo Sapiens
FMKQPQGKG

SEQ ID NO: 964744 - protein, 9 aa, Homo Sapiens
SKRGEIVRQ

SEQ ID NO: 964745 - protein, 9 aa, Homo Sapiens
GPWAPGRAP

SEQ ID NO: 964746 - protein, 9 aa, Homo Sapiens
TLSVSVSKN

SEQ ID NO: 964747 - protein, 9 aa, Homo Sapiens
PIYSVCMGT

SEQ ID NO: 964748 - protein, 9 aa, Homo Sapiens
MKWRIDKVI

SEQ ID NO: 964749 - protein, 9 aa, Homo Sapiens
SRIISGGVA

SEQ ID NO: 964750 - protein, 9 aa, Homo Sapiens
GPPPPPGLL

SEQ ID NO: 964751 - protein, 9 aa, Homo Sapiens
DFFQPFPSG

SEQ ID NO: 964752 - protein, 9 aa, Homo Sapiens
PLSGLHTDG

SEQ ID NO: 964753 - protein, 9 aa, Homo Sapiens
LRFLGLCLE

SEQ ID NO: 964754 - protein, 9 aa, Homo Sapiens
FFSFMAFFF

SEQ ID NO: 964755 - protein, 9 aa, Homo Sapiens
VRLLENALS

SEQ ID NO: 964756 - protein, 9 aa, Homo Sapiens
SPLFSSLCA

SEQ ID NO: 964757 - protein, 9 aa, Homo Sapiens
RVGGVLGAV

SEQ ID NO: 964758 - protein, 9 aa, Homo Sapiens
CQPPSVCPT

SEQ ID NO: 964759 - protein, 9 aa, Homo Sapiens
ETPNTTKDY

SEQ ID NO: 964760 - protein, 9 aa, Homo Sapiens
VQSQGMNSY

SEQ ID NO: 964761 - protein, 9 aa, Homo Sapiens
ESINFIKQK

SEQ ID NO: 964762 - protein, 9 aa, Homo Sapiens
TVLTYLTIF

SEQ ID NO: 964763 - protein, 9 aa, Homo Sapiens
EVAPNPANF

SEQ ID NO: 964764 - protein, 9 aa, Homo Sapiens
LGVSYIEDF

SEQ ID NO: 964765 - protein, 9 aa, Homo Sapiens
EESYDLKNT

SEQ ID NO: 964766 - protein, 9 aa, Homo Sapiens
GFCYNDKLL

SEQ ID NO: 964767 - protein, 9 aa, Homo Sapiens
RGRKPRDQS

SEQ ID NO: 964768 - protein, 9 aa, Homo Sapiens
FLAEKFKVS

SEQ ID NO: 964769 - protein, 9 aa, Homo Sapiens
VHPEQLLPR

SEQ ID NO: 964770 - protein, 9 aa, Homo Sapiens
NEKITHYTI

SEQ ID NO: 964771 - protein, 9 aa, Homo Sapiens
NAENQHVEH

SEQ ID NO: 964772 - protein, 9 aa, Homo Sapiens
FGEGDAVTK

SEQ ID NO: 964773 - protein, 9 aa, Homo Sapiens
AELSKNLVC

SEQ ID NO: 964774 - protein, 9 aa, Homo Sapiens
LRVLFFVAA

SEQ ID NO: 964775 - protein, 9 aa, Homo Sapiens
PLYGQMIIY

SEQ ID NO: 964776 - protein, 9 aa, Homo Sapiens
NYKLWHLDS

SEQ ID NO: 964777 - protein, 9 aa, Homo Sapiens
FNWDPKTVG

SEQ ID NO: 964778 - protein, 9 aa, Homo Sapiens
SAFRAAGIT

SEQ ID NO: 964779 - protein, 9 aa, Homo Sapiens
LEKSRCIVN

SEQ ID NO: 964780 - protein, 9 aa, Homo Sapiens
KELSPPLSD

SEQ ID NO: 964781 - protein, 9 aa, Homo Sapiens
LTYHRVVFF

SEQ ID NO: 964782 - protein, 9 aa, Homo Sapiens
FCYNDKLLV

SEQ ID NO: 964783 - protein, 9 aa, Homo Sapiens
LLPSGVPAA

SEQ ID NO: 964784 - protein, 9 aa, Homo Sapiens
WVSFTRKEG

SEQ ID NO: 964785 - protein, 9 aa, Homo Sapiens
FKGINVLVK

SEQ ID NO: 964786 - protein, 9 aa, Homo Sapiens
QNPRLFAEE

SEQ ID NO: 964787 - protein, 9 aa, Homo Sapiens
SSNSRASAF

SEQ ID NO: 964788 - protein, 9 aa, Homo Sapiens
HEPAFFNLN

SEQ ID NO: 964789 - protein, 9 aa, Homo Sapiens
EYSLKKIRK

SEQ ID NO: 964790 - protein, 9 aa, Homo Sapiens
GTPEAPAGQ

SEQ ID NO: 964791 - protein, 9 aa, Homo Sapiens
LDRTSVSSF

SEQ ID NO: 964792 - protein, 9 aa, Homo Sapiens
QASTMAATT

SEQ ID NO: 964793 - protein, 9 aa, Homo Sapiens
PFPQDPYPS

SEQ ID NO: 964794 - protein, 9 aa, Homo Sapiens
QNGLTHQSL

SEQ ID NO: 964795 - protein, 9 aa, Homo Sapiens
CYRNGGWTP

SEQ ID NO: 964796 - protein, 9 aa, Homo Sapiens
NKQESDCVS

SEQ ID NO: 964797 - protein, 9 aa, Homo Sapiens
MLCVQAQYS

SEQ ID NO: 964798 - protein, 9 aa, Homo Sapiens
GRNNSSRSQ

SEQ ID NO: 964799 - protein, 9 aa, Homo Sapiens
FPESLRHLK

SEQ ID NO: 964800 - protein, 9 aa, Homo Sapiens
RKENSVKTV

SEQ ID NO: 964801 - protein, 9 aa, Homo Sapiens
IYTVEHMIS

SEQ ID NO: 964802 - protein, 9 aa, Homo Sapiens
RDPDSLNIC

SEQ ID NO: 964803 - protein, 9 aa, Homo Sapiens
FLFSTSPLL

SEQ ID NO: 964804 - protein, 9 aa, Homo Sapiens
PCERCEHQG

SEQ ID NO: 964805 - protein, 9 aa, Homo Sapiens
TSQPQLTPP

SEQ ID NO: 964806 - protein, 9 aa, Homo Sapiens
PYKCEKCWK

SEQ ID NO: 964807 - protein, 9 aa, Homo Sapiens
DFYIFGSIF

SEQ ID NO: 964808 - protein, 9 aa, Homo Sapiens
NFFLALLLS

SEQ ID NO: 964809 - protein, 9 aa, Homo Sapiens
LSNSTVVTP

SEQ ID NO: 964810 - protein, 9 aa, Homo Sapiens
SLDSCRTHR

SEQ ID NO: 964811 - protein, 9 aa, Homo Sapiens
WSFVWSTLE

SEQ ID NO: 964812 - protein, 9 aa, Homo Sapiens
LKLAVVERL

SEQ ID NO: 964813 - protein, 9 aa, Homo Sapiens
TGEPPPGSE

SEQ ID NO: 964814 - protein, 9 aa, Homo Sapiens
KLMEHKRTH

SEQ ID NO: 964815 - protein, 9 aa, Homo Sapiens
SKAWGQVKR

SEQ ID NO: 964816 - protein, 9 aa, Homo Sapiens
LLLWPLSVP

SEQ ID NO: 964817 - protein, 9 aa, Homo Sapiens
CENNDKASE

SEQ ID NO: 964818 - protein, 9 aa, Homo Sapiens
CSSNTSLLA

SEQ ID NO: 964819 - protein, 9 aa, Homo Sapiens
LTTMGTEYG

SEQ ID NO: 964820 - protein, 9 aa, Homo Sapiens
EEKQTCEIV

SEQ ID NO: 964821 - protein, 9 aa, Homo Sapiens
FKTRTKSTV

SEQ ID NO: 964822 - protein, 9 aa, Homo Sapiens
ETTGLKANV

SEQ ID NO: 964823 - protein, 9 aa, Homo Sapiens
QLMPNECKP

SEQ ID NO: 964824 - protein, 9 aa, Homo Sapiens
VEILNEEKV

SEQ ID NO: 964825 - protein, 9 aa, Homo Sapiens
PHSALIISQ

SEQ ID NO: 964826 - protein, 9 aa, Homo Sapiens
FLKHSCPHS

SEQ ID NO: 964827 - protein, 9 aa, Homo Sapiens
HHEQKAKQL

SEQ ID NO: 964828 - protein, 9 aa, Homo Sapiens
RRGRKKRIS

SEQ ID NO: 964829 - protein, 9 aa, Homo Sapiens
KEGYCKQLG

SEQ ID NO: 964830 - protein, 9 aa, Homo Sapiens
KDIYYKTPL

SEQ ID NO: 964831 - protein, 9 aa, Homo Sapiens
AAVQEFYLS

SEQ ID NO: 964832 - protein, 9 aa, Homo Sapiens
NIRNQEELK

SEQ ID NO: 964833 - protein, 9 aa, Homo Sapiens
WYDSLTGVL

SEQ ID NO: 964834 - protein, 9 aa, Homo Sapiens
IRIPRITSI

SEQ ID NO: 964835 - protein, 9 aa, Homo Sapiens
KGNIGIKGC

SEQ ID NO: 964836 - protein, 9 aa, Homo Sapiens
AKSGTSGSW

SEQ ID NO: 964837 - protein, 9 aa, Homo Sapiens
TFRKISSLA

SEQ ID NO: 964838 - protein, 9 aa, Homo Sapiens
TGAGFGGRP

SEQ ID NO: 964839 - protein, 9 aa, Homo Sapiens
SSLVKGSLG

SEQ ID NO: 964840 - protein, 9 aa, Homo Sapiens
QQDAEVTCS

SEQ ID NO: 964841 - protein, 9 aa, Homo Sapiens
RCEHQGQVH

SEQ ID NO: 964842 - protein, 9 aa, Homo Sapiens
DYQVMDEFF

SEQ ID NO: 964843 - protein, 9 aa, Homo Sapiens
ENEVEQHRA

SEQ ID NO: 964844 - protein, 9 aa, Homo Sapiens
PTCQLKELH

SEQ ID NO: 964845 - protein, 9 aa, Homo Sapiens
VLCDACAKF

SEQ ID NO: 964846 - protein, 9 aa, Homo Sapiens
GNKQCEFAF

SEQ ID NO: 964847 - protein, 9 aa, Homo Sapiens
LNFFLALLL

SEQ ID NO: 964848 - protein, 9 aa, Homo Sapiens
YNKPASFFK

SEQ ID NO: 964849 - protein, 9 aa, Homo Sapiens
QLKFTCGNY

SEQ ID NO: 964850 - protein, 9 aa, Homo Sapiens
RPYYNPELL

SEQ ID NO: 964851 - protein, 9 aa, Homo Sapiens
YTDPSLLRK

SEQ ID NO: 964852 - protein, 9 aa, Homo Sapiens
NERGIKTAS

SEQ ID NO: 964853 - protein, 9 aa, Homo Sapiens
MTGCPGAAG

SEQ ID NO: 964854 - protein, 9 aa, Homo Sapiens
LLLAFQTPT

SEQ ID NO: 964855 - protein, 9 aa, Homo Sapiens
GRRDGFGGN

SEQ ID NO: 964856 - protein, 9 aa, Homo Sapiens
GRSSHSALF

SEQ ID NO: 964857 - protein, 9 aa, Homo Sapiens
IGNRILILP

SEQ ID NO: 964858 - protein, 9 aa, Homo Sapiens
DVPQKHSSP

SEQ ID NO: 964859 - protein, 9 aa, Homo Sapiens
GEAPRISVF

SEQ ID NO: 964860 - protein, 9 aa, Homo Sapiens
PGGADRGRN

SEQ ID NO: 964861 - protein, 9 aa, Homo Sapiens
EIPFFKQGL

SEQ ID NO: 964862 - protein, 9 aa, Homo Sapiens
GGLAAGLGS

SEQ ID NO: 964863 - protein, 9 aa, Homo Sapiens
LRYQKLGEE

SEQ ID NO: 964864 - protein, 9 aa, Homo Sapiens
KNIEKGLLH

SEQ ID NO: 964865 - protein, 9 aa, Homo Sapiens
QLMPVREPN

SEQ ID NO: 964866 - protein, 9 aa, Homo Sapiens
ENRGRKPRD

SEQ ID NO: 964867 - protein, 9 aa, Homo Sapiens
KLKRAKENQ

SEQ ID NO: 964868 - protein, 9 aa, Homo Sapiens
YFTYYFIQE

SEQ ID NO: 964869 - protein, 9 aa, Homo Sapiens
LYSRFMGTI

SEQ ID NO: 964870 - protein, 9 aa, Homo Sapiens
VDMGVSSVK

SEQ ID NO: 964871 - protein, 9 aa, Homo Sapiens
LVCLLRIST

SEQ ID NO: 964872 - protein, 9 aa, Homo Sapiens
VKFGKNLGL

SEQ ID NO: 964873 - protein, 9 aa, Homo Sapiens
YLLGMLHSN

SEQ ID NO: 964874 - protein, 9 aa, Homo Sapiens
QPPTPAATL

SEQ ID NO: 964875 - protein, 9 aa, Homo Sapiens
PQKHSSPRW

SEQ ID NO: 964876 - protein, 9 aa, Homo Sapiens
FEMIHEAQQ

SEQ ID NO: 964877 - protein, 9 aa, Homo Sapiens
QADRDYSSL

SEQ ID NO: 964878 - protein, 9 aa, Homo Sapiens
DRALHISMY

SEQ ID NO: 964879 - protein, 9 aa, Homo Sapiens
ALSVCRCKA

SEQ ID NO: 964880 - protein, 9 aa, Homo Sapiens
ILLWGHSRV

SEQ ID NO: 964881 - protein, 9 aa, Homo Sapiens
TSYGAIVQA

SEQ ID NO: 964882 - protein, 9 aa, Homo Sapiens
PWQASLRLK

SEQ ID NO: 964883 - protein, 9 aa, Homo Sapiens
LCSVEKRQS

SEQ ID NO: 964884 - protein, 9 aa, Homo Sapiens
GGSISLGKS

SEQ ID NO: 964885 - protein, 9 aa, Homo Sapiens
EQQRQHKLT

SEQ ID NO: 964886 - protein, 9 aa, Homo Sapiens
PSFSGALCP

SEQ ID NO: 964887 - protein, 9 aa, Homo Sapiens
LRMVLSLKE

SEQ ID NO: 964888 - protein, 9 aa, Homo Sapiens
NPVYPSNQT

SEQ ID NO: 964889 - protein, 9 aa, Homo Sapiens
HLLSLMVLR

SEQ ID NO: 964890 - protein, 9 aa, Homo Sapiens
KTNFLCSMT

SEQ ID NO: 964891 - protein, 9 aa, Homo Sapiens
MINTMSKIC

SEQ ID NO: 964892 - protein, 9 aa, Homo Sapiens
RLFNHVKTG

SEQ ID NO: 964893 - protein, 9 aa, Homo Sapiens
SGCSWLPDW

SEQ ID NO: 964894 - protein, 9 aa, Homo Sapiens
DMKLSFAVQ

SEQ ID NO: 964895 - protein, 9 aa, Homo Sapiens
YNPELLCRY

SEQ ID NO: 964896 - protein, 9 aa, Homo Sapiens
ARDSSIVPD

SEQ ID NO: 964897 - protein, 9 aa, Homo Sapiens
GNLVVLNFF

SEQ ID NO: 964898 - protein, 9 aa, Homo Sapiens
ATAQRGSSS

SEQ ID NO: 964899 - protein, 9 aa, Homo Sapiens
KNVKTALQR

SEQ ID NO: 964900 - protein, 9 aa, Homo Sapiens
KFVYPARAP

SEQ ID NO: 964901 - protein, 9 aa, Homo Sapiens
QGYPLPKSF

SEQ ID NO: 964902 - protein, 9 aa, Homo Sapiens
GSKGEPEKG

SEQ ID NO: 964903 - protein, 9 aa, Homo Sapiens
GSQMNAALM

SEQ ID NO: 964904 - protein, 9 aa, Homo Sapiens
PLAKRNEED

SEQ ID NO: 964905 - protein, 9 aa, Homo Sapiens
KAPKSFSKG

SEQ ID NO: 964906 - protein, 9 aa, Homo Sapiens
EDAQPESPL

SEQ ID NO: 964907 - protein, 9 aa, Homo Sapiens
QEPQSVLIL

SEQ ID NO: 964908 - protein, 9 aa, Homo Sapiens
LLASTAPGP

SEQ ID NO: 964909 - protein, 9 aa, Homo Sapiens
KLAQKKKKL

SEQ ID NO: 964910 - protein, 9 aa, Homo Sapiens
PLFSSLCAE

SEQ ID NO: 964911 - protein, 9 aa, Homo Sapiens
ALYGRQGQP

SEQ ID NO: 964912 - protein, 9 aa, Homo Sapiens
QLAFSGRNV

SEQ ID NO: 964913 - protein, 9 aa, Homo Sapiens
HLNKNIEKG

SEQ ID NO: 964914 - protein, 9 aa, Homo Sapiens
ASHVPHSAL

SEQ ID NO: 964915 - protein, 9 aa, Homo Sapiens
LAERKPLLF

SEQ ID NO: 964916 - protein, 9 aa, Homo Sapiens
AHGVQRDEE

SEQ ID NO: 964917 - protein, 9 aa, Homo Sapiens
LQQELGLIS

SEQ ID NO: 964918 - protein, 9 aa, Homo Sapiens
APLVCLLRI

SEQ ID NO: 964919 - protein, 9 aa, Homo Sapiens
QFLVKKAER

SEQ ID NO: 964920 - protein, 9 aa, Homo Sapiens
RGVHVPSPL

SEQ ID NO: 964921 - protein, 9 aa, Homo Sapiens
GGKAQPGSL

SEQ ID NO: 964922 - protein, 9 aa, Homo Sapiens
SSFAAAVAA

SEQ ID NO: 964923 - protein, 9 aa, Homo Sapiens
KLTLASIDL

SEQ ID NO: 964924 - protein, 9 aa, Homo Sapiens
KGEPGPLGQ

SEQ ID NO: 964925 - protein, 9 aa, Homo Sapiens
PSADPEKKA

SEQ ID NO: 964926 - protein, 9 aa, Homo Sapiens
FIQALKDEF

SEQ ID NO: 964927 - protein, 9 aa, Homo Sapiens
TSEGVRGAG

SEQ ID NO: 964928 - protein, 9 aa, Homo Sapiens
GGAGVSPEA

SEQ ID NO: 964929 - protein, 9 aa, Homo Sapiens
NVKTALQRF

SEQ ID NO: 964930 - protein, 9 aa, Homo Sapiens
GAIGTHSGR

SEQ ID NO: 964931 - protein, 9 aa, Homo Sapiens
EGSGISSRS

SEQ ID NO: 964932 - protein, 9 aa, Homo Sapiens
HTAFMLFCM

SEQ ID NO: 964933 - protein, 9 aa, Homo Sapiens
SWVSGRFSS

SEQ ID NO: 964934 - protein, 9 aa, Homo Sapiens
RVKKLQMKI

SEQ ID NO: 964935 - protein, 9 aa, Homo Sapiens
FRLRDRDDI

SEQ ID NO: 964936 - protein, 9 aa, Homo Sapiens
EPVQASHCE

SEQ ID NO: 964937 - protein, 9 aa, Homo Sapiens
GFLIFWDQC

SEQ ID NO: 964938 - protein, 9 aa, Homo Sapiens
LQLRDDAPT

SEQ ID NO: 964939 - protein, 9 aa, Homo Sapiens
KRYREQQRQ

SEQ ID NO: 964940 - protein, 9 aa, Homo Sapiens
WPGGMDEST

SEQ ID NO: 964941 - protein, 9 aa, Homo Sapiens
RYSQNMPCV

SEQ ID NO: 964942 - protein, 9 aa, Homo Sapiens
RKKRISYSK

SEQ ID NO: 964943 - protein, 9 aa, Homo Sapiens
RILSWPKEK

SEQ ID NO: 964944 - protein, 9 aa, Homo Sapiens
QCKQFAKNL

SEQ ID NO: 964945 - protein, 9 aa, Homo Sapiens
FVWSTLEVT

SEQ ID NO: 964946 - protein, 9 aa, Homo Sapiens
LALKYYPDK

SEQ ID NO: 964947 - protein, 9 aa, Homo Sapiens
GWLVFIKIA

SEQ ID NO: 964948 - protein, 9 aa, Homo Sapiens
KPESLIKRL

SEQ ID NO: 964949 - protein, 9 aa, Homo Sapiens
HWLLGTAAC

SEQ ID NO: 964950 - protein, 9 aa, Homo Sapiens
CECPVGFCY

SEQ ID NO: 964951 - protein, 9 aa, Homo Sapiens
GPITHHKEC

SEQ ID NO: 964952 - protein, 9 aa, Homo Sapiens
SLRLKRRHR

SEQ ID NO: 964953 - protein, 9 aa, Homo Sapiens
EDPAKLDRG

SEQ ID NO: 964954 - protein, 9 aa, Homo Sapiens
LTHQSLLYE

SEQ ID NO: 964955 - protein, 9 aa, Homo Sapiens
CALASYLDL

SEQ ID NO: 964956 - protein, 9 aa, Homo Sapiens
ANYSSSSRT

SEQ ID NO: 964957 - protein, 9 aa, Homo Sapiens
KNKHLIVIS

SEQ ID NO: 964958 - protein, 9 aa, Homo Sapiens
YTNCDTAYQ

SEQ ID NO: 964959 - protein, 9 aa, Homo Sapiens
PKYSFCRLD

SEQ ID NO: 964960 - protein, 9 aa, Homo Sapiens
PSKKRAPAN

SEQ ID NO: 964961 - protein, 9 aa, Homo Sapiens
STPYQNILC

SEQ ID NO: 964962 - protein, 9 aa, Homo Sapiens
TGEQQRGGE

SEQ ID NO: 964963 - protein, 9 aa, Homo Sapiens
TVQPLYWPY

SEQ ID NO: 964964 - protein, 9 aa, Homo Sapiens
VRVLWLISF

SEQ ID NO: 964965 - protein, 9 aa, Homo Sapiens
MAYDCYLAI

SEQ ID NO: 964966 - protein, 9 aa, Homo Sapiens
DVSRNKIPE

SEQ ID NO: 964967 - protein, 9 aa, Homo Sapiens
HINNEHIYG

SEQ ID NO: 964968 - protein, 9 aa, Homo Sapiens
PDFCHAFHP

SEQ ID NO: 964969 - protein, 9 aa, Homo Sapiens
AMFQPFFEM

SEQ ID NO: 964970 - protein, 9 aa, Homo Sapiens
RRMNFKMQV

SEQ ID NO: 964971 - protein, 9 aa, Homo Sapiens
AKPSQPSHL

SEQ ID NO: 964972 - protein, 9 aa, Homo Sapiens
PLPRESSPD

SEQ ID NO: 964973 - protein, 9 aa, Homo Sapiens
KDAHELILN

SEQ ID NO: 964974 - protein, 9 aa, Homo Sapiens
FVVGIPVFR

SEQ ID NO: 964975 - protein, 9 aa, Homo Sapiens
GSHRRDSDL

SEQ ID NO: 964976 - protein, 9 aa, Homo Sapiens
YCGETVVLF

SEQ ID NO: 964977 - protein, 9 aa, Homo Sapiens
QARDSPAPR

SEQ ID NO: 964978 - protein, 9 aa, Homo Sapiens
ALSECPFQE

SEQ ID NO: 964979 - protein, 9 aa, Homo Sapiens
AEKLAQKKK

SEQ ID NO: 964980 - protein, 9 aa, Homo Sapiens
SGQQTYSRY

SEQ ID NO: 964981 - protein, 9 aa, Homo Sapiens
EQKAKQLCQ

SEQ ID NO: 964982 - protein, 9 aa, Homo Sapiens
NGPPGSNGR

SEQ ID NO: 964983 - protein, 9 aa, Homo Sapiens
AQKDHYLGL

SEQ ID NO: 964984 - protein, 9 aa, Homo Sapiens
SITILRPQG

SEQ ID NO: 964985 - protein, 9 aa, Homo Sapiens
FSNREYETL

SEQ ID NO: 964986 - protein, 9 aa, Homo Sapiens
QRAGLQYPV

SEQ ID NO: 964987 - protein, 9 aa, Homo Sapiens
RMGWGGKRR

SEQ ID NO: 964988 - protein, 9 aa, Homo Sapiens
CFSLVSLAS

SEQ ID NO: 964989 - protein, 9 aa, Homo Sapiens
KNMILWPAS

SEQ ID NO: 964990 - protein, 9 aa, Homo Sapiens
EHYLSSAIL

SEQ ID NO: 964991 - protein, 9 aa, Homo Sapiens
TSPERREQG

SEQ ID NO: 964992 - protein, 9 aa, Homo Sapiens
PENFDQDND

SEQ ID NO: 964993 - protein, 9 aa, Homo Sapiens
ASPRARGPF

SEQ ID NO: 964994 - protein, 9 aa, Homo Sapiens
DLGSNALEN

SEQ ID NO: 964995 - protein, 9 aa, Homo Sapiens
NSQSPAENR

SEQ ID NO: 964996 - protein, 9 aa, Homo Sapiens
RALKRKKES

SEQ ID NO: 964997 - protein, 9 aa, Homo Sapiens
NAVCAHGLC

SEQ ID NO: 964998 - protein, 9 aa, Homo Sapiens
FYSSEVFPL

SEQ ID NO: 964999 - protein, 9 aa, Homo Sapiens
LSFIDLSNS

SEQ ID NO: 965000 - protein, 9 aa, Homo Sapiens
FCKNSFLII

SEQ ID NO: 965001 - protein, 9 aa, Homo Sapiens
SPAWEFVEQ

SEQ ID NO: 965002 - protein, 9 aa, Homo Sapiens
DLARALGPK

SEQ ID NO: 965003 - protein, 9 aa, Homo Sapiens
GLECATPLD

SEQ ID NO: 965004 - protein, 9 aa, Homo Sapiens
LPRLFKNVF

SEQ ID NO: 965005 - protein, 9 aa, Homo Sapiens
HAAGQAENE

SEQ ID NO: 965006 - protein, 9 aa, Homo Sapiens
HALPMPRLM

SEQ ID NO: 965007 - protein, 9 aa, Homo Sapiens
RPQKPAAFA

SEQ ID NO: 965008 - protein, 9 aa, Homo Sapiens
LNSLSVPFV

SEQ ID NO: 965009 - protein, 9 aa, Homo Sapiens
LHPHHHPHH

SEQ ID NO: 965010 - protein, 9 aa, Homo Sapiens
IPWESMEKA

SEQ ID NO: 965011 - protein, 9 aa, Homo Sapiens
FKAFSYLSH

SEQ ID NO: 965012 - protein, 9 aa, Homo Sapiens
VMTVTVRPS

SEQ ID NO: 965013 - protein, 9 aa, Homo Sapiens
NAYQGVVYS

SEQ ID NO: 965014 - protein, 9 aa, Homo Sapiens
HVSSQAVLF

SEQ ID NO: 965015 - protein, 9 aa, Homo Sapiens
SLATHQRIY

SEQ ID NO: 965016 - protein, 9 aa, Homo Sapiens
DRDYSSLLK

SEQ ID NO: 965017 - protein, 9 aa, Homo Sapiens
PLLEDISLL

SEQ ID NO: 965018 - protein, 9 aa, Homo Sapiens
AFRAAGITD

SEQ ID NO: 965019 - protein, 9 aa, Homo Sapiens
SVTTDFSSE

SEQ ID NO: 965020 - protein, 9 aa, Homo Sapiens
TEQLLRIDD

SEQ ID NO: 965021 - protein, 9 aa, Homo Sapiens
CVLVRLRSA

SEQ ID NO: 965022 - protein, 9 aa, Homo Sapiens
NKTNSCPLC

SEQ ID NO: 965023 - protein, 9 aa, Homo Sapiens
ARIPENFDQ

SEQ ID NO: 965024 - protein, 9 aa, Homo Sapiens
DNFKTRTKS

SEQ ID NO: 965025 - protein, 9 aa, Homo Sapiens
NFVYERQGI

SEQ ID NO: 965026 - protein, 9 aa, Homo Sapiens
LYCLAFVLE

SEQ ID NO: 965027 - protein, 9 aa, Homo Sapiens
ELPVDCSIK

SEQ ID NO: 965028 - protein, 9 aa, Homo Sapiens
ITLPALFRQ

SEQ ID NO: 965029 - protein, 9 aa, Homo Sapiens
DSCRTHRRD

SEQ ID NO: 965030 - protein, 9 aa, Homo Sapiens
EKLAQKKKK

SEQ ID NO: 965031 - protein, 9 aa, Homo Sapiens
LLFVSWTKN

SEQ ID NO: 965032 - protein, 9 aa, Homo Sapiens
AELIFLEKS

SEQ ID NO: 965033 - protein, 9 aa, Homo Sapiens
NQTRAAVQN

SEQ ID NO: 965034 - protein, 9 aa, Homo Sapiens
PMQVLLEGA

SEQ ID NO: 965035 - protein, 9 aa, Homo Sapiens
WQPDNKKLP

SEQ ID NO: 965036 - protein, 9 aa, Homo Sapiens
AENQHVEHE

SEQ ID NO: 965037 - protein, 9 aa, Homo Sapiens
LHTFLLAKV

SEQ ID NO: 965038 - protein, 9 aa, Homo Sapiens
RGPEQEFGV

SEQ ID NO: 965039 - protein, 9 aa, Homo Sapiens
DSVGEKVNT

SEQ ID NO: 965040 - protein, 9 aa, Homo Sapiens
SDMNFVYER

SEQ ID NO: 965041 - protein, 9 aa, Homo Sapiens
ASKVKTYGD

SEQ ID NO: 965042 - protein, 9 aa, Homo Sapiens
VFYLNTLSY

SEQ ID NO: 965043 - protein, 9 aa, Homo Sapiens
PDGRKINFY

SEQ ID NO: 965044 - protein, 9 aa, Homo Sapiens
LLQQAYAGV

SEQ ID NO: 965045 - protein, 9 aa, Homo Sapiens
GYGFSCCRL

SEQ ID NO: 965046 - protein, 9 aa, Homo Sapiens
REAEREWEG

SEQ ID NO: 965047 - protein, 9 aa, Homo Sapiens
KMRRDLEKS

SEQ ID NO: 965048 - protein, 9 aa, Homo Sapiens
GNLDMITLI

SEQ ID NO: 965049 - protein, 9 aa, Homo Sapiens
KLATRSLRG

SEQ ID NO: 965050 - protein, 9 aa, Homo Sapiens
NPNINPRDI

SEQ ID NO: 965051 - protein, 9 aa, Homo Sapiens
NFVLYLLED

SEQ ID NO: 965052 - protein, 9 aa, Homo Sapiens
SEEKTSGSH

SEQ ID NO: 965053 - protein, 9 aa, Homo Sapiens
SSEKQINVY

SEQ ID NO: 965054 - protein, 9 aa, Homo Sapiens
FKIIDPNNR

SEQ ID NO: 965055 - protein, 9 aa, Homo Sapiens
KYVVIIAYV

SEQ ID NO: 965056 - protein, 9 aa, Homo Sapiens
PRIPGQPGL

SEQ ID NO: 965057 - protein, 9 aa, Homo Sapiens
KKKFSNREY

SEQ ID NO: 965058 - protein, 9 aa, Homo Sapiens
ASQSKACDT

SEQ ID NO: 965059 - protein, 9 aa, Homo Sapiens
VGADGVGKS

SEQ ID NO: 965060 - protein, 9 aa, Homo Sapiens
KVNGTPLDG

SEQ ID NO: 965061 - protein, 9 aa, Homo Sapiens
PPHPCEGQK

SEQ ID NO: 965062 - protein, 9 aa, Homo Sapiens
GTLIRAREK

SEQ ID NO: 965063 - protein, 9 aa, Homo Sapiens
QPYLCCLLL

SEQ ID NO: 965064 - protein, 9 aa, Homo Sapiens
PAVARCFHS

SEQ ID NO: 965065 - protein, 9 aa, Homo Sapiens
PLDWQSSEK

SEQ ID NO: 965066 - protein, 9 aa, Homo Sapiens
RALHISMYF

SEQ ID NO: 965067 - protein, 9 aa, Homo Sapiens
DRSKFIGQT

SEQ ID NO: 965068 - protein, 9 aa, Homo Sapiens
EAVRREAKR

SEQ ID NO: 965069 - protein, 9 aa, Homo Sapiens
SPLHPAPAR

SEQ ID NO: 965070 - protein, 9 aa, Homo Sapiens
TIRKKVGPE

SEQ ID NO: 965071 - protein, 9 aa, Homo Sapiens
CILPWLNKT

SEQ ID NO: 965072 - protein, 9 aa, Homo Sapiens
PEKFFSRIE

SEQ ID NO: 965073 - protein, 9 aa, Homo Sapiens
STVEYLLGM

SEQ ID NO: 965074 - protein, 9 aa, Homo Sapiens
VKPLSCGST

SEQ ID NO: 965075 - protein, 9 aa, Homo Sapiens
GEQQRGGEG

SEQ ID NO: 965076 - protein, 9 aa, Homo Sapiens
LGEGKIPWE

SEQ ID NO: 965077 - protein, 9 aa, Homo Sapiens
LLRQVGKVC

SEQ ID NO: 965078 - protein, 9 aa, Homo Sapiens
LGRAGAICP

SEQ ID NO: 965079 - protein, 9 aa, Homo Sapiens
IHKSDNKCK

SEQ ID NO: 965080 - protein, 9 aa, Homo Sapiens
DKAEPSFYV

SEQ ID NO: 965081 - protein, 9 aa, Homo Sapiens
YQGVVYSAN

SEQ ID NO: 965082 - protein, 9 aa, Homo Sapiens
GNTLRTWCR

SEQ ID NO: 965083 - protein, 9 aa, Homo Sapiens
LASFIRLTP

SEQ ID NO: 965084 - protein, 9 aa, Homo Sapiens
PIGNRILIL

SEQ ID NO: 965085 - protein, 9 aa, Homo Sapiens
EKQGITARE

SEQ ID NO: 965086 - protein, 9 aa, Homo Sapiens
DPSFPLQHP

SEQ ID NO: 965087 - protein, 9 aa, Homo Sapiens
NTTKDYDTT

SEQ ID NO: 965088 - protein, 9 aa, Homo Sapiens
TGVNDDRLE

SEQ ID NO: 965089 - protein, 9 aa, Homo Sapiens
VSQYYSLDH

SEQ ID NO: 965090 - protein, 9 aa, Homo Sapiens
TLKPNAVCA

SEQ ID NO: 965091 - protein, 9 aa, Homo Sapiens
SCSSEVSMP

SEQ ID NO: 965092 - protein, 9 aa, Homo Sapiens
NSAGQLAFS

SEQ ID NO: 965093 - protein, 9 aa, Homo Sapiens
LKNMILWPA

SEQ ID NO: 965094 - protein, 9 aa, Homo Sapiens
KGQKENPAY

SEQ ID NO: 965095 - protein, 9 aa, Homo Sapiens
VGKRYREQQ

SEQ ID NO: 965096 - protein, 9 aa, Homo Sapiens
KEEGGKPEM

SEQ ID NO: 965097 - protein, 9 aa, Homo Sapiens
QKMRRDLEK

SEQ ID NO: 965098 - protein, 9 aa, Homo Sapiens
TTLRTTEIN

SEQ ID NO: 965099 - protein, 9 aa, Homo Sapiens
QDTLFLNEL

SEQ ID NO: 965100 - protein, 9 aa, Homo Sapiens
IFFFLALTS

SEQ ID NO: 965101 - protein, 9 aa, Homo Sapiens
SNMNSSRMN

SEQ ID NO: 965102 - protein, 9 aa, Homo Sapiens
YLMLARKGD

SEQ ID NO: 965103 - protein, 9 aa, Homo Sapiens
GSPLGSPPG

SEQ ID NO: 965104 - protein, 9 aa, Homo Sapiens
PWAFKMPGL

SEQ ID NO: 965105 - protein, 9 aa, Homo Sapiens
KKCYLMENP

SEQ ID NO: 965106 - protein, 9 aa, Homo Sapiens
DKGEPGPLG

SEQ ID NO: 965107 - protein, 9 aa, Homo Sapiens
CLQVPKLDE

SEQ ID NO: 965108 - protein, 9 aa, Homo Sapiens
LGLCLEDLA

SEQ ID NO: 965109 - protein, 9 aa, Homo Sapiens
RAVFSGGGD

SEQ ID NO: 965110 - protein, 9 aa, Homo Sapiens
GRVGSTFEN

SEQ ID NO: 965111 - protein, 9 aa, Homo Sapiens
TGVVLVSRE

SEQ ID NO: 965112 - protein, 9 aa, Homo Sapiens
LVGTPYWMV

SEQ ID NO: 965113 - protein, 9 aa, Homo Sapiens
FASLHMGLE

SEQ ID NO: 965114 - protein, 9 aa, Homo Sapiens
MSKICGQEK

SEQ ID NO: 965115 - protein, 9 aa, Homo Sapiens
WPGFYLGDQ

SEQ ID NO: 965116 - protein, 9 aa, Homo Sapiens
DWSPEVPRC

SEQ ID NO: 965117 - protein, 9 aa, Homo Sapiens
LISAAVTFV

SEQ ID NO: 965118 - protein, 9 aa, Homo Sapiens
ALLWHSSSE

SEQ ID NO: 965119 - protein, 9 aa, Homo Sapiens
KMAPWDPLG

SEQ ID NO: 965120 - protein, 9 aa, Homo Sapiens
FLLSNLDEV

SEQ ID NO: 965121 - protein, 9 aa, Homo Sapiens
FDGAFYAFP

SEQ ID NO: 965122 - protein, 9 aa, Homo Sapiens
LSSVRRGSE

SEQ ID NO: 965123 - protein, 9 aa, Homo Sapiens
SLHLSKHLL

SEQ ID NO: 965124 - protein, 9 aa, Homo Sapiens
VFSRKSHFE

SEQ ID NO: 965125 - protein, 9 aa, Homo Sapiens
STLENEQDQ

SEQ ID NO: 965126 - protein, 9 aa, Homo Sapiens
EIDFILSFL

SEQ ID NO: 965127 - protein, 9 aa, Homo Sapiens
EAFIQALKD

SEQ ID NO: 965128 - protein, 9 aa, Homo Sapiens
LIIFQFIFL

SEQ ID NO: 965129 - protein, 9 aa, Homo Sapiens
FCLLKHQRL

SEQ ID NO: 965130 - protein, 9 aa, Homo Sapiens
RLKVVLRSL

SEQ ID NO: 965131 - protein, 9 aa, Homo Sapiens
GQKRSQASG

SEQ ID NO: 965132 - protein, 9 aa, Homo Sapiens
FSFETVQIN

SEQ ID NO: 965133 - protein, 9 aa, Homo Sapiens
PSLPLGFFG

SEQ ID NO: 965134 - protein, 9 aa, Homo Sapiens
KQPQGKGIS

SEQ ID NO: 965135 - protein, 9 aa, Homo Sapiens
TVSWGEWDR

SEQ ID NO: 965136 - protein, 9 aa, Homo Sapiens
EFRIVEQEN

SEQ ID NO: 965137 - protein, 9 aa, Homo Sapiens
PPPPPGLLP

SEQ ID NO: 965138 - protein, 9 aa, Homo Sapiens
ALPTAPPLP

SEQ ID NO: 965139 - protein, 9 aa, Homo Sapiens
TLASHVPHS

SEQ ID NO: 965140 - protein, 9 aa, Homo Sapiens
ALDNLLFQL

SEQ ID NO: 965141 - protein, 9 aa, Homo Sapiens
SGINAIQAW

SEQ ID NO: 965142 - protein, 9 aa, Homo Sapiens
LRKKDGEFS

SEQ ID NO: 965143 - protein, 9 aa, Homo Sapiens
SEVCFCDLG

SEQ ID NO: 965144 - protein, 9 aa, Homo Sapiens
KAGYRKNLG

SEQ ID NO: 965145 - protein, 9 aa, Homo Sapiens
PQGSPPRSS

SEQ ID NO: 965146 - protein, 9 aa, Homo Sapiens
NALSGTLVI

SEQ ID NO: 965147 - protein, 9 aa, Homo Sapiens
GTEEGPGTF

SEQ ID NO: 965148 - protein, 9 aa, Homo Sapiens
GEDGGSPPC

SEQ ID NO: 965149 - protein, 9 aa, Homo Sapiens
FKMPGLPQY

SEQ ID NO: 965150 - protein, 9 aa, Homo Sapiens
QSLGTALKI

SEQ ID NO: 965151 - protein, 9 aa, Homo Sapiens
SKICGQEKG

SEQ ID NO: 965152 - protein, 9 aa, Homo Sapiens
LEKSTLQHE

SEQ ID NO: 965153 - protein, 9 aa, Homo Sapiens
TGSAEARGH

SEQ ID NO: 965154 - protein, 9 aa, Homo Sapiens
PKEFNFASY

SEQ ID NO: 965155 - protein, 9 aa, Homo Sapiens
TGVSQDLFS

SEQ ID NO: 965156 - protein, 9 aa, Homo Sapiens
GLFHEEAVA

SEQ ID NO: 965157 - protein, 9 aa, Homo Sapiens
YDHPSKSVE

SEQ ID NO: 965158 - protein, 9 aa, Homo Sapiens
RITSIDARG

SEQ ID NO: 965159 - protein, 9 aa, Homo Sapiens
HPCNPGFEV

SEQ ID NO: 965160 - protein, 9 aa, Homo Sapiens
IFLLVTVSL

SEQ ID NO: 965161 - protein, 9 aa, Homo Sapiens
MSVISKVNL

SEQ ID NO: 965162 - protein, 9 aa, Homo Sapiens
SKDSILESA

SEQ ID NO: 965163 - protein, 9 aa, Homo Sapiens
VCQTGGCRS

SEQ ID NO: 965164 - protein, 9 aa, Homo Sapiens
LKSSEVLVK

SEQ ID NO: 965165 - protein, 9 aa, Homo Sapiens
TTCTLKPNA

SEQ ID NO: 965166 - protein, 9 aa, Homo Sapiens
KTKSTNPAS

SEQ ID NO: 965167 - protein, 9 aa, Homo Sapiens
TRTIQRLQE

SEQ ID NO: 965168 - protein, 9 aa, Homo Sapiens
PGAYELGIM

SEQ ID NO: 965169 - protein, 9 aa, Homo Sapiens
LSGTLVIKL

SEQ ID NO: 965170 - protein, 9 aa, Homo Sapiens
DCKSSKRAN

SEQ ID NO: 965171 - protein, 9 aa, Homo Sapiens
LILFSVVLA

SEQ ID NO: 965172 - protein, 9 aa, Homo Sapiens
TKFVYPARA

SEQ ID NO: 965173 - protein, 9 aa, Homo Sapiens
SERLGKQNF

SEQ ID NO: 965174 - protein, 9 aa, Homo Sapiens
HFYTISHAT

SEQ ID NO: 965175 - protein, 9 aa, Homo Sapiens
RTMLERLKN

SEQ ID NO: 965176 - protein, 9 aa, Homo Sapiens
KTKPQRPVK

SEQ ID NO: 965177 - protein, 9 aa, Homo Sapiens
KKRLKDLGV

SEQ ID NO: 965178 - protein, 9 aa, Homo Sapiens
ISKVNLVGS

SEQ ID NO: 965179 - protein, 9 aa, Homo Sapiens
PKSFVLIAQ

SEQ ID NO: 965180 - protein, 9 aa, Homo Sapiens
TEPKSERTE

SEQ ID NO: 965181 - protein, 9 aa, Homo Sapiens
NLKKKKKRK

SEQ ID NO: 965182 - protein, 9 aa, Homo Sapiens
QLRDDAPTH

SEQ ID NO: 965183 - protein, 9 aa, Homo Sapiens
YILKPQMLW

SEQ ID NO: 965184 - protein, 9 aa, Homo Sapiens
LIEKAQGPI

SEQ ID NO: 965185 - protein, 9 aa, Homo Sapiens
KSEQGPYEE

SEQ ID NO: 965186 - protein, 9 aa, Homo Sapiens
VSTPSEAGN

SEQ ID NO: 965187 - protein, 9 aa, Homo Sapiens
KLDEHLVER

SEQ ID NO: 965188 - protein, 9 aa, Homo Sapiens
MTVTVRPST

SEQ ID NO: 965189 - protein, 9 aa, Homo Sapiens
PALMSEDRE

SEQ ID NO: 965190 - protein, 9 aa, Homo Sapiens
KSTELPVDC

SEQ ID NO: 965191 - protein, 9 aa, Homo Sapiens
ILLMLGVYT

SEQ ID NO: 965192 - protein, 9 aa, Homo Sapiens
RSGQQTYSR

SEQ ID NO: 965193 - protein, 9 aa, Homo Sapiens
LLGNNQIMP

SEQ ID NO: 965194 - protein, 9 aa, Homo Sapiens
LAVLVPGVN

SEQ ID NO: 965195 - protein, 9 aa, Homo Sapiens
LPASRMHQT

SEQ ID NO: 965196 - protein, 9 aa, Homo Sapiens
EEPVHFRLI

SEQ ID NO: 965197 - protein, 9 aa, Homo Sapiens
GYFLKDLIQ

SEQ ID NO: 965198 - protein, 9 aa, Homo Sapiens
GKRYREQQR

SEQ ID NO: 965199 - protein, 9 aa, Homo Sapiens
LTPTGREFK

SEQ ID NO: 965200 - protein, 9 aa, Homo Sapiens
IYSVCMGTK

SEQ ID NO: 965201 - protein, 9 aa, Homo Sapiens
YLAQHRKIY

SEQ ID NO: 965202 - protein, 9 aa, Homo Sapiens
FVEEWSPWS

SEQ ID NO: 965203 - protein, 9 aa, Homo Sapiens
GKSIKRAPR

SEQ ID NO: 965204 - protein, 9 aa, Homo Sapiens
KSKGRIVYG

SEQ ID NO: 965205 - protein, 9 aa, Homo Sapiens
APNLIEKQK

SEQ ID NO: 965206 - protein, 9 aa, Homo Sapiens
QGPTKSPTS

SEQ ID NO: 965207 - protein, 9 aa, Homo Sapiens
EIVFNLEEW

SEQ ID NO: 965208 - protein, 9 aa, Homo Sapiens
MPRLFLNLG

SEQ ID NO: 965209 - protein, 9 aa, Homo Sapiens
EVPRCTVKS

SEQ ID NO: 965210 - protein, 9 aa, Homo Sapiens
ALDNSACPQ

SEQ ID NO: 965211 - protein, 9 aa, Homo Sapiens
SQTHVRNSS

SEQ ID NO: 965212 - protein, 9 aa, Homo Sapiens
LRGSRPRGY

SEQ ID NO: 965213 - protein, 9 aa, Homo Sapiens
KTHEPAFFN

SEQ ID NO: 965214 - protein, 9 aa, Homo Sapiens
CEGQKLLLH

SEQ ID NO: 965215 - protein, 9 aa, Homo Sapiens
FSYCSEERP

SEQ ID NO: 965216 - protein, 9 aa, Homo Sapiens
YDSFMSLRG

SEQ ID NO: 965217 - protein, 9 aa, Homo Sapiens
FGEVCSGCL

SEQ ID NO: 965218 - protein, 9 aa, Homo Sapiens
LLERLHAAK

SEQ ID NO: 965219 - protein, 9 aa, Homo Sapiens
GLAAGLGSA

SEQ ID NO: 965220 - protein, 9 aa, Homo Sapiens
GMRGPPPSG

SEQ ID NO: 965221 - protein, 9 aa, Homo Sapiens
HGGHWLLGT

SEQ ID NO: 965222 - protein, 9 aa, Homo Sapiens
QMIHSEEKP

SEQ ID NO: 965223 - protein, 9 aa, Homo Sapiens
LRYQLYDVC

SEQ ID NO: 965224 - protein, 9 aa, Homo Sapiens
CFGESTTGF

SEQ ID NO: 965225 - protein, 9 aa, Homo Sapiens
QYSYIDFKL

SEQ ID NO: 965226 - protein, 9 aa, Homo Sapiens
IPSAQQKKK

SEQ ID NO: 965227 - protein, 9 aa, Homo Sapiens
SKKRAPANP

SEQ ID NO: 965228 - protein, 9 aa, Homo Sapiens
FIDNLISNR

SEQ ID NO: 965229 - protein, 9 aa, Homo Sapiens
PEILPSSDR

SEQ ID NO: 965230 - protein, 9 aa, Homo Sapiens
THTLLFYVH

SEQ ID NO: 965231 - protein, 9 aa, Homo Sapiens
KRAPREETE

SEQ ID NO: 965232 - protein, 9 aa, Homo Sapiens
RTSPERREQ

SEQ ID NO: 965233 - protein, 9 aa, Homo Sapiens
VLVFLLSLL

SEQ ID NO: 965234 - protein, 9 aa, Homo Sapiens
YVIKLGNTK

SEQ ID NO: 965235 - protein, 9 aa, Homo Sapiens
KLLLAFQTP

SEQ ID NO: 965236 - protein, 9 aa, Homo Sapiens
EKQNINIMV

SEQ ID NO: 965237 - protein, 9 aa, Homo Sapiens
TAFLPPRRD

SEQ ID NO: 965238 - protein, 9 aa, Homo Sapiens
NTDTKVENN

SEQ ID NO: 965239 - protein, 9 aa, Homo Sapiens
TENRLGAAA

SEQ ID NO: 965240 - protein, 9 aa, Homo Sapiens
SIRKFLYCE

SEQ ID NO: 965241 - protein, 9 aa, Homo Sapiens
DDAPTHTLV

SEQ ID NO: 965242 - protein, 9 aa, Homo Sapiens
PLKGSFPES

SEQ ID NO: 965243 - protein, 9 aa, Homo Sapiens
FELRNRSDV

SEQ ID NO: 965244 - protein, 9 aa, Homo Sapiens
LKEKPFMFN

SEQ ID NO: 965245 - protein, 9 aa, Homo Sapiens
LNAALAHSS

SEQ ID NO: 965246 - protein, 9 aa, Homo Sapiens
KRHKGKNCI

SEQ ID NO: 965247 - protein, 9 aa, Homo Sapiens
TRSILAQII

SEQ ID NO: 965248 - protein, 9 aa, Homo Sapiens
GNVPNRGGR

SEQ ID NO: 965249 - protein, 9 aa, Homo Sapiens
RTKSTVSVR

SEQ ID NO: 965250 - protein, 9 aa, Homo Sapiens
IFSFSADVE

SEQ ID NO: 965251 - protein, 9 aa, Homo Sapiens
NYTTALCCP

SEQ ID NO: 965252 - protein, 9 aa, Homo Sapiens
GRAGAICPE

SEQ ID NO: 965253 - protein, 9 aa, Homo Sapiens
QSGQISFRS

SEQ ID NO: 965254 - protein, 9 aa, Homo Sapiens
HGAREAERE

SEQ ID NO: 965255 - protein, 9 aa, Homo Sapiens
NKAGYRKNL

SEQ ID NO: 965256 - protein, 9 aa, Homo Sapiens
KQFAKNLLD

SEQ ID NO: 965257 - protein, 9 aa, Homo Sapiens
GDSSLVKGS

SEQ ID NO: 965258 - protein, 9 aa, Homo Sapiens
FPWAFKMPG

SEQ ID NO: 965259 - protein, 9 aa, Homo Sapiens
AISDPPKLK

SEQ ID NO: 965260 - protein, 9 aa, Homo Sapiens
AERVDDTSS

SEQ ID NO: 965261 - protein, 9 aa, Homo Sapiens
NDFYKIYEN

SEQ ID NO: 965262 - protein, 9 aa, Homo Sapiens
DMKDIYYKT

SEQ ID NO: 965263 - protein, 9 aa, Homo Sapiens
AANYSSSSR

SEQ ID NO: 965264 - protein, 9 aa, Homo Sapiens
AKLGEQIDN

SEQ ID NO: 965265 - protein, 9 aa, Homo Sapiens
RLLGWEWEK

SEQ ID NO: 965266 - protein, 9 aa, Homo Sapiens
LQIYCIKEG

SEQ ID NO: 965267 - protein, 9 aa, Homo Sapiens
VRRPTGNAS

SEQ ID NO: 965268 - protein, 9 aa, Homo Sapiens
NDDRLEELV

SEQ ID NO: 965269 - protein, 9 aa, Homo Sapiens
LCCSSSYSQ

SEQ ID NO: 965270 - protein, 9 aa, Homo Sapiens
LAANLGIVG

SEQ ID NO: 965271 - protein, 9 aa, Homo Sapiens
YTGPDFVPG

SEQ ID NO: 965272 - protein, 9 aa, Homo Sapiens
KPGYQREGR

SEQ ID NO: 965273 - protein, 9 aa, Homo Sapiens
WARNEARRD

SEQ ID NO: 965274 - protein, 9 aa, Homo Sapiens
RWQPDNKKL

SEQ ID NO: 965275 - protein, 9 aa, Homo Sapiens
KSAWIKDYS

SEQ ID NO: 965276 - protein, 9 aa, Homo Sapiens
KEFPTQPQQ

SEQ ID NO: 965277 - protein, 9 aa, Homo Sapiens
MGWGGKRRR

SEQ ID NO: 965278 - protein, 9 aa, Homo Sapiens
TCVAKNAAG

SEQ ID NO: 965279 - protein, 9 aa, Homo Sapiens
VLSGDLYPG

SEQ ID NO: 965280 - protein, 9 aa, Homo Sapiens
STYEVSAKG

SEQ ID NO: 965281 - protein, 9 aa, Homo Sapiens
FVVTTNLVN

SEQ ID NO: 965282 - protein, 9 aa, Homo Sapiens
YANINFSNL

SEQ ID NO: 965283 - protein, 9 aa, Homo Sapiens
HEQEIENLE

SEQ ID NO: 965284 - protein, 9 aa, Homo Sapiens
LFHVVTDFI

SEQ ID NO: 965285 - protein, 9 aa, Homo Sapiens
EPARHIFFF

SEQ ID NO: 965286 - protein, 9 aa, Homo Sapiens
NANGFSGAS

SEQ ID NO: 965287 - protein, 9 aa, Homo Sapiens
VFKHKRCIP

SEQ ID NO: 965288 - protein, 9 aa, Homo Sapiens
ELSATSFAQ

SEQ ID NO: 965289 - protein, 9 aa, Homo Sapiens
LDIFYFLFD

SEQ ID NO: 965290 - protein, 9 aa, Homo Sapiens
HPGGFLRGP

SEQ ID NO: 965291 - protein, 9 aa, Homo Sapiens
SAAPPDKAA

SEQ ID NO: 965292 - protein, 9 aa, Homo Sapiens
FYTISHATL

SEQ ID NO: 965293 - protein, 9 aa, Homo Sapiens
TSGRQSFST

SEQ ID NO: 965294 - protein, 9 aa, Homo Sapiens
FTCGNYVME

SEQ ID NO: 965295 - protein, 9 aa, Homo Sapiens
GITKPVIRR

SEQ ID NO: 965296 - protein, 9 aa, Homo Sapiens
QSRLVALGR

SEQ ID NO: 965297 - protein, 9 aa, Homo Sapiens
NTWQPLTQV

SEQ ID NO: 965298 - protein, 9 aa, Homo Sapiens
LKDLIQVVH

SEQ ID NO: 965299 - protein, 9 aa, Homo Sapiens
SPPCEVTVI

SEQ ID NO: 965300 - protein, 9 aa, Homo Sapiens
LLYKKRLKD

SEQ ID NO: 965301 - protein, 9 aa, Homo Sapiens
AHSPFTLLT

SEQ ID NO: 965302 - protein, 9 aa, Homo Sapiens
ILHPEFLFS

SEQ ID NO: 965303 - protein, 9 aa, Homo Sapiens
ARGPFASTT

SEQ ID NO: 965304 - protein, 9 aa, Homo Sapiens
EEFKEVAKS

SEQ ID NO: 965305 - protein, 9 aa, Homo Sapiens
PRFVQLGQS

SEQ ID NO: 965306 - protein, 9 aa, Homo Sapiens
VPLCSSPCF

SEQ ID NO: 965307 - protein, 9 aa, Homo Sapiens
FPKDPQHLG

SEQ ID NO: 965308 - protein, 9 aa, Homo Sapiens
DLFCAWEGC

SEQ ID NO: 965309 - protein, 9 aa, Homo Sapiens
WDPKTVGLI

SEQ ID NO: 965310 - protein, 9 aa, Homo Sapiens
RELDLSGPG

SEQ ID NO: 965311 - protein, 9 aa, Homo Sapiens
EEEMKKHRS

SEQ ID NO: 965312 - protein, 9 aa, Homo Sapiens
LEGGHTDSN

SEQ ID NO: 965313 - protein, 9 aa, Homo Sapiens
EEDNWFEIN

SEQ ID NO: 965314 - protein, 9 aa, Homo Sapiens
NCTHQQDAE

SEQ ID NO: 965315 - protein, 9 aa, Homo Sapiens
FRKISSLAN

SEQ ID NO: 965316 - protein, 9 aa, Homo Sapiens
HLIWHQKVH

SEQ ID NO: 965317 - protein, 9 aa, Homo Sapiens
WAFCLLKHQ

SEQ ID NO: 965318 - protein, 9 aa, Homo Sapiens
EPGPLGQPG

SEQ ID NO: 965319 - protein, 9 aa, Homo Sapiens
DVKNKQESD

SEQ ID NO: 965320 - protein, 9 aa, Homo Sapiens
AHLLSLMVL

SEQ ID NO: 965321 - protein, 9 aa, Homo Sapiens
CPARPCFVE

SEQ ID NO: 965322 - protein, 9 aa, Homo Sapiens
TFFSRTSPV

SEQ ID NO: 965323 - protein, 9 aa, Homo Sapiens
LLLFVLSKV

SEQ ID NO: 965324 - protein, 9 aa, Homo Sapiens
LSEVSNKRE

SEQ ID NO: 965325 - protein, 9 aa, Homo Sapiens
SGSVLSIPN

SEQ ID NO: 965326 - protein, 9 aa, Homo Sapiens
GPRGLSPAS

SEQ ID NO: 965327 - protein, 9 aa, Homo Sapiens
RDAPPKKED

SEQ ID NO: 965328 - protein, 9 aa, Homo Sapiens
CTLKPNAVC

SEQ ID NO: 965329 - protein, 9 aa, Homo Sapiens
KGQKITPAS

SEQ ID NO: 965330 - protein, 9 aa, Homo Sapiens
LSATSFAQK

SEQ ID NO: 965331 - protein, 9 aa, Homo Sapiens
ISAEKSFRA

SEQ ID NO: 965332 - protein, 9 aa, Homo Sapiens
EGLQRLAGP

SEQ ID NO: 965333 - protein, 9 aa, Homo Sapiens
PLADGEVSG

SEQ ID NO: 965334 - protein, 9 aa, Homo Sapiens
YQGVCQTGG

SEQ ID NO: 965335 - protein, 9 aa, Homo Sapiens
FYFFFLGKE

SEQ ID NO: 965336 - protein, 9 aa, Homo Sapiens
RVEAGEEGI

SEQ ID NO: 965337 - protein, 9 aa, Homo Sapiens
FMPVGLVLQ

SEQ ID NO: 965338 - protein, 9 aa, Homo Sapiens
ILNERGIKT

SEQ ID NO: 965339 - protein, 9 aa, Homo Sapiens
SVFFYHVKN

SEQ ID NO: 965340 - protein, 9 aa, Homo Sapiens
YFSSPSFLN

SEQ ID NO: 965341 - protein, 9 aa, Homo Sapiens
FIGIDSEYE

SEQ ID NO: 965342 - protein, 9 aa, Homo Sapiens
TQEDPAKLD

SEQ ID NO: 965343 - protein, 9 aa, Homo Sapiens
KLPAGALGT

SEQ ID NO: 965344 - protein, 9 aa, Homo Sapiens
SFLNFFSTL

SEQ ID NO: 965345 - protein, 9 aa, Homo Sapiens
PLYSSFPEE

SEQ ID NO: 965346 - protein, 9 aa, Homo Sapiens
QQDTAVIFS

SEQ ID NO: 965347 - protein, 9 aa, Homo Sapiens
FLPPRRDST

SEQ ID NO: 965348 - protein, 9 aa, Homo Sapiens
EKEMTDSTP

SEQ ID NO: 965349 - protein, 9 aa, Homo Sapiens
AARIPENFD

SEQ ID NO: 965350 - protein, 9 aa, Homo Sapiens
DDYAKAGTK

SEQ ID NO: 965351 - protein, 9 aa, Homo Sapiens
ALLSNLTLG

SEQ ID NO: 965352 - protein, 9 aa, Homo Sapiens
VFMPVGLVL

SEQ ID NO: 965353 - protein, 9 aa, Homo Sapiens
PWLNKTNSC

SEQ ID NO: 965354 - protein, 9 aa, Homo Sapiens
LELQETSEG

SEQ ID NO: 965355 - protein, 9 aa, Homo Sapiens
KEDVISDPS

SEQ ID NO: 965356 - protein, 9 aa, Homo Sapiens
KGVKFGKNL

SEQ ID NO: 965357 - protein, 9 aa, Homo Sapiens
QSLSSEETV

SEQ ID NO: 965358 - protein, 9 aa, Homo Sapiens
LFPSSSATA

SEQ ID NO: 965359 - protein, 9 aa, Homo Sapiens
KSKWWYNKG

SEQ ID NO: 965360 - protein, 9 aa, Homo Sapiens
KYGPIYSVC

SEQ ID NO: 965361 - protein, 9 aa, Homo Sapiens
FVSPVAKTV

SEQ ID NO: 965362 - protein, 9 aa, Homo Sapiens
AITEASSAH

SEQ ID NO: 965363 - protein, 9 aa, Homo Sapiens
PSPAFLWAV

SEQ ID NO: 965364 - protein, 9 aa, Homo Sapiens
GPVQSQGMN

SEQ ID NO: 965365 - protein, 9 aa, Homo Sapiens
KSLFKKDCD

SEQ ID NO: 965366 - protein, 9 aa, Homo Sapiens
ESQVRRADT

SEQ ID NO: 965367 - protein, 9 aa, Homo Sapiens
RCLNGSSKS

SEQ ID NO: 965368 - protein, 9 aa, Homo Sapiens
AQWQERMWK

SEQ ID NO: 965369 - protein, 9 aa, Homo Sapiens
SHTISPTFP

SEQ ID NO: 965370 - protein, 9 aa, Homo Sapiens
SIKRAPREE

SEQ ID NO: 965371 - protein, 9 aa, Homo Sapiens
GFGGRPNTG

SEQ ID NO: 965372 - protein, 9 aa, Homo Sapiens
LSSFLLPVP

SEQ ID NO: 965373 - protein, 9 aa, Homo Sapiens
LLPNITLRY

SEQ ID NO: 965374 - protein, 9 aa, Homo Sapiens
RSAPSFSDS

SEQ ID NO: 965375 - protein, 9 aa, Homo Sapiens
RPSMDLFRT

SEQ ID NO: 965376 - protein, 9 aa, Homo Sapiens
RHVSSQAVL

SEQ ID NO: 965377 - protein, 9 aa, Homo Sapiens
YLTLTEICR

SEQ ID NO: 965378 - protein, 9 aa, Homo Sapiens
SRRFELRNR

SEQ ID NO: 965379 - protein, 9 aa, Homo Sapiens
LPSQLTTMG

SEQ ID NO: 965380 - protein, 9 aa, Homo Sapiens
GPSRDPDSL

SEQ ID NO: 965381 - protein, 9 aa, Homo Sapiens
KSPASSPSF

SEQ ID NO: 965382 - protein, 9 aa, Homo Sapiens
HQRIYVGER

SEQ ID NO: 965383 - protein, 9 aa, Homo Sapiens
FVFLTLGES

SEQ ID NO: 965384 - protein, 9 aa, Homo Sapiens
WLKMETRMI

SEQ ID NO: 965385 - protein, 9 aa, Homo Sapiens
RSEPQHLKE

SEQ ID NO: 965386 - protein, 9 aa, Homo Sapiens
TVINSKIIM

SEQ ID NO: 965387 - protein, 9 aa, Homo Sapiens
TSVVNAHLL

SEQ ID NO: 965388 - protein, 9 aa, Homo Sapiens
DVPLLEDIS

SEQ ID NO: 965389 - protein, 9 aa, Homo Sapiens
QIASSIRKM

SEQ ID NO: 965390 - protein, 9 aa, Homo Sapiens
TSSLNWHVR

SEQ ID NO: 965391 - protein, 9 aa, Homo Sapiens
TFSDMWSFG

SEQ ID NO: 965392 - protein, 9 aa, Homo Sapiens
LSPALPTPS

SEQ ID NO: 965393 - protein, 9 aa, Homo Sapiens
KEFGFCCEK

SEQ ID NO: 965394 - protein, 9 aa, Homo Sapiens
PNGPQILGF

SEQ ID NO: 965395 - protein, 9 aa, Homo Sapiens
PGDPSFPLQ

SEQ ID NO: 965396 - protein, 9 aa, Homo Sapiens
FSGNDTDSL

SEQ ID NO: 965397 - protein, 9 aa, Homo Sapiens
SQPQLTPPN

SEQ ID NO: 965398 - protein, 9 aa, Homo Sapiens
HQGANRTSF

SEQ ID NO: 965399 - protein, 9 aa, Homo Sapiens
NFDPYLSRR

SEQ ID NO: 965400 - protein, 9 aa, Homo Sapiens
LAALKVAAR

SEQ ID NO: 965401 - protein, 9 aa, Homo Sapiens
FLRGSFPWQ

SEQ ID NO: 965402 - protein, 9 aa, Homo Sapiens
PLFLYTEPP

SEQ ID NO: 965403 - protein, 9 aa, Homo Sapiens
LRPQGRKTP

SEQ ID NO: 965404 - protein, 9 aa, Homo Sapiens
ANQMLGNLI

SEQ ID NO: 965405 - protein, 9 aa, Homo Sapiens
SGSETSTPL

SEQ ID NO: 965406 - protein, 9 aa, Homo Sapiens
LEVTAMAFV

SEQ ID NO: 965407 - protein, 9 aa, Homo Sapiens
PRCLRMVLS

SEQ ID NO: 965408 - protein, 9 aa, Homo Sapiens
GSAEARGHT

SEQ ID NO: 965409 - protein, 9 aa, Homo Sapiens
PRDIKPAAS

SEQ ID NO: 965410 - protein, 9 aa, Homo Sapiens
LLAFQTPTG

SEQ ID NO: 965411 - protein, 9 aa, Homo Sapiens
CIRHLVHSV

SEQ ID NO: 965412 - protein, 9 aa, Homo Sapiens
NYVMEGSLS

SEQ ID NO: 965413 - protein, 9 aa, Homo Sapiens
FIDLSNSTV

SEQ ID NO: 965414 - protein, 9 aa, Homo Sapiens
ELQDGRADG

SEQ ID NO: 965415 - protein, 9 aa, Homo Sapiens
DGNESEVVT

SEQ ID NO: 965416 - protein, 9 aa, Homo Sapiens
AVRFSGFAI

SEQ ID NO: 965417 - protein, 9 aa, Homo Sapiens
ERLKNTHQS

SEQ ID NO: 965418 - protein, 9 aa, Homo Sapiens
VCRCKALKE

SEQ ID NO: 965419 - protein, 9 aa, Homo Sapiens
QICSELDVG

SEQ ID NO: 965420 - protein, 9 aa, Homo Sapiens
VQEFYLSVY

SEQ ID NO: 965421 - protein, 9 aa, Homo Sapiens
LDMITLICL

SEQ ID NO: 965422 - protein, 9 aa, Homo Sapiens
LWGHSRVAL

SEQ ID NO: 965423 - protein, 9 aa, Homo Sapiens
EKRLQQSWE

SEQ ID NO: 965424 - protein, 9 aa, Homo Sapiens
KQKVGEEKQ

SEQ ID NO: 965425 - protein, 9 aa, Homo Sapiens
AIVQSFLGS

SEQ ID NO: 965426 - protein, 9 aa, Homo Sapiens
DAQPESPLA

SEQ ID NO: 965427 - protein, 9 aa, Homo Sapiens
EKTFKAVKE

SEQ ID NO: 965428 - protein, 9 aa, Homo Sapiens
IFPGFDVFA

SEQ ID NO: 965429 - protein, 9 aa, Homo Sapiens
HGPPAQKKS

SEQ ID NO: 965430 - protein, 9 aa, Homo Sapiens
NVPNRGGRP

SEQ ID NO: 965431 - protein, 9 aa, Homo Sapiens
FYFASVSLY

SEQ ID NO: 965432 - protein, 9 aa, Homo Sapiens
KEKVALLWH

SEQ ID NO: 965433 - protein, 9 aa, Homo Sapiens
FSFVIRSAV

SEQ ID NO: 965434 - protein, 9 aa, Homo Sapiens
KKEDMELDD

SEQ ID NO: 965435 - protein, 9 aa, Homo Sapiens
ILNETTGLK

SEQ ID NO: 965436 - protein, 9 aa, Homo Sapiens
ASNSTFFSR

SEQ ID NO: 965437 - protein, 9 aa, Homo Sapiens
LSCGSTQIW

SEQ ID NO: 965438 - protein, 9 aa, Homo Sapiens
VEDKLFEET

SEQ ID NO: 965439 - protein, 9 aa, Homo Sapiens
SRPRGYRWS

SEQ ID NO: 965440 - protein, 9 aa, Homo Sapiens
SQPSFFKTA

SEQ ID NO: 965441 - protein, 9 aa, Homo Sapiens
SFAAAVAAS

SEQ ID NO: 965442 - protein, 9 aa, Homo Sapiens
GGEKEGKEN

SEQ ID NO: 965443 - protein, 9 aa, Homo Sapiens
APPKKEDME

SEQ ID NO: 965444 - protein, 9 aa, Homo Sapiens
LPGPDECEI

SEQ ID NO: 965445 - protein, 9 aa, Homo Sapiens
TSTTRSVLG

SEQ ID NO: 965446 - protein, 9 aa, Homo Sapiens
ATESTKEHQ

SEQ ID NO: 965447 - protein, 9 aa, Homo Sapiens
EKRPSADPE

SEQ ID NO: 965448 - protein, 9 aa, Homo Sapiens
ACRDTKFSD

SEQ ID NO: 965449 - protein, 9 aa, Homo Sapiens
FDHTSREFN

SEQ ID NO: 965450 - protein, 9 aa, Homo Sapiens
KFHHLHPHH

SEQ ID NO: 965451 - protein, 9 aa, Homo Sapiens
SHCEHAFCN

SEQ ID NO: 965452 - protein, 9 aa, Homo Sapiens
WPRDQIVAQ

SEQ ID NO: 965453 - protein, 9 aa, Homo Sapiens
GPRPFPCAQ

SEQ ID NO: 965454 - protein, 9 aa, Homo Sapiens
IAAKNISEV

SEQ ID NO: 965455 - protein, 9 aa, Homo Sapiens
RPQICSELD

SEQ ID NO: 965456 - protein, 9 aa, Homo Sapiens
SQVIPIEEF

SEQ ID NO: 965457 - protein, 9 aa, Homo Sapiens
EKNFYKCEE

SEQ ID NO: 965458 - protein, 9 aa, Homo Sapiens
WCKGTRHTA

SEQ ID NO: 965459 - protein, 9 aa, Homo Sapiens
ERAREVISR

SEQ ID NO: 965460 - protein, 9 aa, Homo Sapiens
LMPNECKPI

SEQ ID NO: 965461 - protein, 9 aa, Homo Sapiens
ILNEEKVKF

SEQ ID NO: 965462 - protein, 9 aa, Homo Sapiens
NILCNGSSR

SEQ ID NO: 965463 - protein, 9 aa, Homo Sapiens
QGKEKARPP

SEQ ID NO: 965464 - protein, 9 aa, Homo Sapiens
VGGLVPNLG

SEQ ID NO: 965465 - protein, 9 aa, Homo Sapiens
SPERREQGT

SEQ ID NO: 965466 - protein, 9 aa, Homo Sapiens
ILFSVVLAS

SEQ ID NO: 965467 - protein, 9 aa, Homo Sapiens
EGPGTFHTE

SEQ ID NO: 965468 - protein, 9 aa, Homo Sapiens
VLVKSKAFQ

SEQ ID NO: 965469 - protein, 9 aa, Homo Sapiens
EENEENDDK

SEQ ID NO: 965470 - protein, 9 aa, Homo Sapiens
VEAAEPKVE

SEQ ID NO: 965471 - protein, 9 aa, Homo Sapiens
LQPEIEIPF

SEQ ID NO: 965472 - protein, 9 aa, Homo Sapiens
KDFKVRSLK

SEQ ID NO: 965473 - protein, 9 aa, Homo Sapiens
EIENKAIQN

SEQ ID NO: 965474 - protein, 9 aa, Homo Sapiens
EGWATSLKG

SEQ ID NO: 965475 - protein, 9 aa, Homo Sapiens
ELPARICFL

SEQ ID NO: 965476 - protein, 9 aa, Homo Sapiens
SRDPDSLNI

SEQ ID NO: 965477 - protein, 9 aa, Homo Sapiens
RKKSDKTGV

SEQ ID NO: 965478 - protein, 9 aa, Homo Sapiens
QKLGEEDNW

SEQ ID NO: 965479 - protein, 9 aa, Homo Sapiens
LSVPFVSKR

SEQ ID NO: 965480 - protein, 9 aa, Homo Sapiens
YEVSAKGQK

SEQ ID NO: 965481 - protein, 9 aa, Homo Sapiens
PSPADPSFS

SEQ ID NO: 965482 - protein, 9 aa, Homo Sapiens
LLPKFRENY

SEQ ID NO: 965483 - protein, 9 aa, Homo Sapiens
QARKSSSLK

SEQ ID NO: 965484 - protein, 9 aa, Homo Sapiens
IQRLQEEAD

SEQ ID NO: 965485 - protein, 9 aa, Homo Sapiens
ETNIRNQEE

SEQ ID NO: 965486 - protein, 9 aa, Homo Sapiens
WLVFIKIAF

SEQ ID NO: 965487 - protein, 9 aa, Homo Sapiens
RTTERRSSG

SEQ ID NO: 965488 - protein, 9 aa, Homo Sapiens
KDCIGPKPA

SEQ ID NO: 965489 - protein, 9 aa, Homo Sapiens
RAKQAGKLV

SEQ ID NO: 965490 - protein, 9 aa, Homo Sapiens
VFSGLFEFC

SEQ ID NO: 965491 - protein, 9 aa, Homo Sapiens
VFSMVLYGQ

SEQ ID NO: 965492 - protein, 9 aa, Homo Sapiens
AGMPPLSPK

SEQ ID NO: 965493 - protein, 9 aa, Homo Sapiens
LIQTMTEVR

SEQ ID NO: 965494 - protein, 9 aa, Homo Sapiens
DFLQMFLPQ

SEQ ID NO: 965495 - protein, 9 aa, Homo Sapiens
LDNFKTRTK

SEQ ID NO: 965496 - protein, 9 aa, Homo Sapiens
NYSSSSRTP

SEQ ID NO: 965497 - protein, 9 aa, Homo Sapiens
DFNPQPFLN

SEQ ID NO: 965498 - protein, 9 aa, Homo Sapiens
ANINFSNLK

SEQ ID NO: 965499 - protein, 9 aa, Homo Sapiens
EGGEKEGKE

SEQ ID NO: 965500 - protein, 9 aa, Homo Sapiens
KCQDLKSLI

SEQ ID NO: 965501 - protein, 9 aa, Homo Sapiens
QASISPSEL

SEQ ID NO: 965502 - protein, 9 aa, Homo Sapiens
FPQQLEESK

SEQ ID NO: 965503 - protein, 9 aa, Homo Sapiens
SGGNKGQLP

SEQ ID NO: 965504 - protein, 9 aa, Homo Sapiens
RLKNTHQSG

SEQ ID NO: 965505 - protein, 9 aa, Homo Sapiens
DYEVPKEFN

SEQ ID NO: 965506 - protein, 9 aa, Homo Sapiens
NAIFSALGI

SEQ ID NO: 965507 - protein, 9 aa, Homo Sapiens
PYEEIISEE

SEQ ID NO: 965508 - protein, 9 aa, Homo Sapiens
LVNNDGILK

SEQ ID NO: 965509 - protein, 9 aa, Homo Sapiens
EFFYNLSSD

SEQ ID NO: 965510 - protein, 9 aa, Homo Sapiens
AGGATESTK

SEQ ID NO: 965511 - protein, 9 aa, Homo Sapiens
GGYPGSALL

SEQ ID NO: 965512 - protein, 9 aa, Homo Sapiens
KNSFLIIHQ

SEQ ID NO: 965513 - protein, 9 aa, Homo Sapiens
QPQSLAKKE

SEQ ID NO: 965514 - protein, 9 aa, Homo Sapiens
PRMCGFFSL

SEQ ID NO: 965515 - protein, 9 aa, Homo Sapiens
MVLYGQIGN

SEQ ID NO: 965516 - protein, 9 aa, Homo Sapiens
FNCGYYLTQ

SEQ ID NO: 965517 - protein, 9 aa, Homo Sapiens
AFLPPRRDS

SEQ ID NO: 965518 - protein, 9 aa, Homo Sapiens
FLEEWQCLD

SEQ ID NO: 965519 - protein, 9 aa, Homo Sapiens
NCSVLSGDL

SEQ ID NO: 965520 - protein, 9 aa, Homo Sapiens
AQSPTAADL

SEQ ID NO: 965521 - protein, 9 aa, Homo Sapiens
LYQKICILE

SEQ ID NO: 965522 - protein, 9 aa, Homo Sapiens
LEKSPDYCT

SEQ ID NO: 965523 - protein, 9 aa, Homo Sapiens
PEEPVHFRL

SEQ ID NO: 965524 - protein, 9 aa, Homo Sapiens
SRRGQKRSQ

SEQ ID NO: 965525 - protein, 9 aa, Homo Sapiens
STGAGFGGR

SEQ ID NO: 965526 - protein, 9 aa, Homo Sapiens
ISEYGRTIS

SEQ ID NO: 965527 - protein, 9 aa, Homo Sapiens
RLELVNPFF

SEQ ID NO: 965528 - protein, 9 aa, Homo Sapiens
IAPLVCLLR

SEQ ID NO: 965529 - protein, 9 aa, Homo Sapiens
LIETNIRNQ

SEQ ID NO: 965530 - protein, 9 aa, Homo Sapiens
GWGGKRRRL

SEQ ID NO: 965531 - protein, 9 aa, Homo Sapiens
SSWTGRICV

SEQ ID NO: 965532 - protein, 9 aa, Homo Sapiens
MYVIDKYML

SEQ ID NO: 965533 - protein, 9 aa, Homo Sapiens
PLARPPALR

SEQ ID NO: 965534 - protein, 9 aa, Homo Sapiens
EPKTTSLQQ

SEQ ID NO: 965535 - protein, 9 aa, Homo Sapiens
FSLWIVKKP

SEQ ID NO: 965536 - protein, 9 aa, Homo Sapiens
AKVFRLRDR

SEQ ID NO: 965537 - protein, 9 aa, Homo Sapiens
HPSKSVEKR

SEQ ID NO: 965538 - protein, 9 aa, Homo Sapiens
LLYDPVIFK

SEQ ID NO: 965539 - protein, 9 aa, Homo Sapiens
GGGGGAGVS

SEQ ID NO: 965540 - protein, 9 aa, Homo Sapiens
GLQHDAGLG

SEQ ID NO: 965541 - protein, 9 aa, Homo Sapiens
QNTSTTRSV

SEQ ID NO: 965542 - protein, 9 aa, Homo Sapiens
KYYPDKNPD

SEQ ID NO: 965543 - protein, 9 aa, Homo Sapiens
KHLIVISAF

SEQ ID NO: 965544 - protein, 9 aa, Homo Sapiens
SLPFVQAMQ

SEQ ID NO: 965545 - protein, 9 aa, Homo Sapiens
EHSNPSPFQ

SEQ ID NO: 965546 - protein, 9 aa, Homo Sapiens
QIHNVEIVV

SEQ ID NO: 965547 - protein, 9 aa, Homo Sapiens
EKKNEKRQK

SEQ ID NO: 965548 - protein, 9 aa, Homo Sapiens
SFLEVSAPS

SEQ ID NO: 965549 - protein, 9 aa, Homo Sapiens
HRSTHMGFP

SEQ ID NO: 965550 - protein, 9 aa, Homo Sapiens
GASAEPDLS

SEQ ID NO: 965551 - protein, 9 aa, Homo Sapiens
THRRDSHKA

SEQ ID NO: 965552 - protein, 9 aa, Homo Sapiens
VDPSKAWGQ

SEQ ID NO: 965553 - protein, 9 aa, Homo Sapiens
KEEEVCGDQ

SEQ ID NO: 965554 - protein, 9 aa, Homo Sapiens
LHISMYFFL

SEQ ID NO: 965555 - protein, 9 aa, Homo Sapiens
RLGPQGGRG

SEQ ID NO: 965556 - protein, 9 aa, Homo Sapiens
DSILESANR

SEQ ID NO: 965557 - protein, 9 aa, Homo Sapiens
DITQSGSPR

SEQ ID NO: 965558 - protein, 9 aa, Homo Sapiens
WGPRSTPFL

SEQ ID NO: 965559 - protein, 9 aa, Homo Sapiens
RYTDPSLLR

SEQ ID NO: 965560 - protein, 9 aa, Homo Sapiens
GPGFSEKDL

SEQ ID NO: 965561 - protein, 9 aa, Homo Sapiens
HSPFTLLTT

SEQ ID NO: 965562 - protein, 9 aa, Homo Sapiens
KYEISSVST

SEQ ID NO: 965563 - protein, 9 aa, Homo Sapiens
AFQHGFKLP

SEQ ID NO: 965564 - protein, 9 aa, Homo Sapiens
LIHRFLLHM

SEQ ID NO: 965565 - protein, 9 aa, Homo Sapiens
EFPLPQKFP

SEQ ID NO: 965566 - protein, 9 aa, Homo Sapiens
SPFLPSRTL

SEQ ID NO: 965567 - protein, 9 aa, Homo Sapiens
LPLFFLFLF

SEQ ID NO: 965568 - protein, 9 aa, Homo Sapiens
DESTITDLN

SEQ ID NO: 965569 - protein, 9 aa, Homo Sapiens
SFLENHDQM

SEQ ID NO: 965570 - protein, 9 aa, Homo Sapiens
GLVELPALF

SEQ ID NO: 965571 - protein, 9 aa, Homo Sapiens
AQSHDCVSV

SEQ ID NO: 965572 - protein, 9 aa, Homo Sapiens
NGYSSTNNS

SEQ ID NO: 965573 - protein, 9 aa, Homo Sapiens
IGILKYKKK

SEQ ID NO: 965574 - protein, 9 aa, Homo Sapiens
TQMSFQQVK

SEQ ID NO: 965575 - protein, 9 aa, Homo Sapiens
CEPPSVAST

SEQ ID NO: 965576 - protein, 9 aa, Homo Sapiens
RKRLFKEED

SEQ ID NO: 965577 - protein, 9 aa, Homo Sapiens
FSPRYKMVV

SEQ ID NO: 965578 - protein, 9 aa, Homo Sapiens
ARFTRSILA

SEQ ID NO: 965579 - protein, 9 aa, Homo Sapiens
VIIAYVLVF

SEQ ID NO: 965580 - protein, 9 aa, Homo Sapiens
CQRQRAIVA

SEQ ID NO: 965581 - protein, 9 aa, Homo Sapiens
PVGNTLRTW

SEQ ID NO: 965582 - protein, 9 aa, Homo Sapiens
FRFSFVIRS

SEQ ID NO: 965583 - protein, 9 aa, Homo Sapiens
FCFGESTTG

SEQ ID NO: 965584 - protein, 9 aa, Homo Sapiens
PDRLAVLGI

SEQ ID NO: 965585 - protein, 9 aa, Homo Sapiens
WSTLEVTAM

SEQ ID NO: 965586 - protein, 9 aa, Homo Sapiens
GKAFSDSSL

SEQ ID NO: 965587 - protein, 9 aa, Homo Sapiens
KCTWASEKQ

SEQ ID NO: 965588 - protein, 9 aa, Homo Sapiens
ELPQLRSAT

SEQ ID NO: 965589 - protein, 9 aa, Homo Sapiens
LHMKPPSDS

SEQ ID NO: 965590 - protein, 9 aa, Homo Sapiens
DIFYFLFDQ

SEQ ID NO: 965591 - protein, 9 aa, Homo Sapiens
LTVQPLYWP

SEQ ID NO: 965592 - protein, 9 aa, Homo Sapiens
FQSSFASQS

SEQ ID NO: 965593 - protein, 9 aa, Homo Sapiens
QEQFQDVLA

SEQ ID NO: 965594 - protein, 9 aa, Homo Sapiens
NHKFVPGAW

SEQ ID NO: 965595 - protein, 9 aa, Homo Sapiens
YSQIASSIR

SEQ ID NO: 965596 - protein, 9 aa, Homo Sapiens
IIFFIDGSN

SEQ ID NO: 965597 - protein, 9 aa, Homo Sapiens
VAELQSRLV

SEQ ID NO: 965598 - protein, 9 aa, Homo Sapiens
GQPAVSKSY

SEQ ID NO: 965599 - protein, 9 aa, Homo Sapiens
GKKWRIQRE

SEQ ID NO: 965600 - protein, 9 aa, Homo Sapiens
SGAMSSNFL

SEQ ID NO: 965601 - protein, 9 aa, Homo Sapiens
TLAALTLQH

SEQ ID NO: 965602 - protein, 9 aa, Homo Sapiens
LGLISQELL

SEQ ID NO: 965603 - protein, 9 aa, Homo Sapiens
TVSYWILNF

SEQ ID NO: 965604 - protein, 9 aa, Homo Sapiens
MVTKDADPY

SEQ ID NO: 965605 - protein, 9 aa, Homo Sapiens
SALATSIGK

SEQ ID NO: 965606 - protein, 9 aa, Homo Sapiens
NRGDGEPVS

SEQ ID NO: 965607 - protein, 9 aa, Homo Sapiens
CLLIYDNKG

SEQ ID NO: 965608 - protein, 9 aa, Homo Sapiens
SSEILGTFK

SEQ ID NO: 965609 - protein, 9 aa, Homo Sapiens
FSQNSHLIW

SEQ ID NO: 965610 - protein, 9 aa, Homo Sapiens
LTFSGCSWL

SEQ ID NO: 965611 - protein, 9 aa, Homo Sapiens
HPEQLLPRP

SEQ ID NO: 965612 - protein, 9 aa, Homo Sapiens
RKDSLSINF

SEQ ID NO: 965613 - protein, 9 aa, Homo Sapiens
SAESNGEKL

SEQ ID NO: 965614 - protein, 9 aa, Homo Sapiens
VVAISPIHF

SEQ ID NO: 965615 - protein, 9 aa, Homo Sapiens
NQHVEHEFY

SEQ ID NO: 965616 - protein, 9 aa, Homo Sapiens
IKRLEEEIK

SEQ ID NO: 965617 - protein, 9 aa, Homo Sapiens
CLCPTGFFG

SEQ ID NO: 965618 - protein, 9 aa, Homo Sapiens
RAITEASSA

SEQ ID NO: 965619 - protein, 9 aa, Homo Sapiens
VVGTSAYLA

SEQ ID NO: 965620 - protein, 9 aa, Homo Sapiens
NKSGTVFYL

SEQ ID NO: 965621 - protein, 9 aa, Homo Sapiens
YIFGSIFLE

SEQ ID NO: 965622 - protein, 9 aa, Homo Sapiens
PIHCICRKP

SEQ ID NO: 965623 - protein, 9 aa, Homo Sapiens
SSPSFFQQG

SEQ ID NO: 965624 - protein, 9 aa, Homo Sapiens
NRAKQAGKL

SEQ ID NO: 965625 - protein, 9 aa, Homo Sapiens
VTSMDVTEI

SEQ ID NO: 965626 - protein, 9 aa, Homo Sapiens
REFNYFGLS

SEQ ID NO: 965627 - protein, 9 aa, Homo Sapiens
SSAVEMRPD

SEQ ID NO: 965628 - protein, 9 aa, Homo Sapiens
TALQVCLAH

SEQ ID NO: 965629 - protein, 9 aa, Homo Sapiens
DKFHHLHPH

SEQ ID NO: 965630 - protein, 9 aa, Homo Sapiens
LLNQPHTHC

SEQ ID NO: 965631 - protein, 9 aa, Homo Sapiens
YGEKKEFVC

SEQ ID NO: 965632 - protein, 9 aa, Homo Sapiens
SEDAQPESP

SEQ ID NO: 965633 - protein, 9 aa, Homo Sapiens
KKDGEFSVL

SEQ ID NO: 965634 - protein, 9 aa, Homo Sapiens
WNLCSVEKR

SEQ ID NO: 965635 - protein, 9 aa, Homo Sapiens
TQHTHTLLF

SEQ ID NO: 965636 - protein, 9 aa, Homo Sapiens
DRGKTPDPQ

SEQ ID NO: 965637 - protein, 9 aa, Homo Sapiens
SQKQNPIEH

SEQ ID NO: 965638 - protein, 9 aa, Homo Sapiens
LHGLPWDFV

SEQ ID NO: 965639 - protein, 9 aa, Homo Sapiens
DEKEEQEVD

SEQ ID NO: 965640 - protein, 9 aa, Homo Sapiens
FVLKRSKRL

SEQ ID NO: 965641 - protein, 9 aa, Homo Sapiens
TPTQSEKEM

SEQ ID NO: 965642 - protein, 9 aa, Homo Sapiens
KIQSLLNQK

SEQ ID NO: 965643 - protein, 9 aa, Homo Sapiens
LHSTEEEVN

SEQ ID NO: 965644 - protein, 9 aa, Homo Sapiens
PPSGMRPPR

SEQ ID NO: 965645 - protein, 9 aa, Homo Sapiens
HEQKAKQLC

SEQ ID NO: 965646 - protein, 9 aa, Homo Sapiens
PDDKLTYGI

SEQ ID NO: 965647 - protein, 9 aa, Homo Sapiens
SPCFSCPTL

SEQ ID NO: 965648 - protein, 9 aa, Homo Sapiens
FIFLQLRNL

SEQ ID NO: 965649 - protein, 9 aa, Homo Sapiens
RRVPLVAGR

SEQ ID NO: 965650 - protein, 9 aa, Homo Sapiens
ALLLWPLSV

SEQ ID NO: 965651 - protein, 9 aa, Homo Sapiens
EFPNGPQIL

SEQ ID NO: 965652 - protein, 9 aa, Homo Sapiens
DEQRKWFLD

SEQ ID NO: 965653 - protein, 9 aa, Homo Sapiens
SSRRITDEF

SEQ ID NO: 965654 - protein, 9 aa, Homo Sapiens
VGVGKSIAT

SEQ ID NO: 965655 - protein, 9 aa, Homo Sapiens
RKWFLDMES

SEQ ID NO: 965656 - protein, 9 aa, Homo Sapiens
EDESIHSAV

SEQ ID NO: 965657 - protein, 9 aa, Homo Sapiens
LETYSSLVL

SEQ ID NO: 965658 - protein, 9 aa, Homo Sapiens
KNHGLLKTA

SEQ ID NO: 965659 - protein, 9 aa, Homo Sapiens
SPLEEKHNQ

SEQ ID NO: 965660 - protein, 9 aa, Homo Sapiens
GTFANCDFP

SEQ ID NO: 965661 - protein, 9 aa, Homo Sapiens
GLTKAGAKE

SEQ ID NO: 965662 - protein, 9 aa, Homo Sapiens
ADRDYSSLL

SEQ ID NO: 965663 - protein, 9 aa, Homo Sapiens
EEAEDILQE

SEQ ID NO: 965664 - protein, 9 aa, Homo Sapiens
YEEIISEEQ

SEQ ID NO: 965665 - protein, 9 aa, Homo Sapiens
GPSLGGLCS

SEQ ID NO: 965666 - protein, 9 aa, Homo Sapiens
FFPQGYGFG

SEQ ID NO: 965667 - protein, 9 aa, Homo Sapiens
QGKGTGEQQ

SEQ ID NO: 965668 - protein, 9 aa, Homo Sapiens
RGRNNSSRS

SEQ ID NO: 965669 - protein, 9 aa, Homo Sapiens
KDAHGGSIS

SEQ ID NO: 965670 - protein, 9 aa, Homo Sapiens
LGASPSLPR

SEQ ID NO: 965671 - protein, 9 aa, Homo Sapiens
RVPLVAGRM

SEQ ID NO: 965672 - protein, 9 aa, Homo Sapiens
ASLESQVRR

SEQ ID NO: 965673 - protein, 9 aa, Homo Sapiens
YGQMIIYAK

SEQ ID NO: 965674 - protein, 9 aa, Homo Sapiens
KLKSFPKDP

SEQ ID NO: 965675 - protein, 9 aa, Homo Sapiens
YSFCRLDDK

SEQ ID NO: 965676 - protein, 9 aa, Homo Sapiens
PEASLGPPG

SEQ ID NO: 965677 - protein, 9 aa, Homo Sapiens
VIQGQAVKK

SEQ ID NO: 965678 - protein, 9 aa, Homo Sapiens
YNAALSCNK

SEQ ID NO: 965679 - protein, 9 aa, Homo Sapiens
WAFKMPGLP

SEQ ID NO: 965680 - protein, 9 aa, Homo Sapiens
TFANCDFPP

SEQ ID NO: 965681 - protein, 9 aa, Homo Sapiens
SLRHLKNTM

SEQ ID NO: 965682 - protein, 9 aa, Homo Sapiens
WQPLTQVPE

SEQ ID NO: 965683 - protein, 9 aa, Homo Sapiens
HPSQTHVRN

SEQ ID NO: 965684 - protein, 9 aa, Homo Sapiens
SPRLGPQGG

SEQ ID NO: 965685 - protein, 9 aa, Homo Sapiens
WASEKQNIN

SEQ ID NO: 965686 - protein, 9 aa, Homo Sapiens
KQLQQQKSV

SEQ ID NO: 965687 - protein, 9 aa, Homo Sapiens
LMPLTQEQF

SEQ ID NO: 965688 - protein, 9 aa, Homo Sapiens
FIDGSNNTG

SEQ ID NO: 965689 - protein, 9 aa, Homo Sapiens
CKVIDEQVE

SEQ ID NO: 965690 - protein, 9 aa, Homo Sapiens
AQKFQGVGL

SEQ ID NO: 965691 - protein, 9 aa, Homo Sapiens
GGGRRDGFG

SEQ ID NO: 965692 - protein, 9 aa, Homo Sapiens
RRFEELLLQ

SEQ ID NO: 965693 - protein, 9 aa, Homo Sapiens
AKLKTRVQK

SEQ ID NO: 965694 - protein, 9 aa, Homo Sapiens
RAREVISRS

SEQ ID NO: 965695 - protein, 9 aa, Homo Sapiens
KRSLNPEWN

SEQ ID NO: 965696 - protein, 9 aa, Homo Sapiens
LHVLTVKKS

SEQ ID NO: 965697 - protein, 9 aa, Homo Sapiens
KSDDFYIFG

SEQ ID NO: 965698 - protein, 9 aa, Homo Sapiens
GTSEAAKKD

SEQ ID NO: 965699 - protein, 9 aa, Homo Sapiens
QKKKKLAKK

SEQ ID NO: 965700 - protein, 9 aa, Homo Sapiens
GKQFTFSYK

SEQ ID NO: 965701 - protein, 9 aa, Homo Sapiens
RPPHTHFYT

SEQ ID NO: 965702 - protein, 9 aa, Homo Sapiens
ETEEAEDIL

SEQ ID NO: 965703 - protein, 9 aa, Homo Sapiens
NFVTSRETQ

SEQ ID NO: 965704 - protein, 9 aa, Homo Sapiens
SWKKSLRNK

SEQ ID NO: 965705 - protein, 9 aa, Homo Sapiens
SLPGRAQRI

SEQ ID NO: 965706 - protein, 9 aa, Homo Sapiens
SAWNLCSVE

SEQ ID NO: 965707 - protein, 9 aa, Homo Sapiens
VGPVLAANL

SEQ ID NO: 965708 - protein, 9 aa, Homo Sapiens
ASSPVYESW

SEQ ID NO: 965709 - protein, 9 aa, Homo Sapiens
LELVNPFFL

SEQ ID NO: 965710 - protein, 9 aa, Homo Sapiens
SKQASTMAA

SEQ ID NO: 965711 - protein, 9 aa, Homo Sapiens
PENLKKKKK

SEQ ID NO: 965712 - protein, 9 aa, Homo Sapiens
GQSGQISFR

SEQ ID NO: 965713 - protein, 9 aa, Homo Sapiens
KNVTEHREV

SEQ ID NO: 965714 - protein, 9 aa, Homo Sapiens
KIPWESMEK

SEQ ID NO: 965715 - protein, 9 aa, Homo Sapiens
SSGPVESKF

SEQ ID NO: 965716 - protein, 9 aa, Homo Sapiens
KDMKLSFAV

SEQ ID NO: 965717 - protein, 9 aa, Homo Sapiens
KYSFCRLDD

SEQ ID NO: 965718 - protein, 9 aa, Homo Sapiens
GFKGFGSHS

SEQ ID NO: 965719 - protein, 9 aa, Homo Sapiens
SPADPSFSG

SEQ ID NO: 965720 - protein, 9 aa, Homo Sapiens
RTNRDDYVN

SEQ ID NO: 965721 - protein, 9 aa, Homo Sapiens
IVLDNVRCS

SEQ ID NO: 965722 - protein, 9 aa, Homo Sapiens
YYNPELLCR

SEQ ID NO: 965723 - protein, 9 aa, Homo Sapiens
VTLQSQRNQ

SEQ ID NO: 965724 - protein, 9 aa, Homo Sapiens
PTAILTQDF

SEQ ID NO: 965725 - protein, 9 aa, Homo Sapiens
TPNVPCRAL

SEQ ID NO: 965726 - protein, 9 aa, Homo Sapiens
EQDRSKFIG

SEQ ID NO: 965727 - protein, 9 aa, Homo Sapiens
HTFDGAFYA

SEQ ID NO: 965728 - protein, 9 aa, Homo Sapiens
EVTAMAFVT

SEQ ID NO: 965729 - protein, 9 aa, Homo Sapiens
ESDQETMAL

SEQ ID NO: 965730 - protein, 9 aa, Homo Sapiens
PKALHFKSS

SEQ ID NO: 965731 - protein, 9 aa, Homo Sapiens
IASESAESD

SEQ ID NO: 965732 - protein, 9 aa, Homo Sapiens
NSTVVTPKT

SEQ ID NO: 965733 - protein, 9 aa, Homo Sapiens
HQLMPNECK

SEQ ID NO: 965734 - protein, 9 aa, Homo Sapiens
FWYLNRGCT

SEQ ID NO: 965735 - protein, 9 aa, Homo Sapiens
SPEALLAPL

SEQ ID NO: 965736 - protein, 9 aa, Homo Sapiens
VITVVGNLS

SEQ ID NO: 965737 - protein, 9 aa, Homo Sapiens
ESAESDPLE

SEQ ID NO: 965738 - protein, 9 aa, Homo Sapiens
DAAGKLPAG

SEQ ID NO: 965739 - protein, 9 aa, Homo Sapiens
GAGFGGRPN

SEQ ID NO: 965740 - protein, 9 aa, Homo Sapiens
RNNSSRSQS

SEQ ID NO: 965741 - protein, 9 aa, Homo Sapiens
QFIFLPYNE

SEQ ID NO: 965742 - protein, 9 aa, Homo Sapiens
LESMPSVRF

SEQ ID NO: 965743 - protein, 9 aa, Homo Sapiens
ALLYDPVIF

SEQ ID NO: 965744 - protein, 9 aa, Homo Sapiens
EEAGEVEKR

SEQ ID NO: 965745 - protein, 9 aa, Homo Sapiens
LRIAHRAHL

SEQ ID NO: 965746 - protein, 9 aa, Homo Sapiens
GSALLQRNF

SEQ ID NO: 965747 - protein, 9 aa, Homo Sapiens
VRFLLLKDN

SEQ ID NO: 965748 - protein, 9 aa, Homo Sapiens
DRTPVVSLF

SEQ ID NO: 965749 - protein, 9 aa, Homo Sapiens
TIQRLQEEA

SEQ ID NO: 965750 - protein, 9 aa, Homo Sapiens
QPLTQVPEE

SEQ ID NO: 965751 - protein, 9 aa, Homo Sapiens
QPPSVCPTP

SEQ ID NO: 965752 - protein, 9 aa, Homo Sapiens
RSAAGFPPA

SEQ ID NO: 965753 - protein, 9 aa, Homo Sapiens
CTHQQDAEV

SEQ ID NO: 965754 - protein, 9 aa, Homo Sapiens
CGETVVLFK

SEQ ID NO: 965755 - protein, 9 aa, Homo Sapiens
SSQQVRSRP

SEQ ID NO: 965756 - protein, 9 aa, Homo Sapiens
LKALFWTVA

SEQ ID NO: 965757 - protein, 9 aa, Homo Sapiens
VLTQLSEAP

SEQ ID NO: 965758 - protein, 9 aa, Homo Sapiens
VIQKSGSLQ

SEQ ID NO: 965759 - protein, 9 aa, Homo Sapiens
GEPPPGSEG

SEQ ID NO: 965760 - protein, 9 aa, Homo Sapiens
GCPAPWASL

SEQ ID NO: 965761 - protein, 9 aa, Homo Sapiens
GRKINFYKV

SEQ ID NO: 965762 - protein, 9 aa, Homo Sapiens
QEDESIHSA

SEQ ID NO: 965763 - protein, 9 aa, Homo Sapiens
TKSKKKKRH

SEQ ID NO: 965764 - protein, 9 aa, Homo Sapiens
FGAYDWEFF

SEQ ID NO: 965765 - protein, 9 aa, Homo Sapiens
ALDLYNTKI

SEQ ID NO: 965766 - protein, 9 aa, Homo Sapiens
NTGKECEDE

SEQ ID NO: 965767 - protein, 9 aa, Homo Sapiens
EKLSGGAPA

SEQ ID NO: 965768 - protein, 9 aa, Homo Sapiens
WCGLRVHGV

SEQ ID NO: 965769 - protein, 9 aa, Homo Sapiens
SFLVLAVRF

SEQ ID NO: 965770 - protein, 9 aa, Homo Sapiens
SCNETILHL

SEQ ID NO: 965771 - protein, 9 aa, Homo Sapiens
DSGMYSSSR

SEQ ID NO: 965772 - protein, 9 aa, Homo Sapiens
GRQSFSTAA

SEQ ID NO: 965773 - protein, 9 aa, Homo Sapiens
ITVTFTCLT

SEQ ID NO: 965774 - protein, 9 aa, Homo Sapiens
VLPIPVFSD

SEQ ID NO: 965775 - protein, 9 aa, Homo Sapiens
GMCNLKNIP

SEQ ID NO: 965776 - protein, 9 aa, Homo Sapiens
LNQTRAAVQ

SEQ ID NO: 965777 - protein, 9 aa, Homo Sapiens
KLGEQIDNL

SEQ ID NO: 965778 - protein, 9 aa, Homo Sapiens
QSGSPRLGP

SEQ ID NO: 965779 - protein, 9 aa, Homo Sapiens
VSGDATKTE

SEQ ID NO: 965780 - protein, 9 aa, Homo Sapiens
LVNPFFLRQ

SEQ ID NO: 965781 - protein, 9 aa, Homo Sapiens
DDCPVFSGL

SEQ ID NO: 965782 - protein, 9 aa, Homo Sapiens
GSEESTPFI

SEQ ID NO: 965783 - protein, 9 aa, Homo Sapiens
QVKRQIYVA

SEQ ID NO: 965784 - protein, 9 aa, Homo Sapiens
NLLRKHTGS

SEQ ID NO: 965785 - protein, 9 aa, Homo Sapiens
KHADSVAKL

SEQ ID NO: 965786 - protein, 9 aa, Homo Sapiens
PRLQLPEAA

SEQ ID NO: 965787 - protein, 9 aa, Homo Sapiens
LSAPAAGWQ

SEQ ID NO: 965788 - protein, 9 aa, Homo Sapiens
VEFSIDSVT

SEQ ID NO: 965789 - protein, 9 aa, Homo Sapiens
AAEGFSNRL

SEQ ID NO: 965790 - protein, 9 aa, Homo Sapiens
CLLPTSHTA

SEQ ID NO: 965791 - protein, 9 aa, Homo Sapiens
WEKGFGELF

SEQ ID NO: 965792 - protein, 9 aa, Homo Sapiens
VFKERNEGH

SEQ ID NO: 965793 - protein, 9 aa, Homo Sapiens
KMAFFTYLT

SEQ ID NO: 965794 - protein, 9 aa, Homo Sapiens
SLPSEPSKF

SEQ ID NO: 965795 - protein, 9 aa, Homo Sapiens
EKASSLKII

SEQ ID NO: 965796 - protein, 9 aa, Homo Sapiens
AEKPKPTNQ

SEQ ID NO: 965797 - protein, 9 aa, Homo Sapiens
PEGTYVSSF

SEQ ID NO: 965798 - protein, 9 aa, Homo Sapiens
GMSPVGNTL

SEQ ID NO: 965799 - protein, 9 aa, Homo Sapiens
LRNKNVKTA

SEQ ID NO: 965800 - protein, 9 aa, Homo Sapiens
GKAFNCGYY

SEQ ID NO: 965801 - protein, 9 aa, Homo Sapiens
RTNPVTDPV

SEQ ID NO: 965802 - protein, 9 aa, Homo Sapiens
DGGGLSRGA

SEQ ID NO: 965803 - protein, 9 aa, Homo Sapiens
QFSPGSGKY

SEQ ID NO: 965804 - protein, 9 aa, Homo Sapiens
FGELKTRGR

SEQ ID NO: 965805 - protein, 9 aa, Homo Sapiens
LGKMAPWDP

SEQ ID NO: 965806 - protein, 9 aa, Homo Sapiens
HFKSSTHNL

SEQ ID NO: 965807 - protein, 9 aa, Homo Sapiens
TAVIFSEAP

SEQ ID NO: 965808 - protein, 9 aa, Homo Sapiens
SCCRLLYYG

SEQ ID NO: 965809 - protein, 9 aa, Homo Sapiens
KRPSADPEK

SEQ ID NO: 965810 - protein, 9 aa, Homo Sapiens
RFTRSILAQ

SEQ ID NO: 965811 - protein, 9 aa, Homo Sapiens
VLMRAPPAF

SEQ ID NO: 965812 - protein, 9 aa, Homo Sapiens
DVLIGQENT

SEQ ID NO: 965813 - protein, 9 aa, Homo Sapiens
HVPSPLHPA

SEQ ID NO: 965814 - protein, 9 aa, Homo Sapiens
SRYSQNMPC

SEQ ID NO: 965815 - protein, 9 aa, Homo Sapiens
ASYLDLLNH

SEQ ID NO: 965816 - protein, 9 aa, Homo Sapiens
GADRGRNNS

SEQ ID NO: 965817 - protein, 9 aa, Homo Sapiens
ADGVGKSAL

SEQ ID NO: 965818 - protein, 9 aa, Homo Sapiens
SYGWQAGNH

SEQ ID NO: 965819 - protein, 9 aa, Homo Sapiens
RAIVAVTGD

SEQ ID NO: 965820 - protein, 9 aa, Homo Sapiens
VWLLLQYDA

SEQ ID NO: 965821 - protein, 9 aa, Homo Sapiens
FFLALLLSS

SEQ ID NO: 965822 - protein, 9 aa, Homo Sapiens
FLKTCNKSF

SEQ ID NO: 965823 - protein, 9 aa, Homo Sapiens
LSGAMSSNF

SEQ ID NO: 965824 - protein, 9 aa, Homo Sapiens
QAFSSTVTE

SEQ ID NO: 965825 - protein, 9 aa, Homo Sapiens
ERVDDTSSS

SEQ ID NO: 965826 - protein, 9 aa, Homo Sapiens
EHGEKTANE

SEQ ID NO: 965827 - protein, 9 aa, Homo Sapiens
SSLKGDSSL

SEQ ID NO: 965828 - protein, 9 aa, Homo Sapiens
VVAIEVLTQ

SEQ ID NO: 965829 - protein, 9 aa, Homo Sapiens
FPIKPKRPF

SEQ ID NO: 965830 - protein, 9 aa, Homo Sapiens
VRRADTSRN

SEQ ID NO: 965831 - protein, 9 aa, Homo Sapiens
RPKYSFCRL

SEQ ID NO: 965832 - protein, 9 aa, Homo Sapiens
FSGRNVPVQ

SEQ ID NO: 965833 - protein, 9 aa, Homo Sapiens
RMCRHSVIS

SEQ ID NO: 965834 - protein, 9 aa, Homo Sapiens
SEGLALPWD

SEQ ID NO: 965835 - protein, 9 aa, Homo Sapiens
NMTTHVFFR

SEQ ID NO: 965836 - protein, 9 aa, Homo Sapiens
LIKVLKRRT

SEQ ID NO: 965837 - protein, 9 aa, Homo Sapiens
YNHPIWGRA

SEQ ID NO: 965838 - protein, 9 aa, Homo Sapiens
GELWRGQEE

SEQ ID NO: 965839 - protein, 9 aa, Homo Sapiens
DSVTSLQHK

SEQ ID NO: 965840 - protein, 9 aa, Homo Sapiens
SSFLLPVPS

SEQ ID NO: 965841 - protein, 9 aa, Homo Sapiens
TSTTLRTTE

SEQ ID NO: 965842 - protein, 9 aa, Homo Sapiens
ATVRERVRI

SEQ ID NO: 965843 - protein, 9 aa, Homo Sapiens
EKFLVEPDG

SEQ ID NO: 965844 - protein, 9 aa, Homo Sapiens
KVIDEQVED

SEQ ID NO: 965845 - protein, 9 aa, Homo Sapiens
KGKTVPEEL

SEQ ID NO: 965846 - protein, 9 aa, Homo Sapiens
PTAADLLQQ

SEQ ID NO: 965847 - protein, 9 aa, Homo Sapiens
NETTGLKAN

SEQ ID NO: 965848 - protein, 9 aa, Homo Sapiens
PPPSGMRPP

SEQ ID NO: 965849 - protein, 9 aa, Homo Sapiens
FPLQHPAPL

SEQ ID NO: 965850 - protein, 9 aa, Homo Sapiens
FMYFLRGSF

SEQ ID NO: 965851 - protein, 9 aa, Homo Sapiens
LSESQREDL

SEQ ID NO: 965852 - protein, 9 aa, Homo Sapiens
SEAPEAEGP

SEQ ID NO: 965853 - protein, 9 aa, Homo Sapiens
GVLAQQRAL

SEQ ID NO: 965854 - protein, 9 aa, Homo Sapiens
DFRRVPLVA

SEQ ID NO: 965855 - protein, 9 aa, Homo Sapiens
MRGPPPSGM

SEQ ID NO: 965856 - protein, 9 aa, Homo Sapiens
PWAPGRAPN

SEQ ID NO: 965857 - protein, 9 aa, Homo Sapiens
PDAAPGQPG

SEQ ID NO: 965858 - protein, 9 aa, Homo Sapiens
FPSQSSLPP

SEQ ID NO: 965859 - protein, 9 aa, Homo Sapiens
VHGLYWMHF

SEQ ID NO: 965860 - protein, 9 aa, Homo Sapiens
GTEPKSERT

SEQ ID NO: 965861 - protein, 9 aa, Homo Sapiens
PQLTPPNSM

SEQ ID NO: 965862 - protein, 9 aa, Homo Sapiens
SAGGRRSLH

SEQ ID NO: 965863 - protein, 9 aa, Homo Sapiens
KILKQSDQM

SEQ ID NO: 965864 - protein, 9 aa, Homo Sapiens
PFTLLTTLM

SEQ ID NO: 965865 - protein, 9 aa, Homo Sapiens
VLLDEIKEA

SEQ ID NO: 965866 - protein, 9 aa, Homo Sapiens
RAGEALSES

SEQ ID NO: 965867 - protein, 9 aa, Homo Sapiens
NEASSFISY

SEQ ID NO: 965868 - protein, 9 aa, Homo Sapiens
TKATLSVSV

SEQ ID NO: 965869 - protein, 9 aa, Homo Sapiens
KGTGEQQRG

SEQ ID NO: 965870 - protein, 9 aa, Homo Sapiens
VSQDLFSYC

SEQ ID NO: 965871 - protein, 9 aa, Homo Sapiens
QSVLILQHL

SEQ ID NO: 965872 - protein, 9 aa, Homo Sapiens
DAEVTCSDG

SEQ ID NO: 965873 - protein, 9 aa, Homo Sapiens
QRREHELYV

SEQ ID NO: 965874 - protein, 9 aa, Homo Sapiens
QKFPSYPEA

SEQ ID NO: 965875 - protein, 9 aa, Homo Sapiens
GGYSQVIPI

SEQ ID NO: 965876 - protein, 9 aa, Homo Sapiens
PEGPIGIIQ

SEQ ID NO: 965877 - protein, 9 aa, Homo Sapiens
FRREKEVFI

SEQ ID NO: 965878 - protein, 9 aa, Homo Sapiens
NYDNKQVCI

SEQ ID NO: 965879 - protein, 9 aa, Homo Sapiens
AGGWCGLRV

SEQ ID NO: 965880 - protein, 9 aa, Homo Sapiens
AHRAHLQGL

SEQ ID NO: 965881 - protein, 9 aa, Homo Sapiens
EPVPSEEEH

SEQ ID NO: 965882 - protein, 9 aa, Homo Sapiens
LDRALHISM

SEQ ID NO: 965883 - protein, 9 aa, Homo Sapiens
PVFSDNYSY

SEQ ID NO: 965884 - protein, 9 aa, Homo Sapiens
LLGHYITKP

SEQ ID NO: 965885 - protein, 9 aa, Homo Sapiens
HELYVVVSN

SEQ ID NO: 965886 - protein, 9 aa, Homo Sapiens
FGELWRGQE

SEQ ID NO: 965887 - protein, 9 aa, Homo Sapiens
VGRTFGYFL

SEQ ID NO: 965888 - protein, 9 aa, Homo Sapiens
MLELKADYK

SEQ ID NO: 965889 - protein, 9 aa, Homo Sapiens
KKREEDGYT

SEQ ID NO: 965890 - protein, 9 aa, Homo Sapiens
PFKEPAVLM

SEQ ID NO: 965891 - protein, 9 aa, Homo Sapiens
QAFNLETAI

SEQ ID NO: 965892 - protein, 9 aa, Homo Sapiens
PEAPAGQPG

SEQ ID NO: 965893 - protein, 9 aa, Homo Sapiens
KFLGMAVED

SEQ ID NO: 965894 - protein, 9 aa, Homo Sapiens
YRLTEEELA

SEQ ID NO: 965895 - protein, 9 aa, Homo Sapiens
AYLLGDIPE

SEQ ID NO: 965896 - protein, 9 aa, Homo Sapiens
TFPIKPKRP

SEQ ID NO: 965897 - protein, 9 aa, Homo Sapiens
AAAPPLPLS

SEQ ID NO: 965898 - protein, 9 aa, Homo Sapiens
PNVSNQTAY

SEQ ID NO: 965899 - protein, 9 aa, Homo Sapiens
QENSFLEVS

SEQ ID NO: 965900 - protein, 9 aa, Homo Sapiens
KKQAFNLET

SEQ ID NO: 965901 - protein, 9 aa, Homo Sapiens
LAFQTPTGM

SEQ ID NO: 965902 - protein, 9 aa, Homo Sapiens
VRFSGFAIS

SEQ ID NO: 965903 - protein, 9 aa, Homo Sapiens
INRLSLPLQ

SEQ ID NO: 965904 - protein, 9 aa, Homo Sapiens
RVVFFIPDF

SEQ ID NO: 965905 - protein, 9 aa, Homo Sapiens
PQFLSIQER

SEQ ID NO: 965906 - protein, 9 aa, Homo Sapiens
SEAPPAAPA

SEQ ID NO: 965907 - protein, 9 aa, Homo Sapiens
ISLLLKRLA

SEQ ID NO: 965908 - protein, 9 aa, Homo Sapiens
VNLVGSSST

SEQ ID NO: 965909 - protein, 9 aa, Homo Sapiens
GNQDSGDGA

SEQ ID NO: 965910 - protein, 9 aa, Homo Sapiens
ITLEEFKEV

SEQ ID NO: 965911 - protein, 9 aa, Homo Sapiens
KQGITAREL

SEQ ID NO: 965912 - protein, 9 aa, Homo Sapiens
EGKFRVEAG

SEQ ID NO: 965913 - protein, 9 aa, Homo Sapiens
VPQFPPGSP

SEQ ID NO: 965914 - protein, 9 aa, Homo Sapiens
GVFVSLVNP

SEQ ID NO: 965915 - protein, 9 aa, Homo Sapiens
AFCKNSFLI

SEQ ID NO: 965916 - protein, 9 aa, Homo Sapiens
TDAISRLGK

SEQ ID NO: 965917 - protein, 9 aa, Homo Sapiens
MPRLMSTTL

SEQ ID NO: 965918 - protein, 9 aa, Homo Sapiens
SFPWQGLKA

SEQ ID NO: 965919 - protein, 9 aa, Homo Sapiens
SSPAGSREA

SEQ ID NO: 965920 - protein, 9 aa, Homo Sapiens
PYSKLNYET

SEQ ID NO: 965921 - protein, 9 aa, Homo Sapiens
PQGDWSPEV

SEQ ID NO: 965922 - protein, 9 aa, Homo Sapiens
SLLKRLEVS

SEQ ID NO: 965923 - protein, 9 aa, Homo Sapiens
EAFHNLHSA

SEQ ID NO: 965924 - protein, 9 aa, Homo Sapiens
IISLLLKRL

SEQ ID NO: 965925 - protein, 9 aa, Homo Sapiens
VSYWILNFT

SEQ ID NO: 965926 - protein, 9 aa, Homo Sapiens
DSLNLCDGD

SEQ ID NO: 965927 - protein, 9 aa, Homo Sapiens
GLLGNNQIM

SEQ ID NO: 965928 - protein, 9 aa, Homo Sapiens
RYYQTIRKK

SEQ ID NO: 965929 - protein, 9 aa, Homo Sapiens
RKLALKYYP

SEQ ID NO: 965930 - protein, 9 aa, Homo Sapiens
GTSSSMRSG

SEQ ID NO: 965931 - protein, 9 aa, Homo Sapiens
MAKEAYSSF

SEQ ID NO: 965932 - protein, 9 aa, Homo Sapiens
LPPPLGDAA

SEQ ID NO: 965933 - protein, 9 aa, Homo Sapiens
NFEKFLVEP

SEQ ID NO: 965934 - protein, 9 aa, Homo Sapiens
EARGHTGPK

SEQ ID NO: 965935 - protein, 9 aa, Homo Sapiens
LFKEEDMTK

SEQ ID NO: 965936 - protein, 9 aa, Homo Sapiens
GLPFPQDPY

SEQ ID NO: 965937 - protein, 9 aa, Homo Sapiens
SPAFLWAVT

SEQ ID NO: 965938 - protein, 9 aa, Homo Sapiens
PALFRELLT

SEQ ID NO: 965939 - protein, 9 aa, Homo Sapiens
DFLMPLTQE

SEQ ID NO: 965940 - protein, 9 aa, Homo Sapiens
LLPSSILSL

SEQ ID NO: 965941 - protein, 9 aa, Homo Sapiens
QKTLHTLCV

SEQ ID NO: 965942 - protein, 9 aa, Homo Sapiens
GGADRGRNN

SEQ ID NO: 965943 - protein, 9 aa, Homo Sapiens
KLKSKWWYN

SEQ ID NO: 965944 - protein, 9 aa, Homo Sapiens
EDLLQSSVL

SEQ ID NO: 965945 - protein, 9 aa, Homo Sapiens
SGTNVCSVY

SEQ ID NO: 965946 - protein, 9 aa, Homo Sapiens
QSLKKIGLL

SEQ ID NO: 965947 - protein, 9 aa, Homo Sapiens
TGPRPFPCA

SEQ ID NO: 965948 - protein, 9 aa, Homo Sapiens
QLTTNPLLT

SEQ ID NO: 965949 - protein, 9 aa, Homo Sapiens
LPLGVSYIE

SEQ ID NO: 965950 - protein, 9 aa, Homo Sapiens
AAPPLPLSG

SEQ ID NO: 965951 - protein, 9 aa, Homo Sapiens
KVLPIPVFS

SEQ ID NO: 965952 - protein, 9 aa, Homo Sapiens
LGQTAPETR

SEQ ID NO: 965953 - protein, 9 aa, Homo Sapiens
GVGLLRQDP

SEQ ID NO: 965954 - protein, 9 aa, Homo Sapiens
WVGGLVPNL

SEQ ID NO: 965955 - protein, 9 aa, Homo Sapiens
GRPSLLASG

SEQ ID NO: 965956 - protein, 9 aa, Homo Sapiens
DKASESESE

SEQ ID NO: 965957 - protein, 9 aa, Homo Sapiens
RFLLLKDNL

SEQ ID NO: 965958 - protein, 9 aa, Homo Sapiens
IYSSGEDDV

SEQ ID NO: 965959 - protein, 9 aa, Homo Sapiens
TVEYLLGML

SEQ ID NO: 965960 - protein, 9 aa, Homo Sapiens
KPTPIPTPL

SEQ ID NO: 965961 - protein, 9 aa, Homo Sapiens
HSKVNYLKE

SEQ ID NO: 965962 - protein, 9 aa, Homo Sapiens
MAGGENRGD

SEQ ID NO: 965963 - protein, 9 aa, Homo Sapiens
PVREPNIPR

SEQ ID NO: 965964 - protein, 9 aa, Homo Sapiens
QRKWFLDME

SEQ ID NO: 965965 - protein, 9 aa, Homo Sapiens
SVCMGTKTT

SEQ ID NO: 965966 - protein, 9 aa, Homo Sapiens
FVQAMQEKD

SEQ ID NO: 965967 - protein, 9 aa, Homo Sapiens
PPSLGVPPK

SEQ ID NO: 965968 - protein, 9 aa, Homo Sapiens
LLVEAILVF

SEQ ID NO: 965969 - protein, 9 aa, Homo Sapiens
VLCAMTDEI

SEQ ID NO: 965970 - protein, 9 aa, Homo Sapiens
FSLPFVQAM

SEQ ID NO: 965971 - protein, 9 aa, Homo Sapiens
LLFNMNAMS

SEQ ID NO: 965972 - protein, 9 aa, Homo Sapiens
SMDVTEINV

SEQ ID NO: 965973 - protein, 9 aa, Homo Sapiens
SSAILQLGM

SEQ ID NO: 965974 - protein, 9 aa, Homo Sapiens
NRYYQTIRK

SEQ ID NO: 965975 - protein, 9 aa, Homo Sapiens
QDTAVIFSE

SEQ ID NO: 965976 - protein, 9 aa, Homo Sapiens
QPPGLVPGP

SEQ ID NO: 965977 - protein, 9 aa, Homo Sapiens
WSCAWFLNI

SEQ ID NO: 965978 - protein, 9 aa, Homo Sapiens
VVSRMLVDF

SEQ ID NO: 965979 - protein, 9 aa, Homo Sapiens
LMIFARRSD

SEQ ID NO: 965980 - protein, 9 aa, Homo Sapiens
ENALSGTLV

SEQ ID NO: 965981 - protein, 9 aa, Homo Sapiens
PPCGLHAPL

SEQ ID NO: 965982 - protein, 9 aa, Homo Sapiens
LCSMTALLD

SEQ ID NO: 965983 - protein, 9 aa, Homo Sapiens
GSEAPEAEG

SEQ ID NO: 965984 - protein, 9 aa, Homo Sapiens
VDEITVTFT

SEQ ID NO: 965985 - protein, 9 aa, Homo Sapiens
PIVLDNVRC

SEQ ID NO: 965986 - protein, 9 aa, Homo Sapiens
NSGMNLIQT

SEQ ID NO: 965987 - protein, 9 aa, Homo Sapiens
QTERQERTP

SEQ ID NO: 965988 - protein, 9 aa, Homo Sapiens
RFSSLLQAL

SEQ ID NO: 965989 - protein, 9 aa, Homo Sapiens
SINDRIKEL

SEQ ID NO: 965990 - protein, 9 aa, Homo Sapiens
SPATGVWES

SEQ ID NO: 965991 - protein, 9 aa, Homo Sapiens
DLYNTKILK

SEQ ID NO: 965992 - protein, 9 aa, Homo Sapiens
LLSQAVRPQ

SEQ ID NO: 965993 - protein, 9 aa, Homo Sapiens
LQQEKHQFV

SEQ ID NO: 965994 - protein, 9 aa, Homo Sapiens
RLVTHKSWL

SEQ ID NO: 965995 - protein, 9 aa, Homo Sapiens
ADPEKKAKN

SEQ ID NO: 965996 - protein, 9 aa, Homo Sapiens
EWALPLFFL

SEQ ID NO: 965997 - protein, 9 aa, Homo Sapiens
ISQTVAMPI

SEQ ID NO: 965998 - protein, 9 aa, Homo Sapiens
STEQAVVAL

SEQ ID NO: 965999 - protein, 9 aa, Homo Sapiens
SWAPLCATY

SEQ ID NO: 966000 - protein, 9 aa, Homo Sapiens
VRERVRIPA

SEQ ID NO: 966001 - protein, 9 aa, Homo Sapiens
VSSFTKIGI

SEQ ID NO: 966002 - protein, 9 aa, Homo Sapiens
PCLQVPKLD

SEQ ID NO: 966003 - protein, 9 aa, Homo Sapiens
HRPHTFQFI

SEQ ID NO: 966004 - protein, 9 aa, Homo Sapiens
GSLLACTEP

SEQ ID NO: 966005 - protein, 9 aa, Homo Sapiens
GVLPSQLTT

SEQ ID NO: 966006 - protein, 9 aa, Homo Sapiens
YSQNMPCVC

SEQ ID NO: 966007 - protein, 9 aa, Homo Sapiens
FTGSLVSML

SEQ ID NO: 966008 - protein, 9 aa, Homo Sapiens
GTVSKTRKS

SEQ ID NO: 966009 - protein, 9 aa, Homo Sapiens
NTSKLLPAS

SEQ ID NO: 966010 - protein, 9 aa, Homo Sapiens
LFVSWTKNG

SEQ ID NO: 966011 - protein, 9 aa, Homo Sapiens
SLFQISVLC

SEQ ID NO: 966012 - protein, 9 aa, Homo Sapiens
CSRSLGRPT

SEQ ID NO: 966013 - protein, 9 aa, Homo Sapiens
LYWMHFCGG

SEQ ID NO: 966014 - protein, 9 aa, Homo Sapiens
RVLWLISFF

SEQ ID NO: 966015 - protein, 9 aa, Homo Sapiens
KLRRRPDFC

SEQ ID NO: 966016 - protein, 9 aa, Homo Sapiens
CSNSSQQVR

SEQ ID NO: 966017 - protein, 9 aa, Homo Sapiens
LLIDTLCLK

SEQ ID NO: 966018 - protein, 9 aa, Homo Sapiens
YQTIRKKVG

SEQ ID NO: 966019 - protein, 9 aa, Homo Sapiens
GVFTTFSDM

SEQ ID NO: 966020 - protein, 9 aa, Homo Sapiens
LKFSPEKKN

SEQ ID NO: 966021 - protein, 9 aa, Homo Sapiens
TPLPPPPLP

SEQ ID NO: 966022 - protein, 9 aa, Homo Sapiens
VPSEEEHCS

SEQ ID NO: 966023 - protein, 9 aa, Homo Sapiens
APRLQLPEA

SEQ ID NO: 966024 - protein, 9 aa, Homo Sapiens
LGMSPVGNT

SEQ ID NO: 966025 - protein, 9 aa, Homo Sapiens
TSVQLNNRF

SEQ ID NO: 966026 - protein, 9 aa, Homo Sapiens
QNYVIQFAQ

SEQ ID NO: 966027 - protein, 9 aa, Homo Sapiens
TYWDIADAT

SEQ ID NO: 966028 - protein, 9 aa, Homo Sapiens
LRQSSRAVW

SEQ ID NO: 966029 - protein, 9 aa, Homo Sapiens
FKAVKEEGN

SEQ ID NO: 966030 - protein, 9 aa, Homo Sapiens
LRRRPDFCH

SEQ ID NO: 966031 - protein, 9 aa, Homo Sapiens
IDLSNSTVV

SEQ ID NO: 966032 - protein, 9 aa, Homo Sapiens
REVIGLEIE

SEQ ID NO: 966033 - protein, 9 aa, Homo Sapiens
HDEQYCQCK

SEQ ID NO: 966034 - protein, 9 aa, Homo Sapiens
MPSYLMLAR

SEQ ID NO: 966035 - protein, 9 aa, Homo Sapiens
KVVKCLIGV

SEQ ID NO: 966036 - protein, 9 aa, Homo Sapiens
ARICFLLQD

SEQ ID NO: 966037 - protein, 9 aa, Homo Sapiens
FERHRRIHS

SEQ ID NO: 966038 - protein, 9 aa, Homo Sapiens
SQVTLTQTP

SEQ ID NO: 966039 - protein, 9 aa, Homo Sapiens
WVEKADNNE

SEQ ID NO: 966040 - protein, 9 aa, Homo Sapiens
GDAFVFFAC

SEQ ID NO: 966041 - protein, 9 aa, Homo Sapiens
RVKRPIGNR

SEQ ID NO: 966042 - protein, 9 aa, Homo Sapiens
AFVFFACEE

SEQ ID NO: 966043 - protein, 9 aa, Homo Sapiens
LQSQRNQAL

SEQ ID NO: 966044 - protein, 9 aa, Homo Sapiens
PKESTSLDH

SEQ ID NO: 966045 - protein, 9 aa, Homo Sapiens
NFLGKKREL

SEQ ID NO: 966046 - protein, 9 aa, Homo Sapiens
PDSKGGGAG

SEQ ID NO: 966047 - protein, 9 aa, Homo Sapiens
SLFAVVFLQ

SEQ ID NO: 966048 - protein, 9 aa, Homo Sapiens
FADFYPFGA

SEQ ID NO: 966049 - protein, 9 aa, Homo Sapiens
RRNLVLVTP

SEQ ID NO: 966050 - protein, 9 aa, Homo Sapiens
EINVFFYPR

SEQ ID NO: 966051 - protein, 9 aa, Homo Sapiens
SAWIKDYSS

SEQ ID NO: 966052 - protein, 9 aa, Homo Sapiens
SSPSFLNFF

SEQ ID NO: 966053 - protein, 9 aa, Homo Sapiens
IAPNFSALL

SEQ ID NO: 966054 - protein, 9 aa, Homo Sapiens
GQLGSPLGS

SEQ ID NO: 966055 - protein, 9 aa, Homo Sapiens
FVARNCSAC

SEQ ID NO: 966056 - protein, 9 aa, Homo Sapiens
PTFSFETVQ

SEQ ID NO: 966057 - protein, 9 aa, Homo Sapiens
PEACPRNLT

SEQ ID NO: 966058 - protein, 9 aa, Homo Sapiens
REEDSGGNK

SEQ ID NO: 966059 - protein, 9 aa, Homo Sapiens
YGFSCCRLL

SEQ ID NO: 966060 - protein, 9 aa, Homo Sapiens
QGQAVKKSS

SEQ ID NO: 966061 - protein, 9 aa, Homo Sapiens
FWEKGFGEL

SEQ ID NO: 966062 - protein, 9 aa, Homo Sapiens
HAEVQHILG

SEQ ID NO: 966063 - protein, 9 aa, Homo Sapiens
LLLLLSSQI

SEQ ID NO: 966064 - protein, 9 aa, Homo Sapiens
DSPLFLYTE

SEQ ID NO: 966065 - protein, 9 aa, Homo Sapiens
FSDNYSYLI

SEQ ID NO: 966066 - protein, 9 aa, Homo Sapiens
ICFSLVSLA

SEQ ID NO: 966067 - protein, 9 aa, Homo Sapiens
VDEIPPYRI

SEQ ID NO: 966068 - protein, 9 aa, Homo Sapiens
ETNLITRLS

SEQ ID NO: 966069 - protein, 9 aa, Homo Sapiens
DSFTGSLVS

SEQ ID NO: 966070 - protein, 9 aa, Homo Sapiens
TSMDVTEIN

SEQ ID NO: 966071 - protein, 9 aa, Homo Sapiens
RFLSPLWRQ

SEQ ID NO: 966072 - protein, 9 aa, Homo Sapiens
SPFQDTDGT

SEQ ID NO: 966073 - protein, 9 aa, Homo Sapiens
VETELFLTY

SEQ ID NO: 966074 - protein, 9 aa, Homo Sapiens
AGVFMPVGL

SEQ ID NO: 966075 - protein, 9 aa, Homo Sapiens
LAGRAYLLG

SEQ ID NO: 966076 - protein, 9 aa, Homo Sapiens
SFLLPVPSL

SEQ ID NO: 966077 - protein, 9 aa, Homo Sapiens
GLSKLSSVP

SEQ ID NO: 966078 - protein, 9 aa, Homo Sapiens
ADAKPESLI

SEQ ID NO: 966079 - protein, 9 aa, Homo Sapiens
FYLGDQDMA

SEQ ID NO: 966080 - protein, 9 aa, Homo Sapiens
SREFNYFGL

SEQ ID NO: 966081 - protein, 9 aa, Homo Sapiens
GVIQKSGSL

SEQ ID NO: 966082 - protein, 9 aa, Homo Sapiens
RPDMALRQS

SEQ ID NO: 966083 - protein, 9 aa, Homo Sapiens
RLFNCSAFL

SEQ ID NO: 966084 - protein, 9 aa, Homo Sapiens
TWASEKQNI

SEQ ID NO: 966085 - protein, 9 aa, Homo Sapiens
IELPQLRSA

SEQ ID NO: 966086 - protein, 9 aa, Homo Sapiens
WVNHGAFCL

SEQ ID NO: 966087 - protein, 9 aa, Homo Sapiens
YLAVESPFF

SEQ ID NO: 966088 - protein, 9 aa, Homo Sapiens
ESANRLREE

SEQ ID NO: 966089 - protein, 9 aa, Homo Sapiens
ATISPAADS

SEQ ID NO: 966090 - protein, 9 aa, Homo Sapiens
RGSNELMIF

SEQ ID NO: 966091 - protein, 9 aa, Homo Sapiens
ADLLQQAYA

SEQ ID NO: 966092 - protein, 9 aa, Homo Sapiens
STQPPAEPL

SEQ ID NO: 966093 - protein, 9 aa, Homo Sapiens
TKFPVPLEC

SEQ ID NO: 966094 - protein, 9 aa, Homo Sapiens
AKMPSYLML

SEQ ID NO: 966095 - protein, 9 aa, Homo Sapiens
KTDSFFSFM

SEQ ID NO: 966096 - protein, 9 aa, Homo Sapiens
ILGNTTADN

SEQ ID NO: 966097 - protein, 9 aa, Homo Sapiens
DEHAENAVQ

SEQ ID NO: 966098 - protein, 9 aa, Homo Sapiens
LKNREAFLG

SEQ ID NO: 966099 - protein, 9 aa, Homo Sapiens
YYLTQHERI

SEQ ID NO: 966100 - protein, 9 aa, Homo Sapiens
AFILSLFLS

SEQ ID NO: 966101 - protein, 9 aa, Homo Sapiens
EKELSGKQI

SEQ ID NO: 966102 - protein, 9 aa, Homo Sapiens
ARSECKRNH

SEQ ID NO: 966103 - protein, 9 aa, Homo Sapiens
PSCQPYLCC

SEQ ID NO: 966104 - protein, 9 aa, Homo Sapiens
EKKDPDPRV

SEQ ID NO: 966105 - protein, 9 aa, Homo Sapiens
AGKLPAGAL

SEQ ID NO: 966106 - protein, 9 aa, Homo Sapiens
DQETMALPI

SEQ ID NO: 966107 - protein, 9 aa, Homo Sapiens
TIRIIYSIS

SEQ ID NO: 966108 - protein, 9 aa, Homo Sapiens
EVYKQVMFE

SEQ ID NO: 966109 - protein, 9 aa, Homo Sapiens
ESDPLERLP

SEQ ID NO: 966110 - protein, 9 aa, Homo Sapiens
QRPRPSKKR

SEQ ID NO: 966111 - protein, 9 aa, Homo Sapiens
HFSYPDPSQ

SEQ ID NO: 966112 - protein, 9 aa, Homo Sapiens
HTFLLAKVT

SEQ ID NO: 966113 - protein, 9 aa, Homo Sapiens
CRHSVISES

SEQ ID NO: 966114 - protein, 9 aa, Homo Sapiens
RLCNRTSLG

SEQ ID NO: 966115 - protein, 9 aa, Homo Sapiens
ARNCSACTY

SEQ ID NO: 966116 - protein, 9 aa, Homo Sapiens
LPFVQAMQE

SEQ ID NO: 966117 - protein, 9 aa, Homo Sapiens
FESPQPKKI

SEQ ID NO: 966118 - protein, 9 aa, Homo Sapiens
TPSSGPVES

SEQ ID NO: 966119 - protein, 9 aa, Homo Sapiens
CPPCSPEVD

SEQ ID NO: 966120 - protein, 9 aa, Homo Sapiens
VNNSVLFPS

SEQ ID NO: 966121 - protein, 9 aa, Homo Sapiens
FTLLTTLMF

SEQ ID NO: 966122 - protein, 9 aa, Homo Sapiens
VRGPTGPIG

SEQ ID NO: 966123 - protein, 9 aa, Homo Sapiens
STQSCDSKS

SEQ ID NO: 966124 - protein, 9 aa, Homo Sapiens
FSGALCPTG

SEQ ID NO: 966125 - protein, 9 aa, Homo Sapiens
WGHSRVALA

SEQ ID NO: 966126 - protein, 9 aa, Homo Sapiens
IKHQKIYSG

SEQ ID NO: 966127 - protein, 9 aa, Homo Sapiens
NSWLKMETR

SEQ ID NO: 966128 - protein, 9 aa, Homo Sapiens
MEEVGEEEE

SEQ ID NO: 966129 - protein, 9 aa, Homo Sapiens
KKQRLGGDV

SEQ ID NO: 966130 - protein, 9 aa, Homo Sapiens
NSVFNEHSS

SEQ ID NO: 966131 - protein, 9 aa, Homo Sapiens
VGRVGSTFE

SEQ ID NO: 966132 - protein, 9 aa, Homo Sapiens
ALSGTLVIK

SEQ ID NO: 966133 - protein, 9 aa, Homo Sapiens
PHQETAETV

SEQ ID NO: 966134 - protein, 9 aa, Homo Sapiens
YKKPGYNES

SEQ ID NO: 966135 - protein, 9 aa, Homo Sapiens
GPPRGFCPE

SEQ ID NO: 966136 - protein, 9 aa, Homo Sapiens
KFQGVGLLR

SEQ ID NO: 966137 - protein, 9 aa, Homo Sapiens
KKREFHNQY

SEQ ID NO: 966138 - protein, 9 aa, Homo Sapiens
LQHDAGLGA

SEQ ID NO: 966139 - protein, 9 aa, Homo Sapiens
APLVKTKPQ

SEQ ID NO: 966140 - protein, 9 aa, Homo Sapiens
QASLRLKRR

SEQ ID NO: 966141 - protein, 9 aa, Homo Sapiens
EVLVKTLED

SEQ ID NO: 966142 - protein, 9 aa, Homo Sapiens
HADSVAKLG

SEQ ID NO: 966143 - protein, 9 aa, Homo Sapiens
PFLNEKGQF

SEQ ID NO: 966144 - protein, 9 aa, Homo Sapiens
KQLGAHSPF

SEQ ID NO: 966145 - protein, 9 aa, Homo Sapiens
RYGYSVRLS

SEQ ID NO: 966146 - protein, 9 aa, Homo Sapiens
SCTDLSINF

SEQ ID NO: 966147 - protein, 9 aa, Homo Sapiens
ELDLSGPGF

SEQ ID NO: 966148 - protein, 9 aa, Homo Sapiens
LPALFRELL

SEQ ID NO: 966149 - protein, 9 aa, Homo Sapiens
EKTSGSHLV

SEQ ID NO: 966150 - protein, 9 aa, Homo Sapiens
FPVLHFYVR

SEQ ID NO: 966151 - protein, 9 aa, Homo Sapiens
KSFSQKQNP

SEQ ID NO: 966152 - protein, 9 aa, Homo Sapiens
LQKGGNFVT

SEQ ID NO: 966153 - protein, 9 aa, Homo Sapiens
SINFEFVKV

SEQ ID NO: 966154 - protein, 9 aa, Homo Sapiens
GLLRQVGKV

SEQ ID NO: 966155 - protein, 9 aa, Homo Sapiens
PSEVVYSAH

SEQ ID NO: 966156 - protein, 9 aa, Homo Sapiens
IWEITLPAL

SEQ ID NO: 966157 - protein, 9 aa, Homo Sapiens
GILPPPPLP

SEQ ID NO: 966158 - protein, 9 aa, Homo Sapiens
GYNESCFNV

SEQ ID NO: 966159 - protein, 9 aa, Homo Sapiens
RLAVLGIFL

SEQ ID NO: 966160 - protein, 9 aa, Homo Sapiens
HGAFCLQWC

SEQ ID NO: 966161 - protein, 9 aa, Homo Sapiens
TRSLRGLEA

SEQ ID NO: 966162 - protein, 9 aa, Homo Sapiens
KELYAGVYI

SEQ ID NO: 966163 - protein, 9 aa, Homo Sapiens
SKNLVCTPP

SEQ ID NO: 966164 - protein, 9 aa, Homo Sapiens
PLSPKKPAL

SEQ ID NO: 966165 - protein, 9 aa, Homo Sapiens
KSLSPEAPR

SEQ ID NO: 966166 - protein, 9 aa, Homo Sapiens
GLVPGPAPA

SEQ ID NO: 966167 - protein, 9 aa, Homo Sapiens
KDKEAGEKL

SEQ ID NO: 966168 - protein, 9 aa, Homo Sapiens
KVQDSVGEK

SEQ ID NO: 966169 - protein, 9 aa, Homo Sapiens
LRLPPEACP

SEQ ID NO: 966170 - protein, 9 aa, Homo Sapiens
QSDTLNPPA

SEQ ID NO: 966171 - protein, 9 aa, Homo Sapiens
CSCKPGYQR

SEQ ID NO: 966172 - protein, 9 aa, Homo Sapiens
GLWVIQVQK

SEQ ID NO: 966173 - protein, 9 aa, Homo Sapiens
FFENLSVPH

SEQ ID NO: 966174 - protein, 9 aa, Homo Sapiens
PPGHQGLPG

SEQ ID NO: 966175 - protein, 9 aa, Homo Sapiens
NNMTTHVFF

SEQ ID NO: 966176 - protein, 9 aa, Homo Sapiens
FQLIAELGM

SEQ ID NO: 966177 - protein, 9 aa, Homo Sapiens
EHYSSEGLD

SEQ ID NO: 966178 - protein, 9 aa, Homo Sapiens
QPCQPPSVC

SEQ ID NO: 966179 - protein, 9 aa, Homo Sapiens
WVSGRFSSL

SEQ ID NO: 966180 - protein, 9 aa, Homo Sapiens
HLVQKLSLE

SEQ ID NO: 966181 - protein, 9 aa, Homo Sapiens
MQTEEGCDA

SEQ ID NO: 966182 - protein, 9 aa, Homo Sapiens
CGFFSLQIM

SEQ ID NO: 966183 - protein, 9 aa, Homo Sapiens
SKRRSSLSK

SEQ ID NO: 966184 - protein, 9 aa, Homo Sapiens
PNITLRYQL

SEQ ID NO: 966185 - protein, 9 aa, Homo Sapiens
MPSVRFLLL

SEQ ID NO: 966186 - protein, 9 aa, Homo Sapiens
DPEKKAKNP

SEQ ID NO: 966187 - protein, 9 aa, Homo Sapiens
AWDAFFQPV

SEQ ID NO: 966188 - protein, 9 aa, Homo Sapiens
EVLTQLSEA

SEQ ID NO: 966189 - protein, 9 aa, Homo Sapiens
SMVLYGQIG

SEQ ID NO: 966190 - protein, 9 aa, Homo Sapiens
CMLAGSVVI

SEQ ID NO: 966191 - protein, 9 aa, Homo Sapiens
DFLSVLSSL

SEQ ID NO: 966192 - protein, 9 aa, Homo Sapiens
LLFVLSKVV

SEQ ID NO: 966193 - protein, 9 aa, Homo Sapiens
LPARICFLL

SEQ ID NO: 966194 - protein, 9 aa, Homo Sapiens
GPGLEKSRC

SEQ ID NO: 966195 - protein, 9 aa, Homo Sapiens
GHLLVGLFH

SEQ ID NO: 966196 - protein, 9 aa, Homo Sapiens
LIKRLEEEI

SEQ ID NO: 966197 - protein, 9 aa, Homo Sapiens
EDGGSPPCE

SEQ ID NO: 966198 - protein, 9 aa, Homo Sapiens
ERKPLLFNM

SEQ ID NO: 966199 - protein, 9 aa, Homo Sapiens
CVGRTGGQA

SEQ ID NO: 966200 - protein, 9 aa, Homo Sapiens
KKTFKMLLL

SEQ ID NO: 966201 - protein, 9 aa, Homo Sapiens
EGRVGGVLG

SEQ ID NO: 966202 - protein, 9 aa, Homo Sapiens
TVSKTRKSV

SEQ ID NO: 966203 - protein, 9 aa, Homo Sapiens
LHSHGSSTR

SEQ ID NO: 966204 - protein, 9 aa, Homo Sapiens
SLYQKICIL

SEQ ID NO: 966205 - protein, 9 aa, Homo Sapiens
FGSHSSSSG

SEQ ID NO: 966206 - protein, 9 aa, Homo Sapiens
RKEWVLTIT

SEQ ID NO: 966207 - protein, 9 aa, Homo Sapiens
CPHSSEILG

SEQ ID NO: 966208 - protein, 9 aa, Homo Sapiens
EERDWDPRL

SEQ ID NO: 966209 - protein, 9 aa, Homo Sapiens
REKITNCAS

SEQ ID NO: 966210 - protein, 9 aa, Homo Sapiens
MTTVFPGSH

SEQ ID NO: 966211 - protein, 9 aa, Homo Sapiens
FADMSKVYS

SEQ ID NO: 966212 - protein, 9 aa, Homo Sapiens
DADVFSRKP

SEQ ID NO: 966213 - protein, 9 aa, Homo Sapiens
DILLMLGVY

SEQ ID NO: 966214 - protein, 9 aa, Homo Sapiens
FFIDGSNNT

SEQ ID NO: 966215 - protein, 9 aa, Homo Sapiens
VLQIQVEEK

SEQ ID NO: 966216 - protein, 9 aa, Homo Sapiens
REEKNFYKC

SEQ ID NO: 966217 - protein, 9 aa, Homo Sapiens
AFLNYLNQP

SEQ ID NO: 966218 - protein, 9 aa, Homo Sapiens
KNTLRTMGM

SEQ ID NO: 966219 - protein, 9 aa, Homo Sapiens
TVFIGGINC

SEQ ID NO: 966220 - protein, 9 aa, Homo Sapiens
PSPFQDTDG

SEQ ID NO: 966221 - protein, 9 aa, Homo Sapiens
APYPLVRRR

SEQ ID NO: 966222 - protein, 9 aa, Homo Sapiens
MDLFRTIFA

SEQ ID NO: 966223 - protein, 9 aa, Homo Sapiens
LDRLRFERV

SEQ ID NO: 966224 - protein, 9 aa, Homo Sapiens
FSFSADVEV

SEQ ID NO: 966225 - protein, 9 aa, Homo Sapiens
AGLDFFQPF

SEQ ID NO: 966226 - protein, 9 aa, Homo Sapiens
CSAFLDWPR

SEQ ID NO: 966227 - protein, 9 aa, Homo Sapiens
KSTVSVRRG

SEQ ID NO: 966228 - protein, 9 aa, Homo Sapiens
TISPTFPPA

SEQ ID NO: 966229 - protein, 9 aa, Homo Sapiens
PPEEAPPKE

SEQ ID NO: 966230 - protein, 9 aa, Homo Sapiens
FSDSATRDP

SEQ ID NO: 966231 - protein, 9 aa, Homo Sapiens
TKPVIRRLA

SEQ ID NO: 966232 - protein, 9 aa, Homo Sapiens
SSSKCHPPA

SEQ ID NO: 966233 - protein, 9 aa, Homo Sapiens
NIPRWQPDN

SEQ ID NO: 966234 - protein, 9 aa, Homo Sapiens
RSESLCCSS

SEQ ID NO: 966235 - protein, 9 aa, Homo Sapiens
LCLKERDWL

SEQ ID NO: 966236 - protein, 9 aa, Homo Sapiens
IKNSGLASG

SEQ ID NO: 966237 - protein, 9 aa, Homo Sapiens
QYCQCKGRL

SEQ ID NO: 966238 - protein, 9 aa, Homo Sapiens
VTFVARNCS

SEQ ID NO: 966239 - protein, 9 aa, Homo Sapiens
KEEIEIQKQ

SEQ ID NO: 966240 - protein, 9 aa, Homo Sapiens
ILKMFFSGL

SEQ ID NO: 966241 - protein, 9 aa, Homo Sapiens
FHPGGFLRG

SEQ ID NO: 966242 - protein, 9 aa, Homo Sapiens
NSFNPCINL

SEQ ID NO: 966243 - protein, 9 aa, Homo Sapiens
FRTAHNARK

SEQ ID NO: 966244 - protein, 9 aa, Homo Sapiens
AGLSKLSSV

SEQ ID NO: 966245 - protein, 9 aa, Homo Sapiens
GDMVTKDAD

SEQ ID NO: 966246 - protein, 9 aa, Homo Sapiens
KNDSGVYYC

SEQ ID NO: 966247 - protein, 9 aa, Homo Sapiens
YAHRPHTFQ

SEQ ID NO: 966248 - protein, 9 aa, Homo Sapiens
YCKEADNVI

SEQ ID NO: 966249 - protein, 9 aa, Homo Sapiens
SSFSEVEEV

SEQ ID NO: 966250 - protein, 9 aa, Homo Sapiens
KEKARPPEP

SEQ ID NO: 966251 - protein, 9 aa, Homo Sapiens
APEEAPPEE

SEQ ID NO: 966252 - protein, 9 aa, Homo Sapiens
PAERVDDTS

SEQ ID NO: 966253 - protein, 9 aa, Homo Sapiens
SKTRKSVQC

SEQ ID NO: 966254 - protein, 9 aa, Homo Sapiens
KKEATCPRH

SEQ ID NO: 966255 - protein, 9 aa, Homo Sapiens
TAISDPPKL

SEQ ID NO: 966256 - protein, 9 aa, Homo Sapiens
APPAFSRAP

SEQ ID NO: 966257 - protein, 9 aa, Homo Sapiens
FSIVRNLLS

SEQ ID NO: 966258 - protein, 9 aa, Homo Sapiens
FLYAHRVGR

SEQ ID NO: 966259 - protein, 9 aa, Homo Sapiens
LSLMPGGNK

SEQ ID NO: 966260 - protein, 9 aa, Homo Sapiens
LVTLQSQRN

SEQ ID NO: 966261 - protein, 9 aa, Homo Sapiens
FSYKNEVCK

SEQ ID NO: 966262 - protein, 9 aa, Homo Sapiens
FFSWLNSLN

SEQ ID NO: 966263 - protein, 9 aa, Homo Sapiens
SFRSNGNIT

SEQ ID NO: 966264 - protein, 9 aa, Homo Sapiens
QLHAAATAL

SEQ ID NO: 966265 - protein, 9 aa, Homo Sapiens
FRESEFQDK

SEQ ID NO: 966266 - protein, 9 aa, Homo Sapiens
GAYDSFMSL

SEQ ID NO: 966267 - protein, 9 aa, Homo Sapiens
KATLSVSVS

SEQ ID NO: 966268 - protein, 9 aa, Homo Sapiens
WQITVNDLP

SEQ ID NO: 966269 - protein, 9 aa, Homo Sapiens
SSGSETSTP

SEQ ID NO: 966270 - protein, 9 aa, Homo Sapiens
LCSAKISIS

SEQ ID NO: 966271 - protein, 9 aa, Homo Sapiens
KPLHPARPG

SEQ ID NO: 966272 - protein, 9 aa, Homo Sapiens
LVPGVNIEE

SEQ ID NO: 966273 - protein, 9 aa, Homo Sapiens
ESTSLDHAL

SEQ ID NO: 966274 - protein, 9 aa, Homo Sapiens
SLLEDVPLL

SEQ ID NO: 966275 - protein, 9 aa, Homo Sapiens
NLGAPKGMG

SEQ ID NO: 966276 - protein, 9 aa, Homo Sapiens
SSGNRSEFP

SEQ ID NO: 966277 - protein, 9 aa, Homo Sapiens
IREEKNFYK

SEQ ID NO: 966278 - protein, 9 aa, Homo Sapiens
VPPPPLARP

SEQ ID NO: 966279 - protein, 9 aa, Homo Sapiens
KLGNTKEKV

SEQ ID NO: 966280 - protein, 9 aa, Homo Sapiens
PGVPPPPLA

SEQ ID NO: 966281 - protein, 9 aa, Homo Sapiens
ALENNGVAS

SEQ ID NO: 966282 - protein, 9 aa, Homo Sapiens
PSQVTLTQT

SEQ ID NO: 966283 - protein, 9 aa, Homo Sapiens
SPQIIFFFL

SEQ ID NO: 966284 - protein, 9 aa, Homo Sapiens
VLGHFSYPD

SEQ ID NO: 966285 - protein, 9 aa, Homo Sapiens
FKLACQAMR

SEQ ID NO: 966286 - protein, 9 aa, Homo Sapiens
GHLRNLVLG

SEQ ID NO: 966287 - protein, 9 aa, Homo Sapiens
IKQMFGLFP

SEQ ID NO: 966288 - protein, 9 aa, Homo Sapiens
SKSTSHHED

SEQ ID NO: 966289 - protein, 9 aa, Homo Sapiens
SEDPQNQRL

SEQ ID NO: 966290 - protein, 9 aa, Homo Sapiens
RVLLIGSLL

SEQ ID NO: 966291 - protein, 9 aa, Homo Sapiens
LDSGTNSKL

SEQ ID NO: 966292 - protein, 9 aa, Homo Sapiens
DTAVIFSEA

SEQ ID NO: 966293 - protein, 9 aa, Homo Sapiens
ESLRHLKNT

SEQ ID NO: 966294 - protein, 9 aa, Homo Sapiens
EEELAPIGI

SEQ ID NO: 966295 - protein, 9 aa, Homo Sapiens
GIRHSKQAS

SEQ ID NO: 966296 - protein, 9 aa, Homo Sapiens
RSKTPRKFC

SEQ ID NO: 966297 - protein, 9 aa, Homo Sapiens
CTEPFSNST

SEQ ID NO: 966298 - protein, 9 aa, Homo Sapiens
IVELVRYLV

SEQ ID NO: 966299 - protein, 9 aa, Homo Sapiens
IGIDSEYEK

SEQ ID NO: 966300 - protein, 9 aa, Homo Sapiens
NLFAARDSS

SEQ ID NO: 966301 - protein, 9 aa, Homo Sapiens
FSDGGDGVF

SEQ ID NO: 966302 - protein, 9 aa, Homo Sapiens
LEDLLRTPS

SEQ ID NO: 966303 - protein, 9 aa, Homo Sapiens
GAQLLTYLI

SEQ ID NO: 966304 - protein, 9 aa, Homo Sapiens
SEDMSEDLL

SEQ ID NO: 966305 - protein, 9 aa, Homo Sapiens
GQLAFSGRN

SEQ ID NO: 966306 - protein, 9 aa, Homo Sapiens
LSMFDVSRE

SEQ ID NO: 966307 - protein, 9 aa, Homo Sapiens
IPASKRGEI

SEQ ID NO: 966308 - protein, 9 aa, Homo Sapiens
QCSRSLGRP

SEQ ID NO: 966309 - protein, 9 aa, Homo Sapiens
AVKEEGNQC

SEQ ID NO: 966310 - protein, 9 aa, Homo Sapiens
EAARKLLLA

SEQ ID NO: 966311 - protein, 9 aa, Homo Sapiens
ISRIISGGV

SEQ ID NO: 966312 - protein, 9 aa, Homo Sapiens
EPRSESPSC

SEQ ID NO: 966313 - protein, 9 aa, Homo Sapiens
QGDHLDCVW

SEQ ID NO: 966314 - protein, 9 aa, Homo Sapiens
NLQENSQKV

SEQ ID NO: 966315 - protein, 9 aa, Homo Sapiens
GEEDNWFEI

SEQ ID NO: 966316 - protein, 9 aa, Homo Sapiens
DSFMSLRGG

SEQ ID NO: 966317 - protein, 9 aa, Homo Sapiens
TSFVGVGKS

SEQ ID NO: 966318 - protein, 9 aa, Homo Sapiens
IAVILESLF

SEQ ID NO: 966319 - protein, 9 aa, Homo Sapiens
YWNDFYKIY

SEQ ID NO: 966320 - protein, 9 aa, Homo Sapiens
GPGTPLKLA

SEQ ID NO: 966321 - protein, 9 aa, Homo Sapiens
GSGNEGEGA

SEQ ID NO: 966322 - protein, 9 aa, Homo Sapiens
KGRIVYGLR

SEQ ID NO: 966323 - protein, 9 aa, Homo Sapiens
VISKVNLVG

SEQ ID NO: 966324 - protein, 9 aa, Homo Sapiens
PGYNESCFN

SEQ ID NO: 966325 - protein, 9 aa, Homo Sapiens
LQQDIMYKG

SEQ ID NO: 966326 - protein, 9 aa, Homo Sapiens
SLGKSWVSS

SEQ ID NO: 966327 - protein, 9 aa, Homo Sapiens
GLFRQHVLE

SEQ ID NO: 966328 - protein, 9 aa, Homo Sapiens
MKVRVLWLI

SEQ ID NO: 966329 - protein, 9 aa, Homo Sapiens
EPPPGSEGL

SEQ ID NO: 966330 - protein, 9 aa, Homo Sapiens
SCQPYLCCL

SEQ ID NO: 966331 - protein, 9 aa, Homo Sapiens
FPLPQKFPS

SEQ ID NO: 966332 - protein, 9 aa, Homo Sapiens
RIEPGVFVS

SEQ ID NO: 966333 - protein, 9 aa, Homo Sapiens
GSPPRSSWG

SEQ ID NO: 966334 - protein, 9 aa, Homo Sapiens
SFQKPKQLQ

SEQ ID NO: 966335 - protein, 9 aa, Homo Sapiens
ERLKVVLRS

SEQ ID NO: 966336 - protein, 9 aa, Homo Sapiens
QYPVGRIHR

SEQ ID NO: 966337 - protein, 9 aa, Homo Sapiens
GLGRAGAIC

SEQ ID NO: 966338 - protein, 9 aa, Homo Sapiens
ALKAHWSTL

SEQ ID NO: 966339 - protein, 9 aa, Homo Sapiens
GHRFRQSLH

SEQ ID NO: 966340 - protein, 9 aa, Homo Sapiens
KVFHDGCLR

SEQ ID NO: 966341 - protein, 9 aa, Homo Sapiens
FQEDESIHS

SEQ ID NO: 966342 - protein, 9 aa, Homo Sapiens
TYLNQTRAA

SEQ ID NO: 966343 - protein, 9 aa, Homo Sapiens
KQELSNSSS

SEQ ID NO: 966344 - protein, 9 aa, Homo Sapiens
ALLPFGPFS

SEQ ID NO: 966345 - protein, 9 aa, Homo Sapiens
NFIRSRPPL

SEQ ID NO: 966346 - protein, 9 aa, Homo Sapiens
TQSGSPRLG

SEQ ID NO: 966347 - protein, 9 aa, Homo Sapiens
THQQDAEVT

SEQ ID NO: 966348 - protein, 9 aa, Homo Sapiens
FIKIAFDKK

SEQ ID NO: 966349 - protein, 9 aa, Homo Sapiens
TLAPPPVDD

SEQ ID NO: 966350 - protein, 9 aa, Homo Sapiens
KAINQGSYG

SEQ ID NO: 966351 - protein, 9 aa, Homo Sapiens
ITIKEPLDK

SEQ ID NO: 966352 - protein, 9 aa, Homo Sapiens
CNCVPDSAL

SEQ ID NO: 966353 - protein, 9 aa, Homo Sapiens
REVLKVFLE

SEQ ID NO: 966354 - protein, 9 aa, Homo Sapiens
LFHPGGFLR

SEQ ID NO: 966355 - protein, 9 aa, Homo Sapiens
EKARKEAAL

SEQ ID NO: 966356 - protein, 9 aa, Homo Sapiens
GARPGGTPE

SEQ ID NO: 966357 - protein, 9 aa, Homo Sapiens
EGVRILSWP

SEQ ID NO: 966358 - protein, 9 aa, Homo Sapiens
MLERLKNTH

SEQ ID NO: 966359 - protein, 9 aa, Homo Sapiens
ELVNPFFLR

SEQ ID NO: 966360 - protein, 9 aa, Homo Sapiens
KESTSLDHA

SEQ ID NO: 966361 - protein, 9 aa, Homo Sapiens
PEIEIPFFK

SEQ ID NO: 966362 - protein, 9 aa, Homo Sapiens
FRVEAGEEG

SEQ ID NO: 966363 - protein, 9 aa, Homo Sapiens
TKDYDTTTE

SEQ ID NO: 966364 - protein, 9 aa, Homo Sapiens
DALDLGDCG

SEQ ID NO: 966365 - protein, 9 aa, Homo Sapiens
FFFLALTST

SEQ ID NO: 966366 - protein, 9 aa, Homo Sapiens
QKNKPVFYP

SEQ ID NO: 966367 - protein, 9 aa, Homo Sapiens
LLSHPPPDL

SEQ ID NO: 966368 - protein, 9 aa, Homo Sapiens
TVFPGSHLC

SEQ ID NO: 966369 - protein, 9 aa, Homo Sapiens
SSILSLEFK

SEQ ID NO: 966370 - protein, 9 aa, Homo Sapiens
NVRCSGHES

SEQ ID NO: 966371 - protein, 9 aa, Homo Sapiens
DEDIFKKLD

SEQ ID NO: 966372 - protein, 9 aa, Homo Sapiens
GFPWAFKMP

SEQ ID NO: 966373 - protein, 9 aa, Homo Sapiens
AGEIKGFIG

SEQ ID NO: 966374 - protein, 9 aa, Homo Sapiens
GHQFLQSPY

SEQ ID NO: 966375 - protein, 9 aa, Homo Sapiens
FAFGPGSQM

SEQ ID NO: 966376 - protein, 9 aa, Homo Sapiens
NPELYKFDL

SEQ ID NO: 966377 - protein, 9 aa, Homo Sapiens
VIFSEAPEE

SEQ ID NO: 966378 - protein, 9 aa, Homo Sapiens
LIVISAFSH

SEQ ID NO: 966379 - protein, 9 aa, Homo Sapiens
CSFQKPKQL

SEQ ID NO: 966380 - protein, 9 aa, Homo Sapiens
GVPPPPLAR

SEQ ID NO: 966381 - protein, 9 aa, Homo Sapiens
WESHIVLDS

SEQ ID NO: 966382 - protein, 9 aa, Homo Sapiens
KNFYKCEEC

SEQ ID NO: 966383 - protein, 9 aa, Homo Sapiens
VSAKGQKIT

SEQ ID NO: 966384 - protein, 9 aa, Homo Sapiens
ILTEEMYED

SEQ ID NO: 966385 - protein, 9 aa, Homo Sapiens
VLDRALHIS

SEQ ID NO: 966386 - protein, 9 aa, Homo Sapiens
ESQREDLQA

SEQ ID NO: 966387 - protein, 9 aa, Homo Sapiens
ETPDKAEPS

SEQ ID NO: 966388 - protein, 9 aa, Homo Sapiens
TVEEAADLL

SEQ ID NO: 966389 - protein, 9 aa, Homo Sapiens
ASMDQDDNQ

SEQ ID NO: 966390 - protein, 9 aa, Homo Sapiens
QVLRDFAQL

SEQ ID NO: 966391 - protein, 9 aa, Homo Sapiens
QGGPCNSPR

SEQ ID NO: 966392 - protein, 9 aa, Homo Sapiens
TFQLELSQK

SEQ ID NO: 966393 - protein, 9 aa, Homo Sapiens
QYATHFSIP

SEQ ID NO: 966394 - protein, 9 aa, Homo Sapiens
SSLPPRVAG

SEQ ID NO: 966395 - protein, 9 aa, Homo Sapiens
AESNGEKLP

SEQ ID NO: 966396 - protein, 9 aa, Homo Sapiens
QGSPPRSSW

SEQ ID NO: 966397 - protein, 9 aa, Homo Sapiens
GSPPGKKEF

SEQ ID NO: 966398 - protein, 9 aa, Homo Sapiens
TNPVTDPVS

SEQ ID NO: 966399 - protein, 9 aa, Homo Sapiens
QEKKFESMY

SEQ ID NO: 966400 - protein, 9 aa, Homo Sapiens
YEDIQPAAW

SEQ ID NO: 966401 - protein, 9 aa, Homo Sapiens
LLGELQVLR

SEQ ID NO: 966402 - protein, 9 aa, Homo Sapiens
FVYERQGIA

SEQ ID NO: 966403 - protein, 9 aa, Homo Sapiens
MVPGGDRSS

SEQ ID NO: 966404 - protein, 9 aa, Homo Sapiens
VSRMLVDFL

SEQ ID NO: 966405 - protein, 9 aa, Homo Sapiens
PCRALKRKK

SEQ ID NO: 966406 - protein, 9 aa, Homo Sapiens
RRRPDFCHA

SEQ ID NO: 966407 - protein, 9 aa, Homo Sapiens
LFKKDCDRR

SEQ ID NO: 966408 - protein, 9 aa, Homo Sapiens
FVDRIIYIV

SEQ ID NO: 966409 - protein, 9 aa, Homo Sapiens
WNDYEVPKE

SEQ ID NO: 966410 - protein, 9 aa, Homo Sapiens
IKNDSGVYY

SEQ ID NO: 966411 - protein, 9 aa, Homo Sapiens
DGDSCSISL

SEQ ID NO: 966412 - protein, 9 aa, Homo Sapiens
HAAATALWN

SEQ ID NO: 966413 - protein, 9 aa, Homo Sapiens
KEPCQIELY

SEQ ID NO: 966414 - protein, 9 aa, Homo Sapiens
QVEDEVLNA

SEQ ID NO: 966415 - protein, 9 aa, Homo Sapiens
DNPAENKRR

SEQ ID NO: 966416 - protein, 9 aa, Homo Sapiens
LAASTPSPS

SEQ ID NO: 966417 - protein, 9 aa, Homo Sapiens
SFFLGYLLQ

SEQ ID NO: 966418 - protein, 9 aa, Homo Sapiens
FSFFLGYLL

SEQ ID NO: 966419 - protein, 9 aa, Homo Sapiens
RLLQIWRKQ

SEQ ID NO: 966420 - protein, 9 aa, Homo Sapiens
SATENSILG

SEQ ID NO: 966421 - protein, 9 aa, Homo Sapiens
DADVSMPKL

SEQ ID NO: 966422 - protein, 9 aa, Homo Sapiens
ISYLVVKVG

SEQ ID NO: 966423 - protein, 9 aa, Homo Sapiens
IAHRAHLQG

SEQ ID NO: 966424 - protein, 9 aa, Homo Sapiens
GESGYLIFW

SEQ ID NO: 966425 - protein, 9 aa, Homo Sapiens
FRLELSREG

SEQ ID NO: 966426 - protein, 9 aa, Homo Sapiens
EDDEKEEQE

SEQ ID NO: 966427 - protein, 9 aa, Homo Sapiens
DCDCLHPED

SEQ ID NO: 966428 - protein, 9 aa, Homo Sapiens
HFPPSQLYV

SEQ ID NO: 966429 - protein, 9 aa, Homo Sapiens
QNILCNGSS

SEQ ID NO: 966430 - protein, 9 aa, Homo Sapiens
SLSMAFVYT

SEQ ID NO: 966431 - protein, 9 aa, Homo Sapiens
ELCSLKNHG

SEQ ID NO: 966432 - protein, 9 aa, Homo Sapiens
LFQLIAELG

SEQ ID NO: 966433 - protein, 9 aa, Homo Sapiens
ISPGGDREA

SEQ ID NO: 966434 - protein, 9 aa, Homo Sapiens
IKTSTTLRT

SEQ ID NO: 966435 - protein, 9 aa, Homo Sapiens
DAFFQPVPA

SEQ ID NO: 966436 - protein, 9 aa, Homo Sapiens
IDKVISWIL

SEQ ID NO: 966437 - protein, 9 aa, Homo Sapiens
LSTYEVSAK

SEQ ID NO: 966438 - protein, 9 aa, Homo Sapiens
FSQTPQQPP

SEQ ID NO: 966439 - protein, 9 aa, Homo Sapiens
RQSPASPSP

SEQ ID NO: 966440 - protein, 9 aa, Homo Sapiens
ERTLSLSSG

SEQ ID NO: 966441 - protein, 9 aa, Homo Sapiens
IKGFIGIDS

SEQ ID NO: 966442 - protein, 9 aa, Homo Sapiens
MTTHVFFRS

SEQ ID NO: 966443 - protein, 9 aa, Homo Sapiens
NSSTGTSEA

SEQ ID NO: 966444 - protein, 9 aa, Homo Sapiens
VAPNLIEKQ

SEQ ID NO: 966445 - protein, 9 aa, Homo Sapiens
IELAERKPL

SEQ ID NO: 966446 - protein, 9 aa, Homo Sapiens
EAFLGEASK

SEQ ID NO: 966447 - protein, 9 aa, Homo Sapiens
SISPSELGE

SEQ ID NO: 966448 - protein, 9 aa, Homo Sapiens
ERGIKTASN

SEQ ID NO: 966449 - protein, 9 aa, Homo Sapiens
PCEILKMFF

SEQ ID NO: 966450 - protein, 9 aa, Homo Sapiens
QPALLLNQP

SEQ ID NO: 966451 - protein, 9 aa, Homo Sapiens
EFYKNADVW

SEQ ID NO: 966452 - protein, 9 aa, Homo Sapiens
GEGKIPWES

SEQ ID NO: 966453 - protein, 9 aa, Homo Sapiens
SPTFPPAHS

SEQ ID NO: 966454 - protein, 9 aa, Homo Sapiens
EKEFGFCCE

SEQ ID NO: 966455 - protein, 9 aa, Homo Sapiens
KERSFKGVK

SEQ ID NO: 966456 - protein, 9 aa, Homo Sapiens
LPQGYRIEQ

SEQ ID NO: 966457 - protein, 9 aa, Homo Sapiens
TASALINKE

SEQ ID NO: 966458 - protein, 9 aa, Homo Sapiens
GELKTRGRA

SEQ ID NO: 966459 - protein, 9 aa, Homo Sapiens
RRDLEKPPR

SEQ ID NO: 966460 - protein, 9 aa, Homo Sapiens
LEFEFAVEL

SEQ ID NO: 966461 - protein, 9 aa, Homo Sapiens
TVTVRPSTQ

SEQ ID NO: 966462 - protein, 9 aa, Homo Sapiens
FLLILAPLQ

SEQ ID NO: 966463 - protein, 9 aa, Homo Sapiens
RMGFSTEQA

SEQ ID NO: 966464 - protein, 9 aa, Homo Sapiens
VSHSQDTLF

SEQ ID NO: 966465 - protein, 9 aa, Homo Sapiens
SKKTNFLCS

SEQ ID NO: 966466 - protein, 9 aa, Homo Sapiens
TEEELAPIG

SEQ ID NO: 966467 - protein, 9 aa, Homo Sapiens
PLCSSPCFS

SEQ ID NO: 966468 - protein, 9 aa, Homo Sapiens
LDDGNESEV

SEQ ID NO: 966469 - protein, 9 aa, Homo Sapiens
IRAREKDCI

SEQ ID NO: 966470 - protein, 9 aa, Homo Sapiens
VLHLSEAPP

SEQ ID NO: 966471 - protein, 9 aa, Homo Sapiens
RELSDDYPS

SEQ ID NO: 966472 - protein, 9 aa, Homo Sapiens
SGNFGGGRR

SEQ ID NO: 966473 - protein, 9 aa, Homo Sapiens
DKLTYGIIA

SEQ ID NO: 966474 - protein, 9 aa, Homo Sapiens
ESMEKAGPL

SEQ ID NO: 966475 - protein, 9 aa, Homo Sapiens
SQKGVTGEW

SEQ ID NO: 966476 - protein, 9 aa, Homo Sapiens
IEDGKIYTV

SEQ ID NO: 966477 - protein, 9 aa, Homo Sapiens
EAEDILQEF

SEQ ID NO: 966478 - protein, 9 aa, Homo Sapiens
QGITKPVIR

SEQ ID NO: 966479 - protein, 9 aa, Homo Sapiens
TAPPLPPLP

SEQ ID NO: 966480 - protein, 9 aa, Homo Sapiens
CLKERDWLP

SEQ ID NO: 966481 - protein, 9 aa, Homo Sapiens
LLSDDMKVL

SEQ ID NO: 966482 - protein, 9 aa, Homo Sapiens
ASGLTEEDE

SEQ ID NO: 966483 - protein, 9 aa, Homo Sapiens
VPQVPAERV

SEQ ID NO: 966484 - protein, 9 aa, Homo Sapiens
LYSSFPEEA

SEQ ID NO: 966485 - protein, 9 aa, Homo Sapiens
LEFRIVEQE

SEQ ID NO: 966486 - protein, 9 aa, Homo Sapiens
ESVVITIPV

SEQ ID NO: 966487 - protein, 9 aa, Homo Sapiens
TTNPLLTQA

SEQ ID NO: 966488 - protein, 9 aa, Homo Sapiens
YLIRDEKKD

SEQ ID NO: 966489 - protein, 9 aa, Homo Sapiens
PLNQVTESA

SEQ ID NO: 966490 - protein, 9 aa, Homo Sapiens
HIFFFSWLN

SEQ ID NO: 966491 - protein, 9 aa, Homo Sapiens
FVGVGKSIA

SEQ ID NO: 966492 - protein, 9 aa, Homo Sapiens
KSPTSWGCS

SEQ ID NO: 966493 - protein, 9 aa, Homo Sapiens
SQNKKEQAE

SEQ ID NO: 966494 - protein, 9 aa, Homo Sapiens
IEKQKKVKL

SEQ ID NO: 966495 - protein, 9 aa, Homo Sapiens
AWNLCSVEK

SEQ ID NO: 966496 - protein, 9 aa, Homo Sapiens
WDDFLSVLS

SEQ ID NO: 966497 - protein, 9 aa, Homo Sapiens
LLQKFAACN

SEQ ID NO: 966498 - protein, 9 aa, Homo Sapiens
TLFNFSNFL

SEQ ID NO: 966499 - protein, 9 aa, Homo Sapiens
KGGGAGHTV

SEQ ID NO: 966500 - protein, 9 aa, Homo Sapiens
PPGWRELVL

SEQ ID NO: 966501 - protein, 9 aa, Homo Sapiens
MEHKRTHTG

SEQ ID NO: 966502 - protein, 9 aa, Homo Sapiens
DNYANICFR

SEQ ID NO: 966503 - protein, 9 aa, Homo Sapiens
DIHFDSDEP

SEQ ID NO: 966504 - protein, 9 aa, Homo Sapiens
SQYKINITS

SEQ ID NO: 966505 - protein, 9 aa, Homo Sapiens
RMSGTNVCS

SEQ ID NO: 966506 - protein, 9 aa, Homo Sapiens
CQLKELHLS

SEQ ID NO: 966507 - protein, 9 aa, Homo Sapiens
CLAAEGFSN

SEQ ID NO: 966508 - protein, 9 aa, Homo Sapiens
QENTLHPDL

SEQ ID NO: 966509 - protein, 9 aa, Homo Sapiens
DHLDCVWLL

SEQ ID NO: 966510 - protein, 9 aa, Homo Sapiens
SMGIRHSKQ

SEQ ID NO: 966511 - protein, 9 aa, Homo Sapiens
RIFFSTAFC

SEQ ID NO: 966512 - protein, 9 aa, Homo Sapiens
TAPGPPERP

SEQ ID NO: 966513 - protein, 9 aa, Homo Sapiens
VLDNVRCSG

SEQ ID NO: 966514 - protein, 9 aa, Homo Sapiens
MAGCLGSHR

SEQ ID NO: 966515 - protein, 9 aa, Homo Sapiens
LKNHGLLKT

SEQ ID NO: 966516 - protein, 9 aa, Homo Sapiens
LAVHPEQLL

SEQ ID NO: 966517 - protein, 9 aa, Homo Sapiens
FPQDPYPSS

SEQ ID NO: 966518 - protein, 9 aa, Homo Sapiens
VGSGGFSGK

SEQ ID NO: 966519 - protein, 9 aa, Homo Sapiens
TVTFTCLTS

SEQ ID NO: 966520 - protein, 9 aa, Homo Sapiens
TNPVYPSNQ

SEQ ID NO: 966521 - protein, 9 aa, Homo Sapiens
DHFSPLSED

SEQ ID NO: 966522 - protein, 9 aa, Homo Sapiens
TILGNTTAD

SEQ ID NO: 966523 - protein, 9 aa, Homo Sapiens
EYGRTISSL

SEQ ID NO: 966524 - protein, 9 aa, Homo Sapiens
AVGRVGSTF

SEQ ID NO: 966525 - protein, 9 aa, Homo Sapiens
VRGAVAFAD

SEQ ID NO: 966526 - protein, 9 aa, Homo Sapiens
WPLSVPAYP

SEQ ID NO: 966527 - protein, 9 aa, Homo Sapiens
KKFLFYARR

SEQ ID NO: 966528 - protein, 9 aa, Homo Sapiens
SGPQLMPVR

SEQ ID NO: 966529 - protein, 9 aa, Homo Sapiens
RQERTPTHY

SEQ ID NO: 966530 - protein, 9 aa, Homo Sapiens
SKGRIVYGL

SEQ ID NO: 966531 - protein, 9 aa, Homo Sapiens
KQGYEHLHL

SEQ ID NO: 966532 - protein, 9 aa, Homo Sapiens
RKEGSLKLS

SEQ ID NO: 966533 - protein, 9 aa, Homo Sapiens
GLLISAEKS

SEQ ID NO: 966534 - protein, 9 aa, Homo Sapiens
VLLQAVLYS

SEQ ID NO: 966535 - protein, 9 aa, Homo Sapiens
YLEMKEGVK

SEQ ID NO: 966536 - protein, 9 aa, Homo Sapiens
REAKRQAQA

SEQ ID NO: 966537 - protein, 9 aa, Homo Sapiens
ANKVLCAMT

SEQ ID NO: 966538 - protein, 9 aa, Homo Sapiens
ASESESEKP

SEQ ID NO: 966539 - protein, 9 aa, Homo Sapiens
TPPFSGNDT

SEQ ID NO: 966540 - protein, 9 aa, Homo Sapiens
IIFQFIFLP

SEQ ID NO: 966541 - protein, 9 aa, Homo Sapiens
VAMPIAGTS

SEQ ID NO: 966542 - protein, 9 aa, Homo Sapiens
LLKCRMAYQ

SEQ ID NO: 966543 - protein, 9 aa, Homo Sapiens
TATVSTLAP

SEQ ID NO: 966544 - protein, 9 aa, Homo Sapiens
EEGPGTFHT

SEQ ID NO: 966545 - protein, 9 aa, Homo Sapiens
FLIIHQRMH

SEQ ID NO: 966546 - protein, 9 aa, Homo Sapiens
ECETQGLPH

SEQ ID NO: 966547 - protein, 9 aa, Homo Sapiens
RLRFERVLG

SEQ ID NO: 966548 - protein, 9 aa, Homo Sapiens
PKEILHHEQ

SEQ ID NO: 966549 - protein, 9 aa, Homo Sapiens
FLRGPASSF

SEQ ID NO: 966550 - protein, 9 aa, Homo Sapiens
HRRDSHKAP

SEQ ID NO: 966551 - protein, 9 aa, Homo Sapiens
LVKDLPTRA

SEQ ID NO: 966552 - protein, 9 aa, Homo Sapiens
SESSDVLPM

SEQ ID NO: 966553 - protein, 9 aa, Homo Sapiens
AGLRAPLNI

SEQ ID NO: 966554 - protein, 9 aa, Homo Sapiens
PVPSEEEHC

SEQ ID NO: 966555 - protein, 9 aa, Homo Sapiens
PVDCSIKTR

SEQ ID NO: 966556 - protein, 9 aa, Homo Sapiens
ADEVWPGFY

SEQ ID NO: 966557 - protein, 9 aa, Homo Sapiens
ALSQYKINI

SEQ ID NO: 966558 - protein, 9 aa, Homo Sapiens
TASSPVYES

SEQ ID NO: 966559 - protein, 9 aa, Homo Sapiens
QHGFKLPRL

SEQ ID NO: 966560 - protein, 9 aa, Homo Sapiens
LSRGAAAGV

SEQ ID NO: 966561 - protein, 9 aa, Homo Sapiens
ENLLRKHTG

SEQ ID NO: 966562 - protein, 9 aa, Homo Sapiens
KHAKERTRY

SEQ ID NO: 966563 - protein, 9 aa, Homo Sapiens
MPLTQEQFQ

SEQ ID NO: 966564 - protein, 9 aa, Homo Sapiens
QNTGAYDSF

SEQ ID NO: 966565 - protein, 9 aa, Homo Sapiens
GLIQDLNNC

SEQ ID NO: 966566 - protein, 9 aa, Homo Sapiens
VREKKIQSL

SEQ ID NO: 966567 - protein, 9 aa, Homo Sapiens
CPVFSGLFE

SEQ ID NO: 966568 - protein, 9 aa, Homo Sapiens
VSTLAPPPV

SEQ ID NO: 966569 - protein, 9 aa, Homo Sapiens
DNTRELQEK

SEQ ID NO: 966570 - protein, 9 aa, Homo Sapiens
QPHVGQKEM

SEQ ID NO: 966571 - protein, 9 aa, Homo Sapiens
ANICFRFMG

SEQ ID NO: 966572 - protein, 9 aa, Homo Sapiens
LVHAEVQHI

SEQ ID NO: 966573 - protein, 9 aa, Homo Sapiens
FYILKPQML

SEQ ID NO: 966574 - protein, 9 aa, Homo Sapiens
STFFSRTSP

SEQ ID NO: 966575 - protein, 9 aa, Homo Sapiens
CYLAICYPL

SEQ ID NO: 966576 - protein, 9 aa, Homo Sapiens
SFPKDPQHL

SEQ ID NO: 966577 - protein, 9 aa, Homo Sapiens
LIKHQKIYS

SEQ ID NO: 966578 - protein, 9 aa, Homo Sapiens
GSRTTERRS

SEQ ID NO: 966579 - protein, 9 aa, Homo Sapiens
AQFNWDPKT

SEQ ID NO: 966580 - protein, 9 aa, Homo Sapiens
LGELQVLRD

SEQ ID NO: 966581 - protein, 9 aa, Homo Sapiens
IGIIQHLEP

SEQ ID NO: 966582 - protein, 9 aa, Homo Sapiens
AIDKEIPSM

SEQ ID NO: 966583 - protein, 9 aa, Homo Sapiens
FARRSDRGS

SEQ ID NO: 966584 - protein, 9 aa, Homo Sapiens
APAAAKSGT

SEQ ID NO: 966585 - protein, 9 aa, Homo Sapiens
PKSFSKGDI

SEQ ID NO: 966586 - protein, 9 aa, Homo Sapiens
SSQILLIYA

SEQ ID NO: 966587 - protein, 9 aa, Homo Sapiens
IAYVLVFLL

SEQ ID NO: 966588 - protein, 9 aa, Homo Sapiens
WTGRICVVV

SEQ ID NO: 966589 - protein, 9 aa, Homo Sapiens
EVWPGFYLG

SEQ ID NO: 966590 - protein, 9 aa, Homo Sapiens
IYEETREVL

SEQ ID NO: 966591 - protein, 9 aa, Homo Sapiens
ISDPSHLPL

SEQ ID NO: 966592 - protein, 9 aa, Homo Sapiens
TERRSSGHS

SEQ ID NO: 966593 - protein, 9 aa, Homo Sapiens
KKLAESLRH

SEQ ID NO: 966594 - protein, 9 aa, Homo Sapiens
WTKNGKALQ

SEQ ID NO: 966595 - protein, 9 aa, Homo Sapiens
LDFRRVPLV

SEQ ID NO: 966596 - protein, 9 aa, Homo Sapiens
VSGRFSSLL

SEQ ID NO: 966597 - protein, 9 aa, Homo Sapiens
KLSYTFSHA

SEQ ID NO: 966598 - protein, 9 aa, Homo Sapiens
VLALYGRQG

SEQ ID NO: 966599 - protein, 9 aa, Homo Sapiens
CADCSGPDL

SEQ ID NO: 966600 - protein, 9 aa, Homo Sapiens
QGMNSYSML

SEQ ID NO: 966601 - protein, 9 aa, Homo Sapiens
VFFRSVIEV

SEQ ID NO: 966602 - protein, 9 aa, Homo Sapiens
EFAFGPGSQ

SEQ ID NO: 966603 - protein, 9 aa, Homo Sapiens
TTADNRIII

SEQ ID NO: 966604 - protein, 9 aa, Homo Sapiens
LPQLRSATS

SEQ ID NO: 966605 - protein, 9 aa, Homo Sapiens
QVPKLDEHL

SEQ ID NO: 966606 - protein, 9 aa, Homo Sapiens
CSALIQHKK

SEQ ID NO: 966607 - protein, 9 aa, Homo Sapiens
RLFLNLGPP

SEQ ID NO: 966608 - protein, 9 aa, Homo Sapiens
QGLPHCRNG

SEQ ID NO: 966609 - protein, 9 aa, Homo Sapiens
KIKNEMATS

SEQ ID NO: 966610 - protein, 9 aa, Homo Sapiens
ENAPIHCIC

SEQ ID NO: 966611 - protein, 9 aa, Homo Sapiens
QTKFPVPLE

SEQ ID NO: 966612 - protein, 9 aa, Homo Sapiens
EEAPPKEDL

SEQ ID NO: 966613 - protein, 9 aa, Homo Sapiens
APPEEAPPK

SEQ ID NO: 966614 - protein, 9 aa, Homo Sapiens
CVLSDRGKT

SEQ ID NO: 966615 - protein, 9 aa, Homo Sapiens
LSVAALSIP

SEQ ID NO: 966616 - protein, 9 aa, Homo Sapiens
KLTYGIIAA

SEQ ID NO: 966617 - protein, 9 aa, Homo Sapiens
VAKNAAGSA

SEQ ID NO: 966618 - protein, 9 aa, Homo Sapiens
RNVLSSFIS

SEQ ID NO: 966619 - protein, 9 aa, Homo Sapiens
GGNLIVELV

SEQ ID NO: 966620 - protein, 9 aa, Homo Sapiens
PLTSTGSDP

SEQ ID NO: 966621 - protein, 9 aa, Homo Sapiens
PKSSFVGDE

SEQ ID NO: 966622 - protein, 9 aa, Homo Sapiens
IFNYTTALC

SEQ ID NO: 966623 - protein, 9 aa, Homo Sapiens
RKSKGRIVY

SEQ ID NO: 966624 - protein, 9 aa, Homo Sapiens
SLAKKESFG

SEQ ID NO: 966625 - protein, 9 aa, Homo Sapiens
VVSLTQEKK

SEQ ID NO: 966626 - protein, 9 aa, Homo Sapiens
TLSTLQQDI

SEQ ID NO: 966627 - protein, 9 aa, Homo Sapiens
QAVKKSSTV

SEQ ID NO: 966628 - protein, 9 aa, Homo Sapiens
ENSILGRDV

SEQ ID NO: 966629 - protein, 9 aa, Homo Sapiens
REFKGEEEY

SEQ ID NO: 966630 - protein, 9 aa, Homo Sapiens
DEEFQSSFA

SEQ ID NO: 966631 - protein, 9 aa, Homo Sapiens
LTASPKPQL

SEQ ID NO: 966632 - protein, 9 aa, Homo Sapiens
DGILSSKFL

SEQ ID NO: 966633 - protein, 9 aa, Homo Sapiens
YDFPRGVQK

SEQ ID NO: 966634 - protein, 9 aa, Homo Sapiens
AKNAAGSAH

SEQ ID NO: 966635 - protein, 9 aa, Homo Sapiens
DTPDAAPGQ

SEQ ID NO: 966636 - protein, 9 aa, Homo Sapiens
VPKLDEHLV

SEQ ID NO: 966637 - protein, 9 aa, Homo Sapiens
HQQLSEVSN

SEQ ID NO: 966638 - protein, 9 aa, Homo Sapiens
DRLEESFKQ

SEQ ID NO: 966639 - protein, 9 aa, Homo Sapiens
GPPPSGMRP

SEQ ID NO: 966640 - protein, 9 aa, Homo Sapiens
ADEAFIQAL

SEQ ID NO: 966641 - protein, 9 aa, Homo Sapiens
NPIFGRNEL

SEQ ID NO: 966642 - protein, 9 aa, Homo Sapiens
GSYGWQAGN

SEQ ID NO: 966643 - protein, 9 aa, Homo Sapiens
SLRNKNVKT

SEQ ID NO: 966644 - protein, 9 aa, Homo Sapiens
EEKTSGSHL

SEQ ID NO: 966645 - protein, 9 aa, Homo Sapiens
LELDNPAEN

SEQ ID NO: 966646 - protein, 9 aa, Homo Sapiens
SLKNAVFKL

SEQ ID NO: 966647 - protein, 9 aa, Homo Sapiens
EVEEWYKSK

SEQ ID NO: 966648 - protein, 9 aa, Homo Sapiens
KGILWQITV

SEQ ID NO: 966649 - protein, 9 aa, Homo Sapiens
IWDVPQKHS

SEQ ID NO: 966650 - protein, 9 aa, Homo Sapiens
IYVGERPYE

SEQ ID NO: 966651 - protein, 9 aa, Homo Sapiens
LTSYGAIVQ

SEQ ID NO: 966652 - protein, 9 aa, Homo Sapiens
ENFDQDNDK

SEQ ID NO: 966653 - protein, 9 aa, Homo Sapiens
IYSLTNMKG

SEQ ID NO: 966654 - protein, 9 aa, Homo Sapiens
SFKNPSFFE

SEQ ID NO: 966655 - protein, 9 aa, Homo Sapiens
KSLRNKEAS

SEQ ID NO: 966656 - protein, 9 aa, Homo Sapiens
TGTSEAAKK

SEQ ID NO: 966657 - protein, 9 aa, Homo Sapiens
SESESEKPT

SEQ ID NO: 966658 - protein, 9 aa, Homo Sapiens
AETVLPLTM

SEQ ID NO: 966659 - protein, 9 aa, Homo Sapiens
GGDIHFDSD

SEQ ID NO: 966660 - protein, 9 aa, Homo Sapiens
EAPPEEAPP

SEQ ID NO: 966661 - protein, 9 aa, Homo Sapiens
LVVLNFFLA

SEQ ID NO: 966662 - protein, 9 aa, Homo Sapiens
REVISRSQH

SEQ ID NO: 966663 - protein, 9 aa, Homo Sapiens
NNCSVMAVD

SEQ ID NO: 966664 - protein, 9 aa, Homo Sapiens
LCATYWDIA

SEQ ID NO: 966665 - protein, 9 aa, Homo Sapiens
VSSGGVPQG

SEQ ID NO: 966666 - protein, 9 aa, Homo Sapiens
TLGDVKNKQ

SEQ ID NO: 966667 - protein, 9 aa, Homo Sapiens
RLTVQMKNT

SEQ ID NO: 966668 - protein, 9 aa, Homo Sapiens
RKSKMTSNK

SEQ ID NO: 966669 - protein, 9 aa, Homo Sapiens
SFFMELLKT

SEQ ID NO: 966670 - protein, 9 aa, Homo Sapiens
EYPNEKITH

SEQ ID NO: 966671 - protein, 9 aa, Homo Sapiens
AVEMRPDKL

SEQ ID NO: 966672 - protein, 9 aa, Homo Sapiens
RNSWLKMET

SEQ ID NO: 966673 - protein, 9 aa, Homo Sapiens
EHLASFIRL

SEQ ID NO: 966674 - protein, 9 aa, Homo Sapiens
SEDEDDEKE

SEQ ID NO: 966675 - protein, 9 aa, Homo Sapiens
SGSARKRLF

SEQ ID NO: 966676 - protein, 9 aa, Homo Sapiens
EFQDKEELT

SEQ ID NO: 966677 - protein, 9 aa, Homo Sapiens
PARHIFFFS

SEQ ID NO: 966678 - protein, 9 aa, Homo Sapiens
PGMTGCPGA

SEQ ID NO: 966679 - protein, 9 aa, Homo Sapiens
KELPARICF

SEQ ID NO: 966680 - protein, 9 aa, Homo Sapiens
PPYGVLRFL

SEQ ID NO: 966681 - protein, 9 aa, Homo Sapiens
SESAESDPL

SEQ ID NO: 966682 - protein, 9 aa, Homo Sapiens
AFNLETAIA

SEQ ID NO: 966683 - protein, 9 aa, Homo Sapiens
SNDDDEHTL

SEQ ID NO: 966684 - protein, 9 aa, Homo Sapiens
NTLRTMGMV

SEQ ID NO: 966685 - protein, 9 aa, Homo Sapiens
SFKEVPRGS

SEQ ID NO: 966686 - protein, 9 aa, Homo Sapiens
EKCNKKVDI

SEQ ID NO: 966687 - protein, 9 aa, Homo Sapiens
VYHMHSKER

SEQ ID NO: 966688 - protein, 9 aa, Homo Sapiens
KVPNLSVFK

SEQ ID NO: 966689 - protein, 9 aa, Homo Sapiens
LGRLVTHKS

SEQ ID NO: 966690 - protein, 9 aa, Homo Sapiens
VEIFVNYYS

SEQ ID NO: 966691 - protein, 9 aa, Homo Sapiens
RAAVQNVVI

SEQ ID NO: 966692 - protein, 9 aa, Homo Sapiens
SLEAEKRKK

SEQ ID NO: 966693 - protein, 9 aa, Homo Sapiens
EAYSSFAAA

SEQ ID NO: 966694 - protein, 9 aa, Homo Sapiens
VLMGNVPNR

SEQ ID NO: 966695 - protein, 9 aa, Homo Sapiens
SALQIYCIK

SEQ ID NO: 966696 - protein, 9 aa, Homo Sapiens
PSLGSCSSE

SEQ ID NO: 966697 - protein, 9 aa, Homo Sapiens
SLSKKKAGH

SEQ ID NO: 966698 - protein, 9 aa, Homo Sapiens
EDGKIYTVE

SEQ ID NO: 966699 - protein, 9 aa, Homo Sapiens
DAEEEGLLL

SEQ ID NO: 966700 - protein, 9 aa, Homo Sapiens
RKSSSLKVS

SEQ ID NO: 966701 - protein, 9 aa, Homo Sapiens
GLEEKEEEE

SEQ ID NO: 966702 - protein, 9 aa, Homo Sapiens
CVAKNAAGS

SEQ ID NO: 966703 - protein, 9 aa, Homo Sapiens
IGKLNLDVE

SEQ ID NO: 966704 - protein, 9 aa, Homo Sapiens
SVLQLGNIS

SEQ ID NO: 966705 - protein, 9 aa, Homo Sapiens
RTSSLNWHV

SEQ ID NO: 966706 - protein, 9 aa, Homo Sapiens
NRTSFLENH

SEQ ID NO: 966707 - protein, 9 aa, Homo Sapiens
KKKKKKFSN

SEQ ID NO: 966708 - protein, 9 aa, Homo Sapiens
YGRTISSLE

SEQ ID NO: 966709 - protein, 9 aa, Homo Sapiens
TPYQNILCN

SEQ ID NO: 966710 - protein, 9 aa, Homo Sapiens
NHLFGSERL

SEQ ID NO: 966711 - protein, 9 aa, Homo Sapiens
PEAEPSIDV

SEQ ID NO: 966712 - protein, 9 aa, Homo Sapiens
FVLIAQQTD

SEQ ID NO: 966713 - protein, 9 aa, Homo Sapiens
TTLKNREAF

SEQ ID NO: 966714 - protein, 9 aa, Homo Sapiens
INHLCFYFF

SEQ ID NO: 966715 - protein, 9 aa, Homo Sapiens
KSYRKRRVL

SEQ ID NO: 966716 - protein, 9 aa, Homo Sapiens
GKTPDPQAG

SEQ ID NO: 966717 - protein, 9 aa, Homo Sapiens
FSGASAEPD

SEQ ID NO: 966718 - protein, 9 aa, Homo Sapiens
CGTGLGSQM

SEQ ID NO: 966719 - protein, 9 aa, Homo Sapiens
DAAQSEEKQ

SEQ ID NO: 966720 - protein, 9 aa, Homo Sapiens
ALLPNITLR

SEQ ID NO: 966721 - protein, 9 aa, Homo Sapiens
GEVEKRVDA

SEQ ID NO: 966722 - protein, 9 aa, Homo Sapiens
PPGMTGCPG

SEQ ID NO: 966723 - protein, 9 aa, Homo Sapiens
TWSYNHPIW

SEQ ID NO: 966724 - protein, 9 aa, Homo Sapiens
RGNIGKLNL

SEQ ID NO: 966725 - protein, 9 aa, Homo Sapiens
GILSSKFLT

SEQ ID NO: 966726 - protein, 9 aa, Homo Sapiens
LAPGQNKIS

SEQ ID NO: 966727 - protein, 9 aa, Homo Sapiens
LCSSPCFSC

SEQ ID NO: 966728 - protein, 9 aa, Homo Sapiens
VEKRQSPVN

SEQ ID NO: 966729 - protein, 9 aa, Homo Sapiens
PPDFNPKDS

SEQ ID NO: 966730 - protein, 9 aa, Homo Sapiens
SPRVKRPIG

SEQ ID NO: 966731 - protein, 9 aa, Homo Sapiens
YFASVSLYQ

SEQ ID NO: 966732 - protein, 9 aa, Homo Sapiens
ECEDENSSP

SEQ ID NO: 966733 - protein, 9 aa, Homo Sapiens
NMKRAAFLN

SEQ ID NO: 966734 - protein, 9 aa, Homo Sapiens
LLENALSGT

SEQ ID NO: 966735 - protein, 9 aa, Homo Sapiens
IQNPRLFAE

SEQ ID NO: 966736 - protein, 9 aa, Homo Sapiens
AEEEGLLLI

SEQ ID NO: 966737 - protein, 9 aa, Homo Sapiens
LVALGRQVG

SEQ ID NO: 966738 - protein, 9 aa, Homo Sapiens
GDLSQNKKE

SEQ ID NO: 966739 - protein, 9 aa, Homo Sapiens
PGPGDPSFP

SEQ ID NO: 966740 - protein, 9 aa, Homo Sapiens
KKDCDRRCL

SEQ ID NO: 966741 - protein, 9 aa, Homo Sapiens
GLLYKHLIT

SEQ ID NO: 966742 - protein, 9 aa, Homo Sapiens
SSLLTPHHR

SEQ ID NO: 966743 - protein, 9 aa, Homo Sapiens
SSEDEDDEK

SEQ ID NO: 966744 - protein, 9 aa, Homo Sapiens
SVCPTPKCP

SEQ ID NO: 966745 - protein, 9 aa, Homo Sapiens
RMNFKMQVY

SEQ ID NO: 966746 - protein, 9 aa, Homo Sapiens
QELGLISGI

SEQ ID NO: 966747 - protein, 9 aa, Homo Sapiens
IQVEEKEEE

SEQ ID NO: 966748 - protein, 9 aa, Homo Sapiens
FFGEGDAVT

SEQ ID NO: 966749 - protein, 9 aa, Homo Sapiens
QTYLNQTRA

SEQ ID NO: 966750 - protein, 9 aa, Homo Sapiens
NFIKQKHGA

SEQ ID NO: 966751 - protein, 9 aa, Homo Sapiens
APPSPAFLW

SEQ ID NO: 966752 - protein, 9 aa, Homo Sapiens
FFGNLCQLD

SEQ ID NO: 966753 - protein, 9 aa, Homo Sapiens
RRDLEKSTL

SEQ ID NO: 966754 - protein, 9 aa, Homo Sapiens
TRAESTSLV

SEQ ID NO: 966755 - protein, 9 aa, Homo Sapiens
TEELLRKTK

SEQ ID NO: 966756 - protein, 9 aa, Homo Sapiens
GPLGQPGYP

SEQ ID NO: 966757 - protein, 9 aa, Homo Sapiens
FGRNELESV

SEQ ID NO: 966758 - protein, 9 aa, Homo Sapiens
SKKKKKKFS

SEQ ID NO: 966759 - protein, 9 aa, Homo Sapiens
GWPLPFSIA

SEQ ID NO: 966760 - protein, 9 aa, Homo Sapiens
KGEPEKGEM

SEQ ID NO: 966761 - protein, 9 aa, Homo Sapiens
LFYVHFLLP

SEQ ID NO: 966762 - protein, 9 aa, Homo Sapiens
AFADFYPFG

SEQ ID NO: 966763 - protein, 9 aa, Homo Sapiens
VRLELVNPF

SEQ ID NO: 966764 - protein, 9 aa, Homo Sapiens
VGLVLQPWM

SEQ ID NO: 966765 - protein, 9 aa, Homo Sapiens
EAKLPRQAF

SEQ ID NO: 966766 - protein, 9 aa, Homo Sapiens
IENLNSILD

SEQ ID NO: 966767 - protein, 9 aa, Homo Sapiens
LFLYTEPPG

SEQ ID NO: 966768 - protein, 9 aa, Homo Sapiens
HGSSTRRRK

SEQ ID NO: 966769 - protein, 9 aa, Homo Sapiens
FIVQRISDP

SEQ ID NO: 966770 - protein, 9 aa, Homo Sapiens
QMFGLFPSS

SEQ ID NO: 966771 - protein, 9 aa, Homo Sapiens
GVGTSSSMR

SEQ ID NO: 966772 - protein, 9 aa, Homo Sapiens
SFHLCMVGL

SEQ ID NO: 966773 - protein, 9 aa, Homo Sapiens
LAKRNEEDE

SEQ ID NO: 966774 - protein, 9 aa, Homo Sapiens
LWDDFLSVL

SEQ ID NO: 966775 - protein, 9 aa, Homo Sapiens
PQPQSLAKK

SEQ ID NO: 966776 - protein, 9 aa, Homo Sapiens
SRDSPLFLY

SEQ ID NO: 966777 - protein, 9 aa, Homo Sapiens
GCLKLPSKK

SEQ ID NO: 966778 - protein, 9 aa, Homo Sapiens
PQIIFFFLA

SEQ ID NO: 966779 - protein, 9 aa, Homo Sapiens
NPAENKRRY

SEQ ID NO: 966780 - protein, 9 aa, Homo Sapiens
RAPREETEK

SEQ ID NO: 966781 - protein, 9 aa, Homo Sapiens
VEVETELFL

SEQ ID NO: 966782 - protein, 9 aa, Homo Sapiens
QIEQFLVKK

SEQ ID NO: 966783 - protein, 9 aa, Homo Sapiens
DVVIEFFLE

SEQ ID NO: 966784 - protein, 9 aa, Homo Sapiens
QMLWELWDI

SEQ ID NO: 966785 - protein, 9 aa, Homo Sapiens
GPSLEDFFN

SEQ ID NO: 966786 - protein, 9 aa, Homo Sapiens
LASVVVRRN

SEQ ID NO: 966787 - protein, 9 aa, Homo Sapiens
YYFIQEGSG

SEQ ID NO: 966788 - protein, 9 aa, Homo Sapiens
RRRKDDYAK

SEQ ID NO: 966789 - protein, 9 aa, Homo Sapiens
LLAVLDDGN

SEQ ID NO: 966790 - protein, 9 aa, Homo Sapiens
KECEDENSS

SEQ ID NO: 966791 - protein, 9 aa, Homo Sapiens
PSQLYVVVS

SEQ ID NO: 966792 - protein, 9 aa, Homo Sapiens
TVFYLNTLS

SEQ ID NO: 966793 - protein, 9 aa, Homo Sapiens
GPPGSNGRW

SEQ ID NO: 966794 - protein, 9 aa, Homo Sapiens
QVQKRHKMP

SEQ ID NO: 966795 - protein, 9 aa, Homo Sapiens
TLFLNELNK

SEQ ID NO: 966796 - protein, 9 aa, Homo Sapiens
MHQTLSAGL

SEQ ID NO: 966797 - protein, 9 aa, Homo Sapiens
AASSGSETS

SEQ ID NO: 966798 - protein, 9 aa, Homo Sapiens
REKFFGQGR

SEQ ID NO: 966799 - protein, 9 aa, Homo Sapiens
KNGVCRKEN

SEQ ID NO: 966800 - protein, 9 aa, Homo Sapiens
ILCNGSSRT

SEQ ID NO: 966801 - protein, 9 aa, Homo Sapiens
LWPLSVPAY

SEQ ID NO: 966802 - protein, 9 aa, Homo Sapiens
ILRPQGRKT

SEQ ID NO: 966803 - protein, 9 aa, Homo Sapiens
LAISPGGDR

SEQ ID NO: 966804 - protein, 9 aa, Homo Sapiens
LNAIFSALG

SEQ ID NO: 966805 - protein, 9 aa, Homo Sapiens
DMITLICLN

SEQ ID NO: 966806 - protein, 9 aa, Homo Sapiens
YSVGSNGLL

SEQ ID NO: 966807 - protein, 9 aa, Homo Sapiens
EEVLGHFSY

SEQ ID NO: 966808 - protein, 9 aa, Homo Sapiens
MLWELWDIL

SEQ ID NO: 966809 - protein, 9 aa, Homo Sapiens
VLLIGSLLG

SEQ ID NO: 966810 - protein, 9 aa, Homo Sapiens
LEAEKRKKS

SEQ ID NO: 966811 - protein, 9 aa, Homo Sapiens
QKAKQLCQE

SEQ ID NO: 966812 - protein, 9 aa, Homo Sapiens
RRLCRHVSS

SEQ ID NO: 966813 - protein, 9 aa, Homo Sapiens
CVSLLTLFH

SEQ ID NO: 966814 - protein, 9 aa, Homo Sapiens
FSTAFCLFN

SEQ ID NO: 966815 - protein, 9 aa, Homo Sapiens
ASRFLSPLW

SEQ ID NO: 966816 - protein, 9 aa, Homo Sapiens
RSGVSDDVF

SEQ ID NO: 966817 - protein, 9 aa, Homo Sapiens
PPPGLLPSG

SEQ ID NO: 966818 - protein, 9 aa, Homo Sapiens
YFLFDQQNC

SEQ ID NO: 966819 - protein, 9 aa, Homo Sapiens
AVIFSEAPE

SEQ ID NO: 966820 - protein, 9 aa, Homo Sapiens
VLFPSSGNR

SEQ ID NO: 966821 - protein, 9 aa, Homo Sapiens
ATLSAPAAG

SEQ ID NO: 966822 - protein, 9 aa, Homo Sapiens
RHLSNSLDP

SEQ ID NO: 966823 - protein, 9 aa, Homo Sapiens
GLTHQSLLY

SEQ ID NO: 966824 - protein, 9 aa, Homo Sapiens
HDCVSVLSE

SEQ ID NO: 966825 - protein, 9 aa, Homo Sapiens
TKNGKALQL

SEQ ID NO: 966826 - protein, 9 aa, Homo Sapiens
CISEVCFCD

SEQ ID NO: 966827 - protein, 9 aa, Homo Sapiens
SLVKGSLGH

SEQ ID NO: 966828 - protein, 9 aa, Homo Sapiens
DPDSLNICV

SEQ ID NO: 966829 - protein, 9 aa, Homo Sapiens
MPVREPNIP

SEQ ID NO: 966830 - protein, 9 aa, Homo Sapiens
QLYVVVSNH

SEQ ID NO: 966831 - protein, 9 aa, Homo Sapiens
EEVAPNPAN

SEQ ID NO: 966832 - protein, 9 aa, Homo Sapiens
LPSSLPPRV

SEQ ID NO: 966833 - protein, 9 aa, Homo Sapiens
FNGLKKHYY

SEQ ID NO: 966834 - protein, 9 aa, Homo Sapiens
DHLTIHIRT

SEQ ID NO: 966835 - protein, 9 aa, Homo Sapiens
AAALSVCRC

SEQ ID NO: 966836 - protein, 9 aa, Homo Sapiens
FFLFLFMYL

SEQ ID NO: 966837 - protein, 9 aa, Homo Sapiens
CLKLATRSL

SEQ ID NO: 966838 - protein, 9 aa, Homo Sapiens
RGLTVTSEQ

SEQ ID NO: 966839 - protein, 9 aa, Homo Sapiens
SYLVVKVGE

SEQ ID NO: 966840 - protein, 9 aa, Homo Sapiens
AATLSAPAA

SEQ ID NO: 966841 - protein, 9 aa, Homo Sapiens
QAQKDHYLG

SEQ ID NO: 966842 - protein, 9 aa, Homo Sapiens
APITCSMQE

SEQ ID NO: 966843 - protein, 9 aa, Homo Sapiens
YLTIFSASC

SEQ ID NO: 966844 - protein, 9 aa, Homo Sapiens
YCIKEGVKD

SEQ ID NO: 966845 - protein, 9 aa, Homo Sapiens
YLNALEHLI

SEQ ID NO: 966846 - protein, 9 aa, Homo Sapiens
VFYFASVSL

SEQ ID NO: 966847 - protein, 9 aa, Homo Sapiens
VGLQHDAGL

SEQ ID NO: 966848 - protein, 9 aa, Homo Sapiens
LFGLASATP

SEQ ID NO: 966849 - protein, 9 aa, Homo Sapiens
RTKLEDYAN

SEQ ID NO: 966850 - protein, 9 aa, Homo Sapiens
LSGGAPAAD

SEQ ID NO: 966851 - protein, 9 aa, Homo Sapiens
SFKDVRQRF

SEQ ID NO: 966852 - protein, 9 aa, Homo Sapiens
VERRKAEAA

SEQ ID NO: 966853 - protein, 9 aa, Homo Sapiens
LATRDAPPK

SEQ ID NO: 966854 - protein, 9 aa, Homo Sapiens
LFRTIFASS

SEQ ID NO: 966855 - protein, 9 aa, Homo Sapiens
LESLFLIAS

SEQ ID NO: 966856 - protein, 9 aa, Homo Sapiens
SRFLSPLWR

SEQ ID NO: 966857 - protein, 9 aa, Homo Sapiens
SETSTPLIP

SEQ ID NO: 966858 - protein, 9 aa, Homo Sapiens
KCHPPACEA

SEQ ID NO: 966859 - protein, 9 aa, Homo Sapiens
TISPAADSY

SEQ ID NO: 966860 - protein, 9 aa, Homo Sapiens
TMSKICGQE

SEQ ID NO: 966861 - protein, 9 aa, Homo Sapiens
GSGGFSGKR

SEQ ID NO: 966862 - protein, 9 aa, Homo Sapiens
QKSEQGPYE

SEQ ID NO: 966863 - protein, 9 aa, Homo Sapiens
LQIQVEEKE

SEQ ID NO: 966864 - protein, 9 aa, Homo Sapiens
LLAKVTRMG

SEQ ID NO: 966865 - protein, 9 aa, Homo Sapiens
RFAPLVKTK

SEQ ID NO: 966866 - protein, 9 aa, Homo Sapiens
TKPQRPVKE

SEQ ID NO: 966867 - protein, 9 aa, Homo Sapiens
WFLDMESTG

SEQ ID NO: 966868 - protein, 9 aa, Homo Sapiens
STELPVDCS

SEQ ID NO: 966869 - protein, 9 aa, Homo Sapiens
CLQSTLWPH

SEQ ID NO: 966870 - protein, 9 aa, Homo Sapiens
MAYQDHETS

SEQ ID NO: 966871 - protein, 9 aa, Homo Sapiens
GLPGLEGPK

SEQ ID NO: 966872 - protein, 9 aa, Homo Sapiens
LDCLKDELS

SEQ ID NO: 966873 - protein, 9 aa, Homo Sapiens
ALINKELYA

SEQ ID NO: 966874 - protein, 9 aa, Homo Sapiens
LYSRQLYGL

SEQ ID NO: 966875 - protein, 9 aa, Homo Sapiens
AFYAFPSEF

SEQ ID NO: 966876 - protein, 9 aa, Homo Sapiens
EAYQWRVSE

SEQ ID NO: 966877 - protein, 9 aa, Homo Sapiens
FYVHFLLPP

SEQ ID NO: 966878 - protein, 9 aa, Homo Sapiens
LKPPFPPIS

SEQ ID NO: 966879 - protein, 9 aa, Homo Sapiens
ATSFAQKIT

SEQ ID NO: 966880 - protein, 9 aa, Homo Sapiens
TDTKVENNT

SEQ ID NO: 966881 - protein, 9 aa, Homo Sapiens
FLDWPRMVE

SEQ ID NO: 966882 - protein, 9 aa, Homo Sapiens
SRYVLSEKS

SEQ ID NO: 966883 - protein, 9 aa, Homo Sapiens
IRKFLYCEA

SEQ ID NO: 966884 - protein, 9 aa, Homo Sapiens
RKRRVLLIG

SEQ ID NO: 966885 - protein, 9 aa, Homo Sapiens
EGLALPWDP

SEQ ID NO: 966886 - protein, 9 aa, Homo Sapiens
SSSSFSSCP

SEQ ID NO: 966887 - protein, 9 aa, Homo Sapiens
IYVDCVIKG

SEQ ID NO: 966888 - protein, 9 aa, Homo Sapiens
IRRFEELLL

SEQ ID NO: 966889 - protein, 9 aa, Homo Sapiens
ASAFRAAGI

SEQ ID NO: 966890 - protein, 9 aa, Homo Sapiens
VLLQLRDDA

SEQ ID NO: 966891 - protein, 9 aa, Homo Sapiens
QGVCQTGGC

SEQ ID NO: 966892 - protein, 9 aa, Homo Sapiens
TSIYSSGED

SEQ ID NO: 966893 - protein, 9 aa, Homo Sapiens
DHTSREFNY

SEQ ID NO: 966894 - protein, 9 aa, Homo Sapiens
CDSKSTSHH

SEQ ID NO: 966895 - protein, 9 aa, Homo Sapiens
APNFSALLP

SEQ ID NO: 966896 - protein, 9 aa, Homo Sapiens
AAAKSGTSG

SEQ ID NO: 966897 - protein, 9 aa, Homo Sapiens
SCDSKSTSH

SEQ ID NO: 966898 - protein, 9 aa, Homo Sapiens
QQRNPPQQP

SEQ ID NO: 966899 - protein, 9 aa, Homo Sapiens
VYPSNQTTA

SEQ ID NO: 966900 - protein, 9 aa, Homo Sapiens
SRMGWGGKR

SEQ ID NO: 966901 - protein, 9 aa, Homo Sapiens
DPAKLDRGE

SEQ ID NO: 966902 - protein, 9 aa, Homo Sapiens
VYSVGSNGL

SEQ ID NO: 966903 - protein, 9 aa, Homo Sapiens
SYEETLSTL

SEQ ID NO: 966904 - protein, 9 aa, Homo Sapiens
SLACTDTFM

SEQ ID NO: 966905 - protein, 9 aa, Homo Sapiens
RDEATGPSG

SEQ ID NO: 966906 - protein, 9 aa, Homo Sapiens
TNRDDYVNI

SEQ ID NO: 966907 - protein, 9 aa, Homo Sapiens
GRWTWTSPG

SEQ ID NO: 966908 - protein, 9 aa, Homo Sapiens
HQSLLYEAA

SEQ ID NO: 966909 - protein, 9 aa, Homo Sapiens
WKAYIWSSH

SEQ ID NO: 966910 - protein, 9 aa, Homo Sapiens
IHSEEKPYK

SEQ ID NO: 966911 - protein, 9 aa, Homo Sapiens
CLAEGPEPS

SEQ ID NO: 966912 - protein, 9 aa, Homo Sapiens
CRLLYYGGY

SEQ ID NO: 966913 - protein, 9 aa, Homo Sapiens
LLGMVWGHL

SEQ ID NO: 966914 - protein, 9 aa, Homo Sapiens
DISLLEDVP

SEQ ID NO: 966915 - protein, 9 aa, Homo Sapiens
DRLLSTWYF

SEQ ID NO: 966916 - protein, 9 aa, Homo Sapiens
IPEILPSSD

SEQ ID NO: 966917 - protein, 9 aa, Homo Sapiens
VFASLHMGL

SEQ ID NO: 966918 - protein, 9 aa, Homo Sapiens
ALPLFFLFL

SEQ ID NO: 966919 - protein, 9 aa, Homo Sapiens
PLPPPPLPT

SEQ ID NO: 966920 - protein, 9 aa, Homo Sapiens
AAFAAQGQL

SEQ ID NO: 966921 - protein, 9 aa, Homo Sapiens
ADIPASKRG

SEQ ID NO: 966922 - protein, 9 aa, Homo Sapiens
GATESTKEH

SEQ ID NO: 966923 - protein, 9 aa, Homo Sapiens
AISRLGKEC

SEQ ID NO: 966924 - protein, 9 aa, Homo Sapiens
PIAPNFSAL

SEQ ID NO: 966925 - protein, 9 aa, Homo Sapiens
VQADRDYSS

SEQ ID NO: 966926 - protein, 9 aa, Homo Sapiens
LQAAWDAFF

SEQ ID NO: 966927 - protein, 9 aa, Homo Sapiens
KSLIQEKDD

SEQ ID NO: 966928 - protein, 9 aa, Homo Sapiens
KVISWILLG

SEQ ID NO: 966929 - protein, 9 aa, Homo Sapiens
LRGSFPWQG

SEQ ID NO: 966930 - protein, 9 aa, Homo Sapiens
FILSLFLSD

SEQ ID NO: 966931 - protein, 9 aa, Homo Sapiens
EPSIDVILV

SEQ ID NO: 966932 - protein, 9 aa, Homo Sapiens
EAILVFTML

SEQ ID NO: 966933 - protein, 9 aa, Homo Sapiens
SFVLIAQQT

SEQ ID NO: 966934 - protein, 9 aa, Homo Sapiens
KRQAQAQLE

SEQ ID NO: 966935 - protein, 9 aa, Homo Sapiens
ISVLCDACA

SEQ ID NO: 966936 - protein, 9 aa, Homo Sapiens
QSQEVSEKV

SEQ ID NO: 966937 - protein, 9 aa, Homo Sapiens
DEEGWEESI

SEQ ID NO: 966938 - protein, 9 aa, Homo Sapiens
EVAKSDPSI

SEQ ID NO: 966939 - protein, 9 aa, Homo Sapiens
PSLCLLPTS

SEQ ID NO: 966940 - protein, 9 aa, Homo Sapiens
TMALPIKSK

SEQ ID NO: 966941 - protein, 9 aa, Homo Sapiens
TGETMNAAC

SEQ ID NO: 966942 - protein, 9 aa, Homo Sapiens
SYLDLLNHS

SEQ ID NO: 966943 - protein, 9 aa, Homo Sapiens
SLLTTALPF

SEQ ID NO: 966944 - protein, 9 aa, Homo Sapiens
ADLSALKAH

SEQ ID NO: 966945 - protein, 9 aa, Homo Sapiens
FENITQKVV

SEQ ID NO: 966946 - protein, 9 aa, Homo Sapiens
GCFGELKTR

SEQ ID NO: 966947 - protein, 9 aa, Homo Sapiens
LHMGLEGLA

SEQ ID NO: 966948 - protein, 9 aa, Homo Sapiens
GGENRGDGE

SEQ ID NO: 966949 - protein, 9 aa, Homo Sapiens
NKGQLPEGE

SEQ ID NO: 966950 - protein, 9 aa, Homo Sapiens
DNYFGCKFF

SEQ ID NO: 966951 - protein, 9 aa, Homo Sapiens
FSTAAHGSS

SEQ ID NO: 966952 - protein, 9 aa, Homo Sapiens
ISCTDLSIN

SEQ ID NO: 966953 - protein, 9 aa, Homo Sapiens
LLWHSSSEV

SEQ ID NO: 966954 - protein, 9 aa, Homo Sapiens
TFSYKNEVC

SEQ ID NO: 966955 - protein, 9 aa, Homo Sapiens
SFFKTAQDI

SEQ ID NO: 966956 - protein, 9 aa, Homo Sapiens
RRMSGTNVC

SEQ ID NO: 966957 - protein, 9 aa, Homo Sapiens
KTSQVPGKH

SEQ ID NO: 966958 - protein, 9 aa, Homo Sapiens
IPVIPETKE

SEQ ID NO: 966959 - protein, 9 aa, Homo Sapiens
TIAVGLVSQ

SEQ ID NO: 966960 - protein, 9 aa, Homo Sapiens
KLNLDVEKT

SEQ ID NO: 966961 - protein, 9 aa, Homo Sapiens
KACSNSSQQ

SEQ ID NO: 966962 - protein, 9 aa, Homo Sapiens
DRGRNNSSR

SEQ ID NO: 966963 - protein, 9 aa, Homo Sapiens
SLGRPTSPL

SEQ ID NO: 966964 - protein, 9 aa, Homo Sapiens
GFLRGPASS

SEQ ID NO: 966965 - protein, 9 aa, Homo Sapiens
DPGSSPAGS

SEQ ID NO: 966966 - protein, 9 aa, Homo Sapiens
DMALRQSSR

SEQ ID NO: 966967 - protein, 9 aa, Homo Sapiens
PTKFFENLS

SEQ ID NO: 966968 - protein, 9 aa, Homo Sapiens
WYVIKLGNT

SEQ ID NO: 966969 - protein, 9 aa, Homo Sapiens
KTLHTLCVG

SEQ ID NO: 966970 - protein, 9 aa, Homo Sapiens
QPTLAPGQN

SEQ ID NO: 966971 - protein, 9 aa, Homo Sapiens
KRETFRKSS

SEQ ID NO: 966972 - protein, 9 aa, Homo Sapiens
SGSRRNAYQ

SEQ ID NO: 966973 - protein, 9 aa, Homo Sapiens
IFSALWVLL

SEQ ID NO: 966974 - protein, 9 aa, Homo Sapiens
GSLQARKSS

SEQ ID NO: 966975 - protein, 9 aa, Homo Sapiens
GIQKVVKCL

SEQ ID NO: 966976 - protein, 9 aa, Homo Sapiens
PSSGPGQAL

SEQ ID NO: 966977 - protein, 9 aa, Homo Sapiens
RPSVLFRLT

SEQ ID NO: 966978 - protein, 9 aa, Homo Sapiens
ILPPPPLPG

SEQ ID NO: 966979 - protein, 9 aa, Homo Sapiens
TQEVGGQDH

SEQ ID NO: 966980 - protein, 9 aa, Homo Sapiens
WRIDKVISW

SEQ ID NO: 966981 - protein, 9 aa, Homo Sapiens
GAHGALLLA

SEQ ID NO: 966982 - protein, 9 aa, Homo Sapiens
DLPTRARLL

SEQ ID NO: 966983 - protein, 9 aa, Homo Sapiens
TGPEASRNG

SEQ ID NO: 966984 - protein, 9 aa, Homo Sapiens
SPVRKNLFC

SEQ ID NO: 966985 - protein, 9 aa, Homo Sapiens
KWRIDKVIS

SEQ ID NO: 966986 - protein, 9 aa, Homo Sapiens
IKGEDRVPA

SEQ ID NO: 966987 - protein, 9 aa, Homo Sapiens
SVPQVPAER

SEQ ID NO: 966988 - protein, 9 aa, Homo Sapiens
AGTRAPPSL

SEQ ID NO: 966989 - protein, 9 aa, Homo Sapiens
APLRKTKST

SEQ ID NO: 966990 - protein, 9 aa, Homo Sapiens
LSIWEKLGK

SEQ ID NO: 966991 - protein, 9 aa, Homo Sapiens
CHLNKNIEK

SEQ ID NO: 966992 - protein, 9 aa, Homo Sapiens
QQPRRKHSR

SEQ ID NO: 966993 - protein, 9 aa, Homo Sapiens
LLPTSHTAC

SEQ ID NO: 966994 - protein, 9 aa, Homo Sapiens
FFISTVATI

SEQ ID NO: 966995 - protein, 9 aa, Homo Sapiens
LKLATRSLR

SEQ ID NO: 966996 - protein, 9 aa, Homo Sapiens
AACNYPLEL

SEQ ID NO: 966997 - protein, 9 aa, Homo Sapiens
NPYNNRKSK

SEQ ID NO: 966998 - protein, 9 aa, Homo Sapiens
THVRKLTLA

SEQ ID NO: 966999 - protein, 9 aa, Homo Sapiens
PLEEKHNQC

SEQ ID NO: 967000 - protein, 9 aa, Homo Sapiens
RIFTPVVFY

SEQ ID NO: 967001 - protein, 9 aa, Homo Sapiens
HHLDSSSAV

SEQ ID NO: 967002 - protein, 9 aa, Homo Sapiens
LRCPLYSSF

SEQ ID NO: 967003 - protein, 9 aa, Homo Sapiens
RWEHMGQET

SEQ ID NO: 967004 - protein, 9 aa, Homo Sapiens
SCPEGFVFK

SEQ ID NO: 967005 - protein, 9 aa, Homo Sapiens
CSLKNHGLL

SEQ ID NO: 967006 - protein, 9 aa, Homo Sapiens
LQKPWLLNA

SEQ ID NO: 967007 - protein, 9 aa, Homo Sapiens
AARDSSIVP

SEQ ID NO: 967008 - protein, 9 aa, Homo Sapiens
RNLLSHPPP

SEQ ID NO: 967009 - protein, 9 aa, Homo Sapiens
NKGADATGS

SEQ ID NO: 967010 - protein, 9 aa, Homo Sapiens
PVIPETKED

SEQ ID NO: 967011 - protein, 9 aa, Homo Sapiens
GRLRLYCKE

SEQ ID NO: 967012 - protein, 9 aa, Homo Sapiens
EDLLRTPSQ

SEQ ID NO: 967013 - protein, 9 aa, Homo Sapiens
AKGQKITPA

SEQ ID NO: 967014 - protein, 9 aa, Homo Sapiens
PADEAFIQA

SEQ ID NO: 967015 - protein, 9 aa, Homo Sapiens
VALPGDEHA

SEQ ID NO: 967016 - protein, 9 aa, Homo Sapiens
KGEDILLML

SEQ ID NO: 967017 - protein, 9 aa, Homo Sapiens
TRAFMKILE

SEQ ID NO: 967018 - protein, 9 aa, Homo Sapiens
RGDMVTKDA

SEQ ID NO: 967019 - protein, 9 aa, Homo Sapiens
NIRPDGSGA

SEQ ID NO: 967020 - protein, 9 aa, Homo Sapiens
ALWVLLLFV

SEQ ID NO: 967021 - protein, 9 aa, Homo Sapiens
FNPCINLMK

SEQ ID NO: 967022 - protein, 9 aa, Homo Sapiens
CNLDIFYFL

SEQ ID NO: 967023 - protein, 9 aa, Homo Sapiens
QSEDPQNQR

SEQ ID NO: 967024 - protein, 9 aa, Homo Sapiens
GKKREEDGY

SEQ ID NO: 967025 - protein, 9 aa, Homo Sapiens
VLILLWGHS

SEQ ID NO: 967026 - protein, 9 aa, Homo Sapiens
VEEEMKKHR

SEQ ID NO: 967027 - protein, 9 aa, Homo Sapiens
LVEPDGVPV

SEQ ID NO: 967028 - protein, 9 aa, Homo Sapiens
QGYRIEQPR

SEQ ID NO: 967029 - protein, 9 aa, Homo Sapiens
NKCKESENS

SEQ ID NO: 967030 - protein, 9 aa, Homo Sapiens
SGVLPSQLT

SEQ ID NO: 967031 - protein, 9 aa, Homo Sapiens
NLFGLASAT

SEQ ID NO: 967032 - protein, 9 aa, Homo Sapiens
LLNQKIRNL

SEQ ID NO: 967033 - protein, 9 aa, Homo Sapiens
DDMISRYVL

SEQ ID NO: 967034 - protein, 9 aa, Homo Sapiens
KEAYSSFAA

SEQ ID NO: 967035 - protein, 9 aa, Homo Sapiens
IKAINQGSY

SEQ ID NO: 967036 - protein, 9 aa, Homo Sapiens
RDNEQDRSK

SEQ ID NO: 967037 - protein, 9 aa, Homo Sapiens
LATSIGKSW

SEQ ID NO: 967038 - protein, 9 aa, Homo Sapiens
HSPTMQQRF

SEQ ID NO: 967039 - protein, 9 aa, Homo Sapiens
NVCSVYSLD

SEQ ID NO: 967040 - protein, 9 aa, Homo Sapiens
CYDYKRRVN

SEQ ID NO: 967041 - protein, 9 aa, Homo Sapiens
IFSYSQIAS

SEQ ID NO: 967042 - protein, 9 aa, Homo Sapiens
DDFLSVLSS

SEQ ID NO: 967043 - protein, 9 aa, Homo Sapiens
RQRAIVAVT

SEQ ID NO: 967044 - protein, 9 aa, Homo Sapiens
EALSQYKIN

SEQ ID NO: 967045 - protein, 9 aa, Homo Sapiens
LLTYHRVVF

SEQ ID NO: 967046 - protein, 9 aa, Homo Sapiens
SPKKPALCA

SEQ ID NO: 967047 - protein, 9 aa, Homo Sapiens
TLCSAKISI

SEQ ID NO: 967048 - protein, 9 aa, Homo Sapiens
EKARQGLAE

SEQ ID NO: 967049 - protein, 9 aa, Homo Sapiens
MSTTPGTPV

SEQ ID NO: 967050 - protein, 9 aa, Homo Sapiens
KEEQEVDVE

SEQ ID NO: 967051 - protein, 9 aa, Homo Sapiens
GDEDIFKKL

SEQ ID NO: 967052 - protein, 9 aa, Homo Sapiens
DFSSESSFE

SEQ ID NO: 967053 - protein, 9 aa, Homo Sapiens
SIAYQTKFP

SEQ ID NO: 967054 - protein, 9 aa, Homo Sapiens
CSGCLKLPS

SEQ ID NO: 967055 - protein, 9 aa, Homo Sapiens
PESSLQREG

SEQ ID NO: 967056 - protein, 9 aa, Homo Sapiens
KQKKVKLFC

SEQ ID NO: 967057 - protein, 9 aa, Homo Sapiens
LIWHQKVHT

SEQ ID NO: 967058 - protein, 9 aa, Homo Sapiens
SSSRMLPPC

SEQ ID NO: 967059 - protein, 9 aa, Homo Sapiens
APEGIQKVV

SEQ ID NO: 967060 - protein, 9 aa, Homo Sapiens
SVFFISTVA

SEQ ID NO: 967061 - protein, 9 aa, Homo Sapiens
LELKADYKR

SEQ ID NO: 967062 - protein, 9 aa, Homo Sapiens
VSPDQGPTK

SEQ ID NO: 967063 - protein, 9 aa, Homo Sapiens
GGPPGMTGC

SEQ ID NO: 967064 - protein, 9 aa, Homo Sapiens
KGDADVSMP

SEQ ID NO: 967065 - protein, 9 aa, Homo Sapiens
VLSIPNSNM

SEQ ID NO: 967066 - protein, 9 aa, Homo Sapiens
ILSFLKLSS

SEQ ID NO: 967067 - protein, 9 aa, Homo Sapiens
LFRFSFVIR

SEQ ID NO: 967068 - protein, 9 aa, Homo Sapiens
TVQMKNTYQ

SEQ ID NO: 967069 - protein, 9 aa, Homo Sapiens
INITSIAPL

SEQ ID NO: 967070 - protein, 9 aa, Homo Sapiens
AAEPKVEAA

SEQ ID NO: 967071 - protein, 9 aa, Homo Sapiens
ERYVPRAFY

SEQ ID NO: 967072 - protein, 9 aa, Homo Sapiens
STWYFSKPP

SEQ ID NO: 967073 - protein, 9 aa, Homo Sapiens
ESSERTRVR

SEQ ID NO: 967074 - protein, 9 aa, Homo Sapiens
SLNICVFIL

SEQ ID NO: 967075 - protein, 9 aa, Homo Sapiens
FLGEASKLQ

SEQ ID NO: 967076 - protein, 9 aa, Homo Sapiens
LSPASSSSS

SEQ ID NO: 967077 - protein, 9 aa, Homo Sapiens
VCMLGDIQL

SEQ ID NO: 967078 - protein, 9 aa, Homo Sapiens
SEVQSKKKE

SEQ ID NO: 967079 - protein, 9 aa, Homo Sapiens
ELDCLKDEL

SEQ ID NO: 967080 - protein, 9 aa, Homo Sapiens
LERLHAAKC

SEQ ID NO: 967081 - protein, 9 aa, Homo Sapiens
WDMETEEAE

SEQ ID NO: 967082 - protein, 9 aa, Homo Sapiens
PYQNILCNG

SEQ ID NO: 967083 - protein, 9 aa, Homo Sapiens
FMDVTPRES

SEQ ID NO: 967084 - protein, 9 aa, Homo Sapiens
KFAACNYPL

SEQ ID NO: 967085 - protein, 9 aa, Homo Sapiens
SRCIVNNLA

SEQ ID NO: 967086 - protein, 9 aa, Homo Sapiens
VLTTERKKK

SEQ ID NO: 967087 - protein, 9 aa, Homo Sapiens
KNQRRNLRS

SEQ ID NO: 967088 - protein, 9 aa, Homo Sapiens
GLDLAALKV

SEQ ID NO: 967089 - protein, 9 aa, Homo Sapiens
FNFSNFLDK

SEQ ID NO: 967090 - protein, 9 aa, Homo Sapiens
FSSCPPCSP

SEQ ID NO: 967091 - protein, 9 aa, Homo Sapiens
NGEKLPCRA

SEQ ID NO: 967092 - protein, 9 aa, Homo Sapiens
VKDLPTRAR

SEQ ID NO: 967093 - protein, 9 aa, Homo Sapiens
KRRQGKIFP

SEQ ID NO: 967094 - protein, 9 aa, Homo Sapiens
KENPAYPAI

SEQ ID NO: 967095 - protein, 9 aa, Homo Sapiens
DMKVLCPTI

SEQ ID NO: 967096 - protein, 9 aa, Homo Sapiens
NQDSGDGAV

SEQ ID NO: 967097 - protein, 9 aa, Homo Sapiens
FHYSEGLFQ

SEQ ID NO: 967098 - protein, 9 aa, Homo Sapiens
FSKPPLDLA

SEQ ID NO: 967099 - protein, 9 aa, Homo Sapiens
QSLAKKESF

SEQ ID NO: 967100 - protein, 9 aa, Homo Sapiens
VPRAFYFQC

SEQ ID NO: 967101 - protein, 9 aa, Homo Sapiens
SNSTVVTPK

SEQ ID NO: 967102 - protein, 9 aa, Homo Sapiens
HSFFMELLK

SEQ ID NO: 967103 - protein, 9 aa, Homo Sapiens
QFEEKHAKE

SEQ ID NO: 967104 - protein, 9 aa, Homo Sapiens
DRLRFERVL

SEQ ID NO: 967105 - protein, 9 aa, Homo Sapiens
RDVVIEFFL

SEQ ID NO: 967106 - protein, 9 aa, Homo Sapiens
TFSGCSWLP

SEQ ID NO: 967107 - protein, 9 aa, Homo Sapiens
YGVLRFLLE

SEQ ID NO: 967108 - protein, 9 aa, Homo Sapiens
TFGAYDWEF

SEQ ID NO: 967109 - protein, 9 aa, Homo Sapiens
TSEAAKKDG

SEQ ID NO: 967110 - protein, 9 aa, Homo Sapiens
NNDKASESE

SEQ ID NO: 967111 - protein, 9 aa, Homo Sapiens
GLASNSTFF

SEQ ID NO: 967112 - protein, 9 aa, Homo Sapiens
GTSAYLAPE

SEQ ID NO: 967113 - protein, 9 aa, Homo Sapiens
TAPETRNSP

SEQ ID NO: 967114 - protein, 9 aa, Homo Sapiens
ATLSVSVSK

SEQ ID NO: 967115 - protein, 9 aa, Homo Sapiens
EKEEEEASG

SEQ ID NO: 967116 - protein, 9 aa, Homo Sapiens
PLDFFHIFH

SEQ ID NO: 967117 - protein, 9 aa, Homo Sapiens
QPGSQAESS

SEQ ID NO: 967118 - protein, 9 aa, Homo Sapiens
VWTLSPLFS

SEQ ID NO: 967119 - protein, 9 aa, Homo Sapiens
WDPPEYPNE

SEQ ID NO: 967120 - protein, 9 aa, Homo Sapiens
KTAAPAPRR

SEQ ID NO: 967121 - protein, 9 aa, Homo Sapiens
LGLELCSLK

SEQ ID NO: 967122 - protein, 9 aa, Homo Sapiens
RLLYYGGYG

SEQ ID NO: 967123 - protein, 9 aa, Homo Sapiens
SLQDVYLSN

SEQ ID NO: 967124 - protein, 9 aa, Homo Sapiens
HVERRKAEA

SEQ ID NO: 967125 - protein, 9 aa, Homo Sapiens
DLDSGTNSK

SEQ ID NO: 967126 - protein, 9 aa, Homo Sapiens
QNSHLIWHQ

SEQ ID NO: 967127 - protein, 9 aa, Homo Sapiens
EDNYANICF

SEQ ID NO: 967128 - protein, 9 aa, Homo Sapiens
TLKNREAFL

SEQ ID NO: 967129 - protein, 9 aa, Homo Sapiens
NPFFLRQAL

SEQ ID NO: 967130 - protein, 9 aa, Homo Sapiens
HSTEEEVNH

SEQ ID NO: 967131 - protein, 9 aa, Homo Sapiens
MISRYVLSE

SEQ ID NO: 967132 - protein, 9 aa, Homo Sapiens
LGSPPGKKE

SEQ ID NO: 967133 - protein, 9 aa, Homo Sapiens
QFVVWPRDQ

SEQ ID NO: 967134 - protein, 9 aa, Homo Sapiens
PKPTNQGQD

SEQ ID NO: 967135 - protein, 9 aa, Homo Sapiens
KSSTHNLRL

SEQ ID NO: 967136 - protein, 9 aa, Homo Sapiens
EAPAGQPGA

SEQ ID NO: 967137 - protein, 9 aa, Homo Sapiens
LLPVPSLPS

SEQ ID NO: 967138 - protein, 9 aa, Homo Sapiens
SIDVILVGS

SEQ ID NO: 967139 - protein, 9 aa, Homo Sapiens
RKKDGEFSV

SEQ ID NO: 967140 - protein, 9 aa, Homo Sapiens
VLILQHLLR

SEQ ID NO: 967141 - protein, 9 aa, Homo Sapiens
SLLYEAAKV

SEQ ID NO: 967142 - protein, 9 aa, Homo Sapiens
SSLKIISAV

SEQ ID NO: 967143 - protein, 9 aa, Homo Sapiens
HLIACRDTK

SEQ ID NO: 967144 - protein, 9 aa, Homo Sapiens
SVLGLLVCF

SEQ ID NO: 967145 - protein, 9 aa, Homo Sapiens
TPILPLGVS

SEQ ID NO: 967146 - protein, 9 aa, Homo Sapiens
SQIYNLNSH

SEQ ID NO: 967147 - protein, 9 aa, Homo Sapiens
LLQVCWLVM

SEQ ID NO: 967148 - protein, 9 aa, Homo Sapiens
NEARRDLEK

SEQ ID NO: 967149 - protein, 9 aa, Homo Sapiens
EKSRCIVNN

SEQ ID NO: 967150 - protein, 9 aa, Homo Sapiens
SINHLCFYF

SEQ ID NO: 967151 - protein, 9 aa, Homo Sapiens
MELSWKRRS

SEQ ID NO: 967152 - protein, 9 aa, Homo Sapiens
NSKLSYTFS

SEQ ID NO: 967153 - protein, 9 aa, Homo Sapiens
GNPGKTSSV

SEQ ID NO: 967154 - protein, 9 aa, Homo Sapiens
TGLALISVN

SEQ ID NO: 967155 - protein, 9 aa, Homo Sapiens
VDEEFQSSF

SEQ ID NO: 967156 - protein, 9 aa, Homo Sapiens
LLVTALLPS

SEQ ID NO: 967157 - protein, 9 aa, Homo Sapiens
GLEGPKGEP

SEQ ID NO: 967158 - protein, 9 aa, Homo Sapiens
FHVVTDFID

SEQ ID NO: 967159 - protein, 9 aa, Homo Sapiens
IVRCFNLID

SEQ ID NO: 967160 - protein, 9 aa, Homo Sapiens
RECVDKCNF

SEQ ID NO: 967161 - protein, 9 aa, Homo Sapiens
LLNSEDMSE

SEQ ID NO: 967162 - protein, 9 aa, Homo Sapiens
LRQEHYLSS

SEQ ID NO: 967163 - protein, 9 aa, Homo Sapiens
QGITARELY

SEQ ID NO: 967164 - protein, 9 aa, Homo Sapiens
AGRAYLLGD

SEQ ID NO: 967165 - protein, 9 aa, Homo Sapiens
WVIQVQKRH

SEQ ID NO: 967166 - protein, 9 aa, Homo Sapiens
LCYDYKRRV

SEQ ID NO: 967167 - protein, 9 aa, Homo Sapiens
AKISISFPC

SEQ ID NO: 967168 - protein, 9 aa, Homo Sapiens
EHQHQIHNV

SEQ ID NO: 967169 - protein, 9 aa, Homo Sapiens
RTSVSSFSE

SEQ ID NO: 967170 - protein, 9 aa, Homo Sapiens
ANQSEDPQN

SEQ ID NO: 967171 - protein, 9 aa, Homo Sapiens
FSLQIMGPL

SEQ ID NO: 967172 - protein, 9 aa, Homo Sapiens
VIFKLACQA

SEQ ID NO: 967173 - protein, 9 aa, Homo Sapiens
CRNVGIREK

SEQ ID NO: 967174 - protein, 9 aa, Homo Sapiens
PAAAKSGTS

SEQ ID NO: 967175 - protein, 9 aa, Homo Sapiens
PGSNGRWTW

SEQ ID NO: 967176 - protein, 9 aa, Homo Sapiens
STEEEVNHY

SEQ ID NO: 967177 - protein, 9 aa, Homo Sapiens
KFLRKKDGE

SEQ ID NO: 967178 - protein, 9 aa, Homo Sapiens
GPQDPAGRD

SEQ ID NO: 967179 - protein, 9 aa, Homo Sapiens
FFQPFPSGE

SEQ ID NO: 967180 - protein, 9 aa, Homo Sapiens
EMELSWKRR

SEQ ID NO: 967181 - protein, 9 aa, Homo Sapiens
LRELDLSGP

SEQ ID NO: 967182 - protein, 9 aa, Homo Sapiens
CLAGRAYLL

SEQ ID NO: 967183 - protein, 9 aa, Homo Sapiens
CLDEDGNTA

SEQ ID NO: 967184 - protein, 9 aa, Homo Sapiens
KNPSMILIE

SEQ ID NO: 967185 - protein, 9 aa, Homo Sapiens
TVIIVGGAL

SEQ ID NO: 967186 - protein, 9 aa, Homo Sapiens
RPSAAFLML

SEQ ID NO: 967187 - protein, 9 aa, Homo Sapiens
KCWKAYIWS

SEQ ID NO: 967188 - protein, 9 aa, Homo Sapiens
ATSIGKSWI

SEQ ID NO: 967189 - protein, 9 aa, Homo Sapiens
AESSERTRV

SEQ ID NO: 967190 - protein, 9 aa, Homo Sapiens
PVPQRLHST

SEQ ID NO: 967191 - protein, 9 aa, Homo Sapiens
ETMTRAEST

SEQ ID NO: 967192 - protein, 9 aa, Homo Sapiens
KFPSYPEAM

SEQ ID NO: 967193 - protein, 9 aa, Homo Sapiens
GTLAALTLQ

SEQ ID NO: 967194 - protein, 9 aa, Homo Sapiens
INFSNLKQD

SEQ ID NO: 967195 - protein, 9 aa, Homo Sapiens
DCISEVCFC

SEQ ID NO: 967196 - protein, 9 aa, Homo Sapiens
SRFWTFETG

SEQ ID NO: 967197 - protein, 9 aa, Homo Sapiens
VASTCQEPS

SEQ ID NO: 967198 - protein, 9 aa, Homo Sapiens
TDCLDEDGN

SEQ ID NO: 967199 - protein, 9 aa, Homo Sapiens
PTGVVLVSR

SEQ ID NO: 967200 - protein, 9 aa, Homo Sapiens
SHSQDTLFL

SEQ ID NO: 967201 - protein, 9 aa, Homo Sapiens
LVTHKSWLW

SEQ ID NO: 967202 - protein, 9 aa, Homo Sapiens
FSPLSEDIK

SEQ ID NO: 967203 - protein, 9 aa, Homo Sapiens
VRPSTQPPA

SEQ ID NO: 967204 - protein, 9 aa, Homo Sapiens
NSWNFVLYL

SEQ ID NO: 967205 - protein, 9 aa, Homo Sapiens
DGPQYFFPQ

SEQ ID NO: 967206 - protein, 9 aa, Homo Sapiens
NRFRFKIID

SEQ ID NO: 967207 - protein, 9 aa, Homo Sapiens
PSFLNFFST

SEQ ID NO: 967208 - protein, 9 aa, Homo Sapiens
FTVGSNFSL

SEQ ID NO: 967209 - protein, 9 aa, Homo Sapiens
DLYADDPVR

SEQ ID NO: 967210 - protein, 9 aa, Homo Sapiens
YNAVKKREF

SEQ ID NO: 967211 - protein, 9 aa, Homo Sapiens
KAFSDSSLL

SEQ ID NO: 967212 - protein, 9 aa, Homo Sapiens
PELDIFPGA

SEQ ID NO: 967213 - protein, 9 aa, Homo Sapiens
HLKEKPFMF

SEQ ID NO: 967214 - protein, 9 aa, Homo Sapiens
TIKEPLDKE

SEQ ID NO: 967215 - protein, 9 aa, Homo Sapiens
ALQIYCIKE

SEQ ID NO: 967216 - protein, 9 aa, Homo Sapiens
MSGQGKQGG

SEQ ID NO: 967217 - protein, 9 aa, Homo Sapiens
VFSQTPQQP

SEQ ID NO: 967218 - protein, 9 aa, Homo Sapiens
VSEKVTVSS

SEQ ID NO: 967219 - protein, 9 aa, Homo Sapiens
CSFHLCMVG

SEQ ID NO: 967220 - protein, 9 aa, Homo Sapiens
ELILNFIRS

SEQ ID NO: 967221 - protein, 9 aa, Homo Sapiens
GGLCSSNTS

SEQ ID NO: 967222 - protein, 9 aa, Homo Sapiens
NSVKTVRST

SEQ ID NO: 967223 - protein, 9 aa, Homo Sapiens
PPPPGLLPS

SEQ ID NO: 967224 - protein, 9 aa, Homo Sapiens
MGLPFPQDP

SEQ ID NO: 967225 - protein, 9 aa, Homo Sapiens
VGNEPKWCI

SEQ ID NO: 967226 - protein, 9 aa, Homo Sapiens
LVALLLWPL

SEQ ID NO: 967227 - protein, 9 aa, Homo Sapiens
SYSFIVVSR

SEQ ID NO: 967228 - protein, 9 aa, Homo Sapiens
YSVRLSFSD

SEQ ID NO: 967229 - protein, 9 aa, Homo Sapiens
QPLNLTLRA

SEQ ID NO: 967230 - protein, 9 aa, Homo Sapiens
HGVQRDEEG

SEQ ID NO: 967231 - protein, 9 aa, Homo Sapiens
VLEIPGNAI

SEQ ID NO: 967232 - protein, 9 aa, Homo Sapiens
LQKWVEKAD

SEQ ID NO: 967233 - protein, 9 aa, Homo Sapiens
TGVWESHIV

SEQ ID NO: 967234 - protein, 9 aa, Homo Sapiens
QQLSEVSNK

SEQ ID NO: 967235 - protein, 9 aa, Homo Sapiens
SVDEIPPYR

SEQ ID NO: 967236 - protein, 9 aa, Homo Sapiens
IPVPQRLHS

SEQ ID NO: 967237 - protein, 9 aa, Homo Sapiens
SSLSKDGRS

SEQ ID NO: 967238 - protein, 9 aa, Homo Sapiens
DVSSSPFLP

SEQ ID NO: 967239 - protein, 9 aa, Homo Sapiens
LLEGSSSED

SEQ ID NO: 967240 - protein, 9 aa, Homo Sapiens
KALFWTVAM

SEQ ID NO: 967241 - protein, 9 aa, Homo Sapiens
DSSAVEMRP

SEQ ID NO: 967242 - protein, 9 aa, Homo Sapiens
FSMVLYGQI

SEQ ID NO: 967243 - protein, 9 aa, Homo Sapiens
QPDRLAVLG

SEQ ID NO: 967244 - protein, 9 aa, Homo Sapiens
FPPISFFLA

SEQ ID NO: 967245 - protein, 9 aa, Homo Sapiens
SIDSVTSLQ

SEQ ID NO: 967246 - protein, 9 aa, Homo Sapiens
SVPFVSKRV

SEQ ID NO: 967247 - protein, 9 aa, Homo Sapiens
SSSFSSCPP

SEQ ID NO: 967248 - protein, 9 aa, Homo Sapiens
LISVNKFLS

SEQ ID NO: 967249 - protein, 9 aa, Homo Sapiens
VRLRSAGQG

SEQ ID NO: 967250 - protein, 9 aa, Homo Sapiens
TGVLAQQRA

SEQ ID NO: 967251 - protein, 9 aa, Homo Sapiens
LTWLLSSLK

SEQ ID NO: 967252 - protein, 9 aa, Homo Sapiens
EYLIHRFLL

SEQ ID NO: 967253 - protein, 9 aa, Homo Sapiens
FNEHSSRRI

SEQ ID NO: 967254 - protein, 9 aa, Homo Sapiens
GNHLFGSER

SEQ ID NO: 967255 - protein, 9 aa, Homo Sapiens
GLPGPDECE

SEQ ID NO: 967256 - protein, 9 aa, Homo Sapiens
RPCFVEEWS

SEQ ID NO: 967257 - protein, 9 aa, Homo Sapiens
PCPPCSPEV

SEQ ID NO: 967258 - protein, 9 aa, Homo Sapiens
ELIFLEKSP

SEQ ID NO: 967259 - protein, 9 aa, Homo Sapiens
LRRMSGTNV

SEQ ID NO: 967260 - protein, 9 aa, Homo Sapiens
ALEHLIEVG

SEQ ID NO: 967261 - protein, 9 aa, Homo Sapiens
LLNLAPYPL

SEQ ID NO: 967262 - protein, 9 aa, Homo Sapiens
RVVYLIRAP

SEQ ID NO: 967263 - protein, 9 aa, Homo Sapiens
DCSGPDLSW

SEQ ID NO: 967264 - protein, 9 aa, Homo Sapiens
LMPVREPNI

SEQ ID NO: 967265 - protein, 9 aa, Homo Sapiens
QDDTTERQQ

SEQ ID NO: 967266 - protein, 9 aa, Homo Sapiens
SPNTSVFFI

SEQ ID NO: 967267 - protein, 9 aa, Homo Sapiens
GAHVGGIVG

SEQ ID NO: 967268 - protein, 9 aa, Homo Sapiens
RVDDTSSSE

SEQ ID NO: 967269 - protein, 9 aa, Homo Sapiens
SQSSGNSST

SEQ ID NO: 967270 - protein, 9 aa, Homo Sapiens
IVFVMDASI

SEQ ID NO: 967271 - protein, 9 aa, Homo Sapiens
TNFLCSMTA

SEQ ID NO: 967272 - protein, 9 aa, Homo Sapiens
TILRPQGRK

SEQ ID NO: 967273 - protein, 9 aa, Homo Sapiens
AILISDDEE

SEQ ID NO: 967274 - protein, 9 aa, Homo Sapiens
FHAMFQPFF

SEQ ID NO: 967275 - protein, 9 aa, Homo Sapiens
SGDATKTED

SEQ ID NO: 967276 - protein, 9 aa, Homo Sapiens
SEEIDFILS

SEQ ID NO: 967277 - protein, 9 aa, Homo Sapiens
KAFESPQPK

SEQ ID NO: 967278 - protein, 9 aa, Homo Sapiens
RWVLPALSY

SEQ ID NO: 967279 - protein, 9 aa, Homo Sapiens
ADRLEESFK

SEQ ID NO: 967280 - protein, 9 aa, Homo Sapiens
FSIATQRTA

SEQ ID NO: 967281 - protein, 9 aa, Homo Sapiens
SQAVRPQES

SEQ ID NO: 967282 - protein, 9 aa, Homo Sapiens
GKSATENSI

SEQ ID NO: 967283 - protein, 9 aa, Homo Sapiens
HTDSNTSLP

SEQ ID NO: 967284 - protein, 9 aa, Homo Sapiens
LASYLDLLN

SEQ ID NO: 967285 - protein, 9 aa, Homo Sapiens
SDKFHHLHP

SEQ ID NO: 967286 - protein, 9 aa, Homo Sapiens
QQGKADLST

SEQ ID NO: 967287 - protein, 9 aa, Homo Sapiens
GPTGIEEFP

SEQ ID NO: 967288 - protein, 9 aa, Homo Sapiens
EKPKPTNQG

SEQ ID NO: 967289 - protein, 9 aa, Homo Sapiens
YQVMDEFFY

SEQ ID NO: 967290 - protein, 9 aa, Homo Sapiens
VFFACEEYA

SEQ ID NO: 967291 - protein, 9 aa, Homo Sapiens
CLAFVLEIP

SEQ ID NO: 967292 - protein, 9 aa, Homo Sapiens
GVSSVKEKY

SEQ ID NO: 967293 - protein, 9 aa, Homo Sapiens
TVLPLTMPC

SEQ ID NO: 967294 - protein, 9 aa, Homo Sapiens
CKNSFLIIH

SEQ ID NO: 967295 - protein, 9 aa, Homo Sapiens
NLKCTDCLD

SEQ ID NO: 967296 - protein, 9 aa, Homo Sapiens
IHCICRKPD

SEQ ID NO: 967297 - protein, 9 aa, Homo Sapiens
ILHHEQKAK

SEQ ID NO: 967298 - protein, 9 aa, Homo Sapiens
TVPNVSNQT

SEQ ID NO: 967299 - protein, 9 aa, Homo Sapiens
FSSESSFEY

SEQ ID NO: 967300 - protein, 9 aa, Homo Sapiens
DSWFLEMDL

SEQ ID NO: 967301 - protein, 9 aa, Homo Sapiens
VVLVSREPG

SEQ ID NO: 967302 - protein, 9 aa, Homo Sapiens
PGTPLKLAV

SEQ ID NO: 967303 - protein, 9 aa, Homo Sapiens
RFLLHMKPP

SEQ ID NO: 967304 - protein, 9 aa, Homo Sapiens
LNLAPYPLV

SEQ ID NO: 967305 - protein, 9 aa, Homo Sapiens
KMTSNKISK

SEQ ID NO: 967306 - protein, 9 aa, Homo Sapiens
AREVISRSQ

SEQ ID NO: 967307 - protein, 9 aa, Homo Sapiens
GEKTANEKT

SEQ ID NO: 967308 - protein, 9 aa, Homo Sapiens
GMGLPFPQD

SEQ ID NO: 967309 - protein, 9 aa, Homo Sapiens
EMKEGVKES

SEQ ID NO: 967310 - protein, 9 aa, Homo Sapiens
KFSILNERG

SEQ ID NO: 967311 - protein, 9 aa, Homo Sapiens
HSCPEGFVF

SEQ ID NO: 967312 - protein, 9 aa, Homo Sapiens
ASPSGPSTS

SEQ ID NO: 967313 - protein, 9 aa, Homo Sapiens
STCSFHLCM

SEQ ID NO: 967314 - protein, 9 aa, Homo Sapiens
LQGLVLVTD

SEQ ID NO: 967315 - protein, 9 aa, Homo Sapiens
VTTNLVNND

SEQ ID NO: 967316 - protein, 9 aa, Homo Sapiens
IREKFFRSL

SEQ ID NO: 967317 - protein, 9 aa, Homo Sapiens
EQVEDEVLN

SEQ ID NO: 967318 - protein, 9 aa, Homo Sapiens
GQMIIYAKF

SEQ ID NO: 967319 - protein, 9 aa, Homo Sapiens
LYQPGRIIH

SEQ ID NO: 967320 - protein, 9 aa, Homo Sapiens
KRLFKEEDM

SEQ ID NO: 967321 - protein, 9 aa, Homo Sapiens
TALCCPSDI

SEQ ID NO: 967322 - protein, 9 aa, Homo Sapiens
RSTHMGFPE

SEQ ID NO: 967323 - protein, 9 aa, Homo Sapiens
RIIYIVTVM

SEQ ID NO: 967324 - protein, 9 aa, Homo Sapiens
NRGRKPRDQ

SEQ ID NO: 967325 - protein, 9 aa, Homo Sapiens
KSATENSIL

SEQ ID NO: 967326 - protein, 9 aa, Homo Sapiens
DASMDQDDN

SEQ ID NO: 967327 - protein, 9 aa, Homo Sapiens
STPSEAGNQ

SEQ ID NO: 967328 - protein, 9 aa, Homo Sapiens
VVSLFLDNT

SEQ ID NO: 967329 - protein, 9 aa, Homo Sapiens
STITDLNTR

SEQ ID NO: 967330 - protein, 9 aa, Homo Sapiens
VDDLLATGE

SEQ ID NO: 967331 - protein, 9 aa, Homo Sapiens
LAALTLQHE

SEQ ID NO: 967332 - protein, 9 aa, Homo Sapiens
YKQVMFEEG

SEQ ID NO: 967333 - protein, 9 aa, Homo Sapiens
LTIFSASCP

SEQ ID NO: 967334 - protein, 9 aa, Homo Sapiens
DSRQGQTFP

SEQ ID NO: 967335 - protein, 9 aa, Homo Sapiens
FGFCCEKDH

SEQ ID NO: 967336 - protein, 9 aa, Homo Sapiens
QVDLPELSE

SEQ ID NO: 967337 - protein, 9 aa, Homo Sapiens
FLPSRTLPT

SEQ ID NO: 967338 - protein, 9 aa, Homo Sapiens
ASWVSGRFS

SEQ ID NO: 967339 - protein, 9 aa, Homo Sapiens
KLPRLFKNV

SEQ ID NO: 967340 - protein, 9 aa, Homo Sapiens
KGALDNLLF

SEQ ID NO: 967341 - protein, 9 aa, Homo Sapiens
YLIRAPLPE

SEQ ID NO: 967342 - protein, 9 aa, Homo Sapiens
SENSGMNLI

SEQ ID NO: 967343 - protein, 9 aa, Homo Sapiens
LTKTEQLLR

SEQ ID NO: 967344 - protein, 9 aa, Homo Sapiens
SKSVEKRLM

SEQ ID NO: 967345 - protein, 9 aa, Homo Sapiens
IWHPESSLQ

SEQ ID NO: 967346 - protein, 9 aa, Homo Sapiens
PSNLPQGYP

SEQ ID NO: 967347 - protein, 9 aa, Homo Sapiens
FSGCSWLPD

SEQ ID NO: 967348 - protein, 9 aa, Homo Sapiens
QIWRKQGYE

SEQ ID NO: 967349 - protein, 9 aa, Homo Sapiens
LQSPALRDK

SEQ ID NO: 967350 - protein, 9 aa, Homo Sapiens
HISMYFFLA

SEQ ID NO: 967351 - protein, 9 aa, Homo Sapiens
KNNQIEQFL

SEQ ID NO: 967352 - protein, 9 aa, Homo Sapiens
SSVRRGSEA

SEQ ID NO: 967353 - protein, 9 aa, Homo Sapiens
HQHQIHNVE

SEQ ID NO: 967354 - protein, 9 aa, Homo Sapiens
ENIREKFFR

SEQ ID NO: 967355 - protein, 9 aa, Homo Sapiens
VTSIYSSGE

SEQ ID NO: 967356 - protein, 9 aa, Homo Sapiens
GFVFKHKRC

SEQ ID NO: 967357 - protein, 9 aa, Homo Sapiens
GSLVSMLND

SEQ ID NO: 967358 - protein, 9 aa, Homo Sapiens
ILPLGVSYI

SEQ ID NO: 967359 - protein, 9 aa, Homo Sapiens
TLYVGNEPK

SEQ ID NO: 967360 - protein, 9 aa, Homo Sapiens
PPQFVVWPR

SEQ ID NO: 967361 - protein, 9 aa, Homo Sapiens
QFTFSYKNE

SEQ ID NO: 967362 - protein, 9 aa, Homo Sapiens
RNNMTTHVF

SEQ ID NO: 967363 - protein, 9 aa, Homo Sapiens
GEEGARYGL

SEQ ID NO: 967364 - protein, 9 aa, Homo Sapiens
YFIQEGSGK

SEQ ID NO: 967365 - protein, 9 aa, Homo Sapiens
YRLQNVKAQ

SEQ ID NO: 967366 - protein, 9 aa, Homo Sapiens
GSVPMQVLL

SEQ ID NO: 967367 - protein, 9 aa, Homo Sapiens
LNQPHTHCP

SEQ ID NO: 967368 - protein, 9 aa, Homo Sapiens
PCSPEVDPI

SEQ ID NO: 967369 - protein, 9 aa, Homo Sapiens
WDNKRETFR

SEQ ID NO: 967370 - protein, 9 aa, Homo Sapiens
IDFILSFLK

SEQ ID NO: 967371 - protein, 9 aa, Homo Sapiens
VEESYDLKN

SEQ ID NO: 967372 - protein, 9 aa, Homo Sapiens
ARALGPKLG

SEQ ID NO: 967373 - protein, 9 aa, Homo Sapiens
ETLYVGNEP

SEQ ID NO: 967374 - protein, 9 aa, Homo Sapiens
AQISFQEDK

SEQ ID NO: 967375 - protein, 9 aa, Homo Sapiens
EVLGHFSYP

SEQ ID NO: 967376 - protein, 9 aa, Homo Sapiens
DFILSFLKL

SEQ ID NO: 967377 - protein, 9 aa, Homo Sapiens
LPLGFFGEG

SEQ ID NO: 967378 - protein, 9 aa, Homo Sapiens
PPHTHFYTI

SEQ ID NO: 967379 - protein, 9 aa, Homo Sapiens
MAFFTYLTL

SEQ ID NO: 967380 - protein, 9 aa, Homo Sapiens
LCVQAQYSP

SEQ ID NO: 967381 - protein, 9 aa, Homo Sapiens
PQNQRLSKN

SEQ ID NO: 967382 - protein, 9 aa, Homo Sapiens
RLFMPNLVP

SEQ ID NO: 967383 - protein, 9 aa, Homo Sapiens
YISRIISGG

SEQ ID NO: 967384 - protein, 9 aa, Homo Sapiens
RAGLQYPVG

SEQ ID NO: 967385 - protein, 9 aa, Homo Sapiens
LTQDFLQMF

SEQ ID NO: 967386 - protein, 9 aa, Homo Sapiens
KGFIGIDSE

SEQ ID NO: 967387 - protein, 9 aa, Homo Sapiens
NGIAPLVCL

SEQ ID NO: 967388 - protein, 9 aa, Homo Sapiens
LEESFKQYF

SEQ ID NO: 967389 - protein, 9 aa, Homo Sapiens
FYNLSSDDF

SEQ ID NO: 967390 - protein, 9 aa, Homo Sapiens
EGSDPSLPG

SEQ ID NO: 967391 - protein, 9 aa, Homo Sapiens
VFRIEPGVF

SEQ ID NO: 967392 - protein, 9 aa, Homo Sapiens
HYKKPGYNE

SEQ ID NO: 967393 - protein, 9 aa, Homo Sapiens
GAHSPFTLL

SEQ ID NO: 967394 - protein, 9 aa, Homo Sapiens
GGKRRRLGR

SEQ ID NO: 967395 - protein, 9 aa, Homo Sapiens
GPKSFVLIA

SEQ ID NO: 967396 - protein, 9 aa, Homo Sapiens
AEPKVEAAE

SEQ ID NO: 967397 - protein, 9 aa, Homo Sapiens
ILGILLPSS

SEQ ID NO: 967398 - protein, 9 aa, Homo Sapiens
SPTAADLLQ

SEQ ID NO: 967399 - protein, 9 aa, Homo Sapiens
SKLMEHKRT

SEQ ID NO: 967400 - protein, 9 aa, Homo Sapiens
CLLGDDPTF

SEQ ID NO: 967401 - protein, 9 aa, Homo Sapiens
RLIYRGASA

SEQ ID NO: 967402 - protein, 9 aa, Homo Sapiens
LIFLEKSPD

SEQ ID NO: 967403 - protein, 9 aa, Homo Sapiens
FHGRWYADR

SEQ ID NO: 967404 - protein, 9 aa, Homo Sapiens
GFSCCRLLY

SEQ ID NO: 967405 - protein, 9 aa, Homo Sapiens
NLIKNDSGV

SEQ ID NO: 967406 - protein, 9 aa, Homo Sapiens
LCCPSDINP

SEQ ID NO: 967407 - protein, 9 aa, Homo Sapiens
AAPAPRRGP

SEQ ID NO: 967408 - protein, 9 aa, Homo Sapiens
TCSMQENSL

SEQ ID NO: 967409 - protein, 9 aa, Homo Sapiens
ETTDEPPPS

SEQ ID NO: 967410 - protein, 9 aa, Homo Sapiens
GKSFGWAFC

SEQ ID NO: 967411 - protein, 9 aa, Homo Sapiens
HSSLRNRQC

SEQ ID NO: 967412 - protein, 9 aa, Homo Sapiens
SVLSEHPLY

SEQ ID NO: 967413 - protein, 9 aa, Homo Sapiens
TQEKKFESM

SEQ ID NO: 967414 - protein, 9 aa, Homo Sapiens
YIDFKLEQG

SEQ ID NO: 967415 - protein, 9 aa, Homo Sapiens
NQSLKKIGL

SEQ ID NO: 967416 - protein, 9 aa, Homo Sapiens
PFLPSRTLP

SEQ ID NO: 967417 - protein, 9 aa, Homo Sapiens
APETAAAAA

SEQ ID NO: 967418 - protein, 9 aa, Homo Sapiens
VGTPYWMVP

SEQ ID NO: 967419 - protein, 9 aa, Homo Sapiens
GKFRVEAGE

SEQ ID NO: 967420 - protein, 9 aa, Homo Sapiens
LPHCRNGGT

SEQ ID NO: 967421 - protein, 9 aa, Homo Sapiens
STLQQDIMY

SEQ ID NO: 967422 - protein, 9 aa, Homo Sapiens
GLLYFHGKR

SEQ ID NO: 967423 - protein, 9 aa, Homo Sapiens
KEVAGDILR

SEQ ID NO: 967424 - protein, 9 aa, Homo Sapiens
GGQDHGEAV

SEQ ID NO: 967425 - protein, 9 aa, Homo Sapiens
IIEHYSSEG

SEQ ID NO: 967426 - protein, 9 aa, Homo Sapiens
DLAALKVAA

SEQ ID NO: 967427 - protein, 9 aa, Homo Sapiens
PLVPQFPPG

SEQ ID NO: 967428 - protein, 9 aa, Homo Sapiens
FQASISPSE

SEQ ID NO: 967429 - protein, 9 aa, Homo Sapiens
RVDEEFQSS

SEQ ID NO: 967430 - protein, 9 aa, Homo Sapiens
CPGAAGRTG

SEQ ID NO: 967431 - protein, 9 aa, Homo Sapiens
FFKEVLSEP

SEQ ID NO: 967432 - protein, 9 aa, Homo Sapiens
ARRQSSVKP

SEQ ID NO: 967433 - protein, 9 aa, Homo Sapiens
EQVVAIEVL

SEQ ID NO: 967434 - protein, 9 aa, Homo Sapiens
PGAPAAAKS

SEQ ID NO: 967435 - protein, 9 aa, Homo Sapiens
EAKRQAQAQ

SEQ ID NO: 967436 - protein, 9 aa, Homo Sapiens
MFEEGSWGR

SEQ ID NO: 967437 - protein, 9 aa, Homo Sapiens
PEVPRCTVK

SEQ ID NO: 967438 - protein, 9 aa, Homo Sapiens
SKFLTSRLE

SEQ ID NO: 967439 - protein, 9 aa, Homo Sapiens
VPSPLHPAP

SEQ ID NO: 967440 - protein, 9 aa, Homo Sapiens
KQPQNSAGG

SEQ ID NO: 967441 - protein, 9 aa, Homo Sapiens
LENEVEQHR

SEQ ID NO: 967442 - protein, 9 aa, Homo Sapiens
HSTVALSSY

SEQ ID NO: 967443 - protein, 9 aa, Homo Sapiens
GEGSTLTPA

SEQ ID NO: 967444 - protein, 9 aa, Homo Sapiens
QHGSLFFRT

SEQ ID NO: 967445 - protein, 9 aa, Homo Sapiens
SGTSGSWQE

SEQ ID NO: 967446 - protein, 9 aa, Homo Sapiens
WSYNHPIWG

SEQ ID NO: 967447 - protein, 9 aa, Homo Sapiens
PVTITTFSK

SEQ ID NO: 967448 - protein, 9 aa, Homo Sapiens
KTRGRAVPG

SEQ ID NO: 967449 - protein, 9 aa, Homo Sapiens
KFFENLSVP

SEQ ID NO: 967450 - protein, 9 aa, Homo Sapiens
STFLFFKNS

SEQ ID NO: 967451 - protein, 9 aa, Homo Sapiens
ISRFWTFET

SEQ ID NO: 967452 - protein, 9 aa, Homo Sapiens
GNTTADNRI

SEQ ID NO: 967453 - protein, 9 aa, Homo Sapiens
PLPPACLSP

SEQ ID NO: 967454 - protein, 9 aa, Homo Sapiens
YGKTGSAEA

SEQ ID NO: 967455 - protein, 9 aa, Homo Sapiens
KERRKKAFT

SEQ ID NO: 967456 - protein, 9 aa, Homo Sapiens
NAFILSLFL

SEQ ID NO: 967457 - protein, 9 aa, Homo Sapiens
DLVEILNEE

SEQ ID NO: 967458 - protein, 9 aa, Homo Sapiens
FPGFDVFAK

SEQ ID NO: 967459 - protein, 9 aa, Homo Sapiens
VVVAISPIH

SEQ ID NO: 967460 - protein, 9 aa, Homo Sapiens
NDYEVPKEF

SEQ ID NO: 967461 - protein, 9 aa, Homo Sapiens
CTWASEKQN

SEQ ID NO: 967462 - protein, 9 aa, Homo Sapiens
LVELPALFR

SEQ ID NO: 967463 - protein, 9 aa, Homo Sapiens
ESTPFIIYH

SEQ ID NO: 967464 - protein, 9 aa, Homo Sapiens
LAFSGRNVP

SEQ ID NO: 967465 - protein, 9 aa, Homo Sapiens
GKEVAGDIL

SEQ ID NO: 967466 - protein, 9 aa, Homo Sapiens
GGHQFLQSP

SEQ ID NO: 967467 - protein, 9 aa, Homo Sapiens
PEKGEMVDY

SEQ ID NO: 967468 - protein, 9 aa, Homo Sapiens
LWIVKKPPS

SEQ ID NO: 967469 - protein, 9 aa, Homo Sapiens
VNYLKELTK

SEQ ID NO: 967470 - protein, 9 aa, Homo Sapiens
SGPVESKFL

SEQ ID NO: 967471 - protein, 9 aa, Homo Sapiens
ERTKLEDYA

SEQ ID NO: 967472 - protein, 9 aa, Homo Sapiens
LPALFRQPS

SEQ ID NO: 967473 - protein, 9 aa, Homo Sapiens
YLVKEIAED

SEQ ID NO: 967474 - protein, 9 aa, Homo Sapiens
PDKAEPSFY

SEQ ID NO: 967475 - protein, 9 aa, Homo Sapiens
RKLLLAFQT

SEQ ID NO: 967476 - protein, 9 aa, Homo Sapiens
SPSCIRHLV

SEQ ID NO: 967477 - protein, 9 aa, Homo Sapiens
FTYYFIQEG

SEQ ID NO: 967478 - protein, 9 aa, Homo Sapiens
SGPGFSEKD

SEQ ID NO: 967479 - protein, 9 aa, Homo Sapiens
SCALQKKSL

SEQ ID NO: 967480 - protein, 9 aa, Homo Sapiens
EETVPIPRP

SEQ ID NO: 967481 - protein, 9 aa, Homo Sapiens
APLPQQRNP

SEQ ID NO: 967482 - protein, 9 aa, Homo Sapiens
SFQQVKQWF

SEQ ID NO: 967483 - protein, 9 aa, Homo Sapiens
PLSVPAYPS

SEQ ID NO: 967484 - protein, 9 aa, Homo Sapiens
TSIDARGST

SEQ ID NO: 967485 - protein, 9 aa, Homo Sapiens
IFGSIFLEK

SEQ ID NO: 967486 - protein, 9 aa, Homo Sapiens
RSVVGTSAY

SEQ ID NO: 967487 - protein, 9 aa, Homo Sapiens
WMKWRIDKV

SEQ ID NO: 967488 - protein, 9 aa, Homo Sapiens
YFHGKRVPL

SEQ ID NO: 967489 - protein, 9 aa, Homo Sapiens
CYSKNQSSC

SEQ ID NO: 967490 - protein, 9 aa, Homo Sapiens
KLLPASHSV

SEQ ID NO: 967491 - protein, 9 aa, Homo Sapiens
AKLPRQAFS

SEQ ID NO: 967492 - protein, 9 aa, Homo Sapiens
FMAAAAGPL

SEQ ID NO: 967493 - protein, 9 aa, Homo Sapiens
WVGLPEVEF

SEQ ID NO: 967494 - protein, 9 aa, Homo Sapiens
NISEVEEWY

SEQ ID NO: 967495 - protein, 9 aa, Homo Sapiens
NKRTPSSGP

SEQ ID NO: 967496 - protein, 9 aa, Homo Sapiens
MLGDIQLRG

SEQ ID NO: 967497 - protein, 9 aa, Homo Sapiens
RLRLYCKEA

SEQ ID NO: 967498 - protein, 9 aa, Homo Sapiens
EIEIPFFKQ

SEQ ID NO: 967499 - protein, 9 aa, Homo Sapiens
GKHVYRVLQ

SEQ ID NO: 967500 - protein, 9 aa, Homo Sapiens
LKIKNEMAT

SEQ ID NO: 967501 - protein, 9 aa, Homo Sapiens
GQETGACLG

SEQ ID NO: 967502 - protein, 9 aa, Homo Sapiens
PGVGILPPP

SEQ ID NO: 967503 - protein, 9 aa, Homo Sapiens
REAVRREAK

SEQ ID NO: 967504 - protein, 9 aa, Homo Sapiens
DQEEQEELS

SEQ ID NO: 967505 - protein, 9 aa, Homo Sapiens
PQNSAGGRR

SEQ ID NO: 967506 - protein, 9 aa, Homo Sapiens
LNEEKVKFD

SEQ ID NO: 967507 - protein, 9 aa, Homo Sapiens
IENKAIQNP

SEQ ID NO: 967508 - protein, 9 aa, Homo Sapiens
LFEETGVEP

SEQ ID NO: 967509 - protein, 9 aa, Homo Sapiens
PYNNRKSKG

SEQ ID NO: 967510 - protein, 9 aa, Homo Sapiens
DGEIATYRK

SEQ ID NO: 967511 - protein, 9 aa, Homo Sapiens
CPRNLTWID

SEQ ID NO: 967512 - protein, 9 aa, Homo Sapiens
TAYQHGNLF

SEQ ID NO: 967513 - protein, 9 aa, Homo Sapiens
FQRELLIQD

SEQ ID NO: 967514 - protein, 9 aa, Homo Sapiens
GQQTYSRYQ

SEQ ID NO: 967515 - protein, 9 aa, Homo Sapiens
SKTSQVPGK

SEQ ID NO: 967516 - protein, 9 aa, Homo Sapiens
KRRRLGRWG

SEQ ID NO: 967517 - protein, 9 aa, Homo Sapiens
KKPALCAGC

SEQ ID NO: 967518 - protein, 9 aa, Homo Sapiens
QTEEGCDAS

SEQ ID NO: 967519 - protein, 9 aa, Homo Sapiens
GGVTKEFFF

SEQ ID NO: 967520 - protein, 9 aa, Homo Sapiens
QKMEAMSDE

SEQ ID NO: 967521 - protein, 9 aa, Homo Sapiens
QPTSQPQLT

SEQ ID NO: 967522 - protein, 9 aa, Homo Sapiens
RFTLQPDYQ

SEQ ID NO: 967523 - protein, 9 aa, Homo Sapiens
INTMSKICG

SEQ ID NO: 967524 - protein, 9 aa, Homo Sapiens
KFRENYLNR

SEQ ID NO: 967525 - protein, 9 aa, Homo Sapiens
FCLAGDNPK

SEQ ID NO: 967526 - protein, 9 aa, Homo Sapiens
EVYQGVCQT

SEQ ID NO: 967527 - protein, 9 aa, Homo Sapiens
AFFQPVPAS

SEQ ID NO: 967528 - protein, 9 aa, Homo Sapiens
SDKFFDYID

SEQ ID NO: 967529 - protein, 9 aa, Homo Sapiens
RGFCPEQIL

SEQ ID NO: 967530 - protein, 9 aa, Homo Sapiens
LFSSLCAER

SEQ ID NO: 967531 - protein, 9 aa, Homo Sapiens
YFFFLGKEL

SEQ ID NO: 967532 - protein, 9 aa, Homo Sapiens
FAQKITKSV

SEQ ID NO: 967533 - protein, 9 aa, Homo Sapiens
LSSKFLTSR

SEQ ID NO: 967534 - protein, 9 aa, Homo Sapiens
YSLSEDAEE

SEQ ID NO: 967535 - protein, 9 aa, Homo Sapiens
PEKKNKRCK

SEQ ID NO: 967536 - protein, 9 aa, Homo Sapiens
EEKHNQCKC

SEQ ID NO: 967537 - protein, 9 aa, Homo Sapiens
WVLTITVPE

SEQ ID NO: 967538 - protein, 9 aa, Homo Sapiens
FISYLVVKV

SEQ ID NO: 967539 - protein, 9 aa, Homo Sapiens
PKDPQHLGE

SEQ ID NO: 967540 - protein, 9 aa, Homo Sapiens
DRIIYIVTV

SEQ ID NO: 967541 - protein, 9 aa, Homo Sapiens
KRSQASGEK

SEQ ID NO: 967542 - protein, 9 aa, Homo Sapiens
RVGSTFENI

SEQ ID NO: 967543 - protein, 9 aa, Homo Sapiens
DYLNALEHL

SEQ ID NO: 967544 - protein, 9 aa, Homo Sapiens
VQPLYWPYK

SEQ ID NO: 967545 - protein, 9 aa, Homo Sapiens
PLDLLLAVL

SEQ ID NO: 967546 - protein, 9 aa, Homo Sapiens
APGSLLACT

SEQ ID NO: 967547 - protein, 9 aa, Homo Sapiens
MEHLVQYFQ

SEQ ID NO: 967548 - protein, 9 aa, Homo Sapiens
LSECPFQED

SEQ ID NO: 967549 - protein, 9 aa, Homo Sapiens
YGPIYSVCM

SEQ ID NO: 967550 - protein, 9 aa, Homo Sapiens
RSSWGDCAE

SEQ ID NO: 967551 - protein, 9 aa, Homo Sapiens
EGIQKVVKC

SEQ ID NO: 967552 - protein, 9 aa, Homo Sapiens
RLPPEACPR

SEQ ID NO: 967553 - protein, 9 aa, Homo Sapiens
KTVGLIHGS

SEQ ID NO: 967554 - protein, 9 aa, Homo Sapiens
ELVRYLVDV

SEQ ID NO: 967555 - protein, 9 aa, Homo Sapiens
TKFFENLSV

SEQ ID NO: 967556 - protein, 9 aa, Homo Sapiens
SPAENRGRK

SEQ ID NO: 967557 - protein, 9 aa, Homo Sapiens
YMGLELQET

SEQ ID NO: 967558 - protein, 9 aa, Homo Sapiens
GSARKRLFK

SEQ ID NO: 967559 - protein, 9 aa, Homo Sapiens
KETIFELEN

SEQ ID NO: 967560 - protein, 9 aa, Homo Sapiens
VSFTRKEGS

SEQ ID NO: 967561 - protein, 9 aa, Homo Sapiens
IPVFSDNYS

SEQ ID NO: 967562 - protein, 9 aa, Homo Sapiens
GKLRRKQEL

SEQ ID NO: 967563 - protein, 9 aa, Homo Sapiens
EEADAAKKQ

SEQ ID NO: 967564 - protein, 9 aa, Homo Sapiens
GPVLSEGLQ

SEQ ID NO: 967565 - protein, 9 aa, Homo Sapiens
SKKQRLGGD

SEQ ID NO: 967566 - protein, 9 aa, Homo Sapiens
ILNFTRNSI

SEQ ID NO: 967567 - protein, 9 aa, Homo Sapiens
ETAAAAAAA

SEQ ID NO: 967568 - protein, 9 aa, Homo Sapiens
SSRAVWWAR

SEQ ID NO: 967569 - protein, 9 aa, Homo Sapiens
LKVVLRSLP

SEQ ID NO: 967570 - protein, 9 aa, Homo Sapiens
VANRLEKRL

SEQ ID NO: 967571 - protein, 9 aa, Homo Sapiens
EFKEVAKSD

SEQ ID NO: 967572 - protein, 9 aa, Homo Sapiens
SEDIKLSVL

SEQ ID NO: 967573 - protein, 9 aa, Homo Sapiens
KPEMNSEGE

SEQ ID NO: 967574 - protein, 9 aa, Homo Sapiens
QTGSRTTER

SEQ ID NO: 967575 - protein, 9 aa, Homo Sapiens
PAAFAAQGQ

SEQ ID NO: 967576 - protein, 9 aa, Homo Sapiens
LKHSCPHSS

SEQ ID NO: 967577 - protein, 9 aa, Homo Sapiens
FPGAAGGAE

SEQ ID NO: 967578 - protein, 9 aa, Homo Sapiens
CRLFNHVKT

SEQ ID NO: 967579 - protein, 9 aa, Homo Sapiens
PRHLSNSLD

SEQ ID NO: 967580 - protein, 9 aa, Homo Sapiens
LLGPSLEDF

SEQ ID NO: 967581 - protein, 9 aa, Homo Sapiens
SLPRSPVSS

SEQ ID NO: 967582 - protein, 9 aa, Homo Sapiens
ERQQPRRKH

SEQ ID NO: 967583 - protein, 9 aa, Homo Sapiens
AASTPSPSE

SEQ ID NO: 967584 - protein, 9 aa, Homo Sapiens
MISCTDLSI

SEQ ID NO: 967585 - protein, 9 aa, Homo Sapiens
GEAQCATKV

SEQ ID NO: 967586 - protein, 9 aa, Homo Sapiens
PDMKLSMFD

SEQ ID NO: 967587 - protein, 9 aa, Homo Sapiens
QITFDETNL

SEQ ID NO: 967588 - protein, 9 aa, Homo Sapiens
VNASKVKTY

SEQ ID NO: 967589 - protein, 9 aa, Homo Sapiens
PKTTSLQQE

SEQ ID NO: 967590 - protein, 9 aa, Homo Sapiens
GQENTLHPD

SEQ ID NO: 967591 - protein, 9 aa, Homo Sapiens
RIIQRLRSE

SEQ ID NO: 967592 - protein, 9 aa, Homo Sapiens
SISWPRLFS

SEQ ID NO: 967593 - protein, 9 aa, Homo Sapiens
DAPPKKEDM

SEQ ID NO: 967594 - protein, 9 aa, Homo Sapiens
DIQFSPGSG

SEQ ID NO: 967595 - protein, 9 aa, Homo Sapiens
QFNWDPKTV

SEQ ID NO: 967596 - protein, 9 aa, Homo Sapiens
RSVLGLLVC

SEQ ID NO: 967597 - protein, 9 aa, Homo Sapiens
CLEIPNICS

SEQ ID NO: 967598 - protein, 9 aa, Homo Sapiens
SNSAGQLAF

SEQ ID NO: 967599 - protein, 9 aa, Homo Sapiens
LSLTVGAQS

SEQ ID NO: 967600 - protein, 9 aa, Homo Sapiens
SGQGKQGGK

SEQ ID NO: 967601 - protein, 9 aa, Homo Sapiens
AERKPLLFN

SEQ ID NO: 967602 - protein, 9 aa, Homo Sapiens
GVRGPTGPI

SEQ ID NO: 967603 - protein, 9 aa, Homo Sapiens
DYTLSTLQQ

SEQ ID NO: 967604 - protein, 9 aa, Homo Sapiens
PILTEEMYE

SEQ ID NO: 967605 - protein, 9 aa, Homo Sapiens
LGDCGVLKE

SEQ ID NO: 967606 - protein, 9 aa, Homo Sapiens
RDLFCAWEG

SEQ ID NO: 967607 - protein, 9 aa, Homo Sapiens
KKIICMSRE

SEQ ID NO: 967608 - protein, 9 aa, Homo Sapiens
QGKVVNASK

SEQ ID NO: 967609 - protein, 9 aa, Homo Sapiens
ETALGRDLF

SEQ ID NO: 967610 - protein, 9 aa, Homo Sapiens
TLRYQLYDV

SEQ ID NO: 967611 - protein, 9 aa, Homo Sapiens
TLGESGYLI

SEQ ID NO: 967612 - protein, 9 aa, Homo Sapiens
SPVQYAHRP

SEQ ID NO: 967613 - protein, 9 aa, Homo Sapiens
ATPLDKAVL

SEQ ID NO: 967614 - protein, 9 aa, Homo Sapiens
DGCFGELKT

SEQ ID NO: 967615 - protein, 9 aa, Homo Sapiens
FCHAFHPEE

SEQ ID NO: 967616 - protein, 9 aa, Homo Sapiens
PYWMVPELI

SEQ ID NO: 967617 - protein, 9 aa, Homo Sapiens
LIGQENTLH

SEQ ID NO: 967618 - protein, 9 aa, Homo Sapiens
KAIKQMFGL

SEQ ID NO: 967619 - protein, 9 aa, Homo Sapiens
GFGHGAREA

SEQ ID NO: 967620 - protein, 9 aa, Homo Sapiens
LADIFCIYA

SEQ ID NO: 967621 - protein, 9 aa, Homo Sapiens
ELSNSSSGS

SEQ ID NO: 967622 - protein, 9 aa, Homo Sapiens
LKLCPATSF

SEQ ID NO: 967623 - protein, 9 aa, Homo Sapiens
LKAPKSFSK

SEQ ID NO: 967624 - protein, 9 aa, Homo Sapiens
EGMVIFHMA

SEQ ID NO: 967625 - protein, 9 aa, Homo Sapiens
QSPALRDKH

SEQ ID NO: 967626 - protein, 9 aa, Homo Sapiens
EEAPPEEAP

SEQ ID NO: 967627 - protein, 9 aa, Homo Sapiens
ISFLVLAVR

SEQ ID NO: 967628 - protein, 9 aa, Homo Sapiens
LASTLENEQ

SEQ ID NO: 967629 - protein, 9 aa, Homo Sapiens
LWRQIRSGR

SEQ ID NO: 967630 - protein, 9 aa, Homo Sapiens
TNVEVETEL

SEQ ID NO: 967631 - protein, 9 aa, Homo Sapiens
WALPLFFLF

SEQ ID NO: 967632 - protein, 9 aa, Homo Sapiens
PWDFVRRMV

SEQ ID NO: 967633 - protein, 9 aa, Homo Sapiens
SPEKKNKRC

SEQ ID NO: 967634 - protein, 9 aa, Homo Sapiens
LYKFDLIAV

SEQ ID NO: 967635 - protein, 9 aa, Homo Sapiens
TWQPLTQVP

SEQ ID NO: 967636 - protein, 9 aa, Homo Sapiens
VVVGADGVG

SEQ ID NO: 967637 - protein, 9 aa, Homo Sapiens
KAFCKNSFL

SEQ ID NO: 967638 - protein, 9 aa, Homo Sapiens
TVSVNEWDK

SEQ ID NO: 967639 - protein, 9 aa, Homo Sapiens
KVVLRSLPE

SEQ ID NO: 967640 - protein, 9 aa, Homo Sapiens
FSNRLCFLE

SEQ ID NO: 967641 - protein, 9 aa, Homo Sapiens
GDADVFSRK

SEQ ID NO: 967642 - protein, 9 aa, Homo Sapiens
HTHFYTISH

SEQ ID NO: 967643 - protein, 9 aa, Homo Sapiens
MELTASPKP

SEQ ID NO: 967644 - protein, 9 aa, Homo Sapiens
DMISRYVLS

SEQ ID NO: 967645 - protein, 9 aa, Homo Sapiens
IDARGSTSA

SEQ ID NO: 967646 - protein, 9 aa, Homo Sapiens
EESKPKPRL

SEQ ID NO: 967647 - protein, 9 aa, Homo Sapiens
LIDERTKLE

SEQ ID NO: 967648 - protein, 9 aa, Homo Sapiens
SSTHNLRLS

SEQ ID NO: 967649 - protein, 9 aa, Homo Sapiens
FFEGKGPLS

SEQ ID NO: 967650 - protein, 9 aa, Homo Sapiens
KDYSSGGSS

SEQ ID NO: 967651 - protein, 9 aa, Homo Sapiens
PLLVTALLP

SEQ ID NO: 967652 - protein, 9 aa, Homo Sapiens
TQGEIHVGP

SEQ ID NO: 967653 - protein, 9 aa, Homo Sapiens
SNGEKLPCR

SEQ ID NO: 967654 - protein, 9 aa, Homo Sapiens
EELAKLKTR

SEQ ID NO: 967655 - protein, 9 aa, Homo Sapiens
GQGKQGGKA

SEQ ID NO: 967656 - protein, 9 aa, Homo Sapiens
MAGDGPQYF

SEQ ID NO: 967657 - protein, 9 aa, Homo Sapiens
NSLEGGHTD

SEQ ID NO: 967658 - protein, 9 aa, Homo Sapiens
EEGCDASAI

SEQ ID NO: 967659 - protein, 9 aa, Homo Sapiens
KKIQSLLNQ

SEQ ID NO: 967660 - protein, 9 aa, Homo Sapiens
GIYVITVVG

SEQ ID NO: 967661 - protein, 9 aa, Homo Sapiens
DKEIPSMAG

SEQ ID NO: 967662 - protein, 9 aa, Homo Sapiens
LIADPFLSK

SEQ ID NO: 967663 - protein, 9 aa, Homo Sapiens
QVTLLTYHR

SEQ ID NO: 967664 - protein, 9 aa, Homo Sapiens
RNKIPEIPE

SEQ ID NO: 967665 - protein, 9 aa, Homo Sapiens
RLLEGSSSE

SEQ ID NO: 967666 - protein, 9 aa, Homo Sapiens
PQPLNLTLR

SEQ ID NO: 967667 - protein, 9 aa, Homo Sapiens
SPKPTVLAS

SEQ ID NO: 967668 - protein, 9 aa, Homo Sapiens
GEKLSGGAP

SEQ ID NO: 967669 - protein, 9 aa, Homo Sapiens
TTALPFMAA

SEQ ID NO: 967670 - protein, 9 aa, Homo Sapiens
PGLLPSGVP

SEQ ID NO: 967671 - protein, 9 aa, Homo Sapiens
KKKKFSNRE

SEQ ID NO: 967672 - protein, 9 aa, Homo Sapiens
GPQYFFPQG

SEQ ID NO: 967673 - protein, 9 aa, Homo Sapiens
LFTFQTREE

SEQ ID NO: 967674 - protein, 9 aa, Homo Sapiens
LGMGLPFPQ

SEQ ID NO: 967675 - protein, 9 aa, Homo Sapiens
VLQLGNISF

SEQ ID NO: 967676 - protein, 9 aa, Homo Sapiens
PPTAANYSS

SEQ ID NO: 967677 - protein, 9 aa, Homo Sapiens
SKPRLSFSP

SEQ ID NO: 967678 - protein, 9 aa, Homo Sapiens
IYTAHLVRT

SEQ ID NO: 967679 - protein, 9 aa, Homo Sapiens
VGTSSSMRS

SEQ ID NO: 967680 - protein, 9 aa, Homo Sapiens
EDIFKKLDS

SEQ ID NO: 967681 - protein, 9 aa, Homo Sapiens
VSVGFYMAK

SEQ ID NO: 967682 - protein, 9 aa, Homo Sapiens
QRGSSSSAT

SEQ ID NO: 967683 - protein, 9 aa, Homo Sapiens
LRKQHHLDS

SEQ ID NO: 967684 - protein, 9 aa, Homo Sapiens
WGEGSTLTP

SEQ ID NO: 967685 - protein, 9 aa, Homo Sapiens
NDMYVIDKY

SEQ ID NO: 967686 - protein, 9 aa, Homo Sapiens
TNSKLSYTF

SEQ ID NO: 967687 - protein, 9 aa, Homo Sapiens
KVEAAEPEV

SEQ ID NO: 967688 - protein, 9 aa, Homo Sapiens
ETREVLKVF

SEQ ID NO: 967689 - protein, 9 aa, Homo Sapiens
NSLSVPFVS

SEQ ID NO: 967690 - protein, 9 aa, Homo Sapiens
TSTKTLFQP

SEQ ID NO: 967691 - protein, 9 aa, Homo Sapiens
MILWPASDR

SEQ ID NO: 967692 - protein, 9 aa, Homo Sapiens
INPRDIKPA

SEQ ID NO: 967693 - protein, 9 aa, Homo Sapiens
ENTWQPLTQ

SEQ ID NO: 967694 - protein, 9 aa, Homo Sapiens
PLQPFYSSE

SEQ ID NO: 967695 - protein, 9 aa, Homo Sapiens
SRSESLCCS

SEQ ID NO: 967696 - protein, 9 aa, Homo Sapiens
WALSIWEKL

SEQ ID NO: 967697 - protein, 9 aa, Homo Sapiens
YQFIVQRIS

SEQ ID NO: 967698 - protein, 9 aa, Homo Sapiens
SEEDFSIYP

SEQ ID NO: 967699 - protein, 9 aa, Homo Sapiens
PAGSREASP

SEQ ID NO: 967700 - protein, 9 aa, Homo Sapiens
DAASSSSFS

SEQ ID NO: 967701 - protein, 9 aa, Homo Sapiens
SEAPEEDQR

SEQ ID NO: 967702 - protein, 9 aa, Homo Sapiens
GHYLIRDEK

SEQ ID NO: 967703 - protein, 9 aa, Homo Sapiens
GMNLIQTMT

SEQ ID NO: 967704 - protein, 9 aa, Homo Sapiens
AEVTCSDGS

SEQ ID NO: 967705 - protein, 9 aa, Homo Sapiens
ERRSSGHSE

SEQ ID NO: 967706 - protein, 9 aa, Homo Sapiens
IQAWYKLHY

SEQ ID NO: 967707 - protein, 9 aa, Homo Sapiens
IAVGLVSQY

SEQ ID NO: 967708 - protein, 9 aa, Homo Sapiens
KIYENGFFK

SEQ ID NO: 967709 - protein, 9 aa, Homo Sapiens
CRLDDKTTN

SEQ ID NO: 967710 - protein, 9 aa, Homo Sapiens
RCGSGLFEV

SEQ ID NO: 967711 - protein, 9 aa, Homo Sapiens
VVIIAYVLV

SEQ ID NO: 967712 - protein, 9 aa, Homo Sapiens
VNPERTNPV

SEQ ID NO: 967713 - protein, 9 aa, Homo Sapiens
LLACTEPSR

SEQ ID NO: 967714 - protein, 9 aa, Homo Sapiens
RKASIQDFI

SEQ ID NO: 967715 - protein, 9 aa, Homo Sapiens
LWGPPRGFC

SEQ ID NO: 967716 - protein, 9 aa, Homo Sapiens
SKVNLVGSS

SEQ ID NO: 967717 - protein, 9 aa, Homo Sapiens
NPGKTSSVP

SEQ ID NO: 967718 - protein, 9 aa, Homo Sapiens
LKYYPDKNP

SEQ ID NO: 967719 - protein, 9 aa, Homo Sapiens
MGAHGALLL

SEQ ID NO: 967720 - protein, 9 aa, Homo Sapiens
WYADRAVFS

SEQ ID NO: 967721 - protein, 9 aa, Homo Sapiens
MPESINFIK

SEQ ID NO: 967722 - protein, 9 aa, Homo Sapiens
PTKSPTSWG

SEQ ID NO: 967723 - protein, 9 aa, Homo Sapiens
EAEKRKKSD

SEQ ID NO: 967724 - protein, 9 aa, Homo Sapiens
LALTTVKSQ

SEQ ID NO: 967725 - protein, 9 aa, Homo Sapiens
TQSLGTALK

SEQ ID NO: 967726 - protein, 9 aa, Homo Sapiens
FVTSRETQD

SEQ ID NO: 967727 - protein, 9 aa, Homo Sapiens
DEFFYNLSS

SEQ ID NO: 967728 - protein, 9 aa, Homo Sapiens
LISDDEEQR

SEQ ID NO: 967729 - protein, 9 aa, Homo Sapiens
EEIDFILSF

SEQ ID NO: 967730 - protein, 9 aa, Homo Sapiens
RPRPSKKRA

SEQ ID NO: 967731 - protein, 9 aa, Homo Sapiens
PAPCPPCSP

SEQ ID NO: 967732 - protein, 9 aa, Homo Sapiens
ETLDSGPPL

SEQ ID NO: 967733 - protein, 9 aa, Homo Sapiens
IRESIRKFL

SEQ ID NO: 967734 - protein, 9 aa, Homo Sapiens
ISLPSEPSK

SEQ ID NO: 967735 - protein, 9 aa, Homo Sapiens
RSLPSSLPP

SEQ ID NO: 967736 - protein, 9 aa, Homo Sapiens
LGSPLGSPP

SEQ ID NO: 967737 - protein, 9 aa, Homo Sapiens
PGESVVITI

SEQ ID NO: 967738 - protein, 9 aa, Homo Sapiens
LLRCGSGLF

SEQ ID NO: 967739 - protein, 9 aa, Homo Sapiens
QAAWDAFFQ

SEQ ID NO: 967740 - protein, 9 aa, Homo Sapiens
MRRSAAGFP

SEQ ID NO: 967741 - protein, 9 aa, Homo Sapiens
VNGTPLDGT

SEQ ID NO: 967742 - protein, 9 aa, Homo Sapiens
NKIPEIPES

SEQ ID NO: 967743 - protein, 9 aa, Homo Sapiens
WDFVRRMVN

SEQ ID NO: 967744 - protein, 9 aa, Homo Sapiens
ILVKDLPTR

SEQ ID NO: 967745 - protein, 9 aa, Homo Sapiens
ATFFWMYLL

SEQ ID NO: 967746 - protein, 9 aa, Homo Sapiens
QKVGTYMLL

SEQ ID NO: 967747 - protein, 9 aa, Homo Sapiens
PRLSFSPKP

SEQ ID NO: 967748 - protein, 9 aa, Homo Sapiens
KGEDRVPAD

SEQ ID NO: 967749 - protein, 9 aa, Homo Sapiens
PQSLAKKES

SEQ ID NO: 967750 - protein, 9 aa, Homo Sapiens
LPPACLSPA

SEQ ID NO: 967751 - protein, 9 aa, Homo Sapiens
QELSNSSSG

SEQ ID NO: 967752 - protein, 9 aa, Homo Sapiens
NTSVFFIST

SEQ ID NO: 967753 - protein, 9 aa, Homo Sapiens
TDVPSGRSC

SEQ ID NO: 967754 - protein, 9 aa, Homo Sapiens
LASWVSGRF

SEQ ID NO: 967755 - protein, 9 aa, Homo Sapiens
DLSALKAHW

SEQ ID NO: 967756 - protein, 9 aa, Homo Sapiens
LQEPQSVLI

SEQ ID NO: 967757 - protein, 9 aa, Homo Sapiens
PRGFCPEQI

SEQ ID NO: 967758 - protein, 9 aa, Homo Sapiens
DNRIIITQQ

SEQ ID NO: 967759 - protein, 9 aa, Homo Sapiens
HPIWGRAKS

SEQ ID NO: 967760 - protein, 9 aa, Homo Sapiens
LLDGDDCDC

SEQ ID NO: 967761 - protein, 9 aa, Homo Sapiens
GSEGLALPW

SEQ ID NO: 967762 - protein, 9 aa, Homo Sapiens
GCVLVRLRS

SEQ ID NO: 967763 - protein, 9 aa, Homo Sapiens
MFRESEFQD

SEQ ID NO: 967764 - protein, 9 aa, Homo Sapiens
FWTVAMMVP

SEQ ID NO: 967765 - protein, 9 aa, Homo Sapiens
NLDIFYFLF

SEQ ID NO: 967766 - protein, 9 aa, Homo Sapiens
LELSREGER

SEQ ID NO: 967767 - protein, 9 aa, Homo Sapiens
QRPGSLEEA

SEQ ID NO: 967768 - protein, 9 aa, Homo Sapiens
GFFGNLCQL

SEQ ID NO: 967769 - protein, 9 aa, Homo Sapiens
FTRSILAQI

SEQ ID NO: 967770 - protein, 9 aa, Homo Sapiens
KLVGVVTTT

SEQ ID NO: 967771 - protein, 9 aa, Homo Sapiens
RYREQQRQH

SEQ ID NO: 967772 - protein, 9 aa, Homo Sapiens
STEHGEKTA

SEQ ID NO: 967773 - protein, 9 aa, Homo Sapiens
LFPCRVCTK

SEQ ID NO: 967774 - protein, 9 aa, Homo Sapiens
LGNHLFGSE

SEQ ID NO: 967775 - protein, 9 aa, Homo Sapiens
FRENYLNRC

SEQ ID NO: 967776 - protein, 9 aa, Homo Sapiens
GFCPEQILQ

SEQ ID NO: 967777 - protein, 9 aa, Homo Sapiens
EAELIFLEK

SEQ ID NO: 967778 - protein, 9 aa, Homo Sapiens
SYLMLARKG

SEQ ID NO: 967779 - protein, 9 aa, Homo Sapiens
ISFRSNGNI

SEQ ID NO: 967780 - protein, 9 aa, Homo Sapiens
FRFKIIDPN

SEQ ID NO: 967781 - protein, 9 aa, Homo Sapiens
FLWAVTLPT

SEQ ID NO: 967782 - protein, 9 aa, Homo Sapiens
PLGASPSLP

SEQ ID NO: 967783 - protein, 9 aa, Homo Sapiens
AKSYRKRRV

SEQ ID NO: 967784 - protein, 9 aa, Homo Sapiens
EPSISWQHI

SEQ ID NO: 967785 - protein, 9 aa, Homo Sapiens
ALPGDEHAE

SEQ ID NO: 967786 - protein, 9 aa, Homo Sapiens
YSKNQSSCG

SEQ ID NO: 967787 - protein, 9 aa, Homo Sapiens
QHKKIHTRK

SEQ ID NO: 967788 - protein, 9 aa, Homo Sapiens
KRNEEDENK

SEQ ID NO: 967789 - protein, 9 aa, Homo Sapiens
RLHFSRWAK

SEQ ID NO: 967790 - protein, 9 aa, Homo Sapiens
PFFKQGLSV

SEQ ID NO: 967791 - protein, 9 aa, Homo Sapiens
PATVALPGD

SEQ ID NO: 967792 - protein, 9 aa, Homo Sapiens
EIELPQLRS

SEQ ID NO: 967793 - protein, 9 aa, Homo Sapiens
SEVSNKREC

SEQ ID NO: 967794 - protein, 9 aa, Homo Sapiens
PPSVCPTPK

SEQ ID NO: 967795 - protein, 9 aa, Homo Sapiens
SCRTHRRDS

SEQ ID NO: 967796 - protein, 9 aa, Homo Sapiens
TGRRMNFKM

SEQ ID NO: 967797 - protein, 9 aa, Homo Sapiens
VDCSIKTRL

SEQ ID NO: 967798 - protein, 9 aa, Homo Sapiens
KFINLFGLA

SEQ ID NO: 967799 - protein, 9 aa, Homo Sapiens
MAARIPENF

SEQ ID NO: 967800 - protein, 9 aa, Homo Sapiens
SAGQGRALK

SEQ ID NO: 967801 - protein, 9 aa, Homo Sapiens
SLGPKDFKV

SEQ ID NO: 967802 - protein, 9 aa, Homo Sapiens
GFKLPRLFK

SEQ ID NO: 967803 - protein, 9 aa, Homo Sapiens
KAEPSFYVG

SEQ ID NO: 967804 - protein, 9 aa, Homo Sapiens
RRDGFGGND

SEQ ID NO: 967805 - protein, 9 aa, Homo Sapiens
CGSGLFEVG

SEQ ID NO: 967806 - protein, 9 aa, Homo Sapiens
ITGLALISV

SEQ ID NO: 967807 - protein, 9 aa, Homo Sapiens
FPPSQLYVV

SEQ ID NO: 967808 - protein, 9 aa, Homo Sapiens
LSGSVLSIP

SEQ ID NO: 967809 - protein, 9 aa, Homo Sapiens
LTLQHERPQ

SEQ ID NO: 967810 - protein, 9 aa, Homo Sapiens
TKTEQLLRI

SEQ ID NO: 967811 - protein, 9 aa, Homo Sapiens
ENLKKKKKR

SEQ ID NO: 967812 - protein, 9 aa, Homo Sapiens
LLERKASIQ

SEQ ID NO: 967813 - protein, 9 aa, Homo Sapiens
VLSDRGKTP

SEQ ID NO: 967814 - protein, 9 aa, Homo Sapiens
TLSPLFSSL

SEQ ID NO: 967815 - protein, 9 aa, Homo Sapiens
EVPKEFNFA

SEQ ID NO: 967816 - protein, 9 aa, Homo Sapiens
NLVCTPPYT

SEQ ID NO: 967817 - protein, 9 aa, Homo Sapiens
MFIPGKEFP

SEQ ID NO: 967818 - protein, 9 aa, Homo Sapiens
TPFIIYHCA

SEQ ID NO: 967819 - protein, 9 aa, Homo Sapiens
ERSFKGVKF

SEQ ID NO: 967820 - protein, 9 aa, Homo Sapiens
RALGPKLGP

SEQ ID NO: 967821 - protein, 9 aa, Homo Sapiens
MKGNIGIKG

SEQ ID NO: 967822 - protein, 9 aa, Homo Sapiens
LLLNQPHTH

SEQ ID NO: 967823 - protein, 9 aa, Homo Sapiens
AAKSGTSGS

SEQ ID NO: 967824 - protein, 9 aa, Homo Sapiens
DNLLFQLIA

SEQ ID NO: 967825 - protein, 9 aa, Homo Sapiens
KEFSIVRNL

SEQ ID NO: 967826 - protein, 9 aa, Homo Sapiens
TFKAVKEEG

SEQ ID NO: 967827 - protein, 9 aa, Homo Sapiens
KVGEEKQTC

SEQ ID NO: 967828 - protein, 9 aa, Homo Sapiens
QFLSIQERE

SEQ ID NO: 967829 - protein, 9 aa, Homo Sapiens
QPFFEMIHE

SEQ ID NO: 967830 - protein, 9 aa, Homo Sapiens
LGLVGTEPK

SEQ ID NO: 967831 - protein, 9 aa, Homo Sapiens
EKADNNENL

SEQ ID NO: 967832 - protein, 9 aa, Homo Sapiens
KISISFPCS

SEQ ID NO: 967833 - protein, 9 aa, Homo Sapiens
EGRSCNETI

SEQ ID NO: 967834 - protein, 9 aa, Homo Sapiens
LQGQAKITS

SEQ ID NO: 967835 - protein, 9 aa, Homo Sapiens
NRSDVEELA

SEQ ID NO: 967836 - protein, 9 aa, Homo Sapiens
DCLLIYDNK

SEQ ID NO: 967837 - protein, 9 aa, Homo Sapiens
KMEAMSDEQ

SEQ ID NO: 967838 - protein, 9 aa, Homo Sapiens
LRRLLRKKG

SEQ ID NO: 967839 - protein, 9 aa, Homo Sapiens
KYGKTGSAE

SEQ ID NO: 967840 - protein, 9 aa, Homo Sapiens
SSTPYQNIL

SEQ ID NO: 967841 - protein, 9 aa, Homo Sapiens
SNFSLWIVK

SEQ ID NO: 967842 - protein, 9 aa, Homo Sapiens
LSKANCLPA

SEQ ID NO: 967843 - protein, 9 aa, Homo Sapiens
FTPVVFYTT

SEQ ID NO: 967844 - protein, 9 aa, Homo Sapiens
MLLILFSVV

SEQ ID NO: 967845 - protein, 9 aa, Homo Sapiens
EWVLTITVP

SEQ ID NO: 967846 - protein, 9 aa, Homo Sapiens
TLQSQRNQA

SEQ ID NO: 967847 - protein, 9 aa, Homo Sapiens
ESTITDLNT

SEQ ID NO: 967848 - protein, 9 aa, Homo Sapiens
YNESCFNVE

SEQ ID NO: 967849 - protein, 9 aa, Homo Sapiens
PLVCLLRIS

SEQ ID NO: 967850 - protein, 9 aa, Homo Sapiens
QHVLEDLLR

SEQ ID NO: 967851 - protein, 9 aa, Homo Sapiens
ACDTKVLIE

SEQ ID NO: 967852 - protein, 9 aa, Homo Sapiens
WQHISPSAK

SEQ ID NO: 967853 - protein, 9 aa, Homo Sapiens
SSNMKRAAF

SEQ ID NO: 967854 - protein, 9 aa, Homo Sapiens
QHLKEKPFM

SEQ ID NO: 967855 - protein, 9 aa, Homo Sapiens
EASSFISYL

SEQ ID NO: 967856 - protein, 9 aa, Homo Sapiens
EEDFSIYPR

SEQ ID NO: 967857 - protein, 9 aa, Homo Sapiens
APGRRSGQQ

SEQ ID NO: 967858 - protein, 9 aa, Homo Sapiens
GMNSYSMLH

SEQ ID NO: 967859 - protein, 9 aa, Homo Sapiens
EHILLEVLD

SEQ ID NO: 967860 - protein, 9 aa, Homo Sapiens
PYTGPDFVP

SEQ ID NO: 967861 - protein, 9 aa, Homo Sapiens
ELSQKGVTG

SEQ ID NO: 967862 - protein, 9 aa, Homo Sapiens
QIISLLLKR

SEQ ID NO: 967863 - protein, 9 aa, Homo Sapiens
ISDIQFSPG

SEQ ID NO: 967864 - protein, 9 aa, Homo Sapiens
FVGDEDIFK

SEQ ID NO: 967865 - protein, 9 aa, Homo Sapiens
VPAPCPPCS

SEQ ID NO: 967866 - protein, 9 aa, Homo Sapiens
FPCAQCGKA

SEQ ID NO: 967867 - protein, 9 aa, Homo Sapiens
VPVVFIVRC

SEQ ID NO: 967868 - protein, 9 aa, Homo Sapiens
STPSPSEVV

SEQ ID NO: 967869 - protein, 9 aa, Homo Sapiens
GEVCSGCLK

SEQ ID NO: 967870 - protein, 9 aa, Homo Sapiens
EKYKNRKPL

SEQ ID NO: 967871 - protein, 9 aa, Homo Sapiens
SEALSQYKI

SEQ ID NO: 967872 - protein, 9 aa, Homo Sapiens
SSFVGDEDI

SEQ ID NO: 967873 - protein, 9 aa, Homo Sapiens
CPFQEDESI

SEQ ID NO: 967874 - protein, 9 aa, Homo Sapiens
EKAFCKNSF

SEQ ID NO: 967875 - protein, 9 aa, Homo Sapiens
LSALKAHWS

SEQ ID NO: 967876 - protein, 9 aa, Homo Sapiens
PSPSEVVYS

SEQ ID NO: 967877 - protein, 9 aa, Homo Sapiens
TLQQDIMYK

SEQ ID NO: 967878 - protein, 9 aa, Homo Sapiens
VRCFNLIDD

SEQ ID NO: 967879 - protein, 9 aa, Homo Sapiens
ATSFKEVPR

SEQ ID NO: 967880 - protein, 9 aa, Homo Sapiens
ISRNSWLKM

SEQ ID NO: 967881 - protein, 9 aa, Homo Sapiens
DDRLEELVS

SEQ ID NO: 967882 - protein, 9 aa, Homo Sapiens
LPLSGLHTD

SEQ ID NO: 967883 - protein, 9 aa, Homo Sapiens
DYKGRFSRQ

SEQ ID NO: 967884 - protein, 9 aa, Homo Sapiens
RTILISAAV

SEQ ID NO: 967885 - protein, 9 aa, Homo Sapiens
LKADYKRRL

SEQ ID NO: 967886 - protein, 9 aa, Homo Sapiens
KKFSNREYE

SEQ ID NO: 967887 - protein, 9 aa, Homo Sapiens
RGNQSQGPP

SEQ ID NO: 967888 - protein, 9 aa, Homo Sapiens
DHSCSAESN

SEQ ID NO: 967889 - protein, 9 aa, Homo Sapiens
LGKLRRKQE

SEQ ID NO: 967890 - protein, 9 aa, Homo Sapiens
GFPGPQDPA

SEQ ID NO: 967891 - protein, 9 aa, Homo Sapiens
GFFGEGDAV

SEQ ID NO: 967892 - protein, 9 aa, Homo Sapiens
DFAATKFVY

SEQ ID NO: 967893 - protein, 9 aa, Homo Sapiens
NRDDYVNIW

SEQ ID NO: 967894 - protein, 9 aa, Homo Sapiens
EMEEHQHQI

SEQ ID NO: 967895 - protein, 9 aa, Homo Sapiens
NKNVKTALQ

SEQ ID NO: 967896 - protein, 9 aa, Homo Sapiens
GDSCSISLQ

SEQ ID NO: 967897 - protein, 9 aa, Homo Sapiens
EPAFFNLNV

SEQ ID NO: 967898 - protein, 9 aa, Homo Sapiens
HSCERGAPR

SEQ ID NO: 967899 - protein, 9 aa, Homo Sapiens
ADTSRNSSQ

SEQ ID NO: 967900 - protein, 9 aa, Homo Sapiens
QTFPIKPKR

SEQ ID NO: 967901 - protein, 9 aa, Homo Sapiens
KDPQHLGEW

SEQ ID NO: 967902 - protein, 9 aa, Homo Sapiens
PVDMKDIYY

SEQ ID NO: 967903 - protein, 9 aa, Homo Sapiens
NSSQCSRSL

SEQ ID NO: 967904 - protein, 9 aa, Homo Sapiens
LPASSWWPT

SEQ ID NO: 967905 - protein, 9 aa, Homo Sapiens
EKPAKSEEC

SEQ ID NO: 967906 - protein, 9 aa, Homo Sapiens
NLPPPLGDA

SEQ ID NO: 967907 - protein, 9 aa, Homo Sapiens
HRFRQSLHL

SEQ ID NO: 967908 - protein, 9 aa, Homo Sapiens
LVPNLGPAE

SEQ ID NO: 967909 - protein, 9 aa, Homo Sapiens
KEWVLTITV

SEQ ID NO: 967910 - protein, 9 aa, Homo Sapiens
GNGIAPLVC

SEQ ID NO: 967911 - protein, 9 aa, Homo Sapiens
DAGLGALLH

SEQ ID NO: 967912 - protein, 9 aa, Homo Sapiens
CLNGSSKSM

SEQ ID NO: 967913 - protein, 9 aa, Homo Sapiens
RFRFKIIDP

SEQ ID NO: 967914 - protein, 9 aa, Homo Sapiens
PASSWWPTP

SEQ ID NO: 967915 - protein, 9 aa, Homo Sapiens
RKPLLFNMN

SEQ ID NO: 967916 - protein, 9 aa, Homo Sapiens
LFHEEAVAI

SEQ ID NO: 967917 - protein, 9 aa, Homo Sapiens
NEGEGAGRG

SEQ ID NO: 967918 - protein, 9 aa, Homo Sapiens
DTLFLNELN

SEQ ID NO: 967919 - protein, 9 aa, Homo Sapiens
PEREHLASF

SEQ ID NO: 967920 - protein, 9 aa, Homo Sapiens
QCKGRLNCI

SEQ ID NO: 967921 - protein, 9 aa, Homo Sapiens
PQQRNPPQQ

SEQ ID NO: 967922 - protein, 9 aa, Homo Sapiens
ELDIFPGAA

SEQ ID NO: 967923 - protein, 9 aa, Homo Sapiens
LHSKVNYLK

SEQ ID NO: 967924 - protein, 9 aa, Homo Sapiens
LFFLFLFMY

SEQ ID NO: 967925 - protein, 9 aa, Homo Sapiens
KSERTEGDH

SEQ ID NO: 967926 - protein, 9 aa, Homo Sapiens
VEEAADLLL

SEQ ID NO: 967927 - protein, 9 aa, Homo Sapiens
PAWEFVEQE

SEQ ID NO: 967928 - protein, 9 aa, Homo Sapiens
PRLKNMILW

SEQ ID NO: 967929 - protein, 9 aa, Homo Sapiens
INSKIIMVT

SEQ ID NO: 967930 - protein, 9 aa, Homo Sapiens
HAPGRRSGQ

SEQ ID NO: 967931 - protein, 9 aa, Homo Sapiens
VRTLVLIVC

SEQ ID NO: 967932 - protein, 9 aa, Homo Sapiens
ELYSRQLYG

SEQ ID NO: 967933 - protein, 9 aa, Homo Sapiens
FFACEEYAQ

SEQ ID NO: 967934 - protein, 9 aa, Homo Sapiens
RGQEEGMDS

SEQ ID NO: 967935 - protein, 9 aa, Homo Sapiens
TSKLLPASH

SEQ ID NO: 967936 - protein, 9 aa, Homo Sapiens
ALGRDLFCA

SEQ ID NO: 967937 - protein, 9 aa, Homo Sapiens
LPKFRENYL

SEQ ID NO: 967938 - protein, 9 aa, Homo Sapiens
RFMKQPQGK

SEQ ID NO: 967939 - protein, 9 aa, Homo Sapiens
EMRPDKLHL

SEQ ID NO: 967940 - protein, 9 aa, Homo Sapiens
YPVGRIHRH

SEQ ID NO: 967941 - protein, 9 aa, Homo Sapiens
VSDKFHHLH

SEQ ID NO: 967942 - protein, 9 aa, Homo Sapiens
LGSITILRP

SEQ ID NO: 967943 - protein, 9 aa, Homo Sapiens
NEVEQHRAV

SEQ ID NO: 967944 - protein, 9 aa, Homo Sapiens
VAISPIHFY

SEQ ID NO: 967945 - protein, 9 aa, Homo Sapiens
KDAVPTIFC

SEQ ID NO: 967946 - protein, 9 aa, Homo Sapiens
LQHGSLFFR

SEQ ID NO: 967947 - protein, 9 aa, Homo Sapiens
QSSSSKCHP

SEQ ID NO: 967948 - protein, 9 aa, Homo Sapiens
CMKLLERKA

SEQ ID NO: 967949 - protein, 9 aa, Homo Sapiens
PLDGTQVLK

SEQ ID NO: 967950 - protein, 9 aa, Homo Sapiens
SFSLAFREH

SEQ ID NO: 967951 - protein, 9 aa, Homo Sapiens
QPESPLATG

SEQ ID NO: 967952 - protein, 9 aa, Homo Sapiens
EKKIQSLLN

SEQ ID NO: 967953 - protein, 9 aa, Homo Sapiens
ACLAEGPEP

SEQ ID NO: 967954 - protein, 9 aa, Homo Sapiens
TRNSPAPPH

SEQ ID NO: 967955 - protein, 9 aa, Homo Sapiens
LALDGEIAT

SEQ ID NO: 967956 - protein, 9 aa, Homo Sapiens
IFKGINVLV

SEQ ID NO: 967957 - protein, 9 aa, Homo Sapiens
DEAFIQALK

SEQ ID NO: 967958 - protein, 9 aa, Homo Sapiens
KGSFPESLR

SEQ ID NO: 967959 - protein, 9 aa, Homo Sapiens
GYSQVIPIE

SEQ ID NO: 967960 - protein, 9 aa, Homo Sapiens
KKNKRCKYK

SEQ ID NO: 967961 - protein, 9 aa, Homo Sapiens
EQLLPRPWI

SEQ ID NO: 967962 - protein, 9 aa, Homo Sapiens
MVPELISRL

SEQ ID NO: 967963 - protein, 9 aa, Homo Sapiens
RLDPETLDS

SEQ ID NO: 967964 - protein, 9 aa, Homo Sapiens
LAQHRKIYT

SEQ ID NO: 967965 - protein, 9 aa, Homo Sapiens
LHAAATALW

SEQ ID NO: 967966 - protein, 9 aa, Homo Sapiens
SRLASTLEN

SEQ ID NO: 967967 - protein, 9 aa, Homo Sapiens
LRNVLSSFI

SEQ ID NO: 967968 - protein, 9 aa, Homo Sapiens
STQIWQHGT

SEQ ID NO: 967969 - protein, 9 aa, Homo Sapiens
SRSQHQETP

SEQ ID NO: 967970 - protein, 9 aa, Homo Sapiens
HAPVHSFFM

SEQ ID NO: 967971 - protein, 9 aa, Homo Sapiens
EGPPPQRGN

SEQ ID NO: 967972 - protein, 9 aa, Homo Sapiens
GSLLRCGSG

SEQ ID NO: 967973 - protein, 9 aa, Homo Sapiens
IFVSADRLE

SEQ ID NO: 967974 - protein, 9 aa, Homo Sapiens
PLCLKLATR

SEQ ID NO: 967975 - protein, 9 aa, Homo Sapiens
RSCNETILH

SEQ ID NO: 967976 - protein, 9 aa, Homo Sapiens
NKAVLSPGM

SEQ ID NO: 967977 - protein, 9 aa, Homo Sapiens
SVNEWDKYL

SEQ ID NO: 967978 - protein, 9 aa, Homo Sapiens
EFGKSAWIK

SEQ ID NO: 967979 - protein, 9 aa, Homo Sapiens
PRSDTPRSV

SEQ ID NO: 967980 - protein, 9 aa, Homo Sapiens
RSAGQGRAL

SEQ ID NO: 967981 - protein, 9 aa, Homo Sapiens
AIGILKYKK

SEQ ID NO: 967982 - protein, 9 aa, Homo Sapiens
GSRPRGYRW

SEQ ID NO: 967983 - protein, 9 aa, Homo Sapiens
SSGINAIQA

SEQ ID NO: 967984 - protein, 9 aa, Homo Sapiens
RKINFYKVI

SEQ ID NO: 967985 - protein, 9 aa, Homo Sapiens
KPENLKKKK

SEQ ID NO: 967986 - protein, 9 aa, Homo Sapiens
SAKISISFP

SEQ ID NO: 967987 - protein, 9 aa, Homo Sapiens
LQNTSTTRS

SEQ ID NO: 967988 - protein, 9 aa, Homo Sapiens
KRGPVAYAL

SEQ ID NO: 967989 - protein, 9 aa, Homo Sapiens
KASESESEK

SEQ ID NO: 967990 - protein, 9 aa, Homo Sapiens
DDENLLRKH

SEQ ID NO: 967991 - protein, 9 aa, Homo Sapiens
TEPCERCEH

SEQ ID NO: 967992 - protein, 9 aa, Homo Sapiens
DIGYGEAQC

SEQ ID NO: 967993 - protein, 9 aa, Homo Sapiens
LSKDGRSLC

SEQ ID NO: 967994 - protein, 9 aa, Homo Sapiens
DSLNICVFI

SEQ ID NO: 967995 - protein, 9 aa, Homo Sapiens
RLLASTAPG

SEQ ID NO: 967996 - protein, 9 aa, Homo Sapiens
LAQKKKKLA

SEQ ID NO: 967997 - protein, 9 aa, Homo Sapiens
PCEGQKLLL

SEQ ID NO: 967998 - protein, 9 aa, Homo Sapiens
YPGSALLQR

SEQ ID NO: 967999 - protein, 9 aa, Homo Sapiens
YSSSRYPPQ

SEQ ID NO: 968000 - protein, 9 aa, Homo Sapiens
LGESGYLIF

SEQ ID NO: 968001 - protein, 9 aa, Homo Sapiens
KNPSFFEGK

SEQ ID NO: 968002 - protein, 9 aa, Homo Sapiens
KWQERLTSF

SEQ ID NO: 968003 - protein, 9 aa, Homo Sapiens
VYLAEVFNG

SEQ ID NO: 968004 - protein, 9 aa, Homo Sapiens
SDIPEILPS

SEQ ID NO: 968005 - protein, 9 aa, Homo Sapiens
YRWSKKAEA

SEQ ID NO: 968006 - protein, 9 aa, Homo Sapiens
SSPLGLLET

SEQ ID NO: 968007 - protein, 9 aa, Homo Sapiens
NKQVCIVMR

SEQ ID NO: 968008 - protein, 9 aa, Homo Sapiens
PGFLIFWDQ

SEQ ID NO: 968009 - protein, 9 aa, Homo Sapiens
EGYCKQLGH

SEQ ID NO: 968010 - protein, 9 aa, Homo Sapiens
TCPPCGLHA

SEQ ID NO: 968011 - protein, 9 aa, Homo Sapiens
PDPPHPCEG

SEQ ID NO: 968012 - protein, 9 aa, Homo Sapiens
FKEPAVLMG

SEQ ID NO: 968013 - protein, 9 aa, Homo Sapiens
EILKMFFSG

SEQ ID NO: 968014 - protein, 9 aa, Homo Sapiens
KKYYTFNSK

SEQ ID NO: 968015 - protein, 9 aa, Homo Sapiens
VAYALQKPW

SEQ ID NO: 968016 - protein, 9 aa, Homo Sapiens
RHQLMPNEC

SEQ ID NO: 968017 - protein, 9 aa, Homo Sapiens
AFVYTQCSS

SEQ ID NO: 968018 - protein, 9 aa, Homo Sapiens
IWHQKVHTR

SEQ ID NO: 968019 - protein, 9 aa, Homo Sapiens
SQTVAMPIA

SEQ ID NO: 968020 - protein, 9 aa, Homo Sapiens
PLYQPGRII

SEQ ID NO: 968021 - protein, 9 aa, Homo Sapiens
RGAVAFADF

SEQ ID NO: 968022 - protein, 9 aa, Homo Sapiens
KPSQPSHLP

SEQ ID NO: 968023 - protein, 9 aa, Homo Sapiens
FSPEKKNKR

SEQ ID NO: 968024 - protein, 9 aa, Homo Sapiens
TMLERLKNT

SEQ ID NO: 968025 - protein, 9 aa, Homo Sapiens
AALSVCRCK

SEQ ID NO: 968026 - protein, 9 aa, Homo Sapiens
IFRYGYSVR

SEQ ID NO: 968027 - protein, 9 aa, Homo Sapiens
SLNWHVRIH

SEQ ID NO: 968028 - protein, 9 aa, Homo Sapiens
LEGLALKAG

SEQ ID NO: 968029 - protein, 9 aa, Homo Sapiens
ASPSLPRSP

SEQ ID NO: 968030 - protein, 9 aa, Homo Sapiens
KSMCFLSFL

SEQ ID NO: 968031 - protein, 9 aa, Homo Sapiens
KRNCHLNKN

SEQ ID NO: 968032 - protein, 9 aa, Homo Sapiens
EVQHILGNL

SEQ ID NO: 968033 - protein, 9 aa, Homo Sapiens
YSPIKEKLD

SEQ ID NO: 968034 - protein, 9 aa, Homo Sapiens
YAWDNKRET

SEQ ID NO: 968035 - protein, 9 aa, Homo Sapiens
CNFNVEEAQ

SEQ ID NO: 968036 - protein, 9 aa, Homo Sapiens
AFLGEASKL

SEQ ID NO: 968037 - protein, 9 aa, Homo Sapiens
KDSLSINFE

SEQ ID NO: 968038 - protein, 9 aa, Homo Sapiens
EEGWEESIS

SEQ ID NO: 968039 - protein, 9 aa, Homo Sapiens
RIWVVLRFM

SEQ ID NO: 968040 - protein, 9 aa, Homo Sapiens
LPASHSVSG

SEQ ID NO: 968041 - protein, 9 aa, Homo Sapiens
SHSTVALSS

SEQ ID NO: 968042 - protein, 9 aa, Homo Sapiens
PGGTPEAPA

SEQ ID NO: 968043 - protein, 9 aa, Homo Sapiens
GTNSKLSYT

SEQ ID NO: 968044 - protein, 9 aa, Homo Sapiens
VTIFLLVTV

SEQ ID NO: 968045 - protein, 9 aa, Homo Sapiens
EARINSSNP

SEQ ID NO: 968046 - protein, 9 aa, Homo Sapiens
SPLLSPDPT

SEQ ID NO: 968047 - protein, 9 aa, Homo Sapiens
KPLADGEVS

SEQ ID NO: 968048 - protein, 9 aa, Homo Sapiens
EEGSDPSLP

SEQ ID NO: 968049 - protein, 9 aa, Homo Sapiens
VSQLLPKFR

SEQ ID NO: 968050 - protein, 9 aa, Homo Sapiens
SDAAGKLPA

SEQ ID NO: 968051 - protein, 9 aa, Homo Sapiens
GAAEKFRLE

SEQ ID NO: 968052 - protein, 9 aa, Homo Sapiens
LLISAEKSF

SEQ ID NO: 968053 - protein, 9 aa, Homo Sapiens
DDKLTYGII

SEQ ID NO: 968054 - protein, 9 aa, Homo Sapiens
PSGPSTSVL

SEQ ID NO: 968055 - protein, 9 aa, Homo Sapiens
PLDAPGSLL

SEQ ID NO: 968056 - protein, 9 aa, Homo Sapiens
YWDIADATV

SEQ ID NO: 968057 - protein, 9 aa, Homo Sapiens
FKTAQDIVT

SEQ ID NO: 968058 - protein, 9 aa, Homo Sapiens
MLVHAEVQH

SEQ ID NO: 968059 - protein, 9 aa, Homo Sapiens
PELLCRYLT

SEQ ID NO: 968060 - protein, 9 aa, Homo Sapiens
SLLTLFHYS

SEQ ID NO: 968061 - protein, 9 aa, Homo Sapiens
IYIFSFFLG

SEQ ID NO: 968062 - protein, 9 aa, Homo Sapiens
RIKRGLTVT

SEQ ID NO: 968063 - protein, 9 aa, Homo Sapiens
HFSRWAKTN

SEQ ID NO: 968064 - protein, 9 aa, Homo Sapiens
IYSISPGIQ

SEQ ID NO: 968065 - protein, 9 aa, Homo Sapiens
NCSLLQKFA

SEQ ID NO: 968066 - protein, 9 aa, Homo Sapiens
LVLPDTLHS

SEQ ID NO: 968067 - protein, 9 aa, Homo Sapiens
YLAEVFNGL

SEQ ID NO: 968068 - protein, 9 aa, Homo Sapiens
FGGRPNTGA

SEQ ID NO: 968069 - protein, 9 aa, Homo Sapiens
IFYVPDMKL

SEQ ID NO: 968070 - protein, 9 aa, Homo Sapiens
LAAEGFSNR

SEQ ID NO: 968071 - protein, 9 aa, Homo Sapiens
SEPRMCGFF

SEQ ID NO: 968072 - protein, 9 aa, Homo Sapiens
HLDSDVEYE

SEQ ID NO: 968073 - protein, 9 aa, Homo Sapiens
VSPVAKTVI

SEQ ID NO: 968074 - protein, 9 aa, Homo Sapiens
ENSQKVGTY

SEQ ID NO: 968075 - protein, 9 aa, Homo Sapiens
SKSMCFLSF

SEQ ID NO: 968076 - protein, 9 aa, Homo Sapiens
SDTLNPPAV

SEQ ID NO: 968077 - protein, 9 aa, Homo Sapiens
LDLLLAVLV

SEQ ID NO: 968078 - protein, 9 aa, Homo Sapiens
QIQVEEKEE

SEQ ID NO: 968079 - protein, 9 aa, Homo Sapiens
ELAPIGIRV

SEQ ID NO: 968080 - protein, 9 aa, Homo Sapiens
SPLGGGAPV

SEQ ID NO: 968081 - protein, 9 aa, Homo Sapiens
DMNFVYERQ

SEQ ID NO: 968082 - protein, 9 aa, Homo Sapiens
NSEDMSEDL

SEQ ID NO: 968083 - protein, 9 aa, Homo Sapiens
PESINFIKQ

SEQ ID NO: 968084 - protein, 9 aa, Homo Sapiens
DFARNQVFS

SEQ ID NO: 968085 - protein, 9 aa, Homo Sapiens
STLCSAKIS

SEQ ID NO: 968086 - protein, 9 aa, Homo Sapiens
IFFIDGSNN

SEQ ID NO: 968087 - protein, 9 aa, Homo Sapiens
VIRRLARRG

SEQ ID NO: 968088 - protein, 9 aa, Homo Sapiens
LNETTGLKA

SEQ ID NO: 968089 - protein, 9 aa, Homo Sapiens
KDSILESAN

SEQ ID NO: 968090 - protein, 9 aa, Homo Sapiens
SIPNSNMSS

SEQ ID NO: 968091 - protein, 9 aa, Homo Sapiens
GSGAPRGRR

SEQ ID NO: 968092 - protein, 9 aa, Homo Sapiens
LSTLQQDIM

SEQ ID NO: 968093 - protein, 9 aa, Homo Sapiens
EKLEGWLVF

SEQ ID NO: 968094 - protein, 9 aa, Homo Sapiens
PCFSCPTLA

SEQ ID NO: 968095 - protein, 9 aa, Homo Sapiens
SNSSTGTSE

SEQ ID NO: 968096 - protein, 9 aa, Homo Sapiens
LLDEIKEAA

SEQ ID NO: 968097 - protein, 9 aa, Homo Sapiens
GAMGRDEAT

SEQ ID NO: 968098 - protein, 9 aa, Homo Sapiens
LLRRMSGTN

SEQ ID NO: 968099 - protein, 9 aa, Homo Sapiens
TKSPLTKTE

SEQ ID NO: 968100 - protein, 9 aa, Homo Sapiens
ANCYRNGGW

SEQ ID NO: 968101 - protein, 9 aa, Homo Sapiens
ASSFISYLV

SEQ ID NO: 968102 - protein, 9 aa, Homo Sapiens
VSKTRKSVQ

SEQ ID NO: 968103 - protein, 9 aa, Homo Sapiens
IFLEKSPDY

SEQ ID NO: 968104 - protein, 9 aa, Homo Sapiens
CLGSHRRDS

SEQ ID NO: 968105 - protein, 9 aa, Homo Sapiens
LKKIGLLIS

SEQ ID NO: 968106 - protein, 9 aa, Homo Sapiens
ADLLLGYMK

SEQ ID NO: 968107 - protein, 9 aa, Homo Sapiens
TRSVLGLLV

SEQ ID NO: 968108 - protein, 9 aa, Homo Sapiens
LAEGPEPST

SEQ ID NO: 968109 - protein, 9 aa, Homo Sapiens
IRKKVGPEL

SEQ ID NO: 968110 - protein, 9 aa, Homo Sapiens
GDFAATKFV

SEQ ID NO: 968111 - protein, 9 aa, Homo Sapiens
EEKKEIKKN

SEQ ID NO: 968112 - protein, 9 aa, Homo Sapiens
ELYKFDLIA

SEQ ID NO: 968113 - protein, 9 aa, Homo Sapiens
QAEKPKPTN

SEQ ID NO: 968114 - protein, 9 aa, Homo Sapiens
IRPSQVTLT

SEQ ID NO: 968115 - protein, 9 aa, Homo Sapiens
VEEWSPWSG

SEQ ID NO: 968116 - protein, 9 aa, Homo Sapiens
RLMSTTLIG

SEQ ID NO: 968117 - protein, 9 aa, Homo Sapiens
LIRPSQVTL

SEQ ID NO: 968118 - protein, 9 aa, Homo Sapiens
QLLTYLIKV

SEQ ID NO: 968119 - protein, 9 aa, Homo Sapiens
LPPPPLPGV

SEQ ID NO: 968120 - protein, 9 aa, Homo Sapiens
GHGDCISEV

SEQ ID NO: 968121 - protein, 9 aa, Homo Sapiens
SILDDNKTL

SEQ ID NO: 968122 - protein, 9 aa, Homo Sapiens
PSLGGLCSS

SEQ ID NO: 968123 - protein, 9 aa, Homo Sapiens
TTDFSSESS

SEQ ID NO: 968124 - protein, 9 aa, Homo Sapiens
PEGRVGGVL

SEQ ID NO: 968125 - protein, 9 aa, Homo Sapiens
EQRITETES

SEQ ID NO: 968126 - protein, 9 aa, Homo Sapiens
VQYFQQGLH

SEQ ID NO: 968127 - protein, 9 aa, Homo Sapiens
SNKRECPAS

SEQ ID NO: 968128 - protein, 9 aa, Homo Sapiens
SNLTLGYRI

SEQ ID NO: 968129 - protein, 9 aa, Homo Sapiens
QKVGEEKQT

SEQ ID NO: 968130 - protein, 9 aa, Homo Sapiens
DKTQMSFQQ

SEQ ID NO: 968131 - protein, 9 aa, Homo Sapiens
SSVDEIPPY

SEQ ID NO: 968132 - protein, 9 aa, Homo Sapiens
GLEKSRCIV

SEQ ID NO: 968133 - protein, 9 aa, Homo Sapiens
VLQLQGQEV

SEQ ID NO: 968134 - protein, 9 aa, Homo Sapiens
SLLTAFLPP

SEQ ID NO: 968135 - protein, 9 aa, Homo Sapiens
EPSFYVGSN

SEQ ID NO: 968136 - protein, 9 aa, Homo Sapiens
ALPFMAAAA

SEQ ID NO: 968137 - protein, 9 aa, Homo Sapiens
QLTVPNVSN

SEQ ID NO: 968138 - protein, 9 aa, Homo Sapiens
FYLNTLSYI

SEQ ID NO: 968139 - protein, 9 aa, Homo Sapiens
AKEAYSSFA

SEQ ID NO: 968140 - protein, 9 aa, Homo Sapiens
PDHFSPLSE

SEQ ID NO: 968141 - protein, 9 aa, Homo Sapiens
ELDVSRNKI

SEQ ID NO: 968142 - protein, 9 aa, Homo Sapiens
PQGYPLPKS

SEQ ID NO: 968143 - protein, 9 aa, Homo Sapiens
IPNSNMSSM

SEQ ID NO: 968144 - protein, 9 aa, Homo Sapiens
EPCERCEHQ

SEQ ID NO: 968145 - protein, 9 aa, Homo Sapiens
ALIREEKNF

SEQ ID NO: 968146 - protein, 9 aa, Homo Sapiens
EVFIFLQLR

SEQ ID NO: 968147 - protein, 9 aa, Homo Sapiens
VFIFLQLRN

SEQ ID NO: 968148 - protein, 9 aa, Homo Sapiens
MRISPEPLN

SEQ ID NO: 968149 - protein, 9 aa, Homo Sapiens
FVSVGFYMA

SEQ ID NO: 968150 - protein, 9 aa, Homo Sapiens
EARRDLEKP

SEQ ID NO: 968151 - protein, 9 aa, Homo Sapiens
DAPGSLLAC

SEQ ID NO: 968152 - protein, 9 aa, Homo Sapiens
IVQSFLGSA

SEQ ID NO: 968153 - protein, 9 aa, Homo Sapiens
ASLHMGLEG

SEQ ID NO: 968154 - protein, 9 aa, Homo Sapiens
QDFARNQVF

SEQ ID NO: 968155 - protein, 9 aa, Homo Sapiens
GSQPGSQAE

SEQ ID NO: 968156 - protein, 9 aa, Homo Sapiens
VLLLFVLSK

SEQ ID NO: 968157 - protein, 9 aa, Homo Sapiens
VHWKPEGRV

SEQ ID NO: 968158 - protein, 9 aa, Homo Sapiens
NSSRMNSPK

SEQ ID NO: 968159 - protein, 9 aa, Homo Sapiens
NQVFSQTPQ

SEQ ID NO: 968160 - protein, 9 aa, Homo Sapiens
PSQTHVRNS

SEQ ID NO: 968161 - protein, 9 aa, Homo Sapiens
DTVLTYLTI

SEQ ID NO: 968162 - protein, 9 aa, Homo Sapiens
EINRLSLPL

SEQ ID NO: 968163 - protein, 9 aa, Homo Sapiens
PGLEGPKGE

SEQ ID NO: 968164 - protein, 9 aa, Homo Sapiens
VLEEPVQAS

SEQ ID NO: 968165 - protein, 9 aa, Homo Sapiens
PSMDLFRTI

SEQ ID NO: 968166 - protein, 9 aa, Homo Sapiens
DYLVKEIAE

SEQ ID NO: 968167 - protein, 9 aa, Homo Sapiens
AILVFTMLA

SEQ ID NO: 968168 - protein, 9 aa, Homo Sapiens
AAAFVTSPL

SEQ ID NO: 968169 - protein, 9 aa, Homo Sapiens
NLIQTMTEV

SEQ ID NO: 968170 - protein, 9 aa, Homo Sapiens
ACLQSTLWP

SEQ ID NO: 968171 - protein, 9 aa, Homo Sapiens
LFYARRSEI

SEQ ID NO: 968172 - protein, 9 aa, Homo Sapiens
TSTLCSAKI

SEQ ID NO: 968173 - protein, 9 aa, Homo Sapiens
FYARRSEIR

SEQ ID NO: 968174 - protein, 9 aa, Homo Sapiens
KMPSYLMLA

SEQ ID NO: 968175 - protein, 9 aa, Homo Sapiens
LQQIPFKEP

SEQ ID NO: 968176 - protein, 9 aa, Homo Sapiens
KCYLMENPQ

SEQ ID NO: 968177 - protein, 9 aa, Homo Sapiens
RLFKEEDMT

SEQ ID NO: 968178 - protein, 9 aa, Homo Sapiens
TESFSDGGD

SEQ ID NO: 968179 - protein, 9 aa, Homo Sapiens
QSPYRSVRF

SEQ ID NO: 968180 - protein, 9 aa, Homo Sapiens
LFSVVLASY

SEQ ID NO: 968181 - protein, 9 aa, Homo Sapiens
EKQINVYNS

SEQ ID NO: 968182 - protein, 9 aa, Homo Sapiens
WLTEALPLL

SEQ ID NO: 968183 - protein, 9 aa, Homo Sapiens
ILLEVLDLQ

SEQ ID NO: 968184 - protein, 9 aa, Homo Sapiens
PLPQKFPSY

SEQ ID NO: 968185 - protein, 9 aa, Homo Sapiens
KKVGPELQR

SEQ ID NO: 968186 - protein, 9 aa, Homo Sapiens
METEEAEDI

SEQ ID NO: 968187 - protein, 9 aa, Homo Sapiens
AALAHSSLR

SEQ ID NO: 968188 - protein, 9 aa, Homo Sapiens
VDMKDIYYK

SEQ ID NO: 968189 - protein, 9 aa, Homo Sapiens
AREKDCIGP

SEQ ID NO: 968190 - protein, 9 aa, Homo Sapiens
QPSSGPGQA

SEQ ID NO: 968191 - protein, 9 aa, Homo Sapiens
HVGQKEMSN

SEQ ID NO: 968192 - protein, 9 aa, Homo Sapiens
KRQSSSSKC

SEQ ID NO: 968193 - protein, 9 aa, Homo Sapiens
VQMKNTYQL

SEQ ID NO: 968194 - protein, 9 aa, Homo Sapiens
AVRREAKRQ

SEQ ID NO: 968195 - protein, 9 aa, Homo Sapiens
HFRLIYRGA

SEQ ID NO: 968196 - protein, 9 aa, Homo Sapiens
VAPLPQQRN

SEQ ID NO: 968197 - protein, 9 aa, Homo Sapiens
GFVLKRSKR

SEQ ID NO: 968198 - protein, 9 aa, Homo Sapiens
PNPNINPRD

SEQ ID NO: 968199 - protein, 9 aa, Homo Sapiens
QRRHGLGHG

SEQ ID NO: 968200 - protein, 9 aa, Homo Sapiens
GLRQEHYLS

SEQ ID NO: 968201 - protein, 9 aa, Homo Sapiens
LDMESTGCS

SEQ ID NO: 968202 - protein, 9 aa, Homo Sapiens
TTPGTPVTP

SEQ ID NO: 968203 - protein, 9 aa, Homo Sapiens
GPPGHQGLP

SEQ ID NO: 968204 - protein, 9 aa, Homo Sapiens
CERCEHQGQ

SEQ ID NO: 968205 - protein, 9 aa, Homo Sapiens
TNLKCTDCL

SEQ ID NO: 968206 - protein, 9 aa, Homo Sapiens
RHIFFFSWL

SEQ ID NO: 968207 - protein, 9 aa, Homo Sapiens
AAHEIKSPP

SEQ ID NO: 968208 - protein, 9 aa, Homo Sapiens
DKSEYLEMK

SEQ ID NO: 968209 - protein, 9 aa, Homo Sapiens
DEDDEKEEQ

SEQ ID NO: 968210 - protein, 9 aa, Homo Sapiens
LMLLILFSV

SEQ ID NO: 968211 - protein, 9 aa, Homo Sapiens
LDFFHIFHA

SEQ ID NO: 968212 - protein, 9 aa, Homo Sapiens
QRGNQSQGP

SEQ ID NO: 968213 - protein, 9 aa, Homo Sapiens
LIAKLQKME

SEQ ID NO: 968214 - protein, 9 aa, Homo Sapiens
KICILEKPF

SEQ ID NO: 968215 - protein, 9 aa, Homo Sapiens
KGFGELFEK

SEQ ID NO: 968216 - protein, 9 aa, Homo Sapiens
LFNFSNFLD

SEQ ID NO: 968217 - protein, 9 aa, Homo Sapiens
MLRLPPEAC

SEQ ID NO: 968218 - protein, 9 aa, Homo Sapiens
LGAHSPFTL

SEQ ID NO: 968219 - protein, 9 aa, Homo Sapiens
NHPSQTHVR

SEQ ID NO: 968220 - protein, 9 aa, Homo Sapiens
FPSSGNRSE

SEQ ID NO: 968221 - protein, 9 aa, Homo Sapiens
VSVKDAVPT

SEQ ID NO: 968222 - protein, 9 aa, Homo Sapiens
LALISVNKF

SEQ ID NO: 968223 - protein, 9 aa, Homo Sapiens
FSNSTNLLP

SEQ ID NO: 968224 - protein, 9 aa, Homo Sapiens
PLLSPDPTT

SEQ ID NO: 968225 - protein, 9 aa, Homo Sapiens
KNGEEPVPS

SEQ ID NO: 968226 - protein, 9 aa, Homo Sapiens
AGQAENEAG

SEQ ID NO: 968227 - protein, 9 aa, Homo Sapiens
LNFTRNSIA

SEQ ID NO: 968228 - protein, 9 aa, Homo Sapiens
SCNKNDAEH

SEQ ID NO: 968229 - protein, 9 aa, Homo Sapiens
IACRDTKFS

SEQ ID NO: 968230 - protein, 9 aa, Homo Sapiens
LHTLCVGRT

SEQ ID NO: 968231 - protein, 9 aa, Homo Sapiens
FLPYNEVLS

SEQ ID NO: 968232 - protein, 9 aa, Homo Sapiens
GPPAQKKST

SEQ ID NO: 968233 - protein, 9 aa, Homo Sapiens
NNEHIYGEK

SEQ ID NO: 968234 - protein, 9 aa, Homo Sapiens
LSDDMKVLC

SEQ ID NO: 968235 - protein, 9 aa, Homo Sapiens
AGSDMNFVY

SEQ ID NO: 968236 - protein, 9 aa, Homo Sapiens
NHGAFCLQW

SEQ ID NO: 968237 - protein, 9 aa, Homo Sapiens
AVLYSRFMG

SEQ ID NO: 968238 - protein, 9 aa, Homo Sapiens
ADDMISRYV

SEQ ID NO: 968239 - protein, 9 aa, Homo Sapiens
GRTWCKGTR

SEQ ID NO: 968240 - protein, 9 aa, Homo Sapiens
RRKAEAAMR

SEQ ID NO: 968241 - protein, 9 aa, Homo Sapiens
ASLRLKRRH

SEQ ID NO: 968242 - protein, 9 aa, Homo Sapiens
FSDGIVTVA

SEQ ID NO: 968243 - protein, 9 aa, Homo Sapiens
RLGKECARV

SEQ ID NO: 968244 - protein, 9 aa, Homo Sapiens
ESPLATGTD

SEQ ID NO: 968245 - protein, 9 aa, Homo Sapiens
VDCVIKGQK

SEQ ID NO: 968246 - protein, 9 aa, Homo Sapiens
AHGALLLAL

SEQ ID NO: 968247 - protein, 9 aa, Homo Sapiens
ELDNPAENK

SEQ ID NO: 968248 - protein, 9 aa, Homo Sapiens
NSRASAFRA

SEQ ID NO: 968249 - protein, 9 aa, Homo Sapiens
LGIYVITVV

SEQ ID NO: 968250 - protein, 9 aa, Homo Sapiens
TRWPDVAQT

SEQ ID NO: 968251 - protein, 9 aa, Homo Sapiens
GPGARSLPS

SEQ ID NO: 968252 - protein, 9 aa, Homo Sapiens
CSSEVSMPT

SEQ ID NO: 968253 - protein, 9 aa, Homo Sapiens
ECVAATFFV

SEQ ID NO: 968254 - protein, 9 aa, Homo Sapiens
RLFKRRQGK

SEQ ID NO: 968255 - protein, 9 aa, Homo Sapiens
TAHLVRTFD

SEQ ID NO: 968256 - protein, 9 aa, Homo Sapiens
ESMPSVRFL

SEQ ID NO: 968257 - protein, 9 aa, Homo Sapiens
STPFLTTKA

SEQ ID NO: 968258 - protein, 9 aa, Homo Sapiens
CNPGFEVVE

SEQ ID NO: 968259 - protein, 9 aa, Homo Sapiens
FPVPLECPT

SEQ ID NO: 968260 - protein, 9 aa, Homo Sapiens
EKPLSTFKD

SEQ ID NO: 968261 - protein, 9 aa, Homo Sapiens
SISLQDVYL

SEQ ID NO: 968262 - protein, 9 aa, Homo Sapiens
TQRREHELY

SEQ ID NO: 968263 - protein, 9 aa, Homo Sapiens
YYQQPPGLV

SEQ ID NO: 968264 - protein, 9 aa, Homo Sapiens
ITPNACLQS

SEQ ID NO: 968265 - protein, 9 aa, Homo Sapiens
HMGLEGLAL

SEQ ID NO: 968266 - protein, 9 aa, Homo Sapiens
RKQGYEHLH

SEQ ID NO: 968267 - protein, 9 aa, Homo Sapiens
LPLRKELDC

SEQ ID NO: 968268 - protein, 9 aa, Homo Sapiens
ASSPSFFQQ

SEQ ID NO: 968269 - protein, 9 aa, Homo Sapiens
TGSRTTERR

SEQ ID NO: 968270 - protein, 9 aa, Homo Sapiens
GANPFYCDC

SEQ ID NO: 968271 - protein, 9 aa, Homo Sapiens
QIYNLNSHR

SEQ ID NO: 968272 - protein, 9 aa, Homo Sapiens
KFSNREYET

SEQ ID NO: 968273 - protein, 9 aa, Homo Sapiens
SSERFNMGE

SEQ ID NO: 968274 - protein, 9 aa, Homo Sapiens
QLGNISFKK

SEQ ID NO: 968275 - protein, 9 aa, Homo Sapiens
PIPTPLPPP

SEQ ID NO: 968276 - protein, 9 aa, Homo Sapiens
LEIVFNLEE

SEQ ID NO: 968277 - protein, 9 aa, Homo Sapiens
LQSPYRSVR

SEQ ID NO: 968278 - protein, 9 aa, Homo Sapiens
EAQRRLRFN

SEQ ID NO: 968279 - protein, 9 aa, Homo Sapiens
LHSTPMLAL

SEQ ID NO: 968280 - protein, 9 aa, Homo Sapiens
WGKLQTQSL

SEQ ID NO: 968281 - protein, 9 aa, Homo Sapiens
NPSMILIEK

SEQ ID NO: 968282 - protein, 9 aa, Homo Sapiens
QKFQGVGLL

SEQ ID NO: 968283 - protein, 9 aa, Homo Sapiens
RREHELYVV

SEQ ID NO: 968284 - protein, 9 aa, Homo Sapiens
LTEEMYEDI

SEQ ID NO: 968285 - protein, 9 aa, Homo Sapiens
QERENLTVY

SEQ ID NO: 968286 - protein, 9 aa, Homo Sapiens
KQHCYSKNQ

SEQ ID NO: 968287 - protein, 9 aa, Homo Sapiens
LFCAWEGCM

SEQ ID NO: 968288 - protein, 9 aa, Homo Sapiens
LNARLIRNL

SEQ ID NO: 968289 - protein, 9 aa, Homo Sapiens
YRKRRVLLI

SEQ ID NO: 968290 - protein, 9 aa, Homo Sapiens
EDQHKNQRR

SEQ ID NO: 968291 - protein, 9 aa, Homo Sapiens
FVGVDSLNL

SEQ ID NO: 968292 - protein, 9 aa, Homo Sapiens
RHSVISESE

SEQ ID NO: 968293 - protein, 9 aa, Homo Sapiens
KTRTKSTVS

SEQ ID NO: 968294 - protein, 9 aa, Homo Sapiens
AVAFADFYP

SEQ ID NO: 968295 - protein, 9 aa, Homo Sapiens
SYMLVHAEV

SEQ ID NO: 968296 - protein, 9 aa, Homo Sapiens
HLSNSLDPP

SEQ ID NO: 968297 - protein, 9 aa, Homo Sapiens
DSLVRDHEQ

SEQ ID NO: 968298 - protein, 9 aa, Homo Sapiens
SLESQVRRA

SEQ ID NO: 968299 - protein, 9 aa, Homo Sapiens
SRSLGRPTS

SEQ ID NO: 968300 - protein, 9 aa, Homo Sapiens
AQKKSTGSS

SEQ ID NO: 968301 - protein, 9 aa, Homo Sapiens
DCFSAMDWP

SEQ ID NO: 968302 - protein, 9 aa, Homo Sapiens
RAPPSLGVP

SEQ ID NO: 968303 - protein, 9 aa, Homo Sapiens
EDKPAPGEW

SEQ ID NO: 968304 - protein, 9 aa, Homo Sapiens
HCRPKYSFC

SEQ ID NO: 968305 - protein, 9 aa, Homo Sapiens
RIKNSGLAS

SEQ ID NO: 968306 - protein, 9 aa, Homo Sapiens
PETMTRAES

SEQ ID NO: 968307 - protein, 9 aa, Homo Sapiens
RLRSAGQGR

SEQ ID NO: 968308 - protein, 9 aa, Homo Sapiens
IWIENLNSI

SEQ ID NO: 968309 - protein, 9 aa, Homo Sapiens
APLCATYWD

SEQ ID NO: 968310 - protein, 9 aa, Homo Sapiens
TNTGFLQTL

SEQ ID NO: 968311 - protein, 9 aa, Homo Sapiens
HWKPEGRVG

SEQ ID NO: 968312 - protein, 9 aa, Homo Sapiens
RTSFLENHD

SEQ ID NO: 968313 - protein, 9 aa, Homo Sapiens
EIEIQKQES

SEQ ID NO: 968314 - protein, 9 aa, Homo Sapiens
FLLHSLRPS

SEQ ID NO: 968315 - protein, 9 aa, Homo Sapiens
WADRGAAPL

SEQ ID NO: 968316 - protein, 9 aa, Homo Sapiens
DIFPGAAGG

SEQ ID NO: 968317 - protein, 9 aa, Homo Sapiens
CCLSLTVGA

SEQ ID NO: 968318 - protein, 9 aa, Homo Sapiens
QGKGISGTF

SEQ ID NO: 968319 - protein, 9 aa, Homo Sapiens
ELFLTYVEG

SEQ ID NO: 968320 - protein, 9 aa, Homo Sapiens
LEMKEGVKE

SEQ ID NO: 968321 - protein, 9 aa, Homo Sapiens
TLNTGKECE

SEQ ID NO: 968322 - protein, 9 aa, Homo Sapiens
EIPGNAIVI

SEQ ID NO: 968323 - protein, 9 aa, Homo Sapiens
HHAAGQAEN

SEQ ID NO: 968324 - protein, 9 aa, Homo Sapiens
SVRLSFSDF

SEQ ID NO: 968325 - protein, 9 aa, Homo Sapiens
MPKLEGDLT

SEQ ID NO: 968326 - protein, 9 aa, Homo Sapiens
RGAPRIPGQ

SEQ ID NO: 968327 - protein, 9 aa, Homo Sapiens
ELKTRGRAV

SEQ ID NO: 968328 - protein, 9 aa, Homo Sapiens
AALSCNKND

SEQ ID NO: 968329 - protein, 9 aa, Homo Sapiens
EPLNQVTES

SEQ ID NO: 968330 - protein, 9 aa, Homo Sapiens
RFELRNRSD

SEQ ID NO: 968331 - protein, 9 aa, Homo Sapiens
SYSKGQLRE

SEQ ID NO: 968332 - protein, 9 aa, Homo Sapiens
VCMGTKTTV

SEQ ID NO: 968333 - protein, 9 aa, Homo Sapiens
LYANINFSN

SEQ ID NO: 968334 - protein, 9 aa, Homo Sapiens
PIFGRNELE

SEQ ID NO: 968335 - protein, 9 aa, Homo Sapiens
FKIHVRKLL

SEQ ID NO: 968336 - protein, 9 aa, Homo Sapiens
IYCIKEGVK

SEQ ID NO: 968337 - protein, 9 aa, Homo Sapiens
PKMRPLHKK

SEQ ID NO: 968338 - protein, 9 aa, Homo Sapiens
NLGIVGLLL

SEQ ID NO: 968339 - protein, 9 aa, Homo Sapiens
GAPAAAKSG

SEQ ID NO: 968340 - protein, 9 aa, Homo Sapiens
PGARSLPSS

SEQ ID NO: 968341 - protein, 9 aa, Homo Sapiens
MDCKSSKRA

SEQ ID NO: 968342 - protein, 9 aa, Homo Sapiens
GSSSSATLP

SEQ ID NO: 968343 - protein, 9 aa, Homo Sapiens
PPRGFCPEQ

SEQ ID NO: 968344 - protein, 9 aa, Homo Sapiens
IYVITVVGN

SEQ ID NO: 968345 - protein, 9 aa, Homo Sapiens
SFSDSATRD

SEQ ID NO: 968346 - protein, 9 aa, Homo Sapiens
INSVTTDFS

SEQ ID NO: 968347 - protein, 9 aa, Homo Sapiens
KLNSLSVPF

SEQ ID NO: 968348 - protein, 9 aa, Homo Sapiens
TLQHERPQP

SEQ ID NO: 968349 - protein, 9 aa, Homo Sapiens
RRKKAFTTI

SEQ ID NO: 968350 - protein, 9 aa, Homo Sapiens
PNLIEKQKK

SEQ ID NO: 968351 - protein, 9 aa, Homo Sapiens
NLSVFKLIT

SEQ ID NO: 968352 - protein, 9 aa, Homo Sapiens
EKRKINVSE

SEQ ID NO: 968353 - protein, 9 aa, Homo Sapiens
EAPEAEGPL

SEQ ID NO: 968354 - protein, 9 aa, Homo Sapiens
SERREKFFG

SEQ ID NO: 968355 - protein, 9 aa, Homo Sapiens
PGPGIGGDI

SEQ ID NO: 968356 - protein, 9 aa, Homo Sapiens
RSSLSKDGR

SEQ ID NO: 968357 - protein, 9 aa, Homo Sapiens
ELLCRYLTT

SEQ ID NO: 968358 - protein, 9 aa, Homo Sapiens
SSKCHPPAC

SEQ ID NO: 968359 - protein, 9 aa, Homo Sapiens
PRPIMPNTV

SEQ ID NO: 968360 - protein, 9 aa, Homo Sapiens
QDPAGRDGA

SEQ ID NO: 968361 - protein, 9 aa, Homo Sapiens
NTLFNFSNF

SEQ ID NO: 968362 - protein, 9 aa, Homo Sapiens
MVWGHLPSR

SEQ ID NO: 968363 - protein, 9 aa, Homo Sapiens
TKEKPAKSE

SEQ ID NO: 968364 - protein, 9 aa, Homo Sapiens
SRARCMLAG

SEQ ID NO: 968365 - protein, 9 aa, Homo Sapiens
KLEDYANLK

SEQ ID NO: 968366 - protein, 9 aa, Homo Sapiens
AEAATREQR

SEQ ID NO: 968367 - protein, 9 aa, Homo Sapiens
AALTLQHER

SEQ ID NO: 968368 - protein, 9 aa, Homo Sapiens
GSNALENNG

SEQ ID NO: 968369 - protein, 9 aa, Homo Sapiens
SYSQIASSI

SEQ ID NO: 968370 - protein, 9 aa, Homo Sapiens
KFSPEKKNK

SEQ ID NO: 968371 - protein, 9 aa, Homo Sapiens
CEKTTVFKF

SEQ ID NO: 968372 - protein, 9 aa, Homo Sapiens
WITSTKTLF

SEQ ID NO: 968373 - protein, 9 aa, Homo Sapiens
EPPSVASTC

SEQ ID NO: 968374 - protein, 9 aa, Homo Sapiens
LFNCSAFLD

SEQ ID NO: 968375 - protein, 9 aa, Homo Sapiens
KENSVKTVR

SEQ ID NO: 968376 - protein, 9 aa, Homo Sapiens
DGVRGPTGP

SEQ ID NO: 968377 - protein, 9 aa, Homo Sapiens
PRARGPFAS

SEQ ID NO: 968378 - protein, 9 aa, Homo Sapiens
RYTCVAKNA

SEQ ID NO: 968379 - protein, 9 aa, Homo Sapiens
APLYGQMII

SEQ ID NO: 968380 - protein, 9 aa, Homo Sapiens
RAAFLNYLN

SEQ ID NO: 968381 - protein, 9 aa, Homo Sapiens
EFEFLKTCN

SEQ ID NO: 968382 - protein, 9 aa, Homo Sapiens
SGKGLGKKW

SEQ ID NO: 968383 - protein, 9 aa, Homo Sapiens
LGPSLEDFF

SEQ ID NO: 968384 - protein, 9 aa, Homo Sapiens
PRVKRPIGN

SEQ ID NO: 968385 - protein, 9 aa, Homo Sapiens
REQGTGRKD

SEQ ID NO: 968386 - protein, 9 aa, Homo Sapiens
CEKARQGLA

SEQ ID NO: 968387 - protein, 9 aa, Homo Sapiens
SKVNYLKEL

SEQ ID NO: 968388 - protein, 9 aa, Homo Sapiens
HTISPTFPP

SEQ ID NO: 968389 - protein, 9 aa, Homo Sapiens
SAVEMRPDK

SEQ ID NO: 968390 - protein, 9 aa, Homo Sapiens
VLDKALDQE

SEQ ID NO: 968391 - protein, 9 aa, Homo Sapiens
SVSTFLFFK

SEQ ID NO: 968392 - protein, 9 aa, Homo Sapiens
LVSLASFEN

SEQ ID NO: 968393 - protein, 9 aa, Homo Sapiens
YLTCGEESS

SEQ ID NO: 968394 - protein, 9 aa, Homo Sapiens
TENSILGRD

SEQ ID NO: 968395 - protein, 9 aa, Homo Sapiens
HKNQRRNLR

SEQ ID NO: 968396 - protein, 9 aa, Homo Sapiens
CPPCGLHAP

SEQ ID NO: 968397 - protein, 9 aa, Homo Sapiens
SGGVAERHG

SEQ ID NO: 968398 - protein, 9 aa, Homo Sapiens
GKAVQQPDR

SEQ ID NO: 968399 - protein, 9 aa, Homo Sapiens
SQSPAENRG

SEQ ID NO: 968400 - protein, 9 aa, Homo Sapiens
ASTTTAMST

SEQ ID NO: 968401 - protein, 9 aa, Homo Sapiens
KLQTQSLGT

SEQ ID NO: 968402 - protein, 9 aa, Homo Sapiens
HVRKLLTPS

SEQ ID NO: 968403 - protein, 9 aa, Homo Sapiens
KKKGKTVPE

SEQ ID NO: 968404 - protein, 9 aa, Homo Sapiens
LNLGPPQGN

SEQ ID NO: 968405 - protein, 9 aa, Homo Sapiens
LLQAVLYSR

SEQ ID NO: 968406 - protein, 9 aa, Homo Sapiens
WLNKTNSCP

SEQ ID NO: 968407 - protein, 9 aa, Homo Sapiens
SPAGSREAS

SEQ ID NO: 968408 - protein, 9 aa, Homo Sapiens
PRRGPEHRS

SEQ ID NO: 968409 - protein, 9 aa, Homo Sapiens
GLPWDFVRR

SEQ ID NO: 968410 - protein, 9 aa, Homo Sapiens
PSLEDFFNF

SEQ ID NO: 968411 - protein, 9 aa, Homo Sapiens
TTPTQSEKE

SEQ ID NO: 968412 - protein, 9 aa, Homo Sapiens
LKFLLSNLD

SEQ ID NO: 968413 - protein, 9 aa, Homo Sapiens
DGAFYAFPS

SEQ ID NO: 968414 - protein, 9 aa, Homo Sapiens
DKEAGEKLS

SEQ ID NO: 968415 - protein, 9 aa, Homo Sapiens
IQSLLNQKI

SEQ ID NO: 968416 - protein, 9 aa, Homo Sapiens
KSHFERHRR

SEQ ID NO: 968417 - protein, 9 aa, Homo Sapiens
LIQDLNNCS

SEQ ID NO: 968418 - protein, 9 aa, Homo Sapiens
GKQNFHKAR

SEQ ID NO: 968419 - protein, 9 aa, Homo Sapiens
FSYPDPSQW

SEQ ID NO: 968420 - protein, 9 aa, Homo Sapiens
LKRSKRLQC

SEQ ID NO: 968421 - protein, 9 aa, Homo Sapiens
ALCNRTFKK

SEQ ID NO: 968422 - protein, 9 aa, Homo Sapiens
SPLGSPPGK

SEQ ID NO: 968423 - protein, 9 aa, Homo Sapiens
ISEVEEWYK

SEQ ID NO: 968424 - protein, 9 aa, Homo Sapiens
FVHHQELKP

SEQ ID NO: 968425 - protein, 9 aa, Homo Sapiens
LFLNELNKY

SEQ ID NO: 968426 - protein, 9 aa, Homo Sapiens
SLQQELGLI

SEQ ID NO: 968427 - protein, 9 aa, Homo Sapiens
NFKMQVYSG

SEQ ID NO: 968428 - protein, 9 aa, Homo Sapiens
PLGDAAGHP

SEQ ID NO: 968429 - protein, 9 aa, Homo Sapiens
FSRIECESP

SEQ ID NO: 968430 - protein, 9 aa, Homo Sapiens
VHPKMRPLH

SEQ ID NO: 968431 - protein, 9 aa, Homo Sapiens
QLRSATSQI

SEQ ID NO: 968432 - protein, 9 aa, Homo Sapiens
LNKHQKIYN

SEQ ID NO: 968433 - protein, 9 aa, Homo Sapiens
VFFYHVKNN

SEQ ID NO: 968434 - protein, 9 aa, Homo Sapiens
GLTVTSEQI

SEQ ID NO: 968435 - protein, 9 aa, Homo Sapiens
PVHFRLIYR

SEQ ID NO: 968436 - protein, 9 aa, Homo Sapiens
FHSLLTAFL

SEQ ID NO: 968437 - protein, 9 aa, Homo Sapiens
FSALWVLLL

SEQ ID NO: 968438 - protein, 9 aa, Homo Sapiens
GNESEVVTA

SEQ ID NO: 968439 - protein, 9 aa, Homo Sapiens
QPFYSSEVF

SEQ ID NO: 968440 - protein, 9 aa, Homo Sapiens
IRSAPSFSD

SEQ ID NO: 968441 - protein, 9 aa, Homo Sapiens
GGLSRGAAA

SEQ ID NO: 968442 - protein, 9 aa, Homo Sapiens
SLTSEKDPL

SEQ ID NO: 968443 - protein, 9 aa, Homo Sapiens
RINSSNPLR

SEQ ID NO: 968444 - protein, 9 aa, Homo Sapiens
PRPFPCAQC

SEQ ID NO: 968445 - protein, 9 aa, Homo Sapiens
PCNPGFEVV

SEQ ID NO: 968446 - protein, 9 aa, Homo Sapiens
DGDDCDCLH

SEQ ID NO: 968447 - protein, 9 aa, Homo Sapiens
PVASEEKTS

SEQ ID NO: 968448 - protein, 9 aa, Homo Sapiens
GGDREALIS

SEQ ID NO: 968449 - protein, 9 aa, Homo Sapiens
ILDFRRVPL

SEQ ID NO: 968450 - protein, 9 aa, Homo Sapiens
HKSWLWQHD

SEQ ID NO: 968451 - protein, 9 aa, Homo Sapiens
VKNKQESDC

SEQ ID NO: 968452 - protein, 9 aa, Homo Sapiens
VLFKESRYS

SEQ ID NO: 968453 - protein, 9 aa, Homo Sapiens
MAPYTGPDF

SEQ ID NO: 968454 - protein, 9 aa, Homo Sapiens
EALVRRLQK

SEQ ID NO: 968455 - protein, 9 aa, Homo Sapiens
ETSDLYADD

SEQ ID NO: 968456 - protein, 9 aa, Homo Sapiens
GRVGGVLGA

SEQ ID NO: 968457 - protein, 9 aa, Homo Sapiens
QPDNIVFVM

SEQ ID NO: 968458 - protein, 9 aa, Homo Sapiens
RFLGLCLED

SEQ ID NO: 968459 - protein, 9 aa, Homo Sapiens
GIAPLVCLL

SEQ ID NO: 968460 - protein, 9 aa, Homo Sapiens
PGALIRPSQ

SEQ ID NO: 968461 - protein, 9 aa, Homo Sapiens
SLKKIRKTV

SEQ ID NO: 968462 - protein, 9 aa, Homo Sapiens
FSEAPEEDQ

SEQ ID NO: 968463 - protein, 9 aa, Homo Sapiens
APWDPLGCQ

SEQ ID NO: 968464 - protein, 9 aa, Homo Sapiens
AGLSQANFI

SEQ ID NO: 968465 - protein, 9 aa, Homo Sapiens
LNDIYFVVG

SEQ ID NO: 968466 - protein, 9 aa, Homo Sapiens
ERTILISAA

SEQ ID NO: 968467 - protein, 9 aa, Homo Sapiens
TLNKHQKIY

SEQ ID NO: 968468 - protein, 9 aa, Homo Sapiens
FLSKANCLP

SEQ ID NO: 968469 - protein, 9 aa, Homo Sapiens
RIPGQPGLP

SEQ ID NO: 968470 - protein, 9 aa, Homo Sapiens
EEEVCGDQI

SEQ ID NO: 968471 - protein, 9 aa, Homo Sapiens
CPAPWASLE

SEQ ID NO: 968472 - protein, 9 aa, Homo Sapiens
FVGGTYFLP

SEQ ID NO: 968473 - protein, 9 aa, Homo Sapiens
SRASAFRAA

SEQ ID NO: 968474 - protein, 9 aa, Homo Sapiens
SVVNAHLLS

SEQ ID NO: 968475 - protein, 9 aa, Homo Sapiens
PGGMDESTI

SEQ ID NO: 968476 - protein, 9 aa, Homo Sapiens
ASEEKTSGS

SEQ ID NO: 968477 - protein, 9 aa, Homo Sapiens
SEVEEWYKS

SEQ ID NO: 968478 - protein, 9 aa, Homo Sapiens
GRLVTHKSW

SEQ ID NO: 968479 - protein, 9 aa, Homo Sapiens
FCRLDDKTT

SEQ ID NO: 968480 - protein, 9 aa, Homo Sapiens
REEDGYTHQ

SEQ ID NO: 968481 - protein, 9 aa, Homo Sapiens
DNKCKESEN

SEQ ID NO: 968482 - protein, 9 aa, Homo Sapiens
VDECETQGL

SEQ ID NO: 968483 - protein, 9 aa, Homo Sapiens
NEWDKYLES

SEQ ID NO: 968484 - protein, 9 aa, Homo Sapiens
KTTVFKFLG

SEQ ID NO: 968485 - protein, 9 aa, Homo Sapiens
KSKKKKRHK

SEQ ID NO: 968486 - protein, 9 aa, Homo Sapiens
LHFKSSTHN

SEQ ID NO: 968487 - protein, 9 aa, Homo Sapiens
WPLPFSIAT

SEQ ID NO: 968488 - protein, 9 aa, Homo Sapiens
RAFYFQCVQ

SEQ ID NO: 968489 - protein, 9 aa, Homo Sapiens
CRPKYSFCR

SEQ ID NO: 968490 - protein, 9 aa, Homo Sapiens
SKPKPRLFM

SEQ ID NO: 968491 - protein, 9 aa, Homo Sapiens
KCVKLDRLR

SEQ ID NO: 968492 - protein, 9 aa, Homo Sapiens
VGFYMAKPD

SEQ ID NO: 968493 - protein, 9 aa, Homo Sapiens
FLQSPYRSV

SEQ ID NO: 968494 - protein, 9 aa, Homo Sapiens
QLIAKLQKM

SEQ ID NO: 968495 - protein, 9 aa, Homo Sapiens
ISAFSHTMS

SEQ ID NO: 968496 - protein, 9 aa, Homo Sapiens
KEGVKESLC

SEQ ID NO: 968497 - protein, 9 aa, Homo Sapiens
GLALISVNK

SEQ ID NO: 968498 - protein, 9 aa, Homo Sapiens
KQTESFSDG

SEQ ID NO: 968499 - protein, 9 aa, Homo Sapiens
KVALLWHSS

SEQ ID NO: 968500 - protein, 9 aa, Homo Sapiens
TLEVTAMAF

SEQ ID NO: 968501 - protein, 9 aa, Homo Sapiens
NVKLALDGE

SEQ ID NO: 968502 - protein, 9 aa, Homo Sapiens
DSDVEYEIR

SEQ ID NO: 968503 - protein, 9 aa, Homo Sapiens
KSFSKGDIW

SEQ ID NO: 968504 - protein, 9 aa, Homo Sapiens
SNLFPGGIL

SEQ ID NO: 968505 - protein, 9 aa, Homo Sapiens
NLAPYPLVR

SEQ ID NO: 968506 - protein, 9 aa, Homo Sapiens
CLKDELSHQ

SEQ ID NO: 968507 - protein, 9 aa, Homo Sapiens
QHHLDSSSA

SEQ ID NO: 968508 - protein, 9 aa, Homo Sapiens
KRSKRLQCG

SEQ ID NO: 968509 - protein, 9 aa, Homo Sapiens
TLKIKNEMA

SEQ ID NO: 968510 - protein, 9 aa, Homo Sapiens
NLKNIPNLT

SEQ ID NO: 968511 - protein, 9 aa, Homo Sapiens
RCFNLIDDS

SEQ ID NO: 968512 - protein, 9 aa, Homo Sapiens
FKERNEGHD

SEQ ID NO: 968513 - protein, 9 aa, Homo Sapiens
CRDTKFSDK

SEQ ID NO: 968514 - protein, 9 aa, Homo Sapiens
KADYKRRLQ

SEQ ID NO: 968515 - protein, 9 aa, Homo Sapiens
RPSKKRAPA

SEQ ID NO: 968516 - protein, 9 aa, Homo Sapiens
STLGNPGKT

SEQ ID NO: 968517 - protein, 9 aa, Homo Sapiens
DVPSGRSCR

SEQ ID NO: 968518 - protein, 9 aa, Homo Sapiens
LYNTKILKQ

SEQ ID NO: 968519 - protein, 9 aa, Homo Sapiens
NGEEPVPSE

SEQ ID NO: 968520 - protein, 9 aa, Homo Sapiens
PDSALRCPG

SEQ ID NO: 968521 - protein, 9 aa, Homo Sapiens
FNLTAQNYV

SEQ ID NO: 968522 - protein, 9 aa, Homo Sapiens
LLYRLLITV

SEQ ID NO: 968523 - protein, 9 aa, Homo Sapiens
AAFPSQSSL

SEQ ID NO: 968524 - protein, 9 aa, Homo Sapiens
LLEDISLLE

SEQ ID NO: 968525 - protein, 9 aa, Homo Sapiens
FYVPDMKLS

SEQ ID NO: 968526 - protein, 9 aa, Homo Sapiens
TKNGEEPVP

SEQ ID NO: 968527 - protein, 9 aa, Homo Sapiens
GSNELMIFA

SEQ ID NO: 968528 - protein, 9 aa, Homo Sapiens
QLKELHLSG

SEQ ID NO: 968529 - protein, 9 aa, Homo Sapiens
PERTLSLSS

SEQ ID NO: 968530 - protein, 9 aa, Homo Sapiens
QLLPKFREN

SEQ ID NO: 968531 - protein, 9 aa, Homo Sapiens
YSSEGLDCL

SEQ ID NO: 968532 - protein, 9 aa, Homo Sapiens
LDLAALKVA

SEQ ID NO: 968533 - protein, 9 aa, Homo Sapiens
KSGPGAYEL

SEQ ID NO: 968534 - protein, 9 aa, Homo Sapiens
SFVGVGKSI

SEQ ID NO: 968535 - protein, 9 aa, Homo Sapiens
FFSTAFCLF

SEQ ID NO: 968536 - protein, 9 aa, Homo Sapiens
CDCLHPEDY

SEQ ID NO: 968537 - protein, 9 aa, Homo Sapiens
TRDAPPKKE

SEQ ID NO: 968538 - protein, 9 aa, Homo Sapiens
LLLLSSQIL

SEQ ID NO: 968539 - protein, 9 aa, Homo Sapiens
QDPAIVQSF

SEQ ID NO: 968540 - protein, 9 aa, Homo Sapiens
PFQDTDGTK

SEQ ID NO: 968541 - protein, 9 aa, Homo Sapiens
ARLIRNLQE

SEQ ID NO: 968542 - protein, 9 aa, Homo Sapiens
AVKKSSTVA

SEQ ID NO: 968543 - protein, 9 aa, Homo Sapiens
MYFLRGSFP

SEQ ID NO: 968544 - protein, 9 aa, Homo Sapiens
SSEVLVKTL

SEQ ID NO: 968545 - protein, 9 aa, Homo Sapiens
EQLEFRIVE

SEQ ID NO: 968546 - protein, 9 aa, Homo Sapiens
DCLDEDGNT

SEQ ID NO: 968547 - protein, 9 aa, Homo Sapiens
AEKFRLELS

SEQ ID NO: 968548 - protein, 9 aa, Homo Sapiens
PSGMRPPRP

SEQ ID NO: 968549 - protein, 9 aa, Homo Sapiens
KTLEDNQVQ

SEQ ID NO: 968550 - protein, 9 aa, Homo Sapiens
FGHGAREAE

SEQ ID NO: 968551 - protein, 9 aa, Homo Sapiens
ILLPSSILS

SEQ ID NO: 968552 - protein, 9 aa, Homo Sapiens
CGSTQIWQH

SEQ ID NO: 968553 - protein, 9 aa, Homo Sapiens
DGYTHQWTV

SEQ ID NO: 968554 - protein, 9 aa, Homo Sapiens
QSSFASQSR

SEQ ID NO: 968555 - protein, 9 aa, Homo Sapiens
SEPARHIFF

SEQ ID NO: 968556 - protein, 9 aa, Homo Sapiens
VTIVGNLDM

SEQ ID NO: 968557 - protein, 9 aa, Homo Sapiens
PQYFFPQGY

SEQ ID NO: 968558 - protein, 9 aa, Homo Sapiens
RAAAMVSSG

SEQ ID NO: 968559 - protein, 9 aa, Homo Sapiens
VALGKLRRK

SEQ ID NO: 968560 - protein, 9 aa, Homo Sapiens
EWGPRSTPF

SEQ ID NO: 968561 - protein, 9 aa, Homo Sapiens
AHVGGIVGQ

SEQ ID NO: 968562 - protein, 9 aa, Homo Sapiens
PFLLILAPL

SEQ ID NO: 968563 - protein, 9 aa, Homo Sapiens
FRIEPGVFV

SEQ ID NO: 968564 - protein, 9 aa, Homo Sapiens
AAMVSSGGV

SEQ ID NO: 968565 - protein, 9 aa, Homo Sapiens
QDRSKFIGQ

SEQ ID NO: 968566 - protein, 9 aa, Homo Sapiens
LHSPTMQQR

SEQ ID NO: 968567 - protein, 9 aa, Homo Sapiens
QHQIHNVEI

SEQ ID NO: 968568 - protein, 9 aa, Homo Sapiens
LLQIWRKQG

SEQ ID NO: 968569 - protein, 9 aa, Homo Sapiens
LPFPQDPYP

SEQ ID NO: 968570 - protein, 9 aa, Homo Sapiens
QRPQKPAAF

SEQ ID NO: 968571 - protein, 9 aa, Homo Sapiens
YSLTNMKGN

SEQ ID NO: 968572 - protein, 9 aa, Homo Sapiens
VCLLRISTI

SEQ ID NO: 968573 - protein, 9 aa, Homo Sapiens
QETSEGVRG

SEQ ID NO: 968574 - protein, 9 aa, Homo Sapiens
LFSDGIVTV

SEQ ID NO: 968575 - protein, 9 aa, Homo Sapiens
SFGWAFCLL

SEQ ID NO: 968576 - protein, 9 aa, Homo Sapiens
RPDGSGAPR

SEQ ID NO: 968577 - protein, 9 aa, Homo Sapiens
GLISQELLR

SEQ ID NO: 968578 - protein, 9 aa, Homo Sapiens
KVKNLHLPW

SEQ ID NO: 968579 - protein, 9 aa, Homo Sapiens
QPNPNINPR

SEQ ID NO: 968580 - protein, 9 aa, Homo Sapiens
LSPLWRQIR

SEQ ID NO: 968581 - protein, 9 aa, Homo Sapiens
YLLSYYPLE

SEQ ID NO: 968582 - protein, 9 aa, Homo Sapiens
TTRSVLGLL

SEQ ID NO: 968583 - protein, 9 aa, Homo Sapiens
KGISGTFVP

SEQ ID NO: 968584 - protein, 9 aa, Homo Sapiens
KSFPKDPQH

SEQ ID NO: 968585 - protein, 9 aa, Homo Sapiens
SAPSFSDSA

SEQ ID NO: 968586 - protein, 9 aa, Homo Sapiens
WWVGLPEVE

SEQ ID NO: 968587 - protein, 9 aa, Homo Sapiens
SMREVIGLE

SEQ ID NO: 968588 - protein, 9 aa, Homo Sapiens
SFLRNVLSS

SEQ ID NO: 968589 - protein, 9 aa, Homo Sapiens
TQEQFQDVL

SEQ ID NO: 968590 - protein, 9 aa, Homo Sapiens
VFKFLGMAV

SEQ ID NO: 968591 - protein, 9 aa, Homo Sapiens
LFFRTPKIV

SEQ ID NO: 968592 - protein, 9 aa, Homo Sapiens
TWCKGTRHT

SEQ ID NO: 968593 - protein, 9 aa, Homo Sapiens
CMSVTRYLA

SEQ ID NO: 968594 - protein, 9 aa, Homo Sapiens
DPKTVGLIH

SEQ ID NO: 968595 - protein, 9 aa, Homo Sapiens
LEMELSWKR

SEQ ID NO: 968596 - protein, 9 aa, Homo Sapiens
RAFMKILEK

SEQ ID NO: 968597 - protein, 9 aa, Homo Sapiens
SYDLKVSAH

SEQ ID NO: 968598 - protein, 9 aa, Homo Sapiens
CFCSDGREC

SEQ ID NO: 968599 - protein, 9 aa, Homo Sapiens
TLLTYHRVV

SEQ ID NO: 968600 - protein, 9 aa, Homo Sapiens
RAGAICPEK

SEQ ID NO: 968601 - protein, 9 aa, Homo Sapiens
APWASLESQ

SEQ ID NO: 968602 - protein, 9 aa, Homo Sapiens
SVPMQVLLE

SEQ ID NO: 968603 - protein, 9 aa, Homo Sapiens
WEHMGQETG

SEQ ID NO: 968604 - protein, 9 aa, Homo Sapiens
HQKIYSGEK

SEQ ID NO: 968605 - protein, 9 aa, Homo Sapiens
WADIPASKR

SEQ ID NO: 968606 - protein, 9 aa, Homo Sapiens
LEEVAPNPA

SEQ ID NO: 968607 - protein, 9 aa, Homo Sapiens
ALTLQHERP

SEQ ID NO: 968608 - protein, 9 aa, Homo Sapiens
PNFSALLPF

SEQ ID NO: 968609 - protein, 9 aa, Homo Sapiens
AFLAEKFKV

SEQ ID NO: 968610 - protein, 9 aa, Homo Sapiens
LVSREPGSG

SEQ ID NO: 968611 - protein, 9 aa, Homo Sapiens
YDGNKQCEF

SEQ ID NO: 968612 - protein, 9 aa, Homo Sapiens
LSIPNSNMS

SEQ ID NO: 968613 - protein, 9 aa, Homo Sapiens
TVTKVSLCE

SEQ ID NO: 968614 - protein, 9 aa, Homo Sapiens
LVFIKIAFD

SEQ ID NO: 968615 - protein, 9 aa, Homo Sapiens
TAILTQDFL

SEQ ID NO: 968616 - protein, 9 aa, Homo Sapiens
QANFILGPV

SEQ ID NO: 968617 - protein, 9 aa, Homo Sapiens
PYLCCLLLL

SEQ ID NO: 968618 - protein, 9 aa, Homo Sapiens
LETTDEPPP

SEQ ID NO: 968619 - protein, 9 aa, Homo Sapiens
REDPQARLL

SEQ ID NO: 968620 - protein, 9 aa, Homo Sapiens
FNPQPFLNE

SEQ ID NO: 968621 - protein, 9 aa, Homo Sapiens
SGLHTDGHS

SEQ ID NO: 968622 - protein, 9 aa, Homo Sapiens
LFHYSEGLF

SEQ ID NO: 968623 - protein, 9 aa, Homo Sapiens
LPCCLWPRS

SEQ ID NO: 968624 - protein, 9 aa, Homo Sapiens
RSLGRPTSP

SEQ ID NO: 968625 - protein, 9 aa, Homo Sapiens
KRVPLNYAE

SEQ ID NO: 968626 - protein, 9 aa, Homo Sapiens
SASKRRSSL

SEQ ID NO: 968627 - protein, 9 aa, Homo Sapiens
QSPTQPSSG

SEQ ID NO: 968628 - protein, 9 aa, Homo Sapiens
KNADVWPPF

SEQ ID NO: 968629 - protein, 9 aa, Homo Sapiens
FWMYLLAGL

SEQ ID NO: 968630 - protein, 9 aa, Homo Sapiens
CVSVLSEHP

SEQ ID NO: 968631 - protein, 9 aa, Homo Sapiens
ASEKQNINI

SEQ ID NO: 968632 - protein, 9 aa, Homo Sapiens
IWVVLRFMD

SEQ ID NO: 968633 - protein, 9 aa, Homo Sapiens
SLPAVARCF

SEQ ID NO: 968634 - protein, 9 aa, Homo Sapiens
PFRPQICSE

SEQ ID NO: 968635 - protein, 9 aa, Homo Sapiens
LQENSQKVG

SEQ ID NO: 968636 - protein, 9 aa, Homo Sapiens
ADEIELPQL

SEQ ID NO: 968637 - protein, 9 aa, Homo Sapiens
ACEKARQGL

SEQ ID NO: 968638 - protein, 9 aa, Homo Sapiens
LLQLRDDAP

SEQ ID NO: 968639 - protein, 9 aa, Homo Sapiens
GLLTNKAVL

SEQ ID NO: 968640 - protein, 9 aa, Homo Sapiens
EQKLKSFPK

SEQ ID NO: 968641 - protein, 9 aa, Homo Sapiens
KFCLAGDNP

SEQ ID NO: 968642 - protein, 9 aa, Homo Sapiens
PLDKAVLSP

SEQ ID NO: 968643 - protein, 9 aa, Homo Sapiens
MHSKERRKK

SEQ ID NO: 968644 - protein, 9 aa, Homo Sapiens
ISLLEDVPL

SEQ ID NO: 968645 - protein, 9 aa, Homo Sapiens
GCQRQRAIV

SEQ ID NO: 968646 - protein, 9 aa, Homo Sapiens
LEINRLSLP

SEQ ID NO: 968647 - protein, 9 aa, Homo Sapiens
EALSESQRE

SEQ ID NO: 968648 - protein, 9 aa, Homo Sapiens
CVCMLGDIQ

SEQ ID NO: 968649 - protein, 9 aa, Homo Sapiens
KEAGEKLSG

SEQ ID NO: 968650 - protein, 9 aa, Homo Sapiens
GRDLFCAWE

SEQ ID NO: 968651 - protein, 9 aa, Homo Sapiens
KKTNFLCSM

SEQ ID NO: 968652 - protein, 9 aa, Homo Sapiens
VSREPGSGK

SEQ ID NO: 968653 - protein, 9 aa, Homo Sapiens
SSFSSCPPC

SEQ ID NO: 968654 - protein, 9 aa, Homo Sapiens
THQSLLYEA

SEQ ID NO: 968655 - protein, 9 aa, Homo Sapiens
DGNKQCEFA

SEQ ID NO: 968656 - protein, 9 aa, Homo Sapiens
YLELDNPAE

SEQ ID NO: 968657 - protein, 9 aa, Homo Sapiens
LNKTNSCPL

SEQ ID NO: 968658 - protein, 9 aa, Homo Sapiens
FKMQVYSGS

SEQ ID NO: 968659 - protein, 9 aa, Homo Sapiens
VWSTLEVTA

SEQ ID NO: 968660 - protein, 9 aa, Homo Sapiens
FEFLKTCNK

SEQ ID NO: 968661 - protein, 9 aa, Homo Sapiens
LQREGYPHD

SEQ ID NO: 968662 - protein, 9 aa, Homo Sapiens
FLSPLWRQI

SEQ ID NO: 968663 - protein, 9 aa, Homo Sapiens
VLCPTIFPV

SEQ ID NO: 968664 - protein, 9 aa, Homo Sapiens
FKLPRLFKN

SEQ ID NO: 968665 - protein, 9 aa, Homo Sapiens
LPQQRNPPQ

SEQ ID NO: 968666 - protein, 9 aa, Homo Sapiens
LSEAPPAAP

SEQ ID NO: 968667 - protein, 9 aa, Homo Sapiens
VFLTLGESG

SEQ ID NO: 968668 - protein, 9 aa, Homo Sapiens
KPYKCEKCW

SEQ ID NO: 968669 - protein, 9 aa, Homo Sapiens
QGVGLLRQD

SEQ ID NO: 968670 - protein, 9 aa, Homo Sapiens
PSFFQQGSP

SEQ ID NO: 968671 - protein, 9 aa, Homo Sapiens
SPSPLGGGA

SEQ ID NO: 968672 - protein, 9 aa, Homo Sapiens
NPQKAFLAE

SEQ ID NO: 968673 - protein, 9 aa, Homo Sapiens
PDQGPTKSP

SEQ ID NO: 968674 - protein, 9 aa, Homo Sapiens
QGSYGWQAG

SEQ ID NO: 968675 - protein, 9 aa, Homo Sapiens
TARHTRWPD

SEQ ID NO: 968676 - protein, 9 aa, Homo Sapiens
LCTHAGDAE

SEQ ID NO: 968677 - protein, 9 aa, Homo Sapiens
VQKLSLEND

SEQ ID NO: 968678 - protein, 9 aa, Homo Sapiens
FSRKSHFER

SEQ ID NO: 968679 - protein, 9 aa, Homo Sapiens
AINQGSYGW

SEQ ID NO: 968680 - protein, 9 aa, Homo Sapiens
CDVSSSPFL

SEQ ID NO: 968681 - protein, 9 aa, Homo Sapiens
HDASGQLGL

SEQ ID NO: 968682 - protein, 9 aa, Homo Sapiens
TITTFSKEK

SEQ ID NO: 968683 - protein, 9 aa, Homo Sapiens
CKFFLYAHR

SEQ ID NO: 968684 - protein, 9 aa, Homo Sapiens
DAKPESLIK

SEQ ID NO: 968685 - protein, 9 aa, Homo Sapiens
SEKQINVYN

SEQ ID NO: 968686 - protein, 9 aa, Homo Sapiens
DIRGPEQEF

SEQ ID NO: 968687 - protein, 9 aa, Homo Sapiens
KAWGQVKRQ

SEQ ID NO: 968688 - protein, 9 aa, Homo Sapiens
ALRSALVLL

SEQ ID NO: 968689 - protein, 9 aa, Homo Sapiens
PRSTPFLTT

SEQ ID NO: 968690 - protein, 9 aa, Homo Sapiens
RSDTPRSVA

SEQ ID NO: 968691 - protein, 9 aa, Homo Sapiens
INSSNPLRY

SEQ ID NO: 968692 - protein, 9 aa, Homo Sapiens
DSYEETLST

SEQ ID NO: 968693 - protein, 9 aa, Homo Sapiens
ARKKLAESL

SEQ ID NO: 968694 - protein, 9 aa, Homo Sapiens
EEEGLLLIP

SEQ ID NO: 968695 - protein, 9 aa, Homo Sapiens
PSSGNRSEF

SEQ ID NO: 968696 - protein, 9 aa, Homo Sapiens
RRVNCCWPM

SEQ ID NO: 968697 - protein, 9 aa, Homo Sapiens
PVQFFQREL

SEQ ID NO: 968698 - protein, 9 aa, Homo Sapiens
AVGLVSQYY

SEQ ID NO: 968699 - protein, 9 aa, Homo Sapiens
YLCCLLLLP

SEQ ID NO: 968700 - protein, 9 aa, Homo Sapiens
PLKDSEFEF

SEQ ID NO: 968701 - protein, 9 aa, Homo Sapiens
ENENLKKCY

SEQ ID NO: 968702 - protein, 9 aa, Homo Sapiens
SLASFENVR

SEQ ID NO: 968703 - protein, 9 aa, Homo Sapiens
PGSLLACTE

SEQ ID NO: 968704 - protein, 9 aa, Homo Sapiens
FLQQIPFKE

SEQ ID NO: 968705 - protein, 9 aa, Homo Sapiens
GSLEEAAAL

SEQ ID NO: 968706 - protein, 9 aa, Homo Sapiens
EGCDASAIV

SEQ ID NO: 968707 - protein, 9 aa, Homo Sapiens
TEEMYEDIQ

SEQ ID NO: 968708 - protein, 9 aa, Homo Sapiens
QEAVISAKI

SEQ ID NO: 968709 - protein, 9 aa, Homo Sapiens
LCPSALATS

SEQ ID NO: 968710 - protein, 9 aa, Homo Sapiens
PDVLIGQEN

SEQ ID NO: 968711 - protein, 9 aa, Homo Sapiens
PPLCLKLAT

SEQ ID NO: 968712 - protein, 9 aa, Homo Sapiens
QCLCPTGFF

SEQ ID NO: 968713 - protein, 9 aa, Homo Sapiens
TNTDTKVEN

SEQ ID NO: 968714 - protein, 9 aa, Homo Sapiens
VARNCSACT

SEQ ID NO: 968715 - protein, 9 aa, Homo Sapiens
PDFVPGALD

SEQ ID NO: 968716 - protein, 9 aa, Homo Sapiens
LKCVKLDRL

SEQ ID NO: 968717 - protein, 9 aa, Homo Sapiens
RIPRITSID

SEQ ID NO: 968718 - protein, 9 aa, Homo Sapiens
FRQHVLEDL

SEQ ID NO: 968719 - protein, 9 aa, Homo Sapiens
RGSEAPEAE

SEQ ID NO: 968720 - protein, 9 aa, Homo Sapiens
ARDSPAPRL

SEQ ID NO: 968721 - protein, 9 aa, Homo Sapiens
GISSRSSPR

SEQ ID NO: 968722 - protein, 9 aa, Homo Sapiens
HTRWPDVAQ

SEQ ID NO: 968723 - protein, 9 aa, Homo Sapiens
MTRMCRHSV

SEQ ID NO: 968724 - protein, 9 aa, Homo Sapiens
LVRTFDPPG

SEQ ID NO: 968725 - protein, 9 aa, Homo Sapiens
KGDSSLVKG

SEQ ID NO: 968726 - protein, 9 aa, Homo Sapiens
CCLAGRAYL

SEQ ID NO: 968727 - protein, 9 aa, Homo Sapiens
DPPEYPNEK

SEQ ID NO: 968728 - protein, 9 aa, Homo Sapiens
QPQPALLLN

SEQ ID NO: 968729 - protein, 9 aa, Homo Sapiens
ALFSPRYKM

SEQ ID NO: 968730 - protein, 9 aa, Homo Sapiens
IATQRTAGE

SEQ ID NO: 968731 - protein, 9 aa, Homo Sapiens
NLGMCNLKN

SEQ ID NO: 968732 - protein, 9 aa, Homo Sapiens
LMRAPPAFS

SEQ ID NO: 968733 - protein, 9 aa, Homo Sapiens
GDCGVLKEL

SEQ ID NO: 968734 - protein, 9 aa, Homo Sapiens
GKKRELSDD

SEQ ID NO: 968735 - protein, 9 aa, Homo Sapiens
WQASLRLKR

SEQ ID NO: 968736 - protein, 9 aa, Homo Sapiens
KEADNVIFE

SEQ ID NO: 968737 - protein, 9 aa, Homo Sapiens
PKVEAAEPE

SEQ ID NO: 968738 - protein, 9 aa, Homo Sapiens
VSLCSYSAT

SEQ ID NO: 968739 - protein, 9 aa, Homo Sapiens
NSILDDNKT

SEQ ID NO: 968740 - protein, 9 aa, Homo Sapiens
SGPLPRESS

SEQ ID NO: 968741 - protein, 9 aa, Homo Sapiens
KGINVLVKS

SEQ ID NO: 968742 - protein, 9 aa, Homo Sapiens
KICGQEKGP

SEQ ID NO: 968743 - protein, 9 aa, Homo Sapiens
AKTNGQLED

SEQ ID NO: 968744 - protein, 9 aa, Homo Sapiens
DDCDCLHPE

SEQ ID NO: 968745 - protein, 9 aa, Homo Sapiens
IPENFDQDN

SEQ ID NO: 968746 - protein, 9 aa, Homo Sapiens
GETMNAACE

SEQ ID NO: 968747 - protein, 9 aa, Homo Sapiens
YKLWHLDSD

SEQ ID NO: 968748 - protein, 9 aa, Homo Sapiens
PVPMASRPR

SEQ ID NO: 968749 - protein, 9 aa, Homo Sapiens
PAIVQSFLG

SEQ ID NO: 968750 - protein, 9 aa, Homo Sapiens
GIRSAPSFS

SEQ ID NO: 968751 - protein, 9 aa, Homo Sapiens
RPRHLSNSL

SEQ ID NO: 968752 - protein, 9 aa, Homo Sapiens
VRILSWPKE

SEQ ID NO: 968753 - protein, 9 aa, Homo Sapiens
LIDTLCLKT

SEQ ID NO: 968754 - protein, 9 aa, Homo Sapiens
QEVSEKVTV

SEQ ID NO: 968755 - protein, 9 aa, Homo Sapiens
VILHPEFLF

SEQ ID NO: 968756 - protein, 9 aa, Homo Sapiens
SLPSSLPPR

SEQ ID NO: 968757 - protein, 9 aa, Homo Sapiens
KNKQESDCV

SEQ ID NO: 968758 - protein, 9 aa, Homo Sapiens
GNSWWVGLP

SEQ ID NO: 968759 - protein, 9 aa, Homo Sapiens
FAAQGQLPS

SEQ ID NO: 968760 - protein, 9 aa, Homo Sapiens
SVLFPSSGN

SEQ ID NO: 968761 - protein, 9 aa, Homo Sapiens
VPAERVDDT

SEQ ID NO: 968762 - protein, 9 aa, Homo Sapiens
TVVLFKNKV

SEQ ID NO: 968763 - protein, 9 aa, Homo Sapiens
NKKLPEPEP

SEQ ID NO: 968764 - protein, 9 aa, Homo Sapiens
NTCSFQKPK

SEQ ID NO: 968765 - protein, 9 aa, Homo Sapiens
HQRRHGLGH

SEQ ID NO: 968766 - protein, 9 aa, Homo Sapiens
LAIGANPFY

SEQ ID NO: 968767 - protein, 9 aa, Homo Sapiens
QVEEKEEEE

SEQ ID NO: 968768 - protein, 9 aa, Homo Sapiens
LKRRHRCGG

SEQ ID NO: 968769 - protein, 9 aa, Homo Sapiens
IDFKLEQGD

SEQ ID NO: 968770 - protein, 9 aa, Homo Sapiens
AIEVLTQLS

SEQ ID NO: 968771 - protein, 9 aa, Homo Sapiens
SLKGDSSLV

SEQ ID NO: 968772 - protein, 9 aa, Homo Sapiens
VEQLEFRIV

SEQ ID NO: 968773 - protein, 9 aa, Homo Sapiens
WRLFNCSAF

SEQ ID NO: 968774 - protein, 9 aa, Homo Sapiens
QTREEEMIY

SEQ ID NO: 968775 - protein, 9 aa, Homo Sapiens
MKLSFAVQR

SEQ ID NO: 968776 - protein, 9 aa, Homo Sapiens
SYNHPIWGR

SEQ ID NO: 968777 - protein, 9 aa, Homo Sapiens
CQCKGRLNC

SEQ ID NO: 968778 - protein, 9 aa, Homo Sapiens
DFNPKDSYS

SEQ ID NO: 968779 - protein, 9 aa, Homo Sapiens
LQNLIKNDS

SEQ ID NO: 968780 - protein, 9 aa, Homo Sapiens
TLCVGRTGG

SEQ ID NO: 968781 - protein, 9 aa, Homo Sapiens
KAFKTDSFF

SEQ ID NO: 968782 - protein, 9 aa, Homo Sapiens
KIYTVEHMI

SEQ ID NO: 968783 - protein, 9 aa, Homo Sapiens
KFTCGNYVM

SEQ ID NO: 968784 - protein, 9 aa, Homo Sapiens
SFHNSSRTF

SEQ ID NO: 968785 - protein, 9 aa, Homo Sapiens
WTVAMMVPD

SEQ ID NO: 968786 - protein, 9 aa, Homo Sapiens
SKKKKRHKG

SEQ ID NO: 968787 - protein, 9 aa, Homo Sapiens
DERADTVTK

SEQ ID NO: 968788 - protein, 9 aa, Homo Sapiens
FKLITEALS

SEQ ID NO: 968789 - protein, 9 aa, Homo Sapiens
LVEATVRER

SEQ ID NO: 968790 - protein, 9 aa, Homo Sapiens
VILGILLPS

SEQ ID NO: 968791 - protein, 9 aa, Homo Sapiens
ELWRGQEEG

SEQ ID NO: 968792 - protein, 9 aa, Homo Sapiens
YEETREVLK

SEQ ID NO: 968793 - protein, 9 aa, Homo Sapiens
FLLAKVTRM

SEQ ID NO: 968794 - protein, 9 aa, Homo Sapiens
SRPGACLAE

SEQ ID NO: 968795 - protein, 9 aa, Homo Sapiens
GSNFSLWIV

SEQ ID NO: 968796 - protein, 9 aa, Homo Sapiens
QNEYNAVKK

SEQ ID NO: 968797 - protein, 9 aa, Homo Sapiens
LFWTVAMMV

SEQ ID NO: 968798 - protein, 9 aa, Homo Sapiens
LQSRLVALG

SEQ ID NO: 968799 - protein, 9 aa, Homo Sapiens
YFSKPPLDL

SEQ ID NO: 968800 - protein, 9 aa, Homo Sapiens
QLVDPDSWF

SEQ ID NO: 968801 - protein, 9 aa, Homo Sapiens
LKPQAAFPS

SEQ ID NO: 968802 - protein, 9 aa, Homo Sapiens
NEDNYANIC

SEQ ID NO: 968803 - protein, 9 aa, Homo Sapiens
PTRARLLFR

SEQ ID NO: 968804 - protein, 9 aa, Homo Sapiens
LQVPKLDEH

SEQ ID NO: 968805 - protein, 9 aa, Homo Sapiens
PQPFLNEKG

SEQ ID NO: 968806 - protein, 9 aa, Homo Sapiens
PISQSSGNS

SEQ ID NO: 968807 - protein, 9 aa, Homo Sapiens
QEKHQFVHH

SEQ ID NO: 968808 - protein, 9 aa, Homo Sapiens
KRTGPEASR

SEQ ID NO: 968809 - protein, 9 aa, Homo Sapiens
GSERLGKQN

SEQ ID NO: 968810 - protein, 9 aa, Homo Sapiens
PLEIVFNLE

SEQ ID NO: 968811 - protein, 9 aa, Homo Sapiens
KPRLFMPNL

SEQ ID NO: 968812 - protein, 9 aa, Homo Sapiens
GQKENPAYP

SEQ ID NO: 968813 - protein, 9 aa, Homo Sapiens
LTVPNVSNQ

SEQ ID NO: 968814 - protein, 9 aa, Homo Sapiens
AKERTRYFS

SEQ ID NO: 968815 - protein, 9 aa, Homo Sapiens
TSEDAQPES

SEQ ID NO: 968816 - protein, 9 aa, Homo Sapiens
PSELGETEE

SEQ ID NO: 968817 - protein, 9 aa, Homo Sapiens
PPGPVPMAS

SEQ ID NO: 968818 - protein, 9 aa, Homo Sapiens
CLKLPSKKE

SEQ ID NO: 968819 - protein, 9 aa, Homo Sapiens
STTRSVLGL

SEQ ID NO: 968820 - protein, 9 aa, Homo Sapiens
VSVNEWDKY

SEQ ID NO: 968821 - protein, 9 aa, Homo Sapiens
QKAFLAEKF

SEQ ID NO: 968822 - protein, 9 aa, Homo Sapiens
KIIDPNNRR

SEQ ID NO: 968823 - protein, 9 aa, Homo Sapiens
FTFQTREEE

SEQ ID NO: 968824 - protein, 9 aa, Homo Sapiens
VNPFFLRQA

SEQ ID NO: 968825 - protein, 9 aa, Homo Sapiens
AHLVRTFDP

SEQ ID NO: 968826 - protein, 9 aa, Homo Sapiens
SSNPLRYNR

SEQ ID NO: 968827 - protein, 9 aa, Homo Sapiens
QEDPAKLDR

SEQ ID NO: 968828 - protein, 9 aa, Homo Sapiens
FFYHVKNNG

SEQ ID NO: 968829 - protein, 9 aa, Homo Sapiens
IVEGCQRQR

SEQ ID NO: 968830 - protein, 9 aa, Homo Sapiens
PVQSQGMNS

SEQ ID NO: 968831 - protein, 9 aa, Homo Sapiens
PAACEKARQ

SEQ ID NO: 968832 - protein, 9 aa, Homo Sapiens
GFSNRLCFL

SEQ ID NO: 968833 - protein, 9 aa, Homo Sapiens
ESSVSSFTK

SEQ ID NO: 968834 - protein, 9 aa, Homo Sapiens
AQLLTYLIK

SEQ ID NO: 968835 - protein, 9 aa, Homo Sapiens
GQKEMSNFT

SEQ ID NO: 968836 - protein, 9 aa, Homo Sapiens
SRWAKTNGQ

SEQ ID NO: 968837 - protein, 9 aa, Homo Sapiens
AFSSTVTED

SEQ ID NO: 968838 - protein, 9 aa, Homo Sapiens
QKDHYLGLA

SEQ ID NO: 968839 - protein, 9 aa, Homo Sapiens
YGRQGQPVE

SEQ ID NO: 968840 - protein, 9 aa, Homo Sapiens
LPDTLHSLP

SEQ ID NO: 968841 - protein, 9 aa, Homo Sapiens
LSQKGVTGE

SEQ ID NO: 968842 - protein, 9 aa, Homo Sapiens
AVESPFFKE

SEQ ID NO: 968843 - protein, 9 aa, Homo Sapiens
AKVIVSVKD

SEQ ID NO: 968844 - protein, 9 aa, Homo Sapiens
DFKLEQGDI

SEQ ID NO: 968845 - protein, 9 aa, Homo Sapiens
VQQPDRLAV

SEQ ID NO: 968846 - protein, 9 aa, Homo Sapiens
IYENGFFKD

SEQ ID NO: 968847 - protein, 9 aa, Homo Sapiens
LPEVEFFDL

SEQ ID NO: 968848 - protein, 9 aa, Homo Sapiens
CNETILHLV

SEQ ID NO: 968849 - protein, 9 aa, Homo Sapiens
EEAADLLLG

SEQ ID NO: 968850 - protein, 9 aa, Homo Sapiens
GEIKGFIGI

SEQ ID NO: 968851 - protein, 9 aa, Homo Sapiens
LSMAFVYTQ

SEQ ID NO: 968852 - protein, 9 aa, Homo Sapiens
YFFPQGYGF

SEQ ID NO: 968853 - protein, 9 aa, Homo Sapiens
ELQLSMRNA

SEQ ID NO: 968854 - protein, 9 aa, Homo Sapiens
EPKVEAAEP

SEQ ID NO: 968855 - protein, 9 aa, Homo Sapiens
CVWLLLQYD

SEQ ID NO: 968856 - protein, 9 aa, Homo Sapiens
NGNKTLTLL

SEQ ID NO: 968857 - protein, 9 aa, Homo Sapiens
FGSERLTLL

SEQ ID NO: 968858 - protein, 9 aa, Homo Sapiens
SEFQDKEEL

SEQ ID NO: 968859 - protein, 9 aa, Homo Sapiens
FQISVLCDA

SEQ ID NO: 968860 - protein, 9 aa, Homo Sapiens
LRRKTDVPS

SEQ ID NO: 968861 - protein, 9 aa, Homo Sapiens
KRDDASMDQ

SEQ ID NO: 968862 - protein, 9 aa, Homo Sapiens
VFKLITEAL

SEQ ID NO: 968863 - protein, 9 aa, Homo Sapiens
FELENEVEQ

SEQ ID NO: 968864 - protein, 9 aa, Homo Sapiens
GQRPGSLEE

SEQ ID NO: 968865 - protein, 9 aa, Homo Sapiens
LGPRGLSPA

SEQ ID NO: 968866 - protein, 9 aa, Homo Sapiens
LVRYLVDVR

SEQ ID NO: 968867 - protein, 9 aa, Homo Sapiens
SNGNKTLTL

SEQ ID NO: 968868 - protein, 9 aa, Homo Sapiens
EKEEQEVDV

SEQ ID NO: 968869 - protein, 9 aa, Homo Sapiens
ERLTSFISL

SEQ ID NO: 968870 - protein, 9 aa, Homo Sapiens
NILGEAGLH

SEQ ID NO: 968871 - protein, 9 aa, Homo Sapiens
NVKKQAFNL

SEQ ID NO: 968872 - protein, 9 aa, Homo Sapiens
GRWYADRAV

SEQ ID NO: 968873 - protein, 9 aa, Homo Sapiens
LAKLKTRVQ

SEQ ID NO: 968874 - protein, 9 aa, Homo Sapiens
NCSAFLDWP

SEQ ID NO: 968875 - protein, 9 aa, Homo Sapiens
EALPLLVTA

SEQ ID NO: 968876 - protein, 9 aa, Homo Sapiens
KKEIKKNEK

SEQ ID NO: 968877 - protein, 9 aa, Homo Sapiens
GFYLGDQDM

SEQ ID NO: 968878 - protein, 9 aa, Homo Sapiens
QVPAERVDD

SEQ ID NO: 968879 - protein, 9 aa, Homo Sapiens
IVGGALVLM

SEQ ID NO: 968880 - protein, 9 aa, Homo Sapiens
VPSGRSCRS

SEQ ID NO: 968881 - protein, 9 aa, Homo Sapiens
LGSRPVQFS

SEQ ID NO: 968882 - protein, 9 aa, Homo Sapiens
GCYPEGPIG

SEQ ID NO: 968883 - protein, 9 aa, Homo Sapiens
LQLGNISFK

SEQ ID NO: 968884 - protein, 9 aa, Homo Sapiens
VPKEFNFAS

SEQ ID NO: 968885 - protein, 9 aa, Homo Sapiens
GCKFFLYAH

SEQ ID NO: 968886 - protein, 9 aa, Homo Sapiens
GQFVVTTNL

SEQ ID NO: 968887 - protein, 9 aa, Homo Sapiens
KHQKIYNEK

SEQ ID NO: 968888 - protein, 9 aa, Homo Sapiens
RNAYQGVVY

SEQ ID NO: 968889 - protein, 9 aa, Homo Sapiens
TFLLAKVTR

SEQ ID NO: 968890 - protein, 9 aa, Homo Sapiens
GCDASAIVA

SEQ ID NO: 968891 - protein, 9 aa, Homo Sapiens
FVEQEVLLK

SEQ ID NO: 968892 - protein, 9 aa, Homo Sapiens
RSLPAVARC

SEQ ID NO: 968893 - protein, 9 aa, Homo Sapiens
MPVQFFQRE

SEQ ID NO: 968894 - protein, 9 aa, Homo Sapiens
LLSPDPTTP

SEQ ID NO: 968895 - protein, 9 aa, Homo Sapiens
SKANCLPAN

SEQ ID NO: 968896 - protein, 9 aa, Homo Sapiens
DFSIYPRFV

SEQ ID NO: 968897 - protein, 9 aa, Homo Sapiens
SLSSEETVP

SEQ ID NO: 968898 - protein, 9 aa, Homo Sapiens
PRGYRWSKK

SEQ ID NO: 968899 - protein, 9 aa, Homo Sapiens
RELLIQDIN

SEQ ID NO: 968900 - protein, 9 aa, Homo Sapiens
KLQMKITKQ

SEQ ID NO: 968901 - protein, 9 aa, Homo Sapiens
LGNTTADNR

SEQ ID NO: 968902 - protein, 9 aa, Homo Sapiens
LALGPRGLS

SEQ ID NO: 968903 - protein, 9 aa, Homo Sapiens
DPPHPCEGQ

SEQ ID NO: 968904 - protein, 9 aa, Homo Sapiens
PGFPGPQDP

SEQ ID NO: 968905 - protein, 9 aa, Homo Sapiens
VSLASFENV

SEQ ID NO: 968906 - protein, 9 aa, Homo Sapiens
DSGHEEKSL

SEQ ID NO: 968907 - protein, 9 aa, Homo Sapiens
PHSSEILGT

SEQ ID NO: 968908 - protein, 9 aa, Homo Sapiens
QVNVNPERT

SEQ ID NO: 968909 - protein, 9 aa, Homo Sapiens
ALQTVIIVG

SEQ ID NO: 968910 - protein, 9 aa, Homo Sapiens
LWWRSKGYR

SEQ ID NO: 968911 - protein, 9 aa, Homo Sapiens
EKVEAYQWR

SEQ ID NO: 968912 - protein, 9 aa, Homo Sapiens
IKEPLDKEE

SEQ ID NO: 968913 - protein, 9 aa, Homo Sapiens
SFLGSASAS

SEQ ID NO: 968914 - protein, 9 aa, Homo Sapiens
WMTRMCRHS

SEQ ID NO: 968915 - protein, 9 aa, Homo Sapiens
LEEKEEEEA

SEQ ID NO: 968916 - protein, 9 aa, Homo Sapiens
GRKKRISYS

SEQ ID NO: 968917 - protein, 9 aa, Homo Sapiens
PNICSHGLC

SEQ ID NO: 968918 - protein, 9 aa, Homo Sapiens
GPIGIIQHL

SEQ ID NO: 968919 - protein, 9 aa, Homo Sapiens
SILAQIIGL

SEQ ID NO: 968920 - protein, 9 aa, Homo Sapiens
KRRVNCCWP

SEQ ID NO: 968921 - protein, 9 aa, Homo Sapiens
TVRPSTQPP

SEQ ID NO: 968922 - protein, 9 aa, Homo Sapiens
YKNADVWPP

SEQ ID NO: 968923 - protein, 9 aa, Homo Sapiens
ALIRPSQVT

SEQ ID NO: 968924 - protein, 9 aa, Homo Sapiens
DYAKAGTKK

SEQ ID NO: 968925 - protein, 9 aa, Homo Sapiens
DEKKDPDPR

SEQ ID NO: 968926 - protein, 9 aa, Homo Sapiens
PPGLVPGPA

SEQ ID NO: 968927 - protein, 9 aa, Homo Sapiens
PSVRFLLLK

SEQ ID NO: 968928 - protein, 9 aa, Homo Sapiens
LNSTQGEIH

SEQ ID NO: 968929 - protein, 9 aa, Homo Sapiens
ADRGRNNSS

SEQ ID NO: 968930 - protein, 9 aa, Homo Sapiens
ILRLQNLIK

SEQ ID NO: 968931 - protein, 9 aa, Homo Sapiens
ECPFQEDES

SEQ ID NO: 968932 - protein, 9 aa, Homo Sapiens
GKIPWESME

SEQ ID NO: 968933 - protein, 9 aa, Homo Sapiens
YHMHSKERR

SEQ ID NO: 968934 - protein, 9 aa, Homo Sapiens
PGAQVDLPE

SEQ ID NO: 968935 - protein, 9 aa, Homo Sapiens
YLNQTRAAV

SEQ ID NO: 968936 - protein, 9 aa, Homo Sapiens
SVTSLQHKG

SEQ ID NO: 968937 - protein, 9 aa, Homo Sapiens
SLQAELSKN

SEQ ID NO: 968938 - protein, 9 aa, Homo Sapiens
KKFESMYVE

SEQ ID NO: 968939 - protein, 9 aa, Homo Sapiens
KVKTYGDNS

SEQ ID NO: 968940 - protein, 9 aa, Homo Sapiens
NGEAKVFRL

SEQ ID NO: 968941 - protein, 9 aa, Homo Sapiens
ADIIFFIDG

SEQ ID NO: 968942 - protein, 9 aa, Homo Sapiens
SFFQQGSPA

SEQ ID NO: 968943 - protein, 9 aa, Homo Sapiens
LKTRGRAVP

SEQ ID NO: 968944 - protein, 9 aa, Homo Sapiens
IDERTKLED

SEQ ID NO: 968945 - protein, 9 aa, Homo Sapiens
FHIFHAIAV

SEQ ID NO: 968946 - protein, 9 aa, Homo Sapiens
IKSPPSARS

SEQ ID NO: 968947 - protein, 9 aa, Homo Sapiens
FRYGYSVRL

SEQ ID NO: 968948 - protein, 9 aa, Homo Sapiens
EIFVNYYSN

SEQ ID NO: 968949 - protein, 9 aa, Homo Sapiens
LTNPVYPSN

SEQ ID NO: 968950 - protein, 9 aa, Homo Sapiens
GSERREKFF

SEQ ID NO: 968951 - protein, 9 aa, Homo Sapiens
SFPESLRHL

SEQ ID NO: 968952 - protein, 9 aa, Homo Sapiens
RIIYSISPG

SEQ ID NO: 968953 - protein, 9 aa, Homo Sapiens
RPIGNRILI

SEQ ID NO: 968954 - protein, 9 aa, Homo Sapiens
VGKVCRQDI

SEQ ID NO: 968955 - protein, 9 aa, Homo Sapiens
LAAGLGSAA

SEQ ID NO: 968956 - protein, 9 aa, Homo Sapiens
GKSIATITV

SEQ ID NO: 968957 - protein, 9 aa, Homo Sapiens
RGYRWSKKA

SEQ ID NO: 968958 - protein, 9 aa, Homo Sapiens
SFISYLVVK

SEQ ID NO: 968959 - protein, 9 aa, Homo Sapiens
SVASTCQEP

SEQ ID NO: 968960 - protein, 9 aa, Homo Sapiens
ENKRRYSAW

SEQ ID NO: 968961 - protein, 9 aa, Homo Sapiens
SLGVPPKRA

SEQ ID NO: 968962 - protein, 9 aa, Homo Sapiens
YESWFKEGA

SEQ ID NO: 968963 - protein, 9 aa, Homo Sapiens
ENRGDGEPV

SEQ ID NO: 968964 - protein, 9 aa, Homo Sapiens
NVRTLVLIV

SEQ ID NO: 968965 - protein, 9 aa, Homo Sapiens
FSIDSVTSL

SEQ ID NO: 968966 - protein, 9 aa, Homo Sapiens
APVCRTTVS

SEQ ID NO: 968967 - protein, 9 aa, Homo Sapiens
FYTTAFDMD

SEQ ID NO: 968968 - protein, 9 aa, Homo Sapiens
KMIEDGKIY

SEQ ID NO: 968969 - protein, 9 aa, Homo Sapiens
PAENKRRYS

SEQ ID NO: 968970 - protein, 9 aa, Homo Sapiens
ARKSSSLKV

SEQ ID NO: 968971 - protein, 9 aa, Homo Sapiens
GLELCSLKN

SEQ ID NO: 968972 - protein, 9 aa, Homo Sapiens
AKTVIELLE

SEQ ID NO: 968973 - protein, 9 aa, Homo Sapiens
RIASESAES

SEQ ID NO: 968974 - protein, 9 aa, Homo Sapiens
PTLAPGQNK

SEQ ID NO: 968975 - protein, 9 aa, Homo Sapiens
SNLKQDYPD

SEQ ID NO: 968976 - protein, 9 aa, Homo Sapiens
LIPCIFSFS

SEQ ID NO: 968977 - protein, 9 aa, Homo Sapiens
LRLLNSEDM

SEQ ID NO: 968978 - protein, 9 aa, Homo Sapiens
HLTIHIRTH

SEQ ID NO: 968979 - protein, 9 aa, Homo Sapiens
TRELQEKMD

SEQ ID NO: 968980 - protein, 9 aa, Homo Sapiens
TNAFILSLF

SEQ ID NO: 968981 - protein, 9 aa, Homo Sapiens
KILNETTGL

SEQ ID NO: 968982 - protein, 9 aa, Homo Sapiens
IHVGPSHQA

SEQ ID NO: 968983 - protein, 9 aa, Homo Sapiens
SVSSFTKIG

SEQ ID NO: 968984 - protein, 9 aa, Homo Sapiens
FTTFSDMWS

SEQ ID NO: 968985 - protein, 9 aa, Homo Sapiens
WAKTNGQLE

SEQ ID NO: 968986 - protein, 9 aa, Homo Sapiens
FKSSTHNLR

SEQ ID NO: 968987 - protein, 9 aa, Homo Sapiens
PPPPLARPP

SEQ ID NO: 968988 - protein, 9 aa, Homo Sapiens
DISRSESLC

SEQ ID NO: 968989 - protein, 9 aa, Homo Sapiens
PITHHKECV

SEQ ID NO: 968990 - protein, 9 aa, Homo Sapiens
PASKRGEIV

SEQ ID NO: 968991 - protein, 9 aa, Homo Sapiens
QSCDSKSTS

SEQ ID NO: 968992 - protein, 9 aa, Homo Sapiens
TAFMLFCMS

SEQ ID NO: 968993 - protein, 9 aa, Homo Sapiens
EAGNQDSGD

SEQ ID NO: 968994 - protein, 9 aa, Homo Sapiens
HLDSSSAVR

SEQ ID NO: 968995 - protein, 9 aa, Homo Sapiens
PPRSSWGDC

SEQ ID NO: 968996 - protein, 9 aa, Homo Sapiens
GYGEAQCAT

SEQ ID NO: 968997 - protein, 9 aa, Homo Sapiens
RPDPPHPCE

SEQ ID NO: 968998 - protein, 9 aa, Homo Sapiens
SGNEGEGAG

SEQ ID NO: 968999 - protein, 9 aa, Homo Sapiens
DSSVDEIPP

SEQ ID NO: 969000 - protein, 9 aa, Homo Sapiens
IVTVMVDCI

SEQ ID NO: 969001 - protein, 9 aa, Homo Sapiens
GPQLMPVRE

SEQ ID NO: 969002 - protein, 9 aa, Homo Sapiens
MISDIQFSP

SEQ ID NO: 969003 - protein, 9 aa, Homo Sapiens
GSSPDSKGG

SEQ ID NO: 969004 - protein, 9 aa, Homo Sapiens
VRKLLTPSY

SEQ ID NO: 969005 - protein, 9 aa, Homo Sapiens
GVATEAVGP

SEQ ID NO: 969006 - protein, 9 aa, Homo Sapiens
VGDEDIFKK

SEQ ID NO: 969007 - protein, 9 aa, Homo Sapiens
GSNGRWTWT

SEQ ID NO: 969008 - protein, 9 aa, Homo Sapiens
SSFISDWLY

SEQ ID NO: 969009 - protein, 9 aa, Homo Sapiens
PNGSLQARK

SEQ ID NO: 969010 - protein, 9 aa, Homo Sapiens
SQYYSLDHQ

SEQ ID NO: 969011 - protein, 9 aa, Homo Sapiens
LEDYLVKEI

SEQ ID NO: 969012 - protein, 9 aa, Homo Sapiens
ESLCCSSSY

SEQ ID NO: 969013 - protein, 9 aa, Homo Sapiens
PTLGSITIL

SEQ ID NO: 969014 - protein, 9 aa, Homo Sapiens
CLAHPELQS

SEQ ID NO: 969015 - protein, 9 aa, Homo Sapiens
PGLEKSRCI

SEQ ID NO: 969016 - protein, 9 aa, Homo Sapiens
RQSSVKPSA

SEQ ID NO: 969017 - protein, 9 aa, Homo Sapiens
RFQASISPS

SEQ ID NO: 969018 - protein, 9 aa, Homo Sapiens
RRKDDYAKA

SEQ ID NO: 969019 - protein, 9 aa, Homo Sapiens
TSRNSSQCS

SEQ ID NO: 969020 - protein, 9 aa, Homo Sapiens
TKIGIHLNA

SEQ ID NO: 969021 - protein, 9 aa, Homo Sapiens
SGLTEEDEG

SEQ ID NO: 969022 - protein, 9 aa, Homo Sapiens
YLNTLSYIK

SEQ ID NO: 969023 - protein, 9 aa, Homo Sapiens
VLRFMDVTP

SEQ ID NO: 969024 - protein, 9 aa, Homo Sapiens
ISPGIQGPE

SEQ ID NO: 969025 - protein, 9 aa, Homo Sapiens
NFLEGEPRE

SEQ ID NO: 969026 - protein, 9 aa, Homo Sapiens
GKGLGKKWR

SEQ ID NO: 969027 - protein, 9 aa, Homo Sapiens
KEKYELAHP

SEQ ID NO: 969028 - protein, 9 aa, Homo Sapiens
PGKDGVRGP

SEQ ID NO: 969029 - protein, 9 aa, Homo Sapiens
KKQELSNSS

SEQ ID NO: 969030 - protein, 9 aa, Homo Sapiens
PDENENLKK

SEQ ID NO: 969031 - protein, 9 aa, Homo Sapiens
FSALLPFGP

SEQ ID NO: 969032 - protein, 9 aa, Homo Sapiens
SFPLQHPAP

SEQ ID NO: 969033 - protein, 9 aa, Homo Sapiens
PDSLNICVF

SEQ ID NO: 969034 - protein, 9 aa, Homo Sapiens
QQKEEIEIQ

SEQ ID NO: 969035 - protein, 9 aa, Homo Sapiens
QTPDHYTFR

SEQ ID NO: 969036 - protein, 9 aa, Homo Sapiens
NFLGIITPV

SEQ ID NO: 969037 - protein, 9 aa, Homo Sapiens
CERGAPRIP

SEQ ID NO: 969038 - protein, 9 aa, Homo Sapiens
EHKVKNLHL

SEQ ID NO: 969039 - protein, 9 aa, Homo Sapiens
WYRLTEEEL

SEQ ID NO: 969040 - protein, 9 aa, Homo Sapiens
QGDWSPEVP

SEQ ID NO: 969041 - protein, 9 aa, Homo Sapiens
KMPESINFI

SEQ ID NO: 969042 - protein, 9 aa, Homo Sapiens
RGSRPRGYR

SEQ ID NO: 969043 - protein, 9 aa, Homo Sapiens
LSEGLQRLA

SEQ ID NO: 969044 - protein, 9 aa, Homo Sapiens
LAGLSKLSS

SEQ ID NO: 969045 - protein, 9 aa, Homo Sapiens
DMVTKDADP

SEQ ID NO: 969046 - protein, 9 aa, Homo Sapiens
LDLYNTKIL

SEQ ID NO: 969047 - protein, 9 aa, Homo Sapiens
YSAARPYSK

SEQ ID NO: 969048 - protein, 9 aa, Homo Sapiens
LKPNAVCAH

SEQ ID NO: 969049 - protein, 9 aa, Homo Sapiens
GNKGQLPEG

SEQ ID NO: 969050 - protein, 9 aa, Homo Sapiens
NQSSCGQER

SEQ ID NO: 969051 - protein, 9 aa, Homo Sapiens
RDWDPRLAI

SEQ ID NO: 969052 - protein, 9 aa, Homo Sapiens
DDASMDQDD

SEQ ID NO: 969053 - protein, 9 aa, Homo Sapiens
FHNSSRTFY

SEQ ID NO: 969054 - protein, 9 aa, Homo Sapiens
PAYPAILGK

SEQ ID NO: 969055 - protein, 9 aa, Homo Sapiens
DCGVLKELY

SEQ ID NO: 969056 - protein, 9 aa, Homo Sapiens
YQTPDHYTF

SEQ ID NO: 969057 - protein, 9 aa, Homo Sapiens
VNEWDKYLE

SEQ ID NO: 969058 - protein, 9 aa, Homo Sapiens
VIWEITLPA

SEQ ID NO: 969059 - protein, 9 aa, Homo Sapiens
KQAGKLVGV

SEQ ID NO: 969060 - protein, 9 aa, Homo Sapiens
PPEACPRNL

SEQ ID NO: 969061 - protein, 9 aa, Homo Sapiens
MGIRHSKQA

SEQ ID NO: 969062 - protein, 9 aa, Homo Sapiens
RKFLYCEAT

SEQ ID NO: 969063 - protein, 9 aa, Homo Sapiens
GLYWMHFCG

SEQ ID NO: 969064 - protein, 9 aa, Homo Sapiens
NNIISEYGR

SEQ ID NO: 969065 - protein, 9 aa, Homo Sapiens
SVNASSERF

SEQ ID NO: 969066 - protein, 9 aa, Homo Sapiens
RPIMPNTVF

SEQ ID NO: 969067 - protein, 9 aa, Homo Sapiens
CRKENSVKT

SEQ ID NO: 969068 - protein, 9 aa, Homo Sapiens
PFFEMIHEA

SEQ ID NO: 969069 - protein, 9 aa, Homo Sapiens
PSQSSLPPP

SEQ ID NO: 969070 - protein, 9 aa, Homo Sapiens
ERRKAEAAM

SEQ ID NO: 969071 - protein, 9 aa, Homo Sapiens
VPLEIVFNL

SEQ ID NO: 969072 - protein, 9 aa, Homo Sapiens
AVIQGQAVK

SEQ ID NO: 969073 - protein, 9 aa, Homo Sapiens
FNYTTALCC

SEQ ID NO: 969074 - protein, 9 aa, Homo Sapiens
SQREDLQAA

SEQ ID NO: 969075 - protein, 9 aa, Homo Sapiens
ITCSMQENS

SEQ ID NO: 969076 - protein, 9 aa, Homo Sapiens
QKLRRRPDF

SEQ ID NO: 969077 - protein, 9 aa, Homo Sapiens
KTTSLQQEL

SEQ ID NO: 969078 - protein, 9 aa, Homo Sapiens
SQDTLFLNE

SEQ ID NO: 969079 - protein, 9 aa, Homo Sapiens
CGNYVMEGS

SEQ ID NO: 969080 - protein, 9 aa, Homo Sapiens
LFCMSVTRY

SEQ ID NO: 969081 - protein, 9 aa, Homo Sapiens
CCLWPRSGI

SEQ ID NO: 969082 - protein, 9 aa, Homo Sapiens
DPLSGHPLR

SEQ ID NO: 969083 - protein, 9 aa, Homo Sapiens
QAGGATEST

SEQ ID NO: 969084 - protein, 9 aa, Homo Sapiens
SSQAVLFLL

SEQ ID NO: 969085 - protein, 9 aa, Homo Sapiens
LRSAGQGRA

SEQ ID NO: 969086 - protein, 9 aa, Homo Sapiens
HLIVISAFS

SEQ ID NO: 969087 - protein, 9 aa, Homo Sapiens
LTSVVNAHL

SEQ ID NO: 969088 - protein, 9 aa, Homo Sapiens
YSKLNYETS

SEQ ID NO: 969089 - protein, 9 aa, Homo Sapiens
LQDGRADGF

SEQ ID NO: 969090 - protein, 9 aa, Homo Sapiens
DPETLDSGP

SEQ ID NO: 969091 - protein, 9 aa, Homo Sapiens
AKVQDSVGE

SEQ ID NO: 969092 - protein, 9 aa, Homo Sapiens
GGTPEAPAG

SEQ ID NO: 969093 - protein, 9 aa, Homo Sapiens
VPQKHSSPR

SEQ ID NO: 969094 - protein, 9 aa, Homo Sapiens
GEPEKGEMV

SEQ ID NO: 969095 - protein, 9 aa, Homo Sapiens
KTKMQTEEG

SEQ ID NO: 969096 - protein, 9 aa, Homo Sapiens
KGGNFVTSR

SEQ ID NO: 969097 - protein, 9 aa, Homo Sapiens
SSSSKCHPP

SEQ ID NO: 969098 - protein, 9 aa, Homo Sapiens
PLELRFLGL

SEQ ID NO: 969099 - protein, 9 aa, Homo Sapiens
GHWLLGTAA

SEQ ID NO: 969100 - protein, 9 aa, Homo Sapiens
YGLSLMPGG

SEQ ID NO: 969101 - protein, 9 aa, Homo Sapiens
VGGTYFLPE

SEQ ID NO: 969102 - protein, 9 aa, Homo Sapiens
KHRLLSQAV

SEQ ID NO: 969103 - protein, 9 aa, Homo Sapiens
SEGGEKEGK

SEQ ID NO: 969104 - protein, 9 aa, Homo Sapiens
QGPPGHQGL

SEQ ID NO: 969105 - protein, 9 aa, Homo Sapiens
RENTWQPLT

SEQ ID NO: 969106 - protein, 9 aa, Homo Sapiens
TITSHTISP

SEQ ID NO: 969107 - protein, 9 aa, Homo Sapiens
AGEKLSGGA

SEQ ID NO: 969108 - protein, 9 aa, Homo Sapiens
YNGLVDGSL

SEQ ID NO: 969109 - protein, 9 aa, Homo Sapiens
SNQSLKKIG

SEQ ID NO: 969110 - protein, 9 aa, Homo Sapiens
ETQGLPHCR

SEQ ID NO: 969111 - protein, 9 aa, Homo Sapiens
RQLLGMVWG

SEQ ID NO: 969112 - protein, 9 aa, Homo Sapiens
IEFFLEEWQ

SEQ ID NO: 969113 - protein, 9 aa, Homo Sapiens
SMEHLVQYF

SEQ ID NO: 969114 - protein, 9 aa, Homo Sapiens
LPLLIDTLC

SEQ ID NO: 969115 - protein, 9 aa, Homo Sapiens
CKNIFFKAF

SEQ ID NO: 969116 - protein, 9 aa, Homo Sapiens
FVNYYSNLF

SEQ ID NO: 969117 - protein, 9 aa, Homo Sapiens
LTYLIKVLK

SEQ ID NO: 969118 - protein, 9 aa, Homo Sapiens
SPSCQPYLC

SEQ ID NO: 969119 - protein, 9 aa, Homo Sapiens
LFDQQNCTL

SEQ ID NO: 969120 - protein, 9 aa, Homo Sapiens
GFSGASAEP

SEQ ID NO: 969121 - protein, 9 aa, Homo Sapiens
SRQGQTFPI

SEQ ID NO: 969122 - protein, 9 aa, Homo Sapiens
EFFLEEWQC

SEQ ID NO: 969123 - protein, 9 aa, Homo Sapiens
AEPPDFNPK

SEQ ID NO: 969124 - protein, 9 aa, Homo Sapiens
DSGSGNEGE

SEQ ID NO: 969125 - protein, 9 aa, Homo Sapiens
FPERSRARC

SEQ ID NO: 969126 - protein, 9 aa, Homo Sapiens
ILRRLLRKK

SEQ ID NO: 969127 - protein, 9 aa, Homo Sapiens
MERAREVIS

SEQ ID NO: 969128 - protein, 9 aa, Homo Sapiens
DWGEGSTLT

SEQ ID NO: 969129 - protein, 9 aa, Homo Sapiens
FNCSAFLDW

SEQ ID NO: 969130 - protein, 9 aa, Homo Sapiens
IDTLCLKTQ

SEQ ID NO: 969131 - protein, 9 aa, Homo Sapiens
MNSPKRAAD

SEQ ID NO: 969132 - protein, 9 aa, Homo Sapiens
DWQSSEKQI

SEQ ID NO: 969133 - protein, 9 aa, Homo Sapiens
HFNLCLKER

SEQ ID NO: 969134 - protein, 9 aa, Homo Sapiens
RENLTVYCN

SEQ ID NO: 969135 - protein, 9 aa, Homo Sapiens
SLLRKHVKT

SEQ ID NO: 969136 - protein, 9 aa, Homo Sapiens
ALDGEIATY

SEQ ID NO: 969137 - protein, 9 aa, Homo Sapiens
FVSWTKNGK

SEQ ID NO: 969138 - protein, 9 aa, Homo Sapiens
NNPIFGRNE

SEQ ID NO: 969139 - protein, 9 aa, Homo Sapiens
SGQLGLISQ

SEQ ID NO: 969140 - protein, 9 aa, Homo Sapiens
GEKRKINVS

SEQ ID NO: 969141 - protein, 9 aa, Homo Sapiens
GSHSSSSGD

SEQ ID NO: 969142 - protein, 9 aa, Homo Sapiens
LYWPYKQQN

SEQ ID NO: 969143 - protein, 9 aa, Homo Sapiens
KSDKTGVRL

SEQ ID NO: 969144 - protein, 9 aa, Homo Sapiens
TKVSLCERD

SEQ ID NO: 969145 - protein, 9 aa, Homo Sapiens
AKRRWAPIT

SEQ ID NO: 969146 - protein, 9 aa, Homo Sapiens
VVLRFMDVT

SEQ ID NO: 969147 - protein, 9 aa, Homo Sapiens
AANQSEDPQ

SEQ ID NO: 969148 - protein, 9 aa, Homo Sapiens
TTTAMSTTP

SEQ ID NO: 969149 - protein, 9 aa, Homo Sapiens
SWNFVLYLL

SEQ ID NO: 969150 - protein, 9 aa, Homo Sapiens
IYYKTPLMT

SEQ ID NO: 969151 - protein, 9 aa, Homo Sapiens
WTKNVTEHR

SEQ ID NO: 969152 - protein, 9 aa, Homo Sapiens
INRIIQRLR

SEQ ID NO: 969153 - protein, 9 aa, Homo Sapiens
PELYKFDLI

SEQ ID NO: 969154 - protein, 9 aa, Homo Sapiens
VSRNKIPEI

SEQ ID NO: 969155 - protein, 9 aa, Homo Sapiens
LTVTSEQIN

SEQ ID NO: 969156 - protein, 9 aa, Homo Sapiens
LQSSVLWKY

SEQ ID NO: 969157 - protein, 9 aa, Homo Sapiens
AYVLVFLLS

SEQ ID NO: 969158 - protein, 9 aa, Homo Sapiens
ACTDTFMIL

SEQ ID NO: 969159 - protein, 9 aa, Homo Sapiens
QNLIKNDSG

SEQ ID NO: 969160 - protein, 9 aa, Homo Sapiens
AIVQAILRM

SEQ ID NO: 969161 - protein, 9 aa, Homo Sapiens
CQAGLDFFQ

SEQ ID NO: 969162 - protein, 9 aa, Homo Sapiens
IKRGLTVTS

SEQ ID NO: 969163 - protein, 9 aa, Homo Sapiens
VAKSDPSIV

SEQ ID NO: 969164 - protein, 9 aa, Homo Sapiens
KKKLAKKWE

SEQ ID NO: 969165 - protein, 9 aa, Homo Sapiens
PSEAGNQDS

SEQ ID NO: 969166 - protein, 9 aa, Homo Sapiens
TVALSSYYF

SEQ ID NO: 969167 - protein, 9 aa, Homo Sapiens
RRSSLSKDG

SEQ ID NO: 969168 - protein, 9 aa, Homo Sapiens
PYGVLRFLL

SEQ ID NO: 969169 - protein, 9 aa, Homo Sapiens
YWTKNVTEH

SEQ ID NO: 969170 - protein, 9 aa, Homo Sapiens
LPEDGLTRV

SEQ ID NO: 969171 - protein, 9 aa, Homo Sapiens
ASRNGTVHL

SEQ ID NO: 969172 - protein, 9 aa, Homo Sapiens
DGEVSGDAT

SEQ ID NO: 969173 - protein, 9 aa, Homo Sapiens
LQTQSLGTA

SEQ ID NO: 969174 - protein, 9 aa, Homo Sapiens
AIKQMFGLF

SEQ ID NO: 969175 - protein, 9 aa, Homo Sapiens
SSNFLGIIT

SEQ ID NO: 969176 - protein, 9 aa, Homo Sapiens
GKECEDENS

SEQ ID NO: 969177 - protein, 9 aa, Homo Sapiens
ALKAPKSFS

SEQ ID NO: 969178 - protein, 9 aa, Homo Sapiens
LVRLRSAGQ

SEQ ID NO: 969179 - protein, 9 aa, Homo Sapiens
ECYLLRLNA

SEQ ID NO: 969180 - protein, 9 aa, Homo Sapiens
IHVRKLLTP

SEQ ID NO: 969181 - protein, 9 aa, Homo Sapiens
SLTQEKKFE

SEQ ID NO: 969182 - protein, 9 aa, Homo Sapiens
VRRLQKRVL

SEQ ID NO: 969183 - protein, 9 aa, Homo Sapiens
LCSLKNHGL

SEQ ID NO: 969184 - protein, 9 aa, Homo Sapiens
LWVLLLFVL

SEQ ID NO: 969185 - protein, 9 aa, Homo Sapiens
PPSLPLGFF

SEQ ID NO: 969186 - protein, 9 aa, Homo Sapiens
TKQPTLAPG

SEQ ID NO: 969187 - protein, 9 aa, Homo Sapiens
VPDMKLSMF

SEQ ID NO: 969188 - protein, 9 aa, Homo Sapiens
QKKSLTSEK

SEQ ID NO: 969189 - protein, 9 aa, Homo Sapiens
PFSNSTNLL

SEQ ID NO: 969190 - protein, 9 aa, Homo Sapiens
ASTCQEPSC

SEQ ID NO: 969191 - protein, 9 aa, Homo Sapiens
AAATALWNP

SEQ ID NO: 969192 - protein, 9 aa, Homo Sapiens
HLIETNIRN

SEQ ID NO: 969193 - protein, 9 aa, Homo Sapiens
PLVAGRMVN

SEQ ID NO: 969194 - protein, 9 aa, Homo Sapiens
LKKIRKTVS

SEQ ID NO: 969195 - protein, 9 aa, Homo Sapiens
SEVDPEKFF

SEQ ID NO: 969196 - protein, 9 aa, Homo Sapiens
AFSGRNVPV

SEQ ID NO: 969197 - protein, 9 aa, Homo Sapiens
NNSWNFVLY

SEQ ID NO: 969198 - protein, 9 aa, Homo Sapiens
KRRHRCGGS

SEQ ID NO: 969199 - protein, 9 aa, Homo Sapiens
LNCSVLSGD

SEQ ID NO: 969200 - protein, 9 aa, Homo Sapiens
RGPEHRSAW

SEQ ID NO: 969201 - protein, 9 aa, Homo Sapiens
CPLGASPSL

SEQ ID NO: 969202 - protein, 9 aa, Homo Sapiens
SSPALLSNL

SEQ ID NO: 969203 - protein, 9 aa, Homo Sapiens
DTAYQHGNL

SEQ ID NO: 969204 - protein, 9 aa, Homo Sapiens
TRTKSTVSV

SEQ ID NO: 969205 - protein, 9 aa, Homo Sapiens
TDCFSAMDW

SEQ ID NO: 969206 - protein, 9 aa, Homo Sapiens
EAAEPKVEA

SEQ ID NO: 969207 - protein, 9 aa, Homo Sapiens
YEKMPESIN

SEQ ID NO: 969208 - protein, 9 aa, Homo Sapiens
EPAPPSPAF

SEQ ID NO: 969209 - protein, 9 aa, Homo Sapiens
ISEVCFCDL

SEQ ID NO: 969210 - protein, 9 aa, Homo Sapiens
PLSGHPLRD

SEQ ID NO: 969211 - protein, 9 aa, Homo Sapiens
EAEKLAQKK

SEQ ID NO: 969212 - protein, 9 aa, Homo Sapiens
PTAPPLPPL

SEQ ID NO: 969213 - protein, 9 aa, Homo Sapiens
HVPHSALII

SEQ ID NO: 969214 - protein, 9 aa, Homo Sapiens
EIAEINRII

SEQ ID NO: 969215 - protein, 9 aa, Homo Sapiens
ALDLGDCGV

SEQ ID NO: 969216 - protein, 9 aa, Homo Sapiens
KAVLSPGMM

SEQ ID NO: 969217 - protein, 9 aa, Homo Sapiens
DQGPTKSPT

SEQ ID NO: 969218 - protein, 9 aa, Homo Sapiens
QKIYNEKNA

SEQ ID NO: 969219 - protein, 9 aa, Homo Sapiens
EKFKVSGKV

SEQ ID NO: 969220 - protein, 9 aa, Homo Sapiens
ILASWVSGR

SEQ ID NO: 969221 - protein, 9 aa, Homo Sapiens
REEEMIYQK

SEQ ID NO: 969222 - protein, 9 aa, Homo Sapiens
GHEEKSLSP

SEQ ID NO: 969223 - protein, 9 aa, Homo Sapiens
NLVGSSSTS

SEQ ID NO: 969224 - protein, 9 aa, Homo Sapiens
FQDTDGTKA

SEQ ID NO: 969225 - protein, 9 aa, Homo Sapiens
MGQETGACL

SEQ ID NO: 969226 - protein, 9 aa, Homo Sapiens
QRISDPSHL

SEQ ID NO: 969227 - protein, 9 aa, Homo Sapiens
LASTAPGPP

SEQ ID NO: 969228 - protein, 9 aa, Homo Sapiens
SSPVYESWF

SEQ ID NO: 969229 - protein, 9 aa, Homo Sapiens
GAVSFSLAF

SEQ ID NO: 969230 - protein, 9 aa, Homo Sapiens
NPGFEVVEN

SEQ ID NO: 969231 - protein, 9 aa, Homo Sapiens
LDAPGSLLA

SEQ ID NO: 969232 - protein, 9 aa, Homo Sapiens
TALPFMAAA

SEQ ID NO: 969233 - protein, 9 aa, Homo Sapiens
IFKLACQAM

SEQ ID NO: 969234 - protein, 9 aa, Homo Sapiens
SPALRDKHW

SEQ ID NO: 969235 - protein, 9 aa, Homo Sapiens
RKTKSTNPA

SEQ ID NO: 969236 - protein, 9 aa, Homo Sapiens
ARPYSKLNY

SEQ ID NO: 969237 - protein, 9 aa, Homo Sapiens
QWQERMWKM

SEQ ID NO: 969238 - protein, 9 aa, Homo Sapiens
TATPLDFFH

SEQ ID NO: 969239 - protein, 9 aa, Homo Sapiens
KQVCIVMRR

SEQ ID NO: 969240 - protein, 9 aa, Homo Sapiens
IKMAFFTYL

SEQ ID NO: 969241 - protein, 9 aa, Homo Sapiens
SVQLNNRFF

SEQ ID NO: 969242 - protein, 9 aa, Homo Sapiens
GKRKVEGLL

SEQ ID NO: 969243 - protein, 9 aa, Homo Sapiens
LLILFSVVL

SEQ ID NO: 969244 - protein, 9 aa, Homo Sapiens
RKSHFERHR

SEQ ID NO: 969245 - protein, 9 aa, Homo Sapiens
YQPGRIIHV

SEQ ID NO: 969246 - protein, 9 aa, Homo Sapiens
RRDSHKAPR

SEQ ID NO: 969247 - protein, 9 aa, Homo Sapiens
ENSVLHLSE

SEQ ID NO: 969248 - protein, 9 aa, Homo Sapiens
LEHLIEVGN

SEQ ID NO: 969249 - protein, 9 aa, Homo Sapiens
QLELSQKGV

SEQ ID NO: 969250 - protein, 9 aa, Homo Sapiens
CHFVSVGFY

SEQ ID NO: 969251 - protein, 9 aa, Homo Sapiens
LNGSSKSMC

SEQ ID NO: 969252 - protein, 9 aa, Homo Sapiens
IWGRAKSRS

SEQ ID NO: 969253 - protein, 9 aa, Homo Sapiens
RLFSDGIVT

SEQ ID NO: 969254 - protein, 9 aa, Homo Sapiens
HLAIGANPF

SEQ ID NO: 969255 - protein, 9 aa, Homo Sapiens
EESTPFIIY

SEQ ID NO: 969256 - protein, 9 aa, Homo Sapiens
QQEKHQFVH

SEQ ID NO: 969257 - protein, 9 aa, Homo Sapiens
VEDQHKNQR

SEQ ID NO: 969258 - protein, 9 aa, Homo Sapiens
RFSFVIRSA

SEQ ID NO: 969259 - protein, 9 aa, Homo Sapiens
TKFSDKEKG

SEQ ID NO: 969260 - protein, 9 aa, Homo Sapiens
LERMGFSTE

SEQ ID NO: 969261 - protein, 9 aa, Homo Sapiens
NPQDFNPQP

SEQ ID NO: 969262 - protein, 9 aa, Homo Sapiens
MSVTRYLAI

SEQ ID NO: 969263 - protein, 9 aa, Homo Sapiens
EATVRERVR

SEQ ID NO: 969264 - protein, 9 aa, Homo Sapiens
EEKEEEEAS

SEQ ID NO: 969265 - protein, 9 aa, Homo Sapiens
VPGKHVYRV

SEQ ID NO: 969266 - protein, 9 aa, Homo Sapiens
DEEQRTFQD

SEQ ID NO: 969267 - protein, 9 aa, Homo Sapiens
TKRYTDPSL

SEQ ID NO: 969268 - protein, 9 aa, Homo Sapiens
AFMKILEKG

SEQ ID NO: 969269 - protein, 9 aa, Homo Sapiens
LLAISPGGD

SEQ ID NO: 969270 - protein, 9 aa, Homo Sapiens
CQLTVPNVS

SEQ ID NO: 969271 - protein, 9 aa, Homo Sapiens
VMAYDCYLA

SEQ ID NO: 969272 - protein, 9 aa, Homo Sapiens
YPRVVYLIR

SEQ ID NO: 969273 - protein, 9 aa, Homo Sapiens
SDSGSGNEG

SEQ ID NO: 969274 - protein, 9 aa, Homo Sapiens
RRPSAAFLM

SEQ ID NO: 969275 - protein, 9 aa, Homo Sapiens
THHKECVAA

SEQ ID NO: 969276 - protein, 9 aa, Homo Sapiens
LISAEKSFR

SEQ ID NO: 969277 - protein, 9 aa, Homo Sapiens
DSFFSFMAF

SEQ ID NO: 969278 - protein, 9 aa, Homo Sapiens
KLGEEDNWF

SEQ ID NO: 969279 - protein, 9 aa, Homo Sapiens
KHFNLCLKE

SEQ ID NO: 969280 - protein, 9 aa, Homo Sapiens
QEIAEINRI

SEQ ID NO: 969281 - protein, 9 aa, Homo Sapiens
VDQKEEEVC

SEQ ID NO: 969282 - protein, 9 aa, Homo Sapiens
ECPVGFCYN

SEQ ID NO: 969283 - protein, 9 aa, Homo Sapiens
LTLFHYSEG

SEQ ID NO: 969284 - protein, 9 aa, Homo Sapiens
SNSSSGSRT

SEQ ID NO: 969285 - protein, 9 aa, Homo Sapiens
EELLRKTKG

SEQ ID NO: 969286 - protein, 9 aa, Homo Sapiens
VLNFFLALL

SEQ ID NO: 969287 - protein, 9 aa, Homo Sapiens
LPQKFPSYP

SEQ ID NO: 969288 - protein, 9 aa, Homo Sapiens
SPEASLGPP

SEQ ID NO: 969289 - protein, 9 aa, Homo Sapiens
IDNLISNRH

SEQ ID NO: 969290 - protein, 9 aa, Homo Sapiens
FQPFPSGEF

SEQ ID NO: 969291 - protein, 9 aa, Homo Sapiens
QTEPCERCE

SEQ ID NO: 969292 - protein, 9 aa, Homo Sapiens
ISVNKFLSY

SEQ ID NO: 969293 - protein, 9 aa, Homo Sapiens
FYKIYENGF

SEQ ID NO: 969294 - protein, 9 aa, Homo Sapiens
RQQPRRKHS

SEQ ID NO: 969295 - protein, 9 aa, Homo Sapiens
SKMTSNKIS

SEQ ID NO: 969296 - protein, 9 aa, Homo Sapiens
PEVEFFDLN

SEQ ID NO: 969297 - protein, 9 aa, Homo Sapiens
VQMIAVILE

SEQ ID NO: 969298 - protein, 9 aa, Homo Sapiens
SSLVLLGHY

SEQ ID NO: 969299 - protein, 9 aa, Homo Sapiens
RVLFFVAAA

SEQ ID NO: 969300 - protein, 9 aa, Homo Sapiens
PAPPSPAFL

SEQ ID NO: 969301 - protein, 9 aa, Homo Sapiens
SMAFVYTQC

SEQ ID NO: 969302 - protein, 9 aa, Homo Sapiens
SHSSSSGDS

SEQ ID NO: 969303 - protein, 9 aa, Homo Sapiens
CFLLHSLRP

SEQ ID NO: 969304 - protein, 9 aa, Homo Sapiens
SSLKNAVFK

SEQ ID NO: 969305 - protein, 9 aa, Homo Sapiens
SDIQFSPGS

SEQ ID NO: 969306 - protein, 9 aa, Homo Sapiens
TTSFVGVGK

SEQ ID NO: 969307 - protein, 9 aa, Homo Sapiens
WLLSSLKNA

SEQ ID NO: 969308 - protein, 9 aa, Homo Sapiens
VILESLFLI

SEQ ID NO: 969309 - protein, 9 aa, Homo Sapiens
ISRLGKECA

SEQ ID NO: 969310 - protein, 9 aa, Homo Sapiens
KVRVLWLIS

SEQ ID NO: 969311 - protein, 9 aa, Homo Sapiens
IHIRTHTGE

SEQ ID NO: 969312 - protein, 9 aa, Homo Sapiens
LRLYCKEAD

SEQ ID NO: 969313 - protein, 9 aa, Homo Sapiens
PDFNPKDSY

SEQ ID NO: 969314 - protein, 9 aa, Homo Sapiens
EVISRSQHQ

SEQ ID NO: 969315 - protein, 9 aa, Homo Sapiens
TADNRIIIT

SEQ ID NO: 969316 - protein, 9 aa, Homo Sapiens
HSNPSPFQD

SEQ ID NO: 969317 - protein, 9 aa, Homo Sapiens
EKLQVALGK

SEQ ID NO: 969318 - protein, 9 aa, Homo Sapiens
PASHSVSGS

SEQ ID NO: 969319 - protein, 9 aa, Homo Sapiens
LGPKDFKVR

SEQ ID NO: 969320 - protein, 9 aa, Homo Sapiens
PESLRHLKN

SEQ ID NO: 969321 - protein, 9 aa, Homo Sapiens
EQGFVLKRS

SEQ ID NO: 969322 - protein, 9 aa, Homo Sapiens
NQGSYGWQA

SEQ ID NO: 969323 - protein, 9 aa, Homo Sapiens
AFKMPGLPQ

SEQ ID NO: 969324 - protein, 9 aa, Homo Sapiens
PVVSLFLDN

SEQ ID NO: 969325 - protein, 9 aa, Homo Sapiens
GVQKNKPVF

SEQ ID NO: 969326 - protein, 9 aa, Homo Sapiens
WDPRLAIID

SEQ ID NO: 969327 - protein, 9 aa, Homo Sapiens
DDTTERQQP

SEQ ID NO: 969328 - protein, 9 aa, Homo Sapiens
ALMSEDREA

SEQ ID NO: 969329 - protein, 9 aa, Homo Sapiens
ILGFGMCFV

SEQ ID NO: 969330 - protein, 9 aa, Homo Sapiens
DLLLAVLVP

SEQ ID NO: 969331 - protein, 9 aa, Homo Sapiens
SEWITSTKT

SEQ ID NO: 969332 - protein, 9 aa, Homo Sapiens
ASDSGHEEK

SEQ ID NO: 969333 - protein, 9 aa, Homo Sapiens
SVSSFSEVE

SEQ ID NO: 969334 - protein, 9 aa, Homo Sapiens
EKDMKLSFA

SEQ ID NO: 969335 - protein, 9 aa, Homo Sapiens
VWPRDQIVA

SEQ ID NO: 969336 - protein, 9 aa, Homo Sapiens
ERAQWQERM

SEQ ID NO: 969337 - protein, 9 aa, Homo Sapiens
FFYNLSSDD

SEQ ID NO: 969338 - protein, 9 aa, Homo Sapiens
PIAGTSVPQ

SEQ ID NO: 969339 - protein, 9 aa, Homo Sapiens
ATKFVYPAR

SEQ ID NO: 969340 - protein, 9 aa, Homo Sapiens
ANPFYCDCN

SEQ ID NO: 969341 - protein, 9 aa, Homo Sapiens
TNLVNNDGI

SEQ ID NO: 969342 - protein, 9 aa, Homo Sapiens
MMETAQTFL

SEQ ID NO: 969343 - protein, 9 aa, Homo Sapiens
PTGDAFVFF

SEQ ID NO: 969344 - protein, 9 aa, Homo Sapiens
TDFSSESSF

SEQ ID NO: 969345 - protein, 9 aa, Homo Sapiens
KQDFRLSSL

SEQ ID NO: 969346 - protein, 9 aa, Homo Sapiens
PRGKWQERL

SEQ ID NO: 969347 - protein, 9 aa, Homo Sapiens
NFSLWIVKK

SEQ ID NO: 969348 - protein, 9 aa, Homo Sapiens
DNLKALFWT

SEQ ID NO: 969349 - protein, 9 aa, Homo Sapiens
GLIYEETRE

SEQ ID NO: 969350 - protein, 9 aa, Homo Sapiens
VMLERKLPC

SEQ ID NO: 969351 - protein, 9 aa, Homo Sapiens
ETILHLVVA

SEQ ID NO: 969352 - protein, 9 aa, Homo Sapiens
KAFSTCSFH

SEQ ID NO: 969353 - protein, 9 aa, Homo Sapiens
ILGPVSRSY

SEQ ID NO: 969354 - protein, 9 aa, Homo Sapiens
KTEQLLRID

SEQ ID NO: 969355 - protein, 9 aa, Homo Sapiens
KEETPNHKL

SEQ ID NO: 969356 - protein, 9 aa, Homo Sapiens
TSREFNYFG

SEQ ID NO: 969357 - protein, 9 aa, Homo Sapiens
ENKAIQNPR

SEQ ID NO: 969358 - protein, 9 aa, Homo Sapiens
HSWSTGKEV

SEQ ID NO: 969359 - protein, 9 aa, Homo Sapiens
FFSRTSPVT

SEQ ID NO: 969360 - protein, 9 aa, Homo Sapiens
SAAVTFVDV

SEQ ID NO: 969361 - protein, 9 aa, Homo Sapiens
TREQRITET

SEQ ID NO: 969362 - protein, 9 aa, Homo Sapiens
DIIFFIDGS

SEQ ID NO: 969363 - protein, 9 aa, Homo Sapiens
NKRCKYKIE

SEQ ID NO: 969364 - protein, 9 aa, Homo Sapiens
GLGSQMNAA

SEQ ID NO: 969365 - protein, 9 aa, Homo Sapiens
FGYATFFWM

SEQ ID NO: 969366 - protein, 9 aa, Homo Sapiens
TYSSLVLLG

SEQ ID NO: 969367 - protein, 9 aa, Homo Sapiens
LSKLSSVPQ

SEQ ID NO: 969368 - protein, 9 aa, Homo Sapiens
QQELGLISG

SEQ ID NO: 969369 - protein, 9 aa, Homo Sapiens
FLIEKAVIF

SEQ ID NO: 969370 - protein, 9 aa, Homo Sapiens
EEIEIQKQE

SEQ ID NO: 969371 - protein, 9 aa, Homo Sapiens
GPITGLALI

SEQ ID NO: 969372 - protein, 9 aa, Homo Sapiens
HQMIHSEEK

SEQ ID NO: 969373 - protein, 9 aa, Homo Sapiens
QCEFAFGPG

SEQ ID NO: 969374 - protein, 9 aa, Homo Sapiens
IFFKAFSYL

SEQ ID NO: 969375 - protein, 9 aa, Homo Sapiens
GCQGCPAPW

SEQ ID NO: 969376 - protein, 9 aa, Homo Sapiens
YKIYENGFF

SEQ ID NO: 969377 - protein, 9 aa, Homo Sapiens
PQFPPGSPQ

SEQ ID NO: 969378 - protein, 9 aa, Homo Sapiens
RCPLYSSFP

SEQ ID NO: 969379 - protein, 9 aa, Homo Sapiens
LLAPLRKTK

SEQ ID NO: 969380 - protein, 9 aa, Homo Sapiens
AGNQDSGDG

SEQ ID NO: 969381 - protein, 9 aa, Homo Sapiens
TSNQSLKKI

SEQ ID NO: 969382 - protein, 9 aa, Homo Sapiens
EIKGEDRVP

SEQ ID NO: 969383 - protein, 9 aa, Homo Sapiens
TTGEKRKIN

SEQ ID NO: 969384 - protein, 9 aa, Homo Sapiens
SVEKRQSPV

SEQ ID NO: 969385 - protein, 9 aa, Homo Sapiens
ESPSCIRHL

SEQ ID NO: 969386 - protein, 9 aa, Homo Sapiens
VIDKYMLHL

SEQ ID NO: 969387 - protein, 9 aa, Homo Sapiens
RQSFSTAAH

SEQ ID NO: 969388 - protein, 9 aa, Homo Sapiens
TGMLSNLTV

SEQ ID NO: 969389 - protein, 9 aa, Homo Sapiens
FIHLNDIYF

SEQ ID NO: 969390 - protein, 9 aa, Homo Sapiens
CDKTQMSFQ

SEQ ID NO: 969391 - protein, 9 aa, Homo Sapiens
TIFSASCPI

SEQ ID NO: 969392 - protein, 9 aa, Homo Sapiens
KQHHLDSSS

SEQ ID NO: 969393 - protein, 9 aa, Homo Sapiens
TLVLIVCTF

SEQ ID NO: 969394 - protein, 9 aa, Homo Sapiens
EGGKPEMNS

SEQ ID NO: 969395 - protein, 9 aa, Homo Sapiens
CSELDVGNF

SEQ ID NO: 969396 - protein, 9 aa, Homo Sapiens
WKKSLRNKE

SEQ ID NO: 969397 - protein, 9 aa, Homo Sapiens
RGKTPDPQA

SEQ ID NO: 969398 - protein, 9 aa, Homo Sapiens
TSLGADGCD

SEQ ID NO: 969399 - protein, 9 aa, Homo Sapiens
RRPTGNASW

SEQ ID NO: 969400 - protein, 9 aa, Homo Sapiens
EKQKKVKLF

SEQ ID NO: 969401 - protein, 9 aa, Homo Sapiens
LVKWLEVCC

SEQ ID NO: 969402 - protein, 9 aa, Homo Sapiens
NHVKTGIED

SEQ ID NO: 969403 - protein, 9 aa, Homo Sapiens
HPCEGQKLL

SEQ ID NO: 969404 - protein, 9 aa, Homo Sapiens
QNPIEHEKI

SEQ ID NO: 969405 - protein, 9 aa, Homo Sapiens
LDCPMEFWT

SEQ ID NO: 969406 - protein, 9 aa, Homo Sapiens
VESMFRESE

SEQ ID NO: 969407 - protein, 9 aa, Homo Sapiens
IMVTIRPEP

SEQ ID NO: 969408 - protein, 9 aa, Homo Sapiens
HSVFSLPFV

SEQ ID NO: 969409 - protein, 9 aa, Homo Sapiens
LASFENVRA

SEQ ID NO: 969410 - protein, 9 aa, Homo Sapiens
CGKSFGWAF

SEQ ID NO: 969411 - protein, 9 aa, Homo Sapiens
LSYYPLEKE

SEQ ID NO: 969412 - protein, 9 aa, Homo Sapiens
KVYSVGSNG

SEQ ID NO: 969413 - protein, 9 aa, Homo Sapiens
VCSGCLKLP

SEQ ID NO: 969414 - protein, 9 aa, Homo Sapiens
GVLRFLLEN

SEQ ID NO: 969415 - protein, 9 aa, Homo Sapiens
IVQRISDPS

SEQ ID NO: 969416 - protein, 9 aa, Homo Sapiens
QVFSQTPQQ

SEQ ID NO: 969417 - protein, 9 aa, Homo Sapiens
LLLAVLVPG

SEQ ID NO: 969418 - protein, 9 aa, Homo Sapiens
PQRLHSTEE

SEQ ID NO: 969419 - protein, 9 aa, Homo Sapiens
QTIATFGAY

SEQ ID NO: 969420 - protein, 9 aa, Homo Sapiens
ERREKFFGQ

SEQ ID NO: 969421 - protein, 9 aa, Homo Sapiens
NKAIQNPRL

SEQ ID NO: 969422 - protein, 9 aa, Homo Sapiens
EILDCRNVG

SEQ ID NO: 969423 - protein, 9 aa, Homo Sapiens
HSCSAESNG

SEQ ID NO: 969424 - protein, 9 aa, Homo Sapiens
YLPHPAKPL

SEQ ID NO: 969425 - protein, 9 aa, Homo Sapiens
NTLRTWCRN

SEQ ID NO: 969426 - protein, 9 aa, Homo Sapiens
VSNKRECPA

SEQ ID NO: 969427 - protein, 9 aa, Homo Sapiens
GGATESTKE

SEQ ID NO: 969428 - protein, 9 aa, Homo Sapiens
DSLTGVLAQ

SEQ ID NO: 969429 - protein, 9 aa, Homo Sapiens
LNSEDMSED

SEQ ID NO: 969430 - protein, 9 aa, Homo Sapiens
SELGETEEG

SEQ ID NO: 969431 - protein, 9 aa, Homo Sapiens
RGPASSFTP

SEQ ID NO: 969432 - protein, 9 aa, Homo Sapiens
SADIIFFID

SEQ ID NO: 969433 - protein, 9 aa, Homo Sapiens
GTGLGSQMN

SEQ ID NO: 969434 - protein, 9 aa, Homo Sapiens
AKITSVQLN

SEQ ID NO: 969435 - protein, 9 aa, Homo Sapiens
LYVVVSNHQ

SEQ ID NO: 969436 - protein, 9 aa, Homo Sapiens
GSALLEEVA

SEQ ID NO: 969437 - protein, 9 aa, Homo Sapiens
KLGPPGTND

SEQ ID NO: 969438 - protein, 9 aa, Homo Sapiens
AWYKLHYMN

SEQ ID NO: 969439 - protein, 9 aa, Homo Sapiens
KDLGVPVTW

SEQ ID NO: 969440 - protein, 9 aa, Homo Sapiens
ELWDDFLSV

SEQ ID NO: 969441 - protein, 9 aa, Homo Sapiens
LVGVVTTTR

SEQ ID NO: 969442 - protein, 9 aa, Homo Sapiens
DNKKLPEPE

SEQ ID NO: 969443 - protein, 9 aa, Homo Sapiens
IRHGGHWLL

SEQ ID NO: 969444 - protein, 9 aa, Homo Sapiens
CDIGYGEAQ

SEQ ID NO: 969445 - protein, 9 aa, Homo Sapiens
PRLAIIDNL

SEQ ID NO: 969446 - protein, 9 aa, Homo Sapiens
DSCSISLQD

SEQ ID NO: 969447 - protein, 9 aa, Homo Sapiens
KLPQGYRIE

SEQ ID NO: 969448 - protein, 9 aa, Homo Sapiens
SVAALSIPL

SEQ ID NO: 969449 - protein, 9 aa, Homo Sapiens
LGNLIKVTP

SEQ ID NO: 969450 - protein, 9 aa, Homo Sapiens
AYALTFSGC

SEQ ID NO: 969451 - protein, 9 aa, Homo Sapiens
LGSQMNAAL

SEQ ID NO: 969452 - protein, 9 aa, Homo Sapiens
AGLGNHLFG

SEQ ID NO: 969453 - protein, 9 aa, Homo Sapiens
ENNDKASES

SEQ ID NO: 969454 - protein, 9 aa, Homo Sapiens
GNRILILPS

SEQ ID NO: 969455 - protein, 9 aa, Homo Sapiens
YVLSEKSQV

SEQ ID NO: 969456 - protein, 9 aa, Homo Sapiens
AMGRDEATG

SEQ ID NO: 969457 - protein, 9 aa, Homo Sapiens
PLSEDIKLS

SEQ ID NO: 969458 - protein, 9 aa, Homo Sapiens
ISLSKKKAG

SEQ ID NO: 969459 - protein, 9 aa, Homo Sapiens
AQWVSFTRK

SEQ ID NO: 969460 - protein, 9 aa, Homo Sapiens
EIYCRLFNH

SEQ ID NO: 969461 - protein, 9 aa, Homo Sapiens
EKHNQCKCE

SEQ ID NO: 969462 - protein, 9 aa, Homo Sapiens
LSWKRRSGG

SEQ ID NO: 969463 - protein, 9 aa, Homo Sapiens
AQHRKIYTG

SEQ ID NO: 969464 - protein, 9 aa, Homo Sapiens
VEGCQRQRA

SEQ ID NO: 969465 - protein, 9 aa, Homo Sapiens
LSQAVRPQE

SEQ ID NO: 969466 - protein, 9 aa, Homo Sapiens
DMISDIQFS

SEQ ID NO: 969467 - protein, 9 aa, Homo Sapiens
EDIKLSVLA

SEQ ID NO: 969468 - protein, 9 aa, Homo Sapiens
DAHELILNF

SEQ ID NO: 969469 - protein, 9 aa, Homo Sapiens
DQTARHTRW

SEQ ID NO: 969470 - protein, 9 aa, Homo Sapiens
KEIPSMAGH

SEQ ID NO: 969471 - protein, 9 aa, Homo Sapiens
TAQNYVIQF

SEQ ID NO: 969472 - protein, 9 aa, Homo Sapiens
MIAVILESL

SEQ ID NO: 969473 - protein, 9 aa, Homo Sapiens
LCLAAEGFS

SEQ ID NO: 969474 - protein, 9 aa, Homo Sapiens
EEVANKVLC

SEQ ID NO: 969475 - protein, 9 aa, Homo Sapiens
TWLLSSLKN

SEQ ID NO: 969476 - protein, 9 aa, Homo Sapiens
ISFFLAIYL

SEQ ID NO: 969477 - protein, 9 aa, Homo Sapiens
VPNIYVDCV

SEQ ID NO: 969478 - protein, 9 aa, Homo Sapiens
VYWTKNVTE

SEQ ID NO: 969479 - protein, 9 aa, Homo Sapiens
FDLIAVSNH

SEQ ID NO: 969480 - protein, 9 aa, Homo Sapiens
TESTEHGEK

SEQ ID NO: 969481 - protein, 9 aa, Homo Sapiens
YQWRVSEGR

SEQ ID NO: 969482 - protein, 9 aa, Homo Sapiens
SEFEFLKTC

SEQ ID NO: 969483 - protein, 9 aa, Homo Sapiens
PPPGSEGLA

SEQ ID NO: 969484 - protein, 9 aa, Homo Sapiens
SFVGDEDIF

SEQ ID NO: 969485 - protein, 9 aa, Homo Sapiens
NAALAHSSL

SEQ ID NO: 969486 - protein, 9 aa, Homo Sapiens
SHSSSSEKG

SEQ ID NO: 969487 - protein, 9 aa, Homo Sapiens
SPPRSSWGD

SEQ ID NO: 969488 - protein, 9 aa, Homo Sapiens
LKFTCGNYV

SEQ ID NO: 969489 - protein, 9 aa, Homo Sapiens
NVTAFWEKG

SEQ ID NO: 969490 - protein, 9 aa, Homo Sapiens
PSKFVRLPE

SEQ ID NO: 969491 - protein, 9 aa, Homo Sapiens
LEPRCLRMV

SEQ ID NO: 969492 - protein, 9 aa, Homo Sapiens
SRNGTVHLY

SEQ ID NO: 969493 - protein, 9 aa, Homo Sapiens
GDRSSSRML

SEQ ID NO: 969494 - protein, 9 aa, Homo Sapiens
GSHSSSSEK

SEQ ID NO: 969495 - protein, 9 aa, Homo Sapiens
YSGEKSFKC

SEQ ID NO: 969496 - protein, 9 aa, Homo Sapiens
NECLEIPNI

SEQ ID NO: 969497 - protein, 9 aa, Homo Sapiens
PFVSKRVVL

SEQ ID NO: 969498 - protein, 9 aa, Homo Sapiens
MKVLCPTIF

SEQ ID NO: 969499 - protein, 9 aa, Homo Sapiens
SISLGKSWV

SEQ ID NO: 969500 - protein, 9 aa, Homo Sapiens
PPSNNSWNF

SEQ ID NO: 969501 - protein, 9 aa, Homo Sapiens
TPGGADRGR

SEQ ID NO: 969502 - protein, 9 aa, Homo Sapiens
KNLPPPLGD

SEQ ID NO: 969503 - protein, 9 aa, Homo Sapiens
KEGSLKLSS

SEQ ID NO: 969504 - protein, 9 aa, Homo Sapiens
DMSKVYSVG

SEQ ID NO: 969505 - protein, 9 aa, Homo Sapiens
APCPPCSPE

SEQ ID NO: 969506 - protein, 9 aa, Homo Sapiens
LGQPGYPGA

SEQ ID NO: 969507 - protein, 9 aa, Homo Sapiens
LQKQTESFS

SEQ ID NO: 969508 - protein, 9 aa, Homo Sapiens
DVFSRKPFV

SEQ ID NO: 969509 - protein, 9 aa, Homo Sapiens
EELHSKVNY

SEQ ID NO: 969510 - protein, 9 aa, Homo Sapiens
LNNCSVMAV

SEQ ID NO: 969511 - protein, 9 aa, Homo Sapiens
PCAQCGKAF

SEQ ID NO: 969512 - protein, 9 aa, Homo Sapiens
NLKKCYLME

SEQ ID NO: 969513 - protein, 9 aa, Homo Sapiens
SLLLDGDDC

SEQ ID NO: 969514 - protein, 9 aa, Homo Sapiens
ITDAISRLG

SEQ ID NO: 969515 - protein, 9 aa, Homo Sapiens
ATGETMNAA

SEQ ID NO: 969516 - protein, 9 aa, Homo Sapiens
AARPYSKLN

SEQ ID NO: 969517 - protein, 9 aa, Homo Sapiens
EFVEQEVLL

SEQ ID NO: 969518 - protein, 9 aa, Homo Sapiens
VLSEKSQVE

SEQ ID NO: 969519 - protein, 9 aa, Homo Sapiens
WQSSEKQIN

SEQ ID NO: 969520 - protein, 9 aa, Homo Sapiens
VSVLSEHPL

SEQ ID NO: 969521 - protein, 9 aa, Homo Sapiens
FASVSLYQG

SEQ ID NO: 969522 - protein, 9 aa, Homo Sapiens
HYLIRDEKK

SEQ ID NO: 969523 - protein, 9 aa, Homo Sapiens
SPKESTSLD

SEQ ID NO: 969524 - protein, 9 aa, Homo Sapiens
RGVRGAVAF

SEQ ID NO: 969525 - protein, 9 aa, Homo Sapiens
GHGHQRRHG

SEQ ID NO: 969526 - protein, 9 aa, Homo Sapiens
GKEKVALLW

SEQ ID NO: 969527 - protein, 9 aa, Homo Sapiens
AHGPPAQKK

SEQ ID NO: 969528 - protein, 9 aa, Homo Sapiens
LTLGESGYL

SEQ ID NO: 969529 - protein, 9 aa, Homo Sapiens
GGRRDGFGG

SEQ ID NO: 969530 - protein, 9 aa, Homo Sapiens
RDWARNEAR

SEQ ID NO: 969531 - protein, 9 aa, Homo Sapiens
LPKACSNSS

SEQ ID NO: 969532 - protein, 9 aa, Homo Sapiens
ELGIMVSKA

SEQ ID NO: 969533 - protein, 9 aa, Homo Sapiens
CIKEGVKDV

SEQ ID NO: 969534 - protein, 9 aa, Homo Sapiens
YSLKKIRKT

SEQ ID NO: 969535 - protein, 9 aa, Homo Sapiens
YNKCQDLKS

SEQ ID NO: 969536 - protein, 9 aa, Homo Sapiens
NEHIYGEKK

SEQ ID NO: 969537 - protein, 9 aa, Homo Sapiens
LQKDNVGPW

SEQ ID NO: 969538 - protein, 9 aa, Homo Sapiens
ATHQRIYVG

SEQ ID NO: 969539 - protein, 9 aa, Homo Sapiens
VTAFWEKGF

SEQ ID NO: 969540 - protein, 9 aa, Homo Sapiens
ALATSIGKS

SEQ ID NO: 969541 - protein, 9 aa, Homo Sapiens
LLTPHHRTH

SEQ ID NO: 969542 - protein, 9 aa, Homo Sapiens
NPLRYNRQI

SEQ ID NO: 969543 - protein, 9 aa, Homo Sapiens
SFTGSLVSM

SEQ ID NO: 969544 - protein, 9 aa, Homo Sapiens
SSPCFSCPT

SEQ ID NO: 969545 - protein, 9 aa, Homo Sapiens
QVMDEFFYN

SEQ ID NO: 969546 - protein, 9 aa, Homo Sapiens
ALHISMYFF

SEQ ID NO: 969547 - protein, 9 aa, Homo Sapiens
YRNGGWTPW

SEQ ID NO: 969548 - protein, 9 aa, Homo Sapiens
PVHSFFMEL

SEQ ID NO: 969549 - protein, 9 aa, Homo Sapiens
PGHQGLPGP

SEQ ID NO: 969550 - protein, 9 aa, Homo Sapiens
RCQTEPCER

SEQ ID NO: 969551 - protein, 9 aa, Homo Sapiens
CIVMRRDQV

SEQ ID NO: 969552 - protein, 9 aa, Homo Sapiens
NSKIIMVTI

SEQ ID NO: 969553 - protein, 9 aa, Homo Sapiens
AKRQAQAQL

SEQ ID NO: 969554 - protein, 9 aa, Homo Sapiens
TKNVTEHRE

SEQ ID NO: 969555 - protein, 9 aa, Homo Sapiens
SVVITIPVI

SEQ ID NO: 969556 - protein, 9 aa, Homo Sapiens
RISDPSHLP

SEQ ID NO: 969557 - protein, 9 aa, Homo Sapiens
SALRCPGPT

SEQ ID NO: 969558 - protein, 9 aa, Homo Sapiens
SVLSIPNSN

SEQ ID NO: 969559 - protein, 9 aa, Homo Sapiens
QGKADLSTM

SEQ ID NO: 969560 - protein, 9 aa, Homo Sapiens
LKSLFKKDC

SEQ ID NO: 969561 - protein, 9 aa, Homo Sapiens
KSFVLIAQQ

SEQ ID NO: 969562 - protein, 9 aa, Homo Sapiens
PAGSDMNFV

SEQ ID NO: 969563 - protein, 9 aa, Homo Sapiens
FFLGYLLQF

SEQ ID NO: 969564 - protein, 9 aa, Homo Sapiens
KSVSETPPF

SEQ ID NO: 969565 - protein, 9 aa, Homo Sapiens
SKQHCYSKN

SEQ ID NO: 969566 - protein, 9 aa, Homo Sapiens
EDENSSPQM

SEQ ID NO: 969567 - protein, 9 aa, Homo Sapiens
NKTLTLLSV

SEQ ID NO: 969568 - protein, 9 aa, Homo Sapiens
LEIPGNAIV

SEQ ID NO: 969569 - protein, 9 aa, Homo Sapiens
ARIFFSTAF

SEQ ID NO: 969570 - protein, 9 aa, Homo Sapiens
FTKIGIHLN

SEQ ID NO: 969571 - protein, 9 aa, Homo Sapiens
KSGVLPSQL

SEQ ID NO: 969572 - protein, 9 aa, Homo Sapiens
CGLRVHGVH

SEQ ID NO: 969573 - protein, 9 aa, Homo Sapiens
DPGEEEKHG

SEQ ID NO: 969574 - protein, 9 aa, Homo Sapiens
PSDQGKEKA

SEQ ID NO: 969575 - protein, 9 aa, Homo Sapiens
NLVLGDNCL

SEQ ID NO: 969576 - protein, 9 aa, Homo Sapiens
GRPTSPLHP

SEQ ID NO: 969577 - protein, 9 aa, Homo Sapiens
YDSLTGVLA

SEQ ID NO: 969578 - protein, 9 aa, Homo Sapiens
FKRIIEHYS

SEQ ID NO: 969579 - protein, 9 aa, Homo Sapiens
AASSSSFSS

SEQ ID NO: 969580 - protein, 9 aa, Homo Sapiens
ALRQSSRAV

SEQ ID NO: 969581 - protein, 9 aa, Homo Sapiens
GINAIQAWY

SEQ ID NO: 969582 - protein, 9 aa, Homo Sapiens
KQSDTLNPP

SEQ ID NO: 969583 - protein, 9 aa, Homo Sapiens
SRNSWLKME

SEQ ID NO: 969584 - protein, 9 aa, Homo Sapiens
GINVLVKSK

SEQ ID NO: 969585 - protein, 9 aa, Homo Sapiens
NVLVKSKAF

SEQ ID NO: 969586 - protein, 9 aa, Homo Sapiens
LGALLHCSP

SEQ ID NO: 969587 - protein, 9 aa, Homo Sapiens
KRRWAPITC

SEQ ID NO: 969588 - protein, 9 aa, Homo Sapiens
SLLACTEPS

SEQ ID NO: 969589 - protein, 9 aa, Homo Sapiens
KRELSDDYP

SEQ ID NO: 969590 - protein, 9 aa, Homo Sapiens
QRQVRRRPS

SEQ ID NO: 969591 - protein, 9 aa, Homo Sapiens
SYNIRPDGS

SEQ ID NO: 969592 - protein, 9 aa, Homo Sapiens
SPSFFQQGS

SEQ ID NO: 969593 - protein, 9 aa, Homo Sapiens
STVALSSYY

SEQ ID NO: 969594 - protein, 9 aa, Homo Sapiens
MDIRGPEQE

SEQ ID NO: 969595 - protein, 9 aa, Homo Sapiens
KSVEKRLMP

SEQ ID NO: 969596 - protein, 9 aa, Homo Sapiens
KVYWTKNVT

SEQ ID NO: 969597 - protein, 9 aa, Homo Sapiens
GMVIFHMAV

SEQ ID NO: 969598 - protein, 9 aa, Homo Sapiens
YANICFRFM

SEQ ID NO: 969599 - protein, 9 aa, Homo Sapiens
DNSACPQPR

SEQ ID NO: 969600 - protein, 9 aa, Homo Sapiens
GVFMPVGLV

SEQ ID NO: 969601 - protein, 9 aa, Homo Sapiens
LLRLNAIFS

SEQ ID NO: 969602 - protein, 9 aa, Homo Sapiens
GEDRVPADL

SEQ ID NO: 969603 - protein, 9 aa, Homo Sapiens
SKIIMVTIR

SEQ ID NO: 969604 - protein, 9 aa, Homo Sapiens
WRVSEGRWI

SEQ ID NO: 969605 - protein, 9 aa, Homo Sapiens
LENNGVASL

SEQ ID NO: 969606 - protein, 9 aa, Homo Sapiens
WHQKVHTRE

SEQ ID NO: 969607 - protein, 9 aa, Homo Sapiens
VTKNGEEPV

SEQ ID NO: 969608 - protein, 9 aa, Homo Sapiens
QAVRPQESR

SEQ ID NO: 969609 - protein, 9 aa, Homo Sapiens
LQLSMRNAM

SEQ ID NO: 969610 - protein, 9 aa, Homo Sapiens
KLEINRLSL

SEQ ID NO: 969611 - protein, 9 aa, Homo Sapiens
LLILAPLQP

SEQ ID NO: 969612 - protein, 9 aa, Homo Sapiens
IYNEKNANQ

SEQ ID NO: 969613 - protein, 9 aa, Homo Sapiens
ILLSTLKIK

SEQ ID NO: 969614 - protein, 9 aa, Homo Sapiens
KLLTPSYVG

SEQ ID NO: 969615 - protein, 9 aa, Homo Sapiens
SRMLVDFLS

SEQ ID NO: 969616 - protein, 9 aa, Homo Sapiens
GKIFPEGSC

SEQ ID NO: 969617 - protein, 9 aa, Homo Sapiens
ALPIKSKKK

SEQ ID NO: 969618 - protein, 9 aa, Homo Sapiens
LAEKFKVSG

SEQ ID NO: 969619 - protein, 9 aa, Homo Sapiens
LGTLAALTL

SEQ ID NO: 969620 - protein, 9 aa, Homo Sapiens
NFSNLKQDY

SEQ ID NO: 969621 - protein, 9 aa, Homo Sapiens
PKKEDMELD

SEQ ID NO: 969622 - protein, 9 aa, Homo Sapiens
EEEEMEEVG

SEQ ID NO: 969623 - protein, 9 aa, Homo Sapiens
AKLEINRLS

SEQ ID NO: 969624 - protein, 9 aa, Homo Sapiens
FTEELLRKT

SEQ ID NO: 969625 - protein, 9 aa, Homo Sapiens
EINRIIQRL

SEQ ID NO: 969626 - protein, 9 aa, Homo Sapiens
QGFVLKRSK

SEQ ID NO: 969627 - protein, 9 aa, Homo Sapiens
TGFFGNLCQ

SEQ ID NO: 969628 - protein, 9 aa, Homo Sapiens
SCSAESNGE

SEQ ID NO: 969629 - protein, 9 aa, Homo Sapiens
GSSPAGSRE

SEQ ID NO: 969630 - protein, 9 aa, Homo Sapiens
CFSAMDWPQ

SEQ ID NO: 969631 - protein, 9 aa, Homo Sapiens
HGGSISLGK

SEQ ID NO: 969632 - protein, 9 aa, Homo Sapiens
FWNTHVRKL

SEQ ID NO: 969633 - protein, 9 aa, Homo Sapiens
NPSFFEGKG

SEQ ID NO: 969634 - protein, 9 aa, Homo Sapiens
RWNDYEVPK

SEQ ID NO: 969635 - protein, 9 aa, Homo Sapiens
PPPLVPQFP

SEQ ID NO: 969636 - protein, 9 aa, Homo Sapiens
AAGQAENEA

SEQ ID NO: 969637 - protein, 9 aa, Homo Sapiens
GVDSLNLCD

SEQ ID NO: 969638 - protein, 9 aa, Homo Sapiens
NEKQSDTLN

SEQ ID NO: 969639 - protein, 9 aa, Homo Sapiens
SPEVPRCTV

SEQ ID NO: 969640 - protein, 9 aa, Homo Sapiens
NCDFPPSLL

SEQ ID NO: 969641 - protein, 9 aa, Homo Sapiens
AAPETAAAA

SEQ ID NO: 969642 - protein, 9 aa, Homo Sapiens
AHSSLRNRQ

SEQ ID NO: 969643 - protein, 9 aa, Homo Sapiens
SGASAEPDL

SEQ ID NO: 969644 - protein, 9 aa, Homo Sapiens
MQVLLEGAE

SEQ ID NO: 969645 - protein, 9 aa, Homo Sapiens
EQGHLRNLV

SEQ ID NO: 969646 - protein, 9 aa, Homo Sapiens
FAARDSSIV

SEQ ID NO: 969647 - protein, 9 aa, Homo Sapiens
QASTVEYLL

SEQ ID NO: 969648 - protein, 9 aa, Homo Sapiens
ITSTKTLFQ

SEQ ID NO: 969649 - protein, 9 aa, Homo Sapiens
RFRQSLHLS

SEQ ID NO: 969650 - protein, 9 aa, Homo Sapiens
LTGVLAQQR

SEQ ID NO: 969651 - protein, 9 aa, Homo Sapiens
IHRFLLHMK

SEQ ID NO: 969652 - protein, 9 aa, Homo Sapiens
RPGSLEEAA

SEQ ID NO: 969653 - protein, 9 aa, Homo Sapiens
TLEEFKEVA

SEQ ID NO: 969654 - protein, 9 aa, Homo Sapiens
GLEGLALKA

SEQ ID NO: 969655 - protein, 9 aa, Homo Sapiens
LSTFKDLDF

SEQ ID NO: 969656 - protein, 9 aa, Homo Sapiens
TERKKKGKT

SEQ ID NO: 969657 - protein, 9 aa, Homo Sapiens
FGWAFCLLK

SEQ ID NO: 969658 - protein, 9 aa, Homo Sapiens
IPTPLPPPP

SEQ ID NO: 969659 - protein, 9 aa, Homo Sapiens
KDHYLGLAN

SEQ ID NO: 969660 - protein, 9 aa, Homo Sapiens
NSVLHLSEA

SEQ ID NO: 969661 - protein, 9 aa, Homo Sapiens
KCNKKVDIV

SEQ ID NO: 969662 - protein, 9 aa, Homo Sapiens
NLVVLNFFL

SEQ ID NO: 969663 - protein, 9 aa, Homo Sapiens
LPSGVPAAA

SEQ ID NO: 969664 - protein, 9 aa, Homo Sapiens
ISTATVSTL

SEQ ID NO: 969665 - protein, 9 aa, Homo Sapiens
EREHLASFI

SEQ ID NO: 969666 - protein, 9 aa, Homo Sapiens
SEYLEMKEG

SEQ ID NO: 969667 - protein, 9 aa, Homo Sapiens
SKVEDKLFE

SEQ ID NO: 969668 - protein, 9 aa, Homo Sapiens
LATHQRIYV

SEQ ID NO: 969669 - protein, 9 aa, Homo Sapiens
KSLTSEKDP

SEQ ID NO: 969670 - protein, 9 aa, Homo Sapiens
TPIPTPLPP

SEQ ID NO: 969671 - protein, 9 aa, Homo Sapiens
WRELVLPDT

SEQ ID NO: 969672 - protein, 9 aa, Homo Sapiens
GFTGRRMNF

SEQ ID NO: 969673 - protein, 9 aa, Homo Sapiens
GRYTCVAKN

SEQ ID NO: 969674 - protein, 9 aa, Homo Sapiens
KLPCCLWPR

SEQ ID NO: 969675 - protein, 9 aa, Homo Sapiens
SCERGAPRI

SEQ ID NO: 969676 - protein, 9 aa, Homo Sapiens
DCLLPRIVR

SEQ ID NO: 969677 - protein, 9 aa, Homo Sapiens
NASKVKTYG

SEQ ID NO: 969678 - protein, 9 aa, Homo Sapiens
GPVPMASRP

SEQ ID NO: 969679 - protein, 9 aa, Homo Sapiens
QKFAACNYP

SEQ ID NO: 969680 - protein, 9 aa, Homo Sapiens
TLPALFRQP

SEQ ID NO: 969681 - protein, 9 aa, Homo Sapiens
TCQLKELHL

SEQ ID NO: 969682 - protein, 9 aa, Homo Sapiens
GGFSGKRTS

SEQ ID NO: 969683 - protein, 9 aa, Homo Sapiens
EKKAKNPKK

SEQ ID NO: 969684 - protein, 9 aa, Homo Sapiens
LNNIISEYG

SEQ ID NO: 969685 - protein, 9 aa, Homo Sapiens
IFWDQCTER

SEQ ID NO: 969686 - protein, 9 aa, Homo Sapiens
DWDPRLAII

SEQ ID NO: 969687 - protein, 9 aa, Homo Sapiens
DFRLSSLFA

SEQ ID NO: 969688 - protein, 9 aa, Homo Sapiens
EHSSRRITD

SEQ ID NO: 969689 - protein, 9 aa, Homo Sapiens
TSLQHKGFS

SEQ ID NO: 969690 - protein, 9 aa, Homo Sapiens
GSTSHSTVA

SEQ ID NO: 969691 - protein, 9 aa, Homo Sapiens
NDQQSQEVS

SEQ ID NO: 969692 - protein, 9 aa, Homo Sapiens
VKTHEPAFF

SEQ ID NO: 969693 - protein, 9 aa, Homo Sapiens
QVIPIEEFN

SEQ ID NO: 969694 - protein, 9 aa, Homo Sapiens
RLLLERLHA

SEQ ID NO: 969695 - protein, 9 aa, Homo Sapiens
QKGGNFVTS

SEQ ID NO: 969696 - protein, 9 aa, Homo Sapiens
ERHQAQKDH

SEQ ID NO: 969697 - protein, 9 aa, Homo Sapiens
PKGQKENPA

SEQ ID NO: 969698 - protein, 9 aa, Homo Sapiens
HLSEAPPAA

SEQ ID NO: 969699 - protein, 9 aa, Homo Sapiens
GKIYTVEHM

SEQ ID NO: 969700 - protein, 9 aa, Homo Sapiens
VLTYLTIFS

SEQ ID NO: 969701 - protein, 9 aa, Homo Sapiens
KQNPIEHEK

SEQ ID NO: 969702 - protein, 9 aa, Homo Sapiens
TESTKEHQL

SEQ ID NO: 969703 - protein, 9 aa, Homo Sapiens
IIHTKEKPA

SEQ ID NO: 969704 - protein, 9 aa, Homo Sapiens
SSKFLTSRL

SEQ ID NO: 969705 - protein, 9 aa, Homo Sapiens
LSQANFILG

SEQ ID NO: 969706 - protein, 9 aa, Homo Sapiens
RYGLSLMPG

SEQ ID NO: 969707 - protein, 9 aa, Homo Sapiens
EYLEMKEGV

SEQ ID NO: 969708 - protein, 9 aa, Homo Sapiens
VEAYQWRVS

SEQ ID NO: 969709 - protein, 9 aa, Homo Sapiens
FSRTSPVTT

SEQ ID NO: 969710 - protein, 9 aa, Homo Sapiens
TCCLSLTVG

SEQ ID NO: 969711 - protein, 9 aa, Homo Sapiens
PFRREKEVF

SEQ ID NO: 969712 - protein, 9 aa, Homo Sapiens
MCNLKNIPN

SEQ ID NO: 969713 - protein, 9 aa, Homo Sapiens
DFCHAFHPE

SEQ ID NO: 969714 - protein, 9 aa, Homo Sapiens
KRETHEALV

SEQ ID NO: 969715 - protein, 9 aa, Homo Sapiens
MLVQTERQE

SEQ ID NO: 969716 - protein, 9 aa, Homo Sapiens
CPLYSSFPE

SEQ ID NO: 969717 - protein, 9 aa, Homo Sapiens
MKLLERKAS

SEQ ID NO: 969718 - protein, 9 aa, Homo Sapiens
TVGSNFSLW

SEQ ID NO: 969719 - protein, 9 aa, Homo Sapiens
VSYIEDFAK

SEQ ID NO: 969720 - protein, 9 aa, Homo Sapiens
PPQPQSLAK

SEQ ID NO: 969721 - protein, 9 aa, Homo Sapiens
YATHFSIPL

SEQ ID NO: 969722 - protein, 9 aa, Homo Sapiens
CRALKRKKE

SEQ ID NO: 969723 - protein, 9 aa, Homo Sapiens
CMLGDIQLR

SEQ ID NO: 969724 - protein, 9 aa, Homo Sapiens
SDDEEQRTF

SEQ ID NO: 969725 - protein, 9 aa, Homo Sapiens
AFCLQWCPK

SEQ ID NO: 969726 - protein, 9 aa, Homo Sapiens
PFLSKANCL

SEQ ID NO: 969727 - protein, 9 aa, Homo Sapiens
GRTISSLEE

SEQ ID NO: 969728 - protein, 9 aa, Homo Sapiens
VIPIEEFNL

SEQ ID NO: 969729 - protein, 9 aa, Homo Sapiens
QKICILEKP

SEQ ID NO: 969730 - protein, 9 aa, Homo Sapiens
QGQTFPIKP

SEQ ID NO: 969731 - protein, 9 aa, Homo Sapiens
FMKILEKGK

SEQ ID NO: 969732 - protein, 9 aa, Homo Sapiens
RIAHRAHLQ

SEQ ID NO: 969733 - protein, 9 aa, Homo Sapiens
APMDIRGPE

SEQ ID NO: 969734 - protein, 9 aa, Homo Sapiens
PFMAAAAGP

SEQ ID NO: 969735 - protein, 9 aa, Homo Sapiens
LGRDLFCAW

SEQ ID NO: 969736 - protein, 9 aa, Homo Sapiens
SFSKGDIWW

SEQ ID NO: 969737 - protein, 9 aa, Homo Sapiens
GIVGQLFGG

SEQ ID NO: 969738 - protein, 9 aa, Homo Sapiens
SVLWKYFLN

SEQ ID NO: 969739 - protein, 9 aa, Homo Sapiens
IAPRLLAST

SEQ ID NO: 969740 - protein, 9 aa, Homo Sapiens
LVLLGHYIT

SEQ ID NO: 969741 - protein, 9 aa, Homo Sapiens
GAAEAATRE

SEQ ID NO: 969742 - protein, 9 aa, Homo Sapiens
PLKLAVVER

SEQ ID NO: 969743 - protein, 9 aa, Homo Sapiens
IFELENEVE

SEQ ID NO: 969744 - protein, 9 aa, Homo Sapiens
IPFKEPAVL

SEQ ID NO: 969745 - protein, 9 aa, Homo Sapiens
DGRKINFYK

SEQ ID NO: 969746 - protein, 9 aa, Homo Sapiens
NFKTRTKST

SEQ ID NO: 969747 - protein, 9 aa, Homo Sapiens
SPQPKKIIC

SEQ ID NO: 969748 - protein, 9 aa, Homo Sapiens
LKVAARGLF

SEQ ID NO: 969749 - protein, 9 aa, Homo Sapiens
PSIAYQTKF

SEQ ID NO: 969750 - protein, 9 aa, Homo Sapiens
RLAIIDNLM

SEQ ID NO: 969751 - protein, 9 aa, Homo Sapiens
LVSQYYSLD

SEQ ID NO: 969752 - protein, 9 aa, Homo Sapiens
KAEAAMRNG

SEQ ID NO: 969753 - protein, 9 aa, Homo Sapiens
GYSVRLSFS

SEQ ID NO: 969754 - protein, 9 aa, Homo Sapiens
KPRLSFSPK

SEQ ID NO: 969755 - protein, 9 aa, Homo Sapiens
QVSRRGQKR

SEQ ID NO: 969756 - protein, 9 aa, Homo Sapiens
SIATQRTAG

SEQ ID NO: 969757 - protein, 9 aa, Homo Sapiens
SLVRDHEQE

SEQ ID NO: 969758 - protein, 9 aa, Homo Sapiens
LPSSILSLE

SEQ ID NO: 969759 - protein, 9 aa, Homo Sapiens
GLVGTEPKS

SEQ ID NO: 969760 - protein, 9 aa, Homo Sapiens
LSNSSSGSR

SEQ ID NO: 969761 - protein, 9 aa, Homo Sapiens
HTLCVGRTG

SEQ ID NO: 969762 - protein, 9 aa, Homo Sapiens
MRAPPAFSR

SEQ ID NO: 969763 - protein, 9 aa, Homo Sapiens
PRAAAMVSS

SEQ ID NO: 969764 - protein, 9 aa, Homo Sapiens
RVLLQLRDD

SEQ ID NO: 969765 - protein, 9 aa, Homo Sapiens
ACPRNLTWI

SEQ ID NO: 969766 - protein, 9 aa, Homo Sapiens
CSPEVDPIE

SEQ ID NO: 969767 - protein, 9 aa, Homo Sapiens
LKSLIQEKD

SEQ ID NO: 969768 - protein, 9 aa, Homo Sapiens
LSTMSAERD

SEQ ID NO: 969769 - protein, 9 aa, Homo Sapiens
VDPEKFFSR

SEQ ID NO: 969770 - protein, 9 aa, Homo Sapiens
NSFLIIHQR

SEQ ID NO: 969771 - protein, 9 aa, Homo Sapiens
PCGLHAPLT

SEQ ID NO: 969772 - protein, 9 aa, Homo Sapiens
YSISPGIQG

SEQ ID NO: 969773 - protein, 9 aa, Homo Sapiens
RKSKVEDKL

SEQ ID NO: 969774 - protein, 9 aa, Homo Sapiens
VGGIVGQLF

SEQ ID NO: 969775 - protein, 9 aa, Homo Sapiens
RPDKLHLEK

SEQ ID NO: 969776 - protein, 9 aa, Homo Sapiens
RTAHNARKK

SEQ ID NO: 969777 - protein, 9 aa, Homo Sapiens
GAYELGIMV

SEQ ID NO: 969778 - protein, 9 aa, Homo Sapiens
EPGESVVIT

SEQ ID NO: 969779 - protein, 9 aa, Homo Sapiens
HSEEKPYKC

SEQ ID NO: 969780 - protein, 9 aa, Homo Sapiens
KWFLDMEST

SEQ ID NO: 969781 - protein, 9 aa, Homo Sapiens
PVIRRLARR

SEQ ID NO: 969782 - protein, 9 aa, Homo Sapiens
SLSKDGRSL

SEQ ID NO: 969783 - protein, 9 aa, Homo Sapiens
LICFSLVSL

SEQ ID NO: 969784 - protein, 9 aa, Homo Sapiens
LITRLSEIE

SEQ ID NO: 969785 - protein, 9 aa, Homo Sapiens
PLGVSYIED

SEQ ID NO: 969786 - protein, 9 aa, Homo Sapiens
PSFSDSATR

SEQ ID NO: 969787 - protein, 9 aa, Homo Sapiens
DIQLRGQTG

SEQ ID NO: 969788 - protein, 9 aa, Homo Sapiens
QRLFRFSFV

SEQ ID NO: 969789 - protein, 9 aa, Homo Sapiens
DLLQSSVLW

SEQ ID NO: 969790 - protein, 9 aa, Homo Sapiens
SQGMNSYSM

SEQ ID NO: 969791 - protein, 9 aa, Homo Sapiens
EAEIEPENI

SEQ ID NO: 969792 - protein, 9 aa, Homo Sapiens
GSLFFRTPK

SEQ ID NO: 969793 - protein, 9 aa, Homo Sapiens
EPRMCGFFS

SEQ ID NO: 969794 - protein, 9 aa, Homo Sapiens
SDLYADDPV

SEQ ID NO: 969795 - protein, 9 aa, Homo Sapiens
SALKAHWST

SEQ ID NO: 969796 - protein, 9 aa, Homo Sapiens
CEDENSSPQ

SEQ ID NO: 969797 - protein, 9 aa, Homo Sapiens
ETRNSPAPP

SEQ ID NO: 969798 - protein, 9 aa, Homo Sapiens
PSEPSKFVR

SEQ ID NO: 969799 - protein, 9 aa, Homo Sapiens
IYISRIISG

SEQ ID NO: 969800 - protein, 9 aa, Homo Sapiens
VHAEVQHIL

SEQ ID NO: 969801 - protein, 9 aa, Homo Sapiens
VPNRGGRPN

SEQ ID NO: 969802 - protein, 9 aa, Homo Sapiens
LCVGRTGGQ

SEQ ID NO: 969803 - protein, 9 aa, Homo Sapiens
YNKGECGSK

SEQ ID NO: 969804 - protein, 9 aa, Homo Sapiens
RQVGKVCRQ

SEQ ID NO: 969805 - protein, 9 aa, Homo Sapiens
NLLHSTPML

SEQ ID NO: 969806 - protein, 9 aa, Homo Sapiens
QQNGEDGGS

SEQ ID NO: 969807 - protein, 9 aa, Homo Sapiens
SLCCSSSYS

SEQ ID NO: 969808 - protein, 9 aa, Homo Sapiens
NERTILISA

SEQ ID NO: 969809 - protein, 9 aa, Homo Sapiens
DAISRLGKE

SEQ ID NO: 969810 - protein, 9 aa, Homo Sapiens
QVRRADTSR

SEQ ID NO: 969811 - protein, 9 aa, Homo Sapiens
SWPRLFSDG

SEQ ID NO: 969812 - protein, 9 aa, Homo Sapiens
FVLEIPGNA

SEQ ID NO: 969813 - protein, 9 aa, Homo Sapiens
VQDSVGEKV

SEQ ID NO: 969814 - protein, 9 aa, Homo Sapiens
KEREKPLST

SEQ ID NO: 969815 - protein, 9 aa, Homo Sapiens
KISNDDDEH

SEQ ID NO: 969816 - protein, 9 aa, Homo Sapiens
DREALISDE

SEQ ID NO: 969817 - protein, 9 aa, Homo Sapiens
PPLPGVGIL

SEQ ID NO: 969818 - protein, 9 aa, Homo Sapiens
QNSAGGRRS

SEQ ID NO: 969819 - protein, 9 aa, Homo Sapiens
SDELQLSMR

SEQ ID NO: 969820 - protein, 9 aa, Homo Sapiens
SHDCVSVLS

SEQ ID NO: 969821 - protein, 9 aa, Homo Sapiens
ELVLPDTLH

SEQ ID NO: 969822 - protein, 9 aa, Homo Sapiens
TPRKFCLAG

SEQ ID NO: 969823 - protein, 9 aa, Homo Sapiens
IIYSISPGI

SEQ ID NO: 969824 - protein, 9 aa, Homo Sapiens
KNQSSCGQE

SEQ ID NO: 969825 - protein, 9 aa, Homo Sapiens
DYSSLLKRL

SEQ ID NO: 969826 - protein, 9 aa, Homo Sapiens
LLPRPWITL

SEQ ID NO: 969827 - protein, 9 aa, Homo Sapiens
EQRKWFLDM

SEQ ID NO: 969828 - protein, 9 aa, Homo Sapiens
IAKLQKMEA

SEQ ID NO: 969829 - protein, 9 aa, Homo Sapiens
AENKRRYSA

SEQ ID NO: 969830 - protein, 9 aa, Homo Sapiens
TNCDTAYQH

SEQ ID NO: 969831 - protein, 9 aa, Homo Sapiens
FINLFGLAS

SEQ ID NO: 969832 - protein, 9 aa, Homo Sapiens
RQSPANGYS

SEQ ID NO: 969833 - protein, 9 aa, Homo Sapiens
FKEEDMTKV

SEQ ID NO: 969834 - protein, 9 aa, Homo Sapiens
HLSSPDNFW

SEQ ID NO: 969835 - protein, 9 aa, Homo Sapiens
KDNVGPWAP

SEQ ID NO: 969836 - protein, 9 aa, Homo Sapiens
SSEGLDCLA

SEQ ID NO: 969837 - protein, 9 aa, Homo Sapiens
FRQSLHLSK

SEQ ID NO: 969838 - protein, 9 aa, Homo Sapiens
VPHSALIIS

SEQ ID NO: 969839 - protein, 9 aa, Homo Sapiens
SLLRYRTNT

SEQ ID NO: 969840 - protein, 9 aa, Homo Sapiens
KPAAFAAQG

SEQ ID NO: 969841 - protein, 9 aa, Homo Sapiens
VITIPVIRQ

SEQ ID NO: 969842 - protein, 9 aa, Homo Sapiens
YLKSFHNSS

SEQ ID NO: 969843 - protein, 9 aa, Homo Sapiens
GDGGGLSRG

SEQ ID NO: 969844 - protein, 9 aa, Homo Sapiens
WYSPIKEKL

SEQ ID NO: 969845 - protein, 9 aa, Homo Sapiens
ASVVVRRNL

SEQ ID NO: 969846 - protein, 9 aa, Homo Sapiens
GNEPKWCIK

SEQ ID NO: 969847 - protein, 9 aa, Homo Sapiens
LTTNPLLTQ

SEQ ID NO: 969848 - protein, 9 aa, Homo Sapiens
TVALPGDEH

SEQ ID NO: 969849 - protein, 9 aa, Homo Sapiens
AGFKGFGSH

SEQ ID NO: 969850 - protein, 9 aa, Homo Sapiens
EKFDDENLL

SEQ ID NO: 969851 - protein, 9 aa, Homo Sapiens
LPQGYPLPK

SEQ ID NO: 969852 - protein, 9 aa, Homo Sapiens
DENENLKKC

SEQ ID NO: 969853 - protein, 9 aa, Homo Sapiens
SAATAQRGS

SEQ ID NO: 969854 - protein, 9 aa, Homo Sapiens
GSSKSMCFL

SEQ ID NO: 969855 - protein, 9 aa, Homo Sapiens
LLPFGPFST

SEQ ID NO: 969856 - protein, 9 aa, Homo Sapiens
ATEAVGPGG

SEQ ID NO: 969857 - protein, 9 aa, Homo Sapiens
GPFASTTKT

SEQ ID NO: 969858 - protein, 9 aa, Homo Sapiens
QYFFPQGYG

SEQ ID NO: 969859 - protein, 9 aa, Homo Sapiens
KDCDRRCLF

SEQ ID NO: 969860 - protein, 9 aa, Homo Sapiens
SGGYPGSAL

SEQ ID NO: 969861 - protein, 9 aa, Homo Sapiens
NSSSGSRTA

SEQ ID NO: 969862 - protein, 9 aa, Homo Sapiens
KPVIRRLAR

SEQ ID NO: 969863 - protein, 9 aa, Homo Sapiens
EFKYKEGYC

SEQ ID NO: 969864 - protein, 9 aa, Homo Sapiens
SVFYFASVS

SEQ ID NO: 969865 - protein, 9 aa, Homo Sapiens
VLRSLPEEV

SEQ ID NO: 969866 - protein, 9 aa, Homo Sapiens
LQVALGKLR

SEQ ID NO: 969867 - protein, 9 aa, Homo Sapiens
ICFRFMGIE

SEQ ID NO: 969868 - protein, 9 aa, Homo Sapiens
LEERDWDPR

SEQ ID NO: 969869 - protein, 9 aa, Homo Sapiens
REAFLGEAS

SEQ ID NO: 969870 - protein, 9 aa, Homo Sapiens
AGCLGSHRR

SEQ ID NO: 969871 - protein, 9 aa, Homo Sapiens
DGIYTAHLV

SEQ ID NO: 969872 - protein, 9 aa, Homo Sapiens
EVETELFLT

SEQ ID NO: 969873 - protein, 9 aa, Homo Sapiens
LISLSKKKA

SEQ ID NO: 969874 - protein, 9 aa, Homo Sapiens
GMDESTITD

SEQ ID NO: 969875 - protein, 9 aa, Homo Sapiens
LSKNHPSQT

SEQ ID NO: 969876 - protein, 9 aa, Homo Sapiens
CATPLDKAV

SEQ ID NO: 969877 - protein, 9 aa, Homo Sapiens
AKNISEVEE

SEQ ID NO: 969878 - protein, 9 aa, Homo Sapiens
AGWAVTVYN

SEQ ID NO: 969879 - protein, 9 aa, Homo Sapiens
MGLWVIQVQ

SEQ ID NO: 969880 - protein, 9 aa, Homo Sapiens
STGTSEAAK

SEQ ID NO: 969881 - protein, 9 aa, Homo Sapiens
QISFQEDKP

SEQ ID NO: 969882 - protein, 9 aa, Homo Sapiens
SECPFQEDE

SEQ ID NO: 969883 - protein, 9 aa, Homo Sapiens
HTLLFYVHF

SEQ ID NO: 969884 - protein, 9 aa, Homo Sapiens
RLKRRHRCG

SEQ ID NO: 969885 - protein, 9 aa, Homo Sapiens
VLGMSPVGN

SEQ ID NO: 969886 - protein, 9 aa, Homo Sapiens
AVSFSLAFR

SEQ ID NO: 969887 - protein, 9 aa, Homo Sapiens
FRDVVIEFF

SEQ ID NO: 969888 - protein, 9 aa, Homo Sapiens
KIFPEGSCL

SEQ ID NO: 969889 - protein, 9 aa, Homo Sapiens
EARLLLERL

SEQ ID NO: 969890 - protein, 9 aa, Homo Sapiens
LTLTEICRR

SEQ ID NO: 969891 - protein, 9 aa, Homo Sapiens
HADEVWPGF

SEQ ID NO: 969892 - protein, 9 aa, Homo Sapiens
FPCRVCTKV

SEQ ID NO: 969893 - protein, 9 aa, Homo Sapiens
LEEAAALVE

SEQ ID NO: 969894 - protein, 9 aa, Homo Sapiens
GVSPEALLA

SEQ ID NO: 969895 - protein, 9 aa, Homo Sapiens
VGLTGMLSN

SEQ ID NO: 969896 - protein, 9 aa, Homo Sapiens
LPPPPLPTE

SEQ ID NO: 969897 - protein, 9 aa, Homo Sapiens
SSFTKIGIH

SEQ ID NO: 969898 - protein, 9 aa, Homo Sapiens
EEPVPSEEE

SEQ ID NO: 969899 - protein, 9 aa, Homo Sapiens
VCLAHPELQ

SEQ ID NO: 969900 - protein, 9 aa, Homo Sapiens
KEKPAKSEE

SEQ ID NO: 969901 - protein, 9 aa, Homo Sapiens
FEKQKVGEE

SEQ ID NO: 969902 - protein, 9 aa, Homo Sapiens
VDSLNLCDG

SEQ ID NO: 969903 - protein, 9 aa, Homo Sapiens
SFSTAAHGS

SEQ ID NO: 969904 - protein, 9 aa, Homo Sapiens
SPSFLNFFS

SEQ ID NO: 969905 - protein, 9 aa, Homo Sapiens
AYSSFAAAV

SEQ ID NO: 969906 - protein, 9 aa, Homo Sapiens
VDIVKRLLI

SEQ ID NO: 969907 - protein, 9 aa, Homo Sapiens
RNLVLGDNC

SEQ ID NO: 969908 - protein, 9 aa, Homo Sapiens
NGHLLVGLF

SEQ ID NO: 969909 - protein, 9 aa, Homo Sapiens
VNVNPERTN

SEQ ID NO: 969910 - protein, 9 aa, Homo Sapiens
LNFFSTLIN

SEQ ID NO: 969911 - protein, 9 aa, Homo Sapiens
KDYDTTTEF

SEQ ID NO: 969912 - protein, 9 aa, Homo Sapiens
GQNGLTHQS

SEQ ID NO: 969913 - protein, 9 aa, Homo Sapiens
PNAVCAHGL

SEQ ID NO: 969914 - protein, 9 aa, Homo Sapiens
EKLDALWVL

SEQ ID NO: 969915 - protein, 9 aa, Homo Sapiens
SLLYKKRLK

SEQ ID NO: 969916 - protein, 9 aa, Homo Sapiens
LVGSSSTSS

SEQ ID NO: 969917 - protein, 9 aa, Homo Sapiens
CLNCSVLSG

SEQ ID NO: 969918 - protein, 9 aa, Homo Sapiens
NIVFVMDAS

SEQ ID NO: 969919 - protein, 9 aa, Homo Sapiens
SECKRNHKF

SEQ ID NO: 969920 - protein, 9 aa, Homo Sapiens
QGANRTSFL

SEQ ID NO: 969921 - protein, 9 aa, Homo Sapiens
ELSPPLSDK

SEQ ID NO: 969922 - protein, 9 aa, Homo Sapiens
VSRMGWGGK

SEQ ID NO: 969923 - protein, 9 aa, Homo Sapiens
YPRPIMPNT

SEQ ID NO: 969924 - protein, 9 aa, Homo Sapiens
QTLSAGLGH

SEQ ID NO: 969925 - protein, 9 aa, Homo Sapiens
VVTTNLVNN

SEQ ID NO: 969926 - protein, 9 aa, Homo Sapiens
ALGKLRRKQ

SEQ ID NO: 969927 - protein, 9 aa, Homo Sapiens
GDLVEILNE

SEQ ID NO: 969928 - protein, 9 aa, Homo Sapiens
QQDIMYKGV

SEQ ID NO: 969929 - protein, 9 aa, Homo Sapiens
RREKFFGQG

SEQ ID NO: 969930 - protein, 9 aa, Homo Sapiens
SQNSHLIWH

SEQ ID NO: 969931 - protein, 9 aa, Homo Sapiens
NTRELQEKM

SEQ ID NO: 969932 - protein, 9 aa, Homo Sapiens
KRKKSDKTG

SEQ ID NO: 969933 - protein, 9 aa, Homo Sapiens
REKKIQSLL

SEQ ID NO: 969934 - protein, 9 aa, Homo Sapiens
AQPESPLAT

SEQ ID NO: 969935 - protein, 9 aa, Homo Sapiens
FLCSMTALL

SEQ ID NO: 969936 - protein, 9 aa, Homo Sapiens
NKFSILNER

SEQ ID NO: 969937 - protein, 9 aa, Homo Sapiens
PNLSVFKLI

SEQ ID NO: 969938 - protein, 9 aa, Homo Sapiens
LKCRMAYQD

SEQ ID NO: 969939 - protein, 9 aa, Homo Sapiens
FVFFACEEY

SEQ ID NO: 969940 - protein, 9 aa, Homo Sapiens
FFEMIHEAQ

SEQ ID NO: 969941 - protein, 9 aa, Homo Sapiens
VGGVLGAVW

SEQ ID NO: 969942 - protein, 9 aa, Homo Sapiens
ASFIRLTPT

SEQ ID NO: 969943 - protein, 9 aa, Homo Sapiens
HQTLSAGLG

SEQ ID NO: 969944 - protein, 9 aa, Homo Sapiens
GDCISEVCF

SEQ ID NO: 969945 - protein, 9 aa, Homo Sapiens
FIIYHCALR

SEQ ID NO: 969946 - protein, 9 aa, Homo Sapiens
AEARGHTGP

SEQ ID NO: 969947 - protein, 9 aa, Homo Sapiens
TKISNDDDE

SEQ ID NO: 969948 - protein, 9 aa, Homo Sapiens
KPEPSISWQ

SEQ ID NO: 969949 - protein, 9 aa, Homo Sapiens
GVNDDRLEE

SEQ ID NO: 969950 - protein, 9 aa, Homo Sapiens
RLRLGVIQK

SEQ ID NO: 969951 - protein, 9 aa, Homo Sapiens
HFSPLSEDI

SEQ ID NO: 969952 - protein, 9 aa, Homo Sapiens
LSNSLDPPH

SEQ ID NO: 969953 - protein, 9 aa, Homo Sapiens
WEFVEQEVL

SEQ ID NO: 969954 - protein, 9 aa, Homo Sapiens
LAAARRQSS

SEQ ID NO: 969955 - protein, 9 aa, Homo Sapiens
AMGLWVIQV

SEQ ID NO: 969956 - protein, 9 aa, Homo Sapiens
WLLGTAACR

SEQ ID NO: 969957 - protein, 9 aa, Homo Sapiens
PGSGPLPRE

SEQ ID NO: 969958 - protein, 9 aa, Homo Sapiens
RWAKTNGQL

SEQ ID NO: 969959 - protein, 9 aa, Homo Sapiens
GLELQETSE

SEQ ID NO: 969960 - protein, 9 aa, Homo Sapiens
KHAPVHSFF

SEQ ID NO: 969961 - protein, 9 aa, Homo Sapiens
LEEELAKLK

SEQ ID NO: 969962 - protein, 9 aa, Homo Sapiens
REPGSGKST

SEQ ID NO: 969963 - protein, 9 aa, Homo Sapiens
HVPNIYVDC

SEQ ID NO: 969964 - protein, 9 aa, Homo Sapiens
TSLQQELGL

SEQ ID NO: 969965 - protein, 9 aa, Homo Sapiens
KPEGRVGGV

SEQ ID NO: 969966 - protein, 9 aa, Homo Sapiens
FRIVEQENA

SEQ ID NO: 969967 - protein, 9 aa, Homo Sapiens
LEKRLQQSW

SEQ ID NO: 969968 - protein, 9 aa, Homo Sapiens
FMLFCMSVT

SEQ ID NO: 969969 - protein, 9 aa, Homo Sapiens
DFKVRSLKM

SEQ ID NO: 969970 - protein, 9 aa, Homo Sapiens
HRRDSDLGA

SEQ ID NO: 969971 - protein, 9 aa, Homo Sapiens
ALHFKSSTH

SEQ ID NO: 969972 - protein, 9 aa, Homo Sapiens
RDDASMDQD

SEQ ID NO: 969973 - protein, 9 aa, Homo Sapiens
SRMHQTLSA

SEQ ID NO: 969974 - protein, 9 aa, Homo Sapiens
HPCLQVPKL

SEQ ID NO: 969975 - protein, 9 aa, Homo Sapiens
LSSEETVPI

SEQ ID NO: 969976 - protein, 9 aa, Homo Sapiens
ICILEKPFE

SEQ ID NO: 969977 - protein, 9 aa, Homo Sapiens
SNRLCFLEP

SEQ ID NO: 969978 - protein, 9 aa, Homo Sapiens
RMRRSAAGF

SEQ ID NO: 969979 - protein, 9 aa, Homo Sapiens
AMDWPQTFE

SEQ ID NO: 969980 - protein, 9 aa, Homo Sapiens
GIIAAIGEQ

SEQ ID NO: 969981 - protein, 9 aa, Homo Sapiens
PASRMHQTL

SEQ ID NO: 969982 - protein, 9 aa, Homo Sapiens
LKTRVQKEN

SEQ ID NO: 969983 - protein, 9 aa, Homo Sapiens
EQEVLLKGP

SEQ ID NO: 969984 - protein, 9 aa, Homo Sapiens
TRMCRHSVI

SEQ ID NO: 969985 - protein, 9 aa, Homo Sapiens
DSVAKLGEQ

SEQ ID NO: 969986 - protein, 9 aa, Homo Sapiens
SILNERGIK

SEQ ID NO: 969987 - protein, 9 aa, Homo Sapiens
TFGYFLKDL

SEQ ID NO: 969988 - protein, 9 aa, Homo Sapiens
LPWDFVRRM

SEQ ID NO: 969989 - protein, 9 aa, Homo Sapiens
VYKQVMFEE

SEQ ID NO: 969990 - protein, 9 aa, Homo Sapiens
LSEDIKLSV

SEQ ID NO: 969991 - protein, 9 aa, Homo Sapiens
SPDNFWYLN

SEQ ID NO: 969992 - protein, 9 aa, Homo Sapiens
STTPGTPVT

SEQ ID NO: 969993 - protein, 9 aa, Homo Sapiens
KWYSPIKEK

SEQ ID NO: 969994 - protein, 9 aa, Homo Sapiens
GMYSSSRYP

SEQ ID NO: 969995 - protein, 9 aa, Homo Sapiens
RSSPRVSSQ

SEQ ID NO: 969996 - protein, 9 aa, Homo Sapiens
LSINFEFVK

SEQ ID NO: 969997 - protein, 9 aa, Homo Sapiens
SPAADSYEE

SEQ ID NO: 969998 - protein, 9 aa, Homo Sapiens
ASHSVSGSL

SEQ ID NO: 969999 - protein, 9 aa, Homo Sapiens
AGQLAFSGR

SEQ ID NO: 970000 - protein, 9 aa, Homo Sapiens
PERSRARCM

SEQ ID NO: 970001 - protein, 9 aa, Homo Sapiens
AKEKARKEA

SEQ ID NO: 970002 - protein, 9 aa, Homo Sapiens
NTMSKICGQ

SEQ ID NO: 970003 - protein, 9 aa, Homo Sapiens
EESKKQRLG

SEQ ID NO: 970004 - protein, 9 aa, Homo Sapiens
TKRNCHLNK

SEQ ID NO: 970005 - protein, 9 aa, Homo Sapiens
EQFLVKKAE

SEQ ID NO: 970006 - protein, 9 aa, Homo Sapiens
SPEPLNQVT

SEQ ID NO: 970007 - protein, 9 aa, Homo Sapiens
NIISEYGRT

SEQ ID NO: 970008 - protein, 9 aa, Homo Sapiens
SKLSYTFSH

SEQ ID NO: 970009 - protein, 9 aa, Homo Sapiens
WDPLGCQGC

SEQ ID NO: 970010 - protein, 9 aa, Homo Sapiens
GESVVITIP

SEQ ID NO: 970011 - protein, 9 aa, Homo Sapiens
LQEAVISAK

SEQ ID NO: 970012 - protein, 9 aa, Homo Sapiens
KFDLIAVSN

SEQ ID NO: 970013 - protein, 9 aa, Homo Sapiens
KCTDCLDED

SEQ ID NO: 970014 - protein, 9 aa, Homo Sapiens
RSESPSCIR

SEQ ID NO: 970015 - protein, 9 aa, Homo Sapiens
SLEEAAALV

SEQ ID NO: 970016 - protein, 9 aa, Homo Sapiens
AQNYVIQFA

SEQ ID NO: 970017 - protein, 9 aa, Homo Sapiens
GLVPNLGPA

SEQ ID NO: 970018 - protein, 9 aa, Homo Sapiens
LNQVTESAR

SEQ ID NO: 970019 - protein, 9 aa, Homo Sapiens
KEKTPESGR

SEQ ID NO: 970020 - protein, 9 aa, Homo Sapiens
TVSTLAPPP

SEQ ID NO: 970021 - protein, 9 aa, Homo Sapiens
PADPSFSGA

SEQ ID NO: 970022 - protein, 9 aa, Homo Sapiens
RVHGLYWMH

SEQ ID NO: 970023 - protein, 9 aa, Homo Sapiens
NGQSGQISF

SEQ ID NO: 970024 - protein, 9 aa, Homo Sapiens
MVIFHMAVS

SEQ ID NO: 970025 - protein, 9 aa, Homo Sapiens
FKNPSFFEG

SEQ ID NO: 970026 - protein, 9 aa, Homo Sapiens
QHCYSKNQS

SEQ ID NO: 970027 - protein, 9 aa, Homo Sapiens
SLLASGRRE

SEQ ID NO: 970028 - protein, 9 aa, Homo Sapiens
DNFWYLNRG

SEQ ID NO: 970029 - protein, 9 aa, Homo Sapiens
ETPPFSGND

SEQ ID NO: 970030 - protein, 9 aa, Homo Sapiens
VVLFKNKVF

SEQ ID NO: 970031 - protein, 9 aa, Homo Sapiens
KKSDKTGVR

SEQ ID NO: 970032 - protein, 9 aa, Homo Sapiens
SPASSPSFF

SEQ ID NO: 970033 - protein, 9 aa, Homo Sapiens
RKKQELSNS

SEQ ID NO: 970034 - protein, 9 aa, Homo Sapiens
HIKGERAQW

SEQ ID NO: 970035 - protein, 9 aa, Homo Sapiens
SRPGFLIFW

SEQ ID NO: 970036 - protein, 9 aa, Homo Sapiens
YCLAFVLEI

SEQ ID NO: 970037 - protein, 9 aa, Homo Sapiens
CEFAFGPGS

SEQ ID NO: 970038 - protein, 9 aa, Homo Sapiens
ASRMHQTLS

SEQ ID NO: 970039 - protein, 9 aa, Homo Sapiens
CQGCPAPWA

SEQ ID NO: 970040 - protein, 9 aa, Homo Sapiens
LLLQVCWLV

SEQ ID NO: 970041 - protein, 9 aa, Homo Sapiens
MTSNKISKR

SEQ ID NO: 970042 - protein, 9 aa, Homo Sapiens
AGEVEKRVD

SEQ ID NO: 970043 - protein, 9 aa, Homo Sapiens
PMLALTTVK

SEQ ID NO: 970044 - protein, 9 aa, Homo Sapiens
VPRLKNMIL

SEQ ID NO: 970045 - protein, 9 aa, Homo Sapiens
GEIATYRKL

SEQ ID NO: 970046 - protein, 9 aa, Homo Sapiens
ASRLSVAAL

SEQ ID NO: 970047 - protein, 9 aa, Homo Sapiens
NPAHWALSI

SEQ ID NO: 970048 - protein, 9 aa, Homo Sapiens
TSNKISKRI

SEQ ID NO: 970049 - protein, 9 aa, Homo Sapiens
YLLGDIPED

SEQ ID NO: 970050 - protein, 9 aa, Homo Sapiens
SGHEEKSLS

SEQ ID NO: 970051 - protein, 9 aa, Homo Sapiens
DILNARLIR

SEQ ID NO: 970052 - protein, 9 aa, Homo Sapiens
LQPFYSSEV

SEQ ID NO: 970053 - protein, 9 aa, Homo Sapiens
TPTGREFKG

SEQ ID NO: 970054 - protein, 9 aa, Homo Sapiens
SPSSLSMAF

SEQ ID NO: 970055 - protein, 9 aa, Homo Sapiens
VCCVCPMCN

SEQ ID NO: 970056 - protein, 9 aa, Homo Sapiens
KTDVPSGRS

SEQ ID NO: 970057 - protein, 9 aa, Homo Sapiens
INAIQAWYK

SEQ ID NO: 970058 - protein, 9 aa, Homo Sapiens
DLSQNKKEQ

SEQ ID NO: 970059 - protein, 9 aa, Homo Sapiens
PLCTHAGDA

SEQ ID NO: 970060 - protein, 9 aa, Homo Sapiens
TLAPGQNKI

SEQ ID NO: 970061 - protein, 9 aa, Homo Sapiens
IILRLLNSE

SEQ ID NO: 970062 - protein, 9 aa, Homo Sapiens
ECKRNHKFV

SEQ ID NO: 970063 - protein, 9 aa, Homo Sapiens
SASTPLYQP

SEQ ID NO: 970064 - protein, 9 aa, Homo Sapiens
ITSVQLNNR

SEQ ID NO: 970065 - protein, 9 aa, Homo Sapiens
KIFRYGYSV

SEQ ID NO: 970066 - protein, 9 aa, Homo Sapiens
CMGTKTTVI

SEQ ID NO: 970067 - protein, 9 aa, Homo Sapiens
LDVSRNKIP

SEQ ID NO: 970068 - protein, 9 aa, Homo Sapiens
SEDAEEEGL

SEQ ID NO: 970069 - protein, 9 aa, Homo Sapiens
PSKAWGQVK

SEQ ID NO: 970070 - protein, 9 aa, Homo Sapiens
QETGACLGL

SEQ ID NO: 970071 - protein, 9 aa, Homo Sapiens
QERLTSFIS

SEQ ID NO: 970072 - protein, 9 aa, Homo Sapiens
PCNCVPDSA

SEQ ID NO: 970073 - protein, 9 aa, Homo Sapiens
VSPEALLAP

SEQ ID NO: 970074 - protein, 9 aa, Homo Sapiens
WGQVKRQIY

SEQ ID NO: 970075 - protein, 9 aa, Homo Sapiens
SKVYWTKNV

SEQ ID NO: 970076 - protein, 9 aa, Homo Sapiens
GLASGLTEE

SEQ ID NO: 970077 - protein, 9 aa, Homo Sapiens
SFFLAIYLP

SEQ ID NO: 970078 - protein, 9 aa, Homo Sapiens
IYNLNSHRK

SEQ ID NO: 970079 - protein, 9 aa, Homo Sapiens
VKKQAFNLE

SEQ ID NO: 970080 - protein, 9 aa, Homo Sapiens
PDSWFLEMD

SEQ ID NO: 970081 - protein, 9 aa, Homo Sapiens
DQHKNQRRN

SEQ ID NO: 970082 - protein, 9 aa, Homo Sapiens
FLVLAVRFS

SEQ ID NO: 970083 - protein, 9 aa, Homo Sapiens
HKECVAATF

SEQ ID NO: 970084 - protein, 9 aa, Homo Sapiens
QETAETVLP

SEQ ID NO: 970085 - protein, 9 aa, Homo Sapiens
RLLNSEDMS

SEQ ID NO: 970086 - protein, 9 aa, Homo Sapiens
ANLGIVGLL

SEQ ID NO: 970087 - protein, 9 aa, Homo Sapiens
GDLVEIKGE

SEQ ID NO: 970088 - protein, 9 aa, Homo Sapiens
SEPSKFVRL

SEQ ID NO: 970089 - protein, 9 aa, Homo Sapiens
QRRLRFNVK

SEQ ID NO: 970090 - protein, 9 aa, Homo Sapiens
PTSPLHPTA

SEQ ID NO: 970091 - protein, 9 aa, Homo Sapiens
PLPPGRQEK

SEQ ID NO: 970092 - protein, 9 aa, Homo Sapiens
AWDNKRETF

SEQ ID NO: 970093 - protein, 9 aa, Homo Sapiens
NQVTESART

SEQ ID NO: 970094 - protein, 9 aa, Homo Sapiens
RWYADRAVF

SEQ ID NO: 970095 - protein, 9 aa, Homo Sapiens
SMRSGVSDD

SEQ ID NO: 970096 - protein, 9 aa, Homo Sapiens
ALLEEVAPN

SEQ ID NO: 970097 - protein, 9 aa, Homo Sapiens
RDSRQGQTF

SEQ ID NO: 970098 - protein, 9 aa, Homo Sapiens
AADLLQQAY

SEQ ID NO: 970099 - protein, 9 aa, Homo Sapiens
VQFFQRELL

SEQ ID NO: 970100 - protein, 9 aa, Homo Sapiens
HQETAETVL

SEQ ID NO: 970101 - protein, 9 aa, Homo Sapiens
YIVTVMVDC

SEQ ID NO: 970102 - protein, 9 aa, Homo Sapiens
SAAFLMLPC

SEQ ID NO: 970103 - protein, 9 aa, Homo Sapiens
AKNILGEAG

SEQ ID NO: 970104 - protein, 9 aa, Homo Sapiens
SSLLRYRTN

SEQ ID NO: 970105 - protein, 9 aa, Homo Sapiens
FLMPLTQEQ

SEQ ID NO: 970106 - protein, 9 aa, Homo Sapiens
DKGILWQIT

SEQ ID NO: 970107 - protein, 9 aa, Homo Sapiens
SRPRHLSNS

SEQ ID NO: 970108 - protein, 9 aa, Homo Sapiens
LPTAPPLPP

SEQ ID NO: 970109 - protein, 9 aa, Homo Sapiens
LQVCWLVME

SEQ ID NO: 970110 - protein, 9 aa, Homo Sapiens
LSPKESTSL

SEQ ID NO: 970111 - protein, 9 aa, Homo Sapiens
NKVLCAMTD

SEQ ID NO: 970112 - protein, 9 aa, Homo Sapiens
PIEHEKIHT

SEQ ID NO: 970113 - protein, 9 aa, Homo Sapiens
PGSLEEAAA

SEQ ID NO: 970114 - protein, 9 aa, Homo Sapiens
DSNTSLPSG

SEQ ID NO: 970115 - protein, 9 aa, Homo Sapiens
TKAGAKEKA

SEQ ID NO: 970116 - protein, 9 aa, Homo Sapiens
RLSFSPKPT

SEQ ID NO: 970117 - protein, 9 aa, Homo Sapiens
LFAARDSSI

SEQ ID NO: 970118 - protein, 9 aa, Homo Sapiens
IQFSPGSGK

SEQ ID NO: 970119 - protein, 9 aa, Homo Sapiens
EEEKKNEKR

SEQ ID NO: 970120 - protein, 9 aa, Homo Sapiens
KTKTIKRSL

SEQ ID NO: 970121 - protein, 9 aa, Homo Sapiens
RMCGFFSLQ

SEQ ID NO: 970122 - protein, 9 aa, Homo Sapiens
NVRLLENAL

SEQ ID NO: 970123 - protein, 9 aa, Homo Sapiens
PGKEKVALL

SEQ ID NO: 970124 - protein, 9 aa, Homo Sapiens
KLEMELSWK

SEQ ID NO: 970125 - protein, 9 aa, Homo Sapiens
AFAAQGQLP

SEQ ID NO: 970126 - protein, 9 aa, Homo Sapiens
LPMPRLMST

SEQ ID NO: 970127 - protein, 9 aa, Homo Sapiens
PVDEITVTF

SEQ ID NO: 970128 - protein, 9 aa, Homo Sapiens
AGKLVGVVT

SEQ ID NO: 970129 - protein, 9 aa, Homo Sapiens
NINFSNLKQ

SEQ ID NO: 970130 - protein, 9 aa, Homo Sapiens
SVEKRLMPP

SEQ ID NO: 970131 - protein, 9 aa, Homo Sapiens
IRIIYSISP

SEQ ID NO: 970132 - protein, 9 aa, Homo Sapiens
IFYFLFDQQ

SEQ ID NO: 970133 - protein, 9 aa, Homo Sapiens
AFFNLNVTL

SEQ ID NO: 970134 - protein, 9 aa, Homo Sapiens
PIEEFNLHL

SEQ ID NO: 970135 - protein, 9 aa, Homo Sapiens
EELAPIGIR

SEQ ID NO: 970136 - protein, 9 aa, Homo Sapiens
RMNSPKRAA

SEQ ID NO: 970137 - protein, 9 aa, Homo Sapiens
SPIKEKLDA

SEQ ID NO: 970138 - protein, 9 aa, Homo Sapiens
FLTSRLEMS

SEQ ID NO: 970139 - protein, 9 aa, Homo Sapiens
PTPLPPPPL

SEQ ID NO: 970140 - protein, 9 aa, Homo Sapiens
LLETTDEPP

SEQ ID NO: 970141 - protein, 9 aa, Homo Sapiens
NCSACTYLA

SEQ ID NO: 970142 - protein, 9 aa, Homo Sapiens
LEDISLLED

SEQ ID NO: 970143 - protein, 9 aa, Homo Sapiens
DLDTKATLS

SEQ ID NO: 970144 - protein, 9 aa, Homo Sapiens
GLGALLHCS

SEQ ID NO: 970145 - protein, 9 aa, Homo Sapiens
IFHMAVSGV

SEQ ID NO: 970146 - protein, 9 aa, Homo Sapiens
RIPENFDQD

SEQ ID NO: 970147 - protein, 9 aa, Homo Sapiens
NLNSHRKVH

SEQ ID NO: 970148 - protein, 9 aa, Homo Sapiens
FVTSPLLSP

SEQ ID NO: 970149 - protein, 9 aa, Homo Sapiens
LDSSSAVRK

SEQ ID NO: 970150 - protein, 9 aa, Homo Sapiens
AFLWAVTLP

SEQ ID NO: 970151 - protein, 9 aa, Homo Sapiens
IFFFSWLNS

SEQ ID NO: 970152 - protein, 9 aa, Homo Sapiens
LLSYYPLEK

SEQ ID NO: 970153 - protein, 9 aa, Homo Sapiens
EKFRLELSR

SEQ ID NO: 970154 - protein, 9 aa, Homo Sapiens
GIEEFPGPP

SEQ ID NO: 970155 - protein, 9 aa, Homo Sapiens
PSVCPTPKC

SEQ ID NO: 970156 - protein, 9 aa, Homo Sapiens
ENNTIHVHR

SEQ ID NO: 970157 - protein, 9 aa, Homo Sapiens
YEMKKFLFY

SEQ ID NO: 970158 - protein, 9 aa, Homo Sapiens
KVCRQDIQD

SEQ ID NO: 970159 - protein, 9 aa, Homo Sapiens
HSTPMLALT

SEQ ID NO: 970160 - protein, 9 aa, Homo Sapiens
SKGDIWWNP

SEQ ID NO: 970161 - protein, 9 aa, Homo Sapiens
ERADTVTKV

SEQ ID NO: 970162 - protein, 9 aa, Homo Sapiens
VHSVFSLPF

SEQ ID NO: 970163 - protein, 9 aa, Homo Sapiens
AKAGTKKDN

SEQ ID NO: 970164 - protein, 9 aa, Homo Sapiens
QPQGKGISG

SEQ ID NO: 970165 - protein, 9 aa, Homo Sapiens
RTIQRLQEE

SEQ ID NO: 970166 - protein, 9 aa, Homo Sapiens
KEKASSLKI

SEQ ID NO: 970167 - protein, 9 aa, Homo Sapiens
ISWQHISPS

SEQ ID NO: 970168 - protein, 9 aa, Homo Sapiens
YTCVAKNAA

SEQ ID NO: 970169 - protein, 9 aa, Homo Sapiens
FKYKEGYCK

SEQ ID NO: 970170 - protein, 9 aa, Homo Sapiens
KNLHLPWIL

SEQ ID NO: 970171 - protein, 9 aa, Homo Sapiens
TPLDGTQVL

SEQ ID NO: 970172 - protein, 9 aa, Homo Sapiens
ISPIHFYSG

SEQ ID NO: 970173 - protein, 9 aa, Homo Sapiens
LLEGAEAAL

SEQ ID NO: 970174 - protein, 9 aa, Homo Sapiens
RKAFSTCSF

SEQ ID NO: 970175 - protein, 9 aa, Homo Sapiens
RQEHYLSSA

SEQ ID NO: 970176 - protein, 9 aa, Homo Sapiens
ATGVWESHI

SEQ ID NO: 970177 - protein, 9 aa, Homo Sapiens
ILWPASDRK

SEQ ID NO: 970178 - protein, 9 aa, Homo Sapiens
VRKLTLASI

SEQ ID NO: 970179 - protein, 9 aa, Homo Sapiens
SINFIKQKH

SEQ ID NO: 970180 - protein, 9 aa, Homo Sapiens
ESYDLKNTL

SEQ ID NO: 970181 - protein, 9 aa, Homo Sapiens
TIPVIRQGD

SEQ ID NO: 970182 - protein, 9 aa, Homo Sapiens
TLSAPAAGW

SEQ ID NO: 970183 - protein, 9 aa, Homo Sapiens
IVISAFSHT

SEQ ID NO: 970184 - protein, 9 aa, Homo Sapiens
NLDVEKTPT

SEQ ID NO: 970185 - protein, 9 aa, Homo Sapiens
APVHSFFME

SEQ ID NO: 970186 - protein, 9 aa, Homo Sapiens
TDFIDNLIS

SEQ ID NO: 970187 - protein, 9 aa, Homo Sapiens
CALQKKSLT

SEQ ID NO: 970188 - protein, 9 aa, Homo Sapiens
TLRAGPITG

SEQ ID NO: 970189 - protein, 9 aa, Homo Sapiens
QLLGMVWGH

SEQ ID NO: 970190 - protein, 9 aa, Homo Sapiens
FSCCRLLYY

SEQ ID NO: 970191 - protein, 9 aa, Homo Sapiens
TLEDYLVKE

SEQ ID NO: 970192 - protein, 9 aa, Homo Sapiens
PFASTTKTL

SEQ ID NO: 970193 - protein, 9 aa, Homo Sapiens
WHVRIHTAE

SEQ ID NO: 970194 - protein, 9 aa, Homo Sapiens
VLLEGAEAA

SEQ ID NO: 970195 - protein, 9 aa, Homo Sapiens
AAVTFVDVS

SEQ ID NO: 970196 - protein, 9 aa, Homo Sapiens
SSGEDDVIT

SEQ ID NO: 970197 - protein, 9 aa, Homo Sapiens
KLDRLRFER

SEQ ID NO: 970198 - protein, 9 aa, Homo Sapiens
HMGQETGAC

SEQ ID NO: 970199 - protein, 9 aa, Homo Sapiens
PGIGGDIHF

SEQ ID NO: 970200 - protein, 9 aa, Homo Sapiens
DSSLLNLAP

SEQ ID NO: 970201 - protein, 9 aa, Homo Sapiens
TTENRLGAA

SEQ ID NO: 970202 - protein, 9 aa, Homo Sapiens
TIATFGAYD

SEQ ID NO: 970203 - protein, 9 aa, Homo Sapiens
LEEKHNQCK

SEQ ID NO: 970204 - protein, 9 aa, Homo Sapiens
PIPVFSDNY

SEQ ID NO: 970205 - protein, 9 aa, Homo Sapiens
YTHQWTVYV

SEQ ID NO: 970206 - protein, 9 aa, Homo Sapiens
SHGSSTRRR

SEQ ID NO: 970207 - protein, 9 aa, Homo Sapiens
GKRRRLGRW

SEQ ID NO: 970208 - protein, 9 aa, Homo Sapiens
LTPPNSMPP

SEQ ID NO: 970209 - protein, 9 aa, Homo Sapiens
DSLSINFEF

SEQ ID NO: 970210 - protein, 9 aa, Homo Sapiens
KRKVEGLLY

SEQ ID NO: 970211 - protein, 9 aa, Homo Sapiens
KNLGAPKGM

SEQ ID NO: 970212 - protein, 9 aa, Homo Sapiens
PPSQLYVVV

SEQ ID NO: 970213 - protein, 9 aa, Homo Sapiens
PEMNSEGEI

SEQ ID NO: 970214 - protein, 9 aa, Homo Sapiens
MSGTNVCSV

SEQ ID NO: 970215 - protein, 9 aa, Homo Sapiens
VEMRPDKLH

SEQ ID NO: 970216 - protein, 9 aa, Homo Sapiens
FYIFGSIFL

SEQ ID NO: 970217 - protein, 9 aa, Homo Sapiens
QHLVQKLSL

SEQ ID NO: 970218 - protein, 9 aa, Homo Sapiens
YKRRLQHLT

SEQ ID NO: 970219 - protein, 9 aa, Homo Sapiens
ISMYFFLAI

SEQ ID NO: 970220 - protein, 9 aa, Homo Sapiens
PFFKEVLSE

SEQ ID NO: 970221 - protein, 9 aa, Homo Sapiens
QVVAIEVLT

SEQ ID NO: 970222 - protein, 9 aa, Homo Sapiens
SGPIVLDNV

SEQ ID NO: 970223 - protein, 9 aa, Homo Sapiens
EEMEEVGEE

SEQ ID NO: 970224 - protein, 9 aa, Homo Sapiens
ADVSMPKLE

SEQ ID NO: 970225 - protein, 9 aa, Homo Sapiens
EPSGLEEKE

SEQ ID NO: 970226 - protein, 9 aa, Homo Sapiens
FLVEPDGVP

SEQ ID NO: 970227 - protein, 9 aa, Homo Sapiens
EDILLMLGV

SEQ ID NO: 970228 - protein, 9 aa, Homo Sapiens
RGIKTASNL

SEQ ID NO: 970229 - protein, 9 aa, Homo Sapiens
NGSSKSMCF

SEQ ID NO: 970230 - protein, 9 aa, Homo Sapiens
NLVNNDGIL

SEQ ID NO: 970231 - protein, 9 aa, Homo Sapiens
FSAMDWPQT

SEQ ID NO: 970232 - protein, 9 aa, Homo Sapiens
GLRAPLNIE

SEQ ID NO: 970233 - protein, 9 aa, Homo Sapiens
KIYSGEKSF

SEQ ID NO: 970234 - protein, 9 aa, Homo Sapiens
PNINPRDIK

SEQ ID NO: 970235 - protein, 9 aa, Homo Sapiens
KERNEGHDL

SEQ ID NO: 970236 - protein, 9 aa, Homo Sapiens
GRVYLAEVF

SEQ ID NO: 970237 - protein, 9 aa, Homo Sapiens
TCSFHLCMV

SEQ ID NO: 970238 - protein, 9 aa, Homo Sapiens
ESSLQREGY

SEQ ID NO: 970239 - protein, 9 aa, Homo Sapiens
KLRRKQELA

SEQ ID NO: 970240 - protein, 9 aa, Homo Sapiens
GADGVGKSA

SEQ ID NO: 970241 - protein, 9 aa, Homo Sapiens
NGFSGASAE

SEQ ID NO: 970242 - protein, 9 aa, Homo Sapiens
PFLTTKAVL

SEQ ID NO: 970243 - protein, 9 aa, Homo Sapiens
EGLVELPAL

SEQ ID NO: 970244 - protein, 9 aa, Homo Sapiens
KSFHNSSRT

SEQ ID NO: 970245 - protein, 9 aa, Homo Sapiens
PPAFSRAPP

SEQ ID NO: 970246 - protein, 9 aa, Homo Sapiens
AKSEECDKA

SEQ ID NO: 970247 - protein, 9 aa, Homo Sapiens
NFWYLNRGC

SEQ ID NO: 970248 - protein, 9 aa, Homo Sapiens
TTTKQPTLA

SEQ ID NO: 970249 - protein, 9 aa, Homo Sapiens
AYELGIMVS

SEQ ID NO: 970250 - protein, 9 aa, Homo Sapiens
TKLEDYANL

SEQ ID NO: 970251 - protein, 9 aa, Homo Sapiens
LKMFFSGLS

SEQ ID NO: 970252 - protein, 9 aa, Homo Sapiens
ADPSFSGAL

SEQ ID NO: 970253 - protein, 9 aa, Homo Sapiens
KIIMVTIRP

SEQ ID NO: 970254 - protein, 9 aa, Homo Sapiens
FMTGYLPLE

SEQ ID NO: 970255 - protein, 9 aa, Homo Sapiens
TVARTKISN

SEQ ID NO: 970256 - protein, 9 aa, Homo Sapiens
LTLEILDCR

SEQ ID NO: 970257 - protein, 9 aa, Homo Sapiens
RRSAAGFPP

SEQ ID NO: 970258 - protein, 9 aa, Homo Sapiens
SALLQRNFS

SEQ ID NO: 970259 - protein, 9 aa, Homo Sapiens
MCGFFSLQI

SEQ ID NO: 970260 - protein, 9 aa, Homo Sapiens
DCVWLLLQY

SEQ ID NO: 970261 - protein, 9 aa, Homo Sapiens
VSSQAVLFL

SEQ ID NO: 970262 - protein, 9 aa, Homo Sapiens
SVLFRLTPR

SEQ ID NO: 970263 - protein, 9 aa, Homo Sapiens
TPVVFYTTA

SEQ ID NO: 970264 - protein, 9 aa, Homo Sapiens
QAWYKLHYM

SEQ ID NO: 970265 - protein, 9 aa, Homo Sapiens
SFSADVEVP

SEQ ID NO: 970266 - protein, 9 aa, Homo Sapiens
GDILNARLI

SEQ ID NO: 970267 - protein, 9 aa, Homo Sapiens
FVLALYGRQ

SEQ ID NO: 970268 - protein, 9 aa, Homo Sapiens
ELRRKTDVP

SEQ ID NO: 970269 - protein, 9 aa, Homo Sapiens
VFPGSHLCM

SEQ ID NO: 970270 - protein, 9 aa, Homo Sapiens
KTLTLLSVT

SEQ ID NO: 970271 - protein, 9 aa, Homo Sapiens
DEKTFKAVK

SEQ ID NO: 970272 - protein, 9 aa, Homo Sapiens
EKFFGQGRE

SEQ ID NO: 970273 - protein, 9 aa, Homo Sapiens
VTVYNKPAS

SEQ ID NO: 970274 - protein, 9 aa, Homo Sapiens
IFCIYAPEA

SEQ ID NO: 970275 - protein, 9 aa, Homo Sapiens
VAIEVLTQL

SEQ ID NO: 970276 - protein, 9 aa, Homo Sapiens
SLKIISAVI

SEQ ID NO: 970277 - protein, 9 aa, Homo Sapiens
TLNPPAVPL

SEQ ID NO: 970278 - protein, 9 aa, Homo Sapiens
HQFLQSPYR

SEQ ID NO: 970279 - protein, 9 aa, Homo Sapiens
CYEMKKFLF

SEQ ID NO: 970280 - protein, 9 aa, Homo Sapiens
VVNVLKFLL

SEQ ID NO: 970281 - protein, 9 aa, Homo Sapiens
ENEASSFIS

SEQ ID NO: 970282 - protein, 9 aa, Homo Sapiens
SARKRLFKE

SEQ ID NO: 970283 - protein, 9 aa, Homo Sapiens
ENTLHPDLS

SEQ ID NO: 970284 - protein, 9 aa, Homo Sapiens
GQAVKKSST

SEQ ID NO: 970285 - protein, 9 aa, Homo Sapiens
DDEEQRTFQ

SEQ ID NO: 970286 - protein, 9 aa, Homo Sapiens
IEHYSSEGL

SEQ ID NO: 970287 - protein, 9 aa, Homo Sapiens
SLLGLPASS

SEQ ID NO: 970288 - protein, 9 aa, Homo Sapiens
HGIRSAPSF

SEQ ID NO: 970289 - protein, 9 aa, Homo Sapiens
PPLGDAAGH

SEQ ID NO: 970290 - protein, 9 aa, Homo Sapiens
ISSRSSPRV

SEQ ID NO: 970291 - protein, 9 aa, Homo Sapiens
SPSGPSTSV

SEQ ID NO: 970292 - protein, 9 aa, Homo Sapiens
GGRTWCKGT

SEQ ID NO: 970293 - protein, 9 aa, Homo Sapiens
PVHSWSTGK

SEQ ID NO: 970294 - protein, 9 aa, Homo Sapiens
SCVSLLTLF

SEQ ID NO: 970295 - protein, 9 aa, Homo Sapiens
GSLWWRSKG

SEQ ID NO: 970296 - protein, 9 aa, Homo Sapiens
EGWLVFIKI

SEQ ID NO: 970297 - protein, 9 aa, Homo Sapiens
SRKSHFERH

SEQ ID NO: 970298 - protein, 9 aa, Homo Sapiens
FVSADRLEE

SEQ ID NO: 970299 - protein, 9 aa, Homo Sapiens
LVTVSLCSY

SEQ ID NO: 970300 - protein, 9 aa, Homo Sapiens
YNLNSHRKV

SEQ ID NO: 970301 - protein, 9 aa, Homo Sapiens
LATGETMNA

SEQ ID NO: 970302 - protein, 9 aa, Homo Sapiens
VTTSFVGVG

SEQ ID NO: 970303 - protein, 9 aa, Homo Sapiens
RNSSQCSRS

SEQ ID NO: 970304 - protein, 9 aa, Homo Sapiens
DASRFLSPL

SEQ ID NO: 970305 - protein, 9 aa, Homo Sapiens
GALIRPSQV

SEQ ID NO: 970306 - protein, 9 aa, Homo Sapiens
LTDSSVDEI

SEQ ID NO: 970307 - protein, 9 aa, Homo Sapiens
DELQLSMRN

SEQ ID NO: 970308 - protein, 9 aa, Homo Sapiens
LSVLSSLTE

SEQ ID NO: 970309 - protein, 9 aa, Homo Sapiens
VASEEKTSG

SEQ ID NO: 970310 - protein, 9 aa, Homo Sapiens
LVDPDSWFL

SEQ ID NO: 970311 - protein, 9 aa, Homo Sapiens
SKFIGQTLK

SEQ ID NO: 970312 - protein, 9 aa, Homo Sapiens
SQSLSSEET

SEQ ID NO: 970313 - protein, 9 aa, Homo Sapiens
SQLTTMGTE

SEQ ID NO: 970314 - protein, 9 aa, Homo Sapiens
PIWGRAKSR

SEQ ID NO: 970315 - protein, 9 aa, Homo Sapiens
GLCLEDLAR

SEQ ID NO: 970316 - protein, 9 aa, Homo Sapiens
VEKADNNEN

SEQ ID NO: 970317 - protein, 9 aa, Homo Sapiens
LGIVGLLLT

SEQ ID NO: 970318 - protein, 9 aa, Homo Sapiens
AEPGAAHEI

SEQ ID NO: 970319 - protein, 9 aa, Homo Sapiens
TSFKEVPRG

SEQ ID NO: 970320 - protein, 9 aa, Homo Sapiens
PGSEGLALP

SEQ ID NO: 970321 - protein, 9 aa, Homo Sapiens
GPVLAANLG

SEQ ID NO: 970322 - protein, 9 aa, Homo Sapiens
LKPQMLWEL

SEQ ID NO: 970323 - protein, 9 aa, Homo Sapiens
PFVGGTYFL

SEQ ID NO: 970324 - protein, 9 aa, Homo Sapiens
ERDWDPRLA

SEQ ID NO: 970325 - protein, 9 aa, Homo Sapiens
AQVDLPELS

SEQ ID NO: 970326 - protein, 9 aa, Homo Sapiens
IYGEKKEFV

SEQ ID NO: 970327 - protein, 9 aa, Homo Sapiens
DIYYKTPLM

SEQ ID NO: 970328 - protein, 9 aa, Homo Sapiens
PQPKKIICM

SEQ ID NO: 970329 - protein, 9 aa, Homo Sapiens
TGLGSQMNA

SEQ ID NO: 970330 - protein, 9 aa, Homo Sapiens
NSSNPLRYN

SEQ ID NO: 970331 - protein, 9 aa, Homo Sapiens
FFMELLKTG

SEQ ID NO: 970332 - protein, 9 aa, Homo Sapiens
FLNIQANNC

SEQ ID NO: 970333 - protein, 9 aa, Homo Sapiens
RVVLLDEIK

SEQ ID NO: 970334 - protein, 9 aa, Homo Sapiens
SPAPRLQLP

SEQ ID NO: 970335 - protein, 9 aa, Homo Sapiens
QFIVQRISD

SEQ ID NO: 970336 - protein, 9 aa, Homo Sapiens
KCNFLEGEP

SEQ ID NO: 970337 - protein, 9 aa, Homo Sapiens
EILHHEQKA

SEQ ID NO: 970338 - protein, 9 aa, Homo Sapiens
QSEKEMTDS

SEQ ID NO: 970339 - protein, 9 aa, Homo Sapiens
FTYLTLTEI

SEQ ID NO: 970340 - protein, 9 aa, Homo Sapiens
DLSWASVNR

SEQ ID NO: 970341 - protein, 9 aa, Homo Sapiens
DFFNFCSRR

SEQ ID NO: 970342 - protein, 9 aa, Homo Sapiens
VFPETMTRA

SEQ ID NO: 970343 - protein, 9 aa, Homo Sapiens
NMKGNIGIK

SEQ ID NO: 970344 - protein, 9 aa, Homo Sapiens
AAFVTSPLL

SEQ ID NO: 970345 - protein, 9 aa, Homo Sapiens
EHMGQETGA

SEQ ID NO: 970346 - protein, 9 aa, Homo Sapiens
TFHSLLTAF

SEQ ID NO: 970347 - protein, 9 aa, Homo Sapiens
ELRNRSDVE

SEQ ID NO: 970348 - protein, 9 aa, Homo Sapiens
FPGPQDPAG

SEQ ID NO: 970349 - protein, 9 aa, Homo Sapiens
PWDPLGCQG

SEQ ID NO: 970350 - protein, 9 aa, Homo Sapiens
ESSPISQSS

SEQ ID NO: 970351 - protein, 9 aa, Homo Sapiens
FVSKRVVLG

SEQ ID NO: 970352 - protein, 9 aa, Homo Sapiens
FLFLFMYLI

SEQ ID NO: 970353 - protein, 9 aa, Homo Sapiens
QILGFGMCF

SEQ ID NO: 970354 - protein, 9 aa, Homo Sapiens
SYPDPSQWT

SEQ ID NO: 970355 - protein, 9 aa, Homo Sapiens
SQVSRRGQK

SEQ ID NO: 970356 - protein, 9 aa, Homo Sapiens
QAESSERTR

SEQ ID NO: 970357 - protein, 9 aa, Homo Sapiens
TEINVFFYP

SEQ ID NO: 970358 - protein, 9 aa, Homo Sapiens
VGSTFENIT

SEQ ID NO: 970359 - protein, 9 aa, Homo Sapiens
EGCQRQRAI

SEQ ID NO: 970360 - protein, 9 aa, Homo Sapiens
KTFKAVKEE

SEQ ID NO: 970361 - protein, 9 aa, Homo Sapiens
GGGLSRGAA

SEQ ID NO: 970362 - protein, 9 aa, Homo Sapiens
GGDRSSSRM

SEQ ID NO: 970363 - protein, 9 aa, Homo Sapiens
IQLRGQTGV

SEQ ID NO: 970364 - protein, 9 aa, Homo Sapiens
KSVQCQRWS

SEQ ID NO: 970365 - protein, 9 aa, Homo Sapiens
DAAGHPGSA

SEQ ID NO: 970366 - protein, 9 aa, Homo Sapiens
THFYTISHA

SEQ ID NO: 970367 - protein, 9 aa, Homo Sapiens
QDSADIIFF

SEQ ID NO: 970368 - protein, 9 aa, Homo Sapiens
QMKNTYQLG

SEQ ID NO: 970369 - protein, 9 aa, Homo Sapiens
PSSLPPRVA

SEQ ID NO: 970370 - protein, 9 aa, Homo Sapiens
KGQLPEGEA

SEQ ID NO: 970371 - protein, 9 aa, Homo Sapiens
KAGTKKDNS

SEQ ID NO: 970372 - protein, 9 aa, Homo Sapiens
RCLRMVLSL

SEQ ID NO: 970373 - protein, 9 aa, Homo Sapiens
DKHWHQLMK

SEQ ID NO: 970374 - protein, 9 aa, Homo Sapiens
VPGTFANCD

SEQ ID NO: 970375 - protein, 9 aa, Homo Sapiens
ESVIWEITL

SEQ ID NO: 970376 - protein, 9 aa, Homo Sapiens
VYNKPASFF

SEQ ID NO: 970377 - protein, 9 aa, Homo Sapiens
GPEDQPLTS

SEQ ID NO: 970378 - protein, 9 aa, Homo Sapiens
RTIFASSSD

SEQ ID NO: 970379 - protein, 9 aa, Homo Sapiens
CGYYLTQHE

SEQ ID NO: 970380 - protein, 9 aa, Homo Sapiens
PSLPGRAQR

SEQ ID NO: 970381 - protein, 9 aa, Homo Sapiens
STPMLALTT

SEQ ID NO: 970382 - protein, 9 aa, Homo Sapiens
QCKVIDEQV

SEQ ID NO: 970383 - protein, 9 aa, Homo Sapiens
SLCLLPTSH

SEQ ID NO: 970384 - protein, 9 aa, Homo Sapiens
LGLRCPLYS

SEQ ID NO: 970385 - protein, 9 aa, Homo Sapiens
QELEYSLKK

SEQ ID NO: 970386 - protein, 9 aa, Homo Sapiens
VWESHIVLD

SEQ ID NO: 970387 - protein, 9 aa, Homo Sapiens
ARYGLSLMP

SEQ ID NO: 970388 - protein, 9 aa, Homo Sapiens
NLNSILDDN

SEQ ID NO: 970389 - protein, 9 aa, Homo Sapiens
AMPIAGTSV

SEQ ID NO: 970390 - protein, 9 aa, Homo Sapiens
FYFLFDQQN

SEQ ID NO: 970391 - protein, 9 aa, Homo Sapiens
RNKEASPPS

SEQ ID NO: 970392 - protein, 9 aa, Homo Sapiens
AAGKLPAGA

SEQ ID NO: 970393 - protein, 9 aa, Homo Sapiens
GPQILGFGM

SEQ ID NO: 970394 - protein, 9 aa, Homo Sapiens
GVWESHIVL

SEQ ID NO: 970395 - protein, 9 aa, Homo Sapiens
KRRSGGDWA

SEQ ID NO: 970396 - protein, 9 aa, Homo Sapiens
SLFKKDCDR

SEQ ID NO: 970397 - protein, 9 aa, Homo Sapiens
FVIRSAVSV

SEQ ID NO: 970398 - protein, 9 aa, Homo Sapiens
GPRAAAMVS

SEQ ID NO: 970399 - protein, 9 aa, Homo Sapiens
ILISDDEEQ

SEQ ID NO: 970400 - protein, 9 aa, Homo Sapiens
IIYAKFDKN

SEQ ID NO: 970401 - protein, 9 aa, Homo Sapiens
WNFDPYLSR

SEQ ID NO: 970402 - protein, 9 aa, Homo Sapiens
DASGQLGLI

SEQ ID NO: 970403 - protein, 9 aa, Homo Sapiens
FHLCMVGLF

SEQ ID NO: 970404 - protein, 9 aa, Homo Sapiens
VGLVSQYYS

SEQ ID NO: 970405 - protein, 9 aa, Homo Sapiens
EVEKRVDAS

SEQ ID NO: 970406 - protein, 9 aa, Homo Sapiens
ETGACLGLV

SEQ ID NO: 970407 - protein, 9 aa, Homo Sapiens
PAASSGSET

SEQ ID NO: 970408 - protein, 9 aa, Homo Sapiens
LKAHWSTLR

SEQ ID NO: 970409 - protein, 9 aa, Homo Sapiens
SPEVDPIES

SEQ ID NO: 970410 - protein, 9 aa, Homo Sapiens
SRNTLFNFS

SEQ ID NO: 970411 - protein, 9 aa, Homo Sapiens
NQEELKGKK

SEQ ID NO: 970412 - protein, 9 aa, Homo Sapiens
EVEAAEPKV

SEQ ID NO: 970413 - protein, 9 aa, Homo Sapiens
SRKPFVVWF

SEQ ID NO: 970414 - protein, 9 aa, Homo Sapiens
EKHAKERTR

SEQ ID NO: 970415 - protein, 9 aa, Homo Sapiens
EIPSMAGHS

SEQ ID NO: 970416 - protein, 9 aa, Homo Sapiens
VTDFIDNLI

SEQ ID NO: 970417 - protein, 9 aa, Homo Sapiens
ASKRGEIVR

SEQ ID NO: 970418 - protein, 9 aa, Homo Sapiens
KSSFVGDED

SEQ ID NO: 970419 - protein, 9 aa, Homo Sapiens
EAPRISVFF

SEQ ID NO: 970420 - protein, 9 aa, Homo Sapiens
DGGSPPCEV

SEQ ID NO: 970421 - protein, 9 aa, Homo Sapiens
SSFPEEAAL

SEQ ID NO: 970422 - protein, 9 aa, Homo Sapiens
KPKPRLFMP

SEQ ID NO: 970423 - protein, 9 aa, Homo Sapiens
RKPFVVWFQ

SEQ ID NO: 970424 - protein, 9 aa, Homo Sapiens
NEHSSRRIT

SEQ ID NO: 970425 - protein, 9 aa, Homo Sapiens
GHSPQIIFF

SEQ ID NO: 970426 - protein, 9 aa, Homo Sapiens
DPRLAIIDN

SEQ ID NO: 970427 - protein, 9 aa, Homo Sapiens
APPSLGVPP

SEQ ID NO: 970428 - protein, 9 aa, Homo Sapiens
TAGGWCGLR

SEQ ID NO: 970429 - protein, 9 aa, Homo Sapiens
MRGDMVTKD

SEQ ID NO: 970430 - protein, 9 aa, Homo Sapiens
FGKSAWIKD

SEQ ID NO: 970431 - protein, 9 aa, Homo Sapiens
MTSNQSLKK

SEQ ID NO: 970432 - protein, 9 aa, Homo Sapiens
PFIIYHCAL

SEQ ID NO: 970433 - protein, 9 aa, Homo Sapiens
EFQSSFASQ

SEQ ID NO: 970434 - protein, 9 aa, Homo Sapiens
KNYCGETVV

SEQ ID NO: 970435 - protein, 9 aa, Homo Sapiens
KPAKSEECD

SEQ ID NO: 970436 - protein, 9 aa, Homo Sapiens
LLAVLVPGV

SEQ ID NO: 970437 - protein, 9 aa, Homo Sapiens
FSILNERGI

SEQ ID NO: 970438 - protein, 9 aa, Homo Sapiens
IVKRLLIKK

SEQ ID NO: 970439 - protein, 9 aa, Homo Sapiens
PTAGLRAPL

SEQ ID NO: 970440 - protein, 9 aa, Homo Sapiens
VTFTCLTSA

SEQ ID NO: 970441 - protein, 9 aa, Homo Sapiens
MNFKMQVYS

SEQ ID NO: 970442 - protein, 9 aa, Homo Sapiens
VYLKEEEKK

SEQ ID NO: 970443 - protein, 9 aa, Homo Sapiens
RHQAQKDHY

SEQ ID NO: 970444 - protein, 9 aa, Homo Sapiens
PSISWQHIS

SEQ ID NO: 970445 - protein, 9 aa, Homo Sapiens
RFEELLLQV

SEQ ID NO: 970446 - protein, 9 aa, Homo Sapiens
ISRSQHQET

SEQ ID NO: 970447 - protein, 9 aa, Homo Sapiens
DNEQDRSKF

SEQ ID NO: 970448 - protein, 9 aa, Homo Sapiens
CLQEPQSVL

SEQ ID NO: 970449 - protein, 9 aa, Homo Sapiens
FNLETAIAD

SEQ ID NO: 970450 - protein, 9 aa, Homo Sapiens
FSRKPFVVW

SEQ ID NO: 970451 - protein, 9 aa, Homo Sapiens
PLSCGSTQI

SEQ ID NO: 970452 - protein, 9 aa, Homo Sapiens
ALRDKHWHQ

SEQ ID NO: 970453 - protein, 9 aa, Homo Sapiens
KIQYLTCGE

SEQ ID NO: 970454 - protein, 9 aa, Homo Sapiens
VSWTKNGKA

SEQ ID NO: 970455 - protein, 9 aa, Homo Sapiens
STFKDLDFL

SEQ ID NO: 970456 - protein, 9 aa, Homo Sapiens
AGLECATPL

SEQ ID NO: 970457 - protein, 9 aa, Homo Sapiens
EKLPQGYRI

SEQ ID NO: 970458 - protein, 9 aa, Homo Sapiens
LTCGEESSS

SEQ ID NO: 970459 - protein, 9 aa, Homo Sapiens
LLGTAACRF

SEQ ID NO: 970460 - protein, 9 aa, Homo Sapiens
KFGKNLGLK

SEQ ID NO: 970461 - protein, 9 aa, Homo Sapiens
SQKVGTYML

SEQ ID NO: 970462 - protein, 9 aa, Homo Sapiens
SWLKMETRM

SEQ ID NO: 970463 - protein, 9 aa, Homo Sapiens
CLQWCPKCC

SEQ ID NO: 970464 - protein, 9 aa, Homo Sapiens
EEVGEEEEQ

SEQ ID NO: 970465 - protein, 9 aa, Homo Sapiens
RHGGHWLLG

SEQ ID NO: 970466 - protein, 9 aa, Homo Sapiens
ILRLLNSED

SEQ ID NO: 970467 - protein, 9 aa, Homo Sapiens
IADPFLSKA

SEQ ID NO: 970468 - protein, 9 aa, Homo Sapiens
YMAKPDMIR

SEQ ID NO: 970469 - protein, 9 aa, Homo Sapiens
QTESFSDGG

SEQ ID NO: 970470 - protein, 9 aa, Homo Sapiens
PTGFFGNLC

SEQ ID NO: 970471 - protein, 9 aa, Homo Sapiens
NGETPLQPF

SEQ ID NO: 970472 - protein, 9 aa, Homo Sapiens
SVEQLEFRI

SEQ ID NO: 970473 - protein, 9 aa, Homo Sapiens
VNNPIFGRN

SEQ ID NO: 970474 - protein, 9 aa, Homo Sapiens
GGKPEMNSE

SEQ ID NO: 970475 - protein, 9 aa, Homo Sapiens
ENLKKCYLM

SEQ ID NO: 970476 - protein, 9 aa, Homo Sapiens
PGFSEKDLE

SEQ ID NO: 970477 - protein, 9 aa, Homo Sapiens
FFLYAHRVG

SEQ ID NO: 970478 - protein, 9 aa, Homo Sapiens
PVLAANLGI

SEQ ID NO: 970479 - protein, 9 aa, Homo Sapiens
AAAMVSSGG

SEQ ID NO: 970480 - protein, 9 aa, Homo Sapiens
DRLEELVSA

SEQ ID NO: 970481 - protein, 9 aa, Homo Sapiens
HTATPLDFF

SEQ ID NO: 970482 - protein, 9 aa, Homo Sapiens
TNMKGNIGI

SEQ ID NO: 970483 - protein, 9 aa, Homo Sapiens
LILLWGHSR

SEQ ID NO: 970484 - protein, 9 aa, Homo Sapiens
SSVLWKYFL

SEQ ID NO: 970485 - protein, 9 aa, Homo Sapiens
EQGPYEEII

SEQ ID NO: 970486 - protein, 9 aa, Homo Sapiens
PAFFNLNVT

SEQ ID NO: 970487 - protein, 9 aa, Homo Sapiens
AAFLNYLNQ

SEQ ID NO: 970488 - protein, 9 aa, Homo Sapiens
VLVPGVNIE

SEQ ID NO: 970489 - protein, 9 aa, Homo Sapiens
WPGVPPPPL

SEQ ID NO: 970490 - protein, 9 aa, Homo Sapiens
IPRITSIDA

SEQ ID NO: 970491 - protein, 9 aa, Homo Sapiens
GAFYAFPSE

SEQ ID NO: 970492 - protein, 9 aa, Homo Sapiens
IYPRFVQLG

SEQ ID NO: 970493 - protein, 9 aa, Homo Sapiens
LPLEFEFAV

SEQ ID NO: 970494 - protein, 9 aa, Homo Sapiens
LATRSLRGL

SEQ ID NO: 970495 - protein, 9 aa, Homo Sapiens
QKDNVGPWA

SEQ ID NO: 970496 - protein, 9 aa, Homo Sapiens
LGVIQKSGS

SEQ ID NO: 970497 - protein, 9 aa, Homo Sapiens
PEPSISWQH

SEQ ID NO: 970498 - protein, 9 aa, Homo Sapiens
WTLSPLFSS

SEQ ID NO: 970499 - protein, 9 aa, Homo Sapiens
SNMKRAAFL

SEQ ID NO: 970500 - protein, 9 aa, Homo Sapiens
SFLKLSSLG

SEQ ID NO: 970501 - protein, 9 aa, Homo Sapiens
AFNCGYYLT

SEQ ID NO: 970502 - protein, 9 aa, Homo Sapiens
QTQSLGTAL

SEQ ID NO: 970503 - protein, 9 aa, Homo Sapiens
KTCFTKLFS

SEQ ID NO: 970504 - protein, 9 aa, Homo Sapiens
METPNTTKD

SEQ ID NO: 970505 - protein, 9 aa, Homo Sapiens
TPDAAPGQP

SEQ ID NO: 970506 - protein, 9 aa, Homo Sapiens
FRPQICSEL

SEQ ID NO: 970507 - protein, 9 aa, Homo Sapiens
PLPKACSNS

SEQ ID NO: 970508 - protein, 9 aa, Homo Sapiens
VKKLQMKIT

SEQ ID NO: 970509 - protein, 9 aa, Homo Sapiens
PMPRLMSTT

SEQ ID NO: 970510 - protein, 9 aa, Homo Sapiens
VGNLDMITL

SEQ ID NO: 970511 - protein, 9 aa, Homo Sapiens
LELRRKTDV

SEQ ID NO: 970512 - protein, 9 aa, Homo Sapiens
GEKEGKENE

SEQ ID NO: 970513 - protein, 9 aa, Homo Sapiens
EKQKVGEEK

SEQ ID NO: 970514 - protein, 9 aa, Homo Sapiens
PMDIRGPEQ

SEQ ID NO: 970515 - protein, 9 aa, Homo Sapiens
QEEADAAKK

SEQ ID NO: 970516 - protein, 9 aa, Homo Sapiens
KHQFVHHQE

SEQ ID NO: 970517 - protein, 9 aa, Homo Sapiens
VLDDGNESE

SEQ ID NO: 970518 - protein, 9 aa, Homo Sapiens
LCDACAKFL

SEQ ID NO: 970519 - protein, 9 aa, Homo Sapiens
FEKFLVEPD

SEQ ID NO: 970520 - protein, 9 aa, Homo Sapiens
APLCTHAGD

SEQ ID NO: 970521 - protein, 9 aa, Homo Sapiens
LEIPNICSH

SEQ ID NO: 970522 - protein, 9 aa, Homo Sapiens
SEGLQRLAG

SEQ ID NO: 970523 - protein, 9 aa, Homo Sapiens
SLTLEDYLV

SEQ ID NO: 970524 - protein, 9 aa, Homo Sapiens
PDGSGAPRG

SEQ ID NO: 970525 - protein, 9 aa, Homo Sapiens
PLAGLSKLS

SEQ ID NO: 970526 - protein, 9 aa, Homo Sapiens
AGLGSAAPP

SEQ ID NO: 970527 - protein, 9 aa, Homo Sapiens
TIFASSSDE

SEQ ID NO: 970528 - protein, 9 aa, Homo Sapiens
VFIVRCFNL

SEQ ID NO: 970529 - protein, 9 aa, Homo Sapiens
GRRSGQQTY

SEQ ID NO: 970530 - protein, 9 aa, Homo Sapiens
YKCEKCWKA

SEQ ID NO: 970531 - protein, 9 aa, Homo Sapiens
KKHRSTHMG

SEQ ID NO: 970532 - protein, 9 aa, Homo Sapiens
NSSPALLSN

SEQ ID NO: 970533 - protein, 9 aa, Homo Sapiens
VSPVQYAHR

SEQ ID NO: 970534 - protein, 9 aa, Homo Sapiens
SKFVRLPEY

SEQ ID NO: 970535 - protein, 9 aa, Homo Sapiens
QTVAMPIAG

SEQ ID NO: 970536 - protein, 9 aa, Homo Sapiens
VEPDGVPVM

SEQ ID NO: 970537 - protein, 9 aa, Homo Sapiens
SLTGVLAQQ

SEQ ID NO: 970538 - protein, 9 aa, Homo Sapiens
FKLEQGDIK

SEQ ID NO: 970539 - protein, 9 aa, Homo Sapiens
SRVVLLDEI

SEQ ID NO: 970540 - protein, 9 aa, Homo Sapiens
FNYFGLSPE

SEQ ID NO: 970541 - protein, 9 aa, Homo Sapiens
SSPDSKGGG

SEQ ID NO: 970542 - protein, 9 aa, Homo Sapiens
TLENEQDQN

SEQ ID NO: 970543 - protein, 9 aa, Homo Sapiens
NASSERFNM

SEQ ID NO: 970544 - protein, 9 aa, Homo Sapiens
LDPETLDSG

SEQ ID NO: 970545 - protein, 9 aa, Homo Sapiens
FYIKTSTTL

SEQ ID NO: 970546 - protein, 9 aa, Homo Sapiens
RKFCLAGDN

SEQ ID NO: 970547 - protein, 9 aa, Homo Sapiens
EIKKNEKPA

SEQ ID NO: 970548 - protein, 9 aa, Homo Sapiens
KPGYNESCF

SEQ ID NO: 970549 - protein, 9 aa, Homo Sapiens
PLGLLETTD

SEQ ID NO: 970550 - protein, 9 aa, Homo Sapiens
LPFMAAAAG

SEQ ID NO: 970551 - protein, 9 aa, Homo Sapiens
RSSHSALFS

SEQ ID NO: 970552 - protein, 9 aa, Homo Sapiens
SIWEKLGKL

SEQ ID NO: 970553 - protein, 9 aa, Homo Sapiens
LSEDAEEEG

SEQ ID NO: 970554 - protein, 9 aa, Homo Sapiens
PERTNPVTD

SEQ ID NO: 970555 - protein, 9 aa, Homo Sapiens
QLGAHSPFT

SEQ ID NO: 970556 - protein, 9 aa, Homo Sapiens
SFQEDKPAP

SEQ ID NO: 970557 - protein, 9 aa, Homo Sapiens
SCAWFLNIQ

SEQ ID NO: 970558 - protein, 9 aa, Homo Sapiens
TYLTIFSAS

SEQ ID NO: 970559 - protein, 9 aa, Homo Sapiens
DWARNEARR

SEQ ID NO: 970560 - protein, 9 aa, Homo Sapiens
NDKASESES

SEQ ID NO: 970561 - protein, 9 aa, Homo Sapiens
QLTTMGTEY

SEQ ID NO: 970562 - protein, 9 aa, Homo Sapiens
ARTKISNDD

SEQ ID NO: 970563 - protein, 9 aa, Homo Sapiens
QFFQRELLI

SEQ ID NO: 970564 - protein, 9 aa, Homo Sapiens
VRDHEQEIE

SEQ ID NO: 970565 - protein, 9 aa, Homo Sapiens
FLGMAVEDT

SEQ ID NO: 970566 - protein, 9 aa, Homo Sapiens
RLQLSNGNK

SEQ ID NO: 970567 - protein, 9 aa, Homo Sapiens
ETHEALVRR

SEQ ID NO: 970568 - protein, 9 aa, Homo Sapiens
NPELQDGRA

SEQ ID NO: 970569 - protein, 9 aa, Homo Sapiens
QPLYWPYKQ

SEQ ID NO: 970570 - protein, 9 aa, Homo Sapiens
NIGKLNLDV

SEQ ID NO: 970571 - protein, 9 aa, Homo Sapiens
RYDVCFCSD

SEQ ID NO: 970572 - protein, 9 aa, Homo Sapiens
LLRKHTGSG

SEQ ID NO: 970573 - protein, 9 aa, Homo Sapiens
MKKHRSTHM

SEQ ID NO: 970574 - protein, 9 aa, Homo Sapiens
VEANQMLGN

SEQ ID NO: 970575 - protein, 9 aa, Homo Sapiens
QQRQHKLTI

SEQ ID NO: 970576 - protein, 9 aa, Homo Sapiens
FKESRYSQN

SEQ ID NO: 970577 - protein, 9 aa, Homo Sapiens
GTPLKLAVV

SEQ ID NO: 970578 - protein, 9 aa, Homo Sapiens
DKFLRKKDG

SEQ ID NO: 970579 - protein, 9 aa, Homo Sapiens
VFSDNYSYL

SEQ ID NO: 970580 - protein, 9 aa, Homo Sapiens
PACLSPALP

SEQ ID NO: 970581 - protein, 9 aa, Homo Sapiens
HYTFRKISS

SEQ ID NO: 970582 - protein, 9 aa, Homo Sapiens
RKLLTPSYV

SEQ ID NO: 970583 - protein, 9 aa, Homo Sapiens
MPLDCPMEF

SEQ ID NO: 970584 - protein, 9 aa, Homo Sapiens
SSQCSRSLG

SEQ ID NO: 970585 - protein, 9 aa, Homo Sapiens
KHQMIHSEE

SEQ ID NO: 970586 - protein, 9 aa, Homo Sapiens
CDFPPSLLH

SEQ ID NO: 970587 - protein, 9 aa, Homo Sapiens
RQRTCVKTV

SEQ ID NO: 970588 - protein, 9 aa, Homo Sapiens
RKKIQYLTC

SEQ ID NO: 970589 - protein, 9 aa, Homo Sapiens
KEIKKNEKP

SEQ ID NO: 970590 - protein, 9 aa, Homo Sapiens
AAGLGSAAP

SEQ ID NO: 970591 - protein, 9 aa, Homo Sapiens
PDNLKALFW

SEQ ID NO: 970592 - protein, 9 aa, Homo Sapiens
KIYNEKNAN

SEQ ID NO: 970593 - protein, 9 aa, Homo Sapiens
YIKTSTTLR

SEQ ID NO: 970594 - protein, 9 aa, Homo Sapiens
TMTRAESTS

SEQ ID NO: 970595 - protein, 9 aa, Homo Sapiens
ISQSSGNSS

SEQ ID NO: 970596 - protein, 9 aa, Homo Sapiens
AAEEKALDN

SEQ ID NO: 970597 - protein, 9 aa, Homo Sapiens
WDKYLESSA

SEQ ID NO: 970598 - protein, 9 aa, Homo Sapiens
NYYSNLFPG

SEQ ID NO: 970599 - protein, 9 aa, Homo Sapiens
DEATGPSGP

SEQ ID NO: 970600 - protein, 9 aa, Homo Sapiens
GSPLEEKHN

SEQ ID NO: 970601 - protein, 9 aa, Homo Sapiens
VDKCNFLEG

SEQ ID NO: 970602 - protein, 9 aa, Homo Sapiens
RTLSLSSGY

SEQ ID NO: 970603 - protein, 9 aa, Homo Sapiens
RLKDLGVPV

SEQ ID NO: 970604 - protein, 9 aa, Homo Sapiens
ELAERKPLL

SEQ ID NO: 970605 - protein, 9 aa, Homo Sapiens
DVAPLPQQR

SEQ ID NO: 970606 - protein, 9 aa, Homo Sapiens
HGDGGGLSR

SEQ ID NO: 970607 - protein, 9 aa, Homo Sapiens
RYQLYDVCS

SEQ ID NO: 970608 - protein, 9 aa, Homo Sapiens
LLYFHGKRV

SEQ ID NO: 970609 - protein, 9 aa, Homo Sapiens
FLGIITPVP

SEQ ID NO: 970610 - protein, 9 aa, Homo Sapiens
LLASGRRES

SEQ ID NO: 970611 - protein, 9 aa, Homo Sapiens
ANGYSSTNN

SEQ ID NO: 970612 - protein, 9 aa, Homo Sapiens
YGEAQCATK

SEQ ID NO: 970613 - protein, 9 aa, Homo Sapiens
AATAQRGSS

SEQ ID NO: 970614 - protein, 9 aa, Homo Sapiens
QARLLEGSS

SEQ ID NO: 970615 - protein, 9 aa, Homo Sapiens
LSKNLVCTP

SEQ ID NO: 970616 - protein, 9 aa, Homo Sapiens
PASSPSFFQ

SEQ ID NO: 970617 - protein, 9 aa, Homo Sapiens
WALLLLLLS

SEQ ID NO: 970618 - protein, 9 aa, Homo Sapiens
LDFFQPFPS

SEQ ID NO: 970619 - protein, 9 aa, Homo Sapiens
ELSWKRRSG

SEQ ID NO: 970620 - protein, 9 aa, Homo Sapiens
TVSDKFHHL

SEQ ID NO: 970621 - protein, 9 aa, Homo Sapiens
SVGFYMAKP

SEQ ID NO: 970622 - protein, 9 aa, Homo Sapiens
KPPFPPISF

SEQ ID NO: 970623 - protein, 9 aa, Homo Sapiens
QFAKNLLDQ

SEQ ID NO: 970624 - protein, 9 aa, Homo Sapiens
AYALQKPWL

SEQ ID NO: 970625 - protein, 9 aa, Homo Sapiens
QRNPPQQPL

SEQ ID NO: 970626 - protein, 9 aa, Homo Sapiens
KNEKPAVKA

SEQ ID NO: 970627 - protein, 9 aa, Homo Sapiens
SAYLAPEVL

SEQ ID NO: 970628 - protein, 9 aa, Homo Sapiens
AEPSFYVGS

SEQ ID NO: 970629 - protein, 9 aa, Homo Sapiens
TQGKGTGEQ

SEQ ID NO: 970630 - protein, 9 aa, Homo Sapiens
FGGRTWCKG

SEQ ID NO: 970631 - protein, 9 aa, Homo Sapiens
LGHFSYPDP

SEQ ID NO: 970632 - protein, 9 aa, Homo Sapiens
LDQEEQEEL

SEQ ID NO: 970633 - protein, 9 aa, Homo Sapiens
NPIEHEKIH

SEQ ID NO: 970634 - protein, 9 aa, Homo Sapiens
RQEKENAKD

SEQ ID NO: 970635 - protein, 9 aa, Homo Sapiens
AGDGPQYFF

SEQ ID NO: 970636 - protein, 9 aa, Homo Sapiens
NCDTAYQHG

SEQ ID NO: 970637 - protein, 9 aa, Homo Sapiens
PLLIDTLCL

SEQ ID NO: 970638 - protein, 9 aa, Homo Sapiens
LLSTWYFSK

SEQ ID NO: 970639 - protein, 9 aa, Homo Sapiens
APIHCICRK

SEQ ID NO: 970640 - protein, 9 aa, Homo Sapiens
AARRQSSVK

SEQ ID NO: 970641 - protein, 9 aa, Homo Sapiens
GNKTLTLLS

SEQ ID NO: 970642 - protein, 9 aa, Homo Sapiens
ITIPVIRQG

SEQ ID NO: 970643 - protein, 9 aa, Homo Sapiens
THEALVRRL

SEQ ID NO: 970644 - protein, 9 aa, Homo Sapiens
SWKRRSGGD

SEQ ID NO: 970645 - protein, 9 aa, Homo Sapiens
ESVEQLEFR

SEQ ID NO: 970646 - protein, 9 aa, Homo Sapiens
RLASTLENE

SEQ ID NO: 970647 - protein, 9 aa, Homo Sapiens
ENVKKQAFN

SEQ ID NO: 970648 - protein, 9 aa, Homo Sapiens
SIYPRFVQL

SEQ ID NO: 970649 - protein, 9 aa, Homo Sapiens
PKACSNSSQ

SEQ ID NO: 970650 - protein, 9 aa, Homo Sapiens
NSRVVLLDE

SEQ ID NO: 970651 - protein, 9 aa, Homo Sapiens
SLWWRSKGY

SEQ ID NO: 970652 - protein, 9 aa, Homo Sapiens
GWCGLRVHG

SEQ ID NO: 970653 - protein, 9 aa, Homo Sapiens
VENNTIHVH

SEQ ID NO: 970654 - protein, 9 aa, Homo Sapiens
ARINSSNPL

SEQ ID NO: 970655 - protein, 9 aa, Homo Sapiens
AESDPLERL

SEQ ID NO: 970656 - protein, 9 aa, Homo Sapiens
KAFNCGYYL

SEQ ID NO: 970657 - protein, 9 aa, Homo Sapiens
FFQPVPASC

SEQ ID NO: 970658 - protein, 9 aa, Homo Sapiens
LVGLTGMLS

SEQ ID NO: 970659 - protein, 9 aa, Homo Sapiens
LRNKEASPP

SEQ ID NO: 970660 - protein, 9 aa, Homo Sapiens
GDIHFDSDE

SEQ ID NO: 970661 - protein, 9 aa, Homo Sapiens
LSLPLQTTS

SEQ ID NO: 970662 - protein, 9 aa, Homo Sapiens
STLAPPPVD

SEQ ID NO: 970663 - protein, 9 aa, Homo Sapiens
SGMYSSSRY

SEQ ID NO: 970664 - protein, 9 aa, Homo Sapiens
WLEVCCVCP

SEQ ID NO: 970665 - protein, 9 aa, Homo Sapiens
MINPELQDG

SEQ ID NO: 970666 - protein, 9 aa, Homo Sapiens
KQFTFSYKN

SEQ ID NO: 970667 - protein, 9 aa, Homo Sapiens
GSSDAAGKL

SEQ ID NO: 970668 - protein, 9 aa, Homo Sapiens
EFNYFGLSP

SEQ ID NO: 970669 - protein, 9 aa, Homo Sapiens
VFVSLVNPQ

SEQ ID NO: 970670 - protein, 9 aa, Homo Sapiens
QDSVGEKVN

SEQ ID NO: 970671 - protein, 9 aa, Homo Sapiens
ARIKRGLTV

SEQ ID NO: 970672 - protein, 9 aa, Homo Sapiens
PVRKNLFCF

SEQ ID NO: 970673 - protein, 9 aa, Homo Sapiens
GAGVSPEAL

SEQ ID NO: 970674 - protein, 9 aa, Homo Sapiens
VEIKGEDRV

SEQ ID NO: 970675 - protein, 9 aa, Homo Sapiens
GGHWLLGTA

SEQ ID NO: 970676 - protein, 9 aa, Homo Sapiens
MNSSRMNSP

SEQ ID NO: 970677 - protein, 9 aa, Homo Sapiens
PRPSKKRAP

SEQ ID NO: 970678 - protein, 9 aa, Homo Sapiens
LGNISFKKE

SEQ ID NO: 970679 - protein, 9 aa, Homo Sapiens
AFFTYLTLT

SEQ ID NO: 970680 - protein, 9 aa, Homo Sapiens
RRFSINDRI

SEQ ID NO: 970681 - protein, 9 aa, Homo Sapiens
TCALASYLD

SEQ ID NO: 970682 - protein, 9 aa, Homo Sapiens
EGSTLTPAG

SEQ ID NO: 970683 - protein, 9 aa, Homo Sapiens
VGEEKQTCE

SEQ ID NO: 970684 - protein, 9 aa, Homo Sapiens
EPDGVPVMH

SEQ ID NO: 970685 - protein, 9 aa, Homo Sapiens
EEEKHGKVG

SEQ ID NO: 970686 - protein, 9 aa, Homo Sapiens
HALDLYNTK

SEQ ID NO: 970687 - protein, 9 aa, Homo Sapiens
NEQDRSKFI

SEQ ID NO: 970688 - protein, 9 aa, Homo Sapiens
QIELYRVVE

SEQ ID NO: 970689 - protein, 9 aa, Homo Sapiens
KIWADIPAS

SEQ ID NO: 970690 - protein, 9 aa, Homo Sapiens
VLKRSKRLQ

SEQ ID NO: 970691 - protein, 9 aa, Homo Sapiens
SSCILPWLN

SEQ ID NO: 970692 - protein, 9 aa, Homo Sapiens
STPLYQPGR

SEQ ID NO: 970693 - protein, 9 aa, Homo Sapiens
ERQERTPTH

SEQ ID NO: 970694 - protein, 9 aa, Homo Sapiens
RRRPSAAFL

SEQ ID NO: 970695 - protein, 9 aa, Homo Sapiens
MTPNVPCRA

SEQ ID NO: 970696 - protein, 9 aa, Homo Sapiens
DQKTLHTLC

SEQ ID NO: 970697 - protein, 9 aa, Homo Sapiens
RTPDGRKIN

SEQ ID NO: 970698 - protein, 9 aa, Homo Sapiens
KEEEKKNEK

SEQ ID NO: 970699 - protein, 9 aa, Homo Sapiens
CQIELYRVV

SEQ ID NO: 970700 - protein, 9 aa, Homo Sapiens
EVTCSDGSN

SEQ ID NO: 970701 - protein, 9 aa, Homo Sapiens
WESMEKAGP

SEQ ID NO: 970702 - protein, 9 aa, Homo Sapiens
LRNLVLGDN

SEQ ID NO: 970703 - protein, 9 aa, Homo Sapiens
THFSIPLDE

SEQ ID NO: 970704 - protein, 9 aa, Homo Sapiens
VTKVSLCER

SEQ ID NO: 970705 - protein, 9 aa, Homo Sapiens
TFVARNCSA

SEQ ID NO: 970706 - protein, 9 aa, Homo Sapiens
EEAQRRLRF

SEQ ID NO: 970707 - protein, 9 aa, Homo Sapiens
AATKFVYPA

SEQ ID NO: 970708 - protein, 9 aa, Homo Sapiens
PERREQGTG

SEQ ID NO: 970709 - protein, 9 aa, Homo Sapiens
DDLLATGET

SEQ ID NO: 970710 - protein, 9 aa, Homo Sapiens
EKRVDASDS

SEQ ID NO: 970711 - protein, 9 aa, Homo Sapiens
TKVFHDGCL

SEQ ID NO: 970712 - protein, 9 aa, Homo Sapiens
HSKERRKKA

SEQ ID NO: 970713 - protein, 9 aa, Homo Sapiens
TSPLLSPDP

SEQ ID NO: 970714 - protein, 9 aa, Homo Sapiens
PVGFCYNDK

SEQ ID NO: 970715 - protein, 9 aa, Homo Sapiens
GVTKEFFFC

SEQ ID NO: 970716 - protein, 9 aa, Homo Sapiens
MALRQSSRA

SEQ ID NO: 970717 - protein, 9 aa, Homo Sapiens
DRGEGPGSP

SEQ ID NO: 970718 - protein, 9 aa, Homo Sapiens
ESPAWEFVE

SEQ ID NO: 970719 - protein, 9 aa, Homo Sapiens
RKKLAESLR

SEQ ID NO: 970720 - protein, 9 aa, Homo Sapiens
TFWTCPPCG

SEQ ID NO: 970721 - protein, 9 aa, Homo Sapiens
PSLPRSPVS

SEQ ID NO: 970722 - protein, 9 aa, Homo Sapiens
GHQGLPGPD

SEQ ID NO: 970723 - protein, 9 aa, Homo Sapiens
GKVCRQDIQ

SEQ ID NO: 970724 - protein, 9 aa, Homo Sapiens
CPTGFFGNL

SEQ ID NO: 970725 - protein, 9 aa, Homo Sapiens
QPFLNEKGQ

SEQ ID NO: 970726 - protein, 9 aa, Homo Sapiens
FLLPVPSLP

SEQ ID NO: 970727 - protein, 9 aa, Homo Sapiens
KCKESENSI

SEQ ID NO: 970728 - protein, 9 aa, Homo Sapiens
GGTYFLPED

SEQ ID NO: 970729 - protein, 9 aa, Homo Sapiens
KFDDENLLR

SEQ ID NO: 970730 - protein, 9 aa, Homo Sapiens
RLPLLIDTL

SEQ ID NO: 970731 - protein, 9 aa, Homo Sapiens
TQSEKEMTD

SEQ ID NO: 970732 - protein, 9 aa, Homo Sapiens
VTITTFSKE

SEQ ID NO: 970733 - protein, 9 aa, Homo Sapiens
NSACPQPRP

SEQ ID NO: 970734 - protein, 9 aa, Homo Sapiens
YVPRAFYFQ

SEQ ID NO: 970735 - protein, 9 aa, Homo Sapiens
GASPTTENR

SEQ ID NO: 970736 - protein, 9 aa, Homo Sapiens
LDRGEGPGS

SEQ ID NO: 970737 - protein, 9 aa, Homo Sapiens
LFRELLTFF

SEQ ID NO: 970738 - protein, 9 aa, Homo Sapiens
RRHGLGHGH

SEQ ID NO: 970739 - protein, 9 aa, Homo Sapiens
FLQMFLPQE

SEQ ID NO: 970740 - protein, 9 aa, Homo Sapiens
AKGAMGRDE

SEQ ID NO: 970741 - protein, 9 aa, Homo Sapiens
HQAQKDHYL

SEQ ID NO: 970742 - protein, 9 aa, Homo Sapiens
RPTSPLHPT

SEQ ID NO: 970743 - protein, 9 aa, Homo Sapiens
LLQKWVEKA

SEQ ID NO: 970744 - protein, 9 aa, Homo Sapiens
PPPPLVPQF

SEQ ID NO: 970745 - protein, 9 aa, Homo Sapiens
EEKHGKVGR

SEQ ID NO: 970746 - protein, 9 aa, Homo Sapiens
VNDMYVIDK

SEQ ID NO: 970747 - protein, 9 aa, Homo Sapiens
FFKAFSYLS

SEQ ID NO: 970748 - protein, 9 aa, Homo Sapiens
RRVLLIGSL

SEQ ID NO: 970749 - protein, 9 aa, Homo Sapiens
FFHIFHAIA

SEQ ID NO: 970750 - protein, 9 aa, Homo Sapiens
DENKRTPSS

SEQ ID NO: 970751 - protein, 9 aa, Homo Sapiens
SLLRCGSGL

SEQ ID NO: 970752 - protein, 9 aa, Homo Sapiens
EEIYCRLFN

SEQ ID NO: 970753 - protein, 9 aa, Homo Sapiens
HLDCVWLLL

SEQ ID NO: 970754 - protein, 9 aa, Homo Sapiens
APYTGPDFV

SEQ ID NO: 970755 - protein, 9 aa, Homo Sapiens
STTLRTTEI

SEQ ID NO: 970756 - protein, 9 aa, Homo Sapiens
FVPGALDYM

SEQ ID NO: 970757 - protein, 9 aa, Homo Sapiens
KNLFCFGES

SEQ ID NO: 970758 - protein, 9 aa, Homo Sapiens
EVSAKGQKI

SEQ ID NO: 970759 - protein, 9 aa, Homo Sapiens
PCQPPSVCP

SEQ ID NO: 970760 - protein, 9 aa, Homo Sapiens
IPTKFFENL

SEQ ID NO: 970761 - protein, 9 aa, Homo Sapiens
TVETSDLYA

SEQ ID NO: 970762 - protein, 9 aa, Homo Sapiens
LLTPSYVGS

SEQ ID NO: 970763 - protein, 9 aa, Homo Sapiens
VTKDADPYV

SEQ ID NO: 970764 - protein, 9 aa, Homo Sapiens
RTLVLIVCT

SEQ ID NO: 970765 - protein, 9 aa, Homo Sapiens
QRFTLQPDY

SEQ ID NO: 970766 - protein, 9 aa, Homo Sapiens
SNNSWNFVL

SEQ ID NO: 970767 - protein, 9 aa, Homo Sapiens
KVENNTIHV

SEQ ID NO: 970768 - protein, 9 aa, Homo Sapiens
KGLGKKWRI

SEQ ID NO: 970769 - protein, 9 aa, Homo Sapiens
KEKARKEAA

SEQ ID NO: 970770 - protein, 9 aa, Homo Sapiens
VTTDFSSES

SEQ ID NO: 970771 - protein, 9 aa, Homo Sapiens
LYDPVIFKL

SEQ ID NO: 970772 - protein, 9 aa, Homo Sapiens
VEYLLGMLH

SEQ ID NO: 970773 - protein, 9 aa, Homo Sapiens
GYQREGRQC

SEQ ID NO: 970774 - protein, 9 aa, Homo Sapiens
LHPEFLFST

SEQ ID NO: 970775 - protein, 9 aa, Homo Sapiens
RLKNMILWP

SEQ ID NO: 970776 - protein, 9 aa, Homo Sapiens
LGPPGPRRG

SEQ ID NO: 970777 - protein, 9 aa, Homo Sapiens
LQRLAGPRD

SEQ ID NO: 970778 - protein, 9 aa, Homo Sapiens
GAFCLQWCP

SEQ ID NO: 970779 - protein, 9 aa, Homo Sapiens
LEDFFNFCS

SEQ ID NO: 970780 - protein, 9 aa, Homo Sapiens
DEVWPGFYL

SEQ ID NO: 970781 - protein, 9 aa, Homo Sapiens
EYLLGMLHS

SEQ ID NO: 970782 - protein, 9 aa, Homo Sapiens
PGSLWWRSK

SEQ ID NO: 970783 - protein, 9 aa, Homo Sapiens
ASSSSFSSC

SEQ ID NO: 970784 - protein, 9 aa, Homo Sapiens
VELDVSRNK

SEQ ID NO: 970785 - protein, 9 aa, Homo Sapiens
GHFSYPDPS

SEQ ID NO: 970786 - protein, 9 aa, Homo Sapiens
GPPQPQSLA

SEQ ID NO: 970787 - protein, 9 aa, Homo Sapiens
GEIHVGPSH

SEQ ID NO: 970788 - protein, 9 aa, Homo Sapiens
CGEESSSDT

SEQ ID NO: 970789 - protein, 9 aa, Homo Sapiens
GLEIEAYVK

SEQ ID NO: 970790 - protein, 9 aa, Homo Sapiens
IIAYVLVFL

SEQ ID NO: 970791 - protein, 9 aa, Homo Sapiens
MPPLSPKKP

SEQ ID NO: 970792 - protein, 9 aa, Homo Sapiens
KPTNQGQDS

SEQ ID NO: 970793 - protein, 9 aa, Homo Sapiens
QKQNPIEHE

SEQ ID NO: 970794 - protein, 9 aa, Homo Sapiens
KRAAFLNYL

SEQ ID NO: 970795 - protein, 9 aa, Homo Sapiens
TAQDIVTCT

SEQ ID NO: 970796 - protein, 9 aa, Homo Sapiens
TDEKTFKAV

SEQ ID NO: 970797 - protein, 9 aa, Homo Sapiens
VARTKISND

SEQ ID NO: 970798 - protein, 9 aa, Homo Sapiens
LCSSNTSLL

SEQ ID NO: 970799 - protein, 9 aa, Homo Sapiens
RGLPGLEGP

SEQ ID NO: 970800 - protein, 9 aa, Homo Sapiens
CFGELKTRG

SEQ ID NO: 970801 - protein, 9 aa, Homo Sapiens
NWHVRIHTA

SEQ ID NO: 970802 - protein, 9 aa, Homo Sapiens
KPGALIRPS

SEQ ID NO: 970803 - protein, 9 aa, Homo Sapiens
KSFSQIYNL

SEQ ID NO: 970804 - protein, 9 aa, Homo Sapiens
ISPAADSYE

SEQ ID NO: 970805 - protein, 9 aa, Homo Sapiens
HFSIPLDES

SEQ ID NO: 970806 - protein, 9 aa, Homo Sapiens
RTETTGEKR

SEQ ID NO: 970807 - protein, 9 aa, Homo Sapiens
ALDQEEQEE

SEQ ID NO: 970808 - protein, 9 aa, Homo Sapiens
SRFMGTISD

SEQ ID NO: 970809 - protein, 9 aa, Homo Sapiens
NENLKKCYL

SEQ ID NO: 970810 - protein, 9 aa, Homo Sapiens
GLGNHLFGS

SEQ ID NO: 970811 - protein, 9 aa, Homo Sapiens
QSFLGSASA

SEQ ID NO: 970812 - protein, 9 aa, Homo Sapiens
HRKIYTGEK

SEQ ID NO: 970813 - protein, 9 aa, Homo Sapiens
QMIIYAKFD

SEQ ID NO: 970814 - protein, 9 aa, Homo Sapiens
YGPGLEKSR

SEQ ID NO: 970815 - protein, 9 aa, Homo Sapiens
TPVVSLFLD

SEQ ID NO: 970816 - protein, 9 aa, Homo Sapiens
QENFLGKKR

SEQ ID NO: 970817 - protein, 9 aa, Homo Sapiens
NAPIHCICR

SEQ ID NO: 970818 - protein, 9 aa, Homo Sapiens
PNACLQSTL

SEQ ID NO: 970819 - protein, 9 aa, Homo Sapiens
ARHIFFFSW

SEQ ID NO: 970820 - protein, 9 aa, Homo Sapiens
YLLKSLFKK

SEQ ID NO: 970821 - protein, 9 aa, Homo Sapiens
AMVSSGGVP

SEQ ID NO: 970822 - protein, 9 aa, Homo Sapiens
IFSEAPEED

SEQ ID NO: 970823 - protein, 9 aa, Homo Sapiens
GPRTPDGRK

SEQ ID NO: 970824 - protein, 9 aa, Homo Sapiens
ILEKGKSGE

SEQ ID NO: 970825 - protein, 9 aa, Homo Sapiens
KLQKMEAMS

SEQ ID NO: 970826 - protein, 9 aa, Homo Sapiens
LHSACVQLF

SEQ ID NO: 970827 - protein, 9 aa, Homo Sapiens
LQIWRKQGY

SEQ ID NO: 970828 - protein, 9 aa, Homo Sapiens
YRQLLGMVW

SEQ ID NO: 970829 - protein, 9 aa, Homo Sapiens
SLGGLCSSN

SEQ ID NO: 970830 - protein, 9 aa, Homo Sapiens
RSPERTLSL

SEQ ID NO: 970831 - protein, 9 aa, Homo Sapiens
YTVEHMISP

SEQ ID NO: 970832 - protein, 9 aa, Homo Sapiens
LKCTDCLDE

SEQ ID NO: 970833 - protein, 9 aa, Homo Sapiens
TLLFYVHFL

SEQ ID NO: 970834 - protein, 9 aa, Homo Sapiens
DQDDNQTGQ

SEQ ID NO: 970835 - protein, 9 aa, Homo Sapiens
KIPEIPESI

SEQ ID NO: 970836 - protein, 9 aa, Homo Sapiens
APRRGPEHR

SEQ ID NO: 970837 - protein, 9 aa, Homo Sapiens
SYYPLEKEL

SEQ ID NO: 970838 - protein, 9 aa, Homo Sapiens
FHMAVSGVG

SEQ ID NO: 970839 - protein, 9 aa, Homo Sapiens
RLQQSWELL

SEQ ID NO: 970840 - protein, 9 aa, Homo Sapiens
EREKPLSTF

SEQ ID NO: 970841 - protein, 9 aa, Homo Sapiens
GNEGEGAGR

SEQ ID NO: 970842 - protein, 9 aa, Homo Sapiens
QTALQVCLA

SEQ ID NO: 970843 - protein, 9 aa, Homo Sapiens
FSTCSFHLC

SEQ ID NO: 970844 - protein, 9 aa, Homo Sapiens
DEQYCQCKG

SEQ ID NO: 970845 - protein, 9 aa, Homo Sapiens
QLQGQEVQV

SEQ ID NO: 970846 - protein, 9 aa, Homo Sapiens
ACSNSSQQV

SEQ ID NO: 970847 - protein, 9 aa, Homo Sapiens
DPQNQRLSK

SEQ ID NO: 970848 - protein, 9 aa, Homo Sapiens
FKEVLSEPW

SEQ ID NO: 970849 - protein, 9 aa, Homo Sapiens
FCSDGRECL

SEQ ID NO: 970850 - protein, 9 aa, Homo Sapiens
ASTLENEQD

SEQ ID NO: 970851 - protein, 9 aa, Homo Sapiens
RVDASDSTA

SEQ ID NO: 970852 - protein, 9 aa, Homo Sapiens
LSRHQLMPN

SEQ ID NO: 970853 - protein, 9 aa, Homo Sapiens
GLPHCRNGG

SEQ ID NO: 970854 - protein, 9 aa, Homo Sapiens
KLVVVGADG

SEQ ID NO: 970855 - protein, 9 aa, Homo Sapiens
IRPDGSGAP

SEQ ID NO: 970856 - protein, 9 aa, Homo Sapiens
NQTTAEKQS

SEQ ID NO: 970857 - protein, 9 aa, Homo Sapiens
RTGPEASRN

SEQ ID NO: 970858 - protein, 9 aa, Homo Sapiens
IRFPADEAF

SEQ ID NO: 970859 - protein, 9 aa, Homo Sapiens
RSGDLSQNK

SEQ ID NO: 970860 - protein, 9 aa, Homo Sapiens
EVGEEEEQP

SEQ ID NO: 970861 - protein, 9 aa, Homo Sapiens
LPSEPSKFV

SEQ ID NO: 970862 - protein, 9 aa, Homo Sapiens
QREDPQARL

SEQ ID NO: 970863 - protein, 9 aa, Homo Sapiens
VSSFKDVRQ

SEQ ID NO: 970864 - protein, 9 aa, Homo Sapiens
PVYPSNQTT

SEQ ID NO: 970865 - protein, 9 aa, Homo Sapiens
IIFVSADRL

SEQ ID NO: 970866 - protein, 9 aa, Homo Sapiens
EMNSEGEIP

SEQ ID NO: 970867 - protein, 9 aa, Homo Sapiens
QCMKLLERK

SEQ ID NO: 970868 - protein, 9 aa, Homo Sapiens
EDQPLTSTG

SEQ ID NO: 970869 - protein, 9 aa, Homo Sapiens
EPLDKEETP

SEQ ID NO: 970870 - protein, 9 aa, Homo Sapiens
PMASRPRVR

SEQ ID NO: 970871 - protein, 9 aa, Homo Sapiens
TGKECEDEN

SEQ ID NO: 970872 - protein, 9 aa, Homo Sapiens
RVSEGRWIK

SEQ ID NO: 970873 - protein, 9 aa, Homo Sapiens
PGWRELVLP

SEQ ID NO: 970874 - protein, 9 aa, Homo Sapiens
ENVTAFWEK

SEQ ID NO: 970875 - protein, 9 aa, Homo Sapiens
HSVISESEV

SEQ ID NO: 970876 - protein, 9 aa, Homo Sapiens
QDFNPQPFL

SEQ ID NO: 970877 - protein, 9 aa, Homo Sapiens
LLRKKGVDG

SEQ ID NO: 970878 - protein, 9 aa, Homo Sapiens
LVSMLNDLI

SEQ ID NO: 970879 - protein, 9 aa, Homo Sapiens
EEGGKPEMN

SEQ ID NO: 970880 - protein, 9 aa, Homo Sapiens
FGNYFTYYF

SEQ ID NO: 970881 - protein, 9 aa, Homo Sapiens
ILDCRNVGI

SEQ ID NO: 970882 - protein, 9 aa, Homo Sapiens
YHISRNSWL

SEQ ID NO: 970883 - protein, 9 aa, Homo Sapiens
EEKALDNSA

SEQ ID NO: 970884 - protein, 9 aa, Homo Sapiens
LNERGIKTA

SEQ ID NO: 970885 - protein, 9 aa, Homo Sapiens
KNIPNLTAL

SEQ ID NO: 970886 - protein, 9 aa, Homo Sapiens
TLFHYSEGL

SEQ ID NO: 970887 - protein, 9 aa, Homo Sapiens
NILLSTLKI

SEQ ID NO: 970888 - protein, 9 aa, Homo Sapiens
QFVVTTNLV

SEQ ID NO: 970889 - protein, 9 aa, Homo Sapiens
RQHVLEDLL

SEQ ID NO: 970890 - protein, 9 aa, Homo Sapiens
PQKFPSYPE

SEQ ID NO: 970891 - protein, 9 aa, Homo Sapiens
EAEREWEGG

SEQ ID NO: 970892 - protein, 9 aa, Homo Sapiens
FCPEQILQL

SEQ ID NO: 970893 - protein, 9 aa, Homo Sapiens
AVTVYNKPA

SEQ ID NO: 970894 - protein, 9 aa, Homo Sapiens
PDNFWYLNR

SEQ ID NO: 970895 - protein, 9 aa, Homo Sapiens
VSWGEWDRV

SEQ ID NO: 970896 - protein, 9 aa, Homo Sapiens
PAHWALSIW

SEQ ID NO: 970897 - protein, 9 aa, Homo Sapiens
LVGTEPKSE

SEQ ID NO: 970898 - protein, 9 aa, Homo Sapiens
SPTQPSSGP

SEQ ID NO: 970899 - protein, 9 aa, Homo Sapiens
RESEFQDKE

SEQ ID NO: 970900 - protein, 9 aa, Homo Sapiens
LNLTLRAGP

SEQ ID NO: 970901 - protein, 9 aa, Homo Sapiens
PQVPAERVD

SEQ ID NO: 970902 - protein, 9 aa, Homo Sapiens
HFVSVGFYM

SEQ ID NO: 970903 - protein, 9 aa, Homo Sapiens
LADGEVSGD

SEQ ID NO: 970904 - protein, 9 aa, Homo Sapiens
YKLVVVGAD

SEQ ID NO: 970905 - protein, 9 aa, Homo Sapiens
KINFYKVID

SEQ ID NO: 970906 - protein, 9 aa, Homo Sapiens
RQLYGLGSP

SEQ ID NO: 970907 - protein, 9 aa, Homo Sapiens
THKSWLWQH

SEQ ID NO: 970908 - protein, 9 aa, Homo Sapiens
LRVHGLYWM

SEQ ID NO: 970909 - protein, 9 aa, Homo Sapiens
MSTTLIGTE

SEQ ID NO: 970910 - protein, 9 aa, Homo Sapiens
ALLQRNFSI

SEQ ID NO: 970911 - protein, 9 aa, Homo Sapiens
LESQVRRAD

SEQ ID NO: 970912 - protein, 9 aa, Homo Sapiens
SPGIQGPEH

SEQ ID NO: 970913 - protein, 9 aa, Homo Sapiens
KRLKDLGVP

SEQ ID NO: 970914 - protein, 9 aa, Homo Sapiens
YTFRKISSL

SEQ ID NO: 970915 - protein, 9 aa, Homo Sapiens
FPPGSPQRS

SEQ ID NO: 970916 - protein, 9 aa, Homo Sapiens
AEYMVFGSL

SEQ ID NO: 970917 - protein, 9 aa, Homo Sapiens
IEPTSGIVC

SEQ ID NO: 970918 - protein, 9 aa, Homo Sapiens
QENGNLRRS

SEQ ID NO: 970919 - protein, 9 aa, Homo Sapiens
KAYKKYIKD

SEQ ID NO: 970920 - protein, 9 aa, Homo Sapiens
EHFLERSWY

SEQ ID NO: 970921 - protein, 9 aa, Homo Sapiens
QEETLADLT

SEQ ID NO: 970922 - protein, 9 aa, Homo Sapiens
TRKKAEPTF

SEQ ID NO: 970923 - protein, 9 aa, Homo Sapiens
NVWQKNLQD

SEQ ID NO: 970924 - protein, 9 aa, Homo Sapiens
SSTSDHHWC

SEQ ID NO: 970925 - protein, 9 aa, Homo Sapiens
LFSEYYEPR

SEQ ID NO: 970926 - protein, 9 aa, Homo Sapiens
LKKEIGKLE

SEQ ID NO: 970927 - protein, 9 aa, Homo Sapiens
VSSHSSQVT

SEQ ID NO: 970928 - protein, 9 aa, Homo Sapiens
SRMGSIQEE

SEQ ID NO: 970929 - protein, 9 aa, Homo Sapiens
EKDLKEELT

SEQ ID NO: 970930 - protein, 9 aa, Homo Sapiens
LEFFFTSIF

SEQ ID NO: 970931 - protein, 9 aa, Homo Sapiens
CFTLKRYEG

SEQ ID NO: 970932 - protein, 9 aa, Homo Sapiens
MQSLVDVIR

SEQ ID NO: 970933 - protein, 9 aa, Homo Sapiens
HKKFDDDTY

SEQ ID NO: 970934 - protein, 9 aa, Homo Sapiens
GRIAATLAG

SEQ ID NO: 970935 - protein, 9 aa, Homo Sapiens
DKVALLIRN

SEQ ID NO: 970936 - protein, 9 aa, Homo Sapiens
FDPRTPWLL

SEQ ID NO: 970937 - protein, 9 aa, Homo Sapiens
QIRMNLSGR

SEQ ID NO: 970938 - protein, 9 aa, Homo Sapiens
LHLKIDSYS

SEQ ID NO: 970939 - protein, 9 aa, Homo Sapiens
VSSRVTFLD

SEQ ID NO: 970940 - protein, 9 aa, Homo Sapiens
RRSPGPKGD

SEQ ID NO: 970941 - protein, 9 aa, Homo Sapiens
ITLHDEPVN

SEQ ID NO: 970942 - protein, 9 aa, Homo Sapiens
QRQNPFNEK

SEQ ID NO: 970943 - protein, 9 aa, Homo Sapiens
RKIEATNAV

SEQ ID NO: 970944 - protein, 9 aa, Homo Sapiens
ADSSSLFPN

SEQ ID NO: 970945 - protein, 9 aa, Homo Sapiens
MAAVAGSGP

SEQ ID NO: 970946 - protein, 9 aa, Homo Sapiens
ESYITLALL

SEQ ID NO: 970947 - protein, 9 aa, Homo Sapiens
IISENESDD

SEQ ID NO: 970948 - protein, 9 aa, Homo Sapiens
VKQPPPPLP

SEQ ID NO: 970949 - protein, 9 aa, Homo Sapiens
GAEDALDAD

SEQ ID NO: 970950 - protein, 9 aa, Homo Sapiens
AIKHANSVG

SEQ ID NO: 970951 - protein, 9 aa, Homo Sapiens
VTKDSGVGL

SEQ ID NO: 970952 - protein, 9 aa, Homo Sapiens
PKPNQNILI

SEQ ID NO: 970953 - protein, 9 aa, Homo Sapiens
QLALGLAIF

SEQ ID NO: 970954 - protein, 9 aa, Homo Sapiens
WNCSSLETH

SEQ ID NO: 970955 - protein, 9 aa, Homo Sapiens
FIAAVYEHV

SEQ ID NO: 970956 - protein, 9 aa, Homo Sapiens
ECPSAFDSL

SEQ ID NO: 970957 - protein, 9 aa, Homo Sapiens
FGASDSSRF

SEQ ID NO: 970958 - protein, 9 aa, Homo Sapiens
GFLIALIPF

SEQ ID NO: 970959 - protein, 9 aa, Homo Sapiens
ETAMVTSIE

SEQ ID NO: 970960 - protein, 9 aa, Homo Sapiens
ISITMGPKD

SEQ ID NO: 970961 - protein, 9 aa, Homo Sapiens
IPLKYVPGM

SEQ ID NO: 970962 - protein, 9 aa, Homo Sapiens
FCLKREGLD

SEQ ID NO: 970963 - protein, 9 aa, Homo Sapiens
KHANSVGTS

SEQ ID NO: 970964 - protein, 9 aa, Homo Sapiens
GGVMTGRAG

SEQ ID NO: 970965 - protein, 9 aa, Homo Sapiens
FTSIFSALW

SEQ ID NO: 970966 - protein, 9 aa, Homo Sapiens
GPSVVGLGS

SEQ ID NO: 970967 - protein, 9 aa, Homo Sapiens
NPSGTDHVT

SEQ ID NO: 970968 - protein, 9 aa, Homo Sapiens
NSILTPTWV

SEQ ID NO: 970969 - protein, 9 aa, Homo Sapiens
QIEISSPCC

SEQ ID NO: 970970 - protein, 9 aa, Homo Sapiens
SCSFPHNFV

SEQ ID NO: 970971 - protein, 9 aa, Homo Sapiens
KDDANMEQI

SEQ ID NO: 970972 - protein, 9 aa, Homo Sapiens
VSSSLLASP

SEQ ID NO: 970973 - protein, 9 aa, Homo Sapiens
VEKDFCLMD

SEQ ID NO: 970974 - protein, 9 aa, Homo Sapiens
QTMTKLTRG

SEQ ID NO: 970975 - protein, 9 aa, Homo Sapiens
GKNRMAVSQ

SEQ ID NO: 970976 - protein, 9 aa, Homo Sapiens
NVLSSTSAI

SEQ ID NO: 970977 - protein, 9 aa, Homo Sapiens
TPQPGFSNS

SEQ ID NO: 970978 - protein, 9 aa, Homo Sapiens
DSDAESDSG

SEQ ID NO: 970979 - protein, 9 aa, Homo Sapiens
LCRVAPPYP

SEQ ID NO: 970980 - protein, 9 aa, Homo Sapiens
YVLVKLHDG

SEQ ID NO: 970981 - protein, 9 aa, Homo Sapiens
PSSSFSTLI

SEQ ID NO: 970982 - protein, 9 aa, Homo Sapiens
KGMKVHVNL

SEQ ID NO: 970983 - protein, 9 aa, Homo Sapiens
SREDMRLLY

SEQ ID NO: 970984 - protein, 9 aa, Homo Sapiens
HEPPKLFET

SEQ ID NO: 970985 - protein, 9 aa, Homo Sapiens
IAATLAGSR

SEQ ID NO: 970986 - protein, 9 aa, Homo Sapiens
INSEQDIVK

SEQ ID NO: 970987 - protein, 9 aa, Homo Sapiens
SRKMKFKGN

SEQ ID NO: 970988 - protein, 9 aa, Homo Sapiens
FLKHGYIPG

SEQ ID NO: 970989 - protein, 9 aa, Homo Sapiens
IQEETLADL

SEQ ID NO: 970990 - protein, 9 aa, Homo Sapiens
LDLGLIRMI

SEQ ID NO: 970991 - protein, 9 aa, Homo Sapiens
KKDWCAKCQ

SEQ ID NO: 970992 - protein, 9 aa, Homo Sapiens
VTGSSRTRL

SEQ ID NO: 970993 - protein, 9 aa, Homo Sapiens
PVCPPRSAP

SEQ ID NO: 970994 - protein, 9 aa, Homo Sapiens
EKSKDVNGL

SEQ ID NO: 970995 - protein, 9 aa, Homo Sapiens
FTYHKKTHT

SEQ ID NO: 970996 - protein, 9 aa, Homo Sapiens
FETVRFPLM

SEQ ID NO: 970997 - protein, 9 aa, Homo Sapiens
LLQADLPLG

SEQ ID NO: 970998 - protein, 9 aa, Homo Sapiens
SCVGFFSAM

SEQ ID NO: 970999 - protein, 9 aa, Homo Sapiens
PPGPNYGAD

SEQ ID NO: 971000 - protein, 9 aa, Homo Sapiens
QFPRACGLR

SEQ ID NO: 971001 - protein, 9 aa, Homo Sapiens
CVPREVSCV

SEQ ID NO: 971002 - protein, 9 aa, Homo Sapiens
NLLSPAPMN

SEQ ID NO: 971003 - protein, 9 aa, Homo Sapiens
TELSKKDRE

SEQ ID NO: 971004 - protein, 9 aa, Homo Sapiens
SSSHLLLTL

SEQ ID NO: 971005 - protein, 9 aa, Homo Sapiens
LYNLSSPSP

SEQ ID NO: 971006 - protein, 9 aa, Homo Sapiens
TTNKKIGIF

SEQ ID NO: 971007 - protein, 9 aa, Homo Sapiens
DWYDFVWNC

SEQ ID NO: 971008 - protein, 9 aa, Homo Sapiens
WLKREAISG

SEQ ID NO: 971009 - protein, 9 aa, Homo Sapiens
HPTPALPFP

SEQ ID NO: 971010 - protein, 9 aa, Homo Sapiens
ISKRAETLG

SEQ ID NO: 971011 - protein, 9 aa, Homo Sapiens
EEREDDAFC

SEQ ID NO: 971012 - protein, 9 aa, Homo Sapiens
RVAAEPLDG

SEQ ID NO: 971013 - protein, 9 aa, Homo Sapiens
RTSSRIGLL

SEQ ID NO: 971014 - protein, 9 aa, Homo Sapiens
KDLCRKIIG

SEQ ID NO: 971015 - protein, 9 aa, Homo Sapiens
SLLNQHQRT

SEQ ID NO: 971016 - protein, 9 aa, Homo Sapiens
IFLTISREH

SEQ ID NO: 971017 - protein, 9 aa, Homo Sapiens
DPPYFSPSR

SEQ ID NO: 971018 - protein, 9 aa, Homo Sapiens
TCIPSYNTI

SEQ ID NO: 971019 - protein, 9 aa, Homo Sapiens
PSTFTYHKK

SEQ ID NO: 971020 - protein, 9 aa, Homo Sapiens
FIKASFMSH

SEQ ID NO: 971021 - protein, 9 aa, Homo Sapiens
SCVATEEEG

SEQ ID NO: 971022 - protein, 9 aa, Homo Sapiens
DYVVTLSEP

SEQ ID NO: 971023 - protein, 9 aa, Homo Sapiens
PTPALPFPG

SEQ ID NO: 971024 - protein, 9 aa, Homo Sapiens
SRPPCNQRG

SEQ ID NO: 971025 - protein, 9 aa, Homo Sapiens
GRGVDEAPL

SEQ ID NO: 971026 - protein, 9 aa, Homo Sapiens
FLELKFSHK

SEQ ID NO: 971027 - protein, 9 aa, Homo Sapiens
SFWTLAGES

SEQ ID NO: 971028 - protein, 9 aa, Homo Sapiens
QLHLKIDSY

SEQ ID NO: 971029 - protein, 9 aa, Homo Sapiens
KPTETPPMK

SEQ ID NO: 971030 - protein, 9 aa, Homo Sapiens
LPDNLPELE

SEQ ID NO: 971031 - protein, 9 aa, Homo Sapiens
FSKFKENTS

SEQ ID NO: 971032 - protein, 9 aa, Homo Sapiens
ARLTRFYGC

SEQ ID NO: 971033 - protein, 9 aa, Homo Sapiens
FGSGGGGPK

SEQ ID NO: 971034 - protein, 9 aa, Homo Sapiens
FRDRLGDIF

SEQ ID NO: 971035 - protein, 9 aa, Homo Sapiens
IMQKVEHAL

SEQ ID NO: 971036 - protein, 9 aa, Homo Sapiens
AGNGSRDNK

SEQ ID NO: 971037 - protein, 9 aa, Homo Sapiens
DLEQTMTKL

SEQ ID NO: 971038 - protein, 9 aa, Homo Sapiens
EKVQLEILP

SEQ ID NO: 971039 - protein, 9 aa, Homo Sapiens
HRKAFTTCS

SEQ ID NO: 971040 - protein, 9 aa, Homo Sapiens
ECENGFILR

SEQ ID NO: 971041 - protein, 9 aa, Homo Sapiens
ANCRKQENQ

SEQ ID NO: 971042 - protein, 9 aa, Homo Sapiens
ANHNLKQVE

SEQ ID NO: 971043 - protein, 9 aa, Homo Sapiens
VEEWGPFNL

SEQ ID NO: 971044 - protein, 9 aa, Homo Sapiens
LSSAFADSF

SEQ ID NO: 971045 - protein, 9 aa, Homo Sapiens
LFYLPRVCS

SEQ ID NO: 971046 - protein, 9 aa, Homo Sapiens
KFDGDEQFY

SEQ ID NO: 971047 - protein, 9 aa, Homo Sapiens
SPLTVSMFL

SEQ ID NO: 971048 - protein, 9 aa, Homo Sapiens
VLEESESFI

SEQ ID NO: 971049 - protein, 9 aa, Homo Sapiens
TGTKGEKED

SEQ ID NO: 971050 - protein, 9 aa, Homo Sapiens
ASFLEWEPE

SEQ ID NO: 971051 - protein, 9 aa, Homo Sapiens
MMRKKDLCR

SEQ ID NO: 971052 - protein, 9 aa, Homo Sapiens
NMFDVITDQ

SEQ ID NO: 971053 - protein, 9 aa, Homo Sapiens
FSPSRASVH

SEQ ID NO: 971054 - protein, 9 aa, Homo Sapiens
KKIAALAPS

SEQ ID NO: 971055 - protein, 9 aa, Homo Sapiens
LSAPAMEPD

SEQ ID NO: 971056 - protein, 9 aa, Homo Sapiens
DPPLVSSSL

SEQ ID NO: 971057 - protein, 9 aa, Homo Sapiens
SRGRGRGGG

SEQ ID NO: 971058 - protein, 9 aa, Homo Sapiens
QKEKKDSQL

SEQ ID NO: 971059 - protein, 9 aa, Homo Sapiens
EDIRAHLPQ

SEQ ID NO: 971060 - protein, 9 aa, Homo Sapiens
ENEKRATKP

SEQ ID NO: 971061 - protein, 9 aa, Homo Sapiens
STVINSRAC

SEQ ID NO: 971062 - protein, 9 aa, Homo Sapiens
EESPQEKVL

SEQ ID NO: 971063 - protein, 9 aa, Homo Sapiens
KNIMRANFN

SEQ ID NO: 971064 - protein, 9 aa, Homo Sapiens
VKRTYAFRE

SEQ ID NO: 971065 - protein, 9 aa, Homo Sapiens
ERRLHWNGK

SEQ ID NO: 971066 - protein, 9 aa, Homo Sapiens
DEFYDADGF

SEQ ID NO: 971067 - protein, 9 aa, Homo Sapiens
HFLERSWYA

SEQ ID NO: 971068 - protein, 9 aa, Homo Sapiens
RGDPGPFGP

SEQ ID NO: 971069 - protein, 9 aa, Homo Sapiens
IIKSRNNEV

SEQ ID NO: 971070 - protein, 9 aa, Homo Sapiens
ALMAYWKKE

SEQ ID NO: 971071 - protein, 9 aa, Homo Sapiens
LAPGDNPYM

SEQ ID NO: 971072 - protein, 9 aa, Homo Sapiens
SEPPRDWFP

SEQ ID NO: 971073 - protein, 9 aa, Homo Sapiens
TFCKQIGTL

SEQ ID NO: 971074 - protein, 9 aa, Homo Sapiens
DDDSDEKNC

SEQ ID NO: 971075 - protein, 9 aa, Homo Sapiens
AFYRSYTMQ

SEQ ID NO: 971076 - protein, 9 aa, Homo Sapiens
TAPSALSSS

SEQ ID NO: 971077 - protein, 9 aa, Homo Sapiens
SRIKRENTT

SEQ ID NO: 971078 - protein, 9 aa, Homo Sapiens
NLPELEEGF

SEQ ID NO: 971079 - protein, 9 aa, Homo Sapiens
LPFPGPGPT

SEQ ID NO: 971080 - protein, 9 aa, Homo Sapiens
SAGIVAVLK

SEQ ID NO: 971081 - protein, 9 aa, Homo Sapiens
PVLVTTFVG

SEQ ID NO: 971082 - protein, 9 aa, Homo Sapiens
VPESRIPNR

SEQ ID NO: 971083 - protein, 9 aa, Homo Sapiens
QKGGCPRGA

SEQ ID NO: 971084 - protein, 9 aa, Homo Sapiens
LVFGGDVPI

SEQ ID NO: 971085 - protein, 9 aa, Homo Sapiens
GKPDMAYCL

SEQ ID NO: 971086 - protein, 9 aa, Homo Sapiens
GGYAEVGRA

SEQ ID NO: 971087 - protein, 9 aa, Homo Sapiens
ALIPFWNKD

SEQ ID NO: 971088 - protein, 9 aa, Homo Sapiens
YSVHQTSSP

SEQ ID NO: 971089 - protein, 9 aa, Homo Sapiens
MSWARQPGG

SEQ ID NO: 971090 - protein, 9 aa, Homo Sapiens
IQLDGLVWR

SEQ ID NO: 971091 - protein, 9 aa, Homo Sapiens
FGSVTFDHE

SEQ ID NO: 971092 - protein, 9 aa, Homo Sapiens
FFFQDNSRY

SEQ ID NO: 971093 - protein, 9 aa, Homo Sapiens
GEQSWLLAP

SEQ ID NO: 971094 - protein, 9 aa, Homo Sapiens
FVTFDDHDF

SEQ ID NO: 971095 - protein, 9 aa, Homo Sapiens
SEPGNEAKD

SEQ ID NO: 971096 - protein, 9 aa, Homo Sapiens
LNFKSINHM

SEQ ID NO: 971097 - protein, 9 aa, Homo Sapiens
IYSCVLGLI

SEQ ID NO: 971098 - protein, 9 aa, Homo Sapiens
SITMGPKDH

SEQ ID NO: 971099 - protein, 9 aa, Homo Sapiens
SSTSVTTNE

SEQ ID NO: 971100 - protein, 9 aa, Homo Sapiens
VNKKIVRNI

SEQ ID NO: 971101 - protein, 9 aa, Homo Sapiens
LQVFHEKPP

SEQ ID NO: 971102 - protein, 9 aa, Homo Sapiens
CQIEISSPC

SEQ ID NO: 971103 - protein, 9 aa, Homo Sapiens
ITWLLEQPE

SEQ ID NO: 971104 - protein, 9 aa, Homo Sapiens
FDRDPKVFR

SEQ ID NO: 971105 - protein, 9 aa, Homo Sapiens
PILYMLSIL

SEQ ID NO: 971106 - protein, 9 aa, Homo Sapiens
KGPPGLVGA

SEQ ID NO: 971107 - protein, 9 aa, Homo Sapiens
DSEAESTKS

SEQ ID NO: 971108 - protein, 9 aa, Homo Sapiens
LPQRFHTGE

SEQ ID NO: 971109 - protein, 9 aa, Homo Sapiens
ERTEPDHQP

SEQ ID NO: 971110 - protein, 9 aa, Homo Sapiens
TLGSKCSDF

SEQ ID NO: 971111 - protein, 9 aa, Homo Sapiens
LLDSEDVDV

SEQ ID NO: 971112 - protein, 9 aa, Homo Sapiens
CVNLTLTGE

SEQ ID NO: 971113 - protein, 9 aa, Homo Sapiens
KLTFVILAI

SEQ ID NO: 971114 - protein, 9 aa, Homo Sapiens
LQETSFTKK

SEQ ID NO: 971115 - protein, 9 aa, Homo Sapiens
SLEGFSKFK

SEQ ID NO: 971116 - protein, 9 aa, Homo Sapiens
LILEKRNKY

SEQ ID NO: 971117 - protein, 9 aa, Homo Sapiens
RLRWPWQAA

SEQ ID NO: 971118 - protein, 9 aa, Homo Sapiens
AHRMQKKIA

SEQ ID NO: 971119 - protein, 9 aa, Homo Sapiens
RILPNHGLS

SEQ ID NO: 971120 - protein, 9 aa, Homo Sapiens
PHDIFCQRK

SEQ ID NO: 971121 - protein, 9 aa, Homo Sapiens
GCWMTFFPE

SEQ ID NO: 971122 - protein, 9 aa, Homo Sapiens
RAGHGGPQF

SEQ ID NO: 971123 - protein, 9 aa, Homo Sapiens
LNDPNKPTG

SEQ ID NO: 971124 - protein, 9 aa, Homo Sapiens
KGDERPMGL

SEQ ID NO: 971125 - protein, 9 aa, Homo Sapiens
KAHEPGMDQ

SEQ ID NO: 971126 - protein, 9 aa, Homo Sapiens
ERWTVVDSE

SEQ ID NO: 971127 - protein, 9 aa, Homo Sapiens
PAPMNWDML

SEQ ID NO: 971128 - protein, 9 aa, Homo Sapiens
APGDNPYMY

SEQ ID NO: 971129 - protein, 9 aa, Homo Sapiens
RGTLYHPSL

SEQ ID NO: 971130 - protein, 9 aa, Homo Sapiens
AKEKKSSFK

SEQ ID NO: 971131 - protein, 9 aa, Homo Sapiens
KFHSTIKVL

SEQ ID NO: 971132 - protein, 9 aa, Homo Sapiens
DAGVEAFPA

SEQ ID NO: 971133 - protein, 9 aa, Homo Sapiens
EWQAAVKPP

SEQ ID NO: 971134 - protein, 9 aa, Homo Sapiens
KGNFKNSKV

SEQ ID NO: 971135 - protein, 9 aa, Homo Sapiens
LWCCALRSS

SEQ ID NO: 971136 - protein, 9 aa, Homo Sapiens
QGGSNNIEG

SEQ ID NO: 971137 - protein, 9 aa, Homo Sapiens
PALEAFSCG

SEQ ID NO: 971138 - protein, 9 aa, Homo Sapiens
GVVIANFIE

SEQ ID NO: 971139 - protein, 9 aa, Homo Sapiens
EPPTATSEP

SEQ ID NO: 971140 - protein, 9 aa, Homo Sapiens
MKGKDIEDW

SEQ ID NO: 971141 - protein, 9 aa, Homo Sapiens
TGFSVEEVV

SEQ ID NO: 971142 - protein, 9 aa, Homo Sapiens
INHMNYLPS

SEQ ID NO: 971143 - protein, 9 aa, Homo Sapiens
GYTFCKQIG

SEQ ID NO: 971144 - protein, 9 aa, Homo Sapiens
SLDNDSLGS

SEQ ID NO: 971145 - protein, 9 aa, Homo Sapiens
IWKYLYQSP

SEQ ID NO: 971146 - protein, 9 aa, Homo Sapiens
YECVCPPER

SEQ ID NO: 971147 - protein, 9 aa, Homo Sapiens
TKAKKDWCA

SEQ ID NO: 971148 - protein, 9 aa, Homo Sapiens
RDNFHWEEY

SEQ ID NO: 971149 - protein, 9 aa, Homo Sapiens
NKCTKDAPA

SEQ ID NO: 971150 - protein, 9 aa, Homo Sapiens
SSFYSAYYG

SEQ ID NO: 971151 - protein, 9 aa, Homo Sapiens
CHLRDFEPD

SEQ ID NO: 971152 - protein, 9 aa, Homo Sapiens
KGTQRDLEA

SEQ ID NO: 971153 - protein, 9 aa, Homo Sapiens
SGFSAHLVI

SEQ ID NO: 971154 - protein, 9 aa, Homo Sapiens
PPLIFFGVP

SEQ ID NO: 971155 - protein, 9 aa, Homo Sapiens
SFLNIATRI

SEQ ID NO: 971156 - protein, 9 aa, Homo Sapiens
LSLSVGLWV

SEQ ID NO: 971157 - protein, 9 aa, Homo Sapiens
LTISREHER

SEQ ID NO: 971158 - protein, 9 aa, Homo Sapiens
TTVVVFGLD

SEQ ID NO: 971159 - protein, 9 aa, Homo Sapiens
VNCSERIKN

SEQ ID NO: 971160 - protein, 9 aa, Homo Sapiens
SLPQSSIVR

SEQ ID NO: 971161 - protein, 9 aa, Homo Sapiens
LMINATATI

SEQ ID NO: 971162 - protein, 9 aa, Homo Sapiens
VLQDLLPKI

SEQ ID NO: 971163 - protein, 9 aa, Homo Sapiens
LAERKQKLD

SEQ ID NO: 971164 - protein, 9 aa, Homo Sapiens
GIVEERWTV

SEQ ID NO: 971165 - protein, 9 aa, Homo Sapiens
DFVSLAPWE

SEQ ID NO: 971166 - protein, 9 aa, Homo Sapiens
FSMMRKKDL

SEQ ID NO: 971167 - protein, 9 aa, Homo Sapiens
LGLIRMIEE

SEQ ID NO: 971168 - protein, 9 aa, Homo Sapiens
LPLKALREN

SEQ ID NO: 971169 - protein, 9 aa, Homo Sapiens
CNSTKSGAG

SEQ ID NO: 971170 - protein, 9 aa, Homo Sapiens
LIDFLNEFY

SEQ ID NO: 971171 - protein, 9 aa, Homo Sapiens
LSQSEQTTT

SEQ ID NO: 971172 - protein, 9 aa, Homo Sapiens
GGGAPVRTT

SEQ ID NO: 971173 - protein, 9 aa, Homo Sapiens
KGGCPRGAS

SEQ ID NO: 971174 - protein, 9 aa, Homo Sapiens
ENQSGGSLG

SEQ ID NO: 971175 - protein, 9 aa, Homo Sapiens
CVVFIKWIV

SEQ ID NO: 971176 - protein, 9 aa, Homo Sapiens
SEQTTTSPK

SEQ ID NO: 971177 - protein, 9 aa, Homo Sapiens
ADSGEENTK

SEQ ID NO: 971178 - protein, 9 aa, Homo Sapiens
YASIAKDLA

SEQ ID NO: 971179 - protein, 9 aa, Homo Sapiens
IRNVFFCVK

SEQ ID NO: 971180 - protein, 9 aa, Homo Sapiens
FWDPGTAAD

SEQ ID NO: 971181 - protein, 9 aa, Homo Sapiens
NKNNLILEK

SEQ ID NO: 971182 - protein, 9 aa, Homo Sapiens
GPDGPHSDR

SEQ ID NO: 971183 - protein, 9 aa, Homo Sapiens
FRPEAPSGQ

SEQ ID NO: 971184 - protein, 9 aa, Homo Sapiens
KCLSQSEQT

SEQ ID NO: 971185 - protein, 9 aa, Homo Sapiens
RPPSHGSPT

SEQ ID NO: 971186 - protein, 9 aa, Homo Sapiens
FVGLPQNLS

SEQ ID NO: 971187 - protein, 9 aa, Homo Sapiens
STDGVDKLF

SEQ ID NO: 971188 - protein, 9 aa, Homo Sapiens
RDQIKMFIQ

SEQ ID NO: 971189 - protein, 9 aa, Homo Sapiens
IGGPAPSIC

SEQ ID NO: 971190 - protein, 9 aa, Homo Sapiens
LPFFRVSTL

SEQ ID NO: 971191 - protein, 9 aa, Homo Sapiens
RFGLCSPSY

SEQ ID NO: 971192 - protein, 9 aa, Homo Sapiens
DMFGSQPLL

SEQ ID NO: 971193 - protein, 9 aa, Homo Sapiens
PSTFHYEVV

SEQ ID NO: 971194 - protein, 9 aa, Homo Sapiens
CLWCCALRS

SEQ ID NO: 971195 - protein, 9 aa, Homo Sapiens
PQTYVEYAI

SEQ ID NO: 971196 - protein, 9 aa, Homo Sapiens
YMEIKGPPS

SEQ ID NO: 971197 - protein, 9 aa, Homo Sapiens
GLVNCSERI

SEQ ID NO: 971198 - protein, 9 aa, Homo Sapiens
VEAFPAGAS

SEQ ID NO: 971199 - protein, 9 aa, Homo Sapiens
SSRVTFLDD

SEQ ID NO: 971200 - protein, 9 aa, Homo Sapiens
ADLKQECRN

SEQ ID NO: 971201 - protein, 9 aa, Homo Sapiens
MLMPKENFT

SEQ ID NO: 971202 - protein, 9 aa, Homo Sapiens
KEFELRPQV

SEQ ID NO: 971203 - protein, 9 aa, Homo Sapiens
DNTSCQVVS

SEQ ID NO: 971204 - protein, 9 aa, Homo Sapiens
LSPTIEKKV

SEQ ID NO: 971205 - protein, 9 aa, Homo Sapiens
DLFSPILYM

SEQ ID NO: 971206 - protein, 9 aa, Homo Sapiens
RSLINKFDL

SEQ ID NO: 971207 - protein, 9 aa, Homo Sapiens
NSTQIRQNT

SEQ ID NO: 971208 - protein, 9 aa, Homo Sapiens
RSPGPKGDM

SEQ ID NO: 971209 - protein, 9 aa, Homo Sapiens
FGLDGVRRM

SEQ ID NO: 971210 - protein, 9 aa, Homo Sapiens
TMNSVRSGP

SEQ ID NO: 971211 - protein, 9 aa, Homo Sapiens
LKIDSYSLN

SEQ ID NO: 971212 - protein, 9 aa, Homo Sapiens
PFYQEIMER

SEQ ID NO: 971213 - protein, 9 aa, Homo Sapiens
VLNETLCLT

SEQ ID NO: 971214 - protein, 9 aa, Homo Sapiens
KDTSCKNNM

SEQ ID NO: 971215 - protein, 9 aa, Homo Sapiens
FSQALLTVF

SEQ ID NO: 971216 - protein, 9 aa, Homo Sapiens
EKASARLLG

SEQ ID NO: 971217 - protein, 9 aa, Homo Sapiens
ESLDQLKTL

SEQ ID NO: 971218 - protein, 9 aa, Homo Sapiens
AYYGKIPKA

SEQ ID NO: 971219 - protein, 9 aa, Homo Sapiens
VQLGVLRCY

SEQ ID NO: 971220 - protein, 9 aa, Homo Sapiens
RLQHQHRGL

SEQ ID NO: 971221 - protein, 9 aa, Homo Sapiens
CCAGTGNKK

SEQ ID NO: 971222 - protein, 9 aa, Homo Sapiens
PSSSSTLER

SEQ ID NO: 971223 - protein, 9 aa, Homo Sapiens
DIRAHLPQD

SEQ ID NO: 971224 - protein, 9 aa, Homo Sapiens
KIKSFQKQT

SEQ ID NO: 971225 - protein, 9 aa, Homo Sapiens
TISSSLNKT

SEQ ID NO: 971226 - protein, 9 aa, Homo Sapiens
FCQRNSHNL

SEQ ID NO: 971227 - protein, 9 aa, Homo Sapiens
ESRPPCNQR

SEQ ID NO: 971228 - protein, 9 aa, Homo Sapiens
SSNRLSRLN

SEQ ID NO: 971229 - protein, 9 aa, Homo Sapiens
SPPDSQEDF

SEQ ID NO: 971230 - protein, 9 aa, Homo Sapiens
CVSLEPLLP

SEQ ID NO: 971231 - protein, 9 aa, Homo Sapiens
DTMVETIAF

SEQ ID NO: 971232 - protein, 9 aa, Homo Sapiens
VEGNLMKTE

SEQ ID NO: 971233 - protein, 9 aa, Homo Sapiens
KKSSSRKGL

SEQ ID NO: 971234 - protein, 9 aa, Homo Sapiens
VSTSQRTCC

SEQ ID NO: 971235 - protein, 9 aa, Homo Sapiens
KCDAVVCTL

SEQ ID NO: 971236 - protein, 9 aa, Homo Sapiens
VFGVEPDLI

SEQ ID NO: 971237 - protein, 9 aa, Homo Sapiens
EVHERIHFG

SEQ ID NO: 971238 - protein, 9 aa, Homo Sapiens
KEKKSSFKD

SEQ ID NO: 971239 - protein, 9 aa, Homo Sapiens
RMQKKIAAL

SEQ ID NO: 971240 - protein, 9 aa, Homo Sapiens
IMPGSRKMK

SEQ ID NO: 971241 - protein, 9 aa, Homo Sapiens
FSNQMDQNI

SEQ ID NO: 971242 - protein, 9 aa, Homo Sapiens
VPPSSFLSS

SEQ ID NO: 971243 - protein, 9 aa, Homo Sapiens
ILRIPVHPI

SEQ ID NO: 971244 - protein, 9 aa, Homo Sapiens
LLKGMRQAD

SEQ ID NO: 971245 - protein, 9 aa, Homo Sapiens
DKRKVLLKL

SEQ ID NO: 971246 - protein, 9 aa, Homo Sapiens
SLEAKDVTV

SEQ ID NO: 971247 - protein, 9 aa, Homo Sapiens
PNYGADAHF

SEQ ID NO: 971248 - protein, 9 aa, Homo Sapiens
SFPENEEDT

SEQ ID NO: 971249 - protein, 9 aa, Homo Sapiens
IKSFQKQTF

SEQ ID NO: 971250 - protein, 9 aa, Homo Sapiens
KGGNSVILN

SEQ ID NO: 971251 - protein, 9 aa, Homo Sapiens
RSGNEPLSA

SEQ ID NO: 971252 - protein, 9 aa, Homo Sapiens
QDKKILETE

SEQ ID NO: 971253 - protein, 9 aa, Homo Sapiens
FIQPKEWKG

SEQ ID NO: 971254 - protein, 9 aa, Homo Sapiens
FEESPQEKV

SEQ ID NO: 971255 - protein, 9 aa, Homo Sapiens
EPSPLPELV

SEQ ID NO: 971256 - protein, 9 aa, Homo Sapiens
CVENAGGSP

SEQ ID NO: 971257 - protein, 9 aa, Homo Sapiens
VDEAPLSTL

SEQ ID NO: 971258 - protein, 9 aa, Homo Sapiens
NEEDTRLYS

SEQ ID NO: 971259 - protein, 9 aa, Homo Sapiens
SQLHRLQHQ

SEQ ID NO: 971260 - protein, 9 aa, Homo Sapiens
PTFRPEAPS

SEQ ID NO: 971261 - protein, 9 aa, Homo Sapiens
AALMAPSSL

SEQ ID NO: 971262 - protein, 9 aa, Homo Sapiens
SFLEWEPEP

SEQ ID NO: 971263 - protein, 9 aa, Homo Sapiens
PLFLLVLTL

SEQ ID NO: 971264 - protein, 9 aa, Homo Sapiens
QPLLELIRL

SEQ ID NO: 971265 - protein, 9 aa, Homo Sapiens
NPQRWGFGT

SEQ ID NO: 971266 - protein, 9 aa, Homo Sapiens
DLETKNSSY

SEQ ID NO: 971267 - protein, 9 aa, Homo Sapiens
SLRRHETSH

SEQ ID NO: 971268 - protein, 9 aa, Homo Sapiens
ISGPGTEKG

SEQ ID NO: 971269 - protein, 9 aa, Homo Sapiens
SQLRGTLYH

SEQ ID NO: 971270 - protein, 9 aa, Homo Sapiens
YFRDRLGDI

SEQ ID NO: 971271 - protein, 9 aa, Homo Sapiens
FAAEPTSSG

SEQ ID NO: 971272 - protein, 9 aa, Homo Sapiens
VEKDTDPNS

SEQ ID NO: 971273 - protein, 9 aa, Homo Sapiens
SSPYSRSPV

SEQ ID NO: 971274 - protein, 9 aa, Homo Sapiens
EICKLSGLM

SEQ ID NO: 971275 - protein, 9 aa, Homo Sapiens
FGLTIPCYT

SEQ ID NO: 971276 - protein, 9 aa, Homo Sapiens
YPNGIVTEL

SEQ ID NO: 971277 - protein, 9 aa, Homo Sapiens
QHGSVSDSV

SEQ ID NO: 971278 - protein, 9 aa, Homo Sapiens
TDSESEFLV

SEQ ID NO: 971279 - protein, 9 aa, Homo Sapiens
NLDSQRMPM

SEQ ID NO: 971280 - protein, 9 aa, Homo Sapiens
NGNIKVSHT

SEQ ID NO: 971281 - protein, 9 aa, Homo Sapiens
DEKNCGCKE

SEQ ID NO: 971282 - protein, 9 aa, Homo Sapiens
FYRASLGLG

SEQ ID NO: 971283 - protein, 9 aa, Homo Sapiens
DSFCPSTSL

SEQ ID NO: 971284 - protein, 9 aa, Homo Sapiens
TFFPEWLTR

SEQ ID NO: 971285 - protein, 9 aa, Homo Sapiens
YPENLDSFF

SEQ ID NO: 971286 - protein, 9 aa, Homo Sapiens
SSQVEARSS

SEQ ID NO: 971287 - protein, 9 aa, Homo Sapiens
EFVLSHRAR

SEQ ID NO: 971288 - protein, 9 aa, Homo Sapiens
GVIHGKRKN

SEQ ID NO: 971289 - protein, 9 aa, Homo Sapiens
KLYDQIMLG

SEQ ID NO: 971290 - protein, 9 aa, Homo Sapiens
NQCDLVAFT

SEQ ID NO: 971291 - protein, 9 aa, Homo Sapiens
VGELMDQED

SEQ ID NO: 971292 - protein, 9 aa, Homo Sapiens
RISKRAETL

SEQ ID NO: 971293 - protein, 9 aa, Homo Sapiens
CPENYRRFA

SEQ ID NO: 971294 - protein, 9 aa, Homo Sapiens
LDKETLEEV

SEQ ID NO: 971295 - protein, 9 aa, Homo Sapiens
CNQRGGAPH

SEQ ID NO: 971296 - protein, 9 aa, Homo Sapiens
RMAVSQDDS

SEQ ID NO: 971297 - protein, 9 aa, Homo Sapiens
QVSCFNELK

SEQ ID NO: 971298 - protein, 9 aa, Homo Sapiens
GLNDKKDLG

SEQ ID NO: 971299 - protein, 9 aa, Homo Sapiens
DTLFSEESC

SEQ ID NO: 971300 - protein, 9 aa, Homo Sapiens
VEDTPKAKT

SEQ ID NO: 971301 - protein, 9 aa, Homo Sapiens
QIFPFPSSS

SEQ ID NO: 971302 - protein, 9 aa, Homo Sapiens
LKPLENKET

SEQ ID NO: 971303 - protein, 9 aa, Homo Sapiens
LVIVMKREN

SEQ ID NO: 971304 - protein, 9 aa, Homo Sapiens
AERKQKLDE

SEQ ID NO: 971305 - protein, 9 aa, Homo Sapiens
CVRLYGPSF

SEQ ID NO: 971306 - protein, 9 aa, Homo Sapiens
LERQDLEAC

SEQ ID NO: 971307 - protein, 9 aa, Homo Sapiens
EDVDSFEMK

SEQ ID NO: 971308 - protein, 9 aa, Homo Sapiens
LVTTVVVFG

SEQ ID NO: 971309 - protein, 9 aa, Homo Sapiens
AMLRFLRSL

SEQ ID NO: 971310 - protein, 9 aa, Homo Sapiens
CRSLRATES

SEQ ID NO: 971311 - protein, 9 aa, Homo Sapiens
PFSCEFCEP

SEQ ID NO: 971312 - protein, 9 aa, Homo Sapiens
EESVEGTTI

SEQ ID NO: 971313 - protein, 9 aa, Homo Sapiens
QQRIKKEGE

SEQ ID NO: 971314 - protein, 9 aa, Homo Sapiens
AETHYEEQI

SEQ ID NO: 971315 - protein, 9 aa, Homo Sapiens
WASTADSLS

SEQ ID NO: 971316 - protein, 9 aa, Homo Sapiens
GMKVHVNLS

SEQ ID NO: 971317 - protein, 9 aa, Homo Sapiens
CVTGLVVNS

SEQ ID NO: 971318 - protein, 9 aa, Homo Sapiens
RERGQSKER

SEQ ID NO: 971319 - protein, 9 aa, Homo Sapiens
DECPSAFDS

SEQ ID NO: 971320 - protein, 9 aa, Homo Sapiens
CVKEVCPIL

SEQ ID NO: 971321 - protein, 9 aa, Homo Sapiens
DALCQYFSN

SEQ ID NO: 971322 - protein, 9 aa, Homo Sapiens
FFIQPKEWK

SEQ ID NO: 971323 - protein, 9 aa, Homo Sapiens
KKVIKAPIK

SEQ ID NO: 971324 - protein, 9 aa, Homo Sapiens
SCSVLEESE

SEQ ID NO: 971325 - protein, 9 aa, Homo Sapiens
ITVGLGAFT

SEQ ID NO: 971326 - protein, 9 aa, Homo Sapiens
PTCSLFITT

SEQ ID NO: 971327 - protein, 9 aa, Homo Sapiens
WCSTMPNGK

SEQ ID NO: 971328 - protein, 9 aa, Homo Sapiens
SLAATWSND

SEQ ID NO: 971329 - protein, 9 aa, Homo Sapiens
AKQKQKLTE

SEQ ID NO: 971330 - protein, 9 aa, Homo Sapiens
MAACVVFIK

SEQ ID NO: 971331 - protein, 9 aa, Homo Sapiens
EELRKTKTS

SEQ ID NO: 971332 - protein, 9 aa, Homo Sapiens
YTHKFDGDE

SEQ ID NO: 971333 - protein, 9 aa, Homo Sapiens
CEVHERIHF

SEQ ID NO: 971334 - protein, 9 aa, Homo Sapiens
FNVLSSTSA

SEQ ID NO: 971335 - protein, 9 aa, Homo Sapiens
TVRIIKAVR

SEQ ID NO: 971336 - protein, 9 aa, Homo Sapiens
VIKAPIKDL

SEQ ID NO: 971337 - protein, 9 aa, Homo Sapiens
MLSLSVGLW

SEQ ID NO: 971338 - protein, 9 aa, Homo Sapiens
PQAPFSSKH

SEQ ID NO: 971339 - protein, 9 aa, Homo Sapiens
HSLGLEQRF

SEQ ID NO: 971340 - protein, 9 aa, Homo Sapiens
RLKLGWQMP

SEQ ID NO: 971341 - protein, 9 aa, Homo Sapiens
VIEVKSMGK

SEQ ID NO: 971342 - protein, 9 aa, Homo Sapiens
RLNGATFAS

SEQ ID NO: 971343 - protein, 9 aa, Homo Sapiens
FADPFKLAK

SEQ ID NO: 971344 - protein, 9 aa, Homo Sapiens
YQLSSSFLT

SEQ ID NO: 971345 - protein, 9 aa, Homo Sapiens
DPDTAIPAP

SEQ ID NO: 971346 - protein, 9 aa, Homo Sapiens
TMLPPTFNL

SEQ ID NO: 971347 - protein, 9 aa, Homo Sapiens
LLNQHQRTH

SEQ ID NO: 971348 - protein, 9 aa, Homo Sapiens
TSVTTNETG

SEQ ID NO: 971349 - protein, 9 aa, Homo Sapiens
SEEGFQPML

SEQ ID NO: 971350 - protein, 9 aa, Homo Sapiens
LRNYTRMKI

SEQ ID NO: 971351 - protein, 9 aa, Homo Sapiens
KENRDRNIM

SEQ ID NO: 971352 - protein, 9 aa, Homo Sapiens
TIGFGIGIF

SEQ ID NO: 971353 - protein, 9 aa, Homo Sapiens
VYTDDDLPK

SEQ ID NO: 971354 - protein, 9 aa, Homo Sapiens
RGGSSAQKA

SEQ ID NO: 971355 - protein, 9 aa, Homo Sapiens
KDEIGLDLE

SEQ ID NO: 971356 - protein, 9 aa, Homo Sapiens
LSITIRPPD

SEQ ID NO: 971357 - protein, 9 aa, Homo Sapiens
WCTTRAPCV

SEQ ID NO: 971358 - protein, 9 aa, Homo Sapiens
VQSPKPITV

SEQ ID NO: 971359 - protein, 9 aa, Homo Sapiens
AIRNVFFCV

SEQ ID NO: 971360 - protein, 9 aa, Homo Sapiens
NDMVQSNDL

SEQ ID NO: 971361 - protein, 9 aa, Homo Sapiens
TTTFPKNPV

SEQ ID NO: 971362 - protein, 9 aa, Homo Sapiens
PPPLIFFGV

SEQ ID NO: 971363 - protein, 9 aa, Homo Sapiens
EESYSNDQS

SEQ ID NO: 971364 - protein, 9 aa, Homo Sapiens
PVNWAAAGD

SEQ ID NO: 971365 - protein, 9 aa, Homo Sapiens
LEPLNSRSN

SEQ ID NO: 971366 - protein, 9 aa, Homo Sapiens
RPPCNQRGG

SEQ ID NO: 971367 - protein, 9 aa, Homo Sapiens
QDLVFGGDV

SEQ ID NO: 971368 - protein, 9 aa, Homo Sapiens
CDLRKVRPM

SEQ ID NO: 971369 - protein, 9 aa, Homo Sapiens
SALDTRKKA

SEQ ID NO: 971370 - protein, 9 aa, Homo Sapiens
VELEIEDKR

SEQ ID NO: 971371 - protein, 9 aa, Homo Sapiens
LKNNEKQII

SEQ ID NO: 971372 - protein, 9 aa, Homo Sapiens
HHQFLGDQE

SEQ ID NO: 971373 - protein, 9 aa, Homo Sapiens
RGVDEAPLS

SEQ ID NO: 971374 - protein, 9 aa, Homo Sapiens
QVEARSSSW

SEQ ID NO: 971375 - protein, 9 aa, Homo Sapiens
KILETEIES

SEQ ID NO: 971376 - protein, 9 aa, Homo Sapiens
LCKKSKPKK

SEQ ID NO: 971377 - protein, 9 aa, Homo Sapiens
GGQFLEVYV

SEQ ID NO: 971378 - protein, 9 aa, Homo Sapiens
KPAETVSSS

SEQ ID NO: 971379 - protein, 9 aa, Homo Sapiens
LTTTFFFSR

SEQ ID NO: 971380 - protein, 9 aa, Homo Sapiens
EKGSQDHSG

SEQ ID NO: 971381 - protein, 9 aa, Homo Sapiens
LRKVRPMKC

SEQ ID NO: 971382 - protein, 9 aa, Homo Sapiens
KYRIYTKVS

SEQ ID NO: 971383 - protein, 9 aa, Homo Sapiens
RMTIKTKKK

SEQ ID NO: 971384 - protein, 9 aa, Homo Sapiens
KVHVNLSQS

SEQ ID NO: 971385 - protein, 9 aa, Homo Sapiens
EDLGLPGSK

SEQ ID NO: 971386 - protein, 9 aa, Homo Sapiens
NIPREVSPL

SEQ ID NO: 971387 - protein, 9 aa, Homo Sapiens
EAGLRMLSK

SEQ ID NO: 971388 - protein, 9 aa, Homo Sapiens
RPHDIFCQR

SEQ ID NO: 971389 - protein, 9 aa, Homo Sapiens
SIFGKFSRN

SEQ ID NO: 971390 - protein, 9 aa, Homo Sapiens
SSVSTSQRT

SEQ ID NO: 971391 - protein, 9 aa, Homo Sapiens
ISPSHAWSG

SEQ ID NO: 971392 - protein, 9 aa, Homo Sapiens
LSKKDRETL

SEQ ID NO: 971393 - protein, 9 aa, Homo Sapiens
ICKLSGLMS

SEQ ID NO: 971394 - protein, 9 aa, Homo Sapiens
RTKGGNSVI

SEQ ID NO: 971395 - protein, 9 aa, Homo Sapiens
EILELAGNG

SEQ ID NO: 971396 - protein, 9 aa, Homo Sapiens
TSSRIGLLA

SEQ ID NO: 971397 - protein, 9 aa, Homo Sapiens
VCQFLLKSG

SEQ ID NO: 971398 - protein, 9 aa, Homo Sapiens
SEHSNGTVV

SEQ ID NO: 971399 - protein, 9 aa, Homo Sapiens
MRKAETEPH

SEQ ID NO: 971400 - protein, 9 aa, Homo Sapiens
LPFYQEIME

SEQ ID NO: 971401 - protein, 9 aa, Homo Sapiens
RGLVHPGHH

SEQ ID NO: 971402 - protein, 9 aa, Homo Sapiens
KPNQNILIQ

SEQ ID NO: 971403 - protein, 9 aa, Homo Sapiens
FSGLVQWAK

SEQ ID NO: 971404 - protein, 9 aa, Homo Sapiens
GLTARFQQS

SEQ ID NO: 971405 - protein, 9 aa, Homo Sapiens
LKFHSTIKV

SEQ ID NO: 971406 - protein, 9 aa, Homo Sapiens
TYSKRTLPY

SEQ ID NO: 971407 - protein, 9 aa, Homo Sapiens
RICSESANH

SEQ ID NO: 971408 - protein, 9 aa, Homo Sapiens
PMELYNLSS

SEQ ID NO: 971409 - protein, 9 aa, Homo Sapiens
LLTRKLYDQ

SEQ ID NO: 971410 - protein, 9 aa, Homo Sapiens
EAGLKAFRI

SEQ ID NO: 971411 - protein, 9 aa, Homo Sapiens
PQDSQDLVF

SEQ ID NO: 971412 - protein, 9 aa, Homo Sapiens
EKMKDTSCK

SEQ ID NO: 971413 - protein, 9 aa, Homo Sapiens
KVEKGCLGW

SEQ ID NO: 971414 - protein, 9 aa, Homo Sapiens
LCVFFVSHF

SEQ ID NO: 971415 - protein, 9 aa, Homo Sapiens
SFSKVIFNV

SEQ ID NO: 971416 - protein, 9 aa, Homo Sapiens
IPYLGMTNP

SEQ ID NO: 971417 - protein, 9 aa, Homo Sapiens
FLFPLFPGL

SEQ ID NO: 971418 - protein, 9 aa, Homo Sapiens
CCLWCCALR

SEQ ID NO: 971419 - protein, 9 aa, Homo Sapiens
TADTDPALR

SEQ ID NO: 971420 - protein, 9 aa, Homo Sapiens
SVQRDNFHW

SEQ ID NO: 971421 - protein, 9 aa, Homo Sapiens
TVETEDFSV

SEQ ID NO: 971422 - protein, 9 aa, Homo Sapiens
LMDQEDSES

SEQ ID NO: 971423 - protein, 9 aa, Homo Sapiens
QLEILPVPQ

SEQ ID NO: 971424 - protein, 9 aa, Homo Sapiens
DDAFCQGKD

SEQ ID NO: 971425 - protein, 9 aa, Homo Sapiens
DIVKMVSLA

SEQ ID NO: 971426 - protein, 9 aa, Homo Sapiens
MKFYEVITS

SEQ ID NO: 971427 - protein, 9 aa, Homo Sapiens
SDFLRSRFC

SEQ ID NO: 971428 - protein, 9 aa, Homo Sapiens
QHAALMAPS

SEQ ID NO: 971429 - protein, 9 aa, Homo Sapiens
CRVRDLDRV

SEQ ID NO: 971430 - protein, 9 aa, Homo Sapiens
KKKLEKHLE

SEQ ID NO: 971431 - protein, 9 aa, Homo Sapiens
NYRRFAATL

SEQ ID NO: 971432 - protein, 9 aa, Homo Sapiens
NYLIYLDPT

SEQ ID NO: 971433 - protein, 9 aa, Homo Sapiens
PHLPLKALR

SEQ ID NO: 971434 - protein, 9 aa, Homo Sapiens
RNLFKVELA

SEQ ID NO: 971435 - protein, 9 aa, Homo Sapiens
GPSPSTFHY

SEQ ID NO: 971436 - protein, 9 aa, Homo Sapiens
EYYEPRYVL

SEQ ID NO: 971437 - protein, 9 aa, Homo Sapiens
DKLLSKLKA

SEQ ID NO: 971438 - protein, 9 aa, Homo Sapiens
NIEGINREY

SEQ ID NO: 971439 - protein, 9 aa, Homo Sapiens
KTKTSPCDP

SEQ ID NO: 971440 - protein, 9 aa, Homo Sapiens
QTKVTWYKD

SEQ ID NO: 971441 - protein, 9 aa, Homo Sapiens
MLSKGLAWP

SEQ ID NO: 971442 - protein, 9 aa, Homo Sapiens
AISPSPPGP

SEQ ID NO: 971443 - protein, 9 aa, Homo Sapiens
QVQPCLLNK

SEQ ID NO: 971444 - protein, 9 aa, Homo Sapiens
CYTGPGSIV

SEQ ID NO: 971445 - protein, 9 aa, Homo Sapiens
LVATILLCK

SEQ ID NO: 971446 - protein, 9 aa, Homo Sapiens
HPLPPGTPM

SEQ ID NO: 971447 - protein, 9 aa, Homo Sapiens
CREDFVLSS

SEQ ID NO: 971448 - protein, 9 aa, Homo Sapiens
YRVSFSAAR

SEQ ID NO: 971449 - protein, 9 aa, Homo Sapiens
DNFHWEEYL

SEQ ID NO: 971450 - protein, 9 aa, Homo Sapiens
KKEIGKLEE

SEQ ID NO: 971451 - protein, 9 aa, Homo Sapiens
PSFGSGGGG

SEQ ID NO: 971452 - protein, 9 aa, Homo Sapiens
MKIFRNIFG

SEQ ID NO: 971453 - protein, 9 aa, Homo Sapiens
SILPDNLPE

SEQ ID NO: 971454 - protein, 9 aa, Homo Sapiens
FLLSKFGCC

SEQ ID NO: 971455 - protein, 9 aa, Homo Sapiens
VFNVLSSTS

SEQ ID NO: 971456 - protein, 9 aa, Homo Sapiens
VVPDSPASP

SEQ ID NO: 971457 - protein, 9 aa, Homo Sapiens
KKIVRNICT

SEQ ID NO: 971458 - protein, 9 aa, Homo Sapiens
LVTPRKDSQ

SEQ ID NO: 971459 - protein, 9 aa, Homo Sapiens
EPVNWAAAG

SEQ ID NO: 971460 - protein, 9 aa, Homo Sapiens
FDEAEVCKI

SEQ ID NO: 971461 - protein, 9 aa, Homo Sapiens
GDERPMGLK

SEQ ID NO: 971462 - protein, 9 aa, Homo Sapiens
REVSCVDGT

SEQ ID NO: 971463 - protein, 9 aa, Homo Sapiens
QCFTLKRYE

SEQ ID NO: 971464 - protein, 9 aa, Homo Sapiens
LHAERTQKD

SEQ ID NO: 971465 - protein, 9 aa, Homo Sapiens
AISGEGRKA

SEQ ID NO: 971466 - protein, 9 aa, Homo Sapiens
VEQEEEEEK

SEQ ID NO: 971467 - protein, 9 aa, Homo Sapiens
CNRGDPEHH

SEQ ID NO: 971468 - protein, 9 aa, Homo Sapiens
ICSRVSGWR

SEQ ID NO: 971469 - protein, 9 aa, Homo Sapiens
KKDRETLYP

SEQ ID NO: 971470 - protein, 9 aa, Homo Sapiens
NWSEQRVIF

SEQ ID NO: 971471 - protein, 9 aa, Homo Sapiens
LKVCIHPDG

SEQ ID NO: 971472 - protein, 9 aa, Homo Sapiens
IQIAMAIIR

SEQ ID NO: 971473 - protein, 9 aa, Homo Sapiens
DLKASKTGS

SEQ ID NO: 971474 - protein, 9 aa, Homo Sapiens
DLEKQIKLK

SEQ ID NO: 971475 - protein, 9 aa, Homo Sapiens
GGSYYRVSF

SEQ ID NO: 971476 - protein, 9 aa, Homo Sapiens
VVTLSEPVP

SEQ ID NO: 971477 - protein, 9 aa, Homo Sapiens
FSQLSIFGK

SEQ ID NO: 971478 - protein, 9 aa, Homo Sapiens
SMVCDEIIQ

SEQ ID NO: 971479 - protein, 9 aa, Homo Sapiens
LTCVMKGKD

SEQ ID NO: 971480 - protein, 9 aa, Homo Sapiens
GGAPVRTTK

SEQ ID NO: 971481 - protein, 9 aa, Homo Sapiens
TRAPCVHVR

SEQ ID NO: 971482 - protein, 9 aa, Homo Sapiens
PTKMDLLYS

SEQ ID NO: 971483 - protein, 9 aa, Homo Sapiens
SDHVKVGWR

SEQ ID NO: 971484 - protein, 9 aa, Homo Sapiens
AQTERTEPD

SEQ ID NO: 971485 - protein, 9 aa, Homo Sapiens
DDQDMIESL

SEQ ID NO: 971486 - protein, 9 aa, Homo Sapiens
NIKVSHTSY

SEQ ID NO: 971487 - protein, 9 aa, Homo Sapiens
RDWLRVISK

SEQ ID NO: 971488 - protein, 9 aa, Homo Sapiens
AVTKKTFSL

SEQ ID NO: 971489 - protein, 9 aa, Homo Sapiens
GQVTCVPRE

SEQ ID NO: 971490 - protein, 9 aa, Homo Sapiens
TGVRLAVTR

SEQ ID NO: 971491 - protein, 9 aa, Homo Sapiens
CSESANHRS

SEQ ID NO: 971492 - protein, 9 aa, Homo Sapiens
FFFSRYKSS

SEQ ID NO: 971493 - protein, 9 aa, Homo Sapiens
FSAMLLFVF

SEQ ID NO: 971494 - protein, 9 aa, Homo Sapiens
NGATFASLA

SEQ ID NO: 971495 - protein, 9 aa, Homo Sapiens
STSKEILRP

SEQ ID NO: 971496 - protein, 9 aa, Homo Sapiens
LIHSEIKPF

SEQ ID NO: 971497 - protein, 9 aa, Homo Sapiens
LVKQPPPPL

SEQ ID NO: 971498 - protein, 9 aa, Homo Sapiens
PDLIREGGS

SEQ ID NO: 971499 - protein, 9 aa, Homo Sapiens
ARLLGAHAA

SEQ ID NO: 971500 - protein, 9 aa, Homo Sapiens
QKSVFQMLQ

SEQ ID NO: 971501 - protein, 9 aa, Homo Sapiens
LPFLFPLFP

SEQ ID NO: 971502 - protein, 9 aa, Homo Sapiens
RRLSWFGIP

SEQ ID NO: 971503 - protein, 9 aa, Homo Sapiens
ASIAKDLAS

SEQ ID NO: 971504 - protein, 9 aa, Homo Sapiens
PTIEKKVML

SEQ ID NO: 971505 - protein, 9 aa, Homo Sapiens
LLACLQLAL

SEQ ID NO: 971506 - protein, 9 aa, Homo Sapiens
QIQMSPEPE

SEQ ID NO: 971507 - protein, 9 aa, Homo Sapiens
EDRDDLWDA

SEQ ID NO: 971508 - protein, 9 aa, Homo Sapiens
QKTSDPERG

SEQ ID NO: 971509 - protein, 9 aa, Homo Sapiens
AACVVFIKW

SEQ ID NO: 971510 - protein, 9 aa, Homo Sapiens
GHTRKHPRL

SEQ ID NO: 971511 - protein, 9 aa, Homo Sapiens
SAELLNKFW

SEQ ID NO: 971512 - protein, 9 aa, Homo Sapiens
KFDLVCGME

SEQ ID NO: 971513 - protein, 9 aa, Homo Sapiens
LKDKLEFQK

SEQ ID NO: 971514 - protein, 9 aa, Homo Sapiens
NKPLGLLPR

SEQ ID NO: 971515 - protein, 9 aa, Homo Sapiens
KAVACHRQG

SEQ ID NO: 971516 - protein, 9 aa, Homo Sapiens
SDPYGLNFS

SEQ ID NO: 971517 - protein, 9 aa, Homo Sapiens
TFEEGTLIE

SEQ ID NO: 971518 - protein, 9 aa, Homo Sapiens
DFFFLLSKF

SEQ ID NO: 971519 - protein, 9 aa, Homo Sapiens
SLDAYGVNP

SEQ ID NO: 971520 - protein, 9 aa, Homo Sapiens
PGHHHLEIE

SEQ ID NO: 971521 - protein, 9 aa, Homo Sapiens
EFLVFPTAL

SEQ ID NO: 971522 - protein, 9 aa, Homo Sapiens
KATMIRAMP

SEQ ID NO: 971523 - protein, 9 aa, Homo Sapiens
GFGIGIFGV

SEQ ID NO: 971524 - protein, 9 aa, Homo Sapiens
EDFFQGRQK

SEQ ID NO: 971525 - protein, 9 aa, Homo Sapiens
RKVRPMKCN

SEQ ID NO: 971526 - protein, 9 aa, Homo Sapiens
YNYTLCWNG

SEQ ID NO: 971527 - protein, 9 aa, Homo Sapiens
DAGSRTCLP

SEQ ID NO: 971528 - protein, 9 aa, Homo Sapiens
SSRTRLPPT

SEQ ID NO: 971529 - protein, 9 aa, Homo Sapiens
IIVDHQNDP

SEQ ID NO: 971530 - protein, 9 aa, Homo Sapiens
KVDESRREM

SEQ ID NO: 971531 - protein, 9 aa, Homo Sapiens
RLEKARLVL

SEQ ID NO: 971532 - protein, 9 aa, Homo Sapiens
YGCWMTFFP

SEQ ID NO: 971533 - protein, 9 aa, Homo Sapiens
WEWQKAHEP

SEQ ID NO: 971534 - protein, 9 aa, Homo Sapiens
LCLLSFPFA

SEQ ID NO: 971535 - protein, 9 aa, Homo Sapiens
SVLEESESF

SEQ ID NO: 971536 - protein, 9 aa, Homo Sapiens
VFKRFLTID

SEQ ID NO: 971537 - protein, 9 aa, Homo Sapiens
LNGLLRKIE

SEQ ID NO: 971538 - protein, 9 aa, Homo Sapiens
HSMVCDEII

SEQ ID NO: 971539 - protein, 9 aa, Homo Sapiens
ATSEPPIKP

SEQ ID NO: 971540 - protein, 9 aa, Homo Sapiens
RMQSLVDVI

SEQ ID NO: 971541 - protein, 9 aa, Homo Sapiens
PTNVSTTVS

SEQ ID NO: 971542 - protein, 9 aa, Homo Sapiens
VMRTGISAG

SEQ ID NO: 971543 - protein, 9 aa, Homo Sapiens
QVSRVFWED

SEQ ID NO: 971544 - protein, 9 aa, Homo Sapiens
TGVELEIED

SEQ ID NO: 971545 - protein, 9 aa, Homo Sapiens
SHVECRPYS

SEQ ID NO: 971546 - protein, 9 aa, Homo Sapiens
CHNKCTKDA

SEQ ID NO: 971547 - protein, 9 aa, Homo Sapiens
CDDDSDEKN

SEQ ID NO: 971548 - protein, 9 aa, Homo Sapiens
TSDPYGLNF

SEQ ID NO: 971549 - protein, 9 aa, Homo Sapiens
NDIILAVLV

SEQ ID NO: 971550 - protein, 9 aa, Homo Sapiens
FERETQREK

SEQ ID NO: 971551 - protein, 9 aa, Homo Sapiens
RKLFTAAEF

SEQ ID NO: 971552 - protein, 9 aa, Homo Sapiens
KMMKRALQY

SEQ ID NO: 971553 - protein, 9 aa, Homo Sapiens
FSRRIGFYF

SEQ ID NO: 971554 - protein, 9 aa, Homo Sapiens
KCCQDQEQE

SEQ ID NO: 971555 - protein, 9 aa, Homo Sapiens
ADSLSNMVL

SEQ ID NO: 971556 - protein, 9 aa, Homo Sapiens
SIFSMMRKK

SEQ ID NO: 971557 - protein, 9 aa, Homo Sapiens
LKAWKHSVG

SEQ ID NO: 971558 - protein, 9 aa, Homo Sapiens
AFTFAASAT

SEQ ID NO: 971559 - protein, 9 aa, Homo Sapiens
LNDKKDLGS

SEQ ID NO: 971560 - protein, 9 aa, Homo Sapiens
FFSRYKSSD

SEQ ID NO: 971561 - protein, 9 aa, Homo Sapiens
VTAQFPRAC

SEQ ID NO: 971562 - protein, 9 aa, Homo Sapiens
SWFGIPKPV

SEQ ID NO: 971563 - protein, 9 aa, Homo Sapiens
ANMKAVPAA

SEQ ID NO: 971564 - protein, 9 aa, Homo Sapiens
DLLYSKTAK

SEQ ID NO: 971565 - protein, 9 aa, Homo Sapiens
TSIIGEVWP

SEQ ID NO: 971566 - protein, 9 aa, Homo Sapiens
AGLTARFQQ

SEQ ID NO: 971567 - protein, 9 aa, Homo Sapiens
EAFSCGESS

SEQ ID NO: 971568 - protein, 9 aa, Homo Sapiens
QGRWEFLPK

SEQ ID NO: 971569 - protein, 9 aa, Homo Sapiens
QQIRMNLSG

SEQ ID NO: 971570 - protein, 9 aa, Homo Sapiens
HLGASSSEL

SEQ ID NO: 971571 - protein, 9 aa, Homo Sapiens
PINADSSSL

SEQ ID NO: 971572 - protein, 9 aa, Homo Sapiens
HSKFPAERD

SEQ ID NO: 971573 - protein, 9 aa, Homo Sapiens
EPLDGPARE

SEQ ID NO: 971574 - protein, 9 aa, Homo Sapiens
DILDTAGKE

SEQ ID NO: 971575 - protein, 9 aa, Homo Sapiens
AAVTGFSVE

SEQ ID NO: 971576 - protein, 9 aa, Homo Sapiens
GSVSDSVFD

SEQ ID NO: 971577 - protein, 9 aa, Homo Sapiens
RLTLTEKAE

SEQ ID NO: 971578 - protein, 9 aa, Homo Sapiens
ETSHTGEKP

SEQ ID NO: 971579 - protein, 9 aa, Homo Sapiens
GEGAEANPL

SEQ ID NO: 971580 - protein, 9 aa, Homo Sapiens
AVPPTSSVS

SEQ ID NO: 971581 - protein, 9 aa, Homo Sapiens
NRSFVKTPK

SEQ ID NO: 971582 - protein, 9 aa, Homo Sapiens
GGTAPSALS

SEQ ID NO: 971583 - protein, 9 aa, Homo Sapiens
SKGLAWPQC

SEQ ID NO: 971584 - protein, 9 aa, Homo Sapiens
FQRDFFFLL

SEQ ID NO: 971585 - protein, 9 aa, Homo Sapiens
KSINHMNYL

SEQ ID NO: 971586 - protein, 9 aa, Homo Sapiens
YLSSSLPSS

SEQ ID NO: 971587 - protein, 9 aa, Homo Sapiens
AQGLAGELL

SEQ ID NO: 971588 - protein, 9 aa, Homo Sapiens
HAERTQKDK

SEQ ID NO: 971589 - protein, 9 aa, Homo Sapiens
FAVVMRTGI

SEQ ID NO: 971590 - protein, 9 aa, Homo Sapiens
PFTLKIFKD

SEQ ID NO: 971591 - protein, 9 aa, Homo Sapiens
GFVLLSYIQ

SEQ ID NO: 971592 - protein, 9 aa, Homo Sapiens
LNLDSQRMP

SEQ ID NO: 971593 - protein, 9 aa, Homo Sapiens
DPNKPTGCE

SEQ ID NO: 971594 - protein, 9 aa, Homo Sapiens
TQRDLEAFL

SEQ ID NO: 971595 - protein, 9 aa, Homo Sapiens
ALEAKAVAC

SEQ ID NO: 971596 - protein, 9 aa, Homo Sapiens
RAMPANGAL

SEQ ID NO: 971597 - protein, 9 aa, Homo Sapiens
QNNLHYLND

SEQ ID NO: 971598 - protein, 9 aa, Homo Sapiens
LRGHHVFCQ

SEQ ID NO: 971599 - protein, 9 aa, Homo Sapiens
KNCFQFQYN

SEQ ID NO: 971600 - protein, 9 aa, Homo Sapiens
PLEKFSLKP

SEQ ID NO: 971601 - protein, 9 aa, Homo Sapiens
FSSPFYPRN

SEQ ID NO: 971602 - protein, 9 aa, Homo Sapiens
ISGLRGLFW

SEQ ID NO: 971603 - protein, 9 aa, Homo Sapiens
LLFPILHRG

SEQ ID NO: 971604 - protein, 9 aa, Homo Sapiens
RQDLEACCQ

SEQ ID NO: 971605 - protein, 9 aa, Homo Sapiens
RSRVNTTGI

SEQ ID NO: 971606 - protein, 9 aa, Homo Sapiens
VYLPFYQEI

SEQ ID NO: 971607 - protein, 9 aa, Homo Sapiens
QLTLPQRFH

SEQ ID NO: 971608 - protein, 9 aa, Homo Sapiens
KDSQLMTFN

SEQ ID NO: 971609 - protein, 9 aa, Homo Sapiens
IIIYAGLRS

SEQ ID NO: 971610 - protein, 9 aa, Homo Sapiens
GLIRMIEEF

SEQ ID NO: 971611 - protein, 9 aa, Homo Sapiens
LQQQRSASF

SEQ ID NO: 971612 - protein, 9 aa, Homo Sapiens
SSYHRLLTC

SEQ ID NO: 971613 - protein, 9 aa, Homo Sapiens
FAALSLGPP

SEQ ID NO: 971614 - protein, 9 aa, Homo Sapiens
LSSPDGVYT

SEQ ID NO: 971615 - protein, 9 aa, Homo Sapiens
KTGSLLFVK

SEQ ID NO: 971616 - protein, 9 aa, Homo Sapiens
SNVDAEERK

SEQ ID NO: 971617 - protein, 9 aa, Homo Sapiens
VESPRFPYG

SEQ ID NO: 971618 - protein, 9 aa, Homo Sapiens
MRKKDLCRK

SEQ ID NO: 971619 - protein, 9 aa, Homo Sapiens
MLRFLRSLV

SEQ ID NO: 971620 - protein, 9 aa, Homo Sapiens
KVNKKIVRN

SEQ ID NO: 971621 - protein, 9 aa, Homo Sapiens
GLVGANGSP

SEQ ID NO: 971622 - protein, 9 aa, Homo Sapiens
PPPERGVRD

SEQ ID NO: 971623 - protein, 9 aa, Homo Sapiens
ISLLNIMMD

SEQ ID NO: 971624 - protein, 9 aa, Homo Sapiens
LDILDTAGK

SEQ ID NO: 971625 - protein, 9 aa, Homo Sapiens
VQPCLLNKN

SEQ ID NO: 971626 - protein, 9 aa, Homo Sapiens
SGNYPLCIG

SEQ ID NO: 971627 - protein, 9 aa, Homo Sapiens
LQESSRRAE

SEQ ID NO: 971628 - protein, 9 aa, Homo Sapiens
LNGLEFGNG

SEQ ID NO: 971629 - protein, 9 aa, Homo Sapiens
RMFSKDMPY

SEQ ID NO: 971630 - protein, 9 aa, Homo Sapiens
VAQLYFFYF

SEQ ID NO: 971631 - protein, 9 aa, Homo Sapiens
TKSVPLVCK

SEQ ID NO: 971632 - protein, 9 aa, Homo Sapiens
ESKHLSEPP

SEQ ID NO: 971633 - protein, 9 aa, Homo Sapiens
YLYQSPTDF

SEQ ID NO: 971634 - protein, 9 aa, Homo Sapiens
IGFGIGIFG

SEQ ID NO: 971635 - protein, 9 aa, Homo Sapiens
HCSAPENPI

SEQ ID NO: 971636 - protein, 9 aa, Homo Sapiens
CLLNKNCFQ

SEQ ID NO: 971637 - protein, 9 aa, Homo Sapiens
PCPICKKEF

SEQ ID NO: 971638 - protein, 9 aa, Homo Sapiens
QSKERKHLL

SEQ ID NO: 971639 - protein, 9 aa, Homo Sapiens
DKDFINTAN

SEQ ID NO: 971640 - protein, 9 aa, Homo Sapiens
LPKDYMIPL

SEQ ID NO: 971641 - protein, 9 aa, Homo Sapiens
IFDRVDPCQ

SEQ ID NO: 971642 - protein, 9 aa, Homo Sapiens
YSCVLGLIS

SEQ ID NO: 971643 - protein, 9 aa, Homo Sapiens
TTLGALTFD

SEQ ID NO: 971644 - protein, 9 aa, Homo Sapiens
QEKIWVEEK

SEQ ID NO: 971645 - protein, 9 aa, Homo Sapiens
ASARLLGAH

SEQ ID NO: 971646 - protein, 9 aa, Homo Sapiens
DKETLEEVI

SEQ ID NO: 971647 - protein, 9 aa, Homo Sapiens
LKEHYEKNM

SEQ ID NO: 971648 - protein, 9 aa, Homo Sapiens
LELAGNGSR

SEQ ID NO: 971649 - protein, 9 aa, Homo Sapiens
AQVGADAAI

SEQ ID NO: 971650 - protein, 9 aa, Homo Sapiens
ISKVQKDVF

SEQ ID NO: 971651 - protein, 9 aa, Homo Sapiens
NHNLKQVEY

SEQ ID NO: 971652 - protein, 9 aa, Homo Sapiens
NETGGENMT

SEQ ID NO: 971653 - protein, 9 aa, Homo Sapiens
DRDPKVFRC

SEQ ID NO: 971654 - protein, 9 aa, Homo Sapiens
LTAYTAIPE

SEQ ID NO: 971655 - protein, 9 aa, Homo Sapiens
SKRGGSSAQ

SEQ ID NO: 971656 - protein, 9 aa, Homo Sapiens
LIMRNLGQA

SEQ ID NO: 971657 - protein, 9 aa, Homo Sapiens
MNSVRSGPF

SEQ ID NO: 971658 - protein, 9 aa, Homo Sapiens
FWTLAGEST

SEQ ID NO: 971659 - protein, 9 aa, Homo Sapiens
IPKPNQNIL

SEQ ID NO: 971660 - protein, 9 aa, Homo Sapiens
LNKFWNKEF

SEQ ID NO: 971661 - protein, 9 aa, Homo Sapiens
TAPKTQRLR

SEQ ID NO: 971662 - protein, 9 aa, Homo Sapiens
GQKFGSHPG

SEQ ID NO: 971663 - protein, 9 aa, Homo Sapiens
KNSSYQTGC

SEQ ID NO: 971664 - protein, 9 aa, Homo Sapiens
DSVRRNIKK

SEQ ID NO: 971665 - protein, 9 aa, Homo Sapiens
NLLQPPVPR

SEQ ID NO: 971666 - protein, 9 aa, Homo Sapiens
DKDRNLRPW

SEQ ID NO: 971667 - protein, 9 aa, Homo Sapiens
KEEQGFDFF

SEQ ID NO: 971668 - protein, 9 aa, Homo Sapiens
SDSKTKCTA

SEQ ID NO: 971669 - protein, 9 aa, Homo Sapiens
VDPCQACSL

SEQ ID NO: 971670 - protein, 9 aa, Homo Sapiens
EFGNGDEEA

SEQ ID NO: 971671 - protein, 9 aa, Homo Sapiens
LLKEFEHHL

SEQ ID NO: 971672 - protein, 9 aa, Homo Sapiens
FRLHHSASN

SEQ ID NO: 971673 - protein, 9 aa, Homo Sapiens
VCTVRRLDR

SEQ ID NO: 971674 - protein, 9 aa, Homo Sapiens
KPGMGKPEL

SEQ ID NO: 971675 - protein, 9 aa, Homo Sapiens
SRLFKSVFV

SEQ ID NO: 971676 - protein, 9 aa, Homo Sapiens
GRIPYLGMT

SEQ ID NO: 971677 - protein, 9 aa, Homo Sapiens
YTTLFQTTS

SEQ ID NO: 971678 - protein, 9 aa, Homo Sapiens
GLSSSRTRT

SEQ ID NO: 971679 - protein, 9 aa, Homo Sapiens
ENDKIRLEK

SEQ ID NO: 971680 - protein, 9 aa, Homo Sapiens
MESGLQIQM

SEQ ID NO: 971681 - protein, 9 aa, Homo Sapiens
GDWLDSIRI

SEQ ID NO: 971682 - protein, 9 aa, Homo Sapiens
TQTVRIIKA

SEQ ID NO: 971683 - protein, 9 aa, Homo Sapiens
SRTRTSSTE

SEQ ID NO: 971684 - protein, 9 aa, Homo Sapiens
SSHLLLTLC

SEQ ID NO: 971685 - protein, 9 aa, Homo Sapiens
SSQYSAGNF

SEQ ID NO: 971686 - protein, 9 aa, Homo Sapiens
FQRSQTDER

SEQ ID NO: 971687 - protein, 9 aa, Homo Sapiens
SRSPMPEKS

SEQ ID NO: 971688 - protein, 9 aa, Homo Sapiens
NPNEELSKD

SEQ ID NO: 971689 - protein, 9 aa, Homo Sapiens
SCQVVSGVF

SEQ ID NO: 971690 - protein, 9 aa, Homo Sapiens
LGPLDRKAI

SEQ ID NO: 971691 - protein, 9 aa, Homo Sapiens
SIVRAFFGS

SEQ ID NO: 971692 - protein, 9 aa, Homo Sapiens
PNQYSVHQT

SEQ ID NO: 971693 - protein, 9 aa, Homo Sapiens
QAPVSKSAL

SEQ ID NO: 971694 - protein, 9 aa, Homo Sapiens
ITMGPKDHM

SEQ ID NO: 971695 - protein, 9 aa, Homo Sapiens
ISYSRCMIQ

SEQ ID NO: 971696 - protein, 9 aa, Homo Sapiens
LSQSLLTLE

SEQ ID NO: 971697 - protein, 9 aa, Homo Sapiens
QTYVEYAIS

SEQ ID NO: 971698 - protein, 9 aa, Homo Sapiens
NGNAIFLTI

SEQ ID NO: 971699 - protein, 9 aa, Homo Sapiens
YEDLRDGYN

SEQ ID NO: 971700 - protein, 9 aa, Homo Sapiens
RTYAFREKH

SEQ ID NO: 971701 - protein, 9 aa, Homo Sapiens
HQRCPREGH

SEQ ID NO: 971702 - protein, 9 aa, Homo Sapiens
LGQVTCVPR

SEQ ID NO: 971703 - protein, 9 aa, Homo Sapiens
PGTEKGSQD

SEQ ID NO: 971704 - protein, 9 aa, Homo Sapiens
RKKAEPTFG

SEQ ID NO: 971705 - protein, 9 aa, Homo Sapiens
FSFCLKREG

SEQ ID NO: 971706 - protein, 9 aa, Homo Sapiens
KSDSLPFFR

SEQ ID NO: 971707 - protein, 9 aa, Homo Sapiens
LWVLAALLT

SEQ ID NO: 971708 - protein, 9 aa, Homo Sapiens
WMAGFLIAL

SEQ ID NO: 971709 - protein, 9 aa, Homo Sapiens
SRIPNRYLG

SEQ ID NO: 971710 - protein, 9 aa, Homo Sapiens
IEMHLTESF

SEQ ID NO: 971711 - protein, 9 aa, Homo Sapiens
LVRGATLLG

SEQ ID NO: 971712 - protein, 9 aa, Homo Sapiens
LEEAGPSPS

SEQ ID NO: 971713 - protein, 9 aa, Homo Sapiens
MQMKLSQDF

SEQ ID NO: 971714 - protein, 9 aa, Homo Sapiens
KEVCPILSC

SEQ ID NO: 971715 - protein, 9 aa, Homo Sapiens
QAQMTKQQE

SEQ ID NO: 971716 - protein, 9 aa, Homo Sapiens
FDDHDFVDK

SEQ ID NO: 971717 - protein, 9 aa, Homo Sapiens
SLVDVIRSP

SEQ ID NO: 971718 - protein, 9 aa, Homo Sapiens
SDLDEGLNE

SEQ ID NO: 971719 - protein, 9 aa, Homo Sapiens
IFFGVPIPS

SEQ ID NO: 971720 - protein, 9 aa, Homo Sapiens
LTFVILAIS

SEQ ID NO: 971721 - protein, 9 aa, Homo Sapiens
KRKNVGDLM

SEQ ID NO: 971722 - protein, 9 aa, Homo Sapiens
PCETTDKCK

SEQ ID NO: 971723 - protein, 9 aa, Homo Sapiens
LSAGIVAVL

SEQ ID NO: 971724 - protein, 9 aa, Homo Sapiens
DELKSKKKS

SEQ ID NO: 971725 - protein, 9 aa, Homo Sapiens
PGFSNSTSS

SEQ ID NO: 971726 - protein, 9 aa, Homo Sapiens
LSASLHGGN

SEQ ID NO: 971727 - protein, 9 aa, Homo Sapiens
KDKDNFSPG

SEQ ID NO: 971728 - protein, 9 aa, Homo Sapiens
GEEARRKMR

SEQ ID NO: 971729 - protein, 9 aa, Homo Sapiens
PDSRKFGCA

SEQ ID NO: 971730 - protein, 9 aa, Homo Sapiens
TFDDHDFVD

SEQ ID NO: 971731 - protein, 9 aa, Homo Sapiens
KKLSLENKL

SEQ ID NO: 971732 - protein, 9 aa, Homo Sapiens
ITVIENLLI

SEQ ID NO: 971733 - protein, 9 aa, Homo Sapiens
SGSDCGHMF

SEQ ID NO: 971734 - protein, 9 aa, Homo Sapiens
TFFSRRILT

SEQ ID NO: 971735 - protein, 9 aa, Homo Sapiens
IRMIEEFRE

SEQ ID NO: 971736 - protein, 9 aa, Homo Sapiens
NGLLRKIEA

SEQ ID NO: 971737 - protein, 9 aa, Homo Sapiens
FCPSTSLLY

SEQ ID NO: 971738 - protein, 9 aa, Homo Sapiens
EKQIKLKEV

SEQ ID NO: 971739 - protein, 9 aa, Homo Sapiens
SSLFLVEIY

SEQ ID NO: 971740 - protein, 9 aa, Homo Sapiens
FGLLSPRVN

SEQ ID NO: 971741 - protein, 9 aa, Homo Sapiens
AMVTSIEMH

SEQ ID NO: 971742 - protein, 9 aa, Homo Sapiens
NISIQSKCR

SEQ ID NO: 971743 - protein, 9 aa, Homo Sapiens
QVSYKEGDL

SEQ ID NO: 971744 - protein, 9 aa, Homo Sapiens
GTRRSGSRG

SEQ ID NO: 971745 - protein, 9 aa, Homo Sapiens
GPPGRKGQP

SEQ ID NO: 971746 - protein, 9 aa, Homo Sapiens
ALCDTHQPP

SEQ ID NO: 971747 - protein, 9 aa, Homo Sapiens
RANFNKTNE

SEQ ID NO: 971748 - protein, 9 aa, Homo Sapiens
EAETHYEEQ

SEQ ID NO: 971749 - protein, 9 aa, Homo Sapiens
DSPLNDMVQ

SEQ ID NO: 971750 - protein, 9 aa, Homo Sapiens
MLSHVHIES

SEQ ID NO: 971751 - protein, 9 aa, Homo Sapiens
PILHRGLVH

SEQ ID NO: 971752 - protein, 9 aa, Homo Sapiens
AEMSFYHHG

SEQ ID NO: 971753 - protein, 9 aa, Homo Sapiens
ERKVVVEEE

SEQ ID NO: 971754 - protein, 9 aa, Homo Sapiens
NSMEFLSSR

SEQ ID NO: 971755 - protein, 9 aa, Homo Sapiens
DDRGSDHVK

SEQ ID NO: 971756 - protein, 9 aa, Homo Sapiens
VQIKKEKDQ

SEQ ID NO: 971757 - protein, 9 aa, Homo Sapiens
PNGTVESPR

SEQ ID NO: 971758 - protein, 9 aa, Homo Sapiens
MTKLTRGGL

SEQ ID NO: 971759 - protein, 9 aa, Homo Sapiens
SCEVHERIH

SEQ ID NO: 971760 - protein, 9 aa, Homo Sapiens
SQPLLELIR

SEQ ID NO: 971761 - protein, 9 aa, Homo Sapiens
SQHLNGQFK

SEQ ID NO: 971762 - protein, 9 aa, Homo Sapiens
HPPRGPLNL

SEQ ID NO: 971763 - protein, 9 aa, Homo Sapiens
DSEFIDSLM

SEQ ID NO: 971764 - protein, 9 aa, Homo Sapiens
QNDNAKLTA

SEQ ID NO: 971765 - protein, 9 aa, Homo Sapiens
FNVKDANAY

SEQ ID NO: 971766 - protein, 9 aa, Homo Sapiens
KPELHGQPG

SEQ ID NO: 971767 - protein, 9 aa, Homo Sapiens
APLSPTIEK

SEQ ID NO: 971768 - protein, 9 aa, Homo Sapiens
RRATGVRLA

SEQ ID NO: 971769 - protein, 9 aa, Homo Sapiens
AAKDLGQLF

SEQ ID NO: 971770 - protein, 9 aa, Homo Sapiens
RAPCVHVRV

SEQ ID NO: 971771 - protein, 9 aa, Homo Sapiens
PPGAVKRTG

SEQ ID NO: 971772 - protein, 9 aa, Homo Sapiens
KIAIRNVFF

SEQ ID NO: 971773 - protein, 9 aa, Homo Sapiens
CGVYTPQRF

SEQ ID NO: 971774 - protein, 9 aa, Homo Sapiens
SNNSFSNLA

SEQ ID NO: 971775 - protein, 9 aa, Homo Sapiens
LELLSDEAV

SEQ ID NO: 971776 - protein, 9 aa, Homo Sapiens
GNKPLGLLP

SEQ ID NO: 971777 - protein, 9 aa, Homo Sapiens
SKVIFNVKD

SEQ ID NO: 971778 - protein, 9 aa, Homo Sapiens
HLLTYMTLM

SEQ ID NO: 971779 - protein, 9 aa, Homo Sapiens
AHCFLSAGI

SEQ ID NO: 971780 - protein, 9 aa, Homo Sapiens
APSIIFIDQ

SEQ ID NO: 971781 - protein, 9 aa, Homo Sapiens
VFHEKPPDP

SEQ ID NO: 971782 - protein, 9 aa, Homo Sapiens
HLERQDLEA

SEQ ID NO: 971783 - protein, 9 aa, Homo Sapiens
LKKCKLSNL

SEQ ID NO: 971784 - protein, 9 aa, Homo Sapiens
AQLLVIENK

SEQ ID NO: 971785 - protein, 9 aa, Homo Sapiens
CCQDQEQEV

SEQ ID NO: 971786 - protein, 9 aa, Homo Sapiens
QPVPESRIP

SEQ ID NO: 971787 - protein, 9 aa, Homo Sapiens
DKKDLGSKS

SEQ ID NO: 971788 - protein, 9 aa, Homo Sapiens
GPSANPPVP

SEQ ID NO: 971789 - protein, 9 aa, Homo Sapiens
RPKSSGMPS

SEQ ID NO: 971790 - protein, 9 aa, Homo Sapiens
IQFGEKMMK

SEQ ID NO: 971791 - protein, 9 aa, Homo Sapiens
GDPEHHVFL

SEQ ID NO: 971792 - protein, 9 aa, Homo Sapiens
YSALPPVSS

SEQ ID NO: 971793 - protein, 9 aa, Homo Sapiens
FGFVQTLKG

SEQ ID NO: 971794 - protein, 9 aa, Homo Sapiens
PARAARYHS

SEQ ID NO: 971795 - protein, 9 aa, Homo Sapiens
GPFGPPGPP

SEQ ID NO: 971796 - protein, 9 aa, Homo Sapiens
LRENPCFPL

SEQ ID NO: 971797 - protein, 9 aa, Homo Sapiens
ASKRGGSSA

SEQ ID NO: 971798 - protein, 9 aa, Homo Sapiens
PPKREARAQ

SEQ ID NO: 971799 - protein, 9 aa, Homo Sapiens
EDTRLYSCL

SEQ ID NO: 971800 - protein, 9 aa, Homo Sapiens
KQQRIKKEG

SEQ ID NO: 971801 - protein, 9 aa, Homo Sapiens
GGRERGQSK

SEQ ID NO: 971802 - protein, 9 aa, Homo Sapiens
APTQSSEFE

SEQ ID NO: 971803 - protein, 9 aa, Homo Sapiens
SDSSEELFD

SEQ ID NO: 971804 - protein, 9 aa, Homo Sapiens
SHVHIESWS

SEQ ID NO: 971805 - protein, 9 aa, Homo Sapiens
MSGAGMALA

SEQ ID NO: 971806 - protein, 9 aa, Homo Sapiens
SRETTKVKI

SEQ ID NO: 971807 - protein, 9 aa, Homo Sapiens
AVNDIILAV

SEQ ID NO: 971808 - protein, 9 aa, Homo Sapiens
TAGPASASM

SEQ ID NO: 971809 - protein, 9 aa, Homo Sapiens
RKVLLKLSR

SEQ ID NO: 971810 - protein, 9 aa, Homo Sapiens
MEESEIAKE

SEQ ID NO: 971811 - protein, 9 aa, Homo Sapiens
EDAGVEAFP

SEQ ID NO: 971812 - protein, 9 aa, Homo Sapiens
LLELIRLWI

SEQ ID NO: 971813 - protein, 9 aa, Homo Sapiens
TTKAERRHQ

SEQ ID NO: 971814 - protein, 9 aa, Homo Sapiens
QLRGTLYHP

SEQ ID NO: 971815 - protein, 9 aa, Homo Sapiens
RIAATLAGS

SEQ ID NO: 971816 - protein, 9 aa, Homo Sapiens
DEDSVVGES

SEQ ID NO: 971817 - protein, 9 aa, Homo Sapiens
KHPNSLTGK

SEQ ID NO: 971818 - protein, 9 aa, Homo Sapiens
VMLSHVHIE

SEQ ID NO: 971819 - protein, 9 aa, Homo Sapiens
SQESEEAGS

SEQ ID NO: 971820 - protein, 9 aa, Homo Sapiens
LRRHETSHT

SEQ ID NO: 971821 - protein, 9 aa, Homo Sapiens
DSKNEDLTK

SEQ ID NO: 971822 - protein, 9 aa, Homo Sapiens
TGGKYIRER

SEQ ID NO: 971823 - protein, 9 aa, Homo Sapiens
MDGKKNFTV

SEQ ID NO: 971824 - protein, 9 aa, Homo Sapiens
FENEKRATK

SEQ ID NO: 971825 - protein, 9 aa, Homo Sapiens
AAEMEHFLE

SEQ ID NO: 971826 - protein, 9 aa, Homo Sapiens
VVKNPTVLE

SEQ ID NO: 971827 - protein, 9 aa, Homo Sapiens
HSKQEGLIC

SEQ ID NO: 971828 - protein, 9 aa, Homo Sapiens
MSGFIYQEK

SEQ ID NO: 971829 - protein, 9 aa, Homo Sapiens
KLLDLETKN

SEQ ID NO: 971830 - protein, 9 aa, Homo Sapiens
KEKQDKKIL

SEQ ID NO: 971831 - protein, 9 aa, Homo Sapiens
STRLPHTTL

SEQ ID NO: 971832 - protein, 9 aa, Homo Sapiens
TVHYKGGAV

SEQ ID NO: 971833 - protein, 9 aa, Homo Sapiens
IALIPFWNK

SEQ ID NO: 971834 - protein, 9 aa, Homo Sapiens
PCSESQHLN

SEQ ID NO: 971835 - protein, 9 aa, Homo Sapiens
NFNKKCDTS

SEQ ID NO: 971836 - protein, 9 aa, Homo Sapiens
LFPLFPGLS

SEQ ID NO: 971837 - protein, 9 aa, Homo Sapiens
PMLTEENSR

SEQ ID NO: 971838 - protein, 9 aa, Homo Sapiens
RAGFLFFWY

SEQ ID NO: 971839 - protein, 9 aa, Homo Sapiens
RVDPCQACS

SEQ ID NO: 971840 - protein, 9 aa, Homo Sapiens
APRTSSSLD

SEQ ID NO: 971841 - protein, 9 aa, Homo Sapiens
EGEKKEEEE

SEQ ID NO: 971842 - protein, 9 aa, Homo Sapiens
RYASIAKDL

SEQ ID NO: 971843 - protein, 9 aa, Homo Sapiens
MFSESSTMD

SEQ ID NO: 971844 - protein, 9 aa, Homo Sapiens
QTPDPSRPY

SEQ ID NO: 971845 - protein, 9 aa, Homo Sapiens
QRDFFFLLS

SEQ ID NO: 971846 - protein, 9 aa, Homo Sapiens
GLFRAWVWA

SEQ ID NO: 971847 - protein, 9 aa, Homo Sapiens
IGKLEEFFQ

SEQ ID NO: 971848 - protein, 9 aa, Homo Sapiens
KYLKENRDR

SEQ ID NO: 971849 - protein, 9 aa, Homo Sapiens
GIVCTVRRL

SEQ ID NO: 971850 - protein, 9 aa, Homo Sapiens
GEGLNMFDV

SEQ ID NO: 971851 - protein, 9 aa, Homo Sapiens
DNYVGCAEE

SEQ ID NO: 971852 - protein, 9 aa, Homo Sapiens
MTSTSKEIL

SEQ ID NO: 971853 - protein, 9 aa, Homo Sapiens
PTYSKRTLP

SEQ ID NO: 971854 - protein, 9 aa, Homo Sapiens
GVGILRIPV

SEQ ID NO: 971855 - protein, 9 aa, Homo Sapiens
TATSEPPIK

SEQ ID NO: 971856 - protein, 9 aa, Homo Sapiens
SHRKAFTTC

SEQ ID NO: 971857 - protein, 9 aa, Homo Sapiens
SEEAGSTAP

SEQ ID NO: 971858 - protein, 9 aa, Homo Sapiens
WDLEQTMTK

SEQ ID NO: 971859 - protein, 9 aa, Homo Sapiens
SKCSDFLRS

SEQ ID NO: 971860 - protein, 9 aa, Homo Sapiens
ESLQDVPQR

SEQ ID NO: 971861 - protein, 9 aa, Homo Sapiens
HSYQLTLPQ

SEQ ID NO: 971862 - protein, 9 aa, Homo Sapiens
KKDLGSKSV

SEQ ID NO: 971863 - protein, 9 aa, Homo Sapiens
QVQIKKEKD

SEQ ID NO: 971864 - protein, 9 aa, Homo Sapiens
GFLEVKNAS

SEQ ID NO: 971865 - protein, 9 aa, Homo Sapiens
IRTKGGNSV

SEQ ID NO: 971866 - protein, 9 aa, Homo Sapiens
ESLHSKNSG

SEQ ID NO: 971867 - protein, 9 aa, Homo Sapiens
SGPAAAPSS

SEQ ID NO: 971868 - protein, 9 aa, Homo Sapiens
TQIRQNTRD

SEQ ID NO: 971869 - protein, 9 aa, Homo Sapiens
NPTAGVGQE

SEQ ID NO: 971870 - protein, 9 aa, Homo Sapiens
HVQKIISVI

SEQ ID NO: 971871 - protein, 9 aa, Homo Sapiens
SVVGESDRI

SEQ ID NO: 971872 - protein, 9 aa, Homo Sapiens
PLFLKAWKH

SEQ ID NO: 971873 - protein, 9 aa, Homo Sapiens
ADGFHQSGS

SEQ ID NO: 971874 - protein, 9 aa, Homo Sapiens
CGGDNTSCQ

SEQ ID NO: 971875 - protein, 9 aa, Homo Sapiens
LAISPSPPG

SEQ ID NO: 971876 - protein, 9 aa, Homo Sapiens
FIENKGTAL

SEQ ID NO: 971877 - protein, 9 aa, Homo Sapiens
REKHDNCTT

SEQ ID NO: 971878 - protein, 9 aa, Homo Sapiens
RTCLPAPIP

SEQ ID NO: 971879 - protein, 9 aa, Homo Sapiens
SMVSGLSSS

SEQ ID NO: 971880 - protein, 9 aa, Homo Sapiens
KTPPHELTE

SEQ ID NO: 971881 - protein, 9 aa, Homo Sapiens
SLGEGPSAN

SEQ ID NO: 971882 - protein, 9 aa, Homo Sapiens
NGSRDNKKT

SEQ ID NO: 971883 - protein, 9 aa, Homo Sapiens
IDKLKKCKL

SEQ ID NO: 971884 - protein, 9 aa, Homo Sapiens
TCLPAPIPP

SEQ ID NO: 971885 - protein, 9 aa, Homo Sapiens
VAICHLLTY

SEQ ID NO: 971886 - protein, 9 aa, Homo Sapiens
GPLDRKAID

SEQ ID NO: 971887 - protein, 9 aa, Homo Sapiens
LIIIWQNPF

SEQ ID NO: 971888 - protein, 9 aa, Homo Sapiens
PAAAPSSLL

SEQ ID NO: 971889 - protein, 9 aa, Homo Sapiens
YSLIMRNLG

SEQ ID NO: 971890 - protein, 9 aa, Homo Sapiens
GDFGSVTFD

SEQ ID NO: 971891 - protein, 9 aa, Homo Sapiens
KGKDIEDWS

SEQ ID NO: 971892 - protein, 9 aa, Homo Sapiens
AYCPASVVK

SEQ ID NO: 971893 - protein, 9 aa, Homo Sapiens
DPVCPPRSA

SEQ ID NO: 971894 - protein, 9 aa, Homo Sapiens
LDDIRQICL

SEQ ID NO: 971895 - protein, 9 aa, Homo Sapiens
QTDAADAIS

SEQ ID NO: 971896 - protein, 9 aa, Homo Sapiens
ADEPNVTSR

SEQ ID NO: 971897 - protein, 9 aa, Homo Sapiens
PRSSFTTDT

SEQ ID NO: 971898 - protein, 9 aa, Homo Sapiens
PHWRETLQV

SEQ ID NO: 971899 - protein, 9 aa, Homo Sapiens
VYEKRHQVS

SEQ ID NO: 971900 - protein, 9 aa, Homo Sapiens
AEANPLATS

SEQ ID NO: 971901 - protein, 9 aa, Homo Sapiens
DSIRIGRYR

SEQ ID NO: 971902 - protein, 9 aa, Homo Sapiens
NDKIRLEKD

SEQ ID NO: 971903 - protein, 9 aa, Homo Sapiens
EKDPVTKER

SEQ ID NO: 971904 - protein, 9 aa, Homo Sapiens
PAFAQTSYT

SEQ ID NO: 971905 - protein, 9 aa, Homo Sapiens
LFHSMVCDE

SEQ ID NO: 971906 - protein, 9 aa, Homo Sapiens
WVRVCAAGI

SEQ ID NO: 971907 - protein, 9 aa, Homo Sapiens
MLSITIRPP

SEQ ID NO: 971908 - protein, 9 aa, Homo Sapiens
NPLATSQGP

SEQ ID NO: 971909 - protein, 9 aa, Homo Sapiens
NYPFVSQGE

SEQ ID NO: 971910 - protein, 9 aa, Homo Sapiens
LESSREQKD

SEQ ID NO: 971911 - protein, 9 aa, Homo Sapiens
SYYRVSFSA

SEQ ID NO: 971912 - protein, 9 aa, Homo Sapiens
DTPNAKGKN

SEQ ID NO: 971913 - protein, 9 aa, Homo Sapiens
RPTRPKSSG

SEQ ID NO: 971914 - protein, 9 aa, Homo Sapiens
CELGGHTML

SEQ ID NO: 971915 - protein, 9 aa, Homo Sapiens
KIVRNICTT

SEQ ID NO: 971916 - protein, 9 aa, Homo Sapiens
SLEPLLPLP

SEQ ID NO: 971917 - protein, 9 aa, Homo Sapiens
TPKAKTPDW

SEQ ID NO: 971918 - protein, 9 aa, Homo Sapiens
QFGRTPTLP

SEQ ID NO: 971919 - protein, 9 aa, Homo Sapiens
VAFTCFLLG

SEQ ID NO: 971920 - protein, 9 aa, Homo Sapiens
HVEKDTDPN

SEQ ID NO: 971921 - protein, 9 aa, Homo Sapiens
GDEQQVESI

SEQ ID NO: 971922 - protein, 9 aa, Homo Sapiens
FKRFLCKKS

SEQ ID NO: 971923 - protein, 9 aa, Homo Sapiens
LHGGNLVVS

SEQ ID NO: 971924 - protein, 9 aa, Homo Sapiens
DPRQSRLFK

SEQ ID NO: 971925 - protein, 9 aa, Homo Sapiens
RIRSGNEPL

SEQ ID NO: 971926 - protein, 9 aa, Homo Sapiens
SSSELLPVI

SEQ ID NO: 971927 - protein, 9 aa, Homo Sapiens
ETSFTKKAY

SEQ ID NO: 971928 - protein, 9 aa, Homo Sapiens
KGKNWQMLA

SEQ ID NO: 971929 - protein, 9 aa, Homo Sapiens
PELFSSKTA

SEQ ID NO: 971930 - protein, 9 aa, Homo Sapiens
GPASASMPT

SEQ ID NO: 971931 - protein, 9 aa, Homo Sapiens
KSQAKTTTL

SEQ ID NO: 971932 - protein, 9 aa, Homo Sapiens
SPYSRSPVS

SEQ ID NO: 971933 - protein, 9 aa, Homo Sapiens
FRMFSKDMP

SEQ ID NO: 971934 - protein, 9 aa, Homo Sapiens
CSDFLRSRF

SEQ ID NO: 971935 - protein, 9 aa, Homo Sapiens
HVKAIDLSR

SEQ ID NO: 971936 - protein, 9 aa, Homo Sapiens
KKFLEEAEI

SEQ ID NO: 971937 - protein, 9 aa, Homo Sapiens
NTITYNACV

SEQ ID NO: 971938 - protein, 9 aa, Homo Sapiens
ALGQKFGSH

SEQ ID NO: 971939 - protein, 9 aa, Homo Sapiens
VLIQRSTHA

SEQ ID NO: 971940 - protein, 9 aa, Homo Sapiens
DVEEWGPFN

SEQ ID NO: 971941 - protein, 9 aa, Homo Sapiens
TLATAAVSA

SEQ ID NO: 971942 - protein, 9 aa, Homo Sapiens
NRPQVFLLA

SEQ ID NO: 971943 - protein, 9 aa, Homo Sapiens
HRLQHQHRG

SEQ ID NO: 971944 - protein, 9 aa, Homo Sapiens
NFWNIIYTD

SEQ ID NO: 971945 - protein, 9 aa, Homo Sapiens
KTRLENQSF

SEQ ID NO: 971946 - protein, 9 aa, Homo Sapiens
TIRIINLQI

SEQ ID NO: 971947 - protein, 9 aa, Homo Sapiens
AILVGGMFT

SEQ ID NO: 971948 - protein, 9 aa, Homo Sapiens
SEIAKEKLE

SEQ ID NO: 971949 - protein, 9 aa, Homo Sapiens
KEELTEALR

SEQ ID NO: 971950 - protein, 9 aa, Homo Sapiens
TALLGRSRQ

SEQ ID NO: 971951 - protein, 9 aa, Homo Sapiens
TVISGPGTE

SEQ ID NO: 971952 - protein, 9 aa, Homo Sapiens
AISPSRASG

SEQ ID NO: 971953 - protein, 9 aa, Homo Sapiens
FLIALIPFW

SEQ ID NO: 971954 - protein, 9 aa, Homo Sapiens
KEKDLKEEL

SEQ ID NO: 971955 - protein, 9 aa, Homo Sapiens
MNWDMLMEP

SEQ ID NO: 971956 - protein, 9 aa, Homo Sapiens
CKNNMFAQF

SEQ ID NO: 971957 - protein, 9 aa, Homo Sapiens
DFSLKNNEK

SEQ ID NO: 971958 - protein, 9 aa, Homo Sapiens
VHKKFDDDT

SEQ ID NO: 971959 - protein, 9 aa, Homo Sapiens
LASISEKVQ

SEQ ID NO: 971960 - protein, 9 aa, Homo Sapiens
TCCRPKTHI

SEQ ID NO: 971961 - protein, 9 aa, Homo Sapiens
LPPPHLSLH

SEQ ID NO: 971962 - protein, 9 aa, Homo Sapiens
KDRETLYPT

SEQ ID NO: 971963 - protein, 9 aa, Homo Sapiens
LRAAEMEHF

SEQ ID NO: 971964 - protein, 9 aa, Homo Sapiens
REKVIFLCQ

SEQ ID NO: 971965 - protein, 9 aa, Homo Sapiens
TIHWKGNFK

SEQ ID NO: 971966 - protein, 9 aa, Homo Sapiens
DIPNTDSGE

SEQ ID NO: 971967 - protein, 9 aa, Homo Sapiens
CVPLMPKLL

SEQ ID NO: 971968 - protein, 9 aa, Homo Sapiens
FIKSSLQVF

SEQ ID NO: 971969 - protein, 9 aa, Homo Sapiens
TFLDDIRQI

SEQ ID NO: 971970 - protein, 9 aa, Homo Sapiens
TLAGESTET

SEQ ID NO: 971971 - protein, 9 aa, Homo Sapiens
EKRHQVSVS

SEQ ID NO: 971972 - protein, 9 aa, Homo Sapiens
GMAHRMQKK

SEQ ID NO: 971973 - protein, 9 aa, Homo Sapiens
GIYYQLSSS

SEQ ID NO: 971974 - protein, 9 aa, Homo Sapiens
LAEKEDFDS

SEQ ID NO: 971975 - protein, 9 aa, Homo Sapiens
EKRLGFRRQ

SEQ ID NO: 971976 - protein, 9 aa, Homo Sapiens
FALQMYGCR

SEQ ID NO: 971977 - protein, 9 aa, Homo Sapiens
KEESCGSLS

SEQ ID NO: 971978 - protein, 9 aa, Homo Sapiens
IWCELGGHT

SEQ ID NO: 971979 - protein, 9 aa, Homo Sapiens
EQTEFIYDQ

SEQ ID NO: 971980 - protein, 9 aa, Homo Sapiens
FLLFPILHR

SEQ ID NO: 971981 - protein, 9 aa, Homo Sapiens
GNAIFLTIS

SEQ ID NO: 971982 - protein, 9 aa, Homo Sapiens
EKRVLLTGL

SEQ ID NO: 971983 - protein, 9 aa, Homo Sapiens
SFTSPHRPR

SEQ ID NO: 971984 - protein, 9 aa, Homo Sapiens
LEESESFIQ

SEQ ID NO: 971985 - protein, 9 aa, Homo Sapiens
TYNNEGGGE

SEQ ID NO: 971986 - protein, 9 aa, Homo Sapiens
DMIESLFYT

SEQ ID NO: 971987 - protein, 9 aa, Homo Sapiens
FGKEQSFTS

SEQ ID NO: 971988 - protein, 9 aa, Homo Sapiens
KAEKKRCEI

SEQ ID NO: 971989 - protein, 9 aa, Homo Sapiens
KKDLCRKII

SEQ ID NO: 971990 - protein, 9 aa, Homo Sapiens
QTSSPLCTS

SEQ ID NO: 971991 - protein, 9 aa, Homo Sapiens
FSVENPEQD

SEQ ID NO: 971992 - protein, 9 aa, Homo Sapiens
LGIPRLLDS

SEQ ID NO: 971993 - protein, 9 aa, Homo Sapiens
LSLLSHFAE

SEQ ID NO: 971994 - protein, 9 aa, Homo Sapiens
QAFALGQKF

SEQ ID NO: 971995 - protein, 9 aa, Homo Sapiens
LNVVKKVEK

SEQ ID NO: 971996 - protein, 9 aa, Homo Sapiens
YSNDQSPQI

SEQ ID NO: 971997 - protein, 9 aa, Homo Sapiens
SLVQLGVLR

SEQ ID NO: 971998 - protein, 9 aa, Homo Sapiens
VDRSQLRGT

SEQ ID NO: 971999 - protein, 9 aa, Homo Sapiens
RFMERYASI

SEQ ID NO: 972000 - protein, 9 aa, Homo Sapiens
GPNYGADAH

SEQ ID NO: 972001 - protein, 9 aa, Homo Sapiens
GHMFFWEKS

SEQ ID NO: 972002 - protein, 9 aa, Homo Sapiens
REGLDGSFP

SEQ ID NO: 972003 - protein, 9 aa, Homo Sapiens
PQYQLQSFK

SEQ ID NO: 972004 - protein, 9 aa, Homo Sapiens
SPAEQGPSG

SEQ ID NO: 972005 - protein, 9 aa, Homo Sapiens
KFWYNSTLT

SEQ ID NO: 972006 - protein, 9 aa, Homo Sapiens
TPVSGNGEF

SEQ ID NO: 972007 - protein, 9 aa, Homo Sapiens
LLAPSNCIS

SEQ ID NO: 972008 - protein, 9 aa, Homo Sapiens
GLTIEKFWR

SEQ ID NO: 972009 - protein, 9 aa, Homo Sapiens
VRKLFTAAE

SEQ ID NO: 972010 - protein, 9 aa, Homo Sapiens
KKAEPTFGG

SEQ ID NO: 972011 - protein, 9 aa, Homo Sapiens
LMEPPSSRE

SEQ ID NO: 972012 - protein, 9 aa, Homo Sapiens
REPVLSFQG

SEQ ID NO: 972013 - protein, 9 aa, Homo Sapiens
VEYAISQPL

SEQ ID NO: 972014 - protein, 9 aa, Homo Sapiens
PPCNQRGGA

SEQ ID NO: 972015 - protein, 9 aa, Homo Sapiens
RWNLVRKTL

SEQ ID NO: 972016 - protein, 9 aa, Homo Sapiens
MAFTFAASA

SEQ ID NO: 972017 - protein, 9 aa, Homo Sapiens
QKIRLPEQI

SEQ ID NO: 972018 - protein, 9 aa, Homo Sapiens
RVIMQKVEH

SEQ ID NO: 972019 - protein, 9 aa, Homo Sapiens
KVCNHYKYI

SEQ ID NO: 972020 - protein, 9 aa, Homo Sapiens
KLSQLHRLQ

SEQ ID NO: 972021 - protein, 9 aa, Homo Sapiens
KYSLIMRNL

SEQ ID NO: 972022 - protein, 9 aa, Homo Sapiens
FSLKNNEKQ

SEQ ID NO: 972023 - protein, 9 aa, Homo Sapiens
LPREDTVCS

SEQ ID NO: 972024 - protein, 9 aa, Homo Sapiens
QIRQNTRDH

SEQ ID NO: 972025 - protein, 9 aa, Homo Sapiens
NVFRHFYIM

SEQ ID NO: 972026 - protein, 9 aa, Homo Sapiens
TGPYQCKIR

SEQ ID NO: 972027 - protein, 9 aa, Homo Sapiens
CKLSGLMSK

SEQ ID NO: 972028 - protein, 9 aa, Homo Sapiens
LFSSKTAHV

SEQ ID NO: 972029 - protein, 9 aa, Homo Sapiens
SSRRAELPP

SEQ ID NO: 972030 - protein, 9 aa, Homo Sapiens
RNKANATRC

SEQ ID NO: 972031 - protein, 9 aa, Homo Sapiens
EAFPAGASA

SEQ ID NO: 972032 - protein, 9 aa, Homo Sapiens
KSYVLLTRK

SEQ ID NO: 972033 - protein, 9 aa, Homo Sapiens
TVTAQFPRA

SEQ ID NO: 972034 - protein, 9 aa, Homo Sapiens
YCYALLVPL

SEQ ID NO: 972035 - protein, 9 aa, Homo Sapiens
VQWAKFILF

SEQ ID NO: 972036 - protein, 9 aa, Homo Sapiens
LTIPFSVPN

SEQ ID NO: 972037 - protein, 9 aa, Homo Sapiens
TKIPYMAAC

SEQ ID NO: 972038 - protein, 9 aa, Homo Sapiens
DKGPPGRKG

SEQ ID NO: 972039 - protein, 9 aa, Homo Sapiens
RPQVFLLAS

SEQ ID NO: 972040 - protein, 9 aa, Homo Sapiens
LASMIYLTP

SEQ ID NO: 972041 - protein, 9 aa, Homo Sapiens
LQPVPESRI

SEQ ID NO: 972042 - protein, 9 aa, Homo Sapiens
MLIHSEIKP

SEQ ID NO: 972043 - protein, 9 aa, Homo Sapiens
GYSYKKDEI

SEQ ID NO: 972044 - protein, 9 aa, Homo Sapiens
TRLENQSFN

SEQ ID NO: 972045 - protein, 9 aa, Homo Sapiens
ALVAEQVSA

SEQ ID NO: 972046 - protein, 9 aa, Homo Sapiens
NLGPLDRKA

SEQ ID NO: 972047 - protein, 9 aa, Homo Sapiens
YNYPFVSQG

SEQ ID NO: 972048 - protein, 9 aa, Homo Sapiens
QQQRSASFL

SEQ ID NO: 972049 - protein, 9 aa, Homo Sapiens
MSRETTKVK

SEQ ID NO: 972050 - protein, 9 aa, Homo Sapiens
EQQVESITP

SEQ ID NO: 972051 - protein, 9 aa, Homo Sapiens
FMAETLVGT

SEQ ID NO: 972052 - protein, 9 aa, Homo Sapiens
ACAPECVES

SEQ ID NO: 972053 - protein, 9 aa, Homo Sapiens
APVSKSALI

SEQ ID NO: 972054 - protein, 9 aa, Homo Sapiens
VQKIISVIS

SEQ ID NO: 972055 - protein, 9 aa, Homo Sapiens
STSQRTCCR

SEQ ID NO: 972056 - protein, 9 aa, Homo Sapiens
KGYSYKKDE

SEQ ID NO: 972057 - protein, 9 aa, Homo Sapiens
NYAKLSAKH

SEQ ID NO: 972058 - protein, 9 aa, Homo Sapiens
DRFWDPGTA

SEQ ID NO: 972059 - protein, 9 aa, Homo Sapiens
GVDTTFMTL

SEQ ID NO: 972060 - protein, 9 aa, Homo Sapiens
EDKDFINTA

SEQ ID NO: 972061 - protein, 9 aa, Homo Sapiens
EQIEPSVSS

SEQ ID NO: 972062 - protein, 9 aa, Homo Sapiens
KKCLSQSEQ

SEQ ID NO: 972063 - protein, 9 aa, Homo Sapiens
ASGLLRANA

SEQ ID NO: 972064 - protein, 9 aa, Homo Sapiens
KVQLEILPV

SEQ ID NO: 972065 - protein, 9 aa, Homo Sapiens
GVRDLREPD

SEQ ID NO: 972066 - protein, 9 aa, Homo Sapiens
GHCYKFRIQ

SEQ ID NO: 972067 - protein, 9 aa, Homo Sapiens
LCLGLLCVF

SEQ ID NO: 972068 - protein, 9 aa, Homo Sapiens
SDEKNCGCK

SEQ ID NO: 972069 - protein, 9 aa, Homo Sapiens
TEFIYDQTF

SEQ ID NO: 972070 - protein, 9 aa, Homo Sapiens
GPSFILQVY

SEQ ID NO: 972071 - protein, 9 aa, Homo Sapiens
VFGSLLKEG

SEQ ID NO: 972072 - protein, 9 aa, Homo Sapiens
CLGLLCVFF

SEQ ID NO: 972073 - protein, 9 aa, Homo Sapiens
DRGSDHVKV

SEQ ID NO: 972074 - protein, 9 aa, Homo Sapiens
SKGCQLEKT

SEQ ID NO: 972075 - protein, 9 aa, Homo Sapiens
ERSLTTTFF

SEQ ID NO: 972076 - protein, 9 aa, Homo Sapiens
HGSVLIECP

SEQ ID NO: 972077 - protein, 9 aa, Homo Sapiens
RREAETHYE

SEQ ID NO: 972078 - protein, 9 aa, Homo Sapiens
PDTAIPAPT

SEQ ID NO: 972079 - protein, 9 aa, Homo Sapiens
GSSYHRLLT

SEQ ID NO: 972080 - protein, 9 aa, Homo Sapiens
RYFKCQAKY

SEQ ID NO: 972081 - protein, 9 aa, Homo Sapiens
RLLGAHAAA

SEQ ID NO: 972082 - protein, 9 aa, Homo Sapiens
KSVSCPRCV

SEQ ID NO: 972083 - protein, 9 aa, Homo Sapiens
HKEHTVIPH

SEQ ID NO: 972084 - protein, 9 aa, Homo Sapiens
KFWNKEFAY

SEQ ID NO: 972085 - protein, 9 aa, Homo Sapiens
EHSNGTVVP

SEQ ID NO: 972086 - protein, 9 aa, Homo Sapiens
FTAAEFLLP

SEQ ID NO: 972087 - protein, 9 aa, Homo Sapiens
TADSLSNMV

SEQ ID NO: 972088 - protein, 9 aa, Homo Sapiens
GKEEYSAMR

SEQ ID NO: 972089 - protein, 9 aa, Homo Sapiens
QWAKFILFS

SEQ ID NO: 972090 - protein, 9 aa, Homo Sapiens
PGMGKPELH

SEQ ID NO: 972091 - protein, 9 aa, Homo Sapiens
EAKRKFLEL

SEQ ID NO: 972092 - protein, 9 aa, Homo Sapiens
LRFLFGLLS

SEQ ID NO: 972093 - protein, 9 aa, Homo Sapiens
EFLSSRRGP

SEQ ID NO: 972094 - protein, 9 aa, Homo Sapiens
KTFFVNSAF

SEQ ID NO: 972095 - protein, 9 aa, Homo Sapiens
KDSPLNDMV

SEQ ID NO: 972096 - protein, 9 aa, Homo Sapiens
EGTTIYLPG

SEQ ID NO: 972097 - protein, 9 aa, Homo Sapiens
DTTFMTLQW

SEQ ID NO: 972098 - protein, 9 aa, Homo Sapiens
DLKQECRNG

SEQ ID NO: 972099 - protein, 9 aa, Homo Sapiens
TLALLYSET

SEQ ID NO: 972100 - protein, 9 aa, Homo Sapiens
LSENLLQPP

SEQ ID NO: 972101 - protein, 9 aa, Homo Sapiens
SLCSSAWFR

SEQ ID NO: 972102 - protein, 9 aa, Homo Sapiens
NSEQDIVKM

SEQ ID NO: 972103 - protein, 9 aa, Homo Sapiens
QYQLQSFKP

SEQ ID NO: 972104 - protein, 9 aa, Homo Sapiens
SEQAFFVRE

SEQ ID NO: 972105 - protein, 9 aa, Homo Sapiens
PFNLVYGAT

SEQ ID NO: 972106 - protein, 9 aa, Homo Sapiens
RAAEMEHFL

SEQ ID NO: 972107 - protein, 9 aa, Homo Sapiens
SFSYSLAER

SEQ ID NO: 972108 - protein, 9 aa, Homo Sapiens
LEKDPVTKE

SEQ ID NO: 972109 - protein, 9 aa, Homo Sapiens
EYPENLDSF

SEQ ID NO: 972110 - protein, 9 aa, Homo Sapiens
AEQGPSGAS

SEQ ID NO: 972111 - protein, 9 aa, Homo Sapiens
EVKNASLFL

SEQ ID NO: 972112 - protein, 9 aa, Homo Sapiens
NRERVPCIL

SEQ ID NO: 972113 - protein, 9 aa, Homo Sapiens
VSFECENGF

SEQ ID NO: 972114 - protein, 9 aa, Homo Sapiens
TSGIVCTVR

SEQ ID NO: 972115 - protein, 9 aa, Homo Sapiens
LRDFEPDAI

SEQ ID NO: 972116 - protein, 9 aa, Homo Sapiens
QHQHRGLRG

SEQ ID NO: 972117 - protein, 9 aa, Homo Sapiens
AGIKYSVFY

SEQ ID NO: 972118 - protein, 9 aa, Homo Sapiens
FWNIIYTDT

SEQ ID NO: 972119 - protein, 9 aa, Homo Sapiens
AFRICSESA

SEQ ID NO: 972120 - protein, 9 aa, Homo Sapiens
SGTDHVTVP

SEQ ID NO: 972121 - protein, 9 aa, Homo Sapiens
HIESWSLGM

SEQ ID NO: 972122 - protein, 9 aa, Homo Sapiens
ETTNKKIGI

SEQ ID NO: 972123 - protein, 9 aa, Homo Sapiens
FTRGWKLTF

SEQ ID NO: 972124 - protein, 9 aa, Homo Sapiens
TFDEAEVCK

SEQ ID NO: 972125 - protein, 9 aa, Homo Sapiens
YAFREKHDN

SEQ ID NO: 972126 - protein, 9 aa, Homo Sapiens
RNIKKVDRE

SEQ ID NO: 972127 - protein, 9 aa, Homo Sapiens
EELFDQDES

SEQ ID NO: 972128 - protein, 9 aa, Homo Sapiens
TVGLGRTKG

SEQ ID NO: 972129 - protein, 9 aa, Homo Sapiens
KVTRDQIKM

SEQ ID NO: 972130 - protein, 9 aa, Homo Sapiens
CTKDAPACR

SEQ ID NO: 972131 - protein, 9 aa, Homo Sapiens
YYRVSFSAA

SEQ ID NO: 972132 - protein, 9 aa, Homo Sapiens
KTGVELEIE

SEQ ID NO: 972133 - protein, 9 aa, Homo Sapiens
SPNGRLKLG

SEQ ID NO: 972134 - protein, 9 aa, Homo Sapiens
SAMTQLRVM

SEQ ID NO: 972135 - protein, 9 aa, Homo Sapiens
PGKHLVTKV

SEQ ID NO: 972136 - protein, 9 aa, Homo Sapiens
WRWNLVRKT

SEQ ID NO: 972137 - protein, 9 aa, Homo Sapiens
HHSASNTSD

SEQ ID NO: 972138 - protein, 9 aa, Homo Sapiens
LPHSHVEKD

SEQ ID NO: 972139 - protein, 9 aa, Homo Sapiens
QSEQTTTSP

SEQ ID NO: 972140 - protein, 9 aa, Homo Sapiens
TCVPREVSC

SEQ ID NO: 972141 - protein, 9 aa, Homo Sapiens
NQYSVHQTS

SEQ ID NO: 972142 - protein, 9 aa, Homo Sapiens
LENQSFNSS

SEQ ID NO: 972143 - protein, 9 aa, Homo Sapiens
RMKFIKYLK

SEQ ID NO: 972144 - protein, 9 aa, Homo Sapiens
AAVKPPPER

SEQ ID NO: 972145 - protein, 9 aa, Homo Sapiens
AALELLSDE

SEQ ID NO: 972146 - protein, 9 aa, Homo Sapiens
YIFGLTIPC

SEQ ID NO: 972147 - protein, 9 aa, Homo Sapiens
KASKTGSLL

SEQ ID NO: 972148 - protein, 9 aa, Homo Sapiens
EIAKEKLEF

SEQ ID NO: 972149 - protein, 9 aa, Homo Sapiens
SIATENFSA

SEQ ID NO: 972150 - protein, 9 aa, Homo Sapiens
LALRQSVEV

SEQ ID NO: 972151 - protein, 9 aa, Homo Sapiens
SRSLPFELE

SEQ ID NO: 972152 - protein, 9 aa, Homo Sapiens
LLLPFLFPL

SEQ ID NO: 972153 - protein, 9 aa, Homo Sapiens
ADAKKNPAF

SEQ ID NO: 972154 - protein, 9 aa, Homo Sapiens
KEQSEQKTS

SEQ ID NO: 972155 - protein, 9 aa, Homo Sapiens
DWALAEYMV

SEQ ID NO: 972156 - protein, 9 aa, Homo Sapiens
APECVESLH

SEQ ID NO: 972157 - protein, 9 aa, Homo Sapiens
EEDGAFAAE

SEQ ID NO: 972158 - protein, 9 aa, Homo Sapiens
RIPIEDKDF

SEQ ID NO: 972159 - protein, 9 aa, Homo Sapiens
QAQTKVTWY

SEQ ID NO: 972160 - protein, 9 aa, Homo Sapiens
FFIFLLFPI

SEQ ID NO: 972161 - protein, 9 aa, Homo Sapiens
DSTKALPEK

SEQ ID NO: 972162 - protein, 9 aa, Homo Sapiens
FNLVYGATP

SEQ ID NO: 972163 - protein, 9 aa, Homo Sapiens
LSLVWPFSA

SEQ ID NO: 972164 - protein, 9 aa, Homo Sapiens
FPEWLTRSP

SEQ ID NO: 972165 - protein, 9 aa, Homo Sapiens
TRESTSTNA

SEQ ID NO: 972166 - protein, 9 aa, Homo Sapiens
EILRPFLIV

SEQ ID NO: 972167 - protein, 9 aa, Homo Sapiens
LELKFSHKE

SEQ ID NO: 972168 - protein, 9 aa, Homo Sapiens
NTVLEDVDP

SEQ ID NO: 972169 - protein, 9 aa, Homo Sapiens
LDNDSLGSA

SEQ ID NO: 972170 - protein, 9 aa, Homo Sapiens
EKLVRRTTE

SEQ ID NO: 972171 - protein, 9 aa, Homo Sapiens
VPTDQTGRR

SEQ ID NO: 972172 - protein, 9 aa, Homo Sapiens
LNLSNNSFS

SEQ ID NO: 972173 - protein, 9 aa, Homo Sapiens
AACAPECVE

SEQ ID NO: 972174 - protein, 9 aa, Homo Sapiens
AKYSNGDCY

SEQ ID NO: 972175 - protein, 9 aa, Homo Sapiens
VINDSLYKE

SEQ ID NO: 972176 - protein, 9 aa, Homo Sapiens
VGQEEEEDN

SEQ ID NO: 972177 - protein, 9 aa, Homo Sapiens
WAKFILFSC

SEQ ID NO: 972178 - protein, 9 aa, Homo Sapiens
RGVPGEDPS

SEQ ID NO: 972179 - protein, 9 aa, Homo Sapiens
KTLRRENKN

SEQ ID NO: 972180 - protein, 9 aa, Homo Sapiens
LRANADAPA

SEQ ID NO: 972181 - protein, 9 aa, Homo Sapiens
IKPFKRFLC

SEQ ID NO: 972182 - protein, 9 aa, Homo Sapiens
QFYLFAFFS

SEQ ID NO: 972183 - protein, 9 aa, Homo Sapiens
RQNPFNEKP

SEQ ID NO: 972184 - protein, 9 aa, Homo Sapiens
PAEKRVLLT

SEQ ID NO: 972185 - protein, 9 aa, Homo Sapiens
LIYLDPTHL

SEQ ID NO: 972186 - protein, 9 aa, Homo Sapiens
KTFSLYPLH

SEQ ID NO: 972187 - protein, 9 aa, Homo Sapiens
FLRREPVLS

SEQ ID NO: 972188 - protein, 9 aa, Homo Sapiens
EKKEEEETP

SEQ ID NO: 972189 - protein, 9 aa, Homo Sapiens
VGLGAFTKV

SEQ ID NO: 972190 - protein, 9 aa, Homo Sapiens
GVHSWSSQV

SEQ ID NO: 972191 - protein, 9 aa, Homo Sapiens
GIPKLAPGD

SEQ ID NO: 972192 - protein, 9 aa, Homo Sapiens
TLGLNDKKD

SEQ ID NO: 972193 - protein, 9 aa, Homo Sapiens
LLVMRTDRR

SEQ ID NO: 972194 - protein, 9 aa, Homo Sapiens
FVILAISPV

SEQ ID NO: 972195 - protein, 9 aa, Homo Sapiens
FREKEWQAA

SEQ ID NO: 972196 - protein, 9 aa, Homo Sapiens
EDVMGPTLN

SEQ ID NO: 972197 - protein, 9 aa, Homo Sapiens
SFEMKFYEV

SEQ ID NO: 972198 - protein, 9 aa, Homo Sapiens
DSFFRNEID

SEQ ID NO: 972199 - protein, 9 aa, Homo Sapiens
LGEGPSANP

SEQ ID NO: 972200 - protein, 9 aa, Homo Sapiens
ALLDKGADV

SEQ ID NO: 972201 - protein, 9 aa, Homo Sapiens
MIRDWLRVI

SEQ ID NO: 972202 - protein, 9 aa, Homo Sapiens
RAWVWAGLG

SEQ ID NO: 972203 - protein, 9 aa, Homo Sapiens
SFIKASFMS

SEQ ID NO: 972204 - protein, 9 aa, Homo Sapiens
QELRVRAKY

SEQ ID NO: 972205 - protein, 9 aa, Homo Sapiens
YFYFRPVMD

SEQ ID NO: 972206 - protein, 9 aa, Homo Sapiens
YSSLLNQHQ

SEQ ID NO: 972207 - protein, 9 aa, Homo Sapiens
ELNDPNKPT

SEQ ID NO: 972208 - protein, 9 aa, Homo Sapiens
WGFWRWNLV

SEQ ID NO: 972209 - protein, 9 aa, Homo Sapiens
SYRRFEGCT

SEQ ID NO: 972210 - protein, 9 aa, Homo Sapiens
PEAFSQLSI

SEQ ID NO: 972211 - protein, 9 aa, Homo Sapiens
ARQPGGDTS

SEQ ID NO: 972212 - protein, 9 aa, Homo Sapiens
RLTRFYGCE

SEQ ID NO: 972213 - protein, 9 aa, Homo Sapiens
TNETGGENM

SEQ ID NO: 972214 - protein, 9 aa, Homo Sapiens
SVSCPRCVR

SEQ ID NO: 972215 - protein, 9 aa, Homo Sapiens
GIPRLLDSE

SEQ ID NO: 972216 - protein, 9 aa, Homo Sapiens
LLEDTLFSS

SEQ ID NO: 972217 - protein, 9 aa, Homo Sapiens
MIRAMPANG

SEQ ID NO: 972218 - protein, 9 aa, Homo Sapiens
FTQKQQRML

SEQ ID NO: 972219 - protein, 9 aa, Homo Sapiens
LRMRREAET

SEQ ID NO: 972220 - protein, 9 aa, Homo Sapiens
PRSAPATLT

SEQ ID NO: 972221 - protein, 9 aa, Homo Sapiens
RLLRREINV

SEQ ID NO: 972222 - protein, 9 aa, Homo Sapiens
LFDQDESSE

SEQ ID NO: 972223 - protein, 9 aa, Homo Sapiens
VALLIRNMN

SEQ ID NO: 972224 - protein, 9 aa, Homo Sapiens
RTAEPITVT

SEQ ID NO: 972225 - protein, 9 aa, Homo Sapiens
LQKKQVQIK

SEQ ID NO: 972226 - protein, 9 aa, Homo Sapiens
EKAEKKRCE

SEQ ID NO: 972227 - protein, 9 aa, Homo Sapiens
PPSSREDMR

SEQ ID NO: 972228 - protein, 9 aa, Homo Sapiens
TFSLYPLHL

SEQ ID NO: 972229 - protein, 9 aa, Homo Sapiens
SEDYDSYRR

SEQ ID NO: 972230 - protein, 9 aa, Homo Sapiens
PGQVTYTTL

SEQ ID NO: 972231 - protein, 9 aa, Homo Sapiens
LLYSETADG

SEQ ID NO: 972232 - protein, 9 aa, Homo Sapiens
EKYIVHKKF

SEQ ID NO: 972233 - protein, 9 aa, Homo Sapiens
GNGSRDNKK

SEQ ID NO: 972234 - protein, 9 aa, Homo Sapiens
RTLGSKCSD

SEQ ID NO: 972235 - protein, 9 aa, Homo Sapiens
EPGRPVSAG

SEQ ID NO: 972236 - protein, 9 aa, Homo Sapiens
LNCSYTISG

SEQ ID NO: 972237 - protein, 9 aa, Homo Sapiens
SGRVDFDDF

SEQ ID NO: 972238 - protein, 9 aa, Homo Sapiens
NFDKVLAER

SEQ ID NO: 972239 - protein, 9 aa, Homo Sapiens
VEIKFTLRD

SEQ ID NO: 972240 - protein, 9 aa, Homo Sapiens
LLSKLKAGG

SEQ ID NO: 972241 - protein, 9 aa, Homo Sapiens
QWRDLSLMQ

SEQ ID NO: 972242 - protein, 9 aa, Homo Sapiens
QAPFSSKHR

SEQ ID NO: 972243 - protein, 9 aa, Homo Sapiens
DTRLYSCLA

SEQ ID NO: 972244 - protein, 9 aa, Homo Sapiens
DPGTAADPL

SEQ ID NO: 972245 - protein, 9 aa, Homo Sapiens
TFCMLMPKE

SEQ ID NO: 972246 - protein, 9 aa, Homo Sapiens
FHSMVCDEI

SEQ ID NO: 972247 - protein, 9 aa, Homo Sapiens
VERLSQTYF

SEQ ID NO: 972248 - protein, 9 aa, Homo Sapiens
HSIAGRTAG

SEQ ID NO: 972249 - protein, 9 aa, Homo Sapiens
ISRSLPFEL

SEQ ID NO: 972250 - protein, 9 aa, Homo Sapiens
PRACGLRCR

SEQ ID NO: 972251 - protein, 9 aa, Homo Sapiens
PFKRFLCKK

SEQ ID NO: 972252 - protein, 9 aa, Homo Sapiens
QVPLDGGVR

SEQ ID NO: 972253 - protein, 9 aa, Homo Sapiens
ELKVCIHPD

SEQ ID NO: 972254 - protein, 9 aa, Homo Sapiens
GVSLCSSAW

SEQ ID NO: 972255 - protein, 9 aa, Homo Sapiens
DSSEELFDQ

SEQ ID NO: 972256 - protein, 9 aa, Homo Sapiens
DDTTQLSLL

SEQ ID NO: 972257 - protein, 9 aa, Homo Sapiens
PAAESRPPC

SEQ ID NO: 972258 - protein, 9 aa, Homo Sapiens
DPFRAETII

SEQ ID NO: 972259 - protein, 9 aa, Homo Sapiens
PSPDGRRAT

SEQ ID NO: 972260 - protein, 9 aa, Homo Sapiens
TYLNFKSIN

SEQ ID NO: 972261 - protein, 9 aa, Homo Sapiens
SSTRRDSAE

SEQ ID NO: 972262 - protein, 9 aa, Homo Sapiens
LMAPTFLLV

SEQ ID NO: 972263 - protein, 9 aa, Homo Sapiens
AYCLISAKM

SEQ ID NO: 972264 - protein, 9 aa, Homo Sapiens
EKLQLNTKF

SEQ ID NO: 972265 - protein, 9 aa, Homo Sapiens
PSVVGLGSI

SEQ ID NO: 972266 - protein, 9 aa, Homo Sapiens
DERPMGLKG

SEQ ID NO: 972267 - protein, 9 aa, Homo Sapiens
LVYLGIAVS

SEQ ID NO: 972268 - protein, 9 aa, Homo Sapiens
EEQGFDFFF

SEQ ID NO: 972269 - protein, 9 aa, Homo Sapiens
KIDLLIDFL

SEQ ID NO: 972270 - protein, 9 aa, Homo Sapiens
KLKKCKLSN

SEQ ID NO: 972271 - protein, 9 aa, Homo Sapiens
DTAGKEEYS

SEQ ID NO: 972272 - protein, 9 aa, Homo Sapiens
QKNIPREVS

SEQ ID NO: 972273 - protein, 9 aa, Homo Sapiens
FYYNFNKTL

SEQ ID NO: 972274 - protein, 9 aa, Homo Sapiens
RMLSKGLAW

SEQ ID NO: 972275 - protein, 9 aa, Homo Sapiens
SLINKFDLV

SEQ ID NO: 972276 - protein, 9 aa, Homo Sapiens
RSLEAKDVT

SEQ ID NO: 972277 - protein, 9 aa, Homo Sapiens
VQLEILPVP

SEQ ID NO: 972278 - protein, 9 aa, Homo Sapiens
SVISELLER

SEQ ID NO: 972279 - protein, 9 aa, Homo Sapiens
SFPFARGGR

SEQ ID NO: 972280 - protein, 9 aa, Homo Sapiens
GVMTGRAGH

SEQ ID NO: 972281 - protein, 9 aa, Homo Sapiens
KAFSEYSGF

SEQ ID NO: 972282 - protein, 9 aa, Homo Sapiens
DAAALELLS

SEQ ID NO: 972283 - protein, 9 aa, Homo Sapiens
IRELKDKLE

SEQ ID NO: 972284 - protein, 9 aa, Homo Sapiens
NLKQVEYVF

SEQ ID NO: 972285 - protein, 9 aa, Homo Sapiens
FSEYSGFSA

SEQ ID NO: 972286 - protein, 9 aa, Homo Sapiens
DLVIVMKRE

SEQ ID NO: 972287 - protein, 9 aa, Homo Sapiens
TIEKFWREL

SEQ ID NO: 972288 - protein, 9 aa, Homo Sapiens
LIKEKLIFS

SEQ ID NO: 972289 - protein, 9 aa, Homo Sapiens
WALAEYMVF

SEQ ID NO: 972290 - protein, 9 aa, Homo Sapiens
AIKSRPVLR

SEQ ID NO: 972291 - protein, 9 aa, Homo Sapiens
VSRVFWEDG

SEQ ID NO: 972292 - protein, 9 aa, Homo Sapiens
AEVSILPDN

SEQ ID NO: 972293 - protein, 9 aa, Homo Sapiens
CSYTISGLR

SEQ ID NO: 972294 - protein, 9 aa, Homo Sapiens
SIAKDLASR

SEQ ID NO: 972295 - protein, 9 aa, Homo Sapiens
PRPKSPSFG

SEQ ID NO: 972296 - protein, 9 aa, Homo Sapiens
PGYNGKTSI

SEQ ID NO: 972297 - protein, 9 aa, Homo Sapiens
QTRRTAEPI

SEQ ID NO: 972298 - protein, 9 aa, Homo Sapiens
LIFDRVDPC

SEQ ID NO: 972299 - protein, 9 aa, Homo Sapiens
DPAPKKERP

SEQ ID NO: 972300 - protein, 9 aa, Homo Sapiens
FFLLSKFGC

SEQ ID NO: 972301 - protein, 9 aa, Homo Sapiens
KFILFSCLL

SEQ ID NO: 972302 - protein, 9 aa, Homo Sapiens
LKGMRQADI

SEQ ID NO: 972303 - protein, 9 aa, Homo Sapiens
RQSVEVDIN

SEQ ID NO: 972304 - protein, 9 aa, Homo Sapiens
CFKCNRGDP

SEQ ID NO: 972305 - protein, 9 aa, Homo Sapiens
PPLVLLVTV

SEQ ID NO: 972306 - protein, 9 aa, Homo Sapiens
EEKLVRRTT

SEQ ID NO: 972307 - protein, 9 aa, Homo Sapiens
AQRRRCVEN

SEQ ID NO: 972308 - protein, 9 aa, Homo Sapiens
LVESHPNGL

SEQ ID NO: 972309 - protein, 9 aa, Homo Sapiens
GAFYRSYTM

SEQ ID NO: 972310 - protein, 9 aa, Homo Sapiens
SFSNLAPGA

SEQ ID NO: 972311 - protein, 9 aa, Homo Sapiens
THVFFRSVI

SEQ ID NO: 972312 - protein, 9 aa, Homo Sapiens
QDQEQEVCF

SEQ ID NO: 972313 - protein, 9 aa, Homo Sapiens
MDLLYSKTA

SEQ ID NO: 972314 - protein, 9 aa, Homo Sapiens
MKSQAKTTT

SEQ ID NO: 972315 - protein, 9 aa, Homo Sapiens
AVKMRCNST

SEQ ID NO: 972316 - protein, 9 aa, Homo Sapiens
TKLLNGMDE

SEQ ID NO: 972317 - protein, 9 aa, Homo Sapiens
LIYFENEKR

SEQ ID NO: 972318 - protein, 9 aa, Homo Sapiens
LATAAVSAM

SEQ ID NO: 972319 - protein, 9 aa, Homo Sapiens
QIEPSVSST

SEQ ID NO: 972320 - protein, 9 aa, Homo Sapiens
LGFRRQASL

SEQ ID NO: 972321 - protein, 9 aa, Homo Sapiens
VEQTEFIYD

SEQ ID NO: 972322 - protein, 9 aa, Homo Sapiens
VECRPYSIP

SEQ ID NO: 972323 - protein, 9 aa, Homo Sapiens
IEVKSMGKS

SEQ ID NO: 972324 - protein, 9 aa, Homo Sapiens
ECRPYSIPP

SEQ ID NO: 972325 - protein, 9 aa, Homo Sapiens
HVFFRSVIE

SEQ ID NO: 972326 - protein, 9 aa, Homo Sapiens
PSANPPVPV

SEQ ID NO: 972327 - protein, 9 aa, Homo Sapiens
YTCELKYEE

SEQ ID NO: 972328 - protein, 9 aa, Homo Sapiens
SMPTDGAKK

SEQ ID NO: 972329 - protein, 9 aa, Homo Sapiens
DLPLGQQDL

SEQ ID NO: 972330 - protein, 9 aa, Homo Sapiens
LQNDNAKLT

SEQ ID NO: 972331 - protein, 9 aa, Homo Sapiens
ETGGENMTV

SEQ ID NO: 972332 - protein, 9 aa, Homo Sapiens
AYIFYYNFN

SEQ ID NO: 972333 - protein, 9 aa, Homo Sapiens
WQESSEKRL

SEQ ID NO: 972334 - protein, 9 aa, Homo Sapiens
GHSIAGRTA

SEQ ID NO: 972335 - protein, 9 aa, Homo Sapiens
TYNPGSPPM

SEQ ID NO: 972336 - protein, 9 aa, Homo Sapiens
MVETAFANS

SEQ ID NO: 972337 - protein, 9 aa, Homo Sapiens
VDKLFGKEQ

SEQ ID NO: 972338 - protein, 9 aa, Homo Sapiens
FRSVPLAEK

SEQ ID NO: 972339 - protein, 9 aa, Homo Sapiens
NLQILTNPS

SEQ ID NO: 972340 - protein, 9 aa, Homo Sapiens
KEGDLQKEE

SEQ ID NO: 972341 - protein, 9 aa, Homo Sapiens
MIPLKYVPG

SEQ ID NO: 972342 - protein, 9 aa, Homo Sapiens
NHAAELGVS

SEQ ID NO: 972343 - protein, 9 aa, Homo Sapiens
ALLTMPVMV

SEQ ID NO: 972344 - protein, 9 aa, Homo Sapiens
RASADAKKN

SEQ ID NO: 972345 - protein, 9 aa, Homo Sapiens
DETIIKSRN

SEQ ID NO: 972346 - protein, 9 aa, Homo Sapiens
IIFIDQLDA

SEQ ID NO: 972347 - protein, 9 aa, Homo Sapiens
EKFFQCNES

SEQ ID NO: 972348 - protein, 9 aa, Homo Sapiens
ADAHFDDDE

SEQ ID NO: 972349 - protein, 9 aa, Homo Sapiens
MIYLTPTQV

SEQ ID NO: 972350 - protein, 9 aa, Homo Sapiens
TMPVMVLRT

SEQ ID NO: 972351 - protein, 9 aa, Homo Sapiens
VLTLLACLQ

SEQ ID NO: 972352 - protein, 9 aa, Homo Sapiens
AQLFIFLVL

SEQ ID NO: 972353 - protein, 9 aa, Homo Sapiens
PFYPRNYPN

SEQ ID NO: 972354 - protein, 9 aa, Homo Sapiens
PSGQITTLG

SEQ ID NO: 972355 - protein, 9 aa, Homo Sapiens
LLLIQDFVS

SEQ ID NO: 972356 - protein, 9 aa, Homo Sapiens
DHLNGLLRK

SEQ ID NO: 972357 - protein, 9 aa, Homo Sapiens
SDCGHMFFW

SEQ ID NO: 972358 - protein, 9 aa, Homo Sapiens
FLVFPTALT

SEQ ID NO: 972359 - protein, 9 aa, Homo Sapiens
LSPVLYFEQ

SEQ ID NO: 972360 - protein, 9 aa, Homo Sapiens
IFVMFLLMY

SEQ ID NO: 972361 - protein, 9 aa, Homo Sapiens
ISRIKRENT

SEQ ID NO: 972362 - protein, 9 aa, Homo Sapiens
QITKEREES

SEQ ID NO: 972363 - protein, 9 aa, Homo Sapiens
NKEQSEQKT

SEQ ID NO: 972364 - protein, 9 aa, Homo Sapiens
KVCIHPDGV

SEQ ID NO: 972365 - protein, 9 aa, Homo Sapiens
TANHNLKQV

SEQ ID NO: 972366 - protein, 9 aa, Homo Sapiens
LDNYRNLVY

SEQ ID NO: 972367 - protein, 9 aa, Homo Sapiens
VLSFALQMY

SEQ ID NO: 972368 - protein, 9 aa, Homo Sapiens
LEDTLFSSS

SEQ ID NO: 972369 - protein, 9 aa, Homo Sapiens
ETLEEVIAK

SEQ ID NO: 972370 - protein, 9 aa, Homo Sapiens
NLPKDYMIP

SEQ ID NO: 972371 - protein, 9 aa, Homo Sapiens
DAGIKYSVF

SEQ ID NO: 972372 - protein, 9 aa, Homo Sapiens
STTGGKYIR

SEQ ID NO: 972373 - protein, 9 aa, Homo Sapiens
QWNLVCDQK

SEQ ID NO: 972374 - protein, 9 aa, Homo Sapiens
TYNACVSQI

SEQ ID NO: 972375 - protein, 9 aa, Homo Sapiens
KALLNEKVA

SEQ ID NO: 972376 - protein, 9 aa, Homo Sapiens
PRESSYMEI

SEQ ID NO: 972377 - protein, 9 aa, Homo Sapiens
MFVKRNGPD

SEQ ID NO: 972378 - protein, 9 aa, Homo Sapiens
HVVILPNKT

SEQ ID NO: 972379 - protein, 9 aa, Homo Sapiens
EGDLQKEEH

SEQ ID NO: 972380 - protein, 9 aa, Homo Sapiens
HSRGEGSSG

SEQ ID NO: 972381 - protein, 9 aa, Homo Sapiens
DGNLCLLSF

SEQ ID NO: 972382 - protein, 9 aa, Homo Sapiens
SIFFMIIFY

SEQ ID NO: 972383 - protein, 9 aa, Homo Sapiens
AKNRPQVFL

SEQ ID NO: 972384 - protein, 9 aa, Homo Sapiens
QVIILRRNE

SEQ ID NO: 972385 - protein, 9 aa, Homo Sapiens
KNPAFGGKH

SEQ ID NO: 972386 - protein, 9 aa, Homo Sapiens
KVVVEEEDR

SEQ ID NO: 972387 - protein, 9 aa, Homo Sapiens
MSSIPMSRI

SEQ ID NO: 972388 - protein, 9 aa, Homo Sapiens
IRNMNYREH

SEQ ID NO: 972389 - protein, 9 aa, Homo Sapiens
LSSSRTRTS

SEQ ID NO: 972390 - protein, 9 aa, Homo Sapiens
SPEFDPRTP

SEQ ID NO: 972391 - protein, 9 aa, Homo Sapiens
ETHNKIPYE

SEQ ID NO: 972392 - protein, 9 aa, Homo Sapiens
SRSPVSKRR

SEQ ID NO: 972393 - protein, 9 aa, Homo Sapiens
GVYTDDDLP

SEQ ID NO: 972394 - protein, 9 aa, Homo Sapiens
AFAAVNVWQ

SEQ ID NO: 972395 - protein, 9 aa, Homo Sapiens
SLDDSKRSP

SEQ ID NO: 972396 - protein, 9 aa, Homo Sapiens
RATQETTNK

SEQ ID NO: 972397 - protein, 9 aa, Homo Sapiens
VEGTTIYLP

SEQ ID NO: 972398 - protein, 9 aa, Homo Sapiens
ALRENPCFP

SEQ ID NO: 972399 - protein, 9 aa, Homo Sapiens
PVPESRIPN

SEQ ID NO: 972400 - protein, 9 aa, Homo Sapiens
AGTTGKGKV

SEQ ID NO: 972401 - protein, 9 aa, Homo Sapiens
GSCVATEEE

SEQ ID NO: 972402 - protein, 9 aa, Homo Sapiens
DLLIDFLNE

SEQ ID NO: 972403 - protein, 9 aa, Homo Sapiens
TTESFTRES

SEQ ID NO: 972404 - protein, 9 aa, Homo Sapiens
KYHLERQDL

SEQ ID NO: 972405 - protein, 9 aa, Homo Sapiens
LTLPQRFHT

SEQ ID NO: 972406 - protein, 9 aa, Homo Sapiens
NWEPKDDAN

SEQ ID NO: 972407 - protein, 9 aa, Homo Sapiens
SEIKPFQCD

SEQ ID NO: 972408 - protein, 9 aa, Homo Sapiens
VSCSVLEES

SEQ ID NO: 972409 - protein, 9 aa, Homo Sapiens
KAWKHSVGI

SEQ ID NO: 972410 - protein, 9 aa, Homo Sapiens
VENLKKRDM

SEQ ID NO: 972411 - protein, 9 aa, Homo Sapiens
SSLQVFHEK

SEQ ID NO: 972412 - protein, 9 aa, Homo Sapiens
SSFTTDTAL

SEQ ID NO: 972413 - protein, 9 aa, Homo Sapiens
DFFRVLNFN

SEQ ID NO: 972414 - protein, 9 aa, Homo Sapiens
LTRFYGCEN

SEQ ID NO: 972415 - protein, 9 aa, Homo Sapiens
GGVDTTFMT

SEQ ID NO: 972416 - protein, 9 aa, Homo Sapiens
FPKNPVYTF

SEQ ID NO: 972417 - protein, 9 aa, Homo Sapiens
DAYGVNPAR

SEQ ID NO: 972418 - protein, 9 aa, Homo Sapiens
NADPILIFL

SEQ ID NO: 972419 - protein, 9 aa, Homo Sapiens
NLDSFFRNE

SEQ ID NO: 972420 - protein, 9 aa, Homo Sapiens
PPGPQGPLG

SEQ ID NO: 972421 - protein, 9 aa, Homo Sapiens
IMRNLGQAQ

SEQ ID NO: 972422 - protein, 9 aa, Homo Sapiens
ALRQSVEVD

SEQ ID NO: 972423 - protein, 9 aa, Homo Sapiens
WQNPFLQQP

SEQ ID NO: 972424 - protein, 9 aa, Homo Sapiens
IKKEKDQLQ

SEQ ID NO: 972425 - protein, 9 aa, Homo Sapiens
EINVLRQKL

SEQ ID NO: 972426 - protein, 9 aa, Homo Sapiens
SASFLEWEP

SEQ ID NO: 972427 - protein, 9 aa, Homo Sapiens
PCVHVRVGS

SEQ ID NO: 972428 - protein, 9 aa, Homo Sapiens
FYFRPVMDT

SEQ ID NO: 972429 - protein, 9 aa, Homo Sapiens
HSPKFPKKE

SEQ ID NO: 972430 - protein, 9 aa, Homo Sapiens
FAAVLSMIR

SEQ ID NO: 972431 - protein, 9 aa, Homo Sapiens
NTTGIIETK

SEQ ID NO: 972432 - protein, 9 aa, Homo Sapiens
CSSLETHNK

SEQ ID NO: 972433 - protein, 9 aa, Homo Sapiens
LVVNSGDAV

SEQ ID NO: 972434 - protein, 9 aa, Homo Sapiens
ILQKGEIRA

SEQ ID NO: 972435 - protein, 9 aa, Homo Sapiens
ASKGCQLEK

SEQ ID NO: 972436 - protein, 9 aa, Homo Sapiens
VTRDQIKMF

SEQ ID NO: 972437 - protein, 9 aa, Homo Sapiens
DGVSLCSSA

SEQ ID NO: 972438 - protein, 9 aa, Homo Sapiens
PRQSRLFKS

SEQ ID NO: 972439 - protein, 9 aa, Homo Sapiens
LGGHTMLPI

SEQ ID NO: 972440 - protein, 9 aa, Homo Sapiens
LSPTFRPEA

SEQ ID NO: 972441 - protein, 9 aa, Homo Sapiens
FYDADGFHQ

SEQ ID NO: 972442 - protein, 9 aa, Homo Sapiens
LRGTLYHPS

SEQ ID NO: 972443 - protein, 9 aa, Homo Sapiens
PKEWKGGIQ

SEQ ID NO: 972444 - protein, 9 aa, Homo Sapiens
MSRILPNHG

SEQ ID NO: 972445 - protein, 9 aa, Homo Sapiens
RAETLGFGA

SEQ ID NO: 972446 - protein, 9 aa, Homo Sapiens
MKSPLQRTQ

SEQ ID NO: 972447 - protein, 9 aa, Homo Sapiens
VTELCPAAE

SEQ ID NO: 972448 - protein, 9 aa, Homo Sapiens
PESESPMLQ

SEQ ID NO: 972449 - protein, 9 aa, Homo Sapiens
ELSSDLRLQ

SEQ ID NO: 972450 - protein, 9 aa, Homo Sapiens
TAILVGGMF

SEQ ID NO: 972451 - protein, 9 aa, Homo Sapiens
FSNLAPGAF

SEQ ID NO: 972452 - protein, 9 aa, Homo Sapiens
VKKFLEEAE

SEQ ID NO: 972453 - protein, 9 aa, Homo Sapiens
GATLLGAWR

SEQ ID NO: 972454 - protein, 9 aa, Homo Sapiens
DLIYNVSRN

SEQ ID NO: 972455 - protein, 9 aa, Homo Sapiens
EDKRKVLLK

SEQ ID NO: 972456 - protein, 9 aa, Homo Sapiens
ENLDSFFRN

SEQ ID NO: 972457 - protein, 9 aa, Homo Sapiens
AESRPPCNQ

SEQ ID NO: 972458 - protein, 9 aa, Homo Sapiens
RCCSCNISI

SEQ ID NO: 972459 - protein, 9 aa, Homo Sapiens
TKGGNSVIL

SEQ ID NO: 972460 - protein, 9 aa, Homo Sapiens
EPPKLFETV

SEQ ID NO: 972461 - protein, 9 aa, Homo Sapiens
RNKQQRIKK

SEQ ID NO: 972462 - protein, 9 aa, Homo Sapiens
LGSKCSDFL

SEQ ID NO: 972463 - protein, 9 aa, Homo Sapiens
ESYSNDQSP

SEQ ID NO: 972464 - protein, 9 aa, Homo Sapiens
FVWNCTRGI

SEQ ID NO: 972465 - protein, 9 aa, Homo Sapiens
PASDSKTKC

SEQ ID NO: 972466 - protein, 9 aa, Homo Sapiens
CSVFATNNK

SEQ ID NO: 972467 - protein, 9 aa, Homo Sapiens
HALPQSESI

SEQ ID NO: 972468 - protein, 9 aa, Homo Sapiens
GQGRWEFLP

SEQ ID NO: 972469 - protein, 9 aa, Homo Sapiens
RFPYGYPNY

SEQ ID NO: 972470 - protein, 9 aa, Homo Sapiens
MFFLNLFVP

SEQ ID NO: 972471 - protein, 9 aa, Homo Sapiens
NGFILRGSP

SEQ ID NO: 972472 - protein, 9 aa, Homo Sapiens
QTDERLFEC

SEQ ID NO: 972473 - protein, 9 aa, Homo Sapiens
QDYVVTLSE

SEQ ID NO: 972474 - protein, 9 aa, Homo Sapiens
ITCQKWSFT

SEQ ID NO: 972475 - protein, 9 aa, Homo Sapiens
GAYAVSIFF

SEQ ID NO: 972476 - protein, 9 aa, Homo Sapiens
NEESVEGTT

SEQ ID NO: 972477 - protein, 9 aa, Homo Sapiens
QSPTDFMRH

SEQ ID NO: 972478 - protein, 9 aa, Homo Sapiens
KFTEDEKKS

SEQ ID NO: 972479 - protein, 9 aa, Homo Sapiens
SFSAARSRK

SEQ ID NO: 972480 - protein, 9 aa, Homo Sapiens
YDSYRRFEG

SEQ ID NO: 972481 - protein, 9 aa, Homo Sapiens
FVKRNGPDG

SEQ ID NO: 972482 - protein, 9 aa, Homo Sapiens
FMSHLQSLR

SEQ ID NO: 972483 - protein, 9 aa, Homo Sapiens
TDPALRDVL

SEQ ID NO: 972484 - protein, 9 aa, Homo Sapiens
ASDLKASKT

SEQ ID NO: 972485 - protein, 9 aa, Homo Sapiens
REALMAYWK

SEQ ID NO: 972486 - protein, 9 aa, Homo Sapiens
QCVKEVCPI

SEQ ID NO: 972487 - protein, 9 aa, Homo Sapiens
RLSFIKASF

SEQ ID NO: 972488 - protein, 9 aa, Homo Sapiens
IYLEFVLSH

SEQ ID NO: 972489 - protein, 9 aa, Homo Sapiens
SLQPVPESR

SEQ ID NO: 972490 - protein, 9 aa, Homo Sapiens
PKEEQKFPE

SEQ ID NO: 972491 - protein, 9 aa, Homo Sapiens
HAPRTSSSL

SEQ ID NO: 972492 - protein, 9 aa, Homo Sapiens
SSSIDLPRE

SEQ ID NO: 972493 - protein, 9 aa, Homo Sapiens
CDRNSHGQE

SEQ ID NO: 972494 - protein, 9 aa, Homo Sapiens
VRERIFAHN

SEQ ID NO: 972495 - protein, 9 aa, Homo Sapiens
AVYEHVVIL

SEQ ID NO: 972496 - protein, 9 aa, Homo Sapiens
YMREKFFQC

SEQ ID NO: 972497 - protein, 9 aa, Homo Sapiens
SPTFRPEAP

SEQ ID NO: 972498 - protein, 9 aa, Homo Sapiens
TNLRKTGVE

SEQ ID NO: 972499 - protein, 9 aa, Homo Sapiens
KDFINTANW

SEQ ID NO: 972500 - protein, 9 aa, Homo Sapiens
QPLGSFRVV

SEQ ID NO: 972501 - protein, 9 aa, Homo Sapiens
LWWINGQSL

SEQ ID NO: 972502 - protein, 9 aa, Homo Sapiens
SLLSHFAET

SEQ ID NO: 972503 - protein, 9 aa, Homo Sapiens
LDSQRMPMQ

SEQ ID NO: 972504 - protein, 9 aa, Homo Sapiens
LPRVCSYTC

SEQ ID NO: 972505 - protein, 9 aa, Homo Sapiens
AVVMRTGIS

SEQ ID NO: 972506 - protein, 9 aa, Homo Sapiens
QYFSNERIP

SEQ ID NO: 972507 - protein, 9 aa, Homo Sapiens
PLVSSSLLA

SEQ ID NO: 972508 - protein, 9 aa, Homo Sapiens
KFPKKEFQA

SEQ ID NO: 972509 - protein, 9 aa, Homo Sapiens
YAIWKYLYQ

SEQ ID NO: 972510 - protein, 9 aa, Homo Sapiens
SQRTDYQKL

SEQ ID NO: 972511 - protein, 9 aa, Homo Sapiens
LRMLSKGLA

SEQ ID NO: 972512 - protein, 9 aa, Homo Sapiens
SPSVQTIIP

SEQ ID NO: 972513 - protein, 9 aa, Homo Sapiens
NPQVPLDGG

SEQ ID NO: 972514 - protein, 9 aa, Homo Sapiens
AQLIYFENE

SEQ ID NO: 972515 - protein, 9 aa, Homo Sapiens
TLCRVAPPY

SEQ ID NO: 972516 - protein, 9 aa, Homo Sapiens
TMQLTMNIP

SEQ ID NO: 972517 - protein, 9 aa, Homo Sapiens
VANMKAVPA

SEQ ID NO: 972518 - protein, 9 aa, Homo Sapiens
YRLDDGCRV

SEQ ID NO: 972519 - protein, 9 aa, Homo Sapiens
LQVQLAISP

SEQ ID NO: 972520 - protein, 9 aa, Homo Sapiens
STSDHHWCI

SEQ ID NO: 972521 - protein, 9 aa, Homo Sapiens
TNLDFKVSN

SEQ ID NO: 972522 - protein, 9 aa, Homo Sapiens
QLFKLKEHM
